United States Patent 11,369,692 (MATERIALS AND METHODS FOR TREATMENT OF DUCHENNE MUSCULAR DYSTROPHY) - sequence listing, part 25

SEQ ID NO: 821630 - DNA, 22 bp, Artificial Sequence
  chemically synthesized
ctttttaaatataggtatttat

SEQ ID NO: 821631 - DNA, 22 bp, Artificial Sequence
  chemically synthesized
tttaaatataggtatttatagt

SEQ ID NO: 821632 - DNA, 22 bp, Artificial Sequence
  chemically synthesized
ttaaatataggtatttatagtt

SEQ ID NO: 821633 - DNA, 22 bp, Artificial Sequence
  chemically synthesized
taaatataggtatttatagtta

SEQ ID NO: 821634 - DNA, 22 bp, Artificial Sequence
  chemically synthesized
gagtaaaatgtataactataaa

SEQ ID NO: 821635 - DNA, 22 bp, Artificial Sequence
  chemically synthesized
aaatataggtatttatagttat

SEQ ID NO: 821636 - DNA, 22 bp, Artificial Sequence
  chemically synthesized
agagtaaaatgtataactataa

SEQ ID NO: 821637 - DNA, 22 bp, Artificial Sequence
  chemically synthesized
aatataggtatttatagttata

SEQ ID NO: 821638 - DNA, 22 bp, Artificial Sequence
  chemically synthesized
aagcagtgcttagagtaaaatg

SEQ ID NO: 821639 - DNA, 22 bp, Artificial Sequence
  chemically synthesized
atagttatacattttactctaa

SEQ ID NO: 821640 - DNA, 22 bp, Artificial Sequence
  chemically synthesized
tagttatacattttactctaag

SEQ ID NO: 821641 - DNA, 22 bp, Artificial Sequence
  chemically synthesized
tacattttactctaagcactgc

SEQ ID NO: 821642 - DNA, 22 bp, Artificial Sequence
  chemically synthesized
tgggaggaggctgaagcagtgc

SEQ ID NO: 821643 - DNA, 22 bp, Artificial Sequence
  chemically synthesized
atgggaggaggctgaagcagtg

SEQ ID NO: 821644 - DNA, 22 bp, Artificial Sequence
  chemically synthesized
tactctaagcactgcttcagcc

SEQ ID NO: 821645 - DNA, 22 bp, Artificial Sequence
  chemically synthesized
actctaagcactgcttcagcct

SEQ ID NO: 821646 - DNA, 22 bp, Artificial Sequence
  chemically synthesized
ctctaagcactgcttcagcctc

SEQ ID NO: 821647 - DNA, 22 bp, Artificial Sequence
  chemically synthesized
taagcactgcttcagcctcctc

SEQ ID NO: 821648 - DNA, 22 bp, Artificial Sequence
  chemically synthesized
agcactgcttcagcctcctccc

SEQ ID NO: 821649 - DNA, 22 bp, Artificial Sequence
  chemically synthesized
cttcagcctcctcccataagtt

SEQ ID NO: 821650 - DNA, 22 bp, Artificial Sequence
  chemically synthesized
cagcctcctcccataagttttg

SEQ ID NO: 821651 - DNA, 22 bp, Artificial Sequence
  chemically synthesized
agcctcctcccataagttttgg

SEQ ID NO: 821652 - DNA, 22 bp, Artificial Sequence
  chemically synthesized
ctcccataagttttggtatatt

SEQ ID NO: 821653 - DNA, 22 bp, Artificial Sequence
  chemically synthesized
ccataagttttggtatattgta

SEQ ID NO: 821654 - DNA, 22 bp, Artificial Sequence
  chemically synthesized
agataaatggaaataaaaatac

SEQ ID NO: 821655 - DNA, 22 bp, Artificial Sequence
  chemically synthesized
gagataaatggaaataaaaata

SEQ ID NO: 821656 - DNA, 22 bp, Artificial Sequence
  chemically synthesized
tggtatattgtatttttatttc

SEQ ID NO: 821657 - DNA, 22 bp, Artificial Sequence
  chemically synthesized
ggtatattgtatttttatttcc

SEQ ID NO: 821658 - DNA, 22 bp, Artificial Sequence
  chemically synthesized
gtatattgtatttttatttcca

SEQ ID NO: 821659 - DNA, 22 bp, Artificial Sequence
  chemically synthesized
tatttttatttccatttatctc

SEQ ID NO: 821660 - DNA, 22 bp, Artificial Sequence
  chemically synthesized
ttatttccatttatctcaagat

SEQ ID NO: 821661 - DNA, 22 bp, Artificial Sequence
  chemically synthesized
tatttccatttatctcaagata

SEQ ID NO: 821662 - DNA, 22 bp, Artificial Sequence
  chemically synthesized
atttccatttatctcaagatat

SEQ ID NO: 821663 - DNA, 22 bp, Artificial Sequence
  chemically synthesized
tttccatttatctcaagatatt

SEQ ID NO: 821664 - DNA, 22 bp, Artificial Sequence
  chemically synthesized
ccatttatctcaagatattttt

SEQ ID NO: 821665 - DNA, 22 bp, Artificial Sequence
  chemically synthesized
catttatctcaagatatttttg

SEQ ID NO: 821666 - DNA, 22 bp, Artificial Sequence
  chemically synthesized
atctcaagatatttttgtattt

SEQ ID NO: 821667 - DNA, 22 bp, Artificial Sequence
  chemically synthesized
tctcaagatatttttgtatttt

SEQ ID NO: 821668 - DNA, 22 bp, Artificial Sequence
  chemically synthesized
aagatatttttgtattttctta

SEQ ID NO: 821669 - DNA, 22 bp, Artificial Sequence
  chemically synthesized
ttgtattttcttatttcttctt

SEQ ID NO: 821670 - DNA, 22 bp, Artificial Sequence
  chemically synthesized
tgtattttcttatttcttcttt

SEQ ID NO: 821671 - DNA, 22 bp, Artificial Sequence
  chemically synthesized
gtattttcttatttcttctttg

SEQ ID NO: 821672 - DNA, 22 bp, Artificial Sequence
  chemically synthesized
tattttcttatttcttctttgt

SEQ ID NO: 821673 - DNA, 22 bp, Artificial Sequence
  chemically synthesized
aatagccaatgggacaaagaag

SEQ ID NO: 821674 - DNA, 22 bp, Artificial Sequence
  chemically synthesized
aaatagccaatgggacaaagaa

SEQ ID NO: 821675 - DNA, 22 bp, Artificial Sequence
  chemically synthesized
ttaaatagccaatgggacaaag

SEQ ID NO: 821676 - DNA, 22 bp, Artificial Sequence
  chemically synthesized
tcttatttcttctttgtcccat

SEQ ID NO: 821677 - DNA, 22 bp, Artificial Sequence
  chemically synthesized
cttatttcttctttgtcccatt

SEQ ID NO: 821678 - DNA, 22 bp, Artificial Sequence
  chemically synthesized
ttatttcttctttgtcccattg

SEQ ID NO: 821679 - DNA, 22 bp, Artificial Sequence
  chemically synthesized
atttcttctttgtcccattggc

SEQ ID NO: 821680 - DNA, 22 bp, Artificial Sequence
  chemically synthesized
tttcttctttgtcccattggct

SEQ ID NO: 821681 - DNA, 22 bp, Artificial Sequence
  chemically synthesized
cttctttgtcccattggctatt

SEQ ID NO: 821682 - DNA, 22 bp, Artificial Sequence
  chemically synthesized
ttctttgtcccattggctattt

SEQ ID NO: 821683 - DNA, 22 bp, Artificial Sequence
  chemically synthesized
ctttgtcccattggctatttaa

SEQ ID NO: 821684 - DNA, 22 bp, Artificial Sequence
  chemically synthesized
tacaacacactcttaaatagcc

SEQ ID NO: 821685 - DNA, 22 bp, Artificial Sequence
  chemically synthesized
tttgtcccattggctatttaag

SEQ ID NO: 821686 - DNA, 22 bp, Artificial Sequence
  chemically synthesized
tgtcccattggctatttaagag

SEQ ID NO: 821687 - DNA, 22 bp, Artificial Sequence
  chemically synthesized
gtcccattggctatttaagagt

SEQ ID NO: 821688 - DNA, 22 bp, Artificial Sequence
  chemically synthesized
tcccattggctatttaagagtg

SEQ ID NO: 821689 - DNA, 22 bp, Artificial Sequence
  chemically synthesized
gctatttaagagtgtgttgtat

SEQ ID NO: 821690 - DNA, 22 bp, Artificial Sequence
  chemically synthesized
tttaagagtgtgttgtataatt

SEQ ID NO: 821691 - DNA, 22 bp, Artificial Sequence
  chemically synthesized
ataaatatgagaaaattataca

SEQ ID NO: 821692 - DNA, 22 bp, Artificial Sequence
  chemically synthesized
aagagtgtgttgtataattttc

SEQ ID NO: 821693 - DNA, 22 bp, Artificial Sequence
  chemically synthesized
agagtgtgttgtataattttct

SEQ ID NO: 821694 - DNA, 22 bp, Artificial Sequence
  chemically synthesized
ggagttcataaatatgagaaaa

SEQ ID NO: 821695 - DNA, 22 bp, Artificial Sequence
  chemically synthesized
gggagttcataaatatgagaaa

SEQ ID NO: 821696 - DNA, 22 bp, Artificial Sequence
  chemically synthesized
tataattttctcatatttatga

SEQ ID NO: 821697 - DNA, 22 bp, Artificial Sequence
  chemically synthesized
tctcatatttatgaactcccaa

SEQ ID NO: 821698 - DNA, 22 bp, Artificial Sequence
  chemically synthesized
ctcatatttatgaactcccaaa

SEQ ID NO: 821699 - DNA, 22 bp, Artificial Sequence
  chemically synthesized
tcatatttatgaactcccaaat

SEQ ID NO: 821700 - DNA, 22 bp, Artificial Sequence
  chemically synthesized
atatttatgaactcccaaattt

SEQ ID NO: 821701 - DNA, 22 bp, Artificial Sequence
  chemically synthesized
atgaactcccaaatttacatct

SEQ ID NO: 821702 - DNA, 22 bp, Artificial Sequence
  chemically synthesized
aaaatcagtaacagatgtaaat

SEQ ID NO: 821703 - DNA, 22 bp, Artificial Sequence
  chemically synthesized
tgaactcccaaatttacatctg

SEQ ID NO: 821704 - DNA, 22 bp, Artificial Sequence
  chemically synthesized
ccaaatttacatctgttactga

SEQ ID NO: 821705 - DNA, 22 bp, Artificial Sequence
  chemically synthesized
acatctgttactgatttttaat

SEQ ID NO: 821706 - DNA, 22 bp, Artificial Sequence
  chemically synthesized
catctgttactgatttttaatt

SEQ ID NO: 821707 - DNA, 22 bp, Artificial Sequence
  chemically synthesized
tgaccataatggagtacaatta

SEQ ID NO: 821708 - DNA, 22 bp, Artificial Sequence
  chemically synthesized
ttactgatttttaattgtactc

SEQ ID NO: 821709 - DNA, 22 bp, Artificial Sequence
  chemically synthesized
atgaccataatggagtacaatt

SEQ ID NO: 821710 - DNA, 22 bp, Artificial Sequence
  chemically synthesized
tatgaccataatggagtacaat

SEQ ID NO: 821711 - DNA, 22 bp, Artificial Sequence
  chemically synthesized
ctgatttttaattgtactccat

SEQ ID NO: 821712 - DNA, 22 bp, Artificial Sequence
  chemically synthesized
atttttaattgtactccattat

SEQ ID NO: 821713 - DNA, 22 bp, Artificial Sequence
  chemically synthesized
ttaattgtactccattatggtc

SEQ ID NO: 821714 - DNA, 22 bp, Artificial Sequence
  chemically synthesized
taattgtactccattatggtca

SEQ ID NO: 821715 - DNA, 22 bp, Artificial Sequence
  chemically synthesized
aattgtactccattatggtcat

SEQ ID NO: 821716 - DNA, 22 bp, Artificial Sequence
  chemically synthesized
attgtactccattatggtcata

SEQ ID NO: 821717 - DNA, 22 bp, Artificial Sequence
  chemically synthesized
tactccattatggtcataaaat

SEQ ID NO: 821718 - DNA, 22 bp, Artificial Sequence
  chemically synthesized
aaatcatacaatgcagatttta

SEQ ID NO: 821719 - DNA, 22 bp, Artificial Sequence
  chemically synthesized
cattatggtcataaaatctgca

SEQ ID NO: 821720 - DNA, 22 bp, Artificial Sequence
  chemically synthesized
tggtcataaaatctgcattgta

SEQ ID NO: 821721 - DNA, 22 bp, Artificial Sequence
  chemically synthesized
aaagggattaaaatcatacaat

SEQ ID NO: 821722 - DNA, 22 bp, Artificial Sequence
  chemically synthesized
cattcaaagggattaaaatcat

SEQ ID NO: 821723 - DNA, 22 bp, Artificial Sequence
  chemically synthesized
actacattcaaagggattaaaa

SEQ ID NO: 821724 - DNA, 22 bp, Artificial Sequence
  chemically synthesized
cattgtatgattttaatccctt

SEQ ID NO: 821725 - DNA, 22 bp, Artificial Sequence
  chemically synthesized
tatgattttaatccctttgaat

SEQ ID NO: 821726 - DNA, 22 bp, Artificial Sequence
  chemically synthesized
taatccctttgaatgtagtgag

SEQ ID NO: 821727 - DNA, 22 bp, Artificial Sequence
  chemically synthesized
aatccctttgaatgtagtgaga

SEQ ID NO: 821728 - DNA, 22 bp, Artificial Sequence
  chemically synthesized
atccctttgaatgtagtgagac

SEQ ID NO: 821729 - DNA, 22 bp, Artificial Sequence
  chemically synthesized
ggtcataaaataagtctcacta

SEQ ID NO: 821730 - DNA, 22 bp, Artificial Sequence
  chemically synthesized
tgaatgtagtgagacttatttt

SEQ ID NO: 821731 - DNA, 22 bp, Artificial Sequence
  chemically synthesized
gaatgtagtgagacttatttta

SEQ ID NO: 821732 - DNA, 22 bp, Artificial Sequence
  chemically synthesized
aatgtagtgagacttattttat

SEQ ID NO: 821733 - DNA, 22 bp, Artificial Sequence
  chemically synthesized
gggtaggccatatgctaggtca

SEQ ID NO: 821734 - DNA, 22 bp, Artificial Sequence
  chemically synthesized
tagggtaggccatatgctaggt

SEQ ID NO: 821735 - DNA, 22 bp, Artificial Sequence
  chemically synthesized
tctagggtaggccatatgctag

SEQ ID NO: 821736 - DNA, 22 bp, Artificial Sequence
  chemically synthesized
attttatgacctagcatatggc

SEQ ID NO: 821737 - DNA, 22 bp, Artificial Sequence
  chemically synthesized
ttttatgacctagcatatggcc

SEQ ID NO: 821738 - DNA, 22 bp, Artificial Sequence
  chemically synthesized
tatgacctagcatatggcctac

SEQ ID NO: 821739 - DNA, 22 bp, Artificial Sequence
  chemically synthesized
atgacctagcatatggcctacc

SEQ ID NO: 821740 - DNA, 22 bp, Artificial Sequence
  chemically synthesized
tgacctagcatatggcctaccc

SEQ ID NO: 821741 - DNA, 22 bp, Artificial Sequence
  chemically synthesized
tacacgaaatattctctagggt

SEQ ID NO: 821742 - DNA, 22 bp, Artificial Sequence
  chemically synthesized
gcatatggcctaccctagagaa

SEQ ID NO: 821743 - DNA, 22 bp, Artificial Sequence
  chemically synthesized
aactgtacacgaaatattctct

SEQ ID NO: 821744 - DNA, 22 bp, Artificial Sequence
  chemically synthesized
caactgtacacgaaatattctc

SEQ ID NO: 821745 - DNA, 22 bp, Artificial Sequence
  chemically synthesized
tcaactgtacacgaaatattct

SEQ ID NO: 821746 - DNA, 22 bp, Artificial Sequence
  chemically synthesized
ttcaactgtacacgaaatattc

SEQ ID NO: 821747 - DNA, 22 bp, Artificial Sequence
  chemically synthesized
ttttcaactgtacacgaaatat

SEQ ID NO: 821748 - DNA, 22 bp, Artificial Sequence
  chemically synthesized
ccctagagaatatttcgtgtac

SEQ ID NO: 821749 - DNA, 22 bp, Artificial Sequence
  chemically synthesized
attcttttcaactgtacacgaa

SEQ ID NO: 821750 - DNA, 22 bp, Artificial Sequence
  chemically synthesized
gagaatatttcgtgtacagttg

SEQ ID NO: 821751 - DNA, 22 bp, Artificial Sequence
  chemically synthesized
cgtgtacagttgaaaagaatga

SEQ ID NO: 821752 - DNA, 22 bp, Artificial Sequence
  chemically synthesized
gtgtacagttgaaaagaatgag

SEQ ID NO: 821753 - DNA, 22 bp, Artificial Sequence
  chemically synthesized
atccaataatagcagaatactc

SEQ ID NO: 821754 - DNA, 22 bp, Artificial Sequence
  chemically synthesized
catccaataatagcagaatact

SEQ ID NO: 821755 - DNA, 22 bp, Artificial Sequence
  chemically synthesized
aaaagaatgagtattctgctat

SEQ ID NO: 821756 - DNA, 22 bp, Artificial Sequence
  chemically synthesized
tacagcgtttcatccaataata

SEQ ID NO: 821757 - DNA, 22 bp, Artificial Sequence
  chemically synthesized
tgctattattggatgaaacgct

SEQ ID NO: 821758 - DNA, 22 bp, Artificial Sequence
  chemically synthesized
ctattattggatgaaacgctgt

SEQ ID NO: 821759 - DNA, 22 bp, Artificial Sequence
  chemically synthesized
acagatatctatacagcgtttc

SEQ ID NO: 821760 - DNA, 22 bp, Artificial Sequence
  chemically synthesized
ttattggatgaaacgctgtata

SEQ ID NO: 821761 - DNA, 22 bp, Artificial Sequence
  chemically synthesized
ttggatgaaacgctgtatagat

SEQ ID NO: 821762 - DNA, 22 bp, Artificial Sequence
  chemically synthesized
gatgaaacgctgtatagatatc

SEQ ID NO: 821763 - DNA, 22 bp, Artificial Sequence
  chemically synthesized
caagacctaacagatatctata

SEQ ID NO: 821764 - DNA, 22 bp, Artificial Sequence
  chemically synthesized
acaagacctaacagatatctat

SEQ ID NO: 821765 - DNA, 22 bp, Artificial Sequence
  chemically synthesized
taaacttacaagacctaacaga

SEQ ID NO: 821766 - DNA, 22 bp, Artificial Sequence
  chemically synthesized
tatagatatctgttaggtcttg

SEQ ID NO: 821767 - DNA, 22 bp, Artificial Sequence
  chemically synthesized
taaagactataaacttacaaga

SEQ ID NO: 821768 - DNA, 22 bp, Artificial Sequence
  chemically synthesized
ttaggtcttgtaagtttatagt

SEQ ID NO: 821769 - DNA, 22 bp, Artificial Sequence
  chemically synthesized
ggtcttgtaagtttatagtctt

SEQ ID NO: 821770 - DNA, 22 bp, Artificial Sequence
  chemically synthesized
aaaaagactataaagactataa

SEQ ID NO: 821771 - DNA, 22 bp, Artificial Sequence
  chemically synthesized
gaaaaagactataaagactata

SEQ ID NO: 821772 - DNA, 22 bp, Artificial Sequence
  chemically synthesized
gtaagtttatagtctttatagt

SEQ ID NO: 821773 - DNA, 22 bp, Artificial Sequence
  chemically synthesized
taagtttatagtctttatagtc

SEQ ID NO: 821774 - DNA, 22 bp, Artificial Sequence
  chemically synthesized
atagtctttatagtctttttca

SEQ ID NO: 821775 - DNA, 22 bp, Artificial Sequence
  chemically synthesized
tagtctttatagtctttttcaa

SEQ ID NO: 821776 - DNA, 22 bp, Artificial Sequence
  chemically synthesized
acaaggaaatagacacttgaaa

SEQ ID NO: 821777 - DNA, 22 bp, Artificial Sequence
  chemically synthesized
tatagtctttttcaagtgtcta

SEQ ID NO: 821778 - DNA, 22 bp, Artificial Sequence
  chemically synthesized
atagtctttttcaagtgtctat

SEQ ID NO: 821779 - DNA, 22 bp, Artificial Sequence
  chemically synthesized
tagtctttttcaagtgtctatt

SEQ ID NO: 821780 - DNA, 22 bp, Artificial Sequence
  chemically synthesized
ggcaaattaacaaggaaataga

SEQ ID NO: 821781 - DNA, 22 bp, Artificial Sequence
  chemically synthesized
tttcaagtgtctatttccttgt

SEQ ID NO: 821782 - DNA, 22 bp, Artificial Sequence
  chemically synthesized
ttcaagtgtctatttccttgtt

SEQ ID NO: 821783 - DNA, 22 bp, Artificial Sequence
  chemically synthesized
tcaagtgtctatttccttgtta

SEQ ID NO: 821784 - DNA, 22 bp, Artificial Sequence
  chemically synthesized
caagtgtctatttccttgttaa

SEQ ID NO: 821785 - DNA, 22 bp, Artificial Sequence
  chemically synthesized
aagtgtctatttccttgttaat

SEQ ID NO: 821786 - DNA, 22 bp, Artificial Sequence
  chemically synthesized
tttccttgttaatttgcctagt

SEQ ID NO: 821787 - DNA, 22 bp, Artificial Sequence
  chemically synthesized
ccttgttaatttgcctagttct

SEQ ID NO: 821788 - DNA, 22 bp, Artificial Sequence
  chemically synthesized
ataacaggtaaaagaactaggc

SEQ ID NO: 821789 - DNA, 22 bp, Artificial Sequence
  chemically synthesized
cttgttaatttgcctagttctt

SEQ ID NO: 821790 - DNA, 22 bp, Artificial Sequence
  chemically synthesized
aataacaggtaaaagaactagg

SEQ ID NO: 821791 - DNA, 22 bp, Artificial Sequence
  chemically synthesized
taataacaggtaaaagaactag

SEQ ID NO: 821792 - DNA, 22 bp, Artificial Sequence
  chemically synthesized
ttaataacaggtaaaagaacta

SEQ ID NO: 821793 - DNA, 22 bp, Artificial Sequence
  chemically synthesized
gttaatttgcctagttctttta

SEQ ID NO: 821794 - DNA, 22 bp, Artificial Sequence
  chemically synthesized
ttaatttgcctagttcttttac

SEQ ID NO: 821795 - DNA, 22 bp, Artificial Sequence
  chemically synthesized
acttttaataacaggtaaaaga

SEQ ID NO: 821796 - DNA, 22 bp, Artificial Sequence
  chemically synthesized
atttgcctagttcttttacctg

SEQ ID NO: 821797 - DNA, 22 bp, Artificial Sequence
  chemically synthesized
gcctagttcttttacctgttat

SEQ ID NO: 821798 - DNA, 22 bp, Artificial Sequence
  chemically synthesized
cctagttcttttacctgttatt

SEQ ID NO: 821799 - DNA, 22 bp, Artificial Sequence
  chemically synthesized
aacatctcacttttaataacag

SEQ ID NO: 821800 - DNA, 22 bp, Artificial Sequence
  chemically synthesized
caacatctcacttttaataaca

SEQ ID NO: 821801 - DNA, 22 bp, Artificial Sequence
  chemically synthesized
gttcttttacctgttattaaaa

SEQ ID NO: 821802 - DNA, 22 bp, Artificial Sequence
  chemically synthesized
ttttacctgttattaaaagtga

SEQ ID NO: 821803 - DNA, 22 bp, Artificial Sequence
  chemically synthesized
ttacctgttattaaaagtgaga

SEQ ID NO: 821804 - DNA, 22 bp, Artificial Sequence
  chemically synthesized
gagacttcaacatctcactttt

SEQ ID NO: 821805 - DNA, 22 bp, Artificial Sequence
  chemically synthesized
tacctgttattaaaagtgagat

SEQ ID NO: 821806 - DNA, 22 bp, Artificial Sequence
  chemically synthesized
acctgttattaaaagtgagatg

SEQ ID NO: 821807 - DNA, 22 bp, Artificial Sequence
  chemically synthesized
cctgttattaaaagtgagatgt

SEQ ID NO: 821808 - DNA, 22 bp, Artificial Sequence
  chemically synthesized
ttattaaaagtgagatgttgaa

SEQ ID NO: 821809 - DNA, 22 bp, Artificial Sequence
  chemically synthesized
ttaaaagtgagatgttgaagtc

SEQ ID NO: 821810 - DNA, 22 bp, Artificial Sequence
  chemically synthesized
aaagtgagatgttgaagtctcc

SEQ ID NO: 821811 - DNA, 22 bp, Artificial Sequence
  chemically synthesized
aacaaaaatagttggagacttc

SEQ ID NO: 821812 - DNA, 22 bp, Artificial Sequence
  chemically synthesized
ggtaattcaacaaaaatagttg

SEQ ID NO: 821813 - DNA, 22 bp, Artificial Sequence
  chemically synthesized
aagtctccaactatttttgttg

SEQ ID NO: 821814 - DNA, 22 bp, Artificial Sequence
  chemically synthesized
caactatttttgttgaattacc

SEQ ID NO: 821815 - DNA, 22 bp, Artificial Sequence
  chemically synthesized
aaagaagaattaggtaattcaa

SEQ ID NO: 821816 - DNA, 22 bp, Artificial Sequence
  chemically synthesized
aactgaaagaagaattaggtaa

SEQ ID NO: 821817 - DNA, 22 bp, Artificial Sequence
  chemically synthesized
tttttgttgaattacctaattc

SEQ ID NO: 821818 - DNA, 22 bp, Artificial Sequence
  chemically synthesized
ttgttgaattacctaattcttc

SEQ ID NO: 821819 - DNA, 22 bp, Artificial Sequence
  chemically synthesized
actgaactgaaagaagaattag

SEQ ID NO: 821820 - DNA, 22 bp, Artificial Sequence
  chemically synthesized
tgttgaattacctaattcttct

SEQ ID NO: 821821 - DNA, 22 bp, Artificial Sequence
  chemically synthesized
gttgaattacctaattcttctt

SEQ ID NO: 821822 - DNA, 22 bp, Artificial Sequence
  chemically synthesized
ttgaattacctaattcttcttt

SEQ ID NO: 821823 - DNA, 22 bp, Artificial Sequence
  chemically synthesized
aattacctaattcttctttcag

SEQ ID NO: 821824 - DNA, 22 bp, Artificial Sequence
  chemically synthesized
cctaattcttctttcagttcag

SEQ ID NO: 821825 - DNA, 22 bp, Artificial Sequence
  chemically synthesized
attcttctttcagttcagtcag

SEQ ID NO: 821826 - DNA, 22 bp, Artificial Sequence
  chemically synthesized
ttctttcagttcagtcagtttt

SEQ ID NO: 821827 - DNA, 22 bp, Artificial Sequence
  chemically synthesized
ctttcagttcagtcagtttttg

SEQ ID NO: 821828 - DNA, 22 bp, Artificial Sequence
  chemically synthesized
tttcagttcagtcagtttttgc

SEQ ID NO: 821829 - DNA, 22 bp, Artificial Sequence
  chemically synthesized
tcagttcagtcagtttttgctt

SEQ ID NO: 821830 - DNA, 22 bp, Artificial Sequence
  chemically synthesized
aggaaatacagaaagcaaaaac

SEQ ID NO: 821831 - DNA, 22 bp, Artificial Sequence
  chemically synthesized
cagttcagtcagtttttgcttt

SEQ ID NO: 821832 - DNA, 22 bp, Artificial Sequence
  chemically synthesized
agttcagtcagtttttgctttc

SEQ ID NO: 821833 - DNA, 22 bp, Artificial Sequence
  chemically synthesized
agtcagtttttgctttctgtat

SEQ ID NO: 821834 - DNA, 22 bp, Artificial Sequence
  chemically synthesized
ttgctttctgtatttccttaat

SEQ ID NO: 821835 - DNA, 22 bp, Artificial Sequence
  chemically synthesized
tgctttctgtatttccttaata

SEQ ID NO: 821836 - DNA, 22 bp, Artificial Sequence
  chemically synthesized
gctttctgtatttccttaatat

SEQ ID NO: 821837 - DNA, 22 bp, Artificial Sequence
  chemically synthesized
ctttctgtatttccttaatatt

SEQ ID NO: 821838 - DNA, 22 bp, Artificial Sequence
  chemically synthesized
tctgtatttccttaatattttt

SEQ ID NO: 821839 - DNA, 22 bp, Artificial Sequence
  chemically synthesized
ctgtatttccttaatatttttt

SEQ ID NO: 821840 - DNA, 22 bp, Artificial Sequence
  chemically synthesized
tgtatttccttaatattttttc

SEQ ID NO: 821841 - DNA, 22 bp, Artificial Sequence
  chemically synthesized
tatttccttaatattttttctt

SEQ ID NO: 821842 - DNA, 22 bp, Artificial Sequence
  chemically synthesized
ccttaatattttttctttcttt

SEQ ID NO: 821843 - DNA, 22 bp, Artificial Sequence
  chemically synthesized
cttaatattttttctttctttt

SEQ ID NO: 821844 - DNA, 22 bp, Artificial Sequence
  chemically synthesized
aatattttttctttcttttctt

SEQ ID NO: 821845 - DNA, 22 bp, Artificial Sequence
  chemically synthesized
atattttttctttcttttcttt

SEQ ID NO: 821846 - DNA, 22 bp, Artificial Sequence
  chemically synthesized
tttctttcttttctttggattg

SEQ ID NO: 821847 - DNA, 22 bp, Artificial Sequence
  chemically synthesized
ttctttcttttctttggattgg

SEQ ID NO: 821848 - DNA, 22 bp, Artificial Sequence
  chemically synthesized
tctttcttttctttggattgga

SEQ ID NO: 821849 - DNA, 22 bp, Artificial Sequence
  chemically synthesized
ctttcttttctttggattggat

SEQ ID NO: 821850 - DNA, 22 bp, Artificial Sequence
  chemically synthesized
tttcttttctttggattggatt

SEQ ID NO: 821851 - DNA, 22 bp, Artificial Sequence
  chemically synthesized
tcttttctttggattggattat

SEQ ID NO: 821852 - DNA, 22 bp, Artificial Sequence
  chemically synthesized
cttttctttggattggattatc

SEQ ID NO: 821853 - DNA, 22 bp, Artificial Sequence
  chemically synthesized
ttttctttggattggattatcc

SEQ ID NO: 821854 - DNA, 22 bp, Artificial Sequence
  chemically synthesized
ttctttggattggattatccca

SEQ ID NO: 821855 - DNA, 22 bp, Artificial Sequence
  chemically synthesized
aaaataggtaaatgggataatc

SEQ ID NO: 821856 - DNA, 22 bp, Artificial Sequence
  chemically synthesized
tctttggattggattatcccat

SEQ ID NO: 821857 - DNA, 22 bp, Artificial Sequence
  chemically synthesized
gaaaataggtaaatgggataat

SEQ ID NO: 821858 - DNA, 22 bp, Artificial Sequence
  chemically synthesized
ctttggattggattatcccatt

SEQ ID NO: 821859 - DNA, 22 bp, Artificial Sequence
  chemically synthesized
tttggattggattatcccattt

SEQ ID NO: 821860 - DNA, 22 bp, Artificial Sequence
  chemically synthesized
tggattggattatcccatttac

SEQ ID NO: 821861 - DNA, 22 bp, Artificial Sequence
  chemically synthesized
ggattggattatcccatttacc

SEQ ID NO: 821862 - DNA, 22 bp, Artificial Sequence
  chemically synthesized
gattggattatcccatttacct

SEQ ID NO: 821863 - DNA, 22 bp, Artificial Sequence
  chemically synthesized
gattatcccatttacctatttt

SEQ ID NO: 821864 - DNA, 22 bp, Artificial Sequence
  chemically synthesized
tcccatttacctattttcaagt

SEQ ID NO: 821865 - DNA, 22 bp, Artificial Sequence
  chemically synthesized
caaaagaaagaatcagcaaact

SEQ ID NO: 821866 - DNA, 22 bp, Artificial Sequence
  chemically synthesized
acctattttcaagtttgctgat

SEQ ID NO: 821867 - DNA, 22 bp, Artificial Sequence
  chemically synthesized
cctattttcaagtttgctgatt

SEQ ID NO: 821868 - DNA, 22 bp, Artificial Sequence
  chemically synthesized
ttttcaagtttgctgattcttt

SEQ ID NO: 821869 - DNA, 22 bp, Artificial Sequence
  chemically synthesized
aagctgcaaaagaaagaatcag

SEQ ID NO: 821870 - DNA, 22 bp, Artificial Sequence
  chemically synthesized
tcaagtttgctgattctttctt

SEQ ID NO: 821871 - DNA, 22 bp, Artificial Sequence
  chemically synthesized
caagtttgctgattctttcttt

SEQ ID NO: 821872 - DNA, 22 bp, Artificial Sequence
  chemically synthesized
aagtttgctgattctttctttt

SEQ ID NO: 821873 - DNA, 22 bp, Artificial Sequence
  chemically synthesized
gctgattctttcttttgcagct

SEQ ID NO: 821874 - DNA, 22 bp, Artificial Sequence
  chemically synthesized
acgtcagattcaagctgcaaaa

SEQ ID NO: 821875 - DNA, 22 bp, Artificial Sequence
  chemically synthesized
ctgattctttcttttgcagctt

SEQ ID NO: 821876 - DNA, 22 bp, Artificial Sequence
  chemically synthesized
gacgtcagattcaagctgcaaa

SEQ ID NO: 821877 - DNA, 22 bp, Artificial Sequence
  chemically synthesized
attctttcttttgcagcttgaa

SEQ ID NO: 821878 - DNA, 22 bp, Artificial Sequence
  chemically synthesized
acttgacgtcagattcaagctg

SEQ ID NO: 821879 - DNA, 22 bp, Artificial Sequence
  chemically synthesized
cacttgacgtcagattcaagct

SEQ ID NO: 821880 - DNA, 22 bp, Artificial Sequence
  chemically synthesized
tcacttgacgtcagattcaagc

SEQ ID NO: 821881 - DNA, 22 bp, Artificial Sequence
  chemically synthesized
tttcttttgcagcttgaatctg

SEQ ID NO: 821882 - DNA, 22 bp, Artificial Sequence
  chemically synthesized
tcttttgcagcttgaatctgac

SEQ ID NO: 821883 - DNA, 22 bp, Artificial Sequence
  chemically synthesized
cttttgcagcttgaatctgacg

SEQ ID NO: 821884 - DNA, 22 bp, Artificial Sequence
  chemically synthesized
ttttgcagcttgaatctgacgt

SEQ ID NO: 821885 - DNA, 22 bp, Artificial Sequence
  chemically synthesized
aattttcacttgacgtcagatt

SEQ ID NO: 821886 - DNA, 22 bp, Artificial Sequence
  chemically synthesized
ttgcagcttgaatctgacgtca

SEQ ID NO: 821887 - DNA, 22 bp, Artificial Sequence
  chemically synthesized
tgcagcttgaatctgacgtcaa

SEQ ID NO: 821888 - DNA, 22 bp, Artificial Sequence
  chemically synthesized
gcagcttgaatctgacgtcaag

SEQ ID NO: 821889 - DNA, 22 bp, Artificial Sequence
  chemically synthesized
cagcttgaatctgacgtcaagt

SEQ ID NO: 821890 - DNA, 22 bp, Artificial Sequence
  chemically synthesized
aaattaaattttcacttgacgt

SEQ ID NO: 821891 - DNA, 22 bp, Artificial Sequence
  chemically synthesized
gaatctgacgtcaagtgaaaat

SEQ ID NO: 821892 - DNA, 22 bp, Artificial Sequence
  chemically synthesized
aatctgacgtcaagtgaaaatt

SEQ ID NO: 821893 - DNA, 22 bp, Artificial Sequence
  chemically synthesized
acgtcaagtgaaaatttaattt

SEQ ID NO: 821894 - DNA, 22 bp, Artificial Sequence
  chemically synthesized
gaaagcacaataactaaaatta

SEQ ID NO: 821895 - DNA, 22 bp, Artificial Sequence
  chemically synthesized
gagttggaaagcacaataacta

SEQ ID NO: 821896 - DNA, 22 bp, Artificial Sequence
  chemically synthesized
aattttagttattgtgctttcc

SEQ ID NO: 821897 - DNA, 22 bp, Artificial Sequence
  chemically synthesized
attttagttattgtgctttcca

SEQ ID NO: 821898 - DNA, 22 bp, Artificial Sequence
  chemically synthesized
tagttattgtgctttccaactc

SEQ ID NO: 821899 - DNA, 22 bp, Artificial Sequence
  chemically synthesized
agttattgtgctttccaactcc

SEQ ID NO: 821900 - DNA, 22 bp, Artificial Sequence
  chemically synthesized
agtggaatatctggagttggaa

SEQ ID NO: 821901 - DNA, 22 bp, Artificial Sequence
  chemically synthesized
gttattgtgctttccaactcca

SEQ ID NO: 821902 - DNA, 22 bp, Artificial Sequence
  chemically synthesized
ttgtgctttccaactccagata

SEQ ID NO: 821903 - DNA, 22 bp, Artificial Sequence
  chemically synthesized
tgctttccaactccagatattc

SEQ ID NO: 821904 - DNA, 22 bp, Artificial Sequence
  chemically synthesized
tccaactccagatattccactg

SEQ ID NO: 821905 - DNA, 22 bp, Artificial Sequence
  chemically synthesized
taaataagaactcagtggaata

SEQ ID NO: 821906 - DNA, 22 bp, Artificial Sequence
  chemically synthesized
ccaactccagatattccactga

SEQ ID NO: 821907 - DNA, 22 bp, Artificial Sequence
  chemically synthesized
caactccagatattccactgag

SEQ ID NO: 821908 - DNA, 22 bp, Artificial Sequence
  chemically synthesized
cagatattccactgagttctta

SEQ ID NO: 821909 - DNA, 22 bp, Artificial Sequence
  chemically synthesized
cactgagttcttatttacaatt

SEQ ID NO: 821910 - DNA, 22 bp, Artificial Sequence
  chemically synthesized
agttcttatttacaatttctat

SEQ ID NO: 821911 - DNA, 22 bp, Artificial Sequence
  chemically synthesized
ttatttacaatttctatctctt

SEQ ID NO: 821912 - DNA, 22 bp, Artificial Sequence
  chemically synthesized
atttacaatttctatctcttta

SEQ ID NO: 821913 - DNA, 22 bp, Artificial Sequence
  chemically synthesized
tttacaatttctatctctttat

SEQ ID NO: 821914 - DNA, 22 bp, Artificial Sequence
  chemically synthesized
acaatttctatctctttattga

SEQ ID NO: 821915 - DNA, 22 bp, Artificial Sequence
  chemically synthesized
caatttctatctctttattgat

SEQ ID NO: 821916 - DNA, 22 bp, Artificial Sequence
  chemically synthesized
acaaatagagagtatcaataaa

SEQ ID NO: 821917 - DNA, 22 bp, Artificial Sequence
  chemically synthesized
aacaaatagagagtatcaataa

SEQ ID NO: 821918 - DNA, 22 bp, Artificial Sequence
  chemically synthesized
ctatctctttattgatactctc

SEQ ID NO: 821919 - DNA, 22 bp, Artificial Sequence
  chemically synthesized
tcttaacaaatagagagtatca

SEQ ID NO: 821920 - DNA, 22 bp, Artificial Sequence
  chemically synthesized
tatctctttattgatactctct

SEQ ID NO: 821921 - DNA, 22 bp, Artificial Sequence
  chemically synthesized
gtcttaacaaatagagagtatc

SEQ ID NO: 821922 - DNA, 22 bp, Artificial Sequence
  chemically synthesized
tctctttattgatactctctat

SEQ ID NO: 821923 - DNA, 22 bp, Artificial Sequence
  chemically synthesized
tttattgatactctctatttgt

SEQ ID NO: 821924 - DNA, 22 bp, Artificial Sequence
  chemically synthesized
tattgatactctctatttgtta

SEQ ID NO: 821925 - DNA, 22 bp, Artificial Sequence
  chemically synthesized
attgatactctctatttgttaa

SEQ ID NO: 821926 - DNA, 22 bp, Artificial Sequence
  chemically synthesized
ttgatactctctatttgttaag

SEQ ID NO: 821927 - DNA, 22 bp, Artificial Sequence
  chemically synthesized
atactctctatttgttaagaca

SEQ ID NO: 821928 - DNA, 22 bp, Artificial Sequence
  chemically synthesized
gaagcccatgtgcttgtcttaa

SEQ ID NO: 821929 - DNA, 22 bp, Artificial Sequence
  chemically synthesized
tctatttgttaagacaagcaca

SEQ ID NO: 821930 - DNA, 22 bp, Artificial Sequence
  chemically synthesized
tatttgttaagacaagcacatg

SEQ ID NO: 821931 - DNA, 22 bp, Artificial Sequence
  chemically synthesized
tttgttaagacaagcacatggg

SEQ ID NO: 821932 - DNA, 22 bp, Artificial Sequence
  chemically synthesized
cgggatctagaagcccatgtgc

SEQ ID NO: 821933 - DNA, 22 bp, Artificial Sequence
  chemically synthesized
gcgggatctagaagcccatgtg

SEQ ID NO: 821934 - DNA, 22 bp, Artificial Sequence
  chemically synthesized
gttaagacaagcacatgggctt

SEQ ID NO: 821935 - DNA, 22 bp, Artificial Sequence
  chemically synthesized
ttaagacaagcacatgggcttc

SEQ ID NO: 821936 - DNA, 22 bp, Artificial Sequence
  chemically synthesized
ttgcgggatctagaagcccatg

SEQ ID NO: 821937 - DNA, 22 bp, Artificial Sequence
  chemically synthesized
agacaagcacatgggcttctag

SEQ ID NO: 821938 - DNA, 22 bp, Artificial Sequence
  chemically synthesized
acatgttcttgcgggatctaga

SEQ ID NO: 821939 - DNA, 22 bp, Artificial Sequence
  chemically synthesized
tgacatgttcttgcgggatcta

SEQ ID NO: 821940 - DNA, 22 bp, Artificial Sequence
  chemically synthesized
gcaacctctgacatgttcttgc

SEQ ID NO: 821941 - DNA, 22 bp, Artificial Sequence
  chemically synthesized
ggcaacctctgacatgttcttg

SEQ ID NO: 821942 - DNA, 22 bp, Artificial Sequence
  chemically synthesized
tggcaacctctgacatgttctt

SEQ ID NO: 821943 - DNA, 22 bp, Artificial Sequence
  chemically synthesized
ctagatcccgcaagaacatgtc

SEQ ID NO: 821944 - DNA, 22 bp, Artificial Sequence
  chemically synthesized
tagatcccgcaagaacatgtca

SEQ ID NO: 821945 - DNA, 22 bp, Artificial Sequence
  chemically synthesized
gatcccgcaagaacatgtcaga

SEQ ID NO: 821946 - DNA, 22 bp, Artificial Sequence
  chemically synthesized
gagaatgaggtgtccatagggg

SEQ ID NO: 821947 - DNA, 22 bp, Artificial Sequence
  chemically synthesized
tggagaatgaggtgtccatagg

SEQ ID NO: 821948 - DNA, 22 bp, Artificial Sequence
  chemically synthesized
ccaaaatcccctatggacacct

SEQ ID NO: 821949 - DNA, 22 bp, Artificial Sequence
  chemically synthesized
cagtgaagctctggagaatgag

SEQ ID NO: 821950 - DNA, 22 bp, Artificial Sequence
  chemically synthesized
ccagtgaagctctggagaatga

SEQ ID NO: 821951 - DNA, 22 bp, Artificial Sequence
  chemically synthesized
tggacacctcattctccagagc

SEQ ID NO: 821952 - DNA, 22 bp, Artificial Sequence
  chemically synthesized
gagaaaaacttccagtgaagct

SEQ ID NO: 821953 - DNA, 22 bp, Artificial Sequence
  chemically synthesized
attctccagagcttcactggaa

SEQ ID NO: 821954 - DNA, 22 bp, Artificial Sequence
  chemically synthesized
tccagagcttcactggaagttt

SEQ ID NO: 821955 - DNA, 22 bp, Artificial Sequence
  chemically synthesized
cagagcttcactggaagttttt

SEQ ID NO: 821956 - DNA, 22 bp, Artificial Sequence
  chemically synthesized
cactggaagtttttctccagac

SEQ ID NO: 821957 - DNA, 22 bp, Artificial Sequence
  chemically synthesized
agataaacataggtctggagaa

SEQ ID NO: 821958 - DNA, 22 bp, Artificial Sequence
  chemically synthesized
actggaagtttttctccagacc

SEQ ID NO: 821959 - DNA, 22 bp, Artificial Sequence
  chemically synthesized
gttgagataaacataggtctgg

SEQ ID NO: 821960 - DNA, 22 bp, Artificial Sequence
  chemically synthesized
gaagtttttctccagacctatg

SEQ ID NO: 821961 - DNA, 22 bp, Artificial Sequence
  chemically synthesized
ttctccagacctatgtttatct

SEQ ID NO: 821962 - DNA, 22 bp, Artificial Sequence
  chemically synthesized
tgatgctagttgagataaacat

SEQ ID NO: 821963 - DNA, 22 bp, Artificial Sequence
  chemically synthesized
tctccagacctatgtttatctc

SEQ ID NO: 821964 - DNA, 22 bp, Artificial Sequence
  chemically synthesized
ctccagacctatgtttatctca

SEQ ID NO: 821965 - DNA, 22 bp, Artificial Sequence
  chemically synthesized
tccagacctatgtttatctcaa

SEQ ID NO: 821966 - DNA, 22 bp, Artificial Sequence
  chemically synthesized
cagacctatgtttatctcaact

SEQ ID NO: 821967 - DNA, 22 bp, Artificial Sequence
  chemically synthesized
aggctgtgatgctagttgagat

SEQ ID NO: 821968 - DNA, 22 bp, Artificial Sequence
  chemically synthesized
ctaaggctgtgatgctagttga

SEQ ID NO: 821969 - DNA, 22 bp, Artificial Sequence
  chemically synthesized
tgtttatctcaactagcatcac

SEQ ID NO: 821970 - DNA, 22 bp, Artificial Sequence
  chemically synthesized
atctcaactagcatcacagcct

SEQ ID NO: 821971 - DNA, 22 bp, Artificial Sequence
  chemically synthesized
tctcaactagcatcacagcctt

SEQ ID NO: 821972 - DNA, 22 bp, Artificial Sequence
  chemically synthesized
acataacaggttcctaaggctg

SEQ ID NO: 821973 - DNA, 22 bp, Artificial Sequence
  chemically synthesized
aactagcatcacagccttagga

SEQ ID NO: 821974 - DNA, 22 bp, Artificial Sequence
  chemically synthesized
aacataacaggttcctaaggct

SEQ ID NO: 821975 - DNA, 22 bp, Artificial Sequence
  chemically synthesized
taacataacaggttcctaaggc

SEQ ID NO: 821976 - DNA, 22 bp, Artificial Sequence
  chemically synthesized
tttaacataacaggttcctaag

SEQ ID NO: 821977 - DNA, 22 bp, Artificial Sequence
  chemically synthesized
gcatcacagccttaggaacctg

SEQ ID NO: 821978 - DNA, 22 bp, Artificial Sequence
  chemically synthesized
gcagcaattctttaacataaca

SEQ ID NO: 821979 - DNA, 22 bp, Artificial Sequence
  chemically synthesized
aggaacctgttatgttaaagaa

SEQ ID NO: 821980 - DNA, 22 bp, Artificial Sequence
  chemically synthesized
ggaacctgttatgttaaagaat

SEQ ID NO: 821981 - DNA, 22 bp, Artificial Sequence
  chemically synthesized
ttatgttaaagaattgctgcta

SEQ ID NO: 821982 - DNA, 22 bp, Artificial Sequence
  chemically synthesized
gtccaaaccaattagcagcaat

SEQ ID NO: 821983 - DNA, 22 bp, Artificial Sequence
  chemically synthesized
tgttaaagaattgctgctaatt

SEQ ID NO: 821984 - DNA, 22 bp, Artificial Sequence
  chemically synthesized
aagaattgctgctaattggttt

SEQ ID NO: 821985 - DNA, 22 bp, Artificial Sequence
  chemically synthesized
cagggtgttggtccaaaccaat

SEQ ID NO: 821986 - DNA, 22 bp, Artificial Sequence
  chemically synthesized
gctccagggtgttggtccaaac

SEQ ID NO: 821987 - DNA, 22 bp, Artificial Sequence
  chemically synthesized
ctgctaattggtttggaccaac

SEQ ID NO: 821988 - DNA, 22 bp, Artificial Sequence
  chemically synthesized
ctaattggtttggaccaacacc

SEQ ID NO: 821989 - DNA, 22 bp, Artificial Sequence
  chemically synthesized
attggtttggaccaacaccctg

SEQ ID NO: 821990 - DNA, 22 bp, Artificial Sequence
  chemically synthesized
gtttggaccaacaccctggagc

SEQ ID NO: 821991 - DNA, 22 bp, Artificial Sequence
  chemically synthesized
ggaaaagccctagctccagggt

SEQ ID NO: 821992 - DNA, 22 bp, Artificial Sequence
  chemically synthesized
taggaaaagccctagctccagg

SEQ ID NO: 821993 - DNA, 22 bp, Artificial Sequence
  chemically synthesized
ctaggaaaagccctagctccag

SEQ ID NO: 821994 - DNA, 22 bp, Artificial Sequence
  chemically synthesized
ggaccaacaccctggagctagg

SEQ ID NO: 821995 - DNA, 22 bp, Artificial Sequence
  chemically synthesized
tctaggaaaagccctagctcca

SEQ ID NO: 821996 - DNA, 22 bp, Artificial Sequence
  chemically synthesized
gaccaacaccctggagctaggg

SEQ ID NO: 821997 - DNA, 22 bp, Artificial Sequence
  chemically synthesized
gagataactttctaggaaaagc

SEQ ID NO: 821998 - DNA, 22 bp, Artificial Sequence
  chemically synthesized
agagataactttctaggaaaag

SEQ ID NO: 821999 - DNA, 22 bp, Artificial Sequence
  chemically synthesized
gagctagggcttttcctagaaa

SEQ ID NO: 822000 - DNA, 22 bp, Artificial Sequence
  chemically synthesized
gggcttttcctagaaagttatc

SEQ ID NO: 822001 - DNA, 22 bp, Artificial Sequence
  chemically synthesized
gcccgacttagagataactttc

SEQ ID NO: 822002 - DNA, 22 bp, Artificial Sequence
  chemically synthesized
ggcccgacttagagataacttt

SEQ ID NO: 822003 - DNA, 22 bp, Artificial Sequence
  chemically synthesized
tttggcccgacttagagataac

SEQ ID NO: 822004 - DNA, 22 bp, Artificial Sequence
  chemically synthesized
atttggcccgacttagagataa

SEQ ID NO: 822005 - DNA, 22 bp, Artificial Sequence
  chemically synthesized
ttcctagaaagttatctctaag

SEQ ID NO: 822006 - DNA, 22 bp, Artificial Sequence
  chemically synthesized
tatttggcccgacttagagata

SEQ ID NO: 822007 - DNA, 22 bp, Artificial Sequence
  chemically synthesized
tcctagaaagttatctctaagt

SEQ ID NO: 822008 - DNA, 22 bp, Artificial Sequence
  chemically synthesized
cctagaaagttatctctaagtc

SEQ ID NO: 822009 - DNA, 22 bp, Artificial Sequence
  chemically synthesized
ctagaaagttatctctaagtcg

SEQ ID NO: 822010 - DNA, 22 bp, Artificial Sequence
  chemically synthesized
cctttatttggcccgacttaga

SEQ ID NO: 822011 - DNA, 22 bp, Artificial Sequence
  chemically synthesized
gcctttatttggcccgacttag

SEQ ID NO: 822012 - DNA, 22 bp, Artificial Sequence
  chemically synthesized
gaaagttatctctaagtcgggc

SEQ ID NO: 822013 - DNA, 22 bp, Artificial Sequence
  chemically synthesized
tctctaagtcgggccaaataaa

SEQ ID NO: 822014 - DNA, 22 bp, Artificial Sequence
  chemically synthesized
taagtcgggccaaataaaggca

SEQ ID NO: 822015 - DNA, 22 bp, Artificial Sequence
  chemically synthesized
tatacatggccttgcctttatt

SEQ ID NO: 822016 - DNA, 22 bp, Artificial Sequence
  chemically synthesized
agtcgggccaaataaaggcaag

SEQ ID NO: 822017 - DNA, 22 bp, Artificial Sequence
  chemically synthesized
gaataaacctatatacatggcc

SEQ ID NO: 822018 - DNA, 22 bp, Artificial Sequence
  chemically synthesized
cctggaataaacctatatacat

SEQ ID NO: 822019 - DNA, 22 bp, Artificial Sequence
  chemically synthesized
cagctccctggaataaacctat

SEQ ID NO: 822020 - DNA, 22 bp, Artificial Sequence
  chemically synthesized
gcagctccctggaataaaccta

SEQ ID NO: 822021 - DNA, 22 bp, Artificial Sequence
  chemically synthesized
tcttgcagctccctggaataaa

SEQ ID NO: 822022 - DNA, 22 bp, Artificial Sequence
  chemically synthesized
acctatcttgcagctccctgga

SEQ ID NO: 822023 - DNA, 22 bp, Artificial Sequence
  chemically synthesized
gacctatcttgcagctccctgg

SEQ ID NO: 822024 - DNA, 22 bp, Artificial Sequence
  chemically synthesized
tttgacctatcttgcagctccc

SEQ ID NO: 822025 - DNA, 22 bp, Artificial Sequence
  chemically synthesized
attccagggagctgcaagatag

SEQ ID NO: 822026 - DNA, 22 bp, Artificial Sequence
  chemically synthesized
ccactgtttgacctatcttgca

SEQ ID NO: 822027 - DNA, 22 bp, Artificial Sequence
  chemically synthesized
ttccagggagctgcaagatagg

SEQ ID NO: 822028 - DNA, 22 bp, Artificial Sequence
  chemically synthesized
gccactgtttgacctatcttgc

SEQ ID NO: 822029 - DNA, 22 bp, Artificial Sequence
  chemically synthesized
cagggagctgcaagataggtca

SEQ ID NO: 822030 - DNA, 22 bp, Artificial Sequence
  chemically synthesized
caagaaccttgccactgtttga

SEQ ID NO: 822031 - DNA, 22 bp, Artificial Sequence
  chemically synthesized
caagataggtcaaacagtggca

SEQ ID NO: 822032 - DNA, 22 bp, Artificial Sequence
  chemically synthesized
ttccaagaaccttgccactgtt

SEQ ID NO: 822033 - DNA, 22 bp, Artificial Sequence
  chemically synthesized
attccaagaaccttgccactgt

SEQ ID NO: 822034 - DNA, 22 bp, Artificial Sequence
  chemically synthesized
tattccaagaaccttgccactg

SEQ ID NO: 822035 - DNA, 22 bp, Artificial Sequence
  chemically synthesized
aaaaaggccaattttattccaa

SEQ ID NO: 822036 - DNA, 22 bp, Artificial Sequence
  chemically synthesized
caaaaaggccaattttattcca

SEQ ID NO: 822037 - DNA, 22 bp, Artificial Sequence
  chemically synthesized
ttcaaaaaggccaattttattc

SEQ ID NO: 822038 - DNA, 22 bp, Artificial Sequence
  chemically synthesized
gaattcttcaaaaaggccaatt

SEQ ID NO: 822039 - DNA, 22 bp, Artificial Sequence
  chemically synthesized
ttggaataaaattggccttttt

SEQ ID NO: 822040 - DNA, 22 bp, Artificial Sequence
  chemically synthesized
ggaataaaattggcctttttga

SEQ ID NO: 822041 - DNA, 22 bp, Artificial Sequence
  chemically synthesized
gaataaaattggcctttttgaa

SEQ ID NO: 822042 - DNA, 22 bp, Artificial Sequence
  chemically synthesized
gcctttttgaagaattccaatc

SEQ ID NO: 822043 - DNA, 22 bp, Artificial Sequence
  chemically synthesized
tttgaagaattccaatcctggt

SEQ ID NO: 822044 - DNA, 22 bp, Artificial Sequence
  chemically synthesized
ttgaagaattccaatcctggtc

SEQ ID NO: 822045 - DNA, 22 bp, Artificial Sequence
  chemically synthesized
tgaagaattccaatcctggtct

SEQ ID NO: 822046 - DNA, 22 bp, Artificial Sequence
  chemically synthesized
gaagaattccaatcctggtcta

SEQ ID NO: 822047 - DNA, 22 bp, Artificial Sequence
  chemically synthesized
aagaattccaatcctggtctac

SEQ ID NO: 822048 - DNA, 22 bp, Artificial Sequence
  chemically synthesized
gccaccagagagtgtagaccag

SEQ ID NO: 822049 - DNA, 22 bp, Artificial Sequence
  chemically synthesized
agccaccagagagtgtagacca

SEQ ID NO: 822050 - DNA, 22 bp, Artificial Sequence
  chemically synthesized
tagccaccagagagtgtagacc

SEQ ID NO: 822051 - DNA, 22 bp, Artificial Sequence
  chemically synthesized
ttagccaccagagagtgtagac

SEQ ID NO: 822052 - DNA, 22 bp, Artificial Sequence
  chemically synthesized
caatcctggtctacactctctg

SEQ ID NO: 822053 - DNA, 22 bp, Artificial Sequence
  chemically synthesized
gcagccttttagccaccagaga

SEQ ID NO: 822054 - DNA, 22 bp, Artificial Sequence
  chemically synthesized
gtctacactctctggtggctaa

SEQ ID NO: 822055 - DNA, 22 bp, Artificial Sequence
  chemically synthesized
cactctctggtggctaaaaggc

SEQ ID NO: 822056 - DNA, 22 bp, Artificial Sequence
  chemically synthesized
tgaaaactagcagccttttagc

SEQ ID NO: 822057 - DNA, 22 bp, Artificial Sequence
  chemically synthesized
tctggtggctaaaaggctgcta

SEQ ID NO: 822058 - DNA, 22 bp, Artificial Sequence
  chemically synthesized
tggtggctaaaaggctgctagt

SEQ ID NO: 822059 - DNA, 22 bp, Artificial Sequence
  chemically synthesized
gtggctaaaaggctgctagttt

SEQ ID NO: 822060 - DNA, 22 bp, Artificial Sequence
  chemically synthesized
caaccataatagctgtgaaaac

SEQ ID NO: 822061 - DNA, 22 bp, Artificial Sequence
  chemically synthesized
aaaggctgctagttttcacagc

SEQ ID NO: 822062 - DNA, 22 bp, Artificial Sequence
  chemically synthesized
gcaaccataatagctgtgaaaa

SEQ ID NO: 822063 - DNA, 22 bp, Artificial Sequence
  chemically synthesized
ctagttttcacagctattatgg

SEQ ID NO: 822064 - DNA, 22 bp, Artificial Sequence
  chemically synthesized
gttttcacagctattatggttg

SEQ ID NO: 822065 - DNA, 22 bp, Artificial Sequence
  chemically synthesized
tcacagctattatggttgcaag

SEQ ID NO: 822066 - DNA, 22 bp, Artificial Sequence
  chemically synthesized
aaaatcagtagccttgcaacca

SEQ ID NO: 822067 - DNA, 22 bp, Artificial Sequence
  chemically synthesized
cacagctattatggttgcaagg

SEQ ID NO: 822068 - DNA, 22 bp, Artificial Sequence
  chemically synthesized
gaaaatcagtagccttgcaacc

SEQ ID NO: 822069 - DNA, 22 bp, Artificial Sequence
  chemically synthesized
acagctattatggttgcaaggc

SEQ ID NO: 822070 - DNA, 22 bp, Artificial Sequence
  chemically synthesized
ttatggttgcaaggctactgat

SEQ ID NO: 822071 - DNA, 22 bp, Artificial Sequence
  chemically synthesized
tggttgcaaggctactgatttt

SEQ ID NO: 822072 - DNA, 22 bp, Artificial Sequence
  chemically synthesized
cacagtagccttgaaaatcagt

SEQ ID NO: 822073 - DNA, 22 bp, Artificial Sequence
  chemically synthesized
caaggctactgattttcaaggc

SEQ ID NO: 822074 - DNA, 22 bp, Artificial Sequence
  chemically synthesized
ccagctccacagtagccttgaa

SEQ ID NO: 822075 - DNA, 22 bp, Artificial Sequence
  chemically synthesized
tcccagctccacagtagccttg

SEQ ID NO: 822076 - DNA, 22 bp, Artificial Sequence
  chemically synthesized
ctcccagctccacagtagcctt

SEQ ID NO: 822077 - DNA, 22 bp, Artificial Sequence
  chemically synthesized
tctcccagctccacagtagcct

SEQ ID NO: 822078 - DNA, 22 bp, Artificial Sequence
  chemically synthesized
ctgattttcaaggctactgtgg

SEQ ID NO: 822079 - DNA, 22 bp, Artificial Sequence
  chemically synthesized
attttcaaggctactgtggagc

SEQ ID NO: 822080 - DNA, 22 bp, Artificial Sequence
  chemically synthesized
tcaaggctactgtggagctggg

SEQ ID NO: 822081 - DNA, 22 bp, Artificial Sequence
  chemically synthesized
ccgtcactttctcccagctcca

SEQ ID NO: 822082 - DNA, 22 bp, Artificial Sequence
  chemically synthesized
caaggctactgtggagctggga

SEQ ID NO: 822083 - DNA, 22 bp, Artificial Sequence
  chemically synthesized
cccgtcactttctcccagctcc

SEQ ID NO: 822084 - DNA, 22 bp, Artificial Sequence
  chemically synthesized
aaggctactgtggagctgggag

SEQ ID NO: 822085 - DNA, 22 bp, Artificial Sequence
  chemically synthesized
tcccgtcactttctcccagctc

SEQ ID NO: 822086 - DNA, 22 bp, Artificial Sequence
  chemically synthesized
gcctttcccgtcactttctccc

SEQ ID NO: 822087 - DNA, 22 bp, Artificial Sequence
  chemically synthesized
ctgtggagctgggagaaagtga

SEQ ID NO: 822088 - DNA, 22 bp, Artificial Sequence
  chemically synthesized
tggagctgggagaaagtgacgg

SEQ ID NO: 822089 - DNA, 22 bp, Artificial Sequence
  chemically synthesized
agttggcctttcccgtcacttt

SEQ ID NO: 822090 - DNA, 22 bp, Artificial Sequence
  chemically synthesized
aagttggcctttcccgtcactt

SEQ ID NO: 822091 - DNA, 22 bp, Artificial Sequence
  chemically synthesized
taagttggcctttcccgtcact

SEQ ID NO: 822092 - DNA, 22 bp, Artificial Sequence
  chemically synthesized
ttaagttggcctttcccgtcac

SEQ ID NO: 822093 - DNA, 22 bp, Artificial Sequence
  chemically synthesized
tttaagttggcctttcccgtca

SEQ ID NO: 822094 - DNA, 22 bp, Artificial Sequence
  chemically synthesized
ggagaaagtgacgggaaaggcc

SEQ ID NO: 822095 - DNA, 22 bp, Artificial Sequence
  chemically synthesized
aggttttttaagttggcctttc

SEQ ID NO: 822096 - DNA, 22 bp, Artificial Sequence
  chemically synthesized
gaggttttttaagttggccttt

SEQ ID NO: 822097 - DNA, 22 bp, Artificial Sequence
  chemically synthesized
aataaaaatggcaaagtttgag

SEQ ID NO: 822098 - DNA, 22 bp, Artificial Sequence
  chemically synthesized
tcaataaaaatggcaaagtttg

SEQ ID NO: 822099 - DNA, 22 bp, Artificial Sequence
  chemically synthesized
aaaaaacctcaaactttgccat

SEQ ID NO: 822100 - DNA, 22 bp, Artificial Sequence
  chemically synthesized
aaaaacctcaaactttgccatt

SEQ ID NO: 822101 - DNA, 22 bp, Artificial Sequence
  chemically synthesized
actctcaataaaaatggcaaag

SEQ ID NO: 822102 - DNA, 22 bp, Artificial Sequence
  chemically synthesized
aaatgctgactctcaataaaaa

SEQ ID NO: 822103 - DNA, 22 bp, Artificial Sequence
  chemically synthesized
aaactttgccatttttattgag

SEQ ID NO: 822104 - DNA, 22 bp, Artificial Sequence
  chemically synthesized
gaaatgctgactctcaataaaa

SEQ ID NO: 822105 - DNA, 22 bp, Artificial Sequence
  chemically synthesized
tgaaatgctgactctcaataaa

SEQ ID NO: 822106 - DNA, 22 bp, Artificial Sequence
  chemically synthesized
ttgaaatgctgactctcaataa

SEQ ID NO: 822107 - DNA, 22 bp, Artificial Sequence
  chemically synthesized
tgccatttttattgagagtcag

SEQ ID NO: 822108 - DNA, 22 bp, Artificial Sequence
  chemically synthesized
gccatttttattgagagtcagc

SEQ ID NO: 822109 - DNA, 22 bp, Artificial Sequence
  chemically synthesized
ccatttttattgagagtcagca

SEQ ID NO: 822110 - DNA, 22 bp, Artificial Sequence
  chemically synthesized
gcaacaatttttgaaatgctga

SEQ ID NO: 822111 - DNA, 22 bp, Artificial Sequence
  chemically synthesized
ttattgagagtcagcatttcaa

SEQ ID NO: 822112 - DNA, 22 bp, Artificial Sequence
  chemically synthesized
tattgagagtcagcatttcaaa

SEQ ID NO: 822113 - DNA, 22 bp, Artificial Sequence
  chemically synthesized
attgagagtcagcatttcaaaa

SEQ ID NO: 822114 - DNA, 22 bp, Artificial Sequence
  chemically synthesized
ttgagagtcagcatttcaaaaa

SEQ ID NO: 822115 - DNA, 22 bp, Artificial Sequence
  chemically synthesized
agagtcagcatttcaaaaattg

SEQ ID NO: 822116 - DNA, 22 bp, Artificial Sequence
  chemically synthesized
accaaaggctggcaacaatttt

SEQ ID NO: 822117 - DNA, 22 bp, Artificial Sequence
  chemically synthesized
ggaattaaccaaaggctggcaa

SEQ ID NO: 822118 - DNA, 22 bp, Artificial Sequence
  chemically synthesized
caaaaattgttgccagcctttg

SEQ ID NO: 822119 - DNA, 22 bp, Artificial Sequence
  chemically synthesized
aaaaattgttgccagcctttgg

SEQ ID NO: 822120 - DNA, 22 bp, Artificial Sequence
  chemically synthesized
aaccctgggaattaaccaaagg

SEQ ID NO: 822121 - DNA, 22 bp, Artificial Sequence
  chemically synthesized
tgaaccctgggaattaaccaaa

SEQ ID NO: 822122 - DNA, 22 bp, Artificial Sequence
  chemically synthesized
ctgaaccctgggaattaaccaa

SEQ ID NO: 822123 - DNA, 22 bp, Artificial Sequence
  chemically synthesized
tctgaaccctgggaattaacca

SEQ ID NO: 822124 - DNA, 22 bp, Artificial Sequence
  chemically synthesized
ttgccagcctttggttaattcc

SEQ ID NO: 822125 - DNA, 22 bp, Artificial Sequence
  chemically synthesized
ttctgaaccctgggaattaacc

SEQ ID NO: 822126 - DNA, 22 bp, Artificial Sequence
  chemically synthesized
ccagcctttggttaattcccag

SEQ ID NO: 822127 - DNA, 22 bp, Artificial Sequence
  chemically synthesized
tggttaattcccagggttcaga

SEQ ID NO: 822128 - DNA, 22 bp, Artificial Sequence
  chemically synthesized
ggttaattcccagggttcagaa

SEQ ID NO: 822129 - DNA, 22 bp, Artificial Sequence
  chemically synthesized
gttaattcccagggttcagaaa

SEQ ID NO: 822130 - DNA, 22 bp, Artificial Sequence
  chemically synthesized
gccccacatcgccttttctgaa

SEQ ID NO: 822131 - DNA, 22 bp, Artificial Sequence
  chemically synthesized
attcccagggttcagaaaaggc

SEQ ID NO: 822132 - DNA, 22 bp, Artificial Sequence
  chemically synthesized
ccagggttcagaaaaggcgatg

SEQ ID NO: 822133 - DNA, 22 bp, Artificial Sequence
  chemically synthesized
agaaaaggcgatgtggggccag

SEQ ID NO: 822134 - DNA, 22 bp, Artificial Sequence
  chemically synthesized
ggatacaggcgtgagccaacat

SEQ ID NO: 822135 - DNA, 22 bp, Artificial Sequence
  chemically synthesized
ccaaagtgctgggatacaggcg

SEQ ID NO: 822136 - DNA, 22 bp, Artificial Sequence
  chemically synthesized
agcctcccaaagtgctgggata

SEQ ID NO: 822137 - DNA, 22 bp, Artificial Sequence
  chemically synthesized
gctcacgcctgtatcccagcac

SEQ ID NO: 822138 - DNA, 22 bp, Artificial Sequence
  chemically synthesized
cagcctcccaaagtgctgggat

SEQ ID NO: 822139 - DNA, 22 bp, Artificial Sequence
  chemically synthesized
acgcctgtatcccagcactttg

SEQ ID NO: 822140 - DNA, 22 bp, Artificial Sequence
  chemically synthesized
cgcccacttcagcctcccaaag

SEQ ID NO: 822141 - DNA, 22 bp, Artificial Sequence
  chemically synthesized
tatcccagcactttgggaggct

SEQ ID NO: 822142 - DNA, 22 bp, Artificial Sequence
  chemically synthesized
gagtgttccgcccacttcagcc

SEQ ID NO: 822143 - DNA, 22 bp, Artificial Sequence
  chemically synthesized
acctcgagtgttccgcccactt

SEQ ID NO: 822144 - DNA, 22 bp, Artificial Sequence
  chemically synthesized
tgggaggctgaagtgggcggaa

SEQ ID NO: 822145 - DNA, 22 bp, Artificial Sequence
  chemically synthesized
gggaggctgaagtgggcggaac

SEQ ID NO: 822146 - DNA, 22 bp, Artificial Sequence
  chemically synthesized
ctgacctcgagtgttccgccca

SEQ ID NO: 822147 - DNA, 22 bp, Artificial Sequence
  chemically synthesized
ggaggctgaagtgggcggaaca

SEQ ID NO: 822148 - DNA, 22 bp, Artificial Sequence
  chemically synthesized
aaactcctgacctcgagtgttc

SEQ ID NO: 822149 - DNA, 22 bp, Artificial Sequence
  chemically synthesized
aagtgggcggaacactcgaggt

SEQ ID NO: 822150 - DNA, 22 bp, Artificial Sequence
  chemically synthesized
gtctcaaactcctgacctcgag

SEQ ID NO: 822151 - DNA, 22 bp, Artificial Sequence
  chemically synthesized
gccaggctggtctcaaactcct

SEQ ID NO: 822152 - DNA, 22 bp, Artificial Sequence
  chemically synthesized
tgttggccaggctggtctcaaa

SEQ ID NO: 822153 - DNA, 22 bp, Artificial Sequence
  chemically synthesized
gaggtcaggagtttgagaccag

SEQ ID NO: 822154 - DNA, 22 bp, Artificial Sequence
  chemically synthesized
actatgttggccaggctggtct

SEQ ID NO: 822155 - DNA, 22 bp, Artificial Sequence
  chemically synthesized
cactatgttggccaggctggtc

SEQ ID NO: 822156 - DNA, 22 bp, Artificial Sequence
  chemically synthesized
gagaccagcctggccaacatag

SEQ ID NO: 822157 - DNA, 22 bp, Artificial Sequence
  chemically synthesized
agaccagcctggccaacatagt

SEQ ID NO: 822158 - DNA, 22 bp, Artificial Sequence
  chemically synthesized
gtagagacagggtttcactatg

SEQ ID NO: 822159 - DNA, 22 bp, Artificial Sequence
  chemically synthesized
agtagagacagggtttcactat

SEQ ID NO: 822160 - DNA, 22 bp, Artificial Sequence
  chemically synthesized
tagtagagacagggtttcacta

SEQ ID NO: 822161 - DNA, 22 bp, Artificial Sequence
  chemically synthesized
ttagtagagacagggtttcact

SEQ ID NO: 822162 - DNA, 22 bp, Artificial Sequence
  chemically synthesized
gccaacatagtgaaaccctgtc

SEQ ID NO: 822163 - DNA, 22 bp, Artificial Sequence
  chemically synthesized
gtgtttttagtagagacagggt

SEQ ID NO: 822164 - DNA, 22 bp, Artificial Sequence
  chemically synthesized
tcgtgtttttagtagagacagg

SEQ ID NO: 822165 - DNA, 22 bp, Artificial Sequence
  chemically synthesized
ctcgtgtttttagtagagacag

SEQ ID NO: 822166 - DNA, 22 bp, Artificial Sequence
  chemically synthesized
tttctcgtgtttttagtagaga

SEQ ID NO: 822167 - DNA, 22 bp, Artificial Sequence
  chemically synthesized
tctctactaaaaacacgagaaa

SEQ ID NO: 822168 - DNA, 22 bp, Artificial Sequence
  chemically synthesized
caccacgcccaactatttctcg

SEQ ID NO: 822169 - DNA, 22 bp, Artificial Sequence
  chemically synthesized
tactaaaaacacgagaaatagt

SEQ ID NO: 822170 - DNA, 22 bp, Artificial Sequence
  chemically synthesized
ctaaaaacacgagaaatagttg

SEQ ID NO: 822171 - DNA, 22 bp, Artificial Sequence
  chemically synthesized
aaaacacgagaaatagttgggc

SEQ ID NO: 822172 - DNA, 22 bp, Artificial Sequence
  chemically synthesized
caggcacattccaccacgccca

SEQ ID NO: 822173 - DNA, 22 bp, Artificial Sequence
  chemically synthesized
ggcgtggtggaatgtgcctgta

SEQ ID NO: 822174 - DNA, 22 bp, Artificial Sequence
  chemically synthesized
agcatcccaagtagatggaact

SEQ ID NO: 822175 - DNA, 22 bp, Artificial Sequence
  chemically synthesized
tcagcatcccaagtagatggaa

SEQ ID NO: 822176 - DNA, 22 bp, Artificial Sequence
  chemically synthesized
tagttccatctacttgggatgc

SEQ ID NO: 822177 - DNA, 22 bp, Artificial Sequence
  chemically synthesized
catctacttgggatgctgagag

SEQ ID NO: 822178 - DNA, 22 bp, Artificial Sequence
  chemically synthesized
tgatcaagtgagtctctcagca

SEQ ID NO: 822179 - DNA, 22 bp, Artificial Sequence
  chemically synthesized
ctgtgatcaagtgagtctctca

SEQ ID NO: 822180 - DNA, 22 bp, Artificial Sequence
  chemically synthesized
cttgggatgctgagagactcac

SEQ ID NO: 822181 - DNA, 22 bp, Artificial Sequence
  chemically synthesized
gggatgctgagagactcacttg

SEQ ID NO: 822182 - DNA, 22 bp, Artificial Sequence
  chemically synthesized
ggatgctgagagactcacttga

SEQ ID NO: 822183 - DNA, 22 bp, Artificial Sequence
  chemically synthesized
cacctcctgtgatcaagtgagt

SEQ ID NO: 822184 - DNA, 22 bp, Artificial Sequence
  chemically synthesized
agagactcacttgatcacagga

SEQ ID NO: 822185 - DNA, 22 bp, Artificial Sequence
  chemically synthesized
gtgcaacctccacctcctgtga

SEQ ID NO: 822186 - DNA, 22 bp, Artificial Sequence
  chemically synthesized
agtgcaacctccacctcctgtg

SEQ ID NO: 822187 - DNA, 22 bp, Artificial Sequence
  chemically synthesized
gcttagtgcaacctccacctcc

SEQ ID NO: 822188 - DNA, 22 bp, Artificial Sequence
  chemically synthesized
acttgatcacaggaggtggagg

SEQ ID NO: 822189 - DNA, 22 bp, Artificial Sequence
  chemically synthesized
ggcttagtgcaacctccacctc

SEQ ID NO: 822190 - DNA, 22 bp, Artificial Sequence
  chemically synthesized
gatcacaggaggtggaggttgc

SEQ ID NO: 822191 - DNA, 22 bp, Artificial Sequence
  chemically synthesized
atcacaggaggtggaggttgca

SEQ ID NO: 822192 - DNA, 22 bp, Artificial Sequence
  chemically synthesized
gagtgcagtggcatgatcttgg

SEQ ID NO: 822193 - DNA, 22 bp, Artificial Sequence
  chemically synthesized
cactaagccaagatcatgccac

SEQ ID NO: 822194 - DNA, 22 bp, Artificial Sequence
  chemically synthesized
agccaagatcatgccactgcac

SEQ ID NO: 822195 - DNA, 22 bp, Artificial Sequence
  chemically synthesized
tcacccaggctggagtgcagtg

SEQ ID NO: 822196 - DNA, 22 bp, Artificial Sequence
  chemically synthesized
tgtcacccaggctggagtgcag

SEQ ID NO: 822197 - DNA, 22 bp, Artificial Sequence
  chemically synthesized
actctgtcacccaggctggagt

SEQ ID NO: 822198 - DNA, 22 bp, Artificial Sequence
  chemically synthesized
cactccagcctgggtgacagag

SEQ ID NO: 822199 - DNA, 22 bp, Artificial Sequence
  chemically synthesized
agatggagtctcactctgtcac

SEQ ID NO: 822200 - DNA, 22 bp, Artificial Sequence
  chemically synthesized
gagatggagtctcactctgtca

SEQ ID NO: 822201 - DNA, 22 bp, Artificial Sequence
  chemically synthesized
tgagatggagtctcactctgtc

SEQ ID NO: 822202 - DNA, 22 bp, Artificial Sequence
  chemically synthesized
ttgagatggagtctcactctgt

SEQ ID NO: 822203 - DNA, 22 bp, Artificial Sequence
  chemically synthesized
cagcctgggtgacagagtgaga

SEQ ID NO: 822204 - DNA, 22 bp, Artificial Sequence
  chemically synthesized
tttgagatggagtctcactctg

SEQ ID NO: 822205 - DNA, 22 bp, Artificial Sequence
  chemically synthesized
ttttgagatggagtctcactct

SEQ ID NO: 822206 - DNA, 22 bp, Artificial Sequence
  chemically synthesized
tttttgagatggagtctcactc

SEQ ID NO: 822207 - DNA, 22 bp, Artificial Sequence
  chemically synthesized
ctttttttgagatggagtctca

SEQ ID NO: 822208 - DNA, 22 bp, Artificial Sequence
  chemically synthesized
cctttttttgagatggagtctc

SEQ ID NO: 822209 - DNA, 22 bp, Artificial Sequence
  chemically synthesized
ggtgacagagtgagactccatc

SEQ ID NO: 822210 - DNA, 22 bp, Artificial Sequence
  chemically synthesized
tcctttttttgagatggagtct

SEQ ID NO: 822211 - DNA, 22 bp, Artificial Sequence
  chemically synthesized
ttcctttttttgagatggagtc

SEQ ID NO: 822212 - DNA, 22 bp, Artificial Sequence
  chemically synthesized
tttcctttttttgagatggagt

SEQ ID NO: 822213 - DNA, 22 bp, Artificial Sequence
  chemically synthesized
ttttcctttttttgagatggag

SEQ ID NO: 822214 - DNA, 22 bp, Artificial Sequence
  chemically synthesized
tttttcctttttttgagatgga

SEQ ID NO: 822215 - DNA, 22 bp, Artificial Sequence
  chemically synthesized
tttttttcctttttttgagatg

SEQ ID NO: 822216 - DNA, 22 bp, Artificial Sequence
  chemically synthesized
ctttttttcctttttttgagat

SEQ ID NO: 822217 - DNA, 22 bp, Artificial Sequence
  chemically synthesized
tctttttttcctttttttgaga

SEQ ID NO: 822218 - DNA, 22 bp, Artificial Sequence
  chemically synthesized
tttctttttttcctttttttga

SEQ ID NO: 822219 - DNA, 22 bp, Artificial Sequence
  chemically synthesized
ctttctttttttcctttttttg

SEQ ID NO: 822220 - DNA, 22 bp, Artificial Sequence
  chemically synthesized
tctttctttttttccttttttt

SEQ ID NO: 822221 - DNA, 22 bp, Artificial Sequence
  chemically synthesized
ttctttctttttttcctttttt

SEQ ID NO: 822222 - DNA, 22 bp, Artificial Sequence
  chemically synthesized
ttttctttctttttttcctttt

SEQ ID NO: 822223 - DNA, 22 bp, Artificial Sequence
  chemically synthesized
cttttctttctttttttccttt

SEQ ID NO: 822224 - DNA, 22 bp, Artificial Sequence
  chemically synthesized
tcttttctttctttttttcctt

SEQ ID NO: 822225 - DNA, 22 bp, Artificial Sequence
  chemically synthesized
catctcaaaaaaaggaaaaaaa

SEQ ID NO: 822226 - DNA, 22 bp, Artificial Sequence
  chemically synthesized
ttcttttctttctttttttcct

SEQ ID NO: 822227 - DNA, 22 bp, Artificial Sequence
  chemically synthesized
tttcttttctttctttttttcc

SEQ ID NO: 822228 - DNA, 22 bp, Artificial Sequence
  chemically synthesized
ttttcttttctttctttttttc

SEQ ID NO: 822229 - DNA, 22 bp, Artificial Sequence
  chemically synthesized
ttttttcttttctttctttttt

SEQ ID NO: 822230 - DNA, 22 bp, Artificial Sequence
  chemically synthesized
cttttttcttttctttcttttt

SEQ ID NO: 822231 - DNA, 22 bp, Artificial Sequence
  chemically synthesized
aaaaaaaggaaaaaaagaaaga

SEQ ID NO: 822232 - DNA, 22 bp, Artificial Sequence
  chemically synthesized
tcttttttcttttctttctttt

SEQ ID NO: 822233 - DNA, 22 bp, Artificial Sequence
  chemically synthesized
ttcttttttcttttctttcttt

SEQ ID NO: 822234 - DNA, 22 bp, Artificial Sequence
  chemically synthesized
gaaatcatcttttcttttttct

SEQ ID NO: 822235 - DNA, 22 bp, Artificial Sequence
  chemically synthesized
cgaaatcatcttttcttttttc

SEQ ID NO: 822236 - DNA, 22 bp, Artificial Sequence
  chemically synthesized
tcgaaatcatcttttctttttt

SEQ ID NO: 822237 - DNA, 22 bp, Artificial Sequence
  chemically synthesized
aaaaaattttcgaaatcatctt

SEQ ID NO: 822238 - DNA, 22 bp, Artificial Sequence
  chemically synthesized
ctcaaaaaattttcgaaatcat

SEQ ID NO: 822239 - DNA, 22 bp, Artificial Sequence
  chemically synthesized
ctcctcaaaaaattttcgaaat

SEQ ID NO: 822240 - DNA, 22 bp, Artificial Sequence
  chemically synthesized
tgtaaatctgctcctcaaaaaa

SEQ ID NO: 822241 - DNA, 22 bp, Artificial Sequence
  chemically synthesized
cgaaaattttttgaggagcaga

SEQ ID NO: 822242 - DNA, 22 bp, Artificial Sequence
  chemically synthesized
gaaaattttttgaggagcagat

SEQ ID NO: 822243 - DNA, 22 bp, Artificial Sequence
  chemically synthesized
tttgaggagcagatttacacag

SEQ ID NO: 822244 - DNA, 22 bp, Artificial Sequence
  chemically synthesized
ttgaggagcagatttacacagt

SEQ ID NO: 822245 - DNA, 22 bp, Artificial Sequence
  chemically synthesized
tgaggagcagatttacacagtt

SEQ ID NO: 822246 - DNA, 22 bp, Artificial Sequence
  chemically synthesized
gaggagcagatttacacagtta

SEQ ID NO: 822247 - DNA, 22 bp, Artificial Sequence
  chemically synthesized
aggagcagatttacacagttac

SEQ ID NO: 822248 - DNA, 22 bp, Artificial Sequence
  chemically synthesized
aaaatataatgtggtaactgtg

SEQ ID NO: 822249 - DNA, 22 bp, Artificial Sequence
  chemically synthesized
gaaaatataatgtggtaactgt

SEQ ID NO: 822250 - DNA, 22 bp, Artificial Sequence
  chemically synthesized
acacagttaccacattatattt

SEQ ID NO: 822251 - DNA, 22 bp, Artificial Sequence
  chemically synthesized
tcccgtgcttgaaaatataatg

SEQ ID NO: 822252 - DNA, 22 bp, Artificial Sequence
  chemically synthesized
cacagttaccacattatatttt

SEQ ID NO: 822253 - DNA, 22 bp, Artificial Sequence
  chemically synthesized
atcccgtgcttgaaaatataat

SEQ ID NO: 822254 - DNA, 22 bp, Artificial Sequence
  chemically synthesized
acttatcccgtgcttgaaaata

SEQ ID NO: 822255 - DNA, 22 bp, Artificial Sequence
  chemically synthesized
aacttatcccgtgcttgaaaat

SEQ ID NO: 822256 - DNA, 22 bp, Artificial Sequence
  chemically synthesized
ccacattatattttcaagcacg

SEQ ID NO: 822257 - DNA, 22 bp, Artificial Sequence
  chemically synthesized
acaatttaacttatcccgtgct

SEQ ID NO: 822258 - DNA, 22 bp, Artificial Sequence
  chemically synthesized
cacaatttaacttatcccgtgc

SEQ ID NO: 822259 - DNA, 22 bp, Artificial Sequence
  chemically synthesized
tcacaatttaacttatcccgtg

SEQ ID NO: 822260 - DNA, 22 bp, Artificial Sequence
  chemically synthesized
ttcacaatttaacttatcccgt

SEQ ID NO: 822261 - DNA, 22 bp, Artificial Sequence
  chemically synthesized
tattttcaagcacgggataagt

SEQ ID NO: 822262 - DNA, 22 bp, Artificial Sequence
  chemically synthesized
cttttcacaatttaacttatcc

SEQ ID NO: 822263 - DNA, 22 bp, Artificial Sequence
  chemically synthesized
gcttttcacaatttaacttatc

SEQ ID NO: 822264 - DNA, 22 bp, Artificial Sequence
  chemically synthesized
tcaagcacgggataagttaaat

SEQ ID NO: 822265 - DNA, 22 bp, Artificial Sequence
  chemically synthesized
caagcacgggataagttaaatt

SEQ ID NO: 822266 - DNA, 22 bp, Artificial Sequence
  chemically synthesized
aagcacgggataagttaaattg

SEQ ID NO: 822267 - DNA, 22 bp, Artificial Sequence
  chemically synthesized
gtttgcttttcacaatttaact

SEQ ID NO: 822268 - DNA, 22 bp, Artificial Sequence
  chemically synthesized
tagtttgcttttcacaatttaa

SEQ ID NO: 822269 - DNA, 22 bp, Artificial Sequence
  chemically synthesized
tctagtttgcttttcacaattt

SEQ ID NO: 822270 - DNA, 22 bp, Artificial Sequence
  chemically synthesized
ctctagtttgcttttcacaatt

SEQ ID NO: 822271 - DNA, 22 bp, Artificial Sequence
  chemically synthesized
tctctagtttgcttttcacaat

SEQ ID NO: 822272 - DNA, 22 bp, Artificial Sequence
  chemically synthesized
taccatattttctctagtttgc

SEQ ID NO: 822273 - DNA, 22 bp, Artificial Sequence
  chemically synthesized
aattgtgaaaagcaaactagag

SEQ ID NO: 822274 - DNA, 22 bp, Artificial Sequence
  chemically synthesized
attgtaccatattttctctagt

SEQ ID NO: 822275 - DNA, 22 bp, Artificial Sequence
  chemically synthesized
gattgtaccatattttctctag

SEQ ID NO: 822276 - DNA, 22 bp, Artificial Sequence
  chemically synthesized
tgaaaagcaaactagagaaaat

SEQ ID NO: 822277 - DNA, 22 bp, Artificial Sequence
  chemically synthesized
tgattgtaccatattttctcta

SEQ ID NO: 822278 - DNA, 22 bp, Artificial Sequence
  chemically synthesized
tgctttgattgtaccatatttt

SEQ ID NO: 822279 - DNA, 22 bp, Artificial Sequence
  chemically synthesized
atgctttgattgtaccatattt

SEQ ID NO: 822280 - DNA, 22 bp, Artificial Sequence
  chemically synthesized
tatgctttgattgtaccatatt

SEQ ID NO: 822281 - DNA, 22 bp, Artificial Sequence
  chemically synthesized
gagaaaatatggtacaatcaaa

SEQ ID NO: 822282 - DNA, 22 bp, Artificial Sequence
  chemically synthesized
aataactttatgctttgattgt

SEQ ID NO: 822283 - DNA, 22 bp, Artificial Sequence
  chemically synthesized
gaataactttatgctttgattg

SEQ ID NO: 822284 - DNA, 22 bp, Artificial Sequence
  chemically synthesized
atgcagagtcaccaagccttga

SEQ ID NO: 822285 - DNA, 22 bp, Artificial Sequence
  chemically synthesized
aatgcagagtcaccaagccttg

SEQ ID NO: 822286 - DNA, 22 bp, Artificial Sequence
  chemically synthesized
ttcaaggcttggtgactctgca

SEQ ID NO: 822287 - DNA, 22 bp, Artificial Sequence
  chemically synthesized
tataaatatttaatgcagagtc

SEQ ID NO: 822288 - DNA, 22 bp, Artificial Sequence
  chemically synthesized
aaggcttggtgactctgcatta

SEQ ID NO: 822289 - DNA, 22 bp, Artificial Sequence
  chemically synthesized
tattatataaatatttaatgca

SEQ ID NO: 822290 - DNA, 22 bp, Artificial Sequence
  chemically synthesized
ttatattatataaatatttaat

SEQ ID NO: 822291 - DNA, 22 bp, Artificial Sequence
  chemically synthesized
ggtgactctgcattaaatattt

SEQ ID NO: 822292 - DNA, 22 bp, Artificial Sequence
  chemically synthesized
gtgactctgcattaaatattta

SEQ ID NO: 822293 - DNA, 22 bp, Artificial Sequence
  chemically synthesized
tgcattaaatatttatataata

SEQ ID NO: 822294 - DNA, 22 bp, Artificial Sequence
  chemically synthesized
cattaaatatttatataatata

SEQ ID NO: 822295 - DNA, 22 bp, Artificial Sequence
  chemically synthesized
cccaggtaactattatattata

SEQ ID NO: 822296 - DNA, 22 bp, Artificial Sequence
  chemically synthesized
ccccaggtaactattatattat

SEQ ID NO: 822297 - DNA, 22 bp, Artificial Sequence
  chemically synthesized
aatatttatataatataatagt

SEQ ID NO: 822298 - DNA, 22 bp, Artificial Sequence
  chemically synthesized
gtttccccaggtaactattata

SEQ ID NO: 822299 - DNA, 22 bp, Artificial Sequence
  chemically synthesized
atataatataatagttacctgg

SEQ ID NO: 822300 - DNA, 22 bp, Artificial Sequence
  chemically synthesized
tataatataatagttacctggg

SEQ ID NO: 822301 - DNA, 22 bp, Artificial Sequence
  chemically synthesized
cctggggaaactagcccattac

SEQ ID NO: 822302 - DNA, 22 bp, Artificial Sequence
  chemically synthesized
atagaacacaggtagtaatggg

SEQ ID NO: 822303 - DNA, 22 bp, Artificial Sequence
  chemically synthesized
gggaaactagcccattactacc

SEQ ID NO: 822304 - DNA, 22 bp, Artificial Sequence
  chemically synthesized
ctgatagaacacaggtagtaat

SEQ ID NO: 822305 - DNA, 22 bp, Artificial Sequence
  chemically synthesized
cattgctgatagaacacaggta

SEQ ID NO: 822306 - DNA, 22 bp, Artificial Sequence
  chemically synthesized
tacattgctgatagaacacagg

SEQ ID NO: 822307 - DNA, 22 bp, Artificial Sequence
  chemically synthesized
gcccattactacctgtgttcta

SEQ ID NO: 822308 - DNA, 22 bp, Artificial Sequence
  chemically synthesized
tctacattgctgatagaacaca

SEQ ID NO: 822309 - DNA, 22 bp, Artificial Sequence
  chemically synthesized
ctacctgtgttctatcagcaat

SEQ ID NO: 822310 - DNA, 22 bp, Artificial Sequence
  chemically synthesized
cctgtgttctatcagcaatgta

SEQ ID NO: 822311 - DNA, 22 bp, Artificial Sequence
  chemically synthesized
tgttctatcagcaatgtagaga

SEQ ID NO: 822312 - DNA, 22 bp, Artificial Sequence
  chemically synthesized
tatcagcaatgtagagagcact

SEQ ID NO: 822313 - DNA, 22 bp, Artificial Sequence
  chemically synthesized
tcagcaatgtagagagcactct

SEQ ID NO: 822314 - DNA, 22 bp, Artificial Sequence
  chemically synthesized
aaagcatacaaacagagtgctc

SEQ ID NO: 822315 - DNA, 22 bp, Artificial Sequence
  chemically synthesized
tcaaagcatacaaacagagtgc

SEQ ID NO: 822316 - DNA, 22 bp, Artificial Sequence
  chemically synthesized
aagttctcaaagcatacaaaca

SEQ ID NO: 822317 - DNA, 22 bp, Artificial Sequence
  chemically synthesized
aaagttctcaaagcatacaaac

SEQ ID NO: 822318 - DNA, 22 bp, Artificial Sequence
  chemically synthesized
ttaaagttctcaaagcatacaa

SEQ ID NO: 822319 - DNA, 22 bp, Artificial Sequence
  chemically synthesized
tgtttgtatgctttgagaactt

SEQ ID NO: 822320 - DNA, 22 bp, Artificial Sequence
  chemically synthesized
tttgtatgctttgagaacttta

SEQ ID NO: 822321 - DNA, 22 bp, Artificial Sequence
  chemically synthesized
gtatgctttgagaactttaaga

SEQ ID NO: 822322 - DNA, 22 bp, Artificial Sequence
  chemically synthesized
tatgctttgagaactttaagag

SEQ ID NO: 822323 - DNA, 22 bp, Artificial Sequence
  chemically synthesized
aagtatgcatgaaactcttaaa

SEQ ID NO: 822324 - DNA, 22 bp, Artificial Sequence
  chemically synthesized
taaagtatgcatgaaactctta

SEQ ID NO: 822325 - DNA, 22 bp, Artificial Sequence
  chemically synthesized
ctaaagtatgcatgaaactctt

SEQ ID NO: 822326 - DNA, 22 bp, Artificial Sequence
  chemically synthesized
tgagaactttaagagtttcatg

SEQ ID NO: 822327 - DNA, 22 bp, Artificial Sequence
  chemically synthesized
gagaactttaagagtttcatgc

SEQ ID NO: 822328 - DNA, 22 bp, Artificial Sequence
  chemically synthesized
cttctaaagtatgcatgaaact

SEQ ID NO: 822329 - DNA, 22 bp, Artificial Sequence
  chemically synthesized
agaactttaagagtttcatgca

SEQ ID NO: 822330 - DNA, 22 bp, Artificial Sequence
  chemically synthesized
ccttctaaagtatgcatgaaac

SEQ ID NO: 822331 - DNA, 22 bp, Artificial Sequence
  chemically synthesized
tccttctaaagtatgcatgaaa

SEQ ID NO: 822332 - DNA, 22 bp, Artificial Sequence
  chemically synthesized
ttccttctaaagtatgcatgaa

SEQ ID NO: 822333 - DNA, 22 bp, Artificial Sequence
  chemically synthesized
taagagtttcatgcatacttta

SEQ ID NO: 822334 - DNA, 22 bp, Artificial Sequence
  chemically synthesized
aagagtttcatgcatactttag

SEQ ID NO: 822335 - DNA, 22 bp, Artificial Sequence
  chemically synthesized
agagtttcatgcatactttaga

SEQ ID NO: 822336 - DNA, 22 bp, Artificial Sequence
  chemically synthesized
catgcatactttagaaggaaaa

SEQ ID NO: 822337 - DNA, 22 bp, Artificial Sequence
  chemically synthesized
atgcatactttagaaggaaaag

SEQ ID NO: 822338 - DNA, 22 bp, Artificial Sequence
  chemically synthesized
tagaaggaaaagtactattggg

SEQ ID NO: 822339 - DNA, 22 bp, Artificial Sequence
  chemically synthesized
agaaggaaaagtactattgggt

SEQ ID NO: 822340 - DNA, 22 bp, Artificial Sequence
  chemically synthesized
gaaggaaaagtactattgggtt

SEQ ID NO: 822341 - DNA, 22 bp, Artificial Sequence
  chemically synthesized
aagagaaaagatcaataaccca

SEQ ID NO: 822342 - DNA, 22 bp, Artificial Sequence
  chemically synthesized
tgtgattaaagagaaaagatca

SEQ ID NO: 822343 - DNA, 22 bp, Artificial Sequence
  chemically synthesized
tatgtgattaaagagaaaagat

SEQ ID NO: 822344 - DNA, 22 bp, Artificial Sequence
  chemically synthesized
ttgggttattgatcttttctct

SEQ ID NO: 822345 - DNA, 22 bp, Artificial Sequence
  chemically synthesized
ctatgtgattaaagagaaaaga

SEQ ID NO: 822346 - DNA, 22 bp, Artificial Sequence
  chemically synthesized
ggttattgatcttttctcttta

SEQ ID NO: 822347 - DNA, 22 bp, Artificial Sequence
  chemically synthesized
aagcttctatgtgattaaagag

SEQ ID NO: 822348 - DNA, 22 bp, Artificial Sequence
  chemically synthesized
ttgatcttttctctttaatcac

SEQ ID NO: 822349 - DNA, 22 bp, Artificial Sequence
  chemically synthesized
atcttttctctttaatcacata

SEQ ID NO: 822350 - DNA, 22 bp, Artificial Sequence
  chemically synthesized
ccctaaagcttctatgtgatta

SEQ ID NO: 822351 - DNA, 22 bp, Artificial Sequence
  chemically synthesized
tcccctaaagcttctatgtgat

SEQ ID NO: 822352 - DNA, 22 bp, Artificial Sequence
  chemically synthesized
ttctctttaatcacatagaagc

SEQ ID NO: 822353 - DNA, 22 bp, Artificial Sequence
  chemically synthesized
ttctcccctaaagcttctatgt

SEQ ID NO: 822354 - DNA, 22 bp, Artificial Sequence
  chemically synthesized
tctctttaatcacatagaagct

SEQ ID NO: 822355 - DNA, 22 bp, Artificial Sequence
  chemically synthesized
gttctcccctaaagcttctatg

SEQ ID NO: 822356 - DNA, 22 bp, Artificial Sequence
  chemically synthesized
ctctttaatcacatagaagctt

SEQ ID NO: 822357 - DNA, 22 bp, Artificial Sequence
  chemically synthesized
tgttctcccctaaagcttctat

SEQ ID NO: 822358 - DNA, 22 bp, Artificial Sequence
  chemically synthesized
tctttaatcacatagaagcttt

SEQ ID NO: 822359 - DNA, 22 bp, Artificial Sequence
  chemically synthesized
ttgttctcccctaaagcttcta

SEQ ID NO: 822360 - DNA, 22 bp, Artificial Sequence
  chemically synthesized
tttaatcacatagaagctttag

SEQ ID NO: 822361 - DNA, 22 bp, Artificial Sequence
  chemically synthesized
taatcacatagaagctttaggg

SEQ ID NO: 822362 - DNA, 22 bp, Artificial Sequence
  chemically synthesized
ccttttgttctcccctaaagct

SEQ ID NO: 822363 - DNA, 22 bp, Artificial Sequence
  chemically synthesized
aatcacatagaagctttagggg

SEQ ID NO: 822364 - DNA, 22 bp, Artificial Sequence
  chemically synthesized
atcacatagaagctttagggga

SEQ ID NO: 822365 - DNA, 22 bp, Artificial Sequence
  chemically synthesized
ttcccttttgttctcccctaaa

SEQ ID NO: 822366 - DNA, 22 bp, Artificial Sequence
  chemically synthesized
attcccttttgttctcccctaa

SEQ ID NO: 822367 - DNA, 22 bp, Artificial Sequence
  chemically synthesized
tattcccttttgttctccccta

SEQ ID NO: 822368 - DNA, 22 bp, Artificial Sequence
  chemically synthesized
tttattcccttttgttctcccc

SEQ ID NO: 822369 - DNA, 22 bp, Artificial Sequence
  chemically synthesized
ctttattcccttttgttctccc

SEQ ID NO: 822370 - DNA, 22 bp, Artificial Sequence
  chemically synthesized
tctttattcccttttgttctcc

SEQ ID NO: 822371 - DNA, 22 bp, Artificial Sequence
  chemically synthesized
taggggagaacaaaagggaata

SEQ ID NO: 822372 - DNA, 22 bp, Artificial Sequence
  chemically synthesized
atgtattttctttattcccttt

SEQ ID NO: 822373 - DNA, 22 bp, Artificial Sequence
  chemically synthesized
aggggagaacaaaagggaataa

SEQ ID NO: 822374 - DNA, 22 bp, Artificial Sequence
  chemically synthesized
catgtattttctttattccctt

SEQ ID NO: 822375 - DNA, 22 bp, Artificial Sequence
  chemically synthesized
ggggagaacaaaagggaataaa

SEQ ID NO: 822376 - DNA, 22 bp, Artificial Sequence
  chemically synthesized
ttcatgtattttctttattccc

SEQ ID NO: 822377 - DNA, 22 bp, Artificial Sequence
  chemically synthesized
cttcatgtattttctttattcc

SEQ ID NO: 822378 - DNA, 22 bp, Artificial Sequence
  chemically synthesized
ccatttcttcatgtattttctt

SEQ ID NO: 822379 - DNA, 22 bp, Artificial Sequence
  chemically synthesized
ccaggacctaccatttcttcat

SEQ ID NO: 822380 - DNA, 22 bp, Artificial Sequence
  chemically synthesized
gccaggacctaccatttcttca

SEQ ID NO: 822381 - DNA, 22 bp, Artificial Sequence
  chemically synthesized
ttgccaggacctaccatttctt

SEQ ID NO: 822382 - DNA, 22 bp, Artificial Sequence
  chemically synthesized
cttgccaggacctaccatttct

SEQ ID NO: 822383 - DNA, 22 bp, Artificial Sequence
  chemically synthesized
gaaatcttcttgccaggaccta

SEQ ID NO: 822384 - DNA, 22 bp, Artificial Sequence
  chemically synthesized
ttagaaatcttcttgccaggac

SEQ ID NO: 822385 - DNA, 22 bp, Artificial Sequence
  chemically synthesized
gcaagaagatttctaataatgc

SEQ ID NO: 822386 - DNA, 22 bp, Artificial Sequence
  chemically synthesized
gtacaataatgaaaagcattat

SEQ ID NO: 822387 - DNA, 22 bp, Artificial Sequence
  chemically synthesized
tggtacaataatgaaaagcatt

SEQ ID NO: 822388 - DNA, 22 bp, Artificial Sequence
  chemically synthesized
ctggtacaataatgaaaagcat

SEQ ID NO: 822389 - DNA, 22 bp, Artificial Sequence
  chemically synthesized
ggtttctggtacaataatgaaa

SEQ ID NO: 822390 - DNA, 22 bp, Artificial Sequence
  chemically synthesized
ctaataatgcttttcattattg

SEQ ID NO: 822391 - DNA, 22 bp, Artificial Sequence
  chemically synthesized
gggtttctggtacaataatgaa

SEQ ID NO: 822392 - DNA, 22 bp, Artificial Sequence
  chemically synthesized
taataatgcttttcattattgt

SEQ ID NO: 822393 - DNA, 22 bp, Artificial Sequence
  chemically synthesized
ataatgcttttcattattgtac

SEQ ID NO: 822394 - DNA, 22 bp, Artificial Sequence
  chemically synthesized
aggtttgggtttctggtacaat

SEQ ID NO: 822395 - DNA, 22 bp, Artificial Sequence
  chemically synthesized
gaggtttgggtttctggtacaa

SEQ ID NO: 822396 - DNA, 22 bp, Artificial Sequence
  chemically synthesized
ttcattattgtaccagaaaccc

SEQ ID NO: 822397 - DNA, 22 bp, Artificial Sequence
  chemically synthesized
tcattattgtaccagaaaccca

SEQ ID NO: 822398 - DNA, 22 bp, Artificial Sequence
  chemically synthesized
cattattgtaccagaaacccaa

SEQ ID NO: 822399 - DNA, 22 bp, Artificial Sequence
  chemically synthesized
gtagtttgaggtttgggtttct

SEQ ID NO: 822400 - DNA, 22 bp, Artificial Sequence
  chemically synthesized
attattgtaccagaaacccaaa

SEQ ID NO: 822401 - DNA, 22 bp, Artificial Sequence
  chemically synthesized
ttgtaccagaaacccaaacctc

SEQ ID NO: 822402 - DNA, 22 bp, Artificial Sequence
  chemically synthesized
taccagaaacccaaacctcaaa

SEQ ID NO: 822403 - DNA, 22 bp, Artificial Sequence
  chemically synthesized
acccacactagtagtttgaggt

SEQ ID NO: 822404 - DNA, 22 bp, Artificial Sequence
  chemically synthesized
aatcagcaaattgacccacact

SEQ ID NO: 822405 - DNA, 22 bp, Artificial Sequence
  chemically synthesized
aaactactagtgtgggtcaatt

SEQ ID NO: 822406 - DNA, 22 bp, Artificial Sequence
  chemically synthesized
ctagtgtgggtcaatttgctga

SEQ ID NO: 822407 - DNA, 22 bp, Artificial Sequence
  chemically synthesized
tacaaaattaaatcagcaaatt

SEQ ID NO: 822408 - DNA, 22 bp, Artificial Sequence
  chemically synthesized
gtgtgggtcaatttgctgattt

SEQ ID NO: 822409 - DNA, 22 bp, Artificial Sequence
  chemically synthesized
gagttgtacaaaattaaatcag

SEQ ID NO: 822410 - DNA, 22 bp, Artificial Sequence
  chemically synthesized
ggagttgtacaaaattaaatca

SEQ ID NO: 822411 - DNA, 22 bp, Artificial Sequence
  chemically synthesized
tggagttgtacaaaattaaatc

SEQ ID NO: 822412 - DNA, 22 bp, Artificial Sequence
  chemically synthesized
ttggagttgtacaaaattaaat

SEQ ID NO: 822413 - DNA, 22 bp, Artificial Sequence
  chemically synthesized
tttggagttgtacaaaattaaa

SEQ ID NO: 822414 - DNA, 22 bp, Artificial Sequence
  chemically synthesized
gctgatttaattttgtacaact

SEQ ID NO: 822415 - DNA, 22 bp, Artificial Sequence
  chemically synthesized
tgtattttttggagttgtacaa

SEQ ID NO: 822416 - DNA, 22 bp, Artificial Sequence
  chemically synthesized
ctgatttaattttgtacaactc

SEQ ID NO: 822417 - DNA, 22 bp, Artificial Sequence
  chemically synthesized
gtgtattttttggagttgtaca

SEQ ID NO: 822418 - DNA, 22 bp, Artificial Sequence
  chemically synthesized
tgtgtattttttggagttgtac

SEQ ID NO: 822419 - DNA, 22 bp, Artificial Sequence
  chemically synthesized
atttaattttgtacaactccaa

SEQ ID NO: 822420 - DNA, 22 bp, Artificial Sequence
  chemically synthesized
aattttgtacaactccaaaaaa

SEQ ID NO: 822421 - DNA, 22 bp, Artificial Sequence
  chemically synthesized
attttgtacaactccaaaaaat

SEQ ID NO: 822422 - DNA, 22 bp, Artificial Sequence
  chemically synthesized
tatattttgtgtattttttgga

SEQ ID NO: 822423 - DNA, 22 bp, Artificial Sequence
  chemically synthesized
atatattttgtgtattttttgg

SEQ ID NO: 822424 - DNA, 22 bp, Artificial Sequence
  chemically synthesized
tatatattttgtgtattttttg

SEQ ID NO: 822425 - DNA, 22 bp, Artificial Sequence
  chemically synthesized
ttatatattttgtgtatttttt

SEQ ID NO: 822426 - DNA, 22 bp, Artificial Sequence
  chemically synthesized
tgtacaactccaaaaaatacac

SEQ ID NO: 822427 - DNA, 22 bp, Artificial Sequence
  chemically synthesized
gtacaactccaaaaaatacaca

SEQ ID NO: 822428 - DNA, 22 bp, Artificial Sequence
  chemically synthesized
ttttatatattttgtgtatttt

SEQ ID NO: 822429 - DNA, 22 bp, Artificial Sequence
  chemically synthesized
tacaactccaaaaaatacacaa

SEQ ID NO: 822430 - DNA, 22 bp, Artificial Sequence
  chemically synthesized
cttttatatattttgtgtattt

SEQ ID NO: 822431 - DNA, 22 bp, Artificial Sequence
  chemically synthesized
tcttttatatattttgtgtatt

SEQ ID NO: 822432 - DNA, 22 bp, Artificial Sequence
  chemically synthesized
ttcttttatatattttgtgtat

SEQ ID NO: 822433 - DNA, 22 bp, Artificial Sequence
  chemically synthesized
aatttttcttttatatattttg

SEQ ID NO: 822434 - DNA, 22 bp, Artificial Sequence
  chemically synthesized
caaaaaatacacaaaatatata

SEQ ID NO: 822435 - DNA, 22 bp, Artificial Sequence
  chemically synthesized
agtttccactaccgtacatatt

SEQ ID NO: 822436 - DNA, 22 bp, Artificial Sequence
  chemically synthesized
atccaccataaaaatatgtacg

SEQ ID NO: 822437 - DNA, 22 bp, Artificial Sequence
  chemically synthesized
ccactaccgtacatatttttat

SEQ ID NO: 822438 - DNA, 22 bp, Artificial Sequence
  chemically synthesized
cactaccgtacatatttttatg

SEQ ID NO: 822439 - DNA, 22 bp, Artificial Sequence
  chemically synthesized
ccgtacatatttttatggtgga

SEQ ID NO: 822440 - DNA, 22 bp, Artificial Sequence
  chemically synthesized
ttatggtggatgagatatatga

SEQ ID NO: 822441 - DNA, 22 bp, Artificial Sequence
  chemically synthesized
tatggtggatgagatatatgat

SEQ ID NO: 822442 - DNA, 22 bp, Artificial Sequence
  chemically synthesized
atggtggatgagatatatgatg

SEQ ID NO: 822443 - DNA, 22 bp, Artificial Sequence
  chemically synthesized
tggtggatgagatatatgatgc

SEQ ID NO: 822444 - DNA, 22 bp, Artificial Sequence
  chemically synthesized
tggaaggatcgatggcatcata

SEQ ID NO: 822445 - DNA, 22 bp, Artificial Sequence
  chemically synthesized
tctgtggaaggatcgatggcat

SEQ ID NO: 822446 - DNA, 22 bp, Artificial Sequence
  chemically synthesized
gttatctgtggaaggatcgatg

SEQ ID NO: 822447 - DNA, 22 bp, Artificial Sequence
  chemically synthesized
agttatctgtggaaggatcgat

SEQ ID NO: 822448 - DNA, 22 bp, Artificial Sequence
  chemically synthesized
tagttatctgtggaaggatcga

SEQ ID NO: 822449 - DNA, 22 bp, Artificial Sequence
  chemically synthesized
ttagttatctgtggaaggatcg

SEQ ID NO: 822450 - DNA, 22 bp, Artificial Sequence
  chemically synthesized
catttttagttatctgtggaag

SEQ ID NO: 822451 - DNA, 22 bp, Artificial Sequence
  chemically synthesized
acatttttagttatctgtggaa

SEQ ID NO: 822452 - DNA, 22 bp, Artificial Sequence
  chemically synthesized
ccacagataactaaaaatgtaa

SEQ ID NO: 822453 - DNA, 22 bp, Artificial Sequence
  chemically synthesized
cacagataactaaaaatgtaag

SEQ ID NO: 822454 - DNA, 22 bp, Artificial Sequence
  chemically synthesized
aaatatggaagtagtgccttac

SEQ ID NO: 822455 - DNA, 22 bp, Artificial Sequence
  chemically synthesized
caaatatggaagtagtgcctta

SEQ ID NO: 822456 - DNA, 22 bp, Artificial Sequence
  chemically synthesized
tcaaatatggaagtagtgcctt

SEQ ID NO: 822457 - DNA, 22 bp, Artificial Sequence
  chemically synthesized
ttcaaatatggaagtagtgcct

SEQ ID NO: 822458 - DNA, 22 bp, Artificial Sequence
  chemically synthesized
aaaatgtaaggcactacttcca

SEQ ID NO: 822459 - DNA, 22 bp, Artificial Sequence
  chemically synthesized
aaaagggagacatttttcaaat

SEQ ID NO: 822460 - DNA, 22 bp, Artificial Sequence
  chemically synthesized
ctaaaaagggagacatttttca

SEQ ID NO: 822461 - DNA, 22 bp, Artificial Sequence
  chemically synthesized
actaaaaagggagacatttttc

SEQ ID NO: 822462 - DNA, 22 bp, Artificial Sequence
  chemically synthesized
cttccatatttgaaaaatgtct

SEQ ID NO: 822463 - DNA, 22 bp, Artificial Sequence
  chemically synthesized
tactaaaaagggagacattttt

SEQ ID NO: 822464 - DNA, 22 bp, Artificial Sequence
  chemically synthesized
ccatatttgaaaaatgtctccc

SEQ ID NO: 822465 - DNA, 22 bp, Artificial Sequence
  chemically synthesized
ttttactaaaaagggagacatt

SEQ ID NO: 822466 - DNA, 22 bp, Artificial Sequence
  chemically synthesized
catatttgaaaaatgtctccct

SEQ ID NO: 822467 - DNA, 22 bp, Artificial Sequence
  chemically synthesized
aaattattttactaaaaaggga

SEQ ID NO: 822468 - DNA, 22 bp, Artificial Sequence
  chemically synthesized
gaaaaatgtctccctttttagt

SEQ ID NO: 822469 - DNA, 22 bp, Artificial Sequence
  chemically synthesized
aaaaatgtctccctttttagta

SEQ ID NO: 822470 - DNA, 22 bp, Artificial Sequence
  chemically synthesized
agtgtctcaaattattttacta

SEQ ID NO: 822471 - DNA, 22 bp, Artificial Sequence
  chemically synthesized
gagtgtctcaaattattttact

SEQ ID NO: 822472 - DNA, 22 bp, Artificial Sequence
  chemically synthesized
tttgagtgtctcaaattatttt

SEQ ID NO: 822473 - DNA, 22 bp, Artificial Sequence
  chemically synthesized
cctttttagtaaaataatttga

SEQ ID NO: 822474 - DNA, 22 bp, Artificial Sequence
  chemically synthesized
tttagtaaaataatttgagaca

SEQ ID NO: 822475 - DNA, 22 bp, Artificial Sequence
  chemically synthesized
ttagtaaaataatttgagacac

SEQ ID NO: 822476 - DNA, 22 bp, Artificial Sequence
  chemically synthesized
tagtaaaataatttgagacact

SEQ ID NO: 822477 - DNA, 22 bp, Artificial Sequence
  chemically synthesized
agtaaaataatttgagacactc

SEQ ID NO: 822478 - DNA, 22 bp, Artificial Sequence
  chemically synthesized
aggcagctatttgagtgtctca

SEQ ID NO: 822479 - DNA, 22 bp, Artificial Sequence
  chemically synthesized
gtaaaataatttgagacactca

SEQ ID NO: 822480 - DNA, 22 bp, Artificial Sequence
  chemically synthesized
gagacactcaaatagctgcctt

SEQ ID NO: 822481 - DNA, 22 bp, Artificial Sequence
  chemically synthesized
tatgtagtaactaaggcagcta

SEQ ID NO: 822482 - DNA, 22 bp, Artificial Sequence
  chemically synthesized
agacactcaaatagctgcctta

SEQ ID NO: 822483 - DNA, 22 bp, Artificial Sequence
  chemically synthesized
ttgtatgtagtaactaaggcag

SEQ ID NO: 822484 - DNA, 22 bp, Artificial Sequence
  chemically synthesized
attgtatgtagtaactaaggca

SEQ ID NO: 822485 - DNA, 22 bp, Artificial Sequence
  chemically synthesized
aaatagctgccttagttactac

SEQ ID NO: 822486 - DNA, 22 bp, Artificial Sequence
  chemically synthesized
aacttattgtatgtagtaacta

SEQ ID NO: 822487 - DNA, 22 bp, Artificial Sequence
  chemically synthesized
aaagttgaacttattgtatgta

SEQ ID NO: 822488 - DNA, 22 bp, Artificial Sequence
  chemically synthesized
aaaagttgaacttattgtatgt

SEQ ID NO: 822489 - DNA, 22 bp, Artificial Sequence
  chemically synthesized
ccttagttactacatacaataa

SEQ ID NO: 822490 - DNA, 22 bp, Artificial Sequence
  chemically synthesized
taaaagttgaacttattgtatg

SEQ ID NO: 822491 - DNA, 22 bp, Artificial Sequence
  chemically synthesized
agttactacatacaataagttc

SEQ ID NO: 822492 - DNA, 22 bp, Artificial Sequence
  chemically synthesized
attttaaaagttgaacttattg

SEQ ID NO: 822493 - DNA, 22 bp, Artificial Sequence
  chemically synthesized
gttactacatacaataagttca

SEQ ID NO: 822494 - DNA, 22 bp, Artificial Sequence
  chemically synthesized
ctacatacaataagttcaactt

SEQ ID NO: 822495 - DNA, 22 bp, Artificial Sequence
  chemically synthesized
catacaataagttcaactttta

SEQ ID NO: 822496 - DNA, 22 bp, Artificial Sequence
  chemically synthesized
taatcacataattaattttaaa

SEQ ID NO: 822497 - DNA, 22 bp, Artificial Sequence
  chemically synthesized
tataatcacataattaatttta

SEQ ID NO: 822498 - DNA, 22 bp, Artificial Sequence
  chemically synthesized
aacttttaaaattaattatgtg

SEQ ID NO: 822499 - DNA, 22 bp, Artificial Sequence
  chemically synthesized
ttaaaattaattatgtgattat

SEQ ID NO: 822500 - DNA, 22 bp, Artificial Sequence
  chemically synthesized
taaaattaattatgtgattata

SEQ ID NO: 822501 - DNA, 22 bp, Artificial Sequence
  chemically synthesized
aaaattaattatgtgattatag

SEQ ID NO: 822502 - DNA, 22 bp, Artificial Sequence
  chemically synthesized
aaattaattatgtgattataga

SEQ ID NO: 822503 - DNA, 22 bp, Artificial Sequence
  chemically synthesized
aaacacagacattctataatca

SEQ ID NO: 822504 - DNA, 22 bp, Artificial Sequence
  chemically synthesized
gaaacacagacattctataatc

SEQ ID NO: 822505 - DNA, 22 bp, Artificial Sequence
  chemically synthesized
attatgtgattatagaatgtct

SEQ ID NO: 822506 - DNA, 22 bp, Artificial Sequence
  chemically synthesized
ggaaacttgaaacacagacatt

SEQ ID NO: 822507 - DNA, 22 bp, Artificial Sequence
  chemically synthesized
tgtgattatagaatgtctgtgt

SEQ ID NO: 822508 - DNA, 22 bp, Artificial Sequence
  chemically synthesized
aggaaacttgaaacacagacat

SEQ ID NO: 822509 - DNA, 22 bp, Artificial Sequence
  chemically synthesized
taggaaacttgaaacacagaca

SEQ ID NO: 822510 - DNA, 22 bp, Artificial Sequence
  chemically synthesized
tttaggaaacttgaaacacaga

SEQ ID NO: 822511 - DNA, 22 bp, Artificial Sequence
  chemically synthesized
tagaatgtctgtgtttcaagtt

SEQ ID NO: 822512 - DNA, 22 bp, Artificial Sequence
  chemically synthesized
aaggcattctttaggaaacttg

SEQ ID NO: 822513 - DNA, 22 bp, Artificial Sequence
  chemically synthesized
gaaggcattctttaggaaactt

SEQ ID NO: 822514 - DNA, 22 bp, Artificial Sequence
  chemically synthesized
tgaaggcattctttaggaaact

SEQ ID NO: 822515 - DNA, 22 bp, Artificial Sequence
  chemically synthesized
ttgaaggcattctttaggaaac

SEQ ID NO: 822516 - DNA, 22 bp, Artificial Sequence
  chemically synthesized
tgtttcaagtttcctaaagaat

SEQ ID NO: 822517 - DNA, 22 bp, Artificial Sequence
  chemically synthesized
tgtttttgaaggcattctttag

SEQ ID NO: 822518 - DNA, 22 bp, Artificial Sequence
  chemically synthesized
tgtgtttttgaaggcattcttt

SEQ ID NO: 822519 - DNA, 22 bp, Artificial Sequence
  chemically synthesized
caagtttcctaaagaatgcctt

SEQ ID NO: 822520 - DNA, 22 bp, Artificial Sequence
  chemically synthesized
aagtttcctaaagaatgccttc

SEQ ID NO: 822521 - DNA, 22 bp, Artificial Sequence
  chemically synthesized
cctaaagaatgccttcaaaaac

SEQ ID NO: 822522 - DNA, 22 bp, Artificial Sequence
  chemically synthesized
caaaatctctgtgtttttgaag

SEQ ID NO: 822523 - DNA, 22 bp, Artificial Sequence
  chemically synthesized
ctaaagaatgccttcaaaaaca

SEQ ID NO: 822524 - DNA, 22 bp, Artificial Sequence
  chemically synthesized
aagaatgccttcaaaaacacag

SEQ ID NO: 822525 - DNA, 22 bp, Artificial Sequence
  chemically synthesized
aggctgcaaaatctctgtgttt

SEQ ID NO: 822526 - DNA, 22 bp, Artificial Sequence
  chemically synthesized
taaggctgcaaaatctctgtgt

SEQ ID NO: 822527 - DNA, 22 bp, Artificial Sequence
  chemically synthesized
ctaaggctgcaaaatctctgtg

SEQ ID NO: 822528 - DNA, 22 bp, Artificial Sequence
  chemically synthesized
caaaaacacagagattttgcag

SEQ ID NO: 822529 - DNA, 22 bp, Artificial Sequence
  chemically synthesized
aaaaacacagagattttgcagc

SEQ ID NO: 822530 - DNA, 22 bp, Artificial Sequence
  chemically synthesized
aataaacatttctaaggctgca

SEQ ID NO: 822531 - DNA, 22 bp, Artificial Sequence
  chemically synthesized
ttgaataaacatttctaaggct

SEQ ID NO: 822532 - DNA, 22 bp, Artificial Sequence
  chemically synthesized
aaattattgaataaacatttct

SEQ ID NO: 822533 - DNA, 22 bp, Artificial Sequence
  chemically synthesized
caaattattgaataaacatttc

SEQ ID NO: 822534 - DNA, 22 bp, Artificial Sequence
  chemically synthesized
tcaaattattgaataaacattt

SEQ ID NO: 822535 - DNA, 22 bp, Artificial Sequence
  chemically synthesized
tgcagccttagaaatgtttatt

SEQ ID NO: 822536 - DNA, 22 bp, Artificial Sequence
  chemically synthesized
ttcaaattattgaataaacatt

SEQ ID NO: 822537 - DNA, 22 bp, Artificial Sequence
  chemically synthesized
gcagccttagaaatgtttattc

SEQ ID NO: 822538 - DNA, 22 bp, Artificial Sequence
  chemically synthesized
cagccttagaaatgtttattca

SEQ ID NO: 822539 - DNA, 22 bp, Artificial Sequence
  chemically synthesized
aatacttttcaaattattgaat

SEQ ID NO: 822540 - DNA, 22 bp, Artificial Sequence
  chemically synthesized
agaaatgtttattcaataattt

SEQ ID NO: 822541 - DNA, 22 bp, Artificial Sequence
  chemically synthesized
gaaatgtttattcaataatttg

SEQ ID NO: 822542 - DNA, 22 bp, Artificial Sequence
  chemically synthesized
attcaataatttgaaaagtatt

SEQ ID NO: 822543 - DNA, 22 bp, Artificial Sequence
  chemically synthesized
ttcaataatttgaaaagtattg

SEQ ID NO: 822544 - DNA, 22 bp, Artificial Sequence
  chemically synthesized
aagcaagaaattcaatactttt

SEQ ID NO: 822545 - DNA, 22 bp, Artificial Sequence
  chemically synthesized
aataatttgaaaagtattgaat

SEQ ID NO: 822546 - DNA, 22 bp, Artificial Sequence
  chemically synthesized
tctgaagcaagaaattcaatac

SEQ ID NO: 822547 - DNA, 22 bp, Artificial Sequence
  chemically synthesized
gaaaagtattgaatttcttgct

SEQ ID NO: 822548 - DNA, 22 bp, Artificial Sequence
  chemically synthesized
aaaactatctgaagcaagaaat

SEQ ID NO: 822549 - DNA, 22 bp, Artificial Sequence
  chemically synthesized
aaaagtattgaatttcttgctt

SEQ ID NO: 822550 - DNA, 22 bp, Artificial Sequence
  chemically synthesized
tataatattgaaaactatctga

SEQ ID NO: 822551 - DNA, 22 bp, Artificial Sequence
  chemically synthesized
aatttcttgcttcagatagttt

SEQ ID NO: 822552 - DNA, 22 bp, Artificial Sequence
  chemically synthesized
gctatataatattgaaaactat

SEQ ID NO: 822553 - DNA, 22 bp, Artificial Sequence
  chemically synthesized
ggctatataatattgaaaacta

SEQ ID NO: 822554 - DNA, 22 bp, Artificial Sequence
  chemically synthesized
cttgcttcagatagttttcaat

SEQ ID NO: 822555 - DNA, 22 bp, Artificial Sequence
  chemically synthesized
ttgcttcagatagttttcaata

SEQ ID NO: 822556 - DNA, 22 bp, Artificial Sequence
  chemically synthesized
gcttcagatagttttcaatatt

SEQ ID NO: 822557 - DNA, 22 bp, Artificial Sequence
  chemically synthesized
atttggctatataatattgaaa

SEQ ID NO: 822558 - DNA, 22 bp, Artificial Sequence
  chemically synthesized
cttcagatagttttcaatatta

SEQ ID NO: 822559 - DNA, 22 bp, Artificial Sequence
  chemically synthesized
cagatagttttcaatattatat

SEQ ID NO: 822560 - DNA, 22 bp, Artificial Sequence
  chemically synthesized
gctgatttggctatataatatt

SEQ ID NO: 822561 - DNA, 22 bp, Artificial Sequence
  chemically synthesized
agatagttttcaatattatata

SEQ ID NO: 822562 - DNA, 22 bp, Artificial Sequence
  chemically synthesized
agcctggctgatttggctatat

SEQ ID NO: 822563 - DNA, 22 bp, Artificial Sequence
  chemically synthesized
gagcctggctgatttggctata

SEQ ID NO: 822564 - DNA, 22 bp, Artificial Sequence
  chemically synthesized
tcaatattatatagccaaatca

SEQ ID NO: 822565 - DNA, 22 bp, Artificial Sequence
  chemically synthesized
tttgagcctggctgatttggct

SEQ ID NO: 822566 - DNA, 22 bp, Artificial Sequence
  chemically synthesized
caatattatatagccaaatcag

SEQ ID NO: 822567 - DNA, 22 bp, Artificial Sequence
  chemically synthesized
gtttgagcctggctgatttggc

SEQ ID NO: 822568 - DNA, 22 bp, Artificial Sequence
  chemically synthesized
aatattatatagccaaatcagc

SEQ ID NO: 822569 - DNA, 22 bp, Artificial Sequence
  chemically synthesized
tatagccaaatcagccaggctc

SEQ ID NO: 822570 - DNA, 22 bp, Artificial Sequence
  chemically synthesized
aatagagaagtgaaatcttgtt

SEQ ID NO: 822571 - DNA, 22 bp, Artificial Sequence
  chemically synthesized
aaacaagatttcacttctctat

SEQ ID NO: 822572 - DNA, 22 bp, Artificial Sequence
  chemically synthesized
agagtacatgaattcaatagag

SEQ ID NO: 822573 - DNA, 22 bp, Artificial Sequence
  chemically synthesized
agctaagagtacatgaattcaa

SEQ ID NO: 822574 - DNA, 22 bp, Artificial Sequence
  chemically synthesized
cacttctctattgaattcatgt

SEQ ID NO: 822575 - DNA, 22 bp, Artificial Sequence
  chemically synthesized
acttctctattgaattcatgta

SEQ ID NO: 822576 - DNA, 22 bp, Artificial Sequence
  chemically synthesized
gctgagctaagagtacatgaat

SEQ ID NO: 822577 - DNA, 22 bp, Artificial Sequence
  chemically synthesized
ggctgagctaagagtacatgaa

SEQ ID NO: 822578 - DNA, 22 bp, Artificial Sequence
  chemically synthesized
ctctattgaattcatgtactct

SEQ ID NO: 822579 - DNA, 22 bp, Artificial Sequence
  chemically synthesized
tctattgaattcatgtactctt

SEQ ID NO: 822580 - DNA, 22 bp, Artificial Sequence
  chemically synthesized
tattgaattcatgtactcttag

SEQ ID NO: 822581 - DNA, 22 bp, Artificial Sequence
  chemically synthesized
tgcttggctgagctaagagtac

SEQ ID NO: 822582 - DNA, 22 bp, Artificial Sequence
  chemically synthesized
gtgcttggctgagctaagagta

SEQ ID NO: 822583 - DNA, 22 bp, Artificial Sequence
  chemically synthesized
ttgaattcatgtactcttagct

SEQ ID NO: 822584 - DNA, 22 bp, Artificial Sequence
  chemically synthesized
tgtgcttggctgagctaagagt

SEQ ID NO: 822585 - DNA, 22 bp, Artificial Sequence
  chemically synthesized
aattcatgtactcttagctcag

SEQ ID NO: 822586 - DNA, 22 bp, Artificial Sequence
  chemically synthesized
ttttgtgcttggctgagctaag

SEQ ID NO: 822587 - DNA, 22 bp, Artificial Sequence
  chemically synthesized
gctgttttgtgcttggctgagc

SEQ ID NO: 822588 - DNA, 22 bp, Artificial Sequence
  chemically synthesized
atgtactcttagctcagccaag

SEQ ID NO: 822589 - DNA, 22 bp, Artificial Sequence
  chemically synthesized
ttagctcagccaagcacaaaac

SEQ ID NO: 822590 - DNA, 22 bp, Artificial Sequence
  chemically synthesized
agctcagccaagcacaaaacag

SEQ ID NO: 822591 - DNA, 22 bp, Artificial Sequence
  chemically synthesized
gctcagccaagcacaaaacagc

SEQ ID NO: 822592 - DNA, 22 bp, Artificial Sequence
  chemically synthesized
agccaagcacaaaacagctaat

SEQ ID NO: 822593 - DNA, 22 bp, Artificial Sequence
  chemically synthesized
aaacgtgacagcattagctgtt

SEQ ID NO: 822594 - DNA, 22 bp, Artificial Sequence
  chemically synthesized
caaacgtgacagcattagctgt

SEQ ID NO: 822595 - DNA, 22 bp, Artificial Sequence
  chemically synthesized
tcaaacgtgacagcattagctg

SEQ ID NO: 822596 - DNA, 22 bp, Artificial Sequence
  chemically synthesized
ttcaaacgtgacagcattagct

SEQ ID NO: 822597 - DNA, 22 bp, Artificial Sequence
  chemically synthesized
agcgtaaaagcttttcaaacgt

SEQ ID NO: 822598 - DNA, 22 bp, Artificial Sequence
  chemically synthesized
atgctgtcacgtttgaaaagct

SEQ ID NO: 822599 - DNA, 22 bp, Artificial Sequence
  chemically synthesized
tcacgtttgaaaagcttttacg

SEQ ID NO: 822600 - DNA, 22 bp, Artificial Sequence
  chemically synthesized
tgtcaaattcagcgtaaaagct

SEQ ID NO: 822601 - DNA, 22 bp, Artificial Sequence
  chemically synthesized
gtgtcaaattcagcgtaaaagc

SEQ ID NO: 822602 - DNA, 22 bp, Artificial Sequence
  chemically synthesized
tgtgtcaaattcagcgtaaaag

SEQ ID NO: 822603 - DNA, 22 bp, Artificial Sequence
  chemically synthesized
ttgtgtcaaattcagcgtaaaa

SEQ ID NO: 822604 - DNA, 22 bp, Artificial Sequence
  chemically synthesized
cttttgtgtcaaattcagcgta

SEQ ID NO: 822605 - DNA, 22 bp, Artificial Sequence
  chemically synthesized
gaaaagcttttacgctgaattt

SEQ ID NO: 822606 - DNA, 22 bp, Artificial Sequence
  chemically synthesized
aaaagcttttacgctgaatttg

SEQ ID NO: 822607 - DNA, 22 bp, Artificial Sequence
  chemically synthesized
tgattgcttttgtgtcaaattc

SEQ ID NO: 822608 - DNA, 22 bp, Artificial Sequence
  chemically synthesized
gtgattgcttttgtgtcaaatt

SEQ ID NO: 822609 - DNA, 22 bp, Artificial Sequence
  chemically synthesized
tgtgattgcttttgtgtcaaat

SEQ ID NO: 822610 - DNA, 22 bp, Artificial Sequence
  chemically synthesized
ttacgctgaatttgacacaaaa

SEQ ID NO: 822611 - DNA, 22 bp, Artificial Sequence
  chemically synthesized
tacgctgaatttgacacaaaag

SEQ ID NO: 822612 - DNA, 22 bp, Artificial Sequence
  chemically synthesized
acgctgaatttgacacaaaagc

SEQ ID NO: 822613 - DNA, 22 bp, Artificial Sequence
  chemically synthesized
cgctgaatttgacacaaaagca

SEQ ID NO: 822614 - DNA, 22 bp, Artificial Sequence
  chemically synthesized
tcggctttgtgattgcttttgt

SEQ ID NO: 822615 - DNA, 22 bp, Artificial Sequence
  chemically synthesized
gtcggctttgtgattgcttttg

SEQ ID NO: 822616 - DNA, 22 bp, Artificial Sequence
  chemically synthesized
tgtcggctttgtgattgctttt

SEQ ID NO: 822617 - DNA, 22 bp, Artificial Sequence
  chemically synthesized
ttgtcggctttgtgattgcttt

SEQ ID NO: 822618 - DNA, 22 bp, Artificial Sequence
  chemically synthesized
aatttgacacaaaagcaatcac

SEQ ID NO: 822619 - DNA, 22 bp, Artificial Sequence
  chemically synthesized
tttgtcggctttgtgattgctt

SEQ ID NO: 822620 - DNA, 22 bp, Artificial Sequence
  chemically synthesized
gacacaaaagcaatcacaaagc

SEQ ID NO: 822621 - DNA, 22 bp, Artificial Sequence
  chemically synthesized
acacaaaagcaatcacaaagcc

SEQ ID NO: 822622 - DNA, 22 bp, Artificial Sequence
  chemically synthesized
aaagagaaatcccctttttgtc

SEQ ID NO: 822623 - DNA, 22 bp, Artificial Sequence
  chemically synthesized
gaaagagaaatcccctttttgt

SEQ ID NO: 822624 - DNA, 22 bp, Artificial Sequence
  chemically synthesized
tgaaagagaaatcccctttttg

SEQ ID NO: 822625 - DNA, 22 bp, Artificial Sequence
  chemically synthesized
ttgaaagagaaatccccttttt

SEQ ID NO: 822626 - DNA, 22 bp, Artificial Sequence
  chemically synthesized
tcagtttttgaaagagaaatcc

SEQ ID NO: 822627 - DNA, 22 bp, Artificial Sequence
  chemically synthesized
ccctgtcagtttttgaaagaga

SEQ ID NO: 822628 - DNA, 22 bp, Artificial Sequence
  chemically synthesized
cccctgtcagtttttgaaagag

SEQ ID NO: 822629 - DNA, 22 bp, Artificial Sequence
  chemically synthesized
tcccctgtcagtttttgaaaga

SEQ ID NO: 822630 - DNA, 22 bp, Artificial Sequence
  chemically synthesized
ttcccctgtcagtttttgaaag

SEQ ID NO: 822631 - DNA, 22 bp, Artificial Sequence
  chemically synthesized
tttcccctgtcagtttttgaaa

SEQ ID NO: 822632 - DNA, 22 bp, Artificial Sequence
  chemically synthesized
ttttttcccctgtcagtttttg

SEQ ID NO: 822633 - DNA, 22 bp, Artificial Sequence
  chemically synthesized
attttttcccctgtcagttttt

SEQ ID NO: 822634 - DNA, 22 bp, Artificial Sequence
  chemically synthesized
atttattttttcccctgtcagt

SEQ ID NO: 822635 - DNA, 22 bp, Artificial Sequence
  chemically synthesized
ctctttcaaaaactgacagggg

SEQ ID NO: 822636 - DNA, 22 bp, Artificial Sequence
  chemically synthesized
catttattttttcccctgtcag

SEQ ID NO: 822637 - DNA, 22 bp, Artificial Sequence
  chemically synthesized
tctttcaaaaactgacagggga

SEQ ID NO: 822638 - DNA, 22 bp, Artificial Sequence
  chemically synthesized
tcatttattttttcccctgtca

SEQ ID NO: 822639 - DNA, 22 bp, Artificial Sequence
  chemically synthesized
tttcaaaaactgacaggggaaa

SEQ ID NO: 822640 - DNA, 22 bp, Artificial Sequence
  chemically synthesized
tcaaaaactgacaggggaaaaa

SEQ ID NO: 822641 - DNA, 22 bp, Artificial Sequence
  chemically synthesized
caaaaactgacaggggaaaaaa

SEQ ID NO: 822642 - DNA, 22 bp, Artificial Sequence
  chemically synthesized
aaaaactgacaggggaaaaaat

SEQ ID NO: 822643 - DNA, 22 bp, Artificial Sequence
  chemically synthesized
cgagttttcatttattttttcc

SEQ ID NO: 822644 - DNA, 22 bp, Artificial Sequence
  chemically synthesized
acaggggaaaaaataaatgaaa

SEQ ID NO: 822645 - DNA, 22 bp, Artificial Sequence
  chemically synthesized
ccaggctccgagttttcattta

SEQ ID NO: 822646 - DNA, 22 bp, Artificial Sequence
  chemically synthesized
cccaggctccgagttttcattt

SEQ ID NO: 822647 - DNA, 22 bp, Artificial Sequence
  chemically synthesized
tcccaggctccgagttttcatt

SEQ ID NO: 822648 - DNA, 22 bp, Artificial Sequence
  chemically synthesized
cagtgtcaagagagattttccc

SEQ ID NO: 822649 - DNA, 22 bp, Artificial Sequence
  chemically synthesized
ccagtgtcaagagagattttcc

SEQ ID NO: 822650 - DNA, 22 bp, Artificial Sequence
  chemically synthesized
tccagtgtcaagagagattttc

SEQ ID NO: 822651 - DNA, 22 bp, Artificial Sequence
  chemically synthesized
ttccagtgtcaagagagatttt

SEQ ID NO: 822652 - DNA, 22 bp, Artificial Sequence
  chemically synthesized
ggagcctgggaaaatctctctt

SEQ ID NO: 822653 - DNA, 22 bp, Artificial Sequence
  chemically synthesized
ttttccagtgtcaagagagatt

SEQ ID NO: 822654 - DNA, 22 bp, Artificial Sequence
  chemically synthesized
cttttccagtgtcaagagagat

SEQ ID NO: 822655 - DNA, 22 bp, Artificial Sequence
  chemically synthesized
tcttttccagtgtcaagagaga

SEQ ID NO: 822656 - DNA, 22 bp, Artificial Sequence
  chemically synthesized
aactttcttttccagtgtcaag

SEQ ID NO: 822657 - DNA, 22 bp, Artificial Sequence
  chemically synthesized
ggaaaatctctcttgacactgg

SEQ ID NO: 822658 - DNA, 22 bp, Artificial Sequence
  chemically synthesized
aaactttcttttccagtgtcaa

SEQ ID NO: 822659 - DNA, 22 bp, Artificial Sequence
  chemically synthesized
taaactttcttttccagtgtca

SEQ ID NO: 822660 - DNA, 22 bp, Artificial Sequence
  chemically synthesized
atcgttttaaactttcttttcc

SEQ ID NO: 822661 - DNA, 22 bp, Artificial Sequence
  chemically synthesized
gatcgttttaaactttcttttc

SEQ ID NO: 822662 - DNA, 22 bp, Artificial Sequence
  chemically synthesized
tcttgacactggaaaagaaagt

SEQ ID NO: 822663 - DNA, 22 bp, Artificial Sequence
  chemically synthesized
ttgatcgttttaaactttcttt

SEQ ID NO: 822664 - DNA, 22 bp, Artificial Sequence
  chemically synthesized
ttgacactggaaaagaaagttt

SEQ ID NO: 822665 - DNA, 22 bp, Artificial Sequence
  chemically synthesized
cttgatcgttttaaactttctt

SEQ ID NO: 822666 - DNA, 22 bp, Artificial Sequence
  chemically synthesized
gacactggaaaagaaagtttaa

SEQ ID NO: 822667 - DNA, 22 bp, Artificial Sequence
  chemically synthesized
acactggaaaagaaagtttaaa

SEQ ID NO: 822668 - DNA, 22 bp, Artificial Sequence
  chemically synthesized
tttcttgatcgttttaaacttt

SEQ ID NO: 822669 - DNA, 22 bp, Artificial Sequence
  chemically synthesized
gaaaagaaagtttaaaacgatc

SEQ ID NO: 822670 - DNA, 22 bp, Artificial Sequence
  chemically synthesized
gaaaaattatttcttgatcgtt

SEQ ID NO: 822671 - DNA, 22 bp, Artificial Sequence
  chemically synthesized
ggaaaaattatttcttgatcgt

SEQ ID NO: 822672 - DNA, 22 bp, Artificial Sequence
  chemically synthesized
tggaaaaattatttcttgatcg

SEQ ID NO: 822673 - DNA, 22 bp, Artificial Sequence
  chemically synthesized
tttggaaaaattatttcttgat

SEQ ID NO: 822674 - DNA, 22 bp, Artificial Sequence
  chemically synthesized
aaaacgatcaagaaataatttt

SEQ ID NO: 822675 - DNA, 22 bp, Artificial Sequence
  chemically synthesized
aaacgatcaagaaataattttt

SEQ ID NO: 822676 - DNA, 22 bp, Artificial Sequence
  chemically synthesized
gcaatggattctttggaaaaat

SEQ ID NO: 822677 - DNA, 22 bp, Artificial Sequence
  chemically synthesized
ggcaatggattctttggaaaaa

SEQ ID NO: 822678 - DNA, 22 bp, Artificial Sequence
  chemically synthesized
gtccaaacttggcaatggattc

SEQ ID NO: 822679 - DNA, 22 bp, Artificial Sequence
  chemically synthesized
ttccaaagaatccattgccaag

SEQ ID NO: 822680 - DNA, 22 bp, Artificial Sequence
  chemically synthesized
tccaaagaatccattgccaagt

SEQ ID NO: 822681 - DNA, 22 bp, Artificial Sequence
  chemically synthesized
agattggtccaaacttggcaat

SEQ ID NO: 822682 - DNA, 22 bp, Artificial Sequence
  chemically synthesized
ccaaagaatccattgccaagtt

SEQ ID NO: 822683 - DNA, 22 bp, Artificial Sequence
  chemically synthesized
aagattggtccaaacttggcaa

SEQ ID NO: 822684 - DNA, 22 bp, Artificial Sequence
  chemically synthesized
caaagaatccattgccaagttt

SEQ ID NO: 822685 - DNA, 22 bp, Artificial Sequence
  chemically synthesized
taagattggtccaaacttggca

SEQ ID NO: 822686 - DNA, 22 bp, Artificial Sequence
  chemically synthesized
ttaagattggtccaaacttggc

SEQ ID NO: 822687 - DNA, 22 bp, Artificial Sequence
  chemically synthesized
ggcttttaagattggtccaaac

SEQ ID NO: 822688 - DNA, 22 bp, Artificial Sequence
  chemically synthesized
cctaggcttttaagattggtcc

SEQ ID NO: 822689 - DNA, 22 bp, Artificial Sequence
  chemically synthesized
ttccctaggcttttaagattgg

SEQ ID NO: 822690 - DNA, 22 bp, Artificial Sequence
  chemically synthesized
ccaagtttggaccaatcttaaa

SEQ ID NO: 822691 - DNA, 22 bp, Artificial Sequence
  chemically synthesized
ataacctgttccctaggctttt

SEQ ID NO: 822692 - DNA, 22 bp, Artificial Sequence
  chemically synthesized
ggaccaatcttaaaagcctagg

SEQ ID NO: 822693 - DNA, 22 bp, Artificial Sequence
  chemically synthesized
gaccaatcttaaaagcctaggg

SEQ ID NO: 822694 - DNA, 22 bp, Artificial Sequence
  chemically synthesized
agttcataacctgttccctagg

SEQ ID NO: 822695 - DNA, 22 bp, Artificial Sequence
  chemically synthesized
gttgagttcataacctgttccc

SEQ ID NO: 822696 - DNA, 22 bp, Artificial Sequence
  chemically synthesized
ggttgagttcataacctgttcc

SEQ ID NO: 822697 - DNA, 22 bp, Artificial Sequence
  chemically synthesized
aaaagcctagggaacaggttat

SEQ ID NO: 822698 - DNA, 22 bp, Artificial Sequence
  chemically synthesized
ttggttgagttcataacctgtt

SEQ ID NO: 822699 - DNA, 22 bp, Artificial Sequence
  chemically synthesized
aaagcctagggaacaggttatg

SEQ ID NO: 822700 - DNA, 22 bp, Artificial Sequence
  chemically synthesized
gcggattcttggttgagttcat

SEQ ID NO: 822701 - DNA, 22 bp, Artificial Sequence
  chemically synthesized
gggaacaggttatgaactcaac

SEQ ID NO: 822702 - DNA, 22 bp, Artificial Sequence
  chemically synthesized
ggcggattcttggttgagttca

SEQ ID NO: 822703 - DNA, 22 bp, Artificial Sequence
  chemically synthesized
atttggcggattcttggttgag

SEQ ID NO: 822704 - DNA, 22 bp, Artificial Sequence
  chemically synthesized
catttggcggattcttggttga

SEQ ID NO: 822705 - DNA, 22 bp, Artificial Sequence
  chemically synthesized
tttcatttggcggattcttggt

SEQ ID NO: 822706 - DNA, 22 bp, Artificial Sequence
  chemically synthesized
atttcatttggcggattcttgg

SEQ ID NO: 822707 - DNA, 22 bp, Artificial Sequence
  chemically synthesized
tgaactcaaccaagaatccgcc

SEQ ID NO: 822708 - DNA, 22 bp, Artificial Sequence
  chemically synthesized
aaccaagaatccgccaaatgaa

SEQ ID NO: 822709 - DNA, 22 bp, Artificial Sequence
  chemically synthesized
ccaacagtgatcatcataggat

SEQ ID NO: 822710 - DNA, 22 bp, Artificial Sequence
  chemically synthesized
aaactgccaacagtgatcatca

SEQ ID NO: 822711 - DNA, 22 bp, Artificial Sequence
  chemically synthesized
gcacctaaaactgccaacagtg

SEQ ID NO: 822712 - DNA, 22 bp, Artificial Sequence
  chemically synthesized
tgatgatcactgttggcagttt

SEQ ID NO: 822713 - DNA, 22 bp, Artificial Sequence
  chemically synthesized
ttggcagttttaggtgccaatg

SEQ ID NO: 822714 - DNA, 22 bp, Artificial Sequence
  chemically synthesized
gcagttttaggtgccaatggca

SEQ ID NO: 822715 - DNA, 22 bp, Artificial Sequence
  chemically synthesized
taggtgccaatggcatactatt

SEQ ID NO: 822716 - DNA, 22 bp, Artificial Sequence
  chemically synthesized
acaagaggcaaaaatagtatgc

SEQ ID NO: 822717 - DNA, 22 bp, Artificial Sequence
  chemically synthesized
aggtgccaatggcatactattt

SEQ ID NO: 822718 - DNA, 22 bp, Artificial Sequence
  chemically synthesized
cacaagaggcaaaaatagtatg

SEQ ID NO: 822719 - DNA, 22 bp, Artificial Sequence
  chemically synthesized
ggtgccaatggcatactatttt

SEQ ID NO: 822720 - DNA, 22 bp, Artificial Sequence
  chemically synthesized
tcacaagaggcaaaaatagtat

SEQ ID NO: 822721 - DNA, 22 bp, Artificial Sequence
  chemically synthesized
gaactttcacaagaggcaaaaa

SEQ ID NO: 822722 - DNA, 22 bp, Artificial Sequence
  chemically synthesized
agaactttcacaagaggcaaaa

SEQ ID NO: 822723 - DNA, 22 bp, Artificial Sequence
  chemically synthesized
tttttgcctcttgtgaaagttc

SEQ ID NO: 822724 - DNA, 22 bp, Artificial Sequence
  chemically synthesized
ttgcctcttgtgaaagttctaa

SEQ ID NO: 822725 - DNA, 22 bp, Artificial Sequence
  chemically synthesized
tgcctcttgtgaaagttctaaa

SEQ ID NO: 822726 - DNA, 22 bp, Artificial Sequence
  chemically synthesized
gcctcttgtgaaagttctaaat

SEQ ID NO: 822727 - DNA, 22 bp, Artificial Sequence
  chemically synthesized
cctcttgtgaaagttctaaatg

SEQ ID NO: 822728 - DNA, 22 bp, Artificial Sequence
  chemically synthesized
tgagagatgatgccatttagaa

SEQ ID NO: 822729 - DNA, 22 bp, Artificial Sequence
  chemically synthesized
ttgtgaaagttctaaatggcat

SEQ ID NO: 822730 - DNA, 22 bp, Artificial Sequence
  chemically synthesized
gtgaaagttctaaatggcatca

SEQ ID NO: 822731 - DNA, 22 bp, Artificial Sequence
  chemically synthesized
tgaaagttctaaatggcatcat

SEQ ID NO: 822732 - DNA, 22 bp, Artificial Sequence
  chemically synthesized
tgacagaatcctatgagagatg

SEQ ID NO: 822733 - DNA, 22 bp, Artificial Sequence
  chemically synthesized
taaatggcatcatctctcatag

SEQ ID NO: 822734 - DNA, 22 bp, Artificial Sequence
  chemically synthesized
aatggcatcatctctcatagga

SEQ ID NO: 822735 - DNA, 22 bp, Artificial Sequence
  chemically synthesized
ccaataggctatgacagaatcc

SEQ ID NO: 822736 - DNA, 22 bp, Artificial Sequence
  chemically synthesized
gccaataggctatgacagaatc

SEQ ID NO: 822737 - DNA, 22 bp, Artificial Sequence
  chemically synthesized
tgccaataggctatgacagaat

SEQ ID NO: 822738 - DNA, 22 bp, Artificial Sequence
  chemically synthesized
tcataggattctgtcatagcct

SEQ ID NO: 822739 - DNA, 22 bp, Artificial Sequence
  chemically synthesized
ataggattctgtcatagcctat

SEQ ID NO: 822740 - DNA, 22 bp, Artificial Sequence
  chemically synthesized
atcaaaatctttgccaataggc

SEQ ID NO: 822741 - DNA, 22 bp, Artificial Sequence
  chemically synthesized
taatcaaaatctttgccaatag

SEQ ID NO: 822742 - DNA, 22 bp, Artificial Sequence
  chemically synthesized
tgtcatagcctattggcaaaga

SEQ ID NO: 822743 - DNA, 22 bp, Artificial Sequence
  chemically synthesized
attctaatcaaaatctttgcca

SEQ ID NO: 822744 - DNA, 22 bp, Artificial Sequence
  chemically synthesized
tcatagcctattggcaaagatt

SEQ ID NO: 822745 - DNA, 22 bp, Artificial Sequence
  chemically synthesized
cattctaatcaaaatctttgcc

SEQ ID NO: 822746 - DNA, 22 bp, Artificial Sequence
  chemically synthesized
tcattctaatcaaaatctttgc

SEQ ID NO: 822747 - DNA, 22 bp, Artificial Sequence
  chemically synthesized
ttggcaaagattttgattagaa

SEQ ID NO: 822748 - DNA, 22 bp, Artificial Sequence
  chemically synthesized
gcaaagattttgattagaatga

SEQ ID NO: 822749 - DNA, 22 bp, Artificial Sequence
  chemically synthesized
ggcaaaaacatacaagattttc

SEQ ID NO: 822750 - DNA, 22 bp, Artificial Sequence
  chemically synthesized
tgattagaatgaaaatcttgta

SEQ ID NO: 822751 - DNA, 22 bp, Artificial Sequence
  chemically synthesized
gattagaatgaaaatcttgtat

SEQ ID NO: 822752 - DNA, 22 bp, Artificial Sequence
  chemically synthesized
attagaatgaaaatcttgtatg

SEQ ID NO: 822753 - DNA, 22 bp, Artificial Sequence
  chemically synthesized
gaatgaaaatcttgtatgtttt

SEQ ID NO: 822754 - DNA, 22 bp, Artificial Sequence
  chemically synthesized
agatagaaagacagatgttagg

SEQ ID NO: 822755 - DNA, 22 bp, Artificial Sequence
  chemically synthesized
gtatgtttttgcctaacatctg

SEQ ID NO: 822756 - DNA, 22 bp, Artificial Sequence
  chemically synthesized
gagatagaaagacagatgttag

SEQ ID NO: 822757 - DNA, 22 bp, Artificial Sequence
  chemically synthesized
tatgtttttgcctaacatctgt

SEQ ID NO: 822758 - DNA, 22 bp, Artificial Sequence
  chemically synthesized
tgagatagaaagacagatgtta

SEQ ID NO: 822759 - DNA, 22 bp, Artificial Sequence
  chemically synthesized
ttgagatagaaagacagatgtt

SEQ ID NO: 822760 - DNA, 22 bp, Artificial Sequence
  chemically synthesized
ttttgagatagaaagacagatg

SEQ ID NO: 822761 - DNA, 22 bp, Artificial Sequence
  chemically synthesized
ttgcctaacatctgtctttcta

SEQ ID NO: 822762 - DNA, 22 bp, Artificial Sequence
  chemically synthesized
tgcctaacatctgtctttctat

SEQ ID NO: 822763 - DNA, 22 bp, Artificial Sequence
  chemically synthesized
gcctaacatctgtctttctatc

SEQ ID NO: 822764 - DNA, 22 bp, Artificial Sequence
  chemically synthesized
cctaacatctgtctttctatct

SEQ ID NO: 822765 - DNA, 22 bp, Artificial Sequence
  chemically synthesized
acatctgtctttctatctcaaa

SEQ ID NO: 822766 - DNA, 22 bp, Artificial Sequence
  chemically synthesized
gtacaacaataaagttcttttg

SEQ ID NO: 822767 - DNA, 22 bp, Artificial Sequence
  chemically synthesized
tctttctatctcaaaagaactt

SEQ ID NO: 822768 - DNA, 22 bp, Artificial Sequence
  chemically synthesized
tctatctcaaaagaactttatt

SEQ ID NO: 822769 - DNA, 22 bp, Artificial Sequence
  chemically synthesized
ctatctcaaaagaactttattg

SEQ ID NO: 822770 - DNA, 22 bp, Artificial Sequence
  chemically synthesized
tatctcaaaagaactttattgt

SEQ ID NO: 822771 - DNA, 22 bp, Artificial Sequence
  chemically synthesized
tgggcctggtacaacaataaag

SEQ ID NO: 822772 - DNA, 22 bp, Artificial Sequence
  chemically synthesized
tctcaaaagaactttattgttg

SEQ ID NO: 822773 - DNA, 22 bp, Artificial Sequence
  chemically synthesized
tatgggcctggtacaacaataa

SEQ ID NO: 822774 - DNA, 22 bp, Artificial Sequence
  chemically synthesized
tctatgggcctggtacaacaat

SEQ ID NO: 822775 - DNA, 22 bp, Artificial Sequence
  chemically synthesized
aaaagaactttattgttgtacc

SEQ ID NO: 822776 - DNA, 22 bp, Artificial Sequence
  chemically synthesized
ctctatgggcctggtacaacaa

SEQ ID NO: 822777 - DNA, 22 bp, Artificial Sequence
  chemically synthesized
tcttctctatgggcctggtaca

SEQ ID NO: 822778 - DNA, 22 bp, Artificial Sequence
  chemically synthesized
atcttctctatgggcctggtac

SEQ ID NO: 822779 - DNA, 22 bp, Artificial Sequence
  chemically synthesized
tatcttctctatgggcctggta

SEQ ID NO: 822780 - DNA, 22 bp, Artificial Sequence
  chemically synthesized
tattgttgtaccaggcccatag

SEQ ID NO: 822781 - DNA, 22 bp, Artificial Sequence
  chemically synthesized
attttatcttctctatgggcct

SEQ ID NO: 822782 - DNA, 22 bp, Artificial Sequence
  chemically synthesized
attgttgtaccaggcccataga

SEQ ID NO: 822783 - DNA, 22 bp, Artificial Sequence
  chemically synthesized
aattttatcttctctatgggcc

SEQ ID NO: 822784 - DNA, 22 bp, Artificial Sequence
  chemically synthesized
ttgttgtaccaggcccatagag

SEQ ID NO: 822785 - DNA, 22 bp, Artificial Sequence
  chemically synthesized
ttgtaccaggcccatagagaag

SEQ ID NO: 822786 - DNA, 22 bp, Artificial Sequence
  chemically synthesized
taccaggcccatagagaagata

SEQ ID NO: 822787 - DNA, 22 bp, Artificial Sequence
  chemically synthesized
atggtttaattttatcttctct

SEQ ID NO: 822788 - DNA, 22 bp, Artificial Sequence
  chemically synthesized
catggtttaattttatcttctc

SEQ ID NO: 822789 - DNA, 22 bp, Artificial Sequence
  chemically synthesized
gccacatggcttcatggtttaa

SEQ ID NO: 822790 - DNA, 22 bp, Artificial Sequence
  chemically synthesized
ttagccacatggcttcatggtt

SEQ ID NO: 822791 - DNA, 22 bp, Artificial Sequence
  chemically synthesized
gttagccacatggcttcatggt

SEQ ID NO: 822792 - DNA, 22 bp, Artificial Sequence
  chemically synthesized
tgttagccacatggcttcatgg

SEQ ID NO: 822793 - DNA, 22 bp, Artificial Sequence
  chemically synthesized
attttgttagccacatggcttc

SEQ ID NO: 822794 - DNA, 22 bp, Artificial Sequence
  chemically synthesized
aaccatgaagccatgtggctaa

SEQ ID NO: 822795 - DNA, 22 bp, Artificial Sequence
  chemically synthesized
gaaagtagttaattttgttagc

SEQ ID NO: 822796 - DNA, 22 bp, Artificial Sequence
  chemically synthesized
acaaaattaactactttctaac

SEQ ID NO: 822797 - DNA, 22 bp, Artificial Sequence
  chemically synthesized
aaacaaaaacatgaagttagaa

SEQ ID NO: 822798 - DNA, 22 bp, Artificial Sequence
  chemically synthesized
taaaacaaaaacatgaagttag

SEQ ID NO: 822799 - DNA, 22 bp, Artificial Sequence
  chemically synthesized
ctaaaacaaaaacatgaagtta

SEQ ID NO: 822800 - DNA, 22 bp, Artificial Sequence
  chemically synthesized
tctaaaacaaaaacatgaagtt

SEQ ID NO: 822801 - DNA, 22 bp, Artificial Sequence
  chemically synthesized
ttctaaaacaaaaacatgaagt

SEQ ID NO: 822802 - DNA, 22 bp, Artificial Sequence
  chemically synthesized
actactttctaacttcatgttt

SEQ ID NO: 822803 - DNA, 22 bp, Artificial Sequence
  chemically synthesized
tttctaaaacaaaaacatgaag

SEQ ID NO: 822804 - DNA, 22 bp, Artificial Sequence
  chemically synthesized
ctttctaacttcatgtttttgt

SEQ ID NO: 822805 - DNA, 22 bp, Artificial Sequence
  chemically synthesized
attttttctaaaacaaaaacat

SEQ ID NO: 822806 - DNA, 22 bp, Artificial Sequence
  chemically synthesized
aattttttctaaaacaaaaaca

SEQ ID NO: 822807 - DNA, 22 bp, Artificial Sequence
  chemically synthesized
tctaacttcatgtttttgtttt

SEQ ID NO: 822808 - DNA, 22 bp, Artificial Sequence
  chemically synthesized
ctaacttcatgtttttgtttta

SEQ ID NO: 822809 - DNA, 22 bp, Artificial Sequence
  chemically synthesized
taacttcatgtttttgttttag

SEQ ID NO: 822810 - DNA, 22 bp, Artificial Sequence
  chemically synthesized
acttcatgtttttgttttagaa

SEQ ID NO: 822811 - DNA, 22 bp, Artificial Sequence
  chemically synthesized
acccttaattttttctaaaaca

SEQ ID NO: 822812 - DNA, 22 bp, Artificial Sequence
  chemically synthesized
cacccttaattttttctaaaac

SEQ ID NO: 822813 - DNA, 22 bp, Artificial Sequence
  chemically synthesized
tcacccttaattttttctaaaa

SEQ ID NO: 822814 - DNA, 22 bp, Artificial Sequence
  chemically synthesized
catgtttttgttttagaaaaaa

SEQ ID NO: 822815 - DNA, 22 bp, Artificial Sequence
  chemically synthesized
tttcacccttaattttttctaa

SEQ ID NO: 822816 - DNA, 22 bp, Artificial Sequence
  chemically synthesized
atgtttttgttttagaaaaaat

SEQ ID NO: 822817 - DNA, 22 bp, Artificial Sequence
  chemically synthesized
ctttcacccttaattttttcta

SEQ ID NO: 822818 - DNA, 22 bp, Artificial Sequence
  chemically synthesized
tctttcacccttaattttttct

SEQ ID NO: 822819 - DNA, 22 bp, Artificial Sequence
  chemically synthesized
ttttctttcacccttaattttt

SEQ ID NO: 822820 - DNA, 22 bp, Artificial Sequence
  chemically synthesized
ttgttttagaaaaaattaaggg

SEQ ID NO: 822821 - DNA, 22 bp, Artificial Sequence
  chemically synthesized
tgttttagaaaaaattaagggt

SEQ ID NO: 822822 - DNA, 22 bp, Artificial Sequence
  chemically synthesized
gttttagaaaaaattaagggtg

SEQ ID NO: 822823 - DNA, 22 bp, Artificial Sequence
  chemically synthesized
ttttagaaaaaattaagggtga

SEQ ID NO: 822824 - DNA, 22 bp, Artificial Sequence
  chemically synthesized
gtaattgttttctttcaccctt

SEQ ID NO: 822825 - DNA, 22 bp, Artificial Sequence
  chemically synthesized
tagaaaaaattaagggtgaaag

SEQ ID NO: 822826 - DNA, 22 bp, Artificial Sequence
  chemically synthesized
agaaaaaattaagggtgaaaga

SEQ ID NO: 822827 - DNA, 22 bp, Artificial Sequence
  chemically synthesized
gaaaaaattaagggtgaaagaa

SEQ ID NO: 822828 - DNA, 22 bp, Artificial Sequence
  chemically synthesized
agggtgaaagaaaacaattacc

SEQ ID NO: 822829 - DNA, 22 bp, Artificial Sequence
  chemically synthesized
gcaggccatcaagagacggcca

SEQ ID NO: 822830 - DNA, 22 bp, Artificial Sequence
  chemically synthesized
ccaatatgttatggccgtctct

SEQ ID NO: 822831 - DNA, 22 bp, Artificial Sequence
  chemically synthesized
attagcaggccatcaagagacg

SEQ ID NO: 822832 - DNA, 22 bp, Artificial Sequence
  chemically synthesized
tggccgtctcttgatggcctgc

SEQ ID NO: 822833 - DNA, 22 bp, Artificial Sequence
  chemically synthesized
ttgatggcctgctaattaattg

SEQ ID NO: 822834 - DNA, 22 bp, Artificial Sequence
  chemically synthesized
gatggcctgctaattaattgtt

SEQ ID NO: 822835 - DNA, 22 bp, Artificial Sequence
  chemically synthesized
atggcctgctaattaattgttg

SEQ ID NO: 822836 - DNA, 22 bp, Artificial Sequence
  chemically synthesized
ctaattaattgttgatactcta

SEQ ID NO: 822837 - DNA, 22 bp, Artificial Sequence
  chemically synthesized
attaattgttgatactctatgc

SEQ ID NO: 822838 - DNA, 22 bp, Artificial Sequence
  chemically synthesized
attgttgatactctatgccatc

SEQ ID NO: 822839 - DNA, 22 bp, Artificial Sequence
  chemically synthesized
ttgatactctatgccatctgca

SEQ ID NO: 822840 - DNA, 22 bp, Artificial Sequence
  chemically synthesized
gtgaaaaaacagaatgcagatg

SEQ ID NO: 822841 - DNA, 22 bp, Artificial Sequence
  chemically synthesized
atactctatgccatctgcattc

SEQ ID NO: 822842 - DNA, 22 bp, Artificial Sequence
  chemically synthesized
ggtgaaaaaacagaatgcagat

SEQ ID NO: 822843 - DNA, 22 bp, Artificial Sequence
  chemically synthesized
atttggtgaaaaaacagaatgc

SEQ ID NO: 822844 - DNA, 22 bp, Artificial Sequence
  chemically synthesized
gatttggtgaaaaaacagaatg

SEQ ID NO: 822845 - DNA, 22 bp, Artificial Sequence
  chemically synthesized
tatgccatctgcattctgtttt

SEQ ID NO: 822846 - DNA, 22 bp, Artificial Sequence
  chemically synthesized
tgccatctgcattctgtttttt

SEQ ID NO: 822847 - DNA, 22 bp, Artificial Sequence
  chemically synthesized
cattctgttttttcaccaaatc

SEQ ID NO: 822848 - DNA, 22 bp, Artificial Sequence
  chemically synthesized
tgttttttcaccaaatcaagac

SEQ ID NO: 822849 - DNA, 22 bp, Artificial Sequence
  chemically synthesized
ttttttcaccaaatcaagactc

SEQ ID NO: 822850 - DNA, 22 bp, Artificial Sequence
  chemically synthesized
tttcaccaaatcaagactctcc

SEQ ID NO: 822851 - DNA, 22 bp, Artificial Sequence
  chemically synthesized
ttcaccaaatcaagactctcct

SEQ ID NO: 822852 - DNA, 22 bp, Artificial Sequence
  chemically synthesized
tcaccaaatcaagactctcctg

SEQ ID NO: 822853 - DNA, 22 bp, Artificial Sequence
  chemically synthesized
caccaaatcaagactctcctgt

SEQ ID NO: 822854 - DNA, 22 bp, Artificial Sequence
  chemically synthesized
accaaatcaagactctcctgtt

SEQ ID NO: 822855 - DNA, 22 bp, Artificial Sequence
  chemically synthesized
tcctgttgctgtttctttccac

SEQ ID NO: 822856 - DNA, 22 bp, Artificial Sequence
  chemically synthesized
ctgttgctgtttctttccactc

SEQ ID NO: 822857 - DNA, 22 bp, Artificial Sequence
  chemically synthesized
aaagcgtggtcagagtggaaag

SEQ ID NO: 822858 - DNA, 22 bp, Artificial Sequence
  chemically synthesized
gaaagcgtggtcagagtggaaa

SEQ ID NO: 822859 - DNA, 22 bp, Artificial Sequence
  chemically synthesized
ttgctgtttctttccactctga

SEQ ID NO: 822860 - DNA, 22 bp, Artificial Sequence
  chemically synthesized
tcttgaaagcgtggtcagagtg

SEQ ID NO: 822861 - DNA, 22 bp, Artificial Sequence
  chemically synthesized
ctgtttctttccactctgacca

SEQ ID NO: 822862 - DNA, 22 bp, Artificial Sequence
  chemically synthesized
atcttgaaagcgtggtcagagt

SEQ ID NO: 822863 - DNA, 22 bp, Artificial Sequence
  chemically synthesized
tttctttccactctgaccacgc

SEQ ID NO: 822864 - DNA, 22 bp, Artificial Sequence
  chemically synthesized
ctttccactctgaccacgcttt

SEQ ID NO: 822865 - DNA, 22 bp, Artificial Sequence
  chemically synthesized
tttccactctgaccacgctttc

SEQ ID NO: 822866 - DNA, 22 bp, Artificial Sequence
  chemically synthesized
tccactctgaccacgctttcaa

SEQ ID NO: 822867 - DNA, 22 bp, Artificial Sequence
  chemically synthesized
ccactctgaccacgctttcaag

SEQ ID NO: 822868 - DNA, 22 bp, Artificial Sequence
  chemically synthesized
cactctgaccacgctttcaaga

SEQ ID NO: 822869 - DNA, 22 bp, Artificial Sequence
  chemically synthesized
tgaccacgctttcaagataagc

SEQ ID NO: 822870 - DNA, 22 bp, Artificial Sequence
  chemically synthesized
accacgctttcaagataagctt

SEQ ID NO: 822871 - DNA, 22 bp, Artificial Sequence
  chemically synthesized
tcaagataagctttttccacat

SEQ ID NO: 822872 - DNA, 22 bp, Artificial Sequence
  chemically synthesized
caagataagctttttccacatg

SEQ ID NO: 822873 - DNA, 22 bp, Artificial Sequence
  chemically synthesized
aagataagctttttccacatga

SEQ ID NO: 822874 - DNA, 22 bp, Artificial Sequence
  chemically synthesized
tttccacatgacatctccggtt

SEQ ID NO: 822875 - DNA, 22 bp, Artificial Sequence
  chemically synthesized
ttccacatgacatctccggttt

SEQ ID NO: 822876 - DNA, 22 bp, Artificial Sequence
  chemically synthesized
tccacatgacatctccggtttt

SEQ ID NO: 822877 - DNA, 22 bp, Artificial Sequence
  chemically synthesized
ccacatgacatctccggtttta

SEQ ID NO: 822878 - DNA, 22 bp, Artificial Sequence
  chemically synthesized
acagaacagaaataaaaccgga

SEQ ID NO: 822879 - DNA, 22 bp, Artificial Sequence
  chemically synthesized
cacatgacatctccggttttat

SEQ ID NO: 822880 - DNA, 22 bp, Artificial Sequence
  chemically synthesized
ttcacagaacagaaataaaacc

SEQ ID NO: 822881 - DNA, 22 bp, Artificial Sequence
  chemically synthesized
cggttttatttctgttctgtga

SEQ ID NO: 822882 - DNA, 22 bp, Artificial Sequence
  chemically synthesized
tatttctgttctgtgaataggt

SEQ ID NO: 822883 - DNA, 22 bp, Artificial Sequence
  chemically synthesized
atttctgttctgtgaataggtt

SEQ ID NO: 822884 - DNA, 22 bp, Artificial Sequence
  chemically synthesized
tttctgttctgtgaataggttg

SEQ ID NO: 822885 - DNA, 22 bp, Artificial Sequence
  chemically synthesized
ctgttctgtgaataggttgtta

SEQ ID NO: 822886 - DNA, 22 bp, Artificial Sequence
  chemically synthesized
tgttctgtgaataggttgttat

SEQ ID NO: 822887 - DNA, 22 bp, Artificial Sequence
  chemically synthesized
ttctgtgaataggttgttattg

SEQ ID NO: 822888 - DNA, 22 bp, Artificial Sequence
  chemically synthesized
tgtgaataggttgttattgtcc

SEQ ID NO: 822889 - DNA, 22 bp, Artificial Sequence
  chemically synthesized
tgaataggttgttattgtcccc

SEQ ID NO: 822890 - DNA, 22 bp, Artificial Sequence
  chemically synthesized
ttattgtccccatttattctcc

SEQ ID NO: 822891 - DNA, 22 bp, Artificial Sequence
  chemically synthesized
ttgtccccatttattctcctta

SEQ ID NO: 822892 - DNA, 22 bp, Artificial Sequence
  chemically synthesized
aaaaatacataaataaggagaa

SEQ ID NO: 822893 - DNA, 22 bp, Artificial Sequence
  chemically synthesized
tccccatttattctccttattt

SEQ ID NO: 822894 - DNA, 22 bp, Artificial Sequence
  chemically synthesized
tctcaaaaatacataaataagg

SEQ ID NO: 822895 - DNA, 22 bp, Artificial Sequence
  chemically synthesized
tgtctcaaaaatacataaataa

SEQ ID NO: 822896 - DNA, 22 bp, Artificial Sequence
  chemically synthesized
attctccttatttatgtatttt

SEQ ID NO: 822897 - DNA, 22 bp, Artificial Sequence
  chemically synthesized
ttctccttatttatgtattttt

SEQ ID NO: 822898 - DNA, 22 bp, Artificial Sequence
  chemically synthesized
tccttatttatgtatttttgag

SEQ ID NO: 822899 - DNA, 22 bp, Artificial Sequence
  chemically synthesized
cttatttatgtatttttgagac

SEQ ID NO: 822900 - DNA, 22 bp, Artificial Sequence
  chemically synthesized
atttatgtatttttgagacaga

SEQ ID NO: 822901 - DNA, 22 bp, Artificial Sequence
  chemically synthesized
tttatgtatttttgagacagag

SEQ ID NO: 822902 - DNA, 22 bp, Artificial Sequence
  chemically synthesized
atgtatttttgagacagagtct

SEQ ID NO: 822903 - DNA, 22 bp, Artificial Sequence
  chemically synthesized
ggtgacagagcaagactctgtc

SEQ ID NO: 822904 - DNA, 22 bp, Artificial Sequence
  chemically synthesized
tgtatttttgagacagagtctt

SEQ ID NO: 822905 - DNA, 22 bp, Artificial Sequence
  chemically synthesized
cagcctgggtgacagagcaaga

SEQ ID NO: 822906 - DNA, 22 bp, Artificial Sequence
  chemically synthesized
ttgagacagagtcttgctctgt

SEQ ID NO: 822907 - DNA, 22 bp, Artificial Sequence
  chemically synthesized
tgagacagagtcttgctctgtc

SEQ ID NO: 822908 - DNA, 22 bp, Artificial Sequence
  chemically synthesized
gagacagagtcttgctctgtca

SEQ ID NO: 822909 - DNA, 22 bp, Artificial Sequence
  chemically synthesized
agacagagtcttgctctgtcac

SEQ ID NO: 822910 - DNA, 22 bp, Artificial Sequence
  chemically synthesized
cactccagcctgggtgacagag

SEQ ID NO: 822911 - DNA, 22 bp, Artificial Sequence
  chemically synthesized
gctctgtcacccaggctggagt

SEQ ID NO: 822912 - DNA, 22 bp, Artificial Sequence
  chemically synthesized
ctctgtcacccaggctggagtg

SEQ ID NO: 822913 - DNA, 22 bp, Artificial Sequence
  chemically synthesized
tgtcacccaggctggagtgcag

SEQ ID NO: 822914 - DNA, 22 bp, Artificial Sequence
  chemically synthesized
tcacccaggctggagtgcagtg

SEQ ID NO: 822915 - DNA, 22 bp, Artificial Sequence
  chemically synthesized
cagtgagccaagatcacgccac

SEQ ID NO: 822916 - DNA, 22 bp, Artificial Sequence
  chemically synthesized
gagtgcagtggcgtgatcttgg

SEQ ID NO: 822917 - DNA, 22 bp, Artificial Sequence
  chemically synthesized
aacccgggaggcggaggttgca

SEQ ID NO: 822918 - DNA, 22 bp, Artificial Sequence
  chemically synthesized
gaacccgggaggcggaggttgc

SEQ ID NO: 822919 - DNA, 22 bp, Artificial Sequence
  chemically synthesized
ggctcactgcaacctccgcctc

SEQ ID NO: 822920 - DNA, 22 bp, Artificial Sequence
  chemically synthesized
gctcactgcaacctccgcctcc

SEQ ID NO: 822921 - DNA, 22 bp, Artificial Sequence
  chemically synthesized
actgcaacctccgcctcccggg

SEQ ID NO: 822922 - DNA, 22 bp, Artificial Sequence
  chemically synthesized
caacctccgcctcccgggttca

SEQ ID NO: 822923 - DNA, 22 bp, Artificial Sequence
  chemically synthesized
aggcaggggaatcgcttgaacc

SEQ ID NO: 822924 - DNA, 22 bp, Artificial Sequence
  chemically synthesized
cgcctcccgggttcaagcgatt

SEQ ID NO: 822925 - DNA, 22 bp, Artificial Sequence
  chemically synthesized
ggaggctgaggcaggggaatcg

SEQ ID NO: 822926 - DNA, 22 bp, Artificial Sequence
  chemically synthesized
ccgggttcaagcgattcccctg

SEQ ID NO: 822927 - DNA, 22 bp, Artificial Sequence
  chemically synthesized
gggaggctgaggcaggggaatc

SEQ ID NO: 822928 - DNA, 22 bp, Artificial Sequence
  chemically synthesized
cttgggaggctgaggcagggga

SEQ ID NO: 822929 - DNA, 22 bp, Artificial Sequence
  chemically synthesized
aagcgattcccctgcctcagcc

SEQ ID NO: 822930 - DNA, 22 bp, Artificial Sequence
  chemically synthesized
tagtcccagctacttgggaggc

SEQ ID NO: 822931 - DNA, 22 bp, Artificial Sequence
  chemically synthesized
ccctgcctcagcctcccaagta

SEQ ID NO: 822932 - DNA, 22 bp, Artificial Sequence
  chemically synthesized
cctcagcctcccaagtagctgg

SEQ ID NO: 822933 - DNA, 22 bp, Artificial Sequence
  chemically synthesized
catgcctgtagtcccagctact

SEQ ID NO: 822934 - DNA, 22 bp, Artificial Sequence
  chemically synthesized
agcctcccaagtagctgggact

SEQ ID NO: 822935 - DNA, 22 bp, Artificial Sequence
  chemically synthesized
ccaagtagctgggactacaggc

SEQ ID NO: 822936 - DNA, 22 bp, Artificial Sequence
  chemically synthesized
gcgtggtgctgcatgcctgtag

SEQ ID NO: 822937 - DNA, 22 bp, Artificial Sequence
  chemically synthesized
gcctggcgtggtgctgcatgcc

SEQ ID NO: 822938 - DNA, 22 bp, Artificial Sequence
  chemically synthesized
ggactacaggcatgcagcacca

SEQ ID NO: 822939 - DNA, 22 bp, Artificial Sequence
  chemically synthesized
caggcatgcagcaccacgccag

SEQ ID NO: 822940 - DNA, 22 bp, Artificial Sequence
  chemically synthesized
aaaatacaaaaactagcctggc

SEQ ID NO: 822941 - DNA, 22 bp, Artificial Sequence
  chemically synthesized
ctaaaaatacaaaaactagcct

SEQ ID NO: 822942 - DNA, 22 bp, Artificial Sequence
  chemically synthesized
tactaaaaatacaaaaactagc

SEQ ID NO: 822943 - DNA, 22 bp, Artificial Sequence
  chemically synthesized
tctctactaaaaatacaaaaac

SEQ ID NO: 822944 - DNA, 22 bp, Artificial Sequence
  chemically synthesized
gtttttgtatttttagtagaga

SEQ ID NO: 822945 - DNA, 22 bp, Artificial Sequence
  chemically synthesized
ttgtatttttagtagagacagg

SEQ ID NO: 822946 - DNA, 22 bp, Artificial Sequence
  chemically synthesized
tgtatttttagtagagacaggg

SEQ ID NO: 822947 - DNA, 22 bp, Artificial Sequence
  chemically synthesized
gtatttttagtagagacagggt

SEQ ID NO: 822948 - DNA, 22 bp, Artificial Sequence
  chemically synthesized
tatttttagtagagacagggtt

SEQ ID NO: 822949 - DNA, 22 bp, Artificial Sequence
  chemically synthesized
accaacatggtgaaaccctgtc

SEQ ID NO: 822950 - DNA, 22 bp, Artificial Sequence
  chemically synthesized
ttagtagagacagggtttcacc

SEQ ID NO: 822951 - DNA, 22 bp, Artificial Sequence
  chemically synthesized
tagtagagacagggtttcacca

SEQ ID NO: 822952 - DNA, 22 bp, Artificial Sequence
  chemically synthesized
agtagagacagggtttcaccat

SEQ ID NO: 822953 - DNA, 22 bp, Artificial Sequence
  chemically synthesized
gtagagacagggtttcaccatg

SEQ ID NO: 822954 - DNA, 22 bp, Artificial Sequence
  chemically synthesized
agaccggcctgaccaacatggt

SEQ ID NO: 822955 - DNA, 22 bp, Artificial Sequence
  chemically synthesized
gagaccggcctgaccaacatgg

SEQ ID NO: 822956 - DNA, 22 bp, Artificial Sequence
  chemically synthesized
caccatgttggtcaggccggtc

SEQ ID NO: 822957 - DNA, 22 bp, Artificial Sequence
  chemically synthesized
accatgttggtcaggccggtct

SEQ ID NO: 822958 - DNA, 22 bp, Artificial Sequence
  chemically synthesized
gtcaggccggtctcaaactcct

SEQ ID NO: 822959 - DNA, 22 bp, Artificial Sequence
  chemically synthesized
aaactcctgatctcgtgatctg

SEQ ID NO: 822960 - DNA, 22 bp, Artificial Sequence
  chemically synthesized
ggaggccgaggcaggcagatca

SEQ ID NO: 822961 - DNA, 22 bp, Artificial Sequence
  chemically synthesized
gggaggccgaggcaggcagatc

SEQ ID NO: 822962 - DNA, 22 bp, Artificial Sequence
  chemically synthesized
tgggaggccgaggcaggcagat

SEQ ID NO: 822963 - DNA, 22 bp, Artificial Sequence
  chemically synthesized
ctgatctcgtgatctgcctgcc

SEQ ID NO: 822964 - DNA, 22 bp, Artificial Sequence
  chemically synthesized
atctcgtgatctgcctgcctcg

SEQ ID NO: 822965 - DNA, 22 bp, Artificial Sequence
  chemically synthesized
gtgatctgcctgcctcggcctc

SEQ ID NO: 822966 - DNA, 22 bp, Artificial Sequence
  chemically synthesized
taatcccagcactttgggaggc

SEQ ID NO: 822967 - DNA, 22 bp, Artificial Sequence
  chemically synthesized
cctgcctcggcctcccaaagtg

SEQ ID NO: 822968 - DNA, 22 bp, Artificial Sequence
  chemically synthesized
cctcggcctcccaaagtgctgg

SEQ ID NO: 822969 - DNA, 22 bp, Artificial Sequence
  chemically synthesized
atacctgtaatcccagcacttt

SEQ ID NO: 822970 - DNA, 22 bp, Artificial Sequence
  chemically synthesized
ggcctcccaaagtgctgggatt

SEQ ID NO: 822971 - DNA, 22 bp, Artificial Sequence
  chemically synthesized
ccaaagtgctgggattacaggt

SEQ ID NO: 822972 - DNA, 22 bp, Artificial Sequence
  chemically synthesized
ggattacaggtatgagccaccg

SEQ ID NO: 822973 - DNA, 22 bp, Artificial Sequence
  chemically synthesized
caggtatgagccaccgcgcccg

SEQ ID NO: 822974 - DNA, 22 bp, Artificial Sequence
  chemically synthesized
gaaaaaaagaatggtgaggccg

SEQ ID NO: 822975 - DNA, 22 bp, Artificial Sequence
  chemically synthesized
agaaaaaaagaatggtgaggcc

SEQ ID NO: 822976 - DNA, 22 bp, Artificial Sequence
  chemically synthesized
tttagaaaaaaagaatggtgag

SEQ ID NO: 822977 - DNA, 22 bp, Artificial Sequence
  chemically synthesized
atttagaaaaaaagaatggtga

SEQ ID NO: 822978 - DNA, 22 bp, Artificial Sequence
  chemically synthesized
tatttagaaaaaaagaatggtg

SEQ ID NO: 822979 - DNA, 22 bp, Artificial Sequence
  chemically synthesized
ttatttagaaaaaaagaatggt

SEQ ID NO: 822980 - DNA, 22 bp, Artificial Sequence
  chemically synthesized
cttttatttagaaaaaaagaat

SEQ ID NO: 822981 - DNA, 22 bp, Artificial Sequence
  chemically synthesized
ctccttttatttagaaaaaaag

SEQ ID NO: 822982 - DNA, 22 bp, Artificial Sequence
  chemically synthesized
accattctttttttctaaataa

SEQ ID NO: 822983 - DNA, 22 bp, Artificial Sequence
  chemically synthesized
gaaaaaactcctccttttattt

SEQ ID NO: 822984 - DNA, 22 bp, Artificial Sequence
  chemically synthesized
agaaaaaactcctccttttatt

SEQ ID NO: 822985 - DNA, 22 bp, Artificial Sequence
  chemically synthesized
tttttttctaaataaaaggagg

SEQ ID NO: 822986 - DNA, 22 bp, Artificial Sequence
  chemically synthesized
tttttctaaataaaaggaggag

SEQ ID NO: 822987 - DNA, 22 bp, Artificial Sequence
  chemically synthesized
ttttctaaataaaaggaggagt

SEQ ID NO: 822988 - DNA, 22 bp, Artificial Sequence
  chemically synthesized
tttctaaataaaaggaggagtt

SEQ ID NO: 822989 - DNA, 22 bp, Artificial Sequence
  chemically synthesized
acatttagaaaaaactcctcct

SEQ ID NO: 822990 - DNA, 22 bp, Artificial Sequence
  chemically synthesized
ttctaaataaaaggaggagttt

SEQ ID NO: 822991 - DNA, 22 bp, Artificial Sequence
  chemically synthesized
tctaaataaaaggaggagtttt

SEQ ID NO: 822992 - DNA, 22 bp, Artificial Sequence
  chemically synthesized
ctaaataaaaggaggagttttt

SEQ ID NO: 822993 - DNA, 22 bp, Artificial Sequence
  chemically synthesized
taaataaaaggaggagtttttt

SEQ ID NO: 822994 - DNA, 22 bp, Artificial Sequence
  chemically synthesized
gtctgacatttagaaaaaactc

SEQ ID NO: 822995 - DNA, 22 bp, Artificial Sequence
  chemically synthesized
aataaaaggaggagttttttct

SEQ ID NO: 822996 - DNA, 22 bp, Artificial Sequence
  chemically synthesized
ctggtctgacatttagaaaaaa

SEQ ID NO: 822997 - DNA, 22 bp, Artificial Sequence
  chemically synthesized
gctggtctgacatttagaaaaa

SEQ ID NO: 822998 - DNA, 22 bp, Artificial Sequence
  chemically synthesized
tgtccttgctggtctgacattt

SEQ ID NO: 822999 - DNA, 22 bp, Artificial Sequence
  chemically synthesized
atgtccttgctggtctgacatt

SEQ ID NO: 823000 - DNA, 22 bp, Artificial Sequence
  chemically synthesized
tatgtccttgctggtctgacat

SEQ ID NO: 823001 - DNA, 22 bp, Artificial Sequence
  chemically synthesized
tttctaaatgtcagaccagcaa

SEQ ID NO: 823002 - DNA, 22 bp, Artificial Sequence
  chemically synthesized
ttctaaatgtcagaccagcaag

SEQ ID NO: 823003 - DNA, 22 bp, Artificial Sequence
  chemically synthesized
catctttatgtccttgctggtc

SEQ ID NO: 823004 - DNA, 22 bp, Artificial Sequence
  chemically synthesized
tctaaatgtcagaccagcaagg

SEQ ID NO: 823005 - DNA, 22 bp, Artificial Sequence
  chemically synthesized
ccatctttatgtccttgctggt

SEQ ID NO: 823006 - DNA, 22 bp, Artificial Sequence
  chemically synthesized
ctaaatgtcagaccagcaagga

SEQ ID NO: 823007 - DNA, 22 bp, Artificial Sequence
  chemically synthesized
taaatgtcagaccagcaaggac

SEQ ID NO: 823008 - DNA, 22 bp, Artificial Sequence
  chemically synthesized
aatgtcagaccagcaaggacat

SEQ ID NO: 823009 - DNA, 22 bp, Artificial Sequence
  chemically synthesized
atttccatctttatgtccttgc

SEQ ID NO: 823010 - DNA, 22 bp, Artificial Sequence
  chemically synthesized
attaatttccatctttatgtcc

SEQ ID NO: 823011 - DNA, 22 bp, Artificial Sequence
  chemically synthesized
cattaatttccatctttatgtc

SEQ ID NO: 823012 - DNA, 22 bp, Artificial Sequence
  chemically synthesized
tttcattaatttccatctttat

SEQ ID NO: 823013 - DNA, 22 bp, Artificial Sequence
  chemically synthesized
tattatttcattaatttccatc

SEQ ID NO: 823014 - DNA, 22 bp, Artificial Sequence
  chemically synthesized
atattatttcattaatttccat

SEQ ID NO: 823015 - DNA, 22 bp, Artificial Sequence
  chemically synthesized
tatattatttcattaatttcca

SEQ ID NO: 823016 - DNA, 22 bp, Artificial Sequence
  chemically synthesized
tttatattatttcattaatttc

SEQ ID NO: 823017 - DNA, 22 bp, Artificial Sequence
  chemically synthesized
ctttatattatttcattaattt

SEQ ID NO: 823018 - DNA, 22 bp, Artificial Sequence
  chemically synthesized
acttctttatattatttcatta

SEQ ID NO: 823019 - DNA, 22 bp, Artificial Sequence
  chemically synthesized
aacttctttatattatttcatt

SEQ ID NO: 823020 - DNA, 22 bp, Artificial Sequence
  chemically synthesized
taacttctttatattatttcat

SEQ ID NO: 823021 - DNA, 22 bp, Artificial Sequence
  chemically synthesized
ttttaacttctttatattattt

SEQ ID NO: 823022 - DNA, 22 bp, Artificial Sequence
  chemically synthesized
ataattattttaacttctttat

SEQ ID NO: 823023 - DNA, 22 bp, Artificial Sequence
  chemically synthesized
aataattattttaacttcttta

SEQ ID NO: 823024 - DNA, 22 bp, Artificial Sequence
  chemically synthesized
atgaaataatataaagaagtta

SEQ ID NO: 823025 - DNA, 22 bp, Artificial Sequence
  chemically synthesized
taataattattttaacttcttt

SEQ ID NO: 823026 - DNA, 22 bp, Artificial Sequence
  chemically synthesized
ttaataattattttaacttctt

SEQ ID NO: 823027 - DNA, 22 bp, Artificial Sequence
  chemically synthesized
aacatcttttaataattatttt

SEQ ID NO: 823028 - DNA, 22 bp, Artificial Sequence
  chemically synthesized
ttaaacatcttttaataattat

SEQ ID NO: 823029 - DNA, 22 bp, Artificial Sequence
  chemically synthesized
tcaatgttgttaaacatctttt

SEQ ID NO: 823030 - DNA, 22 bp, Artificial Sequence
  chemically synthesized
aaataattattaaaagatgttt

SEQ ID NO: 823031 - DNA, 22 bp, Artificial Sequence
  chemically synthesized
atcaatgttgttaaacatcttt

SEQ ID NO: 823032 - DNA, 22 bp, Artificial Sequence
  chemically synthesized
ttaaaagatgtttaacaacatt

SEQ ID NO: 823033 - DNA, 22 bp, Artificial Sequence
  chemically synthesized
cataaatatttatcaatgttgt

SEQ ID NO: 823034 - DNA, 22 bp, Artificial Sequence
  chemically synthesized
aaagatgtttaacaacattgat

SEQ ID NO: 823035 - DNA, 22 bp, Artificial Sequence
  chemically synthesized
atattgcataaatatttatcaa

SEQ ID NO: 823036 - DNA, 22 bp, Artificial Sequence
  chemically synthesized
aatattgcataaatatttatca

SEQ ID NO: 823037 - DNA, 22 bp, Artificial Sequence
  chemically synthesized
aacaacattgataaatatttat

SEQ ID NO: 823038 - DNA, 22 bp, Artificial Sequence
  chemically synthesized
acaacattgataaatatttatg

SEQ ID NO: 823039 - DNA, 22 bp, Artificial Sequence
  chemically synthesized
taaacttaatattgcataaata

SEQ ID NO: 823040 - DNA, 22 bp, Artificial Sequence
  chemically synthesized
gtaaacttaatattgcataaat

SEQ ID NO: 823041 - DNA, 22 bp, Artificial Sequence
  chemically synthesized
atttgtaaacttaatattgcat

SEQ ID NO: 823042 - DNA, 22 bp, Artificial Sequence
  chemically synthesized
ataaatatttatgcaatattaa

SEQ ID NO: 823043 - DNA, 22 bp, Artificial Sequence
  chemically synthesized
tgatttgtaaacttaatattgc

SEQ ID NO: 823044 - DNA, 22 bp, Artificial Sequence
  chemically synthesized
aattctgatttgtaaacttaat

SEQ ID NO: 823045 - DNA, 22 bp, Artificial Sequence
  chemically synthesized
aaattctgatttgtaaacttaa

SEQ ID NO: 823046 - DNA, 22 bp, Artificial Sequence
  chemically synthesized
taaattctgatttgtaaactta

SEQ ID NO: 823047 - DNA, 22 bp, Artificial Sequence
  chemically synthesized
atgcaatattaagtttacaaat

SEQ ID NO: 823048 - DNA, 22 bp, Artificial Sequence
  chemically synthesized
tgcaatattaagtttacaaatc

SEQ ID NO: 823049 - DNA, 22 bp, Artificial Sequence
  chemically synthesized
aattttaaattctgatttgtaa

SEQ ID NO: 823050 - DNA, 22 bp, Artificial Sequence
  chemically synthesized
agtttacaaatcagaatttaaa

SEQ ID NO: 823051 - DNA, 22 bp, Artificial Sequence
  chemically synthesized
acaaatcagaatttaaaattta

SEQ ID NO: 823052 - DNA, 22 bp, Artificial Sequence
  chemically synthesized
cataatgtaaattaaattttaa

SEQ ID NO: 823053 - DNA, 22 bp, Artificial Sequence
  chemically synthesized
caaatcagaatttaaaatttaa

SEQ ID NO: 823054 - DNA, 22 bp, Artificial Sequence
  chemically synthesized
tctacataatgtaaattaaatt

SEQ ID NO: 823055 - DNA, 22 bp, Artificial Sequence
  chemically synthesized
attgtctacataatgtaaatta

SEQ ID NO: 823056 - DNA, 22 bp, Artificial Sequence
  chemically synthesized
aattgtctacataatgtaaatt

SEQ ID NO: 823057 - DNA, 22 bp, Artificial Sequence
  chemically synthesized
taattgtctacataatgtaaat

SEQ ID NO: 823058 - DNA, 22 bp, Artificial Sequence
  chemically synthesized
aaaatttaatttacattatgta

SEQ ID NO: 823059 - DNA, 22 bp, Artificial Sequence
  chemically synthesized
aaatttaatttacattatgtag

SEQ ID NO: 823060 - DNA, 22 bp, Artificial Sequence
  chemically synthesized
catatattttaattgtctacat

SEQ ID NO: 823061 - DNA, 22 bp, Artificial Sequence
  chemically synthesized
aatttacattatgtagacaatt

SEQ ID NO: 823062 - DNA, 22 bp, Artificial Sequence
  chemically synthesized
atttacattatgtagacaatta

SEQ ID NO: 823063 - DNA, 22 bp, Artificial Sequence
  chemically synthesized
tctacatatattttaattgtct

SEQ ID NO: 823064 - DNA, 22 bp, Artificial Sequence
  chemically synthesized
atctacatatattttaattgtc

SEQ ID NO: 823065 - DNA, 22 bp, Artificial Sequence
  chemically synthesized
acattatgtagacaattaaaat

SEQ ID NO: 823066 - DNA, 22 bp, Artificial Sequence
  chemically synthesized
ttatctacatatattttaattg

SEQ ID NO: 823067 - DNA, 22 bp, Artificial Sequence
  chemically synthesized
cattatgtagacaattaaaata

SEQ ID NO: 823068 - DNA, 22 bp, Artificial Sequence
  chemically synthesized
gttcttatctacatatatttta

SEQ ID NO: 823069 - DNA, 22 bp, Artificial Sequence
  chemically synthesized
tgtagacaattaaaatatatgt

SEQ ID NO: 823070 - DNA, 22 bp, Artificial Sequence
  chemically synthesized
tagttcttatctacatatattt

SEQ ID NO: 823071 - DNA, 22 bp, Artificial Sequence
  chemically synthesized
ctagttcttatctacatatatt

SEQ ID NO: 823072 - DNA, 22 bp, Artificial Sequence
  chemically synthesized
ttctagttcttatctacatata

SEQ ID NO: 823073 - DNA, 22 bp, Artificial Sequence
  chemically synthesized
acagtctcttctagttcttatc

SEQ ID NO: 823074 - DNA, 22 bp, Artificial Sequence
  chemically synthesized
aaatatatgtagataagaacta

SEQ ID NO: 823075 - DNA, 22 bp, Artificial Sequence
  chemically synthesized
ttgacagtctcttctagttctt

SEQ ID NO: 823076 - DNA, 22 bp, Artificial Sequence
  chemically synthesized
attgacagtctcttctagttct

SEQ ID NO: 823077 - DNA, 22 bp, Artificial Sequence
  chemically synthesized
tattgacagtctcttctagttc

SEQ ID NO: 823078 - DNA, 22 bp, Artificial Sequence
  chemically synthesized
atctttattgacagtctcttct

SEQ ID NO: 823079 - DNA, 22 bp, Artificial Sequence
  chemically synthesized
ctaatctttattgacagtctct

SEQ ID NO: 823080 - DNA, 22 bp, Artificial Sequence
  chemically synthesized
ataattgctaatctttattgac

SEQ ID NO: 823081 - DNA, 22 bp, Artificial Sequence
  chemically synthesized
gaagagactgtcaataaagatt

SEQ ID NO: 823082 - DNA, 22 bp, Artificial Sequence
  chemically synthesized
atgattcataattgctaatctt

SEQ ID NO: 823083 - DNA, 22 bp, Artificial Sequence
  chemically synthesized
tcaataaagattagcaattatg

SEQ ID NO: 823084 - DNA, 22 bp, Artificial Sequence
  chemically synthesized
ataccaaaaagcaattaatgat

SEQ ID NO: 823085 - DNA, 22 bp, Artificial Sequence
  chemically synthesized
gataccaaaaagcaattaatga

SEQ ID NO: 823086 - DNA, 22 bp, Artificial Sequence
  chemically synthesized
gcaattatgaatcattaattgc

SEQ ID NO: 823087 - DNA, 22 bp, Artificial Sequence
  chemically synthesized
tgaatcattaattgctttttgg

SEQ ID NO: 823088 - DNA, 22 bp, Artificial Sequence
  chemically synthesized
ccaaaaatgcttgataccaaaa

SEQ ID NO: 823089 - DNA, 22 bp, Artificial Sequence
  chemically synthesized
attgctttttggtatcaagcat

SEQ ID NO: 823090 - DNA, 22 bp, Artificial Sequence
  chemically synthesized
ctttttggtatcaagcattttt

SEQ ID NO: 823091 - DNA, 22 bp, Artificial Sequence
  chemically synthesized
tttggtatcaagcatttttggt

SEQ ID NO: 823092 - DNA, 22 bp, Artificial Sequence
  chemically synthesized
ttggtatcaagcatttttggta

SEQ ID NO: 823093 - DNA, 22 bp, Artificial Sequence
  chemically synthesized
tggtatcaagcatttttggtaa

SEQ ID NO: 823094 - DNA, 22 bp, Artificial Sequence
  chemically synthesized
ggtatcaagcatttttggtaat

SEQ ID NO: 823095 - DNA, 22 bp, Artificial Sequence
  chemically synthesized
gtatcaagcatttttggtaatt

SEQ ID NO: 823096 - DNA, 22 bp, Artificial Sequence
  chemically synthesized
aacgtaaaaagaaaattaccaa

SEQ ID NO: 823097 - DNA, 22 bp, Artificial Sequence
  chemically synthesized
ttggtaattttctttttacgtt

SEQ ID NO: 823098 - DNA, 22 bp, Artificial Sequence
  chemically synthesized
tggtaattttctttttacgttc

SEQ ID NO: 823099 - DNA, 22 bp, Artificial Sequence
  chemically synthesized
ggtaattttctttttacgttca

SEQ ID NO: 823100 - DNA, 22 bp, Artificial Sequence
  chemically synthesized
gtaattttctttttacgttcag

SEQ ID NO: 823101 - DNA, 22 bp, Artificial Sequence
  chemically synthesized
agccagtcaccatacctgaacg

SEQ ID NO: 823102 - DNA, 22 bp, Artificial Sequence
  chemically synthesized
gagccagtcaccatacctgaac

SEQ ID NO: 823103 - DNA, 22 bp, Artificial Sequence
  chemically synthesized
tctttttacgttcaggtatggt

SEQ ID NO: 823104 - DNA, 22 bp, Artificial Sequence
  chemically synthesized
ctttttacgttcaggtatggtg

SEQ ID NO: 823105 - DNA, 22 bp, Artificial Sequence
  chemically synthesized
tttttacgttcaggtatggtga

SEQ ID NO: 823106 - DNA, 22 bp, Artificial Sequence
  chemically synthesized
aaatttgagccagtcaccatac

SEQ ID NO: 823107 - DNA, 22 bp, Artificial Sequence
  chemically synthesized
tttacgttcaggtatggtgact

SEQ ID NO: 823108 - DNA, 22 bp, Artificial Sequence
  chemically synthesized
aaaatttgagccagtcaccata

SEQ ID NO: 823109 - DNA, 22 bp, Artificial Sequence
  chemically synthesized
ttacgttcaggtatggtgactg

SEQ ID NO: 823110 - DNA, 22 bp, Artificial Sequence
  chemically synthesized
tacgttcaggtatggtgactgg

SEQ ID NO: 823111 - DNA, 22 bp, Artificial Sequence
  chemically synthesized
ttaaaatttgagccagtcacca

SEQ ID NO: 823112 - DNA, 22 bp, Artificial Sequence
  chemically synthesized
acgttcaggtatggtgactggc

SEQ ID NO: 823113 - DNA, 22 bp, Artificial Sequence
  chemically synthesized
cgttcaggtatggtgactggct

SEQ ID NO: 823114 - DNA, 22 bp, Artificial Sequence
  chemically synthesized
taactcttaaaatttgagccag

SEQ ID NO: 823115 - DNA, 22 bp, Artificial Sequence
  chemically synthesized
aggtatggtgactggctcaaat

SEQ ID NO: 823116 - DNA, 22 bp, Artificial Sequence
  chemically synthesized
ttataactcttaaaatttgagc

SEQ ID NO: 823117 - DNA, 22 bp, Artificial Sequence
  chemically synthesized
gctcaaattttaagagttataa

SEQ ID NO: 823118 - DNA, 22 bp, Artificial Sequence
  chemically synthesized
aaattttaagagttataacagt

SEQ ID NO: 823119 - DNA, 22 bp, Artificial Sequence
  chemically synthesized
aaacccaaccaccaacactgtt

SEQ ID NO: 823120 - DNA, 22 bp, Artificial Sequence
  chemically synthesized
caaacccaaccaccaacactgt

SEQ ID NO: 823121 - DNA, 22 bp, Artificial Sequence
  chemically synthesized
taagagttataacagtgttggt

SEQ ID NO: 823122 - DNA, 22 bp, Artificial Sequence
  chemically synthesized
aagagttataacagtgttggtg

SEQ ID NO: 823123 - DNA, 22 bp, Artificial Sequence
  chemically synthesized
agagttataacagtgttggtgg

SEQ ID NO: 823124 - DNA, 22 bp, Artificial Sequence
  chemically synthesized
taacagtgttggtggttgggtt

SEQ ID NO: 823125 - DNA, 22 bp, Artificial Sequence
  chemically synthesized
agcaacaatgaaatgtttcaaa

SEQ ID NO: 823126 - DNA, 22 bp, Artificial Sequence
  chemically synthesized
gtggttgggtttgaaacatttc

SEQ ID NO: 823127 - DNA, 22 bp, Artificial Sequence
  chemically synthesized
ctgagcaacaatgaaatgtttc

SEQ ID NO: 823128 - DNA, 22 bp, Artificial Sequence
  chemically synthesized
actactgagcaacaatgaaatg

SEQ ID NO: 823129 - DNA, 22 bp, Artificial Sequence
  chemically synthesized
tcactactgagcaacaatgaaa

SEQ ID NO: 823130 - DNA, 22 bp, Artificial Sequence
  chemically synthesized
ggtttgaaacatttcattgttg

SEQ ID NO: 823131 - DNA, 22 bp, Artificial Sequence
  chemically synthesized
actctcactactgagcaacaat

SEQ ID NO: 823132 - DNA, 22 bp, Artificial Sequence
  chemically synthesized
gaaacatttcattgttgctcag

SEQ ID NO: 823133 - DNA, 22 bp, Artificial Sequence
  chemically synthesized
aaacatttcattgttgctcagt

SEQ ID NO: 823134 - DNA, 22 bp, Artificial Sequence
  chemically synthesized
cactaactctcactactgagca

SEQ ID NO: 823135 - DNA, 22 bp, Artificial Sequence
  chemically synthesized
cattgttgctcagtagtgagag

SEQ ID NO: 823136 - DNA, 22 bp, Artificial Sequence
  chemically synthesized
attgttgctcagtagtgagagt

SEQ ID NO: 823137 - DNA, 22 bp, Artificial Sequence
  chemically synthesized
ttgctcagtagtgagagttagt

SEQ ID NO: 823138 - DNA, 22 bp, Artificial Sequence
  chemically synthesized
agtgatgactacactaactctc

SEQ ID NO: 823139 - DNA, 22 bp, Artificial Sequence
  chemically synthesized
ctcagtagtgagagttagtgta

SEQ ID NO: 823140 - DNA, 22 bp, Artificial Sequence
  chemically synthesized
agtagtgagagttagtgtagtc

SEQ ID NO: 823141 - DNA, 22 bp, Artificial Sequence
  chemically synthesized
cagcacctcagtgatgactaca

SEQ ID NO: 823142 - DNA, 22 bp, Artificial Sequence
  chemically synthesized
gcagcacctcagtgatgactac

SEQ ID NO: 823143 - DNA, 22 bp, Artificial Sequence
  chemically synthesized
tgcagcacctcagtgatgacta

SEQ ID NO: 823144 - DNA, 22 bp, Artificial Sequence
  chemically synthesized
ctttgcagcacctcagtgatga

SEQ ID NO: 823145 - DNA, 22 bp, Artificial Sequence
  chemically synthesized
gtgtagtcatcactgaggtgct

SEQ ID NO: 823146 - DNA, 22 bp, Artificial Sequence
  chemically synthesized
cagcagccagcctcctttgcag

SEQ ID NO: 823147 - DNA, 22 bp, Artificial Sequence
  chemically synthesized
tgattacagcagccagcctcct

SEQ ID NO: 823148 - DNA, 22 bp, Artificial Sequence
  chemically synthesized
aggtgctgcaaaggaggctggc

SEQ ID NO: 823149 - DNA, 22 bp, Artificial Sequence
  chemically synthesized
gagagctgtgattacagcagcc

SEQ ID NO: 823150 - DNA, 22 bp, Artificial Sequence
  chemically synthesized
caaaggaggctggctgctgtaa

SEQ ID NO: 823151 - DNA, 22 bp, Artificial Sequence
  chemically synthesized
ggagagctgtgattacagcagc

SEQ ID NO: 823152 - DNA, 22 bp, Artificial Sequence
  chemically synthesized
cagccttggagagctgtgatta

SEQ ID NO: 823153 - DNA, 22 bp, Artificial Sequence
  chemically synthesized
gctgctgtaatcacagctctcc

SEQ ID NO: 823154 - DNA, 22 bp, Artificial Sequence
  chemically synthesized
tgtctacagccttggagagctg

SEQ ID NO: 823155 - DNA, 22 bp, Artificial Sequence
  chemically synthesized
ctgtaatcacagctctccaagg

SEQ ID NO: 823156 - DNA, 22 bp, Artificial Sequence
  chemically synthesized
taatcacagctctccaaggctg

SEQ ID NO: 823157 - DNA, 22 bp, Artificial Sequence
  chemically synthesized
tccaaggctgtagacatagctt

SEQ ID NO: 823158 - DNA, 22 bp, Artificial Sequence
  chemically synthesized
caaggctgtagacatagctttg

SEQ ID NO: 823159 - DNA, 22 bp, Artificial Sequence
  chemically synthesized
acaaggcaatcacaaagctatg

SEQ ID NO: 823160 - DNA, 22 bp, Artificial Sequence
  chemically synthesized
tagacatagctttgtgattgcc

SEQ ID NO: 823161 - DNA, 22 bp, Artificial Sequence
  chemically synthesized
tgagcctcacaaggcaatcaca

SEQ ID NO: 823162 - DNA, 22 bp, Artificial Sequence
  chemically synthesized
tgtgattgccttgtgaggctca

SEQ ID NO: 823163 - DNA, 22 bp, Artificial Sequence
  chemically synthesized
gtgattgccttgtgaggctcac

SEQ ID NO: 823164 - DNA, 22 bp, Artificial Sequence
  chemically synthesized
acaagagagcctgtgagcctca

SEQ ID NO: 823165 - DNA, 22 bp, Artificial Sequence
  chemically synthesized
tgattgccttgtgaggctcaca

SEQ ID NO: 823166 - DNA, 22 bp, Artificial Sequence
  chemically synthesized
agattaacaagagagcctgtga

SEQ ID NO: 823167 - DNA, 22 bp, Artificial Sequence
  chemically synthesized
ccttgtgaggctcacaggctct

SEQ ID NO: 823168 - DNA, 22 bp, Artificial Sequence
  chemically synthesized
gtgaggctcacaggctctcttg

SEQ ID NO: 823169 - DNA, 22 bp, Artificial Sequence
  chemically synthesized
tgaggctcacaggctctcttgt

SEQ ID NO: 823170 - DNA, 22 bp, Artificial Sequence
  chemically synthesized
tgtgcctaagattaacaagaga

SEQ ID NO: 823171 - DNA, 22 bp, Artificial Sequence
  chemically synthesized
acaggctctcttgttaatctta

SEQ ID NO: 823172 - DNA, 22 bp, Artificial Sequence
  chemically synthesized
agtctgtgtgcctaagattaac

SEQ ID NO: 823173 - DNA, 22 bp, Artificial Sequence
  chemically synthesized
tgagtctgtgtgcctaagatta

SEQ ID NO: 823174 - DNA, 22 bp, Artificial Sequence
  chemically synthesized
ctgagtctgtgtgcctaagatt

SEQ ID NO: 823175 - DNA, 22 bp, Artificial Sequence
  chemically synthesized
tctgagtctgtgtgcctaagat

SEQ ID NO: 823176 - DNA, 22 bp, Artificial Sequence
  chemically synthesized
tttctgagtctgtgtgcctaag

SEQ ID NO: 823177 - DNA, 22 bp, Artificial Sequence
  chemically synthesized
tcttgttaatcttaggcacaca

SEQ ID NO: 823178 - DNA, 22 bp, Artificial Sequence
  chemically synthesized
ttgttaatcttaggcacacaga

SEQ ID NO: 823179 - DNA, 22 bp, Artificial Sequence
  chemically synthesized
gttaatcttaggcacacagact

SEQ ID NO: 823180 - DNA, 22 bp, Artificial Sequence
  chemically synthesized
ttaatcttaggcacacagactc

SEQ ID NO: 823181 - DNA, 22 bp, Artificial Sequence
  chemically synthesized
cgtaagttctttctgagtctgt

SEQ ID NO: 823182 - DNA, 22 bp, Artificial Sequence
  chemically synthesized
atcttaggcacacagactcaga

SEQ ID NO: 823183 - DNA, 22 bp, Artificial Sequence
  chemically synthesized
ctccgtaagttctttctgagtc

SEQ ID NO: 823184 - DNA, 22 bp, Artificial Sequence
  chemically synthesized
gctccgtaagttctttctgagt

SEQ ID NO: 823185 - DNA, 22 bp, Artificial Sequence
  chemically synthesized
aggcacacagactcagaaagaa

SEQ ID NO: 823186 - DNA, 22 bp, Artificial Sequence
  chemically synthesized
ggcacacagactcagaaagaac

SEQ ID NO: 823187 - DNA, 22 bp, Artificial Sequence
  chemically synthesized
aagcaacacccccttgctccgt

SEQ ID NO: 823188 - DNA, 22 bp, Artificial Sequence
  chemically synthesized
agaaagaacttacggagcaagg

SEQ ID NO: 823189 - DNA, 22 bp, Artificial Sequence
  chemically synthesized
aatggctaaagcaacaccccct

SEQ ID NO: 823190 - DNA, 22 bp, Artificial Sequence
  chemically synthesized
acggagcaagggggtgttgctt

SEQ ID NO: 823191 - DNA, 22 bp, Artificial Sequence
  chemically synthesized
cggagcaagggggtgttgcttt

SEQ ID NO: 823192 - DNA, 22 bp, Artificial Sequence
  chemically synthesized
ctttagccatttaatgtctcct

SEQ ID NO: 823193 - DNA, 22 bp, Artificial Sequence
  chemically synthesized
tagccatttaatgtctcctcct

SEQ ID NO: 823194 - DNA, 22 bp, Artificial Sequence
  chemically synthesized
agccatttaatgtctcctcctg

SEQ ID NO: 823195 - DNA, 22 bp, Artificial Sequence
  chemically synthesized
gccatttaatgtctcctcctgt

SEQ ID NO: 823196 - DNA, 22 bp, Artificial Sequence
  chemically synthesized
aatgtctcctcctgtctatttt

SEQ ID NO: 823197 - DNA, 22 bp, Artificial Sequence
  chemically synthesized
atgtctcctcctgtctattttc

SEQ ID NO: 823198 - DNA, 22 bp, Artificial Sequence
  chemically synthesized
ggaaaaaagtgtgaaaatagac

SEQ ID NO: 823199 - DNA, 22 bp, Artificial Sequence
  chemically synthesized
aggaaaaaagtgtgaaaataga

SEQ ID NO: 823200 - DNA, 22 bp, Artificial Sequence
  chemically synthesized
taggaaaaaagtgtgaaaatag

SEQ ID NO: 823201 - DNA, 22 bp, Artificial Sequence
  chemically synthesized
ttaggaaaaaagtgtgaaaata

SEQ ID NO: 823202 - DNA, 22 bp, Artificial Sequence
  chemically synthesized
ttttaggaaaaaagtgtgaaaa

SEQ ID NO: 823203 - DNA, 22 bp, Artificial Sequence
  chemically synthesized
cttttaggaaaaaagtgtgaaa

SEQ ID NO: 823204 - DNA, 22 bp, Artificial Sequence
  chemically synthesized
ctcctgtctattttcacacttt

SEQ ID NO: 823205 - DNA, 22 bp, Artificial Sequence
  chemically synthesized
tcttttaggaaaaaagtgtgaa

SEQ ID NO: 823206 - DNA, 22 bp, Artificial Sequence
  chemically synthesized
ctgtctattttcacactttttt

SEQ ID NO: 823207 - DNA, 22 bp, Artificial Sequence
  chemically synthesized
tctattttcacacttttttcct

SEQ ID NO: 823208 - DNA, 22 bp, Artificial Sequence
  chemically synthesized
aaattttcttttaggaaaaaag

SEQ ID NO: 823209 - DNA, 22 bp, Artificial Sequence
  chemically synthesized
aaaattttcttttaggaaaaaa

SEQ ID NO: 823210 - DNA, 22 bp, Artificial Sequence
  chemically synthesized
ttttcacacttttttcctaaaa

SEQ ID NO: 823211 - DNA, 22 bp, Artificial Sequence
  chemically synthesized
cttaaaattttcttttaggaaa

SEQ ID NO: 823212 - DNA, 22 bp, Artificial Sequence
  chemically synthesized
tcacacttttttcctaaaagaa

SEQ ID NO: 823213 - DNA, 22 bp, Artificial Sequence
  chemically synthesized
ttacttaaaattttcttttagg

SEQ ID NO: 823214 - DNA, 22 bp, Artificial Sequence
  chemically synthesized
cacacttttttcctaaaagaaa

SEQ ID NO: 823215 - DNA, 22 bp, Artificial Sequence
  chemically synthesized
attacttaaaattttcttttag

SEQ ID NO: 823216 - DNA, 22 bp, Artificial Sequence
  chemically synthesized
acacttttttcctaaaagaaaa

SEQ ID NO: 823217 - DNA, 22 bp, Artificial Sequence
  chemically synthesized
gcttattacttaaaattttctt

SEQ ID NO: 823218 - DNA, 22 bp, Artificial Sequence
  chemically synthesized
ttttcctaaaagaaaattttaa

SEQ ID NO: 823219 - DNA, 22 bp, Artificial Sequence
  chemically synthesized
tttcctaaaagaaaattttaag

SEQ ID NO: 823220 - DNA, 22 bp, Artificial Sequence
  chemically synthesized
gctggcttattacttaaaattt

SEQ ID NO: 823221 - DNA, 22 bp, Artificial Sequence
  chemically synthesized
ttcctaaaagaaaattttaagt

SEQ ID NO: 823222 - DNA, 22 bp, Artificial Sequence
  chemically synthesized
tcctaaaagaaaattttaagta

SEQ ID NO: 823223 - DNA, 22 bp, Artificial Sequence
  chemically synthesized
cctaaaagaaaattttaagtaa

SEQ ID NO: 823224 - DNA, 22 bp, Artificial Sequence
  chemically synthesized
ctaaaagaaaattttaagtaat

SEQ ID NO: 823225 - DNA, 22 bp, Artificial Sequence
  chemically synthesized
aaagaaaattttaagtaataag

SEQ ID NO: 823226 - DNA, 22 bp, Artificial Sequence
  chemically synthesized
agtgatattagctggcttatta

SEQ ID NO: 823227 - DNA, 22 bp, Artificial Sequence
  chemically synthesized
ctaagtgatattagctggctta

SEQ ID NO: 823228 - DNA, 22 bp, Artificial Sequence
  chemically synthesized
taagtaataagccagctaatat

SEQ ID NO: 823229 - DNA, 22 bp, Artificial Sequence
  chemically synthesized
aagtaataagccagctaatatc

SEQ ID NO: 823230 - DNA, 22 bp, Artificial Sequence
  chemically synthesized
agtaataagccagctaatatca

SEQ ID NO: 823231 - DNA, 22 bp, Artificial Sequence
  chemically synthesized
catcgaatgtgtcatcactact

SEQ ID NO: 823232 - DNA, 22 bp, Artificial Sequence
  chemically synthesized
acatcgaatgtgtcatcactac

SEQ ID NO: 823233 - DNA, 22 bp, Artificial Sequence
  chemically synthesized
tacatcgaatgtgtcatcacta

SEQ ID NO: 823234 - DNA, 22 bp, Artificial Sequence
  chemically synthesized
atatcacttagtagtgatgaca

SEQ ID NO: 823235 - DNA, 22 bp, Artificial Sequence
  chemically synthesized
gtctttacatcgaatgtgtcat

SEQ ID NO: 823236 - DNA, 22 bp, Artificial Sequence
  chemically synthesized
tctggtctttacatcgaatgtg

SEQ ID NO: 823237 - DNA, 22 bp, Artificial Sequence
  chemically synthesized
agtagtgatgacacattcgatg

SEQ ID NO: 823238 - DNA, 22 bp, Artificial Sequence
  chemically synthesized
gtagtgatgacacattcgatgt

SEQ ID NO: 823239 - DNA, 22 bp, Artificial Sequence
  chemically synthesized
gatgtaaagaccagataaccat

SEQ ID NO: 823240 - DNA, 22 bp, Artificial Sequence
  chemically synthesized
aaaggtagggagcaaataaaat

SEQ ID NO: 823241 - DNA, 22 bp, Artificial Sequence
  chemically synthesized
taaaaggtagggagcaaataaa

SEQ ID NO: 823242 - DNA, 22 bp, Artificial Sequence
  chemically synthesized
ctaaaaggtagggagcaaataa

SEQ ID NO: 823243 - DNA, 22 bp, Artificial Sequence
  chemically synthesized
ttctaaaaggtagggagcaaat

SEQ ID NO: 823244 - DNA, 22 bp, Artificial Sequence
  chemically synthesized
attcttctaaaaggtagggagc

SEQ ID NO: 823245 - DNA, 22 bp, Artificial Sequence
  chemically synthesized
aattcttctaaaaggtagggag

SEQ ID NO: 823246 - DNA, 22 bp, Artificial Sequence
  chemically synthesized
tatttgctccctaccttttaga

SEQ ID NO: 823247 - DNA, 22 bp, Artificial Sequence
  chemically synthesized
atttgctccctaccttttagaa

SEQ ID NO: 823248 - DNA, 22 bp, Artificial Sequence
  chemically synthesized
tttgctccctaccttttagaag

SEQ ID NO: 823249 - DNA, 22 bp, Artificial Sequence
  chemically synthesized
gctccctaccttttagaagaat

SEQ ID NO: 823250 - DNA, 22 bp, Artificial Sequence
  chemically synthesized
ctccctaccttttagaagaatt

SEQ ID NO: 823251 - DNA, 22 bp, Artificial Sequence
  chemically synthesized
cctaccttttagaagaattaaa

SEQ ID NO: 823252 - DNA, 22 bp, Artificial Sequence
  chemically synthesized
atgaaacgacaatgtttaattc

SEQ ID NO: 823253 - DNA, 22 bp, Artificial Sequence
  chemically synthesized
aatgaaacgacaatgtttaatt

SEQ ID NO: 823254 - DNA, 22 bp, Artificial Sequence
  chemically synthesized
ccttttagaagaattaaacatt

SEQ ID NO: 823255 - DNA, 22 bp, Artificial Sequence
  chemically synthesized
taatgaaacgacaatgtttaat

SEQ ID NO: 823256 - DNA, 22 bp, Artificial Sequence
  chemically synthesized
ttaatgaaacgacaatgtttaa

SEQ ID NO: 823257 - DNA, 22 bp, Artificial Sequence
  chemically synthesized
ttagaagaattaaacattgtcg

SEQ ID NO: 823258 - DNA, 22 bp, Artificial Sequence
  chemically synthesized
tagaagaattaaacattgtcgt

SEQ ID NO: 823259 - DNA, 22 bp, Artificial Sequence
  chemically synthesized
atttttaatgaaacgacaatgt

SEQ ID NO: 823260 - DNA, 22 bp, Artificial Sequence
  chemically synthesized
agaagaattaaacattgtcgtt

SEQ ID NO: 823261 - DNA, 22 bp, Artificial Sequence
  chemically synthesized
catttttaatgaaacgacaatg

SEQ ID NO: 823262 - DNA, 22 bp, Artificial Sequence
  chemically synthesized
gaagaattaaacattgtcgttt

SEQ ID NO: 823263 - DNA, 22 bp, Artificial Sequence
  chemically synthesized
catttcatttttaatgaaacga

SEQ ID NO: 823264 - DNA, 22 bp, Artificial Sequence
  chemically synthesized
aacattgtcgtttcattaaaaa

SEQ ID NO: 823265 - DNA, 22 bp, Artificial Sequence
  chemically synthesized
caaactgcatttcatttttaat

SEQ ID NO: 823266 - DNA, 22 bp, Artificial Sequence
  chemically synthesized
tcgtttcattaaaaatgaaatg

SEQ ID NO: 823267 - DNA, 22 bp, Artificial Sequence
  chemically synthesized
cattaaaaatgaaatgcagttt

SEQ ID NO: 823268 - DNA, 22 bp, Artificial Sequence
  chemically synthesized
attaaaaatgaaatgcagtttg

SEQ ID NO: 823269 - DNA, 22 bp, Artificial Sequence
  chemically synthesized
aaaatgaaatgcagtttgcaat

SEQ ID NO: 823270 - DNA, 22 bp, Artificial Sequence
  chemically synthesized
atgaaaaaataaaacaataatt

SEQ ID NO: 823271 - DNA, 22 bp, Artificial Sequence
  chemically synthesized
gatgaaaaaataaaacaataat

SEQ ID NO: 823272 - DNA, 22 bp, Artificial Sequence
  chemically synthesized
tgatgaaaaaataaaacaataa

SEQ ID NO: 823273 - DNA, 22 bp, Artificial Sequence
  chemically synthesized
tttgatgaaaaaataaaacaat

SEQ ID NO: 823274 - DNA, 22 bp, Artificial Sequence
  chemically synthesized
tattctttgatgaaaaaataaa

SEQ ID NO: 823275 - DNA, 22 bp, Artificial Sequence
  chemically synthesized
gcaattattgttttattttttc

SEQ ID NO: 823276 - DNA, 22 bp, Artificial Sequence
  chemically synthesized
caattattgttttattttttca

SEQ ID NO: 823277 - DNA, 22 bp, Artificial Sequence
  chemically synthesized
atattatattctttgatgaaaa

SEQ ID NO: 823278 - DNA, 22 bp, Artificial Sequence
  chemically synthesized
catattatattctttgatgaaa

SEQ ID NO: 823279 - DNA, 22 bp, Artificial Sequence
  chemically synthesized
ttgttttattttttcatcaaag

SEQ ID NO: 823280 - DNA, 22 bp, Artificial Sequence
  chemically synthesized
ttttattttttcatcaaagaat

SEQ ID NO: 823281 - DNA, 22 bp, Artificial Sequence
  chemically synthesized
tattttttcatcaaagaatata

SEQ ID NO: 823282 - DNA, 22 bp, Artificial Sequence
  chemically synthesized
attttttcatcaaagaatataa

SEQ ID NO: 823283 - DNA, 22 bp, Artificial Sequence
  chemically synthesized
ttttttcatcaaagaatataat

SEQ ID NO: 823284 - DNA, 22 bp, Artificial Sequence
  chemically synthesized
tttcatcaaagaatataatatg

SEQ ID NO: 823285 - DNA, 22 bp, Artificial Sequence
  chemically synthesized
ttcatcaaagaatataatatga

SEQ ID NO: 823286 - DNA, 22 bp, Artificial Sequence
  chemically synthesized
cgaaaaaaaatttcatattata

SEQ ID NO: 823287 - DNA, 22 bp, Artificial Sequence
  chemically synthesized
tcatcaaagaatataatatgaa

SEQ ID NO: 823288 - DNA, 22 bp, Artificial Sequence
  chemically synthesized
catcaaagaatataatatgaaa

SEQ ID NO: 823289 - DNA, 22 bp, Artificial Sequence
  chemically synthesized
atcaaagaatataatatgaaat

SEQ ID NO: 823290 - DNA, 22 bp, Artificial Sequence
  chemically synthesized
tttttcgcagtatactatttca

SEQ ID NO: 823291 - DNA, 22 bp, Artificial Sequence
  chemically synthesized
ttttcgcagtatactatttcat

SEQ ID NO: 823292 - DNA, 22 bp, Artificial Sequence
  chemically synthesized
tttcgcagtatactatttcatt

SEQ ID NO: 823293 - DNA, 22 bp, Artificial Sequence
  chemically synthesized
ttcgcagtatactatttcattg

SEQ ID NO: 823294 - DNA, 22 bp, Artificial Sequence
  chemically synthesized
tcgcagtatactatttcattgc

SEQ ID NO: 823295 - DNA, 22 bp, Artificial Sequence
  chemically synthesized
cgcagtatactatttcattgct

SEQ ID NO: 823296 - DNA, 22 bp, Artificial Sequence
  chemically synthesized
gcagtatactatttcattgctt

SEQ ID NO: 823297 - DNA, 22 bp, Artificial Sequence
  chemically synthesized
tttcattgctttcattttctac

SEQ ID NO: 823298 - DNA, 22 bp, Artificial Sequence
  chemically synthesized
ataaaccaacaggtagaaaatg

SEQ ID NO: 823299 - DNA, 22 bp, Artificial Sequence
  chemically synthesized
cattgctttcattttctacctg

SEQ ID NO: 823300 - DNA, 22 bp, Artificial Sequence
  chemically synthesized
ctgataaaccaacaggtagaaa

SEQ ID NO: 823301 - DNA, 22 bp, Artificial Sequence
  chemically synthesized
attgctttcattttctacctgt

SEQ ID NO: 823302 - DNA, 22 bp, Artificial Sequence
  chemically synthesized
ctttcattttctacctgttggt

SEQ ID NO: 823303 - DNA, 22 bp, Artificial Sequence
  chemically synthesized
cattactgataaaccaacaggt

SEQ ID NO: 823304 - DNA, 22 bp, Artificial Sequence
  chemically synthesized
tcattttctacctgttggttta

SEQ ID NO: 823305 - DNA, 22 bp, Artificial Sequence
  chemically synthesized
cattttctacctgttggtttat

SEQ ID NO: 823306 - DNA, 22 bp, Artificial Sequence
  chemically synthesized
attttctacctgttggtttatc

SEQ ID NO: 823307 - DNA, 22 bp, Artificial Sequence
  chemically synthesized
tattacattactgataaaccaa

SEQ ID NO: 823308 - DNA, 22 bp, Artificial Sequence
  chemically synthesized
tctacctgttggtttatcagta

SEQ ID NO: 823309 - DNA, 22 bp, Artificial Sequence
  chemically synthesized
ctacctgttggtttatcagtaa

SEQ ID NO: 823310 - DNA, 22 bp, Artificial Sequence
  chemically synthesized
tacctgttggtttatcagtaat

SEQ ID NO: 823311 - DNA, 22 bp, Artificial Sequence
  chemically synthesized
cctgttggtttatcagtaatgt

SEQ ID NO: 823312 - DNA, 22 bp, Artificial Sequence
  chemically synthesized
ttggtttatcagtaatgtaata

SEQ ID NO: 823313 - DNA, 22 bp, Artificial Sequence
  chemically synthesized
acaaataagattatattacatt

SEQ ID NO: 823314 - DNA, 22 bp, Artificial Sequence
  chemically synthesized
gtttatcagtaatgtaatataa

SEQ ID NO: 823315 - DNA, 22 bp, Artificial Sequence
  chemically synthesized
attgacaaataagattatatta

SEQ ID NO: 823316 - DNA, 22 bp, Artificial Sequence
  chemically synthesized
atcagtaatgtaatataatctt

SEQ ID NO: 823317 - DNA, 22 bp, Artificial Sequence
  chemically synthesized
tcagtaatgtaatataatctta

SEQ ID NO: 823318 - DNA, 22 bp, Artificial Sequence
  chemically synthesized
ttaattgacaaataagattata

SEQ ID NO: 823319 - DNA, 22 bp, Artificial Sequence
  chemically synthesized
atgtaattattaattgacaaat

SEQ ID NO: 823320 - DNA, 22 bp, Artificial Sequence
  chemically synthesized
aaaaagactcatgtaattatta

SEQ ID NO: 823321 - DNA, 22 bp, Artificial Sequence
  chemically synthesized
atttgtcaattaataattacat

SEQ ID NO: 823322 - DNA, 22 bp, Artificial Sequence
  chemically synthesized
tttgtcaattaataattacatg

SEQ ID NO: 823323 - DNA, 22 bp, Artificial Sequence
  chemically synthesized
gtcaattaataattacatgagt

SEQ ID NO: 823324 - DNA, 22 bp, Artificial Sequence
  chemically synthesized
tcaattaataattacatgagtc

SEQ ID NO: 823325 - DNA, 22 bp, Artificial Sequence
  chemically synthesized
ataattacatgagtctttttca

SEQ ID NO: 823326 - DNA, 22 bp, Artificial Sequence
  chemically synthesized
catgagtctttttcagattctt

SEQ ID NO: 823327 - DNA, 22 bp, Artificial Sequence
  chemically synthesized
tttcagattcttatggggtttt

SEQ ID NO: 823328 - DNA, 22 bp, Artificial Sequence
  chemically synthesized
aaacaaagcaagaaaaccccat

SEQ ID NO: 823329 - DNA, 22 bp, Artificial Sequence
  chemically synthesized
ttcagattcttatggggttttc

SEQ ID NO: 823330 - DNA, 22 bp, Artificial Sequence
  chemically synthesized
tcagattcttatggggttttct

SEQ ID NO: 823331 - DNA, 22 bp, Artificial Sequence
  chemically synthesized
cagattcttatggggttttctt

SEQ ID NO: 823332 - DNA, 22 bp, Artificial Sequence
  chemically synthesized
agattcttatggggttttcttg

SEQ ID NO: 823333 - DNA, 22 bp, Artificial Sequence
  chemically synthesized
cgtggctaaaacaaagcaagaa

SEQ ID NO: 823334 - DNA, 22 bp, Artificial Sequence
  chemically synthesized
ttatggggttttcttgctttgt

SEQ ID NO: 823335 - DNA, 22 bp, Artificial Sequence
  chemically synthesized
atggggttttcttgctttgttt

SEQ ID NO: 823336 - DNA, 22 bp, Artificial Sequence
  chemically synthesized
tctacgtggctaaaacaaagca

SEQ ID NO: 823337 - DNA, 22 bp, Artificial Sequence
  chemically synthesized
tggggttttcttgctttgtttt

SEQ ID NO: 823338 - DNA, 22 bp, Artificial Sequence
  chemically synthesized
caattgtctacgtggctaaaac

SEQ ID NO: 823339 - DNA, 22 bp, Artificial Sequence
  chemically synthesized
ccaattgtctacgtggctaaaa

SEQ ID NO: 823340 - DNA, 22 bp, Artificial Sequence
  chemically synthesized
tcttgctttgttttagccacgt

SEQ ID NO: 823341 - DNA, 22 bp, Artificial Sequence
  chemically synthesized
ttccaattgtctacgtggctaa

SEQ ID NO: 823342 - DNA, 22 bp, Artificial Sequence
  chemically synthesized
cttgctttgttttagccacgta

SEQ ID NO: 823343 - DNA, 22 bp, Artificial Sequence
  chemically synthesized
ttgctttgttttagccacgtag

SEQ ID NO: 823344 - DNA, 22 bp, Artificial Sequence
  chemically synthesized
ctcttccaattgtctacgtggc

SEQ ID NO: 823345 - DNA, 22 bp, Artificial Sequence
  chemically synthesized
gctttgttttagccacgtagac

SEQ ID NO: 823346 - DNA, 22 bp, Artificial Sequence
  chemically synthesized
cctcttccaattgtctacgtgg

SEQ ID NO: 823347 - DNA, 22 bp, Artificial Sequence
  chemically synthesized
ctttgttttagccacgtagaca

SEQ ID NO: 823348 - DNA, 22 bp, Artificial Sequence
  chemically synthesized
tgttttagccacgtagacaatt

SEQ ID NO: 823349 - DNA, 22 bp, Artificial Sequence
  chemically synthesized
gttttagccacgtagacaattg

SEQ ID NO: 823350 - DNA, 22 bp, Artificial Sequence
  chemically synthesized
ttttagccacgtagacaattgg

SEQ ID NO: 823351 - DNA, 22 bp, Artificial Sequence
  chemically synthesized
acaggcttcctcttccaattgt

SEQ ID NO: 823352 - DNA, 22 bp, Artificial Sequence
  chemically synthesized
tagccacgtagacaattggaag

SEQ ID NO: 823353 - DNA, 22 bp, Artificial Sequence
  chemically synthesized
agccacgtagacaattggaaga

SEQ ID NO: 823354 - DNA, 22 bp, Artificial Sequence
  chemically synthesized
gccacgtagacaattggaagag

SEQ ID NO: 823355 - DNA, 22 bp, Artificial Sequence
  chemically synthesized
tagatgacctcacaggcttcct

SEQ ID NO: 823356 - DNA, 22 bp, Artificial Sequence
  chemically synthesized
gtagatgacctcacaggcttcc

SEQ ID NO: 823357 - DNA, 22 bp, Artificial Sequence
  chemically synthesized
ttgtagatgacctcacaggctt

SEQ ID NO: 823358 - DNA, 22 bp, Artificial Sequence
  chemically synthesized
ctcttgtagatgacctcacagg

SEQ ID NO: 823359 - DNA, 22 bp, Artificial Sequence
  chemically synthesized
gaagaggaagcctgtgaggtca

SEQ ID NO: 823360 - DNA, 22 bp, Artificial Sequence
  chemically synthesized
tgaggtcatctacaagagtaat

SEQ ID NO: 823361 - DNA, 22 bp, Artificial Sequence
  chemically synthesized
tgatgcgaatgcatagcaatta

SEQ ID NO: 823362 - DNA, 22 bp, Artificial Sequence
  chemically synthesized
caagagtaattgctatgcattc

SEQ ID NO: 823363 - DNA, 22 bp, Artificial Sequence
  chemically synthesized
aaagtagtagagttgtgatgcg

SEQ ID NO: 823364 - DNA, 22 bp, Artificial Sequence
  chemically synthesized
gaaagtagtagagttgtgatgc

SEQ ID NO: 823365 - DNA, 22 bp, Artificial Sequence
  chemically synthesized
tgaaagtagtagagttgtgatg

SEQ ID NO: 823366 - DNA, 22 bp, Artificial Sequence
  chemically synthesized
ctatgcattcgcatcacaactc

SEQ ID NO: 823367 - DNA, 22 bp, Artificial Sequence
  chemically synthesized
ttgaaagtagtagagttgtgat

SEQ ID NO: 823368 - DNA, 22 bp, Artificial Sequence
  chemically synthesized
ttttgaaagtagtagagttgtg

SEQ ID NO: 823369 - DNA, 22 bp, Artificial Sequence
  chemically synthesized
tgcattcgcatcacaactctac

SEQ ID NO: 823370 - DNA, 22 bp, Artificial Sequence
  chemically synthesized
cttttgaaagtagtagagttgt

SEQ ID NO: 823371 - DNA, 22 bp, Artificial Sequence
  chemically synthesized
gcatcacaactctactactttc

SEQ ID NO: 823372 - DNA, 22 bp, Artificial Sequence
  chemically synthesized
agaatcttcttttgaaagtagt

SEQ ID NO: 823373 - DNA, 22 bp, Artificial Sequence
  chemically synthesized
gagaagttcagaatcttctttt

SEQ ID NO: 823374 - DNA, 22 bp, Artificial Sequence
  chemically synthesized
tactactttcaaaagaagattc

SEQ ID NO: 823375 - DNA, 22 bp, Artificial Sequence
  chemically synthesized
ctactttcaaaagaagattctg

SEQ ID NO: 823376 - DNA, 22 bp, Artificial Sequence
  chemically synthesized
ctttcaaaagaagattctgaac

SEQ ID NO: 823377 - DNA, 22 bp, Artificial Sequence
  chemically synthesized
aaggctagagaagttcagaatc

SEQ ID NO: 823378 - DNA, 22 bp, Artificial Sequence
  chemically synthesized
tcaaaagaagattctgaacttc

SEQ ID NO: 823379 - DNA, 22 bp, Artificial Sequence
  chemically synthesized
caaaagaagattctgaacttct

SEQ ID NO: 823380 - DNA, 22 bp, Artificial Sequence
  chemically synthesized
aaaagaagattctgaacttctc

SEQ ID NO: 823381 - DNA, 22 bp, Artificial Sequence
  chemically synthesized
cagagaagaaaactgaaggcta

SEQ ID NO: 823382 - DNA, 22 bp, Artificial Sequence
  chemically synthesized
gcagagaagaaaactgaaggct

SEQ ID NO: 823383 - DNA, 22 bp, Artificial Sequence
  chemically synthesized
tgaacttctctagccttcagtt

SEQ ID NO: 823384 - DNA, 22 bp, Artificial Sequence
  chemically synthesized
aacttctctagccttcagtttt

SEQ ID NO: 823385 - DNA, 22 bp, Artificial Sequence
  chemically synthesized
gtttgcagagaagaaaactgaa

SEQ ID NO: 823386 - DNA, 22 bp, Artificial Sequence
  chemically synthesized
agtttgcagagaagaaaactga

SEQ ID NO: 823387 - DNA, 22 bp, Artificial Sequence
  chemically synthesized
ttagtttgcagagaagaaaact

SEQ ID NO: 823388 - DNA, 22 bp, Artificial Sequence
  chemically synthesized
ctctagccttcagttttcttct

SEQ ID NO: 823389 - DNA, 22 bp, Artificial Sequence
  chemically synthesized
tctagccttcagttttcttctc

SEQ ID NO: 823390 - DNA, 22 bp, Artificial Sequence
  chemically synthesized
ttcttagtttgcagagaagaaa

SEQ ID NO: 823391 - DNA, 22 bp, Artificial Sequence
  chemically synthesized
tagccttcagttttcttctctg

SEQ ID NO: 823392 - DNA, 22 bp, Artificial Sequence
  chemically synthesized
gccttcagttttcttctctgca

SEQ ID NO: 823393 - DNA, 22 bp, Artificial Sequence
  chemically synthesized
ttattcttagtttgcagagaag

SEQ ID NO: 823394 - DNA, 22 bp, Artificial Sequence
  chemically synthesized
attattcttagtttgcagagaa

SEQ ID NO: 823395 - DNA, 22 bp, Artificial Sequence
  chemically synthesized
ttattattcttagtttgcagag

SEQ ID NO: 823396 - DNA, 22 bp, Artificial Sequence
  chemically synthesized
cagttttcttctctgcaaacta

SEQ ID NO: 823397 - DNA, 22 bp, Artificial Sequence
  chemically synthesized
agttttcttctctgcaaactaa

SEQ ID NO: 823398 - DNA, 22 bp, Artificial Sequence
  chemically synthesized
tcttctctgcaaactaagaata

SEQ ID NO: 823399 - DNA, 22 bp, Artificial Sequence
  chemically synthesized
cttctctgcaaactaagaataa

SEQ ID NO: 823400 - DNA, 22 bp, Artificial Sequence
  chemically synthesized
ttctctgcaaactaagaataat

SEQ ID NO: 823401 - DNA, 22 bp, Artificial Sequence
  chemically synthesized
aaaagtactcttattattctta

SEQ ID NO: 823402 - DNA, 22 bp, Artificial Sequence
  chemically synthesized
gaaaagtactcttattattctt

SEQ ID NO: 823403 - DNA, 22 bp, Artificial Sequence
  chemically synthesized
ctctgcaaactaagaataataa

SEQ ID NO: 823404 - DNA, 22 bp, Artificial Sequence
  chemically synthesized
tgaaaagtactcttattattct

SEQ ID NO: 823405 - DNA, 22 bp, Artificial Sequence
  chemically synthesized
tctgcaaactaagaataataag

SEQ ID NO: 823406 - DNA, 22 bp, Artificial Sequence
  chemically synthesized
tttgaaaagtactcttattatt

SEQ ID NO: 823407 - DNA, 22 bp, Artificial Sequence
  chemically synthesized
tgcaaactaagaataataagag

SEQ ID NO: 823408 - DNA, 22 bp, Artificial Sequence
  chemically synthesized
caaactaagaataataagagta

SEQ ID NO: 823409 - DNA, 22 bp, Artificial Sequence
  chemically synthesized
agaataataagagtacttttca

SEQ ID NO: 823410 - DNA, 22 bp, Artificial Sequence
  chemically synthesized
aaaaacactctttgaaaagtac

SEQ ID NO: 823411 - DNA, 22 bp, Artificial Sequence
  chemically synthesized
caaaaacactctttgaaaagta

SEQ ID NO: 823412 - DNA, 22 bp, Artificial Sequence
  chemically synthesized
tcaaaaacactctttgaaaagt

SEQ ID NO: 823413 - DNA, 22 bp, Artificial Sequence
  chemically synthesized
atcctttcaaaaacactctttg

SEQ ID NO: 823414 - DNA, 22 bp, Artificial Sequence
  chemically synthesized
catcctttcaaaaacactcttt

SEQ ID NO: 823415 - DNA, 22 bp, Artificial Sequence
  chemically synthesized
tttcatcctttcaaaaacactc

SEQ ID NO: 823416 - DNA, 22 bp, Artificial Sequence
  chemically synthesized
atttcatcctttcaaaaacact

SEQ ID NO: 823417 - DNA, 22 bp, Artificial Sequence
  chemically synthesized
gtttatttcatcctttcaaaaa

SEQ ID NO: 823418 - DNA, 22 bp, Artificial Sequence
  chemically synthesized
ttcaaagagtgtttttgaaagg

SEQ ID NO: 823419 - DNA, 22 bp, Artificial Sequence
  chemically synthesized
tcaaagagtgtttttgaaagga

SEQ ID NO: 823420 - DNA, 22 bp, Artificial Sequence
  chemically synthesized
caaagagtgtttttgaaaggat

SEQ ID NO: 823421 - DNA, 22 bp, Artificial Sequence
  chemically synthesized
aaagagtgtttttgaaaggatg

SEQ ID NO: 823422 - DNA, 22 bp, Artificial Sequence
  chemically synthesized
tatatattggtttatttcatcc

SEQ ID NO: 823423 - DNA, 22 bp, Artificial Sequence
  chemically synthesized
atatatattggtttatttcatc

SEQ ID NO: 823424 - DNA, 22 bp, Artificial Sequence
  chemically synthesized
tatatatattggtttatttcat

SEQ ID NO: 823425 - DNA, 22 bp, Artificial Sequence
  chemically synthesized
ttgaaaggatgaaataaaccaa

SEQ ID NO: 823426 - DNA, 22 bp, Artificial Sequence
  chemically synthesized
tgaaaggatgaaataaaccaat

SEQ ID NO: 823427 - DNA, 22 bp, Artificial Sequence
  chemically synthesized
gaaaggatgaaataaaccaata

SEQ ID NO: 823428 - DNA, 22 bp, Artificial Sequence
  chemically synthesized
aaaggatgaaataaaccaatat

SEQ ID NO: 823429 - DNA, 22 bp, Artificial Sequence
  chemically synthesized
gtcactttatatatattggttt

SEQ ID NO: 823430 - DNA, 22 bp, Artificial Sequence
  chemically synthesized
tgtgtcaaaaagtatgctagtc

SEQ ID NO: 823431 - DNA, 22 bp, Artificial Sequence
  chemically synthesized
ctgtgtgtcaaaaagtatgcta

SEQ ID NO: 823432 - DNA, 22 bp, Artificial Sequence
  chemically synthesized
gctgtgtgtcaaaaagtatgct

SEQ ID NO: 823433 - DNA, 22 bp, Artificial Sequence
  chemically synthesized
gtgaatgcttgctgtgtgtcaa

SEQ ID NO: 823434 - DNA, 22 bp, Artificial Sequence
  chemically synthesized
agtgaatgcttgctgtgtgtca

SEQ ID NO: 823435 - DNA, 22 bp, Artificial Sequence
  chemically synthesized
tagtgaatgcttgctgtgtgtc

SEQ ID NO: 823436 - DNA, 22 bp, Artificial Sequence
  chemically synthesized
gcatactttttgacacacagca

SEQ ID NO: 823437 - DNA, 22 bp, Artificial Sequence
  chemically synthesized
ttagtgaatgcttgctgtgtgt

SEQ ID NO: 823438 - DNA, 22 bp, Artificial Sequence
  chemically synthesized
tttgacacacagcaagcattca

SEQ ID NO: 823439 - DNA, 22 bp, Artificial Sequence
  chemically synthesized
ttgacacacagcaagcattcac

SEQ ID NO: 823440 - DNA, 22 bp, Artificial Sequence
  chemically synthesized
tgacacacagcaagcattcact

SEQ ID NO: 823441 - DNA, 22 bp, Artificial Sequence
  chemically synthesized
ataataacttttagtgaatgct

SEQ ID NO: 823442 - DNA, 22 bp, Artificial Sequence
  chemically synthesized
gacacacagcaagcattcacta

SEQ ID NO: 823443 - DNA, 22 bp, Artificial Sequence
  chemically synthesized
acacacagcaagcattcactaa

SEQ ID NO: 823444 - DNA, 22 bp, Artificial Sequence
  chemically synthesized
atgttaataataacttttagtg

SEQ ID NO: 823445 - DNA, 22 bp, Artificial Sequence
  chemically synthesized
aagtaatcctaatgttaataat

SEQ ID NO: 823446 - DNA, 22 bp, Artificial Sequence
  chemically synthesized
actaaaagttattattaacatt

SEQ ID NO: 823447 - DNA, 22 bp, Artificial Sequence
  chemically synthesized
aaagttattattaacattagga

SEQ ID NO: 823448 - DNA, 22 bp, Artificial Sequence
  chemically synthesized
aaattaaagtaatcctaatgtt

SEQ ID NO: 823449 - DNA, 22 bp, Artificial Sequence
  chemically synthesized
ttattaacattaggattacttt

SEQ ID NO: 823450 - DNA, 22 bp, Artificial Sequence
  chemically synthesized
ttaacattaggattactttaat

SEQ ID NO: 823451 - DNA, 22 bp, Artificial Sequence
  chemically synthesized
acattaggattactttaatttt

SEQ ID NO: 823452 - DNA, 22 bp, Artificial Sequence
  chemically synthesized
aatgatgtatgctaaaattaaa

SEQ ID NO: 823453 - DNA, 22 bp, Artificial Sequence
  chemically synthesized
gaatgatgtatgctaaaattaa

SEQ ID NO: 823454 - DNA, 22 bp, Artificial Sequence
  chemically synthesized
ttgaatgatgtatgctaaaatt

SEQ ID NO: 823455 - DNA, 22 bp, Artificial Sequence
  chemically synthesized
cttgaatgatgtatgctaaaat

SEQ ID NO: 823456 - DNA, 22 bp, Artificial Sequence
  chemically synthesized
ggattactttaattttagcata

SEQ ID NO: 823457 - DNA, 22 bp, Artificial Sequence
  chemically synthesized
ctttaattttagcatacatcat

SEQ ID NO: 823458 - DNA, 22 bp, Artificial Sequence
  chemically synthesized
atccatttcttgaatgatgtat

SEQ ID NO: 823459 - DNA, 22 bp, Artificial Sequence
  chemically synthesized
catccatttcttgaatgatgta

SEQ ID NO: 823460 - DNA, 22 bp, Artificial Sequence
  chemically synthesized
taattttagcatacatcattca

SEQ ID NO: 823461 - DNA, 22 bp, Artificial Sequence
  chemically synthesized
tcatccatttcttgaatgatgt

SEQ ID NO: 823462 - DNA, 22 bp, Artificial Sequence
  chemically synthesized
aattttagcatacatcattcaa

SEQ ID NO: 823463 - DNA, 22 bp, Artificial Sequence
  chemically synthesized
ttcatccatttcttgaatgatg

SEQ ID NO: 823464 - DNA, 22 bp, Artificial Sequence
  chemically synthesized
attttagcatacatcattcaag

SEQ ID NO: 823465 - DNA, 22 bp, Artificial Sequence
  chemically synthesized
tttcatccatttcttgaatgat

SEQ ID NO: 823466 - DNA, 22 bp, Artificial Sequence
  chemically synthesized
tagcatacatcattcaagaaat

SEQ ID NO: 823467 - DNA, 22 bp, Artificial Sequence
  chemically synthesized
agcatacatcattcaagaaatg

SEQ ID NO: 823468 - DNA, 22 bp, Artificial Sequence
  chemically synthesized
gcatacatcattcaagaaatgg

SEQ ID NO: 823469 - DNA, 22 bp, Artificial Sequence
  chemically synthesized
taattttttcatccatttcttg

SEQ ID NO: 823470 - DNA, 22 bp, Artificial Sequence
  chemically synthesized
aagaaatggatgaaaaaattac

SEQ ID NO: 823471 - DNA, 22 bp, Artificial Sequence
  chemically synthesized
ccgatacagataaagatggcca

SEQ ID NO: 823472 - DNA, 22 bp, Artificial Sequence
  chemically synthesized
cagctttggccatctttatctg

SEQ ID NO: 823473 - DNA, 22 bp, Artificial Sequence
  chemically synthesized
aatgtaagttcccgatacagat

SEQ ID NO: 823474 - DNA, 22 bp, Artificial Sequence
  chemically synthesized
tggccatctttatctgtatcgg

SEQ ID NO: 823475 - DNA, 22 bp, Artificial Sequence
  chemically synthesized
ggccatctttatctgtatcggg

SEQ ID NO: 823476 - DNA, 22 bp, Artificial Sequence
  chemically synthesized
gccatctttatctgtatcggga

SEQ ID NO: 823477 - DNA, 22 bp, Artificial Sequence
  chemically synthesized
cagattcaatgtaagttcccga

SEQ ID NO: 823478 - DNA, 22 bp, Artificial Sequence
  chemically synthesized
ctgcagattcaatgtaagttcc

SEQ ID NO: 823479 - DNA, 22 bp, Artificial Sequence
  chemically synthesized
tatctgtatcgggaacttacat

SEQ ID NO: 823480 - DNA, 22 bp, Artificial Sequence
  chemically synthesized
atctgtatcgggaacttacatt

SEQ ID NO: 823481 - DNA, 22 bp, Artificial Sequence
  chemically synthesized
tctgtatcgggaacttacattg

SEQ ID NO: 823482 - DNA, 22 bp, Artificial Sequence
  chemically synthesized
tatcgggaacttacattgaatc

SEQ ID NO: 823483 - DNA, 22 bp, Artificial Sequence
  chemically synthesized
atgatgtgtattgctgcagatt

SEQ ID NO: 823484 - DNA, 22 bp, Artificial Sequence
  chemically synthesized
aatgatgtgtattgctgcagat

SEQ ID NO: 823485 - DNA, 22 bp, Artificial Sequence
  chemically synthesized
acattgaatctgcagcaataca

SEQ ID NO: 823486 - DNA, 22 bp, Artificial Sequence
  chemically synthesized
cattgaatctgcagcaatacac

SEQ ID NO: 823487 - DNA, 22 bp, Artificial Sequence
  chemically synthesized
ggaatttaatgatgtgtattgc

SEQ ID NO: 823488 - DNA, 22 bp, Artificial Sequence
  chemically synthesized
aggaatttaatgatgtgtattg

SEQ ID NO: 823489 - DNA, 22 bp, Artificial Sequence
  chemically synthesized
aatctgcagcaatacacatcat

SEQ ID NO: 823490 - DNA, 22 bp, Artificial Sequence
  chemically synthesized
tgtttaggaatttaatgatgtg

SEQ ID NO: 823491 - DNA, 22 bp, Artificial Sequence
  chemically synthesized
tgtgtttaggaatttaatgatg

SEQ ID NO: 823492 - DNA, 22 bp, Artificial Sequence
  chemically synthesized
cagcaatacacatcattaaatt

SEQ ID NO: 823493 - DNA, 22 bp, Artificial Sequence
  chemically synthesized
tgctctgtgtttaggaatttaa

SEQ ID NO: 823494 - DNA, 22 bp, Artificial Sequence
  chemically synthesized
gtgctctgtgtttaggaattta

SEQ ID NO: 823495 - DNA, 22 bp, Artificial Sequence
  chemically synthesized
tttgtgctctgtgtttaggaat

SEQ ID NO: 823496 - DNA, 22 bp, Artificial Sequence
  chemically synthesized
gtttgtgctctgtgtttaggaa

SEQ ID NO: 823497 - DNA, 22 bp, Artificial Sequence
  chemically synthesized
tgtttgtgctctgtgtttagga

SEQ ID NO: 823498 - DNA, 22 bp, Artificial Sequence
  chemically synthesized
ttgtttgtgctctgtgtttagg

SEQ ID NO: 823499 - DNA, 22 bp, Artificial Sequence
  chemically synthesized
tttgtttgtgctctgtgtttag

SEQ ID NO: 823500 - DNA, 22 bp, Artificial Sequence
  chemically synthesized
acattttttgtttgtgctctgt

SEQ ID NO: 823501 - DNA, 22 bp, Artificial Sequence
  chemically synthesized
aattcctaaacacagagcacaa

SEQ ID NO: 823502 - DNA, 22 bp, Artificial Sequence
  chemically synthesized
ctaaacacagagcacaaacaaa

SEQ ID NO: 823503 - DNA, 22 bp, Artificial Sequence
  chemically synthesized
aacacagagcacaaacaaaaaa

SEQ ID NO: 823504 - DNA, 22 bp, Artificial Sequence
  chemically synthesized
tagagattgacattttttgttt

SEQ ID NO: 823505 - DNA, 22 bp, Artificial Sequence
  chemically synthesized
tctatagagattgacatttttt

SEQ ID NO: 823506 - DNA, 22 bp, Artificial Sequence
  chemically synthesized
agccactatctatagagattga

SEQ ID NO: 823507 - DNA, 22 bp, Artificial Sequence
  chemically synthesized
catcataaaaatggctcagcca

SEQ ID NO: 823508 - DNA, 22 bp, Artificial Sequence
  chemically synthesized
tatagatagtggctgagccatt

SEQ ID NO: 823509 - DNA, 22 bp, Artificial Sequence
  chemically synthesized
tagatagtggctgagccatttt

SEQ ID NO: 823510 - DNA, 22 bp, Artificial Sequence
  chemically synthesized
aaactacatcataaaaatggct

SEQ ID NO: 823511 - DNA, 22 bp, Artificial Sequence
  chemically synthesized
gaatggtctaaaactacatcat

SEQ ID NO: 823512 - DNA, 22 bp, Artificial Sequence
  chemically synthesized
ggaatggtctaaaactacatca

SEQ ID NO: 823513 - DNA, 22 bp, Artificial Sequence
  chemically synthesized
agccatttttatgatgtagttt

SEQ ID NO: 823514 - DNA, 22 bp, Artificial Sequence
  chemically synthesized
tggaatggtctaaaactacatc

SEQ ID NO: 823515 - DNA, 22 bp, Artificial Sequence
  chemically synthesized
ttatgatgtagttttagaccat

SEQ ID NO: 823516 - DNA, 22 bp, Artificial Sequence
  chemically synthesized
tatgatgtagttttagaccatt

SEQ ID NO: 823517 - DNA, 22 bp, Artificial Sequence
  chemically synthesized
atgatgtagttttagaccattc

SEQ ID NO: 823518 - DNA, 22 bp, Artificial Sequence
  chemically synthesized
tgatgtagttttagaccattcc

SEQ ID NO: 823519 - DNA, 22 bp, Artificial Sequence
  chemically synthesized
aaaaaaaaaaacgctttggaat

SEQ ID NO: 823520 - DNA, 22 bp, Artificial Sequence
  chemically synthesized
tagaccattccaaagcgttttt

SEQ ID NO: 823521 - DNA, 22 bp, Artificial Sequence
  chemically synthesized
aaattaaaaaaaaaaaacgctt

SEQ ID NO: 823522 - DNA, 22 bp, Artificial Sequence
  chemically synthesized
agaccattccaaagcgtttttt

SEQ ID NO: 823523 - DNA, 22 bp, Artificial Sequence
  chemically synthesized
gaaattaaaaaaaaaaaacgct

SEQ ID NO: 823524 - DNA, 22 bp, Artificial Sequence
  chemically synthesized
gaccattccaaagcgttttttt

SEQ ID NO: 823525 - DNA, 22 bp, Artificial Sequence
  chemically synthesized
tgaaattaaaaaaaaaaaacgc

SEQ ID NO: 823526 - DNA, 22 bp, Artificial Sequence
  chemically synthesized
ttgaaattaaaaaaaaaaaacg

SEQ ID NO: 823527 - DNA, 22 bp, Artificial Sequence
  chemically synthesized
caaagcgttttttttttttaat

SEQ ID NO: 823528 - DNA, 22 bp, Artificial Sequence
  chemically synthesized
tcaaacttttgaaattaaaaaa

SEQ ID NO: 823529 - DNA, 22 bp, Artificial Sequence
  chemically synthesized
gtcaaacttttgaaattaaaaa

SEQ ID NO: 823530 - DNA, 22 bp, Artificial Sequence
  chemically synthesized
tgtcaaacttttgaaattaaaa

SEQ ID NO: 823531 - DNA, 22 bp, Artificial Sequence
  chemically synthesized
tcctttgtcaaacttttgaaat

SEQ ID NO: 823532 - DNA, 22 bp, Artificial Sequence
  chemically synthesized
tttttttttaatttcaaaagtt

SEQ ID NO: 823533 - DNA, 22 bp, Artificial Sequence
  chemically synthesized
ttttttttaatttcaaaagttt

SEQ ID NO: 823534 - DNA, 22 bp, Artificial Sequence
  chemically synthesized
ctatcctttgtcaaacttttga

SEQ ID NO: 823535 - DNA, 22 bp, Artificial Sequence
  chemically synthesized
tttttttaatttcaaaagtttg

SEQ ID NO: 823536 - DNA, 22 bp, Artificial Sequence
  chemically synthesized
ttttttaatttcaaaagtttga

SEQ ID NO: 823537 - DNA, 22 bp, Artificial Sequence
  chemically synthesized
tttttaatttcaaaagtttgac

SEQ ID NO: 823538 - DNA, 22 bp, Artificial Sequence
  chemically synthesized
ttttaatttcaaaagtttgaca

SEQ ID NO: 823539 - DNA, 22 bp, Artificial Sequence
  chemically synthesized
tttaatttcaaaagtttgacaa

SEQ ID NO: 823540 - DNA, 22 bp, Artificial Sequence
  chemically synthesized
ttaatttcaaaagtttgacaaa

SEQ ID NO: 823541 - DNA, 22 bp, Artificial Sequence
  chemically synthesized
taattgctatcctttgtcaaac

SEQ ID NO: 823542 - DNA, 22 bp, Artificial Sequence
  chemically synthesized
taatttcaaaagtttgacaaag

SEQ ID NO: 823543 - DNA, 22 bp, Artificial Sequence
  chemically synthesized
aatttcaaaagtttgacaaagg

SEQ ID NO: 823544 - DNA, 22 bp, Artificial Sequence
  chemically synthesized
atttcaaaagtttgacaaagga

SEQ ID NO: 823545 - DNA, 22 bp, Artificial Sequence
  chemically synthesized
tattataattgctatcctttgt

SEQ ID NO: 823546 - DNA, 22 bp, Artificial Sequence
  chemically synthesized
caaaagtttgacaaaggatagc

SEQ ID NO: 823547 - DNA, 22 bp, Artificial Sequence
  chemically synthesized
aaaagtttgacaaaggatagca

SEQ ID NO: 823548 - DNA, 22 bp, Artificial Sequence
  chemically synthesized
gacaaaggatagcaattataat

SEQ ID NO: 823549 - DNA, 22 bp, Artificial Sequence
  chemically synthesized
acaaaggatagcaattataata

SEQ ID NO: 823550 - DNA, 22 bp, Artificial Sequence
  chemically synthesized
aaataaaaccagaattgtatta

SEQ ID NO: 823551 - DNA, 22 bp, Artificial Sequence
  chemically synthesized
atcacctaaaataaaaccagaa

SEQ ID NO: 823552 - DNA, 22 bp, Artificial Sequence
  chemically synthesized
aatcacctaaaataaaaccaga

SEQ ID NO: 823553 - DNA, 22 bp, Artificial Sequence
  chemically synthesized
taatcacctaaaataaaaccag

SEQ ID NO: 823554 - DNA, 22 bp, Artificial Sequence
  chemically synthesized
taatacaattctggttttattt

SEQ ID NO: 823555 - DNA, 22 bp, Artificial Sequence
  chemically synthesized
tggttttattttaggtgattaa

SEQ ID NO: 823556 - DNA, 22 bp, Artificial Sequence
  chemically synthesized
gttttattttaggtgattaaaa

SEQ ID NO: 823557 - DNA, 22 bp, Artificial Sequence
  chemically synthesized
tattttaggtgattaaaacatc

SEQ ID NO: 823558 - DNA, 22 bp, Artificial Sequence
  chemically synthesized
attttaggtgattaaaacatct

SEQ ID NO: 823559 - DNA, 22 bp, Artificial Sequence
  chemically synthesized
tcaaaacatgtaagatgtttta

SEQ ID NO: 823560 - DNA, 22 bp, Artificial Sequence
  chemically synthesized
ttttaggtgattaaaacatctt

SEQ ID NO: 823561 - DNA, 22 bp, Artificial Sequence
  chemically synthesized
taggtgattaaaacatcttaca

SEQ ID NO: 823562 - DNA, 22 bp, Artificial Sequence
  chemically synthesized
aggtgattaaaacatcttacat

SEQ ID NO: 823563 - DNA, 22 bp, Artificial Sequence
  chemically synthesized
cattgtcaaaacatgtaagatg

SEQ ID NO: 823564 - DNA, 22 bp, Artificial Sequence
  chemically synthesized
ggtgattaaaacatcttacatg

SEQ ID NO: 823565 - DNA, 22 bp, Artificial Sequence
  chemically synthesized
aaacatcttacatgttttgaca

SEQ ID NO: 823566 - DNA, 22 bp, Artificial Sequence
  chemically synthesized
acatgttttgacaatgcaattg

SEQ ID NO: 823567 - DNA, 22 bp, Artificial Sequence
  chemically synthesized
catgttttgacaatgcaattgt

SEQ ID NO: 823568 - DNA, 22 bp, Artificial Sequence
  chemically synthesized
tgacaatgcaattgttttgttt

SEQ ID NO: 823569 - DNA, 22 bp, Artificial Sequence
  chemically synthesized
gacaatgcaattgttttgtttt

SEQ ID NO: 823570 - DNA, 22 bp, Artificial Sequence
  chemically synthesized
acaatgcaattgttttgttttc

SEQ ID NO: 823571 - DNA, 22 bp, Artificial Sequence
  chemically synthesized
cagaaggaaatatgaaagtaga

SEQ ID NO: 823572 - DNA, 22 bp, Artificial Sequence
  chemically synthesized
ttttgttttctactttcatatt

SEQ ID NO: 823573 - DNA, 22 bp, Artificial Sequence
  chemically synthesized
tgttttctactttcatatttcc

SEQ ID NO: 823574 - DNA, 22 bp, Artificial Sequence
  chemically synthesized
gttttctactttcatatttcct

SEQ ID NO: 823575 - DNA, 22 bp, Artificial Sequence
  chemically synthesized
ttttctactttcatatttcctt

SEQ ID NO: 823576 - DNA, 22 bp, Artificial Sequence
  chemically synthesized
tctactttcatatttccttctg

SEQ ID NO: 823577 - DNA, 22 bp, Artificial Sequence
  chemically synthesized
ctactttcatatttccttctgc

SEQ ID NO: 823578 - DNA, 22 bp, Artificial Sequence
  chemically synthesized
tactttcatatttccttctgca

SEQ ID NO: 823579 - DNA, 22 bp, Artificial Sequence
  chemically synthesized
ctttcatatttccttctgcaga

SEQ ID NO: 823580 - DNA, 22 bp, Artificial Sequence
  chemically synthesized
tcatatttccttctgcagatat

SEQ ID NO: 823581 - DNA, 22 bp, Artificial Sequence
  chemically synthesized
catatttccttctgcagatatt

SEQ ID NO: 823582 - DNA, 22 bp, Artificial Sequence
  chemically synthesized
atatttccttctgcagatattt

SEQ ID NO: 823583 - DNA, 22 bp, Artificial Sequence
  chemically synthesized
aataagagacaaaaatatctgc

SEQ ID NO: 823584 - DNA, 22 bp, Artificial Sequence
  chemically synthesized
aaataagagacaaaaatatctg

SEQ ID NO: 823585 - DNA, 22 bp, Artificial Sequence
  chemically synthesized
taaataagagacaaaaatatct

SEQ ID NO: 823586 - DNA, 22 bp, Artificial Sequence
  chemically synthesized
ccttctgcagatatttttgtct

SEQ ID NO: 823587 - DNA, 22 bp, Artificial Sequence
  chemically synthesized
cttctgcagatatttttgtctc

SEQ ID NO: 823588 - DNA, 22 bp, Artificial Sequence
  chemically synthesized
ctgcagatatttttgtctctta

SEQ ID NO: 823589 - DNA, 22 bp, Artificial Sequence
  chemically synthesized
tgcagatatttttgtctcttat

SEQ ID NO: 823590 - DNA, 22 bp, Artificial Sequence
  chemically synthesized
cagatatttttgtctcttattt

SEQ ID NO: 823591 - DNA, 22 bp, Artificial Sequence
  chemically synthesized
gaagagcaagtagctttaaata

SEQ ID NO: 823592 - DNA, 22 bp, Artificial Sequence
  chemically synthesized
agaagagcaagtagctttaaat

SEQ ID NO: 823593 - DNA, 22 bp, Artificial Sequence
  chemically synthesized
ttagaagagcaagtagctttaa

SEQ ID NO: 823594 - DNA, 22 bp, Artificial Sequence
  chemically synthesized
ttgtctcttatttaaagctact

SEQ ID NO: 823595 - DNA, 22 bp, Artificial Sequence
  chemically synthesized
tgtctcttatttaaagctactt

SEQ ID NO: 823596 - DNA, 22 bp, Artificial Sequence
  chemically synthesized
gtctcttatttaaagctacttg

SEQ ID NO: 823597 - DNA, 22 bp, Artificial Sequence
  chemically synthesized
ctcttagaagagcaagtagctt

SEQ ID NO: 823598 - DNA, 22 bp, Artificial Sequence
  chemically synthesized
tctcttatttaaagctacttgc

SEQ ID NO: 823599 - DNA, 22 bp, Artificial Sequence
  chemically synthesized
attgctcttagaagagcaagta

SEQ ID NO: 823600 - DNA, 22 bp, Artificial Sequence
  chemically synthesized
ttatttaaagctacttgctctt

SEQ ID NO: 823601 - DNA, 22 bp, Artificial Sequence
  chemically synthesized
aattgctcttagaagagcaagt

SEQ ID NO: 823602 - DNA, 22 bp, Artificial Sequence
  chemically synthesized
atttaaagctacttgctcttct

SEQ ID NO: 823603 - DNA, 22 bp, Artificial Sequence
  chemically synthesized
tttaaagctacttgctcttcta

SEQ ID NO: 823604 - DNA, 22 bp, Artificial Sequence
  chemically synthesized
aaagctacttgctcttctaaga

SEQ ID NO: 823605 - DNA, 22 bp, Artificial Sequence
  chemically synthesized
gggtttaattgctcttagaaga

SEQ ID NO: 823606 - DNA, 22 bp, Artificial Sequence
  chemically synthesized
aagctacttgctcttctaagag

SEQ ID NO: 823607 - DNA, 22 bp, Artificial Sequence
  chemically synthesized
cttgctcttctaagagcaatta

SEQ ID NO: 823608 - DNA, 22 bp, Artificial Sequence
  chemically synthesized
gctcttctaagagcaattaaac

SEQ ID NO: 823609 - DNA, 22 bp, Artificial Sequence
  chemically synthesized
ctcttctaagagcaattaaacc

SEQ ID NO: 823610 - DNA, 22 bp, Artificial Sequence
  chemically synthesized
ttctaagagcaattaaacccta

SEQ ID NO: 823611 - DNA, 22 bp, Artificial Sequence
  chemically synthesized
ctaagagcaattaaaccctaac

SEQ ID NO: 823612 - DNA, 22 bp, Artificial Sequence
  chemically synthesized
taagagcaattaaaccctaacc

SEQ ID NO: 823613 - DNA, 22 bp, Artificial Sequence
  chemically synthesized
agagcaattaaaccctaaccat

SEQ ID NO: 823614 - DNA, 22 bp, Artificial Sequence
  chemically synthesized
aagtgatggtaagaatggttag

SEQ ID NO: 823615 - DNA, 22 bp, Artificial Sequence
  chemically synthesized
aaccctaaccattcttaccatc

SEQ ID NO: 823616 - DNA, 22 bp, Artificial Sequence
  chemically synthesized
agaaaatcctaaagtgatggta

SEQ ID NO: 823617 - DNA, 22 bp, Artificial Sequence
  chemically synthesized
accattcttaccatcactttag

SEQ ID NO: 823618 - DNA, 22 bp, Artificial Sequence
  chemically synthesized
acctaagaaaatcctaaagtga

SEQ ID NO: 823619 - DNA, 22 bp, Artificial Sequence
  chemically synthesized
aacctaagaaaatcctaaagtg

SEQ ID NO: 823620 - DNA, 22 bp, Artificial Sequence
  chemically synthesized
ttaccatcactttaggattttc

SEQ ID NO: 823621 - DNA, 22 bp, Artificial Sequence
  chemically synthesized
accatcactttaggattttctt

SEQ ID NO: 823622 - DNA, 22 bp, Artificial Sequence
  chemically synthesized
ccatcactttaggattttctta

SEQ ID NO: 823623 - DNA, 22 bp, Artificial Sequence
  chemically synthesized
taggattttcttaggttaaatt

SEQ ID NO: 823624 - DNA, 22 bp, Artificial Sequence
  chemically synthesized
aggattttcttaggttaaattt

SEQ ID NO: 823625 - DNA, 22 bp, Artificial Sequence
  chemically synthesized
ggattttcttaggttaaattta

SEQ ID NO: 823626 - DNA, 22 bp, Artificial Sequence
  chemically synthesized
gcaaatgagaaataaatttaac

SEQ ID NO: 823627 - DNA, 22 bp, Artificial Sequence
  chemically synthesized
tcttaggttaaatttatttctc

SEQ ID NO: 823628 - DNA, 22 bp, Artificial Sequence
  chemically synthesized
cttaggttaaatttatttctca

SEQ ID NO: 823629 - DNA, 22 bp, Artificial Sequence
  chemically synthesized
gtagttagcaaatgagaaataa

SEQ ID NO: 823630 - DNA, 22 bp, Artificial Sequence
  chemically synthesized
ttaggttaaatttatttctcat

SEQ ID NO: 823631 - DNA, 22 bp, Artificial Sequence
  chemically synthesized
tggtagttagcaaatgagaaat

SEQ ID NO: 823632 - DNA, 22 bp, Artificial Sequence
  chemically synthesized
aggttaaatttatttctcattt

SEQ ID NO: 823633 - DNA, 22 bp, Artificial Sequence
  chemically synthesized
ggttaaatttatttctcatttg

SEQ ID NO: 823634 - DNA, 22 bp, Artificial Sequence
  chemically synthesized
aatttatttctcatttgctaac

SEQ ID NO: 823635 - DNA, 22 bp, Artificial Sequence
  chemically synthesized
atttctcatttgctaactacca

SEQ ID NO: 823636 - DNA, 22 bp, Artificial Sequence
  chemically synthesized
tttctcatttgctaactaccag

SEQ ID NO: 823637 - DNA, 22 bp, Artificial Sequence
  chemically synthesized
gggcaagaggactctggtagtt

SEQ ID NO: 823638 - DNA, 22 bp, Artificial Sequence
  chemically synthesized
ctcatttgctaactaccagagt

SEQ ID NO: 823639 - DNA, 22 bp, Artificial Sequence
  chemically synthesized
tcatttgctaactaccagagtc

SEQ ID NO: 823640 - DNA, 22 bp, Artificial Sequence
  chemically synthesized
actagggcaagaggactctggt

SEQ ID NO: 823641 - DNA, 22 bp, Artificial Sequence
  chemically synthesized
atttgctaactaccagagtcct

SEQ ID NO: 823642 - DNA, 22 bp, Artificial Sequence
  chemically synthesized
gactagggcaagaggactctgg

SEQ ID NO: 823643 - DNA, 22 bp, Artificial Sequence
  chemically synthesized
gctaactaccagagtcctcttg

SEQ ID NO: 823644 - DNA, 22 bp, Artificial Sequence
  chemically synthesized
ctaactaccagagtcctcttgc

SEQ ID NO: 823645 - DNA, 22 bp, Artificial Sequence
  chemically synthesized
actaccagagtcctcttgccct

SEQ ID NO: 823646 - DNA, 22 bp, Artificial Sequence
  chemically synthesized
ccagagtcctcttgccctagtc

SEQ ID NO: 823647 - DNA, 22 bp, Artificial Sequence
  chemically synthesized
ttgccctagtcaaatctatcac

SEQ ID NO: 823648 - DNA, 22 bp, Artificial Sequence
  chemically synthesized
gccctagtcaaatctatcactg

SEQ ID NO: 823649 - DNA, 22 bp, Artificial Sequence
  chemically synthesized
ccctagtcaaatctatcactgt

SEQ ID NO: 823650 - DNA, 22 bp, Artificial Sequence
  chemically synthesized
gtcaaatctatcactgtatgcc

SEQ ID NO: 823651 - DNA, 22 bp, Artificial Sequence
  chemically synthesized
tcactgtatgcctctcatctct

SEQ ID NO: 823652 - DNA, 22 bp, Artificial Sequence
  chemically synthesized
gatgagaagaaggagagatgag

SEQ ID NO: 823653 - DNA, 22 bp, Artificial Sequence
  chemically synthesized
tatgcctctcatctctccttct

SEQ ID NO: 823654 - DNA, 22 bp, Artificial Sequence
  chemically synthesized
agttagatgagaagaaggagag

SEQ ID NO: 823655 - DNA, 22 bp, Artificial Sequence
  chemically synthesized
gagttagatgagaagaaggaga

SEQ ID NO: 823656 - DNA, 22 bp, Artificial Sequence
  chemically synthesized
tcatctctccttcttctcatct

SEQ ID NO: 823657 - DNA, 22 bp, Artificial Sequence
  chemically synthesized
gatccttgagttagatgagaag

SEQ ID NO: 823658 - DNA, 22 bp, Artificial Sequence
  chemically synthesized
atctctccttcttctcatctaa

SEQ ID NO: 823659 - DNA, 22 bp, Artificial Sequence
  chemically synthesized
gactggatccttgagttagatg

SEQ ID NO: 823660 - DNA, 22 bp, Artificial Sequence
  chemically synthesized
ggactggatccttgagttagat

SEQ ID NO: 823661 - DNA, 22 bp, Artificial Sequence
  chemically synthesized
tccttcttctcatctaactcaa

SEQ ID NO: 823662 - DNA, 22 bp, Artificial Sequence
  chemically synthesized
cttcttctcatctaactcaagg

SEQ ID NO: 823663 - DNA, 22 bp, Artificial Sequence
  chemically synthesized
cttctcatctaactcaaggatc

SEQ ID NO: 823664 - DNA, 22 bp, Artificial Sequence
  chemically synthesized
ttctcatctaactcaaggatcc

SEQ ID NO: 823665 - DNA, 22 bp, Artificial Sequence
  chemically synthesized
ctcatctaactcaaggatccag

SEQ ID NO: 823666 - DNA, 22 bp, Artificial Sequence
  chemically synthesized
tcatctaactcaaggatccagt

SEQ ID NO: 823667 - DNA, 22 bp, Artificial Sequence
  chemically synthesized
atctaactcaaggatccagtcc

SEQ ID NO: 823668 - DNA, 22 bp, Artificial Sequence
  chemically synthesized
actcaaggatccagtccaaact

SEQ ID NO: 823669 - DNA, 22 bp, Artificial Sequence
  chemically synthesized
aaggatccagtccaaacttcgt

SEQ ID NO: 823670 - DNA, 22 bp, Artificial Sequence
  chemically synthesized
gtaagaaggtataagcagaaaa

SEQ ID NO: 823671 - DNA, 22 bp, Artificial Sequence
  chemically synthesized
actggtaagaaggtataagcag

SEQ ID NO: 823672 - DNA, 22 bp, Artificial Sequence
  chemically synthesized
cgtattttctgcttataccttc

SEQ ID NO: 823673 - DNA, 22 bp, Artificial Sequence
  chemically synthesized
gtattttctgcttataccttct

SEQ ID NO: 823674 - DNA, 22 bp, Artificial Sequence
  chemically synthesized
tctgcttataccttcttaccag

SEQ ID NO: 823675 - DNA, 22 bp, Artificial Sequence
  chemically synthesized
ctgcttataccttcttaccagt

SEQ ID NO: 823676 - DNA, 22 bp, Artificial Sequence
  chemically synthesized
tgcttataccttcttaccagtt

SEQ ID NO: 823677 - DNA, 22 bp, Artificial Sequence
  chemically synthesized
cttataccttcttaccagttaa

SEQ ID NO: 823678 - DNA, 22 bp, Artificial Sequence
  chemically synthesized
ataccttcttaccagttaacta

SEQ ID NO: 823679 - DNA, 22 bp, Artificial Sequence
  chemically synthesized
taccttcttaccagttaactac

SEQ ID NO: 823680 - DNA, 22 bp, Artificial Sequence
  chemically synthesized
gatcacaaaccaaagtagttaa

SEQ ID NO: 823681 - DNA, 22 bp, Artificial Sequence
  chemically synthesized
ttggatcacaaaccaaagtagt

SEQ ID NO: 823682 - DNA, 22 bp, Artificial Sequence
  chemically synthesized
cttaccagttaactactttggt

SEQ ID NO: 823683 - DNA, 22 bp, Artificial Sequence
  chemically synthesized
ttaccagttaactactttggtt

SEQ ID NO: 823684 - DNA, 22 bp, Artificial Sequence
  chemically synthesized
accagttaactactttggtttg

SEQ ID NO: 823685 - DNA, 22 bp, Artificial Sequence
  chemically synthesized
ccagttaactactttggtttgt

SEQ ID NO: 823686 - DNA, 22 bp, Artificial Sequence
  chemically synthesized
tgaatctattggatcacaaacc

SEQ ID NO: 823687 - DNA, 22 bp, Artificial Sequence
  chemically synthesized
actactttggtttgtgatccaa

SEQ ID NO: 823688 - DNA, 22 bp, Artificial Sequence
  chemically synthesized
ctttggtttgtgatccaataga

SEQ ID NO: 823689 - DNA, 22 bp, Artificial Sequence
  chemically synthesized
ggatactatgaatctattggat

SEQ ID NO: 823690 - DNA, 22 bp, Artificial Sequence
  chemically synthesized
cggatactatgaatctattgga

SEQ ID NO: 823691 - DNA, 22 bp, Artificial Sequence
  chemically synthesized
tggtttgtgatccaatagattc

SEQ ID NO: 823692 - DNA, 22 bp, Artificial Sequence
  chemically synthesized
ggtttgtgatccaatagattca

SEQ ID NO: 823693 - DNA, 22 bp, Artificial Sequence
  chemically synthesized
gtttgtgatccaatagattcat

SEQ ID NO: 823694 - DNA, 22 bp, Artificial Sequence
  chemically synthesized
taagtttcggatactatgaatc

SEQ ID NO: 823695 - DNA, 22 bp, Artificial Sequence
  chemically synthesized
gtgatccaatagattcatagta

SEQ ID NO: 823696 - DNA, 22 bp, Artificial Sequence
  chemically synthesized
tgatccaatagattcatagtat

SEQ ID NO: 823697 - DNA, 22 bp, Artificial Sequence
  chemically synthesized
tataagtttcggatactatgaa

SEQ ID NO: 823698 - DNA, 22 bp, Artificial Sequence
  chemically synthesized
tctataagtttcggatactatg

SEQ ID NO: 823699 - DNA, 22 bp, Artificial Sequence
  chemically synthesized
ctctataagtttcggatactat

SEQ ID NO: 823700 - DNA, 22 bp, Artificial Sequence
  chemically synthesized
ttctctataagtttcggatact

SEQ ID NO: 823701 - DNA, 22 bp, Artificial Sequence
  chemically synthesized
cttctctataagtttcggatac

SEQ ID NO: 823702 - DNA, 22 bp, Artificial Sequence
  chemically synthesized
tcttctctataagtttcggata

SEQ ID NO: 823703 - DNA, 22 bp, Artificial Sequence
  chemically synthesized
ttcttctctataagtttcggat

SEQ ID NO: 823704 - DNA, 22 bp, Artificial Sequence
  chemically synthesized
tttcttctctataagtttcgga

SEQ ID NO: 823705 - DNA, 22 bp, Artificial Sequence
  chemically synthesized
tttttcttctctataagtttcg

SEQ ID NO: 823706 - DNA, 22 bp, Artificial Sequence
  chemically synthesized
ctttttcttctctataagtttc

SEQ ID NO: 823707 - DNA, 22 bp, Artificial Sequence
  chemically synthesized
atagtatccgaaacttatagag

SEQ ID NO: 823708 - DNA, 22 bp, Artificial Sequence
  chemically synthesized
cttctttttcttctctataagt

SEQ ID NO: 823709 - DNA, 22 bp, Artificial Sequence
  chemically synthesized
tgctacttctttttcttctcta

SEQ ID NO: 823710 - DNA, 22 bp, Artificial Sequence
  chemically synthesized
atagagaagaaaaagaagtagc

SEQ ID NO: 823711 - DNA, 22 bp, Artificial Sequence
  chemically synthesized
tagagaagaaaaagaagtagca

SEQ ID NO: 823712 - DNA, 22 bp, Artificial Sequence
  chemically synthesized
gtgaggtagtcagcatgttatg

SEQ ID NO: 823713 - DNA, 22 bp, Artificial Sequence
  chemically synthesized
gtcatattcgtgaggtagtcag

SEQ ID NO: 823714 - DNA, 22 bp, Artificial Sequence
  chemically synthesized
tagtcatattcgtgaggtagtc

SEQ ID NO: 823715 - DNA, 22 bp, Artificial Sequence
  chemically synthesized
aaagctctagtcatattcgtga

SEQ ID NO: 823716 - DNA, 22 bp, Artificial Sequence
  chemically synthesized
gaaagctctagtcatattcgtg

SEQ ID NO: 823717 - DNA, 22 bp, Artificial Sequence
  chemically synthesized
ttgaaagctctagtcatattcg

SEQ ID NO: 823718 - DNA, 22 bp, Artificial Sequence
  chemically synthesized
actacctcacgaatatgactag

SEQ ID NO: 823719 - DNA, 22 bp, Artificial Sequence
  chemically synthesized
ttcttgaaagctctagtcatat

SEQ ID NO: 823720 - DNA, 22 bp, Artificial Sequence
  chemically synthesized
cctcacgaatatgactagagct

SEQ ID NO: 823721 - DNA, 22 bp, Artificial Sequence
  chemically synthesized
acgaatatgactagagctttca

SEQ ID NO: 823722 - DNA, 22 bp, Artificial Sequence
  chemically synthesized
gagctttcaagaataaccacat

SEQ ID NO: 823723 - DNA, 22 bp, Artificial Sequence
  chemically synthesized
tgtaatatatagaatcatgtgg

SEQ ID NO: 823724 - DNA, 22 bp, Artificial Sequence
  chemically synthesized
tcaagaataaccacatgattct

SEQ ID NO: 823725 - DNA, 22 bp, Artificial Sequence
  chemically synthesized
caagaataaccacatgattcta

SEQ ID NO: 823726 - DNA, 22 bp, Artificial Sequence
  chemically synthesized
aagaataaccacatgattctat

SEQ ID NO: 823727 - DNA, 22 bp, Artificial Sequence
  chemically synthesized
actatgtaatatatagaatcat

SEQ ID NO: 823728 - DNA, 22 bp, Artificial Sequence
  chemically synthesized
gtctgactatgtaatatataga

SEQ ID NO: 823729 - DNA, 22 bp, Artificial Sequence
  chemically synthesized
ctggtctgactatgtaatatat

SEQ ID NO: 823730 - DNA, 22 bp, Artificial Sequence
  chemically synthesized
attcctggtctgactatgtaat

SEQ ID NO: 823731 - DNA, 22 bp, Artificial Sequence
  chemically synthesized
ctaattcctggtctgactatgt

SEQ ID NO: 823732 - DNA, 22 bp, Artificial Sequence
  chemically synthesized
cctaattcctggtctgactatg

SEQ ID NO: 823733 - DNA, 22 bp, Artificial Sequence
  chemically synthesized
tcctaattcctggtctgactat

SEQ ID NO: 823734 - DNA, 22 bp, Artificial Sequence
  chemically synthesized
tatatattacatagtcagacca

SEQ ID NO: 823735 - DNA, 22 bp, Artificial Sequence
  chemically synthesized
tatattacatagtcagaccagg

SEQ ID NO: 823736 - DNA, 22 bp, Artificial Sequence
  chemically synthesized
catagtcagaccaggaattagg

SEQ ID NO: 823737 - DNA, 22 bp, Artificial Sequence
  chemically synthesized
caatggtcattttcctaattcc

SEQ ID NO: 823738 - DNA, 22 bp, Artificial Sequence
  chemically synthesized
ggaatctccaatggtcattttc

SEQ ID NO: 823739 - DNA, 22 bp, Artificial Sequence
  chemically synthesized
ggaaaatgaccattggagattc

SEQ ID NO: 823740 - DNA, 22 bp, Artificial Sequence
  chemically synthesized
aatggatgagcatagatgaatt

SEQ ID NO: 823741 - DNA, 22 bp, Artificial Sequence
  chemically synthesized
caatggatgagcatagatgaat

SEQ ID NO: 823742 - DNA, 22 bp, Artificial Sequence
  chemically synthesized
tcaatggatgagcatagatgaa

SEQ ID NO: 823743 - DNA, 22 bp, Artificial Sequence
  chemically synthesized
gagattcctaattcatctatgc

SEQ ID NO: 823744 - DNA, 22 bp, Artificial Sequence
  chemically synthesized
ttcaatggatgagcatagatga

SEQ ID NO: 823745 - DNA, 22 bp, Artificial Sequence
  chemically synthesized
tttcaatggatgagcatagatg

SEQ ID NO: 823746 - DNA, 22 bp, Artificial Sequence
  chemically synthesized
ctaattcatctatgctcatcca

SEQ ID NO: 823747 - DNA, 22 bp, Artificial Sequence
  chemically synthesized
atggttttttcaatggatgagc

SEQ ID NO: 823748 - DNA, 22 bp, Artificial Sequence
  chemically synthesized
attcatctatgctcatccattg

SEQ ID NO: 823749 - DNA, 22 bp, Artificial Sequence
  chemically synthesized
atctatgctcatccattgaaaa

SEQ ID NO: 823750 - DNA, 22 bp, Artificial Sequence
  chemically synthesized
ccactaatggttttttcaatgg

SEQ ID NO: 823751 - DNA, 22 bp, Artificial Sequence
  chemically synthesized
tgctcatccattgaaaaaacca

SEQ ID NO: 823752 - DNA, 22 bp, Artificial Sequence
  chemically synthesized
atccattgaaaaaaccattagt

SEQ ID NO: 823753 - DNA, 22 bp, Artificial Sequence
  chemically synthesized
aagagacacatgttaccactaa

SEQ ID NO: 823754 - DNA, 22 bp, Artificial Sequence
  chemically synthesized
caagagacacatgttaccacta

SEQ ID NO: 823755 - DNA, 22 bp, Artificial Sequence
  chemically synthesized
tcaagagacacatgttaccact

SEQ ID NO: 823756 - DNA, 22 bp, Artificial Sequence
  chemically synthesized
aaaaaaccattagtggtaacat

SEQ ID NO: 823757 - DNA, 22 bp, Artificial Sequence
  chemically synthesized
tttcaagagacacatgttacca

SEQ ID NO: 823758 - DNA, 22 bp, Artificial Sequence
  chemically synthesized
gtggtaacatgtgtctcttgaa

SEQ ID NO: 823759 - DNA, 22 bp, Artificial Sequence
  chemically synthesized
ggtgaataaaaattctttcaag

SEQ ID NO: 823760 - DNA, 22 bp, Artificial Sequence
  chemically synthesized
ttgaaagaatttttattcacct

SEQ ID NO: 823761 - DNA, 22 bp, Artificial Sequence
  chemically synthesized
gagtcaaaatctaggtgaataa

SEQ ID NO: 823762 - DNA, 22 bp, Artificial Sequence
  chemically synthesized
gaaagaatttttattcacctag

SEQ ID NO: 823763 - DNA, 22 bp, Artificial Sequence
  chemically synthesized
aaagaatttttattcacctaga

SEQ ID NO: 823764 - DNA, 22 bp, Artificial Sequence
  chemically synthesized
ttggagtcaaaatctaggtgaa

SEQ ID NO: 823765 - DNA, 22 bp, Artificial Sequence
  chemically synthesized
tgttggagtcaaaatctaggtg

SEQ ID NO: 823766 - DNA, 22 bp, Artificial Sequence
  chemically synthesized
gctctgttggagtcaaaatcta

SEQ ID NO: 823767 - DNA, 22 bp, Artificial Sequence
  chemically synthesized
ttattcacctagattttgactc

SEQ ID NO: 823768 - DNA, 22 bp, Artificial Sequence
  chemically synthesized
tattcacctagattttgactcc

SEQ ID NO: 823769 - DNA, 22 bp, Artificial Sequence
  chemically synthesized
attcacctagattttgactcca

SEQ ID NO: 823770 - DNA, 22 bp, Artificial Sequence
  chemically synthesized
ttcacctagattttgactccaa

SEQ ID NO: 823771 - DNA, 22 bp, Artificial Sequence
  chemically synthesized
tcattagctctgttggagtcaa

SEQ ID NO: 823772 - DNA, 22 bp, Artificial Sequence
  chemically synthesized
atcattagctctgttggagtca

SEQ ID NO: 823773 - DNA, 22 bp, Artificial Sequence
  chemically synthesized
acctagattttgactccaacag

SEQ ID NO: 823774 - DNA, 22 bp, Artificial Sequence
  chemically synthesized
gattttgactccaacagagcta

SEQ ID NO: 823775 - DNA, 22 bp, Artificial Sequence
  chemically synthesized
cagtcttatcattagctctgtt

SEQ ID NO: 823776 - DNA, 22 bp, Artificial Sequence
  chemically synthesized
acagtcttatcattagctctgt

SEQ ID NO: 823777 - DNA, 22 bp, Artificial Sequence
  chemically synthesized
tacagtcttatcattagctctg

SEQ ID NO: 823778 - DNA, 22 bp, Artificial Sequence
  chemically synthesized
tgactccaacagagctaatgat

SEQ ID NO: 823779 - DNA, 22 bp, Artificial Sequence
  chemically synthesized
gactccaacagagctaatgata

SEQ ID NO: 823780 - DNA, 22 bp, Artificial Sequence
  chemically synthesized
actccaacagagctaatgataa

SEQ ID NO: 823781 - DNA, 22 bp, Artificial Sequence
  chemically synthesized
caacagagctaatgataagact

SEQ ID NO: 823782 - DNA, 22 bp, Artificial Sequence
  chemically synthesized
gaaagccacatagaattttaca

SEQ ID NO: 823783 - DNA, 22 bp, Artificial Sequence
  chemically synthesized
atgataagactgtaaaattcta

SEQ ID NO: 823784 - DNA, 22 bp, Artificial Sequence
  chemically synthesized
taaaattctatgtggctttcta

SEQ ID NO: 823785 - DNA, 22 bp, Artificial Sequence
  chemically synthesized
tatgatgaggatgttagaaagc

SEQ ID NO: 823786 - DNA, 22 bp, Artificial Sequence
  chemically synthesized
atatgatgaggatgttagaaag

SEQ ID NO: 823787 - DNA, 22 bp, Artificial Sequence
  chemically synthesized
gtttatatgatgaggatgttag

SEQ ID NO: 823788 - DNA, 22 bp, Artificial Sequence
  chemically synthesized
tatgtggctttctaacatcctc

SEQ ID NO: 823789 - DNA, 22 bp, Artificial Sequence
  chemically synthesized
agtttatatgatgaggatgtta

SEQ ID NO: 823790 - DNA, 22 bp, Artificial Sequence
  chemically synthesized
tagtttatatgatgaggatgtt

SEQ ID NO: 823791 - DNA, 22 bp, Artificial Sequence
  chemically synthesized
tgtggctttctaacatcctcat

SEQ ID NO: 823792 - DNA, 22 bp, Artificial Sequence
  chemically synthesized
tctaacatcctcatcatataaa

SEQ ID NO: 823793 - DNA, 22 bp, Artificial Sequence
  chemically synthesized
ctaacatcctcatcatataaac

SEQ ID NO: 823794 - DNA, 22 bp, Artificial Sequence
  chemically synthesized
taacatcctcatcatataaact

SEQ ID NO: 823795 - DNA, 22 bp, Artificial Sequence
  chemically synthesized
acatcctcatcatataaactaa

SEQ ID NO: 823796 - DNA, 22 bp, Artificial Sequence
  chemically synthesized
tgaggacaaggttttagtttat

SEQ ID NO: 823797 - DNA, 22 bp, Artificial Sequence
  chemically synthesized
ctatgaggacaaggttttagtt

SEQ ID NO: 823798 - DNA, 22 bp, Artificial Sequence
  chemically synthesized
atcatataaactaaaaccttgt

SEQ ID NO: 823799 - DNA, 22 bp, Artificial Sequence
  chemically synthesized
agctgctatgaggacaaggttt

SEQ ID NO: 823800 - DNA, 22 bp, Artificial Sequence
  chemically synthesized
aaaccttgtcctcatagcagct

SEQ ID NO: 823801 - DNA, 22 bp, Artificial Sequence
  chemically synthesized
tcgaagggacctgagctgctat

SEQ ID NO: 823802 - DNA, 22 bp, Artificial Sequence
  chemically synthesized
atcgaagggacctgagctgcta

SEQ ID NO: 823803 - DNA, 22 bp, Artificial Sequence
  chemically synthesized
tatcgaagggacctgagctgct

SEQ ID NO: 823804 - DNA, 22 bp, Artificial Sequence
  chemically synthesized
gtcctcatagcagctcaggtcc

SEQ ID NO: 823805 - DNA, 22 bp, Artificial Sequence
  chemically synthesized
tcctcatagcagctcaggtccc

SEQ ID NO: 823806 - DNA, 22 bp, Artificial Sequence
  chemically synthesized
atagcagctcaggtcccttcga

SEQ ID NO: 823807 - DNA, 22 bp, Artificial Sequence
  chemically synthesized
tcatagccattttatcgaaggg

SEQ ID NO: 823808 - DNA, 22 bp, Artificial Sequence
  chemically synthesized
tgtcatagccattttatcgaag

SEQ ID NO: 823809 - DNA, 22 bp, Artificial Sequence
  chemically synthesized
aggtcccttcgataaaatggct

SEQ ID NO: 823810 - DNA, 22 bp, Artificial Sequence
  chemically synthesized
gccaatctctgtcatagccatt

SEQ ID NO: 823811 - DNA, 22 bp, Artificial Sequence
  chemically synthesized
agccaatctctgtcatagccat

SEQ ID NO: 823812 - DNA, 22 bp, Artificial Sequence
  chemically synthesized
tagccaatctctgtcatagcca

SEQ ID NO: 823813 - DNA, 22 bp, Artificial Sequence
  chemically synthesized
ttagccaatctctgtcatagcc

SEQ ID NO: 823814 - DNA, 22 bp, Artificial Sequence
  chemically synthesized
cgataaaatggctatgacagag

SEQ ID NO: 823815 - DNA, 22 bp, Artificial Sequence
  chemically synthesized
gataaaatggctatgacagaga

SEQ ID NO: 823816 - DNA, 22 bp, Artificial Sequence
  chemically synthesized
gtgagcttttagccaatctctg

SEQ ID NO: 823817 - DNA, 22 bp, Artificial Sequence
  chemically synthesized
tgacagagattggctaaaagct

SEQ ID NO: 823818 - DNA, 22 bp, Artificial Sequence
  chemically synthesized
atggaattagtgagcttttagc

SEQ ID NO: 823819 - DNA, 22 bp, Artificial Sequence
  chemically synthesized
aggaagagttaatggaattagt

SEQ ID NO: 823820 - DNA, 22 bp, Artificial Sequence
  chemically synthesized
gctaaaagctcactaattccat

SEQ ID NO: 823821 - DNA, 22 bp, Artificial Sequence
  chemically synthesized
caggaagagttaatggaattag

SEQ ID NO: 823822 - DNA, 22 bp, Artificial Sequence
  chemically synthesized
aaagctcactaattccattaac

SEQ ID NO: 823823 - DNA, 22 bp, Artificial Sequence
  chemically synthesized
aatttcaggaagagttaatgga

SEQ ID NO: 823824 - DNA, 22 bp, Artificial Sequence
  chemically synthesized
gattgaatttcaggaagagtta

SEQ ID NO: 823825 - DNA, 22 bp, Artificial Sequence
  chemically synthesized
actaattccattaactcttcct

SEQ ID NO: 823826 - DNA, 22 bp, Artificial Sequence
  chemically synthesized
tcgattgaatttcaggaagagt

SEQ ID NO: 823827 - DNA, 22 bp, Artificial Sequence
  chemically synthesized
attccattaactcttcctgaaa

SEQ ID NO: 823828 - DNA, 22 bp, Artificial Sequence
  chemically synthesized
ttctcgattgaatttcaggaag

SEQ ID NO: 823829 - DNA, 22 bp, Artificial Sequence
  chemically synthesized
gttctcgattgaatttcaggaa

SEQ ID NO: 823830 - DNA, 22 bp, Artificial Sequence
  chemically synthesized
cattaactcttcctgaaattca

SEQ ID NO: 823831 - DNA, 22 bp, Artificial Sequence
  chemically synthesized
actcttcctgaaattcaatcga

SEQ ID NO: 823832 - DNA, 22 bp, Artificial Sequence
  chemically synthesized
ttcctgaaattcaatcgagaac

SEQ ID NO: 823833 - DNA, 22 bp, Artificial Sequence
  chemically synthesized
cctgaaattcaatcgagaacaa

SEQ ID NO: 823834 - DNA, 22 bp, Artificial Sequence
  chemically synthesized
ctgaaattcaatcgagaacaag

SEQ ID NO: 823835 - DNA, 22 bp, Artificial Sequence
  chemically synthesized
aaattcaatcgagaacaagttc

SEQ ID NO: 823836 - DNA, 22 bp, Artificial Sequence
  chemically synthesized
aatcgagaacaagttctgtgtg

SEQ ID NO: 823837 - DNA, 22 bp, Artificial Sequence
  chemically synthesized
caccacatcccatcacacagaa

SEQ ID NO: 823838 - DNA, 22 bp, Artificial Sequence
  chemically synthesized
ccaccacatcccatcacacaga

SEQ ID NO: 823839 - DNA, 22 bp, Artificial Sequence
  chemically synthesized
tgtatatcacttccaccacatc

SEQ ID NO: 823840 - DNA, 22 bp, Artificial Sequence
  chemically synthesized
tgtgtgatgggatgtggtggaa

SEQ ID NO: 823841 - DNA, 22 bp, Artificial Sequence
  chemically synthesized
tgtgatgggatgtggtggaagt

SEQ ID NO: 823842 - DNA, 22 bp, Artificial Sequence
  chemically synthesized
gaaattatgtatatcacttcca

SEQ ID NO: 823843 - DNA, 22 bp, Artificial Sequence
  chemically synthesized
tggccaggcctggaaattatgt

SEQ ID NO: 823844 - DNA, 22 bp, Artificial Sequence
  chemically synthesized
atggccaggcctggaaattatg

SEQ ID NO: 823845 - DNA, 22 bp, Artificial Sequence
  chemically synthesized
tatggccaggcctggaaattat

SEQ ID NO: 823846 - DNA, 22 bp, Artificial Sequence
  chemically synthesized
ccaggcctggccataaaacacc

SEQ ID NO: 823847 - DNA, 22 bp, Artificial Sequence
  chemically synthesized
caggcctggccataaaacacca

SEQ ID NO: 823848 - DNA, 22 bp, Artificial Sequence
  chemically synthesized
gccataaaacaccatggattga

SEQ ID NO: 823849 - DNA, 22 bp, Artificial Sequence
  chemically synthesized
cagaaaaggaagacagaatgtg

SEQ ID NO: 823850 - DNA, 22 bp, Artificial Sequence
  chemically synthesized
actgaccacattctgtcttcct

SEQ ID NO: 823851 - DNA, 22 bp, Artificial Sequence
  chemically synthesized
accacattctgtcttccttttc

SEQ ID NO: 823852 - DNA, 22 bp, Artificial Sequence
  chemically synthesized
ccaaaagccactgcagaaaagg

SEQ ID NO: 823853 - DNA, 22 bp, Artificial Sequence
  chemically synthesized
tgtcttccttttctgcagtggc

SEQ ID NO: 823854 - DNA, 22 bp, Artificial Sequence
  chemically synthesized
tcttccttttctgcagtggctt

SEQ ID NO: 823855 - DNA, 22 bp, Artificial Sequence
  chemically synthesized
aacacactgccaaaagccactg

SEQ ID NO: 823856 - DNA, 22 bp, Artificial Sequence
  chemically synthesized
caacacactgccaaaagccact

SEQ ID NO: 823857 - DNA, 22 bp, Artificial Sequence
  chemically synthesized
tcaacacactgccaaaagccac

SEQ ID NO: 823858 - DNA, 22 bp, Artificial Sequence
  chemically synthesized
ccttttctgcagtggcttttgg

SEQ ID NO: 823859 - DNA, 22 bp, Artificial Sequence
  chemically synthesized
cttttctgcagtggcttttggc

SEQ ID NO: 823860 - DNA, 22 bp, Artificial Sequence
  chemically synthesized
ttctgcagtggcttttggcagt

SEQ ID NO: 823861 - DNA, 22 bp, Artificial Sequence
  chemically synthesized
tctgcagtggcttttggcagtg

SEQ ID NO: 823862 - DNA, 22 bp, Artificial Sequence
  chemically synthesized
tcattttcaacacactgccaaa

SEQ ID NO: 823863 - DNA, 22 bp, Artificial Sequence
  chemically synthesized
ctgcagtggcttttggcagtgt

SEQ ID NO: 823864 - DNA, 22 bp, Artificial Sequence
  chemically synthesized
gtcattttcaacacactgccaa

SEQ ID NO: 823865 - DNA, 22 bp, Artificial Sequence
  chemically synthesized
tgcagtggcttttggcagtgtg

SEQ ID NO: 823866 - DNA, 22 bp, Artificial Sequence
  chemically synthesized
cagtggcttttggcagtgtgtt

SEQ ID NO: 823867 - DNA, 22 bp, Artificial Sequence
  chemically synthesized
tgacacttgtcattttcaacac

SEQ ID NO: 823868 - DNA, 22 bp, Artificial Sequence
  chemically synthesized
gtgacacttgtcattttcaaca

SEQ ID NO: 823869 - DNA, 22 bp, Artificial Sequence
  chemically synthesized
tgtgacacttgtcattttcaac

SEQ ID NO: 823870 - DNA, 22 bp, Artificial Sequence
  chemically synthesized
ttggcagtgtgttgaaaatgac

SEQ ID NO: 823871 - DNA, 22 bp, Artificial Sequence
  chemically synthesized
tggcagtgtgttgaaaatgaca

SEQ ID NO: 823872 - DNA, 22 bp, Artificial Sequence
  chemically synthesized
ggcagtgtgttgaaaatgacaa

SEQ ID NO: 823873 - DNA, 22 bp, Artificial Sequence
  chemically synthesized
gcagtgtgttgaaaatgacaag

SEQ ID NO: 823874 - DNA, 22 bp, Artificial Sequence
  chemically synthesized
caattttgtgacacttgtcatt

SEQ ID NO: 823875 - DNA, 22 bp, Artificial Sequence
  chemically synthesized
ccaattttgtgacacttgtcat

SEQ ID NO: 823876 - DNA, 22 bp, Artificial Sequence
  chemically synthesized
tccaattttgtgacacttgtca

SEQ ID NO: 823877 - DNA, 22 bp, Artificial Sequence
  chemically synthesized
ttccaattttgtgacacttgtc

SEQ ID NO: 823878 - DNA, 22 bp, Artificial Sequence
  chemically synthesized
aaaatgacaagtgtcacaaaat

SEQ ID NO: 823879 - DNA, 22 bp, Artificial Sequence
  chemically synthesized
gaaacccagacttttccaattt

SEQ ID NO: 823880 - DNA, 22 bp, Artificial Sequence
  chemically synthesized
ggaaacccagacttttccaatt

SEQ ID NO: 823881 - DNA, 22 bp, Artificial Sequence
  chemically synthesized
gaaaagtctgggtttccaagtg

SEQ ID NO: 823882 - DNA, 22 bp, Artificial Sequence
  chemically synthesized
tcccccaacatggtcacttgga

SEQ ID NO: 823883 - DNA, 22 bp, Artificial Sequence
  chemically synthesized
ggagctgtcccccaacatggtc

SEQ ID NO: 823884 - DNA, 22 bp, Artificial Sequence
  chemically synthesized
ggtttccaagtgaccatgttgg

SEQ ID NO: 823885 - DNA, 22 bp, Artificial Sequence
  chemically synthesized
aggagctgtcccccaacatggt

SEQ ID NO: 823886 - DNA, 22 bp, Artificial Sequence
  chemically synthesized
ttaggagctgtcccccaacatg

SEQ ID NO: 823887 - DNA, 22 bp, Artificial Sequence
  chemically synthesized
ccaagtgaccatgttgggggac

SEQ ID NO: 823888 - DNA, 22 bp, Artificial Sequence
  chemically synthesized
caagtgaccatgttgggggaca

SEQ ID NO: 823889 - DNA, 22 bp, Artificial Sequence
  chemically synthesized
acaagccattcttaggagctgt

SEQ ID NO: 823890 - DNA, 22 bp, Artificial Sequence
  chemically synthesized
ggggacagctcctaagaatggc

SEQ ID NO: 823891 - DNA, 22 bp, Artificial Sequence
  chemically synthesized
ctaagaatggcttgtcaacctc

SEQ ID NO: 823892 - DNA, 22 bp, Artificial Sequence
  chemically synthesized
agaatggcttgtcaacctctac

SEQ ID NO: 823893 - DNA, 22 bp, Artificial Sequence
  chemically synthesized
tatcatagtccagtagaggttg

SEQ ID NO: 823894 - DNA, 22 bp, Artificial Sequence
  chemically synthesized
gttatatcatagtccagtagag

SEQ ID NO: 823895 - DNA, 22 bp, Artificial Sequence
  chemically synthesized
ggttatatcatagtccagtaga

SEQ ID NO: 823896 - DNA, 22 bp, Artificial Sequence
  chemically synthesized
ttggttatatcatagtccagta

SEQ ID NO: 823897 - DNA, 22 bp, Artificial Sequence
  chemically synthesized
cttggttatatcatagtccagt

SEQ ID NO: 823898 - DNA, 22 bp, Artificial Sequence
  chemically synthesized
tcttggttatatcatagtccag

SEQ ID NO: 823899 - DNA, 22 bp, Artificial Sequence
  chemically synthesized
gtcaacctctactggactatga

SEQ ID NO: 823900 - DNA, 22 bp, Artificial Sequence
  chemically synthesized
tcaacctctactggactatgat

SEQ ID NO: 823901 - DNA, 22 bp, Artificial Sequence
  chemically synthesized
ctttcttggttatatcatagtc

SEQ ID NO: 823902 - DNA, 22 bp, Artificial Sequence
  chemically synthesized
tactggactatgatataaccaa

SEQ ID NO: 823903 - DNA, 22 bp, Artificial Sequence
  chemically synthesized
ctggactatgatataaccaaga

SEQ ID NO: 823904 - DNA, 22 bp, Artificial Sequence
  chemically synthesized
gactatgatataaccaagaaag

SEQ ID NO: 823905 - DNA, 22 bp, Artificial Sequence
  chemically synthesized
acacaataaagactgctttctt

SEQ ID NO: 823906 - DNA, 22 bp, Artificial Sequence
  chemically synthesized
aacacaataaagactgctttct

SEQ ID NO: 823907 - DNA, 22 bp, Artificial Sequence
  chemically synthesized
tgatataaccaagaaagcagtc

SEQ ID NO: 823908 - DNA, 22 bp, Artificial Sequence
  chemically synthesized
aatagcttaacacaataaagac

SEQ ID NO: 823909 - DNA, 22 bp, Artificial Sequence
  chemically synthesized
aaatctcaatagcttaacacaa

SEQ ID NO: 823910 - DNA, 22 bp, Artificial Sequence
  chemically synthesized
tgaaatctcaatagcttaacac

SEQ ID NO: 823911 - DNA, 22 bp, Artificial Sequence
  chemically synthesized
tattgtgttaagctattgagat

SEQ ID NO: 823912 - DNA, 22 bp, Artificial Sequence
  chemically synthesized
attgtgttaagctattgagatt

SEQ ID NO: 823913 - DNA, 22 bp, Artificial Sequence
  chemically synthesized
ttgtgttaagctattgagattt

SEQ ID NO: 823914 - DNA, 22 bp, Artificial Sequence
  chemically synthesized
tgttaagctattgagatttcag

SEQ ID NO: 823915 - DNA, 22 bp, Artificial Sequence
  chemically synthesized
tagtaagaaatgaactctgaaa

SEQ ID NO: 823916 - DNA, 22 bp, Artificial Sequence
  chemically synthesized
agctattgagatttcagagttc

SEQ ID NO: 823917 - DNA, 22 bp, Artificial Sequence
  chemically synthesized
agctatagtaagaaatgaactc

SEQ ID NO: 823918 - DNA, 22 bp, Artificial Sequence
  chemically synthesized
ttgagatttcagagttcatttc

SEQ ID NO: 823919 - DNA, 22 bp, Artificial Sequence
  chemically synthesized
agatttcagagttcatttctta

SEQ ID NO: 823920 - DNA, 22 bp, Artificial Sequence
  chemically synthesized
tgctaagctatagtaagaaatg

SEQ ID NO: 823921 - DNA, 22 bp, Artificial Sequence
  chemically synthesized
cagagttcatttcttactatag

SEQ ID NO: 823922 - DNA, 22 bp, Artificial Sequence
  chemically synthesized
ggctatgctaagctatagtaag

SEQ ID NO: 823923 - DNA, 22 bp, Artificial Sequence
  chemically synthesized
agagttcatttcttactatagc

SEQ ID NO: 823924 - DNA, 22 bp, Artificial Sequence
  chemically synthesized
atttcttactatagcttagcat

SEQ ID NO: 823925 - DNA, 22 bp, Artificial Sequence
  chemically synthesized
gtcaggttaggctatgctaagc

SEQ ID NO: 823926 - DNA, 22 bp, Artificial Sequence
  chemically synthesized
cttactatagcttagcatagcc

SEQ ID NO: 823927 - DNA, 22 bp, Artificial Sequence
  chemically synthesized
ttactatagcttagcatagcct

SEQ ID NO: 823928 - DNA, 22 bp, Artificial Sequence
  chemically synthesized
actatagcttagcatagcctaa

SEQ ID NO: 823929 - DNA, 22 bp, Artificial Sequence
  chemically synthesized
ctatagcttagcatagcctaac

SEQ ID NO: 823930 - DNA, 22 bp, Artificial Sequence
  chemically synthesized
caaattagtcaggttaggctat

SEQ ID NO: 823931 - DNA, 22 bp, Artificial Sequence
  chemically synthesized
ccaaattagtcaggttaggcta

SEQ ID NO: 823932 - DNA, 22 bp, Artificial Sequence
  chemically synthesized
tagcttagcatagcctaacctg

SEQ ID NO: 823933 - DNA, 22 bp, Artificial Sequence
  chemically synthesized
catttccaaattagtcaggtta

SEQ ID NO: 823934 - DNA, 22 bp, Artificial Sequence
  chemically synthesized
ccatttccaaattagtcaggtt

SEQ ID NO: 823935 - DNA, 22 bp, Artificial Sequence
  chemically synthesized
agcatagcctaacctgactaat

SEQ ID NO: 823936 - DNA, 22 bp, Artificial Sequence
  chemically synthesized
gcatagcctaacctgactaatt

SEQ ID NO: 823937 - DNA, 22 bp, Artificial Sequence
  chemically synthesized
acctgactaatttggaaatgga

SEQ ID NO: 823938 - DNA, 22 bp, Artificial Sequence
  chemically synthesized
gatgaaatggcttccatttcca

SEQ ID NO: 823939 - DNA, 22 bp, Artificial Sequence
  chemically synthesized
ggatgaaatggcttccatttcc

SEQ ID NO: 823940 - DNA, 22 bp, Artificial Sequence
  chemically synthesized
ttggatgaaatggcttccattt

SEQ ID NO: 823941 - DNA, 22 bp, Artificial Sequence
  chemically synthesized
cttggatgaaatggcttccatt

SEQ ID NO: 823942 - DNA, 22 bp, Artificial Sequence
  chemically synthesized
actaatttggaaatggaagcca

SEQ ID NO: 823943 - DNA, 22 bp, Artificial Sequence
  chemically synthesized
tcttggatgaaatggcttccat

SEQ ID NO: 823944 - DNA, 22 bp, Artificial Sequence
  chemically synthesized
atttggaaatggaagccatttc

SEQ ID NO: 823945 - DNA, 22 bp, Artificial Sequence
  chemically synthesized
ggaaatggaagccatttcatcc

SEQ ID NO: 823946 - DNA, 22 bp, Artificial Sequence
  chemically synthesized
gaaatggaagccatttcatcca

SEQ ID NO: 823947 - DNA, 22 bp, Artificial Sequence
  chemically synthesized
agaaggaaaccgtatcattttc

SEQ ID NO: 823948 - DNA, 22 bp, Artificial Sequence
  chemically synthesized
catccaagaaaatgatacggtt

SEQ ID NO: 823949 - DNA, 22 bp, Artificial Sequence
  chemically synthesized
atccaagaaaatgatacggttt

SEQ ID NO: 823950 - DNA, 22 bp, Artificial Sequence
  chemically synthesized
tgtcatctaagaaggaaaccgt

SEQ ID NO: 823951 - DNA, 22 bp, Artificial Sequence
  chemically synthesized
gttatgtcatctaagaaggaaa

SEQ ID NO: 823952 - DNA, 22 bp, Artificial Sequence
  chemically synthesized
aaattggttatgtcatctaaga

SEQ ID NO: 823953 - DNA, 22 bp, Artificial Sequence
  chemically synthesized
tcaaattggttatgtcatctaa

SEQ ID NO: 823954 - DNA, 22 bp, Artificial Sequence
  chemically synthesized
attctcaaattggttatgtcat

SEQ ID NO: 823955 - DNA, 22 bp, Artificial Sequence
  chemically synthesized
ccttcttagatgacataaccaa

SEQ ID NO: 823956 - DNA, 22 bp, Artificial Sequence
  chemically synthesized
cttcttagatgacataaccaat

SEQ ID NO: 823957 - DNA, 22 bp, Artificial Sequence
  chemically synthesized
cttagatgacataaccaatttg

SEQ ID NO: 823958 - DNA, 22 bp, Artificial Sequence
  chemically synthesized
ttagatgacataaccaatttga

SEQ ID NO: 823959 - DNA, 22 bp, Artificial Sequence
  chemically synthesized
agatgacataaccaatttgaga

SEQ ID NO: 823960 - DNA, 22 bp, Artificial Sequence
  chemically synthesized
gatgacataaccaatttgagaa

SEQ ID NO: 823961 - DNA, 22 bp, Artificial Sequence
  chemically synthesized
aaccagtatctgattctcaaat

SEQ ID NO: 823962 - DNA, 22 bp, Artificial Sequence
  chemically synthesized
ctaaaccagtatctgattctca

SEQ ID NO: 823963 - DNA, 22 bp, Artificial Sequence
  chemically synthesized
gctaaaccagtatctgattctc

SEQ ID NO: 823964 - DNA, 22 bp, Artificial Sequence
  chemically synthesized
tgctaaaccagtatctgattct

SEQ ID NO: 823965 - DNA, 22 bp, Artificial Sequence
  chemically synthesized
ttgctaaaccagtatctgattc

SEQ ID NO: 823966 - DNA, 22 bp, Artificial Sequence
  chemically synthesized
gagaatcagatactggtttagc

SEQ ID NO: 823967 - DNA, 22 bp, Artificial Sequence
  chemically synthesized
agaatcagatactggtttagca

SEQ ID NO: 823968 - DNA, 22 bp, Artificial Sequence
  chemically synthesized
acagaaaaggccttttgctaaa

SEQ ID NO: 823969 - DNA, 22 bp, Artificial Sequence
  chemically synthesized
tctgacagaaaaggccttttgc

SEQ ID NO: 823970 - DNA, 22 bp, Artificial Sequence
  chemically synthesized
atctgacagaaaaggccttttg

SEQ ID NO: 823971 - DNA, 22 bp, Artificial Sequence
  chemically synthesized
tatctgacagaaaaggcctttt

SEQ ID NO: 823972 - DNA, 22 bp, Artificial Sequence
  chemically synthesized
gtttagcaaaaggccttttctg

SEQ ID NO: 823973 - DNA, 22 bp, Artificial Sequence
  chemically synthesized
agcaaaaggccttttctgtcag

SEQ ID NO: 823974 - DNA, 22 bp, Artificial Sequence
  chemically synthesized
tagatattttatctgacagaaa

SEQ ID NO: 823975 - DNA, 22 bp, Artificial Sequence
  chemically synthesized
gcaaaaggccttttctgtcaga

SEQ ID NO: 823976 - DNA, 22 bp, Artificial Sequence
  chemically synthesized
tatagatattttatctgacaga

SEQ ID NO: 823977 - DNA, 22 bp, Artificial Sequence
  chemically synthesized
ttctgtcagataaaatatctat

SEQ ID NO: 823978 - DNA, 22 bp, Artificial Sequence
  chemically synthesized
tctgtcagataaaatatctata

SEQ ID NO: 823979 - DNA, 22 bp, Artificial Sequence
  chemically synthesized
atcaaaaccctctatagatatt

SEQ ID NO: 823980 - DNA, 22 bp, Artificial Sequence
  chemically synthesized
ctgtcagataaaatatctatag

SEQ ID NO: 823981 - DNA, 22 bp, Artificial Sequence
  chemically synthesized
gatcaaaaccctctatagatat

SEQ ID NO: 823982 - DNA, 22 bp, Artificial Sequence
  chemically synthesized
tgtcagataaaatatctataga

SEQ ID NO: 823983 - DNA, 22 bp, Artificial Sequence
  chemically synthesized
tcagataaaatatctatagagg

SEQ ID NO: 823984 - DNA, 22 bp, Artificial Sequence
  chemically synthesized
ggcacttgatcaaaaccctcta

SEQ ID NO: 823985 - DNA, 22 bp, Artificial Sequence
  chemically synthesized
atcagattgggcacttgatcaa

SEQ ID NO: 823986 - DNA, 22 bp, Artificial Sequence
  chemically synthesized
tagagggttttgatcaagtgcc

SEQ ID NO: 823987 - DNA, 22 bp, Artificial Sequence
  chemically synthesized
tgatcaagtgcccaatctgatc

SEQ ID NO: 823988 - DNA, 22 bp, Artificial Sequence
  chemically synthesized
gatcaagtgcccaatctgatca

SEQ ID NO: 823989 - DNA, 22 bp, Artificial Sequence
  chemically synthesized
atcaagtgcccaatctgatcaa

SEQ ID NO: 823990 - DNA, 22 bp, Artificial Sequence
  chemically synthesized
agcagggaagtaacatggtagg

SEQ ID NO: 823991 - DNA, 22 bp, Artificial Sequence
  chemically synthesized
gagcagggaagtaacatggtag

SEQ ID NO: 823992 - DNA, 22 bp, Artificial Sequence
  chemically synthesized
tgagcagggaagtaacatggta

SEQ ID NO: 823993 - DNA, 22 bp, Artificial Sequence
  chemically synthesized
atcaacctcctaccatgttact

SEQ ID NO: 823994 - DNA, 22 bp, Artificial Sequence
  chemically synthesized
gggtattttgagcagggaagta

SEQ ID NO: 823995 - DNA, 22 bp, Artificial Sequence
  chemically synthesized
agggtattttgagcagggaagt

SEQ ID NO: 823996 - DNA, 22 bp, Artificial Sequence
  chemically synthesized
tagggtattttgagcagggaag

SEQ ID NO: 823997 - DNA, 22 bp, Artificial Sequence
  chemically synthesized
ctaccatgttacttccctgctc

SEQ ID NO: 823998 - DNA, 22 bp, Artificial Sequence
  chemically synthesized
ccatgttacttccctgctcaaa

SEQ ID NO: 823999 - DNA, 22 bp, Artificial Sequence
  chemically synthesized
agctttagggtattttgagcag

SEQ ID NO: 824000 - DNA, 22 bp, Artificial Sequence
  chemically synthesized
cttccctgctcaaaatacccta

SEQ ID NO: 824001 - DNA, 22 bp, Artificial Sequence
  chemically synthesized
ccctgctcaaaataccctaaag

SEQ ID NO: 824002 - DNA, 22 bp, Artificial Sequence
  chemically synthesized
cctgctcaaaataccctaaagc

SEQ ID NO: 824003 - DNA, 22 bp, Artificial Sequence
  chemically synthesized
aacaatggttaagctttagggt

SEQ ID NO: 824004 - DNA, 22 bp, Artificial Sequence
  chemically synthesized
ctcaaaataccctaaagcttaa

SEQ ID NO: 824005 - DNA, 22 bp, Artificial Sequence
  chemically synthesized
aaaataccctaaagcttaacca

SEQ ID NO: 824006 - DNA, 22 bp, Artificial Sequence
  chemically synthesized
aatgttaaacaatggttaagct

SEQ ID NO: 824007 - DNA, 22 bp, Artificial Sequence
  chemically synthesized
aaatgttaaacaatggttaagc

SEQ ID NO: 824008 - DNA, 22 bp, Artificial Sequence
  chemically synthesized
aagcttaaccattgtttaacat

SEQ ID NO: 824009 - DNA, 22 bp, Artificial Sequence
  chemically synthesized
aaaagcccttaaatgttaaaca

SEQ ID NO: 824010 - DNA, 22 bp, Artificial Sequence
  chemically synthesized
gaaaagcccttaaatgttaaac

SEQ ID NO: 824011 - DNA, 22 bp, Artificial Sequence
  chemically synthesized
aaccattgtttaacatttaagg

SEQ ID NO: 824012 - DNA, 22 bp, Artificial Sequence
  chemically synthesized
accattgtttaacatttaaggg

SEQ ID NO: 824013 - DNA, 22 bp, Artificial Sequence
  chemically synthesized
gtcagtttgaaaagcccttaaa

SEQ ID NO: 824014 - DNA, 22 bp, Artificial Sequence
  chemically synthesized
ctagtcagtttgaaaagccctt

SEQ ID NO: 824015 - DNA, 22 bp, Artificial Sequence
  chemically synthesized
actagtcagtttgaaaagccct

SEQ ID NO: 824016 - DNA, 22 bp, Artificial Sequence
  chemically synthesized
tttaacatttaagggcttttca

SEQ ID NO: 824017 - DNA, 22 bp, Artificial Sequence
  chemically synthesized
aacatttaagggcttttcaaac

SEQ ID NO: 824018 - DNA, 22 bp, Artificial Sequence
  chemically synthesized
acatttaagggcttttcaaact

SEQ ID NO: 824019 - DNA, 22 bp, Artificial Sequence
  chemically synthesized
gtatttactagtcagtttgaaa

SEQ ID NO: 824020 - DNA, 22 bp, Artificial Sequence
  chemically synthesized
agtatttactagtcagtttgaa

SEQ ID NO: 824021 - DNA, 22 bp, Artificial Sequence
  chemically synthesized
aagggcttttcaaactgactag

SEQ ID NO: 824022 - DNA, 22 bp, Artificial Sequence
  chemically synthesized
agggcttttcaaactgactagt

SEQ ID NO: 824023 - DNA, 22 bp, Artificial Sequence
  chemically synthesized
aaacttagtatttactagtcag

SEQ ID NO: 824024 - DNA, 22 bp, Artificial Sequence
  chemically synthesized
caaacttagtatttactagtca

SEQ ID NO: 824025 - DNA, 22 bp, Artificial Sequence
  chemically synthesized
ttcaaactgactagtaaatact

SEQ ID NO: 824026 - DNA, 22 bp, Artificial Sequence
  chemically synthesized
tcaaactgactagtaaatacta

SEQ ID NO: 824027 - DNA, 22 bp, Artificial Sequence
  chemically synthesized
caaactgactagtaaatactaa

SEQ ID NO: 824028 - DNA, 22 bp, Artificial Sequence
  chemically synthesized
atcccttcaaacttagtattta

SEQ ID NO: 824029 - DNA, 22 bp, Artificial Sequence
  chemically synthesized
aaactgactagtaaatactaag

SEQ ID NO: 824030 - DNA, 22 bp, Artificial Sequence
  chemically synthesized
aatcccttcaaacttagtattt

SEQ ID NO: 824031 - DNA, 22 bp, Artificial Sequence
  chemically synthesized
actagtaaatactaagtttgaa

SEQ ID NO: 824032 - DNA, 22 bp, Artificial Sequence
  chemically synthesized
catgcgtttaatcccttcaaac

SEQ ID NO: 824033 - DNA, 22 bp, Artificial Sequence
  chemically synthesized
gtaaatactaagtttgaaggga

SEQ ID NO: 824034 - DNA, 22 bp, Artificial Sequence
  chemically synthesized
gcatgcgtttaatcccttcaaa

SEQ ID NO: 824035 - DNA, 22 bp, Artificial Sequence
  chemically synthesized
tgcatgcgtttaatcccttcaa

SEQ ID NO: 824036 - DNA, 22 bp, Artificial Sequence
  chemically synthesized
agtttgaagggattaaacgcat

SEQ ID NO: 824037 - DNA, 22 bp, Artificial Sequence
  chemically synthesized
gaagggattaaacgcatgcaaa

SEQ ID NO: 824038 - DNA, 22 bp, Artificial Sequence
  chemically synthesized
aagggattaaacgcatgcaaag

SEQ ID NO: 824039 - DNA, 22 bp, Artificial Sequence
  chemically synthesized
tcaagcagcatgcatagtgctt

SEQ ID NO: 824040 - DNA, 22 bp, Artificial Sequence
  chemically synthesized
atcaagcagcatgcatagtgct

SEQ ID NO: 824041 - DNA, 22 bp, Artificial Sequence
  chemically synthesized
aacgcatgcaaagcactatgca

SEQ ID NO: 824042 - DNA, 22 bp, Artificial Sequence
  chemically synthesized
tatcaagcagcatgcatagtgc

SEQ ID NO: 824043 - DNA, 22 bp, Artificial Sequence
  chemically synthesized
tgttttatcaagcagcatgcat

SEQ ID NO: 824044 - DNA, 22 bp, Artificial Sequence
  chemically synthesized
ataactatgttttatcaagcag

SEQ ID NO: 824045 - DNA, 22 bp, Artificial Sequence
  chemically synthesized
aataactatgttttatcaagca

SEQ ID NO: 824046 - DNA, 22 bp, Artificial Sequence
  chemically synthesized
cttaataactatgttttatcaa

SEQ ID NO: 824047 - DNA, 22 bp, Artificial Sequence
  chemically synthesized
tgcatgctgcttgataaaacat

SEQ ID NO: 824048 - DNA, 22 bp, Artificial Sequence
  chemically synthesized
cttgataaaacatagttattaa

SEQ ID NO: 824049 - DNA, 22 bp, Artificial Sequence
  chemically synthesized
gataaaacatagttattaagca

SEQ ID NO: 824050 - DNA, 22 bp, Artificial Sequence
  chemically synthesized
ataaaacatagttattaagcaa

SEQ ID NO: 824051 - DNA, 22 bp, Artificial Sequence
  chemically synthesized
ttaagcaattttcttccttttc

SEQ ID NO: 824052 - DNA, 22 bp, Artificial Sequence
  chemically synthesized
agcaattttcttccttttcctt

SEQ ID NO: 824053 - DNA, 22 bp, Artificial Sequence
  chemically synthesized
aggataaaagaaaaaggaaaag

SEQ ID NO: 824054 - DNA, 22 bp, Artificial Sequence
  chemically synthesized
ctcaggataaaagaaaaaggaa

SEQ ID NO: 824055 - DNA, 22 bp, Artificial Sequence
  chemically synthesized
tcttccttttcctttttctttt

SEQ ID NO: 824056 - DNA, 22 bp, Artificial Sequence
  chemically synthesized
cttccttttcctttttctttta

SEQ ID NO: 824057 - DNA, 22 bp, Artificial Sequence
  chemically synthesized
ttccttttcctttttcttttat

SEQ ID NO: 824058 - DNA, 22 bp, Artificial Sequence
  chemically synthesized
taattcctcaggataaaagaaa

SEQ ID NO: 824059 - DNA, 22 bp, Artificial Sequence
  chemically synthesized
ccttttcctttttcttttatcc

SEQ ID NO: 824060 - DNA, 22 bp, Artificial Sequence
  chemically synthesized
cttttcctttttcttttatcct

SEQ ID NO: 824061 - DNA, 22 bp, Artificial Sequence
  chemically synthesized
ttcctttttcttttatcctgag

SEQ ID NO: 824062 - DNA, 22 bp, Artificial Sequence
  chemically synthesized
tcctttttcttttatcctgagg

SEQ ID NO: 824063 - DNA, 22 bp, Artificial Sequence
  chemically synthesized
cctttttcttttatcctgagga

SEQ ID NO: 824064 - DNA, 22 bp, Artificial Sequence
  chemically synthesized
gtagtctataattcctcaggat

SEQ ID NO: 824065 - DNA, 22 bp, Artificial Sequence
  chemically synthesized
ctttttcttttatcctgaggaa

SEQ ID NO: 824066 - DNA, 22 bp, Artificial Sequence
  chemically synthesized
agtagtctataattcctcagga

SEQ ID NO: 824067 - DNA, 22 bp, Artificial Sequence
  chemically synthesized
tttcttttatcctgaggaatta

SEQ ID NO: 824068 - DNA, 22 bp, Artificial Sequence
  chemically synthesized
cttagtagtctataattcctca

SEQ ID NO: 824069 - DNA, 22 bp, Artificial Sequence
  chemically synthesized
ttcttttatcctgaggaattat

SEQ ID NO: 824070 - DNA, 22 bp, Artificial Sequence
  chemically synthesized
tcttttatcctgaggaattata

SEQ ID NO: 824071 - DNA, 22 bp, Artificial Sequence
  chemically synthesized
cttttatcctgaggaattatag

SEQ ID NO: 824072 - DNA, 22 bp, Artificial Sequence
  chemically synthesized
ttttatcctgaggaattataga

SEQ ID NO: 824073 - DNA, 22 bp, Artificial Sequence
  chemically synthesized
tctgcttagtagtctataattc

SEQ ID NO: 824074 - DNA, 22 bp, Artificial Sequence
  chemically synthesized
ttatcctgaggaattatagact

SEQ ID NO: 824075 - DNA, 22 bp, Artificial Sequence
  chemically synthesized
tatcctgaggaattatagacta

SEQ ID NO: 824076 - DNA, 22 bp, Artificial Sequence
  chemically synthesized
atcctgaggaattatagactac

SEQ ID NO: 824077 - DNA, 22 bp, Artificial Sequence
  chemically synthesized
tcctgaggaattatagactact

SEQ ID NO: 824078 - DNA, 22 bp, Artificial Sequence
  chemically synthesized
aaatatctgtctgcttagtagt

SEQ ID NO: 824079 - DNA, 22 bp, Artificial Sequence
  chemically synthesized
aggaattatagactactaagca

SEQ ID NO: 824080 - DNA, 22 bp, Artificial Sequence
  chemically synthesized
ctcaaatatctgtctgcttagt

SEQ ID NO: 824081 - DNA, 22 bp, Artificial Sequence
  chemically synthesized
cctcaaatatctgtctgcttag

SEQ ID NO: 824082 - DNA, 22 bp, Artificial Sequence
  chemically synthesized
tagactactaagcagacagata

SEQ ID NO: 824083 - DNA, 22 bp, Artificial Sequence
  chemically synthesized
aaatttcctcaaatatctgtct

SEQ ID NO: 824084 - DNA, 22 bp, Artificial Sequence
  chemically synthesized
tgaaatttcctcaaatatctgt

SEQ ID NO: 824085 - DNA, 22 bp, Artificial Sequence
  chemically synthesized
ctctgaaatttcctcaaatatc

SEQ ID NO: 824086 - DNA, 22 bp, Artificial Sequence
  chemically synthesized
ctaagcagacagatatttgagg

SEQ ID NO: 824087 - DNA, 22 bp, Artificial Sequence
  chemically synthesized
cctctgaaatttcctcaaatat

SEQ ID NO: 824088 - DNA, 22 bp, Artificial Sequence
  chemically synthesized
tcctctgaaatttcctcaaata

SEQ ID NO: 824089 - DNA, 22 bp, Artificial Sequence
  chemically synthesized
agcagacagatatttgaggaaa

SEQ ID NO: 824090 - DNA, 22 bp, Artificial Sequence
  chemically synthesized
tttcctctgaaatttcctcaaa

SEQ ID NO: 824091 - DNA, 22 bp, Artificial Sequence
  chemically synthesized
tctttcctctgaaatttcctca

SEQ ID NO: 824092 - DNA, 22 bp, Artificial Sequence
  chemically synthesized
ctctttcctctgaaatttcctc

SEQ ID NO: 824093 - DNA, 22 bp, Artificial Sequence
  chemically synthesized
tctctttcctctgaaatttcct

SEQ ID NO: 824094 - DNA, 22 bp, Artificial Sequence
  chemically synthesized
tttctctttcctctgaaatttc

SEQ ID NO: 824095 - DNA, 22 bp, Artificial Sequence
  chemically synthesized
ctttctctttcctctgaaattt

SEQ ID NO: 824096 - DNA, 22 bp, Artificial Sequence
  chemically synthesized
ttctttctctttcctctgaaat

SEQ ID NO: 824097 - DNA, 22 bp, Artificial Sequence
  chemically synthesized
tcttctttctctttcctctgaa

SEQ ID NO: 824098 - DNA, 22 bp, Artificial Sequence
  chemically synthesized
ctcttctttctctttcctctga

SEQ ID NO: 824099 - DNA, 22 bp, Artificial Sequence
  chemically synthesized
ttctcttctttctctttcctct

SEQ ID NO: 824100 - DNA, 22 bp, Artificial Sequence
  chemically synthesized
gaggaaatttcagaggaaagag

SEQ ID NO: 824101 - DNA, 22 bp, Artificial Sequence
  chemically synthesized
aggaaatttcagaggaaagaga

SEQ ID NO: 824102 - DNA, 22 bp, Artificial Sequence
  chemically synthesized
attcttctcttctttctctttc

SEQ ID NO: 824103 - DNA, 22 bp, Artificial Sequence
  chemically synthesized
cagaggaaagagaaagaagaga

SEQ ID NO: 824104 - DNA, 22 bp, Artificial Sequence
  chemically synthesized
agaggaaagagaaagaagagaa

SEQ ID NO: 824105 - DNA, 22 bp, Artificial Sequence
  chemically synthesized
cagcccagctcattcttctctt

SEQ ID NO: 824106 - DNA, 22 bp, Artificial Sequence
  chemically synthesized
cctccagcccagctcattcttc

SEQ ID NO: 824107 - DNA, 22 bp, Artificial Sequence
  chemically synthesized
acctccagcccagctcattctt

SEQ ID NO: 824108 - DNA, 22 bp, Artificial Sequence
  chemically synthesized
ttacctccagcccagctcattc

SEQ ID NO: 824109 - DNA, 22 bp, Artificial Sequence
  chemically synthesized
tcttacctccagcccagctcat

SEQ ID NO: 824110 - DNA, 22 bp, Artificial Sequence
  chemically synthesized
cccccattctcttacctccagc

SEQ ID NO: 824111 - DNA, 22 bp, Artificial Sequence
  chemically synthesized
tccccccattctcttacctcca

SEQ ID NO: 824112 - DNA, 22 bp, Artificial Sequence
  chemically synthesized
ctccccccattctcttacctcc

SEQ ID NO: 824113 - DNA, 22 bp, Artificial Sequence
  chemically synthesized
tctccccccattctcttacctc

SEQ ID NO: 824114 - DNA, 22 bp, Artificial Sequence
  chemically synthesized
actttctccccccattctctta

SEQ ID NO: 824115 - DNA, 22 bp, Artificial Sequence
  chemically synthesized
tcactttctccccccattctct

SEQ ID NO: 824116 - DNA, 22 bp, Artificial Sequence
  chemically synthesized
ggctggaggtaagagaatgggg

SEQ ID NO: 824117 - DNA, 22 bp, Artificial Sequence
  chemically synthesized
gaggtaagagaatggggggaga

SEQ ID NO: 824118 - DNA, 22 bp, Artificial Sequence
  chemically synthesized
gggaggaataaggagtactctc

SEQ ID NO: 824119 - DNA, 22 bp, Artificial Sequence
  chemically synthesized
cttattcctccccaatcctgat

SEQ ID NO: 824120 - DNA, 22 bp, Artificial Sequence
  chemically synthesized
attcctccccaatcctgatacc

SEQ ID NO: 824121 - DNA, 22 bp, Artificial Sequence
  chemically synthesized
ttcctccccaatcctgataccc

SEQ ID NO: 824122 - DNA, 22 bp, Artificial Sequence
  chemically synthesized
ctccccaatcctgatacccact

SEQ ID NO: 824123 - DNA, 22 bp, Artificial Sequence
  chemically synthesized
cccaatcctgatacccactcac

SEQ ID NO: 824124 - DNA, 22 bp, Artificial Sequence
  chemically synthesized
gatcaagaaatgggggtgagtg

SEQ ID NO: 824125 - DNA, 22 bp, Artificial Sequence
  chemically synthesized
atacccactcacccccatttct

SEQ ID NO: 824126 - DNA, 22 bp, Artificial Sequence
  chemically synthesized
gaggccctggatcaagaaatgg

SEQ ID NO: 824127 - DNA, 22 bp, Artificial Sequence
  chemically synthesized
ggaggccctggatcaagaaatg

SEQ ID NO: 824128 - DNA, 22 bp, Artificial Sequence
  chemically synthesized
tttggaggccctggatcaagaa

SEQ ID NO: 824129 - DNA, 22 bp, Artificial Sequence
  chemically synthesized
atttggaggccctggatcaaga

SEQ ID NO: 824130 - DNA, 22 bp, Artificial Sequence
  chemically synthesized
acccccatttcttgatccaggg

SEQ ID NO: 824131 - DNA, 22 bp, Artificial Sequence
  chemically synthesized
atatcttatttggaggccctgg

SEQ ID NO: 824132 - DNA, 22 bp, Artificial Sequence
  chemically synthesized
catatcttatttggaggccctg

SEQ ID NO: 824133 - DNA, 22 bp, Artificial Sequence
  chemically synthesized
tcatatcttatttggaggccct

SEQ ID NO: 824134 - DNA, 22 bp, Artificial Sequence
  chemically synthesized
tttcatatcttatttggaggcc

SEQ ID NO: 824135 - DNA, 22 bp, Artificial Sequence
  chemically synthesized
cttgatccagggcctccaaata

SEQ ID NO: 824136 - DNA, 22 bp, Artificial Sequence
  chemically synthesized
ttgatccagggcctccaaataa

SEQ ID NO: 824137 - DNA, 22 bp, Artificial Sequence
  chemically synthesized
ctctttcatatcttatttggag

SEQ ID NO: 824138 - DNA, 22 bp, Artificial Sequence
  chemically synthesized
gatccagggcctccaaataaga

SEQ ID NO: 824139 - DNA, 22 bp, Artificial Sequence
  chemically synthesized
atccagggcctccaaataagat

SEQ ID NO: 824140 - DNA, 22 bp, Artificial Sequence
  chemically synthesized
caaataagatatgaaagagtag

SEQ ID NO: 824141 - DNA, 22 bp, Artificial Sequence
  chemically synthesized
gaaaaagtaacaggtctactct

SEQ ID NO: 824142 - DNA, 22 bp, Artificial Sequence
  chemically synthesized
ctagaaaaagtaacaggtctac

SEQ ID NO: 824143 - DNA, 22 bp, Artificial Sequence
  chemically synthesized
cctagaaaaagtaacaggtcta

SEQ ID NO: 824144 - DNA, 22 bp, Artificial Sequence
  chemically synthesized
cttcctagaaaaagtaacaggt

SEQ ID NO: 824145 - DNA, 22 bp, Artificial Sequence
  chemically synthesized
attccttcctagaaaaagtaac

SEQ ID NO: 824146 - DNA, 22 bp, Artificial Sequence
  chemically synthesized
aattccttcctagaaaaagtaa

SEQ ID NO: 824147 - DNA, 22 bp, Artificial Sequence
  chemically synthesized
gggcttaattccttcctagaaa

SEQ ID NO: 824148 - DNA, 22 bp, Artificial Sequence
  chemically synthesized
ttactttttctaggaaggaatt

SEQ ID NO: 824149 - DNA, 22 bp, Artificial Sequence
  chemically synthesized
ctttttctaggaaggaattaag

SEQ ID NO: 824150 - DNA, 22 bp, Artificial Sequence
  chemically synthesized
tttctaggaaggaattaagccc

SEQ ID NO: 824151 - DNA, 22 bp, Artificial Sequence
  chemically synthesized
ttctaggaaggaattaagcccg

SEQ ID NO: 824152 - DNA, 22 bp, Artificial Sequence
  chemically synthesized
tctaggaaggaattaagcccga

SEQ ID NO: 824153 - DNA, 22 bp, Artificial Sequence
  chemically synthesized
ctaggaaggaattaagcccgaa

SEQ ID NO: 824154 - DNA, 22 bp, Artificial Sequence
  chemically synthesized
taggaaggaattaagcccgaat

SEQ ID NO: 824155 - DNA, 22 bp, Artificial Sequence
  chemically synthesized
catgaagtcaaccattcgggct

SEQ ID NO: 824156 - DNA, 22 bp, Artificial Sequence
  chemically synthesized
ggaaggaattaagcccgaatgg

SEQ ID NO: 824157 - DNA, 22 bp, Artificial Sequence
  chemically synthesized
tgtagttgcatgaagtcaacca

SEQ ID NO: 824158 - DNA, 22 bp, Artificial Sequence
  chemically synthesized
atgtagttgcatgaagtcaacc

SEQ ID NO: 824159 - DNA, 22 bp, Artificial Sequence
  chemically synthesized
agcccgaatggttgacttcatg

SEQ ID NO: 824160 - DNA, 22 bp, Artificial Sequence
  chemically synthesized
gtatacgtatttatgtagttgc

SEQ ID NO: 824161 - DNA, 22 bp, Artificial Sequence
  chemically synthesized
acttcatgcaactacataaata

SEQ ID NO: 824162 - DNA, 22 bp, Artificial Sequence
  chemically synthesized
aaaattggtatacgtatttatg

SEQ ID NO: 824163 - DNA, 22 bp, Artificial Sequence
  chemically synthesized
caaaattggtatacgtatttat

SEQ ID NO: 824164 - DNA, 22 bp, Artificial Sequence
  chemically synthesized
catgcaactacataaatacgta

SEQ ID NO: 824165 - DNA, 22 bp, Artificial Sequence
  chemically synthesized
atgcaactacataaatacgtat

SEQ ID NO: 824166 - DNA, 22 bp, Artificial Sequence
  chemically synthesized
agatcacttcaaaattggtata

SEQ ID NO: 824167 - DNA, 22 bp, Artificial Sequence
  chemically synthesized
aagatcacttcaaaattggtat

SEQ ID NO: 824168 - DNA, 22 bp, Artificial Sequence
  chemically synthesized
cataaatacgtataccaatttt

SEQ ID NO: 824169 - DNA, 22 bp, Artificial Sequence
  chemically synthesized
taagatcacttcaaaattggta

SEQ ID NO: 824170 - DNA, 22 bp, Artificial Sequence
  chemically synthesized
caccatctttaagatcacttca

SEQ ID NO: 824171 - DNA, 22 bp, Artificial Sequence
  chemically synthesized
ttgcaccatctttaagatcact

SEQ ID NO: 824172 - DNA, 22 bp, Artificial Sequence
  chemically synthesized
tgttgcaccatctttaagatca

SEQ ID NO: 824173 - DNA, 22 bp, Artificial Sequence
  chemically synthesized
ctgttgcaccatctttaagatc

SEQ ID NO: 824174 - DNA, 22 bp, Artificial Sequence
  chemically synthesized
tctgttgcaccatctttaagat

SEQ ID NO: 824175 - DNA, 22 bp, Artificial Sequence
  chemically synthesized
gttttctgttgcaccatcttta

SEQ ID NO: 824176 - DNA, 22 bp, Artificial Sequence
  chemically synthesized
tgaagtgatcttaaagatggtg

SEQ ID NO: 824177 - DNA, 22 bp, Artificial Sequence
  chemically synthesized
gaagtgatcttaaagatggtgc

SEQ ID NO: 824178 - DNA, 22 bp, Artificial Sequence
  chemically synthesized
aagtgatcttaaagatggtgca

SEQ ID NO: 824179 - DNA, 22 bp, Artificial Sequence
  chemically synthesized
gctggttttctgttgcaccatc

SEQ ID NO: 824180 - DNA, 22 bp, Artificial Sequence
  chemically synthesized
aaagatggtgcaacagaaaacc

SEQ ID NO: 824181 - DNA, 22 bp, Artificial Sequence
  chemically synthesized
aagatggtgcaacagaaaacca

SEQ ID NO: 824182 - DNA, 22 bp, Artificial Sequence
  chemically synthesized
gatatagttggctggttttctg

SEQ ID NO: 824183 - DNA, 22 bp, Artificial Sequence
  chemically synthesized
gtaatctggatatagttggctg

SEQ ID NO: 824184 - DNA, 22 bp, Artificial Sequence
  chemically synthesized
agtaatctggatatagttggct

SEQ ID NO: 824185 - DNA, 22 bp, Artificial Sequence
  chemically synthesized
tttagtaatctggatatagttg

SEQ ID NO: 824186 - DNA, 22 bp, Artificial Sequence
  chemically synthesized
gtttagtaatctggatatagtt

SEQ ID NO: 824187 - DNA, 22 bp, Artificial Sequence
  chemically synthesized
tgtttagtaatctggatatagt

SEQ ID NO: 824188 - DNA, 22 bp, Artificial Sequence
  chemically synthesized
attttgtttagtaatctggata

SEQ ID NO: 824189 - DNA, 22 bp, Artificial Sequence
  chemically synthesized
aagttaattttgtttagtaatc

SEQ ID NO: 824190 - DNA, 22 bp, Artificial Sequence
  chemically synthesized
tatccagattactaaacaaaat

SEQ ID NO: 824191 - DNA, 22 bp, Artificial Sequence
  chemically synthesized
atgtcaatgttaaagttaattt

SEQ ID NO: 824192 - DNA, 22 bp, Artificial Sequence
  chemically synthesized
ctaaacaaaattaactttaaca

SEQ ID NO: 824193 - DNA, 22 bp, Artificial Sequence
  chemically synthesized
acagctaatgtcaatgttaaag

SEQ ID NO: 824194 - DNA, 22 bp, Artificial Sequence
  chemically synthesized
aacaaaattaactttaacattg

SEQ ID NO: 824195 - DNA, 22 bp, Artificial Sequence
  chemically synthesized
actttaacattgacattagctg

SEQ ID NO: 824196 - DNA, 22 bp, Artificial Sequence
  chemically synthesized
taacattgacattagctgtcaa

SEQ ID NO: 824197 - DNA, 22 bp, Artificial Sequence
  chemically synthesized
aacattgacattagctgtcaat

SEQ ID NO: 824198 - DNA, 22 bp, Artificial Sequence
  chemically synthesized
acattgacattagctgtcaatt

SEQ ID NO: 824199 - DNA, 22 bp, Artificial Sequence
  chemically synthesized
acattagctgtcaattttcctc

SEQ ID NO: 824200 - DNA, 22 bp, Artificial Sequence
  chemically synthesized
agtcaaggtagagaatagagga

SEQ ID NO: 824201 - DNA, 22 bp, Artificial Sequence
  chemically synthesized
gctgtcaattttcctctattct

SEQ ID NO: 824202 - DNA, 22 bp, Artificial Sequence
  chemically synthesized
gagtcaaggtagagaatagagg

SEQ ID NO: 824203 - DNA, 22 bp, Artificial Sequence
  chemically synthesized
tgagtcaaggtagagaatagag

SEQ ID NO: 824204 - DNA, 22 bp, Artificial Sequence
  chemically synthesized
ttgagtcaaggtagagaataga

SEQ ID NO: 824205 - DNA, 22 bp, Artificial Sequence
  chemically synthesized
tcaattttcctctattctctac

SEQ ID NO: 824206 - DNA, 22 bp, Artificial Sequence
  chemically synthesized
tcctctattctctaccttgact

SEQ ID NO: 824207 - DNA, 22 bp, Artificial Sequence
  chemically synthesized
cctctattctctaccttgactc

SEQ ID NO: 824208 - DNA, 22 bp, Artificial Sequence
  chemically synthesized
ctctattctctaccttgactca

SEQ ID NO: 824209 - DNA, 22 bp, Artificial Sequence
  chemically synthesized
gccagtagacttttgagtcaag

SEQ ID NO: 824210 - DNA, 22 bp, Artificial Sequence
  chemically synthesized
tattctctaccttgactcaaaa

SEQ ID NO: 824211 - DNA, 22 bp, Artificial Sequence
  chemically synthesized
ttctctaccttgactcaaaagt

SEQ ID NO: 824212 - DNA, 22 bp, Artificial Sequence
  chemically synthesized
tctaccttgactcaaaagtcta

SEQ ID NO: 824213 - DNA, 22 bp, Artificial Sequence
  chemically synthesized
taccttgactcaaaagtctact

SEQ ID NO: 824214 - DNA, 22 bp, Artificial Sequence
  chemically synthesized
gcatgcctagccagtagacttt

SEQ ID NO: 824215 - DNA, 22 bp, Artificial Sequence
  chemically synthesized
ccttgactcaaaagtctactgg

SEQ ID NO: 824216 - DNA, 22 bp, Artificial Sequence
  chemically synthesized
gactcaaaagtctactggctag

SEQ ID NO: 824217 - DNA, 22 bp, Artificial Sequence
  chemically synthesized
actcaaaagtctactggctagg

SEQ ID NO: 824218 - DNA, 22 bp, Artificial Sequence
  chemically synthesized
aaaagtctactggctaggcatg

SEQ ID NO: 824219 - DNA, 22 bp, Artificial Sequence
  chemically synthesized
caggcatgagttagcatgccta

SEQ ID NO: 824220 - DNA, 22 bp, Artificial Sequence
  chemically synthesized
ggattacaggcatgagttagca

SEQ ID NO: 824221 - DNA, 22 bp, Artificial Sequence
  chemically synthesized
ctggctaggcatgctaactcat

SEQ ID NO: 824222 - DNA, 22 bp, Artificial Sequence
  chemically synthesized
gctaggcatgctaactcatgcc

SEQ ID NO: 824223 - DNA, 22 bp, Artificial Sequence
  chemically synthesized
ggcatgctaactcatgcctgta

SEQ ID NO: 824224 - DNA, 22 bp, Artificial Sequence
  chemically synthesized
ccaaagcactaggattacaggc

SEQ ID NO: 824225 - DNA, 22 bp, Artificial Sequence
  chemically synthesized
gcctcccaaagcactaggatta

SEQ ID NO: 824226 - DNA, 22 bp, Artificial Sequence
  chemically synthesized
actcatgcctgtaatcctagtg

SEQ ID NO: 824227 - DNA, 22 bp, Artificial Sequence
  chemically synthesized
ggcctcccaaagcactaggatt

SEQ ID NO: 824228 - DNA, 22 bp, Artificial Sequence
  chemically synthesized
cttggcctcccaaagcactagg

SEQ ID NO: 824229 - DNA, 22 bp, Artificial Sequence
  chemically synthesized
atgcctgtaatcctagtgcttt

SEQ ID NO: 824230 - DNA, 22 bp, Artificial Sequence
  chemically synthesized
ccttggcctcccaaagcactag

SEQ ID NO: 824231 - DNA, 22 bp, Artificial Sequence
  chemically synthesized
cttccttggcctcccaaagcac

SEQ ID NO: 824232 - DNA, 22 bp, Artificial Sequence
  chemically synthesized
tccttccttggcctcccaaagc

SEQ ID NO: 824233 - DNA, 22 bp, Artificial Sequence
  chemically synthesized
taatcctagtgctttgggaggc

SEQ ID NO: 824234 - DNA, 22 bp, Artificial Sequence
  chemically synthesized
aagcaattctccttccttggcc

SEQ ID NO: 824235 - DNA, 22 bp, Artificial Sequence
  chemically synthesized
gtgctttgggaggccaaggaag

SEQ ID NO: 824236 - DNA, 22 bp, Artificial Sequence
  chemically synthesized
gcctcaagcaattctccttcct

SEQ ID NO: 824237 - DNA, 22 bp, Artificial Sequence
  chemically synthesized
ggcctcaagcaattctccttcc

SEQ ID NO: 824238 - DNA, 22 bp, Artificial Sequence
  chemically synthesized
tgggaggccaaggaaggagaat

SEQ ID NO: 824239 - DNA, 22 bp, Artificial Sequence
  chemically synthesized
gggaggccaaggaaggagaatt

SEQ ID NO: 824240 - DNA, 22 bp, Artificial Sequence
  chemically synthesized
ttggcctcaagcaattctcctt

SEQ ID NO: 824241 - DNA, 22 bp, Artificial Sequence
  chemically synthesized
ggaggccaaggaaggagaattg

SEQ ID NO: 824242 - DNA, 22 bp, Artificial Sequence
  chemically synthesized
aactcttggcctcaagcaattc

SEQ ID NO: 824243 - DNA, 22 bp, Artificial Sequence
  chemically synthesized
gaactcttggcctcaagcaatt

SEQ ID NO: 824244 - DNA, 22 bp, Artificial Sequence
  chemically synthesized
ttgaactcttggcctcaagcaa

SEQ ID NO: 824245 - DNA, 22 bp, Artificial Sequence
  chemically synthesized
tagagatgggttcttgaactct

SEQ ID NO: 824246 - DNA, 22 bp, Artificial Sequence
  chemically synthesized
cttgaggccaagagttcaagaa

SEQ ID NO: 824247 - DNA, 22 bp, Artificial Sequence
  chemically synthesized
tgtagagatgggttcttgaact

SEQ ID NO: 824248 - DNA, 22 bp, Artificial Sequence
  chemically synthesized
ctgtagagatgggttcttgaac

SEQ ID NO: 824249 - DNA, 22 bp, Artificial Sequence
  chemically synthesized
tctgtagagatgggttcttgaa

SEQ ID NO: 824250 - DNA, 22 bp, Artificial Sequence
  chemically synthesized
gaggccaagagttcaagaaccc

SEQ ID NO: 824251 - DNA, 22 bp, Artificial Sequence
  chemically synthesized
aggccaagagttcaagaaccca

SEQ ID NO: 824252 - DNA, 22 bp, Artificial Sequence
  chemically synthesized
ttttctgtagagatgggttctt

SEQ ID NO: 824253 - DNA, 22 bp, Artificial Sequence
  chemically synthesized
gttttctgtagagatgggttct

SEQ ID NO: 824254 - DNA, 22 bp, Artificial Sequence
  chemically synthesized
tgttttctgtagagatgggttc

SEQ ID NO: 824255 - DNA, 22 bp, Artificial Sequence
  chemically synthesized
ttgttttctgtagagatgggtt

SEQ ID NO: 824256 - DNA, 22 bp, Artificial Sequence
  chemically synthesized
aaaatttttgttttctgtagag

SEQ ID NO: 824257 - DNA, 22 bp, Artificial Sequence
  chemically synthesized
aaaaatttttgttttctgtaga

SEQ ID NO: 824258 - DNA, 22 bp, Artificial Sequence
  chemically synthesized
aagaacccatctctacagaaaa

SEQ ID NO: 824259 - DNA, 22 bp, Artificial Sequence
  chemically synthesized
taaaaatttttgttttctgtag

SEQ ID NO: 824260 - DNA, 22 bp, Artificial Sequence
  chemically synthesized
ttaaaaatttttgttttctgta

SEQ ID NO: 824261 - DNA, 22 bp, Artificial Sequence
  chemically synthesized
tttaaaaatttttgttttctgt

SEQ ID NO: 824262 - DNA, 22 bp, Artificial Sequence
  chemically synthesized
attttttaaaaatttttgtttt

SEQ ID NO: 824263 - DNA, 22 bp, Artificial Sequence
  chemically synthesized
gctaattttttaaaaatttttg

SEQ ID NO: 824264 - DNA, 22 bp, Artificial Sequence
  chemically synthesized
tacagaaaacaaaaatttttaa

SEQ ID NO: 824265 - DNA, 22 bp, Artificial Sequence
  chemically synthesized
cagaaaacaaaaatttttaaaa

SEQ ID NO: 824266 - DNA, 22 bp, Artificial Sequence
  chemically synthesized
ttaaaaaattagccaggcgtgg

SEQ ID NO: 824267 - DNA, 22 bp, Artificial Sequence
  chemically synthesized
taaaaaattagccaggcgtggt

SEQ ID NO: 824268 - DNA, 22 bp, Artificial Sequence
  chemically synthesized
aaaaaattagccaggcgtggtg

SEQ ID NO: 824269 - DNA, 22 bp, Artificial Sequence
  chemically synthesized
aaaaattagccaggcgtggtgg

SEQ ID NO: 824270 - DNA, 22 bp, Artificial Sequence
  chemically synthesized
gccaggcgtgtaccaccacgcc

SEQ ID NO: 824271 - DNA, 22 bp, Artificial Sequence
  chemically synthesized
ctagccaggcgtgtaccaccac

SEQ ID NO: 824272 - DNA, 22 bp, Artificial Sequence
  chemically synthesized
gccaggcgtggtggtacacgcc

SEQ ID NO: 824273 - DNA, 22 bp, Artificial Sequence
  chemically synthesized
ggactactagccaggcgtgtac

SEQ ID NO: 824274 - DNA, 22 bp, Artificial Sequence
  chemically synthesized
gtagctgggactactagccagg

SEQ ID NO: 824275 - DNA, 22 bp, Artificial Sequence
  chemically synthesized
cctagtagctgggactactagc

SEQ ID NO: 824276 - DNA, 22 bp, Artificial Sequence
  chemically synthesized
agcctccctagtagctgggact

SEQ ID NO: 824277 - DNA, 22 bp, Artificial Sequence
  chemically synthesized
cctcagcctccctagtagctgg

SEQ ID NO: 824278 - DNA, 22 bp, Artificial Sequence
  chemically synthesized
gctagtagtcccagctactagg

SEQ ID NO: 824279 - DNA, 22 bp, Artificial Sequence
  chemically synthesized
ctgcctcagcctccctagtagc

SEQ ID NO: 824280 - DNA, 22 bp, Artificial Sequence
  chemically synthesized
gtagtcccagctactagggagg

SEQ ID NO: 824281 - DNA, 22 bp, Artificial Sequence
  chemically synthesized
aagcagtcctcctgcctcagcc

SEQ ID NO: 824282 - DNA, 22 bp, Artificial Sequence
  chemically synthesized
ctagggaggctgaggcaggagg

SEQ ID NO: 824283 - DNA, 22 bp, Artificial Sequence
  chemically synthesized
gggctcaagcagtcctcctgcc

SEQ ID NO: 824284 - DNA, 22 bp, Artificial Sequence
  chemically synthesized
gggaggctgaggcaggaggact

SEQ ID NO: 824285 - DNA, 22 bp, Artificial Sequence
  chemically synthesized
tggggctcaagcagtcctcctg

SEQ ID NO: 824286 - DNA, 22 bp, Artificial Sequence
  chemically synthesized
aactctggggctcaagcagtcc

SEQ ID NO: 824287 - DNA, 22 bp, Artificial Sequence
  chemically synthesized
gaactctggggctcaagcagtc

SEQ ID NO: 824288 - DNA, 22 bp, Artificial Sequence
  chemically synthesized
aggcaggaggactgcttgagcc

SEQ ID NO: 824289 - DNA, 22 bp, Artificial Sequence
  chemically synthesized
agccttgaactctggggctcaa

SEQ ID NO: 824290 - DNA, 22 bp, Artificial Sequence
  chemically synthesized
actgagccttgaactctggggc

SEQ ID NO: 824291 - DNA, 22 bp, Artificial Sequence
  chemically synthesized
cttgagccccagagttcaaggc

SEQ ID NO: 824292 - DNA, 22 bp, Artificial Sequence
  chemically synthesized
gagccccagagttcaaggctca

SEQ ID NO: 824293 - DNA, 22 bp, Artificial Sequence
  chemically synthesized
agccccagagttcaaggctcag

SEQ ID NO: 824294 - DNA, 22 bp, Artificial Sequence
  chemically synthesized
aaggctcagtgagctatgattg

SEQ ID NO: 824295 - DNA, 22 bp, Artificial Sequence
  chemically synthesized
aagtgcagtggcacaatcatag

SEQ ID NO: 824296 - DNA, 22 bp, Artificial Sequence
  chemically synthesized
agtgagctatgattgtgccact

SEQ ID NO: 824297 - DNA, 22 bp, Artificial Sequence
  chemically synthesized
tcacccaggctaaagtgcagtg

SEQ ID NO: 824298 - DNA, 22 bp, Artificial Sequence
  chemically synthesized
tgattgtgccactgcactttag

SEQ ID NO: 824299 - DNA, 22 bp, Artificial Sequence
  chemically synthesized
actgtcacccaggctaaagtgc

SEQ ID NO: 824300 - DNA, 22 bp, Artificial Sequence
  chemically synthesized
tgccactgcactttagcctggg

SEQ ID NO: 824301 - DNA, 22 bp, Artificial Sequence
  chemically synthesized
cactttagcctgggtgacagtg

SEQ ID NO: 824302 - DNA, 22 bp, Artificial Sequence
  chemically synthesized
gagacagagtctcactgtcacc

SEQ ID NO: 824303 - DNA, 22 bp, Artificial Sequence
  chemically synthesized
agagacagagtctcactgtcac

SEQ ID NO: 824304 - DNA, 22 bp, Artificial Sequence
  chemically synthesized
ttagagacagagtctcactgtc

SEQ ID NO: 824305 - DNA, 22 bp, Artificial Sequence
  chemically synthesized
cttagagacagagtctcactgt

SEQ ID NO: 824306 - DNA, 22 bp, Artificial Sequence
  chemically synthesized
tagcctgggtgacagtgagact

SEQ ID NO: 824307 - DNA, 22 bp, Artificial Sequence
  chemically synthesized
tcttagagacagagtctcactg

SEQ ID NO: 824308 - DNA, 22 bp, Artificial Sequence
  chemically synthesized
agcctgggtgacagtgagactc

SEQ ID NO: 824309 - DNA, 22 bp, Artificial Sequence
  chemically synthesized
gcctgggtgacagtgagactct

SEQ ID NO: 824310 - DNA, 22 bp, Artificial Sequence
  chemically synthesized
ttttcttagagacagagtctca

SEQ ID NO: 824311 - DNA, 22 bp, Artificial Sequence
  chemically synthesized
attttcttagagacagagtctc

SEQ ID NO: 824312 - DNA, 22 bp, Artificial Sequence
  chemically synthesized
ggtgacagtgagactctgtctc

SEQ ID NO: 824313 - DNA, 22 bp, Artificial Sequence
  chemically synthesized
tatatttattttcttagagaca

SEQ ID NO: 824314 - DNA, 22 bp, Artificial Sequence
  chemically synthesized
gtatatttattttcttagagac

SEQ ID NO: 824315 - DNA, 22 bp, Artificial Sequence
  chemically synthesized
tgtatatttattttcttagaga

SEQ ID NO: 824316 - DNA, 22 bp, Artificial Sequence
  chemically synthesized
tgtctctaagaaaataaatata

SEQ ID NO: 824317 - DNA, 22 bp, Artificial Sequence
  chemically synthesized
tctctaagaaaataaatataca

SEQ ID NO: 824318 - DNA, 22 bp, Artificial Sequence
  chemically synthesized
taagaaaataaatatacaaagt

SEQ ID NO: 824319 - DNA, 22 bp, Artificial Sequence
  chemically synthesized
aaatgaacagtagactttgtat

SEQ ID NO: 824320 - DNA, 22 bp, Artificial Sequence
  chemically synthesized
agaaaataaatatacaaagtct

SEQ ID NO: 824321 - DNA, 22 bp, Artificial Sequence
  chemically synthesized
aagctgaaatgaacagtagact

SEQ ID NO: 824322 - DNA, 22 bp, Artificial Sequence
  chemically synthesized
acagaaaatcacgttaaagctg

SEQ ID NO: 824323 - DNA, 22 bp, Artificial Sequence
  chemically synthesized
ctgttcatttcagctttaacgt

SEQ ID NO: 824324 - DNA, 22 bp, Artificial Sequence
  chemically synthesized
ttaacagaaaatcacgttaaag

SEQ ID NO: 824325 - DNA, 22 bp, Artificial Sequence
  chemically synthesized
ttcatttcagctttaacgtgat

SEQ ID NO: 824326 - DNA, 22 bp, Artificial Sequence
  chemically synthesized
atttcagctttaacgtgatttt

SEQ ID NO: 824327 - DNA, 22 bp, Artificial Sequence
  chemically synthesized
cagctttaacgtgattttctgt

SEQ ID NO: 824328 - DNA, 22 bp, Artificial Sequence
  chemically synthesized
agctttaacgtgattttctgtt

SEQ ID NO: 824329 - DNA, 22 bp, Artificial Sequence
  chemically synthesized
atgtaaagttattaacagaaaa

SEQ ID NO: 824330 - DNA, 22 bp, Artificial Sequence
  chemically synthesized
aatgtaaagttattaacagaaa

SEQ ID NO: 824331 - DNA, 22 bp, Artificial Sequence
  chemically synthesized
taacgtgattttctgttaataa

SEQ ID NO: 824332 - DNA, 22 bp, Artificial Sequence
  chemically synthesized
aacgtgattttctgttaataac

SEQ ID NO: 824333 - DNA, 22 bp, Artificial Sequence
  chemically synthesized
acgtgattttctgttaataact

SEQ ID NO: 824334 - DNA, 22 bp, Artificial Sequence
  chemically synthesized
atgatgtttaatgtaaagttat

SEQ ID NO: 824335 - DNA, 22 bp, Artificial Sequence
  chemically synthesized
aatgatgtttaatgtaaagtta

SEQ ID NO: 824336 - DNA, 22 bp, Artificial Sequence
  chemically synthesized
tctgttaataactttacattaa

SEQ ID NO: 824337 - DNA, 22 bp, Artificial Sequence
  chemically synthesized
ctgttaataactttacattaaa

SEQ ID NO: 824338 - DNA, 22 bp, Artificial Sequence
  chemically synthesized
tgttaataactttacattaaac

SEQ ID NO: 824339 - DNA, 22 bp, Artificial Sequence
  chemically synthesized
taatttaatgatgtttaatgta

SEQ ID NO: 824340 - DNA, 22 bp, Artificial Sequence
  chemically synthesized
ttaataactttacattaaacat

SEQ ID NO: 824341 - DNA, 22 bp, Artificial Sequence
  chemically synthesized
ataactttacattaaacatcat

SEQ ID NO: 824342 - DNA, 22 bp, Artificial Sequence
  chemically synthesized
tacattaaacatcattaaatta

SEQ ID NO: 824343 - DNA, 22 bp, Artificial Sequence
  chemically synthesized
taccatagattgtaatttaatg

SEQ ID NO: 824344 - DNA, 22 bp, Artificial Sequence
  chemically synthesized
acattaaacatcattaaattac

SEQ ID NO: 824345 - DNA, 22 bp, Artificial Sequence
  chemically synthesized
cattaaacatcattaaattaca

SEQ ID NO: 824346 - DNA, 22 bp, Artificial Sequence
  chemically synthesized
aacatcattaaattacaatcta

SEQ ID NO: 824347 - DNA, 22 bp, Artificial Sequence
  chemically synthesized
ataaaattataccatagattgt

SEQ ID NO: 824348 - DNA, 22 bp, Artificial Sequence
  chemically synthesized
gataaaattataccatagattg

SEQ ID NO: 824349 - DNA, 22 bp, Artificial Sequence
  chemically synthesized
catttgataaaattataccata

SEQ ID NO: 824350 - DNA, 22 bp, Artificial Sequence
  chemically synthesized
aattacaatctatggtataatt

SEQ ID NO: 824351 - DNA, 22 bp, Artificial Sequence
  chemically synthesized
gttacatttgataaaattatac

SEQ ID NO: 824352 - DNA, 22 bp, Artificial Sequence
  chemically synthesized
caatctatggtataattttatc

SEQ ID NO: 824353 - DNA, 22 bp, Artificial Sequence
  chemically synthesized
tggtataattttatcaaatgta

SEQ ID NO: 824354 - DNA, 22 bp, Artificial Sequence
  chemically synthesized
aaataaaatactggttacattt

SEQ ID NO: 824355 - DNA, 22 bp, Artificial Sequence
  chemically synthesized
aaaataaaatactggttacatt

SEQ ID NO: 824356 - DNA, 22 bp, Artificial Sequence
  chemically synthesized
taaaataaaatactggttacat

SEQ ID NO: 824357 - DNA, 22 bp, Artificial Sequence
  chemically synthesized
ttaaaataaaatactggttaca

SEQ ID NO: 824358 - DNA, 22 bp, Artificial Sequence
  chemically synthesized
tttaaaataaaatactggttac

SEQ ID NO: 824359 - DNA, 22 bp, Artificial Sequence
  chemically synthesized
tatcaaatgtaaccagtatttt

SEQ ID NO: 824360 - DNA, 22 bp, Artificial Sequence
  chemically synthesized
atcaaatgtaaccagtatttta

SEQ ID NO: 824361 - DNA, 22 bp, Artificial Sequence
  chemically synthesized
tcaaatgtaaccagtattttat

SEQ ID NO: 824362 - DNA, 22 bp, Artificial Sequence
  chemically synthesized
gtatcaaagatacctttttaaa

SEQ ID NO: 824363 - DNA, 22 bp, Artificial Sequence
  chemically synthesized
tattttaaaaaggtatctttga

SEQ ID NO: 824364 - DNA, 22 bp, Artificial Sequence
  chemically synthesized
attttaaaaaggtatctttgat

SEQ ID NO: 824365 - DNA, 22 bp, Artificial Sequence
  chemically synthesized
ttttaaaaaggtatctttgata

SEQ ID NO: 824366 - DNA, 22 bp, Artificial Sequence
  chemically synthesized
taaaaaggtatctttgatacta

SEQ ID NO: 824367 - DNA, 22 bp, Artificial Sequence
  chemically synthesized
aaaaaggtatctttgatactaa

SEQ ID NO: 824368 - DNA, 22 bp, Artificial Sequence
  chemically synthesized
aaaaggtatctttgatactaac

SEQ ID NO: 824369 - DNA, 22 bp, Artificial Sequence
  chemically synthesized
tgatactaaccttggtttctgt

SEQ ID NO: 824370 - DNA, 22 bp, Artificial Sequence
  chemically synthesized
gatactaaccttggtttctgtg

SEQ ID NO: 824371 - DNA, 22 bp, Artificial Sequence
  chemically synthesized
atactaaccttggtttctgtga

SEQ ID NO: 824372 - DNA, 22 bp, Artificial Sequence
  chemically synthesized
accttggtttctgtgattttct

SEQ ID NO: 824373 - DNA, 22 bp, Artificial Sequence
  chemically synthesized
ggtttctgtgattttcttttgg

SEQ ID NO: 824374 - DNA, 22 bp, Artificial Sequence
  chemically synthesized
gtttctgtgattttcttttgga

SEQ ID NO: 824375 - DNA, 22 bp, Artificial Sequence
  chemically synthesized
tacagtagatgcaatccaaaag

SEQ ID NO: 824376 - DNA, 22 bp, Artificial Sequence
  chemically synthesized
ctgtgattttcttttggattgc

SEQ ID NO: 824377 - DNA, 22 bp, Artificial Sequence
  chemically synthesized
tgtgattttcttttggattgca

SEQ ID NO: 824378 - DNA, 22 bp, Artificial Sequence
  chemically synthesized
tgattttcttttggattgcatc

SEQ ID NO: 824379 - DNA, 22 bp, Artificial Sequence
  chemically synthesized
tcttttggattgcatctactgt

SEQ ID NO: 824380 - DNA, 22 bp, Artificial Sequence
  chemically synthesized
cttttggattgcatctactgta

SEQ ID NO: 824381 - DNA, 22 bp, Artificial Sequence
  chemically synthesized
ttttggattgcatctactgtat

SEQ ID NO: 824382 - DNA, 22 bp, Artificial Sequence
  chemically synthesized
ttggattgcatctactgtatag

SEQ ID NO: 824383 - DNA, 22 bp, Artificial Sequence
  chemically synthesized
tggattgcatctactgtatagg

SEQ ID NO: 824384 - DNA, 22 bp, Artificial Sequence
  chemically synthesized
ggattgcatctactgtataggg

SEQ ID NO: 824385 - DNA, 22 bp, Artificial Sequence
  chemically synthesized
gattgcatctactgtataggga

SEQ ID NO: 824386 - DNA, 22 bp, Artificial Sequence
  chemically synthesized
agtcatggaaggagggtcccta

SEQ ID NO: 824387 - DNA, 22 bp, Artificial Sequence
  chemically synthesized
catctactgtatagggaccctc

SEQ ID NO: 824388 - DNA, 22 bp, Artificial Sequence
  chemically synthesized
gagtcatggaaggagggtccct

SEQ ID NO: 824389 - DNA, 22 bp, Artificial Sequence
  chemically synthesized
ctgtatagggaccctccttcca

SEQ ID NO: 824390 - DNA, 22 bp, Artificial Sequence
  chemically synthesized
tatagggaccctccttccatga

SEQ ID NO: 824391 - DNA, 22 bp, Artificial Sequence
  chemically synthesized
ggacaggccagagccaagcttg

SEQ ID NO: 824392 - DNA, 22 bp, Artificial Sequence
  chemically synthesized
cttccatgactcaagcttggct

SEQ ID NO: 824393 - DNA, 22 bp, Artificial Sequence
  chemically synthesized
aggacaggccagagccaagctt

SEQ ID NO: 824394 - DNA, 22 bp, Artificial Sequence
  chemically synthesized
ccatgactcaagcttggctctg

SEQ ID NO: 824395 - DNA, 22 bp, Artificial Sequence
  chemically synthesized
catgactcaagcttggctctgg

SEQ ID NO: 824396 - DNA, 22 bp, Artificial Sequence
  chemically synthesized
agcaggtcttaggacaggccag

SEQ ID NO: 824397 - DNA, 22 bp, Artificial Sequence
  chemically synthesized
aagcttggctctggcctgtcct

SEQ ID NO: 824398 - DNA, 22 bp, Artificial Sequence
  chemically synthesized
ggctctggcctgtcctaagacc

SEQ ID NO: 824399 - DNA, 22 bp, Artificial Sequence
  chemically synthesized
gctctggcctgtcctaagacct

SEQ ID NO: 824400 - DNA, 22 bp, Artificial Sequence
  chemically synthesized
aggaagaagctgagcaggtctt

SEQ ID NO: 824401 - DNA, 22 bp, Artificial Sequence
  chemically synthesized
tggcctgtcctaagacctgctc

SEQ ID NO: 824402 - DNA, 22 bp, Artificial Sequence
  chemically synthesized
gcctgtcctaagacctgctcag

SEQ ID NO: 824403 - DNA, 22 bp, Artificial Sequence
  chemically synthesized
gaagctaaggaagaagctgagc

SEQ ID NO: 824404 - DNA, 22 bp, Artificial Sequence
  chemically synthesized
tcctaagacctgctcagcttct

SEQ ID NO: 824405 - DNA, 22 bp, Artificial Sequence
  chemically synthesized
agacctgctcagcttcttcctt

SEQ ID NO: 824406 - DNA, 22 bp, Artificial Sequence
  chemically synthesized
ctcagcttcttccttagcttcc

SEQ ID NO: 824407 - DNA, 22 bp, Artificial Sequence
  chemically synthesized
aacacaatggctggaagctaag

SEQ ID NO: 824408 - DNA, 22 bp, Artificial Sequence
  chemically synthesized
agcttcttccttagcttccagc

SEQ ID NO: 824409 - DNA, 22 bp, Artificial Sequence
  chemically synthesized
cttccttagcttccagccattg

SEQ ID NO: 824410 - DNA, 22 bp, Artificial Sequence
  chemically synthesized
aaggattcaacacaatggctgg

SEQ ID NO: 824411 - DNA, 22 bp, Artificial Sequence
  chemically synthesized
ttccttagcttccagccattgt

SEQ ID NO: 824412 - DNA, 22 bp, Artificial Sequence
  chemically synthesized
ccttagcttccagccattgtgt

SEQ ID NO: 824413 - DNA, 22 bp, Artificial Sequence
  chemically synthesized
cttagcttccagccattgtgtt

SEQ ID NO: 824414 - DNA, 22 bp, Artificial Sequence
  chemically synthesized
agcttccagccattgtgttgaa

SEQ ID NO: 824415 - DNA, 22 bp, Artificial Sequence
  chemically synthesized
gcttccagccattgtgttgaat

SEQ ID NO: 824416 - DNA, 22 bp, Artificial Sequence
  chemically synthesized
ccagccattgtgttgaatcctt

SEQ ID NO: 824417 - DNA, 22 bp, Artificial Sequence
  chemically synthesized
aatgaaatgttaaaggattcaa

SEQ ID NO: 824418 - DNA, 22 bp, Artificial Sequence
  chemically synthesized
cagccattgtgttgaatccttt

SEQ ID NO: 824419 - DNA, 22 bp, Artificial Sequence
  chemically synthesized
tgttgaatcctttaacatttca

SEQ ID NO: 824420 - DNA, 22 bp, Artificial Sequence
  chemically synthesized
aatcctttaacatttcattcaa

SEQ ID NO: 824421 - DNA, 22 bp, Artificial Sequence
  chemically synthesized
agaaccggaggcaacagttgaa

SEQ ID NO: 824422 - DNA, 22 bp, Artificial Sequence
  chemically synthesized
cagaaccggaggcaacagttga

SEQ ID NO: 824423 - DNA, 22 bp, Artificial Sequence
  chemically synthesized
taacatttcattcaactgttgc

SEQ ID NO: 824424 - DNA, 22 bp, Artificial Sequence
  chemically synthesized
aacatttcattcaactgttgcc

SEQ ID NO: 824425 - DNA, 22 bp, Artificial Sequence
  chemically synthesized
acatttcattcaactgttgcct

SEQ ID NO: 824426 - DNA, 22 bp, Artificial Sequence
  chemically synthesized
cattcaactgttgcctccggtt

SEQ ID NO: 824427 - DNA, 22 bp, Artificial Sequence
  chemically synthesized
attcaactgttgcctccggttc

SEQ ID NO: 824428 - DNA, 22 bp, Artificial Sequence
  chemically synthesized
aactgttgcctccggttctgaa

SEQ ID NO: 824429 - DNA, 22 bp, Artificial Sequence
  chemically synthesized
ttgcctccggttctgaaggtgt

SEQ ID NO: 824430 - DNA, 22 bp, Artificial Sequence
  chemically synthesized
cctccggttctgaaggtgttct

SEQ ID NO: 824431 - DNA, 22 bp, Artificial Sequence
  chemically synthesized
cggttctgaaggtgttcttgta

SEQ ID NO: 824432 - DNA, 22 bp, Artificial Sequence
  chemically synthesized
tgaaggtgttcttgtacttcat

SEQ ID NO: 824433 - DNA, 22 bp, Artificial Sequence
  chemically synthesized
agaatcagtgggatgaagtaca

SEQ ID NO: 824434 - DNA, 22 bp, Artificial Sequence
  chemically synthesized
aaggtgttcttgtacttcatcc

SEQ ID NO: 824435 - DNA, 22 bp, Artificial Sequence
  chemically synthesized
aaagaattcagaatcagtggga

SEQ ID NO: 824436 - DNA, 22 bp, Artificial Sequence
  chemically synthesized
ttgtacttcatcccactgattc

SEQ ID NO: 824437 - DNA, 22 bp, Artificial Sequence
  chemically synthesized
gtacttcatcccactgattctg

SEQ ID NO: 824438 - DNA, 22 bp, Artificial Sequence
  chemically synthesized
gttgaaagaattcagaatcagt

SEQ ID NO: 824439 - DNA, 22 bp, Artificial Sequence
  chemically synthesized
tacttcatcccactgattctga

SEQ ID NO: 824440 - DNA, 22 bp, Artificial Sequence
  chemically synthesized
tagttgaaagaattcagaatca

SEQ ID NO: 824441 - DNA, 22 bp, Artificial Sequence
  chemically synthesized
ttctagttgaaagaattcagaa

SEQ ID NO: 824442 - DNA, 22 bp, Artificial Sequence
  chemically synthesized
catcccactgattctgaattct

SEQ ID NO: 824443 - DNA, 22 bp, Artificial Sequence
  chemically synthesized
attctagttgaaagaattcaga

SEQ ID NO: 824444 - DNA, 22 bp, Artificial Sequence
  chemically synthesized
atcccactgattctgaattctt

SEQ ID NO: 824445 - DNA, 22 bp, Artificial Sequence
  chemically synthesized
tattctagttgaaagaattcag

SEQ ID NO: 824446 - DNA, 22 bp, Artificial Sequence
  chemically synthesized
ttattctagttgaaagaattca

SEQ ID NO: 824447 - DNA, 22 bp, Artificial Sequence
  chemically synthesized
cttttattctagttgaaagaat

SEQ ID NO: 824448 - DNA, 22 bp, Artificial Sequence
  chemically synthesized
ccttttattctagttgaaagaa

SEQ ID NO: 824449 - DNA, 22 bp, Artificial Sequence
  chemically synthesized
tccttttattctagttgaaaga

SEQ ID NO: 824450 - DNA, 22 bp, Artificial Sequence
  chemically synthesized
ttccttttattctagttgaaag

SEQ ID NO: 824451 - DNA, 22 bp, Artificial Sequence
  chemically synthesized
attctgaattctttcaactaga

SEQ ID NO: 824452 - DNA, 22 bp, Artificial Sequence
  chemically synthesized
tttttccttttattctagttga

SEQ ID NO: 824453 - DNA, 22 bp, Artificial Sequence
  chemically synthesized
atttttccttttattctagttg

SEQ ID NO: 824454 - DNA, 22 bp, Artificial Sequence
  chemically synthesized
tgaattctttcaactagaataa

SEQ ID NO: 824455 - DNA, 22 bp, Artificial Sequence
  chemically synthesized
aattctttcaactagaataaaa

SEQ ID NO: 824456 - DNA, 22 bp, Artificial Sequence
  chemically synthesized
tatatttatttttccttttatt

SEQ ID NO: 824457 - DNA, 22 bp, Artificial Sequence
  chemically synthesized
tttcaactagaataaaaggaaa

SEQ ID NO: 824458 - DNA, 22 bp, Artificial Sequence
  chemically synthesized
ctatatatttatttttcctttt

SEQ ID NO: 824459 - DNA, 22 bp, Artificial Sequence
  chemically synthesized
tcaactagaataaaaggaaaaa

SEQ ID NO: 824460 - DNA, 22 bp, Artificial Sequence
  chemically synthesized
caactagaataaaaggaaaaat

SEQ ID NO: 824461 - DNA, 22 bp, Artificial Sequence
  chemically synthesized
aactagaataaaaggaaaaata

SEQ ID NO: 824462 - DNA, 22 bp, Artificial Sequence
  chemically synthesized
ctactatatatttatttttcct

SEQ ID NO: 824463 - DNA, 22 bp, Artificial Sequence
  chemically synthesized
actactatatatttatttttcc

SEQ ID NO: 824464 - DNA, 22 bp, Artificial Sequence
  chemically synthesized
gaataaaaggaaaaataaatat

SEQ ID NO: 824465 - DNA, 22 bp, Artificial Sequence
  chemically synthesized
gcatttactactatatatttat

SEQ ID NO: 824466 - DNA, 22 bp, Artificial Sequence
  chemically synthesized
cagactagcatttactactata

SEQ ID NO: 824467 - DNA, 22 bp, Artificial Sequence
  chemically synthesized
ctccagactagcatttactact

SEQ ID NO: 824468 - DNA, 22 bp, Artificial Sequence
  chemically synthesized
aaatgtctcctccagactagca

SEQ ID NO: 824469 - DNA, 22 bp, Artificial Sequence
  chemically synthesized
aaaatgtctcctccagactagc

SEQ ID NO: 824470 - DNA, 22 bp, Artificial Sequence
  chemically synthesized
catttaaaatgtctcctccaga

SEQ ID NO: 824471 - DNA, 22 bp, Artificial Sequence
  chemically synthesized
gaagttacatttaaaatgtctc

SEQ ID NO: 824472 - DNA, 22 bp, Artificial Sequence
  chemically synthesized
ggaagttacatttaaaatgtct

SEQ ID NO: 824473 - DNA, 22 bp, Artificial Sequence
  chemically synthesized
gtctggaggagacattttaaat

SEQ ID NO: 824474 - DNA, 22 bp, Artificial Sequence
  chemically synthesized
gaggagacattttaaatgtaac

SEQ ID NO: 824475 - DNA, 22 bp, Artificial Sequence
  chemically synthesized
taaatgtaacttccaaacgtta

SEQ ID NO: 824476 - DNA, 22 bp, Artificial Sequence
  chemically synthesized
aaatgtaacttccaaacgttat

SEQ ID NO: 824477 - DNA, 22 bp, Artificial Sequence
  chemically synthesized
aatgtaacttccaaacgttatc

SEQ ID NO: 824478 - DNA, 22 bp, Artificial Sequence
  chemically synthesized
aataagcaacataaatgtgaga

SEQ ID NO: 824479 - DNA, 22 bp, Artificial Sequence
  chemically synthesized
aaataagcaacataaatgtgag

SEQ ID NO: 824480 - DNA, 22 bp, Artificial Sequence
  chemically synthesized
ccaaacgttatctcacatttat

SEQ ID NO: 824481 - DNA, 22 bp, Artificial Sequence
  chemically synthesized
taaataagcaacataaatgtga

SEQ ID NO: 824482 - DNA, 22 bp, Artificial Sequence
  chemically synthesized
caaacgttatctcacatttatg

SEQ ID NO: 824483 - DNA, 22 bp, Artificial Sequence
  chemically synthesized
ttaaataagcaacataaatgtg

SEQ ID NO: 824484 - DNA, 22 bp, Artificial Sequence
  chemically synthesized
tttaaataagcaacataaatgt

SEQ ID NO: 824485 - DNA, 22 bp, Artificial Sequence
  chemically synthesized
tctcacatttatgttgcttatt

SEQ ID NO: 824486 - DNA, 22 bp, Artificial Sequence
  chemically synthesized
acatttatgttgcttatttaaa

SEQ ID NO: 824487 - DNA, 22 bp, Artificial Sequence
  chemically synthesized
atgttgcttatttaaaaaatta

SEQ ID NO: 824488 - DNA, 22 bp, Artificial Sequence
  chemically synthesized
tgttgcttatttaaaaaattat

SEQ ID NO: 824489 - DNA, 22 bp, Artificial Sequence
  chemically synthesized
gccataacacaatgaataattt

SEQ ID NO: 824490 - DNA, 22 bp, Artificial Sequence
  chemically synthesized
cttatttaaaaaattattcatt

SEQ ID NO: 824491 - DNA, 22 bp, Artificial Sequence
  chemically synthesized
atttaaaaaattattcattgtg

SEQ ID NO: 824492 - DNA, 22 bp, Artificial Sequence
  chemically synthesized
tttaaaaaattattcattgtgt

SEQ ID NO: 824493 - DNA, 22 bp, Artificial Sequence
  chemically synthesized
aaaaaattattcattgtgttat

SEQ ID NO: 824494 - DNA, 22 bp, Artificial Sequence
  chemically synthesized
atcatcctagccataacacaat

SEQ ID NO: 824495 - DNA, 22 bp, Artificial Sequence
  chemically synthesized
aaaaattattcattgtgttatg

SEQ ID NO: 824496 - DNA, 22 bp, Artificial Sequence
  chemically synthesized
ttcatcatcctagccataacac

SEQ ID NO: 824497 - DNA, 22 bp, Artificial Sequence
  chemically synthesized
ttgttcatcatcctagccataa

SEQ ID NO: 824498 - DNA, 22 bp, Artificial Sequence
  chemically synthesized
ttcattgtgttatggctaggat

SEQ ID NO: 824499 - DNA, 22 bp, Artificial Sequence
  chemically synthesized
attgtgttatggctaggatgat

SEQ ID NO: 824500 - DNA, 22 bp, Artificial Sequence
  chemically synthesized
tgttatggctaggatgatgaac

SEQ ID NO: 824501 - DNA, 22 bp, Artificial Sequence
  chemically synthesized
tggctaggatgatgaacaacag

SEQ ID NO: 824502 - DNA, 22 bp, Artificial Sequence
  chemically synthesized
ggatgatgaacaacaggattct

SEQ ID NO: 824503 - DNA, 22 bp, Artificial Sequence
  chemically synthesized
ccatcaaaaaagcaaagaatcc

SEQ ID NO: 824504 - DNA, 22 bp, Artificial Sequence
  chemically synthesized
gccatcaaaaaagcaaagaatc

SEQ ID NO: 824505 - DNA, 22 bp, Artificial Sequence
  chemically synthesized
atatttgccatcaaaaaagcaa

SEQ ID NO: 824506 - DNA, 22 bp, Artificial Sequence
  chemically synthesized
acagaaactaatatttgccatc

SEQ ID NO: 824507 - DNA, 22 bp, Artificial Sequence
  chemically synthesized
tttgcttttttgatggcaaata

SEQ ID NO: 824508 - DNA, 22 bp, Artificial Sequence
  chemically synthesized
aacagaaactaatatttgccat

SEQ ID NO: 824509 - DNA, 22 bp, Artificial Sequence
  chemically synthesized
tgcttttttgatggcaaatatt

SEQ ID NO: 824510 - DNA, 22 bp, Artificial Sequence
  chemically synthesized
gcttttttgatggcaaatatta

SEQ ID NO: 824511 - DNA, 22 bp, Artificial Sequence
  chemically synthesized
cttttttgatggcaaatattag

SEQ ID NO: 824512 - DNA, 22 bp, Artificial Sequence
  chemically synthesized
ttttgatggcaaatattagttt

SEQ ID NO: 824513 - DNA, 22 bp, Artificial Sequence
  chemically synthesized
tttgatggcaaatattagtttc

SEQ ID NO: 824514 - DNA, 22 bp, Artificial Sequence
  chemically synthesized
ttgatggcaaatattagtttct

SEQ ID NO: 824515 - DNA, 22 bp, Artificial Sequence
  chemically synthesized
tgatggcaaatattagtttctg

SEQ ID NO: 824516 - DNA, 22 bp, Artificial Sequence
  chemically synthesized
gatggcaaatattagtttctgt

SEQ ID NO: 824517 - DNA, 22 bp, Artificial Sequence
  chemically synthesized
atggcaaatattagtttctgtt

SEQ ID NO: 824518 - DNA, 22 bp, Artificial Sequence
  chemically synthesized
aggaaaataatttaacagaaac

SEQ ID NO: 824519 - DNA, 22 bp, Artificial Sequence
  chemically synthesized
caggaaaataatttaacagaaa

SEQ ID NO: 824520 - DNA, 22 bp, Artificial Sequence
  chemically synthesized
tgtcaccttcaggaaaataatt

SEQ ID NO: 824521 - DNA, 22 bp, Artificial Sequence
  chemically synthesized
gtttctgttaaattattttcct

SEQ ID NO: 824522 - DNA, 22 bp, Artificial Sequence
  chemically synthesized
tatgtcaccttcaggaaaataa

SEQ ID NO: 824523 - DNA, 22 bp, Artificial Sequence
  chemically synthesized
ctgttaaattattttcctgaag

SEQ ID NO: 824524 - DNA, 22 bp, Artificial Sequence
  chemically synthesized
tgttaaattattttcctgaagg

SEQ ID NO: 824525 - DNA, 22 bp, Artificial Sequence
  chemically synthesized
atgttctatgtcaccttcagga

SEQ ID NO: 824526 - DNA, 22 bp, Artificial Sequence
  chemically synthesized
ttaaattattttcctgaaggtg

SEQ ID NO: 824527 - DNA, 22 bp, Artificial Sequence
  chemically synthesized
aattattttcctgaaggtgaca

SEQ ID NO: 824528 - DNA, 22 bp, Artificial Sequence
  chemically synthesized
ttttcctgaaggtgacatagaa

SEQ ID NO: 824529 - DNA, 22 bp, Artificial Sequence
  chemically synthesized
tatatatgttgatgttctatgt

SEQ ID NO: 824530 - DNA, 22 bp, Artificial Sequence
  chemically synthesized
tcctgaaggtgacatagaacat

SEQ ID NO: 824531 - DNA, 22 bp, Artificial Sequence
  chemically synthesized
atatatatgttgatgttctatg

SEQ ID NO: 824532 - DNA, 22 bp, Artificial Sequence
  chemically synthesized
cctgaaggtgacatagaacatc

SEQ ID NO: 824533 - DNA, 22 bp, Artificial Sequence
  chemically synthesized
tatatatatgttgatgttctat

SEQ ID NO: 824534 - DNA, 22 bp, Artificial Sequence
  chemically synthesized
ctgaaggtgacatagaacatca

SEQ ID NO: 824535 - DNA, 22 bp, Artificial Sequence
  chemically synthesized
aaggtgacatagaacatcaaca

SEQ ID NO: 824536 - DNA, 22 bp, Artificial Sequence
  chemically synthesized
aaattttatatatatgttgatg

SEQ ID NO: 824537 - DNA, 22 bp, Artificial Sequence
  chemically synthesized
agttaaaattttatatatatgt

SEQ ID NO: 824538 - DNA, 22 bp, Artificial Sequence
  chemically synthesized
gggatcaagaattgagttaaaa

SEQ ID NO: 824539 - DNA, 22 bp, Artificial Sequence
  chemically synthesized
tagggatcaagaattgagttaa

SEQ ID NO: 824540 - DNA, 22 bp, Artificial Sequence
  chemically synthesized
gttctagggatcaagaattgag

SEQ ID NO: 824541 - DNA, 22 bp, Artificial Sequence
  chemically synthesized
ggttctagggatcaagaattga

SEQ ID NO: 824542 - DNA, 22 bp, Artificial Sequence
  chemically synthesized
atatttggttctagggatcaag

SEQ ID NO: 824543 - DNA, 22 bp, Artificial Sequence
  chemically synthesized
taactcaattcttgatccctag

SEQ ID NO: 824544 - DNA, 22 bp, Artificial Sequence
  chemically synthesized
aactcaattcttgatccctaga

SEQ ID NO: 824545 - DNA, 22 bp, Artificial Sequence
  chemically synthesized
actcaattcttgatccctagaa

SEQ ID NO: 824546 - DNA, 22 bp, Artificial Sequence
  chemically synthesized
aattcttgatccctagaaccaa

SEQ ID NO: 824547 - DNA, 22 bp, Artificial Sequence
  chemically synthesized
acagatgattcatatttggttc

SEQ ID NO: 824548 - DNA, 22 bp, Artificial Sequence
  chemically synthesized
ttgatccctagaaccaaatatg

SEQ ID NO: 824549 - DNA, 22 bp, Artificial Sequence
  chemically synthesized
taacagatgattcatatttggt

SEQ ID NO: 824550 - DNA, 22 bp, Artificial Sequence
  chemically synthesized
ctaacagatgattcatatttgg

SEQ ID NO: 824551 - DNA, 22 bp, Artificial Sequence
  chemically synthesized
gatccctagaaccaaatatgaa

SEQ ID NO: 824552 - DNA, 22 bp, Artificial Sequence
  chemically synthesized
tctaacagatgattcatatttg

SEQ ID NO: 824553 - DNA, 22 bp, Artificial Sequence
  chemically synthesized
atccctagaaccaaatatgaat

SEQ ID NO: 824554 - DNA, 22 bp, Artificial Sequence
  chemically synthesized
ttctaacagatgattcatattt

SEQ ID NO: 824555 - DNA, 22 bp, Artificial Sequence
  chemically synthesized
gaaccaaatatgaatcatctgt

SEQ ID NO: 824556 - DNA, 22 bp, Artificial Sequence
  chemically synthesized
tagtgcttttctaacagatgat

SEQ ID NO: 824557 - DNA, 22 bp, Artificial Sequence
  chemically synthesized
ctgtagtgcttttctaacagat

SEQ ID NO: 824558 - DNA, 22 bp, Artificial Sequence
  chemically synthesized
tgctgtagtgcttttctaacag

SEQ ID NO: 824559 - DNA, 22 bp, Artificial Sequence
  chemically synthesized
ttagaaaagcactacagcagaa

SEQ ID NO: 824560 - DNA, 22 bp, Artificial Sequence
  chemically synthesized
gaaaagcactacagcagaatat

SEQ ID NO: 824561 - DNA, 22 bp, Artificial Sequence
  chemically synthesized
cagcagaatatccatatcccct

SEQ ID NO: 824562 - DNA, 22 bp, Artificial Sequence
  chemically synthesized
aagtggcaaggatgaggggata

SEQ ID NO: 824563 - DNA, 22 bp, Artificial Sequence
  chemically synthesized
atgggtgctgaagtggcaagga

SEQ ID NO: 824564 - DNA, 22 bp, Artificial Sequence
  chemically synthesized
atccttgccacttcagcaccca

SEQ ID NO: 824565 - DNA, 22 bp, Artificial Sequence
  chemically synthesized
ggaaatcaggctgatgggtgct

SEQ ID NO: 824566 - DNA, 22 bp, Artificial Sequence
  chemically synthesized
gccacttcagcacccatcagcc

SEQ ID NO: 824567 - DNA, 22 bp, Artificial Sequence
  chemically synthesized
ccacttcagcacccatcagcct

SEQ ID NO: 824568 - DNA, 22 bp, Artificial Sequence
  chemically synthesized
gcactgggaaatcaggctgatg

SEQ ID NO: 824569 - DNA, 22 bp, Artificial Sequence
  chemically synthesized
cagcacccatcagcctgatttc

SEQ ID NO: 824570 - DNA, 22 bp, Artificial Sequence
  chemically synthesized
agcacccatcagcctgatttcc

SEQ ID NO: 824571 - DNA, 22 bp, Artificial Sequence
  chemically synthesized
aggcaatgaaatgctggcactg

SEQ ID NO: 824572 - DNA, 22 bp, Artificial Sequence
  chemically synthesized
caggcaatgaaatgctggcact

SEQ ID NO: 824573 - DNA, 22 bp, Artificial Sequence
  chemically synthesized
atttcccagtgccagcatttca

SEQ ID NO: 824574 - DNA, 22 bp, Artificial Sequence
  chemically synthesized
cccagtgccagcatttcattgc

SEQ ID NO: 824575 - DNA, 22 bp, Artificial Sequence
  chemically synthesized
ccagtgccagcatttcattgcc

SEQ ID NO: 824576 - DNA, 22 bp, Artificial Sequence
  chemically synthesized
tggcaacagaaagccttcaggc

SEQ ID NO: 824577 - DNA, 22 bp, Artificial Sequence
  chemically synthesized
ctgtggcaacagaaagccttca

SEQ ID NO: 824578 - DNA, 22 bp, Artificial Sequence
  chemically synthesized
cattgcctgaaggctttctgtt

SEQ ID NO: 824579 - DNA, 22 bp, Artificial Sequence
  chemically synthesized
attgcctgaaggctttctgttg

SEQ ID NO: 824580 - DNA, 22 bp, Artificial Sequence
  chemically synthesized
cctgaaggctttctgttgccac

SEQ ID NO: 824581 - DNA, 22 bp, Artificial Sequence
  chemically synthesized
aaggctttctgttgccacagga

SEQ ID NO: 824582 - DNA, 22 bp, Artificial Sequence
  chemically synthesized
tctgttgccacaggagtttgct

SEQ ID NO: 824583 - DNA, 22 bp, Artificial Sequence
  chemically synthesized
ctgttgccacaggagtttgctt

SEQ ID NO: 824584 - DNA, 22 bp, Artificial Sequence
  chemically synthesized
tgttgccacaggagtttgcttt

SEQ ID NO: 824585 - DNA, 22 bp, Artificial Sequence
  chemically synthesized
tcacatggatggcaaagcaaac

SEQ ID NO: 824586 - DNA, 22 bp, Artificial Sequence
  chemically synthesized
ttgccacaggagtttgctttgc

SEQ ID NO: 824587 - DNA, 22 bp, Artificial Sequence
  chemically synthesized
ccacaggagtttgctttgccat

SEQ ID NO: 824588 - DNA, 22 bp, Artificial Sequence
  chemically synthesized
gcctgtcacatggatggcaaag

SEQ ID NO: 824589 - DNA, 22 bp, Artificial Sequence
  chemically synthesized
gtatgtctagcctgtcacatgg

SEQ ID NO: 824590 - DNA, 22 bp, Artificial Sequence
  chemically synthesized
gctttgccatccatgtgacagg

SEQ ID NO: 824591 - DNA, 22 bp, Artificial Sequence
  chemically synthesized
ctttgccatccatgtgacaggc

SEQ ID NO: 824592 - DNA, 22 bp, Artificial Sequence
  chemically synthesized
cctggtatgtctagcctgtcac

SEQ ID NO: 824593 - DNA, 22 bp, Artificial Sequence
  chemically synthesized
tgccatccatgtgacaggctag

SEQ ID NO: 824594 - DNA, 22 bp, Artificial Sequence
  chemically synthesized
gccatccatgtgacaggctaga

SEQ ID NO: 824595 - DNA, 22 bp, Artificial Sequence
  chemically synthesized
ccatccatgtgacaggctagac

SEQ ID NO: 824596 - DNA, 22 bp, Artificial Sequence
  chemically synthesized
gaggggaggcatcagttgcctg

SEQ ID NO: 824597 - DNA, 22 bp, Artificial Sequence
  chemically synthesized
gacataccaggcaactgatgcc

SEQ ID NO: 824598 - DNA, 22 bp, Artificial Sequence
  chemically synthesized
ggagctggaggggaggcatcag

SEQ ID NO: 824599 - DNA, 22 bp, Artificial Sequence
  chemically synthesized
tgggagctggaggggaggcatc

SEQ ID NO: 824600 - DNA, 22 bp, Artificial Sequence
  chemically synthesized
cctctgggagctggaggggagg

SEQ ID NO: 824601 - DNA, 22 bp, Artificial Sequence
  chemically synthesized
atgcctcccctccagctcccag

SEQ ID NO: 824602 - DNA, 22 bp, Artificial Sequence
  chemically synthesized
tatacaggctgcctctgggagc

SEQ ID NO: 824603 - DNA, 22 bp, Artificial Sequence
  chemically synthesized
ccctccagctcccagaggcagc

SEQ ID NO: 824604 - DNA, 22 bp, Artificial Sequence
  chemically synthesized
gtcattatatacaggctgcctc

SEQ ID NO: 824605 - DNA, 22 bp, Artificial Sequence
  chemically synthesized
cagctcccagaggcagcctgta

SEQ ID NO: 824606 - DNA, 22 bp, Artificial Sequence
  chemically synthesized
caattagtcattatatacaggc

SEQ ID NO: 824607 - DNA, 22 bp, Artificial Sequence
  chemically synthesized
ccagaggcagcctgtatataat

SEQ ID NO: 824608 - DNA, 22 bp, Artificial Sequence
  chemically synthesized
ctacaattagtcattatataca

SEQ ID NO: 824609 - DNA, 22 bp, Artificial Sequence
  chemically synthesized
tatataatgactaattgtagga

SEQ ID NO: 824610 - DNA, 22 bp, Artificial Sequence
  chemically synthesized
gtgtaacaatatcccaattcct

SEQ ID NO: 824611 - DNA, 22 bp, Artificial Sequence
  chemically synthesized
attgtaggaattgggatattgt

SEQ ID NO: 824612 - DNA, 22 bp, Artificial Sequence
  chemically synthesized
taggaattgggatattgttaca

SEQ ID NO: 824613 - DNA, 22 bp, Artificial Sequence
  chemically synthesized
gcatcaagggagctagtgtaac

SEQ ID NO: 824614 - DNA, 22 bp, Artificial Sequence
  chemically synthesized
ggatattgttacactagctccc

SEQ ID NO: 824615 - DNA, 22 bp, Artificial Sequence
  chemically synthesized
ccctagcatcaagggagctagt

SEQ ID NO: 824616 - DNA, 22 bp, Artificial Sequence
  chemically synthesized
cccctagcatcaagggagctag

SEQ ID NO: 824617 - DNA, 22 bp, Artificial Sequence
  chemically synthesized
tttcccctagcatcaagggagc

SEQ ID NO: 824618 - DNA, 22 bp, Artificial Sequence
  chemically synthesized
ttacactagctcccttgatgct

SEQ ID NO: 824619 - DNA, 22 bp, Artificial Sequence
  chemically synthesized
cactagctcccttgatgctagg

SEQ ID NO: 824620 - DNA, 22 bp, Artificial Sequence
  chemically synthesized
agagttatttcccctagcatca

SEQ ID NO: 824621 - DNA, 22 bp, Artificial Sequence
  chemically synthesized
gctcccttgatgctaggggaaa

SEQ ID NO: 824622 - DNA, 22 bp, Artificial Sequence
  chemically synthesized
ccttgatgctaggggaaataac

SEQ ID NO: 824623 - DNA, 22 bp, Artificial Sequence
  chemically synthesized
gatgctaggggaaataactctg

SEQ ID NO: 824624 - DNA, 22 bp, Artificial Sequence
  chemically synthesized
atgctaggggaaataactctga

SEQ ID NO: 824625 - DNA, 22 bp, Artificial Sequence
  chemically synthesized
taaaatacatgcctcagagtta

SEQ ID NO: 824626 - DNA, 22 bp, Artificial Sequence
  chemically synthesized
gtaaaatacatgcctcagagtt

SEQ ID NO: 824627 - DNA, 22 bp, Artificial Sequence
  chemically synthesized
ggggaaataactctgaggcatg

SEQ ID NO: 824628 - DNA, 22 bp, Artificial Sequence
  chemically synthesized
gaacccttgtaaaatacatgcc

SEQ ID NO: 824629 - DNA, 22 bp, Artificial Sequence
  chemically synthesized
tggaacccttgtaaaatacatg

SEQ ID NO: 824630 - DNA, 22 bp, Artificial Sequence
  chemically synthesized
tgaggcatgtattttacaaggg

SEQ ID NO: 824631 - DNA, 22 bp, Artificial Sequence
  chemically synthesized
ggaaactctggaacccttgtaa

SEQ ID NO: 824632 - DNA, 22 bp, Artificial Sequence
  chemically synthesized
aggcatgtattttacaagggtt

SEQ ID NO: 824633 - DNA, 22 bp, Artificial Sequence
  chemically synthesized
gggaaactctggaacccttgta

SEQ ID NO: 824634 - DNA, 22 bp, Artificial Sequence
  chemically synthesized
tcccttgggaaactctggaacc

SEQ ID NO: 824635 - DNA, 22 bp, Artificial Sequence
  chemically synthesized
atcccttgggaaactctggaac

SEQ ID NO: 824636 - DNA, 22 bp, Artificial Sequence
  chemically synthesized
tatcccttgggaaactctggaa

SEQ ID NO: 824637 - DNA, 22 bp, Artificial Sequence
  chemically synthesized
tacaagggttccagagtttccc

SEQ ID NO: 824638 - DNA, 22 bp, Artificial Sequence
  chemically synthesized
acaagggttccagagtttccca

SEQ ID NO: 824639 - DNA, 22 bp, Artificial Sequence
  chemically synthesized
caagggttccagagtttcccaa

SEQ ID NO: 824640 - DNA, 22 bp, Artificial Sequence
  chemically synthesized
gagctttatcccttgggaaact

SEQ ID NO: 824641 - DNA, 22 bp, Artificial Sequence
  chemically synthesized
cagagtttcccaagggataaag

SEQ ID NO: 824642 - DNA, 22 bp, Artificial Sequence
  chemically synthesized
tgggtcactggagctttatccc

SEQ ID NO: 824643 - DNA, 22 bp, Artificial Sequence
  chemically synthesized
ttgtgggtcactggagctttat

SEQ ID NO: 824644 - DNA, 22 bp, Artificial Sequence
  chemically synthesized
ctgttgtgggtcactggagctt

SEQ ID NO: 824645 - DNA, 22 bp, Artificial Sequence
  chemically synthesized
cccaagggataaagctccagtg

SEQ ID NO: 824646 - DNA, 22 bp, Artificial Sequence
  chemically synthesized
ccaagggataaagctccagtga

SEQ ID NO: 824647 - DNA, 22 bp, Artificial Sequence
  chemically synthesized
tcaagccagctgctgttgtggg

SEQ ID NO: 824648 - DNA, 22 bp, Artificial Sequence
  chemically synthesized
cagtgacccacaacagcagctg

SEQ ID NO: 824649 - DNA, 22 bp, Artificial Sequence
  chemically synthesized
gcttgataatgcaccactcttt

SEQ ID NO: 824650 - DNA, 22 bp, Artificial Sequence
  chemically synthesized
gataatgcaccactctttactg

SEQ ID NO: 824651 - DNA, 22 bp, Artificial Sequence
  chemically synthesized
ataatgcaccactctttactgg

SEQ ID NO: 824652 - DNA, 22 bp, Artificial Sequence
  chemically synthesized
tttactggctgccttgcctcac

SEQ ID NO: 824653 - DNA, 22 bp, Artificial Sequence
  chemically synthesized
tactggctgccttgcctcacct

SEQ ID NO: 824654 - DNA, 22 bp, Artificial Sequence
  chemically synthesized
actggctgccttgcctcacctg

SEQ ID NO: 824655 - DNA, 22 bp, Artificial Sequence
  chemically synthesized
ctggctgccttgcctcacctgt

SEQ ID NO: 824656 - DNA, 22 bp, Artificial Sequence
  chemically synthesized
gctgccttgcctcacctgtctc

SEQ ID NO: 824657 - DNA, 22 bp, Artificial Sequence
  chemically synthesized
ccttgcctcacctgtctcattt

SEQ ID NO: 824658 - DNA, 22 bp, Artificial Sequence
  chemically synthesized
gcctcacctgtctcatttttcc

SEQ ID NO: 824659 - DNA, 22 bp, Artificial Sequence
  chemically synthesized
cctcacctgtctcatttttcca

SEQ ID NO: 824660 - DNA, 22 bp, Artificial Sequence
  chemically synthesized
atcagtagaagagtggaaaaat

SEQ ID NO: 824661 - DNA, 22 bp, Artificial Sequence
  chemically synthesized
acctgtctcatttttccactct

SEQ ID NO: 824662 - DNA, 22 bp, Artificial Sequence
  chemically synthesized
tctcatttttccactcttctac

SEQ ID NO: 824663 - DNA, 22 bp, Artificial Sequence
  chemically synthesized
atttttccactcttctactgat

SEQ ID NO: 824664 - DNA, 22 bp, Artificial Sequence
  chemically synthesized
gggggtaaattaatcagtagaa

SEQ ID NO: 824665 - DNA, 22 bp, Artificial Sequence
  chemically synthesized
ggggggtaaattaatcagtaga

SEQ ID NO: 824666 - DNA, 22 bp, Artificial Sequence
  chemically synthesized
ttccactcttctactgattaat

SEQ ID NO: 824667 - DNA, 22 bp, Artificial Sequence
  chemically synthesized
tttggggggtaaattaatcagt

SEQ ID NO: 824668 - DNA, 22 bp, Artificial Sequence
  chemically synthesized
tccactcttctactgattaatt

SEQ ID NO: 824669 - DNA, 22 bp, Artificial Sequence
  chemically synthesized
atttggggggtaaattaatcag

SEQ ID NO: 824670 - DNA, 22 bp, Artificial Sequence
  chemically synthesized
ccactcttctactgattaattt

SEQ ID NO: 824671 - DNA, 22 bp, Artificial Sequence
  chemically synthesized
cactcttctactgattaattta

SEQ ID NO: 824672 - DNA, 22 bp, Artificial Sequence
  chemically synthesized
ttctactgattaatttaccccc

SEQ ID NO: 824673 - DNA, 22 bp, Artificial Sequence
  chemically synthesized
ctactgattaatttacccccca

SEQ ID NO: 824674 - DNA, 22 bp, Artificial Sequence
  chemically synthesized
tactgattaatttaccccccaa

SEQ ID NO: 824675 - DNA, 22 bp, Artificial Sequence
  chemically synthesized
ctgattaatttaccccccaaat

SEQ ID NO: 824676 - DNA, 22 bp, Artificial Sequence
  chemically synthesized
agagcaagtgatttatttgggg

SEQ ID NO: 824677 - DNA, 22 bp, Artificial Sequence
  chemically synthesized
attaatttaccccccaaataaa

SEQ ID NO: 824678 - DNA, 22 bp, Artificial Sequence
  chemically synthesized
aagagcaagtgatttatttggg

SEQ ID NO: 824679 - DNA, 22 bp, Artificial Sequence
  chemically synthesized
taagagcaagtgatttatttgg

SEQ ID NO: 824680 - DNA, 22 bp, Artificial Sequence
  chemically synthesized
atttaccccccaaataaatcac

SEQ ID NO: 824681 - DNA, 22 bp, Artificial Sequence
  chemically synthesized
accccccaaataaatcacttgc

SEQ ID NO: 824682 - DNA, 22 bp, Artificial Sequence
  chemically synthesized
ccccccaaataaatcacttgct

SEQ ID NO: 824683 - DNA, 22 bp, Artificial Sequence
  chemically synthesized
gaaaaggttttaagagcaagtg

SEQ ID NO: 824684 - DNA, 22 bp, Artificial Sequence
  chemically synthesized
ggaaaaggttttaagagcaagt

SEQ ID NO: 824685 - DNA, 22 bp, Artificial Sequence
  chemically synthesized
agaagacccttggaaaaggttt

SEQ ID NO: 824686 - DNA, 22 bp, Artificial Sequence
  chemically synthesized
actcagaagacccttggaaaag

SEQ ID NO: 824687 - DNA, 22 bp, Artificial Sequence
  chemically synthesized
gctcttaaaaccttttccaagg

SEQ ID NO: 824688 - DNA, 22 bp, Artificial Sequence
  chemically synthesized
ctcttaaaaccttttccaaggg

SEQ ID NO: 824689 - DNA, 22 bp, Artificial Sequence
  chemically synthesized
ttaaaaccttttccaagggtct

SEQ ID NO: 824690 - DNA, 22 bp, Artificial Sequence
  chemically synthesized
ggttcactcagaagacccttgg

SEQ ID NO: 824691 - DNA, 22 bp, Artificial Sequence
  chemically synthesized
gggttcactcagaagacccttg

SEQ ID NO: 824692 - DNA, 22 bp, Artificial Sequence
  chemically synthesized
aaaaccttttccaagggtcttc

SEQ ID NO: 824693 - DNA, 22 bp, Artificial Sequence
  chemically synthesized
aaaccttttccaagggtcttct

SEQ ID NO: 824694 - DNA, 22 bp, Artificial Sequence
  chemically synthesized
ccttgggttcactcagaagacc

SEQ ID NO: 824695 - DNA, 22 bp, Artificial Sequence
  chemically synthesized
cccttgggttcactcagaagac

SEQ ID NO: 824696 - DNA, 22 bp, Artificial Sequence
  chemically synthesized
ttccaagggtcttctgagtgaa

SEQ ID NO: 824697 - DNA, 22 bp, Artificial Sequence
  chemically synthesized
tcttcccttgggttcactcaga

SEQ ID NO: 824698 - DNA, 22 bp, Artificial Sequence
  chemically synthesized
tccaagggtcttctgagtgaac

SEQ ID NO: 824699 - DNA, 22 bp, Artificial Sequence
  chemically synthesized
atcttcccttgggttcactcag

SEQ ID NO: 824700 - DNA, 22 bp, Artificial Sequence
  chemically synthesized
ccaagggtcttctgagtgaacc

SEQ ID NO: 824701 - DNA, 22 bp, Artificial Sequence
  chemically synthesized
caagggtcttctgagtgaaccc

SEQ ID NO: 824702 - DNA, 22 bp, Artificial Sequence
  chemically synthesized
atacacttatcttcccttgggt

SEQ ID NO: 824703 - DNA, 22 bp, Artificial Sequence
  chemically synthesized
taatacacttatcttcccttgg

SEQ ID NO: 824704 - DNA, 22 bp, Artificial Sequence
  chemically synthesized
ctaatacacttatcttcccttg

SEQ ID NO: 824705 - DNA, 22 bp, Artificial Sequence
  chemically synthesized
ctgagtgaacccaagggaagat

SEQ ID NO: 824706 - DNA, 22 bp, Artificial Sequence
  chemically synthesized
tgagtgaacccaagggaagata

SEQ ID NO: 824707 - DNA, 22 bp, Artificial Sequence
  chemically synthesized
agtgaacccaagggaagataag

SEQ ID NO: 824708 - DNA, 22 bp, Artificial Sequence
  chemically synthesized
gaaacttcttctttttctttct

SEQ ID NO: 824709 - DNA, 22 bp, Artificial Sequence
  chemically synthesized
catcaaaaaaaaaaaagaaaga

SEQ ID NO: 824710 - DNA, 22 bp, Artificial Sequence
  chemically synthesized
cttctttttctttctttttttt

SEQ ID NO: 824711 - DNA, 22 bp, Artificial Sequence
  chemically synthesized
ttctttttctttcttttttttt

SEQ ID NO: 824712 - DNA, 22 bp, Artificial Sequence
  chemically synthesized
ctttttctttcttttttttttt

SEQ ID NO: 824713 - DNA, 22 bp, Artificial Sequence
  chemically synthesized
tttttctttctttttttttttt

SEQ ID NO: 824714 - DNA, 22 bp, Artificial Sequence
  chemically synthesized
tttctttcttttttttttttga

SEQ ID NO: 824715 - DNA, 22 bp, Artificial Sequence
  chemically synthesized
ttctttcttttttttttttgat

SEQ ID NO: 824716 - DNA, 22 bp, Artificial Sequence
  chemically synthesized
tctttcttttttttttttgatg

SEQ ID NO: 824717 - DNA, 22 bp, Artificial Sequence
  chemically synthesized
ctttcttttttttttttgatgg

SEQ ID NO: 824718 - DNA, 22 bp, Artificial Sequence
  chemically synthesized
tttcttttttttttttgatgga

SEQ ID NO: 824719 - DNA, 22 bp, Artificial Sequence
  chemically synthesized
caagagcaaaactccatcaaaa

SEQ ID NO: 824720 - DNA, 22 bp, Artificial Sequence
  chemically synthesized
tcttttttttttttgatggagt

SEQ ID NO: 824721 - DNA, 22 bp, Artificial Sequence
  chemically synthesized
cttttttttttttgatggagtt

SEQ ID NO: 824722 - DNA, 22 bp, Artificial Sequence
  chemically synthesized
ttttttttttttgatggagttt

SEQ ID NO: 824723 - DNA, 22 bp, Artificial Sequence
  chemically synthesized
ggttacaagagcaaaactccat

SEQ ID NO: 824724 - DNA, 22 bp, Artificial Sequence
  chemically synthesized
ttttttttttgatggagttttg

SEQ ID NO: 824725 - DNA, 22 bp, Artificial Sequence
  chemically synthesized
tttttttttgatggagttttgc

SEQ ID NO: 824726 - DNA, 22 bp, Artificial Sequence
  chemically synthesized
ttttttttgatggagttttgct

SEQ ID NO: 824727 - DNA, 22 bp, Artificial Sequence
  chemically synthesized
tttttttgatggagttttgctc

SEQ ID NO: 824728 - DNA, 22 bp, Artificial Sequence
  chemically synthesized
ttttttgatggagttttgctct

SEQ ID NO: 824729 - DNA, 22 bp, Artificial Sequence
  chemically synthesized
tttttgatggagttttgctctt

SEQ ID NO: 824730 - DNA, 22 bp, Artificial Sequence
  chemically synthesized
ttttgatggagttttgctcttg

SEQ ID NO: 824731 - DNA, 22 bp, Artificial Sequence
  chemically synthesized
cagcctgggttacaagagcaaa

SEQ ID NO: 824732 - DNA, 22 bp, Artificial Sequence
  chemically synthesized
tttgatggagttttgctcttgt

SEQ ID NO: 824733 - DNA, 22 bp, Artificial Sequence
  chemically synthesized
ttgatggagttttgctcttgta

SEQ ID NO: 824734 - DNA, 22 bp, Artificial Sequence
  chemically synthesized
tgatggagttttgctcttgtaa

SEQ ID NO: 824735 - DNA, 22 bp, Artificial Sequence
  chemically synthesized
gatggagttttgctcttgtaac

SEQ ID NO: 824736 - DNA, 22 bp, Artificial Sequence
  chemically synthesized
atggagttttgctcttgtaacc

SEQ ID NO: 824737 - DNA, 22 bp, Artificial Sequence
  chemically synthesized
cactccagcctgggttacaaga

SEQ ID NO: 824738 - DNA, 22 bp, Artificial Sequence
  chemically synthesized
caccattgcactccagcctggg

SEQ ID NO: 824739 - DNA, 22 bp, Artificial Sequence
  chemically synthesized
tgctcttgtaacccaggctgga

SEQ ID NO: 824740 - DNA, 22 bp, Artificial Sequence
  chemically synthesized
gctcttgtaacccaggctggag

SEQ ID NO: 824741 - DNA, 22 bp, Artificial Sequence
  chemically synthesized
ctcttgtaacccaggctggagt

SEQ ID NO: 824742 - DNA, 22 bp, Artificial Sequence
  chemically synthesized
ttgtaacccaggctggagtgca

SEQ ID NO: 824743 - DNA, 22 bp, Artificial Sequence
  chemically synthesized
gtaacccaggctggagtgcaat

SEQ ID NO: 824744 - DNA, 22 bp, Artificial Sequence
  chemically synthesized
taacccaggctggagtgcaatg

SEQ ID NO: 824745 - DNA, 22 bp, Artificial Sequence
  chemically synthesized
cagtgagcggagattgcaccat

SEQ ID NO: 824746 - DNA, 22 bp, Artificial Sequence
  chemically synthesized
gagtgcaatggtgcaatctccg

SEQ ID NO: 824747 - DNA, 22 bp, Artificial Sequence
  chemically synthesized
aacccgggaggcggaggttgca

SEQ ID NO: 824748 - DNA, 22 bp, Artificial Sequence
  chemically synthesized
gaacccgggaggcggaggttgc

SEQ ID NO: 824749 - DNA, 22 bp, Artificial Sequence
  chemically synthesized
cgctcactgcaacctccgcctc

SEQ ID NO: 824750 - DNA, 22 bp, Artificial Sequence
  chemically synthesized
actgcaacctccgcctcccggg

SEQ ID NO: 824751 - DNA, 22 bp, Artificial Sequence
  chemically synthesized
caacctccgcctcccgggttca

SEQ ID NO: 824752 - DNA, 22 bp, Artificial Sequence
  chemically synthesized
agacaggaggatagcttgaacc

SEQ ID NO: 824753 - DNA, 22 bp, Artificial Sequence
  chemically synthesized
cgcctcccgggttcaagctatc

SEQ ID NO: 824754 - DNA, 22 bp, Artificial Sequence
  chemically synthesized
ccgggttcaagctatcctcctg

SEQ ID NO: 824755 - DNA, 22 bp, Artificial Sequence
  chemically synthesized
gggaggctgagacaggaggata

SEQ ID NO: 824756 - DNA, 22 bp, Artificial Sequence
  chemically synthesized
ctcgggaggctgagacaggagg

SEQ ID NO: 824757 - DNA, 22 bp, Artificial Sequence
  chemically synthesized
ctactcgggaggctgagacagg

SEQ ID NO: 824758 - DNA, 22 bp, Artificial Sequence
  chemically synthesized
aagctatcctcctgtctcagcc

SEQ ID NO: 824759 - DNA, 22 bp, Artificial Sequence
  chemically synthesized
ctgctactcgggaggctgagac

SEQ ID NO: 824760 - DNA, 22 bp, Artificial Sequence
  chemically synthesized
tcctcctgtctcagcctcccga

SEQ ID NO: 824761 - DNA, 22 bp, Artificial Sequence
  chemically synthesized
tagttcctgctactcgggaggc

SEQ ID NO: 824762 - DNA, 22 bp, Artificial Sequence
  chemically synthesized
ctgtctcagcctcccgagtagc

SEQ ID NO: 824763 - DNA, 22 bp, Artificial Sequence
  chemically synthesized
tctcagcctcccgagtagcagg

SEQ ID NO: 824764 - DNA, 22 bp, Artificial Sequence
  chemically synthesized
agcctcccgagtagcaggaact

SEQ ID NO: 824765 - DNA, 22 bp, Artificial Sequence
  chemically synthesized
ccgagtagcaggaactacaggc

SEQ ID NO: 824766 - DNA, 22 bp, Artificial Sequence
  chemically synthesized
ggcatgatggcacgtgcctgta

SEQ ID NO: 824767 - DNA, 22 bp, Artificial Sequence
  chemically synthesized
gctgggcatgatggcacgtgcc

SEQ ID NO: 824768 - DNA, 22 bp, Artificial Sequence
  chemically synthesized
caggcacgtgccatcatgccca

SEQ ID NO: 824769 - DNA, 22 bp, Artificial Sequence
  chemically synthesized
aaaatacaaaaaaaaaaaatta

SEQ ID NO: 824770 - DNA, 22 bp, Artificial Sequence
  chemically synthesized
ttaaaaatacaaaaaaaaaaaa

SEQ ID NO: 824771 - DNA, 22 bp, Artificial Sequence
  chemically synthesized
tattaaaaatacaaaaaaaaaa

SEQ ID NO: 824772 - DNA, 22 bp, Artificial Sequence
  chemically synthesized
tctctattaaaaatacaaaaaa

SEQ ID NO: 824773 - DNA, 22 bp, Artificial Sequence
  chemically synthesized
attttttttttttgtattttta

SEQ ID NO: 824774 - DNA, 22 bp, Artificial Sequence
  chemically synthesized
tttttttttgtatttttaatag

SEQ ID NO: 824775 - DNA, 22 bp, Artificial Sequence
  chemically synthesized
ttttttttgtatttttaataga

SEQ ID NO: 824776 - DNA, 22 bp, Artificial Sequence
  chemically synthesized
tttttttgtatttttaatagag

SEQ ID NO: 824777 - DNA, 22 bp, Artificial Sequence
  chemically synthesized
ttttttgtatttttaatagaga

SEQ ID NO: 824778 - DNA, 22 bp, Artificial Sequence
  chemically synthesized
tttttgtatttttaatagagac

SEQ ID NO: 824779 - DNA, 22 bp, Artificial Sequence
  chemically synthesized
ttttgtatttttaatagagaca

SEQ ID NO: 824780 - DNA, 22 bp, Artificial Sequence
  chemically synthesized
tttgtatttttaatagagacag

SEQ ID NO: 824781 - DNA, 22 bp, Artificial Sequence
  chemically synthesized
ttgtatttttaatagagacagg

SEQ ID NO: 824782 - DNA, 22 bp, Artificial Sequence
  chemically synthesized
tgtatttttaatagagacaggg

SEQ ID NO: 824783 - DNA, 22 bp, Artificial Sequence
  chemically synthesized
gtatttttaatagagacagggt

SEQ ID NO: 824784 - DNA, 22 bp, Artificial Sequence
  chemically synthesized
tatttttaatagagacagggtt

SEQ ID NO: 824785 - DNA, 22 bp, Artificial Sequence
  chemically synthesized
ttaatagagacagggtttcacc

SEQ ID NO: 824786 - DNA, 22 bp, Artificial Sequence
  chemically synthesized
taatagagacagggtttcacca

SEQ ID NO: 824787 - DNA, 22 bp, Artificial Sequence
  chemically synthesized
aatagagacagggtttcaccat

SEQ ID NO: 824788 - DNA, 22 bp, Artificial Sequence
  chemically synthesized
atagagacagggtttcaccatg

SEQ ID NO: 824789 - DNA, 22 bp, Artificial Sequence
  chemically synthesized
agaccagcccggccaacatggt

SEQ ID NO: 824790 - DNA, 22 bp, Artificial Sequence
  chemically synthesized
gagaccagcccggccaacatgg

SEQ ID NO: 824791 - DNA, 22 bp, Artificial Sequence
  chemically synthesized
caccatgttggccgggctggtc

SEQ ID NO: 824792 - DNA, 22 bp, Artificial Sequence
  chemically synthesized
accatgttggccgggctggtct

SEQ ID NO: 824793 - DNA, 22 bp, Artificial Sequence
  chemically synthesized
aggtcaggagtttgagaccagc

SEQ ID NO: 824794 - DNA, 22 bp, Artificial Sequence
  chemically synthesized
gccgggctggtctcaaactcct

SEQ ID NO: 824795 - DNA, 22 bp, Artificial Sequence
  chemically synthesized
gtctcaaactcctgacctcagg

SEQ ID NO: 824796 - DNA, 22 bp, Artificial Sequence
  chemically synthesized
aaactcctgacctcaggtgatc

SEQ ID NO: 824797 - DNA, 22 bp, Artificial Sequence
  chemically synthesized
ggaggccgaggcaggtggatca

SEQ ID NO: 824798 - DNA, 22 bp, Artificial Sequence
  chemically synthesized
ctgacctcaggtgatccacctg

SEQ ID NO: 824799 - DNA, 22 bp, Artificial Sequence
  chemically synthesized
gggaggccgaggcaggtggatc

SEQ ID NO: 824800 - DNA, 22 bp, Artificial Sequence
  chemically synthesized
tgggaggccgaggcaggtggat

SEQ ID NO: 824801 - DNA, 22 bp, Artificial Sequence
  chemically synthesized
acctcaggtgatccacctgcct

SEQ ID NO: 824802 - DNA, 22 bp, Artificial Sequence
  chemically synthesized
aggtgatccacctgcctcggcc

SEQ ID NO: 824803 - DNA, 22 bp, Artificial Sequence
  chemically synthesized
taatcccagcactttgggaggc

SEQ ID NO: 824804 - DNA, 22 bp, Artificial Sequence
  chemically synthesized
cctcggcctcccaaagtgctgg

SEQ ID NO: 824805 - DNA, 22 bp, Artificial Sequence
  chemically synthesized
acgcctgtaatcccagcacttt

SEQ ID NO: 824806 - DNA, 22 bp, Artificial Sequence
  chemically synthesized
ggcctcccaaagtgctgggatt

SEQ ID NO: 824807 - DNA, 22 bp, Artificial Sequence
  chemically synthesized
ccaaagtgctgggattacaggc

SEQ ID NO: 824808 - DNA, 22 bp, Artificial Sequence
  chemically synthesized
gccaggcgcggtggctcacgcc

SEQ ID NO: 824809 - DNA, 22 bp, Artificial Sequence
  chemically synthesized
ggattacaggcgtgagccaccg

SEQ ID NO: 824810 - DNA, 22 bp, Artificial Sequence
  chemically synthesized
caggcgtgagccaccgcgcctg

SEQ ID NO: 824811 - DNA, 22 bp, Artificial Sequence
  chemically synthesized
aaagaagttggccaggcgcggt

SEQ ID NO: 824812 - DNA, 22 bp, Artificial Sequence
  chemically synthesized
ttaaaagaagttggccaggcgc

SEQ ID NO: 824813 - DNA, 22 bp, Artificial Sequence
  chemically synthesized
ggtattgttaaaagaagttggc

SEQ ID NO: 824814 - DNA, 22 bp, Artificial Sequence
  chemically synthesized
aggtattgttaaaagaagttgg

SEQ ID NO: 824815 - DNA, 22 bp, Artificial Sequence
  chemically synthesized
ttaggtattgttaaaagaagtt

SEQ ID NO: 824816 - DNA, 22 bp, Artificial Sequence
  chemically synthesized
gccaacttcttttaacaatacc

SEQ ID NO: 824817 - DNA, 22 bp, Artificial Sequence
  chemically synthesized
cttttaacaatacctaagaatt

SEQ ID NO: 824818 - DNA, 22 bp, Artificial Sequence
  chemically synthesized
ttttaacaatacctaagaattc

SEQ ID NO: 824819 - DNA, 22 bp, Artificial Sequence
  chemically synthesized
ttaacaatacctaagaattcac

SEQ ID NO: 824820 - DNA, 22 bp, Artificial Sequence
  chemically synthesized
taacaatacctaagaattcacg

SEQ ID NO: 824821 - DNA, 22 bp, Artificial Sequence
  chemically synthesized
aacaatacctaagaattcacgc

SEQ ID NO: 824822 - DNA, 22 bp, Artificial Sequence
  chemically synthesized
acaatacctaagaattcacgct

SEQ ID NO: 824823 - DNA, 22 bp, Artificial Sequence
  chemically synthesized
caaaatgcacccagcgtgaatt

SEQ ID NO: 824824 - DNA, 22 bp, Artificial Sequence
  chemically synthesized
acaaaatgcacccagcgtgaat

SEQ ID NO: 824825 - DNA, 22 bp, Artificial Sequence
  chemically synthesized
agaattcacgctgggtgcattt

SEQ ID NO: 824826 - DNA, 22 bp, Artificial Sequence
  chemically synthesized
acgctgggtgcattttgtaaga

SEQ ID NO: 824827 - DNA, 22 bp, Artificial Sequence
  chemically synthesized
aatataagccagtcttacaaaa

SEQ ID NO: 824828 - DNA, 22 bp, Artificial Sequence
  chemically synthesized
ggtgcattttgtaagactggct

SEQ ID NO: 824829 - DNA, 22 bp, Artificial Sequence
  chemically synthesized
tgtaagactggcttatattgag

SEQ ID NO: 824830 - DNA, 22 bp, Artificial Sequence
  chemically synthesized
gtaagactggcttatattgagg

SEQ ID NO: 824831 - DNA, 22 bp, Artificial Sequence
  chemically synthesized
taagactggcttatattgaggc

SEQ ID NO: 824832 - DNA, 22 bp, Artificial Sequence
  chemically synthesized
caatgataccagtgatagcctc

SEQ ID NO: 824833 - DNA, 22 bp, Artificial Sequence
  chemically synthesized
ccaatgataccagtgatagcct

SEQ ID NO: 824834 - DNA, 22 bp, Artificial Sequence
  chemically synthesized
gcttatattgaggctatcactg

SEQ ID NO: 824835 - DNA, 22 bp, Artificial Sequence
  chemically synthesized
gacttccaatgataccagtgat

SEQ ID NO: 824836 - DNA, 22 bp, Artificial Sequence
  chemically synthesized
atattgaggctatcactggtat

SEQ ID NO: 824837 - DNA, 22 bp, Artificial Sequence
  chemically synthesized
ggacttccaatgataccagtga

SEQ ID NO: 824838 - DNA, 22 bp, Artificial Sequence
  chemically synthesized
tattgaggctatcactggtatc

SEQ ID NO: 824839 - DNA, 22 bp, Artificial Sequence
  chemically synthesized
ttggacttccaatgataccagt

SEQ ID NO: 824840 - DNA, 22 bp, Artificial Sequence
  chemically synthesized
aggctatcactggtatcattgg

SEQ ID NO: 824841 - DNA, 22 bp, Artificial Sequence
  chemically synthesized
cctcttggacttccaatgatac

SEQ ID NO: 824842 - DNA, 22 bp, Artificial Sequence
  chemically synthesized
tcactggtatcattggaagtcc

SEQ ID NO: 824843 - DNA, 22 bp, Artificial Sequence
  chemically synthesized
tatagtacctccctcttggact

SEQ ID NO: 824844 - DNA, 22 bp, Artificial Sequence
  chemically synthesized
gtatcattggaagtccaagagg

SEQ ID NO: 824845 - DNA, 22 bp, Artificial Sequence
  chemically synthesized
gaagtccaagagggaggtacta

SEQ ID NO: 824846 - DNA, 22 bp, Artificial Sequence
  chemically synthesized
agagtagaatctatatagtacc

SEQ ID NO: 824847 - DNA, 22 bp, Artificial Sequence
  chemically synthesized
cagagtagaatctatatagtac

SEQ ID NO: 824848 - DNA, 22 bp, Artificial Sequence
  chemically synthesized
aaaagaacatatttcagagtag

SEQ ID NO: 824849 - DNA, 22 bp, Artificial Sequence
  chemically synthesized
gaaaagaacatatttcagagta

SEQ ID NO: 824850 - DNA, 22 bp, Artificial Sequence
  chemically synthesized
tatagattctactctgaaatat

SEQ ID NO: 824851 - DNA, 22 bp, Artificial Sequence
  chemically synthesized
atatttgaaaagaacatatttc

SEQ ID NO: 824852 - DNA, 22 bp, Artificial Sequence
  chemically synthesized
aatatttgaaaagaacatattt

SEQ ID NO: 824853 - DNA, 22 bp, Artificial Sequence
  chemically synthesized
taatatttgaaaagaacatatt

SEQ ID NO: 824854 - DNA, 22 bp, Artificial Sequence
  chemically synthesized
ttttaatatttgaaaagaacat

SEQ ID NO: 824855 - DNA, 22 bp, Artificial Sequence
  chemically synthesized
tactctgaaatatgttcttttc

SEQ ID NO: 824856 - DNA, 22 bp, Artificial Sequence
  chemically synthesized
attttaatatttgaaaagaaca

SEQ ID NO: 824857 - DNA, 22 bp, Artificial Sequence
  chemically synthesized
ctctgaaatatgttcttttcaa

SEQ ID NO: 824858 - DNA, 22 bp, Artificial Sequence
  chemically synthesized
tttattttaatatttgaaaaga

SEQ ID NO: 824859 - DNA, 22 bp, Artificial Sequence
  chemically synthesized
tgaaatatgttcttttcaaata

SEQ ID NO: 824860 - DNA, 22 bp, Artificial Sequence
  chemically synthesized
aaatatgttcttttcaaatatt

SEQ ID NO: 824861 - DNA, 22 bp, Artificial Sequence
  chemically synthesized
ttttcaaatattaaaataaaca

SEQ ID NO: 824862 - DNA, 22 bp, Artificial Sequence
  chemically synthesized
ttcaaatattaaaataaacagg

SEQ ID NO: 824863 - DNA, 22 bp, Artificial Sequence
  chemically synthesized
tcaaatattaaaataaacagga

SEQ ID NO: 824864 - DNA, 22 bp, Artificial Sequence
  chemically synthesized
caaatattaaaataaacaggac

SEQ ID NO: 824865 - DNA, 22 bp, Artificial Sequence
  chemically synthesized
aaatattaaaataaacaggact

SEQ ID NO: 824866 - DNA, 22 bp, Artificial Sequence
  chemically synthesized
catagaaaaaataatgtagtcc

SEQ ID NO: 824867 - DNA, 22 bp, Artificial Sequence
  chemically synthesized
aaataaacaggactacattatt

SEQ ID NO: 824868 - DNA, 22 bp, Artificial Sequence
  chemically synthesized
gagaagttgcatagaaaaaata

SEQ ID NO: 824869 - DNA, 22 bp, Artificial Sequence
  chemically synthesized
agagaagttgcatagaaaaaat

SEQ ID NO: 824870 - DNA, 22 bp, Artificial Sequence
  chemically synthesized
cattattttttctatgcaactt

SEQ ID NO: 824871 - DNA, 22 bp, Artificial Sequence
  chemically synthesized
ttttttctatgcaacttctcta

SEQ ID NO: 824872 - DNA, 22 bp, Artificial Sequence
  chemically synthesized
ataaaaccagcttagagaagtt

SEQ ID NO: 824873 - DNA, 22 bp, Artificial Sequence
  chemically synthesized
cataaaaccagcttagagaagt

SEQ ID NO: 824874 - DNA, 22 bp, Artificial Sequence
  chemically synthesized
tttctatgcaacttctctaagc

SEQ ID NO: 824875 - DNA, 22 bp, Artificial Sequence
  chemically synthesized
ttctatgcaacttctctaagct

SEQ ID NO: 824876 - DNA, 22 bp, Artificial Sequence
  chemically synthesized
tttcataaaaccagcttagaga

SEQ ID NO: 824877 - DNA, 22 bp, Artificial Sequence
  chemically synthesized
tctatgcaacttctctaagctg

SEQ ID NO: 824878 - DNA, 22 bp, Artificial Sequence
  chemically synthesized
atttcataaaaccagcttagag

SEQ ID NO: 824879 - DNA, 22 bp, Artificial Sequence
  chemically synthesized
ctatgcaacttctctaagctgg

SEQ ID NO: 824880 - DNA, 22 bp, Artificial Sequence
  chemically synthesized
tatttcataaaaccagcttaga

SEQ ID NO: 824881 - DNA, 22 bp, Artificial Sequence
  chemically synthesized
tatgcaacttctctaagctggt

SEQ ID NO: 824882 - DNA, 22 bp, Artificial Sequence
  chemically synthesized
ttatttcataaaaccagcttag

SEQ ID NO: 824883 - DNA, 22 bp, Artificial Sequence
  chemically synthesized
tgcaacttctctaagctggttt

SEQ ID NO: 824884 - DNA, 22 bp, Artificial Sequence
  chemically synthesized
tttttatttcataaaaccagct

SEQ ID NO: 824885 - DNA, 22 bp, Artificial Sequence
  chemically synthesized
tattatttttatttcataaaac

SEQ ID NO: 824886 - DNA, 22 bp, Artificial Sequence
  chemically synthesized
ctctaagctggttttatgaaat

SEQ ID NO: 824887 - DNA, 22 bp, Artificial Sequence
  chemically synthesized
tgtattatttttatttcataaa

SEQ ID NO: 824888 - DNA, 22 bp, Artificial Sequence
  chemically synthesized
tctaagctggttttatgaaata

SEQ ID NO: 824889 - DNA, 22 bp, Artificial Sequence
  chemically synthesized
ctgtattatttttatttcataa

SEQ ID NO: 824890 - DNA, 22 bp, Artificial Sequence
  chemically synthesized
tctgtattatttttatttcata

SEQ ID NO: 824891 - DNA, 22 bp, Artificial Sequence
  chemically synthesized
taagctggttttatgaaataaa

SEQ ID NO: 824892 - DNA, 22 bp, Artificial Sequence
  chemically synthesized
agctggttttatgaaataaaaa

SEQ ID NO: 824893 - DNA, 22 bp, Artificial Sequence
  chemically synthesized
ttttctgtattatttttatttc

SEQ ID NO: 824894 - DNA, 22 bp, Artificial Sequence
  chemically synthesized
gttttctgtattatttttattt

SEQ ID NO: 824895 - DNA, 22 bp, Artificial Sequence
  chemically synthesized
cttgttttctgtattattttta

SEQ ID NO: 824896 - DNA, 22 bp, Artificial Sequence
  chemically synthesized
gttttatgaaataaaaataata

SEQ ID NO: 824897 - DNA, 22 bp, Artificial Sequence
  chemically synthesized
ttacttgttttctgtattattt

SEQ ID NO: 824898 - DNA, 22 bp, Artificial Sequence
  chemically synthesized
attacttgttttctgtattatt

SEQ ID NO: 824899 - DNA, 22 bp, Artificial Sequence
  chemically synthesized
tatgaaataaaaataatacaga

SEQ ID NO: 824900 - DNA, 22 bp, Artificial Sequence
  chemically synthesized
tattacttgttttctgtattat

SEQ ID NO: 824901 - DNA, 22 bp, Artificial Sequence
  chemically synthesized
atgaaataaaaataatacagaa

SEQ ID NO: 824902 - DNA, 22 bp, Artificial Sequence
  chemically synthesized
tgaaataaaaataatacagaaa

SEQ ID NO: 824903 - DNA, 22 bp, Artificial Sequence
  chemically synthesized
agggataaagtagatggcagtt

SEQ ID NO: 824904 - DNA, 22 bp, Artificial Sequence
  chemically synthesized
aagggataaagtagatggcagt

SEQ ID NO: 824905 - DNA, 22 bp, Artificial Sequence
  chemically synthesized
atgcttaagggataaagtagat

SEQ ID NO: 824906 - DNA, 22 bp, Artificial Sequence
  chemically synthesized
catgcttaagggataaagtaga

SEQ ID NO: 824907 - DNA, 22 bp, Artificial Sequence
  chemically synthesized
tcaggtttcatgcttaagggat

SEQ ID NO: 824908 - DNA, 22 bp, Artificial Sequence
  chemically synthesized
ccatctactttatcccttaagc

SEQ ID NO: 824909 - DNA, 22 bp, Artificial Sequence
  chemically synthesized
ctttatcccttaagcatgaaac

SEQ ID NO: 824910 - DNA, 22 bp, Artificial Sequence
  chemically synthesized
gaatgtctatcaggtttcatgc

SEQ ID NO: 824911 - DNA, 22 bp, Artificial Sequence
  chemically synthesized
tatcccttaagcatgaaacctg

SEQ ID NO: 824912 - DNA, 22 bp, Artificial Sequence
  chemically synthesized
atcccttaagcatgaaacctga

SEQ ID NO: 824913 - DNA, 22 bp, Artificial Sequence
  chemically synthesized
tcccttaagcatgaaacctgat

SEQ ID NO: 824914 - DNA, 22 bp, Artificial Sequence
  chemically synthesized
aagcatgaaacctgatagacat

SEQ ID NO: 824915 - DNA, 22 bp, Artificial Sequence
  chemically synthesized
agcatgaaacctgatagacatt

SEQ ID NO: 824916 - DNA, 22 bp, Artificial Sequence
  chemically synthesized
ggaaagaatctagaatgtctat

SEQ ID NO: 824917 - DNA, 22 bp, Artificial Sequence
  chemically synthesized
aggaaagaatctagaatgtcta

SEQ ID NO: 824918 - DNA, 22 bp, Artificial Sequence
  chemically synthesized
ggtgacgcttaggaaagaatct

SEQ ID NO: 824919 - DNA, 22 bp, Artificial Sequence
  chemically synthesized
atagacattctagattctttcc

SEQ ID NO: 824920 - DNA, 22 bp, Artificial Sequence
  chemically synthesized
tagattctttcctaagcgtcac

SEQ ID NO: 824921 - DNA, 22 bp, Artificial Sequence
  chemically synthesized
tatgaggtgttgggtgacgctt

SEQ ID NO: 824922 - DNA, 22 bp, Artificial Sequence
  chemically synthesized
gattctttcctaagcgtcaccc

SEQ ID NO: 824923 - DNA, 22 bp, Artificial Sequence
  chemically synthesized
attatatgaggtgttgggtgac

SEQ ID NO: 824924 - DNA, 22 bp, Artificial Sequence
  chemically synthesized
tttcctaagcgtcacccaacac

SEQ ID NO: 824925 - DNA, 22 bp, Artificial Sequence
  chemically synthesized
tcctaagcgtcacccaacacct

SEQ ID NO: 824926 - DNA, 22 bp, Artificial Sequence
  chemically synthesized
cctaagcgtcacccaacacctc

SEQ ID NO: 824927 - DNA, 22 bp, Artificial Sequence
  chemically synthesized
ctaagcgtcacccaacacctca

SEQ ID NO: 824928 - DNA, 22 bp, Artificial Sequence
  chemically synthesized
taactaattatatgaggtgttg

SEQ ID NO: 824929 - DNA, 22 bp, Artificial Sequence
  chemically synthesized
gtaactaattatatgaggtgtt

SEQ ID NO: 824930 - DNA, 22 bp, Artificial Sequence
  chemically synthesized
agcgtcacccaacacctcatat

SEQ ID NO: 824931 - DNA, 22 bp, Artificial Sequence
  chemically synthesized
tatatgagagaaatttgtaact

SEQ ID NO: 824932 - DNA, 22 bp, Artificial Sequence
  chemically synthesized
atataattagttacaaatttct

SEQ ID NO: 824933 - DNA, 22 bp, Artificial Sequence
  chemically synthesized
gttacaaatttctctcatatat

SEQ ID NO: 824934 - DNA, 22 bp, Artificial Sequence
  chemically synthesized
caaatttctctcatatataact

SEQ ID NO: 824935 - DNA, 22 bp, Artificial Sequence
  chemically synthesized
ctctcatatataacttctttcc

SEQ ID NO: 824936 - DNA, 22 bp, Artificial Sequence
  chemically synthesized
tctcatatataacttctttcct

SEQ ID NO: 824937 - DNA, 22 bp, Artificial Sequence
  chemically synthesized
tcatatataacttctttcctct

SEQ ID NO: 824938 - DNA, 22 bp, Artificial Sequence
  chemically synthesized
atatataacttctttcctcttt

SEQ ID NO: 824939 - DNA, 22 bp, Artificial Sequence
  chemically synthesized
cagtgccaatagaaagaggaaa

SEQ ID NO: 824940 - DNA, 22 bp, Artificial Sequence
  chemically synthesized
gcagtgccaatagaaagaggaa

SEQ ID NO: 824941 - DNA, 22 bp, Artificial Sequence
  chemically synthesized
ctttcctctttctattggcact

SEQ ID NO: 824942 - DNA, 22 bp, Artificial Sequence
  chemically synthesized
tttcctctttctattggcactg

SEQ ID NO: 824943 - DNA, 22 bp, Artificial Sequence
  chemically synthesized
tcctctttctattggcactgca

SEQ ID NO: 824944 - DNA, 22 bp, Artificial Sequence
  chemically synthesized
cctctttctattggcactgcaa

SEQ ID NO: 824945 - DNA, 22 bp, Artificial Sequence
  chemically synthesized
ctctttctattggcactgcaaa

SEQ ID NO: 824946 - DNA, 22 bp, Artificial Sequence
  chemically synthesized
tttctattggcactgcaaacct

SEQ ID NO: 824947 - DNA, 22 bp, Artificial Sequence
  chemically synthesized
tctattggcactgcaaacctct

SEQ ID NO: 824948 - DNA, 22 bp, Artificial Sequence
  chemically synthesized
ctattggcactgcaaacctcta

SEQ ID NO: 824949 - DNA, 22 bp, Artificial Sequence
  chemically synthesized
tattggcactgcaaacctctat

SEQ ID NO: 824950 - DNA, 22 bp, Artificial Sequence
  chemically synthesized
ttggcactgcaaacctctatca

SEQ ID NO: 824951 - DNA, 22 bp, Artificial Sequence
  chemically synthesized
gcactgcaaacctctatcattt

SEQ ID NO: 824952 - DNA, 22 bp, Artificial Sequence
  chemically synthesized
tggatgtgagggcaaaaaatga

SEQ ID NO: 824953 - DNA, 22 bp, Artificial Sequence
  chemically synthesized
atggatgtgagggcaaaaaatg

SEQ ID NO: 824954 - DNA, 22 bp, Artificial Sequence
  chemically synthesized
caaacctctatcattttttgcc

SEQ ID NO: 824955 - DNA, 22 bp, Artificial Sequence
  chemically synthesized
ttatggatgtgagggcaaaaaa

SEQ ID NO: 824956 - DNA, 22 bp, Artificial Sequence
  chemically synthesized
tatcattttttgccctcacatc

SEQ ID NO: 824957 - DNA, 22 bp, Artificial Sequence
  chemically synthesized
tcattttttgccctcacatcca

SEQ ID NO: 824958 - DNA, 22 bp, Artificial Sequence
  chemically synthesized
tttgccctcacatccataagag

SEQ ID NO: 824959 - DNA, 22 bp, Artificial Sequence
  chemically synthesized
ttgccctcacatccataagagg

SEQ ID NO: 824960 - DNA, 22 bp, Artificial Sequence
  chemically synthesized
tgccctcacatccataagaggc

SEQ ID NO: 824961 - DNA, 22 bp, Artificial Sequence
  chemically synthesized
gccctcacatccataagaggct

SEQ ID NO: 824962 - DNA, 22 bp, Artificial Sequence
  chemically synthesized
ccctcacatccataagaggctc

SEQ ID NO: 824963 - DNA, 22 bp, Artificial Sequence
  chemically synthesized
ggaggatgatatagagcctctt

SEQ ID NO: 824964 - DNA, 22 bp, Artificial Sequence
  chemically synthesized
acatccataagaggctctatat

SEQ ID NO: 824965 - DNA, 22 bp, Artificial Sequence
  chemically synthesized
ggtctgggaggatgatatagag

SEQ ID NO: 824966 - DNA, 22 bp, Artificial Sequence
  chemically synthesized
gggtctgggaggatgatataga

SEQ ID NO: 824967 - DNA, 22 bp, Artificial Sequence
  chemically synthesized
aaacagagatttgggtctggga

SEQ ID NO: 824968 - DNA, 22 bp, Artificial Sequence
  chemically synthesized
tatatcatcctcccagacccaa

SEQ ID NO: 824969 - DNA, 22 bp, Artificial Sequence
  chemically synthesized
taaaacagagatttgggtctgg

SEQ ID NO: 824970 - DNA, 22 bp, Artificial Sequence
  chemically synthesized
tatcatcctcccagacccaaat

SEQ ID NO: 824971 - DNA, 22 bp, Artificial Sequence
  chemically synthesized
cattctaaaacagagatttggg

SEQ ID NO: 824972 - DNA, 22 bp, Artificial Sequence
  chemically synthesized
acattctaaaacagagatttgg

SEQ ID NO: 824973 - DNA, 22 bp, Artificial Sequence
  chemically synthesized
ccagacccaaatctctgtttta

SEQ ID NO: 824974 - DNA, 22 bp, Artificial Sequence
  chemically synthesized
gggtagaatttacattctaaaa

SEQ ID NO: 824975 - DNA, 22 bp, Artificial Sequence
  chemically synthesized
attggggtagaatttacattct

SEQ ID NO: 824976 - DNA, 22 bp, Artificial Sequence
  chemically synthesized
aattggggtagaatttacattc

SEQ ID NO: 824977 - DNA, 22 bp, Artificial Sequence
  chemically synthesized
taattggggtagaatttacatt

SEQ ID NO: 824978 - DNA, 22 bp, Artificial Sequence
  chemically synthesized
tgttttagaatgtaaattctac

SEQ ID NO: 824979 - DNA, 22 bp, Artificial Sequence
  chemically synthesized
atctttaattggggtagaattt

SEQ ID NO: 824980 - DNA, 22 bp, Artificial Sequence
  chemically synthesized
ttttagaatgtaaattctaccc

SEQ ID NO: 824981 - DNA, 22 bp, Artificial Sequence
  chemically synthesized
aatctttaattggggtagaatt

SEQ ID NO: 824982 - DNA, 22 bp, Artificial Sequence
  chemically synthesized
taatctttaattggggtagaat

SEQ ID NO: 824983 - DNA, 22 bp, Artificial Sequence
  chemically synthesized
tagaatgtaaattctaccccaa

SEQ ID NO: 824984 - DNA, 22 bp, Artificial Sequence
  chemically synthesized
agaatgtaaattctaccccaat

SEQ ID NO: 824985 - DNA, 22 bp, Artificial Sequence
  chemically synthesized
gaatgtaaattctaccccaatt

SEQ ID NO: 824986 - DNA, 22 bp, Artificial Sequence
  chemically synthesized
gttttaatctttaattggggta

SEQ ID NO: 824987 - DNA, 22 bp, Artificial Sequence
  chemically synthesized
tgttagttttaatctttaattg

SEQ ID NO: 824988 - DNA, 22 bp, Artificial Sequence
  chemically synthesized
atgttagttttaatctttaatt

SEQ ID NO: 824989 - DNA, 22 bp, Artificial Sequence
  chemically synthesized
taccccaattaaagattaaaac

SEQ ID NO: 824990 - DNA, 22 bp, Artificial Sequence
  chemically synthesized
ccccaattaaagattaaaacta

SEQ ID NO: 824991 - DNA, 22 bp, Artificial Sequence
  chemically synthesized
aagattaaaactaacataaatc

SEQ ID NO: 824992 - DNA, 22 bp, Artificial Sequence
  chemically synthesized
aaactaacataaatctgatcac

SEQ ID NO: 824993 - DNA, 22 bp, Artificial Sequence
  chemically synthesized
taagagggagtgcagtgatcag

SEQ ID NO: 824994 - DNA, 22 bp, Artificial Sequence
  chemically synthesized
ataagagggagtgcagtgatca

SEQ ID NO: 824995 - DNA, 22 bp, Artificial Sequence
  chemically synthesized
tataagagggagtgcagtgatc

SEQ ID NO: 824996 - DNA, 22 bp, Artificial Sequence
  chemically synthesized
acataaatctgatcactgcact

SEQ ID NO: 824997 - DNA, 22 bp, Artificial Sequence
  chemically synthesized
aagggttttataagagggagtg

SEQ ID NO: 824998 - DNA, 22 bp, Artificial Sequence
  chemically synthesized
atcactgcactccctcttataa

SEQ ID NO: 824999 - DNA, 22 bp, Artificial Sequence
  chemically synthesized
cactccctcttataaaaccctt

SEQ ID NO: 825000 - DNA, 22 bp, Artificial Sequence
  chemically synthesized
cctcttataaaacccttcaatg

SEQ ID NO: 825001 - DNA, 22 bp, Artificial Sequence
  chemically synthesized
ttataaaacccttcaatgtttc

SEQ ID NO: 825002 - DNA, 22 bp, Artificial Sequence
  chemically synthesized
ataaaacccttcaatgtttccc

SEQ ID NO: 825003 - DNA, 22 bp, Artificial Sequence
  chemically synthesized
cagaagacagtagggaaacatt

SEQ ID NO: 825004 - DNA, 22 bp, Artificial Sequence
  chemically synthesized
taaaacccttcaatgtttccct

SEQ ID NO: 825005 - DNA, 22 bp, Artificial Sequence
  chemically synthesized
agatattccagaagacagtagg

SEQ ID NO: 825006 - DNA, 22 bp, Artificial Sequence
  chemically synthesized
caatgtttccctactgtcttct

SEQ ID NO: 825007 - DNA, 22 bp, Artificial Sequence
  chemically synthesized
aatgtttccctactgtcttctg

SEQ ID NO: 825008 - DNA, 22 bp, Artificial Sequence
  chemically synthesized
ccctactgtcttctggaatatc

SEQ ID NO: 825009 - DNA, 22 bp, Artificial Sequence
  chemically synthesized
cctactgtcttctggaatatct

SEQ ID NO: 825010 - DNA, 22 bp, Artificial Sequence
  chemically synthesized
ctgtcttctggaatatcttagc

SEQ ID NO: 825011 - DNA, 22 bp, Artificial Sequence
  chemically synthesized
tcttctggaatatcttagctgg

SEQ ID NO: 825012 - DNA, 22 bp, Artificial Sequence
  chemically synthesized
ctggaatatcttagctggacat

SEQ ID NO: 825013 - DNA, 22 bp, Artificial Sequence
  chemically synthesized
tggaatatcttagctggacata

SEQ ID NO: 825014 - DNA, 22 bp, Artificial Sequence
  chemically synthesized
gaatatcttagctggacatacg

SEQ ID NO: 825015 - DNA, 22 bp, Artificial Sequence
  chemically synthesized
ggcaagatcatagaagaacacg

SEQ ID NO: 825016 - DNA, 22 bp, Artificial Sequence
  chemically synthesized
agctggacatacgtgttcttct

SEQ ID NO: 825017 - DNA, 22 bp, Artificial Sequence
  chemically synthesized
gctggacatacgtgttcttcta

SEQ ID NO: 825018 - DNA, 22 bp, Artificial Sequence
  chemically synthesized
tctaggcaagatcatagaagaa

SEQ ID NO: 825019 - DNA, 22 bp, Artificial Sequence
  chemically synthesized
gacatacgtgttcttctatgat

SEQ ID NO: 825020 - DNA, 22 bp, Artificial Sequence
  chemically synthesized
agattatctaggcaagatcata

SEQ ID NO: 825021 - DNA, 22 bp, Artificial Sequence
  chemically synthesized
tcagattatctaggcaagatca

SEQ ID NO: 825022 - DNA, 22 bp, Artificial Sequence
  chemically synthesized
ttctatgatcttgcctagataa

SEQ ID NO: 825023 - DNA, 22 bp, Artificial Sequence
  chemically synthesized
ctatgatcttgcctagataatc

SEQ ID NO: 825024 - DNA, 22 bp, Artificial Sequence
  chemically synthesized
tatgatcttgcctagataatct

SEQ ID NO: 825025 - DNA, 22 bp, Artificial Sequence
  chemically synthesized
tgatcttgcctagataatctga

SEQ ID NO: 825026 - DNA, 22 bp, Artificial Sequence
  chemically synthesized
tagataaacctctcagattatc

SEQ ID NO: 825027 - DNA, 22 bp, Artificial Sequence
  chemically synthesized
gtagataaacctctcagattat

SEQ ID NO: 825028 - DNA, 22 bp, Artificial Sequence
  chemically synthesized
tgtagataaacctctcagatta

SEQ ID NO: 825029 - DNA, 22 bp, Artificial Sequence
  chemically synthesized
ctttgtagataaacctctcaga

SEQ ID NO: 825030 - DNA, 22 bp, Artificial Sequence
  chemically synthesized
gcctagataatctgagaggttt

SEQ ID NO: 825031 - DNA, 22 bp, Artificial Sequence
  chemically synthesized
cctagataatctgagaggttta

SEQ ID NO: 825032 - DNA, 22 bp, Artificial Sequence
  chemically synthesized
ttgctttgtagataaacctctc

SEQ ID NO: 825033 - DNA, 22 bp, Artificial Sequence
  chemically synthesized
gttgctttgtagataaacctct

SEQ ID NO: 825034 - DNA, 22 bp, Artificial Sequence
  chemically synthesized
gataatctgagaggtttatcta

SEQ ID NO: 825035 - DNA, 22 bp, Artificial Sequence
  chemically synthesized
tgatttgttgctttgtagataa

SEQ ID NO: 825036 - DNA, 22 bp, Artificial Sequence
  chemically synthesized
gtgatttgttgctttgtagata

SEQ ID NO: 825037 - DNA, 22 bp, Artificial Sequence
  chemically synthesized
tcttgtgatttgttgctttgta

SEQ ID NO: 825038 - DNA, 22 bp, Artificial Sequence
  chemically synthesized
agaggtttatctacaaagcaac

SEQ ID NO: 825039 - DNA, 22 bp, Artificial Sequence
  chemically synthesized
atcttgtgatttgttgctttgt

SEQ ID NO: 825040 - DNA, 22 bp, Artificial Sequence
  chemically synthesized
cttatcttgtgatttgttgctt

SEQ ID NO: 825041 - DNA, 22 bp, Artificial Sequence
  chemically synthesized
atctacaaagcaacaaatcaca

SEQ ID NO: 825042 - DNA, 22 bp, Artificial Sequence
  chemically synthesized
tctacaaagcaacaaatcacaa

SEQ ID NO: 825043 - DNA, 22 bp, Artificial Sequence
  chemically synthesized
taccctgcttatcttgtgattt

SEQ ID NO: 825044 - DNA, 22 bp, Artificial Sequence
  chemically synthesized
ataccctgcttatcttgtgatt

SEQ ID NO: 825045 - DNA, 22 bp, Artificial Sequence
  chemically synthesized
caaagcaacaaatcacaagata

SEQ ID NO: 825046 - DNA, 22 bp, Artificial Sequence
  chemically synthesized
ttataccctgcttatcttgtga

SEQ ID NO: 825047 - DNA, 22 bp, Artificial Sequence
  chemically synthesized
cttataccctgcttatcttgtg

SEQ ID NO: 825048 - DNA, 22 bp, Artificial Sequence
  chemically synthesized
tgatggtttcttataccctgct

SEQ ID NO: 825049 - DNA, 22 bp, Artificial Sequence
  chemically synthesized
tctgtgatggtttcttataccc

SEQ ID NO: 825050 - DNA, 22 bp, Artificial Sequence
  chemically synthesized
tattatctgtgatggtttctta

SEQ ID NO: 825051 - DNA, 22 bp, Artificial Sequence
  chemically synthesized
gtattatctgtgatggtttctt

SEQ ID NO: 825052 - DNA, 22 bp, Artificial Sequence
  chemically synthesized
ttgtattatctgtgatggtttc

SEQ ID NO: 825053 - DNA, 22 bp, Artificial Sequence
  chemically synthesized
caaggttcttgtattatctgtg

SEQ ID NO: 825054 - DNA, 22 bp, Artificial Sequence
  chemically synthesized
ttgcaaggttcttgtattatct

SEQ ID NO: 825055 - DNA, 22 bp, Artificial Sequence
  chemically synthesized
ctgttgcaaggttcttgtatta

SEQ ID NO: 825056 - DNA, 22 bp, Artificial Sequence
  chemically synthesized
tactgttgcaaggttcttgtat

SEQ ID NO: 825057 - DNA, 22 bp, Artificial Sequence
  chemically synthesized
gatgtagtaacagctctactgt

SEQ ID NO: 825058 - DNA, 22 bp, Artificial Sequence
  chemically synthesized
ggcctagatgtagtaacagctc

SEQ ID NO: 825059 - DNA, 22 bp, Artificial Sequence
  chemically synthesized
gggcctagatgtagtaacagct

SEQ ID NO: 825060 - DNA, 22 bp, Artificial Sequence
  chemically synthesized
gcaacagtagagctgttactac

SEQ ID NO: 825061 - DNA, 22 bp, Artificial Sequence
  chemically synthesized
caacagtagagctgttactaca

SEQ ID NO: 825062 - DNA, 22 bp, Artificial Sequence
  chemically synthesized
atcccttgggcctagatgtagt

SEQ ID NO: 825063 - DNA, 22 bp, Artificial Sequence
  chemically synthesized
ccctcatcccttgggcctagat

SEQ ID NO: 825064 - DNA, 22 bp, Artificial Sequence
  chemically synthesized
cctcccctcatcccttgggcct

SEQ ID NO: 825065 - DNA, 22 bp, Artificial Sequence
  chemically synthesized
ttactacatctaggcccaaggg

SEQ ID NO: 825066 - DNA, 22 bp, Artificial Sequence
  chemically synthesized
ccctcccctcatcccttgggcc

SEQ ID NO: 825067 - DNA, 22 bp, Artificial Sequence
  chemically synthesized
tccctcccctcatcccttgggc

SEQ ID NO: 825068 - DNA, 22 bp, Artificial Sequence
  chemically synthesized
ttccctcccctcatcccttggg

SEQ ID NO: 825069 - DNA, 22 bp, Artificial Sequence
  chemically synthesized
ctacatctaggcccaagggatg

SEQ ID NO: 825070 - DNA, 22 bp, Artificial Sequence
  chemically synthesized
catctaggcccaagggatgagg

SEQ ID NO: 825071 - DNA, 22 bp, Artificial Sequence
  chemically synthesized
gccacttttccctcccctcatc

SEQ ID NO: 825072 - DNA, 22 bp, Artificial Sequence
  chemically synthesized
ggccacttttccctcccctcat

SEQ ID NO: 825073 - DNA, 22 bp, Artificial Sequence
  chemically synthesized
tggccacttttccctcccctca

SEQ ID NO: 825074 - DNA, 22 bp, Artificial Sequence
  chemically synthesized
ggcccaagggatgaggggaggg

SEQ ID NO: 825075 - DNA, 22 bp, Artificial Sequence
  chemically synthesized
ttggccacttttccctcccctc

SEQ ID NO: 825076 - DNA, 22 bp, Artificial Sequence
  chemically synthesized
cttttggccacttttccctccc

SEQ ID NO: 825077 - DNA, 22 bp, Artificial Sequence
  chemically synthesized
tgcttttggccacttttccctc

SEQ ID NO: 825078 - DNA, 22 bp, Artificial Sequence
  chemically synthesized
tctgcttttggccacttttccc

SEQ ID NO: 825079 - DNA, 22 bp, Artificial Sequence
  chemically synthesized
caattctctgcttttggccact

SEQ ID NO: 825080 - DNA, 22 bp, Artificial Sequence
  chemically synthesized
attccaattctctgcttttggc

SEQ ID NO: 825081 - DNA, 22 bp, Artificial Sequence
  chemically synthesized
tcattccaattctctgcttttg

SEQ ID NO: 825082 - DNA, 22 bp, Artificial Sequence
  chemically synthesized
ctcattccaattctctgctttt

SEQ ID NO: 825083 - DNA, 22 bp, Artificial Sequence
  chemically synthesized
agggtggtttctcattccaatt

SEQ ID NO: 825084 - DNA, 22 bp, Artificial Sequence
  chemically synthesized
tcagggtggtttctcattccaa

SEQ ID NO: 825085 - DNA, 22 bp, Artificial Sequence
  chemically synthesized
ctcagggtggtttctcattcca

SEQ ID NO: 825086 - DNA, 22 bp, Artificial Sequence
  chemically synthesized
ttctcagggtggtttctcattc

SEQ ID NO: 825087 - DNA, 22 bp, Artificial Sequence
  chemically synthesized
ctcttctcagggtggtttctca

SEQ ID NO: 825088 - DNA, 22 bp, Artificial Sequence
  chemically synthesized
ttgctcttctcagggtggtttc

SEQ ID NO: 825089 - DNA, 22 bp, Artificial Sequence
  chemically synthesized
gaatgagaaaccaccctgagaa

SEQ ID NO: 825090 - DNA, 22 bp, Artificial Sequence
  chemically synthesized
acaaaaggttattgctcttctc

SEQ ID NO: 825091 - DNA, 22 bp, Artificial Sequence
  chemically synthesized
gacaaaaggttattgctcttct

SEQ ID NO: 825092 - DNA, 22 bp, Artificial Sequence
  chemically synthesized
tgacaaaaggttattgctcttc

SEQ ID NO: 825093 - DNA, 22 bp, Artificial Sequence
  chemically synthesized
tgtcctttgacaaaaggttatt

SEQ ID NO: 825094 - DNA, 22 bp, Artificial Sequence
  chemically synthesized
agaagagcaataaccttttgtc

SEQ ID NO: 825095 - DNA, 22 bp, Artificial Sequence
  chemically synthesized
actatgtcctttgacaaaaggt

SEQ ID NO: 825096 - DNA, 22 bp, Artificial Sequence
  chemically synthesized
ccacaggctgactatgtccttt

SEQ ID NO: 825097 - DNA, 22 bp, Artificial Sequence
  chemically synthesized
aggttgccacaggctgactatg

SEQ ID NO: 825098 - DNA, 22 bp, Artificial Sequence
  chemically synthesized
ttgtcaaaggacatagtcagcc

SEQ ID NO: 825099 - DNA, 22 bp, Artificial Sequence
  chemically synthesized
gaggttgccacaggctgactat

SEQ ID NO: 825100 - DNA, 22 bp, Artificial Sequence
  chemically synthesized
tgtcaaaggacatagtcagcct

SEQ ID NO: 825101 - DNA, 22 bp, Artificial Sequence
  chemically synthesized
tgaggttgccacaggctgacta

SEQ ID NO: 825102 - DNA, 22 bp, Artificial Sequence
  chemically synthesized
gtcaaaggacatagtcagcctg

SEQ ID NO: 825103 - DNA, 22 bp, Artificial Sequence
  chemically synthesized
tcaaaggacatagtcagcctgt

SEQ ID NO: 825104 - DNA, 22 bp, Artificial Sequence
  chemically synthesized
cctttgaggttgccacaggctg

SEQ ID NO: 825105 - DNA, 22 bp, Artificial Sequence
  chemically synthesized
cctccctttgaggttgccacag

SEQ ID NO: 825106 - DNA, 22 bp, Artificial Sequence
  chemically synthesized
attccctccctttgaggttgcc

SEQ ID NO: 825107 - DNA, 22 bp, Artificial Sequence
  chemically synthesized
ctaattccctccctttgaggtt

SEQ ID NO: 825108 - DNA, 22 bp, Artificial Sequence
  chemically synthesized
tcctaattccctccctttgagg

SEQ ID NO: 825109 - DNA, 22 bp, Artificial Sequence
  chemically synthesized
ttctcctaattccctccctttg

SEQ ID NO: 825110 - DNA, 22 bp, Artificial Sequence
  chemically synthesized
attctcctaattccctcccttt

SEQ ID NO: 825111 - DNA, 22 bp, Artificial Sequence
  chemically synthesized
tggcaacctcaaagggagggaa

SEQ ID NO: 825112 - DNA, 22 bp, Artificial Sequence
  chemically synthesized
aaagggagggaattaggagaat

SEQ ID NO: 825113 - DNA, 22 bp, Artificial Sequence
  chemically synthesized
ggagaataaatatcttgacctc

SEQ ID NO: 825114 - DNA, 22 bp, Artificial Sequence
  chemically synthesized
aagacaggaggtaaagtgaggt

SEQ ID NO: 825115 - DNA, 22 bp, Artificial Sequence
  chemically synthesized
gacctcactttacctcctgtct

SEQ ID NO: 825116 - DNA, 22 bp, Artificial Sequence
  chemically synthesized
gaaggaaattgaagacaggagg

SEQ ID NO: 825117 - DNA, 22 bp, Artificial Sequence
  chemically synthesized
acctcactttacctcctgtctt

SEQ ID NO: 825118 - DNA, 22 bp, Artificial Sequence
  chemically synthesized
actttacctcctgtcttcaatt

SEQ ID NO: 825119 - DNA, 22 bp, Artificial Sequence
  chemically synthesized
tacctcctgtcttcaatttcct

SEQ ID NO: 825120 - DNA, 22 bp, Artificial Sequence
  chemically synthesized
acctcctgtcttcaatttcctt

SEQ ID NO: 825121 - DNA, 22 bp, Artificial Sequence
  chemically synthesized
cctcctgtcttcaatttccttc

SEQ ID NO: 825122 - DNA, 22 bp, Artificial Sequence
  chemically synthesized
ctgtcttcaatttccttctagg

SEQ ID NO: 825123 - DNA, 22 bp, Artificial Sequence
  chemically synthesized
ggcacccaagagccctagaagg

SEQ ID NO: 825124 - DNA, 22 bp, Artificial Sequence
  chemically synthesized
aggcacccaagagccctagaag

SEQ ID NO: 825125 - DNA, 22 bp, Artificial Sequence
  chemically synthesized
tcttcaatttccttctagggct

SEQ ID NO: 825126 - DNA, 22 bp, Artificial Sequence
  chemically synthesized
gtttaggcacccaagagcccta

SEQ ID NO: 825127 - DNA, 22 bp, Artificial Sequence
  chemically synthesized
caatttccttctagggctcttg

SEQ ID NO: 825128 - DNA, 22 bp, Artificial Sequence
  chemically synthesized
aatttccttctagggctcttgg

SEQ ID NO: 825129 - DNA, 22 bp, Artificial Sequence
  chemically synthesized
cagttggtttaggcacccaaga

SEQ ID NO: 825130 - DNA, 22 bp, Artificial Sequence
  chemically synthesized
ccttctagggctcttgggtgcc

SEQ ID NO: 825131 - DNA, 22 bp, Artificial Sequence
  chemically synthesized
ccagttggtttaggcacccaag

SEQ ID NO: 825132 - DNA, 22 bp, Artificial Sequence
  chemically synthesized
cttctagggctcttgggtgcct

SEQ ID NO: 825133 - DNA, 22 bp, Artificial Sequence
  chemically synthesized
ctagggctcttgggtgcctaaa

SEQ ID NO: 825134 - DNA, 22 bp, Artificial Sequence
  chemically synthesized
gcttccagttggtttaggcacc

SEQ ID NO: 825135 - DNA, 22 bp, Artificial Sequence
  chemically synthesized
tagggctcttgggtgcctaaac

SEQ ID NO: 825136 - DNA, 22 bp, Artificial Sequence
  chemically synthesized
ggcttccagttggtttaggcac

SEQ ID NO: 825137 - DNA, 22 bp, Artificial Sequence
  chemically synthesized
tggcttccagttggtttaggca

SEQ ID NO: 825138 - DNA, 22 bp, Artificial Sequence
  chemically synthesized
gggctcttgggtgcctaaacca

SEQ ID NO: 825139 - DNA, 22 bp, Artificial Sequence
  chemically synthesized
ttgggtgcctaaaccaactgga

SEQ ID NO: 825140 - DNA, 22 bp, Artificial Sequence
  chemically synthesized
gggtgcctaaaccaactggaag

SEQ ID NO: 825141 - DNA, 22 bp, Artificial Sequence
  chemically synthesized
ggtgcctaaaccaactggaagc

SEQ ID NO: 825142 - DNA, 22 bp, Artificial Sequence
  chemically synthesized
ccatgccctttggcttccagtt

SEQ ID NO: 825143 - DNA, 22 bp, Artificial Sequence
  chemically synthesized
ggctcccatgccctttggcttc

SEQ ID NO: 825144 - DNA, 22 bp, Artificial Sequence
  chemically synthesized
aaccaactggaagccaaagggc

SEQ ID NO: 825145 - DNA, 22 bp, Artificial Sequence
  chemically synthesized
tcatcattgggctcccatgccc

SEQ ID NO: 825146 - DNA, 22 bp, Artificial Sequence
  chemically synthesized
tgtcatcattgggctcccatgc

SEQ ID NO: 825147 - DNA, 22 bp, Artificial Sequence
  chemically synthesized
gaagccaaagggcatgggagcc

SEQ ID NO: 825148 - DNA, 22 bp, Artificial Sequence
  chemically synthesized
acctctgtcatcattgggctcc

SEQ ID NO: 825149 - DNA, 22 bp, Artificial Sequence
  chemically synthesized
ggaggctgacctctgtcatcat

SEQ ID NO: 825150 - DNA, 22 bp, Artificial Sequence
  chemically synthesized
tgggaggctgacctctgtcatc

SEQ ID NO: 825151 - DNA, 22 bp, Artificial Sequence
  chemically synthesized
ttctgggaggctgacctctgtc

SEQ ID NO: 825152 - DNA, 22 bp, Artificial Sequence
  chemically synthesized
attctgggaggctgacctctgt

SEQ ID NO: 825153 - DNA, 22 bp, Artificial Sequence
  chemically synthesized
tattctgggaggctgacctctg

SEQ ID NO: 825154 - DNA, 22 bp, Artificial Sequence
  chemically synthesized
tttattctgggaggctgacctc

SEQ ID NO: 825155 - DNA, 22 bp, Artificial Sequence
  chemically synthesized
ctctttattctgggaggctgac

SEQ ID NO: 825156 - DNA, 22 bp, Artificial Sequence
  chemically synthesized
gctctttattctgggaggctga

SEQ ID NO: 825157 - DNA, 22 bp, Artificial Sequence
  chemically synthesized
ccttgctctttattctgggagg

SEQ ID NO: 825158 - DNA, 22 bp, Artificial Sequence
  chemically synthesized
tcccttgctctttattctggga

SEQ ID NO: 825159 - DNA, 22 bp, Artificial Sequence
  chemically synthesized
tctcccttgctctttattctgg

SEQ ID NO: 825160 - DNA, 22 bp, Artificial Sequence
  chemically synthesized
ctctcccttgctctttattctg

SEQ ID NO: 825161 - DNA, 22 bp, Artificial Sequence
  chemically synthesized
accttctctcccttgctcttta

SEQ ID NO: 825162 - DNA, 22 bp, Artificial Sequence
  chemically synthesized
gaccttctctcccttgctcttt

SEQ ID NO: 825163 - DNA, 22 bp, Artificial Sequence
  chemically synthesized
tgaccttctctcccttgctctt

SEQ ID NO: 825164 - DNA, 22 bp, Artificial Sequence
  chemically synthesized
tttgaccttctctcccttgctc

SEQ ID NO: 825165 - DNA, 22 bp, Artificial Sequence
  chemically synthesized
ccagaataaagagcaagggaga

SEQ ID NO: 825166 - DNA, 22 bp, Artificial Sequence
  chemically synthesized
tagccattctttgaccttctct

SEQ ID NO: 825167 - DNA, 22 bp, Artificial Sequence
  chemically synthesized
tccatctgtagccattctttga

SEQ ID NO: 825168 - DNA, 22 bp, Artificial Sequence
  chemically synthesized
gtccatctgtagccattctttg

SEQ ID NO: 825169 - DNA, 22 bp, Artificial Sequence
  chemically synthesized
tttgtccatctgtagccattct

SEQ ID NO: 825170 - DNA, 22 bp, Artificial Sequence
  chemically synthesized
gtttgtccatctgtagccattc

SEQ ID NO: 825171 - DNA, 22 bp, Artificial Sequence
  chemically synthesized
tgtttgtccatctgtagccatt

SEQ ID NO: 825172 - DNA, 22 bp, Artificial Sequence
  chemically synthesized
tgccatatacattttgtttgtc

SEQ ID NO: 825173 - DNA, 22 bp, Artificial Sequence
  chemically synthesized
ctgtgccatatacattttgttt

SEQ ID NO: 825174 - DNA, 22 bp, Artificial Sequence
  chemically synthesized
cagatggacaaacaaaatgtat

SEQ ID NO: 825175 - DNA, 22 bp, Artificial Sequence
  chemically synthesized
tattcctgtgccatatacattt

SEQ ID NO: 825176 - DNA, 22 bp, Artificial Sequence
  chemically synthesized
atattcctgtgccatatacatt

SEQ ID NO: 825177 - DNA, 22 bp, Artificial Sequence
  chemically synthesized
tatattcctgtgccatatacat

SEQ ID NO: 825178 - DNA, 22 bp, Artificial Sequence
  chemically synthesized
cataacaaaataagaagcatag

SEQ ID NO: 825179 - DNA, 22 bp, Artificial Sequence
  chemically synthesized
acataacaaaataagaagcata

SEQ ID NO: 825180 - DNA, 22 bp, Artificial Sequence
  chemically synthesized
cttacataacaaaataagaagc

SEQ ID NO: 825181 - DNA, 22 bp, Artificial Sequence
  chemically synthesized
acttacataacaaaataagaag

SEQ ID NO: 825182 - DNA, 22 bp, Artificial Sequence
  chemically synthesized
tacttacataacaaaataagaa

SEQ ID NO: 825183 - DNA, 22 bp, Artificial Sequence
  chemically synthesized
tgcttcttattttgttatgtaa

SEQ ID NO: 825184 - DNA, 22 bp, Artificial Sequence
  chemically synthesized
aaaaggactttacttacataac

SEQ ID NO: 825185 - DNA, 22 bp, Artificial Sequence
  chemically synthesized
cttattttgttatgtaagtaaa

SEQ ID NO: 825186 - DNA, 22 bp, Artificial Sequence
  chemically synthesized
attaaaaaggactttacttaca

SEQ ID NO: 825187 - DNA, 22 bp, Artificial Sequence
  chemically synthesized
ttattttgttatgtaagtaaag

SEQ ID NO: 825188 - DNA, 22 bp, Artificial Sequence
  chemically synthesized
attttgttatgtaagtaaagtc

SEQ ID NO: 825189 - DNA, 22 bp, Artificial Sequence
  chemically synthesized
ttttgttatgtaagtaaagtcc

SEQ ID NO: 825190 - DNA, 22 bp, Artificial Sequence
  chemically synthesized
tgttatgtaagtaaagtccttt

SEQ ID NO: 825191 - DNA, 22 bp, Artificial Sequence
  chemically synthesized
gttatgtaagtaaagtcctttt

SEQ ID NO: 825192 - DNA, 22 bp, Artificial Sequence
  chemically synthesized
ttatgtaagtaaagtccttttt

SEQ ID NO: 825193 - DNA, 22 bp, Artificial Sequence
  chemically synthesized
tgtaagtaaagtcctttttaat

SEQ ID NO: 825194 - DNA, 22 bp, Artificial Sequence
  chemically synthesized
tggaggcaacagggttaattaa

SEQ ID NO: 825195 - DNA, 22 bp, Artificial Sequence
  chemically synthesized
gtggaggcaacagggttaatta

SEQ ID NO: 825196 - DNA, 22 bp, Artificial Sequence
  chemically synthesized
tgtggaggcaacagggttaatt

SEQ ID NO: 825197 - DNA, 22 bp, Artificial Sequence
  chemically synthesized
tttaattaaccctgttgcctcc

SEQ ID NO: 825198 - DNA, 22 bp, Artificial Sequence
  chemically synthesized
acataactttgtggaggcaaca

SEQ ID NO: 825199 - DNA, 22 bp, Artificial Sequence
  chemically synthesized
ttaattaaccctgttgcctcca

SEQ ID NO: 825200 - DNA, 22 bp, Artificial Sequence
  chemically synthesized
cacataactttgtggaggcaac

SEQ ID NO: 825201 - DNA, 22 bp, Artificial Sequence
  chemically synthesized
taattaaccctgttgcctccac

SEQ ID NO: 825202 - DNA, 22 bp, Artificial Sequence
  chemically synthesized
aattaaccctgttgcctccaca

SEQ ID NO: 825203 - DNA, 22 bp, Artificial Sequence
  chemically synthesized
attaaccctgttgcctccacaa

SEQ ID NO: 825204 - DNA, 22 bp, Artificial Sequence
  chemically synthesized
taacttcacataactttgtgga

SEQ ID NO: 825205 - DNA, 22 bp, Artificial Sequence
  chemically synthesized
accctgttgcctccacaaagtt

SEQ ID NO: 825206 - DNA, 22 bp, Artificial Sequence
  chemically synthesized
ataacttcacataactttgtgg

SEQ ID NO: 825207 - DNA, 22 bp, Artificial Sequence
  chemically synthesized
acttataacttcacataacttt

SEQ ID NO: 825208 - DNA, 22 bp, Artificial Sequence
  chemically synthesized
aacttataacttcacataactt

SEQ ID NO: 825209 - DNA, 22 bp, Artificial Sequence
  chemically synthesized
ttgcctccacaaagttatgtga

SEQ ID NO: 825210 - DNA, 22 bp, Artificial Sequence
  chemically synthesized
taacttataacttcacataact

SEQ ID NO: 825211 - DNA, 22 bp, Artificial Sequence
  chemically synthesized
tttaacttataacttcacataa

SEQ ID NO: 825212 - DNA, 22 bp, Artificial Sequence
  chemically synthesized
cctccacaaagttatgtgaagt

SEQ ID NO: 825213 - DNA, 22 bp, Artificial Sequence
  chemically synthesized
ctttaacttataacttcacata

SEQ ID NO: 825214 - DNA, 22 bp, Artificial Sequence
  chemically synthesized
cacaaagttatgtgaagttata

SEQ ID NO: 825215 - DNA, 22 bp, Artificial Sequence
  chemically synthesized
aagtatttctttaacttataac

SEQ ID NO: 825216 - DNA, 22 bp, Artificial Sequence
  chemically synthesized
tgtgaagttataagttaaagaa

SEQ ID NO: 825217 - DNA, 22 bp, Artificial Sequence
  chemically synthesized
gccatctcaagtatttctttaa

SEQ ID NO: 825218 - DNA, 22 bp, Artificial Sequence
  chemically synthesized
taagttaaagaaatacttgaga

SEQ ID NO: 825219 - DNA, 22 bp, Artificial Sequence
  chemically synthesized
aagaaatacttgagatggccag

SEQ ID NO: 825220 - DNA, 22 bp, Artificial Sequence
  chemically synthesized
caggcgtgagccaccgcacctg

SEQ ID NO: 825221 - DNA, 22 bp, Artificial Sequence
  chemically synthesized
gagatggccaggtgcggtggct

SEQ ID NO: 825222 - DNA, 22 bp, Artificial Sequence
  chemically synthesized
agatggccaggtgcggtggctc

SEQ ID NO: 825223 - DNA, 22 bp, Artificial Sequence
  chemically synthesized
ggattacaggcgtgagccaccg

SEQ ID NO: 825224 - DNA, 22 bp, Artificial Sequence
  chemically synthesized
ccagagacctgggattacaggc

SEQ ID NO: 825225 - DNA, 22 bp, Artificial Sequence
  chemically synthesized
gcctcccagagacctgggatta

SEQ ID NO: 825226 - DNA, 22 bp, Artificial Sequence
  chemically synthesized
ggcctcccagagacctgggatt

SEQ ID NO: 825227 - DNA, 22 bp, Artificial Sequence
  chemically synthesized
tggcctcccagagacctgggat

SEQ ID NO: 825228 - DNA, 22 bp, Artificial Sequence
  chemically synthesized
acgcctgtaatcccaggtctct

SEQ ID NO: 825229 - DNA, 22 bp, Artificial Sequence
  chemically synthesized
taatcccaggtctctgggaggc

SEQ ID NO: 825230 - DNA, 22 bp, Artificial Sequence
  chemically synthesized
atgatccacccgctttggcctc

SEQ ID NO: 825231 - DNA, 22 bp, Artificial Sequence
  chemically synthesized
acctcatgatccacccgctttg

SEQ ID NO: 825232 - DNA, 22 bp, Artificial Sequence
  chemically synthesized
ctgacctcatgatccacccgct

SEQ ID NO: 825233 - DNA, 22 bp, Artificial Sequence
  chemically synthesized
tgggaggccaaagcgggtggat

SEQ ID NO: 825234 - DNA, 22 bp, Artificial Sequence
  chemically synthesized
ggaggccaaagcgggtggatca

SEQ ID NO: 825235 - DNA, 22 bp, Artificial Sequence
  chemically synthesized
gaactcctgacctcatgatcca

SEQ ID NO: 825236 - DNA, 22 bp, Artificial Sequence
  chemically synthesized
gtctcgaactcctgacctcatg

SEQ ID NO: 825237 - DNA, 22 bp, Artificial Sequence
  chemically synthesized
agcatgtcggtcaggctggtct

SEQ ID NO: 825238 - DNA, 22 bp, Artificial Sequence
  chemically synthesized
cagcatgtcggtcaggctggtc

SEQ ID NO: 825239 - DNA, 22 bp, Artificial Sequence
  chemically synthesized
ggtttcagcatgtcggtcaggc

SEQ ID NO: 825240 - DNA, 22 bp, Artificial Sequence
  chemically synthesized
gagaccagcctgaccgacatgc

SEQ ID NO: 825241 - DNA, 22 bp, Artificial Sequence
  chemically synthesized
gtagagactgggtttcagcatg

SEQ ID NO: 825242 - DNA, 22 bp, Artificial Sequence
  chemically synthesized
agtagagactgggtttcagcat

SEQ ID NO: 825243 - DNA, 22 bp, Artificial Sequence
  chemically synthesized
tagtagagactgggtttcagca

SEQ ID NO: 825244 - DNA, 22 bp, Artificial Sequence
  chemically synthesized
ttagtagagactgggtttcagc

SEQ ID NO: 825245 - DNA, 22 bp, Artificial Sequence
  chemically synthesized
accgacatgctgaaacccagtc

SEQ ID NO: 825246 - DNA, 22 bp, Artificial Sequence
  chemically synthesized
tatttttagtagagactgggtt

SEQ ID NO: 825247 - DNA, 22 bp, Artificial Sequence
  chemically synthesized
gtatttttagtagagactgggt

SEQ ID NO: 825248 - DNA, 22 bp, Artificial Sequence
  chemically synthesized
tgtatttttagtagagactggg

SEQ ID NO: 825249 - DNA, 22 bp, Artificial Sequence
  chemically synthesized
ttgtatttttagtagagactgg

SEQ ID NO: 825250 - DNA, 22 bp, Artificial Sequence
  chemically synthesized
atttttgtatttttagtagaga

SEQ ID NO: 825251 - DNA, 22 bp, Artificial Sequence
  chemically synthesized
aaacccagtctctactaaaaat

SEQ ID NO: 825252 - DNA, 22 bp, Artificial Sequence
  chemically synthesized
caggcgtgtgctaatttttgta

SEQ ID NO: 825253 - DNA, 22 bp, Artificial Sequence
  chemically synthesized
tactaaaaatacaaaaattagc

SEQ ID NO: 825254 - DNA, 22 bp, Artificial Sequence
  chemically synthesized
ctaaaaatacaaaaattagcac

SEQ ID NO: 825255 - DNA, 22 bp, Artificial Sequence
  chemically synthesized
ggattacaggcgtgtgctaatt

SEQ ID NO: 825256 - DNA, 22 bp, Artificial Sequence
  chemically synthesized
aaaatacaaaaattagcacacg

SEQ ID NO: 825257 - DNA, 22 bp, Artificial Sequence
  chemically synthesized
agtagctgggattacaggcgtg

SEQ ID NO: 825258 - DNA, 22 bp, Artificial Sequence
  chemically synthesized
ctgagtagctgggattacaggc

SEQ ID NO: 825259 - DNA, 22 bp, Artificial Sequence
  chemically synthesized
gcacacgcctgtaatcccagct

SEQ ID NO: 825260 - DNA, 22 bp, Artificial Sequence
  chemically synthesized
agcctcctgagtagctgggatt

SEQ ID NO: 825261 - DNA, 22 bp, Artificial Sequence
  chemically synthesized
cctcagcctcctgagtagctgg

SEQ ID NO: 825262 - DNA, 22 bp, Artificial Sequence
  chemically synthesized
ctgcctcagcctcctgagtagc

SEQ ID NO: 825263 - DNA, 22 bp, Artificial Sequence
  chemically synthesized
tcctgcctcagcctcctgagta

SEQ ID NO: 825264 - DNA, 22 bp, Artificial Sequence
  chemically synthesized
taatcccagctactcaggaggc

SEQ ID NO: 825265 - DNA, 22 bp, Artificial Sequence
  chemically synthesized
aagtgattctcctgcctcagcc

SEQ ID NO: 825266 - DNA, 22 bp, Artificial Sequence
  chemically synthesized
ctcaggaggctgaggcaggaga

SEQ ID NO: 825267 - DNA, 22 bp, Artificial Sequence
  chemically synthesized
aggaggctgaggcaggagaatc

SEQ ID NO: 825268 - DNA, 22 bp, Artificial Sequence
  chemically synthesized
ccgggttcaagtgattctcctg

SEQ ID NO: 825269 - DNA, 22 bp, Artificial Sequence
  chemically synthesized
cctcccgggttcaagtgattct

SEQ ID NO: 825270 - DNA, 22 bp, Artificial Sequence
  chemically synthesized
tgcctcccgggttcaagtgatt

SEQ ID NO: 825271 - DNA, 22 bp, Artificial Sequence
  chemically synthesized
aggcaggagaatcacttgaacc

SEQ ID NO: 825272 - DNA, 22 bp, Artificial Sequence
  chemically synthesized
caacctctgcctcccgggttca

SEQ ID NO: 825273 - DNA, 22 bp, Artificial Sequence
  chemically synthesized
actgcaacctctgcctcccggg

SEQ ID NO: 825274 - DNA, 22 bp, Artificial Sequence
  chemically synthesized
ggctcactgcaacctctgcctc

SEQ ID NO: 825275 - DNA, 22 bp, Artificial Sequence
  chemically synthesized
gaacccgggaggcagaggttgc

SEQ ID NO: 825276 - DNA, 22 bp, Artificial Sequence
  chemically synthesized
aacccgggaggcagaggttgca

SEQ ID NO: 825277 - DNA, 22 bp, Artificial Sequence
  chemically synthesized
gagtgcagcggcatgatctcgg

SEQ ID NO: 825278 - DNA, 22 bp, Artificial Sequence
  chemically synthesized
cagtgagccgagatcatgccgc

SEQ ID NO: 825279 - DNA, 22 bp, Artificial Sequence
  chemically synthesized
tcacccaggctggagtgcagcg

SEQ ID NO: 825280 - DNA, 22 bp, Artificial Sequence
  chemically synthesized
tgtcacccaggctggagtgcag

SEQ ID NO: 825281 - DNA, 22 bp, Artificial Sequence
  chemically synthesized
ctctgtcacccaggctggagtg

SEQ ID NO: 825282 - DNA, 22 bp, Artificial Sequence
  chemically synthesized
gctctgtcacccaggctggagt

SEQ ID NO: 825283 - DNA, 22 bp, Artificial Sequence
  chemically synthesized
tgctctgtcacccaggctggag

SEQ ID NO: 825284 - DNA, 22 bp, Artificial Sequence
  chemically synthesized
cactccagcctgggtgacagag

SEQ ID NO: 825285 - DNA, 22 bp, Artificial Sequence
  chemically synthesized
agatggagttttgctctgtcac

SEQ ID NO: 825286 - DNA, 22 bp, Artificial Sequence
  chemically synthesized
gagatggagttttgctctgtca

SEQ ID NO: 825287 - DNA, 22 bp, Artificial Sequence
  chemically synthesized
tgagatggagttttgctctgtc

SEQ ID NO: 825288 - DNA, 22 bp, Artificial Sequence
  chemically synthesized
ttgagatggagttttgctctgt

SEQ ID NO: 825289 - DNA, 22 bp, Artificial Sequence
  chemically synthesized
cagcctgggtgacagagcaaaa

SEQ ID NO: 825290 - DNA, 22 bp, Artificial Sequence
  chemically synthesized
tttttgagatggagttttgctc

SEQ ID NO: 825291 - DNA, 22 bp, Artificial Sequence
  chemically synthesized
atttttgagatggagttttgct

SEQ ID NO: 825292 - DNA, 22 bp, Artificial Sequence
  chemically synthesized
ggtgacagagcaaaactccatc

SEQ ID NO: 825293 - DNA, 22 bp, Artificial Sequence
  chemically synthesized
tgtatttatttttgagatggag

SEQ ID NO: 825294 - DNA, 22 bp, Artificial Sequence
  chemically synthesized
tatgtatttatttttgagatgg

SEQ ID NO: 825295 - DNA, 22 bp, Artificial Sequence
  chemically synthesized
ctatgtatttatttttgagatg

SEQ ID NO: 825296 - DNA, 22 bp, Artificial Sequence
  chemically synthesized
tctatgtatttatttttgagat

SEQ ID NO: 825297 - DNA, 22 bp, Artificial Sequence
  chemically synthesized
tttctatgtatttatttttgag

SEQ ID NO: 825298 - DNA, 22 bp, Artificial Sequence
  chemically synthesized
ctttctatgtatttatttttga

SEQ ID NO: 825299 - DNA, 22 bp, Artificial Sequence
  chemically synthesized
catctcaaaaataaatacatag

SEQ ID NO: 825300 - DNA, 22 bp, Artificial Sequence
  chemically synthesized
aagtatttctttctatgtattt

SEQ ID NO: 825301 - DNA, 22 bp, Artificial Sequence
  chemically synthesized
aaaaataaatacatagaaagaa

SEQ ID NO: 825302 - DNA, 22 bp, Artificial Sequence
  chemically synthesized
caaaatatctgaagtatttctt

SEQ ID NO: 825303 - DNA, 22 bp, Artificial Sequence
  chemically synthesized
acaaaatatctgaagtatttct

SEQ ID NO: 825304 - DNA, 22 bp, Artificial Sequence
  chemically synthesized
tttacaaaatatctgaagtatt

SEQ ID NO: 825305 - DNA, 22 bp, Artificial Sequence
  chemically synthesized
atttacaaaatatctgaagtat

SEQ ID NO: 825306 - DNA, 22 bp, Artificial Sequence
  chemically synthesized
atgcttatttacaaaatatctg

SEQ ID NO: 825307 - DNA, 22 bp, Artificial Sequence
  chemically synthesized
gtcctgatgcttatttacaaaa

SEQ ID NO: 825308 - DNA, 22 bp, Artificial Sequence
  chemically synthesized
tagtcctgatgcttatttacaa

SEQ ID NO: 825309 - DNA, 22 bp, Artificial Sequence
  chemically synthesized
ctagtcctgatgcttatttaca

SEQ ID NO: 825310 - DNA, 22 bp, Artificial Sequence
  chemically synthesized
tctagtcctgatgcttatttac

SEQ ID NO: 825311 - DNA, 22 bp, Artificial Sequence
  chemically synthesized
cagatattttgtaaataagcat

SEQ ID NO: 825312 - DNA, 22 bp, Artificial Sequence
  chemically synthesized
agatattttgtaaataagcatc

SEQ ID NO: 825313 - DNA, 22 bp, Artificial Sequence
  chemically synthesized
tggggtctttctagtcctgatg

SEQ ID NO: 825314 - DNA, 22 bp, Artificial Sequence
  chemically synthesized
gtggggtctttctagtcctgat

SEQ ID NO: 825315 - DNA, 22 bp, Artificial Sequence
  chemically synthesized
tgtaaataagcatcaggactag

SEQ ID NO: 825316 - DNA, 22 bp, Artificial Sequence
  chemically synthesized
tgtggggtctttctagtcctga

SEQ ID NO: 825317 - DNA, 22 bp, Artificial Sequence
  chemically synthesized
gtaaataagcatcaggactaga

SEQ ID NO: 825318 - DNA, 22 bp, Artificial Sequence
  chemically synthesized
taaataagcatcaggactagaa

SEQ ID NO: 825319 - DNA, 22 bp, Artificial Sequence
  chemically synthesized
gttttgtggggtctttctagtc

SEQ ID NO: 825320 - DNA, 22 bp, Artificial Sequence
  chemically synthesized
caatcactagttttgtggggtc

SEQ ID NO: 825321 - DNA, 22 bp, Artificial Sequence
  chemically synthesized
atgttacaatcactagttttgt

SEQ ID NO: 825322 - DNA, 22 bp, Artificial Sequence
  chemically synthesized
catgttacaatcactagttttg

SEQ ID NO: 825323 - DNA, 22 bp, Artificial Sequence
  chemically synthesized
gaaagaccccacaaaactagtg

SEQ ID NO: 825324 - DNA, 22 bp, Artificial Sequence
  chemically synthesized
atttcatgttacaatcactagt

SEQ ID NO: 825325 - DNA, 22 bp, Artificial Sequence
  chemically synthesized
gatttcatgttacaatcactag

SEQ ID NO: 825326 - DNA, 22 bp, Artificial Sequence
  chemically synthesized
tgatttcatgttacaatcacta

SEQ ID NO: 825327 - DNA, 22 bp, Artificial Sequence
  chemically synthesized
ttgatttcatgttacaatcact

SEQ ID NO: 825328 - DNA, 22 bp, Artificial Sequence
  chemically synthesized
tatttttgatttcatgttacaa

SEQ ID NO: 825329 - DNA, 22 bp, Artificial Sequence
  chemically synthesized
gggactatatttttgatttcat

SEQ ID NO: 825330 - DNA, 22 bp, Artificial Sequence
  chemically synthesized
gtgattgtaacatgaaatcaaa

SEQ ID NO: 825331 - DNA, 22 bp, Artificial Sequence
  chemically synthesized
tggggactatatttttgatttc

SEQ ID NO: 825332 - DNA, 22 bp, Artificial Sequence
  chemically synthesized
ttctggggactatatttttgat

SEQ ID NO: 825333 - DNA, 22 bp, Artificial Sequence
  chemically synthesized
taacatgaaatcaaaaatatag

SEQ ID NO: 825334 - DNA, 22 bp, Artificial Sequence
  chemically synthesized
attattctggggactatatttt

SEQ ID NO: 825335 - DNA, 22 bp, Artificial Sequence
  chemically synthesized
aattattctggggactatattt

SEQ ID NO: 825336 - DNA, 22 bp, Artificial Sequence
  chemically synthesized
taattattctggggactatatt

SEQ ID NO: 825337 - DNA, 22 bp, Artificial Sequence
  chemically synthesized
agttttaattattctggggact

SEQ ID NO: 825338 - DNA, 22 bp, Artificial Sequence
  chemically synthesized
ctgagttttaattattctgggg

SEQ ID NO: 825339 - DNA, 22 bp, Artificial Sequence
  chemically synthesized
actgagttttaattattctggg

SEQ ID NO: 825340 - DNA, 22 bp, Artificial Sequence
  chemically synthesized
taatgtgtgccacttactgagt

SEQ ID NO: 825341 - DNA, 22 bp, Artificial Sequence
  chemically synthesized
aaactcagtaagtggcacacat

SEQ ID NO: 825342 - DNA, 22 bp, Artificial Sequence
  chemically synthesized
agtaagtggcacacattataga

SEQ ID NO: 825343 - DNA, 22 bp, Artificial Sequence
  chemically synthesized
ataaaaaaacagtagtctataa

SEQ ID NO: 825344 - DNA, 22 bp, Artificial Sequence
  chemically synthesized
tagactactgtttttttatcag

SEQ ID NO: 825345 - DNA, 22 bp, Artificial Sequence
  chemically synthesized
ctgtttttttatcaggtttatt

SEQ ID NO: 825346 - DNA, 22 bp, Artificial Sequence
  chemically synthesized
tttttttatcaggtttatttct

SEQ ID NO: 825347 - DNA, 22 bp, Artificial Sequence
  chemically synthesized
ttttatcaggtttatttctgtt

SEQ ID NO: 825348 - DNA, 22 bp, Artificial Sequence
  chemically synthesized
tttatcaggtttatttctgttt

SEQ ID NO: 825349 - DNA, 22 bp, Artificial Sequence
  chemically synthesized
ttatcaggtttatttctgtttg

SEQ ID NO: 825350 - DNA, 22 bp, Artificial Sequence
  chemically synthesized
tatcaggtttatttctgtttgg

SEQ ID NO: 825351 - DNA, 22 bp, Artificial Sequence
  chemically synthesized
atcaggtttatttctgtttggg

SEQ ID NO: 825352 - DNA, 22 bp, Artificial Sequence
  chemically synthesized
tcaggtttatttctgtttgggt

SEQ ID NO: 825353 - DNA, 22 bp, Artificial Sequence
  chemically synthesized
caatacatagcaaacacccaaa

SEQ ID NO: 825354 - DNA, 22 bp, Artificial Sequence
  chemically synthesized
gcaatacatagcaaacacccaa

SEQ ID NO: 825355 - DNA, 22 bp, Artificial Sequence
  chemically synthesized
tgcaatacatagcaaacaccca

SEQ ID NO: 825356 - DNA, 22 bp, Artificial Sequence
  chemically synthesized
atttctgtttgggtgtttgcta

SEQ ID NO: 825357 - DNA, 22 bp, Artificial Sequence
  chemically synthesized
tttctgtttgggtgtttgctat

SEQ ID NO: 825358 - DNA, 22 bp, Artificial Sequence
  chemically synthesized
gttttgcaatacatagcaaaca

SEQ ID NO: 825359 - DNA, 22 bp, Artificial Sequence
  chemically synthesized
ctgtttgggtgtttgctatgta

SEQ ID NO: 825360 - DNA, 22 bp, Artificial Sequence
  chemically synthesized
tgtttgggtgtttgctatgtat

SEQ ID NO: 825361 - DNA, 22 bp, Artificial Sequence
  chemically synthesized
tttgggtgtttgctatgtattg

SEQ ID NO: 825362 - DNA, 22 bp, Artificial Sequence
  chemically synthesized
gggtgtttgctatgtattgcaa

SEQ ID NO: 825363 - DNA, 22 bp, Artificial Sequence
  chemically synthesized
ggtgtttgctatgtattgcaaa

SEQ ID NO: 825364 - DNA, 22 bp, Artificial Sequence
  chemically synthesized
gctatgtattgcaaaactagtc

SEQ ID NO: 825365 - DNA, 22 bp, Artificial Sequence
  chemically synthesized
ctatgtattgcaaaactagtcg

SEQ ID NO: 825366 - DNA, 22 bp, Artificial Sequence
  chemically synthesized
caatataatatgtcgactagtt

SEQ ID NO: 825367 - DNA, 22 bp, Artificial Sequence
  chemically synthesized
tgtattgcaaaactagtcgaca

SEQ ID NO: 825368 - DNA, 22 bp, Artificial Sequence
  chemically synthesized
aagttgcaatataatatgtcga

SEQ ID NO: 825369 - DNA, 22 bp, Artificial Sequence
  chemically synthesized
caaaactagtcgacatattata

SEQ ID NO: 825370 - DNA, 22 bp, Artificial Sequence
  chemically synthesized
actgaagttgcaatataatatg

SEQ ID NO: 825371 - DNA, 22 bp, Artificial Sequence
  chemically synthesized
gtcgacatattatattgcaact

SEQ ID NO: 825372 - DNA, 22 bp, Artificial Sequence
  chemically synthesized
acatgttaactgaagttgcaat

SEQ ID NO: 825373 - DNA, 22 bp, Artificial Sequence
  chemically synthesized
tattgcaacttcagttaacatg

SEQ ID NO: 825374 - DNA, 22 bp, Artificial Sequence
  chemically synthesized
aacagaggttgacatgttaact

SEQ ID NO: 825375 - DNA, 22 bp, Artificial Sequence
  chemically synthesized
caacttcagttaacatgtcaac

SEQ ID NO: 825376 - DNA, 22 bp, Artificial Sequence
  chemically synthesized
cggttaaacagaggttgacatg

SEQ ID NO: 825377 - DNA, 22 bp, Artificial Sequence
  chemically synthesized
acggttaaacagaggttgacat

SEQ ID NO: 825378 - DNA, 22 bp, Artificial Sequence
  chemically synthesized
cagttaacatgtcaacctctgt

SEQ ID NO: 825379 - DNA, 22 bp, Artificial Sequence
  chemically synthesized
agttaacatgtcaacctctgtt

SEQ ID NO: 825380 - DNA, 22 bp, Artificial Sequence
  chemically synthesized
acatgtcaacctctgtttaacc

SEQ ID NO: 825381 - DNA, 22 bp, Artificial Sequence
  chemically synthesized
gagagagacttacggttaaaca

SEQ ID NO: 825382 - DNA, 22 bp, Artificial Sequence
  chemically synthesized
aaagattagagagagacttacg

SEQ ID NO: 825383 - DNA, 22 bp, Artificial Sequence
  chemically synthesized
tgtttaaccgtaagtctctctc

SEQ ID NO: 825384 - DNA, 22 bp, Artificial Sequence
  chemically synthesized
tttaaccgtaagtctctctcta

SEQ ID NO: 825385 - DNA, 22 bp, Artificial Sequence
  chemically synthesized
aaccgtaagtctctctctaatc

SEQ ID NO: 825386 - DNA, 22 bp, Artificial Sequence
  chemically synthesized
accgtaagtctctctctaatct

SEQ ID NO: 825387 - DNA, 22 bp, Artificial Sequence
  chemically synthesized
tctctaatctttgaacgccatt

SEQ ID NO: 825388 - DNA, 22 bp, Artificial Sequence
  chemically synthesized
tctaatctttgaacgccattgt

SEQ ID NO: 825389 - DNA, 22 bp, Artificial Sequence
  chemically synthesized
taatctttgaacgccattgttt

SEQ ID NO: 825390 - DNA, 22 bp, Artificial Sequence
  chemically synthesized
atctttgaacgccattgttttg

SEQ ID NO: 825391 - DNA, 22 bp, Artificial Sequence
  chemically synthesized
tgaacgccattgttttgtgtgt

SEQ ID NO: 825392 - DNA, 22 bp, Artificial Sequence
  chemically synthesized
gaacgccattgttttgtgtgtc

SEQ ID NO: 825393 - DNA, 22 bp, Artificial Sequence
  chemically synthesized
aacgccattgttttgtgtgtct

SEQ ID NO: 825394 - DNA, 22 bp, Artificial Sequence
  chemically synthesized
gtggaacaacaacaatgagaca

SEQ ID NO: 825395 - DNA, 22 bp, Artificial Sequence
  chemically synthesized
cctagtggaacaacaacaatga

SEQ ID NO: 825396 - DNA, 22 bp, Artificial Sequence
  chemically synthesized
ttttgtgtgtctcattgttgtt

SEQ ID NO: 825397 - DNA, 22 bp, Artificial Sequence
  chemically synthesized
tgtgtgtctcattgttgttgtt

SEQ ID NO: 825398 - DNA, 22 bp, Artificial Sequence
  chemically synthesized
gtgtgtctcattgttgttgttc

SEQ ID NO: 825399 - DNA, 22 bp, Artificial Sequence
  chemically synthesized
cactacctagtggaacaacaac

SEQ ID NO: 825400 - DNA, 22 bp, Artificial Sequence
  chemically synthesized
tgtgtctcattgttgttgttcc

SEQ ID NO: 825401 - DNA, 22 bp, Artificial Sequence
  chemically synthesized
ttccactacctagtggaacaac

SEQ ID NO: 825402 - DNA, 22 bp, Artificial Sequence
  chemically synthesized
attgttgttgttccactaggta

SEQ ID NO: 825403 - DNA, 22 bp, Artificial Sequence
  chemically synthesized
cgaaagctgttccactacctag

SEQ ID NO: 825404 - DNA, 22 bp, Artificial Sequence
  chemically synthesized
ttgttgttccactaggtagtgg

SEQ ID NO: 825405 - DNA, 22 bp, Artificial Sequence
  chemically synthesized
ttgttccactaggtagtggaac

SEQ ID NO: 825406 - DNA, 22 bp, Artificial Sequence
  chemically synthesized
aactacgaaagctgttccacta

SEQ ID NO: 825407 - DNA, 22 bp, Artificial Sequence
  chemically synthesized
ttccactaggtagtggaacagc

SEQ ID NO: 825408 - DNA, 22 bp, Artificial Sequence
  chemically synthesized
cactaggtagtggaacagcttt

SEQ ID NO: 825409 - DNA, 22 bp, Artificial Sequence
  chemically synthesized
caaggcctcaactacgaaagct

SEQ ID NO: 825410 - DNA, 22 bp, Artificial Sequence
  chemically synthesized
ggtagtggaacagctttcgtag

SEQ ID NO: 825411 - DNA, 22 bp, Artificial Sequence
  chemically synthesized
aacaattacaaggcctcaacta

SEQ ID NO: 825412 - DNA, 22 bp, Artificial Sequence
  chemically synthesized
gaagactaaacaattacaaggc

SEQ ID NO: 825413 - DNA, 22 bp, Artificial Sequence
  chemically synthesized
tcgtagttgaggccttgtaatt

SEQ ID NO: 825414 - DNA, 22 bp, Artificial Sequence
  chemically synthesized
cgtagttgaggccttgtaattg

SEQ ID NO: 825415 - DNA, 22 bp, Artificial Sequence
  chemically synthesized
gtagttgaggccttgtaattgt

SEQ ID NO: 825416 - DNA, 22 bp, Artificial Sequence
  chemically synthesized
attagaagactaaacaattaca

SEQ ID NO: 825417 - DNA, 22 bp, Artificial Sequence
  chemically synthesized
aggccttgtaattgtttagtct

SEQ ID NO: 825418 - DNA, 22 bp, Artificial Sequence
  chemically synthesized
gtaattgtttagtcttctaatt

SEQ ID NO: 825419 - DNA, 22 bp, Artificial Sequence
  chemically synthesized
taattgtttagtcttctaatta

SEQ ID NO: 825420 - DNA, 22 bp, Artificial Sequence
  chemically synthesized
taaaccaaagattaattagaag

SEQ ID NO: 825421 - DNA, 22 bp, Artificial Sequence
  chemically synthesized
ataaaccaaagattaattagaa

SEQ ID NO: 825422 - DNA, 22 bp, Artificial Sequence
  chemically synthesized
tataaaccaaagattaattaga

SEQ ID NO: 825423 - DNA, 22 bp, Artificial Sequence
  chemically synthesized
ttttataaaccaaagattaatt

SEQ ID NO: 825424 - DNA, 22 bp, Artificial Sequence
  chemically synthesized
tttagtcttctaattaatcttt

SEQ ID NO: 825425 - DNA, 22 bp, Artificial Sequence
  chemically synthesized
attttataaaccaaagattaat

SEQ ID NO: 825426 - DNA, 22 bp, Artificial Sequence
  chemically synthesized
agtcttctaattaatctttggt

SEQ ID NO: 825427 - DNA, 22 bp, Artificial Sequence
  chemically synthesized
gtcttctaattaatctttggtt

SEQ ID NO: 825428 - DNA, 22 bp, Artificial Sequence
  chemically synthesized
caccatttattttataaaccaa

SEQ ID NO: 825429 - DNA, 22 bp, Artificial Sequence
  chemically synthesized
ctaattaatctttggtttataa

SEQ ID NO: 825430 - DNA, 22 bp, Artificial Sequence
  chemically synthesized
acaccatttattttataaacca

SEQ ID NO: 825431 - DNA, 22 bp, Artificial Sequence
  chemically synthesized
taattaatctttggtttataaa

SEQ ID NO: 825432 - DNA, 22 bp, Artificial Sequence
  chemically synthesized
attaatctttggtttataaaat

SEQ ID NO: 825433 - DNA, 22 bp, Artificial Sequence
  chemically synthesized
atctttggtttataaaataaat

SEQ ID NO: 825434 - DNA, 22 bp, Artificial Sequence
  chemically synthesized
taagagcatttacaccatttat

SEQ ID NO: 825435 - DNA, 22 bp, Artificial Sequence
  chemically synthesized
tggtttataaaataaatggtgt

SEQ ID NO: 825436 - DNA, 22 bp, Artificial Sequence
  chemically synthesized
ataagagcatttacaccattta

SEQ ID NO: 825437 - DNA, 22 bp, Artificial Sequence
  chemically synthesized
ggtttataaaataaatggtgta

SEQ ID NO: 825438 - DNA, 22 bp, Artificial Sequence
  chemically synthesized
gtttataaaataaatggtgtaa

SEQ ID NO: 825439 - DNA, 22 bp, Artificial Sequence
  chemically synthesized
ttataagagcatttacaccatt

SEQ ID NO: 825440 - DNA, 22 bp, Artificial Sequence
  chemically synthesized
cttataagagcatttacaccat

SEQ ID NO: 825441 - DNA, 22 bp, Artificial Sequence
  chemically synthesized
tcttataagagcatttacacca

SEQ ID NO: 825442 - DNA, 22 bp, Artificial Sequence
  chemically synthesized
ataaaataaatggtgtaaatgc

SEQ ID NO: 825443 - DNA, 22 bp, Artificial Sequence
  chemically synthesized
taaaataaatggtgtaaatgct

SEQ ID NO: 825444 - DNA, 22 bp, Artificial Sequence
  chemically synthesized
tacagctttcttataagagcat

SEQ ID NO: 825445 - DNA, 22 bp, Artificial Sequence
  chemically synthesized
atacagctttcttataagagca

SEQ ID NO: 825446 - DNA, 22 bp, Artificial Sequence
  chemically synthesized
tatacagctttcttataagagc

SEQ ID NO: 825447 - DNA, 22 bp, Artificial Sequence
  chemically synthesized
cactttatacagctttcttata

SEQ ID NO: 825448 - DNA, 22 bp, Artificial Sequence
  chemically synthesized
acactttatacagctttcttat

SEQ ID NO: 825449 - DNA, 22 bp, Artificial Sequence
  chemically synthesized
atttacactttatacagctttc

SEQ ID NO: 825450 - DNA, 22 bp, Artificial Sequence
  chemically synthesized
catttacactttatacagcttt

SEQ ID NO: 825451 - DNA, 22 bp, Artificial Sequence
  chemically synthesized
tcatttacactttatacagctt

SEQ ID NO: 825452 - DNA, 22 bp, Artificial Sequence
  chemically synthesized
ttataagaaagctgtataaagt

SEQ ID NO: 825453 - DNA, 22 bp, Artificial Sequence
  chemically synthesized
ataagaaagctgtataaagtgt

SEQ ID NO: 825454 - DNA, 22 bp, Artificial Sequence
  chemically synthesized
taagaaagctgtataaagtgta

SEQ ID NO: 825455 - DNA, 22 bp, Artificial Sequence
  chemically synthesized
aagacattttcatttacacttt

SEQ ID NO: 825456 - DNA, 22 bp, Artificial Sequence
  chemically synthesized
aaagacattttcatttacactt

SEQ ID NO: 825457 - DNA, 22 bp, Artificial Sequence
  chemically synthesized
tataaagtgtaaatgaaaatgt

SEQ ID NO: 825458 - DNA, 22 bp, Artificial Sequence
  chemically synthesized
agaacacttaaagacattttca

SEQ ID NO: 825459 - DNA, 22 bp, Artificial Sequence
  chemically synthesized
cagaacacttaaagacattttc

SEQ ID NO: 825460 - DNA, 22 bp, Artificial Sequence
  chemically synthesized
gaatatccacagaatatttcag

SEQ ID NO: 825461 - DNA, 22 bp, Artificial Sequence
  chemically synthesized
taagtgttctgaaatattctgt

SEQ ID NO: 825462 - DNA, 22 bp, Artificial Sequence
  chemically synthesized
aagtgttctgaaatattctgtg

SEQ ID NO: 825463 - DNA, 22 bp, Artificial Sequence
  chemically synthesized
agtgttctgaaatattctgtgg

SEQ ID NO: 825464 - DNA, 22 bp, Artificial Sequence
  chemically synthesized
taattggaatatccacagaata

SEQ ID NO: 825465 - DNA, 22 bp, Artificial Sequence
  chemically synthesized
gtaattggaatatccacagaat

SEQ ID NO: 825466 - DNA, 22 bp, Artificial Sequence
  chemically synthesized
tgaaatattctgtggatattcc

SEQ ID NO: 825467 - DNA, 22 bp, Artificial Sequence
  chemically synthesized
aaatattctgtggatattccaa

SEQ ID NO: 825468 - DNA, 22 bp, Artificial Sequence
  chemically synthesized
aaaaagggtttgtaattggaat

SEQ ID NO: 825469 - DNA, 22 bp, Artificial Sequence
  chemically synthesized
tgtggatattccaattacaaac

SEQ ID NO: 825470 - DNA, 22 bp, Artificial Sequence
  chemically synthesized
tggatattccaattacaaaccc

SEQ ID NO: 825471 - DNA, 22 bp, Artificial Sequence
  chemically synthesized
tgataagttgaaaaagggtttg

SEQ ID NO: 825472 - DNA, 22 bp, Artificial Sequence
  chemically synthesized
ctatgataagttgaaaaagggt

SEQ ID NO: 825473 - DNA, 22 bp, Artificial Sequence
  chemically synthesized
caattacaaaccctttttcaac

SEQ ID NO: 825474 - DNA, 22 bp, Artificial Sequence
  chemically synthesized
caaaccctttttcaacttatca

SEQ ID NO: 825475 - DNA, 22 bp, Artificial Sequence
  chemically synthesized
aagtagcctgctatgataagtt

SEQ ID NO: 825476 - DNA, 22 bp, Artificial Sequence
  chemically synthesized
tttcaacttatcatagcaggct

SEQ ID NO: 825477 - DNA, 22 bp, Artificial Sequence
  chemically synthesized
ttcaacttatcatagcaggcta

SEQ ID NO: 825478 - DNA, 22 bp, Artificial Sequence
  chemically synthesized
tcaacttatcatagcaggctac

SEQ ID NO: 825479 - DNA, 22 bp, Artificial Sequence
  chemically synthesized
caacttatcatagcaggctact

SEQ ID NO: 825480 - DNA, 22 bp, Artificial Sequence
  chemically synthesized
aacttatcatagcaggctactt

SEQ ID NO: 825481 - DNA, 22 bp, Artificial Sequence
  chemically synthesized
atcatagcaggctactttagta

SEQ ID NO: 825482 - DNA, 22 bp, Artificial Sequence
  chemically synthesized
tcatagcaggctactttagtac

SEQ ID NO: 825483 - DNA, 22 bp, Artificial Sequence
  chemically synthesized
ctttagtacacatacttgggac

SEQ ID NO: 825484 - DNA, 22 bp, Artificial Sequence
  chemically synthesized
tagtacacatacttgggacttt

SEQ ID NO: 825485 - DNA, 22 bp, Artificial Sequence
  chemically synthesized
agtacacatacttgggactttt

SEQ ID NO: 825486 - DNA, 22 bp, Artificial Sequence
  chemically synthesized
gtacacatacttgggacttttt

SEQ ID NO: 825487 - DNA, 22 bp, Artificial Sequence
  chemically synthesized
gggactttttctcatatcctac

SEQ ID NO: 825488 - DNA, 22 bp, Artificial Sequence
  chemically synthesized
ggactttttctcatatcctact

SEQ ID NO: 825489 - DNA, 22 bp, Artificial Sequence
  chemically synthesized
tttctcatatcctactgttatg

SEQ ID NO: 825490 - DNA, 22 bp, Artificial Sequence
  chemically synthesized
ttctcatatcctactgttatgt

SEQ ID NO: 825491 - DNA, 22 bp, Artificial Sequence
  chemically synthesized
tctcatatcctactgttatgta

SEQ ID NO: 825492 - DNA, 22 bp, Artificial Sequence
  chemically synthesized
aaatacacatggtacataacag

SEQ ID NO: 825493 - DNA, 22 bp, Artificial Sequence
  chemically synthesized
ctcatatcctactgttatgtac

SEQ ID NO: 825494 - DNA, 22 bp, Artificial Sequence
  chemically synthesized
caaatacacatggtacataaca

SEQ ID NO: 825495 - DNA, 22 bp, Artificial Sequence
  chemically synthesized
tcatatcctactgttatgtacc

SEQ ID NO: 825496 - DNA, 22 bp, Artificial Sequence
  chemically synthesized
tcaaatacacatggtacataac

SEQ ID NO: 825497 - DNA, 22 bp, Artificial Sequence
  chemically synthesized
atatcctactgttatgtaccat

SEQ ID NO: 825498 - DNA, 22 bp, Artificial Sequence
  chemically synthesized
ttttcaaatacacatggtacat

SEQ ID NO: 825499 - DNA, 22 bp, Artificial Sequence
  chemically synthesized
tattattttcaaatacacatgg

SEQ ID NO: 825500 - DNA, 22 bp, Artificial Sequence
  chemically synthesized
ctgttatgtaccatgtgtattt

SEQ ID NO: 825501 - DNA, 22 bp, Artificial Sequence
  chemically synthesized
ttatgtaccatgtgtatttgaa

SEQ ID NO: 825502 - DNA, 22 bp, Artificial Sequence
  chemically synthesized
tgtaccatgtgtatttgaaaat

SEQ ID NO: 825503 - DNA, 22 bp, Artificial Sequence
  chemically synthesized
aggaatgtcaactgtattattt

SEQ ID NO: 825504 - DNA, 22 bp, Artificial Sequence
  chemically synthesized
aaggaatgtcaactgtattatt

SEQ ID NO: 825505 - DNA, 22 bp, Artificial Sequence
  chemically synthesized
taaggaatgtcaactgtattat

SEQ ID NO: 825506 - DNA, 22 bp, Artificial Sequence
  chemically synthesized
ttaaggaatgtcaactgtatta

SEQ ID NO: 825507 - DNA, 22 bp, Artificial Sequence
  chemically synthesized
tttttaaggaatgtcaactgta

SEQ ID NO: 825508 - DNA, 22 bp, Artificial Sequence
  chemically synthesized
gaaaataatacagttgacattc

SEQ ID NO: 825509 - DNA, 22 bp, Artificial Sequence
  chemically synthesized
aaaataatacagttgacattcc

SEQ ID NO: 825510 - DNA, 22 bp, Artificial Sequence
  chemically synthesized
gaatcagagactatttttaagg

SEQ ID NO: 825511 - DNA, 22 bp, Artificial Sequence
  chemically synthesized
acattccttaaaaatagtctct

SEQ ID NO: 825512 - DNA, 22 bp, Artificial Sequence
  chemically synthesized
cttaaaaatagtctctgattcc

SEQ ID NO: 825513 - DNA, 22 bp, Artificial Sequence
  chemically synthesized
aaaaatagtctctgattccaat

SEQ ID NO: 825514 - DNA, 22 bp, Artificial Sequence
  chemically synthesized
aaaatagtctctgattccaatt

SEQ ID NO: 825515 - DNA, 22 bp, Artificial Sequence
  chemically synthesized
acgaaagcgaaggcaaattgga

SEQ ID NO: 825516 - DNA, 22 bp, Artificial Sequence
  chemically synthesized
agactaacgaaagcgaaggcaa

SEQ ID NO: 825517 - DNA, 22 bp, Artificial Sequence
  chemically synthesized
tgattccaatttgccttcgctt

SEQ ID NO: 825518 - DNA, 22 bp, Artificial Sequence
  chemically synthesized
attccaatttgccttcgctttc

SEQ ID NO: 825519 - DNA, 22 bp, Artificial Sequence
  chemically synthesized
gtaattaagactaacgaaagcg

SEQ ID NO: 825520 - DNA, 22 bp, Artificial Sequence
  chemically synthesized
caatttgccttcgctttcgtta

SEQ ID NO: 825521 - DNA, 22 bp, Artificial Sequence
  chemically synthesized
gccttcgctttcgttagtctta

SEQ ID NO: 825522 - DNA, 22 bp, Artificial Sequence
  chemically synthesized
ccttcgctttcgttagtcttaa

SEQ ID NO: 825523 - DNA, 22 bp, Artificial Sequence
  chemically synthesized
cgctttcgttagtcttaattac

SEQ ID NO: 825524 - DNA, 22 bp, Artificial Sequence
  chemically synthesized
gctttcgttagtcttaattact

SEQ ID NO: 825525 - DNA, 22 bp, Artificial Sequence
  chemically synthesized
gcatagtaaaatgttagtaatt

SEQ ID NO: 825526 - DNA, 22 bp, Artificial Sequence
  chemically synthesized
tcgttagtcttaattactaaca

SEQ ID NO: 825527 - DNA, 22 bp, Artificial Sequence
  chemically synthesized
cgttagtcttaattactaacat

SEQ ID NO: 825528 - DNA, 22 bp, Artificial Sequence
  chemically synthesized
gttagtcttaattactaacatt

SEQ ID NO: 825529 - DNA, 22 bp, Artificial Sequence
  chemically synthesized
ctagcatagtaaaatgttagta

SEQ ID NO: 825530 - DNA, 22 bp, Artificial Sequence
  chemically synthesized
gtcttaattactaacattttac

SEQ ID NO: 825531 - DNA, 22 bp, Artificial Sequence
  chemically synthesized
aattactaacattttactatgc

SEQ ID NO: 825532 - DNA, 22 bp, Artificial Sequence
  chemically synthesized
attactaacattttactatgct

SEQ ID NO: 825533 - DNA, 22 bp, Artificial Sequence
  chemically synthesized
aaaaatattgctagcatagtaa

SEQ ID NO: 825534 - DNA, 22 bp, Artificial Sequence
  chemically synthesized
taaaaaatattgctagcatagt

SEQ ID NO: 825535 - DNA, 22 bp, Artificial Sequence
  chemically synthesized
ctaacattttactatgctagca

SEQ ID NO: 825536 - DNA, 22 bp, Artificial Sequence
  chemically synthesized
acattttactatgctagcaata

SEQ ID NO: 825537 - DNA, 22 bp, Artificial Sequence
  chemically synthesized
ggcattctaaaaaatattgcta

SEQ ID NO: 825538 - DNA, 22 bp, Artificial Sequence
  chemically synthesized
tactatgctagcaatatttttt

SEQ ID NO: 825539 - DNA, 22 bp, Artificial Sequence
  chemically synthesized
actatgctagcaatatttttta

SEQ ID NO: 825540 - DNA, 22 bp, Artificial Sequence
  chemically synthesized
ctatgctagcaatattttttag

SEQ ID NO: 825541 - DNA, 22 bp, Artificial Sequence
  chemically synthesized
tgctagcaatattttttagaat

SEQ ID NO: 825542 - DNA, 22 bp, Artificial Sequence
  chemically synthesized
gcaatattttttagaatgccta

SEQ ID NO: 825543 - DNA, 22 bp, Artificial Sequence
  chemically synthesized
tgtgaaaaccactaggcattct

SEQ ID NO: 825544 - DNA, 22 bp, Artificial Sequence
  chemically synthesized
atgtgaaaaccactaggcattc

SEQ ID NO: 825545 - DNA, 22 bp, Artificial Sequence
  chemically synthesized
tgtttatgtgaaaaccactagg

SEQ ID NO: 825546 - DNA, 22 bp, Artificial Sequence
  chemically synthesized
tttagaatgcctagtggttttc

SEQ ID NO: 825547 - DNA, 22 bp, Artificial Sequence
  chemically synthesized
ctatgtttatgtgaaaaccact

SEQ ID NO: 825548 - DNA, 22 bp, Artificial Sequence
  chemically synthesized
ttagaatgcctagtggttttca

SEQ ID NO: 825549 - DNA, 22 bp, Artificial Sequence
  chemically synthesized
gctatgtttatgtgaaaaccac

SEQ ID NO: 825550 - DNA, 22 bp, Artificial Sequence
  chemically synthesized
tagaatgcctagtggttttcac

SEQ ID NO: 825551 - DNA, 22 bp, Artificial Sequence
  chemically synthesized
agaatgcctagtggttttcaca

SEQ ID NO: 825552 - DNA, 22 bp, Artificial Sequence
  chemically synthesized
gaatgcctagtggttttcacat

SEQ ID NO: 825553 - DNA, 22 bp, Artificial Sequence
  chemically synthesized
gtggttttcacataaacatagc

SEQ ID NO: 825554 - DNA, 22 bp, Artificial Sequence
  chemically synthesized
tcacataaacatagcaagctct

SEQ ID NO: 825555 - DNA, 22 bp, Artificial Sequence
  chemically synthesized
gcatgaatcaaaagagcttgct

SEQ ID NO: 825556 - DNA, 22 bp, Artificial Sequence
  chemically synthesized
cacataaacatagcaagctctt

SEQ ID NO: 825557 - DNA, 22 bp, Artificial Sequence
  chemically synthesized
acataaacatagcaagctcttt

SEQ ID NO: 825558 - DNA, 22 bp, Artificial Sequence
  chemically synthesized
ctggcatgaatcaaaagagctt

SEQ ID NO: 825559 - DNA, 22 bp, Artificial Sequence
  chemically synthesized
actggcatgaatcaaaagagct

SEQ ID NO: 825560 - DNA, 22 bp, Artificial Sequence
  chemically synthesized
ttttgattcatgccagtaaata

SEQ ID NO: 825561 - DNA, 22 bp, Artificial Sequence
  chemically synthesized
ttgattcatgccagtaaatatt

SEQ ID NO: 825562 - DNA, 22 bp, Artificial Sequence
  chemically synthesized
taggatgtacaaaatatttact

SEQ ID NO: 825563 - DNA, 22 bp, Artificial Sequence
  chemically synthesized
tgattcatgccagtaaatattt

SEQ ID NO: 825564 - DNA, 22 bp, Artificial Sequence
  chemically synthesized
gattcatgccagtaaatatttt

SEQ ID NO: 825565 - DNA, 22 bp, Artificial Sequence
  chemically synthesized
attcatgccagtaaatattttg

SEQ ID NO: 825566 - DNA, 22 bp, Artificial Sequence
  chemically synthesized
atgccagtaaatattttgtaca

SEQ ID NO: 825567 - DNA, 22 bp, Artificial Sequence
  chemically synthesized
aaatgaactgtaggatgtacaa

SEQ ID NO: 825568 - DNA, 22 bp, Artificial Sequence
  chemically synthesized
ttgaaatgaactgtaggatgta

SEQ ID NO: 825569 - DNA, 22 bp, Artificial Sequence
  chemically synthesized
cctattgaaatgaactgtagga

SEQ ID NO: 825570 - DNA, 22 bp, Artificial Sequence
  chemically synthesized
ccctattgaaatgaactgtagg

SEQ ID NO: 825571 - DNA, 22 bp, Artificial Sequence
  chemically synthesized
tccctattgaaatgaactgtag

SEQ ID NO: 825572 - DNA, 22 bp, Artificial Sequence
  chemically synthesized
ttttccctattgaaatgaactg

SEQ ID NO: 825573 - DNA, 22 bp, Artificial Sequence
  chemically synthesized
tgtacatcctacagttcatttc

SEQ ID NO: 825574 - DNA, 22 bp, Artificial Sequence
  chemically synthesized
gtacatcctacagttcatttca

SEQ ID NO: 825575 - DNA, 22 bp, Artificial Sequence
  chemically synthesized
tacatcctacagttcatttcaa

SEQ ID NO: 825576 - DNA, 22 bp, Artificial Sequence
  chemically synthesized
cagttcatttcaatagggaaaa

SEQ ID NO: 825577 - DNA, 22 bp, Artificial Sequence
  chemically synthesized
aaaatatagactgttttcccta

SEQ ID NO: 825578 - DNA, 22 bp, Artificial Sequence
  chemically synthesized
aaaaatatagactgttttccct

SEQ ID NO: 825579 - DNA, 22 bp, Artificial Sequence
  chemically synthesized
taaaaatatagactgttttccc

SEQ ID NO: 825580 - DNA, 22 bp, Artificial Sequence
  chemically synthesized
ttaaaaatatagactgttttcc

SEQ ID NO: 825581 - DNA, 22 bp, Artificial Sequence
  chemically synthesized
atttcaatagggaaaacagtct

SEQ ID NO: 825582 - DNA, 22 bp, Artificial Sequence
  chemically synthesized
caatagggaaaacagtctatat

SEQ ID NO: 825583 - DNA, 22 bp, Artificial Sequence
  chemically synthesized
aatagggaaaacagtctatatt

SEQ ID NO: 825584 - DNA, 22 bp, Artificial Sequence
  chemically synthesized
gagatggccttttaaaaatata

SEQ ID NO: 825585 - DNA, 22 bp, Artificial Sequence
  chemically synthesized
atatctagagatggccttttaa

SEQ ID NO: 825586 - DNA, 22 bp, Artificial Sequence
  chemically synthesized
ctaatatctagagatggccttt

SEQ ID NO: 825587 - DNA, 22 bp, Artificial Sequence
  chemically synthesized
cctaatatctagagatggcctt

SEQ ID NO: 825588 - DNA, 22 bp, Artificial Sequence
  chemically synthesized
tcctaatatctagagatggcct

SEQ ID NO: 825589 - DNA, 22 bp, Artificial Sequence
  chemically synthesized
ttcctaatatctagagatggcc

SEQ ID NO: 825590 - DNA, 22 bp, Artificial Sequence
  chemically synthesized
tatttttaaaaggccatctcta

SEQ ID NO: 825591 - DNA, 22 bp, Artificial Sequence
  chemically synthesized
tcttttcctaatatctagagat

SEQ ID NO: 825592 - DNA, 22 bp, Artificial Sequence
  chemically synthesized
atcttttcctaatatctagaga

SEQ ID NO: 825593 - DNA, 22 bp, Artificial Sequence
  chemically synthesized
ttaaaaggccatctctagatat

SEQ ID NO: 825594 - DNA, 22 bp, Artificial Sequence
  chemically synthesized
tatcttttcctaatatctagag

SEQ ID NO: 825595 - DNA, 22 bp, Artificial Sequence
  chemically synthesized
taaaaggccatctctagatatt

SEQ ID NO: 825596 - DNA, 22 bp, Artificial Sequence
  chemically synthesized
aaaaggccatctctagatatta

SEQ ID NO: 825597 - DNA, 22 bp, Artificial Sequence
  chemically synthesized
aaaggccatctctagatattag

SEQ ID NO: 825598 - DNA, 22 bp, Artificial Sequence
  chemically synthesized
ctttatcttttcctaatatcta

SEQ ID NO: 825599 - DNA, 22 bp, Artificial Sequence
  chemically synthesized
tagatattaggaaaagataaag

SEQ ID NO: 825600 - DNA, 22 bp, Artificial Sequence
  chemically synthesized
gatattaggaaaagataaagca

SEQ ID NO: 825601 - DNA, 22 bp, Artificial Sequence
  chemically synthesized
cataataggaagaactgcttta

SEQ ID NO: 825602 - DNA, 22 bp, Artificial Sequence
  chemically synthesized
ctacataataggaagaactgct

SEQ ID NO: 825603 - DNA, 22 bp, Artificial Sequence
  chemically synthesized
ggaaaagataaagcagttcttc

SEQ ID NO: 825604 - DNA, 22 bp, Artificial Sequence
  chemically synthesized
cctacataataggaagaactgc

SEQ ID NO: 825605 - DNA, 22 bp, Artificial Sequence
  chemically synthesized
tcttcctacataataggaagaa

SEQ ID NO: 825606 - DNA, 22 bp, Artificial Sequence
  chemically synthesized
aaattatcttcctacataatag

SEQ ID NO: 825607 - DNA, 22 bp, Artificial Sequence
  chemically synthesized
caggattaaaattatcttccta

SEQ ID NO: 825608 - DNA, 22 bp, Artificial Sequence
  chemically synthesized
ttcctattatgtaggaagataa

SEQ ID NO: 825609 - DNA, 22 bp, Artificial Sequence
  chemically synthesized
ccaggattaaaattatcttcct

SEQ ID NO: 825610 - DNA, 22 bp, Artificial Sequence
  chemically synthesized
tccaggattaaaattatcttcc

SEQ ID NO: 825611 - DNA, 22 bp, Artificial Sequence
  chemically synthesized
cctattatgtaggaagataatt

SEQ ID NO: 825612 - DNA, 22 bp, Artificial Sequence
  chemically synthesized
ttccaggattaaaattatcttc

SEQ ID NO: 825613 - DNA, 22 bp, Artificial Sequence
  chemically synthesized
ctattatgtaggaagataattt

SEQ ID NO: 825614 - DNA, 22 bp, Artificial Sequence
  chemically synthesized
tttccaggattaaaattatctt

SEQ ID NO: 825615 - DNA, 22 bp, Artificial Sequence
  chemically synthesized
tttttccaggattaaaattatc

SEQ ID NO: 825616 - DNA, 22 bp, Artificial Sequence
  chemically synthesized
ttatgtaggaagataattttaa

SEQ ID NO: 825617 - DNA, 22 bp, Artificial Sequence
  chemically synthesized
ctttttccaggattaaaattat

SEQ ID NO: 825618 - DNA, 22 bp, Artificial Sequence
  chemically synthesized
tgtaggaagataattttaatcc

SEQ ID NO: 825619 - DNA, 22 bp, Artificial Sequence
  chemically synthesized
cttctttttccaggattaaaat

SEQ ID NO: 825620 - DNA, 22 bp, Artificial Sequence
  chemically synthesized
ccttctttttccaggattaaaa

SEQ ID NO: 825621 - DNA, 22 bp, Artificial Sequence
  chemically synthesized
taaaagtttccttctttttcca

SEQ ID NO: 825622 - DNA, 22 bp, Artificial Sequence
  chemically synthesized
taatcctggaaaaagaaggaaa

SEQ ID NO: 825623 - DNA, 22 bp, Artificial Sequence
  chemically synthesized
aggttataaaagtttccttctt

SEQ ID NO: 825624 - DNA, 22 bp, Artificial Sequence
  chemically synthesized
aatcctggaaaaagaaggaaac

SEQ ID NO: 825625 - DNA, 22 bp, Artificial Sequence
  chemically synthesized
atcctggaaaaagaaggaaact

SEQ ID NO: 825626 - DNA, 22 bp, Artificial Sequence
  chemically synthesized
gaaaaagaaggaaacttttata

SEQ ID NO: 825627 - DNA, 22 bp, Artificial Sequence
  chemically synthesized
aaataatggttcaggttataaa

SEQ ID NO: 825628 - DNA, 22 bp, Artificial Sequence
  chemically synthesized
cctgaaataatggttcaggtta

SEQ ID NO: 825629 - DNA, 22 bp, Artificial Sequence
  chemically synthesized
gcctgaaataatggttcaggtt

SEQ ID NO: 825630 - DNA, 22 bp, Artificial Sequence
  chemically synthesized
ttataacctgaaccattatttc

SEQ ID NO: 825631 - DNA, 22 bp, Artificial Sequence
  chemically synthesized
tataacctgaaccattatttca

SEQ ID NO: 825632 - DNA, 22 bp, Artificial Sequence
  chemically synthesized
ataacctgaaccattatttcag

SEQ ID NO: 825633 - DNA, 22 bp, Artificial Sequence
  chemically synthesized
taacctgaaccattatttcagg

SEQ ID NO: 825634 - DNA, 22 bp, Artificial Sequence
  chemically synthesized
aaatcccatgtttgcctgaaat

SEQ ID NO: 825635 - DNA, 22 bp, Artificial Sequence
  chemically synthesized
aaccattatttcaggcaaacat

SEQ ID NO: 825636 - DNA, 22 bp, Artificial Sequence
  chemically synthesized
agcaagcattcaaatcccatgt

SEQ ID NO: 825637 - DNA, 22 bp, Artificial Sequence
  chemically synthesized
tttcaggcaaacatgggatttg

SEQ ID NO: 825638 - DNA, 22 bp, Artificial Sequence
  chemically synthesized
ttgagcaagcattcaaatccca

SEQ ID NO: 825639 - DNA, 22 bp, Artificial Sequence
  chemically synthesized
caggcaaacatgggatttgaat

SEQ ID NO: 825640 - DNA, 22 bp, Artificial Sequence
  chemically synthesized
aggcaaacatgggatttgaatg

SEQ ID NO: 825641 - DNA, 22 bp, Artificial Sequence
  chemically synthesized
ttattgagcaagcattcaaatc

SEQ ID NO: 825642 - DNA, 22 bp, Artificial Sequence
  chemically synthesized
tattattgagcaagcattcaaa

SEQ ID NO: 825643 - DNA, 22 bp, Artificial Sequence
  chemically synthesized
ctattattgagcaagcattcaa

SEQ ID NO: 825644 - DNA, 22 bp, Artificial Sequence
  chemically synthesized
aaagccttctattattgagcaa

SEQ ID NO: 825645 - DNA, 22 bp, Artificial Sequence
  chemically synthesized
ctgaaagccttctattattgag

SEQ ID NO: 825646 - DNA, 22 bp, Artificial Sequence
  chemically synthesized
gctgaaagccttctattattga

SEQ ID NO: 825647 - DNA, 22 bp, Artificial Sequence
  chemically synthesized
tgctgaaagccttctattattg

SEQ ID NO: 825648 - DNA, 22 bp, Artificial Sequence
  chemically synthesized
gaatgcttgctcaataatagaa

SEQ ID NO: 825649 - DNA, 22 bp, Artificial Sequence
  chemically synthesized
ttgctgaaagccttctattatt

SEQ ID NO: 825650 - DNA, 22 bp, Artificial Sequence
  chemically synthesized
aatgcttgctcaataatagaag

SEQ ID NO: 825651 - DNA, 22 bp, Artificial Sequence
  chemically synthesized
tttgctgaaagccttctattat

SEQ ID NO: 825652 - DNA, 22 bp, Artificial Sequence
  chemically synthesized
ttttgctgaaagccttctatta

SEQ ID NO: 825653 - DNA, 22 bp, Artificial Sequence
  chemically synthesized
gctcaataatagaaggctttca

SEQ ID NO: 825654 - DNA, 22 bp, Artificial Sequence
  chemically synthesized
ctcaataatagaaggctttcag

SEQ ID NO: 825655 - DNA, 22 bp, Artificial Sequence
  chemically synthesized
aataatagaaggctttcagcaa

SEQ ID NO: 825656 - DNA, 22 bp, Artificial Sequence
  chemically synthesized
cataacacacatatgaccactt

SEQ ID NO: 825657 - DNA, 22 bp, Artificial Sequence
  chemically synthesized
tcagcaaaaaagtggtcatatg

SEQ ID NO: 825658 - DNA, 22 bp, Artificial Sequence
  chemically synthesized
ctacataacacacatatgacca

SEQ ID NO: 825659 - DNA, 22 bp, Artificial Sequence
  chemically synthesized
cagcaaaaaagtggtcatatgt

SEQ ID NO: 825660 - DNA, 22 bp, Artificial Sequence
  chemically synthesized
gctacataacacacatatgacc

SEQ ID NO: 825661 - DNA, 22 bp, Artificial Sequence
  chemically synthesized
agcaaaaaagtggtcatatgtg

SEQ ID NO: 825662 - DNA, 22 bp, Artificial Sequence
  chemically synthesized
acttgctacataacacacatat

SEQ ID NO: 825663 - DNA, 22 bp, Artificial Sequence
  chemically synthesized
aacttgctacataacacacata

SEQ ID NO: 825664 - DNA, 22 bp, Artificial Sequence
  chemically synthesized
taacttgctacataacacacat

SEQ ID NO: 825665 - DNA, 22 bp, Artificial Sequence
  chemically synthesized
tgtagcaagttaaaatggctcc

SEQ ID NO: 825666 - DNA, 22 bp, Artificial Sequence
  chemically synthesized
agtgggatgcacaccccaagga

SEQ ID NO: 825667 - DNA, 22 bp, Artificial Sequence
  chemically synthesized
aaatggctccttggggtgtgca

SEQ ID NO: 825668 - DNA, 22 bp, Artificial Sequence
  chemically synthesized
cttggggtgtgcatcccactga

SEQ ID NO: 825669 - DNA, 22 bp, Artificial Sequence
  chemically synthesized
ggggtgtgcatcccactgaggg

SEQ ID NO: 825670 - DNA, 22 bp, Artificial Sequence
  chemically synthesized
gggtgtgcatcccactgagggt

SEQ ID NO: 825671 - DNA, 22 bp, Artificial Sequence
  chemically synthesized
aaggtcaagggtgaaaaagcat

SEQ ID NO: 825672 - DNA, 22 bp, Artificial Sequence
  chemically synthesized
agggtatgctttttcacccttg

SEQ ID NO: 825673 - DNA, 22 bp, Artificial Sequence
  chemically synthesized
tgataatgtacagttgaaggtc

SEQ ID NO: 825674 - DNA, 22 bp, Artificial Sequence
  chemically synthesized
tttcacccttgaccttcaactg

SEQ ID NO: 825675 - DNA, 22 bp, Artificial Sequence
  chemically synthesized
ttcacccttgaccttcaactgt

SEQ ID NO: 825676 - DNA, 22 bp, Artificial Sequence
  chemically synthesized
tcacccttgaccttcaactgta

SEQ ID NO: 825677 - DNA, 22 bp, Artificial Sequence
  chemically synthesized
cacccttgaccttcaactgtac

SEQ ID NO: 825678 - DNA, 22 bp, Artificial Sequence
  chemically synthesized
acccttgaccttcaactgtaca

SEQ ID NO: 825679 - DNA, 22 bp, Artificial Sequence
  chemically synthesized
ataaattatgataatgtacagt

SEQ ID NO: 825680 - DNA, 22 bp, Artificial Sequence
  chemically synthesized
gaccttcaactgtacattatca

SEQ ID NO: 825681 - DNA, 22 bp, Artificial Sequence
  chemically synthesized
actaataaattatgataatgta

SEQ ID NO: 825682 - DNA, 22 bp, Artificial Sequence
  chemically synthesized
accttcaactgtacattatcat

SEQ ID NO: 825683 - DNA, 22 bp, Artificial Sequence
  chemically synthesized
attaactaataaattatgataa

SEQ ID NO: 825684 - DNA, 22 bp, Artificial Sequence
  chemically synthesized
aattaactaataaattatgata

SEQ ID NO: 825685 - DNA, 22 bp, Artificial Sequence
  chemically synthesized
caactgtacattatcataattt

SEQ ID NO: 825686 - DNA, 22 bp, Artificial Sequence
  chemically synthesized
taattaactaataaattatgat

SEQ ID NO: 825687 - DNA, 22 bp, Artificial Sequence
  chemically synthesized
aactgtacattatcataattta

SEQ ID NO: 825688 - DNA, 22 bp, Artificial Sequence
  chemically synthesized
ttaattaactaataaattatga

SEQ ID NO: 825689 - DNA, 22 bp, Artificial Sequence
  chemically synthesized
tacattatcataatttattagt

SEQ ID NO: 825690 - DNA, 22 bp, Artificial Sequence
  chemically synthesized
taaatatttttaattaactaat

SEQ ID NO: 825691 - DNA, 22 bp, Artificial Sequence
  chemically synthesized
tcataatttattagttaattaa

SEQ ID NO: 825692 - DNA, 22 bp, Artificial Sequence
  chemically synthesized
gcctataaatatttttaattaa

SEQ ID NO: 825693 - DNA, 22 bp, Artificial Sequence
  chemically synthesized
tagcctataaatatttttaatt

SEQ ID NO: 825694 - DNA, 22 bp, Artificial Sequence
  chemically synthesized
attagttaattaaaaatattta

SEQ ID NO: 825695 - DNA, 22 bp, Artificial Sequence
  chemically synthesized
ttagttaattaaaaatatttat

SEQ ID NO: 825696 - DNA, 22 bp, Artificial Sequence
  chemically synthesized
gttaattaaaaatatttatagg

SEQ ID NO: 825697 - DNA, 22 bp, Artificial Sequence
  chemically synthesized
agtgagtctctagcctataaat

SEQ ID NO: 825698 - DNA, 22 bp, Artificial Sequence
  chemically synthesized
attaaaaatatttataggctag

SEQ ID NO: 825699 - DNA, 22 bp, Artificial Sequence
  chemically synthesized
ttgagtgagtctctagcctata

SEQ ID NO: 825700 - DNA, 22 bp, Artificial Sequence
  chemically synthesized
aaaatatttataggctagagac

SEQ ID NO: 825701 - DNA, 22 bp, Artificial Sequence
  chemically synthesized
ataggctagagactcactcaat

SEQ ID NO: 825702 - DNA, 22 bp, Artificial Sequence
  chemically synthesized
taggctagagactcactcaata

SEQ ID NO: 825703 - DNA, 22 bp, Artificial Sequence
  chemically synthesized
gagactcactcaataatccatc

SEQ ID NO: 825704 - DNA, 22 bp, Artificial Sequence
  chemically synthesized
actcaataatccatctatccct

SEQ ID NO: 825705 - DNA, 22 bp, Artificial Sequence
  chemically synthesized
aataatccatctatccctctgt

SEQ ID NO: 825706 - DNA, 22 bp, Artificial Sequence
  chemically synthesized
catggatggatgtgtggggatg

SEQ ID NO: 825707 - DNA, 22 bp, Artificial Sequence
  chemically synthesized
tccctctgtgcatccccacaca

SEQ ID NO: 825708 - DNA, 22 bp, Artificial Sequence
  chemically synthesized
gctacatggatggatgtgtggg

SEQ ID NO: 825709 - DNA, 22 bp, Artificial Sequence
  chemically synthesized
tgtgcatccccacacatccatc

SEQ ID NO: 825710 - DNA, 22 bp, Artificial Sequence
  chemically synthesized
gctggctacatggatggatgtg

SEQ ID NO: 825711 - DNA, 22 bp, Artificial Sequence
  chemically synthesized
tgcatccccacacatccatcca

SEQ ID NO: 825712 - DNA, 22 bp, Artificial Sequence
  chemically synthesized
acagatggtaaataaaatagag

SEQ ID NO: 825713 - DNA, 22 bp, Artificial Sequence
  chemically synthesized
gtgtctaacagatggtaaataa

SEQ ID NO: 825714 - DNA, 22 bp, Artificial Sequence
  chemically synthesized
gtctctattttatttaccatct

SEQ ID NO: 825715 - DNA, 22 bp, Artificial Sequence
  chemically synthesized
tattttatttaccatctgttag

SEQ ID NO: 825716 - DNA, 22 bp, Artificial Sequence
  chemically synthesized
ttttatttaccatctgttagac

SEQ ID NO: 825717 - DNA, 22 bp, Artificial Sequence
  chemically synthesized
tcataatggctggtgtctaaca

SEQ ID NO: 825718 - DNA, 22 bp, Artificial Sequence
  chemically synthesized
tatttaccatctgttagacacc

SEQ ID NO: 825719 - DNA, 22 bp, Artificial Sequence
  chemically synthesized
atcataatggctggtgtctaac

SEQ ID NO: 825720 - DNA, 22 bp, Artificial Sequence
  chemically synthesized
atttaccatctgttagacacca

SEQ ID NO: 825721 - DNA, 22 bp, Artificial Sequence
  chemically synthesized
tttaccatctgttagacaccag

SEQ ID NO: 825722 - DNA, 22 bp, Artificial Sequence
  chemically synthesized
ttatcataatggctggtgtcta

SEQ ID NO: 825723 - DNA, 22 bp, Artificial Sequence
  chemically synthesized
accatctgttagacaccagcca

SEQ ID NO: 825724 - DNA, 22 bp, Artificial Sequence
  chemically synthesized
ccatctgttagacaccagccat

SEQ ID NO: 825725 - DNA, 22 bp, Artificial Sequence
  chemically synthesized
caagttcttatcataatggctg

SEQ ID NO: 825726 - DNA, 22 bp, Artificial Sequence
  chemically synthesized
ccaagttcttatcataatggct

SEQ ID NO: 825727 - DNA, 22 bp, Artificial Sequence
  chemically synthesized
tccaagttcttatcataatggc

SEQ ID NO: 825728 - DNA, 22 bp, Artificial Sequence
  chemically synthesized
ttagacaccagccattatgata

SEQ ID NO: 825729 - DNA, 22 bp, Artificial Sequence
  chemically synthesized
ttttccaagttcttatcataat

SEQ ID NO: 825730 - DNA, 22 bp, Artificial Sequence
  chemically synthesized
gttttccaagttcttatcataa

SEQ ID NO: 825731 - DNA, 22 bp, Artificial Sequence
  chemically synthesized
gacaccagccattatgataaga

SEQ ID NO: 825732 - DNA, 22 bp, Artificial Sequence
  chemically synthesized
tgttttccaagttcttatcata

SEQ ID NO: 825733 - DNA, 22 bp, Artificial Sequence
  chemically synthesized
ttgttttccaagttcttatcat

SEQ ID NO: 825734 - DNA, 22 bp, Artificial Sequence
  chemically synthesized
aacccttttgttttccaagttc

SEQ ID NO: 825735 - DNA, 22 bp, Artificial Sequence
  chemically synthesized
aaacccttttgttttccaagtt

SEQ ID NO: 825736 - DNA, 22 bp, Artificial Sequence
  chemically synthesized
tcttaaacccttttgttttcca

SEQ ID NO: 825737 - DNA, 22 bp, Artificial Sequence
  chemically synthesized
tgataagaacttggaaaacaaa

SEQ ID NO: 825738 - DNA, 22 bp, Artificial Sequence
  chemically synthesized
ggaaaacaaaagggtttaagac

SEQ ID NO: 825739 - DNA, 22 bp, Artificial Sequence
  chemically synthesized
gaaaacaaaagggtttaagaca

SEQ ID NO: 825740 - DNA, 22 bp, Artificial Sequence
  chemically synthesized
aaccagaagccaggtaatctgt

SEQ ID NO: 825741 - DNA, 22 bp, Artificial Sequence
  chemically synthesized
aagacagattacctggcttctg

SEQ ID NO: 825742 - DNA, 22 bp, Artificial Sequence
  chemically synthesized
agacagattacctggcttctgg

SEQ ID NO: 825743 - DNA, 22 bp, Artificial Sequence
  chemically synthesized
acaggcacctaaaccagaagcc

SEQ ID NO: 825744 - DNA, 22 bp, Artificial Sequence
  chemically synthesized
tctaacaggcacctaaaccaga

SEQ ID NO: 825745 - DNA, 22 bp, Artificial Sequence
  chemically synthesized
cctggcttctggtttaggtgcc

SEQ ID NO: 825746 - DNA, 22 bp, Artificial Sequence
  chemically synthesized
gcttctggtttaggtgcctgtt

SEQ ID NO: 825747 - DNA, 22 bp, Artificial Sequence
  chemically synthesized
ctggtttaggtgcctgttagat

SEQ ID NO: 825748 - DNA, 22 bp, Artificial Sequence
  chemically synthesized
tggtttaggtgcctgttagata

SEQ ID NO: 825749 - DNA, 22 bp, Artificial Sequence
  chemically synthesized
gtttaggtgcctgttagatagt

SEQ ID NO: 825750 - DNA, 22 bp, Artificial Sequence
  chemically synthesized
aggtgcctgttagatagtggtg

SEQ ID NO: 825751 - DNA, 22 bp, Artificial Sequence
  chemically synthesized
ggtgcctgttagatagtggtgc

SEQ ID NO: 825752 - DNA, 22 bp, Artificial Sequence
  chemically synthesized
gataggcagtgaatagcaccac

SEQ ID NO: 825753 - DNA, 22 bp, Artificial Sequence
  chemically synthesized
ggataggcagtgaatagcacca

SEQ ID NO: 825754 - DNA, 22 bp, Artificial Sequence
  chemically synthesized
tggataggcagtgaatagcacc

SEQ ID NO: 825755 - DNA, 22 bp, Artificial Sequence
  chemically synthesized
tttggataggcagtgaatagca

SEQ ID NO: 825756 - DNA, 22 bp, Artificial Sequence
  chemically synthesized
ttagatagtggtgctattcact

SEQ ID NO: 825757 - DNA, 22 bp, Artificial Sequence
  chemically synthesized
gatagtggtgctattcactgcc

SEQ ID NO: 825758 - DNA, 22 bp, Artificial Sequence
  chemically synthesized
cattctttggataggcagtgaa

SEQ ID NO: 825759 - DNA, 22 bp, Artificial Sequence
  chemically synthesized
tgcattctttggataggcagtg

SEQ ID NO: 825760 - DNA, 22 bp, Artificial Sequence
  chemically synthesized
actctgcattctttggataggc

SEQ ID NO: 825761 - DNA, 22 bp, Artificial Sequence
  chemically synthesized
ttcactgcctatccaaagaatg

SEQ ID NO: 825762 - DNA, 22 bp, Artificial Sequence
  chemically synthesized
catgctcactctgcattctttg

SEQ ID NO: 825763 - DNA, 22 bp, Artificial Sequence
  chemically synthesized
actgcctatccaaagaatgcag

SEQ ID NO: 825764 - DNA, 22 bp, Artificial Sequence
  chemically synthesized
tccatgctcactctgcattctt

SEQ ID NO: 825765 - DNA, 22 bp, Artificial Sequence
  chemically synthesized
ctccatgctcactctgcattct

SEQ ID NO: 825766 - DNA, 22 bp, Artificial Sequence
  chemically synthesized
cctatccaaagaatgcagagtg

SEQ ID NO: 825767 - DNA, 22 bp, Artificial Sequence
  chemically synthesized
tcttctccatgctcactctgca

SEQ ID NO: 825768 - DNA, 22 bp, Artificial Sequence
  chemically synthesized
tccaaagaatgcagagtgagca

SEQ ID NO: 825769 - DNA, 22 bp, Artificial Sequence
  chemically synthesized
attatcttctccatgctcactc

SEQ ID NO: 825770 - DNA, 22 bp, Artificial Sequence
  chemically synthesized
aactcattatcttctccatgct

SEQ ID NO: 825771 - DNA, 22 bp, Artificial Sequence
  chemically synthesized
ccagtgaataggtccaaaactg

SEQ ID NO: 825772 - DNA, 22 bp, Artificial Sequence
  chemically synthesized
acaacctcccagtgaataggtc

SEQ ID NO: 825773 - DNA, 22 bp, Artificial Sequence
  chemically synthesized
ctcacaacctcccagtgaatag

SEQ ID NO: 825774 - DNA, 22 bp, Artificial Sequence
  chemically synthesized
agttttggacctattcactggg

SEQ ID NO: 825775 - DNA, 22 bp, Artificial Sequence
  chemically synthesized
tggacctattcactgggaggtt

SEQ ID NO: 825776 - DNA, 22 bp, Artificial Sequence
  chemically synthesized
ggacctattcactgggaggttg

SEQ ID NO: 825777 - DNA, 22 bp, Artificial Sequence
  chemically synthesized
gacctattcactgggaggttgt

SEQ ID NO: 825778 - DNA, 22 bp, Artificial Sequence
  chemically synthesized
tgtgtgtgttcctcacaacctc

SEQ ID NO: 825779 - DNA, 22 bp, Artificial Sequence
  chemically synthesized
atgtgtgtgttcctcacaacct

SEQ ID NO: 825780 - DNA, 22 bp, Artificial Sequence
  chemically synthesized
tatgtgtgtgttcctcacaacc

SEQ ID NO: 825781 - DNA, 22 bp, Artificial Sequence
  chemically synthesized
ttcactgggaggttgtgaggaa

SEQ ID NO: 825782 - DNA, 22 bp, Artificial Sequence
  chemically synthesized
gttttatgtgtgtgttcctcac

SEQ ID NO: 825783 - DNA, 22 bp, Artificial Sequence
  chemically synthesized
actgggaggttgtgaggaacac

SEQ ID NO: 825784 - DNA, 22 bp, Artificial Sequence
  chemically synthesized
ggaggttgtgaggaacacacac

SEQ ID NO: 825785 - DNA, 22 bp, Artificial Sequence
  chemically synthesized
aaatgttagttttatgtgtgtg

SEQ ID NO: 825786 - DNA, 22 bp, Artificial Sequence
  chemically synthesized
actaaaatgttagttttatgtg

SEQ ID NO: 825787 - DNA, 22 bp, Artificial Sequence
  chemically synthesized
tgaggaacacacacataaaact

SEQ ID NO: 825788 - DNA, 22 bp, Artificial Sequence
  chemically synthesized
ctgactaaaatgttagttttat

SEQ ID NO: 825789 - DNA, 22 bp, Artificial Sequence
  chemically synthesized
agtcctcctgactaaaatgtta

SEQ ID NO: 825790 - DNA, 22 bp, Artificial Sequence
  chemically synthesized
cagtcctcctgactaaaatgtt

SEQ ID NO: 825791 - DNA, 22 bp, Artificial Sequence
  chemically synthesized
tagatccttcagtcctcctgac

SEQ ID NO: 825792 - DNA, 22 bp, Artificial Sequence
  chemically synthesized
acattttagtcaggaggactga

SEQ ID NO: 825793 - DNA, 22 bp, Artificial Sequence
  chemically synthesized
tgctatagatccttcagtcctc

SEQ ID NO: 825794 - DNA, 22 bp, Artificial Sequence
  chemically synthesized
tagtcaggaggactgaaggatc

SEQ ID NO: 825795 - DNA, 22 bp, Artificial Sequence
  chemically synthesized
agtcaggaggactgaaggatct

SEQ ID NO: 825796 - DNA, 22 bp, Artificial Sequence
  chemically synthesized
gtcaggaggactgaaggatcta

SEQ ID NO: 825797 - DNA, 22 bp, Artificial Sequence
  chemically synthesized
ccaaaatacacagctatgctat

SEQ ID NO: 825798 - DNA, 22 bp, Artificial Sequence
  chemically synthesized
tcccaaaatacacagctatgct

SEQ ID NO: 825799 - DNA, 22 bp, Artificial Sequence
  chemically synthesized
aaggatctatagcatagctgtg

SEQ ID NO: 825800 - DNA, 22 bp, Artificial Sequence
  chemically synthesized
tctctcccaaaatacacagcta

SEQ ID NO: 825801 - DNA, 22 bp, Artificial Sequence
  chemically synthesized
tgtctctcccaaaatacacagc

SEQ ID NO: 825802 - DNA, 22 bp, Artificial Sequence
  chemically synthesized
ctgtctctcccaaaatacacag

SEQ ID NO: 825803 - DNA, 22 bp, Artificial Sequence
  chemically synthesized
tagcatagctgtgtattttggg

SEQ ID NO: 825804 - DNA, 22 bp, Artificial Sequence
  chemically synthesized
tgtattttgggagagacagaaa

SEQ ID NO: 825805 - DNA, 22 bp, Artificial Sequence
  chemically synthesized
tgggagagacagaaatctggga

SEQ ID NO: 825806 - DNA, 22 bp, Artificial Sequence
  chemically synthesized
gggagagacagaaatctgggat

SEQ ID NO: 825807 - DNA, 22 bp, Artificial Sequence
  chemically synthesized
tagtgacggccaatcccagatt

SEQ ID NO: 825808 - DNA, 22 bp, Artificial Sequence
  chemically synthesized
ggagagacagaaatctgggatt

SEQ ID NO: 825809 - DNA, 22 bp, Artificial Sequence
  chemically synthesized
tgtagtgacggccaatcccaga

SEQ ID NO: 825810 - DNA, 22 bp, Artificial Sequence
  chemically synthesized
tctgtagtgacggccaatccca

SEQ ID NO: 825811 - DNA, 22 bp, Artificial Sequence
  chemically synthesized
ctctgtagtgacggccaatccc

SEQ ID NO: 825812 - DNA, 22 bp, Artificial Sequence
  chemically synthesized
tttctctgtagtgacggccaat

SEQ ID NO: 825813 - DNA, 22 bp, Artificial Sequence
  chemically synthesized
atttctctgtagtgacggccaa

SEQ ID NO: 825814 - DNA, 22 bp, Artificial Sequence
  chemically synthesized
tatttctctgtagtgacggcca

SEQ ID NO: 825815 - DNA, 22 bp, Artificial Sequence
  chemically synthesized
ttatttctctgtagtgacggcc

SEQ ID NO: 825816 - DNA, 22 bp, Artificial Sequence
  chemically synthesized
tttatttctctgtagtgacggc

SEQ ID NO: 825817 - DNA, 22 bp, Artificial Sequence
  chemically synthesized
ctttttatttctctgtagtgac

SEQ ID NO: 825818 - DNA, 22 bp, Artificial Sequence
  chemically synthesized
gctttttatttctctgtagtga

SEQ ID NO: 825819 - DNA, 22 bp, Artificial Sequence
  chemically synthesized
tgctttttatttctctgtagtg

SEQ ID NO: 825820 - DNA, 22 bp, Artificial Sequence
  chemically synthesized
ggattggccgtcactacagaga

SEQ ID NO: 825821 - DNA, 22 bp, Artificial Sequence
  chemically synthesized
aggctttgctttttatttctct

SEQ ID NO: 825822 - DNA, 22 bp, Artificial Sequence
  chemically synthesized
gccgtcactacagagaaataaa

SEQ ID NO: 825823 - DNA, 22 bp, Artificial Sequence
  chemically synthesized
gaggctttgctttttatttctc

SEQ ID NO: 825824 - DNA, 22 bp, Artificial Sequence
  chemically synthesized
catttgaggctttgctttttat

SEQ ID NO: 825825 - DNA, 22 bp, Artificial Sequence
  chemically synthesized
gcatttgaggctttgcttttta

SEQ ID NO: 825826 - DNA, 22 bp, Artificial Sequence
  chemically synthesized
cagagaaataaaaagcaaagcc

SEQ ID NO: 825827 - DNA, 22 bp, Artificial Sequence
  chemically synthesized
tgtgccatataaatgagaatgc

SEQ ID NO: 825828 - DNA, 22 bp, Artificial Sequence
  chemically synthesized
aaatgcaagtgcattctcattt

SEQ ID NO: 825829 - DNA, 22 bp, Artificial Sequence
  chemically synthesized
agtctatgtgccatataaatga

SEQ ID NO: 825830 - DNA, 22 bp, Artificial Sequence
  chemically synthesized
ggctcagtctatgtgccatata

SEQ ID NO: 825831 - DNA, 22 bp, Artificial Sequence
  chemically synthesized
tcatttatatggcacatagact

SEQ ID NO: 825832 - DNA, 22 bp, Artificial Sequence
  chemically synthesized
atttatatggcacatagactga

SEQ ID NO: 825833 - DNA, 22 bp, Artificial Sequence
  chemically synthesized
atatggcacatagactgagccc

SEQ ID NO: 825834 - DNA, 22 bp, Artificial Sequence
  chemically synthesized
tatggcacatagactgagccca

SEQ ID NO: 825835 - DNA, 22 bp, Artificial Sequence
  chemically synthesized
ccagcccggtgttgggctcagt

SEQ ID NO: 825836 - DNA, 22 bp, Artificial Sequence
  chemically synthesized
caggagtccattcccagcccgg

SEQ ID NO: 825837 - DNA, 22 bp, Artificial Sequence
  chemically synthesized
ccaggagtccattcccagcccg

SEQ ID NO: 825838 - DNA, 22 bp, Artificial Sequence
  chemically synthesized
tccaggagtccattcccagccc

SEQ ID NO: 825839 - DNA, 22 bp, Artificial Sequence
  chemically synthesized
agcccaacaccgggctgggaat

SEQ ID NO: 825840 - DNA, 22 bp, Artificial Sequence
  chemically synthesized
tattttccaggagtccattccc

SEQ ID NO: 825841 - DNA, 22 bp, Artificial Sequence
  chemically synthesized
cgttgtattttccaggagtcca

SEQ ID NO: 825842 - DNA, 22 bp, Artificial Sequence
  chemically synthesized
acgttgtattttccaggagtcc

SEQ ID NO: 825843 - DNA, 22 bp, Artificial Sequence
  chemically synthesized
tacgttgtattttccaggagtc

SEQ ID NO: 825844 - DNA, 22 bp, Artificial Sequence
  chemically synthesized
ttacgttgtattttccaggagt

SEQ ID NO: 825845 - DNA, 22 bp, Artificial Sequence
  chemically synthesized
tttacgttgtattttccaggag

SEQ ID NO: 825846 - DNA, 22 bp, Artificial Sequence
  chemically synthesized
tttttacgttgtattttccagg

SEQ ID NO: 825847 - DNA, 22 bp, Artificial Sequence
  chemically synthesized
ggaatggactcctggaaaatac

SEQ ID NO: 825848 - DNA, 22 bp, Artificial Sequence
  chemically synthesized
ttctttttacgttgtattttcc

SEQ ID NO: 825849 - DNA, 22 bp, Artificial Sequence
  chemically synthesized
attctttttacgttgtattttc

SEQ ID NO: 825850 - DNA, 22 bp, Artificial Sequence
  chemically synthesized
tttattctttttacgttgtatt

SEQ ID NO: 825851 - DNA, 22 bp, Artificial Sequence
  chemically synthesized
atttattctttttacgttgtat

SEQ ID NO: 825852 - DNA, 22 bp, Artificial Sequence
  chemically synthesized
tatttattctttttacgttgta

SEQ ID NO: 825853 - DNA, 22 bp, Artificial Sequence
  chemically synthesized
ctggaaaatacaacgtaaaaag

SEQ ID NO: 825854 - DNA, 22 bp, Artificial Sequence
  chemically synthesized
tgttttatttattctttttacg

SEQ ID NO: 825855 - DNA, 22 bp, Artificial Sequence
  chemically synthesized
gtgttttatttattctttttac

SEQ ID NO: 825856 - DNA, 22 bp, Artificial Sequence
  chemically synthesized
gaaaatacaacgtaaaaagaat

SEQ ID NO: 825857 - DNA, 22 bp, Artificial Sequence
  chemically synthesized
tgtgttttatttattcttttta

SEQ ID NO: 825858 - DNA, 22 bp, Artificial Sequence
  chemically synthesized
tttgtgttttatttattctttt

SEQ ID NO: 825859 - DNA, 22 bp, Artificial Sequence
  chemically synthesized
ctctttgtgttttatttattct

SEQ ID NO: 825860 - DNA, 22 bp, Artificial Sequence
  chemically synthesized
gctctttgtgttttatttattc

SEQ ID NO: 825861 - DNA, 22 bp, Artificial Sequence
  chemically synthesized
tttgctctttgtgttttattta

SEQ ID NO: 825862 - DNA, 22 bp, Artificial Sequence
  chemically synthesized
atttgctctttgtgttttattt

SEQ ID NO: 825863 - DNA, 22 bp, Artificial Sequence
  chemically synthesized
atcttatttgctctttgtgttt

SEQ ID NO: 825864 - DNA, 22 bp, Artificial Sequence
  chemically synthesized
attcatcttatttgctctttgt

SEQ ID NO: 825865 - DNA, 22 bp, Artificial Sequence
  chemically synthesized
cattcatcttatttgctctttg

SEQ ID NO: 825866 - DNA, 22 bp, Artificial Sequence
  chemically synthesized
tcattcatcttatttgctcttt

SEQ ID NO: 825867 - DNA, 22 bp, Artificial Sequence
  chemically synthesized
gtctttcattcatcttatttgc

SEQ ID NO: 825868 - DNA, 22 bp, Artificial Sequence
  chemically synthesized
tagtctttcattcatcttattt

SEQ ID NO: 825869 - DNA, 22 bp, Artificial Sequence
  chemically synthesized
tctagtctttcattcatcttat

SEQ ID NO: 825870 - DNA, 22 bp, Artificial Sequence
  chemically synthesized
ctctagtctttcattcatctta

SEQ ID NO: 825871 - DNA, 22 bp, Artificial Sequence
  chemically synthesized
cttctctagtctttcattcatc

SEQ ID NO: 825872 - DNA, 22 bp, Artificial Sequence
  chemically synthesized
ctccttctctagtctttcattc

SEQ ID NO: 825873 - DNA, 22 bp, Artificial Sequence
  chemically synthesized
ctcctccttctctagtctttca

SEQ ID NO: 825874 - DNA, 22 bp, Artificial Sequence
  chemically synthesized
atattcctcctccttctctagt

SEQ ID NO: 825875 - DNA, 22 bp, Artificial Sequence
  chemically synthesized
gatattcctcctccttctctag

SEQ ID NO: 825876 - DNA, 22 bp, Artificial Sequence
  chemically synthesized
ttgatattcctcctccttctct

SEQ ID NO: 825877 - DNA, 22 bp, Artificial Sequence
  chemically synthesized
cttgatattcctcctccttctc

SEQ ID NO: 825878 - DNA, 22 bp, Artificial Sequence
  chemically synthesized
tcttgatattcctcctccttct

SEQ ID NO: 825879 - DNA, 22 bp, Artificial Sequence
  chemically synthesized
gagaaggaggaggaatatcaag

SEQ ID NO: 825880 - DNA, 22 bp, Artificial Sequence
  chemically synthesized
taaaagtacactttcttgatat

SEQ ID NO: 825881 - DNA, 22 bp, Artificial Sequence
  chemically synthesized
tataaaagtacactttcttgat

SEQ ID NO: 825882 - DNA, 22 bp, Artificial Sequence
  chemically synthesized
catgttctataaaagtacactt

SEQ ID NO: 825883 - DNA, 22 bp, Artificial Sequence
  chemically synthesized
ccatgttctataaaagtacact

SEQ ID NO: 825884 - DNA, 22 bp, Artificial Sequence
  chemically synthesized
tccatgttctataaaagtacac

SEQ ID NO: 825885 - DNA, 22 bp, Artificial Sequence
  chemically synthesized
ttccatgttctataaaagtaca

SEQ ID NO: 825886 - DNA, 22 bp, Artificial Sequence
  chemically synthesized
ttttccatgttctataaaagta

SEQ ID NO: 825887 - DNA, 22 bp, Artificial Sequence
  chemically synthesized
cttttccatgttctataaaagt

SEQ ID NO: 825888 - DNA, 22 bp, Artificial Sequence
  chemically synthesized
tcttttccatgttctataaaag

SEQ ID NO: 825889 - DNA, 22 bp, Artificial Sequence
  chemically synthesized
aaaatctttcttttccatgttc

SEQ ID NO: 825890 - DNA, 22 bp, Artificial Sequence
  chemically synthesized
gaaaatctttcttttccatgtt

SEQ ID NO: 825891 - DNA, 22 bp, Artificial Sequence
  chemically synthesized
tgaaaatctttcttttccatgt

SEQ ID NO: 825892 - DNA, 22 bp, Artificial Sequence
  chemically synthesized
ttgaaaatctttcttttccatg

SEQ ID NO: 825893 - DNA, 22 bp, Artificial Sequence
  chemically synthesized
ttatagaacatggaaaagaaag

SEQ ID NO: 825894 - DNA, 22 bp, Artificial Sequence
  chemically synthesized
tatagaacatggaaaagaaaga

SEQ ID NO: 825895 - DNA, 22 bp, Artificial Sequence
  chemically synthesized
tgtttttgaaaatctttctttt

SEQ ID NO: 825896 - DNA, 22 bp, Artificial Sequence
  chemically synthesized
atagaacatggaaaagaaagat

SEQ ID NO: 825897 - DNA, 22 bp, Artificial Sequence
  chemically synthesized
gtgtttttgaaaatctttcttt

SEQ ID NO: 825898 - DNA, 22 bp, Artificial Sequence
  chemically synthesized
tagaacatggaaaagaaagatt

SEQ ID NO: 825899 - DNA, 22 bp, Artificial Sequence
  chemically synthesized
ttgtgtttttgaaaatctttct

SEQ ID NO: 825900 - DNA, 22 bp, Artificial Sequence
  chemically synthesized
atcactcttgtgtttttgaaaa

SEQ ID NO: 825901 - DNA, 22 bp, Artificial Sequence
  chemically synthesized
aaagtgttaatcactcttgtgt

SEQ ID NO: 825902 - DNA, 22 bp, Artificial Sequence
  chemically synthesized
gaaagtgttaatcactcttgtg

SEQ ID NO: 825903 - DNA, 22 bp, Artificial Sequence
  chemically synthesized
tcaaaaacacaagagtgattaa

SEQ ID NO: 825904 - DNA, 22 bp, Artificial Sequence
  chemically synthesized
caaaaacacaagagtgattaac

SEQ ID NO: 825905 - DNA, 22 bp, Artificial Sequence
  chemically synthesized
aaaaacacaagagtgattaaca

SEQ ID NO: 825906 - DNA, 22 bp, Artificial Sequence
  chemically synthesized
tgagatttgaaagtgttaatca

SEQ ID NO: 825907 - DNA, 22 bp, Artificial Sequence
  chemically synthesized
tgacatctatgagatttgaaag

SEQ ID NO: 825908 - DNA, 22 bp, Artificial Sequence
  chemically synthesized
gtgacatctatgagatttgaaa

SEQ ID NO: 825909 - DNA, 22 bp, Artificial Sequence
  chemically synthesized
tgtcttgtgacatctatgagat

SEQ ID NO: 825910 - DNA, 22 bp, Artificial Sequence
  chemically synthesized
acactttcaaatctcatagatg

SEQ ID NO: 825911 - DNA, 22 bp, Artificial Sequence
  chemically synthesized
ttatgtcttgtgacatctatga

SEQ ID NO: 825912 - DNA, 22 bp, Artificial Sequence
  chemically synthesized
attatgtcttgtgacatctatg

SEQ ID NO: 825913 - DNA, 22 bp, Artificial Sequence
  chemically synthesized
tattatgtcttgtgacatctat

SEQ ID NO: 825914 - DNA, 22 bp, Artificial Sequence
  chemically synthesized
ttattatgtcttgtgacatcta

SEQ ID NO: 825915 - DNA, 22 bp, Artificial Sequence
  chemically synthesized
tcaaatctcatagatgtcacaa

SEQ ID NO: 825916 - DNA, 22 bp, Artificial Sequence
  chemically synthesized
caaatctcatagatgtcacaag

SEQ ID NO: 825917 - DNA, 22 bp, Artificial Sequence
  chemically synthesized
aaatctcatagatgtcacaaga

SEQ ID NO: 825918 - DNA, 22 bp, Artificial Sequence
  chemically synthesized
tgatttttattatgtcttgtga

SEQ ID NO: 825919 - DNA, 22 bp, Artificial Sequence
  chemically synthesized
gttatgatttttattatgtctt

SEQ ID NO: 825920 - DNA, 22 bp, Artificial Sequence
  chemically synthesized
atagatgtcacaagacataata

SEQ ID NO: 825921 - DNA, 22 bp, Artificial Sequence
  chemically synthesized
aaataaatgttagttatgattt

SEQ ID NO: 825922 - DNA, 22 bp, Artificial Sequence
  chemically synthesized
agacagtgtagatattcaaata

SEQ ID NO: 825923 - DNA, 22 bp, Artificial Sequence
  chemically synthesized
cagacagtgtagatattcaaat

SEQ ID NO: 825924 - DNA, 22 bp, Artificial Sequence
  chemically synthesized
acatttatttgaatatctacac

SEQ ID NO: 825925 - DNA, 22 bp, Artificial Sequence
  chemically synthesized
atttgaatatctacactgtctg

SEQ ID NO: 825926 - DNA, 22 bp, Artificial Sequence
  chemically synthesized
tttgaatatctacactgtctga

SEQ ID NO: 825927 - DNA, 22 bp, Artificial Sequence
  chemically synthesized
gaatatctacactgtctgaagc

SEQ ID NO: 825928 - DNA, 22 bp, Artificial Sequence
  chemically synthesized
aatatctacactgtctgaagct

SEQ ID NO: 825929 - DNA, 22 bp, Artificial Sequence
  chemically synthesized
cactgtctgaagctctgtgttg

SEQ ID NO: 825930 - DNA, 22 bp, Artificial Sequence
  chemically synthesized
atgcaaggaaagaacaacacag

SEQ ID NO: 825931 - DNA, 22 bp, Artificial Sequence
  chemically synthesized
tctgaagctctgtgttgttctt

SEQ ID NO: 825932 - DNA, 22 bp, Artificial Sequence
  chemically synthesized
aagctctgtgttgttctttcct

SEQ ID NO: 825933 - DNA, 22 bp, Artificial Sequence
  chemically synthesized
agtgattaatgcaaggaaagaa

SEQ ID NO: 825934 - DNA, 22 bp, Artificial Sequence
  chemically synthesized
tgtgttgttctttccttgcatt

SEQ ID NO: 825935 - DNA, 22 bp, Artificial Sequence
  chemically synthesized
tgttgttctttccttgcattaa

SEQ ID NO: 825936 - DNA, 22 bp, Artificial Sequence
  chemically synthesized
tatgatgattaagtgattaatg

SEQ ID NO: 825937 - DNA, 22 bp, Artificial Sequence
  chemically synthesized
ttctttccttgcattaatcact

SEQ ID NO: 825938 - DNA, 22 bp, Artificial Sequence
  chemically synthesized
tttccttgcattaatcacttaa

SEQ ID NO: 825939 - DNA, 22 bp, Artificial Sequence
  chemically synthesized
tccttgcattaatcacttaatc

SEQ ID NO: 825940 - DNA, 22 bp, Artificial Sequence
  chemically synthesized
ccttgcattaatcacttaatca

SEQ ID NO: 825941 - DNA, 22 bp, Artificial Sequence
  chemically synthesized
cttgcattaatcacttaatcat

SEQ ID NO: 825942 - DNA, 22 bp, Artificial Sequence
  chemically synthesized
taggattgtatgatgattaagt

SEQ ID NO: 825943 - DNA, 22 bp, Artificial Sequence
  chemically synthesized
ataggattgtatgatgattaag

SEQ ID NO: 825944 - DNA, 22 bp, Artificial Sequence
  chemically synthesized
gcattaatcacttaatcatcat

SEQ ID NO: 825945 - DNA, 22 bp, Artificial Sequence
  chemically synthesized
cattaatcacttaatcatcata

SEQ ID NO: 825946 - DNA, 22 bp, Artificial Sequence
  chemically synthesized
tacttataggattgtatgatga

SEQ ID NO: 825947 - DNA, 22 bp, Artificial Sequence
  chemically synthesized
atcacttaatcatcatacaatc

SEQ ID NO: 825948 - DNA, 22 bp, Artificial Sequence
  chemically synthesized
aatcatcatacaatcctataag

SEQ ID NO: 825949 - DNA, 22 bp, Artificial Sequence
  chemically synthesized
atcatcatacaatcctataagt

SEQ ID NO: 825950 - DNA, 22 bp, Artificial Sequence
  chemically synthesized
taagtataattgtttacgttct

SEQ ID NO: 825951 - DNA, 22 bp, Artificial Sequence
  chemically synthesized
cagcaatagaaaaagaacgtaa

SEQ ID NO: 825952 - DNA, 22 bp, Artificial Sequence
  chemically synthesized
tttacgttctttttctattgct

SEQ ID NO: 825953 - DNA, 22 bp, Artificial Sequence
  chemically synthesized
acgttctttttctattgctgca

SEQ ID NO: 825954 - DNA, 22 bp, Artificial Sequence
  chemically synthesized
aatgaggataattgcagcaata

SEQ ID NO: 825955 - DNA, 22 bp, Artificial Sequence
  chemically synthesized
cgttctttttctattgctgcaa

SEQ ID NO: 825956 - DNA, 22 bp, Artificial Sequence
  chemically synthesized
ttaaatgaggataattgcagca

SEQ ID NO: 825957 - DNA, 22 bp, Artificial Sequence
  chemically synthesized
gttaaatgaggataattgcagc

SEQ ID NO: 825958 - DNA, 22 bp, Artificial Sequence
  chemically synthesized
tttttctattgctgcaattatc

SEQ ID NO: 825959 - DNA, 22 bp, Artificial Sequence
  chemically synthesized
tttctattgctgcaattatcct

SEQ ID NO: 825960 - DNA, 22 bp, Artificial Sequence
  chemically synthesized
atttgttaaatgaggataattg

SEQ ID NO: 825961 - DNA, 22 bp, Artificial Sequence
  chemically synthesized
ttctattgctgcaattatcctc

SEQ ID NO: 825962 - DNA, 22 bp, Artificial Sequence
  chemically synthesized
tctattgctgcaattatcctca

SEQ ID NO: 825963 - DNA, 22 bp, Artificial Sequence
  chemically synthesized
ctattgctgcaattatcctcat

SEQ ID NO: 825964 - DNA, 22 bp, Artificial Sequence
  chemically synthesized
ctcatttgttaaatgaggataa

SEQ ID NO: 825965 - DNA, 22 bp, Artificial Sequence
  chemically synthesized
tattgctgcaattatcctcatt

SEQ ID NO: 825966 - DNA, 22 bp, Artificial Sequence
  chemically synthesized
cctcatttgttaaatgaggata

SEQ ID NO: 825967 - DNA, 22 bp, Artificial Sequence
  chemically synthesized
ttgctgcaattatcctcattta

SEQ ID NO: 825968 - DNA, 22 bp, Artificial Sequence
  chemically synthesized
tttcctcatttgttaaatgagg

SEQ ID NO: 825969 - DNA, 22 bp, Artificial Sequence
  chemically synthesized
atttcctcatttgttaaatgag

SEQ ID NO: 825970 - DNA, 22 bp, Artificial Sequence
  chemically synthesized
ctgcaattatcctcatttaaca

SEQ ID NO: 825971 - DNA, 22 bp, Artificial Sequence
  chemically synthesized
tatttcctcatttgttaaatga

SEQ ID NO: 825972 - DNA, 22 bp, Artificial Sequence
  chemically synthesized
caattatcctcatttaacaaat

SEQ ID NO: 825973 - DNA, 22 bp, Artificial Sequence
  chemically synthesized
tctttatttcctcatttgttaa

SEQ ID NO: 825974 - DNA, 22 bp, Artificial Sequence
  chemically synthesized
tcctcatttaacaaatgaggaa

SEQ ID NO: 825975 - DNA, 22 bp, Artificial Sequence
  chemically synthesized
acgctgtctttatttcctcatt

SEQ ID NO: 825976 - DNA, 22 bp, Artificial Sequence
  chemically synthesized
aacgctgtctttatttcctcat

SEQ ID NO: 825977 - DNA, 22 bp, Artificial Sequence
  chemically synthesized
atttaacaaatgaggaaataaa

SEQ ID NO: 825978 - DNA, 22 bp, Artificial Sequence
  chemically synthesized
tttaacgctgtctttatttcct

SEQ ID NO: 825979 - DNA, 22 bp, Artificial Sequence
  chemically synthesized
aacaaatgaggaaataaagaca

SEQ ID NO: 825980 - DNA, 22 bp, Artificial Sequence
  chemically synthesized
acaaatgaggaaataaagacag

SEQ ID NO: 825981 - DNA, 22 bp, Artificial Sequence
  chemically synthesized
gaccagttatttaacgctgtct

SEQ ID NO: 825982 - DNA, 22 bp, Artificial Sequence
  chemically synthesized
agaccagttatttaacgctgtc

SEQ ID NO: 825983 - DNA, 22 bp, Artificial Sequence
  chemically synthesized
tgtgaccttagaccagttattt

SEQ ID NO: 825984 - DNA, 22 bp, Artificial Sequence
  chemically synthesized
tctatgtgaccttagaccagtt

SEQ ID NO: 825985 - DNA, 22 bp, Artificial Sequence
  chemically synthesized
aataactggtctaaggtcacat

SEQ ID NO: 825986 - DNA, 22 bp, Artificial Sequence
  chemically synthesized
acaatcactatctatgtgacct

SEQ ID NO: 825987 - DNA, 22 bp, Artificial Sequence
  chemically synthesized
taacaatcactatctatgtgac

SEQ ID NO: 825988 - DNA, 22 bp, Artificial Sequence
  chemically synthesized
gtctaaggtcacatagatagtg

SEQ ID NO: 825989 - DNA, 22 bp, Artificial Sequence
  chemically synthesized
aggtcacatagatagtgattgt

SEQ ID NO: 825990 - DNA, 22 bp, Artificial Sequence
  chemically synthesized
aatccaagtgtcggctctaaca

SEQ ID NO: 825991 - DNA, 22 bp, Artificial Sequence
  chemically synthesized
gaatccaagtgtcggctctaac

SEQ ID NO: 825992 - DNA, 22 bp, Artificial Sequence
  chemically synthesized
ttgaatccaagtgtcggctcta

SEQ ID NO: 825993 - DNA, 22 bp, Artificial Sequence
  chemically synthesized
cttgaatccaagtgtcggctct

SEQ ID NO: 825994 - DNA, 22 bp, Artificial Sequence
  chemically synthesized
acttcttgaatccaagtgtcgg

SEQ ID NO: 825995 - DNA, 22 bp, Artificial Sequence
  chemically synthesized
ttagagccgacacttggattca

SEQ ID NO: 825996 - DNA, 22 bp, Artificial Sequence
  chemically synthesized
gaggtctaacttcttgaatcca

SEQ ID NO: 825997 - DNA, 22 bp, Artificial Sequence
  chemically synthesized
gagccgacacttggattcaaga

SEQ ID NO: 825998 - DNA, 22 bp, Artificial Sequence
  chemically synthesized
ggaggtctaacttcttgaatcc

SEQ ID NO: 825999 - DNA, 22 bp, Artificial Sequence
  chemically synthesized
tggaggtctaacttcttgaatc

SEQ ID NO: 826000 - DNA, 22 bp, Artificial Sequence
  chemically synthesized
gcatgggctttggaggtctaac

SEQ ID NO: 826001 - DNA, 22 bp, Artificial Sequence
  chemically synthesized
ggattcaagaagttagacctcc

SEQ ID NO: 826002 - DNA, 22 bp, Artificial Sequence
  chemically synthesized
ggcatgggctttggaggtctaa

SEQ ID NO: 826003 - DNA, 22 bp, Artificial Sequence
  chemically synthesized
gattcaagaagttagacctcca

SEQ ID NO: 826004 - DNA, 22 bp, Artificial Sequence
  chemically synthesized
tggcatgggctttggaggtcta

SEQ ID NO: 826005 - DNA, 22 bp, Artificial Sequence
  chemically synthesized
ttggcatgggctttggaggtct

SEQ ID NO: 826006 - DNA, 22 bp, Artificial Sequence
  chemically synthesized
aagaagttagacctccaaagcc

SEQ ID NO: 826007 - DNA, 22 bp, Artificial Sequence
  chemically synthesized
gacctccaaagcccatgccaaa

SEQ ID NO: 826008 - DNA, 22 bp, Artificial Sequence
  chemically synthesized
caaagcccatgccaaaagtatc

SEQ ID NO: 826009 - DNA, 22 bp, Artificial Sequence
  chemically synthesized
catgtggccaaagccaatggat

SEQ ID NO: 826010 - DNA, 22 bp, Artificial Sequence
  chemically synthesized
agggaattccatgtggccaaag

SEQ ID NO: 826011 - DNA, 22 bp, Artificial Sequence
  chemically synthesized
cagggaattccatgtggccaaa

SEQ ID NO: 826012 - DNA, 22 bp, Artificial Sequence
  chemically synthesized
gctttggccacatggaattccc

SEQ ID NO: 826013 - DNA, 22 bp, Artificial Sequence
  chemically synthesized
tgtatggtcttcagggaattcc

SEQ ID NO: 826014 - DNA, 22 bp, Artificial Sequence
  chemically synthesized
gtgtatggtcttcagggaattc

SEQ ID NO: 826015 - DNA, 22 bp, Artificial Sequence
  chemically synthesized
tgtgtatggtcttcagggaatt

SEQ ID NO: 826016 - DNA, 22 bp, Artificial Sequence
  chemically synthesized
tggccacatggaattccctgaa

SEQ ID NO: 826017 - DNA, 22 bp, Artificial Sequence
  chemically synthesized
ggccacatggaattccctgaag

SEQ ID NO: 826018 - DNA, 22 bp, Artificial Sequence
  chemically synthesized
gccacatggaattccctgaaga

SEQ ID NO: 826019 - DNA, 22 bp, Artificial Sequence
  chemically synthesized
aaatcattttgtgtatggtctt

SEQ ID NO: 826020 - DNA, 22 bp, Artificial Sequence
  chemically synthesized
cactgaaatcattttgtgtatg

SEQ ID NO: 826021 - DNA, 22 bp, Artificial Sequence
  chemically synthesized
cctgaagaccatacacaaaatg

SEQ ID NO: 826022 - DNA, 22 bp, Artificial Sequence
  chemically synthesized
ccactgcactgaaatcattttg

SEQ ID NO: 826023 - DNA, 22 bp, Artificial Sequence
  chemically synthesized
aagaccatacacaaaatgattt

SEQ ID NO: 826024 - DNA, 22 bp, Artificial Sequence
  chemically synthesized
taccactgcactgaaatcattt

SEQ ID NO: 826025 - DNA, 22 bp, Artificial Sequence
  chemically synthesized
ctaccactgcactgaaatcatt

SEQ ID NO: 826026 - DNA, 22 bp, Artificial Sequence
  chemically synthesized
cagtaagatttctaccactgca

SEQ ID NO: 826027 - DNA, 22 bp, Artificial Sequence
  chemically synthesized
ctacagtaagatttctaccact

SEQ ID NO: 826028 - DNA, 22 bp, Artificial Sequence
  chemically synthesized
atctcctacagtaagatttcta

SEQ ID NO: 826029 - DNA, 22 bp, Artificial Sequence
  chemically synthesized
cagtgcagtggtagaaatctta

SEQ ID NO: 826030 - DNA, 22 bp, Artificial Sequence
  chemically synthesized
aatctcctacagtaagatttct

SEQ ID NO: 826031 - DNA, 22 bp, Artificial Sequence
  chemically synthesized
agtgcagtggtagaaatcttac

SEQ ID NO: 826032 - DNA, 22 bp, Artificial Sequence
  chemically synthesized
taatctcctacagtaagatttc

SEQ ID NO: 826033 - DNA, 22 bp, Artificial Sequence
  chemically synthesized
ttaatctcctacagtaagattt

SEQ ID NO: 826034 - DNA, 22 bp, Artificial Sequence
  chemically synthesized
tttaatctcctacagtaagatt

SEQ ID NO: 826035 - DNA, 22 bp, Artificial Sequence
  chemically synthesized
ataggtattttttaatctccta

SEQ ID NO: 826036 - DNA, 22 bp, Artificial Sequence
  chemically synthesized
cataggtattttttaatctcct

SEQ ID NO: 826037 - DNA, 22 bp, Artificial Sequence
  chemically synthesized
tcataggtattttttaatctcc

SEQ ID NO: 826038 - DNA, 22 bp, Artificial Sequence
  chemically synthesized
ttcataggtattttttaatctc

SEQ ID NO: 826039 - DNA, 22 bp, Artificial Sequence
  chemically synthesized
tttcataggtattttttaatct

SEQ ID NO: 826040 - DNA, 22 bp, Artificial Sequence
  chemically synthesized
ctttttcataggtattttttaa

SEQ ID NO: 826041 - DNA, 22 bp, Artificial Sequence
  chemically synthesized
actgtaggagattaaaaaatac

SEQ ID NO: 826042 - DNA, 22 bp, Artificial Sequence
  chemically synthesized
actttttcataggtatttttta

SEQ ID NO: 826043 - DNA, 22 bp, Artificial Sequence
  chemically synthesized
ctgtaggagattaaaaaatacc

SEQ ID NO: 826044 - DNA, 22 bp, Artificial Sequence
  chemically synthesized
taggagattaaaaaatacctat

SEQ ID NO: 826045 - DNA, 22 bp, Artificial Sequence
  chemically synthesized
tccttactttttcataggtatt

SEQ ID NO: 826046 - DNA, 22 bp, Artificial Sequence
  chemically synthesized
ctgtccttactttttcataggt

SEQ ID NO: 826047 - DNA, 22 bp, Artificial Sequence
  chemically synthesized
actgtccttactttttcatagg

SEQ ID NO: 826048 - DNA, 22 bp, Artificial Sequence
  chemically synthesized
aaaaatacctatgaaaaagtaa

SEQ ID NO: 826049 - DNA, 22 bp, Artificial Sequence
  chemically synthesized
caatttactgtccttacttttt

SEQ ID NO: 826050 - DNA, 22 bp, Artificial Sequence
  chemically synthesized
gatagtctacaatttactgtcc

SEQ ID NO: 826051 - DNA, 22 bp, Artificial Sequence
  chemically synthesized
tgaaaaagtaaggacagtaaat

SEQ ID NO: 826052 - DNA, 22 bp, Artificial Sequence
  chemically synthesized
tggttggatagtctacaattta

SEQ ID NO: 826053 - DNA, 22 bp, Artificial Sequence
  chemically synthesized
taatgatctatggttggatagt

SEQ ID NO: 826054 - DNA, 22 bp, Artificial Sequence
  chemically synthesized
ataatgatctatggttggatag

SEQ ID NO: 826055 - DNA, 22 bp, Artificial Sequence
  chemically synthesized
ttataatgatctatggttggat

SEQ ID NO: 826056 - DNA, 22 bp, Artificial Sequence
  chemically synthesized
cttataatgatctatggttgga

SEQ ID NO: 826057 - DNA, 22 bp, Artificial Sequence
  chemically synthesized
cttcttataatgatctatggtt

SEQ ID NO: 826058 - DNA, 22 bp, Artificial Sequence
  chemically synthesized
ccttcttataatgatctatggt

SEQ ID NO: 826059 - DNA, 22 bp, Artificial Sequence
  chemically synthesized
tagactatccaaccatagatca

SEQ ID NO: 826060 - DNA, 22 bp, Artificial Sequence
  chemically synthesized
acttccttcttataatgatcta

SEQ ID NO: 826061 - DNA, 22 bp, Artificial Sequence
  chemically synthesized
tgacttccttcttataatgatc

SEQ ID NO: 826062 - DNA, 22 bp, Artificial Sequence
  chemically synthesized
tccaaccatagatcattataag

SEQ ID NO: 826063 - DNA, 22 bp, Artificial Sequence
  chemically synthesized
ccctctgacttccttcttataa

SEQ ID NO: 826064 - DNA, 22 bp, Artificial Sequence
  chemically synthesized
acaccaaactcccctctgactt

SEQ ID NO: 826065 - DNA, 22 bp, Artificial Sequence
  chemically synthesized
gacaccaaactcccctctgact

SEQ ID NO: 826066 - DNA, 22 bp, Artificial Sequence
  chemically synthesized
ttgacaccaaactcccctctga

SEQ ID NO: 826067 - DNA, 22 bp, Artificial Sequence
  chemically synthesized
taagaaggaagtcagaggggag

SEQ ID NO: 826068 - DNA, 22 bp, Artificial Sequence
  chemically synthesized
tcttgacaccaaactcccctct

SEQ ID NO: 826069 - DNA, 22 bp, Artificial Sequence
  chemically synthesized
ctcttgacaccaaactcccctc

SEQ ID NO: 826070 - DNA, 22 bp, Artificial Sequence
  chemically synthesized
ggaaaaaacttctcttgacacc

SEQ ID NO: 826071 - DNA, 22 bp, Artificial Sequence
  chemically synthesized
gggaaaaaacttctcttgacac

SEQ ID NO: 826072 - DNA, 22 bp, Artificial Sequence
  chemically synthesized
catatttgggaaaaaacttctc

SEQ ID NO: 826073 - DNA, 22 bp, Artificial Sequence
  chemically synthesized
ccatatttgggaaaaaacttct

SEQ ID NO: 826074 - DNA, 22 bp, Artificial Sequence
  chemically synthesized
tccatatttgggaaaaaacttc

SEQ ID NO: 826075 - DNA, 22 bp, Artificial Sequence
  chemically synthesized
ggtgtcaagagaagttttttcc

SEQ ID NO: 826076 - DNA, 22 bp, Artificial Sequence
  chemically synthesized
gtgtcaagagaagttttttccc

SEQ ID NO: 826077 - DNA, 22 bp, Artificial Sequence
  chemically synthesized
aagttttccatatttgggaaaa

SEQ ID NO: 826078 - DNA, 22 bp, Artificial Sequence
  chemically synthesized
atactcaagttttccatatttg

SEQ ID NO: 826079 - DNA, 22 bp, Artificial Sequence
  chemically synthesized
tattcatactcaagttttccat

SEQ ID NO: 826080 - DNA, 22 bp, Artificial Sequence
  chemically synthesized
tttcccaaatatggaaaacttg

SEQ ID NO: 826081 - DNA, 22 bp, Artificial Sequence
  chemically synthesized
ttcccaaatatggaaaacttga

SEQ ID NO: 826082 - DNA, 22 bp, Artificial Sequence
  chemically synthesized
tcccaaatatggaaaacttgag

SEQ ID NO: 826083 - DNA, 22 bp, Artificial Sequence
  chemically synthesized
cccaaatatggaaaacttgagt

SEQ ID NO: 826084 - DNA, 22 bp, Artificial Sequence
  chemically synthesized
ccaaatatggaaaacttgagta

SEQ ID NO: 826085 - DNA, 22 bp, Artificial Sequence
  chemically synthesized
cccaatcaatacctatattcat

SEQ ID NO: 826086 - DNA, 22 bp, Artificial Sequence
  chemically synthesized
ccccaatcaatacctatattca

SEQ ID NO: 826087 - DNA, 22 bp, Artificial Sequence
  chemically synthesized
tccccaatcaatacctatattc

SEQ ID NO: 826088 - DNA, 22 bp, Artificial Sequence
  chemically synthesized
gagtatgaatataggtattgat

SEQ ID NO: 826089 - DNA, 22 bp, Artificial Sequence
  chemically synthesized
agtatgaatataggtattgatt

SEQ ID NO: 826090 - DNA, 22 bp, Artificial Sequence
  chemically synthesized
accattttccccaatcaatacc

SEQ ID NO: 826091 - DNA, 22 bp, Artificial Sequence
  chemically synthesized
gaccattttccccaatcaatac

SEQ ID NO: 826092 - DNA, 22 bp, Artificial Sequence
  chemically synthesized
tgaccattttccccaatcaata

SEQ ID NO: 826093 - DNA, 22 bp, Artificial Sequence
  chemically synthesized
ttgaccattttccccaatcaat

SEQ ID NO: 826094 - DNA, 22 bp, Artificial Sequence
  chemically synthesized
tcttttgaccattttccccaat

SEQ ID NO: 826095 - DNA, 22 bp, Artificial Sequence
  chemically synthesized
gtcttttgaccattttccccaa

SEQ ID NO: 826096 - DNA, 22 bp, Artificial Sequence
  chemically synthesized
tgtcttttgaccattttcccca

SEQ ID NO: 826097 - DNA, 22 bp, Artificial Sequence
  chemically synthesized
attggggaaaatggtcaaaaga

SEQ ID NO: 826098 - DNA, 22 bp, Artificial Sequence
  chemically synthesized
gcatcatctttgtcttttgacc

SEQ ID NO: 826099 - DNA, 22 bp, Artificial Sequence
  chemically synthesized
gggaaaatggtcaaaagacaaa

SEQ ID NO: 826100 - DNA, 22 bp, Artificial Sequence
  chemically synthesized
catctggcatcatctttgtctt

SEQ ID NO: 826101 - DNA, 22 bp, Artificial Sequence
  chemically synthesized
ccatctggcatcatctttgtct

SEQ ID NO: 826102 - DNA, 22 bp, Artificial Sequence
  chemically synthesized
ttccatctggcatcatctttgt

SEQ ID NO: 826103 - DNA, 22 bp, Artificial Sequence
  chemically synthesized
cttccatctggcatcatctttg

SEQ ID NO: 826104 - DNA, 22 bp, Artificial Sequence
  chemically synthesized
tcttccatctggcatcatcttt

SEQ ID NO: 826105 - DNA, 22 bp, Artificial Sequence
  chemically synthesized
ttcttccatctggcatcatctt

SEQ ID NO: 826106 - DNA, 22 bp, Artificial Sequence
  chemically synthesized
agggacttttcttccatctggc

SEQ ID NO: 826107 - DNA, 22 bp, Artificial Sequence
  chemically synthesized
tcagggacttttcttccatctg

SEQ ID NO: 826108 - DNA, 22 bp, Artificial Sequence
  chemically synthesized
ctcagggacttttcttccatct

SEQ ID NO: 826109 - DNA, 22 bp, Artificial Sequence
  chemically synthesized
aatacacgcaccttctcaggga

SEQ ID NO: 826110 - DNA, 22 bp, Artificial Sequence
  chemically synthesized
atgttcaatacacgcaccttct

SEQ ID NO: 826111 - DNA, 22 bp, Artificial Sequence
  chemically synthesized
gttaatgttcaatacacgcacc

SEQ ID NO: 826112 - DNA, 22 bp, Artificial Sequence
  chemically synthesized
agaaggtgcgtgtattgaacat

SEQ ID NO: 826113 - DNA, 22 bp, Artificial Sequence
  chemically synthesized
aacattaactaactacctcctt

SEQ ID NO: 826114 - DNA, 22 bp, Artificial Sequence
  chemically synthesized
actaactacctccttctcctgt

SEQ ID NO: 826115 - DNA, 22 bp, Artificial Sequence
  chemically synthesized
actacctccttctcctgtgttt

SEQ ID NO: 826116 - DNA, 22 bp, Artificial Sequence
  chemically synthesized
cctccttctcctgtgtttcccc

SEQ ID NO: 826117 - DNA, 22 bp, Artificial Sequence
  chemically synthesized
cttctcctgtgtttcccctgtt

SEQ ID NO: 826118 - DNA, 22 bp, Artificial Sequence
  chemically synthesized
ctcctgtgtttcccctgttatt

SEQ ID NO: 826119 - DNA, 22 bp, Artificial Sequence
  chemically synthesized
cacaaatggaaaaataacaggg

SEQ ID NO: 826120 - DNA, 22 bp, Artificial Sequence
  chemically synthesized
tcctgtgtttcccctgttattt

SEQ ID NO: 826121 - DNA, 22 bp, Artificial Sequence
  chemically synthesized
ctgtgtttcccctgttattttt

SEQ ID NO: 826122 - DNA, 22 bp, Artificial Sequence
  chemically synthesized
tgtttcccctgttatttttcca

SEQ ID NO: 826123 - DNA, 22 bp, Artificial Sequence
  chemically synthesized
cccctgttatttttccatttgt

SEQ ID NO: 826124 - DNA, 22 bp, Artificial Sequence
  chemically synthesized
tgggaaaactgcacaaatggaa

SEQ ID NO: 826125 - DNA, 22 bp, Artificial Sequence
  chemically synthesized
ccctgttatttttccatttgtg

SEQ ID NO: 826126 - DNA, 22 bp, Artificial Sequence
  chemically synthesized
ttgtgggaaaactgcacaaatg

SEQ ID NO: 826127 - DNA, 22 bp, Artificial Sequence
  chemically synthesized
ttatttttccatttgtgcagtt

SEQ ID NO: 826128 - DNA, 22 bp, Artificial Sequence
  chemically synthesized
tttttccatttgtgcagttttc

SEQ ID NO: 826129 - DNA, 22 bp, Artificial Sequence
  chemically synthesized
ttccatttgtgcagttttccca

SEQ ID NO: 826130 - DNA, 22 bp, Artificial Sequence
  chemically synthesized
tccatttgtgcagttttcccac

SEQ ID NO: 826131 - DNA, 22 bp, Artificial Sequence
  chemically synthesized
ccatttgtgcagttttcccaca

SEQ ID NO: 826132 - DNA, 22 bp, Artificial Sequence
  chemically synthesized
catttgtgcagttttcccacaa

SEQ ID NO: 826133 - DNA, 22 bp, Artificial Sequence
  chemically synthesized
gtgcagttttcccacaatagac

SEQ ID NO: 826134 - DNA, 22 bp, Artificial Sequence
  chemically synthesized
tgcagttttcccacaatagacc

SEQ ID NO: 826135 - DNA, 22 bp, Artificial Sequence
  chemically synthesized
tcccacaatagacctctctttg

SEQ ID NO: 826136 - DNA, 22 bp, Artificial Sequence
  chemically synthesized
cccacaatagacctctctttgc

SEQ ID NO: 826137 - DNA, 22 bp, Artificial Sequence
  chemically synthesized
ccacaatagacctctctttgct

SEQ ID NO: 826138 - DNA, 22 bp, Artificial Sequence
  chemically synthesized
agtacacaccatccacagagca

SEQ ID NO: 826139 - DNA, 22 bp, Artificial Sequence
  chemically synthesized
aaactaagtacacaccatccac

SEQ ID NO: 826140 - DNA, 22 bp, Artificial Sequence
  chemically synthesized
tctttgctctgtggatggtgtg

SEQ ID NO: 826141 - DNA, 22 bp, Artificial Sequence
  chemically synthesized
tttgctctgtggatggtgtgta

SEQ ID NO: 826142 - DNA, 22 bp, Artificial Sequence
  chemically synthesized
tgctctgtggatggtgtgtact

SEQ ID NO: 826143 - DNA, 22 bp, Artificial Sequence
  chemically synthesized
gctctgtggatggtgtgtactt

SEQ ID NO: 826144 - DNA, 22 bp, Artificial Sequence
  chemically synthesized
ctctgtggatggtgtgtactta

SEQ ID NO: 826145 - DNA, 22 bp, Artificial Sequence
  chemically synthesized
tgtggatggtgtgtacttagtt

SEQ ID NO: 826146 - DNA, 22 bp, Artificial Sequence
  chemically synthesized
tggatggtgtgtacttagtttt

SEQ ID NO: 826147 - DNA, 22 bp, Artificial Sequence
  chemically synthesized
aagccagggagatgagttaaaa

SEQ ID NO: 826148 - DNA, 22 bp, Artificial Sequence
  chemically synthesized
accactaaagccagggagatga

SEQ ID NO: 826149 - DNA, 22 bp, Artificial Sequence
  chemically synthesized
agttttaactcatctccctggc

SEQ ID NO: 826150 - DNA, 22 bp, Artificial Sequence
  chemically synthesized
gttttaactcatctccctggct

SEQ ID NO: 826151 - DNA, 22 bp, Artificial Sequence
  chemically synthesized
aattaaccactaaagccaggga

SEQ ID NO: 826152 - DNA, 22 bp, Artificial Sequence
  chemically synthesized
gaattaaccactaaagccaggg

SEQ ID NO: 826153 - DNA, 22 bp, Artificial Sequence
  chemically synthesized
tgaattaaccactaaagccagg

SEQ ID NO: 826154 - DNA, 22 bp, Artificial Sequence
  chemically synthesized
taactcatctccctggctttag

SEQ ID NO: 826155 - DNA, 22 bp, Artificial Sequence
  chemically synthesized
aactcatctccctggctttagt

SEQ ID NO: 826156 - DNA, 22 bp, Artificial Sequence
  chemically synthesized
actcatctccctggctttagtg

SEQ ID NO: 826157 - DNA, 22 bp, Artificial Sequence
  chemically synthesized
atctccctggctttagtggtta

SEQ ID NO: 826158 - DNA, 22 bp, Artificial Sequence
  chemically synthesized
cctggctttagtggttaattca

SEQ ID NO: 826159 - DNA, 22 bp, Artificial Sequence
  chemically synthesized
gctttagtggttaattcaaaga

SEQ ID NO: 826160 - DNA, 22 bp, Artificial Sequence
  chemically synthesized
gaaccataagtccatctttgaa

SEQ ID NO: 826161 - DNA, 22 bp, Artificial Sequence
  chemically synthesized
ggaaccataagtccatctttga

SEQ ID NO: 826162 - DNA, 22 bp, Artificial Sequence
  chemically synthesized
tagtggttaattcaaagatgga

SEQ ID NO: 826163 - DNA, 22 bp, Artificial Sequence
  chemically synthesized
agtggttaattcaaagatggac

SEQ ID NO: 826164 - DNA, 22 bp, Artificial Sequence
  chemically synthesized
gtggttaattcaaagatggact

SEQ ID NO: 826165 - DNA, 22 bp, Artificial Sequence
  chemically synthesized
cttggaaccataagtccatctt

SEQ ID NO: 826166 - DNA, 22 bp, Artificial Sequence
  chemically synthesized
acttggaaccataagtccatct

SEQ ID NO: 826167 - DNA, 22 bp, Artificial Sequence
  chemically synthesized
accttacttggaaccataagtc

SEQ ID NO: 826168 - DNA, 22 bp, Artificial Sequence
  chemically synthesized
attcaaagatggacttatggtt

SEQ ID NO: 826169 - DNA, 22 bp, Artificial Sequence
  chemically synthesized
attgaccttacttggaaccata

SEQ ID NO: 826170 - DNA, 22 bp, Artificial Sequence
  chemically synthesized
aaagatggacttatggttccaa

SEQ ID NO: 826171 - DNA, 22 bp, Artificial Sequence
  chemically synthesized
tgattgaccttacttggaacca

SEQ ID NO: 826172 - DNA, 22 bp, Artificial Sequence
  chemically synthesized
gttctgattgaccttacttgga

SEQ ID NO: 826173 - DNA, 22 bp, Artificial Sequence
  chemically synthesized
attggttctgattgaccttact

SEQ ID NO: 826174 - DNA, 22 bp, Artificial Sequence
  chemically synthesized
cattggttctgattgaccttac

SEQ ID NO: 826175 - DNA, 22 bp, Artificial Sequence
  chemically synthesized
atggttccaagtaaggtcaatc

SEQ ID NO: 826176 - DNA, 22 bp, Artificial Sequence
  chemically synthesized
tggttccaagtaaggtcaatca

SEQ ID NO: 826177 - DNA, 22 bp, Artificial Sequence
  chemically synthesized
tttcattggttctgattgacct

SEQ ID NO: 826178 - DNA, 22 bp, Artificial Sequence
  chemically synthesized
caagtaaggtcaatcagaacca

SEQ ID NO: 826179 - DNA, 22 bp, Artificial Sequence
  chemically synthesized
gagttgtttcattggttctgat

SEQ ID NO: 826180 - DNA, 22 bp, Artificial Sequence
  chemically synthesized
taggatttttgttgttgttgtt

SEQ ID NO: 826181 - DNA, 22 bp, Artificial Sequence
  chemically synthesized
ggatttttgttgttgttgttgt

SEQ ID NO: 826182 - DNA, 22 bp, Artificial Sequence
  chemically synthesized
gaatcacgaacaacaacaacaa

SEQ ID NO: 826183 - DNA, 22 bp, Artificial Sequence
  chemically synthesized
agaatcacgaacaacaacaaca

SEQ ID NO: 826184 - DNA, 22 bp, Artificial Sequence
  chemically synthesized
tagaatcacgaacaacaacaac

SEQ ID NO: 826185 - DNA, 22 bp, Artificial Sequence
  chemically synthesized
ttagaatcacgaacaacaacaa

SEQ ID NO: 826186 - DNA, 22 bp, Artificial Sequence
  chemically synthesized
ttttagaatcacgaacaacaac

SEQ ID NO: 826187 - DNA, 22 bp, Artificial Sequence
  chemically synthesized
ttgttgttgttgttgttgttcg

SEQ ID NO: 826188 - DNA, 22 bp, Artificial Sequence
  chemically synthesized
tgttgttgttgttgttgttcgt

SEQ ID NO: 826189 - DNA, 22 bp, Artificial Sequence
  chemically synthesized
tcttttagaatcacgaacaaca

SEQ ID NO: 826190 - DNA, 22 bp, Artificial Sequence
  chemically synthesized
gttgttgttgttgttgttcgtg

SEQ ID NO: 826191 - DNA, 22 bp, Artificial Sequence
  chemically synthesized
ctcttttagaatcacgaacaac

SEQ ID NO: 826192 - DNA, 22 bp, Artificial Sequence
  chemically synthesized
ttgttgttgttgttgttcgtga

SEQ ID NO: 826193 - DNA, 22 bp, Artificial Sequence
  chemically synthesized
tctcttttagaatcacgaacaa

SEQ ID NO: 826194 - DNA, 22 bp, Artificial Sequence
  chemically synthesized
ttgttgttgttgttcgtgattc

SEQ ID NO: 826195 - DNA, 22 bp, Artificial Sequence
  chemically synthesized
ttgttgttgttcgtgattctaa

SEQ ID NO: 826196 - DNA, 22 bp, Artificial Sequence
  chemically synthesized
ttgttgttcgtgattctaaaag

SEQ ID NO: 826197 - DNA, 22 bp, Artificial Sequence
  chemically synthesized
ttgttcgtgattctaaaagaga

SEQ ID NO: 826198 - DNA, 22 bp, Artificial Sequence
  chemically synthesized
ttcgtgattctaaaagagaaaa

SEQ ID NO: 826199 - DNA, 22 bp, Artificial Sequence
  chemically synthesized
gtgattctaaaagagaaaaccc

SEQ ID NO: 826200 - DNA, 22 bp, Artificial Sequence
  chemically synthesized
aacaagaagcaatgggttttct

SEQ ID NO: 826201 - DNA, 22 bp, Artificial Sequence
  chemically synthesized
aaacaagaagcaatgggttttc

SEQ ID NO: 826202 - DNA, 22 bp, Artificial Sequence
  chemically synthesized
taaaagagaaaacccattgctt

SEQ ID NO: 826203 - DNA, 22 bp, Artificial Sequence
  chemically synthesized
aaagagaaaacccattgcttct

SEQ ID NO: 826204 - DNA, 22 bp, Artificial Sequence
  chemically synthesized
atccatcttaaacaagaagcaa

SEQ ID NO: 826205 - DNA, 22 bp, Artificial Sequence
  chemically synthesized
tcatccatcttaaacaagaagc

SEQ ID NO: 826206 - DNA, 22 bp, Artificial Sequence
  chemically synthesized
ctcatccatcttaaacaagaag

SEQ ID NO: 826207 - DNA, 22 bp, Artificial Sequence
  chemically synthesized
tctcatccatcttaaacaagaa

SEQ ID NO: 826208 - DNA, 22 bp, Artificial Sequence
  chemically synthesized
cgtgctttctcatccatcttaa

SEQ ID NO: 826209 - DNA, 22 bp, Artificial Sequence
  chemically synthesized
cttcttgtttaagatggatgag

SEQ ID NO: 826210 - DNA, 22 bp, Artificial Sequence
  chemically synthesized
cttgtttaagatggatgagaaa

SEQ ID NO: 826211 - DNA, 22 bp, Artificial Sequence
  chemically synthesized
ttgtttaagatggatgagaaag

SEQ ID NO: 826212 - DNA, 22 bp, Artificial Sequence
  chemically synthesized
cagaactacgtgctttctcatc

SEQ ID NO: 826213 - DNA, 22 bp, Artificial Sequence
  chemically synthesized
gtttaagatggatgagaaagca

SEQ ID NO: 826214 - DNA, 22 bp, Artificial Sequence
  chemically synthesized
tttaagatggatgagaaagcac

SEQ ID NO: 826215 - DNA, 22 bp, Artificial Sequence
  chemically synthesized
aagatggatgagaaagcacgta

SEQ ID NO: 826216 - DNA, 22 bp, Artificial Sequence
  chemically synthesized
agatggatgagaaagcacgtag

SEQ ID NO: 826217 - DNA, 22 bp, Artificial Sequence
  chemically synthesized
agatggatatcaggatactgca

SEQ ID NO: 826218 - DNA, 22 bp, Artificial Sequence
  chemically synthesized
taagatggatatcaggatactg

SEQ ID NO: 826219 - DNA, 22 bp, Artificial Sequence
  chemically synthesized
ttctaagatggatatcaggata

SEQ ID NO: 826220 - DNA, 22 bp, Artificial Sequence
  chemically synthesized
attgttctaagatggatatcag

SEQ ID NO: 826221 - DNA, 22 bp, Artificial Sequence
  chemically synthesized
aattgttctaagatggatatca

SEQ ID NO: 826222 - DNA, 22 bp, Artificial Sequence
  chemically synthesized
tgcagtatcctgatatccatct

SEQ ID NO: 826223 - DNA, 22 bp, Artificial Sequence
  chemically synthesized
ttaattgttctaagatggatat

SEQ ID NO: 826224 - DNA, 22 bp, Artificial Sequence
  chemically synthesized
cagtatcctgatatccatctta

SEQ ID NO: 826225 - DNA, 22 bp, Artificial Sequence
  chemically synthesized
ctcttaattgttctaagatgga

SEQ ID NO: 826226 - DNA, 22 bp, Artificial Sequence
  chemically synthesized
attcctcttaattgttctaaga

SEQ ID NO: 826227 - DNA, 22 bp, Artificial Sequence
  chemically synthesized
aattcctcttaattgttctaag

SEQ ID NO: 826228 - DNA, 22 bp, Artificial Sequence
  chemically synthesized
atatccatcttagaacaattaa

SEQ ID NO: 826229 - DNA, 22 bp, Artificial Sequence
  chemically synthesized
cgtttaattcctcttaattgtt

SEQ ID NO: 826230 - DNA, 22 bp, Artificial Sequence
  chemically synthesized
ttccgtttaattcctcttaatt

SEQ ID NO: 826231 - DNA, 22 bp, Artificial Sequence
  chemically synthesized
gttccgtttaattcctcttaat

SEQ ID NO: 826232 - DNA, 22 bp, Artificial Sequence
  chemically synthesized
agaacaattaagaggaattaaa

SEQ ID NO: 826233 - DNA, 22 bp, Artificial Sequence
  chemically synthesized
gaacaattaagaggaattaaac

SEQ ID NO: 826234 - DNA, 22 bp, Artificial Sequence
  chemically synthesized
cccagtatttgttccgtttaat

SEQ ID NO: 826235 - DNA, 22 bp, Artificial Sequence
  chemically synthesized
ctccccagtatttgttccgttt

SEQ ID NO: 826236 - DNA, 22 bp, Artificial Sequence
  chemically synthesized
tgctccccagtatttgttccgt

SEQ ID NO: 826237 - DNA, 22 bp, Artificial Sequence
  chemically synthesized
agaggaattaaacggaacaaat

SEQ ID NO: 826238 - DNA, 22 bp, Artificial Sequence
  chemically synthesized
catggctctgctccccagtatt

SEQ ID NO: 826239 - DNA, 22 bp, Artificial Sequence
  chemically synthesized
aacggaacaaatactggggagc

SEQ ID NO: 826240 - DNA, 22 bp, Artificial Sequence
  chemically synthesized
cattgcatggctctgctcccca

SEQ ID NO: 826241 - DNA, 22 bp, Artificial Sequence
  chemically synthesized
tccattgcatggctctgctccc

SEQ ID NO: 826242 - DNA, 22 bp, Artificial Sequence
  chemically synthesized
ctccattgcatggctctgctcc

SEQ ID NO: 826243 - DNA, 22 bp, Artificial Sequence
  chemically synthesized
cttctccattgcatggctctgc

SEQ ID NO: 826244 - DNA, 22 bp, Artificial Sequence
  chemically synthesized
ccttctccattgcatggctctg

SEQ ID NO: 826245 - DNA, 22 bp, Artificial Sequence
  chemically synthesized
tccttctccattgcatggctct

SEQ ID NO: 826246 - DNA, 22 bp, Artificial Sequence
  chemically synthesized
gttttccttctccattgcatgg

SEQ ID NO: 826247 - DNA, 22 bp, Artificial Sequence
  chemically synthesized
gggagcagagccatgcaatgga

SEQ ID NO: 826248 - DNA, 22 bp, Artificial Sequence
  chemically synthesized
tagttttccttctccattgcat

SEQ ID NO: 826249 - DNA, 22 bp, Artificial Sequence
  chemically synthesized
aatagcatgaccagattctagt

SEQ ID NO: 826250 - DNA, 22 bp, Artificial Sequence
  chemically synthesized
aggaattaaatagcatgaccag

SEQ ID NO: 826251 - DNA, 22 bp, Artificial Sequence
  chemically synthesized
attcaggaattaaatagcatga

SEQ ID NO: 826252 - DNA, 22 bp, Artificial Sequence
  chemically synthesized
gattcaggaattaaatagcatg

SEQ ID NO: 826253 - DNA, 22 bp, Artificial Sequence
  chemically synthesized
gaatctggtcatgctatttaat

SEQ ID NO: 826254 - DNA, 22 bp, Artificial Sequence
  chemically synthesized
gtcatgctatttaattcctgaa

SEQ ID NO: 826255 - DNA, 22 bp, Artificial Sequence
  chemically synthesized
aaagatagacgaggcttgattc

SEQ ID NO: 826256 - DNA, 22 bp, Artificial Sequence
  chemically synthesized
tttaattcctgaatcaagcctc

SEQ ID NO: 826257 - DNA, 22 bp, Artificial Sequence
  chemically synthesized
aattcctgaatcaagcctcgtc

SEQ ID NO: 826258 - DNA, 22 bp, Artificial Sequence
  chemically synthesized
attcctgaatcaagcctcgtct

SEQ ID NO: 826259 - DNA, 22 bp, Artificial Sequence
  chemically synthesized
aacagttgaaagatagacgagg

SEQ ID NO: 826260 - DNA, 22 bp, Artificial Sequence
  chemically synthesized
ctgaatcaagcctcgtctatct

SEQ ID NO: 826261 - DNA, 22 bp, Artificial Sequence
  chemically synthesized
aatcaagcctcgtctatctttc

SEQ ID NO: 826262 - DNA, 22 bp, Artificial Sequence
  chemically synthesized
atcagtgtcattaaacagttga

SEQ ID NO: 826263 - DNA, 22 bp, Artificial Sequence
  chemically synthesized
gtctatctttcaactgtttaat

SEQ ID NO: 826264 - DNA, 22 bp, Artificial Sequence
  chemically synthesized
tctttcaactgtttaatgacac

SEQ ID NO: 826265 - DNA, 22 bp, Artificial Sequence
  chemically synthesized
tcaactgtttaatgacactgat

SEQ ID NO: 826266 - DNA, 22 bp, Artificial Sequence
  chemically synthesized
caactgtttaatgacactgatc

SEQ ID NO: 826267 - DNA, 22 bp, Artificial Sequence
  chemically synthesized
aactgtttaatgacactgatca

SEQ ID NO: 826268 - DNA, 22 bp, Artificial Sequence
  chemically synthesized
agacaaaatgtattgatcagtg

SEQ ID NO: 826269 - DNA, 22 bp, Artificial Sequence
  chemically synthesized
ctcagacaaaatgtattgatca

SEQ ID NO: 826270 - DNA, 22 bp, Artificial Sequence
  chemically synthesized
tttaatgacactgatcaataca

SEQ ID NO: 826271 - DNA, 22 bp, Artificial Sequence
  chemically synthesized
actcagacaaaatgtattgatc

SEQ ID NO: 826272 - DNA, 22 bp, Artificial Sequence
  chemically synthesized
aatgacactgatcaatacattt

SEQ ID NO: 826273 - DNA, 22 bp, Artificial Sequence
  chemically synthesized
atgacactgatcaatacatttt

SEQ ID NO: 826274 - DNA, 22 bp, Artificial Sequence
  chemically synthesized
gacttactcagacaaaatgtat

SEQ ID NO: 826275 - DNA, 22 bp, Artificial Sequence
  chemically synthesized
agacttactcagacaaaatgta

SEQ ID NO: 826276 - DNA, 22 bp, Artificial Sequence
  chemically synthesized
atcaatacattttgtctgagta

SEQ ID NO: 826277 - DNA, 22 bp, Artificial Sequence
  chemically synthesized
aaagtagcttagacttactcag

SEQ ID NO: 826278 - DNA, 22 bp, Artificial Sequence
  chemically synthesized
caaagtagcttagacttactca

SEQ ID NO: 826279 - DNA, 22 bp, Artificial Sequence
  chemically synthesized
tgtctgagtaagtctaagctac

SEQ ID NO: 826280 - DNA, 22 bp, Artificial Sequence
  chemically synthesized
gtctgagtaagtctaagctact

SEQ ID NO: 826281 - DNA, 22 bp, Artificial Sequence
  chemically synthesized
tctgagtaagtctaagctactt

SEQ ID NO: 826282 - DNA, 22 bp, Artificial Sequence
  chemically synthesized
agtaagtctaagctactttgaa

SEQ ID NO: 826283 - DNA, 22 bp, Artificial Sequence
  chemically synthesized
tagtaatggaaaatccatttca

SEQ ID NO: 826284 - DNA, 22 bp, Artificial Sequence
  chemically synthesized
agctactttgaaatggattttc

SEQ ID NO: 826285 - DNA, 22 bp, Artificial Sequence
  chemically synthesized
tacattgtagtaatggaaaatc

SEQ ID NO: 826286 - DNA, 22 bp, Artificial Sequence
  chemically synthesized
gtacattgtagtaatggaaaat

SEQ ID NO: 826287 - DNA, 22 bp, Artificial Sequence
  chemically synthesized
ctttgaaatggattttccatta

SEQ ID NO: 826288 - DNA, 22 bp, Artificial Sequence
  chemically synthesized
tgaaatggattttccattacta

SEQ ID NO: 826289 - DNA, 22 bp, Artificial Sequence
  chemically synthesized
gaaatggattttccattactac

SEQ ID NO: 826290 - DNA, 22 bp, Artificial Sequence
  chemically synthesized
aaatggattttccattactaca

SEQ ID NO: 826291 - DNA, 22 bp, Artificial Sequence
  chemically synthesized
gaacttgtacattgtagtaatg

SEQ ID NO: 826292 - DNA, 22 bp, Artificial Sequence
  chemically synthesized
taagttagaacttgtacattgt

SEQ ID NO: 826293 - DNA, 22 bp, Artificial Sequence
  chemically synthesized
tataagttagaacttgtacatt

SEQ ID NO: 826294 - DNA, 22 bp, Artificial Sequence
  chemically synthesized
tccattactacaatgtacaagt

SEQ ID NO: 826295 - DNA, 22 bp, Artificial Sequence
  chemically synthesized
ccattactacaatgtacaagtt

SEQ ID NO: 826296 - DNA, 22 bp, Artificial Sequence
  chemically synthesized
tctataagttagaacttgtaca

SEQ ID NO: 826297 - DNA, 22 bp, Artificial Sequence
  chemically synthesized
cattactacaatgtacaagttc

SEQ ID NO: 826298 - DNA, 22 bp, Artificial Sequence
  chemically synthesized
tctctataagttagaacttgta

SEQ ID NO: 826299 - DNA, 22 bp, Artificial Sequence
  chemically synthesized
ctacaatgtacaagttctaact

SEQ ID NO: 826300 - DNA, 22 bp, Artificial Sequence
  chemically synthesized
tctctctctataagttagaact

SEQ ID NO: 826301 - DNA, 22 bp, Artificial Sequence
  chemically synthesized
gtctctctctataagttagaac

SEQ ID NO: 826302 - DNA, 22 bp, Artificial Sequence
  chemically synthesized
caatgtacaagttctaacttat

SEQ ID NO: 826303 - DNA, 22 bp, Artificial Sequence
  chemically synthesized
catcaaaagagtttgtctctct

SEQ ID NO: 826304 - DNA, 22 bp, Artificial Sequence
  chemically synthesized
acatcaaaagagtttgtctctc

SEQ ID NO: 826305 - DNA, 22 bp, Artificial Sequence
  chemically synthesized
taacttatagagagagacaaac

SEQ ID NO: 826306 - DNA, 22 bp, Artificial Sequence
  chemically synthesized
acttatagagagagacaaactc

SEQ ID NO: 826307 - DNA, 22 bp, Artificial Sequence
  chemically synthesized
tttacatcaaaagagtttgtct

SEQ ID NO: 826308 - DNA, 22 bp, Artificial Sequence
  chemically synthesized
gtttacatcaaaagagtttgtc

SEQ ID NO: 826309 - DNA, 22 bp, Artificial Sequence
  chemically synthesized
tgtttacatcaaaagagtttgt

SEQ ID NO: 826310 - DNA, 22 bp, Artificial Sequence
  chemically synthesized
atagagagagacaaactctttt

SEQ ID NO: 826311 - DNA, 22 bp, Artificial Sequence
  chemically synthesized
tagagagagacaaactcttttg

SEQ ID NO: 826312 - DNA, 22 bp, Artificial Sequence
  chemically synthesized
ggagacctttgtttacatcaaa

SEQ ID NO: 826313 - DNA, 22 bp, Artificial Sequence
  chemically synthesized
ctaggagacctttgtttacatc

SEQ ID NO: 826314 - DNA, 22 bp, Artificial Sequence
  chemically synthesized
ttttgatgtaaacaaaggtctc

SEQ ID NO: 826315 - DNA, 22 bp, Artificial Sequence
  chemically synthesized
tacaattcctaggagacctttg

SEQ ID NO: 826316 - DNA, 22 bp, Artificial Sequence
  chemically synthesized
gtacaattcctaggagaccttt

SEQ ID NO: 826317 - DNA, 22 bp, Artificial Sequence
  chemically synthesized
ttgatgtaaacaaaggtctcct

SEQ ID NO: 826318 - DNA, 22 bp, Artificial Sequence
  chemically synthesized
tgatgtaaacaaaggtctccta

SEQ ID NO: 826319 - DNA, 22 bp, Artificial Sequence
  chemically synthesized
ttgtacaattcctaggagacct

SEQ ID NO: 826320 - DNA, 22 bp, Artificial Sequence
  chemically synthesized
gatgtaaacaaaggtctcctag

SEQ ID NO: 826321 - DNA, 22 bp, Artificial Sequence
  chemically synthesized
atgtaaacaaaggtctcctagg

SEQ ID NO: 826322 - DNA, 22 bp, Artificial Sequence
  chemically synthesized
ccatgattcttgtacaattcct

SEQ ID NO: 826323 - DNA, 22 bp, Artificial Sequence
  chemically synthesized
ctaggaattgtacaagaatcat

SEQ ID NO: 826324 - DNA, 22 bp, Artificial Sequence
  chemically synthesized
ggaattgtacaagaatcatggg

SEQ ID NO: 826325 - DNA, 22 bp, Artificial Sequence
  chemically synthesized
ccatgtacaattcccatgattc

SEQ ID NO: 826326 - DNA, 22 bp, Artificial Sequence
  chemically synthesized
ttcccatgtacaattcccatga

SEQ ID NO: 826327 - DNA, 22 bp, Artificial Sequence
  chemically synthesized
tacaagaatcatgggaattgta

SEQ ID NO: 826328 - DNA, 22 bp, Artificial Sequence
  chemically synthesized
aaagctattcccatgtacaatt

SEQ ID NO: 826329 - DNA, 22 bp, Artificial Sequence
  chemically synthesized
gaaagctattcccatgtacaat

SEQ ID NO: 826330 - DNA, 22 bp, Artificial Sequence
  chemically synthesized
tatttgaaagctattcccatgt

SEQ ID NO: 826331 - DNA, 22 bp, Artificial Sequence
  chemically synthesized
gtatttgaaagctattcccatg

SEQ ID NO: 826332 - DNA, 22 bp, Artificial Sequence
  chemically synthesized
tgtatttgaaagctattcccat

SEQ ID NO: 826333 - DNA, 22 bp, Artificial Sequence
  chemically synthesized
ttgtatttgaaagctattccca

SEQ ID NO: 826334 - DNA, 22 bp, Artificial Sequence
  chemically synthesized
aacttttgtatttgaaagctat

SEQ ID NO: 826335 - DNA, 22 bp, Artificial Sequence
  chemically synthesized
aaacttttgtatttgaaagcta

SEQ ID NO: 826336 - DNA, 22 bp, Artificial Sequence
  chemically synthesized
taaacttttgtatttgaaagct

SEQ ID NO: 826337 - DNA, 22 bp, Artificial Sequence
  chemically synthesized
tacatgggaatagctttcaaat

SEQ ID NO: 826338 - DNA, 22 bp, Artificial Sequence
  chemically synthesized
ttaaacttttgtatttgaaagc

SEQ ID NO: 826339 - DNA, 22 bp, Artificial Sequence
  chemically synthesized
ttttaaacttttgtatttgaaa

SEQ ID NO: 826340 - DNA, 22 bp, Artificial Sequence
  chemically synthesized
tcaaatacaaaagtttaaaaga

SEQ ID NO: 826341 - DNA, 22 bp, Artificial Sequence
  chemically synthesized
caaatacaaaagtttaaaagag

SEQ ID NO: 826342 - DNA, 22 bp, Artificial Sequence
  chemically synthesized
aaatacaaaagtttaaaagagg

SEQ ID NO: 826343 - DNA, 22 bp, Artificial Sequence
  chemically synthesized
agcaggatcaaagtcctctttt

SEQ ID NO: 826344 - DNA, 22 bp, Artificial Sequence
  chemically synthesized
aagcaggatcaaagtcctcttt

SEQ ID NO: 826345 - DNA, 22 bp, Artificial Sequence
  chemically synthesized
taagcaggatcaaagtcctctt

SEQ ID NO: 826346 - DNA, 22 bp, Artificial Sequence
  chemically synthesized
ctttaagcaggatcaaagtcct

SEQ ID NO: 826347 - DNA, 22 bp, Artificial Sequence
  chemically synthesized
aagctactttaagcaggatcaa

SEQ ID NO: 826348 - DNA, 22 bp, Artificial Sequence
  chemically synthesized
aaaagaggactttgatcctgct

SEQ ID NO: 826349 - DNA, 22 bp, Artificial Sequence
  chemically synthesized
aaagaggactttgatcctgctt

SEQ ID NO: 826350 - DNA, 22 bp, Artificial Sequence
  chemically synthesized
gttaaagctactttaagcagga

SEQ ID NO: 826351 - DNA, 22 bp, Artificial Sequence
  chemically synthesized
tgatcctgcttaaagtagcttt

SEQ ID NO: 826352 - DNA, 22 bp, Artificial Sequence
  chemically synthesized
gataccctagttaaagctactt

SEQ ID NO: 826353 - DNA, 22 bp, Artificial Sequence
  chemically synthesized
gatcctgcttaaagtagcttta

SEQ ID NO: 826354 - DNA, 22 bp, Artificial Sequence
  chemically synthesized
atcctgcttaaagtagctttaa

SEQ ID NO: 826355 - DNA, 22 bp, Artificial Sequence
  chemically synthesized
tctagataccctagttaaagct

SEQ ID NO: 826356 - DNA, 22 bp, Artificial Sequence
  chemically synthesized
atctagataccctagttaaagc

SEQ ID NO: 826357 - DNA, 22 bp, Artificial Sequence
  chemically synthesized
cttaaagtagctttaactaggg

SEQ ID NO: 826358 - DNA, 22 bp, Artificial Sequence
  chemically synthesized
aaagtagctttaactagggtat

SEQ ID NO: 826359 - DNA, 22 bp, Artificial Sequence
  chemically synthesized
aagtagctttaactagggtatc

SEQ ID NO: 826360 - DNA, 22 bp, Artificial Sequence
  chemically synthesized
agtgtatttatctagataccct

SEQ ID NO: 826361 - DNA, 22 bp, Artificial Sequence
  chemically synthesized
taactagggtatctagataaat

SEQ ID NO: 826362 - DNA, 22 bp, Artificial Sequence
  chemically synthesized
aactagggtatctagataaata

SEQ ID NO: 826363 - DNA, 22 bp, Artificial Sequence
  chemically synthesized
actagggtatctagataaatac

SEQ ID NO: 826364 - DNA, 22 bp, Artificial Sequence
  chemically synthesized
gggtatctagataaatacactg

SEQ ID NO: 826365 - DNA, 22 bp, Artificial Sequence
  chemically synthesized
caaggtgatataagcattcagt

SEQ ID NO: 826366 - DNA, 22 bp, Artificial Sequence
  chemically synthesized
gataaatacactgaatgcttat

SEQ ID NO: 826367 - DNA, 22 bp, Artificial Sequence
  chemically synthesized
ctccaaggtgatataagcattc

SEQ ID NO: 826368 - DNA, 22 bp, Artificial Sequence
  chemically synthesized
tgtaggaactcctccaaggtga

SEQ ID NO: 826369 - DNA, 22 bp, Artificial Sequence
  chemically synthesized
atgtaggaactcctccaaggtg

SEQ ID NO: 826370 - DNA, 22 bp, Artificial Sequence
  chemically synthesized
aatgcttatatcaccttggagg

SEQ ID NO: 826371 - DNA, 22 bp, Artificial Sequence
  chemically synthesized
tatgtaggaactcctccaaggt

SEQ ID NO: 826372 - DNA, 22 bp, Artificial Sequence
  chemically synthesized
ttatgtaggaactcctccaagg

SEQ ID NO: 826373 - DNA, 22 bp, Artificial Sequence
  chemically synthesized
tttatgtaggaactcctccaag

SEQ ID NO: 826374 - DNA, 22 bp, Artificial Sequence
  chemically synthesized
atatcaccttggaggagttcct

SEQ ID NO: 826375 - DNA, 22 bp, Artificial Sequence
  chemically synthesized
tatcaccttggaggagttccta

SEQ ID NO: 826376 - DNA, 22 bp, Artificial Sequence
  chemically synthesized
gaaattttttatgtaggaactc

SEQ ID NO: 826377 - DNA, 22 bp, Artificial Sequence
  chemically synthesized
ggaaattttttatgtaggaact

SEQ ID NO: 826378 - DNA, 22 bp, Artificial Sequence
  chemically synthesized
tggaaattttttatgtaggaac

SEQ ID NO: 826379 - DNA, 22 bp, Artificial Sequence
  chemically synthesized
ggaggagttcctacataaaaaa

SEQ ID NO: 826380 - DNA, 22 bp, Artificial Sequence
  chemically synthesized
gaggagttcctacataaaaaat

SEQ ID NO: 826381 - DNA, 22 bp, Artificial Sequence
  chemically synthesized
tgggctttggaaattttttatg

SEQ ID NO: 826382 - DNA, 22 bp, Artificial Sequence
  chemically synthesized
tatgggctttggaaatttttta

SEQ ID NO: 826383 - DNA, 22 bp, Artificial Sequence
  chemically synthesized
gttctatgggctttggaaattt

SEQ ID NO: 826384 - DNA, 22 bp, Artificial Sequence
  chemically synthesized
ggttctatgggctttggaaatt

SEQ ID NO: 826385 - DNA, 22 bp, Artificial Sequence
  chemically synthesized
tggttctatgggctttggaaat

SEQ ID NO: 826386 - DNA, 22 bp, Artificial Sequence
  chemically synthesized
ctacataaaaaatttccaaagc

SEQ ID NO: 826387 - DNA, 22 bp, Artificial Sequence
  chemically synthesized
cataaaaaatttccaaagccca

SEQ ID NO: 826388 - DNA, 22 bp, Artificial Sequence
  chemically synthesized
gtaagttttggttctatgggct

SEQ ID NO: 826389 - DNA, 22 bp, Artificial Sequence
  chemically synthesized
ggtaagttttggttctatgggc

SEQ ID NO: 826390 - DNA, 22 bp, Artificial Sequence
  chemically synthesized
tggtaagttttggttctatggg

SEQ ID NO: 826391 - DNA, 22 bp, Artificial Sequence
  chemically synthesized
ttggtaagttttggttctatgg

SEQ ID NO: 826392 - DNA, 22 bp, Artificial Sequence
  chemically synthesized
ccaaagcccatagaaccaaaac

SEQ ID NO: 826393 - DNA, 22 bp, Artificial Sequence
  chemically synthesized
caaagcccatagaaccaaaact

SEQ ID NO: 826394 - DNA, 22 bp, Artificial Sequence
  chemically synthesized
aatgccataacatttttggtaa

SEQ ID NO: 826395 - DNA, 22 bp, Artificial Sequence
  chemically synthesized
tctaaatgccataacatttttg

SEQ ID NO: 826396 - DNA, 22 bp, Artificial Sequence
  chemically synthesized
accaaaaatgttatggcattta

SEQ ID NO: 826397 - DNA, 22 bp, Artificial Sequence
  chemically synthesized
ccaaaaatgttatggcatttag

SEQ ID NO: 826398 - DNA, 22 bp, Artificial Sequence
  chemically synthesized
acagaataatgttgtctaaatg

SEQ ID NO: 826399 - DNA, 22 bp, Artificial Sequence
  chemically synthesized
tggcatttagacaacattattc

SEQ ID NO: 826400 - DNA, 22 bp, Artificial Sequence
  chemically synthesized
cccataaggctcacagaataat

SEQ ID NO: 826401 - DNA, 22 bp, Artificial Sequence
  chemically synthesized
ctacccataaggctcacagaat

SEQ ID NO: 826402 - DNA, 22 bp, Artificial Sequence
  chemically synthesized
cctacccataaggctcacagaa

SEQ ID NO: 826403 - DNA, 22 bp, Artificial Sequence
  chemically synthesized
agacaacattattctgtgagcc

SEQ ID NO: 826404 - DNA, 22 bp, Artificial Sequence
  chemically synthesized
gacaacattattctgtgagcct

SEQ ID NO: 826405 - DNA, 22 bp, Artificial Sequence
  chemically synthesized
ttctgtgagccttatgggtagg

SEQ ID NO: 826406 - DNA, 22 bp, Artificial Sequence
  chemically synthesized
tgtgagccttatgggtaggaag

SEQ ID NO: 826407 - DNA, 22 bp, Artificial Sequence
  chemically synthesized
gtggcaaaaatcccttcctacc

SEQ ID NO: 826408 - DNA, 22 bp, Artificial Sequence
  chemically synthesized
tgagccttatgggtaggaaggg

SEQ ID NO: 826409 - DNA, 22 bp, Artificial Sequence
  chemically synthesized
atgggtaggaagggatttttgc

SEQ ID NO: 826410 - DNA, 22 bp, Artificial Sequence
  chemically synthesized
tgggtaggaagggatttttgcc

SEQ ID NO: 826411 - DNA, 22 bp, Artificial Sequence
  chemically synthesized
aatagaaagaggtaaacattgg

SEQ ID NO: 826412 - DNA, 22 bp, Artificial Sequence
  chemically synthesized
ttgccaccaatgtttacctctt

SEQ ID NO: 826413 - DNA, 22 bp, Artificial Sequence
  chemically synthesized
tgccaccaatgtttacctcttt

SEQ ID NO: 826414 - DNA, 22 bp, Artificial Sequence
  chemically synthesized
gccaccaatgtttacctctttc

SEQ ID NO: 826415 - DNA, 22 bp, Artificial Sequence
  chemically synthesized
ccaccaatgtttacctctttct

SEQ ID NO: 826416 - DNA, 22 bp, Artificial Sequence
  chemically synthesized
ataatataaagaaattgaatag

SEQ ID NO: 826417 - DNA, 22 bp, Artificial Sequence
  chemically synthesized
acctctttctattcaatttctt

SEQ ID NO: 826418 - DNA, 22 bp, Artificial Sequence
  chemically synthesized
cctctttctattcaatttcttt

SEQ ID NO: 826419 - DNA, 22 bp, Artificial Sequence
  chemically synthesized
tgtattcataatataaagaaat

SEQ ID NO: 826420 - DNA, 22 bp, Artificial Sequence
  chemically synthesized
atgtattcataatataaagaaa

SEQ ID NO: 826421 - DNA, 22 bp, Artificial Sequence
  chemically synthesized
tttctattcaatttctttatat

SEQ ID NO: 826422 - DNA, 22 bp, Artificial Sequence
  chemically synthesized
tctattcaatttctttatatta

SEQ ID NO: 826423 - DNA, 22 bp, Artificial Sequence
  chemically synthesized
ctattcaatttctttatattat

SEQ ID NO: 826424 - DNA, 22 bp, Artificial Sequence
  chemically synthesized
atttatgtattcataatataaa

SEQ ID NO: 826425 - DNA, 22 bp, Artificial Sequence
  chemically synthesized
tattcaatttctttatattatg

SEQ ID NO: 826426 - DNA, 22 bp, Artificial Sequence
  chemically synthesized
catttatgtattcataatataa

SEQ ID NO: 826427 - DNA, 22 bp, Artificial Sequence
  chemically synthesized
tcatttatgtattcataatata

SEQ ID NO: 826428 - DNA, 22 bp, Artificial Sequence
  chemically synthesized
ttcaatttctttatattatgaa

SEQ ID NO: 826429 - DNA, 22 bp, Artificial Sequence
  chemically synthesized
aatttctttatattatgaatac

SEQ ID NO: 826430 - DNA, 22 bp, Artificial Sequence
  chemically synthesized
ctttatattatgaatacataaa

SEQ ID NO: 826431 - DNA, 22 bp, Artificial Sequence
  chemically synthesized
tttatattatgaatacataaat

SEQ ID NO: 826432 - DNA, 22 bp, Artificial Sequence
  chemically synthesized
agtgtcattttcatttatgtat

SEQ ID NO: 826433 - DNA, 22 bp, Artificial Sequence
  chemically synthesized
gagtgtcattttcatttatgta

SEQ ID NO: 826434 - DNA, 22 bp, Artificial Sequence
  chemically synthesized
tatattatgaatacataaatga

SEQ ID NO: 826435 - DNA, 22 bp, Artificial Sequence
  chemically synthesized
tgagtgtcattttcatttatgt

SEQ ID NO: 826436 - DNA, 22 bp, Artificial Sequence
  chemically synthesized
atattatgaatacataaatgaa

SEQ ID NO: 826437 - DNA, 22 bp, Artificial Sequence
  chemically synthesized
ttgagtgtcattttcatttatg

SEQ ID NO: 826438 - DNA, 22 bp, Artificial Sequence
  chemically synthesized
tattatgaatacataaatgaaa

SEQ ID NO: 826439 - DNA, 22 bp, Artificial Sequence
  chemically synthesized
tttgagtgtcattttcatttat

SEQ ID NO: 826440 - DNA, 22 bp, Artificial Sequence
  chemically synthesized
tttttgagtgtcattttcattt

SEQ ID NO: 826441 - DNA, 22 bp, Artificial Sequence
  chemically synthesized
tctttttgagtgtcattttcat

SEQ ID NO: 826442 - DNA, 22 bp, Artificial Sequence
  chemically synthesized
tgaatacataaatgaaaatgac

SEQ ID NO: 826443 - DNA, 22 bp, Artificial Sequence
  chemically synthesized
tccccagatgtctctctttttg

SEQ ID NO: 826444 - DNA, 22 bp, Artificial Sequence
  chemically synthesized
gtccccagatgtctctcttttt

SEQ ID NO: 826445 - DNA, 22 bp, Artificial Sequence
  chemically synthesized
tgtccccagatgtctctctttt

SEQ ID NO: 826446 - DNA, 22 bp, Artificial Sequence
  chemically synthesized
ggataattttgtccccagatgt

SEQ ID NO: 826447 - DNA, 22 bp, Artificial Sequence
  chemically synthesized
aaaaagagagacatctggggac

SEQ ID NO: 826448 - DNA, 22 bp, Artificial Sequence
  chemically synthesized
tatgtgaatgtcctgggataat

SEQ ID NO: 826449 - DNA, 22 bp, Artificial Sequence
  chemically synthesized
gggacaaaattatcccaggaca

SEQ ID NO: 826450 - DNA, 22 bp, Artificial Sequence
  chemically synthesized
tcccaggacattcacatatagg

SEQ ID NO: 826451 - DNA, 22 bp, Artificial Sequence
  chemically synthesized
acatatagggtggccacgcctg

SEQ ID NO: 826452 - DNA, 22 bp, Artificial Sequence
  chemically synthesized
aaccatggatgtaaccaggcgt

SEQ ID NO: 826453 - DNA, 22 bp, Artificial Sequence
  chemically synthesized
aaaccatggatgtaaccaggcg

SEQ ID NO: 826454 - DNA, 22 bp, Artificial Sequence
  chemically synthesized
taaaccatggatgtaaccaggc

SEQ ID NO: 826455 - DNA, 22 bp, Artificial Sequence
  chemically synthesized
ttttaaaccatggatgtaacca

SEQ ID NO: 826456 - DNA, 22 bp, Artificial Sequence
  chemically synthesized
gttacatccatggtttaaaata

SEQ ID NO: 826457 - DNA, 22 bp, Artificial Sequence
  chemically synthesized
catccatggtttaaaataattc

SEQ ID NO: 826458 - DNA, 22 bp, Artificial Sequence
  chemically synthesized
aaagggaaaaagagtagaatta

SEQ ID NO: 826459 - DNA, 22 bp, Artificial Sequence
  chemically synthesized
aaaagggaaaaagagtagaatt

SEQ ID NO: 826460 - DNA, 22 bp, Artificial Sequence
  chemically synthesized
cttaaaagggaaaaagagtaga

SEQ ID NO: 826461 - DNA, 22 bp, Artificial Sequence
  chemically synthesized
aaaataattctactctttttcc

SEQ ID NO: 826462 - DNA, 22 bp, Artificial Sequence
  chemically synthesized
aaataattctactctttttccc

SEQ ID NO: 826463 - DNA, 22 bp, Artificial Sequence
  chemically synthesized
tcaaagatctacttaaaaggga

SEQ ID NO: 826464 - DNA, 22 bp, Artificial Sequence
  chemically synthesized
tactctttttcccttttaagta

SEQ ID NO: 826465 - DNA, 22 bp, Artificial Sequence
  chemically synthesized
ctctttttcccttttaagtaga

SEQ ID NO: 826466 - DNA, 22 bp, Artificial Sequence
  chemically synthesized
cgttatcaaagatctacttaaa

SEQ ID NO: 826467 - DNA, 22 bp, Artificial Sequence
  chemically synthesized
tttttcccttttaagtagatct

SEQ ID NO: 826468 - DNA, 22 bp, Artificial Sequence
  chemically synthesized
tttcccttttaagtagatcttt

SEQ ID NO: 826469 - DNA, 22 bp, Artificial Sequence
  chemically synthesized
ttcccttttaagtagatctttg

SEQ ID NO: 826470 - DNA, 22 bp, Artificial Sequence
  chemically synthesized
tcccttttaagtagatctttga

SEQ ID NO: 826471 - DNA, 22 bp, Artificial Sequence
  chemically synthesized
cccttttaagtagatctttgat

SEQ ID NO: 826472 - DNA, 22 bp, Artificial Sequence
  chemically synthesized
ccttttaagtagatctttgata

SEQ ID NO: 826473 - DNA, 22 bp, Artificial Sequence
  chemically synthesized
agtgggtgttccgttatcaaag

SEQ ID NO: 826474 - DNA, 22 bp, Artificial Sequence
  chemically synthesized
gagtgggtgttccgttatcaaa

SEQ ID NO: 826475 - DNA, 22 bp, Artificial Sequence
  chemically synthesized
ttaagtagatctttgataacgg

SEQ ID NO: 826476 - DNA, 22 bp, Artificial Sequence
  chemically synthesized
taagtagatctttgataacgga

SEQ ID NO: 826477 - DNA, 22 bp, Artificial Sequence
  chemically synthesized
aagtagatctttgataacggaa

SEQ ID NO: 826478 - DNA, 22 bp, Artificial Sequence
  chemically synthesized
agtagatctttgataacggaac

SEQ ID NO: 826479 - DNA, 22 bp, Artificial Sequence
  chemically synthesized
tgataacggaacacccactcaa

SEQ ID NO: 826480 - DNA, 22 bp, Artificial Sequence
  chemically synthesized
gataacggaacacccactcaaa

SEQ ID NO: 826481 - DNA, 22 bp, Artificial Sequence
  chemically synthesized
ataacggaacacccactcaaat

SEQ ID NO: 826482 - DNA, 22 bp, Artificial Sequence
  chemically synthesized
tatgtgatgatgacatttgagt

SEQ ID NO: 826483 - DNA, 22 bp, Artificial Sequence
  chemically synthesized
atatgtgatgatgacatttgag

SEQ ID NO: 826484 - DNA, 22 bp, Artificial Sequence
  chemically synthesized
tatatgtgatgatgacatttga

SEQ ID NO: 826485 - DNA, 22 bp, Artificial Sequence
  chemically synthesized
aaatgtcatcatcacatataaa

SEQ ID NO: 826486 - DNA, 22 bp, Artificial Sequence
  chemically synthesized
cacatatgagagcaggggaagt

SEQ ID NO: 826487 - DNA, 22 bp, Artificial Sequence
  chemically synthesized
cccctgctctcatatgtgcagt

SEQ ID NO: 826488 - DNA, 22 bp, Artificial Sequence
  chemically synthesized
ccctgctctcatatgtgcagtc

SEQ ID NO: 826489 - DNA, 22 bp, Artificial Sequence
  chemically synthesized
ctctcatatgtgcagtcatttt

SEQ ID NO: 826490 - DNA, 22 bp, Artificial Sequence
  chemically synthesized
tcatatgtgcagtcattttctc

SEQ ID NO: 826491 - DNA, 22 bp, Artificial Sequence
  chemically synthesized
atatgtgcagtcattttctctc

SEQ ID NO: 826492 - DNA, 22 bp, Artificial Sequence
  chemically synthesized
tgggagaaccacggtgagagaa

SEQ ID NO: 826493 - DNA, 22 bp, Artificial Sequence
  chemically synthesized
acaaagtgttatgggagaacca

SEQ ID NO: 826494 - DNA, 22 bp, Artificial Sequence
  chemically synthesized
aacaaagtgttatgggagaacc

SEQ ID NO: 826495 - DNA, 22 bp, Artificial Sequence
  chemically synthesized
tctctcaccgtggttctcccat

SEQ ID NO: 826496 - DNA, 22 bp, Artificial Sequence
  chemically synthesized
ctctcaccgtggttctcccata

SEQ ID NO: 826497 - DNA, 22 bp, Artificial Sequence
  chemically synthesized
tctcaccgtggttctcccataa

SEQ ID NO: 826498 - DNA, 22 bp, Artificial Sequence
  chemically synthesized
tcaccgtggttctcccataaca

SEQ ID NO: 826499 - DNA, 22 bp, Artificial Sequence
  chemically synthesized
accgtggttctcccataacact

SEQ ID NO: 826500 - DNA, 22 bp, Artificial Sequence
  chemically synthesized
aaatcttaacaaagtgttatgg

SEQ ID NO: 826501 - DNA, 22 bp, Artificial Sequence
  chemically synthesized
aaaatcttaacaaagtgttatg

SEQ ID NO: 826502 - DNA, 22 bp, Artificial Sequence
  chemically synthesized
taaaatcttaacaaagtgttat

SEQ ID NO: 826503 - DNA, 22 bp, Artificial Sequence
  chemically synthesized
tcccataacactttgttaagat

SEQ ID NO: 826504 - DNA, 22 bp, Artificial Sequence
  chemically synthesized
ccataacactttgttaagattt

SEQ ID NO: 826505 - DNA, 22 bp, Artificial Sequence
  chemically synthesized
tgttaagattttaaaacttgta

SEQ ID NO: 826506 - DNA, 22 bp, Artificial Sequence
  chemically synthesized
gttaagattttaaaacttgtac

SEQ ID NO: 826507 - DNA, 22 bp, Artificial Sequence
  chemically synthesized
ttaagattttaaaacttgtact

SEQ ID NO: 826508 - DNA, 22 bp, Artificial Sequence
  chemically synthesized
agattttaaaacttgtactgtg

SEQ ID NO: 826509 - DNA, 22 bp, Artificial Sequence
  chemically synthesized
taaaacttgtactgtgtgctac

SEQ ID NO: 826510 - DNA, 22 bp, Artificial Sequence
  chemically synthesized
aaaacttgtactgtgtgctact

SEQ ID NO: 826511 - DNA, 22 bp, Artificial Sequence
  chemically synthesized
aaacttgtactgtgtgctacta

SEQ ID NO: 826512 - DNA, 22 bp, Artificial Sequence
  chemically synthesized
gtactgtgtgctactatgattt

SEQ ID NO: 826513 - DNA, 22 bp, Artificial Sequence
  chemically synthesized
tactgtgtgctactatgattta

SEQ ID NO: 826514 - DNA, 22 bp, Artificial Sequence
  chemically synthesized
tgtgctactatgatttacattt

SEQ ID NO: 826515 - DNA, 22 bp, Artificial Sequence
  chemically synthesized
ctatgatttacatttttacatt

SEQ ID NO: 826516 - DNA, 22 bp, Artificial Sequence
  chemically synthesized
tgatttacatttttacatttta

SEQ ID NO: 826517 - DNA, 22 bp, Artificial Sequence
  chemically synthesized
acatttttacattttacatttc

SEQ ID NO: 826518 - DNA, 22 bp, Artificial Sequence
  chemically synthesized
gagtcagagacagaaatgtaaa

SEQ ID NO: 826519 - DNA, 22 bp, Artificial Sequence
  chemically synthesized
catttttacattttacatttct

SEQ ID NO: 826520 - DNA, 22 bp, Artificial Sequence
  chemically synthesized
tctagagtcagagacagaaatg

SEQ ID NO: 826521 - DNA, 22 bp, Artificial Sequence
  chemically synthesized
ttacattttacatttctgtctc

SEQ ID NO: 826522 - DNA, 22 bp, Artificial Sequence
  chemically synthesized
tacattttacatttctgtctct

SEQ ID NO: 826523 - DNA, 22 bp, Artificial Sequence
  chemically synthesized
acattttacatttctgtctctg

SEQ ID NO: 826524 - DNA, 22 bp, Artificial Sequence
  chemically synthesized
cattttacatttctgtctctga

SEQ ID NO: 826525 - DNA, 22 bp, Artificial Sequence
  chemically synthesized
tacatttctgtctctgactcta

SEQ ID NO: 826526 - DNA, 22 bp, Artificial Sequence
  chemically synthesized
acatttctgtctctgactctag

SEQ ID NO: 826527 - DNA, 22 bp, Artificial Sequence
  chemically synthesized
catttctgtctctgactctaga

SEQ ID NO: 826528 - DNA, 22 bp, Artificial Sequence
  chemically synthesized
aggcaaggacactgtctagagt

SEQ ID NO: 826529 - DNA, 22 bp, Artificial Sequence
  chemically synthesized
gaggcaaggacactgtctagag

SEQ ID NO: 826530 - DNA, 22 bp, Artificial Sequence
  chemically synthesized
tgaggcaaggacactgtctaga

SEQ ID NO: 826531 - DNA, 22 bp, Artificial Sequence
  chemically synthesized
ctgtctctgactctagacagtg

SEQ ID NO: 826532 - DNA, 22 bp, Artificial Sequence
  chemically synthesized
tgtctctgactctagacagtgt

SEQ ID NO: 826533 - DNA, 22 bp, Artificial Sequence
  chemically synthesized
tctctgactctagacagtgtcc

SEQ ID NO: 826534 - DNA, 22 bp, Artificial Sequence
  chemically synthesized
cctttgaggcaaggacactgtc

SEQ ID NO: 826535 - DNA, 22 bp, Artificial Sequence
  chemically synthesized
gcctttgaggcaaggacactgt

SEQ ID NO: 826536 - DNA, 22 bp, Artificial Sequence
  chemically synthesized
tgactctagacagtgtccttgc

SEQ ID NO: 826537 - DNA, 22 bp, Artificial Sequence
  chemically synthesized
actctagacagtgtccttgcct

SEQ ID NO: 826538 - DNA, 22 bp, Artificial Sequence
  chemically synthesized
tccttgcctttgaggcaaggac

SEQ ID NO: 826539 - DNA, 22 bp, Artificial Sequence
  chemically synthesized
tgtccttgcctttgaggcaagg

SEQ ID NO: 826540 - DNA, 22 bp, Artificial Sequence
  chemically synthesized
tagacagtgtccttgcctcaaa

SEQ ID NO: 826541 - DNA, 22 bp, Artificial Sequence
  chemically synthesized
gacagtgtccttgcctcaaagg

SEQ ID NO: 826542 - DNA, 22 bp, Artificial Sequence
  chemically synthesized
cagattctgtccttgcctttga

SEQ ID NO: 826543 - DNA, 22 bp, Artificial Sequence
  chemically synthesized
tacagattctgtccttgccttt

SEQ ID NO: 826544 - DNA, 22 bp, Artificial Sequence
  chemically synthesized
ctacagattctgtccttgcctt

SEQ ID NO: 826545 - DNA, 22 bp, Artificial Sequence
  chemically synthesized
gcctcaaaggcaaggacagaat

SEQ ID NO: 826546 - DNA, 22 bp, Artificial Sequence
  chemically synthesized
cctcaaaggcaaggacagaatc

SEQ ID NO: 826547 - DNA, 22 bp, Artificial Sequence
  chemically synthesized
acagcatcttctacagattctg

SEQ ID NO: 826548 - DNA, 22 bp, Artificial Sequence
  chemically synthesized
aaaggcaaggacagaatctgta

SEQ ID NO: 826549 - DNA, 22 bp, Artificial Sequence
  chemically synthesized
tagaagatgctgtcagggccca

SEQ ID NO: 826550 - DNA, 22 bp, Artificial Sequence
  chemically synthesized
tcagggcccatctatctgccgt

SEQ ID NO: 826551 - DNA, 22 bp, Artificial Sequence
  chemically synthesized
aaggatgagtgccaacggcaga

SEQ ID NO: 826552 - DNA, 22 bp, Artificial Sequence
  chemically synthesized
gaaggatgagtgccaacggcag

SEQ ID NO: 826553 - DNA, 22 bp, Artificial Sequence
  chemically synthesized
gcatatacttgaaggatgagtg

SEQ ID NO: 826554 - DNA, 22 bp, Artificial Sequence
  chemically synthesized
tctgccgttggcactcatcctt

SEQ ID NO: 826555 - DNA, 22 bp, Artificial Sequence
  chemically synthesized
ctggcatatacttgaaggatga

SEQ ID NO: 826556 - DNA, 22 bp, Artificial Sequence
  chemically synthesized
ccgttggcactcatccttcaag

SEQ ID NO: 826557 - DNA, 22 bp, Artificial Sequence
  chemically synthesized
gcactcatccttcaagtatatg

SEQ ID NO: 826558 - DNA, 22 bp, Artificial Sequence
  chemically synthesized
ggacactgctggcatatacttg

SEQ ID NO: 826559 - DNA, 22 bp, Artificial Sequence
  chemically synthesized
tactaggacactgctggcatat

SEQ ID NO: 826560 - DNA, 22 bp, Artificial Sequence
  chemically synthesized
atccttcaagtatatgccagca

SEQ ID NO: 826561 - DNA, 22 bp, Artificial Sequence
  chemically synthesized
gtactaggacactgctggcata

SEQ ID NO: 826562 - DNA, 22 bp, Artificial Sequence
  chemically synthesized
caagtatatgccagcagtgtcc

SEQ ID NO: 826563 - DNA, 22 bp, Artificial Sequence
  chemically synthesized
aagtatatgccagcagtgtcct

SEQ ID NO: 826564 - DNA, 22 bp, Artificial Sequence
  chemically synthesized
cagtagggcaaatgcttgtact

SEQ ID NO: 826565 - DNA, 22 bp, Artificial Sequence
  chemically synthesized
gcagtagggcaaatgcttgtac

SEQ ID NO: 826566 - DNA, 22 bp, Artificial Sequence
  chemically synthesized
aggtttgcagtagggcaaatgc

SEQ ID NO: 826567 - DNA, 22 bp, Artificial Sequence
  chemically synthesized
tcaggtttgcagtagggcaaat

SEQ ID NO: 826568 - DNA, 22 bp, Artificial Sequence
  chemically synthesized
gtacaagcatttgccctactgc

SEQ ID NO: 826569 - DNA, 22 bp, Artificial Sequence
  chemically synthesized
aggaaaatctctcaggtttgca

SEQ ID NO: 826570 - DNA, 22 bp, Artificial Sequence
  chemically synthesized
gccctactgcaaacctgagaga

SEQ ID NO: 826571 - DNA, 22 bp, Artificial Sequence
  chemically synthesized
ccctactgcaaacctgagagat

SEQ ID NO: 826572 - DNA, 22 bp, Artificial Sequence
  chemically synthesized
gcaagctgaggaaaatctctca

SEQ ID NO: 826573 - DNA, 22 bp, Artificial Sequence
  chemically synthesized
ctgcaaacctgagagattttcc

SEQ ID NO: 826574 - DNA, 22 bp, Artificial Sequence
  chemically synthesized
caaacctgagagattttcctca

SEQ ID NO: 826575 - DNA, 22 bp, Artificial Sequence
  chemically synthesized
gccagcgcacctagcaagctga

SEQ ID NO: 826576 - DNA, 22 bp, Artificial Sequence
  chemically synthesized
agagattttcctcagcttgcta

SEQ ID NO: 826577 - DNA, 22 bp, Artificial Sequence
  chemically synthesized
tggccagcgcacctagcaagct

SEQ ID NO: 826578 - DNA, 22 bp, Artificial Sequence
  chemically synthesized
ctggccagcgcacctagcaagc

SEQ ID NO: 826579 - DNA, 22 bp, Artificial Sequence
  chemically synthesized
tcctcagcttgctaggtgcgct

SEQ ID NO: 826580 - DNA, 22 bp, Artificial Sequence
  chemically synthesized
cctcagcttgctaggtgcgctg

SEQ ID NO: 826581 - DNA, 22 bp, Artificial Sequence
  chemically synthesized
ctcagcttgctaggtgcgctgg

SEQ ID NO: 826582 - DNA, 22 bp, Artificial Sequence
  chemically synthesized
cagcacttctggccagcgcacc

SEQ ID NO: 826583 - DNA, 22 bp, Artificial Sequence
  chemically synthesized
ccagcacttctggccagcgcac

SEQ ID NO: 826584 - DNA, 22 bp, Artificial Sequence
  chemically synthesized
tccagcacttctggccagcgca

SEQ ID NO: 826585 - DNA, 22 bp, Artificial Sequence
  chemically synthesized
agcttgctaggtgcgctggcca

SEQ ID NO: 826586 - DNA, 22 bp, Artificial Sequence
  chemically synthesized
gctaggtgcgctggccagaagt

SEQ ID NO: 826587 - DNA, 22 bp, Artificial Sequence
  chemically synthesized
ctaggtgcgctggccagaagtg

SEQ ID NO: 826588 - DNA, 22 bp, Artificial Sequence
  chemically synthesized
ggtgcgctggccagaagtgctg

SEQ ID NO: 826589 - DNA, 22 bp, Artificial Sequence
  chemically synthesized
gtacataaactttccagcactt

SEQ ID NO: 826590 - DNA, 22 bp, Artificial Sequence
  chemically synthesized
ctggtacataaactttccagca

SEQ ID NO: 826591 - DNA, 22 bp, Artificial Sequence
  chemically synthesized
cctggtacataaactttccagc

SEQ ID NO: 826592 - DNA, 22 bp, Artificial Sequence
  chemically synthesized
gccagaagtgctggaaagttta

SEQ ID NO: 826593 - DNA, 22 bp, Artificial Sequence
  chemically synthesized
aatgcttcctggtacataaact

SEQ ID NO: 826594 - DNA, 22 bp, Artificial Sequence
  chemically synthesized
gctaaatgcttcctggtacata

SEQ ID NO: 826595 - DNA, 22 bp, Artificial Sequence
  chemically synthesized
gaaagtttatgtaccaggaagc

SEQ ID NO: 826596 - DNA, 22 bp, Artificial Sequence
  chemically synthesized
tccatcattggctaaatgcttc

SEQ ID NO: 826597 - DNA, 22 bp, Artificial Sequence
  chemically synthesized
atccatcattggctaaatgctt

SEQ ID NO: 826598 - DNA, 22 bp, Artificial Sequence
  chemically synthesized
atgtaccaggaagcatttagcc

SEQ ID NO: 826599 - DNA, 22 bp, Artificial Sequence
  chemically synthesized
ttatccatcattggctaaatgc

SEQ ID NO: 826600 - DNA, 22 bp, Artificial Sequence
  chemically synthesized
tgtaccaggaagcatttagcca

SEQ ID NO: 826601 - DNA, 22 bp, Artificial Sequence
  chemically synthesized
caactcttatccatcattggct

SEQ ID NO: 826602 - DNA, 22 bp, Artificial Sequence
  chemically synthesized
ttccaactcttatccatcattg

SEQ ID NO: 826603 - DNA, 22 bp, Artificial Sequence
  chemically synthesized
actattccaactcttatccatc

SEQ ID NO: 826604 - DNA, 22 bp, Artificial Sequence
  chemically synthesized
agccaatgatggataagagttg

SEQ ID NO: 826605 - DNA, 22 bp, Artificial Sequence
  chemically synthesized
gccaatgatggataagagttgg

SEQ ID NO: 826606 - DNA, 22 bp, Artificial Sequence
  chemically synthesized
gaatagttagccctggttcctt

SEQ ID NO: 826607 - DNA, 22 bp, Artificial Sequence
  chemically synthesized
gccctggttccttgcctttacc

SEQ ID NO: 826608 - DNA, 22 bp, Artificial Sequence
  chemically synthesized
tcaaccacaagggggtaaaggc

SEQ ID NO: 826609 - DNA, 22 bp, Artificial Sequence
  chemically synthesized
gttccttgcctttacccccttg

SEQ ID NO: 826610 - DNA, 22 bp, Artificial Sequence
  chemically synthesized
aaagttgtcaaccacaaggggg

SEQ ID NO: 826611 - DNA, 22 bp, Artificial Sequence
  chemically synthesized
cttgcctttacccccttgtggt

SEQ ID NO: 826612 - DNA, 22 bp, Artificial Sequence
  chemically synthesized
gcctttacccccttgtggttga

SEQ ID NO: 826613 - DNA, 22 bp, Artificial Sequence
  chemically synthesized
cctttacccccttgtggttgac

SEQ ID NO: 826614 - DNA, 22 bp, Artificial Sequence
  chemically synthesized
tacccccttgtggttgacaact

SEQ ID NO: 826615 - DNA, 22 bp, Artificial Sequence
  chemically synthesized
acccccttgtggttgacaactt

SEQ ID NO: 826616 - DNA, 22 bp, Artificial Sequence
  chemically synthesized
cccccttgtggttgacaacttt

SEQ ID NO: 826617 - DNA, 22 bp, Artificial Sequence
  chemically synthesized
gtggttgacaactttgaggcat

SEQ ID NO: 826618 - DNA, 22 bp, Artificial Sequence
  chemically synthesized
tggttgacaactttgaggcatg

SEQ ID NO: 826619 - DNA, 22 bp, Artificial Sequence
  chemically synthesized
acaactttgaggcatgtttttt

SEQ ID NO: 826620 - DNA, 22 bp, Artificial Sequence
  chemically synthesized
tgaggcatgttttttgtttgtt

SEQ ID NO: 826621 - DNA, 22 bp, Artificial Sequence
  chemically synthesized
gaggcatgttttttgtttgttt

SEQ ID NO: 826622 - DNA, 22 bp, Artificial Sequence
  chemically synthesized
aggcatgttttttgtttgtttg

SEQ ID NO: 826623 - DNA, 22 bp, Artificial Sequence
  chemically synthesized
ggagatagtaaacaaacaaaca

SEQ ID NO: 826624 - DNA, 22 bp, Artificial Sequence
  chemically synthesized
tgggagatagtaaacaaacaaa

SEQ ID NO: 826625 - DNA, 22 bp, Artificial Sequence
  chemically synthesized
tttgtttgtttgtttgtttact

SEQ ID NO: 826626 - DNA, 22 bp, Artificial Sequence
  chemically synthesized
ttgtttgtttgtttgtttacta

SEQ ID NO: 826627 - DNA, 22 bp, Artificial Sequence
  chemically synthesized
tgtttgtttgtttgtttactat

SEQ ID NO: 826628 - DNA, 22 bp, Artificial Sequence
  chemically synthesized
gtttgtttgtttgtttactatc

SEQ ID NO: 826629 - DNA, 22 bp, Artificial Sequence
  chemically synthesized
tttgtttgtttgtttactatct

SEQ ID NO: 826630 - DNA, 22 bp, Artificial Sequence
  chemically synthesized
gtttgtttgtttactatctccc

SEQ ID NO: 826631 - DNA, 22 bp, Artificial Sequence
  chemically synthesized
tttgtttgtttactatctccca

SEQ ID NO: 826632 - DNA, 22 bp, Artificial Sequence
  chemically synthesized
atgaaggagctctgggagatag

SEQ ID NO: 826633 - DNA, 22 bp, Artificial Sequence
  chemically synthesized
gtttgtttactatctcccagag

SEQ ID NO: 826634 - DNA, 22 bp, Artificial Sequence
  chemically synthesized
tttgtttactatctcccagagc

SEQ ID NO: 826635 - DNA, 22 bp, Artificial Sequence
  chemically synthesized
atcctgatgaaggagctctggg

SEQ ID NO: 826636 - DNA, 22 bp, Artificial Sequence
  chemically synthesized
gtttactatctcccagagctcc

SEQ ID NO: 826637 - DNA, 22 bp, Artificial Sequence
  chemically synthesized
gatcctgatgaaggagctctgg

SEQ ID NO: 826638 - DNA, 22 bp, Artificial Sequence
  chemically synthesized
tttactatctcccagagctcct

SEQ ID NO: 826639 - DNA, 22 bp, Artificial Sequence
  chemically synthesized
actatctcccagagctccttca

SEQ ID NO: 826640 - DNA, 22 bp, Artificial Sequence
  chemically synthesized
ctatctcccagagctccttcat

SEQ ID NO: 826641 - DNA, 22 bp, Artificial Sequence
  chemically synthesized
gggtttgatcctgatgaaggag

SEQ ID NO: 826642 - DNA, 22 bp, Artificial Sequence
  chemically synthesized
tctcccagagctccttcatcag

SEQ ID NO: 826643 - DNA, 22 bp, Artificial Sequence
  chemically synthesized
ccagagctccttcatcaggatc

SEQ ID NO: 826644 - DNA, 22 bp, Artificial Sequence
  chemically synthesized
ggccactggggtttgatcctga

SEQ ID NO: 826645 - DNA, 22 bp, Artificial Sequence
  chemically synthesized
gggccactggggtttgatcctg

SEQ ID NO: 826646 - DNA, 22 bp, Artificial Sequence
  chemically synthesized
tgggccactggggtttgatcct

SEQ ID NO: 826647 - DNA, 22 bp, Artificial Sequence
  chemically synthesized
ctttgggccactggggtttgat

SEQ ID NO: 826648 - DNA, 22 bp, Artificial Sequence
  chemically synthesized
cttcatcaggatcaaaccccag

SEQ ID NO: 826649 - DNA, 22 bp, Artificial Sequence
  chemically synthesized
ttgctttgggccactggggttt

SEQ ID NO: 826650 - DNA, 22 bp, Artificial Sequence
  chemically synthesized
catcaggatcaaaccccagtgg

SEQ ID NO: 826651 - DNA, 22 bp, Artificial Sequence
  chemically synthesized
atcaggatcaaaccccagtggc

SEQ ID NO: 826652 - DNA, 22 bp, Artificial Sequence
  chemically synthesized
gttattgctttgggccactggg

SEQ ID NO: 826653 - DNA, 22 bp, Artificial Sequence
  chemically synthesized
tggaactagttattgctttggg

SEQ ID NO: 826654 - DNA, 22 bp, Artificial Sequence
  chemically synthesized
agccagttatggaactagttat

SEQ ID NO: 826655 - DNA, 22 bp, Artificial Sequence
  chemically synthesized
gttccataactggcttaattat

SEQ ID NO: 826656 - DNA, 22 bp, Artificial Sequence
  chemically synthesized
cataactggcttaattattggc

SEQ ID NO: 826657 - DNA, 22 bp, Artificial Sequence
  chemically synthesized
gcttaattattggcttctttca

SEQ ID NO: 826658 - DNA, 22 bp, Artificial Sequence
  chemically synthesized
aattattggcttctttcattta

SEQ ID NO: 826659 - DNA, 22 bp, Artificial Sequence
  chemically synthesized
attattggcttctttcatttat

SEQ ID NO: 826660 - DNA, 22 bp, Artificial Sequence
  chemically synthesized
ttggcttctttcatttattatc

SEQ ID NO: 826661 - DNA, 22 bp, Artificial Sequence
  chemically synthesized
gcttctttcatttattatctca

SEQ ID NO: 826662 - DNA, 22 bp, Artificial Sequence
  chemically synthesized
ctttcatttattatctcattgt

SEQ ID NO: 826663 - DNA, 22 bp, Artificial Sequence
  chemically synthesized
tttcatttattatctcattgtc

SEQ ID NO: 826664 - DNA, 22 bp, Artificial Sequence
  chemically synthesized
tcatttattatctcattgtccc

SEQ ID NO: 826665 - DNA, 22 bp, Artificial Sequence
  chemically synthesized
catttattatctcattgtccca

SEQ ID NO: 826666 - DNA, 22 bp, Artificial Sequence
  chemically synthesized
atttattatctcattgtcccac

SEQ ID NO: 826667 - DNA, 22 bp, Artificial Sequence
  chemically synthesized
attatctcattgtcccactctc

SEQ ID NO: 826668 - DNA, 22 bp, Artificial Sequence
  chemically synthesized
ttatctcattgtcccactctcc

SEQ ID NO: 826669 - DNA, 22 bp, Artificial Sequence
  chemically synthesized
tctcattgtcccactctcctac

SEQ ID NO: 826670 - DNA, 22 bp, Artificial Sequence
  chemically synthesized
attgtcccactctcctactggt

SEQ ID NO: 826671 - DNA, 22 bp, Artificial Sequence
  chemically synthesized
tcccactctcctactggtactt

SEQ ID NO: 826672 - DNA, 22 bp, Artificial Sequence
  chemically synthesized
taatgtgatcccaggaagtacc

SEQ ID NO: 826673 - DNA, 22 bp, Artificial Sequence
  chemically synthesized
gttgtaatgtgatcccaggaag

SEQ ID NO: 826674 - DNA, 22 bp, Artificial Sequence
  chemically synthesized
tcctactggtacttcctgggat

SEQ ID NO: 826675 - DNA, 22 bp, Artificial Sequence
  chemically synthesized
ggttgtaatgtgatcccaggaa

SEQ ID NO: 826676 - DNA, 22 bp, Artificial Sequence
  chemically synthesized
ctactggtacttcctgggatca

SEQ ID NO: 826677 - DNA, 22 bp, Artificial Sequence
  chemically synthesized
ctggtacttcctgggatcacat

SEQ ID NO: 826678 - DNA, 22 bp, Artificial Sequence
  chemically synthesized
gtacttcctgggatcacattac

SEQ ID NO: 826679 - DNA, 22 bp, Artificial Sequence
  chemically synthesized
cctgggatcacattacaaccaa

SEQ ID NO: 826680 - DNA, 22 bp, Artificial Sequence
  chemically synthesized
ctgggatcacattacaaccaaa

SEQ ID NO: 826681 - DNA, 22 bp, Artificial Sequence
  chemically synthesized
atggtgaaagtggtttggttgt

SEQ ID NO: 826682 - DNA, 22 bp, Artificial Sequence
  chemically synthesized
ggatcacattacaaccaaacca

SEQ ID NO: 826683 - DNA, 22 bp, Artificial Sequence
  chemically synthesized
aacaatgattaatggtgaaagt

SEQ ID NO: 826684 - DNA, 22 bp, Artificial Sequence
  chemically synthesized
aaacaatgattaatggtgaaag

SEQ ID NO: 826685 - DNA, 22 bp, Artificial Sequence
  chemically synthesized
caaccaaaccactttcaccatt

SEQ ID NO: 826686 - DNA, 22 bp, Artificial Sequence
  chemically synthesized
taaacaatgattaatggtgaaa

SEQ ID NO: 826687 - DNA, 22 bp, Artificial Sequence
  chemically synthesized
agaaacagacctttaaacaatg

SEQ ID NO: 826688 - DNA, 22 bp, Artificial Sequence
  chemically synthesized
tcaccattaatcattgtttaaa

SEQ ID NO: 826689 - DNA, 22 bp, Artificial Sequence
  chemically synthesized
cagaaacagacctttaaacaat

SEQ ID NO: 826690 - DNA, 22 bp, Artificial Sequence
  chemically synthesized
caccattaatcattgtttaaag

SEQ ID NO: 826691 - DNA, 22 bp, Artificial Sequence
  chemically synthesized
tcagaaacagacctttaaacaa

SEQ ID NO: 826692 - DNA, 22 bp, Artificial Sequence
  chemically synthesized
accattaatcattgtttaaagg

SEQ ID NO: 826693 - DNA, 22 bp, Artificial Sequence
  chemically synthesized
tttcagaaacagacctttaaac

SEQ ID NO: 826694 - DNA, 22 bp, Artificial Sequence
  chemically synthesized
ctttcagaaacagacctttaaa

SEQ ID NO: 826695 - DNA, 22 bp, Artificial Sequence
  chemically synthesized
gcttctttcagaaacagacctt

SEQ ID NO: 826696 - DNA, 22 bp, Artificial Sequence
  chemically synthesized
atcattgtttaaaggtctgttt

SEQ ID NO: 826697 - DNA, 22 bp, Artificial Sequence
  chemically synthesized
ggctagcttctttcagaaacag

SEQ ID NO: 826698 - DNA, 22 bp, Artificial Sequence
  chemically synthesized
aggctagcttctttcagaaaca

SEQ ID NO: 826699 - DNA, 22 bp, Artificial Sequence
  chemically synthesized
tttaaaggtctgtttctgaaag

SEQ ID NO: 826700 - DNA, 22 bp, Artificial Sequence
  chemically synthesized
acttaggctagcttctttcaga

SEQ ID NO: 826701 - DNA, 22 bp, Artificial Sequence
  chemically synthesized
aaaggtctgtttctgaaagaag

SEQ ID NO: 826702 - DNA, 22 bp, Artificial Sequence
  chemically synthesized
aaggtctgtttctgaaagaagc

SEQ ID NO: 826703 - DNA, 22 bp, Artificial Sequence
  chemically synthesized
tttctgaaagaagctagcctaa

SEQ ID NO: 826704 - DNA, 22 bp, Artificial Sequence
  chemically synthesized
ctgaaagaagctagcctaagtt

SEQ ID NO: 826705 - DNA, 22 bp, Artificial Sequence
  chemically synthesized
tgaaagaagctagcctaagtta

SEQ ID NO: 826706 - DNA, 22 bp, Artificial Sequence
  chemically synthesized
aaagaagctagcctaagttagt

SEQ ID NO: 826707 - DNA, 22 bp, Artificial Sequence
  chemically synthesized
aatggataaaatactaacttag

SEQ ID NO: 826708 - DNA, 22 bp, Artificial Sequence
  chemically synthesized
aaatggataaaatactaactta

SEQ ID NO: 826709 - DNA, 22 bp, Artificial Sequence
  chemically synthesized
taaatggataaaatactaactt

SEQ ID NO: 826710 - DNA, 22 bp, Artificial Sequence
  chemically synthesized
ttaaatggataaaatactaact

SEQ ID NO: 826711 - DNA, 22 bp, Artificial Sequence
  chemically synthesized
tttaaatggataaaatactaac

SEQ ID NO: 826712 - DNA, 22 bp, Artificial Sequence
  chemically synthesized
ttttaaatggataaaatactaa

SEQ ID NO: 826713 - DNA, 22 bp, Artificial Sequence
  chemically synthesized
gcctaagttagtattttatcca

SEQ ID NO: 826714 - DNA, 22 bp, Artificial Sequence
  chemically synthesized
agttagtattttatccatttaa

SEQ ID NO: 826715 - DNA, 22 bp, Artificial Sequence
  chemically synthesized
ccagagaaggatttttttaaat

SEQ ID NO: 826716 - DNA, 22 bp, Artificial Sequence
  chemically synthesized
gtattttatccatttaaaaaaa

SEQ ID NO: 826717 - DNA, 22 bp, Artificial Sequence
  chemically synthesized
gccagagaaggatttttttaaa

SEQ ID NO: 826718 - DNA, 22 bp, Artificial Sequence
  chemically synthesized
tgccagagaaggatttttttaa

SEQ ID NO: 826719 - DNA, 22 bp, Artificial Sequence
  chemically synthesized
tatccatttaaaaaaatccttc

SEQ ID NO: 826720 - DNA, 22 bp, Artificial Sequence
  chemically synthesized
cgctttgccagagaaggatttt

SEQ ID NO: 826721 - DNA, 22 bp, Artificial Sequence
  chemically synthesized
atccatttaaaaaaatccttct

SEQ ID NO: 826722 - DNA, 22 bp, Artificial Sequence
  chemically synthesized
ccgctttgccagagaaggattt

SEQ ID NO: 826723 - DNA, 22 bp, Artificial Sequence
  chemically synthesized
tccatttaaaaaaatccttctc

SEQ ID NO: 826724 - DNA, 22 bp, Artificial Sequence
  chemically synthesized
ttccgctttgccagagaaggat

SEQ ID NO: 826725 - DNA, 22 bp, Artificial Sequence
  chemically synthesized
cttccgctttgccagagaagga

SEQ ID NO: 826726 - DNA, 22 bp, Artificial Sequence
  chemically synthesized
gcttcttccgctttgccagaga

SEQ ID NO: 826727 - DNA, 22 bp, Artificial Sequence
  chemically synthesized
aaaaaaatccttctctggcaaa

SEQ ID NO: 826728 - DNA, 22 bp, Artificial Sequence
  chemically synthesized
aaaaaatccttctctggcaaag

SEQ ID NO: 826729 - DNA, 22 bp, Artificial Sequence
  chemically synthesized
tagcttcttccgctttgccaga

SEQ ID NO: 826730 - DNA, 22 bp, Artificial Sequence
  chemically synthesized
ctagcttcttccgctttgccag

SEQ ID NO: 826731 - DNA, 22 bp, Artificial Sequence
  chemically synthesized
tctagcttcttccgctttgcca

SEQ ID NO: 826732 - DNA, 22 bp, Artificial Sequence
  chemically synthesized
ttttctagcttcttccgctttg

SEQ ID NO: 826733 - DNA, 22 bp, Artificial Sequence
  chemically synthesized
attttctagcttcttccgcttt

SEQ ID NO: 826734 - DNA, 22 bp, Artificial Sequence
  chemically synthesized
tattttctagcttcttccgctt

SEQ ID NO: 826735 - DNA, 22 bp, Artificial Sequence
  chemically synthesized
ttattttctagcttcttccgct

SEQ ID NO: 826736 - DNA, 22 bp, Artificial Sequence
  chemically synthesized
ctctggcaaagcggaagaagct

SEQ ID NO: 826737 - DNA, 22 bp, Artificial Sequence
  chemically synthesized
tttttattttctagcttcttcc

SEQ ID NO: 826738 - DNA, 22 bp, Artificial Sequence
  chemically synthesized
tctggcaaagcggaagaagcta

SEQ ID NO: 826739 - DNA, 22 bp, Artificial Sequence
  chemically synthesized
atttttattttctagcttcttc

SEQ ID NO: 826740 - DNA, 22 bp, Artificial Sequence
  chemically synthesized
tatttttattttctagcttctt

SEQ ID NO: 826741 - DNA, 22 bp, Artificial Sequence
  chemically synthesized
tggcaaagcggaagaagctaga

SEQ ID NO: 826742 - DNA, 22 bp, Artificial Sequence
  chemically synthesized
gcaaagcggaagaagctagaaa

SEQ ID NO: 826743 - DNA, 22 bp, Artificial Sequence
  chemically synthesized
ctttatttttattttctagctt

SEQ ID NO: 826744 - DNA, 22 bp, Artificial Sequence
  chemically synthesized
actttatttttattttctagct

SEQ ID NO: 826745 - DNA, 22 bp, Artificial Sequence
  chemically synthesized
tactttatttttattttctagc

SEQ ID NO: 826746 - DNA, 22 bp, Artificial Sequence
  chemically synthesized
ttactttatttttattttctag

SEQ ID NO: 826747 - DNA, 22 bp, Artificial Sequence
  chemically synthesized
tttactttatttttattttcta

SEQ ID NO: 826748 - DNA, 22 bp, Artificial Sequence
  chemically synthesized
ctttttactttatttttatttt

SEQ ID NO: 826749 - DNA, 22 bp, Artificial Sequence
  chemically synthesized
actttttactttatttttattt

SEQ ID NO: 826750 - DNA, 22 bp, Artificial Sequence
  chemically synthesized
tactttttactttatttttatt

SEQ ID NO: 826751 - DNA, 22 bp, Artificial Sequence
  chemically synthesized
ttactttttactttatttttat

SEQ ID NO: 826752 - DNA, 22 bp, Artificial Sequence
  chemically synthesized
atttttactttttactttattt

SEQ ID NO: 826753 - DNA, 22 bp, Artificial Sequence
  chemically synthesized
aatttttactttttactttatt

SEQ ID NO: 826754 - DNA, 22 bp, Artificial Sequence
  chemically synthesized
taatttttactttttactttat

SEQ ID NO: 826755 - DNA, 22 bp, Artificial Sequence
  chemically synthesized
ttaatttttactttttacttta

SEQ ID NO: 826756 - DNA, 22 bp, Artificial Sequence
  chemically synthesized
gaaaataaaaataaagtaaaaa

SEQ ID NO: 826757 - DNA, 22 bp, Artificial Sequence
  chemically synthesized
aggatgtttttaatttttactt

SEQ ID NO: 826758 - DNA, 22 bp, Artificial Sequence
  chemically synthesized
tgcactaaggatgtttttaatt

SEQ ID NO: 826759 - DNA, 22 bp, Artificial Sequence
  chemically synthesized
gtgcactaaggatgtttttaat

SEQ ID NO: 826760 - DNA, 22 bp, Artificial Sequence
  chemically synthesized
gtttgtgcactaaggatgtttt

SEQ ID NO: 826761 - DNA, 22 bp, Artificial Sequence
  chemically synthesized
aaaacatccttagtgcacaaac

SEQ ID NO: 826762 - DNA, 22 bp, Artificial Sequence
  chemically synthesized
caaatgccaaacactagtttgt

SEQ ID NO: 826763 - DNA, 22 bp, Artificial Sequence
  chemically synthesized
agtgcacaaactagtgtttggc

SEQ ID NO: 826764 - DNA, 22 bp, Artificial Sequence
  chemically synthesized
gtgcacaaactagtgtttggca

SEQ ID NO: 826765 - DNA, 22 bp, Artificial Sequence
  chemically synthesized
aaggtattccaaatgccaaaca

SEQ ID NO: 826766 - DNA, 22 bp, Artificial Sequence
  chemically synthesized
ttgaaggtattccaaatgccaa

SEQ ID NO: 826767 - DNA, 22 bp, Artificial Sequence
  chemically synthesized
attgaaggtattccaaatgcca

SEQ ID NO: 826768 - DNA, 22 bp, Artificial Sequence
  chemically synthesized
gtgtttggcatttggaatacct

SEQ ID NO: 826769 - DNA, 22 bp, Artificial Sequence
  chemically synthesized
acagacatttattgaaggtatt

SEQ ID NO: 826770 - DNA, 22 bp, Artificial Sequence
  chemically synthesized
gacagacatttattgaaggtat

SEQ ID NO: 826771 - DNA, 22 bp, Artificial Sequence
  chemically synthesized
ggcatttggaataccttcaata

SEQ ID NO: 826772 - DNA, 22 bp, Artificial Sequence
  chemically synthesized
gcatttggaataccttcaataa

SEQ ID NO: 826773 - DNA, 22 bp, Artificial Sequence
  chemically synthesized
atttgacagacatttattgaag

SEQ ID NO: 826774 - DNA, 22 bp, Artificial Sequence
  chemically synthesized
ggaataccttcaataaatgtct

SEQ ID NO: 826775 - DNA, 22 bp, Artificial Sequence
  chemically synthesized
gaataccttcaataaatgtctg

SEQ ID NO: 826776 - DNA, 22 bp, Artificial Sequence
  chemically synthesized
catgtacaactcatttgacaga

SEQ ID NO: 826777 - DNA, 22 bp, Artificial Sequence
  chemically synthesized
caataaatgtctgtcaaatgag

SEQ ID NO: 826778 - DNA, 22 bp, Artificial Sequence
  chemically synthesized
aataaatgtctgtcaaatgagt

SEQ ID NO: 826779 - DNA, 22 bp, Artificial Sequence
  chemically synthesized
tcaaatgagttgtacatgtaga

SEQ ID NO: 826780 - DNA, 22 bp, Artificial Sequence
  chemically synthesized
tacatgtagattatttccatta

SEQ ID NO: 826781 - DNA, 22 bp, Artificial Sequence
  chemically synthesized
taaagagaaagtggggataatg

SEQ ID NO: 826782 - DNA, 22 bp, Artificial Sequence
  chemically synthesized
tttccattatccccactttctc

SEQ ID NO: 826783 - DNA, 22 bp, Artificial Sequence
  chemically synthesized
tatcattataaagagaaagtgg

SEQ ID NO: 826784 - DNA, 22 bp, Artificial Sequence
  chemically synthesized
atatcattataaagagaaagtg

SEQ ID NO: 826785 - DNA, 22 bp, Artificial Sequence
  chemically synthesized
tatatcattataaagagaaagt

SEQ ID NO: 826786 - DNA, 22 bp, Artificial Sequence
  chemically synthesized
ccattatccccactttctcttt

SEQ ID NO: 826787 - DNA, 22 bp, Artificial Sequence
  chemically synthesized
ttatatcattataaagagaaag

SEQ ID NO: 826788 - DNA, 22 bp, Artificial Sequence
  chemically synthesized
cattatccccactttctcttta

SEQ ID NO: 826789 - DNA, 22 bp, Artificial Sequence
  chemically synthesized
tccccactttctctttataatg

SEQ ID NO: 826790 - DNA, 22 bp, Artificial Sequence
  chemically synthesized
gaaatggcatttttatatcatt

SEQ ID NO: 826791 - DNA, 22 bp, Artificial Sequence
  chemically synthesized
agaaatggcatttttatatcat

SEQ ID NO: 826792 - DNA, 22 bp, Artificial Sequence
  chemically synthesized
tagaaatggcatttttatatca

SEQ ID NO: 826793 - DNA, 22 bp, Artificial Sequence
  chemically synthesized
tctctttataatgatataaaaa

SEQ ID NO: 826794 - DNA, 22 bp, Artificial Sequence
  chemically synthesized
ctctttataatgatataaaaat

SEQ ID NO: 826795 - DNA, 22 bp, Artificial Sequence
  chemically synthesized
tctttataatgatataaaaatg

SEQ ID NO: 826796 - DNA, 22 bp, Artificial Sequence
  chemically synthesized
actttagaaatggcatttttat

SEQ ID NO: 826797 - DNA, 22 bp, Artificial Sequence
  chemically synthesized
tttataatgatataaaaatgcc

SEQ ID NO: 826798 - DNA, 22 bp, Artificial Sequence
  chemically synthesized
tataatgatataaaaatgccat

SEQ ID NO: 826799 - DNA, 22 bp, Artificial Sequence
  chemically synthesized
ataatgatataaaaatgccatt

SEQ ID NO: 826800 - DNA, 22 bp, Artificial Sequence
  chemically synthesized
taatgatataaaaatgccattt

SEQ ID NO: 826801 - DNA, 22 bp, Artificial Sequence
  chemically synthesized
ggcaaaggttaactttagaaat

SEQ ID NO: 826802 - DNA, 22 bp, Artificial Sequence
  chemically synthesized
aagatgctgggcaaaggttaac

SEQ ID NO: 826803 - DNA, 22 bp, Artificial Sequence
  chemically synthesized
ctaaagttaacctttgcccagc

SEQ ID NO: 826804 - DNA, 22 bp, Artificial Sequence
  chemically synthesized
taaagttaacctttgcccagca

SEQ ID NO: 826805 - DNA, 22 bp, Artificial Sequence
  chemically synthesized
aagttaacctttgcccagcatc

SEQ ID NO: 826806 - DNA, 22 bp, Artificial Sequence
  chemically synthesized
agaagaaagactgaagatgctg

SEQ ID NO: 826807 - DNA, 22 bp, Artificial Sequence
  chemically synthesized
aagaagaaagactgaagatgct

SEQ ID NO: 826808 - DNA, 22 bp, Artificial Sequence
  chemically synthesized
acctttgcccagcatcttcagt

SEQ ID NO: 826809 - DNA, 22 bp, Artificial Sequence
  chemically synthesized
cttaagaagaaagactgaagat

SEQ ID NO: 826810 - DNA, 22 bp, Artificial Sequence
  chemically synthesized
tgcccagcatcttcagtctttc

SEQ ID NO: 826811 - DNA, 22 bp, Artificial Sequence
  chemically synthesized
gcccagcatcttcagtctttct

SEQ ID NO: 826812 - DNA, 22 bp, Artificial Sequence
  chemically synthesized
cccagcatcttcagtctttctt

SEQ ID NO: 826813 - DNA, 22 bp, Artificial Sequence
  chemically synthesized
cagtctttcttcttaagtaacc

SEQ ID NO: 826814 - DNA, 22 bp, Artificial Sequence
  chemically synthesized
agtctttcttcttaagtaacca

SEQ ID NO: 826815 - DNA, 22 bp, Artificial Sequence
  chemically synthesized
tcttcttaagtaaccactattt

SEQ ID NO: 826816 - DNA, 22 bp, Artificial Sequence
  chemically synthesized
cttcttaagtaaccactatttg

SEQ ID NO: 826817 - DNA, 22 bp, Artificial Sequence
  chemically synthesized
aaatgcaacaaacaaatagtgg

SEQ ID NO: 826818 - DNA, 22 bp, Artificial Sequence
  chemically synthesized
ttcttaagtaaccactatttgt

SEQ ID NO: 826819 - DNA, 22 bp, Artificial Sequence
  chemically synthesized
gaaatgcaacaaacaaatagtg

SEQ ID NO: 826820 - DNA, 22 bp, Artificial Sequence
  chemically synthesized
cttaagtaaccactatttgttt

SEQ ID NO: 826821 - DNA, 22 bp, Artificial Sequence
  chemically synthesized
ttaagtaaccactatttgtttg

SEQ ID NO: 826822 - DNA, 22 bp, Artificial Sequence
  chemically synthesized
aagtaaccactatttgtttgtt

SEQ ID NO: 826823 - DNA, 22 bp, Artificial Sequence
  chemically synthesized
agtaaccactatttgtttgttg

SEQ ID NO: 826824 - DNA, 22 bp, Artificial Sequence
  chemically synthesized
tgaaaacttgaaatgcaacaaa

SEQ ID NO: 826825 - DNA, 22 bp, Artificial Sequence
  chemically synthesized
aaattatgaaaacttgaaatgc

SEQ ID NO: 826826 - DNA, 22 bp, Artificial Sequence
  chemically synthesized
caaattatgaaaacttgaaatg

SEQ ID NO: 826827 - DNA, 22 bp, Artificial Sequence
  chemically synthesized
tttgtttgttgcatttcaagtt

SEQ ID NO: 826828 - DNA, 22 bp, Artificial Sequence
  chemically synthesized
tcaaattatgaaaacttgaaat

SEQ ID NO: 826829 - DNA, 22 bp, Artificial Sequence
  chemically synthesized
gtttgttgcatttcaagttttc

SEQ ID NO: 826830 - DNA, 22 bp, Artificial Sequence
  chemically synthesized
tttgttgcatttcaagttttca

SEQ ID NO: 826831 - DNA, 22 bp, Artificial Sequence
  chemically synthesized
gttgcatttcaagttttcataa

SEQ ID NO: 826832 - DNA, 22 bp, Artificial Sequence
  chemically synthesized
ttgcatttcaagttttcataat

SEQ ID NO: 826833 - DNA, 22 bp, Artificial Sequence
  chemically synthesized
agtccattttcaaattatgaaa

SEQ ID NO: 826834 - DNA, 22 bp, Artificial Sequence
  chemically synthesized
gagtccattttcaaattatgaa

SEQ ID NO: 826835 - DNA, 22 bp, Artificial Sequence
  chemically synthesized
catttcaagttttcataatttg

SEQ ID NO: 826836 - DNA, 22 bp, Artificial Sequence
  chemically synthesized
caagttttcataatttgaaaat

SEQ ID NO: 826837 - DNA, 22 bp, Artificial Sequence
  chemically synthesized
aagttttcataatttgaaaatg

SEQ ID NO: 826838 - DNA, 22 bp, Artificial Sequence
  chemically synthesized
tcataatttgaaaatggactca

SEQ ID NO: 826839 - DNA, 22 bp, Artificial Sequence
  chemically synthesized
cataatttgaaaatggactcaa

SEQ ID NO: 826840 - DNA, 22 bp, Artificial Sequence
  chemically synthesized
ataatttgaaaatggactcaag

SEQ ID NO: 826841 - DNA, 22 bp, Artificial Sequence
  chemically synthesized
gaaaatggactcaagactttcc

SEQ ID NO: 826842 - DNA, 22 bp, Artificial Sequence
  chemically synthesized
aaaatggactcaagactttccc

SEQ ID NO: 826843 - DNA, 22 bp, Artificial Sequence
  chemically synthesized
aagactttcccatttccttcct

SEQ ID NO: 826844 - DNA, 22 bp, Artificial Sequence
  chemically synthesized
tcccatttccttccttattttc

SEQ ID NO: 826845 - DNA, 22 bp, Artificial Sequence
  chemically synthesized
cccatttccttccttattttcc

SEQ ID NO: 826846 - DNA, 22 bp, Artificial Sequence
  chemically synthesized
ccatttccttccttattttcct

SEQ ID NO: 826847 - DNA, 22 bp, Artificial Sequence
  chemically synthesized
gcataagcataagaggaaaata

SEQ ID NO: 826848 - DNA, 22 bp, Artificial Sequence
  chemically synthesized
ccttccttattttcctcttatg

SEQ ID NO: 826849 - DNA, 22 bp, Artificial Sequence
  chemically synthesized
cttccttattttcctcttatgc

SEQ ID NO: 826850 - DNA, 22 bp, Artificial Sequence
  chemically synthesized
ccttattttcctcttatgctta

SEQ ID NO: 826851 - DNA, 22 bp, Artificial Sequence
  chemically synthesized
cttattttcctcttatgcttat

SEQ ID NO: 826852 - DNA, 22 bp, Artificial Sequence
  chemically synthesized
attttcctcttatgcttatgct

SEQ ID NO: 826853 - DNA, 22 bp, Artificial Sequence
  chemically synthesized
ttttcctcttatgcttatgcta

SEQ ID NO: 826854 - DNA, 22 bp, Artificial Sequence
  chemically synthesized
gaatagagatcattagcataag

SEQ ID NO: 826855 - DNA, 22 bp, Artificial Sequence
  chemically synthesized
tcctcttatgcttatgctaatg

SEQ ID NO: 826856 - DNA, 22 bp, Artificial Sequence
  chemically synthesized
cctcttatgcttatgctaatga

SEQ ID NO: 826857 - DNA, 22 bp, Artificial Sequence
  chemically synthesized
ctcttatgcttatgctaatgat

SEQ ID NO: 826858 - DNA, 22 bp, Artificial Sequence
  chemically synthesized
gcctggaatagagatcattagc

SEQ ID NO: 826859 - DNA, 22 bp, Artificial Sequence
  chemically synthesized
ttatgcttatgctaatgatctc

SEQ ID NO: 826860 - DNA, 22 bp, Artificial Sequence
  chemically synthesized
ttcgcctggaatagagatcatt

SEQ ID NO: 826861 - DNA, 22 bp, Artificial Sequence
  chemically synthesized
atgcttatgctaatgatctcta

SEQ ID NO: 826862 - DNA, 22 bp, Artificial Sequence
  chemically synthesized
gttcgcctggaatagagatcat

SEQ ID NO: 826863 - DNA, 22 bp, Artificial Sequence
  chemically synthesized
tgcttatgctaatgatctctat

SEQ ID NO: 826864 - DNA, 22 bp, Artificial Sequence
  chemically synthesized
atgctaatgatctctattccag

SEQ ID NO: 826865 - DNA, 22 bp, Artificial Sequence
  chemically synthesized
tgctaatgatctctattccagg

SEQ ID NO: 826866 - DNA, 22 bp, Artificial Sequence
  chemically synthesized
agaggacatttgttcgcctgga

SEQ ID NO: 826867 - DNA, 22 bp, Artificial Sequence
  chemically synthesized
atgatctctattccaggcgaac

SEQ ID NO: 826868 - DNA, 22 bp, Artificial Sequence
  chemically synthesized
tattccaggcgaacaaatgtcc

SEQ ID NO: 826869 - DNA, 22 bp, Artificial Sequence
  chemically synthesized
ttccaggcgaacaaatgtcctc

SEQ ID NO: 826870 - DNA, 22 bp, Artificial Sequence
  chemically synthesized
caggcgaacaaatgtcctctga

SEQ ID NO: 826871 - DNA, 22 bp, Artificial Sequence
  chemically synthesized
aataagaaacaaaggaaattca

SEQ ID NO: 826872 - DNA, 22 bp, Artificial Sequence
  chemically synthesized
tgaatttcctttgtttcttatt

SEQ ID NO: 826873 - DNA, 22 bp, Artificial Sequence
  chemically synthesized
aatttcctttgtttcttattta

SEQ ID NO: 826874 - DNA, 22 bp, Artificial Sequence
  chemically synthesized
atacaaaggcattaaataagaa

SEQ ID NO: 826875 - DNA, 22 bp, Artificial Sequence
  chemically synthesized
cctttgtttcttatttaatgcc

SEQ ID NO: 826876 - DNA, 22 bp, Artificial Sequence
  chemically synthesized
ctttgtttcttatttaatgcct

SEQ ID NO: 826877 - DNA, 22 bp, Artificial Sequence
  chemically synthesized
tgtttcttatttaatgcctttg

SEQ ID NO: 826878 - DNA, 22 bp, Artificial Sequence
  chemically synthesized
gtttcttatttaatgcctttgt

SEQ ID NO: 826879 - DNA, 22 bp, Artificial Sequence
  chemically synthesized
tttcttatttaatgcctttgta

SEQ ID NO: 826880 - DNA, 22 bp, Artificial Sequence
  chemically synthesized
cttatttaatgcctttgtatca

SEQ ID NO: 826881 - DNA, 22 bp, Artificial Sequence
  chemically synthesized
ttatttaatgcctttgtatcaa

SEQ ID NO: 826882 - DNA, 22 bp, Artificial Sequence
  chemically synthesized
atttaatgcctttgtatcaacc

SEQ ID NO: 826883 - DNA, 22 bp, Artificial Sequence
  chemically synthesized
tttaatgcctttgtatcaacca

SEQ ID NO: 826884 - DNA, 22 bp, Artificial Sequence
  chemically synthesized
tacaaatgaatgtggttgatac

SEQ ID NO: 826885 - DNA, 22 bp, Artificial Sequence
  chemically synthesized
atacaaatgaatgtggttgata

SEQ ID NO: 826886 - DNA, 22 bp, Artificial Sequence
  chemically synthesized
tatacaaatgaatgtggttgat

SEQ ID NO: 826887 - DNA, 22 bp, Artificial Sequence
  chemically synthesized
aatgcctttgtatcaaccacat

SEQ ID NO: 826888 - DNA, 22 bp, Artificial Sequence
  chemically synthesized
atgcctttgtatcaaccacatt

SEQ ID NO: 826889 - DNA, 22 bp, Artificial Sequence
  chemically synthesized
tgtatcaaccacattcatttgt

SEQ ID NO: 826890 - DNA, 22 bp, Artificial Sequence
  chemically synthesized
aagatgttttatacaaatgaat

SEQ ID NO: 826891 - DNA, 22 bp, Artificial Sequence
  chemically synthesized
gtatcaaccacattcatttgta

SEQ ID NO: 826892 - DNA, 22 bp, Artificial Sequence
  chemically synthesized
tatcaaccacattcatttgtat

SEQ ID NO: 826893 - DNA, 22 bp, Artificial Sequence
  chemically synthesized
gtaaacatgacattaaagatgt

SEQ ID NO: 826894 - DNA, 22 bp, Artificial Sequence
  chemically synthesized
atttgtataaaacatctttaat

SEQ ID NO: 826895 - DNA, 22 bp, Artificial Sequence
  chemically synthesized
ctagtaaacatgacattaaaga

SEQ ID NO: 826896 - DNA, 22 bp, Artificial Sequence
  chemically synthesized
gtataaaacatctttaatgtca

SEQ ID NO: 826897 - DNA, 22 bp, Artificial Sequence
  chemically synthesized
tactagtaaacatgacattaaa

SEQ ID NO: 826898 - DNA, 22 bp, Artificial Sequence
  chemically synthesized
tataaaacatctttaatgtcat

SEQ ID NO: 826899 - DNA, 22 bp, Artificial Sequence
  chemically synthesized
taatgtcatgtttactagtaga

SEQ ID NO: 826900 - DNA, 22 bp, Artificial Sequence
  chemically synthesized
aatgtcatgtttactagtagaa

SEQ ID NO: 826901 - DNA, 22 bp, Artificial Sequence
  chemically synthesized
atgtcatgtttactagtagaat

SEQ ID NO: 826902 - DNA, 22 bp, Artificial Sequence
  chemically synthesized
tataaggcacagatattctact

SEQ ID NO: 826903 - DNA, 22 bp, Artificial Sequence
  chemically synthesized
atataaggcacagatattctac

SEQ ID NO: 826904 - DNA, 22 bp, Artificial Sequence
  chemically synthesized
tatataaggcacagatattcta

SEQ ID NO: 826905 - DNA, 22 bp, Artificial Sequence
  chemically synthesized
actagtagaatatctgtgcctt

SEQ ID NO: 826906 - DNA, 22 bp, Artificial Sequence
  chemically synthesized
tggattttatataaggcacaga

SEQ ID NO: 826907 - DNA, 22 bp, Artificial Sequence
  chemically synthesized
ctagtagaatatctgtgcctta

SEQ ID NO: 826908 - DNA, 22 bp, Artificial Sequence
  chemically synthesized
atggattttatataaggcacag

SEQ ID NO: 826909 - DNA, 22 bp, Artificial Sequence
  chemically synthesized
gtagaatatctgtgccttatat

SEQ ID NO: 826910 - DNA, 22 bp, Artificial Sequence
  chemically synthesized
atttatggattttatataaggc

SEQ ID NO: 826911 - DNA, 22 bp, Artificial Sequence
  chemically synthesized
aatttatggattttatataagg

SEQ ID NO: 826912 - DNA, 22 bp, Artificial Sequence
  chemically synthesized
taatttatggattttatataag

SEQ ID NO: 826913 - DNA, 22 bp, Artificial Sequence
  chemically synthesized
ttaatttatggattttatataa

SEQ ID NO: 826914 - DNA, 22 bp, Artificial Sequence
  chemically synthesized
tgccttatataaaatccataaa

SEQ ID NO: 826915 - DNA, 22 bp, Artificial Sequence
  chemically synthesized
ccatatcttttaatttatggat

SEQ ID NO: 826916 - DNA, 22 bp, Artificial Sequence
  chemically synthesized
atataaaatccataaattaaaa

SEQ ID NO: 826917 - DNA, 22 bp, Artificial Sequence
  chemically synthesized
tataaaatccataaattaaaag

SEQ ID NO: 826918 - DNA, 22 bp, Artificial Sequence
  chemically synthesized
accctcccatatcttttaattt

SEQ ID NO: 826919 - DNA, 22 bp, Artificial Sequence
  chemically synthesized
gaccctcccatatcttttaatt

SEQ ID NO: 826920 - DNA, 22 bp, Artificial Sequence
  chemically synthesized
tttgaccctcccatatctttta

SEQ ID NO: 826921 - DNA, 22 bp, Artificial Sequence
  chemically synthesized
aattatttgaccctcccatatc

SEQ ID NO: 826922 - DNA, 22 bp, Artificial Sequence
  chemically synthesized
ctgaattatttgaccctcccat

SEQ ID NO: 826923 - DNA, 22 bp, Artificial Sequence
  chemically synthesized
actgaattatttgaccctccca

SEQ ID NO: 826924 - DNA, 22 bp, Artificial Sequence
  chemically synthesized
gcttactgaattatttgaccct

SEQ ID NO: 826925 - DNA, 22 bp, Artificial Sequence
  chemically synthesized
aaagatatgggagggtcaaata

SEQ ID NO: 826926 - DNA, 22 bp, Artificial Sequence
  chemically synthesized
ggcttactgaattatttgaccc

SEQ ID NO: 826927 - DNA, 22 bp, Artificial Sequence
  chemically synthesized
tggcttactgaattatttgacc

SEQ ID NO: 826928 - DNA, 22 bp, Artificial Sequence
  chemically synthesized
gttttggcttactgaattattt

SEQ ID NO: 826929 - DNA, 22 bp, Artificial Sequence
  chemically synthesized
attagttttggcttactgaatt

SEQ ID NO: 826930 - DNA, 22 bp, Artificial Sequence
  chemically synthesized
agtaagccaaaactaatcaatg

SEQ ID NO: 826931 - DNA, 22 bp, Artificial Sequence
  chemically synthesized
gggaaagagaggtcattgatta

SEQ ID NO: 826932 - DNA, 22 bp, Artificial Sequence
  chemically synthesized
agaaagttagggaaagagaggt

SEQ ID NO: 826933 - DNA, 22 bp, Artificial Sequence
  chemically synthesized
aagaaagttagggaaagagagg

SEQ ID NO: 826934 - DNA, 22 bp, Artificial Sequence
  chemically synthesized
taagaaagttagggaaagagag

SEQ ID NO: 826935 - DNA, 22 bp, Artificial Sequence
  chemically synthesized
atcaatgacctctctttcccta

SEQ ID NO: 826936 - DNA, 22 bp, Artificial Sequence
  chemically synthesized
ttttaagaaagttagggaaaga

SEQ ID NO: 826937 - DNA, 22 bp, Artificial Sequence
  chemically synthesized
tagttattttaagaaagttagg

SEQ ID NO: 826938 - DNA, 22 bp, Artificial Sequence
  chemically synthesized
acctatagttattttaagaaag

SEQ ID NO: 826939 - DNA, 22 bp, Artificial Sequence
  chemically synthesized
tctttccctaactttcttaaaa

SEQ ID NO: 826940 - DNA, 22 bp, Artificial Sequence
  chemically synthesized
taacctatagttattttaagaa

SEQ ID NO: 826941 - DNA, 22 bp, Artificial Sequence
  chemically synthesized
tttccctaactttcttaaaata

SEQ ID NO: 826942 - DNA, 22 bp, Artificial Sequence
  chemically synthesized
tctaacctatagttattttaag

SEQ ID NO: 826943 - DNA, 22 bp, Artificial Sequence
  chemically synthesized
tccctaactttcttaaaataac

SEQ ID NO: 826944 - DNA, 22 bp, Artificial Sequence
  chemically synthesized
ccctaactttcttaaaataact

SEQ ID NO: 826945 - DNA, 22 bp, Artificial Sequence
  chemically synthesized
tctctaacctatagttatttta

SEQ ID NO: 826946 - DNA, 22 bp, Artificial Sequence
  chemically synthesized
cctaactttcttaaaataacta

SEQ ID NO: 826947 - DNA, 22 bp, Artificial Sequence
  chemically synthesized
actttcttaaaataactatagg

SEQ ID NO: 826948 - DNA, 22 bp, Artificial Sequence
  chemically synthesized
tcttaaaataactataggttag

SEQ ID NO: 826949 - DNA, 22 bp, Artificial Sequence
  chemically synthesized
cttaaaataactataggttaga

SEQ ID NO: 826950 - DNA, 22 bp, Artificial Sequence
  chemically synthesized
ttaaaataactataggttagag

SEQ ID NO: 826951 - DNA, 22 bp, Artificial Sequence
  chemically synthesized
aaaataactataggttagagag

SEQ ID NO: 826952 - DNA, 22 bp, Artificial Sequence
  chemically synthesized
aaataactataggttagagaga

SEQ ID NO: 826953 - DNA, 22 bp, Artificial Sequence
  chemically synthesized
taggttagagagaatctgttgg

SEQ ID NO: 826954 - DNA, 22 bp, Artificial Sequence
  chemically synthesized
gagagaatctgttggcatatcc

SEQ ID NO: 826955 - DNA, 22 bp, Artificial Sequence
  chemically synthesized
agaagatagacacaggcaatag

SEQ ID NO: 826956 - DNA, 22 bp, Artificial Sequence
  chemically synthesized
ttggcatatcctattgcctgtg

SEQ ID NO: 826957 - DNA, 22 bp, Artificial Sequence
  chemically synthesized
attaagaagatagacacaggca

SEQ ID NO: 826958 - DNA, 22 bp, Artificial Sequence
  chemically synthesized
gcatatcctattgcctgtgtct

SEQ ID NO: 826959 - DNA, 22 bp, Artificial Sequence
  chemically synthesized
gattaagaagatagacacaggc

SEQ ID NO: 826960 - DNA, 22 bp, Artificial Sequence
  chemically synthesized
taatttgattaagaagatagac

SEQ ID NO: 826961 - DNA, 22 bp, Artificial Sequence
  chemically synthesized
ttgcctgtgtctatcttcttaa

SEQ ID NO: 826962 - DNA, 22 bp, Artificial Sequence
  chemically synthesized
tctgtaatttgattaagaagat

SEQ ID NO: 826963 - DNA, 22 bp, Artificial Sequence
  chemically synthesized
atctgtaatttgattaagaaga

SEQ ID NO: 826964 - DNA, 22 bp, Artificial Sequence
  chemically synthesized
cctgtgtctatcttcttaatca

SEQ ID NO: 826965 - DNA, 22 bp, Artificial Sequence
  chemically synthesized
tttatctgtaatttgattaaga

SEQ ID NO: 826966 - DNA, 22 bp, Artificial Sequence
  chemically synthesized
tgtctatcttcttaatcaaatt

SEQ ID NO: 826967 - DNA, 22 bp, Artificial Sequence
  chemically synthesized
aattatttatctgtaatttgat

SEQ ID NO: 826968 - DNA, 22 bp, Artificial Sequence
  chemically synthesized
taaattatttatctgtaatttg

SEQ ID NO: 826969 - DNA, 22 bp, Artificial Sequence
  chemically synthesized
ctaaattatttatctgtaattt

SEQ ID NO: 826970 - DNA, 22 bp, Artificial Sequence
  chemically synthesized
tcttcttaatcaaattacagat

SEQ ID NO: 826971 - DNA, 22 bp, Artificial Sequence
  chemically synthesized
cttaatcaaattacagataaat

SEQ ID NO: 826972 - DNA, 22 bp, Artificial Sequence
  chemically synthesized
ttaatcaaattacagataaata

SEQ ID NO: 826973 - DNA, 22 bp, Artificial Sequence
  chemically synthesized
aatcaaattacagataaataat

SEQ ID NO: 826974 - DNA, 22 bp, Artificial Sequence
  chemically synthesized
atcaaattacagataaataatt

SEQ ID NO: 826975 - DNA, 22 bp, Artificial Sequence
  chemically synthesized
cagataaataatttagaaacgt

SEQ ID NO: 826976 - DNA, 22 bp, Artificial Sequence
  chemically synthesized
aatatatagagggacgtttcta

SEQ ID NO: 826977 - DNA, 22 bp, Artificial Sequence
  chemically synthesized
caatatatagagggacgtttct

SEQ ID NO: 826978 - DNA, 22 bp, Artificial Sequence
  chemically synthesized
gcttcaatatatagagggacgt

SEQ ID NO: 826979 - DNA, 22 bp, Artificial Sequence
  chemically synthesized
agaaacgtccctctatatattg

SEQ ID NO: 826980 - DNA, 22 bp, Artificial Sequence
  chemically synthesized
atccactggcttcaatatatag

SEQ ID NO: 826981 - DNA, 22 bp, Artificial Sequence
  chemically synthesized
gaaacgtccctctatatattga

SEQ ID NO: 826982 - DNA, 22 bp, Artificial Sequence
  chemically synthesized
tatatattgaagccagtggatt

SEQ ID NO: 826983 - DNA, 22 bp, Artificial Sequence
  chemically synthesized
tatattgaagccagtggattag

SEQ ID NO: 826984 - DNA, 22 bp, Artificial Sequence
  chemically synthesized
ggtcatgtgggagaccctaatc

SEQ ID NO: 826985 - DNA, 22 bp, Artificial Sequence
  chemically synthesized
aagccagtggattagggtctcc

SEQ ID NO: 826986 - DNA, 22 bp, Artificial Sequence
  chemically synthesized
cctaggtcatgtgggagaccct

SEQ ID NO: 826987 - DNA, 22 bp, Artificial Sequence
  chemically synthesized
gtgtctccctaggtcatgtggg

SEQ ID NO: 826988 - DNA, 22 bp, Artificial Sequence
  chemically synthesized
gggtctcccacatgacctaggg

SEQ ID NO: 826989 - DNA, 22 bp, Artificial Sequence
  chemically synthesized
ccacatgacctagggagacacc

SEQ ID NO: 826990 - DNA, 22 bp, Artificial Sequence
  chemically synthesized
gccatgccagctggtgtctccc

SEQ ID NO: 826991 - DNA, 22 bp, Artificial Sequence
  chemically synthesized
agccatgccagctggtgtctcc

SEQ ID NO: 826992 - DNA, 22 bp, Artificial Sequence
  chemically synthesized
ccttagccatgccagctggtgt

SEQ ID NO: 826993 - DNA, 22 bp, Artificial Sequence
  chemically synthesized
gggagacaccagctggcatggc

SEQ ID NO: 826994 - DNA, 22 bp, Artificial Sequence
  chemically synthesized
gcatggctaagggagtggttgc

SEQ ID NO: 826995 - DNA, 22 bp, Artificial Sequence
  chemically synthesized
ggagtaggggaggtatggtgca

SEQ ID NO: 826996 - DNA, 22 bp, Artificial Sequence
  chemically synthesized
agggagtggttgcaccatacct

SEQ ID NO: 826997 - DNA, 22 bp, Artificial Sequence
  chemically synthesized
ctgggagtaggggaggtatggt

SEQ ID NO: 826998 - DNA, 22 bp, Artificial Sequence
  chemically synthesized
actgctgggagtaggggaggta

SEQ ID NO: 826999 - DNA, 22 bp, Artificial Sequence
  chemically synthesized
cactgctgggagtaggggaggt

SEQ ID NO: 827000 - DNA, 22 bp, Artificial Sequence
  chemically synthesized
caccatacctcccctactccca

SEQ ID NO: 827001 - DNA, 22 bp, Artificial Sequence
  chemically synthesized
caagcttcactgctgggagtag

SEQ ID NO: 827002 - DNA, 22 bp, Artificial Sequence
  chemically synthesized
ctgcaagcttcactgctgggag

SEQ ID NO: 827003 - DNA, 22 bp, Artificial Sequence
  chemically synthesized
ttgctgcaagcttcactgctgg

SEQ ID NO: 827004 - DNA, 22 bp, Artificial Sequence
  chemically synthesized
tgttgctgcaagcttcactgct

SEQ ID NO: 827005 - DNA, 22 bp, Artificial Sequence
  chemically synthesized
ctgttgctgcaagcttcactgc

SEQ ID NO: 827006 - DNA, 22 bp, Artificial Sequence
  chemically synthesized
ccctactcccagcagtgaagct

SEQ ID NO: 827007 - DNA, 22 bp, Artificial Sequence
  chemically synthesized
ctcccagcagtgaagcttgcag

SEQ ID NO: 827008 - DNA, 22 bp, Artificial Sequence
  chemically synthesized
ccagcagtgaagcttgcagcaa

SEQ ID NO: 827009 - DNA, 22 bp, Artificial Sequence
  chemically synthesized
acgagaagtaaggagtcacttc

SEQ ID NO: 827010 - DNA, 22 bp, Artificial Sequence
  chemically synthesized
aacgagaagtaaggagtcactt

SEQ ID NO: 827011 - DNA, 22 bp, Artificial Sequence
  chemically synthesized
gcagcaacagaagtgactcctt

SEQ ID NO: 827012 - DNA, 22 bp, Artificial Sequence
  chemically synthesized
cagcaacagaagtgactcctta

SEQ ID NO: 827013 - DNA, 22 bp, Artificial Sequence
  chemically synthesized
cttaacgagaagtaaggagtca

SEQ ID NO: 827014 - DNA, 22 bp, Artificial Sequence
  chemically synthesized
tccttaacgagaagtaaggagt

SEQ ID NO: 827015 - DNA, 22 bp, Artificial Sequence
  chemically synthesized
ctccttaacgagaagtaaggag

SEQ ID NO: 827016 - DNA, 22 bp, Artificial Sequence
  chemically synthesized
ttctccttaacgagaagtaagg

SEQ ID NO: 827017 - DNA, 22 bp, Artificial Sequence
  chemically synthesized
tcttctccttaacgagaagtaa

SEQ ID NO: 827018 - DNA, 22 bp, Artificial Sequence
  chemically synthesized
gctctcttctccttaacgagaa

SEQ ID NO: 827019 - DNA, 22 bp, Artificial Sequence
  chemically synthesized
cgctctcttctccttaacgaga

SEQ ID NO: 827020 - DNA, 22 bp, Artificial Sequence
  chemically synthesized
tcgctctcttctccttaacgag

SEQ ID NO: 827021 - DNA, 22 bp, Artificial Sequence
  chemically synthesized
ttcgctctcttctccttaacga

SEQ ID NO: 827022 - DNA, 22 bp, Artificial Sequence
  chemically synthesized
cttttcgctctcttctccttaa

SEQ ID NO: 827023 - DNA, 22 bp, Artificial Sequence
  chemically synthesized
cttacttctcgttaaggagaag

SEQ ID NO: 827024 - DNA, 22 bp, Artificial Sequence
  chemically synthesized
acttttcgctctcttctcctta

SEQ ID NO: 827025 - DNA, 22 bp, Artificial Sequence
  chemically synthesized
tacttttcgctctcttctcctt

SEQ ID NO: 827026 - DNA, 22 bp, Artificial Sequence
  chemically synthesized
acttctcgttaaggagaagaga

SEQ ID NO: 827027 - DNA, 22 bp, Artificial Sequence
  chemically synthesized
tttacttttcgctctcttctcc

SEQ ID NO: 827028 - DNA, 22 bp, Artificial Sequence
  chemically synthesized
cttctcgttaaggagaagagag

SEQ ID NO: 827029 - DNA, 22 bp, Artificial Sequence
  chemically synthesized
ctttacttttcgctctcttctc

SEQ ID NO: 827030 - DNA, 22 bp, Artificial Sequence
  chemically synthesized
ctcgttaaggagaagagagcga

SEQ ID NO: 827031 - DNA, 22 bp, Artificial Sequence
  chemically synthesized
tcgttaaggagaagagagcgaa

SEQ ID NO: 827032 - DNA, 22 bp, Artificial Sequence
  chemically synthesized
gttaaggagaagagagcgaaaa

SEQ ID NO: 827033 - DNA, 22 bp, Artificial Sequence
  chemically synthesized
aggagaagagagcgaaaagtaa

SEQ ID NO: 827034 - DNA, 22 bp, Artificial Sequence
  chemically synthesized
gtatccaagatgcaagacaaag

SEQ ID NO: 827035 - DNA, 22 bp, Artificial Sequence
  chemically synthesized
agctggtatccaagatgcaaga

SEQ ID NO: 827036 - DNA, 22 bp, Artificial Sequence
  chemically synthesized
tggctgagctggtatccaagat

SEQ ID NO: 827037 - DNA, 22 bp, Artificial Sequence
  chemically synthesized
ctgtggctgagctggtatccaa

SEQ ID NO: 827038 - DNA, 22 bp, Artificial Sequence
  chemically synthesized
tgtcttgcatcttggataccag

SEQ ID NO: 827039 - DNA, 22 bp, Artificial Sequence
  chemically synthesized
gtcttgcatcttggataccagc

SEQ ID NO: 827040 - DNA, 22 bp, Artificial Sequence
  chemically synthesized
tcttgcatcttggataccagct

SEQ ID NO: 827041 - DNA, 22 bp, Artificial Sequence
  chemically synthesized
gcatcttggataccagctcagc

SEQ ID NO: 827042 - DNA, 22 bp, Artificial Sequence
  chemically synthesized
catcttggataccagctcagcc

SEQ ID NO: 827043 - DNA, 22 bp, Artificial Sequence
  chemically synthesized
ggataccagctcagccacagta

SEQ ID NO: 827044 - DNA, 22 bp, Artificial Sequence
  chemically synthesized
gataccagctcagccacagtag

SEQ ID NO: 827045 - DNA, 22 bp, Artificial Sequence
  chemically synthesized
cccatgccccatcctactgtgg

SEQ ID NO: 827046 - DNA, 22 bp, Artificial Sequence
  chemically synthesized
tgcccatgccccatcctactgt

SEQ ID NO: 827047 - DNA, 22 bp, Artificial Sequence
  chemically synthesized
atgactctgcccatgccccatc

SEQ ID NO: 827048 - DNA, 22 bp, Artificial Sequence
  chemically synthesized
agccacagtaggatggggcatg

SEQ ID NO: 827049 - DNA, 22 bp, Artificial Sequence
  chemically synthesized
gaatgggggcctcatgactctg

SEQ ID NO: 827050 - DNA, 22 bp, Artificial Sequence
  chemically synthesized
gggcctggaatgggggcctcat

SEQ ID NO: 827051 - DNA, 22 bp, Artificial Sequence
  chemically synthesized
tccaggaactagggcctggaat

SEQ ID NO: 827052 - DNA, 22 bp, Artificial Sequence
  chemically synthesized
gaaatgctatccaggaactagg

SEQ ID NO: 827053 - DNA, 22 bp, Artificial Sequence
  chemically synthesized
caggccctagttcctggatagc

SEQ ID NO: 827054 - DNA, 22 bp, Artificial Sequence
  chemically synthesized
gttcctggatagcatttctaga

SEQ ID NO: 827055 - DNA, 22 bp, Artificial Sequence
  chemically synthesized
gcccagggtgtgtctagaaatg

SEQ ID NO: 827056 - DNA, 22 bp, Artificial Sequence
  chemically synthesized
ggcccagggtgtgtctagaaat

SEQ ID NO: 827057 - DNA, 22 bp, Artificial Sequence
  chemically synthesized
tggcccagggtgtgtctagaaa

SEQ ID NO: 827058 - DNA, 22 bp, Artificial Sequence
  chemically synthesized
ttggcccagggtgtgtctagaa

SEQ ID NO: 827059 - DNA, 22 bp, Artificial Sequence
  chemically synthesized
ctggatagcatttctagacaca

SEQ ID NO: 827060 - DNA, 22 bp, Artificial Sequence
  chemically synthesized
gatagcatttctagacacaccc

SEQ ID NO: 827061 - DNA, 22 bp, Artificial Sequence
  chemically synthesized
ccttttggcccagggtgtgtct

SEQ ID NO: 827062 - DNA, 22 bp, Artificial Sequence
  chemically synthesized
ctagacacaccctgggccaaaa

SEQ ID NO: 827063 - DNA, 22 bp, Artificial Sequence
  chemically synthesized
tagacacaccctgggccaaaag

SEQ ID NO: 827064 - DNA, 22 bp, Artificial Sequence
  chemically synthesized
gacacaccctgggccaaaaggg

SEQ ID NO: 827065 - DNA, 22 bp, Artificial Sequence
  chemically synthesized
aggtagcagattcccttttggc

SEQ ID NO: 827066 - DNA, 22 bp, Artificial Sequence
  chemically synthesized
aaggtagcagattcccttttgg

SEQ ID NO: 827067 - DNA, 22 bp, Artificial Sequence
  chemically synthesized
taaggtagcagattcccttttg

SEQ ID NO: 827068 - DNA, 22 bp, Artificial Sequence
  chemically synthesized
cctttaaggtagcagattccct

SEQ ID NO: 827069 - DNA, 22 bp, Artificial Sequence
  chemically synthesized
ccctttaaggtagcagattccc

SEQ ID NO: 827070 - DNA, 22 bp, Artificial Sequence
  chemically synthesized
ggccaaaagggaatctgctacc

SEQ ID NO: 827071 - DNA, 22 bp, Artificial Sequence
  chemically synthesized
agtccttccctttaaggtagca

SEQ ID NO: 827072 - DNA, 22 bp, Artificial Sequence
  chemically synthesized
ataggactgagtccttcccttt

SEQ ID NO: 827073 - DNA, 22 bp, Artificial Sequence
  chemically synthesized
ctaccttaaagggaaggactca

SEQ ID NO: 827074 - DNA, 22 bp, Artificial Sequence
  chemically synthesized
ccttaaagggaaggactcagtc

SEQ ID NO: 827075 - DNA, 22 bp, Artificial Sequence
  chemically synthesized
atgaatcctgataggactgagt

SEQ ID NO: 827076 - DNA, 22 bp, Artificial Sequence
  chemically synthesized
aaagggaaggactcagtcctat

SEQ ID NO: 827077 - DNA, 22 bp, Artificial Sequence
  chemically synthesized
aagggaaggactcagtcctatc

SEQ ID NO: 827078 - DNA, 22 bp, Artificial Sequence
  chemically synthesized
gtagctgatgaatcctgatagg

SEQ ID NO: 827079 - DNA, 22 bp, Artificial Sequence
  chemically synthesized
gttagtagctgatgaatcctga

SEQ ID NO: 827080 - DNA, 22 bp, Artificial Sequence
  chemically synthesized
agttagtagctgatgaatcctg

SEQ ID NO: 827081 - DNA, 22 bp, Artificial Sequence
  chemically synthesized
tagttagtagctgatgaatcct

SEQ ID NO: 827082 - DNA, 22 bp, Artificial Sequence
  chemically synthesized
tttagttagtagctgatgaatc

SEQ ID NO: 827083 - DNA, 22 bp, Artificial Sequence
  chemically synthesized
agtcctatcaggattcatcagc

SEQ ID NO: 827084 - DNA, 22 bp, Artificial Sequence
  chemically synthesized
tcaggattcatcagctactaac

SEQ ID NO: 827085 - DNA, 22 bp, Artificial Sequence
  chemically synthesized
aaggcctctttagttagtagct

SEQ ID NO: 827086 - DNA, 22 bp, Artificial Sequence
  chemically synthesized
aacgttcaaggcctctttagtt

SEQ ID NO: 827087 - DNA, 22 bp, Artificial Sequence
  chemically synthesized
atcagctactaactaaagaggc

SEQ ID NO: 827088 - DNA, 22 bp, Artificial Sequence
  chemically synthesized
ttcaacgttcaaggcctcttta

SEQ ID NO: 827089 - DNA, 22 bp, Artificial Sequence
  chemically synthesized
gttattcaacgttcaaggcctc

SEQ ID NO: 827090 - DNA, 22 bp, Artificial Sequence
  chemically synthesized
ctaactaaagaggccttgaacg

SEQ ID NO: 827091 - DNA, 22 bp, Artificial Sequence
  chemically synthesized
actaaagaggccttgaacgttg

SEQ ID NO: 827092 - DNA, 22 bp, Artificial Sequence
  chemically synthesized
caactggttattcaacgttcaa

SEQ ID NO: 827093 - DNA, 22 bp, Artificial Sequence
  chemically synthesized
aagaggccttgaacgttgaata

SEQ ID NO: 827094 - DNA, 22 bp, Artificial Sequence
  chemically synthesized
ggtattgcaactggttattcaa

SEQ ID NO: 827095 - DNA, 22 bp, Artificial Sequence
  chemically synthesized
cctgggtattgcaactggttat

SEQ ID NO: 827096 - DNA, 22 bp, Artificial Sequence
  chemically synthesized
gaacgttgaataaccagttgca

SEQ ID NO: 827097 - DNA, 22 bp, Artificial Sequence
  chemically synthesized
aacgttgaataaccagttgcaa

SEQ ID NO: 827098 - DNA, 22 bp, Artificial Sequence
  chemically synthesized
aataaccagttgcaatacccag

SEQ ID NO: 827099 - DNA, 22 bp, Artificial Sequence
  chemically synthesized
caatacccagggagtacactgt

SEQ ID NO: 827100 - DNA, 22 bp, Artificial Sequence
  chemically synthesized
agaggccaagtcccacagtgta

SEQ ID NO: 827101 - DNA, 22 bp, Artificial Sequence
  chemically synthesized
tgaagccagcacatctcagagg

SEQ ID NO: 827102 - DNA, 22 bp, Artificial Sequence
  chemically synthesized
tgggacttggcctctgagatgt

SEQ ID NO: 827103 - DNA, 22 bp, Artificial Sequence
  chemically synthesized
ggtgacctatgaagccagcaca

SEQ ID NO: 827104 - DNA, 22 bp, Artificial Sequence
  chemically synthesized
ggcctctgagatgtgctggctt

SEQ ID NO: 827105 - DNA, 22 bp, Artificial Sequence
  chemically synthesized
gcctctgagatgtgctggcttc

SEQ ID NO: 827106 - DNA, 22 bp, Artificial Sequence
  chemically synthesized
ctgggtgacctatgaagccagc

SEQ ID NO: 827107 - DNA, 22 bp, Artificial Sequence
  chemically synthesized
gctgggtgacctatgaagccag

SEQ ID NO: 827108 - DNA, 22 bp, Artificial Sequence
  chemically synthesized
tgagatgtgctggcttcatagg

SEQ ID NO: 827109 - DNA, 22 bp, Artificial Sequence
  chemically synthesized
agatgtgctggcttcataggtc

SEQ ID NO: 827110 - DNA, 22 bp, Artificial Sequence
  chemically synthesized
ggaatttgctgggtgacctatg

SEQ ID NO: 827111 - DNA, 22 bp, Artificial Sequence
  chemically synthesized
gcttcataggtcacccagcaaa

SEQ ID NO: 827112 - DNA, 22 bp, Artificial Sequence
  chemically synthesized
cataggtcacccagcaaattcc

SEQ ID NO: 827113 - DNA, 22 bp, Artificial Sequence
  chemically synthesized
ataggtcacccagcaaattccc

SEQ ID NO: 827114 - DNA, 22 bp, Artificial Sequence
  chemically synthesized
accataaccaccacagctggga

SEQ ID NO: 827115 - DNA, 22 bp, Artificial Sequence
  chemically synthesized
caccataaccaccacagctggg

SEQ ID NO: 827116 - DNA, 22 bp, Artificial Sequence
  chemically synthesized
tcaccataaccaccacagctgg

SEQ ID NO: 827117 - DNA, 22 bp, Artificial Sequence
  chemically synthesized
ccagctgtggtggttatggtga

SEQ ID NO: 827118 - DNA, 22 bp, Artificial Sequence
  chemically synthesized
aaacagaaggggtctttcacca

SEQ ID NO: 827119 - DNA, 22 bp, Artificial Sequence
  chemically synthesized
tcaaacagaaggggtctttcac

SEQ ID NO: 827120 - DNA, 22 bp, Artificial Sequence
  chemically synthesized
tggtggttatggtgaaagaccc

SEQ ID NO: 827121 - DNA, 22 bp, Artificial Sequence
  chemically synthesized
ctcaaacagaaggggtctttca

SEQ ID NO: 827122 - DNA, 22 bp, Artificial Sequence
  chemically synthesized
tctcaaacagaaggggtctttc

SEQ ID NO: 827123 - DNA, 22 bp, Artificial Sequence
  chemically synthesized
ttctcaaacagaaggggtcttt

SEQ ID NO: 827124 - DNA, 22 bp, Artificial Sequence
  chemically synthesized
cttttctcaaacagaaggggtc

SEQ ID NO: 827125 - DNA, 22 bp, Artificial Sequence
  chemically synthesized
tggtgaaagaccccttctgttt

SEQ ID NO: 827126 - DNA, 22 bp, Artificial Sequence
  chemically synthesized
tctacttttctcaaacagaagg

SEQ ID NO: 827127 - DNA, 22 bp, Artificial Sequence
  chemically synthesized
tgtctacttttctcaaacagaa

SEQ ID NO: 827128 - DNA, 22 bp, Artificial Sequence
  chemically synthesized
ctgtctacttttctcaaacaga

SEQ ID NO: 827129 - DNA, 22 bp, Artificial Sequence
  chemically synthesized
tctgtctacttttctcaaacag

SEQ ID NO: 827130 - DNA, 22 bp, Artificial Sequence
  chemically synthesized
ttctgtctacttttctcaaaca

SEQ ID NO: 827131 - DNA, 22 bp, Artificial Sequence
  chemically synthesized
cttttctgtctacttttctcaa

SEQ ID NO: 827132 - DNA, 22 bp, Artificial Sequence
  chemically synthesized
acttttctgtctacttttctca

SEQ ID NO: 827133 - DNA, 22 bp, Artificial Sequence
  chemically synthesized
tacttttctgtctacttttctc

SEQ ID NO: 827134 - DNA, 22 bp, Artificial Sequence
  chemically synthesized
ctgtttgagaaaagtagacaga

SEQ ID NO: 827135 - DNA, 22 bp, Artificial Sequence
  chemically synthesized
tgtttgagaaaagtagacagaa

SEQ ID NO: 827136 - DNA, 22 bp, Artificial Sequence
  chemically synthesized
tttgagaaaagtagacagaaaa

SEQ ID NO: 827137 - DNA, 22 bp, Artificial Sequence
  chemically synthesized
gagaaaagtagacagaaaagta

SEQ ID NO: 827138 - DNA, 22 bp, Artificial Sequence
  chemically synthesized
agaaaagtagacagaaaagtaa

SEQ ID NO: 827139 - DNA, 22 bp, Artificial Sequence
  chemically synthesized
aggggcaagacaaagtcccctt

SEQ ID NO: 827140 - DNA, 22 bp, Artificial Sequence
  chemically synthesized
gtacctaaggggcaagacaaag

SEQ ID NO: 827141 - DNA, 22 bp, Artificial Sequence
  chemically synthesized
agctggtacctaaggggcaaga

SEQ ID NO: 827142 - DNA, 22 bp, Artificial Sequence
  chemically synthesized
tggctgagctggtacctaaggg

SEQ ID NO: 827143 - DNA, 22 bp, Artificial Sequence
  chemically synthesized
tgtggctgagctggtacctaag

SEQ ID NO: 827144 - DNA, 22 bp, Artificial Sequence
  chemically synthesized
ctgtggctgagctggtacctaa

SEQ ID NO: 827145 - DNA, 22 bp, Artificial Sequence
  chemically synthesized
tgtcttgccccttaggtaccag

SEQ ID NO: 827146 - DNA, 22 bp, Artificial Sequence
  chemically synthesized
tctgtggctgagctggtaccta

SEQ ID NO: 827147 - DNA, 22 bp, Artificial Sequence
  chemically synthesized
gtcttgccccttaggtaccagc

SEQ ID NO: 827148 - DNA, 22 bp, Artificial Sequence
  chemically synthesized
tcttgccccttaggtaccagct

SEQ ID NO: 827149 - DNA, 22 bp, Artificial Sequence
  chemically synthesized
cctttctgtggctgagctggta

SEQ ID NO: 827150 - DNA, 22 bp, Artificial Sequence
  chemically synthesized
gccccttaggtaccagctcagc

SEQ ID NO: 827151 - DNA, 22 bp, Artificial Sequence
  chemically synthesized
tgcctttctgtggctgagctgg

SEQ ID NO: 827152 - DNA, 22 bp, Artificial Sequence
  chemically synthesized
ccccttaggtaccagctcagcc

SEQ ID NO: 827153 - DNA, 22 bp, Artificial Sequence
  chemically synthesized
tctgcctttctgtggctgagct

SEQ ID NO: 827154 - DNA, 22 bp, Artificial Sequence
  chemically synthesized
ctctgcctttctgtggctgagc

SEQ ID NO: 827155 - DNA, 22 bp, Artificial Sequence
  chemically synthesized
cttctctgcctttctgtggctg

SEQ ID NO: 827156 - DNA, 22 bp, Artificial Sequence
  chemically synthesized
aggtaccagctcagccacagaa

SEQ ID NO: 827157 - DNA, 22 bp, Artificial Sequence
  chemically synthesized
ggtaccagctcagccacagaaa

SEQ ID NO: 827158 - DNA, 22 bp, Artificial Sequence
  chemically synthesized
cctgcttctctgcctttctgtg

SEQ ID NO: 827159 - DNA, 22 bp, Artificial Sequence
  chemically synthesized
agccacagaaaggcagagaagc

SEQ ID NO: 827160 - DNA, 22 bp, Artificial Sequence
  chemically synthesized
agaaatcccagaagcctgcctg

SEQ ID NO: 827161 - DNA, 22 bp, Artificial Sequence
  chemically synthesized
ggccaggactcagaaatcccag

SEQ ID NO: 827162 - DNA, 22 bp, Artificial Sequence
  chemically synthesized
ctgggatttctgagtcctggcc

SEQ ID NO: 827163 - DNA, 22 bp, Artificial Sequence
  chemically synthesized
tccaagaacctaggccaggact

SEQ ID NO: 827164 - DNA, 22 bp, Artificial Sequence
  chemically synthesized
tgggatttctgagtcctggcct

SEQ ID NO: 827165 - DNA, 22 bp, Artificial Sequence
  chemically synthesized
ggatttctgagtcctggcctag

SEQ ID NO: 827166 - DNA, 22 bp, Artificial Sequence
  chemically synthesized
ctgagtcctggcctaggttctt

SEQ ID NO: 827167 - DNA, 22 bp, Artificial Sequence
  chemically synthesized
tgagtcctggcctaggttcttg

SEQ ID NO: 827168 - DNA, 22 bp, Artificial Sequence
  chemically synthesized
agtcctggcctaggttcttgga

SEQ ID NO: 827169 - DNA, 22 bp, Artificial Sequence
  chemically synthesized
gcctaggttcttggacagcatt

SEQ ID NO: 827170 - DNA, 22 bp, Artificial Sequence
  chemically synthesized
ggttcttggacagcatttttgg

SEQ ID NO: 827171 - DNA, 22 bp, Artificial Sequence
  chemically synthesized
gcccaaggcaggaccaaaaatg

SEQ ID NO: 827172 - DNA, 22 bp, Artificial Sequence
  chemically synthesized
tggcccaaggcaggaccaaaaa

SEQ ID NO: 827173 - DNA, 22 bp, Artificial Sequence
  chemically synthesized
ttggacagcatttttggtcctg

SEQ ID NO: 827174 - DNA, 22 bp, Artificial Sequence
  chemically synthesized
ggacagcatttttggtcctgcc

SEQ ID NO: 827175 - DNA, 22 bp, Artificial Sequence
  chemically synthesized
gacagcatttttggtcctgcct

SEQ ID NO: 827176 - DNA, 22 bp, Artificial Sequence
  chemically synthesized
ccctctggcccaaggcaggacc

SEQ ID NO: 827177 - DNA, 22 bp, Artificial Sequence
  chemically synthesized
ggctcccctctggcccaaggca

SEQ ID NO: 827178 - DNA, 22 bp, Artificial Sequence
  chemically synthesized
gggctcccctctggcccaaggc

SEQ ID NO: 827179 - DNA, 22 bp, Artificial Sequence
  chemically synthesized
ttggtcctgccttgggccagag

SEQ ID NO: 827180 - DNA, 22 bp, Artificial Sequence
  chemically synthesized
tggtcctgccttgggccagagg

SEQ ID NO: 827181 - DNA, 22 bp, Artificial Sequence
  chemically synthesized
ggtcctgccttgggccagaggg

SEQ ID NO: 827182 - DNA, 22 bp, Artificial Sequence
  chemically synthesized
gtcctgccttgggccagagggg

SEQ ID NO: 827183 - DNA, 22 bp, Artificial Sequence
  chemically synthesized
gggccttgggctcccctctggc

SEQ ID NO: 827184 - DNA, 22 bp, Artificial Sequence
  chemically synthesized
agggccttgggctcccctctgg

SEQ ID NO: 827185 - DNA, 22 bp, Artificial Sequence
  chemically synthesized
tagggccttgggctcccctctg

SEQ ID NO: 827186 - DNA, 22 bp, Artificial Sequence
  chemically synthesized
ccttgggccagaggggagccca

SEQ ID NO: 827187 - DNA, 22 bp, Artificial Sequence
  chemically synthesized
gggccagaggggagcccaaggc

SEQ ID NO: 827188 - DNA, 22 bp, Artificial Sequence
  chemically synthesized
ggccagaggggagcccaaggcc

SEQ ID NO: 827189 - DNA, 22 bp, Artificial Sequence
  chemically synthesized
ggacccatattttagggccttg

SEQ ID NO: 827190 - DNA, 22 bp, Artificial Sequence
  chemically synthesized
agagaactgggacccatatttt

SEQ ID NO: 827191 - DNA, 22 bp, Artificial Sequence
  chemically synthesized
tggtgaatgctgagagaactgg

SEQ ID NO: 827192 - DNA, 22 bp, Artificial Sequence
  chemically synthesized
aaatatgggtcccagttctctc

SEQ ID NO: 827193 - DNA, 22 bp, Artificial Sequence
  chemically synthesized
gtggtgaatgctgagagaactg

SEQ ID NO: 827194 - DNA, 22 bp, Artificial Sequence
  chemically synthesized
catcagcttgtggtgaatgctg

SEQ ID NO: 827195 - DNA, 22 bp, Artificial Sequence
  chemically synthesized
ccatcagcttgtggtgaatgct

SEQ ID NO: 827196 - DNA, 22 bp, Artificial Sequence
  chemically synthesized
ttccatcagcttgtggtgaatg

SEQ ID NO: 827197 - DNA, 22 bp, Artificial Sequence
  chemically synthesized
tctcagcattcaccacaagctg

SEQ ID NO: 827198 - DNA, 22 bp, Artificial Sequence
  chemically synthesized
tcagcattcaccacaagctgat

SEQ ID NO: 827199 - DNA, 22 bp, Artificial Sequence
  chemically synthesized
agcattcaccacaagctgatgg

SEQ ID NO: 827200 - DNA, 22 bp, Artificial Sequence
  chemically synthesized
aagcccaagggctcttccatca

SEQ ID NO: 827201 - DNA, 22 bp, Artificial Sequence
  chemically synthesized
aaagcccaagggctcttccatc

SEQ ID NO: 827202 - DNA, 22 bp, Artificial Sequence
  chemically synthesized
accacaagctgatggaagagcc

SEQ ID NO: 827203 - DNA, 22 bp, Artificial Sequence
  chemically synthesized
acttaaagcccaagggctcttc

SEQ ID NO: 827204 - DNA, 22 bp, Artificial Sequence
  chemically synthesized
gtgttcacttaaagcccaaggg

SEQ ID NO: 827205 - DNA, 22 bp, Artificial Sequence
  chemically synthesized
atggaagagcccttgggcttta

SEQ ID NO: 827206 - DNA, 22 bp, Artificial Sequence
  chemically synthesized
cactggtgttcacttaaagccc

SEQ ID NO: 827207 - DNA, 22 bp, Artificial Sequence
  chemically synthesized
gcctccactggtgttcacttaa

SEQ ID NO: 827208 - DNA, 22 bp, Artificial Sequence
  chemically synthesized
ggcctccactggtgttcactta

SEQ ID NO: 827209 - DNA, 22 bp, Artificial Sequence
  chemically synthesized
cttggcctccactggtgttcac

SEQ ID NO: 827210 - DNA, 22 bp, Artificial Sequence
  chemically synthesized
tgcttggcctccactggtgttc

SEQ ID NO: 827211 - DNA, 22 bp, Artificial Sequence
  chemically synthesized
gggctttaagtgaacaccagtg

SEQ ID NO: 827212 - DNA, 22 bp, Artificial Sequence
  chemically synthesized
ggctttaagtgaacaccagtgg

SEQ ID NO: 827213 - DNA, 22 bp, Artificial Sequence
  chemically synthesized
taagtgaacaccagtggaggcc

SEQ ID NO: 827214 - DNA, 22 bp, Artificial Sequence
  chemically synthesized
aagtgaacaccagtggaggcca

SEQ ID NO: 827215 - DNA, 22 bp, Artificial Sequence
  chemically synthesized
agtgaacaccagtggaggccaa

SEQ ID NO: 827216 - DNA, 22 bp, Artificial Sequence
  chemically synthesized
accaccatgagggttctgcttg

SEQ ID NO: 827217 - DNA, 22 bp, Artificial Sequence
  chemically synthesized
tggccctcaccaccatgagggt

SEQ ID NO: 827218 - DNA, 22 bp, Artificial Sequence
  chemically synthesized
cctgtggccctcaccaccatga

SEQ ID NO: 827219 - DNA, 22 bp, Artificial Sequence
  chemically synthesized
tccctgtggccctcaccaccat

SEQ ID NO: 827220 - DNA, 22 bp, Artificial Sequence
  chemically synthesized
atggtggtgagggccacaggga

SEQ ID NO: 827221 - DNA, 22 bp, Artificial Sequence
  chemically synthesized
aaaggcagaggatcctctccct

SEQ ID NO: 827222 - DNA, 22 bp, Artificial Sequence
  chemically synthesized
aaaaggcagaggatcctctccc

SEQ ID NO: 827223 - DNA, 22 bp, Artificial Sequence
  chemically synthesized
taaaaggcagaggatcctctcc

SEQ ID NO: 827224 - DNA, 22 bp, Artificial Sequence
  chemically synthesized
ttaaaaggcagaggatcctctc

SEQ ID NO: 827225 - DNA, 22 bp, Artificial Sequence
  chemically synthesized
cccttttaaaaggcagaggatc

SEQ ID NO: 827226 - DNA, 22 bp, Artificial Sequence
  chemically synthesized
gcccttttaaaaggcagaggat

SEQ ID NO: 827227 - DNA, 22 bp, Artificial Sequence
  chemically synthesized
cttgcccttttaaaaggcagag

SEQ ID NO: 827228 - DNA, 22 bp, Artificial Sequence
  chemically synthesized
ccttgcccttttaaaaggcaga

SEQ ID NO: 827229 - DNA, 22 bp, Artificial Sequence
  chemically synthesized
ttccttgcccttttaaaaggca

SEQ ID NO: 827230 - DNA, 22 bp, Artificial Sequence
  chemically synthesized
ctcttccttgcccttttaaaag

SEQ ID NO: 827231 - DNA, 22 bp, Artificial Sequence
  chemically synthesized
cctgctcttccttgccctttta

SEQ ID NO: 827232 - DNA, 22 bp, Artificial Sequence
  chemically synthesized
tgccttttaaaagggcaaggaa

SEQ ID NO: 827233 - DNA, 22 bp, Artificial Sequence
  chemically synthesized
ccttttaaaagggcaaggaaga

SEQ ID NO: 827234 - DNA, 22 bp, Artificial Sequence
  chemically synthesized
ttaaaagggcaaggaagagcag

SEQ ID NO: 827235 - DNA, 22 bp, Artificial Sequence
  chemically synthesized
taaaagggcaaggaagagcagg

SEQ ID NO: 827236 - DNA, 22 bp, Artificial Sequence
  chemically synthesized
aaaagggcaaggaagagcaggg

SEQ ID NO: 827237 - DNA, 22 bp, Artificial Sequence
  chemically synthesized
aaagggcaaggaagagcaggga

SEQ ID NO: 827238 - DNA, 22 bp, Artificial Sequence
  chemically synthesized
acaccacaatataaagtgctcc

SEQ ID NO: 827239 - DNA, 22 bp, Artificial Sequence
  chemically synthesized
gcactcacaccacaatataaag

SEQ ID NO: 827240 - DNA, 22 bp, Artificial Sequence
  chemically synthesized
agctagcactcacaccacaata

SEQ ID NO: 827241 - DNA, 22 bp, Artificial Sequence
  chemically synthesized
tggctaagctagcactcacacc

SEQ ID NO: 827242 - DNA, 22 bp, Artificial Sequence
  chemically synthesized
ttgtggctaagctagcactcac

SEQ ID NO: 827243 - DNA, 22 bp, Artificial Sequence
  chemically synthesized
tatattgtggtgtgagtgctag

SEQ ID NO: 827244 - DNA, 22 bp, Artificial Sequence
  chemically synthesized
atattgtggtgtgagtgctagc

SEQ ID NO: 827245 - DNA, 22 bp, Artificial Sequence
  chemically synthesized
tattgtggctaagctagcactc

SEQ ID NO: 827246 - DNA, 22 bp, Artificial Sequence
  chemically synthesized
tattgtggtgtgagtgctagct

SEQ ID NO: 827247 - DNA, 22 bp, Artificial Sequence
  chemically synthesized
ttctattgtggctaagctagca

SEQ ID NO: 827248 - DNA, 22 bp, Artificial Sequence
  chemically synthesized
tattctattgtggctaagctag

SEQ ID NO: 827249 - DNA, 22 bp, Artificial Sequence
  chemically synthesized
tggtgtgagtgctagcttagcc

SEQ ID NO: 827250 - DNA, 22 bp, Artificial Sequence
  chemically synthesized
atgttctattctattgtggcta

SEQ ID NO: 827251 - DNA, 22 bp, Artificial Sequence
  chemically synthesized
cctcatgttctattctattgtg

SEQ ID NO: 827252 - DNA, 22 bp, Artificial Sequence
  chemically synthesized
acctcatgttctattctattgt

SEQ ID NO: 827253 - DNA, 22 bp, Artificial Sequence
  chemically synthesized
gcttagccacaatagaatagaa

SEQ ID NO: 827254 - DNA, 22 bp, Artificial Sequence
  chemically synthesized
gcagtttacctcatgttctatt

SEQ ID NO: 827255 - DNA, 22 bp, Artificial Sequence
  chemically synthesized
agccacaatagaatagaacatg

SEQ ID NO: 827256 - DNA, 22 bp, Artificial Sequence
  chemically synthesized
agcagtttacctcatgttctat

SEQ ID NO: 827257 - DNA, 22 bp, Artificial Sequence
  chemically synthesized
gccacaatagaatagaacatga

SEQ ID NO: 827258 - DNA, 22 bp, Artificial Sequence
  chemically synthesized
gagtcaaaaaccttagcagttt

SEQ ID NO: 827259 - DNA, 22 bp, Artificial Sequence
  chemically synthesized
agggccagtcattggagtcaaa

SEQ ID NO: 827260 - DNA, 22 bp, Artificial Sequence
  chemically synthesized
ctaaggtttttgactccaatga

SEQ ID NO: 827261 - DNA, 22 bp, Artificial Sequence
  chemically synthesized
tctgagggccagtcattggagt

SEQ ID NO: 827262 - DNA, 22 bp, Artificial Sequence
  chemically synthesized
aggtttttgactccaatgactg

SEQ ID NO: 827263 - DNA, 22 bp, Artificial Sequence
  chemically synthesized
ttgactccaatgactggccctc

SEQ ID NO: 827264 - DNA, 22 bp, Artificial Sequence
  chemically synthesized
tgactccaatgactggccctca

SEQ ID NO: 827265 - DNA, 22 bp, Artificial Sequence
  chemically synthesized
gactccaatgactggccctcag

SEQ ID NO: 827266 - DNA, 22 bp, Artificial Sequence
  chemically synthesized
actccaatgactggccctcaga

SEQ ID NO: 827267 - DNA, 22 bp, Artificial Sequence
  chemically synthesized
caatgactggccctcagacagc

SEQ ID NO: 827268 - DNA, 22 bp, Artificial Sequence
  chemically synthesized
gccctcagacagcatctctgga

SEQ ID NO: 827269 - DNA, 22 bp, Artificial Sequence
  chemically synthesized
ggccccgggcatatccagagat

SEQ ID NO: 827270 - DNA, 22 bp, Artificial Sequence
  chemically synthesized
aggccccgggcatatccagaga

SEQ ID NO: 827271 - DNA, 22 bp, Artificial Sequence
  chemically synthesized
agacagcatctctggatatgcc

SEQ ID NO: 827272 - DNA, 22 bp, Artificial Sequence
  chemically synthesized
ggtggaaatcttaggccccggg

SEQ ID NO: 827273 - DNA, 22 bp, Artificial Sequence
  chemically synthesized
cggtggaaatcttaggccccgg

SEQ ID NO: 827274 - DNA, 22 bp, Artificial Sequence
  chemically synthesized
tcggtggaaatcttaggccccg

SEQ ID NO: 827275 - DNA, 22 bp, Artificial Sequence
  chemically synthesized
ttcggtggaaatcttaggcccc

SEQ ID NO: 827276 - DNA, 22 bp, Artificial Sequence
  chemically synthesized
tggatatgcccggggcctaaga

SEQ ID NO: 827277 - DNA, 22 bp, Artificial Sequence
  chemically synthesized
gatatgcccggggcctaagatt

SEQ ID NO: 827278 - DNA, 22 bp, Artificial Sequence
  chemically synthesized
gcagcagatttttcggtggaaa

SEQ ID NO: 827279 - DNA, 22 bp, Artificial Sequence
  chemically synthesized
agatttccaccgaaaaatctgc

SEQ ID NO: 827280 - DNA, 22 bp, Artificial Sequence
  chemically synthesized
aatacatctggcagcagatttt

SEQ ID NO: 827281 - DNA, 22 bp, Artificial Sequence
  chemically synthesized
caatacatctggcagcagattt

SEQ ID NO: 827282 - DNA, 22 bp, Artificial Sequence
  chemically synthesized
ccaccgaaaaatctgctgccag

SEQ ID NO: 827283 - DNA, 22 bp, Artificial Sequence
  chemically synthesized
caccgaaaaatctgctgccaga

SEQ ID NO: 827284 - DNA, 22 bp, Artificial Sequence
  chemically synthesized
ctgccagatgtattgaagctcc

SEQ ID NO: 827285 - DNA, 22 bp, Artificial Sequence
  chemically synthesized
ccagatgtattgaagctccact

SEQ ID NO: 827286 - DNA, 22 bp, Artificial Sequence
  chemically synthesized
aagctccactgcatgttatttg

SEQ ID NO: 827287 - DNA, 22 bp, Artificial Sequence
  chemically synthesized
cactgcatgttatttgtttcct

SEQ ID NO: 827288 - DNA, 22 bp, Artificial Sequence
  chemically synthesized
aaagcagcaagagaaaggaaac

SEQ ID NO: 827289 - DNA, 22 bp, Artificial Sequence
  chemically synthesized
catgttatttgtttcctttctc

SEQ ID NO: 827290 - DNA, 22 bp, Artificial Sequence
  chemically synthesized
tttgtttcctttctcttgctgc

SEQ ID NO: 827291 - DNA, 22 bp, Artificial Sequence
  chemically synthesized
gtttcctttctcttgctgcttt

SEQ ID NO: 827292 - DNA, 22 bp, Artificial Sequence
  chemically synthesized
tttcctttctcttgctgctttt

SEQ ID NO: 827293 - DNA, 22 bp, Artificial Sequence
  chemically synthesized
cctttctcttgctgcttttagg

SEQ ID NO: 827294 - DNA, 22 bp, Artificial Sequence
  chemically synthesized
ctttctcttgctgcttttagga

SEQ ID NO: 827295 - DNA, 22 bp, Artificial Sequence
  chemically synthesized
tctcttgctgcttttaggattc

SEQ ID NO: 827296 - DNA, 22 bp, Artificial Sequence
  chemically synthesized
ctcttgctgcttttaggattct

SEQ ID NO: 827297 - DNA, 22 bp, Artificial Sequence
  chemically synthesized
tcttgctgcttttaggattctt

SEQ ID NO: 827298 - DNA, 22 bp, Artificial Sequence
  chemically synthesized
ttgctgcttttaggattctttc

SEQ ID NO: 827299 - DNA, 22 bp, Artificial Sequence
  chemically synthesized
gctgcttttaggattctttctt

SEQ ID NO: 827300 - DNA, 22 bp, Artificial Sequence
  chemically synthesized
ctgcttttaggattctttcttt

SEQ ID NO: 827301 - DNA, 22 bp, Artificial Sequence
  chemically synthesized
cttttaggattctttctttatc

SEQ ID NO: 827302 - DNA, 22 bp, Artificial Sequence
  chemically synthesized
ccacaggtcaaggataaagaaa

SEQ ID NO: 827303 - DNA, 22 bp, Artificial Sequence
  chemically synthesized
ttaggattctttctttatcctt

SEQ ID NO: 827304 - DNA, 22 bp, Artificial Sequence
  chemically synthesized
taggattctttctttatccttg

SEQ ID NO: 827305 - DNA, 22 bp, Artificial Sequence
  chemically synthesized
aggattctttctttatccttga

SEQ ID NO: 827306 - DNA, 22 bp, Artificial Sequence
  chemically synthesized
ggattctttctttatccttgac

SEQ ID NO: 827307 - DNA, 22 bp, Artificial Sequence
  chemically synthesized
tttctttatccttgacctgtgg

SEQ ID NO: 827308 - DNA, 22 bp, Artificial Sequence
  chemically synthesized
tctttatccttgacctgtggga

SEQ ID NO: 827309 - DNA, 22 bp, Artificial Sequence
  chemically synthesized
ctttatccttgacctgtgggag

SEQ ID NO: 827310 - DNA, 22 bp, Artificial Sequence
  chemically synthesized
tttatccttgacctgtgggagt

SEQ ID NO: 827311 - DNA, 22 bp, Artificial Sequence
  chemically synthesized
tatccttgacctgtgggagttt

SEQ ID NO: 827312 - DNA, 22 bp, Artificial Sequence
  chemically synthesized
atccttgacctgtgggagtttg

SEQ ID NO: 827313 - DNA, 22 bp, Artificial Sequence
  chemically synthesized
tccttgacctgtgggagtttga

SEQ ID NO: 827314 - DNA, 22 bp, Artificial Sequence
  chemically synthesized
aaggcatgcaataatcaaactc

SEQ ID NO: 827315 - DNA, 22 bp, Artificial Sequence
  chemically synthesized
gacctgtgggagtttgattatt

SEQ ID NO: 827316 - DNA, 22 bp, Artificial Sequence
  chemically synthesized
acctgtgggagtttgattattg

SEQ ID NO: 827317 - DNA, 22 bp, Artificial Sequence
  chemically synthesized
cctcaaggcatgcaataatcaa

SEQ ID NO: 827318 - DNA, 22 bp, Artificial Sequence
  chemically synthesized
tgggagtttgattattgcatgc

SEQ ID NO: 827319 - DNA, 22 bp, Artificial Sequence
  chemically synthesized
agagactacctcaaggcatgca

SEQ ID NO: 827320 - DNA, 22 bp, Artificial Sequence
  chemically synthesized
tctcagagactacctcaaggca

SEQ ID NO: 827321 - DNA, 22 bp, Artificial Sequence
  chemically synthesized
gattattgcatgccttgaggta

SEQ ID NO: 827322 - DNA, 22 bp, Artificial Sequence
  chemically synthesized
attattgcatgccttgaggtag

SEQ ID NO: 827323 - DNA, 22 bp, Artificial Sequence
  chemically synthesized
ttgcatgccttgaggtagtctc

SEQ ID NO: 827324 - DNA, 22 bp, Artificial Sequence
  chemically synthesized
catgccttgaggtagtctctga

SEQ ID NO: 827325 - DNA, 22 bp, Artificial Sequence
  chemically synthesized
gaggtagtctctgagataattc

SEQ ID NO: 827326 - DNA, 22 bp, Artificial Sequence
  chemically synthesized
aggtagtctctgagataattct

SEQ ID NO: 827327 - DNA, 22 bp, Artificial Sequence
  chemically synthesized
tagaacaccaagcagaattatc

SEQ ID NO: 827328 - DNA, 22 bp, Artificial Sequence
  chemically synthesized
tgagataattctgcttggtgtt

SEQ ID NO: 827329 - DNA, 22 bp, Artificial Sequence
  chemically synthesized
agataattctgcttggtgttct

SEQ ID NO: 827330 - DNA, 22 bp, Artificial Sequence
  chemically synthesized
aagtacgacaaagttatagaac

SEQ ID NO: 827331 - DNA, 22 bp, Artificial Sequence
  chemically synthesized
tgcttggtgttctataactttg

SEQ ID NO: 827332 - DNA, 22 bp, Artificial Sequence
  chemically synthesized
cttggtgttctataactttgtc

SEQ ID NO: 827333 - DNA, 22 bp, Artificial Sequence
  chemically synthesized
ggtgttctataactttgtcgta

SEQ ID NO: 827334 - DNA, 22 bp, Artificial Sequence
  chemically synthesized
gtgttctataactttgtcgtac

SEQ ID NO: 827335 - DNA, 22 bp, Artificial Sequence
  chemically synthesized
tataactttgtcgtacttgaat

SEQ ID NO: 827336 - DNA, 22 bp, Artificial Sequence
  chemically synthesized
taactttgtcgtacttgaatgt

SEQ ID NO: 827337 - DNA, 22 bp, Artificial Sequence
  chemically synthesized
tgtcgtacttgaatgttggtat

SEQ ID NO: 827338 - DNA, 22 bp, Artificial Sequence
  chemically synthesized
gtcgtacttgaatgttggtatc

SEQ ID NO: 827339 - DNA, 22 bp, Artificial Sequence
  chemically synthesized
tcgtacttgaatgttggtatct

SEQ ID NO: 827340 - DNA, 22 bp, Artificial Sequence
  chemically synthesized
agaaacagagaaagataccaac

SEQ ID NO: 827341 - DNA, 22 bp, Artificial Sequence
  chemically synthesized
cagaaacagagaaagataccaa

SEQ ID NO: 827342 - DNA, 22 bp, Artificial Sequence
  chemically synthesized
gaatgttggtatctttctctgt

SEQ ID NO: 827343 - DNA, 22 bp, Artificial Sequence
  chemically synthesized
aatgttggtatctttctctgtt

SEQ ID NO: 827344 - DNA, 22 bp, Artificial Sequence
  chemically synthesized
gtatctttctctgtttctgaag

SEQ ID NO: 827345 - DNA, 22 bp, Artificial Sequence
  chemically synthesized
tctctgtttctgaagttctctg

SEQ ID NO: 827346 - DNA, 22 bp, Artificial Sequence
  chemically synthesized
ctctgtttctgaagttctctga

SEQ ID NO: 827347 - DNA, 22 bp, Artificial Sequence
  chemically synthesized
tctgtttctgaagttctctgat

SEQ ID NO: 827348 - DNA, 22 bp, Artificial Sequence
  chemically synthesized
tgtttctgaagttctctgatat

SEQ ID NO: 827349 - DNA, 22 bp, Artificial Sequence
  chemically synthesized
atacaaagggacaatatcagag

SEQ ID NO: 827350 - DNA, 22 bp, Artificial Sequence
  chemically synthesized
tttctgaagttctctgatattg

SEQ ID NO: 827351 - DNA, 22 bp, Artificial Sequence
  chemically synthesized
ctgaagttctctgatattgtcc

SEQ ID NO: 827352 - DNA, 22 bp, Artificial Sequence
  chemically synthesized
tgaagttctctgatattgtccc

SEQ ID NO: 827353 - DNA, 22 bp, Artificial Sequence
  chemically synthesized
aagttctctgatattgtccctt

SEQ ID NO: 827354 - DNA, 22 bp, Artificial Sequence
  chemically synthesized
tctgatattgtccctttgtatc

SEQ ID NO: 827355 - DNA, 22 bp, Artificial Sequence
  chemically synthesized
tgatattgtccctttgtatcaa

SEQ ID NO: 827356 - DNA, 22 bp, Artificial Sequence
  chemically synthesized
atattgtccctttgtatcaact

SEQ ID NO: 827357 - DNA, 22 bp, Artificial Sequence
  chemically synthesized
tccctttgtatcaactttctat

SEQ ID NO: 827358 - DNA, 22 bp, Artificial Sequence
  chemically synthesized
tgtatcaactttctatccctat

SEQ ID NO: 827359 - DNA, 22 bp, Artificial Sequence
  chemically synthesized
gtatcaactttctatccctatc

SEQ ID NO: 827360 - DNA, 22 bp, Artificial Sequence
  chemically synthesized
tatcaactttctatccctatct

SEQ ID NO: 827361 - DNA, 22 bp, Artificial Sequence
  chemically synthesized
aacaggaggtagagaaagagat

SEQ ID NO: 827362 - DNA, 22 bp, Artificial Sequence
  chemically synthesized
aaacaggaggtagagaaagaga

SEQ ID NO: 827363 - DNA, 22 bp, Artificial Sequence
  chemically synthesized
tctatccctatctctttctcta

SEQ ID NO: 827364 - DNA, 22 bp, Artificial Sequence
  chemically synthesized
ctatccctatctctttctctac

SEQ ID NO: 827365 - DNA, 22 bp, Artificial Sequence
  chemically synthesized
tatccctatctctttctctacc

SEQ ID NO: 827366 - DNA, 22 bp, Artificial Sequence
  chemically synthesized
gccttaaacaggaggtagagaa

SEQ ID NO: 827367 - DNA, 22 bp, Artificial Sequence
  chemically synthesized
tccctatctctttctctacctc

SEQ ID NO: 827368 - DNA, 22 bp, Artificial Sequence
  chemically synthesized
ttggccttaaacaggaggtaga

SEQ ID NO: 827369 - DNA, 22 bp, Artificial Sequence
  chemically synthesized
tctctttctctacctcctgttt

SEQ ID NO: 827370 - DNA, 22 bp, Artificial Sequence
  chemically synthesized
agagttattggccttaaacagg

SEQ ID NO: 827371 - DNA, 22 bp, Artificial Sequence
  chemically synthesized
tttctctacctcctgtttaagg

SEQ ID NO: 827372 - DNA, 22 bp, Artificial Sequence
  chemically synthesized
tctctacctcctgtttaaggcc

SEQ ID NO: 827373 - DNA, 22 bp, Artificial Sequence
  chemically synthesized
ctctacctcctgtttaaggcca

SEQ ID NO: 827374 - DNA, 22 bp, Artificial Sequence
  chemically synthesized
tctacctcctgtttaaggccaa

SEQ ID NO: 827375 - DNA, 22 bp, Artificial Sequence
  chemically synthesized
tacctcctgtttaaggccaata

SEQ ID NO: 827376 - DNA, 22 bp, Artificial Sequence
  chemically synthesized
cctcctgtttaaggccaataac

SEQ ID NO: 827377 - DNA, 22 bp, Artificial Sequence
  chemically synthesized
ctgtttaaggccaataactctt

SEQ ID NO: 827378 - DNA, 22 bp, Artificial Sequence
  chemically synthesized
aaaagggtcaatctaagagtta

SEQ ID NO: 827379 - DNA, 22 bp, Artificial Sequence
  chemically synthesized
tttaaggccaataactcttaga

SEQ ID NO: 827380 - DNA, 22 bp, Artificial Sequence
  chemically synthesized
aaggccaataactcttagattg

SEQ ID NO: 827381 - DNA, 22 bp, Artificial Sequence
  chemically synthesized
aggccaataactcttagattga

SEQ ID NO: 827382 - DNA, 22 bp, Artificial Sequence
  chemically synthesized
ttagattgacccttttgaggct

SEQ ID NO: 827383 - DNA, 22 bp, Artificial Sequence
  chemically synthesized
agattgacccttttgaggctat

SEQ ID NO: 827384 - DNA, 22 bp, Artificial Sequence
  chemically synthesized
gattgacccttttgaggctatt

SEQ ID NO: 827385 - DNA, 22 bp, Artificial Sequence
  chemically synthesized
caagatccagaaaatagcctca

SEQ ID NO: 827386 - DNA, 22 bp, Artificial Sequence
  chemically synthesized
cctacaagatccagaaaatagc

SEQ ID NO: 827387 - DNA, 22 bp, Artificial Sequence
  chemically synthesized
acccttttgaggctattttctg

SEQ ID NO: 827388 - DNA, 22 bp, Artificial Sequence
  chemically synthesized
tctgcctacaagatccagaaaa

SEQ ID NO: 827389 - DNA, 22 bp, Artificial Sequence
  chemically synthesized
ttgaggctattttctggatctt

SEQ ID NO: 827390 - DNA, 22 bp, Artificial Sequence
  chemically synthesized
tgaggctattttctggatcttg

SEQ ID NO: 827391 - DNA, 22 bp, Artificial Sequence
  chemically synthesized
gaggctattttctggatcttgt

SEQ ID NO: 827392 - DNA, 22 bp, Artificial Sequence
  chemically synthesized
aggctattttctggatcttgta

SEQ ID NO: 827393 - DNA, 22 bp, Artificial Sequence
  chemically synthesized
aaataggctgtctgcctacaag

SEQ ID NO: 827394 - DNA, 22 bp, Artificial Sequence
  chemically synthesized
caaataggctgtctgcctacaa

SEQ ID NO: 827395 - DNA, 22 bp, Artificial Sequence
  chemically synthesized
ttttctggatcttgtaggcaga

SEQ ID NO: 827396 - DNA, 22 bp, Artificial Sequence
  chemically synthesized
tcaaataggctgtctgcctaca

SEQ ID NO: 827397 - DNA, 22 bp, Artificial Sequence
  chemically synthesized
tctggatcttgtaggcagacag

SEQ ID NO: 827398 - DNA, 22 bp, Artificial Sequence
  chemically synthesized
ctggatcttgtaggcagacagc

SEQ ID NO: 827399 - DNA, 22 bp, Artificial Sequence
  chemically synthesized
tggatcttgtaggcagacagcc

SEQ ID NO: 827400 - DNA, 22 bp, Artificial Sequence
  chemically synthesized
gatcttgtaggcagacagccta

SEQ ID NO: 827401 - DNA, 22 bp, Artificial Sequence
  chemically synthesized
tgtattttcaaataggctgtct

SEQ ID NO: 827402 - DNA, 22 bp, Artificial Sequence
  chemically synthesized
gctgtgtattttcaaataggct

SEQ ID NO: 827403 - DNA, 22 bp, Artificial Sequence
  chemically synthesized
gtaggcagacagcctatttgaa

SEQ ID NO: 827404 - DNA, 22 bp, Artificial Sequence
  chemically synthesized
tggctgtgtattttcaaatagg

SEQ ID NO: 827405 - DNA, 22 bp, Artificial Sequence
  chemically synthesized
taggcagacagcctatttgaaa

SEQ ID NO: 827406 - DNA, 22 bp, Artificial Sequence
  chemically synthesized
tctggctgtgtattttcaaata

SEQ ID NO: 827407 - DNA, 22 bp, Artificial Sequence
  chemically synthesized
ctctggctgtgtattttcaaat

SEQ ID NO: 827408 - DNA, 22 bp, Artificial Sequence
  chemically synthesized
tcttctctggctgtgtattttc

SEQ ID NO: 827409 - DNA, 22 bp, Artificial Sequence
  chemically synthesized
gtcttctctggctgtgtatttt

SEQ ID NO: 827410 - DNA, 22 bp, Artificial Sequence
  chemically synthesized
tgtcttctctggctgtgtattt

SEQ ID NO: 827411 - DNA, 22 bp, Artificial Sequence
  chemically synthesized
ttgtcttctctggctgtgtatt

SEQ ID NO: 827412 - DNA, 22 bp, Artificial Sequence
  chemically synthesized
ttttgtcttctctggctgtgta

SEQ ID NO: 827413 - DNA, 22 bp, Artificial Sequence
  chemically synthesized
cttttgtcttctctggctgtgt

SEQ ID NO: 827414 - DNA, 22 bp, Artificial Sequence
  chemically synthesized
tcttttgtcttctctggctgtg

SEQ ID NO: 827415 - DNA, 22 bp, Artificial Sequence
  chemically synthesized
ttcttttgtcttctctggctgt

SEQ ID NO: 827416 - DNA, 22 bp, Artificial Sequence
  chemically synthesized
tttgaaaatacacagccagaga

SEQ ID NO: 827417 - DNA, 22 bp, Artificial Sequence
  chemically synthesized
tttcttttgtcttctctggctg

SEQ ID NO: 827418 - DNA, 22 bp, Artificial Sequence
  chemically synthesized
ttttcttttgtcttctctggct

SEQ ID NO: 827419 - DNA, 22 bp, Artificial Sequence
  chemically synthesized
gaaaatacacagccagagaaga

SEQ ID NO: 827420 - DNA, 22 bp, Artificial Sequence
  chemically synthesized
aaaatacacagccagagaagac

SEQ ID NO: 827421 - DNA, 22 bp, Artificial Sequence
  chemically synthesized
tttttttcttttgtcttctctg

SEQ ID NO: 827422 - DNA, 22 bp, Artificial Sequence
  chemically synthesized
ttatttttttcttttgtcttct

SEQ ID NO: 827423 - DNA, 22 bp, Artificial Sequence
  chemically synthesized
attatttttttcttttgtcttc

SEQ ID NO: 827424 - DNA, 22 bp, Artificial Sequence
  chemically synthesized
ttattatttttttcttttgtct

SEQ ID NO: 827425 - DNA, 22 bp, Artificial Sequence
  chemically synthesized
cttattatttttttcttttgtc

SEQ ID NO: 827426 - DNA, 22 bp, Artificial Sequence
  chemically synthesized
tttcttattatttttttctttt

SEQ ID NO: 827427 - DNA, 22 bp, Artificial Sequence
  chemically synthesized
attgtttcttattatttttttc

SEQ ID NO: 827428 - DNA, 22 bp, Artificial Sequence
  chemically synthesized
cattgtttcttattattttttt

SEQ ID NO: 827429 - DNA, 22 bp, Artificial Sequence
  chemically synthesized
taggtatgcttcattgtttctt

SEQ ID NO: 827430 - DNA, 22 bp, Artificial Sequence
  chemically synthesized
gtaggtatgcttcattgtttct

SEQ ID NO: 827431 - DNA, 22 bp, Artificial Sequence
  chemically synthesized
gatcttgtaggtatgcttcatt

SEQ ID NO: 827432 - DNA, 22 bp, Artificial Sequence
  chemically synthesized
tgtctggatcttgtaggtatgc

SEQ ID NO: 827433 - DNA, 22 bp, Artificial Sequence
  chemically synthesized
gtgtctggatcttgtaggtatg

SEQ ID NO: 827434 - DNA, 22 bp, Artificial Sequence
  chemically synthesized
tgtgtctggatcttgtaggtat

SEQ ID NO: 827435 - DNA, 22 bp, Artificial Sequence
  chemically synthesized
ttgtgtctggatcttgtaggta

SEQ ID NO: 827436 - DNA, 22 bp, Artificial Sequence
  chemically synthesized
tttgtgtctggatcttgtaggt

SEQ ID NO: 827437 - DNA, 22 bp, Artificial Sequence
  chemically synthesized
aagggttttttgtgtctggatc

SEQ ID NO: 827438 - DNA, 22 bp, Artificial Sequence
  chemically synthesized
gaagggttttttgtgtctggat

SEQ ID NO: 827439 - DNA, 22 bp, Artificial Sequence
  chemically synthesized
tgaagggttttttgtgtctgga

SEQ ID NO: 827440 - DNA, 22 bp, Artificial Sequence
  chemically synthesized
ttgaagggttttttgtgtctgg

SEQ ID NO: 827441 - DNA, 22 bp, Artificial Sequence
  chemically synthesized
tttgaagggttttttgtgtctg

SEQ ID NO: 827442 - DNA, 22 bp, Artificial Sequence
  chemically synthesized
ttttgaagggttttttgtgtct

SEQ ID NO: 827443 - DNA, 22 bp, Artificial Sequence
  chemically synthesized
caagatccagacacaaaaaacc

SEQ ID NO: 827444 - DNA, 22 bp, Artificial Sequence
  chemically synthesized
atttttttgaagggttttttgt

SEQ ID NO: 827445 - DNA, 22 bp, Artificial Sequence
  chemically synthesized
attgatttttttgaagggtttt

SEQ ID NO: 827446 - DNA, 22 bp, Artificial Sequence
  chemically synthesized
gattcattgatttttttgaagg

SEQ ID NO: 827447 - DNA, 22 bp, Artificial Sequence
  chemically synthesized
ctggattcattgatttttttga

SEQ ID NO: 827448 - DNA, 22 bp, Artificial Sequence
  chemically synthesized
gctcctggattcattgattttt

SEQ ID NO: 827449 - DNA, 22 bp, Artificial Sequence
  chemically synthesized
caaaaaaatcaatgaatccagg

SEQ ID NO: 827450 - DNA, 22 bp, Artificial Sequence
  chemically synthesized
aaaaaactggctcctggattca

SEQ ID NO: 827451 - DNA, 22 bp, Artificial Sequence
  chemically synthesized
aaaaaaatcaatgaatccagga

SEQ ID NO: 827452 - DNA, 22 bp, Artificial Sequence
  chemically synthesized
caaaaaactggctcctggattc

SEQ ID NO: 827453 - DNA, 22 bp, Artificial Sequence
  chemically synthesized
tcaaaaaactggctcctggatt

SEQ ID NO: 827454 - DNA, 22 bp, Artificial Sequence
  chemically synthesized
ttcaaaaaactggctcctggat

SEQ ID NO: 827455 - DNA, 22 bp, Artificial Sequence
  chemically synthesized
atcttttcaaaaaactggctcc

SEQ ID NO: 827456 - DNA, 22 bp, Artificial Sequence
  chemically synthesized
ttgatcttttcaaaaaactggc

SEQ ID NO: 827457 - DNA, 22 bp, Artificial Sequence
  chemically synthesized
tgttgatcttttcaaaaaactg

SEQ ID NO: 827458 - DNA, 22 bp, Artificial Sequence
  chemically synthesized
tcaattctgttgatcttttcaa

SEQ ID NO: 827459 - DNA, 22 bp, Artificial Sequence
  chemically synthesized
gcggtctatcaattctgttgat

SEQ ID NO: 827460 - DNA, 22 bp, Artificial Sequence
  chemically synthesized
tttgaaaagatcaacagaattg

SEQ ID NO: 827461 - DNA, 22 bp, Artificial Sequence
  chemically synthesized
ctagcggtctatcaattctgtt

SEQ ID NO: 827462 - DNA, 22 bp, Artificial Sequence
  chemically synthesized
ttgaaaagatcaacagaattga

SEQ ID NO: 827463 - DNA, 22 bp, Artificial Sequence
  chemically synthesized
actagcggtctatcaattctgt

SEQ ID NO: 827464 - DNA, 22 bp, Artificial Sequence
  chemically synthesized
tgaaaagatcaacagaattgat

SEQ ID NO: 827465 - DNA, 22 bp, Artificial Sequence
  chemically synthesized
gaaaagatcaacagaattgata

SEQ ID NO: 827466 - DNA, 22 bp, Artificial Sequence
  chemically synthesized
aaaagatcaacagaattgatag

SEQ ID NO: 827467 - DNA, 22 bp, Artificial Sequence
  chemically synthesized
gtcttactagcggtctatcaat

SEQ ID NO: 827468 - DNA, 22 bp, Artificial Sequence
  chemically synthesized
ttagtcttactagcggtctatc

SEQ ID NO: 827469 - DNA, 22 bp, Artificial Sequence
  chemically synthesized
attagtcttactagcggtctat

SEQ ID NO: 827470 - DNA, 22 bp, Artificial Sequence
  chemically synthesized
tattagtcttactagcggtcta

SEQ ID NO: 827471 - DNA, 22 bp, Artificial Sequence
  chemically synthesized
tttattagtcttactagcggtc

SEQ ID NO: 827472 - DNA, 22 bp, Artificial Sequence
  chemically synthesized
ctttattagtcttactagcggt

SEQ ID NO: 827473 - DNA, 22 bp, Artificial Sequence
  chemically synthesized
ttctttattagtcttactagcg

SEQ ID NO: 827474 - DNA, 22 bp, Artificial Sequence
  chemically synthesized
cttctttattagtcttactagc

SEQ ID NO: 827475 - DNA, 22 bp, Artificial Sequence
  chemically synthesized
tcttctttattagtcttactag

SEQ ID NO: 827476 - DNA, 22 bp, Artificial Sequence
  chemically synthesized
ttcttctttattagtcttacta

SEQ ID NO: 827477 - DNA, 22 bp, Artificial Sequence
  chemically synthesized
ttttcttctttattagtcttac

SEQ ID NO: 827478 - DNA, 22 bp, Artificial Sequence
  chemically synthesized
atagaccgctagtaagactaat

SEQ ID NO: 827479 - DNA, 22 bp, Artificial Sequence
  chemically synthesized
tcttttcttctttattagtctt

SEQ ID NO: 827480 - DNA, 22 bp, Artificial Sequence
  chemically synthesized
tctcttttcttctttattagtc

SEQ ID NO: 827481 - DNA, 22 bp, Artificial Sequence
  chemically synthesized
ctctcttttcttctttattagt

SEQ ID NO: 827482 - DNA, 22 bp, Artificial Sequence
  chemically synthesized
ttctctcttttcttctttatta

SEQ ID NO: 827483 - DNA, 22 bp, Artificial Sequence
  chemically synthesized
attcttctctcttttcttcttt

SEQ ID NO: 827484 - DNA, 22 bp, Artificial Sequence
  chemically synthesized
gtaagactaataaagaagaaaa

SEQ ID NO: 827485 - DNA, 22 bp, Artificial Sequence
  chemically synthesized
gattcttctctcttttcttctt

SEQ ID NO: 827486 - DNA, 22 bp, Artificial Sequence
  chemically synthesized
tttgattcttctctcttttctt

SEQ ID NO: 827487 - DNA, 22 bp, Artificial Sequence
  chemically synthesized
ataaagaagaaaagagagaaga

SEQ ID NO: 827488 - DNA, 22 bp, Artificial Sequence
  chemically synthesized
catctatttgattcttctctct

SEQ ID NO: 827489 - DNA, 22 bp, Artificial Sequence
  chemically synthesized
ttgcatctatttgattcttctc

SEQ ID NO: 827490 - DNA, 22 bp, Artificial Sequence
  chemically synthesized
attgcatctatttgattcttct

SEQ ID NO: 827491 - DNA, 22 bp, Artificial Sequence
  chemically synthesized
tattgcatctatttgattcttc

SEQ ID NO: 827492 - DNA, 22 bp, Artificial Sequence
  chemically synthesized
ttattgcatctatttgattctt

SEQ ID NO: 827493 - DNA, 22 bp, Artificial Sequence
  chemically synthesized
tttattgcatctatttgattct

SEQ ID NO: 827494 - DNA, 22 bp, Artificial Sequence
  chemically synthesized
tcattttttattgcatctattt

SEQ ID NO: 827495 - DNA, 22 bp, Artificial Sequence
  chemically synthesized
atcattttttattgcatctatt

SEQ ID NO: 827496 - DNA, 22 bp, Artificial Sequence
  chemically synthesized
tatcattttttattgcatctat

SEQ ID NO: 827497 - DNA, 22 bp, Artificial Sequence
  chemically synthesized
tggtgtcggtggtgatatcccc

SEQ ID NO: 827498 - DNA, 22 bp, Artificial Sequence
  chemically synthesized
tgtggtgtcggtggtgatatcc

SEQ ID NO: 827499 - DNA, 22 bp, Artificial Sequence
  chemically synthesized
ctgtggtgtcggtggtgatatc

SEQ ID NO: 827500 - DNA, 22 bp, Artificial Sequence
  chemically synthesized
tatttctgtggtgtcggtggtg

SEQ ID NO: 827501 - DNA, 22 bp, Artificial Sequence
  chemically synthesized
gtatttctgtggtgtcggtggt

SEQ ID NO: 827502 - DNA, 22 bp, Artificial Sequence
  chemically synthesized
atggtagtttgtatttctgtgg

SEQ ID NO: 827503 - DNA, 22 bp, Artificial Sequence
  chemically synthesized
tgatggtagtttgtatttctgt

SEQ ID NO: 827504 - DNA, 22 bp, Artificial Sequence
  chemically synthesized
tctgatggtagtttgtatttct

SEQ ID NO: 827505 - DNA, 22 bp, Artificial Sequence
  chemically synthesized
tagtattctctgatggtagttt

SEQ ID NO: 827506 - DNA, 22 bp, Artificial Sequence
  chemically synthesized
atagtattctctgatggtagtt

SEQ ID NO: 827507 - DNA, 22 bp, Artificial Sequence
  chemically synthesized
cgtagaggtgtttatagtattc

SEQ ID NO: 827508 - DNA, 22 bp, Artificial Sequence
  chemically synthesized
gcgtagaggtgtttatagtatt

SEQ ID NO: 827509 - DNA, 22 bp, Artificial Sequence
  chemically synthesized
ccatcagagaatactataaaca

SEQ ID NO: 827510 - DNA, 22 bp, Artificial Sequence
  chemically synthesized
tttgcgtagaggtgtttatagt

SEQ ID NO: 827511 - DNA, 22 bp, Artificial Sequence
  chemically synthesized
atttgcgtagaggtgtttatag

SEQ ID NO: 827512 - DNA, 22 bp, Artificial Sequence
  chemically synthesized
gtttatttgcgtagaggtgttt

SEQ ID NO: 827513 - DNA, 22 bp, Artificial Sequence
  chemically synthesized
tagtttatttgcgtagaggtgt

SEQ ID NO: 827514 - DNA, 22 bp, Artificial Sequence
  chemically synthesized
ctagtttatttgcgtagaggtg

SEQ ID NO: 827515 - DNA, 22 bp, Artificial Sequence
  chemically synthesized
tctagtttatttgcgtagaggt

SEQ ID NO: 827516 - DNA, 22 bp, Artificial Sequence
  chemically synthesized
gattttctagtttatttgcgta

SEQ ID NO: 827517 - DNA, 22 bp, Artificial Sequence
  chemically synthesized
taaacacctctacgcaaataaa

SEQ ID NO: 827518 - DNA, 22 bp, Artificial Sequence
  chemically synthesized
tagattttctagtttatttgcg

SEQ ID NO: 827519 - DNA, 22 bp, Artificial Sequence
  chemically synthesized
ctagattttctagtttatttgc

SEQ ID NO: 827520 - DNA, 22 bp, Artificial Sequence
  chemically synthesized
ttctagattttctagtttattt

SEQ ID NO: 827521 - DNA, 22 bp, Artificial Sequence
  chemically synthesized
cttctagattttctagtttatt

SEQ ID NO: 827522 - DNA, 22 bp, Artificial Sequence
  chemically synthesized
tacgcaaataaactagaaaatc

SEQ ID NO: 827523 - DNA, 22 bp, Artificial Sequence
  chemically synthesized
tccatttcttctagattttcta

SEQ ID NO: 827524 - DNA, 22 bp, Artificial Sequence
  chemically synthesized
cgcaaataaactagaaaatcta

SEQ ID NO: 827525 - DNA, 22 bp, Artificial Sequence
  chemically synthesized
atccatttcttctagattttct

SEQ ID NO: 827526 - DNA, 22 bp, Artificial Sequence
  chemically synthesized
gaaaatctagaagaaatggata

SEQ ID NO: 827527 - DNA, 22 bp, Artificial Sequence
  chemically synthesized
gaagaaatggataaattcctgc

SEQ ID NO: 827528 - DNA, 22 bp, Artificial Sequence
  chemically synthesized
ggaaggtgtatgtgtgcaggaa

SEQ ID NO: 827529 - DNA, 22 bp, Artificial Sequence
  chemically synthesized
gggaaggtgtatgtgtgcagga

SEQ ID NO: 827530 - DNA, 22 bp, Artificial Sequence
  chemically synthesized
gtcttgggaaggtgtatgtgtg

SEQ ID NO: 827531 - DNA, 22 bp, Artificial Sequence
  chemically synthesized
agtcttgggaaggtgtatgtgt

SEQ ID NO: 827532 - DNA, 22 bp, Artificial Sequence
  chemically synthesized
gtttagtcttgggaaggtgtat

SEQ ID NO: 827533 - DNA, 22 bp, Artificial Sequence
  chemically synthesized
ctggtttagtcttgggaaggtg

SEQ ID NO: 827534 - DNA, 22 bp, Artificial Sequence
  chemically synthesized
ctgcacacatacaccttcccaa

SEQ ID NO: 827535 - DNA, 22 bp, Artificial Sequence
  chemically synthesized
cctggtttagtcttgggaaggt

SEQ ID NO: 827536 - DNA, 22 bp, Artificial Sequence
  chemically synthesized
ttcctggtttagtcttgggaag

SEQ ID NO: 827537 - DNA, 22 bp, Artificial Sequence
  chemically synthesized
cacacatacaccttcccaagac

SEQ ID NO: 827538 - DNA, 22 bp, Artificial Sequence
  chemically synthesized
cttcctggtttagtcttgggaa

SEQ ID NO: 827539 - DNA, 22 bp, Artificial Sequence
  chemically synthesized
aacttcttcctggtttagtctt

SEQ ID NO: 827540 - DNA, 22 bp, Artificial Sequence
  chemically synthesized
agggattcaacttcttcctggt

SEQ ID NO: 827541 - DNA, 22 bp, Artificial Sequence
  chemically synthesized
cccaagactaaaccaggaagaa

SEQ ID NO: 827542 - DNA, 22 bp, Artificial Sequence
  chemically synthesized
ccaagactaaaccaggaagaag

SEQ ID NO: 827543 - DNA, 22 bp, Artificial Sequence
  chemically synthesized
ttcagggattcaacttcttcct

SEQ ID NO: 827544 - DNA, 22 bp, Artificial Sequence
  chemically synthesized
gtctattcagggattcaacttc

SEQ ID NO: 827545 - DNA, 22 bp, Artificial Sequence
  chemically synthesized
aaccaggaagaagttgaatccc

SEQ ID NO: 827546 - DNA, 22 bp, Artificial Sequence
  chemically synthesized
ttggtctattcagggattcaac

SEQ ID NO: 827547 - DNA, 22 bp, Artificial Sequence
  chemically synthesized
ttattggtctattcagggattc

SEQ ID NO: 827548 - DNA, 22 bp, Artificial Sequence
  chemically synthesized
agagcctgttattggtctattc

SEQ ID NO: 827549 - DNA, 22 bp, Artificial Sequence
  chemically synthesized
cagagcctgttattggtctatt

SEQ ID NO: 827550 - DNA, 22 bp, Artificial Sequence
  chemically synthesized
aatccctgaatagaccaataac

SEQ ID NO: 827551 - DNA, 22 bp, Artificial Sequence
  chemically synthesized
aatttcagagcctgttattggt

SEQ ID NO: 827552 - DNA, 22 bp, Artificial Sequence
  chemically synthesized
cctcaatttcagagcctgttat

SEQ ID NO: 827553 - DNA, 22 bp, Artificial Sequence
  chemically synthesized
aatagaccaataacaggctctg

SEQ ID NO: 827554 - DNA, 22 bp, Artificial Sequence
  chemically synthesized
ttgcctcaatttcagagcctgt

SEQ ID NO: 827555 - DNA, 22 bp, Artificial Sequence
  chemically synthesized
attattgcctcaatttcagagc

SEQ ID NO: 827556 - DNA, 22 bp, Artificial Sequence
  chemically synthesized
ttaattattgcctcaatttcag

SEQ ID NO: 827557 - DNA, 22 bp, Artificial Sequence
  chemically synthesized
taggctattaattattgcctca

SEQ ID NO: 827558 - DNA, 22 bp, Artificial Sequence
  chemically synthesized
gtaggctattaattattgcctc

SEQ ID NO: 827559 - DNA, 22 bp, Artificial Sequence
  chemically synthesized
gtttgtaggctattaattattg

SEQ ID NO: 827560 - DNA, 22 bp, Artificial Sequence
  chemically synthesized
tgaaattgaggcaataattaat

SEQ ID NO: 827561 - DNA, 22 bp, Artificial Sequence
  chemically synthesized
ggtttgtaggctattaattatt

SEQ ID NO: 827562 - DNA, 22 bp, Artificial Sequence
  chemically synthesized
tggtttgtaggctattaattat

SEQ ID NO: 827563 - DNA, 22 bp, Artificial Sequence
  chemically synthesized
aaattgaggcaataattaatag

SEQ ID NO: 827564 - DNA, 22 bp, Artificial Sequence
  chemically synthesized
ttggtttgtaggctattaatta

SEQ ID NO: 827565 - DNA, 22 bp, Artificial Sequence
  chemically synthesized
tttggtttgtaggctattaatt

SEQ ID NO: 827566 - DNA, 22 bp, Artificial Sequence
  chemically synthesized
ttttggtttgtaggctattaat

SEQ ID NO: 827567 - DNA, 22 bp, Artificial Sequence
  chemically synthesized
tttttggtttgtaggctattaa

SEQ ID NO: 827568 - DNA, 22 bp, Artificial Sequence
  chemically synthesized
aggcaataattaatagcctaca

SEQ ID NO: 827569 - DNA, 22 bp, Artificial Sequence
  chemically synthesized
gactttttttggtttgtaggct

SEQ ID NO: 827570 - DNA, 22 bp, Artificial Sequence
  chemically synthesized
gtcctggactttttttggtttg

SEQ ID NO: 827571 - DNA, 22 bp, Artificial Sequence
  chemically synthesized
atagcctacaaaccaaaaaaag

SEQ ID NO: 827572 - DNA, 22 bp, Artificial Sequence
  chemically synthesized
caaaccaaaaaaagtccaggac

SEQ ID NO: 827573 - DNA, 22 bp, Artificial Sequence
  chemically synthesized
tgaatccgtctggtcctggact

SEQ ID NO: 827574 - DNA, 22 bp, Artificial Sequence
  chemically synthesized
ggctgtgaatccgtctggtcct

SEQ ID NO: 827575 - DNA, 22 bp, Artificial Sequence
  chemically synthesized
gtagaattcggctgtgaatccg

SEQ ID NO: 827576 - DNA, 22 bp, Artificial Sequence
  chemically synthesized
tggtagaattcggctgtgaatc

SEQ ID NO: 827577 - DNA, 22 bp, Artificial Sequence
  chemically synthesized
cacctctggtagaattcggctg

SEQ ID NO: 827578 - DNA, 22 bp, Artificial Sequence
  chemically synthesized
gcacctctggtagaattcggct

SEQ ID NO: 827579 - DNA, 22 bp, Artificial Sequence
  chemically synthesized
tgcacctctggtagaattcggc

SEQ ID NO: 827580 - DNA, 22 bp, Artificial Sequence
  chemically synthesized
tttgcacctctggtagaattcg

SEQ ID NO: 827581 - DNA, 22 bp, Artificial Sequence
  chemically synthesized
ctctttgcacctctggtagaat

SEQ ID NO: 827582 - DNA, 22 bp, Artificial Sequence
  chemically synthesized
acagccgaattctaccagaggt

SEQ ID NO: 827583 - DNA, 22 bp, Artificial Sequence
  chemically synthesized
taccagaggtgcaaagaggaac

SEQ ID NO: 827584 - DNA, 22 bp, Artificial Sequence
  chemically synthesized
ccagaggtgcaaagaggaactg

SEQ ID NO: 827585 - DNA, 22 bp, Artificial Sequence
  chemically synthesized
gaaggaatgataccagttcctc

SEQ ID NO: 827586 - DNA, 22 bp, Artificial Sequence
  chemically synthesized
agaaggaatgataccagttcct

SEQ ID NO: 827587 - DNA, 22 bp, Artificial Sequence
  chemically synthesized
tagaaggaatgataccagttcc

SEQ ID NO: 827588 - DNA, 22 bp, Artificial Sequence
  chemically synthesized
gaatagttttagaaggaatgat

SEQ ID NO: 827589 - DNA, 22 bp, Artificial Sequence
  chemically synthesized
attggaatagttttagaaggaa

SEQ ID NO: 827590 - DNA, 22 bp, Artificial Sequence
  chemically synthesized
ttgattggaatagttttagaag

SEQ ID NO: 827591 - DNA, 22 bp, Artificial Sequence
  chemically synthesized
tattgattggaatagttttaga

SEQ ID NO: 827592 - DNA, 22 bp, Artificial Sequence
  chemically synthesized
gtatcattccttctaaaactat

SEQ ID NO: 827593 - DNA, 22 bp, Artificial Sequence
  chemically synthesized
ctattgattggaatagttttag

SEQ ID NO: 827594 - DNA, 22 bp, Artificial Sequence
  chemically synthesized
tctattgattggaatagtttta

SEQ ID NO: 827595 - DNA, 22 bp, Artificial Sequence
  chemically synthesized
ttctattgattggaatagtttt

SEQ ID NO: 827596 - DNA, 22 bp, Artificial Sequence
  chemically synthesized
tttctattgattggaatagttt

SEQ ID NO: 827597 - DNA, 22 bp, Artificial Sequence
  chemically synthesized
tttttctattgattggaatagt

SEQ ID NO: 827598 - DNA, 22 bp, Artificial Sequence
  chemically synthesized
cttctaaaactattccaatcaa

SEQ ID NO: 827599 - DNA, 22 bp, Artificial Sequence
  chemically synthesized
cctctttttctattgattggaa

SEQ ID NO: 827600 - DNA, 22 bp, Artificial Sequence
  chemically synthesized
ctaaaactattccaatcaatag

SEQ ID NO: 827601 - DNA, 22 bp, Artificial Sequence
  chemically synthesized
taaaactattccaatcaataga

SEQ ID NO: 827602 - DNA, 22 bp, Artificial Sequence
  chemically synthesized
aaactattccaatcaatagaaa

SEQ ID NO: 827603 - DNA, 22 bp, Artificial Sequence
  chemically synthesized
gggaggattccctctttttcta

SEQ ID NO: 827604 - DNA, 22 bp, Artificial Sequence
  chemically synthesized
ttccaatcaatagaaaaagagg

SEQ ID NO: 827605 - DNA, 22 bp, Artificial Sequence
  chemically synthesized
caatcaatagaaaaagagggaa

SEQ ID NO: 827606 - DNA, 22 bp, Artificial Sequence
  chemically synthesized
ataaaatgagttagggaggatt

SEQ ID NO: 827607 - DNA, 22 bp, Artificial Sequence
  chemically synthesized
gcctcataaaatgagttaggga

SEQ ID NO: 827608 - DNA, 22 bp, Artificial Sequence
  chemically synthesized
cctaactcattttatgaggcca

SEQ ID NO: 827609 - DNA, 22 bp, Artificial Sequence
  chemically synthesized
gtatcaggatgatgctggcctc

SEQ ID NO: 827610 - DNA, 22 bp, Artificial Sequence
  chemically synthesized
actcattttatgaggccagcat

SEQ ID NO: 827611 - DNA, 22 bp, Artificial Sequence
  chemically synthesized
ggtatcaggatgatgctggcct

SEQ ID NO: 827612 - DNA, 22 bp, Artificial Sequence
  chemically synthesized
tggtatcaggatgatgctggcc

SEQ ID NO: 827613 - DNA, 22 bp, Artificial Sequence
  chemically synthesized
attttatgaggccagcatcatc

SEQ ID NO: 827614 - DNA, 22 bp, Artificial Sequence
  chemically synthesized
tatgaggccagcatcatcctga

SEQ ID NO: 827615 - DNA, 22 bp, Artificial Sequence
  chemically synthesized
atgaggccagcatcatcctgat

SEQ ID NO: 827616 - DNA, 22 bp, Artificial Sequence
  chemically synthesized
ccaggctttggtatcaggatga

SEQ ID NO: 827617 - DNA, 22 bp, Artificial Sequence
  chemically synthesized
tgaggccagcatcatcctgata

SEQ ID NO: 827618 - DNA, 22 bp, Artificial Sequence
  chemically synthesized
tgccaggctttggtatcaggat

SEQ ID NO: 827619 - DNA, 22 bp, Artificial Sequence
  chemically synthesized
tgtctctgccaggctttggtat

SEQ ID NO: 827620 - DNA, 22 bp, Artificial Sequence
  chemically synthesized
ttgtgtctctgccaggctttgg

SEQ ID NO: 827621 - DNA, 22 bp, Artificial Sequence
  chemically synthesized
gttgtgtctctgccaggctttg

SEQ ID NO: 827622 - DNA, 22 bp, Artificial Sequence
  chemically synthesized
tgttgtgtctctgccaggcttt

SEQ ID NO: 827623 - DNA, 22 bp, Artificial Sequence
  chemically synthesized
ttgttgtgtctctgccaggctt

SEQ ID NO: 827624 - DNA, 22 bp, Artificial Sequence
  chemically synthesized
tttgttgtgtctctgccaggct

SEQ ID NO: 827625 - DNA, 22 bp, Artificial Sequence
  chemically synthesized
ttttgttgtgtctctgccaggc

SEQ ID NO: 827626 - DNA, 22 bp, Artificial Sequence
  chemically synthesized
tttttgttgtgtctctgccagg

SEQ ID NO: 827627 - DNA, 22 bp, Artificial Sequence
  chemically synthesized
tttttttgttgtgtctctgcca

SEQ ID NO: 827628 - DNA, 22 bp, Artificial Sequence
  chemically synthesized
ataccaaagcctggcagagaca

SEQ ID NO: 827629 - DNA, 22 bp, Artificial Sequence
  chemically synthesized
tctttttttgttgtgtctctgc

SEQ ID NO: 827630 - DNA, 22 bp, Artificial Sequence
  chemically synthesized
aaattctctttttttgttgtgt

SEQ ID NO: 827631 - DNA, 22 bp, Artificial Sequence
  chemically synthesized
tctaaaattctctttttttgtt

SEQ ID NO: 827632 - DNA, 22 bp, Artificial Sequence
  chemically synthesized
gtctaaaattctctttttttgt

SEQ ID NO: 827633 - DNA, 22 bp, Artificial Sequence
  chemically synthesized
gcagagacacaacaaaaaaaga

SEQ ID NO: 827634 - DNA, 22 bp, Artificial Sequence
  chemically synthesized
atcagggatatttgtctaaaat

SEQ ID NO: 827635 - DNA, 22 bp, Artificial Sequence
  chemically synthesized
catcgatgttcatcagggatat

SEQ ID NO: 827636 - DNA, 22 bp, Artificial Sequence
  chemically synthesized
gcatcgatgttcatcagggata

SEQ ID NO: 827637 - DNA, 22 bp, Artificial Sequence
  chemically synthesized
tgcatcgatgttcatcagggat

SEQ ID NO: 827638 - DNA, 22 bp, Artificial Sequence
  chemically synthesized
ttgcatcgatgttcatcaggga

SEQ ID NO: 827639 - DNA, 22 bp, Artificial Sequence
  chemically synthesized
tagacaaatatccctgatgaac

SEQ ID NO: 827640 - DNA, 22 bp, Artificial Sequence
  chemically synthesized
agacaaatatccctgatgaaca

SEQ ID NO: 827641 - DNA, 22 bp, Artificial Sequence
  chemically synthesized
gacaaatatccctgatgaacat

SEQ ID NO: 827642 - DNA, 22 bp, Artificial Sequence
  chemically synthesized
aggatttttgcatcgatgttca

SEQ ID NO: 827643 - DNA, 22 bp, Artificial Sequence
  chemically synthesized
ttgaggatttttgcatcgatgt

SEQ ID NO: 827644 - DNA, 22 bp, Artificial Sequence
  chemically synthesized
attgaggatttttgcatcgatg

SEQ ID NO: 827645 - DNA, 22 bp, Artificial Sequence
  chemically synthesized
tattgaggatttttgcatcgat

SEQ ID NO: 827646 - DNA, 22 bp, Artificial Sequence
  chemically synthesized
atgaacatcgatgcaaaaatcc

SEQ ID NO: 827647 - DNA, 22 bp, Artificial Sequence
  chemically synthesized
ccagtattttattgaggatttt

SEQ ID NO: 827648 - DNA, 22 bp, Artificial Sequence
  chemically synthesized
gccagtattttattgaggattt

SEQ ID NO: 827649 - DNA, 22 bp, Artificial Sequence
  chemically synthesized
ggtttgccagtattttattgag

SEQ ID NO: 827650 - DNA, 22 bp, Artificial Sequence
  chemically synthesized
gattcggtttgccagtatttta

SEQ ID NO: 827651 - DNA, 22 bp, Artificial Sequence
  chemically synthesized
ctggattcggtttgccagtatt

SEQ ID NO: 827652 - DNA, 22 bp, Artificial Sequence
  chemically synthesized
aataaaatactggcaaaccgaa

SEQ ID NO: 827653 - DNA, 22 bp, Artificial Sequence
  chemically synthesized
atgtgctgctggattcggtttg

SEQ ID NO: 827654 - DNA, 22 bp, Artificial Sequence
  chemically synthesized
gatgtgctgctggattcggttt

SEQ ID NO: 827655 - DNA, 22 bp, Artificial Sequence
  chemically synthesized
tgatgtgctgctggattcggtt

SEQ ID NO: 827656 - DNA, 22 bp, Artificial Sequence
  chemically synthesized
ttgatgtgctgctggattcggt

SEQ ID NO: 827657 - DNA, 22 bp, Artificial Sequence
  chemically synthesized
tttgatgtgctgctggattcgg

SEQ ID NO: 827658 - DNA, 22 bp, Artificial Sequence
  chemically synthesized
gcaaaccgaatccagcagcaca

SEQ ID NO: 827659 - DNA, 22 bp, Artificial Sequence
  chemically synthesized
atcatggtggataagctttttg

SEQ ID NO: 827660 - DNA, 22 bp, Artificial Sequence
  chemically synthesized
gatcatggtggataagcttttt

SEQ ID NO: 827661 - DNA, 22 bp, Artificial Sequence
  chemically synthesized
atccaccatgatcaagtgggct

SEQ ID NO: 827662 - DNA, 22 bp, Artificial Sequence
  chemically synthesized
tccaccatgatcaagtgggctt

SEQ ID NO: 827663 - DNA, 22 bp, Artificial Sequence
  chemically synthesized
catcccagggatgaagcccact

SEQ ID NO: 827664 - DNA, 22 bp, Artificial Sequence
  chemically synthesized
gcatcccagggatgaagcccac

SEQ ID NO: 827665 - DNA, 22 bp, Artificial Sequence
  chemically synthesized
aaccagccttgcatcccaggga

SEQ ID NO: 827666 - DNA, 22 bp, Artificial Sequence
  chemically synthesized
cgtatgttgaaccagccttgca

SEQ ID NO: 827667 - DNA, 22 bp, Artificial Sequence
  chemically synthesized
catccctgggatgcaaggctgg

SEQ ID NO: 827668 - DNA, 22 bp, Artificial Sequence
  chemically synthesized
gcgtatgttgaaccagccttgc

SEQ ID NO: 827669 - DNA, 22 bp, Artificial Sequence
  chemically synthesized
atccctgggatgcaaggctggt

SEQ ID NO: 827670 - DNA, 22 bp, Artificial Sequence
  chemically synthesized
atttgcgtatgttgaaccagcc

SEQ ID NO: 827671 - DNA, 22 bp, Artificial Sequence
  chemically synthesized
ttgatttgcgtatgttgaacca

SEQ ID NO: 827672 - DNA, 22 bp, Artificial Sequence
  chemically synthesized
ggatgcaaggctggttcaacat

SEQ ID NO: 827673 - DNA, 22 bp, Artificial Sequence
  chemically synthesized
attgatttgcgtatgttgaacc

SEQ ID NO: 827674 - DNA, 22 bp, Artificial Sequence
  chemically synthesized
catttattgatttgcgtatgtt

SEQ ID NO: 827675 - DNA, 22 bp, Artificial Sequence
  chemically synthesized
gattacatttattgatttgcgt

SEQ ID NO: 827676 - DNA, 22 bp, Artificial Sequence
  chemically synthesized
gttcaacatacgcaaatcaata

SEQ ID NO: 827677 - DNA, 22 bp, Artificial Sequence
  chemically synthesized
aacatacgcaaatcaataaatg

SEQ ID NO: 827678 - DNA, 22 bp, Artificial Sequence
  chemically synthesized
tatgctggattacatttattga

SEQ ID NO: 827679 - DNA, 22 bp, Artificial Sequence
  chemically synthesized
atatgctggattacatttattg

SEQ ID NO: 827680 - DNA, 22 bp, Artificial Sequence
  chemically synthesized
tttatatgctggattacattta

SEQ ID NO: 827681 - DNA, 22 bp, Artificial Sequence
  chemically synthesized
tgtttatatgctggattacatt

SEQ ID NO: 827682 - DNA, 22 bp, Artificial Sequence
  chemically synthesized
gttctgtttatatgctggatta

SEQ ID NO: 827683 - DNA, 22 bp, Artificial Sequence
  chemically synthesized
tcgttggttctgtttatatgct

SEQ ID NO: 827684 - DNA, 22 bp, Artificial Sequence
  chemically synthesized
gtcgttggttctgtttatatgc

SEQ ID NO: 827685 - DNA, 22 bp, Artificial Sequence
  chemically synthesized
tgtcgttggttctgtttatatg

SEQ ID NO: 827686 - DNA, 22 bp, Artificial Sequence
  chemically synthesized
ttgtcgttggttctgtttatat

SEQ ID NO: 827687 - DNA, 22 bp, Artificial Sequence
  chemically synthesized
agataaccatgtggtttttgtc

SEQ ID NO: 827688 - DNA, 22 bp, Artificial Sequence
  chemically synthesized
ttgagataaccatgtggttttt

SEQ ID NO: 827689 - DNA, 22 bp, Artificial Sequence
  chemically synthesized
catctattgagataaccatgtg

SEQ ID NO: 827690 - DNA, 22 bp, Artificial Sequence
  chemically synthesized
tgcatctattgagataaccatg

SEQ ID NO: 827691 - DNA, 22 bp, Artificial Sequence
  chemically synthesized
ctgcatctattgagataaccat

SEQ ID NO: 827692 - DNA, 22 bp, Artificial Sequence
  chemically synthesized
tctgcatctattgagataacca

SEQ ID NO: 827693 - DNA, 22 bp, Artificial Sequence
  chemically synthesized
ttctgcatctattgagataacc

SEQ ID NO: 827694 - DNA, 22 bp, Artificial Sequence
  chemically synthesized
gtcaagggccttttctgcatct

SEQ ID NO: 827695 - DNA, 22 bp, Artificial Sequence
  chemically synthesized
ggtcaagggccttttctgcatc

SEQ ID NO: 827696 - DNA, 22 bp, Artificial Sequence
  chemically synthesized
tctcaatagatgcagaaaaggc

SEQ ID NO: 827697 - DNA, 22 bp, Artificial Sequence
  chemically synthesized
aatttggtcaagggccttttct

SEQ ID NO: 827698 - DNA, 22 bp, Artificial Sequence
  chemically synthesized
aatagatgcagaaaaggccctt

SEQ ID NO: 827699 - DNA, 22 bp, Artificial Sequence
  chemically synthesized
ttgaatttggtcaagggccttt

SEQ ID NO: 827700 - DNA, 22 bp, Artificial Sequence
  chemically synthesized
gcatgaagggctgttgaatttg

SEQ ID NO: 827701 - DNA, 22 bp, Artificial Sequence
  chemically synthesized
agcatgaagggctgttgaattt

SEQ ID NO: 827702 - DNA, 22 bp, Artificial Sequence
  chemically synthesized
tagcatgaagggctgttgaatt

SEQ ID NO: 827703 - DNA, 22 bp, Artificial Sequence
  chemically synthesized
ttagcatgaagggctgttgaat

SEQ ID NO: 827704 - DNA, 22 bp, Artificial Sequence
  chemically synthesized
gaccaaattcaacagcccttca

SEQ ID NO: 827705 - DNA, 22 bp, Artificial Sequence
  chemically synthesized
accaaattcaacagcccttcat

SEQ ID NO: 827706 - DNA, 22 bp, Artificial Sequence
  chemically synthesized
tcgagagtttttagcatgaagg

SEQ ID NO: 827707 - DNA, 22 bp, Artificial Sequence
  chemically synthesized
atcgagagtttttagcatgaag

SEQ ID NO: 827708 - DNA, 22 bp, Artificial Sequence
  chemically synthesized
atttatcgagagtttttagcat

SEQ ID NO: 827709 - DNA, 22 bp, Artificial Sequence
  chemically synthesized
aacagcccttcatgctaaaaac

SEQ ID NO: 827710 - DNA, 22 bp, Artificial Sequence
  chemically synthesized
catgctaaaaactctcgataaa

SEQ ID NO: 827711 - DNA, 22 bp, Artificial Sequence
  chemically synthesized
atgctaaaaactctcgataaat

SEQ ID NO: 827712 - DNA, 22 bp, Artificial Sequence
  chemically synthesized
aaaactctcgataaattaggta

SEQ ID NO: 827713 - DNA, 22 bp, Artificial Sequence
  chemically synthesized
agatacgtcccatcaataccta

SEQ ID NO: 827714 - DNA, 22 bp, Artificial Sequence
  chemically synthesized
gagatacgtcccatcaatacct

SEQ ID NO: 827715 - DNA, 22 bp, Artificial Sequence
  chemically synthesized
tgagatacgtcccatcaatacc

SEQ ID NO: 827716 - DNA, 22 bp, Artificial Sequence
  chemically synthesized
tcgataaattaggtattgatgg

SEQ ID NO: 827717 - DNA, 22 bp, Artificial Sequence
  chemically synthesized
gataaattaggtattgatggga

SEQ ID NO: 827718 - DNA, 22 bp, Artificial Sequence
  chemically synthesized
ttttgagatacgtcccatcaat

SEQ ID NO: 827719 - DNA, 22 bp, Artificial Sequence
  chemically synthesized
ctattttgagatacgtcccatc

SEQ ID NO: 827720 - DNA, 22 bp, Artificial Sequence
  chemically synthesized
actattttgagatacgtcccat

SEQ ID NO: 827721 - DNA, 22 bp, Artificial Sequence
  chemically synthesized
ttactattttgagatacgtccc

SEQ ID NO: 827722 - DNA, 22 bp, Artificial Sequence
  chemically synthesized
ggtattgatgggacgtatctca

SEQ ID NO: 827723 - DNA, 22 bp, Artificial Sequence
  chemically synthesized
atgggacgtatctcaaaatagt

SEQ ID NO: 827724 - DNA, 22 bp, Artificial Sequence
  chemically synthesized
tcataaatagctcttactattt

SEQ ID NO: 827725 - DNA, 22 bp, Artificial Sequence
  chemically synthesized
gtcataaatagctcttactatt

SEQ ID NO: 827726 - DNA, 22 bp, Artificial Sequence
  chemically synthesized
tgggtttgtcataaatagctct

SEQ ID NO: 827727 - DNA, 22 bp, Artificial Sequence
  chemically synthesized
aaaatagtaagagctatttatg

SEQ ID NO: 827728 - DNA, 22 bp, Artificial Sequence
  chemically synthesized
gctgtgggtttgtcataaatag

SEQ ID NO: 827729 - DNA, 22 bp, Artificial Sequence
  chemically synthesized
agtatgatattggctgtgggtt

SEQ ID NO: 827730 - DNA, 22 bp, Artificial Sequence
  chemically synthesized
tttatgacaaacccacagccaa

SEQ ID NO: 827731 - DNA, 22 bp, Artificial Sequence
  chemically synthesized
atgacaaacccacagccaatat

SEQ ID NO: 827732 - DNA, 22 bp, Artificial Sequence
  chemically synthesized
tgacaaacccacagccaatatc

SEQ ID NO: 827733 - DNA, 22 bp, Artificial Sequence
  chemically synthesized
cccattcagtatgatattggct

SEQ ID NO: 827734 - DNA, 22 bp, Artificial Sequence
  chemically synthesized
gcccattcagtatgatattggc

SEQ ID NO: 827735 - DNA, 22 bp, Artificial Sequence
  chemically synthesized
tgcccattcagtatgatattgg

SEQ ID NO: 827736 - DNA, 22 bp, Artificial Sequence
  chemically synthesized
cagttttgcccattcagtatga

SEQ ID NO: 827737 - DNA, 22 bp, Artificial Sequence
  chemically synthesized
ccagttttgcccattcagtatg

SEQ ID NO: 827738 - DNA, 22 bp, Artificial Sequence
  chemically synthesized
aaagggaatgcttccagttttg

SEQ ID NO: 827739 - DNA, 22 bp, Artificial Sequence
  chemically synthesized
caaagggaatgcttccagtttt

SEQ ID NO: 827740 - DNA, 22 bp, Artificial Sequence
  chemically synthesized
tcaaagggaatgcttccagttt

SEQ ID NO: 827741 - DNA, 22 bp, Artificial Sequence
  chemically synthesized
aatgggcaaaactggaagcatt

SEQ ID NO: 827742 - DNA, 22 bp, Artificial Sequence
  chemically synthesized
tgccagttttcaaagggaatgc

SEQ ID NO: 827743 - DNA, 22 bp, Artificial Sequence
  chemically synthesized
gtgccagttttcaaagggaatg

SEQ ID NO: 827744 - DNA, 22 bp, Artificial Sequence
  chemically synthesized
tcttgtgccagttttcaaaggg

SEQ ID NO: 827745 - DNA, 22 bp, Artificial Sequence
  chemically synthesized
gaagcattccctttgaaaactg

SEQ ID NO: 827746 - DNA, 22 bp, Artificial Sequence
  chemically synthesized
cctttgaaaactggcacaagac

SEQ ID NO: 827747 - DNA, 22 bp, Artificial Sequence
  chemically synthesized
tgaaaactggcacaagacaggg

SEQ ID NO: 827748 - DNA, 22 bp, Artificial Sequence
  chemically synthesized
gaaaactggcacaagacaggga

SEQ ID NO: 827749 - DNA, 22 bp, Artificial Sequence
  chemically synthesized
aaaactggcacaagacagggat

SEQ ID NO: 827750 - DNA, 22 bp, Artificial Sequence
  chemically synthesized
gcacaagacagggatgccctct

SEQ ID NO: 827751 - DNA, 22 bp, Artificial Sequence
  chemically synthesized
aataggagtggtgagagagggc

SEQ ID NO: 827752 - DNA, 22 bp, Artificial Sequence
  chemically synthesized
tgttgaataggagtggtgagag

SEQ ID NO: 827753 - DNA, 22 bp, Artificial Sequence
  chemically synthesized
caacactatgttgaataggagt

SEQ ID NO: 827754 - DNA, 22 bp, Artificial Sequence
  chemically synthesized
ccaacactatgttgaataggag

SEQ ID NO: 827755 - DNA, 22 bp, Artificial Sequence
  chemically synthesized
tctcaccactcctattcaacat

SEQ ID NO: 827756 - DNA, 22 bp, Artificial Sequence
  chemically synthesized
tcaccactcctattcaacatag

SEQ ID NO: 827757 - DNA, 22 bp, Artificial Sequence
  chemically synthesized
accactcctattcaacatagtg

SEQ ID NO: 827758 - DNA, 22 bp, Artificial Sequence
  chemically synthesized
gccagaacttccaacactatgt

SEQ ID NO: 827759 - DNA, 22 bp, Artificial Sequence
  chemically synthesized
ctattcaacatagtgttggaag

SEQ ID NO: 827760 - DNA, 22 bp, Artificial Sequence
  chemically synthesized
ttcaacatagtgttggaagttc

SEQ ID NO: 827761 - DNA, 22 bp, Artificial Sequence
  chemically synthesized
atcgccctggccagaacttcca

SEQ ID NO: 827762 - DNA, 22 bp, Artificial Sequence
  chemically synthesized
aacatagtgttggaagttctgg

SEQ ID NO: 827763 - DNA, 22 bp, Artificial Sequence
  chemically synthesized
cctgatcgccctggccagaact

SEQ ID NO: 827764 - DNA, 22 bp, Artificial Sequence
  chemically synthesized
ctgcctgatcgccctggccaga

SEQ ID NO: 827765 - DNA, 22 bp, Artificial Sequence
  chemically synthesized
cctgcctgatcgccctggccag

SEQ ID NO: 827766 - DNA, 22 bp, Artificial Sequence
  chemically synthesized
tcctgcctgatcgccctggcca

SEQ ID NO: 827767 - DNA, 22 bp, Artificial Sequence
  chemically synthesized
ttcctgcctgatcgccctggcc

SEQ ID NO: 827768 - DNA, 22 bp, Artificial Sequence
  chemically synthesized
tttcctgcctgatcgccctggc

SEQ ID NO: 827769 - DNA, 22 bp, Artificial Sequence
  chemically synthesized
tttttcctgcctgatcgccctg

SEQ ID NO: 827770 - DNA, 22 bp, Artificial Sequence
  chemically synthesized
gaagttctggccagggcgatca

SEQ ID NO: 827771 - DNA, 22 bp, Artificial Sequence
  chemically synthesized
ctttttcctgcctgatcgccct

SEQ ID NO: 827772 - DNA, 22 bp, Artificial Sequence
  chemically synthesized
tttctttttcctgcctgatcgc

SEQ ID NO: 827773 - DNA, 22 bp, Artificial Sequence
  chemically synthesized
atttctttttcctgcctgatcg

SEQ ID NO: 827774 - DNA, 22 bp, Artificial Sequence
  chemically synthesized
tatttctttttcctgcctgatc

SEQ ID NO: 827775 - DNA, 22 bp, Artificial Sequence
  chemically synthesized
tggccagggcgatcaggcagga

SEQ ID NO: 827776 - DNA, 22 bp, Artificial Sequence
  chemically synthesized
gccagggcgatcaggcaggaaa

SEQ ID NO: 827777 - DNA, 22 bp, Artificial Sequence
  chemically synthesized
aataccctttatttctttttcc

SEQ ID NO: 827778 - DNA, 22 bp, Artificial Sequence
  chemically synthesized
attgaataccctttatttcttt

SEQ ID NO: 827779 - DNA, 22 bp, Artificial Sequence
  chemically synthesized
ctaattgaataccctttatttc

SEQ ID NO: 827780 - DNA, 22 bp, Artificial Sequence
  chemically synthesized
cctaattgaataccctttattt

SEQ ID NO: 827781 - DNA, 22 bp, Artificial Sequence
  chemically synthesized
tcctaattgaataccctttatt

SEQ ID NO: 827782 - DNA, 22 bp, Artificial Sequence
  chemically synthesized
ttcctaattgaataccctttat

SEQ ID NO: 827783 - DNA, 22 bp, Artificial Sequence
  chemically synthesized
ttttcctaattgaatacccttt

SEQ ID NO: 827784 - DNA, 22 bp, Artificial Sequence
  chemically synthesized
ctcttttcctaattgaataccc

SEQ ID NO: 827785 - DNA, 22 bp, Artificial Sequence
  chemically synthesized
cctcttttcctaattgaatacc

SEQ ID NO: 827786 - DNA, 22 bp, Artificial Sequence
  chemically synthesized
acttcctcttttcctaattgaa

SEQ ID NO: 827787 - DNA, 22 bp, Artificial Sequence
  chemically synthesized
gacttcctcttttcctaattga

SEQ ID NO: 827788 - DNA, 22 bp, Artificial Sequence
  chemically synthesized
aattaggaaaagaggaagtcaa

SEQ ID NO: 827789 - DNA, 22 bp, Artificial Sequence
  chemically synthesized
caaacagggacaatttgacttc

SEQ ID NO: 827790 - DNA, 22 bp, Artificial Sequence
  chemically synthesized
ggaaaagaggaagtcaaattgt

SEQ ID NO: 827791 - DNA, 22 bp, Artificial Sequence
  chemically synthesized
aatatacaatcatgtcgtctgc

SEQ ID NO: 827792 - DNA, 22 bp, Artificial Sequence
  chemically synthesized
taaatatacaatcatgtcgtct

SEQ ID NO: 827793 - DNA, 22 bp, Artificial Sequence
  chemically synthesized
tccctgtttgcagacgacatga

SEQ ID NO: 827794 - DNA, 22 bp, Artificial Sequence
  chemically synthesized
ctaaatatacaatcatgtcgtc

SEQ ID NO: 827795 - DNA, 22 bp, Artificial Sequence
  chemically synthesized
tctaaatatacaatcatgtcgt

SEQ ID NO: 827796 - DNA, 22 bp, Artificial Sequence
  chemically synthesized
tttgcagacgacatgattgtat

SEQ ID NO: 827797 - DNA, 22 bp, Artificial Sequence
  chemically synthesized
gcagacgacatgattgtatatt

SEQ ID NO: 827798 - DNA, 22 bp, Artificial Sequence
  chemically synthesized
cagacgacatgattgtatattt

SEQ ID NO: 827799 - DNA, 22 bp, Artificial Sequence
  chemically synthesized
agacgatggggttttctaaata

SEQ ID NO: 827800 - DNA, 22 bp, Artificial Sequence
  chemically synthesized
ggctgagacgatggggttttct

SEQ ID NO: 827801 - DNA, 22 bp, Artificial Sequence
  chemically synthesized
gggctgagacgatggggttttc

SEQ ID NO: 827802 - DNA, 22 bp, Artificial Sequence
  chemically synthesized
tgggctgagacgatggggtttt

SEQ ID NO: 827803 - DNA, 22 bp, Artificial Sequence
  chemically synthesized
tatatttagaaaaccccatcgt

SEQ ID NO: 827804 - DNA, 22 bp, Artificial Sequence
  chemically synthesized
aggagattttgggctgagacga

SEQ ID NO: 827805 - DNA, 22 bp, Artificial Sequence
  chemically synthesized
agaaaaccccatcgtctcagcc

SEQ ID NO: 827806 - DNA, 22 bp, Artificial Sequence
  chemically synthesized
aaggagattttgggctgagacg

SEQ ID NO: 827807 - DNA, 22 bp, Artificial Sequence
  chemically synthesized
gaaaaccccatcgtctcagccc

SEQ ID NO: 827808 - DNA, 22 bp, Artificial Sequence
  chemically synthesized
tcagcttaaggagattttgggc

SEQ ID NO: 827809 - DNA, 22 bp, Artificial Sequence
  chemically synthesized
atcagcttaaggagattttggg

SEQ ID NO: 827810 - DNA, 22 bp, Artificial Sequence
  chemically synthesized
cttatcagcttaaggagatttt

SEQ ID NO: 827811 - DNA, 22 bp, Artificial Sequence
  chemically synthesized
aagttgcttatcagcttaagga

SEQ ID NO: 827812 - DNA, 22 bp, Artificial Sequence
  chemically synthesized
agcccaaaatctccttaagctg

SEQ ID NO: 827813 - DNA, 22 bp, Artificial Sequence
  chemically synthesized
ctgaagttgcttatcagcttaa

SEQ ID NO: 827814 - DNA, 22 bp, Artificial Sequence
  chemically synthesized
gctgaagttgcttatcagctta

SEQ ID NO: 827815 - DNA, 22 bp, Artificial Sequence
  chemically synthesized
tgctgaagttgcttatcagctt

SEQ ID NO: 827816 - DNA, 22 bp, Artificial Sequence
  chemically synthesized
agactttgctgaagttgcttat

SEQ ID NO: 827817 - DNA, 22 bp, Artificial Sequence
  chemically synthesized
cttaagctgataagcaacttca

SEQ ID NO: 827818 - DNA, 22 bp, Artificial Sequence
  chemically synthesized
aagctgataagcaacttcagca

SEQ ID NO: 827819 - DNA, 22 bp, Artificial Sequence
  chemically synthesized
agctgataagcaacttcagcaa

SEQ ID NO: 827820 - DNA, 22 bp, Artificial Sequence
  chemically synthesized
tatcctgagactttgctgaagt

SEQ ID NO: 827821 - DNA, 22 bp, Artificial Sequence
  chemically synthesized
atatcctgagactttgctgaag

SEQ ID NO: 827822 - DNA, 22 bp, Artificial Sequence
  chemically synthesized
tatatcctgagactttgctgaa

SEQ ID NO: 827823 - DNA, 22 bp, Artificial Sequence
  chemically synthesized
ataagcaacttcagcaaagtct

SEQ ID NO: 827824 - DNA, 22 bp, Artificial Sequence
  chemically synthesized
attttatatcctgagactttgc

SEQ ID NO: 827825 - DNA, 22 bp, Artificial Sequence
  chemically synthesized
cacattgattttatatcctgag

SEQ ID NO: 827826 - DNA, 22 bp, Artificial Sequence
  chemically synthesized
gcacattgattttatatcctga

SEQ ID NO: 827827 - DNA, 22 bp, Artificial Sequence
  chemically synthesized
tgcacattgattttatatcctg

SEQ ID NO: 827828 - DNA, 22 bp, Artificial Sequence
  chemically synthesized
cagcaaagtctcaggatataaa

SEQ ID NO: 827829 - DNA, 22 bp, Artificial Sequence
  chemically synthesized
ttgcacattgattttatatcct

SEQ ID NO: 827830 - DNA, 22 bp, Artificial Sequence
  chemically synthesized
agcaaagtctcaggatataaaa

SEQ ID NO: 827831 - DNA, 22 bp, Artificial Sequence
  chemically synthesized
tgatttttgcacattgatttta

SEQ ID NO: 827832 - DNA, 22 bp, Artificial Sequence
  chemically synthesized
gtgatttttgcacattgatttt

SEQ ID NO: 827833 - DNA, 22 bp, Artificial Sequence
  chemically synthesized
aggatataaaatcaatgtgcaa

SEQ ID NO: 827834 - DNA, 22 bp, Artificial Sequence
  chemically synthesized
gtgtataagaatgcttgtgatt

SEQ ID NO: 827835 - DNA, 22 bp, Artificial Sequence
  chemically synthesized
ttggtgtataagaatgcttgtg

SEQ ID NO: 827836 - DNA, 22 bp, Artificial Sequence
  chemically synthesized
ttattggtgtataagaatgctt

SEQ ID NO: 827837 - DNA, 22 bp, Artificial Sequence
  chemically synthesized
tctgttattggtgtataagaat

SEQ ID NO: 827838 - DNA, 22 bp, Artificial Sequence
  chemically synthesized
gtctgttattggtgtataagaa

SEQ ID NO: 827839 - DNA, 22 bp, Artificial Sequence
  chemically synthesized
tttgtctgttattggtgtataa

SEQ ID NO: 827840 - DNA, 22 bp, Artificial Sequence
  chemically synthesized
tgtttgtctgttattggtgtat

SEQ ID NO: 827841 - DNA, 22 bp, Artificial Sequence
  chemically synthesized
tctgtttgtctgttattggtgt

SEQ ID NO: 827842 - DNA, 22 bp, Artificial Sequence
  chemically synthesized
gctctctgtttgtctgttattg

SEQ ID NO: 827843 - DNA, 22 bp, Artificial Sequence
  chemically synthesized
ggctctctgtttgtctgttatt

SEQ ID NO: 827844 - DNA, 22 bp, Artificial Sequence
  chemically synthesized
ttatacaccaataacagacaaa

SEQ ID NO: 827845 - DNA, 22 bp, Artificial Sequence
  chemically synthesized
atacaccaataacagacaaaca

SEQ ID NO: 827846 - DNA, 22 bp, Artificial Sequence
  chemically synthesized
tacaccaataacagacaaacag

SEQ ID NO: 827847 - DNA, 22 bp, Artificial Sequence
  chemically synthesized
atgatttggctctctgtttgtc

SEQ ID NO: 827848 - DNA, 22 bp, Artificial Sequence
  chemically synthesized
actcatgatttggctctctgtt

SEQ ID NO: 827849 - DNA, 22 bp, Artificial Sequence
  chemically synthesized
tgaatgagagttcactcatgat

SEQ ID NO: 827850 - DNA, 22 bp, Artificial Sequence
  chemically synthesized
aagcaattgtgaatgagagttc

SEQ ID NO: 827851 - DNA, 22 bp, Artificial Sequence
  chemically synthesized
gaagcaattgtgaatgagagtt

SEQ ID NO: 827852 - DNA, 22 bp, Artificial Sequence
  chemically synthesized
tgaagcaattgtgaatgagagt

SEQ ID NO: 827853 - DNA, 22 bp, Artificial Sequence
  chemically synthesized
tttgaagcaattgtgaatgaga

SEQ ID NO: 827854 - DNA, 22 bp, Artificial Sequence
  chemically synthesized
tctttgaagcaattgtgaatga

SEQ ID NO: 827855 - DNA, 22 bp, Artificial Sequence
  chemically synthesized
ttctctttgaagcaattgtgaa

SEQ ID NO: 827856 - DNA, 22 bp, Artificial Sequence
  chemically synthesized
attctctttgaagcaattgtga

SEQ ID NO: 827857 - DNA, 22 bp, Artificial Sequence
  chemically synthesized
tattctctttgaagcaattgtg

SEQ ID NO: 827858 - DNA, 22 bp, Artificial Sequence
  chemically synthesized
tcattcacaattgcttcaaaga

SEQ ID NO: 827859 - DNA, 22 bp, Artificial Sequence
  chemically synthesized
attcacaattgcttcaaagaga

SEQ ID NO: 827860 - DNA, 22 bp, Artificial Sequence
  chemically synthesized
taggtattttattctctttgaa

SEQ ID NO: 827861 - DNA, 22 bp, Artificial Sequence
  chemically synthesized
gtaggtattttattctctttga

SEQ ID NO: 827862 - DNA, 22 bp, Artificial Sequence
  chemically synthesized
acaattgcttcaaagagaataa

SEQ ID NO: 827863 - DNA, 22 bp, Artificial Sequence
  chemically synthesized
tatttgtaggtattttattctc

SEQ ID NO: 827864 - DNA, 22 bp, Artificial Sequence
  chemically synthesized
cttcaaagagaataaaatacct

SEQ ID NO: 827865 - DNA, 22 bp, Artificial Sequence
  chemically synthesized
taagttgtatttgtaggtattt

SEQ ID NO: 827866 - DNA, 22 bp, Artificial Sequence
  chemically synthesized
caaagagaataaaatacctaca

SEQ ID NO: 827867 - DNA, 22 bp, Artificial Sequence
  chemically synthesized
gtaagttgtatttgtaggtatt

SEQ ID NO: 827868 - DNA, 22 bp, Artificial Sequence
  chemically synthesized
aaagagaataaaatacctacaa

SEQ ID NO: 827869 - DNA, 22 bp, Artificial Sequence
  chemically synthesized
acatcccttgtaagttgtattt

SEQ ID NO: 827870 - DNA, 22 bp, Artificial Sequence
  chemically synthesized
cacatcccttgtaagttgtatt

SEQ ID NO: 827871 - DNA, 22 bp, Artificial Sequence
  chemically synthesized
caaatacaacttacaagggatg

SEQ ID NO: 827872 - DNA, 22 bp, Artificial Sequence
  chemically synthesized
aagaggtccttcacatcccttg

SEQ ID NO: 827873 - DNA, 22 bp, Artificial Sequence
  chemically synthesized
gaagaggtccttcacatccctt

SEQ ID NO: 827874 - DNA, 22 bp, Artificial Sequence
  chemically synthesized
cttgaagaggtccttcacatcc

SEQ ID NO: 827875 - DNA, 22 bp, Artificial Sequence
  chemically synthesized
tccttgaagaggtccttcacat

SEQ ID NO: 827876 - DNA, 22 bp, Artificial Sequence
  chemically synthesized
acaagggatgtgaaggacctct

SEQ ID NO: 827877 - DNA, 22 bp, Artificial Sequence
  chemically synthesized
caagggatgtgaaggacctctt

SEQ ID NO: 827878 - DNA, 22 bp, Artificial Sequence
  chemically synthesized
tagttctccttgaagaggtcct

SEQ ID NO: 827879 - DNA, 22 bp, Artificial Sequence
  chemically synthesized
gtagttctccttgaagaggtcc

SEQ ID NO: 827880 - DNA, 22 bp, Artificial Sequence
  chemically synthesized
agcagtggtttgtagttctcct

SEQ ID NO: 827881 - DNA, 22 bp, Artificial Sequence
  chemically synthesized
gagcagtggtttgtagttctcc

SEQ ID NO: 827882 - DNA, 22 bp, Artificial Sequence
  chemically synthesized
cttgagcagtggtttgtagttc

SEQ ID NO: 827883 - DNA, 22 bp, Artificial Sequence
  chemically synthesized
ccttgagcagtggtttgtagtt

SEQ ID NO: 827884 - DNA, 22 bp, Artificial Sequence
  chemically synthesized
ttcaaggagaactacaaaccac

SEQ ID NO: 827885 - DNA, 22 bp, Artificial Sequence
  chemically synthesized
tttccttgagcagtggtttgta

SEQ ID NO: 827886 - DNA, 22 bp, Artificial Sequence
  chemically synthesized
atttccttgagcagtggtttgt

SEQ ID NO: 827887 - DNA, 22 bp, Artificial Sequence
  chemically synthesized
caaggagaactacaaaccactg

SEQ ID NO: 827888 - DNA, 22 bp, Artificial Sequence
  chemically synthesized
tatttccttgagcagtggtttg

SEQ ID NO: 827889 - DNA, 22 bp, Artificial Sequence
  chemically synthesized
aaggagaactacaaaccactgc

SEQ ID NO: 827890 - DNA, 22 bp, Artificial Sequence
  chemically synthesized
ttatttccttgagcagtggttt

SEQ ID NO: 827891 - DNA, 22 bp, Artificial Sequence
  chemically synthesized
ttttatttccttgagcagtggt

SEQ ID NO: 827892 - DNA, 22 bp, Artificial Sequence
  chemically synthesized
tgtcctcttttatttccttgag

SEQ ID NO: 827893 - DNA, 22 bp, Artificial Sequence
  chemically synthesized
gtgtcctcttttatttccttga

SEQ ID NO: 827894 - DNA, 22 bp, Artificial Sequence
  chemically synthesized
caaaccactgctcaaggaaata

SEQ ID NO: 827895 - DNA, 22 bp, Artificial Sequence
  chemically synthesized
tttgtgtcctcttttatttcct

SEQ ID NO: 827896 - DNA, 22 bp, Artificial Sequence
  chemically synthesized
gtttgtgtcctcttttatttcc

SEQ ID NO: 827897 - DNA, 22 bp, Artificial Sequence
  chemically synthesized
catttgtttgtgtcctctttta

SEQ ID NO: 827898 - DNA, 22 bp, Artificial Sequence
  chemically synthesized
ccatttgtttgtgtcctctttt

SEQ ID NO: 827899 - DNA, 22 bp, Artificial Sequence
  chemically synthesized
ctcaaggaaataaaagaggaca

SEQ ID NO: 827900 - DNA, 22 bp, Artificial Sequence
  chemically synthesized
ttccatttgtttgtgtcctctt

SEQ ID NO: 827901 - DNA, 22 bp, Artificial Sequence
  chemically synthesized
aaggaaataaaagaggacacaa

SEQ ID NO: 827902 - DNA, 22 bp, Artificial Sequence
  chemically synthesized
tccatgagcatggaatgttctt

SEQ ID NO: 827903 - DNA, 22 bp, Artificial Sequence
  chemically synthesized
ctatccatgagcatggaatgtt

SEQ ID NO: 827904 - DNA, 22 bp, Artificial Sequence
  chemically synthesized
cctatccatgagcatggaatgt

SEQ ID NO: 827905 - DNA, 22 bp, Artificial Sequence
  chemically synthesized
ttcctatccatgagcatggaat

SEQ ID NO: 827906 - DNA, 22 bp, Artificial Sequence
  chemically synthesized
attcttcctatccatgagcatg

SEQ ID NO: 827907 - DNA, 22 bp, Artificial Sequence
  chemically synthesized
acgatattgattcttcctatcc

SEQ ID NO: 827908 - DNA, 22 bp, Artificial Sequence
  chemically synthesized
cacgatattgattcttcctatc

SEQ ID NO: 827909 - DNA, 22 bp, Artificial Sequence
  chemically synthesized
tcacgatattgattcttcctat

SEQ ID NO: 827910 - DNA, 22 bp, Artificial Sequence
  chemically synthesized
catgctcatggataggaagaat

SEQ ID NO: 827911 - DNA, 22 bp, Artificial Sequence
  chemically synthesized
atggataggaagaatcaatatc

SEQ ID NO: 827912 - DNA, 22 bp, Artificial Sequence
  chemically synthesized
ggcagtatggccattttcacga

SEQ ID NO: 827913 - DNA, 22 bp, Artificial Sequence
  chemically synthesized
gggcagtatggccattttcacg

SEQ ID NO: 827914 - DNA, 22 bp, Artificial Sequence
  chemically synthesized
cttgggcagtatggccattttc

SEQ ID NO: 827915 - DNA, 22 bp, Artificial Sequence
  chemically synthesized
ccttgggcagtatggccatttt

SEQ ID NO: 827916 - DNA, 22 bp, Artificial Sequence
  chemically synthesized
taaatttccttgggcagtatgg

SEQ ID NO: 827917 - DNA, 22 bp, Artificial Sequence
  chemically synthesized
aatctataaatttccttgggca

SEQ ID NO: 827918 - DNA, 22 bp, Artificial Sequence
  chemically synthesized
cccaaggaaatttatagattca

SEQ ID NO: 827919 - DNA, 22 bp, Artificial Sequence
  chemically synthesized
atggggatggcattgaatctat

SEQ ID NO: 827920 - DNA, 22 bp, Artificial Sequence
  chemically synthesized
gatggggatggcattgaatcta

SEQ ID NO: 827921 - DNA, 22 bp, Artificial Sequence
  chemically synthesized
gtagcttgatggggatggcatt

SEQ ID NO: 827922 - DNA, 22 bp, Artificial Sequence
  chemically synthesized
atagattcaatgccatccccat

SEQ ID NO: 827923 - DNA, 22 bp, Artificial Sequence
  chemically synthesized
tagattcaatgccatccccatc

SEQ ID NO: 827924 - DNA, 22 bp, Artificial Sequence
  chemically synthesized
aatgccatccccatcaagctac

SEQ ID NO: 827925 - DNA, 22 bp, Artificial Sequence
  chemically synthesized
tgaagaaagtcattggtagctt

SEQ ID NO: 827926 - DNA, 22 bp, Artificial Sequence
  chemically synthesized
tgtgaagaaagtcattggtagc

SEQ ID NO: 827927 - DNA, 22 bp, Artificial Sequence
  chemically synthesized
caattctgtgaagaaagtcatt

SEQ ID NO: 827928 - DNA, 22 bp, Artificial Sequence
  chemically synthesized
ccaattctgtgaagaaagtcat

SEQ ID NO: 827929 - DNA, 22 bp, Artificial Sequence
  chemically synthesized
tccaattctgtgaagaaagtca

SEQ ID NO: 827930 - DNA, 22 bp, Artificial Sequence
  chemically synthesized
ttccaattctgtgaagaaagtc

SEQ ID NO: 827931 - DNA, 22 bp, Artificial Sequence
  chemically synthesized
tttccaattctgtgaagaaagt

SEQ ID NO: 827932 - DNA, 22 bp, Artificial Sequence
  chemically synthesized
ccaatgactttcttcacagaat

SEQ ID NO: 827933 - DNA, 22 bp, Artificial Sequence
  chemically synthesized
aagtagttttttccaattctgt

SEQ ID NO: 827934 - DNA, 22 bp, Artificial Sequence
  chemically synthesized
aaagtagttttttccaattctg

SEQ ID NO: 827935 - DNA, 22 bp, Artificial Sequence
  chemically synthesized
taaagtagttttttccaattct

SEQ ID NO: 827936 - DNA, 22 bp, Artificial Sequence
  chemically synthesized
tcttcacagaattggaaaaaac

SEQ ID NO: 827937 - DNA, 22 bp, Artificial Sequence
  chemically synthesized
cttcacagaattggaaaaaact

SEQ ID NO: 827938 - DNA, 22 bp, Artificial Sequence
  chemically synthesized
ttcacagaattggaaaaaacta

SEQ ID NO: 827939 - DNA, 22 bp, Artificial Sequence
  chemically synthesized
cacagaattggaaaaaactact

SEQ ID NO: 827940 - DNA, 22 bp, Artificial Sequence
  chemically synthesized
acagaattggaaaaaactactt

SEQ ID NO: 827941 - DNA, 22 bp, Artificial Sequence
  chemically synthesized
catatgaactttaaagtagttt

SEQ ID NO: 827942 - DNA, 22 bp, Artificial Sequence
  chemically synthesized
gttccatatgaactttaaagta

SEQ ID NO: 827943 - DNA, 22 bp, Artificial Sequence
  chemically synthesized
ggttccatatgaactttaaagt

SEQ ID NO: 827944 - DNA, 22 bp, Artificial Sequence
  chemically synthesized
tggttccatatgaactttaaag

SEQ ID NO: 827945 - DNA, 22 bp, Artificial Sequence
  chemically synthesized
ttggttccatatgaactttaaa

SEQ ID NO: 827946 - DNA, 22 bp, Artificial Sequence
  chemically synthesized
gaaaaaactactttaaagttca

SEQ ID NO: 827947 - DNA, 22 bp, Artificial Sequence
  chemically synthesized
tttggttccatatgaactttaa

SEQ ID NO: 827948 - DNA, 22 bp, Artificial Sequence
  chemically synthesized
ttttggttccatatgaacttta

SEQ ID NO: 827949 - DNA, 22 bp, Artificial Sequence
  chemically synthesized
ttttttggttccatatgaactt

SEQ ID NO: 827950 - DNA, 22 bp, Artificial Sequence
  chemically synthesized
ctttaaagttcatatggaacca

SEQ ID NO: 827951 - DNA, 22 bp, Artificial Sequence
  chemically synthesized
taaagttcatatggaaccaaaa

SEQ ID NO: 827952 - DNA, 22 bp, Artificial Sequence
  chemically synthesized
aaagttcatatggaaccaaaaa

SEQ ID NO: 827953 - DNA, 22 bp, Artificial Sequence
  chemically synthesized
aagttcatatggaaccaaaaaa

SEQ ID NO: 827954 - DNA, 22 bp, Artificial Sequence
  chemically synthesized
gcaatgtgggctcttttttggt

SEQ ID NO: 827955 - DNA, 22 bp, Artificial Sequence
  chemically synthesized
ggcaatgtgggctcttttttgg

SEQ ID NO: 827956 - DNA, 22 bp, Artificial Sequence
  chemically synthesized
atatggaaccaaaaaagagccc

SEQ ID NO: 827957 - DNA, 22 bp, Artificial Sequence
  chemically synthesized
tcttggcaatgtgggctctttt

SEQ ID NO: 827958 - DNA, 22 bp, Artificial Sequence
  chemically synthesized
aggattgtcttggcaatgtggg

SEQ ID NO: 827959 - DNA, 22 bp, Artificial Sequence
  chemically synthesized
gctcaggattgtcttggcaatg

SEQ ID NO: 827960 - DNA, 22 bp, Artificial Sequence
  chemically synthesized
ggctcaggattgtcttggcaat

SEQ ID NO: 827961 - DNA, 22 bp, Artificial Sequence
  chemically synthesized
tggctcaggattgtcttggcaa

SEQ ID NO: 827962 - DNA, 22 bp, Artificial Sequence
  chemically synthesized
ttggctcaggattgtcttggca

SEQ ID NO: 827963 - DNA, 22 bp, Artificial Sequence
  chemically synthesized
ttttggctcaggattgtcttgg

SEQ ID NO: 827964 - DNA, 22 bp, Artificial Sequence
  chemically synthesized
ttcttttggctcaggattgtct

SEQ ID NO: 827965 - DNA, 22 bp, Artificial Sequence
  chemically synthesized
gttcttttggctcaggattgtc

SEQ ID NO: 827966 - DNA, 22 bp, Artificial Sequence
  chemically synthesized
tgttcttttggctcaggattgt

SEQ ID NO: 827967 - DNA, 22 bp, Artificial Sequence
  chemically synthesized
cagctttgttcttttggctcag

SEQ ID NO: 827968 - DNA, 22 bp, Artificial Sequence
  chemically synthesized
ccaagacaatcctgagccaaaa

SEQ ID NO: 827969 - DNA, 22 bp, Artificial Sequence
  chemically synthesized
agccaaaagaacaaagctggag

SEQ ID NO: 827970 - DNA, 22 bp, Artificial Sequence
  chemically synthesized
aagtcaggtagcgtgatgcctc

SEQ ID NO: 827971 - DNA, 22 bp, Artificial Sequence
  chemically synthesized
gaagtcaggtagcgtgatgcct

SEQ ID NO: 827972 - DNA, 22 bp, Artificial Sequence
  chemically synthesized
gaggcatcacgctacctgactt

SEQ ID NO: 827973 - DNA, 22 bp, Artificial Sequence
  chemically synthesized
tagtatagtttgaagtcaggta

SEQ ID NO: 827974 - DNA, 22 bp, Artificial Sequence
  chemically synthesized
gtagtatagtttgaagtcaggt

SEQ ID NO: 827975 - DNA, 22 bp, Artificial Sequence
  chemically synthesized
ccgtagccttgtagtatagttt

SEQ ID NO: 827976 - DNA, 22 bp, Artificial Sequence
  chemically synthesized
cctgacttcaaactatactaca

SEQ ID NO: 827977 - DNA, 22 bp, Artificial Sequence
  chemically synthesized
gttaccgtagccttgtagtata

SEQ ID NO: 827978 - DNA, 22 bp, Artificial Sequence
  chemically synthesized
ggttaccgtagccttgtagtat

SEQ ID NO: 827979 - DNA, 22 bp, Artificial Sequence
  chemically synthesized
tggttaccgtagccttgtagta

SEQ ID NO: 827980 - DNA, 22 bp, Artificial Sequence
  chemically synthesized
acttcaaactatactacaaggc

SEQ ID NO: 827981 - DNA, 22 bp, Artificial Sequence
  chemically synthesized
ttttggttaccgtagccttgta

SEQ ID NO: 827982 - DNA, 22 bp, Artificial Sequence
  chemically synthesized
caaactatactacaaggctacg

SEQ ID NO: 827983 - DNA, 22 bp, Artificial Sequence
  chemically synthesized
aaactatactacaaggctacgg

SEQ ID NO: 827984 - DNA, 22 bp, Artificial Sequence
  chemically synthesized
tactacaaggctacggtaacca

SEQ ID NO: 827985 - DNA, 22 bp, Artificial Sequence
  chemically synthesized
caaggctacggtaaccaaaaca

SEQ ID NO: 827986 - DNA, 22 bp, Artificial Sequence
  chemically synthesized
gtaccagtaccatgctgttttg

SEQ ID NO: 827987 - DNA, 22 bp, Artificial Sequence
  chemically synthesized
ggtaccagtaccatgctgtttt

SEQ ID NO: 827988 - DNA, 22 bp, Artificial Sequence
  chemically synthesized
tggtaccagtaccatgctgttt

SEQ ID NO: 827989 - DNA, 22 bp, Artificial Sequence
  chemically synthesized
cggtaaccaaaacagcatggta

SEQ ID NO: 827990 - DNA, 22 bp, Artificial Sequence
  chemically synthesized
ttttggtaccagtaccatgctg

SEQ ID NO: 827991 - DNA, 22 bp, Artificial Sequence
  chemically synthesized
tgttttggtaccagtaccatgc

SEQ ID NO: 827992 - DNA, 22 bp, Artificial Sequence
  chemically synthesized
gtgtatatctctgttttggtac

SEQ ID NO: 827993 - DNA, 22 bp, Artificial Sequence
  chemically synthesized
cattggtgtatatctctgtttt

SEQ ID NO: 827994 - DNA, 22 bp, Artificial Sequence
  chemically synthesized
ttccattggtgtatatctctgt

SEQ ID NO: 827995 - DNA, 22 bp, Artificial Sequence
  chemically synthesized
tgttccattggtgtatatctct

SEQ ID NO: 827996 - DNA, 22 bp, Artificial Sequence
  chemically synthesized
gtaccaaaacagagatatacac

SEQ ID NO: 827997 - DNA, 22 bp, Artificial Sequence
  chemically synthesized
ttctgttccattggtgtatatc

SEQ ID NO: 827998 - DNA, 22 bp, Artificial Sequence
  chemically synthesized
tgttctgttccattggtgtata

SEQ ID NO: 827999 - DNA, 22 bp, Artificial Sequence
  chemically synthesized
agagctctgttctgttccattg

SEQ ID NO: 828000 - DNA, 22 bp, Artificial Sequence
  chemically synthesized
tgagagctctgttctgttccat

SEQ ID NO: 828001 - DNA, 22 bp, Artificial Sequence
  chemically synthesized
ctgagagctctgttctgttcca

SEQ ID NO: 828002 - DNA, 22 bp, Artificial Sequence
  chemically synthesized
tttctgagagctctgttctgtt

SEQ ID NO: 828003 - DNA, 22 bp, Artificial Sequence
  chemically synthesized
tagatgtgtggtattatttctg

SEQ ID NO: 828004 - DNA, 22 bp, Artificial Sequence
  chemically synthesized
tcagaaataataccacacatct

SEQ ID NO: 828005 - DNA, 22 bp, Artificial Sequence
  chemically synthesized
agaaataataccacacatctac

SEQ ID NO: 828006 - DNA, 22 bp, Artificial Sequence
  chemically synthesized
tcaaagatcagatggttgtaga

SEQ ID NO: 828007 - DNA, 22 bp, Artificial Sequence
  chemically synthesized
gtcaaagatcagatggttgtag

SEQ ID NO: 828008 - DNA, 22 bp, Artificial Sequence
  chemically synthesized
tcaggtttgtcaaagatcagat

SEQ ID NO: 828009 - DNA, 22 bp, Artificial Sequence
  chemically synthesized
gtcaggtttgtcaaagatcaga

SEQ ID NO: 828010 - DNA, 22 bp, Artificial Sequence
  chemically synthesized
tgtcaggtttgtcaaagatcag

SEQ ID NO: 828011 - DNA, 22 bp, Artificial Sequence
  chemically synthesized
ttgtcaggtttgtcaaagatca

SEQ ID NO: 828012 - DNA, 22 bp, Artificial Sequence
  chemically synthesized
tttttgtcaggtttgtcaaaga

SEQ ID NO: 828013 - DNA, 22 bp, Artificial Sequence
  chemically synthesized
caaccatctgatctttgacaaa

SEQ ID NO: 828014 - DNA, 22 bp, Artificial Sequence
  chemically synthesized
gtttttgtcaggtttgtcaaag

SEQ ID NO: 828015 - DNA, 22 bp, Artificial Sequence
  chemically synthesized
ttgtttttgtcaggtttgtcaa

SEQ ID NO: 828016 - DNA, 22 bp, Artificial Sequence
  chemically synthesized
cttgtttttgtcaggtttgtca

SEQ ID NO: 828017 - DNA, 22 bp, Artificial Sequence
  chemically synthesized
atctttgacaaacctgacaaaa

SEQ ID NO: 828018 - DNA, 22 bp, Artificial Sequence
  chemically synthesized
cccatttcttgtttttgtcagg

SEQ ID NO: 828019 - DNA, 22 bp, Artificial Sequence
  chemically synthesized
ccccatttcttgtttttgtcag

SEQ ID NO: 828020 - DNA, 22 bp, Artificial Sequence
  chemically synthesized
tccccatttcttgtttttgtca

SEQ ID NO: 828021 - DNA, 22 bp, Artificial Sequence
  chemically synthesized
tgacaaacctgacaaaaacaag

SEQ ID NO: 828022 - DNA, 22 bp, Artificial Sequence
  chemically synthesized
gacaaacctgacaaaaacaaga

SEQ ID NO: 828023 - DNA, 22 bp, Artificial Sequence
  chemically synthesized
acaaacctgacaaaaacaagaa

SEQ ID NO: 828024 - DNA, 22 bp, Artificial Sequence
  chemically synthesized
acaaaaacaagaaatggggaaa

SEQ ID NO: 828025 - DNA, 22 bp, Artificial Sequence
  chemically synthesized
aatagggaatcctttccccatt

SEQ ID NO: 828026 - DNA, 22 bp, Artificial Sequence
  chemically synthesized
ttaaatagggaatcctttcccc

SEQ ID NO: 828027 - DNA, 22 bp, Artificial Sequence
  chemically synthesized
attaaatagggaatcctttccc

SEQ ID NO: 828028 - DNA, 22 bp, Artificial Sequence
  chemically synthesized
ccagcaccatttattaaatagg

SEQ ID NO: 828029 - DNA, 22 bp, Artificial Sequence
  chemically synthesized
cccagcaccatttattaaatag

SEQ ID NO: 828030 - DNA, 22 bp, Artificial Sequence
  chemically synthesized
tcccagcaccatttattaaata

SEQ ID NO: 828031 - DNA, 22 bp, Artificial Sequence
  chemically synthesized
gccagttttcccagcaccattt

SEQ ID NO: 828032 - DNA, 22 bp, Artificial Sequence
  chemically synthesized
cctatttaataaatggtgctgg

SEQ ID NO: 828033 - DNA, 22 bp, Artificial Sequence
  chemically synthesized
tttaataaatggtgctgggaaa

SEQ ID NO: 828034 - DNA, 22 bp, Artificial Sequence
  chemically synthesized
aataaatggtgctgggaaaact

SEQ ID NO: 828035 - DNA, 22 bp, Artificial Sequence
  chemically synthesized
ataaatggtgctgggaaaactg

SEQ ID NO: 828036 - DNA, 22 bp, Artificial Sequence
  chemically synthesized
catatggctagccagttttccc

SEQ ID NO: 828037 - DNA, 22 bp, Artificial Sequence
  chemically synthesized
tacatatggctagccagttttc

SEQ ID NO: 828038 - DNA, 22 bp, Artificial Sequence
  chemically synthesized
tctacatatggctagccagttt

SEQ ID NO: 828039 - DNA, 22 bp, Artificial Sequence
  chemically synthesized
agctctctacatatggctagcc

SEQ ID NO: 828040 - DNA, 22 bp, Artificial Sequence
  chemically synthesized
cagctctctacatatggctagc

SEQ ID NO: 828041 - DNA, 22 bp, Artificial Sequence
  chemically synthesized
ggaaaactggctagccatatgt

SEQ ID NO: 828042 - DNA, 22 bp, Artificial Sequence
  chemically synthesized
gctagccatatgtagagagctg

SEQ ID NO: 828043 - DNA, 22 bp, Artificial Sequence
  chemically synthesized
gccatatgtagagagctgaaac

SEQ ID NO: 828044 - DNA, 22 bp, Artificial Sequence
  chemically synthesized
tatatggtataaggaagggatc

SEQ ID NO: 828045 - DNA, 22 bp, Artificial Sequence
  chemically synthesized
gtatatggtataaggaagggat

SEQ ID NO: 828046 - DNA, 22 bp, Artificial Sequence
  chemically synthesized
tgtatatggtataaggaaggga

SEQ ID NO: 828047 - DNA, 22 bp, Artificial Sequence
  chemically synthesized
ttgtatatggtataaggaaggg

SEQ ID NO: 828048 - DNA, 22 bp, Artificial Sequence
  chemically synthesized
aaactggatcccttccttatac

SEQ ID NO: 828049 - DNA, 22 bp, Artificial Sequence
  chemically synthesized
atttttgtatatggtataagga

SEQ ID NO: 828050 - DNA, 22 bp, Artificial Sequence
  chemically synthesized
gatcccttccttataccatata

SEQ ID NO: 828051 - DNA, 22 bp, Artificial Sequence
  chemically synthesized
aattaatttttgtatatggtat

SEQ ID NO: 828052 - DNA, 22 bp, Artificial Sequence
  chemically synthesized
gaattaatttttgtatatggta

SEQ ID NO: 828053 - DNA, 22 bp, Artificial Sequence
  chemically synthesized
ccttataccatatacaaaaatt

SEQ ID NO: 828054 - DNA, 22 bp, Artificial Sequence
  chemically synthesized
cttataccatatacaaaaatta

SEQ ID NO: 828055 - DNA, 22 bp, Artificial Sequence
  chemically synthesized
aatccatcttgaattaattttt

SEQ ID NO: 828056 - DNA, 22 bp, Artificial Sequence
  chemically synthesized
ataccatatacaaaaattaatt

SEQ ID NO: 828057 - DNA, 22 bp, Artificial Sequence
  chemically synthesized
caatccatcttgaattaatttt

SEQ ID NO: 828058 - DNA, 22 bp, Artificial Sequence
  chemically synthesized
taccatatacaaaaattaattc

SEQ ID NO: 828059 - DNA, 22 bp, Artificial Sequence
  chemically synthesized
agtcttcaatccatcttgaatt

SEQ ID NO: 828060 - DNA, 22 bp, Artificial Sequence
  chemically synthesized
acattaagtcttcaatccatct

SEQ ID NO: 828061 - DNA, 22 bp, Artificial Sequence
  chemically synthesized
ggtctaacattaagtcttcaat

SEQ ID NO: 828062 - DNA, 22 bp, Artificial Sequence
  chemically synthesized
attcaagatggattgaagactt

SEQ ID NO: 828063 - DNA, 22 bp, Artificial Sequence
  chemically synthesized
aggtctaacattaagtcttcaa

SEQ ID NO: 828064 - DNA, 22 bp, Artificial Sequence
  chemically synthesized
taggtctaacattaagtcttca

SEQ ID NO: 828065 - DNA, 22 bp, Artificial Sequence
  chemically synthesized
aagatggattgaagacttaatg

SEQ ID NO: 828066 - DNA, 22 bp, Artificial Sequence
  chemically synthesized
tggttttaggtctaacattaag

SEQ ID NO: 828067 - DNA, 22 bp, Artificial Sequence
  chemically synthesized
atggttttaggtctaacattaa

SEQ ID NO: 828068 - DNA, 22 bp, Artificial Sequence
  chemically synthesized
tatggttttaggtctaacatta

SEQ ID NO: 828069 - DNA, 22 bp, Artificial Sequence
  chemically synthesized
ttatggttttaggtctaacatt

SEQ ID NO: 828070 - DNA, 22 bp, Artificial Sequence
  chemically synthesized
aagacttaatgttagacctaaa

SEQ ID NO: 828071 - DNA, 22 bp, Artificial Sequence
  chemically synthesized
gggtttttatggttttaggtct

SEQ ID NO: 828072 - DNA, 22 bp, Artificial Sequence
  chemically synthesized
tagggtttttatggttttaggt

SEQ ID NO: 828073 - DNA, 22 bp, Artificial Sequence
  chemically synthesized
ctagggtttttatggttttagg

SEQ ID NO: 828074 - DNA, 22 bp, Artificial Sequence
  chemically synthesized
ttctagggtttttatggtttta

SEQ ID NO: 828075 - DNA, 22 bp, Artificial Sequence
  chemically synthesized
aatgttagacctaaaaccataa

SEQ ID NO: 828076 - DNA, 22 bp, Artificial Sequence
  chemically synthesized
cttctagggtttttatggtttt

SEQ ID NO: 828077 - DNA, 22 bp, Artificial Sequence
  chemically synthesized
atgttagacctaaaaccataaa

SEQ ID NO: 828078 - DNA, 22 bp, Artificial Sequence
  chemically synthesized
tcttctagggtttttatggttt

SEQ ID NO: 828079 - DNA, 22 bp, Artificial Sequence
  chemically synthesized
ggttttcttctagggtttttat

SEQ ID NO: 828080 - DNA, 22 bp, Artificial Sequence
  chemically synthesized
gacctaaaaccataaaaaccct

SEQ ID NO: 828081 - DNA, 22 bp, Artificial Sequence
  chemically synthesized
cctaggttttcttctagggttt

SEQ ID NO: 828082 - DNA, 22 bp, Artificial Sequence
  chemically synthesized
aaaccataaaaaccctagaaga

SEQ ID NO: 828083 - DNA, 22 bp, Artificial Sequence
  chemically synthesized
aatggtattgcctaggttttct

SEQ ID NO: 828084 - DNA, 22 bp, Artificial Sequence
  chemically synthesized
cgtcctgaatggtattgcctag

SEQ ID NO: 828085 - DNA, 22 bp, Artificial Sequence
  chemically synthesized
gaagaaaacctaggcaatacca

SEQ ID NO: 828086 - DNA, 22 bp, Artificial Sequence
  chemically synthesized
cccatgcctacgtcctgaatgg

SEQ ID NO: 828087 - DNA, 22 bp, Artificial Sequence
  chemically synthesized
gcccatgcctacgtcctgaatg

SEQ ID NO: 828088 - DNA, 22 bp, Artificial Sequence
  chemically synthesized
ggcaataccattcaggacgtag

SEQ ID NO: 828089 - DNA, 22 bp, Artificial Sequence
  chemically synthesized
gacatgaagtccttgcccatgc

SEQ ID NO: 828090 - DNA, 22 bp, Artificial Sequence
  chemically synthesized
agacatgaagtccttgcccatg

SEQ ID NO: 828091 - DNA, 22 bp, Artificial Sequence
  chemically synthesized
tagacatgaagtccttgcccat

SEQ ID NO: 828092 - DNA, 22 bp, Artificial Sequence
  chemically synthesized
aggacgtaggcatgggcaagga

SEQ ID NO: 828093 - DNA, 22 bp, Artificial Sequence
  chemically synthesized
gtgttttagacatgaagtcctt

SEQ ID NO: 828094 - DNA, 22 bp, Artificial Sequence
  chemically synthesized
ggtgttttagacatgaagtcct

SEQ ID NO: 828095 - DNA, 22 bp, Artificial Sequence
  chemically synthesized
tggtgttttagacatgaagtcc

SEQ ID NO: 828096 - DNA, 22 bp, Artificial Sequence
  chemically synthesized
ttggtgttttagacatgaagtc

SEQ ID NO: 828097 - DNA, 22 bp, Artificial Sequence
  chemically synthesized
cttttggtgttttagacatgaa

SEQ ID NO: 828098 - DNA, 22 bp, Artificial Sequence
  chemically synthesized
ccattgcttttggtgttttaga

SEQ ID NO: 828099 - DNA, 22 bp, Artificial Sequence
  chemically synthesized
ttgccattgcttttggtgtttt

SEQ ID NO: 828100 - DNA, 22 bp, Artificial Sequence
  chemically synthesized
gttgccattgcttttggtgttt

SEQ ID NO: 828101 - DNA, 22 bp, Artificial Sequence
  chemically synthesized
tgttgccattgcttttggtgtt

SEQ ID NO: 828102 - DNA, 22 bp, Artificial Sequence
  chemically synthesized
ttgttgccattgcttttggtgt

SEQ ID NO: 828103 - DNA, 22 bp, Artificial Sequence
  chemically synthesized
catgtctaaaacaccaaaagca

SEQ ID NO: 828104 - DNA, 22 bp, Artificial Sequence
  chemically synthesized
atgtctaaaacaccaaaagcaa

SEQ ID NO: 828105 - DNA, 22 bp, Artificial Sequence
  chemically synthesized
gcttttgttgccattgcttttg

SEQ ID NO: 828106 - DNA, 22 bp, Artificial Sequence
  chemically synthesized
ggcttttgttgccattgctttt

SEQ ID NO: 828107 - DNA, 22 bp, Artificial Sequence
  chemically synthesized
tggcttttgttgccattgcttt

SEQ ID NO: 828108 - DNA, 22 bp, Artificial Sequence
  chemically synthesized
aaacaccaaaagcaatggcaac

SEQ ID NO: 828109 - DNA, 22 bp, Artificial Sequence
  chemically synthesized
tccgttttggcttttgttgcca

SEQ ID NO: 828110 - DNA, 22 bp, Artificial Sequence
  chemically synthesized
gtccgttttggcttttgttgcc

SEQ ID NO: 828111 - DNA, 22 bp, Artificial Sequence
  chemically synthesized
gatcccatttgtccgttttggc

SEQ ID NO: 828112 - DNA, 22 bp, Artificial Sequence
  chemically synthesized
attagatcccatttgtccgttt

SEQ ID NO: 828113 - DNA, 22 bp, Artificial Sequence
  chemically synthesized
cattagatcccatttgtccgtt

SEQ ID NO: 828114 - DNA, 22 bp, Artificial Sequence
  chemically synthesized
gtttcattagatcccatttgtc

SEQ ID NO: 828115 - DNA, 22 bp, Artificial Sequence
  chemically synthesized
agtttcattagatcccatttgt

SEQ ID NO: 828116 - DNA, 22 bp, Artificial Sequence
  chemically synthesized
tagtttcattagatcccatttg

SEQ ID NO: 828117 - DNA, 22 bp, Artificial Sequence
  chemically synthesized
tttagtttcattagatcccatt

SEQ ID NO: 828118 - DNA, 22 bp, Artificial Sequence
  chemically synthesized
tgcagaagctctttagtttcat

SEQ ID NO: 828119 - DNA, 22 bp, Artificial Sequence
  chemically synthesized
ctgtgcagaagctctttagttt

SEQ ID NO: 828120 - DNA, 22 bp, Artificial Sequence
  chemically synthesized
gctgtgcagaagctctttagtt

SEQ ID NO: 828121 - DNA, 22 bp, Artificial Sequence
  chemically synthesized
tgctgtgcagaagctctttagt

SEQ ID NO: 828122 - DNA, 22 bp, Artificial Sequence
  chemically synthesized
ttgctgtgcagaagctctttag

SEQ ID NO: 828123 - DNA, 22 bp, Artificial Sequence
  chemically synthesized
ttttgctgtgcagaagctcttt

SEQ ID NO: 828124 - DNA, 22 bp, Artificial Sequence
  chemically synthesized
cttttgctgtgcagaagctctt

SEQ ID NO: 828125 - DNA, 22 bp, Artificial Sequence
  chemically synthesized
atgaaactaaagagcttctgca

SEQ ID NO: 828126 - DNA, 22 bp, Artificial Sequence
  chemically synthesized
atggtagtttcttttgctgtgc

SEQ ID NO: 828127 - DNA, 22 bp, Artificial Sequence
  chemically synthesized
aagagcttctgcacagcaaaag

SEQ ID NO: 828128 - DNA, 22 bp, Artificial Sequence
  chemically synthesized
tgatggtagtttcttttgctgt

SEQ ID NO: 828129 - DNA, 22 bp, Artificial Sequence
  chemically synthesized
actctgatggtagtttcttttg

SEQ ID NO: 828130 - DNA, 22 bp, Artificial Sequence
  chemically synthesized
ttcactctgatggtagtttctt

SEQ ID NO: 828131 - DNA, 22 bp, Artificial Sequence
  chemically synthesized
ctgcacagcaaaagaaactacc

SEQ ID NO: 828132 - DNA, 22 bp, Artificial Sequence
  chemically synthesized
tgcacagcaaaagaaactacca

SEQ ID NO: 828133 - DNA, 22 bp, Artificial Sequence
  chemically synthesized
cacagcaaaagaaactaccatc

SEQ ID NO: 828134 - DNA, 22 bp, Artificial Sequence
  chemically synthesized
cctgttcactctgatggtagtt

SEQ ID NO: 828135 - DNA, 22 bp, Artificial Sequence
  chemically synthesized
taggctgcctgttcactctgat

SEQ ID NO: 828136 - DNA, 22 bp, Artificial Sequence
  chemically synthesized
tgtaggctgcctgttcactctg

SEQ ID NO: 828137 - DNA, 22 bp, Artificial Sequence
  chemically synthesized
ccattctgtaggctgcctgttc

SEQ ID NO: 828138 - DNA, 22 bp, Artificial Sequence
  chemically synthesized
ccatcagagtgaacaggcagcc

SEQ ID NO: 828139 - DNA, 22 bp, Artificial Sequence
  chemically synthesized
tcccattctgtaggctgcctgt

SEQ ID NO: 828140 - DNA, 22 bp, Artificial Sequence
  chemically synthesized
ctcccattctgtaggctgcctg

SEQ ID NO: 828141 - DNA, 22 bp, Artificial Sequence
  chemically synthesized
tctcccattctgtaggctgcct

SEQ ID NO: 828142 - DNA, 22 bp, Artificial Sequence
  chemically synthesized
caaaaattttctcccattctgt

SEQ ID NO: 828143 - DNA, 22 bp, Artificial Sequence
  chemically synthesized
cagaatgggagaaaatttttgc

SEQ ID NO: 828144 - DNA, 22 bp, Artificial Sequence
  chemically synthesized
tcagatgagtagattgcaaaaa

SEQ ID NO: 828145 - DNA, 22 bp, Artificial Sequence
  chemically synthesized
gtcagatgagtagattgcaaaa

SEQ ID NO: 828146 - DNA, 22 bp, Artificial Sequence
  chemically synthesized
tgtcagatgagtagattgcaaa

SEQ ID NO: 828147 - DNA, 22 bp, Artificial Sequence
  chemically synthesized
gccctttgtcagatgagtagat

SEQ ID NO: 828148 - DNA, 22 bp, Artificial Sequence
  chemically synthesized
ttgcaatctactcatctgacaa

SEQ ID NO: 828149 - DNA, 22 bp, Artificial Sequence
  chemically synthesized
gatattagccctttgtcagatg

SEQ ID NO: 828150 - DNA, 22 bp, Artificial Sequence
  chemically synthesized
tgcaatctactcatctgacaaa

SEQ ID NO: 828151 - DNA, 22 bp, Artificial Sequence
  chemically synthesized
gcaatctactcatctgacaaag

SEQ ID NO: 828152 - DNA, 22 bp, Artificial Sequence
  chemically synthesized
tggatattagccctttgtcaga

SEQ ID NO: 828153 - DNA, 22 bp, Artificial Sequence
  chemically synthesized
caatctactcatctgacaaagg

SEQ ID NO: 828154 - DNA, 22 bp, Artificial Sequence
  chemically synthesized
tagattctggatattagccctt

SEQ ID NO: 828155 - DNA, 22 bp, Artificial Sequence
  chemically synthesized
ctcatctgacaaagggctaata

SEQ ID NO: 828156 - DNA, 22 bp, Artificial Sequence
  chemically synthesized
gtagattctggatattagccct

SEQ ID NO: 828157 - DNA, 22 bp, Artificial Sequence
  chemically synthesized
tgtagattctggatattagccc

SEQ ID NO: 828158 - DNA, 22 bp, Artificial Sequence
  chemically synthesized
atctgacaaagggctaatatcc

SEQ ID NO: 828159 - DNA, 22 bp, Artificial Sequence
  chemically synthesized
tttgtagattctggatattagc

SEQ ID NO: 828160 - DNA, 22 bp, Artificial Sequence
  chemically synthesized
acaaagggctaatatccagaat

SEQ ID NO: 828161 - DNA, 22 bp, Artificial Sequence
  chemically synthesized
agttctttgtagattctggata

SEQ ID NO: 828162 - DNA, 22 bp, Artificial Sequence
  chemically synthesized
gagttctttgtagattctggat

SEQ ID NO: 828163 - DNA, 22 bp, Artificial Sequence
  chemically synthesized
tttgagttctttgtagattctg

SEQ ID NO: 828164 - DNA, 22 bp, Artificial Sequence
  chemically synthesized
gtttgagttctttgtagattct

SEQ ID NO: 828165 - DNA, 22 bp, Artificial Sequence
  chemically synthesized
atatccagaatctacaaagaac

SEQ ID NO: 828166 - DNA, 22 bp, Artificial Sequence
  chemically synthesized
taagtttgtttgagttctttgt

SEQ ID NO: 828167 - DNA, 22 bp, Artificial Sequence
  chemically synthesized
gtaagtttgtttgagttctttg

SEQ ID NO: 828168 - DNA, 22 bp, Artificial Sequence
  chemically synthesized
ttgtaagtttgtttgagttctt

SEQ ID NO: 828169 - DNA, 22 bp, Artificial Sequence
  chemically synthesized
cttgtaagtttgtttgagttct

SEQ ID NO: 828170 - DNA, 22 bp, Artificial Sequence
  chemically synthesized
tcttgtaagtttgtttgagttc

SEQ ID NO: 828171 - DNA, 22 bp, Artificial Sequence
  chemically synthesized
ttcttgtaagtttgtttgagtt

SEQ ID NO: 828172 - DNA, 22 bp, Artificial Sequence
  chemically synthesized
tttcttgtaagtttgtttgagt

SEQ ID NO: 828173 - DNA, 22 bp, Artificial Sequence
  chemically synthesized
ttttttcttgtaagtttgtttg

SEQ ID NO: 828174 - DNA, 22 bp, Artificial Sequence
  chemically synthesized
gttttttcttgtaagtttgttt

SEQ ID NO: 828175 - DNA, 22 bp, Artificial Sequence
  chemically synthesized
caaagaactcaaacaaacttac

SEQ ID NO: 828176 - DNA, 22 bp, Artificial Sequence
  chemically synthesized
tttgttttttcttgtaagtttg

SEQ ID NO: 828177 - DNA, 22 bp, Artificial Sequence
  chemically synthesized
aaacaaacttacaagaaaaaac

SEQ ID NO: 828178 - DNA, 22 bp, Artificial Sequence
  chemically synthesized
atggggttgtttgttttttctt

SEQ ID NO: 828179 - DNA, 22 bp, Artificial Sequence
  chemically synthesized
gatggggttgtttgttttttct

SEQ ID NO: 828180 - DNA, 22 bp, Artificial Sequence
  chemically synthesized
tgatggggttgtttgttttttc

SEQ ID NO: 828181 - DNA, 22 bp, Artificial Sequence
  chemically synthesized
ttgatggggttgtttgtttttt

SEQ ID NO: 828182 - DNA, 22 bp, Artificial Sequence
  chemically synthesized
tttgatggggttgtttgttttt

SEQ ID NO: 828183 - DNA, 22 bp, Artificial Sequence
  chemically synthesized
acaagaaaaaacaaacaacccc

SEQ ID NO: 828184 - DNA, 22 bp, Artificial Sequence
  chemically synthesized
caagaaaaaacaaacaacccca

SEQ ID NO: 828185 - DNA, 22 bp, Artificial Sequence
  chemically synthesized
gcccactttttgatggggttgt

SEQ ID NO: 828186 - DNA, 22 bp, Artificial Sequence
  chemically synthesized
cgcccactttttgatggggttg

SEQ ID NO: 828187 - DNA, 22 bp, Artificial Sequence
  chemically synthesized
atatccttcgcccactttttga

SEQ ID NO: 828188 - DNA, 22 bp, Artificial Sequence
  chemically synthesized
ttcatatccttcgcccactttt

SEQ ID NO: 828189 - DNA, 22 bp, Artificial Sequence
  chemically synthesized
agaagtgtctgttcatatcctt

SEQ ID NO: 828190 - DNA, 22 bp, Artificial Sequence
  chemically synthesized
gagaagtgtctgttcatatcct

SEQ ID NO: 828191 - DNA, 22 bp, Artificial Sequence
  chemically synthesized
tgagaagtgtctgttcatatcc

SEQ ID NO: 828192 - DNA, 22 bp, Artificial Sequence
  chemically synthesized
ttgagaagtgtctgttcatatc

SEQ ID NO: 828193 - DNA, 22 bp, Artificial Sequence
  chemically synthesized
ttttgagaagtgtctgttcata

SEQ ID NO: 828194 - DNA, 22 bp, Artificial Sequence
  chemically synthesized
cttttgagaagtgtctgttcat

SEQ ID NO: 828195 - DNA, 22 bp, Artificial Sequence
  chemically synthesized
cataaatgtcttcttttgagaa

SEQ ID NO: 828196 - DNA, 22 bp, Artificial Sequence
  chemically synthesized
gctgcataaatgtcttcttttg

SEQ ID NO: 828197 - DNA, 22 bp, Artificial Sequence
  chemically synthesized
ggctgcataaatgtcttctttt

SEQ ID NO: 828198 - DNA, 22 bp, Artificial Sequence
  chemically synthesized
tggctgcataaatgtcttcttt

SEQ ID NO: 828199 - DNA, 22 bp, Artificial Sequence
  chemically synthesized
ttggctgcataaatgtcttctt

SEQ ID NO: 828200 - DNA, 22 bp, Artificial Sequence
  chemically synthesized
ctcaaaagaagacatttatgca

SEQ ID NO: 828201 - DNA, 22 bp, Artificial Sequence
  chemically synthesized
tcaaaagaagacatttatgcag

SEQ ID NO: 828202 - DNA, 22 bp, Artificial Sequence
  chemically synthesized
atgtgtcttttggctgcataaa

SEQ ID NO: 828203 - DNA, 22 bp, Artificial Sequence
  chemically synthesized
aaaagaagacatttatgcagcc

SEQ ID NO: 828204 - DNA, 22 bp, Artificial Sequence
  chemically synthesized
catgtgtcttttggctgcataa

SEQ ID NO: 828205 - DNA, 22 bp, Artificial Sequence
  chemically synthesized
tcatgtgtcttttggctgcata

SEQ ID NO: 828206 - DNA, 22 bp, Artificial Sequence
  chemically synthesized
ttcatgtgtcttttggctgcat

SEQ ID NO: 828207 - DNA, 22 bp, Artificial Sequence
  chemically synthesized
tttcatgtgtcttttggctgca

SEQ ID NO: 828208 - DNA, 22 bp, Artificial Sequence
  chemically synthesized
atgcagccaaaagacacatgaa

SEQ ID NO: 828209 - DNA, 22 bp, Artificial Sequence
  chemically synthesized
tgcagccaaaagacacatgaaa

SEQ ID NO: 828210 - DNA, 22 bp, Artificial Sequence
  chemically synthesized
atggccagtgatgatgagcatt

SEQ ID NO: 828211 - DNA, 22 bp, Artificial Sequence
  chemically synthesized
tgatggccagtgatgatgagca

SEQ ID NO: 828212 - DNA, 22 bp, Artificial Sequence
  chemically synthesized
tctgatggccagtgatgatgag

SEQ ID NO: 828213 - DNA, 22 bp, Artificial Sequence
  chemically synthesized
ctctgatggccagtgatgatga

SEQ ID NO: 828214 - DNA, 22 bp, Artificial Sequence
  chemically synthesized
cgtttctctgatggccagtgat

SEQ ID NO: 828215 - DNA, 22 bp, Artificial Sequence
  chemically synthesized
gcgtttctctgatggccagtga

SEQ ID NO: 828216 - DNA, 22 bp, Artificial Sequence
  chemically synthesized
atttgcgtttctctgatggcca

SEQ ID NO: 828217 - DNA, 22 bp, Artificial Sequence
  chemically synthesized
gatttgcgtttctctgatggcc

SEQ ID NO: 828218 - DNA, 22 bp, Artificial Sequence
  chemically synthesized
tgatttgcgtttctctgatggc

SEQ ID NO: 828219 - DNA, 22 bp, Artificial Sequence
  chemically synthesized
atcatcactggccatcagagaa

SEQ ID NO: 828220 - DNA, 22 bp, Artificial Sequence
  chemically synthesized
tggttttgatttgcgtttctct

SEQ ID NO: 828221 - DNA, 22 bp, Artificial Sequence
  chemically synthesized
attgtggttttgatttgcgttt

SEQ ID NO: 828222 - DNA, 22 bp, Artificial Sequence
  chemically synthesized
gccatcagagaaacgcaaatca

SEQ ID NO: 828223 - DNA, 22 bp, Artificial Sequence
  chemically synthesized
gtgtgagatggtatctcattgt

SEQ ID NO: 828224 - DNA, 22 bp, Artificial Sequence
  chemically synthesized
actggtgtgagatggtatctca

SEQ ID NO: 828225 - DNA, 22 bp, Artificial Sequence
  chemically synthesized
taactggtgtgagatggtatct

SEQ ID NO: 828226 - DNA, 22 bp, Artificial Sequence
  chemically synthesized
ccattctaactggtgtgagatg

SEQ ID NO: 828227 - DNA, 22 bp, Artificial Sequence
  chemically synthesized
atgattgccattctaactggtg

SEQ ID NO: 828228 - DNA, 22 bp, Artificial Sequence
  chemically synthesized
aatgattgccattctaactggt

SEQ ID NO: 828229 - DNA, 22 bp, Artificial Sequence
  chemically synthesized
taatgattgccattctaactgg

SEQ ID NO: 828230 - DNA, 22 bp, Artificial Sequence
  chemically synthesized
ttaatgattgccattctaactg

SEQ ID NO: 828231 - DNA, 22 bp, Artificial Sequence
  chemically synthesized
tttaatgattgccattctaact

SEQ ID NO: 828232 - DNA, 22 bp, Artificial Sequence
  chemically synthesized
actttttaatgattgccattct

SEQ ID NO: 828233 - DNA, 22 bp, Artificial Sequence
  chemically synthesized
acaccagttagaatggcaatca

SEQ ID NO: 828234 - DNA, 22 bp, Artificial Sequence
  chemically synthesized
ctgactttttaatgattgccat

SEQ ID NO: 828235 - DNA, 22 bp, Artificial Sequence
  chemically synthesized
cctgactttttaatgattgcca

SEQ ID NO: 828236 - DNA, 22 bp, Artificial Sequence
  chemically synthesized
tttcctgactttttaatgattg

SEQ ID NO: 828237 - DNA, 22 bp, Artificial Sequence
  chemically synthesized
ttgtttcctgactttttaatga

SEQ ID NO: 828238 - DNA, 22 bp, Artificial Sequence
  chemically synthesized
gaatggcaatcattaaaaagtc

SEQ ID NO: 828239 - DNA, 22 bp, Artificial Sequence
  chemically synthesized
cagcacctgttgtttcctgact

SEQ ID NO: 828240 - DNA, 22 bp, Artificial Sequence
  chemically synthesized
tccagcacctgttgtttcctga

SEQ ID NO: 828241 - DNA, 22 bp, Artificial Sequence
  chemically synthesized
aaaagtcaggaaacaacaggtg

SEQ ID NO: 828242 - DNA, 22 bp, Artificial Sequence
  chemically synthesized
cacatcctctccagcacctgtt

SEQ ID NO: 828243 - DNA, 22 bp, Artificial Sequence
  chemically synthesized
tccacatcctctccagcacctg

SEQ ID NO: 828244 - DNA, 22 bp, Artificial Sequence
  chemically synthesized
ctccacatcctctccagcacct

SEQ ID NO: 828245 - DNA, 22 bp, Artificial Sequence
  chemically synthesized
tttctccacatcctctccagca

SEQ ID NO: 828246 - DNA, 22 bp, Artificial Sequence
  chemically synthesized
ctatttctccacatcctctcca

SEQ ID NO: 828247 - DNA, 22 bp, Artificial Sequence
  chemically synthesized
gagaggatgtggagaaatagga

SEQ ID NO: 828248 - DNA, 22 bp, Artificial Sequence
  chemically synthesized
acagtgtaaagtgttcctattt

SEQ ID NO: 828249 - DNA, 22 bp, Artificial Sequence
  chemically synthesized
actaacagtgtaaagtgttcct

SEQ ID NO: 828250 - DNA, 22 bp, Artificial Sequence
  chemically synthesized
cagtctcactaacagtgtaaag

SEQ ID NO: 828251 - DNA, 22 bp, Artificial Sequence
  chemically synthesized
acagtctcactaacagtgtaaa

SEQ ID NO: 828252 - DNA, 22 bp, Artificial Sequence
  chemically synthesized
gtttacagtctcactaacagtg

SEQ ID NO: 828253 - DNA, 22 bp, Artificial Sequence
  chemically synthesized
aactagtttacagtctcactaa

SEQ ID NO: 828254 - DNA, 22 bp, Artificial Sequence
  chemically synthesized
tacactgttagtgagactgtaa

SEQ ID NO: 828255 - DNA, 22 bp, Artificial Sequence
  chemically synthesized
acactgttagtgagactgtaaa

SEQ ID NO: 828256 - DNA, 22 bp, Artificial Sequence
  chemically synthesized
cactgttagtgagactgtaaac

SEQ ID NO: 828257 - DNA, 22 bp, Artificial Sequence
  chemically synthesized
cacaatggttgaactagtttac

SEQ ID NO: 828258 - DNA, 22 bp, Artificial Sequence
  chemically synthesized
ttagtgagactgtaaactagtt

SEQ ID NO: 828259 - DNA, 22 bp, Artificial Sequence
  chemically synthesized
ccacaatggttgaactagttta

SEQ ID NO: 828260 - DNA, 22 bp, Artificial Sequence
  chemically synthesized
gtgagactgtaaactagttcaa

SEQ ID NO: 828261 - DNA, 22 bp, Artificial Sequence
  chemically synthesized
acttccacaatggttgaactag

SEQ ID NO: 828262 - DNA, 22 bp, Artificial Sequence
  chemically synthesized
taaactagttcaaccattgtgg

SEQ ID NO: 828263 - DNA, 22 bp, Artificial Sequence
  chemically synthesized
gttcaaccattgtggaagtcag

SEQ ID NO: 828264 - DNA, 22 bp, Artificial Sequence
  chemically synthesized
aggaatcgccacactgacttcc

SEQ ID NO: 828265 - DNA, 22 bp, Artificial Sequence
  chemically synthesized
aaccattgtggaagtcagtgtg

SEQ ID NO: 828266 - DNA, 22 bp, Artificial Sequence
  chemically synthesized
gatccctgaggaatcgccacac

SEQ ID NO: 828267 - DNA, 22 bp, Artificial Sequence
  chemically synthesized
tagatccctgaggaatcgccac

SEQ ID NO: 828268 - DNA, 22 bp, Artificial Sequence
  chemically synthesized
tggaagtcagtgtggcgattcc

SEQ ID NO: 828269 - DNA, 22 bp, Artificial Sequence
  chemically synthesized
gttctagatccctgaggaatcg

SEQ ID NO: 828270 - DNA, 22 bp, Artificial Sequence
  chemically synthesized
tagttctagatccctgaggaat

SEQ ID NO: 828271 - DNA, 22 bp, Artificial Sequence
  chemically synthesized
ctagttctagatccctgaggaa

SEQ ID NO: 828272 - DNA, 22 bp, Artificial Sequence
  chemically synthesized
ctcagggatctagaactagaaa

SEQ ID NO: 828273 - DNA, 22 bp, Artificial Sequence
  chemically synthesized
ggtcaaatggtatttctagttc

SEQ ID NO: 828274 - DNA, 22 bp, Artificial Sequence
  chemically synthesized
agggatctagaactagaaatac

SEQ ID NO: 828275 - DNA, 22 bp, Artificial Sequence
  chemically synthesized
gaactagaaataccatttgacc

SEQ ID NO: 828276 - DNA, 22 bp, Artificial Sequence
  chemically synthesized
gaaataccatttgacccagcta

SEQ ID NO: 828277 - DNA, 22 bp, Artificial Sequence
  chemically synthesized
ggtatatacccagtaatgggat

SEQ ID NO: 828278 - DNA, 22 bp, Artificial Sequence
  chemically synthesized
gggtatatacccagtaatggga

SEQ ID NO: 828279 - DNA, 22 bp, Artificial Sequence
  chemically synthesized
tgggtatatacccagtaatggg

SEQ ID NO: 828280 - DNA, 22 bp, Artificial Sequence
  chemically synthesized
gacccagctatcccattactgg

SEQ ID NO: 828281 - DNA, 22 bp, Artificial Sequence
  chemically synthesized
acccagctatcccattactggg

SEQ ID NO: 828282 - DNA, 22 bp, Artificial Sequence
  chemically synthesized
taatcctttgggtatataccca

SEQ ID NO: 828283 - DNA, 22 bp, Artificial Sequence
  chemically synthesized
ataatcctttgggtatataccc

SEQ ID NO: 828284 - DNA, 22 bp, Artificial Sequence
  chemically synthesized
tcccattactgggtatataccc

SEQ ID NO: 828285 - DNA, 22 bp, Artificial Sequence
  chemically synthesized
ctgggtatatacccaaaggatt

SEQ ID NO: 828286 - DNA, 22 bp, Artificial Sequence
  chemically synthesized
ggtatatacccaaaggattata

SEQ ID NO: 828287 - DNA, 22 bp, Artificial Sequence
  chemically synthesized
cagcagcaggatttataatcct

SEQ ID NO: 828288 - DNA, 22 bp, Artificial Sequence
  chemically synthesized
acagcagcaggatttataatcc

SEQ ID NO: 828289 - DNA, 22 bp, Artificial Sequence
  chemically synthesized
tacagcagcaggatttataatc

SEQ ID NO: 828290 - DNA, 22 bp, Artificial Sequence
  chemically synthesized
tgcatgtatctttacagcagca

SEQ ID NO: 828291 - DNA, 22 bp, Artificial Sequence
  chemically synthesized
taaatcctgctgctgtaaagat

SEQ ID NO: 828292 - DNA, 22 bp, Artificial Sequence
  chemically synthesized
ctgctgtaaagatacatgcaca

SEQ ID NO: 828293 - DNA, 22 bp, Artificial Sequence
  chemically synthesized
ctgtaaagatacatgcacaggt

SEQ ID NO: 828294 - DNA, 22 bp, Artificial Sequence
  chemically synthesized
taaagatacatgcacaggtatg

SEQ ID NO: 828295 - DNA, 22 bp, Artificial Sequence
  chemically synthesized
tgaatagtgcagcaataaacat

SEQ ID NO: 828296 - DNA, 22 bp, Artificial Sequence
  chemically synthesized
ttgtgaatagtgcagcaataaa

SEQ ID NO: 828297 - DNA, 22 bp, Artificial Sequence
  chemically synthesized
ctattgtgaatagtgcagcaat

SEQ ID NO: 828298 - DNA, 22 bp, Artificial Sequence
  chemically synthesized
gctattgtgaatagtgcagcaa

SEQ ID NO: 828299 - DNA, 22 bp, Artificial Sequence
  chemically synthesized
tgctattgtgaatagtgcagca

SEQ ID NO: 828300 - DNA, 22 bp, Artificial Sequence
  chemically synthesized
caggtctttgctattgtgaata

SEQ ID NO: 828301 - DNA, 22 bp, Artificial Sequence
  chemically synthesized
attgctgcactattcacaatag

SEQ ID NO: 828302 - DNA, 22 bp, Artificial Sequence
  chemically synthesized
ttgctgcactattcacaatagc

SEQ ID NO: 828303 - DNA, 22 bp, Artificial Sequence
  chemically synthesized
gttccaggtctttgctattgtg

SEQ ID NO: 828304 - DNA, 22 bp, Artificial Sequence
  chemically synthesized
ctgcactattcacaatagcaaa

SEQ ID NO: 828305 - DNA, 22 bp, Artificial Sequence
  chemically synthesized
cactattcacaatagcaaagac

SEQ ID NO: 828306 - DNA, 22 bp, Artificial Sequence
  chemically synthesized
gattggttccaggtctttgcta

SEQ ID NO: 828307 - DNA, 22 bp, Artificial Sequence
  chemically synthesized
ggattggttccaggtctttgct

SEQ ID NO: 828308 - DNA, 22 bp, Artificial Sequence
  chemically synthesized
ttcacaatagcaaagacctgga

SEQ ID NO: 828309 - DNA, 22 bp, Artificial Sequence
  chemically synthesized
acaatagcaaagacctggaacc

SEQ ID NO: 828310 - DNA, 22 bp, Artificial Sequence
  chemically synthesized
atggacatttggattggttcca

SEQ ID NO: 828311 - DNA, 22 bp, Artificial Sequence
  chemically synthesized
tcattgatggacatttggattg

SEQ ID NO: 828312 - DNA, 22 bp, Artificial Sequence
  chemically synthesized
gaaccaatccaaatgtccatca

SEQ ID NO: 828313 - DNA, 22 bp, Artificial Sequence
  chemically synthesized
atccagtctatcattgatggac

SEQ ID NO: 828314 - DNA, 22 bp, Artificial Sequence
  chemically synthesized
aatccagtctatcattgatgga

SEQ ID NO: 828315 - DNA, 22 bp, Artificial Sequence
  chemically synthesized
ttaatccagtctatcattgatg

SEQ ID NO: 828316 - DNA, 22 bp, Artificial Sequence
  chemically synthesized
cttaatccagtctatcattgat

SEQ ID NO: 828317 - DNA, 22 bp, Artificial Sequence
  chemically synthesized
tcttaatccagtctatcattga

SEQ ID NO: 828318 - DNA, 22 bp, Artificial Sequence
  chemically synthesized
catggtgtatatgtgccacatt

SEQ ID NO: 828319 - DNA, 22 bp, Artificial Sequence
  chemically synthesized
gattaagaaaatgtggcacata

SEQ ID NO: 828320 - DNA, 22 bp, Artificial Sequence
  chemically synthesized
agaaaatgtggcacatatacac

SEQ ID NO: 828321 - DNA, 22 bp, Artificial Sequence
  chemically synthesized
catagtattccatggtgtatat

SEQ ID NO: 828322 - DNA, 22 bp, Artificial Sequence
  chemically synthesized
tggttgcatagtattccatggt

SEQ ID NO: 828323 - DNA, 22 bp, Artificial Sequence
  chemically synthesized
atggttgcatagtattccatgg

SEQ ID NO: 828324 - DNA, 22 bp, Artificial Sequence
  chemically synthesized
tatggttgcatagtattccatg

SEQ ID NO: 828325 - DNA, 22 bp, Artificial Sequence
  chemically synthesized
ttatggttgcatagtattccat

SEQ ID NO: 828326 - DNA, 22 bp, Artificial Sequence
  chemically synthesized
tttatggttgcatagtattcca

SEQ ID NO: 828327 - DNA, 22 bp, Artificial Sequence
  chemically synthesized
ttttatggttgcatagtattcc

SEQ ID NO: 828328 - DNA, 22 bp, Artificial Sequence
  chemically synthesized
atccttttttatggttgcatag

SEQ ID NO: 828329 - DNA, 22 bp, Artificial Sequence
  chemically synthesized
tgcaaccataaaaaaggatgag

SEQ ID NO: 828330 - DNA, 22 bp, Artificial Sequence
  chemically synthesized
caaaggatgtgaactcatcctt

SEQ ID NO: 828331 - DNA, 22 bp, Artificial Sequence
  chemically synthesized
atccatgtccctacaaaggatg

SEQ ID NO: 828332 - DNA, 22 bp, Artificial Sequence
  chemically synthesized
catccatgtccctacaaaggat

SEQ ID NO: 828333 - DNA, 22 bp, Artificial Sequence
  chemically synthesized
cagcttcatccatgtccctaca

SEQ ID NO: 828334 - DNA, 22 bp, Artificial Sequence
  chemically synthesized
ccagcttcatccatgtccctac

SEQ ID NO: 828335 - DNA, 22 bp, Artificial Sequence
  chemically synthesized
acatcctttgtagggacatgga

SEQ ID NO: 828336 - DNA, 22 bp, Artificial Sequence
  chemically synthesized
tgtagggacatggatgaagctg

SEQ ID NO: 828337 - DNA, 22 bp, Artificial Sequence
  chemically synthesized
gtagggacatggatgaagctgg

SEQ ID NO: 828338 - DNA, 22 bp, Artificial Sequence
  chemically synthesized
tagggacatggatgaagctgga

SEQ ID NO: 828339 - DNA, 22 bp, Artificial Sequence
  chemically synthesized
agaaagatgatttccagcttca

SEQ ID NO: 828340 - DNA, 22 bp, Artificial Sequence
  chemically synthesized
ctgagaaagatgatttccagct

SEQ ID NO: 828341 - DNA, 22 bp, Artificial Sequence
  chemically synthesized
gctgagaaagatgatttccagc

SEQ ID NO: 828342 - DNA, 22 bp, Artificial Sequence
  chemically synthesized
tgatagtttgctgagaaagatg

SEQ ID NO: 828343 - DNA, 22 bp, Artificial Sequence
  chemically synthesized
gtgatagtttgctgagaaagat

SEQ ID NO: 828344 - DNA, 22 bp, Artificial Sequence
  chemically synthesized
tccttgtgatagtttgctgaga

SEQ ID NO: 828345 - DNA, 22 bp, Artificial Sequence
  chemically synthesized
gaaatcatctttctcagcaaac

SEQ ID NO: 828346 - DNA, 22 bp, Artificial Sequence
  chemically synthesized
tgtccttgtgatagtttgctga

SEQ ID NO: 828347 - DNA, 22 bp, Artificial Sequence
  chemically synthesized
ctgtccttgtgatagtttgctg

SEQ ID NO: 828348 - DNA, 22 bp, Artificial Sequence
  chemically synthesized
tctgtccttgtgatagtttgct

SEQ ID NO: 828349 - DNA, 22 bp, Artificial Sequence
  chemically synthesized
gttttctgtccttgtgatagtt

SEQ ID NO: 828350 - DNA, 22 bp, Artificial Sequence
  chemically synthesized
ggttttctgtccttgtgatagt

SEQ ID NO: 828351 - DNA, 22 bp, Artificial Sequence
  chemically synthesized
tctcagcaaactatcacaagga

SEQ ID NO: 828352 - DNA, 22 bp, Artificial Sequence
  chemically synthesized
ctcagcaaactatcacaaggac

SEQ ID NO: 828353 - DNA, 22 bp, Artificial Sequence
  chemically synthesized
tcagcaaactatcacaaggaca

SEQ ID NO: 828354 - DNA, 22 bp, Artificial Sequence
  chemically synthesized
agcaaactatcacaaggacaga

SEQ ID NO: 828355 - DNA, 22 bp, Artificial Sequence
  chemically synthesized
tcacaaggacagaaaaccaaac

SEQ ID NO: 828356 - DNA, 22 bp, Artificial Sequence
  chemically synthesized
tgagtgagaacatgcggtgttt

SEQ ID NO: 828357 - DNA, 22 bp, Artificial Sequence
  chemically synthesized
ccacctatgagtgagaacatgc

SEQ ID NO: 828358 - DNA, 22 bp, Artificial Sequence
  chemically synthesized
aattcccacctatgagtgagaa

SEQ ID NO: 828359 - DNA, 22 bp, Artificial Sequence
  chemically synthesized
ttcaattcccacctatgagtga

SEQ ID NO: 828360 - DNA, 22 bp, Artificial Sequence
  chemically synthesized
attgttcaattcccacctatga

SEQ ID NO: 828361 - DNA, 22 bp, Artificial Sequence
  chemically synthesized
tcattgttcaattcccacctat

SEQ ID NO: 828362 - DNA, 22 bp, Artificial Sequence
  chemically synthesized
tcactcataggtgggaattgaa

SEQ ID NO: 828363 - DNA, 22 bp, Artificial Sequence
  chemically synthesized
actcataggtgggaattgaaca

SEQ ID NO: 828364 - DNA, 22 bp, Artificial Sequence
  chemically synthesized
ataggtgggaattgaacaatga

SEQ ID NO: 828365 - DNA, 22 bp, Artificial Sequence
  chemically synthesized
cgtccaggtgttctcattgttc

SEQ ID NO: 828366 - DNA, 22 bp, Artificial Sequence
  chemically synthesized
ctgcgtccaggtgttctcattg

SEQ ID NO: 828367 - DNA, 22 bp, Artificial Sequence
  chemically synthesized
cctgcgtccaggtgttctcatt

SEQ ID NO: 828368 - DNA, 22 bp, Artificial Sequence
  chemically synthesized
cccttcctgcgtccaggtgttc

SEQ ID NO: 828369 - DNA, 22 bp, Artificial Sequence
  chemically synthesized
aacaatgagaacacctggacgc

SEQ ID NO: 828370 - DNA, 22 bp, Artificial Sequence
  chemically synthesized
gacgcaggaaggggaacatcac

SEQ ID NO: 828371 - DNA, 22 bp, Artificial Sequence
  chemically synthesized
accccacgacaggccccggtgt

SEQ ID NO: 828372 - DNA, 22 bp, Artificial Sequence
  chemically synthesized
ccccgtcccctcaccccacgac

SEQ ID NO: 828373 - DNA, 22 bp, Artificial Sequence
  chemically synthesized
tccctcccccgtcccctcaccc

SEQ ID NO: 828374 - DNA, 22 bp, Artificial Sequence
  chemically synthesized
tcgtggggtgaggggacggggg

SEQ ID NO: 828375 - DNA, 22 bp, Artificial Sequence
  chemically synthesized
ccaatgctatccctcccccgtc

SEQ ID NO: 828376 - DNA, 22 bp, Artificial Sequence
  chemically synthesized
ggtatatctcccaatgctatcc

SEQ ID NO: 828377 - DNA, 22 bp, Artificial Sequence
  chemically synthesized
cattaggtatatctcccaatgc

SEQ ID NO: 828378 - DNA, 22 bp, Artificial Sequence
  chemically synthesized
acattaggtatatctcccaatg

SEQ ID NO: 828379 - DNA, 22 bp, Artificial Sequence
  chemically synthesized
tcatttacattaggtatatctc

SEQ ID NO: 828380 - DNA, 22 bp, Artificial Sequence
  chemically synthesized
gtcatttacattaggtatatct

SEQ ID NO: 828381 - DNA, 22 bp, Artificial Sequence
  chemically synthesized
acttgtcatttacattaggtat

SEQ ID NO: 828382 - DNA, 22 bp, Artificial Sequence
  chemically synthesized
ggagatatacctaatgtaaatg

SEQ ID NO: 828383 - DNA, 22 bp, Artificial Sequence
  chemically synthesized
cacccattaacttgtcatttac

SEQ ID NO: 828384 - DNA, 22 bp, Artificial Sequence
  chemically synthesized
gtatgctccacccattaacttg

SEQ ID NO: 828385 - DNA, 22 bp, Artificial Sequence
  chemically synthesized
atgtaaatgacaagttaatggg

SEQ ID NO: 828386 - DNA, 22 bp, Artificial Sequence
  chemically synthesized
tacatgtgccgtgttggtatgc

SEQ ID NO: 828387 - DNA, 22 bp, Artificial Sequence
  chemically synthesized
atgggtggagcataccaacacg

SEQ ID NO: 828388 - DNA, 22 bp, Artificial Sequence
  chemically synthesized
catatctatacatgtgccgtgt

SEQ ID NO: 828389 - DNA, 22 bp, Artificial Sequence
  chemically synthesized
ttacatatctatacatgtgccg

SEQ ID NO: 828390 - DNA, 22 bp, Artificial Sequence
  chemically synthesized
gttacatatctatacatgtgcc

SEQ ID NO: 828391 - DNA, 22 bp, Artificial Sequence
  chemically synthesized
caggtttgttacatatctatac

SEQ ID NO: 828392 - DNA, 22 bp, Artificial Sequence
  chemically synthesized
gcaggtttgttacatatctata

SEQ ID NO: 828393 - DNA, 22 bp, Artificial Sequence
  chemically synthesized
gggtacatgtgcacaacttgca

SEQ ID NO: 828394 - DNA, 22 bp, Artificial Sequence
  chemically synthesized
tagggtacatgtgcacaacttg

SEQ ID NO: 828395 - DNA, 22 bp, Artificial Sequence
  chemically synthesized
agttctagggtacatgtgcaca

SEQ ID NO: 828396 - DNA, 22 bp, Artificial Sequence
  chemically synthesized
aagttctagggtacatgtgcac

SEQ ID NO: 828397 - DNA, 22 bp, Artificial Sequence
  chemically synthesized
taagttctagggtacatgtgca

SEQ ID NO: 828398 - DNA, 22 bp, Artificial Sequence
  chemically synthesized
caagttgtgcacatgtacccta

SEQ ID NO: 828399 - DNA, 22 bp, Artificial Sequence
  chemically synthesized
tactttaagttctagggtacat

SEQ ID NO: 828400 - DNA, 22 bp, Artificial Sequence
  chemically synthesized
attatactttaagttctagggt

SEQ ID NO: 828401 - DNA, 22 bp, Artificial Sequence
  chemically synthesized
aattatactttaagttctaggg

SEQ ID NO: 828402 - DNA, 22 bp, Artificial Sequence
  chemically synthesized
taattatactttaagttctagg

SEQ ID NO: 828403 - DNA, 22 bp, Artificial Sequence
  chemically synthesized
tgcacatgtaccctagaactta

SEQ ID NO: 828404 - DNA, 22 bp, Artificial Sequence
  chemically synthesized
ttaattatactttaagttctag

SEQ ID NO: 828405 - DNA, 22 bp, Artificial Sequence
  chemically synthesized
tttaattatactttaagttcta

SEQ ID NO: 828406 - DNA, 22 bp, Artificial Sequence
  chemically synthesized
ttttaattatactttaagttct

SEQ ID NO: 828407 - DNA, 22 bp, Artificial Sequence
  chemically synthesized
tttttaattatactttaagttc

SEQ ID NO: 828408 - DNA, 22 bp, Artificial Sequence
  chemically synthesized
ttttttaattatactttaagtt

SEQ ID NO: 828409 - DNA, 22 bp, Artificial Sequence
  chemically synthesized
tttttttaattatactttaagt

SEQ ID NO: 828410 - DNA, 22 bp, Artificial Sequence
  chemically synthesized
ttttttttaattatactttaag

SEQ ID NO: 828411 - DNA, 22 bp, Artificial Sequence
  chemically synthesized
cttttttttttaattatacttt

SEQ ID NO: 828412 - DNA, 22 bp, Artificial Sequence
  chemically synthesized
acttttttttttaattatactt

SEQ ID NO: 828413 - DNA, 22 bp, Artificial Sequence
  chemically synthesized
gaacttaaagtataattaaaaa

SEQ ID NO: 828414 - DNA, 22 bp, Artificial Sequence
  chemically synthesized
aaagtataattaaaaaaaaaag

SEQ ID NO: 828415 - DNA, 22 bp, Artificial Sequence
  chemically synthesized
aagtataattaaaaaaaaaagt

SEQ ID NO: 828416 - DNA, 22 bp, Artificial Sequence
  chemically synthesized
acatcacaacttactttttttt

SEQ ID NO: 828417 - DNA, 22 bp, Artificial Sequence
  chemically synthesized
taacatcacaacttactttttt

SEQ ID NO: 828418 - DNA, 22 bp, Artificial Sequence
  chemically synthesized
ctaacatcacaacttacttttt

SEQ ID NO: 828419 - DNA, 22 bp, Artificial Sequence
  chemically synthesized
tgtttctaacatcacaacttac

SEQ ID NO: 828420 - DNA, 22 bp, Artificial Sequence
  chemically synthesized
atgtttctaacatcacaactta

SEQ ID NO: 828421 - DNA, 22 bp, Artificial Sequence
  chemically synthesized
tatgtttctaacatcacaactt

SEQ ID NO: 828422 - DNA, 22 bp, Artificial Sequence
  chemically synthesized
aaaaaaaaagtaagttgtgatg

SEQ ID NO: 828423 - DNA, 22 bp, Artificial Sequence
  chemically synthesized
ccacattttatgtttctaacat

SEQ ID NO: 828424 - DNA, 22 bp, Artificial Sequence
  chemically synthesized
ctcccacattttatgtttctaa

SEQ ID NO: 828425 - DNA, 22 bp, Artificial Sequence
  chemically synthesized
cctcctcccacattttatgttt

SEQ ID NO: 828426 - DNA, 22 bp, Artificial Sequence
  chemically synthesized
tccctcctcccacattttatgt

SEQ ID NO: 828427 - DNA, 22 bp, Artificial Sequence
  chemically synthesized
tgatgttagaaacataaaatgt

SEQ ID NO: 828428 - DNA, 22 bp, Artificial Sequence
  chemically synthesized
actctccctcctcccacatttt

SEQ ID NO: 828429 - DNA, 22 bp, Artificial Sequence
  chemically synthesized
gactctccctcctcccacattt

SEQ ID NO: 828430 - DNA, 22 bp, Artificial Sequence
  chemically synthesized
tgactctccctcctcccacatt

SEQ ID NO: 828431 - DNA, 22 bp, Artificial Sequence
  chemically synthesized
gaaacataaaatgtgggaggag

SEQ ID NO: 828432 - DNA, 22 bp, Artificial Sequence
  chemically synthesized
aacactttgactctccctcctc

SEQ ID NO: 828433 - DNA, 22 bp, Artificial Sequence
  chemically synthesized
tgtgcatatactcaacactttg

SEQ ID NO: 828434 - DNA, 22 bp, Artificial Sequence
  chemically synthesized
attgtgtgcatatactcaacac

SEQ ID NO: 828435 - DNA, 22 bp, Artificial Sequence
  chemically synthesized
gattgtgtgcatatactcaaca

SEQ ID NO: 828436 - DNA, 22 bp, Artificial Sequence
  chemically synthesized
aatttgattgtgtgcatatact

SEQ ID NO: 828437 - DNA, 22 bp, Artificial Sequence
  chemically synthesized
aaatttgattgtgtgcatatac

SEQ ID NO: 828438 - DNA, 22 bp, Artificial Sequence
  chemically synthesized
ataataacttaaatttgattgt

SEQ ID NO: 828439 - DNA, 22 bp, Artificial Sequence
  chemically synthesized
agtatatgcacacaatcaaatt

SEQ ID NO: 828440 - DNA, 22 bp, Artificial Sequence
  chemically synthesized
taagctgataataacttaaatt

SEQ ID NO: 828441 - DNA, 22 bp, Artificial Sequence
  chemically synthesized
ataagctgataataacttaaat

SEQ ID NO: 828442 - DNA, 22 bp, Artificial Sequence
  chemically synthesized
tataagctgataataacttaaa

SEQ ID NO: 828443 - DNA, 22 bp, Artificial Sequence
  chemically synthesized
cataaaacattttataagctga

SEQ ID NO: 828444 - DNA, 22 bp, Artificial Sequence
  chemically synthesized
acataaaacattttataagctg

SEQ ID NO: 828445 - DNA, 22 bp, Artificial Sequence
  chemically synthesized
aagttattatcagcttataaaa

SEQ ID NO: 828446 - DNA, 22 bp, Artificial Sequence
  chemically synthesized
agttattatcagcttataaaat

SEQ ID NO: 828447 - DNA, 22 bp, Artificial Sequence
  chemically synthesized
ttatcagcttataaaatgtttt

SEQ ID NO: 828448 - DNA, 22 bp, Artificial Sequence
  chemically synthesized
cgaggcttacataaaacatttt

SEQ ID NO: 828449 - DNA, 22 bp, Artificial Sequence
  chemically synthesized
tcagcttataaaatgttttatg

SEQ ID NO: 828450 - DNA, 22 bp, Artificial Sequence
  chemically synthesized
tggatactccgaggcttacata

SEQ ID NO: 828451 - DNA, 22 bp, Artificial Sequence
  chemically synthesized
ataaaatgttttatgtaagcct

SEQ ID NO: 828452 - DNA, 22 bp, Artificial Sequence
  chemically synthesized
gtggatactccgaggcttacat

SEQ ID NO: 828453 - DNA, 22 bp, Artificial Sequence
  chemically synthesized
taaaatgttttatgtaagcctc

SEQ ID NO: 828454 - DNA, 22 bp, Artificial Sequence
  chemically synthesized
tgtggatactccgaggcttaca

SEQ ID NO: 828455 - DNA, 22 bp, Artificial Sequence
  chemically synthesized
tgctttgtggatactccgaggc

SEQ ID NO: 828456 - DNA, 22 bp, Artificial Sequence
  chemically synthesized
gtgctttgtggatactccgagg

SEQ ID NO: 828457 - DNA, 22 bp, Artificial Sequence
  chemically synthesized
tatgtaagcctcggagtatcca

SEQ ID NO: 828458 - DNA, 22 bp, Artificial Sequence
  chemically synthesized
atgtaagcctcggagtatccac

SEQ ID NO: 828459 - DNA, 22 bp, Artificial Sequence
  chemically synthesized
tgtaagcctcggagtatccaca

SEQ ID NO: 828460 - DNA, 22 bp, Artificial Sequence
  chemically synthesized
taagtttgtgctttgtggatac

SEQ ID NO: 828461 - DNA, 22 bp, Artificial Sequence
  chemically synthesized
ggagtatccacaaagcacaaac

SEQ ID NO: 828462 - DNA, 22 bp, Artificial Sequence
  chemically synthesized
atgtatgtattataagtttgtg

SEQ ID NO: 828463 - DNA, 22 bp, Artificial Sequence
  chemically synthesized
tcattcatgtatgtattataag

SEQ ID NO: 828464 - DNA, 22 bp, Artificial Sequence
  chemically synthesized
atcattcatgtatgtattataa

SEQ ID NO: 828465 - DNA, 22 bp, Artificial Sequence
  chemically synthesized
tatcattcatgtatgtattata

SEQ ID NO: 828466 - DNA, 22 bp, Artificial Sequence
  chemically synthesized
ttatcattcatgtatgtattat

SEQ ID NO: 828467 - DNA, 22 bp, Artificial Sequence
  chemically synthesized
tttttatcattcatgtatgtat

SEQ ID NO: 828468 - DNA, 22 bp, Artificial Sequence
  chemically synthesized
gtttttatcattcatgtatgta

SEQ ID NO: 828469 - DNA, 22 bp, Artificial Sequence
  chemically synthesized
tgtttttatcattcatgtatgt

SEQ ID NO: 828470 - DNA, 22 bp, Artificial Sequence
  chemically synthesized
ttgtttttatcattcatgtatg

SEQ ID NO: 828471 - DNA, 22 bp, Artificial Sequence
  chemically synthesized
ataatacatacatgaatgataa

SEQ ID NO: 828472 - DNA, 22 bp, Artificial Sequence
  chemically synthesized
ggtcttttgtttttatcattca

SEQ ID NO: 828473 - DNA, 22 bp, Artificial Sequence
  chemically synthesized
taatacatacatgaatgataaa

SEQ ID NO: 828474 - DNA, 22 bp, Artificial Sequence
  chemically synthesized
gggtcttttgtttttatcattc

SEQ ID NO: 828475 - DNA, 22 bp, Artificial Sequence
  chemically synthesized
tgggtcttttgtttttatcatt

SEQ ID NO: 828476 - DNA, 22 bp, Artificial Sequence
  chemically synthesized
tgtagtagtatactttgggtct

SEQ ID NO: 828477 - DNA, 22 bp, Artificial Sequence
  chemically synthesized
gtgtagtagtatactttgggtc

SEQ ID NO: 828478 - DNA, 22 bp, Artificial Sequence
  chemically synthesized
tgtgtagtagtatactttgggt

SEQ ID NO: 828479 - DNA, 22 bp, Artificial Sequence
  chemically synthesized
atggttttgtgtagtagtatac

SEQ ID NO: 828480 - DNA, 22 bp, Artificial Sequence
  chemically synthesized
gatggttttgtgtagtagtata

SEQ ID NO: 828481 - DNA, 22 bp, Artificial Sequence
  chemically synthesized
tgatggttttgtgtagtagtat

SEQ ID NO: 828482 - DNA, 22 bp, Artificial Sequence
  chemically synthesized
tgttttgatggttttgtgtagt

SEQ ID NO: 828483 - DNA, 22 bp, Artificial Sequence
  chemically synthesized
gtgttttgatggttttgtgtag

SEQ ID NO: 828484 - DNA, 22 bp, Artificial Sequence
  chemically synthesized
tgtgttttgatggttttgtgta

SEQ ID NO: 828485 - DNA, 22 bp, Artificial Sequence
  chemically synthesized
ctttgtgttttgatggttttgt

SEQ ID NO: 828486 - DNA, 22 bp, Artificial Sequence
  chemically synthesized
cctttgtgttttgatggttttg

SEQ ID NO: 828487 - DNA, 22 bp, Artificial Sequence
  chemically synthesized
tcttcctttgtgttttgatggt

SEQ ID NO: 828488 - DNA, 22 bp, Artificial Sequence
  chemically synthesized
ctacacaaaaccatcaaaacac

SEQ ID NO: 828489 - DNA, 22 bp, Artificial Sequence
  chemically synthesized
ctgtcttcctttgtgttttgat

SEQ ID NO: 828490 - DNA, 22 bp, Artificial Sequence
  chemically synthesized
cacaaaaccatcaaaacacaaa

SEQ ID NO: 828491 - DNA, 22 bp, Artificial Sequence
  chemically synthesized
ttgctgtcttcctttgtgtttt

SEQ ID NO: 828492 - DNA, 22 bp, Artificial Sequence
  chemically synthesized
tattgctgtcttcctttgtgtt

SEQ ID NO: 828493 - DNA, 22 bp, Artificial Sequence
  chemically synthesized
ctctattgctgtcttcctttgt

SEQ ID NO: 828494 - DNA, 22 bp, Artificial Sequence
  chemically synthesized
cctctattgctgtcttcctttg

SEQ ID NO: 828495 - DNA, 22 bp, Artificial Sequence
  chemically synthesized
ttcctctattgctgtcttcctt

SEQ ID NO: 828496 - DNA, 22 bp, Artificial Sequence
  chemically synthesized
cttcctctattgctgtcttcct

SEQ ID NO: 828497 - DNA, 22 bp, Artificial Sequence
  chemically synthesized
tcttcctctattgctgtcttcc

SEQ ID NO: 828498 - DNA, 22 bp, Artificial Sequence
  chemically synthesized
ctttcttcctctattgctgtct

SEQ ID NO: 828499 - DNA, 22 bp, Artificial Sequence
  chemically synthesized
ttcctttcttcctctattgctg

SEQ ID NO: 828500 - DNA, 22 bp, Artificial Sequence
  chemically synthesized
gttcctttcttcctctattgct

SEQ ID NO: 828501 - DNA, 22 bp, Artificial Sequence
  chemically synthesized
tgttcctttcttcctctattgc

SEQ ID NO: 828502 - DNA, 22 bp, Artificial Sequence
  chemically synthesized
tttgttcctttcttcctctatt

SEQ ID NO: 828503 - DNA, 22 bp, Artificial Sequence
  chemically synthesized
cagattctttgttcctttcttc

SEQ ID NO: 828504 - DNA, 22 bp, Artificial Sequence
  chemically synthesized
acagattctttgttcctttctt

SEQ ID NO: 828505 - DNA, 22 bp, Artificial Sequence
  chemically synthesized
tcttacagattctttgttcctt

SEQ ID NO: 828506 - DNA, 22 bp, Artificial Sequence
  chemically synthesized
gttgtcttacagattctttgtt

SEQ ID NO: 828507 - DNA, 22 bp, Artificial Sequence
  chemically synthesized
ctggttgtcttacagattcttt

SEQ ID NO: 828508 - DNA, 22 bp, Artificial Sequence
  chemically synthesized
cctggttgtcttacagattctt

SEQ ID NO: 828509 - DNA, 22 bp, Artificial Sequence
  chemically synthesized
tttcctggttgtcttacagatt

SEQ ID NO: 828510 - DNA, 22 bp, Artificial Sequence
  chemically synthesized
attgtttcctggttgtcttaca

SEQ ID NO: 828511 - DNA, 22 bp, Artificial Sequence
  chemically synthesized
ttcattgtttcctggttgtctt

SEQ ID NO: 828512 - DNA, 22 bp, Artificial Sequence
  chemically synthesized
gttcattgtttcctggttgtct

SEQ ID NO: 828513 - DNA, 22 bp, Artificial Sequence
  chemically synthesized
tgttcattgtttcctggttgtc

SEQ ID NO: 828514 - DNA, 22 bp, Artificial Sequence
  chemically synthesized
taagacaaccaggaaacaatga

SEQ ID NO: 828515 - DNA, 22 bp, Artificial Sequence
  chemically synthesized
gtgtcattttgttcattgtttc

SEQ ID NO: 828516 - DNA, 22 bp, Artificial Sequence
  chemically synthesized
ctagtgtcattttgttcattgt

SEQ ID NO: 828517 - DNA, 22 bp, Artificial Sequence
  chemically synthesized
actagtgtcattttgttcattg

SEQ ID NO: 828518 - DNA, 22 bp, Artificial Sequence
  chemically synthesized
aaaataatgatggatgggtaag

SEQ ID NO: 828519 - DNA, 22 bp, Artificial Sequence
  chemically synthesized
gtaagtccttacccatccatca

SEQ ID NO: 828520 - DNA, 22 bp, Artificial Sequence
  chemically synthesized
cattcaaaataatgatggatgg

SEQ ID NO: 828521 - DNA, 22 bp, Artificial Sequence
  chemically synthesized
acattcaaaataatgatggatg

SEQ ID NO: 828522 - DNA, 22 bp, Artificial Sequence
  chemically synthesized
tttacattcaaaataatgatgg

SEQ ID NO: 828523 - DNA, 22 bp, Artificial Sequence
  chemically synthesized
atctatttacattcaaaataat

SEQ ID NO: 828524 - DNA, 22 bp, Artificial Sequence
  chemically synthesized
acccatccatcattattttgaa

SEQ ID NO: 828525 - DNA, 22 bp, Artificial Sequence
  chemically synthesized
aatctatttacattcaaaataa

SEQ ID NO: 828526 - DNA, 22 bp, Artificial Sequence
  chemically synthesized
cccatccatcattattttgaat

SEQ ID NO: 828527 - DNA, 22 bp, Artificial Sequence
  chemically synthesized
gagagtttaatctatttacatt

SEQ ID NO: 828528 - DNA, 22 bp, Artificial Sequence
  chemically synthesized
attggagagtttaatctattta

SEQ ID NO: 828529 - DNA, 22 bp, Artificial Sequence
  chemically synthesized
gattggagagtttaatctattt

SEQ ID NO: 828530 - DNA, 22 bp, Artificial Sequence
  chemically synthesized
tgattggagagtttaatctatt

SEQ ID NO: 828531 - DNA, 22 bp, Artificial Sequence
  chemically synthesized
ttttgaatgtaaatagattaaa

SEQ ID NO: 828532 - DNA, 22 bp, Artificial Sequence
  chemically synthesized
ttgattggagagtttaatctat

SEQ ID NO: 828533 - DNA, 22 bp, Artificial Sequence
  chemically synthesized
tgaatgtaaatagattaaactc

SEQ ID NO: 828534 - DNA, 22 bp, Artificial Sequence
  chemically synthesized
gaatgtaaatagattaaactct

SEQ ID NO: 828535 - DNA, 22 bp, Artificial Sequence
  chemically synthesized
aatgtaaatagattaaactctc

SEQ ID NO: 828536 - DNA, 22 bp, Artificial Sequence
  chemically synthesized
tgccttttgattggagagttta

SEQ ID NO: 828537 - DNA, 22 bp, Artificial Sequence
  chemically synthesized
tatgccttttgattggagagtt

SEQ ID NO: 828538 - DNA, 22 bp, Artificial Sequence
  chemically synthesized
aaccactctatgccttttgatt

SEQ ID NO: 828539 - DNA, 22 bp, Artificial Sequence
  chemically synthesized
aactctccaatcaaaaggcata

SEQ ID NO: 828540 - DNA, 22 bp, Artificial Sequence
  chemically synthesized
atccactcaaccactctatgcc

SEQ ID NO: 828541 - DNA, 22 bp, Artificial Sequence
  chemically synthesized
tccaatcaaaaggcatagagtg

SEQ ID NO: 828542 - DNA, 22 bp, Artificial Sequence
  chemically synthesized
caatcaaaaggcatagagtggt

SEQ ID NO: 828543 - DNA, 22 bp, Artificial Sequence
  chemically synthesized
tcgttaatccactcaaccactc

SEQ ID NO: 828544 - DNA, 22 bp, Artificial Sequence
  chemically synthesized
ttgtcgttaatccactcaacca

SEQ ID NO: 828545 - DNA, 22 bp, Artificial Sequence
  chemically synthesized
ttgttgtcgttaatccactcaa

SEQ ID NO: 828546 - DNA, 22 bp, Artificial Sequence
  chemically synthesized
gttgttgtcgttaatccactca

SEQ ID NO: 828547 - DNA, 22 bp, Artificial Sequence
  chemically synthesized
tgttgttgtcgttaatccactc

SEQ ID NO: 828548 - DNA, 22 bp, Artificial Sequence
  chemically synthesized
ttgttgttgtcgttaatccact

SEQ ID NO: 828549 - DNA, 22 bp, Artificial Sequence
  chemically synthesized
tttgttgttgtcgttaatccac

SEQ ID NO: 828550 - DNA, 22 bp, Artificial Sequence
  chemically synthesized
ttttttgttgttgtcgttaatc

SEQ ID NO: 828551 - DNA, 22 bp, Artificial Sequence
  chemically synthesized
gttttttgttgttgtcgttaat

SEQ ID NO: 828552 - DNA, 22 bp, Artificial Sequence
  chemically synthesized
ggtcttgttttttgttgttgtc

SEQ ID NO: 828553 - DNA, 22 bp, Artificial Sequence
  chemically synthesized
agtggattaacgacaacaacaa

SEQ ID NO: 828554 - DNA, 22 bp, Artificial Sequence
  chemically synthesized
gggtcttgttttttgttgttgt

SEQ ID NO: 828555 - DNA, 22 bp, Artificial Sequence
  chemically synthesized
acgacaacaacaaaaaacaaga

SEQ ID NO: 828556 - DNA, 22 bp, Artificial Sequence
  chemically synthesized
taggcagcacatatttgggtct

SEQ ID NO: 828557 - DNA, 22 bp, Artificial Sequence
  chemically synthesized
gtaggcagcacatatttgggtc

SEQ ID NO: 828558 - DNA, 22 bp, Artificial Sequence
  chemically synthesized
aggtgaaatgagccacttgtag

SEQ ID NO: 828559 - DNA, 22 bp, Artificial Sequence
  chemically synthesized
aaggtgaaatgagccacttgta

SEQ ID NO: 828560 - DNA, 22 bp, Artificial Sequence
  chemically synthesized
taaggtgaaatgagccacttgt

SEQ ID NO: 828561 - DNA, 22 bp, Artificial Sequence
  chemically synthesized
cctacaagtggctcatttcacc

SEQ ID NO: 828562 - DNA, 22 bp, Artificial Sequence
  chemically synthesized
tgcatgtcctttaaggtgaaat

SEQ ID NO: 828563 - DNA, 22 bp, Artificial Sequence
  chemically synthesized
caagtggctcatttcaccttaa

SEQ ID NO: 828564 - DNA, 22 bp, Artificial Sequence
  chemically synthesized
agtctatgcatgtcctttaagg

SEQ ID NO: 828565 - DNA, 22 bp, Artificial Sequence
  chemically synthesized
cagtctatgcatgtcctttaag

SEQ ID NO: 828566 - DNA, 22 bp, Artificial Sequence
  chemically synthesized
tcagtctatgcatgtcctttaa

SEQ ID NO: 828567 - DNA, 22 bp, Artificial Sequence
  chemically synthesized
ctttcagtctatgcatgtcctt

SEQ ID NO: 828568 - DNA, 22 bp, Artificial Sequence
  chemically synthesized
atttcaccttaaaggacatgca

SEQ ID NO: 828569 - DNA, 22 bp, Artificial Sequence
  chemically synthesized
actttcagtctatgcatgtcct

SEQ ID NO: 828570 - DNA, 22 bp, Artificial Sequence
  chemically synthesized
tactttcagtctatgcatgtcc

SEQ ID NO: 828571 - DNA, 22 bp, Artificial Sequence
  chemically synthesized
caccttaaaggacatgcataga

SEQ ID NO: 828572 - DNA, 22 bp, Artificial Sequence
  chemically synthesized
accttaaaggacatgcatagac

SEQ ID NO: 828573 - DNA, 22 bp, Artificial Sequence
  chemically synthesized
atccctttactttcagtctatg

SEQ ID NO: 828574 - DNA, 22 bp, Artificial Sequence
  chemically synthesized
catccctttactttcagtctat

SEQ ID NO: 828575 - DNA, 22 bp, Artificial Sequence
  chemically synthesized
aaaggacatgcatagactgaaa

SEQ ID NO: 828576 - DNA, 22 bp, Artificial Sequence
  chemically synthesized
tcatccctttactttcagtcta

SEQ ID NO: 828577 - DNA, 22 bp, Artificial Sequence
  chemically synthesized
aaggacatgcatagactgaaag

SEQ ID NO: 828578 - DNA, 22 bp, Artificial Sequence
  chemically synthesized
ttcatccctttactttcagtct

SEQ ID NO: 828579 - DNA, 22 bp, Artificial Sequence
  chemically synthesized
tttcatccctttactttcagtc

SEQ ID NO: 828580 - DNA, 22 bp, Artificial Sequence
  chemically synthesized
ttttcatccctttactttcagt

SEQ ID NO: 828581 - DNA, 22 bp, Artificial Sequence
  chemically synthesized
aaagtaaagggatgaaaaaaga

SEQ ID NO: 828582 - DNA, 22 bp, Artificial Sequence
  chemically synthesized
atgtacatggagtatctttttt

SEQ ID NO: 828583 - DNA, 22 bp, Artificial Sequence
  chemically synthesized
tcatgtacatggagtatctttt

SEQ ID NO: 828584 - DNA, 22 bp, Artificial Sequence
  chemically synthesized
ttctcatgtacatggagtatct

SEQ ID NO: 828585 - DNA, 22 bp, Artificial Sequence
  chemically synthesized
gttctcatgtacatggagtatc

SEQ ID NO: 828586 - DNA, 22 bp, Artificial Sequence
  chemically synthesized
tgttctcatgtacatggagtat

SEQ ID NO: 828587 - DNA, 22 bp, Artificial Sequence
  chemically synthesized
ttgttctcatgtacatggagta

SEQ ID NO: 828588 - DNA, 22 bp, Artificial Sequence
  chemically synthesized
tttgttctcatgtacatggagt

SEQ ID NO: 828589 - DNA, 22 bp, Artificial Sequence
  chemically synthesized
tttttgttctcatgtacatgga

SEQ ID NO: 828590 - DNA, 22 bp, Artificial Sequence
  chemically synthesized
tctttttgttctcatgtacatg

SEQ ID NO: 828591 - DNA, 22 bp, Artificial Sequence
  chemically synthesized
ctctctttttgttctcatgtac

SEQ ID NO: 828592 - DNA, 22 bp, Artificial Sequence
  chemically synthesized
ccctgctctctttttgttctca

SEQ ID NO: 828593 - DNA, 22 bp, Artificial Sequence
  chemically synthesized
catgtacatgagaacaaaaaga

SEQ ID NO: 828594 - DNA, 22 bp, Artificial Sequence
  chemically synthesized
aagtaagtgtaactaccctgct

SEQ ID NO: 828595 - DNA, 22 bp, Artificial Sequence
  chemically synthesized
tctgaagtaagtgtaactaccc

SEQ ID NO: 828596 - DNA, 22 bp, Artificial Sequence
  chemically synthesized
gtctgaagtaagtgtaactacc

SEQ ID NO: 828597 - DNA, 22 bp, Artificial Sequence
  chemically synthesized
tgtctgaagtaagtgtaactac

SEQ ID NO: 828598 - DNA, 22 bp, Artificial Sequence
  chemically synthesized
ttttgtctgaagtaagtgtaac

SEQ ID NO: 828599 - DNA, 22 bp, Artificial Sequence
  chemically synthesized
aagattattttgtctgaagtaa

SEQ ID NO: 828600 - DNA, 22 bp, Artificial Sequence
  chemically synthesized
acctaaagattattttgtctga

SEQ ID NO: 828601 - DNA, 22 bp, Artificial Sequence
  chemically synthesized
gacctaaagattattttgtctg

SEQ ID NO: 828602 - DNA, 22 bp, Artificial Sequence
  chemically synthesized
cacttacttcagacaaaataat

SEQ ID NO: 828603 - DNA, 22 bp, Artificial Sequence
  chemically synthesized
acttcagacaaaataatcttta

SEQ ID NO: 828604 - DNA, 22 bp, Artificial Sequence
  chemically synthesized
cttcagacaaaataatctttag

SEQ ID NO: 828605 - DNA, 22 bp, Artificial Sequence
  chemically synthesized
aacagatttgacctaaagatta

SEQ ID NO: 828606 - DNA, 22 bp, Artificial Sequence
  chemically synthesized
gaacagatttgacctaaagatt

SEQ ID NO: 828607 - DNA, 22 bp, Artificial Sequence
  chemically synthesized
tgaacagatttgacctaaagat

SEQ ID NO: 828608 - DNA, 22 bp, Artificial Sequence
  chemically synthesized
cagacaaaataatctttaggtc

SEQ ID NO: 828609 - DNA, 22 bp, Artificial Sequence
  chemically synthesized
agacaaaataatctttaggtca

SEQ ID NO: 828610 - DNA, 22 bp, Artificial Sequence
  chemically synthesized
tcactttgaacagatttgacct

SEQ ID NO: 828611 - DNA, 22 bp, Artificial Sequence
  chemically synthesized
gtcactttgaacagatttgacc

SEQ ID NO: 828612 - DNA, 22 bp, Artificial Sequence
  chemically synthesized
tgtcactttgaacagatttgac

SEQ ID NO: 828613 - DNA, 22 bp, Artificial Sequence
  chemically synthesized
tttgtcactttgaacagatttg

SEQ ID NO: 828614 - DNA, 22 bp, Artificial Sequence
  chemically synthesized
taggtcaaatctgttcaaagtg

SEQ ID NO: 828615 - DNA, 22 bp, Artificial Sequence
  chemically synthesized
aggtcaaatctgttcaaagtga

SEQ ID NO: 828616 - DNA, 22 bp, Artificial Sequence
  chemically synthesized
ggtcaaatctgttcaaagtgac

SEQ ID NO: 828617 - DNA, 22 bp, Artificial Sequence
  chemically synthesized
tcaatatataatgatgttcttt

SEQ ID NO: 828618 - DNA, 22 bp, Artificial Sequence
  chemically synthesized
ttcaaagtgacaaagaacatca

SEQ ID NO: 828619 - DNA, 22 bp, Artificial Sequence
  chemically synthesized
atcaatatataatgatgttctt

SEQ ID NO: 828620 - DNA, 22 bp, Artificial Sequence
  chemically synthesized
tatcaatatataatgatgttct

SEQ ID NO: 828621 - DNA, 22 bp, Artificial Sequence
  chemically synthesized
aaagtgacaaagaacatcatta

SEQ ID NO: 828622 - DNA, 22 bp, Artificial Sequence
  chemically synthesized
atgaaataacctttatcaatat

SEQ ID NO: 828623 - DNA, 22 bp, Artificial Sequence
  chemically synthesized
gatgaaataacctttatcaata

SEQ ID NO: 828624 - DNA, 22 bp, Artificial Sequence
  chemically synthesized
ttgatgaaataacctttatcaa

SEQ ID NO: 828625 - DNA, 22 bp, Artificial Sequence
  chemically synthesized
tgtcctcttgatgaaataacct

SEQ ID NO: 828626 - DNA, 22 bp, Artificial Sequence
  chemically synthesized
tatattgataaaggttatttca

SEQ ID NO: 828627 - DNA, 22 bp, Artificial Sequence
  chemically synthesized
ttatgtcctcttgatgaaataa

SEQ ID NO: 828628 - DNA, 22 bp, Artificial Sequence
  chemically synthesized
gttatgtcctcttgatgaaata

SEQ ID NO: 828629 - DNA, 22 bp, Artificial Sequence
  chemically synthesized
ataaaggttatttcatcaagag

SEQ ID NO: 828630 - DNA, 22 bp, Artificial Sequence
  chemically synthesized
tatacttgttatgtcctcttga

SEQ ID NO: 828631 - DNA, 22 bp, Artificial Sequence
  chemically synthesized
atatacttgttatgtcctcttg

SEQ ID NO: 828632 - DNA, 22 bp, Artificial Sequence
  chemically synthesized
tttcatcaagaggacataacaa

SEQ ID NO: 828633 - DNA, 22 bp, Artificial Sequence
  chemically synthesized
ggatgcttatatacttgttatg

SEQ ID NO: 828634 - DNA, 22 bp, Artificial Sequence
  chemically synthesized
catcaagaggacataacaagta

SEQ ID NO: 828635 - DNA, 22 bp, Artificial Sequence
  chemically synthesized
gggatgcttatatacttgttat

SEQ ID NO: 828636 - DNA, 22 bp, Artificial Sequence
  chemically synthesized
atcaagaggacataacaagtat

SEQ ID NO: 828637 - DNA, 22 bp, Artificial Sequence
  chemically synthesized
atttgggatgcttatatacttg

SEQ ID NO: 828638 - DNA, 22 bp, Artificial Sequence
  chemically synthesized
tgatttgggatgcttatatact

SEQ ID NO: 828639 - DNA, 22 bp, Artificial Sequence
  chemically synthesized
ggtgctctgatttgggatgctt

SEQ ID NO: 828640 - DNA, 22 bp, Artificial Sequence
  chemically synthesized
aggtgctctgatttgggatgct

SEQ ID NO: 828641 - DNA, 22 bp, Artificial Sequence
  chemically synthesized
tatatttaggtgctctgatttg

SEQ ID NO: 828642 - DNA, 22 bp, Artificial Sequence
  chemically synthesized
atatatttaggtgctctgattt

SEQ ID NO: 828643 - DNA, 22 bp, Artificial Sequence
  chemically synthesized
tatatatttaggtgctctgatt

SEQ ID NO: 828644 - DNA, 22 bp, Artificial Sequence
  chemically synthesized
ctttatatatttaggtgctctg

SEQ ID NO: 828645 - DNA, 22 bp, Artificial Sequence
  chemically synthesized
gctttatatatttaggtgctct

SEQ ID NO: 828646 - DNA, 22 bp, Artificial Sequence
  chemically synthesized
atgtttgctttatatatttagg

SEQ ID NO: 828647 - DNA, 22 bp, Artificial Sequence
  chemically synthesized
aatgtttgctttatatatttag

SEQ ID NO: 828648 - DNA, 22 bp, Artificial Sequence
  chemically synthesized
agatcccttaatgtttgcttta

SEQ ID NO: 828649 - DNA, 22 bp, Artificial Sequence
  chemically synthesized
cagatcccttaatgtttgcttt

SEQ ID NO: 828650 - DNA, 22 bp, Artificial Sequence
  chemically synthesized
ccttcagatcccttaatgtttg

SEQ ID NO: 828651 - DNA, 22 bp, Artificial Sequence
  chemically synthesized
aatatataaagcaaacattaag

SEQ ID NO: 828652 - DNA, 22 bp, Artificial Sequence
  chemically synthesized
cccttcagatcccttaatgttt

SEQ ID NO: 828653 - DNA, 22 bp, Artificial Sequence
  chemically synthesized
tgtttcccttcagatcccttaa

SEQ ID NO: 828654 - DNA, 22 bp, Artificial Sequence
  chemically synthesized
taggctatgtttcccttcagat

SEQ ID NO: 828655 - DNA, 22 bp, Artificial Sequence
  chemically synthesized
tgttataggctatgtttccctt

SEQ ID NO: 828656 - DNA, 22 bp, Artificial Sequence
  chemically synthesized
agggatctgaagggaaacatag

SEQ ID NO: 828657 - DNA, 22 bp, Artificial Sequence
  chemically synthesized
ttatgttataggctatgtttcc

SEQ ID NO: 828658 - DNA, 22 bp, Artificial Sequence
  chemically synthesized
ttattatgttataggctatgtt

SEQ ID NO: 828659 - DNA, 22 bp, Artificial Sequence
  chemically synthesized
ctattattatgttataggctat

SEQ ID NO: 828660 - DNA, 22 bp, Artificial Sequence
  chemically synthesized
aagggaaacatagcctataaca

SEQ ID NO: 828661 - DNA, 22 bp, Artificial Sequence
  chemically synthesized
cctgctattattatgttatagg

SEQ ID NO: 828662 - DNA, 22 bp, Artificial Sequence
  chemically synthesized
aaattgcctgctattattatgt

SEQ ID NO: 828663 - DNA, 22 bp, Artificial Sequence
  chemically synthesized
taacataataatagcaggcaat

SEQ ID NO: 828664 - DNA, 22 bp, Artificial Sequence
  chemically synthesized
aagtggaatattgaaattgcct

SEQ ID NO: 828665 - DNA, 22 bp, Artificial Sequence
  chemically synthesized
aaagtggaatattgaaattgcc

SEQ ID NO: 828666 - DNA, 22 bp, Artificial Sequence
  chemically synthesized
cttaaagtggaatattgaaatt

SEQ ID NO: 828667 - DNA, 22 bp, Artificial Sequence
  chemically synthesized
ttgcttaaagtggaatattgaa

SEQ ID NO: 828668 - DNA, 22 bp, Artificial Sequence
  chemically synthesized
tctattgcttaaagtggaatat

SEQ ID NO: 828669 - DNA, 22 bp, Artificial Sequence
  chemically synthesized
tgtctattgcttaaagtggaat

SEQ ID NO: 828670 - DNA, 22 bp, Artificial Sequence
  chemically synthesized
ctgtctattgcttaaagtggaa

SEQ ID NO: 828671 - DNA, 22 bp, Artificial Sequence
  chemically synthesized
tctgtctattgcttaaagtgga

SEQ ID NO: 828672 - DNA, 22 bp, Artificial Sequence
  chemically synthesized
ttctgtctattgcttaaagtgg

SEQ ID NO: 828673 - DNA, 22 bp, Artificial Sequence
  chemically synthesized
caatattccactttaagcaata

SEQ ID NO: 828674 - DNA, 22 bp, Artificial Sequence
  chemically synthesized
aatattccactttaagcaatag

SEQ ID NO: 828675 - DNA, 22 bp, Artificial Sequence
  chemically synthesized
tgaatttttctgtctattgctt

SEQ ID NO: 828676 - DNA, 22 bp, Artificial Sequence
  chemically synthesized
atgaatttttctgtctattgct

SEQ ID NO: 828677 - DNA, 22 bp, Artificial Sequence
  chemically synthesized
ttatgaatttttctgtctattg

SEQ ID NO: 828678 - DNA, 22 bp, Artificial Sequence
  chemically synthesized
cttatgaatttttctgtctatt

SEQ ID NO: 828679 - DNA, 22 bp, Artificial Sequence
  chemically synthesized
tcttatgaatttttctgtctat

SEQ ID NO: 828680 - DNA, 22 bp, Artificial Sequence
  chemically synthesized
cactttaagcaatagacagaaa

SEQ ID NO: 828681 - DNA, 22 bp, Artificial Sequence
  chemically synthesized
taagcaatagacagaaaaattc

SEQ ID NO: 828682 - DNA, 22 bp, Artificial Sequence
  chemically synthesized
aagcaatagacagaaaaattca

SEQ ID NO: 828683 - DNA, 22 bp, Artificial Sequence
  chemically synthesized
agcaatagacagaaaaattcat

SEQ ID NO: 828684 - DNA, 22 bp, Artificial Sequence
  chemically synthesized
aagtccaatgttttcttatgaa

SEQ ID NO: 828685 - DNA, 22 bp, Artificial Sequence
  chemically synthesized
aaatgtcattcaagtccaatgt

SEQ ID NO: 828686 - DNA, 22 bp, Artificial Sequence
  chemically synthesized
ataagaaaacattggacttgaa

SEQ ID NO: 828687 - DNA, 22 bp, Artificial Sequence
  chemically synthesized
gtctaaaatgtcattcaagtcc

SEQ ID NO: 828688 - DNA, 22 bp, Artificial Sequence
  chemically synthesized
ggtctaaaatgtcattcaagtc

SEQ ID NO: 828689 - DNA, 22 bp, Artificial Sequence
  chemically synthesized
ggtccatttggtctaaaatgtc

SEQ ID NO: 828690 - DNA, 22 bp, Artificial Sequence
  chemically synthesized
gacttgaatgacattttagacc

SEQ ID NO: 828691 - DNA, 22 bp, Artificial Sequence
  chemically synthesized
ttaggtccatttggtctaaaat

SEQ ID NO: 828692 - DNA, 22 bp, Artificial Sequence
  chemically synthesized
gaatgacattttagaccaaatg

SEQ ID NO: 828693 - DNA, 22 bp, Artificial Sequence
  chemically synthesized
aatgacattttagaccaaatgg

SEQ ID NO: 828694 - DNA, 22 bp, Artificial Sequence
  chemically synthesized
tatatgtctgttaggtccattt

SEQ ID NO: 828695 - DNA, 22 bp, Artificial Sequence
  chemically synthesized
tgtatatgtctgttaggtccat

SEQ ID NO: 828696 - DNA, 22 bp, Artificial Sequence
  chemically synthesized
tagaccaaatggacctaacaga

SEQ ID NO: 828697 - DNA, 22 bp, Artificial Sequence
  chemically synthesized
agaccaaatggacctaacagac

SEQ ID NO: 828698 - DNA, 22 bp, Artificial Sequence
  chemically synthesized
gaccaaatggacctaacagaca

SEQ ID NO: 828699 - DNA, 22 bp, Artificial Sequence
  chemically synthesized
agggcacaatgttctgtatatg

SEQ ID NO: 828700 - DNA, 22 bp, Artificial Sequence
  chemically synthesized
ttcagggcacaatgttctgtat

SEQ ID NO: 828701 - DNA, 22 bp, Artificial Sequence
  chemically synthesized
ctgttcagggcacaatgttctg

SEQ ID NO: 828702 - DNA, 22 bp, Artificial Sequence
  chemically synthesized
acagacatatacagaacattgt

SEQ ID NO: 828703 - DNA, 22 bp, Artificial Sequence
  chemically synthesized
ctactgttcagggcacaatgtt

SEQ ID NO: 828704 - DNA, 22 bp, Artificial Sequence
  chemically synthesized
cctactgttcagggcacaatgt

SEQ ID NO: 828705 - DNA, 22 bp, Artificial Sequence
  chemically synthesized
tcctactgttcagggcacaatg

SEQ ID NO: 828706 - DNA, 22 bp, Artificial Sequence
  chemically synthesized
tattttcctactgttcagggca

SEQ ID NO: 828707 - DNA, 22 bp, Artificial Sequence
  chemically synthesized
agaagaatctgtattttcctac

SEQ ID NO: 828708 - DNA, 22 bp, Artificial Sequence
  chemically synthesized
tgccctgaacagtaggaaaata

SEQ ID NO: 828709 - DNA, 22 bp, Artificial Sequence
  chemically synthesized
gagaagaatctgtattttccta

SEQ ID NO: 828710 - DNA, 22 bp, Artificial Sequence
  chemically synthesized
aacagtaggaaaatacagattc

SEQ ID NO: 828711 - DNA, 22 bp, Artificial Sequence
  chemically synthesized
catgtgtacttgagaagaatct

SEQ ID NO: 828712 - DNA, 22 bp, Artificial Sequence
  chemically synthesized
gagaatgttacatgtgtacttg

SEQ ID NO: 828713 - DNA, 22 bp, Artificial Sequence
  chemically synthesized
tcctggagaatgttacatgtgt

SEQ ID NO: 828714 - DNA, 22 bp, Artificial Sequence
  chemically synthesized
ttctcaagtacacatgtaacat

SEQ ID NO: 828715 - DNA, 22 bp, Artificial Sequence
  chemically synthesized
ctcaagtacacatgtaacattc

SEQ ID NO: 828716 - DNA, 22 bp, Artificial Sequence
  chemically synthesized
tcaagtacacatgtaacattct

SEQ ID NO: 828717 - DNA, 22 bp, Artificial Sequence
  chemically synthesized
aagtacacatgtaacattctcc

SEQ ID NO: 828718 - DNA, 22 bp, Artificial Sequence
  chemically synthesized
acatatgatctatcctggagaa

SEQ ID NO: 828719 - DNA, 22 bp, Artificial Sequence
  chemically synthesized
tggcctaacatatgatctatcc

SEQ ID NO: 828720 - DNA, 22 bp, Artificial Sequence
  chemically synthesized
tctgtggcctaacatatgatct

SEQ ID NO: 828721 - DNA, 22 bp, Artificial Sequence
  chemically synthesized
gtctgtggcctaacatatgatc

SEQ ID NO: 828722 - DNA, 22 bp, Artificial Sequence
  chemically synthesized
tccaggatagatcatatgttag

SEQ ID NO: 828723 - DNA, 22 bp, Artificial Sequence
  chemically synthesized
caggatagatcatatgttaggc

SEQ ID NO: 828724 - DNA, 22 bp, Artificial Sequence
  chemically synthesized
agacttgtctgtggcctaacat

SEQ ID NO: 828725 - DNA, 22 bp, Artificial Sequence
  chemically synthesized
ttgagacttgtctgtggcctaa

SEQ ID NO: 828726 - DNA, 22 bp, Artificial Sequence
  chemically synthesized
gttgagacttgtctgtggccta

SEQ ID NO: 828727 - DNA, 22 bp, Artificial Sequence
  chemically synthesized
aatttgttgagacttgtctgtg

SEQ ID NO: 828728 - DNA, 22 bp, Artificial Sequence
  chemically synthesized
aaatttgttgagacttgtctgt

SEQ ID NO: 828729 - DNA, 22 bp, Artificial Sequence
  chemically synthesized
ttaaatttgttgagacttgtct

SEQ ID NO: 828730 - DNA, 22 bp, Artificial Sequence
  chemically synthesized
cttaaatttgttgagacttgtc

SEQ ID NO: 828731 - DNA, 22 bp, Artificial Sequence
  chemically synthesized
tcttaaatttgttgagacttgt

SEQ ID NO: 828732 - DNA, 22 bp, Artificial Sequence
  chemically synthesized
ggccacagacaagtctcaacaa

SEQ ID NO: 828733 - DNA, 22 bp, Artificial Sequence
  chemically synthesized
aacaaatttaagaaaacccatc

SEQ ID NO: 828734 - DNA, 22 bp, Artificial Sequence
  chemically synthesized
tggtcagaaaagatacacgatg

SEQ ID NO: 828735 - DNA, 22 bp, Artificial Sequence
  chemically synthesized
aagaaaacccatcgtgtatctt

SEQ ID NO: 828736 - DNA, 22 bp, Artificial Sequence
  chemically synthesized
agaaaacccatcgtgtatcttt

SEQ ID NO: 828737 - DNA, 22 bp, Artificial Sequence
  chemically synthesized
tattgtggtcagaaaagataca

SEQ ID NO: 828738 - DNA, 22 bp, Artificial Sequence
  chemically synthesized
atattgtggtcagaaaagatac

SEQ ID NO: 828739 - DNA, 22 bp, Artificial Sequence
  chemically synthesized
tatattgtggtcagaaaagata

SEQ ID NO: 828740 - DNA, 22 bp, Artificial Sequence
  chemically synthesized
attttatattgtggtcagaaaa

SEQ ID NO: 828741 - DNA, 22 bp, Artificial Sequence
  chemically synthesized
taattttatattgtggtcagaa

SEQ ID NO: 828742 - DNA, 22 bp, Artificial Sequence
  chemically synthesized
ctaattttatattgtggtcaga

SEQ ID NO: 828743 - DNA, 22 bp, Artificial Sequence
  chemically synthesized
atttctaattttatattgtggt

SEQ ID NO: 828744 - DNA, 22 bp, Artificial Sequence
  chemically synthesized
ttctgaccacaatataaaatta

SEQ ID NO: 828745 - DNA, 22 bp, Artificial Sequence
  chemically synthesized
tctgaccacaatataaaattag

SEQ ID NO: 828746 - DNA, 22 bp, Artificial Sequence
  chemically synthesized
ctgaccacaatataaaattaga

SEQ ID NO: 828747 - DNA, 22 bp, Artificial Sequence
  chemically synthesized
atgtaattgatttctaatttta

SEQ ID NO: 828748 - DNA, 22 bp, Artificial Sequence
  chemically synthesized
tgaccacaatataaaattagaa

SEQ ID NO: 828749 - DNA, 22 bp, Artificial Sequence
  chemically synthesized
tcatgtaattgatttctaattt

SEQ ID NO: 828750 - DNA, 22 bp, Artificial Sequence
  chemically synthesized
accacaatataaaattagaaat

SEQ ID NO: 828751 - DNA, 22 bp, Artificial Sequence
  chemically synthesized
ctcatgtaattgatttctaatt

SEQ ID NO: 828752 - DNA, 22 bp, Artificial Sequence
  chemically synthesized
tatgatttctcatgtaattgat

SEQ ID NO: 828753 - DNA, 22 bp, Artificial Sequence
  chemically synthesized
atatgatttctcatgtaattga

SEQ ID NO: 828754 - DNA, 22 bp, Artificial Sequence
  chemically synthesized
tatatgatttctcatgtaattg

SEQ ID NO: 828755 - DNA, 22 bp, Artificial Sequence
  chemically synthesized
attttatatgatttctcatgta

SEQ ID NO: 828756 - DNA, 22 bp, Artificial Sequence
  chemically synthesized
aattttatatgatttctcatgt

SEQ ID NO: 828757 - DNA, 22 bp, Artificial Sequence
  chemically synthesized
gaaatcaattacatgagaaatc

SEQ ID NO: 828758 - DNA, 22 bp, Artificial Sequence
  chemically synthesized
ttaattttatatgatttctcat

SEQ ID NO: 828759 - DNA, 22 bp, Artificial Sequence
  chemically synthesized
cttaattttatatgatttctca

SEQ ID NO: 828760 - DNA, 22 bp, Artificial Sequence
  chemically synthesized
cacatatttcttaattttatat

SEQ ID NO: 828761 - DNA, 22 bp, Artificial Sequence
  chemically synthesized
catgagaaatcatataaaatta

SEQ ID NO: 828762 - DNA, 22 bp, Artificial Sequence
  chemically synthesized
ccacatatttcttaattttata

SEQ ID NO: 828763 - DNA, 22 bp, Artificial Sequence
  chemically synthesized
gtttccacatatttcttaattt

SEQ ID NO: 828764 - DNA, 22 bp, Artificial Sequence
  chemically synthesized
agtttccacatatttcttaatt

SEQ ID NO: 828765 - DNA, 22 bp, Artificial Sequence
  chemically synthesized
tttagtttccacatatttctta

SEQ ID NO: 828766 - DNA, 22 bp, Artificial Sequence
  chemically synthesized
ggagcatattgtttagtttcca

SEQ ID NO: 828767 - DNA, 22 bp, Artificial Sequence
  chemically synthesized
aggagcatattgtttagtttcc

SEQ ID NO: 828768 - DNA, 22 bp, Artificial Sequence
  chemically synthesized
agaaatatgtggaaactaaaca

SEQ ID NO: 828769 - DNA, 22 bp, Artificial Sequence
  chemically synthesized
tttaggagcatattgtttagtt

SEQ ID NO: 828770 - DNA, 22 bp, Artificial Sequence
  chemically synthesized
acccaataattgtttaggagca

SEQ ID NO: 828771 - DNA, 22 bp, Artificial Sequence
  chemically synthesized
gacccaataattgtttaggagc

SEQ ID NO: 828772 - DNA, 22 bp, Artificial Sequence
  chemically synthesized
tgacccaataattgtttaggag

SEQ ID NO: 828773 - DNA, 22 bp, Artificial Sequence
  chemically synthesized
ttgacccaataattgtttagga

SEQ ID NO: 828774 - DNA, 22 bp, Artificial Sequence
  chemically synthesized
aacaatatgctcctaaacaatt

SEQ ID NO: 828775 - DNA, 22 bp, Artificial Sequence
  chemically synthesized
ttttgacccaataattgtttag

SEQ ID NO: 828776 - DNA, 22 bp, Artificial Sequence
  chemically synthesized
cttttgacccaataattgttta

SEQ ID NO: 828777 - DNA, 22 bp, Artificial Sequence
  chemically synthesized
ttcttttgacccaataattgtt

SEQ ID NO: 828778 - DNA, 22 bp, Artificial Sequence
  chemically synthesized
cttcttttgacccaataattgt

SEQ ID NO: 828779 - DNA, 22 bp, Artificial Sequence
  chemically synthesized
aatttcttcttttgacccaata

SEQ ID NO: 828780 - DNA, 22 bp, Artificial Sequence
  chemically synthesized
gaatttcttcttttgacccaat

SEQ ID NO: 828781 - DNA, 22 bp, Artificial Sequence
  chemically synthesized
ctaaacaattattgggtcaaaa

SEQ ID NO: 828782 - DNA, 22 bp, Artificial Sequence
  chemically synthesized
ttgaatttcttcttttgaccca

SEQ ID NO: 828783 - DNA, 22 bp, Artificial Sequence
  chemically synthesized
aacaattattgggtcaaaagaa

SEQ ID NO: 828784 - DNA, 22 bp, Artificial Sequence
  chemically synthesized
ctcttgaatttcttcttttgac

SEQ ID NO: 828785 - DNA, 22 bp, Artificial Sequence
  chemically synthesized
cctcttgaatttcttcttttga

SEQ ID NO: 828786 - DNA, 22 bp, Artificial Sequence
  chemically synthesized
ttgggtcaaaagaagaaattca

SEQ ID NO: 828787 - DNA, 22 bp, Artificial Sequence
  chemically synthesized
aaaaatttcctcttgaatttct

SEQ ID NO: 828788 - DNA, 22 bp, Artificial Sequence
  chemically synthesized
aaaaaatttcctcttgaatttc

SEQ ID NO: 828789 - DNA, 22 bp, Artificial Sequence
  chemically synthesized
ggtcaaaagaagaaattcaaga

SEQ ID NO: 828790 - DNA, 22 bp, Artificial Sequence
  chemically synthesized
taaaaaatttcctcttgaattt

SEQ ID NO: 828791 - DNA, 22 bp, Artificial Sequence
  chemically synthesized
ttaaaaaatttcctcttgaatt

SEQ ID NO: 828792 - DNA, 22 bp, Artificial Sequence
  chemically synthesized
aagacttttaaaaaatttcctc

SEQ ID NO: 828793 - DNA, 22 bp, Artificial Sequence
  chemically synthesized
tctcaagacttttaaaaaattt

SEQ ID NO: 828794 - DNA, 22 bp, Artificial Sequence
  chemically synthesized
gtctcaagacttttaaaaaatt

SEQ ID NO: 828795 - DNA, 22 bp, Artificial Sequence
  chemically synthesized
tttgtctcaagacttttaaaaa

SEQ ID NO: 828796 - DNA, 22 bp, Artificial Sequence
  chemically synthesized
aagaggaaattttttaaaagtc

SEQ ID NO: 828797 - DNA, 22 bp, Artificial Sequence
  chemically synthesized
tgtttgtctcaagacttttaaa

SEQ ID NO: 828798 - DNA, 22 bp, Artificial Sequence
  chemically synthesized
ctgtttgtctcaagacttttaa

SEQ ID NO: 828799 - DNA, 22 bp, Artificial Sequence
  chemically synthesized
atttctgtttgtctcaagactt

SEQ ID NO: 828800 - DNA, 22 bp, Artificial Sequence
  chemically synthesized
catttctgtttgtctcaagact

SEQ ID NO: 828801 - DNA, 22 bp, Artificial Sequence
  chemically synthesized
tcatttctgtttgtctcaagac

SEQ ID NO: 828802 - DNA, 22 bp, Artificial Sequence
  chemically synthesized
tttaaaagtcttgagacaaaca

SEQ ID NO: 828803 - DNA, 22 bp, Artificial Sequence
  chemically synthesized
tgttttcatttctgtttgtctc

SEQ ID NO: 828804 - DNA, 22 bp, Artificial Sequence
  chemically synthesized
ttaaaagtcttgagacaaacag

SEQ ID NO: 828805 - DNA, 22 bp, Artificial Sequence
  chemically synthesized
taaaagtcttgagacaaacaga

SEQ ID NO: 828806 - DNA, 22 bp, Artificial Sequence
  chemically synthesized
aaaagtcttgagacaaacagaa

SEQ ID NO: 828807 - DNA, 22 bp, Artificial Sequence
  chemically synthesized
aaagtcttgagacaaacagaaa

SEQ ID NO: 828808 - DNA, 22 bp, Artificial Sequence
  chemically synthesized
tgttgtgttttcatttctgttt

SEQ ID NO: 828809 - DNA, 22 bp, Artificial Sequence
  chemically synthesized
tatgttgtgttttcatttctgt

SEQ ID NO: 828810 - DNA, 22 bp, Artificial Sequence
  chemically synthesized
ctatgttgtgttttcatttctg

SEQ ID NO: 828811 - DNA, 22 bp, Artificial Sequence
  chemically synthesized
tctatgttgtgttttcatttct

SEQ ID NO: 828812 - DNA, 22 bp, Artificial Sequence
  chemically synthesized
ttctatgttgtgttttcatttc

SEQ ID NO: 828813 - DNA, 22 bp, Artificial Sequence
  chemically synthesized
gagacaaacagaaatgaaaaca

SEQ ID NO: 828814 - DNA, 22 bp, Artificial Sequence
  chemically synthesized
agacaaacagaaatgaaaacac

SEQ ID NO: 828815 - DNA, 22 bp, Artificial Sequence
  chemically synthesized
cccccagaagtttttctatgtt

SEQ ID NO: 828816 - DNA, 22 bp, Artificial Sequence
  chemically synthesized
ctacccccagaagtttttctat

SEQ ID NO: 828817 - DNA, 22 bp, Artificial Sequence
  chemically synthesized
gctacccccagaagtttttcta

SEQ ID NO: 828818 - DNA, 22 bp, Artificial Sequence
  chemically synthesized
tgctacccccagaagtttttct

SEQ ID NO: 828819 - DNA, 22 bp, Artificial Sequence
  chemically synthesized
ttgctacccccagaagtttttc

SEQ ID NO: 828820 - DNA, 22 bp, Artificial Sequence
  chemically synthesized
cttttgctacccccagaagttt

SEQ ID NO: 828821 - DNA, 22 bp, Artificial Sequence
  chemically synthesized
gcactgcttttgctacccccag

SEQ ID NO: 828822 - DNA, 22 bp, Artificial Sequence
  chemically synthesized
agcactgcttttgctaccccca

SEQ ID NO: 828823 - DNA, 22 bp, Artificial Sequence
  chemically synthesized
ttagcactgcttttgctacccc

SEQ ID NO: 828824 - DNA, 22 bp, Artificial Sequence
  chemically synthesized
cctcttagcactgcttttgcta

SEQ ID NO: 828825 - DNA, 22 bp, Artificial Sequence
  chemically synthesized
ccctcttagcactgcttttgct

SEQ ID NO: 828826 - DNA, 22 bp, Artificial Sequence
  chemically synthesized
ctgggggtagcaaaagcagtgc

SEQ ID NO: 828827 - DNA, 22 bp, Artificial Sequence
  chemically synthesized
tgggggtagcaaaagcagtgct

SEQ ID NO: 828828 - DNA, 22 bp, Artificial Sequence
  chemically synthesized
ggggtagcaaaagcagtgctaa

SEQ ID NO: 828829 - DNA, 22 bp, Artificial Sequence
  chemically synthesized
atataaacttccctcttagcac

SEQ ID NO: 828830 - DNA, 22 bp, Artificial Sequence
  chemically synthesized
ttgatataaacttccctcttag

SEQ ID NO: 828831 - DNA, 22 bp, Artificial Sequence
  chemically synthesized
attgatataaacttccctctta

SEQ ID NO: 828832 - DNA, 22 bp, Artificial Sequence
  chemically synthesized
atgtaggaatttattgatataa

SEQ ID NO: 828833 - DNA, 22 bp, Artificial Sequence
  chemically synthesized
gatgtaggaatttattgatata

SEQ ID NO: 828834 - DNA, 22 bp, Artificial Sequence
  chemically synthesized
agagggaagtttatatcaataa

SEQ ID NO: 828835 - DNA, 22 bp, Artificial Sequence
  chemically synthesized
tgatgtaggaatttattgatat

SEQ ID NO: 828836 - DNA, 22 bp, Artificial Sequence
  chemically synthesized
ttgatgtaggaatttattgata

SEQ ID NO: 828837 - DNA, 22 bp, Artificial Sequence
  chemically synthesized
tttgatgtaggaatttattgat

SEQ ID NO: 828838 - DNA, 22 bp, Artificial Sequence
  chemically synthesized
ttttgatgtaggaatttattga

SEQ ID NO: 828839 - DNA, 22 bp, Artificial Sequence
  chemically synthesized
ttttttgatgtaggaatttatt

SEQ ID NO: 828840 - DNA, 22 bp, Artificial Sequence
  chemically synthesized
cttttttgatgtaggaatttat

SEQ ID NO: 828841 - DNA, 22 bp, Artificial Sequence
  chemically synthesized
ttcttttttgatgtaggaattt

SEQ ID NO: 828842 - DNA, 22 bp, Artificial Sequence
  chemically synthesized
cttcttttttgatgtaggaatt

SEQ ID NO: 828843 - DNA, 22 bp, Artificial Sequence
  chemically synthesized
atatcaataaattcctacatca

SEQ ID NO: 828844 - DNA, 22 bp, Artificial Sequence
  chemically synthesized
tatcaataaattcctacatcaa

SEQ ID NO: 828845 - DNA, 22 bp, Artificial Sequence
  chemically synthesized
agatatttcttcttttttgatg

SEQ ID NO: 828846 - DNA, 22 bp, Artificial Sequence
  chemically synthesized
gagatatttcttcttttttgat

SEQ ID NO: 828847 - DNA, 22 bp, Artificial Sequence
  chemically synthesized
atttgagatatttcttcttttt

SEQ ID NO: 828848 - DNA, 22 bp, Artificial Sequence
  chemically synthesized
catttgagatatttcttctttt

SEQ ID NO: 828849 - DNA, 22 bp, Artificial Sequence
  chemically synthesized
ctacatcaaaaaagaagaaata

SEQ ID NO: 828850 - DNA, 22 bp, Artificial Sequence
  chemically synthesized
catcaaaaaagaagaaatatct

SEQ ID NO: 828851 - DNA, 22 bp, Artificial Sequence
  chemically synthesized
ggtatttcatttgagatatttc

SEQ ID NO: 828852 - DNA, 22 bp, Artificial Sequence
  chemically synthesized
aggtataatgttaggtatttca

SEQ ID NO: 828853 - DNA, 22 bp, Artificial Sequence
  chemically synthesized
ctgaggtataatgttaggtatt

SEQ ID NO: 828854 - DNA, 22 bp, Artificial Sequence
  chemically synthesized
cctgaggtataatgttaggtat

SEQ ID NO: 828855 - DNA, 22 bp, Artificial Sequence
  chemically synthesized
aaatgaaatacctaacattata

SEQ ID NO: 828856 - DNA, 22 bp, Artificial Sequence
  chemically synthesized
tagtttcctgaggtataatgtt

SEQ ID NO: 828857 - DNA, 22 bp, Artificial Sequence
  chemically synthesized
gtagtttcctgaggtataatgt

SEQ ID NO: 828858 - DNA, 22 bp, Artificial Sequence
  chemically synthesized
tgtagtttcctgaggtataatg

SEQ ID NO: 828859 - DNA, 22 bp, Artificial Sequence
  chemically synthesized
ttgtagtttcctgaggtataat

SEQ ID NO: 828860 - DNA, 22 bp, Artificial Sequence
  chemically synthesized
tttgtagtttcctgaggtataa

SEQ ID NO: 828861 - DNA, 22 bp, Artificial Sequence
  chemically synthesized
tttttgtagtttcctgaggtat

SEQ ID NO: 828862 - DNA, 22 bp, Artificial Sequence
  chemically synthesized
ctttttgtagtttcctgaggta

SEQ ID NO: 828863 - DNA, 22 bp, Artificial Sequence
  chemically synthesized
ttctttttgtagtttcctgagg

SEQ ID NO: 828864 - DNA, 22 bp, Artificial Sequence
  chemically synthesized
acattatacctcaggaaactac

SEQ ID NO: 828865 - DNA, 22 bp, Artificial Sequence
  chemically synthesized
attcttctttttgtagtttcct

SEQ ID NO: 828866 - DNA, 22 bp, Artificial Sequence
  chemically synthesized
attcattcttctttttgtagtt

SEQ ID NO: 828867 - DNA, 22 bp, Artificial Sequence
  chemically synthesized
aattcattcttctttttgtagt

SEQ ID NO: 828868 - DNA, 22 bp, Artificial Sequence
  chemically synthesized
tacctcaggaaactacaaaaag

SEQ ID NO: 828869 - DNA, 22 bp, Artificial Sequence
  chemically synthesized
ggcttaattcattcttcttttt

SEQ ID NO: 828870 - DNA, 22 bp, Artificial Sequence
  chemically synthesized
gggcttaattcattcttctttt

SEQ ID NO: 828871 - DNA, 22 bp, Artificial Sequence
  chemically synthesized
aggaaactacaaaaagaagaat

SEQ ID NO: 828872 - DNA, 22 bp, Artificial Sequence
  chemically synthesized
tgggcttaattcattcttcttt

SEQ ID NO: 828873 - DNA, 22 bp, Artificial Sequence
  chemically synthesized
actttgggcttaattcattctt

SEQ ID NO: 828874 - DNA, 22 bp, Artificial Sequence
  chemically synthesized
ctaactttgggcttaattcatt

SEQ ID NO: 828875 - DNA, 22 bp, Artificial Sequence
  chemically synthesized
caaaaagaagaatgaattaagc

SEQ ID NO: 828876 - DNA, 22 bp, Artificial Sequence
  chemically synthesized
tgctaactttgggcttaattca

SEQ ID NO: 828877 - DNA, 22 bp, Artificial Sequence
  chemically synthesized
ctgctaactttgggcttaattc

SEQ ID NO: 828878 - DNA, 22 bp, Artificial Sequence
  chemically synthesized
tctgctaactttgggcttaatt

SEQ ID NO: 828879 - DNA, 22 bp, Artificial Sequence
  chemically synthesized
tttctgctaactttgggcttaa

SEQ ID NO: 828880 - DNA, 22 bp, Artificial Sequence
  chemically synthesized
ctttctgctaactttgggctta

SEQ ID NO: 828881 - DNA, 22 bp, Artificial Sequence
  chemically synthesized
ttctttctgctaactttgggct

SEQ ID NO: 828882 - DNA, 22 bp, Artificial Sequence
  chemically synthesized
cttctttctgctaactttgggc

SEQ ID NO: 828883 - DNA, 22 bp, Artificial Sequence
  chemically synthesized
tcttctttctgctaactttggg

SEQ ID NO: 828884 - DNA, 22 bp, Artificial Sequence
  chemically synthesized
ttttcttctttctgctaacttt

SEQ ID NO: 828885 - DNA, 22 bp, Artificial Sequence
  chemically synthesized
ttattttcttctttctgctaac

SEQ ID NO: 828886 - DNA, 22 bp, Artificial Sequence
  chemically synthesized
gttattttcttctttctgctaa

SEQ ID NO: 828887 - DNA, 22 bp, Artificial Sequence
  chemically synthesized
tgttattttcttctttctgcta

SEQ ID NO: 828888 - DNA, 22 bp, Artificial Sequence
  chemically synthesized
agcccaaagttagcagaaagaa

SEQ ID NO: 828889 - DNA, 22 bp, Artificial Sequence
  chemically synthesized
atctttgttattttcttctttc

SEQ ID NO: 828890 - DNA, 22 bp, Artificial Sequence
  chemically synthesized
tgatctttgttattttcttctt

SEQ ID NO: 828891 - DNA, 22 bp, Artificial Sequence
  chemically synthesized
ctctgatctttgttattttctt

SEQ ID NO: 828892 - DNA, 22 bp, Artificial Sequence
  chemically synthesized
tgctctgatctttgttattttc

SEQ ID NO: 828893 - DNA, 22 bp, Artificial Sequence
  chemically synthesized
ctgctctgatctttgttatttt

SEQ ID NO: 828894 - DNA, 22 bp, Artificial Sequence
  chemically synthesized
gcagaaagaagaaaataacaaa

SEQ ID NO: 828895 - DNA, 22 bp, Artificial Sequence
  chemically synthesized
tttctgctctgatctttgttat

SEQ ID NO: 828896 - DNA, 22 bp, Artificial Sequence
  chemically synthesized
atttctgctctgatctttgtta

SEQ ID NO: 828897 - DNA, 22 bp, Artificial Sequence
  chemically synthesized
atttatttctgctctgatcttt

SEQ ID NO: 828898 - DNA, 22 bp, Artificial Sequence
  chemically synthesized
catttatttctgctctgatctt

SEQ ID NO: 828899 - DNA, 22 bp, Artificial Sequence
  chemically synthesized
tttcatttatttctgctctgat

SEQ ID NO: 828900 - DNA, 22 bp, Artificial Sequence
  chemically synthesized
tatttcatttatttctgctctg

SEQ ID NO: 828901 - DNA, 22 bp, Artificial Sequence
  chemically synthesized
gtctctatttcatttatttctg

SEQ ID NO: 828902 - DNA, 22 bp, Artificial Sequence
  chemically synthesized
tagtctctatttcatttatttc

SEQ ID NO: 828903 - DNA, 22 bp, Artificial Sequence
  chemically synthesized
tctagtctctatttcatttatt

SEQ ID NO: 828904 - DNA, 22 bp, Artificial Sequence
  chemically synthesized
ctctagtctctatttcatttat

SEQ ID NO: 828905 - DNA, 22 bp, Artificial Sequence
  chemically synthesized
tttctctagtctctatttcatt

SEQ ID NO: 828906 - DNA, 22 bp, Artificial Sequence
  chemically synthesized
ttgtttctctagtctctatttc

SEQ ID NO: 828907 - DNA, 22 bp, Artificial Sequence
  chemically synthesized
tattgtttctctagtctctatt

SEQ ID NO: 828908 - DNA, 22 bp, Artificial Sequence
  chemically synthesized
ctattgtttctctagtctctat

SEQ ID NO: 828909 - DNA, 22 bp, Artificial Sequence
  chemically synthesized
tctattgtttctctagtctcta

SEQ ID NO: 828910 - DNA, 22 bp, Artificial Sequence
  chemically synthesized
ttctattgtttctctagtctct

SEQ ID NO: 828911 - DNA, 22 bp, Artificial Sequence
  chemically synthesized
tttctattgtttctctagtctc

SEQ ID NO: 828912 - DNA, 22 bp, Artificial Sequence
  chemically synthesized
ttttctattgtttctctagtct

SEQ ID NO: 828913 - DNA, 22 bp, Artificial Sequence
  chemically synthesized
tttttctattgtttctctagtc

SEQ ID NO: 828914 - DNA, 22 bp, Artificial Sequence
  chemically synthesized
actttttttctattgtttctct

SEQ ID NO: 828915 - DNA, 22 bp, Artificial Sequence
  chemically synthesized
ttgactttttttctattgtttc

SEQ ID NO: 828916 - DNA, 22 bp, Artificial Sequence
  chemically synthesized
attgactttttttctattgttt

SEQ ID NO: 828917 - DNA, 22 bp, Artificial Sequence
  chemically synthesized
tattgactttttttctattgtt

SEQ ID NO: 828918 - DNA, 22 bp, Artificial Sequence
  chemically synthesized
gttttattgactttttttctat

SEQ ID NO: 828919 - DNA, 22 bp, Artificial Sequence
  chemically synthesized
agttttattgactttttttcta

SEQ ID NO: 828920 - DNA, 22 bp, Artificial Sequence
  chemically synthesized
tagttttattgactttttttct

SEQ ID NO: 828921 - DNA, 22 bp, Artificial Sequence
  chemically synthesized
ttagttttattgactttttttc

SEQ ID NO: 828922 - DNA, 22 bp, Artificial Sequence
  chemically synthesized
gagaaacaatagaaaaaaagtc

SEQ ID NO: 828923 - DNA, 22 bp, Artificial Sequence
  chemically synthesized
aaaaaaccaacttttagtttta

SEQ ID NO: 828924 - DNA, 22 bp, Artificial Sequence
  chemically synthesized
caaaaaaccaacttttagtttt

SEQ ID NO: 828925 - DNA, 22 bp, Artificial Sequence
  chemically synthesized
tcaaaaaaccaacttttagttt

SEQ ID NO: 828926 - DNA, 22 bp, Artificial Sequence
  chemically synthesized
ttcaaaaaaccaacttttagtt

SEQ ID NO: 828927 - DNA, 22 bp, Artificial Sequence
  chemically synthesized
gcttttcaaaaaaccaactttt

SEQ ID NO: 828928 - DNA, 22 bp, Artificial Sequence
  chemically synthesized
agcttttcaaaaaaccaacttt

SEQ ID NO: 828929 - DNA, 22 bp, Artificial Sequence
  chemically synthesized
tgtttagcttttcaaaaaacca

SEQ ID NO: 828930 - DNA, 22 bp, Artificial Sequence
  chemically synthesized
aaagttggttttttgaaaagct

SEQ ID NO: 828931 - DNA, 22 bp, Artificial Sequence
  chemically synthesized
tcaattgtgtttagcttttcaa

SEQ ID NO: 828932 - DNA, 22 bp, Artificial Sequence
  chemically synthesized
gtcaattgtgtttagcttttca

SEQ ID NO: 828933 - DNA, 22 bp, Artificial Sequence
  chemically synthesized
gttttttgaaaagctaaacaca

SEQ ID NO: 828934 - DNA, 22 bp, Artificial Sequence
  chemically synthesized
aggatttgtcaattgtgtttag

SEQ ID NO: 828935 - DNA, 22 bp, Artificial Sequence
  chemically synthesized
tttgaaaagctaaacacaattg

SEQ ID NO: 828936 - DNA, 22 bp, Artificial Sequence
  chemically synthesized
ttgaaaagctaaacacaattga

SEQ ID NO: 828937 - DNA, 22 bp, Artificial Sequence
  chemically synthesized
gctaaggatttgtcaattgtgt

SEQ ID NO: 828938 - DNA, 22 bp, Artificial Sequence
  chemically synthesized
tgaaaagctaaacacaattgac

SEQ ID NO: 828939 - DNA, 22 bp, Artificial Sequence
  chemically synthesized
gaaaagctaaacacaattgaca

SEQ ID NO: 828940 - DNA, 22 bp, Artificial Sequence
  chemically synthesized
aaaagctaaacacaattgacaa

SEQ ID NO: 828941 - DNA, 22 bp, Artificial Sequence
  chemically synthesized
gtctagctaaggatttgtcaat

SEQ ID NO: 828942 - DNA, 22 bp, Artificial Sequence
  chemically synthesized
agtctagctaaggatttgtcaa

SEQ ID NO: 828943 - DNA, 22 bp, Artificial Sequence
  chemically synthesized
ttagtctagctaaggatttgtc

SEQ ID NO: 828944 - DNA, 22 bp, Artificial Sequence
  chemically synthesized
aacacaattgacaaatccttag

SEQ ID NO: 828945 - DNA, 22 bp, Artificial Sequence
  chemically synthesized
attcttagtctagctaaggatt

SEQ ID NO: 828946 - DNA, 22 bp, Artificial Sequence
  chemically synthesized
cattcttagtctagctaaggat

SEQ ID NO: 828947 - DNA, 22 bp, Artificial Sequence
  chemically synthesized
ttcattcttagtctagctaagg

SEQ ID NO: 828948 - DNA, 22 bp, Artificial Sequence
  chemically synthesized
tcttcattcttagtctagctaa

SEQ ID NO: 828949 - DNA, 22 bp, Artificial Sequence
  chemically synthesized
ctctcttcattcttagtctagc

SEQ ID NO: 828950 - DNA, 22 bp, Artificial Sequence
  chemically synthesized
acaaatccttagctagactaag

SEQ ID NO: 828951 - DNA, 22 bp, Artificial Sequence
  chemically synthesized
agcctgctctcttcattcttag

SEQ ID NO: 828952 - DNA, 22 bp, Artificial Sequence
  chemically synthesized
gagcctgctctcttcattctta

SEQ ID NO: 828953 - DNA, 22 bp, Artificial Sequence
  chemically synthesized
tttgagcctgctctcttcattc

SEQ ID NO: 828954 - DNA, 22 bp, Artificial Sequence
  chemically synthesized
agctagactaagaatgaagaga

SEQ ID NO: 828955 - DNA, 22 bp, Artificial Sequence
  chemically synthesized
atttgagcctgctctcttcatt

SEQ ID NO: 828956 - DNA, 22 bp, Artificial Sequence
  chemically synthesized
gctagactaagaatgaagagag

SEQ ID NO: 828957 - DNA, 22 bp, Artificial Sequence
  chemically synthesized
atttatttgagcctgctctctt

SEQ ID NO: 828958 - DNA, 22 bp, Artificial Sequence
  chemically synthesized
gactaagaatgaagagagcagg

SEQ ID NO: 828959 - DNA, 22 bp, Artificial Sequence
  chemically synthesized
gatttatttgagcctgctctct

SEQ ID NO: 828960 - DNA, 22 bp, Artificial Sequence
  chemically synthesized
atttgatttatttgagcctgct

SEQ ID NO: 828961 - DNA, 22 bp, Artificial Sequence
  chemically synthesized
agaatgaagagagcaggctcaa

SEQ ID NO: 828962 - DNA, 22 bp, Artificial Sequence
  chemically synthesized
tgatttgatttatttgagcctg

SEQ ID NO: 828963 - DNA, 22 bp, Artificial Sequence
  chemically synthesized
ctgatttgatttatttgagcct

SEQ ID NO: 828964 - DNA, 22 bp, Artificial Sequence
  chemically synthesized
atttctgatttgatttatttga

SEQ ID NO: 828965 - DNA, 22 bp, Artificial Sequence
  chemically synthesized
gatttctgatttgatttatttg

SEQ ID NO: 828966 - DNA, 22 bp, Artificial Sequence
  chemically synthesized
tgatttctgatttgatttattt

SEQ ID NO: 828967 - DNA, 22 bp, Artificial Sequence
  chemically synthesized
tttgatttctgatttgatttat

SEQ ID NO: 828968 - DNA, 22 bp, Artificial Sequence
  chemically synthesized
tctttgatttctgatttgattt

SEQ ID NO: 828969 - DNA, 22 bp, Artificial Sequence
  chemically synthesized
ctctttgatttctgatttgatt

SEQ ID NO: 828970 - DNA, 22 bp, Artificial Sequence
  chemically synthesized
aaataaatcaaatcagaaatca

SEQ ID NO: 828971 - DNA, 22 bp, Artificial Sequence
  chemically synthesized
tcagtcataatgtcttctcttt

SEQ ID NO: 828972 - DNA, 22 bp, Artificial Sequence
  chemically synthesized
tgttatcagtcataatgtcttc

SEQ ID NO: 828973 - DNA, 22 bp, Artificial Sequence
  chemically synthesized
tgtgttatcagtcataatgtct

SEQ ID NO: 828974 - DNA, 22 bp, Artificial Sequence
  chemically synthesized
ctgtgttatcagtcataatgtc

SEQ ID NO: 828975 - DNA, 22 bp, Artificial Sequence
  chemically synthesized
tatttctgtgttatcagtcata

SEQ ID NO: 828976 - DNA, 22 bp, Artificial Sequence
  chemically synthesized
gtatttctgtgttatcagtcat

SEQ ID NO: 828977 - DNA, 22 bp, Artificial Sequence
  chemically synthesized
tgtatttctgtgttatcagtca

SEQ ID NO: 828978 - DNA, 22 bp, Artificial Sequence
  chemically synthesized
ggatcctttgtatttctgtgtt

SEQ ID NO: 828979 - DNA, 22 bp, Artificial Sequence
  chemically synthesized
aggatcctttgtatttctgtgt

SEQ ID NO: 828980 - DNA, 22 bp, Artificial Sequence
  chemically synthesized
ttaggatcctttgtatttctgt

SEQ ID NO: 828981 - DNA, 22 bp, Artificial Sequence
  chemically synthesized
tgactgataacacagaaataca

SEQ ID NO: 828982 - DNA, 22 bp, Artificial Sequence
  chemically synthesized
ataacacagaaatacaaaggat

SEQ ID NO: 828983 - DNA, 22 bp, Artificial Sequence
  chemically synthesized
atcgtagtctcttaggatcctt

SEQ ID NO: 828984 - DNA, 22 bp, Artificial Sequence
  chemically synthesized
ttcatcgtagtctcttaggatc

SEQ ID NO: 828985 - DNA, 22 bp, Artificial Sequence
  chemically synthesized
gtatataattgttcatcgtagt

SEQ ID NO: 828986 - DNA, 22 bp, Artificial Sequence
  chemically synthesized
ggtatataattgttcatcgtag

SEQ ID NO: 828987 - DNA, 22 bp, Artificial Sequence
  chemically synthesized
ttggtatataattgttcatcgt

SEQ ID NO: 828988 - DNA, 22 bp, Artificial Sequence
  chemically synthesized
cttggtatataattgttcatcg

SEQ ID NO: 828989 - DNA, 22 bp, Artificial Sequence
  chemically synthesized
agagactacgatgaacaattat

SEQ ID NO: 828990 - DNA, 22 bp, Artificial Sequence
  chemically synthesized
cgatgaacaattatataccaag

SEQ ID NO: 828991 - DNA, 22 bp, Artificial Sequence
  chemically synthesized
ggatgtccaatttcttggtata

SEQ ID NO: 828992 - DNA, 22 bp, Artificial Sequence
  chemically synthesized
ttaggatgtccaatttcttggt

SEQ ID NO: 828993 - DNA, 22 bp, Artificial Sequence
  chemically synthesized
tgttaggatgtccaatttcttg

SEQ ID NO: 828994 - DNA, 22 bp, Artificial Sequence
  chemically synthesized
ctgttaggatgtccaatttctt

SEQ ID NO: 828995 - DNA, 22 bp, Artificial Sequence
  chemically synthesized
tataccaagaaattggacatcc

SEQ ID NO: 828996 - DNA, 22 bp, Artificial Sequence
  chemically synthesized
atccatttctgttaggatgtcc

SEQ ID NO: 828997 - DNA, 22 bp, Artificial Sequence
  chemically synthesized
agaattcatccatttctgttag

SEQ ID NO: 828998 - DNA, 22 bp, Artificial Sequence
  chemically synthesized
taagaattcatccatttctgtt

SEQ ID NO: 828999 - DNA, 22 bp, Artificial Sequence
  chemically synthesized
ctaagaattcatccatttctgt

SEQ ID NO: 829000 - DNA, 22 bp, Artificial Sequence
  chemically synthesized
gacatcctaacagaaatggatg

SEQ ID NO: 829001 - DNA, 22 bp, Artificial Sequence
  chemically synthesized
tgtatttctaagaattcatcca

SEQ ID NO: 829002 - DNA, 22 bp, Artificial Sequence
  chemically synthesized
acagaaatggatgaattcttag

SEQ ID NO: 829003 - DNA, 22 bp, Artificial Sequence
  chemically synthesized
gtagattatgtatttctaagaa

SEQ ID NO: 829004 - DNA, 22 bp, Artificial Sequence
  chemically synthesized
ggtagattatgtatttctaaga

SEQ ID NO: 829005 - DNA, 22 bp, Artificial Sequence
  chemically synthesized
tggtagattatgtatttctaag

SEQ ID NO: 829006 - DNA, 22 bp, Artificial Sequence
  chemically synthesized
agttttggtagattatgtattt

SEQ ID NO: 829007 - DNA, 22 bp, Artificial Sequence
  chemically synthesized
ttcagttttggtagattatgta

SEQ ID NO: 829008 - DNA, 22 bp, Artificial Sequence
  chemically synthesized
attattcagttttggtagatta

SEQ ID NO: 829009 - DNA, 22 bp, Artificial Sequence
  chemically synthesized
ttagaaatacataatctaccaa

SEQ ID NO: 829010 - DNA, 22 bp, Artificial Sequence
  chemically synthesized
cattattcagttttggtagatt

SEQ ID NO: 829011 - DNA, 22 bp, Artificial Sequence
  chemically synthesized
tcattattcagttttggtagat

SEQ ID NO: 829012 - DNA, 22 bp, Artificial Sequence
  chemically synthesized
agaaatacataatctaccaaaa

SEQ ID NO: 829013 - DNA, 22 bp, Artificial Sequence
  chemically synthesized
gaaatacataatctaccaaaac

SEQ ID NO: 829014 - DNA, 22 bp, Artificial Sequence
  chemically synthesized
caattttcattattcagttttg

SEQ ID NO: 829015 - DNA, 22 bp, Artificial Sequence
  chemically synthesized
ccaattttcattattcagtttt

SEQ ID NO: 829016 - DNA, 22 bp, Artificial Sequence
  chemically synthesized
agatttccaattttcattattc

SEQ ID NO: 829017 - DNA, 22 bp, Artificial Sequence
  chemically synthesized
cagatttccaattttcattatt

SEQ ID NO: 829018 - DNA, 22 bp, Artificial Sequence
  chemically synthesized
tcagatttccaattttcattat

SEQ ID NO: 829019 - DNA, 22 bp, Artificial Sequence
  chemically synthesized
ttcagatttccaattttcatta

SEQ ID NO: 829020 - DNA, 22 bp, Artificial Sequence
  chemically synthesized
ccaaaactgaataatgaaaatt

SEQ ID NO: 829021 - DNA, 22 bp, Artificial Sequence
  chemically synthesized
gtcttttcagatttccaatttt

SEQ ID NO: 829022 - DNA, 22 bp, Artificial Sequence
  chemically synthesized
ctggtcttttcagatttccaat

SEQ ID NO: 829023 - DNA, 22 bp, Artificial Sequence
  chemically synthesized
aataatgaaaattggaaatctg

SEQ ID NO: 829024 - DNA, 22 bp, Artificial Sequence
  chemically synthesized
ttactggtcttttcagatttcc

SEQ ID NO: 829025 - DNA, 22 bp, Artificial Sequence
  chemically synthesized
gctgttactggtcttttcagat

SEQ ID NO: 829026 - DNA, 22 bp, Artificial Sequence
  chemically synthesized
agctgttactggtcttttcaga

SEQ ID NO: 829027 - DNA, 22 bp, Artificial Sequence
  chemically synthesized
cttagctgttactggtcttttc

SEQ ID NO: 829028 - DNA, 22 bp, Artificial Sequence
  chemically synthesized
ccttagctgttactggtctttt

SEQ ID NO: 829029 - DNA, 22 bp, Artificial Sequence
  chemically synthesized
tccttagctgttactggtcttt

SEQ ID NO: 829030 - DNA, 22 bp, Artificial Sequence
  chemically synthesized
tttccttagctgttactggtct

SEQ ID NO: 829031 - DNA, 22 bp, Artificial Sequence
  chemically synthesized
gaaatctgaaaagaccagtaac

SEQ ID NO: 829032 - DNA, 22 bp, Artificial Sequence
  chemically synthesized
actctttccttagctgttactg

SEQ ID NO: 829033 - DNA, 22 bp, Artificial Sequence
  chemically synthesized
aactctttccttagctgttact

SEQ ID NO: 829034 - DNA, 22 bp, Artificial Sequence
  chemically synthesized
cttaactctttccttagctgtt

SEQ ID NO: 829035 - DNA, 22 bp, Artificial Sequence
  chemically synthesized
aaaagaccagtaacagctaagg

SEQ ID NO: 829036 - DNA, 22 bp, Artificial Sequence
  chemically synthesized
atgcaatctccttaactctttc

SEQ ID NO: 829037 - DNA, 22 bp, Artificial Sequence
  chemically synthesized
aatactgatgcaatctccttaa

SEQ ID NO: 829038 - DNA, 22 bp, Artificial Sequence
  chemically synthesized
aaatactgatgcaatctcctta

SEQ ID NO: 829039 - DNA, 22 bp, Artificial Sequence
  chemically synthesized
taaatactgatgcaatctcctt

SEQ ID NO: 829040 - DNA, 22 bp, Artificial Sequence
  chemically synthesized
aggaaagagttaaggagattgc

SEQ ID NO: 829041 - DNA, 22 bp, Artificial Sequence
  chemically synthesized
ttaaatactgatgcaatctcct

SEQ ID NO: 829042 - DNA, 22 bp, Artificial Sequence
  chemically synthesized
aggagattgcatcagtatttaa

SEQ ID NO: 829043 - DNA, 22 bp, Artificial Sequence
  chemically synthesized
atgtgagaacttttaaatactg

SEQ ID NO: 829044 - DNA, 22 bp, Artificial Sequence
  chemically synthesized
gatgtgagaacttttaaatact

SEQ ID NO: 829045 - DNA, 22 bp, Artificial Sequence
  chemically synthesized
tgatgtgagaacttttaaatac

SEQ ID NO: 829046 - DNA, 22 bp, Artificial Sequence
  chemically synthesized
ctttgatgtgagaacttttaaa

SEQ ID NO: 829047 - DNA, 22 bp, Artificial Sequence
  chemically synthesized
cctttgatgtgagaacttttaa

SEQ ID NO: 829048 - DNA, 22 bp, Artificial Sequence
  chemically synthesized
tcctttgatgtgagaactttta

SEQ ID NO: 829049 - DNA, 22 bp, Artificial Sequence
  chemically synthesized
catcagtatttaaaagttctca

SEQ ID NO: 829050 - DNA, 22 bp, Artificial Sequence
  chemically synthesized
agctttcctttgatgtgagaac

SEQ ID NO: 829051 - DNA, 22 bp, Artificial Sequence
  chemically synthesized
gagctttcctttgatgtgagaa

SEQ ID NO: 829052 - DNA, 22 bp, Artificial Sequence
  chemically synthesized
gtcttgagctttcctttgatgt

SEQ ID NO: 829053 - DNA, 22 bp, Artificial Sequence
  chemically synthesized
aaaagttctcacatcaaaggaa

SEQ ID NO: 829054 - DNA, 22 bp, Artificial Sequence
  chemically synthesized
aaagttctcacatcaaaggaaa

SEQ ID NO: 829055 - DNA, 22 bp, Artificial Sequence
  chemically synthesized
tcacatcaaaggaaagctcaag

SEQ ID NO: 829056 - DNA, 22 bp, Artificial Sequence
  chemically synthesized
acatcaaaggaaagctcaagac

SEQ ID NO: 829057 - DNA, 22 bp, Artificial Sequence
  chemically synthesized
ccatgaagccatctggtcttga

SEQ ID NO: 829058 - DNA, 22 bp, Artificial Sequence
  chemically synthesized
tcccatgaagccatctggtctt

SEQ ID NO: 829059 - DNA, 22 bp, Artificial Sequence
  chemically synthesized
tagaattctcccatgaagccat

SEQ ID NO: 829060 - DNA, 22 bp, Artificial Sequence
  chemically synthesized
gtagaattctcccatgaagcca

SEQ ID NO: 829061 - DNA, 22 bp, Artificial Sequence
  chemically synthesized
aagaccagatggcttcatggga

SEQ ID NO: 829062 - DNA, 22 bp, Artificial Sequence
  chemically synthesized
aatgtttgtagaattctcccat

SEQ ID NO: 829063 - DNA, 22 bp, Artificial Sequence
  chemically synthesized
aaatgtttgtagaattctccca

SEQ ID NO: 829064 - DNA, 22 bp, Artificial Sequence
  chemically synthesized
taaatgtttgtagaattctccc

SEQ ID NO: 829065 - DNA, 22 bp, Artificial Sequence
  chemically synthesized
tttaaatgtttgtagaattctc

SEQ ID NO: 829066 - DNA, 22 bp, Artificial Sequence
  chemically synthesized
ctttaaatgtttgtagaattct

SEQ ID NO: 829067 - DNA, 22 bp, Artificial Sequence
  chemically synthesized
catgggagaattctacaaacat

SEQ ID NO: 829068 - DNA, 22 bp, Artificial Sequence
  chemically synthesized
ggtcttctttaaatgtttgtag

SEQ ID NO: 829069 - DNA, 22 bp, Artificial Sequence
  chemically synthesized
atgggagaattctacaaacatt

SEQ ID NO: 829070 - DNA, 22 bp, Artificial Sequence
  chemically synthesized
tgttaggtcttctttaaatgtt

SEQ ID NO: 829071 - DNA, 22 bp, Artificial Sequence
  chemically synthesized
gtgttaggtcttctttaaatgt

SEQ ID NO: 829072 - DNA, 22 bp, Artificial Sequence
  chemically synthesized
tacaaacatttaaagaagacct

SEQ ID NO: 829073 - DNA, 22 bp, Artificial Sequence
  chemically synthesized
caaacatttaaagaagacctaa

SEQ ID NO: 829074 - DNA, 22 bp, Artificial Sequence
  chemically synthesized
agaaagatttgtgttaggtctt

SEQ ID NO: 829075 - DNA, 22 bp, Artificial Sequence
  chemically synthesized
gagaaagatttgtgttaggtct

SEQ ID NO: 829076 - DNA, 22 bp, Artificial Sequence
  chemically synthesized
aaagaagacctaacacaaatct

SEQ ID NO: 829077 - DNA, 22 bp, Artificial Sequence
  chemically synthesized
aagaagacctaacacaaatctt

SEQ ID NO: 829078 - DNA, 22 bp, Artificial Sequence
  chemically synthesized
caaaagagtttgagaaagattt

SEQ ID NO: 829079 - DNA, 22 bp, Artificial Sequence
  chemically synthesized
ccaaaagagtttgagaaagatt

SEQ ID NO: 829080 - DNA, 22 bp, Artificial Sequence
  chemically synthesized
tccaaaagagtttgagaaagat

SEQ ID NO: 829081 - DNA, 22 bp, Artificial Sequence
  chemically synthesized
gttttccaaaagagtttgagaa

SEQ ID NO: 829082 - DNA, 22 bp, Artificial Sequence
  chemically synthesized
agttttccaaaagagtttgaga

SEQ ID NO: 829083 - DNA, 22 bp, Artificial Sequence
  chemically synthesized
acacaaatctttctcaaactct

SEQ ID NO: 829084 - DNA, 22 bp, Artificial Sequence
  chemically synthesized
tagttttccaaaagagtttgag

SEQ ID NO: 829085 - DNA, 22 bp, Artificial Sequence
  chemically synthesized
tttagttttccaaaagagtttg

SEQ ID NO: 829086 - DNA, 22 bp, Artificial Sequence
  chemically synthesized
ctctttagttttccaaaagagt

SEQ ID NO: 829087 - DNA, 22 bp, Artificial Sequence
  chemically synthesized
cctctttagttttccaaaagag

SEQ ID NO: 829088 - DNA, 22 bp, Artificial Sequence
  chemically synthesized
tctcaaactcttttggaaaact

SEQ ID NO: 829089 - DNA, 22 bp, Artificial Sequence
  chemically synthesized
ctcaaactcttttggaaaacta

SEQ ID NO: 829090 - DNA, 22 bp, Artificial Sequence
  chemically synthesized
tcaaactcttttggaaaactaa

SEQ ID NO: 829091 - DNA, 22 bp, Artificial Sequence
  chemically synthesized
aaactcttttggaaaactaaag

SEQ ID NO: 829092 - DNA, 22 bp, Artificial Sequence
  chemically synthesized
gacgaatcccttcctctttagt

SEQ ID NO: 829093 - DNA, 22 bp, Artificial Sequence
  chemically synthesized
ggacgaatcccttcctctttag

SEQ ID NO: 829094 - DNA, 22 bp, Artificial Sequence
  chemically synthesized
ttttggaaaactaaagaggaag

SEQ ID NO: 829095 - DNA, 22 bp, Artificial Sequence
  chemically synthesized
ttggaaaactaaagaggaaggg

SEQ ID NO: 829096 - DNA, 22 bp, Artificial Sequence
  chemically synthesized
tggaaaactaaagaggaaggga

SEQ ID NO: 829097 - DNA, 22 bp, Artificial Sequence
  chemically synthesized
ggaaaactaaagaggaagggat

SEQ ID NO: 829098 - DNA, 22 bp, Artificial Sequence
  chemically synthesized
gaaaactaaagaggaagggatt

SEQ ID NO: 829099 - DNA, 22 bp, Artificial Sequence
  chemically synthesized
taaaataaatttggacgaatcc

SEQ ID NO: 829100 - DNA, 22 bp, Artificial Sequence
  chemically synthesized
gtaaaataaatttggacgaatc

SEQ ID NO: 829101 - DNA, 22 bp, Artificial Sequence
  chemically synthesized
aagaggaagggattcgtccaaa

SEQ ID NO: 829102 - DNA, 22 bp, Artificial Sequence
  chemically synthesized
gccttgtaaaataaatttggac

SEQ ID NO: 829103 - DNA, 22 bp, Artificial Sequence
  chemically synthesized
ctggccttgtaaaataaatttg

SEQ ID NO: 829104 - DNA, 22 bp, Artificial Sequence
  chemically synthesized
gtccaaatttattttacaaggc

SEQ ID NO: 829105 - DNA, 22 bp, Artificial Sequence
  chemically synthesized
ggatcagggtattgctggcctt

SEQ ID NO: 829106 - DNA, 22 bp, Artificial Sequence
  chemically synthesized
gggatcagggtattgctggcct

SEQ ID NO: 829107 - DNA, 22 bp, Artificial Sequence
  chemically synthesized
tgggatcagggtattgctggcc

SEQ ID NO: 829108 - DNA, 22 bp, Artificial Sequence
  chemically synthesized
attttacaaggccagcaatacc

SEQ ID NO: 829109 - DNA, 22 bp, Artificial Sequence
  chemically synthesized
ttttacaaggccagcaataccc

SEQ ID NO: 829110 - DNA, 22 bp, Artificial Sequence
  chemically synthesized
gctttgggatcagggtattgct

SEQ ID NO: 829111 - DNA, 22 bp, Artificial Sequence
  chemically synthesized
tacaaggccagcaataccctga

SEQ ID NO: 829112 - DNA, 22 bp, Artificial Sequence
  chemically synthesized
acaaggccagcaataccctgat

SEQ ID NO: 829113 - DNA, 22 bp, Artificial Sequence
  chemically synthesized
cctggctttgggatcagggtat

SEQ ID NO: 829114 - DNA, 22 bp, Artificial Sequence
  chemically synthesized
caaggccagcaataccctgatc

SEQ ID NO: 829115 - DNA, 22 bp, Artificial Sequence
  chemically synthesized
gcctggctttgggatcagggta

SEQ ID NO: 829116 - DNA, 22 bp, Artificial Sequence
  chemically synthesized
tgcctggctttgggatcagggt

SEQ ID NO: 829117 - DNA, 22 bp, Artificial Sequence
  chemically synthesized
tagtgtctttgcctggctttgg

SEQ ID NO: 829118 - DNA, 22 bp, Artificial Sequence
  chemically synthesized
gtagtgtctttgcctggctttg

SEQ ID NO: 829119 - DNA, 22 bp, Artificial Sequence
  chemically synthesized
cttgtagtgtctttgcctggct

SEQ ID NO: 829120 - DNA, 22 bp, Artificial Sequence
  chemically synthesized
ccttgtagtgtctttgcctggc

SEQ ID NO: 829121 - DNA, 22 bp, Artificial Sequence
  chemically synthesized
tccttgtagtgtctttgcctgg

SEQ ID NO: 829122 - DNA, 22 bp, Artificial Sequence
  chemically synthesized
tttccttgtagtgtctttgcct

SEQ ID NO: 829123 - DNA, 22 bp, Artificial Sequence
  chemically synthesized
atcccaaagccaggcaaagaca

SEQ ID NO: 829124 - DNA, 22 bp, Artificial Sequence
  chemically synthesized
ctttccttgtagtgtctttgcc

SEQ ID NO: 829125 - DNA, 22 bp, Artificial Sequence
  chemically synthesized
tctttccttgtagtgtctttgc

SEQ ID NO: 829126 - DNA, 22 bp, Artificial Sequence
  chemically synthesized
tagttttctttccttgtagtgt

SEQ ID NO: 829127 - DNA, 22 bp, Artificial Sequence
  chemically synthesized
gcctatagttttctttccttgt

SEQ ID NO: 829128 - DNA, 22 bp, Artificial Sequence
  chemically synthesized
gtgatattggcctatagttttc

SEQ ID NO: 829129 - DNA, 22 bp, Artificial Sequence
  chemically synthesized
caaggaaagaaaactataggcc

SEQ ID NO: 829130 - DNA, 22 bp, Artificial Sequence
  chemically synthesized
attcgtgatattggcctatagt

SEQ ID NO: 829131 - DNA, 22 bp, Artificial Sequence
  chemically synthesized
cattcgtgatattggcctatag

SEQ ID NO: 829132 - DNA, 22 bp, Artificial Sequence
  chemically synthesized
atttcattcgtgatattggcct

SEQ ID NO: 829133 - DNA, 22 bp, Artificial Sequence
  chemically synthesized
catctaatttcattcgtgatat

SEQ ID NO: 829134 - DNA, 22 bp, Artificial Sequence
  chemically synthesized
gcatctaatttcattcgtgata

SEQ ID NO: 829135 - DNA, 22 bp, Artificial Sequence
  chemically synthesized
tgcatctaatttcattcgtgat

SEQ ID NO: 829136 - DNA, 22 bp, Artificial Sequence
  chemically synthesized
ttgcatctaatttcattcgtga

SEQ ID NO: 829137 - DNA, 22 bp, Artificial Sequence
  chemically synthesized
taggccaatatcacgaatgaaa

SEQ ID NO: 829138 - DNA, 22 bp, Artificial Sequence
  chemically synthesized
agaatttttgcatctaatttca

SEQ ID NO: 829139 - DNA, 22 bp, Artificial Sequence
  chemically synthesized
attgagaatttttgcatctaat

SEQ ID NO: 829140 - DNA, 22 bp, Artificial Sequence
  chemically synthesized
cattgagaatttttgcatctaa

SEQ ID NO: 829141 - DNA, 22 bp, Artificial Sequence
  chemically synthesized
gtatttcattgagaatttttgc

SEQ ID NO: 829142 - DNA, 22 bp, Artificial Sequence
  chemically synthesized
actagtatttcattgagaattt

SEQ ID NO: 829143 - DNA, 22 bp, Artificial Sequence
  chemically synthesized
gatgcaaaaattctcaatgaaa

SEQ ID NO: 829144 - DNA, 22 bp, Artificial Sequence
  chemically synthesized
aatatggttcactagtatttca

SEQ ID NO: 829145 - DNA, 22 bp, Artificial Sequence
  chemically synthesized
ttaaatatggttcactagtatt

SEQ ID NO: 829146 - DNA, 22 bp, Artificial Sequence
  chemically synthesized
tcaatgaaatactagtgaacca

SEQ ID NO: 829147 - DNA, 22 bp, Artificial Sequence
  chemically synthesized
aatgaaatactagtgaaccata

SEQ ID NO: 829148 - DNA, 22 bp, Artificial Sequence
  chemically synthesized
ataaactattaaatatggttca

SEQ ID NO: 829149 - DNA, 22 bp, Artificial Sequence
  chemically synthesized
taataaactattaaatatggtt

SEQ ID NO: 829150 - DNA, 22 bp, Artificial Sequence
  chemically synthesized
ctaataaactattaaatatggt

SEQ ID NO: 829151 - DNA, 22 bp, Artificial Sequence
  chemically synthesized
gtgaaccatatttaatagttta

SEQ ID NO: 829152 - DNA, 22 bp, Artificial Sequence
  chemically synthesized
gtcatggtgaataatccttcta

SEQ ID NO: 829153 - DNA, 22 bp, Artificial Sequence
  chemically synthesized
ggtcatggtgaataatccttct

SEQ ID NO: 829154 - DNA, 22 bp, Artificial Sequence
  chemically synthesized
aatagtttattagaaggattat

SEQ ID NO: 829155 - DNA, 22 bp, Artificial Sequence
  chemically synthesized
atagtttattagaaggattatt

SEQ ID NO: 829156 - DNA, 22 bp, Artificial Sequence
  chemically synthesized
ttggtcatggtgaataatcctt

SEQ ID NO: 829157 - DNA, 22 bp, Artificial Sequence
  chemically synthesized
attagaaggattattcaccatg

SEQ ID NO: 829158 - DNA, 22 bp, Artificial Sequence
  chemically synthesized
ttagaaggattattcaccatga

SEQ ID NO: 829159 - DNA, 22 bp, Artificial Sequence
  chemically synthesized
gaaggattattcaccatgacca

SEQ ID NO: 829160 - DNA, 22 bp, Artificial Sequence
  chemically synthesized
tcccagggataaatccctcttg

SEQ ID NO: 829161 - DNA, 22 bp, Artificial Sequence
  chemically synthesized
ttcaccatgaccaagagggatt

SEQ ID NO: 829162 - DNA, 22 bp, Artificial Sequence
  chemically synthesized
tatcccagggataaatccctct

SEQ ID NO: 829163 - DNA, 22 bp, Artificial Sequence
  chemically synthesized
ctatcccagggataaatccctc

SEQ ID NO: 829164 - DNA, 22 bp, Artificial Sequence
  chemically synthesized
accatgaccaagagggatttat

SEQ ID NO: 829165 - DNA, 22 bp, Artificial Sequence
  chemically synthesized
aaacaaccttctatcccaggga

SEQ ID NO: 829166 - DNA, 22 bp, Artificial Sequence
  chemically synthesized
catatattgaaacaaccttcta

SEQ ID NO: 829167 - DNA, 22 bp, Artificial Sequence
  chemically synthesized
gcatatattgaaacaaccttct

SEQ ID NO: 829168 - DNA, 22 bp, Artificial Sequence
  chemically synthesized
atccctgggatagaaggttgtt

SEQ ID NO: 829169 - DNA, 22 bp, Artificial Sequence
  chemically synthesized
tccctgggatagaaggttgttt

SEQ ID NO: 829170 - DNA, 22 bp, Artificial Sequence
  chemically synthesized
atttgcatatattgaaacaacc

SEQ ID NO: 829171 - DNA, 22 bp, Artificial Sequence
  chemically synthesized
ttaatttgcatatattgaaaca

SEQ ID NO: 829172 - DNA, 22 bp, Artificial Sequence
  chemically synthesized
ggatagaaggttgtttcaatat

SEQ ID NO: 829173 - DNA, 22 bp, Artificial Sequence
  chemically synthesized
attaatttgcatatattgaaac

SEQ ID NO: 829174 - DNA, 22 bp, Artificial Sequence
  chemically synthesized
aatcacatttattaatttgcat

SEQ ID NO: 829175 - DNA, 22 bp, Artificial Sequence
  chemically synthesized
tttcaatatatgcaaattaata

SEQ ID NO: 829176 - DNA, 22 bp, Artificial Sequence
  chemically synthesized
caatatatgcaaattaataaat

SEQ ID NO: 829177 - DNA, 22 bp, Artificial Sequence
  chemically synthesized
aatatatgcaaattaataaatg

SEQ ID NO: 829178 - DNA, 22 bp, Artificial Sequence
  chemically synthesized
tatgttgaatcacatttattaa

SEQ ID NO: 829179 - DNA, 22 bp, Artificial Sequence
  chemically synthesized
ttatatgttgaatcacatttat

SEQ ID NO: 829180 - DNA, 22 bp, Artificial Sequence
  chemically synthesized
tgttatatgttgaatcacattt

SEQ ID NO: 829181 - DNA, 22 bp, Artificial Sequence
  chemically synthesized
attctgttatatgttgaatcac

SEQ ID NO: 829182 - DNA, 22 bp, Artificial Sequence
  chemically synthesized
cattctgttatatgttgaatca

SEQ ID NO: 829183 - DNA, 22 bp, Artificial Sequence
  chemically synthesized
ataaatgtgattcaacatataa

SEQ ID NO: 829184 - DNA, 22 bp, Artificial Sequence
  chemically synthesized
tacttcattctgttatatgttg

SEQ ID NO: 829185 - DNA, 22 bp, Artificial Sequence
  chemically synthesized
gtacttcattctgttatatgtt

SEQ ID NO: 829186 - DNA, 22 bp, Artificial Sequence
  chemically synthesized
tgtacttcattctgttatatgt

SEQ ID NO: 829187 - DNA, 22 bp, Artificial Sequence
  chemically synthesized
ttgtacttcattctgttatatg

SEQ ID NO: 829188 - DNA, 22 bp, Artificial Sequence
  chemically synthesized
aacatataacagaatgaagtac

SEQ ID NO: 829189 - DNA, 22 bp, Artificial Sequence
  chemically synthesized
aaatgatcatacggtttttgta

SEQ ID NO: 829190 - DNA, 22 bp, Artificial Sequence
  chemically synthesized
ttaaaatgatcatacggttttt

SEQ ID NO: 829191 - DNA, 22 bp, Artificial Sequence
  chemically synthesized
attaaaatgatcatacggtttt

SEQ ID NO: 829192 - DNA, 22 bp, Artificial Sequence
  chemically synthesized
agtttattaaaatgatcatacg

SEQ ID NO: 829193 - DNA, 22 bp, Artificial Sequence
  chemically synthesized
tgagtttattaaaatgatcata

SEQ ID NO: 829194 - DNA, 22 bp, Artificial Sequence
  chemically synthesized
ctgagtttattaaaatgatcat

SEQ ID NO: 829195 - DNA, 22 bp, Artificial Sequence
  chemically synthesized
tctgagtttattaaaatgatca

SEQ ID NO: 829196 - DNA, 22 bp, Artificial Sequence
  chemically synthesized
tttctgagtttattaaaatgat

SEQ ID NO: 829197 - DNA, 22 bp, Artificial Sequence
  chemically synthesized
tcaaatgctctttctgagttta

SEQ ID NO: 829198 - DNA, 22 bp, Artificial Sequence
  chemically synthesized
gtcaaatgctctttctgagttt

SEQ ID NO: 829199 - DNA, 22 bp, Artificial Sequence
  chemically synthesized
tgtcaaatgctctttctgagtt

SEQ ID NO: 829200 - DNA, 22 bp, Artificial Sequence
  chemically synthesized
aattttgtcaaatgctctttct

SEQ ID NO: 829201 - DNA, 22 bp, Artificial Sequence
  chemically synthesized
taataaactcagaaagagcatt

SEQ ID NO: 829202 - DNA, 22 bp, Artificial Sequence
  chemically synthesized
aataaactcagaaagagcattt

SEQ ID NO: 829203 - DNA, 22 bp, Artificial Sequence
  chemically synthesized
ataaactcagaaagagcatttg

SEQ ID NO: 829204 - DNA, 22 bp, Artificial Sequence
  chemically synthesized
agaaagagcatttgacaaaatt

SEQ ID NO: 829205 - DNA, 22 bp, Artificial Sequence
  chemically synthesized
ataaaaggatgttgaattttgt

SEQ ID NO: 829206 - DNA, 22 bp, Artificial Sequence
  chemically synthesized
tcataaaaggatgttgaatttt

SEQ ID NO: 829207 - DNA, 22 bp, Artificial Sequence
  chemically synthesized
ctcataaaaggatgttgaattt

SEQ ID NO: 829208 - DNA, 22 bp, Artificial Sequence
  chemically synthesized
tctcataaaaggatgttgaatt

SEQ ID NO: 829209 - DNA, 22 bp, Artificial Sequence
  chemically synthesized
ttctcataaaaggatgttgaat

SEQ ID NO: 829210 - DNA, 22 bp, Artificial Sequence
  chemically synthesized
gacaaaattcaacatcctttta

SEQ ID NO: 829211 - DNA, 22 bp, Artificial Sequence
  chemically synthesized
acaaaattcaacatccttttat

SEQ ID NO: 829212 - DNA, 22 bp, Artificial Sequence
  chemically synthesized
agagtttttctcataaaaggat

SEQ ID NO: 829213 - DNA, 22 bp, Artificial Sequence
  chemically synthesized
ctaagagtttttctcataaaag

SEQ ID NO: 829214 - DNA, 22 bp, Artificial Sequence
  chemically synthesized
gctaagagtttttctcataaaa

SEQ ID NO: 829215 - DNA, 22 bp, Artificial Sequence
  chemically synthesized
atttgctaagagtttttctcat

SEQ ID NO: 829216 - DNA, 22 bp, Artificial Sequence
  chemically synthesized
aacatccttttatgagaaaaac

SEQ ID NO: 829217 - DNA, 22 bp, Artificial Sequence
  chemically synthesized
tacctaatttgctaagagtttt

SEQ ID NO: 829218 - DNA, 22 bp, Artificial Sequence
  chemically synthesized
tatacctaatttgctaagagtt

SEQ ID NO: 829219 - DNA, 22 bp, Artificial Sequence
  chemically synthesized
ctatacctaatttgctaagagt

SEQ ID NO: 829220 - DNA, 22 bp, Artificial Sequence
  chemically synthesized
ttatgagaaaaactcttagcaa

SEQ ID NO: 829221 - DNA, 22 bp, Artificial Sequence
  chemically synthesized
tatgagaaaaactcttagcaaa

SEQ ID NO: 829222 - DNA, 22 bp, Artificial Sequence
  chemically synthesized
ttctatacctaatttgctaaga

SEQ ID NO: 829223 - DNA, 22 bp, Artificial Sequence
  chemically synthesized
atgagaaaaactcttagcaaat

SEQ ID NO: 829224 - DNA, 22 bp, Artificial Sequence
  chemically synthesized
cttctatacctaatttgctaag

SEQ ID NO: 829225 - DNA, 22 bp, Artificial Sequence
  chemically synthesized
tgagaaaaactcttagcaaatt

SEQ ID NO: 829226 - DNA, 22 bp, Artificial Sequence
  chemically synthesized
gagaacatttcttctataccta

SEQ ID NO: 829227 - DNA, 22 bp, Artificial Sequence
  chemically synthesized
ggagaacatttcttctatacct

SEQ ID NO: 829228 - DNA, 22 bp, Artificial Sequence
  chemically synthesized
tggagaacatttcttctatacc

SEQ ID NO: 829229 - DNA, 22 bp, Artificial Sequence
  chemically synthesized
ttagcaaattaggtatagaaga

SEQ ID NO: 829230 - DNA, 22 bp, Artificial Sequence
  chemically synthesized
ttggagaacatttcttctatac

SEQ ID NO: 829231 - DNA, 22 bp, Artificial Sequence
  chemically synthesized
agcaaattaggtatagaagaaa

SEQ ID NO: 829232 - DNA, 22 bp, Artificial Sequence
  chemically synthesized
ttttggagaacatttcttctat

SEQ ID NO: 829233 - DNA, 22 bp, Artificial Sequence
  chemically synthesized
gcaaattaggtatagaagaaat

SEQ ID NO: 829234 - DNA, 22 bp, Artificial Sequence
  chemically synthesized
ttcttttggagaacatttcttc

SEQ ID NO: 829235 - DNA, 22 bp, Artificial Sequence
  chemically synthesized
attcttttggagaacatttctt

SEQ ID NO: 829236 - DNA, 22 bp, Artificial Sequence
  chemically synthesized
tattcttttggagaacatttct

SEQ ID NO: 829237 - DNA, 22 bp, Artificial Sequence
  chemically synthesized
ttattcttttggagaacatttc

SEQ ID NO: 829238 - DNA, 22 bp, Artificial Sequence
  chemically synthesized
ggtatagaagaaatgttctcca

SEQ ID NO: 829239 - DNA, 22 bp, Artificial Sequence
  chemically synthesized
tggcttttattcttttggagaa

SEQ ID NO: 829240 - DNA, 22 bp, Artificial Sequence
  chemically synthesized
atggcttttattcttttggaga

SEQ ID NO: 829241 - DNA, 22 bp, Artificial Sequence
  chemically synthesized
taatttatggcttttattcttt

SEQ ID NO: 829242 - DNA, 22 bp, Artificial Sequence
  chemically synthesized
gtaatttatggcttttattctt

SEQ ID NO: 829243 - DNA, 22 bp, Artificial Sequence
  chemically synthesized
tccaaaagaataaaagccataa

SEQ ID NO: 829244 - DNA, 22 bp, Artificial Sequence
  chemically synthesized
tgggcttgtaatttatggcttt

SEQ ID NO: 829245 - DNA, 22 bp, Artificial Sequence
  chemically synthesized
caaaagaataaaagccataaat

SEQ ID NO: 829246 - DNA, 22 bp, Artificial Sequence
  chemically synthesized
gctgtgggcttgtaatttatgg

SEQ ID NO: 829247 - DNA, 22 bp, Artificial Sequence
  chemically synthesized
tgcatgatgttagctgtgggct

SEQ ID NO: 829248 - DNA, 22 bp, Artificial Sequence
  chemically synthesized
ttgtgcatgatgttagctgtgg

SEQ ID NO: 829249 - DNA, 22 bp, Artificial Sequence
  chemically synthesized
ctgttgtgcatgatgttagctg

SEQ ID NO: 829250 - DNA, 22 bp, Artificial Sequence
  chemically synthesized
actgttgtgcatgatgttagct

SEQ ID NO: 829251 - DNA, 22 bp, Artificial Sequence
  chemically synthesized
tactgttgtgcatgatgttagc

SEQ ID NO: 829252 - DNA, 22 bp, Artificial Sequence
  chemically synthesized
caagcccacagctaacatcatg

SEQ ID NO: 829253 - DNA, 22 bp, Artificial Sequence
  chemically synthesized
cgttttactgttgtgcatgatg

SEQ ID NO: 829254 - DNA, 22 bp, Artificial Sequence
  chemically synthesized
tacgttttactgttgtgcatga

SEQ ID NO: 829255 - DNA, 22 bp, Artificial Sequence
  chemically synthesized
ctacgttttactgttgtgcatg

SEQ ID NO: 829256 - DNA, 22 bp, Artificial Sequence
  chemically synthesized
acatcatgcacaacagtaaaac

SEQ ID NO: 829257 - DNA, 22 bp, Artificial Sequence
  chemically synthesized
gagaaaagccttctacgtttta

SEQ ID NO: 829258 - DNA, 22 bp, Artificial Sequence
  chemically synthesized
agagaaaagccttctacgtttt

SEQ ID NO: 829259 - DNA, 22 bp, Artificial Sequence
  chemically synthesized
atcttagagaaaagccttctac

SEQ ID NO: 829260 - DNA, 22 bp, Artificial Sequence
  chemically synthesized
ctgatcttagagaaaagccttc

SEQ ID NO: 829261 - DNA, 22 bp, Artificial Sequence
  chemically synthesized
ctcctgatcttagagaaaagcc

SEQ ID NO: 829262 - DNA, 22 bp, Artificial Sequence
  chemically synthesized
gctcctgatcttagagaaaagc

SEQ ID NO: 829263 - DNA, 22 bp, Artificial Sequence
  chemically synthesized
tcttgctcctgatcttagagaa

SEQ ID NO: 829264 - DNA, 22 bp, Artificial Sequence
  chemically synthesized
gtcttgctcctgatcttagaga

SEQ ID NO: 829265 - DNA, 22 bp, Artificial Sequence
  chemically synthesized
tgtcttgctcctgatcttagag

SEQ ID NO: 829266 - DNA, 22 bp, Artificial Sequence
  chemically synthesized
ttctctaagatcaggagcaaga

SEQ ID NO: 829267 - DNA, 22 bp, Artificial Sequence
  chemically synthesized
tctctaagatcaggagcaagac

SEQ ID NO: 829268 - DNA, 22 bp, Artificial Sequence
  chemically synthesized
ctctaagatcaggagcaagaca

SEQ ID NO: 829269 - DNA, 22 bp, Artificial Sequence
  chemically synthesized
tctaagatcaggagcaagacaa

SEQ ID NO: 829270 - DNA, 22 bp, Artificial Sequence
  chemically synthesized
taagatcaggagcaagacaaag

SEQ ID NO: 829271 - DNA, 22 bp, Artificial Sequence
  chemically synthesized
agatcaggagcaagacaaagat

SEQ ID NO: 829272 - DNA, 22 bp, Artificial Sequence
  chemically synthesized
aacaagggtggggagagtgggc

SEQ ID NO: 829273 - DNA, 22 bp, Artificial Sequence
  chemically synthesized
agttaaacaagggtggggagag

SEQ ID NO: 829274 - DNA, 22 bp, Artificial Sequence
  chemically synthesized
ccagtactaagttaaacaaggg

SEQ ID NO: 829275 - DNA, 22 bp, Artificial Sequence
  chemically synthesized
tccccacccttgtttaacttag

SEQ ID NO: 829276 - DNA, 22 bp, Artificial Sequence
  chemically synthesized
ggactcccagtactaagttaaa

SEQ ID NO: 829277 - DNA, 22 bp, Artificial Sequence
  chemically synthesized
cccacccttgtttaacttagta

SEQ ID NO: 829278 - DNA, 22 bp, Artificial Sequence
  chemically synthesized
gctaggactcccagtactaagt

SEQ ID NO: 829279 - DNA, 22 bp, Artificial Sequence
  chemically synthesized
tggctaggactcccagtactaa

SEQ ID NO: 829280 - DNA, 22 bp, Artificial Sequence
  chemically synthesized
ctctggctaggactcccagtac

SEQ ID NO: 829281 - DNA, 22 bp, Artificial Sequence
  chemically synthesized
gtttaacttagtactgggagtc

SEQ ID NO: 829282 - DNA, 22 bp, Artificial Sequence
  chemically synthesized
tttaacttagtactgggagtcc

SEQ ID NO: 829283 - DNA, 22 bp, Artificial Sequence
  chemically synthesized
attgctctggctaggactccca

SEQ ID NO: 829284 - DNA, 22 bp, Artificial Sequence
  chemically synthesized
aacttagtactgggagtcctag

SEQ ID NO: 829285 - DNA, 22 bp, Artificial Sequence
  chemically synthesized
acttagtactgggagtcctagc

SEQ ID NO: 829286 - DNA, 22 bp, Artificial Sequence
  chemically synthesized
cctaattgctctggctaggact

SEQ ID NO: 829287 - DNA, 22 bp, Artificial Sequence
  chemically synthesized
agtactgggagtcctagccaga

SEQ ID NO: 829288 - DNA, 22 bp, Artificial Sequence
  chemically synthesized
ctgcctaattgctctggctagg

SEQ ID NO: 829289 - DNA, 22 bp, Artificial Sequence
  chemically synthesized
gtactgggagtcctagccagag

SEQ ID NO: 829290 - DNA, 22 bp, Artificial Sequence
  chemically synthesized
tcctgcctaattgctctggcta

SEQ ID NO: 829291 - DNA, 22 bp, Artificial Sequence
  chemically synthesized
ctcctgcctaattgctctggct

SEQ ID NO: 829292 - DNA, 22 bp, Artificial Sequence
  chemically synthesized
tctcctgcctaattgctctggc

SEQ ID NO: 829293 - DNA, 22 bp, Artificial Sequence
  chemically synthesized
tttctcctgcctaattgctctg

SEQ ID NO: 829294 - DNA, 22 bp, Artificial Sequence
  chemically synthesized
ggagtcctagccagagcaatta

SEQ ID NO: 829295 - DNA, 22 bp, Artificial Sequence
  chemically synthesized
ctttctcctgcctaattgctct

SEQ ID NO: 829296 - DNA, 22 bp, Artificial Sequence
  chemically synthesized
tttctttctcctgcctaattgc

SEQ ID NO: 829297 - DNA, 22 bp, Artificial Sequence
  chemically synthesized
atttctttctcctgcctaattg

SEQ ID NO: 829298 - DNA, 22 bp, Artificial Sequence
  chemically synthesized
tatttctttctcctgcctaatt

SEQ ID NO: 829299 - DNA, 22 bp, Artificial Sequence
  chemically synthesized
ttatttctttctcctgcctaat

SEQ ID NO: 829300 - DNA, 22 bp, Artificial Sequence
  chemically synthesized
gccagagcaattaggcaggaga

SEQ ID NO: 829301 - DNA, 22 bp, Artificial Sequence
  chemically synthesized
ccttttatttctttctcctgcc

SEQ ID NO: 829302 - DNA, 22 bp, Artificial Sequence
  chemically synthesized
gttgccttttatttctttctcc

SEQ ID NO: 829303 - DNA, 22 bp, Artificial Sequence
  chemically synthesized
ggttgccttttatttctttctc

SEQ ID NO: 829304 - DNA, 22 bp, Artificial Sequence
  chemically synthesized
agtttggttgccttttatttct

SEQ ID NO: 829305 - DNA, 22 bp, Artificial Sequence
  chemically synthesized
cagtttggttgccttttatttc

SEQ ID NO: 829306 - DNA, 22 bp, Artificial Sequence
  chemically synthesized
ggcaggagaaagaaataaaagg

SEQ ID NO: 829307 - DNA, 22 bp, Artificial Sequence
  chemically synthesized
tcagtttggttgccttttattt

SEQ ID NO: 829308 - DNA, 22 bp, Artificial Sequence
  chemically synthesized
ttcagtttggttgccttttatt

SEQ ID NO: 829309 - DNA, 22 bp, Artificial Sequence
  chemically synthesized
atccttttcagtttggttgcct

SEQ ID NO: 829310 - DNA, 22 bp, Artificial Sequence
  chemically synthesized
catccttttcagtttggttgcc

SEQ ID NO: 829311 - DNA, 22 bp, Artificial Sequence
  chemically synthesized
cttcatccttttcagtttggtt

SEQ ID NO: 829312 - DNA, 22 bp, Artificial Sequence
  chemically synthesized
acttcatccttttcagtttggt

SEQ ID NO: 829313 - DNA, 22 bp, Artificial Sequence
  chemically synthesized
tacttcatccttttcagtttgg

SEQ ID NO: 829314 - DNA, 22 bp, Artificial Sequence
  chemically synthesized
aaaaggatgaagtaaaattgcc

SEQ ID NO: 829315 - DNA, 22 bp, Artificial Sequence
  chemically synthesized
tgtcatcagcaagaaggggcaa

SEQ ID NO: 829316 - DNA, 22 bp, Artificial Sequence
  chemically synthesized
tataagattatgtcatcagcaa

SEQ ID NO: 829317 - DNA, 22 bp, Artificial Sequence
  chemically synthesized
ctgtataagattatgtcatcag

SEQ ID NO: 829318 - DNA, 22 bp, Artificial Sequence
  chemically synthesized
gctgtataagattatgtcatca

SEQ ID NO: 829319 - DNA, 22 bp, Artificial Sequence
  chemically synthesized
ccccttcttgctgatgacataa

SEQ ID NO: 829320 - DNA, 22 bp, Artificial Sequence
  chemically synthesized
ggatttgctgtataagattatg

SEQ ID NO: 829321 - DNA, 22 bp, Artificial Sequence
  chemically synthesized
cttgctgatgacataatcttat

SEQ ID NO: 829322 - DNA, 22 bp, Artificial Sequence
  chemically synthesized
aggatttgctgtataagattat

SEQ ID NO: 829323 - DNA, 22 bp, Artificial Sequence
  chemically synthesized
ttgctgatgacataatcttata

SEQ ID NO: 829324 - DNA, 22 bp, Artificial Sequence
  chemically synthesized
gctgatgacataatcttataca

SEQ ID NO: 829325 - DNA, 22 bp, Artificial Sequence
  chemically synthesized
ctgatgacataatcttatacag

SEQ ID NO: 829326 - DNA, 22 bp, Artificial Sequence
  chemically synthesized
atgacataatcttatacagcaa

SEQ ID NO: 829327 - DNA, 22 bp, Artificial Sequence
  chemically synthesized
agtggagtccttaggatttgct

SEQ ID NO: 829328 - DNA, 22 bp, Artificial Sequence
  chemically synthesized
cagtggagtccttaggatttgc

SEQ ID NO: 829329 - DNA, 22 bp, Artificial Sequence
  chemically synthesized
tcagtggagtccttaggatttg

SEQ ID NO: 829330 - DNA, 22 bp, Artificial Sequence
  chemically synthesized
atacagcaaatcctaaggactc

SEQ ID NO: 829331 - DNA, 22 bp, Artificial Sequence
  chemically synthesized
tacagcaaatcctaaggactcc

SEQ ID NO: 829332 - DNA, 22 bp, Artificial Sequence
  chemically synthesized
acagttttcagtggagtcctta

SEQ ID NO: 829333 - DNA, 22 bp, Artificial Sequence
  chemically synthesized
taacagttttcagtggagtcct

SEQ ID NO: 829334 - DNA, 22 bp, Artificial Sequence
  chemically synthesized
tgtatgaattctaacagttttc

SEQ ID NO: 829335 - DNA, 22 bp, Artificial Sequence
  chemically synthesized
aggactccactgaaaactgtta

SEQ ID NO: 829336 - DNA, 22 bp, Artificial Sequence
  chemically synthesized
gtgtatgaattctaacagtttt

SEQ ID NO: 829337 - DNA, 22 bp, Artificial Sequence
  chemically synthesized
aacttgtgtatgaattctaaca

SEQ ID NO: 829338 - DNA, 22 bp, Artificial Sequence
  chemically synthesized
cactgaaaactgttagaattca

SEQ ID NO: 829339 - DNA, 22 bp, Artificial Sequence
  chemically synthesized
ctaaacttgtgtatgaattcta

SEQ ID NO: 829340 - DNA, 22 bp, Artificial Sequence
  chemically synthesized
actaaacttgtgtatgaattct

SEQ ID NO: 829341 - DNA, 22 bp, Artificial Sequence
  chemically synthesized
tactaaacttgtgtatgaattc

SEQ ID NO: 829342 - DNA, 22 bp, Artificial Sequence
  chemically synthesized
aaaactgttagaattcatacac

SEQ ID NO: 829343 - DNA, 22 bp, Artificial Sequence
  chemically synthesized
caactttactaaacttgtgtat

SEQ ID NO: 829344 - DNA, 22 bp, Artificial Sequence
  chemically synthesized
ttagaattcatacacaagttta

SEQ ID NO: 829345 - DNA, 22 bp, Artificial Sequence
  chemically synthesized
gaattcatacacaagtttagta

SEQ ID NO: 829346 - DNA, 22 bp, Artificial Sequence
  chemically synthesized
taccctgcaactttactaaact

SEQ ID NO: 829347 - DNA, 22 bp, Artificial Sequence
  chemically synthesized
gtaccctgcaactttactaaac

SEQ ID NO: 829348 - DNA, 22 bp, Artificial Sequence
  chemically synthesized
tgtaccctgcaactttactaaa

SEQ ID NO: 829349 - DNA, 22 bp, Artificial Sequence
  chemically synthesized
atacacaagtttagtaaagttg

SEQ ID NO: 829350 - DNA, 22 bp, Artificial Sequence
  chemically synthesized
attttgtaccctgcaactttac

SEQ ID NO: 829351 - DNA, 22 bp, Artificial Sequence
  chemically synthesized
taagttgattttgtaccctgca

SEQ ID NO: 829352 - DNA, 22 bp, Artificial Sequence
  chemically synthesized
gtaagttgattttgtaccctgc

SEQ ID NO: 829353 - DNA, 22 bp, Artificial Sequence
  chemically synthesized
tgtaagttgattttgtaccctg

SEQ ID NO: 829354 - DNA, 22 bp, Artificial Sequence
  chemically synthesized
ttgtaagttgattttgtaccct

SEQ ID NO: 829355 - DNA, 22 bp, Artificial Sequence
  chemically synthesized
agtaaagttgcagggtacaaaa

SEQ ID NO: 829356 - DNA, 22 bp, Artificial Sequence
  chemically synthesized
gtaaagttgcagggtacaaaat

SEQ ID NO: 829357 - DNA, 22 bp, Artificial Sequence
  chemically synthesized
atttttgtaagttgattttgta

SEQ ID NO: 829358 - DNA, 22 bp, Artificial Sequence
  chemically synthesized
ctgatttttgtaagttgatttt

SEQ ID NO: 829359 - DNA, 22 bp, Artificial Sequence
  chemically synthesized
cagggtacaaaatcaacttaca

SEQ ID NO: 829360 - DNA, 22 bp, Artificial Sequence
  chemically synthesized
tcgctactgatttttgtaagtt

SEQ ID NO: 829361 - DNA, 22 bp, Artificial Sequence
  chemically synthesized
ttatcgctactgatttttgtaa

SEQ ID NO: 829362 - DNA, 22 bp, Artificial Sequence
  chemically synthesized
acaaaaatcagtagcgataaca

SEQ ID NO: 829363 - DNA, 22 bp, Artificial Sequence
  chemically synthesized
caaaaatcagtagcgataacaa

SEQ ID NO: 829364 - DNA, 22 bp, Artificial Sequence
  chemically synthesized
tacaaacaataacaattgttat

SEQ ID NO: 829365 - DNA, 22 bp, Artificial Sequence
  chemically synthesized
ttgtacaaacaataacaattgt

SEQ ID NO: 829366 - DNA, 22 bp, Artificial Sequence
  chemically synthesized
ttattgtacaaacaataacaat

SEQ ID NO: 829367 - DNA, 22 bp, Artificial Sequence
  chemically synthesized
ttgttattgtacaaacaataac

SEQ ID NO: 829368 - DNA, 22 bp, Artificial Sequence
  chemically synthesized
gttgttattgtacaaacaataa

SEQ ID NO: 829369 - DNA, 22 bp, Artificial Sequence
  chemically synthesized
gacagtttgttgttattgtaca

SEQ ID NO: 829370 - DNA, 22 bp, Artificial Sequence
  chemically synthesized
agacagtttgttgttattgtac

SEQ ID NO: 829371 - DNA, 22 bp, Artificial Sequence
  chemically synthesized
tagacagtttgttgttattgta

SEQ ID NO: 829372 - DNA, 22 bp, Artificial Sequence
  chemically synthesized
ttattgtttgtacaataacaac

SEQ ID NO: 829373 - DNA, 22 bp, Artificial Sequence
  chemically synthesized
ttttagacagtttgttgttatt

SEQ ID NO: 829374 - DNA, 22 bp, Artificial Sequence
  chemically synthesized
ttgtttgtacaataacaacaaa

SEQ ID NO: 829375 - DNA, 22 bp, Artificial Sequence
  chemically synthesized
tattttagacagtttgttgtta

SEQ ID NO: 829376 - DNA, 22 bp, Artificial Sequence
  chemically synthesized
ctattttagacagtttgttgtt

SEQ ID NO: 829377 - DNA, 22 bp, Artificial Sequence
  chemically synthesized
tttgtacaataacaacaaactg

SEQ ID NO: 829378 - DNA, 22 bp, Artificial Sequence
  chemically synthesized
atttctattttagacagtttgt

SEQ ID NO: 829379 - DNA, 22 bp, Artificial Sequence
  chemically synthesized
gtacaataacaacaaactgtct

SEQ ID NO: 829380 - DNA, 22 bp, Artificial Sequence
  chemically synthesized
aatttctattttagacagtttg

SEQ ID NO: 829381 - DNA, 22 bp, Artificial Sequence
  chemically synthesized
tacaataacaacaaactgtcta

SEQ ID NO: 829382 - DNA, 22 bp, Artificial Sequence
  chemically synthesized
cttaatttctattttagacagt

SEQ ID NO: 829383 - DNA, 22 bp, Artificial Sequence
  chemically synthesized
ccttaatttctattttagacag

SEQ ID NO: 829384 - DNA, 22 bp, Artificial Sequence
  chemically synthesized
tttccttaatttctattttaga

SEQ ID NO: 829385 - DNA, 22 bp, Artificial Sequence
  chemically synthesized
tctaaaatagaaattaaggaaa

SEQ ID NO: 829386 - DNA, 22 bp, Artificial Sequence
  chemically synthesized
taagtgagattgtttccttaat

SEQ ID NO: 829387 - DNA, 22 bp, Artificial Sequence
  chemically synthesized
ttataagtgagattgtttcctt

SEQ ID NO: 829388 - DNA, 22 bp, Artificial Sequence
  chemically synthesized
aaatagaaattaaggaaacaat

SEQ ID NO: 829389 - DNA, 22 bp, Artificial Sequence
  chemically synthesized
atgctattataagtgagattgt

SEQ ID NO: 829390 - DNA, 22 bp, Artificial Sequence
  chemically synthesized
catgctattataagtgagattg

SEQ ID NO: 829391 - DNA, 22 bp, Artificial Sequence
  chemically synthesized
tcatgctattataagtgagatt

SEQ ID NO: 829392 - DNA, 22 bp, Artificial Sequence
  chemically synthesized
ttcatgctattataagtgagat

SEQ ID NO: 829393 - DNA, 22 bp, Artificial Sequence
  chemically synthesized
tttcatgctattataagtgaga

SEQ ID NO: 829394 - DNA, 22 bp, Artificial Sequence
  chemically synthesized
aggaaacaatctcacttataat

SEQ ID NO: 829395 - DNA, 22 bp, Artificial Sequence
  chemically synthesized
caaatattttttcatgctatta

SEQ ID NO: 829396 - DNA, 22 bp, Artificial Sequence
  chemically synthesized
actccaaatattttttcatgct

SEQ ID NO: 829397 - DNA, 22 bp, Artificial Sequence
  chemically synthesized
acttataatagcatgaaaaaat

SEQ ID NO: 829398 - DNA, 22 bp, Artificial Sequence
  chemically synthesized
aattcactccaaatattttttc

SEQ ID NO: 829399 - DNA, 22 bp, Artificial Sequence
  chemically synthesized
ataatagcatgaaaaaatattt

SEQ ID NO: 829400 - DNA, 22 bp, Artificial Sequence
  chemically synthesized
taatagcatgaaaaaatatttg

SEQ ID NO: 829401 - DNA, 22 bp, Artificial Sequence
  chemically synthesized
gttaaattcactccaaatattt

SEQ ID NO: 829402 - DNA, 22 bp, Artificial Sequence
  chemically synthesized
ggttaaattcactccaaatatt

SEQ ID NO: 829403 - DNA, 22 bp, Artificial Sequence
  chemically synthesized
ttggttaaattcactccaaata

SEQ ID NO: 829404 - DNA, 22 bp, Artificial Sequence
  chemically synthesized
cttggttaaattcactccaaat

SEQ ID NO: 829405 - DNA, 22 bp, Artificial Sequence
  chemically synthesized
tcttggttaaattcactccaaa

SEQ ID NO: 829406 - DNA, 22 bp, Artificial Sequence
  chemically synthesized
actttcttggttaaattcactc

SEQ ID NO: 829407 - DNA, 22 bp, Artificial Sequence
  chemically synthesized
cactttcttggttaaattcact

SEQ ID NO: 829408 - DNA, 22 bp, Artificial Sequence
  chemically synthesized
tcactttcttggttaaattcac

SEQ ID NO: 829409 - DNA, 22 bp, Artificial Sequence
  chemically synthesized
ggagtgaatttaaccaagaaag

SEQ ID NO: 829410 - DNA, 22 bp, Artificial Sequence
  chemically synthesized
gagtgaatttaaccaagaaagt

SEQ ID NO: 829411 - DNA, 22 bp, Artificial Sequence
  chemically synthesized
aacacgcagatctttcactttc

SEQ ID NO: 829412 - DNA, 22 bp, Artificial Sequence
  chemically synthesized
caacacgcagatctttcacttt

SEQ ID NO: 829413 - DNA, 22 bp, Artificial Sequence
  chemically synthesized
aaccaagaaagtgaaagatctg

SEQ ID NO: 829414 - DNA, 22 bp, Artificial Sequence
  chemically synthesized
accaagaaagtgaaagatctgc

SEQ ID NO: 829415 - DNA, 22 bp, Artificial Sequence
  chemically synthesized
tagtttcaacacgcagatcttt

SEQ ID NO: 829416 - DNA, 22 bp, Artificial Sequence
  chemically synthesized
atagtttcaacacgcagatctt

SEQ ID NO: 829417 - DNA, 22 bp, Artificial Sequence
  chemically synthesized
gtcagtgtcttatagtttcaac

SEQ ID NO: 829418 - DNA, 22 bp, Artificial Sequence
  chemically synthesized
cgtcagtgtcttatagtttcaa

SEQ ID NO: 829419 - DNA, 22 bp, Artificial Sequence
  chemically synthesized
tcgtcagtgtcttatagtttca

SEQ ID NO: 829420 - DNA, 22 bp, Artificial Sequence
  chemically synthesized
tttcgtcagtgtcttatagttt

SEQ ID NO: 829421 - DNA, 22 bp, Artificial Sequence
  chemically synthesized
ctttcgtcagtgtcttatagtt

SEQ ID NO: 829422 - DNA, 22 bp, Artificial Sequence
  chemically synthesized
cgtgttgaaactataagacact

SEQ ID NO: 829423 - DNA, 22 bp, Artificial Sequence
  chemically synthesized
aatttctttcgtcagtgtctta

SEQ ID NO: 829424 - DNA, 22 bp, Artificial Sequence
  chemically synthesized
caatttctttcgtcagtgtctt

SEQ ID NO: 829425 - DNA, 22 bp, Artificial Sequence
  chemically synthesized
aaactataagacactgacgaaa

SEQ ID NO: 829426 - DNA, 22 bp, Artificial Sequence
  chemically synthesized
tgtcatcttcaatttctttcgt

SEQ ID NO: 829427 - DNA, 22 bp, Artificial Sequence
  chemically synthesized
gtgtcatcttcaatttctttcg

SEQ ID NO: 829428 - DNA, 22 bp, Artificial Sequence
  chemically synthesized
taagacactgacgaaagaaatt

SEQ ID NO: 829429 - DNA, 22 bp, Artificial Sequence
  chemically synthesized
tttgtgtcatcttcaatttctt

SEQ ID NO: 829430 - DNA, 22 bp, Artificial Sequence
  chemically synthesized
atttgtgtcatcttcaatttct

SEQ ID NO: 829431 - DNA, 22 bp, Artificial Sequence
  chemically synthesized
catttatttgtgtcatcttcaa

SEQ ID NO: 829432 - DNA, 22 bp, Artificial Sequence
  chemically synthesized
ccatttatttgtgtcatcttca

SEQ ID NO: 829433 - DNA, 22 bp, Artificial Sequence
  chemically synthesized
acgaaagaaattgaagatgaca

SEQ ID NO: 829434 - DNA, 22 bp, Artificial Sequence
  chemically synthesized
tccatttatttgtgtcatcttc

SEQ ID NO: 829435 - DNA, 22 bp, Artificial Sequence
  chemically synthesized
aagatgacacaaataaatggaa

SEQ ID NO: 829436 - DNA, 22 bp, Artificial Sequence
  chemically synthesized
tgaacacagaaatctttccatt

SEQ ID NO: 829437 - DNA, 22 bp, Artificial Sequence
  chemically synthesized
atgaacacagaaatctttccat

SEQ ID NO: 829438 - DNA, 22 bp, Artificial Sequence
  chemically synthesized
caatttatgaacacagaaatct

SEQ ID NO: 829439 - DNA, 22 bp, Artificial Sequence
  chemically synthesized
ccaatttatgaacacagaaatc

SEQ ID NO: 829440 - DNA, 22 bp, Artificial Sequence
  chemically synthesized
tccaatttatgaacacagaaat

SEQ ID NO: 829441 - DNA, 22 bp, Artificial Sequence
  chemically synthesized
ttccaatttatgaacacagaaa

SEQ ID NO: 829442 - DNA, 22 bp, Artificial Sequence
  chemically synthesized
atttttccaatttatgaacaca

SEQ ID NO: 829443 - DNA, 22 bp, Artificial Sequence
  chemically synthesized
acaatattaatttttccaattt

SEQ ID NO: 829444 - DNA, 22 bp, Artificial Sequence
  chemically synthesized
aacaatattaatttttccaatt

SEQ ID NO: 829445 - DNA, 22 bp, Artificial Sequence
  chemically synthesized
ctgtgttcataaattggaaaaa

SEQ ID NO: 829446 - DNA, 22 bp, Artificial Sequence
  chemically synthesized
tgtgttcataaattggaaaaat

SEQ ID NO: 829447 - DNA, 22 bp, Artificial Sequence
  chemically synthesized
tgttcataaattggaaaaatta

SEQ ID NO: 829448 - DNA, 22 bp, Artificial Sequence
  chemically synthesized
tgtttaacaatattaatttttc

SEQ ID NO: 829449 - DNA, 22 bp, Artificial Sequence
  chemically synthesized
atgtttaacaatattaattttt

SEQ ID NO: 829450 - DNA, 22 bp, Artificial Sequence
  chemically synthesized
tatgtttaacaatattaatttt

SEQ ID NO: 829451 - DNA, 22 bp, Artificial Sequence
  chemically synthesized
ataaattggaaaaattaatatt

SEQ ID NO: 829452 - DNA, 22 bp, Artificial Sequence
  chemically synthesized
ctttatgtttaacaatattaat

SEQ ID NO: 829453 - DNA, 22 bp, Artificial Sequence
  chemically synthesized
gattgctttatgtttaacaata

SEQ ID NO: 829454 - DNA, 22 bp, Artificial Sequence
  chemically synthesized
agattgctttatgtttaacaat

SEQ ID NO: 829455 - DNA, 22 bp, Artificial Sequence
  chemically synthesized
gaaaaattaatattgttaaaca

SEQ ID NO: 829456 - DNA, 22 bp, Artificial Sequence
  chemically synthesized
tagattgctttatgtttaacaa

SEQ ID NO: 829457 - DNA, 22 bp, Artificial Sequence
  chemically synthesized
atattgttaaacataaagcaat

SEQ ID NO: 829458 - DNA, 22 bp, Artificial Sequence
  chemically synthesized
tgtcgaatctttagattgcttt

SEQ ID NO: 829459 - DNA, 22 bp, Artificial Sequence
  chemically synthesized
ttaaacataaagcaatctaaag

SEQ ID NO: 829460 - DNA, 22 bp, Artificial Sequence
  chemically synthesized
gtattgtgtcgaatctttagat

SEQ ID NO: 829461 - DNA, 22 bp, Artificial Sequence
  chemically synthesized
aacataaagcaatctaaagatt

SEQ ID NO: 829462 - DNA, 22 bp, Artificial Sequence
  chemically synthesized
ttagtattgtgtcgaatcttta

SEQ ID NO: 829463 - DNA, 22 bp, Artificial Sequence
  chemically synthesized
gttagtattgtgtcgaatcttt

SEQ ID NO: 829464 - DNA, 22 bp, Artificial Sequence
  chemically synthesized
tgttagtattgtgtcgaatctt

SEQ ID NO: 829465 - DNA, 22 bp, Artificial Sequence
  chemically synthesized
aagattcgacacaatactaaca

SEQ ID NO: 829466 - DNA, 22 bp, Artificial Sequence
  chemically synthesized
gacacaatactaacaaaatctg

SEQ ID NO: 829467 - DNA, 22 bp, Artificial Sequence
  chemically synthesized
taaagaacaatatgcagatttt

SEQ ID NO: 829468 - DNA, 22 bp, Artificial Sequence
  chemically synthesized
tataaagaacaatatgcagatt

SEQ ID NO: 829469 - DNA, 22 bp, Artificial Sequence
  chemically synthesized
acaaaatctgcatattgttctt

SEQ ID NO: 829470 - DNA, 22 bp, Artificial Sequence
  chemically synthesized
aaaaaaattctataaagaacaa

SEQ ID NO: 829471 - DNA, 22 bp, Artificial Sequence
  chemically synthesized
aaaaaaaattctataaagaaca

SEQ ID NO: 829472 - DNA, 22 bp, Artificial Sequence
  chemically synthesized
taaaaaaaattctataaagaac

SEQ ID NO: 829473 - DNA, 22 bp, Artificial Sequence
  chemically synthesized
ttaaaaaaaattctataaagaa

SEQ ID NO: 829474 - DNA, 22 bp, Artificial Sequence
  chemically synthesized
tttaaaaaaaattctataaaga

SEQ ID NO: 829475 - DNA, 22 bp, Artificial Sequence
  chemically synthesized
catattgttctttatagaattt

SEQ ID NO: 829476 - DNA, 22 bp, Artificial Sequence
  chemically synthesized
ggattttttaaaaaaaattcta

SEQ ID NO: 829477 - DNA, 22 bp, Artificial Sequence
  chemically synthesized
aggattttttaaaaaaaattct

SEQ ID NO: 829478 - DNA, 22 bp, Artificial Sequence
  chemically synthesized
taggattttttaaaaaaaattc

SEQ ID NO: 829479 - DNA, 22 bp, Artificial Sequence
  chemically synthesized
ttctttatagaattttttttaa

SEQ ID NO: 829480 - DNA, 22 bp, Artificial Sequence
  chemically synthesized
tttatagaattttttttaaaaa

SEQ ID NO: 829481 - DNA, 22 bp, Artificial Sequence
  chemically synthesized
tatagaattttttttaaaaaat

SEQ ID NO: 829482 - DNA, 22 bp, Artificial Sequence
  chemically synthesized
atagaattttttttaaaaaatc

SEQ ID NO: 829483 - DNA, 22 bp, Artificial Sequence
  chemically synthesized
tagaattttttttaaaaaatcc

SEQ ID NO: 829484 - DNA, 22 bp, Artificial Sequence
  chemically synthesized
catgcaaattttaggatttttt

SEQ ID NO: 829485 - DNA, 22 bp, Artificial Sequence
  chemically synthesized
tggttccatgcaaattttagga

SEQ ID NO: 829486 - DNA, 22 bp, Artificial Sequence
  chemically synthesized
tttttaaaaaatcctaaaattt

SEQ ID NO: 829487 - DNA, 22 bp, Artificial Sequence
  chemically synthesized
gtggttccatgcaaattttagg

SEQ ID NO: 829488 - DNA, 22 bp, Artificial Sequence
  chemically synthesized
ttttaaaaaatcctaaaatttg

SEQ ID NO: 829489 - DNA, 22 bp, Artificial Sequence
  chemically synthesized
tgtggttccatgcaaattttag

SEQ ID NO: 829490 - DNA, 22 bp, Artificial Sequence
  chemically synthesized
tttaaaaaatcctaaaatttgc

SEQ ID NO: 829491 - DNA, 22 bp, Artificial Sequence
  chemically synthesized
ttgtggttccatgcaaatttta

SEQ ID NO: 829492 - DNA, 22 bp, Artificial Sequence
  chemically synthesized
ttaaaaaatcctaaaatttgca

SEQ ID NO: 829493 - DNA, 22 bp, Artificial Sequence
  chemically synthesized
taaaaaatcctaaaatttgcat

SEQ ID NO: 829494 - DNA, 22 bp, Artificial Sequence
  chemically synthesized
aaaaaatcctaaaatttgcatg

SEQ ID NO: 829495 - DNA, 22 bp, Artificial Sequence
  chemically synthesized
aaaaatcctaaaatttgcatgg

SEQ ID NO: 829496 - DNA, 22 bp, Artificial Sequence
  chemically synthesized
tccagggtcttttgtggttcca

SEQ ID NO: 829497 - DNA, 22 bp, Artificial Sequence
  chemically synthesized
aaatttgcatggaaccacaaaa

SEQ ID NO: 829498 - DNA, 22 bp, Artificial Sequence
  chemically synthesized
gctatccagggtcttttgtggt

SEQ ID NO: 829499 - DNA, 22 bp, Artificial Sequence
  chemically synthesized
ggctatccagggtcttttgtgg

SEQ ID NO: 829500 - DNA, 22 bp, Artificial Sequence
  chemically synthesized
tggctatccagggtcttttgtg

SEQ ID NO: 829501 - DNA, 22 bp, Artificial Sequence
  chemically synthesized
gcatggaaccacaaaagaccct

SEQ ID NO: 829502 - DNA, 22 bp, Artificial Sequence
  chemically synthesized
catggaaccacaaaagaccctg

SEQ ID NO: 829503 - DNA, 22 bp, Artificial Sequence
  chemically synthesized
gtaaagacagctttggctatcc

SEQ ID NO: 829504 - DNA, 22 bp, Artificial Sequence
  chemically synthesized
agtaaagacagctttggctatc

SEQ ID NO: 829505 - DNA, 22 bp, Artificial Sequence
  chemically synthesized
tagtaaagacagctttggctat

SEQ ID NO: 829506 - DNA, 22 bp, Artificial Sequence
  chemically synthesized
ttagtaaagacagctttggcta

SEQ ID NO: 829507 - DNA, 22 bp, Artificial Sequence
  chemically synthesized
tttagtaaagacagctttggct

SEQ ID NO: 829508 - DNA, 22 bp, Artificial Sequence
  chemically synthesized
tttttagtaaagacagctttgg

SEQ ID NO: 829509 - DNA, 22 bp, Artificial Sequence
  chemically synthesized
ttctttttagtaaagacagctt

SEQ ID NO: 829510 - DNA, 22 bp, Artificial Sequence
  chemically synthesized
attctttttagtaaagacagct

SEQ ID NO: 829511 - DNA, 22 bp, Artificial Sequence
  chemically synthesized
tattctttttagtaaagacagc

SEQ ID NO: 829512 - DNA, 22 bp, Artificial Sequence
  chemically synthesized
gatagccaaagctgtctttact

SEQ ID NO: 829513 - DNA, 22 bp, Artificial Sequence
  chemically synthesized
caattttattctttttagtaaa

SEQ ID NO: 829514 - DNA, 22 bp, Artificial Sequence
  chemically synthesized
ccaattttattctttttagtaa

SEQ ID NO: 829515 - DNA, 22 bp, Artificial Sequence
  chemically synthesized
tctttactaaaaagaataaaat

SEQ ID NO: 829516 - DNA, 22 bp, Artificial Sequence
  chemically synthesized
tactaaaaagaataaaattgga

SEQ ID NO: 829517 - DNA, 22 bp, Artificial Sequence
  chemically synthesized
actaaaaagaataaaattggaa

SEQ ID NO: 829518 - DNA, 22 bp, Artificial Sequence
  chemically synthesized
ctaaaaagaataaaattggaag

SEQ ID NO: 829519 - DNA, 22 bp, Artificial Sequence
  chemically synthesized
aaaagaataaaattggaagtat

SEQ ID NO: 829520 - DNA, 22 bp, Artificial Sequence
  chemically synthesized
aaatccagtagtgacatacttc

SEQ ID NO: 829521 - DNA, 22 bp, Artificial Sequence
  chemically synthesized
gaaatccagtagtgacatactt

SEQ ID NO: 829522 - DNA, 22 bp, Artificial Sequence
  chemically synthesized
tgaaatccagtagtgacatact

SEQ ID NO: 829523 - DNA, 22 bp, Artificial Sequence
  chemically synthesized
gaagtatgtcactactggattt

SEQ ID NO: 829524 - DNA, 22 bp, Artificial Sequence
  chemically synthesized
taatacattttgaaatccagta

SEQ ID NO: 829525 - DNA, 22 bp, Artificial Sequence
  chemically synthesized
gtaatacattttgaaatccagt

SEQ ID NO: 829526 - DNA, 22 bp, Artificial Sequence
  chemically synthesized
tgtaatacattttgaaatccag

SEQ ID NO: 829527 - DNA, 22 bp, Artificial Sequence
  chemically synthesized
tagctttgtaatacattttgaa

SEQ ID NO: 829528 - DNA, 22 bp, Artificial Sequence
  chemically synthesized
ttatagctttgtaatacatttt

SEQ ID NO: 829529 - DNA, 22 bp, Artificial Sequence
  chemically synthesized
ctggatttcaaaatgtattaca

SEQ ID NO: 829530 - DNA, 22 bp, Artificial Sequence
  chemically synthesized
attattatagctttgtaataca

SEQ ID NO: 829531 - DNA, 22 bp, Artificial Sequence
  chemically synthesized
gattattatagctttgtaatac

SEQ ID NO: 829532 - DNA, 22 bp, Artificial Sequence
  chemically synthesized
gatttcaaaatgtattacaaag

SEQ ID NO: 829533 - DNA, 22 bp, Artificial Sequence
  chemically synthesized
tgattattatagctttgtaata

SEQ ID NO: 829534 - DNA, 22 bp, Artificial Sequence
  chemically synthesized
ttttgattattatagctttgta

SEQ ID NO: 829535 - DNA, 22 bp, Artificial Sequence
  chemically synthesized
caaaatgtattacaaagctata

SEQ ID NO: 829536 - DNA, 22 bp, Artificial Sequence
  chemically synthesized
aaaatgtattacaaagctataa

SEQ ID NO: 829537 - DNA, 22 bp, Artificial Sequence
  chemically synthesized
ccatgctgttttgattattata

SEQ ID NO: 829538 - DNA, 22 bp, Artificial Sequence
  chemically synthesized
gccatgctgttttgattattat

SEQ ID NO: 829539 - DNA, 22 bp, Artificial Sequence
  chemically synthesized
caaagctataataatcaaaaca

SEQ ID NO: 829540 - DNA, 22 bp, Artificial Sequence
  chemically synthesized
tgtacttgccatgctgttttga

SEQ ID NO: 829541 - DNA, 22 bp, Artificial Sequence
  chemically synthesized
atgtacttgccatgctgttttg

SEQ ID NO: 829542 - DNA, 22 bp, Artificial Sequence
  chemically synthesized
tatgtacttgccatgctgtttt

SEQ ID NO: 829543 - DNA, 22 bp, Artificial Sequence
  chemically synthesized
ttatgtacttgccatgctgttt

SEQ ID NO: 829544 - DNA, 22 bp, Artificial Sequence
  chemically synthesized
taataatcaaaacagcatggca

SEQ ID NO: 829545 - DNA, 22 bp, Artificial Sequence
  chemically synthesized
tttttatgtacttgccatgctg

SEQ ID NO: 829546 - DNA, 22 bp, Artificial Sequence
  chemically synthesized
gtctgtttttatgtacttgcca

SEQ ID NO: 829547 - DNA, 22 bp, Artificial Sequence
  chemically synthesized
cattggtctgtttttatgtact

SEQ ID NO: 829548 - DNA, 22 bp, Artificial Sequence
  chemically synthesized
ttccattggtctgtttttatgt

SEQ ID NO: 829549 - DNA, 22 bp, Artificial Sequence
  chemically synthesized
attccattggtctgtttttatg

SEQ ID NO: 829550 - DNA, 22 bp, Artificial Sequence
  chemically synthesized
tcttattccattggtctgtttt

SEQ ID NO: 829551 - DNA, 22 bp, Artificial Sequence
  chemically synthesized
gtcttattccattggtctgttt

SEQ ID NO: 829552 - DNA, 22 bp, Artificial Sequence
  chemically synthesized
tgtcttattccattggtctgtt

SEQ ID NO: 829553 - DNA, 22 bp, Artificial Sequence
  chemically synthesized
tttgtcttattccattggtctg

SEQ ID NO: 829554 - DNA, 22 bp, Artificial Sequence
  chemically synthesized
gtcctctttgtcttattccatt

SEQ ID NO: 829555 - DNA, 22 bp, Artificial Sequence
  chemically synthesized
agtcctctttgtcttattccat

SEQ ID NO: 829556 - DNA, 22 bp, Artificial Sequence
  chemically synthesized
tagtcctctttgtcttattcca

SEQ ID NO: 829557 - DNA, 22 bp, Artificial Sequence
  chemically synthesized
ttttagtcctctttgtcttatt

SEQ ID NO: 829558 - DNA, 22 bp, Artificial Sequence
  chemically synthesized
attttagtcctctttgtcttat

SEQ ID NO: 829559 - DNA, 22 bp, Artificial Sequence
  chemically synthesized
atcaaaggtgtgtaggtttatt

SEQ ID NO: 829560 - DNA, 22 bp, Artificial Sequence
  chemically synthesized
aaataaacctacacacctttga

SEQ ID NO: 829561 - DNA, 22 bp, Artificial Sequence
  chemically synthesized
tcaaaaatcaattgatcaaagg

SEQ ID NO: 829562 - DNA, 22 bp, Artificial Sequence
  chemically synthesized
gtcaaaaatcaattgatcaaag

SEQ ID NO: 829563 - DNA, 22 bp, Artificial Sequence
  chemically synthesized
tgtcaaaaatcaattgatcaaa

SEQ ID NO: 829564 - DNA, 22 bp, Artificial Sequence
  chemically synthesized
cctttgtcaaaaatcaattgat

SEQ ID NO: 829565 - DNA, 22 bp, Artificial Sequence
  chemically synthesized
cacacctttgatcaattgattt

SEQ ID NO: 829566 - DNA, 22 bp, Artificial Sequence
  chemically synthesized
ctacctttgtcaaaaatcaatt

SEQ ID NO: 829567 - DNA, 22 bp, Artificial Sequence
  chemically synthesized
gctacctttgtcaaaaatcaat

SEQ ID NO: 829568 - DNA, 22 bp, Artificial Sequence
  chemically synthesized
ttgctacctttgtcaaaaatca

SEQ ID NO: 829569 - DNA, 22 bp, Artificial Sequence
  chemically synthesized
tgatcaattgatttttgacaaa

SEQ ID NO: 829570 - DNA, 22 bp, Artificial Sequence
  chemically synthesized
gatcaattgatttttgacaaag

SEQ ID NO: 829571 - DNA, 22 bp, Artificial Sequence
  chemically synthesized
atcaattgatttttgacaaagg

SEQ ID NO: 829572 - DNA, 22 bp, Artificial Sequence
  chemically synthesized
tgtgttcttgctacctttgtca

SEQ ID NO: 829573 - DNA, 22 bp, Artificial Sequence
  chemically synthesized
ttgtgtgttcttgctacctttg

SEQ ID NO: 829574 - DNA, 22 bp, Artificial Sequence
  chemically synthesized
atttttgacaaaggtagcaaga

SEQ ID NO: 829575 - DNA, 22 bp, Artificial Sequence
  chemically synthesized
cctattgtgtgttcttgctacc

SEQ ID NO: 829576 - DNA, 22 bp, Artificial Sequence
  chemically synthesized
tccctattgtgtgttcttgcta

SEQ ID NO: 829577 - DNA, 22 bp, Artificial Sequence
  chemically synthesized
ttgacaaaggtagcaagaacac

SEQ ID NO: 829578 - DNA, 22 bp, Artificial Sequence
  chemically synthesized
tgacaaaggtagcaagaacaca

SEQ ID NO: 829579 - DNA, 22 bp, Artificial Sequence
  chemically synthesized
gacaaaggtagcaagaacacac

SEQ ID NO: 829580 - DNA, 22 bp, Artificial Sequence
  chemically synthesized
acaaaggtagcaagaacacaca

SEQ ID NO: 829581 - DNA, 22 bp, Artificial Sequence
  chemically synthesized
tcctctccctattgtgtgttct

SEQ ID NO: 829582 - DNA, 22 bp, Artificial Sequence
  chemically synthesized
aagagactgtcctctccctatt

SEQ ID NO: 829583 - DNA, 22 bp, Artificial Sequence
  chemically synthesized
ttgaagagactgtcctctccct

SEQ ID NO: 829584 - DNA, 22 bp, Artificial Sequence
  chemically synthesized
attgaagagactgtcctctccc

SEQ ID NO: 829585 - DNA, 22 bp, Artificial Sequence
  chemically synthesized
ccaataccatttattgaagaga

SEQ ID NO: 829586 - DNA, 22 bp, Artificial Sequence
  chemically synthesized
cccaataccatttattgaagag

SEQ ID NO: 829587 - DNA, 22 bp, Artificial Sequence
  chemically synthesized
tcccaataccatttattgaaga

SEQ ID NO: 829588 - DNA, 22 bp, Artificial Sequence
  chemically synthesized
agttttcccaataccatttatt

SEQ ID NO: 829589 - DNA, 22 bp, Artificial Sequence
  chemically synthesized
ttcaataaatggtattgggaaa

SEQ ID NO: 829590 - DNA, 22 bp, Artificial Sequence
  chemically synthesized
caataaatggtattgggaaaac

SEQ ID NO: 829591 - DNA, 22 bp, Artificial Sequence
  chemically synthesized
aataaatggtattgggaaaact

SEQ ID NO: 829592 - DNA, 22 bp, Artificial Sequence
  chemically synthesized
tatgtgaacattcagttttccc

SEQ ID NO: 829593 - DNA, 22 bp, Artificial Sequence
  chemically synthesized
tgtatgtgaacattcagttttc

SEQ ID NO: 829594 - DNA, 22 bp, Artificial Sequence
  chemically synthesized
ttctgtatgtgaacattcagtt

SEQ ID NO: 829595 - DNA, 22 bp, Artificial Sequence
  chemically synthesized
attctgtatgtgaacattcagt

SEQ ID NO: 829596 - DNA, 22 bp, Artificial Sequence
  chemically synthesized
tattctgtatgtgaacattcag

SEQ ID NO: 829597 - DNA, 22 bp, Artificial Sequence
  chemically synthesized
ggaaaactgaatgttcacatac

SEQ ID NO: 829598 - DNA, 22 bp, Artificial Sequence
  chemically synthesized
aatgttcacatacagaataaaa

SEQ ID NO: 829599 - DNA, 22 bp, Artificial Sequence
  chemically synthesized
acatacagaataaaactggacc

SEQ ID NO: 829600 - DNA, 22 bp, Artificial Sequence
  chemically synthesized
tataaggggtgagataagggtc

SEQ ID NO: 829601 - DNA, 22 bp, Artificial Sequence
  chemically synthesized
gtataaggggtgagataagggt

SEQ ID NO: 829602 - DNA, 22 bp, Artificial Sequence
  chemically synthesized
ttgtataaggggtgagataagg

SEQ ID NO: 829603 - DNA, 22 bp, Artificial Sequence
  chemically synthesized
attcttgtataaggggtgagat

SEQ ID NO: 829604 - DNA, 22 bp, Artificial Sequence
  chemically synthesized
gacccttatctcaccccttata

SEQ ID NO: 829605 - DNA, 22 bp, Artificial Sequence
  chemically synthesized
agttgattcttgtataaggggt

SEQ ID NO: 829606 - DNA, 22 bp, Artificial Sequence
  chemically synthesized
gagttgattcttgtataagggg

SEQ ID NO: 829607 - DNA, 22 bp, Artificial Sequence
  chemically synthesized
tgagttgattcttgtataaggg

SEQ ID NO: 829608 - DNA, 22 bp, Artificial Sequence
  chemically synthesized
atctcaccccttatacaagaat

SEQ ID NO: 829609 - DNA, 22 bp, Artificial Sequence
  chemically synthesized
tctcaccccttatacaagaatc

SEQ ID NO: 829610 - DNA, 22 bp, Artificial Sequence
  chemically synthesized
atccattttgagttgattcttg

SEQ ID NO: 829611 - DNA, 22 bp, Artificial Sequence
  chemically synthesized
aatccattttgagttgattctt

SEQ ID NO: 829612 - DNA, 22 bp, Artificial Sequence
  chemically synthesized
accccttatacaagaatcaact

SEQ ID NO: 829613 - DNA, 22 bp, Artificial Sequence
  chemically synthesized
taatccattttgagttgattct

SEQ ID NO: 829614 - DNA, 22 bp, Artificial Sequence
  chemically synthesized
aggctttaatccattttgagtt

SEQ ID NO: 829615 - DNA, 22 bp, Artificial Sequence
  chemically synthesized
atacaagaatcaactcaaaatg

SEQ ID NO: 829616 - DNA, 22 bp, Artificial Sequence
  chemically synthesized
aaggctttaatccattttgagt

SEQ ID NO: 829617 - DNA, 22 bp, Artificial Sequence
  chemically synthesized
tacaagaatcaactcaaaatgg

SEQ ID NO: 829618 - DNA, 22 bp, Artificial Sequence
  chemically synthesized
catttaaggctttaatccattt

SEQ ID NO: 829619 - DNA, 22 bp, Artificial Sequence
  chemically synthesized
aggtattacatttaaggcttta

SEQ ID NO: 829620 - DNA, 22 bp, Artificial Sequence
  chemically synthesized
caggtattacatttaaggcttt

SEQ ID NO: 829621 - DNA, 22 bp, Artificial Sequence
  chemically synthesized
aaaatggattaaagccttaaat

SEQ ID NO: 829622 - DNA, 22 bp, Artificial Sequence
  chemically synthesized
gtttcaggtattacatttaagg

SEQ ID NO: 829623 - DNA, 22 bp, Artificial Sequence
  chemically synthesized
agtttcaggtattacatttaag

SEQ ID NO: 829624 - DNA, 22 bp, Artificial Sequence
  chemically synthesized
tagtttcaggtattacatttaa

SEQ ID NO: 829625 - DNA, 22 bp, Artificial Sequence
  chemically synthesized
ttagtttcaggtattacattta

SEQ ID NO: 829626 - DNA, 22 bp, Artificial Sequence
  chemically synthesized
aagccttaaatgtaatacctga

SEQ ID NO: 829627 - DNA, 22 bp, Artificial Sequence
  chemically synthesized
tagtttttagtttcaggtatta

SEQ ID NO: 829628 - DNA, 22 bp, Artificial Sequence
  chemically synthesized
gtagtttttagtttcaggtatt

SEQ ID NO: 829629 - DNA, 22 bp, Artificial Sequence
  chemically synthesized
tgtagtttttagtttcaggtat

SEQ ID NO: 829630 - DNA, 22 bp, Artificial Sequence
  chemically synthesized
ttgtagtttttagtttcaggta

SEQ ID NO: 829631 - DNA, 22 bp, Artificial Sequence
  chemically synthesized
aaatgtaatacctgaaactaaa

SEQ ID NO: 829632 - DNA, 22 bp, Artificial Sequence
  chemically synthesized
aatgtaatacctgaaactaaaa

SEQ ID NO: 829633 - DNA, 22 bp, Artificial Sequence
  chemically synthesized
tgtttttgtagtttttagtttc

SEQ ID NO: 829634 - DNA, 22 bp, Artificial Sequence
  chemically synthesized
atgtttttgtagtttttagttt

SEQ ID NO: 829635 - DNA, 22 bp, Artificial Sequence
  chemically synthesized
ttatgtttttgtagtttttagt

SEQ ID NO: 829636 - DNA, 22 bp, Artificial Sequence
  chemically synthesized
tcttatgtttttgtagttttta

SEQ ID NO: 829637 - DNA, 22 bp, Artificial Sequence
  chemically synthesized
ctcttatgtttttgtagttttt

SEQ ID NO: 829638 - DNA, 22 bp, Artificial Sequence
  chemically synthesized
ttctcttatgtttttgtagttt

SEQ ID NO: 829639 - DNA, 22 bp, Artificial Sequence
  chemically synthesized
aaactaaaaactacaaaaacat

SEQ ID NO: 829640 - DNA, 22 bp, Artificial Sequence
  chemically synthesized
aaaactacaaaaacataagaga

SEQ ID NO: 829641 - DNA, 22 bp, Artificial Sequence
  chemically synthesized
caaaaacataagagaagagctc

SEQ ID NO: 829642 - DNA, 22 bp, Artificial Sequence
  chemically synthesized
cccagaccaatgtcatggagct

SEQ ID NO: 829643 - DNA, 22 bp, Artificial Sequence
  chemically synthesized
catgacattggtctgggcagtg

SEQ ID NO: 829644 - DNA, 22 bp, Artificial Sequence
  chemically synthesized
ggggtcatatgcaagaaaccac

SEQ ID NO: 829645 - DNA, 22 bp, Artificial Sequence
  chemically synthesized
gggggtcatatgcaagaaacca

SEQ ID NO: 829646 - DNA, 22 bp, Artificial Sequence
  chemically synthesized
gtctgggcagtggtttcttgca

SEQ ID NO: 829647 - DNA, 22 bp, Artificial Sequence
  chemically synthesized
tgtttgggggtcatatgcaaga

SEQ ID NO: 829648 - DNA, 22 bp, Artificial Sequence
  chemically synthesized
ggcagtggtttcttgcatatga

SEQ ID NO: 829649 - DNA, 22 bp, Artificial Sequence
  chemically synthesized
attgtgtttgggggtcatatgc

SEQ ID NO: 829650 - DNA, 22 bp, Artificial Sequence
  chemically synthesized
tgttgattgtgtttgggggtca

SEQ ID NO: 829651 - DNA, 22 bp, Artificial Sequence
  chemically synthesized
gtgttgattgtgtttgggggtc

SEQ ID NO: 829652 - DNA, 22 bp, Artificial Sequence
  chemically synthesized
tgtgttgattgtgtttgggggt

SEQ ID NO: 829653 - DNA, 22 bp, Artificial Sequence
  chemically synthesized
ttgtgttgattgtgtttggggg

SEQ ID NO: 829654 - DNA, 22 bp, Artificial Sequence
  chemically synthesized
cttgcatatgacccccaaacac

SEQ ID NO: 829655 - DNA, 22 bp, Artificial Sequence
  chemically synthesized
ttgcatatgacccccaaacaca

SEQ ID NO: 829656 - DNA, 22 bp, Artificial Sequence
  chemically synthesized
tttttgtgttgattgtgtttgg

SEQ ID NO: 829657 - DNA, 22 bp, Artificial Sequence
  chemically synthesized
gcatatgacccccaaacacaat

SEQ ID NO: 829658 - DNA, 22 bp, Artificial Sequence
  chemically synthesized
catatgacccccaaacacaatc

SEQ ID NO: 829659 - DNA, 22 bp, Artificial Sequence
  chemically synthesized
cctatttttgtgttgattgtgt

SEQ ID NO: 829660 - DNA, 22 bp, Artificial Sequence
  chemically synthesized
acctatttttgtgttgattgtg

SEQ ID NO: 829661 - DNA, 22 bp, Artificial Sequence
  chemically synthesized
cttacctatttttgtgttgatt

SEQ ID NO: 829662 - DNA, 22 bp, Artificial Sequence
  chemically synthesized
acttacctatttttgtgttgat

SEQ ID NO: 829663 - DNA, 22 bp, Artificial Sequence
  chemically synthesized
atgcaatcttacttacctattt

SEQ ID NO: 829664 - DNA, 22 bp, Artificial Sequence
  chemically synthesized
gatgcaatcttacttacctatt

SEQ ID NO: 829665 - DNA, 22 bp, Artificial Sequence
  chemically synthesized
gtttgatgcaatcttacttacc

SEQ ID NO: 829666 - DNA, 22 bp, Artificial Sequence
  chemically synthesized
agtttgatgcaatcttacttac

SEQ ID NO: 829667 - DNA, 22 bp, Artificial Sequence
  chemically synthesized
tagtttgatgcaatcttactta

SEQ ID NO: 829668 - DNA, 22 bp, Artificial Sequence
  chemically synthesized
ttagtttgatgcaatcttactt

SEQ ID NO: 829669 - DNA, 22 bp, Artificial Sequence
  chemically synthesized
tttagtttgatgcaatcttact

SEQ ID NO: 829670 - DNA, 22 bp, Artificial Sequence
  chemically synthesized
tgcaaagctttttagtttgatg

SEQ ID NO: 829671 - DNA, 22 bp, Artificial Sequence
  chemically synthesized
ctgtgcaaagctttttagtttg

SEQ ID NO: 829672 - DNA, 22 bp, Artificial Sequence
  chemically synthesized
gctgtgcaaagctttttagttt

SEQ ID NO: 829673 - DNA, 22 bp, Artificial Sequence
  chemically synthesized
tgctgtgcaaagctttttagtt

SEQ ID NO: 829674 - DNA, 22 bp, Artificial Sequence
  chemically synthesized
ctttgctgtgcaaagcttttta

SEQ ID NO: 829675 - DNA, 22 bp, Artificial Sequence
  chemically synthesized
cctttgctgtgcaaagcttttt

SEQ ID NO: 829676 - DNA, 22 bp, Artificial Sequence
  chemically synthesized
catcaaactaaaaagctttgca

SEQ ID NO: 829677 - DNA, 22 bp, Artificial Sequence
  chemically synthesized
tttcctttgctgtgcaaagctt

SEQ ID NO: 829678 - DNA, 22 bp, Artificial Sequence
  chemically synthesized
attgtttcctttgctgtgcaaa

SEQ ID NO: 829679 - DNA, 22 bp, Artificial Sequence
  chemically synthesized
cattaattgtttcctttgctgt

SEQ ID NO: 829680 - DNA, 22 bp, Artificial Sequence
  chemically synthesized
aaaagctttgcacagcaaagga

SEQ ID NO: 829681 - DNA, 22 bp, Artificial Sequence
  chemically synthesized
ttccattaattgtttcctttgc

SEQ ID NO: 829682 - DNA, 22 bp, Artificial Sequence
  chemically synthesized
attccattaattgtttcctttg

SEQ ID NO: 829683 - DNA, 22 bp, Artificial Sequence
  chemically synthesized
tattccattaattgtttccttt

SEQ ID NO: 829684 - DNA, 22 bp, Artificial Sequence
  chemically synthesized
tttattccattaattgtttcct

SEQ ID NO: 829685 - DNA, 22 bp, Artificial Sequence
  chemically synthesized
tgcacagcaaaggaaacaatta

SEQ ID NO: 829686 - DNA, 22 bp, Artificial Sequence
  chemically synthesized
gcacagcaaaggaaacaattaa

SEQ ID NO: 829687 - DNA, 22 bp, Artificial Sequence
  chemically synthesized
cacagcaaaggaaacaattaat

SEQ ID NO: 829688 - DNA, 22 bp, Artificial Sequence
  chemically synthesized
tctctttattccattaattgtt

SEQ ID NO: 829689 - DNA, 22 bp, Artificial Sequence
  chemically synthesized
tgggttgtctctttattccatt

SEQ ID NO: 829690 - DNA, 22 bp, Artificial Sequence
  chemically synthesized
ccaatctgtgggttgtctcttt

SEQ ID NO: 829691 - DNA, 22 bp, Artificial Sequence
  chemically synthesized
tcccaatctgtgggttgtctct

SEQ ID NO: 829692 - DNA, 22 bp, Artificial Sequence
  chemically synthesized
ctcccaatctgtgggttgtctc

SEQ ID NO: 829693 - DNA, 22 bp, Artificial Sequence
  chemically synthesized
atggaataaagagacaacccac

SEQ ID NO: 829694 - DNA, 22 bp, Artificial Sequence
  chemically synthesized
caaatatcttctcccaatctgt

SEQ ID NO: 829695 - DNA, 22 bp, Artificial Sequence
  chemically synthesized
gcaaatatcttctcccaatctg

SEQ ID NO: 829696 - DNA, 22 bp, Artificial Sequence
  chemically synthesized
atgtatgatttgcaaatatctt

SEQ ID NO: 829697 - DNA, 22 bp, Artificial Sequence
  chemically synthesized
tctaatgtatgatttgcaaata

SEQ ID NO: 829698 - DNA, 22 bp, Artificial Sequence
  chemically synthesized
atctaatgtatgatttgcaaat

SEQ ID NO: 829699 - DNA, 22 bp, Artificial Sequence
  chemically synthesized
ggagaagatatttgcaaatcat

SEQ ID NO: 829700 - DNA, 22 bp, Artificial Sequence
  chemically synthesized
gcaccttatctaatgtatgatt

SEQ ID NO: 829701 - DNA, 22 bp, Artificial Sequence
  chemically synthesized
gatattagcaccttatctaatg

SEQ ID NO: 829702 - DNA, 22 bp, Artificial Sequence
  chemically synthesized
ggatattagcaccttatctaat

SEQ ID NO: 829703 - DNA, 22 bp, Artificial Sequence
  chemically synthesized
gcaaatcatacattagataagg

SEQ ID NO: 829704 - DNA, 22 bp, Artificial Sequence
  chemically synthesized
tggatattagcaccttatctaa

SEQ ID NO: 829705 - DNA, 22 bp, Artificial Sequence
  chemically synthesized
caaatcatacattagataaggt

SEQ ID NO: 829706 - DNA, 22 bp, Artificial Sequence
  chemically synthesized
tatattttggatattagcacct

SEQ ID NO: 829707 - DNA, 22 bp, Artificial Sequence
  chemically synthesized
gtatattttggatattagcacc

SEQ ID NO: 829708 - DNA, 22 bp, Artificial Sequence
  chemically synthesized
cttgtatattttggatattagc

SEQ ID NO: 829709 - DNA, 22 bp, Artificial Sequence
  chemically synthesized
gataaggtgctaatatccaaaa

SEQ ID NO: 829710 - DNA, 22 bp, Artificial Sequence
  chemically synthesized
agttccttgtatattttggata

SEQ ID NO: 829711 - DNA, 22 bp, Artificial Sequence
  chemically synthesized
gagttccttgtatattttggat

SEQ ID NO: 829712 - DNA, 22 bp, Artificial Sequence
  chemically synthesized
agtagcttgagttccttgtata

SEQ ID NO: 829713 - DNA, 22 bp, Artificial Sequence
  chemically synthesized
atatccaaaatatacaaggaac

SEQ ID NO: 829714 - DNA, 22 bp, Artificial Sequence
  chemically synthesized
ttgagtagcttgagttccttgt

SEQ ID NO: 829715 - DNA, 22 bp, Artificial Sequence
  chemically synthesized
ttattgagtagcttgagttcct

SEQ ID NO: 829716 - DNA, 22 bp, Artificial Sequence
  chemically synthesized
gttattgagtagcttgagttcc

SEQ ID NO: 829717 - DNA, 22 bp, Artificial Sequence
  chemically synthesized
ttgttattgagtagcttgagtt

SEQ ID NO: 829718 - DNA, 22 bp, Artificial Sequence
  chemically synthesized
cttgttattgagtagcttgagt

SEQ ID NO: 829719 - DNA, 22 bp, Artificial Sequence
  chemically synthesized
tcttgttattgagtagcttgag

SEQ ID NO: 829720 - DNA, 22 bp, Artificial Sequence
  chemically synthesized
ttttcttgttattgagtagctt

SEQ ID NO: 829721 - DNA, 22 bp, Artificial Sequence
  chemically synthesized
gttttcttgttattgagtagct

SEQ ID NO: 829722 - DNA, 22 bp, Artificial Sequence
  chemically synthesized
tttgttttcttgttattgagta

SEQ ID NO: 829723 - DNA, 22 bp, Artificial Sequence
  chemically synthesized
gggttatttgttttcttgttat

SEQ ID NO: 829724 - DNA, 22 bp, Artificial Sequence
  chemically synthesized
aagctactcaataacaagaaaa

SEQ ID NO: 829725 - DNA, 22 bp, Artificial Sequence
  chemically synthesized
ttagggttatttgttttcttgt

SEQ ID NO: 829726 - DNA, 22 bp, Artificial Sequence
  chemically synthesized
attagggttatttgttttcttg

SEQ ID NO: 829727 - DNA, 22 bp, Artificial Sequence
  chemically synthesized
tattagggttatttgttttctt

SEQ ID NO: 829728 - DNA, 22 bp, Artificial Sequence
  chemically synthesized
ttattagggttatttgttttct

SEQ ID NO: 829729 - DNA, 22 bp, Artificial Sequence
  chemically synthesized
tttattagggttatttgttttc

SEQ ID NO: 829730 - DNA, 22 bp, Artificial Sequence
  chemically synthesized
ctcaataacaagaaaacaaata

SEQ ID NO: 829731 - DNA, 22 bp, Artificial Sequence
  chemically synthesized
ttttattagggttatttgtttt

SEQ ID NO: 829732 - DNA, 22 bp, Artificial Sequence
  chemically synthesized
aataacaagaaaacaaataacc

SEQ ID NO: 829733 - DNA, 22 bp, Artificial Sequence
  chemically synthesized
cccatttttttattagggttat

SEQ ID NO: 829734 - DNA, 22 bp, Artificial Sequence
  chemically synthesized
gcccatttttttattagggtta

SEQ ID NO: 829735 - DNA, 22 bp, Artificial Sequence
  chemically synthesized
atatatttgcccatttttttat

SEQ ID NO: 829736 - DNA, 22 bp, Artificial Sequence
  chemically synthesized
ttcatatatttgcccatttttt

SEQ ID NO: 829737 - DNA, 22 bp, Artificial Sequence
  chemically synthesized
ataaaaaaatgggcaaatatat

SEQ ID NO: 829738 - DNA, 22 bp, Artificial Sequence
  chemically synthesized
agaatgtctattcatatatttg

SEQ ID NO: 829739 - DNA, 22 bp, Artificial Sequence
  chemically synthesized
gagaatgtctattcatatattt

SEQ ID NO: 829740 - DNA, 22 bp, Artificial Sequence
  chemically synthesized
tgagaatgtctattcatatatt

SEQ ID NO: 829741 - DNA, 22 bp, Artificial Sequence
  chemically synthesized
ttgagaatgtctattcatatat

SEQ ID NO: 829742 - DNA, 22 bp, Artificial Sequence
  chemically synthesized
tcatcttttgagaatgtctatt

SEQ ID NO: 829743 - DNA, 22 bp, Artificial Sequence
  chemically synthesized
gtcatcttttgagaatgtctat

SEQ ID NO: 829744 - DNA, 22 bp, Artificial Sequence
  chemically synthesized
tttgtcatcttttgagaatgtc

SEQ ID NO: 829745 - DNA, 22 bp, Artificial Sequence
  chemically synthesized
tcaaaagatgacaaacagcata

SEQ ID NO: 829746 - DNA, 22 bp, Artificial Sequence
  chemically synthesized
aaaagatgacaaacagcatata

SEQ ID NO: 829747 - DNA, 22 bp, Artificial Sequence
  chemically synthesized
tacatatatgtgtgtgtatata

SEQ ID NO: 829748 - DNA, 22 bp, Artificial Sequence
  chemically synthesized
agtattatacatatatgtgtgt

SEQ ID NO: 829749 - DNA, 22 bp, Artificial Sequence
  chemically synthesized
gagatgttgagtattatacata

SEQ ID NO: 829750 - DNA, 22 bp, Artificial Sequence
  chemically synthesized
atgattagagatgttgagtatt

SEQ ID NO: 829751 - DNA, 22 bp, Artificial Sequence
  chemically synthesized
gatgattagagatgttgagtat

SEQ ID NO: 829752 - DNA, 22 bp, Artificial Sequence
  chemically synthesized
tgatgattagagatgttgagta

SEQ ID NO: 829753 - DNA, 22 bp, Artificial Sequence
  chemically synthesized
ttgatgattagagatgttgagt

SEQ ID NO: 829754 - DNA, 22 bp, Artificial Sequence
  chemically synthesized
tttgatgattagagatgttgag

SEQ ID NO: 829755 - DNA, 22 bp, Artificial Sequence
  chemically synthesized
cattttttgatgattagagatg

SEQ ID NO: 829756 - DNA, 22 bp, Artificial Sequence
  chemically synthesized
gcattttttgatgattagagat

SEQ ID NO: 829757 - DNA, 22 bp, Artificial Sequence
  chemically synthesized
atttgcattttttgatgattag

SEQ ID NO: 829758 - DNA, 22 bp, Artificial Sequence
  chemically synthesized
aatttgcattttttgatgatta

SEQ ID NO: 829759 - DNA, 22 bp, Artificial Sequence
  chemically synthesized
taatttgcattttttgatgatt

SEQ ID NO: 829760 - DNA, 22 bp, Artificial Sequence
  chemically synthesized
aacatctctaatcatcaaaaaa

SEQ ID NO: 829761 - DNA, 22 bp, Artificial Sequence
  chemically synthesized
tgattttaatttgcattttttg

SEQ ID NO: 829762 - DNA, 22 bp, Artificial Sequence
  chemically synthesized
attgtgattttaatttgcattt

SEQ ID NO: 829763 - DNA, 22 bp, Artificial Sequence
  chemically synthesized
taatcatcaaaaaatgcaaatt

SEQ ID NO: 829764 - DNA, 22 bp, Artificial Sequence
  chemically synthesized
atcatcaaaaaatgcaaattaa

SEQ ID NO: 829765 - DNA, 22 bp, Artificial Sequence
  chemically synthesized
aaatcacaatgagatatcacct

SEQ ID NO: 829766 - DNA, 22 bp, Artificial Sequence
  chemically synthesized
ataatagccaatccaaaagata

SEQ ID NO: 829767 - DNA, 22 bp, Artificial Sequence
  chemically synthesized
gataatagccaatccaaaagat

SEQ ID NO: 829768 - DNA, 22 bp, Artificial Sequence
  chemically synthesized
tgataatagccaatccaaaaga

SEQ ID NO: 829769 - DNA, 22 bp, Artificial Sequence
  chemically synthesized
ttgataatagccaatccaaaag

SEQ ID NO: 829770 - DNA, 22 bp, Artificial Sequence
  chemically synthesized
tttgataatagccaatccaaaa

SEQ ID NO: 829771 - DNA, 22 bp, Artificial Sequence
  chemically synthesized
aactttttgataatagccaatc

SEQ ID NO: 829772 - DNA, 22 bp, Artificial Sequence
  chemically synthesized
caactttttgataatagccaat

SEQ ID NO: 829773 - DNA, 22 bp, Artificial Sequence
  chemically synthesized
atatcttttggattggctatta

SEQ ID NO: 829774 - DNA, 22 bp, Artificial Sequence
  chemically synthesized
tcaactttttgataatagccaa

SEQ ID NO: 829775 - DNA, 22 bp, Artificial Sequence
  chemically synthesized
tctttcaactttttgataatag

SEQ ID NO: 829776 - DNA, 22 bp, Artificial Sequence
  chemically synthesized
ttggattggctattatcaaaaa

SEQ ID NO: 829777 - DNA, 22 bp, Artificial Sequence
  chemically synthesized
ttatctttcaactttttgataa

SEQ ID NO: 829778 - DNA, 22 bp, Artificial Sequence
  chemically synthesized
tggattggctattatcaaaaag

SEQ ID NO: 829779 - DNA, 22 bp, Artificial Sequence
  chemically synthesized
gttatctttcaactttttgata

SEQ ID NO: 829780 - DNA, 22 bp, Artificial Sequence
  chemically synthesized
ggattggctattatcaaaaagt

SEQ ID NO: 829781 - DNA, 22 bp, Artificial Sequence
  chemically synthesized
gattggctattatcaaaaagtt

SEQ ID NO: 829782 - DNA, 22 bp, Artificial Sequence
  chemically synthesized
gctattatcaaaaagttgaaag

SEQ ID NO: 829783 - DNA, 22 bp, Artificial Sequence
  chemically synthesized
atgaacacttgttatctttcaa

SEQ ID NO: 829784 - DNA, 22 bp, Artificial Sequence
  chemically synthesized
ttatcaaaaagttgaaagataa

SEQ ID NO: 829785 - DNA, 22 bp, Artificial Sequence
  chemically synthesized
tcaaaaagttgaaagataacaa

SEQ ID NO: 829786 - DNA, 22 bp, Artificial Sequence
  chemically synthesized
tatcctcatgaacacttgttat

SEQ ID NO: 829787 - DNA, 22 bp, Artificial Sequence
  chemically synthesized
tgtatcctcatgaacacttgtt

SEQ ID NO: 829788 - DNA, 22 bp, Artificial Sequence
  chemically synthesized
tctgtatcctcatgaacacttg

SEQ ID NO: 829789 - DNA, 22 bp, Artificial Sequence
  chemically synthesized
ttctctgtatcctcatgaacac

SEQ ID NO: 829790 - DNA, 22 bp, Artificial Sequence
  chemically synthesized
aaagataacaagtgttcatgag

SEQ ID NO: 829791 - DNA, 22 bp, Artificial Sequence
  chemically synthesized
attctctgtatcctcatgaaca

SEQ ID NO: 829792 - DNA, 22 bp, Artificial Sequence
  chemically synthesized
cttattctctgtatcctcatga

SEQ ID NO: 829793 - DNA, 22 bp, Artificial Sequence
  chemically synthesized
ccttattctctgtatcctcatg

SEQ ID NO: 829794 - DNA, 22 bp, Artificial Sequence
  chemically synthesized
atgaggatacagagaataagga

SEQ ID NO: 829795 - DNA, 22 bp, Artificial Sequence
  chemically synthesized
ccaatagtggataaggtttcct

SEQ ID NO: 829796 - DNA, 22 bp, Artificial Sequence
  chemically synthesized
acaatactaccaatagtggata

SEQ ID NO: 829797 - DNA, 22 bp, Artificial Sequence
  chemically synthesized
attcacaatactaccaatagtg

SEQ ID NO: 829798 - DNA, 22 bp, Artificial Sequence
  chemically synthesized
ctaattcacaatactaccaata

SEQ ID NO: 829799 - DNA, 22 bp, Artificial Sequence
  chemically synthesized
atccactattggtagtattgtg

SEQ ID NO: 829800 - DNA, 22 bp, Artificial Sequence
  chemically synthesized
tccactattggtagtattgtga

SEQ ID NO: 829801 - DNA, 22 bp, Artificial Sequence
  chemically synthesized
tggaggccgttactaattcaca

SEQ ID NO: 829802 - DNA, 22 bp, Artificial Sequence
  chemically synthesized
atggaggccgttactaattcac

SEQ ID NO: 829803 - DNA, 22 bp, Artificial Sequence
  chemically synthesized
ttggtagtattgtgaattagta

SEQ ID NO: 829804 - DNA, 22 bp, Artificial Sequence
  chemically synthesized
tatggaggccgttactaattca

SEQ ID NO: 829805 - DNA, 22 bp, Artificial Sequence
  chemically synthesized
gtagtattgtgaattagtaacg

SEQ ID NO: 829806 - DNA, 22 bp, Artificial Sequence
  chemically synthesized
tctttatggaggccgttactaa

SEQ ID NO: 829807 - DNA, 22 bp, Artificial Sequence
  chemically synthesized
atactgtctttatggaggccgt

SEQ ID NO: 829808 - DNA, 22 bp, Artificial Sequence
  chemically synthesized
tgaattagtaacggcctccata

SEQ ID NO: 829809 - DNA, 22 bp, Artificial Sequence
  chemically synthesized
gtaacggcctccataaagacag

SEQ ID NO: 829810 - DNA, 22 bp, Artificial Sequence
  chemically synthesized
agaaacattcatactgtcttta

SEQ ID NO: 829811 - DNA, 22 bp, Artificial Sequence
  chemically synthesized
gagaaacattcatactgtcttt

SEQ ID NO: 829812 - DNA, 22 bp, Artificial Sequence
  chemically synthesized
tgagaaacattcatactgtctt

SEQ ID NO: 829813 - DNA, 22 bp, Artificial Sequence
  chemically synthesized
ttttgagaaacattcatactgt

SEQ ID NO: 829814 - DNA, 22 bp, Artificial Sequence
  chemically synthesized
ttattttgagaaacattcatac

SEQ ID NO: 829815 - DNA, 22 bp, Artificial Sequence
  chemically synthesized
attattttgagaaacattcata

SEQ ID NO: 829816 - DNA, 22 bp, Artificial Sequence
  chemically synthesized
cataaagacagtatgaatgttt

SEQ ID NO: 829817 - DNA, 22 bp, Artificial Sequence
  chemically synthesized
tattattttgagaaacattcat

SEQ ID NO: 829818 - DNA, 22 bp, Artificial Sequence
  chemically synthesized
ttattattttgagaaacattca

SEQ ID NO: 829819 - DNA, 22 bp, Artificial Sequence
  chemically synthesized
tttattattttgagaaacattc

SEQ ID NO: 829820 - DNA, 22 bp, Artificial Sequence
  chemically synthesized
tttttattattttgagaaacat

SEQ ID NO: 829821 - DNA, 22 bp, Artificial Sequence
  chemically synthesized
tctttttattattttgagaaac

SEQ ID NO: 829822 - DNA, 22 bp, Artificial Sequence
  chemically synthesized
ctcaaaataataaaaagagaat

SEQ ID NO: 829823 - DNA, 22 bp, Artificial Sequence
  chemically synthesized
gaacatatggtcattctctttt

SEQ ID NO: 829824 - DNA, 22 bp, Artificial Sequence
  chemically synthesized
tcaaaataataaaaagagaatg

SEQ ID NO: 829825 - DNA, 22 bp, Artificial Sequence
  chemically synthesized
tggaacatatggtcattctctt

SEQ ID NO: 829826 - DNA, 22 bp, Artificial Sequence
  chemically synthesized
aaaataataaaaagagaatgac

SEQ ID NO: 829827 - DNA, 22 bp, Artificial Sequence
  chemically synthesized
ctggaacatatggtcattctct

SEQ ID NO: 829828 - DNA, 22 bp, Artificial Sequence
  chemically synthesized
agtatgtacccagaagtgggat

SEQ ID NO: 829829 - DNA, 22 bp, Artificial Sequence
  chemically synthesized
gagtatgtacccagaagtggga

SEQ ID NO: 829830 - DNA, 22 bp, Artificial Sequence
  chemically synthesized
tgagtatgtacccagaagtggg

SEQ ID NO: 829831 - DNA, 22 bp, Artificial Sequence
  chemically synthesized
ttgagtatgtacccagaagtgg

SEQ ID NO: 829832 - DNA, 22 bp, Artificial Sequence
  chemically synthesized
ttttgagtatgtacccagaagt

SEQ ID NO: 829833 - DNA, 22 bp, Artificial Sequence
  chemically synthesized
cttttgagtatgtacccagaag

SEQ ID NO: 829834 - DNA, 22 bp, Artificial Sequence
  chemically synthesized
cagaaatcccacttctgggtac

SEQ ID NO: 829835 - DNA, 22 bp, Artificial Sequence
  chemically synthesized
tcttttgagtatgtacccagaa

SEQ ID NO: 829836 - DNA, 22 bp, Artificial Sequence
  chemically synthesized
ttcttttgagtatgtacccaga

SEQ ID NO: 829837 - DNA, 22 bp, Artificial Sequence
  chemically synthesized
cttttcttttgagtatgtaccc

SEQ ID NO: 829838 - DNA, 22 bp, Artificial Sequence
  chemically synthesized
cctccttttcttttgagtatgt

SEQ ID NO: 829839 - DNA, 22 bp, Artificial Sequence
  chemically synthesized
ctgggtacatactcaaaagaaa

SEQ ID NO: 829840 - DNA, 22 bp, Artificial Sequence
  chemically synthesized
tgggtacatactcaaaagaaaa

SEQ ID NO: 829841 - DNA, 22 bp, Artificial Sequence
  chemically synthesized
ggtacatactcaaaagaaaagg

SEQ ID NO: 829842 - DNA, 22 bp, Artificial Sequence
  chemically synthesized
aatacactccctccttttcttt

SEQ ID NO: 829843 - DNA, 22 bp, Artificial Sequence
  chemically synthesized
caatacactccctccttttctt

SEQ ID NO: 829844 - DNA, 22 bp, Artificial Sequence
  chemically synthesized
ttcaatacactccctccttttc

SEQ ID NO: 829845 - DNA, 22 bp, Artificial Sequence
  chemically synthesized
aaaagaaaaggagggagtgtat

SEQ ID NO: 829846 - DNA, 22 bp, Artificial Sequence
  chemically synthesized
caacaatgtgagagtgcagata

SEQ ID NO: 829847 - DNA, 22 bp, Artificial Sequence
  chemically synthesized
aagagctatctgcactctcaca

SEQ ID NO: 829848 - DNA, 22 bp, Artificial Sequence
  chemically synthesized
tgaacagtgctacaacaatgtg

SEQ ID NO: 829849 - DNA, 22 bp, Artificial Sequence
  chemically synthesized
tctgcactctcacattgttgta

SEQ ID NO: 829850 - DNA, 22 bp, Artificial Sequence
  chemically synthesized
ttgtgaacagtgctacaacaat

SEQ ID NO: 829851 - DNA, 22 bp, Artificial Sequence
  chemically synthesized
cactctcacattgttgtagcac

SEQ ID NO: 829852 - DNA, 22 bp, Artificial Sequence
  chemically synthesized
cctgttgtgaacagtgctacaa

SEQ ID NO: 829853 - DNA, 22 bp, Artificial Sequence
  chemically synthesized
gcctgttgtgaacagtgctaca

SEQ ID NO: 829854 - DNA, 22 bp, Artificial Sequence
  chemically synthesized
tcacattgttgtagcactgttc

SEQ ID NO: 829855 - DNA, 22 bp, Artificial Sequence
  chemically synthesized
acattgttgtagcactgttcac

SEQ ID NO: 829856 - DNA, 22 bp, Artificial Sequence
  chemically synthesized
caaatcttgcctgttgtgaaca

SEQ ID NO: 829857 - DNA, 22 bp, Artificial Sequence
  chemically synthesized
ccaaatcttgcctgttgtgaac

SEQ ID NO: 829858 - DNA, 22 bp, Artificial Sequence
  chemically synthesized
ttgtagcactgttcacaacagg

SEQ ID NO: 829859 - DNA, 22 bp, Artificial Sequence
  chemically synthesized
cttccaaatcttgcctgttgtg

SEQ ID NO: 829860 - DNA, 22 bp, Artificial Sequence
  chemically synthesized
gcttccaaatcttgcctgttgt

SEQ ID NO: 829861 - DNA, 22 bp, Artificial Sequence
  chemically synthesized
tagcactgttcacaacaggcaa

SEQ ID NO: 829862 - DNA, 22 bp, Artificial Sequence
  chemically synthesized
gcttgcttccaaatcttgcctg

SEQ ID NO: 829863 - DNA, 22 bp, Artificial Sequence
  chemically synthesized
ttcacaacaggcaagatttgga

SEQ ID NO: 829864 - DNA, 22 bp, Artificial Sequence
  chemically synthesized
acaacaggcaagatttggaagc

SEQ ID NO: 829865 - DNA, 22 bp, Artificial Sequence
  chemically synthesized
atggacagttagcttgcttcca

SEQ ID NO: 829866 - DNA, 22 bp, Artificial Sequence
  chemically synthesized
gcatgttgatggacagttagct

SEQ ID NO: 829867 - DNA, 22 bp, Artificial Sequence
  chemically synthesized
ggaagcaagctaactgtccatc

SEQ ID NO: 829868 - DNA, 22 bp, Artificial Sequence
  chemically synthesized
gaagcaagctaactgtccatca

SEQ ID NO: 829869 - DNA, 22 bp, Artificial Sequence
  chemically synthesized
tatccattcgcatgttgatgga

SEQ ID NO: 829870 - DNA, 22 bp, Artificial Sequence
  chemically synthesized
tgtatccattcgcatgttgatg

SEQ ID NO: 829871 - DNA, 22 bp, Artificial Sequence
  chemically synthesized
ctgtatccattcgcatgttgat

SEQ ID NO: 829872 - DNA, 22 bp, Artificial Sequence
  chemically synthesized
tctgtatccattcgcatgttga

SEQ ID NO: 829873 - DNA, 22 bp, Artificial Sequence
  chemically synthesized
actgtccatcaacatgcgaatg

SEQ ID NO: 829874 - DNA, 22 bp, Artificial Sequence
  chemically synthesized
tccatcaacatgcgaatggata

SEQ ID NO: 829875 - DNA, 22 bp, Artificial Sequence
  chemically synthesized
tatgagccacattttctgtatc

SEQ ID NO: 829876 - DNA, 22 bp, Artificial Sequence
  chemically synthesized
atatgagccacattttctgtat

SEQ ID NO: 829877 - DNA, 22 bp, Artificial Sequence
  chemically synthesized
aatagtaccgcatcatttatat

SEQ ID NO: 829878 - DNA, 22 bp, Artificial Sequence
  chemically synthesized
ctaaatagtaccgcatcattta

SEQ ID NO: 829879 - DNA, 22 bp, Artificial Sequence
  chemically synthesized
ttgctaaatagtaccgcatcat

SEQ ID NO: 829880 - DNA, 22 bp, Artificial Sequence
  chemically synthesized
attgctaaatagtaccgcatca

SEQ ID NO: 829881 - DNA, 22 bp, Artificial Sequence
  chemically synthesized
tattgctaaatagtaccgcatc

SEQ ID NO: 829882 - DNA, 22 bp, Artificial Sequence
  chemically synthesized
ttattgctaaatagtaccgcat

SEQ ID NO: 829883 - DNA, 22 bp, Artificial Sequence
  chemically synthesized
tttattgctaaatagtaccgca

SEQ ID NO: 829884 - DNA, 22 bp, Artificial Sequence
  chemically synthesized
ttttattgctaaatagtaccgc

SEQ ID NO: 829885 - DNA, 22 bp, Artificial Sequence
  chemically synthesized
atataaatgatgcggtactatt

SEQ ID NO: 829886 - DNA, 22 bp, Artificial Sequence
  chemically synthesized
ttttttattgctaaatagtacc

SEQ ID NO: 829887 - DNA, 22 bp, Artificial Sequence
  chemically synthesized
tttagcaataaaaaagaattat

SEQ ID NO: 829888 - DNA, 22 bp, Artificial Sequence
  chemically synthesized
caaatgacaggatataattctt

SEQ ID NO: 829889 - DNA, 22 bp, Artificial Sequence
  chemically synthesized
agcaataaaaaagaattatatc

SEQ ID NO: 829890 - DNA, 22 bp, Artificial Sequence
  chemically synthesized
gcaataaaaaagaattatatcc

SEQ ID NO: 829891 - DNA, 22 bp, Artificial Sequence
  chemically synthesized
catccaagatgttgcaaatgac

SEQ ID NO: 829892 - DNA, 22 bp, Artificial Sequence
  chemically synthesized
tatcctgtcatttgcaacatct

SEQ ID NO: 829893 - DNA, 22 bp, Artificial Sequence
  chemically synthesized
cagttccatccaagatgttgca

SEQ ID NO: 829894 - DNA, 22 bp, Artificial Sequence
  chemically synthesized
tcatttgcaacatcttggatgg

SEQ ID NO: 829895 - DNA, 22 bp, Artificial Sequence
  chemically synthesized
gcaacatcttggatggaactgg

SEQ ID NO: 829896 - DNA, 22 bp, Artificial Sequence
  chemically synthesized
atgtaatgacctccagttccat

SEQ ID NO: 829897 - DNA, 22 bp, Artificial Sequence
  chemically synthesized
caacatcttggatggaactgga

SEQ ID NO: 829898 - DNA, 22 bp, Artificial Sequence
  chemically synthesized
aatgtaatgacctccagttcca

SEQ ID NO: 829899 - DNA, 22 bp, Artificial Sequence
  chemically synthesized
atttaatgtaatgacctccagt

SEQ ID NO: 829900 - DNA, 22 bp, Artificial Sequence
  chemically synthesized
catttaatgtaatgacctccag

SEQ ID NO: 829901 - DNA, 22 bp, Artificial Sequence
  chemically synthesized
tttcatttaatgtaatgacctc

SEQ ID NO: 829902 - DNA, 22 bp, Artificial Sequence
  chemically synthesized
ggatggaactggaggtcattac

SEQ ID NO: 829903 - DNA, 22 bp, Artificial Sequence
  chemically synthesized
atttcatttaatgtaatgacct

SEQ ID NO: 829904 - DNA, 22 bp, Artificial Sequence
  chemically synthesized
gatggaactggaggtcattaca

SEQ ID NO: 829905 - DNA, 22 bp, Artificial Sequence
  chemically synthesized
gcttatttcatttaatgtaatg

SEQ ID NO: 829906 - DNA, 22 bp, Artificial Sequence
  chemically synthesized
tgactggcttatttcatttaat

SEQ ID NO: 829907 - DNA, 22 bp, Artificial Sequence
  chemically synthesized
gaggtcattacattaaatgaaa

SEQ ID NO: 829908 - DNA, 22 bp, Artificial Sequence
  chemically synthesized
tgtgactggcttatttcattta

SEQ ID NO: 829909 - DNA, 22 bp, Artificial Sequence
  chemically synthesized
gttctgtgactggcttatttca

SEQ ID NO: 829910 - DNA, 22 bp, Artificial Sequence
  chemically synthesized
cgttctgtgactggcttatttc

SEQ ID NO: 829911 - DNA, 22 bp, Artificial Sequence
  chemically synthesized
tcgttctgtgactggcttattt

SEQ ID NO: 829912 - DNA, 22 bp, Artificial Sequence
  chemically synthesized
cattaaatgaaataagccagtc

SEQ ID NO: 829913 - DNA, 22 bp, Artificial Sequence
  chemically synthesized
aatgaaataagccagtcacaga

SEQ ID NO: 829914 - DNA, 22 bp, Artificial Sequence
  chemically synthesized
gatcccacaaataagtgagaac

SEQ ID NO: 829915 - DNA, 22 bp, Artificial Sequence
  chemically synthesized
agatcccacaaataagtgagaa

SEQ ID NO: 829916 - DNA, 22 bp, Artificial Sequence
  chemically synthesized
tagatcccacaaataagtgaga

SEQ ID NO: 829917 - DNA, 22 bp, Artificial Sequence
  chemically synthesized
ttagatcccacaaataagtgag

SEQ ID NO: 829918 - DNA, 22 bp, Artificial Sequence
  chemically synthesized
atttttagatcccacaaataag

SEQ ID NO: 829919 - DNA, 22 bp, Artificial Sequence
  chemically synthesized
aatttttagatcccacaaataa

SEQ ID NO: 829920 - DNA, 22 bp, Artificial Sequence
  chemically synthesized
catgttctcacttatttgtggg

SEQ ID NO: 829921 - DNA, 22 bp, Artificial Sequence
  chemically synthesized
taatttttagatcccacaaata

SEQ ID NO: 829922 - DNA, 22 bp, Artificial Sequence
  chemically synthesized
tcacttatttgtgggatctaaa

SEQ ID NO: 829923 - DNA, 22 bp, Artificial Sequence
  chemically synthesized
aatagttttaatttttagatcc

SEQ ID NO: 829924 - DNA, 22 bp, Artificial Sequence
  chemically synthesized
acttatttgtgggatctaaaaa

SEQ ID NO: 829925 - DNA, 22 bp, Artificial Sequence
  chemically synthesized
atttgtgggatctaaaaattaa

SEQ ID NO: 829926 - DNA, 22 bp, Artificial Sequence
  chemically synthesized
tttgtgggatctaaaaattaaa

SEQ ID NO: 829927 - DNA, 22 bp, Artificial Sequence
  chemically synthesized
gtgggatctaaaaattaaaact

SEQ ID NO: 829928 - DNA, 22 bp, Artificial Sequence
  chemically synthesized
catgagttcaatagttttaatt

SEQ ID NO: 829929 - DNA, 22 bp, Artificial Sequence
  chemically synthesized
tgggatctaaaaattaaaacta

SEQ ID NO: 829930 - DNA, 22 bp, Artificial Sequence
  chemically synthesized
tctccatgagttcaatagtttt

SEQ ID NO: 829931 - DNA, 22 bp, Artificial Sequence
  chemically synthesized
tgtctccatgagttcaatagtt

SEQ ID NO: 829932 - DNA, 22 bp, Artificial Sequence
  chemically synthesized
ttctgtctccatgagttcaata

SEQ ID NO: 829933 - DNA, 22 bp, Artificial Sequence
  chemically synthesized
aaaattaaaactattgaactca

SEQ ID NO: 829934 - DNA, 22 bp, Artificial Sequence
  chemically synthesized
attctgtctccatgagttcaat

SEQ ID NO: 829935 - DNA, 22 bp, Artificial Sequence
  chemically synthesized
tattctgtctccatgagttcaa

SEQ ID NO: 829936 - DNA, 22 bp, Artificial Sequence
  chemically synthesized
ttattctgtctccatgagttca

SEQ ID NO: 829937 - DNA, 22 bp, Artificial Sequence
  chemically synthesized
aaactattgaactcatggagac

SEQ ID NO: 829938 - DNA, 22 bp, Artificial Sequence
  chemically synthesized
ttgaactcatggagacagaata

SEQ ID NO: 829939 - DNA, 22 bp, Artificial Sequence
  chemically synthesized
gtaaccatccttttattctgtc

SEQ ID NO: 829940 - DNA, 22 bp, Artificial Sequence
  chemically synthesized
aactcatggagacagaataaaa

SEQ ID NO: 829941 - DNA, 22 bp, Artificial Sequence
  chemically synthesized
tggtaaccatccttttattctg

SEQ ID NO: 829942 - DNA, 22 bp, Artificial Sequence
  chemically synthesized
atggagacagaataaaaggatg

SEQ ID NO: 829943 - DNA, 22 bp, Artificial Sequence
  chemically synthesized
tagcctctggtaaccatccttt

SEQ ID NO: 829944 - DNA, 22 bp, Artificial Sequence
  chemically synthesized
gtagcctctggtaaccatcctt

SEQ ID NO: 829945 - DNA, 22 bp, Artificial Sequence
  chemically synthesized
tgtagcctctggtaaccatcct

SEQ ID NO: 829946 - DNA, 22 bp, Artificial Sequence
  chemically synthesized
ccctttgtagcctctggtaacc

SEQ ID NO: 829947 - DNA, 22 bp, Artificial Sequence
  chemically synthesized
cacactaccctttgtagcctct

SEQ ID NO: 829948 - DNA, 22 bp, Artificial Sequence
  chemically synthesized
cctccacactaccctttgtagc

SEQ ID NO: 829949 - DNA, 22 bp, Artificial Sequence
  chemically synthesized
ccagaggctacaaagggtagtg

SEQ ID NO: 829950 - DNA, 22 bp, Artificial Sequence
  chemically synthesized
tcccctacctccacactaccct

SEQ ID NO: 829951 - DNA, 22 bp, Artificial Sequence
  chemically synthesized
caaagggtagtgtggaggtagg

SEQ ID NO: 829952 - DNA, 22 bp, Artificial Sequence
  chemically synthesized
acaatccccacctatcccctac

SEQ ID NO: 829953 - DNA, 22 bp, Artificial Sequence
  chemically synthesized
tagccgctaacaatccccacct

SEQ ID NO: 829954 - DNA, 22 bp, Artificial Sequence
  chemically synthesized
gtagccgctaacaatccccacc

SEQ ID NO: 829955 - DNA, 22 bp, Artificial Sequence
  chemically synthesized
tgtagccgctaacaatccccac

SEQ ID NO: 829956 - DNA, 22 bp, Artificial Sequence
  chemically synthesized
ttgtagccgctaacaatcccca

SEQ ID NO: 829957 - DNA, 22 bp, Artificial Sequence
  chemically synthesized
tttgtagccgctaacaatcccc

SEQ ID NO: 829958 - DNA, 22 bp, Artificial Sequence
  chemically synthesized
ttttttgtagccgctaacaatc

SEQ ID NO: 829959 - DNA, 22 bp, Artificial Sequence
  chemically synthesized
actattttttgtagccgctaac

SEQ ID NO: 829960 - DNA, 22 bp, Artificial Sequence
  chemically synthesized
taactattttttgtagccgcta

SEQ ID NO: 829961 - DNA, 22 bp, Artificial Sequence
  chemically synthesized
ctaactattttttgtagccgct

SEQ ID NO: 829962 - DNA, 22 bp, Artificial Sequence
  chemically synthesized
tctaactattttttgtagccgc

SEQ ID NO: 829963 - DNA, 22 bp, Artificial Sequence
  chemically synthesized
tttctaactattttttgtagcc

SEQ ID NO: 829964 - DNA, 22 bp, Artificial Sequence
  chemically synthesized
attctttctaactattttttgt

SEQ ID NO: 829965 - DNA, 22 bp, Artificial Sequence
  chemically synthesized
ttagcggctacaaaaaatagtt

SEQ ID NO: 829966 - DNA, 22 bp, Artificial Sequence
  chemically synthesized
ctcattctttctaactattttt

SEQ ID NO: 829967 - DNA, 22 bp, Artificial Sequence
  chemically synthesized
actcattctttctaactatttt

SEQ ID NO: 829968 - DNA, 22 bp, Artificial Sequence
  chemically synthesized
gcggctacaaaaaatagttaga

SEQ ID NO: 829969 - DNA, 22 bp, Artificial Sequence
  chemically synthesized
ggtcttactcattctttctaac

SEQ ID NO: 829970 - DNA, 22 bp, Artificial Sequence
  chemically synthesized
caaaaaatagttagaaagaatg

SEQ ID NO: 829971 - DNA, 22 bp, Artificial Sequence
  chemically synthesized
tcaaatactaggtcttactcat

SEQ ID NO: 829972 - DNA, 22 bp, Artificial Sequence
  chemically synthesized
cactatcaaatactaggtctta

SEQ ID NO: 829973 - DNA, 22 bp, Artificial Sequence
  chemically synthesized
gaaagaatgagtaagacctagt

SEQ ID NO: 829974 - DNA, 22 bp, Artificial Sequence
  chemically synthesized
ttgcactatcaaatactaggtc

SEQ ID NO: 829975 - DNA, 22 bp, Artificial Sequence
  chemically synthesized
tagtccccctgttgcactatca

SEQ ID NO: 829976 - DNA, 22 bp, Artificial Sequence
  chemically synthesized
actatagtccccctgttgcact

SEQ ID NO: 829977 - DNA, 22 bp, Artificial Sequence
  chemically synthesized
gtatttgatagtgcaacagggg

SEQ ID NO: 829978 - DNA, 22 bp, Artificial Sequence
  chemically synthesized
ttgactatagtccccctgttgc

SEQ ID NO: 829979 - DNA, 22 bp, Artificial Sequence
  chemically synthesized
ttattgactatagtccccctgt

SEQ ID NO: 829980 - DNA, 22 bp, Artificial Sequence
  chemically synthesized
gatagtgcaacagggggactat

SEQ ID NO: 829981 - DNA, 22 bp, Artificial Sequence
  chemically synthesized
atagtgcaacagggggactata

SEQ ID NO: 829982 - DNA, 22 bp, Artificial Sequence
  chemically synthesized
aattattattgactatagtccc

SEQ ID NO: 829983 - DNA, 22 bp, Artificial Sequence
  chemically synthesized
atgtacaattaaattattattg

SEQ ID NO: 829984 - DNA, 22 bp, Artificial Sequence
  chemically synthesized
aatgtacaattaaattattatt

SEQ ID NO: 829985 - DNA, 22 bp, Artificial Sequence
  chemically synthesized
taatgtacaattaaattattat

SEQ ID NO: 829986 - DNA, 22 bp, Artificial Sequence
  chemically synthesized
ttaatgtacaattaaattatta

SEQ ID NO: 829987 - DNA, 22 bp, Artificial Sequence
  chemically synthesized
tttaatgtacaattaaattatt

SEQ ID NO: 829988 - DNA, 22 bp, Artificial Sequence
  chemically synthesized
ttttttaatgtacaattaaatt

SEQ ID NO: 829989 - DNA, 22 bp, Artificial Sequence
  chemically synthesized
tagtcaataataatttaattgt

SEQ ID NO: 829990 - DNA, 22 bp, Artificial Sequence
  chemically synthesized
gttattttttaatgtacaatta

SEQ ID NO: 829991 - DNA, 22 bp, Artificial Sequence
  chemically synthesized
agttattttttaatgtacaatt

SEQ ID NO: 829992 - DNA, 22 bp, Artificial Sequence
  chemically synthesized
tagttattttttaatgtacaat

SEQ ID NO: 829993 - DNA, 22 bp, Artificial Sequence
  chemically synthesized
ttagttattttttaatgtacaa

SEQ ID NO: 829994 - DNA, 22 bp, Artificial Sequence
  chemically synthesized
tacttttagttattttttaatg

SEQ ID NO: 829995 - DNA, 22 bp, Artificial Sequence
  chemically synthesized
aattgtacattaaaaaataact

SEQ ID NO: 829996 - DNA, 22 bp, Artificial Sequence
  chemically synthesized
attgtacattaaaaaataacta

SEQ ID NO: 829997 - DNA, 22 bp, Artificial Sequence
  chemically synthesized
tacattaaaaaataactaaaag

SEQ ID NO: 829998 - DNA, 22 bp, Artificial Sequence
  chemically synthesized
caaacaatgtaattgtactttt

SEQ ID NO: 829999 - DNA, 22 bp, Artificial Sequence
  chemically synthesized
aaaaataactaaaagtacaatt

SEQ ID NO: 830000 - DNA, 22 bp, Artificial Sequence
  chemically synthesized
tgctacaaacaatgtaattgta

SEQ ID NO: 830001 - DNA, 22 bp, Artificial Sequence
  chemically synthesized
gtgctacaaacaatgtaattgt

SEQ ID NO: 830002 - DNA, 22 bp, Artificial Sequence
  chemically synthesized
tgtgctacaaacaatgtaattg

SEQ ID NO: 830003 - DNA, 22 bp, Artificial Sequence
  chemically synthesized
tcctttgtgctacaaacaatgt

SEQ ID NO: 830004 - DNA, 22 bp, Artificial Sequence
  chemically synthesized
aaagtacaattacattgtttgt

SEQ ID NO: 830005 - DNA, 22 bp, Artificial Sequence
  chemically synthesized
atcctttgtgctacaaacaatg

SEQ ID NO: 830006 - DNA, 22 bp, Artificial Sequence
  chemically synthesized
tcaagcatttatcctttgtgct

SEQ ID NO: 830007 - DNA, 22 bp, Artificial Sequence
  chemically synthesized
cattgtttgtagcacaaaggat

SEQ ID NO: 830008 - DNA, 22 bp, Artificial Sequence
  chemically synthesized
tttgtagcacaaaggataaatg

SEQ ID NO: 830009 - DNA, 22 bp, Artificial Sequence
  chemically synthesized
gtagcacaaaggataaatgctt

SEQ ID NO: 830010 - DNA, 22 bp, Artificial Sequence
  chemically synthesized
tagcacaaaggataaatgcttg

SEQ ID NO: 830011 - DNA, 22 bp, Artificial Sequence
  chemically synthesized
gacaggatggatgcctcattct

SEQ ID NO: 830012 - DNA, 22 bp, Artificial Sequence
  chemically synthesized
acaggatggatgcctcattctc

SEQ ID NO: 830013 - DNA, 22 bp, Artificial Sequence
  chemically synthesized
attctccatgatgtgcttgttt

SEQ ID NO: 830014 - DNA, 22 bp, Artificial Sequence
  chemically synthesized
tccatgatgtgcttgtttcaca

SEQ ID NO: 830015 - DNA, 22 bp, Artificial Sequence
  chemically synthesized
catgatgtgcttgtttcacatt

SEQ ID NO: 830016 - DNA, 22 bp, Artificial Sequence
  chemically synthesized
atataggcatgtaatgtgaaac

SEQ ID NO: 830017 - DNA, 22 bp, Artificial Sequence
  chemically synthesized
gatataggcatgtaatgtgaaa

SEQ ID NO: 830018 - DNA, 22 bp, Artificial Sequence
  chemically synthesized
tgatataggcatgtaatgtgaa

SEQ ID NO: 830019 - DNA, 22 bp, Artificial Sequence
  chemically synthesized
gtttcacattacatgcctatat

SEQ ID NO: 830020 - DNA, 22 bp, Artificial Sequence
  chemically synthesized
tttcacattacatgcctatatc

SEQ ID NO: 830021 - DNA, 22 bp, Artificial Sequence
  chemically synthesized
cacattacatgcctatatcaaa

SEQ ID NO: 830022 - DNA, 22 bp, Artificial Sequence
  chemically synthesized
acattacatgcctatatcaaaa

SEQ ID NO: 830023 - DNA, 22 bp, Artificial Sequence
  chemically synthesized
cggggtacatgaggtgttttga

SEQ ID NO: 830024 - DNA, 22 bp, Artificial Sequence
  chemically synthesized
acggggtacatgaggtgttttg

SEQ ID NO: 830025 - DNA, 22 bp, Artificial Sequence
  chemically synthesized
catgcctatatcaaaacacctc

SEQ ID NO: 830026 - DNA, 22 bp, Artificial Sequence
  chemically synthesized
tatcaaaacacctcatgtaccc

SEQ ID NO: 830027 - DNA, 22 bp, Artificial Sequence
  chemically synthesized
atgtaccccgtaaatatatata

SEQ ID NO: 830028 - DNA, 22 bp, Artificial Sequence
  chemically synthesized
gggtacatagtaggtatatata

SEQ ID NO: 830029 - DNA, 22 bp, Artificial Sequence
  chemically synthesized
ggggtacatagtaggtatatat

SEQ ID NO: 830030 - DNA, 22 bp, Artificial Sequence
  chemically synthesized
tggggtacatagtaggtatata

SEQ ID NO: 830031 - DNA, 22 bp, Artificial Sequence
  chemically synthesized
ttggggtacatagtaggtatat

SEQ ID NO: 830032 - DNA, 22 bp, Artificial Sequence
  chemically synthesized
tttggggtacatagtaggtata

SEQ ID NO: 830033 - DNA, 22 bp, Artificial Sequence
  chemically synthesized
attttttggggtacatagtagg

SEQ ID NO: 830034 - DNA, 22 bp, Artificial Sequence
  chemically synthesized
aattttttggggtacatagtag

SEQ ID NO: 830035 - DNA, 22 bp, Artificial Sequence
  chemically synthesized
taattttttggggtacatagta

SEQ ID NO: 830036 - DNA, 22 bp, Artificial Sequence
  chemically synthesized
ttaattttttggggtacatagt

SEQ ID NO: 830037 - DNA, 22 bp, Artificial Sequence
  chemically synthesized
tttttaattttttggggtacat

SEQ ID NO: 830038 - DNA, 22 bp, Artificial Sequence
  chemically synthesized
atttttaattttttggggtaca

SEQ ID NO: 830039 - DNA, 22 bp, Artificial Sequence
  chemically synthesized
tatttttaattttttggggtac

SEQ ID NO: 830040 - DNA, 22 bp, Artificial Sequence
  chemically synthesized
ttatttttaattttttggggta

SEQ ID NO: 830041 - DNA, 22 bp, Artificial Sequence
  chemically synthesized
tttatttttaattttttggggt

SEQ ID NO: 830042 - DNA, 22 bp, Artificial Sequence
  chemically synthesized
ttttatttttaattttttgggg

SEQ ID NO: 830043 - DNA, 22 bp, Artificial Sequence
  chemically synthesized
tttttatttttaattttttggg

SEQ ID NO: 830044 - DNA, 22 bp, Artificial Sequence
  chemically synthesized
ttttttatttttaattttttgg

SEQ ID NO: 830045 - DNA, 22 bp, Artificial Sequence
  chemically synthesized
tttttttatttttaattttttg

SEQ ID NO: 830046 - DNA, 22 bp, Artificial Sequence
  chemically synthesized
ctatgtaccccaaaaaattaaa

SEQ ID NO: 830047 - DNA, 22 bp, Artificial Sequence
  chemically synthesized
tgtaccccaaaaaattaaaaat

SEQ ID NO: 830048 - DNA, 22 bp, Artificial Sequence
  chemically synthesized
aaattttttttttatttttaat

SEQ ID NO: 830049 - DNA, 22 bp, Artificial Sequence
  chemically synthesized
aaaattttttttttatttttaa

SEQ ID NO: 830050 - DNA, 22 bp, Artificial Sequence
  chemically synthesized
taaaattttttttttattttta

SEQ ID NO: 830051 - DNA, 22 bp, Artificial Sequence
  chemically synthesized
ttaaaattttttttttattttt

SEQ ID NO: 830052 - DNA, 22 bp, Artificial Sequence
  chemically synthesized
ggtttttaaaatttttttttta

SEQ ID NO: 830053 - DNA, 22 bp, Artificial Sequence
  chemically synthesized
ctaggtttttaaaatttttttt

SEQ ID NO: 830054 - DNA, 22 bp, Artificial Sequence
  chemically synthesized
cctaggtttttaaaattttttt

SEQ ID NO: 830055 - DNA, 22 bp, Artificial Sequence
  chemically synthesized
aaaataaaaaaaaaattttaaa

SEQ ID NO: 830056 - DNA, 22 bp, Artificial Sequence
  chemically synthesized
caaatgacagaatttcctaggt

SEQ ID NO: 830057 - DNA, 22 bp, Artificial Sequence
  chemically synthesized
ttccaaatgacagaatttccta

SEQ ID NO: 830058 - DNA, 22 bp, Artificial Sequence
  chemically synthesized
ttattccaaatgacagaatttc

SEQ ID NO: 830059 - DNA, 22 bp, Artificial Sequence
  chemically synthesized
taaaaacctaggaaattctgtc

SEQ ID NO: 830060 - DNA, 22 bp, Artificial Sequence
  chemically synthesized
attattccaaatgacagaattt

SEQ ID NO: 830061 - DNA, 22 bp, Artificial Sequence
  chemically synthesized
aaaaacctaggaaattctgtca

SEQ ID NO: 830062 - DNA, 22 bp, Artificial Sequence
  chemically synthesized
aaaacctaggaaattctgtcat

SEQ ID NO: 830063 - DNA, 22 bp, Artificial Sequence
  chemically synthesized
atccttattattccaaatgaca

SEQ ID NO: 830064 - DNA, 22 bp, Artificial Sequence
  chemically synthesized
ggaaattctgtcatttggaata

SEQ ID NO: 830065 - DNA, 22 bp, Artificial Sequence
  chemically synthesized
caggctcatccttattattcca

SEQ ID NO: 830066 - DNA, 22 bp, Artificial Sequence
  chemically synthesized
tgtcatttggaataataaggat

SEQ ID NO: 830067 - DNA, 22 bp, Artificial Sequence
  chemically synthesized
tcatttggaataataaggatga

SEQ ID NO: 830068 - DNA, 22 bp, Artificial Sequence
  chemically synthesized
atgtcctccaggctcatcctta

SEQ ID NO: 830069 - DNA, 22 bp, Artificial Sequence
  chemically synthesized
ggaataataaggatgagcctgg

SEQ ID NO: 830070 - DNA, 22 bp, Artificial Sequence
  chemically synthesized
acctaatgtcctccaggctcat

SEQ ID NO: 830071 - DNA, 22 bp, Artificial Sequence
  chemically synthesized
gaataataaggatgagcctgga

SEQ ID NO: 830072 - DNA, 22 bp, Artificial Sequence
  chemically synthesized
aacctaatgtcctccaggctca

SEQ ID NO: 830073 - DNA, 22 bp, Artificial Sequence
  chemically synthesized
acttaacctaatgtcctccagg

SEQ ID NO: 830074 - DNA, 22 bp, Artificial Sequence
  chemically synthesized
cacttaacctaatgtcctccag

SEQ ID NO: 830075 - DNA, 22 bp, Artificial Sequence
  chemically synthesized
tttcacttaacctaatgtcctc

SEQ ID NO: 830076 - DNA, 22 bp, Artificial Sequence
  chemically synthesized
atttcacttaacctaatgtcct

SEQ ID NO: 830077 - DNA, 22 bp, Artificial Sequence
  chemically synthesized
tgccaagtttatttcacttaac

SEQ ID NO: 830078 - DNA, 22 bp, Artificial Sequence
  chemically synthesized
gaggacattaggttaagtgaaa

SEQ ID NO: 830079 - DNA, 22 bp, Artificial Sequence
  chemically synthesized
tgtgccaagtttatttcactta

SEQ ID NO: 830080 - DNA, 22 bp, Artificial Sequence
  chemically synthesized
tctgtgccaagtttatttcact

SEQ ID NO: 830081 - DNA, 22 bp, Artificial Sequence
  chemically synthesized
ggttaagtgaaataaacttggc

SEQ ID NO: 830082 - DNA, 22 bp, Artificial Sequence
  chemically synthesized
agtgaaataaacttggcacaga

SEQ ID NO: 830083 - DNA, 22 bp, Artificial Sequence
  chemically synthesized
tatgatatgtgtctctctgtgc

SEQ ID NO: 830084 - DNA, 22 bp, Artificial Sequence
  chemically synthesized
ggcacagagagacacatatcat

SEQ ID NO: 830085 - DNA, 22 bp, Artificial Sequence
  chemically synthesized
gcacagagagacacatatcata

SEQ ID NO: 830086 - DNA, 22 bp, Artificial Sequence
  chemically synthesized
cacatacaaatgagattatatg

SEQ ID NO: 830087 - DNA, 22 bp, Artificial Sequence
  chemically synthesized
aactgcacatacaaatgagatt

SEQ ID NO: 830088 - DNA, 22 bp, Artificial Sequence
  chemically synthesized
aaactgcacatacaaatgagat

SEQ ID NO: 830089 - DNA, 22 bp, Artificial Sequence
  chemically synthesized
taaactgcacatacaaatgaga

SEQ ID NO: 830090 - DNA, 22 bp, Artificial Sequence
  chemically synthesized
ttaaactgcacatacaaatgag

SEQ ID NO: 830091 - DNA, 22 bp, Artificial Sequence
  chemically synthesized
tttaaactgcacatacaaatga

SEQ ID NO: 830092 - DNA, 22 bp, Artificial Sequence
  chemically synthesized
ttttaaactgcacatacaaatg

SEQ ID NO: 830093 - DNA, 22 bp, Artificial Sequence
  chemically synthesized
tttttaaactgcacatacaaat

SEQ ID NO: 830094 - DNA, 22 bp, Artificial Sequence
  chemically synthesized
aactttttttaaactgcacata

SEQ ID NO: 830095 - DNA, 22 bp, Artificial Sequence
  chemically synthesized
atttgtatgtgcagtttaaaaa

SEQ ID NO: 830096 - DNA, 22 bp, Artificial Sequence
  chemically synthesized
tgagttcaactttttttaaact

SEQ ID NO: 830097 - DNA, 22 bp, Artificial Sequence
  chemically synthesized
tatgagttcaactttttttaaa

SEQ ID NO: 830098 - DNA, 22 bp, Artificial Sequence
  chemically synthesized
ctatgagttcaactttttttaa

SEQ ID NO: 830099 - DNA, 22 bp, Artificial Sequence
  chemically synthesized
gtatgtgcagtttaaaaaaagt

SEQ ID NO: 830100 - DNA, 22 bp, Artificial Sequence
  chemically synthesized
tatgtgcagtttaaaaaaagtt

SEQ ID NO: 830101 - DNA, 22 bp, Artificial Sequence
  chemically synthesized
catttctatgagttcaactttt

SEQ ID NO: 830102 - DNA, 22 bp, Artificial Sequence
  chemically synthesized
tccatttctatgagttcaactt

SEQ ID NO: 830103 - DNA, 22 bp, Artificial Sequence
  chemically synthesized
aaaaaaagttgaactcatagaa

SEQ ID NO: 830104 - DNA, 22 bp, Artificial Sequence
  chemically synthesized
aaaaaagttgaactcatagaaa

SEQ ID NO: 830105 - DNA, 22 bp, Artificial Sequence
  chemically synthesized
aactcatagaaatggagagtat

SEQ ID NO: 830106 - DNA, 22 bp, Artificial Sequence
  chemically synthesized
atcaccaccataatactctcca

SEQ ID NO: 830107 - DNA, 22 bp, Artificial Sequence
  chemically synthesized
gatcaccaccataatactctcc

SEQ ID NO: 830108 - DNA, 22 bp, Artificial Sequence
  chemically synthesized
tgatcaccaccataatactctc

SEQ ID NO: 830109 - DNA, 22 bp, Artificial Sequence
  chemically synthesized
ttgatcaccaccataatactct

SEQ ID NO: 830110 - DNA, 22 bp, Artificial Sequence
  chemically synthesized
atagaaatggagagtattatgg

SEQ ID NO: 830111 - DNA, 22 bp, Artificial Sequence
  chemically synthesized
cagcttttgatcaccaccataa

SEQ ID NO: 830112 - DNA, 22 bp, Artificial Sequence
  chemically synthesized
tggtggtgatcaaaagctgcag

SEQ ID NO: 830113 - DNA, 22 bp, Artificial Sequence
  chemically synthesized
catccacccaccactgcagctt

SEQ ID NO: 830114 - DNA, 22 bp, Artificial Sequence
  chemically synthesized
ccatccacccaccactgcagct

SEQ ID NO: 830115 - DNA, 22 bp, Artificial Sequence
  chemically synthesized
tccatccacccaccactgcagc

SEQ ID NO: 830116 - DNA, 22 bp, Artificial Sequence
  chemically synthesized
ttccatccacccaccactgcag

SEQ ID NO: 830117 - DNA, 22 bp, Artificial Sequence
  chemically synthesized
atttttccatccacccaccact

SEQ ID NO: 830118 - DNA, 22 bp, Artificial Sequence
  chemically synthesized
tcatttttccatccacccacca

SEQ ID NO: 830119 - DNA, 22 bp, Artificial Sequence
  chemically synthesized
cagtggtgggtggatggaaaaa

SEQ ID NO: 830120 - DNA, 22 bp, Artificial Sequence
  chemically synthesized
ataaacgtctctcatttttcca

SEQ ID NO: 830121 - DNA, 22 bp, Artificial Sequence
  chemically synthesized
tacccattgataaacgtctctc

SEQ ID NO: 830122 - DNA, 22 bp, Artificial Sequence
  chemically synthesized
gtacccattgataaacgtctct

SEQ ID NO: 830123 - DNA, 22 bp, Artificial Sequence
  chemically synthesized
tgtacccattgataaacgtctc

SEQ ID NO: 830124 - DNA, 22 bp, Artificial Sequence
  chemically synthesized
gaactttgtacccattgataaa

SEQ ID NO: 830125 - DNA, 22 bp, Artificial Sequence
  chemically synthesized
actggaactttgtacccattga

SEQ ID NO: 830126 - DNA, 22 bp, Artificial Sequence
  chemically synthesized
tctaactggaactttgtaccca

SEQ ID NO: 830127 - DNA, 22 bp, Artificial Sequence
  chemically synthesized
ctgtctaactggaactttgtac

SEQ ID NO: 830128 - DNA, 22 bp, Artificial Sequence
  chemically synthesized
ctcctgtctaactggaactttg

SEQ ID NO: 830129 - DNA, 22 bp, Artificial Sequence
  chemically synthesized
atcaatgggtacaaagttccag

SEQ ID NO: 830130 - DNA, 22 bp, Artificial Sequence
  chemically synthesized
tcaatgggtacaaagttccagt

SEQ ID NO: 830131 - DNA, 22 bp, Artificial Sequence
  chemically synthesized
ttcctcctgtctaactggaact

SEQ ID NO: 830132 - DNA, 22 bp, Artificial Sequence
  chemically synthesized
attcctcctgtctaactggaac

SEQ ID NO: 830133 - DNA, 22 bp, Artificial Sequence
  chemically synthesized
cagttagacaggaggaataagt

SEQ ID NO: 830134 - DNA, 22 bp, Artificial Sequence
  chemically synthesized
tgcaaaagaacaccagaactta

SEQ ID NO: 830135 - DNA, 22 bp, Artificial Sequence
  chemically synthesized
gacaggaggaataagttctggt

SEQ ID NO: 830136 - DNA, 22 bp, Artificial Sequence
  chemically synthesized
tgctgtgcaaaagaacaccaga

SEQ ID NO: 830137 - DNA, 22 bp, Artificial Sequence
  chemically synthesized
ctgtgctgtgcaaaagaacacc

SEQ ID NO: 830138 - DNA, 22 bp, Artificial Sequence
  chemically synthesized
tagttcctgtgctgtgcaaaag

SEQ ID NO: 830139 - DNA, 22 bp, Artificial Sequence
  chemically synthesized
gctatagttcctgtgctgtgca

SEQ ID NO: 830140 - DNA, 22 bp, Artificial Sequence
  chemically synthesized
tggtgttcttttgcacagcaca

SEQ ID NO: 830141 - DNA, 22 bp, Artificial Sequence
  chemically synthesized
gtgttcttttgcacagcacagg

SEQ ID NO: 830142 - DNA, 22 bp, Artificial Sequence
  chemically synthesized
ttttgcacagcacaggaactat

SEQ ID NO: 830143 - DNA, 22 bp, Artificial Sequence
  chemically synthesized
ttgcacagcacaggaactatag

SEQ ID NO: 830144 - DNA, 22 bp, Artificial Sequence
  chemically synthesized
tgcacagcacaggaactatagc

SEQ ID NO: 830145 - DNA, 22 bp, Artificial Sequence
  chemically synthesized
gcacagcacaggaactatagct

SEQ ID NO: 830146 - DNA, 22 bp, Artificial Sequence
  chemically synthesized
cacagcacaggaactatagcta

SEQ ID NO: 830147 - DNA, 22 bp, Artificial Sequence
  chemically synthesized
gaaatatacaatatgacaatat

SEQ ID NO: 830148 - DNA, 22 bp, Artificial Sequence
  chemically synthesized
ggaaatatacaatatgacaata

SEQ ID NO: 830149 - DNA, 22 bp, Artificial Sequence
  chemically synthesized
tttggaaatatacaatatgaca

SEQ ID NO: 830150 - DNA, 22 bp, Artificial Sequence
  chemically synthesized
tagctaatattgtcatattgta

SEQ ID NO: 830151 - DNA, 22 bp, Artificial Sequence
  chemically synthesized
gctatttggaaatatacaatat

SEQ ID NO: 830152 - DNA, 22 bp, Artificial Sequence
  chemically synthesized
agctatttggaaatatacaata

SEQ ID NO: 830153 - DNA, 22 bp, Artificial Sequence
  chemically synthesized
tagctatttggaaatatacaat

SEQ ID NO: 830154 - DNA, 22 bp, Artificial Sequence
  chemically synthesized
ttagctatttggaaatatacaa

SEQ ID NO: 830155 - DNA, 22 bp, Artificial Sequence
  chemically synthesized
atattgtcatattgtatatttc

SEQ ID NO: 830156 - DNA, 22 bp, Artificial Sequence
  chemically synthesized
tttagctatttggaaatataca

SEQ ID NO: 830157 - DNA, 22 bp, Artificial Sequence
  chemically synthesized
ctttttagctatttggaaatat

SEQ ID NO: 830158 - DNA, 22 bp, Artificial Sequence
  chemically synthesized
tcatattgtatatttccaaata

SEQ ID NO: 830159 - DNA, 22 bp, Artificial Sequence
  chemically synthesized
aaatcctcctttttagctattt

SEQ ID NO: 830160 - DNA, 22 bp, Artificial Sequence
  chemically synthesized
aaaatcctcctttttagctatt

SEQ ID NO: 830161 - DNA, 22 bp, Artificial Sequence
  chemically synthesized
tatatttccaaatagctaaaaa

SEQ ID NO: 830162 - DNA, 22 bp, Artificial Sequence
  chemically synthesized
ccaaatagctaaaaaggaggat

SEQ ID NO: 830163 - DNA, 22 bp, Artificial Sequence
  chemically synthesized
caaatagctaaaaaggaggatt

SEQ ID NO: 830164 - DNA, 22 bp, Artificial Sequence
  chemically synthesized
tggtgagaatatttaaaatcct

SEQ ID NO: 830165 - DNA, 22 bp, Artificial Sequence
  chemically synthesized
gtggtgagaatatttaaaatcc

SEQ ID NO: 830166 - DNA, 22 bp, Artificial Sequence
  chemically synthesized
tgtggtgagaatatttaaaatc

SEQ ID NO: 830167 - DNA, 22 bp, Artificial Sequence
  chemically synthesized
ttgtggtgagaatatttaaaat

SEQ ID NO: 830168 - DNA, 22 bp, Artificial Sequence
  chemically synthesized
aaaaggaggattttaaatattc

SEQ ID NO: 830169 - DNA, 22 bp, Artificial Sequence
  chemically synthesized
atttttgtggtgagaatattta

SEQ ID NO: 830170 - DNA, 22 bp, Artificial Sequence
  chemically synthesized
tcatttttgtggtgagaatatt

SEQ ID NO: 830171 - DNA, 22 bp, Artificial Sequence
  chemically synthesized
ctcatttttgtggtgagaatat

SEQ ID NO: 830172 - DNA, 22 bp, Artificial Sequence
  chemically synthesized
aaatacttctcatttttgtggt

SEQ ID NO: 830173 - DNA, 22 bp, Artificial Sequence
  chemically synthesized
taaatattctcaccacaaaaat

SEQ ID NO: 830174 - DNA, 22 bp, Artificial Sequence
  chemically synthesized
aaatattctcaccacaaaaatg

SEQ ID NO: 830175 - DNA, 22 bp, Artificial Sequence
  chemically synthesized
aatattctcaccacaaaaatga

SEQ ID NO: 830176 - DNA, 22 bp, Artificial Sequence
  chemically synthesized
tcacctcaaatacttctcattt

SEQ ID NO: 830177 - DNA, 22 bp, Artificial Sequence
  chemically synthesized
tcaccacaaaaatgagaagtat

SEQ ID NO: 830178 - DNA, 22 bp, Artificial Sequence
  chemically synthesized
accacaaaaatgagaagtattt

SEQ ID NO: 830179 - DNA, 22 bp, Artificial Sequence
  chemically synthesized
atagcatatctatcacctcaaa

SEQ ID NO: 830180 - DNA, 22 bp, Artificial Sequence
  chemically synthesized
gaggtgatagatatgctattag

SEQ ID NO: 830181 - DNA, 22 bp, Artificial Sequence
  chemically synthesized
aggtgatagatatgctattagc

SEQ ID NO: 830182 - DNA, 22 bp, Artificial Sequence
  chemically synthesized
tggaataatcaaatcaggctaa

SEQ ID NO: 830183 - DNA, 22 bp, Artificial Sequence
  chemically synthesized
ttagcctgatttgattattcca

SEQ ID NO: 830184 - DNA, 22 bp, Artificial Sequence
  chemically synthesized
gcctgatttgattattccacaa

SEQ ID NO: 830185 - DNA, 22 bp, Artificial Sequence
  chemically synthesized
aatccatatatatacattgtgg

SEQ ID NO: 830186 - DNA, 22 bp, Artificial Sequence
  chemically synthesized
atttgattattccacaatgtat

SEQ ID NO: 830187 - DNA, 22 bp, Artificial Sequence
  chemically synthesized
caatccatatatatacattgtg

SEQ ID NO: 830188 - DNA, 22 bp, Artificial Sequence
  chemically synthesized
gattattccacaatgtatatat

SEQ ID NO: 830189 - DNA, 22 bp, Artificial Sequence
  chemically synthesized
attattccacaatgtatatata

SEQ ID NO: 830190 - DNA, 22 bp, Artificial Sequence
  chemically synthesized
tgatgtttcaatccatatatat

SEQ ID NO: 830191 - DNA, 22 bp, Artificial Sequence
  chemically synthesized
ttccacaatgtatatatatgga

SEQ ID NO: 830192 - DNA, 22 bp, Artificial Sequence
  chemically synthesized
cacaatgtatatatatggattg

SEQ ID NO: 830193 - DNA, 22 bp, Artificial Sequence
  chemically synthesized
tggggtacattgtgatgtttca

SEQ ID NO: 830194 - DNA, 22 bp, Artificial Sequence
  chemically synthesized
tattatggggtacattgtgatg

SEQ ID NO: 830195 - DNA, 22 bp, Artificial Sequence
  chemically synthesized
aaacatcacaatgtaccccata

SEQ ID NO: 830196 - DNA, 22 bp, Artificial Sequence
  chemically synthesized
gtcgacaactatattatggggt

SEQ ID NO: 830197 - DNA, 22 bp, Artificial Sequence
  chemically synthesized
agtcgacaactatattatgggg

SEQ ID NO: 830198 - DNA, 22 bp, Artificial Sequence
  chemically synthesized
tagtcgacaactatattatggg

SEQ ID NO: 830199 - DNA, 22 bp, Artificial Sequence
  chemically synthesized
ttagtcgacaactatattatgg

SEQ ID NO: 830200 - DNA, 22 bp, Artificial Sequence
  chemically synthesized
gtttttagtcgacaactatatt

SEQ ID NO: 830201 - DNA, 22 bp, Artificial Sequence
  chemically synthesized
cgtttttagtcgacaactatat

SEQ ID NO: 830202 - DNA, 22 bp, Artificial Sequence
  chemically synthesized
tttcgtttttagtcgacaacta

SEQ ID NO: 830203 - DNA, 22 bp, Artificial Sequence
  chemically synthesized
atttcgtttttagtcgacaact

SEQ ID NO: 830204 - DNA, 22 bp, Artificial Sequence
  chemically synthesized
tatttcgtttttagtcgacaac

SEQ ID NO: 830205 - DNA, 22 bp, Artificial Sequence
  chemically synthesized
aaaattttatttcgtttttagt

SEQ ID NO: 830206 - DNA, 22 bp, Artificial Sequence
  chemically synthesized
aaaaattttatttcgtttttag

SEQ ID NO: 830207 - DNA, 22 bp, Artificial Sequence
  chemically synthesized
taaaaattttatttcgttttta

SEQ ID NO: 830208 - DNA, 22 bp, Artificial Sequence
  chemically synthesized
attttaaaaattttatttcgtt

SEQ ID NO: 830209 - DNA, 22 bp, Artificial Sequence
  chemically synthesized
tcgactaaaaacgaaataaaat

SEQ ID NO: 830210 - DNA, 22 bp, Artificial Sequence
  chemically synthesized
aaaacgaaataaaatttttaaa

SEQ ID NO: 830211 - DNA, 22 bp, Artificial Sequence
  chemically synthesized
aaataatattcattttaaaaat

SEQ ID NO: 830212 - DNA, 22 bp, Artificial Sequence
  chemically synthesized
caactcaaataatattcatttt

SEQ ID NO: 830213 - DNA, 22 bp, Artificial Sequence
  chemically synthesized
ttaaaatgaatattatttgagt

SEQ ID NO: 830214 - DNA, 22 bp, Artificial Sequence
  chemically synthesized
taaaatgaatattatttgagtt

SEQ ID NO: 830215 - DNA, 22 bp, Artificial Sequence
  chemically synthesized
aaaatgaatattatttgagttg

SEQ ID NO: 830216 - DNA, 22 bp, Artificial Sequence
  chemically synthesized
ggagtggaattacaactcaaat

SEQ ID NO: 830217 - DNA, 22 bp, Artificial Sequence
  chemically synthesized
aaatgaatattatttgagttgt

SEQ ID NO: 830218 - DNA, 22 bp, Artificial Sequence
  chemically synthesized
gatatacacctgggagtggaat

SEQ ID NO: 830219 - DNA, 22 bp, Artificial Sequence
  chemically synthesized
tttgagttgtaattccactccc

SEQ ID NO: 830220 - DNA, 22 bp, Artificial Sequence
  chemically synthesized
ttggatatacacctgggagtgg

SEQ ID NO: 830221 - DNA, 22 bp, Artificial Sequence
  chemically synthesized
gagttgtaattccactcccagg

SEQ ID NO: 830222 - DNA, 22 bp, Artificial Sequence
  chemically synthesized
agttgtaattccactcccaggt

SEQ ID NO: 830223 - DNA, 22 bp, Artificial Sequence
  chemically synthesized
tgttggatatacacctgggagt

SEQ ID NO: 830224 - DNA, 22 bp, Artificial Sequence
  chemically synthesized
ctgttggatatacacctgggag

SEQ ID NO: 830225 - DNA, 22 bp, Artificial Sequence
  chemically synthesized
taattccactcccaggtgtata

SEQ ID NO: 830226 - DNA, 22 bp, Artificial Sequence
  chemically synthesized
tgcatttctgttggatatacac

SEQ ID NO: 830227 - DNA, 22 bp, Artificial Sequence
  chemically synthesized
cactcccaggtgtatatccaac

SEQ ID NO: 830228 - DNA, 22 bp, Artificial Sequence
  chemically synthesized
ataactatgcatttctgttgga

SEQ ID NO: 830229 - DNA, 22 bp, Artificial Sequence
  chemically synthesized
ccaggtgtatatccaacagaaa

SEQ ID NO: 830230 - DNA, 22 bp, Artificial Sequence
  chemically synthesized
gtgaatatattaataactatgc

SEQ ID NO: 830231 - DNA, 22 bp, Artificial Sequence
  chemically synthesized
ggtgaatatattaataactatg

SEQ ID NO: 830232 - DNA, 22 bp, Artificial Sequence
  chemically synthesized
tggtgaatatattaataactat

SEQ ID NO: 830233 - DNA, 22 bp, Artificial Sequence
  chemically synthesized
ttggtgaatatattaataacta

SEQ ID NO: 830234 - DNA, 22 bp, Artificial Sequence
  chemically synthesized
gtacatggtttttggtgaatat

SEQ ID NO: 830235 - DNA, 22 bp, Artificial Sequence
  chemically synthesized
ttaatatattcaccaaaaacca

SEQ ID NO: 830236 - DNA, 22 bp, Artificial Sequence
  chemically synthesized
atatattcaccaaaaaccatgt

SEQ ID NO: 830237 - DNA, 22 bp, Artificial Sequence
  chemically synthesized
tcaacagtctagtacatggttt

SEQ ID NO: 830238 - DNA, 22 bp, Artificial Sequence
  chemically synthesized
accaaaaaccatgtactagact

SEQ ID NO: 830239 - DNA, 22 bp, Artificial Sequence
  chemically synthesized
caatccatagccatgctatcaa

SEQ ID NO: 830240 - DNA, 22 bp, Artificial Sequence
  chemically synthesized
tgcaatccatagccatgctatc

SEQ ID NO: 830241 - DNA, 22 bp, Artificial Sequence
  chemically synthesized
gactgttgatagcatggctatg

SEQ ID NO: 830242 - DNA, 22 bp, Artificial Sequence
  chemically synthesized
ttgatagcatggctatggattg

SEQ ID NO: 830243 - DNA, 22 bp, Artificial Sequence
  chemically synthesized
tcaacaattctgcaatccatag

SEQ ID NO: 830244 - DNA, 22 bp, Artificial Sequence
  chemically synthesized
atagcatggctatggattgcag

SEQ ID NO: 830245 - DNA, 22 bp, Artificial Sequence
  chemically synthesized
ctgtcaacaattctgcaatcca

SEQ ID NO: 830246 - DNA, 22 bp, Artificial Sequence
  chemically synthesized
tggattgcagaattgttgacag

SEQ ID NO: 830247 - DNA, 22 bp, Artificial Sequence
  chemically synthesized
caacatgaggaaattgctgtca

SEQ ID NO: 830248 - DNA, 22 bp, Artificial Sequence
  chemically synthesized
ccaacatgaggaaattgctgtc

SEQ ID NO: 830249 - DNA, 22 bp, Artificial Sequence
  chemically synthesized
cagaattgttgacagcaatttc

SEQ ID NO: 830250 - DNA, 22 bp, Artificial Sequence
  chemically synthesized
agtagtttccaacatgaggaaa

SEQ ID NO: 830251 - DNA, 22 bp, Artificial Sequence
  chemically synthesized
ttgacagcaatttcctcatgtt

SEQ ID NO: 830252 - DNA, 22 bp, Artificial Sequence
  chemically synthesized
acagcaatttcctcatgttgga

SEQ ID NO: 830253 - DNA, 22 bp, Artificial Sequence
  chemically synthesized
cctcatgttggaaactactcaa

SEQ ID NO: 830254 - DNA, 22 bp, Artificial Sequence
  chemically synthesized
ctcatgttggaaactactcaat

SEQ ID NO: 830255 - DNA, 22 bp, Artificial Sequence
  chemically synthesized
atatagatgagaaattgagtag

SEQ ID NO: 830256 - DNA, 22 bp, Artificial Sequence
  chemically synthesized
atgttggaaactactcaatttc

SEQ ID NO: 830257 - DNA, 22 bp, Artificial Sequence
  chemically synthesized
gaaactactcaatttctcatct

SEQ ID NO: 830258 - DNA, 22 bp, Artificial Sequence
  chemically synthesized
cacatgttgatatagatgagaa

SEQ ID NO: 830259 - DNA, 22 bp, Artificial Sequence
  chemically synthesized
acacatgttgatatagatgaga

SEQ ID NO: 830260 - DNA, 22 bp, Artificial Sequence
  chemically synthesized
ctcaatttctcatctatatcaa

SEQ ID NO: 830261 - DNA, 22 bp, Artificial Sequence
  chemically synthesized
aatttctcatctatatcaacat

SEQ ID NO: 830262 - DNA, 22 bp, Artificial Sequence
  chemically synthesized
ctcatctatatcaacatgtgta

SEQ ID NO: 830263 - DNA, 22 bp, Artificial Sequence
  chemically synthesized
tcatctatatcaacatgtgtaa

SEQ ID NO: 830264 - DNA, 22 bp, Artificial Sequence
  chemically synthesized
atctatatcaacatgtgtaaat

SEQ ID NO: 830265 - DNA, 22 bp, Artificial Sequence
  chemically synthesized
ataccacagtgtatttacacat

SEQ ID NO: 830266 - DNA, 22 bp, Artificial Sequence
  chemically synthesized
ttgataccacagtgtatttaca

SEQ ID NO: 830267 - DNA, 22 bp, Artificial Sequence
  chemically synthesized
tatcaacatgtgtaaatacact

SEQ ID NO: 830268 - DNA, 22 bp, Artificial Sequence
  chemically synthesized
tattgataccacagtgtattta

SEQ ID NO: 830269 - DNA, 22 bp, Artificial Sequence
  chemically synthesized
aataatattctattgataccac

SEQ ID NO: 830270 - DNA, 22 bp, Artificial Sequence
  chemically synthesized
ctgaataatattctattgatac

SEQ ID NO: 830271 - DNA, 22 bp, Artificial Sequence
  chemically synthesized
actgaataatattctattgata

SEQ ID NO: 830272 - DNA, 22 bp, Artificial Sequence
  chemically synthesized
ttactgaataatattctattga

SEQ ID NO: 830273 - DNA, 22 bp, Artificial Sequence
  chemically synthesized
cttactgaataatattctattg

SEQ ID NO: 830274 - DNA, 22 bp, Artificial Sequence
  chemically synthesized
tcttactgaataatattctatt

SEQ ID NO: 830275 - DNA, 22 bp, Artificial Sequence
  chemically synthesized
ttcttactgaataatattctat

SEQ ID NO: 830276 - DNA, 22 bp, Artificial Sequence
  chemically synthesized
tggtatcaatagaatattattc

SEQ ID NO: 830277 - DNA, 22 bp, Artificial Sequence
  chemically synthesized
acttttcttactgaataatatt

SEQ ID NO: 830278 - DNA, 22 bp, Artificial Sequence
  chemically synthesized
ttcacttttcttactgaataat

SEQ ID NO: 830279 - DNA, 22 bp, Artificial Sequence
  chemically synthesized
tggattgttcacttttcttact

SEQ ID NO: 830280 - DNA, 22 bp, Artificial Sequence
  chemically synthesized
ttcagtaagaaaagtgaacaat

SEQ ID NO: 830281 - DNA, 22 bp, Artificial Sequence
  chemically synthesized
tatgtagttgtggattgttcac

SEQ ID NO: 830282 - DNA, 22 bp, Artificial Sequence
  chemically synthesized
agtaagaaaagtgaacaatcca

SEQ ID NO: 830283 - DNA, 22 bp, Artificial Sequence
  chemically synthesized
ttgtatgtagttgtggattgtt

SEQ ID NO: 830284 - DNA, 22 bp, Artificial Sequence
  chemically synthesized
atccatattattgtatgtagtt

SEQ ID NO: 830285 - DNA, 22 bp, Artificial Sequence
  chemically synthesized
tgagattcatccatattattgt

SEQ ID NO: 830286 - DNA, 22 bp, Artificial Sequence
  chemically synthesized
gtgagattcatccatattattg

SEQ ID NO: 830287 - DNA, 22 bp, Artificial Sequence
  chemically synthesized
catacaataatatggatgaatc

SEQ ID NO: 830288 - DNA, 22 bp, Artificial Sequence
  chemically synthesized
cccccaacaatatgtttgtgag

SEQ ID NO: 830289 - DNA, 22 bp, Artificial Sequence
  chemically synthesized
ccccccaacaatatgtttgtga

SEQ ID NO: 830290 - DNA, 22 bp, Artificial Sequence
  chemically synthesized
tccccccaacaatatgtttgtg

SEQ ID NO: 830291 - DNA, 22 bp, Artificial Sequence
  chemically synthesized
ttccccccaacaatatgtttgt

SEQ ID NO: 830292 - DNA, 22 bp, Artificial Sequence
  chemically synthesized
tatttttccccccaacaatatg

SEQ ID NO: 830293 - DNA, 22 bp, Artificial Sequence
  chemically synthesized
tggctgtatttttccccccaac

SEQ ID NO: 830294 - DNA, 22 bp, Artificial Sequence
  chemically synthesized
acaaacatattgttggggggaa

SEQ ID NO: 830295 - DNA, 22 bp, Artificial Sequence
  chemically synthesized
tctgtggctgtatttttccccc

SEQ ID NO: 830296 - DNA, 22 bp, Artificial Sequence
  chemically synthesized
gtctgtggctgtatttttcccc

SEQ ID NO: 830297 - DNA, 22 bp, Artificial Sequence
  chemically synthesized
cttgtctgtggctgtatttttc

SEQ ID NO: 830298 - DNA, 22 bp, Artificial Sequence
  chemically synthesized
ttggggggaaaaatacagccac

SEQ ID NO: 830299 - DNA, 22 bp, Artificial Sequence
  chemically synthesized
gggggaaaaatacagccacaga

SEQ ID NO: 830300 - DNA, 22 bp, Artificial Sequence
  chemically synthesized
tatgaaggaatcgaacagtcat

SEQ ID NO: 830301 - DNA, 22 bp, Artificial Sequence
  chemically synthesized
tgtattatatgaaggaatcgaa

SEQ ID NO: 830302 - DNA, 22 bp, Artificial Sequence
  chemically synthesized
gtgtattatatgaaggaatcga

SEQ ID NO: 830303 - DNA, 22 bp, Artificial Sequence
  chemically synthesized
tgtgtattatatgaaggaatcg

SEQ ID NO: 830304 - DNA, 22 bp, Artificial Sequence
  chemically synthesized
ttgtgtattatatgaaggaatc

SEQ ID NO: 830305 - DNA, 22 bp, Artificial Sequence
  chemically synthesized
tttttgtgtattatatgaagga

SEQ ID NO: 830306 - DNA, 22 bp, Artificial Sequence
  chemically synthesized
ctgtttttgtgtattatatgaa

SEQ ID NO: 830307 - DNA, 22 bp, Artificial Sequence
  chemically synthesized
cctgtttttgtgtattatatga

SEQ ID NO: 830308 - DNA, 22 bp, Artificial Sequence
  chemically synthesized
tcctgtttttgtgtattatatg

SEQ ID NO: 830309 - DNA, 22 bp, Artificial Sequence
  chemically synthesized
ttcgattccttcatataataca

SEQ ID NO: 830310 - DNA, 22 bp, Artificial Sequence
  chemically synthesized
ttcctgtttttgtgtattatat

SEQ ID NO: 830311 - DNA, 22 bp, Artificial Sequence
  chemically synthesized
tttcctgtttttgtgtattata

SEQ ID NO: 830312 - DNA, 22 bp, Artificial Sequence
  chemically synthesized
gattccttcatataatacacaa

SEQ ID NO: 830313 - DNA, 22 bp, Artificial Sequence
  chemically synthesized
ctttttcctgtttttgtgtatt

SEQ ID NO: 830314 - DNA, 22 bp, Artificial Sequence
  chemically synthesized
ttactttttcctgtttttgtgt

SEQ ID NO: 830315 - DNA, 22 bp, Artificial Sequence
  chemically synthesized
cttcatataatacacaaaaaca

SEQ ID NO: 830316 - DNA, 22 bp, Artificial Sequence
  chemically synthesized
tattactttttcctgtttttgt

SEQ ID NO: 830317 - DNA, 22 bp, Artificial Sequence
  chemically synthesized
ctattactttttcctgtttttg

SEQ ID NO: 830318 - DNA, 22 bp, Artificial Sequence
  chemically synthesized
catataatacacaaaaacagga

SEQ ID NO: 830319 - DNA, 22 bp, Artificial Sequence
  chemically synthesized
tctattactttttcctgttttt

SEQ ID NO: 830320 - DNA, 22 bp, Artificial Sequence
  chemically synthesized
atataatacacaaaaacaggaa

SEQ ID NO: 830321 - DNA, 22 bp, Artificial Sequence
  chemically synthesized
aaaagttttctattactttttc

SEQ ID NO: 830322 - DNA, 22 bp, Artificial Sequence
  chemically synthesized
caaaagttttctattacttttt

SEQ ID NO: 830323 - DNA, 22 bp, Artificial Sequence
  chemically synthesized
cttcaaaagttttctattactt

SEQ ID NO: 830324 - DNA, 22 bp, Artificial Sequence
  chemically synthesized
acttcaaaagttttctattact

SEQ ID NO: 830325 - DNA, 22 bp, Artificial Sequence
  chemically synthesized
tccttacttcaaaagttttcta

SEQ ID NO: 830326 - DNA, 22 bp, Artificial Sequence
  chemically synthesized
ctatccttacttcaaaagtttt

SEQ ID NO: 830327 - DNA, 22 bp, Artificial Sequence
  chemically synthesized
acaagggtgactactatcctta

SEQ ID NO: 830328 - DNA, 22 bp, Artificial Sequence
  chemically synthesized
cacaagggtgactactatcctt

SEQ ID NO: 830329 - DNA, 22 bp, Artificial Sequence
  chemically synthesized
ttgaagtaaggatagtagtcac

SEQ ID NO: 830330 - DNA, 22 bp, Artificial Sequence
  chemically synthesized
tgaagtaaggatagtagtcacc

SEQ ID NO: 830331 - DNA, 22 bp, Artificial Sequence
  chemically synthesized
gaagtaaggatagtagtcaccc

SEQ ID NO: 830332 - DNA, 22 bp, Artificial Sequence
  chemically synthesized
aagtaaggatagtagtcaccct

SEQ ID NO: 830333 - DNA, 22 bp, Artificial Sequence
  chemically synthesized
cagtcatgaacatttcacaagg

SEQ ID NO: 830334 - DNA, 22 bp, Artificial Sequence
  chemically synthesized
tccagtcatgaacatttcacaa

SEQ ID NO: 830335 - DNA, 22 bp, Artificial Sequence
  chemically synthesized
ctccagtcatgaacatttcaca

SEQ ID NO: 830336 - DNA, 22 bp, Artificial Sequence
  chemically synthesized
atgtcttctccagtcatgaaca

SEQ ID NO: 830337 - DNA, 22 bp, Artificial Sequence
  chemically synthesized
catgtcttctccagtcatgaac

SEQ ID NO: 830338 - DNA, 22 bp, Artificial Sequence
  chemically synthesized
gtgaaatgttcatgactggaga

SEQ ID NO: 830339 - DNA, 22 bp, Artificial Sequence
  chemically synthesized
tgaaatgttcatgactggagaa

SEQ ID NO: 830340 - DNA, 22 bp, Artificial Sequence
  chemically synthesized
aggatcccccttcatgtcttct

SEQ ID NO: 830341 - DNA, 22 bp, Artificial Sequence
  chemically synthesized
atgactggagaagacatgaagg

SEQ ID NO: 830342 - DNA, 22 bp, Artificial Sequence
  chemically synthesized
gagaagacatgaagggggatcc

SEQ ID NO: 830343 - DNA, 22 bp, Artificial Sequence
  chemically synthesized
agcttctggctatattatatta

SEQ ID NO: 830344 - DNA, 22 bp, Artificial Sequence
  chemically synthesized
ctggctatattatattatgttt

SEQ ID NO: 830345 - DNA, 22 bp, Artificial Sequence
  chemically synthesized
tggctatattatattatgtttc

SEQ ID NO: 830346 - DNA, 22 bp, Artificial Sequence
  chemically synthesized
gctatattatattatgtttctt

SEQ ID NO: 830347 - DNA, 22 bp, Artificial Sequence
  chemically synthesized
tattatattatgtttcttgatt

SEQ ID NO: 830348 - DNA, 22 bp, Artificial Sequence
  chemically synthesized
tgtaaatagcatccaaatcaag

SEQ ID NO: 830349 - DNA, 22 bp, Artificial Sequence
  chemically synthesized
tattatgtttcttgatttggat

SEQ ID NO: 830350 - DNA, 22 bp, Artificial Sequence
  chemically synthesized
tgtttcttgatttggatgctat

SEQ ID NO: 830351 - DNA, 22 bp, Artificial Sequence
  chemically synthesized
cttgatttggatgctatttaca

SEQ ID NO: 830352 - DNA, 22 bp, Artificial Sequence
  chemically synthesized
ttgatttggatgctatttacac

SEQ ID NO: 830353 - DNA, 22 bp, Artificial Sequence
  chemically synthesized
gatttggatgctatttacacag

SEQ ID NO: 830354 - DNA, 22 bp, Artificial Sequence
  chemically synthesized
atttggatgctatttacacagt

SEQ ID NO: 830355 - DNA, 22 bp, Artificial Sequence
  chemically synthesized
taaatagaatgcaactgtgtaa

SEQ ID NO: 830356 - DNA, 22 bp, Artificial Sequence
  chemically synthesized
tataaatagaatgcaactgtgt

SEQ ID NO: 830357 - DNA, 22 bp, Artificial Sequence
  chemically synthesized
ggatgctatttacacagttgca

SEQ ID NO: 830358 - DNA, 22 bp, Artificial Sequence
  chemically synthesized
ctataaatagaatgcaactgtg

SEQ ID NO: 830359 - DNA, 22 bp, Artificial Sequence
  chemically synthesized
gatgctatttacacagttgcat

SEQ ID NO: 830360 - DNA, 22 bp, Artificial Sequence
  chemically synthesized
tttacacagttgcattctattt

SEQ ID NO: 830361 - DNA, 22 bp, Artificial Sequence
  chemically synthesized
acacagttgcattctatttata

SEQ ID NO: 830362 - DNA, 22 bp, Artificial Sequence
  chemically synthesized
cacagttgcattctatttatag

SEQ ID NO: 830363 - DNA, 22 bp, Artificial Sequence
  chemically synthesized
cattctatttatagaaattcac

SEQ ID NO: 830364 - DNA, 22 bp, Artificial Sequence
  chemically synthesized
gccatatgcagaagagtgaatt

SEQ ID NO: 830365 - DNA, 22 bp, Artificial Sequence
  chemically synthesized
tatttatagaaattcactcttc

SEQ ID NO: 830366 - DNA, 22 bp, Artificial Sequence
  chemically synthesized
tttatagaaattcactcttctg

SEQ ID NO: 830367 - DNA, 22 bp, Artificial Sequence
  chemically synthesized
gctagccatatgcagaagagtg

SEQ ID NO: 830368 - DNA, 22 bp, Artificial Sequence
  chemically synthesized
atagaaattcactcttctgcat

SEQ ID NO: 830369 - DNA, 22 bp, Artificial Sequence
  chemically synthesized
tagaaattcactcttctgcata

SEQ ID NO: 830370 - DNA, 22 bp, Artificial Sequence
  chemically synthesized
ggagaactggctagccatatgc

SEQ ID NO: 830371 - DNA, 22 bp, Artificial Sequence
  chemically synthesized
actcttctgcatatggctagcc

SEQ ID NO: 830372 - DNA, 22 bp, Artificial Sequence
  chemically synthesized
ttctgcatatggctagccagtt

SEQ ID NO: 830373 - DNA, 22 bp, Artificial Sequence
  chemically synthesized
ctgcatatggctagccagttct

SEQ ID NO: 830374 - DNA, 22 bp, Artificial Sequence
  chemically synthesized
tgcatatggctagccagttctc

SEQ ID NO: 830375 - DNA, 22 bp, Artificial Sequence
  chemically synthesized
catatggctagccagttctccc

SEQ ID NO: 830376 - DNA, 22 bp, Artificial Sequence
  chemically synthesized
ataaatggtgctgggagaactg

SEQ ID NO: 830377 - DNA, 22 bp, Artificial Sequence
  chemically synthesized
aataaatggtgctgggagaact

SEQ ID NO: 830378 - DNA, 22 bp, Artificial Sequence
  chemically synthesized
tttaataaatggtgctgggaga

SEQ ID NO: 830379 - DNA, 22 bp, Artificial Sequence
  chemically synthesized
cctatttaataaatggtgctgg

SEQ ID NO: 830380 - DNA, 22 bp, Artificial Sequence
  chemically synthesized
gccagttctcccagcaccattt

SEQ ID NO: 830381 - DNA, 22 bp, Artificial Sequence
  chemically synthesized
tcccagcaccatttattaaata

SEQ ID NO: 830382 - DNA, 22 bp, Artificial Sequence
  chemically synthesized
ccagcaccatttattaaatagg

SEQ ID NO: 830383 - DNA, 22 bp, Artificial Sequence
  chemically synthesized
acaaatcaaattccctatttaa

SEQ ID NO: 830384 - DNA, 22 bp, Artificial Sequence
  chemically synthesized
cacaaatcaaattccctattta

SEQ ID NO: 830385 - DNA, 22 bp, Artificial Sequence
  chemically synthesized
attaaatagggaatttgatttg

SEQ ID NO: 830386 - DNA, 22 bp, Artificial Sequence
  chemically synthesized
ttaaatagggaatttgatttgt

SEQ ID NO: 830387 - DNA, 22 bp, Artificial Sequence
  chemically synthesized
aatagggaatttgatttgtgaa

SEQ ID NO: 830388 - DNA, 22 bp, Artificial Sequence
  chemically synthesized
tatgtagaatatatttcacaaa

SEQ ID NO: 830389 - DNA, 22 bp, Artificial Sequence
  chemically synthesized
gatttgtgaaatatattctaca

SEQ ID NO: 830390 - DNA, 22 bp, Artificial Sequence
  chemically synthesized
tccaaagttgtatgtagaatat

SEQ ID NO: 830391 - DNA, 22 bp, Artificial Sequence
  chemically synthesized
atttgtgaaatatattctacat

SEQ ID NO: 830392 - DNA, 22 bp, Artificial Sequence
  chemically synthesized
gtgaaatatattctacatacaa

SEQ ID NO: 830393 - DNA, 22 bp, Artificial Sequence
  chemically synthesized
tgaaatatattctacatacaac

SEQ ID NO: 830394 - DNA, 22 bp, Artificial Sequence
  chemically synthesized
aaaaagatgaattgtccaaagt

SEQ ID NO: 830395 - DNA, 22 bp, Artificial Sequence
  chemically synthesized
aaaaaagatgaattgtccaaag

SEQ ID NO: 830396 - DNA, 22 bp, Artificial Sequence
  chemically synthesized
taaaaaagatgaattgtccaaa

SEQ ID NO: 830397 - DNA, 22 bp, Artificial Sequence
  chemically synthesized
ttaaaaaagatgaattgtccaa

SEQ ID NO: 830398 - DNA, 22 bp, Artificial Sequence
  chemically synthesized
tacatacaactttggacaattc

SEQ ID NO: 830399 - DNA, 22 bp, Artificial Sequence
  chemically synthesized
tttaaaaaagatgaattgtcca

SEQ ID NO: 830400 - DNA, 22 bp, Artificial Sequence
  chemically synthesized
ttttaaaaaagatgaattgtcc

SEQ ID NO: 830401 - DNA, 22 bp, Artificial Sequence
  chemically synthesized
catacaactttggacaattcat

SEQ ID NO: 830402 - DNA, 22 bp, Artificial Sequence
  chemically synthesized
tggacaattcatcttttttaaa

SEQ ID NO: 830403 - DNA, 22 bp, Artificial Sequence
  chemically synthesized
ggacaattcatcttttttaaaa

SEQ ID NO: 830404 - DNA, 22 bp, Artificial Sequence
  chemically synthesized
gacaattcatcttttttaaaaa

SEQ ID NO: 830405 - DNA, 22 bp, Artificial Sequence
  chemically synthesized
acacgtgacaccttttttaaaa

SEQ ID NO: 830406 - DNA, 22 bp, Artificial Sequence
  chemically synthesized
cacacgtgacaccttttttaaa

SEQ ID NO: 830407 - DNA, 22 bp, Artificial Sequence
  chemically synthesized
atcttttttaaaaaaggtgtca

SEQ ID NO: 830408 - DNA, 22 bp, Artificial Sequence
  chemically synthesized
ttttaaaaaaggtgtcacgtgt

SEQ ID NO: 830409 - DNA, 22 bp, Artificial Sequence
  chemically synthesized
tttaaaaaaggtgtcacgtgtg

SEQ ID NO: 830410 - DNA, 22 bp, Artificial Sequence
  chemically synthesized
ttaaaaaaggtgtcacgtgtga

SEQ ID NO: 830411 - DNA, 22 bp, Artificial Sequence
  chemically synthesized
taaaaaaggtgtcacgtgtgaa

SEQ ID NO: 830412 - DNA, 22 bp, Artificial Sequence
  chemically synthesized
aaaaaaggtgtcacgtgtgaaa

SEQ ID NO: 830413 - DNA, 22 bp, Artificial Sequence
  chemically synthesized
aaaaaggtgtcacgtgtgaaat

SEQ ID NO: 830414 - DNA, 22 bp, Artificial Sequence
  chemically synthesized
acagcagccaaaatgacacata

SEQ ID NO: 830415 - DNA, 22 bp, Artificial Sequence
  chemically synthesized
ttcacagcagccaaaatgacac

SEQ ID NO: 830416 - DNA, 22 bp, Artificial Sequence
  chemically synthesized
ttattcacagcagccaaaatga

SEQ ID NO: 830417 - DNA, 22 bp, Artificial Sequence
  chemically synthesized
attattcacagcagccaaaatg

SEQ ID NO: 830418 - DNA, 22 bp, Artificial Sequence
  chemically synthesized
tattattcacagcagccaaaat

SEQ ID NO: 830419 - DNA, 22 bp, Artificial Sequence
  chemically synthesized
ttattattcacagcagccaaaa

SEQ ID NO: 830420 - DNA, 22 bp, Artificial Sequence
  chemically synthesized
catcttttattattcacagcag

SEQ ID NO: 830421 - DNA, 22 bp, Artificial Sequence
  chemically synthesized
tggctgctgtgaataataaaag

SEQ ID NO: 830422 - DNA, 22 bp, Artificial Sequence
  chemically synthesized
ggctgctgtgaataataaaaga

SEQ ID NO: 830423 - DNA, 22 bp, Artificial Sequence
  chemically synthesized
gctgctgtgaataataaaagat

SEQ ID NO: 830424 - DNA, 22 bp, Artificial Sequence
  chemically synthesized
tagcagaatgattgcatctttt

SEQ ID NO: 830425 - DNA, 22 bp, Artificial Sequence
  chemically synthesized
ctgtgaataataaaagatgcaa

SEQ ID NO: 830426 - DNA, 22 bp, Artificial Sequence
  chemically synthesized
gtagcagaatgattgcatcttt

SEQ ID NO: 830427 - DNA, 22 bp, Artificial Sequence
  chemically synthesized
tgaataataaaagatgcaatca

SEQ ID NO: 830428 - DNA, 22 bp, Artificial Sequence
  chemically synthesized
tgtttgtagcagaatgattgca

SEQ ID NO: 830429 - DNA, 22 bp, Artificial Sequence
  chemically synthesized
tgctacaaacacaatacgattt

SEQ ID NO: 830430 - DNA, 22 bp, Artificial Sequence
  chemically synthesized
ctacaaacacaatacgattttg

SEQ ID NO: 830431 - DNA, 22 bp, Artificial Sequence
  chemically synthesized
caaacacaatacgattttgact

SEQ ID NO: 830432 - DNA, 22 bp, Artificial Sequence
  chemically synthesized
tcacatcaatgtacagtcaaaa

SEQ ID NO: 830433 - DNA, 22 bp, Artificial Sequence
  chemically synthesized
gtcacatcaatgtacagtcaaa

SEQ ID NO: 830434 - DNA, 22 bp, Artificial Sequence
  chemically synthesized
tgtcacatcaatgtacagtcaa

SEQ ID NO: 830435 - DNA, 22 bp, Artificial Sequence
  chemically synthesized
tttgtcacatcaatgtacagtc

SEQ ID NO: 830436 - DNA, 22 bp, Artificial Sequence
  chemically synthesized
aaatgttctttgtcacatcaat

SEQ ID NO: 830437 - DNA, 22 bp, Artificial Sequence
  chemically synthesized
tgaaatgttctttgtcacatca

SEQ ID NO: 830438 - DNA, 22 bp, Artificial Sequence
  chemically synthesized
tgactgtacattgatgtgacaa

SEQ ID NO: 830439 - DNA, 22 bp, Artificial Sequence
  chemically synthesized
ctgaaatgttctttgtcacatc

SEQ ID NO: 830440 - DNA, 22 bp, Artificial Sequence
  chemically synthesized
gactgtacattgatgtgacaaa

SEQ ID NO: 830441 - DNA, 22 bp, Artificial Sequence
  chemically synthesized
actgtacattgatgtgacaaag

SEQ ID NO: 830442 - DNA, 22 bp, Artificial Sequence
  chemically synthesized
tacattgatgtgacaaagaaca

SEQ ID NO: 830443 - DNA, 22 bp, Artificial Sequence
  chemically synthesized
atgtgacaaagaacatttcaga

SEQ ID NO: 830444 - DNA, 22 bp, Artificial Sequence
  chemically synthesized
tccaataagaatttctgaaatg

SEQ ID NO: 830445 - DNA, 22 bp, Artificial Sequence
  chemically synthesized
actgtccaataagaatttctga

SEQ ID NO: 830446 - DNA, 22 bp, Artificial Sequence
  chemically synthesized
gtccagttcactgtccaataag

SEQ ID NO: 830447 - DNA, 22 bp, Artificial Sequence
  chemically synthesized
cagaaattcttattggacagtg

SEQ ID NO: 830448 - DNA, 22 bp, Artificial Sequence
  chemically synthesized
agaaattcttattggacagtga

SEQ ID NO: 830449 - DNA, 22 bp, Artificial Sequence
  chemically synthesized
tgaatctagtccagttcactgt

SEQ ID NO: 830450 - DNA, 22 bp, Artificial Sequence
  chemically synthesized
ttattggacagtgaactggact

SEQ ID NO: 830451 - DNA, 22 bp, Artificial Sequence
  chemically synthesized
attggacagtgaactggactag

SEQ ID NO: 830452 - DNA, 22 bp, Artificial Sequence
  chemically synthesized
ttggacagtgaactggactaga

SEQ ID NO: 830453 - DNA, 22 bp, Artificial Sequence
  chemically synthesized
gacagtgaactggactagattc

SEQ ID NO: 830454 - DNA, 22 bp, Artificial Sequence
  chemically synthesized
atgtgtgtctgtgaatctagtc

SEQ ID NO: 830455 - DNA, 22 bp, Artificial Sequence
  chemically synthesized
tatgtgctgatgtgtgtctgtg

SEQ ID NO: 830456 - DNA, 22 bp, Artificial Sequence
  chemically synthesized
gactagattcacagacacacat

SEQ ID NO: 830457 - DNA, 22 bp, Artificial Sequence
  chemically synthesized
gtctgtatgtgctgatgtgtgt

SEQ ID NO: 830458 - DNA, 22 bp, Artificial Sequence
  chemically synthesized
gattcacagacacacatcagca

SEQ ID NO: 830459 - DNA, 22 bp, Artificial Sequence
  chemically synthesized
attcgtctgtatgtgctgatgt

SEQ ID NO: 830460 - DNA, 22 bp, Artificial Sequence
  chemically synthesized
gattcgtctgtatgtgctgatg

SEQ ID NO: 830461 - DNA, 22 bp, Artificial Sequence
  chemically synthesized
acagacacacatcagcacatac

SEQ ID NO: 830462 - DNA, 22 bp, Artificial Sequence
  chemically synthesized
cttgattcgtctgtatgtgctg

SEQ ID NO: 830463 - DNA, 22 bp, Artificial Sequence
  chemically synthesized
aatagcagaatagctgcttgat

SEQ ID NO: 830464 - DNA, 22 bp, Artificial Sequence
  chemically synthesized
ttaaatagcagaatagctgctt

SEQ ID NO: 830465 - DNA, 22 bp, Artificial Sequence
  chemically synthesized
attaaatagcagaatagctgct

SEQ ID NO: 830466 - DNA, 22 bp, Artificial Sequence
  chemically synthesized
tattaaatagcagaatagctgc

SEQ ID NO: 830467 - DNA, 22 bp, Artificial Sequence
  chemically synthesized
ttattaaatagcagaatagctg

SEQ ID NO: 830468 - DNA, 22 bp, Artificial Sequence
  chemically synthesized
ttttattaaatagcagaatagc

SEQ ID NO: 830469 - DNA, 22 bp, Artificial Sequence
  chemically synthesized
cttttattaaatagcagaatag

SEQ ID NO: 830470 - DNA, 22 bp, Artificial Sequence
  chemically synthesized
tttcttttattaaatagcagaa

SEQ ID NO: 830471 - DNA, 22 bp, Artificial Sequence
  chemically synthesized
gtttcttttattaaatagcaga

SEQ ID NO: 830472 - DNA, 22 bp, Artificial Sequence
  chemically synthesized
tgtttcttttattaaatagcag

SEQ ID NO: 830473 - DNA, 22 bp, Artificial Sequence
  chemically synthesized
ctttgtttcttttattaaatag

SEQ ID NO: 830474 - DNA, 22 bp, Artificial Sequence
  chemically synthesized
tactgctttgtttcttttatta

SEQ ID NO: 830475 - DNA, 22 bp, Artificial Sequence
  chemically synthesized
ttctgctatttaataaaagaaa

SEQ ID NO: 830476 - DNA, 22 bp, Artificial Sequence
  chemically synthesized
tgctatttaataaaagaaacaa

SEQ ID NO: 830477 - DNA, 22 bp, Artificial Sequence
  chemically synthesized
ctatttaataaaagaaacaaag

SEQ ID NO: 830478 - DNA, 22 bp, Artificial Sequence
  chemically synthesized
tttaataaaagaaacaaagcag

SEQ ID NO: 830479 - DNA, 22 bp, Artificial Sequence
  chemically synthesized
aataaaagaaacaaagcagtac

SEQ ID NO: 830480 - DNA, 22 bp, Artificial Sequence
  chemically synthesized
taacaatcaattgtactgcttt

SEQ ID NO: 830481 - DNA, 22 bp, Artificial Sequence
  chemically synthesized
ataaaagaaacaaagcagtaca

SEQ ID NO: 830482 - DNA, 22 bp, Artificial Sequence
  chemically synthesized
ctataacaatcaattgtactgc

SEQ ID NO: 830483 - DNA, 22 bp, Artificial Sequence
  chemically synthesized
ggactactataacaatcaattg

SEQ ID NO: 830484 - DNA, 22 bp, Artificial Sequence
  chemically synthesized
gggactactataacaatcaatt

SEQ ID NO: 830485 - DNA, 22 bp, Artificial Sequence
  chemically synthesized
ttgggactactataacaatcaa

SEQ ID NO: 830486 - DNA, 22 bp, Artificial Sequence
  chemically synthesized
ctcttgggactactataacaat

SEQ ID NO: 830487 - DNA, 22 bp, Artificial Sequence
  chemically synthesized
cagggtctactcttgggactac

SEQ ID NO: 830488 - DNA, 22 bp, Artificial Sequence
  chemically synthesized
tgcagggtctactcttgggact

SEQ ID NO: 830489 - DNA, 22 bp, Artificial Sequence
  chemically synthesized
attgttatagtagtcccaagag

SEQ ID NO: 830490 - DNA, 22 bp, Artificial Sequence
  chemically synthesized
ctgcagggtctactcttgggac

SEQ ID NO: 830491 - DNA, 22 bp, Artificial Sequence
  chemically synthesized
ttatagtagtcccaagagtaga

SEQ ID NO: 830492 - DNA, 22 bp, Artificial Sequence
  chemically synthesized
tagtagtcccaagagtagaccc

SEQ ID NO: 830493 - DNA, 22 bp, Artificial Sequence
  chemically synthesized
tatatatttctgcagggtctac

SEQ ID NO: 830494 - DNA, 22 bp, Artificial Sequence
  chemically synthesized
gtatatatttctgcagggtcta

SEQ ID NO: 830495 - DNA, 22 bp, Artificial Sequence
  chemically synthesized
tgtatatatttctgcagggtct

SEQ ID NO: 830496 - DNA, 22 bp, Artificial Sequence
  chemically synthesized
ttgtatatatttctgcagggtc

SEQ ID NO: 830497 - DNA, 22 bp, Artificial Sequence
  chemically synthesized
tcttttgtatatatttctgcag

SEQ ID NO: 830498 - DNA, 22 bp, Artificial Sequence
  chemically synthesized
aaattgtcttttgtatatattt

SEQ ID NO: 830499 - DNA, 22 bp, Artificial Sequence
  chemically synthesized
taaaattgtcttttgtatatat

SEQ ID NO: 830500 - DNA, 22 bp, Artificial Sequence
  chemically synthesized
ctaaaattgtcttttgtatata

SEQ ID NO: 830501 - DNA, 22 bp, Artificial Sequence
  chemically synthesized
cagaaatatatacaaaagacaa

SEQ ID NO: 830502 - DNA, 22 bp, Artificial Sequence
  chemically synthesized
aaacttctaaaattgtcttttg

SEQ ID NO: 830503 - DNA, 22 bp, Artificial Sequence
  chemically synthesized
aaaacttctaaaattgtctttt

SEQ ID NO: 830504 - DNA, 22 bp, Artificial Sequence
  chemically synthesized
acaaaatgaaatacatttaaaa

SEQ ID NO: 830505 - DNA, 22 bp, Artificial Sequence
  chemically synthesized
gacaaaatgaaatacatttaaa

SEQ ID NO: 830506 - DNA, 22 bp, Artificial Sequence
  chemically synthesized
cttgacaaaatgaaatacattt

SEQ ID NO: 830507 - DNA, 22 bp, Artificial Sequence
  chemically synthesized
tagaagttttaaatgtatttca

SEQ ID NO: 830508 - DNA, 22 bp, Artificial Sequence
  chemically synthesized
agaagttttaaatgtatttcat

SEQ ID NO: 830509 - DNA, 22 bp, Artificial Sequence
  chemically synthesized
gaagttttaaatgtatttcatt

SEQ ID NO: 830510 - DNA, 22 bp, Artificial Sequence
  chemically synthesized
attccttgacaaaatgaaatac

SEQ ID NO: 830511 - DNA, 22 bp, Artificial Sequence
  chemically synthesized
cattccttgacaaaatgaaata

SEQ ID NO: 830512 - DNA, 22 bp, Artificial Sequence
  chemically synthesized
tcattccttgacaaaatgaaat

SEQ ID NO: 830513 - DNA, 22 bp, Artificial Sequence
  chemically synthesized
ctttcattccttgacaaaatga

SEQ ID NO: 830514 - DNA, 22 bp, Artificial Sequence
  chemically synthesized
gctttcattccttgacaaaatg

SEQ ID NO: 830515 - DNA, 22 bp, Artificial Sequence
  chemically synthesized
taaatgtatttcattttgtcaa

SEQ ID NO: 830516 - DNA, 22 bp, Artificial Sequence
  chemically synthesized
aaatgtatttcattttgtcaag

SEQ ID NO: 830517 - DNA, 22 bp, Artificial Sequence
  chemically synthesized
aatgtatttcattttgtcaagg

SEQ ID NO: 830518 - DNA, 22 bp, Artificial Sequence
  chemically synthesized
gatttgctttcattccttgaca

SEQ ID NO: 830519 - DNA, 22 bp, Artificial Sequence
  chemically synthesized
agatttgctttcattccttgac

SEQ ID NO: 830520 - DNA, 22 bp, Artificial Sequence
  chemically synthesized
tagatttgctttcattccttga

SEQ ID NO: 830521 - DNA, 22 bp, Artificial Sequence
  chemically synthesized
cattttgtcaaggaatgaaagc

SEQ ID NO: 830522 - DNA, 22 bp, Artificial Sequence
  chemically synthesized
attttgtcaaggaatgaaagca

SEQ ID NO: 830523 - DNA, 22 bp, Artificial Sequence
  chemically synthesized
agattttagatttgctttcatt

SEQ ID NO: 830524 - DNA, 22 bp, Artificial Sequence
  chemically synthesized
cagattttagatttgctttcat

SEQ ID NO: 830525 - DNA, 22 bp, Artificial Sequence
  chemically synthesized
tgtcaaggaatgaaagcaaatc

SEQ ID NO: 830526 - DNA, 22 bp, Artificial Sequence
  chemically synthesized
gtcaaggaatgaaagcaaatct

SEQ ID NO: 830527 - DNA, 22 bp, Artificial Sequence
  chemically synthesized
tcaaggaatgaaagcaaatcta

SEQ ID NO: 830528 - DNA, 22 bp, Artificial Sequence
  chemically synthesized
atgatcttcagattttagattt

SEQ ID NO: 830529 - DNA, 22 bp, Artificial Sequence
  chemically synthesized
tgatgatcttcagattttagat

SEQ ID NO: 830530 - DNA, 22 bp, Artificial Sequence
  chemically synthesized
gctctgatgatcttcagatttt

SEQ ID NO: 830531 - DNA, 22 bp, Artificial Sequence
  chemically synthesized
cgctctgatgatcttcagattt

SEQ ID NO: 830532 - DNA, 22 bp, Artificial Sequence
  chemically synthesized
aaatctgaagatcatcagagcg

SEQ ID NO: 830533 - DNA, 22 bp, Artificial Sequence
  chemically synthesized
ggataacagcttcgctctgatg

SEQ ID NO: 830534 - DNA, 22 bp, Artificial Sequence
  chemically synthesized
aggataacagcttcgctctgat

SEQ ID NO: 830535 - DNA, 22 bp, Artificial Sequence
  chemically synthesized
taggataacagcttcgctctga

SEQ ID NO: 830536 - DNA, 22 bp, Artificial Sequence
  chemically synthesized
ttaggataacagcttcgctctg

SEQ ID NO: 830537 - DNA, 22 bp, Artificial Sequence
  chemically synthesized
aagatcatcagagcgaagctgt

SEQ ID NO: 830538 - DNA, 22 bp, Artificial Sequence
  chemically synthesized
atccacttttaggataacagct

SEQ ID NO: 830539 - DNA, 22 bp, Artificial Sequence
  chemically synthesized
ccacactgatccacttttagga

SEQ ID NO: 830540 - DNA, 22 bp, Artificial Sequence
  chemically synthesized
ttatcctaaaagtggatcagtg

SEQ ID NO: 830541 - DNA, 22 bp, Artificial Sequence
  chemically synthesized
tcctaaaagtggatcagtgtgg

SEQ ID NO: 830542 - DNA, 22 bp, Artificial Sequence
  chemically synthesized
tatgatgtcagactaccacact

SEQ ID NO: 830543 - DNA, 22 bp, Artificial Sequence
  chemically synthesized
aaagtggatcagtgtggtagtc

SEQ ID NO: 830544 - DNA, 22 bp, Artificial Sequence
  chemically synthesized
ccaggtctatatgatgtcagac

SEQ ID NO: 830545 - DNA, 22 bp, Artificial Sequence
  chemically synthesized
tggacaattaccaggtctatat

SEQ ID NO: 830546 - DNA, 22 bp, Artificial Sequence
  chemically synthesized
agttatggacaattaccaggtc

SEQ ID NO: 830547 - DNA, 22 bp, Artificial Sequence
  chemically synthesized
acatcatatagacctggtaatt

SEQ ID NO: 830548 - DNA, 22 bp, Artificial Sequence
  chemically synthesized
atgctcagttatggacaattac

SEQ ID NO: 830549 - DNA, 22 bp, Artificial Sequence
  chemically synthesized
gtaattgtccataactgagcat

SEQ ID NO: 830550 - DNA, 22 bp, Artificial Sequence
  chemically synthesized
tagtataaattgatgctcagtt

SEQ ID NO: 830551 - DNA, 22 bp, Artificial Sequence
  chemically synthesized
tgtagtataaattgatgctcag

SEQ ID NO: 830552 - DNA, 22 bp, Artificial Sequence
  chemically synthesized
tccataactgagcatcaattta

SEQ ID NO: 830553 - DNA, 22 bp, Artificial Sequence
  chemically synthesized
agcatcaatttatactacagaa

SEQ ID NO: 830554 - DNA, 22 bp, Artificial Sequence
  chemically synthesized
atactacagaattttaccacac

SEQ ID NO: 830555 - DNA, 22 bp, Artificial Sequence
  chemically synthesized
tactacagaattttaccacact

SEQ ID NO: 830556 - DNA, 22 bp, Artificial Sequence
  chemically synthesized
ggtgaagtgtcgcaagtgtggt

SEQ ID NO: 830557 - DNA, 22 bp, Artificial Sequence
  chemically synthesized
cagaattttaccacacttgcga

SEQ ID NO: 830558 - DNA, 22 bp, Artificial Sequence
  chemically synthesized
ctgggtgaagtgtcgcaagtgt

SEQ ID NO: 830559 - DNA, 22 bp, Artificial Sequence
  chemically synthesized
taccacacttgcgacacttcac

SEQ ID NO: 830560 - DNA, 22 bp, Artificial Sequence
  chemically synthesized
tcagtctcctgggtgaagtgtc

SEQ ID NO: 830561 - DNA, 22 bp, Artificial Sequence
  chemically synthesized
accacacttgcgacacttcacc

SEQ ID NO: 830562 - DNA, 22 bp, Artificial Sequence
  chemically synthesized
ccacacttgcgacacttcaccc

SEQ ID NO: 830563 - DNA, 22 bp, Artificial Sequence
  chemically synthesized
atctgtcagtctcctgggtgaa

SEQ ID NO: 830564 - DNA, 22 bp, Artificial Sequence
  chemically synthesized
gatctgtcagtctcctgggtga

SEQ ID NO: 830565 - DNA, 22 bp, Artificial Sequence
  chemically synthesized
tgatctgtcagtctcctgggtg

SEQ ID NO: 830566 - DNA, 22 bp, Artificial Sequence
  chemically synthesized
ttgatctgtcagtctcctgggt

SEQ ID NO: 830567 - DNA, 22 bp, Artificial Sequence
  chemically synthesized
gcgacacttcacccaggagact

SEQ ID NO: 830568 - DNA, 22 bp, Artificial Sequence
  chemically synthesized
cgacacttcacccaggagactg

SEQ ID NO: 830569 - DNA, 22 bp, Artificial Sequence
  chemically synthesized
cacccaggagactgacagatca

SEQ ID NO: 830570 - DNA, 22 bp, Artificial Sequence
  chemically synthesized
acccaggagactgacagatcaa

SEQ ID NO: 830571 - DNA, 22 bp, Artificial Sequence
  chemically synthesized
ccataatatgtttttgatctgt

SEQ ID NO: 830572 - DNA, 22 bp, Artificial Sequence
  chemically synthesized
acagatcaaaaacatattatgg

SEQ ID NO: 830573 - DNA, 22 bp, Artificial Sequence
  chemically synthesized
gtggccaaatacattgccataa

SEQ ID NO: 830574 - DNA, 22 bp, Artificial Sequence
  chemically synthesized
tagtggccaaatacattgccat

SEQ ID NO: 830575 - DNA, 22 bp, Artificial Sequence
  chemically synthesized
tggcaatgtatttggccactag

SEQ ID NO: 830576 - DNA, 22 bp, Artificial Sequence
  chemically synthesized
acaatatgggctctagtggcca

SEQ ID NO: 830577 - DNA, 22 bp, Artificial Sequence
  chemically synthesized
ggccactagagcccatattgtt

SEQ ID NO: 830578 - DNA, 22 bp, Artificial Sequence
  chemically synthesized
gccactagagcccatattgtta

SEQ ID NO: 830579 - DNA, 22 bp, Artificial Sequence
  chemically synthesized
gtgtaaatgtaaatctaacaat

SEQ ID NO: 830580 - DNA, 22 bp, Artificial Sequence
  chemically synthesized
ggtgtaaatgtaaatctaacaa

SEQ ID NO: 830581 - DNA, 22 bp, Artificial Sequence
  chemically synthesized
gagcccatattgttagatttac

SEQ ID NO: 830582 - DNA, 22 bp, Artificial Sequence
  chemically synthesized
ttagatttacatttacaccaaa

SEQ ID NO: 830583 - DNA, 22 bp, Artificial Sequence
  chemically synthesized
tatgtcagatgaatttggtgta

SEQ ID NO: 830584 - DNA, 22 bp, Artificial Sequence
  chemically synthesized
gtatgtcagatgaatttggtgt

SEQ ID NO: 830585 - DNA, 22 bp, Artificial Sequence
  chemically synthesized
gatttacatttacaccaaattc

SEQ ID NO: 830586 - DNA, 22 bp, Artificial Sequence
  chemically synthesized
tgtatgtcagatgaatttggtg

SEQ ID NO: 830587 - DNA, 22 bp, Artificial Sequence
  chemically synthesized
ttgtatgtcagatgaatttggt

SEQ ID NO: 830588 - DNA, 22 bp, Artificial Sequence
  chemically synthesized
acatttacaccaaattcatctg

SEQ ID NO: 830589 - DNA, 22 bp, Artificial Sequence
  chemically synthesized
acttttgtatgtcagatgaatt

SEQ ID NO: 830590 - DNA, 22 bp, Artificial Sequence
  chemically synthesized
catttacaccaaattcatctga

SEQ ID NO: 830591 - DNA, 22 bp, Artificial Sequence
  chemically synthesized
cacttttgtatgtcagatgaat

SEQ ID NO: 830592 - DNA, 22 bp, Artificial Sequence
  chemically synthesized
tttcacttttgtatgtcagatg

SEQ ID NO: 830593 - DNA, 22 bp, Artificial Sequence
  chemically synthesized
acaccaaattcatctgacatac

SEQ ID NO: 830594 - DNA, 22 bp, Artificial Sequence
  chemically synthesized
caccaaattcatctgacataca

SEQ ID NO: 830595 - DNA, 22 bp, Artificial Sequence
  chemically synthesized
ttatttcacttttgtatgtcag

SEQ ID NO: 830596 - DNA, 22 bp, Artificial Sequence
  chemically synthesized
ttattatttcacttttgtatgt

SEQ ID NO: 830597 - DNA, 22 bp, Artificial Sequence
  chemically synthesized
attattatttcacttttgtatg

SEQ ID NO: 830598 - DNA, 22 bp, Artificial Sequence
  chemically synthesized
tattattatttcacttttgtat

SEQ ID NO: 830599 - DNA, 22 bp, Artificial Sequence
  chemically synthesized
atctgacatacaaaagtgaaat

SEQ ID NO: 830600 - DNA, 22 bp, Artificial Sequence
  chemically synthesized
acatacaaaagtgaaataataa

SEQ ID NO: 830601 - DNA, 22 bp, Artificial Sequence
  chemically synthesized
tgtgcatatactttattattat

SEQ ID NO: 830602 - DNA, 22 bp, Artificial Sequence
  chemically synthesized
atgtgcatatactttattatta

SEQ ID NO: 830603 - DNA, 22 bp, Artificial Sequence
  chemically synthesized
ggtttatgtgcatatactttat

SEQ ID NO: 830604 - DNA, 22 bp, Artificial Sequence
  chemically synthesized
tctgggtttatgtgcatatact

SEQ ID NO: 830605 - DNA, 22 bp, Artificial Sequence
  chemically synthesized
caaacatgcacagattgtctgg

SEQ ID NO: 830606 - DNA, 22 bp, Artificial Sequence
  chemically synthesized
aattacaaacatgcacagattg

SEQ ID NO: 830607 - DNA, 22 bp, Artificial Sequence
  chemically synthesized
caattacaaacatgcacagatt

SEQ ID NO: 830608 - DNA, 22 bp, Artificial Sequence
  chemically synthesized
ttcaattacaaacatgcacaga

SEQ ID NO: 830609 - DNA, 22 bp, Artificial Sequence
  chemically synthesized
ggtagctcttcaattacaaaca

SEQ ID NO: 830610 - DNA, 22 bp, Artificial Sequence
  chemically synthesized
tgcatgtttgtaattgaagagc

SEQ ID NO: 830611 - DNA, 22 bp, Artificial Sequence
  chemically synthesized
gtaattgaagagctacccaatg

SEQ ID NO: 830612 - DNA, 22 bp, Artificial Sequence
  chemically synthesized
taattgaagagctacccaatgt

SEQ ID NO: 830613 - DNA, 22 bp, Artificial Sequence
  chemically synthesized
aagagctacccaatgtacacat

SEQ ID NO: 830614 - DNA, 22 bp, Artificial Sequence
  chemically synthesized
tgagaaaaaaaaaatgtgtaca

SEQ ID NO: 830615 - DNA, 22 bp, Artificial Sequence
  chemically synthesized
gtgagaaaaaaaaaatgtgtac

SEQ ID NO: 830616 - DNA, 22 bp, Artificial Sequence
  chemically synthesized
tgtgagaaaaaaaaaatgtgta

SEQ ID NO: 830617 - DNA, 22 bp, Artificial Sequence
  chemically synthesized
cccaatgtacacattttttttt

SEQ ID NO: 830618 - DNA, 22 bp, Artificial Sequence
  chemically synthesized
catgacggacctttgtgagaaa

SEQ ID NO: 830619 - DNA, 22 bp, Artificial Sequence
  chemically synthesized
ccatgacggacctttgtgagaa

SEQ ID NO: 830620 - DNA, 22 bp, Artificial Sequence
  chemically synthesized
tccatgacggacctttgtgaga

SEQ ID NO: 830621 - DNA, 22 bp, Artificial Sequence
  chemically synthesized
tttttttctcacaaaggtccgt

SEQ ID NO: 830622 - DNA, 22 bp, Artificial Sequence
  chemically synthesized
ttttttctcacaaaggtccgtc

SEQ ID NO: 830623 - DNA, 22 bp, Artificial Sequence
  chemically synthesized
tttttctcacaaaggtccgtca

SEQ ID NO: 830624 - DNA, 22 bp, Artificial Sequence
  chemically synthesized
ttttctcacaaaggtccgtcat

SEQ ID NO: 830625 - DNA, 22 bp, Artificial Sequence
  chemically synthesized
tttctcacaaaggtccgtcatg

SEQ ID NO: 830626 - DNA, 22 bp, Artificial Sequence
  chemically synthesized
ttctcacaaaggtccgtcatgg

SEQ ID NO: 830627 - DNA, 22 bp, Artificial Sequence
  chemically synthesized
tctcacaaaggtccgtcatgga

SEQ ID NO: 830628 - DNA, 22 bp, Artificial Sequence
  chemically synthesized
gtcgagaagctttccatgacgg

SEQ ID NO: 830629 - DNA, 22 bp, Artificial Sequence
  chemically synthesized
ctcacaaaggtccgtcatggaa

SEQ ID NO: 830630 - DNA, 22 bp, Artificial Sequence
  chemically synthesized
tcacaaaggtccgtcatggaaa

SEQ ID NO: 830631 - DNA, 22 bp, Artificial Sequence
  chemically synthesized
acaaaggtccgtcatggaaagc

SEQ ID NO: 830632 - DNA, 22 bp, Artificial Sequence
  chemically synthesized
cacaaattagtcgagaagcttt

SEQ ID NO: 830633 - DNA, 22 bp, Artificial Sequence
  chemically synthesized
ctgcacaaattagtcgagaagc

SEQ ID NO: 830634 - DNA, 22 bp, Artificial Sequence
  chemically synthesized
actgcacaaattagtcgagaag

SEQ ID NO: 830635 - DNA, 22 bp, Artificial Sequence
  chemically synthesized
tttactgcacaaattagtcgag

SEQ ID NO: 830636 - DNA, 22 bp, Artificial Sequence
  chemically synthesized
cccaacatctatttactgcaca

SEQ ID NO: 830637 - DNA, 22 bp, Artificial Sequence
  chemically synthesized
ctcgactaatttgtgcagtaaa

SEQ ID NO: 830638 - DNA, 22 bp, Artificial Sequence
  chemically synthesized
tcgactaatttgtgcagtaaat

SEQ ID NO: 830639 - DNA, 22 bp, Artificial Sequence
  chemically synthesized
ttacccaacatctatttactgc

SEQ ID NO: 830640 - DNA, 22 bp, Artificial Sequence
  chemically synthesized
gactaatttgtgcagtaaatag

SEQ ID NO: 830641 - DNA, 22 bp, Artificial Sequence
  chemically synthesized
attacccaacatctatttactg

SEQ ID NO: 830642 - DNA, 22 bp, Artificial Sequence
  chemically synthesized
tattacccaacatctatttact

SEQ ID NO: 830643 - DNA, 22 bp, Artificial Sequence
  chemically synthesized
atttgtgcagtaaatagatgtt

SEQ ID NO: 830644 - DNA, 22 bp, Artificial Sequence
  chemically synthesized
cctttattacccaacatctatt

SEQ ID NO: 830645 - DNA, 22 bp, Artificial Sequence
  chemically synthesized
ccctttattacccaacatctat

SEQ ID NO: 830646 - DNA, 22 bp, Artificial Sequence
  chemically synthesized
gtgcagtaaatagatgttgggt

SEQ ID NO: 830647 - DNA, 22 bp, Artificial Sequence
  chemically synthesized
tttccctttattacccaacatc

SEQ ID NO: 830648 - DNA, 22 bp, Artificial Sequence
  chemically synthesized
tgcagtaaatagatgttgggta

SEQ ID NO: 830649 - DNA, 22 bp, Artificial Sequence
  chemically synthesized
atttccctttattacccaacat

SEQ ID NO: 830650 - DNA, 22 bp, Artificial Sequence
  chemically synthesized
tttatttccctttattacccaa

SEQ ID NO: 830651 - DNA, 22 bp, Artificial Sequence
  chemically synthesized
gttatttatttccctttattac

SEQ ID NO: 830652 - DNA, 22 bp, Artificial Sequence
  chemically synthesized
gcattggttatttatttccctt

SEQ ID NO: 830653 - DNA, 22 bp, Artificial Sequence
  chemically synthesized
agcattggttatttatttccct

SEQ ID NO: 830654 - DNA, 22 bp, Artificial Sequence
  chemically synthesized
ggtaataaagggaaataaataa

SEQ ID NO: 830655 - DNA, 22 bp, Artificial Sequence
  chemically synthesized
agtcttagcattggttatttat

SEQ ID NO: 830656 - DNA, 22 bp, Artificial Sequence
  chemically synthesized
tcatcctgagtcttagcattgg

SEQ ID NO: 830657 - DNA, 22 bp, Artificial Sequence
  chemically synthesized
agtctgtcatcctgagtcttag

SEQ ID NO: 830658 - DNA, 22 bp, Artificial Sequence
  chemically synthesized
ggtctcagtctgtcatcctgag

SEQ ID NO: 830659 - DNA, 22 bp, Artificial Sequence
  chemically synthesized
agactcaggatgacagactgag

SEQ ID NO: 830660 - DNA, 22 bp, Artificial Sequence
  chemically synthesized
aggatgacagactgagacccag

SEQ ID NO: 830661 - DNA, 22 bp, Artificial Sequence
  chemically synthesized
gtaaatcaggacacatgctggg

SEQ ID NO: 830662 - DNA, 22 bp, Artificial Sequence
  chemically synthesized
gaggttcgtaaatcaggacaca

SEQ ID NO: 830663 - DNA, 22 bp, Artificial Sequence
  chemically synthesized
agacccagcatgtgtcctgatt

SEQ ID NO: 830664 - DNA, 22 bp, Artificial Sequence
  chemically synthesized
tggaggttcgtaaatcaggaca

SEQ ID NO: 830665 - DNA, 22 bp, Artificial Sequence
  chemically synthesized
ctggaggttcgtaaatcaggac

SEQ ID NO: 830666 - DNA, 22 bp, Artificial Sequence
  chemically synthesized
acacttctggaggttcgtaaat

SEQ ID NO: 830667 - DNA, 22 bp, Artificial Sequence
  chemically synthesized
gacacttctggaggttcgtaaa

SEQ ID NO: 830668 - DNA, 22 bp, Artificial Sequence
  chemically synthesized
caatttgacacttctggaggtt

SEQ ID NO: 830669 - DNA, 22 bp, Artificial Sequence
  chemically synthesized
ccaatttgacacttctggaggt

SEQ ID NO: 830670 - DNA, 22 bp, Artificial Sequence
  chemically synthesized
atttacgaacctccagaagtgt

SEQ ID NO: 830671 - DNA, 22 bp, Artificial Sequence
  chemically synthesized
agtttccaatttgacacttctg

SEQ ID NO: 830672 - DNA, 22 bp, Artificial Sequence
  chemically synthesized
acgaacctccagaagtgtcaaa

SEQ ID NO: 830673 - DNA, 22 bp, Artificial Sequence
  chemically synthesized
ctgagtttccaatttgacactt

SEQ ID NO: 830674 - DNA, 22 bp, Artificial Sequence
  chemically synthesized
cgaacctccagaagtgtcaaat

SEQ ID NO: 830675 - DNA, 22 bp, Artificial Sequence
  chemically synthesized
cagaagtgtcaaattggaaact

SEQ ID NO: 830676 - DNA, 22 bp, Artificial Sequence
  chemically synthesized
acatgattgctgagtttccaat

SEQ ID NO: 830677 - DNA, 22 bp, Artificial Sequence
  chemically synthesized
gacatgattgctgagtttccaa

SEQ ID NO: 830678 - DNA, 22 bp, Artificial Sequence
  chemically synthesized
ttgacatgattgctgagtttcc

SEQ ID NO: 830679 - DNA, 22 bp, Artificial Sequence
  chemically synthesized
tggttcttgacatgattgctga

SEQ ID NO: 830680 - DNA, 22 bp, Artificial Sequence
  chemically synthesized
gaaactcagcaatcatgtcaag

SEQ ID NO: 830681 - DNA, 22 bp, Artificial Sequence
  chemically synthesized
caatattgtggttcttgacatg

SEQ ID NO: 830682 - DNA, 22 bp, Artificial Sequence
  chemically synthesized
tgcaatattgtggttcttgaca

SEQ ID NO: 830683 - DNA, 22 bp, Artificial Sequence
  chemically synthesized
tctgcaatattgtggttcttga

SEQ ID NO: 830684 - DNA, 22 bp, Artificial Sequence
  chemically synthesized
ctctgcaatattgtggttcttg

SEQ ID NO: 830685 - DNA, 22 bp, Artificial Sequence
  chemically synthesized
agcaatcatgtcaagaaccaca

SEQ ID NO: 830686 - DNA, 22 bp, Artificial Sequence
  chemically synthesized
tctctgcaatattgtggttctt

SEQ ID NO: 830687 - DNA, 22 bp, Artificial Sequence
  chemically synthesized
tttctctgcaatattgtggttc

SEQ ID NO: 830688 - DNA, 22 bp, Artificial Sequence
  chemically synthesized
ctttctctgcaatattgtggtt

SEQ ID NO: 830689 - DNA, 22 bp, Artificial Sequence
  chemically synthesized
tttctttctctgcaatattgtg

SEQ ID NO: 830690 - DNA, 22 bp, Artificial Sequence
  chemically synthesized
aactgtttctttctctgcaata

SEQ ID NO: 830691 - DNA, 22 bp, Artificial Sequence
  chemically synthesized
aatcaactgaactgtttctttc

SEQ ID NO: 830692 - DNA, 22 bp, Artificial Sequence
  chemically synthesized
gtattcaatcaactgaactgtt

SEQ ID NO: 830693 - DNA, 22 bp, Artificial Sequence
  chemically synthesized
cagagaaagaaacagttcagtt

SEQ ID NO: 830694 - DNA, 22 bp, Artificial Sequence
  chemically synthesized
gttcgtattcaatcaactgaac

SEQ ID NO: 830695 - DNA, 22 bp, Artificial Sequence
  chemically synthesized
aagtgaaagattggttcgtatt

SEQ ID NO: 830696 - DNA, 22 bp, Artificial Sequence
  chemically synthesized
gaagtgaaagattggttcgtat

SEQ ID NO: 830697 - DNA, 22 bp, Artificial Sequence
  chemically synthesized
agttgattgaatacgaaccaat

SEQ ID NO: 830698 - DNA, 22 bp, Artificial Sequence
  chemically synthesized
attgaatacgaaccaatctttc

SEQ ID NO: 830699 - DNA, 22 bp, Artificial Sequence
  chemically synthesized
aaaaacttgaagtgaaagattg

SEQ ID NO: 830700 - DNA, 22 bp, Artificial Sequence
  chemically synthesized
aatacgaaccaatctttcactt

SEQ ID NO: 830701 - DNA, 22 bp, Artificial Sequence
  chemically synthesized
gtctaaaaaacttgaagtgaaa

SEQ ID NO: 830702 - DNA, 22 bp, Artificial Sequence
  chemically synthesized
aacatagctagtctaaaaaact

SEQ ID NO: 830703 - DNA, 22 bp, Artificial Sequence
  chemically synthesized
tcacttcaagttttttagacta

SEQ ID NO: 830704 - DNA, 22 bp, Artificial Sequence
  chemically synthesized
cacttcaagttttttagactag

SEQ ID NO: 830705 - DNA, 22 bp, Artificial Sequence
  chemically synthesized
acttcaagttttttagactagc

SEQ ID NO: 830706 - DNA, 22 bp, Artificial Sequence
  chemically synthesized
caagttttttagactagctatg

SEQ ID NO: 830707 - DNA, 22 bp, Artificial Sequence
  chemically synthesized
aagttttttagactagctatgt

SEQ ID NO: 830708 - DNA, 22 bp, Artificial Sequence
  chemically synthesized
tttagactagctatgtttaatt

SEQ ID NO: 830709 - DNA, 22 bp, Artificial Sequence
  chemically synthesized
ttagactagctatgtttaatta

SEQ ID NO: 830710 - DNA, 22 bp, Artificial Sequence
  chemically synthesized
tagactagctatgtttaattat

SEQ ID NO: 830711 - DNA, 22 bp, Artificial Sequence
  chemically synthesized
agactagctatgtttaattatc

SEQ ID NO: 830712 - DNA, 22 bp, Artificial Sequence
  chemically synthesized
gactagctatgtttaattatcg

SEQ ID NO: 830713 - DNA, 22 bp, Artificial Sequence
  chemically synthesized
gctatgtttaattatcgatata

SEQ ID NO: 830714 - DNA, 22 bp, Artificial Sequence
  chemically synthesized
tatcagtcaagaatgtatatcg

SEQ ID NO: 830715 - DNA, 22 bp, Artificial Sequence
  chemically synthesized
tgtttaattatcgatatacatt

SEQ ID NO: 830716 - DNA, 22 bp, Artificial Sequence
  chemically synthesized
atatcagtcaagaatgtatatc

SEQ ID NO: 830717 - DNA, 22 bp, Artificial Sequence
  chemically synthesized
aattatcgatatacattcttga

SEQ ID NO: 830718 - DNA, 22 bp, Artificial Sequence
  chemically synthesized
attatcgatatacattcttgac

SEQ ID NO: 830719 - DNA, 22 bp, Artificial Sequence
  chemically synthesized
tgggaatttatatcagtcaaga

SEQ ID NO: 830720 - DNA, 22 bp, Artificial Sequence
  chemically synthesized
tcgatatacattcttgactgat

SEQ ID NO: 830721 - DNA, 22 bp, Artificial Sequence
  chemically synthesized
agagagatgttgtgggaattta

SEQ ID NO: 830722 - DNA, 22 bp, Artificial Sequence
  chemically synthesized
ttgactgatataaattcccaca

SEQ ID NO: 830723 - DNA, 22 bp, Artificial Sequence
  chemically synthesized
gactgatataaattcccacaac

SEQ ID NO: 830724 - DNA, 22 bp, Artificial Sequence
  chemically synthesized
cctaagagagatgttgtgggaa

SEQ ID NO: 830725 - DNA, 22 bp, Artificial Sequence
  chemically synthesized
actgatataaattcccacaaca

SEQ ID NO: 830726 - DNA, 22 bp, Artificial Sequence
  chemically synthesized
ctccctaagagagatgttgtgg

SEQ ID NO: 830727 - DNA, 22 bp, Artificial Sequence
  chemically synthesized
atataaattcccacaacatctc

SEQ ID NO: 830728 - DNA, 22 bp, Artificial Sequence
  chemically synthesized
ccacaacatctctcttagggag

SEQ ID NO: 830729 - DNA, 22 bp, Artificial Sequence
  chemically synthesized
tgtataaataacattcctccct

SEQ ID NO: 830730 - DNA, 22 bp, Artificial Sequence
  chemically synthesized
gtgtataaataacattcctccc

SEQ ID NO: 830731 - DNA, 22 bp, Artificial Sequence
  chemically synthesized
ttgtgtataaataacattcctc

SEQ ID NO: 830732 - DNA, 22 bp, Artificial Sequence
  chemically synthesized
cttgtgtataaataacattcct

SEQ ID NO: 830733 - DNA, 22 bp, Artificial Sequence
  chemically synthesized
tcttagggaggaatgttattta

SEQ ID NO: 830734 - DNA, 22 bp, Artificial Sequence
  chemically synthesized
ttagggaggaatgttatttata

SEQ ID NO: 830735 - DNA, 22 bp, Artificial Sequence
  chemically synthesized
agggaggaatgttatttataca

SEQ ID NO: 830736 - DNA, 22 bp, Artificial Sequence
  chemically synthesized
gggaggaatgttatttatacac

SEQ ID NO: 830737 - DNA, 22 bp, Artificial Sequence
  chemically synthesized
aaaaggtaatcatttcttgtgt

SEQ ID NO: 830738 - DNA, 22 bp, Artificial Sequence
  chemically synthesized
tttatacacaagaaatgattac

SEQ ID NO: 830739 - DNA, 22 bp, Artificial Sequence
  chemically synthesized
atacacaagaaatgattacctt

SEQ ID NO: 830740 - DNA, 22 bp, Artificial Sequence
  chemically synthesized
tacacaagaaatgattaccttt

SEQ ID NO: 830741 - DNA, 22 bp, Artificial Sequence
  chemically synthesized
tagcaatgtgtattcaaaaggt

SEQ ID NO: 830742 - DNA, 22 bp, Artificial Sequence
  chemically synthesized
tgtagcaatgtgtattcaaaag

SEQ ID NO: 830743 - DNA, 22 bp, Artificial Sequence
  chemically synthesized
ttctgtagcaatgtgtattcaa

SEQ ID NO: 830744 - DNA, 22 bp, Artificial Sequence
  chemically synthesized
gttctgtagcaatgtgtattca

SEQ ID NO: 830745 - DNA, 22 bp, Artificial Sequence
  chemically synthesized
tgttctgtagcaatgtgtattc

SEQ ID NO: 830746 - DNA, 22 bp, Artificial Sequence
  chemically synthesized
tttgttctgtagcaatgtgtat

SEQ ID NO: 830747 - DNA, 22 bp, Artificial Sequence
  chemically synthesized
ttctttgttctgtagcaatgtg

SEQ ID NO: 830748 - DNA, 22 bp, Artificial Sequence
  chemically synthesized
ccttttgaatacacattgctac

SEQ ID NO: 830749 - DNA, 22 bp, Artificial Sequence
  chemically synthesized
ttgaatacacattgctacagaa

SEQ ID NO: 830750 - DNA, 22 bp, Artificial Sequence
  chemically synthesized
tgaatacacattgctacagaac

SEQ ID NO: 830751 - DNA, 22 bp, Artificial Sequence
  chemically synthesized
gaatacacattgctacagaaca

SEQ ID NO: 830752 - DNA, 22 bp, Artificial Sequence
  chemically synthesized
aatacacattgctacagaacaa

SEQ ID NO: 830753 - DNA, 22 bp, Artificial Sequence
  chemically synthesized
caacagaactgttctttgttct

SEQ ID NO: 830754 - DNA, 22 bp, Artificial Sequence
  chemically synthesized
ctacagaacaaagaacagttct

SEQ ID NO: 830755 - DNA, 22 bp, Artificial Sequence
  chemically synthesized
cagaacaaagaacagttctgtt

SEQ ID NO: 830756 - DNA, 22 bp, Artificial Sequence
  chemically synthesized
tacagtcagtgcagaaattgca

SEQ ID NO: 830757 - DNA, 22 bp, Artificial Sequence
  chemically synthesized
gtgctgtacagtcagtgcagaa

SEQ ID NO: 830758 - DNA, 22 bp, Artificial Sequence
  chemically synthesized
tcgtgctgtacagtcagtgcag

SEQ ID NO: 830759 - DNA, 22 bp, Artificial Sequence
  chemically synthesized
tgttgcaatttctgcactgact

SEQ ID NO: 830760 - DNA, 22 bp, Artificial Sequence
  chemically synthesized
ttgcaatttctgcactgactgt

SEQ ID NO: 830761 - DNA, 22 bp, Artificial Sequence
  chemically synthesized
attctcgtgctgtacagtcagt

SEQ ID NO: 830762 - DNA, 22 bp, Artificial Sequence
  chemically synthesized
caatttctgcactgactgtaca

SEQ ID NO: 830763 - DNA, 22 bp, Artificial Sequence
  chemically synthesized
taattctcgtgctgtacagtca

SEQ ID NO: 830764 - DNA, 22 bp, Artificial Sequence
  chemically synthesized
ctaattctcgtgctgtacagtc

SEQ ID NO: 830765 - DNA, 22 bp, Artificial Sequence
  chemically synthesized
ctgcactgactgtacagcacga

SEQ ID NO: 830766 - DNA, 22 bp, Artificial Sequence
  chemically synthesized
tgcactgactgtacagcacgag

SEQ ID NO: 830767 - DNA, 22 bp, Artificial Sequence
  chemically synthesized
cactgactgtacagcacgagaa

SEQ ID NO: 830768 - DNA, 22 bp, Artificial Sequence
  chemically synthesized
cacagacttctaattctcgtgc

SEQ ID NO: 830769 - DNA, 22 bp, Artificial Sequence
  chemically synthesized
actgtacagcacgagaattaga

SEQ ID NO: 830770 - DNA, 22 bp, Artificial Sequence
  chemically synthesized
tacagcacgagaattagaagtc

SEQ ID NO: 830771 - DNA, 22 bp, Artificial Sequence
  chemically synthesized
aaaatcagttacacagacttct

SEQ ID NO: 830772 - DNA, 22 bp, Artificial Sequence
  chemically synthesized
taaaaatcagttacacagactt

SEQ ID NO: 830773 - DNA, 22 bp, Artificial Sequence
  chemically synthesized
ctaaaaatcagttacacagact

SEQ ID NO: 830774 - DNA, 22 bp, Artificial Sequence
  chemically synthesized
tctaaaaatcagttacacagac

SEQ ID NO: 830775 - DNA, 22 bp, Artificial Sequence
  chemically synthesized
ctttctaaaaatcagttacaca

SEQ ID NO: 830776 - DNA, 22 bp, Artificial Sequence
  chemically synthesized
gaagtctgtgtaactgattttt

SEQ ID NO: 830777 - DNA, 22 bp, Artificial Sequence
  chemically synthesized
gtcaaagttgctttctaaaaat

SEQ ID NO: 830778 - DNA, 22 bp, Artificial Sequence
  chemically synthesized
ctagtcaaagttgctttctaaa

SEQ ID NO: 830779 - DNA, 22 bp, Artificial Sequence
  chemically synthesized
tgtaactgatttttagaaagca

SEQ ID NO: 830780 - DNA, 22 bp, Artificial Sequence
  chemically synthesized
actgctagtcaaagttgctttc

SEQ ID NO: 830781 - DNA, 22 bp, Artificial Sequence
  chemically synthesized
atttttagaaagcaactttgac

SEQ ID NO: 830782 - DNA, 22 bp, Artificial Sequence
  chemically synthesized
ttagaaagcaactttgactagc

SEQ ID NO: 830783 - DNA, 22 bp, Artificial Sequence
  chemically synthesized
tagaaagcaactttgactagca

SEQ ID NO: 830784 - DNA, 22 bp, Artificial Sequence
  chemically synthesized
agaaagcaactttgactagcag

SEQ ID NO: 830785 - DNA, 22 bp, Artificial Sequence
  chemically synthesized
gaaagcaactttgactagcagt

SEQ ID NO: 830786 - DNA, 22 bp, Artificial Sequence
  chemically synthesized
taacccaagactaactgctagt

SEQ ID NO: 830787 - DNA, 22 bp, Artificial Sequence
  chemically synthesized
tgactagcagttagtcttgggt

SEQ ID NO: 830788 - DNA, 22 bp, Artificial Sequence
  chemically synthesized
gactagcagttagtcttgggtt

SEQ ID NO: 830789 - DNA, 22 bp, Artificial Sequence
  chemically synthesized
atccagggttataacccaagac

SEQ ID NO: 830790 - DNA, 22 bp, Artificial Sequence
  chemically synthesized
actagcagttagtcttgggtta

SEQ ID NO: 830791 - DNA, 22 bp, Artificial Sequence
  chemically synthesized
gcagttagtcttgggttataac

SEQ ID NO: 830792 - DNA, 22 bp, Artificial Sequence
  chemically synthesized
atcgctaatccagggttataac

SEQ ID NO: 830793 - DNA, 22 bp, Artificial Sequence
  chemically synthesized
catcgctaatccagggttataa

SEQ ID NO: 830794 - DNA, 22 bp, Artificial Sequence
  chemically synthesized
tttcatcgctaatccagggtta

SEQ ID NO: 830795 - DNA, 22 bp, Artificial Sequence
  chemically synthesized
gtcttgggttataaccctggat

SEQ ID NO: 830796 - DNA, 22 bp, Artificial Sequence
  chemically synthesized
gggttataaccctggattagcg

SEQ ID NO: 830797 - DNA, 22 bp, Artificial Sequence
  chemically synthesized
ggttataaccctggattagcga

SEQ ID NO: 830798 - DNA, 22 bp, Artificial Sequence
  chemically synthesized
aatccactatttcatcgctaat

SEQ ID NO: 830799 - DNA, 22 bp, Artificial Sequence
  chemically synthesized
aaatccactatttcatcgctaa

SEQ ID NO: 830800 - DNA, 22 bp, Artificial Sequence
  chemically synthesized
taaccctggattagcgatgaaa

SEQ ID NO: 830801 - DNA, 22 bp, Artificial Sequence
  chemically synthesized
ccatttaaatccactatttcat

SEQ ID NO: 830802 - DNA, 22 bp, Artificial Sequence
  chemically synthesized
cccatttaaatccactatttca

SEQ ID NO: 830803 - DNA, 22 bp, Artificial Sequence
  chemically synthesized
tcccatttaaatccactatttc

SEQ ID NO: 830804 - DNA, 22 bp, Artificial Sequence
  chemically synthesized
ttcccatttaaatccactattt

SEQ ID NO: 830805 - DNA, 22 bp, Artificial Sequence
  chemically synthesized
gattagcgatgaaatagtggat

SEQ ID NO: 830806 - DNA, 22 bp, Artificial Sequence
  chemically synthesized
gcgatgaaatagtggatttaaa

SEQ ID NO: 830807 - DNA, 22 bp, Artificial Sequence
  chemically synthesized
agatcgtggcaaatcaactttt

SEQ ID NO: 830808 - DNA, 22 bp, Artificial Sequence
  chemically synthesized
aaatgggaaaagttgatttgcc

SEQ ID NO: 830809 - DNA, 22 bp, Artificial Sequence
  chemically synthesized
aatgggaaaagttgatttgcca

SEQ ID NO: 830810 - DNA, 22 bp, Artificial Sequence
  chemically synthesized
aggaaactgagatcgtggcaaa

SEQ ID NO: 830811 - DNA, 22 bp, Artificial Sequence
  chemically synthesized
ggagttgaggaaactgagatcg

SEQ ID NO: 830812 - DNA, 22 bp, Artificial Sequence
  chemically synthesized
gggagttgaggaaactgagatc

SEQ ID NO: 830813 - DNA, 22 bp, Artificial Sequence
  chemically synthesized
atttgccacgatctcagtttcc

SEQ ID NO: 830814 - DNA, 22 bp, Artificial Sequence
  chemically synthesized
agtttgggagttgaggaaactg

SEQ ID NO: 830815 - DNA, 22 bp, Artificial Sequence
  chemically synthesized
cagtttgggagttgaggaaact

SEQ ID NO: 830816 - DNA, 22 bp, Artificial Sequence
  chemically synthesized
gccacgatctcagtttcctcaa

SEQ ID NO: 830817 - DNA, 22 bp, Artificial Sequence
  chemically synthesized
ccacgatctcagtttcctcaac

SEQ ID NO: 830818 - DNA, 22 bp, Artificial Sequence
  chemically synthesized
tttcagtttgggagttgaggaa

SEQ ID NO: 830819 - DNA, 22 bp, Artificial Sequence
  chemically synthesized
tcattatttcagtttgggagtt

SEQ ID NO: 830820 - DNA, 22 bp, Artificial Sequence
  chemically synthesized
agtttcctcaactcccaaactg

SEQ ID NO: 830821 - DNA, 22 bp, Artificial Sequence
  chemically synthesized
cagttgtcattatttcagtttg

SEQ ID NO: 830822 - DNA, 22 bp, Artificial Sequence
  chemically synthesized
cctcaactcccaaactgaaata

SEQ ID NO: 830823 - DNA, 22 bp, Artificial Sequence
  chemically synthesized
tgcagttgtcattatttcagtt

SEQ ID NO: 830824 - DNA, 22 bp, Artificial Sequence
  chemically synthesized
ctcaactcccaaactgaaataa

SEQ ID NO: 830825 - DNA, 22 bp, Artificial Sequence
  chemically synthesized
aactcccaaactgaaataatga

SEQ ID NO: 830826 - DNA, 22 bp, Artificial Sequence
  chemically synthesized
tggttctgcagttgtcattatt

SEQ ID NO: 830827 - DNA, 22 bp, Artificial Sequence
  chemically synthesized
tgtggttctgcagttgtcatta

SEQ ID NO: 830828 - DNA, 22 bp, Artificial Sequence
  chemically synthesized
ccaaactgaaataatgacaact

SEQ ID NO: 830829 - DNA, 22 bp, Artificial Sequence
  chemically synthesized
aaataatgacaactgcagaacc

SEQ ID NO: 830830 - DNA, 22 bp, Artificial Sequence
  chemically synthesized
acaataattctgtggttctgca

SEQ ID NO: 830831 - DNA, 22 bp, Artificial Sequence
  chemically synthesized
cacaataattctgtggttctgc

SEQ ID NO: 830832 - DNA, 22 bp, Artificial Sequence
  chemically synthesized
tcttcacaataattctgtggtt

SEQ ID NO: 830833 - DNA, 22 bp, Artificial Sequence
  chemically synthesized
atcttcacaataattctgtggt

SEQ ID NO: 830834 - DNA, 22 bp, Artificial Sequence
  chemically synthesized
tatcttcacaataattctgtgg

SEQ ID NO: 830835 - DNA, 22 bp, Artificial Sequence
  chemically synthesized
aattttatcttcacaataattc

SEQ ID NO: 830836 - DNA, 22 bp, Artificial Sequence
  chemically synthesized
cagaaccacagaattattgtga

SEQ ID NO: 830837 - DNA, 22 bp, Artificial Sequence
  chemically synthesized
ttgaattttatcttcacaataa

SEQ ID NO: 830838 - DNA, 22 bp, Artificial Sequence
  chemically synthesized
attattgaattttatcttcaca

SEQ ID NO: 830839 - DNA, 22 bp, Artificial Sequence
  chemically synthesized
ttcattattgaattttatcttc

SEQ ID NO: 830840 - DNA, 22 bp, Artificial Sequence
  chemically synthesized
attcattattgaattttatctt

SEQ ID NO: 830841 - DNA, 22 bp, Artificial Sequence
  chemically synthesized
tattcattattgaattttatct

SEQ ID NO: 830842 - DNA, 22 bp, Artificial Sequence
  chemically synthesized
ttattcattattgaattttatc

SEQ ID NO: 830843 - DNA, 22 bp, Artificial Sequence
  chemically synthesized
ttgtgaagataaaattcaataa

SEQ ID NO: 830844 - DNA, 22 bp, Artificial Sequence
  chemically synthesized
tgcttttattcattattgaatt

SEQ ID NO: 830845 - DNA, 22 bp, Artificial Sequence
  chemically synthesized
atgcttttattcattattgaat

SEQ ID NO: 830846 - DNA, 22 bp, Artificial Sequence
  chemically synthesized
tatgcttttattcattattgaa

SEQ ID NO: 830847 - DNA, 22 bp, Artificial Sequence
  chemically synthesized
tgaagataaaattcaataatga

SEQ ID NO: 830848 - DNA, 22 bp, Artificial Sequence
  chemically synthesized
gtaggatcctttatgcttttat

SEQ ID NO: 830849 - DNA, 22 bp, Artificial Sequence
  chemically synthesized
agtaggatcctttatgctttta

SEQ ID NO: 830850 - DNA, 22 bp, Artificial Sequence
  chemically synthesized
tagtaggatcctttatgctttt

SEQ ID NO: 830851 - DNA, 22 bp, Artificial Sequence
  chemically synthesized
aataatgaataaaagcataaag

SEQ ID NO: 830852 - DNA, 22 bp, Artificial Sequence
  chemically synthesized
ctttagtaggatcctttatgct

SEQ ID NO: 830853 - DNA, 22 bp, Artificial Sequence
  chemically synthesized
gctttagtaggatcctttatgc

SEQ ID NO: 830854 - DNA, 22 bp, Artificial Sequence
  chemically synthesized
tacagagaagcagtagcacctt

SEQ ID NO: 830855 - DNA, 22 bp, Artificial Sequence
  chemically synthesized
tctatacagagaagcagtagca

SEQ ID NO: 830856 - DNA, 22 bp, Artificial Sequence
  chemically synthesized
ctaaagcaaggtgctactgctt

SEQ ID NO: 830857 - DNA, 22 bp, Artificial Sequence
  chemically synthesized
gtctatacagagaagcagtagc

SEQ ID NO: 830858 - DNA, 22 bp, Artificial Sequence
  chemically synthesized
aagcaaggtgctactgcttctc

SEQ ID NO: 830859 - DNA, 22 bp, Artificial Sequence
  chemically synthesized
gtcttgtctatacagagaagca

SEQ ID NO: 830860 - DNA, 22 bp, Artificial Sequence
  chemically synthesized
agtcttgtctatacagagaagc

SEQ ID NO: 830861 - DNA, 22 bp, Artificial Sequence
  chemically synthesized
tttagtcttgtctatacagaga

SEQ ID NO: 830862 - DNA, 22 bp, Artificial Sequence
  chemically synthesized
attgtttagtcttgtctataca

SEQ ID NO: 830863 - DNA, 22 bp, Artificial Sequence
  chemically synthesized
ctgcttctctgtatagacaaga

SEQ ID NO: 830864 - DNA, 22 bp, Artificial Sequence
  chemically synthesized
cttctctgtatagacaagacta

SEQ ID NO: 830865 - DNA, 22 bp, Artificial Sequence
  chemically synthesized
taattcattgtttagtcttgtc

SEQ ID NO: 830866 - DNA, 22 bp, Artificial Sequence
  chemically synthesized
ctctgtatagacaagactaaac

SEQ ID NO: 830867 - DNA, 22 bp, Artificial Sequence
  chemically synthesized
tctgtatagacaagactaaaca

SEQ ID NO: 830868 - DNA, 22 bp, Artificial Sequence
  chemically synthesized
tgtatagacaagactaaacaat

SEQ ID NO: 830869 - DNA, 22 bp, Artificial Sequence
  chemically synthesized
ataactataattcattgtttag

SEQ ID NO: 830870 - DNA, 22 bp, Artificial Sequence
  chemically synthesized
tatagacaagactaaacaatga

SEQ ID NO: 830871 - DNA, 22 bp, Artificial Sequence
  chemically synthesized
ttgataactataattcattgtt

SEQ ID NO: 830872 - DNA, 22 bp, Artificial Sequence
  chemically synthesized
gttgataactataattcattgt

SEQ ID NO: 830873 - DNA, 22 bp, Artificial Sequence
  chemically synthesized
aacaatgaattatagttatcaa

SEQ ID NO: 830874 - DNA, 22 bp, Artificial Sequence
  chemically synthesized
gcagatcgtgaatgtttgttga

SEQ ID NO: 830875 - DNA, 22 bp, Artificial Sequence
  chemically synthesized
cctagcagatcgtgaatgtttg

SEQ ID NO: 830876 - DNA, 22 bp, Artificial Sequence
  chemically synthesized
tagttatcaacaaacattcacg

SEQ ID NO: 830877 - DNA, 22 bp, Artificial Sequence
  chemically synthesized
tcaacaaacattcacgatctgc

SEQ ID NO: 830878 - DNA, 22 bp, Artificial Sequence
  chemically synthesized
acgatctgctagggagtgcaca

SEQ ID NO: 830879 - DNA, 22 bp, Artificial Sequence
  chemically synthesized
ctagggagtgcacactatggat

SEQ ID NO: 830880 - DNA, 22 bp, Artificial Sequence
  chemically synthesized
tgggatcagtgagatccatagt

SEQ ID NO: 830881 - DNA, 22 bp, Artificial Sequence
  chemically synthesized
gggagtgcacactatggatctc

SEQ ID NO: 830882 - DNA, 22 bp, Artificial Sequence
  chemically synthesized
tgtgggatcagtgagatccata

SEQ ID NO: 830883 - DNA, 22 bp, Artificial Sequence
  chemically synthesized
gcgtactctgtgggatcagtga

SEQ ID NO: 830884 - DNA, 22 bp, Artificial Sequence
  chemically synthesized
tggcgtactctgtgggatcagt

SEQ ID NO: 830885 - DNA, 22 bp, Artificial Sequence
  chemically synthesized
tggatctcactgatcccacaga

SEQ ID NO: 830886 - DNA, 22 bp, Artificial Sequence
  chemically synthesized
gaactctggcgtactctgtggg

SEQ ID NO: 830887 - DNA, 22 bp, Artificial Sequence
  chemically synthesized
cctggaactctggcgtactctg

SEQ ID NO: 830888 - DNA, 22 bp, Artificial Sequence
  chemically synthesized
actgatcccacagagtacgcca

SEQ ID NO: 830889 - DNA, 22 bp, Artificial Sequence
  chemically synthesized
tacctggaactctggcgtactc

SEQ ID NO: 830890 - DNA, 22 bp, Artificial Sequence
  chemically synthesized
ctacctggaactctggcgtact

SEQ ID NO: 830891 - DNA, 22 bp, Artificial Sequence
  chemically synthesized
tctacctggaactctggcgtac

SEQ ID NO: 830892 - DNA, 22 bp, Artificial Sequence
  chemically synthesized
atcccacagagtacgccagagt

SEQ ID NO: 830893 - DNA, 22 bp, Artificial Sequence
  chemically synthesized
gcattttctacctggaactctg

SEQ ID NO: 830894 - DNA, 22 bp, Artificial Sequence
  chemically synthesized
ggcattttctacctggaactct

SEQ ID NO: 830895 - DNA, 22 bp, Artificial Sequence
  chemically synthesized
accttggcattttctacctgga

SEQ ID NO: 830896 - DNA, 22 bp, Artificial Sequence
  chemically synthesized
caccttggcattttctacctgg

SEQ ID NO: 830897 - DNA, 22 bp, Artificial Sequence
  chemically synthesized
tcaccttggcattttctacctg

SEQ ID NO: 830898 - DNA, 22 bp, Artificial Sequence
  chemically synthesized
agcctttcaccttggcattttc

SEQ ID NO: 830899 - DNA, 22 bp, Artificial Sequence
  chemically synthesized
aagcctttcaccttggcatttt

SEQ ID NO: 830900 - DNA, 22 bp, Artificial Sequence
  chemically synthesized
caggtagaaaatgccaaggtga

SEQ ID NO: 830901 - DNA, 22 bp, Artificial Sequence
  chemically synthesized
caatttaagcctttcaccttgg

SEQ ID NO: 830902 - DNA, 22 bp, Artificial Sequence
  chemically synthesized
cctgcaatttaagcctttcacc

SEQ ID NO: 830903 - DNA, 22 bp, Artificial Sequence
  chemically synthesized
acctgcaatttaagcctttcac

SEQ ID NO: 830904 - DNA, 22 bp, Artificial Sequence
  chemically synthesized
aaaagatttacctgcaatttaa

SEQ ID NO: 830905 - DNA, 22 bp, Artificial Sequence
  chemically synthesized
aaatgacctcaaaagatttacc

SEQ ID NO: 830906 - DNA, 22 bp, Artificial Sequence
  chemically synthesized
aaattgcaggtaaatcttttga

SEQ ID NO: 830907 - DNA, 22 bp, Artificial Sequence
  chemically synthesized
actcaaatgacctcaaaagatt

SEQ ID NO: 830908 - DNA, 22 bp, Artificial Sequence
  chemically synthesized
aattgcaggtaaatcttttgag

SEQ ID NO: 830909 - DNA, 22 bp, Artificial Sequence
  chemically synthesized
actcactcaaatgacctcaaaa

SEQ ID NO: 830910 - DNA, 22 bp, Artificial Sequence
  chemically synthesized
cactcactcaaatgacctcaaa

SEQ ID NO: 830911 - DNA, 22 bp, Artificial Sequence
  chemically synthesized
caggtaaatcttttgaggtcat

SEQ ID NO: 830912 - DNA, 22 bp, Artificial Sequence
  chemically synthesized
ttcactcactcaaatgacctca

SEQ ID NO: 830913 - DNA, 22 bp, Artificial Sequence
  chemically synthesized
ttgaggtcatttgagtgagtga

SEQ ID NO: 830914 - DNA, 22 bp, Artificial Sequence
  chemically synthesized
tgaggtcatttgagtgagtgaa

SEQ ID NO: 830915 - DNA, 22 bp, Artificial Sequence
  chemically synthesized
gaggtcatttgagtgagtgaag

SEQ ID NO: 830916 - DNA, 22 bp, Artificial Sequence
  chemically synthesized
aggtcatttgagtgagtgaaga

SEQ ID NO: 830917 - DNA, 22 bp, Artificial Sequence
  chemically synthesized
gtcatgtccgtcactcttcact

SEQ ID NO: 830918 - DNA, 22 bp, Artificial Sequence
  chemically synthesized
gagtgagtgaagagtgacggac

SEQ ID NO: 830919 - DNA, 22 bp, Artificial Sequence
  chemically synthesized
agtgagtgaagagtgacggaca

SEQ ID NO: 830920 - DNA, 22 bp, Artificial Sequence
  chemically synthesized
cccacagttagtcatgtccgtc

SEQ ID NO: 830921 - DNA, 22 bp, Artificial Sequence
  chemically synthesized
gagttgcccacagttagtcatg

SEQ ID NO: 830922 - DNA, 22 bp, Artificial Sequence
  chemically synthesized
agagttgcccacagttagtcat

SEQ ID NO: 830923 - DNA, 22 bp, Artificial Sequence
  chemically synthesized
tagagttgcccacagttagtca

SEQ ID NO: 830924 - DNA, 22 bp, Artificial Sequence
  chemically synthesized
ctttagagttgcccacagttag

SEQ ID NO: 830925 - DNA, 22 bp, Artificial Sequence
  chemically synthesized
cctttagagttgcccacagtta

SEQ ID NO: 830926 - DNA, 22 bp, Artificial Sequence
  chemically synthesized
tcctttagagttgcccacagtt

SEQ ID NO: 830927 - DNA, 22 bp, Artificial Sequence
  chemically synthesized
ttcctttagagttgcccacagt

SEQ ID NO: 830928 - DNA, 22 bp, Artificial Sequence
  chemically synthesized
ggatcatttttcctttagagtt

SEQ ID NO: 830929 - DNA, 22 bp, Artificial Sequence
  chemically synthesized
actgtgggcaactctaaaggaa

SEQ ID NO: 830930 - DNA, 22 bp, Artificial Sequence
  chemically synthesized
caattgggatcatttttccttt

SEQ ID NO: 830931 - DNA, 22 bp, Artificial Sequence
  chemically synthesized
tgggcaactctaaaggaaaaat

SEQ ID NO: 830932 - DNA, 22 bp, Artificial Sequence
  chemically synthesized
actgcaattgggatcatttttc

SEQ ID NO: 830933 - DNA, 22 bp, Artificial Sequence
  chemically synthesized
aactgcaattgggatcattttt

SEQ ID NO: 830934 - DNA, 22 bp, Artificial Sequence
  chemically synthesized
tcttaactgcaattgggatcat

SEQ ID NO: 830935 - DNA, 22 bp, Artificial Sequence
  chemically synthesized
gtcttaactgcaattgggatca

SEQ ID NO: 830936 - DNA, 22 bp, Artificial Sequence
  chemically synthesized
taaaggaaaaatgatcccaatt

SEQ ID NO: 830937 - DNA, 22 bp, Artificial Sequence
  chemically synthesized
tgtcttaactgcaattgggatc

SEQ ID NO: 830938 - DNA, 22 bp, Artificial Sequence
  chemically synthesized
aaggaaaaatgatcccaattgc

SEQ ID NO: 830939 - DNA, 22 bp, Artificial Sequence
  chemically synthesized
gaaatctttgtcttaactgcaa

SEQ ID NO: 830940 - DNA, 22 bp, Artificial Sequence
  chemically synthesized
agaaatctttgtcttaactgca

SEQ ID NO: 830941 - DNA, 22 bp, Artificial Sequence
  chemically synthesized
cagttaagacaaagatttctaa

SEQ ID NO: 830942 - DNA, 22 bp, Artificial Sequence
  chemically synthesized
atcccaacaaatagtttagaaa

SEQ ID NO: 830943 - DNA, 22 bp, Artificial Sequence
  chemically synthesized
agacaaagatttctaaactatt

SEQ ID NO: 830944 - DNA, 22 bp, Artificial Sequence
  chemically synthesized
ctgatcccaacaaatagtttag

SEQ ID NO: 830945 - DNA, 22 bp, Artificial Sequence
  chemically synthesized
cctgatcccaacaaatagttta

SEQ ID NO: 830946 - DNA, 22 bp, Artificial Sequence
  chemically synthesized
tcctgatcccaacaaatagttt

SEQ ID NO: 830947 - DNA, 22 bp, Artificial Sequence
  chemically synthesized
ttcctgatcccaacaaatagtt

SEQ ID NO: 830948 - DNA, 22 bp, Artificial Sequence
  chemically synthesized
tttcctgatcccaacaaatagt

SEQ ID NO: 830949 - DNA, 22 bp, Artificial Sequence
  chemically synthesized
cctttttcctgatcccaacaaa

SEQ ID NO: 830950 - DNA, 22 bp, Artificial Sequence
  chemically synthesized
tccctttttcctgatcccaaca

SEQ ID NO: 830951 - DNA, 22 bp, Artificial Sequence
  chemically synthesized
ctccctttttcctgatcccaac

SEQ ID NO: 830952 - DNA, 22 bp, Artificial Sequence
  chemically synthesized
ctaaactatttgttgggatcag

SEQ ID NO: 830953 - DNA, 22 bp, Artificial Sequence
  chemically synthesized
taaactatttgttgggatcagg

SEQ ID NO: 830954 - DNA, 22 bp, Artificial Sequence
  chemically synthesized
tttctccctttttcctgatccc

SEQ ID NO: 830955 - DNA, 22 bp, Artificial Sequence
  chemically synthesized
aactatttgttgggatcaggaa

SEQ ID NO: 830956 - DNA, 22 bp, Artificial Sequence
  chemically synthesized
ctatttctccctttttcctgat

SEQ ID NO: 830957 - DNA, 22 bp, Artificial Sequence
  chemically synthesized
tttgttgggatcaggaaaaagg

SEQ ID NO: 830958 - DNA, 22 bp, Artificial Sequence
  chemically synthesized
ctgctatttctccctttttcct

SEQ ID NO: 830959 - DNA, 22 bp, Artificial Sequence
  chemically synthesized
gttgggatcaggaaaaagggag

SEQ ID NO: 830960 - DNA, 22 bp, Artificial Sequence
  chemically synthesized
ttgggatcaggaaaaagggaga

SEQ ID NO: 830961 - DNA, 22 bp, Artificial Sequence
  chemically synthesized
ggatcaggaaaaagggagaaat

SEQ ID NO: 830962 - DNA, 22 bp, Artificial Sequence
  chemically synthesized
ggagaacagtctactgctattt

SEQ ID NO: 830963 - DNA, 22 bp, Artificial Sequence
  chemically synthesized
gcctcggagaacagtctactgc

SEQ ID NO: 830964 - DNA, 22 bp, Artificial Sequence
  chemically synthesized
agcctcggagaacagtctactg

SEQ ID NO: 830965 - DNA, 22 bp, Artificial Sequence
  chemically synthesized
tagcctcggagaacagtctact

SEQ ID NO: 830966 - DNA, 22 bp, Artificial Sequence
  chemically synthesized
atggttttagcctcggagaaca

SEQ ID NO: 830967 - DNA, 22 bp, Artificial Sequence
  chemically synthesized
gatggttttagcctcggagaac

SEQ ID NO: 830968 - DNA, 22 bp, Artificial Sequence
  chemically synthesized
tgatggttttagcctcggagaa

SEQ ID NO: 830969 - DNA, 22 bp, Artificial Sequence
  chemically synthesized
ttgatggttttagcctcggaga

SEQ ID NO: 830970 - DNA, 22 bp, Artificial Sequence
  chemically synthesized
tttgatggttttagcctcggag

SEQ ID NO: 830971 - DNA, 22 bp, Artificial Sequence
  chemically synthesized
acattttttgatggttttagcc

SEQ ID NO: 830972 - DNA, 22 bp, Artificial Sequence
  chemically synthesized
ttctccgaggctaaaaccatca

SEQ ID NO: 830973 - DNA, 22 bp, Artificial Sequence
  chemically synthesized
tccgaggctaaaaccatcaaaa

SEQ ID NO: 830974 - DNA, 22 bp, Artificial Sequence
  chemically synthesized
cgaggctaaaaccatcaaaaaa

SEQ ID NO: 830975 - DNA, 22 bp, Artificial Sequence
  chemically synthesized
atcatgcctaacattttttgat

SEQ ID NO: 830976 - DNA, 22 bp, Artificial Sequence
  chemically synthesized
gatcatgcctaacattttttga

SEQ ID NO: 830977 - DNA, 22 bp, Artificial Sequence
  chemically synthesized
ttgatcatgcctaacatttttt

SEQ ID NO: 830978 - DNA, 22 bp, Artificial Sequence
  chemically synthesized
aaaccatcaaaaaatgttaggc

SEQ ID NO: 830979 - DNA, 22 bp, Artificial Sequence
  chemically synthesized
attcttgatcatgcctaacatt

SEQ ID NO: 830980 - DNA, 22 bp, Artificial Sequence
  chemically synthesized
cattcttgatcatgcctaacat

SEQ ID NO: 830981 - DNA, 22 bp, Artificial Sequence
  chemically synthesized
agcttcattcttgatcatgcct

SEQ ID NO: 830982 - DNA, 22 bp, Artificial Sequence
  chemically synthesized
cagcttcattcttgatcatgcc

SEQ ID NO: 830983 - DNA, 22 bp, Artificial Sequence
  chemically synthesized
tcagcttcattcttgatcatgc

SEQ ID NO: 830984 - DNA, 22 bp, Artificial Sequence
  chemically synthesized
ttttcagcttcattcttgatca

SEQ ID NO: 830985 - DNA, 22 bp, Artificial Sequence
  chemically synthesized
gttttcagcttcattcttgatc

SEQ ID NO: 830986 - DNA, 22 bp, Artificial Sequence
  chemically synthesized
cttgttttcagcttcattcttg

SEQ ID NO: 830987 - DNA, 22 bp, Artificial Sequence
  chemically synthesized
ccttgttttcagcttcattctt

SEQ ID NO: 830988 - DNA, 22 bp, Artificial Sequence
  chemically synthesized
ggcatgatcaagaatgaagctg

SEQ ID NO: 830989 - DNA, 22 bp, Artificial Sequence
  chemically synthesized
caataatggtggtttccttgtt

SEQ ID NO: 830990 - DNA, 22 bp, Artificial Sequence
  chemically synthesized
aaaacaaggaaaccaccattat

SEQ ID NO: 830991 - DNA, 22 bp, Artificial Sequence
  chemically synthesized
tacaaggttacaataatggtgg

SEQ ID NO: 830992 - DNA, 22 bp, Artificial Sequence
  chemically synthesized
gtacaaggttacaataatggtg

SEQ ID NO: 830993 - DNA, 22 bp, Artificial Sequence
  chemically synthesized
tgtacaaggttacaataatggt

SEQ ID NO: 830994 - DNA, 22 bp, Artificial Sequence
  chemically synthesized
gctttgtacaaggttacaataa

SEQ ID NO: 830995 - DNA, 22 bp, Artificial Sequence
  chemically synthesized
tgtcctagctttgtacaaggtt

SEQ ID NO: 830996 - DNA, 22 bp, Artificial Sequence
  chemically synthesized
ttgtaaccttgtacaaagctag

SEQ ID NO: 830997 - DNA, 22 bp, Artificial Sequence
  chemically synthesized
ggtatagttgtgtcctagcttt

SEQ ID NO: 830998 - DNA, 22 bp, Artificial Sequence
  chemically synthesized
taaccttgtacaaagctaggac

SEQ ID NO: 830999 - DNA, 22 bp, Artificial Sequence
  chemically synthesized
taggtatagttgtgtcctagct

SEQ ID NO: 831000 - DNA, 22 bp, Artificial Sequence
  chemically synthesized
ctctaggtatagttgtgtccta

SEQ ID NO: 831001 - DNA, 22 bp, Artificial Sequence
  chemically synthesized
gtacaaagctaggacacaacta

SEQ ID NO: 831002 - DNA, 22 bp, Artificial Sequence
  chemically synthesized
tacaaagctaggacacaactat

SEQ ID NO: 831003 - DNA, 22 bp, Artificial Sequence
  chemically synthesized
cattactctaggtatagttgtg

SEQ ID NO: 831004 - DNA, 22 bp, Artificial Sequence
  chemically synthesized
acattactctaggtatagttgt

SEQ ID NO: 831005 - DNA, 22 bp, Artificial Sequence
  chemically synthesized
tgcttacattactctaggtata

SEQ ID NO: 831006 - DNA, 22 bp, Artificial Sequence
  chemically synthesized
ggacacaactatacctagagta

SEQ ID NO: 831007 - DNA, 22 bp, Artificial Sequence
  chemically synthesized
agttatgcttacattactctag

SEQ ID NO: 831008 - DNA, 22 bp, Artificial Sequence
  chemically synthesized
tacctagagtaatgtaagcata

SEQ ID NO: 831009 - DNA, 22 bp, Artificial Sequence
  chemically synthesized
tatgtcaaacattgagttatgc

SEQ ID NO: 831010 - DNA, 22 bp, Artificial Sequence
  chemically synthesized
gagtaatgtaagcataactcaa

SEQ ID NO: 831011 - DNA, 22 bp, Artificial Sequence
  chemically synthesized
gtatgtcaaacattgagttatg

SEQ ID NO: 831012 - DNA, 22 bp, Artificial Sequence
  chemically synthesized
tgtatgtcaaacattgagttat

SEQ ID NO: 831013 - DNA, 22 bp, Artificial Sequence
  chemically synthesized
tatgtctttgtatgtcaaacat

SEQ ID NO: 831014 - DNA, 22 bp, Artificial Sequence
  chemically synthesized
atatgtctttgtatgtcaaaca

SEQ ID NO: 831015 - DNA, 22 bp, Artificial Sequence
  chemically synthesized
cttatatgtctttgtatgtcaa

SEQ ID NO: 831016 - DNA, 22 bp, Artificial Sequence
  chemically synthesized
agttccttatatgtctttgtat

SEQ ID NO: 831017 - DNA, 22 bp, Artificial Sequence
  chemically synthesized
aatgtttgacatacaaagacat

SEQ ID NO: 831018 - DNA, 22 bp, Artificial Sequence
  chemically synthesized
ctcagttccttatatgtctttg

SEQ ID NO: 831019 - DNA, 22 bp, Artificial Sequence
  chemically synthesized
cctcagttccttatatgtcttt

SEQ ID NO: 831020 - DNA, 22 bp, Artificial Sequence
  chemically synthesized
tcctcagttccttatatgtctt

SEQ ID NO: 831021 - DNA, 22 bp, Artificial Sequence
  chemically synthesized
gacatacaaagacatataagga

SEQ ID NO: 831022 - DNA, 22 bp, Artificial Sequence
  chemically synthesized
acatacaaagacatataaggaa

SEQ ID NO: 831023 - DNA, 22 bp, Artificial Sequence
  chemically synthesized
gactttcctcagttccttatat

SEQ ID NO: 831024 - DNA, 22 bp, Artificial Sequence
  chemically synthesized
ggactttcctcagttccttata

SEQ ID NO: 831025 - DNA, 22 bp, Artificial Sequence
  chemically synthesized
tttggactttcctcagttcctt

SEQ ID NO: 831026 - DNA, 22 bp, Artificial Sequence
  chemically synthesized
ttatttggactttcctcagttc

SEQ ID NO: 831027 - DNA, 22 bp, Artificial Sequence
  chemically synthesized
tgttattatttggactttcctc

SEQ ID NO: 831028 - DNA, 22 bp, Artificial Sequence
  chemically synthesized
taatctgtgttattatttggac

SEQ ID NO: 831029 - DNA, 22 bp, Artificial Sequence
  chemically synthesized
ataatctgtgttattatttgga

SEQ ID NO: 831030 - DNA, 22 bp, Artificial Sequence
  chemically synthesized
cttataatctgtgttattattt

SEQ ID NO: 831031 - DNA, 22 bp, Artificial Sequence
  chemically synthesized
aggaaagtccaaataataacac

SEQ ID NO: 831032 - DNA, 22 bp, Artificial Sequence
  chemically synthesized
atattccttataatctgtgtta

SEQ ID NO: 831033 - DNA, 22 bp, Artificial Sequence
  chemically synthesized
aatattccttataatctgtgtt

SEQ ID NO: 831034 - DNA, 22 bp, Artificial Sequence
  chemically synthesized
taaggaatattaagatatgtcc

SEQ ID NO: 831035 - DNA, 22 bp, Artificial Sequence
  chemically synthesized
tggaagtagaagggacatatct

SEQ ID NO: 831036 - DNA, 22 bp, Artificial Sequence
  chemically synthesized
gtggaagtagaagggacatatc

SEQ ID NO: 831037 - DNA, 22 bp, Artificial Sequence
  chemically synthesized
aatgccttgtggaagtagaagg

SEQ ID NO: 831038 - DNA, 22 bp, Artificial Sequence
  chemically synthesized
aaatgccttgtggaagtagaag

SEQ ID NO: 831039 - DNA, 22 bp, Artificial Sequence
  chemically synthesized
agatatgtcccttctacttcca

SEQ ID NO: 831040 - DNA, 22 bp, Artificial Sequence
  chemically synthesized
tttaaatgccttgtggaagtag

SEQ ID NO: 831041 - DNA, 22 bp, Artificial Sequence
  chemically synthesized
ctacttccacaaggcatttaaa

SEQ ID NO: 831042 - DNA, 22 bp, Artificial Sequence
  chemically synthesized
cacagaaccctgtttaaatgcc

SEQ ID NO: 831043 - DNA, 22 bp, Artificial Sequence
  chemically synthesized
tacttccacaaggcatttaaac

SEQ ID NO: 831044 - DNA, 22 bp, Artificial Sequence
  chemically synthesized
ccacagaaccctgtttaaatgc

SEQ ID NO: 831045 - DNA, 22 bp, Artificial Sequence
  chemically synthesized
cttccacaaggcatttaaacag

SEQ ID NO: 831046 - DNA, 22 bp, Artificial Sequence
  chemically synthesized
ccacaaggcatttaaacagggt

SEQ ID NO: 831047 - DNA, 22 bp, Artificial Sequence
  chemically synthesized
cacaaggcatttaaacagggtt

SEQ ID NO: 831048 - DNA, 22 bp, Artificial Sequence
  chemically synthesized
tagataggtcttccacagaacc

SEQ ID NO: 831049 - DNA, 22 bp, Artificial Sequence
  chemically synthesized
actatagataggtcttccacag

SEQ ID NO: 831050 - DNA, 22 bp, Artificial Sequence
  chemically synthesized
aactatagataggtcttccaca

SEQ ID NO: 831051 - DNA, 22 bp, Artificial Sequence
  chemically synthesized
aaacagggttctgtggaagacc

SEQ ID NO: 831052 - DNA, 22 bp, Artificial Sequence
  chemically synthesized
aacagggttctgtggaagacct

SEQ ID NO: 831053 - DNA, 22 bp, Artificial Sequence
  chemically synthesized
caaagcttaactatagataggt

SEQ ID NO: 831054 - DNA, 22 bp, Artificial Sequence
  chemically synthesized
gcaaagcttaactatagatagg

SEQ ID NO: 831055 - DNA, 22 bp, Artificial Sequence
  chemically synthesized
tgcaaagcttaactatagatag

SEQ ID NO: 831056 - DNA, 22 bp, Artificial Sequence
  chemically synthesized
ttgcaaagcttaactatagata

SEQ ID NO: 831057 - DNA, 22 bp, Artificial Sequence
  chemically synthesized
tgtggaagacctatctatagtt

SEQ ID NO: 831058 - DNA, 22 bp, Artificial Sequence
  chemically synthesized
ttttgcaaagcttaactataga

SEQ ID NO: 831059 - DNA, 22 bp, Artificial Sequence
  chemically synthesized
tggaagacctatctatagttaa

SEQ ID NO: 831060 - DNA, 22 bp, Artificial Sequence
  chemically synthesized
cttttgcaaagcttaactatag

SEQ ID NO: 831061 - DNA, 22 bp, Artificial Sequence
  chemically synthesized
aaacttcttttgcaaagcttaa

SEQ ID NO: 831062 - DNA, 22 bp, Artificial Sequence
  chemically synthesized
tctatagttaagctttgcaaaa

SEQ ID NO: 831063 - DNA, 22 bp, Artificial Sequence
  chemically synthesized
agttgaaacttcttttgcaaag

SEQ ID NO: 831064 - DNA, 22 bp, Artificial Sequence
  chemically synthesized
gagttgaaacttcttttgcaaa

SEQ ID NO: 831065 - DNA, 22 bp, Artificial Sequence
  chemically synthesized
tagttaagctttgcaaaagaag

SEQ ID NO: 831066 - DNA, 22 bp, Artificial Sequence
  chemically synthesized
tgggtttgagttgaaacttctt

SEQ ID NO: 831067 - DNA, 22 bp, Artificial Sequence
  chemically synthesized
gtgggtttgagttgaaacttct

SEQ ID NO: 831068 - DNA, 22 bp, Artificial Sequence
  chemically synthesized
agctttgcaaaagaagtttcaa

SEQ ID NO: 831069 - DNA, 22 bp, Artificial Sequence
  chemically synthesized
tgtgggtttgagttgaaacttc

SEQ ID NO: 831070 - DNA, 22 bp, Artificial Sequence
  chemically synthesized
tttgtgggtttgagttgaaact

SEQ ID NO: 831071 - DNA, 22 bp, Artificial Sequence
  chemically synthesized
tgcaaaagaagtttcaactcaa

SEQ ID NO: 831072 - DNA, 22 bp, Artificial Sequence
  chemically synthesized
ctctttgtgggtttgagttgaa

SEQ ID NO: 831073 - DNA, 22 bp, Artificial Sequence
  chemically synthesized
gcaaaagaagtttcaactcaaa

SEQ ID NO: 831074 - DNA, 22 bp, Artificial Sequence
  chemically synthesized
cctctttgtgggtttgagttga

SEQ ID NO: 831075 - DNA, 22 bp, Artificial Sequence
  chemically synthesized
caaaagaagtttcaactcaaac

SEQ ID NO: 831076 - DNA, 22 bp, Artificial Sequence
  chemically synthesized
ttcctctttgtgggtttgagtt

SEQ ID NO: 831077 - DNA, 22 bp, Artificial Sequence
  chemically synthesized
cttcctctttgtgggtttgagt

SEQ ID NO: 831078 - DNA, 22 bp, Artificial Sequence
  chemically synthesized
caactcaaacccacaaagagga

SEQ ID NO: 831079 - DNA, 22 bp, Artificial Sequence
  chemically synthesized
aactcaaacccacaaagaggaa

SEQ ID NO: 831080 - DNA, 22 bp, Artificial Sequence
  chemically synthesized
gcatatatgtttcttcctcttt

SEQ ID NO: 831081 - DNA, 22 bp, Artificial Sequence
  chemically synthesized
aaacccacaaagaggaagaaac

SEQ ID NO: 831082 - DNA, 22 bp, Artificial Sequence
  chemically synthesized
catggttagcatatatgtttct

SEQ ID NO: 831083 - DNA, 22 bp, Artificial Sequence
  chemically synthesized
gctacatggttagcatatatgt

SEQ ID NO: 831084 - DNA, 22 bp, Artificial Sequence
  chemically synthesized
atactagctacatggttagcat

SEQ ID NO: 831085 - DNA, 22 bp, Artificial Sequence
  chemically synthesized
accatgtagctagtatgaacgg

SEQ ID NO: 831086 - DNA, 22 bp, Artificial Sequence
  chemically synthesized
agtgaaaaaaaatgcccgttca

SEQ ID NO: 831087 - DNA, 22 bp, Artificial Sequence
  chemically synthesized
tatctaagtgaaaaaaaatgcc

SEQ ID NO: 831088 - DNA, 22 bp, Artificial Sequence
  chemically synthesized
tatatctaagtgaaaaaaaatg

SEQ ID NO: 831089 - DNA, 22 bp, Artificial Sequence
  chemically synthesized
gtatgaacgggcattttttttc

SEQ ID NO: 831090 - DNA, 22 bp, Artificial Sequence
  chemically synthesized
ctatatctaagtgaaaaaaaat

SEQ ID NO: 831091 - DNA, 22 bp, Artificial Sequence
  chemically synthesized
tctatatctaagtgaaaaaaaa

SEQ ID NO: 831092 - DNA, 22 bp, Artificial Sequence
  chemically synthesized
ttctatatctaagtgaaaaaaa

SEQ ID NO: 831093 - DNA, 22 bp, Artificial Sequence
  chemically synthesized
cttttctatatctaagtgaaaa

SEQ ID NO: 831094 - DNA, 22 bp, Artificial Sequence
  chemically synthesized
ctccttttctatatctaagtga

SEQ ID NO: 831095 - DNA, 22 bp, Artificial Sequence
  chemically synthesized
tttttcacttagatatagaaaa

SEQ ID NO: 831096 - DNA, 22 bp, Artificial Sequence
  chemically synthesized
ttttcacttagatatagaaaag

SEQ ID NO: 831097 - DNA, 22 bp, Artificial Sequence
  chemically synthesized
tttcacttagatatagaaaagg

SEQ ID NO: 831098 - DNA, 22 bp, Artificial Sequence
  chemically synthesized
ttcacttagatatagaaaagga

SEQ ID NO: 831099 - DNA, 22 bp, Artificial Sequence
  chemically synthesized
tcacttagatatagaaaaggag

SEQ ID NO: 831100 - DNA, 22 bp, Artificial Sequence
  chemically synthesized
cacttagatatagaaaaggagg

SEQ ID NO: 831101 - DNA, 22 bp, Artificial Sequence
  chemically synthesized
acttagatatagaaaaggagga

SEQ ID NO: 831102 - DNA, 22 bp, Artificial Sequence
  chemically synthesized
taaaacaaccacattcctcctt

SEQ ID NO: 831103 - DNA, 22 bp, Artificial Sequence
  chemically synthesized
gtaaaacaaccacattcctcct

SEQ ID NO: 831104 - DNA, 22 bp, Artificial Sequence
  chemically synthesized
agatatagaaaaggaggaatgt

SEQ ID NO: 831105 - DNA, 22 bp, Artificial Sequence
  chemically synthesized
gatatagaaaaggaggaatgtg

SEQ ID NO: 831106 - DNA, 22 bp, Artificial Sequence
  chemically synthesized
tttgtaaaacaaccacattcct

SEQ ID NO: 831107 - DNA, 22 bp, Artificial Sequence
  chemically synthesized
tatttgtaaaacaaccacattc

SEQ ID NO: 831108 - DNA, 22 bp, Artificial Sequence
  chemically synthesized
tctatttgtaaaacaaccacat

SEQ ID NO: 831109 - DNA, 22 bp, Artificial Sequence
  chemically synthesized
ttctctatttgtaaaacaacca

SEQ ID NO: 831110 - DNA, 22 bp, Artificial Sequence
  chemically synthesized
attctctatttgtaaaacaacc

SEQ ID NO: 831111 - DNA, 22 bp, Artificial Sequence
  chemically synthesized
tattctctatttgtaaaacaac

SEQ ID NO: 831112 - DNA, 22 bp, Artificial Sequence
  chemically synthesized
agatactttattctctatttgt

SEQ ID NO: 831113 - DNA, 22 bp, Artificial Sequence
  chemically synthesized
catctcagatactttattctct

SEQ ID NO: 831114 - DNA, 22 bp, Artificial Sequence
  chemically synthesized
ttttacaaatagagaataaagt

SEQ ID NO: 831115 - DNA, 22 bp, Artificial Sequence
  chemically synthesized
ttacatctcagatactttattc

SEQ ID NO: 831116 - DNA, 22 bp, Artificial Sequence
  chemically synthesized
tacaaatagagaataaagtatc

SEQ ID NO: 831117 - DNA, 22 bp, Artificial Sequence
  chemically synthesized
acaaatagagaataaagtatct

SEQ ID NO: 831118 - DNA, 22 bp, Artificial Sequence
  chemically synthesized
caaatagagaataaagtatctg

SEQ ID NO: 831119 - DNA, 22 bp, Artificial Sequence
  chemically synthesized
atctgttacatctcagatactt

SEQ ID NO: 831120 - DNA, 22 bp, Artificial Sequence
  chemically synthesized
gatctgttacatctcagatact

SEQ ID NO: 831121 - DNA, 22 bp, Artificial Sequence
  chemically synthesized
tgatctgttacatctcagatac

SEQ ID NO: 831122 - DNA, 22 bp, Artificial Sequence
  chemically synthesized
ttgatctgttacatctcagata

SEQ ID NO: 831123 - DNA, 22 bp, Artificial Sequence
  chemically synthesized
tttgatctgttacatctcagat

SEQ ID NO: 831124 - DNA, 22 bp, Artificial Sequence
  chemically synthesized
gctttttgatctgttacatctc

SEQ ID NO: 831125 - DNA, 22 bp, Artificial Sequence
  chemically synthesized
agctttttgatctgttacatct

SEQ ID NO: 831126 - DNA, 22 bp, Artificial Sequence
  chemically synthesized
tagctttttgatctgttacatc

SEQ ID NO: 831127 - DNA, 22 bp, Artificial Sequence
  chemically synthesized
ttagctttttgatctgttacat

SEQ ID NO: 831128 - DNA, 22 bp, Artificial Sequence
  chemically synthesized
tttttagctttttgatctgtta

SEQ ID NO: 831129 - DNA, 22 bp, Artificial Sequence
  chemically synthesized
tgtttttagctttttgatctgt

SEQ ID NO: 831130 - DNA, 22 bp, Artificial Sequence
  chemically synthesized
agatgtaacagatcaaaaagct

SEQ ID NO: 831131 - DNA, 22 bp, Artificial Sequence
  chemically synthesized
ccctctgtttttagctttttga

SEQ ID NO: 831132 - DNA, 22 bp, Artificial Sequence
  chemically synthesized
tgtgccaataactcccctctgt

SEQ ID NO: 831133 - DNA, 22 bp, Artificial Sequence
  chemically synthesized
atgtgccaataactcccctctg

SEQ ID NO: 831134 - DNA, 22 bp, Artificial Sequence
  chemically synthesized
tttatgtgccaataactcccct

SEQ ID NO: 831135 - DNA, 22 bp, Artificial Sequence
  chemically synthesized
atttatgtgccaataactcccc

SEQ ID NO: 831136 - DNA, 22 bp, Artificial Sequence
  chemically synthesized
aaaacagaggggagttattggc

SEQ ID NO: 831137 - DNA, 22 bp, Artificial Sequence
  chemically synthesized
ttggcacataaataaatcctgg

SEQ ID NO: 831138 - DNA, 22 bp, Artificial Sequence
  chemically synthesized
gtcatcatagtggccaggattt

SEQ ID NO: 831139 - DNA, 22 bp, Artificial Sequence
  chemically synthesized
ggtcatcatagtggccaggatt

SEQ ID NO: 831140 - DNA, 22 bp, Artificial Sequence
  chemically synthesized
gcacataaataaatcctggcca

SEQ ID NO: 831141 - DNA, 22 bp, Artificial Sequence
  chemically synthesized
gagaaaaagcaacttggtcatc

SEQ ID NO: 831142 - DNA, 22 bp, Artificial Sequence
  chemically synthesized
agagaaaaagcaacttggtcat

SEQ ID NO: 831143 - DNA, 22 bp, Artificial Sequence
  chemically synthesized
gccactatgatgaccaagttgc

SEQ ID NO: 831144 - DNA, 22 bp, Artificial Sequence
  chemically synthesized
ggatttagagaaaaagcaactt

SEQ ID NO: 831145 - DNA, 22 bp, Artificial Sequence
  chemically synthesized
gggatttagagaaaaagcaact

SEQ ID NO: 831146 - DNA, 22 bp, Artificial Sequence
  chemically synthesized
tgggatttagagaaaaagcaac

SEQ ID NO: 831147 - DNA, 22 bp, Artificial Sequence
  chemically synthesized
ttgggatttagagaaaaagcaa

SEQ ID NO: 831148 - DNA, 22 bp, Artificial Sequence
  chemically synthesized
tgatgaccaagttgctttttct

SEQ ID NO: 831149 - DNA, 22 bp, Artificial Sequence
  chemically synthesized
tttgggatttagagaaaaagca

SEQ ID NO: 831150 - DNA, 22 bp, Artificial Sequence
  chemically synthesized
gctttttgggatttagagaaaa

SEQ ID NO: 831151 - DNA, 22 bp, Artificial Sequence
  chemically synthesized
tagctttttgggatttagagaa

SEQ ID NO: 831152 - DNA, 22 bp, Artificial Sequence
  chemically synthesized
cattctagctttttgggattta

SEQ ID NO: 831153 - DNA, 22 bp, Artificial Sequence
  chemically synthesized
tgcattctagctttttgggatt

SEQ ID NO: 831154 - DNA, 22 bp, Artificial Sequence
  chemically synthesized
ctttttctctaaatcccaaaaa

SEQ ID NO: 831155 - DNA, 22 bp, Artificial Sequence
  chemically synthesized
ctgcattctagctttttgggat

SEQ ID NO: 831156 - DNA, 22 bp, Artificial Sequence
  chemically synthesized
tttctctaaatcccaaaaagct

SEQ ID NO: 831157 - DNA, 22 bp, Artificial Sequence
  chemically synthesized
tttctgcattctagctttttgg

SEQ ID NO: 831158 - DNA, 22 bp, Artificial Sequence
  chemically synthesized
ttctctaaatcccaaaaagcta

SEQ ID NO: 831159 - DNA, 22 bp, Artificial Sequence
  chemically synthesized
tctctaaatcccaaaaagctag

SEQ ID NO: 831160 - DNA, 22 bp, Artificial Sequence
  chemically synthesized
ctctaaatcccaaaaagctaga

SEQ ID NO: 831161 - DNA, 22 bp, Artificial Sequence
  chemically synthesized
tctaaatcccaaaaagctagaa

SEQ ID NO: 831162 - DNA, 22 bp, Artificial Sequence
  chemically synthesized
gctgtttctgcattctagcttt

SEQ ID NO: 831163 - DNA, 22 bp, Artificial Sequence
  chemically synthesized
ggctgtttctgcattctagctt

SEQ ID NO: 831164 - DNA, 22 bp, Artificial Sequence
  chemically synthesized
taaatcccaaaaagctagaatg

SEQ ID NO: 831165 - DNA, 22 bp, Artificial Sequence
  chemically synthesized
aatcccaaaaagctagaatgca

SEQ ID NO: 831166 - DNA, 22 bp, Artificial Sequence
  chemically synthesized
accaaaatgcttggctgtttct

SEQ ID NO: 831167 - DNA, 22 bp, Artificial Sequence
  chemically synthesized
aaccaaaatgcttggctgtttc

SEQ ID NO: 831168 - DNA, 22 bp, Artificial Sequence
  chemically synthesized
gaatgcagaaacagccaagcat

SEQ ID NO: 831169 - DNA, 22 bp, Artificial Sequence
  chemically synthesized
catgaacttaaccaaaatgctt

SEQ ID NO: 831170 - DNA, 22 bp, Artificial Sequence
  chemically synthesized
ccatgaacttaaccaaaatgct

SEQ ID NO: 831171 - DNA, 22 bp, Artificial Sequence
  chemically synthesized
gcttccatgaacttaaccaaaa

SEQ ID NO: 831172 - DNA, 22 bp, Artificial Sequence
  chemically synthesized
ggtctggcttccatgaacttaa

SEQ ID NO: 831173 - DNA, 22 bp, Artificial Sequence
  chemically synthesized
tgggtctggcttccatgaactt

SEQ ID NO: 831174 - DNA, 22 bp, Artificial Sequence
  chemically synthesized
ttctgggtctggcttccatgaa

SEQ ID NO: 831175 - DNA, 22 bp, Artificial Sequence
  chemically synthesized
gttctgggtctggcttccatga

SEQ ID NO: 831176 - DNA, 22 bp, Artificial Sequence
  chemically synthesized
tggttaagttcatggaagccag

SEQ ID NO: 831177 - DNA, 22 bp, Artificial Sequence
  chemically synthesized
ggttaagttcatggaagccaga

SEQ ID NO: 831178 - DNA, 22 bp, Artificial Sequence
  chemically synthesized
gttaagttcatggaagccagac

SEQ ID NO: 831179 - DNA, 22 bp, Artificial Sequence
  chemically synthesized
gtcatttgttctgggtctggct

SEQ ID NO: 831180 - DNA, 22 bp, Artificial Sequence
  chemically synthesized
agtcatttgttctgggtctggc

SEQ ID NO: 831181 - DNA, 22 bp, Artificial Sequence
  chemically synthesized
agttcatggaagccagacccag

SEQ ID NO: 831182 - DNA, 22 bp, Artificial Sequence
  chemically synthesized
atggaagccagacccagaacaa

SEQ ID NO: 831183 - DNA, 22 bp, Artificial Sequence
  chemically synthesized
aaatttagtcatttgttctggg

SEQ ID NO: 831184 - DNA, 22 bp, Artificial Sequence
  chemically synthesized
aaaatttagtcatttgttctgg

SEQ ID NO: 831185 - DNA, 22 bp, Artificial Sequence
  chemically synthesized
taaaatttagtcatttgttctg

SEQ ID NO: 831186 - DNA, 22 bp, Artificial Sequence
  chemically synthesized
taaaattttaaaatttagtcat

SEQ ID NO: 831187 - DNA, 22 bp, Artificial Sequence
  chemically synthesized
atattataaaattttaaaattt

SEQ ID NO: 831188 - DNA, 22 bp, Artificial Sequence
  chemically synthesized
ggctaatattataaaattttaa

SEQ ID NO: 831189 - DNA, 22 bp, Artificial Sequence
  chemically synthesized
aatgttaggctaatattataaa

SEQ ID NO: 831190 - DNA, 22 bp, Artificial Sequence
  chemically synthesized
aattttaaaattttataatatt

SEQ ID NO: 831191 - DNA, 22 bp, Artificial Sequence
  chemically synthesized
aaatgttaggctaatattataa

SEQ ID NO: 831192 - DNA, 22 bp, Artificial Sequence
  chemically synthesized
taaaattttataatattagcct

SEQ ID NO: 831193 - DNA, 22 bp, Artificial Sequence
  chemically synthesized
accttaaatgttaggctaatat

SEQ ID NO: 831194 - DNA, 22 bp, Artificial Sequence
  chemically synthesized
aaaattttataatattagccta

SEQ ID NO: 831195 - DNA, 22 bp, Artificial Sequence
  chemically synthesized
aaattttataatattagcctaa

SEQ ID NO: 831196 - DNA, 22 bp, Artificial Sequence
  chemically synthesized
caaactaaccttaaatgttagg

SEQ ID NO: 831197 - DNA, 22 bp, Artificial Sequence
  chemically synthesized
tataatattagcctaacattta

SEQ ID NO: 831198 - DNA, 22 bp, Artificial Sequence
  chemically synthesized
ataatattagcctaacatttaa

SEQ ID NO: 831199 - DNA, 22 bp, Artificial Sequence
  chemically synthesized
taatattagcctaacatttaag

SEQ ID NO: 831200 - DNA, 22 bp, Artificial Sequence
  chemically synthesized
catgttccaaactaaccttaaa

SEQ ID NO: 831201 - DNA, 22 bp, Artificial Sequence
  chemically synthesized
ccatgttccaaactaaccttaa

SEQ ID NO: 831202 - DNA, 22 bp, Artificial Sequence
  chemically synthesized
tccatgttccaaactaacctta

SEQ ID NO: 831203 - DNA, 22 bp, Artificial Sequence
  chemically synthesized
ttccatgttccaaactaacctt

SEQ ID NO: 831204 - DNA, 22 bp, Artificial Sequence
  chemically synthesized
gcctaacatttaaggttagttt

SEQ ID NO: 831205 - DNA, 22 bp, Artificial Sequence
  chemically synthesized
atcttttccatgttccaaacta

SEQ ID NO: 831206 - DNA, 22 bp, Artificial Sequence
  chemically synthesized
acatttaaggttagtttggaac

SEQ ID NO: 831207 - DNA, 22 bp, Artificial Sequence
  chemically synthesized
ttgatcttttccatgttccaaa

SEQ ID NO: 831208 - DNA, 22 bp, Artificial Sequence
  chemically synthesized
aaggttagtttggaacatggaa

SEQ ID NO: 831209 - DNA, 22 bp, Artificial Sequence
  chemically synthesized
aggttagtttggaacatggaaa

SEQ ID NO: 831210 - DNA, 22 bp, Artificial Sequence
  chemically synthesized
aactgttgatcttttccatgtt

SEQ ID NO: 831211 - DNA, 22 bp, Artificial Sequence
  chemically synthesized
gtttggaacatggaaaagatca

SEQ ID NO: 831212 - DNA, 22 bp, Artificial Sequence
  chemically synthesized
ggaacatggaaaagatcaacag

SEQ ID NO: 831213 - DNA, 22 bp, Artificial Sequence
  chemically synthesized
gaacatggaaaagatcaacagt

SEQ ID NO: 831214 - DNA, 22 bp, Artificial Sequence
  chemically synthesized
agtgctattttcacactgttta

SEQ ID NO: 831215 - DNA, 22 bp, Artificial Sequence
  chemically synthesized
gtgctattttcacactgtttac

SEQ ID NO: 831216 - DNA, 22 bp, Artificial Sequence
  chemically synthesized
ttttcacactgtttactcctct

SEQ ID NO: 831217 - DNA, 22 bp, Artificial Sequence
  chemically synthesized
tccccatataatagaggagtaa

SEQ ID NO: 831218 - DNA, 22 bp, Artificial Sequence
  chemically synthesized
tcacactgtttactcctctatt

SEQ ID NO: 831219 - DNA, 22 bp, Artificial Sequence
  chemically synthesized
ttatccccatataatagaggag

SEQ ID NO: 831220 - DNA, 22 bp, Artificial Sequence
  chemically synthesized
cacactgtttactcctctatta

SEQ ID NO: 831221 - DNA, 22 bp, Artificial Sequence
  chemically synthesized
acactgtttactcctctattat

SEQ ID NO: 831222 - DNA, 22 bp, Artificial Sequence
  chemically synthesized
ttattatccccatataatagag

SEQ ID NO: 831223 - DNA, 22 bp, Artificial Sequence
  chemically synthesized
gttattatccccatataataga

SEQ ID NO: 831224 - DNA, 22 bp, Artificial Sequence
  chemically synthesized
ttgttattatccccatataata

SEQ ID NO: 831225 - DNA, 22 bp, Artificial Sequence
  chemically synthesized
cttgttattatccccatataat

SEQ ID NO: 831226 - DNA, 22 bp, Artificial Sequence
  chemically synthesized
tttactcctctattatatgggg

SEQ ID NO: 831227 - DNA, 22 bp, Artificial Sequence
  chemically synthesized
tcttgttattatccccatataa

SEQ ID NO: 831228 - DNA, 22 bp, Artificial Sequence
  chemically synthesized
actcctctattatatggggata

SEQ ID NO: 831229 - DNA, 22 bp, Artificial Sequence
  chemically synthesized
ctcctctattatatggggataa

SEQ ID NO: 831230 - DNA, 22 bp, Artificial Sequence
  chemically synthesized
attttcttgttattatccccat

SEQ ID NO: 831231 - DNA, 22 bp, Artificial Sequence
  chemically synthesized
ctctattatatggggataataa

SEQ ID NO: 831232 - DNA, 22 bp, Artificial Sequence
  chemically synthesized
ttaattttcttgttattatccc

SEQ ID NO: 831233 - DNA, 22 bp, Artificial Sequence
  chemically synthesized
tattatatggggataataacaa

SEQ ID NO: 831234 - DNA, 22 bp, Artificial Sequence
  chemically synthesized
ttatatggggataataacaaga

SEQ ID NO: 831235 - DNA, 22 bp, Artificial Sequence
  chemically synthesized
gattattaattttcttgttatt

SEQ ID NO: 831236 - DNA, 22 bp, Artificial Sequence
  chemically synthesized
tagattattaattttcttgtta

SEQ ID NO: 831237 - DNA, 22 bp, Artificial Sequence
  chemically synthesized
tatggggataataacaagaaaa

SEQ ID NO: 831238 - DNA, 22 bp, Artificial Sequence
  chemically synthesized
ctagattattaattttcttgtt

SEQ ID NO: 831239 - DNA, 22 bp, Artificial Sequence
  chemically synthesized
tctagattattaattttcttgt

SEQ ID NO: 831240 - DNA, 22 bp, Artificial Sequence
  chemically synthesized
tctttctagattattaattttc

SEQ ID NO: 831241 - DNA, 22 bp, Artificial Sequence
  chemically synthesized
atctttctagattattaatttt

SEQ ID NO: 831242 - DNA, 22 bp, Artificial Sequence
  chemically synthesized
tatctttctagattattaattt

SEQ ID NO: 831243 - DNA, 22 bp, Artificial Sequence
  chemically synthesized
ttatctttctagattattaatt

SEQ ID NO: 831244 - DNA, 22 bp, Artificial Sequence
  chemically synthesized
cttttatctttctagattatta

SEQ ID NO: 831245 - DNA, 22 bp, Artificial Sequence
  chemically synthesized
ccttttatctttctagattatt

SEQ ID NO: 831246 - DNA, 22 bp, Artificial Sequence
  chemically synthesized
tttccttttatctttctagatt

SEQ ID NO: 831247 - DNA, 22 bp, Artificial Sequence
  chemically synthesized
tgtacattatttccttttatct

SEQ ID NO: 831248 - DNA, 22 bp, Artificial Sequence
  chemically synthesized
ataatctagaaagataaaagga

SEQ ID NO: 831249 - DNA, 22 bp, Artificial Sequence
  chemically synthesized
gtgtacattatttccttttatc

SEQ ID NO: 831250 - DNA, 22 bp, Artificial Sequence
  chemically synthesized
gaaagataaaaggaaataatgt

SEQ ID NO: 831251 - DNA, 22 bp, Artificial Sequence
  chemically synthesized
agtgccttgtgtacattatttc

SEQ ID NO: 831252 - DNA, 22 bp, Artificial Sequence
  chemically synthesized
tcagtgccttgtgtacattatt

SEQ ID NO: 831253 - DNA, 22 bp, Artificial Sequence
  chemically synthesized
ctcagtgccttgtgtacattat

SEQ ID NO: 831254 - DNA, 22 bp, Artificial Sequence
  chemically synthesized
tctcagtgccttgtgtacatta

SEQ ID NO: 831255 - DNA, 22 bp, Artificial Sequence
  chemically synthesized
ttctcagtgccttgtgtacatt

SEQ ID NO: 831256 - DNA, 22 bp, Artificial Sequence
  chemically synthesized
ggggtcaggtacttttctcagt

SEQ ID NO: 831257 - DNA, 22 bp, Artificial Sequence
  chemically synthesized
tctaggggtcaggtacttttct

SEQ ID NO: 831258 - DNA, 22 bp, Artificial Sequence
  chemically synthesized
agagctgtctaggggtcaggta

SEQ ID NO: 831259 - DNA, 22 bp, Artificial Sequence
  chemically synthesized
agaaaagtacctgacccctaga

SEQ ID NO: 831260 - DNA, 22 bp, Artificial Sequence
  chemically synthesized
taattgagagctgtctaggggt

SEQ ID NO: 831261 - DNA, 22 bp, Artificial Sequence
  chemically synthesized
cgcccctataattgagagctgt

SEQ ID NO: 831262 - DNA, 22 bp, Artificial Sequence
  chemically synthesized
acgcccctataattgagagctg

SEQ ID NO: 831263 - DNA, 22 bp, Artificial Sequence
  chemically synthesized
acccctagacagctctcaatta

SEQ ID NO: 831264 - DNA, 22 bp, Artificial Sequence
  chemically synthesized
tttacgcccctataattgagag

SEQ ID NO: 831265 - DNA, 22 bp, Artificial Sequence
  chemically synthesized
cctatttacgcccctataattg

SEQ ID NO: 831266 - DNA, 22 bp, Artificial Sequence
  chemically synthesized
gacagctctcaattataggggc

SEQ ID NO: 831267 - DNA, 22 bp, Artificial Sequence
  chemically synthesized
tcaattataggggcgtaaatag

SEQ ID NO: 831268 - DNA, 22 bp, Artificial Sequence
  chemically synthesized
aattataggggcgtaaataggc

SEQ ID NO: 831269 - DNA, 22 bp, Artificial Sequence
  chemically synthesized
ccaaagtacacgattgcctatt

SEQ ID NO: 831270 - DNA, 22 bp, Artificial Sequence
  chemically synthesized
taggggcgtaaataggcaatcg

SEQ ID NO: 831271 - DNA, 22 bp, Artificial Sequence
  chemically synthesized
agaagccccagaaaagtccaac

SEQ ID NO: 831272 - DNA, 22 bp, Artificial Sequence
  chemically synthesized
aagaagccccagaaaagtccaa

SEQ ID NO: 831273 - DNA, 22 bp, Artificial Sequence
  chemically synthesized
tggtaacactgttggacttttc

SEQ ID NO: 831274 - DNA, 22 bp, Artificial Sequence
  chemically synthesized
ggtaacactgttggacttttct

SEQ ID NO: 831275 - DNA, 22 bp, Artificial Sequence
  chemically synthesized
gtaacactgttggacttttctg

SEQ ID NO: 831276 - DNA, 22 bp, Artificial Sequence
  chemically synthesized
aggatttaagaagccccagaaa

SEQ ID NO: 831277 - DNA, 22 bp, Artificial Sequence
  chemically synthesized
ttggacttttctggggcttctt

SEQ ID NO: 831278 - DNA, 22 bp, Artificial Sequence
  chemically synthesized
tgactcaggatttaagaagccc

SEQ ID NO: 831279 - DNA, 22 bp, Artificial Sequence
  chemically synthesized
atgactcaggatttaagaagcc

SEQ ID NO: 831280 - DNA, 22 bp, Artificial Sequence
  chemically synthesized
gacttttctggggcttcttaaa

SEQ ID NO: 831281 - DNA, 22 bp, Artificial Sequence
  chemically synthesized
tatgactcaggatttaagaagc

SEQ ID NO: 831282 - DNA, 22 bp, Artificial Sequence
  chemically synthesized
ctttatgactcaggatttaaga

SEQ ID NO: 831283 - DNA, 22 bp, Artificial Sequence
  chemically synthesized
gctttatgactcaggatttaag

SEQ ID NO: 831284 - DNA, 22 bp, Artificial Sequence
  chemically synthesized
ttctggggcttcttaaatcctg

SEQ ID NO: 831285 - DNA, 22 bp, Artificial Sequence
  chemically synthesized
tgctttatgactcaggatttaa

SEQ ID NO: 831286 - DNA, 22 bp, Artificial Sequence
  chemically synthesized
tctggggcttcttaaatcctga

SEQ ID NO: 831287 - DNA, 22 bp, Artificial Sequence
  chemically synthesized
ctggggcttcttaaatcctgag

SEQ ID NO: 831288 - DNA, 22 bp, Artificial Sequence
  chemically synthesized
tggggcttcttaaatcctgagt

SEQ ID NO: 831289 - DNA, 22 bp, Artificial Sequence
  chemically synthesized
ctttgctttatgactcaggatt

SEQ ID NO: 831290 - DNA, 22 bp, Artificial Sequence
  chemically synthesized
gggcttcttaaatcctgagtca

SEQ ID NO: 831291 - DNA, 22 bp, Artificial Sequence
  chemically synthesized
tcctcctttgctttatgactca

SEQ ID NO: 831292 - DNA, 22 bp, Artificial Sequence
  chemically synthesized
cttaaatcctgagtcataaagc

SEQ ID NO: 831293 - DNA, 22 bp, Artificial Sequence
  chemically synthesized
ttaaatcctgagtcataaagca

SEQ ID NO: 831294 - DNA, 22 bp, Artificial Sequence
  chemically synthesized
aaatcctgagtcataaagcaaa

SEQ ID NO: 831295 - DNA, 22 bp, Artificial Sequence
  chemically synthesized
aatcctgagtcataaagcaaag

SEQ ID NO: 831296 - DNA, 22 bp, Artificial Sequence
  chemically synthesized
agtcataaagcaaaggaggata

SEQ ID NO: 831297 - DNA, 22 bp, Artificial Sequence
  chemically synthesized
cagggatcatccaatctatcct

SEQ ID NO: 831298 - DNA, 22 bp, Artificial Sequence
  chemically synthesized
aaaacatctccagggatcatcc

SEQ ID NO: 831299 - DNA, 22 bp, Artificial Sequence
  chemically synthesized
gagctgaaaacatctccaggga

SEQ ID NO: 831300 - DNA, 22 bp, Artificial Sequence
  chemically synthesized
ttagagctgaaaacatctccag

SEQ ID NO: 831301 - DNA, 22 bp, Artificial Sequence
  chemically synthesized
gatgatccctggagatgttttc

SEQ ID NO: 831302 - DNA, 22 bp, Artificial Sequence
  chemically synthesized
acaaactgttagagctgaaaac

SEQ ID NO: 831303 - DNA, 22 bp, Artificial Sequence
  chemically synthesized
cacaaactgttagagctgaaaa

SEQ ID NO: 831304 - DNA, 22 bp, Artificial Sequence
  chemically synthesized
gagatgttttcagctctaacag

SEQ ID NO: 831305 - DNA, 22 bp, Artificial Sequence
  chemically synthesized
tcagctctaacagtttgtgaaa

SEQ ID NO: 831306 - DNA, 22 bp, Artificial Sequence
  chemically synthesized
cagctctaacagtttgtgaaat

SEQ ID NO: 831307 - DNA, 22 bp, Artificial Sequence
  chemically synthesized
agctctaacagtttgtgaaata

SEQ ID NO: 831308 - DNA, 22 bp, Artificial Sequence
  chemically synthesized
taacagtttgtgaaatacgttt

SEQ ID NO: 831309 - DNA, 22 bp, Artificial Sequence
  chemically synthesized
acagtttgtgaaatacgtttct

SEQ ID NO: 831310 - DNA, 22 bp, Artificial Sequence
  chemically synthesized
acagaggcatcaagaaacgtat

SEQ ID NO: 831311 - DNA, 22 bp, Artificial Sequence
  chemically synthesized
tgacagaggcatcaagaaacgt

SEQ ID NO: 831312 - DNA, 22 bp, Artificial Sequence
  chemically synthesized
gtgaaatacgtttcttgatgcc

SEQ ID NO: 831313 - DNA, 22 bp, Artificial Sequence
  chemically synthesized
agctctgacagaggcatcaaga

SEQ ID NO: 831314 - DNA, 22 bp, Artificial Sequence
  chemically synthesized
tgaaatacgtttcttgatgcct

SEQ ID NO: 831315 - DNA, 22 bp, Artificial Sequence
  chemically synthesized
cagctctgacagaggcatcaag

SEQ ID NO: 831316 - DNA, 22 bp, Artificial Sequence
  chemically synthesized
tcagctctgacagaggcatcaa

SEQ ID NO: 831317 - DNA, 22 bp, Artificial Sequence
  chemically synthesized
cttgatgcctctgtcagagctg

SEQ ID NO: 831318 - DNA, 22 bp, Artificial Sequence
  chemically synthesized
ttgatgcctctgtcagagctga

SEQ ID NO: 831319 - DNA, 22 bp, Artificial Sequence
  chemically synthesized
taaggtgagctttcagctctga

SEQ ID NO: 831320 - DNA, 22 bp, Artificial Sequence
  chemically synthesized
gtaaggtgagctttcagctctg

SEQ ID NO: 831321 - DNA, 22 bp, Artificial Sequence
  chemically synthesized
gatgcctctgtcagagctgaaa

SEQ ID NO: 831322 - DNA, 22 bp, Artificial Sequence
  chemically synthesized
atgcctctgtcagagctgaaag

SEQ ID NO: 831323 - DNA, 22 bp, Artificial Sequence
  chemically synthesized
tgtcagagctgaaagctcacct

SEQ ID NO: 831324 - DNA, 22 bp, Artificial Sequence
  chemically synthesized
tcagagctgaaagctcacctta

SEQ ID NO: 831325 - DNA, 22 bp, Artificial Sequence
  chemically synthesized
acaaaaaccttgtaaggtgagc

SEQ ID NO: 831326 - DNA, 22 bp, Artificial Sequence
  chemically synthesized
cacaaaaaccttgtaaggtgag

SEQ ID NO: 831327 - DNA, 22 bp, Artificial Sequence
  chemically synthesized
ttcacaaaaaccttgtaaggtg

SEQ ID NO: 831328 - DNA, 22 bp, Artificial Sequence
  chemically synthesized
aaagctcaccttacaaggtttt

SEQ ID NO: 831329 - DNA, 22 bp, Artificial Sequence
  chemically synthesized
ggtgagttcttcacaaaaacct

SEQ ID NO: 831330 - DNA, 22 bp, Artificial Sequence
  chemically synthesized
accttacaaggtttttgtgaag

SEQ ID NO: 831331 - DNA, 22 bp, Artificial Sequence
  chemically synthesized
ggctgggtgagttcttcacaaa

SEQ ID NO: 831332 - DNA, 22 bp, Artificial Sequence
  chemically synthesized
acaaggtttttgtgaagaactc

SEQ ID NO: 831333 - DNA, 22 bp, Artificial Sequence
  chemically synthesized
caaggtttttgtgaagaactca

SEQ ID NO: 831334 - DNA, 22 bp, Artificial Sequence
  chemically synthesized
ggcactgggctgggtgagttct

SEQ ID NO: 831335 - DNA, 22 bp, Artificial Sequence
  chemically synthesized
atctaggcactgggctgggtga

SEQ ID NO: 831336 - DNA, 22 bp, Artificial Sequence
  chemically synthesized
ttgtgaagaactcacccagccc

SEQ ID NO: 831337 - DNA, 22 bp, Artificial Sequence
  chemically synthesized
tgtgaagaactcacccagccca

SEQ ID NO: 831338 - DNA, 22 bp, Artificial Sequence
  chemically synthesized
gtgaagaactcacccagcccag

SEQ ID NO: 831339 - DNA, 22 bp, Artificial Sequence
  chemically synthesized
ttcatctaggcactgggctggg

SEQ ID NO: 831340 - DNA, 22 bp, Artificial Sequence
  chemically synthesized
tgaagaactcacccagcccagt

SEQ ID NO: 831341 - DNA, 22 bp, Artificial Sequence
  chemically synthesized
gttcatctaggcactgggctgg

SEQ ID NO: 831342 - DNA, 22 bp, Artificial Sequence
  chemically synthesized
acccagcccagtgcctagatga

SEQ ID NO: 831343 - DNA, 22 bp, Artificial Sequence
  chemically synthesized
atacgtcatttgttcatctagg

SEQ ID NO: 831344 - DNA, 22 bp, Artificial Sequence
  chemically synthesized
ttgatacgtcatttgttcatct

SEQ ID NO: 831345 - DNA, 22 bp, Artificial Sequence
  chemically synthesized
gatgaacaaatgacgtatcaat

SEQ ID NO: 831346 - DNA, 22 bp, Artificial Sequence
  chemically synthesized
ccaaaggtccatccaggggaac

SEQ ID NO: 831347 - DNA, 22 bp, Artificial Sequence
  chemically synthesized
accaaaggtccatccaggggaa

SEQ ID NO: 831348 - DNA, 22 bp, Artificial Sequence
  chemically synthesized
aaatttaccaaaggtccatcca

SEQ ID NO: 831349 - DNA, 22 bp, Artificial Sequence
  chemically synthesized
ttcccctggatggacctttggt

SEQ ID NO: 831350 - DNA, 22 bp, Artificial Sequence
  chemically synthesized
ccaagttgaaatttaccaaagg

SEQ ID NO: 831351 - DNA, 22 bp, Artificial Sequence
  chemically synthesized
ccctggatggacctttggtaaa

SEQ ID NO: 831352 - DNA, 22 bp, Artificial Sequence
  chemically synthesized
gatggacctttggtaaatttca

SEQ ID NO: 831353 - DNA, 22 bp, Artificial Sequence
  chemically synthesized
tggtaaatttcaacttggcaat

SEQ ID NO: 831354 - DNA, 22 bp, Artificial Sequence
  chemically synthesized
ggtaaatttcaacttggcaatc

SEQ ID NO: 831355 - DNA, 22 bp, Artificial Sequence
  chemically synthesized
gtaaatttcaacttggcaatct

SEQ ID NO: 831356 - DNA, 22 bp, Artificial Sequence
  chemically synthesized
aatatatgaccataagattgcc

SEQ ID NO: 831357 - DNA, 22 bp, Artificial Sequence
  chemically synthesized
caacttggcaatcttatggtca

SEQ ID NO: 831358 - DNA, 22 bp, Artificial Sequence
  chemically synthesized
aacttggcaatcttatggtcat

SEQ ID NO: 831359 - DNA, 22 bp, Artificial Sequence
  chemically synthesized
ggcaatcttatggtcatatatt

SEQ ID NO: 831360 - DNA, 22 bp, Artificial Sequence
  chemically synthesized
gcaatcttatggtcatatattc

SEQ ID NO: 831361 - DNA, 22 bp, Artificial Sequence
  chemically synthesized
acatgtagcatgactgaatata

SEQ ID NO: 831362 - DNA, 22 bp, Artificial Sequence
  chemically synthesized
actgacatgtagcatgactgaa

SEQ ID NO: 831363 - DNA, 22 bp, Artificial Sequence
  chemically synthesized
atggtcatatattcagtcatgc

SEQ ID NO: 831364 - DNA, 22 bp, Artificial Sequence
  chemically synthesized
aactgacatgtagcatgactga

SEQ ID NO: 831365 - DNA, 22 bp, Artificial Sequence
  chemically synthesized
tggtcatatattcagtcatgct

SEQ ID NO: 831366 - DNA, 22 bp, Artificial Sequence
  chemically synthesized
taactgacatgtagcatgactg

SEQ ID NO: 831367 - DNA, 22 bp, Artificial Sequence
  chemically synthesized
ctttaactgacatgtagcatga

SEQ ID NO: 831368 - DNA, 22 bp, Artificial Sequence
  chemically synthesized
cctttaactgacatgtagcatg

SEQ ID NO: 831369 - DNA, 22 bp, Artificial Sequence
  chemically synthesized
agtttcctttaactgacatgta

SEQ ID NO: 831370 - DNA, 22 bp, Artificial Sequence
  chemically synthesized
gagtttcctttaactgacatgt

SEQ ID NO: 831371 - DNA, 22 bp, Artificial Sequence
  chemically synthesized
agtcatgctacatgtcagttaa

SEQ ID NO: 831372 - DNA, 22 bp, Artificial Sequence
  chemically synthesized
gcttgagtttcctttaactgac

SEQ ID NO: 831373 - DNA, 22 bp, Artificial Sequence
  chemically synthesized
ggttggcttgagtttcctttaa

SEQ ID NO: 831374 - DNA, 22 bp, Artificial Sequence
  chemically synthesized
aggttggcttgagtttccttta

SEQ ID NO: 831375 - DNA, 22 bp, Artificial Sequence
  chemically synthesized
taggttggcttgagtttccttt

SEQ ID NO: 831376 - DNA, 22 bp, Artificial Sequence
  chemically synthesized
ttaggttggcttgagtttcctt

SEQ ID NO: 831377 - DNA, 22 bp, Artificial Sequence
  chemically synthesized
catgtcagttaaaggaaactca

SEQ ID NO: 831378 - DNA, 22 bp, Artificial Sequence
  chemically synthesized
tttaggttggcttgagtttcct

SEQ ID NO: 831379 - DNA, 22 bp, Artificial Sequence
  chemically synthesized
aaggaaactcaagccaacctaa

SEQ ID NO: 831380 - DNA, 22 bp, Artificial Sequence
  chemically synthesized
aagccaacctaaaaaatgttcc

SEQ ID NO: 831381 - DNA, 22 bp, Artificial Sequence
  chemically synthesized
gcccagacaggagggaacattt

SEQ ID NO: 831382 - DNA, 22 bp, Artificial Sequence
  chemically synthesized
ggcccagacaggagggaacatt

SEQ ID NO: 831383 - DNA, 22 bp, Artificial Sequence
  chemically synthesized
aaaaatgttccctcctgtctgg

SEQ ID NO: 831384 - DNA, 22 bp, Artificial Sequence
  chemically synthesized
cctcctgtctgggccaaggcta

SEQ ID NO: 831385 - DNA, 22 bp, Artificial Sequence
  chemically synthesized
agatacaaaaaaatagccttgg

SEQ ID NO: 831386 - DNA, 22 bp, Artificial Sequence
  chemically synthesized
aagatacaaaaaaatagccttg

SEQ ID NO: 831387 - DNA, 22 bp, Artificial Sequence
  chemically synthesized
ctgtctgggccaaggctatttt

SEQ ID NO: 831388 - DNA, 22 bp, Artificial Sequence
  chemically synthesized
ttaagatacaaaaaaatagcct

SEQ ID NO: 831389 - DNA, 22 bp, Artificial Sequence
  chemically synthesized
tcttaagatacaaaaaaatagc

SEQ ID NO: 831390 - DNA, 22 bp, Artificial Sequence
  chemically synthesized
tctgggccaaggctattttttt

SEQ ID NO: 831391 - DNA, 22 bp, Artificial Sequence
  chemically synthesized
ggccaaggctatttttttgtat

SEQ ID NO: 831392 - DNA, 22 bp, Artificial Sequence
  chemically synthesized
tgtgacacatgcctctcttaag

SEQ ID NO: 831393 - DNA, 22 bp, Artificial Sequence
  chemically synthesized
tttttttgtatcttaagagagg

SEQ ID NO: 831394 - DNA, 22 bp, Artificial Sequence
  chemically synthesized
ttttgtatcttaagagaggcat

SEQ ID NO: 831395 - DNA, 22 bp, Artificial Sequence
  chemically synthesized
tttgtatcttaagagaggcatg

SEQ ID NO: 831396 - DNA, 22 bp, Artificial Sequence
  chemically synthesized
ttgtatcttaagagaggcatgt

SEQ ID NO: 831397 - DNA, 22 bp, Artificial Sequence
  chemically synthesized
tgtatcttaagagaggcatgtg

SEQ ID NO: 831398 - DNA, 22 bp, Artificial Sequence
  chemically synthesized
gtatcttaagagaggcatgtgt

SEQ ID NO: 831399 - DNA, 22 bp, Artificial Sequence
  chemically synthesized
tatcttaagagaggcatgtgtc

SEQ ID NO: 831400 - DNA, 22 bp, Artificial Sequence
  chemically synthesized
aagagaggcatgtgtcacacag

SEQ ID NO: 831401 - DNA, 22 bp, Artificial Sequence
  chemically synthesized
agagaggcatgtgtcacacagg

SEQ ID NO: 831402 - DNA, 22 bp, Artificial Sequence
  chemically synthesized
atgaatgggtatacctgtgtga

SEQ ID NO: 831403 - DNA, 22 bp, Artificial Sequence
  chemically synthesized
gatgaatgggtatacctgtgtg

SEQ ID NO: 831404 - DNA, 22 bp, Artificial Sequence
  chemically synthesized
tgatgaatgggtatacctgtgt

SEQ ID NO: 831405 - DNA, 22 bp, Artificial Sequence
  chemically synthesized
tgaaatgagttttgatgaatgg

SEQ ID NO: 831406 - DNA, 22 bp, Artificial Sequence
  chemically synthesized
atgtgtattatgaaatgagttt

SEQ ID NO: 831407 - DNA, 22 bp, Artificial Sequence
  chemically synthesized
atcaaaactcatttcataatac

SEQ ID NO: 831408 - DNA, 22 bp, Artificial Sequence
  chemically synthesized
gaatgtgtaaatctcatgtgta

SEQ ID NO: 831409 - DNA, 22 bp, Artificial Sequence
  chemically synthesized
atttcataatacacatgagatt

SEQ ID NO: 831410 - DNA, 22 bp, Artificial Sequence
  chemically synthesized
cataatacacatgagatttaca

SEQ ID NO: 831411 - DNA, 22 bp, Artificial Sequence
  chemically synthesized
ataatacacatgagatttacac

SEQ ID NO: 831412 - DNA, 22 bp, Artificial Sequence
  chemically synthesized
tatagactagaatgtgtaaatc

SEQ ID NO: 831413 - DNA, 22 bp, Artificial Sequence
  chemically synthesized
gtatagactagaatgtgtaaat

SEQ ID NO: 831414 - DNA, 22 bp, Artificial Sequence
  chemically synthesized
tggcaaaatttgtatagactag

SEQ ID NO: 831415 - DNA, 22 bp, Artificial Sequence
  chemically synthesized
gtggcaaaatttgtatagacta

SEQ ID NO: 831416 - DNA, 22 bp, Artificial Sequence
  chemically synthesized
tttgtggcaaaatttgtataga

SEQ ID NO: 831417 - DNA, 22 bp, Artificial Sequence
  chemically synthesized
acacattctagtctatacaaat

SEQ ID NO: 831418 - DNA, 22 bp, Artificial Sequence
  chemically synthesized
gtttgtggcaaaatttgtatag

SEQ ID NO: 831419 - DNA, 22 bp, Artificial Sequence
  chemically synthesized
cacattctagtctatacaaatt

SEQ ID NO: 831420 - DNA, 22 bp, Artificial Sequence
  chemically synthesized
tttgtttgtggcaaaatttgta

SEQ ID NO: 831421 - DNA, 22 bp, Artificial Sequence
  chemically synthesized
gtttgtttgtggcaaaatttgt

SEQ ID NO: 831422 - DNA, 22 bp, Artificial Sequence
  chemically synthesized
tttgtttgtttgtggcaaaatt

SEQ ID NO: 831423 - DNA, 22 bp, Artificial Sequence
  chemically synthesized
tagtctatacaaattttgccac

SEQ ID NO: 831424 - DNA, 22 bp, Artificial Sequence
  chemically synthesized
gtttgtttgtttgtggcaaaat

SEQ ID NO: 831425 - DNA, 22 bp, Artificial Sequence
  chemically synthesized
tgtttgtttgtttgtggcaaaa

SEQ ID NO: 831426 - DNA, 22 bp, Artificial Sequence
  chemically synthesized
gtctatacaaattttgccacaa

SEQ ID NO: 831427 - DNA, 22 bp, Artificial Sequence
  chemically synthesized
ttgtttgtttgtttgtggcaaa

SEQ ID NO: 831428 - DNA, 22 bp, Artificial Sequence
  chemically synthesized
ttttgtttgtttgtttgtggca

SEQ ID NO: 831429 - DNA, 22 bp, Artificial Sequence
  chemically synthesized
cttttgtttgtttgtttgtggc

SEQ ID NO: 831430 - DNA, 22 bp, Artificial Sequence
  chemically synthesized
tacaaattttgccacaaacaaa

SEQ ID NO: 831431 - DNA, 22 bp, Artificial Sequence
  chemically synthesized
acatttcttttgtttgtttgtt

SEQ ID NO: 831432 - DNA, 22 bp, Artificial Sequence
  chemically synthesized
ttcacatttcttttgtttgttt

SEQ ID NO: 831433 - DNA, 22 bp, Artificial Sequence
  chemically synthesized
gttcacatttcttttgtttgtt

SEQ ID NO: 831434 - DNA, 22 bp, Artificial Sequence
  chemically synthesized
tgccacaaacaaacaaacaaaa

SEQ ID NO: 831435 - DNA, 22 bp, Artificial Sequence
  chemically synthesized
gccacaaacaaacaaacaaaag

SEQ ID NO: 831436 - DNA, 22 bp, Artificial Sequence
  chemically synthesized
ccacaaacaaacaaacaaaaga

SEQ ID NO: 831437 - DNA, 22 bp, Artificial Sequence
  chemically synthesized
aatatttgttcacatttctttt

SEQ ID NO: 831438 - DNA, 22 bp, Artificial Sequence
  chemically synthesized
accagagctcaatatttgttca

SEQ ID NO: 831439 - DNA, 22 bp, Artificial Sequence
  chemically synthesized
aacatgcatgtcattaaccaga

SEQ ID NO: 831440 - DNA, 22 bp, Artificial Sequence
  chemically synthesized
caacatgcatgtcattaaccag

SEQ ID NO: 831441 - DNA, 22 bp, Artificial Sequence
  chemically synthesized
ttcaacatgcatgtcattaacc

SEQ ID NO: 831442 - DNA, 22 bp, Artificial Sequence
  chemically synthesized
agttcttcaacatgcatgtcat

SEQ ID NO: 831443 - DNA, 22 bp, Artificial Sequence
  chemically synthesized
agctctggttaatgacatgcat

SEQ ID NO: 831444 - DNA, 22 bp, Artificial Sequence
  chemically synthesized
tggttaatgacatgcatgttga

SEQ ID NO: 831445 - DNA, 22 bp, Artificial Sequence
  chemically synthesized
cccctaagttcttcaacatgca

SEQ ID NO: 831446 - DNA, 22 bp, Artificial Sequence
  chemically synthesized
acccctaagttcttcaacatgc

SEQ ID NO: 831447 - DNA, 22 bp, Artificial Sequence
  chemically synthesized
gttaatgacatgcatgttgaag

SEQ ID NO: 831448 - DNA, 22 bp, Artificial Sequence
  chemically synthesized
tacccctaagttcttcaacatg

SEQ ID NO: 831449 - DNA, 22 bp, Artificial Sequence
  chemically synthesized
atgacatgcatgttgaagaact

SEQ ID NO: 831450 - DNA, 22 bp, Artificial Sequence
  chemically synthesized
cctttacccctaagttcttcaa

SEQ ID NO: 831451 - DNA, 22 bp, Artificial Sequence
  chemically synthesized
gtgacatcggttccctttaccc

SEQ ID NO: 831452 - DNA, 22 bp, Artificial Sequence
  chemically synthesized
aagaacttaggggtaaagggaa

SEQ ID NO: 831453 - DNA, 22 bp, Artificial Sequence
  chemically synthesized
aggggtaaagggaaccgatgtc

SEQ ID NO: 831454 - DNA, 22 bp, Artificial Sequence
  chemically synthesized
ggggtaaagggaaccgatgtca

SEQ ID NO: 831455 - DNA, 22 bp, Artificial Sequence
  chemically synthesized
aaagtaagttggtgacatcggt

SEQ ID NO: 831456 - DNA, 22 bp, Artificial Sequence
  chemically synthesized
caaagtaagttggtgacatcgg

SEQ ID NO: 831457 - DNA, 22 bp, Artificial Sequence
  chemically synthesized
atgcccttcaaagtaagttggt

SEQ ID NO: 831458 - DNA, 22 bp, Artificial Sequence
  chemically synthesized
tgatgcccttcaaagtaagttg

SEQ ID NO: 831459 - DNA, 22 bp, Artificial Sequence
  chemically synthesized
ctgatgcccttcaaagtaagtt

SEQ ID NO: 831460 - DNA, 22 bp, Artificial Sequence
  chemically synthesized
tctgatgcccttcaaagtaagt

SEQ ID NO: 831461 - DNA, 22 bp, Artificial Sequence
  chemically synthesized
ttttctgatgcccttcaaagta

SEQ ID NO: 831462 - DNA, 22 bp, Artificial Sequence
  chemically synthesized
ttattttctgatgcccttcaaa

SEQ ID NO: 831463 - DNA, 22 bp, Artificial Sequence
  chemically synthesized
actttgaagggcatcagaaaat

SEQ ID NO: 831464 - DNA, 22 bp, Artificial Sequence
  chemically synthesized
ctttgaagggcatcagaaaata

SEQ ID NO: 831465 - DNA, 22 bp, Artificial Sequence
  chemically synthesized
tgaagggcatcagaaaataata

SEQ ID NO: 831466 - DNA, 22 bp, Artificial Sequence
  chemically synthesized
cccgccaacccctattattttc

SEQ ID NO: 831467 - DNA, 22 bp, Artificial Sequence
  chemically synthesized
gaagggcatcagaaaataatag

SEQ ID NO: 831468 - DNA, 22 bp, Artificial Sequence
  chemically synthesized
aagggcatcagaaaataatagg

SEQ ID NO: 831469 - DNA, 22 bp, Artificial Sequence
  chemically synthesized
tacccgccaacccctattattt

SEQ ID NO: 831470 - DNA, 22 bp, Artificial Sequence
  chemically synthesized
tctacccgccaacccctattat

SEQ ID NO: 831471 - DNA, 22 bp, Artificial Sequence
  chemically synthesized
ctctacccgccaacccctatta

SEQ ID NO: 831472 - DNA, 22 bp, Artificial Sequence
  chemically synthesized
tctctacccgccaacccctatt

SEQ ID NO: 831473 - DNA, 22 bp, Artificial Sequence
  chemically synthesized
tttctctacccgccaaccccta

SEQ ID NO: 831474 - DNA, 22 bp, Artificial Sequence
  chemically synthesized
ctttctctacccgccaacccct

SEQ ID NO: 831475 - DNA, 22 bp, Artificial Sequence
  chemically synthesized
cttctttctctacccgccaacc

SEQ ID NO: 831476 - DNA, 22 bp, Artificial Sequence
  chemically synthesized
acttctttctctacccgccaac

SEQ ID NO: 831477 - DNA, 22 bp, Artificial Sequence
  chemically synthesized
tacttctttctctacccgccaa

SEQ ID NO: 831478 - DNA, 22 bp, Artificial Sequence
  chemically synthesized
tatcactttacttctttctcta

SEQ ID NO: 831479 - DNA, 22 bp, Artificial Sequence
  chemically synthesized
ttgtatcactttacttctttct

SEQ ID NO: 831480 - DNA, 22 bp, Artificial Sequence
  chemically synthesized
gttgtatcactttacttctttc

SEQ ID NO: 831481 - DNA, 22 bp, Artificial Sequence
  chemically synthesized
tgttgtatcactttacttcttt

SEQ ID NO: 831482 - DNA, 22 bp, Artificial Sequence
  chemically synthesized
gcgggtagagaaagaagtaaag

SEQ ID NO: 831483 - DNA, 22 bp, Artificial Sequence
  chemically synthesized
gattttgttgtatcactttact

SEQ ID NO: 831484 - DNA, 22 bp, Artificial Sequence
  chemically synthesized
tagattttgttgtatcacttta

SEQ ID NO: 831485 - DNA, 22 bp, Artificial Sequence
  chemically synthesized
tctagattttgttgtatcactt

SEQ ID NO: 831486 - DNA, 22 bp, Artificial Sequence
  chemically synthesized
atgaacccactctctagatttt

SEQ ID NO: 831487 - DNA, 22 bp, Artificial Sequence
  chemically synthesized
tacagtgagtgctcatgaaccc

SEQ ID NO: 831488 - DNA, 22 bp, Artificial Sequence
  chemically synthesized
gagagtgggttcatgagcactc

SEQ ID NO: 831489 - DNA, 22 bp, Artificial Sequence
  chemically synthesized
aaagaattgtacagtgagtgct

SEQ ID NO: 831490 - DNA, 22 bp, Artificial Sequence
  chemically synthesized
atgagcactcactgtacaattc

SEQ ID NO: 831491 - DNA, 22 bp, Artificial Sequence
  chemically synthesized
aaatacacagaaagctgaaaga

SEQ ID NO: 831492 - DNA, 22 bp, Artificial Sequence
  chemically synthesized
caaatacacagaaagctgaaag

SEQ ID NO: 831493 - DNA, 22 bp, Artificial Sequence
  chemically synthesized
actgtacaattctttcagcttt

SEQ ID NO: 831494 - DNA, 22 bp, Artificial Sequence
  chemically synthesized
tcaaatacacagaaagctgaaa

SEQ ID NO: 831495 - DNA, 22 bp, Artificial Sequence
  chemically synthesized
ttcaaatacacagaaagctgaa

SEQ ID NO: 831496 - DNA, 22 bp, Artificial Sequence
  chemically synthesized
tacaattctttcagctttctgt

SEQ ID NO: 831497 - DNA, 22 bp, Artificial Sequence
  chemically synthesized
aaatttttcaaatacacagaaa

SEQ ID NO: 831498 - DNA, 22 bp, Artificial Sequence
  chemically synthesized
aaaatttttcaaatacacagaa

SEQ ID NO: 831499 - DNA, 22 bp, Artificial Sequence
  chemically synthesized
taaaatttttcaaatacacaga

SEQ ID NO: 831500 - DNA, 22 bp, Artificial Sequence
  chemically synthesized
tttcagctttctgtgtatttga

SEQ ID NO: 831501 - DNA, 22 bp, Artificial Sequence
  chemically synthesized
ttttaaaatttttcaaatacac

SEQ ID NO: 831502 - DNA, 22 bp, Artificial Sequence
  chemically synthesized
tcagctttctgtgtatttgaaa

SEQ ID NO: 831503 - DNA, 22 bp, Artificial Sequence
  chemically synthesized
tattttaaaatttttcaaatac

SEQ ID NO: 831504 - DNA, 22 bp, Artificial Sequence
  chemically synthesized
cagctttctgtgtatttgaaaa

SEQ ID NO: 831505 - DNA, 22 bp, Artificial Sequence
  chemically synthesized
agctttctgtgtatttgaaaaa

SEQ ID NO: 831506 - DNA, 22 bp, Artificial Sequence
  chemically synthesized
acattctattttaaaatttttc

SEQ ID NO: 831507 - DNA, 22 bp, Artificial Sequence
  chemically synthesized
tctgtgtatttgaaaaatttta

SEQ ID NO: 831508 - DNA, 22 bp, Artificial Sequence
  chemically synthesized
ctgtgtatttgaaaaattttaa

SEQ ID NO: 831509 - DNA, 22 bp, Artificial Sequence
  chemically synthesized
tgtgtatttgaaaaattttaaa

SEQ ID NO: 831510 - DNA, 22 bp, Artificial Sequence
  chemically synthesized
tctaacattctattttaaaatt

SEQ ID NO: 831511 - DNA, 22 bp, Artificial Sequence
  chemically synthesized
tgtatttgaaaaattttaaaat

SEQ ID NO: 831512 - DNA, 22 bp, Artificial Sequence
  chemically synthesized
atctaacattctattttaaaat

SEQ ID NO: 831513 - DNA, 22 bp, Artificial Sequence
  chemically synthesized
tatctaacattctattttaaaa

SEQ ID NO: 831514 - DNA, 22 bp, Artificial Sequence
  chemically synthesized
gaaaaattttaaaatagaatgt

SEQ ID NO: 831515 - DNA, 22 bp, Artificial Sequence
  chemically synthesized
aaaaattttaaaatagaatgtt

SEQ ID NO: 831516 - DNA, 22 bp, Artificial Sequence
  chemically synthesized
taaaatagaatgttagataaaa

SEQ ID NO: 831517 - DNA, 22 bp, Artificial Sequence
  chemically synthesized
aaaatagaatgttagataaaat

SEQ ID NO: 831518 - DNA, 22 bp, Artificial Sequence
  chemically synthesized
aaatagaatgttagataaaatg

SEQ ID NO: 831519 - DNA, 22 bp, Artificial Sequence
  chemically synthesized
gataaaatgttctctcggctgg

SEQ ID NO: 831520 - DNA, 22 bp, Artificial Sequence
  chemically synthesized
caggtgtgagccaccgtgccca

SEQ ID NO: 831521 - DNA, 22 bp, Artificial Sequence
  chemically synthesized
tctcggctgggcacggtggctc

SEQ ID NO: 831522 - DNA, 22 bp, Artificial Sequence
  chemically synthesized
ggattacaggtgtgagccaccg

SEQ ID NO: 831523 - DNA, 22 bp, Artificial Sequence
  chemically synthesized
tcggctgggcacggtggctcac

SEQ ID NO: 831524 - DNA, 22 bp, Artificial Sequence
  chemically synthesized
ggctgggcacggtggctcacac

SEQ ID NO: 831525 - DNA, 22 bp, Artificial Sequence
  chemically synthesized
ggcacggtggctcacacctgta

SEQ ID NO: 831526 - DNA, 22 bp, Artificial Sequence
  chemically synthesized
ccaaagtgctgggattacaggt

SEQ ID NO: 831527 - DNA, 22 bp, Artificial Sequence
  chemically synthesized
ggcctcccaaagtgctgggatt

SEQ ID NO: 831528 - DNA, 22 bp, Artificial Sequence
  chemically synthesized
acacctgtaatcccagcacttt

SEQ ID NO: 831529 - DNA, 22 bp, Artificial Sequence
  chemically synthesized
acctcggcctcccaaagtgctg

SEQ ID NO: 831530 - DNA, 22 bp, Artificial Sequence
  chemically synthesized
taatcccagcactttgggaggc

SEQ ID NO: 831531 - DNA, 22 bp, Artificial Sequence
  chemically synthesized
atgatccgttcacctcggcctc

SEQ ID NO: 831532 - DNA, 22 bp, Artificial Sequence
  chemically synthesized
atctcatgatccgttcacctcg

SEQ ID NO: 831533 - DNA, 22 bp, Artificial Sequence
  chemically synthesized
ctgatctcatgatccgttcacc

SEQ ID NO: 831534 - DNA, 22 bp, Artificial Sequence
  chemically synthesized
tgggaggccgaggtgaacggat

SEQ ID NO: 831535 - DNA, 22 bp, Artificial Sequence
  chemically synthesized
gggaggccgaggtgaacggatc

SEQ ID NO: 831536 - DNA, 22 bp, Artificial Sequence
  chemically synthesized
ggaggccgaggtgaacggatca

SEQ ID NO: 831537 - DNA, 22 bp, Artificial Sequence
  chemically synthesized
agctcctgatctcatgatccgt

SEQ ID NO: 831538 - DNA, 22 bp, Artificial Sequence
  chemically synthesized
aagctcctgatctcatgatccg

SEQ ID NO: 831539 - DNA, 22 bp, Artificial Sequence
  chemically synthesized
atcttaagctcctgatctcatg

SEQ ID NO: 831540 - DNA, 22 bp, Artificial Sequence
  chemically synthesized
gccaggttgatcttaagctcct

SEQ ID NO: 831541 - DNA, 22 bp, Artificial Sequence
  chemically synthesized
ggccaggttgatcttaagctcc

SEQ ID NO: 831542 - DNA, 22 bp, Artificial Sequence
  chemically synthesized
accatcttggccaggttgatct

SEQ ID NO: 831543 - DNA, 22 bp, Artificial Sequence
  chemically synthesized
caccatcttggccaggttgatc

SEQ ID NO: 831544 - DNA, 22 bp, Artificial Sequence
  chemically synthesized
aagatcaacctggccaagatgg

SEQ ID NO: 831545 - DNA, 22 bp, Artificial Sequence
  chemically synthesized
agatcaacctggccaagatggt

SEQ ID NO: 831546 - DNA, 22 bp, Artificial Sequence
  chemically synthesized
gtacagacagggtttcaccatc

SEQ ID NO: 831547 - DNA, 22 bp, Artificial Sequence
  chemically synthesized
agtacagacagggtttcaccat

SEQ ID NO: 831548 - DNA, 22 bp, Artificial Sequence
  chemically synthesized
tagtacagacagggtttcacca

SEQ ID NO: 831549 - DNA, 22 bp, Artificial Sequence
  chemically synthesized
ttagtacagacagggtttcacc

SEQ ID NO: 831550 - DNA, 22 bp, Artificial Sequence
  chemically synthesized
gccaagatggtgaaaccctgtc

SEQ ID NO: 831551 - DNA, 22 bp, Artificial Sequence
  chemically synthesized
tatttttagtacagacagggtt

SEQ ID NO: 831552 - DNA, 22 bp, Artificial Sequence
  chemically synthesized
gtatttttagtacagacagggt

SEQ ID NO: 831553 - DNA, 22 bp, Artificial Sequence
  chemically synthesized
tgtatttttagtacagacaggg

SEQ ID NO: 831554 - DNA, 22 bp, Artificial Sequence
  chemically synthesized
ttgtatttttagtacagacagg

SEQ ID NO: 831555 - DNA, 22 bp, Artificial Sequence
  chemically synthesized
atttttgtatttttagtacaga

SEQ ID NO: 831556 - DNA, 22 bp, Artificial Sequence
  chemically synthesized
gctaatttttgtatttttagta

SEQ ID NO: 831557 - DNA, 22 bp, Artificial Sequence
  chemically synthesized
cgcctggctaatttttgtattt

SEQ ID NO: 831558 - DNA, 22 bp, Artificial Sequence
  chemically synthesized
tctgtactaaaaatacaaaaat

SEQ ID NO: 831559 - DNA, 22 bp, Artificial Sequence
  chemically synthesized
tactaaaaatacaaaaattagc

SEQ ID NO: 831560 - DNA, 22 bp, Artificial Sequence
  chemically synthesized
ccactgcgcctggctaattttt

SEQ ID NO: 831561 - DNA, 22 bp, Artificial Sequence
  chemically synthesized
aaaatacaaaaattagccaggc

SEQ ID NO: 831562 - DNA, 22 bp, Artificial Sequence
  chemically synthesized
caggtgcctgccactgcgcctg

SEQ ID NO: 831563 - DNA, 22 bp, Artificial Sequence
  chemically synthesized
ggattacaggtgcctgccactg

SEQ ID NO: 831564 - DNA, 22 bp, Artificial Sequence
  chemically synthesized
gccaggcgcagtggcaggcacc

SEQ ID NO: 831565 - DNA, 22 bp, Artificial Sequence
  chemically synthesized
ccgagtagctgggattacaggt

SEQ ID NO: 831566 - DNA, 22 bp, Artificial Sequence
  chemically synthesized
agcctcccgagtagctgggatt

SEQ ID NO: 831567 - DNA, 22 bp, Artificial Sequence
  chemically synthesized
cctcagcctcccgagtagctgg

SEQ ID NO: 831568 - DNA, 22 bp, Artificial Sequence
  chemically synthesized
ctgcctcagcctcccgagtagc

SEQ ID NO: 831569 - DNA, 22 bp, Artificial Sequence
  chemically synthesized
tcctgcctcagcctcccgagta

SEQ ID NO: 831570 - DNA, 22 bp, Artificial Sequence
  chemically synthesized
taatcccagctactcgggaggc

SEQ ID NO: 831571 - DNA, 22 bp, Artificial Sequence
  chemically synthesized
aagcgattctcctgcctcagcc

SEQ ID NO: 831572 - DNA, 22 bp, Artificial Sequence
  chemically synthesized
ctcgggaggctgaggcaggaga

SEQ ID NO: 831573 - DNA, 22 bp, Artificial Sequence
  chemically synthesized
gggaggctgaggcaggagaatc

SEQ ID NO: 831574 - DNA, 22 bp, Artificial Sequence
  chemically synthesized
ccgcccgggttcaagcgattct

SEQ ID NO: 831575 - DNA, 22 bp, Artificial Sequence
  chemically synthesized
tgccgcccgggttcaagcgatt

SEQ ID NO: 831576 - DNA, 22 bp, Artificial Sequence
  chemically synthesized
aggcaggagaatcgcttgaacc

SEQ ID NO: 831577 - DNA, 22 bp, Artificial Sequence
  chemically synthesized
caacctctgccgcccgggttca

SEQ ID NO: 831578 - DNA, 22 bp, Artificial Sequence
  chemically synthesized
actgcaacctctgccgcccggg

SEQ ID NO: 831579 - DNA, 22 bp, Artificial Sequence
  chemically synthesized
ggctcactgcaacctctgccgc

SEQ ID NO: 831580 - DNA, 22 bp, Artificial Sequence
  chemically synthesized
gaacccgggcggcagaggttgc

SEQ ID NO: 831581 - DNA, 22 bp, Artificial Sequence
  chemically synthesized
aacccgggcggcagaggttgca

SEQ ID NO: 831582 - DNA, 22 bp, Artificial Sequence
  chemically synthesized
gagtgcagtggcgcaatctcgg

SEQ ID NO: 831583 - DNA, 22 bp, Artificial Sequence
  chemically synthesized
cagtgagccgagattgcgccac

SEQ ID NO: 831584 - DNA, 22 bp, Artificial Sequence
  chemically synthesized
ggctggagtgcagtggcgcaat

SEQ ID NO: 831585 - DNA, 22 bp, Artificial Sequence
  chemically synthesized
cctaggctggagtgcagtggcg

SEQ ID NO: 831586 - DNA, 22 bp, Artificial Sequence
  chemically synthesized
tgttgcctaggctggagtgcag

SEQ ID NO: 831587 - DNA, 22 bp, Artificial Sequence
  chemically synthesized
actatgttgcctaggctggagt

SEQ ID NO: 831588 - DNA, 22 bp, Artificial Sequence
  chemically synthesized
cgccactgcactccagcctagg

SEQ ID NO: 831589 - DNA, 22 bp, Artificial Sequence
  chemically synthesized
cactccagcctaggcaacatag

SEQ ID NO: 831590 - DNA, 22 bp, Artificial Sequence
  chemically synthesized
agacagagtctcactatgttgc

SEQ ID NO: 831591 - DNA, 22 bp, Artificial Sequence
  chemically synthesized
gagacagagtctcactatgttg

SEQ ID NO: 831592 - DNA, 22 bp, Artificial Sequence
  chemically synthesized
tgagacagagtctcactatgtt

SEQ ID NO: 831593 - DNA, 22 bp, Artificial Sequence
  chemically synthesized
ttgagacagagtctcactatgt

SEQ ID NO: 831594 - DNA, 22 bp, Artificial Sequence
  chemically synthesized
cagcctaggcaacatagtgaga

SEQ ID NO: 831595 - DNA, 22 bp, Artificial Sequence
  chemically synthesized
tttgagacagagtctcactatg

SEQ ID NO: 831596 - DNA, 22 bp, Artificial Sequence
  chemically synthesized
ttttgagacagagtctcactat

SEQ ID NO: 831597 - DNA, 22 bp, Artificial Sequence
  chemically synthesized
tttttgagacagagtctcacta

SEQ ID NO: 831598 - DNA, 22 bp, Artificial Sequence
  chemically synthesized
ttttttgagacagagtctcact

SEQ ID NO: 831599 - DNA, 22 bp, Artificial Sequence
  chemically synthesized
tttttttgagacagagtctcac

SEQ ID NO: 831600 - DNA, 22 bp, Artificial Sequence
  chemically synthesized
ttttttttgagacagagtctca

SEQ ID NO: 831601 - DNA, 22 bp, Artificial Sequence
  chemically synthesized
tttttttttgagacagagtctc

SEQ ID NO: 831602 - DNA, 22 bp, Artificial Sequence
  chemically synthesized
ggcaacatagtgagactctgtc

SEQ ID NO: 831603 - DNA, 22 bp, Artificial Sequence
  chemically synthesized
ttttttttttgagacagagtct

SEQ ID NO: 831604 - DNA, 22 bp, Artificial Sequence
  chemically synthesized
tttttttttttgagacagagtc

SEQ ID NO: 831605 - DNA, 22 bp, Artificial Sequence
  chemically synthesized
ttttttttttttgagacagagt

SEQ ID NO: 831606 - DNA, 22 bp, Artificial Sequence
  chemically synthesized
tgagagaatttttttttttttt

SEQ ID NO: 831607 - DNA, 22 bp, Artificial Sequence
  chemically synthesized
tgtgagagaatttttttttttt

SEQ ID NO: 831608 - DNA, 22 bp, Artificial Sequence
  chemically synthesized
ctgtgagagaattttttttttt

SEQ ID NO: 831609 - DNA, 22 bp, Artificial Sequence
  chemically synthesized
tctgtgagagaatttttttttt

SEQ ID NO: 831610 - DNA, 22 bp, Artificial Sequence
  chemically synthesized
tgtctcaaaaaaaaaaaaaaat

SEQ ID NO: 831611 - DNA, 22 bp, Artificial Sequence
  chemically synthesized
tctcaaaaaaaaaaaaaaattc

SEQ ID NO: 831612 - DNA, 22 bp, Artificial Sequence
  chemically synthesized
tgttttctgtgagagaattttt

SEQ ID NO: 831613 - DNA, 22 bp, Artificial Sequence
  chemically synthesized
gtgttttctgtgagagaatttt

SEQ ID NO: 831614 - DNA, 22 bp, Artificial Sequence
  chemically synthesized
aaaaaaaaaaaaaaattctctc

SEQ ID NO: 831615 - DNA, 22 bp, Artificial Sequence
  chemically synthesized
tgtgttttctgtgagagaattt

SEQ ID NO: 831616 - DNA, 22 bp, Artificial Sequence
  chemically synthesized
ctttgtgttttctgtgagagaa

SEQ ID NO: 831617 - DNA, 22 bp, Artificial Sequence
  chemically synthesized
aataatacactgctttgtgttt

SEQ ID NO: 831618 - DNA, 22 bp, Artificial Sequence
  chemically synthesized
aaataatacactgctttgtgtt

SEQ ID NO: 831619 - DNA, 22 bp, Artificial Sequence
  chemically synthesized
tctcacagaaaacacaaagcag

SEQ ID NO: 831620 - DNA, 22 bp, Artificial Sequence
  chemically synthesized
cttaaataatacactgctttgt

SEQ ID NO: 831621 - DNA, 22 bp, Artificial Sequence
  chemically synthesized
tcacagaaaacacaaagcagtg

SEQ ID NO: 831622 - DNA, 22 bp, Artificial Sequence
  chemically synthesized
acagaaaacacaaagcagtgta

SEQ ID NO: 831623 - DNA, 22 bp, Artificial Sequence
  chemically synthesized
agaaaactgcttaaataataca

SEQ ID NO: 831624 - DNA, 22 bp, Artificial Sequence
  chemically synthesized
gtgattcagaaaactgcttaaa

SEQ ID NO: 831625 - DNA, 22 bp, Artificial Sequence
  chemically synthesized
tttaagcagttttctgaatcac

SEQ ID NO: 831626 - DNA, 22 bp, Artificial Sequence
  chemically synthesized
gaaagtggtgttagtgattcag

SEQ ID NO: 831627 - DNA, 22 bp, Artificial Sequence
  chemically synthesized
aagcagttttctgaatcactaa

SEQ ID NO: 831628 - DNA, 22 bp, Artificial Sequence
  chemically synthesized
agcagttttctgaatcactaac

SEQ ID NO: 831629 - DNA, 22 bp, Artificial Sequence
  chemically synthesized
attggaaagtggtgttagtgat

SEQ ID NO: 831630 - DNA, 22 bp, Artificial Sequence
  chemically synthesized
cattggaaagtggtgttagtga

SEQ ID NO: 831631 - DNA, 22 bp, Artificial Sequence
  chemically synthesized
ttcattggaaagtggtgttagt

SEQ ID NO: 831632 - DNA, 22 bp, Artificial Sequence
  chemically synthesized
cttcattggaaagtggtgttag

SEQ ID NO: 831633 - DNA, 22 bp, Artificial Sequence
  chemically synthesized
tcttcattggaaagtggtgtta

SEQ ID NO: 831634 - DNA, 22 bp, Artificial Sequence
  chemically synthesized
ttcttcattggaaagtggtgtt

SEQ ID NO: 831635 - DNA, 22 bp, Artificial Sequence
  chemically synthesized
tctgaatcactaacaccacttt

SEQ ID NO: 831636 - DNA, 22 bp, Artificial Sequence
  chemically synthesized
tttcttcattggaaagtggtgt

SEQ ID NO: 831637 - DNA, 22 bp, Artificial Sequence
  chemically synthesized
ctgaatcactaacaccactttc

SEQ ID NO: 831638 - DNA, 22 bp, Artificial Sequence
  chemically synthesized
ttttcttcattggaaagtggtg

SEQ ID NO: 831639 - DNA, 22 bp, Artificial Sequence
  chemically synthesized
tgaatcactaacaccactttcc

SEQ ID NO: 831640 - DNA, 22 bp, Artificial Sequence
  chemically synthesized
aatcactaacaccactttccaa

SEQ ID NO: 831641 - DNA, 22 bp, Artificial Sequence
  chemically synthesized
acaccactttccaatgaagaaa

SEQ ID NO: 831642 - DNA, 22 bp, Artificial Sequence
  chemically synthesized
tccaatgaagaaaaaaatacca

SEQ ID NO: 831643 - DNA, 22 bp, Artificial Sequence
  chemically synthesized
ccaatgaagaaaaaaataccat

SEQ ID NO: 831644 - DNA, 22 bp, Artificial Sequence
  chemically synthesized
catatcccacagatggtatttt

SEQ ID NO: 831645 - DNA, 22 bp, Artificial Sequence
  chemically synthesized
caatgaagaaaaaaataccatc

SEQ ID NO: 831646 - DNA, 22 bp, Artificial Sequence
  chemically synthesized
ccatatcccacagatggtattt

SEQ ID NO: 831647 - DNA, 22 bp, Artificial Sequence
  chemically synthesized
aacttccatatcccacagatgg

SEQ ID NO: 831648 - DNA, 22 bp, Artificial Sequence
  chemically synthesized
aaacttccatatcccacagatg

SEQ ID NO: 831649 - DNA, 22 bp, Artificial Sequence
  chemically synthesized
taaacttccatatcccacagat

SEQ ID NO: 831650 - DNA, 22 bp, Artificial Sequence
  chemically synthesized
gtatctttaaacttccatatcc

SEQ ID NO: 831651 - DNA, 22 bp, Artificial Sequence
  chemically synthesized
agtatctttaaacttccatatc

SEQ ID NO: 831652 - DNA, 22 bp, Artificial Sequence
  chemically synthesized
tttagtatctttaaacttccat

SEQ ID NO: 831653 - DNA, 22 bp, Artificial Sequence
  chemically synthesized
tgtttagtatctttaaacttcc

SEQ ID NO: 831654 - DNA, 22 bp, Artificial Sequence
  chemically synthesized
tgggatatggaagtttaaagat

SEQ ID NO: 831655 - DNA, 22 bp, Artificial Sequence
  chemically synthesized
gtataagttctgtttagtatct

SEQ ID NO: 831656 - DNA, 22 bp, Artificial Sequence
  chemically synthesized
cactcgtataagttctgtttag

SEQ ID NO: 831657 - DNA, 22 bp, Artificial Sequence
  chemically synthesized
ccactcgtataagttctgttta

SEQ ID NO: 831658 - DNA, 22 bp, Artificial Sequence
  chemically synthesized
aaagatactaaacagaacttat

SEQ ID NO: 831659 - DNA, 22 bp, Artificial Sequence
  chemically synthesized
aagatactaaacagaacttata

SEQ ID NO: 831660 - DNA, 22 bp, Artificial Sequence
  chemically synthesized
ccatttccactcgtataagttc

SEQ ID NO: 831661 - DNA, 22 bp, Artificial Sequence
  chemically synthesized
gccatttccactcgtataagtt

SEQ ID NO: 831662 - DNA, 22 bp, Artificial Sequence
  chemically synthesized
tgccatttccactcgtataagt

SEQ ID NO: 831663 - DNA, 22 bp, Artificial Sequence
  chemically synthesized
aacagaacttatacgagtggaa

SEQ ID NO: 831664 - DNA, 22 bp, Artificial Sequence
  chemically synthesized
agcaaaacgttttgccatttcc

SEQ ID NO: 831665 - DNA, 22 bp, Artificial Sequence
  chemically synthesized
gagcaaaacgttttgccatttc

SEQ ID NO: 831666 - DNA, 22 bp, Artificial Sequence
  chemically synthesized
tgagcaaaacgttttgccattt

SEQ ID NO: 831667 - DNA, 22 bp, Artificial Sequence
  chemically synthesized
atacgagtggaaatggcaaaac

SEQ ID NO: 831668 - DNA, 22 bp, Artificial Sequence
  chemically synthesized
tacgagtggaaatggcaaaacg

SEQ ID NO: 831669 - DNA, 22 bp, Artificial Sequence
  chemically synthesized
tgactttgagcaaaacgttttg

SEQ ID NO: 831670 - DNA, 22 bp, Artificial Sequence
  chemically synthesized
catacacattgtgactttgagc

SEQ ID NO: 831671 - DNA, 22 bp, Artificial Sequence
  chemically synthesized
tccatacacattgtgactttga

SEQ ID NO: 831672 - DNA, 22 bp, Artificial Sequence
  chemically synthesized
ctctccatacacattgtgactt

SEQ ID NO: 831673 - DNA, 22 bp, Artificial Sequence
  chemically synthesized
tgctcaaagtcacaatgtgtat

SEQ ID NO: 831674 - DNA, 22 bp, Artificial Sequence
  chemically synthesized
caactcctctccatacacattg

SEQ ID NO: 831675 - DNA, 22 bp, Artificial Sequence
  chemically synthesized
gctcaaagtcacaatgtgtatg

SEQ ID NO: 831676 - DNA, 22 bp, Artificial Sequence
  chemically synthesized
ccaactcctctccatacacatt

SEQ ID NO: 831677 - DNA, 22 bp, Artificial Sequence
  chemically synthesized
ctcaaagtcacaatgtgtatgg

SEQ ID NO: 831678 - DNA, 22 bp, Artificial Sequence
  chemically synthesized
aaagtcacaatgtgtatggaga

SEQ ID NO: 831679 - DNA, 22 bp, Artificial Sequence
  chemically synthesized
catttccaactcctctccatac

SEQ ID NO: 831680 - DNA, 22 bp, Artificial Sequence
  chemically synthesized
aattccatttccaactcctctc

SEQ ID NO: 831681 - DNA, 22 bp, Artificial Sequence
  chemically synthesized
cctaaattccatttccaactcc

SEQ ID NO: 831682 - DNA, 22 bp, Artificial Sequence
  chemically synthesized
agagacctgcctaaattccatt

SEQ ID NO: 831683 - DNA, 22 bp, Artificial Sequence
  chemically synthesized
gaaaattaagagacctgcctaa

SEQ ID NO: 831684 - DNA, 22 bp, Artificial Sequence
  chemically synthesized
gaaatggaatttaggcaggtct

SEQ ID NO: 831685 - DNA, 22 bp, Artificial Sequence
  chemically synthesized
attagaaaattaagagacctgc

SEQ ID NO: 831686 - DNA, 22 bp, Artificial Sequence
  chemically synthesized
ttgattagaaaattaagagacc

SEQ ID NO: 831687 - DNA, 22 bp, Artificial Sequence
  chemically synthesized
aggcaggtctcttaattttcta

SEQ ID NO: 831688 - DNA, 22 bp, Artificial Sequence
  chemically synthesized
ggcaggtctcttaattttctaa

SEQ ID NO: 831689 - DNA, 22 bp, Artificial Sequence
  chemically synthesized
acagtctgttgattagaaaatt

SEQ ID NO: 831690 - DNA, 22 bp, Artificial Sequence
  chemically synthesized
gacagtctgttgattagaaaat

SEQ ID NO: 831691 - DNA, 22 bp, Artificial Sequence
  chemically synthesized
tgacagtctgttgattagaaaa

SEQ ID NO: 831692 - DNA, 22 bp, Artificial Sequence
  chemically synthesized
gtctttgacagtctgttgatta

SEQ ID NO: 831693 - DNA, 22 bp, Artificial Sequence
  chemically synthesized
ttaattttctaatcaacagact

SEQ ID NO: 831694 - DNA, 22 bp, Artificial Sequence
  chemically synthesized
aattttctaatcaacagactgt

SEQ ID NO: 831695 - DNA, 22 bp, Artificial Sequence
  chemically synthesized
attttctaatcaacagactgtc

SEQ ID NO: 831696 - DNA, 22 bp, Artificial Sequence
  chemically synthesized
tctaatcaacagactgtcaaag

SEQ ID NO: 831697 - DNA, 22 bp, Artificial Sequence
  chemically synthesized
ctaatcaacagactgtcaaaga

SEQ ID NO: 831698 - DNA, 22 bp, Artificial Sequence
  chemically synthesized
taatcaacagactgtcaaagac

SEQ ID NO: 831699 - DNA, 22 bp, Artificial Sequence
  chemically synthesized
aggaggtaatctggtctttgac

SEQ ID NO: 831700 - DNA, 22 bp, Artificial Sequence
  chemically synthesized
atcaacagactgtcaaagacca

SEQ ID NO: 831701 - DNA, 22 bp, Artificial Sequence
  chemically synthesized
aaggaggtaatctggtctttga

SEQ ID NO: 831702 - DNA, 22 bp, Artificial Sequence
  chemically synthesized
taaggaggtaatctggtctttg

SEQ ID NO: 831703 - DNA, 22 bp, Artificial Sequence
  chemically synthesized
ttaaggaggtaatctggtcttt

SEQ ID NO: 831704 - DNA, 22 bp, Artificial Sequence
  chemically synthesized
agcatacttttaaggaggtaat

SEQ ID NO: 831705 - DNA, 22 bp, Artificial Sequence
  chemically synthesized
tcaaagaccagattacctcctt

SEQ ID NO: 831706 - DNA, 22 bp, Artificial Sequence
  chemically synthesized
gaatattcagcatacttttaag

SEQ ID NO: 831707 - DNA, 22 bp, Artificial Sequence
  chemically synthesized
ttagaatattcagcatactttt

SEQ ID NO: 831708 - DNA, 22 bp, Artificial Sequence
  chemically synthesized
tattagaatattcagcatactt

SEQ ID NO: 831709 - DNA, 22 bp, Artificial Sequence
  chemically synthesized
tctattagaatattcagcatac

SEQ ID NO: 831710 - DNA, 22 bp, Artificial Sequence
  chemically synthesized
cctccttaaaagtatgctgaat

SEQ ID NO: 831711 - DNA, 22 bp, Artificial Sequence
  chemically synthesized
ctctattagaatattcagcata

SEQ ID NO: 831712 - DNA, 22 bp, Artificial Sequence
  chemically synthesized
tctctattagaatattcagcat

SEQ ID NO: 831713 - DNA, 22 bp, Artificial Sequence
  chemically synthesized
cttaaaagtatgctgaatattc

SEQ ID NO: 831714 - DNA, 22 bp, Artificial Sequence
  chemically synthesized
attttctctattagaatattca

SEQ ID NO: 831715 - DNA, 22 bp, Artificial Sequence
  chemically synthesized
aaaagtatgctgaatattctaa

SEQ ID NO: 831716 - DNA, 22 bp, Artificial Sequence
  chemically synthesized
aaagtatgctgaatattctaat

SEQ ID NO: 831717 - DNA, 22 bp, Artificial Sequence
  chemically synthesized
actcattttctctattagaata

SEQ ID NO: 831718 - DNA, 22 bp, Artificial Sequence
  chemically synthesized
gaaggttaactcattttctcta

SEQ ID NO: 831719 - DNA, 22 bp, Artificial Sequence
  chemically synthesized
agaaggttaactcattttctct

SEQ ID NO: 831720 - DNA, 22 bp, Artificial Sequence
  chemically synthesized
aatattctaatagagaaaatga

SEQ ID NO: 831721 - DNA, 22 bp, Artificial Sequence
  chemically synthesized
tagaaggttaactcattttctc

SEQ ID NO: 831722 - DNA, 22 bp, Artificial Sequence
  chemically synthesized
tttagaaggttaactcattttc

SEQ ID NO: 831723 - DNA, 22 bp, Artificial Sequence
  chemically synthesized
ctttagaaggttaactcatttt

SEQ ID NO: 831724 - DNA, 22 bp, Artificial Sequence
  chemically synthesized
tctttagaaggttaactcattt

SEQ ID NO: 831725 - DNA, 22 bp, Artificial Sequence
  chemically synthesized
taatagagaaaatgagttaacc

SEQ ID NO: 831726 - DNA, 22 bp, Artificial Sequence
  chemically synthesized
atagagaaaatgagttaacctt

SEQ ID NO: 831727 - DNA, 22 bp, Artificial Sequence
  chemically synthesized
ccaaaacaggagaatgagcttt

SEQ ID NO: 831728 - DNA, 22 bp, Artificial Sequence
  chemically synthesized
accttctaaagaaagctcattc

SEQ ID NO: 831729 - DNA, 22 bp, Artificial Sequence
  chemically synthesized
ttaccaaaacaggagaatgagc

SEQ ID NO: 831730 - DNA, 22 bp, Artificial Sequence
  chemically synthesized
attaccaaaacaggagaatgag

SEQ ID NO: 831731 - DNA, 22 bp, Artificial Sequence
  chemically synthesized
tattaccaaaacaggagaatga

SEQ ID NO: 831732 - DNA, 22 bp, Artificial Sequence
  chemically synthesized
ctaaagaaagctcattctcctg

SEQ ID NO: 831733 - DNA, 22 bp, Artificial Sequence
  chemically synthesized
taaagaaagctcattctcctgt

SEQ ID NO: 831734 - DNA, 22 bp, Artificial Sequence
  chemically synthesized
aagaaagctcattctcctgttt

SEQ ID NO: 831735 - DNA, 22 bp, Artificial Sequence
  chemically synthesized
tgttttattaccaaaacaggag

SEQ ID NO: 831736 - DNA, 22 bp, Artificial Sequence
  chemically synthesized
cctatgttttattaccaaaaca

SEQ ID NO: 831737 - DNA, 22 bp, Artificial Sequence
  chemically synthesized
ccctatgttttattaccaaaac

SEQ ID NO: 831738 - DNA, 22 bp, Artificial Sequence
  chemically synthesized
attctcctgttttggtaataaa

SEQ ID NO: 831739 - DNA, 22 bp, Artificial Sequence
  chemically synthesized
tcctgttttggtaataaaacat

SEQ ID NO: 831740 - DNA, 22 bp, Artificial Sequence
  chemically synthesized
ctgttttggtaataaaacatag

SEQ ID NO: 831741 - DNA, 22 bp, Artificial Sequence
  chemically synthesized
ttttggtaataaaacataggga

SEQ ID NO: 831742 - DNA, 22 bp, Artificial Sequence
  chemically synthesized
tggtaataaaacatagggaagt

SEQ ID NO: 831743 - DNA, 22 bp, Artificial Sequence
  chemically synthesized
ggtaataaaacatagggaagta

SEQ ID NO: 831744 - DNA, 22 bp, Artificial Sequence
  chemically synthesized
gtaataaaacatagggaagtat

SEQ ID NO: 831745 - DNA, 22 bp, Artificial Sequence
  chemically synthesized
cgtatgggaagcaatacatact

SEQ ID NO: 831746 - DNA, 22 bp, Artificial Sequence
  chemically synthesized
ccgtatgggaagcaatacatac

SEQ ID NO: 831747 - DNA, 22 bp, Artificial Sequence
  chemically synthesized
tccgtatgggaagcaatacata

SEQ ID NO: 831748 - DNA, 22 bp, Artificial Sequence
  chemically synthesized
atctttccgtatgggaagcaat

SEQ ID NO: 831749 - DNA, 22 bp, Artificial Sequence
  chemically synthesized
acccagctcatctttccgtatg

SEQ ID NO: 831750 - DNA, 22 bp, Artificial Sequence
  chemically synthesized
tcacccagctcatctttccgta

SEQ ID NO: 831751 - DNA, 22 bp, Artificial Sequence
  chemically synthesized
ctctcacccagctcatctttcc

SEQ ID NO: 831752 - DNA, 22 bp, Artificial Sequence
  chemically synthesized
cttcccatacggaaagatgagc

SEQ ID NO: 831753 - DNA, 22 bp, Artificial Sequence
  chemically synthesized
cccatacggaaagatgagctgg

SEQ ID NO: 831754 - DNA, 22 bp, Artificial Sequence
  chemically synthesized
ccatacggaaagatgagctggg

SEQ ID NO: 831755 - DNA, 22 bp, Artificial Sequence
  chemically synthesized
ggtgagaggaggattgggtttt

SEQ ID NO: 831756 - DNA, 22 bp, Artificial Sequence
  chemically synthesized
caaccagtggtaaaaacccaat

SEQ ID NO: 831757 - DNA, 22 bp, Artificial Sequence
  chemically synthesized
tcctccaaccagtggtaaaaac

SEQ ID NO: 831758 - DNA, 22 bp, Artificial Sequence
  chemically synthesized
ttatcctccaaccagtggtaaa

SEQ ID NO: 831759 - DNA, 22 bp, Artificial Sequence
  chemically synthesized
ggtttttaccactggttggagg

SEQ ID NO: 831760 - DNA, 22 bp, Artificial Sequence
  chemically synthesized
ataatctattatcctccaacca

SEQ ID NO: 831761 - DNA, 22 bp, Artificial Sequence
  chemically synthesized
cataatctattatcctccaacc

SEQ ID NO: 831762 - DNA, 22 bp, Artificial Sequence
  chemically synthesized
tcataatctattatcctccaac

SEQ ID NO: 831763 - DNA, 22 bp, Artificial Sequence
  chemically synthesized
ttcataatctattatcctccaa

SEQ ID NO: 831764 - DNA, 22 bp, Artificial Sequence
  chemically synthesized
tttcataatctattatcctcca

SEQ ID NO: 831765 - DNA, 22 bp, Artificial Sequence
  chemically synthesized
ttaccactggttggaggataat

SEQ ID NO: 831766 - DNA, 22 bp, Artificial Sequence
  chemically synthesized
taccactggttggaggataata

SEQ ID NO: 831767 - DNA, 22 bp, Artificial Sequence
  chemically synthesized
accactggttggaggataatag

SEQ ID NO: 831768 - DNA, 22 bp, Artificial Sequence
  chemically synthesized
ccactggttggaggataataga

SEQ ID NO: 831769 - DNA, 22 bp, Artificial Sequence
  chemically synthesized
atattttttcataatctattat

SEQ ID NO: 831770 - DNA, 22 bp, Artificial Sequence
  chemically synthesized
gttggaggataatagattatga

SEQ ID NO: 831771 - DNA, 22 bp, Artificial Sequence
  chemically synthesized
gatgttgatattttttcataat

SEQ ID NO: 831772 - DNA, 22 bp, Artificial Sequence
  chemically synthesized
gaggataatagattatgaaaaa

SEQ ID NO: 831773 - DNA, 22 bp, Artificial Sequence
  chemically synthesized
tgactggatgttgatatttttt

SEQ ID NO: 831774 - DNA, 22 bp, Artificial Sequence
  chemically synthesized
attatgactggatgttgatatt

SEQ ID NO: 831775 - DNA, 22 bp, Artificial Sequence
  chemically synthesized
cattatgactggatgttgatat

SEQ ID NO: 831776 - DNA, 22 bp, Artificial Sequence
  chemically synthesized
tgaaaaaatatcaacatccagt

SEQ ID NO: 831777 - DNA, 22 bp, Artificial Sequence
  chemically synthesized
catgtttcattatgactggatg

SEQ ID NO: 831778 - DNA, 22 bp, Artificial Sequence
  chemically synthesized
acatgtttcattatgactggat

SEQ ID NO: 831779 - DNA, 22 bp, Artificial Sequence
  chemically synthesized
ataaaacaacttacatgtttca

SEQ ID NO: 831780 - DNA, 22 bp, Artificial Sequence
  chemically synthesized
attaataaaacaacttacatgt

SEQ ID NO: 831781 - DNA, 22 bp, Artificial Sequence
  chemically synthesized
aattaataaaacaacttacatg

SEQ ID NO: 831782 - DNA, 22 bp, Artificial Sequence
  chemically synthesized
tttaattaataaaacaacttac

SEQ ID NO: 831783 - DNA, 22 bp, Artificial Sequence
  chemically synthesized
acctatttaattaataaaacaa

SEQ ID NO: 831784 - DNA, 22 bp, Artificial Sequence
  chemically synthesized
agcattcacctatttaattaat

SEQ ID NO: 831785 - DNA, 22 bp, Artificial Sequence
  chemically synthesized
cagcattcacctatttaattaa

SEQ ID NO: 831786 - DNA, 22 bp, Artificial Sequence
  chemically synthesized
ttttattaattaaataggtgaa

SEQ ID NO: 831787 - DNA, 22 bp, Artificial Sequence
  chemically synthesized
tattaattaaataggtgaatgc

SEQ ID NO: 831788 - DNA, 22 bp, Artificial Sequence
  chemically synthesized
attaattaaataggtgaatgct

SEQ ID NO: 831789 - DNA, 22 bp, Artificial Sequence
  chemically synthesized
ttaattaaataggtgaatgctg

SEQ ID NO: 831790 - DNA, 22 bp, Artificial Sequence
  chemically synthesized
attaaataggtgaatgctgaaa

SEQ ID NO: 831791 - DNA, 22 bp, Artificial Sequence
  chemically synthesized
aataggtgaatgctgaaatgtg

SEQ ID NO: 831792 - DNA, 22 bp, Artificial Sequence
  chemically synthesized
atgtgatcaaataatatcacat

SEQ ID NO: 831793 - DNA, 22 bp, Artificial Sequence
  chemically synthesized
aatgtgatcaaataatatcaca

SEQ ID NO: 831794 - DNA, 22 bp, Artificial Sequence
  chemically synthesized
taatgtgatcaaataatatcac

SEQ ID NO: 831795 - DNA, 22 bp, Artificial Sequence
  chemically synthesized
attttaatgtgatcaaataata

SEQ ID NO: 831796 - DNA, 22 bp, Artificial Sequence
  chemically synthesized
ttcattttaatgtgatcaaata

SEQ ID NO: 831797 - DNA, 22 bp, Artificial Sequence
  chemically synthesized
aaatgtgatattatttgatcac

SEQ ID NO: 831798 - DNA, 22 bp, Artificial Sequence
  chemically synthesized
aaaaaattattcattttaatgt

SEQ ID NO: 831799 - DNA, 22 bp, Artificial Sequence
  chemically synthesized
aaaaaaattattcattttaatg

SEQ ID NO: 831800 - DNA, 22 bp, Artificial Sequence
  chemically synthesized
taaaaaaattattcattttaat

SEQ ID NO: 831801 - DNA, 22 bp, Artificial Sequence
  chemically synthesized
ttaaaaaaattattcattttaa

SEQ ID NO: 831802 - DNA, 22 bp, Artificial Sequence
  chemically synthesized
tttgatcacattaaaatgaata

SEQ ID NO: 831803 - DNA, 22 bp, Artificial Sequence
  chemically synthesized
gatcacattaaaatgaataatt

SEQ ID NO: 831804 - DNA, 22 bp, Artificial Sequence
  chemically synthesized
tgtttttaaaaaaattattcat

SEQ ID NO: 831805 - DNA, 22 bp, Artificial Sequence
  chemically synthesized
atcacattaaaatgaataattt

SEQ ID NO: 831806 - DNA, 22 bp, Artificial Sequence
  chemically synthesized
aaatgaataatttttttaaaaa

SEQ ID NO: 831807 - DNA, 22 bp, Artificial Sequence
  chemically synthesized
ttttaaaaacataatgacttct

SEQ ID NO: 831808 - DNA, 22 bp, Artificial Sequence
  chemically synthesized
tttaaaaacataatgacttctc

SEQ ID NO: 831809 - DNA, 22 bp, Artificial Sequence
  chemically synthesized
ttaaaaacataatgacttctct

SEQ ID NO: 831810 - DNA, 22 bp, Artificial Sequence
  chemically synthesized
taaaaacataatgacttctctt

SEQ ID NO: 831811 - DNA, 22 bp, Artificial Sequence
  chemically synthesized
caacacccccaaaagagaagtc

SEQ ID NO: 831812 - DNA, 22 bp, Artificial Sequence
  chemically synthesized
aaaaacataatgacttctcttt

SEQ ID NO: 831813 - DNA, 22 bp, Artificial Sequence
  chemically synthesized
ccaacacccccaaaagagaagt

SEQ ID NO: 831814 - DNA, 22 bp, Artificial Sequence
  chemically synthesized
aaaacataatgacttctctttt

SEQ ID NO: 831815 - DNA, 22 bp, Artificial Sequence
  chemically synthesized
agcaatagtttccaacaccccc

SEQ ID NO: 831816 - DNA, 22 bp, Artificial Sequence
  chemically synthesized
aagcaatagtttccaacacccc

SEQ ID NO: 831817 - DNA, 22 bp, Artificial Sequence
  chemically synthesized
ctcttttgggggtgttggaaac

SEQ ID NO: 831818 - DNA, 22 bp, Artificial Sequence
  chemically synthesized
tcttttgggggtgttggaaact

SEQ ID NO: 831819 - DNA, 22 bp, Artificial Sequence
  chemically synthesized
atcttaagcaatagtttccaac

SEQ ID NO: 831820 - DNA, 22 bp, Artificial Sequence
  chemically synthesized
catcttaagcaatagtttccaa

SEQ ID NO: 831821 - DNA, 22 bp, Artificial Sequence
  chemically synthesized
ttttgggggtgttggaaactat

SEQ ID NO: 831822 - DNA, 22 bp, Artificial Sequence
  chemically synthesized
tcatcttaagcaatagtttcca

SEQ ID NO: 831823 - DNA, 22 bp, Artificial Sequence
  chemically synthesized
ttgggggtgttggaaactattg

SEQ ID NO: 831824 - DNA, 22 bp, Artificial Sequence
  chemically synthesized
tgggggtgttggaaactattgc

SEQ ID NO: 831825 - DNA, 22 bp, Artificial Sequence
  chemically synthesized
gggggtgttggaaactattgct

SEQ ID NO: 831826 - DNA, 22 bp, Artificial Sequence
  chemically synthesized
ggggtgttggaaactattgctt

SEQ ID NO: 831827 - DNA, 22 bp, Artificial Sequence
  chemically synthesized
aggctttcatcttaagcaatag

SEQ ID NO: 831828 - DNA, 22 bp, Artificial Sequence
  chemically synthesized
caggctttcatcttaagcaata

SEQ ID NO: 831829 - DNA, 22 bp, Artificial Sequence
  chemically synthesized
acttcaggctttcatcttaagc

SEQ ID NO: 831830 - DNA, 22 bp, Artificial Sequence
  chemically synthesized
gaaactattgcttaagatgaaa

SEQ ID NO: 831831 - DNA, 22 bp, Artificial Sequence
  chemically synthesized
ctaacttcaggctttcatctta

SEQ ID NO: 831832 - DNA, 22 bp, Artificial Sequence
  chemically synthesized
tcctaacttcaggctttcatct

SEQ ID NO: 831833 - DNA, 22 bp, Artificial Sequence
  chemically synthesized
ctcctaacttcaggctttcatc

SEQ ID NO: 831834 - DNA, 22 bp, Artificial Sequence
  chemically synthesized
tctcctaacttcaggctttcat

SEQ ID NO: 831835 - DNA, 22 bp, Artificial Sequence
  chemically synthesized
ttctcctaacttcaggctttca

SEQ ID NO: 831836 - DNA, 22 bp, Artificial Sequence
  chemically synthesized
ttgcttaagatgaaagcctgaa

SEQ ID NO: 831837 - DNA, 22 bp, Artificial Sequence
  chemically synthesized
cttaagatgaaagcctgaagtt

SEQ ID NO: 831838 - DNA, 22 bp, Artificial Sequence
  chemically synthesized
aagatgaaagcctgaagttagg

SEQ ID NO: 831839 - DNA, 22 bp, Artificial Sequence
  chemically synthesized
agatgaaagcctgaagttagga

SEQ ID NO: 831840 - DNA, 22 bp, Artificial Sequence
  chemically synthesized
catagatatacatcaagctttt

SEQ ID NO: 831841 - DNA, 22 bp, Artificial Sequence
  chemically synthesized
gcatagatatacatcaagcttt

SEQ ID NO: 831842 - DNA, 22 bp, Artificial Sequence
  chemically synthesized
aagttaggagaaaagcttgatg

SEQ ID NO: 831843 - DNA, 22 bp, Artificial Sequence
  chemically synthesized
tgcatagatatacatcaagctt

SEQ ID NO: 831844 - DNA, 22 bp, Artificial Sequence
  chemically synthesized
ttgcatagatatacatcaagct

SEQ ID NO: 831845 - DNA, 22 bp, Artificial Sequence
  chemically synthesized
ggagaaaagcttgatgtatatc

SEQ ID NO: 831846 - DNA, 22 bp, Artificial Sequence
  chemically synthesized
aaatatttttgcatagatatac

SEQ ID NO: 831847 - DNA, 22 bp, Artificial Sequence
  chemically synthesized
gatgtatatctatgcaaaaata

SEQ ID NO: 831848 - DNA, 22 bp, Artificial Sequence
  chemically synthesized
atgtatatctatgcaaaaatat

SEQ ID NO: 831849 - DNA, 22 bp, Artificial Sequence
  chemically synthesized
agatgataaactgaaatatttt

SEQ ID NO: 831850 - DNA, 22 bp, Artificial Sequence
  chemically synthesized
tgcaaaaatatttcagtttatc

SEQ ID NO: 831851 - DNA, 22 bp, Artificial Sequence
  chemically synthesized
taagtgacctaagatgataaac

SEQ ID NO: 831852 - DNA, 22 bp, Artificial Sequence
  chemically synthesized
gtaagtgacctaagatgataaa

SEQ ID NO: 831853 - DNA, 22 bp, Artificial Sequence
  chemically synthesized
tgacttgtaagtgacctaagat

SEQ ID NO: 831854 - DNA, 22 bp, Artificial Sequence
  chemically synthesized
tgtgacttgtaagtgacctaag

SEQ ID NO: 831855 - DNA, 22 bp, Artificial Sequence
  chemically synthesized
cagtttatcatcttaggtcact

SEQ ID NO: 831856 - DNA, 22 bp, Artificial Sequence
  chemically synthesized
ctgtgacttgtaagtgacctaa

SEQ ID NO: 831857 - DNA, 22 bp, Artificial Sequence
  chemically synthesized
agtttatcatcttaggtcactt

SEQ ID NO: 831858 - DNA, 22 bp, Artificial Sequence
  chemically synthesized
tctgtgacttgtaagtgaccta

SEQ ID NO: 831859 - DNA, 22 bp, Artificial Sequence
  chemically synthesized
ttctgtgacttgtaagtgacct

SEQ ID NO: 831860 - DNA, 22 bp, Artificial Sequence
  chemically synthesized
ttttctgtgacttgtaagtgac

SEQ ID NO: 831861 - DNA, 22 bp, Artificial Sequence
  chemically synthesized
cttttctgtgacttgtaagtga

SEQ ID NO: 831862 - DNA, 22 bp, Artificial Sequence
  chemically synthesized
atcatcttaggtcacttacaag

SEQ ID NO: 831863 - DNA, 22 bp, Artificial Sequence
  chemically synthesized
tcatcttaggtcacttacaagt

SEQ ID NO: 831864 - DNA, 22 bp, Artificial Sequence
  chemically synthesized
gatagtttcttttctgtgactt

SEQ ID NO: 831865 - DNA, 22 bp, Artificial Sequence
  chemically synthesized
aggtcacttacaagtcacagaa

SEQ ID NO: 831866 - DNA, 22 bp, Artificial Sequence
  chemically synthesized
ggtcacttacaagtcacagaaa

SEQ ID NO: 831867 - DNA, 22 bp, Artificial Sequence
  chemically synthesized
tcacatctagatagtttctttt

SEQ ID NO: 831868 - DNA, 22 bp, Artificial Sequence
  chemically synthesized
acaagtcacagaaaagaaacta

SEQ ID NO: 831869 - DNA, 22 bp, Artificial Sequence
  chemically synthesized
caagtcacagaaaagaaactat

SEQ ID NO: 831870 - DNA, 22 bp, Artificial Sequence
  chemically synthesized
ttatcacatctagatagtttct

SEQ ID NO: 831871 - DNA, 22 bp, Artificial Sequence
  chemically synthesized
ggcctattatcacatctagata

SEQ ID NO: 831872 - DNA, 22 bp, Artificial Sequence
  chemically synthesized
atgatatgttaggcctattatc

SEQ ID NO: 831873 - DNA, 22 bp, Artificial Sequence
  chemically synthesized
tctagatgtgataataggccta

SEQ ID NO: 831874 - DNA, 22 bp, Artificial Sequence
  chemically synthesized
gatgtgataataggcctaacat

SEQ ID NO: 831875 - DNA, 22 bp, Artificial Sequence
  chemically synthesized
gaccgatggatcatctaatgat

SEQ ID NO: 831876 - DNA, 22 bp, Artificial Sequence
  chemically synthesized
acatatcattagatgatccatc

SEQ ID NO: 831877 - DNA, 22 bp, Artificial Sequence
  chemically synthesized
agatgctggaccgatggatcat

SEQ ID NO: 831878 - DNA, 22 bp, Artificial Sequence
  chemically synthesized
atgactgagatgctggaccgat

SEQ ID NO: 831879 - DNA, 22 bp, Artificial Sequence
  chemically synthesized
gatgatccatcggtccagcatc

SEQ ID NO: 831880 - DNA, 22 bp, Artificial Sequence
  chemically synthesized
gttaatgactgagatgctggac

SEQ ID NO: 831881 - DNA, 22 bp, Artificial Sequence
  chemically synthesized
attagttaatgactgagatgct

SEQ ID NO: 831882 - DNA, 22 bp, Artificial Sequence
  chemically synthesized
aattagttaatgactgagatgc

SEQ ID NO: 831883 - DNA, 22 bp, Artificial Sequence
  chemically synthesized
gcacttaattagttaatgactg

SEQ ID NO: 831884 - DNA, 22 bp, Artificial Sequence
  chemically synthesized
ggcacttaattagttaatgact

SEQ ID NO: 831885 - DNA, 22 bp, Artificial Sequence
  chemically synthesized
catttggcacttaattagttaa

SEQ ID NO: 831886 - DNA, 22 bp, Artificial Sequence
  chemically synthesized
ctacatttggcacttaattagt

SEQ ID NO: 831887 - DNA, 22 bp, Artificial Sequence
  chemically synthesized
gctacatttggcacttaattag

SEQ ID NO: 831888 - DNA, 22 bp, Artificial Sequence
  chemically synthesized
agtcattaactaattaagtgcc

SEQ ID NO: 831889 - DNA, 22 bp, Artificial Sequence
  chemically synthesized
tttgctacatttggcacttaat

SEQ ID NO: 831890 - DNA, 22 bp, Artificial Sequence
  chemically synthesized
atttgctacatttggcacttaa

SEQ ID NO: 831891 - DNA, 22 bp, Artificial Sequence
  chemically synthesized
tatttgctacatttggcactta

SEQ ID NO: 831892 - DNA, 22 bp, Artificial Sequence
  chemically synthesized
actaattaagtgccaaatgtag

SEQ ID NO: 831893 - DNA, 22 bp, Artificial Sequence
  chemically synthesized
gtactttatttgctacatttgg

SEQ ID NO: 831894 - DNA, 22 bp, Artificial Sequence
  chemically synthesized
ttagtactttatttgctacatt

SEQ ID NO: 831895 - DNA, 22 bp, Artificial Sequence
  chemically synthesized
attaagtgccaaatgtagcaaa

SEQ ID NO: 831896 - DNA, 22 bp, Artificial Sequence
  chemically synthesized
agtgccaaatgtagcaaataaa

SEQ ID NO: 831897 - DNA, 22 bp, Artificial Sequence
  chemically synthesized
agttgttagtactttatttgct

SEQ ID NO: 831898 - DNA, 22 bp, Artificial Sequence
  chemically synthesized
gagttgttagtactttatttgc

SEQ ID NO: 831899 - DNA, 22 bp, Artificial Sequence
  chemically synthesized
tgagttgttagtactttatttg

SEQ ID NO: 831900 - DNA, 22 bp, Artificial Sequence
  chemically synthesized
ttgagttgttagtactttattt

SEQ ID NO: 831901 - DNA, 22 bp, Artificial Sequence
  chemically synthesized
aacacttttgagttgttagtac

SEQ ID NO: 831902 - DNA, 22 bp, Artificial Sequence
  chemically synthesized
ctgaacacttttgagttgttag

SEQ ID NO: 831903 - DNA, 22 bp, Artificial Sequence
  chemically synthesized
gctgaacacttttgagttgtta

SEQ ID NO: 831904 - DNA, 22 bp, Artificial Sequence
  chemically synthesized
ttgctgaacacttttgagttgt

SEQ ID NO: 831905 - DNA, 22 bp, Artificial Sequence
  chemically synthesized
atgaactcttgctgaacacttt

SEQ ID NO: 831906 - DNA, 22 bp, Artificial Sequence
  chemically synthesized
aatgaactcttgctgaacactt

SEQ ID NO: 831907 - DNA, 22 bp, Artificial Sequence
  chemically synthesized
taatgaactcttgctgaacact

SEQ ID NO: 831908 - DNA, 22 bp, Artificial Sequence
  chemically synthesized
acaactcaaaagtgttcagcaa

SEQ ID NO: 831909 - DNA, 22 bp, Artificial Sequence
  chemically synthesized
gctttaatgaactcttgctgaa

SEQ ID NO: 831910 - DNA, 22 bp, Artificial Sequence
  chemically synthesized
cgctttaatgaactcttgctga

SEQ ID NO: 831911 - DNA, 22 bp, Artificial Sequence
  chemically synthesized
aaaagtgttcagcaagagttca

SEQ ID NO: 831912 - DNA, 22 bp, Artificial Sequence
  chemically synthesized
gcttcgctttaatgaactcttg

SEQ ID NO: 831913 - DNA, 22 bp, Artificial Sequence
  chemically synthesized
agcttcgctttaatgaactctt

SEQ ID NO: 831914 - DNA, 22 bp, Artificial Sequence
  chemically synthesized
tagcttcgctttaatgaactct

SEQ ID NO: 831915 - DNA, 22 bp, Artificial Sequence
  chemically synthesized
agcaagagttcattaaagcgaa

SEQ ID NO: 831916 - DNA, 22 bp, Artificial Sequence
  chemically synthesized
taatggtcccctttagcttcgc

SEQ ID NO: 831917 - DNA, 22 bp, Artificial Sequence
  chemically synthesized
attaaagcgaagctaaagggga

SEQ ID NO: 831918 - DNA, 22 bp, Artificial Sequence
  chemically synthesized
gaattataatggtcccctttag

SEQ ID NO: 831919 - DNA, 22 bp, Artificial Sequence
  chemically synthesized
aagcgaagctaaaggggaccat

SEQ ID NO: 831920 - DNA, 22 bp, Artificial Sequence
  chemically synthesized
tggtgctagaattataatggtc

SEQ ID NO: 831921 - DNA, 22 bp, Artificial Sequence
  chemically synthesized
aaggggaccattataattctag

SEQ ID NO: 831922 - DNA, 22 bp, Artificial Sequence
  chemically synthesized
taattctagcaccacagattta

SEQ ID NO: 831923 - DNA, 22 bp, Artificial Sequence
  chemically synthesized
gtgacatggtaataaatctgtg

SEQ ID NO: 831924 - DNA, 22 bp, Artificial Sequence
  chemically synthesized
tagcaccacagatttattacca

SEQ ID NO: 831925 - DNA, 22 bp, Artificial Sequence
  chemically synthesized
catgctggtgacatggtaataa

SEQ ID NO: 831926 - DNA, 22 bp, Artificial Sequence
  chemically synthesized
gcaccacagatttattaccatg

SEQ ID NO: 831927 - DNA, 22 bp, Artificial Sequence
  chemically synthesized
tgtgcattgcatgctggtgaca

SEQ ID NO: 831928 - DNA, 22 bp, Artificial Sequence
  chemically synthesized
ttgtgtgcattgcatgctggtg

SEQ ID NO: 831929 - DNA, 22 bp, Artificial Sequence
  chemically synthesized
attgtgtgcattgcatgctggt

SEQ ID NO: 831930 - DNA, 22 bp, Artificial Sequence
  chemically synthesized
attaccatgtcaccagcatgca

SEQ ID NO: 831931 - DNA, 22 bp, Artificial Sequence
  chemically synthesized
tattgtgtgcattgcatgctgg

SEQ ID NO: 831932 - DNA, 22 bp, Artificial Sequence
  chemically synthesized
ttaccatgtcaccagcatgcaa

SEQ ID NO: 831933 - DNA, 22 bp, Artificial Sequence
  chemically synthesized
ccatgtcaccagcatgcaatgc

SEQ ID NO: 831934 - DNA, 22 bp, Artificial Sequence
  chemically synthesized
cagtgatgaatgagttttattg

SEQ ID NO: 831935 - DNA, 22 bp, Artificial Sequence
  chemically synthesized
acagtgatgaatgagttttatt

SEQ ID NO: 831936 - DNA, 22 bp, Artificial Sequence
  chemically synthesized
atgtgcaaatttacagtgatga

SEQ ID NO: 831937 - DNA, 22 bp, Artificial Sequence
  chemically synthesized
gatgtgcaaatttacagtgatg

SEQ ID NO: 831938 - DNA, 22 bp, Artificial Sequence
  chemically synthesized
attcatcactgtaaatttgcac

SEQ ID NO: 831939 - DNA, 22 bp, Artificial Sequence
  chemically synthesized
atcactgtaaatttgcacatca

SEQ ID NO: 831940 - DNA, 22 bp, Artificial Sequence
  chemically synthesized
caacaaatgcatcaaatttgat

SEQ ID NO: 831941 - DNA, 22 bp, Artificial Sequence
  chemically synthesized
taaatttgcacatcaaatttga

SEQ ID NO: 831942 - DNA, 22 bp, Artificial Sequence
  chemically synthesized
tattccaacaaatgcatcaaat

SEQ ID NO: 831943 - DNA, 22 bp, Artificial Sequence
  chemically synthesized
atattccaacaaatgcatcaaa

SEQ ID NO: 831944 - DNA, 22 bp, Artificial Sequence
  chemically synthesized
gcacatcaaatttgatgcattt

SEQ ID NO: 831945 - DNA, 22 bp, Artificial Sequence
  chemically synthesized
cacatcaaatttgatgcatttg

SEQ ID NO: 831946 - DNA, 22 bp, Artificial Sequence
  chemically synthesized
aaaatatttatattccaacaaa

SEQ ID NO: 831947 - DNA, 22 bp, Artificial Sequence
  chemically synthesized
aaaaatatttatattccaacaa

SEQ ID NO: 831948 - DNA, 22 bp, Artificial Sequence
  chemically synthesized
taaaaatatttatattccaaca

SEQ ID NO: 831949 - DNA, 22 bp, Artificial Sequence
  chemically synthesized
gatgcatttgttggaatataaa

SEQ ID NO: 831950 - DNA, 22 bp, Artificial Sequence
  chemically synthesized
atgcatttgttggaatataaat

SEQ ID NO: 831951 - DNA, 22 bp, Artificial Sequence
  chemically synthesized
catgattttaaaaatatttata

SEQ ID NO: 831952 - DNA, 22 bp, Artificial Sequence
  chemically synthesized
tacatgattttaaaaatattta

SEQ ID NO: 831953 - DNA, 22 bp, Artificial Sequence
  chemically synthesized
gttggaatataaatatttttaa

SEQ ID NO: 831954 - DNA, 22 bp, Artificial Sequence
  chemically synthesized
ttctacatgattttaaaaatat

SEQ ID NO: 831955 - DNA, 22 bp, Artificial Sequence
  chemically synthesized
ttggaatataaatatttttaaa

SEQ ID NO: 831956 - DNA, 22 bp, Artificial Sequence
  chemically synthesized
attctacatgattttaaaaata

SEQ ID NO: 831957 - DNA, 22 bp, Artificial Sequence
  chemically synthesized
tattctacatgattttaaaaat

SEQ ID NO: 831958 - DNA, 22 bp, Artificial Sequence
  chemically synthesized
ttattctacatgattttaaaaa

SEQ ID NO: 831959 - DNA, 22 bp, Artificial Sequence
  chemically synthesized
gaatataaatatttttaaaatc

SEQ ID NO: 831960 - DNA, 22 bp, Artificial Sequence
  chemically synthesized
tttattctacatgattttaaaa

SEQ ID NO: 831961 - DNA, 22 bp, Artificial Sequence
  chemically synthesized
ttaaaatcatgtagaataaaaa

SEQ ID NO: 831962 - DNA, 22 bp, Artificial Sequence
  chemically synthesized
taaaatcatgtagaataaaaag

SEQ ID NO: 831963 - DNA, 22 bp, Artificial Sequence
  chemically synthesized
aaaatcatgtagaataaaaagc

SEQ ID NO: 831964 - DNA, 22 bp, Artificial Sequence
  chemically synthesized
aaatcatgtagaataaaaagca

SEQ ID NO: 831965 - DNA, 22 bp, Artificial Sequence
  chemically synthesized
agggagaaaaaaatgcttttta

SEQ ID NO: 831966 - DNA, 22 bp, Artificial Sequence
  chemically synthesized
agtgtgtgctaagggagaaaaa

SEQ ID NO: 831967 - DNA, 22 bp, Artificial Sequence
  chemically synthesized
ttttctcccttagcacacactg

SEQ ID NO: 831968 - DNA, 22 bp, Artificial Sequence
  chemically synthesized
tttctcccttagcacacactga

SEQ ID NO: 831969 - DNA, 22 bp, Artificial Sequence
  chemically synthesized
ttctcccttagcacacactgaa

SEQ ID NO: 831970 - DNA, 22 bp, Artificial Sequence
  chemically synthesized
tctcccttagcacacactgaat

SEQ ID NO: 831971 - DNA, 22 bp, Artificial Sequence
  chemically synthesized
ctcccttagcacacactgaatt

SEQ ID NO: 831972 - DNA, 22 bp, Artificial Sequence
  chemically synthesized
tcccttagcacacactgaattt

SEQ ID NO: 831973 - DNA, 22 bp, Artificial Sequence
  chemically synthesized
ccttagcacacactgaatttca

SEQ ID NO: 831974 - DNA, 22 bp, Artificial Sequence
  chemically synthesized
agcacacactgaatttcatatc

SEQ ID NO: 831975 - DNA, 22 bp, Artificial Sequence
  chemically synthesized
gcacacactgaatttcatatct

SEQ ID NO: 831976 - DNA, 22 bp, Artificial Sequence
  chemically synthesized
aagtggcaaggtgtagatatga

SEQ ID NO: 831977 - DNA, 22 bp, Artificial Sequence
  chemically synthesized
aatttcatatctacaccttgcc

SEQ ID NO: 831978 - DNA, 22 bp, Artificial Sequence
  chemically synthesized
catatctacaccttgccacttc

SEQ ID NO: 831979 - DNA, 22 bp, Artificial Sequence
  chemically synthesized
atatctacaccttgccacttca

SEQ ID NO: 831980 - DNA, 22 bp, Artificial Sequence
  chemically synthesized
atcaagtaaaagttgaagtggc

SEQ ID NO: 831981 - DNA, 22 bp, Artificial Sequence
  chemically synthesized
cactcatcaagtaaaagttgaa

SEQ ID NO: 831982 - DNA, 22 bp, Artificial Sequence
  chemically synthesized
caccttgccacttcaactttta

SEQ ID NO: 831983 - DNA, 22 bp, Artificial Sequence
  chemically synthesized
tgcactcatcaagtaaaagttg

SEQ ID NO: 831984 - DNA, 22 bp, Artificial Sequence
  chemically synthesized
ctgcactcatcaagtaaaagtt

SEQ ID NO: 831985 - DNA, 22 bp, Artificial Sequence
  chemically synthesized
tctgcactcatcaagtaaaagt

SEQ ID NO: 831986 - DNA, 22 bp, Artificial Sequence
  chemically synthesized
gccacttcaacttttacttgat

SEQ ID NO: 831987 - DNA, 22 bp, Artificial Sequence
  chemically synthesized
ccacttcaacttttacttgatg

SEQ ID NO: 831988 - DNA, 22 bp, Artificial Sequence
  chemically synthesized
cgttttctgcactcatcaagta

SEQ ID NO: 831989 - DNA, 22 bp, Artificial Sequence
  chemically synthesized
ccgttttctgcactcatcaagt

SEQ ID NO: 831990 - DNA, 22 bp, Artificial Sequence
  chemically synthesized
caacttttacttgatgagtgca

SEQ ID NO: 831991 - DNA, 22 bp, Artificial Sequence
  chemically synthesized
atttccgttttctgcactcatc

SEQ ID NO: 831992 - DNA, 22 bp, Artificial Sequence
  chemically synthesized
aacttttacttgatgagtgcag

SEQ ID NO: 831993 - DNA, 22 bp, Artificial Sequence
  chemically synthesized
ttacttgatgagtgcagaaaac

SEQ ID NO: 831994 - DNA, 22 bp, Artificial Sequence
  chemically synthesized
tacttgatgagtgcagaaaacg

SEQ ID NO: 831995 - DNA, 22 bp, Artificial Sequence
  chemically synthesized
ggggttaatttccgttttctgc

SEQ ID NO: 831996 - DNA, 22 bp, Artificial Sequence
  chemically synthesized
acttgatgagtgcagaaaacgg

SEQ ID NO: 831997 - DNA, 22 bp, Artificial Sequence
  chemically synthesized
cggggttaatttccgttttctg

SEQ ID NO: 831998 - DNA, 22 bp, Artificial Sequence
  chemically synthesized
cttgatgagtgcagaaaacgga

SEQ ID NO: 831999 - DNA, 22 bp, Artificial Sequence
  chemically synthesized
tcggggttaatttccgttttct

SEQ ID NO: 832000 - DNA, 22 bp, Artificial Sequence
  chemically synthesized
ttcggggttaatttccgttttc

SEQ ID NO: 832001 - DNA, 22 bp, Artificial Sequence
  chemically synthesized
gatgagtgcagaaaacggaaat

SEQ ID NO: 832002 - DNA, 22 bp, Artificial Sequence
  chemically synthesized
atgagtgcagaaaacggaaatt

SEQ ID NO: 832003 - DNA, 22 bp, Artificial Sequence
  chemically synthesized
tttttcggggttaatttccgtt

SEQ ID NO: 832004 - DNA, 22 bp, Artificial Sequence
  chemically synthesized
gtttttcggggttaatttccgt

SEQ ID NO: 832005 - DNA, 22 bp, Artificial Sequence
  chemically synthesized
tgtttttcggggttaatttccg

SEQ ID NO: 832006 - DNA, 22 bp, Artificial Sequence
  chemically synthesized
accccgaaaaacaaagtggcct

SEQ ID NO: 832007 - DNA, 22 bp, Artificial Sequence
  chemically synthesized
taaaaataagagtgaggccact

SEQ ID NO: 832008 - DNA, 22 bp, Artificial Sequence
  chemically synthesized
gtaaaaataagagtgaggccac

SEQ ID NO: 832009 - DNA, 22 bp, Artificial Sequence
  chemically synthesized
gatggtggagtatgcttgtaaa

SEQ ID NO: 832010 - DNA, 22 bp, Artificial Sequence
  chemically synthesized
actcttatttttacaagcatac

SEQ ID NO: 832011 - DNA, 22 bp, Artificial Sequence
  chemically synthesized
ttatttttacaagcatactcca

SEQ ID NO: 832012 - DNA, 22 bp, Artificial Sequence
  chemically synthesized
aatagttggatggtggagtatg

SEQ ID NO: 832013 - DNA, 22 bp, Artificial Sequence
  chemically synthesized
atttttacaagcatactccacc

SEQ ID NO: 832014 - DNA, 22 bp, Artificial Sequence
  chemically synthesized
gaatagttggatggtggagtat

SEQ ID NO: 832015 - DNA, 22 bp, Artificial Sequence
  chemically synthesized
tttttacaagcatactccacca

SEQ ID NO: 832016 - DNA, 22 bp, Artificial Sequence
  chemically synthesized
ttacaagcatactccaccatcc

SEQ ID NO: 832017 - DNA, 22 bp, Artificial Sequence
  chemically synthesized
acttgaatagttggatggtgga

SEQ ID NO: 832018 - DNA, 22 bp, Artificial Sequence
  chemically synthesized
tacaagcatactccaccatcca

SEQ ID NO: 832019 - DNA, 22 bp, Artificial Sequence
  chemically synthesized
aacttgaatagttggatggtgg

SEQ ID NO: 832020 - DNA, 22 bp, Artificial Sequence
  chemically synthesized
acaagcatactccaccatccaa

SEQ ID NO: 832021 - DNA, 22 bp, Artificial Sequence
  chemically synthesized
caagcatactccaccatccaac

SEQ ID NO: 832022 - DNA, 22 bp, Artificial Sequence
  chemically synthesized
ttaacttgaatagttggatggt

SEQ ID NO: 832023 - DNA, 22 bp, Artificial Sequence
  chemically synthesized
cttaacttgaatagttggatgg

SEQ ID NO: 832024 - DNA, 22 bp, Artificial Sequence
  chemically synthesized
tttcttaacttgaatagttgga

SEQ ID NO: 832025 - DNA, 22 bp, Artificial Sequence
  chemically synthesized
atttcttaacttgaatagttgg

SEQ ID NO: 832026 - DNA, 22 bp, Artificial Sequence
  chemically synthesized
tatttcttaacttgaatagttg

SEQ ID NO: 832027 - DNA, 22 bp, Artificial Sequence
  chemically synthesized
ttatttcttaacttgaatagtt

SEQ ID NO: 832028 - DNA, 22 bp, Artificial Sequence
  chemically synthesized
tttttatttcttaacttgaata

SEQ ID NO: 832029 - DNA, 22 bp, Artificial Sequence
  chemically synthesized
caccatccaactattcaagtta

SEQ ID NO: 832030 - DNA, 22 bp, Artificial Sequence
  chemically synthesized
atttttatttcttaacttgaat

SEQ ID NO: 832031 - DNA, 22 bp, Artificial Sequence
  chemically synthesized
catttatttttatttcttaact

SEQ ID NO: 832032 - DNA, 22 bp, Artificial Sequence
  chemically synthesized
ccatttatttttatttcttaac

SEQ ID NO: 832033 - DNA, 22 bp, Artificial Sequence
  chemically synthesized
tccatttatttttatttcttaa

SEQ ID NO: 832034 - DNA, 22 bp, Artificial Sequence
  chemically synthesized
ttttccatttatttttatttct

SEQ ID NO: 832035 - DNA, 22 bp, Artificial Sequence
  chemically synthesized
ttcaagttaagaaataaaaata

SEQ ID NO: 832036 - DNA, 22 bp, Artificial Sequence
  chemically synthesized
aagttaagaaataaaaataaat

SEQ ID NO: 832037 - DNA, 22 bp, Artificial Sequence
  chemically synthesized
aagaaattgttttccatttatt

SEQ ID NO: 832038 - DNA, 22 bp, Artificial Sequence
  chemically synthesized
agaaataaaaataaatggaaaa

SEQ ID NO: 832039 - DNA, 22 bp, Artificial Sequence
  chemically synthesized
ttcaagaaattgttttccattt

SEQ ID NO: 832040 - DNA, 22 bp, Artificial Sequence
  chemically synthesized
tgttcaagaaattgttttccat

SEQ ID NO: 832041 - DNA, 22 bp, Artificial Sequence
  chemically synthesized
ctgttcaagaaattgttttcca

SEQ ID NO: 832042 - DNA, 22 bp, Artificial Sequence
  chemically synthesized
gccatagtttctgttcaagaaa

SEQ ID NO: 832043 - DNA, 22 bp, Artificial Sequence
  chemically synthesized
agccatagtttctgttcaagaa

SEQ ID NO: 832044 - DNA, 22 bp, Artificial Sequence
  chemically synthesized
tagccatagtttctgttcaaga

SEQ ID NO: 832045 - DNA, 22 bp, Artificial Sequence
  chemically synthesized
ttagccatagtttctgttcaag

SEQ ID NO: 832046 - DNA, 22 bp, Artificial Sequence
  chemically synthesized
tttagccatagtttctgttcaa

SEQ ID NO: 832047 - DNA, 22 bp, Artificial Sequence
  chemically synthesized
tgctttttagccatagtttctg

SEQ ID NO: 832048 - DNA, 22 bp, Artificial Sequence
  chemically synthesized
cttgaacagaaactatggctaa

SEQ ID NO: 832049 - DNA, 22 bp, Artificial Sequence
  chemically synthesized
ttgaacagaaactatggctaaa

SEQ ID NO: 832050 - DNA, 22 bp, Artificial Sequence
  chemically synthesized
gaacagaaactatggctaaaaa

SEQ ID NO: 832051 - DNA, 22 bp, Artificial Sequence
  chemically synthesized
aacagaaactatggctaaaaag

SEQ ID NO: 832052 - DNA, 22 bp, Artificial Sequence
  chemically synthesized
tggctaaaaagcacaattccat

SEQ ID NO: 832053 - DNA, 22 bp, Artificial Sequence
  chemically synthesized
tcagtaagcaatgtatggaatt

SEQ ID NO: 832054 - DNA, 22 bp, Artificial Sequence
  chemically synthesized
tgtcagtaagcaatgtatggaa

SEQ ID NO: 832055 - DNA, 22 bp, Artificial Sequence
  chemically synthesized
aaaagcacaattccatacattg

SEQ ID NO: 832056 - DNA, 22 bp, Artificial Sequence
  chemically synthesized
catacattgcttactgacagaa

SEQ ID NO: 832057 - DNA, 22 bp, Artificial Sequence
  chemically synthesized
aaatacagaaaagttctgtcag

SEQ ID NO: 832058 - DNA, 22 bp, Artificial Sequence
  chemically synthesized
cttactgacagaacttttctgt

SEQ ID NO: 832059 - DNA, 22 bp, Artificial Sequence
  chemically synthesized
actgacagaacttttctgtatt

SEQ ID NO: 832060 - DNA, 22 bp, Artificial Sequence
  chemically synthesized
ctgacagaacttttctgtattt

SEQ ID NO: 832061 - DNA, 22 bp, Artificial Sequence
  chemically synthesized
acagaacttttctgtatttcaa

SEQ ID NO: 832062 - DNA, 22 bp, Artificial Sequence
  chemically synthesized
ttctgtatttcaattcttcctt

SEQ ID NO: 832063 - DNA, 22 bp, Artificial Sequence
  chemically synthesized
tctgtatttcaattcttcctta

SEQ ID NO: 832064 - DNA, 22 bp, Artificial Sequence
  chemically synthesized
aagagaaggaggtaaggaagaa

SEQ ID NO: 832065 - DNA, 22 bp, Artificial Sequence
  chemically synthesized
ctgtatttcaattcttccttac

SEQ ID NO: 832066 - DNA, 22 bp, Artificial Sequence
  chemically synthesized
tgtatttcaattcttccttacc

SEQ ID NO: 832067 - DNA, 22 bp, Artificial Sequence
  chemically synthesized
tatttcaattcttccttacctc

SEQ ID NO: 832068 - DNA, 22 bp, Artificial Sequence
  chemically synthesized
aatctgaagagaaggaggtaag

SEQ ID NO: 832069 - DNA, 22 bp, Artificial Sequence
  chemically synthesized
caattcttccttacctccttct

SEQ ID NO: 832070 - DNA, 22 bp, Artificial Sequence
  chemically synthesized
aattcttccttacctccttctc

SEQ ID NO: 832071 - DNA, 22 bp, Artificial Sequence
  chemically synthesized
ttccttacctccttctcttcag

SEQ ID NO: 832072 - DNA, 22 bp, Artificial Sequence
  chemically synthesized
ccttacctccttctcttcagat

SEQ ID NO: 832073 - DNA, 22 bp, Artificial Sequence
  chemically synthesized
cttacctccttctcttcagatt

SEQ ID NO: 832074 - DNA, 22 bp, Artificial Sequence
  chemically synthesized
acctccttctcttcagatttag

SEQ ID NO: 832075 - DNA, 22 bp, Artificial Sequence
  chemically synthesized
cctccttctcttcagatttagg

SEQ ID NO: 832076 - DNA, 22 bp, Artificial Sequence
  chemically synthesized
cttctcttcagatttaggtgtc

SEQ ID NO: 832077 - DNA, 22 bp, Artificial Sequence
  chemically synthesized
ctcttcagatttaggtgtccct

SEQ ID NO: 832078 - DNA, 22 bp, Artificial Sequence
  chemically synthesized
ggcatgggtaggagggacacct

SEQ ID NO: 832079 - DNA, 22 bp, Artificial Sequence
  chemically synthesized
tcttcagatttaggtgtccctc

SEQ ID NO: 832080 - DNA, 22 bp, Artificial Sequence
  chemically synthesized
ttcagatttaggtgtccctcct

SEQ ID NO: 832081 - DNA, 22 bp, Artificial Sequence
  chemically synthesized
cagatttaggtgtccctcctac

SEQ ID NO: 832082 - DNA, 22 bp, Artificial Sequence
  chemically synthesized
agatttaggtgtccctcctacc

SEQ ID NO: 832083 - DNA, 22 bp, Artificial Sequence
  chemically synthesized
aggtgtccctcctacccatgcc

SEQ ID NO: 832084 - DNA, 22 bp, Artificial Sequence
  chemically synthesized
ggtgtccctcctacccatgcct

SEQ ID NO: 832085 - DNA, 22 bp, Artificial Sequence
  chemically synthesized
agtacagcgagggaattaggca

SEQ ID NO: 832086 - DNA, 22 bp, Artificial Sequence
  chemically synthesized
ctacccatgcctaattccctcg

SEQ ID NO: 832087 - DNA, 22 bp, Artificial Sequence
  chemically synthesized
cccatgcctaattccctcgctg

SEQ ID NO: 832088 - DNA, 22 bp, Artificial Sequence
  chemically synthesized
gaacattgagtacagcgaggga

SEQ ID NO: 832089 - DNA, 22 bp, Artificial Sequence
  chemically synthesized
attccctcgctgtactcaatgt

SEQ ID NO: 832090 - DNA, 22 bp, Artificial Sequence
  chemically synthesized
cctcgctgtactcaatgttcca

SEQ ID NO: 832091 - DNA, 22 bp, Artificial Sequence
  chemically synthesized
gctgtactcaatgttccagtct

SEQ ID NO: 832092 - DNA, 22 bp, Artificial Sequence
  chemically synthesized
atagaagatggaagagactgga

SEQ ID NO: 832093 - DNA, 22 bp, Artificial Sequence
  chemically synthesized
tactcaatgttccagtctcttc

SEQ ID NO: 832094 - DNA, 22 bp, Artificial Sequence
  chemically synthesized
tcatagaagatggaagagactg

SEQ ID NO: 832095 - DNA, 22 bp, Artificial Sequence
  chemically synthesized
ctcatagaagatggaagagact

SEQ ID NO: 832096 - DNA, 22 bp, Artificial Sequence
  chemically synthesized
aatgttccagtctcttccatct

SEQ ID NO: 832097 - DNA, 22 bp, Artificial Sequence
  chemically synthesized
cagtctcttccatcttctatga

SEQ ID NO: 832098 - DNA, 22 bp, Artificial Sequence
  chemically synthesized
ttccatcttctatgagaagtga

SEQ ID NO: 832099 - DNA, 22 bp, Artificial Sequence
  chemically synthesized
ccatcttctatgagaagtgatt

SEQ ID NO: 832100 - DNA, 22 bp, Artificial Sequence
  chemically synthesized
catcttctatgagaagtgattc

SEQ ID NO: 832101 - DNA, 22 bp, Artificial Sequence
  chemically synthesized
ctatgagaagtgattccatctt

SEQ ID NO: 832102 - DNA, 22 bp, Artificial Sequence
  chemically synthesized
tatgagaagtgattccatcttt

SEQ ID NO: 832103 - DNA, 22 bp, Artificial Sequence
  chemically synthesized
tgagaagtgattccatctttta

SEQ ID NO: 832104 - DNA, 22 bp, Artificial Sequence
  chemically synthesized
aagacataggaggggtaaaaga

SEQ ID NO: 832105 - DNA, 22 bp, Artificial Sequence
  chemically synthesized
catcttttacccctcctatgtc

SEQ ID NO: 832106 - DNA, 22 bp, Artificial Sequence
  chemically synthesized
tagacggagattgaagacatag

SEQ ID NO: 832107 - DNA, 22 bp, Artificial Sequence
  chemically synthesized
ttacccctcctatgtcttcaat

SEQ ID NO: 832108 - DNA, 22 bp, Artificial Sequence
  chemically synthesized
tacccctcctatgtcttcaatc

SEQ ID NO: 832109 - DNA, 22 bp, Artificial Sequence
  chemically synthesized
acccctcctatgtcttcaatct

SEQ ID NO: 832110 - DNA, 22 bp, Artificial Sequence
  chemically synthesized
cccctcctatgtcttcaatctc

SEQ ID NO: 832111 - DNA, 22 bp, Artificial Sequence
  chemically synthesized
ctatgtcttcaatctccgtcta

SEQ ID NO: 832112 - DNA, 22 bp, Artificial Sequence
  chemically synthesized
tgtcttcaatctccgtctacaa

SEQ ID NO: 832113 - DNA, 22 bp, Artificial Sequence
  chemically synthesized
aaataaacatggttgtagacgg

SEQ ID NO: 832114 - DNA, 22 bp, Artificial Sequence
  chemically synthesized
aaaataaacatggttgtagacg

SEQ ID NO: 832115 - DNA, 22 bp, Artificial Sequence
  chemically synthesized
ttaaaataaacatggttgtaga

SEQ ID NO: 832116 - DNA, 22 bp, Artificial Sequence
  chemically synthesized
cttaaaataaacatggttgtag

SEQ ID NO: 832117 - DNA, 22 bp, Artificial Sequence
  chemically synthesized
caatctccgtctacaaccatgt

SEQ ID NO: 832118 - DNA, 22 bp, Artificial Sequence
  chemically synthesized
ttcttaaaataaacatggttgt

SEQ ID NO: 832119 - DNA, 22 bp, Artificial Sequence
  chemically synthesized
aatctccgtctacaaccatgtt

SEQ ID NO: 832120 - DNA, 22 bp, Artificial Sequence
  chemically synthesized
cttcttaaaataaacatggttg

SEQ ID NO: 832121 - DNA, 22 bp, Artificial Sequence
  chemically synthesized
tcttcttaaaataaacatggtt

SEQ ID NO: 832122 - DNA, 22 bp, Artificial Sequence
  chemically synthesized
ttttcttcttaaaataaacatg

SEQ ID NO: 832123 - DNA, 22 bp, Artificial Sequence
  chemically synthesized
cgtctacaaccatgtttatttt

SEQ ID NO: 832124 - DNA, 22 bp, Artificial Sequence
  chemically synthesized
gttgttttcttcttaaaataaa

SEQ ID NO: 832125 - DNA, 22 bp, Artificial Sequence
  chemically synthesized
ggttgttttcttcttaaaataa

SEQ ID NO: 832126 - DNA, 22 bp, Artificial Sequence
  chemically synthesized
tggttgttttcttcttaaaata

SEQ ID NO: 832127 - DNA, 22 bp, Artificial Sequence
  chemically synthesized
caaccatgtttattttaagaag

SEQ ID NO: 832128 - DNA, 22 bp, Artificial Sequence
  chemically synthesized
gttttggttgttttcttcttaa

SEQ ID NO: 832129 - DNA, 22 bp, Artificial Sequence
  chemically synthesized
gttggttttggttgttttcttc

SEQ ID NO: 832130 - DNA, 22 bp, Artificial Sequence
  chemically synthesized
ggttggttttggttgttttctt

SEQ ID NO: 832131 - DNA, 22 bp, Artificial Sequence
  chemically synthesized
tttggttggttttggttgtttt

SEQ ID NO: 832132 - DNA, 22 bp, Artificial Sequence
  chemically synthesized
attttaagaagaaaacaaccaa

SEQ ID NO: 832133 - DNA, 22 bp, Artificial Sequence
  chemically synthesized
gtttggttggttttggttgttt

SEQ ID NO: 832134 - DNA, 22 bp, Artificial Sequence
  chemically synthesized
ttttaagaagaaaacaaccaaa

SEQ ID NO: 832135 - DNA, 22 bp, Artificial Sequence
  chemically synthesized
tgtttggttggttttggttgtt

SEQ ID NO: 832136 - DNA, 22 bp, Artificial Sequence
  chemically synthesized
ttgtttggttggttttggttgt

SEQ ID NO: 832137 - DNA, 22 bp, Artificial Sequence
  chemically synthesized
taagaagaaaacaaccaaaacc

SEQ ID NO: 832138 - DNA, 22 bp, Artificial Sequence
  chemically synthesized
aagaagaaaacaaccaaaacca

SEQ ID NO: 832139 - DNA, 22 bp, Artificial Sequence
  chemically synthesized
agaagaaaacaaccaaaaccaa

SEQ ID NO: 832140 - DNA, 22 bp, Artificial Sequence
  chemically synthesized
tcttttgtttggttggttttgg

SEQ ID NO: 832141 - DNA, 22 bp, Artificial Sequence
  chemically synthesized
gtcttttgtttggttggttttg

SEQ ID NO: 832142 - DNA, 22 bp, Artificial Sequence
  chemically synthesized
tgtcttttgtttggttggtttt

SEQ ID NO: 832143 - DNA, 22 bp, Artificial Sequence
  chemically synthesized
ttgtcttttgtttggttggttt

SEQ ID NO: 832144 - DNA, 22 bp, Artificial Sequence
  chemically synthesized
ttttgtcttttgtttggttggt

SEQ ID NO: 832145 - DNA, 22 bp, Artificial Sequence
  chemically synthesized
tttcctttggtcctacacccca

SEQ ID NO: 832146 - DNA, 22 bp, Artificial Sequence
  chemically synthesized
cctttggtcctacaccccacct

SEQ ID NO: 832147 - DNA, 22 bp, Artificial Sequence
  chemically synthesized
ctttggtcctacaccccacctg

SEQ ID NO: 832148 - DNA, 22 bp, Artificial Sequence
  chemically synthesized
catcaggggacgcaggtggggt

SEQ ID NO: 832149 - DNA, 22 bp, Artificial Sequence
  chemically synthesized
ccatcaggggacgcaggtgggg

SEQ ID NO: 832150 - DNA, 22 bp, Artificial Sequence
  chemically synthesized
tggtcctacaccccacctgcgt

SEQ ID NO: 832151 - DNA, 22 bp, Artificial Sequence
  chemically synthesized
ggtcctacaccccacctgcgtc

SEQ ID NO: 832152 - DNA, 22 bp, Artificial Sequence
  chemically synthesized
gtcctacaccccacctgcgtcc

SEQ ID NO: 832153 - DNA, 22 bp, Artificial Sequence
  chemically synthesized
caccccacctgcgtcccctgat

SEQ ID NO: 832154 - DNA, 22 bp, Artificial Sequence
  chemically synthesized
cgtcccctgatggaaaccctat

SEQ ID NO: 832155 - DNA, 22 bp, Artificial Sequence
  chemically synthesized
ccacaaaggaggaagacatagg

SEQ ID NO: 832156 - DNA, 22 bp, Artificial Sequence
  chemically synthesized
tcccacaaaggaggaagacata

SEQ ID NO: 832157 - DNA, 22 bp, Artificial Sequence
  chemically synthesized
atggaaaccctatgtcttcctc

SEQ ID NO: 832158 - DNA, 22 bp, Artificial Sequence
  chemically synthesized
gtgtaagccactctcccacaaa

SEQ ID NO: 832159 - DNA, 22 bp, Artificial Sequence
  chemically synthesized
tgtcttcctcctttgtgggaga

SEQ ID NO: 832160 - DNA, 22 bp, Artificial Sequence
  chemically synthesized
cctcctttgtgggagagtggct

SEQ ID NO: 832161 - DNA, 22 bp, Artificial Sequence
  chemically synthesized
ctcctttgtgggagagtggctt

SEQ ID NO: 832162 - DNA, 22 bp, Artificial Sequence
  chemically synthesized
agtagcactggtgtaagccact

SEQ ID NO: 832163 - DNA, 22 bp, Artificial Sequence
  chemically synthesized
ctttgtgggagagtggcttaca

SEQ ID NO: 832164 - DNA, 22 bp, Artificial Sequence
  chemically synthesized
aagtagcactggtgtaagccac

SEQ ID NO: 832165 - DNA, 22 bp, Artificial Sequence
  chemically synthesized
taagtagcactggtgtaagcca

SEQ ID NO: 832166 - DNA, 22 bp, Artificial Sequence
  chemically synthesized
tgtgggagagtggcttacacca

SEQ ID NO: 832167 - DNA, 22 bp, Artificial Sequence
  chemically synthesized
gtgggagagtggcttacaccag

SEQ ID NO: 832168 - DNA, 22 bp, Artificial Sequence
  chemically synthesized
tgggagagtggcttacaccagt

SEQ ID NO: 832169 - DNA, 22 bp, Artificial Sequence
  chemically synthesized
atacacaaaccatcctttaagt

SEQ ID NO: 832170 - DNA, 22 bp, Artificial Sequence
  chemically synthesized
acaccagtgctacttaaaggat

SEQ ID NO: 832171 - DNA, 22 bp, Artificial Sequence
  chemically synthesized
caccagtgctacttaaaggatg

SEQ ID NO: 832172 - DNA, 22 bp, Artificial Sequence
  chemically synthesized
ctcatacacaaaccatccttta

SEQ ID NO: 832173 - DNA, 22 bp, Artificial Sequence
  chemically synthesized
atgctgctcatacacaaaccat

SEQ ID NO: 832174 - DNA, 22 bp, Artificial Sequence
  chemically synthesized
cttaaaggatggtttgtgtatg

SEQ ID NO: 832175 - DNA, 22 bp, Artificial Sequence
  chemically synthesized
aaaggatggtttgtgtatgagc

SEQ ID NO: 832176 - DNA, 22 bp, Artificial Sequence
  chemically synthesized
aaggatggtttgtgtatgagca

SEQ ID NO: 832177 - DNA, 22 bp, Artificial Sequence
  chemically synthesized
tcaggtgatgctgatgctgctc

SEQ ID NO: 832178 - DNA, 22 bp, Artificial Sequence
  chemically synthesized
gtgtatgagcagcatcagcatc

SEQ ID NO: 832179 - DNA, 22 bp, Artificial Sequence
  chemically synthesized
tgtatgagcagcatcagcatca

SEQ ID NO: 832180 - DNA, 22 bp, Artificial Sequence
  chemically synthesized
acaagttatcaggtgatgctga

SEQ ID NO: 832181 - DNA, 22 bp, Artificial Sequence
  chemically synthesized
taacaagttatcaggtgatgct

SEQ ID NO: 832182 - DNA, 22 bp, Artificial Sequence
  chemically synthesized
ctaacaagttatcaggtgatgc

SEQ ID NO: 832183 - DNA, 22 bp, Artificial Sequence
  chemically synthesized
catttctaacaagttatcaggt

SEQ ID NO: 832184 - DNA, 22 bp, Artificial Sequence
  chemically synthesized
tgcatttctaacaagttatcag

SEQ ID NO: 832185 - DNA, 22 bp, Artificial Sequence
  chemically synthesized
agattctgcatttctaacaagt

SEQ ID NO: 832186 - DNA, 22 bp, Artificial Sequence
  chemically synthesized
ataacttgttagaaatgcagaa

SEQ ID NO: 832187 - DNA, 22 bp, Artificial Sequence
  chemically synthesized
gagtggagcctgagattctgca

SEQ ID NO: 832188 - DNA, 22 bp, Artificial Sequence
  chemically synthesized
tagagtggagcctgagattctg

SEQ ID NO: 832189 - DNA, 22 bp, Artificial Sequence
  chemically synthesized
gttagaaatgcagaatctcagg

SEQ ID NO: 832190 - DNA, 22 bp, Artificial Sequence
  chemically synthesized
ttagaaatgcagaatctcaggc

SEQ ID NO: 832191 - DNA, 22 bp, Artificial Sequence
  chemically synthesized
gctctagagtggagcctgagat

SEQ ID NO: 832192 - DNA, 22 bp, Artificial Sequence
  chemically synthesized
gaaatgcagaatctcaggctcc

SEQ ID NO: 832193 - DNA, 22 bp, Artificial Sequence
  chemically synthesized
attagctctagagtggagcctg

SEQ ID NO: 832194 - DNA, 22 bp, Artificial Sequence
  chemically synthesized
attcattagctctagagtggag

SEQ ID NO: 832195 - DNA, 22 bp, Artificial Sequence
  chemically synthesized
gattcattagctctagagtgga

SEQ ID NO: 832196 - DNA, 22 bp, Artificial Sequence
  chemically synthesized
tgattcattagctctagagtgg

SEQ ID NO: 832197 - DNA, 22 bp, Artificial Sequence
  chemically synthesized
aggctccactctagagctaatg

SEQ ID NO: 832198 - DNA, 22 bp, Artificial Sequence
  chemically synthesized
aaatgcagattttgattcatta

SEQ ID NO: 832199 - DNA, 22 bp, Artificial Sequence
  chemically synthesized
cactctagagctaatgaatcaa

SEQ ID NO: 832200 - DNA, 22 bp, Artificial Sequence
  chemically synthesized
aaaatgcagattttgattcatt

SEQ ID NO: 832201 - DNA, 22 bp, Artificial Sequence
  chemically synthesized
taaaatgcagattttgattcat

SEQ ID NO: 832202 - DNA, 22 bp, Artificial Sequence
  chemically synthesized
ttttaaaatgcagattttgatt

SEQ ID NO: 832203 - DNA, 22 bp, Artificial Sequence
  chemically synthesized
tagagctaatgaatcaaaatct

SEQ ID NO: 832204 - DNA, 22 bp, Artificial Sequence
  chemically synthesized
attttaaaatgcagattttgat

SEQ ID NO: 832205 - DNA, 22 bp, Artificial Sequence
  chemically synthesized
gagctaatgaatcaaaatctgc

SEQ ID NO: 832206 - DNA, 22 bp, Artificial Sequence
  chemically synthesized
atgaatcaaaatctgcatttta

SEQ ID NO: 832207 - DNA, 22 bp, Artificial Sequence
  chemically synthesized
aaaaatcttattttaaaatgca

SEQ ID NO: 832208 - DNA, 22 bp, Artificial Sequence
  chemically synthesized
cattttaaaataagatttttca

SEQ ID NO: 832209 - DNA, 22 bp, Artificial Sequence
  chemically synthesized
aaaatgtaatcacctgaaaaat

SEQ ID NO: 832210 - DNA, 22 bp, Artificial Sequence
  chemically synthesized
tcaaaatgtaatcacctgaaaa

SEQ ID NO: 832211 - DNA, 22 bp, Artificial Sequence
  chemically synthesized
taaaataagatttttcaggtga

SEQ ID NO: 832212 - DNA, 22 bp, Artificial Sequence
  chemically synthesized
ctcaaaatgtaatcacctgaaa

SEQ ID NO: 832213 - DNA, 22 bp, Artificial Sequence
  chemically synthesized
aaaataagatttttcaggtgat

SEQ ID NO: 832214 - DNA, 22 bp, Artificial Sequence
  chemically synthesized
aaataagatttttcaggtgatt

SEQ ID NO: 832215 - DNA, 22 bp, Artificial Sequence
  chemically synthesized
cttctcaaaatgtaatcacctg

SEQ ID NO: 832216 - DNA, 22 bp, Artificial Sequence
  chemically synthesized
ttgcttctcaaaatgtaatcac

SEQ ID NO: 832217 - DNA, 22 bp, Artificial Sequence
  chemically synthesized
ttcaggtgattacattttgaga

SEQ ID NO: 832218 - DNA, 22 bp, Artificial Sequence
  chemically synthesized
tcaggtgattacattttgagaa

SEQ ID NO: 832219 - DNA, 22 bp, Artificial Sequence
  chemically synthesized
caggtgattacattttgagaag

SEQ ID NO: 832220 - DNA, 22 bp, Artificial Sequence
  chemically synthesized
aggtgattacattttgagaagc

SEQ ID NO: 832221 - DNA, 22 bp, Artificial Sequence
  chemically synthesized
cattttgagaagcaatagtcta

SEQ ID NO: 832222 - DNA, 22 bp, Artificial Sequence
  chemically synthesized
tgagaagcaatagtctataccc

SEQ ID NO: 832223 - DNA, 22 bp, Artificial Sequence
  chemically synthesized
gagaagcaatagtctataccca

SEQ ID NO: 832224 - DNA, 22 bp, Artificial Sequence
  chemically synthesized
agaagcaatagtctatacccac

SEQ ID NO: 832225 - DNA, 22 bp, Artificial Sequence
  chemically synthesized
tacccactatttccacatccac

SEQ ID NO: 832226 - DNA, 22 bp, Artificial Sequence
  chemically synthesized
gaagggtatgtgaggtgtggat

SEQ ID NO: 832227 - DNA, 22 bp, Artificial Sequence
  chemically synthesized
agaagggtatgtgaggtgtgga

SEQ ID NO: 832228 - DNA, 22 bp, Artificial Sequence
  chemically synthesized
tttccacatccacacctcacat

SEQ ID NO: 832229 - DNA, 22 bp, Artificial Sequence
  chemically synthesized
ccacatccacacctcacatacc

SEQ ID NO: 832230 - DNA, 22 bp, Artificial Sequence
  chemically synthesized
cacatccacacctcacataccc

SEQ ID NO: 832231 - DNA, 22 bp, Artificial Sequence
  chemically synthesized
acatacccttctaaaccattac

SEQ ID NO: 832232 - DNA, 22 bp, Artificial Sequence
  chemically synthesized
agtggcaaaagccaaaacgtaa

SEQ ID NO: 832233 - DNA, 22 bp, Artificial Sequence
  chemically synthesized
cagtggcaaaagccaaaacgta

SEQ ID NO: 832234 - DNA, 22 bp, Artificial Sequence
  chemically synthesized
ctaaaccattacgttttggctt

SEQ ID NO: 832235 - DNA, 22 bp, Artificial Sequence
  chemically synthesized
taaaccattacgttttggcttt

SEQ ID NO: 832236 - DNA, 22 bp, Artificial Sequence
  chemically synthesized
aaccattacgttttggcttttg

SEQ ID NO: 832237 - DNA, 22 bp, Artificial Sequence
  chemically synthesized
caaaagtaatttcagtggcaaa

SEQ ID NO: 832238 - DNA, 22 bp, Artificial Sequence
  chemically synthesized
cgttttggcttttgccactgaa

SEQ ID NO: 832239 - DNA, 22 bp, Artificial Sequence
  chemically synthesized
tggcttttgccactgaaattac

SEQ ID NO: 832240 - DNA, 22 bp, Artificial Sequence
  chemically synthesized
tcacctacaaaagtaatttcag

SEQ ID NO: 832241 - DNA, 22 bp, Artificial Sequence
  chemically synthesized
ggcttttgccactgaaattact

SEQ ID NO: 832242 - DNA, 22 bp, Artificial Sequence
  chemically synthesized
gcttttgccactgaaattactt

SEQ ID NO: 832243 - DNA, 22 bp, Artificial Sequence
  chemically synthesized
ctatcacctacaaaagtaattt

SEQ ID NO: 832244 - DNA, 22 bp, Artificial Sequence
  chemically synthesized
ttgccactgaaattacttttgt

SEQ ID NO: 832245 - DNA, 22 bp, Artificial Sequence
  chemically synthesized
tgccactgaaattacttttgta

SEQ ID NO: 832246 - DNA, 22 bp, Artificial Sequence
  chemically synthesized
gccactgaaattacttttgtag

SEQ ID NO: 832247 - DNA, 22 bp, Artificial Sequence
  chemically synthesized
ccactgaaattacttttgtagg

SEQ ID NO: 832248 - DNA, 22 bp, Artificial Sequence
  chemically synthesized
aggtcactgctatcacctacaa

SEQ ID NO: 832249 - DNA, 22 bp, Artificial Sequence
  chemically synthesized
aaggtcactgctatcacctaca

SEQ ID NO: 832250 - DNA, 22 bp, Artificial Sequence
  chemically synthesized
taaggtcactgctatcacctac

SEQ ID NO: 832251 - DNA, 22 bp, Artificial Sequence
  chemically synthesized
aaattacttttgtaggtgatag

SEQ ID NO: 832252 - DNA, 22 bp, Artificial Sequence
  chemically synthesized
cttttgtaggtgatagcagtga

SEQ ID NO: 832253 - DNA, 22 bp, Artificial Sequence
  chemically synthesized
tagcaactttaaggtcactgct

SEQ ID NO: 832254 - DNA, 22 bp, Artificial Sequence
  chemically synthesized
ttgtaggtgatagcagtgacct

SEQ ID NO: 832255 - DNA, 22 bp, Artificial Sequence
  chemically synthesized
tgtaggtgatagcagtgacctt

SEQ ID NO: 832256 - DNA, 22 bp, Artificial Sequence
  chemically synthesized
gtaggtgatagcagtgacctta

SEQ ID NO: 832257 - DNA, 22 bp, Artificial Sequence
  chemically synthesized
taggtgatagcagtgaccttaa

SEQ ID NO: 832258 - DNA, 22 bp, Artificial Sequence
  chemically synthesized
atactgtagcaactttaaggtc

SEQ ID NO: 832259 - DNA, 22 bp, Artificial Sequence
  chemically synthesized
taatactgtagcaactttaagg

SEQ ID NO: 832260 - DNA, 22 bp, Artificial Sequence
  chemically synthesized
tctaatactgtagcaactttaa

SEQ ID NO: 832261 - DNA, 22 bp, Artificial Sequence
  chemically synthesized
gactctctaatactgtagcaac

SEQ ID NO: 832262 - DNA, 22 bp, Artificial Sequence
  chemically synthesized
agactctctaatactgtagcaa

SEQ ID NO: 832263 - DNA, 22 bp, Artificial Sequence
  chemically synthesized
tagactctctaatactgtagca

SEQ ID NO: 832264 - DNA, 22 bp, Artificial Sequence
  chemically synthesized
aaagttgctacagtattagaga

SEQ ID NO: 832265 - DNA, 22 bp, Artificial Sequence
  chemically synthesized
aagttgctacagtattagagag

SEQ ID NO: 832266 - DNA, 22 bp, Artificial Sequence
  chemically synthesized
ctacagtattagagagtctaaa

SEQ ID NO: 832267 - DNA, 22 bp, Artificial Sequence
  chemically synthesized
aaaacataaagactttagactc

SEQ ID NO: 832268 - DNA, 22 bp, Artificial Sequence
  chemically synthesized
cagtattagagagtctaaagtc

SEQ ID NO: 832269 - DNA, 22 bp, Artificial Sequence
  chemically synthesized
gagagtctaaagtctttatgtt

SEQ ID NO: 832270 - DNA, 22 bp, Artificial Sequence
  chemically synthesized
aagggatatctgaaaacataaa

SEQ ID NO: 832271 - DNA, 22 bp, Artificial Sequence
  chemically synthesized
aagtctttatgttttcagatat

SEQ ID NO: 832272 - DNA, 22 bp, Artificial Sequence
  chemically synthesized
gcaggtactgaagggatatctg

SEQ ID NO: 832273 - DNA, 22 bp, Artificial Sequence
  chemically synthesized
tatgttttcagatatcccttca

SEQ ID NO: 832274 - DNA, 22 bp, Artificial Sequence
  chemically synthesized
atgttttcagatatcccttcag

SEQ ID NO: 832275 - DNA, 22 bp, Artificial Sequence
  chemically synthesized
tgttttcagatatcccttcagt

SEQ ID NO: 832276 - DNA, 22 bp, Artificial Sequence
  chemically synthesized
gtcaattggcaggtactgaagg

SEQ ID NO: 832277 - DNA, 22 bp, Artificial Sequence
  chemically synthesized
tcagatatcccttcagtacctg

SEQ ID NO: 832278 - DNA, 22 bp, Artificial Sequence
  chemically synthesized
cagatatcccttcagtacctgc

SEQ ID NO: 832279 - DNA, 22 bp, Artificial Sequence
  chemically synthesized
agatatcccttcagtacctgcc

SEQ ID NO: 832280 - DNA, 22 bp, Artificial Sequence
  chemically synthesized
aaagagggttcgtcaattggca

SEQ ID NO: 832281 - DNA, 22 bp, Artificial Sequence
  chemically synthesized
caaagagggttcgtcaattggc

SEQ ID NO: 832282 - DNA, 22 bp, Artificial Sequence
  chemically synthesized
cagtacctgccaattgacgaac

SEQ ID NO: 832283 - DNA, 22 bp, Artificial Sequence
  chemically synthesized
agtacctgccaattgacgaacc

SEQ ID NO: 832284 - DNA, 22 bp, Artificial Sequence
  chemically synthesized
ccaattgacgaaccctctttga

SEQ ID NO: 832285 - DNA, 22 bp, Artificial Sequence
  chemically synthesized
atcaaaagagaaggtttcaaag

SEQ ID NO: 832286 - DNA, 22 bp, Artificial Sequence
  chemically synthesized
acgaaccctctttgaaaccttc

SEQ ID NO: 832287 - DNA, 22 bp, Artificial Sequence
  chemically synthesized
catattaatcaaaagagaaggt

SEQ ID NO: 832288 - DNA, 22 bp, Artificial Sequence
  chemically synthesized
ccatattaatcaaaagagaagg

SEQ ID NO: 832289 - DNA, 22 bp, Artificial Sequence
  chemically synthesized
tttgaaaccttctcttttgatt

SEQ ID NO: 832290 - DNA, 22 bp, Artificial Sequence
  chemically synthesized
tgaaaccttctcttttgattaa

SEQ ID NO: 832291 - DNA, 22 bp, Artificial Sequence
  chemically synthesized
gaaaccttctcttttgattaat

SEQ ID NO: 832292 - DNA, 22 bp, Artificial Sequence
  chemically synthesized
aaaccttctcttttgattaata

SEQ ID NO: 832293 - DNA, 22 bp, Artificial Sequence
  chemically synthesized
ctcttttgattaatatggaaga

SEQ ID NO: 832294 - DNA, 22 bp, Artificial Sequence
  chemically synthesized
tcttttgattaatatggaagat

SEQ ID NO: 832295 - DNA, 22 bp, Artificial Sequence
  chemically synthesized
ttttgattaatatggaagattc

SEQ ID NO: 832296 - DNA, 22 bp, Artificial Sequence
  chemically synthesized
ttgattaatatggaagattcct

SEQ ID NO: 832297 - DNA, 22 bp, Artificial Sequence
  chemically synthesized
tgattaatatggaagattcctt

SEQ ID NO: 832298 - DNA, 22 bp, Artificial Sequence
  chemically synthesized
gattaatatggaagattccttc

SEQ ID NO: 832299 - DNA, 22 bp, Artificial Sequence
  chemically synthesized
attaatatggaagattccttct

SEQ ID NO: 832300 - DNA, 22 bp, Artificial Sequence
  chemically synthesized
atatggaagattccttcttgga

SEQ ID NO: 832301 - DNA, 22 bp, Artificial Sequence
  chemically synthesized
cttcttggattttattctgcct

SEQ ID NO: 832302 - DNA, 22 bp, Artificial Sequence
  chemically synthesized
cttggattttattctgcctatt

SEQ ID NO: 832303 - DNA, 22 bp, Artificial Sequence
  chemically synthesized
ttggattttattctgcctattt

SEQ ID NO: 832304 - DNA, 22 bp, Artificial Sequence
  chemically synthesized
ggattttattctgcctatttgg

SEQ ID NO: 832305 - DNA, 22 bp, Artificial Sequence
  chemically synthesized
gattttattctgcctatttggc

SEQ ID NO: 832306 - DNA, 22 bp, Artificial Sequence
  chemically synthesized
agagagtgaggagtggccaaat

SEQ ID NO: 832307 - DNA, 22 bp, Artificial Sequence
  chemically synthesized
tattctgcctatttggccactc

SEQ ID NO: 832308 - DNA, 22 bp, Artificial Sequence
  chemically synthesized
attctgcctatttggccactcc

SEQ ID NO: 832309 - DNA, 22 bp, Artificial Sequence
  chemically synthesized
ttctgcctatttggccactcct

SEQ ID NO: 832310 - DNA, 22 bp, Artificial Sequence
  chemically synthesized
tgcctatttggccactcctcac

SEQ ID NO: 832311 - DNA, 22 bp, Artificial Sequence
  chemically synthesized
cctatttggccactcctcactc

SEQ ID NO: 832312 - DNA, 22 bp, Artificial Sequence
  chemically synthesized
tttggccactcctcactctctt

SEQ ID NO: 832313 - DNA, 22 bp, Artificial Sequence
  chemically synthesized
aggaatgggcctaagagagtga

SEQ ID NO: 832314 - DNA, 22 bp, Artificial Sequence
  chemically synthesized
aaggaatgggcctaagagagtg

SEQ ID NO: 832315 - DNA, 22 bp, Artificial Sequence
  chemically synthesized
ggccactcctcactctcttagg

SEQ ID NO: 832316 - DNA, 22 bp, Artificial Sequence
  chemically synthesized
gccactcctcactctcttaggc

SEQ ID NO: 832317 - DNA, 22 bp, Artificial Sequence
  chemically synthesized
ctcactctcttaggcccattcc

SEQ ID NO: 832318 - DNA, 22 bp, Artificial Sequence
  chemically synthesized
actctcttaggcccattcctta

SEQ ID NO: 832319 - DNA, 22 bp, Artificial Sequence
  chemically synthesized
gggaatagcaacatttaaggaa

SEQ ID NO: 832320 - DNA, 22 bp, Artificial Sequence
  chemically synthesized
tcttaggcccattccttaaatg

SEQ ID NO: 832321 - DNA, 22 bp, Artificial Sequence
  chemically synthesized
ttaggcccattccttaaatgtt

SEQ ID NO: 832322 - DNA, 22 bp, Artificial Sequence
  chemically synthesized
aggcccattccttaaatgttgc

SEQ ID NO: 832323 - DNA, 22 bp, Artificial Sequence
  chemically synthesized
ggcccattccttaaatgttgct

SEQ ID NO: 832324 - DNA, 22 bp, Artificial Sequence
  chemically synthesized
cttaaatgttgctattccctag

SEQ ID NO: 832325 - DNA, 22 bp, Artificial Sequence
  chemically synthesized
aaatgttgctattccctagggg

SEQ ID NO: 832326 - DNA, 22 bp, Artificial Sequence
  chemically synthesized
aatgttgctattccctaggggt

SEQ ID NO: 832327 - DNA, 22 bp, Artificial Sequence
  chemically synthesized
ctattccctaggggtctccctt

SEQ ID NO: 832328 - DNA, 22 bp, Artificial Sequence
  chemically synthesized
ttccctaggggtctccctttga

SEQ ID NO: 832329 - DNA, 22 bp, Artificial Sequence
  chemically synthesized
cctaggggtctccctttgatct

SEQ ID NO: 832330 - DNA, 22 bp, Artificial Sequence
  chemically synthesized
ggggtctccctttgatcttttt

SEQ ID NO: 832331 - DNA, 22 bp, Artificial Sequence
  chemically synthesized
cctttgatctttttgttttcac

SEQ ID NO: 832332 - DNA, 22 bp, Artificial Sequence
  chemically synthesized
tgatctttttgttttcacttta

SEQ ID NO: 832333 - DNA, 22 bp, Artificial Sequence
  chemically synthesized
gatctttttgttttcactttac

SEQ ID NO: 832334 - DNA, 22 bp, Artificial Sequence
  chemically synthesized
atctttttgttttcactttaca

SEQ ID NO: 832335 - DNA, 22 bp, Artificial Sequence
  chemically synthesized
accagagagaatatgtaaagtg

SEQ ID NO: 832336 - DNA, 22 bp, Artificial Sequence
  chemically synthesized
tttgttttcactttacatattc

SEQ ID NO: 832337 - DNA, 22 bp, Artificial Sequence
  chemically synthesized
ttgttttcactttacatattct

SEQ ID NO: 832338 - DNA, 22 bp, Artificial Sequence
  chemically synthesized
tgttttcactttacatattctc

SEQ ID NO: 832339 - DNA, 22 bp, Artificial Sequence
  chemically synthesized
gttttcactttacatattctct

SEQ ID NO: 832340 - DNA, 22 bp, Artificial Sequence
  chemically synthesized
ttttcactttacatattctctc

SEQ ID NO: 832341 - DNA, 22 bp, Artificial Sequence
  chemically synthesized
tcactttacatattctctctgg

SEQ ID NO: 832342 - DNA, 22 bp, Artificial Sequence
  chemically synthesized
cactttacatattctctctggt

SEQ ID NO: 832343 - DNA, 22 bp, Artificial Sequence
  chemically synthesized
actttacatattctctctggtg

SEQ ID NO: 832344 - DNA, 22 bp, Artificial Sequence
  chemically synthesized
tacatattctctctggtgagtt

SEQ ID NO: 832345 - DNA, 22 bp, Artificial Sequence
  chemically synthesized
acatattctctctggtgagttc

SEQ ID NO: 832346 - DNA, 22 bp, Artificial Sequence
  chemically synthesized
catattctctctggtgagttca

SEQ ID NO: 832347 - DNA, 22 bp, Artificial Sequence
  chemically synthesized
tctctggtgagttcatgtatgt

SEQ ID NO: 832348 - DNA, 22 bp, Artificial Sequence
  chemically synthesized
tctggtgagttcatgtatgtat

SEQ ID NO: 832349 - DNA, 22 bp, Artificial Sequence
  chemically synthesized
tggtgagttcatgtatgtatat

SEQ ID NO: 832350 - DNA, 22 bp, Artificial Sequence
  chemically synthesized
gtgagttcatgtatgtatattg

SEQ ID NO: 832351 - DNA, 22 bp, Artificial Sequence
  chemically synthesized
gagatagtaaatgaagcaatat

SEQ ID NO: 832352 - DNA, 22 bp, Artificial Sequence
  chemically synthesized
agagatagtaaatgaagcaata

SEQ ID NO: 832353 - DNA, 22 bp, Artificial Sequence
  chemically synthesized
tagagatagtaaatgaagcaat

SEQ ID NO: 832354 - DNA, 22 bp, Artificial Sequence
  chemically synthesized
atgtatgtatattgcttcattt

SEQ ID NO: 832355 - DNA, 22 bp, Artificial Sequence
  chemically synthesized
ttttagagatagtaaatgaagc

SEQ ID NO: 832356 - DNA, 22 bp, Artificial Sequence
  chemically synthesized
attattttagagatagtaaatg

SEQ ID NO: 832357 - DNA, 22 bp, Artificial Sequence
  chemically synthesized
tgattattttagagatagtaaa

SEQ ID NO: 832358 - DNA, 22 bp, Artificial Sequence
  chemically synthesized
ctctgattattttagagatagt

SEQ ID NO: 832359 - DNA, 22 bp, Artificial Sequence
  chemically synthesized
actctgattattttagagatag

SEQ ID NO: 832360 - DNA, 22 bp, Artificial Sequence
  chemically synthesized
tactctgattattttagagata

SEQ ID NO: 832361 - DNA, 22 bp, Artificial Sequence
  chemically synthesized
cttcatttactatctctaaaat

SEQ ID NO: 832362 - DNA, 22 bp, Artificial Sequence
  chemically synthesized
catttactatctctaaaataat

SEQ ID NO: 832363 - DNA, 22 bp, Artificial Sequence
  chemically synthesized
atttactatctctaaaataatc

SEQ ID NO: 832364 - DNA, 22 bp, Artificial Sequence
  chemically synthesized
actatctctaaaataatcagag

SEQ ID NO: 832365 - DNA, 22 bp, Artificial Sequence
  chemically synthesized
ctatctctaaaataatcagagt

SEQ ID NO: 832366 - DNA, 22 bp, Artificial Sequence
  chemically synthesized
aaacacagattttactctgatt

SEQ ID NO: 832367 - DNA, 22 bp, Artificial Sequence
  chemically synthesized
aaaacacagattttactctgat

SEQ ID NO: 832368 - DNA, 22 bp, Artificial Sequence
  chemically synthesized
tctctaaaataatcagagtaaa

SEQ ID NO: 832369 - DNA, 22 bp, Artificial Sequence
  chemically synthesized
gcttaaaacacagattttactc

SEQ ID NO: 832370 - DNA, 22 bp, Artificial Sequence
  chemically synthesized
taaaataatcagagtaaaatct

SEQ ID NO: 832371 - DNA, 22 bp, Artificial Sequence
  chemically synthesized
agcttaaaacacagattttact

SEQ ID NO: 832372 - DNA, 22 bp, Artificial Sequence
  chemically synthesized
aaataatcagagtaaaatctgt

SEQ ID NO: 832373 - DNA, 22 bp, Artificial Sequence
  chemically synthesized
ttagcttaaaacacagatttta

SEQ ID NO: 832374 - DNA, 22 bp, Artificial Sequence
  chemically synthesized
aagagacaattcttagcttaaa

SEQ ID NO: 832375 - DNA, 22 bp, Artificial Sequence
  chemically synthesized
tgttttaagctaagaattgtct

SEQ ID NO: 832376 - DNA, 22 bp, Artificial Sequence
  chemically synthesized
taagctaagaattgtctcttga

SEQ ID NO: 832377 - DNA, 22 bp, Artificial Sequence
  chemically synthesized
tggatacagagttcaagagaca

SEQ ID NO: 832378 - DNA, 22 bp, Artificial Sequence
  chemically synthesized
aagctaagaattgtctcttgaa

SEQ ID NO: 832379 - DNA, 22 bp, Artificial Sequence
  chemically synthesized
agctaagaattgtctcttgaac

SEQ ID NO: 832380 - DNA, 22 bp, Artificial Sequence
  chemically synthesized
tatggatacagagttcaagaga

SEQ ID NO: 832381 - DNA, 22 bp, Artificial Sequence
  chemically synthesized
gctctatggatacagagttcaa

SEQ ID NO: 832382 - DNA, 22 bp, Artificial Sequence
  chemically synthesized
agaattgtctcttgaactctgt

SEQ ID NO: 832383 - DNA, 22 bp, Artificial Sequence
  chemically synthesized
ggctctatggatacagagttca

SEQ ID NO: 832384 - DNA, 22 bp, Artificial Sequence
  chemically synthesized
tctcttgaactctgtatccata

SEQ ID NO: 832385 - DNA, 22 bp, Artificial Sequence
  chemically synthesized
gtaggcgtttggctctatggat

SEQ ID NO: 832386 - DNA, 22 bp, Artificial Sequence
  chemically synthesized
ttgaactctgtatccatagagc

SEQ ID NO: 832387 - DNA, 22 bp, Artificial Sequence
  chemically synthesized
agtaggcgtttggctctatgga

SEQ ID NO: 832388 - DNA, 22 bp, Artificial Sequence
  chemically synthesized
gaactctgtatccatagagcca

SEQ ID NO: 832389 - DNA, 22 bp, Artificial Sequence
  chemically synthesized
aactctgtatccatagagccaa

SEQ ID NO: 832390 - DNA, 22 bp, Artificial Sequence
  chemically synthesized
tgtatccatagagccaaacgcc

SEQ ID NO: 832391 - DNA, 22 bp, Artificial Sequence
  chemically synthesized
tatccatagagccaaacgccta

SEQ ID NO: 832392 - DNA, 22 bp, Artificial Sequence
  chemically synthesized
atagagatttagtaggcgtttg

SEQ ID NO: 832393 - DNA, 22 bp, Artificial Sequence
  chemically synthesized
catagagatttagtaggcgttt

SEQ ID NO: 832394 - DNA, 22 bp, Artificial Sequence
  chemically synthesized
tttcatagagatttagtaggcg

SEQ ID NO: 832395 - DNA, 22 bp, Artificial Sequence
  chemically synthesized
gctatttcatagagatttagta

SEQ ID NO: 832396 - DNA, 22 bp, Artificial Sequence
  chemically synthesized
gatatgttggctatttcataga

SEQ ID NO: 832397 - DNA, 22 bp, Artificial Sequence
  chemically synthesized
ggatatgttggctatttcatag

SEQ ID NO: 832398 - DNA, 22 bp, Artificial Sequence
  chemically synthesized
ctaaatctctatgaaatagcca

SEQ ID NO: 832399 - DNA, 22 bp, Artificial Sequence
  chemically synthesized
aatctctatgaaatagccaaca

SEQ ID NO: 832400 - DNA, 22 bp, Artificial Sequence
  chemically synthesized
tatgaaatagccaacatatcca

SEQ ID NO: 832401 - DNA, 22 bp, Artificial Sequence
  chemically synthesized
tgaaatagccaacatatccaaa

SEQ ID NO: 832402 - DNA, 22 bp, Artificial Sequence
  chemically synthesized
ggggagaggaagaatgaagatg

SEQ ID NO: 832403 - DNA, 22 bp, Artificial Sequence
  chemically synthesized
gattacatcatcttcattcttc

SEQ ID NO: 832404 - DNA, 22 bp, Artificial Sequence
  chemically synthesized
catcatcttcattcttcctctc

SEQ ID NO: 832405 - DNA, 22 bp, Artificial Sequence
  chemically synthesized
cattcttcctctcccctaatca

SEQ ID NO: 832406 - DNA, 22 bp, Artificial Sequence
  chemically synthesized
attcttcctctcccctaatcac

SEQ ID NO: 832407 - DNA, 22 bp, Artificial Sequence
  chemically synthesized
ttcctctcccctaatcactgat

SEQ ID NO: 832408 - DNA, 22 bp, Artificial Sequence
  chemically synthesized
cctctcccctaatcactgatac

SEQ ID NO: 832409 - DNA, 22 bp, Artificial Sequence
  chemically synthesized
ctctcccctaatcactgataca

SEQ ID NO: 832410 - DNA, 22 bp, Artificial Sequence
  chemically synthesized
tcccctaatcactgatacacat

SEQ ID NO: 832411 - DNA, 22 bp, Artificial Sequence
  chemically synthesized
agtagaggaacagatgtgtatc

SEQ ID NO: 832412 - DNA, 22 bp, Artificial Sequence
  chemically synthesized
ccctaatcactgatacacatct

SEQ ID NO: 832413 - DNA, 22 bp, Artificial Sequence
  chemically synthesized
atcactgatacacatctgttcc

SEQ ID NO: 832414 - DNA, 22 bp, Artificial Sequence
  chemically synthesized
agtgactaagtagaggaacaga

SEQ ID NO: 832415 - DNA, 22 bp, Artificial Sequence
  chemically synthesized
cagtgactaagtagaggaacag

SEQ ID NO: 832416 - DNA, 22 bp, Artificial Sequence
  chemically synthesized
cttcagtgactaagtagaggaa

SEQ ID NO: 832417 - DNA, 22 bp, Artificial Sequence
  chemically synthesized
atacacatctgttcctctactt

SEQ ID NO: 832418 - DNA, 22 bp, Artificial Sequence
  chemically synthesized
tccttcagtgactaagtagagg

SEQ ID NO: 832419 - DNA, 22 bp, Artificial Sequence
  chemically synthesized
ctccttcagtgactaagtagag

SEQ ID NO: 832420 - DNA, 22 bp, Artificial Sequence
  chemically synthesized
catgtttctccttcagtgacta

SEQ ID NO: 832421 - DNA, 22 bp, Artificial Sequence
  chemically synthesized
gcatgtttctccttcagtgact

SEQ ID NO: 832422 - DNA, 22 bp, Artificial Sequence
  chemically synthesized
ttcctctacttagtcactgaag

SEQ ID NO: 832423 - DNA, 22 bp, Artificial Sequence
  chemically synthesized
ctctacttagtcactgaaggag

SEQ ID NO: 832424 - DNA, 22 bp, Artificial Sequence
  chemically synthesized
tacttagtcactgaaggagaaa

SEQ ID NO: 832425 - DNA, 22 bp, Artificial Sequence
  chemically synthesized
cttagtcactgaaggagaaaca

SEQ ID NO: 832426 - DNA, 22 bp, Artificial Sequence
  chemically synthesized
agtcactgaaggagaaacatgc

SEQ ID NO: 832427 - DNA, 22 bp, Artificial Sequence
  chemically synthesized
gtcactgaaggagaaacatgca

SEQ ID NO: 832428 - DNA, 22 bp, Artificial Sequence
  chemically synthesized
aaggagaaacatgcaaattatc

SEQ ID NO: 832429 - DNA, 22 bp, Artificial Sequence
  chemically synthesized
aagtataaggaagaaagaagaa

SEQ ID NO: 832430 - DNA, 22 bp, Artificial Sequence
  chemically synthesized
gttaaagtataaggaagaaaga

SEQ ID NO: 832431 - DNA, 22 bp, Artificial Sequence
  chemically synthesized
tccttcattcttctttcttcct

SEQ ID NO: 832432 - DNA, 22 bp, Artificial Sequence
  chemically synthesized
ggttaaagtataaggaagaaag

SEQ ID NO: 832433 - DNA, 22 bp, Artificial Sequence
  chemically synthesized
ttggttaaagtataaggaagaa

SEQ ID NO: 832434 - DNA, 22 bp, Artificial Sequence
  chemically synthesized
cttggttaaagtataaggaaga

SEQ ID NO: 832435 - DNA, 22 bp, Artificial Sequence
  chemically synthesized
cattcttctttcttccttatac

SEQ ID NO: 832436 - DNA, 22 bp, Artificial Sequence
  chemically synthesized
attcttctttcttccttatact

SEQ ID NO: 832437 - DNA, 22 bp, Artificial Sequence
  chemically synthesized
ttctttcttccttatactttaa

SEQ ID NO: 832438 - DNA, 22 bp, Artificial Sequence
  chemically synthesized
ggcatcttcttggttaaagtat

SEQ ID NO: 832439 - DNA, 22 bp, Artificial Sequence
  chemically synthesized
ctttcttccttatactttaacc

SEQ ID NO: 832440 - DNA, 22 bp, Artificial Sequence
  chemically synthesized
tttcttccttatactttaacca

SEQ ID NO: 832441 - DNA, 22 bp, Artificial Sequence
  chemically synthesized
tcttccttatactttaaccaag

SEQ ID NO: 832442 - DNA, 22 bp, Artificial Sequence
  chemically synthesized
cttccttatactttaaccaaga

SEQ ID NO: 832443 - DNA, 22 bp, Artificial Sequence
  chemically synthesized
ttccttatactttaaccaagaa

SEQ ID NO: 832444 - DNA, 22 bp, Artificial Sequence
  chemically synthesized
ccttatactttaaccaagaaga

SEQ ID NO: 832445 - DNA, 22 bp, Artificial Sequence
  chemically synthesized
cttatactttaaccaagaagat

SEQ ID NO: 832446 - DNA, 22 bp, Artificial Sequence
  chemically synthesized
atactttaaccaagaagatgcc

SEQ ID NO: 832447 - DNA, 22 bp, Artificial Sequence
  chemically synthesized
tactttaaccaagaagatgccg

SEQ ID NO: 832448 - DNA, 22 bp, Artificial Sequence
  chemically synthesized
aggagaagtgactcggcatctt

SEQ ID NO: 832449 - DNA, 22 bp, Artificial Sequence
  chemically synthesized
ttaaggagaagtgactcggcat

SEQ ID NO: 832450 - DNA, 22 bp, Artificial Sequence
  chemically synthesized
taaccaagaagatgccgagtca

SEQ ID NO: 832451 - DNA, 22 bp, Artificial Sequence
  chemically synthesized
aaccaagaagatgccgagtcac

SEQ ID NO: 832452 - DNA, 22 bp, Artificial Sequence
  chemically synthesized
accaagaagatgccgagtcact

SEQ ID NO: 832453 - DNA, 22 bp, Artificial Sequence
  chemically synthesized
ctccttaatagctcttctggcc

SEQ ID NO: 832454 - DNA, 22 bp, Artificial Sequence
  chemically synthesized
tccttaatagctcttctggcct

SEQ ID NO: 832455 - DNA, 22 bp, Artificial Sequence
  chemically synthesized
cttaatagctcttctggcctct

SEQ ID NO: 832456 - DNA, 22 bp, Artificial Sequence
  chemically synthesized
aatagctcttctggcctctata

SEQ ID NO: 832457 - DNA, 22 bp, Artificial Sequence
  chemically synthesized
atagctcttctggcctctatat

SEQ ID NO: 832458 - DNA, 22 bp, Artificial Sequence
  chemically synthesized
ttctggcctctatatcattcat

SEQ ID NO: 832459 - DNA, 22 bp, Artificial Sequence
  chemically synthesized
gggaagagagagatgaatgata

SEQ ID NO: 832460 - DNA, 22 bp, Artificial Sequence
  chemically synthesized
ctggcctctatatcattcatct

SEQ ID NO: 832461 - DNA, 22 bp, Artificial Sequence
  chemically synthesized
tggcctctatatcattcatctc

SEQ ID NO: 832462 - DNA, 22 bp, Artificial Sequence
  chemically synthesized
gcctctatatcattcatctctc

SEQ ID NO: 832463 - DNA, 22 bp, Artificial Sequence
  chemically synthesized
tatatcattcatctctctcttc

SEQ ID NO: 832464 - DNA, 22 bp, Artificial Sequence
  chemically synthesized
aagcaatctagggaagagagag

SEQ ID NO: 832465 - DNA, 22 bp, Artificial Sequence
  chemically synthesized
tatcattcatctctctcttccc

SEQ ID NO: 832466 - DNA, 22 bp, Artificial Sequence
  chemically synthesized
actaaagcaatctagggaagag

SEQ ID NO: 832467 - DNA, 22 bp, Artificial Sequence
  chemically synthesized
aactaaagcaatctagggaaga

SEQ ID NO: 832468 - DNA, 22 bp, Artificial Sequence
  chemically synthesized
taactaaagcaatctagggaag

SEQ ID NO: 832469 - DNA, 22 bp, Artificial Sequence
  chemically synthesized
ttaactaaagcaatctagggaa

SEQ ID NO: 832470 - DNA, 22 bp, Artificial Sequence
  chemically synthesized
atctctctcttccctagattgc

SEQ ID NO: 832471 - DNA, 22 bp, Artificial Sequence
  chemically synthesized
tctcttccctagattgctttag

SEQ ID NO: 832472 - DNA, 22 bp, Artificial Sequence
  chemically synthesized
tcttccctagattgctttagtt

SEQ ID NO: 832473 - DNA, 22 bp, Artificial Sequence
  chemically synthesized
ttccctagattgctttagttaa

SEQ ID NO: 832474 - DNA, 22 bp, Artificial Sequence
  chemically synthesized
ccctagattgctttagttaaaa

SEQ ID NO: 832475 - DNA, 22 bp, Artificial Sequence
  chemically synthesized
cctagattgctttagttaaaag

SEQ ID NO: 832476 - DNA, 22 bp, Artificial Sequence
  chemically synthesized
gattgctttagttaaaagcctc

SEQ ID NO: 832477 - DNA, 22 bp, Artificial Sequence
  chemically synthesized
gagagaccatcaggaggctttt

SEQ ID NO: 832478 - DNA, 22 bp, Artificial Sequence
  chemically synthesized
ctttagttaaaagcctcctgat

SEQ ID NO: 832479 - DNA, 22 bp, Artificial Sequence
  chemically synthesized
aactagagagaccatcaggagg

SEQ ID NO: 832480 - DNA, 22 bp, Artificial Sequence
  chemically synthesized
tagttaaaagcctcctgatggt

SEQ ID NO: 832481 - DNA, 22 bp, Artificial Sequence
  chemically synthesized
agttaaaagcctcctgatggtc

SEQ ID NO: 832482 - DNA, 22 bp, Artificial Sequence
  chemically synthesized
gttaaaagcctcctgatggtct

SEQ ID NO: 832483 - DNA, 22 bp, Artificial Sequence
  chemically synthesized
cgctgaactagagagaccatca

SEQ ID NO: 832484 - DNA, 22 bp, Artificial Sequence
  chemically synthesized
aaagcctcctgatggtctctct

SEQ ID NO: 832485 - DNA, 22 bp, Artificial Sequence
  chemically synthesized
tgttccgctgaactagagagac

SEQ ID NO: 832486 - DNA, 22 bp, Artificial Sequence
  chemically synthesized
ctgatggtctctctagttcagc

SEQ ID NO: 832487 - DNA, 22 bp, Artificial Sequence
  chemically synthesized
atggtctctctagttcagcgga

SEQ ID NO: 832488 - DNA, 22 bp, Artificial Sequence
  chemically synthesized
tctagttcagcggaacacaacc

SEQ ID NO: 832489 - DNA, 22 bp, Artificial Sequence
  chemically synthesized
tagttcagcggaacacaacctt

SEQ ID NO: 832490 - DNA, 22 bp, Artificial Sequence
  chemically synthesized
aaatgcacagacaaggttgtgt

SEQ ID NO: 832491 - DNA, 22 bp, Artificial Sequence
  chemically synthesized
gttcagcggaacacaaccttgt

SEQ ID NO: 832492 - DNA, 22 bp, Artificial Sequence
  chemically synthesized
attcaaatgcacagacaaggtt

SEQ ID NO: 832493 - DNA, 22 bp, Artificial Sequence
  chemically synthesized
gattcaaatgcacagacaaggt

SEQ ID NO: 832494 - DNA, 22 bp, Artificial Sequence
  chemically synthesized
agcggaacacaaccttgtctgt

SEQ ID NO: 832495 - DNA, 22 bp, Artificial Sequence
  chemically synthesized
ttgattcaaatgcacagacaag

SEQ ID NO: 832496 - DNA, 22 bp, Artificial Sequence
  chemically synthesized
aagcagccctcttgattcaaat

SEQ ID NO: 832497 - DNA, 22 bp, Artificial Sequence
  chemically synthesized
aaagcagccctcttgattcaaa

SEQ ID NO: 832498 - DNA, 22 bp, Artificial Sequence
  chemically synthesized
taaagcagccctcttgattcaa

SEQ ID NO: 832499 - DNA, 22 bp, Artificial Sequence
  chemically synthesized
ttaaagcagccctcttgattca

SEQ ID NO: 832500 - DNA, 22 bp, Artificial Sequence
  chemically synthesized
gtctgtgcatttgaatcaagag

SEQ ID NO: 832501 - DNA, 22 bp, Artificial Sequence
  chemically synthesized
tctgtgcatttgaatcaagagg

SEQ ID NO: 832502 - DNA, 22 bp, Artificial Sequence
  chemically synthesized
tgcatttgaatcaagagggctg

SEQ ID NO: 832503 - DNA, 22 bp, Artificial Sequence
  chemically synthesized
gtagtttttaaagcagccctct

SEQ ID NO: 832504 - DNA, 22 bp, Artificial Sequence
  chemically synthesized
gaatcaagagggctgctttaaa

SEQ ID NO: 832505 - DNA, 22 bp, Artificial Sequence
  chemically synthesized
aatcaagagggctgctttaaaa

SEQ ID NO: 832506 - DNA, 22 bp, Artificial Sequence
  chemically synthesized
atagggcccagacattcgtagt

SEQ ID NO: 832507 - DNA, 22 bp, Artificial Sequence
  chemically synthesized
aatagggcccagacattcgtag

SEQ ID NO: 832508 - DNA, 22 bp, Artificial Sequence
  chemically synthesized
ctttaaaaactacgaatgtctg

SEQ ID NO: 832509 - DNA, 22 bp, Artificial Sequence
  chemically synthesized
taaaaactacgaatgtctgggc

SEQ ID NO: 832510 - DNA, 22 bp, Artificial Sequence
  chemically synthesized
aaaaactacgaatgtctgggcc

SEQ ID NO: 832511 - DNA, 22 bp, Artificial Sequence
  chemically synthesized
aaaactacgaatgtctgggccc

SEQ ID NO: 832512 - DNA, 22 bp, Artificial Sequence
  chemically synthesized
aatcagagccttaatagggccc

SEQ ID NO: 832513 - DNA, 22 bp, Artificial Sequence
  chemically synthesized
cgaatgtctgggccctattaag

SEQ ID NO: 832514 - DNA, 22 bp, Artificial Sequence
  chemically synthesized
ggccctattaaggctctgattt

SEQ ID NO: 832515 - DNA, 22 bp, Artificial Sequence
  chemically synthesized
caccccaaaccagttaaatcag

SEQ ID NO: 832516 - DNA, 22 bp, Artificial Sequence
  chemically synthesized
ttaaggctctgatttaactggt

SEQ ID NO: 832517 - DNA, 22 bp, Artificial Sequence
  chemically synthesized
gactccaccccaaaccagttaa

SEQ ID NO: 832518 - DNA, 22 bp, Artificial Sequence
  chemically synthesized
ggactccaccccaaaccagtta

SEQ ID NO: 832519 - DNA, 22 bp, Artificial Sequence
  chemically synthesized
aggctctgatttaactggtttg

SEQ ID NO: 832520 - DNA, 22 bp, Artificial Sequence
  chemically synthesized
tgatttaactggtttggggtgg

SEQ ID NO: 832521 - DNA, 22 bp, Artificial Sequence
  chemically synthesized
atttaactggtttggggtggag

SEQ ID NO: 832522 - DNA, 22 bp, Artificial Sequence
  chemically synthesized
aactggtttggggtggagtcca

SEQ ID NO: 832523 - DNA, 22 bp, Artificial Sequence
  chemically synthesized
actggtttggggtggagtccaa

SEQ ID NO: 832524 - DNA, 22 bp, Artificial Sequence
  chemically synthesized
gtttggggtggagtccaagtat

SEQ ID NO: 832525 - DNA, 22 bp, Artificial Sequence
  chemically synthesized
aaaaaaatgccaatacttggac

SEQ ID NO: 832526 - DNA, 22 bp, Artificial Sequence
  chemically synthesized
aaaaaaaatgccaatacttgga

SEQ ID NO: 832527 - DNA, 22 bp, Artificial Sequence
  chemically synthesized
ggggtggagtccaagtattggc

SEQ ID NO: 832528 - DNA, 22 bp, Artificial Sequence
  chemically synthesized
gggtggagtccaagtattggca

SEQ ID NO: 832529 - DNA, 22 bp, Artificial Sequence
  chemically synthesized
gggggagtttaaaaaaaatgcc

SEQ ID NO: 832530 - DNA, 22 bp, Artificial Sequence
  chemically synthesized
gaatcactagggggagtttaaa

SEQ ID NO: 832531 - DNA, 22 bp, Artificial Sequence
  chemically synthesized
gcattttttttaaactccccct

SEQ ID NO: 832532 - DNA, 22 bp, Artificial Sequence
  chemically synthesized
cacgttagaatcactaggggga

SEQ ID NO: 832533 - DNA, 22 bp, Artificial Sequence
  chemically synthesized
tttttaaactccccctagtgat

SEQ ID NO: 832534 - DNA, 22 bp, Artificial Sequence
  chemically synthesized
ttttaaactccccctagtgatt

SEQ ID NO: 832535 - DNA, 22 bp, Artificial Sequence
  chemically synthesized
gctgcacgttagaatcactagg

SEQ ID NO: 832536 - DNA, 22 bp, Artificial Sequence
  chemically synthesized
tttaaactccccctagtgattc

SEQ ID NO: 832537 - DNA, 22 bp, Artificial Sequence
  chemically synthesized
ttaaactccccctagtgattct

SEQ ID NO: 832538 - DNA, 22 bp, Artificial Sequence
  chemically synthesized
taaactccccctagtgattcta

SEQ ID NO: 832539 - DNA, 22 bp, Artificial Sequence
  chemically synthesized
aaactccccctagtgattctaa

SEQ ID NO: 832540 - DNA, 22 bp, Artificial Sequence
  chemically synthesized
aactccccctagtgattctaac

SEQ ID NO: 832541 - DNA, 22 bp, Artificial Sequence
  chemically synthesized
atccctggctgcacgttagaat

SEQ ID NO: 832542 - DNA, 22 bp, Artificial Sequence
  chemically synthesized
tcatccctggctgcacgttaga

SEQ ID NO: 832543 - DNA, 22 bp, Artificial Sequence
  chemically synthesized
cccctagtgattctaacgtgca

SEQ ID NO: 832544 - DNA, 22 bp, Artificial Sequence
  chemically synthesized
gtgattctaacgtgcagccagg

SEQ ID NO: 832545 - DNA, 22 bp, Artificial Sequence
  chemically synthesized
aatcagtggttctcatccctgg

SEQ ID NO: 832546 - DNA, 22 bp, Artificial Sequence
  chemically synthesized
taacgtgcagccagggatgaga

SEQ ID NO: 832547 - DNA, 22 bp, Artificial Sequence
  chemically synthesized
acgtgcagccagggatgagaac

SEQ ID NO: 832548 - DNA, 22 bp, Artificial Sequence
  chemically synthesized
acattaaatcagtggttctcat

SEQ ID NO: 832549 - DNA, 22 bp, Artificial Sequence
  chemically synthesized
atttaatgttagccttttgcac

SEQ ID NO: 832550 - DNA, 22 bp, Artificial Sequence
  chemically synthesized
aagaaggatggggagtgcaaaa

SEQ ID NO: 832551 - DNA, 22 bp, Artificial Sequence
  chemically synthesized
aaagaaggatggggagtgcaaa

SEQ ID NO: 832552 - DNA, 22 bp, Artificial Sequence
  chemically synthesized
aatgttagccttttgcactccc

SEQ ID NO: 832553 - DNA, 22 bp, Artificial Sequence
  chemically synthesized
taaagaaggatggggagtgcaa

SEQ ID NO: 832554 - DNA, 22 bp, Artificial Sequence
  chemically synthesized
atgttagccttttgcactcccc

SEQ ID NO: 832555 - DNA, 22 bp, Artificial Sequence
  chemically synthesized
gagttttaaagaaggatgggga

SEQ ID NO: 832556 - DNA, 22 bp, Artificial Sequence
  chemically synthesized
gccttttgcactccccatcctt

SEQ ID NO: 832557 - DNA, 22 bp, Artificial Sequence
  chemically synthesized
actagagttttaaagaaggatg

SEQ ID NO: 832558 - DNA, 22 bp, Artificial Sequence
  chemically synthesized
ttgcactccccatccttcttta

SEQ ID NO: 832559 - DNA, 22 bp, Artificial Sequence
  chemically synthesized
tgactagagttttaaagaagga

SEQ ID NO: 832560 - DNA, 22 bp, Artificial Sequence
  chemically synthesized
tgcactccccatccttctttaa

SEQ ID NO: 832561 - DNA, 22 bp, Artificial Sequence
  chemically synthesized
gcactccccatccttctttaaa

SEQ ID NO: 832562 - DNA, 22 bp, Artificial Sequence
  chemically synthesized
tctgactagagttttaaagaag

SEQ ID NO: 832563 - DNA, 22 bp, Artificial Sequence
  chemically synthesized
cactccccatccttctttaaaa

SEQ ID NO: 832564 - DNA, 22 bp, Artificial Sequence
  chemically synthesized
ctctgactagagttttaaagaa

SEQ ID NO: 832565 - DNA, 22 bp, Artificial Sequence
  chemically synthesized
cccatccttctttaaaactcta

SEQ ID NO: 832566 - DNA, 22 bp, Artificial Sequence
  chemically synthesized
ctttaaaactctagtcagagaa

SEQ ID NO: 832567 - DNA, 22 bp, Artificial Sequence
  chemically synthesized
tttaaaactctagtcagagaag

SEQ ID NO: 832568 - DNA, 22 bp, Artificial Sequence
  chemically synthesized
taaaactctagtcagagaagtc

SEQ ID NO: 832569 - DNA, 22 bp, Artificial Sequence
  chemically synthesized
aaaactctagtcagagaagtct

SEQ ID NO: 832570 - DNA, 22 bp, Artificial Sequence
  chemically synthesized
aaactctagtcagagaagtctt

SEQ ID NO: 832571 - DNA, 22 bp, Artificial Sequence
  chemically synthesized
aaaaaaaaaaaaaaaaagactt

SEQ ID NO: 832572 - DNA, 22 bp, Artificial Sequence
  chemically synthesized
tagtcagagaagtctttttttt

SEQ ID NO: 832573 - DNA, 22 bp, Artificial Sequence
  chemically synthesized
ttaaaaaaaaaaaaaaaaaaga

SEQ ID NO: 832574 - DNA, 22 bp, Artificial Sequence
  chemically synthesized
gtcagagaagtctttttttttt

SEQ ID NO: 832575 - DNA, 22 bp, Artificial Sequence
  chemically synthesized
cctattaaaaaaaaaaaaaaaa

SEQ ID NO: 832576 - DNA, 22 bp, Artificial Sequence
  chemically synthesized
ttttttttttttttttaatagg

SEQ ID NO: 832577 - DNA, 22 bp, Artificial Sequence
  chemically synthesized
tttttttttttttttaataggg

SEQ ID NO: 832578 - DNA, 22 bp, Artificial Sequence
  chemically synthesized
ttttttttttttttaataggga

SEQ ID NO: 832579 - DNA, 22 bp, Artificial Sequence
  chemically synthesized
tttttttttttttaatagggag

SEQ ID NO: 832580 - DNA, 22 bp, Artificial Sequence
  chemically synthesized
ttttttttttttaatagggagt

SEQ ID NO: 832581 - DNA, 22 bp, Artificial Sequence
  chemically synthesized
tttttttttttaatagggagtc

SEQ ID NO: 832582 - DNA, 22 bp, Artificial Sequence
  chemically synthesized
ttttttttttaatagggagtct

SEQ ID NO: 832583 - DNA, 22 bp, Artificial Sequence
  chemically synthesized
gatgacagagggagactcccta

SEQ ID NO: 832584 - DNA, 22 bp, Artificial Sequence
  chemically synthesized
tttttttttaatagggagtctc

SEQ ID NO: 832585 - DNA, 22 bp, Artificial Sequence
  chemically synthesized
ttttttttaatagggagtctcc

SEQ ID NO: 832586 - DNA, 22 bp, Artificial Sequence
  chemically synthesized
tttttttaatagggagtctccc

SEQ ID NO: 832587 - DNA, 22 bp, Artificial Sequence
  chemically synthesized
ttttttaatagggagtctccct

SEQ ID NO: 832588 - DNA, 22 bp, Artificial Sequence
  chemically synthesized
tttttaatagggagtctccctc

SEQ ID NO: 832589 - DNA, 22 bp, Artificial Sequence
  chemically synthesized
ttttaatagggagtctccctct

SEQ ID NO: 832590 - DNA, 22 bp, Artificial Sequence
  chemically synthesized
agcctggatgacagagggagac

SEQ ID NO: 832591 - DNA, 22 bp, Artificial Sequence
  chemically synthesized
tttaatagggagtctccctctg

SEQ ID NO: 832592 - DNA, 22 bp, Artificial Sequence
  chemically synthesized
cagcctggatgacagagggaga

SEQ ID NO: 832593 - DNA, 22 bp, Artificial Sequence
  chemically synthesized
ttaatagggagtctccctctgt

SEQ ID NO: 832594 - DNA, 22 bp, Artificial Sequence
  chemically synthesized
taatagggagtctccctctgtc

SEQ ID NO: 832595 - DNA, 22 bp, Artificial Sequence
  chemically synthesized
aatagggagtctccctctgtca

SEQ ID NO: 832596 - DNA, 22 bp, Artificial Sequence
  chemically synthesized
atagggagtctccctctgtcat

SEQ ID NO: 832597 - DNA, 22 bp, Artificial Sequence
  chemically synthesized
cacttcagcctggatgacagag

SEQ ID NO: 832598 - DNA, 22 bp, Artificial Sequence
  chemically synthesized
cctctgtcatccaggctgaagt

SEQ ID NO: 832599 - DNA, 22 bp, Artificial Sequence
  chemically synthesized
tgtcatccaggctgaagtgcag

SEQ ID NO: 832600 - DNA, 22 bp, Artificial Sequence
  chemically synthesized
tcatccaggctgaagtgcagtg

SEQ ID NO: 832601 - DNA, 22 bp, Artificial Sequence
  chemically synthesized
aagtgcagtggcaccatcttgg

SEQ ID NO: 832602 - DNA, 22 bp, Artificial Sequence
  chemically synthesized
aacccaagaggcagaggtggca

SEQ ID NO: 832603 - DNA, 22 bp, Artificial Sequence
  chemically synthesized
gaacccaagaggcagaggtggc

SEQ ID NO: 832604 - DNA, 22 bp, Artificial Sequence
  chemically synthesized
ggctcactgccacctctgcctc

SEQ ID NO: 832605 - DNA, 22 bp, Artificial Sequence
  chemically synthesized
gctcactgccacctctgcctct

SEQ ID NO: 832606 - DNA, 22 bp, Artificial Sequence
  chemically synthesized
actgccacctctgcctcttggg

SEQ ID NO: 832607 - DNA, 22 bp, Artificial Sequence
  chemically synthesized
ccacctctgcctcttgggttca

SEQ ID NO: 832608 - DNA, 22 bp, Artificial Sequence
  chemically synthesized
aggcaggagaatagcttgaacc

SEQ ID NO: 832609 - DNA, 22 bp, Artificial Sequence
  chemically synthesized
tgcctcttgggttcaagctatt

SEQ ID NO: 832610 - DNA, 22 bp, Artificial Sequence
  chemically synthesized
cctcttgggttcaagctattct

SEQ ID NO: 832611 - DNA, 22 bp, Artificial Sequence
  chemically synthesized
ttgggttcaagctattctcctg

SEQ ID NO: 832612 - DNA, 22 bp, Artificial Sequence
  chemically synthesized
aggaggctgaggcaggagaata

SEQ ID NO: 832613 - DNA, 22 bp, Artificial Sequence
  chemically synthesized
gggttcaagctattctcctgcc

SEQ ID NO: 832614 - DNA, 22 bp, Artificial Sequence
  chemically synthesized
ggttcaagctattctcctgcct

SEQ ID NO: 832615 - DNA, 22 bp, Artificial Sequence
  chemically synthesized
ctcaggaggctgaggcaggaga

SEQ ID NO: 832616 - DNA, 22 bp, Artificial Sequence
  chemically synthesized
aagctattctcctgcctcagcc

SEQ ID NO: 832617 - DNA, 22 bp, Artificial Sequence
  chemically synthesized
ttctcctgcctcagcctcctga

SEQ ID NO: 832618 - DNA, 22 bp, Artificial Sequence
  chemically synthesized
taatcccagctactcaggaggc

SEQ ID NO: 832619 - DNA, 22 bp, Artificial Sequence
  chemically synthesized
tcctgcctcagcctcctgagta

SEQ ID NO: 832620 - DNA, 22 bp, Artificial Sequence
  chemically synthesized
ctgcctcagcctcctgagtagc

SEQ ID NO: 832621 - DNA, 22 bp, Artificial Sequence
  chemically synthesized
cctcagcctcctgagtagctgg

SEQ ID NO: 832622 - DNA, 22 bp, Artificial Sequence
  chemically synthesized
agcctcctgagtagctgggatt

SEQ ID NO: 832623 - DNA, 22 bp, Artificial Sequence
  chemically synthesized
ctgagtagctgggattacaggc

SEQ ID NO: 832624 - DNA, 22 bp, Artificial Sequence
  chemically synthesized
agtagctgggattacaggcatg

SEQ ID NO: 832625 - DNA, 22 bp, Artificial Sequence
  chemically synthesized
ggcatggtggtgcatgcctgta

SEQ ID NO: 832626 - DNA, 22 bp, Artificial Sequence
  chemically synthesized
ggattacaggcatgcaccacca

SEQ ID NO: 832627 - DNA, 22 bp, Artificial Sequence
  chemically synthesized
caggcatgcaccaccatgccca

SEQ ID NO: 832628 - DNA, 22 bp, Artificial Sequence
  chemically synthesized
aaaatacaaaaaaatagctggg

SEQ ID NO: 832629 - DNA, 22 bp, Artificial Sequence
  chemically synthesized
ctaaaaatacaaaaaaatagct

SEQ ID NO: 832630 - DNA, 22 bp, Artificial Sequence
  chemically synthesized
tactaaaaatacaaaaaaatag

SEQ ID NO: 832631 - DNA, 22 bp, Artificial Sequence
  chemically synthesized
tttttttgtatttttagtagag

SEQ ID NO: 832632 - DNA, 22 bp, Artificial Sequence
  chemically synthesized
atgaaaccccatctctactaaa

SEQ ID NO: 832633 - DNA, 22 bp, Artificial Sequence
  chemically synthesized
gatgaaaccccatctctactaa

SEQ ID NO: 832634 - DNA, 22 bp, Artificial Sequence
  chemically synthesized
ttttgtatttttagtagagatg

SEQ ID NO: 832635 - DNA, 22 bp, Artificial Sequence
  chemically synthesized
tttgtatttttagtagagatgg

SEQ ID NO: 832636 - DNA, 22 bp, Artificial Sequence
  chemically synthesized
ttgtatttttagtagagatggg

SEQ ID NO: 832637 - DNA, 22 bp, Artificial Sequence
  chemically synthesized
tgtatttttagtagagatgggg

SEQ ID NO: 832638 - DNA, 22 bp, Artificial Sequence
  chemically synthesized
gtatttttagtagagatggggt

SEQ ID NO: 832639 - DNA, 22 bp, Artificial Sequence
  chemically synthesized
tatttttagtagagatggggtt

SEQ ID NO: 832640 - DNA, 22 bp, Artificial Sequence
  chemically synthesized
gtcaacttgatgaaaccccatc

SEQ ID NO: 832641 - DNA, 22 bp, Artificial Sequence
  chemically synthesized
ttagtagagatggggtttcatc

SEQ ID NO: 832642 - DNA, 22 bp, Artificial Sequence
  chemically synthesized
tagtagagatggggtttcatca

SEQ ID NO: 832643 - DNA, 22 bp, Artificial Sequence
  chemically synthesized
agtagagatggggtttcatcaa

SEQ ID NO: 832644 - DNA, 22 bp, Artificial Sequence
  chemically synthesized
gtagagatggggtttcatcaag

SEQ ID NO: 832645 - DNA, 22 bp, Artificial Sequence
  chemically synthesized
aagaccagcctggtcaacttga

SEQ ID NO: 832646 - DNA, 22 bp, Artificial Sequence
  chemically synthesized
catcaagttgaccaggctggtc

SEQ ID NO: 832647 - DNA, 22 bp, Artificial Sequence
  chemically synthesized
atcaagttgaccaggctggtct

SEQ ID NO: 832648 - DNA, 22 bp, Artificial Sequence
  chemically synthesized
atgtcaggagttcaagaccagc

SEQ ID NO: 832649 - DNA, 22 bp, Artificial Sequence
  chemically synthesized
gatgtcaggagttcaagaccag

SEQ ID NO: 832650 - DNA, 22 bp, Artificial Sequence
  chemically synthesized
accaggctggtcttgaactcct

SEQ ID NO: 832651 - DNA, 22 bp, Artificial Sequence
  chemically synthesized
gtcttgaactcctgacatcaag

SEQ ID NO: 832652 - DNA, 22 bp, Artificial Sequence
  chemically synthesized
gaggtgggtggaccacttgatg

SEQ ID NO: 832653 - DNA, 22 bp, Artificial Sequence
  chemically synthesized
gaactcctgacatcaagtggtc

SEQ ID NO: 832654 - DNA, 22 bp, Artificial Sequence
  chemically synthesized
tggaggtgggtggaccacttga

SEQ ID NO: 832655 - DNA, 22 bp, Artificial Sequence
  chemically synthesized
aactcctgacatcaagtggtcc

SEQ ID NO: 832656 - DNA, 22 bp, Artificial Sequence
  chemically synthesized
tctggaggtgggtggaccactt

SEQ ID NO: 832657 - DNA, 22 bp, Artificial Sequence
  chemically synthesized
ctctggaggtgggtggaccact

SEQ ID NO: 832658 - DNA, 22 bp, Artificial Sequence
  chemically synthesized
ctgacatcaagtggtccaccca

SEQ ID NO: 832659 - DNA, 22 bp, Artificial Sequence
  chemically synthesized
acatcaagtggtccacccacct

SEQ ID NO: 832660 - DNA, 22 bp, Artificial Sequence
  chemically synthesized
agaagacttctctggaggtggg

SEQ ID NO: 832661 - DNA, 22 bp, Artificial Sequence
  chemically synthesized
cagaagacttctctggaggtgg

SEQ ID NO: 832662 - DNA, 22 bp, Artificial Sequence
  chemically synthesized
atcttcagaagacttctctgga

SEQ ID NO: 832663 - DNA, 22 bp, Artificial Sequence
  chemically synthesized
catcttcagaagacttctctgg

SEQ ID NO: 832664 - DNA, 22 bp, Artificial Sequence
  chemically synthesized
tcatcttcagaagacttctctg

SEQ ID NO: 832665 - DNA, 22 bp, Artificial Sequence
  chemically synthesized
cagagaagtcttctgaagatga

SEQ ID NO: 832666 - DNA, 22 bp, Artificial Sequence
  chemically synthesized
ctgaagatgaaaatcttggtct

SEQ ID NO: 832667 - DNA, 22 bp, Artificial Sequence
  chemically synthesized
ataagtgatgaaagaccaagat

SEQ ID NO: 832668 - DNA, 22 bp, Artificial Sequence
  chemically synthesized
tgaagatgaaaatcttggtctt

SEQ ID NO: 832669 - DNA, 22 bp, Artificial Sequence
  chemically synthesized
aataagtgatgaaagaccaaga

SEQ ID NO: 832670 - DNA, 22 bp, Artificial Sequence
  chemically synthesized
aagatgaaaatcttggtctttc

SEQ ID NO: 832671 - DNA, 22 bp, Artificial Sequence
  chemically synthesized
aggaaatttaataagtgatgaa

SEQ ID NO: 832672 - DNA, 22 bp, Artificial Sequence
  chemically synthesized
ggtctttcatcacttattaaat

SEQ ID NO: 832673 - DNA, 22 bp, Artificial Sequence
  chemically synthesized
gtctttcatcacttattaaatt

SEQ ID NO: 832674 - DNA, 22 bp, Artificial Sequence
  chemically synthesized
tcatcacttattaaatttcctt

SEQ ID NO: 832675 - DNA, 22 bp, Artificial Sequence
  chemically synthesized
catcacttattaaatttcctta

SEQ ID NO: 832676 - DNA, 22 bp, Artificial Sequence
  chemically synthesized
atcacttattaaatttccttaa

SEQ ID NO: 832677 - DNA, 22 bp, Artificial Sequence
  chemically synthesized
attaaatttccttaatgtcatg

SEQ ID NO: 832678 - DNA, 22 bp, Artificial Sequence
  chemically synthesized
ttaaatttccttaatgtcatgc

SEQ ID NO: 832679 - DNA, 22 bp, Artificial Sequence
  chemically synthesized
aatttccttaatgtcatgcctc

SEQ ID NO: 832680 - DNA, 22 bp, Artificial Sequence
  chemically synthesized
ccttaatgtcatgcctcccacc

SEQ ID NO: 832681 - DNA, 22 bp, Artificial Sequence
  chemically synthesized
aaagcagtgtggggtgggaggc

SEQ ID NO: 832682 - DNA, 22 bp, Artificial Sequence
  chemically synthesized
cttaatgtcatgcctcccaccc

SEQ ID NO: 832683 - DNA, 22 bp, Artificial Sequence
  chemically synthesized
aatgtcatgcctcccaccccac

SEQ ID NO: 832684 - DNA, 22 bp, Artificial Sequence
  chemically synthesized
atgtcatgcctcccaccccaca

SEQ ID NO: 832685 - DNA, 22 bp, Artificial Sequence
  chemically synthesized
tcctgaaagcagtgtggggtgg

SEQ ID NO: 832686 - DNA, 22 bp, Artificial Sequence
  chemically synthesized
atactatcctgaaagcagtgtg

SEQ ID NO: 832687 - DNA, 22 bp, Artificial Sequence
  chemically synthesized
aatactatcctgaaagcagtgt

SEQ ID NO: 832688 - DNA, 22 bp, Artificial Sequence
  chemically synthesized
taatactatcctgaaagcagtg

SEQ ID NO: 832689 - DNA, 22 bp, Artificial Sequence
  chemically synthesized
ccaccccacactgctttcagga

SEQ ID NO: 832690 - DNA, 22 bp, Artificial Sequence
  chemically synthesized
ctttcaggatagtattaaaact

SEQ ID NO: 832691 - DNA, 22 bp, Artificial Sequence
  chemically synthesized
taggataggtaaagagttttaa

SEQ ID NO: 832692 - DNA, 22 bp, Artificial Sequence
  chemically synthesized
tcaggatagtattaaaactctt

SEQ ID NO: 832693 - DNA, 22 bp, Artificial Sequence
  chemically synthesized
gtaggataggtaaagagtttta

SEQ ID NO: 832694 - DNA, 22 bp, Artificial Sequence
  chemically synthesized
caggatagtattaaaactcttt

SEQ ID NO: 832695 - DNA, 22 bp, Artificial Sequence
  chemically synthesized
aggatagtattaaaactcttta

SEQ ID NO: 832696 - DNA, 22 bp, Artificial Sequence
  chemically synthesized
taaaagatcttgtaggataggt

SEQ ID NO: 832697 - DNA, 22 bp, Artificial Sequence
  chemically synthesized
aaactctttacctatcctacaa

SEQ ID NO: 832698 - DNA, 22 bp, Artificial Sequence
  chemically synthesized
tttacctatcctacaagatctt

SEQ ID NO: 832699 - DNA, 22 bp, Artificial Sequence
  chemically synthesized
tacctatcctacaagatctttt

SEQ ID NO: 832700 - DNA, 22 bp, Artificial Sequence
  chemically synthesized
acctatcctacaagatctttta

SEQ ID NO: 832701 - DNA, 22 bp, Artificial Sequence
  chemically synthesized
cctatcctacaagatcttttat

SEQ ID NO: 832702 - DNA, 22 bp, Artificial Sequence
  chemically synthesized
tcctacaagatcttttataacg

SEQ ID NO: 832703 - DNA, 22 bp, Artificial Sequence
  chemically synthesized
caagatcttttataacgtggcc

SEQ ID NO: 832704 - DNA, 22 bp, Artificial Sequence
  chemically synthesized
gaaaagtagacaaaggccacgt

SEQ ID NO: 832705 - DNA, 22 bp, Artificial Sequence
  chemically synthesized
ttataacgtggcctttgtctac

SEQ ID NO: 832706 - DNA, 22 bp, Artificial Sequence
  chemically synthesized
tataacgtggcctttgtctact

SEQ ID NO: 832707 - DNA, 22 bp, Artificial Sequence
  chemically synthesized
ataacgtggcctttgtctactt

SEQ ID NO: 832708 - DNA, 22 bp, Artificial Sequence
  chemically synthesized
taacgtggcctttgtctacttt

SEQ ID NO: 832709 - DNA, 22 bp, Artificial Sequence
  chemically synthesized
tgtctacttttctagtttcttg

SEQ ID NO: 832710 - DNA, 22 bp, Artificial Sequence
  chemically synthesized
gtctacttttctagtttcttgg

SEQ ID NO: 832711 - DNA, 22 bp, Artificial Sequence
  chemically synthesized
tctacttttctagtttcttggc

SEQ ID NO: 832712 - DNA, 22 bp, Artificial Sequence
  chemically synthesized
cttttctagtttcttggcttct

SEQ ID NO: 832713 - DNA, 22 bp, Artificial Sequence
  chemically synthesized
ttctagtttcttggcttctgct

SEQ ID NO: 832714 - DNA, 22 bp, Artificial Sequence
  chemically synthesized
tctagtttcttggcttctgctg

SEQ ID NO: 832715 - DNA, 22 bp, Artificial Sequence
  chemically synthesized
ctagtttcttggcttctgctgc

SEQ ID NO: 832716 - DNA, 22 bp, Artificial Sequence
  chemically synthesized
tagtttcttggcttctgctgcc

SEQ ID NO: 832717 - DNA, 22 bp, Artificial Sequence
  chemically synthesized
gtttcttggcttctgctgcctg

SEQ ID NO: 832718 - DNA, 22 bp, Artificial Sequence
  chemically synthesized
cttggcttctgctgcctgttgt

SEQ ID NO: 832719 - DNA, 22 bp, Artificial Sequence
  chemically synthesized
ttggcttctgctgcctgttgtg

SEQ ID NO: 832720 - DNA, 22 bp, Artificial Sequence
  chemically synthesized
gagtataggcatcacaacaggc

SEQ ID NO: 832721 - DNA, 22 bp, Artificial Sequence
  chemically synthesized
ggcttctgctgcctgttgtgat

SEQ ID NO: 832722 - DNA, 22 bp, Artificial Sequence
  chemically synthesized
gcttctgctgcctgttgtgatg

SEQ ID NO: 832723 - DNA, 22 bp, Artificial Sequence
  chemically synthesized
ctgctgcctgttgtgatgccta

SEQ ID NO: 832724 - DNA, 22 bp, Artificial Sequence
  chemically synthesized
tgctgcctgttgtgatgcctat

SEQ ID NO: 832725 - DNA, 22 bp, Artificial Sequence
  chemically synthesized
taaagctggagtataggcatca

SEQ ID NO: 832726 - DNA, 22 bp, Artificial Sequence
  chemically synthesized
ctgcctgttgtgatgcctatac

SEQ ID NO: 832727 - DNA, 22 bp, Artificial Sequence
  chemically synthesized
cctgttgtgatgcctatactcc

SEQ ID NO: 832728 - DNA, 22 bp, Artificial Sequence
  chemically synthesized
tgtagctgtaaagctggagtat

SEQ ID NO: 832729 - DNA, 22 bp, Artificial Sequence
  chemically synthesized
ttgtgatgcctatactccagct

SEQ ID NO: 832730 - DNA, 22 bp, Artificial Sequence
  chemically synthesized
ctgtgtagctgtaaagctggag

SEQ ID NO: 832731 - DNA, 22 bp, Artificial Sequence
  chemically synthesized
tgatgcctatactccagcttta

SEQ ID NO: 832732 - DNA, 22 bp, Artificial Sequence
  chemically synthesized
cctgtgtagctgtaaagctgga

SEQ ID NO: 832733 - DNA, 22 bp, Artificial Sequence
  chemically synthesized
cttcctgtgtagctgtaaagct

SEQ ID NO: 832734 - DNA, 22 bp, Artificial Sequence
  chemically synthesized
tactccagctttacagctacac

SEQ ID NO: 832735 - DNA, 22 bp, Artificial Sequence
  chemically synthesized
gggctccttcctgtgtagctgt

SEQ ID NO: 832736 - DNA, 22 bp, Artificial Sequence
  chemically synthesized
cagctttacagctacacaggaa

SEQ ID NO: 832737 - DNA, 22 bp, Artificial Sequence
  chemically synthesized
tacatacctagggctccttcct

SEQ ID NO: 832738 - DNA, 22 bp, Artificial Sequence
  chemically synthesized
tacagctacacaggaaggagcc

SEQ ID NO: 832739 - DNA, 22 bp, Artificial Sequence
  chemically synthesized
acagctacacaggaaggagccc

SEQ ID NO: 832740 - DNA, 22 bp, Artificial Sequence
  chemically synthesized
cagctacacaggaaggagccct

SEQ ID NO: 832741 - DNA, 22 bp, Artificial Sequence
  chemically synthesized
cacaggaaggagccctaggtat

SEQ ID NO: 832742 - DNA, 22 bp, Artificial Sequence
  chemically synthesized
ggtatgtacaatgttaccacac

SEQ ID NO: 832743 - DNA, 22 bp, Artificial Sequence
  chemically synthesized
gacaaatgtgaggtgtgtggta

SEQ ID NO: 832744 - DNA, 22 bp, Artificial Sequence
  chemically synthesized
agacaaatgtgaggtgtgtggt

SEQ ID NO: 832745 - DNA, 22 bp, Artificial Sequence
  chemically synthesized
ccacacacctcacatttgtcta

SEQ ID NO: 832746 - DNA, 22 bp, Artificial Sequence
  chemically synthesized
acatttgtctaagtatttcaca

SEQ ID NO: 832747 - DNA, 22 bp, Artificial Sequence
  chemically synthesized
gtctaagtatttcacatgtatc

SEQ ID NO: 832748 - DNA, 22 bp, Artificial Sequence
  chemically synthesized
tctaagtatttcacatgtatct

SEQ ID NO: 832749 - DNA, 22 bp, Artificial Sequence
  chemically synthesized
agtatttcacatgtatctcaca

SEQ ID NO: 832750 - DNA, 22 bp, Artificial Sequence
  chemically synthesized
cacatgtatctcacatgtgtct

SEQ ID NO: 832751 - DNA, 22 bp, Artificial Sequence
  chemically synthesized
acatgtatctcacatgtgtcta

SEQ ID NO: 832752 - DNA, 22 bp, Artificial Sequence
  chemically synthesized
taggcagagagaaagcatagac

SEQ ID NO: 832753 - DNA, 22 bp, Artificial Sequence
  chemically synthesized
acatgtgtctatgctttctctc

SEQ ID NO: 832754 - DNA, 22 bp, Artificial Sequence
  chemically synthesized
tgctttctctctgcctacaatg

SEQ ID NO: 832755 - DNA, 22 bp, Artificial Sequence
  chemically synthesized
aaaaggcagagagcattgtagg

SEQ ID NO: 832756 - DNA, 22 bp, Artificial Sequence
  chemically synthesized
tctctctgcctacaatgctctc

SEQ ID NO: 832757 - DNA, 22 bp, Artificial Sequence
  chemically synthesized
ctctctgcctacaatgctctct

SEQ ID NO: 832758 - DNA, 22 bp, Artificial Sequence
  chemically synthesized
tctctgcctacaatgctctctg

SEQ ID NO: 832759 - DNA, 22 bp, Artificial Sequence
  chemically synthesized
caaactgaaaaggcagagagca

SEQ ID NO: 832760 - DNA, 22 bp, Artificial Sequence
  chemically synthesized
tctgcctacaatgctctctgcc

SEQ ID NO: 832761 - DNA, 22 bp, Artificial Sequence
  chemically synthesized
tgcctacaatgctctctgcctt

SEQ ID NO: 832762 - DNA, 22 bp, Artificial Sequence
  chemically synthesized
cctacaatgctctctgcctttt

SEQ ID NO: 832763 - DNA, 22 bp, Artificial Sequence
  chemically synthesized
caatgctctctgccttttcagt

SEQ ID NO: 832764 - DNA, 22 bp, Artificial Sequence
  chemically synthesized
agcagagtgctgcaaactgaaa

SEQ ID NO: 832765 - DNA, 22 bp, Artificial Sequence
  chemically synthesized
gagcagagtgctgcaaactgaa

SEQ ID NO: 832766 - DNA, 22 bp, Artificial Sequence
  chemically synthesized
tgagcagagtgctgcaaactga

SEQ ID NO: 832767 - DNA, 22 bp, Artificial Sequence
  chemically synthesized
ttgagcagagtgctgcaaactg

SEQ ID NO: 832768 - DNA, 22 bp, Artificial Sequence
  chemically synthesized
tctgccttttcagtttgcagca

SEQ ID NO: 832769 - DNA, 22 bp, Artificial Sequence
  chemically synthesized
tgccttttcagtttgcagcact

SEQ ID NO: 832770 - DNA, 22 bp, Artificial Sequence
  chemically synthesized
ccttttcagtttgcagcactct

SEQ ID NO: 832771 - DNA, 22 bp, Artificial Sequence
  chemically synthesized
ttcagtttgcagcactctgctc

SEQ ID NO: 832772 - DNA, 22 bp, Artificial Sequence
  chemically synthesized
tcagtttgcagcactctgctca

SEQ ID NO: 832773 - DNA, 22 bp, Artificial Sequence
  chemically synthesized
cagtttgcagcactctgctcaa

SEQ ID NO: 832774 - DNA, 22 bp, Artificial Sequence
  chemically synthesized
agtttgcagcactctgctcaaa

SEQ ID NO: 832775 - DNA, 22 bp, Artificial Sequence
  chemically synthesized
gtggcagtgacttttgagcaga

SEQ ID NO: 832776 - DNA, 22 bp, Artificial Sequence
  chemically synthesized
actagtggcagtgacttttgag

SEQ ID NO: 832777 - DNA, 22 bp, Artificial Sequence
  chemically synthesized
gcagcactctgctcaaaagtca

SEQ ID NO: 832778 - DNA, 22 bp, Artificial Sequence
  chemically synthesized
cagcactctgctcaaaagtcac

SEQ ID NO: 832779 - DNA, 22 bp, Artificial Sequence
  chemically synthesized
tgctcaaaagtcactgccacta

SEQ ID NO: 832780 - DNA, 22 bp, Artificial Sequence
  chemically synthesized
ctcaaaagtcactgccactagt

SEQ ID NO: 832781 - DNA, 22 bp, Artificial Sequence
  chemically synthesized
tcaggacaaaactgactagtgg

SEQ ID NO: 832782 - DNA, 22 bp, Artificial Sequence
  chemically synthesized
aaaagtcactgccactagtcag

SEQ ID NO: 832783 - DNA, 22 bp, Artificial Sequence
  chemically synthesized
ccactagtcagttttgtcctga

SEQ ID NO: 832784 - DNA, 22 bp, Artificial Sequence
  chemically synthesized
gtcagttttgtcctgataattc

SEQ ID NO: 832785 - DNA, 22 bp, Artificial Sequence
  chemically synthesized
atagggtgaaagggaattatca

SEQ ID NO: 832786 - DNA, 22 bp, Artificial Sequence
  chemically synthesized
gatagggtgaaagggaattatc

SEQ ID NO: 832787 - DNA, 22 bp, Artificial Sequence
  chemically synthesized
tgatagggtgaaagggaattat

SEQ ID NO: 832788 - DNA, 22 bp, Artificial Sequence
  chemically synthesized
tgtcctgataattccctttcac

SEQ ID NO: 832789 - DNA, 22 bp, Artificial Sequence
  chemically synthesized
gtcctgataattccctttcacc

SEQ ID NO: 832790 - DNA, 22 bp, Artificial Sequence
  chemically synthesized
tcctgataattccctttcaccc

SEQ ID NO: 832791 - DNA, 22 bp, Artificial Sequence
  chemically synthesized
ataattccctttcaccctatca

SEQ ID NO: 832792 - DNA, 22 bp, Artificial Sequence
  chemically synthesized
cctttcaccctatcaaagcctt

SEQ ID NO: 832793 - DNA, 22 bp, Artificial Sequence
  chemically synthesized
tcaccctatcaaagccttgttt

SEQ ID NO: 832794 - DNA, 22 bp, Artificial Sequence
  chemically synthesized
caccctatcaaagccttgttta

SEQ ID NO: 832795 - DNA, 22 bp, Artificial Sequence
  chemically synthesized
accctatcaaagccttgtttac

SEQ ID NO: 832796 - DNA, 22 bp, Artificial Sequence
  chemically synthesized
tcaaagccttgtttacgtgcca

SEQ ID NO: 832797 - DNA, 22 bp, Artificial Sequence
  chemically synthesized
acaaggtagcatggaatggcac

SEQ ID NO: 832798 - DNA, 22 bp, Artificial Sequence
  chemically synthesized
gtttacgtgccattccatgcta

SEQ ID NO: 832799 - DNA, 22 bp, Artificial Sequence
  chemically synthesized
tttacgtgccattccatgctac

SEQ ID NO: 832800 - DNA, 22 bp, Artificial Sequence
  chemically synthesized
agaaactcacaaggtagcatgg

SEQ ID NO: 832801 - DNA, 22 bp, Artificial Sequence
  chemically synthesized
gagaaactcacaaggtagcatg

SEQ ID NO: 832802 - DNA, 22 bp, Artificial Sequence
  chemically synthesized
acgtgccattccatgctacctt

SEQ ID NO: 832803 - DNA, 22 bp, Artificial Sequence
  chemically synthesized
cgtgccattccatgctaccttg

SEQ ID NO: 832804 - DNA, 22 bp, Artificial Sequence
  chemically synthesized
tgacttgagaaactcacaaggt

SEQ ID NO: 832805 - DNA, 22 bp, Artificial Sequence
  chemically synthesized
gttatgacttgagaaactcaca

SEQ ID NO: 832806 - DNA, 22 bp, Artificial Sequence
  chemically synthesized
ggttatgacttgagaaactcac

SEQ ID NO: 832807 - DNA, 22 bp, Artificial Sequence
  chemically synthesized
catgctaccttgtgagtttctc

SEQ ID NO: 832808 - DNA, 22 bp, Artificial Sequence
  chemically synthesized
ttggttatgacttgagaaactc

SEQ ID NO: 832809 - DNA, 22 bp, Artificial Sequence
  chemically synthesized
agttcttggttatgacttgaga

SEQ ID NO: 832810 - DNA, 22 bp, Artificial Sequence
  chemically synthesized
ccttgtgagtttctcaagtcat

SEQ ID NO: 832811 - DNA, 22 bp, Artificial Sequence
  chemically synthesized
aagttcttggttatgacttgag

SEQ ID NO: 832812 - DNA, 22 bp, Artificial Sequence
  chemically synthesized
gtgagtttctcaagtcataacc

SEQ ID NO: 832813 - DNA, 22 bp, Artificial Sequence
  chemically synthesized
tgagtttctcaagtcataacca

SEQ ID NO: 832814 - DNA, 22 bp, Artificial Sequence
  chemically synthesized
catgagtacttaagttcttggt

SEQ ID NO: 832815 - DNA, 22 bp, Artificial Sequence
  chemically synthesized
ctcaagtcataaccaagaactt

SEQ ID NO: 832816 - DNA, 22 bp, Artificial Sequence
  chemically synthesized
acatgagtacttaagttcttgg

SEQ ID NO: 832817 - DNA, 22 bp, Artificial Sequence
  chemically synthesized
tcaagtcataaccaagaactta

SEQ ID NO: 832818 - DNA, 22 bp, Artificial Sequence
  chemically synthesized
aagtcataaccaagaacttaag

SEQ ID NO: 832819 - DNA, 22 bp, Artificial Sequence
  chemically synthesized
aagtactcatgtaagtgtcctt

SEQ ID NO: 832820 - DNA, 22 bp, Artificial Sequence
  chemically synthesized
ggcatgggtaggaaggacactt

SEQ ID NO: 832821 - DNA, 22 bp, Artificial Sequence
  chemically synthesized
agtactcatgtaagtgtccttc

SEQ ID NO: 832822 - DNA, 22 bp, Artificial Sequence
  chemically synthesized
aggcatgggtaggaaggacact

SEQ ID NO: 832823 - DNA, 22 bp, Artificial Sequence
  chemically synthesized
cagtttaggcatgggtaggaag

SEQ ID NO: 832824 - DNA, 22 bp, Artificial Sequence
  chemically synthesized
atgtaagtgtccttcctaccca

SEQ ID NO: 832825 - DNA, 22 bp, Artificial Sequence
  chemically synthesized
acagtttaggcatgggtaggaa

SEQ ID NO: 832826 - DNA, 22 bp, Artificial Sequence
  chemically synthesized
tacagtttaggcatgggtagga

SEQ ID NO: 832827 - DNA, 22 bp, Artificial Sequence
  chemically synthesized
ttacagtttaggcatgggtagg

SEQ ID NO: 832828 - DNA, 22 bp, Artificial Sequence
  chemically synthesized
acttttacagtttaggcatggg

SEQ ID NO: 832829 - DNA, 22 bp, Artificial Sequence
  chemically synthesized
cacttttacagtttaggcatgg

SEQ ID NO: 832830 - DNA, 22 bp, Artificial Sequence
  chemically synthesized
tcacttttacagtttaggcatg

SEQ ID NO: 832831 - DNA, 22 bp, Artificial Sequence
  chemically synthesized
cctacccatgcctaaactgtaa

SEQ ID NO: 832832 - DNA, 22 bp, Artificial Sequence
  chemically synthesized
ctacccatgcctaaactgtaaa

SEQ ID NO: 832833 - DNA, 22 bp, Artificial Sequence
  chemically synthesized
tgatgattttcacttttacagt

SEQ ID NO: 832834 - DNA, 22 bp, Artificial Sequence
  chemically synthesized
cccatgcctaaactgtaaaagt

SEQ ID NO: 832835 - DNA, 22 bp, Artificial Sequence
  chemically synthesized
gtgatgattttcacttttacag

SEQ ID NO: 832836 - DNA, 22 bp, Artificial Sequence
  chemically synthesized
catatttgtgatgattttcact

SEQ ID NO: 832837 - DNA, 22 bp, Artificial Sequence
  chemically synthesized
aactgtaaaagtgaaaatcatc

SEQ ID NO: 832838 - DNA, 22 bp, Artificial Sequence
  chemically synthesized
tatattgcatatttgtgatgat

SEQ ID NO: 832839 - DNA, 22 bp, Artificial Sequence
  chemically synthesized
taaaagtgaaaatcatcacaaa

SEQ ID NO: 832840 - DNA, 22 bp, Artificial Sequence
  chemically synthesized
atatattgcatatttgtgatga

SEQ ID NO: 832841 - DNA, 22 bp, Artificial Sequence
  chemically synthesized
tttatatattgcatatttgtga

SEQ ID NO: 832842 - DNA, 22 bp, Artificial Sequence
  chemically synthesized
gtttatatattgcatatttgtg

SEQ ID NO: 832843 - DNA, 22 bp, Artificial Sequence
  chemically synthesized
tgtttatatattgcatatttgt

SEQ ID NO: 832844 - DNA, 22 bp, Artificial Sequence
  chemically synthesized
ttttgtttatatattgcatatt

SEQ ID NO: 832845 - DNA, 22 bp, Artificial Sequence
  chemically synthesized
attttgtttatatattgcatat

SEQ ID NO: 832846 - DNA, 22 bp, Artificial Sequence
  chemically synthesized
aatgtatgtgtttattttgttt

SEQ ID NO: 832847 - DNA, 22 bp, Artificial Sequence
  chemically synthesized
actaaatgtatgtgtttatttt

SEQ ID NO: 832848 - DNA, 22 bp, Artificial Sequence
  chemically synthesized
atagcattgactaaatgtatgt

SEQ ID NO: 832849 - DNA, 22 bp, Artificial Sequence
  chemically synthesized
catagcattgactaaatgtatg

SEQ ID NO: 832850 - DNA, 22 bp, Artificial Sequence
  chemically synthesized
tcatagcattgactaaatgtat

SEQ ID NO: 832851 - DNA, 22 bp, Artificial Sequence
  chemically synthesized
attttcatagcattgactaaat

SEQ ID NO: 832852 - DNA, 22 bp, Artificial Sequence
  chemically synthesized
aattttcatagcattgactaaa

SEQ ID NO: 832853 - DNA, 22 bp, Artificial Sequence
  chemically synthesized
atcacatacttaattttcatag

SEQ ID NO: 832854 - DNA, 22 bp, Artificial Sequence
  chemically synthesized
gatcacatacttaattttcata

SEQ ID NO: 832855 - DNA, 22 bp, Artificial Sequence
  chemically synthesized
agtcaatgctatgaaaattaag

SEQ ID NO: 832856 - DNA, 22 bp, Artificial Sequence
  chemically synthesized
gtcaatgctatgaaaattaagt

SEQ ID NO: 832857 - DNA, 22 bp, Artificial Sequence
  chemically synthesized
aaaacatttgatcacatactta

SEQ ID NO: 832858 - DNA, 22 bp, Artificial Sequence
  chemically synthesized
caaaacatttgatcacatactt

SEQ ID NO: 832859 - DNA, 22 bp, Artificial Sequence
  chemically synthesized
ttcaaaacatttgatcacatac

SEQ ID NO: 832860 - DNA, 22 bp, Artificial Sequence
  chemically synthesized
tgaaaattaagtatgtgatcaa

SEQ ID NO: 832861 - DNA, 22 bp, Artificial Sequence
  chemically synthesized
actcttcaaaacatttgatcac

SEQ ID NO: 832862 - DNA, 22 bp, Artificial Sequence
  chemically synthesized
cactcttcaaaacatttgatca

SEQ ID NO: 832863 - DNA, 22 bp, Artificial Sequence
  chemically synthesized
tcactcttcaaaacatttgatc

SEQ ID NO: 832864 - DNA, 22 bp, Artificial Sequence
  chemically synthesized
agtatgtgatcaaatgttttga

SEQ ID NO: 832865 - DNA, 22 bp, Artificial Sequence
  chemically synthesized
atacaaaagccccattttcact

SEQ ID NO: 832866 - DNA, 22 bp, Artificial Sequence
  chemically synthesized
aatacaaaagccccattttcac

SEQ ID NO: 832867 - DNA, 22 bp, Artificial Sequence
  chemically synthesized
cccttaatacaaaagccccatt

SEQ ID NO: 832868 - DNA, 22 bp, Artificial Sequence
  chemically synthesized
tgaagagtgaaaatggggcttt

SEQ ID NO: 832869 - DNA, 22 bp, Artificial Sequence
  chemically synthesized
ccccttaatacaaaagccccat

SEQ ID NO: 832870 - DNA, 22 bp, Artificial Sequence
  chemically synthesized
gaagagtgaaaatggggctttt

SEQ ID NO: 832871 - DNA, 22 bp, Artificial Sequence
  chemically synthesized
aagagtgaaaatggggcttttg

SEQ ID NO: 832872 - DNA, 22 bp, Artificial Sequence
  chemically synthesized
atcttccccttaatacaaaagc

SEQ ID NO: 832873 - DNA, 22 bp, Artificial Sequence
  chemically synthesized
ctcatcttccccttaatacaaa

SEQ ID NO: 832874 - DNA, 22 bp, Artificial Sequence
  chemically synthesized
cctcatcttccccttaatacaa

SEQ ID NO: 832875 - DNA, 22 bp, Artificial Sequence
  chemically synthesized
atttcctcatcttccccttaat

SEQ ID NO: 832876 - DNA, 22 bp, Artificial Sequence
  chemically synthesized
ttgtattaaggggaagatgagg

SEQ ID NO: 832877 - DNA, 22 bp, Artificial Sequence
  chemically synthesized
atcaattcatttcctcatcttc

SEQ ID NO: 832878 - DNA, 22 bp, Artificial Sequence
  chemically synthesized
tgtattaaggggaagatgagga

SEQ ID NO: 832879 - DNA, 22 bp, Artificial Sequence
  chemically synthesized
catcaattcatttcctcatctt

SEQ ID NO: 832880 - DNA, 22 bp, Artificial Sequence
  chemically synthesized
gtattaaggggaagatgaggaa

SEQ ID NO: 832881 - DNA, 22 bp, Artificial Sequence
  chemically synthesized
tattaaggggaagatgaggaaa

SEQ ID NO: 832882 - DNA, 22 bp, Artificial Sequence
  chemically synthesized
cacttcatcaattcatttcctc

SEQ ID NO: 832883 - DNA, 22 bp, Artificial Sequence
  chemically synthesized
aggggaagatgaggaaatgaat

SEQ ID NO: 832884 - DNA, 22 bp, Artificial Sequence
  chemically synthesized
aggctacacttcatcaattcat

SEQ ID NO: 832885 - DNA, 22 bp, Artificial Sequence
  chemically synthesized
aagaaatcagttcaggctacac

SEQ ID NO: 832886 - DNA, 22 bp, Artificial Sequence
  chemically synthesized
gaagaaatcagttcaggctaca

SEQ ID NO: 832887 - DNA, 22 bp, Artificial Sequence
  chemically synthesized
atgaagtgtagcctgaactgat

SEQ ID NO: 832888 - DNA, 22 bp, Artificial Sequence
  chemically synthesized
gagaagcatttgaagaaatcag

SEQ ID NO: 832889 - DNA, 22 bp, Artificial Sequence
  chemically synthesized
tggagaagcatttgaagaaatc

SEQ ID NO: 832890 - DNA, 22 bp, Artificial Sequence
  chemically synthesized
ctggagaagcatttgaagaaat

SEQ ID NO: 832891 - DNA, 22 bp, Artificial Sequence
  chemically synthesized
tctggagaagcatttgaagaaa

SEQ ID NO: 832892 - DNA, 22 bp, Artificial Sequence
  chemically synthesized
ttctggagaagcatttgaagaa

SEQ ID NO: 832893 - DNA, 22 bp, Artificial Sequence
  chemically synthesized
cttttctggagaagcatttgaa

SEQ ID NO: 832894 - DNA, 22 bp, Artificial Sequence
  chemically synthesized
gcttttctggagaagcatttga

SEQ ID NO: 832895 - DNA, 22 bp, Artificial Sequence
  chemically synthesized
aactgatttcttcaaatgcttc

SEQ ID NO: 832896 - DNA, 22 bp, Artificial Sequence
  chemically synthesized
tgcttttctggagaagcatttg

SEQ ID NO: 832897 - DNA, 22 bp, Artificial Sequence
  chemically synthesized
ttgcttttctggagaagcattt

SEQ ID NO: 832898 - DNA, 22 bp, Artificial Sequence
  chemically synthesized
tttgcttttctggagaagcatt

SEQ ID NO: 832899 - DNA, 22 bp, Artificial Sequence
  chemically synthesized
tttttgcttttctggagaagca

SEQ ID NO: 832900 - DNA, 22 bp, Artificial Sequence
  chemically synthesized
atttcttcaaatgcttctccag

SEQ ID NO: 832901 - DNA, 22 bp, Artificial Sequence
  chemically synthesized
ctctttttgcttttctggagaa

SEQ ID NO: 832902 - DNA, 22 bp, Artificial Sequence
  chemically synthesized
cttcaaatgcttctccagaaaa

SEQ ID NO: 832903 - DNA, 22 bp, Artificial Sequence
  chemically synthesized
ttcaaatgcttctccagaaaag

SEQ ID NO: 832904 - DNA, 22 bp, Artificial Sequence
  chemically synthesized
ttcctctttttgcttttctgga

SEQ ID NO: 832905 - DNA, 22 bp, Artificial Sequence
  chemically synthesized
caaatgcttctccagaaaagca

SEQ ID NO: 832906 - DNA, 22 bp, Artificial Sequence
  chemically synthesized
aaatgcttctccagaaaagcaa

SEQ ID NO: 832907 - DNA, 22 bp, Artificial Sequence
  chemically synthesized
ttattcctctttttgcttttct

SEQ ID NO: 832908 - DNA, 22 bp, Artificial Sequence
  chemically synthesized
attattcctctttttgcttttc

SEQ ID NO: 832909 - DNA, 22 bp, Artificial Sequence
  chemically synthesized
tattattcctctttttgctttt

SEQ ID NO: 832910 - DNA, 22 bp, Artificial Sequence
  chemically synthesized
ttattattcctctttttgcttt

SEQ ID NO: 832911 - DNA, 22 bp, Artificial Sequence
  chemically synthesized
tttattattcctctttttgctt

SEQ ID NO: 832912 - DNA, 22 bp, Artificial Sequence
  chemically synthesized
ttttattattcctctttttgct

SEQ ID NO: 832913 - DNA, 22 bp, Artificial Sequence
  chemically synthesized
tttttattattcctctttttgc

SEQ ID NO: 832914 - DNA, 22 bp, Artificial Sequence
  chemically synthesized
ttttttattattcctctttttg

SEQ ID NO: 832915 - DNA, 22 bp, Artificial Sequence
  chemically synthesized
ctccagaaaagcaaaaagagga

SEQ ID NO: 832916 - DNA, 22 bp, Artificial Sequence
  chemically synthesized
tttttttattattcctcttttt

SEQ ID NO: 832917 - DNA, 22 bp, Artificial Sequence
  chemically synthesized
tccagaaaagcaaaaagaggaa

SEQ ID NO: 832918 - DNA, 22 bp, Artificial Sequence
  chemically synthesized
cagaaaagcaaaaagaggaata

SEQ ID NO: 832919 - DNA, 22 bp, Artificial Sequence
  chemically synthesized
atctttttttttattattcctc

SEQ ID NO: 832920 - DNA, 22 bp, Artificial Sequence
  chemically synthesized
attgatctttttttttattatt

SEQ ID NO: 832921 - DNA, 22 bp, Artificial Sequence
  chemically synthesized
aatgaaccagaattcattgatc

SEQ ID NO: 832922 - DNA, 22 bp, Artificial Sequence
  chemically synthesized
ataatatagtatgtatgttaaa

SEQ ID NO: 832923 - DNA, 22 bp, Artificial Sequence
  chemically synthesized
aataatatagtatgtatgttaa

SEQ ID NO: 832924 - DNA, 22 bp, Artificial Sequence
  chemically synthesized
tggttcatttaacatacatact

SEQ ID NO: 832925 - DNA, 22 bp, Artificial Sequence
  chemically synthesized
tcttaataatatagtatgtatg

SEQ ID NO: 832926 - DNA, 22 bp, Artificial Sequence
  chemically synthesized
gtcttaataatatagtatgtat

SEQ ID NO: 832927 - DNA, 22 bp, Artificial Sequence
  chemically synthesized
gttcatttaacatacatactat

SEQ ID NO: 832928 - DNA, 22 bp, Artificial Sequence
  chemically synthesized
atttaacatacatactatatta

SEQ ID NO: 832929 - DNA, 22 bp, Artificial Sequence
  chemically synthesized
tgtttgtcttaataatatagta

SEQ ID NO: 832930 - DNA, 22 bp, Artificial Sequence
  chemically synthesized
aacatacatactatattattaa

SEQ ID NO: 832931 - DNA, 22 bp, Artificial Sequence
  chemically synthesized
acatacatactatattattaag

SEQ ID NO: 832932 - DNA, 22 bp, Artificial Sequence
  chemically synthesized
atcctgtgtttgtcttaataat

SEQ ID NO: 832933 - DNA, 22 bp, Artificial Sequence
  chemically synthesized
actgatcctgtgtttgtcttaa

SEQ ID NO: 832934 - DNA, 22 bp, Artificial Sequence
  chemically synthesized
cactgatcctgtgtttgtctta

SEQ ID NO: 832935 - DNA, 22 bp, Artificial Sequence
  chemically synthesized
tcactgatcctgtgtttgtctt

SEQ ID NO: 832936 - DNA, 22 bp, Artificial Sequence
  chemically synthesized
ttttcactgatcctgtgtttgt

SEQ ID NO: 832937 - DNA, 22 bp, Artificial Sequence
  chemically synthesized
attttcactgatcctgtgtttg

SEQ ID NO: 832938 - DNA, 22 bp, Artificial Sequence
  chemically synthesized
tattattaagacaaacacagga

SEQ ID NO: 832939 - DNA, 22 bp, Artificial Sequence
  chemically synthesized
tattttcactgatcctgtgttt

SEQ ID NO: 832940 - DNA, 22 bp, Artificial Sequence
  chemically synthesized
ttaagacaaacacaggatcagt

SEQ ID NO: 832941 - DNA, 22 bp, Artificial Sequence
  chemically synthesized
agacaaacacaggatcagtgaa

SEQ ID NO: 832942 - DNA, 22 bp, Artificial Sequence
  chemically synthesized
aaatatattttattttcactga

SEQ ID NO: 832943 - DNA, 22 bp, Artificial Sequence
  chemically synthesized
gtctaaaatatattttattttc

SEQ ID NO: 832944 - DNA, 22 bp, Artificial Sequence
  chemically synthesized
agtctaaaatatattttatttt

SEQ ID NO: 832945 - DNA, 22 bp, Artificial Sequence
  chemically synthesized
tagtctaaaatatattttattt

SEQ ID NO: 832946 - DNA, 22 bp, Artificial Sequence
  chemically synthesized
ccagcattttagtctaaaatat

SEQ ID NO: 832947 - DNA, 22 bp, Artificial Sequence
  chemically synthesized
taccagcattttagtctaaaat

SEQ ID NO: 832948 - DNA, 22 bp, Artificial Sequence
  chemically synthesized
ctaccagcattttagtctaaaa

SEQ ID NO: 832949 - DNA, 22 bp, Artificial Sequence
  chemically synthesized
tctaccagcattttagtctaaa

SEQ ID NO: 832950 - DNA, 22 bp, Artificial Sequence
  chemically synthesized
ttctaccagcattttagtctaa

SEQ ID NO: 832951 - DNA, 22 bp, Artificial Sequence
  chemically synthesized
gtttttctaccagcattttagt

SEQ ID NO: 832952 - DNA, 22 bp, Artificial Sequence
  chemically synthesized
ggtttttctaccagcattttag

SEQ ID NO: 832953 - DNA, 22 bp, Artificial Sequence
  chemically synthesized
tggtttttctaccagcatttta

SEQ ID NO: 832954 - DNA, 22 bp, Artificial Sequence
  chemically synthesized
ttggtttttctaccagcatttt

SEQ ID NO: 832955 - DNA, 22 bp, Artificial Sequence
  chemically synthesized
tttggtttttctaccagcattt

SEQ ID NO: 832956 - DNA, 22 bp, Artificial Sequence
  chemically synthesized
ctttttggtttttctaccagca

SEQ ID NO: 832957 - DNA, 22 bp, Artificial Sequence
  chemically synthesized
cctttttggtttttctaccagc

SEQ ID NO: 832958 - DNA, 22 bp, Artificial Sequence
  chemically synthesized
tagactaaaatgctggtagaaa

SEQ ID NO: 832959 - DNA, 22 bp, Artificial Sequence
  chemically synthesized
agactaaaatgctggtagaaaa

SEQ ID NO: 832960 - DNA, 22 bp, Artificial Sequence
  chemically synthesized
gactaaaatgctggtagaaaaa

SEQ ID NO: 832961 - DNA, 22 bp, Artificial Sequence
  chemically synthesized
cttcctttttggtttttctacc

SEQ ID NO: 832962 - DNA, 22 bp, Artificial Sequence
  chemically synthesized
aaatgctggtagaaaaaccaaa

SEQ ID NO: 832963 - DNA, 22 bp, Artificial Sequence
  chemically synthesized
atactccttcctttttggtttt

SEQ ID NO: 832964 - DNA, 22 bp, Artificial Sequence
  chemically synthesized
catactccttcctttttggttt

SEQ ID NO: 832965 - DNA, 22 bp, Artificial Sequence
  chemically synthesized
tcatactccttcctttttggtt

SEQ ID NO: 832966 - DNA, 22 bp, Artificial Sequence
  chemically synthesized
gtagaaaaaccaaaaaggaagg

SEQ ID NO: 832967 - DNA, 22 bp, Artificial Sequence
  chemically synthesized
tgtctttcatactccttccttt

SEQ ID NO: 832968 - DNA, 22 bp, Artificial Sequence
  chemically synthesized
atgtctttcatactccttcctt

SEQ ID NO: 832969 - DNA, 22 bp, Artificial Sequence
  chemically synthesized
ggaagggtaacttatgtctttc

SEQ ID NO: 832970 - DNA, 22 bp, Artificial Sequence
  chemically synthesized
aaaatggagcctaggaagggta

SEQ ID NO: 832971 - DNA, 22 bp, Artificial Sequence
  chemically synthesized
cccttcctaggctccattttca

SEQ ID NO: 832972 - DNA, 22 bp, Artificial Sequence
  chemically synthesized
aacaatcaaaaatatctgaaaa

SEQ ID NO: 832973 - DNA, 22 bp, Artificial Sequence
  chemically synthesized
cctaggctccattttcagatat

SEQ ID NO: 832974 - DNA, 22 bp, Artificial Sequence
  chemically synthesized
aaacaatcaaaaatatctgaaa

SEQ ID NO: 832975 - DNA, 22 bp, Artificial Sequence
  chemically synthesized
ctaggctccattttcagatatt

SEQ ID NO: 832976 - DNA, 22 bp, Artificial Sequence
  chemically synthesized
ggctccattttcagatattttt

SEQ ID NO: 832977 - DNA, 22 bp, Artificial Sequence
  chemically synthesized
aagtttaaacaatcaaaaatat

SEQ ID NO: 832978 - DNA, 22 bp, Artificial Sequence
  chemically synthesized
cattttcagatatttttgattg

SEQ ID NO: 832979 - DNA, 22 bp, Artificial Sequence
  chemically synthesized
ctgaagtttaaacaatcaaaaa

SEQ ID NO: 832980 - DNA, 22 bp, Artificial Sequence
  chemically synthesized
tcagatatttttgattgtttaa

SEQ ID NO: 832981 - DNA, 22 bp, Artificial Sequence
  chemically synthesized
cagatatttttgattgtttaaa

SEQ ID NO: 832982 - DNA, 22 bp, Artificial Sequence
  chemically synthesized
agatatttttgattgtttaaac

SEQ ID NO: 832983 - DNA, 22 bp, Artificial Sequence
  chemically synthesized
atgaattgctgaagtttaaaca

SEQ ID NO: 832984 - DNA, 22 bp, Artificial Sequence
  chemically synthesized
ttgattgtttaaacttcagcaa

SEQ ID NO: 832985 - DNA, 22 bp, Artificial Sequence
  chemically synthesized
tgattgtttaaacttcagcaat

SEQ ID NO: 832986 - DNA, 22 bp, Artificial Sequence
  chemically synthesized
taacattcatgaattgctgaag

SEQ ID NO: 832987 - DNA, 22 bp, Artificial Sequence
  chemically synthesized
gattgtttaaacttcagcaatt

SEQ ID NO: 832988 - DNA, 22 bp, Artificial Sequence
  chemically synthesized
attgtttaaacttcagcaattc

SEQ ID NO: 832989 - DNA, 22 bp, Artificial Sequence
  chemically synthesized
ctataacattcatgaattgctg

SEQ ID NO: 832990 - DNA, 22 bp, Artificial Sequence
  chemically synthesized
actataacattcatgaattgct

SEQ ID NO: 832991 - DNA, 22 bp, Artificial Sequence
  chemically synthesized
tttaaacttcagcaattcatga

SEQ ID NO: 832992 - DNA, 22 bp, Artificial Sequence
  chemically synthesized
aaacttcagcaattcatgaatg

SEQ ID NO: 832993 - DNA, 22 bp, Artificial Sequence
  chemically synthesized
aacttcagcaattcatgaatgt

SEQ ID NO: 832994 - DNA, 22 bp, Artificial Sequence
  chemically synthesized
aaatcatttactataacattca

SEQ ID NO: 832995 - DNA, 22 bp, Artificial Sequence
  chemically synthesized
caaatcatttactataacattc

SEQ ID NO: 832996 - DNA, 22 bp, Artificial Sequence
  chemically synthesized
cagcaattcatgaatgttatag

SEQ ID NO: 832997 - DNA, 22 bp, Artificial Sequence
  chemically synthesized
tcaaatcatttactataacatt

SEQ ID NO: 832998 - DNA, 22 bp, Artificial Sequence
  chemically synthesized
agcaattcatgaatgttatagt

SEQ ID NO: 832999 - DNA, 22 bp, Artificial Sequence
  chemically synthesized
ttcaaatcatttactataacat

SEQ ID NO: 833000 - DNA, 22 bp, Artificial Sequence
  chemically synthesized
cccatttttcaaatcatttact

SEQ ID NO: 833001 - DNA, 22 bp, Artificial Sequence
  chemically synthesized
atgaatgttatagtaaatgatt

SEQ ID NO: 833002 - DNA, 22 bp, Artificial Sequence
  chemically synthesized
tctccccatttttcaaatcatt

SEQ ID NO: 833003 - DNA, 22 bp, Artificial Sequence
  chemically synthesized
atctccccatttttcaaatcat

SEQ ID NO: 833004 - DNA, 22 bp, Artificial Sequence
  chemically synthesized
tatctccccatttttcaaatca

SEQ ID NO: 833005 - DNA, 22 bp, Artificial Sequence
  chemically synthesized
ttatctccccatttttcaaatc

SEQ ID NO: 833006 - DNA, 22 bp, Artificial Sequence
  chemically synthesized
cttttatctccccatttttcaa

SEQ ID NO: 833007 - DNA, 22 bp, Artificial Sequence
  chemically synthesized
tagtaaatgatttgaaaaatgg

SEQ ID NO: 833008 - DNA, 22 bp, Artificial Sequence
  chemically synthesized
gaaaaatggggagataaaagta

SEQ ID NO: 833009 - DNA, 22 bp, Artificial Sequence
  chemically synthesized
aaaaatggggagataaaagtaa

SEQ ID NO: 833010 - DNA, 22 bp, Artificial Sequence
  chemically synthesized
gaacgaggaaagaattactttt

SEQ ID NO: 833011 - DNA, 22 bp, Artificial Sequence
  chemically synthesized
ttggaacgaggaaagaattact

SEQ ID NO: 833012 - DNA, 22 bp, Artificial Sequence
  chemically synthesized
aatggggattattggaacgagg

SEQ ID NO: 833013 - DNA, 22 bp, Artificial Sequence
  chemically synthesized
gaatggggattattggaacgag

SEQ ID NO: 833014 - DNA, 22 bp, Artificial Sequence
  chemically synthesized
cttgaatggggattattggaac

SEQ ID NO: 833015 - DNA, 22 bp, Artificial Sequence
  chemically synthesized
ttacttgaatggggattattgg

SEQ ID NO: 833016 - DNA, 22 bp, Artificial Sequence
  chemically synthesized
gttacttgaatggggattattg

SEQ ID NO: 833017 - DNA, 22 bp, Artificial Sequence
  chemically synthesized
tttcctcgttccaataatcccc

SEQ ID NO: 833018 - DNA, 22 bp, Artificial Sequence
  chemically synthesized
tgttacttgaatggggattatt

SEQ ID NO: 833019 - DNA, 22 bp, Artificial Sequence
  chemically synthesized
tcctcgttccaataatccccat

SEQ ID NO: 833020 - DNA, 22 bp, Artificial Sequence
  chemically synthesized
cctcgttccaataatccccatt

SEQ ID NO: 833021 - DNA, 22 bp, Artificial Sequence
  chemically synthesized
ttttgttacttgaatggggatt

SEQ ID NO: 833022 - DNA, 22 bp, Artificial Sequence
  chemically synthesized
ctcgttccaataatccccattc

SEQ ID NO: 833023 - DNA, 22 bp, Artificial Sequence
  chemically synthesized
gttccaataatccccattcaag

SEQ ID NO: 833024 - DNA, 22 bp, Artificial Sequence
  chemically synthesized
agctgttttgttacttgaatgg

SEQ ID NO: 833025 - DNA, 22 bp, Artificial Sequence
  chemically synthesized
caataatccccattcaagtaac

SEQ ID NO: 833026 - DNA, 22 bp, Artificial Sequence
  chemically synthesized
tattaagctgttttgttacttg

SEQ ID NO: 833027 - DNA, 22 bp, Artificial Sequence
  chemically synthesized
gtattaagctgttttgttactt

SEQ ID NO: 833028 - DNA, 22 bp, Artificial Sequence
  chemically synthesized
tgtattaagctgttttgttact

SEQ ID NO: 833029 - DNA, 22 bp, Artificial Sequence
  chemically synthesized
catattttgtattaagctgttt

SEQ ID NO: 833030 - DNA, 22 bp, Artificial Sequence
  chemically synthesized
acatattttgtattaagctgtt

SEQ ID NO: 833031 - DNA, 22 bp, Artificial Sequence
  chemically synthesized
aagtaacaaaacagcttaatac

SEQ ID NO: 833032 - DNA, 22 bp, Artificial Sequence
  chemically synthesized
aaaataaatttacatattttgt

SEQ ID NO: 833033 - DNA, 22 bp, Artificial Sequence
  chemically synthesized
aatacaaaatatgtaaatttat

SEQ ID NO: 833034 - DNA, 22 bp, Artificial Sequence
  chemically synthesized
atacaaaatatgtaaatttatt

SEQ ID NO: 833035 - DNA, 22 bp, Artificial Sequence
  chemically synthesized
ggataagtcatcagaaaaaaat

SEQ ID NO: 833036 - DNA, 22 bp, Artificial Sequence
  chemically synthesized
aggataagtcatcagaaaaaaa

SEQ ID NO: 833037 - DNA, 22 bp, Artificial Sequence
  chemically synthesized
taggataagtcatcagaaaaaa

SEQ ID NO: 833038 - DNA, 22 bp, Artificial Sequence
  chemically synthesized
ttaggataagtcatcagaaaaa

SEQ ID NO: 833039 - DNA, 22 bp, Artificial Sequence
  chemically synthesized
atttttaatttttttctgatga

SEQ ID NO: 833040 - DNA, 22 bp, Artificial Sequence
  chemically synthesized
tttttaatttttttctgatgac

SEQ ID NO: 833041 - DNA, 22 bp, Artificial Sequence
  chemically synthesized
ttaatttttttctgatgactta

SEQ ID NO: 833042 - DNA, 22 bp, Artificial Sequence
  chemically synthesized
taatttttttctgatgacttat

SEQ ID NO: 833043 - DNA, 22 bp, Artificial Sequence
  chemically synthesized
tagatttttaggataagtcatc

SEQ ID NO: 833044 - DNA, 22 bp, Artificial Sequence
  chemically synthesized
aatttttttctgatgacttatc

SEQ ID NO: 833045 - DNA, 22 bp, Artificial Sequence
  chemically synthesized
gtagatttttaggataagtcat

SEQ ID NO: 833046 - DNA, 22 bp, Artificial Sequence
  chemically synthesized
atttttttctgatgacttatcc

SEQ ID NO: 833047 - DNA, 22 bp, Artificial Sequence
  chemically synthesized
tgtagatttttaggataagtca

SEQ ID NO: 833048 - DNA, 22 bp, Artificial Sequence
  chemically synthesized
ttttctgatgacttatcctaaa

SEQ ID NO: 833049 - DNA, 22 bp, Artificial Sequence
  chemically synthesized
tttctgatgacttatcctaaaa

SEQ ID NO: 833050 - DNA, 22 bp, Artificial Sequence
  chemically synthesized
ttctgatgacttatcctaaaaa

SEQ ID NO: 833051 - DNA, 22 bp, Artificial Sequence
  chemically synthesized
tctgatgacttatcctaaaaat

SEQ ID NO: 833052 - DNA, 22 bp, Artificial Sequence
  chemically synthesized
catattttgtagatttttagga

SEQ ID NO: 833053 - DNA, 22 bp, Artificial Sequence
  chemically synthesized
ctgatgacttatcctaaaaatc

SEQ ID NO: 833054 - DNA, 22 bp, Artificial Sequence
  chemically synthesized
acatattttgtagatttttagg

SEQ ID NO: 833055 - DNA, 22 bp, Artificial Sequence
  chemically synthesized
tgatgacttatcctaaaaatct

SEQ ID NO: 833056 - DNA, 22 bp, Artificial Sequence
  chemically synthesized
atgacttatcctaaaaatctac

SEQ ID NO: 833057 - DNA, 22 bp, Artificial Sequence
  chemically synthesized
atttacatattttgtagatttt

SEQ ID NO: 833058 - DNA, 22 bp, Artificial Sequence
  chemically synthesized
atcctaaaaatctacaaaatat

SEQ ID NO: 833059 - DNA, 22 bp, Artificial Sequence
  chemically synthesized
tcctaaaaatctacaaaatatg

SEQ ID NO: 833060 - DNA, 22 bp, Artificial Sequence
  chemically synthesized
aaagttcatttacatattttgt

SEQ ID NO: 833061 - DNA, 22 bp, Artificial Sequence
  chemically synthesized
aaaagttcatttacatattttg

SEQ ID NO: 833062 - DNA, 22 bp, Artificial Sequence
  chemically synthesized
taaaagttcatttacatatttt

SEQ ID NO: 833063 - DNA, 22 bp, Artificial Sequence
  chemically synthesized
aaaatctacaaaatatgtaaat

SEQ ID NO: 833064 - DNA, 22 bp, Artificial Sequence
  chemically synthesized
attttaaaagttcatttacata

SEQ ID NO: 833065 - DNA, 22 bp, Artificial Sequence
  chemically synthesized
tactaattttaaaagttcattt

SEQ ID NO: 833066 - DNA, 22 bp, Artificial Sequence
  chemically synthesized
caaaatatgtaaatgaactttt

SEQ ID NO: 833067 - DNA, 22 bp, Artificial Sequence
  chemically synthesized
ctatactaattttaaaagttca

SEQ ID NO: 833068 - DNA, 22 bp, Artificial Sequence
  chemically synthesized
taagagttcctatactaatttt

SEQ ID NO: 833069 - DNA, 22 bp, Artificial Sequence
  chemically synthesized
ttgtaagagttcctatactaat

SEQ ID NO: 833070 - DNA, 22 bp, Artificial Sequence
  chemically synthesized
tactattgtaagagttcctata

SEQ ID NO: 833071 - DNA, 22 bp, Artificial Sequence
  chemically synthesized
ttaaaattagtataggaactct

SEQ ID NO: 833072 - DNA, 22 bp, Artificial Sequence
  chemically synthesized
taaaattagtataggaactctt

SEQ ID NO: 833073 - DNA, 22 bp, Artificial Sequence
  chemically synthesized
ctgtactattgtaagagttcct

SEQ ID NO: 833074 - DNA, 22 bp, Artificial Sequence
  chemically synthesized
aaaattagtataggaactctta

SEQ ID NO: 833075 - DNA, 22 bp, Artificial Sequence
  chemically synthesized
aaattagtataggaactcttac

SEQ ID NO: 833076 - DNA, 22 bp, Artificial Sequence
  chemically synthesized
gtataggaactcttacaatagt

SEQ ID NO: 833077 - DNA, 22 bp, Artificial Sequence
  chemically synthesized
aggagctgctgtactattgtaa

SEQ ID NO: 833078 - DNA, 22 bp, Artificial Sequence
  chemically synthesized
aaggagctgctgtactattgta

SEQ ID NO: 833079 - DNA, 22 bp, Artificial Sequence
  chemically synthesized
catttaaggagctgctgtacta

SEQ ID NO: 833080 - DNA, 22 bp, Artificial Sequence
  chemically synthesized
ttacaatagtacagcagctcct

SEQ ID NO: 833081 - DNA, 22 bp, Artificial Sequence
  chemically synthesized
acaatagtacagcagctcctta

SEQ ID NO: 833082 - DNA, 22 bp, Artificial Sequence
  chemically synthesized
caatagtacagcagctccttaa

SEQ ID NO: 833083 - DNA, 22 bp, Artificial Sequence
  chemically synthesized
ccataaacccaagcattgcatt

SEQ ID NO: 833084 - DNA, 22 bp, Artificial Sequence
  chemically synthesized
cccataaacccaagcattgcat

SEQ ID NO: 833085 - DNA, 22 bp, Artificial Sequence
  chemically synthesized
tttcccataaacccaagcattg

SEQ ID NO: 833086 - DNA, 22 bp, Artificial Sequence
  chemically synthesized
gtttcccataaacccaagcatt

SEQ ID NO: 833087 - DNA, 22 bp, Artificial Sequence
  chemically synthesized
tgtttcccataaacccaagcat

SEQ ID NO: 833088 - DNA, 22 bp, Artificial Sequence
  chemically synthesized
ttgtttcccataaacccaagca

SEQ ID NO: 833089 - DNA, 22 bp, Artificial Sequence
  chemically synthesized
cttaaatgcaatgcttgggttt

SEQ ID NO: 833090 - DNA, 22 bp, Artificial Sequence
  chemically synthesized
tttgtttcccataaacccaagc

SEQ ID NO: 833091 - DNA, 22 bp, Artificial Sequence
  chemically synthesized
aaatgcaatgcttgggtttatg

SEQ ID NO: 833092 - DNA, 22 bp, Artificial Sequence
  chemically synthesized
aatgcaatgcttgggtttatgg

SEQ ID NO: 833093 - DNA, 22 bp, Artificial Sequence
  chemically synthesized
acagagtgttttttgtttccca

SEQ ID NO: 833094 - DNA, 22 bp, Artificial Sequence
  chemically synthesized
gggtttatgggaaacaaaaaac

SEQ ID NO: 833095 - DNA, 22 bp, Artificial Sequence
  chemically synthesized
ggtttatgggaaacaaaaaaca

SEQ ID NO: 833096 - DNA, 22 bp, Artificial Sequence
  chemically synthesized
atgggaaacaaaaaacactctg

SEQ ID NO: 833097 - DNA, 22 bp, Artificial Sequence
  chemically synthesized
tgggaaacaaaaaacactctgt

SEQ ID NO: 833098 - DNA, 22 bp, Artificial Sequence
  chemically synthesized
tgtcaattgctcccactgtttt

SEQ ID NO: 833099 - DNA, 22 bp, Artificial Sequence
  chemically synthesized
caggaggtaaatgaaaacagtg

SEQ ID NO: 833100 - DNA, 22 bp, Artificial Sequence
  chemically synthesized
tcaattgctcccactgttttca

SEQ ID NO: 833101 - DNA, 22 bp, Artificial Sequence
  chemically synthesized
ccaggaggtaaatgaaaacagt

SEQ ID NO: 833102 - DNA, 22 bp, Artificial Sequence
  chemically synthesized
tccaggaggtaaatgaaaacag

SEQ ID NO: 833103 - DNA, 22 bp, Artificial Sequence
  chemically synthesized
ctcccactgttttcatttacct

SEQ ID NO: 833104 - DNA, 22 bp, Artificial Sequence
  chemically synthesized
tgattttccaggaggtaaatga

SEQ ID NO: 833105 - DNA, 22 bp, Artificial Sequence
  chemically synthesized
ccactgttttcatttacctcct

SEQ ID NO: 833106 - DNA, 22 bp, Artificial Sequence
  chemically synthesized
ttttcatttacctcctggaaaa

SEQ ID NO: 833107 - DNA, 22 bp, Artificial Sequence
  chemically synthesized
tcatttacctcctggaaaatca

SEQ ID NO: 833108 - DNA, 22 bp, Artificial Sequence
  chemically synthesized
gatgtatagttatgattttcca

SEQ ID NO: 833109 - DNA, 22 bp, Artificial Sequence
  chemically synthesized
catttacctcctggaaaatcat

SEQ ID NO: 833110 - DNA, 22 bp, Artificial Sequence
  chemically synthesized
atttacctcctggaaaatcata

SEQ ID NO: 833111 - DNA, 22 bp, Artificial Sequence
  chemically synthesized
tggatgtatagttatgattttc

SEQ ID NO: 833112 - DNA, 22 bp, Artificial Sequence
  chemically synthesized
tctggatgtatagttatgattt

SEQ ID NO: 833113 - DNA, 22 bp, Artificial Sequence
  chemically synthesized
ctctggatgtatagttatgatt

SEQ ID NO: 833114 - DNA, 22 bp, Artificial Sequence
  chemically synthesized
acctcctggaaaatcataacta

SEQ ID NO: 833115 - DNA, 22 bp, Artificial Sequence
  chemically synthesized
cctcctggaaaatcataactat

SEQ ID NO: 833116 - DNA, 22 bp, Artificial Sequence
  chemically synthesized
ttctctggatgtatagttatga

SEQ ID NO: 833117 - DNA, 22 bp, Artificial Sequence
  chemically synthesized
cttctctggatgtatagttatg

SEQ ID NO: 833118 - DNA, 22 bp, Artificial Sequence
  chemically synthesized
tcttctctggatgtatagttat

SEQ ID NO: 833119 - DNA, 22 bp, Artificial Sequence
  chemically synthesized
ctggaaaatcataactatacat

SEQ ID NO: 833120 - DNA, 22 bp, Artificial Sequence
  chemically synthesized
gaaaatcataactatacatcca

SEQ ID NO: 833121 - DNA, 22 bp, Artificial Sequence
  chemically synthesized
caggtctttcttctctggatgt

SEQ ID NO: 833122 - DNA, 22 bp, Artificial Sequence
  chemically synthesized
tccaggtctttcttctctggat

SEQ ID NO: 833123 - DNA, 22 bp, Artificial Sequence
  chemically synthesized
tctccaggtctttcttctctgg

SEQ ID NO: 833124 - DNA, 22 bp, Artificial Sequence
  chemically synthesized
tctctctccaggtctttcttct

SEQ ID NO: 833125 - DNA, 22 bp, Artificial Sequence
  chemically synthesized
tacatccagagaagaaagacct

SEQ ID NO: 833126 - DNA, 22 bp, Artificial Sequence
  chemically synthesized
accaaggtattgtctctctcca

SEQ ID NO: 833127 - DNA, 22 bp, Artificial Sequence
  chemically synthesized
caccaaggtattgtctctctcc

SEQ ID NO: 833128 - DNA, 22 bp, Artificial Sequence
  chemically synthesized
gagagagacaataccttggtga

SEQ ID NO: 833129 - DNA, 22 bp, Artificial Sequence
  chemically synthesized
gtagccatatgtttcaccaagg

SEQ ID NO: 833130 - DNA, 22 bp, Artificial Sequence
  chemically synthesized
cgtagccatatgtttcaccaag

SEQ ID NO: 833131 - DNA, 22 bp, Artificial Sequence
  chemically synthesized
tatttcgtagccatatgtttca

SEQ ID NO: 833132 - DNA, 22 bp, Artificial Sequence
  chemically synthesized
ctgtatttcgtagccatatgtt

SEQ ID NO: 833133 - DNA, 22 bp, Artificial Sequence
  chemically synthesized
ttcctgtatttcgtagccatat

SEQ ID NO: 833134 - DNA, 22 bp, Artificial Sequence
  chemically synthesized
tgttcctgtatttcgtagccat

SEQ ID NO: 833135 - DNA, 22 bp, Artificial Sequence
  chemically synthesized
ggtgaaacatatggctacgaaa

SEQ ID NO: 833136 - DNA, 22 bp, Artificial Sequence
  chemically synthesized
gtgaaacatatggctacgaaat

SEQ ID NO: 833137 - DNA, 22 bp, Artificial Sequence
  chemically synthesized
ttctgttcctgtatttcgtagc

SEQ ID NO: 833138 - DNA, 22 bp, Artificial Sequence
  chemically synthesized
tactattctgttcctgtatttc

SEQ ID NO: 833139 - DNA, 22 bp, Artificial Sequence
  chemically synthesized
aggtgattatactattctgttc

SEQ ID NO: 833140 - DNA, 22 bp, Artificial Sequence
  chemically synthesized
cgaaatacaggaacagaatagt

SEQ ID NO: 833141 - DNA, 22 bp, Artificial Sequence
  chemically synthesized
aaattaaggtgattatactatt

SEQ ID NO: 833142 - DNA, 22 bp, Artificial Sequence
  chemically synthesized
aaaattaaggtgattatactat

SEQ ID NO: 833143 - DNA, 22 bp, Artificial Sequence
  chemically synthesized
taaaattaaggtgattatacta

SEQ ID NO: 833144 - DNA, 22 bp, Artificial Sequence
  chemically synthesized
cctttaaaattaaggtgattat

SEQ ID NO: 833145 - DNA, 22 bp, Artificial Sequence
  chemically synthesized
ccctttaaaattaaggtgatta

SEQ ID NO: 833146 - DNA, 22 bp, Artificial Sequence
  chemically synthesized
aggagaatttccctttaaaatt

SEQ ID NO: 833147 - DNA, 22 bp, Artificial Sequence
  chemically synthesized
caggagaatttccctttaaaat

SEQ ID NO: 833148 - DNA, 22 bp, Artificial Sequence
  chemically synthesized
tttcaggagaatttccctttaa

SEQ ID NO: 833149 - DNA, 22 bp, Artificial Sequence
  chemically synthesized
tgtttcaggagaatttcccttt

SEQ ID NO: 833150 - DNA, 22 bp, Artificial Sequence
  chemically synthesized
aattttaaagggaaattctcct

SEQ ID NO: 833151 - DNA, 22 bp, Artificial Sequence
  chemically synthesized
attttaaagggaaattctcctg

SEQ ID NO: 833152 - DNA, 22 bp, Artificial Sequence
  chemically synthesized
tgggaattctgtttcaggagaa

SEQ ID NO: 833153 - DNA, 22 bp, Artificial Sequence
  chemically synthesized
taaagggaaattctcctgaaac

SEQ ID NO: 833154 - DNA, 22 bp, Artificial Sequence
  chemically synthesized
aaagggaaattctcctgaaaca

SEQ ID NO: 833155 - DNA, 22 bp, Artificial Sequence
  chemically synthesized
ctatgggaattctgtttcagga

SEQ ID NO: 833156 - DNA, 22 bp, Artificial Sequence
  chemically synthesized
aagggaaattctcctgaaacag

SEQ ID NO: 833157 - DNA, 22 bp, Artificial Sequence
  chemically synthesized
actatgggaattctgtttcagg

SEQ ID NO: 833158 - DNA, 22 bp, Artificial Sequence
  chemically synthesized
tactatgggaattctgtttcag

SEQ ID NO: 833159 - DNA, 22 bp, Artificial Sequence
  chemically synthesized
ttactatgggaattctgtttca

SEQ ID NO: 833160 - DNA, 22 bp, Artificial Sequence
  chemically synthesized
cttttactatgggaattctgtt

SEQ ID NO: 833161 - DNA, 22 bp, Artificial Sequence
  chemically synthesized
ccttttactatgggaattctgt

SEQ ID NO: 833162 - DNA, 22 bp, Artificial Sequence
  chemically synthesized
tccttttactatgggaattctg

SEQ ID NO: 833163 - DNA, 22 bp, Artificial Sequence
  chemically synthesized
ttccttttactatgggaattct

SEQ ID NO: 833164 - DNA, 22 bp, Artificial Sequence
  chemically synthesized
tttccttttactatgggaattc

SEQ ID NO: 833165 - DNA, 22 bp, Artificial Sequence
  chemically synthesized
ttttccttttactatgggaatt

SEQ ID NO: 833166 - DNA, 22 bp, Artificial Sequence
  chemically synthesized
tcctgaaacagaattcccatag

SEQ ID NO: 833167 - DNA, 22 bp, Artificial Sequence
  chemically synthesized
tttttccttttactatgggaat

SEQ ID NO: 833168 - DNA, 22 bp, Artificial Sequence
  chemically synthesized
ctgaaacagaattcccatagta

SEQ ID NO: 833169 - DNA, 22 bp, Artificial Sequence
  chemically synthesized
aaacagaattcccatagtaaaa

SEQ ID NO: 833170 - DNA, 22 bp, Artificial Sequence
  chemically synthesized
aattttttttccttttactatg

SEQ ID NO: 833171 - DNA, 22 bp, Artificial Sequence
  chemically synthesized
ctcaattttttttccttttact

SEQ ID NO: 833172 - DNA, 22 bp, Artificial Sequence
  chemically synthesized
aattcctcaattttttttcctt

SEQ ID NO: 833173 - DNA, 22 bp, Artificial Sequence
  chemically synthesized
aaattcctcaattttttttcct

SEQ ID NO: 833174 - DNA, 22 bp, Artificial Sequence
  chemically synthesized
taaattcctcaattttttttcc

SEQ ID NO: 833175 - DNA, 22 bp, Artificial Sequence
  chemically synthesized
ccatagtaaaaggaaaaaaaat

SEQ ID NO: 833176 - DNA, 22 bp, Artificial Sequence
  chemically synthesized
ttttaaattcctcaattttttt

SEQ ID NO: 833177 - DNA, 22 bp, Artificial Sequence
  chemically synthesized
attttaaattcctcaatttttt

SEQ ID NO: 833178 - DNA, 22 bp, Artificial Sequence
  chemically synthesized
ccttattttaaattcctcaatt

SEQ ID NO: 833179 - DNA, 22 bp, Artificial Sequence
  chemically synthesized
acatggattaccttattttaaa

SEQ ID NO: 833180 - DNA, 22 bp, Artificial Sequence
  chemically synthesized
ttcacatggattaccttatttt

SEQ ID NO: 833181 - DNA, 22 bp, Artificial Sequence
  chemically synthesized
aggaatttaaaataaggtaatc

SEQ ID NO: 833182 - DNA, 22 bp, Artificial Sequence
  chemically synthesized
caaagcactgttcacatggatt

SEQ ID NO: 833183 - DNA, 22 bp, Artificial Sequence
  chemically synthesized
acaaagcactgttcacatggat

SEQ ID NO: 833184 - DNA, 22 bp, Artificial Sequence
  chemically synthesized
aaaataaggtaatccatgtgaa

SEQ ID NO: 833185 - DNA, 22 bp, Artificial Sequence
  chemically synthesized
aaataaggtaatccatgtgaac

SEQ ID NO: 833186 - DNA, 22 bp, Artificial Sequence
  chemically synthesized
cagtttacaaagcactgttcac

SEQ ID NO: 833187 - DNA, 22 bp, Artificial Sequence
  chemically synthesized
gcagtttacaaagcactgttca

SEQ ID NO: 833188 - DNA, 22 bp, Artificial Sequence
  chemically synthesized
tgcagtttacaaagcactgttc

SEQ ID NO: 833189 - DNA, 22 bp, Artificial Sequence
  chemically synthesized
acagttttgcagtttacaaagc

SEQ ID NO: 833190 - DNA, 22 bp, Artificial Sequence
  chemically synthesized
ctgacagttttgcagtttacaa

SEQ ID NO: 833191 - DNA, 22 bp, Artificial Sequence
  chemically synthesized
gctgacagttttgcagtttaca

SEQ ID NO: 833192 - DNA, 22 bp, Artificial Sequence
  chemically synthesized
tttgctgacagttttgcagttt

SEQ ID NO: 833193 - DNA, 22 bp, Artificial Sequence
  chemically synthesized
ttatttgctgacagttttgcag

SEQ ID NO: 833194 - DNA, 22 bp, Artificial Sequence
  chemically synthesized
attatttgctgacagttttgca

SEQ ID NO: 833195 - DNA, 22 bp, Artificial Sequence
  chemically synthesized
tgtaaactgcaaaactgtcagc

SEQ ID NO: 833196 - DNA, 22 bp, Artificial Sequence
  chemically synthesized
gtaaactgcaaaactgtcagca

SEQ ID NO: 833197 - DNA, 22 bp, Artificial Sequence
  chemically synthesized
taaactgcaaaactgtcagcaa

SEQ ID NO: 833198 - DNA, 22 bp, Artificial Sequence
  chemically synthesized
caaaactgtcagcaaataataa

SEQ ID NO: 833199 - DNA, 22 bp, Artificial Sequence
  chemically synthesized
tcagcaaataataaggtatgat

SEQ ID NO: 833200 - DNA, 22 bp, Artificial Sequence
  chemically synthesized
aagaaaataacaatcatacctt

SEQ ID NO: 833201 - DNA, 22 bp, Artificial Sequence
  chemically synthesized
aaagaaaataacaatcatacct

SEQ ID NO: 833202 - DNA, 22 bp, Artificial Sequence
  chemically synthesized
taaagaaaataacaatcatacc

SEQ ID NO: 833203 - DNA, 22 bp, Artificial Sequence
  chemically synthesized
ttttaaagaaaataacaatcat

SEQ ID NO: 833204 - DNA, 22 bp, Artificial Sequence
  chemically synthesized
attttaaagaaaataacaatca

SEQ ID NO: 833205 - DNA, 22 bp, Artificial Sequence
  chemically synthesized
tatcttattttaaagaaaataa

SEQ ID NO: 833206 - DNA, 22 bp, Artificial Sequence
  chemically synthesized
tgtatcttattttaaagaaaat

SEQ ID NO: 833207 - DNA, 22 bp, Artificial Sequence
  chemically synthesized
ttctgtatcttattttaaagaa

SEQ ID NO: 833208 - DNA, 22 bp, Artificial Sequence
  chemically synthesized
ttattttctttaaaataagata

SEQ ID NO: 833209 - DNA, 22 bp, Artificial Sequence
  chemically synthesized
ttttctttaaaataagatacag

SEQ ID NO: 833210 - DNA, 22 bp, Artificial Sequence
  chemically synthesized
tctttaaaataagatacagaat

SEQ ID NO: 833211 - DNA, 22 bp, Artificial Sequence
  chemically synthesized
ctttaaaataagatacagaata

SEQ ID NO: 833212 - DNA, 22 bp, Artificial Sequence
  chemically synthesized
tttaaaataagatacagaatag

SEQ ID NO: 833213 - DNA, 22 bp, Artificial Sequence
  chemically synthesized
taaaataagatacagaatagca

SEQ ID NO: 833214 - DNA, 22 bp, Artificial Sequence
  chemically synthesized
aaaataagatacagaatagcat

SEQ ID NO: 833215 - DNA, 22 bp, Artificial Sequence
  chemically synthesized
aaataagatacagaatagcatt

SEQ ID NO: 833216 - DNA, 22 bp, Artificial Sequence
  chemically synthesized
caaatagtataggcaaaatgct

SEQ ID NO: 833217 - DNA, 22 bp, Artificial Sequence
  chemically synthesized
gctgcaaatagtataggcaaaa

SEQ ID NO: 833218 - DNA, 22 bp, Artificial Sequence
  chemically synthesized
ggctgcaaatagtataggcaaa

SEQ ID NO: 833219 - DNA, 22 bp, Artificial Sequence
  chemically synthesized
ccttggctgcaaatagtatagg

SEQ ID NO: 833220 - DNA, 22 bp, Artificial Sequence
  chemically synthesized
cccttggctgcaaatagtatag

SEQ ID NO: 833221 - DNA, 22 bp, Artificial Sequence
  chemically synthesized
tgcctatactatttgcagccaa

SEQ ID NO: 833222 - DNA, 22 bp, Artificial Sequence
  chemically synthesized
gcctatactatttgcagccaag

SEQ ID NO: 833223 - DNA, 22 bp, Artificial Sequence
  chemically synthesized
cctatactatttgcagccaagg

SEQ ID NO: 833224 - DNA, 22 bp, Artificial Sequence
  chemically synthesized
tactatttgcagccaagggaag

SEQ ID NO: 833225 - DNA, 22 bp, Artificial Sequence
  chemically synthesized
aaaggataggatcttcccttgg

SEQ ID NO: 833226 - DNA, 22 bp, Artificial Sequence
  chemically synthesized
aaaaggataggatcttcccttg

SEQ ID NO: 833227 - DNA, 22 bp, Artificial Sequence
  chemically synthesized
taaaaggataggatcttccctt

SEQ ID NO: 833228 - DNA, 22 bp, Artificial Sequence
  chemically synthesized
tttgcagccaagggaagatcct

SEQ ID NO: 833229 - DNA, 22 bp, Artificial Sequence
  chemically synthesized
gcagccaagggaagatcctatc

SEQ ID NO: 833230 - DNA, 22 bp, Artificial Sequence
  chemically synthesized
cagccaagggaagatcctatcc

SEQ ID NO: 833231 - DNA, 22 bp, Artificial Sequence
  chemically synthesized
tatgttttaaaaggataggatc

SEQ ID NO: 833232 - DNA, 22 bp, Artificial Sequence
  chemically synthesized
atatgttttaaaaggataggat

SEQ ID NO: 833233 - DNA, 22 bp, Artificial Sequence
  chemically synthesized
tatatgttttaaaaggatagga

SEQ ID NO: 833234 - DNA, 22 bp, Artificial Sequence
  chemically synthesized
gttttatatgttttaaaaggat

SEQ ID NO: 833235 - DNA, 22 bp, Artificial Sequence
  chemically synthesized
aaaagcattagttttatatgtt

SEQ ID NO: 833236 - DNA, 22 bp, Artificial Sequence
  chemically synthesized
tccttttaaaacatataaaact

SEQ ID NO: 833237 - DNA, 22 bp, Artificial Sequence
  chemically synthesized
ggttaaaaagcattagttttat

SEQ ID NO: 833238 - DNA, 22 bp, Artificial Sequence
  chemically synthesized
gggttaaaaagcattagtttta

SEQ ID NO: 833239 - DNA, 22 bp, Artificial Sequence
  chemically synthesized
ttaaaacatataaaactaatgc

SEQ ID NO: 833240 - DNA, 22 bp, Artificial Sequence
  chemically synthesized
taaaacatataaaactaatgct

SEQ ID NO: 833241 - DNA, 22 bp, Artificial Sequence
  chemically synthesized
tttgggttaaaaagcattagtt

SEQ ID NO: 833242 - DNA, 22 bp, Artificial Sequence
  chemically synthesized
aaaacatataaaactaatgctt

SEQ ID NO: 833243 - DNA, 22 bp, Artificial Sequence
  chemically synthesized
gtttgggttaaaaagcattagt

SEQ ID NO: 833244 - DNA, 22 bp, Artificial Sequence
  chemically synthesized
aaacatataaaactaatgcttt

SEQ ID NO: 833245 - DNA, 22 bp, Artificial Sequence
  chemically synthesized
tgtttgggttaaaaagcattag

SEQ ID NO: 833246 - DNA, 22 bp, Artificial Sequence
  chemically synthesized
ttgtttgggttaaaaagcatta

SEQ ID NO: 833247 - DNA, 22 bp, Artificial Sequence
  chemically synthesized
tttgtttgggttaaaaagcatt

SEQ ID NO: 833248 - DNA, 22 bp, Artificial Sequence
  chemically synthesized
atgctttttaacccaaacaaaa

SEQ ID NO: 833249 - DNA, 22 bp, Artificial Sequence
  chemically synthesized
gcaacgtatgtgtgtctttttg

SEQ ID NO: 833250 - DNA, 22 bp, Artificial Sequence
  chemically synthesized
tttaacccaaacaaaaagacac

SEQ ID NO: 833251 - DNA, 22 bp, Artificial Sequence
  chemically synthesized
ttaacccaaacaaaaagacaca

SEQ ID NO: 833252 - DNA, 22 bp, Artificial Sequence
  chemically synthesized
tggcaacgtatgtgtgtctttt

SEQ ID NO: 833253 - DNA, 22 bp, Artificial Sequence
  chemically synthesized
taacccaaacaaaaagacacac

SEQ ID NO: 833254 - DNA, 22 bp, Artificial Sequence
  chemically synthesized
aacccaaacaaaaagacacaca

SEQ ID NO: 833255 - DNA, 22 bp, Artificial Sequence
  chemically synthesized
acccaaacaaaaagacacacat

SEQ ID NO: 833256 - DNA, 22 bp, Artificial Sequence
  chemically synthesized
agaccaagttctggcaacgtat

SEQ ID NO: 833257 - DNA, 22 bp, Artificial Sequence
  chemically synthesized
gagaccaagttctggcaacgta

SEQ ID NO: 833258 - DNA, 22 bp, Artificial Sequence
  chemically synthesized
cttgagaccaagttctggcaac

SEQ ID NO: 833259 - DNA, 22 bp, Artificial Sequence
  chemically synthesized
gcttgagaccaagttctggcaa

SEQ ID NO: 833260 - DNA, 22 bp, Artificial Sequence
  chemically synthesized
ccagaacttggtctcaagcaag

SEQ ID NO: 833261 - DNA, 22 bp, Artificial Sequence
  chemically synthesized
gaaaaatatagtcttgcttgag

SEQ ID NO: 833262 - DNA, 22 bp, Artificial Sequence
  chemically synthesized
agaaaaatatagtcttgcttga

SEQ ID NO: 833263 - DNA, 22 bp, Artificial Sequence
  chemically synthesized
ggtctcaagcaagactatattt

SEQ ID NO: 833264 - DNA, 22 bp, Artificial Sequence
  chemically synthesized
aagaacttagaaaaatatagtc

SEQ ID NO: 833265 - DNA, 22 bp, Artificial Sequence
  chemically synthesized
gtctcaagcaagactatatttt

SEQ ID NO: 833266 - DNA, 22 bp, Artificial Sequence
  chemically synthesized
ttaaagaacttagaaaaatata

SEQ ID NO: 833267 - DNA, 22 bp, Artificial Sequence
  chemically synthesized
attaaagaacttagaaaaatat

SEQ ID NO: 833268 - DNA, 22 bp, Artificial Sequence
  chemically synthesized
aagcaagactatatttttctaa

SEQ ID NO: 833269 - DNA, 22 bp, Artificial Sequence
  chemically synthesized
tttattaaagaacttagaaaaa

SEQ ID NO: 833270 - DNA, 22 bp, Artificial Sequence
  chemically synthesized
atttattaaagaacttagaaaa

SEQ ID NO: 833271 - DNA, 22 bp, Artificial Sequence
  chemically synthesized
tatttattaaagaacttagaaa

SEQ ID NO: 833272 - DNA, 22 bp, Artificial Sequence
  chemically synthesized
tttatttattaaagaacttaga

SEQ ID NO: 833273 - DNA, 22 bp, Artificial Sequence
  chemically synthesized
tatttttctaagttctttaata

SEQ ID NO: 833274 - DNA, 22 bp, Artificial Sequence
  chemically synthesized
ttctaagttctttaataaataa

SEQ ID NO: 833275 - DNA, 22 bp, Artificial Sequence
  chemically synthesized
tctaagttctttaataaataaa

SEQ ID NO: 833276 - DNA, 22 bp, Artificial Sequence
  chemically synthesized
ctaagttctttaataaataaag

SEQ ID NO: 833277 - DNA, 22 bp, Artificial Sequence
  chemically synthesized
taagttctttaataaataaaga

SEQ ID NO: 833278 - DNA, 22 bp, Artificial Sequence
  chemically synthesized
agttctttaataaataaagagc

SEQ ID NO: 833279 - DNA, 22 bp, Artificial Sequence
  chemically synthesized
aatgaccaaatggctctttatt

SEQ ID NO: 833280 - DNA, 22 bp, Artificial Sequence
  chemically synthesized
tttaataaataaagagccattt

SEQ ID NO: 833281 - DNA, 22 bp, Artificial Sequence
  chemically synthesized
taataaataaagagccatttgg

SEQ ID NO: 833282 - DNA, 22 bp, Artificial Sequence
  chemically synthesized
aataaataaagagccatttggt

SEQ ID NO: 833283 - DNA, 22 bp, Artificial Sequence
  chemically synthesized
ataaataaagagccatttggtc

SEQ ID NO: 833284 - DNA, 22 bp, Artificial Sequence
  chemically synthesized
ggtcattcaatactgatttgtc

SEQ ID NO: 833285 - DNA, 22 bp, Artificial Sequence
  chemically synthesized
gtcattcaatactgatttgtct

SEQ ID NO: 833286 - DNA, 22 bp, Artificial Sequence
  chemically synthesized
acaaatatataaagacaaatca

SEQ ID NO: 833287 - DNA, 22 bp, Artificial Sequence
  chemically synthesized
aatactgatttgtctttatata

SEQ ID NO: 833288 - DNA, 22 bp, Artificial Sequence
  chemically synthesized
atttgtctttatatatttgtta

SEQ ID NO: 833289 - DNA, 22 bp, Artificial Sequence
  chemically synthesized
gtctttatatatttgttaatta

SEQ ID NO: 833290 - DNA, 22 bp, Artificial Sequence
  chemically synthesized
tctttatatatttgttaattat

SEQ ID NO: 833291 - DNA, 22 bp, Artificial Sequence
  chemically synthesized
tatatatttgttaattatttgt

SEQ ID NO: 833292 - DNA, 22 bp, Artificial Sequence
  chemically synthesized
atatatttgttaattatttgtt

SEQ ID NO: 833293 - DNA, 22 bp, Artificial Sequence
  chemically synthesized
tatatttgttaattatttgttc

SEQ ID NO: 833294 - DNA, 22 bp, Artificial Sequence
  chemically synthesized
gttaattatttgttcctttatg

SEQ ID NO: 833295 - DNA, 22 bp, Artificial Sequence
  chemically synthesized
ttaattatttgttcctttatgt

SEQ ID NO: 833296 - DNA, 22 bp, Artificial Sequence
  chemically synthesized
tgatgaatgcatacataaagga

SEQ ID NO: 833297 - DNA, 22 bp, Artificial Sequence
  chemically synthesized
gtgatgaatgcatacataaagg

SEQ ID NO: 833298 - DNA, 22 bp, Artificial Sequence
  chemically synthesized
attatttgttcctttatgtatg

SEQ ID NO: 833299 - DNA, 22 bp, Artificial Sequence
  chemically synthesized
tttgttcctttatgtatgcatt

SEQ ID NO: 833300 - DNA, 22 bp, Artificial Sequence
  chemically synthesized
gttcctttatgtatgcattcat

SEQ ID NO: 833301 - DNA, 22 bp, Artificial Sequence
  chemically synthesized
ttcctttatgtatgcattcatc

SEQ ID NO: 833302 - DNA, 22 bp, Artificial Sequence
  chemically synthesized
taaaaaagtttgtgatgaatgc

SEQ ID NO: 833303 - DNA, 22 bp, Artificial Sequence
  chemically synthesized
ctttatgtatgcattcatcaca

SEQ ID NO: 833304 - DNA, 22 bp, Artificial Sequence
  chemically synthesized
tatgtatgcattcatcacaaac

SEQ ID NO: 833305 - DNA, 22 bp, Artificial Sequence
  chemically synthesized
atgtatgcattcatcacaaact

SEQ ID NO: 833306 - DNA, 22 bp, Artificial Sequence
  chemically synthesized
tgtatgcattcatcacaaactt

SEQ ID NO: 833307 - DNA, 22 bp, Artificial Sequence
  chemically synthesized
tataagagattataaaaaagtt

SEQ ID NO: 833308 - DNA, 22 bp, Artificial Sequence
  chemically synthesized
agttatataagagattataaaa

SEQ ID NO: 833309 - DNA, 22 bp, Artificial Sequence
  chemically synthesized
atcacaaacttttttataatct

SEQ ID NO: 833310 - DNA, 22 bp, Artificial Sequence
  chemically synthesized
aatctcagttatataagagatt

SEQ ID NO: 833311 - DNA, 22 bp, Artificial Sequence
  chemically synthesized
actcaatctcagttatataaga

SEQ ID NO: 833312 - DNA, 22 bp, Artificial Sequence
  chemically synthesized
ttttataatctcttatataact

SEQ ID NO: 833313 - DNA, 22 bp, Artificial Sequence
  chemically synthesized
tttataatctcttatataactg

SEQ ID NO: 833314 - DNA, 22 bp, Artificial Sequence
  chemically synthesized
ttataatctcttatataactga

SEQ ID NO: 833315 - DNA, 22 bp, Artificial Sequence
  chemically synthesized
tataatctcttatataactgag

SEQ ID NO: 833316 - DNA, 22 bp, Artificial Sequence
  chemically synthesized
ataatctcttatataactgaga

SEQ ID NO: 833317 - DNA, 22 bp, Artificial Sequence
  chemically synthesized
taatctcttatataactgagat

SEQ ID NO: 833318 - DNA, 22 bp, Artificial Sequence
  chemically synthesized
tatacatcctaactcaatctca

SEQ ID NO: 833319 - DNA, 22 bp, Artificial Sequence
  chemically synthesized
gtatacatcctaactcaatctc

SEQ ID NO: 833320 - DNA, 22 bp, Artificial Sequence
  chemically synthesized
tgtatacatcctaactcaatct

SEQ ID NO: 833321 - DNA, 22 bp, Artificial Sequence
  chemically synthesized
ttatataactgagattgagtta

SEQ ID NO: 833322 - DNA, 22 bp, Artificial Sequence
  chemically synthesized
atataactgagattgagttagg

SEQ ID NO: 833323 - DNA, 22 bp, Artificial Sequence
  chemically synthesized
tataactgagattgagttagga

SEQ ID NO: 833324 - DNA, 22 bp, Artificial Sequence
  chemically synthesized
attttgtatacatcctaactca

SEQ ID NO: 833325 - DNA, 22 bp, Artificial Sequence
  chemically synthesized
gattttgtatacatcctaactc

SEQ ID NO: 833326 - DNA, 22 bp, Artificial Sequence
  chemically synthesized
tgattttgtatacatcctaact

SEQ ID NO: 833327 - DNA, 22 bp, Artificial Sequence
  chemically synthesized
gctttgattttgtatacatcct

SEQ ID NO: 833328 - DNA, 22 bp, Artificial Sequence
  chemically synthesized
agctttgattttgtatacatcc

SEQ ID NO: 833329 - DNA, 22 bp, Artificial Sequence
  chemically synthesized
agattgagttaggatgtataca

SEQ ID NO: 833330 - DNA, 22 bp, Artificial Sequence
  chemically synthesized
tagctttgattttgtatacatc

SEQ ID NO: 833331 - DNA, 22 bp, Artificial Sequence
  chemically synthesized
ttagctttgattttgtatacat

SEQ ID NO: 833332 - DNA, 22 bp, Artificial Sequence
  chemically synthesized
tttagctttgattttgtataca

SEQ ID NO: 833333 - DNA, 22 bp, Artificial Sequence
  chemically synthesized
ttttagctttgattttgtatac

SEQ ID NO: 833334 - DNA, 22 bp, Artificial Sequence
  chemically synthesized
ttttttagctttgattttgtat

SEQ ID NO: 833335 - DNA, 22 bp, Artificial Sequence
  chemically synthesized
agttaggatgtatacaaaatca

SEQ ID NO: 833336 - DNA, 22 bp, Artificial Sequence
  chemically synthesized
cttttttagctttgattttgta

SEQ ID NO: 833337 - DNA, 22 bp, Artificial Sequence
  chemically synthesized
cttcttttttagctttgatttt

SEQ ID NO: 833338 - DNA, 22 bp, Artificial Sequence
  chemically synthesized
ggatgtatacaaaatcaaagct

SEQ ID NO: 833339 - DNA, 22 bp, Artificial Sequence
  chemically synthesized
ttacttcttttttagctttgat

SEQ ID NO: 833340 - DNA, 22 bp, Artificial Sequence
  chemically synthesized
attacttcttttttagctttga

SEQ ID NO: 833341 - DNA, 22 bp, Artificial Sequence
  chemically synthesized
cagaatgtttattacttctttt

SEQ ID NO: 833342 - DNA, 22 bp, Artificial Sequence
  chemically synthesized
acagaatgtttattacttcttt

SEQ ID NO: 833343 - DNA, 22 bp, Artificial Sequence
  chemically synthesized
cttacagaatgtttattacttc

SEQ ID NO: 833344 - DNA, 22 bp, Artificial Sequence
  chemically synthesized
acttacagaatgtttattactt

SEQ ID NO: 833345 - DNA, 22 bp, Artificial Sequence
  chemically synthesized
aaaaagaagtaataaacattct

SEQ ID NO: 833346 - DNA, 22 bp, Artificial Sequence
  chemically synthesized
tgtaatttacttacagaatgtt

SEQ ID NO: 833347 - DNA, 22 bp, Artificial Sequence
  chemically synthesized
aattatgtaatttacttacaga

SEQ ID NO: 833348 - DNA, 22 bp, Artificial Sequence
  chemically synthesized
tgtaagtaaattacataattga

SEQ ID NO: 833349 - DNA, 22 bp, Artificial Sequence
  chemically synthesized
taagtaaattacataattgagt

SEQ ID NO: 833350 - DNA, 22 bp, Artificial Sequence
  chemically synthesized
caaaggcatgtgaatactcaat

SEQ ID NO: 833351 - DNA, 22 bp, Artificial Sequence
  chemically synthesized
cataattgagtattcacatgcc

SEQ ID NO: 833352 - DNA, 22 bp, Artificial Sequence
  chemically synthesized
agtattcacatgcctttggaat

SEQ ID NO: 833353 - DNA, 22 bp, Artificial Sequence
  chemically synthesized
tcgtgaaagcatagattccaaa

SEQ ID NO: 833354 - DNA, 22 bp, Artificial Sequence
  chemically synthesized
acatgcctttggaatctatgct

SEQ ID NO: 833355 - DNA, 22 bp, Artificial Sequence
  chemically synthesized
tggaatctatgctttcacgata

SEQ ID NO: 833356 - DNA, 22 bp, Artificial Sequence
  chemically synthesized
ggaatctatgctttcacgatag

SEQ ID NO: 833357 - DNA, 22 bp, Artificial Sequence
  chemically synthesized
aataagtggagtctatcgtgaa

SEQ ID NO: 833358 - DNA, 22 bp, Artificial Sequence
  chemically synthesized
gaatctatgctttcacgataga

SEQ ID NO: 833359 - DNA, 22 bp, Artificial Sequence
  chemically synthesized
tgctttcacgatagactccact

SEQ ID NO: 833360 - DNA, 22 bp, Artificial Sequence
  chemically synthesized
gtgatgcattcaataagtggag

SEQ ID NO: 833361 - DNA, 22 bp, Artificial Sequence
  chemically synthesized
tcacgatagactccacttattg

SEQ ID NO: 833362 - DNA, 22 bp, Artificial Sequence
  chemically synthesized
cacgatagactccacttattga

SEQ ID NO: 833363 - DNA, 22 bp, Artificial Sequence
  chemically synthesized
acgatagactccacttattgaa

SEQ ID NO: 833364 - DNA, 22 bp, Artificial Sequence
  chemically synthesized
attagtgatgcattcaataagt

SEQ ID NO: 833365 - DNA, 22 bp, Artificial Sequence
  chemically synthesized
aattagtgatgcattcaataag

SEQ ID NO: 833366 - DNA, 22 bp, Artificial Sequence
  chemically synthesized
taattagtgatgcattcaataa

SEQ ID NO: 833367 - DNA, 22 bp, Artificial Sequence
  chemically synthesized
ttaattagtgatgcattcaata

SEQ ID NO: 833368 - DNA, 22 bp, Artificial Sequence
  chemically synthesized
cttttaattagtgatgcattca

SEQ ID NO: 833369 - DNA, 22 bp, Artificial Sequence
  chemically synthesized
ccttttaattagtgatgcattc

SEQ ID NO: 833370 - DNA, 22 bp, Artificial Sequence
  chemically synthesized
tccttttaattagtgatgcatt

SEQ ID NO: 833371 - DNA, 22 bp, Artificial Sequence
  chemically synthesized
ttccttttaattagtgatgcat

SEQ ID NO: 833372 - DNA, 22 bp, Artificial Sequence
  chemically synthesized
cacttattgaatgcatcactaa

SEQ ID NO: 833373 - DNA, 22 bp, Artificial Sequence
  chemically synthesized
gtttttccttttaattagtgat

SEQ ID NO: 833374 - DNA, 22 bp, Artificial Sequence
  chemically synthesized
agtttttccttttaattagtga

SEQ ID NO: 833375 - DNA, 22 bp, Artificial Sequence
  chemically synthesized
tagtttttccttttaattagtg

SEQ ID NO: 833376 - DNA, 22 bp, Artificial Sequence
  chemically synthesized
attgaatgcatcactaattaaa

SEQ ID NO: 833377 - DNA, 22 bp, Artificial Sequence
  chemically synthesized
ttagtttttccttttaattagt

SEQ ID NO: 833378 - DNA, 22 bp, Artificial Sequence
  chemically synthesized
ttgaatgcatcactaattaaaa

SEQ ID NO: 833379 - DNA, 22 bp, Artificial Sequence
  chemically synthesized
tttagtttttccttttaattag

SEQ ID NO: 833380 - DNA, 22 bp, Artificial Sequence
  chemically synthesized
ttttagtttttccttttaatta

SEQ ID NO: 833381 - DNA, 22 bp, Artificial Sequence
  chemically synthesized
aatgcatcactaattaaaagga

SEQ ID NO: 833382 - DNA, 22 bp, Artificial Sequence
  chemically synthesized
ttttttagtttttccttttaat

SEQ ID NO: 833383 - DNA, 22 bp, Artificial Sequence
  chemically synthesized
cttttttagtttttccttttaa

SEQ ID NO: 833384 - DNA, 22 bp, Artificial Sequence
  chemically synthesized
tcttttttagtttttcctttta

SEQ ID NO: 833385 - DNA, 22 bp, Artificial Sequence
  chemically synthesized
tgaaaattttcttttttagttt

SEQ ID NO: 833386 - DNA, 22 bp, Artificial Sequence
  chemically synthesized
attaaaaggaaaaactaaaaaa

SEQ ID NO: 833387 - DNA, 22 bp, Artificial Sequence
  chemically synthesized
aaaggaaaaactaaaaaagaaa

SEQ ID NO: 833388 - DNA, 22 bp, Artificial Sequence
  chemically synthesized
ggagctatgaaaattttctttt

SEQ ID NO: 833389 - DNA, 22 bp, Artificial Sequence
  chemically synthesized
aaaaagaaaattttcatagctc

SEQ ID NO: 833390 - DNA, 22 bp, Artificial Sequence
  chemically synthesized
acaaggccactgggagctatga

SEQ ID NO: 833391 - DNA, 22 bp, Artificial Sequence
  chemically synthesized
ccataactcacaaggccactgg

SEQ ID NO: 833392 - DNA, 22 bp, Artificial Sequence
  chemically synthesized
accataactcacaaggccactg

SEQ ID NO: 833393 - DNA, 22 bp, Artificial Sequence
  chemically synthesized
taccataactcacaaggccact

SEQ ID NO: 833394 - DNA, 22 bp, Artificial Sequence
  chemically synthesized
tcatagctcccagtggccttgt

SEQ ID NO: 833395 - DNA, 22 bp, Artificial Sequence
  chemically synthesized
catagctcccagtggccttgtg

SEQ ID NO: 833396 - DNA, 22 bp, Artificial Sequence
  chemically synthesized
atagctcccagtggccttgtga

SEQ ID NO: 833397 - DNA, 22 bp, Artificial Sequence
  chemically synthesized
ccagtggccttgtgagttatgg

SEQ ID NO: 833398 - DNA, 22 bp, Artificial Sequence
  chemically synthesized
aagaccaaaatctttaccataa

SEQ ID NO: 833399 - DNA, 22 bp, Artificial Sequence
  chemically synthesized
aggttgaagaccaaaatcttta

SEQ ID NO: 833400 - DNA, 22 bp, Artificial Sequence
  chemically synthesized
gtgagttatggtaaagattttg

SEQ ID NO: 833401 - DNA, 22 bp, Artificial Sequence
  chemically synthesized
tgagttatggtaaagattttgg

SEQ ID NO: 833402 - DNA, 22 bp, Artificial Sequence
  chemically synthesized
cactgaggttgaagaccaaaat

SEQ ID NO: 833403 - DNA, 22 bp, Artificial Sequence
  chemically synthesized
tggtaaagattttggtcttcaa

SEQ ID NO: 833404 - DNA, 22 bp, Artificial Sequence
  chemically synthesized
ccattgcactgaggttgaagac

SEQ ID NO: 833405 - DNA, 22 bp, Artificial Sequence
  chemically synthesized
agtggattcccattgcactgag

SEQ ID NO: 833406 - DNA, 22 bp, Artificial Sequence
  chemically synthesized
tggtcttcaacctcagtgcaat

SEQ ID NO: 833407 - DNA, 22 bp, Artificial Sequence
  chemically synthesized
cagtggattcccattgcactga

SEQ ID NO: 833408 - DNA, 22 bp, Artificial Sequence
  chemically synthesized
ggtcttcaacctcagtgcaatg

SEQ ID NO: 833409 - DNA, 22 bp, Artificial Sequence
  chemically synthesized
tcagtggattcccattgcactg

SEQ ID NO: 833410 - DNA, 22 bp, Artificial Sequence
  chemically synthesized
gtcttcaacctcagtgcaatgg

SEQ ID NO: 833411 - DNA, 22 bp, Artificial Sequence
  chemically synthesized
caacctcagtgcaatgggaatc

SEQ ID NO: 833412 - DNA, 22 bp, Artificial Sequence
  chemically synthesized
aacctttcagtggattcccatt

SEQ ID NO: 833413 - DNA, 22 bp, Artificial Sequence
  chemically synthesized
aacctcagtgcaatgggaatcc

SEQ ID NO: 833414 - DNA, 22 bp, Artificial Sequence
  chemically synthesized
aaacctttcagtggattcccat

SEQ ID NO: 833415 - DNA, 22 bp, Artificial Sequence
  chemically synthesized
taaacctttcagtggattccca

SEQ ID NO: 833416 - DNA, 22 bp, Artificial Sequence
  chemically synthesized
ctttaaacctttcagtggattc

SEQ ID NO: 833417 - DNA, 22 bp, Artificial Sequence
  chemically synthesized
agtgcaatgggaatccactgaa

SEQ ID NO: 833418 - DNA, 22 bp, Artificial Sequence
  chemically synthesized
cctgctttaaacctttcagtgg

SEQ ID NO: 833419 - DNA, 22 bp, Artificial Sequence
  chemically synthesized
ccctgctttaaacctttcagtg

SEQ ID NO: 833420 - DNA, 22 bp, Artificial Sequence
  chemically synthesized
gacggtgtcacttccctgcttt

SEQ ID NO: 833421 - DNA, 22 bp, Artificial Sequence
  chemically synthesized
aaaggtttaaagcagggaagtg

SEQ ID NO: 833422 - DNA, 22 bp, Artificial Sequence
  chemically synthesized
aaagcagggaagtgacaccgtc

SEQ ID NO: 833423 - DNA, 22 bp, Artificial Sequence
  chemically synthesized
aagcccagattagacggtgtca

SEQ ID NO: 833424 - DNA, 22 bp, Artificial Sequence
  chemically synthesized
aagcagggaagtgacaccgtct

SEQ ID NO: 833425 - DNA, 22 bp, Artificial Sequence
  chemically synthesized
caagcccagattagacggtgtc

SEQ ID NO: 833426 - DNA, 22 bp, Artificial Sequence
  chemically synthesized
tcaagcccagattagacggtgt

SEQ ID NO: 833427 - DNA, 22 bp, Artificial Sequence
  chemically synthesized
atgttttcaagcccagattaga

SEQ ID NO: 833428 - DNA, 22 bp, Artificial Sequence
  chemically synthesized
gcaacatgactaatgttttcaa

SEQ ID NO: 833429 - DNA, 22 bp, Artificial Sequence
  chemically synthesized
atctgggcttgaaaacattagt

SEQ ID NO: 833430 - DNA, 22 bp, Artificial Sequence
  chemically synthesized
caattagcaacatgactaatgt

SEQ ID NO: 833431 - DNA, 22 bp, Artificial Sequence
  chemically synthesized
tccaattagcaacatgactaat

SEQ ID NO: 833432 - DNA, 22 bp, Artificial Sequence
  chemically synthesized
ggcttgaaaacattagtcatgt

SEQ ID NO: 833433 - DNA, 22 bp, Artificial Sequence
  chemically synthesized
ctctccaattagcaacatgact

SEQ ID NO: 833434 - DNA, 22 bp, Artificial Sequence
  chemically synthesized
gaaaacattagtcatgttgcta

SEQ ID NO: 833435 - DNA, 22 bp, Artificial Sequence
  chemically synthesized
aaaacattagtcatgttgctaa

SEQ ID NO: 833436 - DNA, 22 bp, Artificial Sequence
  chemically synthesized
caatctactctccaattagcaa

SEQ ID NO: 833437 - DNA, 22 bp, Artificial Sequence
  chemically synthesized
ccctccaatctactctccaatt

SEQ ID NO: 833438 - DNA, 22 bp, Artificial Sequence
  chemically synthesized
gtcatgttgctaattggagagt

SEQ ID NO: 833439 - DNA, 22 bp, Artificial Sequence
  chemically synthesized
ccctcccctccaatctactctc

SEQ ID NO: 833440 - DNA, 22 bp, Artificial Sequence
  chemically synthesized
gccctcccctccaatctactct

SEQ ID NO: 833441 - DNA, 22 bp, Artificial Sequence
  chemically synthesized
tgccctcccctccaatctactc

SEQ ID NO: 833442 - DNA, 22 bp, Artificial Sequence
  chemically synthesized
ttgccctcccctccaatctact

SEQ ID NO: 833443 - DNA, 22 bp, Artificial Sequence
  chemically synthesized
tttgccctcccctccaatctac

SEQ ID NO: 833444 - DNA, 22 bp, Artificial Sequence
  chemically synthesized
ctaattggagagtagattggag

SEQ ID NO: 833445 - DNA, 22 bp, Artificial Sequence
  chemically synthesized
ttttgccctcccctccaatcta

SEQ ID NO: 833446 - DNA, 22 bp, Artificial Sequence
  chemically synthesized
attggagagtagattggagggg

SEQ ID NO: 833447 - DNA, 22 bp, Artificial Sequence
  chemically synthesized
catcttttttgccctcccctcc

SEQ ID NO: 833448 - DNA, 22 bp, Artificial Sequence
  chemically synthesized
gagagtagattggaggggaggg

SEQ ID NO: 833449 - DNA, 22 bp, Artificial Sequence
  chemically synthesized
tgcatcttttttgccctcccct

SEQ ID NO: 833450 - DNA, 22 bp, Artificial Sequence
  chemically synthesized
ctgcatcttttttgccctcccc

SEQ ID NO: 833451 - DNA, 22 bp, Artificial Sequence
  chemically synthesized
tctgcatcttttttgccctccc

SEQ ID NO: 833452 - DNA, 22 bp, Artificial Sequence
  chemically synthesized
ttctgcatcttttttgccctcc

SEQ ID NO: 833453 - DNA, 22 bp, Artificial Sequence
  chemically synthesized
tttttctgcatcttttttgccc

SEQ ID NO: 833454 - DNA, 22 bp, Artificial Sequence
  chemically synthesized
tgtttttctgcatcttttttgc

SEQ ID NO: 833455 - DNA, 22 bp, Artificial Sequence
  chemically synthesized
gaggggagggcaaaaaagatgc

SEQ ID NO: 833456 - DNA, 22 bp, Artificial Sequence
  chemically synthesized
ctctgtttttctgcatcttttt

SEQ ID NO: 833457 - DNA, 22 bp, Artificial Sequence
  chemically synthesized
actctgtttttctgcatctttt

SEQ ID NO: 833458 - DNA, 22 bp, Artificial Sequence
  chemically synthesized
acatcttactctgtttttctgc

SEQ ID NO: 833459 - DNA, 22 bp, Artificial Sequence
  chemically synthesized
tgctaacatcttactctgtttt

SEQ ID NO: 833460 - DNA, 22 bp, Artificial Sequence
  chemically synthesized
ctatgctaacatcttactctgt

SEQ ID NO: 833461 - DNA, 22 bp, Artificial Sequence
  chemically synthesized
gactcctatgctaacatcttac

SEQ ID NO: 833462 - DNA, 22 bp, Artificial Sequence
  chemically synthesized
tgcctggactcctatgctaaca

SEQ ID NO: 833463 - DNA, 22 bp, Artificial Sequence
  chemically synthesized
gcataggagtccaggcacagcc

SEQ ID NO: 833464 - DNA, 22 bp, Artificial Sequence
  chemically synthesized
ccacccaccatcaggctgtgcc

SEQ ID NO: 833465 - DNA, 22 bp, Artificial Sequence
  chemically synthesized
catctaccacccaccatcaggc

SEQ ID NO: 833466 - DNA, 22 bp, Artificial Sequence
  chemically synthesized
ccatctaccacccaccatcagg

SEQ ID NO: 833467 - DNA, 22 bp, Artificial Sequence
  chemically synthesized
tccatctaccacccaccatcag

SEQ ID NO: 833468 - DNA, 22 bp, Artificial Sequence
  chemically synthesized
tctttccatctaccacccacca

SEQ ID NO: 833469 - DNA, 22 bp, Artificial Sequence
  chemically synthesized
atctttccatctaccacccacc

SEQ ID NO: 833470 - DNA, 22 bp, Artificial Sequence
  chemically synthesized
ttatctttccatctaccaccca

SEQ ID NO: 833471 - DNA, 22 bp, Artificial Sequence
  chemically synthesized
cttatctttccatctaccaccc

SEQ ID NO: 833472 - DNA, 22 bp, Artificial Sequence
  chemically synthesized
tcttatctttccatctaccacc

SEQ ID NO: 833473 - DNA, 22 bp, Artificial Sequence
  chemically synthesized
ttcttatctttccatctaccac

SEQ ID NO: 833474 - DNA, 22 bp, Artificial Sequence
  chemically synthesized
atggtgggtggtagatggaaag

SEQ ID NO: 833475 - DNA, 22 bp, Artificial Sequence
  chemically synthesized
atcttttcttatctttccatct

SEQ ID NO: 833476 - DNA, 22 bp, Artificial Sequence
  chemically synthesized
ctaatcttttcttatctttcca

SEQ ID NO: 833477 - DNA, 22 bp, Artificial Sequence
  chemically synthesized
actaatcttttcttatctttcc

SEQ ID NO: 833478 - DNA, 22 bp, Artificial Sequence
  chemically synthesized
aatcttactaatcttttcttat

SEQ ID NO: 833479 - DNA, 22 bp, Artificial Sequence
  chemically synthesized
taaatcttactaatcttttctt

SEQ ID NO: 833480 - DNA, 22 bp, Artificial Sequence
  chemically synthesized
ctaaatcttactaatcttttct

SEQ ID NO: 833481 - DNA, 22 bp, Artificial Sequence
  chemically synthesized
tcttctaaatcttactaatctt

SEQ ID NO: 833482 - DNA, 22 bp, Artificial Sequence
  chemically synthesized
atcttctaaatcttactaatct

SEQ ID NO: 833483 - DNA, 22 bp, Artificial Sequence
  chemically synthesized
tatcttctaaatcttactaatc

SEQ ID NO: 833484 - DNA, 22 bp, Artificial Sequence
  chemically synthesized
tacattttatcttctaaatctt

SEQ ID NO: 833485 - DNA, 22 bp, Artificial Sequence
  chemically synthesized
gtaagatttagaagataaaatg

SEQ ID NO: 833486 - DNA, 22 bp, Artificial Sequence
  chemically synthesized
ggcaaagtcctgtacattttat

SEQ ID NO: 833487 - DNA, 22 bp, Artificial Sequence
  chemically synthesized
gggcaaagtcctgtacatttta

SEQ ID NO: 833488 - DNA, 22 bp, Artificial Sequence
  chemically synthesized
agaagataaaatgtacaggact

SEQ ID NO: 833489 - DNA, 22 bp, Artificial Sequence
  chemically synthesized
gaagataaaatgtacaggactt

SEQ ID NO: 833490 - DNA, 22 bp, Artificial Sequence
  chemically synthesized
ggcagagggaagaacttgggca

SEQ ID NO: 833491 - DNA, 22 bp, Artificial Sequence
  chemically synthesized
taggcagagggaagaacttggg

SEQ ID NO: 833492 - DNA, 22 bp, Artificial Sequence
  chemically synthesized
tgcccaagttcttccctctgcc

SEQ ID NO: 833493 - DNA, 22 bp, Artificial Sequence
  chemically synthesized
gcccaagttcttccctctgcct

SEQ ID NO: 833494 - DNA, 22 bp, Artificial Sequence
  chemically synthesized
cccaagttcttccctctgccta

SEQ ID NO: 833495 - DNA, 22 bp, Artificial Sequence
  chemically synthesized
ttccctctgcctagaatgcatc

SEQ ID NO: 833496 - DNA, 22 bp, Artificial Sequence
  chemically synthesized
ccatgtaccagatgatgcattc

SEQ ID NO: 833497 - DNA, 22 bp, Artificial Sequence
  chemically synthesized
ccctctgcctagaatgcatcat

SEQ ID NO: 833498 - DNA, 22 bp, Artificial Sequence
  chemically synthesized
cctctgcctagaatgcatcatc

SEQ ID NO: 833499 - DNA, 22 bp, Artificial Sequence
  chemically synthesized
tgcctagaatgcatcatctggt

SEQ ID NO: 833500 - DNA, 22 bp, Artificial Sequence
  chemically synthesized
cctagaatgcatcatctggtac

SEQ ID NO: 833501 - DNA, 22 bp, Artificial Sequence
  chemically synthesized
gaatgcatcatctggtacatgg

SEQ ID NO: 833502 - DNA, 22 bp, Artificial Sequence
  chemically synthesized
atgaagcacctgccatgtacca

SEQ ID NO: 833503 - DNA, 22 bp, Artificial Sequence
  chemically synthesized
gtacatggcaggtgcttcatga

SEQ ID NO: 833504 - DNA, 22 bp, Artificial Sequence
  chemically synthesized
ccatcaaaagcattcatgaagc

SEQ ID NO: 833505 - DNA, 22 bp, Artificial Sequence
  chemically synthesized
cccatcaaaagcattcatgaag

SEQ ID NO: 833506 - DNA, 22 bp, Artificial Sequence
  chemically synthesized
atttcccatcaaaagcattcat

SEQ ID NO: 833507 - DNA, 22 bp, Artificial Sequence
  chemically synthesized
ttcatttcccatcaaaagcatt

SEQ ID NO: 833508 - DNA, 22 bp, Artificial Sequence
  chemically synthesized
catgaatgcttttgatgggaaa

SEQ ID NO: 833509 - DNA, 22 bp, Artificial Sequence
  chemically synthesized
taaccctgttcatttcccatca

SEQ ID NO: 833510 - DNA, 22 bp, Artificial Sequence
  chemically synthesized
atgaatgcttttgatgggaaat

SEQ ID NO: 833511 - DNA, 22 bp, Artificial Sequence
  chemically synthesized
ataaccctgttcatttcccatc

SEQ ID NO: 833512 - DNA, 22 bp, Artificial Sequence
  chemically synthesized
tataaccctgttcatttcccat

SEQ ID NO: 833513 - DNA, 22 bp, Artificial Sequence
  chemically synthesized
ttataaccctgttcatttccca

SEQ ID NO: 833514 - DNA, 22 bp, Artificial Sequence
  chemically synthesized
ttgatgggaaatgaacagggtt

SEQ ID NO: 833515 - DNA, 22 bp, Artificial Sequence
  chemically synthesized
tgaggtttttataaccctgttc

SEQ ID NO: 833516 - DNA, 22 bp, Artificial Sequence
  chemically synthesized
tgatgggaaatgaacagggtta

SEQ ID NO: 833517 - DNA, 22 bp, Artificial Sequence
  chemically synthesized
gatgggaaatgaacagggttat

SEQ ID NO: 833518 - DNA, 22 bp, Artificial Sequence
  chemically synthesized
atgggaaatgaacagggttata

SEQ ID NO: 833519 - DNA, 22 bp, Artificial Sequence
  chemically synthesized
aaaaattgtgaggtttttataa

SEQ ID NO: 833520 - DNA, 22 bp, Artificial Sequence
  chemically synthesized
aaaaaattgtgaggtttttata

SEQ ID NO: 833521 - DNA, 22 bp, Artificial Sequence
  chemically synthesized
agaccccttaaaaaattgtgag

SEQ ID NO: 833522 - DNA, 22 bp, Artificial Sequence
  chemically synthesized
ctaagaccccttaaaaaattgt

SEQ ID NO: 833523 - DNA, 22 bp, Artificial Sequence
  chemically synthesized
taaaaacctcacaattttttaa

SEQ ID NO: 833524 - DNA, 22 bp, Artificial Sequence
  chemically synthesized
acaattttttaaggggtcttag

SEQ ID NO: 833525 - DNA, 22 bp, Artificial Sequence
  chemically synthesized
tttaaggggtcttaggagtctt

SEQ ID NO: 833526 - DNA, 22 bp, Artificial Sequence
  chemically synthesized
ttaaggggtcttaggagtcttg

SEQ ID NO: 833527 - DNA, 22 bp, Artificial Sequence
  chemically synthesized
taaggggtcttaggagtcttgg

SEQ ID NO: 833528 - DNA, 22 bp, Artificial Sequence
  chemically synthesized
aaggggtcttaggagtcttggc

SEQ ID NO: 833529 - DNA, 22 bp, Artificial Sequence
  chemically synthesized
aggggtcttaggagtcttggcc

SEQ ID NO: 833530 - DNA, 22 bp, Artificial Sequence
  chemically synthesized
aggagtcttggccctgccatac

SEQ ID NO: 833531 - DNA, 22 bp, Artificial Sequence
  chemically synthesized
caagagagaaaagtatggcagg

SEQ ID NO: 833532 - DNA, 22 bp, Artificial Sequence
  chemically synthesized
ggagtcttggccctgccatact

SEQ ID NO: 833533 - DNA, 22 bp, Artificial Sequence
  chemically synthesized
ctgcaagagagaaaagtatggc

SEQ ID NO: 833534 - DNA, 22 bp, Artificial Sequence
  chemically synthesized
cctgcaagagagaaaagtatgg

SEQ ID NO: 833535 - DNA, 22 bp, Artificial Sequence
  chemically synthesized
tcctgcaagagagaaaagtatg

SEQ ID NO: 833536 - DNA, 22 bp, Artificial Sequence
  chemically synthesized
ttcctgcaagagagaaaagtat

SEQ ID NO: 833537 - DNA, 22 bp, Artificial Sequence
  chemically synthesized
tttcctgcaagagagaaaagta

SEQ ID NO: 833538 - DNA, 22 bp, Artificial Sequence
  chemically synthesized
ggccctgccatacttttctctc

SEQ ID NO: 833539 - DNA, 22 bp, Artificial Sequence
  chemically synthesized
gccctgccatacttttctctct

SEQ ID NO: 833540 - DNA, 22 bp, Artificial Sequence
  chemically synthesized
atctttttcctgcaagagagaa

SEQ ID NO: 833541 - DNA, 22 bp, Artificial Sequence
  chemically synthesized
catctttttcctgcaagagaga

SEQ ID NO: 833542 - DNA, 22 bp, Artificial Sequence
  chemically synthesized
ccatacttttctctcttgcagg

SEQ ID NO: 833543 - DNA, 22 bp, Artificial Sequence
  chemically synthesized
gtttcatctttttcctgcaaga

SEQ ID NO: 833544 - DNA, 22 bp, Artificial Sequence
  chemically synthesized
ttctctcttgcaggaaaaagat

SEQ ID NO: 833545 - DNA, 22 bp, Artificial Sequence
  chemically synthesized
tctctcttgcaggaaaaagatg

SEQ ID NO: 833546 - DNA, 22 bp, Artificial Sequence
  chemically synthesized
ctctcttgcaggaaaaagatga

SEQ ID NO: 833547 - DNA, 22 bp, Artificial Sequence
  chemically synthesized
tctcttgcaggaaaaagatgaa

SEQ ID NO: 833548 - DNA, 22 bp, Artificial Sequence
  chemically synthesized
tcttgcaggaaaaagatgaaac

SEQ ID NO: 833549 - DNA, 22 bp, Artificial Sequence
  chemically synthesized
ttgcaggaaaaagatgaaacta

SEQ ID NO: 833550 - DNA, 22 bp, Artificial Sequence
  chemically synthesized
gcaggaaaaagatgaaactaat

SEQ ID NO: 833551 - DNA, 22 bp, Artificial Sequence
  chemically synthesized
caggaaaaagatgaaactaatg

SEQ ID NO: 833552 - DNA, 22 bp, Artificial Sequence
  chemically synthesized
aaaagcagtggtcacagtccat

SEQ ID NO: 833553 - DNA, 22 bp, Artificial Sequence
  chemically synthesized
ctgaaaagcagtggtcacagtc

SEQ ID NO: 833554 - DNA, 22 bp, Artificial Sequence
  chemically synthesized
gctgaaaagcagtggtcacagt

SEQ ID NO: 833555 - DNA, 22 bp, Artificial Sequence
  chemically synthesized
tgctgaaaagcagtggtcacag

SEQ ID NO: 833556 - DNA, 22 bp, Artificial Sequence
  chemically synthesized
atggactgtgaccactgctttt

SEQ ID NO: 833557 - DNA, 22 bp, Artificial Sequence
  chemically synthesized
ggtgtactttgctgaaaagcag

SEQ ID NO: 833558 - DNA, 22 bp, Artificial Sequence
  chemically synthesized
tgaccactgcttttcagcaaag

SEQ ID NO: 833559 - DNA, 22 bp, Artificial Sequence
  chemically synthesized
cttttcagcaaagtacacctag

SEQ ID NO: 833560 - DNA, 22 bp, Artificial Sequence
  chemically synthesized
ttcagcaaagtacacctaggtc

SEQ ID NO: 833561 - DNA, 22 bp, Artificial Sequence
  chemically synthesized
tcagcaaagtacacctaggtca

SEQ ID NO: 833562 - DNA, 22 bp, Artificial Sequence
  chemically synthesized
cagcaaagtacacctaggtcac

SEQ ID NO: 833563 - DNA, 22 bp, Artificial Sequence
  chemically synthesized
agcaaagtacacctaggtcact

SEQ ID NO: 833564 - DNA, 22 bp, Artificial Sequence
  chemically synthesized
tggaagaagcacagtgacctag

SEQ ID NO: 833565 - DNA, 22 bp, Artificial Sequence
  chemically synthesized
tattgtggaagaagcacagtga

SEQ ID NO: 833566 - DNA, 22 bp, Artificial Sequence
  chemically synthesized
ggtcactgtgcttcttccacaa

SEQ ID NO: 833567 - DNA, 22 bp, Artificial Sequence
  chemically synthesized
tgcttcttccacaatacaggct

SEQ ID NO: 833568 - DNA, 22 bp, Artificial Sequence
  chemically synthesized
agacacgacatgcagcctgtat

SEQ ID NO: 833569 - DNA, 22 bp, Artificial Sequence
  chemically synthesized
cagacacgacatgcagcctgta

SEQ ID NO: 833570 - DNA, 22 bp, Artificial Sequence
  chemically synthesized
tcagacacgacatgcagcctgt

SEQ ID NO: 833571 - DNA, 22 bp, Artificial Sequence
  chemically synthesized
cttccacaatacaggctgcatg

SEQ ID NO: 833572 - DNA, 22 bp, Artificial Sequence
  chemically synthesized
ttccacaatacaggctgcatgt

SEQ ID NO: 833573 - DNA, 22 bp, Artificial Sequence
  chemically synthesized
ccacaatacaggctgcatgtcg

SEQ ID NO: 833574 - DNA, 22 bp, Artificial Sequence
  chemically synthesized
cacaatacaggctgcatgtcgt

SEQ ID NO: 833575 - DNA, 22 bp, Artificial Sequence
  chemically synthesized
agcaaaatgattttcagacacg

SEQ ID NO: 833576 - DNA, 22 bp, Artificial Sequence
  chemically synthesized
aagcaaaatgattttcagacac

SEQ ID NO: 833577 - DNA, 22 bp, Artificial Sequence
  chemically synthesized
taagcaaaatgattttcagaca

SEQ ID NO: 833578 - DNA, 22 bp, Artificial Sequence
  chemically synthesized
catgtcgtgtctgaaaatcatt

SEQ ID NO: 833579 - DNA, 22 bp, Artificial Sequence
  chemically synthesized
ccaacaaagcagctttaagcaa

SEQ ID NO: 833580 - DNA, 22 bp, Artificial Sequence
  chemically synthesized
cccaacaaagcagctttaagca

SEQ ID NO: 833581 - DNA, 22 bp, Artificial Sequence
  chemically synthesized
aaaatcattttgcttaaagctg

SEQ ID NO: 833582 - DNA, 22 bp, Artificial Sequence
  chemically synthesized
tgcttaaagctgctttgttggg

SEQ ID NO: 833583 - DNA, 22 bp, Artificial Sequence
  chemically synthesized
gcttaaagctgctttgttggga

SEQ ID NO: 833584 - DNA, 22 bp, Artificial Sequence
  chemically synthesized
cttaaagctgctttgttgggaa

SEQ ID NO: 833585 - DNA, 22 bp, Artificial Sequence
  chemically synthesized
aaagctgctttgttgggaaata

SEQ ID NO: 833586 - DNA, 22 bp, Artificial Sequence
  chemically synthesized
aagctgctttgttgggaaatat

SEQ ID NO: 833587 - DNA, 22 bp, Artificial Sequence
  chemically synthesized
gaaaagccaagcaagtaatatt

SEQ ID NO: 833588 - DNA, 22 bp, Artificial Sequence
  chemically synthesized
ctttgttgggaaatattacttg

SEQ ID NO: 833589 - DNA, 22 bp, Artificial Sequence
  chemically synthesized
tgttgggaaatattacttgctt

SEQ ID NO: 833590 - DNA, 22 bp, Artificial Sequence
  chemically synthesized
gttgggaaatattacttgcttg

SEQ ID NO: 833591 - DNA, 22 bp, Artificial Sequence
  chemically synthesized
ttgggaaatattacttgcttgg

SEQ ID NO: 833592 - DNA, 22 bp, Artificial Sequence
  chemically synthesized
ggaaatattacttgcttggctt

SEQ ID NO: 833593 - DNA, 22 bp, Artificial Sequence
  chemically synthesized
aaagtcaagctagaaaagccaa

SEQ ID NO: 833594 - DNA, 22 bp, Artificial Sequence
  chemically synthesized
cttgcttggcttttctagcttg

SEQ ID NO: 833595 - DNA, 22 bp, Artificial Sequence
  chemically synthesized
aaataactcaaagtcaagctag

SEQ ID NO: 833596 - DNA, 22 bp, Artificial Sequence
  chemically synthesized
gcttggcttttctagcttgact

SEQ ID NO: 833597 - DNA, 22 bp, Artificial Sequence
  chemically synthesized
cttggcttttctagcttgactt

SEQ ID NO: 833598 - DNA, 22 bp, Artificial Sequence
  chemically synthesized
tctcaaataactcaaagtcaag

SEQ ID NO: 833599 - DNA, 22 bp, Artificial Sequence
  chemically synthesized
ggcttttctagcttgactttga

SEQ ID NO: 833600 - DNA, 22 bp, Artificial Sequence
  chemically synthesized
atctcaaataactcaaagtcaa

SEQ ID NO: 833601 - DNA, 22 bp, Artificial Sequence
  chemically synthesized
gcttttctagcttgactttgag

SEQ ID NO: 833602 - DNA, 22 bp, Artificial Sequence
  chemically synthesized
tttatctcaaataactcaaagt

SEQ ID NO: 833603 - DNA, 22 bp, Artificial Sequence
  chemically synthesized
atttatctcaaataactcaaag

SEQ ID NO: 833604 - DNA, 22 bp, Artificial Sequence
  chemically synthesized
ttctagcttgactttgagttat

SEQ ID NO: 833605 - DNA, 22 bp, Artificial Sequence
  chemically synthesized
tctagcttgactttgagttatt

SEQ ID NO: 833606 - DNA, 22 bp, Artificial Sequence
  chemically synthesized
ctagcttgactttgagttattt

SEQ ID NO: 833607 - DNA, 22 bp, Artificial Sequence
  chemically synthesized
cttatttatctcaaataactca

SEQ ID NO: 833608 - DNA, 22 bp, Artificial Sequence
  chemically synthesized
tagcttgactttgagttatttg

SEQ ID NO: 833609 - DNA, 22 bp, Artificial Sequence
  chemically synthesized
acttatttatctcaaataactc

SEQ ID NO: 833610 - DNA, 22 bp, Artificial Sequence
  chemically synthesized
gcttgactttgagttatttgag

SEQ ID NO: 833611 - DNA, 22 bp, Artificial Sequence
  chemically synthesized
ttacttatttatctcaaataac

SEQ ID NO: 833612 - DNA, 22 bp, Artificial Sequence
  chemically synthesized
tcttacttatttatctcaaata

SEQ ID NO: 833613 - DNA, 22 bp, Artificial Sequence
  chemically synthesized
gactttgagttatttgagataa

SEQ ID NO: 833614 - DNA, 22 bp, Artificial Sequence
  chemically synthesized
tctcttacttatttatctcaaa

SEQ ID NO: 833615 - DNA, 22 bp, Artificial Sequence
  chemically synthesized
actttgagttatttgagataaa

SEQ ID NO: 833616 - DNA, 22 bp, Artificial Sequence
  chemically synthesized
ctctcttacttatttatctcaa

SEQ ID NO: 833617 - DNA, 22 bp, Artificial Sequence
  chemically synthesized
tctctcttacttatttatctca

SEQ ID NO: 833618 - DNA, 22 bp, Artificial Sequence
  chemically synthesized
tgagttatttgagataaataag

SEQ ID NO: 833619 - DNA, 22 bp, Artificial Sequence
  chemically synthesized
gagttatttgagataaataagt

SEQ ID NO: 833620 - DNA, 22 bp, Artificial Sequence
  chemically synthesized
agttatttgagataaataagta

SEQ ID NO: 833621 - DNA, 22 bp, Artificial Sequence
  chemically synthesized
tttgagataaataagtaagaga

SEQ ID NO: 833622 - DNA, 22 bp, Artificial Sequence
  chemically synthesized
gagataaataagtaagagagaa

SEQ ID NO: 833623 - DNA, 22 bp, Artificial Sequence
  chemically synthesized
agataaataagtaagagagaaa

SEQ ID NO: 833624 - DNA, 22 bp, Artificial Sequence
  chemically synthesized
tgatagagaaagggtcaacttt

SEQ ID NO: 833625 - DNA, 22 bp, Artificial Sequence
  chemically synthesized
gactatgatagagaaagggtca

SEQ ID NO: 833626 - DNA, 22 bp, Artificial Sequence
  chemically synthesized
agactatgatagagaaagggtc

SEQ ID NO: 833627 - DNA, 22 bp, Artificial Sequence
  chemically synthesized
tagactatgatagagaaagggt

SEQ ID NO: 833628 - DNA, 22 bp, Artificial Sequence
  chemically synthesized
ttagactatgatagagaaaggg

SEQ ID NO: 833629 - DNA, 22 bp, Artificial Sequence
  chemically synthesized
tttagactatgatagagaaagg

SEQ ID NO: 833630 - DNA, 22 bp, Artificial Sequence
  chemically synthesized
ttttttagactatgatagagaa

SEQ ID NO: 833631 - DNA, 22 bp, Artificial Sequence
  chemically synthesized
attttttagactatgatagaga

SEQ ID NO: 833632 - DNA, 22 bp, Artificial Sequence
  chemically synthesized
tattttttagactatgatagag

SEQ ID NO: 833633 - DNA, 22 bp, Artificial Sequence
  chemically synthesized
accctttctctatcatagtcta

SEQ ID NO: 833634 - DNA, 22 bp, Artificial Sequence
  chemically synthesized
tctctatcatagtctaaaaaat

SEQ ID NO: 833635 - DNA, 22 bp, Artificial Sequence
  chemically synthesized
ctctatcatagtctaaaaaata

SEQ ID NO: 833636 - DNA, 22 bp, Artificial Sequence
  chemically synthesized
tctatcatagtctaaaaaataa

SEQ ID NO: 833637 - DNA, 22 bp, Artificial Sequence
  chemically synthesized
caacagcaacctttatttttta

SEQ ID NO: 833638 - DNA, 22 bp, Artificial Sequence
  chemically synthesized
ccaacagcaacctttatttttt

SEQ ID NO: 833639 - DNA, 22 bp, Artificial Sequence
  chemically synthesized
tatcatagtctaaaaaataaag

SEQ ID NO: 833640 - DNA, 22 bp, Artificial Sequence
  chemically synthesized
tcatagtctaaaaaataaaggt

SEQ ID NO: 833641 - DNA, 22 bp, Artificial Sequence
  chemically synthesized
atttccaacagcaacctttatt

SEQ ID NO: 833642 - DNA, 22 bp, Artificial Sequence
  chemically synthesized
aaaaataaaggttgctgttgga

SEQ ID NO: 833643 - DNA, 22 bp, Artificial Sequence
  chemically synthesized
tgggtccgtgttgatttccaac

SEQ ID NO: 833644 - DNA, 22 bp, Artificial Sequence
  chemically synthesized
ctgttggaaatcaacacggacc

SEQ ID NO: 833645 - DNA, 22 bp, Artificial Sequence
  chemically synthesized
aacaagaaattgtgggtccgtg

SEQ ID NO: 833646 - DNA, 22 bp, Artificial Sequence
  chemically synthesized
ttggaaatcaacacggacccac

SEQ ID NO: 833647 - DNA, 22 bp, Artificial Sequence
  chemically synthesized
gaaatcaacacggacccacaat

SEQ ID NO: 833648 - DNA, 22 bp, Artificial Sequence
  chemically synthesized
cacattcaacaagaaattgtgg

SEQ ID NO: 833649 - DNA, 22 bp, Artificial Sequence
  chemically synthesized
taattccacattcaacaagaaa

SEQ ID NO: 833650 - DNA, 22 bp, Artificial Sequence
  chemically synthesized
cttgttgaatgtggaattataa

SEQ ID NO: 833651 - DNA, 22 bp, Artificial Sequence
  chemically synthesized
ttgttgaatgtggaattataat

SEQ ID NO: 833652 - DNA, 22 bp, Artificial Sequence
  chemically synthesized
atcatgagggataattataatt

SEQ ID NO: 833653 - DNA, 22 bp, Artificial Sequence
  chemically synthesized
gttgaatgtggaattataatta

SEQ ID NO: 833654 - DNA, 22 bp, Artificial Sequence
  chemically synthesized
catcatgagggataattataat

SEQ ID NO: 833655 - DNA, 22 bp, Artificial Sequence
  chemically synthesized
ttgaatgtggaattataattat

SEQ ID NO: 833656 - DNA, 22 bp, Artificial Sequence
  chemically synthesized
aatgtggaattataattatccc

SEQ ID NO: 833657 - DNA, 22 bp, Artificial Sequence
  chemically synthesized
catttcatcatgagggataatt

SEQ ID NO: 833658 - DNA, 22 bp, Artificial Sequence
  chemically synthesized
tattacatttcatcatgaggga

SEQ ID NO: 833659 - DNA, 22 bp, Artificial Sequence
  chemically synthesized
tctatattacatttcatcatga

SEQ ID NO: 833660 - DNA, 22 bp, Artificial Sequence
  chemically synthesized
taattatccctcatgatgaaat

SEQ ID NO: 833661 - DNA, 22 bp, Artificial Sequence
  chemically synthesized
tccctcatgatgaaatgtaata

SEQ ID NO: 833662 - DNA, 22 bp, Artificial Sequence
  chemically synthesized
atgatgaaatgtaatatagaca

SEQ ID NO: 833663 - DNA, 22 bp, Artificial Sequence
  chemically synthesized
catatggcaaactgtctatatt

SEQ ID NO: 833664 - DNA, 22 bp, Artificial Sequence
  chemically synthesized
ttccatatggcaaactgtctat

SEQ ID NO: 833665 - DNA, 22 bp, Artificial Sequence
  chemically synthesized
atctattccatatggcaaactg

SEQ ID NO: 833666 - DNA, 22 bp, Artificial Sequence
  chemically synthesized
catctattccatatggcaaact

SEQ ID NO: 833667 - DNA, 22 bp, Artificial Sequence
  chemically synthesized
tttcatctattccatatggcaa

SEQ ID NO: 833668 - DNA, 22 bp, Artificial Sequence
  chemically synthesized
acctatttcatctattccatat

SEQ ID NO: 833669 - DNA, 22 bp, Artificial Sequence
  chemically synthesized
tcacctatttcatctattccat

SEQ ID NO: 833670 - DNA, 22 bp, Artificial Sequence
  chemically synthesized
gcctctcacctatttcatctat

SEQ ID NO: 833671 - DNA, 22 bp, Artificial Sequence
  chemically synthesized
gccatatggaatagatgaaata

SEQ ID NO: 833672 - DNA, 22 bp, Artificial Sequence
  chemically synthesized
tggcctctcacctatttcatct

SEQ ID NO: 833673 - DNA, 22 bp, Artificial Sequence
  chemically synthesized
ccatatggaatagatgaaatag

SEQ ID NO: 833674 - DNA, 22 bp, Artificial Sequence
  chemically synthesized
acagctctggcctctcacctat

SEQ ID NO: 833675 - DNA, 22 bp, Artificial Sequence
  chemically synthesized
aaactgacagctctggcctctc

SEQ ID NO: 833676 - DNA, 22 bp, Artificial Sequence
  chemically synthesized
tcaaactgacagctctggcctc

SEQ ID NO: 833677 - DNA, 22 bp, Artificial Sequence
  chemically synthesized
tatgaatgacagctctcaaact

SEQ ID NO: 833678 - DNA, 22 bp, Artificial Sequence
  chemically synthesized
atcactatatgaatgacagctc

SEQ ID NO: 833679 - DNA, 22 bp, Artificial Sequence
  chemically synthesized
tcagtttgagagctgtcattca

SEQ ID NO: 833680 - DNA, 22 bp, Artificial Sequence
  chemically synthesized
ttcatcactatatgaatgacag

SEQ ID NO: 833681 - DNA, 22 bp, Artificial Sequence
  chemically synthesized
agttattcatcactatatgaat

SEQ ID NO: 833682 - DNA, 22 bp, Artificial Sequence
  chemically synthesized
cagttattcatcactatatgaa

SEQ ID NO: 833683 - DNA, 22 bp, Artificial Sequence
  chemically synthesized
gagagctgtcattcatatagtg

SEQ ID NO: 833684 - DNA, 22 bp, Artificial Sequence
  chemically synthesized
agagctgtcattcatatagtga

SEQ ID NO: 833685 - DNA, 22 bp, Artificial Sequence
  chemically synthesized
atggcttcagttattcatcact

SEQ ID NO: 833686 - DNA, 22 bp, Artificial Sequence
  chemically synthesized
tcattcatatagtgatgaataa

SEQ ID NO: 833687 - DNA, 22 bp, Artificial Sequence
  chemically synthesized
ccctcatggcttcagttattca

SEQ ID NO: 833688 - DNA, 22 bp, Artificial Sequence
  chemically synthesized
accctcatggcttcagttattc

SEQ ID NO: 833689 - DNA, 22 bp, Artificial Sequence
  chemically synthesized
taccctcatggcttcagttatt

SEQ ID NO: 833690 - DNA, 22 bp, Artificial Sequence
  chemically synthesized
atatagtgatgaataactgaag

SEQ ID NO: 833691 - DNA, 22 bp, Artificial Sequence
  chemically synthesized
tttaccctcatggcttcagtta

SEQ ID NO: 833692 - DNA, 22 bp, Artificial Sequence
  chemically synthesized
ttctttaccctcatggcttcag

SEQ ID NO: 833693 - DNA, 22 bp, Artificial Sequence
  chemically synthesized
gttctttaccctcatggcttca

SEQ ID NO: 833694 - DNA, 22 bp, Artificial Sequence
  chemically synthesized
cccttgttctttaccctcatgg

SEQ ID NO: 833695 - DNA, 22 bp, Artificial Sequence
  chemically synthesized
gcccttgttctttaccctcatg

SEQ ID NO: 833696 - DNA, 22 bp, Artificial Sequence
  chemically synthesized
tgcccttgttctttaccctcat

SEQ ID NO: 833697 - DNA, 22 bp, Artificial Sequence
  chemically synthesized
aagccatgagggtaaagaacaa

SEQ ID NO: 833698 - DNA, 22 bp, Artificial Sequence
  chemically synthesized
ccaaggctttgcccttgttctt

SEQ ID NO: 833699 - DNA, 22 bp, Artificial Sequence
  chemically synthesized
agaccattcccaaggctttgcc

SEQ ID NO: 833700 - DNA, 22 bp, Artificial Sequence
  chemically synthesized
cagaccattcccaaggctttgc

SEQ ID NO: 833701 - DNA, 22 bp, Artificial Sequence
  chemically synthesized
ttcagaccattcccaaggcttt

SEQ ID NO: 833702 - DNA, 22 bp, Artificial Sequence
  chemically synthesized
cctcttcagaccattcccaagg

SEQ ID NO: 833703 - DNA, 22 bp, Artificial Sequence
  chemically synthesized
atctgcctcttcagaccattcc

SEQ ID NO: 833704 - DNA, 22 bp, Artificial Sequence
  chemically synthesized
gatctgcctcttcagaccattc

SEQ ID NO: 833705 - DNA, 22 bp, Artificial Sequence
  chemically synthesized
atgcatttgatctgcctcttca

SEQ ID NO: 833706 - DNA, 22 bp, Artificial Sequence
  chemically synthesized
catgcatttgatctgcctcttc

SEQ ID NO: 833707 - DNA, 22 bp, Artificial Sequence
  chemically synthesized
gggaatggtctgaagaggcaga

SEQ ID NO: 833708 - DNA, 22 bp, Artificial Sequence
  chemically synthesized
ggaatggtctgaagaggcagat

SEQ ID NO: 833709 - DNA, 22 bp, Artificial Sequence
  chemically synthesized
aatttcatgcatttgatctgcc

SEQ ID NO: 833710 - DNA, 22 bp, Artificial Sequence
  chemically synthesized
caatttcatgcatttgatctgc

SEQ ID NO: 833711 - DNA, 22 bp, Artificial Sequence
  chemically synthesized
tttcaatttcatgcatttgatc

SEQ ID NO: 833712 - DNA, 22 bp, Artificial Sequence
  chemically synthesized
atttcaatttcatgcatttgat

SEQ ID NO: 833713 - DNA, 22 bp, Artificial Sequence
  chemically synthesized
aagaggcagatcaaatgcatga

SEQ ID NO: 833714 - DNA, 22 bp, Artificial Sequence
  chemically synthesized
aatgtcttatttcaatttcatg

SEQ ID NO: 833715 - DNA, 22 bp, Artificial Sequence
  chemically synthesized
ctgaatgtcttatttcaatttc

SEQ ID NO: 833716 - DNA, 22 bp, Artificial Sequence
  chemically synthesized
cctgaatgtcttatttcaattt

SEQ ID NO: 833717 - DNA, 22 bp, Artificial Sequence
  chemically synthesized
tcctgaatgtcttatttcaatt

SEQ ID NO: 833718 - DNA, 22 bp, Artificial Sequence
  chemically synthesized
aaataagacattcaggaaaggt

SEQ ID NO: 833719 - DNA, 22 bp, Artificial Sequence
  chemically synthesized
aaagtaagaataatataacctt

SEQ ID NO: 833720 - DNA, 22 bp, Artificial Sequence
  chemically synthesized
gaaagtaagaataatataacct

SEQ ID NO: 833721 - DNA, 22 bp, Artificial Sequence
  chemically synthesized
ccttgaaagtaagaataatata

SEQ ID NO: 833722 - DNA, 22 bp, Artificial Sequence
  chemically synthesized
tgccttgaaagtaagaataata

SEQ ID NO: 833723 - DNA, 22 bp, Artificial Sequence
  chemically synthesized
aggaaaggttatattattctta

SEQ ID NO: 833724 - DNA, 22 bp, Artificial Sequence
  chemically synthesized
ctgccttgaaagtaagaataat

SEQ ID NO: 833725 - DNA, 22 bp, Artificial Sequence
  chemically synthesized
cagagcttctgccttgaaagta

SEQ ID NO: 833726 - DNA, 22 bp, Artificial Sequence
  chemically synthesized
tattattcttactttcaaggca

SEQ ID NO: 833727 - DNA, 22 bp, Artificial Sequence
  chemically synthesized
tctccagagcttctgccttgaa

SEQ ID NO: 833728 - DNA, 22 bp, Artificial Sequence
  chemically synthesized
atctccagagcttctgccttga

SEQ ID NO: 833729 - DNA, 22 bp, Artificial Sequence
  chemically synthesized
tatctccagagcttctgccttg

SEQ ID NO: 833730 - DNA, 22 bp, Artificial Sequence
  chemically synthesized
ttcttactttcaaggcagaagc

SEQ ID NO: 833731 - DNA, 22 bp, Artificial Sequence
  chemically synthesized
ttactttcaaggcagaagctct

SEQ ID NO: 833732 - DNA, 22 bp, Artificial Sequence
  chemically synthesized
actttcaaggcagaagctctgg

SEQ ID NO: 833733 - DNA, 22 bp, Artificial Sequence
  chemically synthesized
ctttcaaggcagaagctctgga

SEQ ID NO: 833734 - DNA, 22 bp, Artificial Sequence
  chemically synthesized
tcatgctttatctccagagctt

SEQ ID NO: 833735 - DNA, 22 bp, Artificial Sequence
  chemically synthesized
tcaaggcagaagctctggagat

SEQ ID NO: 833736 - DNA, 22 bp, Artificial Sequence
  chemically synthesized
caaggcagaagctctggagata

SEQ ID NO: 833737 - DNA, 22 bp, Artificial Sequence
  chemically synthesized
aaggcagaagctctggagataa

SEQ ID NO: 833738 - DNA, 22 bp, Artificial Sequence
  chemically synthesized
gtcaaaggaccacctgtcatgc

SEQ ID NO: 833739 - DNA, 22 bp, Artificial Sequence
  chemically synthesized
cgtcaaaggaccacctgtcatg

SEQ ID NO: 833740 - DNA, 22 bp, Artificial Sequence
  chemically synthesized
tggagataaagcatgacaggtg

SEQ ID NO: 833741 - DNA, 22 bp, Artificial Sequence
  chemically synthesized
gagataaagcatgacaggtggt

SEQ ID NO: 833742 - DNA, 22 bp, Artificial Sequence
  chemically synthesized
cttcgtcaaaggaccacctgtc

SEQ ID NO: 833743 - DNA, 22 bp, Artificial Sequence
  chemically synthesized
gcttcgtcaaaggaccacctgt

SEQ ID NO: 833744 - DNA, 22 bp, Artificial Sequence
  chemically synthesized
tgcttcgtcaaaggaccacctg

SEQ ID NO: 833745 - DNA, 22 bp, Artificial Sequence
  chemically synthesized
actttgcttcgtcaaaggacca

SEQ ID NO: 833746 - DNA, 22 bp, Artificial Sequence
  chemically synthesized
tgacgaagcaaagtgaacctct

SEQ ID NO: 833747 - DNA, 22 bp, Artificial Sequence
  chemically synthesized
gacgaagcaaagtgaacctctt

SEQ ID NO: 833748 - DNA, 22 bp, Artificial Sequence
  chemically synthesized
acgaagcaaagtgaacctcttg

SEQ ID NO: 833749 - DNA, 22 bp, Artificial Sequence
  chemically synthesized
gtaaagtatcagtgaccaccca

SEQ ID NO: 833750 - DNA, 22 bp, Artificial Sequence
  chemically synthesized
ggtaaagtatcagtgaccaccc

SEQ ID NO: 833751 - DNA, 22 bp, Artificial Sequence
  chemically synthesized
tggtaaagtatcagtgaccacc

SEQ ID NO: 833752 - DNA, 22 bp, Artificial Sequence
  chemically synthesized
atcactttggtaaagtatcagt

SEQ ID NO: 833753 - DNA, 22 bp, Artificial Sequence
  chemically synthesized
ttgggtggtcactgatacttta

SEQ ID NO: 833754 - DNA, 22 bp, Artificial Sequence
  chemically synthesized
gggtggtcactgatactttacc

SEQ ID NO: 833755 - DNA, 22 bp, Artificial Sequence
  chemically synthesized
ggtggtcactgatactttacca

SEQ ID NO: 833756 - DNA, 22 bp, Artificial Sequence
  chemically synthesized
tcagccatgtcctaatcacttt

SEQ ID NO: 833757 - DNA, 22 bp, Artificial Sequence
  chemically synthesized
gtcagccatgtcctaatcactt

SEQ ID NO: 833758 - DNA, 22 bp, Artificial Sequence
  chemically synthesized
atactttaccaaagtgattagg

SEQ ID NO: 833759 - DNA, 22 bp, Artificial Sequence
  chemically synthesized
ttgtcagccatgtcctaatcac

SEQ ID NO: 833760 - DNA, 22 bp, Artificial Sequence
  chemically synthesized
taccaaagtgattaggacatgg

SEQ ID NO: 833761 - DNA, 22 bp, Artificial Sequence
  chemically synthesized
accaaagtgattaggacatggc

SEQ ID NO: 833762 - DNA, 22 bp, Artificial Sequence
  chemically synthesized
ccaaagtgattaggacatggct

SEQ ID NO: 833763 - DNA, 22 bp, Artificial Sequence
  chemically synthesized
catccaatctcttgtcagccat

SEQ ID NO: 833764 - DNA, 22 bp, Artificial Sequence
  chemically synthesized
acatccaatctcttgtcagcca

SEQ ID NO: 833765 - DNA, 22 bp, Artificial Sequence
  chemically synthesized
tacatccaatctcttgtcagcc

SEQ ID NO: 833766 - DNA, 22 bp, Artificial Sequence
  chemically synthesized
tttacatccaatctcttgtcag

SEQ ID NO: 833767 - DNA, 22 bp, Artificial Sequence
  chemically synthesized
ctttacatccaatctcttgtca

SEQ ID NO: 833768 - DNA, 22 bp, Artificial Sequence
  chemically synthesized
tctttacatccaatctcttgtc

SEQ ID NO: 833769 - DNA, 22 bp, Artificial Sequence
  chemically synthesized
ggacatggctgacaagagattg

SEQ ID NO: 833770 - DNA, 22 bp, Artificial Sequence
  chemically synthesized
tcattttctttacatccaatct

SEQ ID NO: 833771 - DNA, 22 bp, Artificial Sequence
  chemically synthesized
tatcattttctttacatccaat

SEQ ID NO: 833772 - DNA, 22 bp, Artificial Sequence
  chemically synthesized
ctatcattttctttacatccaa

SEQ ID NO: 833773 - DNA, 22 bp, Artificial Sequence
  chemically synthesized
acaagagattggatgtaaagaa

SEQ ID NO: 833774 - DNA, 22 bp, Artificial Sequence
  chemically synthesized
caagcatttctatcattttctt

SEQ ID NO: 833775 - DNA, 22 bp, Artificial Sequence
  chemically synthesized
tacaagcatttctatcattttc

SEQ ID NO: 833776 - DNA, 22 bp, Artificial Sequence
  chemically synthesized
gatgtaaagaaaatgatagaaa

SEQ ID NO: 833777 - DNA, 22 bp, Artificial Sequence
  chemically synthesized
aaataaactctacaagcatttc

SEQ ID NO: 833778 - DNA, 22 bp, Artificial Sequence
  chemically synthesized
acagctaaaataaactctacaa

SEQ ID NO: 833779 - DNA, 22 bp, Artificial Sequence
  chemically synthesized
aacagctaaaataaactctaca

SEQ ID NO: 833780 - DNA, 22 bp, Artificial Sequence
  chemically synthesized
taacagctaaaataaactctac

SEQ ID NO: 833781 - DNA, 22 bp, Artificial Sequence
  chemically synthesized
ttaacagctaaaataaactcta

SEQ ID NO: 833782 - DNA, 22 bp, Artificial Sequence
  chemically synthesized
tttaacagctaaaataaactct

SEQ ID NO: 833783 - DNA, 22 bp, Artificial Sequence
  chemically synthesized
ttttaacagctaaaataaactc

SEQ ID NO: 833784 - DNA, 22 bp, Artificial Sequence
  chemically synthesized
tttttaacagctaaaataaact

SEQ ID NO: 833785 - DNA, 22 bp, Artificial Sequence
  chemically synthesized
ttttttaacagctaaaataaac

SEQ ID NO: 833786 - DNA, 22 bp, Artificial Sequence
  chemically synthesized
tttttttaacagctaaaataaa

SEQ ID NO: 833787 - DNA, 22 bp, Artificial Sequence
  chemically synthesized
ttttttttaacagctaaaataa

SEQ ID NO: 833788 - DNA, 22 bp, Artificial Sequence
  chemically synthesized
tttttttttaacagctaaaata

SEQ ID NO: 833789 - DNA, 22 bp, Artificial Sequence
  chemically synthesized
ttttttttttaacagctaaaat

SEQ ID NO: 833790 - DNA, 22 bp, Artificial Sequence
  chemically synthesized
tttttttttttaacagctaaaa

SEQ ID NO: 833791 - DNA, 22 bp, Artificial Sequence
  chemically synthesized
ttttttttttttaacagctaaa

SEQ ID NO: 833792 - DNA, 22 bp, Artificial Sequence
  chemically synthesized
gtagagtttattttagctgtta

SEQ ID NO: 833793 - DNA, 22 bp, Artificial Sequence
  chemically synthesized
tttttttttttttaacagctaa

SEQ ID NO: 833794 - DNA, 22 bp, Artificial Sequence
  chemically synthesized
tagagtttattttagctgttaa

SEQ ID NO: 833795 - DNA, 22 bp, Artificial Sequence
  chemically synthesized
ttttttttttttttaacagcta

SEQ ID NO: 833796 - DNA, 22 bp, Artificial Sequence
  chemically synthesized
cttttttttttttttttaacag

SEQ ID NO: 833797 - DNA, 22 bp, Artificial Sequence
  chemically synthesized
gcttttttttttttttttaaca

SEQ ID NO: 833798 - DNA, 22 bp, Artificial Sequence
  chemically synthesized
tgcttttttttttttttttaac

SEQ ID NO: 833799 - DNA, 22 bp, Artificial Sequence
  chemically synthesized
attttagctgttaaaaaaaaaa

SEQ ID NO: 833800 - DNA, 22 bp, Artificial Sequence
  chemically synthesized
ttttagctgttaaaaaaaaaaa

SEQ ID NO: 833801 - DNA, 22 bp, Artificial Sequence
  chemically synthesized
gttttgcttttttttttttttt

SEQ ID NO: 833802 - DNA, 22 bp, Artificial Sequence
  chemically synthesized
tagctgttaaaaaaaaaaaaaa

SEQ ID NO: 833803 - DNA, 22 bp, Artificial Sequence
  chemically synthesized
agctgttaaaaaaaaaaaaaaa

SEQ ID NO: 833804 - DNA, 22 bp, Artificial Sequence
  chemically synthesized
tctggttttgcttttttttttt

SEQ ID NO: 833805 - DNA, 22 bp, Artificial Sequence
  chemically synthesized
gctgttaaaaaaaaaaaaaaaa

SEQ ID NO: 833806 - DNA, 22 bp, Artificial Sequence
  chemically synthesized
ctgtctggttttgctttttttt

SEQ ID NO: 833807 - DNA, 22 bp, Artificial Sequence
  chemically synthesized
cctgtctggttttgcttttttt

SEQ ID NO: 833808 - DNA, 22 bp, Artificial Sequence
  chemically synthesized
ttaaaaaaaaaaaaaaaagcaa

SEQ ID NO: 833809 - DNA, 22 bp, Artificial Sequence
  chemically synthesized
aaaaaaaaaaaaaaagcaaaac

SEQ ID NO: 833810 - DNA, 22 bp, Artificial Sequence
  chemically synthesized
agtttcctgtctggttttgctt

SEQ ID NO: 833811 - DNA, 22 bp, Artificial Sequence
  chemically synthesized
aagtttcctgtctggttttgct

SEQ ID NO: 833812 - DNA, 22 bp, Artificial Sequence
  chemically synthesized
cttaagtttcctgtctggtttt

SEQ ID NO: 833813 - DNA, 22 bp, Artificial Sequence
  chemically synthesized
atattccttaagtttcctgtct

SEQ ID NO: 833814 - DNA, 22 bp, Artificial Sequence
  chemically synthesized
cacaatgaggtagctcatattc

SEQ ID NO: 833815 - DNA, 22 bp, Artificial Sequence
  chemically synthesized
ccacaatgaggtagctcatatt

SEQ ID NO: 833816 - DNA, 22 bp, Artificial Sequence
  chemically synthesized
cttccacaatgaggtagctcat

SEQ ID NO: 833817 - DNA, 22 bp, Artificial Sequence
  chemically synthesized
gcttccacaatgaggtagctca

SEQ ID NO: 833818 - DNA, 22 bp, Artificial Sequence
  chemically synthesized
tgcttccacaatgaggtagctc

SEQ ID NO: 833819 - DNA, 22 bp, Artificial Sequence
  chemically synthesized
aaggaatatgagctacctcatt

SEQ ID NO: 833820 - DNA, 22 bp, Artificial Sequence
  chemically synthesized
aggaatatgagctacctcattg

SEQ ID NO: 833821 - DNA, 22 bp, Artificial Sequence
  chemically synthesized
agtctttgcttccacaatgagg

SEQ ID NO: 833822 - DNA, 22 bp, Artificial Sequence
  chemically synthesized
tgagtctttgcttccacaatga

SEQ ID NO: 833823 - DNA, 22 bp, Artificial Sequence
  chemically synthesized
ctgagtctttgcttccacaatg

SEQ ID NO: 833824 - DNA, 22 bp, Artificial Sequence
  chemically synthesized
ttctgagtctttgcttccacaa

SEQ ID NO: 833825 - DNA, 22 bp, Artificial Sequence
  chemically synthesized
cttctgagtctttgcttccaca

SEQ ID NO: 833826 - DNA, 22 bp, Artificial Sequence
  chemically synthesized
cttcttctgagtctttgcttcc

SEQ ID NO: 833827 - DNA, 22 bp, Artificial Sequence
  chemically synthesized
tacttcttctgagtctttgctt

SEQ ID NO: 833828 - DNA, 22 bp, Artificial Sequence
  chemically synthesized
cctcattgtggaagcaaagact

SEQ ID NO: 833829 - DNA, 22 bp, Artificial Sequence
  chemically synthesized
tctacttcttctgagtctttgc

SEQ ID NO: 833830 - DNA, 22 bp, Artificial Sequence
  chemically synthesized
attgtggaagcaaagactcaga

SEQ ID NO: 833831 - DNA, 22 bp, Artificial Sequence
  chemically synthesized
ttctctacttcttctgagtctt

SEQ ID NO: 833832 - DNA, 22 bp, Artificial Sequence
  chemically synthesized
gttctctacttcttctgagtct

SEQ ID NO: 833833 - DNA, 22 bp, Artificial Sequence
  chemically synthesized
ttgttctctacttcttctgagt

SEQ ID NO: 833834 - DNA, 22 bp, Artificial Sequence
  chemically synthesized
tggaagcaaagactcagaagaa

SEQ ID NO: 833835 - DNA, 22 bp, Artificial Sequence
  chemically synthesized
cttgttctctacttcttctgag

SEQ ID NO: 833836 - DNA, 22 bp, Artificial Sequence
  chemically synthesized
tcttgttctctacttcttctga

SEQ ID NO: 833837 - DNA, 22 bp, Artificial Sequence
  chemically synthesized
ctttcttgttctctacttcttc

SEQ ID NO: 833838 - DNA, 22 bp, Artificial Sequence
  chemically synthesized
ctactttcttgttctctacttc

SEQ ID NO: 833839 - DNA, 22 bp, Artificial Sequence
  chemically synthesized
aacctcctactttcttgttctc

SEQ ID NO: 833840 - DNA, 22 bp, Artificial Sequence
  chemically synthesized
agaagaagtagagaacaagaaa

SEQ ID NO: 833841 - DNA, 22 bp, Artificial Sequence
  chemically synthesized
ctcaacctcctactttcttgtt

SEQ ID NO: 833842 - DNA, 22 bp, Artificial Sequence
  chemically synthesized
actcaacctcctactttcttgt

SEQ ID NO: 833843 - DNA, 22 bp, Artificial Sequence
  chemically synthesized
tactcaacctcctactttcttg

SEQ ID NO: 833844 - DNA, 22 bp, Artificial Sequence
  chemically synthesized
atattttactcaacctcctact

SEQ ID NO: 833845 - DNA, 22 bp, Artificial Sequence
  chemically synthesized
cctgatattttactcaacctcc

SEQ ID NO: 833846 - DNA, 22 bp, Artificial Sequence
  chemically synthesized
gctacctgatattttactcaac

SEQ ID NO: 833847 - DNA, 22 bp, Artificial Sequence
  chemically synthesized
ggctacctgatattttactcaa

SEQ ID NO: 833848 - DNA, 22 bp, Artificial Sequence
  chemically synthesized
acttggctacctgatattttac

SEQ ID NO: 833849 - DNA, 22 bp, Artificial Sequence
  chemically synthesized
actaacttggctacctgatatt

SEQ ID NO: 833850 - DNA, 22 bp, Artificial Sequence
  chemically synthesized
ttgactaacttggctacctgat

SEQ ID NO: 833851 - DNA, 22 bp, Artificial Sequence
  chemically synthesized
gttgactaacttggctacctga

SEQ ID NO: 833852 - DNA, 22 bp, Artificial Sequence
  chemically synthesized
tgttgactaacttggctacctg

SEQ ID NO: 833853 - DNA, 22 bp, Artificial Sequence
  chemically synthesized
ttgttgactaacttggctacct

SEQ ID NO: 833854 - DNA, 22 bp, Artificial Sequence
  chemically synthesized
agtaaaatatcaggtagccaag

SEQ ID NO: 833855 - DNA, 22 bp, Artificial Sequence
  chemically synthesized
cacttttgttgactaacttggc

SEQ ID NO: 833856 - DNA, 22 bp, Artificial Sequence
  chemically synthesized
ccacttttgttgactaacttgg

SEQ ID NO: 833857 - DNA, 22 bp, Artificial Sequence
  chemically synthesized
agtggaaatcttccacttttgt

SEQ ID NO: 833858 - DNA, 22 bp, Artificial Sequence
  chemically synthesized
aagtggaaatcttccacttttg

SEQ ID NO: 833859 - DNA, 22 bp, Artificial Sequence
  chemically synthesized
taagtggaaatcttccactttt

SEQ ID NO: 833860 - DNA, 22 bp, Artificial Sequence
  chemically synthesized
gtcaacaaaagtggaagatttc

SEQ ID NO: 833861 - DNA, 22 bp, Artificial Sequence
  chemically synthesized
taaattttaagtggaaatcttc

SEQ ID NO: 833862 - DNA, 22 bp, Artificial Sequence
  chemically synthesized
gtaaattttaagtggaaatctt

SEQ ID NO: 833863 - DNA, 22 bp, Artificial Sequence
  chemically synthesized
tgtaaattttaagtggaaatct

SEQ ID NO: 833864 - DNA, 22 bp, Artificial Sequence
  chemically synthesized
ttgtaaattttaagtggaaatc

SEQ ID NO: 833865 - DNA, 22 bp, Artificial Sequence
  chemically synthesized
tttgtaaattttaagtggaaat

SEQ ID NO: 833866 - DNA, 22 bp, Artificial Sequence
  chemically synthesized
ttttgtaaattttaagtggaaa

SEQ ID NO: 833867 - DNA, 22 bp, Artificial Sequence
  chemically synthesized
tttttgtaaattttaagtggaa

SEQ ID NO: 833868 - DNA, 22 bp, Artificial Sequence
  chemically synthesized
ttttttgtaaattttaagtgga

SEQ ID NO: 833869 - DNA, 22 bp, Artificial Sequence
  chemically synthesized
tttttttgtaaattttaagtgg

SEQ ID NO: 833870 - DNA, 22 bp, Artificial Sequence
  chemically synthesized
gcattttttttttgtaaatttt

SEQ ID NO: 833871 - DNA, 22 bp, Artificial Sequence
  chemically synthesized
agcattttttttttgtaaattt

SEQ ID NO: 833872 - DNA, 22 bp, Artificial Sequence
  chemically synthesized
tagcattttttttttgtaaatt

SEQ ID NO: 833873 - DNA, 22 bp, Artificial Sequence
  chemically synthesized
ttagcattttttttttgtaaat

SEQ ID NO: 833874 - DNA, 22 bp, Artificial Sequence
  chemically synthesized
ccacttaaaatttacaaaaaaa

SEQ ID NO: 833875 - DNA, 22 bp, Artificial Sequence
  chemically synthesized
cacttaaaatttacaaaaaaaa

SEQ ID NO: 833876 - DNA, 22 bp, Artificial Sequence
  chemically synthesized
acttttagcattttttttttgt

SEQ ID NO: 833877 - DNA, 22 bp, Artificial Sequence
  chemically synthesized
taacttttagcatttttttttt

SEQ ID NO: 833878 - DNA, 22 bp, Artificial Sequence
  chemically synthesized
aaaatttacaaaaaaaaaatgc

SEQ ID NO: 833879 - DNA, 22 bp, Artificial Sequence
  chemically synthesized
aaatttacaaaaaaaaaatgct

SEQ ID NO: 833880 - DNA, 22 bp, Artificial Sequence
  chemically synthesized
caaaattctaacttttagcatt

SEQ ID NO: 833881 - DNA, 22 bp, Artificial Sequence
  chemically synthesized
ccaaaattctaacttttagcat

SEQ ID NO: 833882 - DNA, 22 bp, Artificial Sequence
  chemically synthesized
acaaaaaaaaaatgctaaaagt

SEQ ID NO: 833883 - DNA, 22 bp, Artificial Sequence
  chemically synthesized
tccaaaattctaacttttagca

SEQ ID NO: 833884 - DNA, 22 bp, Artificial Sequence
  chemically synthesized
caaaaaaaaaatgctaaaagtt

SEQ ID NO: 833885 - DNA, 22 bp, Artificial Sequence
  chemically synthesized
agtcgttttccaaaattctaac

SEQ ID NO: 833886 - DNA, 22 bp, Artificial Sequence
  chemically synthesized
aagttcagtcgttttccaaaat

SEQ ID NO: 833887 - DNA, 22 bp, Artificial Sequence
  chemically synthesized
caagttcagtcgttttccaaaa

SEQ ID NO: 833888 - DNA, 22 bp, Artificial Sequence
  chemically synthesized
aaagttagaattttggaaaacg

SEQ ID NO: 833889 - DNA, 22 bp, Artificial Sequence
  chemically synthesized
gaattttggaaaacgactgaac

SEQ ID NO: 833890 - DNA, 22 bp, Artificial Sequence
  chemically synthesized
atatgtacaatcttcaagttca

SEQ ID NO: 833891 - DNA, 22 bp, Artificial Sequence
  chemically synthesized
tggaaaacgactgaacttgaag

SEQ ID NO: 833892 - DNA, 22 bp, Artificial Sequence
  chemically synthesized
ggaaaacgactgaacttgaaga

SEQ ID NO: 833893 - DNA, 22 bp, Artificial Sequence
  chemically synthesized
gaaaacgactgaacttgaagat

SEQ ID NO: 833894 - DNA, 22 bp, Artificial Sequence
  chemically synthesized
gctaatatgtacaatcttcaag

SEQ ID NO: 833895 - DNA, 22 bp, Artificial Sequence
  chemically synthesized
cctggctaatatgtacaatctt

SEQ ID NO: 833896 - DNA, 22 bp, Artificial Sequence
  chemically synthesized
aacttgaagattgtacatatta

SEQ ID NO: 833897 - DNA, 22 bp, Artificial Sequence
  chemically synthesized
gagtaactgcctggctaatatg

SEQ ID NO: 833898 - DNA, 22 bp, Artificial Sequence
  chemically synthesized
agagtaactgcctggctaatat

SEQ ID NO: 833899 - DNA, 22 bp, Artificial Sequence
  chemically synthesized
gaagattgtacatattagccag

SEQ ID NO: 833900 - DNA, 22 bp, Artificial Sequence
  chemically synthesized
aagattgtacatattagccagg

SEQ ID NO: 833901 - DNA, 22 bp, Artificial Sequence
  chemically synthesized
tacatattagccaggcagttac

SEQ ID NO: 833902 - DNA, 22 bp, Artificial Sequence
  chemically synthesized
tataagagtatgagtttagagt

SEQ ID NO: 833903 - DNA, 22 bp, Artificial Sequence
  chemically synthesized
gccaggcagttactctaaactc

SEQ ID NO: 833904 - DNA, 22 bp, Artificial Sequence
  chemically synthesized
ataattatataagagtatgagt

SEQ ID NO: 833905 - DNA, 22 bp, Artificial Sequence
  chemically synthesized
aataattatataagagtatgag

SEQ ID NO: 833906 - DNA, 22 bp, Artificial Sequence
  chemically synthesized
taataattatataagagtatga

SEQ ID NO: 833907 - DNA, 22 bp, Artificial Sequence
  chemically synthesized
ttaataattatataagagtatg

SEQ ID NO: 833908 - DNA, 22 bp, Artificial Sequence
  chemically synthesized
ctctaaactcatactcttatat

SEQ ID NO: 833909 - DNA, 22 bp, Artificial Sequence
  chemically synthesized
cttttaataattatataagagt

SEQ ID NO: 833910 - DNA, 22 bp, Artificial Sequence
  chemically synthesized
taaactcatactcttatataat

SEQ ID NO: 833911 - DNA, 22 bp, Artificial Sequence
  chemically synthesized
aactcatactcttatataatta

SEQ ID NO: 833912 - DNA, 22 bp, Artificial Sequence
  chemically synthesized
atactcttatataattattaaa

SEQ ID NO: 833913 - DNA, 22 bp, Artificial Sequence
  chemically synthesized
gtaaaggagctccttttaataa

SEQ ID NO: 833914 - DNA, 22 bp, Artificial Sequence
  chemically synthesized
ttatataattattaaaaggagc

SEQ ID NO: 833915 - DNA, 22 bp, Artificial Sequence
  chemically synthesized
attagtaaaggagctcctttta

SEQ ID NO: 833916 - DNA, 22 bp, Artificial Sequence
  chemically synthesized
aattagtaaaggagctcctttt

SEQ ID NO: 833917 - DNA, 22 bp, Artificial Sequence
  chemically synthesized
atataattattaaaaggagctc

SEQ ID NO: 833918 - DNA, 22 bp, Artificial Sequence
  chemically synthesized
tataattattaaaaggagctcc

SEQ ID NO: 833919 - DNA, 22 bp, Artificial Sequence
  chemically synthesized
gagatttaattagtaaaggagc

SEQ ID NO: 833920 - DNA, 22 bp, Artificial Sequence
  chemically synthesized
ttaaaaggagctcctttactaa

SEQ ID NO: 833921 - DNA, 22 bp, Artificial Sequence
  chemically synthesized
aaaggagctcctttactaatta

SEQ ID NO: 833922 - DNA, 22 bp, Artificial Sequence
  chemically synthesized
ctttactaattaaatctctaac

SEQ ID NO: 833923 - DNA, 22 bp, Artificial Sequence
  chemically synthesized
tactaattaaatctctaacctg

SEQ ID NO: 833924 - DNA, 22 bp, Artificial Sequence
  chemically synthesized
actaattaaatctctaacctga

SEQ ID NO: 833925 - DNA, 22 bp, Artificial Sequence
  chemically synthesized
gaaaaaagaaaatcaggttaga

SEQ ID NO: 833926 - DNA, 22 bp, Artificial Sequence
  chemically synthesized
ctaattaaatctctaacctgat

SEQ ID NO: 833927 - DNA, 22 bp, Artificial Sequence
  chemically synthesized
ggaaaaaagaaaatcaggttag

SEQ ID NO: 833928 - DNA, 22 bp, Artificial Sequence
  chemically synthesized
attaaatctctaacctgatttt

SEQ ID NO: 833929 - DNA, 22 bp, Artificial Sequence
  chemically synthesized
aatctctaacctgattttcttt

SEQ ID NO: 833930 - DNA, 22 bp, Artificial Sequence
  chemically synthesized
taacctgattttcttttttcca

SEQ ID NO: 833931 - DNA, 22 bp, Artificial Sequence
  chemically synthesized
acctgattttcttttttccaaa

SEQ ID NO: 833932 - DNA, 22 bp, Artificial Sequence
  chemically synthesized
attttcttttttccaaatcctg

SEQ ID NO: 833933 - DNA, 22 bp, Artificial Sequence
  chemically synthesized
tcttttttccaaatcctgccat

SEQ ID NO: 833934 - DNA, 22 bp, Artificial Sequence
  chemically synthesized
cttttttccaaatcctgccatc

SEQ ID NO: 833935 - DNA, 22 bp, Artificial Sequence
  chemically synthesized
ttttttccaaatcctgccatct

SEQ ID NO: 833936 - DNA, 22 bp, Artificial Sequence
  chemically synthesized
ttttccaaatcctgccatcttt

SEQ ID NO: 833937 - DNA, 22 bp, Artificial Sequence
  chemically synthesized
tttccaaatcctgccatctttt

SEQ ID NO: 833938 - DNA, 22 bp, Artificial Sequence
  chemically synthesized
ttccaaatcctgccatcttttt

SEQ ID NO: 833939 - DNA, 22 bp, Artificial Sequence
  chemically synthesized
tccaaatcctgccatctttttt

SEQ ID NO: 833940 - DNA, 22 bp, Artificial Sequence
  chemically synthesized
ccaaatcctgccatcttttttt

SEQ ID NO: 833941 - DNA, 22 bp, Artificial Sequence
  chemically synthesized
caaatcctgccatctttttttg

SEQ ID NO: 833942 - DNA, 22 bp, Artificial Sequence
  chemically synthesized
tggaaatgatagaaaagcaaaa

SEQ ID NO: 833943 - DNA, 22 bp, Artificial Sequence
  chemically synthesized
gtggaaatgatagaaaagcaaa

SEQ ID NO: 833944 - DNA, 22 bp, Artificial Sequence
  chemically synthesized
tgtggaaatgatagaaaagcaa

SEQ ID NO: 833945 - DNA, 22 bp, Artificial Sequence
  chemically synthesized
ttgtggaaatgatagaaaagca

SEQ ID NO: 833946 - DNA, 22 bp, Artificial Sequence
  chemically synthesized
ccatctttttttgcttttctat

SEQ ID NO: 833947 - DNA, 22 bp, Artificial Sequence
  chemically synthesized
tttttgcttttctatcatttcc

SEQ ID NO: 833948 - DNA, 22 bp, Artificial Sequence
  chemically synthesized
ttttgcttttctatcatttcca

SEQ ID NO: 833949 - DNA, 22 bp, Artificial Sequence
  chemically synthesized
tttgcttttctatcatttccac

SEQ ID NO: 833950 - DNA, 22 bp, Artificial Sequence
  chemically synthesized
ttgcttttctatcatttccaca

SEQ ID NO: 833951 - DNA, 22 bp, Artificial Sequence
  chemically synthesized
tgcttttctatcatttccacaa

SEQ ID NO: 833952 - DNA, 22 bp, Artificial Sequence
  chemically synthesized
gcttttctatcatttccacaaa

SEQ ID NO: 833953 - DNA, 22 bp, Artificial Sequence
  chemically synthesized
cttttctatcatttccacaaaa

SEQ ID NO: 833954 - DNA, 22 bp, Artificial Sequence
  chemically synthesized
ttctatcatttccacaaaaacc

SEQ ID NO: 833955 - DNA, 22 bp, Artificial Sequence
  chemically synthesized
tctatcatttccacaaaaacca

SEQ ID NO: 833956 - DNA, 22 bp, Artificial Sequence
  chemically synthesized
ctatcatttccacaaaaaccac

SEQ ID NO: 833957 - DNA, 22 bp, Artificial Sequence
  chemically synthesized
tatcatttccacaaaaaccact

SEQ ID NO: 833958 - DNA, 22 bp, Artificial Sequence
  chemically synthesized
tcatttccacaaaaaccactcc

SEQ ID NO: 833959 - DNA, 22 bp, Artificial Sequence
  chemically synthesized
tgaaagagaggagaggagtggt

SEQ ID NO: 833960 - DNA, 22 bp, Artificial Sequence
  chemically synthesized
ccacaaaaaccactcctctcct

SEQ ID NO: 833961 - DNA, 22 bp, Artificial Sequence
  chemically synthesized
cacaaaaaccactcctctcctc

SEQ ID NO: 833962 - DNA, 22 bp, Artificial Sequence
  chemically synthesized
agagattatgaaagagaggaga

SEQ ID NO: 833963 - DNA, 22 bp, Artificial Sequence
  chemically synthesized
ataaactcagagattatgaaag

SEQ ID NO: 833964 - DNA, 22 bp, Artificial Sequence
  chemically synthesized
ctctcctctctttcataatctc

SEQ ID NO: 833965 - DNA, 22 bp, Artificial Sequence
  chemically synthesized
tcctctctttcataatctctga

SEQ ID NO: 833966 - DNA, 22 bp, Artificial Sequence
  chemically synthesized
ctctctttcataatctctgagt

SEQ ID NO: 833967 - DNA, 22 bp, Artificial Sequence
  chemically synthesized
tctttcataatctctgagttta

SEQ ID NO: 833968 - DNA, 22 bp, Artificial Sequence
  chemically synthesized
tttcataatctctgagtttatc

SEQ ID NO: 833969 - DNA, 22 bp, Artificial Sequence
  chemically synthesized
tcataatctctgagtttatcaa

SEQ ID NO: 833970 - DNA, 22 bp, Artificial Sequence
  chemically synthesized
cataatctctgagtttatcaac

SEQ ID NO: 833971 - DNA, 22 bp, Artificial Sequence
  chemically synthesized
ataatctctgagtttatcaaca

SEQ ID NO: 833972 - DNA, 22 bp, Artificial Sequence
  chemically synthesized
acgtaaccaaaaaaaaatgttg

SEQ ID NO: 833973 - DNA, 22 bp, Artificial Sequence
  chemically synthesized
tgagtttatcaacatttttttt

SEQ ID NO: 833974 - DNA, 22 bp, Artificial Sequence
  chemically synthesized
agtttatcaacatttttttttg

SEQ ID NO: 833975 - DNA, 22 bp, Artificial Sequence
  chemically synthesized
gagtctgacgtaaccaaaaaaa

SEQ ID NO: 833976 - DNA, 22 bp, Artificial Sequence
  chemically synthesized
atcaacatttttttttggttac

SEQ ID NO: 833977 - DNA, 22 bp, Artificial Sequence
  chemically synthesized
tcaacatttttttttggttacg

SEQ ID NO: 833978 - DNA, 22 bp, Artificial Sequence
  chemically synthesized
ttttttggttacgtcagactct

SEQ ID NO: 833979 - DNA, 22 bp, Artificial Sequence
  chemically synthesized
tttttggttacgtcagactcta

SEQ ID NO: 833980 - DNA, 22 bp, Artificial Sequence
  chemically synthesized
ttttggttacgtcagactctag

SEQ ID NO: 833981 - DNA, 22 bp, Artificial Sequence
  chemically synthesized
tttggttacgtcagactctagt

SEQ ID NO: 833982 - DNA, 22 bp, Artificial Sequence
  chemically synthesized
ttggttacgtcagactctagtt

SEQ ID NO: 833983 - DNA, 22 bp, Artificial Sequence
  chemically synthesized
tggttacgtcagactctagttt

SEQ ID NO: 833984 - DNA, 22 bp, Artificial Sequence
  chemically synthesized
ggttacgtcagactctagtttt

SEQ ID NO: 833985 - DNA, 22 bp, Artificial Sequence
  chemically synthesized
gttacgtcagactctagttttc

SEQ ID NO: 833986 - DNA, 22 bp, Artificial Sequence
  chemically synthesized
cgtcagactctagttttcctat

SEQ ID NO: 833987 - DNA, 22 bp, Artificial Sequence
  chemically synthesized
aaatggaccgtggaatatagga

SEQ ID NO: 833988 - DNA, 22 bp, Artificial Sequence
  chemically synthesized
caaatggaccgtggaatatagg

SEQ ID NO: 833989 - DNA, 22 bp, Artificial Sequence
  chemically synthesized
tcaaatggaccgtggaatatag

SEQ ID NO: 833990 - DNA, 22 bp, Artificial Sequence
  chemically synthesized
tagttttcctatattccacggt

SEQ ID NO: 833991 - DNA, 22 bp, Artificial Sequence
  chemically synthesized
gttttcctatattccacggtcc

SEQ ID NO: 833992 - DNA, 22 bp, Artificial Sequence
  chemically synthesized
gtgctttcaaatggaccgtgga

SEQ ID NO: 833993 - DNA, 22 bp, Artificial Sequence
  chemically synthesized
tcctatattccacggtccattt

SEQ ID NO: 833994 - DNA, 22 bp, Artificial Sequence
  chemically synthesized
cctatattccacggtccatttg

SEQ ID NO: 833995 - DNA, 22 bp, Artificial Sequence
  chemically synthesized
ctatattccacggtccatttga

SEQ ID NO: 833996 - DNA, 22 bp, Artificial Sequence
  chemically synthesized
tattccacggtccatttgaaag

SEQ ID NO: 833997 - DNA, 22 bp, Artificial Sequence
  chemically synthesized
cacggtccatttgaaagcacta

SEQ ID NO: 833998 - DNA, 22 bp, Artificial Sequence
  chemically synthesized
catgtaataagttagtgctttc

SEQ ID NO: 833999 - DNA, 22 bp, Artificial Sequence
  chemically synthesized
gttacatgtaataagttagtgc

SEQ ID NO: 834000 - DNA, 22 bp, Artificial Sequence
  chemically synthesized
gcactagttacatgtaataagt

SEQ ID NO: 834001 - DNA, 22 bp, Artificial Sequence
  chemically synthesized
gaaagcactaacttattacatg

SEQ ID NO: 834002 - DNA, 22 bp, Artificial Sequence
  chemically synthesized
aaagcactaacttattacatgt

SEQ ID NO: 834003 - DNA, 22 bp, Artificial Sequence
  chemically synthesized
cattggcactagttacatgtaa

SEQ ID NO: 834004 - DNA, 22 bp, Artificial Sequence
  chemically synthesized
ccattggcactagttacatgta

SEQ ID NO: 834005 - DNA, 22 bp, Artificial Sequence
  chemically synthesized
tccattggcactagttacatgt

SEQ ID NO: 834006 - DNA, 22 bp, Artificial Sequence
  chemically synthesized
acttattacatgtaactagtgc

SEQ ID NO: 834007 - DNA, 22 bp, Artificial Sequence
  chemically synthesized
gaattttccattggcactagtt

SEQ ID NO: 834008 - DNA, 22 bp, Artificial Sequence
  chemically synthesized
attacatgtaactagtgccaat

SEQ ID NO: 834009 - DNA, 22 bp, Artificial Sequence
  chemically synthesized
ttacatgtaactagtgccaatg

SEQ ID NO: 834010 - DNA, 22 bp, Artificial Sequence
  chemically synthesized
gctggaattttccattggcact

SEQ ID NO: 834011 - DNA, 22 bp, Artificial Sequence
  chemically synthesized
catgtaactagtgccaatggaa

SEQ ID NO: 834012 - DNA, 22 bp, Artificial Sequence
  chemically synthesized
ctagctggaattttccattggc

SEQ ID NO: 834013 - DNA, 22 bp, Artificial Sequence
  chemically synthesized
ttgctagctggaattttccatt

SEQ ID NO: 834014 - DNA, 22 bp, Artificial Sequence
  chemically synthesized
attgctagctggaattttccat

SEQ ID NO: 834015 - DNA, 22 bp, Artificial Sequence
  chemically synthesized
gtgccaatggaaaattccagct

SEQ ID NO: 834016 - DNA, 22 bp, Artificial Sequence
  chemically synthesized
acatagatgcgtttattgctag

SEQ ID NO: 834017 - DNA, 22 bp, Artificial Sequence
  chemically synthesized
cagctagcaataaacgcatcta

SEQ ID NO: 834018 - DNA, 22 bp, Artificial Sequence
  chemically synthesized
cagtgactaacatagatgcgtt

SEQ ID NO: 834019 - DNA, 22 bp, Artificial Sequence
  chemically synthesized
cctacagtgactaacatagatg

SEQ ID NO: 834020 - DNA, 22 bp, Artificial Sequence
  chemically synthesized
gcaataaacgcatctatgttag

SEQ ID NO: 834021 - DNA, 22 bp, Artificial Sequence
  chemically synthesized
tgcctacagtgactaacataga

SEQ ID NO: 834022 - DNA, 22 bp, Artificial Sequence
  chemically synthesized
gttctgcctacagtgactaaca

SEQ ID NO: 834023 - DNA, 22 bp, Artificial Sequence
  chemically synthesized
tgttagtcactgtaggcagaac

SEQ ID NO: 834024 - DNA, 22 bp, Artificial Sequence
  chemically synthesized
gagccaacattagttctgccta

SEQ ID NO: 834025 - DNA, 22 bp, Artificial Sequence
  chemically synthesized
gtcactgtaggcagaactaatg

SEQ ID NO: 834026 - DNA, 22 bp, Artificial Sequence
  chemically synthesized
tcattggagccaacattagttc

SEQ ID NO: 834027 - DNA, 22 bp, Artificial Sequence
  chemically synthesized
atcattggagccaacattagtt

SEQ ID NO: 834028 - DNA, 22 bp, Artificial Sequence
  chemically synthesized
ttatcattggagccaacattag

SEQ ID NO: 834029 - DNA, 22 bp, Artificial Sequence
  chemically synthesized
taggcagaactaatgttggctc

SEQ ID NO: 834030 - DNA, 22 bp, Artificial Sequence
  chemically synthesized
atgttggctccaatgataagaa

SEQ ID NO: 834031 - DNA, 22 bp, Artificial Sequence
  chemically synthesized
gctccaatgataagaatgctcc

SEQ ID NO: 834032 - DNA, 22 bp, Artificial Sequence
  chemically synthesized
caatgataagaatgctcctatg

SEQ ID NO: 834033 - DNA, 22 bp, Artificial Sequence
  chemically synthesized
ccagccaagagaaaaccatagg

SEQ ID NO: 834034 - DNA, 22 bp, Artificial Sequence
  chemically synthesized
gccagccaagagaaaaccatag

SEQ ID NO: 834035 - DNA, 22 bp, Artificial Sequence
  chemically synthesized
cttgccagccaagagaaaacca

SEQ ID NO: 834036 - DNA, 22 bp, Artificial Sequence
  chemically synthesized
ctatggttttctcttggctggc

SEQ ID NO: 834037 - DNA, 22 bp, Artificial Sequence
  chemically synthesized
tggttttctcttggctggcaag

SEQ ID NO: 834038 - DNA, 22 bp, Artificial Sequence
  chemically synthesized
tctcttggctggcaagcagttg

SEQ ID NO: 834039 - DNA, 22 bp, Artificial Sequence
  chemically synthesized
ctcttggctggcaagcagttgc

SEQ ID NO: 834040 - DNA, 22 bp, Artificial Sequence
  chemically synthesized
aggagcaatatagcaactgctt

SEQ ID NO: 834041 - DNA, 22 bp, Artificial Sequence
  chemically synthesized
tcttggctggcaagcagttgct

SEQ ID NO: 834042 - DNA, 22 bp, Artificial Sequence
  chemically synthesized
caggagcaatatagcaactgct

SEQ ID NO: 834043 - DNA, 22 bp, Artificial Sequence
  chemically synthesized
tcaggagcaatatagcaactgc

SEQ ID NO: 834044 - DNA, 22 bp, Artificial Sequence
  chemically synthesized
ttggctggcaagcagttgctat

SEQ ID NO: 834045 - DNA, 22 bp, Artificial Sequence
  chemically synthesized
ggctggcaagcagttgctatat

SEQ ID NO: 834046 - DNA, 22 bp, Artificial Sequence
  chemically synthesized
gctggcaagcagttgctatatt

SEQ ID NO: 834047 - DNA, 22 bp, Artificial Sequence
  chemically synthesized
attttcaggagcaatatagcaa

SEQ ID NO: 834048 - DNA, 22 bp, Artificial Sequence
  chemically synthesized
taattttcaggagcaatatagc

SEQ ID NO: 834049 - DNA, 22 bp, Artificial Sequence
  chemically synthesized
ctaattttcaggagcaatatag

SEQ ID NO: 834050 - DNA, 22 bp, Artificial Sequence
  chemically synthesized
gcaagcagttgctatattgctc

SEQ ID NO: 834051 - DNA, 22 bp, Artificial Sequence
  chemically synthesized
tctaattttcaggagcaatata

SEQ ID NO: 834052 - DNA, 22 bp, Artificial Sequence
  chemically synthesized
tttctaattttcaggagcaata

SEQ ID NO: 834053 - DNA, 22 bp, Artificial Sequence
  chemically synthesized
ctatattgctcctgaaaattag

SEQ ID NO: 834054 - DNA, 22 bp, Artificial Sequence
  chemically synthesized
tattgctcctgaaaattagaaa

SEQ ID NO: 834055 - DNA, 22 bp, Artificial Sequence
  chemically synthesized
acagcacaactctttctaattt

SEQ ID NO: 834056 - DNA, 22 bp, Artificial Sequence
  chemically synthesized
cacagcacaactctttctaatt

SEQ ID NO: 834057 - DNA, 22 bp, Artificial Sequence
  chemically synthesized
cttcacagcacaactctttcta

SEQ ID NO: 834058 - DNA, 22 bp, Artificial Sequence
  chemically synthesized
ctcctgaaaattagaaagagtt

SEQ ID NO: 834059 - DNA, 22 bp, Artificial Sequence
  chemically synthesized
ctgcttcacagcacaactcttt

SEQ ID NO: 834060 - DNA, 22 bp, Artificial Sequence
  chemically synthesized
ctgaaaattagaaagagttgtg

SEQ ID NO: 834061 - DNA, 22 bp, Artificial Sequence
  chemically synthesized
tactgcttcacagcacaactct

SEQ ID NO: 834062 - DNA, 22 bp, Artificial Sequence
  chemically synthesized
ctactgcttcacagcacaactc

SEQ ID NO: 834063 - DNA, 22 bp, Artificial Sequence
  chemically synthesized
aaaattagaaagagttgtgctg

SEQ ID NO: 834064 - DNA, 22 bp, Artificial Sequence
  chemically synthesized
gaaagagttgtgctgtgaagca

SEQ ID NO: 834065 - DNA, 22 bp, Artificial Sequence
  chemically synthesized
gtcagtgtatgtaatttctact

SEQ ID NO: 834066 - DNA, 22 bp, Artificial Sequence
  chemically synthesized
tgctgtgaagcagtagaaatta

SEQ ID NO: 834067 - DNA, 22 bp, Artificial Sequence
  chemically synthesized
tgaagcagtagaaattacatac

SEQ ID NO: 834068 - DNA, 22 bp, Artificial Sequence
  chemically synthesized
acgtattagtcagtgtatgtaa

SEQ ID NO: 834069 - DNA, 22 bp, Artificial Sequence
  chemically synthesized
cagctaacgtattagtcagtgt

SEQ ID NO: 834070 - DNA, 22 bp, Artificial Sequence
  chemically synthesized
gcagctaacgtattagtcagtg

SEQ ID NO: 834071 - DNA, 22 bp, Artificial Sequence
  chemically synthesized
catacactgactaatacgttag

SEQ ID NO: 834072 - DNA, 22 bp, Artificial Sequence
  chemically synthesized
actaatacgttagctgcaaatt

SEQ ID NO: 834073 - DNA, 22 bp, Artificial Sequence
  chemically synthesized
atacgttagctgcaaatttcta

SEQ ID NO: 834074 - DNA, 22 bp, Artificial Sequence
  chemically synthesized
aaagaatccatatagaaatttg

SEQ ID NO: 834075 - DNA, 22 bp, Artificial Sequence
  chemically synthesized
agattgaaagaatccatataga

SEQ ID NO: 834076 - DNA, 22 bp, Artificial Sequence
  chemically synthesized
gctgcaaatttctatatggatt

SEQ ID NO: 834077 - DNA, 22 bp, Artificial Sequence
  chemically synthesized
tattcagattgaaagaatccat

SEQ ID NO: 834078 - DNA, 22 bp, Artificial Sequence
  chemically synthesized
caaatttctatatggattcttt

SEQ ID NO: 834079 - DNA, 22 bp, Artificial Sequence
  chemically synthesized
ctatatggattctttcaatctg

SEQ ID NO: 834080 - DNA, 22 bp, Artificial Sequence
  chemically synthesized
tatatggattctttcaatctga

SEQ ID NO: 834081 - DNA, 22 bp, Artificial Sequence
  chemically synthesized
cccaaactgtattcagattgaa

SEQ ID NO: 834082 - DNA, 22 bp, Artificial Sequence
  chemically synthesized
tatggattctttcaatctgaat

SEQ ID NO: 834083 - DNA, 22 bp, Artificial Sequence
  chemically synthesized
ttacccaaactgtattcagatt

SEQ ID NO: 834084 - DNA, 22 bp, Artificial Sequence
  chemically synthesized
tttcaatctgaatacagtttgg

SEQ ID NO: 834085 - DNA, 22 bp, Artificial Sequence
  chemically synthesized
tcaatctgaatacagtttgggt

SEQ ID NO: 834086 - DNA, 22 bp, Artificial Sequence
  chemically synthesized
caatctgaatacagtttgggta

SEQ ID NO: 834087 - DNA, 22 bp, Artificial Sequence
  chemically synthesized
aatctgaatacagtttgggtaa

SEQ ID NO: 834088 - DNA, 22 bp, Artificial Sequence
  chemically synthesized
aggacaaagctattacccaaac

SEQ ID NO: 834089 - DNA, 22 bp, Artificial Sequence
  chemically synthesized
aatacagtttgggtaatagctt

SEQ ID NO: 834090 - DNA, 22 bp, Artificial Sequence
  chemically synthesized
gggtaatagctttgtccttagg

SEQ ID NO: 834091 - DNA, 22 bp, Artificial Sequence
  chemically synthesized
ggtaatagctttgtccttaggt

SEQ ID NO: 834092 - DNA, 22 bp, Artificial Sequence
  chemically synthesized
tgtgtacaaaaatacctaagga

SEQ ID NO: 834093 - DNA, 22 bp, Artificial Sequence
  chemically synthesized
tctgtgtgtacaaaaataccta

SEQ ID NO: 834094 - DNA, 22 bp, Artificial Sequence
  chemically synthesized
atctgtgtgtacaaaaatacct

SEQ ID NO: 834095 - DNA, 22 bp, Artificial Sequence
  chemically synthesized
tatctgtgtgtacaaaaatacc

SEQ ID NO: 834096 - DNA, 22 bp, Artificial Sequence
  chemically synthesized
tgtccttaggtatttttgtaca

SEQ ID NO: 834097 - DNA, 22 bp, Artificial Sequence
  chemically synthesized
gtccttaggtatttttgtacac

SEQ ID NO: 834098 - DNA, 22 bp, Artificial Sequence
  chemically synthesized
tccttaggtatttttgtacaca

SEQ ID NO: 834099 - DNA, 22 bp, Artificial Sequence
  chemically synthesized
acatactttatctgtgtgtaca

SEQ ID NO: 834100 - DNA, 22 bp, Artificial Sequence
  chemically synthesized
aacatactttatctgtgtgtac

SEQ ID NO: 834101 - DNA, 22 bp, Artificial Sequence
  chemically synthesized
aggtatttttgtacacacagat

SEQ ID NO: 834102 - DNA, 22 bp, Artificial Sequence
  chemically synthesized
ggtatttttgtacacacagata

SEQ ID NO: 834103 - DNA, 22 bp, Artificial Sequence
  chemically synthesized
ttgtacacacagataaagtatg

SEQ ID NO: 834104 - DNA, 22 bp, Artificial Sequence
  chemically synthesized
aagaaaatttaacatactttat

SEQ ID NO: 834105 - DNA, 22 bp, Artificial Sequence
  chemically synthesized
tgtacacacagataaagtatgt

SEQ ID NO: 834106 - DNA, 22 bp, Artificial Sequence
  chemically synthesized
gtacacacagataaagtatgtt

SEQ ID NO: 834107 - DNA, 22 bp, Artificial Sequence
  chemically synthesized
tacacacagataaagtatgtta

SEQ ID NO: 834108 - DNA, 22 bp, Artificial Sequence
  chemically synthesized
tctcaagaaaatttaacatact

SEQ ID NO: 834109 - DNA, 22 bp, Artificial Sequence
  chemically synthesized
atgcctgtctcaagaaaattta

SEQ ID NO: 834110 - DNA, 22 bp, Artificial Sequence
  chemically synthesized
ctaatgcctgtctcaagaaaat

SEQ ID NO: 834111 - DNA, 22 bp, Artificial Sequence
  chemically synthesized
gctaatgcctgtctcaagaaaa

SEQ ID NO: 834112 - DNA, 22 bp, Artificial Sequence
  chemically synthesized
ttgctaatgcctgtctcaagaa

SEQ ID NO: 834113 - DNA, 22 bp, Artificial Sequence
  chemically synthesized
aacctcttgctaatgcctgtct

SEQ ID NO: 834114 - DNA, 22 bp, Artificial Sequence
  chemically synthesized
aattttcttgagacaggcatta

SEQ ID NO: 834115 - DNA, 22 bp, Artificial Sequence
  chemically synthesized
tgaacctcttgctaatgcctgt

SEQ ID NO: 834116 - DNA, 22 bp, Artificial Sequence
  chemically synthesized
ttctgaacctcttgctaatgcc

SEQ ID NO: 834117 - DNA, 22 bp, Artificial Sequence
  chemically synthesized
tcttgagacaggcattagcaag

SEQ ID NO: 834118 - DNA, 22 bp, Artificial Sequence
  chemically synthesized
tgttctgaacctcttgctaatg

SEQ ID NO: 834119 - DNA, 22 bp, Artificial Sequence
  chemically synthesized
cttgagacaggcattagcaaga

SEQ ID NO: 834120 - DNA, 22 bp, Artificial Sequence
  chemically synthesized
ttgagacaggcattagcaagag

SEQ ID NO: 834121 - DNA, 22 bp, Artificial Sequence
  chemically synthesized
gagacaggcattagcaagaggt

SEQ ID NO: 834122 - DNA, 22 bp, Artificial Sequence
  chemically synthesized
attctgttctgaacctcttgct

SEQ ID NO: 834123 - DNA, 22 bp, Artificial Sequence
  chemically synthesized
agacaggcattagcaagaggtt

SEQ ID NO: 834124 - DNA, 22 bp, Artificial Sequence
  chemically synthesized
tgctaattctgttctgaacctc

SEQ ID NO: 834125 - DNA, 22 bp, Artificial Sequence
  chemically synthesized
gcaagaggttcagaacagaatt

SEQ ID NO: 834126 - DNA, 22 bp, Artificial Sequence
  chemically synthesized
gaacacaactatgctaattctg

SEQ ID NO: 834127 - DNA, 22 bp, Artificial Sequence
  chemically synthesized
ggaacacaactatgctaattct

SEQ ID NO: 834128 - DNA, 22 bp, Artificial Sequence
  chemically synthesized
tggaacacaactatgctaattc

SEQ ID NO: 834129 - DNA, 22 bp, Artificial Sequence
  chemically synthesized
ttttggaacacaactatgctaa

SEQ ID NO: 834130 - DNA, 22 bp, Artificial Sequence
  chemically synthesized
gttttggaacacaactatgcta

SEQ ID NO: 834131 - DNA, 22 bp, Artificial Sequence
  chemically synthesized
tgttttggaacacaactatgct

SEQ ID NO: 834132 - DNA, 22 bp, Artificial Sequence
  chemically synthesized
agaacagaattagcatagttgt

SEQ ID NO: 834133 - DNA, 22 bp, Artificial Sequence
  chemically synthesized
ttgttttggaacacaactatgc

SEQ ID NO: 834134 - DNA, 22 bp, Artificial Sequence
  chemically synthesized
tcttttgttttggaacacaact

SEQ ID NO: 834135 - DNA, 22 bp, Artificial Sequence
  chemically synthesized
gcatagttgtgttccaaaacaa

SEQ ID NO: 834136 - DNA, 22 bp, Artificial Sequence
  chemically synthesized
tatcagctatcttttgttttgg

SEQ ID NO: 834137 - DNA, 22 bp, Artificial Sequence
  chemically synthesized
atatcagctatcttttgttttg

SEQ ID NO: 834138 - DNA, 22 bp, Artificial Sequence
  chemically synthesized
tgttccaaaacaaaagatagct

SEQ ID NO: 834139 - DNA, 22 bp, Artificial Sequence
  chemically synthesized
caaaacaaaagatagctgatat

SEQ ID NO: 834140 - DNA, 22 bp, Artificial Sequence
  chemically synthesized
gcagcatggcaagtttatatca

SEQ ID NO: 834141 - DNA, 22 bp, Artificial Sequence
  chemically synthesized
gaactggcagcatggcaagttt

SEQ ID NO: 834142 - DNA, 22 bp, Artificial Sequence
  chemically synthesized
atataaacttgccatgctgcca

SEQ ID NO: 834143 - DNA, 22 bp, Artificial Sequence
  chemically synthesized
gccatgctgccagttccaatgg

SEQ ID NO: 834144 - DNA, 22 bp, Artificial Sequence
  chemically synthesized
ccatgctgccagttccaatggt

SEQ ID NO: 834145 - DNA, 22 bp, Artificial Sequence
  chemically synthesized
aaaggtcagtaataccattgga

SEQ ID NO: 834146 - DNA, 22 bp, Artificial Sequence
  chemically synthesized
ccagttccaatggtattactga

SEQ ID NO: 834147 - DNA, 22 bp, Artificial Sequence
  chemically synthesized
caatggtattactgacctttta

SEQ ID NO: 834148 - DNA, 22 bp, Artificial Sequence
  chemically synthesized
aaaaaaaacaacgagattaaaa

SEQ ID NO: 834149 - DNA, 22 bp, Artificial Sequence
  chemically synthesized
aaaaaaaaacaacgagattaaa

SEQ ID NO: 834150 - DNA, 22 bp, Artificial Sequence
  chemically synthesized
ctgaccttttaatctcgttgtt

SEQ ID NO: 834151 - DNA, 22 bp, Artificial Sequence
  chemically synthesized
accttttaatctcgttgttttt

SEQ ID NO: 834152 - DNA, 22 bp, Artificial Sequence
  chemically synthesized
ttaatctcgttgttttttttta

SEQ ID NO: 834153 - DNA, 22 bp, Artificial Sequence
  chemically synthesized
taatctcgttgtttttttttaa

SEQ ID NO: 834154 - DNA, 22 bp, Artificial Sequence
  chemically synthesized
aatctcgttgtttttttttaaa

SEQ ID NO: 834155 - DNA, 22 bp, Artificial Sequence
  chemically synthesized
atctcgttgtttttttttaaat

SEQ ID NO: 834156 - DNA, 22 bp, Artificial Sequence
  chemically synthesized
gttgtttttttttaaatctttt

SEQ ID NO: 834157 - DNA, 22 bp, Artificial Sequence
  chemically synthesized
gcagagaaaaaataaaaagatt

SEQ ID NO: 834158 - DNA, 22 bp, Artificial Sequence
  chemically synthesized
agcagagaaaaaataaaaagat

SEQ ID NO: 834159 - DNA, 22 bp, Artificial Sequence
  chemically synthesized
tttttttttaaatctttttatt

SEQ ID NO: 834160 - DNA, 22 bp, Artificial Sequence
  chemically synthesized
ttttttaaatctttttattttt

SEQ ID NO: 834161 - DNA, 22 bp, Artificial Sequence
  chemically synthesized
tttttaaatctttttatttttt

SEQ ID NO: 834162 - DNA, 22 bp, Artificial Sequence
  chemically synthesized
ttttaaatctttttattttttc

SEQ ID NO: 834163 - DNA, 22 bp, Artificial Sequence
  chemically synthesized
tttaaatctttttattttttct

SEQ ID NO: 834164 - DNA, 22 bp, Artificial Sequence
  chemically synthesized
ttaaatctttttattttttctc

SEQ ID NO: 834165 - DNA, 22 bp, Artificial Sequence
  chemically synthesized
taaatctttttattttttctct

SEQ ID NO: 834166 - DNA, 22 bp, Artificial Sequence
  chemically synthesized
aaatctttttattttttctctg

SEQ ID NO: 834167 - DNA, 22 bp, Artificial Sequence
  chemically synthesized
aatctttttattttttctctgc

SEQ ID NO: 834168 - DNA, 22 bp, Artificial Sequence
  chemically synthesized
tttattttttctctgctaaatc

SEQ ID NO: 834169 - DNA, 22 bp, Artificial Sequence
  chemically synthesized
ttattttttctctgctaaatct

SEQ ID NO: 834170 - DNA, 22 bp, Artificial Sequence
  chemically synthesized
tattttttctctgctaaatctc

SEQ ID NO: 834171 - DNA, 22 bp, Artificial Sequence
  chemically synthesized
attttttctctgctaaatctct

SEQ ID NO: 834172 - DNA, 22 bp, Artificial Sequence
  chemically synthesized
ttttttctctgctaaatctctg

SEQ ID NO: 834173 - DNA, 22 bp, Artificial Sequence
  chemically synthesized
aacagcaagaggcagagattta

SEQ ID NO: 834174 - DNA, 22 bp, Artificial Sequence
  chemically synthesized
tttctctgctaaatctctgcct

SEQ ID NO: 834175 - DNA, 22 bp, Artificial Sequence
  chemically synthesized
ttaaacagcaagaggcagagat

SEQ ID NO: 834176 - DNA, 22 bp, Artificial Sequence
  chemically synthesized
ttctctgctaaatctctgcctc

SEQ ID NO: 834177 - DNA, 22 bp, Artificial Sequence
  chemically synthesized
attaaacagcaagaggcagaga

SEQ ID NO: 834178 - DNA, 22 bp, Artificial Sequence
  chemically synthesized
tctctgctaaatctctgcctct

SEQ ID NO: 834179 - DNA, 22 bp, Artificial Sequence
  chemically synthesized
ctctgctaaatctctgcctctt

SEQ ID NO: 834180 - DNA, 22 bp, Artificial Sequence
  chemically synthesized
tctgctaaatctctgcctcttg

SEQ ID NO: 834181 - DNA, 22 bp, Artificial Sequence
  chemically synthesized
gcttattaaacagcaagaggca

SEQ ID NO: 834182 - DNA, 22 bp, Artificial Sequence
  chemically synthesized
tgctaaatctctgcctcttgct

SEQ ID NO: 834183 - DNA, 22 bp, Artificial Sequence
  chemically synthesized
ctaaatctctgcctcttgctgt

SEQ ID NO: 834184 - DNA, 22 bp, Artificial Sequence
  chemically synthesized
aatctctgcctcttgctgttta

SEQ ID NO: 834185 - DNA, 22 bp, Artificial Sequence
  chemically synthesized
tgcctcttgctgtttaataagc

SEQ ID NO: 834186 - DNA, 22 bp, Artificial Sequence
  chemically synthesized
caaataacggttagcttattaa

SEQ ID NO: 834187 - DNA, 22 bp, Artificial Sequence
  chemically synthesized
cctcttgctgtttaataagcta

SEQ ID NO: 834188 - DNA, 22 bp, Artificial Sequence
  chemically synthesized
ttgctgtttaataagctaaccg

SEQ ID NO: 834189 - DNA, 22 bp, Artificial Sequence
  chemically synthesized
ggttccaaataacggttagctt

SEQ ID NO: 834190 - DNA, 22 bp, Artificial Sequence
  chemically synthesized
gctgtttaataagctaaccgtt

SEQ ID NO: 834191 - DNA, 22 bp, Artificial Sequence
  chemically synthesized
ctgtttaataagctaaccgtta

SEQ ID NO: 834192 - DNA, 22 bp, Artificial Sequence
  chemically synthesized
attaggttccaaataacggtta

SEQ ID NO: 834193 - DNA, 22 bp, Artificial Sequence
  chemically synthesized
cattaggttccaaataacggtt

SEQ ID NO: 834194 - DNA, 22 bp, Artificial Sequence
  chemically synthesized
tttaataagctaaccgttattt

SEQ ID NO: 834195 - DNA, 22 bp, Artificial Sequence
  chemically synthesized
tcattaggttccaaataacggt

SEQ ID NO: 834196 - DNA, 22 bp, Artificial Sequence
  chemically synthesized
aataagctaaccgttatttgga

SEQ ID NO: 834197 - DNA, 22 bp, Artificial Sequence
  chemically synthesized
ataagctaaccgttatttggaa

SEQ ID NO: 834198 - DNA, 22 bp, Artificial Sequence
  chemically synthesized
accgttatttggaacctaatga

SEQ ID NO: 834199 - DNA, 22 bp, Artificial Sequence
  chemically synthesized
agggaaaaaaatcctttcatta

SEQ ID NO: 834200 - DNA, 22 bp, Artificial Sequence
  chemically synthesized
tttggaacctaatgaaaggatt

SEQ ID NO: 834201 - DNA, 22 bp, Artificial Sequence
  chemically synthesized
gactgagggaaaaaaatccttt

SEQ ID NO: 834202 - DNA, 22 bp, Artificial Sequence
  chemically synthesized
ggaacctaatgaaaggattttt

SEQ ID NO: 834203 - DNA, 22 bp, Artificial Sequence
  chemically synthesized
agactgagggaaaaaaatcctt

SEQ ID NO: 834204 - DNA, 22 bp, Artificial Sequence
  chemically synthesized
gaacctaatgaaaggatttttt

SEQ ID NO: 834205 - DNA, 22 bp, Artificial Sequence
  chemically synthesized
atgaaaggatttttttccctca

SEQ ID NO: 834206 - DNA, 22 bp, Artificial Sequence
  chemically synthesized
ggaaggtttagactgagggaaa

SEQ ID NO: 834207 - DNA, 22 bp, Artificial Sequence
  chemically synthesized
aggaaggtttagactgagggaa

SEQ ID NO: 834208 - DNA, 22 bp, Artificial Sequence
  chemically synthesized
tttaggaaggtttagactgagg

SEQ ID NO: 834209 - DNA, 22 bp, Artificial Sequence
  chemically synthesized
ttttccctcagtctaaaccttc

SEQ ID NO: 834210 - DNA, 22 bp, Artificial Sequence
  chemically synthesized
tttccctcagtctaaaccttcc

SEQ ID NO: 834211 - DNA, 22 bp, Artificial Sequence
  chemically synthesized
ttccctcagtctaaaccttcct

SEQ ID NO: 834212 - DNA, 22 bp, Artificial Sequence
  chemically synthesized
tccctcagtctaaaccttccta

SEQ ID NO: 834213 - DNA, 22 bp, Artificial Sequence
  chemically synthesized
ccctcagtctaaaccttcctaa

SEQ ID NO: 834214 - DNA, 22 bp, Artificial Sequence
  chemically synthesized
cctcagtctaaaccttcctaaa

SEQ ID NO: 834215 - DNA, 22 bp, Artificial Sequence
  chemically synthesized
agtctaaaccttcctaaatagc

SEQ ID NO: 834216 - DNA, 22 bp, Artificial Sequence
  chemically synthesized
aaccttcctaaatagcctcttc

SEQ ID NO: 834217 - DNA, 22 bp, Artificial Sequence
  chemically synthesized
aaagtaaatagaataatgaaga

SEQ ID NO: 834218 - DNA, 22 bp, Artificial Sequence
  chemically synthesized
cctaaatagcctcttcattatt

SEQ ID NO: 834219 - DNA, 22 bp, Artificial Sequence
  chemically synthesized
ctaaatagcctcttcattattc

SEQ ID NO: 834220 - DNA, 22 bp, Artificial Sequence
  chemically synthesized
aatagcctcttcattattctat

SEQ ID NO: 834221 - DNA, 22 bp, Artificial Sequence
  chemically synthesized
atgttcaaagtaaatagaataa

SEQ ID NO: 834222 - DNA, 22 bp, Artificial Sequence
  chemically synthesized
aatgttcaaagtaaatagaata

SEQ ID NO: 834223 - DNA, 22 bp, Artificial Sequence
  chemically synthesized
taatgttcaaagtaaatagaat

SEQ ID NO: 834224 - DNA, 22 bp, Artificial Sequence
  chemically synthesized
ttaatgttcaaagtaaatagaa

SEQ ID NO: 834225 - DNA, 22 bp, Artificial Sequence
  chemically synthesized
tttaatgttcaaagtaaataga

SEQ ID NO: 834226 - DNA, 22 bp, Artificial Sequence
  chemically synthesized
ttttaatgttcaaagtaaatag

SEQ ID NO: 834227 - DNA, 22 bp, Artificial Sequence
  chemically synthesized
ttcattattctatttactttga

SEQ ID NO: 834228 - DNA, 22 bp, Artificial Sequence
  chemically synthesized
gtttttttaatgttcaaagtaa

SEQ ID NO: 834229 - DNA, 22 bp, Artificial Sequence
  chemically synthesized
cattattctatttactttgaac

SEQ ID NO: 834230 - DNA, 22 bp, Artificial Sequence
  chemically synthesized
ggtttttttaatgttcaaagta

SEQ ID NO: 834231 - DNA, 22 bp, Artificial Sequence
  chemically synthesized
attattctatttactttgaaca

SEQ ID NO: 834232 - DNA, 22 bp, Artificial Sequence
  chemically synthesized
tggtttttttaatgttcaaagt

SEQ ID NO: 834233 - DNA, 22 bp, Artificial Sequence
  chemically synthesized
ttctatttactttgaacattaa

SEQ ID NO: 834234 - DNA, 22 bp, Artificial Sequence
  chemically synthesized
agctttggtttttttaatgttc

SEQ ID NO: 834235 - DNA, 22 bp, Artificial Sequence
  chemically synthesized
cagctttggtttttttaatgtt

SEQ ID NO: 834236 - DNA, 22 bp, Artificial Sequence
  chemically synthesized
tatttactttgaacattaaaaa

SEQ ID NO: 834237 - DNA, 22 bp, Artificial Sequence
  chemically synthesized
tttactttgaacattaaaaaaa

SEQ ID NO: 834238 - DNA, 22 bp, Artificial Sequence
  chemically synthesized
tttcagctttggtttttttaat

SEQ ID NO: 834239 - DNA, 22 bp, Artificial Sequence
  chemically synthesized
actttgaacattaaaaaaacca

SEQ ID NO: 834240 - DNA, 22 bp, Artificial Sequence
  chemically synthesized
ctttgaacattaaaaaaaccaa

SEQ ID NO: 834241 - DNA, 22 bp, Artificial Sequence
  chemically synthesized
gctatttcagctttggtttttt

SEQ ID NO: 834242 - DNA, 22 bp, Artificial Sequence
  chemically synthesized
tgaacattaaaaaaaccaaagc

SEQ ID NO: 834243 - DNA, 22 bp, Artificial Sequence
  chemically synthesized
gaacattaaaaaaaccaaagct

SEQ ID NO: 834244 - DNA, 22 bp, Artificial Sequence
  chemically synthesized
aacattaaaaaaaccaaagctg

SEQ ID NO: 834245 - DNA, 22 bp, Artificial Sequence
  chemically synthesized
atattagctatttcagctttgg

SEQ ID NO: 834246 - DNA, 22 bp, Artificial Sequence
  chemically synthesized
aaaaaaccaaagctgaaatagc

SEQ ID NO: 834247 - DNA, 22 bp, Artificial Sequence
  chemically synthesized
atgaacatctcatattagctat

SEQ ID NO: 834248 - DNA, 22 bp, Artificial Sequence
  chemically synthesized
catgaacatctcatattagcta

SEQ ID NO: 834249 - DNA, 22 bp, Artificial Sequence
  chemically synthesized
tcatgaacatctcatattagct

SEQ ID NO: 834250 - DNA, 22 bp, Artificial Sequence
  chemically synthesized
aaatagctaatatgagatgttc

SEQ ID NO: 834251 - DNA, 22 bp, Artificial Sequence
  chemically synthesized
aatggagattttcatgaacatc

SEQ ID NO: 834252 - DNA, 22 bp, Artificial Sequence
  chemically synthesized
atatgagatgttcatgaaaatc

SEQ ID NO: 834253 - DNA, 22 bp, Artificial Sequence
  chemically synthesized
ggatgatgacgccctgaatgga

SEQ ID NO: 834254 - DNA, 22 bp, Artificial Sequence
  chemically synthesized
atgaaaatctccattcagggcg

SEQ ID NO: 834255 - DNA, 22 bp, Artificial Sequence
  chemically synthesized
taaaccaattaggatgatgacg

SEQ ID NO: 834256 - DNA, 22 bp, Artificial Sequence
  chemically synthesized
cattcagggcgtcatcatccta

SEQ ID NO: 834257 - DNA, 22 bp, Artificial Sequence
  chemically synthesized
agggcgtcatcatcctaattgg

SEQ ID NO: 834258 - DNA, 22 bp, Artificial Sequence
  chemically synthesized
agcacagcaggttataaaccaa

SEQ ID NO: 834259 - DNA, 22 bp, Artificial Sequence
  chemically synthesized
ttcagcacagcaggttataaac

SEQ ID NO: 834260 - DNA, 22 bp, Artificial Sequence
  chemically synthesized
attggtttataacctgctgtgc

SEQ ID NO: 834261 - DNA, 22 bp, Artificial Sequence
  chemically synthesized
gtttataacctgctgtgctgaa

SEQ ID NO: 834262 - DNA, 22 bp, Artificial Sequence
  chemically synthesized
ataacctgctgtgctgaatagt

SEQ ID NO: 834263 - DNA, 22 bp, Artificial Sequence
  chemically synthesized
taacctgctgtgctgaatagtt

SEQ ID NO: 834264 - DNA, 22 bp, Artificial Sequence
  chemically synthesized
ctgtgctgaatagttcttccac

SEQ ID NO: 834265 - DNA, 22 bp, Artificial Sequence
  chemically synthesized
tgctgaatagttcttccactca

SEQ ID NO: 834266 - DNA, 22 bp, Artificial Sequence
  chemically synthesized
aatagttcttccactcatcctc

SEQ ID NO: 834267 - DNA, 22 bp, Artificial Sequence
  chemically synthesized
aaaaacaaaacaaaatgaggat

SEQ ID NO: 834268 - DNA, 22 bp, Artificial Sequence
  chemically synthesized
ttccactcatcctcattttgtt

SEQ ID NO: 834269 - DNA, 22 bp, Artificial Sequence
  chemically synthesized
agttaaaaaacaaaacaaaatg

SEQ ID NO: 834270 - DNA, 22 bp, Artificial Sequence
  chemically synthesized
ccactcatcctcattttgtttt

SEQ ID NO: 834271 - DNA, 22 bp, Artificial Sequence
  chemically synthesized
aagttaaaaaacaaaacaaaat

SEQ ID NO: 834272 - DNA, 22 bp, Artificial Sequence
  chemically synthesized
cactcatcctcattttgttttg

SEQ ID NO: 834273 - DNA, 22 bp, Artificial Sequence
  chemically synthesized
taagttaaaaaacaaaacaaaa

SEQ ID NO: 834274 - DNA, 22 bp, Artificial Sequence
  chemically synthesized
ttaagttaaaaaacaaaacaaa

SEQ ID NO: 834275 - DNA, 22 bp, Artificial Sequence
  chemically synthesized
atcctcattttgttttgttttt

SEQ ID NO: 834276 - DNA, 22 bp, Artificial Sequence
  chemically synthesized
atttttaagttaaaaaacaaaa

SEQ ID NO: 834277 - DNA, 22 bp, Artificial Sequence
  chemically synthesized
catttttaagttaaaaaacaaa

SEQ ID NO: 834278 - DNA, 22 bp, Artificial Sequence
  chemically synthesized
tcatttttaagttaaaaaacaa

SEQ ID NO: 834279 - DNA, 22 bp, Artificial Sequence
  chemically synthesized
ttcatttttaagttaaaaaaca

SEQ ID NO: 834280 - DNA, 22 bp, Artificial Sequence
  chemically synthesized
attttgttttgttttttaactt

SEQ ID NO: 834281 - DNA, 22 bp, Artificial Sequence
  chemically synthesized
tgttttgttttttaacttaaaa

SEQ ID NO: 834282 - DNA, 22 bp, Artificial Sequence
  chemically synthesized
gttttgttttttaacttaaaaa

SEQ ID NO: 834283 - DNA, 22 bp, Artificial Sequence
  chemically synthesized
ttttgttttttaacttaaaaat

SEQ ID NO: 834284 - DNA, 22 bp, Artificial Sequence
  chemically synthesized
gtagaacttttcatttttaagt

SEQ ID NO: 834285 - DNA, 22 bp, Artificial Sequence
  chemically synthesized
ggtagaacttttcatttttaag

SEQ ID NO: 834286 - DNA, 22 bp, Artificial Sequence
  chemically synthesized
tgttttttaacttaaaaatgaa

SEQ ID NO: 834287 - DNA, 22 bp, Artificial Sequence
  chemically synthesized
gttttttaacttaaaaatgaaa

SEQ ID NO: 834288 - DNA, 22 bp, Artificial Sequence
  chemically synthesized
ttttttaacttaaaaatgaaaa

SEQ ID NO: 834289 - DNA, 22 bp, Artificial Sequence
  chemically synthesized
tttaacttaaaaatgaaaagtt

SEQ ID NO: 834290 - DNA, 22 bp, Artificial Sequence
  chemically synthesized
ttaacttaaaaatgaaaagttc

SEQ ID NO: 834291 - DNA, 22 bp, Artificial Sequence
  chemically synthesized
taacttaaaaatgaaaagttct

SEQ ID NO: 834292 - DNA, 22 bp, Artificial Sequence
  chemically synthesized
aacttaaaaatgaaaagttcta

SEQ ID NO: 834293 - DNA, 22 bp, Artificial Sequence
  chemically synthesized
acttaaaaatgaaaagttctac

SEQ ID NO: 834294 - DNA, 22 bp, Artificial Sequence
  chemically synthesized
aaaaatgaaaagttctaccaaa

SEQ ID NO: 834295 - DNA, 22 bp, Artificial Sequence
  chemically synthesized
aaaatgaaaagttctaccaaat

SEQ ID NO: 834296 - DNA, 22 bp, Artificial Sequence
  chemically synthesized
taagtaagtgagaacatgtgat

SEQ ID NO: 834297 - DNA, 22 bp, Artificial Sequence
  chemically synthesized
ataagtaagtgagaacatgtga

SEQ ID NO: 834298 - DNA, 22 bp, Artificial Sequence
  chemically synthesized
taccaaatatcacatgttctca

SEQ ID NO: 834299 - DNA, 22 bp, Artificial Sequence
  chemically synthesized
ccaaatatcacatgttctcact

SEQ ID NO: 834300 - DNA, 22 bp, Artificial Sequence
  chemically synthesized
ccacttataagtaagtgagaac

SEQ ID NO: 834301 - DNA, 22 bp, Artificial Sequence
  chemically synthesized
gctcccacttataagtaagtga

SEQ ID NO: 834302 - DNA, 22 bp, Artificial Sequence
  chemically synthesized
agctcccacttataagtaagtg

SEQ ID NO: 834303 - DNA, 22 bp, Artificial Sequence
  chemically synthesized
agtgcttagctcccacttataa

SEQ ID NO: 834304 - DNA, 22 bp, Artificial Sequence
  chemically synthesized
tcacttacttataagtgggagc

SEQ ID NO: 834305 - DNA, 22 bp, Artificial Sequence
  chemically synthesized
acttacttataagtgggagcta

SEQ ID NO: 834306 - DNA, 22 bp, Artificial Sequence
  chemically synthesized
acttataagtgggagctaagca

SEQ ID NO: 834307 - DNA, 22 bp, Artificial Sequence
  chemically synthesized
cttataagtgggagctaagcac

SEQ ID NO: 834308 - DNA, 22 bp, Artificial Sequence
  chemically synthesized
ataagtgggagctaagcactga

SEQ ID NO: 834309 - DNA, 22 bp, Artificial Sequence
  chemically synthesized
taagtgggagctaagcactgag

SEQ ID NO: 834310 - DNA, 22 bp, Artificial Sequence
  chemically synthesized
tgtccatgtgtgctcagtgctt

SEQ ID NO: 834311 - DNA, 22 bp, Artificial Sequence
  chemically synthesized
atgtccatgtgtgctcagtgct

SEQ ID NO: 834312 - DNA, 22 bp, Artificial Sequence
  chemically synthesized
ccgtatttatgtccatgtgtgc

SEQ ID NO: 834313 - DNA, 22 bp, Artificial Sequence
  chemically synthesized
ttcccgtatttatgtccatgtg

SEQ ID NO: 834314 - DNA, 22 bp, Artificial Sequence
  chemically synthesized
agcactgagcacacatggacat

SEQ ID NO: 834315 - DNA, 22 bp, Artificial Sequence
  chemically synthesized
ttgttcccgtatttatgtccat

SEQ ID NO: 834316 - DNA, 22 bp, Artificial Sequence
  chemically synthesized
agcacacatggacataaatacg

SEQ ID NO: 834317 - DNA, 22 bp, Artificial Sequence
  chemically synthesized
gtagtccccagggtctattgtt

SEQ ID NO: 834318 - DNA, 22 bp, Artificial Sequence
  chemically synthesized
tagtagtccccagggtctattg

SEQ ID NO: 834319 - DNA, 22 bp, Artificial Sequence
  chemically synthesized
cctctagtagtccccagggtct

SEQ ID NO: 834320 - DNA, 22 bp, Artificial Sequence
  chemically synthesized
ctccctctagtagtccccaggg

SEQ ID NO: 834321 - DNA, 22 bp, Artificial Sequence
  chemically synthesized
cctcctccctctagtagtcccc

SEQ ID NO: 834322 - DNA, 22 bp, Artificial Sequence
  chemically synthesized
ccctccctcctccctctagtag

SEQ ID NO: 834323 - DNA, 22 bp, Artificial Sequence
  chemically synthesized
gggactactagagggaggaggg

SEQ ID NO: 834324 - DNA, 22 bp, Artificial Sequence
  chemically synthesized
acccactcccctccctcctccc

SEQ ID NO: 834325 - DNA, 22 bp, Artificial Sequence
  chemically synthesized
aacccactcccctccctcctcc

SEQ ID NO: 834326 - DNA, 22 bp, Artificial Sequence
  chemically synthesized
taacccactcccctccctcctc

SEQ ID NO: 834327 - DNA, 22 bp, Artificial Sequence
  chemically synthesized
ttaacccactcccctccctcct

SEQ ID NO: 834328 - DNA, 22 bp, Artificial Sequence
  chemically synthesized
tttaacccactcccctccctcc

SEQ ID NO: 834329 - DNA, 22 bp, Artificial Sequence
  chemically synthesized
ttttaacccactcccctccctc

SEQ ID NO: 834330 - DNA, 22 bp, Artificial Sequence
  chemically synthesized
ctagagggaggagggaggggag

SEQ ID NO: 834331 - DNA, 22 bp, Artificial Sequence
  chemically synthesized
gagggaggagggaggggagtgg

SEQ ID NO: 834332 - DNA, 22 bp, Artificial Sequence
  chemically synthesized
ataggtcgtttttttaacccac

SEQ ID NO: 834333 - DNA, 22 bp, Artificial Sequence
  chemically synthesized
gtgagcatagtaactgataggt

SEQ ID NO: 834334 - DNA, 22 bp, Artificial Sequence
  chemically synthesized
aaaaaacgacctatcagttact

SEQ ID NO: 834335 - DNA, 22 bp, Artificial Sequence
  chemically synthesized
tcagttactatgctcactaaca

SEQ ID NO: 834336 - DNA, 22 bp, Artificial Sequence
  chemically synthesized
ctatgctcactaacatggcgat

SEQ ID NO: 834337 - DNA, 22 bp, Artificial Sequence
  chemically synthesized
gagtacggatcccatcgccatg

SEQ ID NO: 834338 - DNA, 22 bp, Artificial Sequence
  chemically synthesized
ggagtacggatcccatcgccat

SEQ ID NO: 834339 - DNA, 22 bp, Artificial Sequence
  chemically synthesized
tgctcactaacatggcgatggg

SEQ ID NO: 834340 - DNA, 22 bp, Artificial Sequence
  chemically synthesized
actaacatggcgatgggatccg

SEQ ID NO: 834341 - DNA, 22 bp, Artificial Sequence
  chemically synthesized
aggtttggagtacggatcccat

SEQ ID NO: 834342 - DNA, 22 bp, Artificial Sequence
  chemically synthesized
acatggcgatgggatccgtact

SEQ ID NO: 834343 - DNA, 22 bp, Artificial Sequence
  chemically synthesized
catgatgctgaggtttggagta

SEQ ID NO: 834344 - DNA, 22 bp, Artificial Sequence
  chemically synthesized
tcacgtgggagtattgcatgat

SEQ ID NO: 834345 - DNA, 22 bp, Artificial Sequence
  chemically synthesized
caaacctcagcatcatgcaata

SEQ ID NO: 834346 - DNA, 22 bp, Artificial Sequence
  chemically synthesized
gtcacgtgggagtattgcatga

SEQ ID NO: 834347 - DNA, 22 bp, Artificial Sequence
  chemically synthesized
agcatcatgcaatactcccacg

SEQ ID NO: 834348 - DNA, 22 bp, Artificial Sequence
  chemically synthesized
ccacgtgacaaatctgcacatg

SEQ ID NO: 834349 - DNA, 22 bp, Artificial Sequence
  chemically synthesized
gatacagaaggtgcatgtgcag

SEQ ID NO: 834350 - DNA, 22 bp, Artificial Sequence
  chemically synthesized
agatacagaaggtgcatgtgca

SEQ ID NO: 834351 - DNA, 22 bp, Artificial Sequence
  chemically synthesized
tagatacagaaggtgcatgtgc

SEQ ID NO: 834352 - DNA, 22 bp, Artificial Sequence
  chemically synthesized
ttagatacagaaggtgcatgtg

SEQ ID NO: 834353 - DNA, 22 bp, Artificial Sequence
  chemically synthesized
aacttttagatacagaaggtgc

SEQ ID NO: 834354 - DNA, 22 bp, Artificial Sequence
  chemically synthesized
caacttttagatacagaaggtg

SEQ ID NO: 834355 - DNA, 22 bp, Artificial Sequence
  chemically synthesized
atttcaacttttagatacagaa

SEQ ID NO: 834356 - DNA, 22 bp, Artificial Sequence
  chemically synthesized
aatttcaacttttagatacaga

SEQ ID NO: 834357 - DNA, 22 bp, Artificial Sequence
  chemically synthesized
cacatgcaccttctgtatctaa

SEQ ID NO: 834358 - DNA, 22 bp, Artificial Sequence
  chemically synthesized
taatttcaacttttagatacag

SEQ ID NO: 834359 - DNA, 22 bp, Artificial Sequence
  chemically synthesized
ttaatttcaacttttagataca

SEQ ID NO: 834360 - DNA, 22 bp, Artificial Sequence
  chemically synthesized
tttaatttcaacttttagatac

SEQ ID NO: 834361 - DNA, 22 bp, Artificial Sequence
  chemically synthesized
ttttaatttcaacttttagata

SEQ ID NO: 834362 - DNA, 22 bp, Artificial Sequence
  chemically synthesized
tttttaatttcaacttttagat

SEQ ID NO: 834363 - DNA, 22 bp, Artificial Sequence
  chemically synthesized
ttttttaatttcaacttttaga

SEQ ID NO: 834364 - DNA, 22 bp, Artificial Sequence
  chemically synthesized
ttttttttaatttcaactttta

SEQ ID NO: 834365 - DNA, 22 bp, Artificial Sequence
  chemically synthesized
cttttttttaatttcaactttt

SEQ ID NO: 834366 - DNA, 22 bp, Artificial Sequence
  chemically synthesized
tcttttttttaatttcaacttt

SEQ ID NO: 834367 - DNA, 22 bp, Artificial Sequence
  chemically synthesized
ctgtatctaaaagttgaaatta

SEQ ID NO: 834368 - DNA, 22 bp, Artificial Sequence
  chemically synthesized
tgtatctaaaagttgaaattaa

SEQ ID NO: 834369 - DNA, 22 bp, Artificial Sequence
  chemically synthesized
tatctaaaagttgaaattaaaa

SEQ ID NO: 834370 - DNA, 22 bp, Artificial Sequence
  chemically synthesized
aaagttgaaattaaaaaaaaga

SEQ ID NO: 834371 - DNA, 22 bp, Artificial Sequence
  chemically synthesized
acaacacagaagttttcttttt

SEQ ID NO: 834372 - DNA, 22 bp, Artificial Sequence
  chemically synthesized
cacaacacagaagttttctttt

SEQ ID NO: 834373 - DNA, 22 bp, Artificial Sequence
  chemically synthesized
tcacaacacagaagttttcttt

SEQ ID NO: 834374 - DNA, 22 bp, Artificial Sequence
  chemically synthesized
ttcacaacacagaagttttctt

SEQ ID NO: 834375 - DNA, 22 bp, Artificial Sequence
  chemically synthesized
aaattaaaaaaaagaaaacttc

SEQ ID NO: 834376 - DNA, 22 bp, Artificial Sequence
  chemically synthesized
cttttcacaacacagaagtttt

SEQ ID NO: 834377 - DNA, 22 bp, Artificial Sequence
  chemically synthesized
aaaaaaagaaaacttctgtgtt

SEQ ID NO: 834378 - DNA, 22 bp, Artificial Sequence
  chemically synthesized
gttccttttcacaacacagaag

SEQ ID NO: 834379 - DNA, 22 bp, Artificial Sequence
  chemically synthesized
ttggttccttttcacaacacag

SEQ ID NO: 834380 - DNA, 22 bp, Artificial Sequence
  chemically synthesized
attgttggttccttttcacaac

SEQ ID NO: 834381 - DNA, 22 bp, Artificial Sequence
  chemically synthesized
tcattgttggttccttttcaca

SEQ ID NO: 834382 - DNA, 22 bp, Artificial Sequence
  chemically synthesized
tctcattgttggttccttttca

SEQ ID NO: 834383 - DNA, 22 bp, Artificial Sequence
  chemically synthesized
ctctcattgttggttccttttc

SEQ ID NO: 834384 - DNA, 22 bp, Artificial Sequence
  chemically synthesized
ctgtgttgtgaaaaggaaccaa

SEQ ID NO: 834385 - DNA, 22 bp, Artificial Sequence
  chemically synthesized
tgtgttgtgaaaaggaaccaac

SEQ ID NO: 834386 - DNA, 22 bp, Artificial Sequence
  chemically synthesized
tgttgtgaaaaggaaccaacaa

SEQ ID NO: 834387 - DNA, 22 bp, Artificial Sequence
  chemically synthesized
tatccttctctcattgttggtt

SEQ ID NO: 834388 - DNA, 22 bp, Artificial Sequence
  chemically synthesized
tgaaaaggaaccaacaatgaga

SEQ ID NO: 834389 - DNA, 22 bp, Artificial Sequence
  chemically synthesized
aaatcctatatccttctctcat

SEQ ID NO: 834390 - DNA, 22 bp, Artificial Sequence
  chemically synthesized
aaaatcctatatccttctctca

SEQ ID NO: 834391 - DNA, 22 bp, Artificial Sequence
  chemically synthesized
taaaatcctatatccttctctc

SEQ ID NO: 834392 - DNA, 22 bp, Artificial Sequence
  chemically synthesized
tgttttaaaatcctatatcctt

SEQ ID NO: 834393 - DNA, 22 bp, Artificial Sequence
  chemically synthesized
aagctatgttttaaaatcctat

SEQ ID NO: 834394 - DNA, 22 bp, Artificial Sequence
  chemically synthesized
ttgaagctatgttttaaaatcc

SEQ ID NO: 834395 - DNA, 22 bp, Artificial Sequence
  chemically synthesized
gggtcattgttgaagctatgtt

SEQ ID NO: 834396 - DNA, 22 bp, Artificial Sequence
  chemically synthesized
tggggtcattgttgaagctatg

SEQ ID NO: 834397 - DNA, 22 bp, Artificial Sequence
  chemically synthesized
ctggggtcattgttgaagctat

SEQ ID NO: 834398 - DNA, 22 bp, Artificial Sequence
  chemically synthesized
taaaacatagcttcaacaatga

SEQ ID NO: 834399 - DNA, 22 bp, Artificial Sequence
  chemically synthesized
aggtttctggggtcattgttga

SEQ ID NO: 834400 - DNA, 22 bp, Artificial Sequence
  chemically synthesized
aaaacatagcttcaacaatgac

SEQ ID NO: 834401 - DNA, 22 bp, Artificial Sequence
  chemically synthesized
aaacatagcttcaacaatgacc

SEQ ID NO: 834402 - DNA, 22 bp, Artificial Sequence
  chemically synthesized
tgaggtttctggggtcattgtt

SEQ ID NO: 834403 - DNA, 22 bp, Artificial Sequence
  chemically synthesized
caacaatgaccccagaaacctc

SEQ ID NO: 834404 - DNA, 22 bp, Artificial Sequence
  chemically synthesized
aacaatgaccccagaaacctca

SEQ ID NO: 834405 - DNA, 22 bp, Artificial Sequence
  chemically synthesized
gataaaggcctctgaggtttct

SEQ ID NO: 834406 - DNA, 22 bp, Artificial Sequence
  chemically synthesized
cagtcagacagttagataaagg

SEQ ID NO: 834407 - DNA, 22 bp, Artificial Sequence
  chemically synthesized
tccagtcagacagttagataaa

SEQ ID NO: 834408 - DNA, 22 bp, Artificial Sequence
  chemically synthesized
ctccagtcagacagttagataa

SEQ ID NO: 834409 - DNA, 22 bp, Artificial Sequence
  chemically synthesized
tctccagtcagacagttagata

SEQ ID NO: 834410 - DNA, 22 bp, Artificial Sequence
  chemically synthesized
agaggcctttatctaactgtct

SEQ ID NO: 834411 - DNA, 22 bp, Artificial Sequence
  chemically synthesized
tagataattttctccagtcaga

SEQ ID NO: 834412 - DNA, 22 bp, Artificial Sequence
  chemically synthesized
gtagataattttctccagtcag

SEQ ID NO: 834413 - DNA, 22 bp, Artificial Sequence
  chemically synthesized
tatctaactgtctgactggaga

SEQ ID NO: 834414 - DNA, 22 bp, Artificial Sequence
  chemically synthesized
atctaactgtctgactggagaa

SEQ ID NO: 834415 - DNA, 22 bp, Artificial Sequence
  chemically synthesized
tctaactgtctgactggagaaa

SEQ ID NO: 834416 - DNA, 22 bp, Artificial Sequence
  chemically synthesized
actgtctgactggagaaaatta

SEQ ID NO: 834417 - DNA, 22 bp, Artificial Sequence
  chemically synthesized
tctgactggagaaaattatcta

SEQ ID NO: 834418 - DNA, 22 bp, Artificial Sequence
  chemically synthesized
actggagaaaattatctacaag

SEQ ID NO: 834419 - DNA, 22 bp, Artificial Sequence
  chemically synthesized
caaacacgtggtaccttgtaga

SEQ ID NO: 834420 - DNA, 22 bp, Artificial Sequence
  chemically synthesized
gcaaacacgtggtaccttgtag

SEQ ID NO: 834421 - DNA, 22 bp, Artificial Sequence
  chemically synthesized
gagaaaattatctacaaggtac

SEQ ID NO: 834422 - DNA, 22 bp, Artificial Sequence
  chemically synthesized
aaagcttgcaaacacgtggtac

SEQ ID NO: 834423 - DNA, 22 bp, Artificial Sequence
  chemically synthesized
tctacaaggtaccacgtgtttg

SEQ ID NO: 834424 - DNA, 22 bp, Artificial Sequence
  chemically synthesized
caaggtaccacgtgtttgcaag

SEQ ID NO: 834425 - DNA, 22 bp, Artificial Sequence
  chemically synthesized
aaaggtgaactgaaagcttgca

SEQ ID NO: 834426 - DNA, 22 bp, Artificial Sequence
  chemically synthesized
ttaaaaggtgaactgaaagctt

SEQ ID NO: 834427 - DNA, 22 bp, Artificial Sequence
  chemically synthesized
tggctattaaaaggtgaactga

SEQ ID NO: 834428 - DNA, 22 bp, Artificial Sequence
  chemically synthesized
gcaagctttcagttcacctttt

SEQ ID NO: 834429 - DNA, 22 bp, Artificial Sequence
  chemically synthesized
caagctttcagttcacctttta

SEQ ID NO: 834430 - DNA, 22 bp, Artificial Sequence
  chemically synthesized
cattgtggctattaaaaggtga

SEQ ID NO: 834431 - DNA, 22 bp, Artificial Sequence
  chemically synthesized
tcagttcaccttttaatagcca

SEQ ID NO: 834432 - DNA, 22 bp, Artificial Sequence
  chemically synthesized
atagttccattgtggctattaa

SEQ ID NO: 834433 - DNA, 22 bp, Artificial Sequence
  chemically synthesized
cagttcaccttttaatagccac

SEQ ID NO: 834434 - DNA, 22 bp, Artificial Sequence
  chemically synthesized
agttcaccttttaatagccaca

SEQ ID NO: 834435 - DNA, 22 bp, Artificial Sequence
  chemically synthesized
attcatagttccattgtggcta

SEQ ID NO: 834436 - DNA, 22 bp, Artificial Sequence
  chemically synthesized
aattcatagttccattgtggct

SEQ ID NO: 834437 - DNA, 22 bp, Artificial Sequence
  chemically synthesized
accttttaatagccacaatgga

SEQ ID NO: 834438 - DNA, 22 bp, Artificial Sequence
  chemically synthesized
ttaatagccacaatggaactat

SEQ ID NO: 834439 - DNA, 22 bp, Artificial Sequence
  chemically synthesized
taatagccacaatggaactatg

SEQ ID NO: 834440 - DNA, 22 bp, Artificial Sequence
  chemically synthesized
gtgtccttaattcatagttcca

SEQ ID NO: 834441 - DNA, 22 bp, Artificial Sequence
  chemically synthesized
aatagccacaatggaactatga

SEQ ID NO: 834442 - DNA, 22 bp, Artificial Sequence
  chemically synthesized
agtgtccttaattcatagttcc

SEQ ID NO: 834443 - DNA, 22 bp, Artificial Sequence
  chemically synthesized
atagccacaatggaactatgaa

SEQ ID NO: 834444 - DNA, 22 bp, Artificial Sequence
  chemically synthesized
gggcttagtgtccttaattcat

SEQ ID NO: 834445 - DNA, 22 bp, Artificial Sequence
  chemically synthesized
aagggagattcgggcttagtgt

SEQ ID NO: 834446 - DNA, 22 bp, Artificial Sequence
  chemically synthesized
tgaattaaggacactaagcccg

SEQ ID NO: 834447 - DNA, 22 bp, Artificial Sequence
  chemically synthesized
aggacactaagcccgaatctcc

SEQ ID NO: 834448 - DNA, 22 bp, Artificial Sequence
  chemically synthesized
cacatagaattaaagggagatt

SEQ ID NO: 834449 - DNA, 22 bp, Artificial Sequence
  chemically synthesized
ccacatagaattaaagggagat

SEQ ID NO: 834450 - DNA, 22 bp, Artificial Sequence
  chemically synthesized
cttccacatagaattaaaggga

SEQ ID NO: 834451 - DNA, 22 bp, Artificial Sequence
  chemically synthesized
ccttccacatagaattaaaggg

SEQ ID NO: 834452 - DNA, 22 bp, Artificial Sequence
  chemically synthesized
agcccgaatctccctttaattc

SEQ ID NO: 834453 - DNA, 22 bp, Artificial Sequence
  chemically synthesized
tccttccacatagaattaaagg

SEQ ID NO: 834454 - DNA, 22 bp, Artificial Sequence
  chemically synthesized
ttccttccacatagaattaaag

SEQ ID NO: 834455 - DNA, 22 bp, Artificial Sequence
  chemically synthesized
cttttccttccacatagaatta

SEQ ID NO: 834456 - DNA, 22 bp, Artificial Sequence
  chemically synthesized
acttttccttccacatagaatt

SEQ ID NO: 834457 - DNA, 22 bp, Artificial Sequence
  chemically synthesized
tacttttccttccacatagaat

SEQ ID NO: 834458 - DNA, 22 bp, Artificial Sequence
  chemically synthesized
tttacttttccttccacataga

SEQ ID NO: 834459 - DNA, 22 bp, Artificial Sequence
  chemically synthesized
ctttacttttccttccacatag

SEQ ID NO: 834460 - DNA, 22 bp, Artificial Sequence
  chemically synthesized
cctttaattctatgtggaagga

SEQ ID NO: 834461 - DNA, 22 bp, Artificial Sequence
  chemically synthesized
tttctttacttttccttccaca

SEQ ID NO: 834462 - DNA, 22 bp, Artificial Sequence
  chemically synthesized
atttctttacttttccttccac

SEQ ID NO: 834463 - DNA, 22 bp, Artificial Sequence
  chemically synthesized
taattctatgtggaaggaaaag

SEQ ID NO: 834464 - DNA, 22 bp, Artificial Sequence
  chemically synthesized
tttatttctttacttttccttc

SEQ ID NO: 834465 - DNA, 22 bp, Artificial Sequence
  chemically synthesized
aattctatgtggaaggaaaagt

SEQ ID NO: 834466 - DNA, 22 bp, Artificial Sequence
  chemically synthesized
attctatgtggaaggaaaagta

SEQ ID NO: 834467 - DNA, 22 bp, Artificial Sequence
  chemically synthesized
tatgtggaaggaaaagtaaaga

SEQ ID NO: 834468 - DNA, 22 bp, Artificial Sequence
  chemically synthesized
tgtggaaggaaaagtaaagaaa

SEQ ID NO: 834469 - DNA, 22 bp, Artificial Sequence
  chemically synthesized
aatcattgtttatttctttact

SEQ ID NO: 834470 - DNA, 22 bp, Artificial Sequence
  chemically synthesized
caatcattgtttatttctttac

SEQ ID NO: 834471 - DNA, 22 bp, Artificial Sequence
  chemically synthesized
tcaatcattgtttatttcttta

SEQ ID NO: 834472 - DNA, 22 bp, Artificial Sequence
  chemically synthesized
ttcaatcattgtttatttcttt

SEQ ID NO: 834473 - DNA, 22 bp, Artificial Sequence
  chemically synthesized
tttcaatcattgtttatttctt

SEQ ID NO: 834474 - DNA, 22 bp, Artificial Sequence
  chemically synthesized
ttttcaatcattgtttatttct

SEQ ID NO: 834475 - DNA, 22 bp, Artificial Sequence
  chemically synthesized
tttttcaatcattgtttatttc

SEQ ID NO: 834476 - DNA, 22 bp, Artificial Sequence
  chemically synthesized
ttttttcaatcattgtttattt

SEQ ID NO: 834477 - DNA, 22 bp, Artificial Sequence
  chemically synthesized
tgtaagtcttttttttcaatca

SEQ ID NO: 834478 - DNA, 22 bp, Artificial Sequence
  chemically synthesized
atgtaagtcttttttttcaatc

SEQ ID NO: 834479 - DNA, 22 bp, Artificial Sequence
  chemically synthesized
tatgtaagtcttttttttcaat

SEQ ID NO: 834480 - DNA, 22 bp, Artificial Sequence
  chemically synthesized
ttatgtaagtcttttttttcaa

SEQ ID NO: 834481 - DNA, 22 bp, Artificial Sequence
  chemically synthesized
cttttatgtaagtctttttttt

SEQ ID NO: 834482 - DNA, 22 bp, Artificial Sequence
  chemically synthesized
ccatctacttttatgtaagtct

SEQ ID NO: 834483 - DNA, 22 bp, Artificial Sequence
  chemically synthesized
accatctacttttatgtaagtc

SEQ ID NO: 834484 - DNA, 22 bp, Artificial Sequence
  chemically synthesized
taccatctacttttatgtaagt

SEQ ID NO: 834485 - DNA, 22 bp, Artificial Sequence
  chemically synthesized
ttaccatctacttttatgtaag

SEQ ID NO: 834486 - DNA, 22 bp, Artificial Sequence
  chemically synthesized
aaaaaaaagacttacataaaag

SEQ ID NO: 834487 - DNA, 22 bp, Artificial Sequence
  chemically synthesized
tttttaccatctacttttatgt

SEQ ID NO: 834488 - DNA, 22 bp, Artificial Sequence
  chemically synthesized
atttttaccatctacttttatg

SEQ ID NO: 834489 - DNA, 22 bp, Artificial Sequence
  chemically synthesized
tatttttaccatctacttttat

SEQ ID NO: 834490 - DNA, 22 bp, Artificial Sequence
  chemically synthesized
ttttatttttaccatctacttt

SEQ ID NO: 834491 - DNA, 22 bp, Artificial Sequence
  chemically synthesized
attttatttttaccatctactt

SEQ ID NO: 834492 - DNA, 22 bp, Artificial Sequence
  chemically synthesized
tattttatttttaccatctact

SEQ ID NO: 834493 - DNA, 22 bp, Artificial Sequence
  chemically synthesized
acataaaagtagatggtaaaaa

SEQ ID NO: 834494 - DNA, 22 bp, Artificial Sequence
  chemically synthesized
acctttattttatttttaccat

SEQ ID NO: 834495 - DNA, 22 bp, Artificial Sequence
  chemically synthesized
cataaaagtagatggtaaaaat

SEQ ID NO: 834496 - DNA, 22 bp, Artificial Sequence
  chemically synthesized
gacctttattttatttttacca

SEQ ID NO: 834497 - DNA, 22 bp, Artificial Sequence
  chemically synthesized
ttgacctttattttatttttac

SEQ ID NO: 834498 - DNA, 22 bp, Artificial Sequence
  chemically synthesized
cttgacctttattttattttta

SEQ ID NO: 834499 - DNA, 22 bp, Artificial Sequence
  chemically synthesized
ccttcttgacctttattttatt

SEQ ID NO: 834500 - DNA, 22 bp, Artificial Sequence
  chemically synthesized
ttaccttcttgacctttatttt

SEQ ID NO: 834501 - DNA, 22 bp, Artificial Sequence
  chemically synthesized
attaccttcttgacctttattt

SEQ ID NO: 834502 - DNA, 22 bp, Artificial Sequence
  chemically synthesized
tttattaccttcttgaccttta

SEQ ID NO: 834503 - DNA, 22 bp, Artificial Sequence
  chemically synthesized
atttattaccttcttgaccttt

SEQ ID NO: 834504 - DNA, 22 bp, Artificial Sequence
  chemically synthesized
aggaaatatgatttatttatta

SEQ ID NO: 834505 - DNA, 22 bp, Artificial Sequence
  chemically synthesized
gaacaacattcaggaaatatga

SEQ ID NO: 834506 - DNA, 22 bp, Artificial Sequence
  chemically synthesized
agaacaacattcaggaaatatg

SEQ ID NO: 834507 - DNA, 22 bp, Artificial Sequence
  chemically synthesized
aacacaatttagaacaacattc

SEQ ID NO: 834508 - DNA, 22 bp, Artificial Sequence
  chemically synthesized
gaacacaatttagaacaacatt

SEQ ID NO: 834509 - DNA, 22 bp, Artificial Sequence
  chemically synthesized
cctgaatgttgttctaaattgt

SEQ ID NO: 834510 - DNA, 22 bp, Artificial Sequence
  chemically synthesized
ctgaatgttgttctaaattgtg

SEQ ID NO: 834511 - DNA, 22 bp, Artificial Sequence
  chemically synthesized
aatgttgttctaaattgtgttc

SEQ ID NO: 834512 - DNA, 22 bp, Artificial Sequence
  chemically synthesized
gaacatataaatttgaacacaa

SEQ ID NO: 834513 - DNA, 22 bp, Artificial Sequence
  chemically synthesized
tctggaacatataaatttgaac

SEQ ID NO: 834514 - DNA, 22 bp, Artificial Sequence
  chemically synthesized
ttctaaattgtgttcaaattta

SEQ ID NO: 834515 - DNA, 22 bp, Artificial Sequence
  chemically synthesized
ctgtctggaacatataaatttg

SEQ ID NO: 834516 - DNA, 22 bp, Artificial Sequence
  chemically synthesized
taaattgtgttcaaatttatat

SEQ ID NO: 834517 - DNA, 22 bp, Artificial Sequence
  chemically synthesized
tactgtctggaacatataaatt

SEQ ID NO: 834518 - DNA, 22 bp, Artificial Sequence
  chemically synthesized
aattgtgttcaaatttatatgt

SEQ ID NO: 834519 - DNA, 22 bp, Artificial Sequence
  chemically synthesized
ctactgtctggaacatataaat

SEQ ID NO: 834520 - DNA, 22 bp, Artificial Sequence
  chemically synthesized
tttctactgtctggaacatata

SEQ ID NO: 834521 - DNA, 22 bp, Artificial Sequence
  chemically synthesized
gtttctactgtctggaacatat

SEQ ID NO: 834522 - DNA, 22 bp, Artificial Sequence
  chemically synthesized
tgttcaaatttatatgttccag

SEQ ID NO: 834523 - DNA, 22 bp, Artificial Sequence
  chemically synthesized
tgtttctactgtctggaacata

SEQ ID NO: 834524 - DNA, 22 bp, Artificial Sequence
  chemically synthesized
ttgtttctactgtctggaacat

SEQ ID NO: 834525 - DNA, 22 bp, Artificial Sequence
  chemically synthesized
tttgtttctactgtctggaaca

SEQ ID NO: 834526 - DNA, 22 bp, Artificial Sequence
  chemically synthesized
aaatttatatgttccagacagt

SEQ ID NO: 834527 - DNA, 22 bp, Artificial Sequence
  chemically synthesized
ctttttgtttctactgtctgga

SEQ ID NO: 834528 - DNA, 22 bp, Artificial Sequence
  chemically synthesized
gctttttgtttctactgtctgg

SEQ ID NO: 834529 - DNA, 22 bp, Artificial Sequence
  chemically synthesized
atatgttccagacagtagaaac

SEQ ID NO: 834530 - DNA, 22 bp, Artificial Sequence
  chemically synthesized
tatgttccagacagtagaaaca

SEQ ID NO: 834531 - DNA, 22 bp, Artificial Sequence
  chemically synthesized
aggatttgctttttgtttctac

SEQ ID NO: 834532 - DNA, 22 bp, Artificial Sequence
  chemically synthesized
cagacagtagaaacaaaaagca

SEQ ID NO: 834533 - DNA, 22 bp, Artificial Sequence
  chemically synthesized
taaatcattaaggatttgcttt

SEQ ID NO: 834534 - DNA, 22 bp, Artificial Sequence
  chemically synthesized
ataaatcattaaggatttgctt

SEQ ID NO: 834535 - DNA, 22 bp, Artificial Sequence
  chemically synthesized
catatttataaatcattaagga

SEQ ID NO: 834536 - DNA, 22 bp, Artificial Sequence
  chemically synthesized
acatatttataaatcattaagg

SEQ ID NO: 834537 - DNA, 22 bp, Artificial Sequence
  chemically synthesized
tacatatttataaatcattaag

SEQ ID NO: 834538 - DNA, 22 bp, Artificial Sequence
  chemically synthesized
ttacatatttataaatcattaa

SEQ ID NO: 834539 - DNA, 22 bp, Artificial Sequence
  chemically synthesized
aatgatttataaatatgtaaaa

SEQ ID NO: 834540 - DNA, 22 bp, Artificial Sequence
  chemically synthesized
atgatttataaatatgtaaaag

SEQ ID NO: 834541 - DNA, 22 bp, Artificial Sequence
  chemically synthesized
ataaatatgtaaaagcattcca

SEQ ID NO: 834542 - DNA, 22 bp, Artificial Sequence
  chemically synthesized
taaatatgtaaaagcattccat

SEQ ID NO: 834543 - DNA, 22 bp, Artificial Sequence
  chemically synthesized
gtaataacacaaatgatggaat

SEQ ID NO: 834544 - DNA, 22 bp, Artificial Sequence
  chemically synthesized
agtaataacacaaatgatggaa

SEQ ID NO: 834545 - DNA, 22 bp, Artificial Sequence
  chemically synthesized
tagtaataacacaaatgatgga

SEQ ID NO: 834546 - DNA, 22 bp, Artificial Sequence
  chemically synthesized
ttagtaataacacaaatgatgg

SEQ ID NO: 834547 - DNA, 22 bp, Artificial Sequence
  chemically synthesized
tttttagtaataacacaaatga

SEQ ID NO: 834548 - DNA, 22 bp, Artificial Sequence
  chemically synthesized
catcatttgtgttattactaaa

SEQ ID NO: 834549 - DNA, 22 bp, Artificial Sequence
  chemically synthesized
aaatataaacatctatttttag

SEQ ID NO: 834550 - DNA, 22 bp, Artificial Sequence
  chemically synthesized
gtgttattactaaaaatagatg

SEQ ID NO: 834551 - DNA, 22 bp, Artificial Sequence
  chemically synthesized
tgttattactaaaaatagatgt

SEQ ID NO: 834552 - DNA, 22 bp, Artificial Sequence
  chemically synthesized
ttactaaaaatagatgtttata

SEQ ID NO: 834553 - DNA, 22 bp, Artificial Sequence
  chemically synthesized
aggatagctgaaatataaacat

SEQ ID NO: 834554 - DNA, 22 bp, Artificial Sequence
  chemically synthesized
caggatagctgaaatataaaca

SEQ ID NO: 834555 - DNA, 22 bp, Artificial Sequence
  chemically synthesized
ctaaaaatagatgtttatattt

SEQ ID NO: 834556 - DNA, 22 bp, Artificial Sequence
  chemically synthesized
tcaggatagctgaaatataaac

SEQ ID NO: 834557 - DNA, 22 bp, Artificial Sequence
  chemically synthesized
ttcaggatagctgaaatataaa

SEQ ID NO: 834558 - DNA, 22 bp, Artificial Sequence
  chemically synthesized
tttcaggatagctgaaatataa

SEQ ID NO: 834559 - DNA, 22 bp, Artificial Sequence
  chemically synthesized
aaaatagatgtttatatttcag

SEQ ID NO: 834560 - DNA, 22 bp, Artificial Sequence
  chemically synthesized
attttttcaggatagctgaaat

SEQ ID NO: 834561 - DNA, 22 bp, Artificial Sequence
  chemically synthesized
taattttttcaggatagctgaa

SEQ ID NO: 834562 - DNA, 22 bp, Artificial Sequence
  chemically synthesized
ttctaattttttcaggatagct

SEQ ID NO: 834563 - DNA, 22 bp, Artificial Sequence
  chemically synthesized
atatttcagctatcctgaaaaa

SEQ ID NO: 834564 - DNA, 22 bp, Artificial Sequence
  chemically synthesized
tatttcagctatcctgaaaaaa

SEQ ID NO: 834565 - DNA, 22 bp, Artificial Sequence
  chemically synthesized
atattattctaattttttcagg

SEQ ID NO: 834566 - DNA, 22 bp, Artificial Sequence
  chemically synthesized
aatattattctaattttttcag

SEQ ID NO: 834567 - DNA, 22 bp, Artificial Sequence
  chemically synthesized
cttaatattattctaatttttt

SEQ ID NO: 834568 - DNA, 22 bp, Artificial Sequence
  chemically synthesized
cagctatcctgaaaaaattaga

SEQ ID NO: 834569 - DNA, 22 bp, Artificial Sequence
  chemically synthesized
agctatcctgaaaaaattagaa

SEQ ID NO: 834570 - DNA, 22 bp, Artificial Sequence
  chemically synthesized
tcctgaaaaaattagaataata

SEQ ID NO: 834571 - DNA, 22 bp, Artificial Sequence
  chemically synthesized
aaaaaattagaataatattaag

SEQ ID NO: 834572 - DNA, 22 bp, Artificial Sequence
  chemically synthesized
gaataatattaagtaggtatat

SEQ ID NO: 834573 - DNA, 22 bp, Artificial Sequence
  chemically synthesized
aaaggcaatgtgcaaatatacc

SEQ ID NO: 834574 - DNA, 22 bp, Artificial Sequence
  chemically synthesized
caaaggcaatgtgcaaatatac

SEQ ID NO: 834575 - DNA, 22 bp, Artificial Sequence
  chemically synthesized
gtgtttcaaaggcaatgtgcaa

SEQ ID NO: 834576 - DNA, 22 bp, Artificial Sequence
  chemically synthesized
agtaggtatatttgcacattgc

SEQ ID NO: 834577 - DNA, 22 bp, Artificial Sequence
  chemically synthesized
tggtgtttcaaaggcaatgtgc

SEQ ID NO: 834578 - DNA, 22 bp, Artificial Sequence
  chemically synthesized
aaatagagctctggtgtttcaa

SEQ ID NO: 834579 - DNA, 22 bp, Artificial Sequence
  chemically synthesized
gcacattgcctttgaaacacca

SEQ ID NO: 834580 - DNA, 22 bp, Artificial Sequence
  chemically synthesized
aaaatagagctctggtgtttca

SEQ ID NO: 834581 - DNA, 22 bp, Artificial Sequence
  chemically synthesized
cacattgcctttgaaacaccag

SEQ ID NO: 834582 - DNA, 22 bp, Artificial Sequence
  chemically synthesized
taaaatagagctctggtgtttc

SEQ ID NO: 834583 - DNA, 22 bp, Artificial Sequence
  chemically synthesized
ttaaaatagagctctggtgttt

SEQ ID NO: 834584 - DNA, 22 bp, Artificial Sequence
  chemically synthesized
cctttgaaacaccagagctcta

SEQ ID NO: 834585 - DNA, 22 bp, Artificial Sequence
  chemically synthesized
agtacatttttaaaatagagct

SEQ ID NO: 834586 - DNA, 22 bp, Artificial Sequence
  chemically synthesized
tgaaacaccagagctctatttt

SEQ ID NO: 834587 - DNA, 22 bp, Artificial Sequence
  chemically synthesized
gaaacaccagagctctatttta

SEQ ID NO: 834588 - DNA, 22 bp, Artificial Sequence
  chemically synthesized
aaacaccagagctctattttaa

SEQ ID NO: 834589 - DNA, 22 bp, Artificial Sequence
  chemically synthesized
gggtagaaaaaaattaagtaca

SEQ ID NO: 834590 - DNA, 22 bp, Artificial Sequence
  chemically synthesized
tattttaaaaatgtacttaatt

SEQ ID NO: 834591 - DNA, 22 bp, Artificial Sequence
  chemically synthesized
agggtagaaaaaaattaagtac

SEQ ID NO: 834592 - DNA, 22 bp, Artificial Sequence
  chemically synthesized
ttttaaaaatgtacttaatttt

SEQ ID NO: 834593 - DNA, 22 bp, Artificial Sequence
  chemically synthesized
taaaaatgtacttaattttttt

SEQ ID NO: 834594 - DNA, 22 bp, Artificial Sequence
  chemically synthesized
aaaaatgtacttaatttttttc

SEQ ID NO: 834595 - DNA, 22 bp, Artificial Sequence
  chemically synthesized
aaaatgtacttaatttttttct

SEQ ID NO: 834596 - DNA, 22 bp, Artificial Sequence
  chemically synthesized
agtaagtttagggtagaaaaaa

SEQ ID NO: 834597 - DNA, 22 bp, Artificial Sequence
  chemically synthesized
attcagtaagtttagggtagaa

SEQ ID NO: 834598 - DNA, 22 bp, Artificial Sequence
  chemically synthesized
tgattcagtaagtttagggtag

SEQ ID NO: 834599 - DNA, 22 bp, Artificial Sequence
  chemically synthesized
aatttttttctaccctaaactt

SEQ ID NO: 834600 - DNA, 22 bp, Artificial Sequence
  chemically synthesized
atttttttctaccctaaactta

SEQ ID NO: 834601 - DNA, 22 bp, Artificial Sequence
  chemically synthesized
ttttctaccctaaacttactga

SEQ ID NO: 834602 - DNA, 22 bp, Artificial Sequence
  chemically synthesized
tttctaccctaaacttactgaa

SEQ ID NO: 834603 - DNA, 22 bp, Artificial Sequence
  chemically synthesized
ttctaccctaaacttactgaat

SEQ ID NO: 834604 - DNA, 22 bp, Artificial Sequence
  chemically synthesized
tctaccctaaacttactgaatc

SEQ ID NO: 834605 - DNA, 22 bp, Artificial Sequence
  chemically synthesized
ctaccctaaacttactgaatca

SEQ ID NO: 834606 - DNA, 22 bp, Artificial Sequence
  chemically synthesized
taccctaaacttactgaatcag

SEQ ID NO: 834607 - DNA, 22 bp, Artificial Sequence
  chemically synthesized
ccctaaacttactgaatcagag

SEQ ID NO: 834608 - DNA, 22 bp, Artificial Sequence
  chemically synthesized
aagagccaaaagactctgattc

SEQ ID NO: 834609 - DNA, 22 bp, Artificial Sequence
  chemically synthesized
aacttactgaatcagagtcttt

SEQ ID NO: 834610 - DNA, 22 bp, Artificial Sequence
  chemically synthesized
actgaatcagagtcttttggct

SEQ ID NO: 834611 - DNA, 22 bp, Artificial Sequence
  chemically synthesized
ctgaatcagagtcttttggctc

SEQ ID NO: 834612 - DNA, 22 bp, Artificial Sequence
  chemically synthesized
aatcagagtcttttggctcttg

SEQ ID NO: 834613 - DNA, 22 bp, Artificial Sequence
  chemically synthesized
agaatgcatgcaatagttcaag

SEQ ID NO: 834614 - DNA, 22 bp, Artificial Sequence
  chemically synthesized
ttgagaatgcatgcaatagttc

SEQ ID NO: 834615 - DNA, 22 bp, Artificial Sequence
  chemically synthesized
ttggctcttgaactattgcatg

SEQ ID NO: 834616 - DNA, 22 bp, Artificial Sequence
  chemically synthesized
tggctcttgaactattgcatgc

SEQ ID NO: 834617 - DNA, 22 bp, Artificial Sequence
  chemically synthesized
tctgttgagaatgcatgcaata

SEQ ID NO: 834618 - DNA, 22 bp, Artificial Sequence
  chemically synthesized
ggctcttgaactattgcatgca

SEQ ID NO: 834619 - DNA, 22 bp, Artificial Sequence
  chemically synthesized
gctcttgaactattgcatgcat

SEQ ID NO: 834620 - DNA, 22 bp, Artificial Sequence
  chemically synthesized
ttgaactattgcatgcattctc

SEQ ID NO: 834621 - DNA, 22 bp, Artificial Sequence
  chemically synthesized
gaactattgcatgcattctcaa

SEQ ID NO: 834622 - DNA, 22 bp, Artificial Sequence
  chemically synthesized
aactattgcatgcattctcaac

SEQ ID NO: 834623 - DNA, 22 bp, Artificial Sequence
  chemically synthesized
gggtgtcattatctgttgagaa

SEQ ID NO: 834624 - DNA, 22 bp, Artificial Sequence
  chemically synthesized
ggggtgtcattatctgttgaga

SEQ ID NO: 834625 - DNA, 22 bp, Artificial Sequence
  chemically synthesized
ttgcatgcattctcaacagata

SEQ ID NO: 834626 - DNA, 22 bp, Artificial Sequence
  chemically synthesized
ccttggggtgtcattatctgtt

SEQ ID NO: 834627 - DNA, 22 bp, Artificial Sequence
  chemically synthesized
catgcattctcaacagataatg

SEQ ID NO: 834628 - DNA, 22 bp, Artificial Sequence
  chemically synthesized
actcccttggggtgtcattatc

SEQ ID NO: 834629 - DNA, 22 bp, Artificial Sequence
  chemically synthesized
cactcccttggggtgtcattat

SEQ ID NO: 834630 - DNA, 22 bp, Artificial Sequence
  chemically synthesized
tcactcccttggggtgtcatta

SEQ ID NO: 834631 - DNA, 22 bp, Artificial Sequence
  chemically synthesized
tcaacagataatgacaccccaa

SEQ ID NO: 834632 - DNA, 22 bp, Artificial Sequence
  chemically synthesized
aacagataatgacaccccaagg

SEQ ID NO: 834633 - DNA, 22 bp, Artificial Sequence
  chemically synthesized
aagaacaaattttcactccctt

SEQ ID NO: 834634 - DNA, 22 bp, Artificial Sequence
  chemically synthesized
tcaagaacaaattttcactccc

SEQ ID NO: 834635 - DNA, 22 bp, Artificial Sequence
  chemically synthesized
tctctcaagaacaaattttcac

SEQ ID NO: 834636 - DNA, 22 bp, Artificial Sequence
  chemically synthesized
atctctcaagaacaaattttca

SEQ ID NO: 834637 - DNA, 22 bp, Artificial Sequence
  chemically synthesized
tatctctcaagaacaaattttc

SEQ ID NO: 834638 - DNA, 22 bp, Artificial Sequence
  chemically synthesized
ttatctctcaagaacaaatttt

SEQ ID NO: 834639 - DNA, 22 bp, Artificial Sequence
  chemically synthesized
agaatttttatctctcaagaac

SEQ ID NO: 834640 - DNA, 22 bp, Artificial Sequence
  chemically synthesized
agaaatagctaagaatttttat

SEQ ID NO: 834641 - DNA, 22 bp, Artificial Sequence
  chemically synthesized
gttcttgagagataaaaattct

SEQ ID NO: 834642 - DNA, 22 bp, Artificial Sequence
  chemically synthesized
ttcttgagagataaaaattctt

SEQ ID NO: 834643 - DNA, 22 bp, Artificial Sequence
  chemically synthesized
ttgagagataaaaattcttagc

SEQ ID NO: 834644 - DNA, 22 bp, Artificial Sequence
  chemically synthesized
tgactcagaaatagctaagaat

SEQ ID NO: 834645 - DNA, 22 bp, Artificial Sequence
  chemically synthesized
gagagataaaaattcttagcta

SEQ ID NO: 834646 - DNA, 22 bp, Artificial Sequence
  chemically synthesized
agagataaaaattcttagctat

SEQ ID NO: 834647 - DNA, 22 bp, Artificial Sequence
  chemically synthesized
ttagctatttctgagtcacaat

SEQ ID NO: 834648 - DNA, 22 bp, Artificial Sequence
  chemically synthesized
agctatttctgagtcacaatgg

SEQ ID NO: 834649 - DNA, 22 bp, Artificial Sequence
  chemically synthesized
gctatttctgagtcacaatggt

SEQ ID NO: 834650 - DNA, 22 bp, Artificial Sequence
  chemically synthesized
agagggtaataaaccattgtga

SEQ ID NO: 834651 - DNA, 22 bp, Artificial Sequence
  chemically synthesized
cagagggtaataaaccattgtg

SEQ ID NO: 834652 - DNA, 22 bp, Artificial Sequence
  chemically synthesized
tcagagggtaataaaccattgt

SEQ ID NO: 834653 - DNA, 22 bp, Artificial Sequence
  chemically synthesized
tttctgagtcacaatggtttat

SEQ ID NO: 834654 - DNA, 22 bp, Artificial Sequence
  chemically synthesized
ctgagtcacaatggtttattac

SEQ ID NO: 834655 - DNA, 22 bp, Artificial Sequence
  chemically synthesized
tgagtcacaatggtttattacc

SEQ ID NO: 834656 - DNA, 22 bp, Artificial Sequence
  chemically synthesized
tggctttcagagggtaataaac

SEQ ID NO: 834657 - DNA, 22 bp, Artificial Sequence
  chemically synthesized
agtcacaatggtttattaccct

SEQ ID NO: 834658 - DNA, 22 bp, Artificial Sequence
  chemically synthesized
cccgtatattgtggctttcaga

SEQ ID NO: 834659 - DNA, 22 bp, Artificial Sequence
  chemically synthesized
attaccctctgaaagccacaat

SEQ ID NO: 834660 - DNA, 22 bp, Artificial Sequence
  chemically synthesized
ttaccctctgaaagccacaata

SEQ ID NO: 834661 - DNA, 22 bp, Artificial Sequence
  chemically synthesized
gatctgcccgtatattgtggct

SEQ ID NO: 834662 - DNA, 22 bp, Artificial Sequence
  chemically synthesized
agatctgcccgtatattgtggc

SEQ ID NO: 834663 - DNA, 22 bp, Artificial Sequence
  chemically synthesized
tagatctgcccgtatattgtgg

SEQ ID NO: 834664 - DNA, 22 bp, Artificial Sequence
  chemically synthesized
ccctctgaaagccacaatatac

SEQ ID NO: 834665 - DNA, 22 bp, Artificial Sequence
  chemically synthesized
tgaaagccacaatatacgggca

SEQ ID NO: 834666 - DNA, 22 bp, Artificial Sequence
  chemically synthesized
aaagccacaatatacgggcaga

SEQ ID NO: 834667 - DNA, 22 bp, Artificial Sequence
  chemically synthesized
ataccacagacatgctttagat

SEQ ID NO: 834668 - DNA, 22 bp, Artificial Sequence
  chemically synthesized
aataccacagacatgctttaga

SEQ ID NO: 834669 - DNA, 22 bp, Artificial Sequence
  chemically synthesized
taataccacagacatgctttag

SEQ ID NO: 834670 - DNA, 22 bp, Artificial Sequence
  chemically synthesized
aagcatgtctgtggtattaaaa

SEQ ID NO: 834671 - DNA, 22 bp, Artificial Sequence
  chemically synthesized
tatccatccgtgttttaatacc

SEQ ID NO: 834672 - DNA, 22 bp, Artificial Sequence
  chemically synthesized
atatccatccgtgttttaatac

SEQ ID NO: 834673 - DNA, 22 bp, Artificial Sequence
  chemically synthesized
tatatccatccgtgttttaata

SEQ ID NO: 834674 - DNA, 22 bp, Artificial Sequence
  chemically synthesized
ttatatccatccgtgttttaat

SEQ ID NO: 834675 - DNA, 22 bp, Artificial Sequence
  chemically synthesized
cttttatatccatccgtgtttt

SEQ ID NO: 834676 - DNA, 22 bp, Artificial Sequence
  chemically synthesized
ccttttatatccatccgtgttt

SEQ ID NO: 834677 - DNA, 22 bp, Artificial Sequence
  chemically synthesized
tccttttatatccatccgtgtt

SEQ ID NO: 834678 - DNA, 22 bp, Artificial Sequence
  chemically synthesized
ttccttttatatccatccgtgt

SEQ ID NO: 834679 - DNA, 22 bp, Artificial Sequence
  chemically synthesized
tttccttttatatccatccgtg

SEQ ID NO: 834680 - DNA, 22 bp, Artificial Sequence
  chemically synthesized
tggtattaaaacacggatggat

SEQ ID NO: 834681 - DNA, 22 bp, Artificial Sequence
  chemically synthesized
ttttccttttatatccatccgt

SEQ ID NO: 834682 - DNA, 22 bp, Artificial Sequence
  chemically synthesized
atttttttccttttatatccat

SEQ ID NO: 834683 - DNA, 22 bp, Artificial Sequence
  chemically synthesized
gatttttttccttttatatcca

SEQ ID NO: 834684 - DNA, 22 bp, Artificial Sequence
  chemically synthesized
aaacacggatggatataaaagg

SEQ ID NO: 834685 - DNA, 22 bp, Artificial Sequence
  chemically synthesized
aggtgaacttgatttttttcct

SEQ ID NO: 834686 - DNA, 22 bp, Artificial Sequence
  chemically synthesized
atgaaattgaggtgaacttgat

SEQ ID NO: 834687 - DNA, 22 bp, Artificial Sequence
  chemically synthesized
tcactcatgaaattgaggtgaa

SEQ ID NO: 834688 - DNA, 22 bp, Artificial Sequence
  chemically synthesized
cagttatcactcatgaaattga

SEQ ID NO: 834689 - DNA, 22 bp, Artificial Sequence
  chemically synthesized
gcagttatcactcatgaaattg

SEQ ID NO: 834690 - DNA, 22 bp, Artificial Sequence
  chemically synthesized
acctcaatttcatgagtgataa

SEQ ID NO: 834691 - DNA, 22 bp, Artificial Sequence
  chemically synthesized
aatttcatgagtgataactgca

SEQ ID NO: 834692 - DNA, 22 bp, Artificial Sequence
  chemically synthesized
catgagtgataactgcaaacca

SEQ ID NO: 834693 - DNA, 22 bp, Artificial Sequence
  chemically synthesized
atgagtgataactgcaaaccac

SEQ ID NO: 834694 - DNA, 22 bp, Artificial Sequence
  chemically synthesized
gaaggaaatacatcaaagtggt

SEQ ID NO: 834695 - DNA, 22 bp, Artificial Sequence
  chemically synthesized
taactggaaggaaatacatcaa

SEQ ID NO: 834696 - DNA, 22 bp, Artificial Sequence
  chemically synthesized
caaaccactttgatgtatttcc

SEQ ID NO: 834697 - DNA, 22 bp, Artificial Sequence
  chemically synthesized
tgatgtatttccttccagttat

SEQ ID NO: 834698 - DNA, 22 bp, Artificial Sequence
  chemically synthesized
gatgtatttccttccagttata

SEQ ID NO: 834699 - DNA, 22 bp, Artificial Sequence
  chemically synthesized
atgtatttccttccagttataa

SEQ ID NO: 834700 - DNA, 22 bp, Artificial Sequence
  chemically synthesized
ccttccagttataatttctttt

SEQ ID NO: 834701 - DNA, 22 bp, Artificial Sequence
  chemically synthesized
cttccagttataatttcttttg

SEQ ID NO: 834702 - DNA, 22 bp, Artificial Sequence
  chemically synthesized
ccagttataatttcttttgctg

SEQ ID NO: 834703 - DNA, 22 bp, Artificial Sequence
  chemically synthesized
cagttataatttcttttgctgg

SEQ ID NO: 834704 - DNA, 22 bp, Artificial Sequence
  chemically synthesized
taaaaaacagagaaaaccagca

SEQ ID NO: 834705 - DNA, 22 bp, Artificial Sequence
  chemically synthesized
gtaaaaaacagagaaaaccagc

SEQ ID NO: 834706 - DNA, 22 bp, Artificial Sequence
  chemically synthesized
taatttcttttgctggttttct

SEQ ID NO: 834707 - DNA, 22 bp, Artificial Sequence
  chemically synthesized
tgtaaaaaacagagaaaaccag

SEQ ID NO: 834708 - DNA, 22 bp, Artificial Sequence
  chemically synthesized
attttgtaaaaaacagagaaaa

SEQ ID NO: 834709 - DNA, 22 bp, Artificial Sequence
  chemically synthesized
cttttgctggttttctctgttt

SEQ ID NO: 834710 - DNA, 22 bp, Artificial Sequence
  chemically synthesized
ttttgctggttttctctgtttt

SEQ ID NO: 834711 - DNA, 22 bp, Artificial Sequence
  chemically synthesized
ttgctggttttctctgtttttt

SEQ ID NO: 834712 - DNA, 22 bp, Artificial Sequence
  chemically synthesized
tgctggttttctctgtttttta

SEQ ID NO: 834713 - DNA, 22 bp, Artificial Sequence
  chemically synthesized
gctggttttctctgttttttac

SEQ ID NO: 834714 - DNA, 22 bp, Artificial Sequence
  chemically synthesized
ctggttttctctgttttttaca

SEQ ID NO: 834715 - DNA, 22 bp, Artificial Sequence
  chemically synthesized
gttttctctgttttttacaaaa

SEQ ID NO: 834716 - DNA, 22 bp, Artificial Sequence
  chemically synthesized
tctctgttttttacaaaattag

SEQ ID NO: 834717 - DNA, 22 bp, Artificial Sequence
  chemically synthesized
tgccataggatcctaattttgt

SEQ ID NO: 834718 - DNA, 22 bp, Artificial Sequence
  chemically synthesized
ctctgttttttacaaaattagg

SEQ ID NO: 834719 - DNA, 22 bp, Artificial Sequence
  chemically synthesized
atgccataggatcctaattttg

SEQ ID NO: 834720 - DNA, 22 bp, Artificial Sequence
  chemically synthesized
tctgttttttacaaaattagga

SEQ ID NO: 834721 - DNA, 22 bp, Artificial Sequence
  chemically synthesized
tgttttttacaaaattaggatc

SEQ ID NO: 834722 - DNA, 22 bp, Artificial Sequence
  chemically synthesized
tttatgccataggatcctaatt

SEQ ID NO: 834723 - DNA, 22 bp, Artificial Sequence
  chemically synthesized
ttttttacaaaattaggatcct

SEQ ID NO: 834724 - DNA, 22 bp, Artificial Sequence
  chemically synthesized
tttacaaaattaggatcctatg

SEQ ID NO: 834725 - DNA, 22 bp, Artificial Sequence
  chemically synthesized
ttacaaaattaggatcctatgg

SEQ ID NO: 834726 - DNA, 22 bp, Artificial Sequence
  chemically synthesized
tacaaaattaggatcctatggc

SEQ ID NO: 834727 - DNA, 22 bp, Artificial Sequence
  chemically synthesized
acaaaattaggatcctatggca

SEQ ID NO: 834728 - DNA, 22 bp, Artificial Sequence
  chemically synthesized
caaaattaggatcctatggcat

SEQ ID NO: 834729 - DNA, 22 bp, Artificial Sequence
  chemically synthesized
ggatcctatggcataaataatt

SEQ ID NO: 834730 - DNA, 22 bp, Artificial Sequence
  chemically synthesized
tggcataaataattccatatcc

SEQ ID NO: 834731 - DNA, 22 bp, Artificial Sequence
  chemically synthesized
aggaaaaaaagtaggatatgga

SEQ ID NO: 834732 - DNA, 22 bp, Artificial Sequence
  chemically synthesized
atgctcaggaaaaaaagtagga

SEQ ID NO: 834733 - DNA, 22 bp, Artificial Sequence
  chemically synthesized
catatcctactttttttcctga

SEQ ID NO: 834734 - DNA, 22 bp, Artificial Sequence
  chemically synthesized
caacattaatgctcaggaaaaa

SEQ ID NO: 834735 - DNA, 22 bp, Artificial Sequence
  chemically synthesized
ttacaacattaatgctcaggaa

SEQ ID NO: 834736 - DNA, 22 bp, Artificial Sequence
  chemically synthesized
ctttttttcctgagcattaatg

SEQ ID NO: 834737 - DNA, 22 bp, Artificial Sequence
  chemically synthesized
tttttcctgagcattaatgttg

SEQ ID NO: 834738 - DNA, 22 bp, Artificial Sequence
  chemically synthesized
ttttcctgagcattaatgttgt

SEQ ID NO: 834739 - DNA, 22 bp, Artificial Sequence
  chemically synthesized
tttcctgagcattaatgttgta

SEQ ID NO: 834740 - DNA, 22 bp, Artificial Sequence
  chemically synthesized
ttcctgagcattaatgttgtaa

SEQ ID NO: 834741 - DNA, 22 bp, Artificial Sequence
  chemically synthesized
tcctgagcattaatgttgtaat

SEQ ID NO: 834742 - DNA, 22 bp, Artificial Sequence
  chemically synthesized
cctgagcattaatgttgtaata

SEQ ID NO: 834743 - DNA, 22 bp, Artificial Sequence
  chemically synthesized
ctgagcattaatgttgtaataa

SEQ ID NO: 834744 - DNA, 22 bp, Artificial Sequence
  chemically synthesized
atgatatagggaattattacaa

SEQ ID NO: 834745 - DNA, 22 bp, Artificial Sequence
  chemically synthesized
aatgatatagggaattattaca

SEQ ID NO: 834746 - DNA, 22 bp, Artificial Sequence
  chemically synthesized
agcattaatgttgtaataattc

SEQ ID NO: 834747 - DNA, 22 bp, Artificial Sequence
  chemically synthesized
atgttgtaataattccctatat

SEQ ID NO: 834748 - DNA, 22 bp, Artificial Sequence
  chemically synthesized
aaatagtatttaatgatatagg

SEQ ID NO: 834749 - DNA, 22 bp, Artificial Sequence
  chemically synthesized
caaatagtatttaatgatatag

SEQ ID NO: 834750 - DNA, 22 bp, Artificial Sequence
  chemically synthesized
taataattccctatatcattaa

SEQ ID NO: 834751 - DNA, 22 bp, Artificial Sequence
  chemically synthesized
cctatatcattaaatactattt

SEQ ID NO: 834752 - DNA, 22 bp, Artificial Sequence
  chemically synthesized
atggaagtagtttcaaatagta

SEQ ID NO: 834753 - DNA, 22 bp, Artificial Sequence
  chemically synthesized
aatggaagtagtttcaaatagt

SEQ ID NO: 834754 - DNA, 22 bp, Artificial Sequence
  chemically synthesized
tatcattaaatactatttgaaa

SEQ ID NO: 834755 - DNA, 22 bp, Artificial Sequence
  chemically synthesized
aaatgtttaatggaagtagttt

SEQ ID NO: 834756 - DNA, 22 bp, Artificial Sequence
  chemically synthesized
aatactatttgaaactacttcc

SEQ ID NO: 834757 - DNA, 22 bp, Artificial Sequence
  chemically synthesized
aatattaaaatgtttaatggaa

SEQ ID NO: 834758 - DNA, 22 bp, Artificial Sequence
  chemically synthesized
tttgaaactacttccattaaac

SEQ ID NO: 834759 - DNA, 22 bp, Artificial Sequence
  chemically synthesized
gaaactacttccattaaacatt

SEQ ID NO: 834760 - DNA, 22 bp, Artificial Sequence
  chemically synthesized
aaactacttccattaaacattt

SEQ ID NO: 834761 - DNA, 22 bp, Artificial Sequence
  chemically synthesized
ccactgaatattaaaatgttta

SEQ ID NO: 834762 - DNA, 22 bp, Artificial Sequence
  chemically synthesized
accactgaatattaaaatgttt

SEQ ID NO: 834763 - DNA, 22 bp, Artificial Sequence
  chemically synthesized
cttccattaaacattttaatat

SEQ ID NO: 834764 - DNA, 22 bp, Artificial Sequence
  chemically synthesized
tacttaccactgaatattaaaa

SEQ ID NO: 834765 - DNA, 22 bp, Artificial Sequence
  chemically synthesized
atacttaccactgaatattaaa

SEQ ID NO: 834766 - DNA, 22 bp, Artificial Sequence
  chemically synthesized
ccattaaacattttaatattca

SEQ ID NO: 834767 - DNA, 22 bp, Artificial Sequence
  chemically synthesized
cattaaacattttaatattcag

SEQ ID NO: 834768 - DNA, 22 bp, Artificial Sequence
  chemically synthesized
atttatacttaccactgaatat

SEQ ID NO: 834769 - DNA, 22 bp, Artificial Sequence
  chemically synthesized
aacattttaatattcagtggta

SEQ ID NO: 834770 - DNA, 22 bp, Artificial Sequence
  chemically synthesized
tagattgatttatacttaccac

SEQ ID NO: 834771 - DNA, 22 bp, Artificial Sequence
  chemically synthesized
taatattcagtggtaagtataa

SEQ ID NO: 834772 - DNA, 22 bp, Artificial Sequence
  chemically synthesized
ttatagattgatttatacttac

SEQ ID NO: 834773 - DNA, 22 bp, Artificial Sequence
  chemically synthesized
aatattcagtggtaagtataaa

SEQ ID NO: 834774 - DNA, 22 bp, Artificial Sequence
  chemically synthesized
attatagattgatttatactta

SEQ ID NO: 834775 - DNA, 22 bp, Artificial Sequence
  chemically synthesized
atattcagtggtaagtataaat

SEQ ID NO: 834776 - DNA, 22 bp, Artificial Sequence
  chemically synthesized
agtggtaagtataaatcaatct

SEQ ID NO: 834777 - DNA, 22 bp, Artificial Sequence
  chemically synthesized
gagaaagtttattatagattga

SEQ ID NO: 834778 - DNA, 22 bp, Artificial Sequence
  chemically synthesized
ggagaaagtttattatagattg

SEQ ID NO: 834779 - DNA, 22 bp, Artificial Sequence
  chemically synthesized
tggagaaagtttattatagatt

SEQ ID NO: 834780 - DNA, 22 bp, Artificial Sequence
  chemically synthesized
ttggagaaagtttattatagat

SEQ ID NO: 834781 - DNA, 22 bp, Artificial Sequence
  chemically synthesized
atttttggagaaagtttattat

SEQ ID NO: 834782 - DNA, 22 bp, Artificial Sequence
  chemically synthesized
aaacattaatttttggagaaag

SEQ ID NO: 834783 - DNA, 22 bp, Artificial Sequence
  chemically synthesized
ttaaaacattaatttttggaga

SEQ ID NO: 834784 - DNA, 22 bp, Artificial Sequence
  chemically synthesized
taataaactttctccaaaaatt

SEQ ID NO: 834785 - DNA, 22 bp, Artificial Sequence
  chemically synthesized
atactattaaaacattaatttt

SEQ ID NO: 834786 - DNA, 22 bp, Artificial Sequence
  chemically synthesized
tctccaaaaattaatgttttaa

SEQ ID NO: 834787 - DNA, 22 bp, Artificial Sequence
  chemically synthesized
ctccaaaaattaatgttttaat

SEQ ID NO: 834788 - DNA, 22 bp, Artificial Sequence
  chemically synthesized
tccaaaaattaatgttttaata

SEQ ID NO: 834789 - DNA, 22 bp, Artificial Sequence
  chemically synthesized
taatactaatactattaaaaca

SEQ ID NO: 834790 - DNA, 22 bp, Artificial Sequence
  chemically synthesized
ataatactaatactattaaaac

SEQ ID NO: 834791 - DNA, 22 bp, Artificial Sequence
  chemically synthesized
caaaaattaatgttttaatagt

SEQ ID NO: 834792 - DNA, 22 bp, Artificial Sequence
  chemically synthesized
tataatactaatactattaaaa

SEQ ID NO: 834793 - DNA, 22 bp, Artificial Sequence
  chemically synthesized
atgttttaatagtattagtatt

SEQ ID NO: 834794 - DNA, 22 bp, Artificial Sequence
  chemically synthesized
aaatgcattttataatactaat

SEQ ID NO: 834795 - DNA, 22 bp, Artificial Sequence
  chemically synthesized
taatagtattagtattataaaa

SEQ ID NO: 834796 - DNA, 22 bp, Artificial Sequence
  chemically synthesized
aatagtattagtattataaaat

SEQ ID NO: 834797 - DNA, 22 bp, Artificial Sequence
  chemically synthesized
atagtattagtattataaaatg

SEQ ID NO: 834798 - DNA, 22 bp, Artificial Sequence
  chemically synthesized
ataatctaaaatgcattttata

SEQ ID NO: 834799 - DNA, 22 bp, Artificial Sequence
  chemically synthesized
gtattataaaatgcattttaga

SEQ ID NO: 834800 - DNA, 22 bp, Artificial Sequence
  chemically synthesized
gaaagtgattaataatctaaaa

SEQ ID NO: 834801 - DNA, 22 bp, Artificial Sequence
  chemically synthesized
taaaatgcattttagattatta

SEQ ID NO: 834802 - DNA, 22 bp, Artificial Sequence
  chemically synthesized
tcactggaaagtgattaataat

SEQ ID NO: 834803 - DNA, 22 bp, Artificial Sequence
  chemically synthesized
atcactggaaagtgattaataa

SEQ ID NO: 834804 - DNA, 22 bp, Artificial Sequence
  chemically synthesized
tttatcactggaaagtgattaa

SEQ ID NO: 834805 - DNA, 22 bp, Artificial Sequence
  chemically synthesized
gttatttatcactggaaagtga

SEQ ID NO: 834806 - DNA, 22 bp, Artificial Sequence
  chemically synthesized
tagattattaatcactttccag

SEQ ID NO: 834807 - DNA, 22 bp, Artificial Sequence
  chemically synthesized
ggttatttatcactggaaagtg

SEQ ID NO: 834808 - DNA, 22 bp, Artificial Sequence
  chemically synthesized
agattattaatcactttccagt

SEQ ID NO: 834809 - DNA, 22 bp, Artificial Sequence
  chemically synthesized
gattattaatcactttccagtg

SEQ ID NO: 834810 - DNA, 22 bp, Artificial Sequence
  chemically synthesized
taatttggttatttatcactgg

SEQ ID NO: 834811 - DNA, 22 bp, Artificial Sequence
  chemically synthesized
ttaatcactttccagtgataaa

SEQ ID NO: 834812 - DNA, 22 bp, Artificial Sequence
  chemically synthesized
atcactttccagtgataaataa

SEQ ID NO: 834813 - DNA, 22 bp, Artificial Sequence
  chemically synthesized
agattgtaatttggttatttat

SEQ ID NO: 834814 - DNA, 22 bp, Artificial Sequence
  chemically synthesized
aagattgtaatttggttattta

SEQ ID NO: 834815 - DNA, 22 bp, Artificial Sequence
  chemically synthesized
tccagtgataaataaccaaatt

SEQ ID NO: 834816 - DNA, 22 bp, Artificial Sequence
  chemically synthesized
ccagtgataaataaccaaatta

SEQ ID NO: 834817 - DNA, 22 bp, Artificial Sequence
  chemically synthesized
cagtgataaataaccaaattac

SEQ ID NO: 834818 - DNA, 22 bp, Artificial Sequence
  chemically synthesized
tcatttaagattgtaatttggt

SEQ ID NO: 834819 - DNA, 22 bp, Artificial Sequence
  chemically synthesized
gtgtctatcatttaagattgta

SEQ ID NO: 834820 - DNA, 22 bp, Artificial Sequence
  chemically synthesized
agtgtctatcatttaagattgt

SEQ ID NO: 834821 - DNA, 22 bp, Artificial Sequence
  chemically synthesized
tagtgtctatcatttaagattg

SEQ ID NO: 834822 - DNA, 22 bp, Artificial Sequence
  chemically synthesized
aacactttagtgtctatcattt

SEQ ID NO: 834823 - DNA, 22 bp, Artificial Sequence
  chemically synthesized
caatcttaaatgatagacacta

SEQ ID NO: 834824 - DNA, 22 bp, Artificial Sequence
  chemically synthesized
gtcactaaacactttagtgtct

SEQ ID NO: 834825 - DNA, 22 bp, Artificial Sequence
  chemically synthesized
ggtcactaaacactttagtgtc

SEQ ID NO: 834826 - DNA, 22 bp, Artificial Sequence
  chemically synthesized
aaatgatagacactaaagtgtt

SEQ ID NO: 834827 - DNA, 22 bp, Artificial Sequence
  chemically synthesized
aatgatagacactaaagtgttt

SEQ ID NO: 834828 - DNA, 22 bp, Artificial Sequence
  chemically synthesized
agtaagaaatttggtcactaaa

SEQ ID NO: 834829 - DNA, 22 bp, Artificial Sequence
  chemically synthesized
aagtgtttagtgaccaaatttc

SEQ ID NO: 834830 - DNA, 22 bp, Artificial Sequence
  chemically synthesized
agtgaccaaatttcttactcag

SEQ ID NO: 834831 - DNA, 22 bp, Artificial Sequence
  chemically synthesized
gtgaccaaatttcttactcagt

SEQ ID NO: 834832 - DNA, 22 bp, Artificial Sequence
  chemically synthesized
aacagggatggaaactgagtaa

SEQ ID NO: 834833 - DNA, 22 bp, Artificial Sequence
  chemically synthesized
gaacagggatggaaactgagta

SEQ ID NO: 834834 - DNA, 22 bp, Artificial Sequence
  chemically synthesized
tttgaacagggatggaaactga

SEQ ID NO: 834835 - DNA, 22 bp, Artificial Sequence
  chemically synthesized
cttactcagtttccatccctgt

SEQ ID NO: 834836 - DNA, 22 bp, Artificial Sequence
  chemically synthesized
ttactcagtttccatccctgtt

SEQ ID NO: 834837 - DNA, 22 bp, Artificial Sequence
  chemically synthesized
actcagtttccatccctgttca

SEQ ID NO: 834838 - DNA, 22 bp, Artificial Sequence
  chemically synthesized
ctcagtttccatccctgttcaa

SEQ ID NO: 834839 - DNA, 22 bp, Artificial Sequence
  chemically synthesized
agtttccatccctgttcaaaca

SEQ ID NO: 834840 - DNA, 22 bp, Artificial Sequence
  chemically synthesized
ccatccctgttcaaacaatgcc

SEQ ID NO: 834841 - DNA, 22 bp, Artificial Sequence
  chemically synthesized
catccctgttcaaacaatgcca

SEQ ID NO: 834842 - DNA, 22 bp, Artificial Sequence
  chemically synthesized
ttcaaacaatgccattttatct

SEQ ID NO: 834843 - DNA, 22 bp, Artificial Sequence
  chemically synthesized
aaacaatgccattttatcttct

SEQ ID NO: 834844 - DNA, 22 bp, Artificial Sequence
  chemically synthesized
tatcttctgctttctctctctg

SEQ ID NO: 834845 - DNA, 22 bp, Artificial Sequence
  chemically synthesized
atcttctgctttctctctctgc

SEQ ID NO: 834846 - DNA, 22 bp, Artificial Sequence
  chemically synthesized
tcttctgctttctctctctgct

SEQ ID NO: 834847 - DNA, 22 bp, Artificial Sequence
  chemically synthesized
ctgctttctctctctgctttct

SEQ ID NO: 834848 - DNA, 22 bp, Artificial Sequence
  chemically synthesized
tgctttctctctctgctttctt

SEQ ID NO: 834849 - DNA, 22 bp, Artificial Sequence
  chemically synthesized
ctttctctctctgctttctttc

SEQ ID NO: 834850 - DNA, 22 bp, Artificial Sequence
  chemically synthesized
tctctctctgctttctttcttg

SEQ ID NO: 834851 - DNA, 22 bp, Artificial Sequence
  chemically synthesized
ctctctctgctttctttcttgc

SEQ ID NO: 834852 - DNA, 22 bp, Artificial Sequence
  chemically synthesized
tctctctgctttctttcttgct

SEQ ID NO: 834853 - DNA, 22 bp, Artificial Sequence
  chemically synthesized
tctctgctttctttcttgctct

SEQ ID NO: 834854 - DNA, 22 bp, Artificial Sequence
  chemically synthesized
tctgctttctttcttgctcttg

SEQ ID NO: 834855 - DNA, 22 bp, Artificial Sequence
  chemically synthesized
aaaagaaagagagcaagagcaa

SEQ ID NO: 834856 - DNA, 22 bp, Artificial Sequence
  chemically synthesized
tgctttctttcttgctcttgct

SEQ ID NO: 834857 - DNA, 22 bp, Artificial Sequence
  chemically synthesized
tcaaaagaaagagagcaagagc

SEQ ID NO: 834858 - DNA, 22 bp, Artificial Sequence
  chemically synthesized
ctttctttcttgctcttgctct

SEQ ID NO: 834859 - DNA, 22 bp, Artificial Sequence
  chemically synthesized
ctcaaaagaaagagagcaagag

SEQ ID NO: 834860 - DNA, 22 bp, Artificial Sequence
  chemically synthesized
tctttcttgctcttgctctctt

SEQ ID NO: 834861 - DNA, 22 bp, Artificial Sequence
  chemically synthesized
ctttcttgctcttgctctcttt

SEQ ID NO: 834862 - DNA, 22 bp, Artificial Sequence
  chemically synthesized
tttcttgctcttgctctctttc

SEQ ID NO: 834863 - DNA, 22 bp, Artificial Sequence
  chemically synthesized
tcttgctcttgctctctttctt

SEQ ID NO: 834864 - DNA, 22 bp, Artificial Sequence
  chemically synthesized
cttgctcttgctctctttcttt

SEQ ID NO: 834865 - DNA, 22 bp, Artificial Sequence
  chemically synthesized
ttgctcttgctctctttctttt

SEQ ID NO: 834866 - DNA, 22 bp, Artificial Sequence
  chemically synthesized
aaaagtcttctcaaaagaaaga

SEQ ID NO: 834867 - DNA, 22 bp, Artificial Sequence
  chemically synthesized
caaaagtcttctcaaaagaaag

SEQ ID NO: 834868 - DNA, 22 bp, Artificial Sequence
  chemically synthesized
gctcttgctctctttcttttga

SEQ ID NO: 834869 - DNA, 22 bp, Artificial Sequence
  chemically synthesized
ctcttgctctctttcttttgag

SEQ ID NO: 834870 - DNA, 22 bp, Artificial Sequence
  chemically synthesized
atttcaaaagtcttctcaaaag

SEQ ID NO: 834871 - DNA, 22 bp, Artificial Sequence
  chemically synthesized
ttgctctctttcttttgagaag

SEQ ID NO: 834872 - DNA, 22 bp, Artificial Sequence
  chemically synthesized
gatttcaaaagtcttctcaaaa

SEQ ID NO: 834873 - DNA, 22 bp, Artificial Sequence
  chemically synthesized
gctctctttcttttgagaagac

SEQ ID NO: 834874 - DNA, 22 bp, Artificial Sequence
  chemically synthesized
ctctctttcttttgagaagact

SEQ ID NO: 834875 - DNA, 22 bp, Artificial Sequence
  chemically synthesized
tctttcttttgagaagactttt

SEQ ID NO: 834876 - DNA, 22 bp, Artificial Sequence
  chemically synthesized
tttcttttgagaagacttttga

SEQ ID NO: 834877 - DNA, 22 bp, Artificial Sequence
  chemically synthesized
gaaagtttgatttcaaaagtct

SEQ ID NO: 834878 - DNA, 22 bp, Artificial Sequence
  chemically synthesized
tcttttgagaagacttttgaaa

SEQ ID NO: 834879 - DNA, 22 bp, Artificial Sequence
  chemically synthesized
tagaaagtttgatttcaaaagt

SEQ ID NO: 834880 - DNA, 22 bp, Artificial Sequence
  chemically synthesized
cttttgagaagacttttgaaat

SEQ ID NO: 834881 - DNA, 22 bp, Artificial Sequence
  chemically synthesized
ttttgagaagacttttgaaatc

SEQ ID NO: 834882 - DNA, 22 bp, Artificial Sequence
  chemically synthesized
ttgagaagacttttgaaatcaa

SEQ ID NO: 834883 - DNA, 22 bp, Artificial Sequence
  chemically synthesized
tgagaagacttttgaaatcaaa

SEQ ID NO: 834884 - DNA, 22 bp, Artificial Sequence
  chemically synthesized
gagaagacttttgaaatcaaac

SEQ ID NO: 834885 - DNA, 22 bp, Artificial Sequence
  chemically synthesized
agaagacttttgaaatcaaact

SEQ ID NO: 834886 - DNA, 22 bp, Artificial Sequence
  chemically synthesized
atatgcagacattctagaaagt

SEQ ID NO: 834887 - DNA, 22 bp, Artificial Sequence
  chemically synthesized
ttgaaatcaaactttctagaat

SEQ ID NO: 834888 - DNA, 22 bp, Artificial Sequence
  chemically synthesized
tgaaatcaaactttctagaatg

SEQ ID NO: 834889 - DNA, 22 bp, Artificial Sequence
  chemically synthesized
gaaatcaaactttctagaatgt

SEQ ID NO: 834890 - DNA, 22 bp, Artificial Sequence
  chemically synthesized
gctcatatgcagacattctaga

SEQ ID NO: 834891 - DNA, 22 bp, Artificial Sequence
  chemically synthesized
aaatcaaactttctagaatgtc

SEQ ID NO: 834892 - DNA, 22 bp, Artificial Sequence
  chemically synthesized
tctagaatgtctgcatatgagc

SEQ ID NO: 834893 - DNA, 22 bp, Artificial Sequence
  chemically synthesized
ctagaatgtctgcatatgagct

SEQ ID NO: 834894 - DNA, 22 bp, Artificial Sequence
  chemically synthesized
tagaatgtctgcatatgagcta

SEQ ID NO: 834895 - DNA, 22 bp, Artificial Sequence
  chemically synthesized
gaatgtctgcatatgagctaga

SEQ ID NO: 834896 - DNA, 22 bp, Artificial Sequence
  chemically synthesized
caaaagtaggaatctagctcat

SEQ ID NO: 834897 - DNA, 22 bp, Artificial Sequence
  chemically synthesized
gaactgcaaaagtaggaatcta

SEQ ID NO: 834898 - DNA, 22 bp, Artificial Sequence
  chemically synthesized
agaactgcaaaagtaggaatct

SEQ ID NO: 834899 - DNA, 22 bp, Artificial Sequence
  chemically synthesized
tagaactgcaaaagtaggaatc

SEQ ID NO: 834900 - DNA, 22 bp, Artificial Sequence
  chemically synthesized
catatgagctagattcctactt

SEQ ID NO: 834901 - DNA, 22 bp, Artificial Sequence
  chemically synthesized
tttagaactgcaaaagtaggaa

SEQ ID NO: 834902 - DNA, 22 bp, Artificial Sequence
  chemically synthesized
tctttagaactgcaaaagtagg

SEQ ID NO: 834903 - DNA, 22 bp, Artificial Sequence
  chemically synthesized
ctctctttagaactgcaaaagt

SEQ ID NO: 834904 - DNA, 22 bp, Artificial Sequence
  chemically synthesized
actctctttagaactgcaaaag

SEQ ID NO: 834905 - DNA, 22 bp, Artificial Sequence
  chemically synthesized
tactctctttagaactgcaaaa

SEQ ID NO: 834906 - DNA, 22 bp, Artificial Sequence
  chemically synthesized
gattcctacttttgcagttcta

SEQ ID NO: 834907 - DNA, 22 bp, Artificial Sequence
  chemically synthesized
ctacttttgcagttctaaagag

SEQ ID NO: 834908 - DNA, 22 bp, Artificial Sequence
  chemically synthesized
cttttgcagttctaaagagagt

SEQ ID NO: 834909 - DNA, 22 bp, Artificial Sequence
  chemically synthesized
ttgcagttctaaagagagtaaa

SEQ ID NO: 834910 - DNA, 22 bp, Artificial Sequence
  chemically synthesized
tgcagttctaaagagagtaaaa

SEQ ID NO: 834911 - DNA, 22 bp, Artificial Sequence
  chemically synthesized
gcagttctaaagagagtaaaat

SEQ ID NO: 834912 - DNA, 22 bp, Artificial Sequence
  chemically synthesized
cagttctaaagagagtaaaatc

SEQ ID NO: 834913 - DNA, 22 bp, Artificial Sequence
  chemically synthesized
taaagagagtaaaatcggctgg

SEQ ID NO: 834914 - DNA, 22 bp, Artificial Sequence
  chemically synthesized
aagagagtaaaatcggctgggc

SEQ ID NO: 834915 - DNA, 22 bp, Artificial Sequence
  chemically synthesized
caggtgtgagccaccacgccca

SEQ ID NO: 834916 - DNA, 22 bp, Artificial Sequence
  chemically synthesized
ggattacaggtgtgagccacca

SEQ ID NO: 834917 - DNA, 22 bp, Artificial Sequence
  chemically synthesized
ggcgtggtggctcacacctgta

SEQ ID NO: 834918 - DNA, 22 bp, Artificial Sequence
  chemically synthesized
ccccaaagagctgggattacag

SEQ ID NO: 834919 - DNA, 22 bp, Artificial Sequence
  chemically synthesized
ttcccccaaagagctgggatta

SEQ ID NO: 834920 - DNA, 22 bp, Artificial Sequence
  chemically synthesized
gttcccccaaagagctgggatt

SEQ ID NO: 834921 - DNA, 22 bp, Artificial Sequence
  chemically synthesized
acacctgtaatcccagctcttt

SEQ ID NO: 834922 - DNA, 22 bp, Artificial Sequence
  chemically synthesized
ccttgttcccccaaagagctgg

SEQ ID NO: 834923 - DNA, 22 bp, Artificial Sequence
  chemically synthesized
tctgccttgttcccccaaagag

SEQ ID NO: 834924 - DNA, 22 bp, Artificial Sequence
  chemically synthesized
taatcccagctctttgggggaa

SEQ ID NO: 834925 - DNA, 22 bp, Artificial Sequence
  chemically synthesized
aagtgatctgtctgccttgttc

SEQ ID NO: 834926 - DNA, 22 bp, Artificial Sequence
  chemically synthesized
tttgggggaacaaggcagacag

SEQ ID NO: 834927 - DNA, 22 bp, Artificial Sequence
  chemically synthesized
aattcaagtgatctgtctgcct

SEQ ID NO: 834928 - DNA, 22 bp, Artificial Sequence
  chemically synthesized
tgggggaacaaggcagacagat

SEQ ID NO: 834929 - DNA, 22 bp, Artificial Sequence
  chemically synthesized
gggggaacaaggcagacagatc

SEQ ID NO: 834930 - DNA, 22 bp, Artificial Sequence
  chemically synthesized
ctgaattcaagtgatctgtctg

SEQ ID NO: 834931 - DNA, 22 bp, Artificial Sequence
  chemically synthesized
ggggaacaaggcagacagatca

SEQ ID NO: 834932 - DNA, 22 bp, Artificial Sequence
  chemically synthesized
aactcctgaattcaagtgatct

SEQ ID NO: 834933 - DNA, 22 bp, Artificial Sequence
  chemically synthesized
gtcctgaactcctgaattcaag

SEQ ID NO: 834934 - DNA, 22 bp, Artificial Sequence
  chemically synthesized
gtcaggctggtcctgaactcct

SEQ ID NO: 834935 - DNA, 22 bp, Artificial Sequence
  chemically synthesized
gaattcaggagttcaggaccag

SEQ ID NO: 834936 - DNA, 22 bp, Artificial Sequence
  chemically synthesized
aattcaggagttcaggaccagc

SEQ ID NO: 834937 - DNA, 22 bp, Artificial Sequence
  chemically synthesized
accatgttggtcaggctggtcc

SEQ ID NO: 834938 - DNA, 22 bp, Artificial Sequence
  chemically synthesized
caccatgttggtcaggctggtc

SEQ ID NO: 834939 - DNA, 22 bp, Artificial Sequence
  chemically synthesized
aggagttcaggaccagcctgac

SEQ ID NO: 834940 - DNA, 22 bp, Artificial Sequence
  chemically synthesized
aggaccagcctgaccaacatgg

SEQ ID NO: 834941 - DNA, 22 bp, Artificial Sequence
  chemically synthesized
gtagagatgggacttcaccatg

SEQ ID NO: 834942 - DNA, 22 bp, Artificial Sequence
  chemically synthesized
agtagagatgggacttcaccat

SEQ ID NO: 834943 - DNA, 22 bp, Artificial Sequence
  chemically synthesized
tagtagagatgggacttcacca

SEQ ID NO: 834944 - DNA, 22 bp, Artificial Sequence
  chemically synthesized
ttagtagagatgggacttcacc

SEQ ID NO: 834945 - DNA, 22 bp, Artificial Sequence
  chemically synthesized
accaacatggtgaagtcccatc

SEQ ID NO: 834946 - DNA, 22 bp, Artificial Sequence
  chemically synthesized
tatttttagtagagatgggact

SEQ ID NO: 834947 - DNA, 22 bp, Artificial Sequence
  chemically synthesized
gtatttttagtagagatgggac

SEQ ID NO: 834948 - DNA, 22 bp, Artificial Sequence
  chemically synthesized
tgtatttttagtagagatggga

SEQ ID NO: 834949 - DNA, 22 bp, Artificial Sequence
  chemically synthesized
ttgtatttttagtagagatggg

SEQ ID NO: 834950 - DNA, 22 bp, Artificial Sequence
  chemically synthesized
atttttgtatttttagtagaga

SEQ ID NO: 834951 - DNA, 22 bp, Artificial Sequence
  chemically synthesized
tactaaaaatacaaaaattagc

SEQ ID NO: 834952 - DNA, 22 bp, Artificial Sequence
  chemically synthesized
ctaaaaatacaaaaattagctg

SEQ ID NO: 834953 - DNA, 22 bp, Artificial Sequence
  chemically synthesized
aaaatacaaaaattagctgggc

SEQ ID NO: 834954 - DNA, 22 bp, Artificial Sequence
  chemically synthesized
cagacatgtaccaccatgccca

SEQ ID NO: 834955 - DNA, 22 bp, Artificial Sequence
  chemically synthesized
agactacagacatgtaccacca

SEQ ID NO: 834956 - DNA, 22 bp, Artificial Sequence
  chemically synthesized
gctgggcatggtggtacatgtc

SEQ ID NO: 834957 - DNA, 22 bp, Artificial Sequence
  chemically synthesized
ggcatggtggtacatgtctgta

SEQ ID NO: 834958 - DNA, 22 bp, Artificial Sequence
  chemically synthesized
agtagctgagactacagacatg

SEQ ID NO: 834959 - DNA, 22 bp, Artificial Sequence
  chemically synthesized
ctgagtagctgagactacagac

SEQ ID NO: 834960 - DNA, 22 bp, Artificial Sequence
  chemically synthesized
agcctcctgagtagctgagact

SEQ ID NO: 834961 - DNA, 22 bp, Artificial Sequence
  chemically synthesized
cctcagcctcctgagtagctga

SEQ ID NO: 834962 - DNA, 22 bp, Artificial Sequence
  chemically synthesized
ctgcctcagcctcctgagtagc

SEQ ID NO: 834963 - DNA, 22 bp, Artificial Sequence
  chemically synthesized
tcctgcctcagcctcctgagta

SEQ ID NO: 834964 - DNA, 22 bp, Artificial Sequence
  chemically synthesized
tagtctcagctactcaggaggc

SEQ ID NO: 834965 - DNA, 22 bp, Artificial Sequence
  chemically synthesized
agctactcaggaggctgaggca

SEQ ID NO: 834966 - DNA, 22 bp, Artificial Sequence
  chemically synthesized
gagtgattctcctgcctcagcc

SEQ ID NO: 834967 - DNA, 22 bp, Artificial Sequence
  chemically synthesized
cgagtgattctcctgcctcagc

SEQ ID NO: 834968 - DNA, 22 bp, Artificial Sequence
  chemically synthesized
tttcgagtgattctcctgcctc

SEQ ID NO: 834969 - DNA, 22 bp, Artificial Sequence
  chemically synthesized
ctcaggaggctgaggcaggaga

SEQ ID NO: 834970 - DNA, 22 bp, Artificial Sequence
  chemically synthesized
ctgtttcgagtgattctcctgc

SEQ ID NO: 834971 - DNA, 22 bp, Artificial Sequence
  chemically synthesized
aggaggctgaggcaggagaatc

SEQ ID NO: 834972 - DNA, 22 bp, Artificial Sequence
  chemically synthesized
cacctcctgtttcgagtgattc

SEQ ID NO: 834973 - DNA, 22 bp, Artificial Sequence
  chemically synthesized
aggcaggagaatcactcgaaac

SEQ ID NO: 834974 - DNA, 22 bp, Artificial Sequence
  chemically synthesized
caacctccacctcctgtttcga

SEQ ID NO: 834975 - DNA, 22 bp, Artificial Sequence
  chemically synthesized
actgcaacctccacctcctgtt

SEQ ID NO: 834976 - DNA, 22 bp, Artificial Sequence
  chemically synthesized
ggctcactgcaacctccacctc

SEQ ID NO: 834977 - DNA, 22 bp, Artificial Sequence
  chemically synthesized
gaaacaggaggtggaggttgca

SEQ ID NO: 834978 - DNA, 22 bp, Artificial Sequence
  chemically synthesized
aatctcggctcactgcaacctc

SEQ ID NO: 834979 - DNA, 22 bp, Artificial Sequence
  chemically synthesized
gagtgtagtggctcaatctcgg

SEQ ID NO: 834980 - DNA, 22 bp, Artificial Sequence
  chemically synthesized
cagtgagccgagattgagccac

SEQ ID NO: 834981 - DNA, 22 bp, Artificial Sequence
  chemically synthesized
tcacccaggctagagtgtagtg

SEQ ID NO: 834982 - DNA, 22 bp, Artificial Sequence
  chemically synthesized
tgtcacccaggctagagtgtag

SEQ ID NO: 834983 - DNA, 22 bp, Artificial Sequence
  chemically synthesized
actctgtcacccaggctagagt

SEQ ID NO: 834984 - DNA, 22 bp, Artificial Sequence
  chemically synthesized
agccactacactctagcctggg

SEQ ID NO: 834985 - DNA, 22 bp, Artificial Sequence
  chemically synthesized
cactctagcctgggtgacagag

SEQ ID NO: 834986 - DNA, 22 bp, Artificial Sequence
  chemically synthesized
agtcagagtctcactctgtcac

SEQ ID NO: 834987 - DNA, 22 bp, Artificial Sequence
  chemically synthesized
tagcctgggtgacagagtgaga

SEQ ID NO: 834988 - DNA, 22 bp, Artificial Sequence
  chemically synthesized
attgagtcagagtctcactctg

SEQ ID NO: 834989 - DNA, 22 bp, Artificial Sequence
  chemically synthesized
gcctgggtgacagagtgagact

SEQ ID NO: 834990 - DNA, 22 bp, Artificial Sequence
  chemically synthesized
attgattgagtcagagtctcac

SEQ ID NO: 834991 - DNA, 22 bp, Artificial Sequence
  chemically synthesized
ggtgacagagtgagactctgac

SEQ ID NO: 834992 - DNA, 22 bp, Artificial Sequence
  chemically synthesized
attgattgattgagtcagagtc

SEQ ID NO: 834993 - DNA, 22 bp, Artificial Sequence
  chemically synthesized
attgattgattgattgagtcag

SEQ ID NO: 834994 - DNA, 22 bp, Artificial Sequence
  chemically synthesized
attgattgattgattgattgag

SEQ ID NO: 834995 - DNA, 22 bp, Artificial Sequence
  chemically synthesized
gattgattgattgattgattga

SEQ ID NO: 834996 - DNA, 22 bp, Artificial Sequence
  chemically synthesized
tgactcaatcaatcaatcaatc

SEQ ID NO: 834997 - DNA, 22 bp, Artificial Sequence
  chemically synthesized
actcgattgattgattgattga

SEQ ID NO: 834998 - DNA, 22 bp, Artificial Sequence
  chemically synthesized
gactcgattgattgattgattg

SEQ ID NO: 834999 - DNA, 22 bp, Artificial Sequence
  chemically synthesized
actcaatcaatcaatcaatcaa

SEQ ID NO: 835000 - DNA, 22 bp, Artificial Sequence
  chemically synthesized
atttgactcgattgattgattg

SEQ ID NO: 835001 - DNA, 22 bp, Artificial Sequence
  chemically synthesized
aatcaatcaatcaatcaatcaa

SEQ ID NO: 835002 - DNA, 22 bp, Artificial Sequence
  chemically synthesized
gatttgactcgattgattgatt

SEQ ID NO: 835003 - DNA, 22 bp, Artificial Sequence
  chemically synthesized
ttgatttgactcgattgattga

SEQ ID NO: 835004 - DNA, 22 bp, Artificial Sequence
  chemically synthesized
cttgatttgactcgattgattg

SEQ ID NO: 835005 - DNA, 22 bp, Artificial Sequence
  chemically synthesized
tcttgatttgactcgattgatt

SEQ ID NO: 835006 - DNA, 22 bp, Artificial Sequence
  chemically synthesized
ttcttgatttgactcgattgat

SEQ ID NO: 835007 - DNA, 22 bp, Artificial Sequence
  chemically synthesized
ttttcttgatttgactcgattg

SEQ ID NO: 835008 - DNA, 22 bp, Artificial Sequence
  chemically synthesized
cactcttttcttgatttgactc

SEQ ID NO: 835009 - DNA, 22 bp, Artificial Sequence
  chemically synthesized
tgcactcttttcttgatttgac

SEQ ID NO: 835010 - DNA, 22 bp, Artificial Sequence
  chemically synthesized
tactctgcactcttttcttgat

SEQ ID NO: 835011 - DNA, 22 bp, Artificial Sequence
  chemically synthesized
gtactctgcactcttttcttga

SEQ ID NO: 835012 - DNA, 22 bp, Artificial Sequence
  chemically synthesized
tgtactctgcactcttttcttg

SEQ ID NO: 835013 - DNA, 22 bp, Artificial Sequence
  chemically synthesized
tttgtactctgcactcttttct

SEQ ID NO: 835014 - DNA, 22 bp, Artificial Sequence
  chemically synthesized
aaactctttgtactctgcactc

SEQ ID NO: 835015 - DNA, 22 bp, Artificial Sequence
  chemically synthesized
gtctcaaactctttgtactctg

SEQ ID NO: 835016 - DNA, 22 bp, Artificial Sequence
  chemically synthesized
agtctcaaactctttgtactct

SEQ ID NO: 835017 - DNA, 22 bp, Artificial Sequence
  chemically synthesized
gagcttagtctcaaactctttg

SEQ ID NO: 835018 - DNA, 22 bp, Artificial Sequence
  chemically synthesized
agagcttagtctcaaactcttt

SEQ ID NO: 835019 - DNA, 22 bp, Artificial Sequence
  chemically synthesized
ttagagcttagtctcaaactct

SEQ ID NO: 835020 - DNA, 22 bp, Artificial Sequence
  chemically synthesized
aagacccagttcttagagctta

SEQ ID NO: 835021 - DNA, 22 bp, Artificial Sequence
  chemically synthesized
gttaaagacccagttcttagag

SEQ ID NO: 835022 - DNA, 22 bp, Artificial Sequence
  chemically synthesized
cgttaaagacccagttcttaga

SEQ ID NO: 835023 - DNA, 22 bp, Artificial Sequence
  chemically synthesized
gagactaagctctaagaactgg

SEQ ID NO: 835024 - DNA, 22 bp, Artificial Sequence
  chemically synthesized
agactaagctctaagaactggg

SEQ ID NO: 835025 - DNA, 22 bp, Artificial Sequence
  chemically synthesized
agctctaagaactgggtcttta

SEQ ID NO: 835026 - DNA, 22 bp, Artificial Sequence
  chemically synthesized
taagaactgggtctttaacgaa

SEQ ID NO: 835027 - DNA, 22 bp, Artificial Sequence
  chemically synthesized
agaactgggtctttaacgaagc

SEQ ID NO: 835028 - DNA, 22 bp, Artificial Sequence
  chemically synthesized
ggtctttaacgaagctgtacct

SEQ ID NO: 835029 - DNA, 22 bp, Artificial Sequence
  chemically synthesized
agtgaaaataaaaggtacagct

SEQ ID NO: 835030 - DNA, 22 bp, Artificial Sequence
  chemically synthesized
taacgaagctgtaccttttatt

SEQ ID NO: 835031 - DNA, 22 bp, Artificial Sequence
  chemically synthesized
aacgaagctgtaccttttattt

SEQ ID NO: 835032 - DNA, 22 bp, Artificial Sequence
  chemically synthesized
aaaattaagtgaaaataaaagg

SEQ ID NO: 835033 - DNA, 22 bp, Artificial Sequence
  chemically synthesized
acgaagctgtaccttttatttt

SEQ ID NO: 835034 - DNA, 22 bp, Artificial Sequence
  chemically synthesized
taccttttattttcacttaatt

SEQ ID NO: 835035 - DNA, 22 bp, Artificial Sequence
  chemically synthesized
ttattttcacttaattttcaat

SEQ ID NO: 835036 - DNA, 22 bp, Artificial Sequence
  chemically synthesized
tattttcacttaattttcaatt

SEQ ID NO: 835037 - DNA, 22 bp, Artificial Sequence
  chemically synthesized
attttcacttaattttcaattg

SEQ ID NO: 835038 - DNA, 22 bp, Artificial Sequence
  chemically synthesized
ttttcacttaattttcaattga

SEQ ID NO: 835039 - DNA, 22 bp, Artificial Sequence
  chemically synthesized
tcacttaattttcaattgattc

SEQ ID NO: 835040 - DNA, 22 bp, Artificial Sequence
  chemically synthesized
cacttaattttcaattgattcc

SEQ ID NO: 835041 - DNA, 22 bp, Artificial Sequence
  chemically synthesized
acttaattttcaattgattcct

SEQ ID NO: 835042 - DNA, 22 bp, Artificial Sequence
  chemically synthesized
aattttcaattgattcctttgt

SEQ ID NO: 835043 - DNA, 22 bp, Artificial Sequence
  chemically synthesized
attttcaattgattcctttgtt

SEQ ID NO: 835044 - DNA, 22 bp, Artificial Sequence
  chemically synthesized
ccatataaacaatgcaacaaag

SEQ ID NO: 835045 - DNA, 22 bp, Artificial Sequence
  chemically synthesized
tcaattgattcctttgttgcat

SEQ ID NO: 835046 - DNA, 22 bp, Artificial Sequence
  chemically synthesized
caattgattcctttgttgcatt

SEQ ID NO: 835047 - DNA, 22 bp, Artificial Sequence
  chemically synthesized
aattgattcctttgttgcattg

SEQ ID NO: 835048 - DNA, 22 bp, Artificial Sequence
  chemically synthesized
ttgccatataaacaatgcaaca

SEQ ID NO: 835049 - DNA, 22 bp, Artificial Sequence
  chemically synthesized
attcctttgttgcattgtttat

SEQ ID NO: 835050 - DNA, 22 bp, Artificial Sequence
  chemically synthesized
ctttgttgcattgtttatatgg

SEQ ID NO: 835051 - DNA, 22 bp, Artificial Sequence
  chemically synthesized
tgttgcattgtttatatggcaa

SEQ ID NO: 835052 - DNA, 22 bp, Artificial Sequence
  chemically synthesized
gttgcattgtttatatggcaat

SEQ ID NO: 835053 - DNA, 22 bp, Artificial Sequence
  chemically synthesized
ttgcattgtttatatggcaata

SEQ ID NO: 835054 - DNA, 22 bp, Artificial Sequence
  chemically synthesized
cattgtttatatggcaataatg

SEQ ID NO: 835055 - DNA, 22 bp, Artificial Sequence
  chemically synthesized
tgtgtaagaacaagcattattg

SEQ ID NO: 835056 - DNA, 22 bp, Artificial Sequence
  chemically synthesized
tttatatggcaataatgcttgt

SEQ ID NO: 835057 - DNA, 22 bp, Artificial Sequence
  chemically synthesized
atatggcaataatgcttgttct

SEQ ID NO: 835058 - DNA, 22 bp, Artificial Sequence
  chemically synthesized
tatggcaataatgcttgttctt

SEQ ID NO: 835059 - DNA, 22 bp, Artificial Sequence
  chemically synthesized
aaatggtaattatgtgtaagaa

SEQ ID NO: 835060 - DNA, 22 bp, Artificial Sequence
  chemically synthesized
aattaaaatggtaattatgtgt

SEQ ID NO: 835061 - DNA, 22 bp, Artificial Sequence
  chemically synthesized
gattaaattaaaatggtaatta

SEQ ID NO: 835062 - DNA, 22 bp, Artificial Sequence
  chemically synthesized
gttcttacacataattaccatt

SEQ ID NO: 835063 - DNA, 22 bp, Artificial Sequence
  chemically synthesized
ttcttacacataattaccattt

SEQ ID NO: 835064 - DNA, 22 bp, Artificial Sequence
  chemically synthesized
tagattaaattaaaatggtaat

SEQ ID NO: 835065 - DNA, 22 bp, Artificial Sequence
  chemically synthesized
ctagattaaattaaaatggtaa

SEQ ID NO: 835066 - DNA, 22 bp, Artificial Sequence
  chemically synthesized
tctagattaaattaaaatggta

SEQ ID NO: 835067 - DNA, 22 bp, Artificial Sequence
  chemically synthesized
ttacacataattaccattttaa

SEQ ID NO: 835068 - DNA, 22 bp, Artificial Sequence
  chemically synthesized
ttctagattaaattaaaatggt

SEQ ID NO: 835069 - DNA, 22 bp, Artificial Sequence
  chemically synthesized
tttctagattaaattaaaatgg

SEQ ID NO: 835070 - DNA, 22 bp, Artificial Sequence
  chemically synthesized
acacataattaccattttaatt

SEQ ID NO: 835071 - DNA, 22 bp, Artificial Sequence
  chemically synthesized
cacataattaccattttaattt

SEQ ID NO: 835072 - DNA, 22 bp, Artificial Sequence
  chemically synthesized
ttttttctagattaaattaaaa

SEQ ID NO: 835073 - DNA, 22 bp, Artificial Sequence
  chemically synthesized
ttattttttctagattaaatta

SEQ ID NO: 835074 - DNA, 22 bp, Artificial Sequence
  chemically synthesized
ttattattttttctagattaaa

SEQ ID NO: 835075 - DNA, 22 bp, Artificial Sequence
  chemically synthesized
tattattattttttctagatta

SEQ ID NO: 835076 - DNA, 22 bp, Artificial Sequence
  chemically synthesized
ccattttaatttaatctagaaa

SEQ ID NO: 835077 - DNA, 22 bp, Artificial Sequence
  chemically synthesized
attctattattattttttctag

SEQ ID NO: 835078 - DNA, 22 bp, Artificial Sequence
  chemically synthesized
tcattctattattattttttct

SEQ ID NO: 835079 - DNA, 22 bp, Artificial Sequence
  chemically synthesized
taatttaatctagaaaaaataa

SEQ ID NO: 835080 - DNA, 22 bp, Artificial Sequence
  chemically synthesized
ctcattctattattattttttc

SEQ ID NO: 835081 - DNA, 22 bp, Artificial Sequence
  chemically synthesized
aatttaatctagaaaaaataat

SEQ ID NO: 835082 - DNA, 22 bp, Artificial Sequence
  chemically synthesized
tctcattctattattatttttt

SEQ ID NO: 835083 - DNA, 22 bp, Artificial Sequence
  chemically synthesized
atttaatctagaaaaaataata

SEQ ID NO: 835084 - DNA, 22 bp, Artificial Sequence
  chemically synthesized
tttctcattctattattatttt

SEQ ID NO: 835085 - DNA, 22 bp, Artificial Sequence
  chemically synthesized
ctttctcattctattattattt

SEQ ID NO: 835086 - DNA, 22 bp, Artificial Sequence
  chemically synthesized
aatctagaaaaaataataatag

SEQ ID NO: 835087 - DNA, 22 bp, Artificial Sequence
  chemically synthesized
atctagaaaaaataataataga

SEQ ID NO: 835088 - DNA, 22 bp, Artificial Sequence
  chemically synthesized
tcttctttctcattctattatt

SEQ ID NO: 835089 - DNA, 22 bp, Artificial Sequence
  chemically synthesized
atcttctttctcattctattat

SEQ ID NO: 835090 - DNA, 22 bp, Artificial Sequence
  chemically synthesized
gaaaaaataataatagaatgag

SEQ ID NO: 835091 - DNA, 22 bp, Artificial Sequence
  chemically synthesized
tttatcttctttctcattctat

SEQ ID NO: 835092 - DNA, 22 bp, Artificial Sequence
  chemically synthesized
atttatcttctttctcattcta

SEQ ID NO: 835093 - DNA, 22 bp, Artificial Sequence
  chemically synthesized
tatttatcttctttctcattct

SEQ ID NO: 835094 - DNA, 22 bp, Artificial Sequence
  chemically synthesized
ttatttatcttctttctcattc

SEQ ID NO: 835095 - DNA, 22 bp, Artificial Sequence
  chemically synthesized
acccagataaagaaaaaatttt

SEQ ID NO: 835096 - DNA, 22 bp, Artificial Sequence
  chemically synthesized
ctgacccagataaagaaaaaat

SEQ ID NO: 835097 - DNA, 22 bp, Artificial Sequence
  chemically synthesized
tttctttatctgggtcaggaat

SEQ ID NO: 835098 - DNA, 22 bp, Artificial Sequence
  chemically synthesized
ttctttatctgggtcaggaatt

SEQ ID NO: 835099 - DNA, 22 bp, Artificial Sequence
  chemically synthesized
tctttatctgggtcaggaattg

SEQ ID NO: 835100 - DNA, 22 bp, Artificial Sequence
  chemically synthesized
tacaataacaaccaattcctga

SEQ ID NO: 835101 - DNA, 22 bp, Artificial Sequence
  chemically synthesized
ctttatctgggtcaggaattgg

SEQ ID NO: 835102 - DNA, 22 bp, Artificial Sequence
  chemically synthesized
tttatctgggtcaggaattggt

SEQ ID NO: 835103 - DNA, 22 bp, Artificial Sequence
  chemically synthesized
tatctgggtcaggaattggttg

SEQ ID NO: 835104 - DNA, 22 bp, Artificial Sequence
  chemically synthesized
atctgggtcaggaattggttgt

SEQ ID NO: 835105 - DNA, 22 bp, Artificial Sequence
  chemically synthesized
tctgggtcaggaattggttgtt

SEQ ID NO: 835106 - DNA, 22 bp, Artificial Sequence
  chemically synthesized
ggtcaggaattggttgttattg

SEQ ID NO: 835107 - DNA, 22 bp, Artificial Sequence
  chemically synthesized
gttgttattgtacagctctctc

SEQ ID NO: 835108 - DNA, 22 bp, Artificial Sequence
  chemically synthesized
ttattgtacagctctctctctc

SEQ ID NO: 835109 - DNA, 22 bp, Artificial Sequence
  chemically synthesized
ttgtacagctctctctctctct

SEQ ID NO: 835110 - DNA, 22 bp, Artificial Sequence
  chemically synthesized
tacagctctctctctctctctc

SEQ ID NO: 835111 - DNA, 22 bp, Artificial Sequence
  chemically synthesized
tctctctctctctctctctctc

SEQ ID NO: 835112 - DNA, 22 bp, Artificial Sequence
  chemically synthesized
tctctctctctctctctctctg

SEQ ID NO: 835113 - DNA, 22 bp, Artificial Sequence
  chemically synthesized
tctctctctctctctctctgtc

SEQ ID NO: 835114 - DNA, 22 bp, Artificial Sequence
  chemically synthesized
tctctctctctctctctgtctg

SEQ ID NO: 835115 - DNA, 22 bp, Artificial Sequence
  chemically synthesized
tctctctctctctctgtctgtg

SEQ ID NO: 835116 - DNA, 22 bp, Artificial Sequence
  chemically synthesized
tctctctctctctgtctgtgtg

SEQ ID NO: 835117 - DNA, 22 bp, Artificial Sequence
  chemically synthesized
tctctctctctgtctgtgtgtg

SEQ ID NO: 835118 - DNA, 22 bp, Artificial Sequence
  chemically synthesized
tctctctctgtctgtgtgtgtg

SEQ ID NO: 835119 - DNA, 22 bp, Artificial Sequence
  chemically synthesized
tctctctgtctgtgtgtgtgtg

SEQ ID NO: 835120 - DNA, 22 bp, Artificial Sequence
  chemically synthesized
tctctgtctgtgtgtgtgtgtg

SEQ ID NO: 835121 - DNA, 22 bp, Artificial Sequence
  chemically synthesized
tctgtctgtgtgtgtgtgtgtg

SEQ ID NO: 835122 - DNA, 22 bp, Artificial Sequence
  chemically synthesized
tgtctgtgtgtgtgtgtgtgtg

SEQ ID NO: 835123 - DNA, 22 bp, Artificial Sequence
  chemically synthesized
tctgtgtgtgtgtgtgtgtgtg

SEQ ID NO: 835124 - DNA, 22 bp, Artificial Sequence
  chemically synthesized
tgtgtgtgtgtgtgtgtgtgtg

SEQ ID NO: 835125 - DNA, 22 bp, Artificial Sequence
  chemically synthesized
acacaccacacacacacacaca

SEQ ID NO: 835126 - DNA, 22 bp, Artificial Sequence
  chemically synthesized
tgacacaccacacacacacaca

SEQ ID NO: 835127 - DNA, 22 bp, Artificial Sequence
  chemically synthesized
tctgacacaccacacacacaca

SEQ ID NO: 835128 - DNA, 22 bp, Artificial Sequence
  chemically synthesized
tctctgacacaccacacacaca

SEQ ID NO: 835129 - DNA, 22 bp, Artificial Sequence
  chemically synthesized
ctctctgacacaccacacacac

SEQ ID NO: 835130 - DNA, 22 bp, Artificial Sequence
  chemically synthesized
aatgaaataaggaccccaaacg

SEQ ID NO: 835131 - DNA, 22 bp, Artificial Sequence
  chemically synthesized
aaatgaaataaggaccccaaac

SEQ ID NO: 835132 - DNA, 22 bp, Artificial Sequence
  chemically synthesized
gcgtttggggtccttatttcat

SEQ ID NO: 835133 - DNA, 22 bp, Artificial Sequence
  chemically synthesized
cgtttggggtccttatttcatt

SEQ ID NO: 835134 - DNA, 22 bp, Artificial Sequence
  chemically synthesized
ggggtccttatttcatttaagt

SEQ ID NO: 835135 - DNA, 22 bp, Artificial Sequence
  chemically synthesized
gggtccttatttcatttaagtt

SEQ ID NO: 835136 - DNA, 22 bp, Artificial Sequence
  chemically synthesized
aaaatagcataataaacttaaa

SEQ ID NO: 835137 - DNA, 22 bp, Artificial Sequence
  chemically synthesized
attgaaaatagcataataaact

SEQ ID NO: 835138 - DNA, 22 bp, Artificial Sequence
  chemically synthesized
atttcatttaagtttattatgc

SEQ ID NO: 835139 - DNA, 22 bp, Artificial Sequence
  chemically synthesized
tttcatttaagtttattatgct

SEQ ID NO: 835140 - DNA, 22 bp, Artificial Sequence
  chemically synthesized
ttaattgaaaatagcataataa

SEQ ID NO: 835141 - DNA, 22 bp, Artificial Sequence
  chemically synthesized
catttaagtttattatgctatt

SEQ ID NO: 835142 - DNA, 22 bp, Artificial Sequence
  chemically synthesized
ctattaattgaaaatagcataa

SEQ ID NO: 835143 - DNA, 22 bp, Artificial Sequence
  chemically synthesized
atttaagtttattatgctattt

SEQ ID NO: 835144 - DNA, 22 bp, Artificial Sequence
  chemically synthesized
gctattaattgaaaatagcata

SEQ ID NO: 835145 - DNA, 22 bp, Artificial Sequence
  chemically synthesized
aagtttattatgctattttcaa

SEQ ID NO: 835146 - DNA, 22 bp, Artificial Sequence
  chemically synthesized
agtttattatgctattttcaat

SEQ ID NO: 835147 - DNA, 22 bp, Artificial Sequence
  chemically synthesized
attatgctattttcaattaata

SEQ ID NO: 835148 - DNA, 22 bp, Artificial Sequence
  chemically synthesized
ttatgctattttcaattaatag

SEQ ID NO: 835149 - DNA, 22 bp, Artificial Sequence
  chemically synthesized
tgctattttcaattaatagcaa

SEQ ID NO: 835150 - DNA, 22 bp, Artificial Sequence
  chemically synthesized
aaaatgtaaagaacttgctatt

SEQ ID NO: 835151 - DNA, 22 bp, Artificial Sequence
  chemically synthesized
aaaaatgtaaagaacttgctat

SEQ ID NO: 835152 - DNA, 22 bp, Artificial Sequence
  chemically synthesized
ttttcaattaatagcaagttct

SEQ ID NO: 835153 - DNA, 22 bp, Artificial Sequence
  chemically synthesized
tcaattaatagcaagttcttta

SEQ ID NO: 835154 - DNA, 22 bp, Artificial Sequence
  chemically synthesized
caattaatagcaagttctttac

SEQ ID NO: 835155 - DNA, 22 bp, Artificial Sequence
  chemically synthesized
aattaatagcaagttctttaca

SEQ ID NO: 835156 - DNA, 22 bp, Artificial Sequence
  chemically synthesized
aaatatagtttaaaaatgtaaa

SEQ ID NO: 835157 - DNA, 22 bp, Artificial Sequence
  chemically synthesized
atagcaagttctttacattttt

SEQ ID NO: 835158 - DNA, 22 bp, Artificial Sequence
  chemically synthesized
aaaatatagtttaaaaatgtaa

SEQ ID NO: 835159 - DNA, 22 bp, Artificial Sequence
  chemically synthesized
ttaaaatatagtttaaaaatgt

SEQ ID NO: 835160 - DNA, 22 bp, Artificial Sequence
  chemically synthesized
tttacatttttaaactatattt

SEQ ID NO: 835161 - DNA, 22 bp, Artificial Sequence
  chemically synthesized
tacatttttaaactatatttta

SEQ ID NO: 835162 - DNA, 22 bp, Artificial Sequence
  chemically synthesized
acatttttaaactatattttaa

SEQ ID NO: 835163 - DNA, 22 bp, Artificial Sequence
  chemically synthesized
catttttaaactatattttaag

SEQ ID NO: 835164 - DNA, 22 bp, Artificial Sequence
  chemically synthesized
agaaatatgtgcactcttaaaa

SEQ ID NO: 835165 - DNA, 22 bp, Artificial Sequence
  chemically synthesized
aagaaatatgtgcactcttaaa

SEQ ID NO: 835166 - DNA, 22 bp, Artificial Sequence
  chemically synthesized
ttaaactatattttaagagtgc

SEQ ID NO: 835167 - DNA, 22 bp, Artificial Sequence
  chemically synthesized
taaactatattttaagagtgca

SEQ ID NO: 835168 - DNA, 22 bp, Artificial Sequence
  chemically synthesized
ttaagaaatatgtgcactctta

SEQ ID NO: 835169 - DNA, 22 bp, Artificial Sequence
  chemically synthesized
aaactatattttaagagtgcac

SEQ ID NO: 835170 - DNA, 22 bp, Artificial Sequence
  chemically synthesized
aactatattttaagagtgcaca

SEQ ID NO: 835171 - DNA, 22 bp, Artificial Sequence
  chemically synthesized
gaactcttaagaaatatgtgca

SEQ ID NO: 835172 - DNA, 22 bp, Artificial Sequence
  chemically synthesized
tattttaagagtgcacatattt

SEQ ID NO: 835173 - DNA, 22 bp, Artificial Sequence
  chemically synthesized
agaactcttaagaaatatgtgc

SEQ ID NO: 835174 - DNA, 22 bp, Artificial Sequence
  chemically synthesized
taagagtgcacatatttcttaa

SEQ ID NO: 835175 - DNA, 22 bp, Artificial Sequence
  chemically synthesized
aagagtgcacatatttcttaag

SEQ ID NO: 835176 - DNA, 22 bp, Artificial Sequence
  chemically synthesized
agagtgcacatatttcttaaga

SEQ ID NO: 835177 - DNA, 22 bp, Artificial Sequence
  chemically synthesized
cttaagagttctaaatggcata

SEQ ID NO: 835178 - DNA, 22 bp, Artificial Sequence
  chemically synthesized
ttaagagttctaaatggcatat

SEQ ID NO: 835179 - DNA, 22 bp, Artificial Sequence
  chemically synthesized
aagagttctaaatggcatattt

SEQ ID NO: 835180 - DNA, 22 bp, Artificial Sequence
  chemically synthesized
agagttctaaatggcatatttc

SEQ ID NO: 835181 - DNA, 22 bp, Artificial Sequence
  chemically synthesized
taaatggcatatttctatttct

SEQ ID NO: 835182 - DNA, 22 bp, Artificial Sequence
  chemically synthesized
aatggcatatttctatttctat

SEQ ID NO: 835183 - DNA, 22 bp, Artificial Sequence
  chemically synthesized
ctatttctatgtatacatatat

SEQ ID NO: 835184 - DNA, 22 bp, Artificial Sequence
  chemically synthesized
tatttctatgtatacatatatg

SEQ ID NO: 835185 - DNA, 22 bp, Artificial Sequence
  chemically synthesized
tttctatgtatacatatatgtt

SEQ ID NO: 835186 - DNA, 22 bp, Artificial Sequence
  chemically synthesized
ctatgtatacatatatgtttct

SEQ ID NO: 835187 - DNA, 22 bp, Artificial Sequence
  chemically synthesized
tatgtatacatatatgtttcta

SEQ ID NO: 835188 - DNA, 22 bp, Artificial Sequence
  chemically synthesized
tgtatacatatatgtttctatt

SEQ ID NO: 835189 - DNA, 22 bp, Artificial Sequence
  chemically synthesized
ctattatatatgtctacttcta

SEQ ID NO: 835190 - DNA, 22 bp, Artificial Sequence
  chemically synthesized
tattatatatgtctacttctat

SEQ ID NO: 835191 - DNA, 22 bp, Artificial Sequence
  chemically synthesized
ttatatatgtctacttctatgt

SEQ ID NO: 835192 - DNA, 22 bp, Artificial Sequence
  chemically synthesized
tatatgtctacttctatgtcta

SEQ ID NO: 835193 - DNA, 22 bp, Artificial Sequence
  chemically synthesized
cttctatgtctatgcacttatc

SEQ ID NO: 835194 - DNA, 22 bp, Artificial Sequence
  chemically synthesized
ctatgtctatgcacttatctgt

SEQ ID NO: 835195 - DNA, 22 bp, Artificial Sequence
  chemically synthesized
tatgtctatgcacttatctgta

SEQ ID NO: 835196 - DNA, 22 bp, Artificial Sequence
  chemically synthesized
tgtctatgcacttatctgtatc

SEQ ID NO: 835197 - DNA, 22 bp, Artificial Sequence
  chemically synthesized
tgcacttatctgtatctatctc

SEQ ID NO: 835198 - DNA, 22 bp, Artificial Sequence
  chemically synthesized
atctgtatctatctctatctct

SEQ ID NO: 835199 - DNA, 22 bp, Artificial Sequence
  chemically synthesized
tctgtatctatctctatctcta

SEQ ID NO: 835200 - DNA, 22 bp, Artificial Sequence
  chemically synthesized
aagagatatcaaagtagagata

SEQ ID NO: 835201 - DNA, 22 bp, Artificial Sequence
  chemically synthesized
aaagagatatcaaagtagagat

SEQ ID NO: 835202 - DNA, 22 bp, Artificial Sequence
  chemically synthesized
tatctatctctatctctacttt

SEQ ID NO: 835203 - DNA, 22 bp, Artificial Sequence
  chemically synthesized
tctctatctctactttgatatc

SEQ ID NO: 835204 - DNA, 22 bp, Artificial Sequence
  chemically synthesized
tatctctactttgatatctctt

SEQ ID NO: 835205 - DNA, 22 bp, Artificial Sequence
  chemically synthesized
tctctactttgatatctcttta

SEQ ID NO: 835206 - DNA, 22 bp, Artificial Sequence
  chemically synthesized
tactttgatatctctttaagtc

SEQ ID NO: 835207 - DNA, 22 bp, Artificial Sequence
  chemically synthesized
ctttgatatctctttaagtctc

SEQ ID NO: 835208 - DNA, 22 bp, Artificial Sequence
  chemically synthesized
tacataaaaagagagacttaaa

SEQ ID NO: 835209 - DNA, 22 bp, Artificial Sequence
  chemically synthesized
gtacataaaaagagagacttaa

SEQ ID NO: 835210 - DNA, 22 bp, Artificial Sequence
  chemically synthesized
tgatatctctttaagtctctct

SEQ ID NO: 835211 - DNA, 22 bp, Artificial Sequence
  chemically synthesized
gatatctctttaagtctctctt

SEQ ID NO: 835212 - DNA, 22 bp, Artificial Sequence
  chemically synthesized
atatctctttaagtctctcttt

SEQ ID NO: 835213 - DNA, 22 bp, Artificial Sequence
  chemically synthesized
ggaacttgtacataaaaagaga

SEQ ID NO: 835214 - DNA, 22 bp, Artificial Sequence
  chemically synthesized
taggaacttgtacataaaaaga

SEQ ID NO: 835215 - DNA, 22 bp, Artificial Sequence
  chemically synthesized
tttaagtctctctttttatgta

SEQ ID NO: 835216 - DNA, 22 bp, Artificial Sequence
  chemically synthesized
taagtctctctttttatgtaca

SEQ ID NO: 835217 - DNA, 22 bp, Artificial Sequence
  chemically synthesized
aagtctctctttttatgtacaa

SEQ ID NO: 835218 - DNA, 22 bp, Artificial Sequence
  chemically synthesized
agtctctctttttatgtacaag

SEQ ID NO: 835219 - DNA, 22 bp, Artificial Sequence
  chemically synthesized
gagcctctaggaacttgtacat

SEQ ID NO: 835220 - DNA, 22 bp, Artificial Sequence
  chemically synthesized
agagcctctaggaacttgtaca

SEQ ID NO: 835221 - DNA, 22 bp, Artificial Sequence
  chemically synthesized
tctttttatgtacaagttccta

SEQ ID NO: 835222 - DNA, 22 bp, Artificial Sequence
  chemically synthesized
tttttatgtacaagttcctaga

SEQ ID NO: 835223 - DNA, 22 bp, Artificial Sequence
  chemically synthesized
ggacttagagcctctaggaact

SEQ ID NO: 835224 - DNA, 22 bp, Artificial Sequence
  chemically synthesized
tttatgtacaagttcctagagg

SEQ ID NO: 835225 - DNA, 22 bp, Artificial Sequence
  chemically synthesized
ttatgtacaagttcctagaggc

SEQ ID NO: 835226 - DNA, 22 bp, Artificial Sequence
  chemically synthesized
tatgtacaagttcctagaggct

SEQ ID NO: 835227 - DNA, 22 bp, Artificial Sequence
  chemically synthesized
atgtacaagttcctagaggctc

SEQ ID NO: 835228 - DNA, 22 bp, Artificial Sequence
  chemically synthesized
tgtacaagttcctagaggctct

SEQ ID NO: 835229 - DNA, 22 bp, Artificial Sequence
  chemically synthesized
gaatgttaggacttagagcctc

SEQ ID NO: 835230 - DNA, 22 bp, Artificial Sequence
  chemically synthesized
tggaatgttaggacttagagcc

SEQ ID NO: 835231 - DNA, 22 bp, Artificial Sequence
  chemically synthesized
ctggaatgttaggacttagagc

SEQ ID NO: 835232 - DNA, 22 bp, Artificial Sequence
  chemically synthesized
ctagaggctctaagtcctaaca

SEQ ID NO: 835233 - DNA, 22 bp, Artificial Sequence
  chemically synthesized
aaatttctggaatgttaggact

SEQ ID NO: 835234 - DNA, 22 bp, Artificial Sequence
  chemically synthesized
gaaatttctggaatgttaggac

SEQ ID NO: 835235 - DNA, 22 bp, Artificial Sequence
  chemically synthesized
tgaaatttctggaatgttagga

SEQ ID NO: 835236 - DNA, 22 bp, Artificial Sequence
  chemically synthesized
gaggctctaagtcctaacattc

SEQ ID NO: 835237 - DNA, 22 bp, Artificial Sequence
  chemically synthesized
tttgaaatttctggaatgttag

SEQ ID NO: 835238 - DNA, 22 bp, Artificial Sequence
  chemically synthesized
ctttgaaatttctggaatgtta

SEQ ID NO: 835239 - DNA, 22 bp, Artificial Sequence
  chemically synthesized
gtttctttgaaatttctggaat

SEQ ID NO: 835240 - DNA, 22 bp, Artificial Sequence
  chemically synthesized
taagtcctaacattccagaaat

SEQ ID NO: 835241 - DNA, 22 bp, Artificial Sequence
  chemically synthesized
tagtttctttgaaatttctgga

SEQ ID NO: 835242 - DNA, 22 bp, Artificial Sequence
  chemically synthesized
agtcctaacattccagaaattt

SEQ ID NO: 835243 - DNA, 22 bp, Artificial Sequence
  chemically synthesized
ctagtttctttgaaatttctgg

SEQ ID NO: 835244 - DNA, 22 bp, Artificial Sequence
  chemically synthesized
tctagtttctttgaaatttctg

SEQ ID NO: 835245 - DNA, 22 bp, Artificial Sequence
  chemically synthesized
tttctagtttctttgaaatttc

SEQ ID NO: 835246 - DNA, 22 bp, Artificial Sequence
  chemically synthesized
ctttctagtttctttgaaattt

SEQ ID NO: 835247 - DNA, 22 bp, Artificial Sequence
  chemically synthesized
tctttctagtttctttgaaatt

SEQ ID NO: 835248 - DNA, 22 bp, Artificial Sequence
  chemically synthesized
acattccagaaatttcaaagaa

SEQ ID NO: 835249 - DNA, 22 bp, Artificial Sequence
  chemically synthesized
cagaaatttcaaagaaactaga

SEQ ID NO: 835250 - DNA, 22 bp, Artificial Sequence
  chemically synthesized
cagaagaaaatctttctttcta

SEQ ID NO: 835251 - DNA, 22 bp, Artificial Sequence
  chemically synthesized
caaagaaactagaaagaaagat

SEQ ID NO: 835252 - DNA, 22 bp, Artificial Sequence
  chemically synthesized
aaagaaactagaaagaaagatt

SEQ ID NO: 835253 - DNA, 22 bp, Artificial Sequence
  chemically synthesized
taattgcagaagaaaatctttc

SEQ ID NO: 835254 - DNA, 22 bp, Artificial Sequence
  chemically synthesized
ttgtaattgcagaagaaaatct

SEQ ID NO: 835255 - DNA, 22 bp, Artificial Sequence
  chemically synthesized
gaaagaaagattttcttctgca

SEQ ID NO: 835256 - DNA, 22 bp, Artificial Sequence
  chemically synthesized
tcctattgtaattgcagaagaa

SEQ ID NO: 835257 - DNA, 22 bp, Artificial Sequence
  chemically synthesized
atcctattgtaattgcagaaga

SEQ ID NO: 835258 - DNA, 22 bp, Artificial Sequence
  chemically synthesized
tatcctattgtaattgcagaag

SEQ ID NO: 835259 - DNA, 22 bp, Artificial Sequence
  chemically synthesized
ttatcctattgtaattgcagaa

SEQ ID NO: 835260 - DNA, 22 bp, Artificial Sequence
  chemically synthesized
ttttatcctattgtaattgcag

SEQ ID NO: 835261 - DNA, 22 bp, Artificial Sequence
  chemically synthesized
tcttctgcaattacaataggat

SEQ ID NO: 835262 - DNA, 22 bp, Artificial Sequence
  chemically synthesized
cttctgcaattacaataggata

SEQ ID NO: 835263 - DNA, 22 bp, Artificial Sequence
  chemically synthesized
ttctgcaattacaataggataa

SEQ ID NO: 835264 - DNA, 22 bp, Artificial Sequence
  chemically synthesized
tccacaatctcttttatcctat

SEQ ID NO: 835265 - DNA, 22 bp, Artificial Sequence
  chemically synthesized
ctgcaattacaataggataaaa

SEQ ID NO: 835266 - DNA, 22 bp, Artificial Sequence
  chemically synthesized
tgcaattacaataggataaaag

SEQ ID NO: 835267 - DNA, 22 bp, Artificial Sequence
  chemically synthesized
ctatccacaatctcttttatcc

SEQ ID NO: 835268 - DNA, 22 bp, Artificial Sequence
  chemically synthesized
caattacaataggataaaagag

SEQ ID NO: 835269 - DNA, 22 bp, Artificial Sequence
  chemically synthesized
ttactatccacaatctctttta

SEQ ID NO: 835270 - DNA, 22 bp, Artificial Sequence
  chemically synthesized
caataggataaaagagattgtg

SEQ ID NO: 835271 - DNA, 22 bp, Artificial Sequence
  chemically synthesized
cagatagctattactatccaca

SEQ ID NO: 835272 - DNA, 22 bp, Artificial Sequence
  chemically synthesized
gcagatagctattactatccac

SEQ ID NO: 835273 - DNA, 22 bp, Artificial Sequence
  chemically synthesized
tgcagatagctattactatcca

SEQ ID NO: 835274 - DNA, 22 bp, Artificial Sequence
  chemically synthesized
ttgcagatagctattactatcc

SEQ ID NO: 835275 - DNA, 22 bp, Artificial Sequence
  chemically synthesized
tttttgcagatagctattacta

SEQ ID NO: 835276 - DNA, 22 bp, Artificial Sequence
  chemically synthesized
atttttgcagatagctattact

SEQ ID NO: 835277 - DNA, 22 bp, Artificial Sequence
  chemically synthesized
tggatagtaatagctatctgca

SEQ ID NO: 835278 - DNA, 22 bp, Artificial Sequence
  chemically synthesized
agccagtttatttttgcagata

SEQ ID NO: 835279 - DNA, 22 bp, Artificial Sequence
  chemically synthesized
aggctcagccagtttatttttg

SEQ ID NO: 835280 - DNA, 22 bp, Artificial Sequence
  chemically synthesized
tctgaggctcagccagtttatt

SEQ ID NO: 835281 - DNA, 22 bp, Artificial Sequence
  chemically synthesized
tctgcaaaaataaactggctga

SEQ ID NO: 835282 - DNA, 22 bp, Artificial Sequence
  chemically synthesized
caaaaataaactggctgagcct

SEQ ID NO: 835283 - DNA, 22 bp, Artificial Sequence
  chemically synthesized
cccaggctatctgaggctcagc

SEQ ID NO: 835284 - DNA, 22 bp, Artificial Sequence
  chemically synthesized
taacaagctccccaggctatct

SEQ ID NO: 835285 - DNA, 22 bp, Artificial Sequence
  chemically synthesized
ataacaagctccccaggctatc

SEQ ID NO: 835286 - DNA, 22 bp, Artificial Sequence
  chemically synthesized
gctgagcctcagatagcctggg

SEQ ID NO: 835287 - DNA, 22 bp, Artificial Sequence
  chemically synthesized
agcctcagatagcctggggagc

SEQ ID NO: 835288 - DNA, 22 bp, Artificial Sequence
  chemically synthesized
tatttataacaagctccccagg

SEQ ID NO: 835289 - DNA, 22 bp, Artificial Sequence
  chemically synthesized
agatagcctggggagcttgtta

SEQ ID NO: 835290 - DNA, 22 bp, Artificial Sequence
  chemically synthesized
ggaatctgtatttataacaagc

SEQ ID NO: 835291 - DNA, 22 bp, Artificial Sequence
  chemically synthesized
gggaatctgtatttataacaag

SEQ ID NO: 835292 - DNA, 22 bp, Artificial Sequence
  chemically synthesized
gggagcttgttataaatacaga

SEQ ID NO: 835293 - DNA, 22 bp, Artificial Sequence
  chemically synthesized
gttataaatacagattcccaag

SEQ ID NO: 835294 - DNA, 22 bp, Artificial Sequence
  chemically synthesized
ttataaatacagattcccaagg

SEQ ID NO: 835295 - DNA, 22 bp, Artificial Sequence
  chemically synthesized
taaatacagattcccaaggcct

SEQ ID NO: 835296 - DNA, 22 bp, Artificial Sequence
  chemically synthesized
acataatagggatataagaagg

SEQ ID NO: 835297 - DNA, 22 bp, Artificial Sequence
  chemically synthesized
tgacataatagggatataagaa

SEQ ID NO: 835298 - DNA, 22 bp, Artificial Sequence
  chemically synthesized
ccaaggccttcttatatcccta

SEQ ID NO: 835299 - DNA, 22 bp, Artificial Sequence
  chemically synthesized
cttatatccctattatgtcaga

SEQ ID NO: 835300 - DNA, 22 bp, Artificial Sequence
  chemically synthesized
ttatatccctattatgtcagaa

SEQ ID NO: 835301 - DNA, 22 bp, Artificial Sequence
  chemically synthesized
caacataagaaattctgacata

SEQ ID NO: 835302 - DNA, 22 bp, Artificial Sequence
  chemically synthesized
ccaacataagaaattctgacat

SEQ ID NO: 835303 - DNA, 22 bp, Artificial Sequence
  chemically synthesized
atatccctattatgtcagaatt

SEQ ID NO: 835304 - DNA, 22 bp, Artificial Sequence
  chemically synthesized
tatccctattatgtcagaattt

SEQ ID NO: 835305 - DNA, 22 bp, Artificial Sequence
  chemically synthesized
cttccaacataagaaattctga

SEQ ID NO: 835306 - DNA, 22 bp, Artificial Sequence
  chemically synthesized
gcttccaacataagaaattctg

SEQ ID NO: 835307 - DNA, 22 bp, Artificial Sequence
  chemically synthesized
ttatgtcagaatttcttatgtt

SEQ ID NO: 835308 - DNA, 22 bp, Artificial Sequence
  chemically synthesized
tgtcagaatttcttatgttgga

SEQ ID NO: 835309 - DNA, 22 bp, Artificial Sequence
  chemically synthesized
ccggacatcttgcttccaacat

SEQ ID NO: 835310 - DNA, 22 bp, Artificial Sequence
  chemically synthesized
gccattcccggacatcttgctt

SEQ ID NO: 835311 - DNA, 22 bp, Artificial Sequence
  chemically synthesized
cttatgttggaagcaagatgtc

SEQ ID NO: 835312 - DNA, 22 bp, Artificial Sequence
  chemically synthesized
ttatgttggaagcaagatgtcc

SEQ ID NO: 835313 - DNA, 22 bp, Artificial Sequence
  chemically synthesized
ctggccattcccggacatcttg

SEQ ID NO: 835314 - DNA, 22 bp, Artificial Sequence
  chemically synthesized
atgttggaagcaagatgtccgg

SEQ ID NO: 835315 - DNA, 22 bp, Artificial Sequence
  chemically synthesized
tgttggaagcaagatgtccggg

SEQ ID NO: 835316 - DNA, 22 bp, Artificial Sequence
  chemically synthesized
gtattactggccattcccggac

SEQ ID NO: 835317 - DNA, 22 bp, Artificial Sequence
  chemically synthesized
gaagcaagatgtccgggaatgg

SEQ ID NO: 835318 - DNA, 22 bp, Artificial Sequence
  chemically synthesized
tagtattactggccattcccgg

SEQ ID NO: 835319 - DNA, 22 bp, Artificial Sequence
  chemically synthesized
ctagtattactggccattcccg

SEQ ID NO: 835320 - DNA, 22 bp, Artificial Sequence
  chemically synthesized
ccacaaagatttctagtattac

SEQ ID NO: 835321 - DNA, 22 bp, Artificial Sequence
  chemically synthesized
cccacaaagatttctagtatta

SEQ ID NO: 835322 - DNA, 22 bp, Artificial Sequence
  chemically synthesized
aaaacgacatttcccacaaaga

SEQ ID NO: 835323 - DNA, 22 bp, Artificial Sequence
  chemically synthesized
caaaacgacatttcccacaaag

SEQ ID NO: 835324 - DNA, 22 bp, Artificial Sequence
  chemically synthesized
tcaaaacgacatttcccacaaa

SEQ ID NO: 835325 - DNA, 22 bp, Artificial Sequence
  chemically synthesized
gaaatctttgtgggaaatgtcg

SEQ ID NO: 835326 - DNA, 22 bp, Artificial Sequence
  chemically synthesized
tgtgggaaatgtcgttttgaaa

SEQ ID NO: 835327 - DNA, 22 bp, Artificial Sequence
  chemically synthesized
gtgggaaatgtcgttttgaaag

SEQ ID NO: 835328 - DNA, 22 bp, Artificial Sequence
  chemically synthesized
atccccaaaaccctttcaaaac

SEQ ID NO: 835329 - DNA, 22 bp, Artificial Sequence
  chemically synthesized
tgggaaatgtcgttttgaaagg

SEQ ID NO: 835330 - DNA, 22 bp, Artificial Sequence
  chemically synthesized
catccccaaaaccctttcaaaa

SEQ ID NO: 835331 - DNA, 22 bp, Artificial Sequence
  chemically synthesized
cttcatccccaaaaccctttca

SEQ ID NO: 835332 - DNA, 22 bp, Artificial Sequence
  chemically synthesized
ggttacttcatccccaaaaccc

SEQ ID NO: 835333 - DNA, 22 bp, Artificial Sequence
  chemically synthesized
atctgggttacttcatccccaa

SEQ ID NO: 835334 - DNA, 22 bp, Artificial Sequence
  chemically synthesized
tgaaagggttttggggatgaag

SEQ ID NO: 835335 - DNA, 22 bp, Artificial Sequence
  chemically synthesized
gaaagggttttggggatgaagt

SEQ ID NO: 835336 - DNA, 22 bp, Artificial Sequence
  chemically synthesized
aaagggttttggggatgaagta

SEQ ID NO: 835337 - DNA, 22 bp, Artificial Sequence
  chemically synthesized
cccccagattcatctgggttac

SEQ ID NO: 835338 - DNA, 22 bp, Artificial Sequence
  chemically synthesized
tggggatgaagtaacccagatg

SEQ ID NO: 835339 - DNA, 22 bp, Artificial Sequence
  chemically synthesized
ggggatgaagtaacccagatga

SEQ ID NO: 835340 - DNA, 22 bp, Artificial Sequence
  chemically synthesized
ttacccccagattcatctgggt

SEQ ID NO: 835341 - DNA, 22 bp, Artificial Sequence
  chemically synthesized
gggatgaagtaacccagatgaa

SEQ ID NO: 835342 - DNA, 22 bp, Artificial Sequence
  chemically synthesized
cctgttacccccagattcatct

SEQ ID NO: 835343 - DNA, 22 bp, Artificial Sequence
  chemically synthesized
ctacctgttacccccagattca

SEQ ID NO: 835344 - DNA, 22 bp, Artificial Sequence
  chemically synthesized
atgacattgctacctgttaccc

SEQ ID NO: 835345 - DNA, 22 bp, Artificial Sequence
  chemically synthesized
tgttaatgacattgctacctgt

SEQ ID NO: 835346 - DNA, 22 bp, Artificial Sequence
  chemically synthesized
atgttaatgacattgctacctg

SEQ ID NO: 835347 - DNA, 22 bp, Artificial Sequence
  chemically synthesized
tatgttaatgacattgctacct

SEQ ID NO: 835348 - DNA, 22 bp, Artificial Sequence
  chemically synthesized
ggggtaacaggtagcaatgtca

SEQ ID NO: 835349 - DNA, 22 bp, Artificial Sequence
  chemically synthesized
gtagctttatgttaatgacatt

SEQ ID NO: 835350 - DNA, 22 bp, Artificial Sequence
  chemically synthesized
atagttggtagctttatgttaa

SEQ ID NO: 835351 - DNA, 22 bp, Artificial Sequence
  chemically synthesized
gtataagttaatagttggtagc

SEQ ID NO: 835352 - DNA, 22 bp, Artificial Sequence
  chemically synthesized
acataaagctaccaactattaa

SEQ ID NO: 835353 - DNA, 22 bp, Artificial Sequence
  chemically synthesized
agatatgttagtataagttaat

SEQ ID NO: 835354 - DNA, 22 bp, Artificial Sequence
  chemically synthesized
ccaactattaacttatactaac

SEQ ID NO: 835355 - DNA, 22 bp, Artificial Sequence
  chemically synthesized
ttaacttatactaacatatctg

SEQ ID NO: 835356 - DNA, 22 bp, Artificial Sequence
  chemically synthesized
acttatactaacatatctgagt

SEQ ID NO: 835357 - DNA, 22 bp, Artificial Sequence
  chemically synthesized
atactaacatatctgagtttta

SEQ ID NO: 835358 - DNA, 22 bp, Artificial Sequence
  chemically synthesized
tactaacatatctgagttttat

SEQ ID NO: 835359 - DNA, 22 bp, Artificial Sequence
  chemically synthesized
tcacagaacaatataaaactca

SEQ ID NO: 835360 - DNA, 22 bp, Artificial Sequence
  chemically synthesized
tctgtcacagaacaatataaaa

SEQ ID NO: 835361 - DNA, 22 bp, Artificial Sequence
  chemically synthesized
acatatctgagttttatattgt

SEQ ID NO: 835362 - DNA, 22 bp, Artificial Sequence
  chemically synthesized
ttatctgtcacagaacaatata

SEQ ID NO: 835363 - DNA, 22 bp, Artificial Sequence
  chemically synthesized
ctattatctgtcacagaacaat

SEQ ID NO: 835364 - DNA, 22 bp, Artificial Sequence
  chemically synthesized
tcctattatctgtcacagaaca

SEQ ID NO: 835365 - DNA, 22 bp, Artificial Sequence
  chemically synthesized
agttttatattgttctgtgaca

SEQ ID NO: 835366 - DNA, 22 bp, Artificial Sequence
  chemically synthesized
actctcctattatctgtcacag

SEQ ID NO: 835367 - DNA, 22 bp, Artificial Sequence
  chemically synthesized
cactctcctattatctgtcaca

SEQ ID NO: 835368 - DNA, 22 bp, Artificial Sequence
  chemically synthesized
tatattgttctgtgacagataa

SEQ ID NO: 835369 - DNA, 22 bp, Artificial Sequence
  chemically synthesized
atattgttctgtgacagataat

SEQ ID NO: 835370 - DNA, 22 bp, Artificial Sequence
  chemically synthesized
tattgttctgtgacagataata

SEQ ID NO: 835371 - DNA, 22 bp, Artificial Sequence
  chemically synthesized
ccttcactctcctattatctgt

SEQ ID NO: 835372 - DNA, 22 bp, Artificial Sequence
  chemically synthesized
accttcactctcctattatctg

SEQ ID NO: 835373 - DNA, 22 bp, Artificial Sequence
  chemically synthesized
taccttcactctcctattatct

SEQ ID NO: 835374 - DNA, 22 bp, Artificial Sequence
  chemically synthesized
ttctgtgacagataataggaga

SEQ ID NO: 835375 - DNA, 22 bp, Artificial Sequence
  chemically synthesized
tgtgacagataataggagagtg

SEQ ID NO: 835376 - DNA, 22 bp, Artificial Sequence
  chemically synthesized
tgacagataataggagagtgaa

SEQ ID NO: 835377 - DNA, 22 bp, Artificial Sequence
  chemically synthesized
ccccaaccaccaccatatacag

SEQ ID NO: 835378 - DNA, 22 bp, Artificial Sequence
  chemically synthesized
cccccaaccaccaccatataca

SEQ ID NO: 835379 - DNA, 22 bp, Artificial Sequence
  chemically synthesized
tcccccaaccaccaccatatac

SEQ ID NO: 835380 - DNA, 22 bp, Artificial Sequence
  chemically synthesized
tatatctgtatatggtggtggt

SEQ ID NO: 835381 - DNA, 22 bp, Artificial Sequence
  chemically synthesized
caagaggttttcccccaaccac

SEQ ID NO: 835382 - DNA, 22 bp, Artificial Sequence
  chemically synthesized
tatatggtggtggttgggggaa

SEQ ID NO: 835383 - DNA, 22 bp, Artificial Sequence
  chemically synthesized
cctgcaagaggttttcccccaa

SEQ ID NO: 835384 - DNA, 22 bp, Artificial Sequence
  chemically synthesized
gattccctgcaagaggttttcc

SEQ ID NO: 835385 - DNA, 22 bp, Artificial Sequence
  chemically synthesized
agattccctgcaagaggttttc

SEQ ID NO: 835386 - DNA, 22 bp, Artificial Sequence
  chemically synthesized
tagattccctgcaagaggtttt

SEQ ID NO: 835387 - DNA, 22 bp, Artificial Sequence
  chemically synthesized
ttagattccctgcaagaggttt

SEQ ID NO: 835388 - DNA, 22 bp, Artificial Sequence
  chemically synthesized
cttttagattccctgcaagagg

SEQ ID NO: 835389 - DNA, 22 bp, Artificial Sequence
  chemically synthesized
ccttttagattccctgcaagag

SEQ ID NO: 835390 - DNA, 22 bp, Artificial Sequence
  chemically synthesized
ggggaaaacctcttgcagggaa

SEQ ID NO: 835391 - DNA, 22 bp, Artificial Sequence
  chemically synthesized
gcttccttttagattccctgca

SEQ ID NO: 835392 - DNA, 22 bp, Artificial Sequence
  chemically synthesized
cctggcttccttttagattccc

SEQ ID NO: 835393 - DNA, 22 bp, Artificial Sequence
  chemically synthesized
ctccctggcttccttttagatt

SEQ ID NO: 835394 - DNA, 22 bp, Artificial Sequence
  chemically synthesized
gctccctggcttccttttagat

SEQ ID NO: 835395 - DNA, 22 bp, Artificial Sequence
  chemically synthesized
ttgcagggaatctaaaaggaag

SEQ ID NO: 835396 - DNA, 22 bp, Artificial Sequence
  chemically synthesized
gcagggaatctaaaaggaagcc

SEQ ID NO: 835397 - DNA, 22 bp, Artificial Sequence
  chemically synthesized
cagggaatctaaaaggaagcca

SEQ ID NO: 835398 - DNA, 22 bp, Artificial Sequence
  chemically synthesized
aaaggaagccagggagcaaaca

SEQ ID NO: 835399 - DNA, 22 bp, Artificial Sequence
  chemically synthesized
agatggtacaaaaaacataata

SEQ ID NO: 835400 - DNA, 22 bp, Artificial Sequence
  chemically synthesized
atctcagatggtacaaaaaaca

SEQ ID NO: 835401 - DNA, 22 bp, Artificial Sequence
  chemically synthesized
ttatgttttttgtaccatctga

SEQ ID NO: 835402 - DNA, 22 bp, Artificial Sequence
  chemically synthesized
tgttttttgtaccatctgagat

SEQ ID NO: 835403 - DNA, 22 bp, Artificial Sequence
  chemically synthesized
tttgtaccatctgagatgaatt

SEQ ID NO: 835404 - DNA, 22 bp, Artificial Sequence
  chemically synthesized
ttgtaccatctgagatgaattg

SEQ ID NO: 835405 - DNA, 22 bp, Artificial Sequence
  chemically synthesized
tgtaccatctgagatgaattgt

SEQ ID NO: 835406 - DNA, 22 bp, Artificial Sequence
  chemically synthesized
gtaccatctgagatgaattgtc

SEQ ID NO: 835407 - DNA, 22 bp, Artificial Sequence
  chemically synthesized
taccatctgagatgaattgtct

SEQ ID NO: 835408 - DNA, 22 bp, Artificial Sequence
  chemically synthesized
atagaaacagagaaacagacaa

SEQ ID NO: 835409 - DNA, 22 bp, Artificial Sequence
  chemically synthesized
agatgaattgtctgtttctctg

SEQ ID NO: 835410 - DNA, 22 bp, Artificial Sequence
  chemically synthesized
aaaatattaatagaaacagaga

SEQ ID NO: 835411 - DNA, 22 bp, Artificial Sequence
  chemically synthesized
aaaaatattaatagaaacagag

SEQ ID NO: 835412 - DNA, 22 bp, Artificial Sequence
  chemically synthesized
tctgtttctctgtttctattaa

SEQ ID NO: 835413 - DNA, 22 bp, Artificial Sequence
  chemically synthesized
tttctctgtttctattaatatt

SEQ ID NO: 835414 - DNA, 22 bp, Artificial Sequence
  chemically synthesized
gatgaccttaaaaatattaata

SEQ ID NO: 835415 - DNA, 22 bp, Artificial Sequence
  chemically synthesized
tagatgaccttaaaaatattaa

SEQ ID NO: 835416 - DNA, 22 bp, Artificial Sequence
  chemically synthesized
ctctgtttctattaatattttt

SEQ ID NO: 835417 - DNA, 22 bp, Artificial Sequence
  chemically synthesized
tctgtttctattaatattttta

SEQ ID NO: 835418 - DNA, 22 bp, Artificial Sequence
  chemically synthesized
ttctagatgaccttaaaaatat

SEQ ID NO: 835419 - DNA, 22 bp, Artificial Sequence
  chemically synthesized
tgtttctattaatatttttaag

SEQ ID NO: 835420 - DNA, 22 bp, Artificial Sequence
  chemically synthesized
tttctattaatatttttaaggt

SEQ ID NO: 835421 - DNA, 22 bp, Artificial Sequence
  chemically synthesized
ctattctagatgaccttaaaaa

SEQ ID NO: 835422 - DNA, 22 bp, Artificial Sequence
  chemically synthesized
actattctagatgaccttaaaa

SEQ ID NO: 835423 - DNA, 22 bp, Artificial Sequence
  chemically synthesized
tactattctagatgaccttaaa

SEQ ID NO: 835424 - DNA, 22 bp, Artificial Sequence
  chemically synthesized
ctattaatatttttaaggtcat

SEQ ID NO: 835425 - DNA, 22 bp, Artificial Sequence
  chemically synthesized
tattaatatttttaaggtcatc

SEQ ID NO: 835426 - DNA, 22 bp, Artificial Sequence
  chemically synthesized
ttaatatttttaaggtcatcta

SEQ ID NO: 835427 - DNA, 22 bp, Artificial Sequence
  chemically synthesized
atatttttaaggtcatctagaa

SEQ ID NO: 835428 - DNA, 22 bp, Artificial Sequence
  chemically synthesized
cccatctttactattctagatg

SEQ ID NO: 835429 - DNA, 22 bp, Artificial Sequence
  chemically synthesized
ttaaggtcatctagaatagtaa

SEQ ID NO: 835430 - DNA, 22 bp, Artificial Sequence
  chemically synthesized
taaggtcatctagaatagtaaa

SEQ ID NO: 835431 - DNA, 22 bp, Artificial Sequence
  chemically synthesized
aaggtcatctagaatagtaaag

SEQ ID NO: 835432 - DNA, 22 bp, Artificial Sequence
  chemically synthesized
aggtcatctagaatagtaaaga

SEQ ID NO: 835433 - DNA, 22 bp, Artificial Sequence
  chemically synthesized
cataaactacccatctttacta

SEQ ID NO: 835434 - DNA, 22 bp, Artificial Sequence
  chemically synthesized
gaatagtaaagatgggtagttt

SEQ ID NO: 835435 - DNA, 22 bp, Artificial Sequence
  chemically synthesized
agtgagaaaagctacataaact

SEQ ID NO: 835436 - DNA, 22 bp, Artificial Sequence
  chemically synthesized
aagtgagaaaagctacataaac

SEQ ID NO: 835437 - DNA, 22 bp, Artificial Sequence
  chemically synthesized
cttaagtgagaaaagctacata

SEQ ID NO: 835438 - DNA, 22 bp, Artificial Sequence
  chemically synthesized
ccttaagtgagaaaagctacat

SEQ ID NO: 835439 - DNA, 22 bp, Artificial Sequence
  chemically synthesized
atgtagcttttctcacttaagg

SEQ ID NO: 835440 - DNA, 22 bp, Artificial Sequence
  chemically synthesized
tgtagcttttctcacttaagga

SEQ ID NO: 835441 - DNA, 22 bp, Artificial Sequence
  chemically synthesized
tgaaaggatgcttccttaagtg

SEQ ID NO: 835442 - DNA, 22 bp, Artificial Sequence
  chemically synthesized
ttctcacttaaggaagcatcct

SEQ ID NO: 835443 - DNA, 22 bp, Artificial Sequence
  chemically synthesized
tctcacttaaggaagcatcctt

SEQ ID NO: 835444 - DNA, 22 bp, Artificial Sequence
  chemically synthesized
ctcacttaaggaagcatccttt

SEQ ID NO: 835445 - DNA, 22 bp, Artificial Sequence
  chemically synthesized
tcacttaaggaagcatcctttc

SEQ ID NO: 835446 - DNA, 22 bp, Artificial Sequence
  chemically synthesized
acttaaggaagcatcctttcat

SEQ ID NO: 835447 - DNA, 22 bp, Artificial Sequence
  chemically synthesized
aaggaagcatcctttcataatg

SEQ ID NO: 835448 - DNA, 22 bp, Artificial Sequence
  chemically synthesized
aggaagcatcctttcataatgc

SEQ ID NO: 835449 - DNA, 22 bp, Artificial Sequence
  chemically synthesized
ggagaagggtaataaagcatta

SEQ ID NO: 835450 - DNA, 22 bp, Artificial Sequence
  chemically synthesized
tcataatgctttattacccttc

SEQ ID NO: 835451 - DNA, 22 bp, Artificial Sequence
  chemically synthesized
cataatgctttattacccttct

SEQ ID NO: 835452 - DNA, 22 bp, Artificial Sequence
  chemically synthesized
ataatgctttattacccttctc

SEQ ID NO: 835453 - DNA, 22 bp, Artificial Sequence
  chemically synthesized
aaagtgatagaattgggagaag

SEQ ID NO: 835454 - DNA, 22 bp, Artificial Sequence
  chemically synthesized
ttcaaagtgatagaattgggag

SEQ ID NO: 835455 - DNA, 22 bp, Artificial Sequence
  chemically synthesized
tattacccttctcccaattcta

SEQ ID NO: 835456 - DNA, 22 bp, Artificial Sequence
  chemically synthesized
attacccttctcccaattctat

SEQ ID NO: 835457 - DNA, 22 bp, Artificial Sequence
  chemically synthesized
ttgttcaaagtgatagaattgg

SEQ ID NO: 835458 - DNA, 22 bp, Artificial Sequence
  chemically synthesized
ttacccttctcccaattctatc

SEQ ID NO: 835459 - DNA, 22 bp, Artificial Sequence
  chemically synthesized
cccttctcccaattctatcact

SEQ ID NO: 835460 - DNA, 22 bp, Artificial Sequence
  chemically synthesized
ctcccaattctatcactttgaa

SEQ ID NO: 835461 - DNA, 22 bp, Artificial Sequence
  chemically synthesized
tcccaattctatcactttgaac

SEQ ID NO: 835462 - DNA, 22 bp, Artificial Sequence
  chemically synthesized
ccaattctatcactttgaacaa

SEQ ID NO: 835463 - DNA, 22 bp, Artificial Sequence
  chemically synthesized
tatcactttgaacaataatcta

SEQ ID NO: 835464 - DNA, 22 bp, Artificial Sequence
  chemically synthesized
tcactttgaacaataatctatc

SEQ ID NO: 835465 - DNA, 22 bp, Artificial Sequence
  chemically synthesized
tccagaagaccaaatgatagat

SEQ ID NO: 835466 - DNA, 22 bp, Artificial Sequence
  chemically synthesized
tgaacaataatctatcatttgg

SEQ ID NO: 835467 - DNA, 22 bp, Artificial Sequence
  chemically synthesized
gaacaataatctatcatttggt

SEQ ID NO: 835468 - DNA, 22 bp, Artificial Sequence
  chemically synthesized
aacaataatctatcatttggtc

SEQ ID NO: 835469 - DNA, 22 bp, Artificial Sequence
  chemically synthesized
cccagtgaggactatccagaag

SEQ ID NO: 835470 - DNA, 22 bp, Artificial Sequence
  chemically synthesized
tcatttggtcttctggatagtc

SEQ ID NO: 835471 - DNA, 22 bp, Artificial Sequence
  chemically synthesized
ggtcttctggatagtcctcact

SEQ ID NO: 835472 - DNA, 22 bp, Artificial Sequence
  chemically synthesized
gtcttctggatagtcctcactg

SEQ ID NO: 835473 - DNA, 22 bp, Artificial Sequence
  chemically synthesized
ggggtgtcctccccagtgagga

SEQ ID NO: 835474 - DNA, 22 bp, Artificial Sequence
  chemically synthesized
ctggatagtcctcactggggag

SEQ ID NO: 835475 - DNA, 22 bp, Artificial Sequence
  chemically synthesized
tggatagtcctcactggggagg

SEQ ID NO: 835476 - DNA, 22 bp, Artificial Sequence
  chemically synthesized
gatagtcctcactggggaggac

SEQ ID NO: 835477 - DNA, 22 bp, Artificial Sequence
  chemically synthesized
actggggaggacaccccgaaca

SEQ ID NO: 835478 - DNA, 22 bp, Artificial Sequence
  chemically synthesized
gggaggacaccccgaacacatt

SEQ ID NO: 835479 - DNA, 22 bp, Artificial Sequence
  chemically synthesized
gcaggaaaatcaataatggtaa

SEQ ID NO: 835480 - DNA, 22 bp, Artificial Sequence
  chemically synthesized
caacaagactggcaggaaaatc

SEQ ID NO: 835481 - DNA, 22 bp, Artificial Sequence
  chemically synthesized
acaacaagactggcaggaaaat

SEQ ID NO: 835482 - DNA, 22 bp, Artificial Sequence
  chemically synthesized
tacaacaagactggcaggaaaa

SEQ ID NO: 835483 - DNA, 22 bp, Artificial Sequence
  chemically synthesized
ccattattgattttcctgccag

SEQ ID NO: 835484 - DNA, 22 bp, Artificial Sequence
  chemically synthesized
ttttacaacaagactggcagga

SEQ ID NO: 835485 - DNA, 22 bp, Artificial Sequence
  chemically synthesized
ttattttacaacaagactggca

SEQ ID NO: 835486 - DNA, 22 bp, Artificial Sequence
  chemically synthesized
ttgattttcctgccagtcttgt

SEQ ID NO: 835487 - DNA, 22 bp, Artificial Sequence
  chemically synthesized
attttcctgccagtcttgttgt

SEQ ID NO: 835488 - DNA, 22 bp, Artificial Sequence
  chemically synthesized
aaactattattttacaacaaga

SEQ ID NO: 835489 - DNA, 22 bp, Artificial Sequence
  chemically synthesized
tcctgccagtcttgttgtaaaa

SEQ ID NO: 835490 - DNA, 22 bp, Artificial Sequence
  chemically synthesized
cctgccagtcttgttgtaaaat

SEQ ID NO: 835491 - DNA, 22 bp, Artificial Sequence
  chemically synthesized
ctgccagtcttgttgtaaaata

SEQ ID NO: 835492 - DNA, 22 bp, Artificial Sequence
  chemically synthesized
ccagtcttgttgtaaaataata

SEQ ID NO: 835493 - DNA, 22 bp, Artificial Sequence
  chemically synthesized
gttgtaaaataatagtttgaat

SEQ ID NO: 835494 - DNA, 22 bp, Artificial Sequence
  chemically synthesized
ttgtaaaataatagtttgaatt

SEQ ID NO: 835495 - DNA, 22 bp, Artificial Sequence
  chemically synthesized
aaagaagaaataataattcaaa

SEQ ID NO: 835496 - DNA, 22 bp, Artificial Sequence
  chemically synthesized
taaaataatagtttgaattatt

SEQ ID NO: 835497 - DNA, 22 bp, Artificial Sequence
  chemically synthesized
gaaagaagaaataataattcaa

SEQ ID NO: 835498 - DNA, 22 bp, Artificial Sequence
  chemically synthesized
taaaccatttgaaagaagaaat

SEQ ID NO: 835499 - DNA, 22 bp, Artificial Sequence
  chemically synthesized
ataaaccatttgaaagaagaaa

SEQ ID NO: 835500 - DNA, 22 bp, Artificial Sequence
  chemically synthesized
gaattattatttcttctttcaa

SEQ ID NO: 835501 - DNA, 22 bp, Artificial Sequence
  chemically synthesized
aattattatttcttctttcaaa

SEQ ID NO: 835502 - DNA, 22 bp, Artificial Sequence
  chemically synthesized
gtttataaaccatttgaaagaa

SEQ ID NO: 835503 - DNA, 22 bp, Artificial Sequence
  chemically synthesized
ttatttcttctttcaaatggtt

SEQ ID NO: 835504 - DNA, 22 bp, Artificial Sequence
  chemically synthesized
tttcttctttcaaatggtttat

SEQ ID NO: 835505 - DNA, 22 bp, Artificial Sequence
  chemically synthesized
cttctttcaaatggtttataaa

SEQ ID NO: 835506 - DNA, 22 bp, Artificial Sequence
  chemically synthesized
acaaggcactggtttataaacc

SEQ ID NO: 835507 - DNA, 22 bp, Artificial Sequence
  chemically synthesized
ttctttcaaatggtttataaac

SEQ ID NO: 835508 - DNA, 22 bp, Artificial Sequence
  chemically synthesized
ctttcaaatggtttataaacca

SEQ ID NO: 835509 - DNA, 22 bp, Artificial Sequence
  chemically synthesized
tttcaaatggtttataaaccag

SEQ ID NO: 835510 - DNA, 22 bp, Artificial Sequence
  chemically synthesized
tcaaatggtttataaaccagtg

SEQ ID NO: 835511 - DNA, 22 bp, Artificial Sequence
  chemically synthesized
caaatggtttataaaccagtgc

SEQ ID NO: 835512 - DNA, 22 bp, Artificial Sequence
  chemically synthesized
aaatggtttataaaccagtgcc

SEQ ID NO: 835513 - DNA, 22 bp, Artificial Sequence
  chemically synthesized
cacaaactcacaaggcactggt

SEQ ID NO: 835514 - DNA, 22 bp, Artificial Sequence
  chemically synthesized
atgctacacaaactcacaaggc

SEQ ID NO: 835515 - DNA, 22 bp, Artificial Sequence
  chemically synthesized
ataaaccagtgccttgtgagtt

SEQ ID NO: 835516 - DNA, 22 bp, Artificial Sequence
  chemically synthesized
taaaccagtgccttgtgagttt

SEQ ID NO: 835517 - DNA, 22 bp, Artificial Sequence
  chemically synthesized
attcatgctacacaaactcaca

SEQ ID NO: 835518 - DNA, 22 bp, Artificial Sequence
  chemically synthesized
ggagactgattcatgctacaca

SEQ ID NO: 835519 - DNA, 22 bp, Artificial Sequence
  chemically synthesized
tgggagactgattcatgctaca

SEQ ID NO: 835520 - DNA, 22 bp, Artificial Sequence
  chemically synthesized
gtgagtttgtgtagcatgaatc

SEQ ID NO: 835521 - DNA, 22 bp, Artificial Sequence
  chemically synthesized
tgagtttgtgtagcatgaatca

SEQ ID NO: 835522 - DNA, 22 bp, Artificial Sequence
  chemically synthesized
gtgtagcatgaatcagtctccc

SEQ ID NO: 835523 - DNA, 22 bp, Artificial Sequence
  chemically synthesized
tgtagcatgaatcagtctccca

SEQ ID NO: 835524 - DNA, 22 bp, Artificial Sequence
  chemically synthesized
gagatgatcaggctctgggaga

SEQ ID NO: 835525 - DNA, 22 bp, Artificial Sequence
  chemically synthesized
cctagagatgatcaggctctgg

SEQ ID NO: 835526 - DNA, 22 bp, Artificial Sequence
  chemically synthesized
acctagagatgatcaggctctg

SEQ ID NO: 835527 - DNA, 22 bp, Artificial Sequence
  chemically synthesized
gtagtttacctagagatgatca

SEQ ID NO: 835528 - DNA, 22 bp, Artificial Sequence
  chemically synthesized
agtagtttacctagagatgatc

SEQ ID NO: 835529 - DNA, 22 bp, Artificial Sequence
  chemically synthesized
tagtagtttacctagagatgat

SEQ ID NO: 835530 - DNA, 22 bp, Artificial Sequence
  chemically synthesized
ccagagcctgatcatctctagg

SEQ ID NO: 835531 - DNA, 22 bp, Artificial Sequence
  chemically synthesized
aattttagtagtttacctagag

SEQ ID NO: 835532 - DNA, 22 bp, Artificial Sequence
  chemically synthesized
atcatctctaggtaaactacta

SEQ ID NO: 835533 - DNA, 22 bp, Artificial Sequence
  chemically synthesized
taggtaaactactaaaatttag

SEQ ID NO: 835534 - DNA, 22 bp, Artificial Sequence
  chemically synthesized
catagccaacaactaaatttta

SEQ ID NO: 835535 - DNA, 22 bp, Artificial Sequence
  chemically synthesized
gcatagccaacaactaaatttt

SEQ ID NO: 835536 - DNA, 22 bp, Artificial Sequence
  chemically synthesized
ggtaaactactaaaatttagtt

SEQ ID NO: 835537 - DNA, 22 bp, Artificial Sequence
  chemically synthesized
tgcatagccaacaactaaattt

SEQ ID NO: 835538 - DNA, 22 bp, Artificial Sequence
  chemically synthesized
agttttgcatagccaacaacta

SEQ ID NO: 835539 - DNA, 22 bp, Artificial Sequence
  chemically synthesized
ctaaaatttagttgttggctat

SEQ ID NO: 835540 - DNA, 22 bp, Artificial Sequence
  chemically synthesized
aaatttagttgttggctatgca

SEQ ID NO: 835541 - DNA, 22 bp, Artificial Sequence
  chemically synthesized
agttgttggctatgcaaaactg

SEQ ID NO: 835542 - DNA, 22 bp, Artificial Sequence
  chemically synthesized
atgtccaatcctcagttttgca

SEQ ID NO: 835543 - DNA, 22 bp, Artificial Sequence
  chemically synthesized
gttgttggctatgcaaaactga

SEQ ID NO: 835544 - DNA, 22 bp, Artificial Sequence
  chemically synthesized
aatgtccaatcctcagttttgc

SEQ ID NO: 835545 - DNA, 22 bp, Artificial Sequence
  chemically synthesized
ttggctatgcaaaactgaggat

SEQ ID NO: 835546 - DNA, 22 bp, Artificial Sequence
  chemically synthesized
gctatgcaaaactgaggattgg

SEQ ID NO: 835547 - DNA, 22 bp, Artificial Sequence
  chemically synthesized
tcgtagatttaatgtccaatcc

SEQ ID NO: 835548 - DNA, 22 bp, Artificial Sequence
  chemically synthesized
tgcaaaactgaggattggacat

SEQ ID NO: 835549 - DNA, 22 bp, Artificial Sequence
  chemically synthesized
aggattggacattaaatctacg

SEQ ID NO: 835550 - DNA, 22 bp, Artificial Sequence
  chemically synthesized
gacattaaatctacgacaactc

SEQ ID NO: 835551 - DNA, 22 bp, Artificial Sequence
  chemically synthesized
atatcatatagcagagttgtcg

SEQ ID NO: 835552 - DNA, 22 bp, Artificial Sequence
  chemically synthesized
aatctacgacaactctgctata

SEQ ID NO: 835553 - DNA, 22 bp, Artificial Sequence
  chemically synthesized
atagagttcatatcatatagca

SEQ ID NO: 835554 - DNA, 22 bp, Artificial Sequence
  chemically synthesized
cgacaactctgctatatgatat

SEQ ID NO: 835555 - DNA, 22 bp, Artificial Sequence
  chemically synthesized
tgctatatgatatgaactctat

SEQ ID NO: 835556 - DNA, 22 bp, Artificial Sequence
  chemically synthesized
ctatatgatatgaactctatca

SEQ ID NO: 835557 - DNA, 22 bp, Artificial Sequence
  chemically synthesized
cataaagaggtcattgatagag

SEQ ID NO: 835558 - DNA, 22 bp, Artificial Sequence
  chemically synthesized
tatgatatgaactctatcaatg

SEQ ID NO: 835559 - DNA, 22 bp, Artificial Sequence
  chemically synthesized
aggaaggactgcataaagaggt

SEQ ID NO: 835560 - DNA, 22 bp, Artificial Sequence
  chemically synthesized
caggaaggactgcataaagagg

SEQ ID NO: 835561 - DNA, 22 bp, Artificial Sequence
  chemically synthesized
tatcaatgacctctttatgcag

SEQ ID NO: 835562 - DNA, 22 bp, Artificial Sequence
  chemically synthesized
tcaatgacctctttatgcagtc

SEQ ID NO: 835563 - DNA, 22 bp, Artificial Sequence
  chemically synthesized
tttatgcagtccttcctgaaat

SEQ ID NO: 835564 - DNA, 22 bp, Artificial Sequence
  chemically synthesized
tatgcagtccttcctgaaatga

SEQ ID NO: 835565 - DNA, 22 bp, Artificial Sequence
  chemically synthesized
atgcagtccttcctgaaatgat

SEQ ID NO: 835566 - DNA, 22 bp, Artificial Sequence
  chemically synthesized
tgcagtccttcctgaaatgatt

SEQ ID NO: 835567 - DNA, 22 bp, Artificial Sequence
  chemically synthesized
aaaaatgatgatataaatcatt

SEQ ID NO: 835568 - DNA, 22 bp, Artificial Sequence
  chemically synthesized
aaaaaatgatgatataaatcat

SEQ ID NO: 835569 - DNA, 22 bp, Artificial Sequence
  chemically synthesized
taaaaaatgatgatataaatca

SEQ ID NO: 835570 - DNA, 22 bp, Artificial Sequence
  chemically synthesized
ttaaaaaatgatgatataaatc

SEQ ID NO: 835571 - DNA, 22 bp, Artificial Sequence
  chemically synthesized
tttttaaaaaatgatgatataa

SEQ ID NO: 835572 - DNA, 22 bp, Artificial Sequence
  chemically synthesized
cctgaaatgatttatatcatca

SEQ ID NO: 835573 - DNA, 22 bp, Artificial Sequence
  chemically synthesized
ctgaaatgatttatatcatcat

SEQ ID NO: 835574 - DNA, 22 bp, Artificial Sequence
  chemically synthesized
aaatgatttatatcatcatttt

SEQ ID NO: 835575 - DNA, 22 bp, Artificial Sequence
  chemically synthesized
atgattatttttaaaaaatgat

SEQ ID NO: 835576 - DNA, 22 bp, Artificial Sequence
  chemically synthesized
aggttaatgattatttttaaaa

SEQ ID NO: 835577 - DNA, 22 bp, Artificial Sequence
  chemically synthesized
atatcatcattttttaaaaata

SEQ ID NO: 835578 - DNA, 22 bp, Artificial Sequence
  chemically synthesized
caggttaatgattatttttaaa

SEQ ID NO: 835579 - DNA, 22 bp, Artificial Sequence
  chemically synthesized
tatcatcattttttaaaaataa

SEQ ID NO: 835580 - DNA, 22 bp, Artificial Sequence
  chemically synthesized
ttcaggttaatgattattttta

SEQ ID NO: 835581 - DNA, 22 bp, Artificial Sequence
  chemically synthesized
cttcaggttaatgattattttt

SEQ ID NO: 835582 - DNA, 22 bp, Artificial Sequence
  chemically synthesized
tcttcaggttaatgattatttt

SEQ ID NO: 835583 - DNA, 22 bp, Artificial Sequence
  chemically synthesized
tttcttcaggttaatgattatt

SEQ ID NO: 835584 - DNA, 22 bp, Artificial Sequence
  chemically synthesized
tttaaaaataatcattaacctg

SEQ ID NO: 835585 - DNA, 22 bp, Artificial Sequence
  chemically synthesized
ttaaaaataatcattaacctga

SEQ ID NO: 835586 - DNA, 22 bp, Artificial Sequence
  chemically synthesized
taaaaataatcattaacctgaa

SEQ ID NO: 835587 - DNA, 22 bp, Artificial Sequence
  chemically synthesized
atatactctttcttcaggttaa

SEQ ID NO: 835588 - DNA, 22 bp, Artificial Sequence
  chemically synthesized
aaaaataatcattaacctgaag

SEQ ID NO: 835589 - DNA, 22 bp, Artificial Sequence
  chemically synthesized
aatatactctttcttcaggtta

SEQ ID NO: 835590 - DNA, 22 bp, Artificial Sequence
  chemically synthesized
aaaataatcattaacctgaaga

SEQ ID NO: 835591 - DNA, 22 bp, Artificial Sequence
  chemically synthesized
gaatatcttaatatactctttc

SEQ ID NO: 835592 - DNA, 22 bp, Artificial Sequence
  chemically synthesized
ggaatatcttaatatactcttt

SEQ ID NO: 835593 - DNA, 22 bp, Artificial Sequence
  chemically synthesized
acctgaagaaagagtatattaa

SEQ ID NO: 835594 - DNA, 22 bp, Artificial Sequence
  chemically synthesized
atggatttggaatatcttaata

SEQ ID NO: 835595 - DNA, 22 bp, Artificial Sequence
  chemically synthesized
aagaaagagtatattaagatat

SEQ ID NO: 835596 - DNA, 22 bp, Artificial Sequence
  chemically synthesized
tgtatctcatggatttggaata

SEQ ID NO: 835597 - DNA, 22 bp, Artificial Sequence
  chemically synthesized
agatattccaaatccatgagat

SEQ ID NO: 835598 - DNA, 22 bp, Artificial Sequence
  chemically synthesized
caaatccatgagatacatagca

SEQ ID NO: 835599 - DNA, 22 bp, Artificial Sequence
  chemically synthesized
gaatatgggtaaaatcaaggaa

SEQ ID NO: 835600 - DNA, 22 bp, Artificial Sequence
  chemically synthesized
agaatatgggtaaaatcaagga

SEQ ID NO: 835601 - DNA, 22 bp, Artificial Sequence
  chemically synthesized
aatgtttagaatatgggtaaaa

SEQ ID NO: 835602 - DNA, 22 bp, Artificial Sequence
  chemically synthesized
tttccttgattttacccatatt

SEQ ID NO: 835603 - DNA, 22 bp, Artificial Sequence
  chemically synthesized
ttccttgattttacccatattc

SEQ ID NO: 835604 - DNA, 22 bp, Artificial Sequence
  chemically synthesized
tccttgattttacccatattct

SEQ ID NO: 835605 - DNA, 22 bp, Artificial Sequence
  chemically synthesized
ccttgattttacccatattcta

SEQ ID NO: 835606 - DNA, 22 bp, Artificial Sequence
  chemically synthesized
atattgaatgtttagaatatgg

SEQ ID NO: 835607 - DNA, 22 bp, Artificial Sequence
  chemically synthesized
cttgattttacccatattctaa

SEQ ID NO: 835608 - DNA, 22 bp, Artificial Sequence
  chemically synthesized
ttaatattgaatgtttagaata

SEQ ID NO: 835609 - DNA, 22 bp, Artificial Sequence
  chemically synthesized
gattttacccatattctaaaca

SEQ ID NO: 835610 - DNA, 22 bp, Artificial Sequence
  chemically synthesized
attttacccatattctaaacat

SEQ ID NO: 835611 - DNA, 22 bp, Artificial Sequence
  chemically synthesized
tacccatattctaaacattcaa

SEQ ID NO: 835612 - DNA, 22 bp, Artificial Sequence
  chemically synthesized
acccatattctaaacattcaat

SEQ ID NO: 835613 - DNA, 22 bp, Artificial Sequence
  chemically synthesized
atgcctgttaatattgaatgtt

SEQ ID NO: 835614 - DNA, 22 bp, Artificial Sequence
  chemically synthesized
cccatattctaaacattcaata

SEQ ID NO: 835615 - DNA, 22 bp, Artificial Sequence
  chemically synthesized
aatgcctgttaatattgaatgt

SEQ ID NO: 835616 - DNA, 22 bp, Artificial Sequence
  chemically synthesized
ttaatgcctgttaatattgaat

SEQ ID NO: 835617 - DNA, 22 bp, Artificial Sequence
  chemically synthesized
attcttaatgcctgttaatatt

SEQ ID NO: 835618 - DNA, 22 bp, Artificial Sequence
  chemically synthesized
gattcttaatgcctgttaatat

SEQ ID NO: 835619 - DNA, 22 bp, Artificial Sequence
  chemically synthesized
taaacattcaatattaacaggc

SEQ ID NO: 835620 - DNA, 22 bp, Artificial Sequence
  chemically synthesized
ttgattcttaatgcctgttaat

SEQ ID NO: 835621 - DNA, 22 bp, Artificial Sequence
  chemically synthesized
aacattcaatattaacaggcat

SEQ ID NO: 835622 - DNA, 22 bp, Artificial Sequence
  chemically synthesized
aatattaacaggcattaagaat

SEQ ID NO: 835623 - DNA, 22 bp, Artificial Sequence
  chemically synthesized
acaggcattaagaatcaagaac

SEQ ID NO: 835624 - DNA, 22 bp, Artificial Sequence
  chemically synthesized
tcaatagtcaaagagttcttga

SEQ ID NO: 835625 - DNA, 22 bp, Artificial Sequence
  chemically synthesized
agaatcaagaactctttgacta

SEQ ID NO: 835626 - DNA, 22 bp, Artificial Sequence
  chemically synthesized
agtatgacctatcaatagtcaa

SEQ ID NO: 835627 - DNA, 22 bp, Artificial Sequence
  chemically synthesized
tattgagtatgacctatcaata

SEQ ID NO: 835628 - DNA, 22 bp, Artificial Sequence
  chemically synthesized
atattgagtatgacctatcaat

SEQ ID NO: 835629 - DNA, 22 bp, Artificial Sequence
  chemically synthesized
tatattgagtatgacctatcaa

SEQ ID NO: 835630 - DNA, 22 bp, Artificial Sequence
  chemically synthesized
tttgactattgataggtcatac

SEQ ID NO: 835631 - DNA, 22 bp, Artificial Sequence
  chemically synthesized
tgactattgataggtcatactc

SEQ ID NO: 835632 - DNA, 22 bp, Artificial Sequence
  chemically synthesized
gactattgataggtcatactca

SEQ ID NO: 835633 - DNA, 22 bp, Artificial Sequence
  chemically synthesized
actattgataggtcatactcaa

SEQ ID NO: 835634 - DNA, 22 bp, Artificial Sequence
  chemically synthesized
ttgataggtcatactcaatata

SEQ ID NO: 835635 - DNA, 22 bp, Artificial Sequence
  chemically synthesized
ataggtcatactcaatataaaa

SEQ ID NO: 835636 - DNA, 22 bp, Artificial Sequence
  chemically synthesized
gagccaatcaaacagtatttta

SEQ ID NO: 835637 - DNA, 22 bp, Artificial Sequence
  chemically synthesized
gtctggagccaatcaaacagta

SEQ ID NO: 835638 - DNA, 22 bp, Artificial Sequence
  chemically synthesized
ggtctggagccaatcaaacagt

SEQ ID NO: 835639 - DNA, 22 bp, Artificial Sequence
  chemically synthesized
tggtctggagccaatcaaacag

SEQ ID NO: 835640 - DNA, 22 bp, Artificial Sequence
  chemically synthesized
aatataaaatactgtttgattg

SEQ ID NO: 835641 - DNA, 22 bp, Artificial Sequence
  chemically synthesized
ttggtctggagccaatcaaaca

SEQ ID NO: 835642 - DNA, 22 bp, Artificial Sequence
  chemically synthesized
tttggtctggagccaatcaaac

SEQ ID NO: 835643 - DNA, 22 bp, Artificial Sequence
  chemically synthesized
ttttggtctggagccaatcaaa

SEQ ID NO: 835644 - DNA, 22 bp, Artificial Sequence
  chemically synthesized
tttttggtctggagccaatcaa

SEQ ID NO: 835645 - DNA, 22 bp, Artificial Sequence
  chemically synthesized
ttttttggtctggagccaatca

SEQ ID NO: 835646 - DNA, 22 bp, Artificial Sequence
  chemically synthesized
tttttttggtctggagccaatc

SEQ ID NO: 835647 - DNA, 22 bp, Artificial Sequence
  chemically synthesized
ttttttttggtctggagccaat

SEQ ID NO: 835648 - DNA, 22 bp, Artificial Sequence
  chemically synthesized
tttttttttggtctggagccaa

SEQ ID NO: 835649 - DNA, 22 bp, Artificial Sequence
  chemically synthesized
tttgattggctccagaccaaaa

SEQ ID NO: 835650 - DNA, 22 bp, Artificial Sequence
  chemically synthesized
caaaacctttttttttttggtc

SEQ ID NO: 835651 - DNA, 22 bp, Artificial Sequence
  chemically synthesized
gattggctccagaccaaaaaaa

SEQ ID NO: 835652 - DNA, 22 bp, Artificial Sequence
  chemically synthesized
acaaaacctttttttttttggt

SEQ ID NO: 835653 - DNA, 22 bp, Artificial Sequence
  chemically synthesized
attggctccagaccaaaaaaaa

SEQ ID NO: 835654 - DNA, 22 bp, Artificial Sequence
  chemically synthesized
tacaaaacctttttttttttgg

SEQ ID NO: 835655 - DNA, 22 bp, Artificial Sequence
  chemically synthesized
gctccagaccaaaaaaaaaaag

SEQ ID NO: 835656 - DNA, 22 bp, Artificial Sequence
  chemically synthesized
cagaccaaaaaaaaaaaggttt

SEQ ID NO: 835657 - DNA, 22 bp, Artificial Sequence
  chemically synthesized
taaagacatgaaaagggcacaa

SEQ ID NO: 835658 - DNA, 22 bp, Artificial Sequence
  chemically synthesized
ataaagacatgaaaagggcaca

SEQ ID NO: 835659 - DNA, 22 bp, Artificial Sequence
  chemically synthesized
tataaagacatgaaaagggcac

SEQ ID NO: 835660 - DNA, 22 bp, Artificial Sequence
  chemically synthesized
tgtaaaattgtgcccttttcat

SEQ ID NO: 835661 - DNA, 22 bp, Artificial Sequence
  chemically synthesized
gtaaaattgtgcccttttcatg

SEQ ID NO: 835662 - DNA, 22 bp, Artificial Sequence
  chemically synthesized
taaaattgtgcccttttcatgt

SEQ ID NO: 835663 - DNA, 22 bp, Artificial Sequence
  chemically synthesized
ggaactttataaagacatgaaa

SEQ ID NO: 835664 - DNA, 22 bp, Artificial Sequence
  chemically synthesized
taggaactttataaagacatga

SEQ ID NO: 835665 - DNA, 22 bp, Artificial Sequence
  chemically synthesized
tgcccttttcatgtctttataa

SEQ ID NO: 835666 - DNA, 22 bp, Artificial Sequence
  chemically synthesized
ttcatgtctttataaagttcct

SEQ ID NO: 835667 - DNA, 22 bp, Artificial Sequence
  chemically synthesized
tcatgtctttataaagttccta

SEQ ID NO: 835668 - DNA, 22 bp, Artificial Sequence
  chemically synthesized
catgtctttataaagttcctag

SEQ ID NO: 835669 - DNA, 22 bp, Artificial Sequence
  chemically synthesized
atgtctttataaagttcctaga

SEQ ID NO: 835670 - DNA, 22 bp, Artificial Sequence
  chemically synthesized
agaataacagaaataaactcta

SEQ ID NO: 835671 - DNA, 22 bp, Artificial Sequence
  chemically synthesized
tataaagttcctagagtttatt

SEQ ID NO: 835672 - DNA, 22 bp, Artificial Sequence
  chemically synthesized
gagaataacagaaataaactct

SEQ ID NO: 835673 - DNA, 22 bp, Artificial Sequence
  chemically synthesized
ataaagttcctagagtttattt

SEQ ID NO: 835674 - DNA, 22 bp, Artificial Sequence
  chemically synthesized
tgagaataacagaaataaactc

SEQ ID NO: 835675 - DNA, 22 bp, Artificial Sequence
  chemically synthesized
taaagttcctagagtttatttc

SEQ ID NO: 835676 - DNA, 22 bp, Artificial Sequence
  chemically synthesized
ctagagtttatttctgttattc

SEQ ID NO: 835677 - DNA, 22 bp, Artificial Sequence
  chemically synthesized
aggaaacattttgagaataaca

SEQ ID NO: 835678 - DNA, 22 bp, Artificial Sequence
  chemically synthesized
gagtttatttctgttattctca

SEQ ID NO: 835679 - DNA, 22 bp, Artificial Sequence
  chemically synthesized
ctgaggaaacattttgagaata

SEQ ID NO: 835680 - DNA, 22 bp, Artificial Sequence
  chemically synthesized
tcctgaggaaacattttgagaa

SEQ ID NO: 835681 - DNA, 22 bp, Artificial Sequence
  chemically synthesized
atttctgttattctcaaaatgt

SEQ ID NO: 835682 - DNA, 22 bp, Artificial Sequence
  chemically synthesized
tttctgttattctcaaaatgtt

SEQ ID NO: 835683 - DNA, 22 bp, Artificial Sequence
  chemically synthesized
aattctcctgaggaaacatttt

SEQ ID NO: 835684 - DNA, 22 bp, Artificial Sequence
  chemically synthesized
ctgttattctcaaaatgtttcc

SEQ ID NO: 835685 - DNA, 22 bp, Artificial Sequence
  chemically synthesized
tgttattctcaaaatgtttcct

SEQ ID NO: 835686 - DNA, 22 bp, Artificial Sequence
  chemically synthesized
ctaaattctcctgaggaaacat

SEQ ID NO: 835687 - DNA, 22 bp, Artificial Sequence
  chemically synthesized
ttattctcaaaatgtttcctca

SEQ ID NO: 835688 - DNA, 22 bp, Artificial Sequence
  chemically synthesized
ttctcaaaatgtttcctcagga

SEQ ID NO: 835689 - DNA, 22 bp, Artificial Sequence
  chemically synthesized
tcaaaatgtttcctcaggagaa

SEQ ID NO: 835690 - DNA, 22 bp, Artificial Sequence
  chemically synthesized
aatattactaaattctcctgag

SEQ ID NO: 835691 - DNA, 22 bp, Artificial Sequence
  chemically synthesized
aaaatgtttcctcaggagaatt

SEQ ID NO: 835692 - DNA, 22 bp, Artificial Sequence
  chemically synthesized
agtggatctaaatattactaaa

SEQ ID NO: 835693 - DNA, 22 bp, Artificial Sequence
  chemically synthesized
cctcaggagaatttagtaatat

SEQ ID NO: 835694 - DNA, 22 bp, Artificial Sequence
  chemically synthesized
aagtggatctaaatattactaa

SEQ ID NO: 835695 - DNA, 22 bp, Artificial Sequence
  chemically synthesized
ctcaggagaatttagtaatatt

SEQ ID NO: 835696 - DNA, 22 bp, Artificial Sequence
  chemically synthesized
taagtggatctaaatattacta

SEQ ID NO: 835697 - DNA, 22 bp, Artificial Sequence
  chemically synthesized
aggagaatttagtaatatttag

SEQ ID NO: 835698 - DNA, 22 bp, Artificial Sequence
  chemically synthesized
ttttaagtggatctaaatatta

SEQ ID NO: 835699 - DNA, 22 bp, Artificial Sequence
  chemically synthesized
gtgattgttttaagtggatcta

SEQ ID NO: 835700 - DNA, 22 bp, Artificial Sequence
  chemically synthesized
agtaatatttagatccacttaa

SEQ ID NO: 835701 - DNA, 22 bp, Artificial Sequence
  chemically synthesized
gtaatatttagatccacttaaa

SEQ ID NO: 835702 - DNA, 22 bp, Artificial Sequence
  chemically synthesized
actagtgattgttttaagtgga

SEQ ID NO: 835703 - DNA, 22 bp, Artificial Sequence
  chemically synthesized
aactagtgattgttttaagtgg

SEQ ID NO: 835704 - DNA, 22 bp, Artificial Sequence
  chemically synthesized
tacttaactagtgattgtttta

SEQ ID NO: 835705 - DNA, 22 bp, Artificial Sequence
  chemically synthesized
gtacttaactagtgattgtttt

SEQ ID NO: 835706 - DNA, 22 bp, Artificial Sequence
  chemically synthesized
agatccacttaaaacaatcact

SEQ ID NO: 835707 - DNA, 22 bp, Artificial Sequence
  chemically synthesized
gatccacttaaaacaatcacta

SEQ ID NO: 835708 - DNA, 22 bp, Artificial Sequence
  chemically synthesized
atttgtacttaactagtgattg

SEQ ID NO: 835709 - DNA, 22 bp, Artificial Sequence
  chemically synthesized
gaagctaatttgtacttaacta

SEQ ID NO: 835710 - DNA, 22 bp, Artificial Sequence
  chemically synthesized
aaaacaatcactagttaagtac

SEQ ID NO: 835711 - DNA, 22 bp, Artificial Sequence
  chemically synthesized
ggaagctaatttgtacttaact

SEQ ID NO: 835712 - DNA, 22 bp, Artificial Sequence
  chemically synthesized
aaacaatcactagttaagtaca

SEQ ID NO: 835713 - DNA, 22 bp, Artificial Sequence
  chemically synthesized
tggaagctaatttgtacttaac

SEQ ID NO: 835714 - DNA, 22 bp, Artificial Sequence
  chemically synthesized
attttggaagctaatttgtact

SEQ ID NO: 835715 - DNA, 22 bp, Artificial Sequence
  chemically synthesized
agattgattttggaagctaatt

SEQ ID NO: 835716 - DNA, 22 bp, Artificial Sequence
  chemically synthesized
cagattgattttggaagctaat

SEQ ID NO: 835717 - DNA, 22 bp, Artificial Sequence
  chemically synthesized
gttaagtacaaattagcttcca

SEQ ID NO: 835718 - DNA, 22 bp, Artificial Sequence
  chemically synthesized
tcagattgattttggaagctaa

SEQ ID NO: 835719 - DNA, 22 bp, Artificial Sequence
  chemically synthesized
agtacaaattagcttccaaaat

SEQ ID NO: 835720 - DNA, 22 bp, Artificial Sequence
  chemically synthesized
agcatgttttcagattgatttt

SEQ ID NO: 835721 - DNA, 22 bp, Artificial Sequence
  chemically synthesized
cagcatgttttcagattgattt

SEQ ID NO: 835722 - DNA, 22 bp, Artificial Sequence
  chemically synthesized
tcagcatgttttcagattgatt

SEQ ID NO: 835723 - DNA, 22 bp, Artificial Sequence
  chemically synthesized
gcttccaaaatcaatctgaaaa

SEQ ID NO: 835724 - DNA, 22 bp, Artificial Sequence
  chemically synthesized
ccaaaatcaatctgaaaacatg

SEQ ID NO: 835725 - DNA, 22 bp, Artificial Sequence
  chemically synthesized
caaaatcaatctgaaaacatgc

SEQ ID NO: 835726 - DNA, 22 bp, Artificial Sequence
  chemically synthesized
gcagatgtatgttttcagcatg

SEQ ID NO: 835727 - DNA, 22 bp, Artificial Sequence
  chemically synthesized
agcagatgtatgttttcagcat

SEQ ID NO: 835728 - DNA, 22 bp, Artificial Sequence
  chemically synthesized
tagcagatgtatgttttcagca

SEQ ID NO: 835729 - DNA, 22 bp, Artificial Sequence
  chemically synthesized
ttagcagatgtatgttttcagc

SEQ ID NO: 835730 - DNA, 22 bp, Artificial Sequence
  chemically synthesized
aaaacatgctgaaaacatacat

SEQ ID NO: 835731 - DNA, 22 bp, Artificial Sequence
  chemically synthesized
aaaacatacatctgctaaaaga

SEQ ID NO: 835732 - DNA, 22 bp, Artificial Sequence
  chemically synthesized
ctaaaagatggttttctctttt

SEQ ID NO: 835733 - DNA, 22 bp, Artificial Sequence
  chemically synthesized
aaagatggttttctcttttatg

SEQ ID NO: 835734 - DNA, 22 bp, Artificial Sequence
  chemically synthesized
gatgggagggggtacataaaag

SEQ ID NO: 835735 - DNA, 22 bp, Artificial Sequence
  chemically synthesized
agatgggagggggtacataaaa

SEQ ID NO: 835736 - DNA, 22 bp, Artificial Sequence
  chemically synthesized
tagatgggagggggtacataaa

SEQ ID NO: 835737 - DNA, 22 bp, Artificial Sequence
  chemically synthesized
ttagatgggagggggtacataa

SEQ ID NO: 835738 - DNA, 22 bp, Artificial Sequence
  chemically synthesized
tctcttttatgtaccccctccc

SEQ ID NO: 835739 - DNA, 22 bp, Artificial Sequence
  chemically synthesized
ctcttttatgtaccccctccca

SEQ ID NO: 835740 - DNA, 22 bp, Artificial Sequence
  chemically synthesized
ataacttttagatgggaggggg

SEQ ID NO: 835741 - DNA, 22 bp, Artificial Sequence
  chemically synthesized
tcttttatgtaccccctcccat

SEQ ID NO: 835742 - DNA, 22 bp, Artificial Sequence
  chemically synthesized
aataacttttagatgggagggg

SEQ ID NO: 835743 - DNA, 22 bp, Artificial Sequence
  chemically synthesized
ttttatgtaccccctcccatct

SEQ ID NO: 835744 - DNA, 22 bp, Artificial Sequence
  chemically synthesized
cttaataacttttagatgggag

SEQ ID NO: 835745 - DNA, 22 bp, Artificial Sequence
  chemically synthesized
ttatgtaccccctcccatctaa

SEQ ID NO: 835746 - DNA, 22 bp, Artificial Sequence
  chemically synthesized
ccttaataacttttagatggga

SEQ ID NO: 835747 - DNA, 22 bp, Artificial Sequence
  chemically synthesized
tatgtaccccctcccatctaaa

SEQ ID NO: 835748 - DNA, 22 bp, Artificial Sequence
  chemically synthesized
atgtaccccctcccatctaaaa

SEQ ID NO: 835749 - DNA, 22 bp, Artificial Sequence
  chemically synthesized
ttccttaataacttttagatgg

SEQ ID NO: 835750 - DNA, 22 bp, Artificial Sequence
  chemically synthesized
tgtaccccctcccatctaaaag

SEQ ID NO: 835751 - DNA, 22 bp, Artificial Sequence
  chemically synthesized
ccatctaaaagttattaaggaa

SEQ ID NO: 835752 - DNA, 22 bp, Artificial Sequence
  chemically synthesized
catagcaacagactcttcctta

SEQ ID NO: 835753 - DNA, 22 bp, Artificial Sequence
  chemically synthesized
ccatagcaacagactcttcctt

SEQ ID NO: 835754 - DNA, 22 bp, Artificial Sequence
  chemically synthesized
aaagttattaaggaagagtctg

SEQ ID NO: 835755 - DNA, 22 bp, Artificial Sequence
  chemically synthesized
ttaaggaagagtctgttgctat

SEQ ID NO: 835756 - DNA, 22 bp, Artificial Sequence
  chemically synthesized
aggaagagtctgttgctatgga

SEQ ID NO: 835757 - DNA, 22 bp, Artificial Sequence
  chemically synthesized
ttgctatggaaacactcgattt

SEQ ID NO: 835758 - DNA, 22 bp, Artificial Sequence
  chemically synthesized
ctatggaaacactcgatttgac

SEQ ID NO: 835759 - DNA, 22 bp, Artificial Sequence
  chemically synthesized
aatacagatggtgtcaaatcga

SEQ ID NO: 835760 - DNA, 22 bp, Artificial Sequence
  chemically synthesized
gaatacagatggtgtcaaatcg

SEQ ID NO: 835761 - DNA, 22 bp, Artificial Sequence
  chemically synthesized
tgaatacagatggtgtcaaatc

SEQ ID NO: 835762 - DNA, 22 bp, Artificial Sequence
  chemically synthesized
tggaaacactcgatttgacacc

SEQ ID NO: 835763 - DNA, 22 bp, Artificial Sequence
  chemically synthesized
aattttgaatacagatggtgtc

SEQ ID NO: 835764 - DNA, 22 bp, Artificial Sequence
  chemically synthesized
gatttgacaccatctgtattca

SEQ ID NO: 835765 - DNA, 22 bp, Artificial Sequence
  chemically synthesized
cagcaattgaattttgaataca

SEQ ID NO: 835766 - DNA, 22 bp, Artificial Sequence
  chemically synthesized
gcagcaattgaattttgaatac

SEQ ID NO: 835767 - DNA, 22 bp, Artificial Sequence
  chemically synthesized
gacaccatctgtattcaaaatt

SEQ ID NO: 835768 - DNA, 22 bp, Artificial Sequence
  chemically synthesized
acaccatctgtattcaaaattc

SEQ ID NO: 835769 - DNA, 22 bp, Artificial Sequence
  chemically synthesized
aaggcttgcagcaattgaattt

SEQ ID NO: 835770 - DNA, 22 bp, Artificial Sequence
  chemically synthesized
gctgaaggcttgcagcaattga

SEQ ID NO: 835771 - DNA, 22 bp, Artificial Sequence
  chemically synthesized
tattcaaaattcaattgctgca

SEQ ID NO: 835772 - DNA, 22 bp, Artificial Sequence
  chemically synthesized
aaaattcaattgctgcaagcct

SEQ ID NO: 835773 - DNA, 22 bp, Artificial Sequence
  chemically synthesized
aattgctgcaagccttcagcca

SEQ ID NO: 835774 - DNA, 22 bp, Artificial Sequence
  chemically synthesized
aaaaccggagattggctgaagg

SEQ ID NO: 835775 - DNA, 22 bp, Artificial Sequence
  chemically synthesized
ctgcaagccttcagccaatctc

SEQ ID NO: 835776 - DNA, 22 bp, Artificial Sequence
  chemically synthesized
ccaattaaaaaccggagattgg

SEQ ID NO: 835777 - DNA, 22 bp, Artificial Sequence
  chemically synthesized
caagccttcagccaatctccgg

SEQ ID NO: 835778 - DNA, 22 bp, Artificial Sequence
  chemically synthesized
gccaattaaaaaccggagattg

SEQ ID NO: 835779 - DNA, 22 bp, Artificial Sequence
  chemically synthesized
cagccaatctccggtttttaat

SEQ ID NO: 835780 - DNA, 22 bp, Artificial Sequence
  chemically synthesized
agccaatctccggtttttaatt

SEQ ID NO: 835781 - DNA, 22 bp, Artificial Sequence
  chemically synthesized
ggaaggtcttgccaattaaaaa

SEQ ID NO: 835782 - DNA, 22 bp, Artificial Sequence
  chemically synthesized
cggtttttaattggcaagacct

SEQ ID NO: 835783 - DNA, 22 bp, Artificial Sequence
  chemically synthesized
tagagcatactgggaaggtctt

SEQ ID NO: 835784 - DNA, 22 bp, Artificial Sequence
  chemically synthesized
gtagagcatactgggaaggtct

SEQ ID NO: 835785 - DNA, 22 bp, Artificial Sequence
  chemically synthesized
ttaattggcaagaccttcccag

SEQ ID NO: 835786 - DNA, 22 bp, Artificial Sequence
  chemically synthesized
taattggcaagaccttcccagt

SEQ ID NO: 835787 - DNA, 22 bp, Artificial Sequence
  chemically synthesized
aattggcaagaccttcccagta

SEQ ID NO: 835788 - DNA, 22 bp, Artificial Sequence
  chemically synthesized
attggcaagaccttcccagtat

SEQ ID NO: 835789 - DNA, 22 bp, Artificial Sequence
  chemically synthesized
gcaagaccttcccagtatgctc

SEQ ID NO: 835790 - DNA, 22 bp, Artificial Sequence
  chemically synthesized
cccagtatgctctacaaatctt

SEQ ID NO: 835791 - DNA, 22 bp, Artificial Sequence
  chemically synthesized
ccagtatgctctacaaatcttt

SEQ ID NO: 835792 - DNA, 22 bp, Artificial Sequence
  chemically synthesized
aaaataaaaaataaaaaaaaag

SEQ ID NO: 835793 - DNA, 22 bp, Artificial Sequence
  chemically synthesized
ctaaaaataaaaaataaaaaaa

SEQ ID NO: 835794 - DNA, 22 bp, Artificial Sequence
  chemically synthesized
cctaaaaataaaaaataaaaaa

SEQ ID NO: 835795 - DNA, 22 bp, Artificial Sequence
  chemically synthesized
tacaaatctttttttttatttt

SEQ ID NO: 835796 - DNA, 22 bp, Artificial Sequence
  chemically synthesized
caaatctttttttttatttttt

SEQ ID NO: 835797 - DNA, 22 bp, Artificial Sequence
  chemically synthesized
acttcctaaaaataaaaaataa

SEQ ID NO: 835798 - DNA, 22 bp, Artificial Sequence
  chemically synthesized
tttttttattttttatttttag

SEQ ID NO: 835799 - DNA, 22 bp, Artificial Sequence
  chemically synthesized
ttttttattttttatttttagg

SEQ ID NO: 835800 - DNA, 22 bp, Artificial Sequence
  chemically synthesized
tttttattttttatttttagga

SEQ ID NO: 835801 - DNA, 22 bp, Artificial Sequence
  chemically synthesized
tatagattgacttcctaaaaat

SEQ ID NO: 835802 - DNA, 22 bp, Artificial Sequence
  chemically synthesized
ttttattttttatttttaggaa

SEQ ID NO: 835803 - DNA, 22 bp, Artificial Sequence
  chemically synthesized
tttattttttatttttaggaag

SEQ ID NO: 835804 - DNA, 22 bp, Artificial Sequence
  chemically synthesized
ttattttttatttttaggaagt

SEQ ID NO: 835805 - DNA, 22 bp, Artificial Sequence
  chemically synthesized
tattttttatttttaggaagtc

SEQ ID NO: 835806 - DNA, 22 bp, Artificial Sequence
  chemically synthesized
attttttatttttaggaagtca

SEQ ID NO: 835807 - DNA, 22 bp, Artificial Sequence
  chemically synthesized
ttttttatttttaggaagtcaa

SEQ ID NO: 835808 - DNA, 22 bp, Artificial Sequence
  chemically synthesized
tttatttttaggaagtcaatct

SEQ ID NO: 835809 - DNA, 22 bp, Artificial Sequence
  chemically synthesized
ttatttttaggaagtcaatcta

SEQ ID NO: 835810 - DNA, 22 bp, Artificial Sequence
  chemically synthesized
caatatgctgtatagattgact

SEQ ID NO: 835811 - DNA, 22 bp, Artificial Sequence
  chemically synthesized
tatttttaggaagtcaatctat

SEQ ID NO: 835812 - DNA, 22 bp, Artificial Sequence
  chemically synthesized
atttttaggaagtcaatctata

SEQ ID NO: 835813 - DNA, 22 bp, Artificial Sequence
  chemically synthesized
tttttaggaagtcaatctatac

SEQ ID NO: 835814 - DNA, 22 bp, Artificial Sequence
  chemically synthesized
cattgcaatatgctgtatagat

SEQ ID NO: 835815 - DNA, 22 bp, Artificial Sequence
  chemically synthesized
ttaggaagtcaatctatacagc

SEQ ID NO: 835816 - DNA, 22 bp, Artificial Sequence
  chemically synthesized
acattgcaatatgctgtataga

SEQ ID NO: 835817 - DNA, 22 bp, Artificial Sequence
  chemically synthesized
taggaagtcaatctatacagca

SEQ ID NO: 835818 - DNA, 22 bp, Artificial Sequence
  chemically synthesized
tacattgcaatatgctgtatag

SEQ ID NO: 835819 - DNA, 22 bp, Artificial Sequence
  chemically synthesized
aggaagtcaatctatacagcat

SEQ ID NO: 835820 - DNA, 22 bp, Artificial Sequence
  chemically synthesized
ggaagtcaatctatacagcata

SEQ ID NO: 835821 - DNA, 22 bp, Artificial Sequence
  chemically synthesized
atgctttacattgcaatatgct

SEQ ID NO: 835822 - DNA, 22 bp, Artificial Sequence
  chemically synthesized
gatgctttacattgcaatatgc

SEQ ID NO: 835823 - DNA, 22 bp, Artificial Sequence
  chemically synthesized
ttgatgctttacattgcaatat

SEQ ID NO: 835824 - DNA, 22 bp, Artificial Sequence
  chemically synthesized
cttgatgctttacattgcaata

SEQ ID NO: 835825 - DNA, 22 bp, Artificial Sequence
  chemically synthesized
tcttgatgctttacattgcaat

SEQ ID NO: 835826 - DNA, 22 bp, Artificial Sequence
  chemically synthesized
tacagcatattgcaatgtaaag

SEQ ID NO: 835827 - DNA, 22 bp, Artificial Sequence
  chemically synthesized
tgaactttcttgatgctttaca

SEQ ID NO: 835828 - DNA, 22 bp, Artificial Sequence
  chemically synthesized
cattgtgaactttcttgatgct

SEQ ID NO: 835829 - DNA, 22 bp, Artificial Sequence
  chemically synthesized
gcattgtgaactttcttgatgc

SEQ ID NO: 835830 - DNA, 22 bp, Artificial Sequence
  chemically synthesized
caatgtaaagcatcaagaaagt

SEQ ID NO: 835831 - DNA, 22 bp, Artificial Sequence
  chemically synthesized
agataatggaatgaggcttgca

SEQ ID NO: 835832 - DNA, 22 bp, Artificial Sequence
  chemically synthesized
aagataatggaatgaggcttgc

SEQ ID NO: 835833 - DNA, 22 bp, Artificial Sequence
  chemically synthesized
taagataatggaatgaggcttg

SEQ ID NO: 835834 - DNA, 22 bp, Artificial Sequence
  chemically synthesized
attttaagataatggaatgagg

SEQ ID NO: 835835 - DNA, 22 bp, Artificial Sequence
  chemically synthesized
acaatgcaagcctcattccatt

SEQ ID NO: 835836 - DNA, 22 bp, Artificial Sequence
  chemically synthesized
acaagtctgattttaagataat

SEQ ID NO: 835837 - DNA, 22 bp, Artificial Sequence
  chemically synthesized
cacaagtctgattttaagataa

SEQ ID NO: 835838 - DNA, 22 bp, Artificial Sequence
  chemically synthesized
attccattatcttaaaatcaga

SEQ ID NO: 835839 - DNA, 22 bp, Artificial Sequence
  chemically synthesized
aaacttcacaagtctgatttta

SEQ ID NO: 835840 - DNA, 22 bp, Artificial Sequence
  chemically synthesized
gaaacttcacaagtctgatttt

SEQ ID NO: 835841 - DNA, 22 bp, Artificial Sequence
  chemically synthesized
tgaaacttcacaagtctgattt

SEQ ID NO: 835842 - DNA, 22 bp, Artificial Sequence
  chemically synthesized
cattatcttaaaatcagacttg

SEQ ID NO: 835843 - DNA, 22 bp, Artificial Sequence
  chemically synthesized
tcttaaaatcagacttgtgaag

SEQ ID NO: 835844 - DNA, 22 bp, Artificial Sequence
  chemically synthesized
taatgctttgaaacttcacaag

SEQ ID NO: 835845 - DNA, 22 bp, Artificial Sequence
  chemically synthesized
aaaatcagacttgtgaagtttc

SEQ ID NO: 835846 - DNA, 22 bp, Artificial Sequence
  chemically synthesized
aaatcagacttgtgaagtttca

SEQ ID NO: 835847 - DNA, 22 bp, Artificial Sequence
  chemically synthesized
tcagaaggctgtaatgctttga

SEQ ID NO: 835848 - DNA, 22 bp, Artificial Sequence
  chemically synthesized
gtgaagtttcaaagcattacag

SEQ ID NO: 835849 - DNA, 22 bp, Artificial Sequence
  chemically synthesized
tgaagtttcaaagcattacagc

SEQ ID NO: 835850 - DNA, 22 bp, Artificial Sequence
  chemically synthesized
caaagcattacagccttctgat

SEQ ID NO: 835851 - DNA, 22 bp, Artificial Sequence
  chemically synthesized
aaagcattacagccttctgata

SEQ ID NO: 835852 - DNA, 22 bp, Artificial Sequence
  chemically synthesized
atgccaagtaattatcagaagg

SEQ ID NO: 835853 - DNA, 22 bp, Artificial Sequence
  chemically synthesized
acctcatgccaagtaattatca

SEQ ID NO: 835854 - DNA, 22 bp, Artificial Sequence
  chemically synthesized
cagccttctgataattacttgg

SEQ ID NO: 835855 - DNA, 22 bp, Artificial Sequence
  chemically synthesized
ggcattaacctcatgccaagta

SEQ ID NO: 835856 - DNA, 22 bp, Artificial Sequence
  chemically synthesized
aggcattaacctcatgccaagt

SEQ ID NO: 835857 - DNA, 22 bp, Artificial Sequence
  chemically synthesized
taggcattaacctcatgccaag

SEQ ID NO: 835858 - DNA, 22 bp, Artificial Sequence
  chemically synthesized
ctgataattacttggcatgagg

SEQ ID NO: 835859 - DNA, 22 bp, Artificial Sequence
  chemically synthesized
tgataattacttggcatgaggt

SEQ ID NO: 835860 - DNA, 22 bp, Artificial Sequence
  chemically synthesized
ataattacttggcatgaggtta

SEQ ID NO: 835861 - DNA, 22 bp, Artificial Sequence
  chemically synthesized
gcaataaattttaggcattaac

SEQ ID NO: 835862 - DNA, 22 bp, Artificial Sequence
  chemically synthesized
cttggcatgaggttaatgccta

SEQ ID NO: 835863 - DNA, 22 bp, Artificial Sequence
  chemically synthesized
ggcaataaattttaggcattaa

SEQ ID NO: 835864 - DNA, 22 bp, Artificial Sequence
  chemically synthesized
ggcatgaggttaatgcctaaaa

SEQ ID NO: 835865 - DNA, 22 bp, Artificial Sequence
  chemically synthesized
gcatgaggttaatgcctaaaat

SEQ ID NO: 835866 - DNA, 22 bp, Artificial Sequence
  chemically synthesized
atgcctaaaatttattgccaag

SEQ ID NO: 835867 - DNA, 22 bp, Artificial Sequence
  chemically synthesized
aaatttattgccaagttttttt

SEQ ID NO: 835868 - DNA, 22 bp, Artificial Sequence
  chemically synthesized
attgccaagtttttttttttgc

SEQ ID NO: 835869 - DNA, 22 bp, Artificial Sequence
  chemically synthesized
ttgccaagtttttttttttgcc

SEQ ID NO: 835870 - DNA, 22 bp, Artificial Sequence
  chemically synthesized
ccaagtttttttttttgcctat

SEQ ID NO: 835871 - DNA, 22 bp, Artificial Sequence
  chemically synthesized
cgtgtgaaatccaataggcaaa

SEQ ID NO: 835872 - DNA, 22 bp, Artificial Sequence
  chemically synthesized
acgtgtgaaatccaataggcaa

SEQ ID NO: 835873 - DNA, 22 bp, Artificial Sequence
  chemically synthesized
tacgtgtgaaatccaataggca

SEQ ID NO: 835874 - DNA, 22 bp, Artificial Sequence
  chemically synthesized
tttacgtgtgaaatccaatagg

SEQ ID NO: 835875 - DNA, 22 bp, Artificial Sequence
  chemically synthesized
ctttacgtgtgaaatccaatag

SEQ ID NO: 835876 - DNA, 22 bp, Artificial Sequence
  chemically synthesized
tctttacgtgtgaaatccaata

SEQ ID NO: 835877 - DNA, 22 bp, Artificial Sequence
  chemically synthesized
ttttttttgcctattggatttc

SEQ ID NO: 835878 - DNA, 22 bp, Artificial Sequence
  chemically synthesized
tttttttgcctattggatttca

SEQ ID NO: 835879 - DNA, 22 bp, Artificial Sequence
  chemically synthesized
ttttttgcctattggatttcac

SEQ ID NO: 835880 - DNA, 22 bp, Artificial Sequence
  chemically synthesized
tttttgcctattggatttcaca

SEQ ID NO: 835881 - DNA, 22 bp, Artificial Sequence
  chemically synthesized
ttttgcctattggatttcacac

SEQ ID NO: 835882 - DNA, 22 bp, Artificial Sequence
  chemically synthesized
tttgcctattggatttcacacg

SEQ ID NO: 835883 - DNA, 22 bp, Artificial Sequence
  chemically synthesized
ttgcctattggatttcacacgt

SEQ ID NO: 835884 - DNA, 22 bp, Artificial Sequence
  chemically synthesized
tgcctattggatttcacacgta

SEQ ID NO: 835885 - DNA, 22 bp, Artificial Sequence
  chemically synthesized
gcctattggatttcacacgtaa

SEQ ID NO: 835886 - DNA, 22 bp, Artificial Sequence
  chemically synthesized
cctattggatttcacacgtaaa

SEQ ID NO: 835887 - DNA, 22 bp, Artificial Sequence
  chemically synthesized
caatgagtattttctttacgtg

SEQ ID NO: 835888 - DNA, 22 bp, Artificial Sequence
  chemically synthesized
acaatgagtattttctttacgt

SEQ ID NO: 835889 - DNA, 22 bp, Artificial Sequence
  chemically synthesized
ttggatttcacacgtaaagaaa

SEQ ID NO: 835890 - DNA, 22 bp, Artificial Sequence
  chemically synthesized
ttacaatgagtattttctttac

SEQ ID NO: 835891 - DNA, 22 bp, Artificial Sequence
  chemically synthesized
gatttcacacgtaaagaaaata

SEQ ID NO: 835892 - DNA, 22 bp, Artificial Sequence
  chemically synthesized
cacacgtaaagaaaatactcat

SEQ ID NO: 835893 - DNA, 22 bp, Artificial Sequence
  chemically synthesized
acacgtaaagaaaatactcatt

SEQ ID NO: 835894 - DNA, 22 bp, Artificial Sequence
  chemically synthesized
aagtcactcttacaatgagtat

SEQ ID NO: 835895 - DNA, 22 bp, Artificial Sequence
  chemically synthesized
atactaaagtcactcttacaat

SEQ ID NO: 835896 - DNA, 22 bp, Artificial Sequence
  chemically synthesized
ctaatactaaagtcactcttac

SEQ ID NO: 835897 - DNA, 22 bp, Artificial Sequence
  chemically synthesized
cctaatactaaagtcactctta

SEQ ID NO: 835898 - DNA, 22 bp, Artificial Sequence
  chemically synthesized
attgtaagagtgactttagtat

SEQ ID NO: 835899 - DNA, 22 bp, Artificial Sequence
  chemically synthesized
agggtcttcctaatactaaagt

SEQ ID NO: 835900 - DNA, 22 bp, Artificial Sequence
  chemically synthesized
cagggtcttcctaatactaaag

SEQ ID NO: 835901 - DNA, 22 bp, Artificial Sequence
  chemically synthesized
tcagggtcttcctaatactaaa

SEQ ID NO: 835902 - DNA, 22 bp, Artificial Sequence
  chemically synthesized
ttcagggtcttcctaatactaa

SEQ ID NO: 835903 - DNA, 22 bp, Artificial Sequence
  chemically synthesized
taagagtgactttagtattagg

SEQ ID NO: 835904 - DNA, 22 bp, Artificial Sequence
  chemically synthesized
tttcagggtcttcctaatacta

SEQ ID NO: 835905 - DNA, 22 bp, Artificial Sequence
  chemically synthesized
tttttcagggtcttcctaatac

SEQ ID NO: 835906 - DNA, 22 bp, Artificial Sequence
  chemically synthesized
aggctctttttcagggtcttcc

SEQ ID NO: 835907 - DNA, 22 bp, Artificial Sequence
  chemically synthesized
tagtattaggaagaccctgaaa

SEQ ID NO: 835908 - DNA, 22 bp, Artificial Sequence
  chemically synthesized
actaaggctctttttcagggtc

SEQ ID NO: 835909 - DNA, 22 bp, Artificial Sequence
  chemically synthesized
agtattaggaagaccctgaaaa

SEQ ID NO: 835910 - DNA, 22 bp, Artificial Sequence
  chemically synthesized
gtattaggaagaccctgaaaaa

SEQ ID NO: 835911 - DNA, 22 bp, Artificial Sequence
  chemically synthesized
ctcactaaggctctttttcagg

SEQ ID NO: 835912 - DNA, 22 bp, Artificial Sequence
  chemically synthesized
ggaagaccctgaaaaagagcct

SEQ ID NO: 835913 - DNA, 22 bp, Artificial Sequence
  chemically synthesized
tgatataagttcctcactaagg

SEQ ID NO: 835914 - DNA, 22 bp, Artificial Sequence
  chemically synthesized
aaaaagagccttagtgaggaac

SEQ ID NO: 835915 - DNA, 22 bp, Artificial Sequence
  chemically synthesized
tgtattgtgatataagttcctc

SEQ ID NO: 835916 - DNA, 22 bp, Artificial Sequence
  chemically synthesized
aactgtgtattgtgatataagt

SEQ ID NO: 835917 - DNA, 22 bp, Artificial Sequence
  chemically synthesized
taaactgtgtattgtgatataa

SEQ ID NO: 835918 - DNA, 22 bp, Artificial Sequence
  chemically synthesized
agtgaggaacttatatcacaat

SEQ ID NO: 835919 - DNA, 22 bp, Artificial Sequence
  chemically synthesized
gtgaggaacttatatcacaata

SEQ ID NO: 835920 - DNA, 22 bp, Artificial Sequence
  chemically synthesized
cattctaaactgtgtattgtga

SEQ ID NO: 835921 - DNA, 22 bp, Artificial Sequence
  chemically synthesized
ccattctaaactgtgtattgtg

SEQ ID NO: 835922 - DNA, 22 bp, Artificial Sequence
  chemically synthesized
tccattctaaactgtgtattgt

SEQ ID NO: 835923 - DNA, 22 bp, Artificial Sequence
  chemically synthesized
ttttccattctaaactgtgtat

SEQ ID NO: 835924 - DNA, 22 bp, Artificial Sequence
  chemically synthesized
gttttccattctaaactgtgta

SEQ ID NO: 835925 - DNA, 22 bp, Artificial Sequence
  chemically synthesized
atatcacaatacacagtttaga

SEQ ID NO: 835926 - DNA, 22 bp, Artificial Sequence
  chemically synthesized
tatcacaatacacagtttagaa

SEQ ID NO: 835927 - DNA, 22 bp, Artificial Sequence
  chemically synthesized
tatttgttttccattctaaact

SEQ ID NO: 835928 - DNA, 22 bp, Artificial Sequence
  chemically synthesized
tatatttgttttccattctaaa

SEQ ID NO: 835929 - DNA, 22 bp, Artificial Sequence
  chemically synthesized
ctatatttgttttccattctaa

SEQ ID NO: 835930 - DNA, 22 bp, Artificial Sequence
  chemically synthesized
atttctatatttgttttccatt

SEQ ID NO: 835931 - DNA, 22 bp, Artificial Sequence
  chemically synthesized
tgatttctatatttgttttcca

SEQ ID NO: 835932 - DNA, 22 bp, Artificial Sequence
  chemically synthesized
actctgatttctatatttgttt

SEQ ID NO: 835933 - DNA, 22 bp, Artificial Sequence
  chemically synthesized
aactctgatttctatatttgtt

SEQ ID NO: 835934 - DNA, 22 bp, Artificial Sequence
  chemically synthesized
ttaactctgatttctatatttg

SEQ ID NO: 835935 - DNA, 22 bp, Artificial Sequence
  chemically synthesized
agaatggaaaacaaatatagaa

SEQ ID NO: 835936 - DNA, 22 bp, Artificial Sequence
  chemically synthesized
gaatggaaaacaaatatagaaa

SEQ ID NO: 835937 - DNA, 22 bp, Artificial Sequence
  chemically synthesized
cattcttaactctgatttctat

SEQ ID NO: 835938 - DNA, 22 bp, Artificial Sequence
  chemically synthesized
caaaattgcattcttaactctg

SEQ ID NO: 835939 - DNA, 22 bp, Artificial Sequence
  chemically synthesized
ttccaaaattgcattcttaact

SEQ ID NO: 835940 - DNA, 22 bp, Artificial Sequence
  chemically synthesized
actattccaaaattgcattctt

SEQ ID NO: 835941 - DNA, 22 bp, Artificial Sequence
  chemically synthesized
agtctgactattccaaaattgc

SEQ ID NO: 835942 - DNA, 22 bp, Artificial Sequence
  chemically synthesized
cagtctgactattccaaaattg

SEQ ID NO: 835943 - DNA, 22 bp, Artificial Sequence
  chemically synthesized
aacttcagtctgactattccaa

SEQ ID NO: 835944 - DNA, 22 bp, Artificial Sequence
  chemically synthesized
agaatgcaattttggaatagtc

SEQ ID NO: 835945 - DNA, 22 bp, Artificial Sequence
  chemically synthesized
caaataatattgaacttcagtc

SEQ ID NO: 835946 - DNA, 22 bp, Artificial Sequence
  chemically synthesized
tggaatagtcagactgaagttc

SEQ ID NO: 835947 - DNA, 22 bp, Artificial Sequence
  chemically synthesized
ggaatagtcagactgaagttca

SEQ ID NO: 835948 - DNA, 22 bp, Artificial Sequence
  chemically synthesized
gaatagtcagactgaagttcaa

SEQ ID NO: 835949 - DNA, 22 bp, Artificial Sequence
  chemically synthesized
acaagtattccaaataatattg

SEQ ID NO: 835950 - DNA, 22 bp, Artificial Sequence
  chemically synthesized
aagttcaatattatttggaata

SEQ ID NO: 835951 - DNA, 22 bp, Artificial Sequence
  chemically synthesized
aatattatttggaatacttgtt

SEQ ID NO: 835952 - DNA, 22 bp, Artificial Sequence
  chemically synthesized
cataaagtagctaacaagtatt

SEQ ID NO: 835953 - DNA, 22 bp, Artificial Sequence
  chemically synthesized
tttggaatacttgttagctact

SEQ ID NO: 835954 - DNA, 22 bp, Artificial Sequence
  chemically synthesized
ggaatacttgttagctacttta

SEQ ID NO: 835955 - DNA, 22 bp, Artificial Sequence
  chemically synthesized
gaatacttgttagctactttat

SEQ ID NO: 835956 - DNA, 22 bp, Artificial Sequence
  chemically synthesized
gttagctactttatgtaacctt

SEQ ID NO: 835957 - DNA, 22 bp, Artificial Sequence
  chemically synthesized
ttagctactttatgtaaccttt

SEQ ID NO: 835958 - DNA, 22 bp, Artificial Sequence
  chemically synthesized
gctactttatgtaacctttcta

SEQ ID NO: 835959 - DNA, 22 bp, Artificial Sequence
  chemically synthesized
ctttatgtaacctttctacatc

SEQ ID NO: 835960 - DNA, 22 bp, Artificial Sequence
  chemically synthesized
tatgtaacctttctacatcttc

SEQ ID NO: 835961 - DNA, 22 bp, Artificial Sequence
  chemically synthesized
atgtaacctttctacatcttct

SEQ ID NO: 835962 - DNA, 22 bp, Artificial Sequence
  chemically synthesized
cagatgaggaaaagaagatgta

SEQ ID NO: 835963 - DNA, 22 bp, Artificial Sequence
  chemically synthesized
tgtaacctttctacatcttctt

SEQ ID NO: 835964 - DNA, 22 bp, Artificial Sequence
  chemically synthesized
acagatgaggaaaagaagatgt

SEQ ID NO: 835965 - DNA, 22 bp, Artificial Sequence
  chemically synthesized
ttacagatgaggaaaagaagat

SEQ ID NO: 835966 - DNA, 22 bp, Artificial Sequence
  chemically synthesized
tctacatcttcttttcctcatc

SEQ ID NO: 835967 - DNA, 22 bp, Artificial Sequence
  chemically synthesized
ctacatcttcttttcctcatct

SEQ ID NO: 835968 - DNA, 22 bp, Artificial Sequence
  chemically synthesized
tacatcttcttttcctcatctg

SEQ ID NO: 835969 - DNA, 22 bp, Artificial Sequence
  chemically synthesized
catcttcttttcctcatctgta

SEQ ID NO: 835970 - DNA, 22 bp, Artificial Sequence
  chemically synthesized
ataatagatctcttacagatga

SEQ ID NO: 835971 - DNA, 22 bp, Artificial Sequence
  chemically synthesized
cttttcctcatctgtaagagat

SEQ ID NO: 835972 - DNA, 22 bp, Artificial Sequence
  chemically synthesized
ttttcctcatctgtaagagatc

SEQ ID NO: 835973 - DNA, 22 bp, Artificial Sequence
  chemically synthesized
ttcctcatctgtaagagatcta

SEQ ID NO: 835974 - DNA, 22 bp, Artificial Sequence
  chemically synthesized
aaatcctcataatagatctctt

SEQ ID NO: 835975 - DNA, 22 bp, Artificial Sequence
  chemically synthesized
tcctcatctgtaagagatctat

SEQ ID NO: 835976 - DNA, 22 bp, Artificial Sequence
  chemically synthesized
aaaatcctcataatagatctct

SEQ ID NO: 835977 - DNA, 22 bp, Artificial Sequence
  chemically synthesized
cctcatctgtaagagatctatt

SEQ ID NO: 835978 - DNA, 22 bp, Artificial Sequence
  chemically synthesized
taaaatcctcataatagatctc

SEQ ID NO: 835979 - DNA, 22 bp, Artificial Sequence
  chemically synthesized
ctcatctgtaagagatctatta

SEQ ID NO: 835980 - DNA, 22 bp, Artificial Sequence
  chemically synthesized
atctgtaagagatctattatga

SEQ ID NO: 835981 - DNA, 22 bp, Artificial Sequence
  chemically synthesized
taagagatctattatgaggatt

SEQ ID NO: 835982 - DNA, 22 bp, Artificial Sequence
  chemically synthesized
ttatgaggattttaaagtacgc

SEQ ID NO: 835983 - DNA, 22 bp, Artificial Sequence
  chemically synthesized
tgaggattttaaagtacgcatt

SEQ ID NO: 835984 - DNA, 22 bp, Artificial Sequence
  chemically synthesized
taaagtacgcattttggggact

SEQ ID NO: 835985 - DNA, 22 bp, Artificial Sequence
  chemically synthesized
aaagtacgcattttggggacta

SEQ ID NO: 835986 - DNA, 22 bp, Artificial Sequence
  chemically synthesized
aagtacgcattttggggactac

SEQ ID NO: 835987 - DNA, 22 bp, Artificial Sequence
  chemically synthesized
tatatgtataagtatgtgtagt

SEQ ID NO: 835988 - DNA, 22 bp, Artificial Sequence
  chemically synthesized
tggggactacacatacttatac

SEQ ID NO: 835989 - DNA, 22 bp, Artificial Sequence
  chemically synthesized
ggggactacacatacttataca

SEQ ID NO: 835990 - DNA, 22 bp, Artificial Sequence
  chemically synthesized
gggactacacatacttatacat

SEQ ID NO: 835991 - DNA, 22 bp, Artificial Sequence
  chemically synthesized
cacatacttatacatatatagt

SEQ ID NO: 835992 - DNA, 22 bp, Artificial Sequence
  chemically synthesized
tagtatatgtatatactatata

SEQ ID NO: 835993 - DNA, 22 bp, Artificial Sequence
  chemically synthesized
atacatatatagtatatacata

SEQ ID NO: 835994 - DNA, 22 bp, Artificial Sequence
  chemically synthesized
tacatatatagtatatacatat

SEQ ID NO: 835995 - DNA, 22 bp, Artificial Sequence
  chemically synthesized
aaatgccgttatagtatatgta

SEQ ID NO: 835996 - DNA, 22 bp, Artificial Sequence
  chemically synthesized
caaatgccgttatagtatatgt

SEQ ID NO: 835997 - DNA, 22 bp, Artificial Sequence
  chemically synthesized
tcaaatgccgttatagtatatg

SEQ ID NO: 835998 - DNA, 22 bp, Artificial Sequence
  chemically synthesized
acagattttcaaatgccgttat

SEQ ID NO: 835999 - DNA, 22 bp, Artificial Sequence
  chemically synthesized
taacggcatttgaaaatctgtt

SEQ ID NO: 836000 - DNA, 22 bp, Artificial Sequence
  chemically synthesized
aagaccatgtggattaacagat

SEQ ID NO: 836001 - DNA, 22 bp, Artificial Sequence
  chemically synthesized
caagaccatgtggattaacaga

SEQ ID NO: 836002 - DNA, 22 bp, Artificial Sequence
  chemically synthesized
gaaaatctgttaatccacatgg

SEQ ID NO: 836003 - DNA, 22 bp, Artificial Sequence
  chemically synthesized
aaaatctgttaatccacatggt

SEQ ID NO: 836004 - DNA, 22 bp, Artificial Sequence
  chemically synthesized
gagaaatatgcttcaagaccat

SEQ ID NO: 836005 - DNA, 22 bp, Artificial Sequence
  chemically synthesized
tggagaaatatgcttcaagacc

SEQ ID NO: 836006 - DNA, 22 bp, Artificial Sequence
  chemically synthesized
ttaatccacatggtcttgaagc

SEQ ID NO: 836007 - DNA, 22 bp, Artificial Sequence
  chemically synthesized
atccacatggtcttgaagcata

SEQ ID NO: 836008 - DNA, 22 bp, Artificial Sequence
  chemically synthesized
atattctggagaaatatgcttc

SEQ ID NO: 836009 - DNA, 22 bp, Artificial Sequence
  chemically synthesized
gatattctggagaaatatgctt

SEQ ID NO: 836010 - DNA, 22 bp, Artificial Sequence
  chemically synthesized
gaagcatatttctccagaatat

SEQ ID NO: 836011 - DNA, 22 bp, Artificial Sequence
  chemically synthesized
aagcatatttctccagaatatc

SEQ ID NO: 836012 - DNA, 22 bp, Artificial Sequence
  chemically synthesized
tatacagatacttgatattctg

SEQ ID NO: 836013 - DNA, 22 bp, Artificial Sequence
  chemically synthesized
atatacagatacttgatattct

SEQ ID NO: 836014 - DNA, 22 bp, Artificial Sequence
  chemically synthesized
ctccagaatatcaagtatctgt

SEQ ID NO: 836015 - DNA, 22 bp, Artificial Sequence
  chemically synthesized
tccagaatatcaagtatctgta

SEQ ID NO: 836016 - DNA, 22 bp, Artificial Sequence
  chemically synthesized
gcaacacttatatacagatact

SEQ ID NO: 836017 - DNA, 22 bp, Artificial Sequence
  chemically synthesized
agcaacacttatatacagatac

SEQ ID NO: 836018 - DNA, 22 bp, Artificial Sequence
  chemically synthesized
cagaatatcaagtatctgtata

SEQ ID NO: 836019 - DNA, 22 bp, Artificial Sequence
  chemically synthesized
tagcaacacttatatacagata

SEQ ID NO: 836020 - DNA, 22 bp, Artificial Sequence
  chemically synthesized
tgaattttagcaacacttatat

SEQ ID NO: 836021 - DNA, 22 bp, Artificial Sequence
  chemically synthesized
tatgaattttagcaacacttat

SEQ ID NO: 836022 - DNA, 22 bp, Artificial Sequence
  chemically synthesized
ctatgaattttagcaacactta

SEQ ID NO: 836023 - DNA, 22 bp, Artificial Sequence
  chemically synthesized
ttctatgaattttagcaacact

SEQ ID NO: 836024 - DNA, 22 bp, Artificial Sequence
  chemically synthesized
tcttctatgaattttagcaaca

SEQ ID NO: 836025 - DNA, 22 bp, Artificial Sequence
  chemically synthesized
tatataagtgttgctaaaattc

SEQ ID NO: 836026 - DNA, 22 bp, Artificial Sequence
  chemically synthesized
taatcctctcttctatgaattt

SEQ ID NO: 836027 - DNA, 22 bp, Artificial Sequence
  chemically synthesized
gtaatcctctcttctatgaatt

SEQ ID NO: 836028 - DNA, 22 bp, Artificial Sequence
  chemically synthesized
tgtaatcctctcttctatgaat

SEQ ID NO: 836029 - DNA, 22 bp, Artificial Sequence
  chemically synthesized
ttgtaatcctctcttctatgaa

SEQ ID NO: 836030 - DNA, 22 bp, Artificial Sequence
  chemically synthesized
tttgtaatcctctcttctatga

SEQ ID NO: 836031 - DNA, 22 bp, Artificial Sequence
  chemically synthesized
ctaaaattcatagaagagagga

SEQ ID NO: 836032 - DNA, 22 bp, Artificial Sequence
  chemically synthesized
cagttttttgtaatcctctctt

SEQ ID NO: 836033 - DNA, 22 bp, Artificial Sequence
  chemically synthesized
aaattcatagaagagaggatta

SEQ ID NO: 836034 - DNA, 22 bp, Artificial Sequence
  chemically synthesized
atagaagagaggattacaaaaa

SEQ ID NO: 836035 - DNA, 22 bp, Artificial Sequence
  chemically synthesized
agagaattccagttttttgtaa

SEQ ID NO: 836036 - DNA, 22 bp, Artificial Sequence
  chemically synthesized
ttcagagaattccagttttttg

SEQ ID NO: 836037 - DNA, 22 bp, Artificial Sequence
  chemically synthesized
aaaataattattcagagaattc

SEQ ID NO: 836038 - DNA, 22 bp, Artificial Sequence
  chemically synthesized
aaaaataattattcagagaatt

SEQ ID NO: 836039 - DNA, 22 bp, Artificial Sequence
  chemically synthesized
caaaaaactggaattctctgaa

SEQ ID NO: 836040 - DNA, 22 bp, Artificial Sequence
  chemically synthesized
tttaaaaataattattcagaga

SEQ ID NO: 836041 - DNA, 22 bp, Artificial Sequence
  chemically synthesized
atttaaaaataattattcagag

SEQ ID NO: 836042 - DNA, 22 bp, Artificial Sequence
  chemically synthesized
ccttatttaaaaataattattc

SEQ ID NO: 836043 - DNA, 22 bp, Artificial Sequence
  chemically synthesized
cccttatttaaaaataattatt

SEQ ID NO: 836044 - DNA, 22 bp, Artificial Sequence
  chemically synthesized
gaattctctgaataattatttt

SEQ ID NO: 836045 - DNA, 22 bp, Artificial Sequence
  chemically synthesized
tctgaataattatttttaaata

SEQ ID NO: 836046 - DNA, 22 bp, Artificial Sequence
  chemically synthesized
tgaataattatttttaaataag

SEQ ID NO: 836047 - DNA, 22 bp, Artificial Sequence
  chemically synthesized
aataattatttttaaataaggg

SEQ ID NO: 836048 - DNA, 22 bp, Artificial Sequence
  chemically synthesized
atatccagtcatatccttccct

SEQ ID NO: 836049 - DNA, 22 bp, Artificial Sequence
  chemically synthesized
aatatccagtcatatccttccc

SEQ ID NO: 836050 - DNA, 22 bp, Artificial Sequence
  chemically synthesized
tttttaaataagggaaggatat

SEQ ID NO: 836051 - DNA, 22 bp, Artificial Sequence
  chemically synthesized
taatatccagtcatatccttcc

SEQ ID NO: 836052 - DNA, 22 bp, Artificial Sequence
  chemically synthesized
tttaatatccagtcatatcctt

SEQ ID NO: 836053 - DNA, 22 bp, Artificial Sequence
  chemically synthesized
ttaaataagggaaggatatgac

SEQ ID NO: 836054 - DNA, 22 bp, Artificial Sequence
  chemically synthesized
ctttaatatccagtcatatcct

SEQ ID NO: 836055 - DNA, 22 bp, Artificial Sequence
  chemically synthesized
taaataagggaaggatatgact

SEQ ID NO: 836056 - DNA, 22 bp, Artificial Sequence
  chemically synthesized
aaataagggaaggatatgactg

SEQ ID NO: 836057 - DNA, 22 bp, Artificial Sequence
  chemically synthesized
aataagggaaggatatgactgg

SEQ ID NO: 836058 - DNA, 22 bp, Artificial Sequence
  chemically synthesized
catttctttaatatccagtcat

SEQ ID NO: 836059 - DNA, 22 bp, Artificial Sequence
  chemically synthesized
acatttctttaatatccagtca

SEQ ID NO: 836060 - DNA, 22 bp, Artificial Sequence
  chemically synthesized
ccagaagcatatttacatttct

SEQ ID NO: 836061 - DNA, 22 bp, Artificial Sequence
  chemically synthesized
ctgccagaagcatatttacatt

SEQ ID NO: 836062 - DNA, 22 bp, Artificial Sequence
  chemically synthesized
gatattaaagaaatgtaaatat

SEQ ID NO: 836063 - DNA, 22 bp, Artificial Sequence
  chemically synthesized
cctgccagaagcatatttacat

SEQ ID NO: 836064 - DNA, 22 bp, Artificial Sequence
  chemically synthesized
tcctgccagaagcatatttaca

SEQ ID NO: 836065 - DNA, 22 bp, Artificial Sequence
  chemically synthesized
aagaaatgtaaatatgcttctg

SEQ ID NO: 836066 - DNA, 22 bp, Artificial Sequence
  chemically synthesized
gcattttcctgccagaagcata

SEQ ID NO: 836067 - DNA, 22 bp, Artificial Sequence
  chemically synthesized
ggcattttcctgccagaagcat

SEQ ID NO: 836068 - DNA, 22 bp, Artificial Sequence
  chemically synthesized
tggcattttcctgccagaagca

SEQ ID NO: 836069 - DNA, 22 bp, Artificial Sequence
  chemically synthesized
ttggcattttcctgccagaagc

SEQ ID NO: 836070 - DNA, 22 bp, Artificial Sequence
  chemically synthesized
tttggcattttcctgccagaag

SEQ ID NO: 836071 - DNA, 22 bp, Artificial Sequence
  chemically synthesized
ttttggcattttcctgccagaa

SEQ ID NO: 836072 - DNA, 22 bp, Artificial Sequence
  chemically synthesized
tgcatacatttttttggcattt

SEQ ID NO: 836073 - DNA, 22 bp, Artificial Sequence
  chemically synthesized
ctggcaggaaaatgccaaaaaa

SEQ ID NO: 836074 - DNA, 22 bp, Artificial Sequence
  chemically synthesized
tggcaggaaaatgccaaaaaaa

SEQ ID NO: 836075 - DNA, 22 bp, Artificial Sequence
  chemically synthesized
gcaggaaaatgccaaaaaaatg

SEQ ID NO: 836076 - DNA, 22 bp, Artificial Sequence
  chemically synthesized
gacccacaactgtgcatacatt

SEQ ID NO: 836077 - DNA, 22 bp, Artificial Sequence
  chemically synthesized
tcccatcaaaatgtcgtgattg

SEQ ID NO: 836078 - DNA, 22 bp, Artificial Sequence
  chemically synthesized
tatcccatcaaaatgtcgtgat

SEQ ID NO: 836079 - DNA, 22 bp, Artificial Sequence
  chemically synthesized
tctatcccatcaaaatgtcgtg

SEQ ID NO: 836080 - DNA, 22 bp, Artificial Sequence
  chemically synthesized
ctctatcccatcaaaatgtcgt

SEQ ID NO: 836081 - DNA, 22 bp, Artificial Sequence
  chemically synthesized
tgggtccaatcacgacattttg

SEQ ID NO: 836082 - DNA, 22 bp, Artificial Sequence
  chemically synthesized
cttctctatcccatcaaaatgt

SEQ ID NO: 836083 - DNA, 22 bp, Artificial Sequence
  chemically synthesized
tggcgaattacttctctatccc

SEQ ID NO: 836084 - DNA, 22 bp, Artificial Sequence
  chemically synthesized
aattgtggcgaattacttctct

SEQ ID NO: 836085 - DNA, 22 bp, Artificial Sequence
  chemically synthesized
tgatgggatagagaagtaattc

SEQ ID NO: 836086 - DNA, 22 bp, Artificial Sequence
  chemically synthesized
gatgggatagagaagtaattcg

SEQ ID NO: 836087 - DNA, 22 bp, Artificial Sequence
  chemically synthesized
atgggatagagaagtaattcgc

SEQ ID NO: 836088 - DNA, 22 bp, Artificial Sequence
  chemically synthesized
ccaagaaaccacagcagtgctc

SEQ ID NO: 836089 - DNA, 22 bp, Artificial Sequence
  chemically synthesized
gccacaattgagcactgctgtg

SEQ ID NO: 836090 - DNA, 22 bp, Artificial Sequence
  chemically synthesized
acagagcctcccaagaaaccac

SEQ ID NO: 836091 - DNA, 22 bp, Artificial Sequence
  chemically synthesized
agcactgctgtggtttcttggg

SEQ ID NO: 836092 - DNA, 22 bp, Artificial Sequence
  chemically synthesized
gtaggttgacagagcctcccaa

SEQ ID NO: 836093 - DNA, 22 bp, Artificial Sequence
  chemically synthesized
agtaggttgacagagcctccca

SEQ ID NO: 836094 - DNA, 22 bp, Artificial Sequence
  chemically synthesized
ctgtggtttcttgggaggctct

SEQ ID NO: 836095 - DNA, 22 bp, Artificial Sequence
  chemically synthesized
tggtttcttgggaggctctgtc

SEQ ID NO: 836096 - DNA, 22 bp, Artificial Sequence
  chemically synthesized
taacttagtaggttgacagagc

SEQ ID NO: 836097 - DNA, 22 bp, Artificial Sequence
  chemically synthesized
cttgggaggctctgtcaaccta

SEQ ID NO: 836098 - DNA, 22 bp, Artificial Sequence
  chemically synthesized
ttgggaggctctgtcaacctac

SEQ ID NO: 836099 - DNA, 22 bp, Artificial Sequence
  chemically synthesized
gggaggctctgtcaacctacta

SEQ ID NO: 836100 - DNA, 22 bp, Artificial Sequence
  chemically synthesized
ggaggctctgtcaacctactaa

SEQ ID NO: 836101 - DNA, 22 bp, Artificial Sequence
  chemically synthesized
ccataggataactataacttag

SEQ ID NO: 836102 - DNA, 22 bp, Artificial Sequence
  chemically synthesized
tgtcaacctactaagttatagt

SEQ ID NO: 836103 - DNA, 22 bp, Artificial Sequence
  chemically synthesized
ttcccataggataactataact

SEQ ID NO: 836104 - DNA, 22 bp, Artificial Sequence
  chemically synthesized
tcaacctactaagttatagtta

SEQ ID NO: 836105 - DNA, 22 bp, Artificial Sequence
  chemically synthesized
ctaagttatagttatcctatgg

SEQ ID NO: 836106 - DNA, 22 bp, Artificial Sequence
  chemically synthesized
tggggtctgttcccataggata

SEQ ID NO: 836107 - DNA, 22 bp, Artificial Sequence
  chemically synthesized
agttatagttatcctatgggaa

SEQ ID NO: 836108 - DNA, 22 bp, Artificial Sequence
  chemically synthesized
gctatggggtctgttcccatag

SEQ ID NO: 836109 - DNA, 22 bp, Artificial Sequence
  chemically synthesized
agctatggggtctgttcccata

SEQ ID NO: 836110 - DNA, 22 bp, Artificial Sequence
  chemically synthesized
tagctatggggtctgttcccat

SEQ ID NO: 836111 - DNA, 22 bp, Artificial Sequence
  chemically synthesized
tagttatcctatgggaacagac

SEQ ID NO: 836112 - DNA, 22 bp, Artificial Sequence
  chemically synthesized
tctttagctatggggtctgttc

SEQ ID NO: 836113 - DNA, 22 bp, Artificial Sequence
  chemically synthesized
tcctatgggaacagaccccata

SEQ ID NO: 836114 - DNA, 22 bp, Artificial Sequence
  chemically synthesized
attatctttagctatggggtct

SEQ ID NO: 836115 - DNA, 22 bp, Artificial Sequence
  chemically synthesized
taattatctttagctatggggt

SEQ ID NO: 836116 - DNA, 22 bp, Artificial Sequence
  chemically synthesized
tgggaacagaccccatagctaa

SEQ ID NO: 836117 - DNA, 22 bp, Artificial Sequence
  chemically synthesized
cagagggcaacattctaattat

SEQ ID NO: 836118 - DNA, 22 bp, Artificial Sequence
  chemically synthesized
cagaactccagagggcaacatt

SEQ ID NO: 836119 - DNA, 22 bp, Artificial Sequence
  chemically synthesized
aagataattagaatgttgccct

SEQ ID NO: 836120 - DNA, 22 bp, Artificial Sequence
  chemically synthesized
cattgcagaactccagagggca

SEQ ID NO: 836121 - DNA, 22 bp, Artificial Sequence
  chemically synthesized
ctacattgcagaactccagagg

SEQ ID NO: 836122 - DNA, 22 bp, Artificial Sequence
  chemically synthesized
gctacattgcagaactccagag

SEQ ID NO: 836123 - DNA, 22 bp, Artificial Sequence
  chemically synthesized
gaatgttgccctctggagttct

SEQ ID NO: 836124 - DNA, 22 bp, Artificial Sequence
  chemically synthesized
ccctctggagttctgcaatgta

SEQ ID NO: 836125 - DNA, 22 bp, Artificial Sequence
  chemically synthesized
tggagttctgcaatgtagcaag

SEQ ID NO: 836126 - DNA, 22 bp, Artificial Sequence
  chemically synthesized
gagttctgcaatgtagcaagct

SEQ ID NO: 836127 - DNA, 22 bp, Artificial Sequence
  chemically synthesized
tgcaatgtagcaagcttgcttt

SEQ ID NO: 836128 - DNA, 22 bp, Artificial Sequence
  chemically synthesized
caatgtagcaagcttgctttac

SEQ ID NO: 836129 - DNA, 22 bp, Artificial Sequence
  chemically synthesized
agtaggacagtggtatggtaaa

SEQ ID NO: 836130 - DNA, 22 bp, Artificial Sequence
  chemically synthesized
ttcagtaggacagtggtatggt

SEQ ID NO: 836131 - DNA, 22 bp, Artificial Sequence
  chemically synthesized
gctgttcagtaggacagtggta

SEQ ID NO: 836132 - DNA, 22 bp, Artificial Sequence
  chemically synthesized
gctttaccataccactgtccta

SEQ ID NO: 836133 - DNA, 22 bp, Artificial Sequence
  chemically synthesized
ctttaccataccactgtcctac

SEQ ID NO: 836134 - DNA, 22 bp, Artificial Sequence
  chemically synthesized
taccataccactgtcctactga

SEQ ID NO: 836135 - DNA, 22 bp, Artificial Sequence
  chemically synthesized
accataccactgtcctactgaa

SEQ ID NO: 836136 - DNA, 22 bp, Artificial Sequence
  chemically synthesized
ccataccactgtcctactgaac

SEQ ID NO: 836137 - DNA, 22 bp, Artificial Sequence
  chemically synthesized
tcaaagaggctggctgttcagt

SEQ ID NO: 836138 - DNA, 22 bp, Artificial Sequence
  chemically synthesized
aggattatcaaagaggctggct

SEQ ID NO: 836139 - DNA, 22 bp, Artificial Sequence
  chemically synthesized
tcctactgaacagccagcctct

SEQ ID NO: 836140 - DNA, 22 bp, Artificial Sequence
  chemically synthesized
aaggattatcaaagaggctggc

SEQ ID NO: 836141 - DNA, 22 bp, Artificial Sequence
  chemically synthesized
ttaaggattatcaaagaggctg

SEQ ID NO: 836142 - DNA, 22 bp, Artificial Sequence
  chemically synthesized
ctgaacagccagcctctttgat

SEQ ID NO: 836143 - DNA, 22 bp, Artificial Sequence
  chemically synthesized
cctcttaaggattatcaaagag

SEQ ID NO: 836144 - DNA, 22 bp, Artificial Sequence
  chemically synthesized
aacagccagcctctttgataat

SEQ ID NO: 836145 - DNA, 22 bp, Artificial Sequence
  chemically synthesized
gaatgttacctcttaaggatta

SEQ ID NO: 836146 - DNA, 22 bp, Artificial Sequence
  chemically synthesized
tttgataatccttaagaggtaa

SEQ ID NO: 836147 - DNA, 22 bp, Artificial Sequence
  chemically synthesized
tgataatccttaagaggtaaca

SEQ ID NO: 836148 - DNA, 22 bp, Artificial Sequence
  chemically synthesized
gataatccttaagaggtaacat

SEQ ID NO: 836149 - DNA, 22 bp, Artificial Sequence
  chemically synthesized
ataatccttaagaggtaacatt

SEQ ID NO: 836150 - DNA, 22 bp, Artificial Sequence
  chemically synthesized
aagaggtaacattccaactaca

SEQ ID NO: 836151 - DNA, 22 bp, Artificial Sequence
  chemically synthesized
agaggtaacattccaactacac

SEQ ID NO: 836152 - DNA, 22 bp, Artificial Sequence
  chemically synthesized
gagcaataagcagtgtagttgg

SEQ ID NO: 836153 - DNA, 22 bp, Artificial Sequence
  chemically synthesized
caactacactgcttattgctcc

SEQ ID NO: 836154 - DNA, 22 bp, Artificial Sequence
  chemically synthesized
aaagtgtgtggtaacctggagc

SEQ ID NO: 836155 - DNA, 22 bp, Artificial Sequence
  chemically synthesized
cactgcttattgctccaggtta

SEQ ID NO: 836156 - DNA, 22 bp, Artificial Sequence
  chemically synthesized
caaagtgtgtggtaacctggag

SEQ ID NO: 836157 - DNA, 22 bp, Artificial Sequence
  chemically synthesized
tcaaagtgtgtggtaacctgga

SEQ ID NO: 836158 - DNA, 22 bp, Artificial Sequence
  chemically synthesized
ttcaaagtgtgtggtaacctgg

SEQ ID NO: 836159 - DNA, 22 bp, Artificial Sequence
  chemically synthesized
cttattgctccaggttaccaca

SEQ ID NO: 836160 - DNA, 22 bp, Artificial Sequence
  chemically synthesized
attgctccaggttaccacacac

SEQ ID NO: 836161 - DNA, 22 bp, Artificial Sequence
  chemically synthesized
ttgctccaggttaccacacact

SEQ ID NO: 836162 - DNA, 22 bp, Artificial Sequence
  chemically synthesized
ctccaggttaccacacactttg

SEQ ID NO: 836163 - DNA, 22 bp, Artificial Sequence
  chemically synthesized
caggttaccacacactttgaaa

SEQ ID NO: 836164 - DNA, 22 bp, Artificial Sequence
  chemically synthesized
acaaagacatgagcttttcaaa

SEQ ID NO: 836165 - DNA, 22 bp, Artificial Sequence
  chemically synthesized
ccacacactttgaaaagctcat

SEQ ID NO: 836166 - DNA, 22 bp, Artificial Sequence
  chemically synthesized
aataaaattaacaaagacatga

SEQ ID NO: 836167 - DNA, 22 bp, Artificial Sequence
  chemically synthesized
tgaaaagctcatgtctttgtta

SEQ ID NO: 836168 - DNA, 22 bp, Artificial Sequence
  chemically synthesized
gaaaagctcatgtctttgttaa

SEQ ID NO: 836169 - DNA, 22 bp, Artificial Sequence
  chemically synthesized
aaaagctcatgtctttgttaat

SEQ ID NO: 836170 - DNA, 22 bp, Artificial Sequence
  chemically synthesized
aaaatatattaaataaaattaa

SEQ ID NO: 836171 - DNA, 22 bp, Artificial Sequence
  chemically synthesized
atgtctttgttaattttattta

SEQ ID NO: 836172 - DNA, 22 bp, Artificial Sequence
  chemically synthesized
tgttaattttatttaatatatt

SEQ ID NO: 836173 - DNA, 22 bp, Artificial Sequence
  chemically synthesized
gttaattttatttaatatattt

SEQ ID NO: 836174 - DNA, 22 bp, Artificial Sequence
  chemically synthesized
ttaattttatttaatatatttt

SEQ ID NO: 836175 - DNA, 22 bp, Artificial Sequence
  chemically synthesized
agtgaataaattaaaaatatat

SEQ ID NO: 836176 - DNA, 22 bp, Artificial Sequence
  chemically synthesized
attttatttaatatatttttaa

SEQ ID NO: 836177 - DNA, 22 bp, Artificial Sequence
  chemically synthesized
gattaagtgaataaattaaaaa

SEQ ID NO: 836178 - DNA, 22 bp, Artificial Sequence
  chemically synthesized
tatttaatatatttttaattta

SEQ ID NO: 836179 - DNA, 22 bp, Artificial Sequence
  chemically synthesized
atttaatatatttttaatttat

SEQ ID NO: 836180 - DNA, 22 bp, Artificial Sequence
  chemically synthesized
tttaatatatttttaatttatt

SEQ ID NO: 836181 - DNA, 22 bp, Artificial Sequence
  chemically synthesized
actagattaagtgaataaatta

SEQ ID NO: 836182 - DNA, 22 bp, Artificial Sequence
  chemically synthesized
aatatatttttaatttattcac

SEQ ID NO: 836183 - DNA, 22 bp, Artificial Sequence
  chemically synthesized
atatatttttaatttattcact

SEQ ID NO: 836184 - DNA, 22 bp, Artificial Sequence
  chemically synthesized
catcattcactagattaagtga

SEQ ID NO: 836185 - DNA, 22 bp, Artificial Sequence
  chemically synthesized
ttaatttattcacttaatctag

SEQ ID NO: 836186 - DNA, 22 bp, Artificial Sequence
  chemically synthesized
taatttattcacttaatctagt

SEQ ID NO: 836187 - DNA, 22 bp, Artificial Sequence
  chemically synthesized
aatttattcacttaatctagtg

SEQ ID NO: 836188 - DNA, 22 bp, Artificial Sequence
  chemically synthesized
atttattcacttaatctagtga

SEQ ID NO: 836189 - DNA, 22 bp, Artificial Sequence
  chemically synthesized
caatcattacatcattcactag

SEQ ID NO: 836190 - DNA, 22 bp, Artificial Sequence
  chemically synthesized
attcacttaatctagtgaatga

SEQ ID NO: 836191 - DNA, 22 bp, Artificial Sequence
  chemically synthesized
ttcacttaatctagtgaatgat

SEQ ID NO: 836192 - DNA, 22 bp, Artificial Sequence
  chemically synthesized
acttaatctagtgaatgatgta

SEQ ID NO: 836193 - DNA, 22 bp, Artificial Sequence
  chemically synthesized
aatctagtgaatgatgtaatga

SEQ ID NO: 836194 - DNA, 22 bp, Artificial Sequence
  chemically synthesized
atctagtgaatgatgtaatgat

SEQ ID NO: 836195 - DNA, 22 bp, Artificial Sequence
  chemically synthesized
aacgaaaatattacaatcatta

SEQ ID NO: 836196 - DNA, 22 bp, Artificial Sequence
  chemically synthesized
gtgaatgatgtaatgattgtaa

SEQ ID NO: 836197 - DNA, 22 bp, Artificial Sequence
  chemically synthesized
cagtcatcactgaacgaaaata

SEQ ID NO: 836198 - DNA, 22 bp, Artificial Sequence
  chemically synthesized
taatattttcgttcagtgatga

SEQ ID NO: 836199 - DNA, 22 bp, Artificial Sequence
  chemically synthesized
tcgttcagtgatgactgtaata

SEQ ID NO: 836200 - DNA, 22 bp, Artificial Sequence
  chemically synthesized
gtggaaccaaaatattacagtc

SEQ ID NO: 836201 - DNA, 22 bp, Artificial Sequence
  chemically synthesized
cgttcagtgatgactgtaatat

SEQ ID NO: 836202 - DNA, 22 bp, Artificial Sequence
  chemically synthesized
agtggaaccaaaatattacagt

SEQ ID NO: 836203 - DNA, 22 bp, Artificial Sequence
  chemically synthesized
gttcagtgatgactgtaatatt

SEQ ID NO: 836204 - DNA, 22 bp, Artificial Sequence
  chemically synthesized
tagtggaaccaaaatattacag

SEQ ID NO: 836205 - DNA, 22 bp, Artificial Sequence
  chemically synthesized
ttagtggaaccaaaatattaca

SEQ ID NO: 836206 - DNA, 22 bp, Artificial Sequence
  chemically synthesized
tttagtggaaccaaaatattac

SEQ ID NO: 836207 - DNA, 22 bp, Artificial Sequence
  chemically synthesized
agtgatgactgtaatattttgg

SEQ ID NO: 836208 - DNA, 22 bp, Artificial Sequence
  chemically synthesized
taatattttggttccactaaaa

SEQ ID NO: 836209 - DNA, 22 bp, Artificial Sequence
  chemically synthesized
tggttccactaaaaaactgact

SEQ ID NO: 836210 - DNA, 22 bp, Artificial Sequence
  chemically synthesized
ggttccactaaaaaactgacta

SEQ ID NO: 836211 - DNA, 22 bp, Artificial Sequence
  chemically synthesized
gttccactaaaaaactgactac

SEQ ID NO: 836212 - DNA, 22 bp, Artificial Sequence
  chemically synthesized
cactaaaaaactgactacatta

SEQ ID NO: 836213 - DNA, 22 bp, Artificial Sequence
  chemically synthesized
aaaaactgactacattaccttc

SEQ ID NO: 836214 - DNA, 22 bp, Artificial Sequence
  chemically synthesized
atatcaggatacacatgaaggt

SEQ ID NO: 836215 - DNA, 22 bp, Artificial Sequence
  chemically synthesized
actacattaccttcatgtgtat

SEQ ID NO: 836216 - DNA, 22 bp, Artificial Sequence
  chemically synthesized
cattaccttcatgtgtatcctg

SEQ ID NO: 836217 - DNA, 22 bp, Artificial Sequence
  chemically synthesized
taaagggattcatatcaggata

SEQ ID NO: 836218 - DNA, 22 bp, Artificial Sequence
  chemically synthesized
ccttcatgtgtatcctgatatg

SEQ ID NO: 836219 - DNA, 22 bp, Artificial Sequence
  chemically synthesized
catgtgtatcctgatatgaatc

SEQ ID NO: 836220 - DNA, 22 bp, Artificial Sequence
  chemically synthesized
atgtgtatcctgatatgaatcc

SEQ ID NO: 836221 - DNA, 22 bp, Artificial Sequence
  chemically synthesized
atatgaatccctttatagtctt

SEQ ID NO: 836222 - DNA, 22 bp, Artificial Sequence
  chemically synthesized
agaaaaaaggaaaggaagacta

SEQ ID NO: 836223 - DNA, 22 bp, Artificial Sequence
  chemically synthesized
aagaaaaaaggaaaggaagact

SEQ ID NO: 836224 - DNA, 22 bp, Artificial Sequence
  chemically synthesized
tgaatttaagaaaaaaggaaag

SEQ ID NO: 836225 - DNA, 22 bp, Artificial Sequence
  chemically synthesized
atgaatttaagaaaaaaggaaa

SEQ ID NO: 836226 - DNA, 22 bp, Artificial Sequence
  chemically synthesized
tatagtcttcctttcctttttt

SEQ ID NO: 836227 - DNA, 22 bp, Artificial Sequence
  chemically synthesized
tatgaatttaagaaaaaaggaa

SEQ ID NO: 836228 - DNA, 22 bp, Artificial Sequence
  chemically synthesized
atagtcttcctttccttttttc

SEQ ID NO: 836229 - DNA, 22 bp, Artificial Sequence
  chemically synthesized
tagtcttcctttccttttttct

SEQ ID NO: 836230 - DNA, 22 bp, Artificial Sequence
  chemically synthesized
tacattttatgaatttaagaaa

SEQ ID NO: 836231 - DNA, 22 bp, Artificial Sequence
  chemically synthesized
atacattttatgaatttaagaa

SEQ ID NO: 836232 - DNA, 22 bp, Artificial Sequence
  chemically synthesized
cctttccttttttcttaaattc

SEQ ID NO: 836233 - DNA, 22 bp, Artificial Sequence
  chemically synthesized
ctttccttttttcttaaattca

SEQ ID NO: 836234 - DNA, 22 bp, Artificial Sequence
  chemically synthesized
tccttttttcttaaattcataa

SEQ ID NO: 836235 - DNA, 22 bp, Artificial Sequence
  chemically synthesized
ccttttttcttaaattcataaa

SEQ ID NO: 836236 - DNA, 22 bp, Artificial Sequence
  chemically synthesized
cttttttcttaaattcataaaa

SEQ ID NO: 836237 - DNA, 22 bp, Artificial Sequence
  chemically synthesized
atcaatttatacattttatgaa

SEQ ID NO: 836238 - DNA, 22 bp, Artificial Sequence
  chemically synthesized
ttttcttaaattcataaaatgt

SEQ ID NO: 836239 - DNA, 22 bp, Artificial Sequence
  chemically synthesized
tttcttaaattcataaaatgta

SEQ ID NO: 836240 - DNA, 22 bp, Artificial Sequence
  chemically synthesized
ttcatcaatttatacattttat

SEQ ID NO: 836241 - DNA, 22 bp, Artificial Sequence
  chemically synthesized
ttcttaaattcataaaatgtat

SEQ ID NO: 836242 - DNA, 22 bp, Artificial Sequence
  chemically synthesized
tcttaaattcataaaatgtata

SEQ ID NO: 836243 - DNA, 22 bp, Artificial Sequence
  chemically synthesized
cttaaattcataaaatgtataa

SEQ ID NO: 836244 - DNA, 22 bp, Artificial Sequence
  chemically synthesized
ttaaattcataaaatgtataaa

SEQ ID NO: 836245 - DNA, 22 bp, Artificial Sequence
  chemically synthesized
attattcatcaatttatacatt

SEQ ID NO: 836246 - DNA, 22 bp, Artificial Sequence
  chemically synthesized
aaattcataaaatgtataaatt

SEQ ID NO: 836247 - DNA, 22 bp, Artificial Sequence
  chemically synthesized
aattcataaaatgtataaattg

SEQ ID NO: 836248 - DNA, 22 bp, Artificial Sequence
  chemically synthesized
ataaaatgtataaattgatgaa

SEQ ID NO: 836249 - DNA, 22 bp, Artificial Sequence
  chemically synthesized
cacagcataagtcctgattatt

SEQ ID NO: 836250 - DNA, 22 bp, Artificial Sequence
  chemically synthesized
acacagcataagtcctgattat

SEQ ID NO: 836251 - DNA, 22 bp, Artificial Sequence
  chemically synthesized
ttacacagcataagtcctgatt

SEQ ID NO: 836252 - DNA, 22 bp, Artificial Sequence
  chemically synthesized
ttcttacacagcataagtcctg

SEQ ID NO: 836253 - DNA, 22 bp, Artificial Sequence
  chemically synthesized
attcttacacagcataagtcct

SEQ ID NO: 836254 - DNA, 22 bp, Artificial Sequence
  chemically synthesized
tattcttacacagcataagtcc

SEQ ID NO: 836255 - DNA, 22 bp, Artificial Sequence
  chemically synthesized
atgaataatcaggacttatgct

SEQ ID NO: 836256 - DNA, 22 bp, Artificial Sequence
  chemically synthesized
tctttattcttacacagcataa

SEQ ID NO: 836257 - DNA, 22 bp, Artificial Sequence
  chemically synthesized
atgctgtgtaagaataaagaca

SEQ ID NO: 836258 - DNA, 22 bp, Artificial Sequence
  chemically synthesized
tgctgtgtaagaataaagacaa

SEQ ID NO: 836259 - DNA, 22 bp, Artificial Sequence
  chemically synthesized
tgtaagaataaagacaacttta

SEQ ID NO: 836260 - DNA, 22 bp, Artificial Sequence
  chemically synthesized
aagggagaaccaaaggcagata

SEQ ID NO: 836261 - DNA, 22 bp, Artificial Sequence
  chemically synthesized
aaagggagaaccaaaggcagat

SEQ ID NO: 836262 - DNA, 22 bp, Artificial Sequence
  chemically synthesized
aacagatttaaagggagaacca

SEQ ID NO: 836263 - DNA, 22 bp, Artificial Sequence
  chemically synthesized
gaacagatttaaagggagaacc

SEQ ID NO: 836264 - DNA, 22 bp, Artificial Sequence
  chemically synthesized
tatctgcctttggttctccctt

SEQ ID NO: 836265 - DNA, 22 bp, Artificial Sequence
  chemically synthesized
atctgcctttggttctcccttt

SEQ ID NO: 836266 - DNA, 22 bp, Artificial Sequence
  chemically synthesized
tctgcctttggttctcccttta

SEQ ID NO: 836267 - DNA, 22 bp, Artificial Sequence
  chemically synthesized
cttgaacagatttaaagggaga

SEQ ID NO: 836268 - DNA, 22 bp, Artificial Sequence
  chemically synthesized
cctttggttctccctttaaatc

SEQ ID NO: 836269 - DNA, 22 bp, Artificial Sequence
  chemically synthesized
tggttctccctttaaatctgtt

SEQ ID NO: 836270 - DNA, 22 bp, Artificial Sequence
  chemically synthesized
ggttctccctttaaatctgttc

SEQ ID NO: 836271 - DNA, 22 bp, Artificial Sequence
  chemically synthesized
gttctccctttaaatctgttca

SEQ ID NO: 836272 - DNA, 22 bp, Artificial Sequence
  chemically synthesized
tccctttaaatctgttcaagta

SEQ ID NO: 836273 - DNA, 22 bp, Artificial Sequence
  chemically synthesized
cctttaaatctgttcaagtagg

SEQ ID NO: 836274 - DNA, 22 bp, Artificial Sequence
  chemically synthesized
taaatctgttcaagtaggttgt

SEQ ID NO: 836275 - DNA, 22 bp, Artificial Sequence
  chemically synthesized
aaatctgttcaagtaggttgtt

SEQ ID NO: 836276 - DNA, 22 bp, Artificial Sequence
  chemically synthesized
aatctgttcaagtaggttgttc

SEQ ID NO: 836277 - DNA, 22 bp, Artificial Sequence
  chemically synthesized
acccaagaacagaacagaacaa

SEQ ID NO: 836278 - DNA, 22 bp, Artificial Sequence
  chemically synthesized
cacccaagaacagaacagaaca

SEQ ID NO: 836279 - DNA, 22 bp, Artificial Sequence
  chemically synthesized
ttcaagtaggttgttctgttct

SEQ ID NO: 836280 - DNA, 22 bp, Artificial Sequence
  chemically synthesized
tcacccaagaacagaacagaac

SEQ ID NO: 836281 - DNA, 22 bp, Artificial Sequence
  chemically synthesized
aagtaggttgttctgttctgtt

SEQ ID NO: 836282 - DNA, 22 bp, Artificial Sequence
  chemically synthesized
cccatattttcacccaagaaca

SEQ ID NO: 836283 - DNA, 22 bp, Artificial Sequence
  chemically synthesized
acccatattttcacccaagaac

SEQ ID NO: 836284 - DNA, 22 bp, Artificial Sequence
  chemically synthesized
ttctgttctgttcttgggtgaa

SEQ ID NO: 836285 - DNA, 22 bp, Artificial Sequence
  chemically synthesized
tgttctgttcttgggtgaaaat

SEQ ID NO: 836286 - DNA, 22 bp, Artificial Sequence
  chemically synthesized
ttctgttcttgggtgaaaatat

SEQ ID NO: 836287 - DNA, 22 bp, Artificial Sequence
  chemically synthesized
tgttcttgggtgaaaatatggg

SEQ ID NO: 836288 - DNA, 22 bp, Artificial Sequence
  chemically synthesized
ttcttgggtgaaaatatgggta

SEQ ID NO: 836289 - DNA, 22 bp, Artificial Sequence
  chemically synthesized
ttgggtgaaaatatgggtaagt

SEQ ID NO: 836290 - DNA, 22 bp, Artificial Sequence
  chemically synthesized
gggtgaaaatatgggtaagttt

SEQ ID NO: 836291 - DNA, 22 bp, Artificial Sequence
  chemically synthesized
ggtgaaaatatgggtaagtttc

SEQ ID NO: 836292 - DNA, 22 bp, Artificial Sequence
  chemically synthesized
atgatgaccagaaaagacatga

SEQ ID NO: 836293 - DNA, 22 bp, Artificial Sequence
  chemically synthesized
aatgatgaccagaaaagacatg

SEQ ID NO: 836294 - DNA, 22 bp, Artificial Sequence
  chemically synthesized
cttaatgatgaccagaaaagac

SEQ ID NO: 836295 - DNA, 22 bp, Artificial Sequence
  chemically synthesized
ccttaatgatgaccagaaaaga

SEQ ID NO: 836296 - DNA, 22 bp, Artificial Sequence
  chemically synthesized
tttccttaatgatgaccagaaa

SEQ ID NO: 836297 - DNA, 22 bp, Artificial Sequence
  chemically synthesized
gtttccttaatgatgaccagaa

SEQ ID NO: 836298 - DNA, 22 bp, Artificial Sequence
  chemically synthesized
tgtttccttaatgatgaccaga

SEQ ID NO: 836299 - DNA, 22 bp, Artificial Sequence
  chemically synthesized
catgtcttttctggtcatcatt

SEQ ID NO: 836300 - DNA, 22 bp, Artificial Sequence
  chemically synthesized
atgtcttttctggtcatcatta

SEQ ID NO: 836301 - DNA, 22 bp, Artificial Sequence
  chemically synthesized
ttctggtcatcattaaggaaac

SEQ ID NO: 836302 - DNA, 22 bp, Artificial Sequence
  chemically synthesized
tctggtcatcattaaggaaaca

SEQ ID NO: 836303 - DNA, 22 bp, Artificial Sequence
  chemically synthesized
ctggtcatcattaaggaaacaa

SEQ ID NO: 836304 - DNA, 22 bp, Artificial Sequence
  chemically synthesized
tggtcatcattaaggaaacaaa

SEQ ID NO: 836305 - DNA, 22 bp, Artificial Sequence
  chemically synthesized
gtcatcattaaggaaacaaagt

SEQ ID NO: 836306 - DNA, 22 bp, Artificial Sequence
  chemically synthesized
gatatggagcaggactttgttt

SEQ ID NO: 836307 - DNA, 22 bp, Artificial Sequence
  chemically synthesized
atgtctcgatatggagcaggac

SEQ ID NO: 836308 - DNA, 22 bp, Artificial Sequence
  chemically synthesized
aatgtctcgatatggagcagga

SEQ ID NO: 836309 - DNA, 22 bp, Artificial Sequence
  chemically synthesized
aggaaacaaagtcctgctccat

SEQ ID NO: 836310 - DNA, 22 bp, Artificial Sequence
  chemically synthesized
taatgtctcgatatggagcagg

SEQ ID NO: 836311 - DNA, 22 bp, Artificial Sequence
  chemically synthesized
attttaatgtctcgatatggag

SEQ ID NO: 836312 - DNA, 22 bp, Artificial Sequence
  chemically synthesized
taattttaatgtctcgatatgg

SEQ ID NO: 836313 - DNA, 22 bp, Artificial Sequence
  chemically synthesized
gatattctaattttaatgtctc

SEQ ID NO: 836314 - DNA, 22 bp, Artificial Sequence
  chemically synthesized
ctccatatcgagacattaaaat

SEQ ID NO: 836315 - DNA, 22 bp, Artificial Sequence
  chemically synthesized
agctggatattctaattttaat

SEQ ID NO: 836316 - DNA, 22 bp, Artificial Sequence
  chemically synthesized
catatcgagacattaaaattag

SEQ ID NO: 836317 - DNA, 22 bp, Artificial Sequence
  chemically synthesized
atatattgagctggatattcta

SEQ ID NO: 836318 - DNA, 22 bp, Artificial Sequence
  chemically synthesized
attaatatattgagctggatat

SEQ ID NO: 836319 - DNA, 22 bp, Artificial Sequence
  chemically synthesized
aaattagaatatccagctcaat

SEQ ID NO: 836320 - DNA, 22 bp, Artificial Sequence
  chemically synthesized
aagtattgattaatatattgag

SEQ ID NO: 836321 - DNA, 22 bp, Artificial Sequence
  chemically synthesized
gaatatccagctcaatatatta

SEQ ID NO: 836322 - DNA, 22 bp, Artificial Sequence
  chemically synthesized
agattgaagtattgattaatat

SEQ ID NO: 836323 - DNA, 22 bp, Artificial Sequence
  chemically synthesized
aatatattaatcaatacttcaa

SEQ ID NO: 836324 - DNA, 22 bp, Artificial Sequence
  chemically synthesized
atcaatacttcaatctgaactc

SEQ ID NO: 836325 - DNA, 22 bp, Artificial Sequence
  chemically synthesized
aggaagaaatcatatatgtgag

SEQ ID NO: 836326 - DNA, 22 bp, Artificial Sequence
  chemically synthesized
caatctgaactcacatatatga

SEQ ID NO: 836327 - DNA, 22 bp, Artificial Sequence
  chemically synthesized
aatctgaactcacatatatgat

SEQ ID NO: 836328 - DNA, 22 bp, Artificial Sequence
  chemically synthesized
attgaggaagaaatcatatatg

SEQ ID NO: 836329 - DNA, 22 bp, Artificial Sequence
  chemically synthesized
taattgaggaagaaatcatata

SEQ ID NO: 836330 - DNA, 22 bp, Artificial Sequence
  chemically synthesized
ctaattgaggaagaaatcatat

SEQ ID NO: 836331 - DNA, 22 bp, Artificial Sequence
  chemically synthesized
ttctaattgaggaagaaatcat

SEQ ID NO: 836332 - DNA, 22 bp, Artificial Sequence
  chemically synthesized
aactcacatatatgatttcttc

SEQ ID NO: 836333 - DNA, 22 bp, Artificial Sequence
  chemically synthesized
acatatatgatttcttcctcaa

SEQ ID NO: 836334 - DNA, 22 bp, Artificial Sequence
  chemically synthesized
catcctcttctaattgaggaag

SEQ ID NO: 836335 - DNA, 22 bp, Artificial Sequence
  chemically synthesized
ccatcctcttctaattgaggaa

SEQ ID NO: 836336 - DNA, 22 bp, Artificial Sequence
  chemically synthesized
tccacttccatcctcttctaat

SEQ ID NO: 836337 - DNA, 22 bp, Artificial Sequence
  chemically synthesized
cttcctcaattagaagaggatg

SEQ ID NO: 836338 - DNA, 22 bp, Artificial Sequence
  chemically synthesized
ttcctcaattagaagaggatgg

SEQ ID NO: 836339 - DNA, 22 bp, Artificial Sequence
  chemically synthesized
cctcaattagaagaggatggaa

SEQ ID NO: 836340 - DNA, 22 bp, Artificial Sequence
  chemically synthesized
ctcaattagaagaggatggaag

SEQ ID NO: 836341 - DNA, 22 bp, Artificial Sequence
  chemically synthesized
aattagaagaggatggaagtgg

SEQ ID NO: 836342 - DNA, 22 bp, Artificial Sequence
  chemically synthesized
gaagaggatggaagtggacagg

SEQ ID NO: 836343 - DNA, 22 bp, Artificial Sequence
  chemically synthesized
ccccaggtagtaaaggacctgt

SEQ ID NO: 836344 - DNA, 22 bp, Artificial Sequence
  chemically synthesized
tactacctggggtagtgggcat

SEQ ID NO: 836345 - DNA, 22 bp, Artificial Sequence
  chemically synthesized
actacctggggtagtgggcatg

SEQ ID NO: 836346 - DNA, 22 bp, Artificial Sequence
  chemically synthesized
ctacctggggtagtgggcatgg

SEQ ID NO: 836347 - DNA, 22 bp, Artificial Sequence
  chemically synthesized
cctggggtagtgggcatggtgg

SEQ ID NO: 836348 - DNA, 22 bp, Artificial Sequence
  chemically synthesized
gggtagtgggcatggtgggctt

SEQ ID NO: 836349 - DNA, 22 bp, Artificial Sequence
  chemically synthesized
gcaagacagaaagaggaagccc

SEQ ID NO: 836350 - DNA, 22 bp, Artificial Sequence
  chemically synthesized
cctctttctgtcttgctagtct

SEQ ID NO: 836351 - DNA, 22 bp, Artificial Sequence
  chemically synthesized
ctctttctgtcttgctagtctt

SEQ ID NO: 836352 - DNA, 22 bp, Artificial Sequence
  chemically synthesized
gtgaatggtagagaagactagc

SEQ ID NO: 836353 - DNA, 22 bp, Artificial Sequence
  chemically synthesized
tttctgtcttgctagtcttctc

SEQ ID NO: 836354 - DNA, 22 bp, Artificial Sequence
  chemically synthesized
tctgtcttgctagtcttctcta

SEQ ID NO: 836355 - DNA, 22 bp, Artificial Sequence
  chemically synthesized
ctgtcttgctagtcttctctac

SEQ ID NO: 836356 - DNA, 22 bp, Artificial Sequence
  chemically synthesized
tgtcttgctagtcttctctacc

SEQ ID NO: 836357 - DNA, 22 bp, Artificial Sequence
  chemically synthesized
tcttgctagtcttctctaccat

SEQ ID NO: 836358 - DNA, 22 bp, Artificial Sequence
  chemically synthesized
gctagtcttctctaccattcac

SEQ ID NO: 836359 - DNA, 22 bp, Artificial Sequence
  chemically synthesized
ctagtcttctctaccattcacc

SEQ ID NO: 836360 - DNA, 22 bp, Artificial Sequence
  chemically synthesized
gtcttctctaccattcaccagc

SEQ ID NO: 836361 - DNA, 22 bp, Artificial Sequence
  chemically synthesized
gggtgagaaatagcagctggtg

SEQ ID NO: 836362 - DNA, 22 bp, Artificial Sequence
  chemically synthesized
ctctaccattcaccagctgcta

SEQ ID NO: 836363 - DNA, 22 bp, Artificial Sequence
  chemically synthesized
tctaccattcaccagctgctat

SEQ ID NO: 836364 - DNA, 22 bp, Artificial Sequence
  chemically synthesized
ttagggtgagaaatagcagctg

SEQ ID NO: 836365 - DNA, 22 bp, Artificial Sequence
  chemically synthesized
gttagggtgagaaatagcagct

SEQ ID NO: 836366 - DNA, 22 bp, Artificial Sequence
  chemically synthesized
taccattcaccagctgctattt

SEQ ID NO: 836367 - DNA, 22 bp, Artificial Sequence
  chemically synthesized
ccattcaccagctgctatttct

SEQ ID NO: 836368 - DNA, 22 bp, Artificial Sequence
  chemically synthesized
acccttgttagggtgagaaata

SEQ ID NO: 836369 - DNA, 22 bp, Artificial Sequence
  chemically synthesized
accagctgctatttctcaccct

SEQ ID NO: 836370 - DNA, 22 bp, Artificial Sequence
  chemically synthesized
ccattaacccttgttagggtga

SEQ ID NO: 836371 - DNA, 22 bp, Artificial Sequence
  chemically synthesized
ctatttctcaccctaacaaggg

SEQ ID NO: 836372 - DNA, 22 bp, Artificial Sequence
  chemically synthesized
cactcccattaacccttgttag

SEQ ID NO: 836373 - DNA, 22 bp, Artificial Sequence
  chemically synthesized
ccactcccattaacccttgtta

SEQ ID NO: 836374 - DNA, 22 bp, Artificial Sequence
  chemically synthesized
tttctcaccctaacaagggtta

SEQ ID NO: 836375 - DNA, 22 bp, Artificial Sequence
  chemically synthesized
ttccactcccattaacccttgt

SEQ ID NO: 836376 - DNA, 22 bp, Artificial Sequence
  chemically synthesized
cttccactcccattaacccttg

SEQ ID NO: 836377 - DNA, 22 bp, Artificial Sequence
  chemically synthesized
ctcaccctaacaagggttaatg

SEQ ID NO: 836378 - DNA, 22 bp, Artificial Sequence
  chemically synthesized
ttcttccactcccattaaccct

SEQ ID NO: 836379 - DNA, 22 bp, Artificial Sequence
  chemically synthesized
tcaccctaacaagggttaatgg

SEQ ID NO: 836380 - DNA, 22 bp, Artificial Sequence
  chemically synthesized
cttcttccactcccattaaccc

SEQ ID NO: 836381 - DNA, 22 bp, Artificial Sequence
  chemically synthesized
accctaacaagggttaatggga

SEQ ID NO: 836382 - DNA, 22 bp, Artificial Sequence
  chemically synthesized
ttcttcttccactcccattaac

SEQ ID NO: 836383 - DNA, 22 bp, Artificial Sequence
  chemically synthesized
cttcttcttccactcccattaa

SEQ ID NO: 836384 - DNA, 22 bp, Artificial Sequence
  chemically synthesized
acaagggttaatgggagtggaa

SEQ ID NO: 836385 - DNA, 22 bp, Artificial Sequence
  chemically synthesized
caccccttcttcttcttccact

SEQ ID NO: 836386 - DNA, 22 bp, Artificial Sequence
  chemically synthesized
tgcaccccttcttcttcttcca

SEQ ID NO: 836387 - DNA, 22 bp, Artificial Sequence
  chemically synthesized
ctgcaccccttcttcttcttcc

SEQ ID NO: 836388 - DNA, 22 bp, Artificial Sequence
  chemically synthesized
tctgcaccccttcttcttcttc

SEQ ID NO: 836389 - DNA, 22 bp, Artificial Sequence
  chemically synthesized
atgggagtggaagaagaagaag

SEQ ID NO: 836390 - DNA, 22 bp, Artificial Sequence
  chemically synthesized
agtgaagtaagaattttctgca

SEQ ID NO: 836391 - DNA, 22 bp, Artificial Sequence
  chemically synthesized
acagtgacagtactgagtgaag

SEQ ID NO: 836392 - DNA, 22 bp, Artificial Sequence
  chemically synthesized
taacagtgacagtactgagtga

SEQ ID NO: 836393 - DNA, 22 bp, Artificial Sequence
  chemically synthesized
ttacttcactcagtactgtcac

SEQ ID NO: 836394 - DNA, 22 bp, Artificial Sequence
  chemically synthesized
acttcactcagtactgtcactg

SEQ ID NO: 836395 - DNA, 22 bp, Artificial Sequence
  chemically synthesized
cttcactcagtactgtcactgt

SEQ ID NO: 836396 - DNA, 22 bp, Artificial Sequence
  chemically synthesized
cactcagtactgtcactgttag

SEQ ID NO: 836397 - DNA, 22 bp, Artificial Sequence
  chemically synthesized
actcagtactgtcactgttaga

SEQ ID NO: 836398 - DNA, 22 bp, Artificial Sequence
  chemically synthesized
agtactgtcactgttagagtgt

SEQ ID NO: 836399 - DNA, 22 bp, Artificial Sequence
  chemically synthesized
gaaagcacaaagtcacactcta

SEQ ID NO: 836400 - DNA, 22 bp, Artificial Sequence
  chemically synthesized
tcactgttagagtgtgactttg

SEQ ID NO: 836401 - DNA, 22 bp, Artificial Sequence
  chemically synthesized
acattagaaagcacaaagtcac

SEQ ID NO: 836402 - DNA, 22 bp, Artificial Sequence
  chemically synthesized
gacattagaaagcacaaagtca

SEQ ID NO: 836403 - DNA, 22 bp, Artificial Sequence
  chemically synthesized
ttagagtgtgactttgtgcttt

SEQ ID NO: 836404 - DNA, 22 bp, Artificial Sequence
  chemically synthesized
gagtgtgactttgtgctttcta

SEQ ID NO: 836405 - DNA, 22 bp, Artificial Sequence
  chemically synthesized
tgtgctttctaatgtcaaatat

SEQ ID NO: 836406 - DNA, 22 bp, Artificial Sequence
  chemically synthesized
gtgctttctaatgtcaaatatc

SEQ ID NO: 836407 - DNA, 22 bp, Artificial Sequence
  chemically synthesized
tgctttctaatgtcaaatatca

SEQ ID NO: 836408 - DNA, 22 bp, Artificial Sequence
  chemically synthesized
cgtgaaaccccagaagtgatat

SEQ ID NO: 836409 - DNA, 22 bp, Artificial Sequence
  chemically synthesized
tctaatgtcaaatatcacttct

SEQ ID NO: 836410 - DNA, 22 bp, Artificial Sequence
  chemically synthesized
ctaatgtcaaatatcacttctg

SEQ ID NO: 836411 - DNA, 22 bp, Artificial Sequence
  chemically synthesized
taatgtcaaatatcacttctgg

SEQ ID NO: 836412 - DNA, 22 bp, Artificial Sequence
  chemically synthesized
atgtcaaatatcacttctgggg

SEQ ID NO: 836413 - DNA, 22 bp, Artificial Sequence
  chemically synthesized
agctccgtgaaaccccagaagt

SEQ ID NO: 836414 - DNA, 22 bp, Artificial Sequence
  chemically synthesized
cagctccgtgaaaccccagaag

SEQ ID NO: 836415 - DNA, 22 bp, Artificial Sequence
  chemically synthesized
ggagaaatacatttcagctccg

SEQ ID NO: 836416 - DNA, 22 bp, Artificial Sequence
  chemically synthesized
ctggggtttcacggagctgaaa

SEQ ID NO: 836417 - DNA, 22 bp, Artificial Sequence
  chemically synthesized
tggggtttcacggagctgaaat

SEQ ID NO: 836418 - DNA, 22 bp, Artificial Sequence
  chemically synthesized
gggtttcacggagctgaaatgt

SEQ ID NO: 836419 - DNA, 22 bp, Artificial Sequence
  chemically synthesized
aaactgggagaaatacatttca

SEQ ID NO: 836420 - DNA, 22 bp, Artificial Sequence
  chemically synthesized
aaaactgggagaaatacatttc

SEQ ID NO: 836421 - DNA, 22 bp, Artificial Sequence
  chemically synthesized
cacggagctgaaatgtatttct

SEQ ID NO: 836422 - DNA, 22 bp, Artificial Sequence
  chemically synthesized
acggagctgaaatgtatttctc

SEQ ID NO: 836423 - DNA, 22 bp, Artificial Sequence
  chemically synthesized
gatcttaaaactgggagaaata

SEQ ID NO: 836424 - DNA, 22 bp, Artificial Sequence
  chemically synthesized
aaatgtatttctcccagtttta

SEQ ID NO: 836425 - DNA, 22 bp, Artificial Sequence
  chemically synthesized
ctcccagttttaagatccagcc

SEQ ID NO: 836426 - DNA, 22 bp, Artificial Sequence
  chemically synthesized
tcccagttttaagatccagcct

SEQ ID NO: 836427 - DNA, 22 bp, Artificial Sequence
  chemically synthesized
ccagttttaagatccagcctct

SEQ ID NO: 836428 - DNA, 22 bp, Artificial Sequence
  chemically synthesized
taagatccagcctctgatctac

SEQ ID NO: 836429 - DNA, 22 bp, Artificial Sequence
  chemically synthesized
aagatccagcctctgatctact

SEQ ID NO: 836430 - DNA, 22 bp, Artificial Sequence
  chemically synthesized
agatccagcctctgatctactt

SEQ ID NO: 836431 - DNA, 22 bp, Artificial Sequence
  chemically synthesized
tggaacatatcatagaagaagt

SEQ ID NO: 836432 - DNA, 22 bp, Artificial Sequence
  chemically synthesized
tgatctacttcttctatgatat

SEQ ID NO: 836433 - DNA, 22 bp, Artificial Sequence
  chemically synthesized
atctacttcttctatgatatgt

SEQ ID NO: 836434 - DNA, 22 bp, Artificial Sequence
  chemically synthesized
aagtaattgtggaacatatcat

SEQ ID NO: 836435 - DNA, 22 bp, Artificial Sequence
  chemically synthesized
ctgaagtaattgtggaacatat

SEQ ID NO: 836436 - DNA, 22 bp, Artificial Sequence
  chemically synthesized
cttcttctatgatatgttccac

SEQ ID NO: 836437 - DNA, 22 bp, Artificial Sequence
  chemically synthesized
cttctatgatatgttccacaat

SEQ ID NO: 836438 - DNA, 22 bp, Artificial Sequence
  chemically synthesized
tctactgaagtaattgtggaac

SEQ ID NO: 836439 - DNA, 22 bp, Artificial Sequence
  chemically synthesized
ttctatgatatgttccacaatt

SEQ ID NO: 836440 - DNA, 22 bp, Artificial Sequence
  chemically synthesized
ctatgatatgttccacaattac

SEQ ID NO: 836441 - DNA, 22 bp, Artificial Sequence
  chemically synthesized
tatgatatgttccacaattact

SEQ ID NO: 836442 - DNA, 22 bp, Artificial Sequence
  chemically synthesized
actgtctactgaagtaattgtg

SEQ ID NO: 836443 - DNA, 22 bp, Artificial Sequence
  chemically synthesized
tgatatgttccacaattacttc

SEQ ID NO: 836444 - DNA, 22 bp, Artificial Sequence
  chemically synthesized
actgactgtctactgaagtaat

SEQ ID NO: 836445 - DNA, 22 bp, Artificial Sequence
  chemically synthesized
tgttgactgactgtctactgaa

SEQ ID NO: 836446 - DNA, 22 bp, Artificial Sequence
  chemically synthesized
gtgttgactgactgtctactga

SEQ ID NO: 836447 - DNA, 22 bp, Artificial Sequence
  chemically synthesized
cacaattacttcagtagacagt

SEQ ID NO: 836448 - DNA, 22 bp, Artificial Sequence
  chemically synthesized
cttcagtagacagtcagtcaac

SEQ ID NO: 836449 - DNA, 22 bp, Artificial Sequence
  chemically synthesized
agatgagtttgtgttgactgac

SEQ ID NO: 836450 - DNA, 22 bp, Artificial Sequence
  chemically synthesized
cagtagacagtcagtcaacaca

SEQ ID NO: 836451 - DNA, 22 bp, Artificial Sequence
  chemically synthesized
agtagacagtcagtcaacacaa

SEQ ID NO: 836452 - DNA, 22 bp, Artificial Sequence
  chemically synthesized
gcacaaagtaggttcagatgag

SEQ ID NO: 836453 - DNA, 22 bp, Artificial Sequence
  chemically synthesized
ggcacaaagtaggttcagatga

SEQ ID NO: 836454 - DNA, 22 bp, Artificial Sequence
  chemically synthesized
gatcagtgtttggcacaaagta

SEQ ID NO: 836455 - DNA, 22 bp, Artificial Sequence
  chemically synthesized
atctgaacctactttgtgccaa

SEQ ID NO: 836456 - DNA, 22 bp, Artificial Sequence
  chemically synthesized
aacctactttgtgccaaacact

SEQ ID NO: 836457 - DNA, 22 bp, Artificial Sequence
  chemically synthesized
cagaacctagatcagtgtttgg

SEQ ID NO: 836458 - DNA, 22 bp, Artificial Sequence
  chemically synthesized
ccagaacctagatcagtgtttg

SEQ ID NO: 836459 - DNA, 22 bp, Artificial Sequence
  chemically synthesized
tccagaacctagatcagtgttt

SEQ ID NO: 836460 - DNA, 22 bp, Artificial Sequence
  chemically synthesized
ctttgtgccaaacactgatcta

SEQ ID NO: 836461 - DNA, 22 bp, Artificial Sequence
  chemically synthesized
tgtgccaaacactgatctaggt

SEQ ID NO: 836462 - DNA, 22 bp, Artificial Sequence
  chemically synthesized
gtgccaaacactgatctaggtt

SEQ ID NO: 836463 - DNA, 22 bp, Artificial Sequence
  chemically synthesized
tgccaaacactgatctaggttc

SEQ ID NO: 836464 - DNA, 22 bp, Artificial Sequence
  chemically synthesized
atcatagattttccagaaccta

SEQ ID NO: 836465 - DNA, 22 bp, Artificial Sequence
  chemically synthesized
catcatagattttccagaacct

SEQ ID NO: 836466 - DNA, 22 bp, Artificial Sequence
  chemically synthesized
tttcatcatagattttccagaa

SEQ ID NO: 836467 - DNA, 22 bp, Artificial Sequence
  chemically synthesized
gtttcatcatagattttccaga

SEQ ID NO: 836468 - DNA, 22 bp, Artificial Sequence
  chemically synthesized
atctaggttctggaaaatctat

SEQ ID NO: 836469 - DNA, 22 bp, Artificial Sequence
  chemically synthesized
tgtcttgtttcatcatagattt

SEQ ID NO: 836470 - DNA, 22 bp, Artificial Sequence
  chemically synthesized
ggttctggaaaatctatgatga

SEQ ID NO: 836471 - DNA, 22 bp, Artificial Sequence
  chemically synthesized
tggaaaatctatgatgaaacaa

SEQ ID NO: 836472 - DNA, 22 bp, Artificial Sequence
  chemically synthesized
gaaaatctatgatgaaacaaga

SEQ ID NO: 836473 - DNA, 22 bp, Artificial Sequence
  chemically synthesized
catgagagcagggactgtgtct

SEQ ID NO: 836474 - DNA, 22 bp, Artificial Sequence
  chemically synthesized
tgatgaaacaagacacagtccc

SEQ ID NO: 836475 - DNA, 22 bp, Artificial Sequence
  chemically synthesized
gctgcatgagagcagggactgt

SEQ ID NO: 836476 - DNA, 22 bp, Artificial Sequence
  chemically synthesized
ggctgcatgagagcagggactg

SEQ ID NO: 836477 - DNA, 22 bp, Artificial Sequence
  chemically synthesized
ctctcatgcagccaaatatttt

SEQ ID NO: 836478 - DNA, 22 bp, Artificial Sequence
  chemically synthesized
tcatgcagccaaatatttttct

SEQ ID NO: 836479 - DNA, 22 bp, Artificial Sequence
  chemically synthesized
atgcagccaaatatttttctcc

SEQ ID NO: 836480 - DNA, 22 bp, Artificial Sequence
  chemically synthesized
ttctcctttgtactttcatttt

SEQ ID NO: 836481 - DNA, 22 bp, Artificial Sequence
  chemically synthesized
tctcctttgtactttcattttt

SEQ ID NO: 836482 - DNA, 22 bp, Artificial Sequence
  chemically synthesized
ctcctttgtactttcatttttc

SEQ ID NO: 836483 - DNA, 22 bp, Artificial Sequence
  chemically synthesized
tcctttgtactttcatttttct

SEQ ID NO: 836484 - DNA, 22 bp, Artificial Sequence
  chemically synthesized
gaggtacaagcaaagaaaaatg

SEQ ID NO: 836485 - DNA, 22 bp, Artificial Sequence
  chemically synthesized
ctttgtactttcatttttcttt

SEQ ID NO: 836486 - DNA, 22 bp, Artificial Sequence
  chemically synthesized
tgtactttcatttttctttgct

SEQ ID NO: 836487 - DNA, 22 bp, Artificial Sequence
  chemically synthesized
gtactttcatttttctttgctt

SEQ ID NO: 836488 - DNA, 22 bp, Artificial Sequence
  chemically synthesized
tactttcatttttctttgcttg

SEQ ID NO: 836489 - DNA, 22 bp, Artificial Sequence
  chemically synthesized
tcatttttctttgcttgtacct

SEQ ID NO: 836490 - DNA, 22 bp, Artificial Sequence
  chemically synthesized
catttttctttgcttgtacctc

SEQ ID NO: 836491 - DNA, 22 bp, Artificial Sequence
  chemically synthesized
atttttctttgcttgtacctct

SEQ ID NO: 836492 - DNA, 22 bp, Artificial Sequence
  chemically synthesized
ttctttgcttgtacctctaatt

SEQ ID NO: 836493 - DNA, 22 bp, Artificial Sequence
  chemically synthesized
tctttgcttgtacctctaattt

SEQ ID NO: 836494 - DNA, 22 bp, Artificial Sequence
  chemically synthesized
gatataaagcataaattagagg

SEQ ID NO: 836495 - DNA, 22 bp, Artificial Sequence
  chemically synthesized
ctttgcttgtacctctaattta

SEQ ID NO: 836496 - DNA, 22 bp, Artificial Sequence
  chemically synthesized
ggatataaagcataaattagag

SEQ ID NO: 836497 - DNA, 22 bp, Artificial Sequence
  chemically synthesized
tttgcttgtacctctaatttat

SEQ ID NO: 836498 - DNA, 22 bp, Artificial Sequence
  chemically synthesized
tgcttgtacctctaatttatgc

SEQ ID NO: 836499 - DNA, 22 bp, Artificial Sequence
  chemically synthesized
gcttgtacctctaatttatgct

SEQ ID NO: 836500 - DNA, 22 bp, Artificial Sequence
  chemically synthesized
cttgtacctctaatttatgctt

SEQ ID NO: 836501 - DNA, 22 bp, Artificial Sequence
  chemically synthesized
gtacctctaatttatgctttat

SEQ ID NO: 836502 - DNA, 22 bp, Artificial Sequence
  chemically synthesized
tacctctaatttatgctttata

SEQ ID NO: 836503 - DNA, 22 bp, Artificial Sequence
  chemically synthesized
taatttatgctttatatccaag

SEQ ID NO: 836504 - DNA, 22 bp, Artificial Sequence
  chemically synthesized
atttatgctttatatccaagtt

SEQ ID NO: 836505 - DNA, 22 bp, Artificial Sequence
  chemically synthesized
atgctttatatccaagttattg

SEQ ID NO: 836506 - DNA, 22 bp, Artificial Sequence
  chemically synthesized
tgctttatatccaagttattgt

SEQ ID NO: 836507 - DNA, 22 bp, Artificial Sequence
  chemically synthesized
tatatccaagttattgttggta

SEQ ID NO: 836508 - DNA, 22 bp, Artificial Sequence
  chemically synthesized
atatccaagttattgttggtac

SEQ ID NO: 836509 - DNA, 22 bp, Artificial Sequence
  chemically synthesized
tatccaagttattgttggtaca

SEQ ID NO: 836510 - DNA, 22 bp, Artificial Sequence
  chemically synthesized
gggaaagacaaatgtgtaccaa

SEQ ID NO: 836511 - DNA, 22 bp, Artificial Sequence
  chemically synthesized
ataatctagggaaagacaaatg

SEQ ID NO: 836512 - DNA, 22 bp, Artificial Sequence
  chemically synthesized
ttgttggtacacatttgtcttt

SEQ ID NO: 836513 - DNA, 22 bp, Artificial Sequence
  chemically synthesized
ttggtacacatttgtctttccc

SEQ ID NO: 836514 - DNA, 22 bp, Artificial Sequence
  chemically synthesized
gtacacatttgtctttccctag

SEQ ID NO: 836515 - DNA, 22 bp, Artificial Sequence
  chemically synthesized
aagaagttgataatctagggaa

SEQ ID NO: 836516 - DNA, 22 bp, Artificial Sequence
  chemically synthesized
taaagaagttgataatctaggg

SEQ ID NO: 836517 - DNA, 22 bp, Artificial Sequence
  chemically synthesized
ctaaagaagttgataatctagg

SEQ ID NO: 836518 - DNA, 22 bp, Artificial Sequence
  chemically synthesized
tctaaagaagttgataatctag

SEQ ID NO: 836519 - DNA, 22 bp, Artificial Sequence
  chemically synthesized
gtctttccctagattatcaact

SEQ ID NO: 836520 - DNA, 22 bp, Artificial Sequence
  chemically synthesized
tctttccctagattatcaactt

SEQ ID NO: 836521 - DNA, 22 bp, Artificial Sequence
  chemically synthesized
atcattttctaaagaagttgat

SEQ ID NO: 836522 - DNA, 22 bp, Artificial Sequence
  chemically synthesized
tccctagattatcaacttcttt

SEQ ID NO: 836523 - DNA, 22 bp, Artificial Sequence
  chemically synthesized
ccctagattatcaacttcttta

SEQ ID NO: 836524 - DNA, 22 bp, Artificial Sequence
  chemically synthesized
cctagattatcaacttctttag

SEQ ID NO: 836525 - DNA, 22 bp, Artificial Sequence
  chemically synthesized
gattatcaacttctttagaaaa

SEQ ID NO: 836526 - DNA, 22 bp, Artificial Sequence
  chemically synthesized
tcaacttctttagaaaatgatt

SEQ ID NO: 836527 - DNA, 22 bp, Artificial Sequence
  chemically synthesized
ctttagaaaatgattaacattt

SEQ ID NO: 836528 - DNA, 22 bp, Artificial Sequence
  chemically synthesized
taaaagtgagtaaaatgttaat

SEQ ID NO: 836529 - DNA, 22 bp, Artificial Sequence
  chemically synthesized
tttagaaaatgattaacatttt

SEQ ID NO: 836530 - DNA, 22 bp, Artificial Sequence
  chemically synthesized
ataaaagtgagtaaaatgttaa

SEQ ID NO: 836531 - DNA, 22 bp, Artificial Sequence
  chemically synthesized
tagaaaatgattaacattttac

SEQ ID NO: 836532 - DNA, 22 bp, Artificial Sequence
  chemically synthesized
agaaaatgattaacattttact

SEQ ID NO: 836533 - DNA, 22 bp, Artificial Sequence
  chemically synthesized
gaaaatgattaacattttactc

SEQ ID NO: 836534 - DNA, 22 bp, Artificial Sequence
  chemically synthesized
gaaaagggatttataaaagtga

SEQ ID NO: 836535 - DNA, 22 bp, Artificial Sequence
  chemically synthesized
acattttactcacttttataaa

SEQ ID NO: 836536 - DNA, 22 bp, Artificial Sequence
  chemically synthesized
tactcacttttataaatccctt

SEQ ID NO: 836537 - DNA, 22 bp, Artificial Sequence
  chemically synthesized
actcacttttataaatcccttt

SEQ ID NO: 836538 - DNA, 22 bp, Artificial Sequence
  chemically synthesized
gtgaccattggaaaagggattt

SEQ ID NO: 836539 - DNA, 22 bp, Artificial Sequence
  chemically synthesized
ctcacttttataaatccctttt

SEQ ID NO: 836540 - DNA, 22 bp, Artificial Sequence
  chemically synthesized
agtgaccattggaaaagggatt

SEQ ID NO: 836541 - DNA, 22 bp, Artificial Sequence
  chemically synthesized
tagtgaccattggaaaagggat

SEQ ID NO: 836542 - DNA, 22 bp, Artificial Sequence
  chemically synthesized
acttttataaatcccttttcca

SEQ ID NO: 836543 - DNA, 22 bp, Artificial Sequence
  chemically synthesized
ttataaatcccttttccaatgg

SEQ ID NO: 836544 - DNA, 22 bp, Artificial Sequence
  chemically synthesized
tataaatcccttttccaatggt

SEQ ID NO: 836545 - DNA, 22 bp, Artificial Sequence
  chemically synthesized
ataaatcccttttccaatggtc

SEQ ID NO: 836546 - DNA, 22 bp, Artificial Sequence
  chemically synthesized
taaatcccttttccaatggtca

SEQ ID NO: 836547 - DNA, 22 bp, Artificial Sequence
  chemically synthesized
ataatactttagtgaccattgg

SEQ ID NO: 836548 - DNA, 22 bp, Artificial Sequence
  chemically synthesized
aataatactttagtgaccattg

SEQ ID NO: 836549 - DNA, 22 bp, Artificial Sequence
  chemically synthesized
atttaataatactttagtgacc

SEQ ID NO: 836550 - DNA, 22 bp, Artificial Sequence
  chemically synthesized
catttaataatactttagtgac

SEQ ID NO: 836551 - DNA, 22 bp, Artificial Sequence
  chemically synthesized
cttcatttaataatactttagt

SEQ ID NO: 836552 - DNA, 22 bp, Artificial Sequence
  chemically synthesized
ttccaatggtcactaaagtatt

SEQ ID NO: 836553 - DNA, 22 bp, Artificial Sequence
  chemically synthesized
tccaatggtcactaaagtatta

SEQ ID NO: 836554 - DNA, 22 bp, Artificial Sequence
  chemically synthesized
ccaatggtcactaaagtattat

SEQ ID NO: 836555 - DNA, 22 bp, Artificial Sequence
  chemically synthesized
caatggtcactaaagtattatt

SEQ ID NO: 836556 - DNA, 22 bp, Artificial Sequence
  chemically synthesized
attacttcatttaataatactt

SEQ ID NO: 836557 - DNA, 22 bp, Artificial Sequence
  chemically synthesized
ttcattacttcatttaataata

SEQ ID NO: 836558 - DNA, 22 bp, Artificial Sequence
  chemically synthesized
attgttcattacttcatttaat

SEQ ID NO: 836559 - DNA, 22 bp, Artificial Sequence
  chemically synthesized
ttcattgttcattacttcattt

SEQ ID NO: 836560 - DNA, 22 bp, Artificial Sequence
  chemically synthesized
attcattgttcattacttcatt

SEQ ID NO: 836561 - DNA, 22 bp, Artificial Sequence
  chemically synthesized
aagtattattaaatgaagtaat

SEQ ID NO: 836562 - DNA, 22 bp, Artificial Sequence
  chemically synthesized
ttaaatgaagtaatgaacaatg

SEQ ID NO: 836563 - DNA, 22 bp, Artificial Sequence
  chemically synthesized
aatgaagtaatgaacaatgaat

SEQ ID NO: 836564 - DNA, 22 bp, Artificial Sequence
  chemically synthesized
tacatccatccgtttattcatt

SEQ ID NO: 836565 - DNA, 22 bp, Artificial Sequence
  chemically synthesized
tgtacatccatccgtttattca

SEQ ID NO: 836566 - DNA, 22 bp, Artificial Sequence
  chemically synthesized
tcgctctgtacatccatccgtt

SEQ ID NO: 836567 - DNA, 22 bp, Artificial Sequence
  chemically synthesized
atcgctctgtacatccatccgt

SEQ ID NO: 836568 - DNA, 22 bp, Artificial Sequence
  chemically synthesized
tccatttatcgctctgtacatc

SEQ ID NO: 836569 - DNA, 22 bp, Artificial Sequence
  chemically synthesized
atccatttatcgctctgtacat

SEQ ID NO: 836570 - DNA, 22 bp, Artificial Sequence
  chemically synthesized
atttatccatttatcgctctgt

SEQ ID NO: 836571 - DNA, 22 bp, Artificial Sequence
  chemically synthesized
ttcatttatccatttatcgctc

SEQ ID NO: 836572 - DNA, 22 bp, Artificial Sequence
  chemically synthesized
gttcatttatccatttatcgct

SEQ ID NO: 836573 - DNA, 22 bp, Artificial Sequence
  chemically synthesized
tgttcatttatccatttatcgc

SEQ ID NO: 836574 - DNA, 22 bp, Artificial Sequence
  chemically synthesized
tgaacaatgtatgaaggtataa

SEQ ID NO: 836575 - DNA, 22 bp, Artificial Sequence
  chemically synthesized
atgaacaatgtatgaaggtata

SEQ ID NO: 836576 - DNA, 22 bp, Artificial Sequence
  chemically synthesized
tatgaacaatgtatgaaggtat

SEQ ID NO: 836577 - DNA, 22 bp, Artificial Sequence
  chemically synthesized
taccttcatacattgttcataa

SEQ ID NO: 836578 - DNA, 22 bp, Artificial Sequence
  chemically synthesized
catacattgttcataaaatatt

SEQ ID NO: 836579 - DNA, 22 bp, Artificial Sequence
  chemically synthesized
atacattgttcataaaatattg

SEQ ID NO: 836580 - DNA, 22 bp, Artificial Sequence
  chemically synthesized
ttcataaaatattgtttatatt

SEQ ID NO: 836581 - DNA, 22 bp, Artificial Sequence
  chemically synthesized
ataaaatattgtttatattact

SEQ ID NO: 836582 - DNA, 22 bp, Artificial Sequence
  chemically synthesized
gataggatatatgtgtcatagg

SEQ ID NO: 836583 - DNA, 22 bp, Artificial Sequence
  chemically synthesized
tttatattactcctatgacaca

SEQ ID NO: 836584 - DNA, 22 bp, Artificial Sequence
  chemically synthesized
atattactcctatgacacatat

SEQ ID NO: 836585 - DNA, 22 bp, Artificial Sequence
  chemically synthesized
tattactcctatgacacatata

SEQ ID NO: 836586 - DNA, 22 bp, Artificial Sequence
  chemically synthesized
ctcctatgacacatatatccta

SEQ ID NO: 836587 - DNA, 22 bp, Artificial Sequence
  chemically synthesized
gtataatattagataggatata

SEQ ID NO: 836588 - DNA, 22 bp, Artificial Sequence
  chemically synthesized
ctatgacacatatatcctatct

SEQ ID NO: 836589 - DNA, 22 bp, Artificial Sequence
  chemically synthesized
tgacacatatatcctatctaat

SEQ ID NO: 836590 - DNA, 22 bp, Artificial Sequence
  chemically synthesized
ggtagaaaaagtaaaattagta

SEQ ID NO: 836591 - DNA, 22 bp, Artificial Sequence
  chemically synthesized
tctaatattatactaattttac

SEQ ID NO: 836592 - DNA, 22 bp, Artificial Sequence
  chemically synthesized
ttaggtagaaaaagtaaaatta

SEQ ID NO: 836593 - DNA, 22 bp, Artificial Sequence
  chemically synthesized
atattatactaattttactttt

SEQ ID NO: 836594 - DNA, 22 bp, Artificial Sequence
  chemically synthesized
ttattaggtagaaaaagtaaaa

SEQ ID NO: 836595 - DNA, 22 bp, Artificial Sequence
  chemically synthesized
attattaggtagaaaaagtaaa

SEQ ID NO: 836596 - DNA, 22 bp, Artificial Sequence
  chemically synthesized
tactaattttactttttctacc

SEQ ID NO: 836597 - DNA, 22 bp, Artificial Sequence
  chemically synthesized
cagtgtttattattaggtagaa

SEQ ID NO: 836598 - DNA, 22 bp, Artificial Sequence
  chemically synthesized
attttactttttctacctaata

SEQ ID NO: 836599 - DNA, 22 bp, Artificial Sequence
  chemically synthesized
attacagtgtttattattaggt

SEQ ID NO: 836600 - DNA, 22 bp, Artificial Sequence
  chemically synthesized
cattacagtgtttattattagg

SEQ ID NO: 836601 - DNA, 22 bp, Artificial Sequence
  chemically synthesized
tactttttctacctaataataa

SEQ ID NO: 836602 - DNA, 22 bp, Artificial Sequence
  chemically synthesized
tcattacagtgtttattattag

SEQ ID NO: 836603 - DNA, 22 bp, Artificial Sequence
  chemically synthesized
actttttctacctaataataaa

SEQ ID NO: 836604 - DNA, 22 bp, Artificial Sequence
  chemically synthesized
ctttttctacctaataataaac

SEQ ID NO: 836605 - DNA, 22 bp, Artificial Sequence
  chemically synthesized
tttcattacagtgtttattatt

SEQ ID NO: 836606 - DNA, 22 bp, Artificial Sequence
  chemically synthesized
tttctacctaataataaacact

SEQ ID NO: 836607 - DNA, 22 bp, Artificial Sequence
  chemically synthesized
ttctacctaataataaacactg

SEQ ID NO: 836608 - DNA, 22 bp, Artificial Sequence
  chemically synthesized
tctacctaataataaacactgt

SEQ ID NO: 836609 - DNA, 22 bp, Artificial Sequence
  chemically synthesized
ctacctaataataaacactgta

SEQ ID NO: 836610 - DNA, 22 bp, Artificial Sequence
  chemically synthesized
tacctaataataaacactgtaa

SEQ ID NO: 836611 - DNA, 22 bp, Artificial Sequence
  chemically synthesized
cctaataataaacactgtaatg

SEQ ID NO: 836612 - DNA, 22 bp, Artificial Sequence
  chemically synthesized
ataataaacactgtaatgaaag

SEQ ID NO: 836613 - DNA, 22 bp, Artificial Sequence
  chemically synthesized
caaggaaaccatgatacagcct

SEQ ID NO: 836614 - DNA, 22 bp, Artificial Sequence
  chemically synthesized
taatgaaagaggctgtatcatg

SEQ ID NO: 836615 - DNA, 22 bp, Artificial Sequence
  chemically synthesized
tgtggtgttccaaggaaaccat

SEQ ID NO: 836616 - DNA, 22 bp, Artificial Sequence
  chemically synthesized
ggaattatgtggtgttccaagg

SEQ ID NO: 836617 - DNA, 22 bp, Artificial Sequence
  chemically synthesized
tatcatggtttccttggaacac

SEQ ID NO: 836618 - DNA, 22 bp, Artificial Sequence
  chemically synthesized
gggctaggaattatgtggtgtt

SEQ ID NO: 836619 - DNA, 22 bp, Artificial Sequence
  chemically synthesized
ccttggaacaccacataattcc

SEQ ID NO: 836620 - DNA, 22 bp, Artificial Sequence
  chemically synthesized
cttggaacaccacataattcct

SEQ ID NO: 836621 - DNA, 22 bp, Artificial Sequence
  chemically synthesized
ggaacaccacataattcctagc

SEQ ID NO: 836622 - DNA, 22 bp, Artificial Sequence
  chemically synthesized
gaacaccacataattcctagcc

SEQ ID NO: 836623 - DNA, 22 bp, Artificial Sequence
  chemically synthesized
cagtgtgcaaggtattggggct

SEQ ID NO: 836624 - DNA, 22 bp, Artificial Sequence
  chemically synthesized
acagtgtgcaaggtattggggc

SEQ ID NO: 836625 - DNA, 22 bp, Artificial Sequence
  chemically synthesized
tgtgcttacagtgtgcaaggta

SEQ ID NO: 836626 - DNA, 22 bp, Artificial Sequence
  chemically synthesized
ctagccccaataccttgcacac

SEQ ID NO: 836627 - DNA, 22 bp, Artificial Sequence
  chemically synthesized
attatgtgcttacagtgtgcaa

SEQ ID NO: 836628 - DNA, 22 bp, Artificial Sequence
  chemically synthesized
gccccaataccttgcacactgt

SEQ ID NO: 836629 - DNA, 22 bp, Artificial Sequence
  chemically synthesized
atcaaatgttgattatgtgctt

SEQ ID NO: 836630 - DNA, 22 bp, Artificial Sequence
  chemically synthesized
gcacactgtaagcacataatca

SEQ ID NO: 836631 - DNA, 22 bp, Artificial Sequence
  chemically synthesized
cacactgtaagcacataatcaa

SEQ ID NO: 836632 - DNA, 22 bp, Artificial Sequence
  chemically synthesized
acacattcatcaaatgttgatt

SEQ ID NO: 836633 - DNA, 22 bp, Artificial Sequence
  chemically synthesized
taagcacataatcaacatttga

SEQ ID NO: 836634 - DNA, 22 bp, Artificial Sequence
  chemically synthesized
aaaagtatattcacacattcat

SEQ ID NO: 836635 - DNA, 22 bp, Artificial Sequence
  chemically synthesized
aaatactgaaaagtatattcac

SEQ ID NO: 836636 - DNA, 22 bp, Artificial Sequence
  chemically synthesized
aaaatactgaaaagtatattca

SEQ ID NO: 836637 - DNA, 22 bp, Artificial Sequence
  chemically synthesized
gatgaatgtgtgaatatacttt

SEQ ID NO: 836638 - DNA, 22 bp, Artificial Sequence
  chemically synthesized
atgaatgtgtgaatatactttt

SEQ ID NO: 836639 - DNA, 22 bp, Artificial Sequence
  chemically synthesized
tgtgaaggaaaaatataagttt

SEQ ID NO: 836640 - DNA, 22 bp, Artificial Sequence
  chemically synthesized
ttcagtattttaaacttatatt

SEQ ID NO: 836641 - DNA, 22 bp, Artificial Sequence
  chemically synthesized
tcagtattttaaacttatattt

SEQ ID NO: 836642 - DNA, 22 bp, Artificial Sequence
  chemically synthesized
cagtattttaaacttatatttt

SEQ ID NO: 836643 - DNA, 22 bp, Artificial Sequence
  chemically synthesized
agtattttaaacttatattttt

SEQ ID NO: 836644 - DNA, 22 bp, Artificial Sequence
  chemically synthesized
aattatgtgaaggaaaaatata

SEQ ID NO: 836645 - DNA, 22 bp, Artificial Sequence
  chemically synthesized
aaattatgtgaaggaaaaatat

SEQ ID NO: 836646 - DNA, 22 bp, Artificial Sequence
  chemically synthesized
taaacttatatttttccttcac

SEQ ID NO: 836647 - DNA, 22 bp, Artificial Sequence
  chemically synthesized
aaacttatatttttccttcaca

SEQ ID NO: 836648 - DNA, 22 bp, Artificial Sequence
  chemically synthesized
gtatttaaattatgtgaaggaa

SEQ ID NO: 836649 - DNA, 22 bp, Artificial Sequence
  chemically synthesized
aacttatatttttccttcacat

SEQ ID NO: 836650 - DNA, 22 bp, Artificial Sequence
  chemically synthesized
cattagtatttaaattatgtga

SEQ ID NO: 836651 - DNA, 22 bp, Artificial Sequence
  chemically synthesized
atatttttccttcacataattt

SEQ ID NO: 836652 - DNA, 22 bp, Artificial Sequence
  chemically synthesized
gcattagtatttaaattatgtg

SEQ ID NO: 836653 - DNA, 22 bp, Artificial Sequence
  chemically synthesized
tatttttccttcacataattta

SEQ ID NO: 836654 - DNA, 22 bp, Artificial Sequence
  chemically synthesized
ttccttcacataatttaaatac

SEQ ID NO: 836655 - DNA, 22 bp, Artificial Sequence
  chemically synthesized
tccttcacataatttaaatact

SEQ ID NO: 836656 - DNA, 22 bp, Artificial Sequence
  chemically synthesized
ataatttgcattagtatttaaa

SEQ ID NO: 836657 - DNA, 22 bp, Artificial Sequence
  chemically synthesized
ccttcacataatttaaatacta

SEQ ID NO: 836658 - DNA, 22 bp, Artificial Sequence
  chemically synthesized
aataatttgcattagtatttaa

SEQ ID NO: 836659 - DNA, 22 bp, Artificial Sequence
  chemically synthesized
cttcacataatttaaatactaa

SEQ ID NO: 836660 - DNA, 22 bp, Artificial Sequence
  chemically synthesized
cacataatttaaatactaatgc

SEQ ID NO: 836661 - DNA, 22 bp, Artificial Sequence
  chemically synthesized
acataatttaaatactaatgca

SEQ ID NO: 836662 - DNA, 22 bp, Artificial Sequence
  chemically synthesized
tacttaataatttgcattagta

SEQ ID NO: 836663 - DNA, 22 bp, Artificial Sequence
  chemically synthesized
atacttaataatttgcattagt

SEQ ID NO: 836664 - DNA, 22 bp, Artificial Sequence
  chemically synthesized
tatacttaataatttgcattag

SEQ ID NO: 836665 - DNA, 22 bp, Artificial Sequence
  chemically synthesized
ttatacttaataatttgcatta

SEQ ID NO: 836666 - DNA, 22 bp, Artificial Sequence
  chemically synthesized
atttttatacttaataatttgc

SEQ ID NO: 836667 - DNA, 22 bp, Artificial Sequence
  chemically synthesized
aaatactaatgcaaattattaa

SEQ ID NO: 836668 - DNA, 22 bp, Artificial Sequence
  chemically synthesized
aatactaatgcaaattattaag

SEQ ID NO: 836669 - DNA, 22 bp, Artificial Sequence
  chemically synthesized
ccctaatttttatacttaataa

SEQ ID NO: 836670 - DNA, 22 bp, Artificial Sequence
  chemically synthesized
gccctaatttttatacttaata

SEQ ID NO: 836671 - DNA, 22 bp, Artificial Sequence
  chemically synthesized
atgcaaattattaagtataaaa

SEQ ID NO: 836672 - DNA, 22 bp, Artificial Sequence
  chemically synthesized
caacttgccctaatttttatac

SEQ ID NO: 836673 - DNA, 22 bp, Artificial Sequence
  chemically synthesized
gcaacttgccctaatttttata

SEQ ID NO: 836674 - DNA, 22 bp, Artificial Sequence
  chemically synthesized
tatttgcaacttgccctaattt

SEQ ID NO: 836675 - DNA, 22 bp, Artificial Sequence
  chemically synthesized
ttaagtataaaaattagggcaa

SEQ ID NO: 836676 - DNA, 22 bp, Artificial Sequence
  chemically synthesized
agtataaaaattagggcaagtt

SEQ ID NO: 836677 - DNA, 22 bp, Artificial Sequence
  chemically synthesized
aattatatttgcaacttgccct

SEQ ID NO: 836678 - DNA, 22 bp, Artificial Sequence
  chemically synthesized
tgactgaattatatttgcaact

SEQ ID NO: 836679 - DNA, 22 bp, Artificial Sequence
  chemically synthesized
gggcaagttgcaaatataattc

SEQ ID NO: 836680 - DNA, 22 bp, Artificial Sequence
  chemically synthesized
ccggaggctgtgactgaattat

SEQ ID NO: 836681 - DNA, 22 bp, Artificial Sequence
  chemically synthesized
cccggaggctgtgactgaatta

SEQ ID NO: 836682 - DNA, 22 bp, Artificial Sequence
  chemically synthesized
atttcccggaggctgtgactga

SEQ ID NO: 836683 - DNA, 22 bp, Artificial Sequence
  chemically synthesized
caaatataattcagtcacagcc

SEQ ID NO: 836684 - DNA, 22 bp, Artificial Sequence
  chemically synthesized
ttcatttcccggaggctgtgac

SEQ ID NO: 836685 - DNA, 22 bp, Artificial Sequence
  chemically synthesized
attcatttcccggaggctgtga

SEQ ID NO: 836686 - DNA, 22 bp, Artificial Sequence
  chemically synthesized
tattcatttcccggaggctgtg

SEQ ID NO: 836687 - DNA, 22 bp, Artificial Sequence
  chemically synthesized
ttttattcatttcccggaggct

SEQ ID NO: 836688 - DNA, 22 bp, Artificial Sequence
  chemically synthesized
agtcacagcctccgggaaatga

SEQ ID NO: 836689 - DNA, 22 bp, Artificial Sequence
  chemically synthesized
gagtgagattattttattcatt

SEQ ID NO: 836690 - DNA, 22 bp, Artificial Sequence
  chemically synthesized
cgggaaatgaataaaataatct

SEQ ID NO: 836691 - DNA, 22 bp, Artificial Sequence
  chemically synthesized
cacaaagaaatcaacctagagt

SEQ ID NO: 836692 - DNA, 22 bp, Artificial Sequence
  chemically synthesized
acacaaagaaatcaacctagag

SEQ ID NO: 836693 - DNA, 22 bp, Artificial Sequence
  chemically synthesized
atttacacaaagaaatcaacct

SEQ ID NO: 836694 - DNA, 22 bp, Artificial Sequence
  chemically synthesized
actctaggttgatttctttgtg

SEQ ID NO: 836695 - DNA, 22 bp, Artificial Sequence
  chemically synthesized
taggttgatttctttgtgtaaa

SEQ ID NO: 836696 - DNA, 22 bp, Artificial Sequence
  chemically synthesized
gtaaggatctaatttacacaaa

SEQ ID NO: 836697 - DNA, 22 bp, Artificial Sequence
  chemically synthesized
agtaaggatctaatttacacaa

SEQ ID NO: 836698 - DNA, 22 bp, Artificial Sequence
  chemically synthesized
ggttgatttctttgtgtaaatt

SEQ ID NO: 836699 - DNA, 22 bp, Artificial Sequence
  chemically synthesized
atttctttgtgtaaattagatc

SEQ ID NO: 836700 - DNA, 22 bp, Artificial Sequence
  chemically synthesized
caaatatttagtaaggatctaa

SEQ ID NO: 836701 - DNA, 22 bp, Artificial Sequence
  chemically synthesized
ctttgtgtaaattagatcctta

SEQ ID NO: 836702 - DNA, 22 bp, Artificial Sequence
  chemically synthesized
tttgtgtaaattagatccttac

SEQ ID NO: 836703 - DNA, 22 bp, Artificial Sequence
  chemically synthesized
tgtgtaaattagatccttacta

SEQ ID NO: 836704 - DNA, 22 bp, Artificial Sequence
  chemically synthesized
gtgtaaattagatccttactaa

SEQ ID NO: 836705 - DNA, 22 bp, Artificial Sequence
  chemically synthesized
tgtaaattagatccttactaaa

SEQ ID NO: 836706 - DNA, 22 bp, Artificial Sequence
  chemically synthesized
gatccttactaaatatttgcag

SEQ ID NO: 836707 - DNA, 22 bp, Artificial Sequence
  chemically synthesized
taaatgtgtaagtctgcaaata

SEQ ID NO: 836708 - DNA, 22 bp, Artificial Sequence
  chemically synthesized
ataaatgtgtaagtctgcaaat

SEQ ID NO: 836709 - DNA, 22 bp, Artificial Sequence
  chemically synthesized
tataaatgtgtaagtctgcaaa

SEQ ID NO: 836710 - DNA, 22 bp, Artificial Sequence
  chemically synthesized
ttataaatgtgtaagtctgcaa

SEQ ID NO: 836711 - DNA, 22 bp, Artificial Sequence
  chemically synthesized
tttataaatgtgtaagtctgca

SEQ ID NO: 836712 - DNA, 22 bp, Artificial Sequence
  chemically synthesized
ttttataaatgtgtaagtctgc

SEQ ID NO: 836713 - DNA, 22 bp, Artificial Sequence
  chemically synthesized
actaaatatttgcagacttaca

SEQ ID NO: 836714 - DNA, 22 bp, Artificial Sequence
  chemically synthesized
tttttataaatgtgtaagtctg

SEQ ID NO: 836715 - DNA, 22 bp, Artificial Sequence
  chemically synthesized
ctaaatatttgcagacttacac

SEQ ID NO: 836716 - DNA, 22 bp, Artificial Sequence
  chemically synthesized
ttttttataaatgtgtaagtct

SEQ ID NO: 836717 - DNA, 22 bp, Artificial Sequence
  chemically synthesized
aatatttgcagacttacacatt

SEQ ID NO: 836718 - DNA, 22 bp, Artificial Sequence
  chemically synthesized
atgacttttttttataaatgtg

SEQ ID NO: 836719 - DNA, 22 bp, Artificial Sequence
  chemically synthesized
gcagacttacacatttataaaa

SEQ ID NO: 836720 - DNA, 22 bp, Artificial Sequence
  chemically synthesized
cagacttacacatttataaaaa

SEQ ID NO: 836721 - DNA, 22 bp, Artificial Sequence
  chemically synthesized
acacatttataaaaaaaagtca

SEQ ID NO: 836722 - DNA, 22 bp, Artificial Sequence
  chemically synthesized
cacatttataaaaaaaagtcat

SEQ ID NO: 836723 - DNA, 22 bp, Artificial Sequence
  chemically synthesized
ataaaaaaaagtcatcagtctc

SEQ ID NO: 836724 - DNA, 22 bp, Artificial Sequence
  chemically synthesized
taaaaaaaagtcatcagtctca

SEQ ID NO: 836725 - DNA, 22 bp, Artificial Sequence
  chemically synthesized
atagagacagaatagatgagac

SEQ ID NO: 836726 - DNA, 22 bp, Artificial Sequence
  chemically synthesized
taatagagacagaatagatgag

SEQ ID NO: 836727 - DNA, 22 bp, Artificial Sequence
  chemically synthesized
ctaatagagacagaatagatga

SEQ ID NO: 836728 - DNA, 22 bp, Artificial Sequence
  chemically synthesized
tctaatagagacagaatagatg

SEQ ID NO: 836729 - DNA, 22 bp, Artificial Sequence
  chemically synthesized
ttctaatagagacagaatagat

SEQ ID NO: 836730 - DNA, 22 bp, Artificial Sequence
  chemically synthesized
acccttttctaatagagacaga

SEQ ID NO: 836731 - DNA, 22 bp, Artificial Sequence
  chemically synthesized
atctattctgtctctattagaa

SEQ ID NO: 836732 - DNA, 22 bp, Artificial Sequence
  chemically synthesized
ttctgtctctattagaaaaggg

SEQ ID NO: 836733 - DNA, 22 bp, Artificial Sequence
  chemically synthesized
aacatagattgacccttttcta

SEQ ID NO: 836734 - DNA, 22 bp, Artificial Sequence
  chemically synthesized
tgtctctattagaaaagggtca

SEQ ID NO: 836735 - DNA, 22 bp, Artificial Sequence
  chemically synthesized
tctctattagaaaagggtcaat

SEQ ID NO: 836736 - DNA, 22 bp, Artificial Sequence
  chemically synthesized
tattagaaaagggtcaatctat

SEQ ID NO: 836737 - DNA, 22 bp, Artificial Sequence
  chemically synthesized
ttagaaaagggtcaatctatgt

SEQ ID NO: 836738 - DNA, 22 bp, Artificial Sequence
  chemically synthesized
tggcagcaaattaaacatagat

SEQ ID NO: 836739 - DNA, 22 bp, Artificial Sequence
  chemically synthesized
gaaaagggtcaatctatgttta

SEQ ID NO: 836740 - DNA, 22 bp, Artificial Sequence
  chemically synthesized
atggcagcaaattaaacataga

SEQ ID NO: 836741 - DNA, 22 bp, Artificial Sequence
  chemically synthesized
aagcttatggcagcaaattaaa

SEQ ID NO: 836742 - DNA, 22 bp, Artificial Sequence
  chemically synthesized
caagcttatggcagcaaattaa

SEQ ID NO: 836743 - DNA, 22 bp, Artificial Sequence
  chemically synthesized
accttcaagcttatggcagcaa

SEQ ID NO: 836744 - DNA, 22 bp, Artificial Sequence
  chemically synthesized
caccttcaagcttatggcagca

SEQ ID NO: 836745 - DNA, 22 bp, Artificial Sequence
  chemically synthesized
tcaccttcaagcttatggcagc

SEQ ID NO: 836746 - DNA, 22 bp, Artificial Sequence
  chemically synthesized
tgtttaatttgctgccataagc

SEQ ID NO: 836747 - DNA, 22 bp, Artificial Sequence
  chemically synthesized
aatttgctgccataagcttgaa

SEQ ID NO: 836748 - DNA, 22 bp, Artificial Sequence
  chemically synthesized
atttgctgccataagcttgaag

SEQ ID NO: 836749 - DNA, 22 bp, Artificial Sequence
  chemically synthesized
aataaattttcaccttcaagct

SEQ ID NO: 836750 - DNA, 22 bp, Artificial Sequence
  chemically synthesized
gctgccataagcttgaaggtga

SEQ ID NO: 836751 - DNA, 22 bp, Artificial Sequence
  chemically synthesized
ctaaataaattttcaccttcaa

SEQ ID NO: 836752 - DNA, 22 bp, Artificial Sequence
  chemically synthesized
ctgccataagcttgaaggtgaa

SEQ ID NO: 836753 - DNA, 22 bp, Artificial Sequence
  chemically synthesized
cctaaataaattttcaccttca

SEQ ID NO: 836754 - DNA, 22 bp, Artificial Sequence
  chemically synthesized
ccataagcttgaaggtgaaaat

SEQ ID NO: 836755 - DNA, 22 bp, Artificial Sequence
  chemically synthesized
gaaggtgaaaatttatttagga

SEQ ID NO: 836756 - DNA, 22 bp, Artificial Sequence
  chemically synthesized
aaggtgaaaatttatttaggaa

SEQ ID NO: 836757 - DNA, 22 bp, Artificial Sequence
  chemically synthesized
gaaaacagtcatcaaatgcttc

SEQ ID NO: 836758 - DNA, 22 bp, Artificial Sequence
  chemically synthesized
atttaggaagcatttgatgact

SEQ ID NO: 836759 - DNA, 22 bp, Artificial Sequence
  chemically synthesized
tttaggaagcatttgatgactg

SEQ ID NO: 836760 - DNA, 22 bp, Artificial Sequence
  chemically synthesized
aggaagcatttgatgactgttt

SEQ ID NO: 836761 - DNA, 22 bp, Artificial Sequence
  chemically synthesized
ggaagcatttgatgactgtttt

SEQ ID NO: 836762 - DNA, 22 bp, Artificial Sequence
  chemically synthesized
agaacagtacctagaaaacagt

SEQ ID NO: 836763 - DNA, 22 bp, Artificial Sequence
  chemically synthesized
gattaagaacagtacctagaaa

SEQ ID NO: 836764 - DNA, 22 bp, Artificial Sequence
  chemically synthesized
gatgactgttttctaggtactg

SEQ ID NO: 836765 - DNA, 22 bp, Artificial Sequence
  chemically synthesized
atgactgttttctaggtactgt

SEQ ID NO: 836766 - DNA, 22 bp, Artificial Sequence
  chemically synthesized
acatacctagattaagaacagt

SEQ ID NO: 836767 - DNA, 22 bp, Artificial Sequence
  chemically synthesized
aacatacctagattaagaacag

SEQ ID NO: 836768 - DNA, 22 bp, Artificial Sequence
  chemically synthesized
ttttctaggtactgttcttaat

SEQ ID NO: 836769 - DNA, 22 bp, Artificial Sequence
  chemically synthesized
tctaggtactgttcttaatcta

SEQ ID NO: 836770 - DNA, 22 bp, Artificial Sequence
  chemically synthesized
ctaggtactgttcttaatctag

SEQ ID NO: 836771 - DNA, 22 bp, Artificial Sequence
  chemically synthesized
taggtactgttcttaatctagg

SEQ ID NO: 836772 - DNA, 22 bp, Artificial Sequence
  chemically synthesized
ggtactgttcttaatctaggta

SEQ ID NO: 836773 - DNA, 22 bp, Artificial Sequence
  chemically synthesized
ttcttaatctaggtatgttaag

SEQ ID NO: 836774 - DNA, 22 bp, Artificial Sequence
  chemically synthesized
ttaatctaggtatgttaaggga

SEQ ID NO: 836775 - DNA, 22 bp, Artificial Sequence
  chemically synthesized
aggataggcaccatcccttaac

SEQ ID NO: 836776 - DNA, 22 bp, Artificial Sequence
  chemically synthesized
aatctaggtatgttaagggatg

SEQ ID NO: 836777 - DNA, 22 bp, Artificial Sequence
  chemically synthesized
aaggataggcaccatcccttaa

SEQ ID NO: 836778 - DNA, 22 bp, Artificial Sequence
  chemically synthesized
atctaggtatgttaagggatgg

SEQ ID NO: 836779 - DNA, 22 bp, Artificial Sequence
  chemically synthesized
ggtatgttaagggatggtgcct

SEQ ID NO: 836780 - DNA, 22 bp, Artificial Sequence
  chemically synthesized
tgagcaacttaaggataggcac

SEQ ID NO: 836781 - DNA, 22 bp, Artificial Sequence
  chemically synthesized
agggatggtgcctatccttaag

SEQ ID NO: 836782 - DNA, 22 bp, Artificial Sequence
  chemically synthesized
atataagttgtgagcaacttaa

SEQ ID NO: 836783 - DNA, 22 bp, Artificial Sequence
  chemically synthesized
tcatataagttgtgagcaactt

SEQ ID NO: 836784 - DNA, 22 bp, Artificial Sequence
  chemically synthesized
tctctcatataagttgtgagca

SEQ ID NO: 836785 - DNA, 22 bp, Artificial Sequence
  chemically synthesized
atctctcatataagttgtgagc

SEQ ID NO: 836786 - DNA, 22 bp, Artificial Sequence
  chemically synthesized
tccttaagttgctcacaactta

SEQ ID NO: 836787 - DNA, 22 bp, Artificial Sequence
  chemically synthesized
aagttgctcacaacttatatga

SEQ ID NO: 836788 - DNA, 22 bp, Artificial Sequence
  chemically synthesized
caaatttatctctcatataagt

SEQ ID NO: 836789 - DNA, 22 bp, Artificial Sequence
  chemically synthesized
agttgctcacaacttatatgag

SEQ ID NO: 836790 - DNA, 22 bp, Artificial Sequence
  chemically synthesized
ctcacaacttatatgagagata

SEQ ID NO: 836791 - DNA, 22 bp, Artificial Sequence
  chemically synthesized
acaacttatatgagagataaat

SEQ ID NO: 836792 - DNA, 22 bp, Artificial Sequence
  chemically synthesized
atatgagagataaatttggaat

SEQ ID NO: 836793 - DNA, 22 bp, Artificial Sequence
  chemically synthesized
tatgagagataaatttggaata

SEQ ID NO: 836794 - DNA, 22 bp, Artificial Sequence
  chemically synthesized
aatatgtacagcagtgaatatt

SEQ ID NO: 836795 - DNA, 22 bp, Artificial Sequence
  chemically synthesized
caatatgtacagcagtgaatat

SEQ ID NO: 836796 - DNA, 22 bp, Artificial Sequence
  chemically synthesized
ggaatattcactgctgtacata

SEQ ID NO: 836797 - DNA, 22 bp, Artificial Sequence
  chemically synthesized
gaatattcactgctgtacatat

SEQ ID NO: 836798 - DNA, 22 bp, Artificial Sequence
  chemically synthesized
actgctgtacatattgaaggat

SEQ ID NO: 836799 - DNA, 22 bp, Artificial Sequence
  chemically synthesized
taaatataataaatccttcaat

SEQ ID NO: 836800 - DNA, 22 bp, Artificial Sequence
  chemically synthesized
ctgtacatattgaaggatttat

SEQ ID NO: 836801 - DNA, 22 bp, Artificial Sequence
  chemically synthesized
attataaatataataaatcctt

SEQ ID NO: 836802 - DNA, 22 bp, Artificial Sequence
  chemically synthesized
aattataaatataataaatcct

SEQ ID NO: 836803 - DNA, 22 bp, Artificial Sequence
  chemically synthesized
tacatattgaaggatttattat

SEQ ID NO: 836804 - DNA, 22 bp, Artificial Sequence
  chemically synthesized
gtagaatttaattataaatata

SEQ ID NO: 836805 - DNA, 22 bp, Artificial Sequence
  chemically synthesized
ggtagaatttaattataaatat

SEQ ID NO: 836806 - DNA, 22 bp, Artificial Sequence
  chemically synthesized
aaggatttattatatttataat

SEQ ID NO: 836807 - DNA, 22 bp, Artificial Sequence
  chemically synthesized
attatatttataattaaattct

SEQ ID NO: 836808 - DNA, 22 bp, Artificial Sequence
  chemically synthesized
ttatatttataattaaattcta

SEQ ID NO: 836809 - DNA, 22 bp, Artificial Sequence
  chemically synthesized
tatttataattaaattctacca

SEQ ID NO: 836810 - DNA, 22 bp, Artificial Sequence
  chemically synthesized
tgtccatatgtgatttggtaga

SEQ ID NO: 836811 - DNA, 22 bp, Artificial Sequence
  chemically synthesized
ataattaaattctaccaaatca

SEQ ID NO: 836812 - DNA, 22 bp, Artificial Sequence
  chemically synthesized
taattaaattctaccaaatcac

SEQ ID NO: 836813 - DNA, 22 bp, Artificial Sequence
  chemically synthesized
aattatgtccatatgtgatttg

SEQ ID NO: 836814 - DNA, 22 bp, Artificial Sequence
  chemically synthesized
aattctaccaaatcacatatgg

SEQ ID NO: 836815 - DNA, 22 bp, Artificial Sequence
  chemically synthesized
taccaaatcacatatggacata

SEQ ID NO: 836816 - DNA, 22 bp, Artificial Sequence
  chemically synthesized
ccaaatcacatatggacataat

SEQ ID NO: 836817 - DNA, 22 bp, Artificial Sequence
  chemically synthesized
ataacacaagaagattaaatta

SEQ ID NO: 836818 - DNA, 22 bp, Artificial Sequence
  chemically synthesized
tgctaataacacaagaagatta

SEQ ID NO: 836819 - DNA, 22 bp, Artificial Sequence
  chemically synthesized
aatcttcttgtgttattagcac

SEQ ID NO: 836820 - DNA, 22 bp, Artificial Sequence
  chemically synthesized
atcttcttgtgttattagcaca

SEQ ID NO: 836821 - DNA, 22 bp, Artificial Sequence
  chemically synthesized
agtatatcagtgcactgtgcta

SEQ ID NO: 836822 - DNA, 22 bp, Artificial Sequence
  chemically synthesized
cagtatatcagtgcactgtgct

SEQ ID NO: 836823 - DNA, 22 bp, Artificial Sequence
  chemically synthesized
cttgtgttattagcacagtgca

SEQ ID NO: 836824 - DNA, 22 bp, Artificial Sequence
  chemically synthesized
ttgtgttattagcacagtgcac

SEQ ID NO: 836825 - DNA, 22 bp, Artificial Sequence
  chemically synthesized
ttcagtatatcagtgcactgtg

SEQ ID NO: 836826 - DNA, 22 bp, Artificial Sequence
  chemically synthesized
gtgttattagcacagtgcactg

SEQ ID NO: 836827 - DNA, 22 bp, Artificial Sequence
  chemically synthesized
tgttattagcacagtgcactga

SEQ ID NO: 836828 - DNA, 22 bp, Artificial Sequence
  chemically synthesized
gattcttcagtatatcagtgca

SEQ ID NO: 836829 - DNA, 22 bp, Artificial Sequence
  chemically synthesized
ttagcacagtgcactgatatac

SEQ ID NO: 836830 - DNA, 22 bp, Artificial Sequence
  chemically synthesized
gcacagtgcactgatatactga

SEQ ID NO: 836831 - DNA, 22 bp, Artificial Sequence
  chemically synthesized
aaaaattagattcttcagtata

SEQ ID NO: 836832 - DNA, 22 bp, Artificial Sequence
  chemically synthesized
attgaaaaattagattcttcag

SEQ ID NO: 836833 - DNA, 22 bp, Artificial Sequence
  chemically synthesized
cattgaaaaattagattcttca

SEQ ID NO: 836834 - DNA, 22 bp, Artificial Sequence
  chemically synthesized
tttcattgaaaaattagattct

SEQ ID NO: 836835 - DNA, 22 bp, Artificial Sequence
  chemically synthesized
atttcattgaaaaattagattc

SEQ ID NO: 836836 - DNA, 22 bp, Artificial Sequence
  chemically synthesized
atatactgaagaatctaatttt

SEQ ID NO: 836837 - DNA, 22 bp, Artificial Sequence
  chemically synthesized
aagaatctaatttttcaatgaa

SEQ ID NO: 836838 - DNA, 22 bp, Artificial Sequence
  chemically synthesized
gacagatccttatttcattgaa

SEQ ID NO: 836839 - DNA, 22 bp, Artificial Sequence
  chemically synthesized
aattggacagatccttatttca

SEQ ID NO: 836840 - DNA, 22 bp, Artificial Sequence
  chemically synthesized
atttttcaatgaaataaggatc

SEQ ID NO: 836841 - DNA, 22 bp, Artificial Sequence
  chemically synthesized
ttcaatgaaataaggatctgtc

SEQ ID NO: 836842 - DNA, 22 bp, Artificial Sequence
  chemically synthesized
tcaatgaaataaggatctgtcc

SEQ ID NO: 836843 - DNA, 22 bp, Artificial Sequence
  chemically synthesized
gtatgctaaattggacagatcc

SEQ ID NO: 836844 - DNA, 22 bp, Artificial Sequence
  chemically synthesized
caatgaaataaggatctgtcca

SEQ ID NO: 836845 - DNA, 22 bp, Artificial Sequence
  chemically synthesized
agtatgctaaattggacagatc

SEQ ID NO: 836846 - DNA, 22 bp, Artificial Sequence
  chemically synthesized
aatgaaataaggatctgtccaa

SEQ ID NO: 836847 - DNA, 22 bp, Artificial Sequence
  chemically synthesized
tagtatgctaaattggacagat

SEQ ID NO: 836848 - DNA, 22 bp, Artificial Sequence
  chemically synthesized
ttttagtatgctaaattggaca

SEQ ID NO: 836849 - DNA, 22 bp, Artificial Sequence
  chemically synthesized
tattttagtatgctaaattgga

SEQ ID NO: 836850 - DNA, 22 bp, Artificial Sequence
  chemically synthesized
ttctattttagtatgctaaatt

SEQ ID NO: 836851 - DNA, 22 bp, Artificial Sequence
  chemically synthesized
ttattctattttagtatgctaa

SEQ ID NO: 836852 - DNA, 22 bp, Artificial Sequence
  chemically synthesized
tccaatttagcatactaaaata

SEQ ID NO: 836853 - DNA, 22 bp, Artificial Sequence
  chemically synthesized
ataaaattgttattctatttta

SEQ ID NO: 836854 - DNA, 22 bp, Artificial Sequence
  chemically synthesized
agcatactaaaatagaataaca

SEQ ID NO: 836855 - DNA, 22 bp, Artificial Sequence
  chemically synthesized
gcatactaaaatagaataacaa

SEQ ID NO: 836856 - DNA, 22 bp, Artificial Sequence
  chemically synthesized
aaatgaaaattaataaaattgt

SEQ ID NO: 836857 - DNA, 22 bp, Artificial Sequence
  chemically synthesized
gaaatgaaaattaataaaattg

SEQ ID NO: 836858 - DNA, 22 bp, Artificial Sequence
  chemically synthesized
aaatagaataacaattttatta

SEQ ID NO: 836859 - DNA, 22 bp, Artificial Sequence
  chemically synthesized
atttgaaatgaaaattaataaa

SEQ ID NO: 836860 - DNA, 22 bp, Artificial Sequence
  chemically synthesized
tattaattttcatttcaaatca

SEQ ID NO: 836861 - DNA, 22 bp, Artificial Sequence
  chemically synthesized
attaattttcatttcaaatcag

SEQ ID NO: 836862 - DNA, 22 bp, Artificial Sequence
  chemically synthesized
ttaattttcatttcaaatcagc

SEQ ID NO: 836863 - DNA, 22 bp, Artificial Sequence
  chemically synthesized
attttcatttcaaatcagcatt

SEQ ID NO: 836864 - DNA, 22 bp, Artificial Sequence
  chemically synthesized
agataatataataatgctgatt

SEQ ID NO: 836865 - DNA, 22 bp, Artificial Sequence
  chemically synthesized
aagataatataataatgctgat

SEQ ID NO: 836866 - DNA, 22 bp, Artificial Sequence
  chemically synthesized
tcatttcaaatcagcattatta

SEQ ID NO: 836867 - DNA, 22 bp, Artificial Sequence
  chemically synthesized
catttcaaatcagcattattat

SEQ ID NO: 836868 - DNA, 22 bp, Artificial Sequence
  chemically synthesized
atttcaaatcagcattattata

SEQ ID NO: 836869 - DNA, 22 bp, Artificial Sequence
  chemically synthesized
caaatcagcattattatattat

SEQ ID NO: 836870 - DNA, 22 bp, Artificial Sequence
  chemically synthesized
aaatcagcattattatattatc

SEQ ID NO: 836871 - DNA, 22 bp, Artificial Sequence
  chemically synthesized
ttatattatcttaagattccct

SEQ ID NO: 836872 - DNA, 22 bp, Artificial Sequence
  chemically synthesized
aggaatacaaataaagggaatc

SEQ ID NO: 836873 - DNA, 22 bp, Artificial Sequence
  chemically synthesized
tattatcttaagattcccttta

SEQ ID NO: 836874 - DNA, 22 bp, Artificial Sequence
  chemically synthesized
aaggaatacaaataaagggaat

SEQ ID NO: 836875 - DNA, 22 bp, Artificial Sequence
  chemically synthesized
tcttaagattccctttatttgt

SEQ ID NO: 836876 - DNA, 22 bp, Artificial Sequence
  chemically synthesized
gcatccttaaggaatacaaata

SEQ ID NO: 836877 - DNA, 22 bp, Artificial Sequence
  chemically synthesized
aagattccctttatttgtattc

SEQ ID NO: 836878 - DNA, 22 bp, Artificial Sequence
  chemically synthesized
agattccctttatttgtattcc

SEQ ID NO: 836879 - DNA, 22 bp, Artificial Sequence
  chemically synthesized
cctttatttgtattccttaagg

SEQ ID NO: 836880 - DNA, 22 bp, Artificial Sequence
  chemically synthesized
tatttgtattccttaaggatgc

SEQ ID NO: 836881 - DNA, 22 bp, Artificial Sequence
  chemically synthesized
atttgtattccttaaggatgcc

SEQ ID NO: 836882 - DNA, 22 bp, Artificial Sequence
  chemically synthesized
tttgtattccttaaggatgcca

SEQ ID NO: 836883 - DNA, 22 bp, Artificial Sequence
  chemically synthesized
taaaaccagaattggcatcctt

SEQ ID NO: 836884 - DNA, 22 bp, Artificial Sequence
  chemically synthesized
gtaaaaccagaattggcatcct

SEQ ID NO: 836885 - DNA, 22 bp, Artificial Sequence
  chemically synthesized
tgtaaaaccagaattggcatcc

SEQ ID NO: 836886 - DNA, 22 bp, Artificial Sequence
  chemically synthesized
gtattccttaaggatgccaatt

SEQ ID NO: 836887 - DNA, 22 bp, Artificial Sequence
  chemically synthesized
tattccttaaggatgccaattc

SEQ ID NO: 836888 - DNA, 22 bp, Artificial Sequence
  chemically synthesized
attttgtaaaaccagaattggc

SEQ ID NO: 836889 - DNA, 22 bp, Artificial Sequence
  chemically synthesized
cttaaggatgccaattctggtt

SEQ ID NO: 836890 - DNA, 22 bp, Artificial Sequence
  chemically synthesized
aaggatgccaattctggtttta

SEQ ID NO: 836891 - DNA, 22 bp, Artificial Sequence
  chemically synthesized
aggatgccaattctggttttac

SEQ ID NO: 836892 - DNA, 22 bp, Artificial Sequence
  chemically synthesized
aatataaagttgattttgtaaa

SEQ ID NO: 836893 - DNA, 22 bp, Artificial Sequence
  chemically synthesized
tggttttacaaaatcaacttta

SEQ ID NO: 836894 - DNA, 22 bp, Artificial Sequence
  chemically synthesized
gttttacaaaatcaactttata

SEQ ID NO: 836895 - DNA, 22 bp, Artificial Sequence
  chemically synthesized
tacaaaatcaactttatattca

SEQ ID NO: 836896 - DNA, 22 bp, Artificial Sequence
  chemically synthesized
acaaaatcaactttatattcaa

SEQ ID NO: 836897 - DNA, 22 bp, Artificial Sequence
  chemically synthesized
caaaatcaactttatattcaat

SEQ ID NO: 836898 - DNA, 22 bp, Artificial Sequence
  chemically synthesized
agacaaaaaagtattgaatata

SEQ ID NO: 836899 - DNA, 22 bp, Artificial Sequence
  chemically synthesized
gttcagacaaaaaagtattgaa

SEQ ID NO: 836900 - DNA, 22 bp, Artificial Sequence
  chemically synthesized
tctagttcagacaaaaaagtat

SEQ ID NO: 836901 - DNA, 22 bp, Artificial Sequence
  chemically synthesized
tatattcaatacttttttgtct

SEQ ID NO: 836902 - DNA, 22 bp, Artificial Sequence
  chemically synthesized
atattcaatacttttttgtctg

SEQ ID NO: 836903 - DNA, 22 bp, Artificial Sequence
  chemically synthesized
tattcaatacttttttgtctga

SEQ ID NO: 836904 - DNA, 22 bp, Artificial Sequence
  chemically synthesized
aatacttttttgtctgaactag

SEQ ID NO: 836905 - DNA, 22 bp, Artificial Sequence
  chemically synthesized
gcatatgtatacagttgtctag

SEQ ID NO: 836906 - DNA, 22 bp, Artificial Sequence
  chemically synthesized
ttttgtctgaactagacaactg

SEQ ID NO: 836907 - DNA, 22 bp, Artificial Sequence
  chemically synthesized
ggcatatgtatacagttgtcta

SEQ ID NO: 836908 - DNA, 22 bp, Artificial Sequence
  chemically synthesized
tttgtctgaactagacaactgt

SEQ ID NO: 836909 - DNA, 22 bp, Artificial Sequence
  chemically synthesized
ttgtctgaactagacaactgta

SEQ ID NO: 836910 - DNA, 22 bp, Artificial Sequence
  chemically synthesized
tgtctgaactagacaactgtat

SEQ ID NO: 836911 - DNA, 22 bp, Artificial Sequence
  chemically synthesized
gtctgaactagacaactgtata

SEQ ID NO: 836912 - DNA, 22 bp, Artificial Sequence
  chemically synthesized
tctgaactagacaactgtatac

SEQ ID NO: 836913 - DNA, 22 bp, Artificial Sequence
  chemically synthesized
aaatacttggcatatgtataca

SEQ ID NO: 836914 - DNA, 22 bp, Artificial Sequence
  chemically synthesized
aactagacaactgtatacatat

SEQ ID NO: 836915 - DNA, 22 bp, Artificial Sequence
  chemically synthesized
taaaatacttggcatatgtata

SEQ ID NO: 836916 - DNA, 22 bp, Artificial Sequence
  chemically synthesized
gacaactgtatacatatgccaa

SEQ ID NO: 836917 - DNA, 22 bp, Artificial Sequence
  chemically synthesized
atcctctaaaatacttggcata

SEQ ID NO: 836918 - DNA, 22 bp, Artificial Sequence
  chemically synthesized
catcctctaaaatacttggcat

SEQ ID NO: 836919 - DNA, 22 bp, Artificial Sequence
  chemically synthesized
tatacatatgccaagtatttta

SEQ ID NO: 836920 - DNA, 22 bp, Artificial Sequence
  chemically synthesized
aaaatttcatcctctaaaatac

SEQ ID NO: 836921 - DNA, 22 bp, Artificial Sequence
  chemically synthesized
caattgaaaatttcatcctcta

SEQ ID NO: 836922 - DNA, 22 bp, Artificial Sequence
  chemically synthesized
ccaattgaaaatttcatcctct

SEQ ID NO: 836923 - DNA, 22 bp, Artificial Sequence
  chemically synthesized
tagaggatgaaattttcaattg

SEQ ID NO: 836924 - DNA, 22 bp, Artificial Sequence
  chemically synthesized
agaggatgaaattttcaattgg

SEQ ID NO: 836925 - DNA, 22 bp, Artificial Sequence
  chemically synthesized
gaggatgaaattttcaattgga

SEQ ID NO: 836926 - DNA, 22 bp, Artificial Sequence
  chemically synthesized
atcatgagtataggagtcagat

SEQ ID NO: 836927 - DNA, 22 bp, Artificial Sequence
  chemically synthesized
catcatgagtataggagtcaga

SEQ ID NO: 836928 - DNA, 22 bp, Artificial Sequence
  chemically synthesized
tcaattggaaatctgactccta

SEQ ID NO: 836929 - DNA, 22 bp, Artificial Sequence
  chemically synthesized
caattggaaatctgactcctat

SEQ ID NO: 836930 - DNA, 22 bp, Artificial Sequence
  chemically synthesized
aattggaaatctgactcctata

SEQ ID NO: 836931 - DNA, 22 bp, Artificial Sequence
  chemically synthesized
gaaatctgactcctatactcat

SEQ ID NO: 836932 - DNA, 22 bp, Artificial Sequence
  chemically synthesized
tgtaacagtcttcatcatgagt

SEQ ID NO: 836933 - DNA, 22 bp, Artificial Sequence
  chemically synthesized
actcctatactcatgatgaaga

SEQ ID NO: 836934 - DNA, 22 bp, Artificial Sequence
  chemically synthesized
ctatactcatgatgaagactgt

SEQ ID NO: 836935 - DNA, 22 bp, Artificial Sequence
  chemically synthesized
tactcatgatgaagactgttac

SEQ ID NO: 836936 - DNA, 22 bp, Artificial Sequence
  chemically synthesized
acatagaaattatgtaacagtc

SEQ ID NO: 836937 - DNA, 22 bp, Artificial Sequence
  chemically synthesized
gacatagaaattatgtaacagt

SEQ ID NO: 836938 - DNA, 22 bp, Artificial Sequence
  chemically synthesized
tgacatagaaattatgtaacag

SEQ ID NO: 836939 - DNA, 22 bp, Artificial Sequence
  chemically synthesized
ttgacatagaaattatgtaaca

SEQ ID NO: 836940 - DNA, 22 bp, Artificial Sequence
  chemically synthesized
atgatgaagactgttacataat

SEQ ID NO: 836941 - DNA, 22 bp, Artificial Sequence
  chemically synthesized
aatatgtttttgacatagaaat

SEQ ID NO: 836942 - DNA, 22 bp, Artificial Sequence
  chemically synthesized
aaatatgtttttgacatagaaa

SEQ ID NO: 836943 - DNA, 22 bp, Artificial Sequence
  chemically synthesized
taaatatgtttttgacatagaa

SEQ ID NO: 836944 - DNA, 22 bp, Artificial Sequence
  chemically synthesized
ttacataatttctatgtcaaaa

SEQ ID NO: 836945 - DNA, 22 bp, Artificial Sequence
  chemically synthesized
cataatttctatgtcaaaaaca

SEQ ID NO: 836946 - DNA, 22 bp, Artificial Sequence
  chemically synthesized
ctatgtcaaaaacatatttaaa

SEQ ID NO: 836947 - DNA, 22 bp, Artificial Sequence
  chemically synthesized
tatgtcaaaaacatatttaaag

SEQ ID NO: 836948 - DNA, 22 bp, Artificial Sequence
  chemically synthesized
aaaacaggtaaactttaaatat

SEQ ID NO: 836949 - DNA, 22 bp, Artificial Sequence
  chemically synthesized
tgtcaaaaacatatttaaagtt

SEQ ID NO: 836950 - DNA, 22 bp, Artificial Sequence
  chemically synthesized
tatggccattcaaaacaggtaa

SEQ ID NO: 836951 - DNA, 22 bp, Artificial Sequence
  chemically synthesized
aaagtttacctgttttgaatgg

SEQ ID NO: 836952 - DNA, 22 bp, Artificial Sequence
  chemically synthesized
aagtttacctgttttgaatggc

SEQ ID NO: 836953 - DNA, 22 bp, Artificial Sequence
  chemically synthesized
acctgttttgaatggccatata

SEQ ID NO: 836954 - DNA, 22 bp, Artificial Sequence
  chemically synthesized
cctgttttgaatggccatatag

SEQ ID NO: 836955 - DNA, 22 bp, Artificial Sequence
  chemically synthesized
ttttgaatggccatatagcttg

SEQ ID NO: 836956 - DNA, 22 bp, Artificial Sequence
  chemically synthesized
aatatatacgtcaacaagctat

SEQ ID NO: 836957 - DNA, 22 bp, Artificial Sequence
  chemically synthesized
tgaatggccatatagcttgttg

SEQ ID NO: 836958 - DNA, 22 bp, Artificial Sequence
  chemically synthesized
gaatggccatatagcttgttga

SEQ ID NO: 836959 - DNA, 22 bp, Artificial Sequence
  chemically synthesized
taaatatatacgtcaacaagct

SEQ ID NO: 836960 - DNA, 22 bp, Artificial Sequence
  chemically synthesized
aatggccatatagcttgttgac

SEQ ID NO: 836961 - DNA, 22 bp, Artificial Sequence
  chemically synthesized
attctaaatatatacgtcaaca

SEQ ID NO: 836962 - DNA, 22 bp, Artificial Sequence
  chemically synthesized
tgtcctgattctaaatatatac

SEQ ID NO: 836963 - DNA, 22 bp, Artificial Sequence
  chemically synthesized
gtgtcctgattctaaatatata

SEQ ID NO: 836964 - DNA, 22 bp, Artificial Sequence
  chemically synthesized
tgtgtcctgattctaaatatat

SEQ ID NO: 836965 - DNA, 22 bp, Artificial Sequence
  chemically synthesized
ttgtgtcctgattctaaatata

SEQ ID NO: 836966 - DNA, 22 bp, Artificial Sequence
  chemically synthesized
gttgacgtatatatttagaatc

SEQ ID NO: 836967 - DNA, 22 bp, Artificial Sequence
  chemically synthesized
tttttgtgtcctgattctaaat

SEQ ID NO: 836968 - DNA, 22 bp, Artificial Sequence
  chemically synthesized
ttgacgtatatatttagaatca

SEQ ID NO: 836969 - DNA, 22 bp, Artificial Sequence
  chemically synthesized
acgtatatatttagaatcagga

SEQ ID NO: 836970 - DNA, 22 bp, Artificial Sequence
  chemically synthesized
attatttttgtgtcctgattct

SEQ ID NO: 836971 - DNA, 22 bp, Artificial Sequence
  chemically synthesized
cattatttttgtgtcctgattc

SEQ ID NO: 836972 - DNA, 22 bp, Artificial Sequence
  chemically synthesized
tatcatttcattatttttgtgt

SEQ ID NO: 836973 - DNA, 22 bp, Artificial Sequence
  chemically synthesized
agaatcaggacacaaaaataat

SEQ ID NO: 836974 - DNA, 22 bp, Artificial Sequence
  chemically synthesized
gaatcaggacacaaaaataatg

SEQ ID NO: 836975 - DNA, 22 bp, Artificial Sequence
  chemically synthesized
attgtatcatttcattattttt

SEQ ID NO: 836976 - DNA, 22 bp, Artificial Sequence
  chemically synthesized
aattgtatcatttcattatttt

SEQ ID NO: 836977 - DNA, 22 bp, Artificial Sequence
  chemically synthesized
atttaattgtatcatttcatta

SEQ ID NO: 836978 - DNA, 22 bp, Artificial Sequence
  chemically synthesized
gatttaattgtatcatttcatt

SEQ ID NO: 836979 - DNA, 22 bp, Artificial Sequence
  chemically synthesized
tgatttaattgtatcatttcat

SEQ ID NO: 836980 - DNA, 22 bp, Artificial Sequence
  chemically synthesized
cattttgatttaattgtatcat

SEQ ID NO: 836981 - DNA, 22 bp, Artificial Sequence
  chemically synthesized
acattttgatttaattgtatca

SEQ ID NO: 836982 - DNA, 22 bp, Artificial Sequence
  chemically synthesized
tttacattttgatttaattgta

SEQ ID NO: 836983 - DNA, 22 bp, Artificial Sequence
  chemically synthesized
gtttacattttgatttaattgt

SEQ ID NO: 836984 - DNA, 22 bp, Artificial Sequence
  chemically synthesized
tgtttacattttgatttaattg

SEQ ID NO: 836985 - DNA, 22 bp, Artificial Sequence
  chemically synthesized
ataatattttgtttacattttg

SEQ ID NO: 836986 - DNA, 22 bp, Artificial Sequence
  chemically synthesized
aatcaaaatgtaaacaaaatat

SEQ ID NO: 836987 - DNA, 22 bp, Artificial Sequence
  chemically synthesized
ataatattgataatattttgtt

SEQ ID NO: 836988 - DNA, 22 bp, Artificial Sequence
  chemically synthesized
aataatattgataatattttgt

SEQ ID NO: 836989 - DNA, 22 bp, Artificial Sequence
  chemically synthesized
atttaataatattgataatatt

SEQ ID NO: 836990 - DNA, 22 bp, Artificial Sequence
  chemically synthesized
aatttaataatattgataatat

SEQ ID NO: 836991 - DNA, 22 bp, Artificial Sequence
  chemically synthesized
cttaatttaataatattgataa

SEQ ID NO: 836992 - DNA, 22 bp, Artificial Sequence
  chemically synthesized
ggagttccttaatttaataata

SEQ ID NO: 836993 - DNA, 22 bp, Artificial Sequence
  chemically synthesized
cggagttccttaatttaataat

SEQ ID NO: 836994 - DNA, 22 bp, Artificial Sequence
  chemically synthesized
tcaatattattaaattaaggaa

SEQ ID NO: 836995 - DNA, 22 bp, Artificial Sequence
  chemically synthesized
cgatagggcacttcggagttcc

SEQ ID NO: 836996 - DNA, 22 bp, Artificial Sequence
  chemically synthesized
ttaaattaaggaactccgaagt

SEQ ID NO: 836997 - DNA, 22 bp, Artificial Sequence
  chemically synthesized
aattaaggaactccgaagtgcc

SEQ ID NO: 836998 - DNA, 22 bp, Artificial Sequence
  chemically synthesized
aggaactccgaagtgccctatc

SEQ ID NO: 836999 - DNA, 22 bp, Artificial Sequence
  chemically synthesized
cgaagtgccctatcgtagattt

SEQ ID NO: 837000 - DNA, 22 bp, Artificial Sequence
  chemically synthesized
catcagtaagtaccaaaatcta

SEQ ID NO: 837001 - DNA, 22 bp, Artificial Sequence
  chemically synthesized
gcatcagtaagtaccaaaatct

SEQ ID NO: 837002 - DNA, 22 bp, Artificial Sequence
  chemically synthesized
tgcatcagtaagtaccaaaatc

SEQ ID NO: 837003 - DNA, 22 bp, Artificial Sequence
  chemically synthesized
tcgtagattttggtacttactg

SEQ ID NO: 837004 - DNA, 22 bp, Artificial Sequence
  chemically synthesized
tccataatactttgcatcagta

SEQ ID NO: 837005 - DNA, 22 bp, Artificial Sequence
  chemically synthesized
tggtacttactgatgcaaagta

SEQ ID NO: 837006 - DNA, 22 bp, Artificial Sequence
  chemically synthesized
ggtacttactgatgcaaagtat

SEQ ID NO: 837007 - DNA, 22 bp, Artificial Sequence
  chemically synthesized
gtacttactgatgcaaagtatt

SEQ ID NO: 837008 - DNA, 22 bp, Artificial Sequence
  chemically synthesized
accaggctgtccataatacttt

SEQ ID NO: 837009 - DNA, 22 bp, Artificial Sequence
  chemically synthesized
aaccaggctgtccataatactt

SEQ ID NO: 837010 - DNA, 22 bp, Artificial Sequence
  chemically synthesized
actgatgcaaagtattatggac

SEQ ID NO: 837011 - DNA, 22 bp, Artificial Sequence
  chemically synthesized
ctgatgcaaagtattatggaca

SEQ ID NO: 837012 - DNA, 22 bp, Artificial Sequence
  chemically synthesized
ggacttaaccaggctgtccata

SEQ ID NO: 837013 - DNA, 22 bp, Artificial Sequence
  chemically synthesized
atgcaaagtattatggacagcc

SEQ ID NO: 837014 - DNA, 22 bp, Artificial Sequence
  chemically synthesized
aggacttaaccaggctgtccat

SEQ ID NO: 837015 - DNA, 22 bp, Artificial Sequence
  chemically synthesized
taggacttaaccaggctgtcca

SEQ ID NO: 837016 - DNA, 22 bp, Artificial Sequence
  chemically synthesized
caaattttaggacttaaccagg

SEQ ID NO: 837017 - DNA, 22 bp, Artificial Sequence
  chemically synthesized
acaaattttaggacttaaccag

SEQ ID NO: 837018 - DNA, 22 bp, Artificial Sequence
  chemically synthesized
tacaaattttaggacttaacca

SEQ ID NO: 837019 - DNA, 22 bp, Artificial Sequence
  chemically synthesized
tggacagcctggttaagtccta

SEQ ID NO: 837020 - DNA, 22 bp, Artificial Sequence
  chemically synthesized
gttaagtcctaaaatttgtaaa

SEQ ID NO: 837021 - DNA, 22 bp, Artificial Sequence
  chemically synthesized
agtaggtaacgaattttacaaa

SEQ ID NO: 837022 - DNA, 22 bp, Artificial Sequence
  chemically synthesized
agtcctaaaatttgtaaaattc

SEQ ID NO: 837023 - DNA, 22 bp, Artificial Sequence
  chemically synthesized
attaagtaggtaacgaatttta

SEQ ID NO: 837024 - DNA, 22 bp, Artificial Sequence
  chemically synthesized
cattaagtaggtaacgaatttt

SEQ ID NO: 837025 - DNA, 22 bp, Artificial Sequence
  chemically synthesized
aaatttgtaaaattcgttacct

SEQ ID NO: 837026 - DNA, 22 bp, Artificial Sequence
  chemically synthesized
cacttcattaagtaggtaacga

SEQ ID NO: 837027 - DNA, 22 bp, Artificial Sequence
  chemically synthesized
acacttcattaagtaggtaacg

SEQ ID NO: 837028 - DNA, 22 bp, Artificial Sequence
  chemically synthesized
tacacttcattaagtaggtaac

SEQ ID NO: 837029 - DNA, 22 bp, Artificial Sequence
  chemically synthesized
gtaaaattcgttacctacttaa

SEQ ID NO: 837030 - DNA, 22 bp, Artificial Sequence
  chemically synthesized
taaaattcgttacctacttaat

SEQ ID NO: 837031 - DNA, 22 bp, Artificial Sequence
  chemically synthesized
actttacacttcattaagtagg

SEQ ID NO: 837032 - DNA, 22 bp, Artificial Sequence
  chemically synthesized
attgactttacacttcattaag

SEQ ID NO: 837033 - DNA, 22 bp, Artificial Sequence
  chemically synthesized
gttacctacttaatgaagtgta

SEQ ID NO: 837034 - DNA, 22 bp, Artificial Sequence
  chemically synthesized
cctacttaatgaagtgtaaagt

SEQ ID NO: 837035 - DNA, 22 bp, Artificial Sequence
  chemically synthesized
cttaatgaagtgtaaagtcaat

SEQ ID NO: 837036 - DNA, 22 bp, Artificial Sequence
  chemically synthesized
aagcagcacattcattgacttt

SEQ ID NO: 837037 - DNA, 22 bp, Artificial Sequence
  chemically synthesized
aatgaagtgtaaagtcaatgaa

SEQ ID NO: 837038 - DNA, 22 bp, Artificial Sequence
  chemically synthesized
atgaagtgtaaagtcaatgaat

SEQ ID NO: 837039 - DNA, 22 bp, Artificial Sequence
  chemically synthesized
tgatcactaaagcagcacattc

SEQ ID NO: 837040 - DNA, 22 bp, Artificial Sequence
  chemically synthesized
acagaatgtgttgtgatcacta

SEQ ID NO: 837041 - DNA, 22 bp, Artificial Sequence
  chemically synthesized
ctttagtgatcacaacacattc

SEQ ID NO: 837042 - DNA, 22 bp, Artificial Sequence
  chemically synthesized
tagtgatcacaacacattctgt

SEQ ID NO: 837043 - DNA, 22 bp, Artificial Sequence
  chemically synthesized
agtgatcacaacacattctgtt

SEQ ID NO: 837044 - DNA, 22 bp, Artificial Sequence
  chemically synthesized
gtgatcacaacacattctgtta

SEQ ID NO: 837045 - DNA, 22 bp, Artificial Sequence
  chemically synthesized
tgttagttgccacatgttgata

SEQ ID NO: 837046 - DNA, 22 bp, Artificial Sequence
  chemically synthesized
ttagttgccacatgttgatatt

SEQ ID NO: 837047 - DNA, 22 bp, Artificial Sequence
  chemically synthesized
ggagaagtagaataaatatcaa

SEQ ID NO: 837048 - DNA, 22 bp, Artificial Sequence
  chemically synthesized
gttgccacatgttgatatttat

SEQ ID NO: 837049 - DNA, 22 bp, Artificial Sequence
  chemically synthesized
ccacatgttgatatttattcta

SEQ ID NO: 837050 - DNA, 22 bp, Artificial Sequence
  chemically synthesized
tccctaggagaagtagaataaa

SEQ ID NO: 837051 - DNA, 22 bp, Artificial Sequence
  chemically synthesized
ttgtccctaggagaagtagaat

SEQ ID NO: 837052 - DNA, 22 bp, Artificial Sequence
  chemically synthesized
atatttattctacttctcctag

SEQ ID NO: 837053 - DNA, 22 bp, Artificial Sequence
  chemically synthesized
agtaacctgttgtccctaggag

SEQ ID NO: 837054 - DNA, 22 bp, Artificial Sequence
  chemically synthesized
attctacttctcctagggacaa

SEQ ID NO: 837055 - DNA, 22 bp, Artificial Sequence
  chemically synthesized
ttctacttctcctagggacaac

SEQ ID NO: 837056 - DNA, 22 bp, Artificial Sequence
  chemically synthesized
actaagtaacctgttgtcccta

SEQ ID NO: 837057 - DNA, 22 bp, Artificial Sequence
  chemically synthesized
gactaagtaacctgttgtccct

SEQ ID NO: 837058 - DNA, 22 bp, Artificial Sequence
  chemically synthesized
tacttctcctagggacaacagg

SEQ ID NO: 837059 - DNA, 22 bp, Artificial Sequence
  chemically synthesized
cttctcctagggacaacaggtt

SEQ ID NO: 837060 - DNA, 22 bp, Artificial Sequence
  chemically synthesized
ctcctagggacaacaggttact

SEQ ID NO: 837061 - DNA, 22 bp, Artificial Sequence
  chemically synthesized
tcctagggacaacaggttactt

SEQ ID NO: 837062 - DNA, 22 bp, Artificial Sequence
  chemically synthesized
ctagggacaacaggttacttag

SEQ ID NO: 837063 - DNA, 22 bp, Artificial Sequence
  chemically synthesized
gggacaacaggttacttagtca

SEQ ID NO: 837064 - DNA, 22 bp, Artificial Sequence
  chemically synthesized
catataaagtgtttgactaagt

SEQ ID NO: 837065 - DNA, 22 bp, Artificial Sequence
  chemically synthesized
ttacatataaagtgtttgacta

SEQ ID NO: 837066 - DNA, 22 bp, Artificial Sequence
  chemically synthesized
agtaacctgttacatataaagt

SEQ ID NO: 837067 - DNA, 22 bp, Artificial Sequence
  chemically synthesized
cttagtcaaacactttatatgt

SEQ ID NO: 837068 - DNA, 22 bp, Artificial Sequence
  chemically synthesized
agtcaaacactttatatgtaac

SEQ ID NO: 837069 - DNA, 22 bp, Artificial Sequence
  chemically synthesized
gtcaaacactttatatgtaaca

SEQ ID NO: 837070 - DNA, 22 bp, Artificial Sequence
  chemically synthesized
tatatgtaacaggttacttagt

SEQ ID NO: 837071 - DNA, 22 bp, Artificial Sequence
  chemically synthesized
atatgtaacaggttacttagtc

SEQ ID NO: 837072 - DNA, 22 bp, Artificial Sequence
  chemically synthesized
tatgtaacaggttacttagtca

SEQ ID NO: 837073 - DNA, 22 bp, Artificial Sequence
  chemically synthesized
tataaacaaagtgtatgactaa

SEQ ID NO: 837074 - DNA, 22 bp, Artificial Sequence
  chemically synthesized
cattatataaacaaagtgtatg

SEQ ID NO: 837075 - DNA, 22 bp, Artificial Sequence
  chemically synthesized
gcattatataaacaaagtgtat

SEQ ID NO: 837076 - DNA, 22 bp, Artificial Sequence
  chemically synthesized
cttagtcatacactttgtttat

SEQ ID NO: 837077 - DNA, 22 bp, Artificial Sequence
  chemically synthesized
agtcatacactttgtttatata

SEQ ID NO: 837078 - DNA, 22 bp, Artificial Sequence
  chemically synthesized
gtcatacactttgtttatataa

SEQ ID NO: 837079 - DNA, 22 bp, Artificial Sequence
  chemically synthesized
tgtttatataatgcaaattctc

SEQ ID NO: 837080 - DNA, 22 bp, Artificial Sequence
  chemically synthesized
gtttatataatgcaaattctca

SEQ ID NO: 837081 - DNA, 22 bp, Artificial Sequence
  chemically synthesized
tttatataatgcaaattctcat

SEQ ID NO: 837082 - DNA, 22 bp, Artificial Sequence
  chemically synthesized
agacaaaatgggaatgagaatt

SEQ ID NO: 837083 - DNA, 22 bp, Artificial Sequence
  chemically synthesized
aagacaaaatgggaatgagaat

SEQ ID NO: 837084 - DNA, 22 bp, Artificial Sequence
  chemically synthesized
atataatgcaaattctcattcc

SEQ ID NO: 837085 - DNA, 22 bp, Artificial Sequence
  chemically synthesized
tataatgcaaattctcattccc

SEQ ID NO: 837086 - DNA, 22 bp, Artificial Sequence
  chemically synthesized
taacttaagacaaaatgggaat

SEQ ID NO: 837087 - DNA, 22 bp, Artificial Sequence
  chemically synthesized
tgttataacttaagacaaaatg

SEQ ID NO: 837088 - DNA, 22 bp, Artificial Sequence
  chemically synthesized
tcattcccattttgtcttaagt

SEQ ID NO: 837089 - DNA, 22 bp, Artificial Sequence
  chemically synthesized
attcccattttgtcttaagtta

SEQ ID NO: 837090 - DNA, 22 bp, Artificial Sequence
  chemically synthesized
aaatgttatgttataacttaag

SEQ ID NO: 837091 - DNA, 22 bp, Artificial Sequence
  chemically synthesized
ccattttgtcttaagttataac

SEQ ID NO: 837092 - DNA, 22 bp, Artificial Sequence
  chemically synthesized
attaaaatgttatgttataact

SEQ ID NO: 837093 - DNA, 22 bp, Artificial Sequence
  chemically synthesized
tgtcttaagttataacataaca

SEQ ID NO: 837094 - DNA, 22 bp, Artificial Sequence
  chemically synthesized
gtcttaagttataacataacat

SEQ ID NO: 837095 - DNA, 22 bp, Artificial Sequence
  chemically synthesized
tcttaagttataacataacatt

SEQ ID NO: 837096 - DNA, 22 bp, Artificial Sequence
  chemically synthesized
aagttataacataacattttaa

SEQ ID NO: 837097 - DNA, 22 bp, Artificial Sequence
  chemically synthesized
agttataacataacattttaat

SEQ ID NO: 837098 - DNA, 22 bp, Artificial Sequence
  chemically synthesized
taacataacattttaatgagtt

SEQ ID NO: 837099 - DNA, 22 bp, Artificial Sequence
  chemically synthesized
agagggtacagagaactcatta

SEQ ID NO: 837100 - DNA, 22 bp, Artificial Sequence
  chemically synthesized
gagagggtacagagaactcatt

SEQ ID NO: 837101 - DNA, 22 bp, Artificial Sequence
  chemically synthesized
tgagagggtacagagaactcat

SEQ ID NO: 837102 - DNA, 22 bp, Artificial Sequence
  chemically synthesized
ttgagagggtacagagaactca

SEQ ID NO: 837103 - DNA, 22 bp, Artificial Sequence
  chemically synthesized
tttgagagggtacagagaactc

SEQ ID NO: 837104 - DNA, 22 bp, Artificial Sequence
  chemically synthesized
taatgagttctctgtaccctct

SEQ ID NO: 837105 - DNA, 22 bp, Artificial Sequence
  chemically synthesized
aatgagttctctgtaccctctc

SEQ ID NO: 837106 - DNA, 22 bp, Artificial Sequence
  chemically synthesized
atgagttctctgtaccctctca

SEQ ID NO: 837107 - DNA, 22 bp, Artificial Sequence
  chemically synthesized
ccatgatgttttttgagagggt

SEQ ID NO: 837108 - DNA, 22 bp, Artificial Sequence
  chemically synthesized
ttaccatgatgttttttgagag

SEQ ID NO: 837109 - DNA, 22 bp, Artificial Sequence
  chemically synthesized
attaccatgatgttttttgaga

SEQ ID NO: 837110 - DNA, 22 bp, Artificial Sequence
  chemically synthesized
ttattaccatgatgttttttga

SEQ ID NO: 837111 - DNA, 22 bp, Artificial Sequence
  chemically synthesized
tctgtaccctctcaaaaaacat

SEQ ID NO: 837112 - DNA, 22 bp, Artificial Sequence
  chemically synthesized
cttattaccatgatgttttttg

SEQ ID NO: 837113 - DNA, 22 bp, Artificial Sequence
  chemically synthesized
tcttattaccatgatgtttttt

SEQ ID NO: 837114 - DNA, 22 bp, Artificial Sequence
  chemically synthesized
tgtaccctctcaaaaaacatca

SEQ ID NO: 837115 - DNA, 22 bp, Artificial Sequence
  chemically synthesized
ttcttattaccatgatgttttt

SEQ ID NO: 837116 - DNA, 22 bp, Artificial Sequence
  chemically synthesized
tttcttattaccatgatgtttt

SEQ ID NO: 837117 - DNA, 22 bp, Artificial Sequence
  chemically synthesized
taccctctcaaaaaacatcatg

SEQ ID NO: 837118 - DNA, 22 bp, Artificial Sequence
  chemically synthesized
tttttcttattaccatgatgtt

SEQ ID NO: 837119 - DNA, 22 bp, Artificial Sequence
  chemically synthesized
ctttttcttattaccatgatgt

SEQ ID NO: 837120 - DNA, 22 bp, Artificial Sequence
  chemically synthesized
tctttttcttattaccatgatg

SEQ ID NO: 837121 - DNA, 22 bp, Artificial Sequence
  chemically synthesized
tcaaaaaacatcatggtaataa

SEQ ID NO: 837122 - DNA, 22 bp, Artificial Sequence
  chemically synthesized
aaaaaacatcatggtaataaga

SEQ ID NO: 837123 - DNA, 22 bp, Artificial Sequence
  chemically synthesized
ataaaactttctttttcttatt

SEQ ID NO: 837124 - DNA, 22 bp, Artificial Sequence
  chemically synthesized
aataaaactttctttttcttat

SEQ ID NO: 837125 - DNA, 22 bp, Artificial Sequence
  chemically synthesized
taataaaactttctttttctta

SEQ ID NO: 837126 - DNA, 22 bp, Artificial Sequence
  chemically synthesized
ttaataaaactttctttttctt

SEQ ID NO: 837127 - DNA, 22 bp, Artificial Sequence
  chemically synthesized
tttaataaaactttctttttct

SEQ ID NO: 837128 - DNA, 22 bp, Artificial Sequence
  chemically synthesized
gggttttttaataaaactttct

SEQ ID NO: 837129 - DNA, 22 bp, Artificial Sequence
  chemically synthesized
gattagggttttttaataaaac

SEQ ID NO: 837130 - DNA, 22 bp, Artificial Sequence
  chemically synthesized
ggattagggttttttaataaaa

SEQ ID NO: 837131 - DNA, 22 bp, Artificial Sequence
  chemically synthesized
aaagcaggaatttggattaggg

SEQ ID NO: 837132 - DNA, 22 bp, Artificial Sequence
  chemically synthesized
gaaagcaggaatttggattagg

SEQ ID NO: 837133 - DNA, 22 bp, Artificial Sequence
  chemically synthesized
tattaaaaaaccctaatccaaa

SEQ ID NO: 837134 - DNA, 22 bp, Artificial Sequence
  chemically synthesized
attaaaaaaccctaatccaaat

SEQ ID NO: 837135 - DNA, 22 bp, Artificial Sequence
  chemically synthesized
ttaaaaaaccctaatccaaatt

SEQ ID NO: 837136 - DNA, 22 bp, Artificial Sequence
  chemically synthesized
aaaaaccctaatccaaattcct

SEQ ID NO: 837137 - DNA, 22 bp, Artificial Sequence
  chemically synthesized
atccaaattcctgctttcaaga

SEQ ID NO: 837138 - DNA, 22 bp, Artificial Sequence
  chemically synthesized
cccccccaccaacccccaatct

SEQ ID NO: 837139 - DNA, 22 bp, Artificial Sequence
  chemically synthesized
ctgctttcaagattgggggttg

SEQ ID NO: 837140 - DNA, 22 bp, Artificial Sequence
  chemically synthesized
ctttcaagattgggggttggtg

SEQ ID NO: 837141 - DNA, 22 bp, Artificial Sequence
  chemically synthesized
gcagctccccccccaccaaccc

SEQ ID NO: 837142 - DNA, 22 bp, Artificial Sequence
  chemically synthesized
cgcagctccccccccaccaacc

SEQ ID NO: 837143 - DNA, 22 bp, Artificial Sequence
  chemically synthesized
tcaagattgggggttggtgggg

SEQ ID NO: 837144 - DNA, 22 bp, Artificial Sequence
  chemically synthesized
caagattgggggttggtggggg

SEQ ID NO: 837145 - DNA, 22 bp, Artificial Sequence
  chemically synthesized
aagattgggggttggtgggggg

SEQ ID NO: 837146 - DNA, 22 bp, Artificial Sequence
  chemically synthesized
agtttcgcagctccccccccac

SEQ ID NO: 837147 - DNA, 22 bp, Artificial Sequence
  chemically synthesized
ggggttggtggggggggagctg

SEQ ID NO: 837148 - DNA, 22 bp, Artificial Sequence
  chemically synthesized
agaagttcagtttcgcagctcc

SEQ ID NO: 837149 - DNA, 22 bp, Artificial Sequence
  chemically synthesized
aagaagttcagtttcgcagctc

SEQ ID NO: 837150 - DNA, 22 bp, Artificial Sequence
  chemically synthesized
gtggggggggagctgcgaaact

SEQ ID NO: 837151 - DNA, 22 bp, Artificial Sequence
  chemically synthesized
atcttaagaagttcagtttcgc

SEQ ID NO: 837152 - DNA, 22 bp, Artificial Sequence
  chemically synthesized
aatcttaagaagttcagtttcg

SEQ ID NO: 837153 - DNA, 22 bp, Artificial Sequence
  chemically synthesized
ttaatcttaagaagttcagttt

SEQ ID NO: 837154 - DNA, 22 bp, Artificial Sequence
  chemically synthesized
cgaaactgaacttcttaagatt

SEQ ID NO: 837155 - DNA, 22 bp, Artificial Sequence
  chemically synthesized
aacttcttaagattaagagctg

SEQ ID NO: 837156 - DNA, 22 bp, Artificial Sequence
  chemically synthesized
cttaagattaagagctggccgg

SEQ ID NO: 837157 - DNA, 22 bp, Artificial Sequence
  chemically synthesized
ttaagattaagagctggccggg

SEQ ID NO: 837158 - DNA, 22 bp, Artificial Sequence
  chemically synthesized
aagattaagagctggccgggcg

SEQ ID NO: 837159 - DNA, 22 bp, Artificial Sequence
  chemically synthesized
agattaagagctggccgggcgc

SEQ ID NO: 837160 - DNA, 22 bp, Artificial Sequence
  chemically synthesized
caggcgtgagccaccgcgcccg

SEQ ID NO: 837161 - DNA, 22 bp, Artificial Sequence
  chemically synthesized
agagctggccgggcgcggtggc

SEQ ID NO: 837162 - DNA, 22 bp, Artificial Sequence
  chemically synthesized
ggattacaggcgtgagccaccg

SEQ ID NO: 837163 - DNA, 22 bp, Artificial Sequence
  chemically synthesized
gccgggcgcggtggctcacgcc

SEQ ID NO: 837164 - DNA, 22 bp, Artificial Sequence
  chemically synthesized
ccaaagtgctgggattacaggc

SEQ ID NO: 837165 - DNA, 22 bp, Artificial Sequence
  chemically synthesized
ggcctcccaaagtgctgggatt

SEQ ID NO: 837166 - DNA, 22 bp, Artificial Sequence
  chemically synthesized
acgcctgtaatcccagcacttt

SEQ ID NO: 837167 - DNA, 22 bp, Artificial Sequence
  chemically synthesized
taatcccagcactttgggaggc

SEQ ID NO: 837168 - DNA, 22 bp, Artificial Sequence
  chemically synthesized
gtgatccgcccgtctcggcctc

SEQ ID NO: 837169 - DNA, 22 bp, Artificial Sequence
  chemically synthesized
acctcgtgatccgcccgtctcg

SEQ ID NO: 837170 - DNA, 22 bp, Artificial Sequence
  chemically synthesized
ctgacctcgtgatccgcccgtc

SEQ ID NO: 837171 - DNA, 22 bp, Artificial Sequence
  chemically synthesized
tgggaggccgagacgggcggat

SEQ ID NO: 837172 - DNA, 22 bp, Artificial Sequence
  chemically synthesized
gggaggccgagacgggcggatc

SEQ ID NO: 837173 - DNA, 22 bp, Artificial Sequence
  chemically synthesized
ggaggccgagacgggcggatca

SEQ ID NO: 837174 - DNA, 22 bp, Artificial Sequence
  chemically synthesized
gatctcctgacctcgtgatccg

SEQ ID NO: 837175 - DNA, 22 bp, Artificial Sequence
  chemically synthesized
gccaggatggtctcgatctcct

SEQ ID NO: 837176 - DNA, 22 bp, Artificial Sequence
  chemically synthesized
accgtgttagccaggatggtct

SEQ ID NO: 837177 - DNA, 22 bp, Artificial Sequence
  chemically synthesized
caccgtgttagccaggatggtc

SEQ ID NO: 837178 - DNA, 22 bp, Artificial Sequence
  chemically synthesized
gtagagacggggtttcaccgtg

SEQ ID NO: 837179 - DNA, 22 bp, Artificial Sequence
  chemically synthesized
agtagagacggggtttcaccgt

SEQ ID NO: 837180 - DNA, 22 bp, Artificial Sequence
  chemically synthesized
tagtagagacggggtttcaccg

SEQ ID NO: 837181 - DNA, 22 bp, Artificial Sequence
  chemically synthesized
ttagtagagacggggtttcacc

SEQ ID NO: 837182 - DNA, 22 bp, Artificial Sequence
  chemically synthesized
gctaacacggtgaaaccccgtc

SEQ ID NO: 837183 - DNA, 22 bp, Artificial Sequence
  chemically synthesized
tatttttagtagagacggggtt

SEQ ID NO: 837184 - DNA, 22 bp, Artificial Sequence
  chemically synthesized
gtatttttagtagagacggggt

SEQ ID NO: 837185 - DNA, 22 bp, Artificial Sequence
  chemically synthesized
tgtatttttagtagagacgggg

SEQ ID NO: 837186 - DNA, 22 bp, Artificial Sequence
  chemically synthesized
acacggtgaaaccccgtctcta

SEQ ID NO: 837187 - DNA, 22 bp, Artificial Sequence
  chemically synthesized
ttgtatttttagtagagacggg

SEQ ID NO: 837188 - DNA, 22 bp, Artificial Sequence
  chemically synthesized
atttttgtatttttagtagaga

SEQ ID NO: 837189 - DNA, 22 bp, Artificial Sequence
  chemically synthesized
tactaaaaatacaaaaattagc

SEQ ID NO: 837190 - DNA, 22 bp, Artificial Sequence
  chemically synthesized
ctaaaaatacaaaaattagccg

SEQ ID NO: 837191 - DNA, 22 bp, Artificial Sequence
  chemically synthesized
aaaatacaaaaattagccgggc

SEQ ID NO: 837192 - DNA, 22 bp, Artificial Sequence
  chemically synthesized
caggcgcgcgccaccatgcccg

SEQ ID NO: 837193 - DNA, 22 bp, Artificial Sequence
  chemically synthesized
ggactacaggcgcgcgccacca

SEQ ID NO: 837194 - DNA, 22 bp, Artificial Sequence
  chemically synthesized
gccgggcatggtggcgcgcgcc

SEQ ID NO: 837195 - DNA, 22 bp, Artificial Sequence
  chemically synthesized
ccgtgtagctgggactacaggc

SEQ ID NO: 837196 - DNA, 22 bp, Artificial Sequence
  chemically synthesized
agcctcccgtgtagctgggact

SEQ ID NO: 837197 - DNA, 22 bp, Artificial Sequence
  chemically synthesized
cctcagcctcccgtgtagctgg

SEQ ID NO: 837198 - DNA, 22 bp, Artificial Sequence
  chemically synthesized
ctgcctcagcctcccgtgtagc

SEQ ID NO: 837199 - DNA, 22 bp, Artificial Sequence
  chemically synthesized
tcctgcctcagcctcccgtgta

SEQ ID NO: 837200 - DNA, 22 bp, Artificial Sequence
  chemically synthesized
tagtcccagctacacgggaggc

SEQ ID NO: 837201 - DNA, 22 bp, Artificial Sequence
  chemically synthesized
acgccattctcctgcctcagcc

SEQ ID NO: 837202 - DNA, 22 bp, Artificial Sequence
  chemically synthesized
cacgggaggctgaggcaggaga

SEQ ID NO: 837203 - DNA, 22 bp, Artificial Sequence
  chemically synthesized
ccgggttcacgccattctcctg

SEQ ID NO: 837204 - DNA, 22 bp, Artificial Sequence
  chemically synthesized
cgcctcccgggttcacgccatt

SEQ ID NO: 837205 - DNA, 22 bp, Artificial Sequence
  chemically synthesized
aggcaggagaatggcgtgaacc

SEQ ID NO: 837206 - DNA, 22 bp, Artificial Sequence
  chemically synthesized
caagctccgcctcccgggttca

SEQ ID NO: 837207 - DNA, 22 bp, Artificial Sequence
  chemically synthesized
actgcaagctccgcctcccggg

SEQ ID NO: 837208 - DNA, 22 bp, Artificial Sequence
  chemically synthesized
ggctcactgcaagctccgcctc

SEQ ID NO: 837209 - DNA, 22 bp, Artificial Sequence
  chemically synthesized
gagtgcagtggcgggatctcgg

SEQ ID NO: 837210 - DNA, 22 bp, Artificial Sequence
  chemically synthesized
gcagtgagccgagatcccgcca

SEQ ID NO: 837211 - DNA, 22 bp, Artificial Sequence
  chemically synthesized
cagtgagccgagatcccgccac

SEQ ID NO: 837212 - DNA, 22 bp, Artificial Sequence
  chemically synthesized
tcgcccaggctggagtgcagtg

SEQ ID NO: 837213 - DNA, 22 bp, Artificial Sequence
  chemically synthesized
tgtcgcccaggctggagtgcag

SEQ ID NO: 837214 - DNA, 22 bp, Artificial Sequence
  chemically synthesized
gctctgtcgcccaggctggagt

SEQ ID NO: 837215 - DNA, 22 bp, Artificial Sequence
  chemically synthesized
cgctctgtcgcccaggctggag

SEQ ID NO: 837216 - DNA, 22 bp, Artificial Sequence
  chemically synthesized
cactccagcctgggcgacagag

SEQ ID NO: 837217 - DNA, 22 bp, Artificial Sequence
  chemically synthesized
agacggagtttcgctctgtcgc

SEQ ID NO: 837218 - DNA, 22 bp, Artificial Sequence
  chemically synthesized
gagacggagtttcgctctgtcg

SEQ ID NO: 837219 - DNA, 22 bp, Artificial Sequence
  chemically synthesized
tgagacggagtttcgctctgtc

SEQ ID NO: 837220 - DNA, 22 bp, Artificial Sequence
  chemically synthesized
ttgagacggagtttcgctctgt

SEQ ID NO: 837221 - DNA, 22 bp, Artificial Sequence
  chemically synthesized
cagcctgggcgacagagcgaaa

SEQ ID NO: 837222 - DNA, 22 bp, Artificial Sequence
  chemically synthesized
tttgagacggagtttcgctctg

SEQ ID NO: 837223 - DNA, 22 bp, Artificial Sequence
  chemically synthesized
ttttgagacggagtttcgctct

SEQ ID NO: 837224 - DNA, 22 bp, Artificial Sequence
  chemically synthesized
tttttgagacggagtttcgctc

SEQ ID NO: 837225 - DNA, 22 bp, Artificial Sequence
  chemically synthesized
ttttttgagacggagtttcgct

SEQ ID NO: 837226 - DNA, 22 bp, Artificial Sequence
  chemically synthesized
tttttttgagacggagtttcgc

SEQ ID NO: 837227 - DNA, 22 bp, Artificial Sequence
  chemically synthesized
ttttttttgagacggagtttcg

SEQ ID NO: 837228 - DNA, 22 bp, Artificial Sequence
  chemically synthesized
tttttttttgagacggagtttc

SEQ ID NO: 837229 - DNA, 22 bp, Artificial Sequence
  chemically synthesized
ggcgacagagcgaaactccgtc

SEQ ID NO: 837230 - DNA, 22 bp, Artificial Sequence
  chemically synthesized
ttttttttttgagacggagttt

SEQ ID NO: 837231 - DNA, 22 bp, Artificial Sequence
  chemically synthesized
tttttttttttgagacggagtt

SEQ ID NO: 837232 - DNA, 22 bp, Artificial Sequence
  chemically synthesized
ttttttttttttgagacggagt

SEQ ID NO: 837233 - DNA, 22 bp, Artificial Sequence
  chemically synthesized
tttttttttttttgagacggag

SEQ ID NO: 837234 - DNA, 22 bp, Artificial Sequence
  chemically synthesized
ttttttttttttttgagacgga

SEQ ID NO: 837235 - DNA, 22 bp, Artificial Sequence
  chemically synthesized
tttttttttttttttgagacgg

SEQ ID NO: 837236 - DNA, 22 bp, Artificial Sequence
  chemically synthesized
ttttttttttttttttgagacg

SEQ ID NO: 837237 - DNA, 22 bp, Artificial Sequence
  chemically synthesized
tttttttttttttttttgagac

SEQ ID NO: 837238 - DNA, 22 bp, Artificial Sequence
  chemically synthesized
ttttttttttttttttttgaga

SEQ ID NO: 837239 - DNA, 22 bp, Artificial Sequence
  chemically synthesized
attttttttttttttttttttt

SEQ ID NO: 837240 - DNA, 22 bp, Artificial Sequence
  chemically synthesized
aatttttttttttttttttttt

SEQ ID NO: 837241 - DNA, 22 bp, Artificial Sequence
  chemically synthesized
ttaatttttttttttttttttt

SEQ ID NO: 837242 - DNA, 22 bp, Artificial Sequence
  chemically synthesized
cgtctcaaaaaaaaaaaaaaaa

SEQ ID NO: 837243 - DNA, 22 bp, Artificial Sequence
  chemically synthesized
aaaaaaaaaaaaaaaaaaaaat

SEQ ID NO: 837244 - DNA, 22 bp, Artificial Sequence
  chemically synthesized
agagctttctatatacatttca

SEQ ID NO: 837245 - DNA, 22 bp, Artificial Sequence
  chemically synthesized
agcaaaatggaaatgaaatgta

SEQ ID NO: 837246 - DNA, 22 bp, Artificial Sequence
  chemically synthesized
gagcaaaatggaaatgaaatgt

SEQ ID NO: 837247 - DNA, 22 bp, Artificial Sequence
  chemically synthesized
atttgagcaaaatggaaatgaa

SEQ ID NO: 837248 - DNA, 22 bp, Artificial Sequence
  chemically synthesized
tctatatacatttcatttccat

SEQ ID NO: 837249 - DNA, 22 bp, Artificial Sequence
  chemically synthesized
ctatatacatttcatttccatt

SEQ ID NO: 837250 - DNA, 22 bp, Artificial Sequence
  chemically synthesized
tatatacatttcatttccattt

SEQ ID NO: 837251 - DNA, 22 bp, Artificial Sequence
  chemically synthesized
ctgatttgagcaaaatggaaat

SEQ ID NO: 837252 - DNA, 22 bp, Artificial Sequence
  chemically synthesized
tatacatttcatttccattttg

SEQ ID NO: 837253 - DNA, 22 bp, Artificial Sequence
  chemically synthesized
gaggatctgctgatttgagcaa

SEQ ID NO: 837254 - DNA, 22 bp, Artificial Sequence
  chemically synthesized
ggaggatctgctgatttgagca

SEQ ID NO: 837255 - DNA, 22 bp, Artificial Sequence
  chemically synthesized
catttccattttgctcaaatca

SEQ ID NO: 837256 - DNA, 22 bp, Artificial Sequence
  chemically synthesized
tggaggatctgctgatttgagc

SEQ ID NO: 837257 - DNA, 22 bp, Artificial Sequence
  chemically synthesized
atttccattttgctcaaatcag

SEQ ID NO: 837258 - DNA, 22 bp, Artificial Sequence
  chemically synthesized
ttggaggatctgctgatttgag

SEQ ID NO: 837259 - DNA, 22 bp, Artificial Sequence
  chemically synthesized
cttttggaggatctgctgattt

SEQ ID NO: 837260 - DNA, 22 bp, Artificial Sequence
  chemically synthesized
ccattttgctcaaatcagcaga

SEQ ID NO: 837261 - DNA, 22 bp, Artificial Sequence
  chemically synthesized
acttttggaggatctgctgatt

SEQ ID NO: 837262 - DNA, 22 bp, Artificial Sequence
  chemically synthesized
cattttgctcaaatcagcagat

SEQ ID NO: 837263 - DNA, 22 bp, Artificial Sequence
  chemically synthesized
agtttacttttggaggatctgc

SEQ ID NO: 837264 - DNA, 22 bp, Artificial Sequence
  chemically synthesized
tgctcaaatcagcagatcctcc

SEQ ID NO: 837265 - DNA, 22 bp, Artificial Sequence
  chemically synthesized
gctcaaatcagcagatcctcca

SEQ ID NO: 837266 - DNA, 22 bp, Artificial Sequence
  chemically synthesized
ctcaaatcagcagatcctccaa

SEQ ID NO: 837267 - DNA, 22 bp, Artificial Sequence
  chemically synthesized
ctcagtttacttttggaggatc

SEQ ID NO: 837268 - DNA, 22 bp, Artificial Sequence
  chemically synthesized
aaatcagcagatcctccaaaag

SEQ ID NO: 837269 - DNA, 22 bp, Artificial Sequence
  chemically synthesized
aaatgttcctcagtttactttt

SEQ ID NO: 837270 - DNA, 22 bp, Artificial Sequence
  chemically synthesized
gaaatgttcctcagtttacttt

SEQ ID NO: 837271 - DNA, 22 bp, Artificial Sequence
  chemically synthesized
ggccatttgaaatgttcctcag

SEQ ID NO: 837272 - DNA, 22 bp, Artificial Sequence
  chemically synthesized
caaaagtaaactgaggaacatt

SEQ ID NO: 837273 - DNA, 22 bp, Artificial Sequence
  chemically synthesized
aggaacatttcaaatggcctag

SEQ ID NO: 837274 - DNA, 22 bp, Artificial Sequence
  chemically synthesized
cagaatacaacatactaggcca

SEQ ID NO: 837275 - DNA, 22 bp, Artificial Sequence
  chemically synthesized
gcagaatacaacatactaggcc

SEQ ID NO: 837276 - DNA, 22 bp, Artificial Sequence
  chemically synthesized
atccttgcagaatacaacatac

SEQ ID NO: 837277 - DNA, 22 bp, Artificial Sequence
  chemically synthesized
caaatggcctagtatgttgtat

SEQ ID NO: 837278 - DNA, 22 bp, Artificial Sequence
  chemically synthesized
aaatggcctagtatgttgtatt

SEQ ID NO: 837279 - DNA, 22 bp, Artificial Sequence
  chemically synthesized
acatacctcatccttgcagaat

SEQ ID NO: 837280 - DNA, 22 bp, Artificial Sequence
  chemically synthesized
gtatgttgtattctgcaaggat

SEQ ID NO: 837281 - DNA, 22 bp, Artificial Sequence
  chemically synthesized
cagttcacatacctcatccttg

SEQ ID NO: 837282 - DNA, 22 bp, Artificial Sequence
  chemically synthesized
attccagttcacatacctcatc

SEQ ID NO: 837283 - DNA, 22 bp, Artificial Sequence
  chemically synthesized
tattctgcaaggatgaggtatg

SEQ ID NO: 837284 - DNA, 22 bp, Artificial Sequence
  chemically synthesized
gtctgattccagttcacatacc

SEQ ID NO: 837285 - DNA, 22 bp, Artificial Sequence
  chemically synthesized
tgcaaggatgaggtatgtgaac

SEQ ID NO: 837286 - DNA, 22 bp, Artificial Sequence
  chemically synthesized
ggtctgattccagttcacatac

SEQ ID NO: 837287 - DNA, 22 bp, Artificial Sequence
  chemically synthesized
caaggatgaggtatgtgaactg

SEQ ID NO: 837288 - DNA, 22 bp, Artificial Sequence
  chemically synthesized
aaagcaccttggtctgattcca

SEQ ID NO: 837289 - DNA, 22 bp, Artificial Sequence
  chemically synthesized
aaaagcaccttggtctgattcc

SEQ ID NO: 837290 - DNA, 22 bp, Artificial Sequence
  chemically synthesized
taaaagcaccttggtctgattc

SEQ ID NO: 837291 - DNA, 22 bp, Artificial Sequence
  chemically synthesized
gaatcagaccaaggtgctttta

SEQ ID NO: 837292 - DNA, 22 bp, Artificial Sequence
  chemically synthesized
ataaacatataacagattttaa

SEQ ID NO: 837293 - DNA, 22 bp, Artificial Sequence
  chemically synthesized
tcataaacatataacagatttt

SEQ ID NO: 837294 - DNA, 22 bp, Artificial Sequence
  chemically synthesized
ttaaaatctgttatatgtttat

SEQ ID NO: 837295 - DNA, 22 bp, Artificial Sequence
  chemically synthesized
gtacaatctctcataaacatat

SEQ ID NO: 837296 - DNA, 22 bp, Artificial Sequence
  chemically synthesized
taaaatctgttatatgtttatg

SEQ ID NO: 837297 - DNA, 22 bp, Artificial Sequence
  chemically synthesized
agtacaatctctcataaacata

SEQ ID NO: 837298 - DNA, 22 bp, Artificial Sequence
  chemically synthesized
aaaatctgttatatgtttatga

SEQ ID NO: 837299 - DNA, 22 bp, Artificial Sequence
  chemically synthesized
tagtacaatctctcataaacat

SEQ ID NO: 837300 - DNA, 22 bp, Artificial Sequence
  chemically synthesized
aaatctgttatatgtttatgag

SEQ ID NO: 837301 - DNA, 22 bp, Artificial Sequence
  chemically synthesized
ttagtacaatctctcataaaca

SEQ ID NO: 837302 - DNA, 22 bp, Artificial Sequence
  chemically synthesized
ttatatgtttatgagagattgt

SEQ ID NO: 837303 - DNA, 22 bp, Artificial Sequence
  chemically synthesized
agagtccttttagtacaatctc

SEQ ID NO: 837304 - DNA, 22 bp, Artificial Sequence
  chemically synthesized
tatgtttatgagagattgtact

SEQ ID NO: 837305 - DNA, 22 bp, Artificial Sequence
  chemically synthesized
atgagagattgtactaaaagga

SEQ ID NO: 837306 - DNA, 22 bp, Artificial Sequence
  chemically synthesized
agggattgagagtccttttagt

SEQ ID NO: 837307 - DNA, 22 bp, Artificial Sequence
  chemically synthesized
tgagagattgtactaaaaggac

SEQ ID NO: 837308 - DNA, 22 bp, Artificial Sequence
  chemically synthesized
aagggattgagagtccttttag

SEQ ID NO: 837309 - DNA, 22 bp, Artificial Sequence
  chemically synthesized
agtcttaagggattgagagtcc

SEQ ID NO: 837310 - DNA, 22 bp, Artificial Sequence
  chemically synthesized
cagtcttaagggattgagagtc

SEQ ID NO: 837311 - DNA, 22 bp, Artificial Sequence
  chemically synthesized
tcagtcttaagggattgagagt

SEQ ID NO: 837312 - DNA, 22 bp, Artificial Sequence
  chemically synthesized
tactaaaaggactctcaatccc

SEQ ID NO: 837313 - DNA, 22 bp, Artificial Sequence
  chemically synthesized
aaaggactctcaatcccttaag

SEQ ID NO: 837314 - DNA, 22 bp, Artificial Sequence
  chemically synthesized
tcaatcccttaagactgaaaat

SEQ ID NO: 837315 - DNA, 22 bp, Artificial Sequence
  chemically synthesized
caatgggtagtgaattttcagt

SEQ ID NO: 837316 - DNA, 22 bp, Artificial Sequence
  chemically synthesized
aatcccttaagactgaaaattc

SEQ ID NO: 837317 - DNA, 22 bp, Artificial Sequence
  chemically synthesized
gcaatgggtagtgaattttcag

SEQ ID NO: 837318 - DNA, 22 bp, Artificial Sequence
  chemically synthesized
tgcaatgggtagtgaattttca

SEQ ID NO: 837319 - DNA, 22 bp, Artificial Sequence
  chemically synthesized
aagactgaaaattcactaccca

SEQ ID NO: 837320 - DNA, 22 bp, Artificial Sequence
  chemically synthesized
agactgaaaattcactacccat

SEQ ID NO: 837321 - DNA, 22 bp, Artificial Sequence
  chemically synthesized
aaaattcactacccattgcaaa

SEQ ID NO: 837322 - DNA, 22 bp, Artificial Sequence
  chemically synthesized
actacccattgcaaagtctggg

SEQ ID NO: 837323 - DNA, 22 bp, Artificial Sequence
  chemically synthesized
cccattgcaaagtctgggtctg

SEQ ID NO: 837324 - DNA, 22 bp, Artificial Sequence
  chemically synthesized
caaagtctgggtctgtttgctt

SEQ ID NO: 837325 - DNA, 22 bp, Artificial Sequence
  chemically synthesized
ggtctgtttgctttgggtttct

SEQ ID NO: 837326 - DNA, 22 bp, Artificial Sequence
  chemically synthesized
tttgctttgggtttcttctggc

SEQ ID NO: 837327 - DNA, 22 bp, Artificial Sequence
  chemically synthesized
gctttgggtttcttctggcttt

SEQ ID NO: 837328 - DNA, 22 bp, Artificial Sequence
  chemically synthesized
aaaagcaaacaaaaagccagaa

SEQ ID NO: 837329 - DNA, 22 bp, Artificial Sequence
  chemically synthesized
ctttgggtttcttctggctttt

SEQ ID NO: 837330 - DNA, 22 bp, Artificial Sequence
  chemically synthesized
gaaaagcaaacaaaaagccaga

SEQ ID NO: 837331 - DNA, 22 bp, Artificial Sequence
  chemically synthesized
tgggtttcttctggctttttgt

SEQ ID NO: 837332 - DNA, 22 bp, Artificial Sequence
  chemically synthesized
tttgaaaagcaaacaaaaagcc

SEQ ID NO: 837333 - DNA, 22 bp, Artificial Sequence
  chemically synthesized
gggtttcttctggctttttgtt

SEQ ID NO: 837334 - DNA, 22 bp, Artificial Sequence
  chemically synthesized
gtttgaaaagcaaacaaaaagc

SEQ ID NO: 837335 - DNA, 22 bp, Artificial Sequence
  chemically synthesized
ggtttcttctggctttttgttt

SEQ ID NO: 837336 - DNA, 22 bp, Artificial Sequence
  chemically synthesized
cttctggctttttgtttgcttt

SEQ ID NO: 837337 - DNA, 22 bp, Artificial Sequence
  chemically synthesized
ttctggctttttgtttgctttt

SEQ ID NO: 837338 - DNA, 22 bp, Artificial Sequence
  chemically synthesized
ctggctttttgtttgcttttca

SEQ ID NO: 837339 - DNA, 22 bp, Artificial Sequence
  chemically synthesized
tggctttttgtttgcttttcaa

SEQ ID NO: 837340 - DNA, 22 bp, Artificial Sequence
  chemically synthesized
gctttttgtttgcttttcaaac

SEQ ID NO: 837341 - DNA, 22 bp, Artificial Sequence
  chemically synthesized
ataaaacgccttgtttgaaaag

SEQ ID NO: 837342 - DNA, 22 bp, Artificial Sequence
  chemically synthesized
tttgtttgcttttcaaacaagg

SEQ ID NO: 837343 - DNA, 22 bp, Artificial Sequence
  chemically synthesized
ttgtttgcttttcaaacaaggc

SEQ ID NO: 837344 - DNA, 22 bp, Artificial Sequence
  chemically synthesized
tgtttgcttttcaaacaaggcg

SEQ ID NO: 837345 - DNA, 22 bp, Artificial Sequence
  chemically synthesized
gtttgcttttcaaacaaggcgt

SEQ ID NO: 837346 - DNA, 22 bp, Artificial Sequence
  chemically synthesized
tttgcttttcaaacaaggcgtt

SEQ ID NO: 837347 - DNA, 22 bp, Artificial Sequence
  chemically synthesized
aagaggttaataaaacgccttg

SEQ ID NO: 837348 - DNA, 22 bp, Artificial Sequence
  chemically synthesized
gcttttcaaacaaggcgtttta

SEQ ID NO: 837349 - DNA, 22 bp, Artificial Sequence
  chemically synthesized
cttttcaaacaaggcgttttat

SEQ ID NO: 837350 - DNA, 22 bp, Artificial Sequence
  chemically synthesized
ccctaaagaggttaataaaacg

SEQ ID NO: 837351 - DNA, 22 bp, Artificial Sequence
  chemically synthesized
ttcaaacaaggcgttttattaa

SEQ ID NO: 837352 - DNA, 22 bp, Artificial Sequence
  chemically synthesized
tcaaacaaggcgttttattaac

SEQ ID NO: 837353 - DNA, 22 bp, Artificial Sequence
  chemically synthesized
caaacaaggcgttttattaacc

SEQ ID NO: 837354 - DNA, 22 bp, Artificial Sequence
  chemically synthesized
aaacaaggcgttttattaacct

SEQ ID NO: 837355 - DNA, 22 bp, Artificial Sequence
  chemically synthesized
gaattaccctaaagaggttaat

SEQ ID NO: 837356 - DNA, 22 bp, Artificial Sequence
  chemically synthesized
tattaacctctttagggtaatt

SEQ ID NO: 837357 - DNA, 22 bp, Artificial Sequence
  chemically synthesized
attaacctctttagggtaattc

SEQ ID NO: 837358 - DNA, 22 bp, Artificial Sequence
  chemically synthesized
ttaacctctttagggtaattcc

SEQ ID NO: 837359 - DNA, 22 bp, Artificial Sequence
  chemically synthesized
acctctttagggtaattccagt

SEQ ID NO: 837360 - DNA, 22 bp, Artificial Sequence
  chemically synthesized
tttagggtaattccagtgatga

SEQ ID NO: 837361 - DNA, 22 bp, Artificial Sequence
  chemically synthesized
catgaccatgagtcatcactgg

SEQ ID NO: 837362 - DNA, 22 bp, Artificial Sequence
  chemically synthesized
tagggtaattccagtgatgact

SEQ ID NO: 837363 - DNA, 22 bp, Artificial Sequence
  chemically synthesized
agggtaattccagtgatgactc

SEQ ID NO: 837364 - DNA, 22 bp, Artificial Sequence
  chemically synthesized
gggtaattccagtgatgactca

SEQ ID NO: 837365 - DNA, 22 bp, Artificial Sequence
  chemically synthesized
cagtgatgactcatggtcatgg

SEQ ID NO: 837366 - DNA, 22 bp, Artificial Sequence
  chemically synthesized
ccatcatcatctccatgaccat

SEQ ID NO: 837367 - DNA, 22 bp, Artificial Sequence
  chemically synthesized
caagctgccatcatcatctcca

SEQ ID NO: 837368 - DNA, 22 bp, Artificial Sequence
  chemically synthesized
atggtcatggagatgatgatgg

SEQ ID NO: 837369 - DNA, 22 bp, Artificial Sequence
  chemically synthesized
gtgtaggctacaagctgccatc

SEQ ID NO: 837370 - DNA, 22 bp, Artificial Sequence
  chemically synthesized
gcagctagtgtaggctacaagc

SEQ ID NO: 837371 - DNA, 22 bp, Artificial Sequence
  chemically synthesized
gcaggggagctggcagctagtg

SEQ ID NO: 837372 - DNA, 22 bp, Artificial Sequence
  chemically synthesized
gtagcctacactagctgccagc

SEQ ID NO: 837373 - DNA, 22 bp, Artificial Sequence
  chemically synthesized
tctcgcaggggagctggcagct

SEQ ID NO: 837374 - DNA, 22 bp, Artificial Sequence
  chemically synthesized
tagcctacactagctgccagct

SEQ ID NO: 837375 - DNA, 22 bp, Artificial Sequence
  chemically synthesized
gactgtctcgcaggggagctgg

SEQ ID NO: 837376 - DNA, 22 bp, Artificial Sequence
  chemically synthesized
cactagctgccagctcccctgc

SEQ ID NO: 837377 - DNA, 22 bp, Artificial Sequence
  chemically synthesized
attggactgtctcgcaggggag

SEQ ID NO: 837378 - DNA, 22 bp, Artificial Sequence
  chemically synthesized
gctgccagctcccctgcgagac

SEQ ID NO: 837379 - DNA, 22 bp, Artificial Sequence
  chemically synthesized
attgattggactgtctcgcagg

SEQ ID NO: 837380 - DNA, 22 bp, Artificial Sequence
  chemically synthesized
ctgattgattggactgtctcgc

SEQ ID NO: 837381 - DNA, 22 bp, Artificial Sequence
  chemically synthesized
ccagctcccctgcgagacagtc

SEQ ID NO: 837382 - DNA, 22 bp, Artificial Sequence
  chemically synthesized
actgattgattggactgtctcg

SEQ ID NO: 837383 - DNA, 22 bp, Artificial Sequence
  chemically synthesized
ccctgcgagacagtccaatcaa

SEQ ID NO: 837384 - DNA, 22 bp, Artificial Sequence
  chemically synthesized
cgagacagtccaatcaatcagt

SEQ ID NO: 837385 - DNA, 22 bp, Artificial Sequence
  chemically synthesized
aaaataacgggaatgccataaa

SEQ ID NO: 837386 - DNA, 22 bp, Artificial Sequence
  chemically synthesized
tgaaaataacgggaatgccata

SEQ ID NO: 837387 - DNA, 22 bp, Artificial Sequence
  chemically synthesized
ttctgaaaataacgggaatgcc

SEQ ID NO: 837388 - DNA, 22 bp, Artificial Sequence
  chemically synthesized
gttctgaaaataacgggaatgc

SEQ ID NO: 837389 - DNA, 22 bp, Artificial Sequence
  chemically synthesized
acatcttgttctgaaaataacg

SEQ ID NO: 837390 - DNA, 22 bp, Artificial Sequence
  chemically synthesized
atggcattcccgttattttcag

SEQ ID NO: 837391 - DNA, 22 bp, Artificial Sequence
  chemically synthesized
taacatcttgttctgaaaataa

SEQ ID NO: 837392 - DNA, 22 bp, Artificial Sequence
  chemically synthesized
tggcattcccgttattttcaga

SEQ ID NO: 837393 - DNA, 22 bp, Artificial Sequence
  chemically synthesized
attctaacatcttgttctgaaa

SEQ ID NO: 837394 - DNA, 22 bp, Artificial Sequence
  chemically synthesized
aattctaacatcttgttctgaa

SEQ ID NO: 837395 - DNA, 22 bp, Artificial Sequence
  chemically synthesized
taattctaacatcttgttctga

SEQ ID NO: 837396 - DNA, 22 bp, Artificial Sequence
  chemically synthesized
ccgttattttcagaacaagatg

SEQ ID NO: 837397 - DNA, 22 bp, Artificial Sequence
  chemically synthesized
ttttaattctaacatcttgttc

SEQ ID NO: 837398 - DNA, 22 bp, Artificial Sequence
  chemically synthesized
aattattttaattctaacatct

SEQ ID NO: 837399 - DNA, 22 bp, Artificial Sequence
  chemically synthesized
ttttcagaacaagatgttagaa

SEQ ID NO: 837400 - DNA, 22 bp, Artificial Sequence
  chemically synthesized
gaattattttaattctaacatc

SEQ ID NO: 837401 - DNA, 22 bp, Artificial Sequence
  chemically synthesized
tcagaacaagatgttagaatta

SEQ ID NO: 837402 - DNA, 22 bp, Artificial Sequence
  chemically synthesized
cagaacaagatgttagaattaa

SEQ ID NO: 837403 - DNA, 22 bp, Artificial Sequence
  chemically synthesized
agaacaagatgttagaattaaa

SEQ ID NO: 837404 - DNA, 22 bp, Artificial Sequence
  chemically synthesized
tatttgaattattttaattcta

SEQ ID NO: 837405 - DNA, 22 bp, Artificial Sequence
  chemically synthesized
atatttgaattattttaattct

SEQ ID NO: 837406 - DNA, 22 bp, Artificial Sequence
  chemically synthesized
tatatttgaattattttaattc

SEQ ID NO: 837407 - DNA, 22 bp, Artificial Sequence
  chemically synthesized
ctttatatttgaattattttaa

SEQ ID NO: 837408 - DNA, 22 bp, Artificial Sequence
  chemically synthesized
ctcctttatatttgaattattt

SEQ ID NO: 837409 - DNA, 22 bp, Artificial Sequence
  chemically synthesized
gaattaaaataattcaaatata

SEQ ID NO: 837410 - DNA, 22 bp, Artificial Sequence
  chemically synthesized
aaataattcaaatataaaggag

SEQ ID NO: 837411 - DNA, 22 bp, Artificial Sequence
  chemically synthesized
aaatataaaggagtaaccgttt

SEQ ID NO: 837412 - DNA, 22 bp, Artificial Sequence
  chemically synthesized
atggacagtaagcatcaaacgg

SEQ ID NO: 837413 - DNA, 22 bp, Artificial Sequence
  chemically synthesized
cctgatggacagtaagcatcaa

SEQ ID NO: 837414 - DNA, 22 bp, Artificial Sequence
  chemically synthesized
gcctccctgatggacagtaagc

SEQ ID NO: 837415 - DNA, 22 bp, Artificial Sequence
  chemically synthesized
cgcctccctgatggacagtaag

SEQ ID NO: 837416 - DNA, 22 bp, Artificial Sequence
  chemically synthesized
gatgcttactgtccatcaggga

SEQ ID NO: 837417 - DNA, 22 bp, Artificial Sequence
  chemically synthesized
atgcttactgtccatcagggag

SEQ ID NO: 837418 - DNA, 22 bp, Artificial Sequence
  chemically synthesized
actgtccatcagggaggcgaaa

SEQ ID NO: 837419 - DNA, 22 bp, Artificial Sequence
  chemically synthesized
ctgtccatcagggaggcgaaac

SEQ ID NO: 837420 - DNA, 22 bp, Artificial Sequence
  chemically synthesized
catgtagtatatgtttcgcctc

SEQ ID NO: 837421 - DNA, 22 bp, Artificial Sequence
  chemically synthesized
tccatgtagtatatgtttcgcc

SEQ ID NO: 837422 - DNA, 22 bp, Artificial Sequence
  chemically synthesized
tccatcagggaggcgaaacata

SEQ ID NO: 837423 - DNA, 22 bp, Artificial Sequence
  chemically synthesized
aggacattctccatgtagtata

SEQ ID NO: 837424 - DNA, 22 bp, Artificial Sequence
  chemically synthesized
tgaggacattctccatgtagta

SEQ ID NO: 837425 - DNA, 22 bp, Artificial Sequence
  chemically synthesized
tctgaggacattctccatgtag

SEQ ID NO: 837426 - DNA, 22 bp, Artificial Sequence
  chemically synthesized
tgtctctctgaggacattctcc

SEQ ID NO: 837427 - DNA, 22 bp, Artificial Sequence
  chemically synthesized
ttgtgtctctctgaggacattc

SEQ ID NO: 837428 - DNA, 22 bp, Artificial Sequence
  chemically synthesized
catggagaatgtcctcagagag

SEQ ID NO: 837429 - DNA, 22 bp, Artificial Sequence
  chemically synthesized
aacgttgttgtgtctctctgag

SEQ ID NO: 837430 - DNA, 22 bp, Artificial Sequence
  chemically synthesized
caacgttgttgtgtctctctga

SEQ ID NO: 837431 - DNA, 22 bp, Artificial Sequence
  chemically synthesized
ggaatttcaacgttgttgtgtc

SEQ ID NO: 837432 - DNA, 22 bp, Artificial Sequence
  chemically synthesized
agagagacacaacaacgttgaa

SEQ ID NO: 837433 - DNA, 22 bp, Artificial Sequence
  chemically synthesized
caaatgccatagattaggaatt

SEQ ID NO: 837434 - DNA, 22 bp, Artificial Sequence
  chemically synthesized
taagttacaaatgccatagatt

SEQ ID NO: 837435 - DNA, 22 bp, Artificial Sequence
  chemically synthesized
aaattcctaatctatggcattt

SEQ ID NO: 837436 - DNA, 22 bp, Artificial Sequence
  chemically synthesized
ccacatctgtaagttacaaatg

SEQ ID NO: 837437 - DNA, 22 bp, Artificial Sequence
  chemically synthesized
ctaatctatggcatttgtaact

SEQ ID NO: 837438 - DNA, 22 bp, Artificial Sequence
  chemically synthesized
atctatggcatttgtaacttac

SEQ ID NO: 837439 - DNA, 22 bp, Artificial Sequence
  chemically synthesized
atgttgccacatctgtaagtta

SEQ ID NO: 837440 - DNA, 22 bp, Artificial Sequence
  chemically synthesized
tcatgttgccacatctgtaagt

SEQ ID NO: 837441 - DNA, 22 bp, Artificial Sequence
  chemically synthesized
tggcatttgtaacttacagatg

SEQ ID NO: 837442 - DNA, 22 bp, Artificial Sequence
  chemically synthesized
ctcatgttgccacatctgtaag

SEQ ID NO: 837443 - DNA, 22 bp, Artificial Sequence
  chemically synthesized
tctcatgttgccacatctgtaa

SEQ ID NO: 837444 - DNA, 22 bp, Artificial Sequence
  chemically synthesized
ctttctcatgttgccacatctg

SEQ ID NO: 837445 - DNA, 22 bp, Artificial Sequence
  chemically synthesized
gtaacttacagatgtggcaaca

SEQ ID NO: 837446 - DNA, 22 bp, Artificial Sequence
  chemically synthesized
taacttacagatgtggcaacat

SEQ ID NO: 837447 - DNA, 22 bp, Artificial Sequence
  chemically synthesized
acagatgtggcaacatgagaaa

SEQ ID NO: 837448 - DNA, 22 bp, Artificial Sequence
  chemically synthesized
cagatgtggcaacatgagaaag

SEQ ID NO: 837449 - DNA, 22 bp, Artificial Sequence
  chemically synthesized
gagatacggagatgggagggca

SEQ ID NO: 837450 - DNA, 22 bp, Artificial Sequence
  chemically synthesized
agctagagatacggagatggga

SEQ ID NO: 837451 - DNA, 22 bp, Artificial Sequence
  chemically synthesized
gtggttcagctagagatacgga

SEQ ID NO: 837452 - DNA, 22 bp, Artificial Sequence
  chemically synthesized
gccctcccatctccgtatctct

SEQ ID NO: 837453 - DNA, 22 bp, Artificial Sequence
  chemically synthesized
ccctcccatctccgtatctcta

SEQ ID NO: 837454 - DNA, 22 bp, Artificial Sequence
  chemically synthesized
ccatctccgtatctctagctga

SEQ ID NO: 837455 - DNA, 22 bp, Artificial Sequence
  chemically synthesized
cgtatctctagctgaaccacca

SEQ ID NO: 837456 - DNA, 22 bp, Artificial Sequence
  chemically synthesized
tagctgaaccaccagttctccc

SEQ ID NO: 837457 - DNA, 22 bp, Artificial Sequence
  chemically synthesized
gagtaggaaaagtgggagaact

SEQ ID NO: 837458 - DNA, 22 bp, Artificial Sequence
  chemically synthesized
gctgaaccaccagttctcccac

SEQ ID NO: 837459 - DNA, 22 bp, Artificial Sequence
  chemically synthesized
aaccaccagttctcccactttt

SEQ ID NO: 837460 - DNA, 22 bp, Artificial Sequence
  chemically synthesized
tcccacttttcctactcgaatg

SEQ ID NO: 837461 - DNA, 22 bp, Artificial Sequence
  chemically synthesized
aaaaataaacaccattcgagta

SEQ ID NO: 837462 - DNA, 22 bp, Artificial Sequence
  chemically synthesized
aaaaaataaacaccattcgagt

SEQ ID NO: 837463 - DNA, 22 bp, Artificial Sequence
  chemically synthesized
ccacttttcctactcgaatggt

SEQ ID NO: 837464 - DNA, 22 bp, Artificial Sequence
  chemically synthesized
taaaaaataaacaccattcgag

SEQ ID NO: 837465 - DNA, 22 bp, Artificial Sequence
  chemically synthesized
ttaaaaaataaacaccattcga

SEQ ID NO: 837466 - DNA, 22 bp, Artificial Sequence
  chemically synthesized
ttcctactcgaatggtgtttat

SEQ ID NO: 837467 - DNA, 22 bp, Artificial Sequence
  chemically synthesized
tcctactcgaatggtgtttatt

SEQ ID NO: 837468 - DNA, 22 bp, Artificial Sequence
  chemically synthesized
cctactcgaatggtgtttattt

SEQ ID NO: 837469 - DNA, 22 bp, Artificial Sequence
  chemically synthesized
ctactcgaatggtgtttatttt

SEQ ID NO: 837470 - DNA, 22 bp, Artificial Sequence
  chemically synthesized
acacatgtttttaaaaaataaa

SEQ ID NO: 837471 - DNA, 22 bp, Artificial Sequence
  chemically synthesized
ctcgaatggtgtttatttttta

SEQ ID NO: 837472 - DNA, 22 bp, Artificial Sequence
  chemically synthesized
gaatggtgtttattttttaaaa

SEQ ID NO: 837473 - DNA, 22 bp, Artificial Sequence
  chemically synthesized
gccgctaacacatgtttttaaa

SEQ ID NO: 837474 - DNA, 22 bp, Artificial Sequence
  chemically synthesized
ctggccgctaacacatgttttt

SEQ ID NO: 837475 - DNA, 22 bp, Artificial Sequence
  chemically synthesized
attttttaaaaacatgtgttag

SEQ ID NO: 837476 - DNA, 22 bp, Artificial Sequence
  chemically synthesized
ttttttaaaaacatgtgttagc

SEQ ID NO: 837477 - DNA, 22 bp, Artificial Sequence
  chemically synthesized
tttaaaaacatgtgttagcggc

SEQ ID NO: 837478 - DNA, 22 bp, Artificial Sequence
  chemically synthesized
ttaaaaacatgtgttagcggcc

SEQ ID NO: 837479 - DNA, 22 bp, Artificial Sequence
  chemically synthesized
taaaaacatgtgttagcggcca

SEQ ID NO: 837480 - DNA, 22 bp, Artificial Sequence
  chemically synthesized
aaaaacatgtgttagcggccag

SEQ ID NO: 837481 - DNA, 22 bp, Artificial Sequence
  chemically synthesized
aaaacatgtgttagcggccagg

SEQ ID NO: 837482 - DNA, 22 bp, Artificial Sequence
  chemically synthesized
caggcgtgagccacggctcctg

SEQ ID NO: 837483 - DNA, 22 bp, Artificial Sequence
  chemically synthesized
ggattacaggcgtgagccacgg

SEQ ID NO: 837484 - DNA, 22 bp, Artificial Sequence
  chemically synthesized
gcggccaggagccgtggctcac

SEQ ID NO: 837485 - DNA, 22 bp, Artificial Sequence
  chemically synthesized
ccaaagtgctgggattacaggc

SEQ ID NO: 837486 - DNA, 22 bp, Artificial Sequence
  chemically synthesized
ggcctcccaaagtgctgggatt

SEQ ID NO: 837487 - DNA, 22 bp, Artificial Sequence
  chemically synthesized
acgcctgtaatcccagcacttt

SEQ ID NO: 837488 - DNA, 22 bp, Artificial Sequence
  chemically synthesized
taatcccagcactttgggaggc

SEQ ID NO: 837489 - DNA, 22 bp, Artificial Sequence
  chemically synthesized
aggtgatccacccgcctcggcc

SEQ ID NO: 837490 - DNA, 22 bp, Artificial Sequence
  chemically synthesized
tgggaggccgaggcgggtggat

SEQ ID NO: 837491 - DNA, 22 bp, Artificial Sequence
  chemically synthesized
gggaggccgaggcgggtggatc

SEQ ID NO: 837492 - DNA, 22 bp, Artificial Sequence
  chemically synthesized
ccaacctcaggtgatccacccg

SEQ ID NO: 837493 - DNA, 22 bp, Artificial Sequence
  chemically synthesized
ggaggccgaggcgggtggatca

SEQ ID NO: 837494 - DNA, 22 bp, Artificial Sequence
  chemically synthesized
gagctcccaacctcaggtgatc

SEQ ID NO: 837495 - DNA, 22 bp, Artificial Sequence
  chemically synthesized
gtctcgagctcccaacctcagg

SEQ ID NO: 837496 - DNA, 22 bp, Artificial Sequence
  chemically synthesized
gtcaggctggtctcgagctccc

SEQ ID NO: 837497 - DNA, 22 bp, Artificial Sequence
  chemically synthesized
aggttgggagctcgagaccagc

SEQ ID NO: 837498 - DNA, 22 bp, Artificial Sequence
  chemically synthesized
catgttggtcaggctggtctcg

SEQ ID NO: 837499 - DNA, 22 bp, Artificial Sequence
  chemically synthesized
tccatgttggtcaggctggtct

SEQ ID NO: 837500 - DNA, 22 bp, Artificial Sequence
  chemically synthesized
ctccatgttggtcaggctggtc

SEQ ID NO: 837501 - DNA, 22 bp, Artificial Sequence
  chemically synthesized
ggagctcgagaccagcctgacc

SEQ ID NO: 837502 - DNA, 22 bp, Artificial Sequence
  chemically synthesized
gagaccagcctgaccaacatgg

SEQ ID NO: 837503 - DNA, 22 bp, Artificial Sequence
  chemically synthesized
gtagagacagagtttctccatg

SEQ ID NO: 837504 - DNA, 22 bp, Artificial Sequence
  chemically synthesized
agtagagacagagtttctccat

SEQ ID NO: 837505 - DNA, 22 bp, Artificial Sequence
  chemically synthesized
tagtagagacagagtttctcca

SEQ ID NO: 837506 - DNA, 22 bp, Artificial Sequence
  chemically synthesized
ttagtagagacagagtttctcc

SEQ ID NO: 837507 - DNA, 22 bp, Artificial Sequence
  chemically synthesized
accaacatggagaaactctgtc

SEQ ID NO: 837508 - DNA, 22 bp, Artificial Sequence
  chemically synthesized
tatttttagtagagacagagtt

SEQ ID NO: 837509 - DNA, 22 bp, Artificial Sequence
  chemically synthesized
gtatttttagtagagacagagt

SEQ ID NO: 837510 - DNA, 22 bp, Artificial Sequence
  chemically synthesized
tgtatttttagtagagacagag

SEQ ID NO: 837511 - DNA, 22 bp, Artificial Sequence
  chemically synthesized
attttgtatttttagtagagac

SEQ ID NO: 837512 - DNA, 22 bp, Artificial Sequence
  chemically synthesized
tgtctctactaaaaatacaaaa

SEQ ID NO: 837513 - DNA, 22 bp, Artificial Sequence
  chemically synthesized
tctctactaaaaatacaaaatt

SEQ ID NO: 837514 - DNA, 22 bp, Artificial Sequence
  chemically synthesized
tactaaaaatacaaaattagcc

SEQ ID NO: 837515 - DNA, 22 bp, Artificial Sequence
  chemically synthesized
ctaaaaatacaaaattagccgg

SEQ ID NO: 837516 - DNA, 22 bp, Artificial Sequence
  chemically synthesized
aaaatacaaaattagccgggca

SEQ ID NO: 837517 - DNA, 22 bp, Artificial Sequence
  chemically synthesized
cagacacgtgccaccatgcccg

SEQ ID NO: 837518 - DNA, 22 bp, Artificial Sequence
  chemically synthesized
ggattacagacacgtgccacca

SEQ ID NO: 837519 - DNA, 22 bp, Artificial Sequence
  chemically synthesized
gccgggcatggtggcacgtgtc

SEQ ID NO: 837520 - DNA, 22 bp, Artificial Sequence
  chemically synthesized
agtagctgggattacagacacg

SEQ ID NO: 837521 - DNA, 22 bp, Artificial Sequence
  chemically synthesized
agccatctgagtagctgggatt

SEQ ID NO: 837522 - DNA, 22 bp, Artificial Sequence
  chemically synthesized
cctcagccatctgagtagctgg

SEQ ID NO: 837523 - DNA, 22 bp, Artificial Sequence
  chemically synthesized
ctgcctcagccatctgagtagc

SEQ ID NO: 837524 - DNA, 22 bp, Artificial Sequence
  chemically synthesized
tcctgcctcagccatctgagta

SEQ ID NO: 837525 - DNA, 22 bp, Artificial Sequence
  chemically synthesized
taatcccagctactcagatggc

SEQ ID NO: 837526 - DNA, 22 bp, Artificial Sequence
  chemically synthesized
aagcgattctcctgcctcagcc

SEQ ID NO: 837527 - DNA, 22 bp, Artificial Sequence
  chemically synthesized
ctcagatggctgaggcaggaga

SEQ ID NO: 837528 - DNA, 22 bp, Artificial Sequence
  chemically synthesized
ggttcaagcgattctcctgcct

SEQ ID NO: 837529 - DNA, 22 bp, Artificial Sequence
  chemically synthesized
agatggctgaggcaggagaatc

SEQ ID NO: 837530 - DNA, 22 bp, Artificial Sequence
  chemically synthesized
ctgggttcaagcgattctcctg

SEQ ID NO: 837531 - DNA, 22 bp, Artificial Sequence
  chemically synthesized
cgcctcctgggttcaagcgatt

SEQ ID NO: 837532 - DNA, 22 bp, Artificial Sequence
  chemically synthesized
aggcaggagaatcgcttgaacc

SEQ ID NO: 837533 - DNA, 22 bp, Artificial Sequence
  chemically synthesized
acagcaacctccgcctcctggg

SEQ ID NO: 837534 - DNA, 22 bp, Artificial Sequence
  chemically synthesized
gctcacagcaacctccgcctcc

SEQ ID NO: 837535 - DNA, 22 bp, Artificial Sequence
  chemically synthesized
ggctcacagcaacctccgcctc

SEQ ID NO: 837536 - DNA, 22 bp, Artificial Sequence
  chemically synthesized
gaacccaggaggcggaggttgc

SEQ ID NO: 837537 - DNA, 22 bp, Artificial Sequence
  chemically synthesized
aacccaggaggcggaggttgct

SEQ ID NO: 837538 - DNA, 22 bp, Artificial Sequence
  chemically synthesized
gagtgcaatggtgcgatcttgg

SEQ ID NO: 837539 - DNA, 22 bp, Artificial Sequence
  chemically synthesized
ctgtgagccaagatcgcaccat

SEQ ID NO: 837540 - DNA, 22 bp, Artificial Sequence
  chemically synthesized
tgagccaagatcgcaccattgc

SEQ ID NO: 837541 - DNA, 22 bp, Artificial Sequence
  chemically synthesized
cccaggctggagtgcaatggtg

SEQ ID NO: 837542 - DNA, 22 bp, Artificial Sequence
  chemically synthesized
ttgcccaggctggagtgcaatg

SEQ ID NO: 837543 - DNA, 22 bp, Artificial Sequence
  chemically synthesized
gttgcccaggctggagtgcaat

SEQ ID NO: 837544 - DNA, 22 bp, Artificial Sequence
  chemically synthesized
ttgttgcccaggctggagtgca

SEQ ID NO: 837545 - DNA, 22 bp, Artificial Sequence
  chemically synthesized
ctcttgttgcccaggctggagt

SEQ ID NO: 837546 - DNA, 22 bp, Artificial Sequence
  chemically synthesized
gctcttgttgcccaggctggag

SEQ ID NO: 837547 - DNA, 22 bp, Artificial Sequence
  chemically synthesized
tgctcttgttgcccaggctgga

SEQ ID NO: 837548 - DNA, 22 bp, Artificial Sequence
  chemically synthesized
cactccagcctgggcaacaaga

SEQ ID NO: 837549 - DNA, 22 bp, Artificial Sequence
  chemically synthesized
agatggagttttgctcttgttg

SEQ ID NO: 837550 - DNA, 22 bp, Artificial Sequence
  chemically synthesized
cagcctgggcaacaagagcaaa

SEQ ID NO: 837551 - DNA, 22 bp, Artificial Sequence
  chemically synthesized
ttgagatggagttttgctcttg

SEQ ID NO: 837552 - DNA, 22 bp, Artificial Sequence
  chemically synthesized
gttgagatggagttttgctctt

SEQ ID NO: 837553 - DNA, 22 bp, Artificial Sequence
  chemically synthesized
tgttgagatggagttttgctct

SEQ ID NO: 837554 - DNA, 22 bp, Artificial Sequence
  chemically synthesized
ttttgttgagatggagttttgc

SEQ ID NO: 837555 - DNA, 22 bp, Artificial Sequence
  chemically synthesized
gttttgttgagatggagttttg

SEQ ID NO: 837556 - DNA, 22 bp, Artificial Sequence
  chemically synthesized
ggcaacaagagcaaaactccat

SEQ ID NO: 837557 - DNA, 22 bp, Artificial Sequence
  chemically synthesized
tgttttgttgagatggagtttt

SEQ ID NO: 837558 - DNA, 22 bp, Artificial Sequence
  chemically synthesized
ttttgttttgttgagatggagt

SEQ ID NO: 837559 - DNA, 22 bp, Artificial Sequence
  chemically synthesized
gttttgttttgttgagatggag

SEQ ID NO: 837560 - DNA, 22 bp, Artificial Sequence
  chemically synthesized
tgttttgttttgttgagatgga

SEQ ID NO: 837561 - DNA, 22 bp, Artificial Sequence
  chemically synthesized
ttttgttttgttttgttgagat

SEQ ID NO: 837562 - DNA, 22 bp, Artificial Sequence
  chemically synthesized
gttttgttttgttttgttgaga

SEQ ID NO: 837563 - DNA, 22 bp, Artificial Sequence
  chemically synthesized
tgttttgttttgttttgttgag

SEQ ID NO: 837564 - DNA, 22 bp, Artificial Sequence
  chemically synthesized
ttttgttttgttttgttttgtt

SEQ ID NO: 837565 - DNA, 22 bp, Artificial Sequence
  chemically synthesized
gttttgttttgttttgttttgt

SEQ ID NO: 837566 - DNA, 22 bp, Artificial Sequence
  chemically synthesized
tgttttgttttgttttgttttg

SEQ ID NO: 837567 - DNA, 22 bp, Artificial Sequence
  chemically synthesized
ttttgttttgttttgttttgtt

SEQ ID NO: 837568 - DNA, 22 bp, Artificial Sequence
  chemically synthesized
catctcaacaaaacaaaacaaa

SEQ ID NO: 837569 - DNA, 22 bp, Artificial Sequence
  chemically synthesized
gttttgttttgttttgttttgt

SEQ ID NO: 837570 - DNA, 22 bp, Artificial Sequence
  chemically synthesized
tttgttttgttttgttttgttt

SEQ ID NO: 837571 - DNA, 22 bp, Artificial Sequence
  chemically synthesized
gtttgttttgttttgttttgtt

SEQ ID NO: 837572 - DNA, 22 bp, Artificial Sequence
  chemically synthesized
tgtttgttttgttttgttttgt

SEQ ID NO: 837573 - DNA, 22 bp, Artificial Sequence
  chemically synthesized
aacaaaacaaaacaaaacaaaa

SEQ ID NO: 837574 - DNA, 22 bp, Artificial Sequence
  chemically synthesized
ttgtttgttttgttttgttttg

SEQ ID NO: 837575 - DNA, 22 bp, Artificial Sequence
  chemically synthesized
tttttgtttgttttgttttgtt

SEQ ID NO: 837576 - DNA, 22 bp, Artificial Sequence
  chemically synthesized
gtttttgtttgttttgttttgt

SEQ ID NO: 837577 - DNA, 22 bp, Artificial Sequence
  chemically synthesized
tgtttttgtttgttttgttttg

SEQ ID NO: 837578 - DNA, 22 bp, Artificial Sequence
  chemically synthesized
acatatgttttgtttttgtttg

SEQ ID NO: 837579 - DNA, 22 bp, Artificial Sequence
  chemically synthesized
gaaagataaaaggctaacatat

SEQ ID NO: 837580 - DNA, 22 bp, Artificial Sequence
  chemically synthesized
agaaagataaaaggctaacata

SEQ ID NO: 837581 - DNA, 22 bp, Artificial Sequence
  chemically synthesized
tagaaagataaaaggctaacat

SEQ ID NO: 837582 - DNA, 22 bp, Artificial Sequence
  chemically synthesized
gcccgttttagaaagataaaag

SEQ ID NO: 837583 - DNA, 22 bp, Artificial Sequence
  chemically synthesized
agcccgttttagaaagataaaa

SEQ ID NO: 837584 - DNA, 22 bp, Artificial Sequence
  chemically synthesized
gccttttatctttctaaaacgg

SEQ ID NO: 837585 - DNA, 22 bp, Artificial Sequence
  chemically synthesized
ttatctttctaaaacgggctaa

SEQ ID NO: 837586 - DNA, 22 bp, Artificial Sequence
  chemically synthesized
tatctttctaaaacgggctaaa

SEQ ID NO: 837587 - DNA, 22 bp, Artificial Sequence
  chemically synthesized
agcaaaataatgtttagcccgt

SEQ ID NO: 837588 - DNA, 22 bp, Artificial Sequence
  chemically synthesized
atctttctaaaacgggctaaac

SEQ ID NO: 837589 - DNA, 22 bp, Artificial Sequence
  chemically synthesized
aagcaaaataatgtttagcccg

SEQ ID NO: 837590 - DNA, 22 bp, Artificial Sequence
  chemically synthesized
tctttctaaaacgggctaaaca

SEQ ID NO: 837591 - DNA, 22 bp, Artificial Sequence
  chemically synthesized
taagcaaaataatgtttagccc

SEQ ID NO: 837592 - DNA, 22 bp, Artificial Sequence
  chemically synthesized
tctaaaacgggctaaacattat

SEQ ID NO: 837593 - DNA, 22 bp, Artificial Sequence
  chemically synthesized
ctaaaacgggctaaacattatt

SEQ ID NO: 837594 - DNA, 22 bp, Artificial Sequence
  chemically synthesized
taaaacgggctaaacattattt

SEQ ID NO: 837595 - DNA, 22 bp, Artificial Sequence
  chemically synthesized
tgcctttaagcaaaataatgtt

SEQ ID NO: 837596 - DNA, 22 bp, Artificial Sequence
  chemically synthesized
aaacgggctaaacattattttg

SEQ ID NO: 837597 - DNA, 22 bp, Artificial Sequence
  chemically synthesized
tatgcctttaagcaaaataatg

SEQ ID NO: 837598 - DNA, 22 bp, Artificial Sequence
  chemically synthesized
ctatgcctttaagcaaaataat

SEQ ID NO: 837599 - DNA, 22 bp, Artificial Sequence
  chemically synthesized
atttctatgcctttaagcaaaa

SEQ ID NO: 837600 - DNA, 22 bp, Artificial Sequence
  chemically synthesized
aacattattttgcttaaaggca

SEQ ID NO: 837601 - DNA, 22 bp, Artificial Sequence
  chemically synthesized
agaggcattaatttctatgcct

SEQ ID NO: 837602 - DNA, 22 bp, Artificial Sequence
  chemically synthesized
ttttgcttaaaggcatagaaat

SEQ ID NO: 837603 - DNA, 22 bp, Artificial Sequence
  chemically synthesized
tcagaggcattaatttctatgc

SEQ ID NO: 837604 - DNA, 22 bp, Artificial Sequence
  chemically synthesized
ctcagaggcattaatttctatg

SEQ ID NO: 837605 - DNA, 22 bp, Artificial Sequence
  chemically synthesized
tgcttaaaggcatagaaattaa

SEQ ID NO: 837606 - DNA, 22 bp, Artificial Sequence
  chemically synthesized
gcttaaaggcatagaaattaat

SEQ ID NO: 837607 - DNA, 22 bp, Artificial Sequence
  chemically synthesized
cttaaaggcatagaaattaatg

SEQ ID NO: 837608 - DNA, 22 bp, Artificial Sequence
  chemically synthesized
aaatttctcagaggcattaatt

SEQ ID NO: 837609 - DNA, 22 bp, Artificial Sequence
  chemically synthesized
aaaggcatagaaattaatgcct

SEQ ID NO: 837610 - DNA, 22 bp, Artificial Sequence
  chemically synthesized
aaaatttctcagaggcattaat

SEQ ID NO: 837611 - DNA, 22 bp, Artificial Sequence
  chemically synthesized
aaggcatagaaattaatgcctc

SEQ ID NO: 837612 - DNA, 22 bp, Artificial Sequence
  chemically synthesized
atgggacttaaaatttctcaga

SEQ ID NO: 837613 - DNA, 22 bp, Artificial Sequence
  chemically synthesized
actcatgggacttaaaatttct

SEQ ID NO: 837614 - DNA, 22 bp, Artificial Sequence
  chemically synthesized
atgcctctgagaaattttaagt

SEQ ID NO: 837615 - DNA, 22 bp, Artificial Sequence
  chemically synthesized
ttgactcatgggacttaaaatt

SEQ ID NO: 837616 - DNA, 22 bp, Artificial Sequence
  chemically synthesized
attgactcatgggacttaaaat

SEQ ID NO: 837617 - DNA, 22 bp, Artificial Sequence
  chemically synthesized
tgagaaattttaagtcccatga

SEQ ID NO: 837618 - DNA, 22 bp, Artificial Sequence
  chemically synthesized
ggtatttattgactcatgggac

SEQ ID NO: 837619 - DNA, 22 bp, Artificial Sequence
  chemically synthesized
agaaattttaagtcccatgagt

SEQ ID NO: 837620 - DNA, 22 bp, Artificial Sequence
  chemically synthesized
taagtcccatgagtcaataaat

SEQ ID NO: 837621 - DNA, 22 bp, Artificial Sequence
  chemically synthesized
aagtcccatgagtcaataaata

SEQ ID NO: 837622 - DNA, 22 bp, Artificial Sequence
  chemically synthesized
aaacatattgggtatttattga

SEQ ID NO: 837623 - DNA, 22 bp, Artificial Sequence
  chemically synthesized
agtcccatgagtcaataaatac

SEQ ID NO: 837624 - DNA, 22 bp, Artificial Sequence
  chemically synthesized
agttcaaacatattgggtattt

SEQ ID NO: 837625 - DNA, 22 bp, Artificial Sequence
  chemically synthesized
aattaagttcaaacatattggg

SEQ ID NO: 837626 - DNA, 22 bp, Artificial Sequence
  chemically synthesized
caattaagttcaaacatattgg

SEQ ID NO: 837627 - DNA, 22 bp, Artificial Sequence
  chemically synthesized
tttcaattaagttcaaacatat

SEQ ID NO: 837628 - DNA, 22 bp, Artificial Sequence
  chemically synthesized
atttcaattaagttcaaacata

SEQ ID NO: 837629 - DNA, 22 bp, Artificial Sequence
  chemically synthesized
tgatagtttatttcaattaagt

SEQ ID NO: 837630 - DNA, 22 bp, Artificial Sequence
  chemically synthesized
gtgatagtttatttcaattaag

SEQ ID NO: 837631 - DNA, 22 bp, Artificial Sequence
  chemically synthesized
tcaatttgtgatagtttatttc

SEQ ID NO: 837632 - DNA, 22 bp, Artificial Sequence
  chemically synthesized
gaacttaattgaaataaactat

SEQ ID NO: 837633 - DNA, 22 bp, Artificial Sequence
  chemically synthesized
aacttaattgaaataaactatc

SEQ ID NO: 837634 - DNA, 22 bp, Artificial Sequence
  chemically synthesized
aattgaaataaactatcacaaa

SEQ ID NO: 837635 - DNA, 22 bp, Artificial Sequence
  chemically synthesized
attgaaataaactatcacaaat

SEQ ID NO: 837636 - DNA, 22 bp, Artificial Sequence
  chemically synthesized
atatataaactatcaatttgtg

SEQ ID NO: 837637 - DNA, 22 bp, Artificial Sequence
  chemically synthesized
aaataaactatcacaaattgat

SEQ ID NO: 837638 - DNA, 22 bp, Artificial Sequence
  chemically synthesized
tcacaaattgatagtttatata

SEQ ID NO: 837639 - DNA, 22 bp, Artificial Sequence
  chemically synthesized
tatatacgactgatatataaac

SEQ ID NO: 837640 - DNA, 22 bp, Artificial Sequence
  chemically synthesized
atatatacgactgatatataaa

SEQ ID NO: 837641 - DNA, 22 bp, Artificial Sequence
  chemically synthesized
tatatatacgactgatatataa

SEQ ID NO: 837642 - DNA, 22 bp, Artificial Sequence
  chemically synthesized
atagtttatatatcagtcgtat

SEQ ID NO: 837643 - DNA, 22 bp, Artificial Sequence
  chemically synthesized
tatgtcaattttatatatacga

SEQ ID NO: 837644 - DNA, 22 bp, Artificial Sequence
  chemically synthesized
atatgtcaattttatatatacg

SEQ ID NO: 837645 - DNA, 22 bp, Artificial Sequence
  chemically synthesized
atatatcagtcgtatatataaa

SEQ ID NO: 837646 - DNA, 22 bp, Artificial Sequence
  chemically synthesized
tatatcagtcgtatatataaaa

SEQ ID NO: 837647 - DNA, 22 bp, Artificial Sequence
  chemically synthesized
taaagtacatgcttatatgtca

SEQ ID NO: 837648 - DNA, 22 bp, Artificial Sequence
  chemically synthesized
acatataagcatgtactttata

SEQ ID NO: 837649 - DNA, 22 bp, Artificial Sequence
  chemically synthesized
atgcatgtagatagttataaag

SEQ ID NO: 837650 - DNA, 22 bp, Artificial Sequence
  chemically synthesized
tatactcatgcatgtagatagt

SEQ ID NO: 837651 - DNA, 22 bp, Artificial Sequence
  chemically synthesized
atatactcatgcatgtagatag

SEQ ID NO: 837652 - DNA, 22 bp, Artificial Sequence
  chemically synthesized
ttatatactcatgcatgtagat

SEQ ID NO: 837653 - DNA, 22 bp, Artificial Sequence
  chemically synthesized
tataactatctacatgcatgag

SEQ ID NO: 837654 - DNA, 22 bp, Artificial Sequence
  chemically synthesized
ataactatctacatgcatgagt

SEQ ID NO: 837655 - DNA, 22 bp, Artificial Sequence
  chemically synthesized
taactatctacatgcatgagta

SEQ ID NO: 837656 - DNA, 22 bp, Artificial Sequence
  chemically synthesized
tctacatgcatgagtatataag

SEQ ID NO: 837657 - DNA, 22 bp, Artificial Sequence
  chemically synthesized
catgcatgagtatataagaata

SEQ ID NO: 837658 - DNA, 22 bp, Artificial Sequence
  chemically synthesized
aatatatgtgtatatatatata

SEQ ID NO: 837659 - DNA, 22 bp, Artificial Sequence
  chemically synthesized
aaatatatgtgtatatatatat

SEQ ID NO: 837660 - DNA, 22 bp, Artificial Sequence
  chemically synthesized
aaagtttaaatatatgtgtata

SEQ ID NO: 837661 - DNA, 22 bp, Artificial Sequence
  chemically synthesized
ttgaaagtttaaatatatgtgt

SEQ ID NO: 837662 - DNA, 22 bp, Artificial Sequence
  chemically synthesized
gagtcagttattgaaagtttaa

SEQ ID NO: 837663 - DNA, 22 bp, Artificial Sequence
  chemically synthesized
ggagtcagttattgaaagttta

SEQ ID NO: 837664 - DNA, 22 bp, Artificial Sequence
  chemically synthesized
catttggagtcagttattgaaa

SEQ ID NO: 837665 - DNA, 22 bp, Artificial Sequence
  chemically synthesized
aaactttcaataactgactcca

SEQ ID NO: 837666 - DNA, 22 bp, Artificial Sequence
  chemically synthesized
aactttcaataactgactccaa

SEQ ID NO: 837667 - DNA, 22 bp, Artificial Sequence
  chemically synthesized
aaaggaggctacatttggagtc

SEQ ID NO: 837668 - DNA, 22 bp, Artificial Sequence
  chemically synthesized
tcaataactgactccaaatgta

SEQ ID NO: 837669 - DNA, 22 bp, Artificial Sequence
  chemically synthesized
caataactgactccaaatgtag

SEQ ID NO: 837670 - DNA, 22 bp, Artificial Sequence
  chemically synthesized
aataactgactccaaatgtagc

SEQ ID NO: 837671 - DNA, 22 bp, Artificial Sequence
  chemically synthesized
tgctgaaaggaggctacatttg

SEQ ID NO: 837672 - DNA, 22 bp, Artificial Sequence
  chemically synthesized
actccaaatgtagcctcctttc

SEQ ID NO: 837673 - DNA, 22 bp, Artificial Sequence
  chemically synthesized
cccaaacctatgctgaaaggag

SEQ ID NO: 837674 - DNA, 22 bp, Artificial Sequence
  chemically synthesized
ccccaaacctatgctgaaagga

SEQ ID NO: 837675 - DNA, 22 bp, Artificial Sequence
  chemically synthesized
caaatgtagcctcctttcagca

SEQ ID NO: 837676 - DNA, 22 bp, Artificial Sequence
  chemically synthesized
tccccaaacctatgctgaaagg

SEQ ID NO: 837677 - DNA, 22 bp, Artificial Sequence
  chemically synthesized
tttccccaaacctatgctgaaa

SEQ ID NO: 837678 - DNA, 22 bp, Artificial Sequence
  chemically synthesized
ctttcagcataggtttggggaa

SEQ ID NO: 837679 - DNA, 22 bp, Artificial Sequence
  chemically synthesized
gatgggtattctttccccaaac

SEQ ID NO: 837680 - DNA, 22 bp, Artificial Sequence
  chemically synthesized
tcagcataggtttggggaaaga

SEQ ID NO: 837681 - DNA, 22 bp, Artificial Sequence
  chemically synthesized
cagcataggtttggggaaagaa

SEQ ID NO: 837682 - DNA, 22 bp, Artificial Sequence
  chemically synthesized
agcataggtttggggaaagaat

SEQ ID NO: 837683 - DNA, 22 bp, Artificial Sequence
  chemically synthesized
aaaataggtgttagatgggtat

SEQ ID NO: 837684 - DNA, 22 bp, Artificial Sequence
  chemically synthesized
taaaaataggtgttagatgggt

SEQ ID NO: 837685 - DNA, 22 bp, Artificial Sequence
  chemically synthesized
ggggaaagaatacccatctaac

SEQ ID NO: 837686 - DNA, 22 bp, Artificial Sequence
  chemically synthesized
gggaaagaatacccatctaaca

SEQ ID NO: 837687 - DNA, 22 bp, Artificial Sequence
  chemically synthesized
attctaaaaataggtgttagat

SEQ ID NO: 837688 - DNA, 22 bp, Artificial Sequence
  chemically synthesized
tgattctaaaaataggtgttag

SEQ ID NO: 837689 - DNA, 22 bp, Artificial Sequence
  chemically synthesized
ctctgattctaaaaataggtgt

SEQ ID NO: 837690 - DNA, 22 bp, Artificial Sequence
  chemically synthesized
atccaactcctctgattctaaa

SEQ ID NO: 837691 - DNA, 22 bp, Artificial Sequence
  chemically synthesized
aatccaactcctctgattctaa

SEQ ID NO: 837692 - DNA, 22 bp, Artificial Sequence
  chemically synthesized
acacctatttttagaatcagag

SEQ ID NO: 837693 - DNA, 22 bp, Artificial Sequence
  chemically synthesized
tttttagaatcagaggagttgg

SEQ ID NO: 837694 - DNA, 22 bp, Artificial Sequence
  chemically synthesized
ttagaatcagaggagttggatt

SEQ ID NO: 837695 - DNA, 22 bp, Artificial Sequence
  chemically synthesized
tagaatcagaggagttggatta

SEQ ID NO: 837696 - DNA, 22 bp, Artificial Sequence
  chemically synthesized
agaatcagaggagttggattaa

SEQ ID NO: 837697 - DNA, 22 bp, Artificial Sequence
  chemically synthesized
gaatcagaggagttggattaaa

SEQ ID NO: 837698 - DNA, 22 bp, Artificial Sequence
  chemically synthesized
gattaaatcctggttccgctat

SEQ ID NO: 837699 - DNA, 22 bp, Artificial Sequence
  chemically synthesized
cataagatcacacagatagcgg

SEQ ID NO: 837700 - DNA, 22 bp, Artificial Sequence
  chemically synthesized
gcataagatcacacagatagcg

SEQ ID NO: 837701 - DNA, 22 bp, Artificial Sequence
  chemically synthesized
aatcctggttccgctatctgtg

SEQ ID NO: 837702 - DNA, 22 bp, Artificial Sequence
  chemically synthesized
tgcataagatcacacagatagc

SEQ ID NO: 837703 - DNA, 22 bp, Artificial Sequence
  chemically synthesized
atattttgcataagatcacaca

SEQ ID NO: 837704 - DNA, 22 bp, Artificial Sequence
  chemically synthesized
gttccgctatctgtgtgatctt

SEQ ID NO: 837705 - DNA, 22 bp, Artificial Sequence
  chemically synthesized
cgctatctgtgtgatcttatgc

SEQ ID NO: 837706 - DNA, 22 bp, Artificial Sequence
  chemically synthesized
tctgtgtgatcttatgcaaaat

SEQ ID NO: 837707 - DNA, 22 bp, Artificial Sequence
  chemically synthesized
tcaaagatattaatattttgca

SEQ ID NO: 837708 - DNA, 22 bp, Artificial Sequence
  chemically synthesized
tgtgatcttatgcaaaatatta

SEQ ID NO: 837709 - DNA, 22 bp, Artificial Sequence
  chemically synthesized
atgcaaaatattaatatctttg

SEQ ID NO: 837710 - DNA, 22 bp, Artificial Sequence
  chemically synthesized
tgcaaaatattaatatctttga

SEQ ID NO: 837711 - DNA, 22 bp, Artificial Sequence
  chemically synthesized
agtaaatgagagaaccaactat

SEQ ID NO: 837712 - DNA, 22 bp, Artificial Sequence
  chemically synthesized
atatctttgatagttggttctc

SEQ ID NO: 837713 - DNA, 22 bp, Artificial Sequence
  chemically synthesized
ttaagtaaatgagagaaccaac

SEQ ID NO: 837714 - DNA, 22 bp, Artificial Sequence
  chemically synthesized
attaagtaaatgagagaaccaa

SEQ ID NO: 837715 - DNA, 22 bp, Artificial Sequence
  chemically synthesized
tccttattaagtaaatgagaga

SEQ ID NO: 837716 - DNA, 22 bp, Artificial Sequence
  chemically synthesized
tgatagttggttctctcattta

SEQ ID NO: 837717 - DNA, 22 bp, Artificial Sequence
  chemically synthesized
gatagttggttctctcatttac

SEQ ID NO: 837718 - DNA, 22 bp, Artificial Sequence
  chemically synthesized
atagttggttctctcatttact

SEQ ID NO: 837719 - DNA, 22 bp, Artificial Sequence
  chemically synthesized
gttctctcatttacttaataag

SEQ ID NO: 837720 - DNA, 22 bp, Artificial Sequence
  chemically synthesized
tggtagatattgtccttattaa

SEQ ID NO: 837721 - DNA, 22 bp, Artificial Sequence
  chemically synthesized
tctcatttacttaataaggaca

SEQ ID NO: 837722 - DNA, 22 bp, Artificial Sequence
  chemically synthesized
tcatttacttaataaggacaat

SEQ ID NO: 837723 - DNA, 22 bp, Artificial Sequence
  chemically synthesized
atttacttaataaggacaatat

SEQ ID NO: 837724 - DNA, 22 bp, Artificial Sequence
  chemically synthesized
acttaataaggacaatatctac

SEQ ID NO: 837725 - DNA, 22 bp, Artificial Sequence
  chemically synthesized
cttaataaggacaatatctacc

SEQ ID NO: 837726 - DNA, 22 bp, Artificial Sequence
  chemically synthesized
acaacagtccctatggtagata

SEQ ID NO: 837727 - DNA, 22 bp, Artificial Sequence
  chemically synthesized
aataaggacaatatctaccata

SEQ ID NO: 837728 - DNA, 22 bp, Artificial Sequence
  chemically synthesized
cacaacagtccctatggtagat

SEQ ID NO: 837729 - DNA, 22 bp, Artificial Sequence
  chemically synthesized
ataaggacaatatctaccatag

SEQ ID NO: 837730 - DNA, 22 bp, Artificial Sequence
  chemically synthesized
tcacaacagtccctatggtaga

SEQ ID NO: 837731 - DNA, 22 bp, Artificial Sequence
  chemically synthesized
ttttcacaacagtccctatggt

SEQ ID NO: 837732 - DNA, 22 bp, Artificial Sequence
  chemically synthesized
attttcacaacagtccctatgg

SEQ ID NO: 837733 - DNA, 22 bp, Artificial Sequence
  chemically synthesized
tattttcacaacagtccctatg

SEQ ID NO: 837734 - DNA, 22 bp, Artificial Sequence
  chemically synthesized
ccatagggactgttgtgaaaat

SEQ ID NO: 837735 - DNA, 22 bp, Artificial Sequence
  chemically synthesized
tacatatataagtggattttat

SEQ ID NO: 837736 - DNA, 22 bp, Artificial Sequence
  chemically synthesized
atacatatataagtggatttta

SEQ ID NO: 837737 - DNA, 22 bp, Artificial Sequence
  chemically synthesized
ttatacatatataagtggattt

SEQ ID NO: 837738 - DNA, 22 bp, Artificial Sequence
  chemically synthesized
ttgtgaaaataaaatccactta

SEQ ID NO: 837739 - DNA, 22 bp, Artificial Sequence
  chemically synthesized
tgaaaataaaatccacttatat

SEQ ID NO: 837740 - DNA, 22 bp, Artificial Sequence
  chemically synthesized
gatgaggaactcttatacatat

SEQ ID NO: 837741 - DNA, 22 bp, Artificial Sequence
  chemically synthesized
tacgaattggatgaggaactct

SEQ ID NO: 837742 - DNA, 22 bp, Artificial Sequence
  chemically synthesized
atatatgtataagagttcctca

SEQ ID NO: 837743 - DNA, 22 bp, Artificial Sequence
  chemically synthesized
atacgaattggatgaggaactc

SEQ ID NO: 837744 - DNA, 22 bp, Artificial Sequence
  chemically synthesized
tatatgtataagagttcctcat

SEQ ID NO: 837745 - DNA, 22 bp, Artificial Sequence
  chemically synthesized
tatacgaattggatgaggaact

SEQ ID NO: 837746 - DNA, 22 bp, Artificial Sequence
  chemically synthesized
tgctttatacgaattggatgag

SEQ ID NO: 837747 - DNA, 22 bp, Artificial Sequence
  chemically synthesized
tgctgtgctttatacgaattgg

SEQ ID NO: 837748 - DNA, 22 bp, Artificial Sequence
  chemically synthesized
gtgctgtgctttatacgaattg

SEQ ID NO: 837749 - DNA, 22 bp, Artificial Sequence
  chemically synthesized
gatttgtgctgtgctttatacg

SEQ ID NO: 837750 - DNA, 22 bp, Artificial Sequence
  chemically synthesized
ctcatccaattcgtataaagca

SEQ ID NO: 837751 - DNA, 22 bp, Artificial Sequence
  chemically synthesized
agatttgtgctgtgctttatac

SEQ ID NO: 837752 - DNA, 22 bp, Artificial Sequence
  chemically synthesized
tagatttgtgctgtgctttata

SEQ ID NO: 837753 - DNA, 22 bp, Artificial Sequence
  chemically synthesized
atccaattcgtataaagcacag

SEQ ID NO: 837754 - DNA, 22 bp, Artificial Sequence
  chemically synthesized
gtataaagcacagcacaaatct

SEQ ID NO: 837755 - DNA, 22 bp, Artificial Sequence
  chemically synthesized
ataaaagagtaatactttagat

SEQ ID NO: 837756 - DNA, 22 bp, Artificial Sequence
  chemically synthesized
aagtatctcataaaagagtaat

SEQ ID NO: 837757 - DNA, 22 bp, Artificial Sequence
  chemically synthesized
aaagtatctcataaaagagtaa

SEQ ID NO: 837758 - DNA, 22 bp, Artificial Sequence
  chemically synthesized
taaagtatctcataaaagagta

SEQ ID NO: 837759 - DNA, 22 bp, Artificial Sequence
  chemically synthesized
aagtattactcttttatgagat

SEQ ID NO: 837760 - DNA, 22 bp, Artificial Sequence
  chemically synthesized
agattttaaagtatctcataaa

SEQ ID NO: 837761 - DNA, 22 bp, Artificial Sequence
  chemically synthesized
ttcagattttaaagtatctcat

SEQ ID NO: 837762 - DNA, 22 bp, Artificial Sequence
  chemically synthesized
attcagattttaaagtatctca

SEQ ID NO: 837763 - DNA, 22 bp, Artificial Sequence
  chemically synthesized
tattcagattttaaagtatctc

SEQ ID NO: 837764 - DNA, 22 bp, Artificial Sequence
  chemically synthesized
ctcttttatgagatactttaaa

SEQ ID NO: 837765 - DNA, 22 bp, Artificial Sequence
  chemically synthesized
actttattcagattttaaagta

SEQ ID NO: 837766 - DNA, 22 bp, Artificial Sequence
  chemically synthesized
ttttatgagatactttaaaatc

SEQ ID NO: 837767 - DNA, 22 bp, Artificial Sequence
  chemically synthesized
ttatgagatactttaaaatctg

SEQ ID NO: 837768 - DNA, 22 bp, Artificial Sequence
  chemically synthesized
tatgagatactttaaaatctga

SEQ ID NO: 837769 - DNA, 22 bp, Artificial Sequence
  chemically synthesized
atgagatactttaaaatctgaa

SEQ ID NO: 837770 - DNA, 22 bp, Artificial Sequence
  chemically synthesized
tgagatactttaaaatctgaat

SEQ ID NO: 837771 - DNA, 22 bp, Artificial Sequence
  chemically synthesized
taaaatctgaataaagttagat

SEQ ID NO: 837772 - DNA, 22 bp, Artificial Sequence
  chemically synthesized
aaaatctgaataaagttagatt

SEQ ID NO: 837773 - DNA, 22 bp, Artificial Sequence
  chemically synthesized
tgggacaaataaaatctaactt

SEQ ID NO: 837774 - DNA, 22 bp, Artificial Sequence
  chemically synthesized
aaatctgaataaagttagattt

SEQ ID NO: 837775 - DNA, 22 bp, Artificial Sequence
  chemically synthesized
atgggacaaataaaatctaact

SEQ ID NO: 837776 - DNA, 22 bp, Artificial Sequence
  chemically synthesized
tatgggacaaataaaatctaac

SEQ ID NO: 837777 - DNA, 22 bp, Artificial Sequence
  chemically synthesized
tttatgggacaaataaaatcta

SEQ ID NO: 837778 - DNA, 22 bp, Artificial Sequence
  chemically synthesized
ctttatgggacaaataaaatct

SEQ ID NO: 837779 - DNA, 22 bp, Artificial Sequence
  chemically synthesized
aataaagttagattttatttgt

SEQ ID NO: 837780 - DNA, 22 bp, Artificial Sequence
  chemically synthesized
acttctttatgggacaaataaa

SEQ ID NO: 837781 - DNA, 22 bp, Artificial Sequence
  chemically synthesized
cacttctttatgggacaaataa

SEQ ID NO: 837782 - DNA, 22 bp, Artificial Sequence
  chemically synthesized
tcacttctttatgggacaaata

SEQ ID NO: 837783 - DNA, 22 bp, Artificial Sequence
  chemically synthesized
gattttatttgtcccataaaga

SEQ ID NO: 837784 - DNA, 22 bp, Artificial Sequence
  chemically synthesized
tcaaaattttcacttctttatg

SEQ ID NO: 837785 - DNA, 22 bp, Artificial Sequence
  chemically synthesized
tatttgtcccataaagaagtga

SEQ ID NO: 837786 - DNA, 22 bp, Artificial Sequence
  chemically synthesized
atttgtcccataaagaagtgaa

SEQ ID NO: 837787 - DNA, 22 bp, Artificial Sequence
  chemically synthesized
tttgtcccataaagaagtgaaa

SEQ ID NO: 837788 - DNA, 22 bp, Artificial Sequence
  chemically synthesized
aaactgtcaaaattttcacttc

SEQ ID NO: 837789 - DNA, 22 bp, Artificial Sequence
  chemically synthesized
gaaactgtcaaaattttcactt

SEQ ID NO: 837790 - DNA, 22 bp, Artificial Sequence
  chemically synthesized
gtcccataaagaagtgaaaatt

SEQ ID NO: 837791 - DNA, 22 bp, Artificial Sequence
  chemically synthesized
tcccataaagaagtgaaaattt

SEQ ID NO: 837792 - DNA, 22 bp, Artificial Sequence
  chemically synthesized
agacaatttgaaactgtcaaaa

SEQ ID NO: 837793 - DNA, 22 bp, Artificial Sequence
  chemically synthesized
cagacaatttgaaactgtcaaa

SEQ ID NO: 837794 - DNA, 22 bp, Artificial Sequence
  chemically synthesized
tgacagtttcaaattgtctgaa

SEQ ID NO: 837795 - DNA, 22 bp, Artificial Sequence
  chemically synthesized
gacagtttcaaattgtctgaaa

SEQ ID NO: 837796 - DNA, 22 bp, Artificial Sequence
  chemically synthesized
acagtttcaaattgtctgaaat

SEQ ID NO: 837797 - DNA, 22 bp, Artificial Sequence
  chemically synthesized
cagaatatgaaacatttcagac

SEQ ID NO: 837798 - DNA, 22 bp, Artificial Sequence
  chemically synthesized
caaattgtctgaaatgtttcat

SEQ ID NO: 837799 - DNA, 22 bp, Artificial Sequence
  chemically synthesized
aaattgtctgaaatgtttcata

SEQ ID NO: 837800 - DNA, 22 bp, Artificial Sequence
  chemically synthesized
cagggaactccagaatatgaaa

SEQ ID NO: 837801 - DNA, 22 bp, Artificial Sequence
  chemically synthesized
tctgaaatgtttcatattctgg

SEQ ID NO: 837802 - DNA, 22 bp, Artificial Sequence
  chemically synthesized
aaatgtttcatattctggagtt

SEQ ID NO: 837803 - DNA, 22 bp, Artificial Sequence
  chemically synthesized
aaaacatgttccagggaactcc

SEQ ID NO: 837804 - DNA, 22 bp, Artificial Sequence
  chemically synthesized
catattctggagttccctggaa

SEQ ID NO: 837805 - DNA, 22 bp, Artificial Sequence
  chemically synthesized
atattctggagttccctggaac

SEQ ID NO: 837806 - DNA, 22 bp, Artificial Sequence
  chemically synthesized
gtaactaaaaacatgttccagg

SEQ ID NO: 837807 - DNA, 22 bp, Artificial Sequence
  chemically synthesized
ggtaactaaaaacatgttccag

SEQ ID NO: 837808 - DNA, 22 bp, Artificial Sequence
  chemically synthesized
tggtaactaaaaacatgttcca

SEQ ID NO: 837809 - DNA, 22 bp, Artificial Sequence
  chemically synthesized
tggagttccctggaacatgttt

SEQ ID NO: 837810 - DNA, 22 bp, Artificial Sequence
  chemically synthesized
gagttccctggaacatgttttt

SEQ ID NO: 837811 - DNA, 22 bp, Artificial Sequence
  chemically synthesized
gtattttggtaactaaaaacat

SEQ ID NO: 837812 - DNA, 22 bp, Artificial Sequence
  chemically synthesized
ggtattttggtaactaaaaaca

SEQ ID NO: 837813 - DNA, 22 bp, Artificial Sequence
  chemically synthesized
cctggaacatgtttttagttac

SEQ ID NO: 837814 - DNA, 22 bp, Artificial Sequence
  chemically synthesized
gaacatgtttttagttaccaaa

SEQ ID NO: 837815 - DNA, 22 bp, Artificial Sequence
  chemically synthesized
agtagcttggtattttggtaac

SEQ ID NO: 837816 - DNA, 22 bp, Artificial Sequence
  chemically synthesized
cagtagcttggtattttggtaa

SEQ ID NO: 837817 - DNA, 22 bp, Artificial Sequence
  chemically synthesized
ccttcagtagcttggtattttg

SEQ ID NO: 837818 - DNA, 22 bp, Artificial Sequence
  chemically synthesized
cccttcagtagcttggtatttt

SEQ ID NO: 837819 - DNA, 22 bp, Artificial Sequence
  chemically synthesized
ttagttaccaaaataccaagct

SEQ ID NO: 837820 - DNA, 22 bp, Artificial Sequence
  chemically synthesized
tagttaccaaaataccaagcta

SEQ ID NO: 837821 - DNA, 22 bp, Artificial Sequence
  chemically synthesized
agttaccaaaataccaagctac

SEQ ID NO: 837822 - DNA, 22 bp, Artificial Sequence
  chemically synthesized
gttaccaaaataccaagctact

SEQ ID NO: 837823 - DNA, 22 bp, Artificial Sequence
  chemically synthesized
ccaaaataccaagctactgaag

SEQ ID NO: 837824 - DNA, 22 bp, Artificial Sequence
  chemically synthesized
ctgaagggaaacgtgggcattt

SEQ ID NO: 837825 - DNA, 22 bp, Artificial Sequence
  chemically synthesized
gcagggcaaccaaaatgcccac

SEQ ID NO: 837826 - DNA, 22 bp, Artificial Sequence
  chemically synthesized
aagggaaacgtgggcattttgg

SEQ ID NO: 837827 - DNA, 22 bp, Artificial Sequence
  chemically synthesized
atgtctggcagggcaaccaaaa

SEQ ID NO: 837828 - DNA, 22 bp, Artificial Sequence
  chemically synthesized
aatgtctggcagggcaaccaaa

SEQ ID NO: 837829 - DNA, 22 bp, Artificial Sequence
  chemically synthesized
ttaatgtctggcagggcaacca

SEQ ID NO: 837830 - DNA, 22 bp, Artificial Sequence
  chemically synthesized
cttaatgtctggcagggcaacc

SEQ ID NO: 837831 - DNA, 22 bp, Artificial Sequence
  chemically synthesized
tcttaatgtctggcagggcaac

SEQ ID NO: 837832 - DNA, 22 bp, Artificial Sequence
  chemically synthesized
ttcttaatgtctggcagggcaa

SEQ ID NO: 837833 - DNA, 22 bp, Artificial Sequence
  chemically synthesized
tttcttaatgtctggcagggca

SEQ ID NO: 837834 - DNA, 22 bp, Artificial Sequence
  chemically synthesized
ttttcttaatgtctggcagggc

SEQ ID NO: 837835 - DNA, 22 bp, Artificial Sequence
  chemically synthesized
atttttttcttaatgtctggca

SEQ ID NO: 837836 - DNA, 22 bp, Artificial Sequence
  chemically synthesized
tggttgccctgccagacattaa

SEQ ID NO: 837837 - DNA, 22 bp, Artificial Sequence
  chemically synthesized
ggttgccctgccagacattaag

SEQ ID NO: 837838 - DNA, 22 bp, Artificial Sequence
  chemically synthesized
gttgccctgccagacattaaga

SEQ ID NO: 837839 - DNA, 22 bp, Artificial Sequence
  chemically synthesized
ccctgccagacattaagaaaaa

SEQ ID NO: 837840 - DNA, 22 bp, Artificial Sequence
  chemically synthesized
ccagacattaagaaaaaaatga

SEQ ID NO: 837841 - DNA, 22 bp, Artificial Sequence
  chemically synthesized
agaaaaaaatgaatcccattct

SEQ ID NO: 837842 - DNA, 22 bp, Artificial Sequence
  chemically synthesized
agagacatagcaataaatagaa

SEQ ID NO: 837843 - DNA, 22 bp, Artificial Sequence
  chemically synthesized
aagagacatagcaataaataga

SEQ ID NO: 837844 - DNA, 22 bp, Artificial Sequence
  chemically synthesized
taagagacatagcaataaatag

SEQ ID NO: 837845 - DNA, 22 bp, Artificial Sequence
  chemically synthesized
tatttattgctatgtctcttaa

SEQ ID NO: 837846 - DNA, 22 bp, Artificial Sequence
  chemically synthesized
tttattgctatgtctcttaaag

SEQ ID NO: 837847 - DNA, 22 bp, Artificial Sequence
  chemically synthesized
attgctatgtctcttaaagtac

SEQ ID NO: 837848 - DNA, 22 bp, Artificial Sequence
  chemically synthesized
ttgctatgtctcttaaagtacg

SEQ ID NO: 837849 - DNA, 22 bp, Artificial Sequence
  chemically synthesized
ggtaccatgccaaacgtacttt

SEQ ID NO: 837850 - DNA, 22 bp, Artificial Sequence
  chemically synthesized
ctatgtctcttaaagtacgttt

SEQ ID NO: 837851 - DNA, 22 bp, Artificial Sequence
  chemically synthesized
tgtctcttaaagtacgtttggc

SEQ ID NO: 837852 - DNA, 22 bp, Artificial Sequence
  chemically synthesized
aatgttgggtaccatgccaaac

SEQ ID NO: 837853 - DNA, 22 bp, Artificial Sequence
  chemically synthesized
tcaatgttgggtaccatgccaa

SEQ ID NO: 837854 - DNA, 22 bp, Artificial Sequence
  chemically synthesized
ttaaagtacgtttggcatggta

SEQ ID NO: 837855 - DNA, 22 bp, Artificial Sequence
  chemically synthesized
aaagtacgtttggcatggtacc

SEQ ID NO: 837856 - DNA, 22 bp, Artificial Sequence
  chemically synthesized
aagtacgtttggcatggtaccc

SEQ ID NO: 837857 - DNA, 22 bp, Artificial Sequence
  chemically synthesized
tgtgtctctcaatgttgggtac

SEQ ID NO: 837858 - DNA, 22 bp, Artificial Sequence
  chemically synthesized
ggcatggtacccaacattgaga

SEQ ID NO: 837859 - DNA, 22 bp, Artificial Sequence
  chemically synthesized
gcatggtacccaacattgagag

SEQ ID NO: 837860 - DNA, 22 bp, Artificial Sequence
  chemically synthesized
ggacagcaggttatgtgtctct

SEQ ID NO: 837861 - DNA, 22 bp, Artificial Sequence
  chemically synthesized
aggacagcaggttatgtgtctc

SEQ ID NO: 837862 - DNA, 22 bp, Artificial Sequence
  chemically synthesized
taggacagcaggttatgtgtct

SEQ ID NO: 837863 - DNA, 22 bp, Artificial Sequence
  chemically synthesized
agagttttaggacagcaggtta

SEQ ID NO: 837864 - DNA, 22 bp, Artificial Sequence
  chemically synthesized
agagacacataacctgctgtcc

SEQ ID NO: 837865 - DNA, 22 bp, Artificial Sequence
  chemically synthesized
ctcagagttttaggacagcagg

SEQ ID NO: 837866 - DNA, 22 bp, Artificial Sequence
  chemically synthesized
taaattgctcagagttttagga

SEQ ID NO: 837867 - DNA, 22 bp, Artificial Sequence
  chemically synthesized
gtaaattgctcagagttttagg

SEQ ID NO: 837868 - DNA, 22 bp, Artificial Sequence
  chemically synthesized
ctgtcctaaaactctgagcaat

SEQ ID NO: 837869 - DNA, 22 bp, Artificial Sequence
  chemically synthesized
caagaatttgtaaattgctcag

SEQ ID NO: 837870 - DNA, 22 bp, Artificial Sequence
  chemically synthesized
tcctaaaactctgagcaattta

SEQ ID NO: 837871 - DNA, 22 bp, Artificial Sequence
  chemically synthesized
tgattacaagaatttgtaaatt

SEQ ID NO: 837872 - DNA, 22 bp, Artificial Sequence
  chemically synthesized
aaactctgagcaatttacaaat

SEQ ID NO: 837873 - DNA, 22 bp, Artificial Sequence
  chemically synthesized
tatgattacaagaatttgtaaa

SEQ ID NO: 837874 - DNA, 22 bp, Artificial Sequence
  chemically synthesized
ctatgattacaagaatttgtaa

SEQ ID NO: 837875 - DNA, 22 bp, Artificial Sequence
  chemically synthesized
tctatgattacaagaatttgta

SEQ ID NO: 837876 - DNA, 22 bp, Artificial Sequence
  chemically synthesized
tttctatgattacaagaatttg

SEQ ID NO: 837877 - DNA, 22 bp, Artificial Sequence
  chemically synthesized
tgagcaatttacaaattcttgt

SEQ ID NO: 837878 - DNA, 22 bp, Artificial Sequence
  chemically synthesized
agcaatttacaaattcttgtaa

SEQ ID NO: 837879 - DNA, 22 bp, Artificial Sequence
  chemically synthesized
acaaattcttgtaatcatagaa

SEQ ID NO: 837880 - DNA, 22 bp, Artificial Sequence
  chemically synthesized
caaattcttgtaatcatagaaa

SEQ ID NO: 837881 - DNA, 22 bp, Artificial Sequence
  chemically synthesized
ttgtaatcatagaaagaattcc

SEQ ID NO: 837882 - DNA, 22 bp, Artificial Sequence
  chemically synthesized
ggatgtaaaatggggaattctt

SEQ ID NO: 837883 - DNA, 22 bp, Artificial Sequence
  chemically synthesized
gtaatcatagaaagaattcccc

SEQ ID NO: 837884 - DNA, 22 bp, Artificial Sequence
  chemically synthesized
gggatgtaaaatggggaattct

SEQ ID NO: 837885 - DNA, 22 bp, Artificial Sequence
  chemically synthesized
taatcatagaaagaattcccca

SEQ ID NO: 837886 - DNA, 22 bp, Artificial Sequence
  chemically synthesized
tgggatgtaaaatggggaattc

SEQ ID NO: 837887 - DNA, 22 bp, Artificial Sequence
  chemically synthesized
ttgggatgtaaaatggggaatt

SEQ ID NO: 837888 - DNA, 22 bp, Artificial Sequence
  chemically synthesized
cccattttacatcccaaaagga

SEQ ID NO: 837889 - DNA, 22 bp, Artificial Sequence
  chemically synthesized
agaggagaaggcacagtccttt

SEQ ID NO: 837890 - DNA, 22 bp, Artificial Sequence
  chemically synthesized
tacatcccaaaaggactgtgcc

SEQ ID NO: 837891 - DNA, 22 bp, Artificial Sequence
  chemically synthesized
acatcccaaaaggactgtgcct

SEQ ID NO: 837892 - DNA, 22 bp, Artificial Sequence
  chemically synthesized
catcccaaaaggactgtgcctt

SEQ ID NO: 837893 - DNA, 22 bp, Artificial Sequence
  chemically synthesized
taggagccactaagaggagaag

SEQ ID NO: 837894 - DNA, 22 bp, Artificial Sequence
  chemically synthesized
gtaggagccactaagaggagaa

SEQ ID NO: 837895 - DNA, 22 bp, Artificial Sequence
  chemically synthesized
atcccttgtaggagccactaag

SEQ ID NO: 837896 - DNA, 22 bp, Artificial Sequence
  chemically synthesized
tgccttctcctcttagtggctc

SEQ ID NO: 837897 - DNA, 22 bp, Artificial Sequence
  chemically synthesized
gtctaatcccttgtaggagcca

SEQ ID NO: 837898 - DNA, 22 bp, Artificial Sequence
  chemically synthesized
agtctaatcccttgtaggagcc

SEQ ID NO: 837899 - DNA, 22 bp, Artificial Sequence
  chemically synthesized
ctcctcttagtggctcctacaa

SEQ ID NO: 837900 - DNA, 22 bp, Artificial Sequence
  chemically synthesized
tcctcttagtggctcctacaag

SEQ ID NO: 837901 - DNA, 22 bp, Artificial Sequence
  chemically synthesized
ctcttagtggctcctacaaggg

SEQ ID NO: 837902 - DNA, 22 bp, Artificial Sequence
  chemically synthesized
gtttagtctaatcccttgtagg

SEQ ID NO: 837903 - DNA, 22 bp, Artificial Sequence
  chemically synthesized
ggtttagtctaatcccttgtag

SEQ ID NO: 837904 - DNA, 22 bp, Artificial Sequence
  chemically synthesized
ttagtggctcctacaagggatt

SEQ ID NO: 837905 - DNA, 22 bp, Artificial Sequence
  chemically synthesized
agtggctcctacaagggattag

SEQ ID NO: 837906 - DNA, 22 bp, Artificial Sequence
  chemically synthesized
gtggctcctacaagggattaga

SEQ ID NO: 837907 - DNA, 22 bp, Artificial Sequence
  chemically synthesized
atgaaggatttggtttagtcta

SEQ ID NO: 837908 - DNA, 22 bp, Artificial Sequence
  chemically synthesized
ctacaagggattagactaaacc

SEQ ID NO: 837909 - DNA, 22 bp, Artificial Sequence
  chemically synthesized
ctcatgaaggatttggtttagt

SEQ ID NO: 837910 - DNA, 22 bp, Artificial Sequence
  chemically synthesized
caagggattagactaaaccaaa

SEQ ID NO: 837911 - DNA, 22 bp, Artificial Sequence
  chemically synthesized
ttcctcatgaaggatttggttt

SEQ ID NO: 837912 - DNA, 22 bp, Artificial Sequence
  chemically synthesized
cctgttcctcatgaaggatttg

SEQ ID NO: 837913 - DNA, 22 bp, Artificial Sequence
  chemically synthesized
acctgttcctcatgaaggattt

SEQ ID NO: 837914 - DNA, 22 bp, Artificial Sequence
  chemically synthesized
tacctgttcctcatgaaggatt

SEQ ID NO: 837915 - DNA, 22 bp, Artificial Sequence
  chemically synthesized
gactaaaccaaatccttcatga

SEQ ID NO: 837916 - DNA, 22 bp, Artificial Sequence
  chemically synthesized
aaccaaatccttcatgaggaac

SEQ ID NO: 837917 - DNA, 22 bp, Artificial Sequence
  chemically synthesized
aagcaatggcactttacctgtt

SEQ ID NO: 837918 - DNA, 22 bp, Artificial Sequence
  chemically synthesized
aaagcaatggcactttacctgt

SEQ ID NO: 837919 - DNA, 22 bp, Artificial Sequence
  chemically synthesized
taaagcaatggcactttacctg

SEQ ID NO: 837920 - DNA, 22 bp, Artificial Sequence
  chemically synthesized
catgaggaacaggtaaagtgcc

SEQ ID NO: 837921 - DNA, 22 bp, Artificial Sequence
  chemically synthesized
atgaggaacaggtaaagtgcca

SEQ ID NO: 837922 - DNA, 22 bp, Artificial Sequence
  chemically synthesized
gcattttaaagcaatggcactt

SEQ ID NO: 837923 - DNA, 22 bp, Artificial Sequence
  chemically synthesized
acgttggcattttaaagcaatg

SEQ ID NO: 837924 - DNA, 22 bp, Artificial Sequence
  chemically synthesized
ctttaaaatgccaacgtgagcc

SEQ ID NO: 837925 - DNA, 22 bp, Artificial Sequence
  chemically synthesized
taaaatgccaacgtgagcctat

SEQ ID NO: 837926 - DNA, 22 bp, Artificial Sequence
  chemically synthesized
aaaatgccaacgtgagcctata

SEQ ID NO: 837927 - DNA, 22 bp, Artificial Sequence
  chemically synthesized
aaatgccaacgtgagcctatat

SEQ ID NO: 837928 - DNA, 22 bp, Artificial Sequence
  chemically synthesized
tatattcctgtgctgttcatat

SEQ ID NO: 837929 - DNA, 22 bp, Artificial Sequence
  chemically synthesized
tgcagaacgataaggtaatatg

SEQ ID NO: 837930 - DNA, 22 bp, Artificial Sequence
  chemically synthesized
ctgtgctgttcatattacctta

SEQ ID NO: 837931 - DNA, 22 bp, Artificial Sequence
  chemically synthesized
tgctgttcatattaccttatcg

SEQ ID NO: 837932 - DNA, 22 bp, Artificial Sequence
  chemically synthesized
ttcatattaccttatcgttctg

SEQ ID NO: 837933 - DNA, 22 bp, Artificial Sequence
  chemically synthesized
atattaccttatcgttctgcac

SEQ ID NO: 837934 - DNA, 22 bp, Artificial Sequence
  chemically synthesized
ccttatcgttctgcacaattac

SEQ ID NO: 837935 - DNA, 22 bp, Artificial Sequence
  chemically synthesized
atcgttctgcacaattacactt

SEQ ID NO: 837936 - DNA, 22 bp, Artificial Sequence
  chemically synthesized
tcgttctgcacaattacacttg

SEQ ID NO: 837937 - DNA, 22 bp, Artificial Sequence
  chemically synthesized
aaaatgtgaacatcaagtgtaa

SEQ ID NO: 837938 - DNA, 22 bp, Artificial Sequence
  chemically synthesized
tgcacaattacacttgatgttc

SEQ ID NO: 837939 - DNA, 22 bp, Artificial Sequence
  chemically synthesized
cacaattacacttgatgttcac

SEQ ID NO: 837940 - DNA, 22 bp, Artificial Sequence
  chemically synthesized
cacttgatgttcacattttcag

SEQ ID NO: 837941 - DNA, 22 bp, Artificial Sequence
  chemically synthesized
gatgttcacattttcaggttga

SEQ ID NO: 837942 - DNA, 22 bp, Artificial Sequence
  chemically synthesized
atgttcacattttcaggttgac

SEQ ID NO: 837943 - DNA, 22 bp, Artificial Sequence
  chemically synthesized
acattttcaggttgactgggtt

SEQ ID NO: 837944 - DNA, 22 bp, Artificial Sequence
  chemically synthesized
tcaggttgactgggttttatca

SEQ ID NO: 837945 - DNA, 22 bp, Artificial Sequence
  chemically synthesized
caggttgactgggttttatcac

SEQ ID NO: 837946 - DNA, 22 bp, Artificial Sequence
  chemically synthesized
aggttgactgggttttatcact

SEQ ID NO: 837947 - DNA, 22 bp, Artificial Sequence
  chemically synthesized
actgggttttatcacttcatgg

SEQ ID NO: 837948 - DNA, 22 bp, Artificial Sequence
  chemically synthesized
aacagaaaagtgtgccatgaag

SEQ ID NO: 837949 - DNA, 22 bp, Artificial Sequence
  chemically synthesized
ggttttatcacttcatggcaca

SEQ ID NO: 837950 - DNA, 22 bp, Artificial Sequence
  chemically synthesized
taattaaacagaaaagtgtgcc

SEQ ID NO: 837951 - DNA, 22 bp, Artificial Sequence
  chemically synthesized
tatcacttcatggcacactttt

SEQ ID NO: 837952 - DNA, 22 bp, Artificial Sequence
  chemically synthesized
atcacttcatggcacacttttc

SEQ ID NO: 837953 - DNA, 22 bp, Artificial Sequence
  chemically synthesized
tgtaattaaacagaaaagtgtg

SEQ ID NO: 837954 - DNA, 22 bp, Artificial Sequence
  chemically synthesized
tcacttcatggcacacttttct

SEQ ID NO: 837955 - DNA, 22 bp, Artificial Sequence
  chemically synthesized
tctgtaattaaacagaaaagtg

SEQ ID NO: 837956 - DNA, 22 bp, Artificial Sequence
  chemically synthesized
ctctgtaattaaacagaaaagt

SEQ ID NO: 837957 - DNA, 22 bp, Artificial Sequence
  chemically synthesized
tctctgtaattaaacagaaaag

SEQ ID NO: 837958 - DNA, 22 bp, Artificial Sequence
  chemically synthesized
catggcacacttttctgtttaa

SEQ ID NO: 837959 - DNA, 22 bp, Artificial Sequence
  chemically synthesized
atggcacacttttctgtttaat

SEQ ID NO: 837960 - DNA, 22 bp, Artificial Sequence
  chemically synthesized
ttctgtttaattacagagaaag

SEQ ID NO: 837961 - DNA, 22 bp, Artificial Sequence
  chemically synthesized
tctgtttaattacagagaaagg

SEQ ID NO: 837962 - DNA, 22 bp, Artificial Sequence
  chemically synthesized
ctgtttaattacagagaaaggt

SEQ ID NO: 837963 - DNA, 22 bp, Artificial Sequence
  chemically synthesized
tgtttaattacagagaaaggtg

SEQ ID NO: 837964 - DNA, 22 bp, Artificial Sequence
  chemically synthesized
tttaattacagagaaaggtgtt

SEQ ID NO: 837965 - DNA, 22 bp, Artificial Sequence
  chemically synthesized
aattacagagaaaggtgttttc

SEQ ID NO: 837966 - DNA, 22 bp, Artificial Sequence
  chemically synthesized
attacagagaaaggtgttttcc

SEQ ID NO: 837967 - DNA, 22 bp, Artificial Sequence
  chemically synthesized
cagagaaaggtgttttcccctc

SEQ ID NO: 837968 - DNA, 22 bp, Artificial Sequence
  chemically synthesized
aaatgcacagaataagaatgag

SEQ ID NO: 837969 - DNA, 22 bp, Artificial Sequence
  chemically synthesized
tcccctcattcttattctgtgc

SEQ ID NO: 837970 - DNA, 22 bp, Artificial Sequence
  chemically synthesized
cccctcattcttattctgtgca

SEQ ID NO: 837971 - DNA, 22 bp, Artificial Sequence
  chemically synthesized
ccctcattcttattctgtgcat

SEQ ID NO: 837972 - DNA, 22 bp, Artificial Sequence
  chemically synthesized
attcttattctgtgcatttgag

SEQ ID NO: 837973 - DNA, 22 bp, Artificial Sequence
  chemically synthesized
ttattctgtgcatttgagactt

SEQ ID NO: 837974 - DNA, 22 bp, Artificial Sequence
  chemically synthesized
aaaagataaaatcaagtctcaa

SEQ ID NO: 837975 - DNA, 22 bp, Artificial Sequence
  chemically synthesized
attctgtgcatttgagacttga

SEQ ID NO: 837976 - DNA, 22 bp, Artificial Sequence
  chemically synthesized
gaaaagataaaatcaagtctca

SEQ ID NO: 837977 - DNA, 22 bp, Artificial Sequence
  chemically synthesized
ttctgtgcatttgagacttgat

SEQ ID NO: 837978 - DNA, 22 bp, Artificial Sequence
  chemically synthesized
tgtgcatttgagacttgatttt

SEQ ID NO: 837979 - DNA, 22 bp, Artificial Sequence
  chemically synthesized
tgcatttgagacttgattttat

SEQ ID NO: 837980 - DNA, 22 bp, Artificial Sequence
  chemically synthesized
gagacttgattttatcttttca

SEQ ID NO: 837981 - DNA, 22 bp, Artificial Sequence
  chemically synthesized
agacttgattttatcttttcaa

SEQ ID NO: 837982 - DNA, 22 bp, Artificial Sequence
  chemically synthesized
aaacaacagaatgtttgaaaag

SEQ ID NO: 837983 - DNA, 22 bp, Artificial Sequence
  chemically synthesized
ttcaaacaacagaatgtttgaa

SEQ ID NO: 837984 - DNA, 22 bp, Artificial Sequence
  chemically synthesized
gattttatcttttcaaacattc

SEQ ID NO: 837985 - DNA, 22 bp, Artificial Sequence
  chemically synthesized
attttatcttttcaaacattct

SEQ ID NO: 837986 - DNA, 22 bp, Artificial Sequence
  chemically synthesized
tctgttcaaacaacagaatgtt

SEQ ID NO: 837987 - DNA, 22 bp, Artificial Sequence
  chemically synthesized
tatcttttcaaacattctgttg

SEQ ID NO: 837988 - DNA, 22 bp, Artificial Sequence
  chemically synthesized
atcttttcaaacattctgttgt

SEQ ID NO: 837989 - DNA, 22 bp, Artificial Sequence
  chemically synthesized
tcttttcaaacattctgttgtt

SEQ ID NO: 837990 - DNA, 22 bp, Artificial Sequence
  chemically synthesized
ttcaaacattctgttgtttgaa

SEQ ID NO: 837991 - DNA, 22 bp, Artificial Sequence
  chemically synthesized
tcaaacattctgttgtttgaac

SEQ ID NO: 837992 - DNA, 22 bp, Artificial Sequence
  chemically synthesized
caaacattctgttgtttgaaca

SEQ ID NO: 837993 - DNA, 22 bp, Artificial Sequence
  chemically synthesized
aaacattctgttgtttgaacag

SEQ ID NO: 837994 - DNA, 22 bp, Artificial Sequence
  chemically synthesized
tcagaaaattgtctgttcaaac

SEQ ID NO: 837995 - DNA, 22 bp, Artificial Sequence
  chemically synthesized
ttatcagaaaattgtctgttca

SEQ ID NO: 837996 - DNA, 22 bp, Artificial Sequence
  chemically synthesized
gttatcagaaaattgtctgttc

SEQ ID NO: 837997 - DNA, 22 bp, Artificial Sequence
  chemically synthesized
tgttgtttgaacagacaatttt

SEQ ID NO: 837998 - DNA, 22 bp, Artificial Sequence
  chemically synthesized
acttgttatcagaaaattgtct

SEQ ID NO: 837999 - DNA, 22 bp, Artificial Sequence
  chemically synthesized
ttgtttgaacagacaattttct

SEQ ID NO: 838000 - DNA, 22 bp, Artificial Sequence
  chemically synthesized
attcacttgttatcagaaaatt

SEQ ID NO: 838001 - DNA, 22 bp, Artificial Sequence
  chemically synthesized
tttgaacagacaattttctgat

SEQ ID NO: 838002 - DNA, 22 bp, Artificial Sequence
  chemically synthesized
gattcacttgttatcagaaaat

SEQ ID NO: 838003 - DNA, 22 bp, Artificial Sequence
  chemically synthesized
gaacagacaattttctgataac

SEQ ID NO: 838004 - DNA, 22 bp, Artificial Sequence
  chemically synthesized
aacagacaattttctgataaca

SEQ ID NO: 838005 - DNA, 22 bp, Artificial Sequence
  chemically synthesized
tctgataacaagtgaatcaagg

SEQ ID NO: 838006 - DNA, 22 bp, Artificial Sequence
  chemically synthesized
ctgataacaagtgaatcaagga

SEQ ID NO: 838007 - DNA, 22 bp, Artificial Sequence
  chemically synthesized
tgataacaagtgaatcaaggac

SEQ ID NO: 838008 - DNA, 22 bp, Artificial Sequence
  chemically synthesized
ataacaagtgaatcaaggactc

SEQ ID NO: 838009 - DNA, 22 bp, Artificial Sequence
  chemically synthesized
gtcgaggaaaggaaaggcaggg

SEQ ID NO: 838010 - DNA, 22 bp, Artificial Sequence
  chemically synthesized
cctgcctttcctttcctcgacc

SEQ ID NO: 838011 - DNA, 22 bp, Artificial Sequence
  chemically synthesized
cctttcctttcctcgaccagtt

SEQ ID NO: 838012 - DNA, 22 bp, Artificial Sequence
  chemically synthesized
agaaaaacgtagaactggtcga

SEQ ID NO: 838013 - DNA, 22 bp, Artificial Sequence
  chemically synthesized
tcagaaaaacgtagaactggtc

SEQ ID NO: 838014 - DNA, 22 bp, Artificial Sequence
  chemically synthesized
tcctttcctcgaccagttctac

SEQ ID NO: 838015 - DNA, 22 bp, Artificial Sequence
  chemically synthesized
cctttcctcgaccagttctacg

SEQ ID NO: 838016 - DNA, 22 bp, Artificial Sequence
  chemically synthesized
ctttcctcgaccagttctacgt

SEQ ID NO: 838017 - DNA, 22 bp, Artificial Sequence
  chemically synthesized
gctctcagaaaaacgtagaact

SEQ ID NO: 838018 - DNA, 22 bp, Artificial Sequence
  chemically synthesized
tcctcgaccagttctacgtttt

SEQ ID NO: 838019 - DNA, 22 bp, Artificial Sequence
  chemically synthesized
cctcgaccagttctacgttttt

SEQ ID NO: 838020 - DNA, 22 bp, Artificial Sequence
  chemically synthesized
ctcgaccagttctacgtttttc

SEQ ID NO: 838021 - DNA, 22 bp, Artificial Sequence
  chemically synthesized
gaccagttctacgtttttctga

SEQ ID NO: 838022 - DNA, 22 bp, Artificial Sequence
  chemically synthesized
ggccacagctggctctcagaaa

SEQ ID NO: 838023 - DNA, 22 bp, Artificial Sequence
  chemically synthesized
ccctgggccacagctggctctc

SEQ ID NO: 838024 - DNA, 22 bp, Artificial Sequence
  chemically synthesized
tacgtttttctgagagccagct

SEQ ID NO: 838025 - DNA, 22 bp, Artificial Sequence
  chemically synthesized
cgtttttctgagagccagctgt

SEQ ID NO: 838026 - DNA, 22 bp, Artificial Sequence
  chemically synthesized
ttgccctgggccacagctggct

SEQ ID NO: 838027 - DNA, 22 bp, Artificial Sequence
  chemically synthesized
ttctgagagccagctgtggccc

SEQ ID NO: 838028 - DNA, 22 bp, Artificial Sequence
  chemically synthesized
tctgagagccagctgtggccca

SEQ ID NO: 838029 - DNA, 22 bp, Artificial Sequence
  chemically synthesized
ctgagagccagctgtggcccag

SEQ ID NO: 838030 - DNA, 22 bp, Artificial Sequence
  chemically synthesized
tgagagccagctgtggcccagg

SEQ ID NO: 838031 - DNA, 22 bp, Artificial Sequence
  chemically synthesized
agagccagctgtggcccagggc

SEQ ID NO: 838032 - DNA, 22 bp, Artificial Sequence
  chemically synthesized
atacaggaaccatggaactgtt

SEQ ID NO: 838033 - DNA, 22 bp, Artificial Sequence
  chemically synthesized
tggcccagggcaacagttccat

SEQ ID NO: 838034 - DNA, 22 bp, Artificial Sequence
  chemically synthesized
catacaggaaccatggaactgt

SEQ ID NO: 838035 - DNA, 22 bp, Artificial Sequence
  chemically synthesized
tcatacaggaaccatggaactg

SEQ ID NO: 838036 - DNA, 22 bp, Artificial Sequence
  chemically synthesized
tttcatacaggaaccatggaac

SEQ ID NO: 838037 - DNA, 22 bp, Artificial Sequence
  chemically synthesized
tctttcatacaggaaccatgga

SEQ ID NO: 838038 - DNA, 22 bp, Artificial Sequence
  chemically synthesized
ctctttcatacaggaaccatgg

SEQ ID NO: 838039 - DNA, 22 bp, Artificial Sequence
  chemically synthesized
tctctttcatacaggaaccatg

SEQ ID NO: 838040 - DNA, 22 bp, Artificial Sequence
  chemically synthesized
ttctctttcatacaggaaccat

SEQ ID NO: 838041 - DNA, 22 bp, Artificial Sequence
  chemically synthesized
catggttcctgtatgaaagaga

SEQ ID NO: 838042 - DNA, 22 bp, Artificial Sequence
  chemically synthesized
gagtcagatttttctctttcat

SEQ ID NO: 838043 - DNA, 22 bp, Artificial Sequence
  chemically synthesized
acaattggagtcagatttttct

SEQ ID NO: 838044 - DNA, 22 bp, Artificial Sequence
  chemically synthesized
ctgtatgaaagagaaaaatctg

SEQ ID NO: 838045 - DNA, 22 bp, Artificial Sequence
  chemically synthesized
tatgaaagagaaaaatctgact

SEQ ID NO: 838046 - DNA, 22 bp, Artificial Sequence
  chemically synthesized
actccaattgtcaggcttattg

SEQ ID NO: 838047 - DNA, 22 bp, Artificial Sequence
  chemically synthesized
caattgtcaggcttattgtatc

SEQ ID NO: 838048 - DNA, 22 bp, Artificial Sequence
  chemically synthesized
tcaggcttattgtatctaccac

SEQ ID NO: 838049 - DNA, 22 bp, Artificial Sequence
  chemically synthesized
caaaggatacaaggcagtggta

SEQ ID NO: 838050 - DNA, 22 bp, Artificial Sequence
  chemically synthesized
attgtatctaccactgccttgt

SEQ ID NO: 838051 - DNA, 22 bp, Artificial Sequence
  chemically synthesized
ttgtatctaccactgccttgta

SEQ ID NO: 838052 - DNA, 22 bp, Artificial Sequence
  chemically synthesized
tatctaccactgccttgtatcc

SEQ ID NO: 838053 - DNA, 22 bp, Artificial Sequence
  chemically synthesized
ggggtcccctacaaaggataca

SEQ ID NO: 838054 - DNA, 22 bp, Artificial Sequence
  chemically synthesized
ccactgccttgtatcctttgta

SEQ ID NO: 838055 - DNA, 22 bp, Artificial Sequence
  chemically synthesized
ccttgtatcctttgtaggggac

SEQ ID NO: 838056 - DNA, 22 bp, Artificial Sequence
  chemically synthesized
gtatcctttgtaggggaccccc

SEQ ID NO: 838057 - DNA, 22 bp, Artificial Sequence
  chemically synthesized
tatcctttgtaggggaccccca

SEQ ID NO: 838058 - DNA, 22 bp, Artificial Sequence
  chemically synthesized
tgtaggggacccccaatggctt

SEQ ID NO: 838059 - DNA, 22 bp, Artificial Sequence
  chemically synthesized
gtaggggacccccaatggcttt

SEQ ID NO: 838060 - DNA, 22 bp, Artificial Sequence
  chemically synthesized
ggtcataggagtaaagccattg

SEQ ID NO: 838061 - DNA, 22 bp, Artificial Sequence
  chemically synthesized
taggggacccccaatggcttta

SEQ ID NO: 838062 - DNA, 22 bp, Artificial Sequence
  chemically synthesized
accctgggtcataggagtaaag

SEQ ID NO: 838063 - DNA, 22 bp, Artificial Sequence
  chemically synthesized
agtctaaccctgggtcatagga

SEQ ID NO: 838064 - DNA, 22 bp, Artificial Sequence
  chemically synthesized
taagtctaaccctgggtcatag

SEQ ID NO: 838065 - DNA, 22 bp, Artificial Sequence
  chemically synthesized
tactcctatgacccagggttag

SEQ ID NO: 838066 - DNA, 22 bp, Artificial Sequence
  chemically synthesized
ccatctctaagtctaaccctgg

SEQ ID NO: 838067 - DNA, 22 bp, Artificial Sequence
  chemically synthesized
actcctatgacccagggttaga

SEQ ID NO: 838068 - DNA, 22 bp, Artificial Sequence
  chemically synthesized
ctcctatgacccagggttagac

SEQ ID NO: 838069 - DNA, 22 bp, Artificial Sequence
  chemically synthesized
ttaccatctctaagtctaaccc

SEQ ID NO: 838070 - DNA, 22 bp, Artificial Sequence
  chemically synthesized
attaccatctctaagtctaacc

SEQ ID NO: 838071 - DNA, 22 bp, Artificial Sequence
  chemically synthesized
ctatgacccagggttagactta

SEQ ID NO: 838072 - DNA, 22 bp, Artificial Sequence
  chemically synthesized
tgacccagggttagacttagag

SEQ ID NO: 838073 - DNA, 22 bp, Artificial Sequence
  chemically synthesized
gcttattaccatctctaagtct

SEQ ID NO: 838074 - DNA, 22 bp, Artificial Sequence
  chemically synthesized
ggcttattaccatctctaagtc

SEQ ID NO: 838075 - DNA, 22 bp, Artificial Sequence
  chemically synthesized
catggtttggcttattaccatc

SEQ ID NO: 838076 - DNA, 22 bp, Artificial Sequence
  chemically synthesized
ctgcatggtttggcttattacc

SEQ ID NO: 838077 - DNA, 22 bp, Artificial Sequence
  chemically synthesized
gacttagagatggtaataagcc

SEQ ID NO: 838078 - DNA, 22 bp, Artificial Sequence
  chemically synthesized
agagatggtaataagccaaacc

SEQ ID NO: 838079 - DNA, 22 bp, Artificial Sequence
  chemically synthesized
caattactgcatggtttggctt

SEQ ID NO: 838080 - DNA, 22 bp, Artificial Sequence
  chemically synthesized
gagatggtaataagccaaacca

SEQ ID NO: 838081 - DNA, 22 bp, Artificial Sequence
  chemically synthesized
ccaattactgcatggtttggct

SEQ ID NO: 838082 - DNA, 22 bp, Artificial Sequence
  chemically synthesized
agtgtttccaattactgcatgg

SEQ ID NO: 838083 - DNA, 22 bp, Artificial Sequence
  chemically synthesized
cagtgtttccaattactgcatg

SEQ ID NO: 838084 - DNA, 22 bp, Artificial Sequence
  chemically synthesized
tcagtgtttccaattactgcat

SEQ ID NO: 838085 - DNA, 22 bp, Artificial Sequence
  chemically synthesized
ttttcagtgtttccaattactg

SEQ ID NO: 838086 - DNA, 22 bp, Artificial Sequence
  chemically synthesized
tattttcagtgtttccaattac

SEQ ID NO: 838087 - DNA, 22 bp, Artificial Sequence
  chemically synthesized
ctattttcagtgtttccaatta

SEQ ID NO: 838088 - DNA, 22 bp, Artificial Sequence
  chemically synthesized
tctattttcagtgtttccaatt

SEQ ID NO: 838089 - DNA, 22 bp, Artificial Sequence
  chemically synthesized
gaaacactgaaaatagaaaatt

SEQ ID NO: 838090 - DNA, 22 bp, Artificial Sequence
  chemically synthesized
aaaatagaaaattctgtataca

SEQ ID NO: 838091 - DNA, 22 bp, Artificial Sequence
  chemically synthesized
agataaagcaaaatgtatacag

SEQ ID NO: 838092 - DNA, 22 bp, Artificial Sequence
  chemically synthesized
aatattaagataaagcaaaatg

SEQ ID NO: 838093 - DNA, 22 bp, Artificial Sequence
  chemically synthesized
caatattaagataaagcaaaat

SEQ ID NO: 838094 - DNA, 22 bp, Artificial Sequence
  chemically synthesized
tcaatattaagataaagcaaaa

SEQ ID NO: 838095 - DNA, 22 bp, Artificial Sequence
  chemically synthesized
tttcaatattaagataaagcaa

SEQ ID NO: 838096 - DNA, 22 bp, Artificial Sequence
  chemically synthesized
ctttcaatattaagataaagca

SEQ ID NO: 838097 - DNA, 22 bp, Artificial Sequence
  chemically synthesized
tgtatacattttgctttatctt

SEQ ID NO: 838098 - DNA, 22 bp, Artificial Sequence
  chemically synthesized
tctttcaatattaagataaagc

SEQ ID NO: 838099 - DNA, 22 bp, Artificial Sequence
  chemically synthesized
tatacattttgctttatcttaa

SEQ ID NO: 838100 - DNA, 22 bp, Artificial Sequence
  chemically synthesized
atattttctttcaatattaaga

SEQ ID NO: 838101 - DNA, 22 bp, Artificial Sequence
  chemically synthesized
tgatattttctttcaatattaa

SEQ ID NO: 838102 - DNA, 22 bp, Artificial Sequence
  chemically synthesized
tgctttatcttaatattgaaag

SEQ ID NO: 838103 - DNA, 22 bp, Artificial Sequence
  chemically synthesized
gctttatcttaatattgaaaga

SEQ ID NO: 838104 - DNA, 22 bp, Artificial Sequence
  chemically synthesized
ctttatcttaatattgaaagaa

SEQ ID NO: 838105 - DNA, 22 bp, Artificial Sequence
  chemically synthesized
tatcttaatattgaaagaaaat

SEQ ID NO: 838106 - DNA, 22 bp, Artificial Sequence
  chemically synthesized
atcttaatattgaaagaaaata

SEQ ID NO: 838107 - DNA, 22 bp, Artificial Sequence
  chemically synthesized
tcttaatattgaaagaaaatat

SEQ ID NO: 838108 - DNA, 22 bp, Artificial Sequence
  chemically synthesized
aatattgaaagaaaatatcaga

SEQ ID NO: 838109 - DNA, 22 bp, Artificial Sequence
  chemically synthesized
atattgaaagaaaatatcagag

SEQ ID NO: 838110 - DNA, 22 bp, Artificial Sequence
  chemically synthesized
aatgaataaatgaaatgctctg

SEQ ID NO: 838111 - DNA, 22 bp, Artificial Sequence
  chemically synthesized
aaagaaaatatcagagcatttc

SEQ ID NO: 838112 - DNA, 22 bp, Artificial Sequence
  chemically synthesized
tgaatgaataaatgaaatgctc

SEQ ID NO: 838113 - DNA, 22 bp, Artificial Sequence
  chemically synthesized
tctgaatgaataaatgaaatgc

SEQ ID NO: 838114 - DNA, 22 bp, Artificial Sequence
  chemically synthesized
catcaagattctctgaatgaat

SEQ ID NO: 838115 - DNA, 22 bp, Artificial Sequence
  chemically synthesized
ccatcaagattctctgaatgaa

SEQ ID NO: 838116 - DNA, 22 bp, Artificial Sequence
  chemically synthesized
tccatcaagattctctgaatga

SEQ ID NO: 838117 - DNA, 22 bp, Artificial Sequence
  chemically synthesized
catttattcattcagagaatct

SEQ ID NO: 838118 - DNA, 22 bp, Artificial Sequence
  chemically synthesized
atttattcattcagagaatctt

SEQ ID NO: 838119 - DNA, 22 bp, Artificial Sequence
  chemically synthesized
attcattcagagaatcttgatg

SEQ ID NO: 838120 - DNA, 22 bp, Artificial Sequence
  chemically synthesized
ttcattcagagaatcttgatgg

SEQ ID NO: 838121 - DNA, 22 bp, Artificial Sequence
  chemically synthesized
attcagagaatcttgatggaaa

SEQ ID NO: 838122 - DNA, 22 bp, Artificial Sequence
  chemically synthesized
aaaaaaataggttttccatcaa

SEQ ID NO: 838123 - DNA, 22 bp, Artificial Sequence
  chemically synthesized
gaaaaaaataggttttccatca

SEQ ID NO: 838124 - DNA, 22 bp, Artificial Sequence
  chemically synthesized
agagaatcttgatggaaaacct

SEQ ID NO: 838125 - DNA, 22 bp, Artificial Sequence
  chemically synthesized
gatggaaaacctatttttttca

SEQ ID NO: 838126 - DNA, 22 bp, Artificial Sequence
  chemically synthesized
atggaaaacctatttttttcaa

SEQ ID NO: 838127 - DNA, 22 bp, Artificial Sequence
  chemically synthesized
cagtcgagggccttgaaaaaaa

SEQ ID NO: 838128 - DNA, 22 bp, Artificial Sequence
  chemically synthesized
aattccagtcgagggccttgaa

SEQ ID NO: 838129 - DNA, 22 bp, Artificial Sequence
  chemically synthesized
aaattccagtcgagggccttga

SEQ ID NO: 838130 - DNA, 22 bp, Artificial Sequence
  chemically synthesized
ttaaattccagtcgagggcctt

SEQ ID NO: 838131 - DNA, 22 bp, Artificial Sequence
  chemically synthesized
tcttaaattccagtcgagggcc

SEQ ID NO: 838132 - DNA, 22 bp, Artificial Sequence
  chemically synthesized
ctcttaaattccagtcgagggc

SEQ ID NO: 838133 - DNA, 22 bp, Artificial Sequence
  chemically synthesized
tttttttcaaggccctcgactg

SEQ ID NO: 838134 - DNA, 22 bp, Artificial Sequence
  chemically synthesized
cttctcttaaattccagtcgag

SEQ ID NO: 838135 - DNA, 22 bp, Artificial Sequence
  chemically synthesized
ttttcaaggccctcgactggaa

SEQ ID NO: 838136 - DNA, 22 bp, Artificial Sequence
  chemically synthesized
tttcaaggccctcgactggaat

SEQ ID NO: 838137 - DNA, 22 bp, Artificial Sequence
  chemically synthesized
ttcaaggccctcgactggaatt

SEQ ID NO: 838138 - DNA, 22 bp, Artificial Sequence
  chemically synthesized
tcaaggccctcgactggaattt

SEQ ID NO: 838139 - DNA, 22 bp, Artificial Sequence
  chemically synthesized
caaggccctcgactggaattta

SEQ ID NO: 838140 - DNA, 22 bp, Artificial Sequence
  chemically synthesized
aaggccctcgactggaatttaa

SEQ ID NO: 838141 - DNA, 22 bp, Artificial Sequence
  chemically synthesized
acagtgttgcttctcttaaatt

SEQ ID NO: 838142 - DNA, 22 bp, Artificial Sequence
  chemically synthesized
ctgacagtgttgcttctcttaa

SEQ ID NO: 838143 - DNA, 22 bp, Artificial Sequence
  chemically synthesized
cctgacagtgttgcttctctta

SEQ ID NO: 838144 - DNA, 22 bp, Artificial Sequence
  chemically synthesized
tcctgacagtgttgcttctctt

SEQ ID NO: 838145 - DNA, 22 bp, Artificial Sequence
  chemically synthesized
gactggaatttaagagaagcaa

SEQ ID NO: 838146 - DNA, 22 bp, Artificial Sequence
  chemically synthesized
tctttcctgacagtgttgcttc

SEQ ID NO: 838147 - DNA, 22 bp, Artificial Sequence
  chemically synthesized
gtctttcctgacagtgttgctt

SEQ ID NO: 838148 - DNA, 22 bp, Artificial Sequence
  chemically synthesized
gaatttaagagaagcaacactg

SEQ ID NO: 838149 - DNA, 22 bp, Artificial Sequence
  chemically synthesized
aagagaagcaacactgtcagga

SEQ ID NO: 838150 - DNA, 22 bp, Artificial Sequence
  chemically synthesized
agagaagcaacactgtcaggaa

SEQ ID NO: 838151 - DNA, 22 bp, Artificial Sequence
  chemically synthesized
gagaaatttgtctttcctgaca

SEQ ID NO: 838152 - DNA, 22 bp, Artificial Sequence
  chemically synthesized
ctcgagaaatttgtctttcctg

SEQ ID NO: 838153 - DNA, 22 bp, Artificial Sequence
  chemically synthesized
gctcgagaaatttgtctttcct

SEQ ID NO: 838154 - DNA, 22 bp, Artificial Sequence
  chemically synthesized
gaacttgctcgagaaatttgtc

SEQ ID NO: 838155 - DNA, 22 bp, Artificial Sequence
  chemically synthesized
agaacttgctcgagaaatttgt

SEQ ID NO: 838156 - DNA, 22 bp, Artificial Sequence
  chemically synthesized
tagaacttgctcgagaaatttg

SEQ ID NO: 838157 - DNA, 22 bp, Artificial Sequence
  chemically synthesized
ttagaacttgctcgagaaattt

SEQ ID NO: 838158 - DNA, 22 bp, Artificial Sequence
  chemically synthesized
tcaggaaagacaaatttctcga

SEQ ID NO: 838159 - DNA, 22 bp, Artificial Sequence
  chemically synthesized
tgcacagaatttttagaacttg

SEQ ID NO: 838160 - DNA, 22 bp, Artificial Sequence
  chemically synthesized
ctcgagcaagttctaaaaattc

SEQ ID NO: 838161 - DNA, 22 bp, Artificial Sequence
  chemically synthesized
tcgagcaagttctaaaaattct

SEQ ID NO: 838162 - DNA, 22 bp, Artificial Sequence
  chemically synthesized
atgtctatgcacagaattttta

SEQ ID NO: 838163 - DNA, 22 bp, Artificial Sequence
  chemically synthesized
gagcaagttctaaaaattctgt

SEQ ID NO: 838164 - DNA, 22 bp, Artificial Sequence
  chemically synthesized
taatgtctatgcacagaatttt

SEQ ID NO: 838165 - DNA, 22 bp, Artificial Sequence
  chemically synthesized
ttctaatgtctatgcacagaat

SEQ ID NO: 838166 - DNA, 22 bp, Artificial Sequence
  chemically synthesized
taaaaattctgtgcatagacat

SEQ ID NO: 838167 - DNA, 22 bp, Artificial Sequence
  chemically synthesized
gtaactgttctaatgtctatgc

SEQ ID NO: 838168 - DNA, 22 bp, Artificial Sequence
  chemically synthesized
aaaattctgtgcatagacatta

SEQ ID NO: 838169 - DNA, 22 bp, Artificial Sequence
  chemically synthesized
tgtgcatagacattagaacagt

SEQ ID NO: 838170 - DNA, 22 bp, Artificial Sequence
  chemically synthesized
tgcatagacattagaacagtta

SEQ ID NO: 838171 - DNA, 22 bp, Artificial Sequence
  chemically synthesized
gaaaatgggtgcacgaatattg

SEQ ID NO: 838172 - DNA, 22 bp, Artificial Sequence
  chemically synthesized
gaacagttaccaatattcgtgc

SEQ ID NO: 838173 - DNA, 22 bp, Artificial Sequence
  chemically synthesized
acatctagaaaatgggtgcacg

SEQ ID NO: 838174 - DNA, 22 bp, Artificial Sequence
  chemically synthesized
cacatctagaaaatgggtgcac

SEQ ID NO: 838175 - DNA, 22 bp, Artificial Sequence
  chemically synthesized
tcacatctagaaaatgggtgca

SEQ ID NO: 838176 - DNA, 22 bp, Artificial Sequence
  chemically synthesized
ccaatattcgtgcacccatttt

SEQ ID NO: 838177 - DNA, 22 bp, Artificial Sequence
  chemically synthesized
gtgcacccattttctagatgtg

SEQ ID NO: 838178 - DNA, 22 bp, Artificial Sequence
  chemically synthesized
taagagtaaaaaaattttcaca

SEQ ID NO: 838179 - DNA, 22 bp, Artificial Sequence
  chemically synthesized
gctataagagtaaaaaaatttt

SEQ ID NO: 838180 - DNA, 22 bp, Artificial Sequence
  chemically synthesized
tctagatgtgaaaattttttta

SEQ ID NO: 838181 - DNA, 22 bp, Artificial Sequence
  chemically synthesized
ctagatgtgaaaatttttttac

SEQ ID NO: 838182 - DNA, 22 bp, Artificial Sequence
  chemically synthesized
ctagctataagagtaaaaaaat

SEQ ID NO: 838183 - DNA, 22 bp, Artificial Sequence
  chemically synthesized
tagatgtgaaaatttttttact

SEQ ID NO: 838184 - DNA, 22 bp, Artificial Sequence
  chemically synthesized
gatgtgaaaatttttttactct

SEQ ID NO: 838185 - DNA, 22 bp, Artificial Sequence
  chemically synthesized
ttttactcttatagctagcagg

SEQ ID NO: 838186 - DNA, 22 bp, Artificial Sequence
  chemically synthesized
tttactcttatagctagcaggg

SEQ ID NO: 838187 - DNA, 22 bp, Artificial Sequence
  chemically synthesized
acaatgatagtgccctgctagc

SEQ ID NO: 838188 - DNA, 22 bp, Artificial Sequence
  chemically synthesized
ttactcttatagctagcagggc

SEQ ID NO: 838189 - DNA, 22 bp, Artificial Sequence
  chemically synthesized
tactcttatagctagcagggca

SEQ ID NO: 838190 - DNA, 22 bp, Artificial Sequence
  chemically synthesized
actcttatagctagcagggcac

SEQ ID NO: 838191 - DNA, 22 bp, Artificial Sequence
  chemically synthesized
ctcttatagctagcagggcact

SEQ ID NO: 838192 - DNA, 22 bp, Artificial Sequence
  chemically synthesized
ttatagctagcagggcactatc

SEQ ID NO: 838193 - DNA, 22 bp, Artificial Sequence
  chemically synthesized
aagggttgacaatgatagtgcc

SEQ ID NO: 838194 - DNA, 22 bp, Artificial Sequence
  chemically synthesized
atagctagcagggcactatcat

SEQ ID NO: 838195 - DNA, 22 bp, Artificial Sequence
  chemically synthesized
tagctagcagggcactatcatt

SEQ ID NO: 838196 - DNA, 22 bp, Artificial Sequence
  chemically synthesized
tcaagggttgacaatgatagtg

SEQ ID NO: 838197 - DNA, 22 bp, Artificial Sequence
  chemically synthesized
ctcaagggttgacaatgatagt

SEQ ID NO: 838198 - DNA, 22 bp, Artificial Sequence
  chemically synthesized
gcagggcactatcattgtcaac

SEQ ID NO: 838199 - DNA, 22 bp, Artificial Sequence
  chemically synthesized
ggccttctcaagggttgacaat

SEQ ID NO: 838200 - DNA, 22 bp, Artificial Sequence
  chemically synthesized
cactaggccttctcaagggttg

SEQ ID NO: 838201 - DNA, 22 bp, Artificial Sequence
  chemically synthesized
tcattgtcaacccttgagaagg

SEQ ID NO: 838202 - DNA, 22 bp, Artificial Sequence
  chemically synthesized
agagttccactaggccttctca

SEQ ID NO: 838203 - DNA, 22 bp, Artificial Sequence
  chemically synthesized
ttgagagttccactaggccttc

SEQ ID NO: 838204 - DNA, 22 bp, Artificial Sequence
  chemically synthesized
tcaacccttgagaaggcctagt

SEQ ID NO: 838205 - DNA, 22 bp, Artificial Sequence
  chemically synthesized
attattgagagttccactaggc

SEQ ID NO: 838206 - DNA, 22 bp, Artificial Sequence
  chemically synthesized
tcctcattattgagagttccac

SEQ ID NO: 838207 - DNA, 22 bp, Artificial Sequence
  chemically synthesized
gagaaggcctagtggaactctc

SEQ ID NO: 838208 - DNA, 22 bp, Artificial Sequence
  chemically synthesized
agaaggcctagtggaactctca

SEQ ID NO: 838209 - DNA, 22 bp, Artificial Sequence
  chemically synthesized
gtggaactctcaataatgagga

SEQ ID NO: 838210 - DNA, 22 bp, Artificial Sequence
  chemically synthesized
agtccataacaatcaactatcc

SEQ ID NO: 838211 - DNA, 22 bp, Artificial Sequence
  chemically synthesized
tcaataatgaggatagttgatt

SEQ ID NO: 838212 - DNA, 22 bp, Artificial Sequence
  chemically synthesized
aataatgaggatagttgattgt

SEQ ID NO: 838213 - DNA, 22 bp, Artificial Sequence
  chemically synthesized
attgttatggactgaatgctgg

SEQ ID NO: 838214 - DNA, 22 bp, Artificial Sequence
  chemically synthesized
ttatggactgaatgctggcatc

SEQ ID NO: 838215 - DNA, 22 bp, Artificial Sequence
  chemically synthesized
gccggcgggggggatgccagca

SEQ ID NO: 838216 - DNA, 22 bp, Artificial Sequence
  chemically synthesized
agccggcgggggggatgccagc

SEQ ID NO: 838217 - DNA, 22 bp, Artificial Sequence
  chemically synthesized
tagccggcgggggggatgccag

SEQ ID NO: 838218 - DNA, 22 bp, Artificial Sequence
  chemically synthesized
tggactgaatgctggcatcccc

SEQ ID NO: 838219 - DNA, 22 bp, Artificial Sequence
  chemically synthesized
aatgctggcatcccccccgccg

SEQ ID NO: 838220 - DNA, 22 bp, Artificial Sequence
  chemically synthesized
aacatacaaattttagccggcg

SEQ ID NO: 838221 - DNA, 22 bp, Artificial Sequence
  chemically synthesized
caacatacaaattttagccggc

SEQ ID NO: 838222 - DNA, 22 bp, Artificial Sequence
  chemically synthesized
gcatcccccccgccggctaaaa

SEQ ID NO: 838223 - DNA, 22 bp, Artificial Sequence
  chemically synthesized
gcacttcaacatacaaatttta

SEQ ID NO: 838224 - DNA, 22 bp, Artificial Sequence
  chemically synthesized
ggggttagcacttcaacataca

SEQ ID NO: 838225 - DNA, 22 bp, Artificial Sequence
  chemically synthesized
aaatttgtatgttgaagtgcta

SEQ ID NO: 838226 - DNA, 22 bp, Artificial Sequence
  chemically synthesized
gtatgttgaagtgctaaccccc

SEQ ID NO: 838227 - DNA, 22 bp, Artificial Sequence
  chemically synthesized
caaatatccattgggggttagc

SEQ ID NO: 838228 - DNA, 22 bp, Artificial Sequence
  chemically synthesized
tatgttgaagtgctaaccccca

SEQ ID NO: 838229 - DNA, 22 bp, Artificial Sequence
  chemically synthesized
aagtgctaacccccaatggata

SEQ ID NO: 838230 - DNA, 22 bp, Artificial Sequence
  chemically synthesized
aaaggccccacctccaaatatc

SEQ ID NO: 838231 - DNA, 22 bp, Artificial Sequence
  chemically synthesized
acccccaatggatatttggagg

SEQ ID NO: 838232 - DNA, 22 bp, Artificial Sequence
  chemically synthesized
tcaaaggccccacctccaaata

SEQ ID NO: 838233 - DNA, 22 bp, Artificial Sequence
  chemically synthesized
ctcaaaggccccacctccaaat

SEQ ID NO: 838234 - DNA, 22 bp, Artificial Sequence
  chemically synthesized
tttctcaaaggccccacctcca

SEQ ID NO: 838235 - DNA, 22 bp, Artificial Sequence
  chemically synthesized
ttatttctcaaaggccccacct

SEQ ID NO: 838236 - DNA, 22 bp, Artificial Sequence
  chemically synthesized
attatttctcaaaggccccacc

SEQ ID NO: 838237 - DNA, 22 bp, Artificial Sequence
  chemically synthesized
acccttattatttctcaaaggc

SEQ ID NO: 838238 - DNA, 22 bp, Artificial Sequence
  chemically synthesized
ggaggtggggcctttgagaaat

SEQ ID NO: 838239 - DNA, 22 bp, Artificial Sequence
  chemically synthesized
gaggtggggcctttgagaaata

SEQ ID NO: 838240 - DNA, 22 bp, Artificial Sequence
  chemically synthesized
atctaacccttattatttctca

SEQ ID NO: 838241 - DNA, 22 bp, Artificial Sequence
  chemically synthesized
tgacctcatctaacccttatta

SEQ ID NO: 838242 - DNA, 22 bp, Artificial Sequence
  chemically synthesized
tgagaaataataagggttagat

SEQ ID NO: 838243 - DNA, 22 bp, Artificial Sequence
  chemically synthesized
gagaaataataagggttagatg

SEQ ID NO: 838244 - DNA, 22 bp, Artificial Sequence
  chemically synthesized
aacctatgacctcatctaaccc

SEQ ID NO: 838245 - DNA, 22 bp, Artificial Sequence
  chemically synthesized
agaaataataagggttagatga

SEQ ID NO: 838246 - DNA, 22 bp, Artificial Sequence
  chemically synthesized
tggaggcctcaacctatgacct

SEQ ID NO: 838247 - DNA, 22 bp, Artificial Sequence
  chemically synthesized
gatgaggtcataggttgaggcc

SEQ ID NO: 838248 - DNA, 22 bp, Artificial Sequence
  chemically synthesized
atccaattatggaggcctcaac

SEQ ID NO: 838249 - DNA, 22 bp, Artificial Sequence
  chemically synthesized
aaaggacactaatccaattatg

SEQ ID NO: 838250 - DNA, 22 bp, Artificial Sequence
  chemically synthesized
aaaaggacactaatccaattat

SEQ ID NO: 838251 - DNA, 22 bp, Artificial Sequence
  chemically synthesized
ttaaaaggacactaatccaatt

SEQ ID NO: 838252 - DNA, 22 bp, Artificial Sequence
  chemically synthesized
cttaaaaggacactaatccaat

SEQ ID NO: 838253 - DNA, 22 bp, Artificial Sequence
  chemically synthesized
aggcctccataattggattagt

SEQ ID NO: 838254 - DNA, 22 bp, Artificial Sequence
  chemically synthesized
ttcttaaaaggacactaatcca

SEQ ID NO: 838255 - DNA, 22 bp, Artificial Sequence
  chemically synthesized
ctcttcttaaaaggacactaat

SEQ ID NO: 838256 - DNA, 22 bp, Artificial Sequence
  chemically synthesized
gctcttcttaaaaggacactaa

SEQ ID NO: 838257 - DNA, 22 bp, Artificial Sequence
  chemically synthesized
cataattggattagtgtccttt

SEQ ID NO: 838258 - DNA, 22 bp, Artificial Sequence
  chemically synthesized
ttgctcttcttaaaaggacact

SEQ ID NO: 838259 - DNA, 22 bp, Artificial Sequence
  chemically synthesized
cttgctcttcttaaaaggacac

SEQ ID NO: 838260 - DNA, 22 bp, Artificial Sequence
  chemically synthesized
ttcttgctcttcttaaaaggac

SEQ ID NO: 838261 - DNA, 22 bp, Artificial Sequence
  chemically synthesized
tcttcttgctcttcttaaaagg

SEQ ID NO: 838262 - DNA, 22 bp, Artificial Sequence
  chemically synthesized
gattagtgtccttttaagaaga

SEQ ID NO: 838263 - DNA, 22 bp, Artificial Sequence
  chemically synthesized
gtctctcttcttgctcttctta

SEQ ID NO: 838264 - DNA, 22 bp, Artificial Sequence
  chemically synthesized
tagtctctcttcttgctcttct

SEQ ID NO: 838265 - DNA, 22 bp, Artificial Sequence
  chemically synthesized
gtgtccttttaagaagagcaag

SEQ ID NO: 838266 - DNA, 22 bp, Artificial Sequence
  chemically synthesized
ttaagaagagcaagaagagaga

SEQ ID NO: 838267 - DNA, 22 bp, Artificial Sequence
  chemically synthesized
taagaagagcaagaagagagac

SEQ ID NO: 838268 - DNA, 22 bp, Artificial Sequence
  chemically synthesized
aagaagagcaagaagagagact

SEQ ID NO: 838269 - DNA, 22 bp, Artificial Sequence
  chemically synthesized
agaagagcaagaagagagacta

SEQ ID NO: 838270 - DNA, 22 bp, Artificial Sequence
  chemically synthesized
gggagagaggtggtgcagagag

SEQ ID NO: 838271 - DNA, 22 bp, Artificial Sequence
  chemically synthesized
gagtacctctctgcaccacctc

SEQ ID NO: 838272 - DNA, 22 bp, Artificial Sequence
  chemically synthesized
gtatgttggggagagaggtggt

SEQ ID NO: 838273 - DNA, 22 bp, Artificial Sequence
  chemically synthesized
tctgcaccacctctctccccaa

SEQ ID NO: 838274 - DNA, 22 bp, Artificial Sequence
  chemically synthesized
tatcctcgtatgttggggagag

SEQ ID NO: 838275 - DNA, 22 bp, Artificial Sequence
  chemically synthesized
tgcaccacctctctccccaaca

SEQ ID NO: 838276 - DNA, 22 bp, Artificial Sequence
  chemically synthesized
ctgtatcctcgtatgttgggga

SEQ ID NO: 838277 - DNA, 22 bp, Artificial Sequence
  chemically synthesized
caccacctctctccccaacata

SEQ ID NO: 838278 - DNA, 22 bp, Artificial Sequence
  chemically synthesized
gctgtatcctcgtatgttgggg

SEQ ID NO: 838279 - DNA, 22 bp, Artificial Sequence
  chemically synthesized
ttgctgtatcctcgtatgttgg

SEQ ID NO: 838280 - DNA, 22 bp, Artificial Sequence
  chemically synthesized
cttgctgtatcctcgtatgttg

SEQ ID NO: 838281 - DNA, 22 bp, Artificial Sequence
  chemically synthesized
ttcttgctgtatcctcgtatgt

SEQ ID NO: 838282 - DNA, 22 bp, Artificial Sequence
  chemically synthesized
cttcttgctgtatcctcgtatg

SEQ ID NO: 838283 - DNA, 22 bp, Artificial Sequence
  chemically synthesized
tctccccaacatacgaggatac

SEQ ID NO: 838284 - DNA, 22 bp, Artificial Sequence
  chemically synthesized
tccccaacatacgaggatacag

SEQ ID NO: 838285 - DNA, 22 bp, Artificial Sequence
  chemically synthesized
cccaacatacgaggatacagca

SEQ ID NO: 838286 - DNA, 22 bp, Artificial Sequence
  chemically synthesized
gtgagaaccttcttcttgctgt

SEQ ID NO: 838287 - DNA, 22 bp, Artificial Sequence
  chemically synthesized
ctggtgagaaccttcttcttgc

SEQ ID NO: 838288 - DNA, 22 bp, Artificial Sequence
  chemically synthesized
acagatgtggttcctggtgaga

SEQ ID NO: 838289 - DNA, 22 bp, Artificial Sequence
  chemically synthesized
tcaccaggaaccacatctgtca

SEQ ID NO: 838290 - DNA, 22 bp, Artificial Sequence
  chemically synthesized
accaggaaccacatctgtcagc

SEQ ID NO: 838291 - DNA, 22 bp, Artificial Sequence
  chemically synthesized
agaagtacaagatcatggtgct

SEQ ID NO: 838292 - DNA, 22 bp, Artificial Sequence
  chemically synthesized
gaggttgagaagtacaagatca

SEQ ID NO: 838293 - DNA, 22 bp, Artificial Sequence
  chemically synthesized
tggaggttgagaagtacaagat

SEQ ID NO: 838294 - DNA, 22 bp, Artificial Sequence
  chemically synthesized
tcagcaccatgatcttgtactt

SEQ ID NO: 838295 - DNA, 22 bp, Artificial Sequence
  chemically synthesized
acggttctggaggttgagaagt

SEQ ID NO: 838296 - DNA, 22 bp, Artificial Sequence
  chemically synthesized
cacggttctggaggttgagaag

SEQ ID NO: 838297 - DNA, 22 bp, Artificial Sequence
  chemically synthesized
tcacggttctggaggttgagaa

SEQ ID NO: 838298 - DNA, 22 bp, Artificial Sequence
  chemically synthesized
ttcacggttctggaggttgaga

SEQ ID NO: 838299 - DNA, 22 bp, Artificial Sequence
  chemically synthesized
tttttcacggttctggaggttg

SEQ ID NO: 838300 - DNA, 22 bp, Artificial Sequence
  chemically synthesized
gtacttctcaacctccagaacc

SEQ ID NO: 838301 - DNA, 22 bp, Artificial Sequence
  chemically synthesized
tacttctcaacctccagaaccg

SEQ ID NO: 838302 - DNA, 22 bp, Artificial Sequence
  chemically synthesized
ctcaacctccagaaccgtgaaa

SEQ ID NO: 838303 - DNA, 22 bp, Artificial Sequence
  chemically synthesized
tcaacctccagaaccgtgaaaa

SEQ ID NO: 838304 - DNA, 22 bp, Artificial Sequence
  chemically synthesized
aacctccagaaccgtgaaaaac

SEQ ID NO: 838305 - DNA, 22 bp, Artificial Sequence
  chemically synthesized
aacaacaggcagttgtttttca

SEQ ID NO: 838306 - DNA, 22 bp, Artificial Sequence
  chemically synthesized
aaacaacaggcagttgtttttc

SEQ ID NO: 838307 - DNA, 22 bp, Artificial Sequence
  chemically synthesized
cagaaccgtgaaaaacaactgc

SEQ ID NO: 838308 - DNA, 22 bp, Artificial Sequence
  chemically synthesized
ggtggcttaaacaacaggcagt

SEQ ID NO: 838309 - DNA, 22 bp, Artificial Sequence
  chemically synthesized
cctgttgtttaagccacccagt

SEQ ID NO: 838310 - DNA, 22 bp, Artificial Sequence
  chemically synthesized
ttgtttaagccacccagtctat

SEQ ID NO: 838311 - DNA, 22 bp, Artificial Sequence
  chemically synthesized
taaaataatgccatagactggg

SEQ ID NO: 838312 - DNA, 22 bp, Artificial Sequence
  chemically synthesized
tttaagccacccagtctatggc

SEQ ID NO: 838313 - DNA, 22 bp, Artificial Sequence
  chemically synthesized
ctataaaataatgccatagact

SEQ ID NO: 838314 - DNA, 22 bp, Artificial Sequence
  chemically synthesized
aagccacccagtctatggcatt

SEQ ID NO: 838315 - DNA, 22 bp, Artificial Sequence
  chemically synthesized
agccacccagtctatggcatta

SEQ ID NO: 838316 - DNA, 22 bp, Artificial Sequence
  chemically synthesized
aggctgctataaaataatgcca

SEQ ID NO: 838317 - DNA, 22 bp, Artificial Sequence
  chemically synthesized
gtaagctcaggctgctataaaa

SEQ ID NO: 838318 - DNA, 22 bp, Artificial Sequence
  chemically synthesized
agtaagctcaggctgctataaa

SEQ ID NO: 838319 - DNA, 22 bp, Artificial Sequence
  chemically synthesized
tggcattattttatagcagcct

SEQ ID NO: 838320 - DNA, 22 bp, Artificial Sequence
  chemically synthesized
atgtcttagtaagctcaggctg

SEQ ID NO: 838321 - DNA, 22 bp, Artificial Sequence
  chemically synthesized
ttttatagcagcctgagcttac

SEQ ID NO: 838322 - DNA, 22 bp, Artificial Sequence
  chemically synthesized
tatagcagcctgagcttactaa

SEQ ID NO: 838323 - DNA, 22 bp, Artificial Sequence
  chemically synthesized
atagcagcctgagcttactaag

SEQ ID NO: 838324 - DNA, 22 bp, Artificial Sequence
  chemically synthesized
tagcagcctgagcttactaaga

SEQ ID NO: 838325 - DNA, 22 bp, Artificial Sequence
  chemically synthesized
tacaaatattaatgtcttagta

SEQ ID NO: 838326 - DNA, 22 bp, Artificial Sequence
  chemically synthesized
actatacaaatattaatgtctt

SEQ ID NO: 838327 - DNA, 22 bp, Artificial Sequence
  chemically synthesized
ctcactatacaaatattaatgt

SEQ ID NO: 838328 - DNA, 22 bp, Artificial Sequence
  chemically synthesized
agcttactaagacattaatatt

SEQ ID NO: 838329 - DNA, 22 bp, Artificial Sequence
  chemically synthesized
actaagacattaatatttgtat

SEQ ID NO: 838330 - DNA, 22 bp, Artificial Sequence
  chemically synthesized
ctaagacattaatatttgtata

SEQ ID NO: 838331 - DNA, 22 bp, Artificial Sequence
  chemically synthesized
aaatggctactcactatacaaa

SEQ ID NO: 838332 - DNA, 22 bp, Artificial Sequence
  chemically synthesized
agacattaatatttgtatagtg

SEQ ID NO: 838333 - DNA, 22 bp, Artificial Sequence
  chemically synthesized
caaatggctactcactatacaa

SEQ ID NO: 838334 - DNA, 22 bp, Artificial Sequence
  chemically synthesized
tcaaatggctactcactataca

SEQ ID NO: 838335 - DNA, 22 bp, Artificial Sequence
  chemically synthesized
ttcaaatggctactcactatac

SEQ ID NO: 838336 - DNA, 22 bp, Artificial Sequence
  chemically synthesized
atatttgtatagtgagtagcca

SEQ ID NO: 838337 - DNA, 22 bp, Artificial Sequence
  chemically synthesized
gtatagtgagtagccatttgaa

SEQ ID NO: 838338 - DNA, 22 bp, Artificial Sequence
  chemically synthesized
tatagtgagtagccatttgaaa

SEQ ID NO: 838339 - DNA, 22 bp, Artificial Sequence
  chemically synthesized
aatgaaatgacgcatggaaaag

SEQ ID NO: 838340 - DNA, 22 bp, Artificial Sequence
  chemically synthesized
gaaaaggacttttccatgcgtc

SEQ ID NO: 838341 - DNA, 22 bp, Artificial Sequence
  chemically synthesized
aaaaggacttttccatgcgtca

SEQ ID NO: 838342 - DNA, 22 bp, Artificial Sequence
  chemically synthesized
ggattcaatgaaatgacgcatg

SEQ ID NO: 838343 - DNA, 22 bp, Artificial Sequence
  chemically synthesized
gtgttaggattcaatgaaatga

SEQ ID NO: 838344 - DNA, 22 bp, Artificial Sequence
  chemically synthesized
ggtgttaggattcaatgaaatg

SEQ ID NO: 838345 - DNA, 22 bp, Artificial Sequence
  chemically synthesized
ttccatgcgtcatttcattgaa

SEQ ID NO: 838346 - DNA, 22 bp, Artificial Sequence
  chemically synthesized
tccatgcgtcatttcattgaat

SEQ ID NO: 838347 - DNA, 22 bp, Artificial Sequence
  chemically synthesized
ccatgcgtcatttcattgaatc

SEQ ID NO: 838348 - DNA, 22 bp, Artificial Sequence
  chemically synthesized
gtttggtgttaggattcaatga

SEQ ID NO: 838349 - DNA, 22 bp, Artificial Sequence
  chemically synthesized
catgcgtcatttcattgaatcc

SEQ ID NO: 838350 - DNA, 22 bp, Artificial Sequence
  chemically synthesized
catactagtttggtgttaggat

SEQ ID NO: 838351 - DNA, 22 bp, Artificial Sequence
  chemically synthesized
ccatactagtttggtgttagga

SEQ ID NO: 838352 - DNA, 22 bp, Artificial Sequence
  chemically synthesized
cattgaatcctaacaccaaact

SEQ ID NO: 838353 - DNA, 22 bp, Artificial Sequence
  chemically synthesized
attgaatcctaacaccaaacta

SEQ ID NO: 838354 - DNA, 22 bp, Artificial Sequence
  chemically synthesized
ataacttccatactagtttggt

SEQ ID NO: 838355 - DNA, 22 bp, Artificial Sequence
  chemically synthesized
aatcctaacaccaaactagtat

SEQ ID NO: 838356 - DNA, 22 bp, Artificial Sequence
  chemically synthesized
ggatcctgataacttccatact

SEQ ID NO: 838357 - DNA, 22 bp, Artificial Sequence
  chemically synthesized
acaccaaactagtatggaagtt

SEQ ID NO: 838358 - DNA, 22 bp, Artificial Sequence
  chemically synthesized
taaaactgggatcctgataact

SEQ ID NO: 838359 - DNA, 22 bp, Artificial Sequence
  chemically synthesized
gtatggaagttatcaggatccc

SEQ ID NO: 838360 - DNA, 22 bp, Artificial Sequence
  chemically synthesized
atctgtaaaactgggatcctga

SEQ ID NO: 838361 - DNA, 22 bp, Artificial Sequence
  chemically synthesized
tcatctgtaaaactgggatcct

SEQ ID NO: 838362 - DNA, 22 bp, Artificial Sequence
  chemically synthesized
ctcatctgtaaaactgggatcc

SEQ ID NO: 838363 - DNA, 22 bp, Artificial Sequence
  chemically synthesized
tctcatctgtaaaactgggatc

SEQ ID NO: 838364 - DNA, 22 bp, Artificial Sequence
  chemically synthesized
attttctcatctgtaaaactgg

SEQ ID NO: 838365 - DNA, 22 bp, Artificial Sequence
  chemically synthesized
tcaggatcccagttttacagat

SEQ ID NO: 838366 - DNA, 22 bp, Artificial Sequence
  chemically synthesized
caacagttaattttctcatctg

SEQ ID NO: 838367 - DNA, 22 bp, Artificial Sequence
  chemically synthesized
tccaacagttaattttctcatc

SEQ ID NO: 838368 - DNA, 22 bp, Artificial Sequence
  chemically synthesized
atctctccaacagttaattttc

SEQ ID NO: 838369 - DNA, 22 bp, Artificial Sequence
  chemically synthesized
aatctctccaacagttaatttt

SEQ ID NO: 838370 - DNA, 22 bp, Artificial Sequence
  chemically synthesized
tacagatgagaaaattaactgt

SEQ ID NO: 838371 - DNA, 22 bp, Artificial Sequence
  chemically synthesized
acagatgagaaaattaactgtt

SEQ ID NO: 838372 - DNA, 22 bp, Artificial Sequence
  chemically synthesized
tttaatctctccaacagttaat

SEQ ID NO: 838373 - DNA, 22 bp, Artificial Sequence
  chemically synthesized
cagatgagaaaattaactgttg

SEQ ID NO: 838374 - DNA, 22 bp, Artificial Sequence
  chemically synthesized
actgttggagagattaaataat

SEQ ID NO: 838375 - DNA, 22 bp, Artificial Sequence
  chemically synthesized
ttggagagattaaataatttgc

SEQ ID NO: 838376 - DNA, 22 bp, Artificial Sequence
  chemically synthesized
gagagattaaataatttgccat

SEQ ID NO: 838377 - DNA, 22 bp, Artificial Sequence
  chemically synthesized
gtgacagtgggacccatggcaa

SEQ ID NO: 838378 - DNA, 22 bp, Artificial Sequence
  chemically synthesized
agtgacagtgggacccatggca

SEQ ID NO: 838379 - DNA, 22 bp, Artificial Sequence
  chemically synthesized
aataatttgccatgggtcccac

SEQ ID NO: 838380 - DNA, 22 bp, Artificial Sequence
  chemically synthesized
cccccttagtgacagtgggacc

SEQ ID NO: 838381 - DNA, 22 bp, Artificial Sequence
  chemically synthesized
tgcccccttagtgacagtggga

SEQ ID NO: 838382 - DNA, 22 bp, Artificial Sequence
  chemically synthesized
gccatgggtcccactgtcacta

SEQ ID NO: 838383 - DNA, 22 bp, Artificial Sequence
  chemically synthesized
gctctgcccccttagtgacagt

SEQ ID NO: 838384 - DNA, 22 bp, Artificial Sequence
  chemically synthesized
ccatgggtcccactgtcactaa

SEQ ID NO: 838385 - DNA, 22 bp, Artificial Sequence
  chemically synthesized
gtccaagcactggctctgcccc

SEQ ID NO: 838386 - DNA, 22 bp, Artificial Sequence
  chemically synthesized
ggtccaagcactggctctgccc

SEQ ID NO: 838387 - DNA, 22 bp, Artificial Sequence
  chemically synthesized
tcactaagggggcagagccagt

SEQ ID NO: 838388 - DNA, 22 bp, Artificial Sequence
  chemically synthesized
agggggcagagccagtgcttgg

SEQ ID NO: 838389 - DNA, 22 bp, Artificial Sequence
  chemically synthesized
aaataagagcacttggtccaag

SEQ ID NO: 838390 - DNA, 22 bp, Artificial Sequence
  chemically synthesized
aatctaaaataagagcacttgg

SEQ ID NO: 838391 - DNA, 22 bp, Artificial Sequence
  chemically synthesized
ggaccaagtgctcttattttag

SEQ ID NO: 838392 - DNA, 22 bp, Artificial Sequence
  chemically synthesized
gaccaagtgctcttattttaga

SEQ ID NO: 838393 - DNA, 22 bp, Artificial Sequence
  chemically synthesized
ttattttagattcagtgctgtt

SEQ ID NO: 838394 - DNA, 22 bp, Artificial Sequence
  chemically synthesized
gtaatatagtagtaacagcact

SEQ ID NO: 838395 - DNA, 22 bp, Artificial Sequence
  chemically synthesized
attttagattcagtgctgttac

SEQ ID NO: 838396 - DNA, 22 bp, Artificial Sequence
  chemically synthesized
agtaatatagtagtaacagcac

SEQ ID NO: 838397 - DNA, 22 bp, Artificial Sequence
  chemically synthesized
ttttagattcagtgctgttact

SEQ ID NO: 838398 - DNA, 22 bp, Artificial Sequence
  chemically synthesized
tagtaatatagtagtaacagca

SEQ ID NO: 838399 - DNA, 22 bp, Artificial Sequence
  chemically synthesized
tttagtaatatagtagtaacag

SEQ ID NO: 838400 - DNA, 22 bp, Artificial Sequence
  chemically synthesized
tagattcagtgctgttactact

SEQ ID NO: 838401 - DNA, 22 bp, Artificial Sequence
  chemically synthesized
ctttagtaatatagtagtaaca

SEQ ID NO: 838402 - DNA, 22 bp, Artificial Sequence
  chemically synthesized
agattcagtgctgttactacta

SEQ ID NO: 838403 - DNA, 22 bp, Artificial Sequence
  chemically synthesized
gattcagtgctgttactactat

SEQ ID NO: 838404 - DNA, 22 bp, Artificial Sequence
  chemically synthesized
tttctttagtaatatagtagta

SEQ ID NO: 838405 - DNA, 22 bp, Artificial Sequence
  chemically synthesized
atttctttagtaatatagtagt

SEQ ID NO: 838406 - DNA, 22 bp, Artificial Sequence
  chemically synthesized
tatttctttagtaatatagtag

SEQ ID NO: 838407 - DNA, 22 bp, Artificial Sequence
  chemically synthesized
agtgctgttactactatattac

SEQ ID NO: 838408 - DNA, 22 bp, Artificial Sequence
  chemically synthesized
gcctttatttctttagtaatat

SEQ ID NO: 838409 - DNA, 22 bp, Artificial Sequence
  chemically synthesized
ggcctttatttctttagtaata

SEQ ID NO: 838410 - DNA, 22 bp, Artificial Sequence
  chemically synthesized
tggcctttatttctttagtaat

SEQ ID NO: 838411 - DNA, 22 bp, Artificial Sequence
  chemically synthesized
ttactactatattactaaagaa

SEQ ID NO: 838412 - DNA, 22 bp, Artificial Sequence
  chemically synthesized
tttggcctttatttctttagta

SEQ ID NO: 838413 - DNA, 22 bp, Artificial Sequence
  chemically synthesized
ctactatattactaaagaaata

SEQ ID NO: 838414 - DNA, 22 bp, Artificial Sequence
  chemically synthesized
ctatattactaaagaaataaag

SEQ ID NO: 838415 - DNA, 22 bp, Artificial Sequence
  chemically synthesized
gagattctttggcctttatttc

SEQ ID NO: 838416 - DNA, 22 bp, Artificial Sequence
  chemically synthesized
tattactaaagaaataaaggcc

SEQ ID NO: 838417 - DNA, 22 bp, Artificial Sequence
  chemically synthesized
tcctggagattctttggccttt

SEQ ID NO: 838418 - DNA, 22 bp, Artificial Sequence
  chemically synthesized
atcctggagattctttggcctt

SEQ ID NO: 838419 - DNA, 22 bp, Artificial Sequence
  chemically synthesized
ctaaagaaataaaggccaaaga

SEQ ID NO: 838420 - DNA, 22 bp, Artificial Sequence
  chemically synthesized
tatcctggagattctttggcct

SEQ ID NO: 838421 - DNA, 22 bp, Artificial Sequence
  chemically synthesized
aagaaataaaggccaaagaatc

SEQ ID NO: 838422 - DNA, 22 bp, Artificial Sequence
  chemically synthesized
cctttatcctggagattctttg

SEQ ID NO: 838423 - DNA, 22 bp, Artificial Sequence
  chemically synthesized
tacctttatcctggagattctt

SEQ ID NO: 838424 - DNA, 22 bp, Artificial Sequence
  chemically synthesized
acaggttctacctttatcctgg

SEQ ID NO: 838425 - DNA, 22 bp, Artificial Sequence
  chemically synthesized
gacaggttctacctttatcctg

SEQ ID NO: 838426 - DNA, 22 bp, Artificial Sequence
  chemically synthesized
tccgtttgacaggttctacctt

SEQ ID NO: 838427 - DNA, 22 bp, Artificial Sequence
  chemically synthesized
atccgtttgacaggttctacct

SEQ ID NO: 838428 - DNA, 22 bp, Artificial Sequence
  chemically synthesized
caggataaaggtagaacctgtc

SEQ ID NO: 838429 - DNA, 22 bp, Artificial Sequence
  chemically synthesized
gtttatccgtttgacaggttct

SEQ ID NO: 838430 - DNA, 22 bp, Artificial Sequence
  chemically synthesized
atgttggtttatccgtttgaca

SEQ ID NO: 838431 - DNA, 22 bp, Artificial Sequence
  chemically synthesized
ctgatgttggtttatccgtttg

SEQ ID NO: 838432 - DNA, 22 bp, Artificial Sequence
  chemically synthesized
tcaaacggataaaccaacatca

SEQ ID NO: 838433 - DNA, 22 bp, Artificial Sequence
  chemically synthesized
gaagtcaggaaacaaatggttg

SEQ ID NO: 838434 - DNA, 22 bp, Artificial Sequence
  chemically synthesized
atataaaactagaagtcaggaa

SEQ ID NO: 838435 - DNA, 22 bp, Artificial Sequence
  chemically synthesized
tcatataaaactagaagtcagg

SEQ ID NO: 838436 - DNA, 22 bp, Artificial Sequence
  chemically synthesized
ctcatataaaactagaagtcag

SEQ ID NO: 838437 - DNA, 22 bp, Artificial Sequence
  chemically synthesized
tctcatataaaactagaagtca

SEQ ID NO: 838438 - DNA, 22 bp, Artificial Sequence
  chemically synthesized
ttctcatataaaactagaagtc

SEQ ID NO: 838439 - DNA, 22 bp, Artificial Sequence
  chemically synthesized
tttctcatataaaactagaagt

SEQ ID NO: 838440 - DNA, 22 bp, Artificial Sequence
  chemically synthesized
ttttctcatataaaactagaag

SEQ ID NO: 838441 - DNA, 22 bp, Artificial Sequence
  chemically synthesized
gtttcctgacttctagttttat

SEQ ID NO: 838442 - DNA, 22 bp, Artificial Sequence
  chemically synthesized
tttcctgacttctagttttata

SEQ ID NO: 838443 - DNA, 22 bp, Artificial Sequence
  chemically synthesized
cctgacttctagttttatatga

SEQ ID NO: 838444 - DNA, 22 bp, Artificial Sequence
  chemically synthesized
ctgacttctagttttatatgag

SEQ ID NO: 838445 - DNA, 22 bp, Artificial Sequence
  chemically synthesized
acttctagttttatatgagaaa

SEQ ID NO: 838446 - DNA, 22 bp, Artificial Sequence
  chemically synthesized
ctagttttatatgagaaaaaag

SEQ ID NO: 838447 - DNA, 22 bp, Artificial Sequence
  chemically synthesized
tagttttatatgagaaaaaagc

SEQ ID NO: 838448 - DNA, 22 bp, Artificial Sequence
  chemically synthesized
aaacaaacaggagcttttttct

SEQ ID NO: 838449 - DNA, 22 bp, Artificial Sequence
  chemically synthesized
gttttatatgagaaaaaagctc

SEQ ID NO: 838450 - DNA, 22 bp, Artificial Sequence
  chemically synthesized
tatatgagaaaaaagctcctgt

SEQ ID NO: 838451 - DNA, 22 bp, Artificial Sequence
  chemically synthesized
atatgagaaaaaagctcctgtt

SEQ ID NO: 838452 - DNA, 22 bp, Artificial Sequence
  chemically synthesized
tatgagaaaaaagctcctgttt

SEQ ID NO: 838453 - DNA, 22 bp, Artificial Sequence
  chemically synthesized
agtggctaaaacaaacaggagc

SEQ ID NO: 838454 - DNA, 22 bp, Artificial Sequence
  chemically synthesized
cagtggctaaaacaaacaggag

SEQ ID NO: 838455 - DNA, 22 bp, Artificial Sequence
  chemically synthesized
cttcagtggctaaaacaaacag

SEQ ID NO: 838456 - DNA, 22 bp, Artificial Sequence
  chemically synthesized
tattacttcagtggctaaaaca

SEQ ID NO: 838457 - DNA, 22 bp, Artificial Sequence
  chemically synthesized
ctgtttgttttagccactgaag

SEQ ID NO: 838458 - DNA, 22 bp, Artificial Sequence
  chemically synthesized
tttgttttagccactgaagtaa

SEQ ID NO: 838459 - DNA, 22 bp, Artificial Sequence
  chemically synthesized
gttttagccactgaagtaatat

SEQ ID NO: 838460 - DNA, 22 bp, Artificial Sequence
  chemically synthesized
ttttagccactgaagtaatata

SEQ ID NO: 838461 - DNA, 22 bp, Artificial Sequence
  chemically synthesized
aaggtaataaactatattactt

SEQ ID NO: 838462 - DNA, 22 bp, Artificial Sequence
  chemically synthesized
tagccactgaagtaatatagtt

SEQ ID NO: 838463 - DNA, 22 bp, Artificial Sequence
  chemically synthesized
agccactgaagtaatatagttt

SEQ ID NO: 838464 - DNA, 22 bp, Artificial Sequence
  chemically synthesized
gttgaaggtaataaactatatt

SEQ ID NO: 838465 - DNA, 22 bp, Artificial Sequence
  chemically synthesized
gccactgaagtaatatagttta

SEQ ID NO: 838466 - DNA, 22 bp, Artificial Sequence
  chemically synthesized
ttagttgaaggtaataaactat

SEQ ID NO: 838467 - DNA, 22 bp, Artificial Sequence
  chemically synthesized
gttagttgaaggtaataaacta

SEQ ID NO: 838468 - DNA, 22 bp, Artificial Sequence
  chemically synthesized
ttgttagttgaaggtaataaac

SEQ ID NO: 838469 - DNA, 22 bp, Artificial Sequence
  chemically synthesized
aagtaatatagtttattacctt

SEQ ID NO: 838470 - DNA, 22 bp, Artificial Sequence
  chemically synthesized
ggactcttgttagttgaaggta

SEQ ID NO: 838471 - DNA, 22 bp, Artificial Sequence
  chemically synthesized
attaccttcaactaacaagagt

SEQ ID NO: 838472 - DNA, 22 bp, Artificial Sequence
  chemically synthesized
ttaccttcaactaacaagagtc

SEQ ID NO: 838473 - DNA, 22 bp, Artificial Sequence
  chemically synthesized
ccttcaactaacaagagtccta

SEQ ID NO: 838474 - DNA, 22 bp, Artificial Sequence
  chemically synthesized
aggggtaaccattaggactctt

SEQ ID NO: 838475 - DNA, 22 bp, Artificial Sequence
  chemically synthesized
caactaacaagagtcctaatgg

SEQ ID NO: 838476 - DNA, 22 bp, Artificial Sequence
  chemically synthesized
aactaacaagagtcctaatggt

SEQ ID NO: 838477 - DNA, 22 bp, Artificial Sequence
  chemically synthesized
gactgaggggtaaccattagga

SEQ ID NO: 838478 - DNA, 22 bp, Artificial Sequence
  chemically synthesized
acaagagtcctaatggttaccc

SEQ ID NO: 838479 - DNA, 22 bp, Artificial Sequence
  chemically synthesized
cacaaaaagactggactgaggg

SEQ ID NO: 838480 - DNA, 22 bp, Artificial Sequence
  chemically synthesized
atggttacccctcagtccagtc

SEQ ID NO: 838481 - DNA, 22 bp, Artificial Sequence
  chemically synthesized
attacacaaaaagactggactg

SEQ ID NO: 838482 - DNA, 22 bp, Artificial Sequence
  chemically synthesized
cctgattacacaaaaagactgg

SEQ ID NO: 838483 - DNA, 22 bp, Artificial Sequence
  chemically synthesized
cccctcagtccagtctttttgt

SEQ ID NO: 838484 - DNA, 22 bp, Artificial Sequence
  chemically synthesized
tctacctgattacacaaaaaga

SEQ ID NO: 838485 - DNA, 22 bp, Artificial Sequence
  chemically synthesized
agtccagtctttttgtgtaatc

SEQ ID NO: 838486 - DNA, 22 bp, Artificial Sequence
  chemically synthesized
tactatctacctgattacacaa

SEQ ID NO: 838487 - DNA, 22 bp, Artificial Sequence
  chemically synthesized
tttgtgtaatcaggtagatagt

SEQ ID NO: 838488 - DNA, 22 bp, Artificial Sequence
  chemically synthesized
gaggaaagctatactatctacc

SEQ ID NO: 838489 - DNA, 22 bp, Artificial Sequence
  chemically synthesized
ttgtgtaatcaggtagatagta

SEQ ID NO: 838490 - DNA, 22 bp, Artificial Sequence
  chemically synthesized
tgtgtaatcaggtagatagtat

SEQ ID NO: 838491 - DNA, 22 bp, Artificial Sequence
  chemically synthesized
gtgtaatcaggtagatagtata

SEQ ID NO: 838492 - DNA, 22 bp, Artificial Sequence
  chemically synthesized
tgtaatcaggtagatagtatag

SEQ ID NO: 838493 - DNA, 22 bp, Artificial Sequence
  chemically synthesized
gattagaggaaagctatactat

SEQ ID NO: 838494 - DNA, 22 bp, Artificial Sequence
  chemically synthesized
tggattagaggaaagctatact

SEQ ID NO: 838495 - DNA, 22 bp, Artificial Sequence
  chemically synthesized
ctggattagaggaaagctatac

SEQ ID NO: 838496 - DNA, 22 bp, Artificial Sequence
  chemically synthesized
atttctggattagaggaaagct

SEQ ID NO: 838497 - DNA, 22 bp, Artificial Sequence
  chemically synthesized
gatttctggattagaggaaagc

SEQ ID NO: 838498 - DNA, 22 bp, Artificial Sequence
  chemically synthesized
ttgatttctggattagaggaaa

SEQ ID NO: 838499 - DNA, 22 bp, Artificial Sequence
  chemically synthesized
atccccattcttgatttctgga

SEQ ID NO: 838500 - DNA, 22 bp, Artificial Sequence
  chemically synthesized
aatccccattcttgatttctgg

SEQ ID NO: 838501 - DNA, 22 bp, Artificial Sequence
  chemically synthesized
tcctctaatccagaaatcaaga

SEQ ID NO: 838502 - DNA, 22 bp, Artificial Sequence
  chemically synthesized
cttaatccccattcttgatttc

SEQ ID NO: 838503 - DNA, 22 bp, Artificial Sequence
  chemically synthesized
cctctaatccagaaatcaagaa

SEQ ID NO: 838504 - DNA, 22 bp, Artificial Sequence
  chemically synthesized
ccttaatccccattcttgattt

SEQ ID NO: 838505 - DNA, 22 bp, Artificial Sequence
  chemically synthesized
ctctaatccagaaatcaagaat

SEQ ID NO: 838506 - DNA, 22 bp, Artificial Sequence
  chemically synthesized
taatccagaaatcaagaatggg

SEQ ID NO: 838507 - DNA, 22 bp, Artificial Sequence
  chemically synthesized
atttccttaatccccattcttg

SEQ ID NO: 838508 - DNA, 22 bp, Artificial Sequence
  chemically synthesized
aatttccttaatccccattctt

SEQ ID NO: 838509 - DNA, 22 bp, Artificial Sequence
  chemically synthesized
atccagaaatcaagaatgggga

SEQ ID NO: 838510 - DNA, 22 bp, Artificial Sequence
  chemically synthesized
cttaatttccttaatccccatt

SEQ ID NO: 838511 - DNA, 22 bp, Artificial Sequence
  chemically synthesized
attccttaatttccttaatccc

SEQ ID NO: 838512 - DNA, 22 bp, Artificial Sequence
  chemically synthesized
cattccttaatttccttaatcc

SEQ ID NO: 838513 - DNA, 22 bp, Artificial Sequence
  chemically synthesized
atttcattccttaatttcctta

SEQ ID NO: 838514 - DNA, 22 bp, Artificial Sequence
  chemically synthesized
aatttcattccttaatttcctt

SEQ ID NO: 838515 - DNA, 22 bp, Artificial Sequence
  chemically synthesized
taatttcattccttaatttcct

SEQ ID NO: 838516 - DNA, 22 bp, Artificial Sequence
  chemically synthesized
tttaatttcattccttaatttc

SEQ ID NO: 838517 - DNA, 22 bp, Artificial Sequence
  chemically synthesized
ctttaatttcattccttaattt

SEQ ID NO: 838518 - DNA, 22 bp, Artificial Sequence
  chemically synthesized
aggaaattaaggaatgaaatta

SEQ ID NO: 838519 - DNA, 22 bp, Artificial Sequence
  chemically synthesized
aggaatgaaattaaagaaggac

SEQ ID NO: 838520 - DNA, 22 bp, Artificial Sequence
  chemically synthesized
gtgagataaatacataagaatg

SEQ ID NO: 838521 - DNA, 22 bp, Artificial Sequence
  chemically synthesized
aagaaggacattcttatgtatt

SEQ ID NO: 838522 - DNA, 22 bp, Artificial Sequence
  chemically synthesized
tgttagtgagataaatacataa

SEQ ID NO: 838523 - DNA, 22 bp, Artificial Sequence
  chemically synthesized
atgttagtgagataaatacata

SEQ ID NO: 838524 - DNA, 22 bp, Artificial Sequence
  chemically synthesized
tatgttagtgagataaatacat

SEQ ID NO: 838525 - DNA, 22 bp, Artificial Sequence
  chemically synthesized
ttatgttagtgagataaataca

SEQ ID NO: 838526 - DNA, 22 bp, Artificial Sequence
  chemically synthesized
cttttatgttagtgagataaat

SEQ ID NO: 838527 - DNA, 22 bp, Artificial Sequence
  chemically synthesized
ttacttttatgttagtgagata

SEQ ID NO: 838528 - DNA, 22 bp, Artificial Sequence
  chemically synthesized
ttatgtatttatctcactaaca

SEQ ID NO: 838529 - DNA, 22 bp, Artificial Sequence
  chemically synthesized
atgtatttatctcactaacata

SEQ ID NO: 838530 - DNA, 22 bp, Artificial Sequence
  chemically synthesized
tgtatttatctcactaacataa

SEQ ID NO: 838531 - DNA, 22 bp, Artificial Sequence
  chemically synthesized
cgattattacttttatgttagt

SEQ ID NO: 838532 - DNA, 22 bp, Artificial Sequence
  chemically synthesized
atctcactaacataaaagtaat

SEQ ID NO: 838533 - DNA, 22 bp, Artificial Sequence
  chemically synthesized
tctcactaacataaaagtaata

SEQ ID NO: 838534 - DNA, 22 bp, Artificial Sequence
  chemically synthesized
actaacataaaagtaataatcg

SEQ ID NO: 838535 - DNA, 22 bp, Artificial Sequence
  chemically synthesized
acataaaagtaataatcgcaat

SEQ ID NO: 838536 - DNA, 22 bp, Artificial Sequence
  chemically synthesized
taacaatggtgatgaaagcaat

SEQ ID NO: 838537 - DNA, 22 bp, Artificial Sequence
  chemically synthesized
tgagataattataacaatggtg

SEQ ID NO: 838538 - DNA, 22 bp, Artificial Sequence
  chemically synthesized
gttatgagataattataacaat

SEQ ID NO: 838539 - DNA, 22 bp, Artificial Sequence
  chemically synthesized
ctttcatcaccattgttataat

SEQ ID NO: 838540 - DNA, 22 bp, Artificial Sequence
  chemically synthesized
tcatcaccattgttataattat

SEQ ID NO: 838541 - DNA, 22 bp, Artificial Sequence
  chemically synthesized
catcaccattgttataattatc

SEQ ID NO: 838542 - DNA, 22 bp, Artificial Sequence
  chemically synthesized
atcaccattgttataattatct

SEQ ID NO: 838543 - DNA, 22 bp, Artificial Sequence
  chemically synthesized
atagttggttatgagataatta

SEQ ID NO: 838544 - DNA, 22 bp, Artificial Sequence
  chemically synthesized
ggaagctaatagttggttatga

SEQ ID NO: 838545 - DNA, 22 bp, Artificial Sequence
  chemically synthesized
ttataattatctcataaccaac

SEQ ID NO: 838546 - DNA, 22 bp, Artificial Sequence
  chemically synthesized
taattatctcataaccaactat

SEQ ID NO: 838547 - DNA, 22 bp, Artificial Sequence
  chemically synthesized
tctcataaccaactattagctt

SEQ ID NO: 838548 - DNA, 22 bp, Artificial Sequence
  chemically synthesized
acaaaaagacctaggaagctaa

SEQ ID NO: 838549 - DNA, 22 bp, Artificial Sequence
  chemically synthesized
ataaccaactattagcttccta

SEQ ID NO: 838550 - DNA, 22 bp, Artificial Sequence
  chemically synthesized
gaggcctaacaaaaagacctag

SEQ ID NO: 838551 - DNA, 22 bp, Artificial Sequence
  chemically synthesized
ggaggcctaacaaaaagaccta

SEQ ID NO: 838552 - DNA, 22 bp, Artificial Sequence
  chemically synthesized
tggaggcctaacaaaaagacct

SEQ ID NO: 838553 - DNA, 22 bp, Artificial Sequence
  chemically synthesized
ttagcttcctaggtctttttgt

SEQ ID NO: 838554 - DNA, 22 bp, Artificial Sequence
  chemically synthesized
gcttcctaggtctttttgttag

SEQ ID NO: 838555 - DNA, 22 bp, Artificial Sequence
  chemically synthesized
aattttggaggcctaacaaaaa

SEQ ID NO: 838556 - DNA, 22 bp, Artificial Sequence
  chemically synthesized
gaattttggaggcctaacaaaa

SEQ ID NO: 838557 - DNA, 22 bp, Artificial Sequence
  chemically synthesized
tgaattttggaggcctaacaaa

SEQ ID NO: 838558 - DNA, 22 bp, Artificial Sequence
  chemically synthesized
ttgaattttggaggcctaacaa

SEQ ID NO: 838559 - DNA, 22 bp, Artificial Sequence
  chemically synthesized
cctaggtctttttgttaggcct

SEQ ID NO: 838560 - DNA, 22 bp, Artificial Sequence
  chemically synthesized
ctaggtctttttgttaggcctc

SEQ ID NO: 838561 - DNA, 22 bp, Artificial Sequence
  chemically synthesized
ggtctttttgttaggcctccaa

SEQ ID NO: 838562 - DNA, 22 bp, Artificial Sequence
  chemically synthesized
tttgttaggcctccaaaattca

SEQ ID NO: 838563 - DNA, 22 bp, Artificial Sequence
  chemically synthesized
ttgttaggcctccaaaattcaa

SEQ ID NO: 838564 - DNA, 22 bp, Artificial Sequence
  chemically synthesized
taaagaaagcttttgaattttg

SEQ ID NO: 838565 - DNA, 22 bp, Artificial Sequence
  chemically synthesized
tgttaggcctccaaaattcaaa

SEQ ID NO: 838566 - DNA, 22 bp, Artificial Sequence
  chemically synthesized
gttaggcctccaaaattcaaaa

SEQ ID NO: 838567 - DNA, 22 bp, Artificial Sequence
  chemically synthesized
ttaggcctccaaaattcaaaag

SEQ ID NO: 838568 - DNA, 22 bp, Artificial Sequence
  chemically synthesized
ggcctccaaaattcaaaagctt

SEQ ID NO: 838569 - DNA, 22 bp, Artificial Sequence
  chemically synthesized
caaaattcaaaagctttcttta

SEQ ID NO: 838570 - DNA, 22 bp, Artificial Sequence
  chemically synthesized
aaaagctttctttacaataccc

SEQ ID NO: 838571 - DNA, 22 bp, Artificial Sequence
  chemically synthesized
cacatggaaaatatgggtattg

SEQ ID NO: 838572 - DNA, 22 bp, Artificial Sequence
  chemically synthesized
gctccacatggaaaatatgggt

SEQ ID NO: 838573 - DNA, 22 bp, Artificial Sequence
  chemically synthesized
tctttacaatacccatattttc

SEQ ID NO: 838574 - DNA, 22 bp, Artificial Sequence
  chemically synthesized
ctttacaatacccatattttcc

SEQ ID NO: 838575 - DNA, 22 bp, Artificial Sequence
  chemically synthesized
tttacaatacccatattttcca

SEQ ID NO: 838576 - DNA, 22 bp, Artificial Sequence
  chemically synthesized
tacaatacccatattttccatg

SEQ ID NO: 838577 - DNA, 22 bp, Artificial Sequence
  chemically synthesized
agcctggctccacatggaaaat

SEQ ID NO: 838578 - DNA, 22 bp, Artificial Sequence
  chemically synthesized
acaatacccatattttccatgt

SEQ ID NO: 838579 - DNA, 22 bp, Artificial Sequence
  chemically synthesized
caatacccatattttccatgtg

SEQ ID NO: 838580 - DNA, 22 bp, Artificial Sequence
  chemically synthesized
aggtccactcagcctggctcca

SEQ ID NO: 838581 - DNA, 22 bp, Artificial Sequence
  chemically synthesized
tctcaggtccactcagcctggc

SEQ ID NO: 838582 - DNA, 22 bp, Artificial Sequence
  chemically synthesized
tccatgtggagccaggctgagt

SEQ ID NO: 838583 - DNA, 22 bp, Artificial Sequence
  chemically synthesized
ccatgtggagccaggctgagtg

SEQ ID NO: 838584 - DNA, 22 bp, Artificial Sequence
  chemically synthesized
catgtggagccaggctgagtgg

SEQ ID NO: 838585 - DNA, 22 bp, Artificial Sequence
  chemically synthesized
cgggacatgatgataattatct

SEQ ID NO: 838586 - DNA, 22 bp, Artificial Sequence
  chemically synthesized
agtggacctgagataattatca

SEQ ID NO: 838587 - DNA, 22 bp, Artificial Sequence
  chemically synthesized
tagctccgggacatgatgataa

SEQ ID NO: 838588 - DNA, 22 bp, Artificial Sequence
  chemically synthesized
atagctccgggacatgatgata

SEQ ID NO: 838589 - DNA, 22 bp, Artificial Sequence
  chemically synthesized
tatagctccgggacatgatgat

SEQ ID NO: 838590 - DNA, 22 bp, Artificial Sequence
  chemically synthesized
agataattatcatcatgtcccg

SEQ ID NO: 838591 - DNA, 22 bp, Artificial Sequence
  chemically synthesized
tcatcatgtcccggagctataa

SEQ ID NO: 838592 - DNA, 22 bp, Artificial Sequence
  chemically synthesized
aaagaaacaagaacccaccaaa

SEQ ID NO: 838593 - DNA, 22 bp, Artificial Sequence
  chemically synthesized
gaaagaaacaagaacccaccaa

SEQ ID NO: 838594 - DNA, 22 bp, Artificial Sequence
  chemically synthesized
ttgaaagaaacaagaacccacc

SEQ ID NO: 838595 - DNA, 22 bp, Artificial Sequence
  chemically synthesized
cttgaaagaaacaagaacccac

SEQ ID NO: 838596 - DNA, 22 bp, Artificial Sequence
  chemically synthesized
taaagttttggtgggttcttgt

SEQ ID NO: 838597 - DNA, 22 bp, Artificial Sequence
  chemically synthesized
tttcttgaaagaaacaagaacc

SEQ ID NO: 838598 - DNA, 22 bp, Artificial Sequence
  chemically synthesized
gtttcttgaaagaaacaagaac

SEQ ID NO: 838599 - DNA, 22 bp, Artificial Sequence
  chemically synthesized
tgtttcttgaaagaaacaagaa

SEQ ID NO: 838600 - DNA, 22 bp, Artificial Sequence
  chemically synthesized
ttgtttcttgaaagaaacaaga

SEQ ID NO: 838601 - DNA, 22 bp, Artificial Sequence
  chemically synthesized
tggtgggttcttgtttctttca

SEQ ID NO: 838602 - DNA, 22 bp, Artificial Sequence
  chemically synthesized
ggtgggttcttgtttctttcaa

SEQ ID NO: 838603 - DNA, 22 bp, Artificial Sequence
  chemically synthesized
gtgggttcttgtttctttcaag

SEQ ID NO: 838604 - DNA, 22 bp, Artificial Sequence
  chemically synthesized
ttgtttctttcaagaaacaaaa

SEQ ID NO: 838605 - DNA, 22 bp, Artificial Sequence
  chemically synthesized
gtttctttcaagaaacaaaaac

SEQ ID NO: 838606 - DNA, 22 bp, Artificial Sequence
  chemically synthesized
tttctttcaagaaacaaaaaca

SEQ ID NO: 838607 - DNA, 22 bp, Artificial Sequence
  chemically synthesized
ctttcaagaaacaaaaacacat

SEQ ID NO: 838608 - DNA, 22 bp, Artificial Sequence
  chemically synthesized
tttcaagaaacaaaaacacatg

SEQ ID NO: 838609 - DNA, 22 bp, Artificial Sequence
  chemically synthesized
tcaagaaacaaaaacacatgtt

SEQ ID NO: 838610 - DNA, 22 bp, Artificial Sequence
  chemically synthesized
caagaaacaaaaacacatgtta

SEQ ID NO: 838611 - DNA, 22 bp, Artificial Sequence
  chemically synthesized
aagaaacaaaaacacatgttat

SEQ ID NO: 838612 - DNA, 22 bp, Artificial Sequence
  chemically synthesized
catgtgtacaggaaacacgtgc

SEQ ID NO: 838613 - DNA, 22 bp, Artificial Sequence
  chemically synthesized
tcctacatgtgtacaggaaaca

SEQ ID NO: 838614 - DNA, 22 bp, Artificial Sequence
  chemically synthesized
atcctacatgtgtacaggaaac

SEQ ID NO: 838615 - DNA, 22 bp, Artificial Sequence
  chemically synthesized
tatcctacatgtgtacaggaaa

SEQ ID NO: 838616 - DNA, 22 bp, Artificial Sequence
  chemically synthesized
ttctgcacgtgtttcctgtaca

SEQ ID NO: 838617 - DNA, 22 bp, Artificial Sequence
  chemically synthesized
tgcacgtgtttcctgtacacat

SEQ ID NO: 838618 - DNA, 22 bp, Artificial Sequence
  chemically synthesized
cacgtgtttcctgtacacatgt

SEQ ID NO: 838619 - DNA, 22 bp, Artificial Sequence
  chemically synthesized
tacatgtcctttatcctacatg

SEQ ID NO: 838620 - DNA, 22 bp, Artificial Sequence
  chemically synthesized
gtacatgtcctttatcctacat

SEQ ID NO: 838621 - DNA, 22 bp, Artificial Sequence
  chemically synthesized
cctgtacacatgtaggataaag

SEQ ID NO: 838622 - DNA, 22 bp, Artificial Sequence
  chemically synthesized
cttgtacatgtcctttatccta

SEQ ID NO: 838623 - DNA, 22 bp, Artificial Sequence
  chemically synthesized
ctgtacacatgtaggataaagg

SEQ ID NO: 838624 - DNA, 22 bp, Artificial Sequence
  chemically synthesized
tacacatgtaggataaaggaca

SEQ ID NO: 838625 - DNA, 22 bp, Artificial Sequence
  chemically synthesized
cagactacttgtacatgtcctt

SEQ ID NO: 838626 - DNA, 22 bp, Artificial Sequence
  chemically synthesized
aaagttgcagactacttgtaca

SEQ ID NO: 838627 - DNA, 22 bp, Artificial Sequence
  chemically synthesized
ccctaaaagttgcagactactt

SEQ ID NO: 838628 - DNA, 22 bp, Artificial Sequence
  chemically synthesized
gccctaaaagttgcagactact

SEQ ID NO: 838629 - DNA, 22 bp, Artificial Sequence
  chemically synthesized
tgccctaaaagttgcagactac

SEQ ID NO: 838630 - DNA, 22 bp, Artificial Sequence
  chemically synthesized
tttgccctaaaagttgcagact

SEQ ID NO: 838631 - DNA, 22 bp, Artificial Sequence
  chemically synthesized
caacttttagggcaaagagtat

SEQ ID NO: 838632 - DNA, 22 bp, Artificial Sequence
  chemically synthesized
ccacaaatgtcaatcatactct

SEQ ID NO: 838633 - DNA, 22 bp, Artificial Sequence
  chemically synthesized
ttagggcaaagagtatgattga

SEQ ID NO: 838634 - DNA, 22 bp, Artificial Sequence
  chemically synthesized
tagggcaaagagtatgattgac

SEQ ID NO: 838635 - DNA, 22 bp, Artificial Sequence
  chemically synthesized
agggcaaagagtatgattgaca

SEQ ID NO: 838636 - DNA, 22 bp, Artificial Sequence
  chemically synthesized
gggcaaagagtatgattgacat

SEQ ID NO: 838637 - DNA, 22 bp, Artificial Sequence
  chemically synthesized
gacactcccacaaatgtcaatc

SEQ ID NO: 838638 - DNA, 22 bp, Artificial Sequence
  chemically synthesized
aatatccccattagacactccc

SEQ ID NO: 838639 - DNA, 22 bp, Artificial Sequence
  chemically synthesized
gaatatccccattagacactcc

SEQ ID NO: 838640 - DNA, 22 bp, Artificial Sequence
  chemically synthesized
tgaatatccccattagacactc

SEQ ID NO: 838641 - DNA, 22 bp, Artificial Sequence
  chemically synthesized
acatttgtgggagtgtctaatg

SEQ ID NO: 838642 - DNA, 22 bp, Artificial Sequence
  chemically synthesized
ctttgaatatccccattagaca

SEQ ID NO: 838643 - DNA, 22 bp, Artificial Sequence
  chemically synthesized
gtgggagtgtctaatggggata

SEQ ID NO: 838644 - DNA, 22 bp, Artificial Sequence
  chemically synthesized
tgggagtgtctaatggggatat

SEQ ID NO: 838645 - DNA, 22 bp, Artificial Sequence
  chemically synthesized
atggggatattcaaagcaacat

SEQ ID NO: 838646 - DNA, 22 bp, Artificial Sequence
  chemically synthesized
aaacatgatcccatgttgcttt

SEQ ID NO: 838647 - DNA, 22 bp, Artificial Sequence
  chemically synthesized
tgaaacatgatcccatgttgct

SEQ ID NO: 838648 - DNA, 22 bp, Artificial Sequence
  chemically synthesized
ctgaaacatgatcccatgttgc

SEQ ID NO: 838649 - DNA, 22 bp, Artificial Sequence
  chemically synthesized
tctgaaacatgatcccatgttg

SEQ ID NO: 838650 - DNA, 22 bp, Artificial Sequence
  chemically synthesized
agttttctgaaacatgatccca

SEQ ID NO: 838651 - DNA, 22 bp, Artificial Sequence
  chemically synthesized
aaagcaacatgggatcatgttt

SEQ ID NO: 838652 - DNA, 22 bp, Artificial Sequence
  chemically synthesized
ccctgagttttctgaaacatga

SEQ ID NO: 838653 - DNA, 22 bp, Artificial Sequence
  chemically synthesized
gccctgagttttctgaaacatg

SEQ ID NO: 838654 - DNA, 22 bp, Artificial Sequence
  chemically synthesized
tgccctgagttttctgaaacat

SEQ ID NO: 838655 - DNA, 22 bp, Artificial Sequence
  chemically synthesized
tgagttttgccctgagttttct

SEQ ID NO: 838656 - DNA, 22 bp, Artificial Sequence
  chemically synthesized
cagaaaactcagggcaaaactc

SEQ ID NO: 838657 - DNA, 22 bp, Artificial Sequence
  chemically synthesized
agaaaactcagggcaaaactca

SEQ ID NO: 838658 - DNA, 22 bp, Artificial Sequence
  chemically synthesized
ccccaggacaagcaacctatga

SEQ ID NO: 838659 - DNA, 22 bp, Artificial Sequence
  chemically synthesized
accccaggacaagcaacctatg

SEQ ID NO: 838660 - DNA, 22 bp, Artificial Sequence
  chemically synthesized
agggcaaaactcataggttgct

SEQ ID NO: 838661 - DNA, 22 bp, Artificial Sequence
  chemically synthesized
gcttaccccaggacaagcaacc

SEQ ID NO: 838662 - DNA, 22 bp, Artificial Sequence
  chemically synthesized
ataggttgcttgtcctggggta

SEQ ID NO: 838663 - DNA, 22 bp, Artificial Sequence
  chemically synthesized
tgatgtggtggctggcttaccc

SEQ ID NO: 838664 - DNA, 22 bp, Artificial Sequence
  chemically synthesized
atgatgtggtggctggcttacc

SEQ ID NO: 838665 - DNA, 22 bp, Artificial Sequence
  chemically synthesized
cttgtcctggggtaagccagcc

SEQ ID NO: 838666 - DNA, 22 bp, Artificial Sequence
  chemically synthesized
ttatgatgtggtggctggctta

SEQ ID NO: 838667 - DNA, 22 bp, Artificial Sequence
  chemically synthesized
gtcctggggtaagccagccacc

SEQ ID NO: 838668 - DNA, 22 bp, Artificial Sequence
  chemically synthesized
tcctggggtaagccagccacca

SEQ ID NO: 838669 - DNA, 22 bp, Artificial Sequence
  chemically synthesized
agtgttcttatgatgtggtggc

SEQ ID NO: 838670 - DNA, 22 bp, Artificial Sequence
  chemically synthesized
gagtgttcttatgatgtggtgg

SEQ ID NO: 838671 - DNA, 22 bp, Artificial Sequence
  chemically synthesized
gggtaagccagccaccacatca

SEQ ID NO: 838672 - DNA, 22 bp, Artificial Sequence
  chemically synthesized
cttgagtgttcttatgatgtgg

SEQ ID NO: 838673 - DNA, 22 bp, Artificial Sequence
  chemically synthesized
catgggactacttgagtgttct

SEQ ID NO: 838674 - DNA, 22 bp, Artificial Sequence
  chemically synthesized
ctccatgggactacttgagtgt

SEQ ID NO: 838675 - DNA, 22 bp, Artificial Sequence
  chemically synthesized
aacgagttcctccatgggacta

SEQ ID NO: 838676 - DNA, 22 bp, Artificial Sequence
  chemically synthesized
taaacgagttcctccatgggac

SEQ ID NO: 838677 - DNA, 22 bp, Artificial Sequence
  chemically synthesized
cctctaaacgagttcctccatg

SEQ ID NO: 838678 - DNA, 22 bp, Artificial Sequence
  chemically synthesized
ccctctaaacgagttcctccat

SEQ ID NO: 838679 - DNA, 22 bp, Artificial Sequence
  chemically synthesized
aagtagtcccatggaggaactc

SEQ ID NO: 838680 - DNA, 22 bp, Artificial Sequence
  chemically synthesized
gtttccctctaaacgagttcct

SEQ ID NO: 838681 - DNA, 22 bp, Artificial Sequence
  chemically synthesized
gttggtttccctctaaacgagt

SEQ ID NO: 838682 - DNA, 22 bp, Artificial Sequence
  chemically synthesized
tctagttggtttccctctaaac

SEQ ID NO: 838683 - DNA, 22 bp, Artificial Sequence
  chemically synthesized
gtgctgtctagttggtttccct

SEQ ID NO: 838684 - DNA, 22 bp, Artificial Sequence
  chemically synthesized
gtttagagggaaaccaactaga

SEQ ID NO: 838685 - DNA, 22 bp, Artificial Sequence
  chemically synthesized
tgagttggtgctgtctagttgg

SEQ ID NO: 838686 - DNA, 22 bp, Artificial Sequence
  chemically synthesized
gtgagttggtgctgtctagttg

SEQ ID NO: 838687 - DNA, 22 bp, Artificial Sequence
  chemically synthesized
agagggaaaccaactagacagc

SEQ ID NO: 838688 - DNA, 22 bp, Artificial Sequence
  chemically synthesized
gagggaaaccaactagacagca

SEQ ID NO: 838689 - DNA, 22 bp, Artificial Sequence
  chemically synthesized
tatagcttgtgagttggtgctg

SEQ ID NO: 838690 - DNA, 22 bp, Artificial Sequence
  chemically synthesized
gtatagcttgtgagttggtgct

SEQ ID NO: 838691 - DNA, 22 bp, Artificial Sequence
  chemically synthesized
cttgtatagcttgtgagttggt

SEQ ID NO: 838692 - DNA, 22 bp, Artificial Sequence
  chemically synthesized
gacagcaccaactcacaagcta

SEQ ID NO: 838693 - DNA, 22 bp, Artificial Sequence
  chemically synthesized
acagtgagttacttgtatagct

SEQ ID NO: 838694 - DNA, 22 bp, Artificial Sequence
  chemically synthesized
cacagtgagttacttgtatagc

SEQ ID NO: 838695 - DNA, 22 bp, Artificial Sequence
  chemically synthesized
tcacagtgagttacttgtatag

SEQ ID NO: 838696 - DNA, 22 bp, Artificial Sequence
  chemically synthesized
actttcacagtgagttacttgt

SEQ ID NO: 838697 - DNA, 22 bp, Artificial Sequence
  chemically synthesized
acaagctatacaagtaactcac

SEQ ID NO: 838698 - DNA, 22 bp, Artificial Sequence
  chemically synthesized
aaggattcactttcacagtgag

SEQ ID NO: 838699 - DNA, 22 bp, Artificial Sequence
  chemically synthesized
tacaagtaactcactgtgaaag

SEQ ID NO: 838700 - DNA, 22 bp, Artificial Sequence
  chemically synthesized
gggctgaaggattcactttcac

SEQ ID NO: 838701 - DNA, 22 bp, Artificial Sequence
  chemically synthesized
actggggctgaaggattcactt

SEQ ID NO: 838702 - DNA, 22 bp, Artificial Sequence
  chemically synthesized
gactggggctgaaggattcact

SEQ ID NO: 838703 - DNA, 22 bp, Artificial Sequence
  chemically synthesized
actgtgaaagtgaatccttcag

SEQ ID NO: 838704 - DNA, 22 bp, Artificial Sequence
  chemically synthesized
tgaaagtgaatccttcagcccc

SEQ ID NO: 838705 - DNA, 22 bp, Artificial Sequence
  chemically synthesized
cagtcatatgatggcttgactg

SEQ ID NO: 838706 - DNA, 22 bp, Artificial Sequence
  chemically synthesized
ggctgcagtcatatgatggctt

SEQ ID NO: 838707 - DNA, 22 bp, Artificial Sequence
  chemically synthesized
cagccccagtcaagccatcata

SEQ ID NO: 838708 - DNA, 22 bp, Artificial Sequence
  chemically synthesized
agccccagtcaagccatcatat

SEQ ID NO: 838709 - DNA, 22 bp, Artificial Sequence
  chemically synthesized
agatgtcaattaggctgcagtc

SEQ ID NO: 838710 - DNA, 22 bp, Artificial Sequence
  chemically synthesized
cactcagatgtcaattaggctg

SEQ ID NO: 838711 - DNA, 22 bp, Artificial Sequence
  chemically synthesized
atgatgttgcactcagatgtca

SEQ ID NO: 838712 - DNA, 22 bp, Artificial Sequence
  chemically synthesized
cagcctaattgacatctgagtg

SEQ ID NO: 838713 - DNA, 22 bp, Artificial Sequence
  chemically synthesized
attgacatctgagtgcaacatc

SEQ ID NO: 838714 - DNA, 22 bp, Artificial Sequence
  chemically synthesized
acgatcactcatgatgttgcac

SEQ ID NO: 838715 - DNA, 22 bp, Artificial Sequence
  chemically synthesized
acatctgagtgcaacatcatga

SEQ ID NO: 838716 - DNA, 22 bp, Artificial Sequence
  chemically synthesized
tctcacgatcactcatgatgtt

SEQ ID NO: 838717 - DNA, 22 bp, Artificial Sequence
  chemically synthesized
tgtctcacgatcactcatgatg

SEQ ID NO: 838718 - DNA, 22 bp, Artificial Sequence
  chemically synthesized
agtgcaacatcatgagtgatcg

SEQ ID NO: 838719 - DNA, 22 bp, Artificial Sequence
  chemically synthesized
aggggttctgtctcacgatcac

SEQ ID NO: 838720 - DNA, 22 bp, Artificial Sequence
  chemically synthesized
gttgaggggttctgtctcacga

SEQ ID NO: 838721 - DNA, 22 bp, Artificial Sequence
  chemically synthesized
ggttgaggggttctgtctcacg

SEQ ID NO: 838722 - DNA, 22 bp, Artificial Sequence
  chemically synthesized
cttggttgaggggttctgtctc

SEQ ID NO: 838723 - DNA, 22 bp, Artificial Sequence
  chemically synthesized
atgcattgcttggttgaggggt

SEQ ID NO: 838724 - DNA, 22 bp, Artificial Sequence
  chemically synthesized
taggtcaggattcatgcattgc

SEQ ID NO: 838725 - DNA, 22 bp, Artificial Sequence
  chemically synthesized
tgtaggtcaggattcatgcatt

SEQ ID NO: 838726 - DNA, 22 bp, Artificial Sequence
  chemically synthesized
aaccaagcaatgcatgaatcct

SEQ ID NO: 838727 - DNA, 22 bp, Artificial Sequence
  chemically synthesized
ataggttctgtaggtcaggatt

SEQ ID NO: 838728 - DNA, 22 bp, Artificial Sequence
  chemically synthesized
tcactcataggttctgtaggtc

SEQ ID NO: 838729 - DNA, 22 bp, Artificial Sequence
  chemically synthesized
ttatcactcataggttctgtag

SEQ ID NO: 838730 - DNA, 22 bp, Artificial Sequence
  chemically synthesized
attatcactcataggttctgta

SEQ ID NO: 838731 - DNA, 22 bp, Artificial Sequence
  chemically synthesized
acctacagaacctatgagtgat

SEQ ID NO: 838732 - DNA, 22 bp, Artificial Sequence
  chemically synthesized
cagaacctatgagtgataataa

SEQ ID NO: 838733 - DNA, 22 bp, Artificial Sequence
  chemically synthesized
aagtagcaataatcatttatta

SEQ ID NO: 838734 - DNA, 22 bp, Artificial Sequence
  chemically synthesized
tgagtgataataaatgattatt

SEQ ID NO: 838735 - DNA, 22 bp, Artificial Sequence
  chemically synthesized
gtgtcctaaagtagcaataatc

SEQ ID NO: 838736 - DNA, 22 bp, Artificial Sequence
  chemically synthesized
agtgtcctaaagtagcaataat

SEQ ID NO: 838737 - DNA, 22 bp, Artificial Sequence
  chemically synthesized
ttgctactttaggacactaagt

SEQ ID NO: 838738 - DNA, 22 bp, Artificial Sequence
  chemically synthesized
ctactttaggacactaagtttg

SEQ ID NO: 838739 - DNA, 22 bp, Artificial Sequence
  chemically synthesized
taaaacaatcaccccaaactta

SEQ ID NO: 838740 - DNA, 22 bp, Artificial Sequence
  chemically synthesized
ctttaggacactaagtttgggg

SEQ ID NO: 838741 - DNA, 22 bp, Artificial Sequence
  chemically synthesized
ctgtaaaacaatcaccccaaac

SEQ ID NO: 838742 - DNA, 22 bp, Artificial Sequence
  chemically synthesized
taggacactaagtttggggtga

SEQ ID NO: 838743 - DNA, 22 bp, Artificial Sequence
  chemically synthesized
aggacactaagtttggggtgat

SEQ ID NO: 838744 - DNA, 22 bp, Artificial Sequence
  chemically synthesized
ggacactaagtttggggtgatt

SEQ ID NO: 838745 - DNA, 22 bp, Artificial Sequence
  chemically synthesized
ttactgtaaaacaatcacccca

SEQ ID NO: 838746 - DNA, 22 bp, Artificial Sequence
  chemically synthesized
cctgttactgtaaaacaatcac

SEQ ID NO: 838747 - DNA, 22 bp, Artificial Sequence
  chemically synthesized
agtttggggtgattgttttaca

SEQ ID NO: 838748 - DNA, 22 bp, Artificial Sequence
  chemically synthesized
aatagttacctgttactgtaaa

SEQ ID NO: 838749 - DNA, 22 bp, Artificial Sequence
  chemically synthesized
ggggtgattgttttacagtaac

SEQ ID NO: 838750 - DNA, 22 bp, Artificial Sequence
  chemically synthesized
gaatagttacctgttactgtaa

SEQ ID NO: 838751 - DNA, 22 bp, Artificial Sequence
  chemically synthesized
gggtgattgttttacagtaaca

SEQ ID NO: 838752 - DNA, 22 bp, Artificial Sequence
  chemically synthesized
ttttacagtaacaggtaactat

SEQ ID NO: 838753 - DNA, 22 bp, Artificial Sequence
  chemically synthesized
tacagtaacaggtaactattca

SEQ ID NO: 838754 - DNA, 22 bp, Artificial Sequence
  chemically synthesized
acagtaacaggtaactattcaa

SEQ ID NO: 838755 - DNA, 22 bp, Artificial Sequence
  chemically synthesized
tcaggaaagagtttgaatagtt

SEQ ID NO: 838756 - DNA, 22 bp, Artificial Sequence
  chemically synthesized
cagtaacaggtaactattcaaa

SEQ ID NO: 838757 - DNA, 22 bp, Artificial Sequence
  chemically synthesized
gtcaggaaagagtttgaatagt

SEQ ID NO: 838758 - DNA, 22 bp, Artificial Sequence
  chemically synthesized
tgtcaggaaagagtttgaatag

SEQ ID NO: 838759 - DNA, 22 bp, Artificial Sequence
  chemically synthesized
ttgtcaggaaagagtttgaata

SEQ ID NO: 838760 - DNA, 22 bp, Artificial Sequence
  chemically synthesized
cttttgtcaggaaagagtttga

SEQ ID NO: 838761 - DNA, 22 bp, Artificial Sequence
  chemically synthesized
tacttttgtcaggaaagagttt

SEQ ID NO: 838762 - DNA, 22 bp, Artificial Sequence
  chemically synthesized
ttctacttttgtcaggaaagag

SEQ ID NO: 838763 - DNA, 22 bp, Artificial Sequence
  chemically synthesized
gttctacttttgtcaggaaaga

SEQ ID NO: 838764 - DNA, 22 bp, Artificial Sequence
  chemically synthesized
ttcaaactctttcctgacaaaa

SEQ ID NO: 838765 - DNA, 22 bp, Artificial Sequence
  chemically synthesized
aaactctttcctgacaaaagta

SEQ ID NO: 838766 - DNA, 22 bp, Artificial Sequence
  chemically synthesized
tttcctgacaaaagtagaacaa

SEQ ID NO: 838767 - DNA, 22 bp, Artificial Sequence
  chemically synthesized
tcctgacaaaagtagaacaagc

SEQ ID NO: 838768 - DNA, 22 bp, Artificial Sequence
  chemically synthesized
cctgacaaaagtagaacaagct

SEQ ID NO: 838769 - DNA, 22 bp, Artificial Sequence
  chemically synthesized
ctgacaaaagtagaacaagctc

SEQ ID NO: 838770 - DNA, 22 bp, Artificial Sequence
  chemically synthesized
acaaaagtagaacaagctcggc

SEQ ID NO: 838771 - DNA, 22 bp, Artificial Sequence
  chemically synthesized
catgaaaaggggaaagccgagc

SEQ ID NO: 838772 - DNA, 22 bp, Artificial Sequence
  chemically synthesized
tacatgaaaaggggaaagccga

SEQ ID NO: 838773 - DNA, 22 bp, Artificial Sequence
  chemically synthesized
ctacatgaaaaggggaaagccg

SEQ ID NO: 838774 - DNA, 22 bp, Artificial Sequence
  chemically synthesized
tctacatgaaaaggggaaagcc

SEQ ID NO: 838775 - DNA, 22 bp, Artificial Sequence
  chemically synthesized
tgacctttctacatgaaaaggg

SEQ ID NO: 838776 - DNA, 22 bp, Artificial Sequence
  chemically synthesized
ggctttccccttttcatgtaga

SEQ ID NO: 838777 - DNA, 22 bp, Artificial Sequence
  chemically synthesized
atagattgtgacctttctacat

SEQ ID NO: 838778 - DNA, 22 bp, Artificial Sequence
  chemically synthesized
tccccttttcatgtagaaaggt

SEQ ID NO: 838779 - DNA, 22 bp, Artificial Sequence
  chemically synthesized
ccccttttcatgtagaaaggtc

SEQ ID NO: 838780 - DNA, 22 bp, Artificial Sequence
  chemically synthesized
cccttttcatgtagaaaggtca

SEQ ID NO: 838781 - DNA, 22 bp, Artificial Sequence
  chemically synthesized
ttcatgtagaaaggtcacaatc

SEQ ID NO: 838782 - DNA, 22 bp, Artificial Sequence
  chemically synthesized
tcatgtagaaaggtcacaatct

SEQ ID NO: 838783 - DNA, 22 bp, Artificial Sequence
  chemically synthesized
catgtagaaaggtcacaatcta

SEQ ID NO: 838784 - DNA, 22 bp, Artificial Sequence
  chemically synthesized
atgtagaaaggtcacaatctat

SEQ ID NO: 838785 - DNA, 22 bp, Artificial Sequence
  chemically synthesized
taaagtaagtaggaaggattaa

SEQ ID NO: 838786 - DNA, 22 bp, Artificial Sequence
  chemically synthesized
ataaagtaagtaggaaggatta

SEQ ID NO: 838787 - DNA, 22 bp, Artificial Sequence
  chemically synthesized
ttaatccttcctacttacttta

SEQ ID NO: 838788 - DNA, 22 bp, Artificial Sequence
  chemically synthesized
agtaaaacatttataaagtaag

SEQ ID NO: 838789 - DNA, 22 bp, Artificial Sequence
  chemically synthesized
aagtaaaacatttataaagtaa

SEQ ID NO: 838790 - DNA, 22 bp, Artificial Sequence
  chemically synthesized
atccttcctacttactttataa

SEQ ID NO: 838791 - DNA, 22 bp, Artificial Sequence
  chemically synthesized
tcttaagtaaaacatttataaa

SEQ ID NO: 838792 - DNA, 22 bp, Artificial Sequence
  chemically synthesized
gtcttaagtaaaacatttataa

SEQ ID NO: 838793 - DNA, 22 bp, Artificial Sequence
  chemically synthesized
cctacttactttataaatgttt

SEQ ID NO: 838794 - DNA, 22 bp, Artificial Sequence
  chemically synthesized
ctacttactttataaatgtttt

SEQ ID NO: 838795 - DNA, 22 bp, Artificial Sequence
  chemically synthesized
tacttgtcttaagtaaaacatt

SEQ ID NO: 838796 - DNA, 22 bp, Artificial Sequence
  chemically synthesized
cttactttataaatgttttact

SEQ ID NO: 838797 - DNA, 22 bp, Artificial Sequence
  chemically synthesized
ttgtacttgtcttaagtaaaac

SEQ ID NO: 838798 - DNA, 22 bp, Artificial Sequence
  chemically synthesized
actttataaatgttttacttaa

SEQ ID NO: 838799 - DNA, 22 bp, Artificial Sequence
  chemically synthesized
ctttataaatgttttacttaag

SEQ ID NO: 838800 - DNA, 22 bp, Artificial Sequence
  chemically synthesized
tgttgtacttgtcttaagtaaa

SEQ ID NO: 838801 - DNA, 22 bp, Artificial Sequence
  chemically synthesized
tataaatgttttacttaagaca

SEQ ID NO: 838802 - DNA, 22 bp, Artificial Sequence
  chemically synthesized
ttctgttgtacttgtcttaagt

SEQ ID NO: 838803 - DNA, 22 bp, Artificial Sequence
  chemically synthesized
ataaatgttttacttaagacaa

SEQ ID NO: 838804 - DNA, 22 bp, Artificial Sequence
  chemically synthesized
attctgttgtacttgtcttaag

SEQ ID NO: 838805 - DNA, 22 bp, Artificial Sequence
  chemically synthesized
taaatgttttacttaagacaag

SEQ ID NO: 838806 - DNA, 22 bp, Artificial Sequence
  chemically synthesized
tattctgttgtacttgtcttaa

SEQ ID NO: 838807 - DNA, 22 bp, Artificial Sequence
  chemically synthesized
tctttattctgttgtacttgtc

SEQ ID NO: 838808 - DNA, 22 bp, Artificial Sequence
  chemically synthesized
tacttaagacaagtacaacaga

SEQ ID NO: 838809 - DNA, 22 bp, Artificial Sequence
  chemically synthesized
acttaagacaagtacaacagaa

SEQ ID NO: 838810 - DNA, 22 bp, Artificial Sequence
  chemically synthesized
cttaagacaagtacaacagaat

SEQ ID NO: 838811 - DNA, 22 bp, Artificial Sequence
  chemically synthesized
ccacctgtctttattctgttgt

SEQ ID NO: 838812 - DNA, 22 bp, Artificial Sequence
  chemically synthesized
gccacctgtctttattctgttg

SEQ ID NO: 838813 - DNA, 22 bp, Artificial Sequence
  chemically synthesized
aagacaagtacaacagaataaa

SEQ ID NO: 838814 - DNA, 22 bp, Artificial Sequence
  chemically synthesized
agacaagtacaacagaataaag

SEQ ID NO: 838815 - DNA, 22 bp, Artificial Sequence
  chemically synthesized
cttgccacctgtctttattctg

SEQ ID NO: 838816 - DNA, 22 bp, Artificial Sequence
  chemically synthesized
aaaattgcttgccacctgtctt

SEQ ID NO: 838817 - DNA, 22 bp, Artificial Sequence
  chemically synthesized
gaaaattgcttgccacctgtct

SEQ ID NO: 838818 - DNA, 22 bp, Artificial Sequence
  chemically synthesized
tacatgatttgaaaattgcttg

SEQ ID NO: 838819 - DNA, 22 bp, Artificial Sequence
  chemically synthesized
atacatgatttgaaaattgctt

SEQ ID NO: 838820 - DNA, 22 bp, Artificial Sequence
  chemically synthesized
cttatacatgatttgaaaattg

SEQ ID NO: 838821 - DNA, 22 bp, Artificial Sequence
  chemically synthesized
acttatacatgatttgaaaatt

SEQ ID NO: 838822 - DNA, 22 bp, Artificial Sequence
  chemically synthesized
ccaaaatttacttatacatgat

SEQ ID NO: 838823 - DNA, 22 bp, Artificial Sequence
  chemically synthesized
accaaaatttacttatacatga

SEQ ID NO: 838824 - DNA, 22 bp, Artificial Sequence
  chemically synthesized
taccaaaatttacttatacatg

SEQ ID NO: 838825 - DNA, 22 bp, Artificial Sequence
  chemically synthesized
tttaccaaaatttacttataca

SEQ ID NO: 838826 - DNA, 22 bp, Artificial Sequence
  chemically synthesized
ctttaccaaaatttacttatac

SEQ ID NO: 838827 - DNA, 22 bp, Artificial Sequence
  chemically synthesized
tctttaccaaaatttacttata

SEQ ID NO: 838828 - DNA, 22 bp, Artificial Sequence
  chemically synthesized
tcaaatcatgtataagtaaatt

SEQ ID NO: 838829 - DNA, 22 bp, Artificial Sequence
  chemically synthesized
tttctttaccaaaatttactta

SEQ ID NO: 838830 - DNA, 22 bp, Artificial Sequence
  chemically synthesized
caaatcatgtataagtaaattt

SEQ ID NO: 838831 - DNA, 22 bp, Artificial Sequence
  chemically synthesized
ctttctttaccaaaatttactt

SEQ ID NO: 838832 - DNA, 22 bp, Artificial Sequence
  chemically synthesized
aaatcatgtataagtaaatttt

SEQ ID NO: 838833 - DNA, 22 bp, Artificial Sequence
  chemically synthesized
cttctttctttaccaaaattta

SEQ ID NO: 838834 - DNA, 22 bp, Artificial Sequence
  chemically synthesized
ctacttctttctttaccaaaat

SEQ ID NO: 838835 - DNA, 22 bp, Artificial Sequence
  chemically synthesized
tacctactacttctttctttac

SEQ ID NO: 838836 - DNA, 22 bp, Artificial Sequence
  chemically synthesized
gtacctactacttctttcttta

SEQ ID NO: 838837 - DNA, 22 bp, Artificial Sequence
  chemically synthesized
tgtacctactacttctttcttt

SEQ ID NO: 838838 - DNA, 22 bp, Artificial Sequence
  chemically synthesized
ttttgtacctactacttctttc

SEQ ID NO: 838839 - DNA, 22 bp, Artificial Sequence
  chemically synthesized
ttattttgtacctactacttct

SEQ ID NO: 838840 - DNA, 22 bp, Artificial Sequence
  chemically synthesized
tggtaaagaaagaagtagtagg

SEQ ID NO: 838841 - DNA, 22 bp, Artificial Sequence
  chemically synthesized
ggtaaagaaagaagtagtaggt

SEQ ID NO: 838842 - DNA, 22 bp, Artificial Sequence
  chemically synthesized
gtaaagaaagaagtagtaggta

SEQ ID NO: 838843 - DNA, 22 bp, Artificial Sequence
  chemically synthesized
tagggattattattttgtacct

SEQ ID NO: 838844 - DNA, 22 bp, Artificial Sequence
  chemically synthesized
tagaaaattgtagggattatta

SEQ ID NO: 838845 - DNA, 22 bp, Artificial Sequence
  chemically synthesized
aagttatagaaaattgtaggga

SEQ ID NO: 838846 - DNA, 22 bp, Artificial Sequence
  chemically synthesized
tcaagttatagaaaattgtagg

SEQ ID NO: 838847 - DNA, 22 bp, Artificial Sequence
  chemically synthesized
agctctcaagttatagaaaatt

SEQ ID NO: 838848 - DNA, 22 bp, Artificial Sequence
  chemically synthesized
tcagctctcaagttatagaaaa

SEQ ID NO: 838849 - DNA, 22 bp, Artificial Sequence
  chemically synthesized
caattttctataacttgagagc

SEQ ID NO: 838850 - DNA, 22 bp, Artificial Sequence
  chemically synthesized
aaaaatgctctcagctctcaag

SEQ ID NO: 838851 - DNA, 22 bp, Artificial Sequence
  chemically synthesized
ctaaaaaatgctctcagctctc

SEQ ID NO: 838852 - DNA, 22 bp, Artificial Sequence
  chemically synthesized
tctataacttgagagctgagag

SEQ ID NO: 838853 - DNA, 22 bp, Artificial Sequence
  chemically synthesized
ctataacttgagagctgagagc

SEQ ID NO: 838854 - DNA, 22 bp, Artificial Sequence
  chemically synthesized
ttcctaaaaaatgctctcagct

SEQ ID NO: 838855 - DNA, 22 bp, Artificial Sequence
  chemically synthesized
tataacttgagagctgagagca

SEQ ID NO: 838856 - DNA, 22 bp, Artificial Sequence
  chemically synthesized
taacttgagagctgagagcatt

SEQ ID NO: 838857 - DNA, 22 bp, Artificial Sequence
  chemically synthesized
gagagctgagagcattttttag

SEQ ID NO: 838858 - DNA, 22 bp, Artificial Sequence
  chemically synthesized
agagctgagagcattttttagg

SEQ ID NO: 838859 - DNA, 22 bp, Artificial Sequence
  chemically synthesized
agagcattttttaggaacagtc

SEQ ID NO: 838860 - DNA, 22 bp, Artificial Sequence
  chemically synthesized
aacacgtgccatggactgttcc

SEQ ID NO: 838861 - DNA, 22 bp, Artificial Sequence
  chemically synthesized
tttaggaacagtccatggcacg

SEQ ID NO: 838862 - DNA, 22 bp, Artificial Sequence
  chemically synthesized
ttaggaacagtccatggcacgt

SEQ ID NO: 838863 - DNA, 22 bp, Artificial Sequence
  chemically synthesized
taggaacagtccatggcacgtg

SEQ ID NO: 838864 - DNA, 22 bp, Artificial Sequence
  chemically synthesized
aggaacagtccatggcacgtgt

SEQ ID NO: 838865 - DNA, 22 bp, Artificial Sequence
  chemically synthesized
ggaacagtccatggcacgtgtt

SEQ ID NO: 838866 - DNA, 22 bp, Artificial Sequence
  chemically synthesized
agccaagggttaaacacgtgcc

SEQ ID NO: 838867 - DNA, 22 bp, Artificial Sequence
  chemically synthesized
gataaaactaagccaagggtta

SEQ ID NO: 838868 - DNA, 22 bp, Artificial Sequence
  chemically synthesized
agataaaactaagccaagggtt

SEQ ID NO: 838869 - DNA, 22 bp, Artificial Sequence
  chemically synthesized
tagataaaactaagccaagggt

SEQ ID NO: 838870 - DNA, 22 bp, Artificial Sequence
  chemically synthesized
aacccttggcttagttttatct

SEQ ID NO: 838871 - DNA, 22 bp, Artificial Sequence
  chemically synthesized
acccttggcttagttttatcta

SEQ ID NO: 838872 - DNA, 22 bp, Artificial Sequence
  chemically synthesized
atggcatcatgcattttagata

SEQ ID NO: 838873 - DNA, 22 bp, Artificial Sequence
  chemically synthesized
ggcttagttttatctaaaatgc

SEQ ID NO: 838874 - DNA, 22 bp, Artificial Sequence
  chemically synthesized
gcttagttttatctaaaatgca

SEQ ID NO: 838875 - DNA, 22 bp, Artificial Sequence
  chemically synthesized
cctgatggcatcatgcatttta

SEQ ID NO: 838876 - DNA, 22 bp, Artificial Sequence
  chemically synthesized
agttttatctaaaatgcatgat

SEQ ID NO: 838877 - DNA, 22 bp, Artificial Sequence
  chemically synthesized
ctccctgatggcatcatgcatt

SEQ ID NO: 838878 - DNA, 22 bp, Artificial Sequence
  chemically synthesized
gttttatctaaaatgcatgatg

SEQ ID NO: 838879 - DNA, 22 bp, Artificial Sequence
  chemically synthesized
tatctaaaatgcatgatgccat

SEQ ID NO: 838880 - DNA, 22 bp, Artificial Sequence
  chemically synthesized
atctaaaatgcatgatgccatc

SEQ ID NO: 838881 - DNA, 22 bp, Artificial Sequence
  chemically synthesized
tctaaaatgcatgatgccatca

SEQ ID NO: 838882 - DNA, 22 bp, Artificial Sequence
  chemically synthesized
aaatgcatgatgccatcaggga

SEQ ID NO: 838883 - DNA, 22 bp, Artificial Sequence
  chemically synthesized
tgggcataaataggaatattac

SEQ ID NO: 838884 - DNA, 22 bp, Artificial Sequence
  chemically synthesized
gtacctgtgggcataaatagga

SEQ ID NO: 838885 - DNA, 22 bp, Artificial Sequence
  chemically synthesized
ggtacctgtgggcataaatagg

SEQ ID NO: 838886 - DNA, 22 bp, Artificial Sequence
  chemically synthesized
tggtacctgtgggcataaatag

SEQ ID NO: 838887 - DNA, 22 bp, Artificial Sequence
  chemically synthesized
tattttggtacctgtgggcata

SEQ ID NO: 838888 - DNA, 22 bp, Artificial Sequence
  chemically synthesized
ttatattttggtacctgtgggc

SEQ ID NO: 838889 - DNA, 22 bp, Artificial Sequence
  chemically synthesized
tgttatattttggtacctgtgg

SEQ ID NO: 838890 - DNA, 22 bp, Artificial Sequence
  chemically synthesized
ctgttatattttggtacctgtg

SEQ ID NO: 838891 - DNA, 22 bp, Artificial Sequence
  chemically synthesized
ctatttatgcccacaggtacca

SEQ ID NO: 838892 - DNA, 22 bp, Artificial Sequence
  chemically synthesized
tttatgcccacaggtaccaaaa

SEQ ID NO: 838893 - DNA, 22 bp, Artificial Sequence
  chemically synthesized
aatttctgttatattttggtac

SEQ ID NO: 838894 - DNA, 22 bp, Artificial Sequence
  chemically synthesized
gaatttctgttatattttggta

SEQ ID NO: 838895 - DNA, 22 bp, Artificial Sequence
  chemically synthesized
atgcccacaggtaccaaaatat

SEQ ID NO: 838896 - DNA, 22 bp, Artificial Sequence
  chemically synthesized
tgcccacaggtaccaaaatata

SEQ ID NO: 838897 - DNA, 22 bp, Artificial Sequence
  chemically synthesized
aagtcttgaatttctgttatat

SEQ ID NO: 838898 - DNA, 22 bp, Artificial Sequence
  chemically synthesized
taactaaagtcttgaatttctg

SEQ ID NO: 838899 - DNA, 22 bp, Artificial Sequence
  chemically synthesized
cagggtcattgtaactaaagtc

SEQ ID NO: 838900 - DNA, 22 bp, Artificial Sequence
  chemically synthesized
tgacctacagggtcattgtaac

SEQ ID NO: 838901 - DNA, 22 bp, Artificial Sequence
  chemically synthesized
atgacctacagggtcattgtaa

SEQ ID NO: 838902 - DNA, 22 bp, Artificial Sequence
  chemically synthesized
aagactttagttacaatgaccc

SEQ ID NO: 838903 - DNA, 22 bp, Artificial Sequence
  chemically synthesized
tcttatgacctacagggtcatt

SEQ ID NO: 838904 - DNA, 22 bp, Artificial Sequence
  chemically synthesized
atcttatgacctacagggtcat

SEQ ID NO: 838905 - DNA, 22 bp, Artificial Sequence
  chemically synthesized
tatcttatgacctacagggtca

SEQ ID NO: 838906 - DNA, 22 bp, Artificial Sequence
  chemically synthesized
ttatcttatgacctacagggtc

SEQ ID NO: 838907 - DNA, 22 bp, Artificial Sequence
  chemically synthesized
tagttacaatgaccctgtaggt

SEQ ID NO: 838908 - DNA, 22 bp, Artificial Sequence
  chemically synthesized
agttacaatgaccctgtaggtc

SEQ ID NO: 838909 - DNA, 22 bp, Artificial Sequence
  chemically synthesized
gttacaatgaccctgtaggtca

SEQ ID NO: 838910 - DNA, 22 bp, Artificial Sequence
  chemically synthesized
gcatttttatcttatgacctac

SEQ ID NO: 838911 - DNA, 22 bp, Artificial Sequence
  chemically synthesized
caatgaccctgtaggtcataag

SEQ ID NO: 838912 - DNA, 22 bp, Artificial Sequence
  chemically synthesized
taggctagcatttttatcttat

SEQ ID NO: 838913 - DNA, 22 bp, Artificial Sequence
  chemically synthesized
ataggctagcatttttatctta

SEQ ID NO: 838914 - DNA, 22 bp, Artificial Sequence
  chemically synthesized
taggtcataagataaaaatgct

SEQ ID NO: 838915 - DNA, 22 bp, Artificial Sequence
  chemically synthesized
catgtttataggctagcatttt

SEQ ID NO: 838916 - DNA, 22 bp, Artificial Sequence
  chemically synthesized
tacatgtttataggctagcatt

SEQ ID NO: 838917 - DNA, 22 bp, Artificial Sequence
  chemically synthesized
gcctataaacatgtagagtatc

SEQ ID NO: 838918 - DNA, 22 bp, Artificial Sequence
  chemically synthesized
taaacatgtagagtatctcttt

SEQ ID NO: 838919 - DNA, 22 bp, Artificial Sequence
  chemically synthesized
tttctgggctcatctctgtttg

SEQ ID NO: 838920 - DNA, 22 bp, Artificial Sequence
  chemically synthesized
ataagacaaatacaaacagaga

SEQ ID NO: 838921 - DNA, 22 bp, Artificial Sequence
  chemically synthesized
tctgggctcatctctgtttgta

SEQ ID NO: 838922 - DNA, 22 bp, Artificial Sequence
  chemically synthesized
ctgggctcatctctgtttgtat

SEQ ID NO: 838923 - DNA, 22 bp, Artificial Sequence
  chemically synthesized
tgggctcatctctgtttgtatt

SEQ ID NO: 838924 - DNA, 22 bp, Artificial Sequence
  chemically synthesized
ggctcatctctgtttgtatttg

SEQ ID NO: 838925 - DNA, 22 bp, Artificial Sequence
  chemically synthesized
atctctgtttgtatttgtctta

SEQ ID NO: 838926 - DNA, 22 bp, Artificial Sequence
  chemically synthesized
agacaaagtgagctaataagac

SEQ ID NO: 838927 - DNA, 22 bp, Artificial Sequence
  chemically synthesized
tgtttgtatttgtcttattagc

SEQ ID NO: 838928 - DNA, 22 bp, Artificial Sequence
  chemically synthesized
tttgtatttgtcttattagctc

SEQ ID NO: 838929 - DNA, 22 bp, Artificial Sequence
  chemically synthesized
tactcagacaaagtgagctaat

SEQ ID NO: 838930 - DNA, 22 bp, Artificial Sequence
  chemically synthesized
gtatttgtcttattagctcact

SEQ ID NO: 838931 - DNA, 22 bp, Artificial Sequence
  chemically synthesized
atactcagacaaagtgagctaa

SEQ ID NO: 838932 - DNA, 22 bp, Artificial Sequence
  chemically synthesized
tatttgtcttattagctcactt

SEQ ID NO: 838933 - DNA, 22 bp, Artificial Sequence
  chemically synthesized
tatactcagacaaagtgagcta

SEQ ID NO: 838934 - DNA, 22 bp, Artificial Sequence
  chemically synthesized
gtcttattagctcactttgtct

SEQ ID NO: 838935 - DNA, 22 bp, Artificial Sequence
  chemically synthesized
tcttattagctcactttgtctg

SEQ ID NO: 838936 - DNA, 22 bp, Artificial Sequence
  chemically synthesized
aagaattttatactcagacaaa

SEQ ID NO: 838937 - DNA, 22 bp, Artificial Sequence
  chemically synthesized
attagctcactttgtctgagta

SEQ ID NO: 838938 - DNA, 22 bp, Artificial Sequence
  chemically synthesized
ttagctcactttgtctgagtat

SEQ ID NO: 838939 - DNA, 22 bp, Artificial Sequence
  chemically synthesized
gctcactttgtctgagtataaa

SEQ ID NO: 838940 - DNA, 22 bp, Artificial Sequence
  chemically synthesized
actttgtctgagtataaaattc

SEQ ID NO: 838941 - DNA, 22 bp, Artificial Sequence
  chemically synthesized
tgtctgagtataaaattcttta

SEQ ID NO: 838942 - DNA, 22 bp, Artificial Sequence
  chemically synthesized
gtctgagtataaaattctttaa

SEQ ID NO: 838943 - DNA, 22 bp, Artificial Sequence
  chemically synthesized
tgagtaaatatattaaagaatt

SEQ ID NO: 838944 - DNA, 22 bp, Artificial Sequence
  chemically synthesized
tctgagtataaaattctttaat

SEQ ID NO: 838945 - DNA, 22 bp, Artificial Sequence
  chemically synthesized
agtataaaattctttaatatat

SEQ ID NO: 838946 - DNA, 22 bp, Artificial Sequence
  chemically synthesized
tgataaagatgattatgagtaa

SEQ ID NO: 838947 - DNA, 22 bp, Artificial Sequence
  chemically synthesized
gtgataaagatgattatgagta

SEQ ID NO: 838948 - DNA, 22 bp, Artificial Sequence
  chemically synthesized
tttaatatatttactcataatc

SEQ ID NO: 838949 - DNA, 22 bp, Artificial Sequence
  chemically synthesized
tgtgataaagatgattatgagt

SEQ ID NO: 838950 - DNA, 22 bp, Artificial Sequence
  chemically synthesized
ttgtgataaagatgattatgag

SEQ ID NO: 838951 - DNA, 22 bp, Artificial Sequence
  chemically synthesized
taatatatttactcataatcat

SEQ ID NO: 838952 - DNA, 22 bp, Artificial Sequence
  chemically synthesized
tttgtgataaagatgattatga

SEQ ID NO: 838953 - DNA, 22 bp, Artificial Sequence
  chemically synthesized
aatatatttactcataatcatc

SEQ ID NO: 838954 - DNA, 22 bp, Artificial Sequence
  chemically synthesized
ttttgtgataaagatgattatg

SEQ ID NO: 838955 - DNA, 22 bp, Artificial Sequence
  chemically synthesized
atatatttactcataatcatct

SEQ ID NO: 838956 - DNA, 22 bp, Artificial Sequence
  chemically synthesized
cttttttgtgataaagatgatt

SEQ ID NO: 838957 - DNA, 22 bp, Artificial Sequence
  chemically synthesized
ccttttttgtgataaagatgat

SEQ ID NO: 838958 - DNA, 22 bp, Artificial Sequence
  chemically synthesized
ttccttttttgtgataaagatg

SEQ ID NO: 838959 - DNA, 22 bp, Artificial Sequence
  chemically synthesized
cttccttttttgtgataaagat

SEQ ID NO: 838960 - DNA, 22 bp, Artificial Sequence
  chemically synthesized
tcttccttttttgtgataaaga

SEQ ID NO: 838961 - DNA, 22 bp, Artificial Sequence
  chemically synthesized
actcataatcatctttatcaca

SEQ ID NO: 838962 - DNA, 22 bp, Artificial Sequence
  chemically synthesized
ttcttccttttttgtgataaag

SEQ ID NO: 838963 - DNA, 22 bp, Artificial Sequence
  chemically synthesized
ctcataatcatctttatcacaa

SEQ ID NO: 838964 - DNA, 22 bp, Artificial Sequence
  chemically synthesized
ataatcatctttatcacaaaaa

SEQ ID NO: 838965 - DNA, 22 bp, Artificial Sequence
  chemically synthesized
aagaaaatagtttttcttcctt

SEQ ID NO: 838966 - DNA, 22 bp, Artificial Sequence
  chemically synthesized
tatcacaaaaaaggaagaaaaa

SEQ ID NO: 838967 - DNA, 22 bp, Artificial Sequence
  chemically synthesized
atcacaaaaaaggaagaaaaac

SEQ ID NO: 838968 - DNA, 22 bp, Artificial Sequence
  chemically synthesized
tcacaaaaaaggaagaaaaact

SEQ ID NO: 838969 - DNA, 22 bp, Artificial Sequence
  chemically synthesized
aataaataaaccaattaaagaa

SEQ ID NO: 838970 - DNA, 22 bp, Artificial Sequence
  chemically synthesized
ttaaataaataaaccaattaaa

SEQ ID NO: 838971 - DNA, 22 bp, Artificial Sequence
  chemically synthesized
ttttctttaattggtttattta

SEQ ID NO: 838972 - DNA, 22 bp, Artificial Sequence
  chemically synthesized
tctttaattggtttatttattt

SEQ ID NO: 838973 - DNA, 22 bp, Artificial Sequence
  chemically synthesized
ctttaattggtttatttattta

SEQ ID NO: 838974 - DNA, 22 bp, Artificial Sequence
  chemically synthesized
tttaattggtttatttatttaa

SEQ ID NO: 838975 - DNA, 22 bp, Artificial Sequence
  chemically synthesized
taattggtttatttatttaata

SEQ ID NO: 838976 - DNA, 22 bp, Artificial Sequence
  chemically synthesized
aattggtttatttatttaatag

SEQ ID NO: 838977 - DNA, 22 bp, Artificial Sequence
  chemically synthesized
attggtttatttatttaatagt

SEQ ID NO: 838978 - DNA, 22 bp, Artificial Sequence
  chemically synthesized
aacataataaacaaaactatta

SEQ ID NO: 838979 - DNA, 22 bp, Artificial Sequence
  chemically synthesized
gtttatttatttaatagttttg

SEQ ID NO: 838980 - DNA, 22 bp, Artificial Sequence
  chemically synthesized
atttatttaatagttttgttta

SEQ ID NO: 838981 - DNA, 22 bp, Artificial Sequence
  chemically synthesized
tttatttaatagttttgtttat

SEQ ID NO: 838982 - DNA, 22 bp, Artificial Sequence
  chemically synthesized
aaaattaaacataataaacaaa

SEQ ID NO: 838983 - DNA, 22 bp, Artificial Sequence
  chemically synthesized
gaaaattaaacataataaacaa

SEQ ID NO: 838984 - DNA, 22 bp, Artificial Sequence
  chemically synthesized
atttaatagttttgtttattat

SEQ ID NO: 838985 - DNA, 22 bp, Artificial Sequence
  chemically synthesized
tttaatagttttgtttattatg

SEQ ID NO: 838986 - DNA, 22 bp, Artificial Sequence
  chemically synthesized
aatagttttgtttattatgttt

SEQ ID NO: 838987 - DNA, 22 bp, Artificial Sequence
  chemically synthesized
atagttttgtttattatgttta

SEQ ID NO: 838988 - DNA, 22 bp, Artificial Sequence
  chemically synthesized
atccaccttgaaaattaaacat

SEQ ID NO: 838989 - DNA, 22 bp, Artificial Sequence
  chemically synthesized
ttcatccaccttgaaaattaaa

SEQ ID NO: 838990 - DNA, 22 bp, Artificial Sequence
  chemically synthesized
tgtttattatgtttaattttca

SEQ ID NO: 838991 - DNA, 22 bp, Artificial Sequence
  chemically synthesized
attcatccaccttgaaaattaa

SEQ ID NO: 838992 - DNA, 22 bp, Artificial Sequence
  chemically synthesized
gtttattatgtttaattttcaa

SEQ ID NO: 838993 - DNA, 22 bp, Artificial Sequence
  chemically synthesized
tattcatccaccttgaaaatta

SEQ ID NO: 838994 - DNA, 22 bp, Artificial Sequence
  chemically synthesized
tttattatgtttaattttcaag

SEQ ID NO: 838995 - DNA, 22 bp, Artificial Sequence
  chemically synthesized
attatgtttaattttcaaggtg

SEQ ID NO: 838996 - DNA, 22 bp, Artificial Sequence
  chemically synthesized
ttatgtttaattttcaaggtgg

SEQ ID NO: 838997 - DNA, 22 bp, Artificial Sequence
  chemically synthesized
tgtttaattttcaaggtggatg

SEQ ID NO: 838998 - DNA, 22 bp, Artificial Sequence
  chemically synthesized
acaaatgttttattcatccacc

SEQ ID NO: 838999 - DNA, 22 bp, Artificial Sequence
  chemically synthesized
aattttcaaggtggatgaataa

SEQ ID NO: 839000 - DNA, 22 bp, Artificial Sequence
  chemically synthesized
attttcaaggtggatgaataaa

SEQ ID NO: 839001 - DNA, 22 bp, Artificial Sequence
  chemically synthesized
ggttaacaaatgttttattcat

SEQ ID NO: 839002 - DNA, 22 bp, Artificial Sequence
  chemically synthesized
tcaaggtggatgaataaaacat

SEQ ID NO: 839003 - DNA, 22 bp, Artificial Sequence
  chemically synthesized
caaggtggatgaataaaacatt

SEQ ID NO: 839004 - DNA, 22 bp, Artificial Sequence
  chemically synthesized
aaggtggatgaataaaacattt

SEQ ID NO: 839005 - DNA, 22 bp, Artificial Sequence
  chemically synthesized
aggggaaagatctgggttaaca

SEQ ID NO: 839006 - DNA, 22 bp, Artificial Sequence
  chemically synthesized
aaggggaaagatctgggttaac

SEQ ID NO: 839007 - DNA, 22 bp, Artificial Sequence
  chemically synthesized
taaggggaaagatctgggttaa

SEQ ID NO: 839008 - DNA, 22 bp, Artificial Sequence
  chemically synthesized
ttaaggggaaagatctgggtta

SEQ ID NO: 839009 - DNA, 22 bp, Artificial Sequence
  chemically synthesized
tttaaggggaaagatctgggtt

SEQ ID NO: 839010 - DNA, 22 bp, Artificial Sequence
  chemically synthesized
tttttaaggggaaagatctggg

SEQ ID NO: 839011 - DNA, 22 bp, Artificial Sequence
  chemically synthesized
ctttttaaggggaaagatctgg

SEQ ID NO: 839012 - DNA, 22 bp, Artificial Sequence
  chemically synthesized
tgtttctttttaaggggaaaga

SEQ ID NO: 839013 - DNA, 22 bp, Artificial Sequence
  chemically synthesized
gttaacccagatctttcccctt

SEQ ID NO: 839014 - DNA, 22 bp, Artificial Sequence
  chemically synthesized
ttaacccagatctttcccctta

SEQ ID NO: 839015 - DNA, 22 bp, Artificial Sequence
  chemically synthesized
attatgtttctttttaagggga

SEQ ID NO: 839016 - DNA, 22 bp, Artificial Sequence
  chemically synthesized
acccagatctttccccttaaaa

SEQ ID NO: 839017 - DNA, 22 bp, Artificial Sequence
  chemically synthesized
cattatgtttctttttaagggg

SEQ ID NO: 839018 - DNA, 22 bp, Artificial Sequence
  chemically synthesized
tcttcattatgtttctttttaa

SEQ ID NO: 839019 - DNA, 22 bp, Artificial Sequence
  chemically synthesized
gtcttcattatgtttcttttta

SEQ ID NO: 839020 - DNA, 22 bp, Artificial Sequence
  chemically synthesized
tgtcttcattatgtttcttttt

SEQ ID NO: 839021 - DNA, 22 bp, Artificial Sequence
  chemically synthesized
ttgtcttcattatgtttctttt

SEQ ID NO: 839022 - DNA, 22 bp, Artificial Sequence
  chemically synthesized
tttttgtcttcattatgtttct

SEQ ID NO: 839023 - DNA, 22 bp, Artificial Sequence
  chemically synthesized
tccccttaaaaagaaacataat

SEQ ID NO: 839024 - DNA, 22 bp, Artificial Sequence
  chemically synthesized
ccccttaaaaagaaacataatg

SEQ ID NO: 839025 - DNA, 22 bp, Artificial Sequence
  chemically synthesized
cccttaaaaagaaacataatga

SEQ ID NO: 839026 - DNA, 22 bp, Artificial Sequence
  chemically synthesized
attgtttttgtcttcattatgt

SEQ ID NO: 839027 - DNA, 22 bp, Artificial Sequence
  chemically synthesized
ctaattgtttttgtcttcatta

SEQ ID NO: 839028 - DNA, 22 bp, Artificial Sequence
  chemically synthesized
aaaaagaaacataatgaagaca

SEQ ID NO: 839029 - DNA, 22 bp, Artificial Sequence
  chemically synthesized
aaaagaaacataatgaagacaa

SEQ ID NO: 839030 - DNA, 22 bp, Artificial Sequence
  chemically synthesized
tactaattgtttttgtcttcat

SEQ ID NO: 839031 - DNA, 22 bp, Artificial Sequence
  chemically synthesized
ctactaattgtttttgtcttca

SEQ ID NO: 839032 - DNA, 22 bp, Artificial Sequence
  chemically synthesized
tctactaattgtttttgtcttc

SEQ ID NO: 839033 - DNA, 22 bp, Artificial Sequence
  chemically synthesized
tgaacataaatagtgttttcta

SEQ ID NO: 839034 - DNA, 22 bp, Artificial Sequence
  chemically synthesized
gtagaaaacactatttatgttc

SEQ ID NO: 839035 - DNA, 22 bp, Artificial Sequence
  chemically synthesized
aagtgatgtaccataattatga

SEQ ID NO: 839036 - DNA, 22 bp, Artificial Sequence
  chemically synthesized
ttaaagtgatgtaccataatta

SEQ ID NO: 839037 - DNA, 22 bp, Artificial Sequence
  chemically synthesized
attaaagtgatgtaccataatt

SEQ ID NO: 839038 - DNA, 22 bp, Artificial Sequence
  chemically synthesized
tttatgttcataattatggtac

SEQ ID NO: 839039 - DNA, 22 bp, Artificial Sequence
  chemically synthesized
tattaaagtgatgtaccataat

SEQ ID NO: 839040 - DNA, 22 bp, Artificial Sequence
  chemically synthesized
ttattaaagtgatgtaccataa

SEQ ID NO: 839041 - DNA, 22 bp, Artificial Sequence
  chemically synthesized
tttattaaagtgatgtaccata

SEQ ID NO: 839042 - DNA, 22 bp, Artificial Sequence
  chemically synthesized
atgttcataattatggtacatc

SEQ ID NO: 839043 - DNA, 22 bp, Artificial Sequence
  chemically synthesized
tgttcataattatggtacatca

SEQ ID NO: 839044 - DNA, 22 bp, Artificial Sequence
  chemically synthesized
ataattatggtacatcacttta

SEQ ID NO: 839045 - DNA, 22 bp, Artificial Sequence
  chemically synthesized
tggtacatcactttaataaaaa

SEQ ID NO: 839046 - DNA, 22 bp, Artificial Sequence
  chemically synthesized
taataggaaaaatattttttat

SEQ ID NO: 839047 - DNA, 22 bp, Artificial Sequence
  chemically synthesized
ataataggaaaaatatttttta

SEQ ID NO: 839048 - DNA, 22 bp, Artificial Sequence
  chemically synthesized
taataaaaaatatttttcctat

SEQ ID NO: 839049 - DNA, 22 bp, Artificial Sequence
  chemically synthesized
aataaaaaatatttttcctatt

SEQ ID NO: 839050 - DNA, 22 bp, Artificial Sequence
  chemically synthesized
aagtgagtttataataggaaaa

SEQ ID NO: 839051 - DNA, 22 bp, Artificial Sequence
  chemically synthesized
ataaaaaatatttttcctatta

SEQ ID NO: 839052 - DNA, 22 bp, Artificial Sequence
  chemically synthesized
caagtgagtttataataggaaa

SEQ ID NO: 839053 - DNA, 22 bp, Artificial Sequence
  chemically synthesized
tcaagtgagtttataataggaa

SEQ ID NO: 839054 - DNA, 22 bp, Artificial Sequence
  chemically synthesized
taaatctttcaagtgagtttat

SEQ ID NO: 839055 - DNA, 22 bp, Artificial Sequence
  chemically synthesized
ttcctattataaactcacttga

SEQ ID NO: 839056 - DNA, 22 bp, Artificial Sequence
  chemically synthesized
attataaatctttcaagtgagt

SEQ ID NO: 839057 - DNA, 22 bp, Artificial Sequence
  chemically synthesized
tcctattataaactcacttgaa

SEQ ID NO: 839058 - DNA, 22 bp, Artificial Sequence
  chemically synthesized
aattataaatctttcaagtgag

SEQ ID NO: 839059 - DNA, 22 bp, Artificial Sequence
  chemically synthesized
cctattataaactcacttgaaa

SEQ ID NO: 839060 - DNA, 22 bp, Artificial Sequence
  chemically synthesized
ctattataaactcacttgaaag

SEQ ID NO: 839061 - DNA, 22 bp, Artificial Sequence
  chemically synthesized
ttataaactcacttgaaagatt

SEQ ID NO: 839062 - DNA, 22 bp, Artificial Sequence
  chemically synthesized
tatttaattataaatctttcaa

SEQ ID NO: 839063 - DNA, 22 bp, Artificial Sequence
  chemically synthesized
taaactcacttgaaagatttat

SEQ ID NO: 839064 - DNA, 22 bp, Artificial Sequence
  chemically synthesized
cgattatatttaattataaatc

SEQ ID NO: 839065 - DNA, 22 bp, Artificial Sequence
  chemically synthesized
ttgcgattatatttaattataa

SEQ ID NO: 839066 - DNA, 22 bp, Artificial Sequence
  chemically synthesized
acttgaaagatttataattaaa

SEQ ID NO: 839067 - DNA, 22 bp, Artificial Sequence
  chemically synthesized
cctgttgcgattatatttaatt

SEQ ID NO: 839068 - DNA, 22 bp, Artificial Sequence
  chemically synthesized
gaaagatttataattaaatata

SEQ ID NO: 839069 - DNA, 22 bp, Artificial Sequence
  chemically synthesized
aaagatttataattaaatataa

SEQ ID NO: 839070 - DNA, 22 bp, Artificial Sequence
  chemically synthesized
ataattaaatataatcgcaaca

SEQ ID NO: 839071 - DNA, 22 bp, Artificial Sequence
  chemically synthesized
taattaaatataatcgcaacag

SEQ ID NO: 839072 - DNA, 22 bp, Artificial Sequence
  chemically synthesized
aaatccaaattacctgttgcga

SEQ ID NO: 839073 - DNA, 22 bp, Artificial Sequence
  chemically synthesized
aaaatccaaattacctgttgcg

SEQ ID NO: 839074 - DNA, 22 bp, Artificial Sequence
  chemically synthesized
aatataatcgcaacaggtaatt

SEQ ID NO: 839075 - DNA, 22 bp, Artificial Sequence
  chemically synthesized
aataggatttaaaatccaaatt

SEQ ID NO: 839076 - DNA, 22 bp, Artificial Sequence
  chemically synthesized
gaataggatttaaaatccaaat

SEQ ID NO: 839077 - DNA, 22 bp, Artificial Sequence
  chemically synthesized
ggattttaaatcctattcaaat

SEQ ID NO: 839078 - DNA, 22 bp, Artificial Sequence
  chemically synthesized
atatcaaaacatatttgaatag

SEQ ID NO: 839079 - DNA, 22 bp, Artificial Sequence
  chemically synthesized
gattttaaatcctattcaaata

SEQ ID NO: 839080 - DNA, 22 bp, Artificial Sequence
  chemically synthesized
taaatcctattcaaatatgttt

SEQ ID NO: 839081 - DNA, 22 bp, Artificial Sequence
  chemically synthesized
aaatcctattcaaatatgtttt

SEQ ID NO: 839082 - DNA, 22 bp, Artificial Sequence
  chemically synthesized
aatcctattcaaatatgttttg

SEQ ID NO: 839083 - DNA, 22 bp, Artificial Sequence
  chemically synthesized
agaggattaatatcaaaacata

SEQ ID NO: 839084 - DNA, 22 bp, Artificial Sequence
  chemically synthesized
aattaagaggattaatatcaaa

SEQ ID NO: 839085 - DNA, 22 bp, Artificial Sequence
  chemically synthesized
ttcaaatatgttttgatattaa

SEQ ID NO: 839086 - DNA, 22 bp, Artificial Sequence
  chemically synthesized
aaattaagaggattaatatcaa

SEQ ID NO: 839087 - DNA, 22 bp, Artificial Sequence
  chemically synthesized
taaattaagaggattaatatca

SEQ ID NO: 839088 - DNA, 22 bp, Artificial Sequence
  chemically synthesized
ttaaattaagaggattaatatc

SEQ ID NO: 839089 - DNA, 22 bp, Artificial Sequence
  chemically synthesized
aaatatgttttgatattaatcc

SEQ ID NO: 839090 - DNA, 22 bp, Artificial Sequence
  chemically synthesized
atttttaaattaagaggattaa

SEQ ID NO: 839091 - DNA, 22 bp, Artificial Sequence
  chemically synthesized
catttttaaattaagaggatta

SEQ ID NO: 839092 - DNA, 22 bp, Artificial Sequence
  chemically synthesized
tgatattaatcctcttaattta

SEQ ID NO: 839093 - DNA, 22 bp, Artificial Sequence
  chemically synthesized
gatattaatcctcttaatttaa

SEQ ID NO: 839094 - DNA, 22 bp, Artificial Sequence
  chemically synthesized
atattaatcctcttaatttaaa

SEQ ID NO: 839095 - DNA, 22 bp, Artificial Sequence
  chemically synthesized
ataaatgtatttcatttttaaa

SEQ ID NO: 839096 - DNA, 22 bp, Artificial Sequence
  chemically synthesized
cataaatgtatttcatttttaa

SEQ ID NO: 839097 - DNA, 22 bp, Artificial Sequence
  chemically synthesized
atcctcttaatttaaaaatgaa

SEQ ID NO: 839098 - DNA, 22 bp, Artificial Sequence
  chemically synthesized
tcataaatgtatttcattttta

SEQ ID NO: 839099 - DNA, 22 bp, Artificial Sequence
  chemically synthesized
ttcataaatgtatttcattttt

SEQ ID NO: 839100 - DNA, 22 bp, Artificial Sequence
  chemically synthesized
ttaatttaaaaatgaaatacat

SEQ ID NO: 839101 - DNA, 22 bp, Artificial Sequence
  chemically synthesized
catttttcataaatgtatttca

SEQ ID NO: 839102 - DNA, 22 bp, Artificial Sequence
  chemically synthesized
ccatttttcataaatgtatttc

SEQ ID NO: 839103 - DNA, 22 bp, Artificial Sequence
  chemically synthesized
aatttaaaaatgaaatacattt

SEQ ID NO: 839104 - DNA, 22 bp, Artificial Sequence
  chemically synthesized
tccatttttcataaatgtattt

SEQ ID NO: 839105 - DNA, 22 bp, Artificial Sequence
  chemically synthesized
atttaaaaatgaaatacattta

SEQ ID NO: 839106 - DNA, 22 bp, Artificial Sequence
  chemically synthesized
aaaaatgaaatacatttatgaa

SEQ ID NO: 839107 - DNA, 22 bp, Artificial Sequence
  chemically synthesized
aaaatgaaatacatttatgaaa

SEQ ID NO: 839108 - DNA, 22 bp, Artificial Sequence
  chemically synthesized
tcatgaaatgaatgttttccat

SEQ ID NO: 839109 - DNA, 22 bp, Artificial Sequence
  chemically synthesized
cctatcatgaaatgaatgtttt

SEQ ID NO: 839110 - DNA, 22 bp, Artificial Sequence
  chemically synthesized
atgaaaaatggaaaacattcat

SEQ ID NO: 839111 - DNA, 22 bp, Artificial Sequence
  chemically synthesized
tgaaaaatggaaaacattcatt

SEQ ID NO: 839112 - DNA, 22 bp, Artificial Sequence
  chemically synthesized
attacctatcatgaaatgaatg

SEQ ID NO: 839113 - DNA, 22 bp, Artificial Sequence
  chemically synthesized
atactaattacctatcatgaaa

SEQ ID NO: 839114 - DNA, 22 bp, Artificial Sequence
  chemically synthesized
aattaatactaattacctatca

SEQ ID NO: 839115 - DNA, 22 bp, Artificial Sequence
  chemically synthesized
tgttaaattaatactaattacc

SEQ ID NO: 839116 - DNA, 22 bp, Artificial Sequence
  chemically synthesized
atttcatgataggtaattagta

SEQ ID NO: 839117 - DNA, 22 bp, Artificial Sequence
  chemically synthesized
catgataggtaattagtattaa

SEQ ID NO: 839118 - DNA, 22 bp, Artificial Sequence
  chemically synthesized
atgataggtaattagtattaat

SEQ ID NO: 839119 - DNA, 22 bp, Artificial Sequence
  chemically synthesized
tacgttgtgttaaattaatact

SEQ ID NO: 839120 - DNA, 22 bp, Artificial Sequence
  chemically synthesized
ctatacgttgtgttaaattaat

SEQ ID NO: 839121 - DNA, 22 bp, Artificial Sequence
  chemically synthesized
cctatacgttgtgttaaattaa

SEQ ID NO: 839122 - DNA, 22 bp, Artificial Sequence
  chemically synthesized
ttcctatacgttgtgttaaatt

SEQ ID NO: 839123 - DNA, 22 bp, Artificial Sequence
  chemically synthesized
cttcctatacgttgtgttaaat

SEQ ID NO: 839124 - DNA, 22 bp, Artificial Sequence
  chemically synthesized
tcttcctatacgttgtgttaaa

SEQ ID NO: 839125 - DNA, 22 bp, Artificial Sequence
  chemically synthesized
ttcttcctatacgttgtgttaa

SEQ ID NO: 839126 - DNA, 22 bp, Artificial Sequence
  chemically synthesized
tttcttcctatacgttgtgtta

SEQ ID NO: 839127 - DNA, 22 bp, Artificial Sequence
  chemically synthesized
gtattaatttaacacaacgtat

SEQ ID NO: 839128 - DNA, 22 bp, Artificial Sequence
  chemically synthesized
atttaacacaacgtataggaag

SEQ ID NO: 839129 - DNA, 22 bp, Artificial Sequence
  chemically synthesized
aacacaacgtataggaagaaaa

SEQ ID NO: 839130 - DNA, 22 bp, Artificial Sequence
  chemically synthesized
acacaacgtataggaagaaaaa

SEQ ID NO: 839131 - DNA, 22 bp, Artificial Sequence
  chemically synthesized
atatataaaaaacaagtatgtt

SEQ ID NO: 839132 - DNA, 22 bp, Artificial Sequence
  chemically synthesized
tatataaaaactgatatataaa

SEQ ID NO: 839133 - DNA, 22 bp, Artificial Sequence
  chemically synthesized
gtatataaaaactgatatataa

SEQ ID NO: 839134 - DNA, 22 bp, Artificial Sequence
  chemically synthesized
taacttgtatataaaaactgat

SEQ ID NO: 839135 - DNA, 22 bp, Artificial Sequence
  chemically synthesized
gttttttatatatcagttttta

SEQ ID NO: 839136 - DNA, 22 bp, Artificial Sequence
  chemically synthesized
ttttttatatatcagtttttat

SEQ ID NO: 839137 - DNA, 22 bp, Artificial Sequence
  chemically synthesized
tttatatatcagtttttatata

SEQ ID NO: 839138 - DNA, 22 bp, Artificial Sequence
  chemically synthesized
ttatatatcagtttttatatac

SEQ ID NO: 839139 - DNA, 22 bp, Artificial Sequence
  chemically synthesized
tatatatcagtttttatataca

SEQ ID NO: 839140 - DNA, 22 bp, Artificial Sequence
  chemically synthesized
atatatcagtttttatatacaa

SEQ ID NO: 839141 - DNA, 22 bp, Artificial Sequence
  chemically synthesized
tatatcagtttttatatacaag

SEQ ID NO: 839142 - DNA, 22 bp, Artificial Sequence
  chemically synthesized
tcagagtaattgtaacttgtat

SEQ ID NO: 839143 - DNA, 22 bp, Artificial Sequence
  chemically synthesized
tatcagagtaattgtaacttgt

SEQ ID NO: 839144 - DNA, 22 bp, Artificial Sequence
  chemically synthesized
ttatatacaagttacaattact

SEQ ID NO: 839145 - DNA, 22 bp, Artificial Sequence
  chemically synthesized
tatatacaagttacaattactc

SEQ ID NO: 839146 - DNA, 22 bp, Artificial Sequence
  chemically synthesized
agagttctatcagagtaattgt

SEQ ID NO: 839147 - DNA, 22 bp, Artificial Sequence
  chemically synthesized
atatacaagttacaattactct

SEQ ID NO: 839148 - DNA, 22 bp, Artificial Sequence
  chemically synthesized
cagagttctatcagagtaattg

SEQ ID NO: 839149 - DNA, 22 bp, Artificial Sequence
  chemically synthesized
tatacaagttacaattactctg

SEQ ID NO: 839150 - DNA, 22 bp, Artificial Sequence
  chemically synthesized
atgaatttcagagttctatcag

SEQ ID NO: 839151 - DNA, 22 bp, Artificial Sequence
  chemically synthesized
aatgaatttcagagttctatca

SEQ ID NO: 839152 - DNA, 22 bp, Artificial Sequence
  chemically synthesized
caattactctgatagaactctg

SEQ ID NO: 839153 - DNA, 22 bp, Artificial Sequence
  chemically synthesized
atatcttaatgaatttcagagt

SEQ ID NO: 839154 - DNA, 22 bp, Artificial Sequence
  chemically synthesized
aatatcttaatgaatttcagag

SEQ ID NO: 839155 - DNA, 22 bp, Artificial Sequence
  chemically synthesized
ctctgatagaactctgaaattc

SEQ ID NO: 839156 - DNA, 22 bp, Artificial Sequence
  chemically synthesized
taatatcttaatgaatttcaga

SEQ ID NO: 839157 - DNA, 22 bp, Artificial Sequence
  chemically synthesized
tgatagaactctgaaattcatt

SEQ ID NO: 839158 - DNA, 22 bp, Artificial Sequence
  chemically synthesized
atagaactctgaaattcattaa

SEQ ID NO: 839159 - DNA, 22 bp, Artificial Sequence
  chemically synthesized
tgaaattcattaagatattaaa

SEQ ID NO: 839160 - DNA, 22 bp, Artificial Sequence
  chemically synthesized
aaattcattaagatattaaaga

SEQ ID NO: 839161 - DNA, 22 bp, Artificial Sequence
  chemically synthesized
aataatagaaatggtctttaat

SEQ ID NO: 839162 - DNA, 22 bp, Artificial Sequence
  chemically synthesized
attaagatattaaagaccattt

SEQ ID NO: 839163 - DNA, 22 bp, Artificial Sequence
  chemically synthesized
agatattaaagaccatttctat

SEQ ID NO: 839164 - DNA, 22 bp, Artificial Sequence
  chemically synthesized
gaaatatacgttaaataataga

SEQ ID NO: 839165 - DNA, 22 bp, Artificial Sequence
  chemically synthesized
aagaccatttctattatttaac

SEQ ID NO: 839166 - DNA, 22 bp, Artificial Sequence
  chemically synthesized
ataaggtacctggaaatatacg

SEQ ID NO: 839167 - DNA, 22 bp, Artificial Sequence
  chemically synthesized
ctattatttaacgtatatttcc

SEQ ID NO: 839168 - DNA, 22 bp, Artificial Sequence
  chemically synthesized
tattatttaacgtatatttcca

SEQ ID NO: 839169 - DNA, 22 bp, Artificial Sequence
  chemically synthesized
ttatttaacgtatatttccagg

SEQ ID NO: 839170 - DNA, 22 bp, Artificial Sequence
  chemically synthesized
gttaataaggtacctggaaata

SEQ ID NO: 839171 - DNA, 22 bp, Artificial Sequence
  chemically synthesized
tttaacgtatatttccaggtac

SEQ ID NO: 839172 - DNA, 22 bp, Artificial Sequence
  chemically synthesized
aacgtatatttccaggtacctt

SEQ ID NO: 839173 - DNA, 22 bp, Artificial Sequence
  chemically synthesized
acgtatatttccaggtacctta

SEQ ID NO: 839174 - DNA, 22 bp, Artificial Sequence
  chemically synthesized
gtagtacctagttaataaggta

SEQ ID NO: 839175 - DNA, 22 bp, Artificial Sequence
  chemically synthesized
agtagtacctagttaataaggt

SEQ ID NO: 839176 - DNA, 22 bp, Artificial Sequence
  chemically synthesized
tagtagtacctagttaataagg

SEQ ID NO: 839177 - DNA, 22 bp, Artificial Sequence
  chemically synthesized
ttagtagtacctagttaataag

SEQ ID NO: 839178 - DNA, 22 bp, Artificial Sequence
  chemically synthesized
tttagtagtacctagttaataa

SEQ ID NO: 839179 - DNA, 22 bp, Artificial Sequence
  chemically synthesized
ttttagtagtacctagttaata

SEQ ID NO: 839180 - DNA, 22 bp, Artificial Sequence
  chemically synthesized
ccaggtaccttattaactaggt

SEQ ID NO: 839181 - DNA, 22 bp, Artificial Sequence
  chemically synthesized
caggtaccttattaactaggta

SEQ ID NO: 839182 - DNA, 22 bp, Artificial Sequence
  chemically synthesized
tttttttagtagtacctagtta

SEQ ID NO: 839183 - DNA, 22 bp, Artificial Sequence
  chemically synthesized
atttttttagtagtacctagtt

SEQ ID NO: 839184 - DNA, 22 bp, Artificial Sequence
  chemically synthesized
tatttttttagtagtacctagt

SEQ ID NO: 839185 - DNA, 22 bp, Artificial Sequence
  chemically synthesized
ttatttttttagtagtacctag

SEQ ID NO: 839186 - DNA, 22 bp, Artificial Sequence
  chemically synthesized
ttttatttttttagtagtacct

SEQ ID NO: 839187 - DNA, 22 bp, Artificial Sequence
  chemically synthesized
attaactaggtactactaaaaa

SEQ ID NO: 839188 - DNA, 22 bp, Artificial Sequence
  chemically synthesized
ttaactaggtactactaaaaaa

SEQ ID NO: 839189 - DNA, 22 bp, Artificial Sequence
  chemically synthesized
gtggttcttttatttttttagt

SEQ ID NO: 839190 - DNA, 22 bp, Artificial Sequence
  chemically synthesized
actaggtactactaaaaaaata

SEQ ID NO: 839191 - DNA, 22 bp, Artificial Sequence
  chemically synthesized
ggtactactaaaaaaataaaag

SEQ ID NO: 839192 - DNA, 22 bp, Artificial Sequence
  chemically synthesized
ctaaaaaaataaaagaaccacg

SEQ ID NO: 839193 - DNA, 22 bp, Artificial Sequence
  chemically synthesized
acatataaatctcgtggttctt

SEQ ID NO: 839194 - DNA, 22 bp, Artificial Sequence
  chemically synthesized
cacatataaatctcgtggttct

SEQ ID NO: 839195 - DNA, 22 bp, Artificial Sequence
  chemically synthesized
aaaaaataaaagaaccacgaga

SEQ ID NO: 839196 - DNA, 22 bp, Artificial Sequence
  chemically synthesized
ttcacatataaatctcgtggtt

SEQ ID NO: 839197 - DNA, 22 bp, Artificial Sequence
  chemically synthesized
cttcacatataaatctcgtggt

SEQ ID NO: 839198 - DNA, 22 bp, Artificial Sequence
  chemically synthesized
ataatgtcatgtgtttcttcac

SEQ ID NO: 839199 - DNA, 22 bp, Artificial Sequence
  chemically synthesized
atatgtgaagaaacacatgaca

SEQ ID NO: 839200 - DNA, 22 bp, Artificial Sequence
  chemically synthesized
tatgtgaagaaacacatgacat

SEQ ID NO: 839201 - DNA, 22 bp, Artificial Sequence
  chemically synthesized
ccatcatcagccatcatcatga

SEQ ID NO: 839202 - DNA, 22 bp, Artificial Sequence
  chemically synthesized
accatcatcagccatcatcatg

SEQ ID NO: 839203 - DNA, 22 bp, Artificial Sequence
  chemically synthesized
tgaacctcatgatgatggctga

SEQ ID NO: 839204 - DNA, 22 bp, Artificial Sequence
  chemically synthesized
atgatgatggctgatgatggta

SEQ ID NO: 839205 - DNA, 22 bp, Artificial Sequence
  chemically synthesized
acacataaaatttaccatcatc

SEQ ID NO: 839206 - DNA, 22 bp, Artificial Sequence
  chemically synthesized
atgatggtaaattttatgtgtt

SEQ ID NO: 839207 - DNA, 22 bp, Artificial Sequence
  chemically synthesized
ggaaccatagcccagccaagtt

SEQ ID NO: 839208 - DNA, 22 bp, Artificial Sequence
  chemically synthesized
tatgtgttaacttggctgggct

SEQ ID NO: 839209 - DNA, 22 bp, Artificial Sequence
  chemically synthesized
atgtgttaacttggctgggcta

SEQ ID NO: 839210 - DNA, 22 bp, Artificial Sequence
  chemically synthesized
tgtgttaacttggctgggctat

SEQ ID NO: 839211 - DNA, 22 bp, Artificial Sequence
  chemically synthesized
accaaacaactgggaaccatag

SEQ ID NO: 839212 - DNA, 22 bp, Artificial Sequence
  chemically synthesized
acttggctgggctatggttccc

SEQ ID NO: 839213 - DNA, 22 bp, Artificial Sequence
  chemically synthesized
gaccaaacaactgggaaccata

SEQ ID NO: 839214 - DNA, 22 bp, Artificial Sequence
  chemically synthesized
ggctgggctatggttcccagtt

SEQ ID NO: 839215 - DNA, 22 bp, Artificial Sequence
  chemically synthesized
gctgggctatggttcccagttg

SEQ ID NO: 839216 - DNA, 22 bp, Artificial Sequence
  chemically synthesized
gtgtttgaccaaacaactggga

SEQ ID NO: 839217 - DNA, 22 bp, Artificial Sequence
  chemically synthesized
ggctatggttcccagttgtttg

SEQ ID NO: 839218 - DNA, 22 bp, Artificial Sequence
  chemically synthesized
gattggtgtttgaccaaacaac

SEQ ID NO: 839219 - DNA, 22 bp, Artificial Sequence
  chemically synthesized
tggttcccagttgtttggtcaa

SEQ ID NO: 839220 - DNA, 22 bp, Artificial Sequence
  chemically synthesized
ccagttgtttggtcaaacacca

SEQ ID NO: 839221 - DNA, 22 bp, Artificial Sequence
  chemically synthesized
acagcaacatctagattggtgt

SEQ ID NO: 839222 - DNA, 22 bp, Artificial Sequence
  chemically synthesized
cacagcaacatctagattggtg

SEQ ID NO: 839223 - DNA, 22 bp, Artificial Sequence
  chemically synthesized
tttggtcaaacaccaatctaga

SEQ ID NO: 839224 - DNA, 22 bp, Artificial Sequence
  chemically synthesized
ggtcaaacaccaatctagatgt

SEQ ID NO: 839225 - DNA, 22 bp, Artificial Sequence
  chemically synthesized
gtcaaacaccaatctagatgtt

SEQ ID NO: 839226 - DNA, 22 bp, Artificial Sequence
  chemically synthesized
aaaaataccttcacagcaacat

SEQ ID NO: 839227 - DNA, 22 bp, Artificial Sequence
  chemically synthesized
atcacatctaaaaaataccttc

SEQ ID NO: 839228 - DNA, 22 bp, Artificial Sequence
  chemically synthesized
gatgttgctgtgaaggtatttt

SEQ ID NO: 839229 - DNA, 22 bp, Artificial Sequence
  chemically synthesized
ctgtgaaggtattttttagatg

SEQ ID NO: 839230 - DNA, 22 bp, Artificial Sequence
  chemically synthesized
aaatgttaatcacatctaaaaa

SEQ ID NO: 839231 - DNA, 22 bp, Artificial Sequence
  chemically synthesized
tgaaggtattttttagatgtga

SEQ ID NO: 839232 - DNA, 22 bp, Artificial Sequence
  chemically synthesized
attgaaatgttaatcacatcta

SEQ ID NO: 839233 - DNA, 22 bp, Artificial Sequence
  chemically synthesized
ctgattgaaatgttaatcacat

SEQ ID NO: 839234 - DNA, 22 bp, Artificial Sequence
  chemically synthesized
tttagatgtgattaacatttca

SEQ ID NO: 839235 - DNA, 22 bp, Artificial Sequence
  chemically synthesized
ttagatgtgattaacatttcaa

SEQ ID NO: 839236 - DNA, 22 bp, Artificial Sequence
  chemically synthesized
aaagtctgctgattgaaatgtt

SEQ ID NO: 839237 - DNA, 22 bp, Artificial Sequence
  chemically synthesized
tagatgtgattaacatttcaat

SEQ ID NO: 839238 - DNA, 22 bp, Artificial Sequence
  chemically synthesized
agatgtgattaacatttcaatc

SEQ ID NO: 839239 - DNA, 22 bp, Artificial Sequence
  chemically synthesized
gatgtgattaacatttcaatca

SEQ ID NO: 839240 - DNA, 22 bp, Artificial Sequence
  chemically synthesized
ctcaaagtctgctgattgaaat

SEQ ID NO: 839241 - DNA, 22 bp, Artificial Sequence
  chemically synthesized
actcaaagtctgctgattgaaa

SEQ ID NO: 839242 - DNA, 22 bp, Artificial Sequence
  chemically synthesized
tactcaaagtctgctgattgaa

SEQ ID NO: 839243 - DNA, 22 bp, Artificial Sequence
  chemically synthesized
ctttactcaaagtctgctgatt

SEQ ID NO: 839244 - DNA, 22 bp, Artificial Sequence
  chemically synthesized
acatttcaatcagcagactttg

SEQ ID NO: 839245 - DNA, 22 bp, Artificial Sequence
  chemically synthesized
caatcagcagactttgagtaaa

SEQ ID NO: 839246 - DNA, 22 bp, Artificial Sequence
  chemically synthesized
aatcagcagactttgagtaaag

SEQ ID NO: 839247 - DNA, 22 bp, Artificial Sequence
  chemically synthesized
tggagggtaatctgctttactc

SEQ ID NO: 839248 - DNA, 22 bp, Artificial Sequence
  chemically synthesized
tgagtaaagcagattaccctcc

SEQ ID NO: 839249 - DNA, 22 bp, Artificial Sequence
  chemically synthesized
gagtaaagcagattaccctcca

SEQ ID NO: 839250 - DNA, 22 bp, Artificial Sequence
  chemically synthesized
agtaaagcagattaccctccac

SEQ ID NO: 839251 - DNA, 22 bp, Artificial Sequence
  chemically synthesized
gagaaggcccacccacattgtg

SEQ ID NO: 839252 - DNA, 22 bp, Artificial Sequence
  chemically synthesized
attggagaaggcccacccacat

SEQ ID NO: 839253 - DNA, 22 bp, Artificial Sequence
  chemically synthesized
ccctccacaatgtgggtgggcc

SEQ ID NO: 839254 - DNA, 22 bp, Artificial Sequence
  chemically synthesized
aaaattgattggagaaggccca

SEQ ID NO: 839255 - DNA, 22 bp, Artificial Sequence
  chemically synthesized
cacaatgtgggtgggccttctc

SEQ ID NO: 839256 - DNA, 22 bp, Artificial Sequence
  chemically synthesized
caaaattgattggagaaggccc

SEQ ID NO: 839257 - DNA, 22 bp, Artificial Sequence
  chemically synthesized
aggacttcaaaattgattggag

SEQ ID NO: 839258 - DNA, 22 bp, Artificial Sequence
  chemically synthesized
aaggacttcaaaattgattgga

SEQ ID NO: 839259 - DNA, 22 bp, Artificial Sequence
  chemically synthesized
ttaaggacttcaaaattgattg

SEQ ID NO: 839260 - DNA, 22 bp, Artificial Sequence
  chemically synthesized
tcttaaggacttcaaaattgat

SEQ ID NO: 839261 - DNA, 22 bp, Artificial Sequence
  chemically synthesized
ctcttaaggacttcaaaattga

SEQ ID NO: 839262 - DNA, 22 bp, Artificial Sequence
  chemically synthesized
tctcttaaggacttcaaaattg

SEQ ID NO: 839263 - DNA, 22 bp, Artificial Sequence
  chemically synthesized
ttctcttaaggacttcaaaatt

SEQ ID NO: 839264 - DNA, 22 bp, Artificial Sequence
  chemically synthesized
ctccaatcaattttgaagtcct

SEQ ID NO: 839265 - DNA, 22 bp, Artificial Sequence
  chemically synthesized
tccaatcaattttgaagtcctt

SEQ ID NO: 839266 - DNA, 22 bp, Artificial Sequence
  chemically synthesized
agtcttttctcttaaggacttc

SEQ ID NO: 839267 - DNA, 22 bp, Artificial Sequence
  chemically synthesized
caatcaattttgaagtccttaa

SEQ ID NO: 839268 - DNA, 22 bp, Artificial Sequence
  chemically synthesized
cagtcttttctcttaaggactt

SEQ ID NO: 839269 - DNA, 22 bp, Artificial Sequence
  chemically synthesized
gggacttcagtcttttctctta

SEQ ID NO: 839270 - DNA, 22 bp, Artificial Sequence
  chemically synthesized
tggggacttcagtcttttctct

SEQ ID NO: 839271 - DNA, 22 bp, Artificial Sequence
  chemically synthesized
tgaagtccttaagagaaaagac

SEQ ID NO: 839272 - DNA, 22 bp, Artificial Sequence
  chemically synthesized
ctggggacttcagtcttttctc

SEQ ID NO: 839273 - DNA, 22 bp, Artificial Sequence
  chemically synthesized
gaagtccttaagagaaaagact

SEQ ID NO: 839274 - DNA, 22 bp, Artificial Sequence
  chemically synthesized
tctggggacttcagtcttttct

SEQ ID NO: 839275 - DNA, 22 bp, Artificial Sequence
  chemically synthesized
aagtccttaagagaaaagactg

SEQ ID NO: 839276 - DNA, 22 bp, Artificial Sequence
  chemically synthesized
ttctggggacttcagtcttttc

SEQ ID NO: 839277 - DNA, 22 bp, Artificial Sequence
  chemically synthesized
cttttctggggacttcagtctt

SEQ ID NO: 839278 - DNA, 22 bp, Artificial Sequence
  chemically synthesized
ccttttctggggacttcagtct

SEQ ID NO: 839279 - DNA, 22 bp, Artificial Sequence
  chemically synthesized
cttccttttctggggacttcag

SEQ ID NO: 839280 - DNA, 22 bp, Artificial Sequence
  chemically synthesized
aagagaaaagactgaagtcccc

SEQ ID NO: 839281 - DNA, 22 bp, Artificial Sequence
  chemically synthesized
agagaaaagactgaagtcccca

SEQ ID NO: 839282 - DNA, 22 bp, Artificial Sequence
  chemically synthesized
aagtccccagaaaaggaaggaa

SEQ ID NO: 839283 - DNA, 22 bp, Artificial Sequence
  chemically synthesized
agtccaaaggtaatccgatagc

SEQ ID NO: 839284 - DNA, 22 bp, Artificial Sequence
  chemically synthesized
gagtccaaaggtaatccgatag

SEQ ID NO: 839285 - DNA, 22 bp, Artificial Sequence
  chemically synthesized
caatcttgagtccaaaggtaat

SEQ ID NO: 839286 - DNA, 22 bp, Artificial Sequence
  chemically synthesized
tgctatcggattacctttggac

SEQ ID NO: 839287 - DNA, 22 bp, Artificial Sequence
  chemically synthesized
ctatcggattacctttggactc

SEQ ID NO: 839288 - DNA, 22 bp, Artificial Sequence
  chemically synthesized
atgttgcaatcttgagtccaaa

SEQ ID NO: 839289 - DNA, 22 bp, Artificial Sequence
  chemically synthesized
tcggattacctttggactcaag

SEQ ID NO: 839290 - DNA, 22 bp, Artificial Sequence
  chemically synthesized
cctttggactcaagattgcaac

SEQ ID NO: 839291 - DNA, 22 bp, Artificial Sequence
  chemically synthesized
tggactcaagattgcaacatca

SEQ ID NO: 839292 - DNA, 22 bp, Artificial Sequence
  chemically synthesized
ggactcaagattgcaacatcaa

SEQ ID NO: 839293 - DNA, 22 bp, Artificial Sequence
  chemically synthesized
gactcaagattgcaacatcaac

SEQ ID NO: 839294 - DNA, 22 bp, Artificial Sequence
  chemically synthesized
aagattgcaacatcaactcttc

SEQ ID NO: 839295 - DNA, 22 bp, Artificial Sequence
  chemically synthesized
gcaggatggagaccaagggaag

SEQ ID NO: 839296 - DNA, 22 bp, Artificial Sequence
  chemically synthesized
caacatcaactcttcccttggt

SEQ ID NO: 839297 - DNA, 22 bp, Artificial Sequence
  chemically synthesized
ttcccttggtctccatcctgcc

SEQ ID NO: 839298 - DNA, 22 bp, Artificial Sequence
  chemically synthesized
cccttggtctccatcctgccag

SEQ ID NO: 839299 - DNA, 22 bp, Artificial Sequence
  chemically synthesized
ccttggtctccatcctgccagg

SEQ ID NO: 839300 - DNA, 22 bp, Artificial Sequence
  chemically synthesized
taaaatccaaaagcctggcagg

SEQ ID NO: 839301 - DNA, 22 bp, Artificial Sequence
  chemically synthesized
ggtctccatcctgccaggcttt

SEQ ID NO: 839302 - DNA, 22 bp, Artificial Sequence
  chemically synthesized
gtctccatcctgccaggctttt

SEQ ID NO: 839303 - DNA, 22 bp, Artificial Sequence
  chemically synthesized
catcctgccaggcttttggatt

SEQ ID NO: 839304 - DNA, 22 bp, Artificial Sequence
  chemically synthesized
ccaggcttttggattttacaga

SEQ ID NO: 839305 - DNA, 22 bp, Artificial Sequence
  chemically synthesized
aaaagtcaaaaatctgtaaaat

SEQ ID NO: 839306 - DNA, 22 bp, Artificial Sequence
  chemically synthesized
ttggattttacagatttttgac

SEQ ID NO: 839307 - DNA, 22 bp, Artificial Sequence
  chemically synthesized
tggattttacagatttttgact

SEQ ID NO: 839308 - DNA, 22 bp, Artificial Sequence
  chemically synthesized
tgggagctgaaaagtcaaaaat

SEQ ID NO: 839309 - DNA, 22 bp, Artificial Sequence
  chemically synthesized
ggattttacagatttttgactt

SEQ ID NO: 839310 - DNA, 22 bp, Artificial Sequence
  chemically synthesized
gattttacagatttttgacttt

SEQ ID NO: 839311 - DNA, 22 bp, Artificial Sequence
  chemically synthesized
tacagatttttgacttttcagc

SEQ ID NO: 839312 - DNA, 22 bp, Artificial Sequence
  chemically synthesized
acagatttttgacttttcagct

SEQ ID NO: 839313 - DNA, 22 bp, Artificial Sequence
  chemically synthesized
cagatttttgacttttcagctc

SEQ ID NO: 839314 - DNA, 22 bp, Artificial Sequence
  chemically synthesized
atatgattgtgggagctgaaaa

SEQ ID NO: 839315 - DNA, 22 bp, Artificial Sequence
  chemically synthesized
actcatatgattgtgggagctg

SEQ ID NO: 839316 - DNA, 22 bp, Artificial Sequence
  chemically synthesized
ttgacttttcagctcccacaat

SEQ ID NO: 839317 - DNA, 22 bp, Artificial Sequence
  chemically synthesized
tgacttttcagctcccacaatc

SEQ ID NO: 839318 - DNA, 22 bp, Artificial Sequence
  chemically synthesized
gacttttcagctcccacaatca

SEQ ID NO: 839319 - DNA, 22 bp, Artificial Sequence
  chemically synthesized
acttttcagctcccacaatcat

SEQ ID NO: 839320 - DNA, 22 bp, Artificial Sequence
  chemically synthesized
agccattaactcatatgattgt

SEQ ID NO: 839321 - DNA, 22 bp, Artificial Sequence
  chemically synthesized
aagccattaactcatatgattg

SEQ ID NO: 839322 - DNA, 22 bp, Artificial Sequence
  chemically synthesized
ttcagctcccacaatcatatga

SEQ ID NO: 839323 - DNA, 22 bp, Artificial Sequence
  chemically synthesized
taagccattaactcatatgatt

SEQ ID NO: 839324 - DNA, 22 bp, Artificial Sequence
  chemically synthesized
tcagctcccacaatcatatgag

SEQ ID NO: 839325 - DNA, 22 bp, Artificial Sequence
  chemically synthesized
cagctcccacaatcatatgagt

SEQ ID NO: 839326 - DNA, 22 bp, Artificial Sequence
  chemically synthesized
agctcccacaatcatatgagtt

SEQ ID NO: 839327 - DNA, 22 bp, Artificial Sequence
  chemically synthesized
attttaagccattaactcatat

SEQ ID NO: 839328 - DNA, 22 bp, Artificial Sequence
  chemically synthesized
ccacaatcatatgagttaatgg

SEQ ID NO: 839329 - DNA, 22 bp, Artificial Sequence
  chemically synthesized
atggcttaaaatcaatctctct

SEQ ID NO: 839330 - DNA, 22 bp, Artificial Sequence
  chemically synthesized
aaaatcaatctctctctctctc

SEQ ID NO: 839331 - DNA, 22 bp, Artificial Sequence
  chemically synthesized
aaatcaatctctctctctctct

SEQ ID NO: 839332 - DNA, 22 bp, Artificial Sequence
  chemically synthesized
tctctctctctctctctctctc

SEQ ID NO: 839333 - DNA, 22 bp, Artificial Sequence
  chemically synthesized
tctctctctctctctctctctc

SEQ ID NO: 839334 - DNA, 22 bp, Artificial Sequence
  chemically synthesized
tctctctctctctctctctctg

SEQ ID NO: 839335 - DNA, 22 bp, Artificial Sequence
  chemically synthesized
tctctctctctctctctctgta

SEQ ID NO: 839336 - DNA, 22 bp, Artificial Sequence
  chemically synthesized
tctctctctctctctctgtatg

SEQ ID NO: 839337 - DNA, 22 bp, Artificial Sequence
  chemically synthesized
tatatatacacacatacagaga

SEQ ID NO: 839338 - DNA, 22 bp, Artificial Sequence
  chemically synthesized
tctctctctctctctgtatgtg

SEQ ID NO: 839339 - DNA, 22 bp, Artificial Sequence
  chemically synthesized
tctctctctctctgtatgtgtg

SEQ ID NO: 839340 - DNA, 22 bp, Artificial Sequence
  chemically synthesized
tctctctctctgtatgtgtgta

SEQ ID NO: 839341 - DNA, 22 bp, Artificial Sequence
  chemically synthesized
tctctctctgtatgtgtgtata

SEQ ID NO: 839342 - DNA, 22 bp, Artificial Sequence
  chemically synthesized
tctctctgtatgtgtgtatata

SEQ ID NO: 839343 - DNA, 22 bp, Artificial Sequence
  chemically synthesized
tctctgtatgtgtgtatatata

SEQ ID NO: 839344 - DNA, 22 bp, Artificial Sequence
  chemically synthesized
tctgtatgtgtgtatatatata

SEQ ID NO: 839345 - DNA, 22 bp, Artificial Sequence
  chemically synthesized
tgtatgtgtgtatatatataat

SEQ ID NO: 839346 - DNA, 22 bp, Artificial Sequence
  chemically synthesized
tatgtgtgtatatatataatat

SEQ ID NO: 839347 - DNA, 22 bp, Artificial Sequence
  chemically synthesized
atatatataataatattatata

SEQ ID NO: 839348 - DNA, 22 bp, Artificial Sequence
  chemically synthesized
gtaataatactaatatatataa

SEQ ID NO: 839349 - DNA, 22 bp, Artificial Sequence
  chemically synthesized
ttatatatattagtattattac

SEQ ID NO: 839350 - DNA, 22 bp, Artificial Sequence
  chemically synthesized
tatatattagtattattaccaa

SEQ ID NO: 839351 - DNA, 22 bp, Artificial Sequence
  chemically synthesized
gtattattaccaatctctctct

SEQ ID NO: 839352 - DNA, 22 bp, Artificial Sequence
  chemically synthesized
ttaccaatctctctctctctct

SEQ ID NO: 839353 - DNA, 22 bp, Artificial Sequence
  chemically synthesized
ccaatctctctctctctctcac

SEQ ID NO: 839354 - DNA, 22 bp, Artificial Sequence
  chemically synthesized
tctctctctctcactctctctc

SEQ ID NO: 839355 - DNA, 22 bp, Artificial Sequence
  chemically synthesized
tctctctctcactctctctctc

SEQ ID NO: 839356 - DNA, 22 bp, Artificial Sequence
  chemically synthesized
tctctctcactctctctctctc

SEQ ID NO: 839357 - DNA, 22 bp, Artificial Sequence
  chemically synthesized
tctctcactctctctctctctc

SEQ ID NO: 839358 - DNA, 22 bp, Artificial Sequence
  chemically synthesized
tctcactctctctctctctctc

SEQ ID NO: 839359 - DNA, 22 bp, Artificial Sequence
  chemically synthesized
tcactctctctctctctctctc

SEQ ID NO: 839360 - DNA, 22 bp, Artificial Sequence
  chemically synthesized
actctctctctctctctctctc

SEQ ID NO: 839361 - DNA, 22 bp, Artificial Sequence
  chemically synthesized
tctctctctctctctctctctc

SEQ ID NO: 839362 - DNA, 22 bp, Artificial Sequence
  chemically synthesized
tctctctctctctctctctctc

SEQ ID NO: 839363 - DNA, 22 bp, Artificial Sequence
  chemically synthesized
tctctctctctctctctctctc

SEQ ID NO: 839364 - DNA, 22 bp, Artificial Sequence
  chemically synthesized
tctctctctctctctctctctc

SEQ ID NO: 839365 - DNA, 22 bp, Artificial Sequence
  chemically synthesized
tctctctctctctctctctctc

SEQ ID NO: 839366 - DNA, 22 bp, Artificial Sequence
  chemically synthesized
tctctctctctctctctctcta

SEQ ID NO: 839367 - DNA, 22 bp, Artificial Sequence
  chemically synthesized
tctctctctctctctctctata

SEQ ID NO: 839368 - DNA, 22 bp, Artificial Sequence
  chemically synthesized
tctctctctctctctctatata

SEQ ID NO: 839369 - DNA, 22 bp, Artificial Sequence
  chemically synthesized
tctctctctctctctatatata

SEQ ID NO: 839370 - DNA, 22 bp, Artificial Sequence
  chemically synthesized
tctctctctctctatatatata

SEQ ID NO: 839371 - DNA, 22 bp, Artificial Sequence
  chemically synthesized
tctctctctctatatatatata

SEQ ID NO: 839372 - DNA, 22 bp, Artificial Sequence
  chemically synthesized
tctctctctatatatatatata

SEQ ID NO: 839373 - DNA, 22 bp, Artificial Sequence
  chemically synthesized
tctctctatatatatatatata

SEQ ID NO: 839374 - DNA, 22 bp, Artificial Sequence
  chemically synthesized
tctctatatatatatatatata

SEQ ID NO: 839375 - DNA, 22 bp, Artificial Sequence
  chemically synthesized
ggagatatatatatatatatat

SEQ ID NO: 839376 - DNA, 22 bp, Artificial Sequence
  chemically synthesized
tctatatatatatatatatata

SEQ ID NO: 839377 - DNA, 22 bp, Artificial Sequence
  chemically synthesized
tatatatatatatatatatata

SEQ ID NO: 839378 - DNA, 22 bp, Artificial Sequence
  chemically synthesized
tatatatatatatatatatata

SEQ ID NO: 839379 - DNA, 22 bp, Artificial Sequence
  chemically synthesized
ataattaggagatatatatata

SEQ ID NO: 839380 - DNA, 22 bp, Artificial Sequence
  chemically synthesized
tatctaataattaggagatata

SEQ ID NO: 839381 - DNA, 22 bp, Artificial Sequence
  chemically synthesized
ttgtatctaataattaggagat

SEQ ID NO: 839382 - DNA, 22 bp, Artificial Sequence
  chemically synthesized
tgttgtatctaataattaggag

SEQ ID NO: 839383 - DNA, 22 bp, Artificial Sequence
  chemically synthesized
ctgttgtatctaataattagga

SEQ ID NO: 839384 - DNA, 22 bp, Artificial Sequence
  chemically synthesized
tcttctgttgtatctaataatt

SEQ ID NO: 839385 - DNA, 22 bp, Artificial Sequence
  chemically synthesized
catctatcttctgttgtatcta

SEQ ID NO: 839386 - DNA, 22 bp, Artificial Sequence
  chemically synthesized
ccatctatcttctgttgtatct

SEQ ID NO: 839387 - DNA, 22 bp, Artificial Sequence
  chemically synthesized
tccatctatcttctgttgtatc

SEQ ID NO: 839388 - DNA, 22 bp, Artificial Sequence
  chemically synthesized
ctaattattagatacaacagaa

SEQ ID NO: 839389 - DNA, 22 bp, Artificial Sequence
  chemically synthesized
tttccatctatcttctgttgta

SEQ ID NO: 839390 - DNA, 22 bp, Artificial Sequence
  chemically synthesized
attattagatacaacagaagat

SEQ ID NO: 839391 - DNA, 22 bp, Artificial Sequence
  chemically synthesized
tctctttccatctatcttctgt

SEQ ID NO: 839392 - DNA, 22 bp, Artificial Sequence
  chemically synthesized
ttagatacaacagaagatagat

SEQ ID NO: 839393 - DNA, 22 bp, Artificial Sequence
  chemically synthesized
ctgtctctttccatctatcttc

SEQ ID NO: 839394 - DNA, 22 bp, Artificial Sequence
  chemically synthesized
gatacaacagaagatagatgga

SEQ ID NO: 839395 - DNA, 22 bp, Artificial Sequence
  chemically synthesized
gaatgctgctgtctctttccat

SEQ ID NO: 839396 - DNA, 22 bp, Artificial Sequence
  chemically synthesized
agaatgctgctgtctctttcca

SEQ ID NO: 839397 - DNA, 22 bp, Artificial Sequence
  chemically synthesized
gagtttagaatgctgctgtctc

SEQ ID NO: 839398 - DNA, 22 bp, Artificial Sequence
  chemically synthesized
tcattagagtttagaatgctgc

SEQ ID NO: 839399 - DNA, 22 bp, Artificial Sequence
  chemically synthesized
accattatcattagagtttaga

SEQ ID NO: 839400 - DNA, 22 bp, Artificial Sequence
  chemically synthesized
tcaattcaccattatcattaga

SEQ ID NO: 839401 - DNA, 22 bp, Artificial Sequence
  chemically synthesized
tattatcaattcaccattatca

SEQ ID NO: 839402 - DNA, 22 bp, Artificial Sequence
  chemically synthesized
taaactctaatgataatggtga

SEQ ID NO: 839403 - DNA, 22 bp, Artificial Sequence
  chemically synthesized
aactctaatgataatggtgaat

SEQ ID NO: 839404 - DNA, 22 bp, Artificial Sequence
  chemically synthesized
acctgtattatcaattcaccat

SEQ ID NO: 839405 - DNA, 22 bp, Artificial Sequence
  chemically synthesized
cacctgtattatcaattcacca

SEQ ID NO: 839406 - DNA, 22 bp, Artificial Sequence
  chemically synthesized
taatgataatggtgaattgata

SEQ ID NO: 839407 - DNA, 22 bp, Artificial Sequence
  chemically synthesized
atgataatggtgaattgataat

SEQ ID NO: 839408 - DNA, 22 bp, Artificial Sequence
  chemically synthesized
acagtccaatatttcacctgta

SEQ ID NO: 839409 - DNA, 22 bp, Artificial Sequence
  chemically synthesized
aaaactcacagtccaatatttc

SEQ ID NO: 839410 - DNA, 22 bp, Artificial Sequence
  chemically synthesized
ataatacaggtgaaatattgga

SEQ ID NO: 839411 - DNA, 22 bp, Artificial Sequence
  chemically synthesized
atcatctgaaaactcacagtcc

SEQ ID NO: 839412 - DNA, 22 bp, Artificial Sequence
  chemically synthesized
catcatctgaaaactcacagtc

SEQ ID NO: 839413 - DNA, 22 bp, Artificial Sequence
  chemically synthesized
tcatcatctgaaaactcacagt

SEQ ID NO: 839414 - DNA, 22 bp, Artificial Sequence
  chemically synthesized
ggttttcatcatctgaaaactc

SEQ ID NO: 839415 - DNA, 22 bp, Artificial Sequence
  chemically synthesized
tctaggttttcatcatctgaaa

SEQ ID NO: 839416 - DNA, 22 bp, Artificial Sequence
  chemically synthesized
atctaggttttcatcatctgaa

SEQ ID NO: 839417 - DNA, 22 bp, Artificial Sequence
  chemically synthesized
gactgtgagttttcagatgatg

SEQ ID NO: 839418 - DNA, 22 bp, Artificial Sequence
  chemically synthesized
tgagttttcagatgatgaaaac

SEQ ID NO: 839419 - DNA, 22 bp, Artificial Sequence
  chemically synthesized
agaacatttatctaggttttca

SEQ ID NO: 839420 - DNA, 22 bp, Artificial Sequence
  chemically synthesized
tcagatgatgaaaacctagata

SEQ ID NO: 839421 - DNA, 22 bp, Artificial Sequence
  chemically synthesized
cagatgatgaaaacctagataa

SEQ ID NO: 839422 - DNA, 22 bp, Artificial Sequence
  chemically synthesized
agatgatgaaaacctagataaa

SEQ ID NO: 839423 - DNA, 22 bp, Artificial Sequence
  chemically synthesized
ggcctgagaacatttatctagg

SEQ ID NO: 839424 - DNA, 22 bp, Artificial Sequence
  chemically synthesized
gggcctgagaacatttatctag

SEQ ID NO: 839425 - DNA, 22 bp, Artificial Sequence
  chemically synthesized
atcagtccttgggcctgagaac

SEQ ID NO: 839426 - DNA, 22 bp, Artificial Sequence
  chemically synthesized
gataaatgttctcaggcccaag

SEQ ID NO: 839427 - DNA, 22 bp, Artificial Sequence
  chemically synthesized
tgcattaatcagtccttgggcc

SEQ ID NO: 839428 - DNA, 22 bp, Artificial Sequence
  chemically synthesized
tcaggcccaaggactgattaat

SEQ ID NO: 839429 - DNA, 22 bp, Artificial Sequence
  chemically synthesized
aggcccaaggactgattaatgc

SEQ ID NO: 839430 - DNA, 22 bp, Artificial Sequence
  chemically synthesized
gaaatatattgtgcattaatca

SEQ ID NO: 839431 - DNA, 22 bp, Artificial Sequence
  chemically synthesized
tcattagaaatatattgtgcat

SEQ ID NO: 839432 - DNA, 22 bp, Artificial Sequence
  chemically synthesized
tgtcattagaaatatattgtgc

SEQ ID NO: 839433 - DNA, 22 bp, Artificial Sequence
  chemically synthesized
ctgtcattagaaatatattgtg

SEQ ID NO: 839434 - DNA, 22 bp, Artificial Sequence
  chemically synthesized
tctgtcattagaaatatattgt

SEQ ID NO: 839435 - DNA, 22 bp, Artificial Sequence
  chemically synthesized
ctttctgtcattagaaatatat

SEQ ID NO: 839436 - DNA, 22 bp, Artificial Sequence
  chemically synthesized
attaatgcacaatatatttcta

SEQ ID NO: 839437 - DNA, 22 bp, Artificial Sequence
  chemically synthesized
cctttctgtcattagaaatata

SEQ ID NO: 839438 - DNA, 22 bp, Artificial Sequence
  chemically synthesized
atgcacaatatatttctaatga

SEQ ID NO: 839439 - DNA, 22 bp, Artificial Sequence
  chemically synthesized
aaatatcatatttcctttctgt

SEQ ID NO: 839440 - DNA, 22 bp, Artificial Sequence
  chemically synthesized
ctaatgacagaaaggaaatatg

SEQ ID NO: 839441 - DNA, 22 bp, Artificial Sequence
  chemically synthesized
taatgacagaaaggaaatatga

SEQ ID NO: 839442 - DNA, 22 bp, Artificial Sequence
  chemically synthesized
atgacagaaaggaaatatgata

SEQ ID NO: 839443 - DNA, 22 bp, Artificial Sequence
  chemically synthesized
agtggattaaaatatcatattt

SEQ ID NO: 839444 - DNA, 22 bp, Artificial Sequence
  chemically synthesized
aataattaagtggattaaaata

SEQ ID NO: 839445 - DNA, 22 bp, Artificial Sequence
  chemically synthesized
ttgaataattaagtggattaaa

SEQ ID NO: 839446 - DNA, 22 bp, Artificial Sequence
  chemically synthesized
ctgttgaataattaagtggatt

SEQ ID NO: 839447 - DNA, 22 bp, Artificial Sequence
  chemically synthesized
cctgttgaataattaagtggat

SEQ ID NO: 839448 - DNA, 22 bp, Artificial Sequence
  chemically synthesized
ttcctgttgaataattaagtgg

SEQ ID NO: 839449 - DNA, 22 bp, Artificial Sequence
  chemically synthesized
taatccacttaattattcaaca

SEQ ID NO: 839450 - DNA, 22 bp, Artificial Sequence
  chemically synthesized
aatccacttaattattcaacag

SEQ ID NO: 839451 - DNA, 22 bp, Artificial Sequence
  chemically synthesized
atccacttaattattcaacagg

SEQ ID NO: 839452 - DNA, 22 bp, Artificial Sequence
  chemically synthesized
tgtggtgaagttcttcctgttg

SEQ ID NO: 839453 - DNA, 22 bp, Artificial Sequence
  chemically synthesized
aattattcaacaggaagaactt

SEQ ID NO: 839454 - DNA, 22 bp, Artificial Sequence
  chemically synthesized
attattcaacaggaagaacttc

SEQ ID NO: 839455 - DNA, 22 bp, Artificial Sequence
  chemically synthesized
atattatgtggtgaagttcttc

SEQ ID NO: 839456 - DNA, 22 bp, Artificial Sequence
  chemically synthesized
ttcaacaggaagaacttcacca

SEQ ID NO: 839457 - DNA, 22 bp, Artificial Sequence
  chemically synthesized
cagctaatattatgtggtgaag

SEQ ID NO: 839458 - DNA, 22 bp, Artificial Sequence
  chemically synthesized
aacaggaagaacttcaccacat

SEQ ID NO: 839459 - DNA, 22 bp, Artificial Sequence
  chemically synthesized
acagctaatattatgtggtgaa

SEQ ID NO: 839460 - DNA, 22 bp, Artificial Sequence
  chemically synthesized
ttacagctaatattatgtggtg

SEQ ID NO: 839461 - DNA, 22 bp, Artificial Sequence
  chemically synthesized
aaattcttacagctaatattat

SEQ ID NO: 839462 - DNA, 22 bp, Artificial Sequence
  chemically synthesized
ttaaaattcttacagctaatat

SEQ ID NO: 839463 - DNA, 22 bp, Artificial Sequence
  chemically synthesized
caccacataatattagctgtaa

SEQ ID NO: 839464 - DNA, 22 bp, Artificial Sequence
  chemically synthesized
accacataatattagctgtaag

SEQ ID NO: 839465 - DNA, 22 bp, Artificial Sequence
  chemically synthesized
gcaaaacaggattgttaaaatt

SEQ ID NO: 839466 - DNA, 22 bp, Artificial Sequence
  chemically synthesized
agcaaaacaggattgttaaaat

SEQ ID NO: 839467 - DNA, 22 bp, Artificial Sequence
  chemically synthesized
tagcaaaacaggattgttaaaa

SEQ ID NO: 839468 - DNA, 22 bp, Artificial Sequence
  chemically synthesized
gctgtaagaattttaacaatcc

SEQ ID NO: 839469 - DNA, 22 bp, Artificial Sequence
  chemically synthesized
taagaattttaacaatcctgtt

SEQ ID NO: 839470 - DNA, 22 bp, Artificial Sequence
  chemically synthesized
tcacacatcctttagcaaaaca

SEQ ID NO: 839471 - DNA, 22 bp, Artificial Sequence
  chemically synthesized
taacaatcctgttttgctaaag

SEQ ID NO: 839472 - DNA, 22 bp, Artificial Sequence
  chemically synthesized
aacaatcctgttttgctaaagg

SEQ ID NO: 839473 - DNA, 22 bp, Artificial Sequence
  chemically synthesized
acaatcctgttttgctaaagga

SEQ ID NO: 839474 - DNA, 22 bp, Artificial Sequence
  chemically synthesized
ttttgctaaaggatgtgtgaca

SEQ ID NO: 839475 - DNA, 22 bp, Artificial Sequence
  chemically synthesized
tgctaaaggatgtgtgacagat

SEQ ID NO: 839476 - DNA, 22 bp, Artificial Sequence
  chemically synthesized
gctaaaggatgtgtgacagata

SEQ ID NO: 839477 - DNA, 22 bp, Artificial Sequence
  chemically synthesized
ctaaaggatgtgtgacagatat

SEQ ID NO: 839478 - DNA, 22 bp, Artificial Sequence
  chemically synthesized
aaggatgtgtgacagatattat

SEQ ID NO: 839479 - DNA, 22 bp, Artificial Sequence
  chemically synthesized
gtgcacaaacatcataaatgac

SEQ ID NO: 839480 - DNA, 22 bp, Artificial Sequence
  chemically synthesized
ggtgcacaaacatcataaatga

SEQ ID NO: 839481 - DNA, 22 bp, Artificial Sequence
  chemically synthesized
tggtgcacaaacatcataaatg

SEQ ID NO: 839482 - DNA, 22 bp, Artificial Sequence
  chemically synthesized
tgtcatttatgatgtttgtgca

SEQ ID NO: 839483 - DNA, 22 bp, Artificial Sequence
  chemically synthesized
tatcaaataaattttggtgcac

SEQ ID NO: 839484 - DNA, 22 bp, Artificial Sequence
  chemically synthesized
gtatcaaataaattttggtgca

SEQ ID NO: 839485 - DNA, 22 bp, Artificial Sequence
  chemically synthesized
tgtatcaaataaattttggtgc

SEQ ID NO: 839486 - DNA, 22 bp, Artificial Sequence
  chemically synthesized
atgatgtttgtgcaccaaaatt

SEQ ID NO: 839487 - DNA, 22 bp, Artificial Sequence
  chemically synthesized
ttgtatcaaataaattttggtg

SEQ ID NO: 839488 - DNA, 22 bp, Artificial Sequence
  chemically synthesized
tgatgtttgtgcaccaaaattt

SEQ ID NO: 839489 - DNA, 22 bp, Artificial Sequence
  chemically synthesized
tttgtatcaaataaattttggt

SEQ ID NO: 839490 - DNA, 22 bp, Artificial Sequence
  chemically synthesized
ctttttgtatcaaataaatttt

SEQ ID NO: 839491 - DNA, 22 bp, Artificial Sequence
  chemically synthesized
actttttgtatcaaataaattt

SEQ ID NO: 839492 - DNA, 22 bp, Artificial Sequence
  chemically synthesized
gtgcaccaaaatttatttgata

SEQ ID NO: 839493 - DNA, 22 bp, Artificial Sequence
  chemically synthesized
tgcaccaaaatttatttgatac

SEQ ID NO: 839494 - DNA, 22 bp, Artificial Sequence
  chemically synthesized
atttgatacaaaaagtaagttg

SEQ ID NO: 839495 - DNA, 22 bp, Artificial Sequence
  chemically synthesized
tttgatacaaaaagtaagttgt

SEQ ID NO: 839496 - DNA, 22 bp, Artificial Sequence
  chemically synthesized
gatacaaaaagtaagttgtatt

SEQ ID NO: 839497 - DNA, 22 bp, Artificial Sequence
  chemically synthesized
atacaaaaagtaagttgtattt

SEQ ID NO: 839498 - DNA, 22 bp, Artificial Sequence
  chemically synthesized
tatttcttttttattatttatt

SEQ ID NO: 839499 - DNA, 22 bp, Artificial Sequence
  chemically synthesized
cttttttattatttatttattt

SEQ ID NO: 839500 - DNA, 22 bp, Artificial Sequence
  chemically synthesized
ttttttattatttatttattta

SEQ ID NO: 839501 - DNA, 22 bp, Artificial Sequence
  chemically synthesized
catcgtaaataaataaataaat

SEQ ID NO: 839502 - DNA, 22 bp, Artificial Sequence
  chemically synthesized
ttttattatttatttatttatt

SEQ ID NO: 839503 - DNA, 22 bp, Artificial Sequence
  chemically synthesized
tttattatttatttatttattt

SEQ ID NO: 839504 - DNA, 22 bp, Artificial Sequence
  chemically synthesized
ttattatttatttatttattta

SEQ ID NO: 839505 - DNA, 22 bp, Artificial Sequence
  chemically synthesized
tattatttatttatttatttat

SEQ ID NO: 839506 - DNA, 22 bp, Artificial Sequence
  chemically synthesized
attatttatttatttatttatt

SEQ ID NO: 839507 - DNA, 22 bp, Artificial Sequence
  chemically synthesized
ttatttatttatttatttattt

SEQ ID NO: 839508 - DNA, 22 bp, Artificial Sequence
  chemically synthesized
tttatttatttatttatttacg

SEQ ID NO: 839509 - DNA, 22 bp, Artificial Sequence
  chemically synthesized
atttatttatttatttacgatg

SEQ ID NO: 839510 - DNA, 22 bp, Artificial Sequence
  chemically synthesized
tttatttatttatttacgatgg

SEQ ID NO: 839511 - DNA, 22 bp, Artificial Sequence
  chemically synthesized
atttatttatttacgatggagt

SEQ ID NO: 839512 - DNA, 22 bp, Artificial Sequence
  chemically synthesized
tttatttatttacgatggagtt

SEQ ID NO: 839513 - DNA, 22 bp, Artificial Sequence
  chemically synthesized
ggcaacaagagtgaaactccat

SEQ ID NO: 839514 - DNA, 22 bp, Artificial Sequence
  chemically synthesized
atttatttacgatggagtttca

SEQ ID NO: 839515 - DNA, 22 bp, Artificial Sequence
  chemically synthesized
tttatttacgatggagtttcac

SEQ ID NO: 839516 - DNA, 22 bp, Artificial Sequence
  chemically synthesized
atttacgatggagtttcactct

SEQ ID NO: 839517 - DNA, 22 bp, Artificial Sequence
  chemically synthesized
acctgggcaacaagagtgaaac

SEQ ID NO: 839518 - DNA, 22 bp, Artificial Sequence
  chemically synthesized
tttacgatggagtttcactctt

SEQ ID NO: 839519 - DNA, 22 bp, Artificial Sequence
  chemically synthesized
taacctgggcaacaagagtgaa

SEQ ID NO: 839520 - DNA, 22 bp, Artificial Sequence
  chemically synthesized
acgatggagtttcactcttgtt

SEQ ID NO: 839521 - DNA, 22 bp, Artificial Sequence
  chemically synthesized
cgatggagtttcactcttgttg

SEQ ID NO: 839522 - DNA, 22 bp, Artificial Sequence
  chemically synthesized
cactctaacctgggcaacaaga

SEQ ID NO: 839523 - DNA, 22 bp, Artificial Sequence
  chemically synthesized
cactcttgttgcccaggttaga

SEQ ID NO: 839524 - DNA, 22 bp, Artificial Sequence
  chemically synthesized
actcttgttgcccaggttagag

SEQ ID NO: 839525 - DNA, 22 bp, Artificial Sequence
  chemically synthesized
ttgttgcccaggttagagtgca

SEQ ID NO: 839526 - DNA, 22 bp, Artificial Sequence
  chemically synthesized
gttgcccaggttagagtgcaat

SEQ ID NO: 839527 - DNA, 22 bp, Artificial Sequence
  chemically synthesized
ttgcccaggttagagtgcaatg

SEQ ID NO: 839528 - DNA, 22 bp, Artificial Sequence
  chemically synthesized
agccgagatcacgccattgcac

SEQ ID NO: 839529 - DNA, 22 bp, Artificial Sequence
  chemically synthesized
cccaggttagagtgcaatggcg

SEQ ID NO: 839530 - DNA, 22 bp, Artificial Sequence
  chemically synthesized
cactgagccgagatcacgccat

SEQ ID NO: 839531 - DNA, 22 bp, Artificial Sequence
  chemically synthesized
gagtgcaatggcgtgatctcgg

SEQ ID NO: 839532 - DNA, 22 bp, Artificial Sequence
  chemically synthesized
aacccgggaggcggaggttgca

SEQ ID NO: 839533 - DNA, 22 bp, Artificial Sequence
  chemically synthesized
gaacccgggaggcggaggttgc

SEQ ID NO: 839534 - DNA, 22 bp, Artificial Sequence
  chemically synthesized
cttgaacccgggaggcggaggt

SEQ ID NO: 839535 - DNA, 22 bp, Artificial Sequence
  chemically synthesized
ggctcagtgcaacctccgcctc

SEQ ID NO: 839536 - DNA, 22 bp, Artificial Sequence
  chemically synthesized
agtgcaacctccgcctcccggg

SEQ ID NO: 839537 - DNA, 22 bp, Artificial Sequence
  chemically synthesized
aggcaggagaattgcttgaacc

SEQ ID NO: 839538 - DNA, 22 bp, Artificial Sequence
  chemically synthesized
cgcctcccgggttcaagcaatt

SEQ ID NO: 839539 - DNA, 22 bp, Artificial Sequence
  chemically synthesized
ccgggttcaagcaattctcctg

SEQ ID NO: 839540 - DNA, 22 bp, Artificial Sequence
  chemically synthesized
gggaggctgaggcaggagaatt

SEQ ID NO: 839541 - DNA, 22 bp, Artificial Sequence
  chemically synthesized
ctcgggaggctgaggcaggaga

SEQ ID NO: 839542 - DNA, 22 bp, Artificial Sequence
  chemically synthesized
aagcaattctcctgcctcagcc

SEQ ID NO: 839543 - DNA, 22 bp, Artificial Sequence
  chemically synthesized
taatcccagctactcgggaggc

SEQ ID NO: 839544 - DNA, 22 bp, Artificial Sequence
  chemically synthesized
tcctgcctcagcctcccgagta

SEQ ID NO: 839545 - DNA, 22 bp, Artificial Sequence
  chemically synthesized
ctgcctcagcctcccgagtagc

SEQ ID NO: 839546 - DNA, 22 bp, Artificial Sequence
  chemically synthesized
cctcagcctcccgagtagctgg

SEQ ID NO: 839547 - DNA, 22 bp, Artificial Sequence
  chemically synthesized
agcctcccgagtagctgggatt

SEQ ID NO: 839548 - DNA, 22 bp, Artificial Sequence
  chemically synthesized
ccgagtagctgggattacaggt

SEQ ID NO: 839549 - DNA, 22 bp, Artificial Sequence
  chemically synthesized
gccaggcatggtggcgggcacc

SEQ ID NO: 839550 - DNA, 22 bp, Artificial Sequence
  chemically synthesized
ggattacaggtgcccgccacca

SEQ ID NO: 839551 - DNA, 22 bp, Artificial Sequence
  chemically synthesized
caggtgcccgccaccatgcctg

SEQ ID NO: 839552 - DNA, 22 bp, Artificial Sequence
  chemically synthesized
aaaatacaaaaaaattagccag

SEQ ID NO: 839553 - DNA, 22 bp, Artificial Sequence
  chemically synthesized
ctaaaaatacaaaaaaattagc

SEQ ID NO: 839554 - DNA, 22 bp, Artificial Sequence
  chemically synthesized
tactaaaaatacaaaaaaatta

SEQ ID NO: 839555 - DNA, 22 bp, Artificial Sequence
  chemically synthesized
gctaatttttttgtatttttag

SEQ ID NO: 839556 - DNA, 22 bp, Artificial Sequence
  chemically synthesized
atttttttgtatttttagtaga

SEQ ID NO: 839557 - DNA, 22 bp, Artificial Sequence
  chemically synthesized
ttttgtatttttagtagagatg

SEQ ID NO: 839558 - DNA, 22 bp, Artificial Sequence
  chemically synthesized
tttgtatttttagtagagatgg

SEQ ID NO: 839559 - DNA, 22 bp, Artificial Sequence
  chemically synthesized
ttgtatttttagtagagatggg

SEQ ID NO: 839560 - DNA, 22 bp, Artificial Sequence
  chemically synthesized
acatggtgaagccccatctcta

SEQ ID NO: 839561 - DNA, 22 bp, Artificial Sequence
  chemically synthesized
tgtatttttagtagagatgggg

SEQ ID NO: 839562 - DNA, 22 bp, Artificial Sequence
  chemically synthesized
gtatttttagtagagatggggc

SEQ ID NO: 839563 - DNA, 22 bp, Artificial Sequence
  chemically synthesized
tatttttagtagagatggggct

SEQ ID NO: 839564 - DNA, 22 bp, Artificial Sequence
  chemically synthesized
gctaacatggtgaagccccatc

SEQ ID NO: 839565 - DNA, 22 bp, Artificial Sequence
  chemically synthesized
ttagtagagatggggcttcacc

SEQ ID NO: 839566 - DNA, 22 bp, Artificial Sequence
  chemically synthesized
tagtagagatggggcttcacca

SEQ ID NO: 839567 - DNA, 22 bp, Artificial Sequence
  chemically synthesized
agtagagatggggcttcaccat

SEQ ID NO: 839568 - DNA, 22 bp, Artificial Sequence
  chemically synthesized
gtagagatggggcttcaccatg

SEQ ID NO: 839569 - DNA, 22 bp, Artificial Sequence
  chemically synthesized
gaaaccagcctggctaacatgg

SEQ ID NO: 839570 - DNA, 22 bp, Artificial Sequence
  chemically synthesized
caccatgttagccaggctggtt

SEQ ID NO: 839571 - DNA, 22 bp, Artificial Sequence
  chemically synthesized
accatgttagccaggctggttt

SEQ ID NO: 839572 - DNA, 22 bp, Artificial Sequence
  chemically synthesized
aggtcaggagttcgaaaccagc

SEQ ID NO: 839573 - DNA, 22 bp, Artificial Sequence
  chemically synthesized
gccaggctggtttcgaactcct

SEQ ID NO: 839574 - DNA, 22 bp, Artificial Sequence
  chemically synthesized
gtttcgaactcctgacctcagg

SEQ ID NO: 839575 - DNA, 22 bp, Artificial Sequence
  chemically synthesized
aagcgatggatcacctgaggtc

SEQ ID NO: 839576 - DNA, 22 bp, Artificial Sequence
  chemically synthesized
cgaactcctgacctcaggtgat

SEQ ID NO: 839577 - DNA, 22 bp, Artificial Sequence
  chemically synthesized
gaactcctgacctcaggtgatc

SEQ ID NO: 839578 - DNA, 22 bp, Artificial Sequence
  chemically synthesized
ggaggctgaagcgatggatcac

SEQ ID NO: 839579 - DNA, 22 bp, Artificial Sequence
  chemically synthesized
gggaggctgaagcgatggatca

SEQ ID NO: 839580 - DNA, 22 bp, Artificial Sequence
  chemically synthesized
ctgacctcaggtgatccatcgc

SEQ ID NO: 839581 - DNA, 22 bp, Artificial Sequence
  chemically synthesized
tgggaggctgaagcgatggatc

SEQ ID NO: 839582 - DNA, 22 bp, Artificial Sequence
  chemically synthesized
acctcaggtgatccatcgcttc

SEQ ID NO: 839583 - DNA, 22 bp, Artificial Sequence
  chemically synthesized
aggtgatccatcgcttcagcct

SEQ ID NO: 839584 - DNA, 22 bp, Artificial Sequence
  chemically synthesized
cagcactttgggaggctgaagc

SEQ ID NO: 839585 - DNA, 22 bp, Artificial Sequence
  chemically synthesized
taattccagcactttgggaggc

SEQ ID NO: 839586 - DNA, 22 bp, Artificial Sequence
  chemically synthesized
ctgtaattccagcactttggga

SEQ ID NO: 839587 - DNA, 22 bp, Artificial Sequence
  chemically synthesized
actcctgtaattccagcacttt

SEQ ID NO: 839588 - DNA, 22 bp, Artificial Sequence
  chemically synthesized
cagcctcccaaagtgctggaat

SEQ ID NO: 839589 - DNA, 22 bp, Artificial Sequence
  chemically synthesized
agcctcccaaagtgctggaatt

SEQ ID NO: 839590 - DNA, 22 bp, Artificial Sequence
  chemically synthesized
ccaaagtgctggaattacagga

SEQ ID NO: 839591 - DNA, 22 bp, Artificial Sequence
  chemically synthesized
ggcacagtggctcactcctgta

SEQ ID NO: 839592 - DNA, 22 bp, Artificial Sequence
  chemically synthesized
gaattacaggagtgagccactg

SEQ ID NO: 839593 - DNA, 22 bp, Artificial Sequence
  chemically synthesized
aaatacaggctgggcacagtgg

SEQ ID NO: 839594 - DNA, 22 bp, Artificial Sequence
  chemically synthesized
caggagtgagccactgtgccca

SEQ ID NO: 839595 - DNA, 22 bp, Artificial Sequence
  chemically synthesized
ataagaattgaaatacaggctg

SEQ ID NO: 839596 - DNA, 22 bp, Artificial Sequence
  chemically synthesized
aataagaattgaaatacaggct

SEQ ID NO: 839597 - DNA, 22 bp, Artificial Sequence
  chemically synthesized
taataagaattgaaatacaggc

SEQ ID NO: 839598 - DNA, 22 bp, Artificial Sequence
  chemically synthesized
tgcccagcctgtatttcaattc

SEQ ID NO: 839599 - DNA, 22 bp, Artificial Sequence
  chemically synthesized
tgagaaattttaataagaattg

SEQ ID NO: 839600 - DNA, 22 bp, Artificial Sequence
  chemically synthesized
atgagaaattttaataagaatt

SEQ ID NO: 839601 - DNA, 22 bp, Artificial Sequence
  chemically synthesized
tatttcaattcttattaaaatt

SEQ ID NO: 839602 - DNA, 22 bp, Artificial Sequence
  chemically synthesized
caattcttattaaaatttctca

SEQ ID NO: 839603 - DNA, 22 bp, Artificial Sequence
  chemically synthesized
aattcttattaaaatttctcat

SEQ ID NO: 839604 - DNA, 22 bp, Artificial Sequence
  chemically synthesized
ttattaaaatttctcataagat

SEQ ID NO: 839605 - DNA, 22 bp, Artificial Sequence
  chemically synthesized
attaaaatttctcataagattg

SEQ ID NO: 839606 - DNA, 22 bp, Artificial Sequence
  chemically synthesized
ttaaaatttctcataagattgt

SEQ ID NO: 839607 - DNA, 22 bp, Artificial Sequence
  chemically synthesized
aaatttctcataagattgtctt

SEQ ID NO: 839608 - DNA, 22 bp, Artificial Sequence
  chemically synthesized
ctcataagattgtctttcacta

SEQ ID NO: 839609 - DNA, 22 bp, Artificial Sequence
  chemically synthesized
tcataagattgtctttcactat

SEQ ID NO: 839610 - DNA, 22 bp, Artificial Sequence
  chemically synthesized
ataagattgtctttcactatct

SEQ ID NO: 839611 - DNA, 22 bp, Artificial Sequence
  chemically synthesized
tggaagtataaagagatagtga

SEQ ID NO: 839612 - DNA, 22 bp, Artificial Sequence
  chemically synthesized
atggaagtataaagagatagtg

SEQ ID NO: 839613 - DNA, 22 bp, Artificial Sequence
  chemically synthesized
ttatggaagtataaagagatag

SEQ ID NO: 839614 - DNA, 22 bp, Artificial Sequence
  chemically synthesized
tctttcactatctctttatact

SEQ ID NO: 839615 - DNA, 22 bp, Artificial Sequence
  chemically synthesized
caaattcttatggaagtataaa

SEQ ID NO: 839616 - DNA, 22 bp, Artificial Sequence
  chemically synthesized
tcactatctctttatacttcca

SEQ ID NO: 839617 - DNA, 22 bp, Artificial Sequence
  chemically synthesized
tacaaattcttatggaagtata

SEQ ID NO: 839618 - DNA, 22 bp, Artificial Sequence
  chemically synthesized
cactatctctttatacttccat

SEQ ID NO: 839619 - DNA, 22 bp, Artificial Sequence
  chemically synthesized
actatctctttatacttccata

SEQ ID NO: 839620 - DNA, 22 bp, Artificial Sequence
  chemically synthesized
ctctacaaattcttatggaagt

SEQ ID NO: 839621 - DNA, 22 bp, Artificial Sequence
  chemically synthesized
tctctttatacttccataagaa

SEQ ID NO: 839622 - DNA, 22 bp, Artificial Sequence
  chemically synthesized
agttactctacaaattcttatg

SEQ ID NO: 839623 - DNA, 22 bp, Artificial Sequence
  chemically synthesized
tttatacttccataagaatttg

SEQ ID NO: 839624 - DNA, 22 bp, Artificial Sequence
  chemically synthesized
tatacttccataagaatttgta

SEQ ID NO: 839625 - DNA, 22 bp, Artificial Sequence
  chemically synthesized
atacttccataagaatttgtag

SEQ ID NO: 839626 - DNA, 22 bp, Artificial Sequence
  chemically synthesized
tacttccataagaatttgtaga

SEQ ID NO: 839627 - DNA, 22 bp, Artificial Sequence
  chemically synthesized
tatatgtctaagttactctaca

SEQ ID NO: 839628 - DNA, 22 bp, Artificial Sequence
  chemically synthesized
ccataagaatttgtagagtaac

SEQ ID NO: 839629 - DNA, 22 bp, Artificial Sequence
  chemically synthesized
gtatatgtctaagttactctac

SEQ ID NO: 839630 - DNA, 22 bp, Artificial Sequence
  chemically synthesized
cataagaatttgtagagtaact

SEQ ID NO: 839631 - DNA, 22 bp, Artificial Sequence
  chemically synthesized
tgtatatgtctaagttactcta

SEQ ID NO: 839632 - DNA, 22 bp, Artificial Sequence
  chemically synthesized
ttttgtatatgtctaagttact

SEQ ID NO: 839633 - DNA, 22 bp, Artificial Sequence
  chemically synthesized
attttgtatatgtctaagttac

SEQ ID NO: 839634 - DNA, 22 bp, Artificial Sequence
  chemically synthesized
tattttgtatatgtctaagtta

SEQ ID NO: 839635 - DNA, 22 bp, Artificial Sequence
  chemically synthesized
ttattttgtatatgtctaagtt

SEQ ID NO: 839636 - DNA, 22 bp, Artificial Sequence
  chemically synthesized
tttattttgtatatgtctaagt

SEQ ID NO: 839637 - DNA, 22 bp, Artificial Sequence
  chemically synthesized
gtagagtaacttagacatatac

SEQ ID NO: 839638 - DNA, 22 bp, Artificial Sequence
  chemically synthesized
gctttttattttgtatatgtct

SEQ ID NO: 839639 - DNA, 22 bp, Artificial Sequence
  chemically synthesized
tagagtaacttagacatataca

SEQ ID NO: 839640 - DNA, 22 bp, Artificial Sequence
  chemically synthesized
agctttttattttgtatatgtc

SEQ ID NO: 839641 - DNA, 22 bp, Artificial Sequence
  chemically synthesized
tagctttttattttgtatatgt

SEQ ID NO: 839642 - DNA, 22 bp, Artificial Sequence
  chemically synthesized
agacatatacaaaataaaaagc

SEQ ID NO: 839643 - DNA, 22 bp, Artificial Sequence
  chemically synthesized
atgaaccctttagctttttatt

SEQ ID NO: 839644 - DNA, 22 bp, Artificial Sequence
  chemically synthesized
gacatatacaaaataaaaagct

SEQ ID NO: 839645 - DNA, 22 bp, Artificial Sequence
  chemically synthesized
taggtctaatgaaccctttagc

SEQ ID NO: 839646 - DNA, 22 bp, Artificial Sequence
  chemically synthesized
gtaggtctaatgaaccctttag

SEQ ID NO: 839647 - DNA, 22 bp, Artificial Sequence
  chemically synthesized
ccttgtaggtctaatgaaccct

SEQ ID NO: 839648 - DNA, 22 bp, Artificial Sequence
  chemically synthesized
gccttgtaggtctaatgaaccc

SEQ ID NO: 839649 - DNA, 22 bp, Artificial Sequence
  chemically synthesized
tttgccttgtaggtctaatgaa

SEQ ID NO: 839650 - DNA, 22 bp, Artificial Sequence
  chemically synthesized
ctgtttgccttgtaggtctaat

SEQ ID NO: 839651 - DNA, 22 bp, Artificial Sequence
  chemically synthesized
aagggttcattagacctacaag

SEQ ID NO: 839652 - DNA, 22 bp, Artificial Sequence
  chemically synthesized
gccattactgtttgccttgtag

SEQ ID NO: 839653 - DNA, 22 bp, Artificial Sequence
  chemically synthesized
attagacctacaaggcaaacag

SEQ ID NO: 839654 - DNA, 22 bp, Artificial Sequence
  chemically synthesized
gacctacaaggcaaacagtaat

SEQ ID NO: 839655 - DNA, 22 bp, Artificial Sequence
  chemically synthesized
caaggcaaacagtaatggctaa

SEQ ID NO: 839656 - DNA, 22 bp, Artificial Sequence
  chemically synthesized
agtataccagggaaattagcca

SEQ ID NO: 839657 - DNA, 22 bp, Artificial Sequence
  chemically synthesized
atgcagccctcagtataccagg

SEQ ID NO: 839658 - DNA, 22 bp, Artificial Sequence
  chemically synthesized
tgatgcagccctcagtatacca

SEQ ID NO: 839659 - DNA, 22 bp, Artificial Sequence
  chemically synthesized
ctgatgcagccctcagtatacc

SEQ ID NO: 839660 - DNA, 22 bp, Artificial Sequence
  chemically synthesized
atttccctggtatactgagggc

SEQ ID NO: 839661 - DNA, 22 bp, Artificial Sequence
  chemically synthesized
ccctggtatactgagggctgca

SEQ ID NO: 839662 - DNA, 22 bp, Artificial Sequence
  chemically synthesized
cctggtatactgagggctgcat

SEQ ID NO: 839663 - DNA, 22 bp, Artificial Sequence
  chemically synthesized
gtatactgagggctgcatcaga

SEQ ID NO: 839664 - DNA, 22 bp, Artificial Sequence
  chemically synthesized
ggtagaccaggtttctgatgca

SEQ ID NO: 839665 - DNA, 22 bp, Artificial Sequence
  chemically synthesized
aggtagaccaggtttctgatgc

SEQ ID NO: 839666 - DNA, 22 bp, Artificial Sequence
  chemically synthesized
tgtttaggtagaccaggtttct

SEQ ID NO: 839667 - DNA, 22 bp, Artificial Sequence
  chemically synthesized
agggctgcatcagaaacctggt

SEQ ID NO: 839668 - DNA, 22 bp, Artificial Sequence
  chemically synthesized
ttgtgtttaggtagaccaggtt

SEQ ID NO: 839669 - DNA, 22 bp, Artificial Sequence
  chemically synthesized
catcagaaacctggtctaccta

SEQ ID NO: 839670 - DNA, 22 bp, Artificial Sequence
  chemically synthesized
aagattgttgtgtttaggtaga

SEQ ID NO: 839671 - DNA, 22 bp, Artificial Sequence
  chemically synthesized
aggattaaagattgttgtgttt

SEQ ID NO: 839672 - DNA, 22 bp, Artificial Sequence
  chemically synthesized
gtctacctaaacacaacaatct

SEQ ID NO: 839673 - DNA, 22 bp, Artificial Sequence
  chemically synthesized
gctgaggattaaagattgttgt

SEQ ID NO: 839674 - DNA, 22 bp, Artificial Sequence
  chemically synthesized
agctgaggattaaagattgttg

SEQ ID NO: 839675 - DNA, 22 bp, Artificial Sequence
  chemically synthesized
tagctgaggattaaagattgtt

SEQ ID NO: 839676 - DNA, 22 bp, Artificial Sequence
  chemically synthesized
tttagctgaggattaaagattg

SEQ ID NO: 839677 - DNA, 22 bp, Artificial Sequence
  chemically synthesized
cctaaacacaacaatctttaat

SEQ ID NO: 839678 - DNA, 22 bp, Artificial Sequence
  chemically synthesized
aacacaacaatctttaatcctc

SEQ ID NO: 839679 - DNA, 22 bp, Artificial Sequence
  chemically synthesized
taatcctcagctaaagagtttc

SEQ ID NO: 839680 - DNA, 22 bp, Artificial Sequence
  chemically synthesized
aatcctcagctaaagagtttct

SEQ ID NO: 839681 - DNA, 22 bp, Artificial Sequence
  chemically synthesized
atcctcagctaaagagtttcta

SEQ ID NO: 839682 - DNA, 22 bp, Artificial Sequence
  chemically synthesized
agctaaagagtttctatacttt

SEQ ID NO: 839683 - DNA, 22 bp, Artificial Sequence
  chemically synthesized
atgataccatgaataaagtata

SEQ ID NO: 839684 - DNA, 22 bp, Artificial Sequence
  chemically synthesized
aatgataccatgaataaagtat

SEQ ID NO: 839685 - DNA, 22 bp, Artificial Sequence
  chemically synthesized
aagagtttctatactttattca

SEQ ID NO: 839686 - DNA, 22 bp, Artificial Sequence
  chemically synthesized
ttaatgataccatgaataaagt

SEQ ID NO: 839687 - DNA, 22 bp, Artificial Sequence
  chemically synthesized
gttcttaatgataccatgaata

SEQ ID NO: 839688 - DNA, 22 bp, Artificial Sequence
  chemically synthesized
ctatactttattcatggtatca

SEQ ID NO: 839689 - DNA, 22 bp, Artificial Sequence
  chemically synthesized
tatactttattcatggtatcat

SEQ ID NO: 839690 - DNA, 22 bp, Artificial Sequence
  chemically synthesized
atcctggttcttaatgatacca

SEQ ID NO: 839691 - DNA, 22 bp, Artificial Sequence
  chemically synthesized
tactttattcatggtatcatta

SEQ ID NO: 839692 - DNA, 22 bp, Artificial Sequence
  chemically synthesized
catcctggttcttaatgatacc

SEQ ID NO: 839693 - DNA, 22 bp, Artificial Sequence
  chemically synthesized
tattcatggtatcattaagaac

SEQ ID NO: 839694 - DNA, 22 bp, Artificial Sequence
  chemically synthesized
attcatggtatcattaagaacc

SEQ ID NO: 839695 - DNA, 22 bp, Artificial Sequence
  chemically synthesized
ttcatggtatcattaagaacca

SEQ ID NO: 839696 - DNA, 22 bp, Artificial Sequence
  chemically synthesized
atggtatcattaagaaccagga

SEQ ID NO: 839697 - DNA, 22 bp, Artificial Sequence
  chemically synthesized
aagtaacataagtttcatcctg

SEQ ID NO: 839698 - DNA, 22 bp, Artificial Sequence
  chemically synthesized
agaaccaggatgaaacttatgt

SEQ ID NO: 839699 - DNA, 22 bp, Artificial Sequence
  chemically synthesized
tacaaccattcaagtaacataa

SEQ ID NO: 839700 - DNA, 22 bp, Artificial Sequence
  chemically synthesized
ctgtacaaccattcaagtaaca

SEQ ID NO: 839701 - DNA, 22 bp, Artificial Sequence
  chemically synthesized
ctgctgtacaaccattcaagta

SEQ ID NO: 839702 - DNA, 22 bp, Artificial Sequence
  chemically synthesized
tgctgctgtacaaccattcaag

SEQ ID NO: 839703 - DNA, 22 bp, Artificial Sequence
  chemically synthesized
ctgctgctgtacaaccattcaa

SEQ ID NO: 839704 - DNA, 22 bp, Artificial Sequence
  chemically synthesized
tctgctgctgtacaaccattca

SEQ ID NO: 839705 - DNA, 22 bp, Artificial Sequence
  chemically synthesized
ttctgctgctgtacaaccattc

SEQ ID NO: 839706 - DNA, 22 bp, Artificial Sequence
  chemically synthesized
tttctgctgctgtacaaccatt

SEQ ID NO: 839707 - DNA, 22 bp, Artificial Sequence
  chemically synthesized
atgttacttgaatggttgtaca

SEQ ID NO: 839708 - DNA, 22 bp, Artificial Sequence
  chemically synthesized
tgttacttgaatggttgtacag

SEQ ID NO: 839709 - DNA, 22 bp, Artificial Sequence
  chemically synthesized
ctttttctgctgctgtacaacc

SEQ ID NO: 839710 - DNA, 22 bp, Artificial Sequence
  chemically synthesized
cctttttctgctgctgtacaac

SEQ ID NO: 839711 - DNA, 22 bp, Artificial Sequence
  chemically synthesized
cttgaatggttgtacagcagca

SEQ ID NO: 839712 - DNA, 22 bp, Artificial Sequence
  chemically synthesized
gaatggttgtacagcagcagaa

SEQ ID NO: 839713 - DNA, 22 bp, Artificial Sequence
  chemically synthesized
aatggttgtacagcagcagaaa

SEQ ID NO: 839714 - DNA, 22 bp, Artificial Sequence
  chemically synthesized
tatggtttcctttttctgctgc

SEQ ID NO: 839715 - DNA, 22 bp, Artificial Sequence
  chemically synthesized
cactgtatggtttcctttttct

SEQ ID NO: 839716 - DNA, 22 bp, Artificial Sequence
  chemically synthesized
tacagcagcagaaaaaggaaac

SEQ ID NO: 839717 - DNA, 22 bp, Artificial Sequence
  chemically synthesized
tagatgctacactgtatggttt

SEQ ID NO: 839718 - DNA, 22 bp, Artificial Sequence
  chemically synthesized
atagatgctacactgtatggtt

SEQ ID NO: 839719 - DNA, 22 bp, Artificial Sequence
  chemically synthesized
aataatgaatttatagatgcta

SEQ ID NO: 839720 - DNA, 22 bp, Artificial Sequence
  chemically synthesized
agccaccgcgcccagcctaaat

SEQ ID NO: 839721 - DNA, 22 bp, Artificial Sequence
  chemically synthesized
taaattcattatttaggctggg

SEQ ID NO: 839722 - DNA, 22 bp, Artificial Sequence
  chemically synthesized
cagacctgagccaccgcgccca

SEQ ID NO: 839723 - DNA, 22 bp, Artificial Sequence
  chemically synthesized
attatttaggctgggcgcggtg

SEQ ID NO: 839724 - DNA, 22 bp, Artificial Sequence
  chemically synthesized
tttaggctgggcgcggtggctc

SEQ ID NO: 839725 - DNA, 22 bp, Artificial Sequence
  chemically synthesized
ggattacagacctgagccaccg

SEQ ID NO: 839726 - DNA, 22 bp, Artificial Sequence
  chemically synthesized
aggctgggcgcggtggctcagg

SEQ ID NO: 839727 - DNA, 22 bp, Artificial Sequence
  chemically synthesized
ggctgggcgcggtggctcaggt

SEQ ID NO: 839728 - DNA, 22 bp, Artificial Sequence
  chemically synthesized
ggcgcggtggctcaggtctgta

SEQ ID NO: 839729 - DNA, 22 bp, Artificial Sequence
  chemically synthesized
ccaaagtgctgggattacagac

SEQ ID NO: 839730 - DNA, 22 bp, Artificial Sequence
  chemically synthesized
ggcctcccaaagtgctgggatt

SEQ ID NO: 839731 - DNA, 22 bp, Artificial Sequence
  chemically synthesized
aggtctgtaatcccagcacttt

SEQ ID NO: 839732 - DNA, 22 bp, Artificial Sequence
  chemically synthesized
taatcccagcactttgggaggc

SEQ ID NO: 839733 - DNA, 22 bp, Artificial Sequence
  chemically synthesized
aggtgatccacccgcctcggcc

SEQ ID NO: 839734 - DNA, 22 bp, Artificial Sequence
  chemically synthesized
caggtgatccacccgcctcggc

SEQ ID NO: 839735 - DNA, 22 bp, Artificial Sequence
  chemically synthesized
acttcaggtgatccacccgcct

SEQ ID NO: 839736 - DNA, 22 bp, Artificial Sequence
  chemically synthesized
gacttcaggtgatccacccgcc

SEQ ID NO: 839737 - DNA, 22 bp, Artificial Sequence
  chemically synthesized
tgggaggccgaggcgggtggat

SEQ ID NO: 839738 - DNA, 22 bp, Artificial Sequence
  chemically synthesized
gggaggccgaggcgggtggatc

SEQ ID NO: 839739 - DNA, 22 bp, Artificial Sequence
  chemically synthesized
ttgacttcaggtgatccacccg

SEQ ID NO: 839740 - DNA, 22 bp, Artificial Sequence
  chemically synthesized
ggaggccgaggcgggtggatca

SEQ ID NO: 839741 - DNA, 22 bp, Artificial Sequence
  chemically synthesized
aaactcttgacttcaggtgatc

SEQ ID NO: 839742 - DNA, 22 bp, Artificial Sequence
  chemically synthesized
gtctcaaactcttgacttcagg

SEQ ID NO: 839743 - DNA, 22 bp, Artificial Sequence
  chemically synthesized
gccaggctggtctcaaactctt

SEQ ID NO: 839744 - DNA, 22 bp, Artificial Sequence
  chemically synthesized
aagtcaagagtttgagaccagc

SEQ ID NO: 839745 - DNA, 22 bp, Artificial Sequence
  chemically synthesized
gtcatgttggccaggctggtct

SEQ ID NO: 839746 - DNA, 22 bp, Artificial Sequence
  chemically synthesized
cgtcatgttggccaggctggtc

SEQ ID NO: 839747 - DNA, 22 bp, Artificial Sequence
  chemically synthesized
gagaccagcctggccaacatga

SEQ ID NO: 839748 - DNA, 22 bp, Artificial Sequence
  chemically synthesized
agaccagcctggccaacatgac

SEQ ID NO: 839749 - DNA, 22 bp, Artificial Sequence
  chemically synthesized
gtagggacggggtttcgtcatg

SEQ ID NO: 839750 - DNA, 22 bp, Artificial Sequence
  chemically synthesized
agtagggacggggtttcgtcat

SEQ ID NO: 839751 - DNA, 22 bp, Artificial Sequence
  chemically synthesized
tagtagggacggggtttcgtca

SEQ ID NO: 839752 - DNA, 22 bp, Artificial Sequence
  chemically synthesized
ttagtagggacggggtttcgtc

SEQ ID NO: 839753 - DNA, 22 bp, Artificial Sequence
  chemically synthesized
gccaacatgacgaaaccccgtc

SEQ ID NO: 839754 - DNA, 22 bp, Artificial Sequence
  chemically synthesized
tatttttagtagggacggggtt

SEQ ID NO: 839755 - DNA, 22 bp, Artificial Sequence
  chemically synthesized
gtatttttagtagggacggggt

SEQ ID NO: 839756 - DNA, 22 bp, Artificial Sequence
  chemically synthesized
tgtatttttagtagggacgggg

SEQ ID NO: 839757 - DNA, 22 bp, Artificial Sequence
  chemically synthesized
ttgtatttttagtagggacggg

SEQ ID NO: 839758 - DNA, 22 bp, Artificial Sequence
  chemically synthesized
tttgtatttttagtagggacgg

SEQ ID NO: 839759 - DNA, 22 bp, Artificial Sequence
  chemically synthesized
ttttgtatttttagtagggacg

SEQ ID NO: 839760 - DNA, 22 bp, Artificial Sequence
  chemically synthesized
atttttttgtatttttagtagg

SEQ ID NO: 839761 - DNA, 22 bp, Artificial Sequence
  chemically synthesized
ctaaaaatacaaaaaaattagc

SEQ ID NO: 839762 - DNA, 22 bp, Artificial Sequence
  chemically synthesized
aaaatacaaaaaaattagctgg

SEQ ID NO: 839763 - DNA, 22 bp, Artificial Sequence
  chemically synthesized
ccaccatcatgcccagctaatt

SEQ ID NO: 839764 - DNA, 22 bp, Artificial Sequence
  chemically synthesized
caggctcccaccatcatgccca

SEQ ID NO: 839765 - DNA, 22 bp, Artificial Sequence
  chemically synthesized
gcattacaggctcccaccatca

SEQ ID NO: 839766 - DNA, 22 bp, Artificial Sequence
  chemically synthesized
gctgggcatgatggtgggagcc

SEQ ID NO: 839767 - DNA, 22 bp, Artificial Sequence
  chemically synthesized
ggcatgatggtgggagcctgta

SEQ ID NO: 839768 - DNA, 22 bp, Artificial Sequence
  chemically synthesized
ccgagtagctggcattacaggc

SEQ ID NO: 839769 - DNA, 22 bp, Artificial Sequence
  chemically synthesized
agcctaccgagtagctggcatt

SEQ ID NO: 839770 - DNA, 22 bp, Artificial Sequence
  chemically synthesized
cctcagcctaccgagtagctgg

SEQ ID NO: 839771 - DNA, 22 bp, Artificial Sequence
  chemically synthesized
gcctcagcctaccgagtagctg

SEQ ID NO: 839772 - DNA, 22 bp, Artificial Sequence
  chemically synthesized
ttgcctcagcctaccgagtagc

SEQ ID NO: 839773 - DNA, 22 bp, Artificial Sequence
  chemically synthesized
tcttgcctcagcctaccgagta

SEQ ID NO: 839774 - DNA, 22 bp, Artificial Sequence
  chemically synthesized
taatgccagctactcggtaggc

SEQ ID NO: 839775 - DNA, 22 bp, Artificial Sequence
  chemically synthesized
ttctcttgcctcagcctaccga

SEQ ID NO: 839776 - DNA, 22 bp, Artificial Sequence
  chemically synthesized
aagctattctcttgcctcagcc

SEQ ID NO: 839777 - DNA, 22 bp, Artificial Sequence
  chemically synthesized
ctcggtaggctgaggcaagaga

SEQ ID NO: 839778 - DNA, 22 bp, Artificial Sequence
  chemically synthesized
ggtaggctgaggcaagagaata

SEQ ID NO: 839779 - DNA, 22 bp, Artificial Sequence
  chemically synthesized
ccagattcaagctattctcttg

SEQ ID NO: 839780 - DNA, 22 bp, Artificial Sequence
  chemically synthesized
cgcctcccagattcaagctatt

SEQ ID NO: 839781 - DNA, 22 bp, Artificial Sequence
  chemically synthesized
aggcaagagaatagcttgaatc

SEQ ID NO: 839782 - DNA, 22 bp, Artificial Sequence
  chemically synthesized
caactccgcctcccagattcaa

SEQ ID NO: 839783 - DNA, 22 bp, Artificial Sequence
  chemically synthesized
actgcaactccgcctcccagat

SEQ ID NO: 839784 - DNA, 22 bp, Artificial Sequence
  chemically synthesized
ctcactgcaactccgcctccca

SEQ ID NO: 839785 - DNA, 22 bp, Artificial Sequence
  chemically synthesized
gctcactgcaactccgcctccc

SEQ ID NO: 839786 - DNA, 22 bp, Artificial Sequence
  chemically synthesized
tgctcactgcaactccgcctcc

SEQ ID NO: 839787 - DNA, 22 bp, Artificial Sequence
  chemically synthesized
gaatctgggaggcggagttgca

SEQ ID NO: 839788 - DNA, 22 bp, Artificial Sequence
  chemically synthesized
aatctgggaggcggagttgcag

SEQ ID NO: 839789 - DNA, 22 bp, Artificial Sequence
  chemically synthesized
ggaggcggagttgcagtgagca

SEQ ID NO: 839790 - DNA, 22 bp, Artificial Sequence
  chemically synthesized
gagtgcagtggtgccatctttg

SEQ ID NO: 839791 - DNA, 22 bp, Artificial Sequence
  chemically synthesized
cagtgagcaaagatggcaccac

SEQ ID NO: 839792 - DNA, 22 bp, Artificial Sequence
  chemically synthesized
cccaggctggagtgcagtggtg

SEQ ID NO: 839793 - DNA, 22 bp, Artificial Sequence
  chemically synthesized
cattgcccaggctggagtgcag

SEQ ID NO: 839794 - DNA, 22 bp, Artificial Sequence
  chemically synthesized
ctccattgcccaggctggagtg

SEQ ID NO: 839795 - DNA, 22 bp, Artificial Sequence
  chemically synthesized
cactccagcctgggcaatggag

SEQ ID NO: 839796 - DNA, 22 bp, Artificial Sequence
  chemically synthesized
agacagagtcctgctccattgc

SEQ ID NO: 839797 - DNA, 22 bp, Artificial Sequence
  chemically synthesized
gagacagagtcctgctccattg

SEQ ID NO: 839798 - DNA, 22 bp, Artificial Sequence
  chemically synthesized
tgagacagagtcctgctccatt

SEQ ID NO: 839799 - DNA, 22 bp, Artificial Sequence
  chemically synthesized
ttgagacagagtcctgctccat

SEQ ID NO: 839800 - DNA, 22 bp, Artificial Sequence
  chemically synthesized
cagcctgggcaatggagcagga

SEQ ID NO: 839801 - DNA, 22 bp, Artificial Sequence
  chemically synthesized
tttgagacagagtcctgctcca

SEQ ID NO: 839802 - DNA, 22 bp, Artificial Sequence
  chemically synthesized
ttttgagacagagtcctgctcc

SEQ ID NO: 839803 - DNA, 22 bp, Artificial Sequence
  chemically synthesized
tttttgagacagagtcctgctc

SEQ ID NO: 839804 - DNA, 22 bp, Artificial Sequence
  chemically synthesized
ttttttgagacagagtcctgct

SEQ ID NO: 839805 - DNA, 22 bp, Artificial Sequence
  chemically synthesized
tttttttgagacagagtcctgc

SEQ ID NO: 839806 - DNA, 22 bp, Artificial Sequence
  chemically synthesized
ggcaatggagcaggactctgtc

SEQ ID NO: 839807 - DNA, 22 bp, Artificial Sequence
  chemically synthesized
aataataattttttttttgaga

SEQ ID NO: 839808 - DNA, 22 bp, Artificial Sequence
  chemically synthesized
tgtctcaaaaaaaaaattatta

SEQ ID NO: 839809 - DNA, 22 bp, Artificial Sequence
  chemically synthesized
gacacacactgaataataattt

SEQ ID NO: 839810 - DNA, 22 bp, Artificial Sequence
  chemically synthesized
tctcaaaaaaaaaattattatt

SEQ ID NO: 839811 - DNA, 22 bp, Artificial Sequence
  chemically synthesized
agacacacactgaataataatt

SEQ ID NO: 839812 - DNA, 22 bp, Artificial Sequence
  chemically synthesized
aaaaaaaaaattattattcagt

SEQ ID NO: 839813 - DNA, 22 bp, Artificial Sequence
  chemically synthesized
caatatagaagcatttagacac

SEQ ID NO: 839814 - DNA, 22 bp, Artificial Sequence
  chemically synthesized
ttattcagtgtgtgtctaaatg

SEQ ID NO: 839815 - DNA, 22 bp, Artificial Sequence
  chemically synthesized
acaatatagaagcatttagaca

SEQ ID NO: 839816 - DNA, 22 bp, Artificial Sequence
  chemically synthesized
ttcagtgtgtgtctaaatgctt

SEQ ID NO: 839817 - DNA, 22 bp, Artificial Sequence
  chemically synthesized
agtgtgtgtctaaatgcttcta

SEQ ID NO: 839818 - DNA, 22 bp, Artificial Sequence
  chemically synthesized
ccaacttacaatatagaagcat

SEQ ID NO: 839819 - DNA, 22 bp, Artificial Sequence
  chemically synthesized
aatgcttctatattgtaagttg

SEQ ID NO: 839820 - DNA, 22 bp, Artificial Sequence
  chemically synthesized
ctatattgtaagttggcagggt

SEQ ID NO: 839821 - DNA, 22 bp, Artificial Sequence
  chemically synthesized
tatattgtaagttggcagggtt

SEQ ID NO: 839822 - DNA, 22 bp, Artificial Sequence
  chemically synthesized
tattgtaagttggcagggttgg

SEQ ID NO: 839823 - DNA, 22 bp, Artificial Sequence
  chemically synthesized
taagttggcagggttgggggtt

SEQ ID NO: 839824 - DNA, 22 bp, Artificial Sequence
  chemically synthesized
gcagggttgggggttgtgtggg

SEQ ID NO: 839825 - DNA, 22 bp, Artificial Sequence
  chemically synthesized
ggggttgtgtggggggtgggtg

SEQ ID NO: 839826 - DNA, 22 bp, Artificial Sequence
  chemically synthesized
agaagaggtagcaccacccacc

SEQ ID NO: 839827 - DNA, 22 bp, Artificial Sequence
  chemically synthesized
gagaagaggtagcaccacccac

SEQ ID NO: 839828 - DNA, 22 bp, Artificial Sequence
  chemically synthesized
tgtggggggtgggtggtgctac

SEQ ID NO: 839829 - DNA, 22 bp, Artificial Sequence
  chemically synthesized
aggaatttgagaagaggtagca

SEQ ID NO: 839830 - DNA, 22 bp, Artificial Sequence
  chemically synthesized
aaggaatttgagaagaggtagc

SEQ ID NO: 839831 - DNA, 22 bp, Artificial Sequence
  chemically synthesized
catttaaggaatttgagaagag

SEQ ID NO: 839832 - DNA, 22 bp, Artificial Sequence
  chemically synthesized
acatttaaggaatttgagaaga

SEQ ID NO: 839833 - DNA, 22 bp, Artificial Sequence
  chemically synthesized
gtttacatttaaggaatttgag

SEQ ID NO: 839834 - DNA, 22 bp, Artificial Sequence
  chemically synthesized
cctcttctcaaattccttaaat

SEQ ID NO: 839835 - DNA, 22 bp, Artificial Sequence
  chemically synthesized
gaagttggtttacatttaagga

SEQ ID NO: 839836 - DNA, 22 bp, Artificial Sequence
  chemically synthesized
ttctcaaattccttaaatgtaa

SEQ ID NO: 839837 - DNA, 22 bp, Artificial Sequence
  chemically synthesized
ctcaaattccttaaatgtaaac

SEQ ID NO: 839838 - DNA, 22 bp, Artificial Sequence
  chemically synthesized
tcaaattccttaaatgtaaacc

SEQ ID NO: 839839 - DNA, 22 bp, Artificial Sequence
  chemically synthesized
aaattccttaaatgtaaaccaa

SEQ ID NO: 839840 - DNA, 22 bp, Artificial Sequence
  chemically synthesized
ggaaaaagcctagaagttggtt

SEQ ID NO: 839841 - DNA, 22 bp, Artificial Sequence
  chemically synthesized
cttaaatgtaaaccaacttcta

SEQ ID NO: 839842 - DNA, 22 bp, Artificial Sequence
  chemically synthesized
aaatgtaaaccaacttctaggc

SEQ ID NO: 839843 - DNA, 22 bp, Artificial Sequence
  chemically synthesized
aatgtaaaccaacttctaggct

SEQ ID NO: 839844 - DNA, 22 bp, Artificial Sequence
  chemically synthesized
ctaggctttttcctaggttcac

SEQ ID NO: 839845 - DNA, 22 bp, Artificial Sequence
  chemically synthesized
gtgcaaagaaaagtgaacctag

SEQ ID NO: 839846 - DNA, 22 bp, Artificial Sequence
  chemically synthesized
taggctttttcctaggttcact

SEQ ID NO: 839847 - DNA, 22 bp, Artificial Sequence
  chemically synthesized
ggctttttcctaggttcacttt

SEQ ID NO: 839848 - DNA, 22 bp, Artificial Sequence
  chemically synthesized
tttcctaggttcacttttcttt

SEQ ID NO: 839849 - DNA, 22 bp, Artificial Sequence
  chemically synthesized
ttcctaggttcacttttctttg

SEQ ID NO: 839850 - DNA, 22 bp, Artificial Sequence
  chemically synthesized
tcctaggttcacttttctttgc

SEQ ID NO: 839851 - DNA, 22 bp, Artificial Sequence
  chemically synthesized
cctaggttcacttttctttgca

SEQ ID NO: 839852 - DNA, 22 bp, Artificial Sequence
  chemically synthesized
ctaggttcacttttctttgcac

SEQ ID NO: 839853 - DNA, 22 bp, Artificial Sequence
  chemically synthesized
ggttcacttttctttgcaccag

SEQ ID NO: 839854 - DNA, 22 bp, Artificial Sequence
  chemically synthesized
cacagagagagggtacctggtg

SEQ ID NO: 839855 - DNA, 22 bp, Artificial Sequence
  chemically synthesized
acttttctttgcaccaggtacc

SEQ ID NO: 839856 - DNA, 22 bp, Artificial Sequence
  chemically synthesized
gcacagagagagggtacctggt

SEQ ID NO: 839857 - DNA, 22 bp, Artificial Sequence
  chemically synthesized
ttctttgcaccaggtaccctct

SEQ ID NO: 839858 - DNA, 22 bp, Artificial Sequence
  chemically synthesized
tctttgcaccaggtaccctctc

SEQ ID NO: 839859 - DNA, 22 bp, Artificial Sequence
  chemically synthesized
agcttgcacagagagagggtac

SEQ ID NO: 839860 - DNA, 22 bp, Artificial Sequence
  chemically synthesized
ctttgcaccaggtaccctctct

SEQ ID NO: 839861 - DNA, 22 bp, Artificial Sequence
  chemically synthesized
tttgcaccaggtaccctctctc

SEQ ID NO: 839862 - DNA, 22 bp, Artificial Sequence
  chemically synthesized
tgcaccaggtaccctctctctg

SEQ ID NO: 839863 - DNA, 22 bp, Artificial Sequence
  chemically synthesized
gcaccaggtaccctctctctgt

SEQ ID NO: 839864 - DNA, 22 bp, Artificial Sequence
  chemically synthesized
caccaggtaccctctctctgtg

SEQ ID NO: 839865 - DNA, 22 bp, Artificial Sequence
  chemically synthesized
gaatgtctgagcttgcacagag

SEQ ID NO: 839866 - DNA, 22 bp, Artificial Sequence
  chemically synthesized
cctggaatgtctgagcttgcac

SEQ ID NO: 839867 - DNA, 22 bp, Artificial Sequence
  chemically synthesized
tctctgtgcaagctcagacatt

SEQ ID NO: 839868 - DNA, 22 bp, Artificial Sequence
  chemically synthesized
aaaagttacctggaatgtctga

SEQ ID NO: 839869 - DNA, 22 bp, Artificial Sequence
  chemically synthesized
tctgtgcaagctcagacattcc

SEQ ID NO: 839870 - DNA, 22 bp, Artificial Sequence
  chemically synthesized
tgtgcaagctcagacattccag

SEQ ID NO: 839871 - DNA, 22 bp, Artificial Sequence
  chemically synthesized
tgcaagctcagacattccaggt

SEQ ID NO: 839872 - DNA, 22 bp, Artificial Sequence
  chemically synthesized
gacaagaattcaaaagttacct

SEQ ID NO: 839873 - DNA, 22 bp, Artificial Sequence
  chemically synthesized
ggacaagaattcaaaagttacc

SEQ ID NO: 839874 - DNA, 22 bp, Artificial Sequence
  chemically synthesized
tggacaagaattcaaaagttac

SEQ ID NO: 839875 - DNA, 22 bp, Artificial Sequence
  chemically synthesized
agacattccaggtaacttttga

SEQ ID NO: 839876 - DNA, 22 bp, Artificial Sequence
  chemically synthesized
ttggacaagaattcaaaagtta

SEQ ID NO: 839877 - DNA, 22 bp, Artificial Sequence
  chemically synthesized
cttttggacaagaattcaaaag

SEQ ID NO: 839878 - DNA, 22 bp, Artificial Sequence
  chemically synthesized
caggtaacttttgaattcttgt

SEQ ID NO: 839879 - DNA, 22 bp, Artificial Sequence
  chemically synthesized
caggagtgatgttacttttgga

SEQ ID NO: 839880 - DNA, 22 bp, Artificial Sequence
  chemically synthesized
ttgaattcttgtccaaaagtaa

SEQ ID NO: 839881 - DNA, 22 bp, Artificial Sequence
  chemically synthesized
tgaattcttgtccaaaagtaac

SEQ ID NO: 839882 - DNA, 22 bp, Artificial Sequence
  chemically synthesized
gaattcttgtccaaaagtaaca

SEQ ID NO: 839883 - DNA, 22 bp, Artificial Sequence
  chemically synthesized
aattcttgtccaaaagtaacat

SEQ ID NO: 839884 - DNA, 22 bp, Artificial Sequence
  chemically synthesized
ttgtccaaaagtaacatcactc

SEQ ID NO: 839885 - DNA, 22 bp, Artificial Sequence
  chemically synthesized
gtccaaaagtaacatcactcct

SEQ ID NO: 839886 - DNA, 22 bp, Artificial Sequence
  chemically synthesized
tccaaaagtaacatcactcctg

SEQ ID NO: 839887 - DNA, 22 bp, Artificial Sequence
  chemically synthesized
aaaacatagagattgcaggagt

SEQ ID NO: 839888 - DNA, 22 bp, Artificial Sequence
  chemically synthesized
aagaaatggttgaaaacataga

SEQ ID NO: 839889 - DNA, 22 bp, Artificial Sequence
  chemically synthesized
aaagaaatggttgaaaacatag

SEQ ID NO: 839890 - DNA, 22 bp, Artificial Sequence
  chemically synthesized
taaagaaatggttgaaaacata

SEQ ID NO: 839891 - DNA, 22 bp, Artificial Sequence
  chemically synthesized
ctgcaatctctatgttttcaac

SEQ ID NO: 839892 - DNA, 22 bp, Artificial Sequence
  chemically synthesized
caatctctatgttttcaaccat

SEQ ID NO: 839893 - DNA, 22 bp, Artificial Sequence
  chemically synthesized
agattttaaagaaatggttgaa

SEQ ID NO: 839894 - DNA, 22 bp, Artificial Sequence
  chemically synthesized
tatgttttcaaccatttcttta

SEQ ID NO: 839895 - DNA, 22 bp, Artificial Sequence
  chemically synthesized
tgttttcaaccatttctttaaa

SEQ ID NO: 839896 - DNA, 22 bp, Artificial Sequence
  chemically synthesized
tcaaccatttctttaaaatctc

SEQ ID NO: 839897 - DNA, 22 bp, Artificial Sequence
  chemically synthesized
gatgaccatactgagattttaa

SEQ ID NO: 839898 - DNA, 22 bp, Artificial Sequence
  chemically synthesized
caaccatttctttaaaatctca

SEQ ID NO: 839899 - DNA, 22 bp, Artificial Sequence
  chemically synthesized
aaccatttctttaaaatctcag

SEQ ID NO: 839900 - DNA, 22 bp, Artificial Sequence
  chemically synthesized
ctttaaaatctcagtatggtca

SEQ ID NO: 839901 - DNA, 22 bp, Artificial Sequence
  chemically synthesized
tttaaaatctcagtatggtcat

SEQ ID NO: 839902 - DNA, 22 bp, Artificial Sequence
  chemically synthesized
acatgaagctagatgaccatac

SEQ ID NO: 839903 - DNA, 22 bp, Artificial Sequence
  chemically synthesized
aacatgaagctagatgaccata

SEQ ID NO: 839904 - DNA, 22 bp, Artificial Sequence
  chemically synthesized
taaaatctcagtatggtcatct

SEQ ID NO: 839905 - DNA, 22 bp, Artificial Sequence
  chemically synthesized
aaaatctcagtatggtcatcta

SEQ ID NO: 839906 - DNA, 22 bp, Artificial Sequence
  chemically synthesized
aaatctcagtatggtcatctag

SEQ ID NO: 839907 - DNA, 22 bp, Artificial Sequence
  chemically synthesized
agtatggtcatctagcttcatg

SEQ ID NO: 839908 - DNA, 22 bp, Artificial Sequence
  chemically synthesized
tgggagacaaagtaatgtgctt

SEQ ID NO: 839909 - DNA, 22 bp, Artificial Sequence
  chemically synthesized
gcttcatgttaagcacattact

SEQ ID NO: 839910 - DNA, 22 bp, Artificial Sequence
  chemically synthesized
attatgggagacaaagtaatgt

SEQ ID NO: 839911 - DNA, 22 bp, Artificial Sequence
  chemically synthesized
catgttaagcacattactttgt

SEQ ID NO: 839912 - DNA, 22 bp, Artificial Sequence
  chemically synthesized
atgttaagcacattactttgtc

SEQ ID NO: 839913 - DNA, 22 bp, Artificial Sequence
  chemically synthesized
agcacattactttgtctcccat

SEQ ID NO: 839914 - DNA, 22 bp, Artificial Sequence
  chemically synthesized
aggataaggagttgattatggg

SEQ ID NO: 839915 - DNA, 22 bp, Artificial Sequence
  chemically synthesized
ctttgtctcccataatcaactc

SEQ ID NO: 839916 - DNA, 22 bp, Artificial Sequence
  chemically synthesized
tgtctcccataatcaactcctt

SEQ ID NO: 839917 - DNA, 22 bp, Artificial Sequence
  chemically synthesized
gtctcccataatcaactcctta

SEQ ID NO: 839918 - DNA, 22 bp, Artificial Sequence
  chemically synthesized
tctcccataatcaactccttat

SEQ ID NO: 839919 - DNA, 22 bp, Artificial Sequence
  chemically synthesized
ccataatcaactccttatcctg

SEQ ID NO: 839920 - DNA, 22 bp, Artificial Sequence
  chemically synthesized
atgtcataaccagagacaaact

SEQ ID NO: 839921 - DNA, 22 bp, Artificial Sequence
  chemically synthesized
cttatcctgagtttgtctctgg

SEQ ID NO: 839922 - DNA, 22 bp, Artificial Sequence
  chemically synthesized
atcctgagtttgtctctggtta

SEQ ID NO: 839923 - DNA, 22 bp, Artificial Sequence
  chemically synthesized
tcctgagtttgtctctggttat

SEQ ID NO: 839924 - DNA, 22 bp, Artificial Sequence
  chemically synthesized
gaagattaatgtcataaccaga

SEQ ID NO: 839925 - DNA, 22 bp, Artificial Sequence
  chemically synthesized
ggaagattaatgtcataaccag

SEQ ID NO: 839926 - DNA, 22 bp, Artificial Sequence
  chemically synthesized
tggaagattaatgtcataacca

SEQ ID NO: 839927 - DNA, 22 bp, Artificial Sequence
  chemically synthesized
agtttgtctctggttatgacat

SEQ ID NO: 839928 - DNA, 22 bp, Artificial Sequence
  chemically synthesized
tttggaagattaatgtcataac

SEQ ID NO: 839929 - DNA, 22 bp, Artificial Sequence
  chemically synthesized
gtctctggttatgacattaatc

SEQ ID NO: 839930 - DNA, 22 bp, Artificial Sequence
  chemically synthesized
aattctttggaagattaatgtc

SEQ ID NO: 839931 - DNA, 22 bp, Artificial Sequence
  chemically synthesized
tctctggttatgacattaatct

SEQ ID NO: 839932 - DNA, 22 bp, Artificial Sequence
  chemically synthesized
tggttatgacattaatcttcca

SEQ ID NO: 839933 - DNA, 22 bp, Artificial Sequence
  chemically synthesized
gttatgacattaatcttccaaa

SEQ ID NO: 839934 - DNA, 22 bp, Artificial Sequence
  chemically synthesized
gagattgaattctttggaagat

SEQ ID NO: 839935 - DNA, 22 bp, Artificial Sequence
  chemically synthesized
tgacattaatcttccaaagaat

SEQ ID NO: 839936 - DNA, 22 bp, Artificial Sequence
  chemically synthesized
agagttggagattgaattcttt

SEQ ID NO: 839937 - DNA, 22 bp, Artificial Sequence
  chemically synthesized
taagagttggagattgaattct

SEQ ID NO: 839938 - DNA, 22 bp, Artificial Sequence
  chemically synthesized
atcttccaaagaattcaatctc

SEQ ID NO: 839939 - DNA, 22 bp, Artificial Sequence
  chemically synthesized
cctctaagagttggagattgaa

SEQ ID NO: 839940 - DNA, 22 bp, Artificial Sequence
  chemically synthesized
ccaaagaattcaatctccaact

SEQ ID NO: 839941 - DNA, 22 bp, Artificial Sequence
  chemically synthesized
caaagaattcaatctccaactc

SEQ ID NO: 839942 - DNA, 22 bp, Artificial Sequence
  chemically synthesized
agagaaggcctgcctctaagag

SEQ ID NO: 839943 - DNA, 22 bp, Artificial Sequence
  chemically synthesized
aatctccaactcttagaggcag

SEQ ID NO: 839944 - DNA, 22 bp, Artificial Sequence
  chemically synthesized
tcaatctaagagaaggcctgcc

SEQ ID NO: 839945 - DNA, 22 bp, Artificial Sequence
  chemically synthesized
caactcttagaggcaggccttc

SEQ ID NO: 839946 - DNA, 22 bp, Artificial Sequence
  chemically synthesized
ttagaggcaggccttctcttag

SEQ ID NO: 839947 - DNA, 22 bp, Artificial Sequence
  chemically synthesized
agaggcaggccttctcttagat

SEQ ID NO: 839948 - DNA, 22 bp, Artificial Sequence
  chemically synthesized
gaggcaggccttctcttagatt

SEQ ID NO: 839949 - DNA, 22 bp, Artificial Sequence
  chemically synthesized
catatataaaactgtcaatcta

SEQ ID NO: 839950 - DNA, 22 bp, Artificial Sequence
  chemically synthesized
attgcatatataaaactgtcaa

SEQ ID NO: 839951 - DNA, 22 bp, Artificial Sequence
  chemically synthesized
ctcttagattgacagttttata

SEQ ID NO: 839952 - DNA, 22 bp, Artificial Sequence
  chemically synthesized
tcttagattgacagttttatat

SEQ ID NO: 839953 - DNA, 22 bp, Artificial Sequence
  chemically synthesized
acattgattgcatatataaaac

SEQ ID NO: 839954 - DNA, 22 bp, Artificial Sequence
  chemically synthesized
ttagattgacagttttatatat

SEQ ID NO: 839955 - DNA, 22 bp, Artificial Sequence
  chemically synthesized
gacattgattgcatatataaaa

SEQ ID NO: 839956 - DNA, 22 bp, Artificial Sequence
  chemically synthesized
tgacattgattgcatatataaa

SEQ ID NO: 839957 - DNA, 22 bp, Artificial Sequence
  chemically synthesized
agattgacagttttatatatgc

SEQ ID NO: 839958 - DNA, 22 bp, Artificial Sequence
  chemically synthesized
gattgacagttttatatatgca

SEQ ID NO: 839959 - DNA, 22 bp, Artificial Sequence
  chemically synthesized
acagttttatatatgcaatcaa

SEQ ID NO: 839960 - DNA, 22 bp, Artificial Sequence
  chemically synthesized
acaggattttgacattgattgc

SEQ ID NO: 839961 - DNA, 22 bp, Artificial Sequence
  chemically synthesized
tatatatgcaatcaatgtcaaa

SEQ ID NO: 839962 - DNA, 22 bp, Artificial Sequence
  chemically synthesized
atatatgcaatcaatgtcaaaa

SEQ ID NO: 839963 - DNA, 22 bp, Artificial Sequence
  chemically synthesized
gaattaacaggattttgacatt

SEQ ID NO: 839964 - DNA, 22 bp, Artificial Sequence
  chemically synthesized
tatatgcaatcaatgtcaaaat

SEQ ID NO: 839965 - DNA, 22 bp, Artificial Sequence
  chemically synthesized
agacataaggtggagctagaat

SEQ ID NO: 839966 - DNA, 22 bp, Artificial Sequence
  chemically synthesized
ttaattctagctccaccttatg

SEQ ID NO: 839967 - DNA, 22 bp, Artificial Sequence
  chemically synthesized
attctagctccaccttatgtct

SEQ ID NO: 839968 - DNA, 22 bp, Artificial Sequence
  chemically synthesized
tagctccaccttatgtctcaat

SEQ ID NO: 839969 - DNA, 22 bp, Artificial Sequence
  chemically synthesized
gctccaccttatgtctcaattt

SEQ ID NO: 839970 - DNA, 22 bp, Artificial Sequence
  chemically synthesized
caccttatgtctcaatttcact

SEQ ID NO: 839971 - DNA, 22 bp, Artificial Sequence
  chemically synthesized
atgtctcaatttcacttctttc

SEQ ID NO: 839972 - DNA, 22 bp, Artificial Sequence
  chemically synthesized
tgtctcaatttcacttctttct

SEQ ID NO: 839973 - DNA, 22 bp, Artificial Sequence
  chemically synthesized
aatttcacttctttctttttac

SEQ ID NO: 839974 - DNA, 22 bp, Artificial Sequence
  chemically synthesized
gagcagtgaccatggagtaaaa

SEQ ID NO: 839975 - DNA, 22 bp, Artificial Sequence
  chemically synthesized
cacttctttctttttactccat

SEQ ID NO: 839976 - DNA, 22 bp, Artificial Sequence
  chemically synthesized
acttctttctttttactccatg

SEQ ID NO: 839977 - DNA, 22 bp, Artificial Sequence
  chemically synthesized
ctttctttttactccatggtca

SEQ ID NO: 839978 - DNA, 22 bp, Artificial Sequence
  chemically synthesized
tttctttttactccatggtcac

SEQ ID NO: 839979 - DNA, 22 bp, Artificial Sequence
  chemically synthesized
tctttttactccatggtcactg

SEQ ID NO: 839980 - DNA, 22 bp, Artificial Sequence
  chemically synthesized
ctttttactccatggtcactgc

SEQ ID NO: 839981 - DNA, 22 bp, Artificial Sequence
  chemically synthesized
tttttactccatggtcactgct

SEQ ID NO: 839982 - DNA, 22 bp, Artificial Sequence
  chemically synthesized
tttactccatggtcactgctcc

SEQ ID NO: 839983 - DNA, 22 bp, Artificial Sequence
  chemically synthesized
ttactccatggtcactgctcca

SEQ ID NO: 839984 - DNA, 22 bp, Artificial Sequence
  chemically synthesized
tactccatggtcactgctccag

SEQ ID NO: 839985 - DNA, 22 bp, Artificial Sequence
  chemically synthesized
actccatggtcactgctccagc

SEQ ID NO: 839986 - DNA, 22 bp, Artificial Sequence
  chemically synthesized
ctccatggtcactgctccagct

SEQ ID NO: 839987 - DNA, 22 bp, Artificial Sequence
  chemically synthesized
catggtcactgctccagcttgg

SEQ ID NO: 839988 - DNA, 22 bp, Artificial Sequence
  chemically synthesized
gaaggcaagagagcccaagctg

SEQ ID NO: 839989 - DNA, 22 bp, Artificial Sequence
  chemically synthesized
ctccagcttgggctctcttgcc

SEQ ID NO: 839990 - DNA, 22 bp, Artificial Sequence
  chemically synthesized
cagcttgggctctcttgccttc

SEQ ID NO: 839991 - DNA, 22 bp, Artificial Sequence
  chemically synthesized
gggctctcttgccttctaactg

SEQ ID NO: 839992 - DNA, 22 bp, Artificial Sequence
  chemically synthesized
ggctctcttgccttctaactgg

SEQ ID NO: 839993 - DNA, 22 bp, Artificial Sequence
  chemically synthesized
tcttgccttctaactggtctta

SEQ ID NO: 839994 - DNA, 22 bp, Artificial Sequence
  chemically synthesized
ttgccttctaactggtcttact

SEQ ID NO: 839995 - DNA, 22 bp, Artificial Sequence
  chemically synthesized
gccttctaactggtcttactga

SEQ ID NO: 839996 - DNA, 22 bp, Artificial Sequence
  chemically synthesized
ccttctaactggtcttactgac

SEQ ID NO: 839997 - DNA, 22 bp, Artificial Sequence
  chemically synthesized
ctaactggtcttactgacttca

SEQ ID NO: 839998 - DNA, 22 bp, Artificial Sequence
  chemically synthesized
taactggtcttactgacttcat

SEQ ID NO: 839999 - DNA, 22 bp, Artificial Sequence
  chemically synthesized
actggtcttactgacttcattt

SEQ ID NO: 840000 - DNA, 22 bp, Artificial Sequence
  chemically synthesized
gtcttactgacttcatttactc

SEQ ID NO: 840001 - DNA, 22 bp, Artificial Sequence
  chemically synthesized
tggaggataagggagtaaatga

SEQ ID NO: 840002 - DNA, 22 bp, Artificial Sequence
  chemically synthesized
actgacttcatttactccctta

SEQ ID NO: 840003 - DNA, 22 bp, Artificial Sequence
  chemically synthesized
ctgacttcatttactcccttat

SEQ ID NO: 840004 - DNA, 22 bp, Artificial Sequence
  chemically synthesized
acttcatttactcccttatcct

SEQ ID NO: 840005 - DNA, 22 bp, Artificial Sequence
  chemically synthesized
catttactcccttatcctccac

SEQ ID NO: 840006 - DNA, 22 bp, Artificial Sequence
  chemically synthesized
atttactcccttatcctccaca

SEQ ID NO: 840007 - DNA, 22 bp, Artificial Sequence
  chemically synthesized
actcccttatcctccacaacac

SEQ ID NO: 840008 - DNA, 22 bp, Artificial Sequence
  chemically synthesized
ctcccttatcctccacaacaca

SEQ ID NO: 840009 - DNA, 22 bp, Artificial Sequence
  chemically synthesized
ccttatcctccacaacacacac

SEQ ID NO: 840010 - DNA, 22 bp, Artificial Sequence
  chemically synthesized
atcctccacaacacacacacac

SEQ ID NO: 840011 - DNA, 22 bp, Artificial Sequence
  chemically synthesized
tcctccacaacacacacacaca

SEQ ID NO: 840012 - DNA, 22 bp, Artificial Sequence
  chemically synthesized
cacaacacacacacacacacac

SEQ ID NO: 840013 - DNA, 22 bp, Artificial Sequence
  chemically synthesized
acagtggggtggaagacgaata

SEQ ID NO: 840014 - DNA, 22 bp, Artificial Sequence
  chemically synthesized
ccatgctgatattcgtcttcca

SEQ ID NO: 840015 - DNA, 22 bp, Artificial Sequence
  chemically synthesized
ttaacagtggggtggaagacga

SEQ ID NO: 840016 - DNA, 22 bp, Artificial Sequence
  chemically synthesized
gacctgttaacagtggggtgga

SEQ ID NO: 840017 - DNA, 22 bp, Artificial Sequence
  chemically synthesized
atattcgtcttccaccccactg

SEQ ID NO: 840018 - DNA, 22 bp, Artificial Sequence
  chemically synthesized
gtcttccaccccactgttaaca

SEQ ID NO: 840019 - DNA, 22 bp, Artificial Sequence
  chemically synthesized
ccaccccactgttaacaggtct

SEQ ID NO: 840020 - DNA, 22 bp, Artificial Sequence
  chemically synthesized
caccccactgttaacaggtcta

SEQ ID NO: 840021 - DNA, 22 bp, Artificial Sequence
  chemically synthesized
atgacaggagaatacataatta

SEQ ID NO: 840022 - DNA, 22 bp, Artificial Sequence
  chemically synthesized
ttaacaggtctaattatgtatt

SEQ ID NO: 840023 - DNA, 22 bp, Artificial Sequence
  chemically synthesized
acaggtctaattatgtattctc

SEQ ID NO: 840024 - DNA, 22 bp, Artificial Sequence
  chemically synthesized
aggaattgatgacaggagaata

SEQ ID NO: 840025 - DNA, 22 bp, Artificial Sequence
  chemically synthesized
caggaattgatgacaggagaat

SEQ ID NO: 840026 - DNA, 22 bp, Artificial Sequence
  chemically synthesized
attatgtattctcctgtcatca

SEQ ID NO: 840027 - DNA, 22 bp, Artificial Sequence
  chemically synthesized
tgtattctcctgtcatcaattc

SEQ ID NO: 840028 - DNA, 22 bp, Artificial Sequence
  chemically synthesized
tcctgtcatcaattcctgaaat

SEQ ID NO: 840029 - DNA, 22 bp, Artificial Sequence
  chemically synthesized
gagagggaagggtatttcagga

SEQ ID NO: 840030 - DNA, 22 bp, Artificial Sequence
  chemically synthesized
ctgtcatcaattcctgaaatac

SEQ ID NO: 840031 - DNA, 22 bp, Artificial Sequence
  chemically synthesized
tcatcaattcctgaaataccct

SEQ ID NO: 840032 - DNA, 22 bp, Artificial Sequence
  chemically synthesized
ctgaaatacccttccctctcca

SEQ ID NO: 840033 - DNA, 22 bp, Artificial Sequence
  chemically synthesized
aaatacccttccctctccagct

SEQ ID NO: 840034 - DNA, 22 bp, Artificial Sequence
  chemically synthesized
aaaagcagaaggaagctggaga

SEQ ID NO: 840035 - DNA, 22 bp, Artificial Sequence
  chemically synthesized
gaaaagcagaaggaagctggag

SEQ ID NO: 840036 - DNA, 22 bp, Artificial Sequence
  chemically synthesized
tgaaaagcagaaggaagctgga

SEQ ID NO: 840037 - DNA, 22 bp, Artificial Sequence
  chemically synthesized
ccctctccagcttccttctgct

SEQ ID NO: 840038 - DNA, 22 bp, Artificial Sequence
  chemically synthesized
cctctccagcttccttctgctt

SEQ ID NO: 840039 - DNA, 22 bp, Artificial Sequence
  chemically synthesized
tccagcttccttctgcttttca

SEQ ID NO: 840040 - DNA, 22 bp, Artificial Sequence
  chemically synthesized
cagcttccttctgcttttcaaa

SEQ ID NO: 840041 - DNA, 22 bp, Artificial Sequence
  chemically synthesized
gtcatgaataagactttgaaaa

SEQ ID NO: 840042 - DNA, 22 bp, Artificial Sequence
  chemically synthesized
ccttctgcttttcaaagtctta

SEQ ID NO: 840043 - DNA, 22 bp, Artificial Sequence
  chemically synthesized
cttctgcttttcaaagtcttat

SEQ ID NO: 840044 - DNA, 22 bp, Artificial Sequence
  chemically synthesized
acctggtcatgaataagacttt

SEQ ID NO: 840045 - DNA, 22 bp, Artificial Sequence
  chemically synthesized
gacctggtcatgaataagactt

SEQ ID NO: 840046 - DNA, 22 bp, Artificial Sequence
  chemically synthesized
ctgcttttcaaagtcttattca

SEQ ID NO: 840047 - DNA, 22 bp, Artificial Sequence
  chemically synthesized
tgcttttcaaagtcttattcat

SEQ ID NO: 840048 - DNA, 22 bp, Artificial Sequence
  chemically synthesized
cttttcaaagtcttattcatga

SEQ ID NO: 840049 - DNA, 22 bp, Artificial Sequence
  chemically synthesized
aatttgacctggtcatgaataa

SEQ ID NO: 840050 - DNA, 22 bp, Artificial Sequence
  chemically synthesized
ttcaaagtcttattcatgacca

SEQ ID NO: 840051 - DNA, 22 bp, Artificial Sequence
  chemically synthesized
tcaaagtcttattcatgaccag

SEQ ID NO: 840052 - DNA, 22 bp, Artificial Sequence
  chemically synthesized
caaagtcttattcatgaccagg

SEQ ID NO: 840053 - DNA, 22 bp, Artificial Sequence
  chemically synthesized
aaagtcttattcatgaccaggt

SEQ ID NO: 840054 - DNA, 22 bp, Artificial Sequence
  chemically synthesized
caggaggaggctgaatttgacc

SEQ ID NO: 840055 - DNA, 22 bp, Artificial Sequence
  chemically synthesized
attcatgaccaggtcaaattca

SEQ ID NO: 840056 - DNA, 22 bp, Artificial Sequence
  chemically synthesized
ccaggaggaggctgaatttgac

SEQ ID NO: 840057 - DNA, 22 bp, Artificial Sequence
  chemically synthesized
ttcatgaccaggtcaaattcag

SEQ ID NO: 840058 - DNA, 22 bp, Artificial Sequence
  chemically synthesized
atgaccaggtcaaattcagcct

SEQ ID NO: 840059 - DNA, 22 bp, Artificial Sequence
  chemically synthesized
gtggaatgcttccaggaggagg

SEQ ID NO: 840060 - DNA, 22 bp, Artificial Sequence
  chemically synthesized
agtggaatgcttccaggaggag

SEQ ID NO: 840061 - DNA, 22 bp, Artificial Sequence
  chemically synthesized
agcctcctcctggaagcattcc

SEQ ID NO: 840062 - DNA, 22 bp, Artificial Sequence
  chemically synthesized
aatgagggcttagtggaatgct

SEQ ID NO: 840063 - DNA, 22 bp, Artificial Sequence
  chemically synthesized
aaatgagggcttagtggaatgc

SEQ ID NO: 840064 - DNA, 22 bp, Artificial Sequence
  chemically synthesized
taaatgagggcttagtggaatg

SEQ ID NO: 840065 - DNA, 22 bp, Artificial Sequence
  chemically synthesized
ctcctggaagcattccactaag

SEQ ID NO: 840066 - DNA, 22 bp, Artificial Sequence
  chemically synthesized
ctggaagcattccactaagccc

SEQ ID NO: 840067 - DNA, 22 bp, Artificial Sequence
  chemically synthesized
gaagcattccactaagccctca

SEQ ID NO: 840068 - DNA, 22 bp, Artificial Sequence
  chemically synthesized
gaggaggagttttaaatgaggg

SEQ ID NO: 840069 - DNA, 22 bp, Artificial Sequence
  chemically synthesized
cactaagccctcatttaaaact

SEQ ID NO: 840070 - DNA, 22 bp, Artificial Sequence
  chemically synthesized
agccctcatttaaaactcctcc

SEQ ID NO: 840071 - DNA, 22 bp, Artificial Sequence
  chemically synthesized
agagaaaactagaggaggagtt

SEQ ID NO: 840072 - DNA, 22 bp, Artificial Sequence
  chemically synthesized
atttaaaactcctcctctagtt

SEQ ID NO: 840073 - DNA, 22 bp, Artificial Sequence
  chemically synthesized
aaaactcctcctctagttttct

SEQ ID NO: 840074 - DNA, 22 bp, Artificial Sequence
  chemically synthesized
caaaatgttgagagaaaactag

SEQ ID NO: 840075 - DNA, 22 bp, Artificial Sequence
  chemically synthesized
aaactcctcctctagttttctc

SEQ ID NO: 840076 - DNA, 22 bp, Artificial Sequence
  chemically synthesized
ctcctctagttttctctcaaca

SEQ ID NO: 840077 - DNA, 22 bp, Artificial Sequence
  chemically synthesized
ctctagttttctctcaacattt

SEQ ID NO: 840078 - DNA, 22 bp, Artificial Sequence
  chemically synthesized
tagttttctctcaacattttgt

SEQ ID NO: 840079 - DNA, 22 bp, Artificial Sequence
  chemically synthesized
gttttctctcaacattttgtaa

SEQ ID NO: 840080 - DNA, 22 bp, Artificial Sequence
  chemically synthesized
agtagagcagtattacaaaatg

SEQ ID NO: 840081 - DNA, 22 bp, Artificial Sequence
  chemically synthesized
cagtagagcagtattacaaaat

SEQ ID NO: 840082 - DNA, 22 bp, Artificial Sequence
  chemically synthesized
tctctcaacattttgtaatact

SEQ ID NO: 840083 - DNA, 22 bp, Artificial Sequence
  chemically synthesized
ctctcaacattttgtaatactg

SEQ ID NO: 840084 - DNA, 22 bp, Artificial Sequence
  chemically synthesized
tctcaacattttgtaatactgc

SEQ ID NO: 840085 - DNA, 22 bp, Artificial Sequence
  chemically synthesized
tcaacattttgtaatactgctc

SEQ ID NO: 840086 - DNA, 22 bp, Artificial Sequence
  chemically synthesized
aacattttgtaatactgctcta

SEQ ID NO: 840087 - DNA, 22 bp, Artificial Sequence
  chemically synthesized
ggataggtgcttcagtagagca

SEQ ID NO: 840088 - DNA, 22 bp, Artificial Sequence
  chemically synthesized
aggataggtgcttcagtagagc

SEQ ID NO: 840089 - DNA, 22 bp, Artificial Sequence
  chemically synthesized
tgtaatactgctctactgaagc

SEQ ID NO: 840090 - DNA, 22 bp, Artificial Sequence
  chemically synthesized
gtaatactgctctactgaagca

SEQ ID NO: 840091 - DNA, 22 bp, Artificial Sequence
  chemically synthesized
taatactgctctactgaagcac

SEQ ID NO: 840092 - DNA, 22 bp, Artificial Sequence
  chemically synthesized
ctctactgaagcacctatccta

SEQ ID NO: 840093 - DNA, 22 bp, Artificial Sequence
  chemically synthesized
ggcaaggcagtttaggataggt

SEQ ID NO: 840094 - DNA, 22 bp, Artificial Sequence
  chemically synthesized
aggcaaggcagtttaggatagg

SEQ ID NO: 840095 - DNA, 22 bp, Artificial Sequence
  chemically synthesized
tactgaagcacctatcctaaac

SEQ ID NO: 840096 - DNA, 22 bp, Artificial Sequence
  chemically synthesized
ctgaagcacctatcctaaactg

SEQ ID NO: 840097 - DNA, 22 bp, Artificial Sequence
  chemically synthesized
aagcacctatcctaaactgcct

SEQ ID NO: 840098 - DNA, 22 bp, Artificial Sequence
  chemically synthesized
gacaagtatatttaggcaaggc

SEQ ID NO: 840099 - DNA, 22 bp, Artificial Sequence
  chemically synthesized
ggacaagtatatttaggcaagg

SEQ ID NO: 840100 - DNA, 22 bp, Artificial Sequence
  chemically synthesized
tcctaaactgccttgcctaaat

SEQ ID NO: 840101 - DNA, 22 bp, Artificial Sequence
  chemically synthesized
aactgccttgcctaaatatact

SEQ ID NO: 840102 - DNA, 22 bp, Artificial Sequence
  chemically synthesized
ccttgcctaaatatacttgtcc

SEQ ID NO: 840103 - DNA, 22 bp, Artificial Sequence
  chemically synthesized
gcctaaatatacttgtccaaat

SEQ ID NO: 840104 - DNA, 22 bp, Artificial Sequence
  chemically synthesized
cctaaatatacttgtccaaata

SEQ ID NO: 840105 - DNA, 22 bp, Artificial Sequence
  chemically synthesized
acaatcaaatgtgggtatttgg

SEQ ID NO: 840106 - DNA, 22 bp, Artificial Sequence
  chemically synthesized
aatatacttgtccaaataccca

SEQ ID NO: 840107 - DNA, 22 bp, Artificial Sequence
  chemically synthesized
aagagctcacaatcaaatgtgg

SEQ ID NO: 840108 - DNA, 22 bp, Artificial Sequence
  chemically synthesized
aaagagctcacaatcaaatgtg

SEQ ID NO: 840109 - DNA, 22 bp, Artificial Sequence
  chemically synthesized
gtccaaatacccacatttgatt

SEQ ID NO: 840110 - DNA, 22 bp, Artificial Sequence
  chemically synthesized
taaagagctcacaatcaaatgt

SEQ ID NO: 840111 - DNA, 22 bp, Artificial Sequence
  chemically synthesized
tccaaatacccacatttgattg

SEQ ID NO: 840112 - DNA, 22 bp, Artificial Sequence
  chemically synthesized
tctttaaagagctcacaatcaa

SEQ ID NO: 840113 - DNA, 22 bp, Artificial Sequence
  chemically synthesized
gtctttaaagagctcacaatca

SEQ ID NO: 840114 - DNA, 22 bp, Artificial Sequence
  chemically synthesized
tgtctttaaagagctcacaatc

SEQ ID NO: 840115 - DNA, 22 bp, Artificial Sequence
  chemically synthesized
agcctttgtctttaaagagctc

SEQ ID NO: 840116 - DNA, 22 bp, Artificial Sequence
  chemically synthesized
gattgtgagctctttaaagaca

SEQ ID NO: 840117 - DNA, 22 bp, Artificial Sequence
  chemically synthesized
attgtgagctctttaaagacaa

SEQ ID NO: 840118 - DNA, 22 bp, Artificial Sequence
  chemically synthesized
tgagctctttaaagacaaaggc

SEQ ID NO: 840119 - DNA, 22 bp, Artificial Sequence
  chemically synthesized
tttaaagacaaaggctgaatct

SEQ ID NO: 840120 - DNA, 22 bp, Artificial Sequence
  chemically synthesized
taaagacaaaggctgaatctta

SEQ ID NO: 840121 - DNA, 22 bp, Artificial Sequence
  chemically synthesized
aaagacaaaggctgaatcttac

SEQ ID NO: 840122 - DNA, 22 bp, Artificial Sequence
  chemically synthesized
aagacaaaggctgaatcttact

SEQ ID NO: 840123 - DNA, 22 bp, Artificial Sequence
  chemically synthesized
aatcttacttttttcctgtatc

SEQ ID NO: 840124 - DNA, 22 bp, Artificial Sequence
  chemically synthesized
acttttttcctgtatcccctct

SEQ ID NO: 840125 - DNA, 22 bp, Artificial Sequence
  chemically synthesized
cttttttcctgtatcccctcta

SEQ ID NO: 840126 - DNA, 22 bp, Artificial Sequence
  chemically synthesized
atatcagagatggtagagggga

SEQ ID NO: 840127 - DNA, 22 bp, Artificial Sequence
  chemically synthesized
ttttcctgtatcccctctacca

SEQ ID NO: 840128 - DNA, 22 bp, Artificial Sequence
  chemically synthesized
tttcctgtatcccctctaccat

SEQ ID NO: 840129 - DNA, 22 bp, Artificial Sequence
  chemically synthesized
ttcctgtatcccctctaccatc

SEQ ID NO: 840130 - DNA, 22 bp, Artificial Sequence
  chemically synthesized
tctaatatcagagatggtagag

SEQ ID NO: 840131 - DNA, 22 bp, Artificial Sequence
  chemically synthesized
tcctgtatcccctctaccatct

SEQ ID NO: 840132 - DNA, 22 bp, Artificial Sequence
  chemically synthesized
cctgtatcccctctaccatctc

SEQ ID NO: 840133 - DNA, 22 bp, Artificial Sequence
  chemically synthesized
ctgtatcccctctaccatctct

SEQ ID NO: 840134 - DNA, 22 bp, Artificial Sequence
  chemically synthesized
tgctatctaatatcagagatgg

SEQ ID NO: 840135 - DNA, 22 bp, Artificial Sequence
  chemically synthesized
tatcccctctaccatctctgat

SEQ ID NO: 840136 - DNA, 22 bp, Artificial Sequence
  chemically synthesized
tgtgctatctaatatcagagat

SEQ ID NO: 840137 - DNA, 22 bp, Artificial Sequence
  chemically synthesized
ctctgtgctatctaatatcaga

SEQ ID NO: 840138 - DNA, 22 bp, Artificial Sequence
  chemically synthesized
taccatctctgatattagatag

SEQ ID NO: 840139 - DNA, 22 bp, Artificial Sequence
  chemically synthesized
ccatctctgatattagatagca

SEQ ID NO: 840140 - DNA, 22 bp, Artificial Sequence
  chemically synthesized
aatgcctactctgtgctatcta

SEQ ID NO: 840141 - DNA, 22 bp, Artificial Sequence
  chemically synthesized
gaatgcctactctgtgctatct

SEQ ID NO: 840142 - DNA, 22 bp, Artificial Sequence
  chemically synthesized
tgatattagatagcacagagta

SEQ ID NO: 840143 - DNA, 22 bp, Artificial Sequence
  chemically synthesized
atattagatagcacagagtagg

SEQ ID NO: 840144 - DNA, 22 bp, Artificial Sequence
  chemically synthesized
agcgaacgtttgaatgcctact

SEQ ID NO: 840145 - DNA, 22 bp, Artificial Sequence
  chemically synthesized
gatagcacagagtaggcattca

SEQ ID NO: 840146 - DNA, 22 bp, Artificial Sequence
  chemically synthesized
agttcagcgaacgtttgaatgc

SEQ ID NO: 840147 - DNA, 22 bp, Artificial Sequence
  chemically synthesized
agttcagttcagcgaacgtttg

SEQ ID NO: 840148 - DNA, 22 bp, Artificial Sequence
  chemically synthesized
aaacgttcgctgaactgaactg

SEQ ID NO: 840149 - DNA, 22 bp, Artificial Sequence
  chemically synthesized
gcaaccaaagagttcagttcag

SEQ ID NO: 840150 - DNA, 22 bp, Artificial Sequence
  chemically synthesized
gctgaactgaactgaactcttt

SEQ ID NO: 840151 - DNA, 22 bp, Artificial Sequence
  chemically synthesized
aactgaactgaactctttggtt

SEQ ID NO: 840152 - DNA, 22 bp, Artificial Sequence
  chemically synthesized
ggatgccgctggcaaccaaaga

SEQ ID NO: 840153 - DNA, 22 bp, Artificial Sequence
  chemically synthesized
aactgaactctttggttgccag

SEQ ID NO: 840154 - DNA, 22 bp, Artificial Sequence
  chemically synthesized
aactctttggttgccagcggca

SEQ ID NO: 840155 - DNA, 22 bp, Artificial Sequence
  chemically synthesized
acatccactaggatgccgctgg

SEQ ID NO: 840156 - DNA, 22 bp, Artificial Sequence
  chemically synthesized
tttggttgccagcggcatccta

SEQ ID NO: 840157 - DNA, 22 bp, Artificial Sequence
  chemically synthesized
tggttgccagcggcatcctagt

SEQ ID NO: 840158 - DNA, 22 bp, Artificial Sequence
  chemically synthesized
ggttgccagcggcatcctagtg

SEQ ID NO: 840159 - DNA, 22 bp, Artificial Sequence
  chemically synthesized
aaaattcacatccactaggatg

SEQ ID NO: 840160 - DNA, 22 bp, Artificial Sequence
  chemically synthesized
gttgccagcggcatcctagtgg

SEQ ID NO: 840161 - DNA, 22 bp, Artificial Sequence
  chemically synthesized
tcaaaattcacatccactagga

SEQ ID NO: 840162 - DNA, 22 bp, Artificial Sequence
  chemically synthesized
ccagcggcatcctagtggatgt

SEQ ID NO: 840163 - DNA, 22 bp, Artificial Sequence
  chemically synthesized
caagcagctctcaaaattcaca

SEQ ID NO: 840164 - DNA, 22 bp, Artificial Sequence
  chemically synthesized
tagctacaagcagctctcaaaa

SEQ ID NO: 840165 - DNA, 22 bp, Artificial Sequence
  chemically synthesized
gtggatgtgaattttgagagct

SEQ ID NO: 840166 - DNA, 22 bp, Artificial Sequence
  chemically synthesized
ttatagctacaagcagctctca

SEQ ID NO: 840167 - DNA, 22 bp, Artificial Sequence
  chemically synthesized
tcaacctgttatagctacaagc

SEQ ID NO: 840168 - DNA, 22 bp, Artificial Sequence
  chemically synthesized
ctgtcaacctgttatagctaca

SEQ ID NO: 840169 - DNA, 22 bp, Artificial Sequence
  chemically synthesized
tgagagctgcttgtagctataa

SEQ ID NO: 840170 - DNA, 22 bp, Artificial Sequence
  chemically synthesized
gagagctgcttgtagctataac

SEQ ID NO: 840171 - DNA, 22 bp, Artificial Sequence
  chemically synthesized
agagctgcttgtagctataaca

SEQ ID NO: 840172 - DNA, 22 bp, Artificial Sequence
  chemically synthesized
gcacctgctgtcaacctgttat

SEQ ID NO: 840173 - DNA, 22 bp, Artificial Sequence
  chemically synthesized
cttgtagctataacaggttgac

SEQ ID NO: 840174 - DNA, 22 bp, Artificial Sequence
  chemically synthesized
gtagctataacaggttgacagc

SEQ ID NO: 840175 - DNA, 22 bp, Artificial Sequence
  chemically synthesized
tagctataacaggttgacagca

SEQ ID NO: 840176 - DNA, 22 bp, Artificial Sequence
  chemically synthesized
acatctagcacctgctgtcaac

SEQ ID NO: 840177 - DNA, 22 bp, Artificial Sequence
  chemically synthesized
gacatctagcacctgctgtcaa

SEQ ID NO: 840178 - DNA, 22 bp, Artificial Sequence
  chemically synthesized
tgacatctagcacctgctgtca

SEQ ID NO: 840179 - DNA, 22 bp, Artificial Sequence
  chemically synthesized
ttgacatctagcacctgctgtc

SEQ ID NO: 840180 - DNA, 22 bp, Artificial Sequence
  chemically synthesized
ttttgacatctagcacctgctg

SEQ ID NO: 840181 - DNA, 22 bp, Artificial Sequence
  chemically synthesized
taacaggttgacagcaggtgct

SEQ ID NO: 840182 - DNA, 22 bp, Artificial Sequence
  chemically synthesized
cttttgacatctagcacctgct

SEQ ID NO: 840183 - DNA, 22 bp, Artificial Sequence
  chemically synthesized
cttcttttgacatctagcacct

SEQ ID NO: 840184 - DNA, 22 bp, Artificial Sequence
  chemically synthesized
ccttcttttgacatctagcacc

SEQ ID NO: 840185 - DNA, 22 bp, Artificial Sequence
  chemically synthesized
acagcaggtgctagatgtcaaa

SEQ ID NO: 840186 - DNA, 22 bp, Artificial Sequence
  chemically synthesized
gatgtcaaaagaaggaaattta

SEQ ID NO: 840187 - DNA, 22 bp, Artificial Sequence
  chemically synthesized
gaagaagtggagtcaaccatat

SEQ ID NO: 840188 - DNA, 22 bp, Artificial Sequence
  chemically synthesized
agaagaagtggagtcaaccata

SEQ ID NO: 840189 - DNA, 22 bp, Artificial Sequence
  chemically synthesized
tagaagaagtggagtcaaccat

SEQ ID NO: 840190 - DNA, 22 bp, Artificial Sequence
  chemically synthesized
ttttagaagaagtggagtcaac

SEQ ID NO: 840191 - DNA, 22 bp, Artificial Sequence
  chemically synthesized
attttagaagaagtggagtcaa

SEQ ID NO: 840192 - DNA, 22 bp, Artificial Sequence
  chemically synthesized
cttattttagaagaagtggagt

SEQ ID NO: 840193 - DNA, 22 bp, Artificial Sequence
  chemically synthesized
atatggttgactccacttcttc

SEQ ID NO: 840194 - DNA, 22 bp, Artificial Sequence
  chemically synthesized
tatggttgactccacttcttct

SEQ ID NO: 840195 - DNA, 22 bp, Artificial Sequence
  chemically synthesized
gatggttgcttattttagaaga

SEQ ID NO: 840196 - DNA, 22 bp, Artificial Sequence
  chemically synthesized
ttagatggttgcttattttaga

SEQ ID NO: 840197 - DNA, 22 bp, Artificial Sequence
  chemically synthesized
actccacttcttctaaaataag

SEQ ID NO: 840198 - DNA, 22 bp, Artificial Sequence
  chemically synthesized
tctattagatggttgcttattt

SEQ ID NO: 840199 - DNA, 22 bp, Artificial Sequence
  chemically synthesized
cacttcttctaaaataagcaac

SEQ ID NO: 840200 - DNA, 22 bp, Artificial Sequence
  chemically synthesized
cttctaaaataagcaaccatct

SEQ ID NO: 840201 - DNA, 22 bp, Artificial Sequence
  chemically synthesized
ttctaaaataagcaaccatcta

SEQ ID NO: 840202 - DNA, 22 bp, Artificial Sequence
  chemically synthesized
aggtattgtctattagatggtt

SEQ ID NO: 840203 - DNA, 22 bp, Artificial Sequence
  chemically synthesized
ctaaaataagcaaccatctaat

SEQ ID NO: 840204 - DNA, 22 bp, Artificial Sequence
  chemically synthesized
taaaataagcaaccatctaata

SEQ ID NO: 840205 - DNA, 22 bp, Artificial Sequence
  chemically synthesized
tcaggtattgtctattagatgg

SEQ ID NO: 840206 - DNA, 22 bp, Artificial Sequence
  chemically synthesized
aaataagcaaccatctaataga

SEQ ID NO: 840207 - DNA, 22 bp, Artificial Sequence
  chemically synthesized
ctctcaggtattgtctattaga

SEQ ID NO: 840208 - DNA, 22 bp, Artificial Sequence
  chemically synthesized
cctctcaggtattgtctattag

SEQ ID NO: 840209 - DNA, 22 bp, Artificial Sequence
  chemically synthesized
atagacaatacctgagaggaag

SEQ ID NO: 840210 - DNA, 22 bp, Artificial Sequence
  chemically synthesized
atgaaatgccagccagtatctt

SEQ ID NO: 840211 - DNA, 22 bp, Artificial Sequence
  chemically synthesized
ctaatgaaatgccagccagtat

SEQ ID NO: 840212 - DNA, 22 bp, Artificial Sequence
  chemically synthesized
ttgctaatgaaatgccagccag

SEQ ID NO: 840213 - DNA, 22 bp, Artificial Sequence
  chemically synthesized
agaggaagatactggctggcat

SEQ ID NO: 840214 - DNA, 22 bp, Artificial Sequence
  chemically synthesized
tgttgctaatgaaatgccagcc

SEQ ID NO: 840215 - DNA, 22 bp, Artificial Sequence
  chemically synthesized
tatgaaatctctgttgctaatg

SEQ ID NO: 840216 - DNA, 22 bp, Artificial Sequence
  chemically synthesized
gtatgaaatctctgttgctaat

SEQ ID NO: 840217 - DNA, 22 bp, Artificial Sequence
  chemically synthesized
gctggcatttcattagcaacag

SEQ ID NO: 840218 - DNA, 22 bp, Artificial Sequence
  chemically synthesized
gcatttcattagcaacagagat

SEQ ID NO: 840219 - DNA, 22 bp, Artificial Sequence
  chemically synthesized
cacatttgtatgaaatctctgt

SEQ ID NO: 840220 - DNA, 22 bp, Artificial Sequence
  chemically synthesized
tccacatttgtatgaaatctct

SEQ ID NO: 840221 - DNA, 22 bp, Artificial Sequence
  chemically synthesized
cattagcaacagagatttcata

SEQ ID NO: 840222 - DNA, 22 bp, Artificial Sequence
  chemically synthesized
attagcaacagagatttcatac

SEQ ID NO: 840223 - DNA, 22 bp, Artificial Sequence
  chemically synthesized
ttctccacatttgtatgaaatc

SEQ ID NO: 840224 - DNA, 22 bp, Artificial Sequence
  chemically synthesized
ttgttctccacatttgtatgaa

SEQ ID NO: 840225 - DNA, 22 bp, Artificial Sequence
  chemically synthesized
gcaacagagatttcatacaaat

SEQ ID NO: 840226 - DNA, 22 bp, Artificial Sequence
  chemically synthesized
tgttgttctccacatttgtatg

SEQ ID NO: 840227 - DNA, 22 bp, Artificial Sequence
  chemically synthesized
catacaaatgtggagaacaaca

SEQ ID NO: 840228 - DNA, 22 bp, Artificial Sequence
  chemically synthesized
atacaaatgtggagaacaacag

SEQ ID NO: 840229 - DNA, 22 bp, Artificial Sequence
  chemically synthesized
atggcgaaataaaaaggctctg

SEQ ID NO: 840230 - DNA, 22 bp, Artificial Sequence
  chemically synthesized
catggcgaaataaaaaggctct

SEQ ID NO: 840231 - DNA, 22 bp, Artificial Sequence
  chemically synthesized
tgaaatccttcatggcgaaata

SEQ ID NO: 840232 - DNA, 22 bp, Artificial Sequence
  chemically synthesized
tttatttcgccatgaaggattt

SEQ ID NO: 840233 - DNA, 22 bp, Artificial Sequence
  chemically synthesized
ttatttcgccatgaaggatttc

SEQ ID NO: 840234 - DNA, 22 bp, Artificial Sequence
  chemically synthesized
tatttcgccatgaaggatttca

SEQ ID NO: 840235 - DNA, 22 bp, Artificial Sequence
  chemically synthesized
caaccaaatctatgaaatcctt

SEQ ID NO: 840236 - DNA, 22 bp, Artificial Sequence
  chemically synthesized
atttcgccatgaaggatttcat

SEQ ID NO: 840237 - DNA, 22 bp, Artificial Sequence
  chemically synthesized
tttcgccatgaaggatttcata

SEQ ID NO: 840238 - DNA, 22 bp, Artificial Sequence
  chemically synthesized
ctgcaaccaaatctatgaaatc

SEQ ID NO: 840239 - DNA, 22 bp, Artificial Sequence
  chemically synthesized
cgccatgaaggatttcatagat

SEQ ID NO: 840240 - DNA, 22 bp, Artificial Sequence
  chemically synthesized
gccatgaaggatttcatagatt

SEQ ID NO: 840241 - DNA, 22 bp, Artificial Sequence
  chemically synthesized
attgctgcaaccaaatctatga

SEQ ID NO: 840242 - DNA, 22 bp, Artificial Sequence
  chemically synthesized
catagatttggttgcagcaatg

SEQ ID NO: 840243 - DNA, 22 bp, Artificial Sequence
  chemically synthesized
atagatttggttgcagcaatga

SEQ ID NO: 840244 - DNA, 22 bp, Artificial Sequence
  chemically synthesized
tcaacccatcattcattgctgc

SEQ ID NO: 840245 - DNA, 22 bp, Artificial Sequence
  chemically synthesized
gtcaacccatcattcattgctg

SEQ ID NO: 840246 - DNA, 22 bp, Artificial Sequence
  chemically synthesized
tgtcaacccatcattcattgct

SEQ ID NO: 840247 - DNA, 22 bp, Artificial Sequence
  chemically synthesized
ggttgcagcaatgaatgatggg

SEQ ID NO: 840248 - DNA, 22 bp, Artificial Sequence
  chemically synthesized
gttgcagcaatgaatgatgggt

SEQ ID NO: 840249 - DNA, 22 bp, Artificial Sequence
  chemically synthesized
tagcagctttgtcaacccatca

SEQ ID NO: 840250 - DNA, 22 bp, Artificial Sequence
  chemically synthesized
atagcagctttgtcaacccatc

SEQ ID NO: 840251 - DNA, 22 bp, Artificial Sequence
  chemically synthesized
cagcaatgaatgatgggttgac

SEQ ID NO: 840252 - DNA, 22 bp, Artificial Sequence
  chemically synthesized
tatagcagctttgtcaacccat

SEQ ID NO: 840253 - DNA, 22 bp, Artificial Sequence
  chemically synthesized
acagttttatagcagctttgtc

SEQ ID NO: 840254 - DNA, 22 bp, Artificial Sequence
  chemically synthesized
actgacagttttatagcagctt

SEQ ID NO: 840255 - DNA, 22 bp, Artificial Sequence
  chemically synthesized
aattaactgacagttttatagc

SEQ ID NO: 840256 - DNA, 22 bp, Artificial Sequence
  chemically synthesized
gaattaactgacagttttatag

SEQ ID NO: 840257 - DNA, 22 bp, Artificial Sequence
  chemically synthesized
tgaattaactgacagttttata

SEQ ID NO: 840258 - DNA, 22 bp, Artificial Sequence
  chemically synthesized
ttgaattaactgacagttttat

SEQ ID NO: 840259 - DNA, 22 bp, Artificial Sequence
  chemically synthesized
acaaagctgctataaaactgtc

SEQ ID NO: 840260 - DNA, 22 bp, Artificial Sequence
  chemically synthesized
acacgatttttgaattaactga

SEQ ID NO: 840261 - DNA, 22 bp, Artificial Sequence
  chemically synthesized
ctataaaactgtcagttaattc

SEQ ID NO: 840262 - DNA, 22 bp, Artificial Sequence
  chemically synthesized
tcacacgatttttgaattaact

SEQ ID NO: 840263 - DNA, 22 bp, Artificial Sequence
  chemically synthesized
taaaactgtcagttaattcaaa

SEQ ID NO: 840264 - DNA, 22 bp, Artificial Sequence
  chemically synthesized
tcagttaattcaaaaatcgtgt

SEQ ID NO: 840265 - DNA, 22 bp, Artificial Sequence
  chemically synthesized
attcaaaaatcgtgtgagagat

SEQ ID NO: 840266 - DNA, 22 bp, Artificial Sequence
  chemically synthesized
aaaaatcgtgtgagagatgttt

SEQ ID NO: 840267 - DNA, 22 bp, Artificial Sequence
  chemically synthesized
tatgagaataaaaaaaaacatc

SEQ ID NO: 840268 - DNA, 22 bp, Artificial Sequence
  chemically synthesized
tgtatgagaataaaaaaaaaca

SEQ ID NO: 840269 - DNA, 22 bp, Artificial Sequence
  chemically synthesized
ctgtatgagaataaaaaaaaac

SEQ ID NO: 840270 - DNA, 22 bp, Artificial Sequence
  chemically synthesized
ttctgtatgagaataaaaaaaa

SEQ ID NO: 840271 - DNA, 22 bp, Artificial Sequence
  chemically synthesized
ttttttattctcatacagaaga

SEQ ID NO: 840272 - DNA, 22 bp, Artificial Sequence
  chemically synthesized
tttttattctcatacagaagaa

SEQ ID NO: 840273 - DNA, 22 bp, Artificial Sequence
  chemically synthesized
ttttattctcatacagaagaac

SEQ ID NO: 840274 - DNA, 22 bp, Artificial Sequence
  chemically synthesized
tttattctcatacagaagaaca

SEQ ID NO: 840275 - DNA, 22 bp, Artificial Sequence
  chemically synthesized
ttattctcatacagaagaacat

SEQ ID NO: 840276 - DNA, 22 bp, Artificial Sequence
  chemically synthesized
tattctcatacagaagaacatt

SEQ ID NO: 840277 - DNA, 22 bp, Artificial Sequence
  chemically synthesized
attctcatacagaagaacattc

SEQ ID NO: 840278 - DNA, 22 bp, Artificial Sequence
  chemically synthesized
ttctcatacagaagaacattct

SEQ ID NO: 840279 - DNA, 22 bp, Artificial Sequence
  chemically synthesized
tcatacagaagaacattctccc

SEQ ID NO: 840280 - DNA, 22 bp, Artificial Sequence
  chemically synthesized
atacagaagaacattctcccct

SEQ ID NO: 840281 - DNA, 22 bp, Artificial Sequence
  chemically synthesized
gtatacagggccatagaagggg

SEQ ID NO: 840282 - DNA, 22 bp, Artificial Sequence
  chemically synthesized
tccccttctatggccctgtata

SEQ ID NO: 840283 - DNA, 22 bp, Artificial Sequence
  chemically synthesized
cataaagaactggtatacaggg

SEQ ID NO: 840284 - DNA, 22 bp, Artificial Sequence
  chemically synthesized
cccttctatggccctgtatacc

SEQ ID NO: 840285 - DNA, 22 bp, Artificial Sequence
  chemically synthesized
tattgcataaagaactggtata

SEQ ID NO: 840286 - DNA, 22 bp, Artificial Sequence
  chemically synthesized
ctatggccctgtataccagttc

SEQ ID NO: 840287 - DNA, 22 bp, Artificial Sequence
  chemically synthesized
tatggccctgtataccagttct

SEQ ID NO: 840288 - DNA, 22 bp, Artificial Sequence
  chemically synthesized
tggccctgtataccagttcttt

SEQ ID NO: 840289 - DNA, 22 bp, Artificial Sequence
  chemically synthesized
acattatattgcataaagaact

SEQ ID NO: 840290 - DNA, 22 bp, Artificial Sequence
  chemically synthesized
tataccagttctttatgcaata

SEQ ID NO: 840291 - DNA, 22 bp, Artificial Sequence
  chemically synthesized
agaaaaggaattcacattatat

SEQ ID NO: 840292 - DNA, 22 bp, Artificial Sequence
  chemically synthesized
aagaaaaggaattcacattata

SEQ ID NO: 840293 - DNA, 22 bp, Artificial Sequence
  chemically synthesized
taagaaaaggaattcacattat

SEQ ID NO: 840294 - DNA, 22 bp, Artificial Sequence
  chemically synthesized
tttatgcaatataatgtgaatt

SEQ ID NO: 840295 - DNA, 22 bp, Artificial Sequence
  chemically synthesized
tatgcaatataatgtgaattcc

SEQ ID NO: 840296 - DNA, 22 bp, Artificial Sequence
  chemically synthesized
atgcaatataatgtgaattcct

SEQ ID NO: 840297 - DNA, 22 bp, Artificial Sequence
  chemically synthesized
tgcaatataatgtgaattcctt

SEQ ID NO: 840298 - DNA, 22 bp, Artificial Sequence
  chemically synthesized
taaattttaagaaaaggaattc

SEQ ID NO: 840299 - DNA, 22 bp, Artificial Sequence
  chemically synthesized
ataaattttaagaaaaggaatt

SEQ ID NO: 840300 - DNA, 22 bp, Artificial Sequence
  chemically synthesized
gtgatagcttataaattttaag

SEQ ID NO: 840301 - DNA, 22 bp, Artificial Sequence
  chemically synthesized
agtgatagcttataaattttaa

SEQ ID NO: 840302 - DNA, 22 bp, Artificial Sequence
  chemically synthesized
cttttcttaaaatttataagct

SEQ ID NO: 840303 - DNA, 22 bp, Artificial Sequence
  chemically synthesized
ttcttaaaatttataagctatc

SEQ ID NO: 840304 - DNA, 22 bp, Artificial Sequence
  chemically synthesized
gagaaatttagtgatagcttat

SEQ ID NO: 840305 - DNA, 22 bp, Artificial Sequence
  chemically synthesized
tcttaaaatttataagctatca

SEQ ID NO: 840306 - DNA, 22 bp, Artificial Sequence
  chemically synthesized
agagaaatttagtgatagctta

SEQ ID NO: 840307 - DNA, 22 bp, Artificial Sequence
  chemically synthesized
cttaaaatttataagctatcac

SEQ ID NO: 840308 - DNA, 22 bp, Artificial Sequence
  chemically synthesized
ttaaaatttataagctatcact

SEQ ID NO: 840309 - DNA, 22 bp, Artificial Sequence
  chemically synthesized
ttagagaaatttagtgatagct

SEQ ID NO: 840310 - DNA, 22 bp, Artificial Sequence
  chemically synthesized
aaaatttataagctatcactaa

SEQ ID NO: 840311 - DNA, 22 bp, Artificial Sequence
  chemically synthesized
aaatttataagctatcactaaa

SEQ ID NO: 840312 - DNA, 22 bp, Artificial Sequence
  chemically synthesized
ataagctatcactaaatttctc

SEQ ID NO: 840313 - DNA, 22 bp, Artificial Sequence
  chemically synthesized
taagctatcactaaatttctct

SEQ ID NO: 840314 - DNA, 22 bp, Artificial Sequence
  chemically synthesized
tcactaaatttctctaagaatt

SEQ ID NO: 840315 - DNA, 22 bp, Artificial Sequence
  chemically synthesized
aacccagtccagaattcttaga

SEQ ID NO: 840316 - DNA, 22 bp, Artificial Sequence
  chemically synthesized
caacccagtccagaattcttag

SEQ ID NO: 840317 - DNA, 22 bp, Artificial Sequence
  chemically synthesized
tcaacccagtccagaattctta

SEQ ID NO: 840318 - DNA, 22 bp, Artificial Sequence
  chemically synthesized
ttcaacccagtccagaattctt

SEQ ID NO: 840319 - DNA, 22 bp, Artificial Sequence
  chemically synthesized
aatttctctaagaattctggac

SEQ ID NO: 840320 - DNA, 22 bp, Artificial Sequence
  chemically synthesized
aggatttttcaacccagtccag

SEQ ID NO: 840321 - DNA, 22 bp, Artificial Sequence
  chemically synthesized
ctctaagaattctggactgggt

SEQ ID NO: 840322 - DNA, 22 bp, Artificial Sequence
  chemically synthesized
tctaagaattctggactgggtt

SEQ ID NO: 840323 - DNA, 22 bp, Artificial Sequence
  chemically synthesized
taagaattctggactgggttga

SEQ ID NO: 840324 - DNA, 22 bp, Artificial Sequence
  chemically synthesized
agctaaggatttttcaacccag

SEQ ID NO: 840325 - DNA, 22 bp, Artificial Sequence
  chemically synthesized
agaattctggactgggttgaaa

SEQ ID NO: 840326 - DNA, 22 bp, Artificial Sequence
  chemically synthesized
cagctaaggatttttcaaccca

SEQ ID NO: 840327 - DNA, 22 bp, Artificial Sequence
  chemically synthesized
tcagctaaggatttttcaaccc

SEQ ID NO: 840328 - DNA, 22 bp, Artificial Sequence
  chemically synthesized
ttcagctaaggatttttcaacc

SEQ ID NO: 840329 - DNA, 22 bp, Artificial Sequence
  chemically synthesized
tttcagctaaggatttttcaac

SEQ ID NO: 840330 - DNA, 22 bp, Artificial Sequence
  chemically synthesized
ttttttcagctaaggatttttc

SEQ ID NO: 840331 - DNA, 22 bp, Artificial Sequence
  chemically synthesized
tggactgggttgaaaaatcctt

SEQ ID NO: 840332 - DNA, 22 bp, Artificial Sequence
  chemically synthesized
gactgggttgaaaaatccttag

SEQ ID NO: 840333 - DNA, 22 bp, Artificial Sequence
  chemically synthesized
gaattattttttcagctaagga

SEQ ID NO: 840334 - DNA, 22 bp, Artificial Sequence
  chemically synthesized
ggaattattttttcagctaagg

SEQ ID NO: 840335 - DNA, 22 bp, Artificial Sequence
  chemically synthesized
ggttgaaaaatccttagctgaa

SEQ ID NO: 840336 - DNA, 22 bp, Artificial Sequence
  chemically synthesized
tggaattattttttcagctaag

SEQ ID NO: 840337 - DNA, 22 bp, Artificial Sequence
  chemically synthesized
ttttggaattattttttcagct

SEQ ID NO: 840338 - DNA, 22 bp, Artificial Sequence
  chemically synthesized
attttggaattattttttcagc

SEQ ID NO: 840339 - DNA, 22 bp, Artificial Sequence
  chemically synthesized
aaaaatccttagctgaaaaaat

SEQ ID NO: 840340 - DNA, 22 bp, Artificial Sequence
  chemically synthesized
agctgaaaaaataattccaaaa

SEQ ID NO: 840341 - DNA, 22 bp, Artificial Sequence
  chemically synthesized
gctgaaaaaataattccaaaat

SEQ ID NO: 840342 - DNA, 22 bp, Artificial Sequence
  chemically synthesized
agagggagtcgtttattttgga

SEQ ID NO: 840343 - DNA, 22 bp, Artificial Sequence
  chemically synthesized
aagagggagtcgtttattttgg

SEQ ID NO: 840344 - DNA, 22 bp, Artificial Sequence
  chemically synthesized
aaaaaataattccaaaataaac

SEQ ID NO: 840345 - DNA, 22 bp, Artificial Sequence
  chemically synthesized
taagagggagtcgtttattttg

SEQ ID NO: 840346 - DNA, 22 bp, Artificial Sequence
  chemically synthesized
caagttttaagagggagtcgtt

SEQ ID NO: 840347 - DNA, 22 bp, Artificial Sequence
  chemically synthesized
caaaataaacgactccctctta

SEQ ID NO: 840348 - DNA, 22 bp, Artificial Sequence
  chemically synthesized
aaacagaattccaagttttaag

SEQ ID NO: 840349 - DNA, 22 bp, Artificial Sequence
  chemically synthesized
tgaaacagaattccaagtttta

SEQ ID NO: 840350 - DNA, 22 bp, Artificial Sequence
  chemically synthesized
ctgaaacagaattccaagtttt

SEQ ID NO: 840351 - DNA, 22 bp, Artificial Sequence
  chemically synthesized
cctcttaaaacttggaattctg

SEQ ID NO: 840352 - DNA, 22 bp, Artificial Sequence
  chemically synthesized
ttaaaacttggaattctgtttc

SEQ ID NO: 840353 - DNA, 22 bp, Artificial Sequence
  chemically synthesized
aaaacttggaattctgtttcag

SEQ ID NO: 840354 - DNA, 22 bp, Artificial Sequence
  chemically synthesized
aaacttggaattctgtttcaga

SEQ ID NO: 840355 - DNA, 22 bp, Artificial Sequence
  chemically synthesized
aaccaagggaaggacttctgaa

SEQ ID NO: 840356 - DNA, 22 bp, Artificial Sequence
  chemically synthesized
ggaattctgtttcagaagtcct

SEQ ID NO: 840357 - DNA, 22 bp, Artificial Sequence
  chemically synthesized
gaattctgtttcagaagtcctt

SEQ ID NO: 840358 - DNA, 22 bp, Artificial Sequence
  chemically synthesized
gctaaaccaagggaaggacttc

SEQ ID NO: 840359 - DNA, 22 bp, Artificial Sequence
  chemically synthesized
ttagctaaaccaagggaaggac

SEQ ID NO: 840360 - DNA, 22 bp, Artificial Sequence
  chemically synthesized
attagctaaaccaagggaagga

SEQ ID NO: 840361 - DNA, 22 bp, Artificial Sequence
  chemically synthesized
tgtttcagaagtccttcccttg

SEQ ID NO: 840362 - DNA, 22 bp, Artificial Sequence
  chemically synthesized
tattagctaaaccaagggaagg

SEQ ID NO: 840363 - DNA, 22 bp, Artificial Sequence
  chemically synthesized
ttattagctaaaccaagggaag

SEQ ID NO: 840364 - DNA, 22 bp, Artificial Sequence
  chemically synthesized
tttcagaagtccttcccttggt

SEQ ID NO: 840365 - DNA, 22 bp, Artificial Sequence
  chemically synthesized
cagaagtccttcccttggttta

SEQ ID NO: 840366 - DNA, 22 bp, Artificial Sequence
  chemically synthesized
agaagtccttcccttggtttag

SEQ ID NO: 840367 - DNA, 22 bp, Artificial Sequence
  chemically synthesized
cccttggtttagctaataaaag

SEQ ID NO: 840368 - DNA, 22 bp, Artificial Sequence
  chemically synthesized
ccttggtttagctaataaaagg

SEQ ID NO: 840369 - DNA, 22 bp, Artificial Sequence
  chemically synthesized
ggtttagctaataaaaggccac

SEQ ID NO: 840370 - DNA, 22 bp, Artificial Sequence
  chemically synthesized
gtttagctaataaaaggccaca

SEQ ID NO: 840371 - DNA, 22 bp, Artificial Sequence
  chemically synthesized
agctaataaaaggccacattat

SEQ ID NO: 840372 - DNA, 22 bp, Artificial Sequence
  chemically synthesized
gctaataaaaggccacattata

SEQ ID NO: 840373 - DNA, 22 bp, Artificial Sequence
  chemically synthesized
ataaaaggccacattatacacc

SEQ ID NO: 840374 - DNA, 22 bp, Artificial Sequence
  chemically synthesized
gagatgggagaatatgaagggt

SEQ ID NO: 840375 - DNA, 22 bp, Artificial Sequence
  chemically synthesized
tacacccttcatattctcccat

SEQ ID NO: 840376 - DNA, 22 bp, Artificial Sequence
  chemically synthesized
gtacagagagaactggagatgg

SEQ ID NO: 840377 - DNA, 22 bp, Artificial Sequence
  chemically synthesized
ggtacagagagaactggagatg

SEQ ID NO: 840378 - DNA, 22 bp, Artificial Sequence
  chemically synthesized
catattctcccatctccagttc

SEQ ID NO: 840379 - DNA, 22 bp, Artificial Sequence
  chemically synthesized
atattctcccatctccagttct

SEQ ID NO: 840380 - DNA, 22 bp, Artificial Sequence
  chemically synthesized
tcccatctccagttctctctgt

SEQ ID NO: 840381 - DNA, 22 bp, Artificial Sequence
  chemically synthesized
ccatctccagttctctctgtac

SEQ ID NO: 840382 - DNA, 22 bp, Artificial Sequence
  chemically synthesized
tggtgagatggatttggtacag

SEQ ID NO: 840383 - DNA, 22 bp, Artificial Sequence
  chemically synthesized
cagttctctctgtaccaaatcc

SEQ ID NO: 840384 - DNA, 22 bp, Artificial Sequence
  chemically synthesized
ttatggtgagatggatttggta

SEQ ID NO: 840385 - DNA, 22 bp, Artificial Sequence
  chemically synthesized
tctctgtaccaaatccatctca

SEQ ID NO: 840386 - DNA, 22 bp, Artificial Sequence
  chemically synthesized
tctgtaccaaatccatctcacc

SEQ ID NO: 840387 - DNA, 22 bp, Artificial Sequence
  chemically synthesized
tgtaccaaatccatctcaccat

SEQ ID NO: 840388 - DNA, 22 bp, Artificial Sequence
  chemically synthesized
taccaaatccatctcaccataa

SEQ ID NO: 840389 - DNA, 22 bp, Artificial Sequence
  chemically synthesized
aatggtacatattgttatggtg

SEQ ID NO: 840390 - DNA, 22 bp, Artificial Sequence
  chemically synthesized
attaaatggtacatattgttat

SEQ ID NO: 840391 - DNA, 22 bp, Artificial Sequence
  chemically synthesized
gatgctcattaaatggtacata

SEQ ID NO: 840392 - DNA, 22 bp, Artificial Sequence
  chemically synthesized
accataacaatatgtaccattt

SEQ ID NO: 840393 - DNA, 22 bp, Artificial Sequence
  chemically synthesized
aagtaaatatgtggcacatatt

SEQ ID NO: 840394 - DNA, 22 bp, Artificial Sequence
  chemically synthesized
aatgagcatctaatatgtgcca

SEQ ID NO: 840395 - DNA, 22 bp, Artificial Sequence
  chemically synthesized
atgagcatctaatatgtgccac

SEQ ID NO: 840396 - DNA, 22 bp, Artificial Sequence
  chemically synthesized
taaagtaaatatgtggcacata

SEQ ID NO: 840397 - DNA, 22 bp, Artificial Sequence
  chemically synthesized
ctaaagtaaatatgtggcacat

SEQ ID NO: 840398 - DNA, 22 bp, Artificial Sequence
  chemically synthesized
gtgtttctaaagtaaatatgtg

SEQ ID NO: 840399 - DNA, 22 bp, Artificial Sequence
  chemically synthesized
atatgtgccacatatttacttt

SEQ ID NO: 840400 - DNA, 22 bp, Artificial Sequence
  chemically synthesized
agaaagtaaaataattggtgtt

SEQ ID NO: 840401 - DNA, 22 bp, Artificial Sequence
  chemically synthesized
actttagaaacaccaattattt

SEQ ID NO: 840402 - DNA, 22 bp, Artificial Sequence
  chemically synthesized
ctttagaaacaccaattatttt

SEQ ID NO: 840403 - DNA, 22 bp, Artificial Sequence
  chemically synthesized
tagaaacaccaattattttact

SEQ ID NO: 840404 - DNA, 22 bp, Artificial Sequence
  chemically synthesized
agaaacaccaattattttactt

SEQ ID NO: 840405 - DNA, 22 bp, Artificial Sequence
  chemically synthesized
gaaacaccaattattttacttt

SEQ ID NO: 840406 - DNA, 22 bp, Artificial Sequence
  chemically synthesized
gtagggtgattaagaaagtaaa

SEQ ID NO: 840407 - DNA, 22 bp, Artificial Sequence
  chemically synthesized
tgctggtagggtgattaagaaa

SEQ ID NO: 840408 - DNA, 22 bp, Artificial Sequence
  chemically synthesized
atgctggtagggtgattaagaa

SEQ ID NO: 840409 - DNA, 22 bp, Artificial Sequence
  chemically synthesized
ttttactttcttaatcacccta

SEQ ID NO: 840410 - DNA, 22 bp, Artificial Sequence
  chemically synthesized
tactttcttaatcaccctacca

SEQ ID NO: 840411 - DNA, 22 bp, Artificial Sequence
  chemically synthesized
actttcttaatcaccctaccag

SEQ ID NO: 840412 - DNA, 22 bp, Artificial Sequence
  chemically synthesized
ctttcttaatcaccctaccagc

SEQ ID NO: 840413 - DNA, 22 bp, Artificial Sequence
  chemically synthesized
ataatagtacttatgctggtag

SEQ ID NO: 840414 - DNA, 22 bp, Artificial Sequence
  chemically synthesized
tcttaatcaccctaccagcata

SEQ ID NO: 840415 - DNA, 22 bp, Artificial Sequence
  chemically synthesized
cttaatcaccctaccagcataa

SEQ ID NO: 840416 - DNA, 22 bp, Artificial Sequence
  chemically synthesized
ttaatcaccctaccagcataag

SEQ ID NO: 840417 - DNA, 22 bp, Artificial Sequence
  chemically synthesized
aatcaccctaccagcataagta

SEQ ID NO: 840418 - DNA, 22 bp, Artificial Sequence
  chemically synthesized
atcaccctaccagcataagtac

SEQ ID NO: 840419 - DNA, 22 bp, Artificial Sequence
  chemically synthesized
tcatgtggggctaataatagta

SEQ ID NO: 840420 - DNA, 22 bp, Artificial Sequence
  chemically synthesized
ccagcataagtactattattag

SEQ ID NO: 840421 - DNA, 22 bp, Artificial Sequence
  chemically synthesized
atctgtcatgtggggctaataa

SEQ ID NO: 840422 - DNA, 22 bp, Artificial Sequence
  chemically synthesized
tcatctgtcatgtggggctaat

SEQ ID NO: 840423 - DNA, 22 bp, Artificial Sequence
  chemically synthesized
tctcatctgtcatgtggggcta

SEQ ID NO: 840424 - DNA, 22 bp, Artificial Sequence
  chemically synthesized
tggttctctcatctgtcatgtg

SEQ ID NO: 840425 - DNA, 22 bp, Artificial Sequence
  chemically synthesized
ttattagccccacatgacagat

SEQ ID NO: 840426 - DNA, 22 bp, Artificial Sequence
  chemically synthesized
ttagccccacatgacagatgag

SEQ ID NO: 840427 - DNA, 22 bp, Artificial Sequence
  chemically synthesized
aactgtggttctctcatctgtc

SEQ ID NO: 840428 - DNA, 22 bp, Artificial Sequence
  chemically synthesized
gccccacatgacagatgagaga

SEQ ID NO: 840429 - DNA, 22 bp, Artificial Sequence
  chemically synthesized
ctaaactgtggttctctcatct

SEQ ID NO: 840430 - DNA, 22 bp, Artificial Sequence
  chemically synthesized
cctaaactgtggttctctcatc

SEQ ID NO: 840431 - DNA, 22 bp, Artificial Sequence
  chemically synthesized
tcctaaactgtggttctctcat

SEQ ID NO: 840432 - DNA, 22 bp, Artificial Sequence
  chemically synthesized
tttcctaaactgtggttctctc

SEQ ID NO: 840433 - DNA, 22 bp, Artificial Sequence
  chemically synthesized
tctttcctaaactgtggttctc

SEQ ID NO: 840434 - DNA, 22 bp, Artificial Sequence
  chemically synthesized
attctctttcctaaactgtggt

SEQ ID NO: 840435 - DNA, 22 bp, Artificial Sequence
  chemically synthesized
gccaagttaattctctttccta

SEQ ID NO: 840436 - DNA, 22 bp, Artificial Sequence
  chemically synthesized
agccaagttaattctctttcct

SEQ ID NO: 840437 - DNA, 22 bp, Artificial Sequence
  chemically synthesized
tgtaaccttagccaagttaatt

SEQ ID NO: 840438 - DNA, 22 bp, Artificial Sequence
  chemically synthesized
aggaaagagaattaacttggct

SEQ ID NO: 840439 - DNA, 22 bp, Artificial Sequence
  chemically synthesized
ggaaagagaattaacttggcta

SEQ ID NO: 840440 - DNA, 22 bp, Artificial Sequence
  chemically synthesized
gctgtgtaaccttagccaagtt

SEQ ID NO: 840441 - DNA, 22 bp, Artificial Sequence
  chemically synthesized
ttagctgtgtaaccttagccaa

SEQ ID NO: 840442 - DNA, 22 bp, Artificial Sequence
  chemically synthesized
acttggctaaggttacacagct

SEQ ID NO: 840443 - DNA, 22 bp, Artificial Sequence
  chemically synthesized
ggctaaggttacacagctaata

SEQ ID NO: 840444 - DNA, 22 bp, Artificial Sequence
  chemically synthesized
gctaaggttacacagctaatag

SEQ ID NO: 840445 - DNA, 22 bp, Artificial Sequence
  chemically synthesized
gtggaccccaatgatctattag

SEQ ID NO: 840446 - DNA, 22 bp, Artificial Sequence
  chemically synthesized
aggttacacagctaatagatca

SEQ ID NO: 840447 - DNA, 22 bp, Artificial Sequence
  chemically synthesized
cacagctaatagatcattgggg

SEQ ID NO: 840448 - DNA, 22 bp, Artificial Sequence
  chemically synthesized
atagatcattggggtccactag

SEQ ID NO: 840449 - DNA, 22 bp, Artificial Sequence
  chemically synthesized
gagatgtacagactagtggacc

SEQ ID NO: 840450 - DNA, 22 bp, Artificial Sequence
  chemically synthesized
catgtgttggagatgtacagac

SEQ ID NO: 840451 - DNA, 22 bp, Artificial Sequence
  chemically synthesized
acatgtgttggagatgtacaga

SEQ ID NO: 840452 - DNA, 22 bp, Artificial Sequence
  chemically synthesized
gggtccactagtctgtacatct

SEQ ID NO: 840453 - DNA, 22 bp, Artificial Sequence
  chemically synthesized
tacatgtgttggagatgtacag

SEQ ID NO: 840454 - DNA, 22 bp, Artificial Sequence
  chemically synthesized
ttacatgtgttggagatgtaca

SEQ ID NO: 840455 - DNA, 22 bp, Artificial Sequence
  chemically synthesized
tcttttacatgtgttggagatg

SEQ ID NO: 840456 - DNA, 22 bp, Artificial Sequence
  chemically synthesized
gtctgtacatctccaacacatg

SEQ ID NO: 840457 - DNA, 22 bp, Artificial Sequence
  chemically synthesized
tacatctccaacacatgtaaaa

SEQ ID NO: 840458 - DNA, 22 bp, Artificial Sequence
  chemically synthesized
atcaaaggattgtcttttacat

SEQ ID NO: 840459 - DNA, 22 bp, Artificial Sequence
  chemically synthesized
caacacatgtaaaagacaatcc

SEQ ID NO: 840460 - DNA, 22 bp, Artificial Sequence
  chemically synthesized
agtgtctaatcaaaggattgtc

SEQ ID NO: 840461 - DNA, 22 bp, Artificial Sequence
  chemically synthesized
gagtgtctaatcaaaggattgt

SEQ ID NO: 840462 - DNA, 22 bp, Artificial Sequence
  chemically synthesized
tgtatttgagtgtctaatcaaa

SEQ ID NO: 840463 - DNA, 22 bp, Artificial Sequence
  chemically synthesized
tgtgtatttgagtgtctaatca

SEQ ID NO: 840464 - DNA, 22 bp, Artificial Sequence
  chemically synthesized
ctgtgtatttgagtgtctaatc

SEQ ID NO: 840465 - DNA, 22 bp, Artificial Sequence
  chemically synthesized
acttctgtgtatttgagtgtct

SEQ ID NO: 840466 - DNA, 22 bp, Artificial Sequence
  chemically synthesized
gacttctgtgtatttgagtgtc

SEQ ID NO: 840467 - DNA, 22 bp, Artificial Sequence
  chemically synthesized
tgacttctgtgtatttgagtgt

SEQ ID NO: 840468 - DNA, 22 bp, Artificial Sequence
  chemically synthesized
ttgacttctgtgtatttgagtg

SEQ ID NO: 840469 - DNA, 22 bp, Artificial Sequence
  chemically synthesized
tgattagacactcaaatacaca

SEQ ID NO: 840470 - DNA, 22 bp, Artificial Sequence
  chemically synthesized
gattagacactcaaatacacag

SEQ ID NO: 840471 - DNA, 22 bp, Artificial Sequence
  chemically synthesized
tacttttgacttctgtgtattt

SEQ ID NO: 840472 - DNA, 22 bp, Artificial Sequence
  chemically synthesized
attagacactcaaatacacaga

SEQ ID NO: 840473 - DNA, 22 bp, Artificial Sequence
  chemically synthesized
atacttttgacttctgtgtatt

SEQ ID NO: 840474 - DNA, 22 bp, Artificial Sequence
  chemically synthesized
tttatacttttgacttctgtgt

SEQ ID NO: 840475 - DNA, 22 bp, Artificial Sequence
  chemically synthesized
gacactcaaatacacagaagtc

SEQ ID NO: 840476 - DNA, 22 bp, Artificial Sequence
  chemically synthesized
ctgtttatacttttgacttctg

SEQ ID NO: 840477 - DNA, 22 bp, Artificial Sequence
  chemically synthesized
ctcctgtttatacttttgactt

SEQ ID NO: 840478 - DNA, 22 bp, Artificial Sequence
  chemically synthesized
aaatacacagaagtcaaaagta

SEQ ID NO: 840479 - DNA, 22 bp, Artificial Sequence
  chemically synthesized
ctgctcctgtttatacttttga

SEQ ID NO: 840480 - DNA, 22 bp, Artificial Sequence
  chemically synthesized
gctgctcctgtttatacttttg

SEQ ID NO: 840481 - DNA, 22 bp, Artificial Sequence
  chemically synthesized
tgctgctcctgtttatactttt

SEQ ID NO: 840482 - DNA, 22 bp, Artificial Sequence
  chemically synthesized
ttgctgctcctgtttatacttt

SEQ ID NO: 840483 - DNA, 22 bp, Artificial Sequence
  chemically synthesized
gatatacatttttgctgctcct

SEQ ID NO: 840484 - DNA, 22 bp, Artificial Sequence
  chemically synthesized
tagtctggatatacatttttgc

SEQ ID NO: 840485 - DNA, 22 bp, Artificial Sequence
  chemically synthesized
aggtaattatagtctggatata

SEQ ID NO: 840486 - DNA, 22 bp, Artificial Sequence
  chemically synthesized
acctcaggtaattatagtctgg

SEQ ID NO: 840487 - DNA, 22 bp, Artificial Sequence
  chemically synthesized
ggactaacctcaggtaattata

SEQ ID NO: 840488 - DNA, 22 bp, Artificial Sequence
  chemically synthesized
aaatattaggactaacctcagg

SEQ ID NO: 840489 - DNA, 22 bp, Artificial Sequence
  chemically synthesized
aaaatattaggactaacctcag

SEQ ID NO: 840490 - DNA, 22 bp, Artificial Sequence
  chemically synthesized
taattacctgaggttagtccta

SEQ ID NO: 840491 - DNA, 22 bp, Artificial Sequence
  chemically synthesized
acaacttaaaatattaggacta

SEQ ID NO: 840492 - DNA, 22 bp, Artificial Sequence
  chemically synthesized
cctgaggttagtcctaatattt

SEQ ID NO: 840493 - DNA, 22 bp, Artificial Sequence
  chemically synthesized
tctgacaacttaaaatattagg

SEQ ID NO: 840494 - DNA, 22 bp, Artificial Sequence
  chemically synthesized
atctgacaacttaaaatattag

SEQ ID NO: 840495 - DNA, 22 bp, Artificial Sequence
  chemically synthesized
aggttagtcctaatattttaag

SEQ ID NO: 840496 - DNA, 22 bp, Artificial Sequence
  chemically synthesized
gtcctaatattttaagttgtca

SEQ ID NO: 840497 - DNA, 22 bp, Artificial Sequence
  chemically synthesized
atattttaagttgtcagataaa

SEQ ID NO: 840498 - DNA, 22 bp, Artificial Sequence
  chemically synthesized
taagttgtcagataaatatacc

SEQ ID NO: 840499 - DNA, 22 bp, Artificial Sequence
  chemically synthesized
aagttgtcagataaatatacct

SEQ ID NO: 840500 - DNA, 22 bp, Artificial Sequence
  chemically synthesized
agttgtcagataaatatacctt

SEQ ID NO: 840501 - DNA, 22 bp, Artificial Sequence
  chemically synthesized
gtcagaaaaataggaaggtata

SEQ ID NO: 840502 - DNA, 22 bp, Artificial Sequence
  chemically synthesized
tcagataaatataccttcctat

SEQ ID NO: 840503 - DNA, 22 bp, Artificial Sequence
  chemically synthesized
gttagtcagaaaaataggaagg

SEQ ID NO: 840504 - DNA, 22 bp, Artificial Sequence
  chemically synthesized
cctatttttctgactaaccagc

SEQ ID NO: 840505 - DNA, 22 bp, Artificial Sequence
  chemically synthesized
ctatttttctgactaaccagcc

SEQ ID NO: 840506 - DNA, 22 bp, Artificial Sequence
  chemically synthesized
tttttctgactaaccagccttt

SEQ ID NO: 840507 - DNA, 22 bp, Artificial Sequence
  chemically synthesized
ttctgactaaccagccttttcc

SEQ ID NO: 840508 - DNA, 22 bp, Artificial Sequence
  chemically synthesized
tctgactaaccagccttttcca

SEQ ID NO: 840509 - DNA, 22 bp, Artificial Sequence
  chemically synthesized
ctgactaaccagccttttccat

SEQ ID NO: 840510 - DNA, 22 bp, Artificial Sequence
  chemically synthesized
tgactaaccagccttttccatt

SEQ ID NO: 840511 - DNA, 22 bp, Artificial Sequence
  chemically synthesized
actaaccagccttttccatttg

SEQ ID NO: 840512 - DNA, 22 bp, Artificial Sequence
  chemically synthesized
aagcccgaggcacatcaaatgg

SEQ ID NO: 840513 - DNA, 22 bp, Artificial Sequence
  chemically synthesized
accagccttttccatttgatgt

SEQ ID NO: 840514 - DNA, 22 bp, Artificial Sequence
  chemically synthesized
aaagcccgaggcacatcaaatg

SEQ ID NO: 840515 - DNA, 22 bp, Artificial Sequence
  chemically synthesized
taaagcccgaggcacatcaaat

SEQ ID NO: 840516 - DNA, 22 bp, Artificial Sequence
  chemically synthesized
ttccatttgatgtgcctcgggc

SEQ ID NO: 840517 - DNA, 22 bp, Artificial Sequence
  chemically synthesized
tatgattttaaagcccgaggca

SEQ ID NO: 840518 - DNA, 22 bp, Artificial Sequence
  chemically synthesized
tccatttgatgtgcctcgggct

SEQ ID NO: 840519 - DNA, 22 bp, Artificial Sequence
  chemically synthesized
ccatttgatgtgcctcgggctt

SEQ ID NO: 840520 - DNA, 22 bp, Artificial Sequence
  chemically synthesized
catttgatgtgcctcgggcttt

SEQ ID NO: 840521 - DNA, 22 bp, Artificial Sequence
  chemically synthesized
gatgtgcctcgggctttaaaat

SEQ ID NO: 840522 - DNA, 22 bp, Artificial Sequence
  chemically synthesized
atgtgcctcgggctttaaaatc

SEQ ID NO: 840523 - DNA, 22 bp, Artificial Sequence
  chemically synthesized
aagcccacgtctatatgatttt

SEQ ID NO: 840524 - DNA, 22 bp, Artificial Sequence
  chemically synthesized
gggctttaaaatcatatagacg

SEQ ID NO: 840525 - DNA, 22 bp, Artificial Sequence
  chemically synthesized
taaaatcatatagacgtgggct

SEQ ID NO: 840526 - DNA, 22 bp, Artificial Sequence
  chemically synthesized
aaaatcatatagacgtgggctt

SEQ ID NO: 840527 - DNA, 22 bp, Artificial Sequence
  chemically synthesized
aaatcatatagacgtgggcttg

SEQ ID NO: 840528 - DNA, 22 bp, Artificial Sequence
  chemically synthesized
ggaagatgacaagtgaggaagt

SEQ ID NO: 840529 - DNA, 22 bp, Artificial Sequence
  chemically synthesized
aggaagatgacaagtgaggaag

SEQ ID NO: 840530 - DNA, 22 bp, Artificial Sequence
  chemically synthesized
gaattctacttcctcacttgtc

SEQ ID NO: 840531 - DNA, 22 bp, Artificial Sequence
  chemically synthesized
aattctacttcctcacttgtca

SEQ ID NO: 840532 - DNA, 22 bp, Artificial Sequence
  chemically synthesized
gggtcttaggaagatgacaagt

SEQ ID NO: 840533 - DNA, 22 bp, Artificial Sequence
  chemically synthesized
tacttcctcacttgtcatcttc

SEQ ID NO: 840534 - DNA, 22 bp, Artificial Sequence
  chemically synthesized
tctagggtcttaggaagatgac

SEQ ID NO: 840535 - DNA, 22 bp, Artificial Sequence
  chemically synthesized
cttcctcacttgtcatcttcct

SEQ ID NO: 840536 - DNA, 22 bp, Artificial Sequence
  chemically synthesized
gtctagggtcttaggaagatga

SEQ ID NO: 840537 - DNA, 22 bp, Artificial Sequence
  chemically synthesized
cctcacttgtcatcttcctaag

SEQ ID NO: 840538 - DNA, 22 bp, Artificial Sequence
  chemically synthesized
ctcacttgtcatcttcctaaga

SEQ ID NO: 840539 - DNA, 22 bp, Artificial Sequence
  chemically synthesized
acttgtcatcttcctaagaccc

SEQ ID NO: 840540 - DNA, 22 bp, Artificial Sequence
  chemically synthesized
acgtaacttgtctagggtctta

SEQ ID NO: 840541 - DNA, 22 bp, Artificial Sequence
  chemically synthesized
gtcatcttcctaagaccctaga

SEQ ID NO: 840542 - DNA, 22 bp, Artificial Sequence
  chemically synthesized
tcatcttcctaagaccctagac

SEQ ID NO: 840543 - DNA, 22 bp, Artificial Sequence
  chemically synthesized
ggagagctaacgtaacttgtct

SEQ ID NO: 840544 - DNA, 22 bp, Artificial Sequence
  chemically synthesized
cctaagaccctagacaagttac

SEQ ID NO: 840545 - DNA, 22 bp, Artificial Sequence
  chemically synthesized
ctaagaccctagacaagttacg

SEQ ID NO: 840546 - DNA, 22 bp, Artificial Sequence
  chemically synthesized
agaccctagacaagttacgtta

SEQ ID NO: 840547 - DNA, 22 bp, Artificial Sequence
  chemically synthesized
gacaagttacgttagctctccg

SEQ ID NO: 840548 - DNA, 22 bp, Artificial Sequence
  chemically synthesized
gagacagaaaaccgagactcgg

SEQ ID NO: 840549 - DNA, 22 bp, Artificial Sequence
  chemically synthesized
agagacagaaaaccgagactcg

SEQ ID NO: 840550 - DNA, 22 bp, Artificial Sequence
  chemically synthesized
cgttagctctccgagtctcggt

SEQ ID NO: 840551 - DNA, 22 bp, Artificial Sequence
  chemically synthesized
tagagacagaaaaccgagactc

SEQ ID NO: 840552 - DNA, 22 bp, Artificial Sequence
  chemically synthesized
gctctccgagtctcggttttct

SEQ ID NO: 840553 - DNA, 22 bp, Artificial Sequence
  chemically synthesized
ccattttagagacagaaaaccg

SEQ ID NO: 840554 - DNA, 22 bp, Artificial Sequence
  chemically synthesized
tccgagtctcggttttctgtct

SEQ ID NO: 840555 - DNA, 22 bp, Artificial Sequence
  chemically synthesized
ctcccattttagagacagaaaa

SEQ ID NO: 840556 - DNA, 22 bp, Artificial Sequence
  chemically synthesized
cgagtctcggttttctgtctct

SEQ ID NO: 840557 - DNA, 22 bp, Artificial Sequence
  chemically synthesized
ctactcccattttagagacaga

SEQ ID NO: 840558 - DNA, 22 bp, Artificial Sequence
  chemically synthesized
ggttttctgtctctaaaatggg

SEQ ID NO: 840559 - DNA, 22 bp, Artificial Sequence
  chemically synthesized
tctgtctctaaaatgggagtag

SEQ ID NO: 840560 - DNA, 22 bp, Artificial Sequence
  chemically synthesized
ctgtctctaaaatgggagtagt

SEQ ID NO: 840561 - DNA, 22 bp, Artificial Sequence
  chemically synthesized
tgtctctaaaatgggagtagta

SEQ ID NO: 840562 - DNA, 22 bp, Artificial Sequence
  chemically synthesized
tctctaaaatgggagtagtaat

SEQ ID NO: 840563 - DNA, 22 bp, Artificial Sequence
  chemically synthesized
ataggtagataaaattactact

SEQ ID NO: 840564 - DNA, 22 bp, Artificial Sequence
  chemically synthesized
aataggtagataaaattactac

SEQ ID NO: 840565 - DNA, 22 bp, Artificial Sequence
  chemically synthesized
taaaatgggagtagtaatttta

SEQ ID NO: 840566 - DNA, 22 bp, Artificial Sequence
  chemically synthesized
aaatgggagtagtaattttatc

SEQ ID NO: 840567 - DNA, 22 bp, Artificial Sequence
  chemically synthesized
taaatttaataggtagataaaa

SEQ ID NO: 840568 - DNA, 22 bp, Artificial Sequence
  chemically synthesized
tctataaatttaataggtagat

SEQ ID NO: 840569 - DNA, 22 bp, Artificial Sequence
  chemically synthesized
ttatctataaatttaataggta

SEQ ID NO: 840570 - DNA, 22 bp, Artificial Sequence
  chemically synthesized
attatctataaatttaataggt

SEQ ID NO: 840571 - DNA, 22 bp, Artificial Sequence
  chemically synthesized
tattatctataaatttaatagg

SEQ ID NO: 840572 - DNA, 22 bp, Artificial Sequence
  chemically synthesized
ttattatctataaatttaatag

SEQ ID NO: 840573 - DNA, 22 bp, Artificial Sequence
  chemically synthesized
tatctacctattaaatttatag

SEQ ID NO: 840574 - DNA, 22 bp, Artificial Sequence
  chemically synthesized
atctacctattaaatttataga

SEQ ID NO: 840575 - DNA, 22 bp, Artificial Sequence
  chemically synthesized
tctacctattaaatttatagat

SEQ ID NO: 840576 - DNA, 22 bp, Artificial Sequence
  chemically synthesized
caaaatttttattatctataaa

SEQ ID NO: 840577 - DNA, 22 bp, Artificial Sequence
  chemically synthesized
cctattaaatttatagataata

SEQ ID NO: 840578 - DNA, 22 bp, Artificial Sequence
  chemically synthesized
ttaaatttatagataataaaaa

SEQ ID NO: 840579 - DNA, 22 bp, Artificial Sequence
  chemically synthesized
aatttatagataataaaaattt

SEQ ID NO: 840580 - DNA, 22 bp, Artificial Sequence
  chemically synthesized
tgggaaatactgcaaaattttt

SEQ ID NO: 840581 - DNA, 22 bp, Artificial Sequence
  chemically synthesized
gtgggaaatactgcaaaatttt

SEQ ID NO: 840582 - DNA, 22 bp, Artificial Sequence
  chemically synthesized
tgtgggaaatactgcaaaattt

SEQ ID NO: 840583 - DNA, 22 bp, Artificial Sequence
  chemically synthesized
atagataataaaaattttgcag

SEQ ID NO: 840584 - DNA, 22 bp, Artificial Sequence
  chemically synthesized
ttgtgggaaatactgcaaaatt

SEQ ID NO: 840585 - DNA, 22 bp, Artificial Sequence
  chemically synthesized
tagataataaaaattttgcagt

SEQ ID NO: 840586 - DNA, 22 bp, Artificial Sequence
  chemically synthesized
aggaaagccttttgtgggaaat

SEQ ID NO: 840587 - DNA, 22 bp, Artificial Sequence
  chemically synthesized
tgcagtatttcccacaaaaggc

SEQ ID NO: 840588 - DNA, 22 bp, Artificial Sequence
  chemically synthesized
gcagtatttcccacaaaaggct

SEQ ID NO: 840589 - DNA, 22 bp, Artificial Sequence
  chemically synthesized
cagtatttcccacaaaaggctt

SEQ ID NO: 840590 - DNA, 22 bp, Artificial Sequence
  chemically synthesized
aacaaatattcaggaaagcctt

SEQ ID NO: 840591 - DNA, 22 bp, Artificial Sequence
  chemically synthesized
cccacaaaaggctttcctgaat

SEQ ID NO: 840592 - DNA, 22 bp, Artificial Sequence
  chemically synthesized
ccacaaaaggctttcctgaata

SEQ ID NO: 840593 - DNA, 22 bp, Artificial Sequence
  chemically synthesized
taaatagaattaaacaaatatt

SEQ ID NO: 840594 - DNA, 22 bp, Artificial Sequence
  chemically synthesized
tcctgaatatttgtttaattct

SEQ ID NO: 840595 - DNA, 22 bp, Artificial Sequence
  chemically synthesized
cctgaatatttgtttaattcta

SEQ ID NO: 840596 - DNA, 22 bp, Artificial Sequence
  chemically synthesized
ctgaatatttgtttaattctat

SEQ ID NO: 840597 - DNA, 22 bp, Artificial Sequence
  chemically synthesized
aatatttgtttaattctattta

SEQ ID NO: 840598 - DNA, 22 bp, Artificial Sequence
  chemically synthesized
gtttaattctatttatagatct

SEQ ID NO: 840599 - DNA, 22 bp, Artificial Sequence
  chemically synthesized
tttaattctatttatagatctt

SEQ ID NO: 840600 - DNA, 22 bp, Artificial Sequence
  chemically synthesized
gaaaagatggaataagatctat

SEQ ID NO: 840601 - DNA, 22 bp, Artificial Sequence
  chemically synthesized
ggaaaagatggaataagatcta

SEQ ID NO: 840602 - DNA, 22 bp, Artificial Sequence
  chemically synthesized
aattctatttatagatcttatt

SEQ ID NO: 840603 - DNA, 22 bp, Artificial Sequence
  chemically synthesized
attctatttatagatcttattc

SEQ ID NO: 840604 - DNA, 22 bp, Artificial Sequence
  chemically synthesized
cttggaaaagatggaataagat

SEQ ID NO: 840605 - DNA, 22 bp, Artificial Sequence
  chemically synthesized
tatttatagatcttattccatc

SEQ ID NO: 840606 - DNA, 22 bp, Artificial Sequence
  chemically synthesized
tttatagatcttattccatctt

SEQ ID NO: 840607 - DNA, 22 bp, Artificial Sequence
  chemically synthesized
atagatcttattccatcttttc

SEQ ID NO: 840608 - DNA, 22 bp, Artificial Sequence
  chemically synthesized
tagatcttattccatcttttcc

SEQ ID NO: 840609 - DNA, 22 bp, Artificial Sequence
  chemically synthesized
attccatcttttccaagcaacc

SEQ ID NO: 840610 - DNA, 22 bp, Artificial Sequence
  chemically synthesized
ttccatcttttccaagcaacct

SEQ ID NO: 840611 - DNA, 22 bp, Artificial Sequence
  chemically synthesized
catcttttccaagcaaccttct

SEQ ID NO: 840612 - DNA, 22 bp, Artificial Sequence
  chemically synthesized
aaagaccgacaggagaaggttg

SEQ ID NO: 840613 - DNA, 22 bp, Artificial Sequence
  chemically synthesized
aaaagaccgacaggagaaggtt

SEQ ID NO: 840614 - DNA, 22 bp, Artificial Sequence
  chemically synthesized
ttccaagcaaccttctcctgtc

SEQ ID NO: 840615 - DNA, 22 bp, Artificial Sequence
  chemically synthesized
tccaagcaaccttctcctgtcg

SEQ ID NO: 840616 - DNA, 22 bp, Artificial Sequence
  chemically synthesized
ccaagcaaccttctcctgtcgg

SEQ ID NO: 840617 - DNA, 22 bp, Artificial Sequence
  chemically synthesized
caagcaaccttctcctgtcggt

SEQ ID NO: 840618 - DNA, 22 bp, Artificial Sequence
  chemically synthesized
ctcctgtcggtcttttaaatct

SEQ ID NO: 840619 - DNA, 22 bp, Artificial Sequence
  chemically synthesized
tcctgtcggtcttttaaatctc

SEQ ID NO: 840620 - DNA, 22 bp, Artificial Sequence
  chemically synthesized
ctgtcggtcttttaaatctctc

SEQ ID NO: 840621 - DNA, 22 bp, Artificial Sequence
  chemically synthesized
tcggtcttttaaatctctcctt

SEQ ID NO: 840622 - DNA, 22 bp, Artificial Sequence
  chemically synthesized
ttaaatctctccttttggggtg

SEQ ID NO: 840623 - DNA, 22 bp, Artificial Sequence
  chemically synthesized
gccccccaccaccaccccaaaa

SEQ ID NO: 840624 - DNA, 22 bp, Artificial Sequence
  chemically synthesized
taaatctctccttttggggtgg

SEQ ID NO: 840625 - DNA, 22 bp, Artificial Sequence
  chemically synthesized
cgccccccaccaccaccccaaa

SEQ ID NO: 840626 - DNA, 22 bp, Artificial Sequence
  chemically synthesized
aaatctctccttttggggtggt

SEQ ID NO: 840627 - DNA, 22 bp, Artificial Sequence
  chemically synthesized
aatctctccttttggggtggtg

SEQ ID NO: 840628 - DNA, 22 bp, Artificial Sequence
  chemically synthesized
tttcgccccccaccaccacccc

SEQ ID NO: 840629 - DNA, 22 bp, Artificial Sequence
  chemically synthesized
gttatttcgccccccaccacca

SEQ ID NO: 840630 - DNA, 22 bp, Artificial Sequence
  chemically synthesized
tccttttggggtggtggtgggg

SEQ ID NO: 840631 - DNA, 22 bp, Artificial Sequence
  chemically synthesized
agttatttcgccccccaccacc

SEQ ID NO: 840632 - DNA, 22 bp, Artificial Sequence
  chemically synthesized
cttttggggtggtggtgggggg

SEQ ID NO: 840633 - DNA, 22 bp, Artificial Sequence
  chemically synthesized
tttagttatttcgccccccacc

SEQ ID NO: 840634 - DNA, 22 bp, Artificial Sequence
  chemically synthesized
ttggggtggtggtggggggcga

SEQ ID NO: 840635 - DNA, 22 bp, Artificial Sequence
  chemically synthesized
tggggtggtggtggggggcgaa

SEQ ID NO: 840636 - DNA, 22 bp, Artificial Sequence
  chemically synthesized
ggggtggtggtggggggcgaaa

SEQ ID NO: 840637 - DNA, 22 bp, Artificial Sequence
  chemically synthesized
gggtggtggtggggggcgaaat

SEQ ID NO: 840638 - DNA, 22 bp, Artificial Sequence
  chemically synthesized
gtagctgtttagttatttcgcc

SEQ ID NO: 840639 - DNA, 22 bp, Artificial Sequence
  chemically synthesized
ggtagctgtttagttatttcgc

SEQ ID NO: 840640 - DNA, 22 bp, Artificial Sequence
  chemically synthesized
tggtagctgtttagttatttcg

SEQ ID NO: 840641 - DNA, 22 bp, Artificial Sequence
  chemically synthesized
ttggtagctgtttagttatttc

SEQ ID NO: 840642 - DNA, 22 bp, Artificial Sequence
  chemically synthesized
tttggtagctgtttagttattt

SEQ ID NO: 840643 - DNA, 22 bp, Artificial Sequence
  chemically synthesized
atgagctttttggtagctgttt

SEQ ID NO: 840644 - DNA, 22 bp, Artificial Sequence
  chemically synthesized
aatgagctttttggtagctgtt

SEQ ID NO: 840645 - DNA, 22 bp, Artificial Sequence
  chemically synthesized
aacagctaccaaaaagctcatt

SEQ ID NO: 840646 - DNA, 22 bp, Artificial Sequence
  chemically synthesized
atgcaaaatacttaatgagctt

SEQ ID NO: 840647 - DNA, 22 bp, Artificial Sequence
  chemically synthesized
aatgcaaaatacttaatgagct

SEQ ID NO: 840648 - DNA, 22 bp, Artificial Sequence
  chemically synthesized
ccaaaaagctcattaagtattt

SEQ ID NO: 840649 - DNA, 22 bp, Artificial Sequence
  chemically synthesized
aaggcttaatgcaaaatactta

SEQ ID NO: 840650 - DNA, 22 bp, Artificial Sequence
  chemically synthesized
gaaggcttaatgcaaaatactt

SEQ ID NO: 840651 - DNA, 22 bp, Artificial Sequence
  chemically synthesized
tgaaggcttaatgcaaaatact

SEQ ID NO: 840652 - DNA, 22 bp, Artificial Sequence
  chemically synthesized
attaagtattttgcattaagcc

SEQ ID NO: 840653 - DNA, 22 bp, Artificial Sequence
  chemically synthesized
gggtgctttgaaggcttaatgc

SEQ ID NO: 840654 - DNA, 22 bp, Artificial Sequence
  chemically synthesized
ttggggtgctttgaaggcttaa

SEQ ID NO: 840655 - DNA, 22 bp, Artificial Sequence
  chemically synthesized
agtattttgcattaagccttca

SEQ ID NO: 840656 - DNA, 22 bp, Artificial Sequence
  chemically synthesized
taatctattggggtgctttgaa

SEQ ID NO: 840657 - DNA, 22 bp, Artificial Sequence
  chemically synthesized
tgcattaagccttcaaagcacc

SEQ ID NO: 840658 - DNA, 22 bp, Artificial Sequence
  chemically synthesized
gcattaagccttcaaagcaccc

SEQ ID NO: 840659 - DNA, 22 bp, Artificial Sequence
  chemically synthesized
cattaagccttcaaagcacccc

SEQ ID NO: 840660 - DNA, 22 bp, Artificial Sequence
  chemically synthesized
attataatctattggggtgctt

SEQ ID NO: 840661 - DNA, 22 bp, Artificial Sequence
  chemically synthesized
aattataatctattggggtgct

SEQ ID NO: 840662 - DNA, 22 bp, Artificial Sequence
  chemically synthesized
taattataatctattggggtgc

SEQ ID NO: 840663 - DNA, 22 bp, Artificial Sequence
  chemically synthesized
agccttcaaagcaccccaatag

SEQ ID NO: 840664 - DNA, 22 bp, Artificial Sequence
  chemically synthesized
ttttaattataatctattgggg

SEQ ID NO: 840665 - DNA, 22 bp, Artificial Sequence
  chemically synthesized
ttattttaattataatctattg

SEQ ID NO: 840666 - DNA, 22 bp, Artificial Sequence
  chemically synthesized
gttattttaattataatctatt

SEQ ID NO: 840667 - DNA, 22 bp, Artificial Sequence
  chemically synthesized
caaagcaccccaatagattata

SEQ ID NO: 840668 - DNA, 22 bp, Artificial Sequence
  chemically synthesized
aaagcaccccaatagattataa

SEQ ID NO: 840669 - DNA, 22 bp, Artificial Sequence
  chemically synthesized
gcatttgttattttaattataa

SEQ ID NO: 840670 - DNA, 22 bp, Artificial Sequence
  chemically synthesized
aatgaatgttagcatttgttat

SEQ ID NO: 840671 - DNA, 22 bp, Artificial Sequence
  chemically synthesized
taattaaaataacaaatgctaa

SEQ ID NO: 840672 - DNA, 22 bp, Artificial Sequence
  chemically synthesized
aaataacaaatgctaacattca

SEQ ID NO: 840673 - DNA, 22 bp, Artificial Sequence
  chemically synthesized
gatcagggccatagtaaaagct

SEQ ID NO: 840674 - DNA, 22 bp, Artificial Sequence
  chemically synthesized
agatcagggccatagtaaaagc

SEQ ID NO: 840675 - DNA, 22 bp, Artificial Sequence
  chemically synthesized
acattcattcagcttttactat

SEQ ID NO: 840676 - DNA, 22 bp, Artificial Sequence
  chemically synthesized
attcagcttttactatggccct

SEQ ID NO: 840677 - DNA, 22 bp, Artificial Sequence
  chemically synthesized
agcttttactatggccctgatc

SEQ ID NO: 840678 - DNA, 22 bp, Artificial Sequence
  chemically synthesized
atgtagagcccttagatcaggg

SEQ ID NO: 840679 - DNA, 22 bp, Artificial Sequence
  chemically synthesized
ttactatggccctgatctaagg

SEQ ID NO: 840680 - DNA, 22 bp, Artificial Sequence
  chemically synthesized
tactatggccctgatctaaggg

SEQ ID NO: 840681 - DNA, 22 bp, Artificial Sequence
  chemically synthesized
actatggccctgatctaagggc

SEQ ID NO: 840682 - DNA, 22 bp, Artificial Sequence
  chemically synthesized
ctatggccctgatctaagggct

SEQ ID NO: 840683 - DNA, 22 bp, Artificial Sequence
  chemically synthesized
tggccctgatctaagggctcta

SEQ ID NO: 840684 - DNA, 22 bp, Artificial Sequence
  chemically synthesized
gatgaaataattaatgtagagc

SEQ ID NO: 840685 - DNA, 22 bp, Artificial Sequence
  chemically synthesized
atctaagggctctacattaatt

SEQ ID NO: 840686 - DNA, 22 bp, Artificial Sequence
  chemically synthesized
agggctctacattaattatttc

SEQ ID NO: 840687 - DNA, 22 bp, Artificial Sequence
  chemically synthesized
ggaggattagatgaaataatta

SEQ ID NO: 840688 - DNA, 22 bp, Artificial Sequence
  chemically synthesized
tacattaattatttcatctaat

SEQ ID NO: 840689 - DNA, 22 bp, Artificial Sequence
  chemically synthesized
atgggttgggaggattagatga

SEQ ID NO: 840690 - DNA, 22 bp, Artificial Sequence
  chemically synthesized
cattaattatttcatctaatcc

SEQ ID NO: 840691 - DNA, 22 bp, Artificial Sequence
  chemically synthesized
tctcatgggttgggaggattag

SEQ ID NO: 840692 - DNA, 22 bp, Artificial Sequence
  chemically synthesized
attatttcatctaatcctccca

SEQ ID NO: 840693 - DNA, 22 bp, Artificial Sequence
  chemically synthesized
tttcatctaatcctcccaaccc

SEQ ID NO: 840694 - DNA, 22 bp, Artificial Sequence
  chemically synthesized
taactatctcatgggttgggag

SEQ ID NO: 840695 - DNA, 22 bp, Artificial Sequence
  chemically synthesized
ataactatctcatgggttggga

SEQ ID NO: 840696 - DNA, 22 bp, Artificial Sequence
  chemically synthesized
catctaatcctcccaacccatg

SEQ ID NO: 840697 - DNA, 22 bp, Artificial Sequence
  chemically synthesized
atctaatcctcccaacccatga

SEQ ID NO: 840698 - DNA, 22 bp, Artificial Sequence
  chemically synthesized
acttataactatctcatgggtt

SEQ ID NO: 840699 - DNA, 22 bp, Artificial Sequence
  chemically synthesized
atcctcccaacccatgagatag

SEQ ID NO: 840700 - DNA, 22 bp, Artificial Sequence
  chemically synthesized
ccaacccatgagatagttataa

SEQ ID NO: 840701 - DNA, 22 bp, Artificial Sequence
  chemically synthesized
taaaataggctcacttataact

SEQ ID NO: 840702 - DNA, 22 bp, Artificial Sequence
  chemically synthesized
tgtaaaataggctcacttataa

SEQ ID NO: 840703 - DNA, 22 bp, Artificial Sequence
  chemically synthesized
tctgtaaaataggctcacttat

SEQ ID NO: 840704 - DNA, 22 bp, Artificial Sequence
  chemically synthesized
ctctgtaaaataggctcactta

SEQ ID NO: 840705 - DNA, 22 bp, Artificial Sequence
  chemically synthesized
cttctctgtaaaataggctcac

SEQ ID NO: 840706 - DNA, 22 bp, Artificial Sequence
  chemically synthesized
ccttctctgtaaaataggctca

SEQ ID NO: 840707 - DNA, 22 bp, Artificial Sequence
  chemically synthesized
gtttccttctctgtaaaatagg

SEQ ID NO: 840708 - DNA, 22 bp, Artificial Sequence
  chemically synthesized
agtttccttctctgtaaaatag

SEQ ID NO: 840709 - DNA, 22 bp, Artificial Sequence
  chemically synthesized
ttagtttccttctctgtaaaat

SEQ ID NO: 840710 - DNA, 22 bp, Artificial Sequence
  chemically synthesized
taagtgagcctattttacagag

SEQ ID NO: 840711 - DNA, 22 bp, Artificial Sequence
  chemically synthesized
ctcttagtttccttctctgtaa

SEQ ID NO: 840712 - DNA, 22 bp, Artificial Sequence
  chemically synthesized
tctgctcttagtttccttctct

SEQ ID NO: 840713 - DNA, 22 bp, Artificial Sequence
  chemically synthesized
ttttacagagaaggaaactaag

SEQ ID NO: 840714 - DNA, 22 bp, Artificial Sequence
  chemically synthesized
tacagagaaggaaactaagagc

SEQ ID NO: 840715 - DNA, 22 bp, Artificial Sequence
  chemically synthesized
agtaaactatctgctcttagtt

SEQ ID NO: 840716 - DNA, 22 bp, Artificial Sequence
  chemically synthesized
acagagaaggaaactaagagca

SEQ ID NO: 840717 - DNA, 22 bp, Artificial Sequence
  chemically synthesized
cagagaaggaaactaagagcag

SEQ ID NO: 840718 - DNA, 22 bp, Artificial Sequence
  chemically synthesized
atctcagtaaactatctgctct

SEQ ID NO: 840719 - DNA, 22 bp, Artificial Sequence
  chemically synthesized
agagcagatagtttactgagat

SEQ ID NO: 840720 - DNA, 22 bp, Artificial Sequence
  chemically synthesized
agcaaatgactaatctcagtaa

SEQ ID NO: 840721 - DNA, 22 bp, Artificial Sequence
  chemically synthesized
gagcaaatgactaatctcagta

SEQ ID NO: 840722 - DNA, 22 bp, Artificial Sequence
  chemically synthesized
tggccttgagcaaatgactaat

SEQ ID NO: 840723 - DNA, 22 bp, Artificial Sequence
  chemically synthesized
gtggccttgagcaaatgactaa

SEQ ID NO: 840724 - DNA, 22 bp, Artificial Sequence
  chemically synthesized
tgtggccttgagcaaatgacta

SEQ ID NO: 840725 - DNA, 22 bp, Artificial Sequence
  chemically synthesized
actgagattagtcatttgctca

SEQ ID NO: 840726 - DNA, 22 bp, Artificial Sequence
  chemically synthesized
gctttgtggccttgagcaaatg

SEQ ID NO: 840727 - DNA, 22 bp, Artificial Sequence
  chemically synthesized
ctgagattagtcatttgctcaa

SEQ ID NO: 840728 - DNA, 22 bp, Artificial Sequence
  chemically synthesized
ttagctttgtggccttgagcaa

SEQ ID NO: 840729 - DNA, 22 bp, Artificial Sequence
  chemically synthesized
agattagtcatttgctcaaggc

SEQ ID NO: 840730 - DNA, 22 bp, Artificial Sequence
  chemically synthesized
gttagctttgtggccttgagca

SEQ ID NO: 840731 - DNA, 22 bp, Artificial Sequence
  chemically synthesized
gtcatttgctcaaggccacaaa

SEQ ID NO: 840732 - DNA, 22 bp, Artificial Sequence
  chemically synthesized
gccacttgttagctttgtggcc

SEQ ID NO: 840733 - DNA, 22 bp, Artificial Sequence
  chemically synthesized
gactggccacttgttagctttg

SEQ ID NO: 840734 - DNA, 22 bp, Artificial Sequence
  chemically synthesized
gctcaaggccacaaagctaaca

SEQ ID NO: 840735 - DNA, 22 bp, Artificial Sequence
  chemically synthesized
ctcaaggccacaaagctaacaa

SEQ ID NO: 840736 - DNA, 22 bp, Artificial Sequence
  chemically synthesized
cctagactggccacttgttagc

SEQ ID NO: 840737 - DNA, 22 bp, Artificial Sequence
  chemically synthesized
aaggccacaaagctaacaagtg

SEQ ID NO: 840738 - DNA, 22 bp, Artificial Sequence
  chemically synthesized
aaaggcaggctgcctagactgg

SEQ ID NO: 840739 - DNA, 22 bp, Artificial Sequence
  chemically synthesized
aaaaggcaggctgcctagactg

SEQ ID NO: 840740 - DNA, 22 bp, Artificial Sequence
  chemically synthesized
taaaaggcaggctgcctagact

SEQ ID NO: 840741 - DNA, 22 bp, Artificial Sequence
  chemically synthesized
acaagtggccagtctaggcagc

SEQ ID NO: 840742 - DNA, 22 bp, Artificial Sequence
  chemically synthesized
ctttaaaaggcaggctgcctag

SEQ ID NO: 840743 - DNA, 22 bp, Artificial Sequence
  chemically synthesized
ggcagcctgccttttaaagtaa

SEQ ID NO: 840744 - DNA, 22 bp, Artificial Sequence
  chemically synthesized
tacagcaatagcatgcattact

SEQ ID NO: 840745 - DNA, 22 bp, Artificial Sequence
  chemically synthesized
ccttttaaagtaatgcatgcta

SEQ ID NO: 840746 - DNA, 22 bp, Artificial Sequence
  chemically synthesized
ggggctatacagcaatagcatg

SEQ ID NO: 840747 - DNA, 22 bp, Artificial Sequence
  chemically synthesized
ttaaagtaatgcatgctattgc

SEQ ID NO: 840748 - DNA, 22 bp, Artificial Sequence
  chemically synthesized
cggggctatacagcaatagcat

SEQ ID NO: 840749 - DNA, 22 bp, Artificial Sequence
  chemically synthesized
taaagtaatgcatgctattgct

SEQ ID NO: 840750 - DNA, 22 bp, Artificial Sequence
  chemically synthesized
aaagtaatgcatgctattgctg

SEQ ID NO: 840751 - DNA, 22 bp, Artificial Sequence
  chemically synthesized
aagtaatgcatgctattgctgt

SEQ ID NO: 840752 - DNA, 22 bp, Artificial Sequence
  chemically synthesized
ccatttcggggctatacagcaa

SEQ ID NO: 840753 - DNA, 22 bp, Artificial Sequence
  chemically synthesized
ttgctgtatagccccgaaatgg

SEQ ID NO: 840754 - DNA, 22 bp, Artificial Sequence
  chemically synthesized
ctgtatagccccgaaatggtag

SEQ ID NO: 840755 - DNA, 22 bp, Artificial Sequence
  chemically synthesized
cgtaacccccaccactaccatt

SEQ ID NO: 840756 - DNA, 22 bp, Artificial Sequence
  chemically synthesized
tatagccccgaaatggtagtgg

SEQ ID NO: 840757 - DNA, 22 bp, Artificial Sequence
  chemically synthesized
cctccgtaacccccaccactac

SEQ ID NO: 840758 - DNA, 22 bp, Artificial Sequence
  chemically synthesized
tccctccgtaacccccaccact

SEQ ID NO: 840759 - DNA, 22 bp, Artificial Sequence
  chemically synthesized
ctccctccgtaacccccaccac

SEQ ID NO: 840760 - DNA, 22 bp, Artificial Sequence
  chemically synthesized
tagcttctccctccgtaacccc

SEQ ID NO: 840761 - DNA, 22 bp, Artificial Sequence
  chemically synthesized
tgtagcttctccctccgtaacc

SEQ ID NO: 840762 - DNA, 22 bp, Artificial Sequence
  chemically synthesized
ctgtagcttctccctccgtaac

SEQ ID NO: 840763 - DNA, 22 bp, Artificial Sequence
  chemically synthesized
tttctgtagcttctccctccgt

SEQ ID NO: 840764 - DNA, 22 bp, Artificial Sequence
  chemically synthesized
gtttctgtagcttctccctccg

SEQ ID NO: 840765 - DNA, 22 bp, Artificial Sequence
  chemically synthesized
agagccttgtttctgtagcttc

SEQ ID NO: 840766 - DNA, 22 bp, Artificial Sequence
  chemically synthesized
aagagccttgtttctgtagctt

SEQ ID NO: 840767 - DNA, 22 bp, Artificial Sequence
  chemically synthesized
cggagggagaagctacagaaac

SEQ ID NO: 840768 - DNA, 22 bp, Artificial Sequence
  chemically synthesized
gatttaagagccttgtttctgt

SEQ ID NO: 840769 - DNA, 22 bp, Artificial Sequence
  chemically synthesized
ggatttaagagccttgtttctg

SEQ ID NO: 840770 - DNA, 22 bp, Artificial Sequence
  chemically synthesized
taacatttggatttaagagcct

SEQ ID NO: 840771 - DNA, 22 bp, Artificial Sequence
  chemically synthesized
ctgtaacatttggatttaagag

SEQ ID NO: 840772 - DNA, 22 bp, Artificial Sequence
  chemically synthesized
cagaaacaaggctcttaaatcc

SEQ ID NO: 840773 - DNA, 22 bp, Artificial Sequence
  chemically synthesized
gtgaatgtcgttcctgtaacat

SEQ ID NO: 840774 - DNA, 22 bp, Artificial Sequence
  chemically synthesized
ttaaatccaaatgttacaggaa

SEQ ID NO: 840775 - DNA, 22 bp, Artificial Sequence
  chemically synthesized
aaatccaaatgttacaggaacg

SEQ ID NO: 840776 - DNA, 22 bp, Artificial Sequence
  chemically synthesized
aatccaaatgttacaggaacga

SEQ ID NO: 840777 - DNA, 22 bp, Artificial Sequence
  chemically synthesized
acaaacaatattggtgaatgtc

SEQ ID NO: 840778 - DNA, 22 bp, Artificial Sequence
  chemically synthesized
cacaaacaatattggtgaatgt

SEQ ID NO: 840779 - DNA, 22 bp, Artificial Sequence
  chemically synthesized
tttcacaaacaatattggtgaa

SEQ ID NO: 840780 - DNA, 22 bp, Artificial Sequence
  chemically synthesized
caggaacgacattcaccaatat

SEQ ID NO: 840781 - DNA, 22 bp, Artificial Sequence
  chemically synthesized
atttcacaaacaatattggtga

SEQ ID NO: 840782 - DNA, 22 bp, Artificial Sequence
  chemically synthesized
tttatttcacaaacaatattgg

SEQ ID NO: 840783 - DNA, 22 bp, Artificial Sequence
  chemically synthesized
tgtttatttcacaaacaatatt

SEQ ID NO: 840784 - DNA, 22 bp, Artificial Sequence
  chemically synthesized
tcattctgtttatttcacaaac

SEQ ID NO: 840785 - DNA, 22 bp, Artificial Sequence
  chemically synthesized
atcattctgtttatttcacaaa

SEQ ID NO: 840786 - DNA, 22 bp, Artificial Sequence
  chemically synthesized
tatcattctgtttatttcacaa

SEQ ID NO: 840787 - DNA, 22 bp, Artificial Sequence
  chemically synthesized
accaatattgtttgtgaaataa

SEQ ID NO: 840788 - DNA, 22 bp, Artificial Sequence
  chemically synthesized
ttatcattctgtttatttcaca

SEQ ID NO: 840789 - DNA, 22 bp, Artificial Sequence
  chemically synthesized
cttttatcattctgtttatttc

SEQ ID NO: 840790 - DNA, 22 bp, Artificial Sequence
  chemically synthesized
ccttttatcattctgtttattt

SEQ ID NO: 840791 - DNA, 22 bp, Artificial Sequence
  chemically synthesized
cttccttttatcattctgttta

SEQ ID NO: 840792 - DNA, 22 bp, Artificial Sequence
  chemically synthesized
tttgtgaaataaacagaatgat

SEQ ID NO: 840793 - DNA, 22 bp, Artificial Sequence
  chemically synthesized
gtgaaataaacagaatgataaa

SEQ ID NO: 840794 - DNA, 22 bp, Artificial Sequence
  chemically synthesized
tgaaataaacagaatgataaaa

SEQ ID NO: 840795 - DNA, 22 bp, Artificial Sequence
  chemically synthesized
gaaagataaaactgcttccttt

SEQ ID NO: 840796 - DNA, 22 bp, Artificial Sequence
  chemically synthesized
ggaaagataaaactgcttcctt

SEQ ID NO: 840797 - DNA, 22 bp, Artificial Sequence
  chemically synthesized
catagcagtgaagaggatttgg

SEQ ID NO: 840798 - DNA, 22 bp, Artificial Sequence
  chemically synthesized
gcatagcagtgaagaggatttg

SEQ ID NO: 840799 - DNA, 22 bp, Artificial Sequence
  chemically synthesized
tatctttccaaatcctcttcac

SEQ ID NO: 840800 - DNA, 22 bp, Artificial Sequence
  chemically synthesized
atctttccaaatcctcttcact

SEQ ID NO: 840801 - DNA, 22 bp, Artificial Sequence
  chemically synthesized
tctttccaaatcctcttcactg

SEQ ID NO: 840802 - DNA, 22 bp, Artificial Sequence
  chemically synthesized
tccaaatcctcttcactgctat

SEQ ID NO: 840803 - DNA, 22 bp, Artificial Sequence
  chemically synthesized
ccaaatcctcttcactgctatg

SEQ ID NO: 840804 - DNA, 22 bp, Artificial Sequence
  chemically synthesized
caaatcctcttcactgctatgc

SEQ ID NO: 840805 - DNA, 22 bp, Artificial Sequence
  chemically synthesized
ttcactgctatgcaaggtatta

SEQ ID NO: 840806 - DNA, 22 bp, Artificial Sequence
  chemically synthesized
cactgctatgcaaggtattatg

SEQ ID NO: 840807 - DNA, 22 bp, Artificial Sequence
  chemically synthesized
actgctatgcaaggtattatgg

SEQ ID NO: 840808 - DNA, 22 bp, Artificial Sequence
  chemically synthesized
caaggcataataccataatacc

SEQ ID NO: 840809 - DNA, 22 bp, Artificial Sequence
  chemically synthesized
ctatgcaaggtattatggtatt

SEQ ID NO: 840810 - DNA, 22 bp, Artificial Sequence
  chemically synthesized
atactgcaaggcataataccat

SEQ ID NO: 840811 - DNA, 22 bp, Artificial Sequence
  chemically synthesized
tgcaaggtattatggtattatg

SEQ ID NO: 840812 - DNA, 22 bp, Artificial Sequence
  chemically synthesized
ttaatactgcaaggcataatac

SEQ ID NO: 840813 - DNA, 22 bp, Artificial Sequence
  chemically synthesized
gtgtctgttaatactgcaaggc

SEQ ID NO: 840814 - DNA, 22 bp, Artificial Sequence
  chemically synthesized
tggtattatgccttgcagtatt

SEQ ID NO: 840815 - DNA, 22 bp, Artificial Sequence
  chemically synthesized
ttcgtgtctgttaatactgcaa

SEQ ID NO: 840816 - DNA, 22 bp, Artificial Sequence
  chemically synthesized
gttcgtgtctgttaatactgca

SEQ ID NO: 840817 - DNA, 22 bp, Artificial Sequence
  chemically synthesized
ttgttcgtgtctgttaatactg

SEQ ID NO: 840818 - DNA, 22 bp, Artificial Sequence
  chemically synthesized
tgccttgcagtattaacagaca

SEQ ID NO: 840819 - DNA, 22 bp, Artificial Sequence
  chemically synthesized
catgaaactcttgttcgtgtct

SEQ ID NO: 840820 - DNA, 22 bp, Artificial Sequence
  chemically synthesized
gcagtattaacagacacgaaca

SEQ ID NO: 840821 - DNA, 22 bp, Artificial Sequence
  chemically synthesized
cagtattaacagacacgaacaa

SEQ ID NO: 840822 - DNA, 22 bp, Artificial Sequence
  chemically synthesized
aattacatgaaactcttgttcg

SEQ ID NO: 840823 - DNA, 22 bp, Artificial Sequence
  chemically synthesized
acagacacgaacaagagtttca

SEQ ID NO: 840824 - DNA, 22 bp, Artificial Sequence
  chemically synthesized
gaggcgtctgaattacatgaaa

SEQ ID NO: 840825 - DNA, 22 bp, Artificial Sequence
  chemically synthesized
ggaggcgtctgaattacatgaa

SEQ ID NO: 840826 - DNA, 22 bp, Artificial Sequence
  chemically synthesized
cttggaggcgtctgaattacat

SEQ ID NO: 840827 - DNA, 22 bp, Artificial Sequence
  chemically synthesized
ccttggaggcgtctgaattaca

SEQ ID NO: 840828 - DNA, 22 bp, Artificial Sequence
  chemically synthesized
ttccttggaggcgtctgaatta

SEQ ID NO: 840829 - DNA, 22 bp, Artificial Sequence
  chemically synthesized
cttccttggaggcgtctgaatt

SEQ ID NO: 840830 - DNA, 22 bp, Artificial Sequence
  chemically synthesized
tcttccttggaggcgtctgaat

SEQ ID NO: 840831 - DNA, 22 bp, Artificial Sequence
  chemically synthesized
aattttcttccttggaggcgtc

SEQ ID NO: 840832 - DNA, 22 bp, Artificial Sequence
  chemically synthesized
catgtaattcagacgcctccaa

SEQ ID NO: 840833 - DNA, 22 bp, Artificial Sequence
  chemically synthesized
aaattttcttccttggaggcgt

SEQ ID NO: 840834 - DNA, 22 bp, Artificial Sequence
  chemically synthesized
atgtaattcagacgcctccaag

SEQ ID NO: 840835 - DNA, 22 bp, Artificial Sequence
  chemically synthesized
gaagaatttaaattttcttcct

SEQ ID NO: 840836 - DNA, 22 bp, Artificial Sequence
  chemically synthesized
agacgcctccaaggaagaaaat

SEQ ID NO: 840837 - DNA, 22 bp, Artificial Sequence
  chemically synthesized
caaggaagaaaatttaaattct

SEQ ID NO: 840838 - DNA, 22 bp, Artificial Sequence
  chemically synthesized
aaattcttctaatcttatctgc

SEQ ID NO: 840839 - DNA, 22 bp, Artificial Sequence
  chemically synthesized
aattcttctaatcttatctgct

SEQ ID NO: 840840 - DNA, 22 bp, Artificial Sequence
  chemically synthesized
ggtcaggggaccaaaagcagat

SEQ ID NO: 840841 - DNA, 22 bp, Artificial Sequence
  chemically synthesized
ttctaatcttatctgcttttgg

SEQ ID NO: 840842 - DNA, 22 bp, Artificial Sequence
  chemically synthesized
ctaatcttatctgcttttggtc

SEQ ID NO: 840843 - DNA, 22 bp, Artificial Sequence
  chemically synthesized
taatcttatctgcttttggtcc

SEQ ID NO: 840844 - DNA, 22 bp, Artificial Sequence
  chemically synthesized
atcttatctgcttttggtcccc

SEQ ID NO: 840845 - DNA, 22 bp, Artificial Sequence
  chemically synthesized
caaaagggctgggtcaggggac

SEQ ID NO: 840846 - DNA, 22 bp, Artificial Sequence
  chemically synthesized
atctgcttttggtcccctgacc

SEQ ID NO: 840847 - DNA, 22 bp, Artificial Sequence
  chemically synthesized
tctgcttttggtcccctgaccc

SEQ ID NO: 840848 - DNA, 22 bp, Artificial Sequence
  chemically synthesized
tgcaaaagggctgggtcagggg

SEQ ID NO: 840849 - DNA, 22 bp, Artificial Sequence
  chemically synthesized
ctgcaaaagggctgggtcaggg

SEQ ID NO: 840850 - DNA, 22 bp, Artificial Sequence
  chemically synthesized
ttctgcaaaagggctgggtcag

SEQ ID NO: 840851 - DNA, 22 bp, Artificial Sequence
  chemically synthesized
cttttggtcccctgacccagcc

SEQ ID NO: 840852 - DNA, 22 bp, Artificial Sequence
  chemically synthesized
cttctgcaaaagggctgggtca

SEQ ID NO: 840853 - DNA, 22 bp, Artificial Sequence
  chemically synthesized
tcttctgcaaaagggctgggtc

SEQ ID NO: 840854 - DNA, 22 bp, Artificial Sequence
  chemically synthesized
ttggtcccctgacccagccctt

SEQ ID NO: 840855 - DNA, 22 bp, Artificial Sequence
  chemically synthesized
tggtcccctgacccagcccttt

SEQ ID NO: 840856 - DNA, 22 bp, Artificial Sequence
  chemically synthesized
ggtcccctgacccagccctttt

SEQ ID NO: 840857 - DNA, 22 bp, Artificial Sequence
  chemically synthesized
gtcccctgacccagcccttttg

SEQ ID NO: 840858 - DNA, 22 bp, Artificial Sequence
  chemically synthesized
gccattttcttctgcaaaaggg

SEQ ID NO: 840859 - DNA, 22 bp, Artificial Sequence
  chemically synthesized
ctggccattttcttctgcaaaa

SEQ ID NO: 840860 - DNA, 22 bp, Artificial Sequence
  chemically synthesized
acccagcccttttgcagaagaa

SEQ ID NO: 840861 - DNA, 22 bp, Artificial Sequence
  chemically synthesized
tcaatcattcctggccattttc

SEQ ID NO: 840862 - DNA, 22 bp, Artificial Sequence
  chemically synthesized
gtcaatcattcctggccatttt

SEQ ID NO: 840863 - DNA, 22 bp, Artificial Sequence
  chemically synthesized
ttgcagaagaaaatggccagga

SEQ ID NO: 840864 - DNA, 22 bp, Artificial Sequence
  chemically synthesized
tgcagaagaaaatggccaggaa

SEQ ID NO: 840865 - DNA, 22 bp, Artificial Sequence
  chemically synthesized
gcagaagaaaatggccaggaat

SEQ ID NO: 840866 - DNA, 22 bp, Artificial Sequence
  chemically synthesized
aatttgtcaatcattcctggcc

SEQ ID NO: 840867 - DNA, 22 bp, Artificial Sequence
  chemically synthesized
cagaagaaaatggccaggaatg

SEQ ID NO: 840868 - DNA, 22 bp, Artificial Sequence
  chemically synthesized
gtgtctgaatttgtcaatcatt

SEQ ID NO: 840869 - DNA, 22 bp, Artificial Sequence
  chemically synthesized
ggtgtctgaatttgtcaatcat

SEQ ID NO: 840870 - DNA, 22 bp, Artificial Sequence
  chemically synthesized
tggtgtctgaatttgtcaatca

SEQ ID NO: 840871 - DNA, 22 bp, Artificial Sequence
  chemically synthesized
tttggtgtctgaatttgtcaat

SEQ ID NO: 840872 - DNA, 22 bp, Artificial Sequence
  chemically synthesized
actctttggtgtctgaatttgt

SEQ ID NO: 840873 - DNA, 22 bp, Artificial Sequence
  chemically synthesized
aactctttggtgtctgaatttg

SEQ ID NO: 840874 - DNA, 22 bp, Artificial Sequence
  chemically synthesized
taactctttggtgtctgaattt

SEQ ID NO: 840875 - DNA, 22 bp, Artificial Sequence
  chemically synthesized
tttaactctttggtgtctgaat

SEQ ID NO: 840876 - DNA, 22 bp, Artificial Sequence
  chemically synthesized
ctttaactctttggtgtctgaa

SEQ ID NO: 840877 - DNA, 22 bp, Artificial Sequence
  chemically synthesized
tctttaactctttggtgtctga

SEQ ID NO: 840878 - DNA, 22 bp, Artificial Sequence
  chemically synthesized
ttctttaactctttggtgtctg

SEQ ID NO: 840879 - DNA, 22 bp, Artificial Sequence
  chemically synthesized
atttttctttaactctttggtg

SEQ ID NO: 840880 - DNA, 22 bp, Artificial Sequence
  chemically synthesized
acaaattcagacaccaaagagt

SEQ ID NO: 840881 - DNA, 22 bp, Artificial Sequence
  chemically synthesized
ctcatttttctttaactctttg

SEQ ID NO: 840882 - DNA, 22 bp, Artificial Sequence
  chemically synthesized
agacaccaaagagttaaagaaa

SEQ ID NO: 840883 - DNA, 22 bp, Artificial Sequence
  chemically synthesized
gaattgctcatttttctttaac

SEQ ID NO: 840884 - DNA, 22 bp, Artificial Sequence
  chemically synthesized
atattcgaattgctcatttttc

SEQ ID NO: 840885 - DNA, 22 bp, Artificial Sequence
  chemically synthesized
taatattcgaattgctcatttt

SEQ ID NO: 840886 - DNA, 22 bp, Artificial Sequence
  chemically synthesized
ctaatattcgaattgctcattt

SEQ ID NO: 840887 - DNA, 22 bp, Artificial Sequence
  chemically synthesized
tctaatattcgaattgctcatt

SEQ ID NO: 840888 - DNA, 22 bp, Artificial Sequence
  chemically synthesized
tttctaatattcgaattgctca

SEQ ID NO: 840889 - DNA, 22 bp, Artificial Sequence
  chemically synthesized
aagaaaaatgagcaattcgaat

SEQ ID NO: 840890 - DNA, 22 bp, Artificial Sequence
  chemically synthesized
cctctttctaatattcgaattg

SEQ ID NO: 840891 - DNA, 22 bp, Artificial Sequence
  chemically synthesized
tccctctttctaatattcgaat

SEQ ID NO: 840892 - DNA, 22 bp, Artificial Sequence
  chemically synthesized
gaatattagaaagagggagaat

SEQ ID NO: 840893 - DNA, 22 bp, Artificial Sequence
  chemically synthesized
aatcagatcaaatgaaaaattc

SEQ ID NO: 840894 - DNA, 22 bp, Artificial Sequence
  chemically synthesized
gaaagagggagaatttttcatt

SEQ ID NO: 840895 - DNA, 22 bp, Artificial Sequence
  chemically synthesized
tctaaatcagatcaaatgaaaa

SEQ ID NO: 840896 - DNA, 22 bp, Artificial Sequence
  chemically synthesized
gtctaaatcagatcaaatgaaa

SEQ ID NO: 840897 - DNA, 22 bp, Artificial Sequence
  chemically synthesized
tgtctaaatcagatcaaatgaa

SEQ ID NO: 840898 - DNA, 22 bp, Artificial Sequence
  chemically synthesized
ttcatttgatctgatttagaca

SEQ ID NO: 840899 - DNA, 22 bp, Artificial Sequence
  chemically synthesized
tcatttgatctgatttagacaa

SEQ ID NO: 840900 - DNA, 22 bp, Artificial Sequence
  chemically synthesized
catttgatctgatttagacaaa

SEQ ID NO: 840901 - DNA, 22 bp, Artificial Sequence
  chemically synthesized
atttgatctgatttagacaaaa

SEQ ID NO: 840902 - DNA, 22 bp, Artificial Sequence
  chemically synthesized
ggtaagagagtaaattttgtct

SEQ ID NO: 840903 - DNA, 22 bp, Artificial Sequence
  chemically synthesized
gatctgatttagacaaaattta

SEQ ID NO: 840904 - DNA, 22 bp, Artificial Sequence
  chemically synthesized
atctgatttagacaaaatttac

SEQ ID NO: 840905 - DNA, 22 bp, Artificial Sequence
  chemically synthesized
atttagacaaaatttactctct

SEQ ID NO: 840906 - DNA, 22 bp, Artificial Sequence
  chemically synthesized
agacaaaatttactctcttacc

SEQ ID NO: 840907 - DNA, 22 bp, Artificial Sequence
  chemically synthesized
gacaaaatttactctcttacct

SEQ ID NO: 840908 - DNA, 22 bp, Artificial Sequence
  chemically synthesized
actctcttacctagattattac

SEQ ID NO: 840909 - DNA, 22 bp, Artificial Sequence
  chemically synthesized
ctctcttacctagattattact

SEQ ID NO: 840910 - DNA, 22 bp, Artificial Sequence
  chemically synthesized
atggaaatcatgcagtaataat

SEQ ID NO: 840911 - DNA, 22 bp, Artificial Sequence
  chemically synthesized
tcttacctagattattactgca

SEQ ID NO: 840912 - DNA, 22 bp, Artificial Sequence
  chemically synthesized
ttacctagattattactgcatg

SEQ ID NO: 840913 - DNA, 22 bp, Artificial Sequence
  chemically synthesized
tattgatggaaatcatgcagta

SEQ ID NO: 840914 - DNA, 22 bp, Artificial Sequence
  chemically synthesized
acctagattattactgcatgat

SEQ ID NO: 840915 - DNA, 22 bp, Artificial Sequence
  chemically synthesized
cctagattattactgcatgatt

SEQ ID NO: 840916 - DNA, 22 bp, Artificial Sequence
  chemically synthesized
gattattactgcatgatttcca

SEQ ID NO: 840917 - DNA, 22 bp, Artificial Sequence
  chemically synthesized
aggtaattatattgatggaaat

SEQ ID NO: 840918 - DNA, 22 bp, Artificial Sequence
  chemically synthesized
ttactgcatgatttccatcaat

SEQ ID NO: 840919 - DNA, 22 bp, Artificial Sequence
  chemically synthesized
ctgcatgatttccatcaatata

SEQ ID NO: 840920 - DNA, 22 bp, Artificial Sequence
  chemically synthesized
tattcaggtaattatattgatg

SEQ ID NO: 840921 - DNA, 22 bp, Artificial Sequence
  chemically synthesized
catgatttccatcaatataatt

SEQ ID NO: 840922 - DNA, 22 bp, Artificial Sequence
  chemically synthesized
ttgtattcaggtaattatattg

SEQ ID NO: 840923 - DNA, 22 bp, Artificial Sequence
  chemically synthesized
ccatcaatataattacctgaat

SEQ ID NO: 840924 - DNA, 22 bp, Artificial Sequence
  chemically synthesized
catcaatataattacctgaata

SEQ ID NO: 840925 - DNA, 22 bp, Artificial Sequence
  chemically synthesized
ccgtggtatctgttgtattcag

SEQ ID NO: 840926 - DNA, 22 bp, Artificial Sequence
  chemically synthesized
ttaccgtggtatctgttgtatt

SEQ ID NO: 840927 - DNA, 22 bp, Artificial Sequence
  chemically synthesized
cctgaatacaacagataccacg

SEQ ID NO: 840928 - DNA, 22 bp, Artificial Sequence
  chemically synthesized
tatgaaactattaccgtggtat

SEQ ID NO: 840929 - DNA, 22 bp, Artificial Sequence
  chemically synthesized
aatacaacagataccacggtaa

SEQ ID NO: 840930 - DNA, 22 bp, Artificial Sequence
  chemically synthesized
ctatatgaaactattaccgtgg

SEQ ID NO: 840931 - DNA, 22 bp, Artificial Sequence
  chemically synthesized
actatatgaaactattaccgtg

SEQ ID NO: 840932 - DNA, 22 bp, Artificial Sequence
  chemically synthesized
tactatatgaaactattaccgt

SEQ ID NO: 840933 - DNA, 22 bp, Artificial Sequence
  chemically synthesized
ggtgtgcaagccaccaccatgt

SEQ ID NO: 840934 - DNA, 22 bp, Artificial Sequence
  chemically synthesized
catatagtaaaacatggtggtg

SEQ ID NO: 840935 - DNA, 22 bp, Artificial Sequence
  chemically synthesized
atatagtaaaacatggtggtgg

SEQ ID NO: 840936 - DNA, 22 bp, Artificial Sequence
  chemically synthesized
aagtaattgggtgtgcaagcca

SEQ ID NO: 840937 - DNA, 22 bp, Artificial Sequence
  chemically synthesized
caagtaattgggtgtgcaagcc

SEQ ID NO: 840938 - DNA, 22 bp, Artificial Sequence
  chemically synthesized
aacttcaagtaattgggtgtgc

SEQ ID NO: 840939 - DNA, 22 bp, Artificial Sequence
  chemically synthesized
atgttaaacttcaagtaattgg

SEQ ID NO: 840940 - DNA, 22 bp, Artificial Sequence
  chemically synthesized
gcacacccaattacttgaagtt

SEQ ID NO: 840941 - DNA, 22 bp, Artificial Sequence
  chemically synthesized
cacacccaattacttgaagttt

SEQ ID NO: 840942 - DNA, 22 bp, Artificial Sequence
  chemically synthesized
gaaatattcatgttaaacttca

SEQ ID NO: 840943 - DNA, 22 bp, Artificial Sequence
  chemically synthesized
ctagaaatattcatgttaaact

SEQ ID NO: 840944 - DNA, 22 bp, Artificial Sequence
  chemically synthesized
tgtctactagaaatattcatgt

SEQ ID NO: 840945 - DNA, 22 bp, Artificial Sequence
  chemically synthesized
cttgaagtttaacatgaatatt

SEQ ID NO: 840946 - DNA, 22 bp, Artificial Sequence
  chemically synthesized
atgtctactagaaatattcatg

SEQ ID NO: 840947 - DNA, 22 bp, Artificial Sequence
  chemically synthesized
gaagtttaacatgaatatttct

SEQ ID NO: 840948 - DNA, 22 bp, Artificial Sequence
  chemically synthesized
tttatgtctactagaaatattc

SEQ ID NO: 840949 - DNA, 22 bp, Artificial Sequence
  chemically synthesized
aagtttaacatgaatatttcta

SEQ ID NO: 840950 - DNA, 22 bp, Artificial Sequence
  chemically synthesized
aacatgaatatttctagtagac

SEQ ID NO: 840951 - DNA, 22 bp, Artificial Sequence
  chemically synthesized
acatgaatatttctagtagaca

SEQ ID NO: 840952 - DNA, 22 bp, Artificial Sequence
  chemically synthesized
agtacaaagctatttatgtcta

SEQ ID NO: 840953 - DNA, 22 bp, Artificial Sequence
  chemically synthesized
ctagtagacataaatagctttg

SEQ ID NO: 840954 - DNA, 22 bp, Artificial Sequence
  chemically synthesized
tagtagacataaatagctttgt

SEQ ID NO: 840955 - DNA, 22 bp, Artificial Sequence
  chemically synthesized
gtagacataaatagctttgtac

SEQ ID NO: 840956 - DNA, 22 bp, Artificial Sequence
  chemically synthesized
tcaagagaaaagttcagtacaa

SEQ ID NO: 840957 - DNA, 22 bp, Artificial Sequence
  chemically synthesized
cagtctatcaagagaaaagttc

SEQ ID NO: 840958 - DNA, 22 bp, Artificial Sequence
  chemically synthesized
ttgcagtctatcaagagaaaag

SEQ ID NO: 840959 - DNA, 22 bp, Artificial Sequence
  chemically synthesized
tgtactgaacttttctcttgat

SEQ ID NO: 840960 - DNA, 22 bp, Artificial Sequence
  chemically synthesized
gtactgaacttttctcttgata

SEQ ID NO: 840961 - DNA, 22 bp, Artificial Sequence
  chemically synthesized
tactgaacttttctcttgatag

SEQ ID NO: 840962 - DNA, 22 bp, Artificial Sequence
  chemically synthesized
aacttttctcttgatagactgc

SEQ ID NO: 840963 - DNA, 22 bp, Artificial Sequence
  chemically synthesized
tacatagttattgcagtctatc

SEQ ID NO: 840964 - DNA, 22 bp, Artificial Sequence
  chemically synthesized
ttctcttgatagactgcaataa

SEQ ID NO: 840965 - DNA, 22 bp, Artificial Sequence
  chemically synthesized
tctcttgatagactgcaataac

SEQ ID NO: 840966 - DNA, 22 bp, Artificial Sequence
  chemically synthesized
ctcttgatagactgcaataact

SEQ ID NO: 840967 - DNA, 22 bp, Artificial Sequence
  chemically synthesized
tcttgatagactgcaataacta

SEQ ID NO: 840968 - DNA, 22 bp, Artificial Sequence
  chemically synthesized
ttgatagactgcaataactatg

SEQ ID NO: 840969 - DNA, 22 bp, Artificial Sequence
  chemically synthesized
ggaaaatctatacatagttatt

SEQ ID NO: 840970 - DNA, 22 bp, Artificial Sequence
  chemically synthesized
gatagactgcaataactatgta

SEQ ID NO: 840971 - DNA, 22 bp, Artificial Sequence
  chemically synthesized
atagactgcaataactatgtat

SEQ ID NO: 840972 - DNA, 22 bp, Artificial Sequence
  chemically synthesized
aacagttgggaaaatctataca

SEQ ID NO: 840973 - DNA, 22 bp, Artificial Sequence
  chemically synthesized
gaacagttgggaaaatctatac

SEQ ID NO: 840974 - DNA, 22 bp, Artificial Sequence
  chemically synthesized
tgaacagttgggaaaatctata

SEQ ID NO: 840975 - DNA, 22 bp, Artificial Sequence
  chemically synthesized
caataactatgtatagattttc

SEQ ID NO: 840976 - DNA, 22 bp, Artificial Sequence
  chemically synthesized
ataactttgaacagttgggaaa

SEQ ID NO: 840977 - DNA, 22 bp, Artificial Sequence
  chemically synthesized
cataactttgaacagttgggaa

SEQ ID NO: 840978 - DNA, 22 bp, Artificial Sequence
  chemically synthesized
tgtatagattttcccaactgtt

SEQ ID NO: 840979 - DNA, 22 bp, Artificial Sequence
  chemically synthesized
tcccaactgttcaaagttatga

SEQ ID NO: 840980 - DNA, 22 bp, Artificial Sequence
  chemically synthesized
gtaaatcccatttcataacttt

SEQ ID NO: 840981 - DNA, 22 bp, Artificial Sequence
  chemically synthesized
cccaactgttcaaagttatgaa

SEQ ID NO: 840982 - DNA, 22 bp, Artificial Sequence
  chemically synthesized
ccaactgttcaaagttatgaaa

SEQ ID NO: 840983 - DNA, 22 bp, Artificial Sequence
  chemically synthesized
tggtaaatcccatttcataact

SEQ ID NO: 840984 - DNA, 22 bp, Artificial Sequence
  chemically synthesized
tctggtaaatcccatttcataa

SEQ ID NO: 840985 - DNA, 22 bp, Artificial Sequence
  chemically synthesized
ctctggtaaatcccatttcata

SEQ ID NO: 840986 - DNA, 22 bp, Artificial Sequence
  chemically synthesized
tctctggtaaatcccatttcat

SEQ ID NO: 840987 - DNA, 22 bp, Artificial Sequence
  chemically synthesized
tttctctggtaaatcccatttc

SEQ ID NO: 840988 - DNA, 22 bp, Artificial Sequence
  chemically synthesized
ttcaaagttatgaaatgggatt

SEQ ID NO: 840989 - DNA, 22 bp, Artificial Sequence
  chemically synthesized
ctttctctggtaaatcccattt

SEQ ID NO: 840990 - DNA, 22 bp, Artificial Sequence
  chemically synthesized
tctttctctggtaaatcccatt

SEQ ID NO: 840991 - DNA, 22 bp, Artificial Sequence
  chemically synthesized
ttctttctctggtaaatcccat

SEQ ID NO: 840992 - DNA, 22 bp, Artificial Sequence
  chemically synthesized
aaagttatgaaatgggatttac

SEQ ID NO: 840993 - DNA, 22 bp, Artificial Sequence
  chemically synthesized
tgaaatgggatttaccagagaa

SEQ ID NO: 840994 - DNA, 22 bp, Artificial Sequence
  chemically synthesized
aaacatttttctttctctggta

SEQ ID NO: 840995 - DNA, 22 bp, Artificial Sequence
  chemically synthesized
tattgaaacatttttctttctc

SEQ ID NO: 840996 - DNA, 22 bp, Artificial Sequence
  chemically synthesized
accagagaaagaaaaatgtttc

SEQ ID NO: 840997 - DNA, 22 bp, Artificial Sequence
  chemically synthesized
ccagagaaagaaaaatgtttca

SEQ ID NO: 840998 - DNA, 22 bp, Artificial Sequence
  chemically synthesized
atatatgtatgtaatactatat

SEQ ID NO: 840999 - DNA, 22 bp, Artificial Sequence
  chemically synthesized
caatatagtattacatacatat

SEQ ID NO: 841000 - DNA, 22 bp, Artificial Sequence
  chemically synthesized
aatatagtattacatacatata

SEQ ID NO: 841001 - DNA, 22 bp, Artificial Sequence
  chemically synthesized
aataaagaaaaaatagttaata

SEQ ID NO: 841002 - DNA, 22 bp, Artificial Sequence
  chemically synthesized
catacatatattaactattttt

SEQ ID NO: 841003 - DNA, 22 bp, Artificial Sequence
  chemically synthesized
aaaaagaaatcagctaaataaa

SEQ ID NO: 841004 - DNA, 22 bp, Artificial Sequence
  chemically synthesized
actattttttctttatttagct

SEQ ID NO: 841005 - DNA, 22 bp, Artificial Sequence
  chemically synthesized
ttttttctttatttagctgatt

SEQ ID NO: 841006 - DNA, 22 bp, Artificial Sequence
  chemically synthesized
tttctttatttagctgatttct

SEQ ID NO: 841007 - DNA, 22 bp, Artificial Sequence
  chemically synthesized
ttctttatttagctgatttctt

SEQ ID NO: 841008 - DNA, 22 bp, Artificial Sequence
  chemically synthesized
gaaatgctcaaaaagaaatcag

SEQ ID NO: 841009 - DNA, 22 bp, Artificial Sequence
  chemically synthesized
tctttatttagctgatttcttt

SEQ ID NO: 841010 - DNA, 22 bp, Artificial Sequence
  chemically synthesized
ctttatttagctgatttctttt

SEQ ID NO: 841011 - DNA, 22 bp, Artificial Sequence
  chemically synthesized
tagaaatgctcaaaaagaaatc

SEQ ID NO: 841012 - DNA, 22 bp, Artificial Sequence
  chemically synthesized
tttatttagctgatttcttttt

SEQ ID NO: 841013 - DNA, 22 bp, Artificial Sequence
  chemically synthesized
ctagaaatgctcaaaaagaaat

SEQ ID NO: 841014 - DNA, 22 bp, Artificial Sequence
  chemically synthesized
tatttagctgatttctttttga

SEQ ID NO: 841015 - DNA, 22 bp, Artificial Sequence
  chemically synthesized
atttagctgatttctttttgag

SEQ ID NO: 841016 - DNA, 22 bp, Artificial Sequence
  chemically synthesized
tttagctgatttctttttgagc

SEQ ID NO: 841017 - DNA, 22 bp, Artificial Sequence
  chemically synthesized
agctgatttctttttgagcatt

SEQ ID NO: 841018 - DNA, 22 bp, Artificial Sequence
  chemically synthesized
gctgatttctttttgagcattt

SEQ ID NO: 841019 - DNA, 22 bp, Artificial Sequence
  chemically synthesized
ccatgaaacttctagaaatgct

SEQ ID NO: 841020 - DNA, 22 bp, Artificial Sequence
  chemically synthesized
atttctttttgagcatttctag

SEQ ID NO: 841021 - DNA, 22 bp, Artificial Sequence
  chemically synthesized
ttgccatgaaacttctagaaat

SEQ ID NO: 841022 - DNA, 22 bp, Artificial Sequence
  chemically synthesized
attgccatgaaacttctagaaa

SEQ ID NO: 841023 - DNA, 22 bp, Artificial Sequence
  chemically synthesized
ctttttgagcatttctagaagt

SEQ ID NO: 841024 - DNA, 22 bp, Artificial Sequence
  chemically synthesized
tattgccatgaaacttctagaa

SEQ ID NO: 841025 - DNA, 22 bp, Artificial Sequence
  chemically synthesized
tttttgagcatttctagaagtt

SEQ ID NO: 841026 - DNA, 22 bp, Artificial Sequence
  chemically synthesized
ttattgccatgaaacttctaga

SEQ ID NO: 841027 - DNA, 22 bp, Artificial Sequence
  chemically synthesized
tttattgccatgaaacttctag

SEQ ID NO: 841028 - DNA, 22 bp, Artificial Sequence
  chemically synthesized
tttgagcatttctagaagtttc

SEQ ID NO: 841029 - DNA, 22 bp, Artificial Sequence
  chemically synthesized
ttgagcatttctagaagtttca

SEQ ID NO: 841030 - DNA, 22 bp, Artificial Sequence
  chemically synthesized
tgagcatttctagaagtttcat

SEQ ID NO: 841031 - DNA, 22 bp, Artificial Sequence
  chemically synthesized
ctttttattgccatgaaacttc

SEQ ID NO: 841032 - DNA, 22 bp, Artificial Sequence
  chemically synthesized
gagcatttctagaagtttcatg

SEQ ID NO: 841033 - DNA, 22 bp, Artificial Sequence
  chemically synthesized
cctttttattgccatgaaactt

SEQ ID NO: 841034 - DNA, 22 bp, Artificial Sequence
  chemically synthesized
agcatttctagaagtttcatgg

SEQ ID NO: 841035 - DNA, 22 bp, Artificial Sequence
  chemically synthesized
gtcttcctttttattgccatga

SEQ ID NO: 841036 - DNA, 22 bp, Artificial Sequence
  chemically synthesized
ggtcttcctttttattgccatg

SEQ ID NO: 841037 - DNA, 22 bp, Artificial Sequence
  chemically synthesized
tggtcttcctttttattgccat

SEQ ID NO: 841038 - DNA, 22 bp, Artificial Sequence
  chemically synthesized
ctagaagtttcatggcaataaa

SEQ ID NO: 841039 - DNA, 22 bp, Artificial Sequence
  chemically synthesized
tagaagtttcatggcaataaaa

SEQ ID NO: 841040 - DNA, 22 bp, Artificial Sequence
  chemically synthesized
gaagtttcatggcaataaaaag

SEQ ID NO: 841041 - DNA, 22 bp, Artificial Sequence
  chemically synthesized
atgattttggtcttccttttta

SEQ ID NO: 841042 - DNA, 22 bp, Artificial Sequence
  chemically synthesized
gatgattttggtcttccttttt

SEQ ID NO: 841043 - DNA, 22 bp, Artificial Sequence
  chemically synthesized
catggcaataaaaaggaagacc

SEQ ID NO: 841044 - DNA, 22 bp, Artificial Sequence
  chemically synthesized
atggcaataaaaaggaagacca

SEQ ID NO: 841045 - DNA, 22 bp, Artificial Sequence
  chemically synthesized
atttgatgattttggtcttcct

SEQ ID NO: 841046 - DNA, 22 bp, Artificial Sequence
  chemically synthesized
tcatttgatgattttggtcttc

SEQ ID NO: 841047 - DNA, 22 bp, Artificial Sequence
  chemically synthesized
ctcatttgatgattttggtctt

SEQ ID NO: 841048 - DNA, 22 bp, Artificial Sequence
  chemically synthesized
tctcatttgatgattttggtct

SEQ ID NO: 841049 - DNA, 22 bp, Artificial Sequence
  chemically synthesized
tattttctcatttgatgatttt

SEQ ID NO: 841050 - DNA, 22 bp, Artificial Sequence
  chemically synthesized
ataaaattgtattttctcattt

SEQ ID NO: 841051 - DNA, 22 bp, Artificial Sequence
  chemically synthesized
ctcataaaattgtattttctca

SEQ ID NO: 841052 - DNA, 22 bp, Artificial Sequence
  chemically synthesized
gctcataaaattgtattttctc

SEQ ID NO: 841053 - DNA, 22 bp, Artificial Sequence
  chemically synthesized
aggaaaaggacagaaataaaat

SEQ ID NO: 841054 - DNA, 22 bp, Artificial Sequence
  chemically synthesized
tatgagcaagtattttatttct

SEQ ID NO: 841055 - DNA, 22 bp, Artificial Sequence
  chemically synthesized
caggaaaaggacagaaataaaa

SEQ ID NO: 841056 - DNA, 22 bp, Artificial Sequence
  chemically synthesized
atgagcaagtattttatttctg

SEQ ID NO: 841057 - DNA, 22 bp, Artificial Sequence
  chemically synthesized
tcaggaaaaggacagaaataaa

SEQ ID NO: 841058 - DNA, 22 bp, Artificial Sequence
  chemically synthesized
tgagcaagtattttatttctgt

SEQ ID NO: 841059 - DNA, 22 bp, Artificial Sequence
  chemically synthesized
gttttcaggaaaaggacagaaa

SEQ ID NO: 841060 - DNA, 22 bp, Artificial Sequence
  chemically synthesized
ggttttcaggaaaaggacagaa

SEQ ID NO: 841061 - DNA, 22 bp, Artificial Sequence
  chemically synthesized
tatttctgtccttttcctgaaa

SEQ ID NO: 841062 - DNA, 22 bp, Artificial Sequence
  chemically synthesized
atttctgtccttttcctgaaaa

SEQ ID NO: 841063 - DNA, 22 bp, Artificial Sequence
  chemically synthesized
gtaaagatttggttttcaggaa

SEQ ID NO: 841064 - DNA, 22 bp, Artificial Sequence
  chemically synthesized
tttctgtccttttcctgaaaac

SEQ ID NO: 841065 - DNA, 22 bp, Artificial Sequence
  chemically synthesized
agtaaagatttggttttcagga

SEQ ID NO: 841066 - DNA, 22 bp, Artificial Sequence
  chemically synthesized
ttagtaaagatttggttttcag

SEQ ID NO: 841067 - DNA, 22 bp, Artificial Sequence
  chemically synthesized
ctgtccttttcctgaaaaccaa

SEQ ID NO: 841068 - DNA, 22 bp, Artificial Sequence
  chemically synthesized
cttagtaaagatttggttttca

SEQ ID NO: 841069 - DNA, 22 bp, Artificial Sequence
  chemically synthesized
tgtccttttcctgaaaaccaaa

SEQ ID NO: 841070 - DNA, 22 bp, Artificial Sequence
  chemically synthesized
tcttagtaaagatttggttttc

SEQ ID NO: 841071 - DNA, 22 bp, Artificial Sequence
  chemically synthesized
ttcttagtaaagatttggtttt

SEQ ID NO: 841072 - DNA, 22 bp, Artificial Sequence
  chemically synthesized
tccttttcctgaaaaccaaatc

SEQ ID NO: 841073 - DNA, 22 bp, Artificial Sequence
  chemically synthesized
ttcctgaaaaccaaatctttac

SEQ ID NO: 841074 - DNA, 22 bp, Artificial Sequence
  chemically synthesized
tcctgaaaaccaaatctttact

SEQ ID NO: 841075 - DNA, 22 bp, Artificial Sequence
  chemically synthesized
cctgaaaaccaaatctttacta

SEQ ID NO: 841076 - DNA, 22 bp, Artificial Sequence
  chemically synthesized
ctgaaaaccaaatctttactaa

SEQ ID NO: 841077 - DNA, 22 bp, Artificial Sequence
  chemically synthesized
aaaaccaaatctttactaagaa

SEQ ID NO: 841078 - DNA, 22 bp, Artificial Sequence
  chemically synthesized
aaaatagaatttttcttagtaa

SEQ ID NO: 841079 - DNA, 22 bp, Artificial Sequence
  chemically synthesized
gatcgtgttcaaaatagaattt

SEQ ID NO: 841080 - DNA, 22 bp, Artificial Sequence
  chemically synthesized
cgatcgtgttcaaaatagaatt

SEQ ID NO: 841081 - DNA, 22 bp, Artificial Sequence
  chemically synthesized
tcgatcgtgttcaaaatagaat

SEQ ID NO: 841082 - DNA, 22 bp, Artificial Sequence
  chemically synthesized
tactaagaaaaattctattttg

SEQ ID NO: 841083 - DNA, 22 bp, Artificial Sequence
  chemically synthesized
ttcgatcgtgttcaaaatagaa

SEQ ID NO: 841084 - DNA, 22 bp, Artificial Sequence
  chemically synthesized
actaagaaaaattctattttga

SEQ ID NO: 841085 - DNA, 22 bp, Artificial Sequence
  chemically synthesized
ctaagaaaaattctattttgaa

SEQ ID NO: 841086 - DNA, 22 bp, Artificial Sequence
  chemically synthesized
agaaaaattctattttgaacac

SEQ ID NO: 841087 - DNA, 22 bp, Artificial Sequence
  chemically synthesized
ataaacttttcgatcgtgttca

SEQ ID NO: 841088 - DNA, 22 bp, Artificial Sequence
  chemically synthesized
tattttgaacacgatcgaaaag

SEQ ID NO: 841089 - DNA, 22 bp, Artificial Sequence
  chemically synthesized
aatactcataaacttttcgatc

SEQ ID NO: 841090 - DNA, 22 bp, Artificial Sequence
  chemically synthesized
ttttgaacacgatcgaaaagtt

SEQ ID NO: 841091 - DNA, 22 bp, Artificial Sequence
  chemically synthesized
tgaacacgatcgaaaagtttat

SEQ ID NO: 841092 - DNA, 22 bp, Artificial Sequence
  chemically synthesized
gaacacgatcgaaaagtttatg

SEQ ID NO: 841093 - DNA, 22 bp, Artificial Sequence
  chemically synthesized
aacacgatcgaaaagtttatga

SEQ ID NO: 841094 - DNA, 22 bp, Artificial Sequence
  chemically synthesized
taaaatgggatggaaattcaat

SEQ ID NO: 841095 - DNA, 22 bp, Artificial Sequence
  chemically synthesized
atgagtattgaatttccatccc

SEQ ID NO: 841096 - DNA, 22 bp, Artificial Sequence
  chemically synthesized
tgagtattgaatttccatccca

SEQ ID NO: 841097 - DNA, 22 bp, Artificial Sequence
  chemically synthesized
aaatctataaaatgggatggaa

SEQ ID NO: 841098 - DNA, 22 bp, Artificial Sequence
  chemically synthesized
gaaatctataaaatgggatgga

SEQ ID NO: 841099 - DNA, 22 bp, Artificial Sequence
  chemically synthesized
tgaaatctataaaatgggatgg

SEQ ID NO: 841100 - DNA, 22 bp, Artificial Sequence
  chemically synthesized
cctttgaaatctataaaatggg

SEQ ID NO: 841101 - DNA, 22 bp, Artificial Sequence
  chemically synthesized
tccctttgaaatctataaaatg

SEQ ID NO: 841102 - DNA, 22 bp, Artificial Sequence
  chemically synthesized
aatttccatcccattttataga

SEQ ID NO: 841103 - DNA, 22 bp, Artificial Sequence
  chemically synthesized
tctctccctttgaaatctataa

SEQ ID NO: 841104 - DNA, 22 bp, Artificial Sequence
  chemically synthesized
atctctccctttgaaatctata

SEQ ID NO: 841105 - DNA, 22 bp, Artificial Sequence
  chemically synthesized
ccatcccattttatagatttca

SEQ ID NO: 841106 - DNA, 22 bp, Artificial Sequence
  chemically synthesized
catcccattttatagatttcaa

SEQ ID NO: 841107 - DNA, 22 bp, Artificial Sequence
  chemically synthesized
agtttatctctccctttgaaat

SEQ ID NO: 841108 - DNA, 22 bp, Artificial Sequence
  chemically synthesized
cagtttatctctccctttgaaa

SEQ ID NO: 841109 - DNA, 22 bp, Artificial Sequence
  chemically synthesized
cacttcagtttatctctccctt

SEQ ID NO: 841110 - DNA, 22 bp, Artificial Sequence
  chemically synthesized
tatagatttcaaagggagagat

SEQ ID NO: 841111 - DNA, 22 bp, Artificial Sequence
  chemically synthesized
atagatttcaaagggagagata

SEQ ID NO: 841112 - DNA, 22 bp, Artificial Sequence
  chemically synthesized
tagatttcaaagggagagataa

SEQ ID NO: 841113 - DNA, 22 bp, Artificial Sequence
  chemically synthesized
ctacacttcagtttatctctcc

SEQ ID NO: 841114 - DNA, 22 bp, Artificial Sequence
  chemically synthesized
caaagggagagataaactgaag

SEQ ID NO: 841115 - DNA, 22 bp, Artificial Sequence
  chemically synthesized
aaagggagagataaactgaagt

SEQ ID NO: 841116 - DNA, 22 bp, Artificial Sequence
  chemically synthesized
cagccctgctacacttcagttt

SEQ ID NO: 841117 - DNA, 22 bp, Artificial Sequence
  chemically synthesized
gcagccctgctacacttcagtt

SEQ ID NO: 841118 - DNA, 22 bp, Artificial Sequence
  chemically synthesized
aacaatgtcatttgcagccctg

SEQ ID NO: 841119 - DNA, 22 bp, Artificial Sequence
  chemically synthesized
aagtgtagcagggctgcaaatg

SEQ ID NO: 841120 - DNA, 22 bp, Artificial Sequence
  chemically synthesized
tctaaacaatgtcatttgcagc

SEQ ID NO: 841121 - DNA, 22 bp, Artificial Sequence
  chemically synthesized
atctaaacaatgtcatttgcag

SEQ ID NO: 841122 - DNA, 22 bp, Artificial Sequence
  chemically synthesized
acaagatatgtttatctaaaca

SEQ ID NO: 841123 - DNA, 22 bp, Artificial Sequence
  chemically synthesized
caaatgacattgtttagataaa

SEQ ID NO: 841124 - DNA, 22 bp, Artificial Sequence
  chemically synthesized
tgacaagatatgtttatctaaa

SEQ ID NO: 841125 - DNA, 22 bp, Artificial Sequence
  chemically synthesized
tttagataaacatatcttgtca

SEQ ID NO: 841126 - DNA, 22 bp, Artificial Sequence
  chemically synthesized
agataaacatatcttgtcagaa

SEQ ID NO: 841127 - DNA, 22 bp, Artificial Sequence
  chemically synthesized
gataaacatatcttgtcagaat

SEQ ID NO: 841128 - DNA, 22 bp, Artificial Sequence
  chemically synthesized
aatggtaccaggataattctga

SEQ ID NO: 841129 - DNA, 22 bp, Artificial Sequence
  chemically synthesized
taaatggtaccaggataattct

SEQ ID NO: 841130 - DNA, 22 bp, Artificial Sequence
  chemically synthesized
gagcctctaaatggtaccagga

SEQ ID NO: 841131 - DNA, 22 bp, Artificial Sequence
  chemically synthesized
gtcagaattatcctggtaccat

SEQ ID NO: 841132 - DNA, 22 bp, Artificial Sequence
  chemically synthesized
tcagaattatcctggtaccatt

SEQ ID NO: 841133 - DNA, 22 bp, Artificial Sequence
  chemically synthesized
tcctggtaccatttagaggctc

SEQ ID NO: 841134 - DNA, 22 bp, Artificial Sequence
  chemically synthesized
caaatatgcctggagcctctaa

SEQ ID NO: 841135 - DNA, 22 bp, Artificial Sequence
  chemically synthesized
gttccaaatatgcctggagcct

SEQ ID NO: 841136 - DNA, 22 bp, Artificial Sequence
  chemically synthesized
gtaccatttagaggctccaggc

SEQ ID NO: 841137 - DNA, 22 bp, Artificial Sequence
  chemically synthesized
agttccaaatatgcctggagcc

SEQ ID NO: 841138 - DNA, 22 bp, Artificial Sequence
  chemically synthesized
gaatcttagttccaaatatgcc

SEQ ID NO: 841139 - DNA, 22 bp, Artificial Sequence
  chemically synthesized
agaggctccaggcatatttgga

SEQ ID NO: 841140 - DNA, 22 bp, Artificial Sequence
  chemically synthesized
gaggctccaggcatatttggaa

SEQ ID NO: 841141 - DNA, 22 bp, Artificial Sequence
  chemically synthesized
agctggaatcttagttccaaat

SEQ ID NO: 841142 - DNA, 22 bp, Artificial Sequence
  chemically synthesized
caggcatatttggaactaagat

SEQ ID NO: 841143 - DNA, 22 bp, Artificial Sequence
  chemically synthesized
agagtctaagctggaatcttag

SEQ ID NO: 841144 - DNA, 22 bp, Artificial Sequence
  chemically synthesized
ttaagagtctaagctggaatct

SEQ ID NO: 841145 - DNA, 22 bp, Artificial Sequence
  chemically synthesized
attaagagtctaagctggaatc

SEQ ID NO: 841146 - DNA, 22 bp, Artificial Sequence
  chemically synthesized
ggaactaagattccagcttaga

SEQ ID NO: 841147 - DNA, 22 bp, Artificial Sequence
  chemically synthesized
gaactaagattccagcttagac

SEQ ID NO: 841148 - DNA, 22 bp, Artificial Sequence
  chemically synthesized
agattccagcttagactcttaa

SEQ ID NO: 841149 - DNA, 22 bp, Artificial Sequence
  chemically synthesized
cagcttagactcttaataagcg

SEQ ID NO: 841150 - DNA, 22 bp, Artificial Sequence
  chemically synthesized
tcgagatgtgtcatagcgctta

SEQ ID NO: 841151 - DNA, 22 bp, Artificial Sequence
  chemically synthesized
agactcttaataagcgctatga

SEQ ID NO: 841152 - DNA, 22 bp, Artificial Sequence
  chemically synthesized
gactcttaataagcgctatgac

SEQ ID NO: 841153 - DNA, 22 bp, Artificial Sequence
  chemically synthesized
ttaataagcgctatgacacatc

SEQ ID NO: 841154 - DNA, 22 bp, Artificial Sequence
  chemically synthesized
aataagcgctatgacacatctc

SEQ ID NO: 841155 - DNA, 22 bp, Artificial Sequence
  chemically synthesized
ataagcgctatgacacatctcg

SEQ ID NO: 841156 - DNA, 22 bp, Artificial Sequence
  chemically synthesized
aaagcaagtgtctgtcgagatg

SEQ ID NO: 841157 - DNA, 22 bp, Artificial Sequence
  chemically synthesized
aaaagcaagtgtctgtcgagat

SEQ ID NO: 841158 - DNA, 22 bp, Artificial Sequence
  chemically synthesized
ttaaaagcaagtgtctgtcgag

SEQ ID NO: 841159 - DNA, 22 bp, Artificial Sequence
  chemically synthesized
cttaaaagcaagtgtctgtcga

SEQ ID NO: 841160 - DNA, 22 bp, Artificial Sequence
  chemically synthesized
tcttaaaagcaagtgtctgtcg

SEQ ID NO: 841161 - DNA, 22 bp, Artificial Sequence
  chemically synthesized
tgacacatctcgacagacactt

SEQ ID NO: 841162 - DNA, 22 bp, Artificial Sequence
  chemically synthesized
gacagacacttgcttttaagaa

SEQ ID NO: 841163 - DNA, 22 bp, Artificial Sequence
  chemically synthesized
gcttttaagaaaatgctttctt

SEQ ID NO: 841164 - DNA, 22 bp, Artificial Sequence
  chemically synthesized
cttttaagaaaatgctttcttg

SEQ ID NO: 841165 - DNA, 22 bp, Artificial Sequence
  chemically synthesized
taatccaaatggtccaagaaag

SEQ ID NO: 841166 - DNA, 22 bp, Artificial Sequence
  chemically synthesized
ttaagaaaatgctttcttggac

SEQ ID NO: 841167 - DNA, 22 bp, Artificial Sequence
  chemically synthesized
taagaaaatgctttcttggacc

SEQ ID NO: 841168 - DNA, 22 bp, Artificial Sequence
  chemically synthesized
aagaaaatgctttcttggacca

SEQ ID NO: 841169 - DNA, 22 bp, Artificial Sequence
  chemically synthesized
agaaaatgctttcttggaccat

SEQ ID NO: 841170 - DNA, 22 bp, Artificial Sequence
  chemically synthesized
gtggaaaggctgtaatccaaat

SEQ ID NO: 841171 - DNA, 22 bp, Artificial Sequence
  chemically synthesized
tcttggaccatttggattacag

SEQ ID NO: 841172 - DNA, 22 bp, Artificial Sequence
  chemically synthesized
cttggaccatttggattacagc

SEQ ID NO: 841173 - DNA, 22 bp, Artificial Sequence
  chemically synthesized
ttggaccatttggattacagcc

SEQ ID NO: 841174 - DNA, 22 bp, Artificial Sequence
  chemically synthesized
ggaccatttggattacagcctt

SEQ ID NO: 841175 - DNA, 22 bp, Artificial Sequence
  chemically synthesized
cagcctagtggaaaggctgtaa

SEQ ID NO: 841176 - DNA, 22 bp, Artificial Sequence
  chemically synthesized
gaccatttggattacagccttt

SEQ ID NO: 841177 - DNA, 22 bp, Artificial Sequence
  chemically synthesized
gcagcctagtggaaaggctgta

SEQ ID NO: 841178 - DNA, 22 bp, Artificial Sequence
  chemically synthesized
ggattacagcctttccactagg

SEQ ID NO: 841179 - DNA, 22 bp, Artificial Sequence
  chemically synthesized
gattacagcctttccactaggc

SEQ ID NO: 841180 - DNA, 22 bp, Artificial Sequence
  chemically synthesized
tgaatatttgcagcctagtgga

SEQ ID NO: 841181 - DNA, 22 bp, Artificial Sequence
  chemically synthesized
atgaatatttgcagcctagtgg

SEQ ID NO: 841182 - DNA, 22 bp, Artificial Sequence
  chemically synthesized
tatgaatatttgcagcctagtg

SEQ ID NO: 841183 - DNA, 22 bp, Artificial Sequence
  chemically synthesized
cagcctttccactaggctgcaa

SEQ ID NO: 841184 - DNA, 22 bp, Artificial Sequence
  chemically synthesized
tccactaggctgcaaatattca

SEQ ID NO: 841185 - DNA, 22 bp, Artificial Sequence
  chemically synthesized
ccactaggctgcaaatattcat

SEQ ID NO: 841186 - DNA, 22 bp, Artificial Sequence
  chemically synthesized
cactaggctgcaaatattcata

SEQ ID NO: 841187 - DNA, 22 bp, Artificial Sequence
  chemically synthesized
ggaatgaatacctttatgaata

SEQ ID NO: 841188 - DNA, 22 bp, Artificial Sequence
  chemically synthesized
aggaatgaatacctttatgaat

SEQ ID NO: 841189 - DNA, 22 bp, Artificial Sequence
  chemically synthesized
taggaatgaatacctttatgaa

SEQ ID NO: 841190 - DNA, 22 bp, Artificial Sequence
  chemically synthesized
ggctgcaaatattcataaaggt

SEQ ID NO: 841191 - DNA, 22 bp, Artificial Sequence
  chemically synthesized
ttaggaatgaatacctttatga

SEQ ID NO: 841192 - DNA, 22 bp, Artificial Sequence
  chemically synthesized
tcttttaggaatgaataccttt

SEQ ID NO: 841193 - DNA, 22 bp, Artificial Sequence
  chemically synthesized
caaatattcataaaggtattca

SEQ ID NO: 841194 - DNA, 22 bp, Artificial Sequence
  chemically synthesized
gtcttttaggaatgaatacctt

SEQ ID NO: 841195 - DNA, 22 bp, Artificial Sequence
  chemically synthesized
tgtcttttaggaatgaatacct

SEQ ID NO: 841196 - DNA, 22 bp, Artificial Sequence
  chemically synthesized
ttgtcttttaggaatgaatacc

SEQ ID NO: 841197 - DNA, 22 bp, Artificial Sequence
  chemically synthesized
agcttttgtcttttaggaatga

SEQ ID NO: 841198 - DNA, 22 bp, Artificial Sequence
  chemically synthesized
ataaaggtattcattcctaaaa

SEQ ID NO: 841199 - DNA, 22 bp, Artificial Sequence
  chemically synthesized
taagcttttgtcttttaggaat

SEQ ID NO: 841200 - DNA, 22 bp, Artificial Sequence
  chemically synthesized
ctaagcttttgtcttttaggaa

SEQ ID NO: 841201 - DNA, 22 bp, Artificial Sequence
  chemically synthesized
tctaagcttttgtcttttagga

SEQ ID NO: 841202 - DNA, 22 bp, Artificial Sequence
  chemically synthesized
ttctaagcttttgtcttttagg

SEQ ID NO: 841203 - DNA, 22 bp, Artificial Sequence
  chemically synthesized
ttttctaagcttttgtctttta

SEQ ID NO: 841204 - DNA, 22 bp, Artificial Sequence
  chemically synthesized
cttttctaagcttttgtctttt

SEQ ID NO: 841205 - DNA, 22 bp, Artificial Sequence
  chemically synthesized
ttcttttctaagcttttgtctt

SEQ ID NO: 841206 - DNA, 22 bp, Artificial Sequence
  chemically synthesized
attcctaaaagacaaaagctta

SEQ ID NO: 841207 - DNA, 22 bp, Artificial Sequence
  chemically synthesized
ctaaaagacaaaagcttagaaa

SEQ ID NO: 841208 - DNA, 22 bp, Artificial Sequence
  chemically synthesized
aatagttcttcttttctaagct

SEQ ID NO: 841209 - DNA, 22 bp, Artificial Sequence
  chemically synthesized
gaatagttcttcttttctaagc

SEQ ID NO: 841210 - DNA, 22 bp, Artificial Sequence
  chemically synthesized
aaagacaaaagcttagaaaaga

SEQ ID NO: 841211 - DNA, 22 bp, Artificial Sequence
  chemically synthesized
agtgatttgaatagttcttctt

SEQ ID NO: 841212 - DNA, 22 bp, Artificial Sequence
  chemically synthesized
agaaaagaagaactattcaaat

SEQ ID NO: 841213 - DNA, 22 bp, Artificial Sequence
  chemically synthesized
gaaaagaagaactattcaaatc

SEQ ID NO: 841214 - DNA, 22 bp, Artificial Sequence
  chemically synthesized
ccaatattcagtgatttgaata

SEQ ID NO: 841215 - DNA, 22 bp, Artificial Sequence
  chemically synthesized
tgccaatattcagtgatttgaa

SEQ ID NO: 841216 - DNA, 22 bp, Artificial Sequence
  chemically synthesized
tctgccaatattcagtgatttg

SEQ ID NO: 841217 - DNA, 22 bp, Artificial Sequence
  chemically synthesized
tatctctctgccaatattcagt

SEQ ID NO: 841218 - DNA, 22 bp, Artificial Sequence
  chemically synthesized
gtatctctctgccaatattcag

SEQ ID NO: 841219 - DNA, 22 bp, Artificial Sequence
  chemically synthesized
ttcaaatcactgaatattggca

SEQ ID NO: 841220 - DNA, 22 bp, Artificial Sequence
  chemically synthesized
aaatcactgaatattggcagag

SEQ ID NO: 841221 - DNA, 22 bp, Artificial Sequence
  chemically synthesized
aatattggcagagagatacaaa

SEQ ID NO: 841222 - DNA, 22 bp, Artificial Sequence
  chemically synthesized
aatgaccggagggcaagtttgt

SEQ ID NO: 841223 - DNA, 22 bp, Artificial Sequence
  chemically synthesized
gcagagagatacaaacttgccc

SEQ ID NO: 841224 - DNA, 22 bp, Artificial Sequence
  chemically synthesized
aaattgaatgaccggagggcaa

SEQ ID NO: 841225 - DNA, 22 bp, Artificial Sequence
  chemically synthesized
atgatagagattaaaattgaat

SEQ ID NO: 841226 - DNA, 22 bp, Artificial Sequence
  chemically synthesized
gccctccggtcattcaatttta

SEQ ID NO: 841227 - DNA, 22 bp, Artificial Sequence
  chemically synthesized
catgatagagattaaaattgaa

SEQ ID NO: 841228 - DNA, 22 bp, Artificial Sequence
  chemically synthesized
ccctccggtcattcaattttaa

SEQ ID NO: 841229 - DNA, 22 bp, Artificial Sequence
  chemically synthesized
tcatgatagagattaaaattga

SEQ ID NO: 841230 - DNA, 22 bp, Artificial Sequence
  chemically synthesized
ttcatgatagagattaaaattg

SEQ ID NO: 841231 - DNA, 22 bp, Artificial Sequence
  chemically synthesized
tttcatgatagagattaaaatt

SEQ ID NO: 841232 - DNA, 22 bp, Artificial Sequence
  chemically synthesized
cggtcattcaattttaatctct

SEQ ID NO: 841233 - DNA, 22 bp, Artificial Sequence
  chemically synthesized
actttttcatgatagagattaa

SEQ ID NO: 841234 - DNA, 22 bp, Artificial Sequence
  chemically synthesized
cattgactttttcatgatagag

SEQ ID NO: 841235 - DNA, 22 bp, Artificial Sequence
  chemically synthesized
aattttaatctctatcatgaaa

SEQ ID NO: 841236 - DNA, 22 bp, Artificial Sequence
  chemically synthesized
atattgcattgactttttcatg

SEQ ID NO: 841237 - DNA, 22 bp, Artificial Sequence
  chemically synthesized
catattgcattgactttttcat

SEQ ID NO: 841238 - DNA, 22 bp, Artificial Sequence
  chemically synthesized
taatctctatcatgaaaaagtc

SEQ ID NO: 841239 - DNA, 22 bp, Artificial Sequence
  chemically synthesized
tcatattgcattgactttttca

SEQ ID NO: 841240 - DNA, 22 bp, Artificial Sequence
  chemically synthesized
aatctctatcatgaaaaagtca

SEQ ID NO: 841241 - DNA, 22 bp, Artificial Sequence
  chemically synthesized
ttcatattgcattgactttttc

SEQ ID NO: 841242 - DNA, 22 bp, Artificial Sequence
  chemically synthesized
atctctatcatgaaaaagtcaa

SEQ ID NO: 841243 - DNA, 22 bp, Artificial Sequence
  chemically synthesized
tttcatattgcattgacttttt

SEQ ID NO: 841244 - DNA, 22 bp, Artificial Sequence
  chemically synthesized
ttttcatattgcattgactttt

SEQ ID NO: 841245 - DNA, 22 bp, Artificial Sequence
  chemically synthesized
tttttcatattgcattgacttt

SEQ ID NO: 841246 - DNA, 22 bp, Artificial Sequence
  chemically synthesized
ttttttcatattgcattgactt

SEQ ID NO: 841247 - DNA, 22 bp, Artificial Sequence
  chemically synthesized
tatcatgaaaaagtcaatgcaa

SEQ ID NO: 841248 - DNA, 22 bp, Artificial Sequence
  chemically synthesized
tcatgaaaaagtcaatgcaata

SEQ ID NO: 841249 - DNA, 22 bp, Artificial Sequence
  chemically synthesized
catttttttttcatattgcatt

SEQ ID NO: 841250 - DNA, 22 bp, Artificial Sequence
  chemically synthesized
tcccctgcatttttttttcata

SEQ ID NO: 841251 - DNA, 22 bp, Artificial Sequence
  chemically synthesized
cattatcccctgcatttttttt

SEQ ID NO: 841252 - DNA, 22 bp, Artificial Sequence
  chemically synthesized
ccattatcccctgcattttttt

SEQ ID NO: 841253 - DNA, 22 bp, Artificial Sequence
  chemically synthesized
tccattatcccctgcatttttt

SEQ ID NO: 841254 - DNA, 22 bp, Artificial Sequence
  chemically synthesized
aacattttccattatcccctgc

SEQ ID NO: 841255 - DNA, 22 bp, Artificial Sequence
  chemically synthesized
tctgaacattttccattatccc

SEQ ID NO: 841256 - DNA, 22 bp, Artificial Sequence
  chemically synthesized
aacattgtctgaacattttcca

SEQ ID NO: 841257 - DNA, 22 bp, Artificial Sequence
  chemically synthesized
ttcaacattgtctgaacatttt

SEQ ID NO: 841258 - DNA, 22 bp, Artificial Sequence
  chemically synthesized
gttcaacattgtctgaacattt

SEQ ID NO: 841259 - DNA, 22 bp, Artificial Sequence
  chemically synthesized
tacagtatttgttcaacattgt

SEQ ID NO: 841260 - DNA, 22 bp, Artificial Sequence
  chemically synthesized
agacaatgttgaacaaatactg

SEQ ID NO: 841261 - DNA, 22 bp, Artificial Sequence
  chemically synthesized
aacaaatactgtataatacatt

SEQ ID NO: 841262 - DNA, 22 bp, Artificial Sequence
  chemically synthesized
agaggaagacaatatgaatgta

SEQ ID NO: 841263 - DNA, 22 bp, Artificial Sequence
  chemically synthesized
cctaagaggaagacaatatgaa

SEQ ID NO: 841264 - DNA, 22 bp, Artificial Sequence
  chemically synthesized
ccctaagaggaagacaatatga

SEQ ID NO: 841265 - DNA, 22 bp, Artificial Sequence
  chemically synthesized
tccctaagaggaagacaatatg

SEQ ID NO: 841266 - DNA, 22 bp, Artificial Sequence
  chemically synthesized
tataatacattcatattgtctt

SEQ ID NO: 841267 - DNA, 22 bp, Artificial Sequence
  chemically synthesized
ttccctaagaggaagacaatat

SEQ ID NO: 841268 - DNA, 22 bp, Artificial Sequence
  chemically synthesized
tttccctaagaggaagacaata

SEQ ID NO: 841269 - DNA, 22 bp, Artificial Sequence
  chemically synthesized
aattttttccctaagaggaaga

SEQ ID NO: 841270 - DNA, 22 bp, Artificial Sequence
  chemically synthesized
caattttttccctaagaggaag

SEQ ID NO: 841271 - DNA, 22 bp, Artificial Sequence
  chemically synthesized
atattgtcttcctcttagggaa

SEQ ID NO: 841272 - DNA, 22 bp, Artificial Sequence
  chemically synthesized
tcttcctcttagggaaaaaatt

SEQ ID NO: 841273 - DNA, 22 bp, Artificial Sequence
  chemically synthesized
atgaaaaatcacttcaattttt

SEQ ID NO: 841274 - DNA, 22 bp, Artificial Sequence
  chemically synthesized
cctcttagggaaaaaattgaag

SEQ ID NO: 841275 - DNA, 22 bp, Artificial Sequence
  chemically synthesized
ctcttagggaaaaaattgaagt

SEQ ID NO: 841276 - DNA, 22 bp, Artificial Sequence
  chemically synthesized
ctaatgaaaaatcacttcaatt

SEQ ID NO: 841277 - DNA, 22 bp, Artificial Sequence
  chemically synthesized
actaatgaaaaatcacttcaat

SEQ ID NO: 841278 - DNA, 22 bp, Artificial Sequence
  chemically synthesized
ttagggaaaaaattgaagtgat

SEQ ID NO: 841279 - DNA, 22 bp, Artificial Sequence
  chemically synthesized
tactaatgaaaaatcacttcaa

SEQ ID NO: 841280 - DNA, 22 bp, Artificial Sequence
  chemically synthesized
agggaaaaaattgaagtgattt

SEQ ID NO: 841281 - DNA, 22 bp, Artificial Sequence
  chemically synthesized
gggaaaaaattgaagtgatttt

SEQ ID NO: 841282 - DNA, 22 bp, Artificial Sequence
  chemically synthesized
ttttactaatgaaaaatcactt

SEQ ID NO: 841283 - DNA, 22 bp, Artificial Sequence
  chemically synthesized
ttattttactaatgaaaaatca

SEQ ID NO: 841284 - DNA, 22 bp, Artificial Sequence
  chemically synthesized
gttattttactaatgaaaaatc

SEQ ID NO: 841285 - DNA, 22 bp, Artificial Sequence
  chemically synthesized
aagtgatttttcattagtaaaa

SEQ ID NO: 841286 - DNA, 22 bp, Artificial Sequence
  chemically synthesized
tacagagagtcatttgttattt

SEQ ID NO: 841287 - DNA, 22 bp, Artificial Sequence
  chemically synthesized
ttcattagtaaaataacaaatg

SEQ ID NO: 841288 - DNA, 22 bp, Artificial Sequence
  chemically synthesized
tcattagtaaaataacaaatga

SEQ ID NO: 841289 - DNA, 22 bp, Artificial Sequence
  chemically synthesized
cattagtaaaataacaaatgac

SEQ ID NO: 841290 - DNA, 22 bp, Artificial Sequence
  chemically synthesized
attagtaaaataacaaatgact

SEQ ID NO: 841291 - DNA, 22 bp, Artificial Sequence
  chemically synthesized
gtaaaataacaaatgactctct

SEQ ID NO: 841292 - DNA, 22 bp, Artificial Sequence
  chemically synthesized
aacatactatacagagagtcat

SEQ ID NO: 841293 - DNA, 22 bp, Artificial Sequence
  chemically synthesized
tgcaaatctgaacatactatac

SEQ ID NO: 841294 - DNA, 22 bp, Artificial Sequence
  chemically synthesized
atgcaaatctgaacatactata

SEQ ID NO: 841295 - DNA, 22 bp, Artificial Sequence
  chemically synthesized
tctgtatagtatgttcagattt

SEQ ID NO: 841296 - DNA, 22 bp, Artificial Sequence
  chemically synthesized
tgtatagtatgttcagatttgc

SEQ ID NO: 841297 - DNA, 22 bp, Artificial Sequence
  chemically synthesized
tatagtatgttcagatttgcat

SEQ ID NO: 841298 - DNA, 22 bp, Artificial Sequence
  chemically synthesized
gcagtgaggtttatgcaaatct

SEQ ID NO: 841299 - DNA, 22 bp, Artificial Sequence
  chemically synthesized
ggcagtgaggtttatgcaaatc

SEQ ID NO: 841300 - DNA, 22 bp, Artificial Sequence
  chemically synthesized
agatttgcataaacctcactgc

SEQ ID NO: 841301 - DNA, 22 bp, Artificial Sequence
  chemically synthesized
agaaatatggaaatttggcagt

SEQ ID NO: 841302 - DNA, 22 bp, Artificial Sequence
  chemically synthesized
gcataaacctcactgccaaatt

SEQ ID NO: 841303 - DNA, 22 bp, Artificial Sequence
  chemically synthesized
cataaacctcactgccaaattt

SEQ ID NO: 841304 - DNA, 22 bp, Artificial Sequence
  chemically synthesized
cctgagaaatatggaaatttgg

SEQ ID NO: 841305 - DNA, 22 bp, Artificial Sequence
  chemically synthesized
gcctgagaaatatggaaatttg

SEQ ID NO: 841306 - DNA, 22 bp, Artificial Sequence
  chemically synthesized
ttgcctgagaaatatggaaatt

SEQ ID NO: 841307 - DNA, 22 bp, Artificial Sequence
  chemically synthesized
cttgcctgagaaatatggaaat

SEQ ID NO: 841308 - DNA, 22 bp, Artificial Sequence
  chemically synthesized
actgccaaatttccatatttct

SEQ ID NO: 841309 - DNA, 22 bp, Artificial Sequence
  chemically synthesized
ccaaatttccatatttctcagg

SEQ ID NO: 841310 - DNA, 22 bp, Artificial Sequence
  chemically synthesized
ccatatttctcaggcaagaaac

SEQ ID NO: 841311 - DNA, 22 bp, Artificial Sequence
  chemically synthesized
catatttctcaggcaagaaact

SEQ ID NO: 841312 - DNA, 22 bp, Artificial Sequence
  chemically synthesized
cacaggtaagtgatcagtttct

SEQ ID NO: 841313 - DNA, 22 bp, Artificial Sequence
  chemically synthesized
ctcaggcaagaaactgatcact

SEQ ID NO: 841314 - DNA, 22 bp, Artificial Sequence
  chemically synthesized
tcaggcaagaaactgatcactt

SEQ ID NO: 841315 - DNA, 22 bp, Artificial Sequence
  chemically synthesized
ccattacacaggtaagtgatca

SEQ ID NO: 841316 - DNA, 22 bp, Artificial Sequence
  chemically synthesized
aggcaagaaactgatcacttac

SEQ ID NO: 841317 - DNA, 22 bp, Artificial Sequence
  chemically synthesized
aattcccattacacaggtaagt

SEQ ID NO: 841318 - DNA, 22 bp, Artificial Sequence
  chemically synthesized
atcacttacctgtgtaatggga

SEQ ID NO: 841319 - DNA, 22 bp, Artificial Sequence
  chemically synthesized
aatatgagactgaattcccatt

SEQ ID NO: 841320 - DNA, 22 bp, Artificial Sequence
  chemically synthesized
ctcaatatgagactgaattccc

SEQ ID NO: 841321 - DNA, 22 bp, Artificial Sequence
  chemically synthesized
acctgtgtaatgggaattcagt

SEQ ID NO: 841322 - DNA, 22 bp, Artificial Sequence
  chemically synthesized
actcaatatgagactgaattcc

SEQ ID NO: 841323 - DNA, 22 bp, Artificial Sequence
  chemically synthesized
cctgtgtaatgggaattcagtc

SEQ ID NO: 841324 - DNA, 22 bp, Artificial Sequence
  chemically synthesized
tgtaatgggaattcagtctcat

SEQ ID NO: 841325 - DNA, 22 bp, Artificial Sequence
  chemically synthesized
gtgagtgatttactcaatatga

SEQ ID NO: 841326 - DNA, 22 bp, Artificial Sequence
  chemically synthesized
agtgagtgatttactcaatatg

SEQ ID NO: 841327 - DNA, 22 bp, Artificial Sequence
  chemically synthesized
agtctcatattgagtaaatcac

SEQ ID NO: 841328 - DNA, 22 bp, Artificial Sequence
  chemically synthesized
atattgagtaaatcactcacta

SEQ ID NO: 841329 - DNA, 22 bp, Artificial Sequence
  chemically synthesized
agtaaatcactcactaagattc

SEQ ID NO: 841330 - DNA, 22 bp, Artificial Sequence
  chemically synthesized
acccaaaagagtgaatcttagt

SEQ ID NO: 841331 - DNA, 22 bp, Artificial Sequence
  chemically synthesized
caacacactgacccaaaagagt

SEQ ID NO: 841332 - DNA, 22 bp, Artificial Sequence
  chemically synthesized
actaagattcactcttttgggt

SEQ ID NO: 841333 - DNA, 22 bp, Artificial Sequence
  chemically synthesized
agattcactcttttgggtcagt

SEQ ID NO: 841334 - DNA, 22 bp, Artificial Sequence
  chemically synthesized
caacaagttgcaacacactgac

SEQ ID NO: 841335 - DNA, 22 bp, Artificial Sequence
  chemically synthesized
actcttttgggtcagtgtgttg

SEQ ID NO: 841336 - DNA, 22 bp, Artificial Sequence
  chemically synthesized
tccaacaagttgcaacacactg

SEQ ID NO: 841337 - DNA, 22 bp, Artificial Sequence
  chemically synthesized
ttttgggtcagtgtgttgcaac

SEQ ID NO: 841338 - DNA, 22 bp, Artificial Sequence
  chemically synthesized
ttgggtcagtgtgttgcaactt

SEQ ID NO: 841339 - DNA, 22 bp, Artificial Sequence
  chemically synthesized
tgggtcagtgtgttgcaacttg

SEQ ID NO: 841340 - DNA, 22 bp, Artificial Sequence
  chemically synthesized
agggttctccaacaagttgcaa

SEQ ID NO: 841341 - DNA, 22 bp, Artificial Sequence
  chemically synthesized
gggtcagtgtgttgcaacttgt

SEQ ID NO: 841342 - DNA, 22 bp, Artificial Sequence
  chemically synthesized
gagggttctccaacaagttgca

SEQ ID NO: 841343 - DNA, 22 bp, Artificial Sequence
  chemically synthesized
ggtcagtgtgttgcaacttgtt

SEQ ID NO: 841344 - DNA, 22 bp, Artificial Sequence
  chemically synthesized
gaaccttgagggttctccaaca

SEQ ID NO: 841345 - DNA, 22 bp, Artificial Sequence
  chemically synthesized
caacttgttggagaaccctcaa

SEQ ID NO: 841346 - DNA, 22 bp, Artificial Sequence
  chemically synthesized
caccatactggaaccttgaggg

SEQ ID NO: 841347 - DNA, 22 bp, Artificial Sequence
  chemically synthesized
gttggagaaccctcaaggttcc

SEQ ID NO: 841348 - DNA, 22 bp, Artificial Sequence
  chemically synthesized
ctccaccatactggaaccttga

SEQ ID NO: 841349 - DNA, 22 bp, Artificial Sequence
  chemically synthesized
ttggagaaccctcaaggttcca

SEQ ID NO: 841350 - DNA, 22 bp, Artificial Sequence
  chemically synthesized
gagaaccctcaaggttccagta

SEQ ID NO: 841351 - DNA, 22 bp, Artificial Sequence
  chemically synthesized
gcagagcattcctccaccatac

SEQ ID NO: 841352 - DNA, 22 bp, Artificial Sequence
  chemically synthesized
agcagagcattcctccaccata

SEQ ID NO: 841353 - DNA, 22 bp, Artificial Sequence
  chemically synthesized
aaggttccagtatggtggagga

SEQ ID NO: 841354 - DNA, 22 bp, Artificial Sequence
  chemically synthesized
atttagcagagcattcctccac

SEQ ID NO: 841355 - DNA, 22 bp, Artificial Sequence
  chemically synthesized
cagtatggtggaggaatgctct

SEQ ID NO: 841356 - DNA, 22 bp, Artificial Sequence
  chemically synthesized
gtaagatagccatacaattgat

SEQ ID NO: 841357 - DNA, 22 bp, Artificial Sequence
  chemically synthesized
ggtaagatagccatacaattga

SEQ ID NO: 841358 - DNA, 22 bp, Artificial Sequence
  chemically synthesized
tgctaaatcaattgtatggcta

SEQ ID NO: 841359 - DNA, 22 bp, Artificial Sequence
  chemically synthesized
ctaaatcaattgtatggctatc

SEQ ID NO: 841360 - DNA, 22 bp, Artificial Sequence
  chemically synthesized
aatcaattgtatggctatctta

SEQ ID NO: 841361 - DNA, 22 bp, Artificial Sequence
  chemically synthesized
ggaagaggaacagatttggtaa

SEQ ID NO: 841362 - DNA, 22 bp, Artificial Sequence
  chemically synthesized
tatggctatcttaccaaatctg

SEQ ID NO: 841363 - DNA, 22 bp, Artificial Sequence
  chemically synthesized
agcctaggaagaggaacagatt

SEQ ID NO: 841364 - DNA, 22 bp, Artificial Sequence
  chemically synthesized
ttgagcctaggaagaggaacag

SEQ ID NO: 841365 - DNA, 22 bp, Artificial Sequence
  chemically synthesized
tcttaccaaatctgttcctctt

SEQ ID NO: 841366 - DNA, 22 bp, Artificial Sequence
  chemically synthesized
accaaatctgttcctcttccta

SEQ ID NO: 841367 - DNA, 22 bp, Artificial Sequence
  chemically synthesized
ccaaatctgttcctcttcctag

SEQ ID NO: 841368 - DNA, 22 bp, Artificial Sequence
  chemically synthesized
ttcctcttcctaggctcaacag

SEQ ID NO: 841369 - DNA, 22 bp, Artificial Sequence
  chemically synthesized
ctcttcctaggctcaacagtgt

SEQ ID NO: 841370 - DNA, 22 bp, Artificial Sequence
  chemically synthesized
gggaaatagtgtacactgttga

SEQ ID NO: 841371 - DNA, 22 bp, Artificial Sequence
  chemically synthesized
ttcctaggctcaacagtgtaca

SEQ ID NO: 841372 - DNA, 22 bp, Artificial Sequence
  chemically synthesized
cctaggctcaacagtgtacact

SEQ ID NO: 841373 - DNA, 22 bp, Artificial Sequence
  chemically synthesized
ctaggctcaacagtgtacacta

SEQ ID NO: 841374 - DNA, 22 bp, Artificial Sequence
  chemically synthesized
ggctcaacagtgtacactattt

SEQ ID NO: 841375 - DNA, 22 bp, Artificial Sequence
  chemically synthesized
cgagggaattagggaaatagtg

SEQ ID NO: 841376 - DNA, 22 bp, Artificial Sequence
  chemically synthesized
aacagtgtacactatttcccta

SEQ ID NO: 841377 - DNA, 22 bp, Artificial Sequence
  chemically synthesized
actgcgagggaattagggaaat

SEQ ID NO: 841378 - DNA, 22 bp, Artificial Sequence
  chemically synthesized
tttccctaattccctcgcagtt

SEQ ID NO: 841379 - DNA, 22 bp, Artificial Sequence
  chemically synthesized
ccctaattccctcgcagttagg

SEQ ID NO: 841380 - DNA, 22 bp, Artificial Sequence
  chemically synthesized
cctaattccctcgcagttaggt

SEQ ID NO: 841381 - DNA, 22 bp, Artificial Sequence
  chemically synthesized
tcacatggtcacacctaactgc

SEQ ID NO: 841382 - DNA, 22 bp, Artificial Sequence
  chemically synthesized
gtcacatggtcacacctaactg

SEQ ID NO: 841383 - DNA, 22 bp, Artificial Sequence
  chemically synthesized
attccctcgcagttaggtgtga

SEQ ID NO: 841384 - DNA, 22 bp, Artificial Sequence
  chemically synthesized
cctcgcagttaggtgtgaccat

SEQ ID NO: 841385 - DNA, 22 bp, Artificial Sequence
  chemically synthesized
gatggatcttgtcacatggtca

SEQ ID NO: 841386 - DNA, 22 bp, Artificial Sequence
  chemically synthesized
gcagttaggtgtgaccatgtga

SEQ ID NO: 841387 - DNA, 22 bp, Artificial Sequence
  chemically synthesized
ttggatggatcttgtcacatgg

SEQ ID NO: 841388 - DNA, 22 bp, Artificial Sequence
  chemically synthesized
tgttggatggatcttgtcacat

SEQ ID NO: 841389 - DNA, 22 bp, Artificial Sequence
  chemically synthesized
ggtgtgaccatgtgacaagatc

SEQ ID NO: 841390 - DNA, 22 bp, Artificial Sequence
  chemically synthesized
atattctgttggatggatcttg

SEQ ID NO: 841391 - DNA, 22 bp, Artificial Sequence
  chemically synthesized
ttcatattctgttggatggatc

SEQ ID NO: 841392 - DNA, 22 bp, Artificial Sequence
  chemically synthesized
gttcatattctgttggatggat

SEQ ID NO: 841393 - DNA, 22 bp, Artificial Sequence
  chemically synthesized
tgttcatattctgttggatgga

SEQ ID NO: 841394 - DNA, 22 bp, Artificial Sequence
  chemically synthesized
attttgttcatattctgttgga

SEQ ID NO: 841395 - DNA, 22 bp, Artificial Sequence
  chemically synthesized
gaaatggtgtgtgttaattttg

SEQ ID NO: 841396 - DNA, 22 bp, Artificial Sequence
  chemically synthesized
tcatgagccacgcctggaaatg

SEQ ID NO: 841397 - DNA, 22 bp, Artificial Sequence
  chemically synthesized
gtcatgagccacgcctggaaat

SEQ ID NO: 841398 - DNA, 22 bp, Artificial Sequence
  chemically synthesized
acacacaccatttccaggcgtg

SEQ ID NO: 841399 - DNA, 22 bp, Artificial Sequence
  chemically synthesized
atgaaaatttgtcatgagccac

SEQ ID NO: 841400 - DNA, 22 bp, Artificial Sequence
  chemically synthesized
ctcatgaaaatttgtcatgagc

SEQ ID NO: 841401 - DNA, 22 bp, Artificial Sequence
  chemically synthesized
ccaggcgtggctcatgacaaat

SEQ ID NO: 841402 - DNA, 22 bp, Artificial Sequence
  chemically synthesized
caggcgtggctcatgacaaatt

SEQ ID NO: 841403 - DNA, 22 bp, Artificial Sequence
  chemically synthesized
atgacaaattttcatgagtaat

SEQ ID NO: 841404 - DNA, 22 bp, Artificial Sequence
  chemically synthesized
atgggcagatgaagaatgagta

SEQ ID NO: 841405 - DNA, 22 bp, Artificial Sequence
  chemically synthesized
aatgggcagatgaagaatgagt

SEQ ID NO: 841406 - DNA, 22 bp, Artificial Sequence
  chemically synthesized
tcatgagtaatactcattcttc

SEQ ID NO: 841407 - DNA, 22 bp, Artificial Sequence
  chemically synthesized
catgagtaatactcattcttca

SEQ ID NO: 841408 - DNA, 22 bp, Artificial Sequence
  chemically synthesized
atgagtaatactcattcttcat

SEQ ID NO: 841409 - DNA, 22 bp, Artificial Sequence
  chemically synthesized
atatgcatttaatgggcagatg

SEQ ID NO: 841410 - DNA, 22 bp, Artificial Sequence
  chemically synthesized
attcttcatctgcccattaaat

SEQ ID NO: 841411 - DNA, 22 bp, Artificial Sequence
  chemically synthesized
ttcatctgcccattaaatgcat

SEQ ID NO: 841412 - DNA, 22 bp, Artificial Sequence
  chemically synthesized
catctgcccattaaatgcatat

SEQ ID NO: 841413 - DNA, 22 bp, Artificial Sequence
  chemically synthesized
atctgcccattaaatgcatatg

SEQ ID NO: 841414 - DNA, 22 bp, Artificial Sequence
  chemically synthesized
cccattaaatgcatatgagtct

SEQ ID NO: 841415 - DNA, 22 bp, Artificial Sequence
  chemically synthesized
tgtccagagcataagactcata

SEQ ID NO: 841416 - DNA, 22 bp, Artificial Sequence
  chemically synthesized
gtgtccagagcataagactcat

SEQ ID NO: 841417 - DNA, 22 bp, Artificial Sequence
  chemically synthesized
tgtgtccagagcataagactca

SEQ ID NO: 841418 - DNA, 22 bp, Artificial Sequence
  chemically synthesized
ttgtgtccagagcataagactc

SEQ ID NO: 841419 - DNA, 22 bp, Artificial Sequence
  chemically synthesized
aatgcatatgagtcttatgctc

SEQ ID NO: 841420 - DNA, 22 bp, Artificial Sequence
  chemically synthesized
catcttttgtgtccagagcata

SEQ ID NO: 841421 - DNA, 22 bp, Artificial Sequence
  chemically synthesized
ccatcttttgtgtccagagcat

SEQ ID NO: 841422 - DNA, 22 bp, Artificial Sequence
  chemically synthesized
cttccatcttttgtgtccagag

SEQ ID NO: 841423 - DNA, 22 bp, Artificial Sequence
  chemically synthesized
atgctctggacacaaaagatgg

SEQ ID NO: 841424 - DNA, 22 bp, Artificial Sequence
  chemically synthesized
tgctctggacacaaaagatgga

SEQ ID NO: 841425 - DNA, 22 bp, Artificial Sequence
  chemically synthesized
aggaacccaagctccttccatc

SEQ ID NO: 841426 - DNA, 22 bp, Artificial Sequence
  chemically synthesized
tggacacaaaagatggaaggag

SEQ ID NO: 841427 - DNA, 22 bp, Artificial Sequence
  chemically synthesized
gacacaaaagatggaaggagct

SEQ ID NO: 841428 - DNA, 22 bp, Artificial Sequence
  chemically synthesized
tgaagtcattcaggaacccaag

SEQ ID NO: 841429 - DNA, 22 bp, Artificial Sequence
  chemically synthesized
tatgaagtcattcaggaaccca

SEQ ID NO: 841430 - DNA, 22 bp, Artificial Sequence
  chemically synthesized
gggttcctgaatgacttcatag

SEQ ID NO: 841431 - DNA, 22 bp, Artificial Sequence
  chemically synthesized
ggttcctgaatgacttcataga

SEQ ID NO: 841432 - DNA, 22 bp, Artificial Sequence
  chemically synthesized
ctgaatgacttcatagagggct

SEQ ID NO: 841433 - DNA, 22 bp, Artificial Sequence
  chemically synthesized
aatgacttcatagagggctgct

SEQ ID NO: 841434 - DNA, 22 bp, Artificial Sequence
  chemically synthesized
gtgcagtccaaaataagcagcc

SEQ ID NO: 841435 - DNA, 22 bp, Artificial Sequence
  chemically synthesized
agtgcagtccaaaataagcagc

SEQ ID NO: 841436 - DNA, 22 bp, Artificial Sequence
  chemically synthesized
tagtgcagtccaaaataagcag

SEQ ID NO: 841437 - DNA, 22 bp, Artificial Sequence
  chemically synthesized
catagagggctgcttattttgg

SEQ ID NO: 841438 - DNA, 22 bp, Artificial Sequence
  chemically synthesized
ttttagtgcagtccaaaataag

SEQ ID NO: 841439 - DNA, 22 bp, Artificial Sequence
  chemically synthesized
atagagggctgcttattttgga

SEQ ID NO: 841440 - DNA, 22 bp, Artificial Sequence
  chemically synthesized
attttagtgcagtccaaaataa

SEQ ID NO: 841441 - DNA, 22 bp, Artificial Sequence
  chemically synthesized
ttattttagtgcagtccaaaat

SEQ ID NO: 841442 - DNA, 22 bp, Artificial Sequence
  chemically synthesized
cttattttagtgcagtccaaaa

SEQ ID NO: 841443 - DNA, 22 bp, Artificial Sequence
  chemically synthesized
cttcttattttagtgcagtcca

SEQ ID NO: 841444 - DNA, 22 bp, Artificial Sequence
  chemically synthesized
acttcttattttagtgcagtcc

SEQ ID NO: 841445 - DNA, 22 bp, Artificial Sequence
  chemically synthesized
cttattttggactgcactaaaa

SEQ ID NO: 841446 - DNA, 22 bp, Artificial Sequence
  chemically synthesized
attttggactgcactaaaataa

SEQ ID NO: 841447 - DNA, 22 bp, Artificial Sequence
  chemically synthesized
ttttggactgcactaaaataag

SEQ ID NO: 841448 - DNA, 22 bp, Artificial Sequence
  chemically synthesized
tggactgcactaaaataagaag

SEQ ID NO: 841449 - DNA, 22 bp, Artificial Sequence
  chemically synthesized
ggactgcactaaaataagaagt

SEQ ID NO: 841450 - DNA, 22 bp, Artificial Sequence
  chemically synthesized
cagcagaaatttacttcttatt

SEQ ID NO: 841451 - DNA, 22 bp, Artificial Sequence
  chemically synthesized
gactgcactaaaataagaagta

SEQ ID NO: 841452 - DNA, 22 bp, Artificial Sequence
  chemically synthesized
ctacagcagaaatttacttctt

SEQ ID NO: 841453 - DNA, 22 bp, Artificial Sequence
  chemically synthesized
actacagcagaaatttacttct

SEQ ID NO: 841454 - DNA, 22 bp, Artificial Sequence
  chemically synthesized
cactaaaataagaagtaaattt

SEQ ID NO: 841455 - DNA, 22 bp, Artificial Sequence
  chemically synthesized
aaataagaagtaaatttctgct

SEQ ID NO: 841456 - DNA, 22 bp, Artificial Sequence
  chemically synthesized
gaggcttactacagcagaaatt

SEQ ID NO: 841457 - DNA, 22 bp, Artificial Sequence
  chemically synthesized
ggaggcttactacagcagaaat

SEQ ID NO: 841458 - DNA, 22 bp, Artificial Sequence
  chemically synthesized
ccaaatcttggaggcttactac

SEQ ID NO: 841459 - DNA, 22 bp, Artificial Sequence
  chemically synthesized
ctgctgtagtaagcctccaaga

SEQ ID NO: 841460 - DNA, 22 bp, Artificial Sequence
  chemically synthesized
tgctgtagtaagcctccaagat

SEQ ID NO: 841461 - DNA, 22 bp, Artificial Sequence
  chemically synthesized
ctgtagtaagcctccaagattt

SEQ ID NO: 841462 - DNA, 22 bp, Artificial Sequence
  chemically synthesized
tagtaagcctccaagatttggg

SEQ ID NO: 841463 - DNA, 22 bp, Artificial Sequence
  chemically synthesized
taacaggtaatctcccaaatct

SEQ ID NO: 841464 - DNA, 22 bp, Artificial Sequence
  chemically synthesized
gccactataacaggtaatctcc

SEQ ID NO: 841465 - DNA, 22 bp, Artificial Sequence
  chemically synthesized
caagatttgggagattacctgt

SEQ ID NO: 841466 - DNA, 22 bp, Artificial Sequence
  chemically synthesized
agtaacactagccactataaca

SEQ ID NO: 841467 - DNA, 22 bp, Artificial Sequence
  chemically synthesized
gggagattacctgttatagtgg

SEQ ID NO: 841468 - DNA, 22 bp, Artificial Sequence
  chemically synthesized
cagtaacactagccactataac

SEQ ID NO: 841469 - DNA, 22 bp, Artificial Sequence
  chemically synthesized
ggagattacctgttatagtggc

SEQ ID NO: 841470 - DNA, 22 bp, Artificial Sequence
  chemically synthesized
tttcagtaacactagccactat

SEQ ID NO: 841471 - DNA, 22 bp, Artificial Sequence
  chemically synthesized
cctgttatagtggctagtgtta

SEQ ID NO: 841472 - DNA, 22 bp, Artificial Sequence
  chemically synthesized
atgtattatttcagtaacacta

SEQ ID NO: 841473 - DNA, 22 bp, Artificial Sequence
  chemically synthesized
ttatagtggctagtgttactga

SEQ ID NO: 841474 - DNA, 22 bp, Artificial Sequence
  chemically synthesized
tagtggctagtgttactgaaat

SEQ ID NO: 841475 - DNA, 22 bp, Artificial Sequence
  chemically synthesized
gtgttactgaaataatacatta

SEQ ID NO: 841476 - DNA, 22 bp, Artificial Sequence
  chemically synthesized
ctgaaataatacattagcatac

SEQ ID NO: 841477 - DNA, 22 bp, Artificial Sequence
  chemically synthesized
aaataatacattagcatacatc

SEQ ID NO: 841478 - DNA, 22 bp, Artificial Sequence
  chemically synthesized
aacaatgaatgtggatgtatgc

SEQ ID NO: 841479 - DNA, 22 bp, Artificial Sequence
  chemically synthesized
aaacaatgaatgtggatgtatg

SEQ ID NO: 841480 - DNA, 22 bp, Artificial Sequence
  chemically synthesized
cttaaacaatgaatgtggatgt

SEQ ID NO: 841481 - DNA, 22 bp, Artificial Sequence
  chemically synthesized
ttgcttaaacaatgaatgtgga

SEQ ID NO: 841482 - DNA, 22 bp, Artificial Sequence
  chemically synthesized
ttgttgcttaaacaatgaatgt

SEQ ID NO: 841483 - DNA, 22 bp, Artificial Sequence
  chemically synthesized
attgttgcttaaacaatgaatg

SEQ ID NO: 841484 - DNA, 22 bp, Artificial Sequence
  chemically synthesized
gcatacatccacattcattgtt

SEQ ID NO: 841485 - DNA, 22 bp, Artificial Sequence
  chemically synthesized
tattgttgcttaaacaatgaat

SEQ ID NO: 841486 - DNA, 22 bp, Artificial Sequence
  chemically synthesized
tttattgttgcttaaacaatga

SEQ ID NO: 841487 - DNA, 22 bp, Artificial Sequence
  chemically synthesized
actctttattgttgcttaaaca

SEQ ID NO: 841488 - DNA, 22 bp, Artificial Sequence
  chemically synthesized
aactctttattgttgcttaaac

SEQ ID NO: 841489 - DNA, 22 bp, Artificial Sequence
  chemically synthesized
aaagtttaactctttattgttg

SEQ ID NO: 841490 - DNA, 22 bp, Artificial Sequence
  chemically synthesized
gaaagtttaactctttattgtt

SEQ ID NO: 841491 - DNA, 22 bp, Artificial Sequence
  chemically synthesized
attgtttaagcaacaataaaga

SEQ ID NO: 841492 - DNA, 22 bp, Artificial Sequence
  chemically synthesized
tgaaagtttaactctttattgt

SEQ ID NO: 841493 - DNA, 22 bp, Artificial Sequence
  chemically synthesized
tttaagcaacaataaagagtta

SEQ ID NO: 841494 - DNA, 22 bp, Artificial Sequence
  chemically synthesized
gttttgaaagtttaactcttta

SEQ ID NO: 841495 - DNA, 22 bp, Artificial Sequence
  chemically synthesized
ggttttgaaagtttaactcttt

SEQ ID NO: 841496 - DNA, 22 bp, Artificial Sequence
  chemically synthesized
aagcaacaataaagagttaaac

SEQ ID NO: 841497 - DNA, 22 bp, Artificial Sequence
  chemically synthesized
ttggttttgaaagtttaactct

SEQ ID NO: 841498 - DNA, 22 bp, Artificial Sequence
  chemically synthesized
agcaacaataaagagttaaact

SEQ ID NO: 841499 - DNA, 22 bp, Artificial Sequence
  chemically synthesized
ttcttggttttgaaagtttaac

SEQ ID NO: 841500 - DNA, 22 bp, Artificial Sequence
  chemically synthesized
aaataggctgttcttggttttg

SEQ ID NO: 841501 - DNA, 22 bp, Artificial Sequence
  chemically synthesized
attaaaataggctgttcttggt

SEQ ID NO: 841502 - DNA, 22 bp, Artificial Sequence
  chemically synthesized
aactttcaaaaccaagaacagc

SEQ ID NO: 841503 - DNA, 22 bp, Artificial Sequence
  chemically synthesized
ctaattaaaataggctgttctt

SEQ ID NO: 841504 - DNA, 22 bp, Artificial Sequence
  chemically synthesized
tcaaaaccaagaacagcctatt

SEQ ID NO: 841505 - DNA, 22 bp, Artificial Sequence
  chemically synthesized
caaaaccaagaacagcctattt

SEQ ID NO: 841506 - DNA, 22 bp, Artificial Sequence
  chemically synthesized
aaaaccaagaacagcctatttt

SEQ ID NO: 841507 - DNA, 22 bp, Artificial Sequence
  chemically synthesized
tagtgattgctaattaaaatag

SEQ ID NO: 841508 - DNA, 22 bp, Artificial Sequence
  chemically synthesized
agttgtagtgattgctaattaa

SEQ ID NO: 841509 - DNA, 22 bp, Artificial Sequence
  chemically synthesized
cagttgtagtgattgctaatta

SEQ ID NO: 841510 - DNA, 22 bp, Artificial Sequence
  chemically synthesized
tcagttgtagtgattgctaatt

SEQ ID NO: 841511 - DNA, 22 bp, Artificial Sequence
  chemically synthesized
tttcagttgtagtgattgctaa

SEQ ID NO: 841512 - DNA, 22 bp, Artificial Sequence
  chemically synthesized
ctttcagttgtagtgattgcta

SEQ ID NO: 841513 - DNA, 22 bp, Artificial Sequence
  chemically synthesized
ttttaattagcaatcactacaa

SEQ ID NO: 841514 - DNA, 22 bp, Artificial Sequence
  chemically synthesized
taattagcaatcactacaactg

SEQ ID NO: 841515 - DNA, 22 bp, Artificial Sequence
  chemically synthesized
aattagcaatcactacaactga

SEQ ID NO: 841516 - DNA, 22 bp, Artificial Sequence
  chemically synthesized
attagcaatcactacaactgaa

SEQ ID NO: 841517 - DNA, 22 bp, Artificial Sequence
  chemically synthesized
aagacatgtcttctttcagttg

SEQ ID NO: 841518 - DNA, 22 bp, Artificial Sequence
  chemically synthesized
gcaatcactacaactgaaagaa

SEQ ID NO: 841519 - DNA, 22 bp, Artificial Sequence
  chemically synthesized
ctaaagacatgtcttctttcag

SEQ ID NO: 841520 - DNA, 22 bp, Artificial Sequence
  chemically synthesized
cctaaagacatgtcttctttca

SEQ ID NO: 841521 - DNA, 22 bp, Artificial Sequence
  chemically synthesized
acttcctaaagacatgtcttct

SEQ ID NO: 841522 - DNA, 22 bp, Artificial Sequence
  chemically synthesized
caactgaaagaagacatgtctt

SEQ ID NO: 841523 - DNA, 22 bp, Artificial Sequence
  chemically synthesized
attcacttcctaaagacatgtc

SEQ ID NO: 841524 - DNA, 22 bp, Artificial Sequence
  chemically synthesized
gattcacttcctaaagacatgt

SEQ ID NO: 841525 - DNA, 22 bp, Artificial Sequence
  chemically synthesized
tgattcacttcctaaagacatg

SEQ ID NO: 841526 - DNA, 22 bp, Artificial Sequence
  chemically synthesized
aaagaagacatgtctttaggaa

SEQ ID NO: 841527 - DNA, 22 bp, Artificial Sequence
  chemically synthesized
tgtatgttttgattcacttcct

SEQ ID NO: 841528 - DNA, 22 bp, Artificial Sequence
  chemically synthesized
aaattatgtatgttttgattca

SEQ ID NO: 841529 - DNA, 22 bp, Artificial Sequence
  chemically synthesized
tctgaaattatgtatgttttga

SEQ ID NO: 841530 - DNA, 22 bp, Artificial Sequence
  chemically synthesized
taggaagtgaatcaaaacatac

SEQ ID NO: 841531 - DNA, 22 bp, Artificial Sequence
  chemically synthesized
gtctgaaattatgtatgttttg

SEQ ID NO: 841532 - DNA, 22 bp, Artificial Sequence
  chemically synthesized
aggaagtgaatcaaaacataca

SEQ ID NO: 841533 - DNA, 22 bp, Artificial Sequence
  chemically synthesized
tgtctgaaattatgtatgtttt

SEQ ID NO: 841534 - DNA, 22 bp, Artificial Sequence
  chemically synthesized
ggaagtgaatcaaaacatacat

SEQ ID NO: 841535 - DNA, 22 bp, Artificial Sequence
  chemically synthesized
ttgtctgaaattatgtatgttt

SEQ ID NO: 841536 - DNA, 22 bp, Artificial Sequence
  chemically synthesized
ttttgtctgaaattatgtatgt

SEQ ID NO: 841537 - DNA, 22 bp, Artificial Sequence
  chemically synthesized
cttttgtctgaaattatgtatg

SEQ ID NO: 841538 - DNA, 22 bp, Artificial Sequence
  chemically synthesized
aatacttcttttgtctgaaatt

SEQ ID NO: 841539 - DNA, 22 bp, Artificial Sequence
  chemically synthesized
agactaaatacttcttttgtct

SEQ ID NO: 841540 - DNA, 22 bp, Artificial Sequence
  chemically synthesized
tactaagactaaatacttcttt

SEQ ID NO: 841541 - DNA, 22 bp, Artificial Sequence
  chemically synthesized
cagacaaaagaagtatttagtc

SEQ ID NO: 841542 - DNA, 22 bp, Artificial Sequence
  chemically synthesized
agacaaaagaagtatttagtct

SEQ ID NO: 841543 - DNA, 22 bp, Artificial Sequence
  chemically synthesized
atcattgtactaagactaaata

SEQ ID NO: 841544 - DNA, 22 bp, Artificial Sequence
  chemically synthesized
aatcattgtactaagactaaat

SEQ ID NO: 841545 - DNA, 22 bp, Artificial Sequence
  chemically synthesized
atgaccttaatcattgtactaa

SEQ ID NO: 841546 - DNA, 22 bp, Artificial Sequence
  chemically synthesized
ttaatgaccttaatcattgtac

SEQ ID NO: 841547 - DNA, 22 bp, Artificial Sequence
  chemically synthesized
gttaatgaccttaatcattgta

SEQ ID NO: 841548 - DNA, 22 bp, Artificial Sequence
  chemically synthesized
tgttaatgaccttaatcattgt

SEQ ID NO: 841549 - DNA, 22 bp, Artificial Sequence
  chemically synthesized
ttgttaatgaccttaatcattg

SEQ ID NO: 841550 - DNA, 22 bp, Artificial Sequence
  chemically synthesized
agtcttagtacaatgattaagg

SEQ ID NO: 841551 - DNA, 22 bp, Artificial Sequence
  chemically synthesized
gtcttagtacaatgattaaggt

SEQ ID NO: 841552 - DNA, 22 bp, Artificial Sequence
  chemically synthesized
cttttgttaatgaccttaatca

SEQ ID NO: 841553 - DNA, 22 bp, Artificial Sequence
  chemically synthesized
ttgcttttgttaatgaccttaa

SEQ ID NO: 841554 - DNA, 22 bp, Artificial Sequence
  chemically synthesized
gttgcttttgttaatgacctta

SEQ ID NO: 841555 - DNA, 22 bp, Artificial Sequence
  chemically synthesized
agtacaatgattaaggtcatta

SEQ ID NO: 841556 - DNA, 22 bp, Artificial Sequence
  chemically synthesized
tgttgcttttgttaatgacctt

SEQ ID NO: 841557 - DNA, 22 bp, Artificial Sequence
  chemically synthesized
gtacaatgattaaggtcattaa

SEQ ID NO: 841558 - DNA, 22 bp, Artificial Sequence
  chemically synthesized
ttttgttgcttttgttaatgac

SEQ ID NO: 841559 - DNA, 22 bp, Artificial Sequence
  chemically synthesized
gttttgttgcttttgttaatga

SEQ ID NO: 841560 - DNA, 22 bp, Artificial Sequence
  chemically synthesized
ccatcttgttttgttgcttttg

SEQ ID NO: 841561 - DNA, 22 bp, Artificial Sequence
  chemically synthesized
cccatcttgttttgttgctttt

SEQ ID NO: 841562 - DNA, 22 bp, Artificial Sequence
  chemically synthesized
aggtcattaacaaaagcaacaa

SEQ ID NO: 841563 - DNA, 22 bp, Artificial Sequence
  chemically synthesized
ccatttcccatcttgttttgtt

SEQ ID NO: 841564 - DNA, 22 bp, Artificial Sequence
  chemically synthesized
accatttcccatcttgttttgt

SEQ ID NO: 841565 - DNA, 22 bp, Artificial Sequence
  chemically synthesized
acaaaagcaacaaaacaagatg

SEQ ID NO: 841566 - DNA, 22 bp, Artificial Sequence
  chemically synthesized
gtatgtttaccatttcccatct

SEQ ID NO: 841567 - DNA, 22 bp, Artificial Sequence
  chemically synthesized
tagtatgtttaccatttcccat

SEQ ID NO: 841568 - DNA, 22 bp, Artificial Sequence
  chemically synthesized
ctagtatgtttaccatttccca

SEQ ID NO: 841569 - DNA, 22 bp, Artificial Sequence
  chemically synthesized
tctagtatgtttaccatttccc

SEQ ID NO: 841570 - DNA, 22 bp, Artificial Sequence
  chemically synthesized
tttctagtatgtttaccatttc

SEQ ID NO: 841571 - DNA, 22 bp, Artificial Sequence
  chemically synthesized
cgctctttctagtatgtttacc

SEQ ID NO: 841572 - DNA, 22 bp, Artificial Sequence
  chemically synthesized
aaaatctgcgctctttctagta

SEQ ID NO: 841573 - DNA, 22 bp, Artificial Sequence
  chemically synthesized
gaaaatctgcgctctttctagt

SEQ ID NO: 841574 - DNA, 22 bp, Artificial Sequence
  chemically synthesized
acttgaaaatctgcgctctttc

SEQ ID NO: 841575 - DNA, 22 bp, Artificial Sequence
  chemically synthesized
tgacttgaaaatctgcgctctt

SEQ ID NO: 841576 - DNA, 22 bp, Artificial Sequence
  chemically synthesized
ctgacttgaaaatctgcgctct

SEQ ID NO: 841577 - DNA, 22 bp, Artificial Sequence
  chemically synthesized
tctgacttgaaaatctgcgctc

SEQ ID NO: 841578 - DNA, 22 bp, Artificial Sequence
  chemically synthesized
tttctgacttgaaaatctgcgc

SEQ ID NO: 841579 - DNA, 22 bp, Artificial Sequence
  chemically synthesized
gaaagagcgcagattttcaagt

SEQ ID NO: 841580 - DNA, 22 bp, Artificial Sequence
  chemically synthesized
taaatgtctctttctgacttga

SEQ ID NO: 841581 - DNA, 22 bp, Artificial Sequence
  chemically synthesized
gtaaatgtctctttctgacttg

SEQ ID NO: 841582 - DNA, 22 bp, Artificial Sequence
  chemically synthesized
gaatttgtaaatgtctctttct

SEQ ID NO: 841583 - DNA, 22 bp, Artificial Sequence
  chemically synthesized
ggaatttgtaaatgtctctttc

SEQ ID NO: 841584 - DNA, 22 bp, Artificial Sequence
  chemically synthesized
tcaagtcagaaagagacattta

SEQ ID NO: 841585 - DNA, 22 bp, Artificial Sequence
  chemically synthesized
caagtcagaaagagacatttac

SEQ ID NO: 841586 - DNA, 22 bp, Artificial Sequence
  chemically synthesized
aagtcagaaagagacatttaca

SEQ ID NO: 841587 - DNA, 22 bp, Artificial Sequence
  chemically synthesized
caaacaagcaaagaacagagct

SEQ ID NO: 841588 - DNA, 22 bp, Artificial Sequence
  chemically synthesized
acaaacaagcaaagaacagagc

SEQ ID NO: 841589 - DNA, 22 bp, Artificial Sequence
  chemically synthesized
acaaattccaagctctgttctt

SEQ ID NO: 841590 - DNA, 22 bp, Artificial Sequence
  chemically synthesized
caaattccaagctctgttcttt

SEQ ID NO: 841591 - DNA, 22 bp, Artificial Sequence
  chemically synthesized
cgtcgtttacaaacaagcaaag

SEQ ID NO: 841592 - DNA, 22 bp, Artificial Sequence
  chemically synthesized
caagctctgttctttgcttgtt

SEQ ID NO: 841593 - DNA, 22 bp, Artificial Sequence
  chemically synthesized
tgttctttgcttgtttgtaaac

SEQ ID NO: 841594 - DNA, 22 bp, Artificial Sequence
  chemically synthesized
ttctttgcttgtttgtaaacga

SEQ ID NO: 841595 - DNA, 22 bp, Artificial Sequence
  chemically synthesized
tttgcttgtttgtaaacgacgc

SEQ ID NO: 841596 - DNA, 22 bp, Artificial Sequence
  chemically synthesized
tgcttgtttgtaaacgacgcag

SEQ ID NO: 841597 - DNA, 22 bp, Artificial Sequence
  chemically synthesized
gcttgtttgtaaacgacgcagt

SEQ ID NO: 841598 - DNA, 22 bp, Artificial Sequence
  chemically synthesized
cttgtttgtaaacgacgcagtc

SEQ ID NO: 841599 - DNA, 22 bp, Artificial Sequence
  chemically synthesized
ggcgacagagcgagactgcgtc

SEQ ID NO: 841600 - DNA, 22 bp, Artificial Sequence
  chemically synthesized
gtttgtaaacgacgcagtctcg

SEQ ID NO: 841601 - DNA, 22 bp, Artificial Sequence
  chemically synthesized
tttgtaaacgacgcagtctcgc

SEQ ID NO: 841602 - DNA, 22 bp, Artificial Sequence
  chemically synthesized
gtaaacgacgcagtctcgctct

SEQ ID NO: 841603 - DNA, 22 bp, Artificial Sequence
  chemically synthesized
taaacgacgcagtctcgctctg

SEQ ID NO: 841604 - DNA, 22 bp, Artificial Sequence
  chemically synthesized
cagcctgggcgacagagcgaga

SEQ ID NO: 841605 - DNA, 22 bp, Artificial Sequence
  chemically synthesized
cactccagcctgggcgacagag

SEQ ID NO: 841606 - DNA, 22 bp, Artificial Sequence
  chemically synthesized
cgccactgcactccagcctggg

SEQ ID NO: 841607 - DNA, 22 bp, Artificial Sequence
  chemically synthesized
gctctgtcgcccaggctggagt

SEQ ID NO: 841608 - DNA, 22 bp, Artificial Sequence
  chemically synthesized
tgtcgcccaggctggagtgcag

SEQ ID NO: 841609 - DNA, 22 bp, Artificial Sequence
  chemically synthesized
tcgcccaggctggagtgcagtg

SEQ ID NO: 841610 - DNA, 22 bp, Artificial Sequence
  chemically synthesized
cagtgagccgagattgcgccac

SEQ ID NO: 841611 - DNA, 22 bp, Artificial Sequence
  chemically synthesized
gcagtgagccgagattgcgcca

SEQ ID NO: 841612 - DNA, 22 bp, Artificial Sequence
  chemically synthesized
gagtgcagtggcgcaatctcgg

SEQ ID NO: 841613 - DNA, 22 bp, Artificial Sequence
  chemically synthesized
ggctcactgcaagctccgcctc

SEQ ID NO: 841614 - DNA, 22 bp, Artificial Sequence
  chemically synthesized
actgcaagctccgcctcccggg

SEQ ID NO: 841615 - DNA, 22 bp, Artificial Sequence
  chemically synthesized
caagctccgcctcccgggttca

SEQ ID NO: 841616 - DNA, 22 bp, Artificial Sequence
  chemically synthesized
aggcaggagaatggcgtgaacc

SEQ ID NO: 841617 - DNA, 22 bp, Artificial Sequence
  chemically synthesized
cgcctcccgggttcacgccatt

SEQ ID NO: 841618 - DNA, 22 bp, Artificial Sequence
  chemically synthesized
ggaggctgaggcaggagaatgg

SEQ ID NO: 841619 - DNA, 22 bp, Artificial Sequence
  chemically synthesized
ccgggttcacgccattctcctg

SEQ ID NO: 841620 - DNA, 22 bp, Artificial Sequence
  chemically synthesized
gggaggctgaggcaggagaatg

SEQ ID NO: 841621 - DNA, 22 bp, Artificial Sequence
  chemically synthesized
cttgggaggctgaggcaggaga

SEQ ID NO: 841622 - DNA, 22 bp, Artificial Sequence
  chemically synthesized
acgccattctcctgcctcagcc

SEQ ID NO: 841623 - DNA, 22 bp, Artificial Sequence
  chemically synthesized
tagtcccagctacttgggaggc

SEQ ID NO: 841624 - DNA, 22 bp, Artificial Sequence
  chemically synthesized
tcctgcctcagcctcccaagta

SEQ ID NO: 841625 - DNA, 22 bp, Artificial Sequence
  chemically synthesized
ctgcctcagcctcccaagtagc

SEQ ID NO: 841626 - DNA, 22 bp, Artificial Sequence
  chemically synthesized
cctcagcctcccaagtagctgg

SEQ ID NO: 841627 - DNA, 22 bp, Artificial Sequence
  chemically synthesized
agcctcccaagtagctgggact

SEQ ID NO: 841628 - DNA, 22 bp, Artificial Sequence
  chemically synthesized
ccaagtagctgggactacaggc

SEQ ID NO: 841629 - DNA, 22 bp, Artificial Sequence
  chemically synthesized
gccgggcgtggtggcgggcgcc

SEQ ID NO: 841630 - DNA, 22 bp, Artificial Sequence
  chemically synthesized
ggactacaggcgcccgccacca

SEQ ID NO: 841631 - DNA, 22 bp, Artificial Sequence
  chemically synthesized
caggcgcccgccaccacgcccg

SEQ ID NO: 841632 - DNA, 22 bp, Artificial Sequence
  chemically synthesized
aaaatacaaaaaaaaattagcc

SEQ ID NO: 841633 - DNA, 22 bp, Artificial Sequence
  chemically synthesized
ctaaaaatacaaaaaaaaatta

SEQ ID NO: 841634 - DNA, 22 bp, Artificial Sequence
  chemically synthesized
tactaaaaatacaaaaaaaaat

SEQ ID NO: 841635 - DNA, 22 bp, Artificial Sequence
  chemically synthesized
atttttttttgtatttttagta

SEQ ID NO: 841636 - DNA, 22 bp, Artificial Sequence
  chemically synthesized
ttttttgtatttttagtagaga

SEQ ID NO: 841637 - DNA, 22 bp, Artificial Sequence
  chemically synthesized
tttttgtatttttagtagagac

SEQ ID NO: 841638 - DNA, 22 bp, Artificial Sequence
  chemically synthesized
ttttgtatttttagtagagacg

SEQ ID NO: 841639 - DNA, 22 bp, Artificial Sequence
  chemically synthesized
tttgtatttttagtagagacgg

SEQ ID NO: 841640 - DNA, 22 bp, Artificial Sequence
  chemically synthesized
ttgtatttttagtagagacggg

SEQ ID NO: 841641 - DNA, 22 bp, Artificial Sequence
  chemically synthesized
acacggtgaaaccccgtctcta

SEQ ID NO: 841642 - DNA, 22 bp, Artificial Sequence
  chemically synthesized
tgtatttttagtagagacgggg

SEQ ID NO: 841643 - DNA, 22 bp, Artificial Sequence
  chemically synthesized
gtatttttagtagagacggggt

SEQ ID NO: 841644 - DNA, 22 bp, Artificial Sequence
  chemically synthesized
tatttttagtagagacggggtt

SEQ ID NO: 841645 - DNA, 22 bp, Artificial Sequence
  chemically synthesized
gctaacacggtgaaaccccgtc

SEQ ID NO: 841646 - DNA, 22 bp, Artificial Sequence
  chemically synthesized
ttagtagagacggggtttcacc

SEQ ID NO: 841647 - DNA, 22 bp, Artificial Sequence
  chemically synthesized
tagtagagacggggtttcaccg

SEQ ID NO: 841648 - DNA, 22 bp, Artificial Sequence
  chemically synthesized
agtagagacggggtttcaccgt

SEQ ID NO: 841649 - DNA, 22 bp, Artificial Sequence
  chemically synthesized
gtagagacggggtttcaccgtg

SEQ ID NO: 841650 - DNA, 22 bp, Artificial Sequence
  chemically synthesized
caccgtgttagccaggatggtc

SEQ ID NO: 841651 - DNA, 22 bp, Artificial Sequence
  chemically synthesized
accgtgttagccaggatggtct

SEQ ID NO: 841652 - DNA, 22 bp, Artificial Sequence
  chemically synthesized
gccaggatggtctcgatctcct

SEQ ID NO: 841653 - DNA, 22 bp, Artificial Sequence
  chemically synthesized
gatctcctgacctcgtgatccg

SEQ ID NO: 841654 - DNA, 22 bp, Artificial Sequence
  chemically synthesized
gggaggccgaggcgggcggatc

SEQ ID NO: 841655 - DNA, 22 bp, Artificial Sequence
  chemically synthesized
ggggaggccgaggcgggcggat

SEQ ID NO: 841656 - DNA, 22 bp, Artificial Sequence
  chemically synthesized
ctgacctcgtgatccgcccgcc

SEQ ID NO: 841657 - DNA, 22 bp, Artificial Sequence
  chemically synthesized
acctcgtgatccgcccgcctcg

SEQ ID NO: 841658 - DNA, 22 bp, Artificial Sequence
  chemically synthesized
gtgatccgcccgcctcggcctc

SEQ ID NO: 841659 - DNA, 22 bp, Artificial Sequence
  chemically synthesized
taatcccagcacttggggaggc

SEQ ID NO: 841660 - DNA, 22 bp, Artificial Sequence
  chemically synthesized
acgcctgtaatcccagcacttg

SEQ ID NO: 841661 - DNA, 22 bp, Artificial Sequence
  chemically synthesized
ggcctccccaagtgctgggatt

SEQ ID NO: 841662 - DNA, 22 bp, Artificial Sequence
  chemically synthesized
cccaagtgctgggattacaggc

SEQ ID NO: 841663 - DNA, 22 bp, Artificial Sequence
  chemically synthesized
ggccgggcgcggtggctcacgc

SEQ ID NO: 841664 - DNA, 22 bp, Artificial Sequence
  chemically synthesized
ggattacaggcgtgagccaccg

SEQ ID NO: 841665 - DNA, 22 bp, Artificial Sequence
  chemically synthesized
ctcggccgggcgcggtggctca

SEQ ID NO: 841666 - DNA, 22 bp, Artificial Sequence
  chemically synthesized
caggcgtgagccaccgcgcccg

SEQ ID NO: 841667 - DNA, 22 bp, Artificial Sequence
  chemically synthesized
caagaacagttactcggccggg

SEQ ID NO: 841668 - DNA, 22 bp, Artificial Sequence
  chemically synthesized
tagacgagaaaacaggttccaa

SEQ ID NO: 841669 - DNA, 22 bp, Artificial Sequence
  chemically synthesized
atagacgagaaaacaggttcca

SEQ ID NO: 841670 - DNA, 22 bp, Artificial Sequence
  chemically synthesized
tatagacgagaaaacaggttcc

SEQ ID NO: 841671 - DNA, 22 bp, Artificial Sequence
  chemically synthesized
ttcttggaacctgttttctcgt

SEQ ID NO: 841672 - DNA, 22 bp, Artificial Sequence
  chemically synthesized
ttggaacctgttttctcgtcta

SEQ ID NO: 841673 - DNA, 22 bp, Artificial Sequence
  chemically synthesized
ggaacctgttttctcgtctata

SEQ ID NO: 841674 - DNA, 22 bp, Artificial Sequence
  chemically synthesized
taatccccattttatagacgag

SEQ ID NO: 841675 - DNA, 22 bp, Artificial Sequence
  chemically synthesized
gaacctgttttctcgtctataa

SEQ ID NO: 841676 - DNA, 22 bp, Artificial Sequence
  chemically synthesized
ataatccccattttatagacga

SEQ ID NO: 841677 - DNA, 22 bp, Artificial Sequence
  chemically synthesized
tataatccccattttatagacg

SEQ ID NO: 841678 - DNA, 22 bp, Artificial Sequence
  chemically synthesized
tattttataatccccattttat

SEQ ID NO: 841679 - DNA, 22 bp, Artificial Sequence
  chemically synthesized
ttttctcgtctataaaatgggg

SEQ ID NO: 841680 - DNA, 22 bp, Artificial Sequence
  chemically synthesized
tctcgtctataaaatggggatt

SEQ ID NO: 841681 - DNA, 22 bp, Artificial Sequence
  chemically synthesized
ctcgtctataaaatggggatta

SEQ ID NO: 841682 - DNA, 22 bp, Artificial Sequence
  chemically synthesized
tcgtctataaaatggggattat

SEQ ID NO: 841683 - DNA, 22 bp, Artificial Sequence
  chemically synthesized
tgagctatattttataatcccc

SEQ ID NO: 841684 - DNA, 22 bp, Artificial Sequence
  chemically synthesized
gtctataaaatggggattataa

SEQ ID NO: 841685 - DNA, 22 bp, Artificial Sequence
  chemically synthesized
gtgagctatattttataatccc

SEQ ID NO: 841686 - DNA, 22 bp, Artificial Sequence
  chemically synthesized
taaaatggggattataaaatat

SEQ ID NO: 841687 - DNA, 22 bp, Artificial Sequence
  chemically synthesized
cagaatcttgtgagctatattt

SEQ ID NO: 841688 - DNA, 22 bp, Artificial Sequence
  chemically synthesized
acagaatcttgtgagctatatt

SEQ ID NO: 841689 - DNA, 22 bp, Artificial Sequence
  chemically synthesized
tacagaatcttgtgagctatat

SEQ ID NO: 841690 - DNA, 22 bp, Artificial Sequence
  chemically synthesized
taaaatatagctcacaagattc

SEQ ID NO: 841691 - DNA, 22 bp, Artificial Sequence
  chemically synthesized
tgtgtgtgtacaaaatctttac

SEQ ID NO: 841692 - DNA, 22 bp, Artificial Sequence
  chemically synthesized
acaagattctgtaaagattttg

SEQ ID NO: 841693 - DNA, 22 bp, Artificial Sequence
  chemically synthesized
tgtgtgtgtgtacaaaatcttt

SEQ ID NO: 841694 - DNA, 22 bp, Artificial Sequence
  chemically synthesized
ctgtgtgtgtgtacaaaatctt

SEQ ID NO: 841695 - DNA, 22 bp, Artificial Sequence
  chemically synthesized
tgtgtttctgtgtgtgtgtaca

SEQ ID NO: 841696 - DNA, 22 bp, Artificial Sequence
  chemically synthesized
tgtaaagattttgtacacacac

SEQ ID NO: 841697 - DNA, 22 bp, Artificial Sequence
  chemically synthesized
tgtgtgtttctgtgtgtgtgta

SEQ ID NO: 841698 - DNA, 22 bp, Artificial Sequence
  chemically synthesized
taaagattttgtacacacacac

SEQ ID NO: 841699 - DNA, 22 bp, Artificial Sequence
  chemically synthesized
ctgtgtgtttctgtgtgtgtgt

SEQ ID NO: 841700 - DNA, 22 bp, Artificial Sequence
  chemically synthesized
tgtacacacacacagaaacaca

SEQ ID NO: 841701 - DNA, 22 bp, Artificial Sequence
  chemically synthesized
gtacacacacacagaaacacac

SEQ ID NO: 841702 - DNA, 22 bp, Artificial Sequence
  chemically synthesized
tacacacacacagaaacacaca

SEQ ID NO: 841703 - DNA, 22 bp, Artificial Sequence
  chemically synthesized
gatggtgtgtgcacatgtgtgt

SEQ ID NO: 841704 - DNA, 22 bp, Artificial Sequence
  chemically synthesized
ataagcattagatggtgtgtgc

SEQ ID NO: 841705 - DNA, 22 bp, Artificial Sequence
  chemically synthesized
agtacctcataagcattagatg

SEQ ID NO: 841706 - DNA, 22 bp, Artificial Sequence
  chemically synthesized
ttcagtacctcataagcattag

SEQ ID NO: 841707 - DNA, 22 bp, Artificial Sequence
  chemically synthesized
attcagtacctcataagcatta

SEQ ID NO: 841708 - DNA, 22 bp, Artificial Sequence
  chemically synthesized
gtatttattcagtacctcataa

SEQ ID NO: 841709 - DNA, 22 bp, Artificial Sequence
  chemically synthesized
atgcttatgaggtactgaataa

SEQ ID NO: 841710 - DNA, 22 bp, Artificial Sequence
  chemically synthesized
ataatagctagtatttattcag

SEQ ID NO: 841711 - DNA, 22 bp, Artificial Sequence
  chemically synthesized
ttgataatagctagtatttatt

SEQ ID NO: 841712 - DNA, 22 bp, Artificial Sequence
  chemically synthesized
atgaggtactgaataaatacta

SEQ ID NO: 841713 - DNA, 22 bp, Artificial Sequence
  chemically synthesized
attgataatagctagtatttat

SEQ ID NO: 841714 - DNA, 22 bp, Artificial Sequence
  chemically synthesized
tgaggtactgaataaatactag

SEQ ID NO: 841715 - DNA, 22 bp, Artificial Sequence
  chemically synthesized
aataaatactagctattatcaa

SEQ ID NO: 841716 - DNA, 22 bp, Artificial Sequence
  chemically synthesized
ggtaagtacttattgataatag

SEQ ID NO: 841717 - DNA, 22 bp, Artificial Sequence
  chemically synthesized
cacatattgggtaagtacttat

SEQ ID NO: 841718 - DNA, 22 bp, Artificial Sequence
  chemically synthesized
ccacatattgggtaagtactta

SEQ ID NO: 841719 - DNA, 22 bp, Artificial Sequence
  chemically synthesized
gctattatcaataagtacttac

SEQ ID NO: 841720 - DNA, 22 bp, Artificial Sequence
  chemically synthesized
ttatcaataagtacttacccaa

SEQ ID NO: 841721 - DNA, 22 bp, Artificial Sequence
  chemically synthesized
tcaataagtacttacccaatat

SEQ ID NO: 841722 - DNA, 22 bp, Artificial Sequence
  chemically synthesized
gtcatacttccacatattgggt

SEQ ID NO: 841723 - DNA, 22 bp, Artificial Sequence
  chemically synthesized
ttagtcatacttccacatattg

SEQ ID NO: 841724 - DNA, 22 bp, Artificial Sequence
  chemically synthesized
aaatattattagtcatacttcc

SEQ ID NO: 841725 - DNA, 22 bp, Artificial Sequence
  chemically synthesized
acccaatatgtggaagtatgac

SEQ ID NO: 841726 - DNA, 22 bp, Artificial Sequence
  chemically synthesized
aaaatattattagtcatacttc

SEQ ID NO: 841727 - DNA, 22 bp, Artificial Sequence
  chemically synthesized
cccaatatgtggaagtatgact

SEQ ID NO: 841728 - DNA, 22 bp, Artificial Sequence
  chemically synthesized
taaaatattattagtcatactt

SEQ ID NO: 841729 - DNA, 22 bp, Artificial Sequence
  chemically synthesized
atattttaaaatattattagtc

SEQ ID NO: 841730 - DNA, 22 bp, Artificial Sequence
  chemically synthesized
ataatattttaaaatattaacc

SEQ ID NO: 841731 - DNA, 22 bp, Artificial Sequence
  chemically synthesized
taaaatattaaccttttactct

SEQ ID NO: 841732 - DNA, 22 bp, Artificial Sequence
  chemically synthesized
aaaatattaaccttttactctg

SEQ ID NO: 841733 - DNA, 22 bp, Artificial Sequence
  chemically synthesized
aaatattaaccttttactctgg

SEQ ID NO: 841734 - DNA, 22 bp, Artificial Sequence
  chemically synthesized
gggaaagtgaaagagtaaccag

SEQ ID NO: 841735 - DNA, 22 bp, Artificial Sequence
  chemically synthesized
accttttactctggttactctt

SEQ ID NO: 841736 - DNA, 22 bp, Artificial Sequence
  chemically synthesized
ttactctggttactctttcact

SEQ ID NO: 841737 - DNA, 22 bp, Artificial Sequence
  chemically synthesized
tactctggttactctttcactt

SEQ ID NO: 841738 - DNA, 22 bp, Artificial Sequence
  chemically synthesized
actctggttactctttcacttt

SEQ ID NO: 841739 - DNA, 22 bp, Artificial Sequence
  chemically synthesized
ctctggttactctttcactttc

SEQ ID NO: 841740 - DNA, 22 bp, Artificial Sequence
  chemically synthesized
tcaatatgttggggaaagtgaa

SEQ ID NO: 841741 - DNA, 22 bp, Artificial Sequence
  chemically synthesized
tggttactctttcactttcccc

SEQ ID NO: 841742 - DNA, 22 bp, Artificial Sequence
  chemically synthesized
gttactctttcactttccccaa

SEQ ID NO: 841743 - DNA, 22 bp, Artificial Sequence
  chemically synthesized
gttgtcaatatgttggggaaag

SEQ ID NO: 841744 - DNA, 22 bp, Artificial Sequence
  chemically synthesized
ctctttcactttccccaacata

SEQ ID NO: 841745 - DNA, 22 bp, Artificial Sequence
  chemically synthesized
tttcactttccccaacatattg

SEQ ID NO: 841746 - DNA, 22 bp, Artificial Sequence
  chemically synthesized
tcactttccccaacatattgac

SEQ ID NO: 841747 - DNA, 22 bp, Artificial Sequence
  chemically synthesized
cactttccccaacatattgaca

SEQ ID NO: 841748 - DNA, 22 bp, Artificial Sequence
  chemically synthesized
actttccccaacatattgacaa

SEQ ID NO: 841749 - DNA, 22 bp, Artificial Sequence
  chemically synthesized
aggaaatgactagttgtcaata

SEQ ID NO: 841750 - DNA, 22 bp, Artificial Sequence
  chemically synthesized
tccccaacatattgacaactag

SEQ ID NO: 841751 - DNA, 22 bp, Artificial Sequence
  chemically synthesized
ccccaacatattgacaactagt

SEQ ID NO: 841752 - DNA, 22 bp, Artificial Sequence
  chemically synthesized
cctaaggaaatgactagttgtc

SEQ ID NO: 841753 - DNA, 22 bp, Artificial Sequence
  chemically synthesized
cccaacatattgacaactagtc

SEQ ID NO: 841754 - DNA, 22 bp, Artificial Sequence
  chemically synthesized
ccctaaggaaatgactagttgt

SEQ ID NO: 841755 - DNA, 22 bp, Artificial Sequence
  chemically synthesized
acccttccctaaggaaatgact

SEQ ID NO: 841756 - DNA, 22 bp, Artificial Sequence
  chemically synthesized
tgttaacccttccctaaggaaa

SEQ ID NO: 841757 - DNA, 22 bp, Artificial Sequence
  chemically synthesized
acaactagtcatttccttaggg

SEQ ID NO: 841758 - DNA, 22 bp, Artificial Sequence
  chemically synthesized
ctatgttaacccttccctaagg

SEQ ID NO: 841759 - DNA, 22 bp, Artificial Sequence
  chemically synthesized
tgctatgttaacccttccctaa

SEQ ID NO: 841760 - DNA, 22 bp, Artificial Sequence
  chemically synthesized
gtcatttccttagggaagggtt

SEQ ID NO: 841761 - DNA, 22 bp, Artificial Sequence
  chemically synthesized
tattctgctatgttaacccttc

SEQ ID NO: 841762 - DNA, 22 bp, Artificial Sequence
  chemically synthesized
atattctgctatgttaaccctt

SEQ ID NO: 841763 - DNA, 22 bp, Artificial Sequence
  chemically synthesized
ccttagggaagggttaacatag

SEQ ID NO: 841764 - DNA, 22 bp, Artificial Sequence
  chemically synthesized
cttagggaagggttaacatagc

SEQ ID NO: 841765 - DNA, 22 bp, Artificial Sequence
  chemically synthesized
ataatttatattctgctatgtt

SEQ ID NO: 841766 - DNA, 22 bp, Artificial Sequence
  chemically synthesized
agggaagggttaacatagcaga

SEQ ID NO: 841767 - DNA, 22 bp, Artificial Sequence
  chemically synthesized
cataatttatattctgctatgt

SEQ ID NO: 841768 - DNA, 22 bp, Artificial Sequence
  chemically synthesized
gggaagggttaacatagcagaa

SEQ ID NO: 841769 - DNA, 22 bp, Artificial Sequence
  chemically synthesized
tatcttcataatttatattctg

SEQ ID NO: 841770 - DNA, 22 bp, Artificial Sequence
  chemically synthesized
acatagcagaatataaattatg

SEQ ID NO: 841771 - DNA, 22 bp, Artificial Sequence
  chemically synthesized
ggaaaccatgagagtctatatc

SEQ ID NO: 841772 - DNA, 22 bp, Artificial Sequence
  chemically synthesized
aaactcggaaaccatgagagtc

SEQ ID NO: 841773 - DNA, 22 bp, Artificial Sequence
  chemically synthesized
caaactcggaaaccatgagagt

SEQ ID NO: 841774 - DNA, 22 bp, Artificial Sequence
  chemically synthesized
tgaagatatagactctcatggt

SEQ ID NO: 841775 - DNA, 22 bp, Artificial Sequence
  chemically synthesized
tcaaactcggaaaccatgagag

SEQ ID NO: 841776 - DNA, 22 bp, Artificial Sequence
  chemically synthesized
ttcaaactcggaaaccatgaga

SEQ ID NO: 841777 - DNA, 22 bp, Artificial Sequence
  chemically synthesized
gacttttcaaactcggaaacca

SEQ ID NO: 841778 - DNA, 22 bp, Artificial Sequence
  chemically synthesized
agacttttcaaactcggaaacc

SEQ ID NO: 841779 - DNA, 22 bp, Artificial Sequence
  chemically synthesized
tcatggtttccgagtttgaaaa

SEQ ID NO: 841780 - DNA, 22 bp, Artificial Sequence
  chemically synthesized
ccaggcttagacttttcaaact

SEQ ID NO: 841781 - DNA, 22 bp, Artificial Sequence
  chemically synthesized
accaggcttagacttttcaaac

SEQ ID NO: 841782 - DNA, 22 bp, Artificial Sequence
  chemically synthesized
atggtttccgagtttgaaaagt

SEQ ID NO: 841783 - DNA, 22 bp, Artificial Sequence
  chemically synthesized
taccaggcttagacttttcaaa

SEQ ID NO: 841784 - DNA, 22 bp, Artificial Sequence
  chemically synthesized
ttaccaggcttagacttttcaa

SEQ ID NO: 841785 - DNA, 22 bp, Artificial Sequence
  chemically synthesized
tcttttaccaggcttagacttt

SEQ ID NO: 841786 - DNA, 22 bp, Artificial Sequence
  chemically synthesized
gtcttttaccaggcttagactt

SEQ ID NO: 841787 - DNA, 22 bp, Artificial Sequence
  chemically synthesized
ccgagtttgaaaagtctaagcc

SEQ ID NO: 841788 - DNA, 22 bp, Artificial Sequence
  chemically synthesized
tgtcttttaccaggcttagact

SEQ ID NO: 841789 - DNA, 22 bp, Artificial Sequence
  chemically synthesized
cgagtttgaaaagtctaagcct

SEQ ID NO: 841790 - DNA, 22 bp, Artificial Sequence
  chemically synthesized
ttgtcttttaccaggcttagac

SEQ ID NO: 841791 - DNA, 22 bp, Artificial Sequence
  chemically synthesized
gaaaagtctaagcctggtaaaa

SEQ ID NO: 841792 - DNA, 22 bp, Artificial Sequence
  chemically synthesized
aaatcttttgtcttttaccagg

SEQ ID NO: 841793 - DNA, 22 bp, Artificial Sequence
  chemically synthesized
aaaagtctaagcctggtaaaag

SEQ ID NO: 841794 - DNA, 22 bp, Artificial Sequence
  chemically synthesized
gaaatcttttgtcttttaccag

SEQ ID NO: 841795 - DNA, 22 bp, Artificial Sequence
  chemically synthesized
tgaaatcttttgtcttttacca

SEQ ID NO: 841796 - DNA, 22 bp, Artificial Sequence
  chemically synthesized
tttgaaatcttttgtcttttac

SEQ ID NO: 841797 - DNA, 22 bp, Artificial Sequence
  chemically synthesized
tctttgaaatcttttgtctttt

SEQ ID NO: 841798 - DNA, 22 bp, Artificial Sequence
  chemically synthesized
ctctttgaaatcttttgtcttt

SEQ ID NO: 841799 - DNA, 22 bp, Artificial Sequence
  chemically synthesized
tctctttgaaatcttttgtctt

SEQ ID NO: 841800 - DNA, 22 bp, Artificial Sequence
  chemically synthesized
ttctctttgaaatcttttgtct

SEQ ID NO: 841801 - DNA, 22 bp, Artificial Sequence
  chemically synthesized
agcctggtaaaagacaaaagat

SEQ ID NO: 841802 - DNA, 22 bp, Artificial Sequence
  chemically synthesized
tttctctttgaaatcttttgtc

SEQ ID NO: 841803 - DNA, 22 bp, Artificial Sequence
  chemically synthesized
ttttctctttgaaatcttttgt

SEQ ID NO: 841804 - DNA, 22 bp, Artificial Sequence
  chemically synthesized
tttttctctttgaaatcttttg

SEQ ID NO: 841805 - DNA, 22 bp, Artificial Sequence
  chemically synthesized
ttttttctctttgaaatctttt

SEQ ID NO: 841806 - DNA, 22 bp, Artificial Sequence
  chemically synthesized
tttttttctctttgaaatcttt

SEQ ID NO: 841807 - DNA, 22 bp, Artificial Sequence
  chemically synthesized
gtaaaagacaaaagatttcaaa

SEQ ID NO: 841808 - DNA, 22 bp, Artificial Sequence
  chemically synthesized
agccatctttttttttctcttt

SEQ ID NO: 841809 - DNA, 22 bp, Artificial Sequence
  chemically synthesized
cagccatctttttttttctctt

SEQ ID NO: 841810 - DNA, 22 bp, Artificial Sequence
  chemically synthesized
tcagccatctttttttttctct

SEQ ID NO: 841811 - DNA, 22 bp, Artificial Sequence
  chemically synthesized
caaagagaaaaaaaaagatggc

SEQ ID NO: 841812 - DNA, 22 bp, Artificial Sequence
  chemically synthesized
aaagagaaaaaaaaagatggct

SEQ ID NO: 841813 - DNA, 22 bp, Artificial Sequence
  chemically synthesized
tagtgcaggaaggaggaaaacc

SEQ ID NO: 841814 - DNA, 22 bp, Artificial Sequence
  chemically synthesized
gtagtgcaggaaggaggaaaac

SEQ ID NO: 841815 - DNA, 22 bp, Artificial Sequence
  chemically synthesized
tgtagtgcaggaaggaggaaaa

SEQ ID NO: 841816 - DNA, 22 bp, Artificial Sequence
  chemically synthesized
aaaggttttcctccttcctgca

SEQ ID NO: 841817 - DNA, 22 bp, Artificial Sequence
  chemically synthesized
tcctccttcctgcactacaaag

SEQ ID NO: 841818 - DNA, 22 bp, Artificial Sequence
  chemically synthesized
cctccttcctgcactacaaagg

SEQ ID NO: 841819 - DNA, 22 bp, Artificial Sequence
  chemically synthesized
ctccttcctgcactacaaagga

SEQ ID NO: 841820 - DNA, 22 bp, Artificial Sequence
  chemically synthesized
cttcctgcactacaaaggattc

SEQ ID NO: 841821 - DNA, 22 bp, Artificial Sequence
  chemically synthesized
ccacaacccgaagaatcctttg

SEQ ID NO: 841822 - DNA, 22 bp, Artificial Sequence
  chemically synthesized
cccacaacccgaagaatccttt

SEQ ID NO: 841823 - DNA, 22 bp, Artificial Sequence
  chemically synthesized
cctgcactacaaaggattcttc

SEQ ID NO: 841824 - DNA, 22 bp, Artificial Sequence
  chemically synthesized
ctgcactacaaaggattcttcg

SEQ ID NO: 841825 - DNA, 22 bp, Artificial Sequence
  chemically synthesized
cttcccacaacccgaagaatcc

SEQ ID NO: 841826 - DNA, 22 bp, Artificial Sequence
  chemically synthesized
ccttcccacaacccgaagaatc

SEQ ID NO: 841827 - DNA, 22 bp, Artificial Sequence
  chemically synthesized
tccttcccacaacccgaagaat

SEQ ID NO: 841828 - DNA, 22 bp, Artificial Sequence
  chemically synthesized
cactacaaaggattcttcgggt

SEQ ID NO: 841829 - DNA, 22 bp, Artificial Sequence
  chemically synthesized
attttccttcccacaacccgaa

SEQ ID NO: 841830 - DNA, 22 bp, Artificial Sequence
  chemically synthesized
caaaggattcttcgggttgtgg

SEQ ID NO: 841831 - DNA, 22 bp, Artificial Sequence
  chemically synthesized
ttcgggttgtgggaaggaaaat

SEQ ID NO: 841832 - DNA, 22 bp, Artificial Sequence
  chemically synthesized
caatatcccctcattttccttc

SEQ ID NO: 841833 - DNA, 22 bp, Artificial Sequence
  chemically synthesized
cgggttgtgggaaggaaaatga

SEQ ID NO: 841834 - DNA, 22 bp, Artificial Sequence
  chemically synthesized
tgcaatatcccctcattttcct

SEQ ID NO: 841835 - DNA, 22 bp, Artificial Sequence
  chemically synthesized
gggttgtgggaaggaaaatgag

SEQ ID NO: 841836 - DNA, 22 bp, Artificial Sequence
  chemically synthesized
ctctgcaatatcccctcatttt

SEQ ID NO: 841837 - DNA, 22 bp, Artificial Sequence
  chemically synthesized
cctctgcaatatcccctcattt

SEQ ID NO: 841838 - DNA, 22 bp, Artificial Sequence
  chemically synthesized
tgggaaggaaaatgaggggata

SEQ ID NO: 841839 - DNA, 22 bp, Artificial Sequence
  chemically synthesized
cttcctctgcaatatcccctca

SEQ ID NO: 841840 - DNA, 22 bp, Artificial Sequence
  chemically synthesized
gcttcctctgcaatatcccctc

SEQ ID NO: 841841 - DNA, 22 bp, Artificial Sequence
  chemically synthesized
ttgcttcctctgcaatatcccc

SEQ ID NO: 841842 - DNA, 22 bp, Artificial Sequence
  chemically synthesized
cttgcttcctctgcaatatccc

SEQ ID NO: 841843 - DNA, 22 bp, Artificial Sequence
  chemically synthesized
tcttgcttcctctgcaatatcc

SEQ ID NO: 841844 - DNA, 22 bp, Artificial Sequence
  chemically synthesized
aattttcttgcttcctctgcaa

SEQ ID NO: 841845 - DNA, 22 bp, Artificial Sequence
  chemically synthesized
gtattgaattttcttgcttcct

SEQ ID NO: 841846 - DNA, 22 bp, Artificial Sequence
  chemically synthesized
cagaggaagcaagaaaattcaa

SEQ ID NO: 841847 - DNA, 22 bp, Artificial Sequence
  chemically synthesized
cagggacacacactggtattga

SEQ ID NO: 841848 - DNA, 22 bp, Artificial Sequence
  chemically synthesized
cctccagggacacacactggta

SEQ ID NO: 841849 - DNA, 22 bp, Artificial Sequence
  chemically synthesized
ccctccagggacacacactggt

SEQ ID NO: 841850 - DNA, 22 bp, Artificial Sequence
  chemically synthesized
cttccctccagggacacacact

SEQ ID NO: 841851 - DNA, 22 bp, Artificial Sequence
  chemically synthesized
ccttccctccagggacacacac

SEQ ID NO: 841852 - DNA, 22 bp, Artificial Sequence
  chemically synthesized
ccttccttccctccagggacac

SEQ ID NO: 841853 - DNA, 22 bp, Artificial Sequence
  chemically synthesized
aataccagtgtgtgtccctgga

SEQ ID NO: 841854 - DNA, 22 bp, Artificial Sequence
  chemically synthesized
taccttccttccctccagggac

SEQ ID NO: 841855 - DNA, 22 bp, Artificial Sequence
  chemically synthesized
tctaccttccttccctccaggg

SEQ ID NO: 841856 - DNA, 22 bp, Artificial Sequence
  chemically synthesized
tctctaccttccttccctccag

SEQ ID NO: 841857 - DNA, 22 bp, Artificial Sequence
  chemically synthesized
ctctctaccttccttccctcca

SEQ ID NO: 841858 - DNA, 22 bp, Artificial Sequence
  chemically synthesized
acttctctctaccttccttccc

SEQ ID NO: 841859 - DNA, 22 bp, Artificial Sequence
  chemically synthesized
cacttctctctaccttccttcc

SEQ ID NO: 841860 - DNA, 22 bp, Artificial Sequence
  chemically synthesized
ttcacttctctctaccttcctt

SEQ ID NO: 841861 - DNA, 22 bp, Artificial Sequence
  chemically synthesized
cttcacttctctctaccttcct

SEQ ID NO: 841862 - DNA, 22 bp, Artificial Sequence
  chemically synthesized
ggtttcttcacttctctctacc

SEQ ID NO: 841863 - DNA, 22 bp, Artificial Sequence
  chemically synthesized
gagggaaggaaggtagagagaa

SEQ ID NO: 841864 - DNA, 22 bp, Artificial Sequence
  chemically synthesized
tcggtttcttcacttctctcta

SEQ ID NO: 841865 - DNA, 22 bp, Artificial Sequence
  chemically synthesized
tctcggtttcttcacttctctc

SEQ ID NO: 841866 - DNA, 22 bp, Artificial Sequence
  chemically synthesized
agatctctctcggtttcttcac

SEQ ID NO: 841867 - DNA, 22 bp, Artificial Sequence
  chemically synthesized
tcagatctctctcggtttcttc

SEQ ID NO: 841868 - DNA, 22 bp, Artificial Sequence
  chemically synthesized
tctcagatctctctcggtttct

SEQ ID NO: 841869 - DNA, 22 bp, Artificial Sequence
  chemically synthesized
aggttctctcagatctctctcg

SEQ ID NO: 841870 - DNA, 22 bp, Artificial Sequence
  chemically synthesized
caggttctctcagatctctctc

SEQ ID NO: 841871 - DNA, 22 bp, Artificial Sequence
  chemically synthesized
tcaggttctctcagatctctct

SEQ ID NO: 841872 - DNA, 22 bp, Artificial Sequence
  chemically synthesized
ctttcaggttctctcagatctc

SEQ ID NO: 841873 - DNA, 22 bp, Artificial Sequence
  chemically synthesized
tgctttcaggttctctcagatc

SEQ ID NO: 841874 - DNA, 22 bp, Artificial Sequence
  chemically synthesized
agagaacctgaaagcagagctg

SEQ ID NO: 841875 - DNA, 22 bp, Artificial Sequence
  chemically synthesized
agaaatgaggtccaagtcagct

SEQ ID NO: 841876 - DNA, 22 bp, Artificial Sequence
  chemically synthesized
ctcagaaatgaggtccaagtca

SEQ ID NO: 841877 - DNA, 22 bp, Artificial Sequence
  chemically synthesized
aaagcagagctgacttggacct

SEQ ID NO: 841878 - DNA, 22 bp, Artificial Sequence
  chemically synthesized
tcctcagaaatgaggtccaagt

SEQ ID NO: 841879 - DNA, 22 bp, Artificial Sequence
  chemically synthesized
agagattctcctcagaaatgag

SEQ ID NO: 841880 - DNA, 22 bp, Artificial Sequence
  chemically synthesized
acttggacctcatttctgagga

SEQ ID NO: 841881 - DNA, 22 bp, Artificial Sequence
  chemically synthesized
cctcagagattctcctcagaaa

SEQ ID NO: 841882 - DNA, 22 bp, Artificial Sequence
  chemically synthesized
ccctcagagattctcctcagaa

SEQ ID NO: 841883 - DNA, 22 bp, Artificial Sequence
  chemically synthesized
ggacctcatttctgaggagaat

SEQ ID NO: 841884 - DNA, 22 bp, Artificial Sequence
  chemically synthesized
gacctcatttctgaggagaatc

SEQ ID NO: 841885 - DNA, 22 bp, Artificial Sequence
  chemically synthesized
atttctgaggagaatctctgag

SEQ ID NO: 841886 - DNA, 22 bp, Artificial Sequence
  chemically synthesized
gccacccggtttccctcagaga

SEQ ID NO: 841887 - DNA, 22 bp, Artificial Sequence
  chemically synthesized
ctgaggagaatctctgagggaa

SEQ ID NO: 841888 - DNA, 22 bp, Artificial Sequence
  chemically synthesized
tgaggagaatctctgagggaaa

SEQ ID NO: 841889 - DNA, 22 bp, Artificial Sequence
  chemically synthesized
aggagaatctctgagggaaacc

SEQ ID NO: 841890 - DNA, 22 bp, Artificial Sequence
  chemically synthesized
tgagggaaaccgggtggcgagt

SEQ ID NO: 841891 - DNA, 22 bp, Artificial Sequence
  chemically synthesized
agggaaaccgggtggcgagttt

SEQ ID NO: 841892 - DNA, 22 bp, Artificial Sequence
  chemically synthesized
cccctactccttcgtctgtcac

SEQ ID NO: 841893 - DNA, 22 bp, Artificial Sequence
  chemically synthesized
ccctactccttcgtctgtcact

SEQ ID NO: 841894 - DNA, 22 bp, Artificial Sequence
  chemically synthesized
catggggtcaggaagagtgaca

SEQ ID NO: 841895 - DNA, 22 bp, Artificial Sequence
  chemically synthesized
ccatggggtcaggaagagtgac

SEQ ID NO: 841896 - DNA, 22 bp, Artificial Sequence
  chemically synthesized
ctccttcgtctgtcactcttcc

SEQ ID NO: 841897 - DNA, 22 bp, Artificial Sequence
  chemically synthesized
cttcgtctgtcactcttcctga

SEQ ID NO: 841898 - DNA, 22 bp, Artificial Sequence
  chemically synthesized
cgtctgtcactcttcctgaccc

SEQ ID NO: 841899 - DNA, 22 bp, Artificial Sequence
  chemically synthesized
gtctgtcactcttcctgacccc

SEQ ID NO: 841900 - DNA, 22 bp, Artificial Sequence
  chemically synthesized
tcactcttcctgaccccatgga

SEQ ID NO: 841901 - DNA, 22 bp, Artificial Sequence
  chemically synthesized
tgtcagtgagtttccatggggt

SEQ ID NO: 841902 - DNA, 22 bp, Artificial Sequence
  chemically synthesized
ttcctgaccccatggaaactca

SEQ ID NO: 841903 - DNA, 22 bp, Artificial Sequence
  chemically synthesized
tgtgttgtgtcagtgagtttcc

SEQ ID NO: 841904 - DNA, 22 bp, Artificial Sequence
  chemically synthesized
cctgaccccatggaaactcact

SEQ ID NO: 841905 - DNA, 22 bp, Artificial Sequence
  chemically synthesized
ctgaccccatggaaactcactg

SEQ ID NO: 841906 - DNA, 22 bp, Artificial Sequence
  chemically synthesized
accccatggaaactcactgaca

SEQ ID NO: 841907 - DNA, 22 bp, Artificial Sequence
  chemically synthesized
gcagtgattgtgtgttgtgtca

SEQ ID NO: 841908 - DNA, 22 bp, Artificial Sequence
  chemically synthesized
actgacacaacacacaatcact

SEQ ID NO: 841909 - DNA, 22 bp, Artificial Sequence
  chemically synthesized
acacaacacacaatcactgcga

SEQ ID NO: 841910 - DNA, 22 bp, Artificial Sequence
  chemically synthesized
atggggagagtgattcgcagtg

SEQ ID NO: 841911 - DNA, 22 bp, Artificial Sequence
  chemically synthesized
aatggggagagtgattcgcagt

SEQ ID NO: 841912 - DNA, 22 bp, Artificial Sequence
  chemically synthesized
tccatttaatggggagagtgat

SEQ ID NO: 841913 - DNA, 22 bp, Artificial Sequence
  chemically synthesized
ctatccatttaatggggagagt

SEQ ID NO: 841914 - DNA, 22 bp, Artificial Sequence
  chemically synthesized
cgaatcactctccccattaaat

SEQ ID NO: 841915 - DNA, 22 bp, Artificial Sequence
  chemically synthesized
acatacactcctatccatttaa

SEQ ID NO: 841916 - DNA, 22 bp, Artificial Sequence
  chemically synthesized
tgacatacactcctatccattt

SEQ ID NO: 841917 - DNA, 22 bp, Artificial Sequence
  chemically synthesized
ctgacatacactcctatccatt

SEQ ID NO: 841918 - DNA, 22 bp, Artificial Sequence
  chemically synthesized
ttctgacatacactcctatcca

SEQ ID NO: 841919 - DNA, 22 bp, Artificial Sequence
  chemically synthesized
tccccattaaatggataggagt

SEQ ID NO: 841920 - DNA, 22 bp, Artificial Sequence
  chemically synthesized
cttctgacatacactcctatcc

SEQ ID NO: 841921 - DNA, 22 bp, Artificial Sequence
  chemically synthesized
tcttctgacatacactcctatc

SEQ ID NO: 841922 - DNA, 22 bp, Artificial Sequence
  chemically synthesized
cccattaaatggataggagtgt

SEQ ID NO: 841923 - DNA, 22 bp, Artificial Sequence
  chemically synthesized
ttcttctgacatacactcctat

SEQ ID NO: 841924 - DNA, 22 bp, Artificial Sequence
  chemically synthesized
ttttcttctgacatacactcct

SEQ ID NO: 841925 - DNA, 22 bp, Artificial Sequence
  chemically synthesized
aatggataggagtgtatgtcag

SEQ ID NO: 841926 - DNA, 22 bp, Artificial Sequence
  chemically synthesized
tgcatattcttttcttctgaca

SEQ ID NO: 841927 - DNA, 22 bp, Artificial Sequence
  chemically synthesized
gacgctgtgcatattcttttct

SEQ ID NO: 841928 - DNA, 22 bp, Artificial Sequence
  chemically synthesized
actagacgctgtgcatattctt

SEQ ID NO: 841929 - DNA, 22 bp, Artificial Sequence
  chemically synthesized
gtaagacccatctgactagacg

SEQ ID NO: 841930 - DNA, 22 bp, Artificial Sequence
  chemically synthesized
ggtaagacccatctgactagac

SEQ ID NO: 841931 - DNA, 22 bp, Artificial Sequence
  chemically synthesized
tggtaagacccatctgactaga

SEQ ID NO: 841932 - DNA, 22 bp, Artificial Sequence
  chemically synthesized
gtcagatgggtcttaccaaagt

SEQ ID NO: 841933 - DNA, 22 bp, Artificial Sequence
  chemically synthesized
tgccgtagtagggtgggcagga

SEQ ID NO: 841934 - DNA, 22 bp, Artificial Sequence
  chemically synthesized
atgccgtagtagggtgggcagg

SEQ ID NO: 841935 - DNA, 22 bp, Artificial Sequence
  chemically synthesized
accaaagttcctgcccacccta

SEQ ID NO: 841936 - DNA, 22 bp, Artificial Sequence
  chemically synthesized
ccaaagttcctgcccaccctac

SEQ ID NO: 841937 - DNA, 22 bp, Artificial Sequence
  chemically synthesized
taccttatgccgtagtagggtg

SEQ ID NO: 841938 - DNA, 22 bp, Artificial Sequence
  chemically synthesized
ctgcccaccctactacggcata

SEQ ID NO: 841939 - DNA, 22 bp, Artificial Sequence
  chemically synthesized
cccaccctactacggcataagg

SEQ ID NO: 841940 - DNA, 22 bp, Artificial Sequence
  chemically synthesized
ctacggcataaggtacagtacg

SEQ ID NO: 841941 - DNA, 22 bp, Artificial Sequence
  chemically synthesized
cggcataaggtacagtacgatg

SEQ ID NO: 841942 - DNA, 22 bp, Artificial Sequence
  chemically synthesized
taatatcaaaaatcatcgtact

SEQ ID NO: 841943 - DNA, 22 bp, Artificial Sequence
  chemically synthesized
gtaatatcaaaaatcatcgtac

SEQ ID NO: 841944 - DNA, 22 bp, Artificial Sequence
  chemically synthesized
tgtaatatcaaaaatcatcgta

SEQ ID NO: 841945 - DNA, 22 bp, Artificial Sequence
  chemically synthesized
atgcccccattttgtaatatca

SEQ ID NO: 841946 - DNA, 22 bp, Artificial Sequence
  chemically synthesized
gatgcccccattttgtaatatc

SEQ ID NO: 841947 - DNA, 22 bp, Artificial Sequence
  chemically synthesized
tgatgcccccattttgtaatat

SEQ ID NO: 841948 - DNA, 22 bp, Artificial Sequence
  chemically synthesized
ctttgatgcccccattttgtaa

SEQ ID NO: 841949 - DNA, 22 bp, Artificial Sequence
  chemically synthesized
cgctactttgatgcccccattt

SEQ ID NO: 841950 - DNA, 22 bp, Artificial Sequence
  chemically synthesized
ttgatattacaaaatgggggca

SEQ ID NO: 841951 - DNA, 22 bp, Artificial Sequence
  chemically synthesized
tgatattacaaaatgggggcat

SEQ ID NO: 841952 - DNA, 22 bp, Artificial Sequence
  chemically synthesized
tccgctactttgatgcccccat

SEQ ID NO: 841953 - DNA, 22 bp, Artificial Sequence
  chemically synthesized
gatattacaaaatgggggcatc

SEQ ID NO: 841954 - DNA, 22 bp, Artificial Sequence
  chemically synthesized
atattacaaaatgggggcatca

SEQ ID NO: 841955 - DNA, 22 bp, Artificial Sequence
  chemically synthesized
caaaatgggggcatcaaagtag

SEQ ID NO: 841956 - DNA, 22 bp, Artificial Sequence
  chemically synthesized
gatatctctccgctactttgat

SEQ ID NO: 841957 - DNA, 22 bp, Artificial Sequence
  chemically synthesized
agatctggatatctctccgcta

SEQ ID NO: 841958 - DNA, 22 bp, Artificial Sequence
  chemically synthesized
cagatctggatatctctccgct

SEQ ID NO: 841959 - DNA, 22 bp, Artificial Sequence
  chemically synthesized
tcagatctggatatctctccgc

SEQ ID NO: 841960 - DNA, 22 bp, Artificial Sequence
  chemically synthesized
ccatgtgcagtgactttcagat

SEQ ID NO: 841961 - DNA, 22 bp, Artificial Sequence
  chemically synthesized
attcccatgtgcagtgactttc

SEQ ID NO: 841962 - DNA, 22 bp, Artificial Sequence
  chemically synthesized
cattcccatgtgcagtgacttt

SEQ ID NO: 841963 - DNA, 22 bp, Artificial Sequence
  chemically synthesized
tcattcccatgtgcagtgactt

SEQ ID NO: 841964 - DNA, 22 bp, Artificial Sequence
  chemically synthesized
ggccatctttcattcccatgtg

SEQ ID NO: 841965 - DNA, 22 bp, Artificial Sequence
  chemically synthesized
aaagtcactgcacatgggaatg

SEQ ID NO: 841966 - DNA, 22 bp, Artificial Sequence
  chemically synthesized
ctgggccatctttcattcccat

SEQ ID NO: 841967 - DNA, 22 bp, Artificial Sequence
  chemically synthesized
cctgggccatctttcattccca

SEQ ID NO: 841968 - DNA, 22 bp, Artificial Sequence
  chemically synthesized
ttcctgggccatctttcattcc

SEQ ID NO: 841969 - DNA, 22 bp, Artificial Sequence
  chemically synthesized
cttcctgggccatctttcattc

SEQ ID NO: 841970 - DNA, 22 bp, Artificial Sequence
  chemically synthesized
cacatgggaatgaaagatggcc

SEQ ID NO: 841971 - DNA, 22 bp, Artificial Sequence
  chemically synthesized
gtccaagcaggcagtggcttct

SEQ ID NO: 841972 - DNA, 22 bp, Artificial Sequence
  chemically synthesized
ttggtccaagcaggcagtggct

SEQ ID NO: 841973 - DNA, 22 bp, Artificial Sequence
  chemically synthesized
gctgttggtccaagcaggcagt

SEQ ID NO: 841974 - DNA, 22 bp, Artificial Sequence
  chemically synthesized
ggctgttggtccaagcaggcag

SEQ ID NO: 841975 - DNA, 22 bp, Artificial Sequence
  chemically synthesized
atatccttggctgttggtccaa

SEQ ID NO: 841976 - DNA, 22 bp, Artificial Sequence
  chemically synthesized
cctcatatccttggctgttggt

SEQ ID NO: 841977 - DNA, 22 bp, Artificial Sequence
  chemically synthesized
tccctcatatccttggctgttg

SEQ ID NO: 841978 - DNA, 22 bp, Artificial Sequence
  chemically synthesized
cctgcttggaccaacagccaag

SEQ ID NO: 841979 - DNA, 22 bp, Artificial Sequence
  chemically synthesized
cttggaccaacagccaaggata

SEQ ID NO: 841980 - DNA, 22 bp, Artificial Sequence
  chemically synthesized
ggaccaacagccaaggatatga

SEQ ID NO: 841981 - DNA, 22 bp, Artificial Sequence
  chemically synthesized
gaccaacagccaaggatatgag

SEQ ID NO: 841982 - DNA, 22 bp, Artificial Sequence
  chemically synthesized
gcatccatggagatgccagtct

SEQ ID NO: 841983 - DNA, 22 bp, Artificial Sequence
  chemically synthesized
ggctggcatccatggagatgcc

SEQ ID NO: 841984 - DNA, 22 bp, Artificial Sequence
  chemically synthesized
tcatctgggctggcatccatgg

SEQ ID NO: 841985 - DNA, 22 bp, Artificial Sequence
  chemically synthesized
gttgtcatctgggctggcatcc

SEQ ID NO: 841986 - DNA, 22 bp, Artificial Sequence
  chemically synthesized
agttgtcatctgggctggcatc

SEQ ID NO: 841987 - DNA, 22 bp, Artificial Sequence
  chemically synthesized
gcatctccatggatgccagccc

SEQ ID NO: 841988 - DNA, 22 bp, Artificial Sequence
  chemically synthesized
tagttgtcatctgggctggcat

SEQ ID NO: 841989 - DNA, 22 bp, Artificial Sequence
  chemically synthesized
tttagttgtcatctgggctggc

SEQ ID NO: 841990 - DNA, 22 bp, Artificial Sequence
  chemically synthesized
ttctttagttgtcatctgggct

SEQ ID NO: 841991 - DNA, 22 bp, Artificial Sequence
  chemically synthesized
gttctttagttgtcatctgggc

SEQ ID NO: 841992 - DNA, 22 bp, Artificial Sequence
  chemically synthesized
catggatgccagcccagatgac

SEQ ID NO: 841993 - DNA, 22 bp, Artificial Sequence
  chemically synthesized
tggcagaacatttgttctttag

SEQ ID NO: 841994 - DNA, 22 bp, Artificial Sequence
  chemically synthesized
gtggcagaacatttgttcttta

SEQ ID NO: 841995 - DNA, 22 bp, Artificial Sequence
  chemically synthesized
aagaacaaatgttctgccacaa

SEQ ID NO: 841996 - DNA, 22 bp, Artificial Sequence
  chemically synthesized
tgccacaaatgttctgccacac

SEQ ID NO: 841997 - DNA, 22 bp, Artificial Sequence
  chemically synthesized
ccacaaatgttctgccacactg

SEQ ID NO: 841998 - DNA, 22 bp, Artificial Sequence
  chemically synthesized
atgggtgtggtgaccacagtgt

SEQ ID NO: 841999 - DNA, 22 bp, Artificial Sequence
  chemically synthesized
tgccacactgtggtcaccacac

SEQ ID NO: 842000 - DNA, 22 bp, Artificial Sequence
  chemically synthesized
ccacactgtggtcaccacaccc

SEQ ID NO: 842001 - DNA, 22 bp, Artificial Sequence
  chemically synthesized
caaagcatgcattgatgggtgt

SEQ ID NO: 842002 - DNA, 22 bp, Artificial Sequence
  chemically synthesized
tggtcaccacacccatcaatgc

SEQ ID NO: 842003 - DNA, 22 bp, Artificial Sequence
  chemically synthesized
tatagttgcaaagcatgcattg

SEQ ID NO: 842004 - DNA, 22 bp, Artificial Sequence
  chemically synthesized
atatagttgcaaagcatgcatt

SEQ ID NO: 842005 - DNA, 22 bp, Artificial Sequence
  chemically synthesized
agggcttatatagttgcaaagc

SEQ ID NO: 842006 - DNA, 22 bp, Artificial Sequence
  chemically synthesized
aatcaattcagggcttatatag

SEQ ID NO: 842007 - DNA, 22 bp, Artificial Sequence
  chemically synthesized
aaatcaattcagggcttatata

SEQ ID NO: 842008 - DNA, 22 bp, Artificial Sequence
  chemically synthesized
taaatcaattcagggcttatat

SEQ ID NO: 842009 - DNA, 22 bp, Artificial Sequence
  chemically synthesized
ttaaatcaattcagggcttata

SEQ ID NO: 842010 - DNA, 22 bp, Artificial Sequence
  chemically synthesized
tgcaactatataagccctgaat

SEQ ID NO: 842011 - DNA, 22 bp, Artificial Sequence
  chemically synthesized
gcaactatataagccctgaatt

SEQ ID NO: 842012 - DNA, 22 bp, Artificial Sequence
  chemically synthesized
caactatataagccctgaattg

SEQ ID NO: 842013 - DNA, 22 bp, Artificial Sequence
  chemically synthesized
tataagccctgaattgatttaa

SEQ ID NO: 842014 - DNA, 22 bp, Artificial Sequence
  chemically synthesized
aatagaagaaatacatttttaa

SEQ ID NO: 842015 - DNA, 22 bp, Artificial Sequence
  chemically synthesized
aattgatttaaaaatgtatttc

SEQ ID NO: 842016 - DNA, 22 bp, Artificial Sequence
  chemically synthesized
cattgaatagaagaaatacatt

SEQ ID NO: 842017 - DNA, 22 bp, Artificial Sequence
  chemically synthesized
atttaaaaatgtatttcttcta

SEQ ID NO: 842018 - DNA, 22 bp, Artificial Sequence
  chemically synthesized
aaaaatgtatttcttctattca

SEQ ID NO: 842019 - DNA, 22 bp, Artificial Sequence
  chemically synthesized
aaaatgtatttcttctattcaa

SEQ ID NO: 842020 - DNA, 22 bp, Artificial Sequence
  chemically synthesized
ataaatgaatgtaattccattg

SEQ ID NO: 842021 - DNA, 22 bp, Artificial Sequence
  chemically synthesized
aataaatgaatgtaattccatt

SEQ ID NO: 842022 - DNA, 22 bp, Artificial Sequence
  chemically synthesized
taataaatgaatgtaattccat

SEQ ID NO: 842023 - DNA, 22 bp, Artificial Sequence
  chemically synthesized
ttaataaatgaatgtaattcca

SEQ ID NO: 842024 - DNA, 22 bp, Artificial Sequence
  chemically synthesized
cttctattcaatggaattacat

SEQ ID NO: 842025 - DNA, 22 bp, Artificial Sequence
  chemically synthesized
ttctattcaatggaattacatt

SEQ ID NO: 842026 - DNA, 22 bp, Artificial Sequence
  chemically synthesized
ctattcaatggaattacattca

SEQ ID NO: 842027 - DNA, 22 bp, Artificial Sequence
  chemically synthesized
ccttttaataaatgaatgtaat

SEQ ID NO: 842028 - DNA, 22 bp, Artificial Sequence
  chemically synthesized
tattcaatggaattacattcat

SEQ ID NO: 842029 - DNA, 22 bp, Artificial Sequence
  chemically synthesized
ttcaatggaattacattcattt

SEQ ID NO: 842030 - DNA, 22 bp, Artificial Sequence
  chemically synthesized
aatggaattacattcatttatt

SEQ ID NO: 842031 - DNA, 22 bp, Artificial Sequence
  chemically synthesized
agtccataatgttaccttttaa

SEQ ID NO: 842032 - DNA, 22 bp, Artificial Sequence
  chemically synthesized
cagtccataatgttacctttta

SEQ ID NO: 842033 - DNA, 22 bp, Artificial Sequence
  chemically synthesized
cattcatttattaaaaggtaac

SEQ ID NO: 842034 - DNA, 22 bp, Artificial Sequence
  chemically synthesized
tcagtccataatgttacctttt

SEQ ID NO: 842035 - DNA, 22 bp, Artificial Sequence
  chemically synthesized
atttattaaaaggtaacattat

SEQ ID NO: 842036 - DNA, 22 bp, Artificial Sequence
  chemically synthesized
agattttcagtccataatgtta

SEQ ID NO: 842037 - DNA, 22 bp, Artificial Sequence
  chemically synthesized
attaaaaggtaacattatggac

SEQ ID NO: 842038 - DNA, 22 bp, Artificial Sequence
  chemically synthesized
ttaaaaggtaacattatggact

SEQ ID NO: 842039 - DNA, 22 bp, Artificial Sequence
  chemically synthesized
tgctgagattttcagtccataa

SEQ ID NO: 842040 - DNA, 22 bp, Artificial Sequence
  chemically synthesized
aaaggtaacattatggactgaa

SEQ ID NO: 842041 - DNA, 22 bp, Artificial Sequence
  chemically synthesized
tggactgaaaatctcagcacaa

SEQ ID NO: 842042 - DNA, 22 bp, Artificial Sequence
  chemically synthesized
taaatgataacaattgtgctga

SEQ ID NO: 842043 - DNA, 22 bp, Artificial Sequence
  chemically synthesized
aaaatctcagcacaattgttat

SEQ ID NO: 842044 - DNA, 22 bp, Artificial Sequence
  chemically synthesized
agcacaattgttatcatttaca

SEQ ID NO: 842045 - DNA, 22 bp, Artificial Sequence
  chemically synthesized
taaaaataatgtgaaataattg

SEQ ID NO: 842046 - DNA, 22 bp, Artificial Sequence
  chemically synthesized
ataaaaataatgtgaaataatt

SEQ ID NO: 842047 - DNA, 22 bp, Artificial Sequence
  chemically synthesized
ttatcatttacaattatttcac

SEQ ID NO: 842048 - DNA, 22 bp, Artificial Sequence
  chemically synthesized
tcatttacaattatttcacatt

SEQ ID NO: 842049 - DNA, 22 bp, Artificial Sequence
  chemically synthesized
acatttataaaaataatgtgaa

SEQ ID NO: 842050 - DNA, 22 bp, Artificial Sequence
  chemically synthesized
acaattatttcacattattttt

SEQ ID NO: 842051 - DNA, 22 bp, Artificial Sequence
  chemically synthesized
caattatttcacattattttta

SEQ ID NO: 842052 - DNA, 22 bp, Artificial Sequence
  chemically synthesized
tttcacattatttttataaatg

SEQ ID NO: 842053 - DNA, 22 bp, Artificial Sequence
  chemically synthesized
atatatccccctcacatttata

SEQ ID NO: 842054 - DNA, 22 bp, Artificial Sequence
  chemically synthesized
cacattatttttataaatgtga

SEQ ID NO: 842055 - DNA, 22 bp, Artificial Sequence
  chemically synthesized
acattatttttataaatgtgag

SEQ ID NO: 842056 - DNA, 22 bp, Artificial Sequence
  chemically synthesized
agttcatatatccccctcacat

SEQ ID NO: 842057 - DNA, 22 bp, Artificial Sequence
  chemically synthesized
aagttcatatatccccctcaca

SEQ ID NO: 842058 - DNA, 22 bp, Artificial Sequence
  chemically synthesized
tttttataaatgtgagggggat

SEQ ID NO: 842059 - DNA, 22 bp, Artificial Sequence
  chemically synthesized
ttataaatgtgagggggatata

SEQ ID NO: 842060 - DNA, 22 bp, Artificial Sequence
  chemically synthesized
tataaatgtgagggggatatat

SEQ ID NO: 842061 - DNA, 22 bp, Artificial Sequence
  chemically synthesized
ataaatgtgagggggatatatg

SEQ ID NO: 842062 - DNA, 22 bp, Artificial Sequence
  chemically synthesized
taaatgtgagggggatatatga

SEQ ID NO: 842063 - DNA, 22 bp, Artificial Sequence
  chemically synthesized
aataaaaacttaagttcatata

SEQ ID NO: 842064 - DNA, 22 bp, Artificial Sequence
  chemically synthesized
caataaaaacttaagttcatat

SEQ ID NO: 842065 - DNA, 22 bp, Artificial Sequence
  chemically synthesized
aagtttttattgaaacttgtca

SEQ ID NO: 842066 - DNA, 22 bp, Artificial Sequence
  chemically synthesized
agtttttattgaaacttgtcat

SEQ ID NO: 842067 - DNA, 22 bp, Artificial Sequence
  chemically synthesized
ttattgaaacttgtcatgcatc

SEQ ID NO: 842068 - DNA, 22 bp, Artificial Sequence
  chemically synthesized
tattgaaacttgtcatgcatct

SEQ ID NO: 842069 - DNA, 22 bp, Artificial Sequence
  chemically synthesized
attgaaacttgtcatgcatctt

SEQ ID NO: 842070 - DNA, 22 bp, Artificial Sequence
  chemically synthesized
ttgaaacttgtcatgcatcttg

SEQ ID NO: 842071 - DNA, 22 bp, Artificial Sequence
  chemically synthesized
aaacttgtcatgcatcttgctt

SEQ ID NO: 842072 - DNA, 22 bp, Artificial Sequence
  chemically synthesized
gtcatgcatcttgctttgtgtg

SEQ ID NO: 842073 - DNA, 22 bp, Artificial Sequence
  chemically synthesized
acaagcatgggacacacaaagc

SEQ ID NO: 842074 - DNA, 22 bp, Artificial Sequence
  chemically synthesized
tcatgcatcttgctttgtgtgt

SEQ ID NO: 842075 - DNA, 22 bp, Artificial Sequence
  chemically synthesized
aacaagcatgggacacacaaag

SEQ ID NO: 842076 - DNA, 22 bp, Artificial Sequence
  chemically synthesized
taacaagcatgggacacacaaa

SEQ ID NO: 842077 - DNA, 22 bp, Artificial Sequence
  chemically synthesized
ttaacaagcatgggacacacaa

SEQ ID NO: 842078 - DNA, 22 bp, Artificial Sequence
  chemically synthesized
tttaacaagcatgggacacaca

SEQ ID NO: 842079 - DNA, 22 bp, Artificial Sequence
  chemically synthesized
gctttgtgtgtcccatgcttgt

SEQ ID NO: 842080 - DNA, 22 bp, Artificial Sequence
  chemically synthesized
ctttgtgtgtcccatgcttgtt

SEQ ID NO: 842081 - DNA, 22 bp, Artificial Sequence
  chemically synthesized
tgtgtgtcccatgcttgttaaa

SEQ ID NO: 842082 - DNA, 22 bp, Artificial Sequence
  chemically synthesized
gtgtgtcccatgcttgttaaaa

SEQ ID NO: 842083 - DNA, 22 bp, Artificial Sequence
  chemically synthesized
tgtgtcccatgcttgttaaaaa

SEQ ID NO: 842084 - DNA, 22 bp, Artificial Sequence
  chemically synthesized
cggatcgaagtaagttttttaa

SEQ ID NO: 842085 - DNA, 22 bp, Artificial Sequence
  chemically synthesized
gttaaaaaacttacttcgatcc

SEQ ID NO: 842086 - DNA, 22 bp, Artificial Sequence
  chemically synthesized
ttaaaaaacttacttcgatccg

SEQ ID NO: 842087 - DNA, 22 bp, Artificial Sequence
  chemically synthesized
gaacaatcattacggatcgaag

SEQ ID NO: 842088 - DNA, 22 bp, Artificial Sequence
  chemically synthesized
aaaaacttacttcgatccgtaa

SEQ ID NO: 842089 - DNA, 22 bp, Artificial Sequence
  chemically synthesized
acttcgatccgtaatgattgtt

SEQ ID NO: 842090 - DNA, 22 bp, Artificial Sequence
  chemically synthesized
cttcgatccgtaatgattgttc

SEQ ID NO: 842091 - DNA, 22 bp, Artificial Sequence
  chemically synthesized
cgatccgtaatgattgttctag

SEQ ID NO: 842092 - DNA, 22 bp, Artificial Sequence
  chemically synthesized
gatccgtaatgattgttctagc

SEQ ID NO: 842093 - DNA, 22 bp, Artificial Sequence
  chemically synthesized
aaaaacaagaccagcaatcaag

SEQ ID NO: 842094 - DNA, 22 bp, Artificial Sequence
  chemically synthesized
gaaaaacaagaccagcaatcaa

SEQ ID NO: 842095 - DNA, 22 bp, Artificial Sequence
  chemically synthesized
ttctagcctcttgattgctggt

SEQ ID NO: 842096 - DNA, 22 bp, Artificial Sequence
  chemically synthesized
tagcctcttgattgctggtctt

SEQ ID NO: 842097 - DNA, 22 bp, Artificial Sequence
  chemically synthesized
gcctcttgattgctggtcttgt

SEQ ID NO: 842098 - DNA, 22 bp, Artificial Sequence
  chemically synthesized
cccaaaatttgaaaaacaagac

SEQ ID NO: 842099 - DNA, 22 bp, Artificial Sequence
  chemically synthesized
ttgattgctggtcttgtttttc

SEQ ID NO: 842100 - DNA, 22 bp, Artificial Sequence
  chemically synthesized
gattgctggtcttgtttttcaa

SEQ ID NO: 842101 - DNA, 22 bp, Artificial Sequence
  chemically synthesized
attgctggtcttgtttttcaaa

SEQ ID NO: 842102 - DNA, 22 bp, Artificial Sequence
  chemically synthesized
ccgctgcccaaaatttgaaaaa

SEQ ID NO: 842103 - DNA, 22 bp, Artificial Sequence
  chemically synthesized
ctggtcttgtttttcaaatttt

SEQ ID NO: 842104 - DNA, 22 bp, Artificial Sequence
  chemically synthesized
attaccgctgcccaaaatttga

SEQ ID NO: 842105 - DNA, 22 bp, Artificial Sequence
  chemically synthesized
gtcttgtttttcaaattttggg

SEQ ID NO: 842106 - DNA, 22 bp, Artificial Sequence
  chemically synthesized
gtttttcaaattttgggcagcg

SEQ ID NO: 842107 - DNA, 22 bp, Artificial Sequence
  chemically synthesized
tttttcaaattttgggcagcgg

SEQ ID NO: 842108 - DNA, 22 bp, Artificial Sequence
  chemically synthesized
gaagaactcattaccgctgccc

SEQ ID NO: 842109 - DNA, 22 bp, Artificial Sequence
  chemically synthesized
ttcaaattttgggcagcggtaa

SEQ ID NO: 842110 - DNA, 22 bp, Artificial Sequence
  chemically synthesized
tcaaattttgggcagcggtaat

SEQ ID NO: 842111 - DNA, 22 bp, Artificial Sequence
  chemically synthesized
caaattttgggcagcggtaatg

SEQ ID NO: 842112 - DNA, 22 bp, Artificial Sequence
  chemically synthesized
aaattttgggcagcggtaatga

SEQ ID NO: 842113 - DNA, 22 bp, Artificial Sequence
  chemically synthesized
tgggcagcggtaatgagttctt

SEQ ID NO: 842114 - DNA, 22 bp, Artificial Sequence
  chemically synthesized
gggcagcggtaatgagttcttc

SEQ ID NO: 842115 - DNA, 22 bp, Artificial Sequence
  chemically synthesized
ggcagcggtaatgagttcttcc

SEQ ID NO: 842116 - DNA, 22 bp, Artificial Sequence
  chemically synthesized
gaacagaggcgtccccagttgg

SEQ ID NO: 842117 - DNA, 22 bp, Artificial Sequence
  chemically synthesized
ggaacagaggcgtccccagttg

SEQ ID NO: 842118 - DNA, 22 bp, Artificial Sequence
  chemically synthesized
ttccaactggggacgcctctgt

SEQ ID NO: 842119 - DNA, 22 bp, Artificial Sequence
  chemically synthesized
ccaactggggacgcctctgttc

SEQ ID NO: 842120 - DNA, 22 bp, Artificial Sequence
  chemically synthesized
caactggggacgcctctgttcc

SEQ ID NO: 842121 - DNA, 22 bp, Artificial Sequence
  chemically synthesized
gggacgcctctgttccaaatcc

SEQ ID NO: 842122 - DNA, 22 bp, Artificial Sequence
  chemically synthesized
caggcaacaatgcaggatttgg

SEQ ID NO: 842123 - DNA, 22 bp, Artificial Sequence
  chemically synthesized
acaggcaacaatgcaggatttg

SEQ ID NO: 842124 - DNA, 22 bp, Artificial Sequence
  chemically synthesized
ttacaggcaacaatgcaggatt

SEQ ID NO: 842125 - DNA, 22 bp, Artificial Sequence
  chemically synthesized
ttcttacaggcaacaatgcagg

SEQ ID NO: 842126 - DNA, 22 bp, Artificial Sequence
  chemically synthesized
gttcttacaggcaacaatgcag

SEQ ID NO: 842127 - DNA, 22 bp, Artificial Sequence
  chemically synthesized
tgttccaaatcctgcattgttg

SEQ ID NO: 842128 - DNA, 22 bp, Artificial Sequence
  chemically synthesized
ttccaaatcctgcattgttgcc

SEQ ID NO: 842129 - DNA, 22 bp, Artificial Sequence
  chemically synthesized
caaatcctgcattgttgcctgt

SEQ ID NO: 842130 - DNA, 22 bp, Artificial Sequence
  chemically synthesized
agggatatttgttcttacaggc

SEQ ID NO: 842131 - DNA, 22 bp, Artificial Sequence
  chemically synthesized
cattgttgcctgtaagaacaaa

SEQ ID NO: 842132 - DNA, 22 bp, Artificial Sequence
  chemically synthesized
atactaagggatatttgttctt

SEQ ID NO: 842133 - DNA, 22 bp, Artificial Sequence
  chemically synthesized
ttgcctgtaagaacaaatatcc

SEQ ID NO: 842134 - DNA, 22 bp, Artificial Sequence
  chemically synthesized
cctgtaagaacaaatatccctt

SEQ ID NO: 842135 - DNA, 22 bp, Artificial Sequence
  chemically synthesized
aagaaccctgatactaagggat

SEQ ID NO: 842136 - DNA, 22 bp, Artificial Sequence
  chemically synthesized
taagaacaaatatcccttagta

SEQ ID NO: 842137 - DNA, 22 bp, Artificial Sequence
  chemically synthesized
agtatcagggttcttcagcgtt

SEQ ID NO: 842138 - DNA, 22 bp, Artificial Sequence
  chemically synthesized
gtatcagggttcttcagcgttg

SEQ ID NO: 842139 - DNA, 22 bp, Artificial Sequence
  chemically synthesized
tgtaaaaggaatacacaacgct

SEQ ID NO: 842140 - DNA, 22 bp, Artificial Sequence
  chemically synthesized
tattatgtaaaaggaatacaca

SEQ ID NO: 842141 - DNA, 22 bp, Artificial Sequence
  chemically synthesized
gtattatgtaaaaggaatacac

SEQ ID NO: 842142 - DNA, 22 bp, Artificial Sequence
  chemically synthesized
tgtattatgtaaaaggaataca

SEQ ID NO: 842143 - DNA, 22 bp, Artificial Sequence
  chemically synthesized
ttcagcgttgtgtattcctttt

SEQ ID NO: 842144 - DNA, 22 bp, Artificial Sequence
  chemically synthesized
ctttgtattatgtaaaaggaat

SEQ ID NO: 842145 - DNA, 22 bp, Artificial Sequence
  chemically synthesized
cagcgttgtgtattccttttac

SEQ ID NO: 842146 - DNA, 22 bp, Artificial Sequence
  chemically synthesized
actttgtattatgtaaaaggaa

SEQ ID NO: 842147 - DNA, 22 bp, Artificial Sequence
  chemically synthesized
agcgttgtgtattccttttaca

SEQ ID NO: 842148 - DNA, 22 bp, Artificial Sequence
  chemically synthesized
tactttgtattatgtaaaagga

SEQ ID NO: 842149 - DNA, 22 bp, Artificial Sequence
  chemically synthesized
tactttactttgtattatgtaa

SEQ ID NO: 842150 - DNA, 22 bp, Artificial Sequence
  chemically synthesized
tgtattccttttacataataca

SEQ ID NO: 842151 - DNA, 22 bp, Artificial Sequence
  chemically synthesized
acaattgtactttactttgtat

SEQ ID NO: 842152 - DNA, 22 bp, Artificial Sequence
  chemically synthesized
cttttacataatacaaagtaaa

SEQ ID NO: 842153 - DNA, 22 bp, Artificial Sequence
  chemically synthesized
ttacataatacaaagtaaagta

SEQ ID NO: 842154 - DNA, 22 bp, Artificial Sequence
  chemically synthesized
gtctcacaattgtactttactt

SEQ ID NO: 842155 - DNA, 22 bp, Artificial Sequence
  chemically synthesized
tacataatacaaagtaaagtac

SEQ ID NO: 842156 - DNA, 22 bp, Artificial Sequence
  chemically synthesized
acataatacaaagtaaagtaca

SEQ ID NO: 842157 - DNA, 22 bp, Artificial Sequence
  chemically synthesized
cataatacaaagtaaagtacaa

SEQ ID NO: 842158 - DNA, 22 bp, Artificial Sequence
  chemically synthesized
gctggtctcacaattgtacttt

SEQ ID NO: 842159 - DNA, 22 bp, Artificial Sequence
  chemically synthesized
ggctggtctcacaattgtactt

SEQ ID NO: 842160 - DNA, 22 bp, Artificial Sequence
  chemically synthesized
tggctggtctcacaattgtact

SEQ ID NO: 842161 - DNA, 22 bp, Artificial Sequence
  chemically synthesized
aaagtgttttggctggtctcac

SEQ ID NO: 842162 - DNA, 22 bp, Artificial Sequence
  chemically synthesized
taaaagtgttttggctggtctc

SEQ ID NO: 842163 - DNA, 22 bp, Artificial Sequence
  chemically synthesized
ctaaaagtgttttggctggtct

SEQ ID NO: 842164 - DNA, 22 bp, Artificial Sequence
  chemically synthesized
tttctaaaagtgttttggctgg

SEQ ID NO: 842165 - DNA, 22 bp, Artificial Sequence
  chemically synthesized
atttctaaaagtgttttggctg

SEQ ID NO: 842166 - DNA, 22 bp, Artificial Sequence
  chemically synthesized
tatttctaaaagtgttttggct

SEQ ID NO: 842167 - DNA, 22 bp, Artificial Sequence
  chemically synthesized
ttatttctaaaagtgttttggc

SEQ ID NO: 842168 - DNA, 22 bp, Artificial Sequence
  chemically synthesized
tttatttctaaaagtgttttgg

SEQ ID NO: 842169 - DNA, 22 bp, Artificial Sequence
  chemically synthesized
ttttatttctaaaagtgttttg

SEQ ID NO: 842170 - DNA, 22 bp, Artificial Sequence
  chemically synthesized
tgagaccagccaaaacactttt

SEQ ID NO: 842171 - DNA, 22 bp, Artificial Sequence
  chemically synthesized
tacagtaacatcttttttattt

SEQ ID NO: 842172 - DNA, 22 bp, Artificial Sequence
  chemically synthesized
atacagtaacatcttttttatt

SEQ ID NO: 842173 - DNA, 22 bp, Artificial Sequence
  chemically synthesized
ttagaaataaaaaagatgttac

SEQ ID NO: 842174 - DNA, 22 bp, Artificial Sequence
  chemically synthesized
tagaaataaaaaagatgttact

SEQ ID NO: 842175 - DNA, 22 bp, Artificial Sequence
  chemically synthesized
agaaataaaaaagatgttactg

SEQ ID NO: 842176 - DNA, 22 bp, Artificial Sequence
  chemically synthesized
taaacccttatacagtaacatc

SEQ ID NO: 842177 - DNA, 22 bp, Artificial Sequence
  chemically synthesized
gaaataaaaaagatgttactgt

SEQ ID NO: 842178 - DNA, 22 bp, Artificial Sequence
  chemically synthesized
tataaacccttatacagtaaca

SEQ ID NO: 842179 - DNA, 22 bp, Artificial Sequence
  chemically synthesized
ctataaacccttatacagtaac

SEQ ID NO: 842180 - DNA, 22 bp, Artificial Sequence
  chemically synthesized
tctataaacccttatacagtaa

SEQ ID NO: 842181 - DNA, 22 bp, Artificial Sequence
  chemically synthesized
ttttctataaacccttatacag

SEQ ID NO: 842182 - DNA, 22 bp, Artificial Sequence
  chemically synthesized
aattgttttctataaaccctta

SEQ ID NO: 842183 - DNA, 22 bp, Artificial Sequence
  chemically synthesized
ttaaattgttttctataaaccc

SEQ ID NO: 842184 - DNA, 22 bp, Artificial Sequence
  chemically synthesized
ctgttaaattgttttctataaa

SEQ ID NO: 842185 - DNA, 22 bp, Artificial Sequence
  chemically synthesized
ctgtataagggtttatagaaaa

SEQ ID NO: 842186 - DNA, 22 bp, Artificial Sequence
  chemically synthesized
cctgttaaattgttttctataa

SEQ ID NO: 842187 - DNA, 22 bp, Artificial Sequence
  chemically synthesized
tataagggtttatagaaaacaa

SEQ ID NO: 842188 - DNA, 22 bp, Artificial Sequence
  chemically synthesized
atagaaaacaatttaacaggaa

SEQ ID NO: 842189 - DNA, 22 bp, Artificial Sequence
  chemically synthesized
tagaaaacaatttaacaggaaa

SEQ ID NO: 842190 - DNA, 22 bp, Artificial Sequence
  chemically synthesized
agaatgaaacatatttcctgtt

SEQ ID NO: 842191 - DNA, 22 bp, Artificial Sequence
  chemically synthesized
atatctaagaatgaaacatatt

SEQ ID NO: 842192 - DNA, 22 bp, Artificial Sequence
  chemically synthesized
gatatctaagaatgaaacatat

SEQ ID NO: 842193 - DNA, 22 bp, Artificial Sequence
  chemically synthesized
tgatatctaagaatgaaacata

SEQ ID NO: 842194 - DNA, 22 bp, Artificial Sequence
  chemically synthesized
ttgatatctaagaatgaaacat

SEQ ID NO: 842195 - DNA, 22 bp, Artificial Sequence
  chemically synthesized
aacaggaaatatgtttcattct

SEQ ID NO: 842196 - DNA, 22 bp, Artificial Sequence
  chemically synthesized
acaggaaatatgtttcattctt

SEQ ID NO: 842197 - DNA, 22 bp, Artificial Sequence
  chemically synthesized
aaatatttttgatatctaagaa

SEQ ID NO: 842198 - DNA, 22 bp, Artificial Sequence
  chemically synthesized
gaaatatttttgatatctaaga

SEQ ID NO: 842199 - DNA, 22 bp, Artificial Sequence
  chemically synthesized
atttgaaatatttttgatatct

SEQ ID NO: 842200 - DNA, 22 bp, Artificial Sequence
  chemically synthesized
catttgaaatatttttgatatc

SEQ ID NO: 842201 - DNA, 22 bp, Artificial Sequence
  chemically synthesized
tcatttgaaatatttttgatat

SEQ ID NO: 842202 - DNA, 22 bp, Artificial Sequence
  chemically synthesized
cattcttagatatcaaaaatat

SEQ ID NO: 842203 - DNA, 22 bp, Artificial Sequence
  chemically synthesized
attcttagatatcaaaaatatt

SEQ ID NO: 842204 - DNA, 22 bp, Artificial Sequence
  chemically synthesized
ttagatatcaaaaatatttcaa

SEQ ID NO: 842205 - DNA, 22 bp, Artificial Sequence
  chemically synthesized
agatatcaaaaatatttcaaat

SEQ ID NO: 842206 - DNA, 22 bp, Artificial Sequence
  chemically synthesized
gatatcaaaaatatttcaaatg

SEQ ID NO: 842207 - DNA, 22 bp, Artificial Sequence
  chemically synthesized
tagtcaagattttcatttgaaa

SEQ ID NO: 842208 - DNA, 22 bp, Artificial Sequence
  chemically synthesized
caaatgaaaatcttgactatag

SEQ ID NO: 842209 - DNA, 22 bp, Artificial Sequence
  chemically synthesized
aatgaagaaaatctatagtcaa

SEQ ID NO: 842210 - DNA, 22 bp, Artificial Sequence
  chemically synthesized
aaatgaaaatcttgactataga

SEQ ID NO: 842211 - DNA, 22 bp, Artificial Sequence
  chemically synthesized
aaatgaagaaaatctatagtca

SEQ ID NO: 842212 - DNA, 22 bp, Artificial Sequence
  chemically synthesized
taaatgaagaaaatctatagtc

SEQ ID NO: 842213 - DNA, 22 bp, Artificial Sequence
  chemically synthesized
agcctttaaatgaagaaaatct

SEQ ID NO: 842214 - DNA, 22 bp, Artificial Sequence
  chemically synthesized
gagcctttaaatgaagaaaatc

SEQ ID NO: 842215 - DNA, 22 bp, Artificial Sequence
  chemically synthesized
gactatagattttcttcattta

SEQ ID NO: 842216 - DNA, 22 bp, Artificial Sequence
  chemically synthesized
catttgagcctttaaatgaaga

SEQ ID NO: 842217 - DNA, 22 bp, Artificial Sequence
  chemically synthesized
actatagattttcttcatttaa

SEQ ID NO: 842218 - DNA, 22 bp, Artificial Sequence
  chemically synthesized
tagattttcttcatttaaaggc

SEQ ID NO: 842219 - DNA, 22 bp, Artificial Sequence
  chemically synthesized
cggaatgtctccatttgagcct

SEQ ID NO: 842220 - DNA, 22 bp, Artificial Sequence
  chemically synthesized
tcttcatttaaaggctcaaatg

SEQ ID NO: 842221 - DNA, 22 bp, Artificial Sequence
  chemically synthesized
cttcatttaaaggctcaaatgg

SEQ ID NO: 842222 - DNA, 22 bp, Artificial Sequence
  chemically synthesized
ttcatttaaaggctcaaatgga

SEQ ID NO: 842223 - DNA, 22 bp, Artificial Sequence
  chemically synthesized
catttaaaggctcaaatggaga

SEQ ID NO: 842224 - DNA, 22 bp, Artificial Sequence
  chemically synthesized
atttaaaggctcaaatggagac

SEQ ID NO: 842225 - DNA, 22 bp, Artificial Sequence
  chemically synthesized
aaaggctcaaatggagacattc

SEQ ID NO: 842226 - DNA, 22 bp, Artificial Sequence
  chemically synthesized
aaggctcaaatggagacattcc

SEQ ID NO: 842227 - DNA, 22 bp, Artificial Sequence
  chemically synthesized
agtaatccgaggtactccggaa

SEQ ID NO: 842228 - DNA, 22 bp, Artificial Sequence
  chemically synthesized
aaatggagacattccggagtac

SEQ ID NO: 842229 - DNA, 22 bp, Artificial Sequence
  chemically synthesized
aagtaatccgaggtactccgga

SEQ ID NO: 842230 - DNA, 22 bp, Artificial Sequence
  chemically synthesized
agacagtggtttaagtaatccg

SEQ ID NO: 842231 - DNA, 22 bp, Artificial Sequence
  chemically synthesized
cggagtacctcggattacttaa

SEQ ID NO: 842232 - DNA, 22 bp, Artificial Sequence
  chemically synthesized
aaggcattcagacagtggttta

SEQ ID NO: 842233 - DNA, 22 bp, Artificial Sequence
  chemically synthesized
ctcaaggcattcagacagtggt

SEQ ID NO: 842234 - DNA, 22 bp, Artificial Sequence
  chemically synthesized
ggattacttaaaccactgtctg

SEQ ID NO: 842235 - DNA, 22 bp, Artificial Sequence
  chemically synthesized
actcaaggcattcagacagtgg

SEQ ID NO: 842236 - DNA, 22 bp, Artificial Sequence
  chemically synthesized
ttactcaaggcattcagacagt

SEQ ID NO: 842237 - DNA, 22 bp, Artificial Sequence
  chemically synthesized
cttactcaaggcattcagacag

SEQ ID NO: 842238 - DNA, 22 bp, Artificial Sequence
  chemically synthesized
cttaaaccactgtctgaatgcc

SEQ ID NO: 842239 - DNA, 22 bp, Artificial Sequence
  chemically synthesized
aaaccactgtctgaatgccttg

SEQ ID NO: 842240 - DNA, 22 bp, Artificial Sequence
  chemically synthesized
aaccactgtctgaatgccttga

SEQ ID NO: 842241 - DNA, 22 bp, Artificial Sequence
  chemically synthesized
agaataacatttcttactcaag

SEQ ID NO: 842242 - DNA, 22 bp, Artificial Sequence
  chemically synthesized
tctgaatgccttgagtaagaaa

SEQ ID NO: 842243 - DNA, 22 bp, Artificial Sequence
  chemically synthesized
aatgccttgagtaagaaatgtt

SEQ ID NO: 842244 - DNA, 22 bp, Artificial Sequence
  chemically synthesized
tcgtaattcagaataacatttc

SEQ ID NO: 842245 - DNA, 22 bp, Artificial Sequence
  chemically synthesized
gagtaagaaatgttattctgaa

SEQ ID NO: 842246 - DNA, 22 bp, Artificial Sequence
  chemically synthesized
agtaagaaatgttattctgaat

SEQ ID NO: 842247 - DNA, 22 bp, Artificial Sequence
  chemically synthesized
aatacattgtcgtaattcagaa

SEQ ID NO: 842248 - DNA, 22 bp, Artificial Sequence
  chemically synthesized
aaatacattgtcgtaattcaga

SEQ ID NO: 842249 - DNA, 22 bp, Artificial Sequence
  chemically synthesized
taaatacattgtcgtaattcag

SEQ ID NO: 842250 - DNA, 22 bp, Artificial Sequence
  chemically synthesized
ttaaatacattgtcgtaattca

SEQ ID NO: 842251 - DNA, 22 bp, Artificial Sequence
  chemically synthesized
tcttttaaatacattgtcgtaa

SEQ ID NO: 842252 - DNA, 22 bp, Artificial Sequence
  chemically synthesized
tctatcttttaaatacattgtc

SEQ ID NO: 842253 - DNA, 22 bp, Artificial Sequence
  chemically synthesized
ttctgaattacgacaatgtatt

SEQ ID NO: 842254 - DNA, 22 bp, Artificial Sequence
  chemically synthesized
tgaattacgacaatgtatttaa

SEQ ID NO: 842255 - DNA, 22 bp, Artificial Sequence
  chemically synthesized
aattacgacaatgtatttaaaa

SEQ ID NO: 842256 - DNA, 22 bp, Artificial Sequence
  chemically synthesized
cgacaatgtatttaaaagatag

SEQ ID NO: 842257 - DNA, 22 bp, Artificial Sequence
  chemically synthesized
taagtataaatagttatctatc

SEQ ID NO: 842258 - DNA, 22 bp, Artificial Sequence
  chemically synthesized
aaaagatagataactatttata

SEQ ID NO: 842259 - DNA, 22 bp, Artificial Sequence
  chemically synthesized
aaagatagataactatttatac

SEQ ID NO: 842260 - DNA, 22 bp, Artificial Sequence
  chemically synthesized
acgtcacacagaatgatattat

SEQ ID NO: 842261 - DNA, 22 bp, Artificial Sequence
  chemically synthesized
gacgtcacacagaatgatatta

SEQ ID NO: 842262 - DNA, 22 bp, Artificial Sequence
  chemically synthesized
tgacgtcacacagaatgatatt

SEQ ID NO: 842263 - DNA, 22 bp, Artificial Sequence
  chemically synthesized
tttatacttataatatcattct

SEQ ID NO: 842264 - DNA, 22 bp, Artificial Sequence
  chemically synthesized
atacttataatatcattctgtg

SEQ ID NO: 842265 - DNA, 22 bp, Artificial Sequence
  chemically synthesized
attttgacgtcacacagaatga

SEQ ID NO: 842266 - DNA, 22 bp, Artificial Sequence
  chemically synthesized
tacttataatatcattctgtgt

SEQ ID NO: 842267 - DNA, 22 bp, Artificial Sequence
  chemically synthesized
aattttgacgtcacacagaatg

SEQ ID NO: 842268 - DNA, 22 bp, Artificial Sequence
  chemically synthesized
ataatatcattctgtgtgacgt

SEQ ID NO: 842269 - DNA, 22 bp, Artificial Sequence
  chemically synthesized
taatatcattctgtgtgacgtc

SEQ ID NO: 842270 - DNA, 22 bp, Artificial Sequence
  chemically synthesized
aaataaatataccttaattttg

SEQ ID NO: 842271 - DNA, 22 bp, Artificial Sequence
  chemically synthesized
aaaataaatataccttaatttt

SEQ ID NO: 842272 - DNA, 22 bp, Artificial Sequence
  chemically synthesized
tgtgtgacgtcaaaattaaggt

SEQ ID NO: 842273 - DNA, 22 bp, Artificial Sequence
  chemically synthesized
taaaataaatataccttaattt

SEQ ID NO: 842274 - DNA, 22 bp, Artificial Sequence
  chemically synthesized
ttaaaataaatataccttaatt

SEQ ID NO: 842275 - DNA, 22 bp, Artificial Sequence
  chemically synthesized
tgtgacgtcaaaattaaggtat

SEQ ID NO: 842276 - DNA, 22 bp, Artificial Sequence
  chemically synthesized
tttttaaaataaatatacctta

SEQ ID NO: 842277 - DNA, 22 bp, Artificial Sequence
  chemically synthesized
tgtttttaaaataaatatacct

SEQ ID NO: 842278 - DNA, 22 bp, Artificial Sequence
  chemically synthesized
ctgtttttaaaataaatatacc

SEQ ID NO: 842279 - DNA, 22 bp, Artificial Sequence
  chemically synthesized
tctgtttttaaaataaatatac

SEQ ID NO: 842280 - DNA, 22 bp, Artificial Sequence
  chemically synthesized
ttctgtttttaaaataaatata

SEQ ID NO: 842281 - DNA, 22 bp, Artificial Sequence
  chemically synthesized
tttctgtttttaaaataaatat

SEQ ID NO: 842282 - DNA, 22 bp, Artificial Sequence
  chemically synthesized
tgctttttctgtttttaaaata

SEQ ID NO: 842283 - DNA, 22 bp, Artificial Sequence
  chemically synthesized
tgtgctttttctgtttttaaaa

SEQ ID NO: 842284 - DNA, 22 bp, Artificial Sequence
  chemically synthesized
aggtatatttattttaaaaaca

SEQ ID NO: 842285 - DNA, 22 bp, Artificial Sequence
  chemically synthesized
aatcggttctgtgctttttctg

SEQ ID NO: 842286 - DNA, 22 bp, Artificial Sequence
  chemically synthesized
aaatcggttctgtgctttttct

SEQ ID NO: 842287 - DNA, 22 bp, Artificial Sequence
  chemically synthesized
attttaaaaacagaaaaagcac

SEQ ID NO: 842288 - DNA, 22 bp, Artificial Sequence
  chemically synthesized
ttttaaaaacagaaaaagcaca

SEQ ID NO: 842289 - DNA, 22 bp, Artificial Sequence
  chemically synthesized
ttaaatcggttctgtgcttttt

SEQ ID NO: 842290 - DNA, 22 bp, Artificial Sequence
  chemically synthesized
taaaaacagaaaaagcacagaa

SEQ ID NO: 842291 - DNA, 22 bp, Artificial Sequence
  chemically synthesized
aaaaacagaaaaagcacagaac

SEQ ID NO: 842292 - DNA, 22 bp, Artificial Sequence
  chemically synthesized
aaaacagaaaaagcacagaacc

SEQ ID NO: 842293 - DNA, 22 bp, Artificial Sequence
  chemically synthesized
aataagtaatatctcttaaatc

SEQ ID NO: 842294 - DNA, 22 bp, Artificial Sequence
  chemically synthesized
aagagatattacttatttaact

SEQ ID NO: 842295 - DNA, 22 bp, Artificial Sequence
  chemically synthesized
agagatattacttatttaactt

SEQ ID NO: 842296 - DNA, 22 bp, Artificial Sequence
  chemically synthesized
aggggtacaatgaagttaaata

SEQ ID NO: 842297 - DNA, 22 bp, Artificial Sequence
  chemically synthesized
cttatttaacttcattgtaccc

SEQ ID NO: 842298 - DNA, 22 bp, Artificial Sequence
  chemically synthesized
atttaacttcattgtacccctg

SEQ ID NO: 842299 - DNA, 22 bp, Artificial Sequence
  chemically synthesized
tttaacttcattgtacccctga

SEQ ID NO: 842300 - DNA, 22 bp, Artificial Sequence
  chemically synthesized
acaggtgagaaatctcaggggt

SEQ ID NO: 842301 - DNA, 22 bp, Artificial Sequence
  chemically synthesized
aacttcattgtacccctgagat

SEQ ID NO: 842302 - DNA, 22 bp, Artificial Sequence
  chemically synthesized
gacaggtgagaaatctcagggg

SEQ ID NO: 842303 - DNA, 22 bp, Artificial Sequence
  chemically synthesized
acttcattgtacccctgagatt

SEQ ID NO: 842304 - DNA, 22 bp, Artificial Sequence
  chemically synthesized
atttgacaggtgagaaatctca

SEQ ID NO: 842305 - DNA, 22 bp, Artificial Sequence
  chemically synthesized
cattgtacccctgagatttctc

SEQ ID NO: 842306 - DNA, 22 bp, Artificial Sequence
  chemically synthesized
catttgacaggtgagaaatctc

SEQ ID NO: 842307 - DNA, 22 bp, Artificial Sequence
  chemically synthesized
attgtacccctgagatttctca

SEQ ID NO: 842308 - DNA, 22 bp, Artificial Sequence
  chemically synthesized
tcatttgacaggtgagaaatct

SEQ ID NO: 842309 - DNA, 22 bp, Artificial Sequence
  chemically synthesized
ttcatttgacaggtgagaaatc

SEQ ID NO: 842310 - DNA, 22 bp, Artificial Sequence
  chemically synthesized
tacccctgagatttctcacctg

SEQ ID NO: 842311 - DNA, 22 bp, Artificial Sequence
  chemically synthesized
accttttcatttgacaggtgag

SEQ ID NO: 842312 - DNA, 22 bp, Artificial Sequence
  chemically synthesized
caccttttcatttgacaggtga

SEQ ID NO: 842313 - DNA, 22 bp, Artificial Sequence
  chemically synthesized
cttcaccttttcatttgacagg

SEQ ID NO: 842314 - DNA, 22 bp, Artificial Sequence
  chemically synthesized
agatttctcacctgtcaaatga

SEQ ID NO: 842315 - DNA, 22 bp, Artificial Sequence
  chemically synthesized
gtctacttcaccttttcatttg

SEQ ID NO: 842316 - DNA, 22 bp, Artificial Sequence
  chemically synthesized
ctcacctgtcaaatgaaaaggt

SEQ ID NO: 842317 - DNA, 22 bp, Artificial Sequence
  chemically synthesized
tcacctgtcaaatgaaaaggtg

SEQ ID NO: 842318 - DNA, 22 bp, Artificial Sequence
  chemically synthesized
gctcgtctacttcaccttttca

SEQ ID NO: 842319 - DNA, 22 bp, Artificial Sequence
  chemically synthesized
agctcgtctacttcaccttttc

SEQ ID NO: 842320 - DNA, 22 bp, Artificial Sequence
  chemically synthesized
acctgtcaaatgaaaaggtgaa

SEQ ID NO: 842321 - DNA, 22 bp, Artificial Sequence
  chemically synthesized
atttagctcgtctacttcacct

SEQ ID NO: 842322 - DNA, 22 bp, Artificial Sequence
  chemically synthesized
tcaaatgaaaaggtgaagtaga

SEQ ID NO: 842323 - DNA, 22 bp, Artificial Sequence
  chemically synthesized
ggagaaaagctgatttagctcg

SEQ ID NO: 842324 - DNA, 22 bp, Artificial Sequence
  chemically synthesized
aggagaaaagctgatttagctc

SEQ ID NO: 842325 - DNA, 22 bp, Artificial Sequence
  chemically synthesized
cggacaggcagcttaggagaaa

SEQ ID NO: 842326 - DNA, 22 bp, Artificial Sequence
  chemically synthesized
acggacaggcagcttaggagaa

SEQ ID NO: 842327 - DNA, 22 bp, Artificial Sequence
  chemically synthesized
ttacggacaggcagcttaggag

SEQ ID NO: 842328 - DNA, 22 bp, Artificial Sequence
  chemically synthesized
aatcagcttttctcctaagctg

SEQ ID NO: 842329 - DNA, 22 bp, Artificial Sequence
  chemically synthesized
gtgattcttacggacaggcagc

SEQ ID NO: 842330 - DNA, 22 bp, Artificial Sequence
  chemically synthesized
ggtgattcttacggacaggcag

SEQ ID NO: 842331 - DNA, 22 bp, Artificial Sequence
  chemically synthesized
ttctcctaagctgcctgtccgt

SEQ ID NO: 842332 - DNA, 22 bp, Artificial Sequence
  chemically synthesized
tctcctaagctgcctgtccgta

SEQ ID NO: 842333 - DNA, 22 bp, Artificial Sequence
  chemically synthesized
ctcctaagctgcctgtccgtaa

SEQ ID NO: 842334 - DNA, 22 bp, Artificial Sequence
  chemically synthesized
tcctaagctgcctgtccgtaag

SEQ ID NO: 842335 - DNA, 22 bp, Artificial Sequence
  chemically synthesized
ctaagctgcctgtccgtaagaa

SEQ ID NO: 842336 - DNA, 22 bp, Artificial Sequence
  chemically synthesized
agctgcctgtccgtaagaatca

SEQ ID NO: 842337 - DNA, 22 bp, Artificial Sequence
  chemically synthesized
cctgtccgtaagaatcaccaaa

SEQ ID NO: 842338 - DNA, 22 bp, Artificial Sequence
  chemically synthesized
tccgtaagaatcaccaaacctt

SEQ ID NO: 842339 - DNA, 22 bp, Artificial Sequence
  chemically synthesized
gagggaggcaaaaaggtttggt

SEQ ID NO: 842340 - DNA, 22 bp, Artificial Sequence
  chemically synthesized
tggagggaggcaaaaaggtttg

SEQ ID NO: 842341 - DNA, 22 bp, Artificial Sequence
  chemically synthesized
gttctggagggaggcaaaaagg

SEQ ID NO: 842342 - DNA, 22 bp, Artificial Sequence
  chemically synthesized
attagttctggagggaggcaaa

SEQ ID NO: 842343 - DNA, 22 bp, Artificial Sequence
  chemically synthesized
catattcattagttctggaggg

SEQ ID NO: 842344 - DNA, 22 bp, Artificial Sequence
  chemically synthesized
tttgcctccctccagaactaat

SEQ ID NO: 842345 - DNA, 22 bp, Artificial Sequence
  chemically synthesized
cactacatattcattagttctg

SEQ ID NO: 842346 - DNA, 22 bp, Artificial Sequence
  chemically synthesized
ttgcctccctccagaactaatg

SEQ ID NO: 842347 - DNA, 22 bp, Artificial Sequence
  chemically synthesized
ccactacatattcattagttct

SEQ ID NO: 842348 - DNA, 22 bp, Artificial Sequence
  chemically synthesized
tgcctccctccagaactaatga

SEQ ID NO: 842349 - DNA, 22 bp, Artificial Sequence
  chemically synthesized
tccactacatattcattagttc

SEQ ID NO: 842350 - DNA, 22 bp, Artificial Sequence
  chemically synthesized
gcctccctccagaactaatgaa

SEQ ID NO: 842351 - DNA, 22 bp, Artificial Sequence
  chemically synthesized
cctccctccagaactaatgaat

SEQ ID NO: 842352 - DNA, 22 bp, Artificial Sequence
  chemically synthesized
cctccagaactaatgaatatgt

SEQ ID NO: 842353 - DNA, 22 bp, Artificial Sequence
  chemically synthesized
cagccctttccactacatattc

SEQ ID NO: 842354 - DNA, 22 bp, Artificial Sequence
  chemically synthesized
gcagccctttccactacatatt

SEQ ID NO: 842355 - DNA, 22 bp, Artificial Sequence
  chemically synthesized
cagaactaatgaatatgtagtg

SEQ ID NO: 842356 - DNA, 22 bp, Artificial Sequence
  chemically synthesized
atgaatatgtagtggaaagggc

SEQ ID NO: 842357 - DNA, 22 bp, Artificial Sequence
  chemically synthesized
aaatgcaagatttgcagccctt

SEQ ID NO: 842358 - DNA, 22 bp, Artificial Sequence
  chemically synthesized
aaaatgcaagatttgcagccct

SEQ ID NO: 842359 - DNA, 22 bp, Artificial Sequence
  chemically synthesized
tttaaaatgcaagatttgcagc

SEQ ID NO: 842360 - DNA, 22 bp, Artificial Sequence
  chemically synthesized
atttaaaatgcaagatttgcag

SEQ ID NO: 842361 - DNA, 22 bp, Artificial Sequence
  chemically synthesized
gataatttatttaaaatgcaag

SEQ ID NO: 842362 - DNA, 22 bp, Artificial Sequence
  chemically synthesized
attagataatttatttaaaatg

SEQ ID NO: 842363 - DNA, 22 bp, Artificial Sequence
  chemically synthesized
caaatcttgcattttaaataaa

SEQ ID NO: 842364 - DNA, 22 bp, Artificial Sequence
  chemically synthesized
gcattttaaataaattatctaa

SEQ ID NO: 842365 - DNA, 22 bp, Artificial Sequence
  chemically synthesized
cattttaaataaattatctaat

SEQ ID NO: 842366 - DNA, 22 bp, Artificial Sequence
  chemically synthesized
aatcataaaagttaattagata

SEQ ID NO: 842367 - DNA, 22 bp, Artificial Sequence
  chemically synthesized
taaataaattatctaattaact

SEQ ID NO: 842368 - DNA, 22 bp, Artificial Sequence
  chemically synthesized
aaataaattatctaattaactt

SEQ ID NO: 842369 - DNA, 22 bp, Artificial Sequence
  chemically synthesized
cctaaatcataaaagttaatta

SEQ ID NO: 842370 - DNA, 22 bp, Artificial Sequence
  chemically synthesized
aataaattatctaattaacttt

SEQ ID NO: 842371 - DNA, 22 bp, Artificial Sequence
  chemically synthesized
gcctaaatcataaaagttaatt

SEQ ID NO: 842372 - DNA, 22 bp, Artificial Sequence
  chemically synthesized
caaacttgcctaaatcataaaa

SEQ ID NO: 842373 - DNA, 22 bp, Artificial Sequence
  chemically synthesized
tctaattaacttttatgattta

SEQ ID NO: 842374 - DNA, 22 bp, Artificial Sequence
  chemically synthesized
tccaaacttgcctaaatcataa

SEQ ID NO: 842375 - DNA, 22 bp, Artificial Sequence
  chemically synthesized
attaacttttatgatttaggca

SEQ ID NO: 842376 - DNA, 22 bp, Artificial Sequence
  chemically synthesized
atgctctccaaacttgcctaaa

SEQ ID NO: 842377 - DNA, 22 bp, Artificial Sequence
  chemically synthesized
acttttatgatttaggcaagtt

SEQ ID NO: 842378 - DNA, 22 bp, Artificial Sequence
  chemically synthesized
ttatgatttaggcaagtttgga

SEQ ID NO: 842379 - DNA, 22 bp, Artificial Sequence
  chemically synthesized
tatgatttaggcaagtttggag

SEQ ID NO: 842380 - DNA, 22 bp, Artificial Sequence
  chemically synthesized
taatctgatgctctccaaactt

SEQ ID NO: 842381 - DNA, 22 bp, Artificial Sequence
  chemically synthesized
atgatttaggcaagtttggaga

SEQ ID NO: 842382 - DNA, 22 bp, Artificial Sequence
  chemically synthesized
tgatttaggcaagtttggagag

SEQ ID NO: 842383 - DNA, 22 bp, Artificial Sequence
  chemically synthesized
acctgtaatctgatgctctcca

SEQ ID NO: 842384 - DNA, 22 bp, Artificial Sequence
  chemically synthesized
aggcaagtttggagagcatcag

SEQ ID NO: 842385 - DNA, 22 bp, Artificial Sequence
  chemically synthesized
ggcaagtttggagagcatcaga

SEQ ID NO: 842386 - DNA, 22 bp, Artificial Sequence
  chemically synthesized
ggagagcatcagattacaggtt

SEQ ID NO: 842387 - DNA, 22 bp, Artificial Sequence
  chemically synthesized
gagagcatcagattacaggtta

SEQ ID NO: 842388 - DNA, 22 bp, Artificial Sequence
  chemically synthesized
taatacaggggaataggaatac

SEQ ID NO: 842389 - DNA, 22 bp, Artificial Sequence
  chemically synthesized
ataatacaggggaataggaata

SEQ ID NO: 842390 - DNA, 22 bp, Artificial Sequence
  chemically synthesized
caggttagtattcctattcccc

SEQ ID NO: 842391 - DNA, 22 bp, Artificial Sequence
  chemically synthesized
aagtcatttataatacagggga

SEQ ID NO: 842392 - DNA, 22 bp, Artificial Sequence
  chemically synthesized
gtattcctattcccctgtatta

SEQ ID NO: 842393 - DNA, 22 bp, Artificial Sequence
  chemically synthesized
tattaaagtcatttataataca

SEQ ID NO: 842394 - DNA, 22 bp, Artificial Sequence
  chemically synthesized
ctattcccctgtattataaatg

SEQ ID NO: 842395 - DNA, 22 bp, Artificial Sequence
  chemically synthesized
ttcccctgtattataaatgact

SEQ ID NO: 842396 - DNA, 22 bp, Artificial Sequence
  chemically synthesized
ccctgtattataaatgacttta

SEQ ID NO: 842397 - DNA, 22 bp, Artificial Sequence
  chemically synthesized
aaatagtgctatattaaagtca

SEQ ID NO: 842398 - DNA, 22 bp, Artificial Sequence
  chemically synthesized
aaaatagtgctatattaaagtc

SEQ ID NO: 842399 - DNA, 22 bp, Artificial Sequence
  chemically synthesized
tattataaatgactttaatata

SEQ ID NO: 842400 - DNA, 22 bp, Artificial Sequence
  chemically synthesized
tttaaaatagtgctatattaaa

SEQ ID NO: 842401 - DNA, 22 bp, Artificial Sequence
  chemically synthesized
atttaaaatagtgctatattaa

SEQ ID NO: 842402 - DNA, 22 bp, Artificial Sequence
  chemically synthesized
tatttaaaatagtgctatatta

SEQ ID NO: 842403 - DNA, 22 bp, Artificial Sequence
  chemically synthesized
ttatttaaaatagtgctatatt

SEQ ID NO: 842404 - DNA, 22 bp, Artificial Sequence
  chemically synthesized
taaatgactttaatatagcact

SEQ ID NO: 842405 - DNA, 22 bp, Artificial Sequence
  chemically synthesized
tatttttatttaaaatagtgct

SEQ ID NO: 842406 - DNA, 22 bp, Artificial Sequence
  chemically synthesized
gtatttttatttaaaatagtgc

SEQ ID NO: 842407 - DNA, 22 bp, Artificial Sequence
  chemically synthesized
taatatagcactattttaaata

SEQ ID NO: 842408 - DNA, 22 bp, Artificial Sequence
  chemically synthesized
tatttgtatttttatttaaaat

SEQ ID NO: 842409 - DNA, 22 bp, Artificial Sequence
  chemically synthesized
aatatagcactattttaaataa

SEQ ID NO: 842410 - DNA, 22 bp, Artificial Sequence
  chemically synthesized
atatagcactattttaaataaa

SEQ ID NO: 842411 - DNA, 22 bp, Artificial Sequence
  chemically synthesized
ttatatttgtatttttatttaa

SEQ ID NO: 842412 - DNA, 22 bp, Artificial Sequence
  chemically synthesized
attatatttgtatttttattta

SEQ ID NO: 842413 - DNA, 22 bp, Artificial Sequence
  chemically synthesized
tattatatttgtatttttattt

SEQ ID NO: 842414 - DNA, 22 bp, Artificial Sequence
  chemically synthesized
actttattatatttgtattttt

SEQ ID NO: 842415 - DNA, 22 bp, Artificial Sequence
  chemically synthesized
ttaactttattatatttgtatt

SEQ ID NO: 842416 - DNA, 22 bp, Artificial Sequence
  chemically synthesized
ttttaaataaaaatacaaatat

SEQ ID NO: 842417 - DNA, 22 bp, Artificial Sequence
  chemically synthesized
taaataaaaatacaaatataat

SEQ ID NO: 842418 - DNA, 22 bp, Artificial Sequence
  chemically synthesized
aaataaaaatacaaatataata

SEQ ID NO: 842419 - DNA, 22 bp, Artificial Sequence
  chemically synthesized
aataaaaatacaaatataataa

SEQ ID NO: 842420 - DNA, 22 bp, Artificial Sequence
  chemically synthesized
aaaattgttaactttattatat

SEQ ID NO: 842421 - DNA, 22 bp, Artificial Sequence
  chemically synthesized
taaattaaaaattgttaacttt

SEQ ID NO: 842422 - DNA, 22 bp, Artificial Sequence
  chemically synthesized
cctataaattaaaaattgttaa

SEQ ID NO: 842423 - DNA, 22 bp, Artificial Sequence
  chemically synthesized
ctacctataaattaaaaattgt

SEQ ID NO: 842424 - DNA, 22 bp, Artificial Sequence
  chemically synthesized
cattactacctataaattaaaa

SEQ ID NO: 842425 - DNA, 22 bp, Artificial Sequence
  chemically synthesized
acattactacctataaattaaa

SEQ ID NO: 842426 - DNA, 22 bp, Artificial Sequence
  chemically synthesized
acaatttttaatttataggtag

SEQ ID NO: 842427 - DNA, 22 bp, Artificial Sequence
  chemically synthesized
atgatttacattactacctata

SEQ ID NO: 842428 - DNA, 22 bp, Artificial Sequence
  chemically synthesized
aatgatttacattactacctat

SEQ ID NO: 842429 - DNA, 22 bp, Artificial Sequence
  chemically synthesized
ttaatttataggtagtaatgta

SEQ ID NO: 842430 - DNA, 22 bp, Artificial Sequence
  chemically synthesized
taatttataggtagtaatgtaa

SEQ ID NO: 842431 - DNA, 22 bp, Artificial Sequence
  chemically synthesized
aatttataggtagtaatgtaaa

SEQ ID NO: 842432 - DNA, 22 bp, Artificial Sequence
  chemically synthesized
atttataggtagtaatgtaaat

SEQ ID NO: 842433 - DNA, 22 bp, Artificial Sequence
  chemically synthesized
ataggtagtaatgtaaatcatt

SEQ ID NO: 842434 - DNA, 22 bp, Artificial Sequence
  chemically synthesized
taggtagtaatgtaaatcatta

SEQ ID NO: 842435 - DNA, 22 bp, Artificial Sequence
  chemically synthesized
aagaaagggaagaatatcttaa

SEQ ID NO: 842436 - DNA, 22 bp, Artificial Sequence
  chemically synthesized
agatattcttccctttcttcag

SEQ ID NO: 842437 - DNA, 22 bp, Artificial Sequence
  chemically synthesized
ttccctttcttcagtgtctatt

SEQ ID NO: 842438 - DNA, 22 bp, Artificial Sequence
  chemically synthesized
agatgacagagaaaatagacac

SEQ ID NO: 842439 - DNA, 22 bp, Artificial Sequence
  chemically synthesized
ccctttcttcagtgtctatttt

SEQ ID NO: 842440 - DNA, 22 bp, Artificial Sequence
  chemically synthesized
cctttcttcagtgtctattttc

SEQ ID NO: 842441 - DNA, 22 bp, Artificial Sequence
  chemically synthesized
tcttcagtgtctattttctctg

SEQ ID NO: 842442 - DNA, 22 bp, Artificial Sequence
  chemically synthesized
cttcagtgtctattttctctgt

SEQ ID NO: 842443 - DNA, 22 bp, Artificial Sequence
  chemically synthesized
ttcagtgtctattttctctgtc

SEQ ID NO: 842444 - DNA, 22 bp, Artificial Sequence
  chemically synthesized
gagagactaagatgacagagaa

SEQ ID NO: 842445 - DNA, 22 bp, Artificial Sequence
  chemically synthesized
cagtgtctattttctctgtcat

SEQ ID NO: 842446 - DNA, 22 bp, Artificial Sequence
  chemically synthesized
agtgtctattttctctgtcatc

SEQ ID NO: 842447 - DNA, 22 bp, Artificial Sequence
  chemically synthesized
aatctagagagactaagatgac

SEQ ID NO: 842448 - DNA, 22 bp, Artificial Sequence
  chemically synthesized
aaatctagagagactaagatga

SEQ ID NO: 842449 - DNA, 22 bp, Artificial Sequence
  chemically synthesized
ttttctctgtcatcttagtctc

SEQ ID NO: 842450 - DNA, 22 bp, Artificial Sequence
  chemically synthesized
tctctgtcatcttagtctctct

SEQ ID NO: 842451 - DNA, 22 bp, Artificial Sequence
  chemically synthesized
ctctgtcatcttagtctctcta

SEQ ID NO: 842452 - DNA, 22 bp, Artificial Sequence
  chemically synthesized
tctgtcatcttagtctctctag

SEQ ID NO: 842453 - DNA, 22 bp, Artificial Sequence
  chemically synthesized
tggtccttaaatctagagagac

SEQ ID NO: 842454 - DNA, 22 bp, Artificial Sequence
  chemically synthesized
tgtcatcttagtctctctagat

SEQ ID NO: 842455 - DNA, 22 bp, Artificial Sequence
  chemically synthesized
tcatcttagtctctctagattt

SEQ ID NO: 842456 - DNA, 22 bp, Artificial Sequence
  chemically synthesized
agattgtggtccttaaatctag

SEQ ID NO: 842457 - DNA, 22 bp, Artificial Sequence
  chemically synthesized
tgagattgtggtccttaaatct

SEQ ID NO: 842458 - DNA, 22 bp, Artificial Sequence
  chemically synthesized
agtctctctagatttaaggacc

SEQ ID NO: 842459 - DNA, 22 bp, Artificial Sequence
  chemically synthesized
gtctctctagatttaaggacca

SEQ ID NO: 842460 - DNA, 22 bp, Artificial Sequence
  chemically synthesized
tctagatttaaggaccacaatc

SEQ ID NO: 842461 - DNA, 22 bp, Artificial Sequence
  chemically synthesized
tagatttaaggaccacaatctc

SEQ ID NO: 842462 - DNA, 22 bp, Artificial Sequence
  chemically synthesized
ataaatacctctgagattgtgg

SEQ ID NO: 842463 - DNA, 22 bp, Artificial Sequence
  chemically synthesized
cataaatacctctgagattgtg

SEQ ID NO: 842464 - DNA, 22 bp, Artificial Sequence
  chemically synthesized
gatttaaggaccacaatctcag

SEQ ID NO: 842465 - DNA, 22 bp, Artificial Sequence
  chemically synthesized
ttcataaatacctctgagattg

SEQ ID NO: 842466 - DNA, 22 bp, Artificial Sequence
  chemically synthesized
cttcataaatacctctgagatt

SEQ ID NO: 842467 - DNA, 22 bp, Artificial Sequence
  chemically synthesized
aaggaccacaatctcagaggta

SEQ ID NO: 842468 - DNA, 22 bp, Artificial Sequence
  chemically synthesized
aggaccacaatctcagaggtat

SEQ ID NO: 842469 - DNA, 22 bp, Artificial Sequence
  chemically synthesized
ataaatttcttcataaatacct

SEQ ID NO: 842470 - DNA, 22 bp, Artificial Sequence
  chemically synthesized
cataaatttcttcataaatacc

SEQ ID NO: 842471 - DNA, 22 bp, Artificial Sequence
  chemically synthesized
tcataaatttcttcataaatac

SEQ ID NO: 842472 - DNA, 22 bp, Artificial Sequence
  chemically synthesized
ttcataaatttcttcataaata

SEQ ID NO: 842473 - DNA, 22 bp, Artificial Sequence
  chemically synthesized
tttcataaatttcttcataaat

SEQ ID NO: 842474 - DNA, 22 bp, Artificial Sequence
  chemically synthesized
ttttcataaatttcttcataaa

SEQ ID NO: 842475 - DNA, 22 bp, Artificial Sequence
  chemically synthesized
tttttcataaatttcttcataa

SEQ ID NO: 842476 - DNA, 22 bp, Artificial Sequence
  chemically synthesized
agaggtatttatgaagaaattt

SEQ ID NO: 842477 - DNA, 22 bp, Artificial Sequence
  chemically synthesized
gtcagatgcctttttttcataa

SEQ ID NO: 842478 - DNA, 22 bp, Artificial Sequence
  chemically synthesized
atgaagaaatttatgaaaaaaa

SEQ ID NO: 842479 - DNA, 22 bp, Artificial Sequence
  chemically synthesized
tgaagaaatttatgaaaaaaag

SEQ ID NO: 842480 - DNA, 22 bp, Artificial Sequence
  chemically synthesized
gaaccagagctagtcagatgcc

SEQ ID NO: 842481 - DNA, 22 bp, Artificial Sequence
  chemically synthesized
agaaccagagctagtcagatgc

SEQ ID NO: 842482 - DNA, 22 bp, Artificial Sequence
  chemically synthesized
atgaaaaaaaggcatctgacta

SEQ ID NO: 842483 - DNA, 22 bp, Artificial Sequence
  chemically synthesized
tagaaccagagctagtcagatg

SEQ ID NO: 842484 - DNA, 22 bp, Artificial Sequence
  chemically synthesized
tgaaaaaaaggcatctgactag

SEQ ID NO: 842485 - DNA, 22 bp, Artificial Sequence
  chemically synthesized
agttttagaaccagagctagtc

SEQ ID NO: 842486 - DNA, 22 bp, Artificial Sequence
  chemically synthesized
ctgagttttagaaccagagcta

SEQ ID NO: 842487 - DNA, 22 bp, Artificial Sequence
  chemically synthesized
actgagttttagaaccagagct

SEQ ID NO: 842488 - DNA, 22 bp, Artificial Sequence
  chemically synthesized
actagctctggttctaaaactc

SEQ ID NO: 842489 - DNA, 22 bp, Artificial Sequence
  chemically synthesized
aaataaaatttactgagtttta

SEQ ID NO: 842490 - DNA, 22 bp, Artificial Sequence
  chemically synthesized
gctctggttctaaaactcagta

SEQ ID NO: 842491 - DNA, 22 bp, Artificial Sequence
  chemically synthesized
tggttctaaaactcagtaaatt

SEQ ID NO: 842492 - DNA, 22 bp, Artificial Sequence
  chemically synthesized
gttctaaaactcagtaaatttt

SEQ ID NO: 842493 - DNA, 22 bp, Artificial Sequence
  chemically synthesized
cccaattaaaataaaatttact

SEQ ID NO: 842494 - DNA, 22 bp, Artificial Sequence
  chemically synthesized
ccccaattaaaataaaatttac

SEQ ID NO: 842495 - DNA, 22 bp, Artificial Sequence
  chemically synthesized
tccccaattaaaataaaattta

SEQ ID NO: 842496 - DNA, 22 bp, Artificial Sequence
  chemically synthesized
taaaactcagtaaattttattt

SEQ ID NO: 842497 - DNA, 22 bp, Artificial Sequence
  chemically synthesized
aaactcagtaaattttatttta

SEQ ID NO: 842498 - DNA, 22 bp, Artificial Sequence
  chemically synthesized
tattttccccaattaaaataaa

SEQ ID NO: 842499 - DNA, 22 bp, Artificial Sequence
  chemically synthesized
gtattttccccaattaaaataa

SEQ ID NO: 842500 - DNA, 22 bp, Artificial Sequence
  chemically synthesized
cttgtattttccccaattaaaa

SEQ ID NO: 842501 - DNA, 22 bp, Artificial Sequence
  chemically synthesized
agtaaattttattttaattggg

SEQ ID NO: 842502 - DNA, 22 bp, Artificial Sequence
  chemically synthesized
tattttaattggggaaaataca

SEQ ID NO: 842503 - DNA, 22 bp, Artificial Sequence
  chemically synthesized
attttaattggggaaaatacaa

SEQ ID NO: 842504 - DNA, 22 bp, Artificial Sequence
  chemically synthesized
ttttaattggggaaaatacaag

SEQ ID NO: 842505 - DNA, 22 bp, Artificial Sequence
  chemically synthesized
acagtaaatattacttgtattt

SEQ ID NO: 842506 - DNA, 22 bp, Artificial Sequence
  chemically synthesized
taattggggaaaatacaagtaa

SEQ ID NO: 842507 - DNA, 22 bp, Artificial Sequence
  chemically synthesized
aattggggaaaatacaagtaat

SEQ ID NO: 842508 - DNA, 22 bp, Artificial Sequence
  chemically synthesized
attggggaaaatacaagtaata

SEQ ID NO: 842509 - DNA, 22 bp, Artificial Sequence
  chemically synthesized
taaactaacagtaaatattact

SEQ ID NO: 842510 - DNA, 22 bp, Artificial Sequence
  chemically synthesized
gggaaaatacaagtaatattta

SEQ ID NO: 842511 - DNA, 22 bp, Artificial Sequence
  chemically synthesized
ataaactaacagtaaatattac

SEQ ID NO: 842512 - DNA, 22 bp, Artificial Sequence
  chemically synthesized
cttataaactaacagtaaatat

SEQ ID NO: 842513 - DNA, 22 bp, Artificial Sequence
  chemically synthesized
tcacatattgcttataaactaa

SEQ ID NO: 842514 - DNA, 22 bp, Artificial Sequence
  chemically synthesized
actgttagtttataagcaatat

SEQ ID NO: 842515 - DNA, 22 bp, Artificial Sequence
  chemically synthesized
ctgttagtttataagcaatatg

SEQ ID NO: 842516 - DNA, 22 bp, Artificial Sequence
  chemically synthesized
ttagtttataagcaatatgtga

SEQ ID NO: 842517 - DNA, 22 bp, Artificial Sequence
  chemically synthesized
gtttataagcaatatgtgacag

SEQ ID NO: 842518 - DNA, 22 bp, Artificial Sequence
  chemically synthesized
ataagcaatatgtgacagatgt

SEQ ID NO: 842519 - DNA, 22 bp, Artificial Sequence
  chemically synthesized
taagcaatatgtgacagatgtt

SEQ ID NO: 842520 - DNA, 22 bp, Artificial Sequence
  chemically synthesized
taagaaaaaaatgagaaaatat

SEQ ID NO: 842521 - DNA, 22 bp, Artificial Sequence
  chemically synthesized
ttataagaaaaaaatgagaaaa

SEQ ID NO: 842522 - DNA, 22 bp, Artificial Sequence
  chemically synthesized
tatctatattttctcatttttt

SEQ ID NO: 842523 - DNA, 22 bp, Artificial Sequence
  chemically synthesized
atctatattttctcattttttt

SEQ ID NO: 842524 - DNA, 22 bp, Artificial Sequence
  chemically synthesized
tctatattttctcatttttttc

SEQ ID NO: 842525 - DNA, 22 bp, Artificial Sequence
  chemically synthesized
gtgtggttattataagaaaaaa

SEQ ID NO: 842526 - DNA, 22 bp, Artificial Sequence
  chemically synthesized
tattttctcatttttttcttat

SEQ ID NO: 842527 - DNA, 22 bp, Artificial Sequence
  chemically synthesized
ctagtgtggttattataagaaa

SEQ ID NO: 842528 - DNA, 22 bp, Artificial Sequence
  chemically synthesized
actagtgtggttattataagaa

SEQ ID NO: 842529 - DNA, 22 bp, Artificial Sequence
  chemically synthesized
tctcatttttttcttataataa

SEQ ID NO: 842530 - DNA, 22 bp, Artificial Sequence
  chemically synthesized
ctcatttttttcttataataac

SEQ ID NO: 842531 - DNA, 22 bp, Artificial Sequence
  chemically synthesized
tttactagtgtggttattataa

SEQ ID NO: 842532 - DNA, 22 bp, Artificial Sequence
  chemically synthesized
tcatttttttcttataataacc

SEQ ID NO: 842533 - DNA, 22 bp, Artificial Sequence
  chemically synthesized
gtttactagtgtggttattata

SEQ ID NO: 842534 - DNA, 22 bp, Artificial Sequence
  chemically synthesized
atttttttcttataataaccac

SEQ ID NO: 842535 - DNA, 22 bp, Artificial Sequence
  chemically synthesized
gcttgtttactagtgtggttat

SEQ ID NO: 842536 - DNA, 22 bp, Artificial Sequence
  chemically synthesized
ttttcttataataaccacacta

SEQ ID NO: 842537 - DNA, 22 bp, Artificial Sequence
  chemically synthesized
tttcttataataaccacactag

SEQ ID NO: 842538 - DNA, 22 bp, Artificial Sequence
  chemically synthesized
ctggcttgtttactagtgtggt

SEQ ID NO: 842539 - DNA, 22 bp, Artificial Sequence
  chemically synthesized
ttcttataataaccacactagt

SEQ ID NO: 842540 - DNA, 22 bp, Artificial Sequence
  chemically synthesized
gctggcttgtttactagtgtgg

SEQ ID NO: 842541 - DNA, 22 bp, Artificial Sequence
  chemically synthesized
tcttataataaccacactagta

SEQ ID NO: 842542 - DNA, 22 bp, Artificial Sequence
  chemically synthesized
cttataataaccacactagtaa

SEQ ID NO: 842543 - DNA, 22 bp, Artificial Sequence
  chemically synthesized
ttataataaccacactagtaaa

SEQ ID NO: 842544 - DNA, 22 bp, Artificial Sequence
  chemically synthesized
ataataaccacactagtaaaca

SEQ ID NO: 842545 - DNA, 22 bp, Artificial Sequence
  chemically synthesized
taataaccacactagtaaacaa

SEQ ID NO: 842546 - DNA, 22 bp, Artificial Sequence
  chemically synthesized
tacaaacttgctggcttgttta

SEQ ID NO: 842547 - DNA, 22 bp, Artificial Sequence
  chemically synthesized
aaattatacaaacttgctggct

SEQ ID NO: 842548 - DNA, 22 bp, Artificial Sequence
  chemically synthesized
aaaattatacaaacttgctggc

SEQ ID NO: 842549 - DNA, 22 bp, Artificial Sequence
  chemically synthesized
gtaaacaagccagcaagtttgt

SEQ ID NO: 842550 - DNA, 22 bp, Artificial Sequence
  chemically synthesized
atgtggtagaacatcatattta

SEQ ID NO: 842551 - DNA, 22 bp, Artificial Sequence
  chemically synthesized
gtataattttaaatatgatgtt

SEQ ID NO: 842552 - DNA, 22 bp, Artificial Sequence
  chemically synthesized
tataattttaaatatgatgttc

SEQ ID NO: 842553 - DNA, 22 bp, Artificial Sequence
  chemically synthesized
gcctcatgtggtagaacatcat

SEQ ID NO: 842554 - DNA, 22 bp, Artificial Sequence
  chemically synthesized
attggcctcatgtggtagaaca

SEQ ID NO: 842555 - DNA, 22 bp, Artificial Sequence
  chemically synthesized
cattggcctcatgtggtagaac

SEQ ID NO: 842556 - DNA, 22 bp, Artificial Sequence
  chemically synthesized
taaatatgatgttctaccacat

SEQ ID NO: 842557 - DNA, 22 bp, Artificial Sequence
  chemically synthesized
aaatatgatgttctaccacatg

SEQ ID NO: 842558 - DNA, 22 bp, Artificial Sequence
  chemically synthesized
aatatgatgttctaccacatga

SEQ ID NO: 842559 - DNA, 22 bp, Artificial Sequence
  chemically synthesized
atcttcattggcctcatgtggt

SEQ ID NO: 842560 - DNA, 22 bp, Artificial Sequence
  chemically synthesized
catcttcattggcctcatgtgg

SEQ ID NO: 842561 - DNA, 22 bp, Artificial Sequence
  chemically synthesized
ttcatcttcattggcctcatgt

SEQ ID NO: 842562 - DNA, 22 bp, Artificial Sequence
  chemically synthesized
atctcttcatcttcattggcct

SEQ ID NO: 842563 - DNA, 22 bp, Artificial Sequence
  chemically synthesized
catctcttcatcttcattggcc

SEQ ID NO: 842564 - DNA, 22 bp, Artificial Sequence
  chemically synthesized
tcatctcttcatcttcattggc

SEQ ID NO: 842565 - DNA, 22 bp, Artificial Sequence
  chemically synthesized
taccacatgaggccaatgaaga

SEQ ID NO: 842566 - DNA, 22 bp, Artificial Sequence
  chemically synthesized
ccacatgaggccaatgaagatg

SEQ ID NO: 842567 - DNA, 22 bp, Artificial Sequence
  chemically synthesized
ccactttcatctcttcatcttc

SEQ ID NO: 842568 - DNA, 22 bp, Artificial Sequence
  chemically synthesized
tctaccactttcatctcttcat

SEQ ID NO: 842569 - DNA, 22 bp, Artificial Sequence
  chemically synthesized
ctatctaccactttcatctctt

SEQ ID NO: 842570 - DNA, 22 bp, Artificial Sequence
  chemically synthesized
agatacattactatctaccact

SEQ ID NO: 842571 - DNA, 22 bp, Artificial Sequence
  chemically synthesized
cagatacattactatctaccac

SEQ ID NO: 842572 - DNA, 22 bp, Artificial Sequence
  chemically synthesized
atataagtttcagatacattac

SEQ ID NO: 842573 - DNA, 22 bp, Artificial Sequence
  chemically synthesized
catataagtttcagatacatta

SEQ ID NO: 842574 - DNA, 22 bp, Artificial Sequence
  chemically synthesized
agtttcatataagtttcagata

SEQ ID NO: 842575 - DNA, 22 bp, Artificial Sequence
  chemically synthesized
aaacttatatgaaacttagtta

SEQ ID NO: 842576 - DNA, 22 bp, Artificial Sequence
  chemically synthesized
atatgaaacttagttatttact

SEQ ID NO: 842577 - DNA, 22 bp, Artificial Sequence
  chemically synthesized
tatgaaacttagttatttactc

SEQ ID NO: 842578 - DNA, 22 bp, Artificial Sequence
  chemically synthesized
agttatttactctgtactttga

SEQ ID NO: 842579 - DNA, 22 bp, Artificial Sequence
  chemically synthesized
gttatttactctgtactttgac

SEQ ID NO: 842580 - DNA, 22 bp, Artificial Sequence
  chemically synthesized
gaaaatcagcaggagtcaaagt

SEQ ID NO: 842581 - DNA, 22 bp, Artificial Sequence
  chemically synthesized
tttactctgtactttgactcct

SEQ ID NO: 842582 - DNA, 22 bp, Artificial Sequence
  chemically synthesized
gttagaaaatcagcaggagtca

SEQ ID NO: 842583 - DNA, 22 bp, Artificial Sequence
  chemically synthesized
actctgtactttgactcctgct

SEQ ID NO: 842584 - DNA, 22 bp, Artificial Sequence
  chemically synthesized
ctctgtactttgactcctgctg

SEQ ID NO: 842585 - DNA, 22 bp, Artificial Sequence
  chemically synthesized
tgtactttgactcctgctgatt

SEQ ID NO: 842586 - DNA, 22 bp, Artificial Sequence
  chemically synthesized
tactttgactcctgctgatttt

SEQ ID NO: 842587 - DNA, 22 bp, Artificial Sequence
  chemically synthesized
tgactcctgctgattttctaac

SEQ ID NO: 842588 - DNA, 22 bp, Artificial Sequence
  chemically synthesized
gactcctgctgattttctaacg

SEQ ID NO: 842589 - DNA, 22 bp, Artificial Sequence
  chemically synthesized
actcctgctgattttctaacga

SEQ ID NO: 842590 - DNA, 22 bp, Artificial Sequence
  chemically synthesized
caaaaccaaaattcgttagaaa

SEQ ID NO: 842591 - DNA, 22 bp, Artificial Sequence
  chemically synthesized
ccaaaaccaaaattcgttagaa

SEQ ID NO: 842592 - DNA, 22 bp, Artificial Sequence
  chemically synthesized
tccaaaaccaaaattcgttaga

SEQ ID NO: 842593 - DNA, 22 bp, Artificial Sequence
  chemically synthesized
ctgctgattttctaacgaattt

SEQ ID NO: 842594 - DNA, 22 bp, Artificial Sequence
  chemically synthesized
ctgattttctaacgaattttgg

SEQ ID NO: 842595 - DNA, 22 bp, Artificial Sequence
  chemically synthesized
gcctttccaaaaccaaaattcg

SEQ ID NO: 842596 - DNA, 22 bp, Artificial Sequence
  chemically synthesized
ggcctttccaaaaccaaaattc

SEQ ID NO: 842597 - DNA, 22 bp, Artificial Sequence
  chemically synthesized
attttctaacgaattttggttt

SEQ ID NO: 842598 - DNA, 22 bp, Artificial Sequence
  chemically synthesized
tctaacgaattttggttttgga

SEQ ID NO: 842599 - DNA, 22 bp, Artificial Sequence
  chemically synthesized
ctaacgaattttggttttggaa

SEQ ID NO: 842600 - DNA, 22 bp, Artificial Sequence
  chemically synthesized
taacgaattttggttttggaaa

SEQ ID NO: 842601 - DNA, 22 bp, Artificial Sequence
  chemically synthesized
acgaattttggttttggaaagg

SEQ ID NO: 842602 - DNA, 22 bp, Artificial Sequence
  chemically synthesized
cagaatgatcaaaatttggcct

SEQ ID NO: 842603 - DNA, 22 bp, Artificial Sequence
  chemically synthesized
tggttttggaaaggccaaattt

SEQ ID NO: 842604 - DNA, 22 bp, Artificial Sequence
  chemically synthesized
ggttttggaaaggccaaatttt

SEQ ID NO: 842605 - DNA, 22 bp, Artificial Sequence
  chemically synthesized
gttttggaaaggccaaattttg

SEQ ID NO: 842606 - DNA, 22 bp, Artificial Sequence
  chemically synthesized
tggaaaggccaaattttgatca

SEQ ID NO: 842607 - DNA, 22 bp, Artificial Sequence
  chemically synthesized
ggaaaggccaaattttgatcat

SEQ ID NO: 842608 - DNA, 22 bp, Artificial Sequence
  chemically synthesized
gaaaggccaaattttgatcatt

SEQ ID NO: 842609 - DNA, 22 bp, Artificial Sequence
  chemically synthesized
acagaagaaacactacagaatg

SEQ ID NO: 842610 - DNA, 22 bp, Artificial Sequence
  chemically synthesized
cacagaagaaacactacagaat

SEQ ID NO: 842611 - DNA, 22 bp, Artificial Sequence
  chemically synthesized
ttcacagaagaaacactacaga

SEQ ID NO: 842612 - DNA, 22 bp, Artificial Sequence
  chemically synthesized
cctcttcacagaagaaacacta

SEQ ID NO: 842613 - DNA, 22 bp, Artificial Sequence
  chemically synthesized
tgatcattctgtagtgtttctt

SEQ ID NO: 842614 - DNA, 22 bp, Artificial Sequence
  chemically synthesized
gatcattctgtagtgtttcttc

SEQ ID NO: 842615 - DNA, 22 bp, Artificial Sequence
  chemically synthesized
atcattctgtagtgtttcttct

SEQ ID NO: 842616 - DNA, 22 bp, Artificial Sequence
  chemically synthesized
cctacctcttcacagaagaaac

SEQ ID NO: 842617 - DNA, 22 bp, Artificial Sequence
  chemically synthesized
tctccctacctcttcacagaag

SEQ ID NO: 842618 - DNA, 22 bp, Artificial Sequence
  chemically synthesized
tgtagtgtttcttctgtgaaga

SEQ ID NO: 842619 - DNA, 22 bp, Artificial Sequence
  chemically synthesized
tagtgtttcttctgtgaagagg

SEQ ID NO: 842620 - DNA, 22 bp, Artificial Sequence
  chemically synthesized
cttctgtgaagaggtagggaga

SEQ ID NO: 842621 - DNA, 22 bp, Artificial Sequence
  chemically synthesized
ttctgtgaagaggtagggagac

SEQ ID NO: 842622 - DNA, 22 bp, Artificial Sequence
  chemically synthesized
aatcacaaagcctgtctcccta

SEQ ID NO: 842623 - DNA, 22 bp, Artificial Sequence
  chemically synthesized
ctgtgaagaggtagggagacag

SEQ ID NO: 842624 - DNA, 22 bp, Artificial Sequence
  chemically synthesized
aaatcacaaagcctgtctccct

SEQ ID NO: 842625 - DNA, 22 bp, Artificial Sequence
  chemically synthesized
tgtgaagaggtagggagacagg

SEQ ID NO: 842626 - DNA, 22 bp, Artificial Sequence
  chemically synthesized
tgaagaggtagggagacaggct

SEQ ID NO: 842627 - DNA, 22 bp, Artificial Sequence
  chemically synthesized
agtttaaatcacaaagcctgtc

SEQ ID NO: 842628 - DNA, 22 bp, Artificial Sequence
  chemically synthesized
ccaaaagcaattgagtttaaat

SEQ ID NO: 842629 - DNA, 22 bp, Artificial Sequence
  chemically synthesized
ttaccaaaagcaattgagttta

SEQ ID NO: 842630 - DNA, 22 bp, Artificial Sequence
  chemically synthesized
ctattaccaaaagcaattgagt

SEQ ID NO: 842631 - DNA, 22 bp, Artificial Sequence
  chemically synthesized
actattaccaaaagcaattgag

SEQ ID NO: 842632 - DNA, 22 bp, Artificial Sequence
  chemically synthesized
tgtgatttaaactcaattgctt

SEQ ID NO: 842633 - DNA, 22 bp, Artificial Sequence
  chemically synthesized
tactattaccaaaagcaattga

SEQ ID NO: 842634 - DNA, 22 bp, Artificial Sequence
  chemically synthesized
gtgatttaaactcaattgcttt

SEQ ID NO: 842635 - DNA, 22 bp, Artificial Sequence
  chemically synthesized
tgatttaaactcaattgctttt

SEQ ID NO: 842636 - DNA, 22 bp, Artificial Sequence
  chemically synthesized
ttttactattaccaaaagcaat

SEQ ID NO: 842637 - DNA, 22 bp, Artificial Sequence
  chemically synthesized
aaactcaattgcttttggtaat

SEQ ID NO: 842638 - DNA, 22 bp, Artificial Sequence
  chemically synthesized
cattattttactattaccaaaa

SEQ ID NO: 842639 - DNA, 22 bp, Artificial Sequence
  chemically synthesized
aactcaattgcttttggtaata

SEQ ID NO: 842640 - DNA, 22 bp, Artificial Sequence
  chemically synthesized
gcattattttactattaccaaa

SEQ ID NO: 842641 - DNA, 22 bp, Artificial Sequence
  chemically synthesized
tgcattattttactattaccaa

SEQ ID NO: 842642 - DNA, 22 bp, Artificial Sequence
  chemically synthesized
ttgcattattttactattacca

SEQ ID NO: 842643 - DNA, 22 bp, Artificial Sequence
  chemically synthesized
tttgcattattttactattacc

SEQ ID NO: 842644 - DNA, 22 bp, Artificial Sequence
  chemically synthesized
aattgcttttggtaatagtaaa

SEQ ID NO: 842645 - DNA, 22 bp, Artificial Sequence
  chemically synthesized
cttttggtaatagtaaaataat

SEQ ID NO: 842646 - DNA, 22 bp, Artificial Sequence
  chemically synthesized
gaaaagttttttgcattatttt

SEQ ID NO: 842647 - DNA, 22 bp, Artificial Sequence
  chemically synthesized
ttggtaatagtaaaataatgca

SEQ ID NO: 842648 - DNA, 22 bp, Artificial Sequence
  chemically synthesized
ggaaaagttttttgcattattt

SEQ ID NO: 842649 - DNA, 22 bp, Artificial Sequence
  chemically synthesized
tggtaatagtaaaataatgcaa

SEQ ID NO: 842650 - DNA, 22 bp, Artificial Sequence
  chemically synthesized
ggtaatagtaaaataatgcaaa

SEQ ID NO: 842651 - DNA, 22 bp, Artificial Sequence
  chemically synthesized
gtaatagtaaaataatgcaaaa

SEQ ID NO: 842652 - DNA, 22 bp, Artificial Sequence
  chemically synthesized
aagtagatgtacaatgtttgga

SEQ ID NO: 842653 - DNA, 22 bp, Artificial Sequence
  chemically synthesized
ttccaaacattgtacatctact

SEQ ID NO: 842654 - DNA, 22 bp, Artificial Sequence
  chemically synthesized
tccaaacattgtacatctactt

SEQ ID NO: 842655 - DNA, 22 bp, Artificial Sequence
  chemically synthesized
ccaaacattgtacatctacttt

SEQ ID NO: 842656 - DNA, 22 bp, Artificial Sequence
  chemically synthesized
caaacattgtacatctacttta

SEQ ID NO: 842657 - DNA, 22 bp, Artificial Sequence
  chemically synthesized
tacatctactttaggcactttc

SEQ ID NO: 842658 - DNA, 22 bp, Artificial Sequence
  chemically synthesized
aatacagagaggagaaagtgcc

SEQ ID NO: 842659 - DNA, 22 bp, Artificial Sequence
  chemically synthesized
caatacagagaggagaaagtgc

SEQ ID NO: 842660 - DNA, 22 bp, Artificial Sequence
  chemically synthesized
tcaatacagagaggagaaagtg

SEQ ID NO: 842661 - DNA, 22 bp, Artificial Sequence
  chemically synthesized
ttcaatacagagaggagaaagt

SEQ ID NO: 842662 - DNA, 22 bp, Artificial Sequence
  chemically synthesized
ctttaggcactttctcctctct

SEQ ID NO: 842663 - DNA, 22 bp, Artificial Sequence
  chemically synthesized
caatttttcaatacagagagga

SEQ ID NO: 842664 - DNA, 22 bp, Artificial Sequence
  chemically synthesized
taggcactttctcctctctgta

SEQ ID NO: 842665 - DNA, 22 bp, Artificial Sequence
  chemically synthesized
aggcactttctcctctctgtat

SEQ ID NO: 842666 - DNA, 22 bp, Artificial Sequence
  chemically synthesized
ggcactttctcctctctgtatt

SEQ ID NO: 842667 - DNA, 22 bp, Artificial Sequence
  chemically synthesized
gcccctccaatttttcaataca

SEQ ID NO: 842668 - DNA, 22 bp, Artificial Sequence
  chemically synthesized
tctcctctctgtattgaaaaat

SEQ ID NO: 842669 - DNA, 22 bp, Artificial Sequence
  chemically synthesized
ctcctctctgtattgaaaaatt

SEQ ID NO: 842670 - DNA, 22 bp, Artificial Sequence
  chemically synthesized
tcctctctgtattgaaaaattg

SEQ ID NO: 842671 - DNA, 22 bp, Artificial Sequence
  chemically synthesized
ctctctgtattgaaaaattgga

SEQ ID NO: 842672 - DNA, 22 bp, Artificial Sequence
  chemically synthesized
aaagttagcccctccaattttt

SEQ ID NO: 842673 - DNA, 22 bp, Artificial Sequence
  chemically synthesized
tctgtattgaaaaattggaggg

SEQ ID NO: 842674 - DNA, 22 bp, Artificial Sequence
  chemically synthesized
ttaaaagttagcccctccaatt

SEQ ID NO: 842675 - DNA, 22 bp, Artificial Sequence
  chemically synthesized
gttaaaagttagcccctccaat

SEQ ID NO: 842676 - DNA, 22 bp, Artificial Sequence
  chemically synthesized
tgtattgaaaaattggaggggc

SEQ ID NO: 842677 - DNA, 22 bp, Artificial Sequence
  chemically synthesized
tattgaaaaattggaggggcta

SEQ ID NO: 842678 - DNA, 22 bp, Artificial Sequence
  chemically synthesized
aaaaattggaggggctaacttt

SEQ ID NO: 842679 - DNA, 22 bp, Artificial Sequence
  chemically synthesized
gaggggctaacttttaacaaat

SEQ ID NO: 842680 - DNA, 22 bp, Artificial Sequence
  chemically synthesized
caaatgtggaaaatttgttaaa

SEQ ID NO: 842681 - DNA, 22 bp, Artificial Sequence
  chemically synthesized
acaaatgtggaaaatttgttaa

SEQ ID NO: 842682 - DNA, 22 bp, Artificial Sequence
  chemically synthesized
acttttaacaaattttccacat

SEQ ID NO: 842683 - DNA, 22 bp, Artificial Sequence
  chemically synthesized
ttaacaaattttccacatttgt

SEQ ID NO: 842684 - DNA, 22 bp, Artificial Sequence
  chemically synthesized
taacaaattttccacatttgta

SEQ ID NO: 842685 - DNA, 22 bp, Artificial Sequence
  chemically synthesized
aacaaattttccacatttgtaa

SEQ ID NO: 842686 - DNA, 22 bp, Artificial Sequence
  chemically synthesized
agcaatcacagcttacaaatgt

SEQ ID NO: 842687 - DNA, 22 bp, Artificial Sequence
  chemically synthesized
acaaattttccacatttgtaag

SEQ ID NO: 842688 - DNA, 22 bp, Artificial Sequence
  chemically synthesized
tgagcaatcacagcttacaaat

SEQ ID NO: 842689 - DNA, 22 bp, Artificial Sequence
  chemically synthesized
ctgagcaatcacagcttacaaa

SEQ ID NO: 842690 - DNA, 22 bp, Artificial Sequence
  chemically synthesized
tctgagcaatcacagcttacaa

SEQ ID NO: 842691 - DNA, 22 bp, Artificial Sequence
  chemically synthesized
ttctgagcaatcacagcttaca

SEQ ID NO: 842692 - DNA, 22 bp, Artificial Sequence
  chemically synthesized
tttctgagcaatcacagcttac

SEQ ID NO: 842693 - DNA, 22 bp, Artificial Sequence
  chemically synthesized
ttttctgagcaatcacagctta

SEQ ID NO: 842694 - DNA, 22 bp, Artificial Sequence
  chemically synthesized
tttttctgagcaatcacagctt

SEQ ID NO: 842695 - DNA, 22 bp, Artificial Sequence
  chemically synthesized
tccacatttgtaagctgtgatt

SEQ ID NO: 842696 - DNA, 22 bp, Artificial Sequence
  chemically synthesized
ccacatttgtaagctgtgattg

SEQ ID NO: 842697 - DNA, 22 bp, Artificial Sequence
  chemically synthesized
cacatttgtaagctgtgattgc

SEQ ID NO: 842698 - DNA, 22 bp, Artificial Sequence
  chemically synthesized
gattttttttctgagcaatcac

SEQ ID NO: 842699 - DNA, 22 bp, Artificial Sequence
  chemically synthesized
gtaagctgtgattgctcagaaa

SEQ ID NO: 842700 - DNA, 22 bp, Artificial Sequence
  chemically synthesized
taagctgtgattgctcagaaaa

SEQ ID NO: 842701 - DNA, 22 bp, Artificial Sequence
  chemically synthesized
aaaattggattttttttctgag

SEQ ID NO: 842702 - DNA, 22 bp, Artificial Sequence
  chemically synthesized
tgattgctcagaaaaaaaatcc

SEQ ID NO: 842703 - DNA, 22 bp, Artificial Sequence
  chemically synthesized
gaaacctgaaaattggattttt

SEQ ID NO: 842704 - DNA, 22 bp, Artificial Sequence
  chemically synthesized
ctcagaaaaaaaatccaatttt

SEQ ID NO: 842705 - DNA, 22 bp, Artificial Sequence
  chemically synthesized
agaaaaaaaatccaattttcag

SEQ ID NO: 842706 - DNA, 22 bp, Artificial Sequence
  chemically synthesized
tgtaaagaaaccataaaagtta

SEQ ID NO: 842707 - DNA, 22 bp, Artificial Sequence
  chemically synthesized
tcaggtttctaacttttatggt

SEQ ID NO: 842708 - DNA, 22 bp, Artificial Sequence
  chemically synthesized
ttgtgtaaagaaaccataaaag

SEQ ID NO: 842709 - DNA, 22 bp, Artificial Sequence
  chemically synthesized
caggtttctaacttttatggtt

SEQ ID NO: 842710 - DNA, 22 bp, Artificial Sequence
  chemically synthesized
aggtttctaacttttatggttt

SEQ ID NO: 842711 - DNA, 22 bp, Artificial Sequence
  chemically synthesized
tgttgtgtaaagaaaccataaa

SEQ ID NO: 842712 - DNA, 22 bp, Artificial Sequence
  chemically synthesized
ctaacttttatggtttctttac

SEQ ID NO: 842713 - DNA, 22 bp, Artificial Sequence
  chemically synthesized
taacttttatggtttctttaca

SEQ ID NO: 842714 - DNA, 22 bp, Artificial Sequence
  chemically synthesized
aaacactctgttgtgtaaagaa

SEQ ID NO: 842715 - DNA, 22 bp, Artificial Sequence
  chemically synthesized
acttttatggtttctttacaca

SEQ ID NO: 842716 - DNA, 22 bp, Artificial Sequence
  chemically synthesized
caaacactctgttgtgtaaaga

SEQ ID NO: 842717 - DNA, 22 bp, Artificial Sequence
  chemically synthesized
ttatggtttctttacacaacag

SEQ ID NO: 842718 - DNA, 22 bp, Artificial Sequence
  chemically synthesized
tatggtttctttacacaacaga

SEQ ID NO: 842719 - DNA, 22 bp, Artificial Sequence
  chemically synthesized
atggtttctttacacaacagag

SEQ ID NO: 842720 - DNA, 22 bp, Artificial Sequence
  chemically synthesized
tggtttctttacacaacagagt

SEQ ID NO: 842721 - DNA, 22 bp, Artificial Sequence
  chemically synthesized
catatttcaaacactctgttgt

SEQ ID NO: 842722 - DNA, 22 bp, Artificial Sequence
  chemically synthesized
ttccatatttcaaacactctgt

SEQ ID NO: 842723 - DNA, 22 bp, Artificial Sequence
  chemically synthesized
gttccatatttcaaacactctg

SEQ ID NO: 842724 - DNA, 22 bp, Artificial Sequence
  chemically synthesized
ctttacacaacagagtgtttga

SEQ ID NO: 842725 - DNA, 22 bp, Artificial Sequence
  chemically synthesized
tttacacaacagagtgtttgaa

SEQ ID NO: 842726 - DNA, 22 bp, Artificial Sequence
  chemically synthesized
tacacaacagagtgtttgaaat

SEQ ID NO: 842727 - DNA, 22 bp, Artificial Sequence
  chemically synthesized
acacaacagagtgtttgaaata

SEQ ID NO: 842728 - DNA, 22 bp, Artificial Sequence
  chemically synthesized
cacaacagagtgtttgaaatat

SEQ ID NO: 842729 - DNA, 22 bp, Artificial Sequence
  chemically synthesized
gcaatttgttccatatttcaaa

SEQ ID NO: 842730 - DNA, 22 bp, Artificial Sequence
  chemically synthesized
ggcaatttgttccatatttcaa

SEQ ID NO: 842731 - DNA, 22 bp, Artificial Sequence
  chemically synthesized
tggcaatttgttccatatttca

SEQ ID NO: 842732 - DNA, 22 bp, Artificial Sequence
  chemically synthesized
tctttggcaatttgttccatat

SEQ ID NO: 842733 - DNA, 22 bp, Artificial Sequence
  chemically synthesized
aatagctgtctttggcaatttg

SEQ ID NO: 842734 - DNA, 22 bp, Artificial Sequence
  chemically synthesized
gaaatatggaacaaattgccaa

SEQ ID NO: 842735 - DNA, 22 bp, Artificial Sequence
  chemically synthesized
caatagctgtctttggcaattt

SEQ ID NO: 842736 - DNA, 22 bp, Artificial Sequence
  chemically synthesized
aaatatggaacaaattgccaaa

SEQ ID NO: 842737 - DNA, 22 bp, Artificial Sequence
  chemically synthesized
cttcaatagctgtctttggcaa

SEQ ID NO: 842738 - DNA, 22 bp, Artificial Sequence
  chemically synthesized
acttcaatagctgtctttggca

SEQ ID NO: 842739 - DNA, 22 bp, Artificial Sequence
  chemically synthesized
tgccacttacttcaatagctgt

SEQ ID NO: 842740 - DNA, 22 bp, Artificial Sequence
  chemically synthesized
atgccacttacttcaatagctg

SEQ ID NO: 842741 - DNA, 22 bp, Artificial Sequence
  chemically synthesized
acttatgccacttacttcaata

SEQ ID NO: 842742 - DNA, 22 bp, Artificial Sequence
  chemically synthesized
ccaaagacagctattgaagtaa

SEQ ID NO: 842743 - DNA, 22 bp, Artificial Sequence
  chemically synthesized
cagctgacttatgccacttact

SEQ ID NO: 842744 - DNA, 22 bp, Artificial Sequence
  chemically synthesized
tccagctgacttatgccactta

SEQ ID NO: 842745 - DNA, 22 bp, Artificial Sequence
  chemically synthesized
ttgaagtaagtggcataagtca

SEQ ID NO: 842746 - DNA, 22 bp, Artificial Sequence
  chemically synthesized
agtactctccagctgacttatg

SEQ ID NO: 842747 - DNA, 22 bp, Artificial Sequence
  chemically synthesized
aagtaagtggcataagtcagct

SEQ ID NO: 842748 - DNA, 22 bp, Artificial Sequence
  chemically synthesized
ttcagtactctccagctgactt

SEQ ID NO: 842749 - DNA, 22 bp, Artificial Sequence
  chemically synthesized
gttcagtactctccagctgact

SEQ ID NO: 842750 - DNA, 22 bp, Artificial Sequence
  chemically synthesized
aaatttgttcagtactctccag

SEQ ID NO: 842751 - DNA, 22 bp, Artificial Sequence
  chemically synthesized
aaaatttgttcagtactctcca

SEQ ID NO: 842752 - DNA, 22 bp, Artificial Sequence
  chemically synthesized
taaaatttgttcagtactctcc

SEQ ID NO: 842753 - DNA, 22 bp, Artificial Sequence
  chemically synthesized
ctttaaaatttgttcagtactc

SEQ ID NO: 842754 - DNA, 22 bp, Artificial Sequence
  chemically synthesized
ctactttaaaatttgttcagta

SEQ ID NO: 842755 - DNA, 22 bp, Artificial Sequence
  chemically synthesized
gagagtactgaacaaattttaa

SEQ ID NO: 842756 - DNA, 22 bp, Artificial Sequence
  chemically synthesized
tatggttcctactttaaaattt

SEQ ID NO: 842757 - DNA, 22 bp, Artificial Sequence
  chemically synthesized
ctatatggttcctactttaaaa

SEQ ID NO: 842758 - DNA, 22 bp, Artificial Sequence
  chemically synthesized
ctactatatggttcctacttta

SEQ ID NO: 842759 - DNA, 22 bp, Artificial Sequence
  chemically synthesized
aacaaattttaaagtaggaacc

SEQ ID NO: 842760 - DNA, 22 bp, Artificial Sequence
  chemically synthesized
cctgctactatatggttcctac

SEQ ID NO: 842761 - DNA, 22 bp, Artificial Sequence
  chemically synthesized
taaagtaggaaccatatagtag

SEQ ID NO: 842762 - DNA, 22 bp, Artificial Sequence
  chemically synthesized
aaagtaggaaccatatagtagc

SEQ ID NO: 842763 - DNA, 22 bp, Artificial Sequence
  chemically synthesized
aagtaggaaccatatagtagca

SEQ ID NO: 842764 - DNA, 22 bp, Artificial Sequence
  chemically synthesized
ataaaatctacctgctactata

SEQ ID NO: 842765 - DNA, 22 bp, Artificial Sequence
  chemically synthesized
cataaaatctacctgctactat

SEQ ID NO: 842766 - DNA, 22 bp, Artificial Sequence
  chemically synthesized
tttcataaaatctacctgctac

SEQ ID NO: 842767 - DNA, 22 bp, Artificial Sequence
  chemically synthesized
atttcataaaatctacctgcta

SEQ ID NO: 842768 - DNA, 22 bp, Artificial Sequence
  chemically synthesized
gaaaacatcttatttcataaaa

SEQ ID NO: 842769 - DNA, 22 bp, Artificial Sequence
  chemically synthesized
acactggaaaacatcttatttc

SEQ ID NO: 842770 - DNA, 22 bp, Artificial Sequence
  chemically synthesized
taacactggaaaacatcttatt

SEQ ID NO: 842771 - DNA, 22 bp, Artificial Sequence
  chemically synthesized
acattctaacactggaaaacat

SEQ ID NO: 842772 - DNA, 22 bp, Artificial Sequence
  chemically synthesized
tatgaaataagatgttttccag

SEQ ID NO: 842773 - DNA, 22 bp, Artificial Sequence
  chemically synthesized
cacattctaacactggaaaaca

SEQ ID NO: 842774 - DNA, 22 bp, Artificial Sequence
  chemically synthesized
atgaaataagatgttttccagt

SEQ ID NO: 842775 - DNA, 22 bp, Artificial Sequence
  chemically synthesized
tgaaataagatgttttccagtg

SEQ ID NO: 842776 - DNA, 22 bp, Artificial Sequence
  chemically synthesized
tccagtgttagaatgtgaaact

SEQ ID NO: 842777 - DNA, 22 bp, Artificial Sequence
  chemically synthesized
ccagtgttagaatgtgaaactc

SEQ ID NO: 842778 - DNA, 22 bp, Artificial Sequence
  chemically synthesized
cagtgttagaatgtgaaactct

SEQ ID NO: 842779 - DNA, 22 bp, Artificial Sequence
  chemically synthesized
ccatgtcacagatgaccagagt

SEQ ID NO: 842780 - DNA, 22 bp, Artificial Sequence
  chemically synthesized
cccatgtcacagatgaccagag

SEQ ID NO: 842781 - DNA, 22 bp, Artificial Sequence
  chemically synthesized
gaatgtgaaactctggtcatct

SEQ ID NO: 842782 - DNA, 22 bp, Artificial Sequence
  chemically synthesized
agcttcccatgtcacagatgac

SEQ ID NO: 842783 - DNA, 22 bp, Artificial Sequence
  chemically synthesized
cagcttcccatgtcacagatga

SEQ ID NO: 842784 - DNA, 22 bp, Artificial Sequence
  chemically synthesized
tcagcttcccatgtcacagatg

SEQ ID NO: 842785 - DNA, 22 bp, Artificial Sequence
  chemically synthesized
tggtcatctgtgacatgggaag

SEQ ID NO: 842786 - DNA, 22 bp, Artificial Sequence
  chemically synthesized
gtcatctgtgacatgggaagct

SEQ ID NO: 842787 - DNA, 22 bp, Artificial Sequence
  chemically synthesized
caaagcaacctttcagcttccc

SEQ ID NO: 842788 - DNA, 22 bp, Artificial Sequence
  chemically synthesized
tgacatgggaagctgaaaggtt

SEQ ID NO: 842789 - DNA, 22 bp, Artificial Sequence
  chemically synthesized
gggtaggcaattccaaagcaac

SEQ ID NO: 842790 - DNA, 22 bp, Artificial Sequence
  chemically synthesized
agggtaggcaattccaaagcaa

SEQ ID NO: 842791 - DNA, 22 bp, Artificial Sequence
  chemically synthesized
tagggtaggcaattccaaagca

SEQ ID NO: 842792 - DNA, 22 bp, Artificial Sequence
  chemically synthesized
aaaggttgctttggaattgcct

SEQ ID NO: 842793 - DNA, 22 bp, Artificial Sequence
  chemically synthesized
aaacattttagggtaggcaatt

SEQ ID NO: 842794 - DNA, 22 bp, Artificial Sequence
  chemically synthesized
ctttggaattgcctaccctaaa

SEQ ID NO: 842795 - DNA, 22 bp, Artificial Sequence
  chemically synthesized
tggaattgcctaccctaaaatg

SEQ ID NO: 842796 - DNA, 22 bp, Artificial Sequence
  chemically synthesized
aacatattcaaacattttaggg

SEQ ID NO: 842797 - DNA, 22 bp, Artificial Sequence
  chemically synthesized
ggaattgcctaccctaaaatgt

SEQ ID NO: 842798 - DNA, 22 bp, Artificial Sequence
  chemically synthesized
gaattgcctaccctaaaatgtt

SEQ ID NO: 842799 - DNA, 22 bp, Artificial Sequence
  chemically synthesized
ttgaacatattcaaacatttta

SEQ ID NO: 842800 - DNA, 22 bp, Artificial Sequence
  chemically synthesized
tattgaacatattcaaacattt

SEQ ID NO: 842801 - DNA, 22 bp, Artificial Sequence
  chemically synthesized
cctaccctaaaatgtttgaata

SEQ ID NO: 842802 - DNA, 22 bp, Artificial Sequence
  chemically synthesized
ccctaaaatgtttgaatatgtt

SEQ ID NO: 842803 - DNA, 22 bp, Artificial Sequence
  chemically synthesized
aaaattctattgaacatattca

SEQ ID NO: 842804 - DNA, 22 bp, Artificial Sequence
  chemically synthesized
aaaaattctattgaacatattc

SEQ ID NO: 842805 - DNA, 22 bp, Artificial Sequence
  chemically synthesized
taaaaattctattgaacatatt

SEQ ID NO: 842806 - DNA, 22 bp, Artificial Sequence
  chemically synthesized
aaatgtttgaatatgttcaata

SEQ ID NO: 842807 - DNA, 22 bp, Artificial Sequence
  chemically synthesized
gaatatgttcaatagaattttt

SEQ ID NO: 842808 - DNA, 22 bp, Artificial Sequence
  chemically synthesized
aatatgttcaatagaattttta

SEQ ID NO: 842809 - DNA, 22 bp, Artificial Sequence
  chemically synthesized
ggtaagtccgttttaaaaattc

SEQ ID NO: 842810 - DNA, 22 bp, Artificial Sequence
  chemically synthesized
tgggtaagtccgttttaaaaat

SEQ ID NO: 842811 - DNA, 22 bp, Artificial Sequence
  chemically synthesized
ctgggtaagtccgttttaaaaa

SEQ ID NO: 842812 - DNA, 22 bp, Artificial Sequence
  chemically synthesized
aatagaatttttaaaacggact

SEQ ID NO: 842813 - DNA, 22 bp, Artificial Sequence
  chemically synthesized
aggtttctgggtaagtccgttt

SEQ ID NO: 842814 - DNA, 22 bp, Artificial Sequence
  chemically synthesized
atctgaggtttctgggtaagtc

SEQ ID NO: 842815 - DNA, 22 bp, Artificial Sequence
  chemically synthesized
catctgaggtttctgggtaagt

SEQ ID NO: 842816 - DNA, 22 bp, Artificial Sequence
  chemically synthesized
ttaaaacggacttacccagaaa

SEQ ID NO: 842817 - DNA, 22 bp, Artificial Sequence
  chemically synthesized
taaaacggacttacccagaaac

SEQ ID NO: 842818 - DNA, 22 bp, Artificial Sequence
  chemically synthesized
acttcatctgaggtttctgggt

SEQ ID NO: 842819 - DNA, 22 bp, Artificial Sequence
  chemically synthesized
aaaacggacttacccagaaacc

SEQ ID NO: 842820 - DNA, 22 bp, Artificial Sequence
  chemically synthesized
gacttcatctgaggtttctggg

SEQ ID NO: 842821 - DNA, 22 bp, Artificial Sequence
  chemically synthesized
aaacggacttacccagaaacct

SEQ ID NO: 842822 - DNA, 22 bp, Artificial Sequence
  chemically synthesized
acccagaaacctcagatgaagt

SEQ ID NO: 842823 - DNA, 22 bp, Artificial Sequence
  chemically synthesized
cccagaaacctcagatgaagtc

SEQ ID NO: 842824 - DNA, 22 bp, Artificial Sequence
  chemically synthesized
aggtgaaaatttgacttcatct

SEQ ID NO: 842825 - DNA, 22 bp, Artificial Sequence
  chemically synthesized
gaggtgaaaatttgacttcatc

SEQ ID NO: 842826 - DNA, 22 bp, Artificial Sequence
  chemically synthesized
tgaggtgaaaatttgacttcat

SEQ ID NO: 842827 - DNA, 22 bp, Artificial Sequence
  chemically synthesized
actttgaggtgaaaatttgact

SEQ ID NO: 842828 - DNA, 22 bp, Artificial Sequence
  chemically synthesized
ttaactttgaggtgaaaatttg

SEQ ID NO: 842829 - DNA, 22 bp, Artificial Sequence
  chemically synthesized
tgttaactttgaggtgaaaatt

SEQ ID NO: 842830 - DNA, 22 bp, Artificial Sequence
  chemically synthesized
agatgaagtcaaattttcacct

SEQ ID NO: 842831 - DNA, 22 bp, Artificial Sequence
  chemically synthesized
tctgttaactttgaggtgaaaa

SEQ ID NO: 842832 - DNA, 22 bp, Artificial Sequence
  chemically synthesized
aagttctctgttaactttgagg

SEQ ID NO: 842833 - DNA, 22 bp, Artificial Sequence
  chemically synthesized
aaagttctctgttaactttgag

SEQ ID NO: 842834 - DNA, 22 bp, Artificial Sequence
  chemically synthesized
tgtatttaaagttctctgttaa

SEQ ID NO: 842835 - DNA, 22 bp, Artificial Sequence
  chemically synthesized
tcacctcaaagttaacagagaa

SEQ ID NO: 842836 - DNA, 22 bp, Artificial Sequence
  chemically synthesized
cacctcaaagttaacagagaac

SEQ ID NO: 842837 - DNA, 22 bp, Artificial Sequence
  chemically synthesized
acctcaaagttaacagagaact

SEQ ID NO: 842838 - DNA, 22 bp, Artificial Sequence
  chemically synthesized
aaagttaacagagaactttaaa

SEQ ID NO: 842839 - DNA, 22 bp, Artificial Sequence
  chemically synthesized
ccagccctgtgtatttaaagtt

SEQ ID NO: 842840 - DNA, 22 bp, Artificial Sequence
  chemically synthesized
gccagccctgtgtatttaaagt

SEQ ID NO: 842841 - DNA, 22 bp, Artificial Sequence
  chemically synthesized
tgccagccctgtgtatttaaag

SEQ ID NO: 842842 - DNA, 22 bp, Artificial Sequence
  chemically synthesized
acagagaactttaaatacacag

SEQ ID NO: 842843 - DNA, 22 bp, Artificial Sequence
  chemically synthesized
tgtattttgccagccctgtgta

SEQ ID NO: 842844 - DNA, 22 bp, Artificial Sequence
  chemically synthesized
atgtattttgccagccctgtgt

SEQ ID NO: 842845 - DNA, 22 bp, Artificial Sequence
  chemically synthesized
taaatacacagggctggcaaaa

SEQ ID NO: 842846 - DNA, 22 bp, Artificial Sequence
  chemically synthesized
aaatacacagggctggcaaaat

SEQ ID NO: 842847 - DNA, 22 bp, Artificial Sequence
  chemically synthesized
aatacacagggctggcaaaata

SEQ ID NO: 842848 - DNA, 22 bp, Artificial Sequence
  chemically synthesized
gcaaaatacataaattcattta

SEQ ID NO: 842849 - DNA, 22 bp, Artificial Sequence
  chemically synthesized
aaatgaatggatgagtaaatga

SEQ ID NO: 842850 - DNA, 22 bp, Artificial Sequence
  chemically synthesized
ttaaaatgaatggatgagtaaa

SEQ ID NO: 842851 - DNA, 22 bp, Artificial Sequence
  chemically synthesized
attaaaatgaatggatgagtaa

SEQ ID NO: 842852 - DNA, 22 bp, Artificial Sequence
  chemically synthesized
atttactcatccattcatttta

SEQ ID NO: 842853 - DNA, 22 bp, Artificial Sequence
  chemically synthesized
aaaaatatttattaaaatgaat

SEQ ID NO: 842854 - DNA, 22 bp, Artificial Sequence
  chemically synthesized
actcatccattcattttaataa

SEQ ID NO: 842855 - DNA, 22 bp, Artificial Sequence
  chemically synthesized
ctcatccattcattttaataaa

SEQ ID NO: 842856 - DNA, 22 bp, Artificial Sequence
  chemically synthesized
gtgctgaaaaatatttattaaa

SEQ ID NO: 842857 - DNA, 22 bp, Artificial Sequence
  chemically synthesized
atccattcattttaataaatat

SEQ ID NO: 842858 - DNA, 22 bp, Artificial Sequence
  chemically synthesized
attttaataaatatttttcagc

SEQ ID NO: 842859 - DNA, 22 bp, Artificial Sequence
  chemically synthesized
gaatagtgcctagtgctgaaaa

SEQ ID NO: 842860 - DNA, 22 bp, Artificial Sequence
  chemically synthesized
taataaatatttttcagcacta

SEQ ID NO: 842861 - DNA, 22 bp, Artificial Sequence
  chemically synthesized
aataaatatttttcagcactag

SEQ ID NO: 842862 - DNA, 22 bp, Artificial Sequence
  chemically synthesized
ataaatatttttcagcactagg

SEQ ID NO: 842863 - DNA, 22 bp, Artificial Sequence
  chemically synthesized
ttcagcactaggcactattcta

SEQ ID NO: 842864 - DNA, 22 bp, Artificial Sequence
  chemically synthesized
tcagcactaggcactattctag

SEQ ID NO: 842865 - DNA, 22 bp, Artificial Sequence
  chemically synthesized
cagcactaggcactattctagg

SEQ ID NO: 842866 - DNA, 22 bp, Artificial Sequence
  chemically synthesized
agcactaggcactattctaggg

SEQ ID NO: 842867 - DNA, 22 bp, Artificial Sequence
  chemically synthesized
ccacatgcatagtccctagaat

SEQ ID NO: 842868 - DNA, 22 bp, Artificial Sequence
  chemically synthesized
ggcactattctagggactatgc

SEQ ID NO: 842869 - DNA, 22 bp, Artificial Sequence
  chemically synthesized
tccactgccacatgcatagtcc

SEQ ID NO: 842870 - DNA, 22 bp, Artificial Sequence
  chemically synthesized
gtccactgccacatgcatagtc

SEQ ID NO: 842871 - DNA, 22 bp, Artificial Sequence
  chemically synthesized
ttctagggactatgcatgtggc

SEQ ID NO: 842872 - DNA, 22 bp, Artificial Sequence
  chemically synthesized
tagggactatgcatgtggcagt

SEQ ID NO: 842873 - DNA, 22 bp, Artificial Sequence
  chemically synthesized
gggactatgcatgtggcagtgg

SEQ ID NO: 842874 - DNA, 22 bp, Artificial Sequence
  chemically synthesized
taccgaatatatttgtccactg

SEQ ID NO: 842875 - DNA, 22 bp, Artificial Sequence
  chemically synthesized
tgcatgtggcagtggacaaata

SEQ ID NO: 842876 - DNA, 22 bp, Artificial Sequence
  chemically synthesized
cacactataccgaatatatttg

SEQ ID NO: 842877 - DNA, 22 bp, Artificial Sequence
  chemically synthesized
atgtgagttacacactataccg

SEQ ID NO: 842878 - DNA, 22 bp, Artificial Sequence
  chemically synthesized
catgtgagttacacactatacc

SEQ ID NO: 842879 - DNA, 22 bp, Artificial Sequence
  chemically synthesized
tcatgtgagttacacactatac

SEQ ID NO: 842880 - DNA, 22 bp, Artificial Sequence
  chemically synthesized
ttcatgtgagttacacactata

SEQ ID NO: 842881 - DNA, 22 bp, Artificial Sequence
  chemically synthesized
ggtatagtgtgtaactcacatg

SEQ ID NO: 842882 - DNA, 22 bp, Artificial Sequence
  chemically synthesized
caagtatcgaaaagcacgattt

SEQ ID NO: 842883 - DNA, 22 bp, Artificial Sequence
  chemically synthesized
ccaagtatcgaaaagcacgatt

SEQ ID NO: 842884 - DNA, 22 bp, Artificial Sequence
  chemically synthesized
acatgaaaaatcgtgcttttcg

SEQ ID NO: 842885 - DNA, 22 bp, Artificial Sequence
  chemically synthesized
tataaaaatttccaagtatcga

SEQ ID NO: 842886 - DNA, 22 bp, Artificial Sequence
  chemically synthesized
ttatataaaaatttccaagtat

SEQ ID NO: 842887 - DNA, 22 bp, Artificial Sequence
  chemically synthesized
gttatataaaaatttccaagta

SEQ ID NO: 842888 - DNA, 22 bp, Artificial Sequence
  chemically synthesized
tgttatataaaaatttccaagt

SEQ ID NO: 842889 - DNA, 22 bp, Artificial Sequence
  chemically synthesized
ttcgatacttggaaatttttat

SEQ ID NO: 842890 - DNA, 22 bp, Artificial Sequence
  chemically synthesized
tcgatacttggaaatttttata

SEQ ID NO: 842891 - DNA, 22 bp, Artificial Sequence
  chemically synthesized
cgatacttggaaatttttatat

SEQ ID NO: 842892 - DNA, 22 bp, Artificial Sequence
  chemically synthesized
gatacttggaaatttttatata

SEQ ID NO: 842893 - DNA, 22 bp, Artificial Sequence
  chemically synthesized
ggaaatttttatataacaaaga

SEQ ID NO: 842894 - DNA, 22 bp, Artificial Sequence
  chemically synthesized
gaaatttttatataacaaagat

SEQ ID NO: 842895 - DNA, 22 bp, Artificial Sequence
  chemically synthesized
ttatataacaaagattatcttt

SEQ ID NO: 842896 - DNA, 22 bp, Artificial Sequence
  chemically synthesized
tatataacaaagattatcttta

SEQ ID NO: 842897 - DNA, 22 bp, Artificial Sequence
  chemically synthesized
atataacaaagattatctttat

SEQ ID NO: 842898 - DNA, 22 bp, Artificial Sequence
  chemically synthesized
tataacaaagattatctttatt

SEQ ID NO: 842899 - DNA, 22 bp, Artificial Sequence
  chemically synthesized
aaagaagaacaacccaataaag

SEQ ID NO: 842900 - DNA, 22 bp, Artificial Sequence
  chemically synthesized
tctttattgggttgttcttctt

SEQ ID NO: 842901 - DNA, 22 bp, Artificial Sequence
  chemically synthesized
tattgggttgttcttcttttaa

SEQ ID NO: 842902 - DNA, 22 bp, Artificial Sequence
  chemically synthesized
tgtgagagtgaattaaaagaag

SEQ ID NO: 842903 - DNA, 22 bp, Artificial Sequence
  chemically synthesized
attgggttgttcttcttttaat

SEQ ID NO: 842904 - DNA, 22 bp, Artificial Sequence
  chemically synthesized
ttgggttgttcttcttttaatt

SEQ ID NO: 842905 - DNA, 22 bp, Artificial Sequence
  chemically synthesized
gttatgtgagagtgaattaaaa

SEQ ID NO: 842906 - DNA, 22 bp, Artificial Sequence
  chemically synthesized
ggttgttcttcttttaattcac

SEQ ID NO: 842907 - DNA, 22 bp, Artificial Sequence
  chemically synthesized
ttcttcttttaattcactctca

SEQ ID NO: 842908 - DNA, 22 bp, Artificial Sequence
  chemically synthesized
ttcttttaattcactctcacat

SEQ ID NO: 842909 - DNA, 22 bp, Artificial Sequence
  chemically synthesized
cttttaattcactctcacataa

SEQ ID NO: 842910 - DNA, 22 bp, Artificial Sequence
  chemically synthesized
ttttaattcactctcacataac

SEQ ID NO: 842911 - DNA, 22 bp, Artificial Sequence
  chemically synthesized
ttaattcactctcacataacca

SEQ ID NO: 842912 - DNA, 22 bp, Artificial Sequence
  chemically synthesized
taattcactctcacataaccag

SEQ ID NO: 842913 - DNA, 22 bp, Artificial Sequence
  chemically synthesized
aattcactctcacataaccaga

SEQ ID NO: 842914 - DNA, 22 bp, Artificial Sequence
  chemically synthesized
attcactctcacataaccagat

SEQ ID NO: 842915 - DNA, 22 bp, Artificial Sequence
  chemically synthesized
agaagcaaaaaaaatctggtta

SEQ ID NO: 842916 - DNA, 22 bp, Artificial Sequence
  chemically synthesized
actctcacataaccagattttt

SEQ ID NO: 842917 - DNA, 22 bp, Artificial Sequence
  chemically synthesized
aaactgagaagcaaaaaaaatc

SEQ ID NO: 842918 - DNA, 22 bp, Artificial Sequence
  chemically synthesized
tcacataaccagattttttttg

SEQ ID NO: 842919 - DNA, 22 bp, Artificial Sequence
  chemically synthesized
acataaccagattttttttgct

SEQ ID NO: 842920 - DNA, 22 bp, Artificial Sequence
  chemically synthesized
tttttgcttctcagttttagat

SEQ ID NO: 842921 - DNA, 22 bp, Artificial Sequence
  chemically synthesized
ttttgcttctcagttttagata

SEQ ID NO: 842922 - DNA, 22 bp, Artificial Sequence
  chemically synthesized
tttgcttctcagttttagatac

SEQ ID NO: 842923 - DNA, 22 bp, Artificial Sequence
  chemically synthesized
ttgcttctcagttttagataca

SEQ ID NO: 842924 - DNA, 22 bp, Artificial Sequence
  chemically synthesized
tgcttctcagttttagatacat

SEQ ID NO: 842925 - DNA, 22 bp, Artificial Sequence
  chemically synthesized
gcttctcagttttagatacatt

SEQ ID NO: 842926 - DNA, 22 bp, Artificial Sequence
  chemically synthesized
cttctcagttttagatacatta

SEQ ID NO: 842927 - DNA, 22 bp, Artificial Sequence
  chemically synthesized
ctcagttttagatacattattc

SEQ ID NO: 842928 - DNA, 22 bp, Artificial Sequence
  chemically synthesized
tcagttttagatacattattca

SEQ ID NO: 842929 - DNA, 22 bp, Artificial Sequence
  chemically synthesized
agttttagatacattattcact

SEQ ID NO: 842930 - DNA, 22 bp, Artificial Sequence
  chemically synthesized
tagatacattattcactgtttg

SEQ ID NO: 842931 - DNA, 22 bp, Artificial Sequence
  chemically synthesized
agatacattattcactgtttgc

SEQ ID NO: 842932 - DNA, 22 bp, Artificial Sequence
  chemically synthesized
gatacattattcactgtttgct

SEQ ID NO: 842933 - DNA, 22 bp, Artificial Sequence
  chemically synthesized
aaagaaggaaaaaagtatagca

SEQ ID NO: 842934 - DNA, 22 bp, Artificial Sequence
  chemically synthesized
aaaagaaggaaaaaagtatagc

SEQ ID NO: 842935 - DNA, 22 bp, Artificial Sequence
  chemically synthesized
ttcactgtttgctatacttttt

SEQ ID NO: 842936 - DNA, 22 bp, Artificial Sequence
  chemically synthesized
actgtttgctatacttttttcc

SEQ ID NO: 842937 - DNA, 22 bp, Artificial Sequence
  chemically synthesized
aaatcttaaaagaaggaaaaaa

SEQ ID NO: 842938 - DNA, 22 bp, Artificial Sequence
  chemically synthesized
gaaatcttaaaagaaggaaaaa

SEQ ID NO: 842939 - DNA, 22 bp, Artificial Sequence
  chemically synthesized
tttgctatacttttttccttct

SEQ ID NO: 842940 - DNA, 22 bp, Artificial Sequence
  chemically synthesized
tgaaatcttaaaagaaggaaaa

SEQ ID NO: 842941 - DNA, 22 bp, Artificial Sequence
  chemically synthesized
gctatacttttttccttctttt

SEQ ID NO: 842942 - DNA, 22 bp, Artificial Sequence
  chemically synthesized
ctatacttttttccttctttta

SEQ ID NO: 842943 - DNA, 22 bp, Artificial Sequence
  chemically synthesized
tacttttttccttcttttaaga

SEQ ID NO: 842944 - DNA, 22 bp, Artificial Sequence
  chemically synthesized
aatgaactttgaaatcttaaaa

SEQ ID NO: 842945 - DNA, 22 bp, Artificial Sequence
  chemically synthesized
aaatgaactttgaaatcttaaa

SEQ ID NO: 842946 - DNA, 22 bp, Artificial Sequence
  chemically synthesized
ttttccttcttttaagatttca

SEQ ID NO: 842947 - DNA, 22 bp, Artificial Sequence
  chemically synthesized
ttaaatgaactttgaaatctta

SEQ ID NO: 842948 - DNA, 22 bp, Artificial Sequence
  chemically synthesized
tttccttcttttaagatttcaa

SEQ ID NO: 842949 - DNA, 22 bp, Artificial Sequence
  chemically synthesized
cttaaatgaactttgaaatctt

SEQ ID NO: 842950 - DNA, 22 bp, Artificial Sequence
  chemically synthesized
ttccttcttttaagatttcaaa

SEQ ID NO: 842951 - DNA, 22 bp, Artificial Sequence
  chemically synthesized
tccttcttttaagatttcaaag

SEQ ID NO: 842952 - DNA, 22 bp, Artificial Sequence
  chemically synthesized
ccttcttttaagatttcaaagt

SEQ ID NO: 842953 - DNA, 22 bp, Artificial Sequence
  chemically synthesized
cttcttttaagatttcaaagtt

SEQ ID NO: 842954 - DNA, 22 bp, Artificial Sequence
  chemically synthesized
cttttaagatttcaaagttcat

SEQ ID NO: 842955 - DNA, 22 bp, Artificial Sequence
  chemically synthesized
ttttaagatttcaaagttcatt

SEQ ID NO: 842956 - DNA, 22 bp, Artificial Sequence
  chemically synthesized
ttaagatttcaaagttcattta

SEQ ID NO: 842957 - DNA, 22 bp, Artificial Sequence
  chemically synthesized
caacatacttcttaaatgaact

SEQ ID NO: 842958 - DNA, 22 bp, Artificial Sequence
  chemically synthesized
taagatttcaaagttcatttaa

SEQ ID NO: 842959 - DNA, 22 bp, Artificial Sequence
  chemically synthesized
acaacatacttcttaaatgaac

SEQ ID NO: 842960 - DNA, 22 bp, Artificial Sequence
  chemically synthesized
aagatttcaaagttcatttaag

SEQ ID NO: 842961 - DNA, 22 bp, Artificial Sequence
  chemically synthesized
tacaacatacttcttaaatgaa

SEQ ID NO: 842962 - DNA, 22 bp, Artificial Sequence
  chemically synthesized
agatttcaaagttcatttaaga

SEQ ID NO: 842963 - DNA, 22 bp, Artificial Sequence
  chemically synthesized
ttacaacatacttcttaaatga

SEQ ID NO: 842964 - DNA, 22 bp, Artificial Sequence
  chemically synthesized
cttttacaacatacttcttaaa

SEQ ID NO: 842965 - DNA, 22 bp, Artificial Sequence
  chemically synthesized
acttttacaacatacttcttaa

SEQ ID NO: 842966 - DNA, 22 bp, Artificial Sequence
  chemically synthesized
caaagttcatttaagaagtatg

SEQ ID NO: 842967 - DNA, 22 bp, Artificial Sequence
  chemically synthesized
aaagttcatttaagaagtatgt

SEQ ID NO: 842968 - DNA, 22 bp, Artificial Sequence
  chemically synthesized
atcaacttacttttacaacata

SEQ ID NO: 842969 - DNA, 22 bp, Artificial Sequence
  chemically synthesized
atttaagaagtatgttgtaaaa

SEQ ID NO: 842970 - DNA, 22 bp, Artificial Sequence
  chemically synthesized
aagaagtatgttgtaaaagtaa

SEQ ID NO: 842971 - DNA, 22 bp, Artificial Sequence
  chemically synthesized
aagttgatcaacttacttttac

SEQ ID NO: 842972 - DNA, 22 bp, Artificial Sequence
  chemically synthesized
agaagtatgttgtaaaagtaag

SEQ ID NO: 842973 - DNA, 22 bp, Artificial Sequence
  chemically synthesized
agattaaagttgatcaacttac

SEQ ID NO: 842974 - DNA, 22 bp, Artificial Sequence
  chemically synthesized
taaaagtaagttgatcaacttt

SEQ ID NO: 842975 - DNA, 22 bp, Artificial Sequence
  chemically synthesized
gtaaggttcagattaaagttga

SEQ ID NO: 842976 - DNA, 22 bp, Artificial Sequence
  chemically synthesized
gagcctggtaaggttcagatta

SEQ ID NO: 842977 - DNA, 22 bp, Artificial Sequence
  chemically synthesized
agagcctggtaaggttcagatt

SEQ ID NO: 842978 - DNA, 22 bp, Artificial Sequence
  chemically synthesized
atcaactttaatctgaacctta

SEQ ID NO: 842979 - DNA, 22 bp, Artificial Sequence
  chemically synthesized
atttagagcctggtaaggttca

SEQ ID NO: 842980 - DNA, 22 bp, Artificial Sequence
  chemically synthesized
aatttagagcctggtaaggttc

SEQ ID NO: 842981 - DNA, 22 bp, Artificial Sequence
  chemically synthesized
taatctgaaccttaccaggctc

SEQ ID NO: 842982 - DNA, 22 bp, Artificial Sequence
  chemically synthesized
aatctgaaccttaccaggctct

SEQ ID NO: 842983 - DNA, 22 bp, Artificial Sequence
  chemically synthesized
atctgaaccttaccaggctcta

SEQ ID NO: 842984 - DNA, 22 bp, Artificial Sequence
  chemically synthesized
tggtcaggtttaatttagagcc

SEQ ID NO: 842985 - DNA, 22 bp, Artificial Sequence
  chemically synthesized
aaccttaccaggctctaaatta

SEQ ID NO: 842986 - DNA, 22 bp, Artificial Sequence
  chemically synthesized
attgtggtcaggtttaatttag

SEQ ID NO: 842987 - DNA, 22 bp, Artificial Sequence
  chemically synthesized
ttcattgtggtcaggtttaatt

SEQ ID NO: 842988 - DNA, 22 bp, Artificial Sequence
  chemically synthesized
accaggctctaaattaaacctg

SEQ ID NO: 842989 - DNA, 22 bp, Artificial Sequence
  chemically synthesized
ccaggctctaaattaaacctga

SEQ ID NO: 842990 - DNA, 22 bp, Artificial Sequence
  chemically synthesized
taaattaaacctgaccacaatg

SEQ ID NO: 842991 - DNA, 22 bp, Artificial Sequence
  chemically synthesized
aattaaacctgaccacaatgaa

SEQ ID NO: 842992 - DNA, 22 bp, Artificial Sequence
  chemically synthesized
agcaataaaagctgttcattgt

SEQ ID NO: 842993 - DNA, 22 bp, Artificial Sequence
  chemically synthesized
cagcaataaaagctgttcattg

SEQ ID NO: 842994 - DNA, 22 bp, Artificial Sequence
  chemically synthesized
aacctgaccacaatgaacagct

SEQ ID NO: 842995 - DNA, 22 bp, Artificial Sequence
  chemically synthesized
atttcagcaataaaagctgttc

SEQ ID NO: 842996 - DNA, 22 bp, Artificial Sequence
  chemically synthesized
ctaatttcagcaataaaagctg

SEQ ID NO: 842997 - DNA, 22 bp, Artificial Sequence
  chemically synthesized
accacaatgaacagcttttatt

SEQ ID NO: 842998 - DNA, 22 bp, Artificial Sequence
  chemically synthesized
gctaatttcagcaataaaagct

SEQ ID NO: 842999 - DNA, 22 bp, Artificial Sequence
  chemically synthesized
acatgcttgctaatttcagcaa

SEQ ID NO: 843000 - DNA, 22 bp, Artificial Sequence
  chemically synthesized
agttgacatgcttgctaatttc

SEQ ID NO: 843001 - DNA, 22 bp, Artificial Sequence
  chemically synthesized
ttattgctgaaattagcaagca

SEQ ID NO: 843002 - DNA, 22 bp, Artificial Sequence
  chemically synthesized
tattgctgaaattagcaagcat

SEQ ID NO: 843003 - DNA, 22 bp, Artificial Sequence
  chemically synthesized
attgctgaaattagcaagcatg

SEQ ID NO: 843004 - DNA, 22 bp, Artificial Sequence
  chemically synthesized
agtctaagttgacatgcttgct

SEQ ID NO: 843005 - DNA, 22 bp, Artificial Sequence
  chemically synthesized
ttgctgaaattagcaagcatgt

SEQ ID NO: 843006 - DNA, 22 bp, Artificial Sequence
  chemically synthesized
gagtctaagttgacatgcttgc

SEQ ID NO: 843007 - DNA, 22 bp, Artificial Sequence
  chemically synthesized
tgagtctaagttgacatgcttg

SEQ ID NO: 843008 - DNA, 22 bp, Artificial Sequence
  chemically synthesized
ctgaaattagcaagcatgtcaa

SEQ ID NO: 843009 - DNA, 22 bp, Artificial Sequence
  chemically synthesized
ttttgagtctaagttgacatgc

SEQ ID NO: 843010 - DNA, 22 bp, Artificial Sequence
  chemically synthesized
gttttgagtctaagttgacatg

SEQ ID NO: 843011 - DNA, 22 bp, Artificial Sequence
  chemically synthesized
aaattagcaagcatgtcaactt

SEQ ID NO: 843012 - DNA, 22 bp, Artificial Sequence
  chemically synthesized
gcaagcatgtcaacttagactc

SEQ ID NO: 843013 - DNA, 22 bp, Artificial Sequence
  chemically synthesized
gagaggaaaatggcttgttttg

SEQ ID NO: 843014 - DNA, 22 bp, Artificial Sequence
  chemically synthesized
attagagaggaaaatggcttgt

SEQ ID NO: 843015 - DNA, 22 bp, Artificial Sequence
  chemically synthesized
agactcaaaacaagccattttc

SEQ ID NO: 843016 - DNA, 22 bp, Artificial Sequence
  chemically synthesized
ttcattagagaggaaaatggct

SEQ ID NO: 843017 - DNA, 22 bp, Artificial Sequence
  chemically synthesized
gactcaaaacaagccattttcc

SEQ ID NO: 843018 - DNA, 22 bp, Artificial Sequence
  chemically synthesized
gttcattagagaggaaaatggc

SEQ ID NO: 843019 - DNA, 22 bp, Artificial Sequence
  chemically synthesized
tgttcattagagaggaaaatgg

SEQ ID NO: 843020 - DNA, 22 bp, Artificial Sequence
  chemically synthesized
ttttgttcattagagaggaaaa

SEQ ID NO: 843021 - DNA, 22 bp, Artificial Sequence
  chemically synthesized
aaaacaagccattttcctctct

SEQ ID NO: 843022 - DNA, 22 bp, Artificial Sequence
  chemically synthesized
agacctattttgttcattagag

SEQ ID NO: 843023 - DNA, 22 bp, Artificial Sequence
  chemically synthesized
tcctctctaatgaacaaaatag

SEQ ID NO: 843024 - DNA, 22 bp, Artificial Sequence
  chemically synthesized
cctctctaatgaacaaaatagg

SEQ ID NO: 843025 - DNA, 22 bp, Artificial Sequence
  chemically synthesized
ctctctaatgaacaaaataggt

SEQ ID NO: 843026 - DNA, 22 bp, Artificial Sequence
  chemically synthesized
acaataccctgagacctatttt

SEQ ID NO: 843027 - DNA, 22 bp, Artificial Sequence
  chemically synthesized
cacaataccctgagacctattt

SEQ ID NO: 843028 - DNA, 22 bp, Artificial Sequence
  chemically synthesized
tctaatgaacaaaataggtctc

SEQ ID NO: 843029 - DNA, 22 bp, Artificial Sequence
  chemically synthesized
taatgaacaaaataggtctcag

SEQ ID NO: 843030 - DNA, 22 bp, Artificial Sequence
  chemically synthesized
atgaacaaaataggtctcaggg

SEQ ID NO: 843031 - DNA, 22 bp, Artificial Sequence
  chemically synthesized
gagaacaggtttcacaataccc

SEQ ID NO: 843032 - DNA, 22 bp, Artificial Sequence
  chemically synthesized
agggtattgtgaaacctgttct

SEQ ID NO: 843033 - DNA, 22 bp, Artificial Sequence
  chemically synthesized
gagaatcacccaactagagaac

SEQ ID NO: 843034 - DNA, 22 bp, Artificial Sequence
  chemically synthesized
tgaaacctgttctctagttggg

SEQ ID NO: 843035 - DNA, 22 bp, Artificial Sequence
  chemically synthesized
tcagcagaattagagaatcacc

SEQ ID NO: 843036 - DNA, 22 bp, Artificial Sequence
  chemically synthesized
ttctctagttgggtgattctct

SEQ ID NO: 843037 - DNA, 22 bp, Artificial Sequence
  chemically synthesized
tctagttgggtgattctctaat

SEQ ID NO: 843038 - DNA, 22 bp, Artificial Sequence
  chemically synthesized
tagttgggtgattctctaattc

SEQ ID NO: 843039 - DNA, 22 bp, Artificial Sequence
  chemically synthesized
gttgggtgattctctaattctg

SEQ ID NO: 843040 - DNA, 22 bp, Artificial Sequence
  chemically synthesized
ggtgattctctaattctgctga

SEQ ID NO: 843041 - DNA, 22 bp, Artificial Sequence
  chemically synthesized
caaagcatgtgtctgtcagcag

SEQ ID NO: 843042 - DNA, 22 bp, Artificial Sequence
  chemically synthesized
acaaagcatgtgtctgtcagca

SEQ ID NO: 843043 - DNA, 22 bp, Artificial Sequence
  chemically synthesized
tctaattctgctgacagacaca

SEQ ID NO: 843044 - DNA, 22 bp, Artificial Sequence
  chemically synthesized
taattctgctgacagacacatg

SEQ ID NO: 843045 - DNA, 22 bp, Artificial Sequence
  chemically synthesized
attctgctgacagacacatgct

SEQ ID NO: 843046 - DNA, 22 bp, Artificial Sequence
  chemically synthesized
aggtgcttacaaagcatgtgtc

SEQ ID NO: 843047 - DNA, 22 bp, Artificial Sequence
  chemically synthesized
tcaggtgcttacaaagcatgtg

SEQ ID NO: 843048 - DNA, 22 bp, Artificial Sequence
  chemically synthesized
ctcaggtgcttacaaagcatgt

SEQ ID NO: 843049 - DNA, 22 bp, Artificial Sequence
  chemically synthesized
tgctgacagacacatgctttgt

SEQ ID NO: 843050 - DNA, 22 bp, Artificial Sequence
  chemically synthesized
ctgacagacacatgctttgtaa

SEQ ID NO: 843051 - DNA, 22 bp, Artificial Sequence
  chemically synthesized
acagacacatgctttgtaagca

SEQ ID NO: 843052 - DNA, 22 bp, Artificial Sequence
  chemically synthesized
ataatcttctcaggtgcttaca

SEQ ID NO: 843053 - DNA, 22 bp, Artificial Sequence
  chemically synthesized
attaataatcttctcaggtgct

SEQ ID NO: 843054 - DNA, 22 bp, Artificial Sequence
  chemically synthesized
tgtaagcacctgagaagattat

SEQ ID NO: 843055 - DNA, 22 bp, Artificial Sequence
  chemically synthesized
gtaagcacctgagaagattatt

SEQ ID NO: 843056 - DNA, 22 bp, Artificial Sequence
  chemically synthesized
taagcacctgagaagattatta

SEQ ID NO: 843057 - DNA, 22 bp, Artificial Sequence
  chemically synthesized
aaaggatctcattaataatctt

SEQ ID NO: 843058 - DNA, 22 bp, Artificial Sequence
  chemically synthesized
caaaggatctcattaataatct

SEQ ID NO: 843059 - DNA, 22 bp, Artificial Sequence
  chemically synthesized
cttcaaaggatctcattaataa

SEQ ID NO: 843060 - DNA, 22 bp, Artificial Sequence
  chemically synthesized
agaagattattaatgagatcct

SEQ ID NO: 843061 - DNA, 22 bp, Artificial Sequence
  chemically synthesized
aggaggctgcttcaaaggatct

SEQ ID NO: 843062 - DNA, 22 bp, Artificial Sequence
  chemically synthesized
aaggaggctgcttcaaaggatc

SEQ ID NO: 843063 - DNA, 22 bp, Artificial Sequence
  chemically synthesized
taaggaggctgcttcaaaggat

SEQ ID NO: 843064 - DNA, 22 bp, Artificial Sequence
  chemically synthesized
ttaaggaggctgcttcaaagga

SEQ ID NO: 843065 - DNA, 22 bp, Artificial Sequence
  chemically synthesized
ttaatgagatcctttgaagcag

SEQ ID NO: 843066 - DNA, 22 bp, Artificial Sequence
  chemically synthesized
gatttttaaggaggctgcttca

SEQ ID NO: 843067 - DNA, 22 bp, Artificial Sequence
  chemically synthesized
atgagatcctttgaagcagcct

SEQ ID NO: 843068 - DNA, 22 bp, Artificial Sequence
  chemically synthesized
agatttttaaggaggctgcttc

SEQ ID NO: 843069 - DNA, 22 bp, Artificial Sequence
  chemically synthesized
cttagatttttaaggaggctgc

SEQ ID NO: 843070 - DNA, 22 bp, Artificial Sequence
  chemically synthesized
tgaagcagcctccttaaaaatc

SEQ ID NO: 843071 - DNA, 22 bp, Artificial Sequence
  chemically synthesized
tgaacctccttagatttttaag

SEQ ID NO: 843072 - DNA, 22 bp, Artificial Sequence
  chemically synthesized
gaagcagcctccttaaaaatct

SEQ ID NO: 843073 - DNA, 22 bp, Artificial Sequence
  chemically synthesized
aagcagcctccttaaaaatcta

SEQ ID NO: 843074 - DNA, 22 bp, Artificial Sequence
  chemically synthesized
cagttgtgaacctccttagatt

SEQ ID NO: 843075 - DNA, 22 bp, Artificial Sequence
  chemically synthesized
tactgcagttgtgaacctcctt

SEQ ID NO: 843076 - DNA, 22 bp, Artificial Sequence
  chemically synthesized
cttaaaaatctaaggaggttca

SEQ ID NO: 843077 - DNA, 22 bp, Artificial Sequence
  chemically synthesized
aaaaatctaaggaggttcacaa

SEQ ID NO: 843078 - DNA, 22 bp, Artificial Sequence
  chemically synthesized
aaaatctaaggaggttcacaac

SEQ ID NO: 843079 - DNA, 22 bp, Artificial Sequence
  chemically synthesized
aggaggttcacaactgcagtac

SEQ ID NO: 843080 - DNA, 22 bp, Artificial Sequence
  chemically synthesized
gaaatgcatagttgtactgcag

SEQ ID NO: 843081 - DNA, 22 bp, Artificial Sequence
  chemically synthesized
agaaatgcatagttgtactgca

SEQ ID NO: 843082 - DNA, 22 bp, Artificial Sequence
  chemically synthesized
tagaaatgcatagttgtactgc

SEQ ID NO: 843083 - DNA, 22 bp, Artificial Sequence
  chemically synthesized
acaactgcagtacaactatgca

SEQ ID NO: 843084 - DNA, 22 bp, Artificial Sequence
  chemically synthesized
aaatattttagaaatgcatagt

SEQ ID NO: 843085 - DNA, 22 bp, Artificial Sequence
  chemically synthesized
gaaatattttagaaatgcatag

SEQ ID NO: 843086 - DNA, 22 bp, Artificial Sequence
  chemically synthesized
tgaaatattttagaaatgcata

SEQ ID NO: 843087 - DNA, 22 bp, Artificial Sequence
  chemically synthesized
cagtacaactatgcatttctaa

SEQ ID NO: 843088 - DNA, 22 bp, Artificial Sequence
  chemically synthesized
ttttgaaatattttagaaatgc

SEQ ID NO: 843089 - DNA, 22 bp, Artificial Sequence
  chemically synthesized
gttttgaaatattttagaaatg

SEQ ID NO: 843090 - DNA, 22 bp, Artificial Sequence
  chemically synthesized
tgttttgaaatattttagaaat

SEQ ID NO: 843091 - DNA, 22 bp, Artificial Sequence
  chemically synthesized
aaattttgttttgaaatatttt

SEQ ID NO: 843092 - DNA, 22 bp, Artificial Sequence
  chemically synthesized
tgcatttctaaaatatttcaaa

SEQ ID NO: 843093 - DNA, 22 bp, Artificial Sequence
  chemically synthesized
ctaaaatatttcaaaacaaaat

SEQ ID NO: 843094 - DNA, 22 bp, Artificial Sequence
  chemically synthesized
taaaatatttcaaaacaaaatt

SEQ ID NO: 843095 - DNA, 22 bp, Artificial Sequence
  chemically synthesized
aaatatttcaaaacaaaatttc

SEQ ID NO: 843096 - DNA, 22 bp, Artificial Sequence
  chemically synthesized
caaaacaaaatttcaacttttt

SEQ ID NO: 843097 - DNA, 22 bp, Artificial Sequence
  chemically synthesized
aaaacaaaatttcaacttttta

SEQ ID NO: 843098 - DNA, 22 bp, Artificial Sequence
  chemically synthesized
accatagagtgggataaaaagt

SEQ ID NO: 843099 - DNA, 22 bp, Artificial Sequence
  chemically synthesized
tatgtgttgaccatagagtggg

SEQ ID NO: 843100 - DNA, 22 bp, Artificial Sequence
  chemically synthesized
caactttttatcccactctatg

SEQ ID NO: 843101 - DNA, 22 bp, Artificial Sequence
  chemically synthesized
gtatgtgttgaccatagagtgg

SEQ ID NO: 843102 - DNA, 22 bp, Artificial Sequence
  chemically synthesized
aactttttatcccactctatgg

SEQ ID NO: 843103 - DNA, 22 bp, Artificial Sequence
  chemically synthesized
tttatcccactctatggtcaac

SEQ ID NO: 843104 - DNA, 22 bp, Artificial Sequence
  chemically synthesized
ttatcccactctatggtcaaca

SEQ ID NO: 843105 - DNA, 22 bp, Artificial Sequence
  chemically synthesized
tatcccactctatggtcaacac

SEQ ID NO: 843106 - DNA, 22 bp, Artificial Sequence
  chemically synthesized
atcccactctatggtcaacaca

SEQ ID NO: 843107 - DNA, 22 bp, Artificial Sequence
  chemically synthesized
tcccactctatggtcaacacat

SEQ ID NO: 843108 - DNA, 22 bp, Artificial Sequence
  chemically synthesized
aaatgaatgtttgtatgtgttg

SEQ ID NO: 843109 - DNA, 22 bp, Artificial Sequence
  chemically synthesized
ttgaaatgaatgtttgtatgtg

SEQ ID NO: 843110 - DNA, 22 bp, Artificial Sequence
  chemically synthesized
gttgaaatgaatgtttgtatgt

SEQ ID NO: 843111 - DNA, 22 bp, Artificial Sequence
  chemically synthesized
tgttgaaatgaatgtttgtatg

SEQ ID NO: 843112 - DNA, 22 bp, Artificial Sequence
  chemically synthesized
tatggtcaacacatacaaacat

SEQ ID NO: 843113 - DNA, 22 bp, Artificial Sequence
  chemically synthesized
tttgttgaaatgaatgtttgta

SEQ ID NO: 843114 - DNA, 22 bp, Artificial Sequence
  chemically synthesized
tggtcaacacatacaaacattc

SEQ ID NO: 843115 - DNA, 22 bp, Artificial Sequence
  chemically synthesized
ctttgttgaaatgaatgtttgt

SEQ ID NO: 843116 - DNA, 22 bp, Artificial Sequence
  chemically synthesized
cagcttctttgttgaaatgaat

SEQ ID NO: 843117 - DNA, 22 bp, Artificial Sequence
  chemically synthesized
acagcttctttgttgaaatgaa

SEQ ID NO: 843118 - DNA, 22 bp, Artificial Sequence
  chemically synthesized
tacagcttctttgttgaaatga

SEQ ID NO: 843119 - DNA, 22 bp, Artificial Sequence
  chemically synthesized
tcattttacagcttctttgttg

SEQ ID NO: 843120 - DNA, 22 bp, Artificial Sequence
  chemically synthesized
atttcaacaaagaagctgtaaa

SEQ ID NO: 843121 - DNA, 22 bp, Artificial Sequence
  chemically synthesized
caacaaagaagctgtaaaatga

SEQ ID NO: 843122 - DNA, 22 bp, Artificial Sequence
  chemically synthesized
aacaaagaagctgtaaaatgat

SEQ ID NO: 843123 - DNA, 22 bp, Artificial Sequence
  chemically synthesized
taaaatgataatgtatattgct

SEQ ID NO: 843124 - DNA, 22 bp, Artificial Sequence
  chemically synthesized
gtgtatgataaatcccatagca

SEQ ID NO: 843125 - DNA, 22 bp, Artificial Sequence
  chemically synthesized
ttagtgtatgataaatcccata

SEQ ID NO: 843126 - DNA, 22 bp, Artificial Sequence
  chemically synthesized
ctatgggatttatcatacacta

SEQ ID NO: 843127 - DNA, 22 bp, Artificial Sequence
  chemically synthesized
agtaaagagcctattagtgtat

SEQ ID NO: 843128 - DNA, 22 bp, Artificial Sequence
  chemically synthesized
tgggatttatcatacactaata

SEQ ID NO: 843129 - DNA, 22 bp, Artificial Sequence
  chemically synthesized
atcatacactaataggctcttt

SEQ ID NO: 843130 - DNA, 22 bp, Artificial Sequence
  chemically synthesized
tcatacactaataggctcttta

SEQ ID NO: 843131 - DNA, 22 bp, Artificial Sequence
  chemically synthesized
aaagaccactaagtaaagagcc

SEQ ID NO: 843132 - DNA, 22 bp, Artificial Sequence
  chemically synthesized
tactaaaagaccactaagtaaa

SEQ ID NO: 843133 - DNA, 22 bp, Artificial Sequence
  chemically synthesized
ctatactaaaagaccactaagt

SEQ ID NO: 843134 - DNA, 22 bp, Artificial Sequence
  chemically synthesized
ataggctctttacttagtggtc

SEQ ID NO: 843135 - DNA, 22 bp, Artificial Sequence
  chemically synthesized
tgctatactaaaagaccactaa

SEQ ID NO: 843136 - DNA, 22 bp, Artificial Sequence
  chemically synthesized
ccattctgctatactaaaagac

SEQ ID NO: 843137 - DNA, 22 bp, Artificial Sequence
  chemically synthesized
tttacttagtggtcttttagta

SEQ ID NO: 843138 - DNA, 22 bp, Artificial Sequence
  chemically synthesized
tacttagtggtcttttagtata

SEQ ID NO: 843139 - DNA, 22 bp, Artificial Sequence
  chemically synthesized
acttagtggtcttttagtatag

SEQ ID NO: 843140 - DNA, 22 bp, Artificial Sequence
  chemically synthesized
cttagtggtcttttagtatagc

SEQ ID NO: 843141 - DNA, 22 bp, Artificial Sequence
  chemically synthesized
agtggtcttttagtatagcaga

SEQ ID NO: 843142 - DNA, 22 bp, Artificial Sequence
  chemically synthesized
gtggtcttttagtatagcagaa

SEQ ID NO: 843143 - DNA, 22 bp, Artificial Sequence
  chemically synthesized
ttagtatagcagaatgggaatt

SEQ ID NO: 843144 - DNA, 22 bp, Artificial Sequence
  chemically synthesized
tagtatagcagaatgggaattt

SEQ ID NO: 843145 - DNA, 22 bp, Artificial Sequence
  chemically synthesized
agtatagcagaatgggaatttt

SEQ ID NO: 843146 - DNA, 22 bp, Artificial Sequence
  chemically synthesized
gtatagcagaatgggaattttc

SEQ ID NO: 843147 - DNA, 22 bp, Artificial Sequence
  chemically synthesized
gaaagggaatcaaaggagaaaa

SEQ ID NO: 843148 - DNA, 22 bp, Artificial Sequence
  chemically synthesized
tagaaagggaatcaaaggagaa

SEQ ID NO: 843149 - DNA, 22 bp, Artificial Sequence
  chemically synthesized
ctagaaagggaatcaaaggaga

SEQ ID NO: 843150 - DNA, 22 bp, Artificial Sequence
  chemically synthesized
tttctagaaagggaatcaaagg

SEQ ID NO: 843151 - DNA, 22 bp, Artificial Sequence
  chemically synthesized
atttctagaaagggaatcaaag

SEQ ID NO: 843152 - DNA, 22 bp, Artificial Sequence
  chemically synthesized
tatttctagaaagggaatcaaa

SEQ ID NO: 843153 - DNA, 22 bp, Artificial Sequence
  chemically synthesized
tttatttctagaaagggaatca

SEQ ID NO: 843154 - DNA, 22 bp, Artificial Sequence
  chemically synthesized
tctttatttctagaaagggaat

SEQ ID NO: 843155 - DNA, 22 bp, Artificial Sequence
  chemically synthesized
tctcctttgattccctttctag

SEQ ID NO: 843156 - DNA, 22 bp, Artificial Sequence
  chemically synthesized
ctcctttgattccctttctaga

SEQ ID NO: 843157 - DNA, 22 bp, Artificial Sequence
  chemically synthesized
tcctttgattccctttctagaa

SEQ ID NO: 843158 - DNA, 22 bp, Artificial Sequence
  chemically synthesized
ctttgattccctttctagaaat

SEQ ID NO: 843159 - DNA, 22 bp, Artificial Sequence
  chemically synthesized
aatccctctctttatttctaga

SEQ ID NO: 843160 - DNA, 22 bp, Artificial Sequence
  chemically synthesized
tgattccctttctagaaataaa

SEQ ID NO: 843161 - DNA, 22 bp, Artificial Sequence
  chemically synthesized
gattccctttctagaaataaag

SEQ ID NO: 843162 - DNA, 22 bp, Artificial Sequence
  chemically synthesized
attccctttctagaaataaaga

SEQ ID NO: 843163 - DNA, 22 bp, Artificial Sequence
  chemically synthesized
cctttctagaaataaagagagg

SEQ ID NO: 843164 - DNA, 22 bp, Artificial Sequence
  chemically synthesized
tctagaaataaagagagggatt

SEQ ID NO: 843165 - DNA, 22 bp, Artificial Sequence
  chemically synthesized
ctagaaataaagagagggattt

SEQ ID NO: 843166 - DNA, 22 bp, Artificial Sequence
  chemically synthesized
tagaaataaagagagggattta

SEQ ID NO: 843167 - DNA, 22 bp, Artificial Sequence
  chemically synthesized
gaaataaagagagggatttaat

SEQ ID NO: 843168 - DNA, 22 bp, Artificial Sequence
  chemically synthesized
aagcgtatgccatattaaatcc

SEQ ID NO: 843169 - DNA, 22 bp, Artificial Sequence
  chemically synthesized
atgaaaaaatactgaagcgtat

SEQ ID NO: 843170 - DNA, 22 bp, Artificial Sequence
  chemically synthesized
aatgaaaaaatactgaagcgta

SEQ ID NO: 843171 - DNA, 22 bp, Artificial Sequence
  chemically synthesized
aatatggcatacgcttcagtat

SEQ ID NO: 843172 - DNA, 22 bp, Artificial Sequence
  chemically synthesized
atatggcatacgcttcagtatt

SEQ ID NO: 843173 - DNA, 22 bp, Artificial Sequence
  chemically synthesized
taatatcttaatgaaaaaatac

SEQ ID NO: 843174 - DNA, 22 bp, Artificial Sequence
  chemically synthesized
ataatatcttaatgaaaaaata

SEQ ID NO: 843175 - DNA, 22 bp, Artificial Sequence
  chemically synthesized
tataatatcttaatgaaaaaat

SEQ ID NO: 843176 - DNA, 22 bp, Artificial Sequence
  chemically synthesized
ttataatatcttaatgaaaaaa

SEQ ID NO: 843177 - DNA, 22 bp, Artificial Sequence
  chemically synthesized
tttttataatatcttaatgaaa

SEQ ID NO: 843178 - DNA, 22 bp, Artificial Sequence
  chemically synthesized
cagtattttttcattaagatat

SEQ ID NO: 843179 - DNA, 22 bp, Artificial Sequence
  chemically synthesized
agtattttttcattaagatatt

SEQ ID NO: 843180 - DNA, 22 bp, Artificial Sequence
  chemically synthesized
accactgtttttataatatctt

SEQ ID NO: 843181 - DNA, 22 bp, Artificial Sequence
  chemically synthesized
aaccactgtttttataatatct

SEQ ID NO: 843182 - DNA, 22 bp, Artificial Sequence
  chemically synthesized
taaccactgtttttataatatc

SEQ ID NO: 843183 - DNA, 22 bp, Artificial Sequence
  chemically synthesized
ttaaccactgtttttataatat

SEQ ID NO: 843184 - DNA, 22 bp, Artificial Sequence
  chemically synthesized
tttcattaagatattataaaaa

SEQ ID NO: 843185 - DNA, 22 bp, Artificial Sequence
  chemically synthesized
ttttaaccactgtttttataat

SEQ ID NO: 843186 - DNA, 22 bp, Artificial Sequence
  chemically synthesized
ttcattaagatattataaaaac

SEQ ID NO: 843187 - DNA, 22 bp, Artificial Sequence
  chemically synthesized
tcattaagatattataaaaaca

SEQ ID NO: 843188 - DNA, 22 bp, Artificial Sequence
  chemically synthesized
cattaagatattataaaaacag

SEQ ID NO: 843189 - DNA, 22 bp, Artificial Sequence
  chemically synthesized
attaagatattataaaaacagt

SEQ ID NO: 843190 - DNA, 22 bp, Artificial Sequence
  chemically synthesized
agatattataaaaacagtggtt

SEQ ID NO: 843191 - DNA, 22 bp, Artificial Sequence
  chemically synthesized
gcaagaaattcttttaaccact

SEQ ID NO: 843192 - DNA, 22 bp, Artificial Sequence
  chemically synthesized
ttagcaagaaattcttttaacc

SEQ ID NO: 843193 - DNA, 22 bp, Artificial Sequence
  chemically synthesized
attagcaagaaattcttttaac

SEQ ID NO: 843194 - DNA, 22 bp, Artificial Sequence
  chemically synthesized
taaaaacagtggttaaaagaat

SEQ ID NO: 843195 - DNA, 22 bp, Artificial Sequence
  chemically synthesized
ttattagcaagaaattctttta

SEQ ID NO: 843196 - DNA, 22 bp, Artificial Sequence
  chemically synthesized
tgttcttattagcaagaaattc

SEQ ID NO: 843197 - DNA, 22 bp, Artificial Sequence
  chemically synthesized
gtgttcttattagcaagaaatt

SEQ ID NO: 843198 - DNA, 22 bp, Artificial Sequence
  chemically synthesized
aaagaatttcttgctaataaga

SEQ ID NO: 843199 - DNA, 22 bp, Artificial Sequence
  chemically synthesized
accatatgcttgtgttcttatt

SEQ ID NO: 843200 - DNA, 22 bp, Artificial Sequence
  chemically synthesized
tcaccatatgcttgtgttctta

SEQ ID NO: 843201 - DNA, 22 bp, Artificial Sequence
  chemically synthesized
ctctcaccatatgcttgtgttc

SEQ ID NO: 843202 - DNA, 22 bp, Artificial Sequence
  chemically synthesized
cttgctaataagaacacaagca

SEQ ID NO: 843203 - DNA, 22 bp, Artificial Sequence
  chemically synthesized
ttgctaataagaacacaagcat

SEQ ID NO: 843204 - DNA, 22 bp, Artificial Sequence
  chemically synthesized
gctaataagaacacaagcatat

SEQ ID NO: 843205 - DNA, 22 bp, Artificial Sequence
  chemically synthesized
ctaataagaacacaagcatatg

SEQ ID NO: 843206 - DNA, 22 bp, Artificial Sequence
  chemically synthesized
ataagaacacaagcatatggtg

SEQ ID NO: 843207 - DNA, 22 bp, Artificial Sequence
  chemically synthesized
aaaggaaaccaaatgaaaaata

SEQ ID NO: 843208 - DNA, 22 bp, Artificial Sequence
  chemically synthesized
aaaaggaaaccaaatgaaaaat

SEQ ID NO: 843209 - DNA, 22 bp, Artificial Sequence
  chemically synthesized
tttttcatttggtttcctttta

SEQ ID NO: 843210 - DNA, 22 bp, Artificial Sequence
  chemically synthesized
ttcatttggtttccttttaagg

SEQ ID NO: 843211 - DNA, 22 bp, Artificial Sequence
  chemically synthesized
tcatttggtttccttttaaggg

SEQ ID NO: 843212 - DNA, 22 bp, Artificial Sequence
  chemically synthesized
catttggtttccttttaagggt

SEQ ID NO: 843213 - DNA, 22 bp, Artificial Sequence
  chemically synthesized
atttggtttccttttaagggta

SEQ ID NO: 843214 - DNA, 22 bp, Artificial Sequence
  chemically synthesized
ggtttccttttaagggtattct

SEQ ID NO: 843215 - DNA, 22 bp, Artificial Sequence
  chemically synthesized
gtttccttttaagggtattcta

SEQ ID NO: 843216 - DNA, 22 bp, Artificial Sequence
  chemically synthesized
ccttttaagggtattctattta

SEQ ID NO: 843217 - DNA, 22 bp, Artificial Sequence
  chemically synthesized
cttttaagggtattctatttat

SEQ ID NO: 843218 - DNA, 22 bp, Artificial Sequence
  chemically synthesized
ttaagggtattctatttatttg

SEQ ID NO: 843219 - DNA, 22 bp, Artificial Sequence
  chemically synthesized
taagggtattctatttatttgc

SEQ ID NO: 843220 - DNA, 22 bp, Artificial Sequence
  chemically synthesized
aagggtattctatttatttgct

SEQ ID NO: 843221 - DNA, 22 bp, Artificial Sequence
  chemically synthesized
agggtattctatttatttgcta

SEQ ID NO: 843222 - DNA, 22 bp, Artificial Sequence
  chemically synthesized
aagtcaaagaaagtatagtagc

SEQ ID NO: 843223 - DNA, 22 bp, Artificial Sequence
  chemically synthesized
tatttatttgctactatacttt

SEQ ID NO: 843224 - DNA, 22 bp, Artificial Sequence
  chemically synthesized
tttatttgctactatactttct

SEQ ID NO: 843225 - DNA, 22 bp, Artificial Sequence
  chemically synthesized
agttgaagtcaaagaaagtata

SEQ ID NO: 843226 - DNA, 22 bp, Artificial Sequence
  chemically synthesized
atttgctactatactttctttg

SEQ ID NO: 843227 - DNA, 22 bp, Artificial Sequence
  chemically synthesized
tttgctactatactttctttga

SEQ ID NO: 843228 - DNA, 22 bp, Artificial Sequence
  chemically synthesized
gctactatactttctttgactt

SEQ ID NO: 843229 - DNA, 22 bp, Artificial Sequence
  chemically synthesized
ctactatactttctttgacttc

SEQ ID NO: 843230 - DNA, 22 bp, Artificial Sequence
  chemically synthesized
taaaactaagttgaagtcaaag

SEQ ID NO: 843231 - DNA, 22 bp, Artificial Sequence
  chemically synthesized
ctatactttctttgacttcaac

SEQ ID NO: 843232 - DNA, 22 bp, Artificial Sequence
  chemically synthesized
tactttctttgacttcaactta

SEQ ID NO: 843233 - DNA, 22 bp, Artificial Sequence
  chemically synthesized
gaattataaaactaagttgaag

SEQ ID NO: 843234 - DNA, 22 bp, Artificial Sequence
  chemically synthesized
tggaattataaaactaagttga

SEQ ID NO: 843235 - DNA, 22 bp, Artificial Sequence
  chemically synthesized
tctttgacttcaacttagtttt

SEQ ID NO: 843236 - DNA, 22 bp, Artificial Sequence
  chemically synthesized
ctttgacttcaacttagtttta

SEQ ID NO: 843237 - DNA, 22 bp, Artificial Sequence
  chemically synthesized
tttgacttcaacttagttttat

SEQ ID NO: 843238 - DNA, 22 bp, Artificial Sequence
  chemically synthesized
tgacttcaacttagttttataa

SEQ ID NO: 843239 - DNA, 22 bp, Artificial Sequence
  chemically synthesized
gacttcaacttagttttataat

SEQ ID NO: 843240 - DNA, 22 bp, Artificial Sequence
  chemically synthesized
agaagttctggaattataaaac

SEQ ID NO: 843241 - DNA, 22 bp, Artificial Sequence
  chemically synthesized
acttcaacttagttttataatt

SEQ ID NO: 843242 - DNA, 22 bp, Artificial Sequence
  chemically synthesized
gagaagttctggaattataaaa

SEQ ID NO: 843243 - DNA, 22 bp, Artificial Sequence
  chemically synthesized
tttgagaagttctggaattata

SEQ ID NO: 843244 - DNA, 22 bp, Artificial Sequence
  chemically synthesized
caacttagttttataattccag

SEQ ID NO: 843245 - DNA, 22 bp, Artificial Sequence
  chemically synthesized
atttgagaagttctggaattat

SEQ ID NO: 843246 - DNA, 22 bp, Artificial Sequence
  chemically synthesized
aacttagttttataattccaga

SEQ ID NO: 843247 - DNA, 22 bp, Artificial Sequence
  chemically synthesized
agttttataattccagaacttc

SEQ ID NO: 843248 - DNA, 22 bp, Artificial Sequence
  chemically synthesized
gttttataattccagaacttct

SEQ ID NO: 843249 - DNA, 22 bp, Artificial Sequence
  chemically synthesized
tataattccagaacttctcaaa

SEQ ID NO: 843250 - DNA, 22 bp, Artificial Sequence
  chemically synthesized
ataattccagaacttctcaaat

SEQ ID NO: 843251 - DNA, 22 bp, Artificial Sequence
  chemically synthesized
taattccagaacttctcaaata

SEQ ID NO: 843252 - DNA, 22 bp, Artificial Sequence
  chemically synthesized
cagaacttctcaaataaactga

SEQ ID NO: 843253 - DNA, 22 bp, Artificial Sequence
  chemically synthesized
gaaggaatagaggtgaaggtca

SEQ ID NO: 843254 - DNA, 22 bp, Artificial Sequence
  chemically synthesized
ctcaaataaactgaccttcacc

SEQ ID NO: 843255 - DNA, 22 bp, Artificial Sequence
  chemically synthesized
tcaaataaactgaccttcacct

SEQ ID NO: 843256 - DNA, 22 bp, Artificial Sequence
  chemically synthesized
aaataaactgaccttcacctct

SEQ ID NO: 843257 - DNA, 22 bp, Artificial Sequence
  chemically synthesized
tgggtggctcgaaggaatagag

SEQ ID NO: 843258 - DNA, 22 bp, Artificial Sequence
  chemically synthesized
accttcacctctattccttcga

SEQ ID NO: 843259 - DNA, 22 bp, Artificial Sequence
  chemically synthesized
atctgtgggtggctcgaaggaa

SEQ ID NO: 843260 - DNA, 22 bp, Artificial Sequence
  chemically synthesized
tcatctgtgggtggctcgaagg

SEQ ID NO: 843261 - DNA, 22 bp, Artificial Sequence
  chemically synthesized
ctcatctgtgggtggctcgaag

SEQ ID NO: 843262 - DNA, 22 bp, Artificial Sequence
  chemically synthesized
cacctctattccttcgagccac

SEQ ID NO: 843263 - DNA, 22 bp, Artificial Sequence
  chemically synthesized
tctcatctgtgggtggctcgaa

SEQ ID NO: 843264 - DNA, 22 bp, Artificial Sequence
  chemically synthesized
acctctattccttcgagccacc

SEQ ID NO: 843265 - DNA, 22 bp, Artificial Sequence
  chemically synthesized
tattccttcgagccacccacag

SEQ ID NO: 843266 - DNA, 22 bp, Artificial Sequence
  chemically synthesized
ttccttcgagccacccacagat

SEQ ID NO: 843267 - DNA, 22 bp, Artificial Sequence
  chemically synthesized
aggtgttttctcatctgtgggt

SEQ ID NO: 843268 - DNA, 22 bp, Artificial Sequence
  chemically synthesized
cttcgagccacccacagatgag

SEQ ID NO: 843269 - DNA, 22 bp, Artificial Sequence
  chemically synthesized
cgagccacccacagatgagaaa

SEQ ID NO: 843270 - DNA, 22 bp, Artificial Sequence
  chemically synthesized
gatctaaggtgttttctcatct

SEQ ID NO: 843271 - DNA, 22 bp, Artificial Sequence
  chemically synthesized
gagccacccacagatgagaaaa

SEQ ID NO: 843272 - DNA, 22 bp, Artificial Sequence
  chemically synthesized
agtaatgattagatctaaggtg

SEQ ID NO: 843273 - DNA, 22 bp, Artificial Sequence
  chemically synthesized
gagtaatgattagatctaaggt

SEQ ID NO: 843274 - DNA, 22 bp, Artificial Sequence
  chemically synthesized
gaggcaagtagtttgagtaatg

SEQ ID NO: 843275 - DNA, 22 bp, Artificial Sequence
  chemically synthesized
ggaggcaagtagtttgagtaat

SEQ ID NO: 843276 - DNA, 22 bp, Artificial Sequence
  chemically synthesized
tggaggcaagtagtttgagtaa

SEQ ID NO: 843277 - DNA, 22 bp, Artificial Sequence
  chemically synthesized
agatctaatcattactcaaact

SEQ ID NO: 843278 - DNA, 22 bp, Artificial Sequence
  chemically synthesized
gatctaatcattactcaaacta

SEQ ID NO: 843279 - DNA, 22 bp, Artificial Sequence
  chemically synthesized
atcattactcaaactacttgcc

SEQ ID NO: 843280 - DNA, 22 bp, Artificial Sequence
  chemically synthesized
tagatggatattttggaggcaa

SEQ ID NO: 843281 - DNA, 22 bp, Artificial Sequence
  chemically synthesized
atagatggatattttggaggca

SEQ ID NO: 843282 - DNA, 22 bp, Artificial Sequence
  chemically synthesized
ctcaaactacttgcctccaaaa

SEQ ID NO: 843283 - DNA, 22 bp, Artificial Sequence
  chemically synthesized
tatagatggatattttggaggc

SEQ ID NO: 843284 - DNA, 22 bp, Artificial Sequence
  chemically synthesized
aaactacttgcctccaaaatat

SEQ ID NO: 843285 - DNA, 22 bp, Artificial Sequence
  chemically synthesized
cttgcctccaaaatatccatct

SEQ ID NO: 843286 - DNA, 22 bp, Artificial Sequence
  chemically synthesized
gcctccaaaatatccatctata

SEQ ID NO: 843287 - DNA, 22 bp, Artificial Sequence
  chemically synthesized
cctccaaaatatccatctataa

SEQ ID NO: 843288 - DNA, 22 bp, Artificial Sequence
  chemically synthesized
caaaatatccatctataaaatt

SEQ ID NO: 843289 - DNA, 22 bp, Artificial Sequence
  chemically synthesized
ggggcagagaacagaattttat

SEQ ID NO: 843290 - DNA, 22 bp, Artificial Sequence
  chemically synthesized
taaaattctgttctctgccccc

SEQ ID NO: 843291 - DNA, 22 bp, Artificial Sequence
  chemically synthesized
gtaggggtagcagattgggggc

SEQ ID NO: 843292 - DNA, 22 bp, Artificial Sequence
  chemically synthesized
tgttctctgcccccaatctgct

SEQ ID NO: 843293 - DNA, 22 bp, Artificial Sequence
  chemically synthesized
ttctctgcccccaatctgctac

SEQ ID NO: 843294 - DNA, 22 bp, Artificial Sequence
  chemically synthesized
tctgcccccaatctgctacccc

SEQ ID NO: 843295 - DNA, 22 bp, Artificial Sequence
  chemically synthesized
tgcccccaatctgctaccccta

SEQ ID NO: 843296 - DNA, 22 bp, Artificial Sequence
  chemically synthesized
cccccaatctgctacccctacc

SEQ ID NO: 843297 - DNA, 22 bp, Artificial Sequence
  chemically synthesized
ggagagtaacatctggtagggg

SEQ ID NO: 843298 - DNA, 22 bp, Artificial Sequence
  chemically synthesized
gggagagtaacatctggtaggg

SEQ ID NO: 843299 - DNA, 22 bp, Artificial Sequence
  chemically synthesized
ctacccctaccagatgttactc

SEQ ID NO: 843300 - DNA, 22 bp, Artificial Sequence
  chemically synthesized
cccctaccagatgttactctcc

SEQ ID NO: 843301 - DNA, 22 bp, Artificial Sequence
  chemically synthesized
ggaacagcatgtttgggagagt

SEQ ID NO: 843302 - DNA, 22 bp, Artificial Sequence
  chemically synthesized
ccagatgttactctcccaaaca

SEQ ID NO: 843303 - DNA, 22 bp, Artificial Sequence
  chemically synthesized
ctctcccaaacatgctgttcct

SEQ ID NO: 843304 - DNA, 22 bp, Artificial Sequence
  chemically synthesized
tcccaaacatgctgttcctagt

SEQ ID NO: 843305 - DNA, 22 bp, Artificial Sequence
  chemically synthesized
ccaaacatgctgttcctagtat

SEQ ID NO: 843306 - DNA, 22 bp, Artificial Sequence
  chemically synthesized
ttcctagtattatcttcatcct

SEQ ID NO: 843307 - DNA, 22 bp, Artificial Sequence
  chemically synthesized
ctagtattatcttcatcctcat

SEQ ID NO: 843308 - DNA, 22 bp, Artificial Sequence
  chemically synthesized
gtattatcttcatcctcatatg

SEQ ID NO: 843309 - DNA, 22 bp, Artificial Sequence
  chemically synthesized
tcttcatcctcatatgacctct

SEQ ID NO: 843310 - DNA, 22 bp, Artificial Sequence
  chemically synthesized
catcctcatatgacctctggtc

SEQ ID NO: 843311 - DNA, 22 bp, Artificial Sequence
  chemically synthesized
atcctcatatgacctctggtcc

SEQ ID NO: 843312 - DNA, 22 bp, Artificial Sequence
  chemically synthesized
aggaaacagaaaaggaccagag

SEQ ID NO: 843313 - DNA, 22 bp, Artificial Sequence
  chemically synthesized
atatgacctctggtccttttct

SEQ ID NO: 843314 - DNA, 22 bp, Artificial Sequence
  chemically synthesized
ggttgaggaaacagaaaaggac

SEQ ID NO: 843315 - DNA, 22 bp, Artificial Sequence
  chemically synthesized
aagctaggttgaggaaacagaa

SEQ ID NO: 843316 - DNA, 22 bp, Artificial Sequence
  chemically synthesized
tggtccttttctgtttcctcaa

SEQ ID NO: 843317 - DNA, 22 bp, Artificial Sequence
  chemically synthesized
gtccttttctgtttcctcaacc

SEQ ID NO: 843318 - DNA, 22 bp, Artificial Sequence
  chemically synthesized
tgactaaagctaggttgaggaa

SEQ ID NO: 843319 - DNA, 22 bp, Artificial Sequence
  chemically synthesized
ttatgactaaagctaggttgag

SEQ ID NO: 843320 - DNA, 22 bp, Artificial Sequence
  chemically synthesized
gttatgactaaagctaggttga

SEQ ID NO: 843321 - DNA, 22 bp, Artificial Sequence
  chemically synthesized
ttctgtttcctcaacctagctt

SEQ ID NO: 843322 - DNA, 22 bp, Artificial Sequence
  chemically synthesized
tctgtttcctcaacctagcttt

SEQ ID NO: 843323 - DNA, 22 bp, Artificial Sequence
  chemically synthesized
tttgttatgactaaagctaggt

SEQ ID NO: 843324 - DNA, 22 bp, Artificial Sequence
  chemically synthesized
ctgtttcctcaacctagcttta

SEQ ID NO: 843325 - DNA, 22 bp, Artificial Sequence
  chemically synthesized
gtttgttatgactaaagctagg

SEQ ID NO: 843326 - DNA, 22 bp, Artificial Sequence
  chemically synthesized
tgtttcctcaacctagctttag

SEQ ID NO: 843327 - DNA, 22 bp, Artificial Sequence
  chemically synthesized
tttcctcaacctagctttagtc

SEQ ID NO: 843328 - DNA, 22 bp, Artificial Sequence
  chemically synthesized
cttgtttgttatgactaaagct

SEQ ID NO: 843329 - DNA, 22 bp, Artificial Sequence
  chemically synthesized
tacttgtttgttatgactaaag

SEQ ID NO: 843330 - DNA, 22 bp, Artificial Sequence
  chemically synthesized
cctcaacctagctttagtcata

SEQ ID NO: 843331 - DNA, 22 bp, Artificial Sequence
  chemically synthesized
ctcaacctagctttagtcataa

SEQ ID NO: 843332 - DNA, 22 bp, Artificial Sequence
  chemically synthesized
aacctagctttagtcataacaa

SEQ ID NO: 843333 - DNA, 22 bp, Artificial Sequence
  chemically synthesized
gcattctacttgtttgttatga

SEQ ID NO: 843334 - DNA, 22 bp, Artificial Sequence
  chemically synthesized
gctttagtcataacaaacaagt

SEQ ID NO: 843335 - DNA, 22 bp, Artificial Sequence
  chemically synthesized
tagtcataacaaacaagtagaa

SEQ ID NO: 843336 - DNA, 22 bp, Artificial Sequence
  chemically synthesized
agtcataacaaacaagtagaat

SEQ ID NO: 843337 - DNA, 22 bp, Artificial Sequence
  chemically synthesized
gtcataacaaacaagtagaatg

SEQ ID NO: 843338 - DNA, 22 bp, Artificial Sequence
  chemically synthesized
ggatcatatcagagaaataaat

SEQ ID NO: 843339 - DNA, 22 bp, Artificial Sequence
  chemically synthesized
attgtgcttatttatttctctg

SEQ ID NO: 843340 - DNA, 22 bp, Artificial Sequence
  chemically synthesized
tgcttatttatttctctgatat

SEQ ID NO: 843341 - DNA, 22 bp, Artificial Sequence
  chemically synthesized
atttatttctctgatatgatcc

SEQ ID NO: 843342 - DNA, 22 bp, Artificial Sequence
  chemically synthesized
tttatttctctgatatgatccc

SEQ ID NO: 843343 - DNA, 22 bp, Artificial Sequence
  chemically synthesized
tgtcacaaatatctgggatcat

SEQ ID NO: 843344 - DNA, 22 bp, Artificial Sequence
  chemically synthesized
atttctctgatatgatcccaga

SEQ ID NO: 843345 - DNA, 22 bp, Artificial Sequence
  chemically synthesized
gtgtcacaaatatctgggatca

SEQ ID NO: 843346 - DNA, 22 bp, Artificial Sequence
  chemically synthesized
tttctctgatatgatcccagat

SEQ ID NO: 843347 - DNA, 22 bp, Artificial Sequence
  chemically synthesized
tttgtgtcacaaatatctggga

SEQ ID NO: 843348 - DNA, 22 bp, Artificial Sequence
  chemically synthesized
ctctgatatgatcccagatatt

SEQ ID NO: 843349 - DNA, 22 bp, Artificial Sequence
  chemically synthesized
tctgatatgatcccagatattt

SEQ ID NO: 843350 - DNA, 22 bp, Artificial Sequence
  chemically synthesized
tgatatgatcccagatatttgt

SEQ ID NO: 843351 - DNA, 22 bp, Artificial Sequence
  chemically synthesized
agttatttgtgtcacaaatatc

SEQ ID NO: 843352 - DNA, 22 bp, Artificial Sequence
  chemically synthesized
atatgatcccagatatttgtga

SEQ ID NO: 843353 - DNA, 22 bp, Artificial Sequence
  chemically synthesized
aagttatttgtgtcacaaatat

SEQ ID NO: 843354 - DNA, 22 bp, Artificial Sequence
  chemically synthesized
taagttatttgtgtcacaaata

SEQ ID NO: 843355 - DNA, 22 bp, Artificial Sequence
  chemically synthesized
gctttaagttatttgtgtcaca

SEQ ID NO: 843356 - DNA, 22 bp, Artificial Sequence
  chemically synthesized
ttcgctttaagttatttgtgtc

SEQ ID NO: 843357 - DNA, 22 bp, Artificial Sequence
  chemically synthesized
gttcgctttaagttatttgtgt

SEQ ID NO: 843358 - DNA, 22 bp, Artificial Sequence
  chemically synthesized
tgttcgctttaagttatttgtg

SEQ ID NO: 843359 - DNA, 22 bp, Artificial Sequence
  chemically synthesized
gttttgttcgctttaagttatt

SEQ ID NO: 843360 - DNA, 22 bp, Artificial Sequence
  chemically synthesized
agttttgttcgctttaagttat

SEQ ID NO: 843361 - DNA, 22 bp, Artificial Sequence
  chemically synthesized
tagttttgttcgctttaagtta

SEQ ID NO: 843362 - DNA, 22 bp, Artificial Sequence
  chemically synthesized
gtgacacaaataacttaaagcg

SEQ ID NO: 843363 - DNA, 22 bp, Artificial Sequence
  chemically synthesized
tgacacaaataacttaaagcga

SEQ ID NO: 843364 - DNA, 22 bp, Artificial Sequence
  chemically synthesized
aaagcgaacaaaactaaaatca

SEQ ID NO: 843365 - DNA, 22 bp, Artificial Sequence
  chemically synthesized
gtaagcatgtaatgattttagt

SEQ ID NO: 843366 - DNA, 22 bp, Artificial Sequence
  chemically synthesized
aagcgaacaaaactaaaatcat

SEQ ID NO: 843367 - DNA, 22 bp, Artificial Sequence
  chemically synthesized
ggtactggtaagcatgtaatga

SEQ ID NO: 843368 - DNA, 22 bp, Artificial Sequence
  chemically synthesized
aggtactggtaagcatgtaatg

SEQ ID NO: 843369 - DNA, 22 bp, Artificial Sequence
  chemically synthesized
aaatcattacatgcttaccagt

SEQ ID NO: 843370 - DNA, 22 bp, Artificial Sequence
  chemically synthesized
tcatgcttaggtactggtaagc

SEQ ID NO: 843371 - DNA, 22 bp, Artificial Sequence
  chemically synthesized
catgcttaccagtacctaagca

SEQ ID NO: 843372 - DNA, 22 bp, Artificial Sequence
  chemically synthesized
accagtacctaagcatgataat

SEQ ID NO: 843373 - DNA, 22 bp, Artificial Sequence
  chemically synthesized
ccagtacctaagcatgataatg

SEQ ID NO: 843374 - DNA, 22 bp, Artificial Sequence
  chemically synthesized
agcatgataatggatcgtgtct

SEQ ID NO: 843375 - DNA, 22 bp, Artificial Sequence
  chemically synthesized
gaatgatagaatccatgtagac

SEQ ID NO: 843376 - DNA, 22 bp, Artificial Sequence
  chemically synthesized
tagaatgatagaatccatgtag

SEQ ID NO: 843377 - DNA, 22 bp, Artificial Sequence
  chemically synthesized
ctctagaatgatagaatccatg

SEQ ID NO: 843378 - DNA, 22 bp, Artificial Sequence
  chemically synthesized
cctctagaatgatagaatccat

SEQ ID NO: 843379 - DNA, 22 bp, Artificial Sequence
  chemically synthesized
tttcctctagaatgatagaatc

SEQ ID NO: 843380 - DNA, 22 bp, Artificial Sequence
  chemically synthesized
gtttcctctagaatgatagaat

SEQ ID NO: 843381 - DNA, 22 bp, Artificial Sequence
  chemically synthesized
tgtttcctctagaatgatagaa

SEQ ID NO: 843382 - DNA, 22 bp, Artificial Sequence
  chemically synthesized
tgttttgtttcctctagaatga

SEQ ID NO: 843383 - DNA, 22 bp, Artificial Sequence
  chemically synthesized
catggattctatcattctagag

SEQ ID NO: 843384 - DNA, 22 bp, Artificial Sequence
  chemically synthesized
ctgtgttttgtttcctctagaa

SEQ ID NO: 843385 - DNA, 22 bp, Artificial Sequence
  chemically synthesized
tcctgtgttttgtttcctctag

SEQ ID NO: 843386 - DNA, 22 bp, Artificial Sequence
  chemically synthesized
ctcctgtgttttgtttcctcta

SEQ ID NO: 843387 - DNA, 22 bp, Artificial Sequence
  chemically synthesized
cttctcctgtgttttgtttcct

SEQ ID NO: 843388 - DNA, 22 bp, Artificial Sequence
  chemically synthesized
tatcattctagaggaaacaaaa

SEQ ID NO: 843389 - DNA, 22 bp, Artificial Sequence
  chemically synthesized
ccttctcctgtgttttgtttcc

SEQ ID NO: 843390 - DNA, 22 bp, Artificial Sequence
  chemically synthesized
tcattctagaggaaacaaaaca

SEQ ID NO: 843391 - DNA, 22 bp, Artificial Sequence
  chemically synthesized
cttccttctcctgtgttttgtt

SEQ ID NO: 843392 - DNA, 22 bp, Artificial Sequence
  chemically synthesized
attccttccttctcctgtgttt

SEQ ID NO: 843393 - DNA, 22 bp, Artificial Sequence
  chemically synthesized
tagaggaaacaaaacacaggag

SEQ ID NO: 843394 - DNA, 22 bp, Artificial Sequence
  chemically synthesized
gaggaaacaaaacacaggagaa

SEQ ID NO: 843395 - DNA, 22 bp, Artificial Sequence
  chemically synthesized
gaaatagcattgattccttcct

SEQ ID NO: 843396 - DNA, 22 bp, Artificial Sequence
  chemically synthesized
agaaatagcattgattccttcc

SEQ ID NO: 843397 - DNA, 22 bp, Artificial Sequence
  chemically synthesized
cttagaaatagcattgattcct

SEQ ID NO: 843398 - DNA, 22 bp, Artificial Sequence
  chemically synthesized
tgactccttagaaatagcattg

SEQ ID NO: 843399 - DNA, 22 bp, Artificial Sequence
  chemically synthesized
atgactccttagaaatagcatt

SEQ ID NO: 843400 - DNA, 22 bp, Artificial Sequence
  chemically synthesized
acttatgactccttagaaatag

SEQ ID NO: 843401 - DNA, 22 bp, Artificial Sequence
  chemically synthesized
tttctaaggagtcataagtcag

SEQ ID NO: 843402 - DNA, 22 bp, Artificial Sequence
  chemically synthesized
gtaaagcccagtagctgactta

SEQ ID NO: 843403 - DNA, 22 bp, Artificial Sequence
  chemically synthesized
ctaaggagtcataagtcagcta

SEQ ID NO: 843404 - DNA, 22 bp, Artificial Sequence
  chemically synthesized
agtaaagcccagtagctgactt

SEQ ID NO: 843405 - DNA, 22 bp, Artificial Sequence
  chemically synthesized
taaggagtcataagtcagctac

SEQ ID NO: 843406 - DNA, 22 bp, Artificial Sequence
  chemically synthesized
tagtaaagcccagtagctgact

SEQ ID NO: 843407 - DNA, 22 bp, Artificial Sequence
  chemically synthesized
ttagtaaagcccagtagctgac

SEQ ID NO: 843408 - DNA, 22 bp, Artificial Sequence
  chemically synthesized
aggagtcataagtcagctactg

SEQ ID NO: 843409 - DNA, 22 bp, Artificial Sequence
  chemically synthesized
caaggggtaagcagtttttagt

SEQ ID NO: 843410 - DNA, 22 bp, Artificial Sequence
  chemically synthesized
ctgggctttactaaaaactgct

SEQ ID NO: 843411 - DNA, 22 bp, Artificial Sequence
  chemically synthesized
atctccaaggggtaagcagttt

SEQ ID NO: 843412 - DNA, 22 bp, Artificial Sequence
  chemically synthesized
ggctttactaaaaactgcttac

SEQ ID NO: 843413 - DNA, 22 bp, Artificial Sequence
  chemically synthesized
tcatctccaaggggtaagcagt

SEQ ID NO: 843414 - DNA, 22 bp, Artificial Sequence
  chemically synthesized
tactaaaaactgcttacccctt

SEQ ID NO: 843415 - DNA, 22 bp, Artificial Sequence
  chemically synthesized
actaaaaactgcttaccccttg

SEQ ID NO: 843416 - DNA, 22 bp, Artificial Sequence
  chemically synthesized
ctaaaaactgcttaccccttgg

SEQ ID NO: 843417 - DNA, 22 bp, Artificial Sequence
  chemically synthesized
aaaactgcttaccccttggaga

SEQ ID NO: 843418 - DNA, 22 bp, Artificial Sequence
  chemically synthesized
cttaccccttggagatgagaat

SEQ ID NO: 843419 - DNA, 22 bp, Artificial Sequence
  chemically synthesized
accccttggagatgagaattca

SEQ ID NO: 843420 - DNA, 22 bp, Artificial Sequence
  chemically synthesized
ccccttggagatgagaattcat

SEQ ID NO: 843421 - DNA, 22 bp, Artificial Sequence
  chemically synthesized
gtggaatccatgatgaattctc

SEQ ID NO: 843422 - DNA, 22 bp, Artificial Sequence
  chemically synthesized
agctagtggaatccatgatgaa

SEQ ID NO: 843423 - DNA, 22 bp, Artificial Sequence
  chemically synthesized
ggagatgagaattcatcatgga

SEQ ID NO: 843424 - DNA, 22 bp, Artificial Sequence
  chemically synthesized
gagatgagaattcatcatggat

SEQ ID NO: 843425 - DNA, 22 bp, Artificial Sequence
  chemically synthesized
ctcagctagtggaatccatgat

SEQ ID NO: 843426 - DNA, 22 bp, Artificial Sequence
  chemically synthesized
gctcagctagtggaatccatga

SEQ ID NO: 843427 - DNA, 22 bp, Artificial Sequence
  chemically synthesized
tgctcagctagtggaatccatg

SEQ ID NO: 843428 - DNA, 22 bp, Artificial Sequence
  chemically synthesized
catctttgctcagctagtggaa

SEQ ID NO: 843429 - DNA, 22 bp, Artificial Sequence
  chemically synthesized
ctccatctttgctcagctagtg

SEQ ID NO: 843430 - DNA, 22 bp, Artificial Sequence
  chemically synthesized
atcatggattccactagctgag

SEQ ID NO: 843431 - DNA, 22 bp, Artificial Sequence
  chemically synthesized
cctccatctttgctcagctagt

SEQ ID NO: 843432 - DNA, 22 bp, Artificial Sequence
  chemically synthesized
tcctccatctttgctcagctag

SEQ ID NO: 843433 - DNA, 22 bp, Artificial Sequence
  chemically synthesized
ttcctccatctttgctcagcta

SEQ ID NO: 843434 - DNA, 22 bp, Artificial Sequence
  chemically synthesized
tttcctccatctttgctcagct

SEQ ID NO: 843435 - DNA, 22 bp, Artificial Sequence
  chemically synthesized
ttttcctccatctttgctcagc

SEQ ID NO: 843436 - DNA, 22 bp, Artificial Sequence
  chemically synthesized
tttttcctccatctttgctcag

SEQ ID NO: 843437 - DNA, 22 bp, Artificial Sequence
  chemically synthesized
cactagctgagcaaagatggag

SEQ ID NO: 843438 - DNA, 22 bp, Artificial Sequence
  chemically synthesized
aagaattttttttcctccatct

SEQ ID NO: 843439 - DNA, 22 bp, Artificial Sequence
  chemically synthesized
gaagaattttttttcctccatc

SEQ ID NO: 843440 - DNA, 22 bp, Artificial Sequence
  chemically synthesized
gctgagcaaagatggaggaaaa

SEQ ID NO: 843441 - DNA, 22 bp, Artificial Sequence
  chemically synthesized
tatttgaagaattttttttcct

SEQ ID NO: 843442 - DNA, 22 bp, Artificial Sequence
  chemically synthesized
agcaaagatggaggaaaaaaaa

SEQ ID NO: 843443 - DNA, 22 bp, Artificial Sequence
  chemically synthesized
gtatttgaagaattttttttcc

SEQ ID NO: 843444 - DNA, 22 bp, Artificial Sequence
  chemically synthesized
tgtatttgaagaattttttttc

SEQ ID NO: 843445 - DNA, 22 bp, Artificial Sequence
  chemically synthesized
actttgtatttgaagaattttt

SEQ ID NO: 843446 - DNA, 22 bp, Artificial Sequence
  chemically synthesized
attcactttgtatttgaagaat

SEQ ID NO: 843447 - DNA, 22 bp, Artificial Sequence
  chemically synthesized
tgattcactttgtatttgaaga

SEQ ID NO: 843448 - DNA, 22 bp, Artificial Sequence
  chemically synthesized
ctgattcactttgtatttgaag

SEQ ID NO: 843449 - DNA, 22 bp, Artificial Sequence
  chemically synthesized
aagacttctgattcactttgta

SEQ ID NO: 843450 - DNA, 22 bp, Artificial Sequence
  chemically synthesized
ttcaaatacaaagtgaatcaga

SEQ ID NO: 843451 - DNA, 22 bp, Artificial Sequence
  chemically synthesized
caaatacaaagtgaatcagaag

SEQ ID NO: 843452 - DNA, 22 bp, Artificial Sequence
  chemically synthesized
aaatacaaagtgaatcagaagt

SEQ ID NO: 843453 - DNA, 22 bp, Artificial Sequence
  chemically synthesized
gtgagattaaagacttctgatt

SEQ ID NO: 843454 - DNA, 22 bp, Artificial Sequence
  chemically synthesized
agtgagattaaagacttctgat

SEQ ID NO: 843455 - DNA, 22 bp, Artificial Sequence
  chemically synthesized
gggggacttagtgagattaaag

SEQ ID NO: 843456 - DNA, 22 bp, Artificial Sequence
  chemically synthesized
tggggggacttagtgagattaa

SEQ ID NO: 843457 - DNA, 22 bp, Artificial Sequence
  chemically synthesized
aactctggggggacttagtgag

SEQ ID NO: 843458 - DNA, 22 bp, Artificial Sequence
  chemically synthesized
actcaactctggggggacttag

SEQ ID NO: 843459 - DNA, 22 bp, Artificial Sequence
  chemically synthesized
cactcaactctggggggactta

SEQ ID NO: 843460 - DNA, 22 bp, Artificial Sequence
  chemically synthesized
taatctcactaagtccccccag

SEQ ID NO: 843461 - DNA, 22 bp, Artificial Sequence
  chemically synthesized
aatctcactaagtccccccaga

SEQ ID NO: 843462 - DNA, 22 bp, Artificial Sequence
  chemically synthesized
atctcactaagtccccccagag

SEQ ID NO: 843463 - DNA, 22 bp, Artificial Sequence
  chemically synthesized
taaccacttcactcaactctgg

SEQ ID NO: 843464 - DNA, 22 bp, Artificial Sequence
  chemically synthesized
actaagtccccccagagttgag

SEQ ID NO: 843465 - DNA, 22 bp, Artificial Sequence
  chemically synthesized
ataaccacttcactcaactctg

SEQ ID NO: 843466 - DNA, 22 bp, Artificial Sequence
  chemically synthesized
tttataaccacttcactcaact

SEQ ID NO: 843467 - DNA, 22 bp, Artificial Sequence
  chemically synthesized
agtccccccagagttgagtgaa

SEQ ID NO: 843468 - DNA, 22 bp, Artificial Sequence
  chemically synthesized
ctatttataaccacttcactca

SEQ ID NO: 843469 - DNA, 22 bp, Artificial Sequence
  chemically synthesized
atagggttgctatttataacca

SEQ ID NO: 843470 - DNA, 22 bp, Artificial Sequence
  chemically synthesized
catagggttgctatttataacc

SEQ ID NO: 843471 - DNA, 22 bp, Artificial Sequence
  chemically synthesized
tttcatagggttgctatttata

SEQ ID NO: 843472 - DNA, 22 bp, Artificial Sequence
  chemically synthesized
agtgaagtggttataaatagca

SEQ ID NO: 843473 - DNA, 22 bp, Artificial Sequence
  chemically synthesized
ctatttcatagggttgctattt

SEQ ID NO: 843474 - DNA, 22 bp, Artificial Sequence
  chemically synthesized
cctatttcatagggttgctatt

SEQ ID NO: 843475 - DNA, 22 bp, Artificial Sequence
  chemically synthesized
acttcctatttcatagggttgc

SEQ ID NO: 843476 - DNA, 22 bp, Artificial Sequence
  chemically synthesized
aacttcctatttcatagggttg

SEQ ID NO: 843477 - DNA, 22 bp, Artificial Sequence
  chemically synthesized
tttaacttcctatttcataggg

SEQ ID NO: 843478 - DNA, 22 bp, Artificial Sequence
  chemically synthesized
taaatagcaaccctatgaaata

SEQ ID NO: 843479 - DNA, 22 bp, Artificial Sequence
  chemically synthesized
actgtttaacttcctatttcat

SEQ ID NO: 843480 - DNA, 22 bp, Artificial Sequence
  chemically synthesized
cactgtttaacttcctatttca

SEQ ID NO: 843481 - DNA, 22 bp, Artificial Sequence
  chemically synthesized
tgaaataggaagttaaacagtg

SEQ ID NO: 843482 - DNA, 22 bp, Artificial Sequence
  chemically synthesized
taatatgtatgatttcactgtt

SEQ ID NO: 843483 - DNA, 22 bp, Artificial Sequence
  chemically synthesized
gttataatatgtatgatttcac

SEQ ID NO: 843484 - DNA, 22 bp, Artificial Sequence
  chemically synthesized
aacagtgaaatcatacatatta

SEQ ID NO: 843485 - DNA, 22 bp, Artificial Sequence
  chemically synthesized
aaatgccctagttataatatgt

SEQ ID NO: 843486 - DNA, 22 bp, Artificial Sequence
  chemically synthesized
aaagcctaaaatgccctagtta

SEQ ID NO: 843487 - DNA, 22 bp, Artificial Sequence
  chemically synthesized
tctaaaagcctaaaatgcccta

SEQ ID NO: 843488 - DNA, 22 bp, Artificial Sequence
  chemically synthesized
gtctaaaagcctaaaatgccct

SEQ ID NO: 843489 - DNA, 22 bp, Artificial Sequence
  chemically synthesized
tgtctaaaagcctaaaatgccc

SEQ ID NO: 843490 - DNA, 22 bp, Artificial Sequence
  chemically synthesized
taactagggcattttaggcttt

SEQ ID NO: 843491 - DNA, 22 bp, Artificial Sequence
  chemically synthesized
taattttgtctaaaagcctaaa

SEQ ID NO: 843492 - DNA, 22 bp, Artificial Sequence
  chemically synthesized
gggcattttaggcttttagaca

SEQ ID NO: 843493 - DNA, 22 bp, Artificial Sequence
  chemically synthesized
taggcttttagacaaaattaca

SEQ ID NO: 843494 - DNA, 22 bp, Artificial Sequence
  chemically synthesized
aggcttttagacaaaattacaa

SEQ ID NO: 843495 - DNA, 22 bp, Artificial Sequence
  chemically synthesized
ggcttttagacaaaattacaat

SEQ ID NO: 843496 - DNA, 22 bp, Artificial Sequence
  chemically synthesized
atgaatacaataaaaaattgta

SEQ ID NO: 843497 - DNA, 22 bp, Artificial Sequence
  chemically synthesized
ttagacaaaattacaatttttt

SEQ ID NO: 843498 - DNA, 22 bp, Artificial Sequence
  chemically synthesized
aatgaatacaataaaaaattgt

SEQ ID NO: 843499 - DNA, 22 bp, Artificial Sequence
  chemically synthesized
tagacaaaattacaatttttta

SEQ ID NO: 843500 - DNA, 22 bp, Artificial Sequence
  chemically synthesized
taatgaatacaataaaaaattg

SEQ ID NO: 843501 - DNA, 22 bp, Artificial Sequence
  chemically synthesized
agacaaaattacaattttttat

SEQ ID NO: 843502 - DNA, 22 bp, Artificial Sequence
  chemically synthesized
gacaaaattacaattttttatt

SEQ ID NO: 843503 - DNA, 22 bp, Artificial Sequence
  chemically synthesized
ttttaatgaatacaataaaaaa

SEQ ID NO: 843504 - DNA, 22 bp, Artificial Sequence
  chemically synthesized
tattttaatgaatacaataaaa

SEQ ID NO: 843505 - DNA, 22 bp, Artificial Sequence
  chemically synthesized
caattttttattgtattcatta

SEQ ID NO: 843506 - DNA, 22 bp, Artificial Sequence
  chemically synthesized
ggtggaattctattttaatgaa

SEQ ID NO: 843507 - DNA, 22 bp, Artificial Sequence
  chemically synthesized
aggtggaattctattttaatga

SEQ ID NO: 843508 - DNA, 22 bp, Artificial Sequence
  chemically synthesized
tttattgtattcattaaaatag

SEQ ID NO: 843509 - DNA, 22 bp, Artificial Sequence
  chemically synthesized
ttattgtattcattaaaataga

SEQ ID NO: 843510 - DNA, 22 bp, Artificial Sequence
  chemically synthesized
tttaggtggaattctattttaa

SEQ ID NO: 843511 - DNA, 22 bp, Artificial Sequence
  chemically synthesized
tattgtattcattaaaatagaa

SEQ ID NO: 843512 - DNA, 22 bp, Artificial Sequence
  chemically synthesized
attgtattcattaaaatagaat

SEQ ID NO: 843513 - DNA, 22 bp, Artificial Sequence
  chemically synthesized
ttgtattcattaaaatagaatt

SEQ ID NO: 843514 - DNA, 22 bp, Artificial Sequence
  chemically synthesized
tattcattaaaatagaattcca

SEQ ID NO: 843515 - DNA, 22 bp, Artificial Sequence
  chemically synthesized
agtattatttaggtggaattct

SEQ ID NO: 843516 - DNA, 22 bp, Artificial Sequence
  chemically synthesized
gagtattatttaggtggaattc

SEQ ID NO: 843517 - DNA, 22 bp, Artificial Sequence
  chemically synthesized
attaaaatagaattccacctaa

SEQ ID NO: 843518 - DNA, 22 bp, Artificial Sequence
  chemically synthesized
tttgagtattatttaggtggaa

SEQ ID NO: 843519 - DNA, 22 bp, Artificial Sequence
  chemically synthesized
atttgagtattatttaggtgga

SEQ ID NO: 843520 - DNA, 22 bp, Artificial Sequence
  chemically synthesized
tatttgagtattatttaggtgg

SEQ ID NO: 843521 - DNA, 22 bp, Artificial Sequence
  chemically synthesized
ttatttgagtattatttaggtg

SEQ ID NO: 843522 - DNA, 22 bp, Artificial Sequence
  chemically synthesized
aaatagaattccacctaaataa

SEQ ID NO: 843523 - DNA, 22 bp, Artificial Sequence
  chemically synthesized
cacctaaataatactcaaataa

SEQ ID NO: 843524 - DNA, 22 bp, Artificial Sequence
  chemically synthesized
aacatatagagtttttatttga

SEQ ID NO: 843525 - DNA, 22 bp, Artificial Sequence
  chemically synthesized
aataatactcaaataaaaactc

SEQ ID NO: 843526 - DNA, 22 bp, Artificial Sequence
  chemically synthesized
aactcaacatatagagttttta

SEQ ID NO: 843527 - DNA, 22 bp, Artificial Sequence
  chemically synthesized
agcattcaactcaacatataga

SEQ ID NO: 843528 - DNA, 22 bp, Artificial Sequence
  chemically synthesized
aaataaaaactctatatgttga

SEQ ID NO: 843529 - DNA, 22 bp, Artificial Sequence
  chemically synthesized
tatatgttgagttgaatgctta

SEQ ID NO: 843530 - DNA, 22 bp, Artificial Sequence
  chemically synthesized
gacatgtaaatactaagcattc

SEQ ID NO: 843531 - DNA, 22 bp, Artificial Sequence
  chemically synthesized
tatgttgagttgaatgcttagt

SEQ ID NO: 843532 - DNA, 22 bp, Artificial Sequence
  chemically synthesized
agacatgtaaatactaagcatt

SEQ ID NO: 843533 - DNA, 22 bp, Artificial Sequence
  chemically synthesized
ttagacatgtaaatactaagca

SEQ ID NO: 843534 - DNA, 22 bp, Artificial Sequence
  chemically synthesized
cttagacatgtaaatactaagc

SEQ ID NO: 843535 - DNA, 22 bp, Artificial Sequence
  chemically synthesized
tcttagacatgtaaatactaag

SEQ ID NO: 843536 - DNA, 22 bp, Artificial Sequence
  chemically synthesized
ttcttagacatgtaaatactaa

SEQ ID NO: 843537 - DNA, 22 bp, Artificial Sequence
  chemically synthesized
agttgaatgcttagtatttaca

SEQ ID NO: 843538 - DNA, 22 bp, Artificial Sequence
  chemically synthesized
aatgcttagtatttacatgtct

SEQ ID NO: 843539 - DNA, 22 bp, Artificial Sequence
  chemically synthesized
aaagtcttttcttagacatgta

SEQ ID NO: 843540 - DNA, 22 bp, Artificial Sequence
  chemically synthesized
caaagtcttttcttagacatgt

SEQ ID NO: 843541 - DNA, 22 bp, Artificial Sequence
  chemically synthesized
tcaaagtcttttcttagacatg

SEQ ID NO: 843542 - DNA, 22 bp, Artificial Sequence
  chemically synthesized
agtatttacatgtctaagaaaa

SEQ ID NO: 843543 - DNA, 22 bp, Artificial Sequence
  chemically synthesized
attttcaaagtcttttcttaga

SEQ ID NO: 843544 - DNA, 22 bp, Artificial Sequence
  chemically synthesized
gtatttacatgtctaagaaaag

SEQ ID NO: 843545 - DNA, 22 bp, Artificial Sequence
  chemically synthesized
gattttcaaagtcttttcttag

SEQ ID NO: 843546 - DNA, 22 bp, Artificial Sequence
  chemically synthesized
acatgtctaagaaaagactttg

SEQ ID NO: 843547 - DNA, 22 bp, Artificial Sequence
  chemically synthesized
catgtctaagaaaagactttga

SEQ ID NO: 843548 - DNA, 22 bp, Artificial Sequence
  chemically synthesized
agaaaagactttgaaaatcaaa

SEQ ID NO: 843549 - DNA, 22 bp, Artificial Sequence
  chemically synthesized
tgaaaatcaaactggtcatatt

SEQ ID NO: 843550 - DNA, 22 bp, Artificial Sequence
  chemically synthesized
gaaaatcaaactggtcatattt

SEQ ID NO: 843551 - DNA, 22 bp, Artificial Sequence
  chemically synthesized
aaaatcaaactggtcatatttt

SEQ ID NO: 843552 - DNA, 22 bp, Artificial Sequence
  chemically synthesized
tagaaaaatataaaaatatgac

SEQ ID NO: 843553 - DNA, 22 bp, Artificial Sequence
  chemically synthesized
atagaaaaatataaaaatatga

SEQ ID NO: 843554 - DNA, 22 bp, Artificial Sequence
  chemically synthesized
tatagaaaaatataaaaatatg

SEQ ID NO: 843555 - DNA, 22 bp, Artificial Sequence
  chemically synthesized
ttatagaaaaatataaaaatat

SEQ ID NO: 843556 - DNA, 22 bp, Artificial Sequence
  chemically synthesized
atttttatagaaaaatataaaa

SEQ ID NO: 843557 - DNA, 22 bp, Artificial Sequence
  chemically synthesized
ttgatttttatagaaaaatata

SEQ ID NO: 843558 - DNA, 22 bp, Artificial Sequence
  chemically synthesized
gtcatatttttatatttttcta

SEQ ID NO: 843559 - DNA, 22 bp, Artificial Sequence
  chemically synthesized
tgtagattgttgatttttatag

SEQ ID NO: 843560 - DNA, 22 bp, Artificial Sequence
  chemically synthesized
ttatatttttctataaaaatca

SEQ ID NO: 843561 - DNA, 22 bp, Artificial Sequence
  chemically synthesized
tatatttttctataaaaatcaa

SEQ ID NO: 843562 - DNA, 22 bp, Artificial Sequence
  chemically synthesized
atatttttctataaaaatcaac

SEQ ID NO: 843563 - DNA, 22 bp, Artificial Sequence
  chemically synthesized
tatttttctataaaaatcaaca

SEQ ID NO: 843564 - DNA, 22 bp, Artificial Sequence
  chemically synthesized
tgctatgtagattgttgatttt

SEQ ID NO: 843565 - DNA, 22 bp, Artificial Sequence
  chemically synthesized
atgctatgtagattgttgattt

SEQ ID NO: 843566 - DNA, 22 bp, Artificial Sequence
  chemically synthesized
ttctataaaaatcaacaatcta

SEQ ID NO: 843567 - DNA, 22 bp, Artificial Sequence
  chemically synthesized
tctataaaaatcaacaatctac

SEQ ID NO: 843568 - DNA, 22 bp, Artificial Sequence
  chemically synthesized
ctataaaaatcaacaatctaca

SEQ ID NO: 843569 - DNA, 22 bp, Artificial Sequence
  chemically synthesized
tataaaaatcaacaatctacat

SEQ ID NO: 843570 - DNA, 22 bp, Artificial Sequence
  chemically synthesized
taaaaatcaacaatctacatag

SEQ ID NO: 843571 - DNA, 22 bp, Artificial Sequence
  chemically synthesized
aaaaatcatcatgggcatttat

SEQ ID NO: 843572 - DNA, 22 bp, Artificial Sequence
  chemically synthesized
gaaaaatcatcatgggcattta

SEQ ID NO: 843573 - DNA, 22 bp, Artificial Sequence
  chemically synthesized
catagcataaatgcccatgatg

SEQ ID NO: 843574 - DNA, 22 bp, Artificial Sequence
  chemically synthesized
aaaatgggaacatttgaaaaat

SEQ ID NO: 843575 - DNA, 22 bp, Artificial Sequence
  chemically synthesized
ctgaaaatgggaacatttgaaa

SEQ ID NO: 843576 - DNA, 22 bp, Artificial Sequence
  chemically synthesized
actgaaaatgggaacatttgaa

SEQ ID NO: 843577 - DNA, 22 bp, Artificial Sequence
  chemically synthesized
atttactgaaaatgggaacatt

SEQ ID NO: 843578 - DNA, 22 bp, Artificial Sequence
  chemically synthesized
atattcatttactgaaaatggg

SEQ ID NO: 843579 - DNA, 22 bp, Artificial Sequence
  chemically synthesized
ttcaaatgttcccattttcagt

SEQ ID NO: 843580 - DNA, 22 bp, Artificial Sequence
  chemically synthesized
tcaaatgttcccattttcagta

SEQ ID NO: 843581 - DNA, 22 bp, Artificial Sequence
  chemically synthesized
caaatgttcccattttcagtaa

SEQ ID NO: 843582 - DNA, 22 bp, Artificial Sequence
  chemically synthesized
attcatattcatttactgaaaa

SEQ ID NO: 843583 - DNA, 22 bp, Artificial Sequence
  chemically synthesized
aaatgttcccattttcagtaaa

SEQ ID NO: 843584 - DNA, 22 bp, Artificial Sequence
  chemically synthesized
aattcatattcatttactgaaa

SEQ ID NO: 843585 - DNA, 22 bp, Artificial Sequence
  chemically synthesized
agcttaattcatattcatttac

SEQ ID NO: 843586 - DNA, 22 bp, Artificial Sequence
  chemically synthesized
cagcttaattcatattcattta

SEQ ID NO: 843587 - DNA, 22 bp, Artificial Sequence
  chemically synthesized
ccattttcagtaaatgaatatg

SEQ ID NO: 843588 - DNA, 22 bp, Artificial Sequence
  chemically synthesized
catttcagcttaattcatattc

SEQ ID NO: 843589 - DNA, 22 bp, Artificial Sequence
  chemically synthesized
tcagtaaatgaatatgaattaa

SEQ ID NO: 843590 - DNA, 22 bp, Artificial Sequence
  chemically synthesized
ttacatttcagcttaattcata

SEQ ID NO: 843591 - DNA, 22 bp, Artificial Sequence
  chemically synthesized
cagtaaatgaatatgaattaag

SEQ ID NO: 843592 - DNA, 22 bp, Artificial Sequence
  chemically synthesized
agtaaatgaatatgaattaagc

SEQ ID NO: 843593 - DNA, 22 bp, Artificial Sequence
  chemically synthesized
cattgttacatttcagcttaat

SEQ ID NO: 843594 - DNA, 22 bp, Artificial Sequence
  chemically synthesized
tacattgttacatttcagctta

SEQ ID NO: 843595 - DNA, 22 bp, Artificial Sequence
  chemically synthesized
agctgaaatgtaacaatgtaga

SEQ ID NO: 843596 - DNA, 22 bp, Artificial Sequence
  chemically synthesized
aaatgtaacaatgtagaactga

SEQ ID NO: 843597 - DNA, 22 bp, Artificial Sequence
  chemically synthesized
taaataaaatagcatcagttct

SEQ ID NO: 843598 - DNA, 22 bp, Artificial Sequence
  chemically synthesized
aagttgtaaataaaatagcatc

SEQ ID NO: 843599 - DNA, 22 bp, Artificial Sequence
  chemically synthesized
gaagttgtaaataaaatagcat

SEQ ID NO: 843600 - DNA, 22 bp, Artificial Sequence
  chemically synthesized
tgaagttgtaaataaaatagca

SEQ ID NO: 843601 - DNA, 22 bp, Artificial Sequence
  chemically synthesized
ttgaagttgtaaataaaatagc

SEQ ID NO: 843602 - DNA, 22 bp, Artificial Sequence
  chemically synthesized
tttgaagttgtaaataaaatag

SEQ ID NO: 843603 - DNA, 22 bp, Artificial Sequence
  chemically synthesized
attttttgaagttgtaaataaa

SEQ ID NO: 843604 - DNA, 22 bp, Artificial Sequence
  chemically synthesized
atgctattttatttacaacttc

SEQ ID NO: 843605 - DNA, 22 bp, Artificial Sequence
  chemically synthesized
tattaattttttgaagttgtaa

SEQ ID NO: 843606 - DNA, 22 bp, Artificial Sequence
  chemically synthesized
atattaattttttgaagttgta

SEQ ID NO: 843607 - DNA, 22 bp, Artificial Sequence
  chemically synthesized
tatattaattttttgaagttgt

SEQ ID NO: 843608 - DNA, 22 bp, Artificial Sequence
  chemically synthesized
tttatattaattttttgaagtt

SEQ ID NO: 843609 - DNA, 22 bp, Artificial Sequence
  chemically synthesized
ttttatttacaacttcaaaaaa

SEQ ID NO: 843610 - DNA, 22 bp, Artificial Sequence
  chemically synthesized
tatttacaacttcaaaaaatta

SEQ ID NO: 843611 - DNA, 22 bp, Artificial Sequence
  chemically synthesized
aattctttatattaattttttg

SEQ ID NO: 843612 - DNA, 22 bp, Artificial Sequence
  chemically synthesized
atttacaacttcaaaaaattaa

SEQ ID NO: 843613 - DNA, 22 bp, Artificial Sequence
  chemically synthesized
tttacaacttcaaaaaattaat

SEQ ID NO: 843614 - DNA, 22 bp, Artificial Sequence
  chemically synthesized
tgaattctttatattaattttt

SEQ ID NO: 843615 - DNA, 22 bp, Artificial Sequence
  chemically synthesized
ctgaattctttatattaatttt

SEQ ID NO: 843616 - DNA, 22 bp, Artificial Sequence
  chemically synthesized
acaacttcaaaaaattaatata

SEQ ID NO: 843617 - DNA, 22 bp, Artificial Sequence
  chemically synthesized
caacttcaaaaaattaatataa

SEQ ID NO: 843618 - DNA, 22 bp, Artificial Sequence
  chemically synthesized
ccttctgaattctttatattaa

SEQ ID NO: 843619 - DNA, 22 bp, Artificial Sequence
  chemically synthesized
accttctgaattctttatatta

SEQ ID NO: 843620 - DNA, 22 bp, Artificial Sequence
  chemically synthesized
taccttctgaattctttatatt

SEQ ID NO: 843621 - DNA, 22 bp, Artificial Sequence
  chemically synthesized
ttaccttctgaattctttatat

SEQ ID NO: 843622 - DNA, 22 bp, Artificial Sequence
  chemically synthesized
caaaaaattaatataaagaatt

SEQ ID NO: 843623 - DNA, 22 bp, Artificial Sequence
  chemically synthesized
ttttaccttctgaattctttat

SEQ ID NO: 843624 - DNA, 22 bp, Artificial Sequence
  chemically synthesized
aaaaaattaatataaagaattc

SEQ ID NO: 843625 - DNA, 22 bp, Artificial Sequence
  chemically synthesized
cgtaaactcttttaccttctga

SEQ ID NO: 843626 - DNA, 22 bp, Artificial Sequence
  chemically synthesized
atataaagaattcagaaggtaa

SEQ ID NO: 843627 - DNA, 22 bp, Artificial Sequence
  chemically synthesized
agaaggtaaaagagtttacgga

SEQ ID NO: 843628 - DNA, 22 bp, Artificial Sequence
  chemically synthesized
aatacataaaatggttccgtaa

SEQ ID NO: 843629 - DNA, 22 bp, Artificial Sequence
  chemically synthesized
caatacataaaatggttccgta

SEQ ID NO: 843630 - DNA, 22 bp, Artificial Sequence
  chemically synthesized
ttcaatacataaaatggttccg

SEQ ID NO: 843631 - DNA, 22 bp, Artificial Sequence
  chemically synthesized
cttcaatacataaaatggttcc

SEQ ID NO: 843632 - DNA, 22 bp, Artificial Sequence
  chemically synthesized
tcttcaatacataaaatggttc

SEQ ID NO: 843633 - DNA, 22 bp, Artificial Sequence
  chemically synthesized
ttttcttcaatacataaaatgg

SEQ ID NO: 843634 - DNA, 22 bp, Artificial Sequence
  chemically synthesized
attttcttcaatacataaaatg

SEQ ID NO: 843635 - DNA, 22 bp, Artificial Sequence
  chemically synthesized
acggaaccattttatgtattga

SEQ ID NO: 843636 - DNA, 22 bp, Artificial Sequence
  chemically synthesized
tgcttattttcttcaatacata

SEQ ID NO: 843637 - DNA, 22 bp, Artificial Sequence
  chemically synthesized
cggaaccattttatgtattgaa

SEQ ID NO: 843638 - DNA, 22 bp, Artificial Sequence
  chemically synthesized
tatgcttattttcttcaataca

SEQ ID NO: 843639 - DNA, 22 bp, Artificial Sequence
  chemically synthesized
ctatgcttattttcttcaatac

SEQ ID NO: 843640 - DNA, 22 bp, Artificial Sequence
  chemically synthesized
acttctatgcttattttcttca

SEQ ID NO: 843641 - DNA, 22 bp, Artificial Sequence
  chemically synthesized
ctgacttctatgcttattttct

SEQ ID NO: 843642 - DNA, 22 bp, Artificial Sequence
  chemically synthesized
cctgacttctatgcttattttc

SEQ ID NO: 843643 - DNA, 22 bp, Artificial Sequence
  chemically synthesized
tatgtattgaagaaaataagca

SEQ ID NO: 843644 - DNA, 22 bp, Artificial Sequence
  chemically synthesized
atgtattgaagaaaataagcat

SEQ ID NO: 843645 - DNA, 22 bp, Artificial Sequence
  chemically synthesized
tgtattgaagaaaataagcata

SEQ ID NO: 843646 - DNA, 22 bp, Artificial Sequence
  chemically synthesized
gtaccttcctgacttctatgct

SEQ ID NO: 843647 - DNA, 22 bp, Artificial Sequence
  chemically synthesized
agtaccttcctgacttctatgc

SEQ ID NO: 843648 - DNA, 22 bp, Artificial Sequence
  chemically synthesized
aagaaaataagcatagaagtca

SEQ ID NO: 843649 - DNA, 22 bp, Artificial Sequence
  chemically synthesized
caatttagtaccttcctgactt

SEQ ID NO: 843650 - DNA, 22 bp, Artificial Sequence
  chemically synthesized
gaaaggctacaatttagtacct

SEQ ID NO: 843651 - DNA, 22 bp, Artificial Sequence
  chemically synthesized
ggtaactagaaaggctacaatt

SEQ ID NO: 843652 - DNA, 22 bp, Artificial Sequence
  chemically synthesized
cggtaactagaaaggctacaat

SEQ ID NO: 843653 - DNA, 22 bp, Artificial Sequence
  chemically synthesized
tcggtaactagaaaggctacaa

SEQ ID NO: 843654 - DNA, 22 bp, Artificial Sequence
  chemically synthesized
aattgtagcctttctagttacc

SEQ ID NO: 843655 - DNA, 22 bp, Artificial Sequence
  chemically synthesized
tagcctttctagttaccgaaag

SEQ ID NO: 843656 - DNA, 22 bp, Artificial Sequence
  chemically synthesized
accagtaaaaccctttcggtaa

SEQ ID NO: 843657 - DNA, 22 bp, Artificial Sequence
  chemically synthesized
tctagttaccgaaagggtttta

SEQ ID NO: 843658 - DNA, 22 bp, Artificial Sequence
  chemically synthesized
ctagttaccgaaagggttttac

SEQ ID NO: 843659 - DNA, 22 bp, Artificial Sequence
  chemically synthesized
tagttaccgaaagggttttact

SEQ ID NO: 843660 - DNA, 22 bp, Artificial Sequence
  chemically synthesized
cagcatcctcaccagtaaaacc

SEQ ID NO: 843661 - DNA, 22 bp, Artificial Sequence
  chemically synthesized
gttaccgaaagggttttactgg

SEQ ID NO: 843662 - DNA, 22 bp, Artificial Sequence
  chemically synthesized
ccgaaagggttttactggtgag

SEQ ID NO: 843663 - DNA, 22 bp, Artificial Sequence
  chemically synthesized
gatagattacagcatcctcacc

SEQ ID NO: 843664 - DNA, 22 bp, Artificial Sequence
  chemically synthesized
aaagctagatagattacagcat

SEQ ID NO: 843665 - DNA, 22 bp, Artificial Sequence
  chemically synthesized
tactggtgaggatgctgtaatc

SEQ ID NO: 843666 - DNA, 22 bp, Artificial Sequence
  chemically synthesized
actggtgaggatgctgtaatct

SEQ ID NO: 843667 - DNA, 22 bp, Artificial Sequence
  chemically synthesized
ctggtgaggatgctgtaatcta

SEQ ID NO: 843668 - DNA, 22 bp, Artificial Sequence
  chemically synthesized
gtgaggatgctgtaatctatct

SEQ ID NO: 843669 - DNA, 22 bp, Artificial Sequence
  chemically synthesized
agtgagatggttgaaagctaga

SEQ ID NO: 843670 - DNA, 22 bp, Artificial Sequence
  chemically synthesized
taatctatctagctttcaacca

SEQ ID NO: 843671 - DNA, 22 bp, Artificial Sequence
  chemically synthesized
tctagctttcaaccatctcact

SEQ ID NO: 843672 - DNA, 22 bp, Artificial Sequence
  chemically synthesized
gctttcaaccatctcactgagc

SEQ ID NO: 843673 - DNA, 22 bp, Artificial Sequence
  chemically synthesized
tcaaccatctcactgagcatct

SEQ ID NO: 843674 - DNA, 22 bp, Artificial Sequence
  chemically synthesized
caaccatctcactgagcatctt

SEQ ID NO: 843675 - DNA, 22 bp, Artificial Sequence
  chemically synthesized
aaccatctcactgagcatcttc

SEQ ID NO: 843676 - DNA, 22 bp, Artificial Sequence
  chemically synthesized
actgagcatcttcttctggctt

SEQ ID NO: 843677 - DNA, 22 bp, Artificial Sequence
  chemically synthesized
agcatcttcttctggcttctat

SEQ ID NO: 843678 - DNA, 22 bp, Artificial Sequence
  chemically synthesized
cttctggcttctattcttgcat

SEQ ID NO: 843679 - DNA, 22 bp, Artificial Sequence
  chemically synthesized
ttctggcttctattcttgcatt

SEQ ID NO: 843680 - DNA, 22 bp, Artificial Sequence
  chemically synthesized
gagaggcagccgaatgcaagaa

SEQ ID NO: 843681 - DNA, 22 bp, Artificial Sequence
  chemically synthesized
ggagaggcagccgaatgcaaga

SEQ ID NO: 843682 - DNA, 22 bp, Artificial Sequence
  chemically synthesized
ctggcttctattcttgcattcg

SEQ ID NO: 843683 - DNA, 22 bp, Artificial Sequence
  chemically synthesized
tggcttctattcttgcattcgg

SEQ ID NO: 843684 - DNA, 22 bp, Artificial Sequence
  chemically synthesized
tttggagaggcagccgaatgca

SEQ ID NO: 843685 - DNA, 22 bp, Artificial Sequence
  chemically synthesized
gcttctattcttgcattcggct

SEQ ID NO: 843686 - DNA, 22 bp, Artificial Sequence
  chemically synthesized
tatttggagaggcagccgaatg

SEQ ID NO: 843687 - DNA, 22 bp, Artificial Sequence
  chemically synthesized
ctattcttgcattcggctgcct

SEQ ID NO: 843688 - DNA, 22 bp, Artificial Sequence
  chemically synthesized
tattcttgcattcggctgcctc

SEQ ID NO: 843689 - DNA, 22 bp, Artificial Sequence
  chemically synthesized
ttcttgcattcggctgcctctc

SEQ ID NO: 843690 - DNA, 22 bp, Artificial Sequence
  chemically synthesized
gccactctatttggagaggcag

SEQ ID NO: 843691 - DNA, 22 bp, Artificial Sequence
  chemically synthesized
ggccactctatttggagaggca

SEQ ID NO: 843692 - DNA, 22 bp, Artificial Sequence
  chemically synthesized
ttgcattcggctgcctctccaa

SEQ ID NO: 843693 - DNA, 22 bp, Artificial Sequence
  chemically synthesized
gcattcggctgcctctccaaat

SEQ ID NO: 843694 - DNA, 22 bp, Artificial Sequence
  chemically synthesized
cattcggctgcctctccaaata

SEQ ID NO: 843695 - DNA, 22 bp, Artificial Sequence
  chemically synthesized
gatttggccactctatttggag

SEQ ID NO: 843696 - DNA, 22 bp, Artificial Sequence
  chemically synthesized
cgatttggccactctatttgga

SEQ ID NO: 843697 - DNA, 22 bp, Artificial Sequence
  chemically synthesized
tcgatttggccactctatttgg

SEQ ID NO: 843698 - DNA, 22 bp, Artificial Sequence
  chemically synthesized
ggctgcctctccaaatagagtg

SEQ ID NO: 843699 - DNA, 22 bp, Artificial Sequence
  chemically synthesized
cctctccaaatagagtggccaa

SEQ ID NO: 843700 - DNA, 22 bp, Artificial Sequence
  chemically synthesized
tccaaatagagtggccaaatcg

SEQ ID NO: 843701 - DNA, 22 bp, Artificial Sequence
  chemically synthesized
caaatagagtggccaaatcgaa

SEQ ID NO: 843702 - DNA, 22 bp, Artificial Sequence
  chemically synthesized
attgtcttccacttacttcctc

SEQ ID NO: 843703 - DNA, 22 bp, Artificial Sequence
  chemically synthesized
tcttccacttacttcctcactt

SEQ ID NO: 843704 - DNA, 22 bp, Artificial Sequence
  chemically synthesized
ccacttacttcctcacttctca

SEQ ID NO: 843705 - DNA, 22 bp, Artificial Sequence
  chemically synthesized
cacttacttcctcacttctcat

SEQ ID NO: 843706 - DNA, 22 bp, Artificial Sequence
  chemically synthesized
acttcctcacttctcatttcca

SEQ ID NO: 843707 - DNA, 22 bp, Artificial Sequence
  chemically synthesized
cttcctcacttctcatttccat

SEQ ID NO: 843708 - DNA, 22 bp, Artificial Sequence
  chemically synthesized
cctcacttctcatttccatttt

SEQ ID NO: 843709 - DNA, 22 bp, Artificial Sequence
  chemically synthesized
ctcacttctcatttccatttta

SEQ ID NO: 843710 - DNA, 22 bp, Artificial Sequence
  chemically synthesized
acttctcatttccattttatac

SEQ ID NO: 843711 - DNA, 22 bp, Artificial Sequence
  chemically synthesized
ctcatttccattttatactggc

SEQ ID NO: 843712 - DNA, 22 bp, Artificial Sequence
  chemically synthesized
tcatttccattttatactggct

SEQ ID NO: 843713 - DNA, 22 bp, Artificial Sequence
  chemically synthesized
atttccattttatactggcttg

SEQ ID NO: 843714 - DNA, 22 bp, Artificial Sequence
  chemically synthesized
ccattttatactggcttggata

SEQ ID NO: 843715 - DNA, 22 bp, Artificial Sequence
  chemically synthesized
cattttatactggcttggatat

SEQ ID NO: 843716 - DNA, 22 bp, Artificial Sequence
  chemically synthesized
tatactggcttggatattgata

SEQ ID NO: 843717 - DNA, 22 bp, Artificial Sequence
  chemically synthesized
atactggcttggatattgatat

SEQ ID NO: 843718 - DNA, 22 bp, Artificial Sequence
  chemically synthesized
tactggcttggatattgatatt

SEQ ID NO: 843719 - DNA, 22 bp, Artificial Sequence
  chemically synthesized
accaagtaggaaaatatcaata

SEQ ID NO: 843720 - DNA, 22 bp, Artificial Sequence
  chemically synthesized
gcttggatattgatattttcct

SEQ ID NO: 843721 - DNA, 22 bp, Artificial Sequence
  chemically synthesized
ggatattgatattttcctactt

SEQ ID NO: 843722 - DNA, 22 bp, Artificial Sequence
  chemically synthesized
gatattgatattttcctacttg

SEQ ID NO: 843723 - DNA, 22 bp, Artificial Sequence
  chemically synthesized
atattttcctacttggtcaacc

SEQ ID NO: 843724 - DNA, 22 bp, Artificial Sequence
  chemically synthesized
aaaaaagaagtagggaaggttg

SEQ ID NO: 843725 - DNA, 22 bp, Artificial Sequence
  chemically synthesized
tcctacttggtcaaccttccct

SEQ ID NO: 843726 - DNA, 22 bp, Artificial Sequence
  chemically synthesized
cctacttggtcaaccttcccta

SEQ ID NO: 843727 - DNA, 22 bp, Artificial Sequence
  chemically synthesized
ctacttggtcaaccttccctac

SEQ ID NO: 843728 - DNA, 22 bp, Artificial Sequence
  chemically synthesized
cttggtcaaccttccctacttc

SEQ ID NO: 843729 - DNA, 22 bp, Artificial Sequence
  chemically synthesized
ggtcaaccttccctacttcttt

SEQ ID NO: 843730 - DNA, 22 bp, Artificial Sequence
  chemically synthesized
gtcaaccttccctacttctttt

SEQ ID NO: 843731 - DNA, 22 bp, Artificial Sequence
  chemically synthesized
gtagaacattcaaaaaagaagt

SEQ ID NO: 843732 - DNA, 22 bp, Artificial Sequence
  chemically synthesized
ccctacttcttttttgaatgtt

SEQ ID NO: 843733 - DNA, 22 bp, Artificial Sequence
  chemically synthesized
cctacttcttttttgaatgttc

SEQ ID NO: 843734 - DNA, 22 bp, Artificial Sequence
  chemically synthesized
cttcttttttgaatgttctact

SEQ ID NO: 843735 - DNA, 22 bp, Artificial Sequence
  chemically synthesized
ccgatggaggtgctagtagaac

SEQ ID NO: 843736 - DNA, 22 bp, Artificial Sequence
  chemically synthesized
cttttttgaatgttctactagc

SEQ ID NO: 843737 - DNA, 22 bp, Artificial Sequence
  chemically synthesized
ttttttgaatgttctactagca

SEQ ID NO: 843738 - DNA, 22 bp, Artificial Sequence
  chemically synthesized
ttttgaatgttctactagcacc

SEQ ID NO: 843739 - DNA, 22 bp, Artificial Sequence
  chemically synthesized
tttgaatgttctactagcacct

SEQ ID NO: 843740 - DNA, 22 bp, Artificial Sequence
  chemically synthesized
ttgaatgttctactagcacctc

SEQ ID NO: 843741 - DNA, 22 bp, Artificial Sequence
  chemically synthesized
tgaatgttctactagcacctcc

SEQ ID NO: 843742 - DNA, 22 bp, Artificial Sequence
  chemically synthesized
gaatgttctactagcacctcca

SEQ ID NO: 843743 - DNA, 22 bp, Artificial Sequence
  chemically synthesized
agaagttaccgatggaggtgct

SEQ ID NO: 843744 - DNA, 22 bp, Artificial Sequence
  chemically synthesized
aatgttctactagcacctccat

SEQ ID NO: 843745 - DNA, 22 bp, Artificial Sequence
  chemically synthesized
aagaagttaccgatggaggtgc

SEQ ID NO: 843746 - DNA, 22 bp, Artificial Sequence
  chemically synthesized
ttaagaagttaccgatggaggt

SEQ ID NO: 843747 - DNA, 22 bp, Artificial Sequence
  chemically synthesized
tactagcacctccatcggtaac

SEQ ID NO: 843748 - DNA, 22 bp, Artificial Sequence
  chemically synthesized
ctagcacctccatcggtaactt

SEQ ID NO: 843749 - DNA, 22 bp, Artificial Sequence
  chemically synthesized
tgaagattcttaagaagttacc

SEQ ID NO: 843750 - DNA, 22 bp, Artificial Sequence
  chemically synthesized
gcacctccatcggtaacttctt

SEQ ID NO: 843751 - DNA, 22 bp, Artificial Sequence
  chemically synthesized
gttatgaagattcttaagaagt

SEQ ID NO: 843752 - DNA, 22 bp, Artificial Sequence
  chemically synthesized
catcggtaacttcttaagaatc

SEQ ID NO: 843753 - DNA, 22 bp, Artificial Sequence
  chemically synthesized
tgaagttggttatgaagattct

SEQ ID NO: 843754 - DNA, 22 bp, Artificial Sequence
  chemically synthesized
atgaagttggttatgaagattc

SEQ ID NO: 843755 - DNA, 22 bp, Artificial Sequence
  chemically synthesized
cttaagaatcttcataaccaac

SEQ ID NO: 843756 - DNA, 22 bp, Artificial Sequence
  chemically synthesized
ttaagaatcttcataaccaact

SEQ ID NO: 843757 - DNA, 22 bp, Artificial Sequence
  chemically synthesized
aagaatcttcataaccaacttc

SEQ ID NO: 843758 - DNA, 22 bp, Artificial Sequence
  chemically synthesized
gaagatatttatgaagttggtt

SEQ ID NO: 843759 - DNA, 22 bp, Artificial Sequence
  chemically synthesized
agaatcttcataaccaacttca

SEQ ID NO: 843760 - DNA, 22 bp, Artificial Sequence
  chemically synthesized
cagttggaagatatttatgaag

SEQ ID NO: 843761 - DNA, 22 bp, Artificial Sequence
  chemically synthesized
cataaccaacttcataaatatc

SEQ ID NO: 843762 - DNA, 22 bp, Artificial Sequence
  chemically synthesized
ataaccaacttcataaatatct

SEQ ID NO: 843763 - DNA, 22 bp, Artificial Sequence
  chemically synthesized
actgcagttggaagatatttat

SEQ ID NO: 843764 - DNA, 22 bp, Artificial Sequence
  chemically synthesized
cataaatatcttccaactgcag

SEQ ID NO: 843765 - DNA, 22 bp, Artificial Sequence
  chemically synthesized
ataaatatcttccaactgcagt

SEQ ID NO: 843766 - DNA, 22 bp, Artificial Sequence
  chemically synthesized
ccaactgcagttagcctttttt

SEQ ID NO: 843767 - DNA, 22 bp, Artificial Sequence
  chemically synthesized
caactgcagttagccttttttg

SEQ ID NO: 843768 - DNA, 22 bp, Artificial Sequence
  chemically synthesized
agtgaataaagaacaaaaaagg

SEQ ID NO: 843769 - DNA, 22 bp, Artificial Sequence
  chemically synthesized
ttcagtgaataaagaacaaaaa

SEQ ID NO: 843770 - DNA, 22 bp, Artificial Sequence
  chemically synthesized
attcagtgaataaagaacaaaa

SEQ ID NO: 843771 - DNA, 22 bp, Artificial Sequence
  chemically synthesized
cagttagccttttttgttcttt

SEQ ID NO: 843772 - DNA, 22 bp, Artificial Sequence
  chemically synthesized
gccttttttgttctttattcac

SEQ ID NO: 843773 - DNA, 22 bp, Artificial Sequence
  chemically synthesized
taaagtatttattcagtgaata

SEQ ID NO: 843774 - DNA, 22 bp, Artificial Sequence
  chemically synthesized
ataaagtatttattcagtgaat

SEQ ID NO: 843775 - DNA, 22 bp, Artificial Sequence
  chemically synthesized
ttttgttctttattcactgaat

SEQ ID NO: 843776 - DNA, 22 bp, Artificial Sequence
  chemically synthesized
tttgttctttattcactgaata

SEQ ID NO: 843777 - DNA, 22 bp, Artificial Sequence
  chemically synthesized
ttgttctttattcactgaataa

SEQ ID NO: 843778 - DNA, 22 bp, Artificial Sequence
  chemically synthesized
tgttctttattcactgaataaa

SEQ ID NO: 843779 - DNA, 22 bp, Artificial Sequence
  chemically synthesized
gttctttattcactgaataaat

SEQ ID NO: 843780 - DNA, 22 bp, Artificial Sequence
  chemically synthesized
ttctttattcactgaataaata

SEQ ID NO: 843781 - DNA, 22 bp, Artificial Sequence
  chemically synthesized
tttattcactgaataaatactt

SEQ ID NO: 843782 - DNA, 22 bp, Artificial Sequence
  chemically synthesized
tattcactgaataaatacttta

SEQ ID NO: 843783 - DNA, 22 bp, Artificial Sequence
  chemically synthesized
attcactgaataaatactttat

SEQ ID NO: 843784 - DNA, 22 bp, Artificial Sequence
  chemically synthesized
ttcactgaataaatactttata

SEQ ID NO: 843785 - DNA, 22 bp, Artificial Sequence
  chemically synthesized
actgaataaatactttataaga

SEQ ID NO: 843786 - DNA, 22 bp, Artificial Sequence
  chemically synthesized
aataaatactttataagatgca

SEQ ID NO: 843787 - DNA, 22 bp, Artificial Sequence
  chemically synthesized
tataaaaataaaatgcatctta

SEQ ID NO: 843788 - DNA, 22 bp, Artificial Sequence
  chemically synthesized
aaattatataaaaataaaatgc

SEQ ID NO: 843789 - DNA, 22 bp, Artificial Sequence
  chemically synthesized
gaaattatataaaaataaaatg

SEQ ID NO: 843790 - DNA, 22 bp, Artificial Sequence
  chemically synthesized
tataagatgcattttattttta

SEQ ID NO: 843791 - DNA, 22 bp, Artificial Sequence
  chemically synthesized
ataagatgcattttatttttat

SEQ ID NO: 843792 - DNA, 22 bp, Artificial Sequence
  chemically synthesized
taagatgcattttatttttata

SEQ ID NO: 843793 - DNA, 22 bp, Artificial Sequence
  chemically synthesized
caagcttgaaattatataaaaa

SEQ ID NO: 843794 - DNA, 22 bp, Artificial Sequence
  chemically synthesized
tgcaagcttgaaattatataaa

SEQ ID NO: 843795 - DNA, 22 bp, Artificial Sequence
  chemically synthesized
tatttttatataatttcaagct

SEQ ID NO: 843796 - DNA, 22 bp, Artificial Sequence
  chemically synthesized
atttttatataatttcaagctt

SEQ ID NO: 843797 - DNA, 22 bp, Artificial Sequence
  chemically synthesized
caaatattctgcaagcttgaaa

SEQ ID NO: 843798 - DNA, 22 bp, Artificial Sequence
  chemically synthesized
tttttatataatttcaagcttg

SEQ ID NO: 843799 - DNA, 22 bp, Artificial Sequence
  chemically synthesized
gcaaatattctgcaagcttgaa

SEQ ID NO: 843800 - DNA, 22 bp, Artificial Sequence
  chemically synthesized
ttatataatttcaagcttgcag

SEQ ID NO: 843801 - DNA, 22 bp, Artificial Sequence
  chemically synthesized
tatataatttcaagcttgcaga

SEQ ID NO: 843802 - DNA, 22 bp, Artificial Sequence
  chemically synthesized
tcttgcaaatattctgcaagct

SEQ ID NO: 843803 - DNA, 22 bp, Artificial Sequence
  chemically synthesized
atataatttcaagcttgcagaa

SEQ ID NO: 843804 - DNA, 22 bp, Artificial Sequence
  chemically synthesized
atcttgcaaatattctgcaagc

SEQ ID NO: 843805 - DNA, 22 bp, Artificial Sequence
  chemically synthesized
tataatttcaagcttgcagaat

SEQ ID NO: 843806 - DNA, 22 bp, Artificial Sequence
  chemically synthesized
tatcttgcaaatattctgcaag

SEQ ID NO: 843807 - DNA, 22 bp, Artificial Sequence
  chemically synthesized
tttatcttgcaaatattctgca

SEQ ID NO: 843808 - DNA, 22 bp, Artificial Sequence
  chemically synthesized
caagcttgcagaatatttgcaa

SEQ ID NO: 843809 - DNA, 22 bp, Artificial Sequence
  chemically synthesized
aagcttgcagaatatttgcaag

SEQ ID NO: 843810 - DNA, 22 bp, Artificial Sequence
  chemically synthesized
ggagttctttatcttgcaaata

SEQ ID NO: 843811 - DNA, 22 bp, Artificial Sequence
  chemically synthesized
cctgggagttctttatcttgca

SEQ ID NO: 843812 - DNA, 22 bp, Artificial Sequence
  chemically synthesized
gcagaatatttgcaagataaag

SEQ ID NO: 843813 - DNA, 22 bp, Artificial Sequence
  chemically synthesized
cagaatatttgcaagataaaga

SEQ ID NO: 843814 - DNA, 22 bp, Artificial Sequence
  chemically synthesized
gcaagataaagaactcccaggt

SEQ ID NO: 843815 - DNA, 22 bp, Artificial Sequence
  chemically synthesized
caagataaagaactcccaggta

SEQ ID NO: 843816 - DNA, 22 bp, Artificial Sequence
  chemically synthesized
acaaatggtgaatccgggcaag

SEQ ID NO: 843817 - DNA, 22 bp, Artificial Sequence
  chemically synthesized
ccaggtaacccttgcccggatt

SEQ ID NO: 843818 - DNA, 22 bp, Artificial Sequence
  chemically synthesized
gcccggattcaccatttgttaa

SEQ ID NO: 843819 - DNA, 22 bp, Artificial Sequence
  chemically synthesized
cccggattcaccatttgttaac

SEQ ID NO: 843820 - DNA, 22 bp, Artificial Sequence
  chemically synthesized
aaaataatgtggcaaaatgtta

SEQ ID NO: 843821 - DNA, 22 bp, Artificial Sequence
  chemically synthesized
accatttgttaacattttgcca

SEQ ID NO: 843822 - DNA, 22 bp, Artificial Sequence
  chemically synthesized
gttaacattttgccacattatt

SEQ ID NO: 843823 - DNA, 22 bp, Artificial Sequence
  chemically synthesized
ttaacattttgccacattattt

SEQ ID NO: 843824 - DNA, 22 bp, Artificial Sequence
  chemically synthesized
acattttgccacattattttta

SEQ ID NO: 843825 - DNA, 22 bp, Artificial Sequence
  chemically synthesized
tgccacattatttttaattatt

SEQ ID NO: 843826 - DNA, 22 bp, Artificial Sequence
  chemically synthesized
gccacattatttttaattattt

SEQ ID NO: 843827 - DNA, 22 bp, Artificial Sequence
  chemically synthesized
ccacattatttttaattattta

SEQ ID NO: 843828 - DNA, 22 bp, Artificial Sequence
  chemically synthesized
tttttaattatttatcatttta

SEQ ID NO: 843829 - DNA, 22 bp, Artificial Sequence
  chemically synthesized
ttaattatttatcattttatca

SEQ ID NO: 843830 - DNA, 22 bp, Artificial Sequence
  chemically synthesized
taattatttatcattttatcat

SEQ ID NO: 843831 - DNA, 22 bp, Artificial Sequence
  chemically synthesized
aattatttatcattttatcatt

SEQ ID NO: 843832 - DNA, 22 bp, Artificial Sequence
  chemically synthesized
attatttatcattttatcattc

SEQ ID NO: 843833 - DNA, 22 bp, Artificial Sequence
  chemically synthesized
tacacacagagagaatgataaa

SEQ ID NO: 843834 - DNA, 22 bp, Artificial Sequence
  chemically synthesized
tttatcattttatcattctctc

SEQ ID NO: 843835 - DNA, 22 bp, Artificial Sequence
  chemically synthesized
atcattttatcattctctctgt

SEQ ID NO: 843836 - DNA, 22 bp, Artificial Sequence
  chemically synthesized
tcattttatcattctctctgtg

SEQ ID NO: 843837 - DNA, 22 bp, Artificial Sequence
  chemically synthesized
tatatctatacacacagagaga

SEQ ID NO: 843838 - DNA, 22 bp, Artificial Sequence
  chemically synthesized
tatcattctctctgtgtgtata

SEQ ID NO: 843839 - DNA, 22 bp, Artificial Sequence
  chemically synthesized
atcattctctctgtgtgtatag

SEQ ID NO: 843840 - DNA, 22 bp, Artificial Sequence
  chemically synthesized
tcattctctctgtgtgtataga

SEQ ID NO: 843841 - DNA, 22 bp, Artificial Sequence
  chemically synthesized
catatacagttatatatctata

SEQ ID NO: 843842 - DNA, 22 bp, Artificial Sequence
  chemically synthesized
tctctgtgtgtatagatatata

SEQ ID NO: 843843 - DNA, 22 bp, Artificial Sequence
  chemically synthesized
tctgtgtgtatagatatataac

SEQ ID NO: 843844 - DNA, 22 bp, Artificial Sequence
  chemically synthesized
tgtgtgtatagatatataactg

SEQ ID NO: 843845 - DNA, 22 bp, Artificial Sequence
  chemically synthesized
tgtgtatagatatataactgta

SEQ ID NO: 843846 - DNA, 22 bp, Artificial Sequence
  chemically synthesized
tatatgtaatgttttatatata

SEQ ID NO: 843847 - DNA, 22 bp, Artificial Sequence
  chemically synthesized
agaaaaaaaatatatatatata

SEQ ID NO: 843848 - DNA, 22 bp, Artificial Sequence
  chemically synthesized
aaatgattcagaaaaaaaatat

SEQ ID NO: 843849 - DNA, 22 bp, Artificial Sequence
  chemically synthesized
tcaaatgattcagaaaaaaaat

SEQ ID NO: 843850 - DNA, 22 bp, Artificial Sequence
  chemically synthesized
tatatatatatattttttttct

SEQ ID NO: 843851 - DNA, 22 bp, Artificial Sequence
  chemically synthesized
atatatatatattttttttctg

SEQ ID NO: 843852 - DNA, 22 bp, Artificial Sequence
  chemically synthesized
tatatatatattttttttctga

SEQ ID NO: 843853 - DNA, 22 bp, Artificial Sequence
  chemically synthesized
ttctcaaatgattcagaaaaaa

SEQ ID NO: 843854 - DNA, 22 bp, Artificial Sequence
  chemically synthesized
caaattattctcaaatgattca

SEQ ID NO: 843855 - DNA, 22 bp, Artificial Sequence
  chemically synthesized
tttttctgaatcatttgagaat

SEQ ID NO: 843856 - DNA, 22 bp, Artificial Sequence
  chemically synthesized
ttttctgaatcatttgagaata

SEQ ID NO: 843857 - DNA, 22 bp, Artificial Sequence
  chemically synthesized
tttctgaatcatttgagaataa

SEQ ID NO: 843858 - DNA, 22 bp, Artificial Sequence
  chemically synthesized
ttctgaatcatttgagaataat

SEQ ID NO: 843859 - DNA, 22 bp, Artificial Sequence
  chemically synthesized
tctgaatcatttgagaataatt

SEQ ID NO: 843860 - DNA, 22 bp, Artificial Sequence
  chemically synthesized
ctgaatcatttgagaataattt

SEQ ID NO: 843861 - DNA, 22 bp, Artificial Sequence
  chemically synthesized
tgaatcatttgagaataatttg

SEQ ID NO: 843862 - DNA, 22 bp, Artificial Sequence
  chemically synthesized
aatcatttgagaataatttgca

SEQ ID NO: 843863 - DNA, 22 bp, Artificial Sequence
  chemically synthesized
gagaataatttgcagatatcat

SEQ ID NO: 843864 - DNA, 22 bp, Artificial Sequence
  chemically synthesized
agaataatttgcagatatcatg

SEQ ID NO: 843865 - DNA, 22 bp, Artificial Sequence
  chemically synthesized
agggtaaaggggcatgatatct

SEQ ID NO: 843866 - DNA, 22 bp, Artificial Sequence
  chemically synthesized
aagggtaaaggggcatgatatc

SEQ ID NO: 843867 - DNA, 22 bp, Artificial Sequence
  chemically synthesized
aagtatttaagggtaaaggggc

SEQ ID NO: 843868 - DNA, 22 bp, Artificial Sequence
  chemically synthesized
gcagatatcatgcccctttacc

SEQ ID NO: 843869 - DNA, 22 bp, Artificial Sequence
  chemically synthesized
cagatatcatgcccctttaccc

SEQ ID NO: 843870 - DNA, 22 bp, Artificial Sequence
  chemically synthesized
agaaataaaacctaaagtattt

SEQ ID NO: 843871 - DNA, 22 bp, Artificial Sequence
  chemically synthesized
ttaagaaataaaacctaaagta

SEQ ID NO: 843872 - DNA, 22 bp, Artificial Sequence
  chemically synthesized
tacccttaaatactttaggttt

SEQ ID NO: 843873 - DNA, 22 bp, Artificial Sequence
  chemically synthesized
acccttaaatactttaggtttt

SEQ ID NO: 843874 - DNA, 22 bp, Artificial Sequence
  chemically synthesized
ctattaagaaataaaacctaaa

SEQ ID NO: 843875 - DNA, 22 bp, Artificial Sequence
  chemically synthesized
cccttaaatactttaggtttta

SEQ ID NO: 843876 - DNA, 22 bp, Artificial Sequence
  chemically synthesized
gctattaagaaataaaacctaa

SEQ ID NO: 843877 - DNA, 22 bp, Artificial Sequence
  chemically synthesized
tgctattaagaaataaaaccta

SEQ ID NO: 843878 - DNA, 22 bp, Artificial Sequence
  chemically synthesized
aaatactttaggttttatttct

SEQ ID NO: 843879 - DNA, 22 bp, Artificial Sequence
  chemically synthesized
aatactttaggttttatttctt

SEQ ID NO: 843880 - DNA, 22 bp, Artificial Sequence
  chemically synthesized
taggttttatttcttaatagca

SEQ ID NO: 843881 - DNA, 22 bp, Artificial Sequence
  chemically synthesized
agagaatgtctttgctattaag

SEQ ID NO: 843882 - DNA, 22 bp, Artificial Sequence
  chemically synthesized
aggttttatttcttaatagcaa

SEQ ID NO: 843883 - DNA, 22 bp, Artificial Sequence
  chemically synthesized
aagagaatgtctttgctattaa

SEQ ID NO: 843884 - DNA, 22 bp, Artificial Sequence
  chemically synthesized
ggttttatttcttaatagcaaa

SEQ ID NO: 843885 - DNA, 22 bp, Artificial Sequence
  chemically synthesized
tttaagagaatgtctttgctat

SEQ ID NO: 843886 - DNA, 22 bp, Artificial Sequence
  chemically synthesized
tatttcttaatagcaaagacat

SEQ ID NO: 843887 - DNA, 22 bp, Artificial Sequence
  chemically synthesized
atttcttaatagcaaagacatt

SEQ ID NO: 843888 - DNA, 22 bp, Artificial Sequence
  chemically synthesized
tttcttaatagcaaagacattc

SEQ ID NO: 843889 - DNA, 22 bp, Artificial Sequence
  chemically synthesized
aggttatttaagagaatgtctt

SEQ ID NO: 843890 - DNA, 22 bp, Artificial Sequence
  chemically synthesized
cttaatagcaaagacattctct

SEQ ID NO: 843891 - DNA, 22 bp, Artificial Sequence
  chemically synthesized
ttaatagcaaagacattctctt

SEQ ID NO: 843892 - DNA, 22 bp, Artificial Sequence
  chemically synthesized
aatagcaaagacattctcttaa

SEQ ID NO: 843893 - DNA, 22 bp, Artificial Sequence
  chemically synthesized
agctgaggttatttaagagaat

SEQ ID NO: 843894 - DNA, 22 bp, Artificial Sequence
  chemically synthesized
atagcaaagacattctcttaaa

SEQ ID NO: 843895 - DNA, 22 bp, Artificial Sequence
  chemically synthesized
aaactgagctgaggttatttaa

SEQ ID NO: 843896 - DNA, 22 bp, Artificial Sequence
  chemically synthesized
gaaactgagctgaggttattta

SEQ ID NO: 843897 - DNA, 22 bp, Artificial Sequence
  chemically synthesized
tgaaactgagctgaggttattt

SEQ ID NO: 843898 - DNA, 22 bp, Artificial Sequence
  chemically synthesized
actttgaaactgagctgaggtt

SEQ ID NO: 843899 - DNA, 22 bp, Artificial Sequence
  chemically synthesized
ctgactttgaaactgagctgag

SEQ ID NO: 843900 - DNA, 22 bp, Artificial Sequence
  chemically synthesized
tcttaaataacctcagctcagt

SEQ ID NO: 843901 - DNA, 22 bp, Artificial Sequence
  chemically synthesized
cctgactttgaaactgagctga

SEQ ID NO: 843902 - DNA, 22 bp, Artificial Sequence
  chemically synthesized
ttaaataacctcagctcagttt

SEQ ID NO: 843903 - DNA, 22 bp, Artificial Sequence
  chemically synthesized
aaataacctcagctcagtttca

SEQ ID NO: 843904 - DNA, 22 bp, Artificial Sequence
  chemically synthesized
aataacctcagctcagtttcaa

SEQ ID NO: 843905 - DNA, 22 bp, Artificial Sequence
  chemically synthesized
aatttcctgactttgaaactga

SEQ ID NO: 843906 - DNA, 22 bp, Artificial Sequence
  chemically synthesized
agctcagtttcaaagtcaggaa

SEQ ID NO: 843907 - DNA, 22 bp, Artificial Sequence
  chemically synthesized
aagccacgctaaatttcctgac

SEQ ID NO: 843908 - DNA, 22 bp, Artificial Sequence
  chemically synthesized
agtttcaaagtcaggaaattta

SEQ ID NO: 843909 - DNA, 22 bp, Artificial Sequence
  chemically synthesized
caaagtcaggaaatttagcgtg

SEQ ID NO: 843910 - DNA, 22 bp, Artificial Sequence
  chemically synthesized
tggtactaaagccacgctaaat

SEQ ID NO: 843911 - DNA, 22 bp, Artificial Sequence
  chemically synthesized
aaagtcaggaaatttagcgtgg

SEQ ID NO: 843912 - DNA, 22 bp, Artificial Sequence
  chemically synthesized
agcgtggctttagtaccataat

SEQ ID NO: 843913 - DNA, 22 bp, Artificial Sequence
  chemically synthesized
gcgtggctttagtaccataatc

SEQ ID NO: 843914 - DNA, 22 bp, Artificial Sequence
  chemically synthesized
aatatagagtatggataagatt

SEQ ID NO: 843915 - DNA, 22 bp, Artificial Sequence
  chemically synthesized
tgaatatagagtatggataaga

SEQ ID NO: 843916 - DNA, 22 bp, Artificial Sequence
  chemically synthesized
tagtaccataatcttatccata

SEQ ID NO: 843917 - DNA, 22 bp, Artificial Sequence
  chemically synthesized
agtaccataatcttatccatac

SEQ ID NO: 843918 - DNA, 22 bp, Artificial Sequence
  chemically synthesized
gtaccataatcttatccatact

SEQ ID NO: 843919 - DNA, 22 bp, Artificial Sequence
  chemically synthesized
tcatactctgaatatagagtat

SEQ ID NO: 843920 - DNA, 22 bp, Artificial Sequence
  chemically synthesized
atccatactctatattcagagt

SEQ ID NO: 843921 - DNA, 22 bp, Artificial Sequence
  chemically synthesized
tccatactctatattcagagta

SEQ ID NO: 843922 - DNA, 22 bp, Artificial Sequence
  chemically synthesized
atggggtaattgtcatactctg

SEQ ID NO: 843923 - DNA, 22 bp, Artificial Sequence
  chemically synthesized
attaatggggtaattgtcatac

SEQ ID NO: 843924 - DNA, 22 bp, Artificial Sequence
  chemically synthesized
tatattcagagtatgacaatta

SEQ ID NO: 843925 - DNA, 22 bp, Artificial Sequence
  chemically synthesized
tattcagagtatgacaattacc

SEQ ID NO: 843926 - DNA, 22 bp, Artificial Sequence
  chemically synthesized
taaagttcattaatggggtaat

SEQ ID NO: 843927 - DNA, 22 bp, Artificial Sequence
  chemically synthesized
agagtatgacaattaccccatt

SEQ ID NO: 843928 - DNA, 22 bp, Artificial Sequence
  chemically synthesized
ccccattaatgaactttatagc

SEQ ID NO: 843929 - DNA, 22 bp, Artificial Sequence
  chemically synthesized
atgaactttatagctatatttt

SEQ ID NO: 843930 - DNA, 22 bp, Artificial Sequence
  chemically synthesized
gaccagaccaggaaataaaaat

SEQ ID NO: 843931 - DNA, 22 bp, Artificial Sequence
  chemically synthesized
tatagctatatttttatttcct

SEQ ID NO: 843932 - DNA, 22 bp, Artificial Sequence
  chemically synthesized
atagctatatttttatttcctg

SEQ ID NO: 843933 - DNA, 22 bp, Artificial Sequence
  chemically synthesized
tagctatatttttatttcctgg

SEQ ID NO: 843934 - DNA, 22 bp, Artificial Sequence
  chemically synthesized
tatttttatttcctggtctggt

SEQ ID NO: 843935 - DNA, 22 bp, Artificial Sequence
  chemically synthesized
ttatttcctggtctggtccaga

SEQ ID NO: 843936 - DNA, 22 bp, Artificial Sequence
  chemically synthesized
tatttcctggtctggtccagac

SEQ ID NO: 843937 - DNA, 22 bp, Artificial Sequence
  chemically synthesized
atttcctggtctggtccagact

SEQ ID NO: 843938 - DNA, 22 bp, Artificial Sequence
  chemically synthesized
tttcctggtctggtccagactc

SEQ ID NO: 843939 - DNA, 22 bp, Artificial Sequence
  chemically synthesized
aaagcaatgcgtgagtctggac

SEQ ID NO: 843940 - DNA, 22 bp, Artificial Sequence
  chemically synthesized
cctggtctggtccagactcacg

SEQ ID NO: 843941 - DNA, 22 bp, Artificial Sequence
  chemically synthesized
ctggtctggtccagactcacgc

SEQ ID NO: 843942 - DNA, 22 bp, Artificial Sequence
  chemically synthesized
gtctggtccagactcacgcatt

SEQ ID NO: 843943 - DNA, 22 bp, Artificial Sequence
  chemically synthesized
gtccagactcacgcattgcttt

SEQ ID NO: 843944 - DNA, 22 bp, Artificial Sequence
  chemically synthesized
aggagatacgacaactaaaagc

SEQ ID NO: 843945 - DNA, 22 bp, Artificial Sequence
  chemically synthesized
acgcattgcttttagttgtcgt

SEQ ID NO: 843946 - DNA, 22 bp, Artificial Sequence
  chemically synthesized
aaaaagactaaggagatacgac

SEQ ID NO: 843947 - DNA, 22 bp, Artificial Sequence
  chemically synthesized
aaaaaagactaaggagatacga

SEQ ID NO: 843948 - DNA, 22 bp, Artificial Sequence
  chemically synthesized
cttttagttgtcgtatctcctt

SEQ ID NO: 843949 - DNA, 22 bp, Artificial Sequence
  chemically synthesized
ttagttgtcgtatctccttagt

SEQ ID NO: 843950 - DNA, 22 bp, Artificial Sequence
  chemically synthesized
aacttaaaaaagactaaggaga

SEQ ID NO: 843951 - DNA, 22 bp, Artificial Sequence
  chemically synthesized
tagttgtcgtatctccttagtc

SEQ ID NO: 843952 - DNA, 22 bp, Artificial Sequence
  chemically synthesized
caacttaaaaaagactaaggag

SEQ ID NO: 843953 - DNA, 22 bp, Artificial Sequence
  chemically synthesized
agttgtcgtatctccttagtct

SEQ ID NO: 843954 - DNA, 22 bp, Artificial Sequence
  chemically synthesized
gttgtcgtatctccttagtctt

SEQ ID NO: 843955 - DNA, 22 bp, Artificial Sequence
  chemically synthesized
tttcaacttaaaaaagactaag

SEQ ID NO: 843956 - DNA, 22 bp, Artificial Sequence
  chemically synthesized
tcgtatctccttagtctttttt

SEQ ID NO: 843957 - DNA, 22 bp, Artificial Sequence
  chemically synthesized
cttagtcttttttaagttgaaa

SEQ ID NO: 843958 - DNA, 22 bp, Artificial Sequence
  chemically synthesized
agtcttttttaagttgaaatag

SEQ ID NO: 843959 - DNA, 22 bp, Artificial Sequence
  chemically synthesized
gtcttttttaagttgaaatagt

SEQ ID NO: 843960 - DNA, 22 bp, Artificial Sequence
  chemically synthesized
aaagaaaggcaaataactattt

SEQ ID NO: 843961 - DNA, 22 bp, Artificial Sequence
  chemically synthesized
ttttaagttgaaatagttattt

SEQ ID NO: 843962 - DNA, 22 bp, Artificial Sequence
  chemically synthesized
tttaagttgaaatagttatttg

SEQ ID NO: 843963 - DNA, 22 bp, Artificial Sequence
  chemically synthesized
ttaagttgaaatagttatttgc

SEQ ID NO: 843964 - DNA, 22 bp, Artificial Sequence
  chemically synthesized
taagttgaaatagttatttgcc

SEQ ID NO: 843965 - DNA, 22 bp, Artificial Sequence
  chemically synthesized
aagttgaaatagttatttgcct

SEQ ID NO: 843966 - DNA, 22 bp, Artificial Sequence
  chemically synthesized
agttgaaatagttatttgcctt

SEQ ID NO: 843967 - DNA, 22 bp, Artificial Sequence
  chemically synthesized
taaagttcaaagaaaggcaaat

SEQ ID NO: 843968 - DNA, 22 bp, Artificial Sequence
  chemically synthesized
aaatagttatttgcctttcttt

SEQ ID NO: 843969 - DNA, 22 bp, Artificial Sequence
  chemically synthesized
taagtgttataaagttcaaaga

SEQ ID NO: 843970 - DNA, 22 bp, Artificial Sequence
  chemically synthesized
tttgcctttctttgaactttat

SEQ ID NO: 843971 - DNA, 22 bp, Artificial Sequence
  chemically synthesized
gcctttctttgaactttataac

SEQ ID NO: 843972 - DNA, 22 bp, Artificial Sequence
  chemically synthesized
cctttctttgaactttataaca

SEQ ID NO: 843973 - DNA, 22 bp, Artificial Sequence
  chemically synthesized
gtcaaaactgtaagtgttataa

SEQ ID NO: 843974 - DNA, 22 bp, Artificial Sequence
  chemically synthesized
tctttgaactttataacactta

SEQ ID NO: 843975 - DNA, 22 bp, Artificial Sequence
  chemically synthesized
ctttgaactttataacacttac

SEQ ID NO: 843976 - DNA, 22 bp, Artificial Sequence
  chemically synthesized
ttggtcaaaactgtaagtgtta

SEQ ID NO: 843977 - DNA, 22 bp, Artificial Sequence
  chemically synthesized
tttgaactttataacacttaca

SEQ ID NO: 843978 - DNA, 22 bp, Artificial Sequence
  chemically synthesized
tgttggtcaaaactgtaagtgt

SEQ ID NO: 843979 - DNA, 22 bp, Artificial Sequence
  chemically synthesized
tgaactttataacacttacagt

SEQ ID NO: 843980 - DNA, 22 bp, Artificial Sequence
  chemically synthesized
gaactttataacacttacagtt

SEQ ID NO: 843981 - DNA, 22 bp, Artificial Sequence
  chemically synthesized
aactttataacacttacagttt

SEQ ID NO: 843982 - DNA, 22 bp, Artificial Sequence
  chemically synthesized
gcctctgttggtcaaaactgta

SEQ ID NO: 843983 - DNA, 22 bp, Artificial Sequence
  chemically synthesized
tataacacttacagttttgacc

SEQ ID NO: 843984 - DNA, 22 bp, Artificial Sequence
  chemically synthesized
ataacacttacagttttgacca

SEQ ID NO: 843985 - DNA, 22 bp, Artificial Sequence
  chemically synthesized
taacacttacagttttgaccaa

SEQ ID NO: 843986 - DNA, 22 bp, Artificial Sequence
  chemically synthesized
caaaatacctggcctctgttgg

SEQ ID NO: 843987 - DNA, 22 bp, Artificial Sequence
  chemically synthesized
acagttttgaccaacagaggcc

SEQ ID NO: 843988 - DNA, 22 bp, Artificial Sequence
  chemically synthesized
tacaaaatacctggcctctgtt

SEQ ID NO: 843989 - DNA, 22 bp, Artificial Sequence
  chemically synthesized
cagttttgaccaacagaggcca

SEQ ID NO: 843990 - DNA, 22 bp, Artificial Sequence
  chemically synthesized
tgaccaacagaggccaggtatt

SEQ ID NO: 843991 - DNA, 22 bp, Artificial Sequence
  chemically synthesized
gaccaacagaggccaggtattt

SEQ ID NO: 843992 - DNA, 22 bp, Artificial Sequence
  chemically synthesized
accaacagaggccaggtatttt

SEQ ID NO: 843993 - DNA, 22 bp, Artificial Sequence
  chemically synthesized
ggggatattctacaaaatacct

SEQ ID NO: 843994 - DNA, 22 bp, Artificial Sequence
  chemically synthesized
gggggatattctacaaaatacc

SEQ ID NO: 843995 - DNA, 22 bp, Artificial Sequence
  chemically synthesized
aaatttgggggatattctacaa

SEQ ID NO: 843996 - DNA, 22 bp, Artificial Sequence
  chemically synthesized
taactcaaatttgggggatatt

SEQ ID NO: 843997 - DNA, 22 bp, Artificial Sequence
  chemically synthesized
ctataactcaaatttgggggat

SEQ ID NO: 843998 - DNA, 22 bp, Artificial Sequence
  chemically synthesized
tgtagaatatcccccaaatttg

SEQ ID NO: 843999 - DNA, 22 bp, Artificial Sequence
  chemically synthesized
gtagaatatcccccaaatttga

SEQ ID NO: 844000 - DNA, 22 bp, Artificial Sequence
  chemically synthesized
tagaatatcccccaaatttgag

SEQ ID NO: 844001 - DNA, 22 bp, Artificial Sequence
  chemically synthesized
aaaaattgctataactcaaatt

SEQ ID NO: 844002 - DNA, 22 bp, Artificial Sequence
  chemically synthesized
aaaaaattgctataactcaaat

SEQ ID NO: 844003 - DNA, 22 bp, Artificial Sequence
  chemically synthesized
gagttatagcaattttttaagt

SEQ ID NO: 844004 - DNA, 22 bp, Artificial Sequence
  chemically synthesized
agttatagcaattttttaagtg

SEQ ID NO: 844005 - DNA, 22 bp, Artificial Sequence
  chemically synthesized
tagcaattttttaagtgcttct

SEQ ID NO: 844006 - DNA, 22 bp, Artificial Sequence
  chemically synthesized
aatgagtgacacaacagaagca

SEQ ID NO: 844007 - DNA, 22 bp, Artificial Sequence
  chemically synthesized
gctcaatgagtgacacaacaga

SEQ ID NO: 844008 - DNA, 22 bp, Artificial Sequence
  chemically synthesized
tttaagtgcttctgttgtgtca

SEQ ID NO: 844009 - DNA, 22 bp, Artificial Sequence
  chemically synthesized
ttaagtgcttctgttgtgtcac

SEQ ID NO: 844010 - DNA, 22 bp, Artificial Sequence
  chemically synthesized
taagtgcttctgttgtgtcact

SEQ ID NO: 844011 - DNA, 22 bp, Artificial Sequence
  chemically synthesized
aagtgcttctgttgtgtcactc

SEQ ID NO: 844012 - DNA, 22 bp, Artificial Sequence
  chemically synthesized
agtgcttctgttgtgtcactca

SEQ ID NO: 844013 - DNA, 22 bp, Artificial Sequence
  chemically synthesized
cacctagctcaatgagtgacac

SEQ ID NO: 844014 - DNA, 22 bp, Artificial Sequence
  chemically synthesized
ctgttgtgtcactcattgagct

SEQ ID NO: 844015 - DNA, 22 bp, Artificial Sequence
  chemically synthesized
tgttgtgtcactcattgagcta

SEQ ID NO: 844016 - DNA, 22 bp, Artificial Sequence
  chemically synthesized
cagcccctgcacctagctcaat

SEQ ID NO: 844017 - DNA, 22 bp, Artificial Sequence
  chemically synthesized
ttgtgtcactcattgagctagg

SEQ ID NO: 844018 - DNA, 22 bp, Artificial Sequence
  chemically synthesized
ctacagcccctgcacctagctc

SEQ ID NO: 844019 - DNA, 22 bp, Artificial Sequence
  chemically synthesized
tgtcactcattgagctaggtgc

SEQ ID NO: 844020 - DNA, 22 bp, Artificial Sequence
  chemically synthesized
actgctacagcccctgcaccta

SEQ ID NO: 844021 - DNA, 22 bp, Artificial Sequence
  chemically synthesized
cactgctacagcccctgcacct

SEQ ID NO: 844022 - DNA, 22 bp, Artificial Sequence
  chemically synthesized
cttcactgctacagcccctgca

SEQ ID NO: 844023 - DNA, 22 bp, Artificial Sequence
  chemically synthesized
attgagctaggtgcaggggctg

SEQ ID NO: 844024 - DNA, 22 bp, Artificial Sequence
  chemically synthesized
tccttcactgctacagcccctg

SEQ ID NO: 844025 - DNA, 22 bp, Artificial Sequence
  chemically synthesized
ctccttcactgctacagcccct

SEQ ID NO: 844026 - DNA, 22 bp, Artificial Sequence
  chemically synthesized
tctccttcactgctacagcccc

SEQ ID NO: 844027 - DNA, 22 bp, Artificial Sequence
  chemically synthesized
agctaggtgcaggggctgtagc

SEQ ID NO: 844028 - DNA, 22 bp, Artificial Sequence
  chemically synthesized
ttttctccttcactgctacagc

SEQ ID NO: 844029 - DNA, 22 bp, Artificial Sequence
  chemically synthesized
ggtgcaggggctgtagcagtga

SEQ ID NO: 844030 - DNA, 22 bp, Artificial Sequence
  chemically synthesized
agaacaggaattattttctcct

SEQ ID NO: 844031 - DNA, 22 bp, Artificial Sequence
  chemically synthesized
gagaacaggaattattttctcc

SEQ ID NO: 844032 - DNA, 22 bp, Artificial Sequence
  chemically synthesized
tgagaacaggaattattttctc

SEQ ID NO: 844033 - DNA, 22 bp, Artificial Sequence
  chemically synthesized
tagcagtgaaggagaaaataat

SEQ ID NO: 844034 - DNA, 22 bp, Artificial Sequence
  chemically synthesized
tttgagaacaggaattattttc

SEQ ID NO: 844035 - DNA, 22 bp, Artificial Sequence
  chemically synthesized
tctttgagaacaggaattattt

SEQ ID NO: 844036 - DNA, 22 bp, Artificial Sequence
  chemically synthesized
ctctttgagaacaggaattatt

SEQ ID NO: 844037 - DNA, 22 bp, Artificial Sequence
  chemically synthesized
tctctttgagaacaggaattat

SEQ ID NO: 844038 - DNA, 22 bp, Artificial Sequence
  chemically synthesized
ttttctctttgagaacaggaat

SEQ ID NO: 844039 - DNA, 22 bp, Artificial Sequence
  chemically synthesized
gttttctctttgagaacaggaa

SEQ ID NO: 844040 - DNA, 22 bp, Artificial Sequence
  chemically synthesized
gtttgttttctctttgagaaca

SEQ ID NO: 844041 - DNA, 22 bp, Artificial Sequence
  chemically synthesized
ctcgtttgttttctctttgaga

SEQ ID NO: 844042 - DNA, 22 bp, Artificial Sequence
  chemically synthesized
ctgttctcaaagagaaaacaaa

SEQ ID NO: 844043 - DNA, 22 bp, Artificial Sequence
  chemically synthesized
tcatcactactcgtttgttttc

SEQ ID NO: 844044 - DNA, 22 bp, Artificial Sequence
  chemically synthesized
ttctcaaagagaaaacaaacga

SEQ ID NO: 844045 - DNA, 22 bp, Artificial Sequence
  chemically synthesized
cctgtcatcactactcgtttgt

SEQ ID NO: 844046 - DNA, 22 bp, Artificial Sequence
  chemically synthesized
tcaaagagaaaacaaacgagta

SEQ ID NO: 844047 - DNA, 22 bp, Artificial Sequence
  chemically synthesized
aaagagaaaacaaacgagtagt

SEQ ID NO: 844048 - DNA, 22 bp, Artificial Sequence
  chemically synthesized
ttgcctgtcatcactactcgtt

SEQ ID NO: 844049 - DNA, 22 bp, Artificial Sequence
  chemically synthesized
attgcctgtcatcactactcgt

SEQ ID NO: 844050 - DNA, 22 bp, Artificial Sequence
  chemically synthesized
tattgcctgtcatcactactcg

SEQ ID NO: 844051 - DNA, 22 bp, Artificial Sequence
  chemically synthesized
ttattgcctgtcatcactactc

SEQ ID NO: 844052 - DNA, 22 bp, Artificial Sequence
  chemically synthesized
tttattgcctgtcatcactact

SEQ ID NO: 844053 - DNA, 22 bp, Artificial Sequence
  chemically synthesized
ttttattgcctgtcatcactac

SEQ ID NO: 844054 - DNA, 22 bp, Artificial Sequence
  chemically synthesized
cttttttattgcctgtcatcac

SEQ ID NO: 844055 - DNA, 22 bp, Artificial Sequence
  chemically synthesized
caattgcttttttattgcctgt

SEQ ID NO: 844056 - DNA, 22 bp, Artificial Sequence
  chemically synthesized
ttgcaattgcttttttattgcc

SEQ ID NO: 844057 - DNA, 22 bp, Artificial Sequence
  chemically synthesized
aggttgttgcaattgctttttt

SEQ ID NO: 844058 - DNA, 22 bp, Artificial Sequence
  chemically synthesized
ccataatacctcaggttgttgc

SEQ ID NO: 844059 - DNA, 22 bp, Artificial Sequence
  chemically synthesized
ccctaccataatacctcaggtt

SEQ ID NO: 844060 - DNA, 22 bp, Artificial Sequence
  chemically synthesized
cccctaccataatacctcaggt

SEQ ID NO: 844061 - DNA, 22 bp, Artificial Sequence
  chemically synthesized
caacaacctgaggtattatggt

SEQ ID NO: 844062 - DNA, 22 bp, Artificial Sequence
  chemically synthesized
catgtttcccctaccataatac

SEQ ID NO: 844063 - DNA, 22 bp, Artificial Sequence
  chemically synthesized
tccatgtttcccctaccataat

SEQ ID NO: 844064 - DNA, 22 bp, Artificial Sequence
  chemically synthesized
ataactctccatgtttccccta

SEQ ID NO: 844065 - DNA, 22 bp, Artificial Sequence
  chemically synthesized
aggtattatggtaggggaaaca

SEQ ID NO: 844066 - DNA, 22 bp, Artificial Sequence
  chemically synthesized
tgataactctccatgtttcccc

SEQ ID NO: 844067 - DNA, 22 bp, Artificial Sequence
  chemically synthesized
tggtaggggaaacatggagagt

SEQ ID NO: 844068 - DNA, 22 bp, Artificial Sequence
  chemically synthesized
ccatatgctctgataactctcc

SEQ ID NO: 844069 - DNA, 22 bp, Artificial Sequence
  chemically synthesized
gccatatgctctgataactctc

SEQ ID NO: 844070 - DNA, 22 bp, Artificial Sequence
  chemically synthesized
tgccatatgctctgataactct

SEQ ID NO: 844071 - DNA, 22 bp, Artificial Sequence
  chemically synthesized
atgtgatatctttgccatatgc

SEQ ID NO: 844072 - DNA, 22 bp, Artificial Sequence
  chemically synthesized
catgtgatatctttgccatatg

SEQ ID NO: 844073 - DNA, 22 bp, Artificial Sequence
  chemically synthesized
tatttcatgtgatatctttgcc

SEQ ID NO: 844074 - DNA, 22 bp, Artificial Sequence
  chemically synthesized
tcagagcatatggcaaagatat

SEQ ID NO: 844075 - DNA, 22 bp, Artificial Sequence
  chemically synthesized
atatttcatgtgatatctttgc

SEQ ID NO: 844076 - DNA, 22 bp, Artificial Sequence
  chemically synthesized
tatatttcatgtgatatctttg

SEQ ID NO: 844077 - DNA, 22 bp, Artificial Sequence
  chemically synthesized
gcctttatatttcatgtgatat

SEQ ID NO: 844078 - DNA, 22 bp, Artificial Sequence
  chemically synthesized
ggcctttatatttcatgtgata

SEQ ID NO: 844079 - DNA, 22 bp, Artificial Sequence
  chemically synthesized
tggcctttatatttcatgtgat

SEQ ID NO: 844080 - DNA, 22 bp, Artificial Sequence
  chemically synthesized
agaagacagtctttggccttta

SEQ ID NO: 844081 - DNA, 22 bp, Artificial Sequence
  chemically synthesized
cagaagacagtctttggccttt

SEQ ID NO: 844082 - DNA, 22 bp, Artificial Sequence
  chemically synthesized
cttcagaagacagtctttggcc

SEQ ID NO: 844083 - DNA, 22 bp, Artificial Sequence
  chemically synthesized
attccttcagaagacagtcttt

SEQ ID NO: 844084 - DNA, 22 bp, Artificial Sequence
  chemically synthesized
gattccttcagaagacagtctt

SEQ ID NO: 844085 - DNA, 22 bp, Artificial Sequence
  chemically synthesized
agcttgattccttcagaagaca

SEQ ID NO: 844086 - DNA, 22 bp, Artificial Sequence
  chemically synthesized
aagcttgattccttcagaagac

SEQ ID NO: 844087 - DNA, 22 bp, Artificial Sequence
  chemically synthesized
cttaagcttgattccttcagaa

SEQ ID NO: 844088 - DNA, 22 bp, Artificial Sequence
  chemically synthesized
aggactacttaagcttgattcc

SEQ ID NO: 844089 - DNA, 22 bp, Artificial Sequence
  chemically synthesized
tcttctgaaggaatcaagctta

SEQ ID NO: 844090 - DNA, 22 bp, Artificial Sequence
  chemically synthesized
ctgaaggaatcaagcttaagta

SEQ ID NO: 844091 - DNA, 22 bp, Artificial Sequence
  chemically synthesized
tgaaggaatcaagcttaagtag

SEQ ID NO: 844092 - DNA, 22 bp, Artificial Sequence
  chemically synthesized
aaggaatcaagcttaagtagtc

SEQ ID NO: 844093 - DNA, 22 bp, Artificial Sequence
  chemically synthesized
aataaagaaaagctgaggacta

SEQ ID NO: 844094 - DNA, 22 bp, Artificial Sequence
  chemically synthesized
aaataaagaaaagctgaggact

SEQ ID NO: 844095 - DNA, 22 bp, Artificial Sequence
  chemically synthesized
aagtagtcctcagcttttcttt

SEQ ID NO: 844096 - DNA, 22 bp, Artificial Sequence
  chemically synthesized
tataatttaaataaagaaaagc

SEQ ID NO: 844097 - DNA, 22 bp, Artificial Sequence
  chemically synthesized
agtagtcctcagcttttcttta

SEQ ID NO: 844098 - DNA, 22 bp, Artificial Sequence
  chemically synthesized
gtataatttaaataaagaaaag

SEQ ID NO: 844099 - DNA, 22 bp, Artificial Sequence
  chemically synthesized
tgtataatttaaataaagaaaa

SEQ ID NO: 844100 - DNA, 22 bp, Artificial Sequence
  chemically synthesized
ttttgtataatttaaataaaga

SEQ ID NO: 844101 - DNA, 22 bp, Artificial Sequence
  chemically synthesized
agcttttctttatttaaattat

SEQ ID NO: 844102 - DNA, 22 bp, Artificial Sequence
  chemically synthesized
aaactgttttgtataatttaaa

SEQ ID NO: 844103 - DNA, 22 bp, Artificial Sequence
  chemically synthesized
aaaactgttttgtataatttaa

SEQ ID NO: 844104 - DNA, 22 bp, Artificial Sequence
  chemically synthesized
ttctttatttaaattatacaaa

SEQ ID NO: 844105 - DNA, 22 bp, Artificial Sequence
  chemically synthesized
tctttatttaaattatacaaaa

SEQ ID NO: 844106 - DNA, 22 bp, Artificial Sequence
  chemically synthesized
ctttatttaaattatacaaaac

SEQ ID NO: 844107 - DNA, 22 bp, Artificial Sequence
  chemically synthesized
tttatttaaattatacaaaaca

SEQ ID NO: 844108 - DNA, 22 bp, Artificial Sequence
  chemically synthesized
tatttaaattatacaaaacagt

SEQ ID NO: 844109 - DNA, 22 bp, Artificial Sequence
  chemically synthesized
atttaaattatacaaaacagtt

SEQ ID NO: 844110 - DNA, 22 bp, Artificial Sequence
  chemically synthesized
tttaaattatacaaaacagttt

SEQ ID NO: 844111 - DNA, 22 bp, Artificial Sequence
  chemically synthesized
aaattatacaaaacagttttaa

SEQ ID NO: 844112 - DNA, 22 bp, Artificial Sequence
  chemically synthesized
aattatacaaaacagttttaaa

SEQ ID NO: 844113 - DNA, 22 bp, Artificial Sequence
  chemically synthesized
tacaaaacagttttaaacacca

SEQ ID NO: 844114 - DNA, 22 bp, Artificial Sequence
  chemically synthesized
ggtatgaggagcagtggtgttt

SEQ ID NO: 844115 - DNA, 22 bp, Artificial Sequence
  chemically synthesized
gggtatgaggagcagtggtgtt

SEQ ID NO: 844116 - DNA, 22 bp, Artificial Sequence
  chemically synthesized
taaacaccactgctcctcatac

SEQ ID NO: 844117 - DNA, 22 bp, Artificial Sequence
  chemically synthesized
aaacaccactgctcctcatacc

SEQ ID NO: 844118 - DNA, 22 bp, Artificial Sequence
  chemically synthesized
aacaccactgctcctcataccc

SEQ ID NO: 844119 - DNA, 22 bp, Artificial Sequence
  chemically synthesized
atggtggccacttgggtatgag

SEQ ID NO: 844120 - DNA, 22 bp, Artificial Sequence
  chemically synthesized
tcatggtggccacttgggtatg

SEQ ID NO: 844121 - DNA, 22 bp, Artificial Sequence
  chemically synthesized
ctcctcatacccaagtggccac

SEQ ID NO: 844122 - DNA, 22 bp, Artificial Sequence
  chemically synthesized
catattctcatggtggccactt

SEQ ID NO: 844123 - DNA, 22 bp, Artificial Sequence
  chemically synthesized
ctcatacccaagtggccaccat

SEQ ID NO: 844124 - DNA, 22 bp, Artificial Sequence
  chemically synthesized
atacccaagtggccaccatgag

SEQ ID NO: 844125 - DNA, 22 bp, Artificial Sequence
  chemically synthesized
agacccaataatagaaggcctg

SEQ ID NO: 844126 - DNA, 22 bp, Artificial Sequence
  chemically synthesized
agtcagttaagacccaataata

SEQ ID NO: 844127 - DNA, 22 bp, Artificial Sequence
  chemically synthesized
ctattattgggtcttaactgac

SEQ ID NO: 844128 - DNA, 22 bp, Artificial Sequence
  chemically synthesized
tattattgggtcttaactgact

SEQ ID NO: 844129 - DNA, 22 bp, Artificial Sequence
  chemically synthesized
ttattgggtcttaactgactga

SEQ ID NO: 844130 - DNA, 22 bp, Artificial Sequence
  chemically synthesized
ttgggtcttaactgactgagga

SEQ ID NO: 844131 - DNA, 22 bp, Artificial Sequence
  chemically synthesized
ggtcttaactgactgaggactc

SEQ ID NO: 844132 - DNA, 22 bp, Artificial Sequence
  chemically synthesized
aaaatgcagtaacaggagtcct

SEQ ID NO: 844133 - DNA, 22 bp, Artificial Sequence
  chemically synthesized
caaaatgcagtaacaggagtcc

SEQ ID NO: 844134 - DNA, 22 bp, Artificial Sequence
  chemically synthesized
aactgactgaggactcctgtta

SEQ ID NO: 844135 - DNA, 22 bp, Artificial Sequence
  chemically synthesized
actgactgaggactcctgttac

SEQ ID NO: 844136 - DNA, 22 bp, Artificial Sequence
  chemically synthesized
actgaggactcctgttactgca

SEQ ID NO: 844137 - DNA, 22 bp, Artificial Sequence
  chemically synthesized
aggactcctgttactgcatttt

SEQ ID NO: 844138 - DNA, 22 bp, Artificial Sequence
  chemically synthesized
ctgttactgcattttgaaatcc

SEQ ID NO: 844139 - DNA, 22 bp, Artificial Sequence
  chemically synthesized
ttactgcattttgaaatccatg

SEQ ID NO: 844140 - DNA, 22 bp, Artificial Sequence
  chemically synthesized
gtgcagtgcaatcatggatttc

SEQ ID NO: 844141 - DNA, 22 bp, Artificial Sequence
  chemically synthesized
ggtgcagtgcaatcatggattt

SEQ ID NO: 844142 - DNA, 22 bp, Artificial Sequence
  chemically synthesized
tggtgcagtgcaatcatggatt

SEQ ID NO: 844143 - DNA, 22 bp, Artificial Sequence
  chemically synthesized
ctgcattttgaaatccatgatt

SEQ ID NO: 844144 - DNA, 22 bp, Artificial Sequence
  chemically synthesized
cattttgaaatccatgattgca

SEQ ID NO: 844145 - DNA, 22 bp, Artificial Sequence
  chemically synthesized
gctttggtgcagtgcaatcatg

SEQ ID NO: 844146 - DNA, 22 bp, Artificial Sequence
  chemically synthesized
ggctttggtgcagtgcaatcat

SEQ ID NO: 844147 - DNA, 22 bp, Artificial Sequence
  chemically synthesized
tgaaatccatgattgcactgca

SEQ ID NO: 844148 - DNA, 22 bp, Artificial Sequence
  chemically synthesized
gaaatccatgattgcactgcac

SEQ ID NO: 844149 - DNA, 22 bp, Artificial Sequence
  chemically synthesized
aaatccatgattgcactgcacc

SEQ ID NO: 844150 - DNA, 22 bp, Artificial Sequence
  chemically synthesized
tgagaagcttggctttggtgca

SEQ ID NO: 844151 - DNA, 22 bp, Artificial Sequence
  chemically synthesized
cactgcaccaaagccaagcttc

SEQ ID NO: 844152 - DNA, 22 bp, Artificial Sequence
  chemically synthesized
caccaaagccaagcttctcaca

SEQ ID NO: 844153 - DNA, 22 bp, Artificial Sequence
  chemically synthesized
ggtgaggagaagtctgtgagaa

SEQ ID NO: 844154 - DNA, 22 bp, Artificial Sequence
  chemically synthesized
ctcacagacttctcctcaccca

SEQ ID NO: 844155 - DNA, 22 bp, Artificial Sequence
  chemically synthesized
tcacagacttctcctcacccaa

SEQ ID NO: 844156 - DNA, 22 bp, Artificial Sequence
  chemically synthesized
acagacttctcctcacccaatg

SEQ ID NO: 844157 - DNA, 22 bp, Artificial Sequence
  chemically synthesized
ccaccacacccaatcattgggt

SEQ ID NO: 844158 - DNA, 22 bp, Artificial Sequence
  chemically synthesized
ctcctcacccaatgattgggtg

SEQ ID NO: 844159 - DNA, 22 bp, Artificial Sequence
  chemically synthesized
gtattcccaccacacccaatca

SEQ ID NO: 844160 - DNA, 22 bp, Artificial Sequence
  chemically synthesized
tcctcacccaatgattgggtgt

SEQ ID NO: 844161 - DNA, 22 bp, Artificial Sequence
  chemically synthesized
agtattcccaccacacccaatc

SEQ ID NO: 844162 - DNA, 22 bp, Artificial Sequence
  chemically synthesized
ctcacccaatgattgggtgtgg

SEQ ID NO: 844163 - DNA, 22 bp, Artificial Sequence
  chemically synthesized
ccttagtattcccaccacaccc

SEQ ID NO: 844164 - DNA, 22 bp, Artificial Sequence
  chemically synthesized
acccaatgattgggtgtggtgg

SEQ ID NO: 844165 - DNA, 22 bp, Artificial Sequence
  chemically synthesized
tgccttagtattcccaccacac

SEQ ID NO: 844166 - DNA, 22 bp, Artificial Sequence
  chemically synthesized
tctgccttagtattcccaccac

SEQ ID NO: 844167 - DNA, 22 bp, Artificial Sequence
  chemically synthesized
ggtgtggtgggaatactaaggc

SEQ ID NO: 844168 - DNA, 22 bp, Artificial Sequence
  chemically synthesized
ccaaggaaggctctctgcctta

SEQ ID NO: 844169 - DNA, 22 bp, Artificial Sequence
  chemically synthesized
aggcagagagccttccttggga

SEQ ID NO: 844170 - DNA, 22 bp, Artificial Sequence
  chemically synthesized
ccttgggagacatgggacttct

SEQ ID NO: 844171 - DNA, 22 bp, Artificial Sequence
  chemically synthesized
cttgggagacatgggacttctt

SEQ ID NO: 844172 - DNA, 22 bp, Artificial Sequence
  chemically synthesized
gggagacatgggacttctttgc

SEQ ID NO: 844173 - DNA, 22 bp, Artificial Sequence
  chemically synthesized
aggcagagccaggcaaagaagt

SEQ ID NO: 844174 - DNA, 22 bp, Artificial Sequence
  chemically synthesized
ggagacatgggacttctttgcc

SEQ ID NO: 844175 - DNA, 22 bp, Artificial Sequence
  chemically synthesized
ggaagtcattgaggcagagcca

SEQ ID NO: 844176 - DNA, 22 bp, Artificial Sequence
  chemically synthesized
ttgggaagtcattgaggcagag

SEQ ID NO: 844177 - DNA, 22 bp, Artificial Sequence
  chemically synthesized
ctttgcctggctctgcctcaat

SEQ ID NO: 844178 - DNA, 22 bp, Artificial Sequence
  chemically synthesized
tttgcctggctctgcctcaatg

SEQ ID NO: 844179 - DNA, 22 bp, Artificial Sequence
  chemically synthesized
tgcctggctctgcctcaatgac

SEQ ID NO: 844180 - DNA, 22 bp, Artificial Sequence
  chemically synthesized
gcctggctctgcctcaatgact

SEQ ID NO: 844181 - DNA, 22 bp, Artificial Sequence
  chemically synthesized
cctggctctgcctcaatgactt

SEQ ID NO: 844182 - DNA, 22 bp, Artificial Sequence
  chemically synthesized
gcaaagctgttgggaagtcatt

SEQ ID NO: 844183 - DNA, 22 bp, Artificial Sequence
  chemically synthesized
ggcaaagctgttgggaagtcat

SEQ ID NO: 844184 - DNA, 22 bp, Artificial Sequence
  chemically synthesized
gctctgcctcaatgacttccca

SEQ ID NO: 844185 - DNA, 22 bp, Artificial Sequence
  chemically synthesized
tggcaaagctgttgggaagtca

SEQ ID NO: 844186 - DNA, 22 bp, Artificial Sequence
  chemically synthesized
tgcctcaatgacttcccaacag

SEQ ID NO: 844187 - DNA, 22 bp, Artificial Sequence
  chemically synthesized
cctcaatgacttcccaacagct

SEQ ID NO: 844188 - DNA, 22 bp, Artificial Sequence
  chemically synthesized
aatgacttcccaacagctttgc

SEQ ID NO: 844189 - DNA, 22 bp, Artificial Sequence
  chemically synthesized
gtggaaggaaattttggcaaag

SEQ ID NO: 844190 - DNA, 22 bp, Artificial Sequence
  chemically synthesized
cccaacagctttgccaaaattt

SEQ ID NO: 844191 - DNA, 22 bp, Artificial Sequence
  chemically synthesized
ccaacagctttgccaaaatttc

SEQ ID NO: 844192 - DNA, 22 bp, Artificial Sequence
  chemically synthesized
tgccaaaatttccttccactag

SEQ ID NO: 844193 - DNA, 22 bp, Artificial Sequence
  chemically synthesized
gccaaaatttccttccactaga

SEQ ID NO: 844194 - DNA, 22 bp, Artificial Sequence
  chemically synthesized
ccaaaatttccttccactagac

SEQ ID NO: 844195 - DNA, 22 bp, Artificial Sequence
  chemically synthesized
ccttccactagaccgcacactg

SEQ ID NO: 844196 - DNA, 22 bp, Artificial Sequence
  chemically synthesized
cttccactagaccgcacactgg

SEQ ID NO: 844197 - DNA, 22 bp, Artificial Sequence
  chemically synthesized
ggcagaagcatcccagtgtgcg

SEQ ID NO: 844198 - DNA, 22 bp, Artificial Sequence
  chemically synthesized
ccactagaccgcacactgggat

SEQ ID NO: 844199 - DNA, 22 bp, Artificial Sequence
  chemically synthesized
cactagaccgcacactgggatg

SEQ ID NO: 844200 - DNA, 22 bp, Artificial Sequence
  chemically synthesized
gaccgcacactgggatgcttct

SEQ ID NO: 844201 - DNA, 22 bp, Artificial Sequence
  chemically synthesized
ggatgcttctgcctagccttct

SEQ ID NO: 844202 - DNA, 22 bp, Artificial Sequence
  chemically synthesized
caaggaagagagagggagagaa

SEQ ID NO: 844203 - DNA, 22 bp, Artificial Sequence
  chemically synthesized
ctgcctagccttctctccctct

SEQ ID NO: 844204 - DNA, 22 bp, Artificial Sequence
  chemically synthesized
tgcaaggaagagagagggagag

SEQ ID NO: 844205 - DNA, 22 bp, Artificial Sequence
  chemically synthesized
tgcctagccttctctccctctc

SEQ ID NO: 844206 - DNA, 22 bp, Artificial Sequence
  chemically synthesized
cctagccttctctccctctctc

SEQ ID NO: 844207 - DNA, 22 bp, Artificial Sequence
  chemically synthesized
actctgcaaggaagagagaggg

SEQ ID NO: 844208 - DNA, 22 bp, Artificial Sequence
  chemically synthesized
tgactctgcaaggaagagagag

SEQ ID NO: 844209 - DNA, 22 bp, Artificial Sequence
  chemically synthesized
gccttctctccctctctcttcc

SEQ ID NO: 844210 - DNA, 22 bp, Artificial Sequence
  chemically synthesized
ctctccctctctcttccttgca

SEQ ID NO: 844211 - DNA, 22 bp, Artificial Sequence
  chemically synthesized
tctccctctctcttccttgcag

SEQ ID NO: 844212 - DNA, 22 bp, Artificial Sequence
  chemically synthesized
tccctctctcttccttgcagag

SEQ ID NO: 844213 - DNA, 22 bp, Artificial Sequence
  chemically synthesized
cctctctcttccttgcagagtc

SEQ ID NO: 844214 - DNA, 22 bp, Artificial Sequence
  chemically synthesized
tctcttccttgcagagtcagaa

SEQ ID NO: 844215 - DNA, 22 bp, Artificial Sequence
  chemically synthesized
gatcaagatgcaattctgactc

SEQ ID NO: 844216 - DNA, 22 bp, Artificial Sequence
  chemically synthesized
tcttccttgcagagtcagaatt

SEQ ID NO: 844217 - DNA, 22 bp, Artificial Sequence
  chemically synthesized
ttccttgcagagtcagaattgc

SEQ ID NO: 844218 - DNA, 22 bp, Artificial Sequence
  chemically synthesized
ccttgcagagtcagaattgcat

SEQ ID NO: 844219 - DNA, 22 bp, Artificial Sequence
  chemically synthesized
cttgcagagtcagaattgcatc

SEQ ID NO: 844220 - DNA, 22 bp, Artificial Sequence
  chemically synthesized
gcagagtcagaattgcatcttg

SEQ ID NO: 844221 - DNA, 22 bp, Artificial Sequence
  chemically synthesized
cagagtcagaattgcatcttga

SEQ ID NO: 844222 - DNA, 22 bp, Artificial Sequence
  chemically synthesized
catcttgatctaacatctcttg

SEQ ID NO: 844223 - DNA, 22 bp, Artificial Sequence
  chemically synthesized
gatctaacatctcttgcacctt

SEQ ID NO: 844224 - DNA, 22 bp, Artificial Sequence
  chemically synthesized
atctaacatctcttgcaccttc

SEQ ID NO: 844225 - DNA, 22 bp, Artificial Sequence
  chemically synthesized
acatctcttgcaccttccttgg

SEQ ID NO: 844226 - DNA, 22 bp, Artificial Sequence
  chemically synthesized
ttgcaccttccttggcttcctc

SEQ ID NO: 844227 - DNA, 22 bp, Artificial Sequence
  chemically synthesized
gcaccttccttggcttcctcct

SEQ ID NO: 844228 - DNA, 22 bp, Artificial Sequence
  chemically synthesized
caccttccttggcttcctcctt

SEQ ID NO: 844229 - DNA, 22 bp, Artificial Sequence
  chemically synthesized
tgtgaaagaaaagaaggaggaa

SEQ ID NO: 844230 - DNA, 22 bp, Artificial Sequence
  chemically synthesized
ccttggcttcctccttcttttc

SEQ ID NO: 844231 - DNA, 22 bp, Artificial Sequence
  chemically synthesized
cttggcttcctccttcttttct

SEQ ID NO: 844232 - DNA, 22 bp, Artificial Sequence
  chemically synthesized
ggcttcctccttcttttctttc

SEQ ID NO: 844233 - DNA, 22 bp, Artificial Sequence
  chemically synthesized
gcttcctccttcttttctttca

SEQ ID NO: 844234 - DNA, 22 bp, Artificial Sequence
  chemically synthesized
gtggaaatatctatgtgaaaga

SEQ ID NO: 844235 - DNA, 22 bp, Artificial Sequence
  chemically synthesized
cctccttcttttctttcacata

SEQ ID NO: 844236 - DNA, 22 bp, Artificial Sequence
  chemically synthesized
ctccttcttttctttcacatag

SEQ ID NO: 844237 - DNA, 22 bp, Artificial Sequence
  chemically synthesized
ttagtggaaatatctatgtgaa

SEQ ID NO: 844238 - DNA, 22 bp, Artificial Sequence
  chemically synthesized
attagtggaaatatctatgtga

SEQ ID NO: 844239 - DNA, 22 bp, Artificial Sequence
  chemically synthesized
cttcttttctttcacatagata

SEQ ID NO: 844240 - DNA, 22 bp, Artificial Sequence
  chemically synthesized
tattagtggaaatatctatgtg

SEQ ID NO: 844241 - DNA, 22 bp, Artificial Sequence
  chemically synthesized
cttttctttcacatagatattt

SEQ ID NO: 844242 - DNA, 22 bp, Artificial Sequence
  chemically synthesized
ttttctttcacatagatatttc

SEQ ID NO: 844243 - DNA, 22 bp, Artificial Sequence
  chemically synthesized
ttctttcacatagatatttcca

SEQ ID NO: 844244 - DNA, 22 bp, Artificial Sequence
  chemically synthesized
tctttcacatagatatttccac

SEQ ID NO: 844245 - DNA, 22 bp, Artificial Sequence
  chemically synthesized
ctttcacatagatatttccact

SEQ ID NO: 844246 - DNA, 22 bp, Artificial Sequence
  chemically synthesized
tttcacatagatatttccacta

SEQ ID NO: 844247 - DNA, 22 bp, Artificial Sequence
  chemically synthesized
tcacatagatatttccactaat

SEQ ID NO: 844248 - DNA, 22 bp, Artificial Sequence
  chemically synthesized
cacatagatatttccactaata

SEQ ID NO: 844249 - DNA, 22 bp, Artificial Sequence
  chemically synthesized
acatagatatttccactaataa

SEQ ID NO: 844250 - DNA, 22 bp, Artificial Sequence
  chemically synthesized
ccactaataaaatattgtccca

SEQ ID NO: 844251 - DNA, 22 bp, Artificial Sequence
  chemically synthesized
cactaataaaatattgtcccat

SEQ ID NO: 844252 - DNA, 22 bp, Artificial Sequence
  chemically synthesized
ataaaatattgtcccattttat

SEQ ID NO: 844253 - DNA, 22 bp, Artificial Sequence
  chemically synthesized
tatgtacccagacaggataaaa

SEQ ID NO: 844254 - DNA, 22 bp, Artificial Sequence
  chemically synthesized
aggttatatgtacccagacagg

SEQ ID NO: 844255 - DNA, 22 bp, Artificial Sequence
  chemically synthesized
tcccattttatcctgtctgggt

SEQ ID NO: 844256 - DNA, 22 bp, Artificial Sequence
  chemically synthesized
tatcctgtctgggtacatataa

SEQ ID NO: 844257 - DNA, 22 bp, Artificial Sequence
  chemically synthesized
atcctgtctgggtacatataac

SEQ ID NO: 844258 - DNA, 22 bp, Artificial Sequence
  chemically synthesized
tcctgtctgggtacatataacc

SEQ ID NO: 844259 - DNA, 22 bp, Artificial Sequence
  chemically synthesized
gtcagggcctgaggttatatgt

SEQ ID NO: 844260 - DNA, 22 bp, Artificial Sequence
  chemically synthesized
tctgggtacatataacctcagg

SEQ ID NO: 844261 - DNA, 22 bp, Artificial Sequence
  chemically synthesized
ggtacatataacctcaggccct

SEQ ID NO: 844262 - DNA, 22 bp, Artificial Sequence
  chemically synthesized
ggaggacaaaagtgagtgtatt

SEQ ID NO: 844263 - DNA, 22 bp, Artificial Sequence
  chemically synthesized
aggccctgactaatacactcac

SEQ ID NO: 844264 - DNA, 22 bp, Artificial Sequence
  chemically synthesized
gggtctaggaggacaaaagtga

SEQ ID NO: 844265 - DNA, 22 bp, Artificial Sequence
  chemically synthesized
agggtctaggaggacaaaagtg

SEQ ID NO: 844266 - DNA, 22 bp, Artificial Sequence
  chemically synthesized
actaatacactcacttttgtcc

SEQ ID NO: 844267 - DNA, 22 bp, Artificial Sequence
  chemically synthesized
atacactcacttttgtcctcct

SEQ ID NO: 844268 - DNA, 22 bp, Artificial Sequence
  chemically synthesized
atgagaggtttagggtctagga

SEQ ID NO: 844269 - DNA, 22 bp, Artificial Sequence
  chemically synthesized
acttttgtcctcctagacccta

SEQ ID NO: 844270 - DNA, 22 bp, Artificial Sequence
  chemically synthesized
ttgtcctcctagaccctaaacc

SEQ ID NO: 844271 - DNA, 22 bp, Artificial Sequence
  chemically synthesized
tgtcctcctagaccctaaacct

SEQ ID NO: 844272 - DNA, 22 bp, Artificial Sequence
  chemically synthesized
gtcctcctagaccctaaacctc

SEQ ID NO: 844273 - DNA, 22 bp, Artificial Sequence
  chemically synthesized
aagagctgatgagaggtttagg

SEQ ID NO: 844274 - DNA, 22 bp, Artificial Sequence
  chemically synthesized
tcctcctagaccctaaacctct

SEQ ID NO: 844275 - DNA, 22 bp, Artificial Sequence
  chemically synthesized
ctagaccctaaacctctcatca

SEQ ID NO: 844276 - DNA, 22 bp, Artificial Sequence
  chemically synthesized
gaccctaaacctctcatcagct

SEQ ID NO: 844277 - DNA, 22 bp, Artificial Sequence
  chemically synthesized
catggaactgaagagctgatga

SEQ ID NO: 844278 - DNA, 22 bp, Artificial Sequence
  chemically synthesized
aacctctcatcagctcttcagt

SEQ ID NO: 844279 - DNA, 22 bp, Artificial Sequence
  chemically synthesized
tcatcagctcttcagttccatg

SEQ ID NO: 844280 - DNA, 22 bp, Artificial Sequence
  chemically synthesized
atcagctcttcagttccatgta

SEQ ID NO: 844281 - DNA, 22 bp, Artificial Sequence
  chemically synthesized
ttcagttccatgtaacgtgatg

SEQ ID NO: 844282 - DNA, 22 bp, Artificial Sequence
  chemically synthesized
cagttccatgtaacgtgatggt

SEQ ID NO: 844283 - DNA, 22 bp, Artificial Sequence
  chemically synthesized
agttccatgtaacgtgatggtt

SEQ ID NO: 844284 - DNA, 22 bp, Artificial Sequence
  chemically synthesized
catgtaacgtgatggttccatg

SEQ ID NO: 844285 - DNA, 22 bp, Artificial Sequence
  chemically synthesized
aggtagtagtgtcatggaacca

SEQ ID NO: 844286 - DNA, 22 bp, Artificial Sequence
  chemically synthesized
cacattcaggtagtagtgtcat

SEQ ID NO: 844287 - DNA, 22 bp, Artificial Sequence
  chemically synthesized
acagttacacattcaggtagta

SEQ ID NO: 844288 - DNA, 22 bp, Artificial Sequence
  chemically synthesized
catgacactactacctgaatgt

SEQ ID NO: 844289 - DNA, 22 bp, Artificial Sequence
  chemically synthesized
aataattgacagttacacattc

SEQ ID NO: 844290 - DNA, 22 bp, Artificial Sequence
  chemically synthesized
ctacctgaatgtgtaactgtca

SEQ ID NO: 844291 - DNA, 22 bp, Artificial Sequence
  chemically synthesized
atattcaataattgacagttac

SEQ ID NO: 844292 - DNA, 22 bp, Artificial Sequence
  chemically synthesized
cctgaatgtgtaactgtcaatt

SEQ ID NO: 844293 - DNA, 22 bp, Artificial Sequence
  chemically synthesized
attaatattcaataattgacag

SEQ ID NO: 844294 - DNA, 22 bp, Artificial Sequence
  chemically synthesized
aatgtgtaactgtcaattattg

SEQ ID NO: 844295 - DNA, 22 bp, Artificial Sequence
  chemically synthesized
ctaattaatattcaataattga

SEQ ID NO: 844296 - DNA, 22 bp, Artificial Sequence
  chemically synthesized
tgttactaattaatattcaata

SEQ ID NO: 844297 - DNA, 22 bp, Artificial Sequence
  chemically synthesized
tcaattattgaatattaattag

SEQ ID NO: 844298 - DNA, 22 bp, Artificial Sequence
  chemically synthesized
ttgaatattaattagtaacata

SEQ ID NO: 844299 - DNA, 22 bp, Artificial Sequence
  chemically synthesized
aatattaattagtaacataggt

SEQ ID NO: 844300 - DNA, 22 bp, Artificial Sequence
  chemically synthesized
attagtaacataggtttcttca

SEQ ID NO: 844301 - DNA, 22 bp, Artificial Sequence
  chemically synthesized
gtaacataggtttcttcatgcc

SEQ ID NO: 844302 - DNA, 22 bp, Artificial Sequence
  chemically synthesized
agaggccagcccatgggaggca

SEQ ID NO: 844303 - DNA, 22 bp, Artificial Sequence
  chemically synthesized
aagaggccagcccatgggaggc

SEQ ID NO: 844304 - DNA, 22 bp, Artificial Sequence
  chemically synthesized
cttcatgcctcccatgggctgg

SEQ ID NO: 844305 - DNA, 22 bp, Artificial Sequence
  chemically synthesized
catcttaagaggccagcccatg

SEQ ID NO: 844306 - DNA, 22 bp, Artificial Sequence
  chemically synthesized
ttcatgcctcccatgggctggc

SEQ ID NO: 844307 - DNA, 22 bp, Artificial Sequence
  chemically synthesized
catgcctcccatgggctggcct

SEQ ID NO: 844308 - DNA, 22 bp, Artificial Sequence
  chemically synthesized
atgcctcccatgggctggcctc

SEQ ID NO: 844309 - DNA, 22 bp, Artificial Sequence
  chemically synthesized
aattgcatcttaagaggccagc

SEQ ID NO: 844310 - DNA, 22 bp, Artificial Sequence
  chemically synthesized
gaattgcatcttaagaggccag

SEQ ID NO: 844311 - DNA, 22 bp, Artificial Sequence
  chemically synthesized
cttgaattgcatcttaagaggc

SEQ ID NO: 844312 - DNA, 22 bp, Artificial Sequence
  chemically synthesized
acttgaattgcatcttaagagg

SEQ ID NO: 844313 - DNA, 22 bp, Artificial Sequence
  chemically synthesized
ccatgggctggcctcttaagat

SEQ ID NO: 844314 - DNA, 22 bp, Artificial Sequence
  chemically synthesized
gcctcttaagatgcaattcaag

SEQ ID NO: 844315 - DNA, 22 bp, Artificial Sequence
  chemically synthesized
ttaagatgcaattcaagtaaat

SEQ ID NO: 844316 - DNA, 22 bp, Artificial Sequence
  chemically synthesized
aagatgcaattcaagtaaatat

SEQ ID NO: 844317 - DNA, 22 bp, Artificial Sequence
  chemically synthesized
agatgcaattcaagtaaatatg

SEQ ID NO: 844318 - DNA, 22 bp, Artificial Sequence
  chemically synthesized
aagtaaatatgtatttttacat

SEQ ID NO: 844319 - DNA, 22 bp, Artificial Sequence
  chemically synthesized
aatagaggtagtatgtaaaaat

SEQ ID NO: 844320 - DNA, 22 bp, Artificial Sequence
  chemically synthesized
taaatagaggtagtatgtaaaa

SEQ ID NO: 844321 - DNA, 22 bp, Artificial Sequence
  chemically synthesized
ctaaatagaggtagtatgtaaa

SEQ ID NO: 844322 - DNA, 22 bp, Artificial Sequence
  chemically synthesized
gtgatttctaaatagaggtagt

SEQ ID NO: 844323 - DNA, 22 bp, Artificial Sequence
  chemically synthesized
agtgatttctaaatagaggtag

SEQ ID NO: 844324 - DNA, 22 bp, Artificial Sequence
  chemically synthesized
ccttagtgatttctaaatagag

SEQ ID NO: 844325 - DNA, 22 bp, Artificial Sequence
  chemically synthesized
ttacatactacctctatttaga

SEQ ID NO: 844326 - DNA, 22 bp, Artificial Sequence
  chemically synthesized
tacatactacctctatttagaa

SEQ ID NO: 844327 - DNA, 22 bp, Artificial Sequence
  chemically synthesized
acatactacctctatttagaaa

SEQ ID NO: 844328 - DNA, 22 bp, Artificial Sequence
  chemically synthesized
catactacctctatttagaaat

SEQ ID NO: 844329 - DNA, 22 bp, Artificial Sequence
  chemically synthesized
cctctatttagaaatcactaag

SEQ ID NO: 844330 - DNA, 22 bp, Artificial Sequence
  chemically synthesized
tatttagaaatcactaaggtag

SEQ ID NO: 844331 - DNA, 22 bp, Artificial Sequence
  chemically synthesized
tttagaaatcactaaggtaggg

SEQ ID NO: 844332 - DNA, 22 bp, Artificial Sequence
  chemically synthesized
agaaatcactaaggtagggtgc

SEQ ID NO: 844333 - DNA, 22 bp, Artificial Sequence
  chemically synthesized
gaaatcactaaggtagggtgca

SEQ ID NO: 844334 - DNA, 22 bp, Artificial Sequence
  chemically synthesized
gaaataatggtcatgcacccta

SEQ ID NO: 844335 - DNA, 22 bp, Artificial Sequence
  chemically synthesized
ggaaataatggtcatgcaccct

SEQ ID NO: 844336 - DNA, 22 bp, Artificial Sequence
  chemically synthesized
cttggaaataatggtcatgcac

SEQ ID NO: 844337 - DNA, 22 bp, Artificial Sequence
  chemically synthesized
aggtagggtgcatgaccattat

SEQ ID NO: 844338 - DNA, 22 bp, Artificial Sequence
  chemically synthesized
cgctccttggaaataatggtca

SEQ ID NO: 844339 - DNA, 22 bp, Artificial Sequence
  chemically synthesized
tgcgctccttggaaataatggt

SEQ ID NO: 844340 - DNA, 22 bp, Artificial Sequence
  chemically synthesized
aattctgcgctccttggaaata

SEQ ID NO: 844341 - DNA, 22 bp, Artificial Sequence
  chemically synthesized
cagttaaattctgcgctccttg

SEQ ID NO: 844342 - DNA, 22 bp, Artificial Sequence
  chemically synthesized
ctccagttaaattctgcgctcc

SEQ ID NO: 844343 - DNA, 22 bp, Artificial Sequence
  chemically synthesized
cctccagttaaattctgcgctc

SEQ ID NO: 844344 - DNA, 22 bp, Artificial Sequence
  chemically synthesized
tcctccagttaaattctgcgct

SEQ ID NO: 844345 - DNA, 22 bp, Artificial Sequence
  chemically synthesized
tttccaaggagcgcagaattta

SEQ ID NO: 844346 - DNA, 22 bp, Artificial Sequence
  chemically synthesized
ttttcctccagttaaattctgc

SEQ ID NO: 844347 - DNA, 22 bp, Artificial Sequence
  chemically synthesized
attttcctccagttaaattctg

SEQ ID NO: 844348 - DNA, 22 bp, Artificial Sequence
  chemically synthesized
ccaaggagcgcagaatttaact

SEQ ID NO: 844349 - DNA, 22 bp, Artificial Sequence
  chemically synthesized
ttattttcctccagttaaattc

SEQ ID NO: 844350 - DNA, 22 bp, Artificial Sequence
  chemically synthesized
caaggagcgcagaatttaactg

SEQ ID NO: 844351 - DNA, 22 bp, Artificial Sequence
  chemically synthesized
aatactcttattttcctccagt

SEQ ID NO: 844352 - DNA, 22 bp, Artificial Sequence
  chemically synthesized
aactggaggaaaataagagtat

SEQ ID NO: 844353 - DNA, 22 bp, Artificial Sequence
  chemically synthesized
actggaggaaaataagagtatt

SEQ ID NO: 844354 - DNA, 22 bp, Artificial Sequence
  chemically synthesized
gaggaaaataagagtattcaga

SEQ ID NO: 844355 - DNA, 22 bp, Artificial Sequence
  chemically synthesized
ccatgtaacacatctgaatact

SEQ ID NO: 844356 - DNA, 22 bp, Artificial Sequence
  chemically synthesized
caccattaccatgtaacacatc

SEQ ID NO: 844357 - DNA, 22 bp, Artificial Sequence
  chemically synthesized
aatggaactccaccattaccat

SEQ ID NO: 844358 - DNA, 22 bp, Artificial Sequence
  chemically synthesized
agatgtgttacatggtaatggt

SEQ ID NO: 844359 - DNA, 22 bp, Artificial Sequence
  chemically synthesized
catgtgttgaatggaactccac

SEQ ID NO: 844360 - DNA, 22 bp, Artificial Sequence
  chemically synthesized
catggtaatggtggagttccat

SEQ ID NO: 844361 - DNA, 22 bp, Artificial Sequence
  chemically synthesized
agctgcatgtgttgaatggaac

SEQ ID NO: 844362 - DNA, 22 bp, Artificial Sequence
  chemically synthesized
gagctgcatgtgttgaatggaa

SEQ ID NO: 844363 - DNA, 22 bp, Artificial Sequence
  chemically synthesized
ttgagctgcatgtgttgaatgg

SEQ ID NO: 844364 - DNA, 22 bp, Artificial Sequence
  chemically synthesized
cagttcttgagctgcatgtgtt

SEQ ID NO: 844365 - DNA, 22 bp, Artificial Sequence
  chemically synthesized
ctacagttcttgagctgcatgt

SEQ ID NO: 844366 - DNA, 22 bp, Artificial Sequence
  chemically synthesized
cctacagttcttgagctgcatg

SEQ ID NO: 844367 - DNA, 22 bp, Artificial Sequence
  chemically synthesized
cattcaacacatgcagctcaag

SEQ ID NO: 844368 - DNA, 22 bp, Artificial Sequence
  chemically synthesized
gtttcctacagttcttgagctg

SEQ ID NO: 844369 - DNA, 22 bp, Artificial Sequence
  chemically synthesized
agtttcctacagttcttgagct

SEQ ID NO: 844370 - DNA, 22 bp, Artificial Sequence
  chemically synthesized
tagtttcctacagttcttgagc

SEQ ID NO: 844371 - DNA, 22 bp, Artificial Sequence
  chemically synthesized
aacacatgcagctcaagaactg

SEQ ID NO: 844372 - DNA, 22 bp, Artificial Sequence
  chemically synthesized
ctttagtttcctacagttcttg

SEQ ID NO: 844373 - DNA, 22 bp, Artificial Sequence
  chemically synthesized
gctttagtttcctacagttctt

SEQ ID NO: 844374 - DNA, 22 bp, Artificial Sequence
  chemically synthesized
gtggcttgctttagtttcctac

SEQ ID NO: 844375 - DNA, 22 bp, Artificial Sequence
  chemically synthesized
ctggtggcttgctttagtttcc

SEQ ID NO: 844376 - DNA, 22 bp, Artificial Sequence
  chemically synthesized
aagaactgtaggaaactaaagc

SEQ ID NO: 844377 - DNA, 22 bp, Artificial Sequence
  chemically synthesized
aggattcctggtggcttgcttt

SEQ ID NO: 844378 - DNA, 22 bp, Artificial Sequence
  chemically synthesized
taggaaactaaagcaagccacc

SEQ ID NO: 844379 - DNA, 22 bp, Artificial Sequence
  chemically synthesized
ttaaggattcctggtggcttgc

SEQ ID NO: 844380 - DNA, 22 bp, Artificial Sequence
  chemically synthesized
tctgttaaggattcctggtggc

SEQ ID NO: 844381 - DNA, 22 bp, Artificial Sequence
  chemically synthesized
ttatctgttaaggattcctggt

SEQ ID NO: 844382 - DNA, 22 bp, Artificial Sequence
  chemically synthesized
aagcaagccaccaggaatcctt

SEQ ID NO: 844383 - DNA, 22 bp, Artificial Sequence
  chemically synthesized
gtggttgttatctgttaaggat

SEQ ID NO: 844384 - DNA, 22 bp, Artificial Sequence
  chemically synthesized
cagcaaacctagtggttgttat

SEQ ID NO: 844385 - DNA, 22 bp, Artificial Sequence
  chemically synthesized
gcagcaaacctagtggttgtta

SEQ ID NO: 844386 - DNA, 22 bp, Artificial Sequence
  chemically synthesized
ttgcagcaaacctagtggttgt

SEQ ID NO: 844387 - DNA, 22 bp, Artificial Sequence
  chemically synthesized
aacagataacaaccactaggtt

SEQ ID NO: 844388 - DNA, 22 bp, Artificial Sequence
  chemically synthesized
acagataacaaccactaggttt

SEQ ID NO: 844389 - DNA, 22 bp, Artificial Sequence
  chemically synthesized
ccatctcttgcagcaaacctag

SEQ ID NO: 844390 - DNA, 22 bp, Artificial Sequence
  chemically synthesized
gccatctcttgcagcaaaccta

SEQ ID NO: 844391 - DNA, 22 bp, Artificial Sequence
  chemically synthesized
tgccatctcttgcagcaaacct

SEQ ID NO: 844392 - DNA, 22 bp, Artificial Sequence
  chemically synthesized
ttgccatctcttgcagcaaacc

SEQ ID NO: 844393 - DNA, 22 bp, Artificial Sequence
  chemically synthesized
cttttgccatctcttgcagcaa

SEQ ID NO: 844394 - DNA, 22 bp, Artificial Sequence
  chemically synthesized
ggtttgctgcaagagatggcaa

SEQ ID NO: 844395 - DNA, 22 bp, Artificial Sequence
  chemically synthesized
ccccaaagttccttttgccatc

SEQ ID NO: 844396 - DNA, 22 bp, Artificial Sequence
  chemically synthesized
gccccaaagttccttttgccat

SEQ ID NO: 844397 - DNA, 22 bp, Artificial Sequence
  chemically synthesized
gctgcaagagatggcaaaagga

SEQ ID NO: 844398 - DNA, 22 bp, Artificial Sequence
  chemically synthesized
ctgcaagagatggcaaaaggaa

SEQ ID NO: 844399 - DNA, 22 bp, Artificial Sequence
  chemically synthesized
caagagatggcaaaaggaactt

SEQ ID NO: 844400 - DNA, 22 bp, Artificial Sequence
  chemically synthesized
aaaacttgccccaaagttcctt

SEQ ID NO: 844401 - DNA, 22 bp, Artificial Sequence
  chemically synthesized
cgtcatctgaaaacttgcccca

SEQ ID NO: 844402 - DNA, 22 bp, Artificial Sequence
  chemically synthesized
ccgtcatctgaaaacttgcccc

SEQ ID NO: 844403 - DNA, 22 bp, Artificial Sequence
  chemically synthesized
tcttccgtcatctgaaaacttg

SEQ ID NO: 844404 - DNA, 22 bp, Artificial Sequence
  chemically synthesized
tgtcttccgtcatctgaaaact

SEQ ID NO: 844405 - DNA, 22 bp, Artificial Sequence
  chemically synthesized
ctgtcttccgtcatctgaaaac

SEQ ID NO: 844406 - DNA, 22 bp, Artificial Sequence
  chemically synthesized
tctgtcttccgtcatctgaaaa

SEQ ID NO: 844407 - DNA, 22 bp, Artificial Sequence
  chemically synthesized
tggggcaagttttcagatgacg

SEQ ID NO: 844408 - DNA, 22 bp, Artificial Sequence
  chemically synthesized
ggggcaagttttcagatgacgg

SEQ ID NO: 844409 - DNA, 22 bp, Artificial Sequence
  chemically synthesized
actttctgtcttccgtcatctg

SEQ ID NO: 844410 - DNA, 22 bp, Artificial Sequence
  chemically synthesized
gggcaagttttcagatgacgga

SEQ ID NO: 844411 - DNA, 22 bp, Artificial Sequence
  chemically synthesized
aactttctgtcttccgtcatct

SEQ ID NO: 844412 - DNA, 22 bp, Artificial Sequence
  chemically synthesized
tcagatgacggaagacagaaag

SEQ ID NO: 844413 - DNA, 22 bp, Artificial Sequence
  chemically synthesized
cagatgacggaagacagaaagt

SEQ ID NO: 844414 - DNA, 22 bp, Artificial Sequence
  chemically synthesized
agatgacggaagacagaaagtt

SEQ ID NO: 844415 - DNA, 22 bp, Artificial Sequence
  chemically synthesized
agagaggtggaataatcttaac

SEQ ID NO: 844416 - DNA, 22 bp, Artificial Sequence
  chemically synthesized
actcagagaggtggaataatct

SEQ ID NO: 844417 - DNA, 22 bp, Artificial Sequence
  chemically synthesized
tcactcagagaggtggaataat

SEQ ID NO: 844418 - DNA, 22 bp, Artificial Sequence
  chemically synthesized
ctcactcagagaggtggaataa

SEQ ID NO: 844419 - DNA, 22 bp, Artificial Sequence
  chemically synthesized
gggcacttctcactcagagagg

SEQ ID NO: 844420 - DNA, 22 bp, Artificial Sequence
  chemically synthesized
agattattccacctctctgagt

SEQ ID NO: 844421 - DNA, 22 bp, Artificial Sequence
  chemically synthesized
cctagggcacttctcactcaga

SEQ ID NO: 844422 - DNA, 22 bp, Artificial Sequence
  chemically synthesized
ttccacctctctgagtgagaag

SEQ ID NO: 844423 - DNA, 22 bp, Artificial Sequence
  chemically synthesized
tctacctagggcacttctcact

SEQ ID NO: 844424 - DNA, 22 bp, Artificial Sequence
  chemically synthesized
gtctacctagggcacttctcac

SEQ ID NO: 844425 - DNA, 22 bp, Artificial Sequence
  chemically synthesized
cacctctctgagtgagaagtgc

SEQ ID NO: 844426 - DNA, 22 bp, Artificial Sequence
  chemically synthesized
tgtctacctagggcacttctca

SEQ ID NO: 844427 - DNA, 22 bp, Artificial Sequence
  chemically synthesized
tctgagtgagaagtgccctagg

SEQ ID NO: 844428 - DNA, 22 bp, Artificial Sequence
  chemically synthesized
aggtctttgtctacctagggca

SEQ ID NO: 844429 - DNA, 22 bp, Artificial Sequence
  chemically synthesized
tgagtgagaagtgccctaggta

SEQ ID NO: 844430 - DNA, 22 bp, Artificial Sequence
  chemically synthesized
agtgagaagtgccctaggtaga

SEQ ID NO: 844431 - DNA, 22 bp, Artificial Sequence
  chemically synthesized
gttgaggtctttgtctacctag

SEQ ID NO: 844432 - DNA, 22 bp, Artificial Sequence
  chemically synthesized
gtcctggttgaggtctttgtct

SEQ ID NO: 844433 - DNA, 22 bp, Artificial Sequence
  chemically synthesized
ggtagacaaagacctcaaccag

SEQ ID NO: 844434 - DNA, 22 bp, Artificial Sequence
  chemically synthesized
aagaagctggtcctggttgagg

SEQ ID NO: 844435 - DNA, 22 bp, Artificial Sequence
  chemically synthesized
tacgttcaagaagctggtcctg

SEQ ID NO: 844436 - DNA, 22 bp, Artificial Sequence
  chemically synthesized
aaccaggaccagcttcttgaac

SEQ ID NO: 844437 - DNA, 22 bp, Artificial Sequence
  chemically synthesized
cacaagttatacgttcaagaag

SEQ ID NO: 844438 - DNA, 22 bp, Artificial Sequence
  chemically synthesized
actgcacaagttatacgttcaa

SEQ ID NO: 844439 - DNA, 22 bp, Artificial Sequence
  chemically synthesized
tgtaactaactgcacaagttat

SEQ ID NO: 844440 - DNA, 22 bp, Artificial Sequence
  chemically synthesized
gtgtaactaactgcacaagtta

SEQ ID NO: 844441 - DNA, 22 bp, Artificial Sequence
  chemically synthesized
cttgaacgtataacttgtgcag

SEQ ID NO: 844442 - DNA, 22 bp, Artificial Sequence
  chemically synthesized
ttgaacgtataacttgtgcagt

SEQ ID NO: 844443 - DNA, 22 bp, Artificial Sequence
  chemically synthesized
gaacgtataacttgtgcagtta

SEQ ID NO: 844444 - DNA, 22 bp, Artificial Sequence
  chemically synthesized
aacgtataacttgtgcagttag

SEQ ID NO: 844445 - DNA, 22 bp, Artificial Sequence
  chemically synthesized
atgcagatccttgtgtaactaa

SEQ ID NO: 844446 - DNA, 22 bp, Artificial Sequence
  chemically synthesized
taatgcagatccttgtgtaact

SEQ ID NO: 844447 - DNA, 22 bp, Artificial Sequence
  chemically synthesized
ctaatgcagatccttgtgtaac

SEQ ID NO: 844448 - DNA, 22 bp, Artificial Sequence
  chemically synthesized
gtgcagttagttacacaaggat

SEQ ID NO: 844449 - DNA, 22 bp, Artificial Sequence
  chemically synthesized
tgcagttagttacacaaggatc

SEQ ID NO: 844450 - DNA, 22 bp, Artificial Sequence
  chemically synthesized
gttacacaaggatctgcattag

SEQ ID NO: 844451 - DNA, 22 bp, Artificial Sequence
  chemically synthesized
cacaaggatctgcattagaagg

SEQ ID NO: 844452 - DNA, 22 bp, Artificial Sequence
  chemically synthesized
cattagaagggattcatacttg

SEQ ID NO: 844453 - DNA, 22 bp, Artificial Sequence
  chemically synthesized
gaagggattcatacttggtttc

SEQ ID NO: 844454 - DNA, 22 bp, Artificial Sequence
  chemically synthesized
aagatggcaacagtagagcatg

SEQ ID NO: 844455 - DNA, 22 bp, Artificial Sequence
  chemically synthesized
atacttggtttcatgctctact

SEQ ID NO: 844456 - DNA, 22 bp, Artificial Sequence
  chemically synthesized
caagatggcaacagtagagcat

SEQ ID NO: 844457 - DNA, 22 bp, Artificial Sequence
  chemically synthesized
ggtttcatgctctactgttgcc

SEQ ID NO: 844458 - DNA, 22 bp, Artificial Sequence
  chemically synthesized
gtttcatgctctactgttgcca

SEQ ID NO: 844459 - DNA, 22 bp, Artificial Sequence
  chemically synthesized
agaatttcaagatggcaacagt

SEQ ID NO: 844460 - DNA, 22 bp, Artificial Sequence
  chemically synthesized
catgctctactgttgccatctt

SEQ ID NO: 844461 - DNA, 22 bp, Artificial Sequence
  chemically synthesized
atgctctactgttgccatcttg

SEQ ID NO: 844462 - DNA, 22 bp, Artificial Sequence
  chemically synthesized
tactgttgccatcttgaaattc

SEQ ID NO: 844463 - DNA, 22 bp, Artificial Sequence
  chemically synthesized
aaaaaaaattaagaatttcaag

SEQ ID NO: 844464 - DNA, 22 bp, Artificial Sequence
  chemically synthesized
ctgttgccatcttgaaattctt

SEQ ID NO: 844465 - DNA, 22 bp, Artificial Sequence
  chemically synthesized
gttaaaaaaaaattaagaattt

SEQ ID NO: 844466 - DNA, 22 bp, Artificial Sequence
  chemically synthesized
ttgccatcttgaaattcttaat

SEQ ID NO: 844467 - DNA, 22 bp, Artificial Sequence
  chemically synthesized
ggttaaaaaaaaattaagaatt

SEQ ID NO: 844468 - DNA, 22 bp, Artificial Sequence
  chemically synthesized
ccatcttgaaattcttaatttt

SEQ ID NO: 844469 - DNA, 22 bp, Artificial Sequence
  chemically synthesized
gaaattcttaatttttttttaa

SEQ ID NO: 844470 - DNA, 22 bp, Artificial Sequence
  chemically synthesized
aaattcttaatttttttttaac

SEQ ID NO: 844471 - DNA, 22 bp, Artificial Sequence
  chemically synthesized
ttaatttttttttaaccaaggg

SEQ ID NO: 844472 - DNA, 22 bp, Artificial Sequence
  chemically synthesized
aatttttttttaaccaagggcc

SEQ ID NO: 844473 - DNA, 22 bp, Artificial Sequence
  chemically synthesized
atttttttttaaccaagggccc

SEQ ID NO: 844474 - DNA, 22 bp, Artificial Sequence
  chemically synthesized
ttttttaaccaagggccctgcg

SEQ ID NO: 844475 - DNA, 22 bp, Artificial Sequence
  chemically synthesized
tttttaaccaagggccctgcgt

SEQ ID NO: 844476 - DNA, 22 bp, Artificial Sequence
  chemically synthesized
ttttaaccaagggccctgcgtt

SEQ ID NO: 844477 - DNA, 22 bp, Artificial Sequence
  chemically synthesized
tttaaccaagggccctgcgttt

SEQ ID NO: 844478 - DNA, 22 bp, Artificial Sequence
  chemically synthesized
ttaaccaagggccctgcgtttt

SEQ ID NO: 844479 - DNA, 22 bp, Artificial Sequence
  chemically synthesized
taaccaagggccctgcgttttc

SEQ ID NO: 844480 - DNA, 22 bp, Artificial Sequence
  chemically synthesized
aaccaagggccctgcgttttca

SEQ ID NO: 844481 - DNA, 22 bp, Artificial Sequence
  chemically synthesized
accaagggccctgcgttttcat

SEQ ID NO: 844482 - DNA, 22 bp, Artificial Sequence
  chemically synthesized
tagagcccagtgaaaaatgaaa

SEQ ID NO: 844483 - DNA, 22 bp, Artificial Sequence
  chemically synthesized
cgttttcatttttcactgggct

SEQ ID NO: 844484 - DNA, 22 bp, Artificial Sequence
  chemically synthesized
tcatttttcactgggctctaca

SEQ ID NO: 844485 - DNA, 22 bp, Artificial Sequence
  chemically synthesized
catttttcactgggctctacag

SEQ ID NO: 844486 - DNA, 22 bp, Artificial Sequence
  chemically synthesized
atttttcactgggctctacaga

SEQ ID NO: 844487 - DNA, 22 bp, Artificial Sequence
  chemically synthesized
ttcactgggctctacagattac

SEQ ID NO: 844488 - DNA, 22 bp, Artificial Sequence
  chemically synthesized
tcactgggctctacagattacg

SEQ ID NO: 844489 - DNA, 22 bp, Artificial Sequence
  chemically synthesized
cactgggctctacagattacgt

SEQ ID NO: 844490 - DNA, 22 bp, Artificial Sequence
  chemically synthesized
actgggctctacagattacgta

SEQ ID NO: 844491 - DNA, 22 bp, Artificial Sequence
  chemically synthesized
aggtcacaatcaggtacgtaat

SEQ ID NO: 844492 - DNA, 22 bp, Artificial Sequence
  chemically synthesized
ggctctacagattacgtacctg

SEQ ID NO: 844493 - DNA, 22 bp, Artificial Sequence
  chemically synthesized
gggttgaggtcacaatcaggta

SEQ ID NO: 844494 - DNA, 22 bp, Artificial Sequence
  chemically synthesized
tacagattacgtacctgattgt

SEQ ID NO: 844495 - DNA, 22 bp, Artificial Sequence
  chemically synthesized
agggttgaggtcacaatcaggt

SEQ ID NO: 844496 - DNA, 22 bp, Artificial Sequence
  chemically synthesized
cagattacgtacctgattgtga

SEQ ID NO: 844497 - DNA, 22 bp, Artificial Sequence
  chemically synthesized
accttagggttgaggtcacaat

SEQ ID NO: 844498 - DNA, 22 bp, Artificial Sequence
  chemically synthesized
cgtacctgattgtgacctcaac

SEQ ID NO: 844499 - DNA, 22 bp, Artificial Sequence
  chemically synthesized
cactaaccttagggttgaggtc

SEQ ID NO: 844500 - DNA, 22 bp, Artificial Sequence
  chemically synthesized
tccactaaccttagggttgagg

SEQ ID NO: 844501 - DNA, 22 bp, Artificial Sequence
  chemically synthesized
ttctccactaaccttagggttg

SEQ ID NO: 844502 - DNA, 22 bp, Artificial Sequence
  chemically synthesized
attctccactaaccttagggtt

SEQ ID NO: 844503 - DNA, 22 bp, Artificial Sequence
  chemically synthesized
attgtgacctcaaccctaaggt

SEQ ID NO: 844504 - DNA, 22 bp, Artificial Sequence
  chemically synthesized
tattctccactaaccttagggt

SEQ ID NO: 844505 - DNA, 22 bp, Artificial Sequence
  chemically synthesized
ttattctccactaaccttaggg

SEQ ID NO: 844506 - DNA, 22 bp, Artificial Sequence
  chemically synthesized
tgacctcaaccctaaggttagt

SEQ ID NO: 844507 - DNA, 22 bp, Artificial Sequence
  chemically synthesized
aaccctaaggttagtggagaat

SEQ ID NO: 844508 - DNA, 22 bp, Artificial Sequence
  chemically synthesized
aggttagtggagaataaaagtt

SEQ ID NO: 844509 - DNA, 22 bp, Artificial Sequence
  chemically synthesized
agccaagatacataacttttat

SEQ ID NO: 844510 - DNA, 22 bp, Artificial Sequence
  chemically synthesized
cagccaagatacataactttta

SEQ ID NO: 844511 - DNA, 22 bp, Artificial Sequence
  chemically synthesized
gtggagaataaaagttatgtat

SEQ ID NO: 844512 - DNA, 22 bp, Artificial Sequence
  chemically synthesized
accagtgcttcagccaagatac

SEQ ID NO: 844513 - DNA, 22 bp, Artificial Sequence
  chemically synthesized
tgtatcttggctgaagcactgg

SEQ ID NO: 844514 - DNA, 22 bp, Artificial Sequence
  chemically synthesized
ccatcaacgattaaccagtgct

SEQ ID NO: 844515 - DNA, 22 bp, Artificial Sequence
  chemically synthesized
cccatcaacgattaaccagtgc

SEQ ID NO: 844516 - DNA, 22 bp, Artificial Sequence
  chemically synthesized
ttcccatcaacgattaaccagt

SEQ ID NO: 844517 - DNA, 22 bp, Artificial Sequence
  chemically synthesized
ggctgaagcactggttaatcgt

SEQ ID NO: 844518 - DNA, 22 bp, Artificial Sequence
  chemically synthesized
gctgaagcactggttaatcgtt

SEQ ID NO: 844519 - DNA, 22 bp, Artificial Sequence
  chemically synthesized
aagcactggttaatcgttgatg

SEQ ID NO: 844520 - DNA, 22 bp, Artificial Sequence
  chemically synthesized
aatgtgttcttcccatcaacga

SEQ ID NO: 844521 - DNA, 22 bp, Artificial Sequence
  chemically synthesized
aaatgtgttcttcccatcaacg

SEQ ID NO: 844522 - DNA, 22 bp, Artificial Sequence
  chemically synthesized
tgtttaaatgtgttcttcccat

SEQ ID NO: 844523 - DNA, 22 bp, Artificial Sequence
  chemically synthesized
gttaatcgttgatgggaagaac

SEQ ID NO: 844524 - DNA, 22 bp, Artificial Sequence
  chemically synthesized
gtgtttaaatgtgttcttccca

SEQ ID NO: 844525 - DNA, 22 bp, Artificial Sequence
  chemically synthesized
atcgttgatgggaagaacacat

SEQ ID NO: 844526 - DNA, 22 bp, Artificial Sequence
  chemically synthesized
atttgtgtttaaatgtgttctt

SEQ ID NO: 844527 - DNA, 22 bp, Artificial Sequence
  chemically synthesized
aatttgtgtttaaatgtgttct

SEQ ID NO: 844528 - DNA, 22 bp, Artificial Sequence
  chemically synthesized
atgggaagaacacatttaaaca

SEQ ID NO: 844529 - DNA, 22 bp, Artificial Sequence
  chemically synthesized
acgtcatttaatttgtgtttaa

SEQ ID NO: 844530 - DNA, 22 bp, Artificial Sequence
  chemically synthesized
attgacgtcatttaatttgtgt

SEQ ID NO: 844531 - DNA, 22 bp, Artificial Sequence
  chemically synthesized
gattgacgtcatttaatttgtg

SEQ ID NO: 844532 - DNA, 22 bp, Artificial Sequence
  chemically synthesized
aaacacaaattaaatgacgtca

SEQ ID NO: 844533 - DNA, 22 bp, Artificial Sequence
  chemically synthesized
aacacaaattaaatgacgtcaa

SEQ ID NO: 844534 - DNA, 22 bp, Artificial Sequence
  chemically synthesized
agcaagaggcatttgattgacg

SEQ ID NO: 844535 - DNA, 22 bp, Artificial Sequence
  chemically synthesized
aatgacgtcaatcaaatgcctc

SEQ ID NO: 844536 - DNA, 22 bp, Artificial Sequence
  chemically synthesized
aggaattaagcaagaggcattt

SEQ ID NO: 844537 - DNA, 22 bp, Artificial Sequence
  chemically synthesized
tcaggaattaagcaagaggcat

SEQ ID NO: 844538 - DNA, 22 bp, Artificial Sequence
  chemically synthesized
aaacgcattctcaggaattaag

SEQ ID NO: 844539 - DNA, 22 bp, Artificial Sequence
  chemically synthesized
gaaacgcattctcaggaattaa

SEQ ID NO: 844540 - DNA, 22 bp, Artificial Sequence
  chemically synthesized
ttgcttaattcctgagaatgcg

SEQ ID NO: 844541 - DNA, 22 bp, Artificial Sequence
  chemically synthesized
cagaaatttgaaacgcattctc

SEQ ID NO: 844542 - DNA, 22 bp, Artificial Sequence
  chemically synthesized
gcttaattcctgagaatgcgtt

SEQ ID NO: 844543 - DNA, 22 bp, Artificial Sequence
  chemically synthesized
ccagaaatttgaaacgcattct

SEQ ID NO: 844544 - DNA, 22 bp, Artificial Sequence
  chemically synthesized
cttaattcctgagaatgcgttt

SEQ ID NO: 844545 - DNA, 22 bp, Artificial Sequence
  chemically synthesized
cttccagaaatttgaaacgcat

SEQ ID NO: 844546 - DNA, 22 bp, Artificial Sequence
  chemically synthesized
aattcctgagaatgcgtttcaa

SEQ ID NO: 844547 - DNA, 22 bp, Artificial Sequence
  chemically synthesized
attcctgagaatgcgtttcaaa

SEQ ID NO: 844548 - DNA, 22 bp, Artificial Sequence
  chemically synthesized
ctccttccagaaatttgaaacg

SEQ ID NO: 844549 - DNA, 22 bp, Artificial Sequence
  chemically synthesized
ctgagaatgcgtttcaaatttc

SEQ ID NO: 844550 - DNA, 22 bp, Artificial Sequence
  chemically synthesized
agaatgcgtttcaaatttctgg

SEQ ID NO: 844551 - DNA, 22 bp, Artificial Sequence
  chemically synthesized
ataactgctccttccagaaatt

SEQ ID NO: 844552 - DNA, 22 bp, Artificial Sequence
  chemically synthesized
cataactgctccttccagaaat

SEQ ID NO: 844553 - DNA, 22 bp, Artificial Sequence
  chemically synthesized
gcttcataactgctccttccag

SEQ ID NO: 844554 - DNA, 22 bp, Artificial Sequence
  chemically synthesized
agcttcataactgctccttcca

SEQ ID NO: 844555 - DNA, 22 bp, Artificial Sequence
  chemically synthesized
tagcttcataactgctccttcc

SEQ ID NO: 844556 - DNA, 22 bp, Artificial Sequence
  chemically synthesized
ttagcttcataactgctccttc

SEQ ID NO: 844557 - DNA, 22 bp, Artificial Sequence
  chemically synthesized
tttagcttcataactgctcctt

SEQ ID NO: 844558 - DNA, 22 bp, Artificial Sequence
  chemically synthesized
caaatttctggaaggagcagtt

SEQ ID NO: 844559 - DNA, 22 bp, Artificial Sequence
  chemically synthesized
aaatttctggaaggagcagtta

SEQ ID NO: 844560 - DNA, 22 bp, Artificial Sequence
  chemically synthesized
ctggaaggagcagttatgaagc

SEQ ID NO: 844561 - DNA, 22 bp, Artificial Sequence
  chemically synthesized
tggaaggagcagttatgaagct

SEQ ID NO: 844562 - DNA, 22 bp, Artificial Sequence
  chemically synthesized
gaaggagcagttatgaagctaa

SEQ ID NO: 844563 - DNA, 22 bp, Artificial Sequence
  chemically synthesized
ccccaaaatacattttttagct

SEQ ID NO: 844564 - DNA, 22 bp, Artificial Sequence
  chemically synthesized
cccccaaaatacattttttagc

SEQ ID NO: 844565 - DNA, 22 bp, Artificial Sequence
  chemically synthesized
tgaagctaaaaaatgtattttg

SEQ ID NO: 844566 - DNA, 22 bp, Artificial Sequence
  chemically synthesized
aggccagatttcccccaaaata

SEQ ID NO: 844567 - DNA, 22 bp, Artificial Sequence
  chemically synthesized
ctgaggccagatttcccccaaa

SEQ ID NO: 844568 - DNA, 22 bp, Artificial Sequence
  chemically synthesized
cctgaggccagatttcccccaa

SEQ ID NO: 844569 - DNA, 22 bp, Artificial Sequence
  chemically synthesized
aaaaatgtattttgggggaaat

SEQ ID NO: 844570 - DNA, 22 bp, Artificial Sequence
  chemically synthesized
tcctgaggccagatttccccca

SEQ ID NO: 844571 - DNA, 22 bp, Artificial Sequence
  chemically synthesized
ttcctgaggccagatttccccc

SEQ ID NO: 844572 - DNA, 22 bp, Artificial Sequence
  chemically synthesized
agcttttcctgaggccagattt

SEQ ID NO: 844573 - DNA, 22 bp, Artificial Sequence
  chemically synthesized
ttcagcttttcctgaggccaga

SEQ ID NO: 844574 - DNA, 22 bp, Artificial Sequence
  chemically synthesized
tgggggaaatctggcctcagga

SEQ ID NO: 844575 - DNA, 22 bp, Artificial Sequence
  chemically synthesized
gggggaaatctggcctcaggaa

SEQ ID NO: 844576 - DNA, 22 bp, Artificial Sequence
  chemically synthesized
ggggaaatctggcctcaggaaa

SEQ ID NO: 844577 - DNA, 22 bp, Artificial Sequence
  chemically synthesized
tcctgttcagcttttcctgagg

SEQ ID NO: 844578 - DNA, 22 bp, Artificial Sequence
  chemically synthesized
actgtcctgttcagcttttcct

SEQ ID NO: 844579 - DNA, 22 bp, Artificial Sequence
  chemically synthesized
taactgtcctgttcagcttttc

SEQ ID NO: 844580 - DNA, 22 bp, Artificial Sequence
  chemically synthesized
ctaactgtcctgttcagctttt

SEQ ID NO: 844581 - DNA, 22 bp, Artificial Sequence
  chemically synthesized
gcctcaggaaaagctgaacagg

SEQ ID NO: 844582 - DNA, 22 bp, Artificial Sequence
  chemically synthesized
aggaaaagctgaacaggacagt

SEQ ID NO: 844583 - DNA, 22 bp, Artificial Sequence
  chemically synthesized
gaaccacttctaactgtcctgt

SEQ ID NO: 844584 - DNA, 22 bp, Artificial Sequence
  chemically synthesized
ggaaccacttctaactgtcctg

SEQ ID NO: 844585 - DNA, 22 bp, Artificial Sequence
  chemically synthesized
aacaggacagttagaagtggtt

SEQ ID NO: 844586 - DNA, 22 bp, Artificial Sequence
  chemically synthesized
atagtgatgacagtcccacctt

SEQ ID NO: 844587 - DNA, 22 bp, Artificial Sequence
  chemically synthesized
gaagtggttccaaggtgggact

SEQ ID NO: 844588 - DNA, 22 bp, Artificial Sequence
  chemically synthesized
caaggtgggactgtcatcacta

SEQ ID NO: 844589 - DNA, 22 bp, Artificial Sequence
  chemically synthesized
caataaccattgatagtgatga

SEQ ID NO: 844590 - DNA, 22 bp, Artificial Sequence
  chemically synthesized
tccaataaccattgatagtgat

SEQ ID NO: 844591 - DNA, 22 bp, Artificial Sequence
  chemically synthesized
ttctccaataaccattgatagt

SEQ ID NO: 844592 - DNA, 22 bp, Artificial Sequence
  chemically synthesized
gttctccaataaccattgatag

SEQ ID NO: 844593 - DNA, 22 bp, Artificial Sequence
  chemically synthesized
tgttctccaataaccattgata

SEQ ID NO: 844594 - DNA, 22 bp, Artificial Sequence
  chemically synthesized
ttgttctccaataaccattgat

SEQ ID NO: 844595 - DNA, 22 bp, Artificial Sequence
  chemically synthesized
tcatcactatcaatggttattg

SEQ ID NO: 844596 - DNA, 22 bp, Artificial Sequence
  chemically synthesized
tagtgacttttgttctccaata

SEQ ID NO: 844597 - DNA, 22 bp, Artificial Sequence
  chemically synthesized
ctatagtgacttttgttctcca

SEQ ID NO: 844598 - DNA, 22 bp, Artificial Sequence
  chemically synthesized
tcaatggttattggagaacaaa

SEQ ID NO: 844599 - DNA, 22 bp, Artificial Sequence
  chemically synthesized
cctatagtgacttttgttctcc

SEQ ID NO: 844600 - DNA, 22 bp, Artificial Sequence
  chemically synthesized
tcctatagtgacttttgttctc

SEQ ID NO: 844601 - DNA, 22 bp, Artificial Sequence
  chemically synthesized
ttcctatagtgacttttgttct

SEQ ID NO: 844602 - DNA, 22 bp, Artificial Sequence
  chemically synthesized
atttttcctatagtgacttttg

SEQ ID NO: 844603 - DNA, 22 bp, Artificial Sequence
  chemically synthesized
catttttcctatagtgactttt

SEQ ID NO: 844604 - DNA, 22 bp, Artificial Sequence
  chemically synthesized
ttggagaacaaaagtcactata

SEQ ID NO: 844605 - DNA, 22 bp, Artificial Sequence
  chemically synthesized
cttcatttttcctatagtgact

SEQ ID NO: 844606 - DNA, 22 bp, Artificial Sequence
  chemically synthesized
gagaacaaaagtcactatagga

SEQ ID NO: 844607 - DNA, 22 bp, Artificial Sequence
  chemically synthesized
cctacttcatttttcctatagt

SEQ ID NO: 844608 - DNA, 22 bp, Artificial Sequence
  chemically synthesized
ccctacttcatttttcctatag

SEQ ID NO: 844609 - DNA, 22 bp, Artificial Sequence
  chemically synthesized
tcgtttccctacttcatttttc

SEQ ID NO: 844610 - DNA, 22 bp, Artificial Sequence
  chemically synthesized
gtcgtttccctacttcattttt

SEQ ID NO: 844611 - DNA, 22 bp, Artificial Sequence
  chemically synthesized
tgtcgtttccctacttcatttt

SEQ ID NO: 844612 - DNA, 22 bp, Artificial Sequence
  chemically synthesized
tttgtcgtttccctacttcatt

SEQ ID NO: 844613 - DNA, 22 bp, Artificial Sequence
  chemically synthesized
ctttgtcgtttccctacttcat

SEQ ID NO: 844614 - DNA, 22 bp, Artificial Sequence
  chemically synthesized
tctttgtcgtttccctacttca

SEQ ID NO: 844615 - DNA, 22 bp, Artificial Sequence
  chemically synthesized
taggaaaaatgaagtagggaaa

SEQ ID NO: 844616 - DNA, 22 bp, Artificial Sequence
  chemically synthesized
accactttctttgtcgtttccc

SEQ ID NO: 844617 - DNA, 22 bp, Artificial Sequence
  chemically synthesized
agatgattcaccactttctttg

SEQ ID NO: 844618 - DNA, 22 bp, Artificial Sequence
  chemically synthesized
ctcagatgattcaccactttct

SEQ ID NO: 844619 - DNA, 22 bp, Artificial Sequence
  chemically synthesized
cctcagatgattcaccactttc

SEQ ID NO: 844620 - DNA, 22 bp, Artificial Sequence
  chemically synthesized
ttcctcagatgattcaccactt

SEQ ID NO: 844621 - DNA, 22 bp, Artificial Sequence
  chemically synthesized
cttcctcagatgattcaccact

SEQ ID NO: 844622 - DNA, 22 bp, Artificial Sequence
  chemically synthesized
caatttcttcctcagatgattc

SEQ ID NO: 844623 - DNA, 22 bp, Artificial Sequence
  chemically synthesized
tctccaatttcttcctcagatg

SEQ ID NO: 844624 - DNA, 22 bp, Artificial Sequence
  chemically synthesized
atctccaatttcttcctcagat

SEQ ID NO: 844625 - DNA, 22 bp, Artificial Sequence
  chemically synthesized
tatctccaatttcttcctcaga

SEQ ID NO: 844626 - DNA, 22 bp, Artificial Sequence
  chemically synthesized
ttatctccaatttcttcctcag

SEQ ID NO: 844627 - DNA, 22 bp, Artificial Sequence
  chemically synthesized
tttatctccaatttcttcctca

SEQ ID NO: 844628 - DNA, 22 bp, Artificial Sequence
  chemically synthesized
ctttttatctccaatttcttcc

SEQ ID NO: 844629 - DNA, 22 bp, Artificial Sequence
  chemically synthesized
tcctttttatctccaatttctt

SEQ ID NO: 844630 - DNA, 22 bp, Artificial Sequence
  chemically synthesized
aggaagaaattggagataaaaa

SEQ ID NO: 844631 - DNA, 22 bp, Artificial Sequence
  chemically synthesized
aagccacaggttctccttttta

SEQ ID NO: 844632 - DNA, 22 bp, Artificial Sequence
  chemically synthesized
ctgaagccacaggttctccttt

SEQ ID NO: 844633 - DNA, 22 bp, Artificial Sequence
  chemically synthesized
ttgctgaagccacaggttctcc

SEQ ID NO: 844634 - DNA, 22 bp, Artificial Sequence
  chemically synthesized
gagataaaaaggagaacctgtg

SEQ ID NO: 844635 - DNA, 22 bp, Artificial Sequence
  chemically synthesized
agcagccatcattgttgctgaa

SEQ ID NO: 844636 - DNA, 22 bp, Artificial Sequence
  chemically synthesized
cagcagccatcattgttgctga

SEQ ID NO: 844637 - DNA, 22 bp, Artificial Sequence
  chemically synthesized
agatttcagcagccatcattgt

SEQ ID NO: 844638 - DNA, 22 bp, Artificial Sequence
  chemically synthesized
tggcttcagcaacaatgatggc

SEQ ID NO: 844639 - DNA, 22 bp, Artificial Sequence
  chemically synthesized
gagatttcagcagccatcattg

SEQ ID NO: 844640 - DNA, 22 bp, Artificial Sequence
  chemically synthesized
cagcaacaatgatggctgctga

SEQ ID NO: 844641 - DNA, 22 bp, Artificial Sequence
  chemically synthesized
agcaacaatgatggctgctgaa

SEQ ID NO: 844642 - DNA, 22 bp, Artificial Sequence
  chemically synthesized
gaaatgtcatttgagatttcag

SEQ ID NO: 844643 - DNA, 22 bp, Artificial Sequence
  chemically synthesized
aacctagaaatgtcatttgaga

SEQ ID NO: 844644 - DNA, 22 bp, Artificial Sequence
  chemically synthesized
gctaaacctagaaatgtcattt

SEQ ID NO: 844645 - DNA, 22 bp, Artificial Sequence
  chemically synthesized
agctaaacctagaaatgtcatt

SEQ ID NO: 844646 - DNA, 22 bp, Artificial Sequence
  chemically synthesized
ctgaaatctcaaatgacatttc

SEQ ID NO: 844647 - DNA, 22 bp, Artificial Sequence
  chemically synthesized
aaatctcaaatgacatttctag

SEQ ID NO: 844648 - DNA, 22 bp, Artificial Sequence
  chemically synthesized
acacttagctaaacctagaaat

SEQ ID NO: 844649 - DNA, 22 bp, Artificial Sequence
  chemically synthesized
aaatgacatttctaggtttagc

SEQ ID NO: 844650 - DNA, 22 bp, Artificial Sequence
  chemically synthesized
gaaacagctaacacttagctaa

SEQ ID NO: 844651 - DNA, 22 bp, Artificial Sequence
  chemically synthesized
ggaaacagctaacacttagcta

SEQ ID NO: 844652 - DNA, 22 bp, Artificial Sequence
  chemically synthesized
ctaggtttagctaagtgttagc

SEQ ID NO: 844653 - DNA, 22 bp, Artificial Sequence
  chemically synthesized
gccttggaaacagctaacactt

SEQ ID NO: 844654 - DNA, 22 bp, Artificial Sequence
  chemically synthesized
taggtttagctaagtgttagct

SEQ ID NO: 844655 - DNA, 22 bp, Artificial Sequence
  chemically synthesized
ggtttagctaagtgttagctgt

SEQ ID NO: 844656 - DNA, 22 bp, Artificial Sequence
  chemically synthesized
tcctagccttggaaacagctaa

SEQ ID NO: 844657 - DNA, 22 bp, Artificial Sequence
  chemically synthesized
agctaagtgttagctgtttcca

SEQ ID NO: 844658 - DNA, 22 bp, Artificial Sequence
  chemically synthesized
gctaagtgttagctgtttccaa

SEQ ID NO: 844659 - DNA, 22 bp, Artificial Sequence
  chemically synthesized
agtgttagctgtttccaaggct

SEQ ID NO: 844660 - DNA, 22 bp, Artificial Sequence
  chemically synthesized
ccaagtctatcctagccttgga

SEQ ID NO: 844661 - DNA, 22 bp, Artificial Sequence
  chemically synthesized
cccaagtctatcctagccttgg

SEQ ID NO: 844662 - DNA, 22 bp, Artificial Sequence
  chemically synthesized
gctgtttccaaggctaggatag

SEQ ID NO: 844663 - DNA, 22 bp, Artificial Sequence
  chemically synthesized
tgtatttcccaagtctatccta

SEQ ID NO: 844664 - DNA, 22 bp, Artificial Sequence
  chemically synthesized
atgtatttcccaagtctatcct

SEQ ID NO: 844665 - DNA, 22 bp, Artificial Sequence
  chemically synthesized
tttccaaggctaggatagactt

SEQ ID NO: 844666 - DNA, 22 bp, Artificial Sequence
  chemically synthesized
ttatgtatttcccaagtctatc

SEQ ID NO: 844667 - DNA, 22 bp, Artificial Sequence
  chemically synthesized
cttatgtatttcccaagtctat

SEQ ID NO: 844668 - DNA, 22 bp, Artificial Sequence
  chemically synthesized
ccaaggctaggatagacttggg

SEQ ID NO: 844669 - DNA, 22 bp, Artificial Sequence
  chemically synthesized
caaggctaggatagacttggga

SEQ ID NO: 844670 - DNA, 22 bp, Artificial Sequence
  chemically synthesized
tttcttatgtatttcccaagtc

SEQ ID NO: 844671 - DNA, 22 bp, Artificial Sequence
  chemically synthesized
gttgtttcttatgtatttccca

SEQ ID NO: 844672 - DNA, 22 bp, Artificial Sequence
  chemically synthesized
ggatagacttgggaaatacata

SEQ ID NO: 844673 - DNA, 22 bp, Artificial Sequence
  chemically synthesized
ttagttgtttcttatgtatttc

SEQ ID NO: 844674 - DNA, 22 bp, Artificial Sequence
  chemically synthesized
gggaaatacataagaaacaact

SEQ ID NO: 844675 - DNA, 22 bp, Artificial Sequence
  chemically synthesized
aaacaaattattagttgtttct

SEQ ID NO: 844676 - DNA, 22 bp, Artificial Sequence
  chemically synthesized
ggaaatacataagaaacaacta

SEQ ID NO: 844677 - DNA, 22 bp, Artificial Sequence
  chemically synthesized
taaaacaaattattagttgttt

SEQ ID NO: 844678 - DNA, 22 bp, Artificial Sequence
  chemically synthesized
ctaaaacaaattattagttgtt

SEQ ID NO: 844679 - DNA, 22 bp, Artificial Sequence
  chemically synthesized
gtaaatgtttctaaaacaaatt

SEQ ID NO: 844680 - DNA, 22 bp, Artificial Sequence
  chemically synthesized
agtaaatgtttctaaaacaaat

SEQ ID NO: 844681 - DNA, 22 bp, Artificial Sequence
  chemically synthesized
cagtttagtaaatgtttctaaa

SEQ ID NO: 844682 - DNA, 22 bp, Artificial Sequence
  chemically synthesized
ataatttgttttagaaacattt

SEQ ID NO: 844683 - DNA, 22 bp, Artificial Sequence
  chemically synthesized
gttttagaaacatttactaaac

SEQ ID NO: 844684 - DNA, 22 bp, Artificial Sequence
  chemically synthesized
ttttagaaacatttactaaact

SEQ ID NO: 844685 - DNA, 22 bp, Artificial Sequence
  chemically synthesized
gcaaatagttgcagtttagtaa

SEQ ID NO: 844686 - DNA, 22 bp, Artificial Sequence
  chemically synthesized
ggcaaatagttgcagtttagta

SEQ ID NO: 844687 - DNA, 22 bp, Artificial Sequence
  chemically synthesized
tagaaacatttactaaactgca

SEQ ID NO: 844688 - DNA, 22 bp, Artificial Sequence
  chemically synthesized
agaaacatttactaaactgcaa

SEQ ID NO: 844689 - DNA, 22 bp, Artificial Sequence
  chemically synthesized
gaaacatttactaaactgcaac

SEQ ID NO: 844690 - DNA, 22 bp, Artificial Sequence
  chemically synthesized
agtgcttggcaaatagttgcag

SEQ ID NO: 844691 - DNA, 22 bp, Artificial Sequence
  chemically synthesized
gctgagtgcttggcaaatagtt

SEQ ID NO: 844692 - DNA, 22 bp, Artificial Sequence
  chemically synthesized
actaaactgcaactatttgcca

SEQ ID NO: 844693 - DNA, 22 bp, Artificial Sequence
  chemically synthesized
ctaaactgcaactatttgccaa

SEQ ID NO: 844694 - DNA, 22 bp, Artificial Sequence
  chemically synthesized
aactgcaactatttgccaagca

SEQ ID NO: 844695 - DNA, 22 bp, Artificial Sequence
  chemically synthesized
tgtgtactagctgagtgcttgg

SEQ ID NO: 844696 - DNA, 22 bp, Artificial Sequence
  chemically synthesized
caactatttgccaagcactcag

SEQ ID NO: 844697 - DNA, 22 bp, Artificial Sequence
  chemically synthesized
tctatgtgtactagctgagtgc

SEQ ID NO: 844698 - DNA, 22 bp, Artificial Sequence
  chemically synthesized
gtctatgtgtactagctgagtg

SEQ ID NO: 844699 - DNA, 22 bp, Artificial Sequence
  chemically synthesized
tttgccaagcactcagctagta

SEQ ID NO: 844700 - DNA, 22 bp, Artificial Sequence
  chemically synthesized
tttgtctatgtgtactagctga

SEQ ID NO: 844701 - DNA, 22 bp, Artificial Sequence
  chemically synthesized
atttgtctatgtgtactagctg

SEQ ID NO: 844702 - DNA, 22 bp, Artificial Sequence
  chemically synthesized
tatttgtctatgtgtactagct

SEQ ID NO: 844703 - DNA, 22 bp, Artificial Sequence
  chemically synthesized
gccaagcactcagctagtacac

SEQ ID NO: 844704 - DNA, 22 bp, Artificial Sequence
  chemically synthesized
ccaagcactcagctagtacaca

SEQ ID NO: 844705 - DNA, 22 bp, Artificial Sequence
  chemically synthesized
agctagtacacatagacaaata

SEQ ID NO: 844706 - DNA, 22 bp, Artificial Sequence
  chemically synthesized
gtacacatagacaaataaaact

SEQ ID NO: 844707 - DNA, 22 bp, Artificial Sequence
  chemically synthesized
aaaaaagaagacaagttttatt

SEQ ID NO: 844708 - DNA, 22 bp, Artificial Sequence
  chemically synthesized
gaaaaaagaagacaagttttat

SEQ ID NO: 844709 - DNA, 22 bp, Artificial Sequence
  chemically synthesized
cttgaaaaaagaagacaagttt

SEQ ID NO: 844710 - DNA, 22 bp, Artificial Sequence
  chemically synthesized
taagttccttgaaaaaagaaga

SEQ ID NO: 844711 - DNA, 22 bp, Artificial Sequence
  chemically synthesized
gattataagttccttgaaaaaa

SEQ ID NO: 844712 - DNA, 22 bp, Artificial Sequence
  chemically synthesized
ctagattataagttccttgaaa

SEQ ID NO: 844713 - DNA, 22 bp, Artificial Sequence
  chemically synthesized
gctagattataagttccttgaa

SEQ ID NO: 844714 - DNA, 22 bp, Artificial Sequence
  chemically synthesized
gtcttcttttttcaaggaactt

SEQ ID NO: 844715 - DNA, 22 bp, Artificial Sequence
  chemically synthesized
tcttcttttttcaaggaactta

SEQ ID NO: 844716 - DNA, 22 bp, Artificial Sequence
  chemically synthesized
tttgctagattataagttcctt

SEQ ID NO: 844717 - DNA, 22 bp, Artificial Sequence
  chemically synthesized
gtttgctagattataagttcct

SEQ ID NO: 844718 - DNA, 22 bp, Artificial Sequence
  chemically synthesized
cttttttcaaggaacttataat

SEQ ID NO: 844719 - DNA, 22 bp, Artificial Sequence
  chemically synthesized
ttttttcaaggaacttataatc

SEQ ID NO: 844720 - DNA, 22 bp, Artificial Sequence
  chemically synthesized
ttttcaaggaacttataatcta

SEQ ID NO: 844721 - DNA, 22 bp, Artificial Sequence
  chemically synthesized
tttcaaggaacttataatctag

SEQ ID NO: 844722 - DNA, 22 bp, Artificial Sequence
  chemically synthesized
ttcaaggaacttataatctagc

SEQ ID NO: 844723 - DNA, 22 bp, Artificial Sequence
  chemically synthesized
tcaaggaacttataatctagca

SEQ ID NO: 844724 - DNA, 22 bp, Artificial Sequence
  chemically synthesized
tgagtatttgtttgctagatta

SEQ ID NO: 844725 - DNA, 22 bp, Artificial Sequence
  chemically synthesized
caaggaacttataatctagcaa

SEQ ID NO: 844726 - DNA, 22 bp, Artificial Sequence
  chemically synthesized
atgagtatttgtttgctagatt

SEQ ID NO: 844727 - DNA, 22 bp, Artificial Sequence
  chemically synthesized
aaggaacttataatctagcaaa

SEQ ID NO: 844728 - DNA, 22 bp, Artificial Sequence
  chemically synthesized
tttatgagtatttgtttgctag

SEQ ID NO: 844729 - DNA, 22 bp, Artificial Sequence
  chemically synthesized
ataatctagcaaacaaatactc

SEQ ID NO: 844730 - DNA, 22 bp, Artificial Sequence
  chemically synthesized
taatctagcaaacaaatactca

SEQ ID NO: 844731 - DNA, 22 bp, Artificial Sequence
  chemically synthesized
gcaaacaaatactcataaacaa

SEQ ID NO: 844732 - DNA, 22 bp, Artificial Sequence
  chemically synthesized
cacaaaaaataattgtttatga

SEQ ID NO: 844733 - DNA, 22 bp, Artificial Sequence
  chemically synthesized
ttacacaaaaaataattgttta

SEQ ID NO: 844734 - DNA, 22 bp, Artificial Sequence
  chemically synthesized
tattattacacaaaaaataatt

SEQ ID NO: 844735 - DNA, 22 bp, Artificial Sequence
  chemically synthesized
ataaacaattattttttgtgta

SEQ ID NO: 844736 - DNA, 22 bp, Artificial Sequence
  chemically synthesized
ccattgtattattacacaaaaa

SEQ ID NO: 844737 - DNA, 22 bp, Artificial Sequence
  chemically synthesized
cccattgtattattacacaaaa

SEQ ID NO: 844738 - DNA, 22 bp, Artificial Sequence
  chemically synthesized
cttcccattgtattattacaca

SEQ ID NO: 844739 - DNA, 22 bp, Artificial Sequence
  chemically synthesized
gcattacttcccattgtattat

SEQ ID NO: 844740 - DNA, 22 bp, Artificial Sequence
  chemically synthesized
ttttttgtgtaataatacaatg

SEQ ID NO: 844741 - DNA, 22 bp, Artificial Sequence
  chemically synthesized
tttgtgtaataatacaatggga

SEQ ID NO: 844742 - DNA, 22 bp, Artificial Sequence
  chemically synthesized
ttgtgtaataatacaatgggaa

SEQ ID NO: 844743 - DNA, 22 bp, Artificial Sequence
  chemically synthesized
tgtgtaataatacaatgggaag

SEQ ID NO: 844744 - DNA, 22 bp, Artificial Sequence
  chemically synthesized
tcgttagcattacttcccattg

SEQ ID NO: 844745 - DNA, 22 bp, Artificial Sequence
  chemically synthesized
gtgtaataatacaatgggaagt

SEQ ID NO: 844746 - DNA, 22 bp, Artificial Sequence
  chemically synthesized
tgtaataatacaatgggaagta

SEQ ID NO: 844747 - DNA, 22 bp, Artificial Sequence
  chemically synthesized
ttgtcgttagcattacttccca

SEQ ID NO: 844748 - DNA, 22 bp, Artificial Sequence
  chemically synthesized
ttgttgtcgttagcattacttc

SEQ ID NO: 844749 - DNA, 22 bp, Artificial Sequence
  chemically synthesized
ttgttgttgtcgttagcattac

SEQ ID NO: 844750 - DNA, 22 bp, Artificial Sequence
  chemically synthesized
aataaacaactattgttgttgt

SEQ ID NO: 844751 - DNA, 22 bp, Artificial Sequence
  chemically synthesized
acgacaacaacaatagttgttt

SEQ ID NO: 844752 - DNA, 22 bp, Artificial Sequence
  chemically synthesized
gcatatggtatgcactcaataa

SEQ ID NO: 844753 - DNA, 22 bp, Artificial Sequence
  chemically synthesized
ggcatatggtatgcactcaata

SEQ ID NO: 844754 - DNA, 22 bp, Artificial Sequence
  chemically synthesized
tggcatatggtatgcactcaat

SEQ ID NO: 844755 - DNA, 22 bp, Artificial Sequence
  chemically synthesized
ttggcatatggtatgcactcaa

SEQ ID NO: 844756 - DNA, 22 bp, Artificial Sequence
  chemically synthesized
ttttggcatatggtatgcactc

SEQ ID NO: 844757 - DNA, 22 bp, Artificial Sequence
  chemically synthesized
tttattgagtgcataccatatg

SEQ ID NO: 844758 - DNA, 22 bp, Artificial Sequence
  chemically synthesized
attgagtgcataccatatgcca

SEQ ID NO: 844759 - DNA, 22 bp, Artificial Sequence
  chemically synthesized
ttgagtgcataccatatgccaa

SEQ ID NO: 844760 - DNA, 22 bp, Artificial Sequence
  chemically synthesized
tgatagactcttttggcatatg

SEQ ID NO: 844761 - DNA, 22 bp, Artificial Sequence
  chemically synthesized
agtgcataccatatgccaaaag

SEQ ID NO: 844762 - DNA, 22 bp, Artificial Sequence
  chemically synthesized
gtatgctgtgatagactctttt

SEQ ID NO: 844763 - DNA, 22 bp, Artificial Sequence
  chemically synthesized
actagtatgctgtgatagactc

SEQ ID NO: 844764 - DNA, 22 bp, Artificial Sequence
  chemically synthesized
aactagtatgctgtgatagact

SEQ ID NO: 844765 - DNA, 22 bp, Artificial Sequence
  chemically synthesized
taactagtatgctgtgatagac

SEQ ID NO: 844766 - DNA, 22 bp, Artificial Sequence
  chemically synthesized
ttaactagtatgctgtgataga

SEQ ID NO: 844767 - DNA, 22 bp, Artificial Sequence
  chemically synthesized
ttttaactagtatgctgtgata

SEQ ID NO: 844768 - DNA, 22 bp, Artificial Sequence
  chemically synthesized
attcttttaactagtatgctgt

SEQ ID NO: 844769 - DNA, 22 bp, Artificial Sequence
  chemically synthesized
cagagttcattcttttaactag

SEQ ID NO: 844770 - DNA, 22 bp, Artificial Sequence
  chemically synthesized
tcacagcatactagttaaaaga

SEQ ID NO: 844771 - DNA, 22 bp, Artificial Sequence
  chemically synthesized
actccagagttcattcttttaa

SEQ ID NO: 844772 - DNA, 22 bp, Artificial Sequence
  chemically synthesized
ggaaagcctgactccagagttc

SEQ ID NO: 844773 - DNA, 22 bp, Artificial Sequence
  chemically synthesized
gttaaaagaatgaactctggag

SEQ ID NO: 844774 - DNA, 22 bp, Artificial Sequence
  chemically synthesized
aaagaatgaactctggagtcag

SEQ ID NO: 844775 - DNA, 22 bp, Artificial Sequence
  chemically synthesized
tggagtcaggctttcccaattt

SEQ ID NO: 844776 - DNA, 22 bp, Artificial Sequence
  chemically synthesized
gagtcaggctttcccaatttgc

SEQ ID NO: 844777 - DNA, 22 bp, Artificial Sequence
  chemically synthesized
tcccaatttgcatactggctgc

SEQ ID NO: 844778 - DNA, 22 bp, Artificial Sequence
  chemically synthesized
cccaatttgcatactggctgcc

SEQ ID NO: 844779 - DNA, 22 bp, Artificial Sequence
  chemically synthesized
ccaatttgcatactggctgcca

SEQ ID NO: 844780 - DNA, 22 bp, Artificial Sequence
  chemically synthesized
gcatactggctgccacctattc

SEQ ID NO: 844781 - DNA, 22 bp, Artificial Sequence
  chemically synthesized
catactggctgccacctattcg

SEQ ID NO: 844782 - DNA, 22 bp, Artificial Sequence
  chemically synthesized
aaaatagtaaaccgaataggtg

SEQ ID NO: 844783 - DNA, 22 bp, Artificial Sequence
  chemically synthesized
gctgccacctattcggtttact

SEQ ID NO: 844784 - DNA, 22 bp, Artificial Sequence
  chemically synthesized
ccacctattcggtttactattt

SEQ ID NO: 844785 - DNA, 22 bp, Artificial Sequence
  chemically synthesized
agtaacatactgaaaatagtaa

SEQ ID NO: 844786 - DNA, 22 bp, Artificial Sequence
  chemically synthesized
aagtaacatactgaaaatagta

SEQ ID NO: 844787 - DNA, 22 bp, Artificial Sequence
  chemically synthesized
ttcggtttactattttcagtat

SEQ ID NO: 844788 - DNA, 22 bp, Artificial Sequence
  chemically synthesized
ggtttactattttcagtatgtt

SEQ ID NO: 844789 - DNA, 22 bp, Artificial Sequence
  chemically synthesized
actattttcagtatgttactta

SEQ ID NO: 844790 - DNA, 22 bp, Artificial Sequence
  chemically synthesized
ctattttcagtatgttacttaa

SEQ ID NO: 844791 - DNA, 22 bp, Artificial Sequence
  chemically synthesized
ttttcagtatgttacttaaatg

SEQ ID NO: 844792 - DNA, 22 bp, Artificial Sequence
  chemically synthesized
tcagtatgttacttaaatgctg

SEQ ID NO: 844793 - DNA, 22 bp, Artificial Sequence
  chemically synthesized
cagtatgttacttaaatgctgt

SEQ ID NO: 844794 - DNA, 22 bp, Artificial Sequence
  chemically synthesized
gaaatgatacagacagcattta

SEQ ID NO: 844795 - DNA, 22 bp, Artificial Sequence
  chemically synthesized
agtatgttacttaaatgctgtc

SEQ ID NO: 844796 - DNA, 22 bp, Artificial Sequence
  chemically synthesized
acagtgctggaaatgatacaga

SEQ ID NO: 844797 - DNA, 22 bp, Artificial Sequence
  chemically synthesized
cttaaatgctgtctgtatcatt

SEQ ID NO: 844798 - DNA, 22 bp, Artificial Sequence
  chemically synthesized
cacagtgctggaaatgatacag

SEQ ID NO: 844799 - DNA, 22 bp, Artificial Sequence
  chemically synthesized
aaatgctgtctgtatcatttcc

SEQ ID NO: 844800 - DNA, 22 bp, Artificial Sequence
  chemically synthesized
aatgctgtctgtatcatttcca

SEQ ID NO: 844801 - DNA, 22 bp, Artificial Sequence
  chemically synthesized
catttcacagtgctggaaatga

SEQ ID NO: 844802 - DNA, 22 bp, Artificial Sequence
  chemically synthesized
tctgtatcatttccagcactgt

SEQ ID NO: 844803 - DNA, 22 bp, Artificial Sequence
  chemically synthesized
agtatctccatttcacagtgct

SEQ ID NO: 844804 - DNA, 22 bp, Artificial Sequence
  chemically synthesized
tatcatttccagcactgtgaaa

SEQ ID NO: 844805 - DNA, 22 bp, Artificial Sequence
  chemically synthesized
ccagcactgtgaaatggagata

SEQ ID NO: 844806 - DNA, 22 bp, Artificial Sequence
  chemically synthesized
cagcactgtgaaatggagatac

SEQ ID NO: 844807 - DNA, 22 bp, Artificial Sequence
  chemically synthesized
agaggtagagactcagtatctc

SEQ ID NO: 844808 - DNA, 22 bp, Artificial Sequence
  chemically synthesized
tgaaatggagatactgagtctc

SEQ ID NO: 844809 - DNA, 22 bp, Artificial Sequence
  chemically synthesized
ataatgaatctgagaggtagag

SEQ ID NO: 844810 - DNA, 22 bp, Artificial Sequence
  chemically synthesized
tcataatgaatctgagaggtag

SEQ ID NO: 844811 - DNA, 22 bp, Artificial Sequence
  chemically synthesized
attctcataatgaatctgagag

SEQ ID NO: 844812 - DNA, 22 bp, Artificial Sequence
  chemically synthesized
agtctctacctctcagattcat

SEQ ID NO: 844813 - DNA, 22 bp, Artificial Sequence
  chemically synthesized
ttaattctcataatgaatctga

SEQ ID NO: 844814 - DNA, 22 bp, Artificial Sequence
  chemically synthesized
tattaattctcataatgaatct

SEQ ID NO: 844815 - DNA, 22 bp, Artificial Sequence
  chemically synthesized
tacctctcagattcattatgag

SEQ ID NO: 844816 - DNA, 22 bp, Artificial Sequence
  chemically synthesized
actctattaattctcataatga

SEQ ID NO: 844817 - DNA, 22 bp, Artificial Sequence
  chemically synthesized
cctctcagattcattatgagaa

SEQ ID NO: 844818 - DNA, 22 bp, Artificial Sequence
  chemically synthesized
tcagattcattatgagaattaa

SEQ ID NO: 844819 - DNA, 22 bp, Artificial Sequence
  chemically synthesized
agattcattatgagaattaata

SEQ ID NO: 844820 - DNA, 22 bp, Artificial Sequence
  chemically synthesized
caaatattaactctattaattc

SEQ ID NO: 844821 - DNA, 22 bp, Artificial Sequence
  chemically synthesized
acaaatattaactctattaatt

SEQ ID NO: 844822 - DNA, 22 bp, Artificial Sequence
  chemically synthesized
attatgagaattaatagagtta

SEQ ID NO: 844823 - DNA, 22 bp, Artificial Sequence
  chemically synthesized
tgagaattaatagagttaatat

SEQ ID NO: 844824 - DNA, 22 bp, Artificial Sequence
  chemically synthesized
aacaccttacaaatattaactc

SEQ ID NO: 844825 - DNA, 22 bp, Artificial Sequence
  chemically synthesized
taaacaccttacaaatattaac

SEQ ID NO: 844826 - DNA, 22 bp, Artificial Sequence
  chemically synthesized
atagagttaatatttgtaaggt

SEQ ID NO: 844827 - DNA, 22 bp, Artificial Sequence
  chemically synthesized
atatttgtaaggtgtttagaac

SEQ ID NO: 844828 - DNA, 22 bp, Artificial Sequence
  chemically synthesized
tgaaatgggaaatgttctaaac

SEQ ID NO: 844829 - DNA, 22 bp, Artificial Sequence
  chemically synthesized
ctatgaaatgggaaatgttcta

SEQ ID NO: 844830 - DNA, 22 bp, Artificial Sequence
  chemically synthesized
actatgaaatgggaaatgttct

SEQ ID NO: 844831 - DNA, 22 bp, Artificial Sequence
  chemically synthesized
gtaaggtgtttagaacatttcc

SEQ ID NO: 844832 - DNA, 22 bp, Artificial Sequence
  chemically synthesized
taaggtgtttagaacatttccc

SEQ ID NO: 844833 - DNA, 22 bp, Artificial Sequence
  chemically synthesized
ttactatgaaatgggaaatgtt

SEQ ID NO: 844834 - DNA, 22 bp, Artificial Sequence
  chemically synthesized
ttcttactatgaaatgggaaat

SEQ ID NO: 844835 - DNA, 22 bp, Artificial Sequence
  chemically synthesized
ttgttcttactatgaaatggga

SEQ ID NO: 844836 - DNA, 22 bp, Artificial Sequence
  chemically synthesized
attgttcttactatgaaatggg

SEQ ID NO: 844837 - DNA, 22 bp, Artificial Sequence
  chemically synthesized
tattgttcttactatgaaatgg

SEQ ID NO: 844838 - DNA, 22 bp, Artificial Sequence
  chemically synthesized
ttattgttcttactatgaaatg

SEQ ID NO: 844839 - DNA, 22 bp, Artificial Sequence
  chemically synthesized
agaacatttcccatttcatagt

SEQ ID NO: 844840 - DNA, 22 bp, Artificial Sequence
  chemically synthesized
gaacatttcccatttcatagta

SEQ ID NO: 844841 - DNA, 22 bp, Artificial Sequence
  chemically synthesized
aaacttttattgttcttactat

SEQ ID NO: 844842 - DNA, 22 bp, Artificial Sequence
  chemically synthesized
aaaacttttattgttcttacta

SEQ ID NO: 844843 - DNA, 22 bp, Artificial Sequence
  chemically synthesized
cccatttcatagtaagaacaat

SEQ ID NO: 844844 - DNA, 22 bp, Artificial Sequence
  chemically synthesized
tttaaaacttttattgttctta

SEQ ID NO: 844845 - DNA, 22 bp, Artificial Sequence
  chemically synthesized
ccatttcatagtaagaacaata

SEQ ID NO: 844846 - DNA, 22 bp, Artificial Sequence
  chemically synthesized
atttaaaacttttattgttctt

SEQ ID NO: 844847 - DNA, 22 bp, Artificial Sequence
  chemically synthesized
tatttaaaacttttattgttct

SEQ ID NO: 844848 - DNA, 22 bp, Artificial Sequence
  chemically synthesized
ttatttaaaacttttattgttc

SEQ ID NO: 844849 - DNA, 22 bp, Artificial Sequence
  chemically synthesized
catagtaagaacaataaaagtt

SEQ ID NO: 844850 - DNA, 22 bp, Artificial Sequence
  chemically synthesized
atagtaagaacaataaaagttt

SEQ ID NO: 844851 - DNA, 22 bp, Artificial Sequence
  chemically synthesized
atagtttttatttaaaactttt

SEQ ID NO: 844852 - DNA, 22 bp, Artificial Sequence
  chemically synthesized
actgatagtttttatttaaaac

SEQ ID NO: 844853 - DNA, 22 bp, Artificial Sequence
  chemically synthesized
cattgactgatagtttttattt

SEQ ID NO: 844854 - DNA, 22 bp, Artificial Sequence
  chemically synthesized
taaataaaaactatcagtcaat

SEQ ID NO: 844855 - DNA, 22 bp, Artificial Sequence
  chemically synthesized
aaataaaaactatcagtcaatg

SEQ ID NO: 844856 - DNA, 22 bp, Artificial Sequence
  chemically synthesized
aataaaaactatcagtcaatgt

SEQ ID NO: 844857 - DNA, 22 bp, Artificial Sequence
  chemically synthesized
acagagtaatatgataattaca

SEQ ID NO: 844858 - DNA, 22 bp, Artificial Sequence
  chemically synthesized
tcagtcaatgtaattatcatat

SEQ ID NO: 844859 - DNA, 22 bp, Artificial Sequence
  chemically synthesized
gtacccacctcacagagtaata

SEQ ID NO: 844860 - DNA, 22 bp, Artificial Sequence
  chemically synthesized
tcatattactctgtgaggtggg

SEQ ID NO: 844861 - DNA, 22 bp, Artificial Sequence
  chemically synthesized
ctctgtgaggtgggtactaata

SEQ ID NO: 844862 - DNA, 22 bp, Artificial Sequence
  chemically synthesized
tgtgaggtgggtactaatattg

SEQ ID NO: 844863 - DNA, 22 bp, Artificial Sequence
  chemically synthesized
gtaaaataggggcaatattagt

SEQ ID NO: 844864 - DNA, 22 bp, Artificial Sequence
  chemically synthesized
tgaggtgggtactaatattgcc

SEQ ID NO: 844865 - DNA, 22 bp, Artificial Sequence
  chemically synthesized
ctagtaaaataggggcaatatt

SEQ ID NO: 844866 - DNA, 22 bp, Artificial Sequence
  chemically synthesized
actagtaaaataggggcaatat

SEQ ID NO: 844867 - DNA, 22 bp, Artificial Sequence
  chemically synthesized
tactagtaaaataggggcaata

SEQ ID NO: 844868 - DNA, 22 bp, Artificial Sequence
  chemically synthesized
tttactagtaaaataggggcaa

SEQ ID NO: 844869 - DNA, 22 bp, Artificial Sequence
  chemically synthesized
ctttactagtaaaataggggca

SEQ ID NO: 844870 - DNA, 22 bp, Artificial Sequence
  chemically synthesized
tctttactagtaaaataggggc

SEQ ID NO: 844871 - DNA, 22 bp, Artificial Sequence
  chemically synthesized
attttctttactagtaaaatag

SEQ ID NO: 844872 - DNA, 22 bp, Artificial Sequence
  chemically synthesized
atattgcccctattttactagt

SEQ ID NO: 844873 - DNA, 22 bp, Artificial Sequence
  chemically synthesized
attcattttctttactagtaaa

SEQ ID NO: 844874 - DNA, 22 bp, Artificial Sequence
  chemically synthesized
cattcattttctttactagtaa

SEQ ID NO: 844875 - DNA, 22 bp, Artificial Sequence
  chemically synthesized
tcattcattttctttactagta

SEQ ID NO: 844876 - DNA, 22 bp, Artificial Sequence
  chemically synthesized
ttcattcattttctttactagt

SEQ ID NO: 844877 - DNA, 22 bp, Artificial Sequence
  chemically synthesized
tttcattcattttctttactag

SEQ ID NO: 844878 - DNA, 22 bp, Artificial Sequence
  chemically synthesized
cccctattttactagtaaagaa

SEQ ID NO: 844879 - DNA, 22 bp, Artificial Sequence
  chemically synthesized
tttttcattcattttctttact

SEQ ID NO: 844880 - DNA, 22 bp, Artificial Sequence
  chemically synthesized
ctttttcattcattttctttac

SEQ ID NO: 844881 - DNA, 22 bp, Artificial Sequence
  chemically synthesized
ttttactagtaaagaaaatgaa

SEQ ID NO: 844882 - DNA, 22 bp, Artificial Sequence
  chemically synthesized
acttctttttcattcattttct

SEQ ID NO: 844883 - DNA, 22 bp, Artificial Sequence
  chemically synthesized
aacttctttttcattcattttc

SEQ ID NO: 844884 - DNA, 22 bp, Artificial Sequence
  chemically synthesized
tactagtaaagaaaatgaatga

SEQ ID NO: 844885 - DNA, 22 bp, Artificial Sequence
  chemically synthesized
actagtaaagaaaatgaatgaa

SEQ ID NO: 844886 - DNA, 22 bp, Artificial Sequence
  chemically synthesized
tttaacttctttttcattcatt

SEQ ID NO: 844887 - DNA, 22 bp, Artificial Sequence
  chemically synthesized
ctagtaaagaaaatgaatgaaa

SEQ ID NO: 844888 - DNA, 22 bp, Artificial Sequence
  chemically synthesized
gtaaagaaaatgaatgaaaaag

SEQ ID NO: 844889 - DNA, 22 bp, Artificial Sequence
  chemically synthesized
gacaaattgtttaacttctttt

SEQ ID NO: 844890 - DNA, 22 bp, Artificial Sequence
  chemically synthesized
ccatgtgatcctagacaaattg

SEQ ID NO: 844891 - DNA, 22 bp, Artificial Sequence
  chemically synthesized
ttaccatgtgatcctagacaaa

SEQ ID NO: 844892 - DNA, 22 bp, Artificial Sequence
  chemically synthesized
attaccatgtgatcctagacaa

SEQ ID NO: 844893 - DNA, 22 bp, Artificial Sequence
  chemically synthesized
aacaatttgtctaggatcacat

SEQ ID NO: 844894 - DNA, 22 bp, Artificial Sequence
  chemically synthesized
ccacttattaccatgtgatcct

SEQ ID NO: 844895 - DNA, 22 bp, Artificial Sequence
  chemically synthesized
tgccacttattaccatgtgatc

SEQ ID NO: 844896 - DNA, 22 bp, Artificial Sequence
  chemically synthesized
gtctaggatcacatggtaataa

SEQ ID NO: 844897 - DNA, 22 bp, Artificial Sequence
  chemically synthesized
tctaggatcacatggtaataag

SEQ ID NO: 844898 - DNA, 22 bp, Artificial Sequence
  chemically synthesized
gaagttctgccacttattacca

SEQ ID NO: 844899 - DNA, 22 bp, Artificial Sequence
  chemically synthesized
ggatcacatggtaataagtggc

SEQ ID NO: 844900 - DNA, 22 bp, Artificial Sequence
  chemically synthesized
tgttagaagttctgccacttat

SEQ ID NO: 844901 - DNA, 22 bp, Artificial Sequence
  chemically synthesized
cctatgttagaagttctgccac

SEQ ID NO: 844902 - DNA, 22 bp, Artificial Sequence
  chemically synthesized
acctatgttagaagttctgcca

SEQ ID NO: 844903 - DNA, 22 bp, Artificial Sequence
  chemically synthesized
gggccaacttacctatgttaga

SEQ ID NO: 844904 - DNA, 22 bp, Artificial Sequence
  chemically synthesized
ggggccaacttacctatgttag

SEQ ID NO: 844905 - DNA, 22 bp, Artificial Sequence
  chemically synthesized
tggggccaacttacctatgtta

SEQ ID NO: 844906 - DNA, 22 bp, Artificial Sequence
  chemically synthesized
ctaacataggtaagttggcccc

SEQ ID NO: 844907 - DNA, 22 bp, Artificial Sequence
  chemically synthesized
taacataggtaagttggcccca

SEQ ID NO: 844908 - DNA, 22 bp, Artificial Sequence
  chemically synthesized
agtgtgtgggctttggggccaa

SEQ ID NO: 844909 - DNA, 22 bp, Artificial Sequence
  chemically synthesized
acataggtaagttggccccaaa

SEQ ID NO: 844910 - DNA, 22 bp, Artificial Sequence
  chemically synthesized
aagtgtgtgggctttggggcca

SEQ ID NO: 844911 - DNA, 22 bp, Artificial Sequence
  chemically synthesized
ttaagtgtgtgggctttggggc

SEQ ID NO: 844912 - DNA, 22 bp, Artificial Sequence
  chemically synthesized
tagttcttaagtgtgtgggctt

SEQ ID NO: 844913 - DNA, 22 bp, Artificial Sequence
  chemically synthesized
tattatagttcttaagtgtgtg

SEQ ID NO: 844914 - DNA, 22 bp, Artificial Sequence
  chemically synthesized
gccccaaagcccacacacttaa

SEQ ID NO: 844915 - DNA, 22 bp, Artificial Sequence
  chemically synthesized
taagtatatcatgctatattat

SEQ ID NO: 844916 - DNA, 22 bp, Artificial Sequence
  chemically synthesized
gtaagtatatcatgctatatta

SEQ ID NO: 844917 - DNA, 22 bp, Artificial Sequence
  chemically synthesized
aagaactataatatagcatgat

SEQ ID NO: 844918 - DNA, 22 bp, Artificial Sequence
  chemically synthesized
agaactataatatagcatgata

SEQ ID NO: 844919 - DNA, 22 bp, Artificial Sequence
  chemically synthesized
taatatagcatgatatacttac

SEQ ID NO: 844920 - DNA, 22 bp, Artificial Sequence
  chemically synthesized
tgacatgagtaccttgtaagta

SEQ ID NO: 844921 - DNA, 22 bp, Artificial Sequence
  chemically synthesized
tactatgacatgagtaccttgt

SEQ ID NO: 844922 - DNA, 22 bp, Artificial Sequence
  chemically synthesized
tattatactatgacatgagtac

SEQ ID NO: 844923 - DNA, 22 bp, Artificial Sequence
  chemically synthesized
atattatactatgacatgagta

SEQ ID NO: 844924 - DNA, 22 bp, Artificial Sequence
  chemically synthesized
ccttatattatactatgacatg

SEQ ID NO: 844925 - DNA, 22 bp, Artificial Sequence
  chemically synthesized
acaaggtactcatgtcatagta

SEQ ID NO: 844926 - DNA, 22 bp, Artificial Sequence
  chemically synthesized
caaggtactcatgtcatagtat

SEQ ID NO: 844927 - DNA, 22 bp, Artificial Sequence
  chemically synthesized
tcatatagctaccttatattat

SEQ ID NO: 844928 - DNA, 22 bp, Artificial Sequence
  chemically synthesized
atgtcatagtataatataaggt

SEQ ID NO: 844929 - DNA, 22 bp, Artificial Sequence
  chemically synthesized
tatcatactatcatatagctac

SEQ ID NO: 844930 - DNA, 22 bp, Artificial Sequence
  chemically synthesized
tattatatcatactatcatata

SEQ ID NO: 844931 - DNA, 22 bp, Artificial Sequence
  chemically synthesized
ctatattatatcatactatcat

SEQ ID NO: 844932 - DNA, 22 bp, Artificial Sequence
  chemically synthesized
tccattcctatattatatcata

SEQ ID NO: 844933 - DNA, 22 bp, Artificial Sequence
  chemically synthesized
atccattcctatattatatcat

SEQ ID NO: 844934 - DNA, 22 bp, Artificial Sequence
  chemically synthesized
tatccattcctatattatatca

SEQ ID NO: 844935 - DNA, 22 bp, Artificial Sequence
  chemically synthesized
tatgatagtatgatataatata

SEQ ID NO: 844936 - DNA, 22 bp, Artificial Sequence
  chemically synthesized
tccctttatccattcctatatt

SEQ ID NO: 844937 - DNA, 22 bp, Artificial Sequence
  chemically synthesized
atatccctgtccctttatccat

SEQ ID NO: 844938 - DNA, 22 bp, Artificial Sequence
  chemically synthesized
catatccctgtccctttatcca

SEQ ID NO: 844939 - DNA, 22 bp, Artificial Sequence
  chemically synthesized
gtttcatatccctgtcccttta

SEQ ID NO: 844940 - DNA, 22 bp, Artificial Sequence
  chemically synthesized
tcgtttcatatccctgtccctt

SEQ ID NO: 844941 - DNA, 22 bp, Artificial Sequence
  chemically synthesized
tattctcgtttcatatccctgt

SEQ ID NO: 844942 - DNA, 22 bp, Artificial Sequence
  chemically synthesized
gtattctcgtttcatatccctg

SEQ ID NO: 844943 - DNA, 22 bp, Artificial Sequence
  chemically synthesized
tgtattctcgtttcatatccct

SEQ ID NO: 844944 - DNA, 22 bp, Artificial Sequence
  chemically synthesized
ttgtattctcgtttcatatccc

SEQ ID NO: 844945 - DNA, 22 bp, Artificial Sequence
  chemically synthesized
cccttttgtattctcgtttcat

SEQ ID NO: 844946 - DNA, 22 bp, Artificial Sequence
  chemically synthesized
ccccttttgtattctcgtttca

SEQ ID NO: 844947 - DNA, 22 bp, Artificial Sequence
  chemically synthesized
atttccccttttgtattctcgt

SEQ ID NO: 844948 - DNA, 22 bp, Artificial Sequence
  chemically synthesized
aatgaaatagttaatttcccct

SEQ ID NO: 844949 - DNA, 22 bp, Artificial Sequence
  chemically synthesized
gaatgaaatagttaatttcccc

SEQ ID NO: 844950 - DNA, 22 bp, Artificial Sequence
  chemically synthesized
tccttgaatgaaatagttaatt

SEQ ID NO: 844951 - DNA, 22 bp, Artificial Sequence
  chemically synthesized
agaatataatctgtccttgaat

SEQ ID NO: 844952 - DNA, 22 bp, Artificial Sequence
  chemically synthesized
actatttcattcaaggacagat

SEQ ID NO: 844953 - DNA, 22 bp, Artificial Sequence
  chemically synthesized
attcagaatataatctgtcctt

SEQ ID NO: 844954 - DNA, 22 bp, Artificial Sequence
  chemically synthesized
tttcattcaaggacagattata

SEQ ID NO: 844955 - DNA, 22 bp, Artificial Sequence
  chemically synthesized
cattcaaggacagattatattc

SEQ ID NO: 844956 - DNA, 22 bp, Artificial Sequence
  chemically synthesized
attcaaggacagattatattct

SEQ ID NO: 844957 - DNA, 22 bp, Artificial Sequence
  chemically synthesized
aaggacagattatattctgaat

SEQ ID NO: 844958 - DNA, 22 bp, Artificial Sequence
  chemically synthesized
caagaaccatgactgattcaga

SEQ ID NO: 844959 - DNA, 22 bp, Artificial Sequence
  chemically synthesized
ttgcaagaaccatgactgattc

SEQ ID NO: 844960 - DNA, 22 bp, Artificial Sequence
  chemically synthesized
attgcaagaaccatgactgatt

SEQ ID NO: 844961 - DNA, 22 bp, Artificial Sequence
  chemically synthesized
tttattgcaagaaccatgactg

SEQ ID NO: 844962 - DNA, 22 bp, Artificial Sequence
  chemically synthesized
tattctgaatcagtcatggttc

SEQ ID NO: 844963 - DNA, 22 bp, Artificial Sequence
  chemically synthesized
tgaatcagtcatggttcttgca

SEQ ID NO: 844964 - DNA, 22 bp, Artificial Sequence
  chemically synthesized
aatcagtcatggttcttgcaat

SEQ ID NO: 844965 - DNA, 22 bp, Artificial Sequence
  chemically synthesized
aatgaactatttattgcaagaa

SEQ ID NO: 844966 - DNA, 22 bp, Artificial Sequence
  chemically synthesized
gaatgaactatttattgcaaga

SEQ ID NO: 844967 - DNA, 22 bp, Artificial Sequence
  chemically synthesized
tgaatgaactatttattgcaag

SEQ ID NO: 844968 - DNA, 22 bp, Artificial Sequence
  chemically synthesized
atcccactttgaatgaactatt

SEQ ID NO: 844969 - DNA, 22 bp, Artificial Sequence
  chemically synthesized
ctcatcccactttgaatgaact

SEQ ID NO: 844970 - DNA, 22 bp, Artificial Sequence
  chemically synthesized
ttgcaataaatagttcattcaa

SEQ ID NO: 844971 - DNA, 22 bp, Artificial Sequence
  chemically synthesized
gcaataaatagttcattcaaag

SEQ ID NO: 844972 - DNA, 22 bp, Artificial Sequence
  chemically synthesized
caataaatagttcattcaaagt

SEQ ID NO: 844973 - DNA, 22 bp, Artificial Sequence
  chemically synthesized
aggaggaaagcctcctcatccc

SEQ ID NO: 844974 - DNA, 22 bp, Artificial Sequence
  chemically synthesized
gaggaggaaagcctcctcatcc

SEQ ID NO: 844975 - DNA, 22 bp, Artificial Sequence
  chemically synthesized
attcaaagtgggatgaggaggc

SEQ ID NO: 844976 - DNA, 22 bp, Artificial Sequence
  chemically synthesized
aaagtgggatgaggaggctttc

SEQ ID NO: 844977 - DNA, 22 bp, Artificial Sequence
  chemically synthesized
aggccttgaggaggaaagcctc

SEQ ID NO: 844978 - DNA, 22 bp, Artificial Sequence
  chemically synthesized
caggccttgaggaggaaagcct

SEQ ID NO: 844979 - DNA, 22 bp, Artificial Sequence
  chemically synthesized
tcaggccttgaggaggaaagcc

SEQ ID NO: 844980 - DNA, 22 bp, Artificial Sequence
  chemically synthesized
gcctttcaggccttgaggagga

SEQ ID NO: 844981 - DNA, 22 bp, Artificial Sequence
  chemically synthesized
agcctttcaggccttgaggagg

SEQ ID NO: 844982 - DNA, 22 bp, Artificial Sequence
  chemically synthesized
cccttagcctttcaggccttga

SEQ ID NO: 844983 - DNA, 22 bp, Artificial Sequence
  chemically synthesized
tcctcctcaaggcctgaaaggc

SEQ ID NO: 844984 - DNA, 22 bp, Artificial Sequence
  chemically synthesized
cctcctcaaggcctgaaaggct

SEQ ID NO: 844985 - DNA, 22 bp, Artificial Sequence
  chemically synthesized
taccctccccttagcctttcag

SEQ ID NO: 844986 - DNA, 22 bp, Artificial Sequence
  chemically synthesized
ctcctcaaggcctgaaaggcta

SEQ ID NO: 844987 - DNA, 22 bp, Artificial Sequence
  chemically synthesized
ctcaaggcctgaaaggctaagg

SEQ ID NO: 844988 - DNA, 22 bp, Artificial Sequence
  chemically synthesized
actataccctccccttagcctt

SEQ ID NO: 844989 - DNA, 22 bp, Artificial Sequence
  chemically synthesized
aaggcctgaaaggctaagggga

SEQ ID NO: 844990 - DNA, 22 bp, Artificial Sequence
  chemically synthesized
ctaactataccctccccttagc

SEQ ID NO: 844991 - DNA, 22 bp, Artificial Sequence
  chemically synthesized
tactaactataccctcccctta

SEQ ID NO: 844992 - DNA, 22 bp, Artificial Sequence
  chemically synthesized
aaaggctaaggggagggtatag

SEQ ID NO: 844993 - DNA, 22 bp, Artificial Sequence
  chemically synthesized
agattctactaactataccctc

SEQ ID NO: 844994 - DNA, 22 bp, Artificial Sequence
  chemically synthesized
tcagattctactaactataccc

SEQ ID NO: 844995 - DNA, 22 bp, Artificial Sequence
  chemically synthesized
ctcagattctactaactatacc

SEQ ID NO: 844996 - DNA, 22 bp, Artificial Sequence
  chemically synthesized
aggggagggtatagttagtaga

SEQ ID NO: 844997 - DNA, 22 bp, Artificial Sequence
  chemically synthesized
cagccacttctcagattctact

SEQ ID NO: 844998 - DNA, 22 bp, Artificial Sequence
  chemically synthesized
tccctgcagccacttctcagat

SEQ ID NO: 844999 - DNA, 22 bp, Artificial Sequence
  chemically synthesized
gtccctgcagccacttctcaga

SEQ ID NO: 845000 - DNA, 22 bp, Artificial Sequence
  chemically synthesized
gtagaatctgagaagtggctgc

SEQ ID NO: 845001 - DNA, 22 bp, Artificial Sequence
  chemically synthesized
tcaagaggtcttgtccctgcag

SEQ ID NO: 845002 - DNA, 22 bp, Artificial Sequence
  chemically synthesized
ctgtcaagaggtcttgtccctg

SEQ ID NO: 845003 - DNA, 22 bp, Artificial Sequence
  chemically synthesized
agaagtggctgcagggacaaga

SEQ ID NO: 845004 - DNA, 22 bp, Artificial Sequence
  chemically synthesized
cagggacaagacctcttgacag

SEQ ID NO: 845005 - DNA, 22 bp, Artificial Sequence
  chemically synthesized
acagccccagctcctgtcaaga

SEQ ID NO: 845006 - DNA, 22 bp, Artificial Sequence
  chemically synthesized
ctcacagccccagctcctgtca

SEQ ID NO: 845007 - DNA, 22 bp, Artificial Sequence
  chemically synthesized
actcacagccccagctcctgtc

SEQ ID NO: 845008 - DNA, 22 bp, Artificial Sequence
  chemically synthesized
tactcacagccccagctcctgt

SEQ ID NO: 845009 - DNA, 22 bp, Artificial Sequence
  chemically synthesized
ctttactcacagccccagctcc

SEQ ID NO: 845010 - DNA, 22 bp, Artificial Sequence
  chemically synthesized
ggttcctttactcacagcccca

SEQ ID NO: 845011 - DNA, 22 bp, Artificial Sequence
  chemically synthesized
ttgacaggagctggggctgtga

SEQ ID NO: 845012 - DNA, 22 bp, Artificial Sequence
  chemically synthesized
gacaggagctggggctgtgagt

SEQ ID NO: 845013 - DNA, 22 bp, Artificial Sequence
  chemically synthesized
acaggagctggggctgtgagta

SEQ ID NO: 845014 - DNA, 22 bp, Artificial Sequence
  chemically synthesized
gggctgtgagtaaaggaaccta

SEQ ID NO: 845015 - DNA, 22 bp, Artificial Sequence
  chemically synthesized
tgagtaaaggaacctagccatc

SEQ ID NO: 845016 - DNA, 22 bp, Artificial Sequence
  chemically synthesized
gccatccctcgactcactctcc

SEQ ID NO: 845017 - DNA, 22 bp, Artificial Sequence
  chemically synthesized
gactcactctcctctcatccat

SEQ ID NO: 845018 - DNA, 22 bp, Artificial Sequence
  chemically synthesized
actctcctctcatccattgatc

SEQ ID NO: 845019 - DNA, 22 bp, Artificial Sequence
  chemically synthesized
ggaggcatcagcagatcaatgg

SEQ ID NO: 845020 - DNA, 22 bp, Artificial Sequence
  chemically synthesized
tcctctcatccattgatctgct

SEQ ID NO: 845021 - DNA, 22 bp, Artificial Sequence
  chemically synthesized
ctctcatccattgatctgctga

SEQ ID NO: 845022 - DNA, 22 bp, Artificial Sequence
  chemically synthesized
tgttgggaggcatcagcagatc

SEQ ID NO: 845023 - DNA, 22 bp, Artificial Sequence
  chemically synthesized
gtgttgggaggcatcagcagat

SEQ ID NO: 845024 - DNA, 22 bp, Artificial Sequence
  chemically synthesized
tcatccattgatctgctgatgc

SEQ ID NO: 845025 - DNA, 22 bp, Artificial Sequence
  chemically synthesized
atccattgatctgctgatgcct

SEQ ID NO: 845026 - DNA, 22 bp, Artificial Sequence
  chemically synthesized
gtccttgtgttgggaggcatca

SEQ ID NO: 845027 - DNA, 22 bp, Artificial Sequence
  chemically synthesized
ggtccttgtgttgggaggcatc

SEQ ID NO: 845028 - DNA, 22 bp, Artificial Sequence
  chemically synthesized
gcttggtccttgtgttgggagg

SEQ ID NO: 845029 - DNA, 22 bp, Artificial Sequence
  chemically synthesized
atctgctgatgcctcccaacac

SEQ ID NO: 845030 - DNA, 22 bp, Artificial Sequence
  chemically synthesized
ttggcttggtccttgtgttggg

SEQ ID NO: 845031 - DNA, 22 bp, Artificial Sequence
  chemically synthesized
ctgatgcctcccaacacaagga

SEQ ID NO: 845032 - DNA, 22 bp, Artificial Sequence
  chemically synthesized
tctattggcttggtccttgtgt

SEQ ID NO: 845033 - DNA, 22 bp, Artificial Sequence
  chemically synthesized
gtctattggcttggtccttgtg

SEQ ID NO: 845034 - DNA, 22 bp, Artificial Sequence
  chemically synthesized
atgcctcccaacacaaggacca

SEQ ID NO: 845035 - DNA, 22 bp, Artificial Sequence
  chemically synthesized
cttgtctattggcttggtcctt

SEQ ID NO: 845036 - DNA, 22 bp, Artificial Sequence
  chemically synthesized
gcttgtctattggcttggtcct

SEQ ID NO: 845037 - DNA, 22 bp, Artificial Sequence
  chemically synthesized
ccaacacaaggaccaagccaat

SEQ ID NO: 845038 - DNA, 22 bp, Artificial Sequence
  chemically synthesized
ggcttgcttgtctattggcttg

SEQ ID NO: 845039 - DNA, 22 bp, Artificial Sequence
  chemically synthesized
accaatatggcagtagcattgg

SEQ ID NO: 845040 - DNA, 22 bp, Artificial Sequence
  chemically synthesized
ggaggttgaccaatatggcagt

SEQ ID NO: 845041 - DNA, 22 bp, Artificial Sequence
  chemically synthesized
ccctaggaggttgaccaatatg

SEQ ID NO: 845042 - DNA, 22 bp, Artificial Sequence
  chemically synthesized
taccctaggaggttgaccaata

SEQ ID NO: 845043 - DNA, 22 bp, Artificial Sequence
  chemically synthesized
ttctaccctaggaggttgacca

SEQ ID NO: 845044 - DNA, 22 bp, Artificial Sequence
  chemically synthesized
ctgccatattggtcaacctcct

SEQ ID NO: 845045 - DNA, 22 bp, Artificial Sequence
  chemically synthesized
ttgttctaccctaggaggttga

SEQ ID NO: 845046 - DNA, 22 bp, Artificial Sequence
  chemically synthesized
ccatattggtcaacctcctagg

SEQ ID NO: 845047 - DNA, 22 bp, Artificial Sequence
  chemically synthesized
acctgttgttctaccctaggag

SEQ ID NO: 845048 - DNA, 22 bp, Artificial Sequence
  chemically synthesized
taacctgttgttctaccctagg

SEQ ID NO: 845049 - DNA, 22 bp, Artificial Sequence
  chemically synthesized
gtcaacctcctagggtagaaca

SEQ ID NO: 845050 - DNA, 22 bp, Artificial Sequence
  chemically synthesized
ctagggtagaacaacaggttag

SEQ ID NO: 845051 - DNA, 22 bp, Artificial Sequence
  chemically synthesized
gcagatccaatctctaacctgt

SEQ ID NO: 845052 - DNA, 22 bp, Artificial Sequence
  chemically synthesized
cgcagatccaatctctaacctg

SEQ ID NO: 845053 - DNA, 22 bp, Artificial Sequence
  chemically synthesized
gggtagaacaacaggttagaga

SEQ ID NO: 845054 - DNA, 22 bp, Artificial Sequence
  chemically synthesized
tcgcagatccaatctctaacct

SEQ ID NO: 845055 - DNA, 22 bp, Artificial Sequence
  chemically synthesized
gatactttcgcagatccaatct

SEQ ID NO: 845056 - DNA, 22 bp, Artificial Sequence
  chemically synthesized
ctggatactttcgcagatccaa

SEQ ID NO: 845057 - DNA, 22 bp, Artificial Sequence
  chemically synthesized
ttgctggatactttcgcagatc

SEQ ID NO: 845058 - DNA, 22 bp, Artificial Sequence
  chemically synthesized
gagattggatctgcgaaagtat

SEQ ID NO: 845059 - DNA, 22 bp, Artificial Sequence
  chemically synthesized
tactgttgctggatactttcgc

SEQ ID NO: 845060 - DNA, 22 bp, Artificial Sequence
  chemically synthesized
atactgttgctggatactttcg

SEQ ID NO: 845061 - DNA, 22 bp, Artificial Sequence
  chemically synthesized
tatactgttgctggatactttc

SEQ ID NO: 845062 - DNA, 22 bp, Artificial Sequence
  chemically synthesized
ttatactgttgctggatacttt

SEQ ID NO: 845063 - DNA, 22 bp, Artificial Sequence
  chemically synthesized
tttatactgttgctggatactt

SEQ ID NO: 845064 - DNA, 22 bp, Artificial Sequence
  chemically synthesized
ttttatactgttgctggatact

SEQ ID NO: 845065 - DNA, 22 bp, Artificial Sequence
  chemically synthesized
tttttatactgttgctggatac

SEQ ID NO: 845066 - DNA, 22 bp, Artificial Sequence
  chemically synthesized
gatctgcgaaagtatccagcaa

SEQ ID NO: 845067 - DNA, 22 bp, Artificial Sequence
  chemically synthesized
ttttttttatactgttgctgga

SEQ ID NO: 845068 - DNA, 22 bp, Artificial Sequence
  chemically synthesized
ttattttttttatactgttgct

SEQ ID NO: 845069 - DNA, 22 bp, Artificial Sequence
  chemically synthesized
cgaaagtatccagcaacagtat

SEQ ID NO: 845070 - DNA, 22 bp, Artificial Sequence
  chemically synthesized
ttattattttttttatactgtt

SEQ ID NO: 845071 - DNA, 22 bp, Artificial Sequence
  chemically synthesized
ccattattattattttttttat

SEQ ID NO: 845072 - DNA, 22 bp, Artificial Sequence
  chemically synthesized
ttgccattattattattttttt

SEQ ID NO: 845073 - DNA, 22 bp, Artificial Sequence
  chemically synthesized
aatagttgttgccattattatt

SEQ ID NO: 845074 - DNA, 22 bp, Artificial Sequence
  chemically synthesized
caatagttgttgccattattat

SEQ ID NO: 845075 - DNA, 22 bp, Artificial Sequence
  chemically synthesized
tttcaatagttgttgccattat

SEQ ID NO: 845076 - DNA, 22 bp, Artificial Sequence
  chemically synthesized
gtttcaatagttgttgccatta

SEQ ID NO: 845077 - DNA, 22 bp, Artificial Sequence
  chemically synthesized
atttgtttcaatagttgttgcc

SEQ ID NO: 845078 - DNA, 22 bp, Artificial Sequence
  chemically synthesized
actgatttgtttcaatagttgt

SEQ ID NO: 845079 - DNA, 22 bp, Artificial Sequence
  chemically synthesized
cactgatttgtttcaatagttg

SEQ ID NO: 845080 - DNA, 22 bp, Artificial Sequence
  chemically synthesized
cttcactgatttgtttcaatag

SEQ ID NO: 845081 - DNA, 22 bp, Artificial Sequence
  chemically synthesized
ccttcactgatttgtttcaata

SEQ ID NO: 845082 - DNA, 22 bp, Artificial Sequence
  chemically synthesized
ttgaaacaaatcagtgaaggaa

SEQ ID NO: 845083 - DNA, 22 bp, Artificial Sequence
  chemically synthesized
ccatatgtggtcatttccttca

SEQ ID NO: 845084 - DNA, 22 bp, Artificial Sequence
  chemically synthesized
aaacaaatcagtgaaggaaatg

SEQ ID NO: 845085 - DNA, 22 bp, Artificial Sequence
  chemically synthesized
agaattcccatatgtggtcatt

SEQ ID NO: 845086 - DNA, 22 bp, Artificial Sequence
  chemically synthesized
ctgagaattcccatatgtggtc

SEQ ID NO: 845087 - DNA, 22 bp, Artificial Sequence
  chemically synthesized
gctgagaattcccatatgtggt

SEQ ID NO: 845088 - DNA, 22 bp, Artificial Sequence
  chemically synthesized
tgctgagaattcccatatgtgg

SEQ ID NO: 845089 - DNA, 22 bp, Artificial Sequence
  chemically synthesized
atatgaagtctttgctgagaat

SEQ ID NO: 845090 - DNA, 22 bp, Artificial Sequence
  chemically synthesized
gatatgaagtctttgctgagaa

SEQ ID NO: 845091 - DNA, 22 bp, Artificial Sequence
  chemically synthesized
tagtgccatacttgatatgaag

SEQ ID NO: 845092 - DNA, 22 bp, Artificial Sequence
  chemically synthesized
tcagcaaagacttcatatcaag

SEQ ID NO: 845093 - DNA, 22 bp, Artificial Sequence
  chemically synthesized
agcaaagacttcatatcaagta

SEQ ID NO: 845094 - DNA, 22 bp, Artificial Sequence
  chemically synthesized
agctgtagtgccatacttgata

SEQ ID NO: 845095 - DNA, 22 bp, Artificial Sequence
  chemically synthesized
ccaaagttcagctgtagtgcca

SEQ ID NO: 845096 - DNA, 22 bp, Artificial Sequence
  chemically synthesized
catatcaagtatggcactacag

SEQ ID NO: 845097 - DNA, 22 bp, Artificial Sequence
  chemically synthesized
atatcaagtatggcactacagc

SEQ ID NO: 845098 - DNA, 22 bp, Artificial Sequence
  chemically synthesized
gccaaatctgccaaagttcagc

SEQ ID NO: 845099 - DNA, 22 bp, Artificial Sequence
  chemically synthesized
tagccaaatctgccaaagttca

SEQ ID NO: 845100 - DNA, 22 bp, Artificial Sequence
  chemically synthesized
tctagccaaatctgccaaagtt

SEQ ID NO: 845101 - DNA, 22 bp, Artificial Sequence
  chemically synthesized
attctctagccaaatctgccaa

SEQ ID NO: 845102 - DNA, 22 bp, Artificial Sequence
  chemically synthesized
cagctgaactttggcagatttg

SEQ ID NO: 845103 - DNA, 22 bp, Artificial Sequence
  chemically synthesized
tcattctctagccaaatctgcc

SEQ ID NO: 845104 - DNA, 22 bp, Artificial Sequence
  chemically synthesized
ctcattctctagccaaatctgc

SEQ ID NO: 845105 - DNA, 22 bp, Artificial Sequence
  chemically synthesized
ttctcattctctagccaaatct

SEQ ID NO: 845106 - DNA, 22 bp, Artificial Sequence
  chemically synthesized
aactttggcagatttggctaga

SEQ ID NO: 845107 - DNA, 22 bp, Artificial Sequence
  chemically synthesized
tggcagatttggctagagaatg

SEQ ID NO: 845108 - DNA, 22 bp, Artificial Sequence
  chemically synthesized
taatgctcttctcattctctag

SEQ ID NO: 845109 - DNA, 22 bp, Artificial Sequence
  chemically synthesized
ggcagatttggctagagaatga

SEQ ID NO: 845110 - DNA, 22 bp, Artificial Sequence
  chemically synthesized
ataatgctcttctcattctcta

SEQ ID NO: 845111 - DNA, 22 bp, Artificial Sequence
  chemically synthesized
gcagatttggctagagaatgag

SEQ ID NO: 845112 - DNA, 22 bp, Artificial Sequence
  chemically synthesized
ccttataatgctcttctcattc

SEQ ID NO: 845113 - DNA, 22 bp, Artificial Sequence
  chemically synthesized
cccttataatgctcttctcatt

SEQ ID NO: 845114 - DNA, 22 bp, Artificial Sequence
  chemically synthesized
tcccttataatgctcttctcat

SEQ ID NO: 845115 - DNA, 22 bp, Artificial Sequence
  chemically synthesized
ggctagagaatgagaagagcat

SEQ ID NO: 845116 - DNA, 22 bp, Artificial Sequence
  chemically synthesized
gctagagaatgagaagagcatt

SEQ ID NO: 845117 - DNA, 22 bp, Artificial Sequence
  chemically synthesized
tctttcccttataatgctcttc

SEQ ID NO: 845118 - DNA, 22 bp, Artificial Sequence
  chemically synthesized
gagaatgagaagagcattataa

SEQ ID NO: 845119 - DNA, 22 bp, Artificial Sequence
  chemically synthesized
atgtctgtctttcccttataat

SEQ ID NO: 845120 - DNA, 22 bp, Artificial Sequence
  chemically synthesized
ttcatgtctgtctttcccttat

SEQ ID NO: 845121 - DNA, 22 bp, Artificial Sequence
  chemically synthesized
gttcatgtctgtctttccctta

SEQ ID NO: 845122 - DNA, 22 bp, Artificial Sequence
  chemically synthesized
tgttcatgtctgtctttccctt

SEQ ID NO: 845123 - DNA, 22 bp, Artificial Sequence
  chemically synthesized
atgcctttgttcatgtctgtct

SEQ ID NO: 845124 - DNA, 22 bp, Artificial Sequence
  chemically synthesized
taagggaaagacagacatgaac

SEQ ID NO: 845125 - DNA, 22 bp, Artificial Sequence
  chemically synthesized
cgttcatgcctttgttcatgtc

SEQ ID NO: 845126 - DNA, 22 bp, Artificial Sequence
  chemically synthesized
acgttcatgcctttgttcatgt

SEQ ID NO: 845127 - DNA, 22 bp, Artificial Sequence
  chemically synthesized
tacgttcatgcctttgttcatg

SEQ ID NO: 845128 - DNA, 22 bp, Artificial Sequence
  chemically synthesized
ttttacgttcatgcctttgttc

SEQ ID NO: 845129 - DNA, 22 bp, Artificial Sequence
  chemically synthesized
attttacgttcatgcctttgtt

SEQ ID NO: 845130 - DNA, 22 bp, Artificial Sequence
  chemically synthesized
tattttacgttcatgcctttgt

SEQ ID NO: 845131 - DNA, 22 bp, Artificial Sequence
  chemically synthesized
aggctttattttacgttcatgc

SEQ ID NO: 845132 - DNA, 22 bp, Artificial Sequence
  chemically synthesized
gaggctttattttacgttcatg

SEQ ID NO: 845133 - DNA, 22 bp, Artificial Sequence
  chemically synthesized
accagcccatttgaggctttat

SEQ ID NO: 845134 - DNA, 22 bp, Artificial Sequence
  chemically synthesized
taaccagcccatttgaggcttt

SEQ ID NO: 845135 - DNA, 22 bp, Artificial Sequence
  chemically synthesized
caggctctaaccagcccatttg

SEQ ID NO: 845136 - DNA, 22 bp, Artificial Sequence
  chemically synthesized
taaagaattccaggctctaacc

SEQ ID NO: 845137 - DNA, 22 bp, Artificial Sequence
  chemically synthesized
gtaaagaattccaggctctaac

SEQ ID NO: 845138 - DNA, 22 bp, Artificial Sequence
  chemically synthesized
aaatgggctggttagagcctgg

SEQ ID NO: 845139 - DNA, 22 bp, Artificial Sequence
  chemically synthesized
tttgtaaagaattccaggctct

SEQ ID NO: 845140 - DNA, 22 bp, Artificial Sequence
  chemically synthesized
ccattatttgtaaagaattcca

SEQ ID NO: 845141 - DNA, 22 bp, Artificial Sequence
  chemically synthesized
gccattatttgtaaagaattcc

SEQ ID NO: 845142 - DNA, 22 bp, Artificial Sequence
  chemically synthesized
gttagagcctggaattctttac

SEQ ID NO: 845143 - DNA, 22 bp, Artificial Sequence
  chemically synthesized
tttgccattatttgtaaagaat

SEQ ID NO: 845144 - DNA, 22 bp, Artificial Sequence
  chemically synthesized
atttgccattatttgtaaagaa

SEQ ID NO: 845145 - DNA, 22 bp, Artificial Sequence
  chemically synthesized
gagcctggaattctttacaaat

SEQ ID NO: 845146 - DNA, 22 bp, Artificial Sequence
  chemically synthesized
aacttatttgccattatttgta

SEQ ID NO: 845147 - DNA, 22 bp, Artificial Sequence
  chemically synthesized
gaattctttacaaataatggca

SEQ ID NO: 845148 - DNA, 22 bp, Artificial Sequence
  chemically synthesized
cctaaacttatttgccattatt

SEQ ID NO: 845149 - DNA, 22 bp, Artificial Sequence
  chemically synthesized
tttacaaataatggcaaataag

SEQ ID NO: 845150 - DNA, 22 bp, Artificial Sequence
  chemically synthesized
tgtctacctaaacttatttgcc

SEQ ID NO: 845151 - DNA, 22 bp, Artificial Sequence
  chemically synthesized
tacaaataatggcaaataagtt

SEQ ID NO: 845152 - DNA, 22 bp, Artificial Sequence
  chemically synthesized
acaaataatggcaaataagttt

SEQ ID NO: 845153 - DNA, 22 bp, Artificial Sequence
  chemically synthesized
ctatgtctacctaaacttattt

SEQ ID NO: 845154 - DNA, 22 bp, Artificial Sequence
  chemically synthesized
caaataatggcaaataagttta

SEQ ID NO: 845155 - DNA, 22 bp, Artificial Sequence
  chemically synthesized
tactatgtctacctaaacttat

SEQ ID NO: 845156 - DNA, 22 bp, Artificial Sequence
  chemically synthesized
ctactatgtctacctaaactta

SEQ ID NO: 845157 - DNA, 22 bp, Artificial Sequence
  chemically synthesized
cttctactatgtctacctaaac

SEQ ID NO: 845158 - DNA, 22 bp, Artificial Sequence
  chemically synthesized
tatactgcttctactatgtcta

SEQ ID NO: 845159 - DNA, 22 bp, Artificial Sequence
  chemically synthesized
aggtagacatagtagaagcagt

SEQ ID NO: 845160 - DNA, 22 bp, Artificial Sequence
  chemically synthesized
ggtagacatagtagaagcagta

SEQ ID NO: 845161 - DNA, 22 bp, Artificial Sequence
  chemically synthesized
aaaagccaactatatactgctt

SEQ ID NO: 845162 - DNA, 22 bp, Artificial Sequence
  chemically synthesized
aaaaagccaactatatactgct

SEQ ID NO: 845163 - DNA, 22 bp, Artificial Sequence
  chemically synthesized
taaaaagccaactatatactgc

SEQ ID NO: 845164 - DNA, 22 bp, Artificial Sequence
  chemically synthesized
ttaaaaagccaactatatactg

SEQ ID NO: 845165 - DNA, 22 bp, Artificial Sequence
  chemically synthesized
atttttaaaaagccaactatat

SEQ ID NO: 845166 - DNA, 22 bp, Artificial Sequence
  chemically synthesized
aaactgatttttaaaaagccaa

SEQ ID NO: 845167 - DNA, 22 bp, Artificial Sequence
  chemically synthesized
aaaacctcaaactgatttttaa

SEQ ID NO: 845168 - DNA, 22 bp, Artificial Sequence
  chemically synthesized
gctttttaaaaatcagtttgag

SEQ ID NO: 845169 - DNA, 22 bp, Artificial Sequence
  chemically synthesized
tttaaaaatcagtttgaggttt

SEQ ID NO: 845170 - DNA, 22 bp, Artificial Sequence
  chemically synthesized
tgataaaattcaaaacctcaaa

SEQ ID NO: 845171 - DNA, 22 bp, Artificial Sequence
  chemically synthesized
ttaaaaatcagtttgaggtttt

SEQ ID NO: 845172 - DNA, 22 bp, Artificial Sequence
  chemically synthesized
gtgataaaattcaaaacctcaa

SEQ ID NO: 845173 - DNA, 22 bp, Artificial Sequence
  chemically synthesized
taaaaatcagtttgaggttttg

SEQ ID NO: 845174 - DNA, 22 bp, Artificial Sequence
  chemically synthesized
aaaaatcagtttgaggttttga

SEQ ID NO: 845175 - DNA, 22 bp, Artificial Sequence
  chemically synthesized
aaaatcagtttgaggttttgaa

SEQ ID NO: 845176 - DNA, 22 bp, Artificial Sequence
  chemically synthesized
tccttgtgataaaattcaaaac

SEQ ID NO: 845177 - DNA, 22 bp, Artificial Sequence
  chemically synthesized
ccagttgtccttgtgataaaat

SEQ ID NO: 845178 - DNA, 22 bp, Artificial Sequence
  chemically synthesized
cccagttgtccttgtgataaaa

SEQ ID NO: 845179 - DNA, 22 bp, Artificial Sequence
  chemically synthesized
gaggttttgaattttatcacaa

SEQ ID NO: 845180 - DNA, 22 bp, Artificial Sequence
  chemically synthesized
aggttttgaattttatcacaag

SEQ ID NO: 845181 - DNA, 22 bp, Artificial Sequence
  chemically synthesized
cttcccagttgtccttgtgata

SEQ ID NO: 845182 - DNA, 22 bp, Artificial Sequence
  chemically synthesized
gctgcttcccagttgtccttgt

SEQ ID NO: 845183 - DNA, 22 bp, Artificial Sequence
  chemically synthesized
tgaattttatcacaaggacaac

SEQ ID NO: 845184 - DNA, 22 bp, Artificial Sequence
  chemically synthesized
gaattttatcacaaggacaact

SEQ ID NO: 845185 - DNA, 22 bp, Artificial Sequence
  chemically synthesized
aattttatcacaaggacaactg

SEQ ID NO: 845186 - DNA, 22 bp, Artificial Sequence
  chemically synthesized
caagttcgctgcttcccagttg

SEQ ID NO: 845187 - DNA, 22 bp, Artificial Sequence
  chemically synthesized
tatcacaaggacaactgggaag

SEQ ID NO: 845188 - DNA, 22 bp, Artificial Sequence
  chemically synthesized
atcacaaggacaactgggaagc

SEQ ID NO: 845189 - DNA, 22 bp, Artificial Sequence
  chemically synthesized
tgcaagttcgctgcttcccagt

SEQ ID NO: 845190 - DNA, 22 bp, Artificial Sequence
  chemically synthesized
tcacaaggacaactgggaagca

SEQ ID NO: 845191 - DNA, 22 bp, Artificial Sequence
  chemically synthesized
ctgcaagttcgctgcttcccag

SEQ ID NO: 845192 - DNA, 22 bp, Artificial Sequence
  chemically synthesized
tctgcaagttcgctgcttccca

SEQ ID NO: 845193 - DNA, 22 bp, Artificial Sequence
  chemically synthesized
ttctgcaagttcgctgcttccc

SEQ ID NO: 845194 - DNA, 22 bp, Artificial Sequence
  chemically synthesized
tttctgcaagttcgctgcttcc

SEQ ID NO: 845195 - DNA, 22 bp, Artificial Sequence
  chemically synthesized
ttttctgcaagttcgctgcttc

SEQ ID NO: 845196 - DNA, 22 bp, Artificial Sequence
  chemically synthesized
agtttttttctgcaagttcgct

SEQ ID NO: 845197 - DNA, 22 bp, Artificial Sequence
  chemically synthesized
ggaagcagcgaacttgcagaaa

SEQ ID NO: 845198 - DNA, 22 bp, Artificial Sequence
  chemically synthesized
tagcctcagtttttttctgcaa

SEQ ID NO: 845199 - DNA, 22 bp, Artificial Sequence
  chemically synthesized
ctatagcctcagtttttttctg

SEQ ID NO: 845200 - DNA, 22 bp, Artificial Sequence
  chemically synthesized
ctcctatagcctcagttttttt

SEQ ID NO: 845201 - DNA, 22 bp, Artificial Sequence
  chemically synthesized
gctcctatagcctcagtttttt

SEQ ID NO: 845202 - DNA, 22 bp, Artificial Sequence
  chemically synthesized
tgctcctatagcctcagttttt

SEQ ID NO: 845203 - DNA, 22 bp, Artificial Sequence
  chemically synthesized
gcagaaaaaaactgaggctata

SEQ ID NO: 845204 - DNA, 22 bp, Artificial Sequence
  chemically synthesized
cagaaaaaaactgaggctatag

SEQ ID NO: 845205 - DNA, 22 bp, Artificial Sequence
  chemically synthesized
aaagctttgctcctatagcctc

SEQ ID NO: 845206 - DNA, 22 bp, Artificial Sequence
  chemically synthesized
ctgaaagctttgctcctatagc

SEQ ID NO: 845207 - DNA, 22 bp, Artificial Sequence
  chemically synthesized
aggctataggagcaaagctttc

SEQ ID NO: 845208 - DNA, 22 bp, Artificial Sequence
  chemically synthesized
taggagcaaagctttcagtaat

SEQ ID NO: 845209 - DNA, 22 bp, Artificial Sequence
  chemically synthesized
tggaggcacaggattactgaaa

SEQ ID NO: 845210 - DNA, 22 bp, Artificial Sequence
  chemically synthesized
tcagtaatcctgtgcctccata

SEQ ID NO: 845211 - DNA, 22 bp, Artificial Sequence
  chemically synthesized
cagtaatcctgtgcctccatag

SEQ ID NO: 845212 - DNA, 22 bp, Artificial Sequence
  chemically synthesized
agtaatcctgtgcctccataga

SEQ ID NO: 845213 - DNA, 22 bp, Artificial Sequence
  chemically synthesized
tcccaaccagaaagaacaaaat

SEQ ID NO: 845214 - DNA, 22 bp, Artificial Sequence
  chemically synthesized
tgcctccatagattttgttctt

SEQ ID NO: 845215 - DNA, 22 bp, Artificial Sequence
  chemically synthesized
atcccaaccagaaagaacaaaa

SEQ ID NO: 845216 - DNA, 22 bp, Artificial Sequence
  chemically synthesized
catagattttgttctttctggt

SEQ ID NO: 845217 - DNA, 22 bp, Artificial Sequence
  chemically synthesized
agaaatttatcccaaccagaaa

SEQ ID NO: 845218 - DNA, 22 bp, Artificial Sequence
  chemically synthesized
tgttctttctggttgggataaa

SEQ ID NO: 845219 - DNA, 22 bp, Artificial Sequence
  chemically synthesized
gttctttctggttgggataaat

SEQ ID NO: 845220 - DNA, 22 bp, Artificial Sequence
  chemically synthesized
ttctttctggttgggataaatt

SEQ ID NO: 845221 - DNA, 22 bp, Artificial Sequence
  chemically synthesized
tttctggttgggataaatttct

SEQ ID NO: 845222 - DNA, 22 bp, Artificial Sequence
  chemically synthesized
tctggttgggataaatttctca

SEQ ID NO: 845223 - DNA, 22 bp, Artificial Sequence
  chemically synthesized
ctggttgggataaatttctcaa

SEQ ID NO: 845224 - DNA, 22 bp, Artificial Sequence
  chemically synthesized
tggttgggataaatttctcaat

SEQ ID NO: 845225 - DNA, 22 bp, Artificial Sequence
  chemically synthesized
gttgggataaatttctcaattc

SEQ ID NO: 845226 - DNA, 22 bp, Artificial Sequence
  chemically synthesized
ggaatggaccaagaattgagaa

SEQ ID NO: 845227 - DNA, 22 bp, Artificial Sequence
  chemically synthesized
taggaatggaccaagaattgag

SEQ ID NO: 845228 - DNA, 22 bp, Artificial Sequence
  chemically synthesized
ctaggaatggaccaagaattga

SEQ ID NO: 845229 - DNA, 22 bp, Artificial Sequence
  chemically synthesized
ggataaatttctcaattcttgg

SEQ ID NO: 845230 - DNA, 22 bp, Artificial Sequence
  chemically synthesized
tatttctaggaatggaccaaga

SEQ ID NO: 845231 - DNA, 22 bp, Artificial Sequence
  chemically synthesized
actgtatttctaggaatggacc

SEQ ID NO: 845232 - DNA, 22 bp, Artificial Sequence
  chemically synthesized
ctcaattcttggtccattccta

SEQ ID NO: 845233 - DNA, 22 bp, Artificial Sequence
  chemically synthesized
tcaattcttggtccattcctag

SEQ ID NO: 845234 - DNA, 22 bp, Artificial Sequence
  chemically synthesized
ttaactgtatttctaggaatgg

SEQ ID NO: 845235 - DNA, 22 bp, Artificial Sequence
  chemically synthesized
aattcttggtccattcctagaa

SEQ ID NO: 845236 - DNA, 22 bp, Artificial Sequence
  chemically synthesized
ttggtccattcctagaaataca

SEQ ID NO: 845237 - DNA, 22 bp, Artificial Sequence
  chemically synthesized
ggtccattcctagaaatacagt

SEQ ID NO: 845238 - DNA, 22 bp, Artificial Sequence
  chemically synthesized
gtccattcctagaaatacagtt

SEQ ID NO: 845239 - DNA, 22 bp, Artificial Sequence
  chemically synthesized
cgtatgggtatctgttaactgt

SEQ ID NO: 845240 - DNA, 22 bp, Artificial Sequence
  chemically synthesized
acgtatgggtatctgttaactg

SEQ ID NO: 845241 - DNA, 22 bp, Artificial Sequence
  chemically synthesized
tacgtatgggtatctgttaact

SEQ ID NO: 845242 - DNA, 22 bp, Artificial Sequence
  chemically synthesized
ttacgtatgggtatctgttaac

SEQ ID NO: 845243 - DNA, 22 bp, Artificial Sequence
  chemically synthesized
ctagaaatacagttaacagata

SEQ ID NO: 845244 - DNA, 22 bp, Artificial Sequence
  chemically synthesized
tttacgtatgggtatctgttaa

SEQ ID NO: 845245 - DNA, 22 bp, Artificial Sequence
  chemically synthesized
gaaatacagttaacagataccc

SEQ ID NO: 845246 - DNA, 22 bp, Artificial Sequence
  chemically synthesized
gtcaatcaacactttttacgta

SEQ ID NO: 845247 - DNA, 22 bp, Artificial Sequence
  chemically synthesized
acagatacccatacgtaaaaag

SEQ ID NO: 845248 - DNA, 22 bp, Artificial Sequence
  chemically synthesized
ggtcaatcaacactttttacgt

SEQ ID NO: 845249 - DNA, 22 bp, Artificial Sequence
  chemically synthesized
tagtcagtgatttggtcaatca

SEQ ID NO: 845250 - DNA, 22 bp, Artificial Sequence
  chemically synthesized
attgtagtcagtgatttggtca

SEQ ID NO: 845251 - DNA, 22 bp, Artificial Sequence
  chemically synthesized
cattgtagtcagtgatttggtc

SEQ ID NO: 845252 - DNA, 22 bp, Artificial Sequence
  chemically synthesized
ccttcattgtagtcagtgattt

SEQ ID NO: 845253 - DNA, 22 bp, Artificial Sequence
  chemically synthesized
cccttcattgtagtcagtgatt

SEQ ID NO: 845254 - DNA, 22 bp, Artificial Sequence
  chemically synthesized
tttcccttcattgtagtcagtg

SEQ ID NO: 845255 - DNA, 22 bp, Artificial Sequence
  chemically synthesized
attgaccaaatcactgactaca

SEQ ID NO: 845256 - DNA, 22 bp, Artificial Sequence
  chemically synthesized
accaaatcactgactacaatga

SEQ ID NO: 845257 - DNA, 22 bp, Artificial Sequence
  chemically synthesized
taccactgtttcccttcattgt

SEQ ID NO: 845258 - DNA, 22 bp, Artificial Sequence
  chemically synthesized
gtaccactgtttcccttcattg

SEQ ID NO: 845259 - DNA, 22 bp, Artificial Sequence
  chemically synthesized
ttgtaccactgtttcccttcat

SEQ ID NO: 845260 - DNA, 22 bp, Artificial Sequence
  chemically synthesized
cttgtaccactgtttcccttca

SEQ ID NO: 845261 - DNA, 22 bp, Artificial Sequence
  chemically synthesized
tttcttgtaccactgtttccct

SEQ ID NO: 845262 - DNA, 22 bp, Artificial Sequence
  chemically synthesized
gtttcttgtaccactgtttccc

SEQ ID NO: 845263 - DNA, 22 bp, Artificial Sequence
  chemically synthesized
actacaatgaagggaaacagtg

SEQ ID NO: 845264 - DNA, 22 bp, Artificial Sequence
  chemically synthesized
cttgtttcttgtaccactgttt

SEQ ID NO: 845265 - DNA, 22 bp, Artificial Sequence
  chemically synthesized
caatgaagggaaacagtggtac

SEQ ID NO: 845266 - DNA, 22 bp, Artificial Sequence
  chemically synthesized
attacttgtttcttgtaccact

SEQ ID NO: 845267 - DNA, 22 bp, Artificial Sequence
  chemically synthesized
taattacttgtttcttgtacca

SEQ ID NO: 845268 - DNA, 22 bp, Artificial Sequence
  chemically synthesized
ccacaagtctctaattacttgt

SEQ ID NO: 845269 - DNA, 22 bp, Artificial Sequence
  chemically synthesized
atctgccacaagtctctaatta

SEQ ID NO: 845270 - DNA, 22 bp, Artificial Sequence
  chemically synthesized
gatctgccacaagtctctaatt

SEQ ID NO: 845271 - DNA, 22 bp, Artificial Sequence
  chemically synthesized
ttgatctgccacaagtctctaa

SEQ ID NO: 845272 - DNA, 22 bp, Artificial Sequence
  chemically synthesized
tatgtattcttgatctgccaca

SEQ ID NO: 845273 - DNA, 22 bp, Artificial Sequence
  chemically synthesized
gtatgtattcttgatctgccac

SEQ ID NO: 845274 - DNA, 22 bp, Artificial Sequence
  chemically synthesized
gagacttgtggcagatcaagaa

SEQ ID NO: 845275 - DNA, 22 bp, Artificial Sequence
  chemically synthesized
ccatttgtatgtattcttgatc

SEQ ID NO: 845276 - DNA, 22 bp, Artificial Sequence
  chemically synthesized
gccatttgtatgtattcttgat

SEQ ID NO: 845277 - DNA, 22 bp, Artificial Sequence
  chemically synthesized
tttgccatttgtatgtattctt

SEQ ID NO: 845278 - DNA, 22 bp, Artificial Sequence
  chemically synthesized
gtttgccatttgtatgtattct

SEQ ID NO: 845279 - DNA, 22 bp, Artificial Sequence
  chemically synthesized
gtggcagatcaagaatacatac

SEQ ID NO: 845280 - DNA, 22 bp, Artificial Sequence
  chemically synthesized
tggcagatcaagaatacataca

SEQ ID NO: 845281 - DNA, 22 bp, Artificial Sequence
  chemically synthesized
atatgcttgtttgccatttgta

SEQ ID NO: 845282 - DNA, 22 bp, Artificial Sequence
  chemically synthesized
catatgcttgtttgccatttgt

SEQ ID NO: 845283 - DNA, 22 bp, Artificial Sequence
  chemically synthesized
tcatatgcttgtttgccatttg

SEQ ID NO: 845284 - DNA, 22 bp, Artificial Sequence
  chemically synthesized
ttcatatgcttgtttgccattt

SEQ ID NO: 845285 - DNA, 22 bp, Artificial Sequence
  chemically synthesized
agcaccttttcatatgcttgtt

SEQ ID NO: 845286 - DNA, 22 bp, Artificial Sequence
  chemically synthesized
agtgatgttgagcaccttttca

SEQ ID NO: 845287 - DNA, 22 bp, Artificial Sequence
  chemically synthesized
tcaatgattcagtgatgttgag

SEQ ID NO: 845288 - DNA, 22 bp, Artificial Sequence
  chemically synthesized
gttatcaatgattcagtgatgt

SEQ ID NO: 845289 - DNA, 22 bp, Artificial Sequence
  chemically synthesized
tggttatcaatgattcagtgat

SEQ ID NO: 845290 - DNA, 22 bp, Artificial Sequence
  chemically synthesized
tctggttatcaatgattcagtg

SEQ ID NO: 845291 - DNA, 22 bp, Artificial Sequence
  chemically synthesized
ctctggttatcaatgattcagt

SEQ ID NO: 845292 - DNA, 22 bp, Artificial Sequence
  chemically synthesized
atttctctggttatcaatgatt

SEQ ID NO: 845293 - DNA, 22 bp, Artificial Sequence
  chemically synthesized
catttctctggttatcaatgat

SEQ ID NO: 845294 - DNA, 22 bp, Artificial Sequence
  chemically synthesized
aacatcactgaatcattgataa

SEQ ID NO: 845295 - DNA, 22 bp, Artificial Sequence
  chemically synthesized
tcatttctctggttatcaatga

SEQ ID NO: 845296 - DNA, 22 bp, Artificial Sequence
  chemically synthesized
attttcatttctctggttatca

SEQ ID NO: 845297 - DNA, 22 bp, Artificial Sequence
  chemically synthesized
gattttcatttctctggttatc

SEQ ID NO: 845298 - DNA, 22 bp, Artificial Sequence
  chemically synthesized
tgattttcatttctctggttat

SEQ ID NO: 845299 - DNA, 22 bp, Artificial Sequence
  chemically synthesized
aatcattgataaccagagaaat

SEQ ID NO: 845300 - DNA, 22 bp, Artificial Sequence
  chemically synthesized
taattttgattttcatttctct

SEQ ID NO: 845301 - DNA, 22 bp, Artificial Sequence
  chemically synthesized
ataaccagagaaatgaaaatca

SEQ ID NO: 845302 - DNA, 22 bp, Artificial Sequence
  chemically synthesized
acgggagtgaggtaatatgtca

SEQ ID NO: 845303 - DNA, 22 bp, Artificial Sequence
  chemically synthesized
aacgggagtgaggtaatatgtc

SEQ ID NO: 845304 - DNA, 22 bp, Artificial Sequence
  chemically synthesized
taacgggagtgaggtaatatgt

SEQ ID NO: 845305 - DNA, 22 bp, Artificial Sequence
  chemically synthesized
caatgacatattacctcactcc

SEQ ID NO: 845306 - DNA, 22 bp, Artificial Sequence
  chemically synthesized
gatataagccattttaacggga

SEQ ID NO: 845307 - DNA, 22 bp, Artificial Sequence
  chemically synthesized
ggatataagccattttaacggg

SEQ ID NO: 845308 - DNA, 22 bp, Artificial Sequence
  chemically synthesized
tggatataagccattttaacgg

SEQ ID NO: 845309 - DNA, 22 bp, Artificial Sequence
  chemically synthesized
ttggatataagccattttaacg

SEQ ID NO: 845310 - DNA, 22 bp, Artificial Sequence
  chemically synthesized
cctcactcccgttaaaatggct

SEQ ID NO: 845311 - DNA, 22 bp, Artificial Sequence
  chemically synthesized
tcttttggatataagccatttt

SEQ ID NO: 845312 - DNA, 22 bp, Artificial Sequence
  chemically synthesized
actcccgttaaaatggcttata

SEQ ID NO: 845313 - DNA, 22 bp, Artificial Sequence
  chemically synthesized
cctgtcttttggatataagcca

SEQ ID NO: 845314 - DNA, 22 bp, Artificial Sequence
  chemically synthesized
ccgttaaaatggcttatatcca

SEQ ID NO: 845315 - DNA, 22 bp, Artificial Sequence
  chemically synthesized
ttgcctgtcttttggatataag

SEQ ID NO: 845316 - DNA, 22 bp, Artificial Sequence
  chemically synthesized
gttattgcctgtcttttggata

SEQ ID NO: 845317 - DNA, 22 bp, Artificial Sequence
  chemically synthesized
aaatggcttatatccaaaagac

SEQ ID NO: 845318 - DNA, 22 bp, Artificial Sequence
  chemically synthesized
tcaacattggttattgcctgtc

SEQ ID NO: 845319 - DNA, 22 bp, Artificial Sequence
  chemically synthesized
gtcaacattggttattgcctgt

SEQ ID NO: 845320 - DNA, 22 bp, Artificial Sequence
  chemically synthesized
atatccaaaagacaggcaataa

SEQ ID NO: 845321 - DNA, 22 bp, Artificial Sequence
  chemically synthesized
tatccaaaagacaggcaataac

SEQ ID NO: 845322 - DNA, 22 bp, Artificial Sequence
  chemically synthesized
acatacttgtcaacattggtta

SEQ ID NO: 845323 - DNA, 22 bp, Artificial Sequence
  chemically synthesized
cacatacttgtcaacattggtt

SEQ ID NO: 845324 - DNA, 22 bp, Artificial Sequence
  chemically synthesized
ttcacatacttgtcaacattgg

SEQ ID NO: 845325 - DNA, 22 bp, Artificial Sequence
  chemically synthesized
cttcacatacttgtcaacattg

SEQ ID NO: 845326 - DNA, 22 bp, Artificial Sequence
  chemically synthesized
tcttcacatacttgtcaacatt

SEQ ID NO: 845327 - DNA, 22 bp, Artificial Sequence
  chemically synthesized
ttcttcacatacttgtcaacat

SEQ ID NO: 845328 - DNA, 22 bp, Artificial Sequence
  chemically synthesized
tttcttcacatacttgtcaaca

SEQ ID NO: 845329 - DNA, 22 bp, Artificial Sequence
  chemically synthesized
ctttttcttcacatacttgtca

SEQ ID NO: 845330 - DNA, 22 bp, Artificial Sequence
  chemically synthesized
acaagtatgtgaagaaaaagga

SEQ ID NO: 845331 - DNA, 22 bp, Artificial Sequence
  chemically synthesized
caccaacagtatacaagggttc

SEQ ID NO: 845332 - DNA, 22 bp, Artificial Sequence
  chemically synthesized
ccaccaacagtatacaagggtt

SEQ ID NO: 845333 - DNA, 22 bp, Artificial Sequence
  chemically synthesized
catttccaccaacagtatacaa

SEQ ID NO: 845334 - DNA, 22 bp, Artificial Sequence
  chemically synthesized
acatttccaccaacagtataca

SEQ ID NO: 845335 - DNA, 22 bp, Artificial Sequence
  chemically synthesized
atttacatttccaccaacagta

SEQ ID NO: 845336 - DNA, 22 bp, Artificial Sequence
  chemically synthesized
tgctaatttacatttccaccaa

SEQ ID NO: 845337 - DNA, 22 bp, Artificial Sequence
  chemically synthesized
gtatactgttggtggaaatgta

SEQ ID NO: 845338 - DNA, 22 bp, Artificial Sequence
  chemically synthesized
tatactgttggtggaaatgtaa

SEQ ID NO: 845339 - DNA, 22 bp, Artificial Sequence
  chemically synthesized
catagtggttgtgctaatttac

SEQ ID NO: 845340 - DNA, 22 bp, Artificial Sequence
  chemically synthesized
ttggtggaaatgtaaattagca

SEQ ID NO: 845341 - DNA, 22 bp, Artificial Sequence
  chemically synthesized
tccatagtggttgtgctaattt

SEQ ID NO: 845342 - DNA, 22 bp, Artificial Sequence
  chemically synthesized
gtggaaatgtaaattagcacaa

SEQ ID NO: 845343 - DNA, 22 bp, Artificial Sequence
  chemically synthesized
caaacggttctccatagtggtt

SEQ ID NO: 845344 - DNA, 22 bp, Artificial Sequence
  chemically synthesized
gcacaaccactatggagaaccg

SEQ ID NO: 845345 - DNA, 22 bp, Artificial Sequence
  chemically synthesized
aggaacctccaaacggttctcc

SEQ ID NO: 845346 - DNA, 22 bp, Artificial Sequence
  chemically synthesized
gaggaacctccaaacggttctc

SEQ ID NO: 845347 - DNA, 22 bp, Artificial Sequence
  chemically synthesized
tgaggaacctccaaacggttct

SEQ ID NO: 845348 - DNA, 22 bp, Artificial Sequence
  chemically synthesized
ttgaggaacctccaaacggttc

SEQ ID NO: 845349 - DNA, 22 bp, Artificial Sequence
  chemically synthesized
tttgaggaacctccaaacggtt

SEQ ID NO: 845350 - DNA, 22 bp, Artificial Sequence
  chemically synthesized
gttttttgaggaacctccaaac

SEQ ID NO: 845351 - DNA, 22 bp, Artificial Sequence
  chemically synthesized
agttttttgaggaacctccaaa

SEQ ID NO: 845352 - DNA, 22 bp, Artificial Sequence
  chemically synthesized
tagttttttgaggaacctccaa

SEQ ID NO: 845353 - DNA, 22 bp, Artificial Sequence
  chemically synthesized
tggagaaccgtttggaggttcc

SEQ ID NO: 845354 - DNA, 22 bp, Artificial Sequence
  chemically synthesized
ttagttttttgaggaacctcca

SEQ ID NO: 845355 - DNA, 22 bp, Artificial Sequence
  chemically synthesized
tttttagttttttgaggaacct

SEQ ID NO: 845356 - DNA, 22 bp, Artificial Sequence
  chemically synthesized
tatttttagttttttgaggaac

SEQ ID NO: 845357 - DNA, 22 bp, Artificial Sequence
  chemically synthesized
ggaggttcctcaaaaaactaaa

SEQ ID NO: 845358 - DNA, 22 bp, Artificial Sequence
  chemically synthesized
gaggttcctcaaaaaactaaaa

SEQ ID NO: 845359 - DNA, 22 bp, Artificial Sequence
  chemically synthesized
tatggtagctctatttttagtt

SEQ ID NO: 845360 - DNA, 22 bp, Artificial Sequence
  chemically synthesized
ctcaaaaaactaaaaatagagc

SEQ ID NO: 845361 - DNA, 22 bp, Artificial Sequence
  chemically synthesized
tattatatggtagctctatttt

SEQ ID NO: 845362 - DNA, 22 bp, Artificial Sequence
  chemically synthesized
aaaaaactaaaaatagagctac

SEQ ID NO: 845363 - DNA, 22 bp, Artificial Sequence
  chemically synthesized
aaaatagagctaccatataata

SEQ ID NO: 845364 - DNA, 22 bp, Artificial Sequence
  chemically synthesized
ccatataatatagcattcccgc

SEQ ID NO: 845365 - DNA, 22 bp, Artificial Sequence
  chemically synthesized
ggtatatacccagcagcgggaa

SEQ ID NO: 845366 - DNA, 22 bp, Artificial Sequence
  chemically synthesized
gggtatatacccagcagcggga

SEQ ID NO: 845367 - DNA, 22 bp, Artificial Sequence
  chemically synthesized
tgggtatatacccagcagcggg

SEQ ID NO: 845368 - DNA, 22 bp, Artificial Sequence
  chemically synthesized
ttgggtatatacccagcagcgg

SEQ ID NO: 845369 - DNA, 22 bp, Artificial Sequence
  chemically synthesized
ttttgggtatatacccagcagc

SEQ ID NO: 845370 - DNA, 22 bp, Artificial Sequence
  chemically synthesized
cttttgggtatatacccagcag

SEQ ID NO: 845371 - DNA, 22 bp, Artificial Sequence
  chemically synthesized
tcttttgggtatatacccagca

SEQ ID NO: 845372 - DNA, 22 bp, Artificial Sequence
  chemically synthesized
ttttcttttgggtatataccca

SEQ ID NO: 845373 - DNA, 22 bp, Artificial Sequence
  chemically synthesized
attttcttttgggtatataccc

SEQ ID NO: 845374 - DNA, 22 bp, Artificial Sequence
  chemically synthesized
ccgctgctgggtatatacccaa

SEQ ID NO: 845375 - DNA, 22 bp, Artificial Sequence
  chemically synthesized
atttattttcttttgggtatat

SEQ ID NO: 845376 - DNA, 22 bp, Artificial Sequence
  chemically synthesized
ctgggtatatacccaaaagaaa

SEQ ID NO: 845377 - DNA, 22 bp, Artificial Sequence
  chemically synthesized
ggtatatacccaaaagaaaata

SEQ ID NO: 845378 - DNA, 22 bp, Artificial Sequence
  chemically synthesized
aatatactgatttattttcttt

SEQ ID NO: 845379 - DNA, 22 bp, Artificial Sequence
  chemically synthesized
caatatactgatttattttctt

SEQ ID NO: 845380 - DNA, 22 bp, Artificial Sequence
  chemically synthesized
ttcaatatactgatttattttc

SEQ ID NO: 845381 - DNA, 22 bp, Artificial Sequence
  chemically synthesized
caataaacatgggagtgcagat

SEQ ID NO: 845382 - DNA, 22 bp, Artificial Sequence
  chemically synthesized
aagagatatctgcactcccatg

SEQ ID NO: 845383 - DNA, 22 bp, Artificial Sequence
  chemically synthesized
tgaatagcgctgcaataaacat

SEQ ID NO: 845384 - DNA, 22 bp, Artificial Sequence
  chemically synthesized
ttgtgaatagcgctgcaataaa

SEQ ID NO: 845385 - DNA, 22 bp, Artificial Sequence
  chemically synthesized
cactcccatgtttattgcagcg

SEQ ID NO: 845386 - DNA, 22 bp, Artificial Sequence
  chemically synthesized
gctattgtgaatagcgctgcaa

SEQ ID NO: 845387 - DNA, 22 bp, Artificial Sequence
  chemically synthesized
ggctattgtgaatagcgctgca

SEQ ID NO: 845388 - DNA, 22 bp, Artificial Sequence
  chemically synthesized
ccatgtttattgcagcgctatt

SEQ ID NO: 845389 - DNA, 22 bp, Artificial Sequence
  chemically synthesized
caaatcttggctattgtgaata

SEQ ID NO: 845390 - DNA, 22 bp, Artificial Sequence
  chemically synthesized
ccaaatcttggctattgtgaat

SEQ ID NO: 845391 - DNA, 22 bp, Artificial Sequence
  chemically synthesized
attgcagcgctattcacaatag

SEQ ID NO: 845392 - DNA, 22 bp, Artificial Sequence
  chemically synthesized
ttgcagcgctattcacaatagc

SEQ ID NO: 845393 - DNA, 22 bp, Artificial Sequence
  chemically synthesized
cttccaaatcttggctattgtg

SEQ ID NO: 845394 - DNA, 22 bp, Artificial Sequence
  chemically synthesized
cagcgctattcacaatagccaa

SEQ ID NO: 845395 - DNA, 22 bp, Artificial Sequence
  chemically synthesized
ggttgcttccaaatcttggcta

SEQ ID NO: 845396 - DNA, 22 bp, Artificial Sequence
  chemically synthesized
aggttgcttccaaatcttggct

SEQ ID NO: 845397 - DNA, 22 bp, Artificial Sequence
  chemically synthesized
ttcacaatagccaagatttgga

SEQ ID NO: 845398 - DNA, 22 bp, Artificial Sequence
  chemically synthesized
acaatagccaagatttggaagc

SEQ ID NO: 845399 - DNA, 22 bp, Artificial Sequence
  chemically synthesized
atggacacttaggttgcttcca

SEQ ID NO: 845400 - DNA, 22 bp, Artificial Sequence
  chemically synthesized
ctgatggacacttaggttgctt

SEQ ID NO: 845401 - DNA, 22 bp, Artificial Sequence
  chemically synthesized
atctactgatggacacttaggt

SEQ ID NO: 845402 - DNA, 22 bp, Artificial Sequence
  chemically synthesized
ggaagcaacctaagtgtccatc

SEQ ID NO: 845403 - DNA, 22 bp, Artificial Sequence
  chemically synthesized
gaagcaacctaagtgtccatca

SEQ ID NO: 845404 - DNA, 22 bp, Artificial Sequence
  chemically synthesized
tccattcatctactgatggaca

SEQ ID NO: 845405 - DNA, 22 bp, Artificial Sequence
  chemically synthesized
gtccattcatctactgatggac

SEQ ID NO: 845406 - DNA, 22 bp, Artificial Sequence
  chemically synthesized
tgtccattcatctactgatgga

SEQ ID NO: 845407 - DNA, 22 bp, Artificial Sequence
  chemically synthesized
tttgtccattcatctactgatg

SEQ ID NO: 845408 - DNA, 22 bp, Artificial Sequence
  chemically synthesized
agtgtccatcagtagatgaatg

SEQ ID NO: 845409 - DNA, 22 bp, Artificial Sequence
  chemically synthesized
tgcataggtaccacatgttctt

SEQ ID NO: 845410 - DNA, 22 bp, Artificial Sequence
  chemically synthesized
cattgtgcataggtaccacatg

SEQ ID NO: 845411 - DNA, 22 bp, Artificial Sequence
  chemically synthesized
agtagtattccattgtgcatag

SEQ ID NO: 845412 - DNA, 22 bp, Artificial Sequence
  chemically synthesized
tggctgagtagtattccattgt

SEQ ID NO: 845413 - DNA, 22 bp, Artificial Sequence
  chemically synthesized
gtggctgagtagtattccattg

SEQ ID NO: 845414 - DNA, 22 bp, Artificial Sequence
  chemically synthesized
tgtggctgagtagtattccatt

SEQ ID NO: 845415 - DNA, 22 bp, Artificial Sequence
  chemically synthesized
ttgtggctgagtagtattccat

SEQ ID NO: 845416 - DNA, 22 bp, Artificial Sequence
  chemically synthesized
tttgtggctgagtagtattcca

SEQ ID NO: 845417 - DNA, 22 bp, Artificial Sequence
  chemically synthesized
ttttgtggctgagtagtattcc

SEQ ID NO: 845418 - DNA, 22 bp, Artificial Sequence
  chemically synthesized
ttttttgtggctgagtagtatt

SEQ ID NO: 845419 - DNA, 22 bp, Artificial Sequence
  chemically synthesized
tgcacaatggaatactactcag

SEQ ID NO: 845420 - DNA, 22 bp, Artificial Sequence
  chemically synthesized
attcttttttgtggctgagtag

SEQ ID NO: 845421 - DNA, 22 bp, Artificial Sequence
  chemically synthesized
ctcagccacaaaaaagaatgag

SEQ ID NO: 845422 - DNA, 22 bp, Artificial Sequence
  chemically synthesized
cagatgacagaatctcattctt

SEQ ID NO: 845423 - DNA, 22 bp, Artificial Sequence
  chemically synthesized
agccacaaaaaagaatgagatt

SEQ ID NO: 845424 - DNA, 22 bp, Artificial Sequence
  chemically synthesized
ttgcagatgacagaatctcatt

SEQ ID NO: 845425 - DNA, 22 bp, Artificial Sequence
  chemically synthesized
caacaatgttgttgcagatgac

SEQ ID NO: 845426 - DNA, 22 bp, Artificial Sequence
  chemically synthesized
ccaacaatgttgttgcagatga

SEQ ID NO: 845427 - DNA, 22 bp, Artificial Sequence
  chemically synthesized
catttccaacaatgttgttgca

SEQ ID NO: 845428 - DNA, 22 bp, Artificial Sequence
  chemically synthesized
tgtcatctgcaacaacattgtt

SEQ ID NO: 845429 - DNA, 22 bp, Artificial Sequence
  chemically synthesized
acctccatttccaacaatgttg

SEQ ID NO: 845430 - DNA, 22 bp, Artificial Sequence
  chemically synthesized
tcatctgcaacaacattgttgg

SEQ ID NO: 845431 - DNA, 22 bp, Artificial Sequence
  chemically synthesized
gcatactgacctccatttccaa

SEQ ID NO: 845432 - DNA, 22 bp, Artificial Sequence
  chemically synthesized
caacaacattgttggaaatgga

SEQ ID NO: 845433 - DNA, 22 bp, Artificial Sequence
  chemically synthesized
acctagcatactgacctccatt

SEQ ID NO: 845434 - DNA, 22 bp, Artificial Sequence
  chemically synthesized
cacctagcatactgacctccat

SEQ ID NO: 845435 - DNA, 22 bp, Artificial Sequence
  chemically synthesized
tttcacctagcatactgacctc

SEQ ID NO: 845436 - DNA, 22 bp, Artificial Sequence
  chemically synthesized
atttcacctagcatactgacct

SEQ ID NO: 845437 - DNA, 22 bp, Artificial Sequence
  chemically synthesized
ttggaaatggaggtcagtatgc

SEQ ID NO: 845438 - DNA, 22 bp, Artificial Sequence
  chemically synthesized
atttatttcacctagcatactg

SEQ ID NO: 845439 - DNA, 22 bp, Artificial Sequence
  chemically synthesized
gaaatggaggtcagtatgctag

SEQ ID NO: 845440 - DNA, 22 bp, Artificial Sequence
  chemically synthesized
tgtctgatttatttcacctagc

SEQ ID NO: 845441 - DNA, 22 bp, Artificial Sequence
  chemically synthesized
tgtgtctgatttatttcaccta

SEQ ID NO: 845442 - DNA, 22 bp, Artificial Sequence
  chemically synthesized
ctgtgtctgatttatttcacct

SEQ ID NO: 845443 - DNA, 22 bp, Artificial Sequence
  chemically synthesized
tctgtgtctgatttatttcacc

SEQ ID NO: 845444 - DNA, 22 bp, Artificial Sequence
  chemically synthesized
tctttctgtgtctgatttattt

SEQ ID NO: 845445 - DNA, 22 bp, Artificial Sequence
  chemically synthesized
gtctttctgtgtctgatttatt

SEQ ID NO: 845446 - DNA, 22 bp, Artificial Sequence
  chemically synthesized
ggtgaaataaatcagacacaga

SEQ ID NO: 845447 - DNA, 22 bp, Artificial Sequence
  chemically synthesized
aatcccacaaataagtgagaac

SEQ ID NO: 845448 - DNA, 22 bp, Artificial Sequence
  chemically synthesized
aaatcccacaaataagtgagaa

SEQ ID NO: 845449 - DNA, 22 bp, Artificial Sequence
  chemically synthesized
taaatcccacaaataagtgaga

SEQ ID NO: 845450 - DNA, 22 bp, Artificial Sequence
  chemically synthesized
aattttaaatcccacaaataag

SEQ ID NO: 845451 - DNA, 22 bp, Artificial Sequence
  chemically synthesized
gaattttaaatcccacaaataa

SEQ ID NO: 845452 - DNA, 22 bp, Artificial Sequence
  chemically synthesized
catgttctcacttatttgtggg

SEQ ID NO: 845453 - DNA, 22 bp, Artificial Sequence
  chemically synthesized
tgaattttaaatcccacaaata

SEQ ID NO: 845454 - DNA, 22 bp, Artificial Sequence
  chemically synthesized
ttttgaattttaaatcccacaa

SEQ ID NO: 845455 - DNA, 22 bp, Artificial Sequence
  chemically synthesized
tcacttatttgtgggatttaaa

SEQ ID NO: 845456 - DNA, 22 bp, Artificial Sequence
  chemically synthesized
aattgttttgaattttaaatcc

SEQ ID NO: 845457 - DNA, 22 bp, Artificial Sequence
  chemically synthesized
acttatttgtgggatttaaaat

SEQ ID NO: 845458 - DNA, 22 bp, Artificial Sequence
  chemically synthesized
atttgtgggatttaaaattcaa

SEQ ID NO: 845459 - DNA, 22 bp, Artificial Sequence
  chemically synthesized
tttgtgggatttaaaattcaaa

SEQ ID NO: 845460 - DNA, 22 bp, Artificial Sequence
  chemically synthesized
gtgggatttaaaattcaaaaca

SEQ ID NO: 845461 - DNA, 22 bp, Artificial Sequence
  chemically synthesized
tgggatttaaaattcaaaacaa

SEQ ID NO: 845462 - DNA, 22 bp, Artificial Sequence
  chemically synthesized
tgtccatgagttcaattgtttt

SEQ ID NO: 845463 - DNA, 22 bp, Artificial Sequence
  chemically synthesized
tatgtccatgagttcaattgtt

SEQ ID NO: 845464 - DNA, 22 bp, Artificial Sequence
  chemically synthesized
tctatgtccatgagttcaattg

SEQ ID NO: 845465 - DNA, 22 bp, Artificial Sequence
  chemically synthesized
aaaattcaaaacaattgaactc

SEQ ID NO: 845466 - DNA, 22 bp, Artificial Sequence
  chemically synthesized
aaattcaaaacaattgaactca

SEQ ID NO: 845467 - DNA, 22 bp, Artificial Sequence
  chemically synthesized
ctctctatgtccatgagttcaa

SEQ ID NO: 845468 - DNA, 22 bp, Artificial Sequence
  chemically synthesized
tactctctatgtccatgagttc

SEQ ID NO: 845469 - DNA, 22 bp, Artificial Sequence
  chemically synthesized
ctactctctatgtccatgagtt

SEQ ID NO: 845470 - DNA, 22 bp, Artificial Sequence
  chemically synthesized
aaaacaattgaactcatggaca

SEQ ID NO: 845471 - DNA, 22 bp, Artificial Sequence
  chemically synthesized
aactcatggacatagagagtag

SEQ ID NO: 845472 - DNA, 22 bp, Artificial Sequence
  chemically synthesized
aggtaaccatccttctactctc

SEQ ID NO: 845473 - DNA, 22 bp, Artificial Sequence
  chemically synthesized
atggacatagagagtagaagga

SEQ ID NO: 845474 - DNA, 22 bp, Artificial Sequence
  chemically synthesized
ccatcctcaggtaaccatcctt

SEQ ID NO: 845475 - DNA, 22 bp, Artificial Sequence
  chemically synthesized
cccatcctcaggtaaccatcct

SEQ ID NO: 845476 - DNA, 22 bp, Artificial Sequence
  chemically synthesized
cccacgacccttcccatcctca

SEQ ID NO: 845477 - DNA, 22 bp, Artificial Sequence
  chemically synthesized
cctgaggatgggaagggtcgtg

SEQ ID NO: 845478 - DNA, 22 bp, Artificial Sequence
  chemically synthesized
aggatgggaagggtcgtgggga

SEQ ID NO: 845479 - DNA, 22 bp, Artificial Sequence
  chemically synthesized
caccacccccacctccccacga

SEQ ID NO: 845480 - DNA, 22 bp, Artificial Sequence
  chemically synthesized
tacctacaccacccccacctcc

SEQ ID NO: 845481 - DNA, 22 bp, Artificial Sequence
  chemically synthesized
tacccagtaactatacctacac

SEQ ID NO: 845482 - DNA, 22 bp, Artificial Sequence
  chemically synthesized
gtacccagtaactatacctaca

SEQ ID NO: 845483 - DNA, 22 bp, Artificial Sequence
  chemically synthesized
tgtacccagtaactatacctac

SEQ ID NO: 845484 - DNA, 22 bp, Artificial Sequence
  chemically synthesized
ttgtacccagtaactataccta

SEQ ID NO: 845485 - DNA, 22 bp, Artificial Sequence
  chemically synthesized
tttgtacccagtaactatacct

SEQ ID NO: 845486 - DNA, 22 bp, Artificial Sequence
  chemically synthesized
attttttgtacccagtaactat

SEQ ID NO: 845487 - DNA, 22 bp, Artificial Sequence
  chemically synthesized
actaattttttgtacccagtaa

SEQ ID NO: 845488 - DNA, 22 bp, Artificial Sequence
  chemically synthesized
taactaattttttgtacccagt

SEQ ID NO: 845489 - DNA, 22 bp, Artificial Sequence
  chemically synthesized
ctaactaattttttgtacccag

SEQ ID NO: 845490 - DNA, 22 bp, Artificial Sequence
  chemically synthesized
tctaactaattttttgtaccca

SEQ ID NO: 845491 - DNA, 22 bp, Artificial Sequence
  chemically synthesized
tttctaactaattttttgtacc

SEQ ID NO: 845492 - DNA, 22 bp, Artificial Sequence
  chemically synthesized
attctttctaactaattttttg

SEQ ID NO: 845493 - DNA, 22 bp, Artificial Sequence
  chemically synthesized
ctcattctttctaactaatttt

SEQ ID NO: 845494 - DNA, 22 bp, Artificial Sequence
  chemically synthesized
actcattctttctaactaattt

SEQ ID NO: 845495 - DNA, 22 bp, Artificial Sequence
  chemically synthesized
ctgggtacaaaaaattagttag

SEQ ID NO: 845496 - DNA, 22 bp, Artificial Sequence
  chemically synthesized
ggtacaaaaaattagttagaaa

SEQ ID NO: 845497 - DNA, 22 bp, Artificial Sequence
  chemically synthesized
tcaaatagtaggtcttactcat

SEQ ID NO: 845498 - DNA, 22 bp, Artificial Sequence
  chemically synthesized
gttagaaagaatgagtaagacc

SEQ ID NO: 845499 - DNA, 22 bp, Artificial Sequence
  chemically synthesized
tgctatcaaatagtaggtctta

SEQ ID NO: 845500 - DNA, 22 bp, Artificial Sequence
  chemically synthesized
gaaagaatgagtaagacctact

SEQ ID NO: 845501 - DNA, 22 bp, Artificial Sequence
  chemically synthesized
ttgtgctatcaaatagtaggtc

SEQ ID NO: 845502 - DNA, 22 bp, Artificial Sequence
  chemically synthesized
tagtccccctgttgtgctatca

SEQ ID NO: 845503 - DNA, 22 bp, Artificial Sequence
  chemically synthesized
gttatagtccccctgttgtgct

SEQ ID NO: 845504 - DNA, 22 bp, Artificial Sequence
  chemically synthesized
ctatttgatagcacaacagggg

SEQ ID NO: 845505 - DNA, 22 bp, Artificial Sequence
  chemically synthesized
ttggttatagtccccctgttgt

SEQ ID NO: 845506 - DNA, 22 bp, Artificial Sequence
  chemically synthesized
tttgatagcacaacagggggac

SEQ ID NO: 845507 - DNA, 22 bp, Artificial Sequence
  chemically synthesized
gatagcacaacagggggactat

SEQ ID NO: 845508 - DNA, 22 bp, Artificial Sequence
  chemically synthesized
atagcacaacagggggactata

SEQ ID NO: 845509 - DNA, 22 bp, Artificial Sequence
  chemically synthesized
aatcattattggttatagtccc

SEQ ID NO: 845510 - DNA, 22 bp, Artificial Sequence
  chemically synthesized
atgtaaaatgtacaattaaatc

SEQ ID NO: 845511 - DNA, 22 bp, Artificial Sequence
  chemically synthesized
taaccaataatgatttaattgt

SEQ ID NO: 845512 - DNA, 22 bp, Artificial Sequence
  chemically synthesized
attaatgtaaaatgtacaatta

SEQ ID NO: 845513 - DNA, 22 bp, Artificial Sequence
  chemically synthesized
aattaatgtaaaatgtacaatt

SEQ ID NO: 845514 - DNA, 22 bp, Artificial Sequence
  chemically synthesized
taattaatgtaaaatgtacaat

SEQ ID NO: 845515 - DNA, 22 bp, Artificial Sequence
  chemically synthesized
ttaattaatgtaaaatgtacaa

SEQ ID NO: 845516 - DNA, 22 bp, Artificial Sequence
  chemically synthesized
ttttaattaatgtaaaatgtac

SEQ ID NO: 845517 - DNA, 22 bp, Artificial Sequence
  chemically synthesized
tactcttttaattaatgtaaaa

SEQ ID NO: 845518 - DNA, 22 bp, Artificial Sequence
  chemically synthesized
aattgtacattttacattaatt

SEQ ID NO: 845519 - DNA, 22 bp, Artificial Sequence
  chemically synthesized
attgtacattttacattaatta

SEQ ID NO: 845520 - DNA, 22 bp, Artificial Sequence
  chemically synthesized
tacattttacattaattaaaag

SEQ ID NO: 845521 - DNA, 22 bp, Artificial Sequence
  chemically synthesized
tacattaattaaaagagtataa

SEQ ID NO: 845522 - DNA, 22 bp, Artificial Sequence
  chemically synthesized
caaacaatccaattatactctt

SEQ ID NO: 845523 - DNA, 22 bp, Artificial Sequence
  chemically synthesized
acattaattaaaagagtataat

SEQ ID NO: 845524 - DNA, 22 bp, Artificial Sequence
  chemically synthesized
cattaattaaaagagtataatt

SEQ ID NO: 845525 - DNA, 22 bp, Artificial Sequence
  chemically synthesized
tgttccaaacaatccaattata

SEQ ID NO: 845526 - DNA, 22 bp, Artificial Sequence
  chemically synthesized
atgttccaaacaatccaattat

SEQ ID NO: 845527 - DNA, 22 bp, Artificial Sequence
  chemically synthesized
attaaaagagtataattggatt

SEQ ID NO: 845528 - DNA, 22 bp, Artificial Sequence
  chemically synthesized
tatgttccaaacaatccaatta

SEQ ID NO: 845529 - DNA, 22 bp, Artificial Sequence
  chemically synthesized
tttatgttccaaacaatccaat

SEQ ID NO: 845530 - DNA, 22 bp, Artificial Sequence
  chemically synthesized
aaagagtataattggattgttt

SEQ ID NO: 845531 - DNA, 22 bp, Artificial Sequence
  chemically synthesized
ttctttatgttccaaacaatcc

SEQ ID NO: 845532 - DNA, 22 bp, Artificial Sequence
  chemically synthesized
attctttatgttccaaacaatc

SEQ ID NO: 845533 - DNA, 22 bp, Artificial Sequence
  chemically synthesized
aagcatttattctttatgttcc

SEQ ID NO: 845534 - DNA, 22 bp, Artificial Sequence
  chemically synthesized
gattgtttggaacataaagaat

SEQ ID NO: 845535 - DNA, 22 bp, Artificial Sequence
  chemically synthesized
aacccctcaagcatttattctt

SEQ ID NO: 845536 - DNA, 22 bp, Artificial Sequence
  chemically synthesized
tttggaacataaagaataaatg

SEQ ID NO: 845537 - DNA, 22 bp, Artificial Sequence
  chemically synthesized
ggaacataaagaataaatgctt

SEQ ID NO: 845538 - DNA, 22 bp, Artificial Sequence
  chemically synthesized
gaacataaagaataaatgcttg

SEQ ID NO: 845539 - DNA, 22 bp, Artificial Sequence
  chemically synthesized
gaggggttgaataccccatttt

SEQ ID NO: 845540 - DNA, 22 bp, Artificial Sequence
  chemically synthesized
aggggttgaataccccatttta

SEQ ID NO: 845541 - DNA, 22 bp, Artificial Sequence
  chemically synthesized
aataccccattttacatgatgt

SEQ ID NO: 845542 - DNA, 22 bp, Artificial Sequence
  chemically synthesized
tacatgatgtgcttactacaca

SEQ ID NO: 845543 - DNA, 22 bp, Artificial Sequence
  chemically synthesized
acatgatgtgcttactacacat

SEQ ID NO: 845544 - DNA, 22 bp, Artificial Sequence
  chemically synthesized
catgatgtgcttactacacatt

SEQ ID NO: 845545 - DNA, 22 bp, Artificial Sequence
  chemically synthesized
atacaggcatgcaatgtgtagt

SEQ ID NO: 845546 - DNA, 22 bp, Artificial Sequence
  chemically synthesized
gatacaggcatgcaatgtgtag

SEQ ID NO: 845547 - DNA, 22 bp, Artificial Sequence
  chemically synthesized
tgatacaggcatgcaatgtgta

SEQ ID NO: 845548 - DNA, 22 bp, Artificial Sequence
  chemically synthesized
agatgttttgatacaggcatgc

SEQ ID NO: 845549 - DNA, 22 bp, Artificial Sequence
  chemically synthesized
gagatgttttgatacaggcatg

SEQ ID NO: 845550 - DNA, 22 bp, Artificial Sequence
  chemically synthesized
actacacattgcatgcctgtat

SEQ ID NO: 845551 - DNA, 22 bp, Artificial Sequence
  chemically synthesized
ctacacattgcatgcctgtatc

SEQ ID NO: 845552 - DNA, 22 bp, Artificial Sequence
  chemically synthesized
cacattgcatgcctgtatcaaa

SEQ ID NO: 845553 - DNA, 22 bp, Artificial Sequence
  chemically synthesized
gtacttgagatgttttgataca

SEQ ID NO: 845554 - DNA, 22 bp, Artificial Sequence
  chemically synthesized
ggtacttgagatgttttgatac

SEQ ID NO: 845555 - DNA, 22 bp, Artificial Sequence
  chemically synthesized
tttggtacttgagatgttttga

SEQ ID NO: 845556 - DNA, 22 bp, Artificial Sequence
  chemically synthesized
atttggtacttgagatgttttg

SEQ ID NO: 845557 - DNA, 22 bp, Artificial Sequence
  chemically synthesized
catgcctgtatcaaaacatctc

SEQ ID NO: 845558 - DNA, 22 bp, Artificial Sequence
  chemically synthesized
tatcaaaacatctcaagtacca

SEQ ID NO: 845559 - DNA, 22 bp, Artificial Sequence
  chemically synthesized
gcaggtgtatatatttatttgg

SEQ ID NO: 845560 - DNA, 22 bp, Artificial Sequence
  chemically synthesized
aagtaccaaataaatatataca

SEQ ID NO: 845561 - DNA, 22 bp, Artificial Sequence
  chemically synthesized
tgagtacctagcaggtgtatat

SEQ ID NO: 845562 - DNA, 22 bp, Artificial Sequence
  chemically synthesized
gtgagtacctagcaggtgtata

SEQ ID NO: 845563 - DNA, 22 bp, Artificial Sequence
  chemically synthesized
tgtgagtacctagcaggtgtat

SEQ ID NO: 845564 - DNA, 22 bp, Artificial Sequence
  chemically synthesized
agttttgtgagtacctagcagg

SEQ ID NO: 845565 - DNA, 22 bp, Artificial Sequence
  chemically synthesized
aagttttgtgagtacctagcag

SEQ ID NO: 845566 - DNA, 22 bp, Artificial Sequence
  chemically synthesized
taagttttgtgagtacctagca

SEQ ID NO: 845567 - DNA, 22 bp, Artificial Sequence
  chemically synthesized
ttaagttttgtgagtacctagc

SEQ ID NO: 845568 - DNA, 22 bp, Artificial Sequence
  chemically synthesized
tatttttaagttttgtgagtac

SEQ ID NO: 845569 - DNA, 22 bp, Artificial Sequence
  chemically synthesized
atatttttaagttttgtgagta

SEQ ID NO: 845570 - DNA, 22 bp, Artificial Sequence
  chemically synthesized
tatatttttaagttttgtgagt

SEQ ID NO: 845571 - DNA, 22 bp, Artificial Sequence
  chemically synthesized
ttatatttttaagttttgtgag

SEQ ID NO: 845572 - DNA, 22 bp, Artificial Sequence
  chemically synthesized
tttttatatttttaagttttgt

SEQ ID NO: 845573 - DNA, 22 bp, Artificial Sequence
  chemically synthesized
atttttatatttttaagttttg

SEQ ID NO: 845574 - DNA, 22 bp, Artificial Sequence
  chemically synthesized
ctaggtactcacaaaacttaaa

SEQ ID NO: 845575 - DNA, 22 bp, Artificial Sequence
  chemically synthesized
tatttttatatttttaagtttt

SEQ ID NO: 845576 - DNA, 22 bp, Artificial Sequence
  chemically synthesized
ggtactcacaaaacttaaaaat

SEQ ID NO: 845577 - DNA, 22 bp, Artificial Sequence
  chemically synthesized
ttttatttttatatttttaagt

SEQ ID NO: 845578 - DNA, 22 bp, Artificial Sequence
  chemically synthesized
gttttatttttatatttttaag

SEQ ID NO: 845579 - DNA, 22 bp, Artificial Sequence
  chemically synthesized
tgttttatttttatatttttaa

SEQ ID NO: 845580 - DNA, 22 bp, Artificial Sequence
  chemically synthesized
ttgttttatttttatattttta

SEQ ID NO: 845581 - DNA, 22 bp, Artificial Sequence
  chemically synthesized
tttgttttatttttatattttt

SEQ ID NO: 845582 - DNA, 22 bp, Artificial Sequence
  chemically synthesized
tttttgttttatttttatattt

SEQ ID NO: 845583 - DNA, 22 bp, Artificial Sequence
  chemically synthesized
acaaaacttaaaaatataaaaa

SEQ ID NO: 845584 - DNA, 22 bp, Artificial Sequence
  chemically synthesized
ctttttgttttatttttatatt

SEQ ID NO: 845585 - DNA, 22 bp, Artificial Sequence
  chemically synthesized
tttctttttgttttatttttat

SEQ ID NO: 845586 - DNA, 22 bp, Artificial Sequence
  chemically synthesized
gtttctttttgttttattttta

SEQ ID NO: 845587 - DNA, 22 bp, Artificial Sequence
  chemically synthesized
cttgtttctttttgttttattt

SEQ ID NO: 845588 - DNA, 22 bp, Artificial Sequence
  chemically synthesized
aaaaatataaaaataaaacaaa

SEQ ID NO: 845589 - DNA, 22 bp, Artificial Sequence
  chemically synthesized
aaaatataaaaataaaacaaaa

SEQ ID NO: 845590 - DNA, 22 bp, Artificial Sequence
  chemically synthesized
attacttgtttctttttgtttt

SEQ ID NO: 845591 - DNA, 22 bp, Artificial Sequence
  chemically synthesized
taattacttgtttctttttgtt

SEQ ID NO: 845592 - DNA, 22 bp, Artificial Sequence
  chemically synthesized
attctaattacttgtttctttt

SEQ ID NO: 845593 - DNA, 22 bp, Artificial Sequence
  chemically synthesized
tgattctaattacttgtttctt

SEQ ID NO: 845594 - DNA, 22 bp, Artificial Sequence
  chemically synthesized
ctgattctaattacttgtttct

SEQ ID NO: 845595 - DNA, 22 bp, Artificial Sequence
  chemically synthesized
cacacatttctgattctaatta

SEQ ID NO: 845596 - DNA, 22 bp, Artificial Sequence
  chemically synthesized
ccacacatttctgattctaatt

SEQ ID NO: 845597 - DNA, 22 bp, Artificial Sequence
  chemically synthesized
gcaatttccacacatttctgat

SEQ ID NO: 845598 - DNA, 22 bp, Artificial Sequence
  chemically synthesized
tagcaatttccacacatttctg

SEQ ID NO: 845599 - DNA, 22 bp, Artificial Sequence
  chemically synthesized
gaatcagaaatgtgtggaaatt

SEQ ID NO: 845600 - DNA, 22 bp, Artificial Sequence
  chemically synthesized
gaaaaggaacatgtgttctagc

SEQ ID NO: 845601 - DNA, 22 bp, Artificial Sequence
  chemically synthesized
agaaaaggaacatgtgttctag

SEQ ID NO: 845602 - DNA, 22 bp, Artificial Sequence
  chemically synthesized
cttagaaaaggaacatgtgttc

SEQ ID NO: 845603 - DNA, 22 bp, Artificial Sequence
  chemically synthesized
ctagaacacatgttccttttct

SEQ ID NO: 845604 - DNA, 22 bp, Artificial Sequence
  chemically synthesized
ataaatactgcttagaaaagga

SEQ ID NO: 845605 - DNA, 22 bp, Artificial Sequence
  chemically synthesized
gaacacatgttccttttctaag

SEQ ID NO: 845606 - DNA, 22 bp, Artificial Sequence
  chemically synthesized
taatactgataaatactgctta

SEQ ID NO: 845607 - DNA, 22 bp, Artificial Sequence
  chemically synthesized
ataatactgataaatactgctt

SEQ ID NO: 845608 - DNA, 22 bp, Artificial Sequence
  chemically synthesized
tataatactgataaatactgct

SEQ ID NO: 845609 - DNA, 22 bp, Artificial Sequence
  chemically synthesized
ttataatactgataaatactgc

SEQ ID NO: 845610 - DNA, 22 bp, Artificial Sequence
  chemically synthesized
cttttctaagcagtatttatca

SEQ ID NO: 845611 - DNA, 22 bp, Artificial Sequence
  chemically synthesized
ttctaagcagtatttatcagta

SEQ ID NO: 845612 - DNA, 22 bp, Artificial Sequence
  chemically synthesized
tctaagcagtatttatcagtat

SEQ ID NO: 845613 - DNA, 22 bp, Artificial Sequence
  chemically synthesized
ctaagcagtatttatcagtatt

SEQ ID NO: 845614 - DNA, 22 bp, Artificial Sequence
  chemically synthesized
taagcagtatttatcagtatta

SEQ ID NO: 845615 - DNA, 22 bp, Artificial Sequence
  chemically synthesized
agcagtatttatcagtattata

SEQ ID NO: 845616 - DNA, 22 bp, Artificial Sequence
  chemically synthesized
gccaaatgatcagtgattttta

SEQ ID NO: 845617 - DNA, 22 bp, Artificial Sequence
  chemically synthesized
atcagtattataaaaatcactg

SEQ ID NO: 845618 - DNA, 22 bp, Artificial Sequence
  chemically synthesized
tcagtattataaaaatcactga

SEQ ID NO: 845619 - DNA, 22 bp, Artificial Sequence
  chemically synthesized
aagctagccaaatgatcagtga

SEQ ID NO: 845620 - DNA, 22 bp, Artificial Sequence
  chemically synthesized
aaagctagccaaatgatcagtg

SEQ ID NO: 845621 - DNA, 22 bp, Artificial Sequence
  chemically synthesized
taaagctagccaaatgatcagt

SEQ ID NO: 845622 - DNA, 22 bp, Artificial Sequence
  chemically synthesized
ttaaagctagccaaatgatcag

SEQ ID NO: 845623 - DNA, 22 bp, Artificial Sequence
  chemically synthesized
taaaaatcactgatcatttggc

SEQ ID NO: 845624 - DNA, 22 bp, Artificial Sequence
  chemically synthesized
tttttaaagctagccaaatgat

SEQ ID NO: 845625 - DNA, 22 bp, Artificial Sequence
  chemically synthesized
atttttaaagctagccaaatga

SEQ ID NO: 845626 - DNA, 22 bp, Artificial Sequence
  chemically synthesized
tatttttaaagctagccaaatg

SEQ ID NO: 845627 - DNA, 22 bp, Artificial Sequence
  chemically synthesized
ttatttttaaagctagccaaat

SEQ ID NO: 845628 - DNA, 22 bp, Artificial Sequence
  chemically synthesized
tttatttttaaagctagccaaa

SEQ ID NO: 845629 - DNA, 22 bp, Artificial Sequence
  chemically synthesized
atcatttggctagctttaaaaa

SEQ ID NO: 845630 - DNA, 22 bp, Artificial Sequence
  chemically synthesized
tcatattttttatttttaaagc

SEQ ID NO: 845631 - DNA, 22 bp, Artificial Sequence
  chemically synthesized
ggctagctttaaaaataaaaaa

SEQ ID NO: 845632 - DNA, 22 bp, Artificial Sequence
  chemically synthesized
gctagctttaaaaataaaaaat

SEQ ID NO: 845633 - DNA, 22 bp, Artificial Sequence
  chemically synthesized
aacagctatcatattttttatt

SEQ ID NO: 845634 - DNA, 22 bp, Artificial Sequence
  chemically synthesized
aaacagctatcatattttttat

SEQ ID NO: 845635 - DNA, 22 bp, Artificial Sequence
  chemically synthesized
ttaaacagctatcatatttttt

SEQ ID NO: 845636 - DNA, 22 bp, Artificial Sequence
  chemically synthesized
gctttaaaaataaaaaatatga

SEQ ID NO: 845637 - DNA, 22 bp, Artificial Sequence
  chemically synthesized
cttaaacagctatcatattttt

SEQ ID NO: 845638 - DNA, 22 bp, Artificial Sequence
  chemically synthesized
taaaaataaaaaatatgatagc

SEQ ID NO: 845639 - DNA, 22 bp, Artificial Sequence
  chemically synthesized
aaaaataaaaaatatgatagct

SEQ ID NO: 845640 - DNA, 22 bp, Artificial Sequence
  chemically synthesized
aaaataaaaaatatgatagctg

SEQ ID NO: 845641 - DNA, 22 bp, Artificial Sequence
  chemically synthesized
ataatgatttcttaaacagcta

SEQ ID NO: 845642 - DNA, 22 bp, Artificial Sequence
  chemically synthesized
aatagctaataatgatttctta

SEQ ID NO: 845643 - DNA, 22 bp, Artificial Sequence
  chemically synthesized
gaatagctaataatgatttctt

SEQ ID NO: 845644 - DNA, 22 bp, Artificial Sequence
  chemically synthesized
agtttgaatagctaataatgat

SEQ ID NO: 845645 - DNA, 22 bp, Artificial Sequence
  chemically synthesized
aagtttgaatagctaataatga

SEQ ID NO: 845646 - DNA, 22 bp, Artificial Sequence
  chemically synthesized
taagtttgaatagctaataatg

SEQ ID NO: 845647 - DNA, 22 bp, Artificial Sequence
  chemically synthesized
ttaagtttgaatagctaataat

SEQ ID NO: 845648 - DNA, 22 bp, Artificial Sequence
  chemically synthesized
tttaagaaatcattattagcta

SEQ ID NO: 845649 - DNA, 22 bp, Artificial Sequence
  chemically synthesized
tttaagtttgaatagctaataa

SEQ ID NO: 845650 - DNA, 22 bp, Artificial Sequence
  chemically synthesized
aagaaatcattattagctattc

SEQ ID NO: 845651 - DNA, 22 bp, Artificial Sequence
  chemically synthesized
ttttttaagtttgaatagctaa

SEQ ID NO: 845652 - DNA, 22 bp, Artificial Sequence
  chemically synthesized
agaaatcattattagctattca

SEQ ID NO: 845653 - DNA, 22 bp, Artificial Sequence
  chemically synthesized
ttgttttttaagtttgaatagc

SEQ ID NO: 845654 - DNA, 22 bp, Artificial Sequence
  chemically synthesized
attgttttttaagtttgaatag

SEQ ID NO: 845655 - DNA, 22 bp, Artificial Sequence
  chemically synthesized
tcttattgttttttaagtttga

SEQ ID NO: 845656 - DNA, 22 bp, Artificial Sequence
  chemically synthesized
ttagctattcaaacttaaaaaa

SEQ ID NO: 845657 - DNA, 22 bp, Artificial Sequence
  chemically synthesized
actgtcttattgttttttaagt

SEQ ID NO: 845658 - DNA, 22 bp, Artificial Sequence
  chemically synthesized
gctattcaaacttaaaaaacaa

SEQ ID NO: 845659 - DNA, 22 bp, Artificial Sequence
  chemically synthesized
actgactgtcttattgtttttt

SEQ ID NO: 845660 - DNA, 22 bp, Artificial Sequence
  chemically synthesized
cactgactgtcttattgttttt

SEQ ID NO: 845661 - DNA, 22 bp, Artificial Sequence
  chemically synthesized
ttcaaacttaaaaaacaataag

SEQ ID NO: 845662 - DNA, 22 bp, Artificial Sequence
  chemically synthesized
aaacttaaaaaacaataagaca

SEQ ID NO: 845663 - DNA, 22 bp, Artificial Sequence
  chemically synthesized
aaaaaacaataagacagtcagt

SEQ ID NO: 845664 - DNA, 22 bp, Artificial Sequence
  chemically synthesized
aaaaacaataagacagtcagtg

SEQ ID NO: 845665 - DNA, 22 bp, Artificial Sequence
  chemically synthesized
caaagaaatagagaaataaatt

SEQ ID NO: 845666 - DNA, 22 bp, Artificial Sequence
  chemically synthesized
ctacaaagaaatagagaaataa

SEQ ID NO: 845667 - DNA, 22 bp, Artificial Sequence
  chemically synthesized
aaacattactacaaagaaatag

SEQ ID NO: 845668 - DNA, 22 bp, Artificial Sequence
  chemically synthesized
atttctctatttctttgtagta

SEQ ID NO: 845669 - DNA, 22 bp, Artificial Sequence
  chemically synthesized
tttctctatttctttgtagtaa

SEQ ID NO: 845670 - DNA, 22 bp, Artificial Sequence
  chemically synthesized
ctctatttctttgtagtaatgt

SEQ ID NO: 845671 - DNA, 22 bp, Artificial Sequence
  chemically synthesized
tctatttctttgtagtaatgtt

SEQ ID NO: 845672 - DNA, 22 bp, Artificial Sequence
  chemically synthesized
tatttctttgtagtaatgtttc

SEQ ID NO: 845673 - DNA, 22 bp, Artificial Sequence
  chemically synthesized
tttctttgtagtaatgtttcaa

SEQ ID NO: 845674 - DNA, 22 bp, Artificial Sequence
  chemically synthesized
ctttgtagtaatgtttcaattt

SEQ ID NO: 845675 - DNA, 22 bp, Artificial Sequence
  chemically synthesized
tttgtagtaatgtttcaatttg

SEQ ID NO: 845676 - DNA, 22 bp, Artificial Sequence
  chemically synthesized
cccaaaatatcaacaaattgaa

SEQ ID NO: 845677 - DNA, 22 bp, Artificial Sequence
  chemically synthesized
tgtagtaatgtttcaatttgtt

SEQ ID NO: 845678 - DNA, 22 bp, Artificial Sequence
  chemically synthesized
gtagtaatgtttcaatttgttg

SEQ ID NO: 845679 - DNA, 22 bp, Artificial Sequence
  chemically synthesized
tagtaatgtttcaatttgttga

SEQ ID NO: 845680 - DNA, 22 bp, Artificial Sequence
  chemically synthesized
actccccaaaatatcaacaaat

SEQ ID NO: 845681 - DNA, 22 bp, Artificial Sequence
  chemically synthesized
aactccccaaaatatcaacaaa

SEQ ID NO: 845682 - DNA, 22 bp, Artificial Sequence
  chemically synthesized
taactccccaaaatatcaacaa

SEQ ID NO: 845683 - DNA, 22 bp, Artificial Sequence
  chemically synthesized
ttaactccccaaaatatcaaca

SEQ ID NO: 845684 - DNA, 22 bp, Artificial Sequence
  chemically synthesized
tttaactccccaaaatatcaac

SEQ ID NO: 845685 - DNA, 22 bp, Artificial Sequence
  chemically synthesized
ttttaactccccaaaatatcaa

SEQ ID NO: 845686 - DNA, 22 bp, Artificial Sequence
  chemically synthesized
caatttgttgatattttgggga

SEQ ID NO: 845687 - DNA, 22 bp, Artificial Sequence
  chemically synthesized
aatttgttgatattttggggag

SEQ ID NO: 845688 - DNA, 22 bp, Artificial Sequence
  chemically synthesized
agagtttttttaactccccaaa

SEQ ID NO: 845689 - DNA, 22 bp, Artificial Sequence
  chemically synthesized
aagagtttttttaactccccaa

SEQ ID NO: 845690 - DNA, 22 bp, Artificial Sequence
  chemically synthesized
gttgatattttggggagttaaa

SEQ ID NO: 845691 - DNA, 22 bp, Artificial Sequence
  chemically synthesized
ttgatattttggggagttaaaa

SEQ ID NO: 845692 - DNA, 22 bp, Artificial Sequence
  chemically synthesized
ggcttaagagtttttttaactc

SEQ ID NO: 845693 - DNA, 22 bp, Artificial Sequence
  chemically synthesized
atattttggggagttaaaaaaa

SEQ ID NO: 845694 - DNA, 22 bp, Artificial Sequence
  chemically synthesized
tggggagttaaaaaaactctta

SEQ ID NO: 845695 - DNA, 22 bp, Artificial Sequence
  chemically synthesized
ggggagttaaaaaaactcttaa

SEQ ID NO: 845696 - DNA, 22 bp, Artificial Sequence
  chemically synthesized
gggagttaaaaaaactcttaag

SEQ ID NO: 845697 - DNA, 22 bp, Artificial Sequence
  chemically synthesized
aaaaaactcttaagcctagcac

SEQ ID NO: 845698 - DNA, 22 bp, Artificial Sequence
  chemically synthesized
cgagtgagaacatgcagtgcta

SEQ ID NO: 845699 - DNA, 22 bp, Artificial Sequence
  chemically synthesized
acgagtgagaacatgcagtgct

SEQ ID NO: 845700 - DNA, 22 bp, Artificial Sequence
  chemically synthesized
ttaagcctagcactgcatgttc

SEQ ID NO: 845701 - DNA, 22 bp, Artificial Sequence
  chemically synthesized
aagcctagcactgcatgttctc

SEQ ID NO: 845702 - DNA, 22 bp, Artificial Sequence
  chemically synthesized
ccacttacgagtgagaacatgc

SEQ ID NO: 845703 - DNA, 22 bp, Artificial Sequence
  chemically synthesized
agcctagcactgcatgttctca

SEQ ID NO: 845704 - DNA, 22 bp, Artificial Sequence
  chemically synthesized
aattcccacttacgagtgagaa

SEQ ID NO: 845705 - DNA, 22 bp, Artificial Sequence
  chemically synthesized
gcactgcatgttctcactcgta

SEQ ID NO: 845706 - DNA, 22 bp, Artificial Sequence
  chemically synthesized
ttcaattcccacttacgagtga

SEQ ID NO: 845707 - DNA, 22 bp, Artificial Sequence
  chemically synthesized
attgttcaattcccacttacga

SEQ ID NO: 845708 - DNA, 22 bp, Artificial Sequence
  chemically synthesized
catgttctcactcgtaagtggg

SEQ ID NO: 845709 - DNA, 22 bp, Artificial Sequence
  chemically synthesized
tcattgttcaattcccacttac

SEQ ID NO: 845710 - DNA, 22 bp, Artificial Sequence
  chemically synthesized
tcactcgtaagtgggaattgaa

SEQ ID NO: 845711 - DNA, 22 bp, Artificial Sequence
  chemically synthesized
actcgtaagtgggaattgaaca

SEQ ID NO: 845712 - DNA, 22 bp, Artificial Sequence
  chemically synthesized
gtaagtgggaattgaacaatga

SEQ ID NO: 845713 - DNA, 22 bp, Artificial Sequence
  chemically synthesized
tgtccatgtgttctcattgttc

SEQ ID NO: 845714 - DNA, 22 bp, Artificial Sequence
  chemically synthesized
cctgtgtccatgtgttctcatt

SEQ ID NO: 845715 - DNA, 22 bp, Artificial Sequence
  chemically synthesized
ccctccctgtgtccatgtgttc

SEQ ID NO: 845716 - DNA, 22 bp, Artificial Sequence
  chemically synthesized
aacaatgagaacacatggacac

SEQ ID NO: 845717 - DNA, 22 bp, Artificial Sequence
  chemically synthesized
acaggccccggtgtgtgatgtt

SEQ ID NO: 845718 - DNA, 22 bp, Artificial Sequence
  chemically synthesized
gacaggccccggtgtgtgatgt

SEQ ID NO: 845719 - DNA, 22 bp, Artificial Sequence
  chemically synthesized
accccttgacaggccccggtgt

SEQ ID NO: 845720 - DNA, 22 bp, Artificial Sequence
  chemically synthesized
cccctcaccccttgacaggccc

SEQ ID NO: 845721 - DNA, 22 bp, Artificial Sequence
  chemically synthesized
gcccctcaccccttgacaggcc

SEQ ID NO: 845722 - DNA, 22 bp, Artificial Sequence
  chemically synthesized
tccccttgcccctcaccccttg

SEQ ID NO: 845723 - DNA, 22 bp, Artificial Sequence
  chemically synthesized
tgtccccttgcccctcacccct

SEQ ID NO: 845724 - DNA, 22 bp, Artificial Sequence
  chemically synthesized
tctgtccccttgcccctcaccc

SEQ ID NO: 845725 - DNA, 22 bp, Artificial Sequence
  chemically synthesized
atgctctctgtccccttgcccc

SEQ ID NO: 845726 - DNA, 22 bp, Artificial Sequence
  chemically synthesized
tcaaggggtgaggggcaagggg

SEQ ID NO: 845727 - DNA, 22 bp, Artificial Sequence
  chemically synthesized
tcctaatgctctctgtcccctt

SEQ ID NO: 845728 - DNA, 22 bp, Artificial Sequence
  chemically synthesized
gtcctaatgctctctgtcccct

SEQ ID NO: 845729 - DNA, 22 bp, Artificial Sequence
  chemically synthesized
ggtatttgtcctaatgctctct

SEQ ID NO: 845730 - DNA, 22 bp, Artificial Sequence
  chemically synthesized
agcccccaatgcattaggtatt

SEQ ID NO: 845731 - DNA, 22 bp, Artificial Sequence
  chemically synthesized
aagcccccaatgcattaggtat

SEQ ID NO: 845732 - DNA, 22 bp, Artificial Sequence
  chemically synthesized
taagcccccaatgcattaggta

SEQ ID NO: 845733 - DNA, 22 bp, Artificial Sequence
  chemically synthesized
ggacaaatacctaatgcattgg

SEQ ID NO: 845734 - DNA, 22 bp, Artificial Sequence
  chemically synthesized
atgcattgggggcttaaaacct

SEQ ID NO: 845735 - DNA, 22 bp, Artificial Sequence
  chemically synthesized
atcaacccaacatccaggtttt

SEQ ID NO: 845736 - DNA, 22 bp, Artificial Sequence
  chemically synthesized
ggggcttaaaacctggatgttg

SEQ ID NO: 845737 - DNA, 22 bp, Artificial Sequence
  chemically synthesized
tactcatcaacccaacatccag

SEQ ID NO: 845738 - DNA, 22 bp, Artificial Sequence
  chemically synthesized
ctatactcatcaacccaacatc

SEQ ID NO: 845739 - DNA, 22 bp, Artificial Sequence
  chemically synthesized
gctatactcatcaacccaacat

SEQ ID NO: 845740 - DNA, 22 bp, Artificial Sequence
  chemically synthesized
aaaacctggatgttgggttgat

SEQ ID NO: 845741 - DNA, 22 bp, Artificial Sequence
  chemically synthesized
aaacctggatgttgggttgatg

SEQ ID NO: 845742 - DNA, 22 bp, Artificial Sequence
  chemically synthesized
gatgttgggttgatgagtatag

SEQ ID NO: 845743 - DNA, 22 bp, Artificial Sequence
  chemically synthesized
ggttgatgagtatagcaaacca

SEQ ID NO: 845744 - DNA, 22 bp, Artificial Sequence
  chemically synthesized
atgagtatagcaaaccaccatg

SEQ ID NO: 845745 - DNA, 22 bp, Artificial Sequence
  chemically synthesized
ggtatacatgtatcatggtggt

SEQ ID NO: 845746 - DNA, 22 bp, Artificial Sequence
  chemically synthesized
cctaggtatacatgtatcatgg

SEQ ID NO: 845747 - DNA, 22 bp, Artificial Sequence
  chemically synthesized
ttacctaggtatacatgtatca

SEQ ID NO: 845748 - DNA, 22 bp, Artificial Sequence
  chemically synthesized
gttacctaggtatacatgtatc

SEQ ID NO: 845749 - DNA, 22 bp, Artificial Sequence
  chemically synthesized
ggatacatgtgcagaacgtgca

SEQ ID NO: 845750 - DNA, 22 bp, Artificial Sequence
  chemically synthesized
ggtaacaaacctgcacgttctg

SEQ ID NO: 845751 - DNA, 22 bp, Artificial Sequence
  chemically synthesized
tgggatacatgtgcagaacgtg

SEQ ID NO: 845752 - DNA, 22 bp, Artificial Sequence
  chemically synthesized
agttctgggatacatgtgcaga

SEQ ID NO: 845753 - DNA, 22 bp, Artificial Sequence
  chemically synthesized
aagttctgggatacatgtgcag

SEQ ID NO: 845754 - DNA, 22 bp, Artificial Sequence
  chemically synthesized
taagttctgggatacatgtgca

SEQ ID NO: 845755 - DNA, 22 bp, Artificial Sequence
  chemically synthesized
ctttaagttctgggatacatgt

SEQ ID NO: 845756 - DNA, 22 bp, Artificial Sequence
  chemically synthesized
actttaagttctgggatacatg

SEQ ID NO: 845757 - DNA, 22 bp, Artificial Sequence
  chemically synthesized
cacgttctgcacatgtatccca

SEQ ID NO: 845758 - DNA, 22 bp, Artificial Sequence
  chemically synthesized
tactttaagttctgggatacat

SEQ ID NO: 845759 - DNA, 22 bp, Artificial Sequence
  chemically synthesized
attttactttaagttctgggat

SEQ ID NO: 845760 - DNA, 22 bp, Artificial Sequence
  chemically synthesized
aattttactttaagttctggga

SEQ ID NO: 845761 - DNA, 22 bp, Artificial Sequence
  chemically synthesized
taattttactttaagttctggg

SEQ ID NO: 845762 - DNA, 22 bp, Artificial Sequence
  chemically synthesized
tgcacatgtatcccagaactta

SEQ ID NO: 845763 - DNA, 22 bp, Artificial Sequence
  chemically synthesized
ttaattttactttaagttctgg

SEQ ID NO: 845764 - DNA, 22 bp, Artificial Sequence
  chemically synthesized
tttaattttactttaagttctg

SEQ ID NO: 845765 - DNA, 22 bp, Artificial Sequence
  chemically synthesized
cacatgtatcccagaacttaaa

SEQ ID NO: 845766 - DNA, 22 bp, Artificial Sequence
  chemically synthesized
gttttttaattttactttaagt

SEQ ID NO: 845767 - DNA, 22 bp, Artificial Sequence
  chemically synthesized
agttttttaattttactttaag

SEQ ID NO: 845768 - DNA, 22 bp, Artificial Sequence
  chemically synthesized
tagttttttaattttactttaa

SEQ ID NO: 845769 - DNA, 22 bp, Artificial Sequence
  chemically synthesized
ttagttttttaattttacttta

SEQ ID NO: 845770 - DNA, 22 bp, Artificial Sequence
  chemically synthesized
tttagttttttaattttacttt

SEQ ID NO: 845771 - DNA, 22 bp, Artificial Sequence
  chemically synthesized
ttttttagttttttaattttac

SEQ ID NO: 845772 - DNA, 22 bp, Artificial Sequence
  chemically synthesized
attttttagttttttaatttta

SEQ ID NO: 845773 - DNA, 22 bp, Artificial Sequence
  chemically synthesized
tttattttttagttttttaatt

SEQ ID NO: 845774 - DNA, 22 bp, Artificial Sequence
  chemically synthesized
atttattttttagttttttaat

SEQ ID NO: 845775 - DNA, 22 bp, Artificial Sequence
  chemically synthesized
tttatttattttttagtttttt

SEQ ID NO: 845776 - DNA, 22 bp, Artificial Sequence
  chemically synthesized
aaagtaaaattaaaaaactaaa

SEQ ID NO: 845777 - DNA, 22 bp, Artificial Sequence
  chemically synthesized
atttatttattttttagttttt

SEQ ID NO: 845778 - DNA, 22 bp, Artificial Sequence
  chemically synthesized
aagtaaaattaaaaaactaaaa

SEQ ID NO: 845779 - DNA, 22 bp, Artificial Sequence
  chemically synthesized
tatttatttatttattttttag

SEQ ID NO: 845780 - DNA, 22 bp, Artificial Sequence
  chemically synthesized
atatttatttatttatttttta

SEQ ID NO: 845781 - DNA, 22 bp, Artificial Sequence
  chemically synthesized
tatatttatttatttatttttt

SEQ ID NO: 845782 - DNA, 22 bp, Artificial Sequence
  chemically synthesized
ttttatatttatttatttattt

SEQ ID NO: 845783 - DNA, 22 bp, Artificial Sequence
  chemically synthesized
attttatatttatttatttatt

SEQ ID NO: 845784 - DNA, 22 bp, Artificial Sequence
  chemically synthesized
aaaaactaaaaaataaataaat

SEQ ID NO: 845785 - DNA, 22 bp, Artificial Sequence
  chemically synthesized
tttattttatatttatttattt

SEQ ID NO: 845786 - DNA, 22 bp, Artificial Sequence
  chemically synthesized
atttattttatatttatttatt

SEQ ID NO: 845787 - DNA, 22 bp, Artificial Sequence
  chemically synthesized
tatttattttatatttatttat

SEQ ID NO: 845788 - DNA, 22 bp, Artificial Sequence
  chemically synthesized
ttttatttattttatatttatt

SEQ ID NO: 845789 - DNA, 22 bp, Artificial Sequence
  chemically synthesized
aaaaataaataaataaatataa

SEQ ID NO: 845790 - DNA, 22 bp, Artificial Sequence
  chemically synthesized
attttatttattttatatttat

SEQ ID NO: 845791 - DNA, 22 bp, Artificial Sequence
  chemically synthesized
tattttatttattttatattta

SEQ ID NO: 845792 - DNA, 22 bp, Artificial Sequence
  chemically synthesized
ttattttatttattttatattt

SEQ ID NO: 845793 - DNA, 22 bp, Artificial Sequence
  chemically synthesized
tttattttatttattttatatt

SEQ ID NO: 845794 - DNA, 22 bp, Artificial Sequence
  chemically synthesized
ttttattttatttattttatat

SEQ ID NO: 845795 - DNA, 22 bp, Artificial Sequence
  chemically synthesized
tttttattttatttattttata

SEQ ID NO: 845796 - DNA, 22 bp, Artificial Sequence
  chemically synthesized
tttttttattttatttatttta

SEQ ID NO: 845797 - DNA, 22 bp, Artificial Sequence
  chemically synthesized
tgctctttttttattttattta

SEQ ID NO: 845798 - DNA, 22 bp, Artificial Sequence
  chemically synthesized
ctatgctctttttttattttat

SEQ ID NO: 845799 - DNA, 22 bp, Artificial Sequence
  chemically synthesized
agattactatgctcttttttta

SEQ ID NO: 845800 - DNA, 22 bp, Artificial Sequence
  chemically synthesized
gagattactatgctcttttttt

SEQ ID NO: 845801 - DNA, 22 bp, Artificial Sequence
  chemically synthesized
tgagattactatgctctttttt

SEQ ID NO: 845802 - DNA, 22 bp, Artificial Sequence
  chemically synthesized
ttgagattactatgctcttttt

SEQ ID NO: 845803 - DNA, 22 bp, Artificial Sequence
  chemically synthesized
tttgagattactatgctctttt

SEQ ID NO: 845804 - DNA, 22 bp, Artificial Sequence
  chemically synthesized
ttttgagattactatgctcttt

SEQ ID NO: 845805 - DNA, 22 bp, Artificial Sequence
  chemically synthesized
tttttgagattactatgctctt

SEQ ID NO: 845806 - DNA, 22 bp, Artificial Sequence
  chemically synthesized
ttttttgagattactatgctct

SEQ ID NO: 845807 - DNA, 22 bp, Artificial Sequence
  chemically synthesized
tttttttgagattactatgctc

SEQ ID NO: 845808 - DNA, 22 bp, Artificial Sequence
  chemically synthesized
ttttttttgagattactatgct

SEQ ID NO: 845809 - DNA, 22 bp, Artificial Sequence
  chemically synthesized
tttttttttgagattactatgc

SEQ ID NO: 845810 - DNA, 22 bp, Artificial Sequence
  chemically synthesized
ttttttttttgagattactatg

SEQ ID NO: 845811 - DNA, 22 bp, Artificial Sequence
  chemically synthesized
tttttttttttgagattactat

SEQ ID NO: 845812 - DNA, 22 bp, Artificial Sequence
  chemically synthesized
ttttttttttttgagattacta

SEQ ID NO: 845813 - DNA, 22 bp, Artificial Sequence
  chemically synthesized
tttttttttttttgagattact

SEQ ID NO: 845814 - DNA, 22 bp, Artificial Sequence
  chemically synthesized
agaggttttttttttttttttg

SEQ ID NO: 845815 - DNA, 22 bp, Artificial Sequence
  chemically synthesized
aagaggtttttttttttttttt

SEQ ID NO: 845816 - DNA, 22 bp, Artificial Sequence
  chemically synthesized
gtaggcttaagaggtttttttt

SEQ ID NO: 845817 - DNA, 22 bp, Artificial Sequence
  chemically synthesized
ggtaggcttaagaggttttttt

SEQ ID NO: 845818 - DNA, 22 bp, Artificial Sequence
  chemically synthesized
aaaaaaaaaaaaaaaacctctt

SEQ ID NO: 845819 - DNA, 22 bp, Artificial Sequence
  chemically synthesized
aaagaagtcaccaaatttggta

SEQ ID NO: 845820 - DNA, 22 bp, Artificial Sequence
  chemically synthesized
caaagaagtcaccaaatttggt

SEQ ID NO: 845821 - DNA, 22 bp, Artificial Sequence
  chemically synthesized
ttaagcctaccaaatttggtga

SEQ ID NO: 845822 - DNA, 22 bp, Artificial Sequence
  chemically synthesized
aagcctaccaaatttggtgact

SEQ ID NO: 845823 - DNA, 22 bp, Artificial Sequence
  chemically synthesized
ccatttcaaagaagtcaccaaa

SEQ ID NO: 845824 - DNA, 22 bp, Artificial Sequence
  chemically synthesized
agcctaccaaatttggtgactt

SEQ ID NO: 845825 - DNA, 22 bp, Artificial Sequence
  chemically synthesized
ttaccatttcaaagaagtcacc

SEQ ID NO: 845826 - DNA, 22 bp, Artificial Sequence
  chemically synthesized
ccaaatttggtgacttctttga

SEQ ID NO: 845827 - DNA, 22 bp, Artificial Sequence
  chemically synthesized
atattattaccatttcaaagaa

SEQ ID NO: 845828 - DNA, 22 bp, Artificial Sequence
  chemically synthesized
ggtgacttctttgaaatggtaa

SEQ ID NO: 845829 - DNA, 22 bp, Artificial Sequence
  chemically synthesized
gtgacttctttgaaatggtaat

SEQ ID NO: 845830 - DNA, 22 bp, Artificial Sequence
  chemically synthesized
atagtagattaatattattacc

SEQ ID NO: 845831 - DNA, 22 bp, Artificial Sequence
  chemically synthesized
ctttgaaatggtaataatatta

SEQ ID NO: 845832 - DNA, 22 bp, Artificial Sequence
  chemically synthesized
tttgaaatggtaataatattaa

SEQ ID NO: 845833 - DNA, 22 bp, Artificial Sequence
  chemically synthesized
tgaaatggtaataatattaatc

SEQ ID NO: 845834 - DNA, 22 bp, Artificial Sequence
  chemically synthesized
gaaatggtaataatattaatct

SEQ ID NO: 845835 - DNA, 22 bp, Artificial Sequence
  chemically synthesized
aaatggtaataatattaatcta

SEQ ID NO: 845836 - DNA, 22 bp, Artificial Sequence
  chemically synthesized
aaaataacacactaatagtaga

SEQ ID NO: 845837 - DNA, 22 bp, Artificial Sequence
  chemically synthesized
aaaaataacacactaatagtag

SEQ ID NO: 845838 - DNA, 22 bp, Artificial Sequence
  chemically synthesized
taaaaataacacactaatagta

SEQ ID NO: 845839 - DNA, 22 bp, Artificial Sequence
  chemically synthesized
ttttaaaaataacacactaata

SEQ ID NO: 845840 - DNA, 22 bp, Artificial Sequence
  chemically synthesized
attttaaaaataacacactaat

SEQ ID NO: 845841 - DNA, 22 bp, Artificial Sequence
  chemically synthesized
atctactattagtgtgttattt

SEQ ID NO: 845842 - DNA, 22 bp, Artificial Sequence
  chemically synthesized
ctattagtgtgttatttttaaa

SEQ ID NO: 845843 - DNA, 22 bp, Artificial Sequence
  chemically synthesized
ttagtgtgttatttttaaaata

SEQ ID NO: 845844 - DNA, 22 bp, Artificial Sequence
  chemically synthesized
gtgtgttatttttaaaataaat

SEQ ID NO: 845845 - DNA, 22 bp, Artificial Sequence
  chemically synthesized
aacacagggagataatttattt

SEQ ID NO: 845846 - DNA, 22 bp, Artificial Sequence
  chemically synthesized
caacacagggagataatttatt

SEQ ID NO: 845847 - DNA, 22 bp, Artificial Sequence
  chemically synthesized
tcaacacagggagataatttat

SEQ ID NO: 845848 - DNA, 22 bp, Artificial Sequence
  chemically synthesized
ttcaacacagggagataattta

SEQ ID NO: 845849 - DNA, 22 bp, Artificial Sequence
  chemically synthesized
tttcaacacagggagataattt

SEQ ID NO: 845850 - DNA, 22 bp, Artificial Sequence
  chemically synthesized
ttttcaacacagggagataatt

SEQ ID NO: 845851 - DNA, 22 bp, Artificial Sequence
  chemically synthesized
tttttaaaataaattatctccc

SEQ ID NO: 845852 - DNA, 22 bp, Artificial Sequence
  chemically synthesized
tttttcaacacagggagataat

SEQ ID NO: 845853 - DNA, 22 bp, Artificial Sequence
  chemically synthesized
ttaaaataaattatctccctgt

SEQ ID NO: 845854 - DNA, 22 bp, Artificial Sequence
  chemically synthesized
taaaataaattatctccctgtg

SEQ ID NO: 845855 - DNA, 22 bp, Artificial Sequence
  chemically synthesized
aaaataaattatctccctgtgt

SEQ ID NO: 845856 - DNA, 22 bp, Artificial Sequence
  chemically synthesized
atctttttttcaacacagggag

SEQ ID NO: 845857 - DNA, 22 bp, Artificial Sequence
  chemically synthesized
aaataaattatctccctgtgtt

SEQ ID NO: 845858 - DNA, 22 bp, Artificial Sequence
  chemically synthesized
aatctttttttcaacacaggga

SEQ ID NO: 845859 - DNA, 22 bp, Artificial Sequence
  chemically synthesized
tctccctgtgttgaaaaaaaga

SEQ ID NO: 845860 - DNA, 22 bp, Artificial Sequence
  chemically synthesized
cctgtgttgaaaaaaagattaa

SEQ ID NO: 845861 - DNA, 22 bp, Artificial Sequence
  chemically synthesized
gaaaggaccatcttaatctttt

SEQ ID NO: 845862 - DNA, 22 bp, Artificial Sequence
  chemically synthesized
ggaaaggaccatcttaatcttt

SEQ ID NO: 845863 - DNA, 22 bp, Artificial Sequence
  chemically synthesized
tgttgaaaaaaagattaagatg

SEQ ID NO: 845864 - DNA, 22 bp, Artificial Sequence
  chemically synthesized
aaaaaaagattaagatggtcct

SEQ ID NO: 845865 - DNA, 22 bp, Artificial Sequence
  chemically synthesized
cgtgtggtataatagcttggaa

SEQ ID NO: 845866 - DNA, 22 bp, Artificial Sequence
  chemically synthesized
agatggtcctttccaagctatt

SEQ ID NO: 845867 - DNA, 22 bp, Artificial Sequence
  chemically synthesized
agttccgtgtggtataatagct

SEQ ID NO: 845868 - DNA, 22 bp, Artificial Sequence
  chemically synthesized
aagttccgtgtggtataatagc

SEQ ID NO: 845869 - DNA, 22 bp, Artificial Sequence
  chemically synthesized
taagttccgtgtggtataatag

SEQ ID NO: 845870 - DNA, 22 bp, Artificial Sequence
  chemically synthesized
tccaagctattataccacacgg

SEQ ID NO: 845871 - DNA, 22 bp, Artificial Sequence
  chemically synthesized
ccaagctattataccacacgga

SEQ ID NO: 845872 - DNA, 22 bp, Artificial Sequence
  chemically synthesized
caagctattataccacacggaa

SEQ ID NO: 845873 - DNA, 22 bp, Artificial Sequence
  chemically synthesized
ttataccacacggaacttaaag

SEQ ID NO: 845874 - DNA, 22 bp, Artificial Sequence
  chemically synthesized
taccacacggaacttaaaggat

SEQ ID NO: 845875 - DNA, 22 bp, Artificial Sequence
  chemically synthesized
gtaaatgacaagtaaatcaatc

SEQ ID NO: 845876 - DNA, 22 bp, Artificial Sequence
  chemically synthesized
agtaaatgacaagtaaatcaat

SEQ ID NO: 845877 - DNA, 22 bp, Artificial Sequence
  chemically synthesized
tagtaaatgacaagtaaatcaa

SEQ ID NO: 845878 - DNA, 22 bp, Artificial Sequence
  chemically synthesized
aaaggattgatttacttgtcat

SEQ ID NO: 845879 - DNA, 22 bp, Artificial Sequence
  chemically synthesized
aaggattgatttacttgtcatt

SEQ ID NO: 845880 - DNA, 22 bp, Artificial Sequence
  chemically synthesized
agggttttagtaaatgacaagt

SEQ ID NO: 845881 - DNA, 22 bp, Artificial Sequence
  chemically synthesized
gatgttaagggttttagtaaat

SEQ ID NO: 845882 - DNA, 22 bp, Artificial Sequence
  chemically synthesized
atttacttgtcatttactaaaa

SEQ ID NO: 845883 - DNA, 22 bp, Artificial Sequence
  chemically synthesized
ggatgttaagggttttagtaaa

SEQ ID NO: 845884 - DNA, 22 bp, Artificial Sequence
  chemically synthesized
tggatgttaagggttttagtaa

SEQ ID NO: 845885 - DNA, 22 bp, Artificial Sequence
  chemically synthesized
ttggatgttaagggttttagta

SEQ ID NO: 845886 - DNA, 22 bp, Artificial Sequence
  chemically synthesized
acttgtcatttactaaaaccct

SEQ ID NO: 845887 - DNA, 22 bp, Artificial Sequence
  chemically synthesized
cttgtcatttactaaaaccctt

SEQ ID NO: 845888 - DNA, 22 bp, Artificial Sequence
  chemically synthesized
atttttggatgttaagggtttt

SEQ ID NO: 845889 - DNA, 22 bp, Artificial Sequence
  chemically synthesized
catttttggatgttaagggttt

SEQ ID NO: 845890 - DNA, 22 bp, Artificial Sequence
  chemically synthesized
gtcatttactaaaacccttaac

SEQ ID NO: 845891 - DNA, 22 bp, Artificial Sequence
  chemically synthesized
tcatttttggatgttaagggtt

SEQ ID NO: 845892 - DNA, 22 bp, Artificial Sequence
  chemically synthesized
tcatttactaaaacccttaaca

SEQ ID NO: 845893 - DNA, 22 bp, Artificial Sequence
  chemically synthesized
actaaaacccttaacatccaaa

SEQ ID NO: 845894 - DNA, 22 bp, Artificial Sequence
  chemically synthesized
ctaaaacccttaacatccaaaa

SEQ ID NO: 845895 - DNA, 22 bp, Artificial Sequence
  chemically synthesized
aaacccttaacatccaaaaatg

SEQ ID NO: 845896 - DNA, 22 bp, Artificial Sequence
  chemically synthesized
tgaaagtgaaaggcattttcat

SEQ ID NO: 845897 - DNA, 22 bp, Artificial Sequence
  chemically synthesized
aacatccaaaaatgaaaatgcc

SEQ ID NO: 845898 - DNA, 22 bp, Artificial Sequence
  chemically synthesized
gtgaaagtgaaaggcattttca

SEQ ID NO: 845899 - DNA, 22 bp, Artificial Sequence
  chemically synthesized
acatccaaaaatgaaaatgcct

SEQ ID NO: 845900 - DNA, 22 bp, Artificial Sequence
  chemically synthesized
gcttgtgaaagtgaaaggcatt

SEQ ID NO: 845901 - DNA, 22 bp, Artificial Sequence
  chemically synthesized
ctggcttgtgaaagtgaaaggc

SEQ ID NO: 845902 - DNA, 22 bp, Artificial Sequence
  chemically synthesized
actggcttgtgaaagtgaaagg

SEQ ID NO: 845903 - DNA, 22 bp, Artificial Sequence
  chemically synthesized
cttactggcttgtgaaagtgaa

SEQ ID NO: 845904 - DNA, 22 bp, Artificial Sequence
  chemically synthesized
acttactggcttgtgaaagtga

SEQ ID NO: 845905 - DNA, 22 bp, Artificial Sequence
  chemically synthesized
tttacttactggcttgtgaaag

SEQ ID NO: 845906 - DNA, 22 bp, Artificial Sequence
  chemically synthesized
tcactttcacaagccagtaagt

SEQ ID NO: 845907 - DNA, 22 bp, Artificial Sequence
  chemically synthesized
cactttcacaagccagtaagta

SEQ ID NO: 845908 - DNA, 22 bp, Artificial Sequence
  chemically synthesized
caccacattatttacttactgg

SEQ ID NO: 845909 - DNA, 22 bp, Artificial Sequence
  chemically synthesized
actttcacaagccagtaagtaa

SEQ ID NO: 845910 - DNA, 22 bp, Artificial Sequence
  chemically synthesized
acaccacattatttacttactg

SEQ ID NO: 845911 - DNA, 22 bp, Artificial Sequence
  chemically synthesized
tcacaagccagtaagtaaataa

SEQ ID NO: 845912 - DNA, 22 bp, Artificial Sequence
  chemically synthesized
cacaagccagtaagtaaataat

SEQ ID NO: 845913 - DNA, 22 bp, Artificial Sequence
  chemically synthesized
acaagccagtaagtaaataatg

SEQ ID NO: 845914 - DNA, 22 bp, Artificial Sequence
  chemically synthesized
aagatccgcaatttacaccaca

SEQ ID NO: 845915 - DNA, 22 bp, Artificial Sequence
  chemically synthesized
caagatccgcaatttacaccac

SEQ ID NO: 845916 - DNA, 22 bp, Artificial Sequence
  chemically synthesized
tatttcaagatccgcaatttac

SEQ ID NO: 845917 - DNA, 22 bp, Artificial Sequence
  chemically synthesized
aaattgtatttcaagatccgca

SEQ ID NO: 845918 - DNA, 22 bp, Artificial Sequence
  chemically synthesized
gaaattgtatttcaagatccgc

SEQ ID NO: 845919 - DNA, 22 bp, Artificial Sequence
  chemically synthesized
tgaaattgtatttcaagatccg

SEQ ID NO: 845920 - DNA, 22 bp, Artificial Sequence
  chemically synthesized
actttgaaattgtatttcaaga

SEQ ID NO: 845921 - DNA, 22 bp, Artificial Sequence
  chemically synthesized
gactttgaaattgtatttcaag

SEQ ID NO: 845922 - DNA, 22 bp, Artificial Sequence
  chemically synthesized
ttgactttgaaattgtatttca

SEQ ID NO: 845923 - DNA, 22 bp, Artificial Sequence
  chemically synthesized
cttgactttgaaattgtatttc

SEQ ID NO: 845924 - DNA, 22 bp, Artificial Sequence
  chemically synthesized
tcttgactttgaaattgtattt

SEQ ID NO: 845925 - DNA, 22 bp, Artificial Sequence
  chemically synthesized
ttcttgactttgaaattgtatt

SEQ ID NO: 845926 - DNA, 22 bp, Artificial Sequence
  chemically synthesized
tttcttgactttgaaattgtat

SEQ ID NO: 845927 - DNA, 22 bp, Artificial Sequence
  chemically synthesized
cggatcttgaaatacaatttca

SEQ ID NO: 845928 - DNA, 22 bp, Artificial Sequence
  chemically synthesized
ttttcttgactttgaaattgta

SEQ ID NO: 845929 - DNA, 22 bp, Artificial Sequence
  chemically synthesized
tttttcttgactttgaaattgt

SEQ ID NO: 845930 - DNA, 22 bp, Artificial Sequence
  chemically synthesized
ttttttcttgactttgaaattg

SEQ ID NO: 845931 - DNA, 22 bp, Artificial Sequence
  chemically synthesized
tttttttcttgactttgaaatt

SEQ ID NO: 845932 - DNA, 22 bp, Artificial Sequence
  chemically synthesized
tttttttttcttgactttgaaa

SEQ ID NO: 845933 - DNA, 22 bp, Artificial Sequence
  chemically synthesized
gaaatacaatttcaaagtcaag

SEQ ID NO: 845934 - DNA, 22 bp, Artificial Sequence
  chemically synthesized
aaatacaatttcaaagtcaaga

SEQ ID NO: 845935 - DNA, 22 bp, Artificial Sequence
  chemically synthesized
tagcataaaattcttttttttt

SEQ ID NO: 845936 - DNA, 22 bp, Artificial Sequence
  chemically synthesized
caaagtcaagaaaaaaaaagaa

SEQ ID NO: 845937 - DNA, 22 bp, Artificial Sequence
  chemically synthesized
aaagtcaagaaaaaaaaagaat

SEQ ID NO: 845938 - DNA, 22 bp, Artificial Sequence
  chemically synthesized
tcaacaaattgtagcataaaat

SEQ ID NO: 845939 - DNA, 22 bp, Artificial Sequence
  chemically synthesized
caaatcattatcaacaaattgt

SEQ ID NO: 845940 - DNA, 22 bp, Artificial Sequence
  chemically synthesized
gcaaatcattatcaacaaattg

SEQ ID NO: 845941 - DNA, 22 bp, Artificial Sequence
  chemically synthesized
tatgctacaatttgttgataat

SEQ ID NO: 845942 - DNA, 22 bp, Artificial Sequence
  chemically synthesized
atgctacaatttgttgataatg

SEQ ID NO: 845943 - DNA, 22 bp, Artificial Sequence
  chemically synthesized
tgctacaatttgttgataatga

SEQ ID NO: 845944 - DNA, 22 bp, Artificial Sequence
  chemically synthesized
gaaatgcgtttgcaaatcatta

SEQ ID NO: 845945 - DNA, 22 bp, Artificial Sequence
  chemically synthesized
caatttgttgataatgatttgc

SEQ ID NO: 845946 - DNA, 22 bp, Artificial Sequence
  chemically synthesized
agaaatgcgtttgcaaatcatt

SEQ ID NO: 845947 - DNA, 22 bp, Artificial Sequence
  chemically synthesized
tagaaatgcgtttgcaaatcat

SEQ ID NO: 845948 - DNA, 22 bp, Artificial Sequence
  chemically synthesized
gttgataatgatttgcaaacgc

SEQ ID NO: 845949 - DNA, 22 bp, Artificial Sequence
  chemically synthesized
ttgataatgatttgcaaacgca

SEQ ID NO: 845950 - DNA, 22 bp, Artificial Sequence
  chemically synthesized
tatcactttagaaatgcgtttg

SEQ ID NO: 845951 - DNA, 22 bp, Artificial Sequence
  chemically synthesized
ataatgatttgcaaacgcattt

SEQ ID NO: 845952 - DNA, 22 bp, Artificial Sequence
  chemically synthesized
atatcactttagaaatgcgttt

SEQ ID NO: 845953 - DNA, 22 bp, Artificial Sequence
  chemically synthesized
tatatcactttagaaatgcgtt

SEQ ID NO: 845954 - DNA, 22 bp, Artificial Sequence
  chemically synthesized
gcaaacgcatttctaaagtgat

SEQ ID NO: 845955 - DNA, 22 bp, Artificial Sequence
  chemically synthesized
caaacgcatttctaaagtgata

SEQ ID NO: 845956 - DNA, 22 bp, Artificial Sequence
  chemically synthesized
tcaacgccctttatatcacttt

SEQ ID NO: 845957 - DNA, 22 bp, Artificial Sequence
  chemically synthesized
aaattatcaacgccctttatat

SEQ ID NO: 845958 - DNA, 22 bp, Artificial Sequence
  chemically synthesized
ctaaagtgatataaagggcgtt

SEQ ID NO: 845959 - DNA, 22 bp, Artificial Sequence
  chemically synthesized
taaagtgatataaagggcgttg

SEQ ID NO: 845960 - DNA, 22 bp, Artificial Sequence
  chemically synthesized
aagtgatataaagggcgttgat

SEQ ID NO: 845961 - DNA, 22 bp, Artificial Sequence
  chemically synthesized
aatagctaaaattatcaacgcc

SEQ ID NO: 845962 - DNA, 22 bp, Artificial Sequence
  chemically synthesized
acgttgaatagctaaaattatc

SEQ ID NO: 845963 - DNA, 22 bp, Artificial Sequence
  chemically synthesized
aaagatctaacgttgaatagct

SEQ ID NO: 845964 - DNA, 22 bp, Artificial Sequence
  chemically synthesized
ataattttagctattcaacgtt

SEQ ID NO: 845965 - DNA, 22 bp, Artificial Sequence
  chemically synthesized
tagctattcaacgttagatctt

SEQ ID NO: 845966 - DNA, 22 bp, Artificial Sequence
  chemically synthesized
agctattcaacgttagatcttt

SEQ ID NO: 845967 - DNA, 22 bp, Artificial Sequence
  chemically synthesized
gctattcaacgttagatctttt

SEQ ID NO: 845968 - DNA, 22 bp, Artificial Sequence
  chemically synthesized
ttcaacgttagatcttttagtt

SEQ ID NO: 845969 - DNA, 22 bp, Artificial Sequence
  chemically synthesized
aacgttagatcttttagttatt

SEQ ID NO: 845970 - DNA, 22 bp, Artificial Sequence
  chemically synthesized
gatcttttagttattctacatt

SEQ ID NO: 845971 - DNA, 22 bp, Artificial Sequence
  chemically synthesized
aagaaatgtgaacaatgtagaa

SEQ ID NO: 845972 - DNA, 22 bp, Artificial Sequence
  chemically synthesized
caagaaatgtgaacaatgtaga

SEQ ID NO: 845973 - DNA, 22 bp, Artificial Sequence
  chemically synthesized
ttagttattctacattgttcac

SEQ ID NO: 845974 - DNA, 22 bp, Artificial Sequence
  chemically synthesized
tagttattctacattgttcaca

SEQ ID NO: 845975 - DNA, 22 bp, Artificial Sequence
  chemically synthesized
agttattctacattgttcacat

SEQ ID NO: 845976 - DNA, 22 bp, Artificial Sequence
  chemically synthesized
gttattctacattgttcacatt

SEQ ID NO: 845977 - DNA, 22 bp, Artificial Sequence
  chemically synthesized
ttctacattgttcacatttctt

SEQ ID NO: 845978 - DNA, 22 bp, Artificial Sequence
  chemically synthesized
tacattgttcacatttcttgaa

SEQ ID NO: 845979 - DNA, 22 bp, Artificial Sequence
  chemically synthesized
cattgttcacatttcttgaaac

SEQ ID NO: 845980 - DNA, 22 bp, Artificial Sequence
  chemically synthesized
tagaacaatagagtttcaagaa

SEQ ID NO: 845981 - DNA, 22 bp, Artificial Sequence
  chemically synthesized
atagaacaatagagtttcaaga

SEQ ID NO: 845982 - DNA, 22 bp, Artificial Sequence
  chemically synthesized
ttcacatttcttgaaactctat

SEQ ID NO: 845983 - DNA, 22 bp, Artificial Sequence
  chemically synthesized
acatttcttgaaactctattgt

SEQ ID NO: 845984 - DNA, 22 bp, Artificial Sequence
  chemically synthesized
cttgaaactctattgttctata

SEQ ID NO: 845985 - DNA, 22 bp, Artificial Sequence
  chemically synthesized
atatgccaaatttatagaacaa

SEQ ID NO: 845986 - DNA, 22 bp, Artificial Sequence
  chemically synthesized
ttgaaactctattgttctataa

SEQ ID NO: 845987 - DNA, 22 bp, Artificial Sequence
  chemically synthesized
gaaactctattgttctataaat

SEQ ID NO: 845988 - DNA, 22 bp, Artificial Sequence
  chemically synthesized
ttaatatgccaaatttatagaa

SEQ ID NO: 845989 - DNA, 22 bp, Artificial Sequence
  chemically synthesized
aaactctattgttctataaatt

SEQ ID NO: 845990 - DNA, 22 bp, Artificial Sequence
  chemically synthesized
gttaatatgccaaatttataga

SEQ ID NO: 845991 - DNA, 22 bp, Artificial Sequence
  chemically synthesized
tgttaatatgccaaatttatag

SEQ ID NO: 845992 - DNA, 22 bp, Artificial Sequence
  chemically synthesized
tattgttctataaatttggcat

SEQ ID NO: 845993 - DNA, 22 bp, Artificial Sequence
  chemically synthesized
tcctttgttaatatgccaaatt

SEQ ID NO: 845994 - DNA, 22 bp, Artificial Sequence
  chemically synthesized
ttgttctataaatttggcatat

SEQ ID NO: 845995 - DNA, 22 bp, Artificial Sequence
  chemically synthesized
attatcctttgttaatatgcca

SEQ ID NO: 845996 - DNA, 22 bp, Artificial Sequence
  chemically synthesized
ttctataaatttggcatattaa

SEQ ID NO: 845997 - DNA, 22 bp, Artificial Sequence
  chemically synthesized
gattatcctttgttaatatgcc

SEQ ID NO: 845998 - DNA, 22 bp, Artificial Sequence
  chemically synthesized
tataaatttggcatattaacaa

SEQ ID NO: 845999 - DNA, 22 bp, Artificial Sequence
  chemically synthesized
tcttgattatcctttgttaata

SEQ ID NO: 846000 - DNA, 22 bp, Artificial Sequence
  chemically synthesized
taaatttggcatattaacaaag

SEQ ID NO: 846001 - DNA, 22 bp, Artificial Sequence
  chemically synthesized
aacctgtcttgattatcctttg

SEQ ID NO: 846002 - DNA, 22 bp, Artificial Sequence
  chemically synthesized
aaacctgtcttgattatccttt

SEQ ID NO: 846003 - DNA, 22 bp, Artificial Sequence
  chemically synthesized
ggcatattaacaaaggataatc

SEQ ID NO: 846004 - DNA, 22 bp, Artificial Sequence
  chemically synthesized
gcatattaacaaaggataatca

SEQ ID NO: 846005 - DNA, 22 bp, Artificial Sequence
  chemically synthesized
gtcttaaacctgtcttgattat

SEQ ID NO: 846006 - DNA, 22 bp, Artificial Sequence
  chemically synthesized
acaaaggataatcaagacaggt

SEQ ID NO: 846007 - DNA, 22 bp, Artificial Sequence
  chemically synthesized
atgcacatgataaaaactggtc

SEQ ID NO: 846008 - DNA, 22 bp, Artificial Sequence
  chemically synthesized
cgaatctgatgcacatgataaa

SEQ ID NO: 846009 - DNA, 22 bp, Artificial Sequence
  chemically synthesized
aagaccagtttttatcatgtgc

SEQ ID NO: 846010 - DNA, 22 bp, Artificial Sequence
  chemically synthesized
agaccagtttttatcatgtgca

SEQ ID NO: 846011 - DNA, 22 bp, Artificial Sequence
  chemically synthesized
ttatcatgtgcatcagattcgc

SEQ ID NO: 846012 - DNA, 22 bp, Artificial Sequence
  chemically synthesized
tatcatgtgcatcagattcgca

SEQ ID NO: 846013 - DNA, 22 bp, Artificial Sequence
  chemically synthesized
atcatgtgcatcagattcgcag

SEQ ID NO: 846014 - DNA, 22 bp, Artificial Sequence
  chemically synthesized
tcatgtgcatcagattcgcagg

SEQ ID NO: 846015 - DNA, 22 bp, Artificial Sequence
  chemically synthesized
ggccataatatcaaaagcctgc

SEQ ID NO: 846016 - DNA, 22 bp, Artificial Sequence
  chemically synthesized
ctgggccataatatcaaaagcc

SEQ ID NO: 846017 - DNA, 22 bp, Artificial Sequence
  chemically synthesized
tgttactgggccataatatcaa

SEQ ID NO: 846018 - DNA, 22 bp, Artificial Sequence
  chemically synthesized
atgttactgggccataatatca

SEQ ID NO: 846019 - DNA, 22 bp, Artificial Sequence
  chemically synthesized
gcaggcttttgatattatggcc

SEQ ID NO: 846020 - DNA, 22 bp, Artificial Sequence
  chemically synthesized
tatcacttatgttactgggcca

SEQ ID NO: 846021 - DNA, 22 bp, Artificial Sequence
  chemically synthesized
ttgatattatggcccagtaaca

SEQ ID NO: 846022 - DNA, 22 bp, Artificial Sequence
  chemically synthesized
tgatattatggcccagtaacat

SEQ ID NO: 846023 - DNA, 22 bp, Artificial Sequence
  chemically synthesized
gatattatggcccagtaacata

SEQ ID NO: 846024 - DNA, 22 bp, Artificial Sequence
  chemically synthesized
atattatggcccagtaacataa

SEQ ID NO: 846025 - DNA, 22 bp, Artificial Sequence
  chemically synthesized
tggcccagtaacataagtgata

SEQ ID NO: 846026 - DNA, 22 bp, Artificial Sequence
  chemically synthesized
aaatgtgtgtaggagaaaaaat

SEQ ID NO: 846027 - DNA, 22 bp, Artificial Sequence
  chemically synthesized
taaaatgtgtgtaggagaaaaa

SEQ ID NO: 846028 - DNA, 22 bp, Artificial Sequence
  chemically synthesized
ctaaaatgtgtgtaggagaaaa

SEQ ID NO: 846029 - DNA, 22 bp, Artificial Sequence
  chemically synthesized
ttctaaaatgtgtgtaggagaa

SEQ ID NO: 846030 - DNA, 22 bp, Artificial Sequence
  chemically synthesized
cttctaaaatgtgtgtaggaga

SEQ ID NO: 846031 - DNA, 22 bp, Artificial Sequence
  chemically synthesized
tcttctaaaatgtgtgtaggag

SEQ ID NO: 846032 - DNA, 22 bp, Artificial Sequence
  chemically synthesized
tttcttctaaaatgtgtgtagg

SEQ ID NO: 846033 - DNA, 22 bp, Artificial Sequence
  chemically synthesized
tctttcttctaaaatgtgtgta

SEQ ID NO: 846034 - DNA, 22 bp, Artificial Sequence
  chemically synthesized
tttctcctacacacattttaga

SEQ ID NO: 846035 - DNA, 22 bp, Artificial Sequence
  chemically synthesized
ttctcctacacacattttagaa

SEQ ID NO: 846036 - DNA, 22 bp, Artificial Sequence
  chemically synthesized
tctcctacacacattttagaag

SEQ ID NO: 846037 - DNA, 22 bp, Artificial Sequence
  chemically synthesized
atgtctctctttcttctaaaat

SEQ ID NO: 846038 - DNA, 22 bp, Artificial Sequence
  chemically synthesized
ctcctacacacattttagaaga

SEQ ID NO: 846039 - DNA, 22 bp, Artificial Sequence
  chemically synthesized
catgtctctctttcttctaaaa

SEQ ID NO: 846040 - DNA, 22 bp, Artificial Sequence
  chemically synthesized
tcctacacacattttagaagaa

SEQ ID NO: 846041 - DNA, 22 bp, Artificial Sequence
  chemically synthesized
ctacacacattttagaagaaag

SEQ ID NO: 846042 - DNA, 22 bp, Artificial Sequence
  chemically synthesized
tttcatgtctctctttcttcta

SEQ ID NO: 846043 - DNA, 22 bp, Artificial Sequence
  chemically synthesized
cacacattttagaagaaagaga

SEQ ID NO: 846044 - DNA, 22 bp, Artificial Sequence
  chemically synthesized
tatattgtttcatgtctctctt

SEQ ID NO: 846045 - DNA, 22 bp, Artificial Sequence
  chemically synthesized
tagaagaaagagagacatgaaa

SEQ ID NO: 846046 - DNA, 22 bp, Artificial Sequence
  chemically synthesized
agaagaaagagagacatgaaac

SEQ ID NO: 846047 - DNA, 22 bp, Artificial Sequence
  chemically synthesized
gaagaaagagagacatgaaaca

SEQ ID NO: 846048 - DNA, 22 bp, Artificial Sequence
  chemically synthesized
caaggcagtcctatatattgtt

SEQ ID NO: 846049 - DNA, 22 bp, Artificial Sequence
  chemically synthesized
gaaccaaacacacaatattcca

SEQ ID NO: 846050 - DNA, 22 bp, Artificial Sequence
  chemically synthesized
ccttggaatattgtgtgtttgg

SEQ ID NO: 846051 - DNA, 22 bp, Artificial Sequence
  chemically synthesized
cagcagtctggaaccaaacaca

SEQ ID NO: 846052 - DNA, 22 bp, Artificial Sequence
  chemically synthesized
ggaatattgtgtgtttggttcc

SEQ ID NO: 846053 - DNA, 22 bp, Artificial Sequence
  chemically synthesized
ttgcagcagtctggaaccaaac

SEQ ID NO: 846054 - DNA, 22 bp, Artificial Sequence
  chemically synthesized
gaatattgtgtgtttggttcca

SEQ ID NO: 846055 - DNA, 22 bp, Artificial Sequence
  chemically synthesized
attgcagcagtctggaaccaaa

SEQ ID NO: 846056 - DNA, 22 bp, Artificial Sequence
  chemically synthesized
tattgcagcagtctggaaccaa

SEQ ID NO: 846057 - DNA, 22 bp, Artificial Sequence
  chemically synthesized
ctttattgcagcagtctggaac

SEQ ID NO: 846058 - DNA, 22 bp, Artificial Sequence
  chemically synthesized
actttattgcagcagtctggaa

SEQ ID NO: 846059 - DNA, 22 bp, Artificial Sequence
  chemically synthesized
tgtgtttggttccagactgctg

SEQ ID NO: 846060 - DNA, 22 bp, Artificial Sequence
  chemically synthesized
tgatatttactttattgcagca

SEQ ID NO: 846061 - DNA, 22 bp, Artificial Sequence
  chemically synthesized
ggttccagactgctgcaataaa

SEQ ID NO: 846062 - DNA, 22 bp, Artificial Sequence
  chemically synthesized
gttccagactgctgcaataaag

SEQ ID NO: 846063 - DNA, 22 bp, Artificial Sequence
  chemically synthesized
ttgtgatatttactttattgca

SEQ ID NO: 846064 - DNA, 22 bp, Artificial Sequence
  chemically synthesized
attgtgatatttactttattgc

SEQ ID NO: 846065 - DNA, 22 bp, Artificial Sequence
  chemically synthesized
tattgtgatatttactttattg

SEQ ID NO: 846066 - DNA, 22 bp, Artificial Sequence
  chemically synthesized
cagactgctgcaataaagtaaa

SEQ ID NO: 846067 - DNA, 22 bp, Artificial Sequence
  chemically synthesized
attttattgtgatatttacttt

SEQ ID NO: 846068 - DNA, 22 bp, Artificial Sequence
  chemically synthesized
ctgcaataaagtaaatatcaca

SEQ ID NO: 846069 - DNA, 22 bp, Artificial Sequence
  chemically synthesized
caataaagtaaatatcacaata

SEQ ID NO: 846070 - DNA, 22 bp, Artificial Sequence
  chemically synthesized
gtgtgcctcattttattgtgat

SEQ ID NO: 846071 - DNA, 22 bp, Artificial Sequence
  chemically synthesized
gggaaccaaaaatattcgtgtg

SEQ ID NO: 846072 - DNA, 22 bp, Artificial Sequence
  chemically synthesized
atgcactggggaaccaaaaata

SEQ ID NO: 846073 - DNA, 22 bp, Artificial Sequence
  chemically synthesized
aatgcactggggaaccaaaaat

SEQ ID NO: 846074 - DNA, 22 bp, Artificial Sequence
  chemically synthesized
ttggttccccagtgcattaaat

SEQ ID NO: 846075 - DNA, 22 bp, Artificial Sequence
  chemically synthesized
tggttccccagtgcattaaatg

SEQ ID NO: 846076 - DNA, 22 bp, Artificial Sequence
  chemically synthesized
ggttccccagtgcattaaatgt

SEQ ID NO: 846077 - DNA, 22 bp, Artificial Sequence
  chemically synthesized
gttccccagtgcattaaatgtt

SEQ ID NO: 846078 - DNA, 22 bp, Artificial Sequence
  chemically synthesized
cccagtgcattaaatgttatgt

SEQ ID NO: 846079 - DNA, 22 bp, Artificial Sequence
  chemically synthesized
acagatgatagtagagtgtaaa

SEQ ID NO: 846080 - DNA, 22 bp, Artificial Sequence
  chemically synthesized
gacagatgatagtagagtgtaa

SEQ ID NO: 846081 - DNA, 22 bp, Artificial Sequence
  chemically synthesized
aatgttatgtttacactctact

SEQ ID NO: 846082 - DNA, 22 bp, Artificial Sequence
  chemically synthesized
cacacttgacagatgatagtag

SEQ ID NO: 846083 - DNA, 22 bp, Artificial Sequence
  chemically synthesized
tgtttacactctactatcatct

SEQ ID NO: 846084 - DNA, 22 bp, Artificial Sequence
  chemically synthesized
ttgcacacttgacagatgatag

SEQ ID NO: 846085 - DNA, 22 bp, Artificial Sequence
  chemically synthesized
acactctactatcatctgtcaa

SEQ ID NO: 846086 - DNA, 22 bp, Artificial Sequence
  chemically synthesized
cactctactatcatctgtcaag

SEQ ID NO: 846087 - DNA, 22 bp, Artificial Sequence
  chemically synthesized
tactatcatctgtcaagtgtgc

SEQ ID NO: 846088 - DNA, 22 bp, Artificial Sequence
  chemically synthesized
ctatcatctgtcaagtgtgcaa

SEQ ID NO: 846089 - DNA, 22 bp, Artificial Sequence
  chemically synthesized
gatacaatgctattgcacactt

SEQ ID NO: 846090 - DNA, 22 bp, Artificial Sequence
  chemically synthesized
agatacaatgctattgcacact

SEQ ID NO: 846091 - DNA, 22 bp, Artificial Sequence
  chemically synthesized
tagatacaatgctattgcacac

SEQ ID NO: 846092 - DNA, 22 bp, Artificial Sequence
  chemically synthesized
tcatctgtcaagtgtgcaatag

SEQ ID NO: 846093 - DNA, 22 bp, Artificial Sequence
  chemically synthesized
ttagatacaatgctattgcaca

SEQ ID NO: 846094 - DNA, 22 bp, Artificial Sequence
  chemically synthesized
tttagatacaatgctattgcac

SEQ ID NO: 846095 - DNA, 22 bp, Artificial Sequence
  chemically synthesized
tcaagtgtgcaatagcattgta

SEQ ID NO: 846096 - DNA, 22 bp, Artificial Sequence
  chemically synthesized
aggtatgtacattttttagata

SEQ ID NO: 846097 - DNA, 22 bp, Artificial Sequence
  chemically synthesized
aaattaaggtatgtacattttt

SEQ ID NO: 846098 - DNA, 22 bp, Artificial Sequence
  chemically synthesized
caaattaaggtatgtacatttt

SEQ ID NO: 846099 - DNA, 22 bp, Artificial Sequence
  chemically synthesized
tcaaattaaggtatgtacattt

SEQ ID NO: 846100 - DNA, 22 bp, Artificial Sequence
  chemically synthesized
tatctaaaaaatgtacatacct

SEQ ID NO: 846101 - DNA, 22 bp, Artificial Sequence
  chemically synthesized
aaaaatgtacataccttaattt

SEQ ID NO: 846102 - DNA, 22 bp, Artificial Sequence
  chemically synthesized
ggagtaatgtattttcaaatta

SEQ ID NO: 846103 - DNA, 22 bp, Artificial Sequence
  chemically synthesized
aggagtaatgtattttcaaatt

SEQ ID NO: 846104 - DNA, 22 bp, Artificial Sequence
  chemically synthesized
taggagtaatgtattttcaaat

SEQ ID NO: 846105 - DNA, 22 bp, Artificial Sequence
  chemically synthesized
ttaggagtaatgtattttcaaa

SEQ ID NO: 846106 - DNA, 22 bp, Artificial Sequence
  chemically synthesized
tttaggagtaatgtattttcaa

SEQ ID NO: 846107 - DNA, 22 bp, Artificial Sequence
  chemically synthesized
ttttaggagtaatgtattttca

SEQ ID NO: 846108 - DNA, 22 bp, Artificial Sequence
  chemically synthesized
tttttaggagtaatgtattttc

SEQ ID NO: 846109 - DNA, 22 bp, Artificial Sequence
  chemically synthesized
ccattttttttaggagtaatgt

SEQ ID NO: 846110 - DNA, 22 bp, Artificial Sequence
  chemically synthesized
aatttgaaaatacattactcct

SEQ ID NO: 846111 - DNA, 22 bp, Artificial Sequence
  chemically synthesized
atttgaaaatacattactccta

SEQ ID NO: 846112 - DNA, 22 bp, Artificial Sequence
  chemically synthesized
ttaccattttttttaggagtaa

SEQ ID NO: 846113 - DNA, 22 bp, Artificial Sequence
  chemically synthesized
gaaaatacattactcctaaaaa

SEQ ID NO: 846114 - DNA, 22 bp, Artificial Sequence
  chemically synthesized
aaaatacattactcctaaaaaa

SEQ ID NO: 846115 - DNA, 22 bp, Artificial Sequence
  chemically synthesized
agatgattgttaccattttttt

SEQ ID NO: 846116 - DNA, 22 bp, Artificial Sequence
  chemically synthesized
ctcctaaaaaaaatggtaacaa

SEQ ID NO: 846117 - DNA, 22 bp, Artificial Sequence
  chemically synthesized
caggctcagatgattgttacca

SEQ ID NO: 846118 - DNA, 22 bp, Artificial Sequence
  chemically synthesized
ctaaaaaaaatggtaacaatca

SEQ ID NO: 846119 - DNA, 22 bp, Artificial Sequence
  chemically synthesized
cctgcaggctcagatgattgtt

SEQ ID NO: 846120 - DNA, 22 bp, Artificial Sequence
  chemically synthesized
aaaaaaatggtaacaatcatct

SEQ ID NO: 846121 - DNA, 22 bp, Artificial Sequence
  chemically synthesized
tgactccctgcaggctcagatg

SEQ ID NO: 846122 - DNA, 22 bp, Artificial Sequence
  chemically synthesized
taccagcaaaaagattatgact

SEQ ID NO: 846123 - DNA, 22 bp, Artificial Sequence
  chemically synthesized
agcctgcagggagtcataatct

SEQ ID NO: 846124 - DNA, 22 bp, Artificial Sequence
  chemically synthesized
cagggagtcataatctttttgc

SEQ ID NO: 846125 - DNA, 22 bp, Artificial Sequence
  chemically synthesized
aggcaagagcctgtaccagcaa

SEQ ID NO: 846126 - DNA, 22 bp, Artificial Sequence
  chemically synthesized
actgaggcaagagcctgtacca

SEQ ID NO: 846127 - DNA, 22 bp, Artificial Sequence
  chemically synthesized
tttgctggtacaggctcttgcc

SEQ ID NO: 846128 - DNA, 22 bp, Artificial Sequence
  chemically synthesized
ttgctggtacaggctcttgcct

SEQ ID NO: 846129 - DNA, 22 bp, Artificial Sequence
  chemically synthesized
tgctggtacaggctcttgcctc

SEQ ID NO: 846130 - DNA, 22 bp, Artificial Sequence
  chemically synthesized
gctggtacaggctcttgcctca

SEQ ID NO: 846131 - DNA, 22 bp, Artificial Sequence
  chemically synthesized
ctggtacaggctcttgcctcag

SEQ ID NO: 846132 - DNA, 22 bp, Artificial Sequence
  chemically synthesized
gtacaggctcttgcctcagtga

SEQ ID NO: 846133 - DNA, 22 bp, Artificial Sequence
  chemically synthesized
atcaatcagcagccatcctcac

SEQ ID NO: 846134 - DNA, 22 bp, Artificial Sequence
  chemically synthesized
ttgcctcagtgaggatggctgc

SEQ ID NO: 846135 - DNA, 22 bp, Artificial Sequence
  chemically synthesized
gcctcagtgaggatggctgctg

SEQ ID NO: 846136 - DNA, 22 bp, Artificial Sequence
  chemically synthesized
cctcagtgaggatggctgctga

SEQ ID NO: 846137 - DNA, 22 bp, Artificial Sequence
  chemically synthesized
agtgaggatggctgctgattga

SEQ ID NO: 846138 - DNA, 22 bp, Artificial Sequence
  chemically synthesized
agcaaccgccaccctgatcaat

SEQ ID NO: 846139 - DNA, 22 bp, Artificial Sequence
  chemically synthesized
cagcaaccgccaccctgatcaa

SEQ ID NO: 846140 - DNA, 22 bp, Artificial Sequence
  chemically synthesized
ctgattgatcagggtggcggtt

SEQ ID NO: 846141 - DNA, 22 bp, Artificial Sequence
  chemically synthesized
attgatcagggtggcggttgct

SEQ ID NO: 846142 - DNA, 22 bp, Artificial Sequence
  chemically synthesized
atcagggtggcggttgctgaag

SEQ ID NO: 846143 - DNA, 22 bp, Artificial Sequence
  chemically synthesized
cagccatcccgaccttcagcaa

SEQ ID NO: 846144 - DNA, 22 bp, Artificial Sequence
  chemically synthesized
ctacagccatcccgaccttcag

SEQ ID NO: 846145 - DNA, 22 bp, Artificial Sequence
  chemically synthesized
agaaattgctacagccatcccg

SEQ ID NO: 846146 - DNA, 22 bp, Artificial Sequence
  chemically synthesized
aagaaattgctacagccatccc

SEQ ID NO: 846147 - DNA, 22 bp, Artificial Sequence
  chemically synthesized
taagaaattgctacagccatcc

SEQ ID NO: 846148 - DNA, 22 bp, Artificial Sequence
  chemically synthesized
ctgaaggtcgggatggctgtag

SEQ ID NO: 846149 - DNA, 22 bp, Artificial Sequence
  chemically synthesized
ttttaagaaattgctacagcca

SEQ ID NO: 846150 - DNA, 22 bp, Artificial Sequence
  chemically synthesized
attttaagaaattgctacagcc

SEQ ID NO: 846151 - DNA, 22 bp, Artificial Sequence
  chemically synthesized
aaggtcgggatggctgtagcaa

SEQ ID NO: 846152 - DNA, 22 bp, Artificial Sequence
  chemically synthesized
tcttattttaagaaattgctac

SEQ ID NO: 846153 - DNA, 22 bp, Artificial Sequence
  chemically synthesized
ttgtcttattttaagaaattgc

SEQ ID NO: 846154 - DNA, 22 bp, Artificial Sequence
  chemically synthesized
gttgttgtcttattttaagaaa

SEQ ID NO: 846155 - DNA, 22 bp, Artificial Sequence
  chemically synthesized
cgttgttgtcttattttaagaa

SEQ ID NO: 846156 - DNA, 22 bp, Artificial Sequence
  chemically synthesized
tagcaatttcttaaaataagac

SEQ ID NO: 846157 - DNA, 22 bp, Artificial Sequence
  chemically synthesized
cttaaaataagacaacaacgaa

SEQ ID NO: 846158 - DNA, 22 bp, Artificial Sequence
  chemically synthesized
ttaaaataagacaacaacgaag

SEQ ID NO: 846159 - DNA, 22 bp, Artificial Sequence
  chemically synthesized
aaaataagacaacaacgaagtt

SEQ ID NO: 846160 - DNA, 22 bp, Artificial Sequence
  chemically synthesized
aaataagacaacaacgaagttt

SEQ ID NO: 846161 - DNA, 22 bp, Artificial Sequence
  chemically synthesized
taaaggagagccaatcgatgca

SEQ ID NO: 846162 - DNA, 22 bp, Artificial Sequence
  chemically synthesized
gctataaaggagagccaatcga

SEQ ID NO: 846163 - DNA, 22 bp, Artificial Sequence
  chemically synthesized
gctgcatcgattggctctcctt

SEQ ID NO: 846164 - DNA, 22 bp, Artificial Sequence
  chemically synthesized
ctgcatcgattggctctccttt

SEQ ID NO: 846165 - DNA, 22 bp, Artificial Sequence
  chemically synthesized
catcgattggctctcctttata

SEQ ID NO: 846166 - DNA, 22 bp, Artificial Sequence
  chemically synthesized
caaagaaatcattggctataaa

SEQ ID NO: 846167 - DNA, 22 bp, Artificial Sequence
  chemically synthesized
gctctcctttatagccaatgat

SEQ ID NO: 846168 - DNA, 22 bp, Artificial Sequence
  chemically synthesized
tcctttatagccaatgatttct

SEQ ID NO: 846169 - DNA, 22 bp, Artificial Sequence
  chemically synthesized
ctttatagccaatgatttcttt

SEQ ID NO: 846170 - DNA, 22 bp, Artificial Sequence
  chemically synthesized
tatagccaatgatttctttgta

SEQ ID NO: 846171 - DNA, 22 bp, Artificial Sequence
  chemically synthesized
atagccaatgatttctttgtag

SEQ ID NO: 846172 - DNA, 22 bp, Artificial Sequence
  chemically synthesized
tagccaatgatttctttgtagc

SEQ ID NO: 846173 - DNA, 22 bp, Artificial Sequence
  chemically synthesized
tcaaacagcatcacatgctaca

SEQ ID NO: 846174 - DNA, 22 bp, Artificial Sequence
  chemically synthesized
ctttgtagcatgtgatgctgtt

SEQ ID NO: 846175 - DNA, 22 bp, Artificial Sequence
  chemically synthesized
tttgtagcatgtgatgctgttt

SEQ ID NO: 846176 - DNA, 22 bp, Artificial Sequence
  chemically synthesized
tgtagcatgtgatgctgtttga

SEQ ID NO: 846177 - DNA, 22 bp, Artificial Sequence
  chemically synthesized
agtaaaatgctatcaaacagca

SEQ ID NO: 846178 - DNA, 22 bp, Artificial Sequence
  chemically synthesized
gtagcatgtgatgctgtttgat

SEQ ID NO: 846179 - DNA, 22 bp, Artificial Sequence
  chemically synthesized
tagcatgtgatgctgtttgata

SEQ ID NO: 846180 - DNA, 22 bp, Artificial Sequence
  chemically synthesized
ctgagtaaaatgctatcaaaca

SEQ ID NO: 846181 - DNA, 22 bp, Artificial Sequence
  chemically synthesized
tactgagtaaaatgctatcaaa

SEQ ID NO: 846182 - DNA, 22 bp, Artificial Sequence
  chemically synthesized
aaagaagttctactgagtaaaa

SEQ ID NO: 846183 - DNA, 22 bp, Artificial Sequence
  chemically synthesized
gaaagaagttctactgagtaaa

SEQ ID NO: 846184 - DNA, 22 bp, Artificial Sequence
  chemically synthesized
tttgatagcattttactcagta

SEQ ID NO: 846185 - DNA, 22 bp, Artificial Sequence
  chemically synthesized
tgaaagaagttctactgagtaa

SEQ ID NO: 846186 - DNA, 22 bp, Artificial Sequence
  chemically synthesized
gatagcattttactcagtagaa

SEQ ID NO: 846187 - DNA, 22 bp, Artificial Sequence
  chemically synthesized
atagcattttactcagtagaac

SEQ ID NO: 846188 - DNA, 22 bp, Artificial Sequence
  chemically synthesized
aaattttgaaagaagttctact

SEQ ID NO: 846189 - DNA, 22 bp, Artificial Sequence
  chemically synthesized
actcaaattttgaaagaagttc

SEQ ID NO: 846190 - DNA, 22 bp, Artificial Sequence
  chemically synthesized
tactcagtagaacttctttcaa

SEQ ID NO: 846191 - DNA, 22 bp, Artificial Sequence
  chemically synthesized
actcagtagaacttctttcaaa

SEQ ID NO: 846192 - DNA, 22 bp, Artificial Sequence
  chemically synthesized
ctcagtagaacttctttcaaaa

SEQ ID NO: 846193 - DNA, 22 bp, Artificial Sequence
  chemically synthesized
agtagaacttctttcaaaattt

SEQ ID NO: 846194 - DNA, 22 bp, Artificial Sequence
  chemically synthesized
agaagattgactcaaattttga

SEQ ID NO: 846195 - DNA, 22 bp, Artificial Sequence
  chemically synthesized
gagaagattgactcaaattttg

SEQ ID NO: 846196 - DNA, 22 bp, Artificial Sequence
  chemically synthesized
ctttcaaaatttgagtcaatct

SEQ ID NO: 846197 - DNA, 22 bp, Artificial Sequence
  chemically synthesized
tttcaaaatttgagtcaatctt

SEQ ID NO: 846198 - DNA, 22 bp, Artificial Sequence
  chemically synthesized
tcaaaatttgagtcaatcttct

SEQ ID NO: 846199 - DNA, 22 bp, Artificial Sequence
  chemically synthesized
caaaatttgagtcaatcttctc

SEQ ID NO: 846200 - DNA, 22 bp, Artificial Sequence
  chemically synthesized
gcatcagggtttgagaagattg

SEQ ID NO: 846201 - DNA, 22 bp, Artificial Sequence
  chemically synthesized
aaaatttgagtcaatcttctca

SEQ ID NO: 846202 - DNA, 22 bp, Artificial Sequence
  chemically synthesized
gagtcaatcttctcaaaccctg

SEQ ID NO: 846203 - DNA, 22 bp, Artificial Sequence
  chemically synthesized
ataaattagcatcagggtttga

SEQ ID NO: 846204 - DNA, 22 bp, Artificial Sequence
  chemically synthesized
agtcaatcttctcaaaccctga

SEQ ID NO: 846205 - DNA, 22 bp, Artificial Sequence
  chemically synthesized
gttgataaattagcatcagggt

SEQ ID NO: 846206 - DNA, 22 bp, Artificial Sequence
  chemically synthesized
agttgataaattagcatcaggg

SEQ ID NO: 846207 - DNA, 22 bp, Artificial Sequence
  chemically synthesized
ctcaaaccctgatgctaattta

SEQ ID NO: 846208 - DNA, 22 bp, Artificial Sequence
  chemically synthesized
tcaaaccctgatgctaatttat

SEQ ID NO: 846209 - DNA, 22 bp, Artificial Sequence
  chemically synthesized
aaaccctgatgctaatttatca

SEQ ID NO: 846210 - DNA, 22 bp, Artificial Sequence
  chemically synthesized
cataaacttagttgataaatta

SEQ ID NO: 846211 - DNA, 22 bp, Artificial Sequence
  chemically synthesized
atgctaatttatcaactaagtt

SEQ ID NO: 846212 - DNA, 22 bp, Artificial Sequence
  chemically synthesized
gaatattccataaacttagttg

SEQ ID NO: 846213 - DNA, 22 bp, Artificial Sequence
  chemically synthesized
agaatattccataaacttagtt

SEQ ID NO: 846214 - DNA, 22 bp, Artificial Sequence
  chemically synthesized
atttatcaactaagtttatgga

SEQ ID NO: 846215 - DNA, 22 bp, Artificial Sequence
  chemically synthesized
atcaactaagtttatggaatat

SEQ ID NO: 846216 - DNA, 22 bp, Artificial Sequence
  chemically synthesized
tcaactaagtttatggaatatt

SEQ ID NO: 846217 - DNA, 22 bp, Artificial Sequence
  chemically synthesized
agtttatggaatattctaaatc

SEQ ID NO: 846218 - DNA, 22 bp, Artificial Sequence
  chemically synthesized
aaatgacaacaaaggatttaga

SEQ ID NO: 846219 - DNA, 22 bp, Artificial Sequence
  chemically synthesized
atggaatattctaaatcctttg

SEQ ID NO: 846220 - DNA, 22 bp, Artificial Sequence
  chemically synthesized
ttgaaatgacaacaaaggattt

SEQ ID NO: 846221 - DNA, 22 bp, Artificial Sequence
  chemically synthesized
tggaatattctaaatcctttgt

SEQ ID NO: 846222 - DNA, 22 bp, Artificial Sequence
  chemically synthesized
tgaacattgttgaaatgacaac

SEQ ID NO: 846223 - DNA, 22 bp, Artificial Sequence
  chemically synthesized
taaatcctttgttgtcatttca

SEQ ID NO: 846224 - DNA, 22 bp, Artificial Sequence
  chemically synthesized
aatcctttgttgtcatttcaac

SEQ ID NO: 846225 - DNA, 22 bp, Artificial Sequence
  chemically synthesized
tgttgtcatttcaacaatgttc

SEQ ID NO: 846226 - DNA, 22 bp, Artificial Sequence
  chemically synthesized
gttgtcatttcaacaatgttca

SEQ ID NO: 846227 - DNA, 22 bp, Artificial Sequence
  chemically synthesized
gtgatgatgctgtgaacattgt

SEQ ID NO: 846228 - DNA, 22 bp, Artificial Sequence
  chemically synthesized
ttgtcatttcaacaatgttcac

SEQ ID NO: 846229 - DNA, 22 bp, Artificial Sequence
  chemically synthesized
ggtgatgatgctgtgaacattg

SEQ ID NO: 846230 - DNA, 22 bp, Artificial Sequence
  chemically synthesized
ttggtgatgatgctgtgaacat

SEQ ID NO: 846231 - DNA, 22 bp, Artificial Sequence
  chemically synthesized
tcatttcaacaatgttcacagc

SEQ ID NO: 846232 - DNA, 22 bp, Artificial Sequence
  chemically synthesized
ctcttggtgatgatgctgtgaa

SEQ ID NO: 846233 - DNA, 22 bp, Artificial Sequence
  chemically synthesized
tactcttggtgatgatgctgtg

SEQ ID NO: 846234 - DNA, 22 bp, Artificial Sequence
  chemically synthesized
caacaatgttcacagcatcatc

SEQ ID NO: 846235 - DNA, 22 bp, Artificial Sequence
  chemically synthesized
aacaatgttcacagcatcatca

SEQ ID NO: 846236 - DNA, 22 bp, Artificial Sequence
  chemically synthesized
acagcatcatcaccaagagtag

SEQ ID NO: 846237 - DNA, 22 bp, Artificial Sequence
  chemically synthesized
atgagatgcactctactcttgg

SEQ ID NO: 846238 - DNA, 22 bp, Artificial Sequence
  chemically synthesized
catgagatgcactctactcttg

SEQ ID NO: 846239 - DNA, 22 bp, Artificial Sequence
  chemically synthesized
tggtttcatgagatgcactcta

SEQ ID NO: 846240 - DNA, 22 bp, Artificial Sequence
  chemically synthesized
tggatgagcaaagattgtggtt

SEQ ID NO: 846241 - DNA, 22 bp, Artificial Sequence
  chemically synthesized
atggatgagcaaagattgtggt

SEQ ID NO: 846242 - DNA, 22 bp, Artificial Sequence
  chemically synthesized
cttatggatgagcaaagattgt

SEQ ID NO: 846243 - DNA, 22 bp, Artificial Sequence
  chemically synthesized
ctgcttatggatgagcaaagat

SEQ ID NO: 846244 - DNA, 22 bp, Artificial Sequence
  chemically synthesized
atgaaaccacaatctttgctca

SEQ ID NO: 846245 - DNA, 22 bp, Artificial Sequence
  chemically synthesized
agcggatccagagttgctgctt

SEQ ID NO: 846246 - DNA, 22 bp, Artificial Sequence
  chemically synthesized
tgctcatccataagcagcaact

SEQ ID NO: 846247 - DNA, 22 bp, Artificial Sequence
  chemically synthesized
cagcggatccagagttgctgct

SEQ ID NO: 846248 - DNA, 22 bp, Artificial Sequence
  chemically synthesized
gctcatccataagcagcaactc

SEQ ID NO: 846249 - DNA, 22 bp, Artificial Sequence
  chemically synthesized
ctcatccataagcagcaactct

SEQ ID NO: 846250 - DNA, 22 bp, Artificial Sequence
  chemically synthesized
atccataagcagcaactctgga

SEQ ID NO: 846251 - DNA, 22 bp, Artificial Sequence
  chemically synthesized
aaggtaaaacttcagcggatcc

SEQ ID NO: 846252 - DNA, 22 bp, Artificial Sequence
  chemically synthesized
taatctcaaggtaaaacttcag

SEQ ID NO: 846253 - DNA, 22 bp, Artificial Sequence
  chemically synthesized
tggatccgctgaagttttacct

SEQ ID NO: 846254 - DNA, 22 bp, Artificial Sequence
  chemically synthesized
gatccgctgaagttttaccttg

SEQ ID NO: 846255 - DNA, 22 bp, Artificial Sequence
  chemically synthesized
aatagctgtaatctcaaggtaa

SEQ ID NO: 846256 - DNA, 22 bp, Artificial Sequence
  chemically synthesized
aagttttaccttgagattacag

SEQ ID NO: 846257 - DNA, 22 bp, Artificial Sequence
  chemically synthesized
taccttgagattacagctattc

SEQ ID NO: 846258 - DNA, 22 bp, Artificial Sequence
  chemically synthesized
accttgagattacagctattca

SEQ ID NO: 846259 - DNA, 22 bp, Artificial Sequence
  chemically synthesized
ccttgagattacagctattcag

SEQ ID NO: 846260 - DNA, 22 bp, Artificial Sequence
  chemically synthesized
gagattacagctattcagtcac

SEQ ID NO: 846261 - DNA, 22 bp, Artificial Sequence
  chemically synthesized
agattacagctattcagtcaca

SEQ ID NO: 846262 - DNA, 22 bp, Artificial Sequence
  chemically synthesized
cagctattcagtcacaccttct

SEQ ID NO: 846263 - DNA, 22 bp, Artificial Sequence
  chemically synthesized
ttcagtcacaccttctgactcc

SEQ ID NO: 846264 - DNA, 22 bp, Artificial Sequence
  chemically synthesized
agtcacaccttctgactccact

SEQ ID NO: 846265 - DNA, 22 bp, Artificial Sequence
  chemically synthesized
ctgactccacttctcattctgg

SEQ ID NO: 846266 - DNA, 22 bp, Artificial Sequence
  chemically synthesized
tgactccacttctcattctggt

SEQ ID NO: 846267 - DNA, 22 bp, Artificial Sequence
  chemically synthesized
actccacttctcattctggttc

SEQ ID NO: 846268 - DNA, 22 bp, Artificial Sequence
  chemically synthesized
cacttctcattctggttctcat

SEQ ID NO: 846269 - DNA, 22 bp, Artificial Sequence
  chemically synthesized
ctcattctggttctcatgctat

SEQ ID NO: 846270 - DNA, 22 bp, Artificial Sequence
  chemically synthesized
tcattctggttctcatgctatt

SEQ ID NO: 846271 - DNA, 22 bp, Artificial Sequence
  chemically synthesized
cagatgtggtagaaatagcatg

SEQ ID NO: 846272 - DNA, 22 bp, Artificial Sequence
  chemically synthesized
attctggttctcatgctatttc

SEQ ID NO: 846273 - DNA, 22 bp, Artificial Sequence
  chemically synthesized
tggttctcatgctatttctacc

SEQ ID NO: 846274 - DNA, 22 bp, Artificial Sequence
  chemically synthesized
gttctcatgctatttctaccac

SEQ ID NO: 846275 - DNA, 22 bp, Artificial Sequence
  chemically synthesized
tcatgctatttctaccacatct

SEQ ID NO: 846276 - DNA, 22 bp, Artificial Sequence
  chemically synthesized
atgctatttctaccacatctgc

SEQ ID NO: 846277 - DNA, 22 bp, Artificial Sequence
  chemically synthesized
agtagaagaagtcactgcagat

SEQ ID NO: 846278 - DNA, 22 bp, Artificial Sequence
  chemically synthesized
cagtagaagaagtcactgcaga

SEQ ID NO: 846279 - DNA, 22 bp, Artificial Sequence
  chemically synthesized
tttctaccacatctgcagtgac

SEQ ID NO: 846280 - DNA, 22 bp, Artificial Sequence
  chemically synthesized
ctaccacatctgcagtgacttc

SEQ ID NO: 846281 - DNA, 22 bp, Artificial Sequence
  chemically synthesized
taccacatctgcagtgacttct

SEQ ID NO: 846282 - DNA, 22 bp, Artificial Sequence
  chemically synthesized
ccacatctgcagtgacttcttc

SEQ ID NO: 846283 - DNA, 22 bp, Artificial Sequence
  chemically synthesized
agggtccaagacttcagtagaa

SEQ ID NO: 846284 - DNA, 22 bp, Artificial Sequence
  chemically synthesized
gagggtccaagacttcagtaga

SEQ ID NO: 846285 - DNA, 22 bp, Artificial Sequence
  chemically synthesized
cagtgacttcttctactgaagt

SEQ ID NO: 846286 - DNA, 22 bp, Artificial Sequence
  chemically synthesized
tgagggtccaagacttcagtag

SEQ ID NO: 846287 - DNA, 22 bp, Artificial Sequence
  chemically synthesized
cttctactgaagtcttggaccc

SEQ ID NO: 846288 - DNA, 22 bp, Artificial Sequence
  chemically synthesized
ttctactgaagtcttggaccct

SEQ ID NO: 846289 - DNA, 22 bp, Artificial Sequence
  chemically synthesized
atcaatgactttgagggtccaa

SEQ ID NO: 846290 - DNA, 22 bp, Artificial Sequence
  chemically synthesized
ctactgaagtcttggaccctca

SEQ ID NO: 846291 - DNA, 22 bp, Artificial Sequence
  chemically synthesized
tactgaagtcttggaccctcaa

SEQ ID NO: 846292 - DNA, 22 bp, Artificial Sequence
  chemically synthesized
ctgaagtcttggaccctcaaag

SEQ ID NO: 846293 - DNA, 22 bp, Artificial Sequence
  chemically synthesized
aagtcttggaccctcaaagtca

SEQ ID NO: 846294 - DNA, 22 bp, Artificial Sequence
  chemically synthesized
caacactcatcaatgactttga

SEQ ID NO: 846295 - DNA, 22 bp, Artificial Sequence
  chemically synthesized
attccaacactcatcaatgact

SEQ ID NO: 846296 - DNA, 22 bp, Artificial Sequence
  chemically synthesized
ggaccctcaaagtcattgatga

SEQ ID NO: 846297 - DNA, 22 bp, Artificial Sequence
  chemically synthesized
gaccctcaaagtcattgatgag

SEQ ID NO: 846298 - DNA, 22 bp, Artificial Sequence
  chemically synthesized
aaagtcattgatgagtgttgga

SEQ ID NO: 846299 - DNA, 22 bp, Artificial Sequence
  chemically synthesized
gaagtagttaattccaacactc

SEQ ID NO: 846300 - DNA, 22 bp, Artificial Sequence
  chemically synthesized
ggaagtagttaattccaacact

SEQ ID NO: 846301 - DNA, 22 bp, Artificial Sequence
  chemically synthesized
atgagtgttggaattaactact

SEQ ID NO: 846302 - DNA, 22 bp, Artificial Sequence
  chemically synthesized
tcaggagtttggaagtagttaa

SEQ ID NO: 846303 - DNA, 22 bp, Artificial Sequence
  chemically synthesized
gaattaactacttccaaactcc

SEQ ID NO: 846304 - DNA, 22 bp, Artificial Sequence
  chemically synthesized
actacttccaaactcctgataa

SEQ ID NO: 846305 - DNA, 22 bp, Artificial Sequence
  chemically synthesized
cttccaaactcctgataatgtt

SEQ ID NO: 846306 - DNA, 22 bp, Artificial Sequence
  chemically synthesized
ccaaactcctgataatgttgat

SEQ ID NO: 846307 - DNA, 22 bp, Artificial Sequence
  chemically synthesized
caaactcctgataatgttgata

SEQ ID NO: 846308 - DNA, 22 bp, Artificial Sequence
  chemically synthesized
aggggaggaggtcaaaatatca

SEQ ID NO: 846309 - DNA, 22 bp, Artificial Sequence
  chemically synthesized
ctgataatgttgatattttgac

SEQ ID NO: 846310 - DNA, 22 bp, Artificial Sequence
  chemically synthesized
ataatgttgatattttgacctc

SEQ ID NO: 846311 - DNA, 22 bp, Artificial Sequence
  chemically synthesized
atgattgaggggaggaggtcaa

SEQ ID NO: 846312 - DNA, 22 bp, Artificial Sequence
  chemically synthesized
atattttgacctcctcccctca

SEQ ID NO: 846313 - DNA, 22 bp, Artificial Sequence
  chemically synthesized
tgacctcctcccctcaatcatg

SEQ ID NO: 846314 - DNA, 22 bp, Artificial Sequence
  chemically synthesized
gacctcctcccctcaatcatga

SEQ ID NO: 846315 - DNA, 22 bp, Artificial Sequence
  chemically synthesized
acctcctcccctcaatcatgaa

SEQ ID NO: 846316 - DNA, 22 bp, Artificial Sequence
  chemically synthesized
ctcccctcaatcatgaattttc

SEQ ID NO: 846317 - DNA, 22 bp, Artificial Sequence
  chemically synthesized
cagatgccatgaagaaaattca

SEQ ID NO: 846318 - DNA, 22 bp, Artificial Sequence
  chemically synthesized
ccctcaatcatgaattttcttc

SEQ ID NO: 846319 - DNA, 22 bp, Artificial Sequence
  chemically synthesized
aatcatgaattttcttcatggc

SEQ ID NO: 846320 - DNA, 22 bp, Artificial Sequence
  chemically synthesized
accattccagatgccatgaaga

SEQ ID NO: 846321 - DNA, 22 bp, Artificial Sequence
  chemically synthesized
tcttcatggcatctggaatggt

SEQ ID NO: 846322 - DNA, 22 bp, Artificial Sequence
  chemically synthesized
cttcatggcatctggaatggtg

SEQ ID NO: 846323 - DNA, 22 bp, Artificial Sequence
  chemically synthesized
ttcatggcatctggaatggtga

SEQ ID NO: 846324 - DNA, 22 bp, Artificial Sequence
  chemically synthesized
catggcatctggaatggtgagg

SEQ ID NO: 846325 - DNA, 22 bp, Artificial Sequence
  chemically synthesized
aaaacggaaagtcctcaccatt

SEQ ID NO: 846326 - DNA, 22 bp, Artificial Sequence
  chemically synthesized
atggcatctggaatggtgagga

SEQ ID NO: 846327 - DNA, 22 bp, Artificial Sequence
  chemically synthesized
gaatggtgaggactttccgttt

SEQ ID NO: 846328 - DNA, 22 bp, Artificial Sequence
  chemically synthesized
gataaagtaaactgaaaacgga

SEQ ID NO: 846329 - DNA, 22 bp, Artificial Sequence
  chemically synthesized
atggatctggataaagtaaact

SEQ ID NO: 846330 - DNA, 22 bp, Artificial Sequence
  chemically synthesized
tccgttttcagtttactttatc

SEQ ID NO: 846331 - DNA, 22 bp, Artificial Sequence
  chemically synthesized
ccgttttcagtttactttatcc

SEQ ID NO: 846332 - DNA, 22 bp, Artificial Sequence
  chemically synthesized
cgttttcagtttactttatcca

SEQ ID NO: 846333 - DNA, 22 bp, Artificial Sequence
  chemically synthesized
tcagtttactttatccagatcc

SEQ ID NO: 846334 - DNA, 22 bp, Artificial Sequence
  chemically synthesized
cagtttactttatccagatcca

SEQ ID NO: 846335 - DNA, 22 bp, Artificial Sequence
  chemically synthesized
agtttactttatccagatccat

SEQ ID NO: 846336 - DNA, 22 bp, Artificial Sequence
  chemically synthesized
tggtgagtccactgatggatct

SEQ ID NO: 846337 - DNA, 22 bp, Artificial Sequence
  chemically synthesized
actttatccagatccatcagtg

SEQ ID NO: 846338 - DNA, 22 bp, Artificial Sequence
  chemically synthesized
ctttatccagatccatcagtgg

SEQ ID NO: 846339 - DNA, 22 bp, Artificial Sequence
  chemically synthesized
tattgtggtgagtccactgatg

SEQ ID NO: 846340 - DNA, 22 bp, Artificial Sequence
  chemically synthesized
tatccagatccatcagtggact

SEQ ID NO: 846341 - DNA, 22 bp, Artificial Sequence
  chemically synthesized
atccagatccatcagtggactc

SEQ ID NO: 846342 - DNA, 22 bp, Artificial Sequence
  chemically synthesized
ctatattgtggtgagtccactg

SEQ ID NO: 846343 - DNA, 22 bp, Artificial Sequence
  chemically synthesized
tccagatccatcagtggactca

SEQ ID NO: 846344 - DNA, 22 bp, Artificial Sequence
  chemically synthesized
ataaaggtatagctgctatatt

SEQ ID NO: 846345 - DNA, 22 bp, Artificial Sequence
  chemically synthesized
cataaaggtatagctgctatat

SEQ ID NO: 846346 - DNA, 22 bp, Artificial Sequence
  chemically synthesized
accacaatatagcagctatacc

SEQ ID NO: 846347 - DNA, 22 bp, Artificial Sequence
  chemically synthesized
aatcatacatttcataaaggta

SEQ ID NO: 846348 - DNA, 22 bp, Artificial Sequence
  chemically synthesized
aaatcatacatttcataaaggt

SEQ ID NO: 846349 - DNA, 22 bp, Artificial Sequence
  chemically synthesized
cttaaatcatacatttcataaa

SEQ ID NO: 846350 - DNA, 22 bp, Artificial Sequence
  chemically synthesized
ttacttaaatcatacatttcat

SEQ ID NO: 846351 - DNA, 22 bp, Artificial Sequence
  chemically synthesized
attacttaaatcatacatttca

SEQ ID NO: 846352 - DNA, 22 bp, Artificial Sequence
  chemically synthesized
tacctttatgaaatgtatgatt

SEQ ID NO: 846353 - DNA, 22 bp, Artificial Sequence
  chemically synthesized
aagtcttattacttaaatcata

SEQ ID NO: 846354 - DNA, 22 bp, Artificial Sequence
  chemically synthesized
caagtcttattacttaaatcat

SEQ ID NO: 846355 - DNA, 22 bp, Artificial Sequence
  chemically synthesized
tcaagtcttattacttaaatca

SEQ ID NO: 846356 - DNA, 22 bp, Artificial Sequence
  chemically synthesized
tatgaaatgtatgatttaagta

SEQ ID NO: 846357 - DNA, 22 bp, Artificial Sequence
  chemically synthesized
atgaaatgtatgatttaagtaa

SEQ ID NO: 846358 - DNA, 22 bp, Artificial Sequence
  chemically synthesized
tgaaatgtatgatttaagtaat

SEQ ID NO: 846359 - DNA, 22 bp, Artificial Sequence
  chemically synthesized
aactttcaagtcttattactta

SEQ ID NO: 846360 - DNA, 22 bp, Artificial Sequence
  chemically synthesized
caactttcaagtcttattactt

SEQ ID NO: 846361 - DNA, 22 bp, Artificial Sequence
  chemically synthesized
aagtaataagacttgaaagttg

SEQ ID NO: 846362 - DNA, 22 bp, Artificial Sequence
  chemically synthesized
agtaataagacttgaaagttga

SEQ ID NO: 846363 - DNA, 22 bp, Artificial Sequence
  chemically synthesized
gatcaagaagtcacttcaactt

SEQ ID NO: 846364 - DNA, 22 bp, Artificial Sequence
  chemically synthesized
ggatcaagaagtcacttcaact

SEQ ID NO: 846365 - DNA, 22 bp, Artificial Sequence
  chemically synthesized
cagtccttggatcaagaagtca

SEQ ID NO: 846366 - DNA, 22 bp, Artificial Sequence
  chemically synthesized
gaaagttgaagtgacttcttga

SEQ ID NO: 846367 - DNA, 22 bp, Artificial Sequence
  chemically synthesized
aaagttgaagtgacttcttgat

SEQ ID NO: 846368 - DNA, 22 bp, Artificial Sequence
  chemically synthesized
tgcagtccttggatcaagaagt

SEQ ID NO: 846369 - DNA, 22 bp, Artificial Sequence
  chemically synthesized
aagtgacttcttgatccaagga

SEQ ID NO: 846370 - DNA, 22 bp, Artificial Sequence
  chemically synthesized
acacaacatccattctgcagtc

SEQ ID NO: 846371 - DNA, 22 bp, Artificial Sequence
  chemically synthesized
cttgatccaaggactgcagaat

SEQ ID NO: 846372 - DNA, 22 bp, Artificial Sequence
  chemically synthesized
ttgatccaaggactgcagaatg

SEQ ID NO: 846373 - DNA, 22 bp, Artificial Sequence
  chemically synthesized
ctaacacaacatccattctgca

SEQ ID NO: 846374 - DNA, 22 bp, Artificial Sequence
  chemically synthesized
gatccaaggactgcagaatgga

SEQ ID NO: 846375 - DNA, 22 bp, Artificial Sequence
  chemically synthesized
atccaaggactgcagaatggat

SEQ ID NO: 846376 - DNA, 22 bp, Artificial Sequence
  chemically synthesized
atacctgctaacacaacatcca

SEQ ID NO: 846377 - DNA, 22 bp, Artificial Sequence
  chemically synthesized
catacctgctaacacaacatcc

SEQ ID NO: 846378 - DNA, 22 bp, Artificial Sequence
  chemically synthesized
tcatacctgctaacacaacatc

SEQ ID NO: 846379 - DNA, 22 bp, Artificial Sequence
  chemically synthesized
ttttcatacctgctaacacaac

SEQ ID NO: 846380 - DNA, 22 bp, Artificial Sequence
  chemically synthesized
attttcatacctgctaacacaa

SEQ ID NO: 846381 - DNA, 22 bp, Artificial Sequence
  chemically synthesized
cagaatggatgttgtgttagca

SEQ ID NO: 846382 - DNA, 22 bp, Artificial Sequence
  chemically synthesized
tattttcatacctgctaacaca

SEQ ID NO: 846383 - DNA, 22 bp, Artificial Sequence
  chemically synthesized
tgttagcaggtatgaaaataaa

SEQ ID NO: 846384 - DNA, 22 bp, Artificial Sequence
  chemically synthesized
gcaggtatgaaaataaaatcat

SEQ ID NO: 846385 - DNA, 22 bp, Artificial Sequence
  chemically synthesized
aggaatatgtccaaagagaatg

SEQ ID NO: 846386 - DNA, 22 bp, Artificial Sequence
  chemically synthesized
tctttggacatattcctcaggg

SEQ ID NO: 846387 - DNA, 22 bp, Artificial Sequence
  chemically synthesized
gtcacccaagagccctgaggaa

SEQ ID NO: 846388 - DNA, 22 bp, Artificial Sequence
  chemically synthesized
tttggacatattcctcagggct

SEQ ID NO: 846389 - DNA, 22 bp, Artificial Sequence
  chemically synthesized
tggacatattcctcagggctct

SEQ ID NO: 846390 - DNA, 22 bp, Artificial Sequence
  chemically synthesized
ggacatattcctcagggctctt

SEQ ID NO: 846391 - DNA, 22 bp, Artificial Sequence
  chemically synthesized
gacatattcctcagggctcttg

SEQ ID NO: 846392 - DNA, 22 bp, Artificial Sequence
  chemically synthesized
acaatgtccctggtcacccaag

SEQ ID NO: 846393 - DNA, 22 bp, Artificial Sequence
  chemically synthesized
gacaatgtccctggtcacccaa

SEQ ID NO: 846394 - DNA, 22 bp, Artificial Sequence
  chemically synthesized
tgacaatgtccctggtcaccca

SEQ ID NO: 846395 - DNA, 22 bp, Artificial Sequence
  chemically synthesized
ctcagggctcttgggtgaccag

SEQ ID NO: 846396 - DNA, 22 bp, Artificial Sequence
  chemically synthesized
tttgacaatgtccctggtcacc

SEQ ID NO: 846397 - DNA, 22 bp, Artificial Sequence
  chemically synthesized
agggctcttgggtgaccaggga

SEQ ID NO: 846398 - DNA, 22 bp, Artificial Sequence
  chemically synthesized
ctctttgacaatgtccctggtc

SEQ ID NO: 846399 - DNA, 22 bp, Artificial Sequence
  chemically synthesized
ctgctctttgacaatgtccctg

SEQ ID NO: 846400 - DNA, 22 bp, Artificial Sequence
  chemically synthesized
ttgggtgaccagggacattgtc

SEQ ID NO: 846401 - DNA, 22 bp, Artificial Sequence
  chemically synthesized
gggtgaccagggacattgtcaa

SEQ ID NO: 846402 - DNA, 22 bp, Artificial Sequence
  chemically synthesized
ggtgaccagggacattgtcaaa

SEQ ID NO: 846403 - DNA, 22 bp, Artificial Sequence
  chemically synthesized
aaaatattactgctctttgaca

SEQ ID NO: 846404 - DNA, 22 bp, Artificial Sequence
  chemically synthesized
caaaatattactgctctttgac

SEQ ID NO: 846405 - DNA, 22 bp, Artificial Sequence
  chemically synthesized
tcaaaatattactgctctttga

SEQ ID NO: 846406 - DNA, 22 bp, Artificial Sequence
  chemically synthesized
tcaaagagcagtaatattttga

SEQ ID NO: 846407 - DNA, 22 bp, Artificial Sequence
  chemically synthesized
aaaaaaatgtgtctttcaaaat

SEQ ID NO: 846408 - DNA, 22 bp, Artificial Sequence
  chemically synthesized
tcaaaaaaatgtgtctttcaaa

SEQ ID NO: 846409 - DNA, 22 bp, Artificial Sequence
  chemically synthesized
ctcaaaaaaatgtgtctttcaa

SEQ ID NO: 846410 - DNA, 22 bp, Artificial Sequence
  chemically synthesized
cttctcaaaaaaatgtgtcttt

SEQ ID NO: 846411 - DNA, 22 bp, Artificial Sequence
  chemically synthesized
agacctacttctcaaaaaaatg

SEQ ID NO: 846412 - DNA, 22 bp, Artificial Sequence
  chemically synthesized
tgaaagacacatttttttgaga

SEQ ID NO: 846413 - DNA, 22 bp, Artificial Sequence
  chemically synthesized
ttgagacctacttctcaaaaaa

SEQ ID NO: 846414 - DNA, 22 bp, Artificial Sequence
  chemically synthesized
gaaagacacatttttttgagaa

SEQ ID NO: 846415 - DNA, 22 bp, Artificial Sequence
  chemically synthesized
aaagacacatttttttgagaag

SEQ ID NO: 846416 - DNA, 22 bp, Artificial Sequence
  chemically synthesized
tgttgagacctacttctcaaaa

SEQ ID NO: 846417 - DNA, 22 bp, Artificial Sequence
  chemically synthesized
agccctctgttgagacctactt

SEQ ID NO: 846418 - DNA, 22 bp, Artificial Sequence
  chemically synthesized
gagccctctgttgagacctact

SEQ ID NO: 846419 - DNA, 22 bp, Artificial Sequence
  chemically synthesized
tgagccctctgttgagacctac

SEQ ID NO: 846420 - DNA, 22 bp, Artificial Sequence
  chemically synthesized
ttttgagaagtaggtctcaaca

SEQ ID NO: 846421 - DNA, 22 bp, Artificial Sequence
  chemically synthesized
tttgagaagtaggtctcaacag

SEQ ID NO: 846422 - DNA, 22 bp, Artificial Sequence
  chemically synthesized
ttgagaagtaggtctcaacaga

SEQ ID NO: 846423 - DNA, 22 bp, Artificial Sequence
  chemically synthesized
tgagaagtaggtctcaacagag

SEQ ID NO: 846424 - DNA, 22 bp, Artificial Sequence
  chemically synthesized
gagaagtaggtctcaacagagg

SEQ ID NO: 846425 - DNA, 22 bp, Artificial Sequence
  chemically synthesized
agaagtaggtctcaacagaggg

SEQ ID NO: 846426 - DNA, 22 bp, Artificial Sequence
  chemically synthesized
atgaacattttgagccctctgt

SEQ ID NO: 846427 - DNA, 22 bp, Artificial Sequence
  chemically synthesized
gatgaacattttgagccctctg

SEQ ID NO: 846428 - DNA, 22 bp, Artificial Sequence
  chemically synthesized
aacagagggctcaaaatgttca

SEQ ID NO: 846429 - DNA, 22 bp, Artificial Sequence
  chemically synthesized
cagcatggtttgatgaacattt

SEQ ID NO: 846430 - DNA, 22 bp, Artificial Sequence
  chemically synthesized
acagcatggtttgatgaacatt

SEQ ID NO: 846431 - DNA, 22 bp, Artificial Sequence
  chemically synthesized
tacagcatggtttgatgaacat

SEQ ID NO: 846432 - DNA, 22 bp, Artificial Sequence
  chemically synthesized
tttacagcatggtttgatgaac

SEQ ID NO: 846433 - DNA, 22 bp, Artificial Sequence
  chemically synthesized
aaaatgttcatcaaaccatgct

SEQ ID NO: 846434 - DNA, 22 bp, Artificial Sequence
  chemically synthesized
cacatctctttacagcatggtt

SEQ ID NO: 846435 - DNA, 22 bp, Artificial Sequence
  chemically synthesized
atcaaaccatgctgtaaagaga

SEQ ID NO: 846436 - DNA, 22 bp, Artificial Sequence
  chemically synthesized
gatgactgcacatctctttaca

SEQ ID NO: 846437 - DNA, 22 bp, Artificial Sequence
  chemically synthesized
taaagagatgtgcagtcatcta

SEQ ID NO: 846438 - DNA, 22 bp, Artificial Sequence
  chemically synthesized
taaatcaaacaacaaagactag

SEQ ID NO: 846439 - DNA, 22 bp, Artificial Sequence
  chemically synthesized
tgtaaatcaaacaacaaagact

SEQ ID NO: 846440 - DNA, 22 bp, Artificial Sequence
  chemically synthesized
tgctctgtaaatcaaacaacaa

SEQ ID NO: 846441 - DNA, 22 bp, Artificial Sequence
  chemically synthesized
cctatgctctgtaaatcaaaca

SEQ ID NO: 846442 - DNA, 22 bp, Artificial Sequence
  chemically synthesized
gtctttgttgtttgatttacag

SEQ ID NO: 846443 - DNA, 22 bp, Artificial Sequence
  chemically synthesized
gtctgcctatgctctgtaaatc

SEQ ID NO: 846444 - DNA, 22 bp, Artificial Sequence
  chemically synthesized
tgttgtttgatttacagagcat

SEQ ID NO: 846445 - DNA, 22 bp, Artificial Sequence
  chemically synthesized
gttgtttgatttacagagcata

SEQ ID NO: 846446 - DNA, 22 bp, Artificial Sequence
  chemically synthesized
ttgtttgatttacagagcatag

SEQ ID NO: 846447 - DNA, 22 bp, Artificial Sequence
  chemically synthesized
gatctagtctgcctatgctctg

SEQ ID NO: 846448 - DNA, 22 bp, Artificial Sequence
  chemically synthesized
tttgatttacagagcataggca

SEQ ID NO: 846449 - DNA, 22 bp, Artificial Sequence
  chemically synthesized
tgctagatctagtctgcctatg

SEQ ID NO: 846450 - DNA, 22 bp, Artificial Sequence
  chemically synthesized
gatttacagagcataggcagac

SEQ ID NO: 846451 - DNA, 22 bp, Artificial Sequence
  chemically synthesized
atttacagagcataggcagact

SEQ ID NO: 846452 - DNA, 22 bp, Artificial Sequence
  chemically synthesized
acagagcataggcagactagat

SEQ ID NO: 846453 - DNA, 22 bp, Artificial Sequence
  chemically synthesized
aggttatgctagatctagtctg

SEQ ID NO: 846454 - DNA, 22 bp, Artificial Sequence
  chemically synthesized
cagagcataggcagactagatc

SEQ ID NO: 846455 - DNA, 22 bp, Artificial Sequence
  chemically synthesized
caggttatgctagatctagtct

SEQ ID NO: 846456 - DNA, 22 bp, Artificial Sequence
  chemically synthesized
gggcccttcaggttatgctaga

SEQ ID NO: 846457 - DNA, 22 bp, Artificial Sequence
  chemically synthesized
gatctagcataacctgaagggc

SEQ ID NO: 846458 - DNA, 22 bp, Artificial Sequence
  chemically synthesized
caaaaatcctagggcccttcag

SEQ ID NO: 846459 - DNA, 22 bp, Artificial Sequence
  chemically synthesized
gcataacctgaagggccctagg

SEQ ID NO: 846460 - DNA, 22 bp, Artificial Sequence
  chemically synthesized
ccattccaaaaatcctagggcc

SEQ ID NO: 846461 - DNA, 22 bp, Artificial Sequence
  chemically synthesized
accattccaaaaatcctagggc

SEQ ID NO: 846462 - DNA, 22 bp, Artificial Sequence
  chemically synthesized
gtttaccattccaaaaatccta

SEQ ID NO: 846463 - DNA, 22 bp, Artificial Sequence
  chemically synthesized
aagggccctaggatttttggaa

SEQ ID NO: 846464 - DNA, 22 bp, Artificial Sequence
  chemically synthesized
aagccagtgctcgtttaccatt

SEQ ID NO: 846465 - DNA, 22 bp, Artificial Sequence
  chemically synthesized
ggatttttggaatggtaaacga

SEQ ID NO: 846466 - DNA, 22 bp, Artificial Sequence
  chemically synthesized
agttgaagccagtgctcgttta

SEQ ID NO: 846467 - DNA, 22 bp, Artificial Sequence
  chemically synthesized
cagttgaagccagtgctcgttt

SEQ ID NO: 846468 - DNA, 22 bp, Artificial Sequence
  chemically synthesized
tcagttgaagccagtgctcgtt

SEQ ID NO: 846469 - DNA, 22 bp, Artificial Sequence
  chemically synthesized
ttggaatggtaaacgagcactg

SEQ ID NO: 846470 - DNA, 22 bp, Artificial Sequence
  chemically synthesized
tggaatggtaaacgagcactgg

SEQ ID NO: 846471 - DNA, 22 bp, Artificial Sequence
  chemically synthesized
ggaatggtaaacgagcactggc

SEQ ID NO: 846472 - DNA, 22 bp, Artificial Sequence
  chemically synthesized
gaatggtaaacgagcactggct

SEQ ID NO: 846473 - DNA, 22 bp, Artificial Sequence
  chemically synthesized
gtgactttcagttgaagccagt

SEQ ID NO: 846474 - DNA, 22 bp, Artificial Sequence
  chemically synthesized
atgcaactggtgactttcagtt

SEQ ID NO: 846475 - DNA, 22 bp, Artificial Sequence
  chemically synthesized
gcttcaactgaaagtcaccagt

SEQ ID NO: 846476 - DNA, 22 bp, Artificial Sequence
  chemically synthesized
tgaggggctaatgcaactggtg

SEQ ID NO: 846477 - DNA, 22 bp, Artificial Sequence
  chemically synthesized
caactgaaagtcaccagttgca

SEQ ID NO: 846478 - DNA, 22 bp, Artificial Sequence
  chemically synthesized
gtgaggggctaatgcaactggt

SEQ ID NO: 846479 - DNA, 22 bp, Artificial Sequence
  chemically synthesized
aactgaaagtcaccagttgcat

SEQ ID NO: 846480 - DNA, 22 bp, Artificial Sequence
  chemically synthesized
tcttgtgaggggctaatgcaac

SEQ ID NO: 846481 - DNA, 22 bp, Artificial Sequence
  chemically synthesized
aaagtcaccagttgcattagcc

SEQ ID NO: 846482 - DNA, 22 bp, Artificial Sequence
  chemically synthesized
actgtcttgtgaggggctaatg

SEQ ID NO: 846483 - DNA, 22 bp, Artificial Sequence
  chemically synthesized
cattagcccctcacaagacagt

SEQ ID NO: 846484 - DNA, 22 bp, Artificial Sequence
  chemically synthesized
aaaggacaggctgactgtcttg

SEQ ID NO: 846485 - DNA, 22 bp, Artificial Sequence
  chemically synthesized
gcccctcacaagacagtcagcc

SEQ ID NO: 846486 - DNA, 22 bp, Artificial Sequence
  chemically synthesized
aaaagttcaaaggacaggctga

SEQ ID NO: 846487 - DNA, 22 bp, Artificial Sequence
  chemically synthesized
caaaagttcaaaggacaggctg

SEQ ID NO: 846488 - DNA, 22 bp, Artificial Sequence
  chemically synthesized
acaagacagtcagcctgtcctt

SEQ ID NO: 846489 - DNA, 22 bp, Artificial Sequence
  chemically synthesized
gcttcaaaagttcaaaggacag

SEQ ID NO: 846490 - DNA, 22 bp, Artificial Sequence
  chemically synthesized
tcctttgaacttttgaagccag

SEQ ID NO: 846491 - DNA, 22 bp, Artificial Sequence
  chemically synthesized
gagagaagtcaatgcctggctt

SEQ ID NO: 846492 - DNA, 22 bp, Artificial Sequence
  chemically synthesized
tgaacttttgaagccaggcatt

SEQ ID NO: 846493 - DNA, 22 bp, Artificial Sequence
  chemically synthesized
gaacttttgaagccaggcattg

SEQ ID NO: 846494 - DNA, 22 bp, Artificial Sequence
  chemically synthesized
aacttttgaagccaggcattga

SEQ ID NO: 846495 - DNA, 22 bp, Artificial Sequence
  chemically synthesized
atagctagagagaagtcaatgc

SEQ ID NO: 846496 - DNA, 22 bp, Artificial Sequence
  chemically synthesized
catagctagagagaagtcaatg

SEQ ID NO: 846497 - DNA, 22 bp, Artificial Sequence
  chemically synthesized
ttgaagccaggcattgacttct

SEQ ID NO: 846498 - DNA, 22 bp, Artificial Sequence
  chemically synthesized
tcatagctagagagaagtcaat

SEQ ID NO: 846499 - DNA, 22 bp, Artificial Sequence
  chemically synthesized
tgaagccaggcattgacttctc

SEQ ID NO: 846500 - DNA, 22 bp, Artificial Sequence
  chemically synthesized
gaagccaggcattgacttctct

SEQ ID NO: 846501 - DNA, 22 bp, Artificial Sequence
  chemically synthesized
aagccaggcattgacttctctc

SEQ ID NO: 846502 - DNA, 22 bp, Artificial Sequence
  chemically synthesized
ggactttcatagctagagagaa

SEQ ID NO: 846503 - DNA, 22 bp, Artificial Sequence
  chemically synthesized
acttctctctagctatgaaagt

SEQ ID NO: 846504 - DNA, 22 bp, Artificial Sequence
  chemically synthesized
ctctctagctatgaaagtccta

SEQ ID NO: 846505 - DNA, 22 bp, Artificial Sequence
  chemically synthesized
tctctagctatgaaagtcctag

SEQ ID NO: 846506 - DNA, 22 bp, Artificial Sequence
  chemically synthesized
tctagctatgaaagtcctagat

SEQ ID NO: 846507 - DNA, 22 bp, Artificial Sequence
  chemically synthesized
gaaaaggatgccatctaggact

SEQ ID NO: 846508 - DNA, 22 bp, Artificial Sequence
  chemically synthesized
tagctatgaaagtcctagatgg

SEQ ID NO: 846509 - DNA, 22 bp, Artificial Sequence
  chemically synthesized
ttggaaaaggatgccatctagg

SEQ ID NO: 846510 - DNA, 22 bp, Artificial Sequence
  chemically synthesized
gctatgaaagtcctagatggca

SEQ ID NO: 846511 - DNA, 22 bp, Artificial Sequence
  chemically synthesized
tattggaaaaggatgccatcta

SEQ ID NO: 846512 - DNA, 22 bp, Artificial Sequence
  chemically synthesized
ctattggaaaaggatgccatct

SEQ ID NO: 846513 - DNA, 22 bp, Artificial Sequence
  chemically synthesized
tgaaagtcctagatggcatcct

SEQ ID NO: 846514 - DNA, 22 bp, Artificial Sequence
  chemically synthesized
gatggcatccttttccaataga

SEQ ID NO: 846515 - DNA, 22 bp, Artificial Sequence
  chemically synthesized
aatatagacgaaacagccttct

SEQ ID NO: 846516 - DNA, 22 bp, Artificial Sequence
  chemically synthesized
caatatagacgaaacagccttc

SEQ ID NO: 846517 - DNA, 22 bp, Artificial Sequence
  chemically synthesized
tcaatatagacgaaacagcctt

SEQ ID NO: 846518 - DNA, 22 bp, Artificial Sequence
  chemically synthesized
ttccaatagaaggctgtttcgt

SEQ ID NO: 846519 - DNA, 22 bp, Artificial Sequence
  chemically synthesized
tccaatagaaggctgtttcgtc

SEQ ID NO: 846520 - DNA, 22 bp, Artificial Sequence
  chemically synthesized
ccaatagaaggctgtttcgtct

SEQ ID NO: 846521 - DNA, 22 bp, Artificial Sequence
  chemically synthesized
caatagaaggctgtttcgtcta

SEQ ID NO: 846522 - DNA, 22 bp, Artificial Sequence
  chemically synthesized
aacaacacattttcaatataga

SEQ ID NO: 846523 - DNA, 22 bp, Artificial Sequence
  chemically synthesized
tttcgtctatattgaaaatgtg

SEQ ID NO: 846524 - DNA, 22 bp, Artificial Sequence
  chemically synthesized
cgtctatattgaaaatgtgttg

SEQ ID NO: 846525 - DNA, 22 bp, Artificial Sequence
  chemically synthesized
gtctatattgaaaatgtgttgt

SEQ ID NO: 846526 - DNA, 22 bp, Artificial Sequence
  chemically synthesized
tattgaaaatgtgttgtttagt

SEQ ID NO: 846527 - DNA, 22 bp, Artificial Sequence
  chemically synthesized
ataaaggtggcaatactaaaca

SEQ ID NO: 846528 - DNA, 22 bp, Artificial Sequence
  chemically synthesized
aaaatgtgttgtttagtattgc

SEQ ID NO: 846529 - DNA, 22 bp, Artificial Sequence
  chemically synthesized
agttaataaaggtggcaatact

SEQ ID NO: 846530 - DNA, 22 bp, Artificial Sequence
  chemically synthesized
acatctaagttaataaaggtgg

SEQ ID NO: 846531 - DNA, 22 bp, Artificial Sequence
  chemically synthesized
tttagtattgccacctttatta

SEQ ID NO: 846532 - DNA, 22 bp, Artificial Sequence
  chemically synthesized
agtattgccacctttattaact

SEQ ID NO: 846533 - DNA, 22 bp, Artificial Sequence
  chemically synthesized
gtattgccacctttattaactt

SEQ ID NO: 846534 - DNA, 22 bp, Artificial Sequence
  chemically synthesized
ccacctttattaacttagatgt

SEQ ID NO: 846535 - DNA, 22 bp, Artificial Sequence
  chemically synthesized
tccagaagatcaaactaacatc

SEQ ID NO: 846536 - DNA, 22 bp, Artificial Sequence
  chemically synthesized
tattaacttagatgttagtttg

SEQ ID NO: 846537 - DNA, 22 bp, Artificial Sequence
  chemically synthesized
attaacttagatgttagtttga

SEQ ID NO: 846538 - DNA, 22 bp, Artificial Sequence
  chemically synthesized
ttaacttagatgttagtttgat

SEQ ID NO: 846539 - DNA, 22 bp, Artificial Sequence
  chemically synthesized
acttagatgttagtttgatctt

SEQ ID NO: 846540 - DNA, 22 bp, Artificial Sequence
  chemically synthesized
cagcaaactatccagaagatca

SEQ ID NO: 846541 - DNA, 22 bp, Artificial Sequence
  chemically synthesized
agatgttagtttgatcttctgg

SEQ ID NO: 846542 - DNA, 22 bp, Artificial Sequence
  chemically synthesized
gatgttagtttgatcttctgga

SEQ ID NO: 846543 - DNA, 22 bp, Artificial Sequence
  chemically synthesized
gtttgatcttctggatagtttg

SEQ ID NO: 846544 - DNA, 22 bp, Artificial Sequence
  chemically synthesized
atggagaagctgcagcaaacta

SEQ ID NO: 846545 - DNA, 22 bp, Artificial Sequence
  chemically synthesized
gatcttctggatagtttgctgc

SEQ ID NO: 846546 - DNA, 22 bp, Artificial Sequence
  chemically synthesized
atcttctggatagtttgctgca

SEQ ID NO: 846547 - DNA, 22 bp, Artificial Sequence
  chemically synthesized
ctggatagtttgctgcagcttc

SEQ ID NO: 846548 - DNA, 22 bp, Artificial Sequence
  chemically synthesized
tggatagtttgctgcagcttct

SEQ ID NO: 846549 - DNA, 22 bp, Artificial Sequence
  chemically synthesized
gatagtttgctgcagcttctcc

SEQ ID NO: 846550 - DNA, 22 bp, Artificial Sequence
  chemically synthesized
gctgcagcttctccatcagcac

SEQ ID NO: 846551 - DNA, 22 bp, Artificial Sequence
  chemically synthesized
ctgcagcttctccatcagcact

SEQ ID NO: 846552 - DNA, 22 bp, Artificial Sequence
  chemically synthesized
cagcttctccatcagcacttgt

SEQ ID NO: 846553 - DNA, 22 bp, Artificial Sequence
  chemically synthesized
ctccatcagcacttgttgctct

SEQ ID NO: 846554 - DNA, 22 bp, Artificial Sequence
  chemically synthesized
tccatcagcacttgttgctctg

SEQ ID NO: 846555 - DNA, 22 bp, Artificial Sequence
  chemically synthesized
catcagcacttgttgctctgcc

SEQ ID NO: 846556 - DNA, 22 bp, Artificial Sequence
  chemically synthesized
taacataaaagtgcaaggcaga

SEQ ID NO: 846557 - DNA, 22 bp, Artificial Sequence
  chemically synthesized
tataacataaaagtgcaaggca

SEQ ID NO: 846558 - DNA, 22 bp, Artificial Sequence
  chemically synthesized
tctataacataaaagtgcaagg

SEQ ID NO: 846559 - DNA, 22 bp, Artificial Sequence
  chemically synthesized
gttgctctgccttgcactttta

SEQ ID NO: 846560 - DNA, 22 bp, Artificial Sequence
  chemically synthesized
ttgctctgccttgcacttttat

SEQ ID NO: 846561 - DNA, 22 bp, Artificial Sequence
  chemically synthesized
ctctgccttgcacttttatgtt

SEQ ID NO: 846562 - DNA, 22 bp, Artificial Sequence
  chemically synthesized
tgccttgcacttttatgttata

SEQ ID NO: 846563 - DNA, 22 bp, Artificial Sequence
  chemically synthesized
ccttgcacttttatgttataga

SEQ ID NO: 846564 - DNA, 22 bp, Artificial Sequence
  chemically synthesized
atgaataagccctctctataac

SEQ ID NO: 846565 - DNA, 22 bp, Artificial Sequence
  chemically synthesized
aatgaataagccctctctataa

SEQ ID NO: 846566 - DNA, 22 bp, Artificial Sequence
  chemically synthesized
gcacttttatgttatagagagg

SEQ ID NO: 846567 - DNA, 22 bp, Artificial Sequence
  chemically synthesized
cacttttatgttatagagaggg

SEQ ID NO: 846568 - DNA, 22 bp, Artificial Sequence
  chemically synthesized
ttatgttatagagagggcttat

SEQ ID NO: 846569 - DNA, 22 bp, Artificial Sequence
  chemically synthesized
tatgttatagagagggcttatt

SEQ ID NO: 846570 - DNA, 22 bp, Artificial Sequence
  chemically synthesized
atgttatagagagggcttattc

SEQ ID NO: 846571 - DNA, 22 bp, Artificial Sequence
  chemically synthesized
atgagccttaatgaataagccc

SEQ ID NO: 846572 - DNA, 22 bp, Artificial Sequence
  chemically synthesized
tgttatagagagggcttattca

SEQ ID NO: 846573 - DNA, 22 bp, Artificial Sequence
  chemically synthesized
tagagagggcttattcattaag

SEQ ID NO: 846574 - DNA, 22 bp, Artificial Sequence
  chemically synthesized
gcagaagtatgttcatgagcct

SEQ ID NO: 846575 - DNA, 22 bp, Artificial Sequence
  chemically synthesized
attcattaaggctcatgaacat

SEQ ID NO: 846576 - DNA, 22 bp, Artificial Sequence
  chemically synthesized
ttcattaaggctcatgaacata

SEQ ID NO: 846577 - DNA, 22 bp, Artificial Sequence
  chemically synthesized
gaagctagcagaagtatgttca

SEQ ID NO: 846578 - DNA, 22 bp, Artificial Sequence
  chemically synthesized
attaaggctcatgaacatactt

SEQ ID NO: 846579 - DNA, 22 bp, Artificial Sequence
  chemically synthesized
aggctcatgaacatacttctgc

SEQ ID NO: 846580 - DNA, 22 bp, Artificial Sequence
  chemically synthesized
atgaacatacttctgctagctt

SEQ ID NO: 846581 - DNA, 22 bp, Artificial Sequence
  chemically synthesized
cagcagaaaagttggaagctag

SEQ ID NO: 846582 - DNA, 22 bp, Artificial Sequence
  chemically synthesized
ctgctagcttccaacttttctg

SEQ ID NO: 846583 - DNA, 22 bp, Artificial Sequence
  chemically synthesized
tgctagcttccaacttttctgc

SEQ ID NO: 846584 - DNA, 22 bp, Artificial Sequence
  chemically synthesized
ctagcttccaacttttctgctg

SEQ ID NO: 846585 - DNA, 22 bp, Artificial Sequence
  chemically synthesized
gcttccaacttttctgctgcag

SEQ ID NO: 846586 - DNA, 22 bp, Artificial Sequence
  chemically synthesized
ccaacttttctgctgcagcttc

SEQ ID NO: 846587 - DNA, 22 bp, Artificial Sequence
  chemically synthesized
caacttttctgctgcagcttcc

SEQ ID NO: 846588 - DNA, 22 bp, Artificial Sequence
  chemically synthesized
ttctgctgcagcttcctcacct

SEQ ID NO: 846589 - DNA, 22 bp, Artificial Sequence
  chemically synthesized
tctgctgcagcttcctcacctc

SEQ ID NO: 846590 - DNA, 22 bp, Artificial Sequence
  chemically synthesized
tgaatgccgagagaggtgagga

SEQ ID NO: 846591 - DNA, 22 bp, Artificial Sequence
  chemically synthesized
ctgctgcagcttcctcacctct

SEQ ID NO: 846592 - DNA, 22 bp, Artificial Sequence
  chemically synthesized
tgctgcagcttcctcacctctc

SEQ ID NO: 846593 - DNA, 22 bp, Artificial Sequence
  chemically synthesized
tgtgaatgccgagagaggtgag

SEQ ID NO: 846594 - DNA, 22 bp, Artificial Sequence
  chemically synthesized
ctgcagcttcctcacctctctc

SEQ ID NO: 846595 - DNA, 22 bp, Artificial Sequence
  chemically synthesized
cagcttcctcacctctctcggc

SEQ ID NO: 846596 - DNA, 22 bp, Artificial Sequence
  chemically synthesized
caattctgtgaatgccgagaga

SEQ ID NO: 846597 - DNA, 22 bp, Artificial Sequence
  chemically synthesized
tgcaattctgtgaatgccgaga

SEQ ID NO: 846598 - DNA, 22 bp, Artificial Sequence
  chemically synthesized
tctgcaattctgtgaatgccga

SEQ ID NO: 846599 - DNA, 22 bp, Artificial Sequence
  chemically synthesized
cctcacctctctcggcattcac

SEQ ID NO: 846600 - DNA, 22 bp, Artificial Sequence
  chemically synthesized
ctcacctctctcggcattcaca

SEQ ID NO: 846601 - DNA, 22 bp, Artificial Sequence
  chemically synthesized
attctctgcaattctgtgaatg

SEQ ID NO: 846602 - DNA, 22 bp, Artificial Sequence
  chemically synthesized
acctctctcggcattcacagaa

SEQ ID NO: 846603 - DNA, 22 bp, Artificial Sequence
  chemically synthesized
tctcggcattcacagaattgca

SEQ ID NO: 846604 - DNA, 22 bp, Artificial Sequence
  chemically synthesized
tcggcattcacagaattgcaga

SEQ ID NO: 846605 - DNA, 22 bp, Artificial Sequence
  chemically synthesized
ggcattcacagaattgcagaga

SEQ ID NO: 846606 - DNA, 22 bp, Artificial Sequence
  chemically synthesized
aagcaaaggactaattctctgc

SEQ ID NO: 846607 - DNA, 22 bp, Artificial Sequence
  chemically synthesized
acagaattgcagagaattagtc

SEQ ID NO: 846608 - DNA, 22 bp, Artificial Sequence
  chemically synthesized
atctaaagcaaaggactaattc

SEQ ID NO: 846609 - DNA, 22 bp, Artificial Sequence
  chemically synthesized
cagagaattagtcctttgcttt

SEQ ID NO: 846610 - DNA, 22 bp, Artificial Sequence
  chemically synthesized
agcaaaaggctaatctaaagca

SEQ ID NO: 846611 - DNA, 22 bp, Artificial Sequence
  chemically synthesized
aagcaaaaggctaatctaaagc

SEQ ID NO: 846612 - DNA, 22 bp, Artificial Sequence
  chemically synthesized
tcttaagcaaaaggctaatcta

SEQ ID NO: 846613 - DNA, 22 bp, Artificial Sequence
  chemically synthesized
gtcctttgctttagattagcct

SEQ ID NO: 846614 - DNA, 22 bp, Artificial Sequence
  chemically synthesized
tgctttagattagccttttgct

SEQ ID NO: 846615 - DNA, 22 bp, Artificial Sequence
  chemically synthesized
gctttagattagccttttgctt

SEQ ID NO: 846616 - DNA, 22 bp, Artificial Sequence
  chemically synthesized
ctttagattagccttttgctta

SEQ ID NO: 846617 - DNA, 22 bp, Artificial Sequence
  chemically synthesized
tagattagccttttgcttaaga

SEQ ID NO: 846618 - DNA, 22 bp, Artificial Sequence
  chemically synthesized
agattagccttttgcttaagat

SEQ ID NO: 846619 - DNA, 22 bp, Artificial Sequence
  chemically synthesized
gattagccttttgcttaagata

SEQ ID NO: 846620 - DNA, 22 bp, Artificial Sequence
  chemically synthesized
gccttttgcttaagataatggt

SEQ ID NO: 846621 - DNA, 22 bp, Artificial Sequence
  chemically synthesized
ttgcttaagataatggtgtggc

SEQ ID NO: 846622 - DNA, 22 bp, Artificial Sequence
  chemically synthesized
tgcttaagataatggtgtggct

SEQ ID NO: 846623 - DNA, 22 bp, Artificial Sequence
  chemically synthesized
gcttaagataatggtgtggctg

SEQ ID NO: 846624 - DNA, 22 bp, Artificial Sequence
  chemically synthesized
cttaagataatggtgtggctgt

SEQ ID NO: 846625 - DNA, 22 bp, Artificial Sequence
  chemically synthesized
gatagaggatcaaaacagccac

SEQ ID NO: 846626 - DNA, 22 bp, Artificial Sequence
  chemically synthesized
aagataatggtgtggctgtttt

SEQ ID NO: 846627 - DNA, 22 bp, Artificial Sequence
  chemically synthesized
agataatggtgtggctgttttg

SEQ ID NO: 846628 - DNA, 22 bp, Artificial Sequence
  chemically synthesized
gtggtctggatagaggatcaaa

SEQ ID NO: 846629 - DNA, 22 bp, Artificial Sequence
  chemically synthesized
agtggtctggatagaggatcaa

SEQ ID NO: 846630 - DNA, 22 bp, Artificial Sequence
  chemically synthesized
ttttgatcctctatccagacca

SEQ ID NO: 846631 - DNA, 22 bp, Artificial Sequence
  chemically synthesized
tgatcctctatccagaccacta

SEQ ID NO: 846632 - DNA, 22 bp, Artificial Sequence
  chemically synthesized
gatcctctatccagaccactaa

SEQ ID NO: 846633 - DNA, 22 bp, Artificial Sequence
  chemically synthesized
atcctctatccagaccactaag

SEQ ID NO: 846634 - DNA, 22 bp, Artificial Sequence
  chemically synthesized
atatggagaatgtcttagtggt

SEQ ID NO: 846635 - DNA, 22 bp, Artificial Sequence
  chemically synthesized
aatatggagaatgtcttagtgg

SEQ ID NO: 846636 - DNA, 22 bp, Artificial Sequence
  chemically synthesized
taatatggagaatgtcttagtg

SEQ ID NO: 846637 - DNA, 22 bp, Artificial Sequence
  chemically synthesized
ttaatatggagaatgtcttagt

SEQ ID NO: 846638 - DNA, 22 bp, Artificial Sequence
  chemically synthesized
tatccagaccactaagacattc

SEQ ID NO: 846639 - DNA, 22 bp, Artificial Sequence
  chemically synthesized
tttttaatatggagaatgtctt

SEQ ID NO: 846640 - DNA, 22 bp, Artificial Sequence
  chemically synthesized
tccagaccactaagacattctc

SEQ ID NO: 846641 - DNA, 22 bp, Artificial Sequence
  chemically synthesized
atttttaatatggagaatgtct

SEQ ID NO: 846642 - DNA, 22 bp, Artificial Sequence
  chemically synthesized
agacattctccatattaaaaat

SEQ ID NO: 846643 - DNA, 22 bp, Artificial Sequence
  chemically synthesized
tccatattaaaaataaggccgt

SEQ ID NO: 846644 - DNA, 22 bp, Artificial Sequence
  chemically synthesized
catattaaaaataaggccgttc

SEQ ID NO: 846645 - DNA, 22 bp, Artificial Sequence
  chemically synthesized
aaaataaggccgttccactttc

SEQ ID NO: 846646 - DNA, 22 bp, Artificial Sequence
  chemically synthesized
aacacaggaataagaaagtgga

SEQ ID NO: 846647 - DNA, 22 bp, Artificial Sequence
  chemically synthesized
ttgaacacaggaataagaaagt

SEQ ID NO: 846648 - DNA, 22 bp, Artificial Sequence
  chemically synthesized
tgttgaacacaggaataagaaa

SEQ ID NO: 846649 - DNA, 22 bp, Artificial Sequence
  chemically synthesized
ctctgttgaacacaggaataag

SEQ ID NO: 846650 - DNA, 22 bp, Artificial Sequence
  chemically synthesized
cactttcttattcctgtgttca

SEQ ID NO: 846651 - DNA, 22 bp, Artificial Sequence
  chemically synthesized
aaagtgctactctgttgaacac

SEQ ID NO: 846652 - DNA, 22 bp, Artificial Sequence
  chemically synthesized
tcttattcctgtgttcaacaga

SEQ ID NO: 846653 - DNA, 22 bp, Artificial Sequence
  chemically synthesized
cttattcctgtgttcaacagag

SEQ ID NO: 846654 - DNA, 22 bp, Artificial Sequence
  chemically synthesized
ttattcctgtgttcaacagagt

SEQ ID NO: 846655 - DNA, 22 bp, Artificial Sequence
  chemically synthesized
attcctgtgttcaacagagtag

SEQ ID NO: 846656 - DNA, 22 bp, Artificial Sequence
  chemically synthesized
ttcctgtgttcaacagagtagc

SEQ ID NO: 846657 - DNA, 22 bp, Artificial Sequence
  chemically synthesized
ctgtgttcaacagagtagcact

SEQ ID NO: 846658 - DNA, 22 bp, Artificial Sequence
  chemically synthesized
aagaaaattaaaagtgctactc

SEQ ID NO: 846659 - DNA, 22 bp, Artificial Sequence
  chemically synthesized
gaagaaaattaaaagtgctact

SEQ ID NO: 846660 - DNA, 22 bp, Artificial Sequence
  chemically synthesized
tgttcaacagagtagcactttt

SEQ ID NO: 846661 - DNA, 22 bp, Artificial Sequence
  chemically synthesized
ttgaagaaaattaaaagtgcta

SEQ ID NO: 846662 - DNA, 22 bp, Artificial Sequence
  chemically synthesized
aacagagtagcacttttaattt

SEQ ID NO: 846663 - DNA, 22 bp, Artificial Sequence
  chemically synthesized
ttaattttcttcaagaacgttt

SEQ ID NO: 846664 - DNA, 22 bp, Artificial Sequence
  chemically synthesized
tgaatgcaaaggaaacgttctt

SEQ ID NO: 846665 - DNA, 22 bp, Artificial Sequence
  chemically synthesized
taattttcttcaagaacgtttc

SEQ ID NO: 846666 - DNA, 22 bp, Artificial Sequence
  chemically synthesized
aattttcttcaagaacgtttcc

SEQ ID NO: 846667 - DNA, 22 bp, Artificial Sequence
  chemically synthesized
attttcttcaagaacgtttcct

SEQ ID NO: 846668 - DNA, 22 bp, Artificial Sequence
  chemically synthesized
tcttcaagaacgtttcctttgc

SEQ ID NO: 846669 - DNA, 22 bp, Artificial Sequence
  chemically synthesized
cttcaagaacgtttcctttgca

SEQ ID NO: 846670 - DNA, 22 bp, Artificial Sequence
  chemically synthesized
ttcaagaacgtttcctttgcat

SEQ ID NO: 846671 - DNA, 22 bp, Artificial Sequence
  chemically synthesized
gccaagttgtgaatgcaaagga

SEQ ID NO: 846672 - DNA, 22 bp, Artificial Sequence
  chemically synthesized
caagaacgtttcctttgcattc

SEQ ID NO: 846673 - DNA, 22 bp, Artificial Sequence
  chemically synthesized
aagaacgtttcctttgcattca

SEQ ID NO: 846674 - DNA, 22 bp, Artificial Sequence
  chemically synthesized
tgccagttggccaagttgtgaa

SEQ ID NO: 846675 - DNA, 22 bp, Artificial Sequence
  chemically synthesized
gtgccagttggccaagttgtga

SEQ ID NO: 846676 - DNA, 22 bp, Artificial Sequence
  chemically synthesized
ttgtgccagttggccaagttgt

SEQ ID NO: 846677 - DNA, 22 bp, Artificial Sequence
  chemically synthesized
cctttgcattcacaacttggcc

SEQ ID NO: 846678 - DNA, 22 bp, Artificial Sequence
  chemically synthesized
ctttgcattcacaacttggcca

SEQ ID NO: 846679 - DNA, 22 bp, Artificial Sequence
  chemically synthesized
tgcattcacaacttggccaact

SEQ ID NO: 846680 - DNA, 22 bp, Artificial Sequence
  chemically synthesized
gcattcacaacttggccaactg

SEQ ID NO: 846681 - DNA, 22 bp, Artificial Sequence
  chemically synthesized
cattcacaacttggccaactgg

SEQ ID NO: 846682 - DNA, 22 bp, Artificial Sequence
  chemically synthesized
acaacttggccaactggcacaa

SEQ ID NO: 846683 - DNA, 22 bp, Artificial Sequence
  chemically synthesized
aaagccagacctcttgtgccag

SEQ ID NO: 846684 - DNA, 22 bp, Artificial Sequence
  chemically synthesized
ggccaactggcacaagaggtct

SEQ ID NO: 846685 - DNA, 22 bp, Artificial Sequence
  chemically synthesized
gccaactggcacaagaggtctg

SEQ ID NO: 846686 - DNA, 22 bp, Artificial Sequence
  chemically synthesized
gcacaagaggtctggctttcag

SEQ ID NO: 846687 - DNA, 22 bp, Artificial Sequence
  chemically synthesized
gctttcagcctgtcttggcttt

SEQ ID NO: 846688 - DNA, 22 bp, Artificial Sequence
  chemically synthesized
tcagcctgtcttggcttttgac

SEQ ID NO: 846689 - DNA, 22 bp, Artificial Sequence
  chemically synthesized
cagcctgtcttggcttttgaca

SEQ ID NO: 846690 - DNA, 22 bp, Artificial Sequence
  chemically synthesized
gtgaggaaggcatgtcaaaagc

SEQ ID NO: 846691 - DNA, 22 bp, Artificial Sequence
  chemically synthesized
agcctgtcttggcttttgacat

SEQ ID NO: 846692 - DNA, 22 bp, Artificial Sequence
  chemically synthesized
agattggtgaggaaggcatgtc

SEQ ID NO: 846693 - DNA, 22 bp, Artificial Sequence
  chemically synthesized
tcttggcttttgacatgccttc

SEQ ID NO: 846694 - DNA, 22 bp, Artificial Sequence
  chemically synthesized
ggcttttgacatgccttcctca

SEQ ID NO: 846695 - DNA, 22 bp, Artificial Sequence
  chemically synthesized
gcttttgacatgccttcctcac

SEQ ID NO: 846696 - DNA, 22 bp, Artificial Sequence
  chemically synthesized
ttgacatgccttcctcaccaat

SEQ ID NO: 846697 - DNA, 22 bp, Artificial Sequence
  chemically synthesized
tgacatgccttcctcaccaatc

SEQ ID NO: 846698 - DNA, 22 bp, Artificial Sequence
  chemically synthesized
gacatgccttcctcaccaatct

SEQ ID NO: 846699 - DNA, 22 bp, Artificial Sequence
  chemically synthesized
acatgccttcctcaccaatctt

SEQ ID NO: 846700 - DNA, 22 bp, Artificial Sequence
  chemically synthesized
cctcaccaatcttaatcatttc

SEQ ID NO: 846701 - DNA, 22 bp, Artificial Sequence
  chemically synthesized
aatcaaaagtcagaaatgatta

SEQ ID NO: 846702 - DNA, 22 bp, Artificial Sequence
  chemically synthesized
ctcaccaatcttaatcatttct

SEQ ID NO: 846703 - DNA, 22 bp, Artificial Sequence
  chemically synthesized
aaatcaaaagtcagaaatgatt

SEQ ID NO: 846704 - DNA, 22 bp, Artificial Sequence
  chemically synthesized
taaatcaaaagtcagaaatgat

SEQ ID NO: 846705 - DNA, 22 bp, Artificial Sequence
  chemically synthesized
accaatcttaatcatttctgac

SEQ ID NO: 846706 - DNA, 22 bp, Artificial Sequence
  chemically synthesized
tcactttaaatcaaaagtcaga

SEQ ID NO: 846707 - DNA, 22 bp, Artificial Sequence
  chemically synthesized
gtcactttaaatcaaaagtcag

SEQ ID NO: 846708 - DNA, 22 bp, Artificial Sequence
  chemically synthesized
aatcatttctgacttttgattt

SEQ ID NO: 846709 - DNA, 22 bp, Artificial Sequence
  chemically synthesized
atcatttctgacttttgattta

SEQ ID NO: 846710 - DNA, 22 bp, Artificial Sequence
  chemically synthesized
ctgacttttgatttaaagtgac

SEQ ID NO: 846711 - DNA, 22 bp, Artificial Sequence
  chemically synthesized
tgacttttgatttaaagtgaca

SEQ ID NO: 846712 - DNA, 22 bp, Artificial Sequence
  chemically synthesized
acttttgatttaaagtgacaaa

SEQ ID NO: 846713 - DNA, 22 bp, Artificial Sequence
  chemically synthesized
ttgatttaaagtgacaaacatg

SEQ ID NO: 846714 - DNA, 22 bp, Artificial Sequence
  chemically synthesized
tgatttaaagtgacaaacatgt

SEQ ID NO: 846715 - DNA, 22 bp, Artificial Sequence
  chemically synthesized
gatttaaagtgacaaacatgtg

SEQ ID NO: 846716 - DNA, 22 bp, Artificial Sequence
  chemically synthesized
atttaaagtgacaaacatgtga

SEQ ID NO: 846717 - DNA, 22 bp, Artificial Sequence
  chemically synthesized
aaagtgacaaacatgtgactct

SEQ ID NO: 846718 - DNA, 22 bp, Artificial Sequence
  chemically synthesized
atgggaaaaaaaagagtcacat

SEQ ID NO: 846719 - DNA, 22 bp, Artificial Sequence
  chemically synthesized
aagtgacaaacatgtgactctt

SEQ ID NO: 846720 - DNA, 22 bp, Artificial Sequence
  chemically synthesized
agtgttcatgggaaaaaaaaga

SEQ ID NO: 846721 - DNA, 22 bp, Artificial Sequence
  chemically synthesized
taagtgttcatgggaaaaaaaa

SEQ ID NO: 846722 - DNA, 22 bp, Artificial Sequence
  chemically synthesized
caatgtcctctaagtgttcatg

SEQ ID NO: 846723 - DNA, 22 bp, Artificial Sequence
  chemically synthesized
ttttttttcccatgaacactta

SEQ ID NO: 846724 - DNA, 22 bp, Artificial Sequence
  chemically synthesized
ttttttcccatgaacacttaga

SEQ ID NO: 846725 - DNA, 22 bp, Artificial Sequence
  chemically synthesized
tttttcccatgaacacttagag

SEQ ID NO: 846726 - DNA, 22 bp, Artificial Sequence
  chemically synthesized
ttttcccatgaacacttagagg

SEQ ID NO: 846727 - DNA, 22 bp, Artificial Sequence
  chemically synthesized
tttcccatgaacacttagagga

SEQ ID NO: 846728 - DNA, 22 bp, Artificial Sequence
  chemically synthesized
ttcccatgaacacttagaggac

SEQ ID NO: 846729 - DNA, 22 bp, Artificial Sequence
  chemically synthesized
tcccatgaacacttagaggaca

SEQ ID NO: 846730 - DNA, 22 bp, Artificial Sequence
  chemically synthesized
cccatgaacacttagaggacat

SEQ ID NO: 846731 - DNA, 22 bp, Artificial Sequence
  chemically synthesized
ccatgaacacttagaggacatt

SEQ ID NO: 846732 - DNA, 22 bp, Artificial Sequence
  chemically synthesized
tgccagtcagtaaccctacaat

SEQ ID NO: 846733 - DNA, 22 bp, Artificial Sequence
  chemically synthesized
agaggacattgtagggttactg

SEQ ID NO: 846734 - DNA, 22 bp, Artificial Sequence
  chemically synthesized
gaggacattgtagggttactga

SEQ ID NO: 846735 - DNA, 22 bp, Artificial Sequence
  chemically synthesized
aaattatgccagtcagtaaccc

SEQ ID NO: 846736 - DNA, 22 bp, Artificial Sequence
  chemically synthesized
tagggttactgactggcataat

SEQ ID NO: 846737 - DNA, 22 bp, Artificial Sequence
  chemically synthesized
agacacaacaatattgaaatta

SEQ ID NO: 846738 - DNA, 22 bp, Artificial Sequence
  chemically synthesized
ctgactggcataatttcaatat

SEQ ID NO: 846739 - DNA, 22 bp, Artificial Sequence
  chemically synthesized
cctgagacacaacaatattgaa

SEQ ID NO: 846740 - DNA, 22 bp, Artificial Sequence
  chemically synthesized
actggcataatttcaatattgt

SEQ ID NO: 846741 - DNA, 22 bp, Artificial Sequence
  chemically synthesized
ttccctgagacacaacaatatt

SEQ ID NO: 846742 - DNA, 22 bp, Artificial Sequence
  chemically synthesized
gcataatttcaatattgttgtg

SEQ ID NO: 846743 - DNA, 22 bp, Artificial Sequence
  chemically synthesized
cctattccctgagacacaacaa

SEQ ID NO: 846744 - DNA, 22 bp, Artificial Sequence
  chemically synthesized
ggcctccctattccctgagaca

SEQ ID NO: 846745 - DNA, 22 bp, Artificial Sequence
  chemically synthesized
caatattgttgtgtctcaggga

SEQ ID NO: 846746 - DNA, 22 bp, Artificial Sequence
  chemically synthesized
gggcctccctattccctgagac

SEQ ID NO: 846747 - DNA, 22 bp, Artificial Sequence
  chemically synthesized
aatattgttgtgtctcagggaa

SEQ ID NO: 846748 - DNA, 22 bp, Artificial Sequence
  chemically synthesized
cttgggcctccctattccctga

SEQ ID NO: 846749 - DNA, 22 bp, Artificial Sequence
  chemically synthesized
tccttgggcctccctattccct

SEQ ID NO: 846750 - DNA, 22 bp, Artificial Sequence
  chemically synthesized
ttgtgtctcagggaatagggag

SEQ ID NO: 846751 - DNA, 22 bp, Artificial Sequence
  chemically synthesized
ctctccttgggcctccctattc

SEQ ID NO: 846752 - DNA, 22 bp, Artificial Sequence
  chemically synthesized
cctctccttgggcctccctatt

SEQ ID NO: 846753 - DNA, 22 bp, Artificial Sequence
  chemically synthesized
tgtctcagggaatagggaggcc

SEQ ID NO: 846754 - DNA, 22 bp, Artificial Sequence
  chemically synthesized
ttcctctccttgggcctcccta

SEQ ID NO: 846755 - DNA, 22 bp, Artificial Sequence
  chemically synthesized
tcttcctctccttgggcctccc

SEQ ID NO: 846756 - DNA, 22 bp, Artificial Sequence
  chemically synthesized
agggaatagggaggcccaagga

SEQ ID NO: 846757 - DNA, 22 bp, Artificial Sequence
  chemically synthesized
atctctcttcctctccttgggc

SEQ ID NO: 846758 - DNA, 22 bp, Artificial Sequence
  chemically synthesized
cctcatctctcttcctctcctt

SEQ ID NO: 846759 - DNA, 22 bp, Artificial Sequence
  chemically synthesized
atcagccattccctcatctctc

SEQ ID NO: 846760 - DNA, 22 bp, Artificial Sequence
  chemically synthesized
cactgatcagccattccctcat

SEQ ID NO: 846761 - DNA, 22 bp, Artificial Sequence
  chemically synthesized
ctccactgatcagccattccct

SEQ ID NO: 846762 - DNA, 22 bp, Artificial Sequence
  chemically synthesized
gctactccactgatcagccatt

SEQ ID NO: 846763 - DNA, 22 bp, Artificial Sequence
  chemically synthesized
tggctactccactgatcagcca

SEQ ID NO: 846764 - DNA, 22 bp, Artificial Sequence
  chemically synthesized
tgtgttctggctactccactga

SEQ ID NO: 846765 - DNA, 22 bp, Artificial Sequence
  chemically synthesized
gtgtgttctggctactccactg

SEQ ID NO: 846766 - DNA, 22 bp, Artificial Sequence
  chemically synthesized
tgtgtgttctggctactccact

SEQ ID NO: 846767 - DNA, 22 bp, Artificial Sequence
  chemically synthesized
atcagtggagtagccagaacac

SEQ ID NO: 846768 - DNA, 22 bp, Artificial Sequence
  chemically synthesized
atcaatcaatgttttgtgtgtt

SEQ ID NO: 846769 - DNA, 22 bp, Artificial Sequence
  chemically synthesized
aatcaatcaatgttttgtgtgt

SEQ ID NO: 846770 - DNA, 22 bp, Artificial Sequence
  chemically synthesized
ataagatggcaaacttaatcaa

SEQ ID NO: 846771 - DNA, 22 bp, Artificial Sequence
  chemically synthesized
cataagatggcaaacttaatca

SEQ ID NO: 846772 - DNA, 22 bp, Artificial Sequence
  chemically synthesized
tcataagatggcaaacttaatc

SEQ ID NO: 846773 - DNA, 22 bp, Artificial Sequence
  chemically synthesized
ttttcataagatggcaaactta

SEQ ID NO: 846774 - DNA, 22 bp, Artificial Sequence
  chemically synthesized
attttcataagatggcaaactt

SEQ ID NO: 846775 - DNA, 22 bp, Artificial Sequence
  chemically synthesized
cttattttcataagatggcaaa

SEQ ID NO: 846776 - DNA, 22 bp, Artificial Sequence
  chemically synthesized
attgattaagtttgccatctta

SEQ ID NO: 846777 - DNA, 22 bp, Artificial Sequence
  chemically synthesized
attaagtttgccatcttatgaa

SEQ ID NO: 846778 - DNA, 22 bp, Artificial Sequence
  chemically synthesized
ccattacttattttcataagat

SEQ ID NO: 846779 - DNA, 22 bp, Artificial Sequence
  chemically synthesized
cccattacttattttcataaga

SEQ ID NO: 846780 - DNA, 22 bp, Artificial Sequence
  chemically synthesized
tcccattacttattttcataag

SEQ ID NO: 846781 - DNA, 22 bp, Artificial Sequence
  chemically synthesized
ttcccattacttattttcataa

SEQ ID NO: 846782 - DNA, 22 bp, Artificial Sequence
  chemically synthesized
agtttgccatcttatgaaaata

SEQ ID NO: 846783 - DNA, 22 bp, Artificial Sequence
  chemically synthesized
gccatcttatgaaaataagtaa

SEQ ID NO: 846784 - DNA, 22 bp, Artificial Sequence
  chemically synthesized
ccatcttatgaaaataagtaat

SEQ ID NO: 846785 - DNA, 22 bp, Artificial Sequence
  chemically synthesized
atgaaaataagtaatgggaaaa

SEQ ID NO: 846786 - DNA, 22 bp, Artificial Sequence
  chemically synthesized
aatacagagtccttttcccatt

SEQ ID NO: 846787 - DNA, 22 bp, Artificial Sequence
  chemically synthesized
tgaaaataagtaatgggaaaag

SEQ ID NO: 846788 - DNA, 22 bp, Artificial Sequence
  chemically synthesized
aaatacagagtccttttcccat

SEQ ID NO: 846789 - DNA, 22 bp, Artificial Sequence
  chemically synthesized
accagccatcccagcatcatgt

SEQ ID NO: 846790 - DNA, 22 bp, Artificial Sequence
  chemically synthesized
tgtatttaagacatgatgctgg

SEQ ID NO: 846791 - DNA, 22 bp, Artificial Sequence
  chemically synthesized
tatttaagacatgatgctggga

SEQ ID NO: 846792 - DNA, 22 bp, Artificial Sequence
  chemically synthesized
aagacatgatgctgggatggct

SEQ ID NO: 846793 - DNA, 22 bp, Artificial Sequence
  chemically synthesized
agacatgatgctgggatggctg

SEQ ID NO: 846794 - DNA, 22 bp, Artificial Sequence
  chemically synthesized
catatggctaaccagccatccc

SEQ ID NO: 846795 - DNA, 22 bp, Artificial Sequence
  chemically synthesized
tgcatatggctaaccagccatc

SEQ ID NO: 846796 - DNA, 22 bp, Artificial Sequence
  chemically synthesized
ctgcatatggctaaccagccat

SEQ ID NO: 846797 - DNA, 22 bp, Artificial Sequence
  chemically synthesized
ttctgcatatggctaaccagcc

SEQ ID NO: 846798 - DNA, 22 bp, Artificial Sequence
  chemically synthesized
cattcttctgcatatggctaac

SEQ ID NO: 846799 - DNA, 22 bp, Artificial Sequence
  chemically synthesized
ggatggctggttagccatatgc

SEQ ID NO: 846800 - DNA, 22 bp, Artificial Sequence
  chemically synthesized
gttagccatatgcagaagaatg

SEQ ID NO: 846801 - DNA, 22 bp, Artificial Sequence
  chemically synthesized
gccatatgcagaagaatgcaac

SEQ ID NO: 846802 - DNA, 22 bp, Artificial Sequence
  chemically synthesized
tatatggtgtaaggagggggtc

SEQ ID NO: 846803 - DNA, 22 bp, Artificial Sequence
  chemically synthesized
gtatatggtgtaaggagggggt

SEQ ID NO: 846804 - DNA, 22 bp, Artificial Sequence
  chemically synthesized
tgtatatggtgtaaggaggggg

SEQ ID NO: 846805 - DNA, 22 bp, Artificial Sequence
  chemically synthesized
ttgtatatggtgtaaggagggg

SEQ ID NO: 846806 - DNA, 22 bp, Artificial Sequence
  chemically synthesized
atttttgtatatggtgtaagga

SEQ ID NO: 846807 - DNA, 22 bp, Artificial Sequence
  chemically synthesized
gaccccctccttacaccatata

SEQ ID NO: 846808 - DNA, 22 bp, Artificial Sequence
  chemically synthesized
agttaatttttgtatatggtgt

SEQ ID NO: 846809 - DNA, 22 bp, Artificial Sequence
  chemically synthesized
gagttaatttttgtatatggtg

SEQ ID NO: 846810 - DNA, 22 bp, Artificial Sequence
  chemically synthesized
catcttgagttaatttttgtat

SEQ ID NO: 846811 - DNA, 22 bp, Artificial Sequence
  chemically synthesized
cttacaccatatacaaaaatta

SEQ ID NO: 846812 - DNA, 22 bp, Artificial Sequence
  chemically synthesized
ttccatcttgagttaatttttg

SEQ ID NO: 846813 - DNA, 22 bp, Artificial Sequence
  chemically synthesized
attccatcttgagttaattttt

SEQ ID NO: 846814 - DNA, 22 bp, Artificial Sequence
  chemically synthesized
acaccatatacaaaaattaact

SEQ ID NO: 846815 - DNA, 22 bp, Artificial Sequence
  chemically synthesized
tattccatcttgagttaatttt

SEQ ID NO: 846816 - DNA, 22 bp, Artificial Sequence
  chemically synthesized
caccatatacaaaaattaactc

SEQ ID NO: 846817 - DNA, 22 bp, Artificial Sequence
  chemically synthesized
aacctttattccatcttgagtt

SEQ ID NO: 846818 - DNA, 22 bp, Artificial Sequence
  chemically synthesized
aaacctttattccatcttgagt

SEQ ID NO: 846819 - DNA, 22 bp, Artificial Sequence
  chemically synthesized
atgtttaaacctttattccatc

SEQ ID NO: 846820 - DNA, 22 bp, Artificial Sequence
  chemically synthesized
actcaagatggaataaaggttt

SEQ ID NO: 846821 - DNA, 22 bp, Artificial Sequence
  chemically synthesized
agatctaatgtttaaaccttta

SEQ ID NO: 846822 - DNA, 22 bp, Artificial Sequence
  chemically synthesized
gagatctaatgtttaaaccttt

SEQ ID NO: 846823 - DNA, 22 bp, Artificial Sequence
  chemically synthesized
aagatggaataaaggtttaaac

SEQ ID NO: 846824 - DNA, 22 bp, Artificial Sequence
  chemically synthesized
taatttgagatctaatgtttaa

SEQ ID NO: 846825 - DNA, 22 bp, Artificial Sequence
  chemically synthesized
ataatttgagatctaatgttta

SEQ ID NO: 846826 - DNA, 22 bp, Artificial Sequence
  chemically synthesized
ttataatttgagatctaatgtt

SEQ ID NO: 846827 - DNA, 22 bp, Artificial Sequence
  chemically synthesized
taggattcttataatttgagat

SEQ ID NO: 846828 - DNA, 22 bp, Artificial Sequence
  chemically synthesized
ataggattcttataatttgaga

SEQ ID NO: 846829 - DNA, 22 bp, Artificial Sequence
  chemically synthesized
aaacattagatctcaaattata

SEQ ID NO: 846830 - DNA, 22 bp, Artificial Sequence
  chemically synthesized
ttataggattcttataatttga

SEQ ID NO: 846831 - DNA, 22 bp, Artificial Sequence
  chemically synthesized
aacattagatctcaaattataa

SEQ ID NO: 846832 - DNA, 22 bp, Artificial Sequence
  chemically synthesized
cttataggattcttataatttg

SEQ ID NO: 846833 - DNA, 22 bp, Artificial Sequence
  chemically synthesized
tcttataggattcttataattt

SEQ ID NO: 846834 - DNA, 22 bp, Artificial Sequence
  chemically synthesized
ggctttcttataggattcttat

SEQ ID NO: 846835 - DNA, 22 bp, Artificial Sequence
  chemically synthesized
gatctcaaattataagaatcct

SEQ ID NO: 846836 - DNA, 22 bp, Artificial Sequence
  chemically synthesized
ctaggctttcttataggattct

SEQ ID NO: 846837 - DNA, 22 bp, Artificial Sequence
  chemically synthesized
cctaggctttcttataggattc

SEQ ID NO: 846838 - DNA, 22 bp, Artificial Sequence
  chemically synthesized
aaattataagaatcctataaga

SEQ ID NO: 846839 - DNA, 22 bp, Artificial Sequence
  chemically synthesized
taagaatcctataagaaagcct

SEQ ID NO: 846840 - DNA, 22 bp, Artificial Sequence
  chemically synthesized
atgtccagagtggtgtttccta

SEQ ID NO: 846841 - DNA, 22 bp, Artificial Sequence
  chemically synthesized
taagaaagcctaggaaacacca

SEQ ID NO: 846842 - DNA, 22 bp, Artificial Sequence
  chemically synthesized
ccaagtctgatgtccagagtgg

SEQ ID NO: 846843 - DNA, 22 bp, Artificial Sequence
  chemically synthesized
cccaagtctgatgtccagagtg

SEQ ID NO: 846844 - DNA, 22 bp, Artificial Sequence
  chemically synthesized
tcccaagtctgatgtccagagt

SEQ ID NO: 846845 - DNA, 22 bp, Artificial Sequence
  chemically synthesized
tttcccaagtctgatgtccaga

SEQ ID NO: 846846 - DNA, 22 bp, Artificial Sequence
  chemically synthesized
ggaaacaccactctggacatca

SEQ ID NO: 846847 - DNA, 22 bp, Artificial Sequence
  chemically synthesized
taaattctttcccaagtctgat

SEQ ID NO: 846848 - DNA, 22 bp, Artificial Sequence
  chemically synthesized
gttataaattctttcccaagtc

SEQ ID NO: 846849 - DNA, 22 bp, Artificial Sequence
  chemically synthesized
agttataaattctttcccaagt

SEQ ID NO: 846850 - DNA, 22 bp, Artificial Sequence
  chemically synthesized
tggacatcagacttgggaaaga

SEQ ID NO: 846851 - DNA, 22 bp, Artificial Sequence
  chemically synthesized
gacatcagacttgggaaagaat

SEQ ID NO: 846852 - DNA, 22 bp, Artificial Sequence
  chemically synthesized
aggacttagttataaattcttt

SEQ ID NO: 846853 - DNA, 22 bp, Artificial Sequence
  chemically synthesized
gaggacttagttataaattctt

SEQ ID NO: 846854 - DNA, 22 bp, Artificial Sequence
  chemically synthesized
tgaggacttagttataaattct

SEQ ID NO: 846855 - DNA, 22 bp, Artificial Sequence
  chemically synthesized
ttgaggacttagttataaattc

SEQ ID NO: 846856 - DNA, 22 bp, Artificial Sequence
  chemically synthesized
cttttgaggacttagttataaa

SEQ ID NO: 846857 - DNA, 22 bp, Artificial Sequence
  chemically synthesized
gggaaagaatttataactaagt

SEQ ID NO: 846858 - DNA, 22 bp, Artificial Sequence
  chemically synthesized
ggaaagaatttataactaagtc

SEQ ID NO: 846859 - DNA, 22 bp, Artificial Sequence
  chemically synthesized
taattgcttttgaggacttagt

SEQ ID NO: 846860 - DNA, 22 bp, Artificial Sequence
  chemically synthesized
ttataattgcttttgaggactt

SEQ ID NO: 846861 - DNA, 22 bp, Artificial Sequence
  chemically synthesized
gttataattgcttttgaggact

SEQ ID NO: 846862 - DNA, 22 bp, Artificial Sequence
  chemically synthesized
tgttataattgcttttgaggac

SEQ ID NO: 846863 - DNA, 22 bp, Artificial Sequence
  chemically synthesized
ataactaagtcctcaaaagcaa

SEQ ID NO: 846864 - DNA, 22 bp, Artificial Sequence
  chemically synthesized
gttttgttataattgcttttga

SEQ ID NO: 846865 - DNA, 22 bp, Artificial Sequence
  chemically synthesized
taactaagtcctcaaaagcaat

SEQ ID NO: 846866 - DNA, 22 bp, Artificial Sequence
  chemically synthesized
ggttttgttataattgcttttg

SEQ ID NO: 846867 - DNA, 22 bp, Artificial Sequence
  chemically synthesized
tggttttgttataattgctttt

SEQ ID NO: 846868 - DNA, 22 bp, Artificial Sequence
  chemically synthesized
ttggttttgttataattgcttt

SEQ ID NO: 846869 - DNA, 22 bp, Artificial Sequence
  chemically synthesized
agtcctcaaaagcaattataac

SEQ ID NO: 846870 - DNA, 22 bp, Artificial Sequence
  chemically synthesized
tcaatttttggttttgttataa

SEQ ID NO: 846871 - DNA, 22 bp, Artificial Sequence
  chemically synthesized
gtcaatttttggttttgttata

SEQ ID NO: 846872 - DNA, 22 bp, Artificial Sequence
  chemically synthesized
aaaagcaattataacaaaacca

SEQ ID NO: 846873 - DNA, 22 bp, Artificial Sequence
  chemically synthesized
cacttgtcaatttttggttttg

SEQ ID NO: 846874 - DNA, 22 bp, Artificial Sequence
  chemically synthesized
agttccacttgtcaatttttgg

SEQ ID NO: 846875 - DNA, 22 bp, Artificial Sequence
  chemically synthesized
taacaaaaccaaaaattgacaa

SEQ ID NO: 846876 - DNA, 22 bp, Artificial Sequence
  chemically synthesized
attaagttccacttgtcaattt

SEQ ID NO: 846877 - DNA, 22 bp, Artificial Sequence
  chemically synthesized
aattaagttccacttgtcaatt

SEQ ID NO: 846878 - DNA, 22 bp, Artificial Sequence
  chemically synthesized
gtttaattaagttccacttgtc

SEQ ID NO: 846879 - DNA, 22 bp, Artificial Sequence
  chemically synthesized
agtttaattaagttccacttgt

SEQ ID NO: 846880 - DNA, 22 bp, Artificial Sequence
  chemically synthesized
tagtttaattaagttccacttg

SEQ ID NO: 846881 - DNA, 22 bp, Artificial Sequence
  chemically synthesized
tttagtttaattaagttccact

SEQ ID NO: 846882 - DNA, 22 bp, Artificial Sequence
  chemically synthesized
acaagtggaacttaattaaact

SEQ ID NO: 846883 - DNA, 22 bp, Artificial Sequence
  chemically synthesized
tgaagagctctttagtttaatt

SEQ ID NO: 846884 - DNA, 22 bp, Artificial Sequence
  chemically synthesized
actgtgaagagctctttagttt

SEQ ID NO: 846885 - DNA, 22 bp, Artificial Sequence
  chemically synthesized
cactgtgaagagctctttagtt

SEQ ID NO: 846886 - DNA, 22 bp, Artificial Sequence
  chemically synthesized
tcactgtgaagagctctttagt

SEQ ID NO: 846887 - DNA, 22 bp, Artificial Sequence
  chemically synthesized
tttcactgtgaagagctcttta

SEQ ID NO: 846888 - DNA, 22 bp, Artificial Sequence
  chemically synthesized
aattaaactaaagagctcttca

SEQ ID NO: 846889 - DNA, 22 bp, Artificial Sequence
  chemically synthesized
attaaactaaagagctcttcac

SEQ ID NO: 846890 - DNA, 22 bp, Artificial Sequence
  chemically synthesized
ataaattctttcactgtgaaga

SEQ ID NO: 846891 - DNA, 22 bp, Artificial Sequence
  chemically synthesized
aactaaagagctcttcacagtg

SEQ ID NO: 846892 - DNA, 22 bp, Artificial Sequence
  chemically synthesized
ttgataaattctttcactgtga

SEQ ID NO: 846893 - DNA, 22 bp, Artificial Sequence
  chemically synthesized
tgttgataaattctttcactgt

SEQ ID NO: 846894 - DNA, 22 bp, Artificial Sequence
  chemically synthesized
aagagctcttcacagtgaaaga

SEQ ID NO: 846895 - DNA, 22 bp, Artificial Sequence
  chemically synthesized
ctctgttgataaattctttcac

SEQ ID NO: 846896 - DNA, 22 bp, Artificial Sequence
  chemically synthesized
actctgttgataaattctttca

SEQ ID NO: 846897 - DNA, 22 bp, Artificial Sequence
  chemically synthesized
tttactctgttgataaattctt

SEQ ID NO: 846898 - DNA, 22 bp, Artificial Sequence
  chemically synthesized
ttcacagtgaaagaatttatca

SEQ ID NO: 846899 - DNA, 22 bp, Artificial Sequence
  chemically synthesized
cacagtgaaagaatttatcaac

SEQ ID NO: 846900 - DNA, 22 bp, Artificial Sequence
  chemically synthesized
tctgtttactctgttgataaat

SEQ ID NO: 846901 - DNA, 22 bp, Artificial Sequence
  chemically synthesized
acagtgaaagaatttatcaaca

SEQ ID NO: 846902 - DNA, 22 bp, Artificial Sequence
  chemically synthesized
tagactgtctgtttactctgtt

SEQ ID NO: 846903 - DNA, 22 bp, Artificial Sequence
  chemically synthesized
tgtagactgtctgtttactctg

SEQ ID NO: 846904 - DNA, 22 bp, Artificial Sequence
  chemically synthesized
ttctgtagactgtctgtttact

SEQ ID NO: 846905 - DNA, 22 bp, Artificial Sequence
  chemically synthesized
attctgtagactgtctgtttac

SEQ ID NO: 846906 - DNA, 22 bp, Artificial Sequence
  chemically synthesized
ttattctgtagactgtctgttt

SEQ ID NO: 846907 - DNA, 22 bp, Artificial Sequence
  chemically synthesized
atcaacagagtaaacagacagt

SEQ ID NO: 846908 - DNA, 22 bp, Artificial Sequence
  chemically synthesized
tcaacagagtaaacagacagtc

SEQ ID NO: 846909 - DNA, 22 bp, Artificial Sequence
  chemically synthesized
tcttattctgtagactgtctgt

SEQ ID NO: 846910 - DNA, 22 bp, Artificial Sequence
  chemically synthesized
caaatatattctcttattctgt

SEQ ID NO: 846911 - DNA, 22 bp, Artificial Sequence
  chemically synthesized
gcaaatatattctcttattctg

SEQ ID NO: 846912 - DNA, 22 bp, Artificial Sequence
  chemically synthesized
cagaataagagaatatatttgc

SEQ ID NO: 846913 - DNA, 22 bp, Artificial Sequence
  chemically synthesized
tcagatgcatagtttgcaaata

SEQ ID NO: 846914 - DNA, 22 bp, Artificial Sequence
  chemically synthesized
gtcagatgcatagtttgcaaat

SEQ ID NO: 846915 - DNA, 22 bp, Artificial Sequence
  chemically synthesized
tgtcagatgcatagtttgcaaa

SEQ ID NO: 846916 - DNA, 22 bp, Artificial Sequence
  chemically synthesized
gacctttgtcagatgcatagtt

SEQ ID NO: 846917 - DNA, 22 bp, Artificial Sequence
  chemically synthesized
aatattagacctttgtcagatg

SEQ ID NO: 846918 - DNA, 22 bp, Artificial Sequence
  chemically synthesized
gcaaactatgcatctgacaaag

SEQ ID NO: 846919 - DNA, 22 bp, Artificial Sequence
  chemically synthesized
tgaatattagacctttgtcaga

SEQ ID NO: 846920 - DNA, 22 bp, Artificial Sequence
  chemically synthesized
caaactatgcatctgacaaagg

SEQ ID NO: 846921 - DNA, 22 bp, Artificial Sequence
  chemically synthesized
tagattctgaatattagacctt

SEQ ID NO: 846922 - DNA, 22 bp, Artificial Sequence
  chemically synthesized
tgcatctgacaaaggtctaata

SEQ ID NO: 846923 - DNA, 22 bp, Artificial Sequence
  chemically synthesized
cctatagattctgaatattaga

SEQ ID NO: 846924 - DNA, 22 bp, Artificial Sequence
  chemically synthesized
acaaaggtctaatattcagaat

SEQ ID NO: 846925 - DNA, 22 bp, Artificial Sequence
  chemically synthesized
agttccctatagattctgaata

SEQ ID NO: 846926 - DNA, 22 bp, Artificial Sequence
  chemically synthesized
aagttccctatagattctgaat

SEQ ID NO: 846927 - DNA, 22 bp, Artificial Sequence
  chemically synthesized
tttaagttccctatagattctg

SEQ ID NO: 846928 - DNA, 22 bp, Artificial Sequence
  chemically synthesized
aattgtttaagttccctataga

SEQ ID NO: 846929 - DNA, 22 bp, Artificial Sequence
  chemically synthesized
atattcagaatctatagggaac

SEQ ID NO: 846930 - DNA, 22 bp, Artificial Sequence
  chemically synthesized
ttgaattgtttaagttccctat

SEQ ID NO: 846931 - DNA, 22 bp, Artificial Sequence
  chemically synthesized
gttgaattgtttaagttcccta

SEQ ID NO: 846932 - DNA, 22 bp, Artificial Sequence
  chemically synthesized
agaatctatagggaacttaaac

SEQ ID NO: 846933 - DNA, 22 bp, Artificial Sequence
  chemically synthesized
acttgttgaattgtttaagttc

SEQ ID NO: 846934 - DNA, 22 bp, Artificial Sequence
  chemically synthesized
gacttgttgaattgtttaagtt

SEQ ID NO: 846935 - DNA, 22 bp, Artificial Sequence
  chemically synthesized
tgacttgttgaattgtttaagt

SEQ ID NO: 846936 - DNA, 22 bp, Artificial Sequence
  chemically synthesized
ttgacttgttgaattgtttaag

SEQ ID NO: 846937 - DNA, 22 bp, Artificial Sequence
  chemically synthesized
tttttgacttgttgaattgttt

SEQ ID NO: 846938 - DNA, 22 bp, Artificial Sequence
  chemically synthesized
gtttttgacttgttgaattgtt

SEQ ID NO: 846939 - DNA, 22 bp, Artificial Sequence
  chemically synthesized
tagggaacttaaacaattcaac

SEQ ID NO: 846940 - DNA, 22 bp, Artificial Sequence
  chemically synthesized
tttgtttttgacttgttgaatt

SEQ ID NO: 846941 - DNA, 22 bp, Artificial Sequence
  chemically synthesized
aaacaattcaacaagtcaaaaa

SEQ ID NO: 846942 - DNA, 22 bp, Artificial Sequence
  chemically synthesized
aacaattcaacaagtcaaaaac

SEQ ID NO: 846943 - DNA, 22 bp, Artificial Sequence
  chemically synthesized
atggggttatttgtttttgact

SEQ ID NO: 846944 - DNA, 22 bp, Artificial Sequence
  chemically synthesized
gatggggttatttgtttttgac

SEQ ID NO: 846945 - DNA, 22 bp, Artificial Sequence
  chemically synthesized
tgatggggttatttgtttttga

SEQ ID NO: 846946 - DNA, 22 bp, Artificial Sequence
  chemically synthesized
ttgatggggttatttgtttttg

SEQ ID NO: 846947 - DNA, 22 bp, Artificial Sequence
  chemically synthesized
tttgatggggttatttgttttt

SEQ ID NO: 846948 - DNA, 22 bp, Artificial Sequence
  chemically synthesized
ttttgatggggttatttgtttt

SEQ ID NO: 846949 - DNA, 22 bp, Artificial Sequence
  chemically synthesized
tttttgatggggttatttgttt

SEQ ID NO: 846950 - DNA, 22 bp, Artificial Sequence
  chemically synthesized
aacaagtcaaaaacaaataacc

SEQ ID NO: 846951 - DNA, 22 bp, Artificial Sequence
  chemically synthesized
cccattttttttgatggggtta

SEQ ID NO: 846952 - DNA, 22 bp, Artificial Sequence
  chemically synthesized
gcccattttttttgatggggtt

SEQ ID NO: 846953 - DNA, 22 bp, Artificial Sequence
  chemically synthesized
tgcccattttttttgatggggt

SEQ ID NO: 846954 - DNA, 22 bp, Artificial Sequence
  chemically synthesized
ttgcccattttttttgatgggg

SEQ ID NO: 846955 - DNA, 22 bp, Artificial Sequence
  chemically synthesized
tgtcttttgcccattttttttg

SEQ ID NO: 846956 - DNA, 22 bp, Artificial Sequence
  chemically synthesized
atgtcttttgcccatttttttt

SEQ ID NO: 846957 - DNA, 22 bp, Artificial Sequence
  chemically synthesized
tttatgtcttttgcccattttt

SEQ ID NO: 846958 - DNA, 22 bp, Artificial Sequence
  chemically synthesized
agtagtgtctgtttatgtcttt

SEQ ID NO: 846959 - DNA, 22 bp, Artificial Sequence
  chemically synthesized
gagtagtgtctgtttatgtctt

SEQ ID NO: 846960 - DNA, 22 bp, Artificial Sequence
  chemically synthesized
tgagtagtgtctgtttatgtct

SEQ ID NO: 846961 - DNA, 22 bp, Artificial Sequence
  chemically synthesized
ttgagtagtgtctgtttatgtc

SEQ ID NO: 846962 - DNA, 22 bp, Artificial Sequence
  chemically synthesized
ttttgagtagtgtctgtttatg

SEQ ID NO: 846963 - DNA, 22 bp, Artificial Sequence
  chemically synthesized
cttttgagtagtgtctgtttat

SEQ ID NO: 846964 - DNA, 22 bp, Artificial Sequence
  chemically synthesized
tatgtcttcttttgagtagtgt

SEQ ID NO: 846965 - DNA, 22 bp, Artificial Sequence
  chemically synthesized
gtatgtcttcttttgagtagtg

SEQ ID NO: 846966 - DNA, 22 bp, Artificial Sequence
  chemically synthesized
gccacttgtatgtcttcttttg

SEQ ID NO: 846967 - DNA, 22 bp, Artificial Sequence
  chemically synthesized
ttggccacttgtatgtcttctt

SEQ ID NO: 846968 - DNA, 22 bp, Artificial Sequence
  chemically synthesized
gttggccacttgtatgtcttct

SEQ ID NO: 846969 - DNA, 22 bp, Artificial Sequence
  chemically synthesized
ctcaaaagaagacatacaagtg

SEQ ID NO: 846970 - DNA, 22 bp, Artificial Sequence
  chemically synthesized
atgtttgttggccacttgtatg

SEQ ID NO: 846971 - DNA, 22 bp, Artificial Sequence
  chemically synthesized
catgtttgttggccacttgtat

SEQ ID NO: 846972 - DNA, 22 bp, Artificial Sequence
  chemically synthesized
tcatgtttgttggccacttgta

SEQ ID NO: 846973 - DNA, 22 bp, Artificial Sequence
  chemically synthesized
aaaagaagacatacaagtggcc

SEQ ID NO: 846974 - DNA, 22 bp, Artificial Sequence
  chemically synthesized
ttcatgtttgttggccacttgt

SEQ ID NO: 846975 - DNA, 22 bp, Artificial Sequence
  chemically synthesized
tttcatgtttgttggccacttg

SEQ ID NO: 846976 - DNA, 22 bp, Artificial Sequence
  chemically synthesized
agtgatgtggagcattttttca

SEQ ID NO: 846977 - DNA, 22 bp, Artificial Sequence
  chemically synthesized
atgttgagtgatgtggagcatt

SEQ ID NO: 846978 - DNA, 22 bp, Artificial Sequence
  chemically synthesized
tgatgttgagtgatgtggagca

SEQ ID NO: 846979 - DNA, 22 bp, Artificial Sequence
  chemically synthesized
tctgatgttgagtgatgtggag

SEQ ID NO: 846980 - DNA, 22 bp, Artificial Sequence
  chemically synthesized
ctctgatgttgagtgatgtgga

SEQ ID NO: 846981 - DNA, 22 bp, Artificial Sequence
  chemically synthesized
catttctctgatgttgagtgat

SEQ ID NO: 846982 - DNA, 22 bp, Artificial Sequence
  chemically synthesized
gcatttctctgatgttgagtga

SEQ ID NO: 846983 - DNA, 22 bp, Artificial Sequence
  chemically synthesized
atttgcatttctctgatgttga

SEQ ID NO: 846984 - DNA, 22 bp, Artificial Sequence
  chemically synthesized
gatttgcatttctctgatgttg

SEQ ID NO: 846985 - DNA, 22 bp, Artificial Sequence
  chemically synthesized
tgatttgcatttctctgatgtt

SEQ ID NO: 846986 - DNA, 22 bp, Artificial Sequence
  chemically synthesized
cacatcactcaacatcagagaa

SEQ ID NO: 846987 - DNA, 22 bp, Artificial Sequence
  chemically synthesized
tggttttgatttgcatttctct

SEQ ID NO: 846988 - DNA, 22 bp, Artificial Sequence
  chemically synthesized
gttgtggttttgatttgcattt

SEQ ID NO: 846989 - DNA, 22 bp, Artificial Sequence
  chemically synthesized
aacatcagagaaatgcaaatca

SEQ ID NO: 846990 - DNA, 22 bp, Artificial Sequence
  chemically synthesized
ataatagccagtatgaatggtg

SEQ ID NO: 846991 - DNA, 22 bp, Artificial Sequence
  chemically synthesized
aataatagccagtatgaatggt

SEQ ID NO: 846992 - DNA, 22 bp, Artificial Sequence
  chemically synthesized
taataatagccagtatgaatgg

SEQ ID NO: 846993 - DNA, 22 bp, Artificial Sequence
  chemically synthesized
ttaataatagccagtatgaatg

SEQ ID NO: 846994 - DNA, 22 bp, Artificial Sequence
  chemically synthesized
tttaataatagccagtatgaat

SEQ ID NO: 846995 - DNA, 22 bp, Artificial Sequence
  chemically synthesized
actttttaataatagccagtat

SEQ ID NO: 846996 - DNA, 22 bp, Artificial Sequence
  chemically synthesized
gactttttaataatagccagta

SEQ ID NO: 846997 - DNA, 22 bp, Artificial Sequence
  chemically synthesized
tgactttttaataatagccagt

SEQ ID NO: 846998 - DNA, 22 bp, Artificial Sequence
  chemically synthesized
acaccattcatactggctatta

SEQ ID NO: 846999 - DNA, 22 bp, Artificial Sequence
  chemically synthesized
ttgactttttaataatagccag

SEQ ID NO: 847000 - DNA, 22 bp, Artificial Sequence
  chemically synthesized
tttgactttttaataatagcca

SEQ ID NO: 847001 - DNA, 22 bp, Artificial Sequence
  chemically synthesized
ttttgactttttaataatagcc

SEQ ID NO: 847002 - DNA, 22 bp, Artificial Sequence
  chemically synthesized
tcatttttttgactttttaata

SEQ ID NO: 847003 - DNA, 22 bp, Artificial Sequence
  chemically synthesized
atactggctattattaaaaagt

SEQ ID NO: 847004 - DNA, 22 bp, Artificial Sequence
  chemically synthesized
gctattattaaaaagtcaaaaa

SEQ ID NO: 847005 - DNA, 22 bp, Artificial Sequence
  chemically synthesized
ttattaaaaagtcaaaaaaatg

SEQ ID NO: 847006 - DNA, 22 bp, Artificial Sequence
  chemically synthesized
ttaaaaagtcaaaaaaatgaca

SEQ ID NO: 847007 - DNA, 22 bp, Artificial Sequence
  chemically synthesized
aaaagtcaaaaaaatgacagat

SEQ ID NO: 847008 - DNA, 22 bp, Artificial Sequence
  chemically synthesized
cagcgtcagcagcatctgtcat

SEQ ID NO: 847009 - DNA, 22 bp, Artificial Sequence
  chemically synthesized
tacagcgtcagcagcatctgtc

SEQ ID NO: 847010 - DNA, 22 bp, Artificial Sequence
  chemically synthesized
tctacagcgtcagcagcatctg

SEQ ID NO: 847011 - DNA, 22 bp, Artificial Sequence
  chemically synthesized
ctctacagcgtcagcagcatct

SEQ ID NO: 847012 - DNA, 22 bp, Artificial Sequence
  chemically synthesized
ttctctacagcgtcagcagcat

SEQ ID NO: 847013 - DNA, 22 bp, Artificial Sequence
  chemically synthesized
cctcttctctacagcgtcagca

SEQ ID NO: 847014 - DNA, 22 bp, Artificial Sequence
  chemically synthesized
ctgacgctgtagagaagaggga

SEQ ID NO: 847015 - DNA, 22 bp, Artificial Sequence
  chemically synthesized
acgctgtagagaagagggaact

SEQ ID NO: 847016 - DNA, 22 bp, Artificial Sequence
  chemically synthesized
tagagaagagggaactctgata

SEQ ID NO: 847017 - DNA, 22 bp, Artificial Sequence
  chemically synthesized
ccagcaacagtgtatcagagtt

SEQ ID NO: 847018 - DNA, 22 bp, Artificial Sequence
  chemically synthesized
cattcccagcaacagtgtatca

SEQ ID NO: 847019 - DNA, 22 bp, Artificial Sequence
  chemically synthesized
gcattcccagcaacagtgtatc

SEQ ID NO: 847020 - DNA, 22 bp, Artificial Sequence
  chemically synthesized
atttgcattcccagcaacagtg

SEQ ID NO: 847021 - DNA, 22 bp, Artificial Sequence
  chemically synthesized
aactaatttgcattcccagcaa

SEQ ID NO: 847022 - DNA, 22 bp, Artificial Sequence
  chemically synthesized
tgatacactgttgctgggaatg

SEQ ID NO: 847023 - DNA, 22 bp, Artificial Sequence
  chemically synthesized
atacactgttgctgggaatgca

SEQ ID NO: 847024 - DNA, 22 bp, Artificial Sequence
  chemically synthesized
tggctgaactaatttgcattcc

SEQ ID NO: 847025 - DNA, 22 bp, Artificial Sequence
  chemically synthesized
actgtggctgaactaatttgca

SEQ ID NO: 847026 - DNA, 22 bp, Artificial Sequence
  chemically synthesized
cactgtggctgaactaatttgc

SEQ ID NO: 847027 - DNA, 22 bp, Artificial Sequence
  chemically synthesized
ttgctgggaatgcaaattagtt

SEQ ID NO: 847028 - DNA, 22 bp, Artificial Sequence
  chemically synthesized
tttcactgtggctgaactaatt

SEQ ID NO: 847029 - DNA, 22 bp, Artificial Sequence
  chemically synthesized
ctgggaatgcaaattagttcag

SEQ ID NO: 847030 - DNA, 22 bp, Artificial Sequence
  chemically synthesized
ggaatgcaaattagttcagcca

SEQ ID NO: 847031 - DNA, 22 bp, Artificial Sequence
  chemically synthesized
aaactgtttcactgtggctgaa

SEQ ID NO: 847032 - DNA, 22 bp, Artificial Sequence
  chemically synthesized
caaactgtttcactgtggctga

SEQ ID NO: 847033 - DNA, 22 bp, Artificial Sequence
  chemically synthesized
agaaatcttcaaactgtttcac

SEQ ID NO: 847034 - DNA, 22 bp, Artificial Sequence
  chemically synthesized
gttcagccacagtgaaacagtt

SEQ ID NO: 847035 - DNA, 22 bp, Artificial Sequence
  chemically synthesized
gagaaatcttcaaactgtttca

SEQ ID NO: 847036 - DNA, 22 bp, Artificial Sequence
  chemically synthesized
tgagaaatcttcaaactgtttc

SEQ ID NO: 847037 - DNA, 22 bp, Artificial Sequence
  chemically synthesized
agccacagtgaaacagtttgaa

SEQ ID NO: 847038 - DNA, 22 bp, Artificial Sequence
  chemically synthesized
agtcctttgagaaatcttcaaa

SEQ ID NO: 847039 - DNA, 22 bp, Artificial Sequence
  chemically synthesized
aagtcctttgagaaatcttcaa

SEQ ID NO: 847040 - DNA, 22 bp, Artificial Sequence
  chemically synthesized
taagtcctttgagaaatcttca

SEQ ID NO: 847041 - DNA, 22 bp, Artificial Sequence
  chemically synthesized
tgttttaagtcctttgagaaat

SEQ ID NO: 847042 - DNA, 22 bp, Artificial Sequence
  chemically synthesized
gaagatttctcaaaggacttaa

SEQ ID NO: 847043 - DNA, 22 bp, Artificial Sequence
  chemically synthesized
aagatttctcaaaggacttaaa

SEQ ID NO: 847044 - DNA, 22 bp, Artificial Sequence
  chemically synthesized
aacgatagttgtgttttaagtc

SEQ ID NO: 847045 - DNA, 22 bp, Artificial Sequence
  chemically synthesized
ctcaaaggacttaaaacacaac

SEQ ID NO: 847046 - DNA, 22 bp, Artificial Sequence
  chemically synthesized
ggttgaacgatagttgtgtttt

SEQ ID NO: 847047 - DNA, 22 bp, Artificial Sequence
  chemically synthesized
tcaaaggacttaaaacacaact

SEQ ID NO: 847048 - DNA, 22 bp, Artificial Sequence
  chemically synthesized
aaaggacttaaaacacaactat

SEQ ID NO: 847049 - DNA, 22 bp, Artificial Sequence
  chemically synthesized
aaaacacaactatcgttcaacc

SEQ ID NO: 847050 - DNA, 22 bp, Artificial Sequence
  chemically synthesized
aaacacaactatcgttcaacct

SEQ ID NO: 847051 - DNA, 22 bp, Artificial Sequence
  chemically synthesized
tatgcccagtaatgggatcact

SEQ ID NO: 847052 - DNA, 22 bp, Artificial Sequence
  chemically synthesized
tcgttcaacctagtgatcccat

SEQ ID NO: 847053 - DNA, 22 bp, Artificial Sequence
  chemically synthesized
ggctatatgcccagtaatggga

SEQ ID NO: 847054 - DNA, 22 bp, Artificial Sequence
  chemically synthesized
gggctatatgcccagtaatggg

SEQ ID NO: 847055 - DNA, 22 bp, Artificial Sequence
  chemically synthesized
aacctagtgatcccattactgg

SEQ ID NO: 847056 - DNA, 22 bp, Artificial Sequence
  chemically synthesized
tttgggctatatgcccagtaat

SEQ ID NO: 847057 - DNA, 22 bp, Artificial Sequence
  chemically synthesized
atttgggctatatgcccagtaa

SEQ ID NO: 847058 - DNA, 22 bp, Artificial Sequence
  chemically synthesized
tatttgggctatatgcccagta

SEQ ID NO: 847059 - DNA, 22 bp, Artificial Sequence
  chemically synthesized
gtgatcccattactgggcatat

SEQ ID NO: 847060 - DNA, 22 bp, Artificial Sequence
  chemically synthesized
ttttatttgggctatatgccca

SEQ ID NO: 847061 - DNA, 22 bp, Artificial Sequence
  chemically synthesized
gttttatttgggctatatgccc

SEQ ID NO: 847062 - DNA, 22 bp, Artificial Sequence
  chemically synthesized
ctgggcatatagcccaaataaa

SEQ ID NO: 847063 - DNA, 22 bp, Artificial Sequence
  chemically synthesized
gtaaagcaatttgttttatttg

SEQ ID NO: 847064 - DNA, 22 bp, Artificial Sequence
  chemically synthesized
ggcatatagcccaaataaaaca

SEQ ID NO: 847065 - DNA, 22 bp, Artificial Sequence
  chemically synthesized
agtaaagcaatttgttttattt

SEQ ID NO: 847066 - DNA, 22 bp, Artificial Sequence
  chemically synthesized
tagtaaagcaatttgttttatt

SEQ ID NO: 847067 - DNA, 22 bp, Artificial Sequence
  chemically synthesized
ttagtaaagcaatttgttttat

SEQ ID NO: 847068 - DNA, 22 bp, Artificial Sequence
  chemically synthesized
tttagtaaagcaatttgtttta

SEQ ID NO: 847069 - DNA, 22 bp, Artificial Sequence
  chemically synthesized
ctttactaaaaaaccacatgta

SEQ ID NO: 847070 - DNA, 22 bp, Artificial Sequence
  chemically synthesized
tactaaaaaaccacatgtattc

SEQ ID NO: 847071 - DNA, 22 bp, Artificial Sequence
  chemically synthesized
aaatgaggatgagaatacatgt

SEQ ID NO: 847072 - DNA, 22 bp, Artificial Sequence
  chemically synthesized
actaaaaaaccacatgtattct

SEQ ID NO: 847073 - DNA, 22 bp, Artificial Sequence
  chemically synthesized
ctaaaaaaccacatgtattctc

SEQ ID NO: 847074 - DNA, 22 bp, Artificial Sequence
  chemically synthesized
aaaaaccacatgtattctcatc

SEQ ID NO: 847075 - DNA, 22 bp, Artificial Sequence
  chemically synthesized
tgaatagtgctgaaatgaggat

SEQ ID NO: 847076 - DNA, 22 bp, Artificial Sequence
  chemically synthesized
ttgtgaatagtgctgaaatgag

SEQ ID NO: 847077 - DNA, 22 bp, Artificial Sequence
  chemically synthesized
ctattgtgaatagtgctgaaat

SEQ ID NO: 847078 - DNA, 22 bp, Artificial Sequence
  chemically synthesized
gctattgtgaatagtgctgaaa

SEQ ID NO: 847079 - DNA, 22 bp, Artificial Sequence
  chemically synthesized
tgctattgtgaatagtgctgaa

SEQ ID NO: 847080 - DNA, 22 bp, Artificial Sequence
  chemically synthesized
tcatcctcatttcagcactatt

SEQ ID NO: 847081 - DNA, 22 bp, Artificial Sequence
  chemically synthesized
atcctcatttcagcactattca

SEQ ID NO: 847082 - DNA, 22 bp, Artificial Sequence
  chemically synthesized
atacctttgctattgtgaatag

SEQ ID NO: 847083 - DNA, 22 bp, Artificial Sequence
  chemically synthesized
catacctttgctattgtgaata

SEQ ID NO: 847084 - DNA, 22 bp, Artificial Sequence
  chemically synthesized
atttcagcactattcacaatag

SEQ ID NO: 847085 - DNA, 22 bp, Artificial Sequence
  chemically synthesized
acttcatacctttgctattgtg

SEQ ID NO: 847086 - DNA, 22 bp, Artificial Sequence
  chemically synthesized
cagcactattcacaatagcaaa

SEQ ID NO: 847087 - DNA, 22 bp, Artificial Sequence
  chemically synthesized
agcactattcacaatagcaaag

SEQ ID NO: 847088 - DNA, 22 bp, Artificial Sequence
  chemically synthesized
ggctgacttcatacctttgcta

SEQ ID NO: 847089 - DNA, 22 bp, Artificial Sequence
  chemically synthesized
ttcacaatagcaaaggtatgaa

SEQ ID NO: 847090 - DNA, 22 bp, Artificial Sequence
  chemically synthesized
acaatagcaaaggtatgaagtc

SEQ ID NO: 847091 - DNA, 22 bp, Artificial Sequence
  chemically synthesized
atgggcacctaggctgacttca

SEQ ID NO: 847092 - DNA, 22 bp, Artificial Sequence
  chemically synthesized
ccactgatgggcacctaggctg

SEQ ID NO: 847093 - DNA, 22 bp, Artificial Sequence
  chemically synthesized
cagtctgccactgatgggcacc

SEQ ID NO: 847094 - DNA, 22 bp, Artificial Sequence
  chemically synthesized
tccagtctgccactgatgggca

SEQ ID NO: 847095 - DNA, 22 bp, Artificial Sequence
  chemically synthesized
ctccagtctgccactgatgggc

SEQ ID NO: 847096 - DNA, 22 bp, Artificial Sequence
  chemically synthesized
tctccagtctgccactgatggg

SEQ ID NO: 847097 - DNA, 22 bp, Artificial Sequence
  chemically synthesized
tttctccagtctgccactgatg

SEQ ID NO: 847098 - DNA, 22 bp, Artificial Sequence
  chemically synthesized
ctttctccagtctgccactgat

SEQ ID NO: 847099 - DNA, 22 bp, Artificial Sequence
  chemically synthesized
tctttctccagtctgccactga

SEQ ID NO: 847100 - DNA, 22 bp, Artificial Sequence
  chemically synthesized
ggtgcccatcagtggcagactg

SEQ ID NO: 847101 - DNA, 22 bp, Artificial Sequence
  chemically synthesized
catggtgtatatgcaccgtatt

SEQ ID NO: 847102 - DNA, 22 bp, Artificial Sequence
  chemically synthesized
gagaaagaaaatacggtgcata

SEQ ID NO: 847103 - DNA, 22 bp, Artificial Sequence
  chemically synthesized
catagtattccatggtgtatat

SEQ ID NO: 847104 - DNA, 22 bp, Artificial Sequence
  chemically synthesized
tggctgcatagtattccatggt

SEQ ID NO: 847105 - DNA, 22 bp, Artificial Sequence
  chemically synthesized
atggctgcatagtattccatgg

SEQ ID NO: 847106 - DNA, 22 bp, Artificial Sequence
  chemically synthesized
tatggctgcatagtattccatg

SEQ ID NO: 847107 - DNA, 22 bp, Artificial Sequence
  chemically synthesized
ttatggctgcatagtattccat

SEQ ID NO: 847108 - DNA, 22 bp, Artificial Sequence
  chemically synthesized
tttatggctgcatagtattcca

SEQ ID NO: 847109 - DNA, 22 bp, Artificial Sequence
  chemically synthesized
ttttatggctgcatagtattcc

SEQ ID NO: 847110 - DNA, 22 bp, Artificial Sequence
  chemically synthesized
ttttttatggctgcatagtatt

SEQ ID NO: 847111 - DNA, 22 bp, Artificial Sequence
  chemically synthesized
ttcttttttatggctgcatagt

SEQ ID NO: 847112 - DNA, 22 bp, Artificial Sequence
  chemically synthesized
gttcttttttatggctgcatag

SEQ ID NO: 847113 - DNA, 22 bp, Artificial Sequence
  chemically synthesized
tgttcttttttatggctgcata

SEQ ID NO: 847114 - DNA, 22 bp, Artificial Sequence
  chemically synthesized
tgcagccataaaaaagaacaaa

SEQ ID NO: 847115 - DNA, 22 bp, Artificial Sequence
  chemically synthesized
caaaggacatgattttgttctt

SEQ ID NO: 847116 - DNA, 22 bp, Artificial Sequence
  chemically synthesized
ctgcaaaggacatgattttgtt

SEQ ID NO: 847117 - DNA, 22 bp, Artificial Sequence
  chemically synthesized
catccatgttgctgcaaaggac

SEQ ID NO: 847118 - DNA, 22 bp, Artificial Sequence
  chemically synthesized
cagctgcatccatgttgctgca

SEQ ID NO: 847119 - DNA, 22 bp, Artificial Sequence
  chemically synthesized
tgcagcaacatggatgcagctg

SEQ ID NO: 847120 - DNA, 22 bp, Artificial Sequence
  chemically synthesized
gcagcaacatggatgcagctgg

SEQ ID NO: 847121 - DNA, 22 bp, Artificial Sequence
  chemically synthesized
gaataatggcctccagctgcat

SEQ ID NO: 847122 - DNA, 22 bp, Artificial Sequence
  chemically synthesized
cagcaacatggatgcagctgga

SEQ ID NO: 847123 - DNA, 22 bp, Artificial Sequence
  chemically synthesized
agaataatggcctccagctgca

SEQ ID NO: 847124 - DNA, 22 bp, Artificial Sequence
  chemically synthesized
acttagaataatggcctccagc

SEQ ID NO: 847125 - DNA, 22 bp, Artificial Sequence
  chemically synthesized
attcacttagaataatggcctc

SEQ ID NO: 847126 - DNA, 22 bp, Artificial Sequence
  chemically synthesized
cattaattcacttagaataatg

SEQ ID NO: 847127 - DNA, 22 bp, Artificial Sequence
  chemically synthesized
tgcattaattcacttagaataa

SEQ ID NO: 847128 - DNA, 22 bp, Artificial Sequence
  chemically synthesized
ctgcattaattcacttagaata

SEQ ID NO: 847129 - DNA, 22 bp, Artificial Sequence
  chemically synthesized
gaggccattattctaagtgaat

SEQ ID NO: 847130 - DNA, 22 bp, Artificial Sequence
  chemically synthesized
tgtttctgcattaattcactta

SEQ ID NO: 847131 - DNA, 22 bp, Artificial Sequence
  chemically synthesized
gtattgtgtttctgcattaatt

SEQ ID NO: 847132 - DNA, 22 bp, Artificial Sequence
  chemically synthesized
ggtattgtgtttctgcattaat

SEQ ID NO: 847133 - DNA, 22 bp, Artificial Sequence
  chemically synthesized
ttctaagtgaattaatgcagaa

SEQ ID NO: 847134 - DNA, 22 bp, Artificial Sequence
  chemically synthesized
taagtgaattaatgcagaaaca

SEQ ID NO: 847135 - DNA, 22 bp, Artificial Sequence
  chemically synthesized
agtgaattaatgcagaaacaca

SEQ ID NO: 847136 - DNA, 22 bp, Artificial Sequence
  chemically synthesized
atgcagaaacacaataccaaat

SEQ ID NO: 847137 - DNA, 22 bp, Artificial Sequence
  chemically synthesized
cacatgagaacacgtggtattt

SEQ ID NO: 847138 - DNA, 22 bp, Artificial Sequence
  chemically synthesized
gctccacatgagaacacgtggt

SEQ ID NO: 847139 - DNA, 22 bp, Artificial Sequence
  chemically synthesized
agctccacatgagaacacgtgg

SEQ ID NO: 847140 - DNA, 22 bp, Artificial Sequence
  chemically synthesized
tttagctccacatgagaacacg

SEQ ID NO: 847141 - DNA, 22 bp, Artificial Sequence
  chemically synthesized
tcatgtggagctaaacagtgcg

SEQ ID NO: 847142 - DNA, 22 bp, Artificial Sequence
  chemically synthesized
tgtccatgacaacgcactgttt

SEQ ID NO: 847143 - DNA, 22 bp, Artificial Sequence
  chemically synthesized
atgtggagctaaacagtgcgtt

SEQ ID NO: 847144 - DNA, 22 bp, Artificial Sequence
  chemically synthesized
ccatcattatgtccatgacaac

SEQ ID NO: 847145 - DNA, 22 bp, Artificial Sequence
  chemically synthesized
ttgccatcattatgtccatgac

SEQ ID NO: 847146 - DNA, 22 bp, Artificial Sequence
  chemically synthesized
aacagtgcgttgtcatggacat

SEQ ID NO: 847147 - DNA, 22 bp, Artificial Sequence
  chemically synthesized
ttgttgccatcattatgtccat

SEQ ID NO: 847148 - DNA, 22 bp, Artificial Sequence
  chemically synthesized
tattgttgccatcattatgtcc

SEQ ID NO: 847149 - DNA, 22 bp, Artificial Sequence
  chemically synthesized
ctattgttgccatcattatgtc

SEQ ID NO: 847150 - DNA, 22 bp, Artificial Sequence
  chemically synthesized
cgtttctattgttgccatcatt

SEQ ID NO: 847151 - DNA, 22 bp, Artificial Sequence
  chemically synthesized
tcatggacataatgatggcaac

SEQ ID NO: 847152 - DNA, 22 bp, Artificial Sequence
  chemically synthesized
gtagtcctccgtttctattgtt

SEQ ID NO: 847153 - DNA, 22 bp, Artificial Sequence
  chemically synthesized
tagtagtcctccgtttctattg

SEQ ID NO: 847154 - DNA, 22 bp, Artificial Sequence
  chemically synthesized
cccactctagtagtcctccgtt

SEQ ID NO: 847155 - DNA, 22 bp, Artificial Sequence
  chemically synthesized
cctccccactctagtagtcctc

SEQ ID NO: 847156 - DNA, 22 bp, Artificial Sequence
  chemically synthesized
cctccctccccactctagtagt

SEQ ID NO: 847157 - DNA, 22 bp, Artificial Sequence
  chemically synthesized
ccctccctccccactctagtag

SEQ ID NO: 847158 - DNA, 22 bp, Artificial Sequence
  chemically synthesized
tttccctccctccccactctag

SEQ ID NO: 847159 - DNA, 22 bp, Artificial Sequence
  chemically synthesized
gtttccctccctccccactcta

SEQ ID NO: 847160 - DNA, 22 bp, Artificial Sequence
  chemically synthesized
aacccttgtttccctccctccc

SEQ ID NO: 847161 - DNA, 22 bp, Artificial Sequence
  chemically synthesized
caacccttgtttccctccctcc

SEQ ID NO: 847162 - DNA, 22 bp, Artificial Sequence
  chemically synthesized
tcaacccttgtttccctccctc

SEQ ID NO: 847163 - DNA, 22 bp, Artificial Sequence
  chemically synthesized
ttcaacccttgtttccctccct

SEQ ID NO: 847164 - DNA, 22 bp, Artificial Sequence
  chemically synthesized
ctagagtggggagggagggaaa

SEQ ID NO: 847165 - DNA, 22 bp, Artificial Sequence
  chemically synthesized
gagtggggagggagggaaacaa

SEQ ID NO: 847166 - DNA, 22 bp, Artificial Sequence
  chemically synthesized
gtttttcaacccttgtttccct

SEQ ID NO: 847167 - DNA, 22 bp, Artificial Sequence
  chemically synthesized
agcatagtaaccgatagttagt

SEQ ID NO: 847168 - DNA, 22 bp, Artificial Sequence
  chemically synthesized
aaaaactaactatcggttacta

SEQ ID NO: 847169 - DNA, 22 bp, Artificial Sequence
  chemically synthesized
tcacccaggtactgagcatagt

SEQ ID NO: 847170 - DNA, 22 bp, Artificial Sequence
  chemically synthesized
actatcggttactatgctcagt

SEQ ID NO: 847171 - DNA, 22 bp, Artificial Sequence
  chemically synthesized
tcggttactatgctcagtacct

SEQ ID NO: 847172 - DNA, 22 bp, Artificial Sequence
  chemically synthesized
ctatgctcagtacctgggtgac

SEQ ID NO: 847173 - DNA, 22 bp, Artificial Sequence
  chemically synthesized
tgctcagtacctgggtgacagt

SEQ ID NO: 847174 - DNA, 22 bp, Artificial Sequence
  chemically synthesized
gagtacaaatgatactgtcacc

SEQ ID NO: 847175 - DNA, 22 bp, Artificial Sequence
  chemically synthesized
ggagtacaaatgatactgtcac

SEQ ID NO: 847176 - DNA, 22 bp, Artificial Sequence
  chemically synthesized
agtacctgggtgacagtatcat

SEQ ID NO: 847177 - DNA, 22 bp, Artificial Sequence
  chemically synthesized
ggtgacagtatcatttgtactc

SEQ ID NO: 847178 - DNA, 22 bp, Artificial Sequence
  chemically synthesized
catgatgccgaggtttggagta

SEQ ID NO: 847179 - DNA, 22 bp, Artificial Sequence
  chemically synthesized
atatattacatgatgccgaggt

SEQ ID NO: 847180 - DNA, 22 bp, Artificial Sequence
  chemically synthesized
gatatattacatgatgccgagg

SEQ ID NO: 847181 - DNA, 22 bp, Artificial Sequence
  chemically synthesized
gtactccaaacctcggcatcat

SEQ ID NO: 847182 - DNA, 22 bp, Artificial Sequence
  chemically synthesized
tactccaaacctcggcatcatg

SEQ ID NO: 847183 - DNA, 22 bp, Artificial Sequence
  chemically synthesized
ccttgatatattacatgatgcc

SEQ ID NO: 847184 - DNA, 22 bp, Artificial Sequence
  chemically synthesized
ttaccttgatatattacatgat

SEQ ID NO: 847185 - DNA, 22 bp, Artificial Sequence
  chemically synthesized
caaacctcggcatcatgtaata

SEQ ID NO: 847186 - DNA, 22 bp, Artificial Sequence
  chemically synthesized
attaccttgatatattacatga

SEQ ID NO: 847187 - DNA, 22 bp, Artificial Sequence
  chemically synthesized
ggcatcatgtaatatatcaagg

SEQ ID NO: 847188 - DNA, 22 bp, Artificial Sequence
  chemically synthesized
agggagtacatgtgtaggttta

SEQ ID NO: 847189 - DNA, 22 bp, Artificial Sequence
  chemically synthesized
gattcagggagtacatgtgtag

SEQ ID NO: 847190 - DNA, 22 bp, Artificial Sequence
  chemically synthesized
agattcagggagtacatgtgta

SEQ ID NO: 847191 - DNA, 22 bp, Artificial Sequence
  chemically synthesized
tagattcagggagtacatgtgt

SEQ ID NO: 847192 - DNA, 22 bp, Artificial Sequence
  chemically synthesized
attttagattcagggagtacat

SEQ ID NO: 847193 - DNA, 22 bp, Artificial Sequence
  chemically synthesized
gattttagattcagggagtaca

SEQ ID NO: 847194 - DNA, 22 bp, Artificial Sequence
  chemically synthesized
tgattttagattcagggagtac

SEQ ID NO: 847195 - DNA, 22 bp, Artificial Sequence
  chemically synthesized
aactttgattttagattcaggg

SEQ ID NO: 847196 - DNA, 22 bp, Artificial Sequence
  chemically synthesized
caactttgattttagattcagg

SEQ ID NO: 847197 - DNA, 22 bp, Artificial Sequence
  chemically synthesized
cacatgtactccctgaatctaa

SEQ ID NO: 847198 - DNA, 22 bp, Artificial Sequence
  chemically synthesized
tcaactttgattttagattcag

SEQ ID NO: 847199 - DNA, 22 bp, Artificial Sequence
  chemically synthesized
ttcaactttgattttagattca

SEQ ID NO: 847200 - DNA, 22 bp, Artificial Sequence
  chemically synthesized
tttcaactttgattttagattc

SEQ ID NO: 847201 - DNA, 22 bp, Artificial Sequence
  chemically synthesized
cctgaatctaaaatcaaagttg

SEQ ID NO: 847202 - DNA, 22 bp, Artificial Sequence
  chemically synthesized
aatctaaaatcaaagttgaaaa

SEQ ID NO: 847203 - DNA, 22 bp, Artificial Sequence
  chemically synthesized
aaatcaaagttgaaaaaatgtt

SEQ ID NO: 847204 - DNA, 22 bp, Artificial Sequence
  chemically synthesized
tgtggaaaaaaaaaaaaagaca

SEQ ID NO: 847205 - DNA, 22 bp, Artificial Sequence
  chemically synthesized
aaaaaatgtttgtctttttttt

SEQ ID NO: 847206 - DNA, 22 bp, Artificial Sequence
  chemically synthesized
gtctttttttttttttccacac

SEQ ID NO: 847207 - DNA, 22 bp, Artificial Sequence
  chemically synthesized
tctttttttttttttccacaca

SEQ ID NO: 847208 - DNA, 22 bp, Artificial Sequence
  chemically synthesized
tttttttttttccacacagggt

SEQ ID NO: 847209 - DNA, 22 bp, Artificial Sequence
  chemically synthesized
ttttttttttccacacagggtc

SEQ ID NO: 847210 - DNA, 22 bp, Artificial Sequence
  chemically synthesized
tttttttttccacacagggtct

SEQ ID NO: 847211 - DNA, 22 bp, Artificial Sequence
  chemically synthesized
ttttttttccacacagggtctt

SEQ ID NO: 847212 - DNA, 22 bp, Artificial Sequence
  chemically synthesized
tttttttccacacagggtcttg

SEQ ID NO: 847213 - DNA, 22 bp, Artificial Sequence
  chemically synthesized
ttttttccacacagggtcttgc

SEQ ID NO: 847214 - DNA, 22 bp, Artificial Sequence
  chemically synthesized
tttttccacacagggtcttgct

SEQ ID NO: 847215 - DNA, 22 bp, Artificial Sequence
  chemically synthesized
ttttccacacagggtcttgctc

SEQ ID NO: 847216 - DNA, 22 bp, Artificial Sequence
  chemically synthesized
tttccacacagggtcttgctct

SEQ ID NO: 847217 - DNA, 22 bp, Artificial Sequence
  chemically synthesized
ttccacacagggtcttgctctg

SEQ ID NO: 847218 - DNA, 22 bp, Artificial Sequence
  chemically synthesized
cagccagaatgacagagcaaga

SEQ ID NO: 847219 - DNA, 22 bp, Artificial Sequence
  chemically synthesized
tccacacagggtcttgctctgt

SEQ ID NO: 847220 - DNA, 22 bp, Artificial Sequence
  chemically synthesized
ccacacagggtcttgctctgtc

SEQ ID NO: 847221 - DNA, 22 bp, Artificial Sequence
  chemically synthesized
cacacagggtcttgctctgtca

SEQ ID NO: 847222 - DNA, 22 bp, Artificial Sequence
  chemically synthesized
cagtgccctccagccagaatga

SEQ ID NO: 847223 - DNA, 22 bp, Artificial Sequence
  chemically synthesized
actccagtgccctccagccaga

SEQ ID NO: 847224 - DNA, 22 bp, Artificial Sequence
  chemically synthesized
gctctgtcattctggctggagg

SEQ ID NO: 847225 - DNA, 22 bp, Artificial Sequence
  chemically synthesized
ctctgtcattctggctggaggg

SEQ ID NO: 847226 - DNA, 22 bp, Artificial Sequence
  chemically synthesized
tgtcattctggctggagggcac

SEQ ID NO: 847227 - DNA, 22 bp, Artificial Sequence
  chemically synthesized
tcattctggctggagggcactg

SEQ ID NO: 847228 - DNA, 22 bp, Artificial Sequence
  chemically synthesized
tggctggagggcactggagtga

SEQ ID NO: 847229 - DNA, 22 bp, Artificial Sequence
  chemically synthesized
gctggagggcactggagtgaac

SEQ ID NO: 847230 - DNA, 22 bp, Artificial Sequence
  chemically synthesized
gagggcactggagtgaacatgg

SEQ ID NO: 847231 - DNA, 22 bp, Artificial Sequence
  chemically synthesized
gagtgaacatggcttactgccg

SEQ ID NO: 847232 - DNA, 22 bp, Artificial Sequence
  chemically synthesized
agcccaggaggtcaaggcggca

SEQ ID NO: 847233 - DNA, 22 bp, Artificial Sequence
  chemically synthesized
gagcccaggaggtcaaggcggc

SEQ ID NO: 847234 - DNA, 22 bp, Artificial Sequence
  chemically synthesized
actgccgccttgacctcctggg

SEQ ID NO: 847235 - DNA, 22 bp, Artificial Sequence
  chemically synthesized
ctgccgccttgacctcctgggc

SEQ ID NO: 847236 - DNA, 22 bp, Artificial Sequence
  chemically synthesized
ccgccttgacctcctgggctca

SEQ ID NO: 847237 - DNA, 22 bp, Artificial Sequence
  chemically synthesized
acacaggaggatcacttgagcc

SEQ ID NO: 847238 - DNA, 22 bp, Artificial Sequence
  chemically synthesized
gacctcctgggctcaagtgatc

SEQ ID NO: 847239 - DNA, 22 bp, Artificial Sequence
  chemically synthesized
acctcctgggctcaagtgatcc

SEQ ID NO: 847240 - DNA, 22 bp, Artificial Sequence
  chemically synthesized
ctgggctcaagtgatcctcctg

SEQ ID NO: 847241 - DNA, 22 bp, Artificial Sequence
  chemically synthesized
ggctcaagtgatcctcctgtgt

SEQ ID NO: 847242 - DNA, 22 bp, Artificial Sequence
  chemically synthesized
catgggaggctgacacaggagg

SEQ ID NO: 847243 - DNA, 22 bp, Artificial Sequence
  chemically synthesized
aagtgatcctcctgtgtcagcc

SEQ ID NO: 847244 - DNA, 22 bp, Artificial Sequence
  chemically synthesized
ccagctgcatgggaggctgaca

SEQ ID NO: 847245 - DNA, 22 bp, Artificial Sequence
  chemically synthesized
ctgtgtcagcctcccatgcagc

SEQ ID NO: 847246 - DNA, 22 bp, Artificial Sequence
  chemically synthesized
tgtcagcctcccatgcagctgg

SEQ ID NO: 847247 - DNA, 22 bp, Artificial Sequence
  chemically synthesized
taaggagccctgccagctgcat

SEQ ID NO: 847248 - DNA, 22 bp, Artificial Sequence
  chemically synthesized
ccatgcagctggcagggctcct

SEQ ID NO: 847249 - DNA, 22 bp, Artificial Sequence
  chemically synthesized
ggcatggtggcacatggctgta

SEQ ID NO: 847250 - DNA, 22 bp, Artificial Sequence
  chemically synthesized
gcagggctccttacagccatgt

SEQ ID NO: 847251 - DNA, 22 bp, Artificial Sequence
  chemically synthesized
actgggcatggtggcacatggc

SEQ ID NO: 847252 - DNA, 22 bp, Artificial Sequence
  chemically synthesized
cttacagccatgtgccaccatg

SEQ ID NO: 847253 - DNA, 22 bp, Artificial Sequence
  chemically synthesized
acagccatgtgccaccatgccc

SEQ ID NO: 847254 - DNA, 22 bp, Artificial Sequence
  chemically synthesized
cagccatgtgccaccatgccca

SEQ ID NO: 847255 - DNA, 22 bp, Artificial Sequence
  chemically synthesized
aaatatatatgtagaaaaatta

SEQ ID NO: 847256 - DNA, 22 bp, Artificial Sequence
  chemically synthesized
aaaatatatatgtagaaaaatt

SEQ ID NO: 847257 - DNA, 22 bp, Artificial Sequence
  chemically synthesized
taaaatatatatgtagaaaaat

SEQ ID NO: 847258 - DNA, 22 bp, Artificial Sequence
  chemically synthesized
tctttaaaatatatatgtagaa

SEQ ID NO: 847259 - DNA, 22 bp, Artificial Sequence
  chemically synthesized
atttttctacatatatatttta

SEQ ID NO: 847260 - DNA, 22 bp, Artificial Sequence
  chemically synthesized
ttctacatatatattttaaaga

SEQ ID NO: 847261 - DNA, 22 bp, Artificial Sequence
  chemically synthesized
tctacatatatattttaaagac

SEQ ID NO: 847262 - DNA, 22 bp, Artificial Sequence
  chemically synthesized
ctacatatatattttaaagaca

SEQ ID NO: 847263 - DNA, 22 bp, Artificial Sequence
  chemically synthesized
tacatatatattttaaagacag

SEQ ID NO: 847264 - DNA, 22 bp, Artificial Sequence
  chemically synthesized
catatatattttaaagacaggg

SEQ ID NO: 847265 - DNA, 22 bp, Artificial Sequence
  chemically synthesized
ggaaacaaagtgagaccctgtc

SEQ ID NO: 847266 - DNA, 22 bp, Artificial Sequence
  chemically synthesized
taaagacagggtctcactttgt

SEQ ID NO: 847267 - DNA, 22 bp, Artificial Sequence
  chemically synthesized
aaagacagggtctcactttgtt

SEQ ID NO: 847268 - DNA, 22 bp, Artificial Sequence
  chemically synthesized
aagacagggtctcactttgttt

SEQ ID NO: 847269 - DNA, 22 bp, Artificial Sequence
  chemically synthesized
agaccagtctgggaaacaaagt

SEQ ID NO: 847270 - DNA, 22 bp, Artificial Sequence
  chemically synthesized
gagaccagtctgggaaacaaag

SEQ ID NO: 847271 - DNA, 22 bp, Artificial Sequence
  chemically synthesized
actttgtttcccagactggtct

SEQ ID NO: 847272 - DNA, 22 bp, Artificial Sequence
  chemically synthesized
gcccagaagtttgagaccagtc

SEQ ID NO: 847273 - DNA, 22 bp, Artificial Sequence
  chemically synthesized
tgtttcccagactggtctcaaa

SEQ ID NO: 847274 - DNA, 22 bp, Artificial Sequence
  chemically synthesized
gtttcccagactggtctcaaac

SEQ ID NO: 847275 - DNA, 22 bp, Artificial Sequence
  chemically synthesized
tttcccagactggtctcaaact

SEQ ID NO: 847276 - DNA, 22 bp, Artificial Sequence
  chemically synthesized
cccagactggtctcaaacttct

SEQ ID NO: 847277 - DNA, 22 bp, Artificial Sequence
  chemically synthesized
ccagactggtctcaaacttctg

SEQ ID NO: 847278 - DNA, 22 bp, Artificial Sequence
  chemically synthesized
gtctcaaacttctgggctaaca

SEQ ID NO: 847279 - DNA, 22 bp, Artificial Sequence
  chemically synthesized
aaacttctgggctaacacgatc

SEQ ID NO: 847280 - DNA, 22 bp, Artificial Sequence
  chemically synthesized
ggaggccaaggcaggaggatcg

SEQ ID NO: 847281 - DNA, 22 bp, Artificial Sequence
  chemically synthesized
ctgggctaacacgatcctcctg

SEQ ID NO: 847282 - DNA, 22 bp, Artificial Sequence
  chemically synthesized
gggaggccaaggcaggaggatc

SEQ ID NO: 847283 - DNA, 22 bp, Artificial Sequence
  chemically synthesized
tgggctaacacgatcctcctgc

SEQ ID NO: 847284 - DNA, 22 bp, Artificial Sequence
  chemically synthesized
tgggaggccaaggcaggaggat

SEQ ID NO: 847285 - DNA, 22 bp, Artificial Sequence
  chemically synthesized
ggctaacacgatcctcctgcct

SEQ ID NO: 847286 - DNA, 22 bp, Artificial Sequence
  chemically synthesized
acactttgggaggccaaggcag

SEQ ID NO: 847287 - DNA, 22 bp, Artificial Sequence
  chemically synthesized
acacgatcctcctgccttggcc

SEQ ID NO: 847288 - DNA, 22 bp, Artificial Sequence
  chemically synthesized
taatcctaacactttgggaggc

SEQ ID NO: 847289 - DNA, 22 bp, Artificial Sequence
  chemically synthesized
ctgccttggcctcccaaagtgt

SEQ ID NO: 847290 - DNA, 22 bp, Artificial Sequence
  chemically synthesized
ccttggcctcccaaagtgttag

SEQ ID NO: 847291 - DNA, 22 bp, Artificial Sequence
  chemically synthesized
acacctgtaatcctaacacttt

SEQ ID NO: 847292 - DNA, 22 bp, Artificial Sequence
  chemically synthesized
ggcctcccaaagtgttaggatt

SEQ ID NO: 847293 - DNA, 22 bp, Artificial Sequence
  chemically synthesized
gcctcccaaagtgttaggatta

SEQ ID NO: 847294 - DNA, 22 bp, Artificial Sequence
  chemically synthesized
ccaaagtgttaggattacaggt

SEQ ID NO: 847295 - DNA, 22 bp, Artificial Sequence
  chemically synthesized
tggggtgcagtggctcacacct

SEQ ID NO: 847296 - DNA, 22 bp, Artificial Sequence
  chemically synthesized
gtggggtgcagtggctcacacc

SEQ ID NO: 847297 - DNA, 22 bp, Artificial Sequence
  chemically synthesized
tgtggggtgcagtggctcacac

SEQ ID NO: 847298 - DNA, 22 bp, Artificial Sequence
  chemically synthesized
ggattacaggtgtgagccactg

SEQ ID NO: 847299 - DNA, 22 bp, Artificial Sequence
  chemically synthesized
caggtgtgagccactgcacccc

SEQ ID NO: 847300 - DNA, 22 bp, Artificial Sequence
  chemically synthesized
atatgagatggcaaactttgtg

SEQ ID NO: 847301 - DNA, 22 bp, Artificial Sequence
  chemically synthesized
cactcatatgagatggcaaact

SEQ ID NO: 847302 - DNA, 22 bp, Artificial Sequence
  chemically synthesized
caccccacaaagtttgccatct

SEQ ID NO: 847303 - DNA, 22 bp, Artificial Sequence
  chemically synthesized
agatgtcatgaactgcactcat

SEQ ID NO: 847304 - DNA, 22 bp, Artificial Sequence
  chemically synthesized
gagatgtcatgaactgcactca

SEQ ID NO: 847305 - DNA, 22 bp, Artificial Sequence
  chemically synthesized
gccatctcatatgagtgcagtt

SEQ ID NO: 847306 - DNA, 22 bp, Artificial Sequence
  chemically synthesized
tgagatgtcatgaactgcactc

SEQ ID NO: 847307 - DNA, 22 bp, Artificial Sequence
  chemically synthesized
ccatctcatatgagtgcagttc

SEQ ID NO: 847308 - DNA, 22 bp, Artificial Sequence
  chemically synthesized
ttttgagatgtcatgaactgca

SEQ ID NO: 847309 - DNA, 22 bp, Artificial Sequence
  chemically synthesized
atatgagtgcagttcatgacat

SEQ ID NO: 847310 - DNA, 22 bp, Artificial Sequence
  chemically synthesized
taattgttttgagatgtcatga

SEQ ID NO: 847311 - DNA, 22 bp, Artificial Sequence
  chemically synthesized
ttgtaattgttttgagatgtca

SEQ ID NO: 847312 - DNA, 22 bp, Artificial Sequence
  chemically synthesized
ctattgtaattgttttgagatg

SEQ ID NO: 847313 - DNA, 22 bp, Artificial Sequence
  chemically synthesized
atgttactattgtaattgtttt

SEQ ID NO: 847314 - DNA, 22 bp, Artificial Sequence
  chemically synthesized
gatgttactattgtaattgttt

SEQ ID NO: 847315 - DNA, 22 bp, Artificial Sequence
  chemically synthesized
atgacatctcaaaacaattaca

SEQ ID NO: 847316 - DNA, 22 bp, Artificial Sequence
  chemically synthesized
tgatgttactattgtaattgtt

SEQ ID NO: 847317 - DNA, 22 bp, Artificial Sequence
  chemically synthesized
aaaacaattacaatagtaacat

SEQ ID NO: 847318 - DNA, 22 bp, Artificial Sequence
  chemically synthesized
tgatcagtgacctttgatgtta

SEQ ID NO: 847319 - DNA, 22 bp, Artificial Sequence
  chemically synthesized
caatagtaacatcaaaggtcac

SEQ ID NO: 847320 - DNA, 22 bp, Artificial Sequence
  chemically synthesized
tgatctgtgatcagtgaccttt

SEQ ID NO: 847321 - DNA, 22 bp, Artificial Sequence
  chemically synthesized
ttatgatctgtgatcagtgacc

SEQ ID NO: 847322 - DNA, 22 bp, Artificial Sequence
  chemically synthesized
gttatgatctgtgatcagtgac

SEQ ID NO: 847323 - DNA, 22 bp, Artificial Sequence
  chemically synthesized
tatttgttatgatctgtgatca

SEQ ID NO: 847324 - DNA, 22 bp, Artificial Sequence
  chemically synthesized
ttatatttgttatgatctgtga

SEQ ID NO: 847325 - DNA, 22 bp, Artificial Sequence
  chemically synthesized
ttattatatttgttatgatctg

SEQ ID NO: 847326 - DNA, 22 bp, Artificial Sequence
  chemically synthesized
ttattattatatttgttatgat

SEQ ID NO: 847327 - DNA, 22 bp, Artificial Sequence
  chemically synthesized
ttattattattatatttgttat

SEQ ID NO: 847328 - DNA, 22 bp, Artificial Sequence
  chemically synthesized
atcacagatcataacaaatata

SEQ ID NO: 847329 - DNA, 22 bp, Artificial Sequence
  chemically synthesized
aaacattattattattattata

SEQ ID NO: 847330 - DNA, 22 bp, Artificial Sequence
  chemically synthesized
caaacattattattattattat

SEQ ID NO: 847331 - DNA, 22 bp, Artificial Sequence
  chemically synthesized
aatatttcaaacattattatta

SEQ ID NO: 847332 - DNA, 22 bp, Artificial Sequence
  chemically synthesized
ctcaatatttcaaacattatta

SEQ ID NO: 847333 - DNA, 22 bp, Artificial Sequence
  chemically synthesized
gctcaatatttcaaacattatt

SEQ ID NO: 847334 - DNA, 22 bp, Artificial Sequence
  chemically synthesized
gtaatttgctcaatatttcaaa

SEQ ID NO: 847335 - DNA, 22 bp, Artificial Sequence
  chemically synthesized
ggtaatttgctcaatatttcaa

SEQ ID NO: 847336 - DNA, 22 bp, Artificial Sequence
  chemically synthesized
tggtaatttgctcaatatttca

SEQ ID NO: 847337 - DNA, 22 bp, Artificial Sequence
  chemically synthesized
tgtcacgttttggtaatttgct

SEQ ID NO: 847338 - DNA, 22 bp, Artificial Sequence
  chemically synthesized
tgtgtcacgttttggtaatttg

SEQ ID NO: 847339 - DNA, 22 bp, Artificial Sequence
  chemically synthesized
gaaatattgagcaaattaccaa

SEQ ID NO: 847340 - DNA, 22 bp, Artificial Sequence
  chemically synthesized
aaatattgagcaaattaccaaa

SEQ ID NO: 847341 - DNA, 22 bp, Artificial Sequence
  chemically synthesized
cgtctctgtgtcacgttttggt

SEQ ID NO: 847342 - DNA, 22 bp, Artificial Sequence
  chemically synthesized
acgtctctgtgtcacgttttgg

SEQ ID NO: 847343 - DNA, 22 bp, Artificial Sequence
  chemically synthesized
tacgtctctgtgtcacgttttg

SEQ ID NO: 847344 - DNA, 22 bp, Artificial Sequence
  chemically synthesized
agcaaattaccaaaacgtgaca

SEQ ID NO: 847345 - DNA, 22 bp, Artificial Sequence
  chemically synthesized
gctttacgtctctgtgtcacgt

SEQ ID NO: 847346 - DNA, 22 bp, Artificial Sequence
  chemically synthesized
ccaaaacgtgacacagagacgt

SEQ ID NO: 847347 - DNA, 22 bp, Artificial Sequence
  chemically synthesized
caacagcatgtgctcgctttac

SEQ ID NO: 847348 - DNA, 22 bp, Artificial Sequence
  chemically synthesized
ccaacagcatgtgctcgcttta

SEQ ID NO: 847349 - DNA, 22 bp, Artificial Sequence
  chemically synthesized
tccaacagcatgtgctcgcttt

SEQ ID NO: 847350 - DNA, 22 bp, Artificial Sequence
  chemically synthesized
ttccaacagcatgtgctcgctt

SEQ ID NO: 847351 - DNA, 22 bp, Artificial Sequence
  chemically synthesized
agcaagtccgtcgggcacaatt

SEQ ID NO: 847352 - DNA, 22 bp, Artificial Sequence
  chemically synthesized
ttggaaaaattgtgcccgacgg

SEQ ID NO: 847353 - DNA, 22 bp, Artificial Sequence
  chemically synthesized
cattgagcaagtccgtcgggca

SEQ ID NO: 847354 - DNA, 22 bp, Artificial Sequence
  chemically synthesized
gaaaaattgtgcccgacggact

SEQ ID NO: 847355 - DNA, 22 bp, Artificial Sequence
  chemically synthesized
tggcaaggctgcattgagcaag

SEQ ID NO: 847356 - DNA, 22 bp, Artificial Sequence
  chemically synthesized
tgcccgacggacttgctcaatg

SEQ ID NO: 847357 - DNA, 22 bp, Artificial Sequence
  chemically synthesized
gtggcaaggctgcattgagcaa

SEQ ID NO: 847358 - DNA, 22 bp, Artificial Sequence
  chemically synthesized
aaagtttgtggcaaggctgcat

SEQ ID NO: 847359 - DNA, 22 bp, Artificial Sequence
  chemically synthesized
gctcaatgcagccttgccacaa

SEQ ID NO: 847360 - DNA, 22 bp, Artificial Sequence
  chemically synthesized
taaattgaaagtttgtggcaag

SEQ ID NO: 847361 - DNA, 22 bp, Artificial Sequence
  chemically synthesized
ctcaatgcagccttgccacaaa

SEQ ID NO: 847362 - DNA, 22 bp, Artificial Sequence
  chemically synthesized
gtaaattgaaagtttgtggcaa

SEQ ID NO: 847363 - DNA, 22 bp, Artificial Sequence
  chemically synthesized
tgtaaattgaaagtttgtggca

SEQ ID NO: 847364 - DNA, 22 bp, Artificial Sequence
  chemically synthesized
ttgtaaattgaaagtttgtggc

SEQ ID NO: 847365 - DNA, 22 bp, Artificial Sequence
  chemically synthesized
aatgcagccttgccacaaactt

SEQ ID NO: 847366 - DNA, 22 bp, Artificial Sequence
  chemically synthesized
tttgtaaattgaaagtttgtgg

SEQ ID NO: 847367 - DNA, 22 bp, Artificial Sequence
  chemically synthesized
actttttgtaaattgaaagttt

SEQ ID NO: 847368 - DNA, 22 bp, Artificial Sequence
  chemically synthesized
cactttttgtaaattgaaagtt

SEQ ID NO: 847369 - DNA, 22 bp, Artificial Sequence
  chemically synthesized
gccacaaactttcaatttacaa

SEQ ID NO: 847370 - DNA, 22 bp, Artificial Sequence
  chemically synthesized
ccacaaactttcaatttacaaa

SEQ ID NO: 847371 - DNA, 22 bp, Artificial Sequence
  chemically synthesized
cagatatttcactttttgtaaa

SEQ ID NO: 847372 - DNA, 22 bp, Artificial Sequence
  chemically synthesized
gcagatatttcactttttgtaa

SEQ ID NO: 847373 - DNA, 22 bp, Artificial Sequence
  chemically synthesized
tgcagatatttcactttttgta

SEQ ID NO: 847374 - DNA, 22 bp, Artificial Sequence
  chemically synthesized
cactttgcagatatttcacttt

SEQ ID NO: 847375 - DNA, 22 bp, Artificial Sequence
  chemically synthesized
tcaatttacaaaaagtgaaata

SEQ ID NO: 847376 - DNA, 22 bp, Artificial Sequence
  chemically synthesized
caatttacaaaaagtgaaatat

SEQ ID NO: 847377 - DNA, 22 bp, Artificial Sequence
  chemically synthesized
aatttacaaaaagtgaaatatc

SEQ ID NO: 847378 - DNA, 22 bp, Artificial Sequence
  chemically synthesized
ttgcactttgcagatatttcac

SEQ ID NO: 847379 - DNA, 22 bp, Artificial Sequence
  chemically synthesized
attgcactttgcagatatttca

SEQ ID NO: 847380 - DNA, 22 bp, Artificial Sequence
  chemically synthesized
tattgcactttgcagatatttc

SEQ ID NO: 847381 - DNA, 22 bp, Artificial Sequence
  chemically synthesized
acaaaaagtgaaatatctgcaa

SEQ ID NO: 847382 - DNA, 22 bp, Artificial Sequence
  chemically synthesized
caaaaagtgaaatatctgcaaa

SEQ ID NO: 847383 - DNA, 22 bp, Artificial Sequence
  chemically synthesized
actttattgcactttgcagata

SEQ ID NO: 847384 - DNA, 22 bp, Artificial Sequence
  chemically synthesized
cactttattgcactttgcagat

SEQ ID NO: 847385 - DNA, 22 bp, Artificial Sequence
  chemically synthesized
ggtttcactttattgcactttg

SEQ ID NO: 847386 - DNA, 22 bp, Artificial Sequence
  chemically synthesized
ttgggtttcactttattgcact

SEQ ID NO: 847387 - DNA, 22 bp, Artificial Sequence
  chemically synthesized
attgggtttcactttattgcac

SEQ ID NO: 847388 - DNA, 22 bp, Artificial Sequence
  chemically synthesized
tattgggtttcactttattgca

SEQ ID NO: 847389 - DNA, 22 bp, Artificial Sequence
  chemically synthesized
gttttattgggtttcactttat

SEQ ID NO: 847390 - DNA, 22 bp, Artificial Sequence
  chemically synthesized
caaagtgcaataaagtgaaacc

SEQ ID NO: 847391 - DNA, 22 bp, Artificial Sequence
  chemically synthesized
aggagtaataatccccaaatat

SEQ ID NO: 847392 - DNA, 22 bp, Artificial Sequence
  chemically synthesized
aaaaaattgaggagtaataatc

SEQ ID NO: 847393 - DNA, 22 bp, Artificial Sequence
  chemically synthesized
atactgaaaaaattgaggagta

SEQ ID NO: 847394 - DNA, 22 bp, Artificial Sequence
  chemically synthesized
ggggattattactcctcaattt

SEQ ID NO: 847395 - DNA, 22 bp, Artificial Sequence
  chemically synthesized
gggattattactcctcaatttt

SEQ ID NO: 847396 - DNA, 22 bp, Artificial Sequence
  chemically synthesized
ttactcctcaattttttcagta

SEQ ID NO: 847397 - DNA, 22 bp, Artificial Sequence
  chemically synthesized
ctcctcaattttttcagtatta

SEQ ID NO: 847398 - DNA, 22 bp, Artificial Sequence
  chemically synthesized
ctcaattttttcagtattaatt

SEQ ID NO: 847399 - DNA, 22 bp, Artificial Sequence
  chemically synthesized
aaggtagaacaagaaattaata

SEQ ID NO: 847400 - DNA, 22 bp, Artificial Sequence
  chemically synthesized
aattttttcagtattaatttct

SEQ ID NO: 847401 - DNA, 22 bp, Artificial Sequence
  chemically synthesized
ttcaaggtagaacaagaaatta

SEQ ID NO: 847402 - DNA, 22 bp, Artificial Sequence
  chemically synthesized
tttcagtattaatttcttgttc

SEQ ID NO: 847403 - DNA, 22 bp, Artificial Sequence
  chemically synthesized
ttcagtattaatttcttgttct

SEQ ID NO: 847404 - DNA, 22 bp, Artificial Sequence
  chemically synthesized
tcagtattaatttcttgttcta

SEQ ID NO: 847405 - DNA, 22 bp, Artificial Sequence
  chemically synthesized
cagtattaatttcttgttctac

SEQ ID NO: 847406 - DNA, 22 bp, Artificial Sequence
  chemically synthesized
agtattaatttcttgttctacc

SEQ ID NO: 847407 - DNA, 22 bp, Artificial Sequence
  chemically synthesized
caaaatgatgttattcaaggta

SEQ ID NO: 847408 - DNA, 22 bp, Artificial Sequence
  chemically synthesized
atttcttgttctaccttgaata

SEQ ID NO: 847409 - DNA, 22 bp, Artificial Sequence
  chemically synthesized
cttgttctaccttgaataacat

SEQ ID NO: 847410 - DNA, 22 bp, Artificial Sequence
  chemically synthesized
ttgttctaccttgaataacatc

SEQ ID NO: 847411 - DNA, 22 bp, Artificial Sequence
  chemically synthesized
gttctaccttgaataacatcat

SEQ ID NO: 847412 - DNA, 22 bp, Artificial Sequence
  chemically synthesized
ttctaccttgaataacatcatt

SEQ ID NO: 847413 - DNA, 22 bp, Artificial Sequence
  chemically synthesized
gaaggattccaaaatgatgtta

SEQ ID NO: 847414 - DNA, 22 bp, Artificial Sequence
  chemically synthesized
taccttgaataacatcattttg

SEQ ID NO: 847415 - DNA, 22 bp, Artificial Sequence
  chemically synthesized
ccttgaataacatcattttgga

SEQ ID NO: 847416 - DNA, 22 bp, Artificial Sequence
  chemically synthesized
gaataacatcattttggaatcc

SEQ ID NO: 847417 - DNA, 22 bp, Artificial Sequence
  chemically synthesized
aataacatcattttggaatcct

SEQ ID NO: 847418 - DNA, 22 bp, Artificial Sequence
  chemically synthesized
ataagtggaagttcgaaggatt

SEQ ID NO: 847419 - DNA, 22 bp, Artificial Sequence
  chemically synthesized
gataagtggaagttcgaaggat

SEQ ID NO: 847420 - DNA, 22 bp, Artificial Sequence
  chemically synthesized
gtcttgataagtggaagttcga

SEQ ID NO: 847421 - DNA, 22 bp, Artificial Sequence
  chemically synthesized
tggaatccttcgaacttccact

SEQ ID NO: 847422 - DNA, 22 bp, Artificial Sequence
  chemically synthesized
ggaatccttcgaacttccactt

SEQ ID NO: 847423 - DNA, 22 bp, Artificial Sequence
  chemically synthesized
gaatccttcgaacttccactta

SEQ ID NO: 847424 - DNA, 22 bp, Artificial Sequence
  chemically synthesized
cgaacttccacttatcaagacg

SEQ ID NO: 847425 - DNA, 22 bp, Artificial Sequence
  chemically synthesized
gaacttccacttatcaagacga

SEQ ID NO: 847426 - DNA, 22 bp, Artificial Sequence
  chemically synthesized
aatagggacaagagaattcgtc

SEQ ID NO: 847427 - DNA, 22 bp, Artificial Sequence
  chemically synthesized
ccacttatcaagacgaattctc

SEQ ID NO: 847428 - DNA, 22 bp, Artificial Sequence
  chemically synthesized
cacttatcaagacgaattctct

SEQ ID NO: 847429 - DNA, 22 bp, Artificial Sequence
  chemically synthesized
tgaatagggacaagagaattcg

SEQ ID NO: 847430 - DNA, 22 bp, Artificial Sequence
  chemically synthesized
ctctgaatagggacaagagaat

SEQ ID NO: 847431 - DNA, 22 bp, Artificial Sequence
  chemically synthesized
atcaagacgaattctcttgtcc

SEQ ID NO: 847432 - DNA, 22 bp, Artificial Sequence
  chemically synthesized
tcaagacgaattctcttgtccc

SEQ ID NO: 847433 - DNA, 22 bp, Artificial Sequence
  chemically synthesized
tatagattcctctgaataggga

SEQ ID NO: 847434 - DNA, 22 bp, Artificial Sequence
  chemically synthesized
ctgtatagattcctctgaatag

SEQ ID NO: 847435 - DNA, 22 bp, Artificial Sequence
  chemically synthesized
gctgtatagattcctctgaata

SEQ ID NO: 847436 - DNA, 22 bp, Artificial Sequence
  chemically synthesized
tcttgtccctattcagaggaat

SEQ ID NO: 847437 - DNA, 22 bp, Artificial Sequence
  chemically synthesized
ttgtccctattcagaggaatct

SEQ ID NO: 847438 - DNA, 22 bp, Artificial Sequence
  chemically synthesized
aatttgctgtatagattcctct

SEQ ID NO: 847439 - DNA, 22 bp, Artificial Sequence
  chemically synthesized
gtccctattcagaggaatctat

SEQ ID NO: 847440 - DNA, 22 bp, Artificial Sequence
  chemically synthesized
tccctattcagaggaatctata

SEQ ID NO: 847441 - DNA, 22 bp, Artificial Sequence
  chemically synthesized
tgattcaatttgctgtatagat

SEQ ID NO: 847442 - DNA, 22 bp, Artificial Sequence
  chemically synthesized
atgattcaatttgctgtataga

SEQ ID NO: 847443 - DNA, 22 bp, Artificial Sequence
  chemically synthesized
ttcagaggaatctatacagcaa

SEQ ID NO: 847444 - DNA, 22 bp, Artificial Sequence
  chemically synthesized
agaggaatctatacagcaaatt

SEQ ID NO: 847445 - DNA, 22 bp, Artificial Sequence
  chemically synthesized
gtacacttatgattcaatttgc

SEQ ID NO: 847446 - DNA, 22 bp, Artificial Sequence
  chemically synthesized
agtacacttatgattcaatttg

SEQ ID NO: 847447 - DNA, 22 bp, Artificial Sequence
  chemically synthesized
tagtacacttatgattcaattt

SEQ ID NO: 847448 - DNA, 22 bp, Artificial Sequence
  chemically synthesized
tacagcaaattgaatcataagt

SEQ ID NO: 847449 - DNA, 22 bp, Artificial Sequence
  chemically synthesized
gtattttagtacacttatgatt

SEQ ID NO: 847450 - DNA, 22 bp, Artificial Sequence
  chemically synthesized
ggtattttagtacacttatgat

SEQ ID NO: 847451 - DNA, 22 bp, Artificial Sequence
  chemically synthesized
tggtattttagtacacttatga

SEQ ID NO: 847452 - DNA, 22 bp, Artificial Sequence
  chemically synthesized
ctttggtattttagtacactta

SEQ ID NO: 847453 - DNA, 22 bp, Artificial Sequence
  chemically synthesized
tgctttggtattttagtacact

SEQ ID NO: 847454 - DNA, 22 bp, Artificial Sequence
  chemically synthesized
ctgctttggtattttagtacac

SEQ ID NO: 847455 - DNA, 22 bp, Artificial Sequence
  chemically synthesized
aatcataagtgtactaaaatac

SEQ ID NO: 847456 - DNA, 22 bp, Artificial Sequence
  chemically synthesized
tcttctgctttggtattttagt

SEQ ID NO: 847457 - DNA, 22 bp, Artificial Sequence
  chemically synthesized
atcttctgctttggtattttag

SEQ ID NO: 847458 - DNA, 22 bp, Artificial Sequence
  chemically synthesized
taatttatcttctgctttggta

SEQ ID NO: 847459 - DNA, 22 bp, Artificial Sequence
  chemically synthesized
gtaatttatcttctgctttggt

SEQ ID NO: 847460 - DNA, 22 bp, Artificial Sequence
  chemically synthesized
atgtcttgtaatttatcttctg

SEQ ID NO: 847461 - DNA, 22 bp, Artificial Sequence
  chemically synthesized
aaataccaaagcagaagataaa

SEQ ID NO: 847462 - DNA, 22 bp, Artificial Sequence
  chemically synthesized
ttcatgtcttgtaatttatctt

SEQ ID NO: 847463 - DNA, 22 bp, Artificial Sequence
  chemically synthesized
actattcatgtcttgtaattta

SEQ ID NO: 847464 - DNA, 22 bp, Artificial Sequence
  chemically synthesized
cactattcatgtcttgtaattt

SEQ ID NO: 847465 - DNA, 22 bp, Artificial Sequence
  chemically synthesized
catttcactattcatgtcttgt

SEQ ID NO: 847466 - DNA, 22 bp, Artificial Sequence
  chemically synthesized
aaatagttacatttcactattc

SEQ ID NO: 847467 - DNA, 22 bp, Artificial Sequence
  chemically synthesized
caagacatgaatagtgaaatgt

SEQ ID NO: 847468 - DNA, 22 bp, Artificial Sequence
  chemically synthesized
caaataatgccctcaaatagtt

SEQ ID NO: 847469 - DNA, 22 bp, Artificial Sequence
  chemically synthesized
ttacaaataatgccctcaaata

SEQ ID NO: 847470 - DNA, 22 bp, Artificial Sequence
  chemically synthesized
tttgagggcattatttgtaata

SEQ ID NO: 847471 - DNA, 22 bp, Artificial Sequence
  chemically synthesized
gagggcattatttgtaatagtt

SEQ ID NO: 847472 - DNA, 22 bp, Artificial Sequence
  chemically synthesized
agggcattatttgtaatagttt

SEQ ID NO: 847473 - DNA, 22 bp, Artificial Sequence
  chemically synthesized
ggaggagtatgtaccaggcaaa

SEQ ID NO: 847474 - DNA, 22 bp, Artificial Sequence
  chemically synthesized
tttgtaatagtttgcctggtac

SEQ ID NO: 847475 - DNA, 22 bp, Artificial Sequence
  chemically synthesized
gtaatagtttgcctggtacata

SEQ ID NO: 847476 - DNA, 22 bp, Artificial Sequence
  chemically synthesized
taatagtttgcctggtacatac

SEQ ID NO: 847477 - DNA, 22 bp, Artificial Sequence
  chemically synthesized
ggatgcaaaattaggaggagta

SEQ ID NO: 847478 - DNA, 22 bp, Artificial Sequence
  chemically synthesized
aggatgcaaaattaggaggagt

SEQ ID NO: 847479 - DNA, 22 bp, Artificial Sequence
  chemically synthesized
gcctggtacatactcctcctaa

SEQ ID NO: 847480 - DNA, 22 bp, Artificial Sequence
  chemically synthesized
taggatgcaaaattaggaggag

SEQ ID NO: 847481 - DNA, 22 bp, Artificial Sequence
  chemically synthesized
cctggtacatactcctcctaat

SEQ ID NO: 847482 - DNA, 22 bp, Artificial Sequence
  chemically synthesized
gtacatactcctcctaattttg

SEQ ID NO: 847483 - DNA, 22 bp, Artificial Sequence
  chemically synthesized
gatagtatctttaggatgcaaa

SEQ ID NO: 847484 - DNA, 22 bp, Artificial Sequence
  chemically synthesized
ggatagtatctttaggatgcaa

SEQ ID NO: 847485 - DNA, 22 bp, Artificial Sequence
  chemically synthesized
tggatagtatctttaggatgca

SEQ ID NO: 847486 - DNA, 22 bp, Artificial Sequence
  chemically synthesized
ctcctaattttgcatcctaaag

SEQ ID NO: 847487 - DNA, 22 bp, Artificial Sequence
  chemically synthesized
ctaattttgcatcctaaagata

SEQ ID NO: 847488 - DNA, 22 bp, Artificial Sequence
  chemically synthesized
cagtctttggatagtatcttta

SEQ ID NO: 847489 - DNA, 22 bp, Artificial Sequence
  chemically synthesized
attttgcatcctaaagatacta

SEQ ID NO: 847490 - DNA, 22 bp, Artificial Sequence
  chemically synthesized
tacagtctttggatagtatctt

SEQ ID NO: 847491 - DNA, 22 bp, Artificial Sequence
  chemically synthesized
ctacagtctttggatagtatct

SEQ ID NO: 847492 - DNA, 22 bp, Artificial Sequence
  chemically synthesized
tgcatcctaaagatactatcca

SEQ ID NO: 847493 - DNA, 22 bp, Artificial Sequence
  chemically synthesized
gcatcctaaagatactatccaa

SEQ ID NO: 847494 - DNA, 22 bp, Artificial Sequence
  chemically synthesized
catcctaaagatactatccaaa

SEQ ID NO: 847495 - DNA, 22 bp, Artificial Sequence
  chemically synthesized
gaatttctacagtctttggata

SEQ ID NO: 847496 - DNA, 22 bp, Artificial Sequence
  chemically synthesized
aagatactatccaaagactgta

SEQ ID NO: 847497 - DNA, 22 bp, Artificial Sequence
  chemically synthesized
tatctggaatttctacagtctt

SEQ ID NO: 847498 - DNA, 22 bp, Artificial Sequence
  chemically synthesized
gtatctggaatttctacagtct

SEQ ID NO: 847499 - DNA, 22 bp, Artificial Sequence
  chemically synthesized
ttgtatctggaatttctacagt

SEQ ID NO: 847500 - DNA, 22 bp, Artificial Sequence
  chemically synthesized
tccaaagactgtagaaattcca

SEQ ID NO: 847501 - DNA, 22 bp, Artificial Sequence
  chemically synthesized
gcctcttgtatctggaatttct

SEQ ID NO: 847502 - DNA, 22 bp, Artificial Sequence
  chemically synthesized
tagcctcttgtatctggaattt

SEQ ID NO: 847503 - DNA, 22 bp, Artificial Sequence
  chemically synthesized
tcaactctagcctcttgtatct

SEQ ID NO: 847504 - DNA, 22 bp, Artificial Sequence
  chemically synthesized
tagaaattccagatacaagagg

SEQ ID NO: 847505 - DNA, 22 bp, Artificial Sequence
  chemically synthesized
cctgtcaactctagcctcttgt

SEQ ID NO: 847506 - DNA, 22 bp, Artificial Sequence
  chemically synthesized
attacctgtcaactctagcctc

SEQ ID NO: 847507 - DNA, 22 bp, Artificial Sequence
  chemically synthesized
aattacctgtcaactctagcct

SEQ ID NO: 847508 - DNA, 22 bp, Artificial Sequence
  chemically synthesized
cagatacaagaggctagagttg

SEQ ID NO: 847509 - DNA, 22 bp, Artificial Sequence
  chemically synthesized
accaaagcttaattacctgtca

SEQ ID NO: 847510 - DNA, 22 bp, Artificial Sequence
  chemically synthesized
attgaccaaagcttaattacct

SEQ ID NO: 847511 - DNA, 22 bp, Artificial Sequence
  chemically synthesized
gattgaccaaagcttaattacc

SEQ ID NO: 847512 - DNA, 22 bp, Artificial Sequence
  chemically synthesized
tgattgaccaaagcttaattac

SEQ ID NO: 847513 - DNA, 22 bp, Artificial Sequence
  chemically synthesized
gagttgacaggtaattaagctt

SEQ ID NO: 847514 - DNA, 22 bp, Artificial Sequence
  chemically synthesized
tttgattgaccaaagcttaatt

SEQ ID NO: 847515 - DNA, 22 bp, Artificial Sequence
  chemically synthesized
gctctttgattgaccaaagctt

SEQ ID NO: 847516 - DNA, 22 bp, Artificial Sequence
  chemically synthesized
acaggtaattaagctttggtca

SEQ ID NO: 847517 - DNA, 22 bp, Artificial Sequence
  chemically synthesized
tagctctttgattgaccaaagc

SEQ ID NO: 847518 - DNA, 22 bp, Artificial Sequence
  chemically synthesized
ctagctctttgattgaccaaag

SEQ ID NO: 847519 - DNA, 22 bp, Artificial Sequence
  chemically synthesized
tctagctctttgattgaccaaa

SEQ ID NO: 847520 - DNA, 22 bp, Artificial Sequence
  chemically synthesized
agctttggtcaatcaaagagct

SEQ ID NO: 847521 - DNA, 22 bp, Artificial Sequence
  chemically synthesized
aataaatattttctagctcttt

SEQ ID NO: 847522 - DNA, 22 bp, Artificial Sequence
  chemically synthesized
caataaatattttctagctctt

SEQ ID NO: 847523 - DNA, 22 bp, Artificial Sequence
  chemically synthesized
tggtcaatcaaagagctagaaa

SEQ ID NO: 847524 - DNA, 22 bp, Artificial Sequence
  chemically synthesized
ggtcaatcaaagagctagaaaa

SEQ ID NO: 847525 - DNA, 22 bp, Artificial Sequence
  chemically synthesized
tttcaataaatattttctagct

SEQ ID NO: 847526 - DNA, 22 bp, Artificial Sequence
  chemically synthesized
gtcaatcaaagagctagaaaat

SEQ ID NO: 847527 - DNA, 22 bp, Artificial Sequence
  chemically synthesized
tgcatacaattatttcaataaa

SEQ ID NO: 847528 - DNA, 22 bp, Artificial Sequence
  chemically synthesized
gaaaatatttattgaaataatt

SEQ ID NO: 847529 - DNA, 22 bp, Artificial Sequence
  chemically synthesized
tgatgtgttatgcatacaatta

SEQ ID NO: 847530 - DNA, 22 bp, Artificial Sequence
  chemically synthesized
ctgtgatgtgttatgcatacaa

SEQ ID NO: 847531 - DNA, 22 bp, Artificial Sequence
  chemically synthesized
attgaaataattgtatgcataa

SEQ ID NO: 847532 - DNA, 22 bp, Artificial Sequence
  chemically synthesized
ttgaaataattgtatgcataac

SEQ ID NO: 847533 - DNA, 22 bp, Artificial Sequence
  chemically synthesized
cctactgtgatgtgttatgcat

SEQ ID NO: 847534 - DNA, 22 bp, Artificial Sequence
  chemically synthesized
aaataattgtatgcataacaca

SEQ ID NO: 847535 - DNA, 22 bp, Artificial Sequence
  chemically synthesized
tatgcataacacatcacagtag

SEQ ID NO: 847536 - DNA, 22 bp, Artificial Sequence
  chemically synthesized
atgtcatccatgaggcacattc

SEQ ID NO: 847537 - DNA, 22 bp, Artificial Sequence
  chemically synthesized
catgtcatccatgaggcacatt

SEQ ID NO: 847538 - DNA, 22 bp, Artificial Sequence
  chemically synthesized
tcatgtcatccatgaggcacat

SEQ ID NO: 847539 - DNA, 22 bp, Artificial Sequence
  chemically synthesized
tttcatgtcatccatgaggcac

SEQ ID NO: 847540 - DNA, 22 bp, Artificial Sequence
  chemically synthesized
gagagtctctttcatgtcatcc

SEQ ID NO: 847541 - DNA, 22 bp, Artificial Sequence
  chemically synthesized
actagagagtctctttcatgtc

SEQ ID NO: 847542 - DNA, 22 bp, Artificial Sequence
  chemically synthesized
cactagagagtctctttcatgt

SEQ ID NO: 847543 - DNA, 22 bp, Artificial Sequence
  chemically synthesized
tttcactagagagtctctttca

SEQ ID NO: 847544 - DNA, 22 bp, Artificial Sequence
  chemically synthesized
atggatgacatgaaagagactc

SEQ ID NO: 847545 - DNA, 22 bp, Artificial Sequence
  chemically synthesized
aattatttcactagagagtctc

SEQ ID NO: 847546 - DNA, 22 bp, Artificial Sequence
  chemically synthesized
atcacaagttcaattatttcac

SEQ ID NO: 847547 - DNA, 22 bp, Artificial Sequence
  chemically synthesized
aaagttcatcacaagttcaatt

SEQ ID NO: 847548 - DNA, 22 bp, Artificial Sequence
  chemically synthesized
tctagtgaaataattgaacttg

SEQ ID NO: 847549 - DNA, 22 bp, Artificial Sequence
  chemically synthesized
tagtgaaataattgaacttgtg

SEQ ID NO: 847550 - DNA, 22 bp, Artificial Sequence
  chemically synthesized
gtgaaataattgaacttgtgat

SEQ ID NO: 847551 - DNA, 22 bp, Artificial Sequence
  chemically synthesized
cattgaaagttcatcacaagtt

SEQ ID NO: 847552 - DNA, 22 bp, Artificial Sequence
  chemically synthesized
cccaactgcattgaaagttcat

SEQ ID NO: 847553 - DNA, 22 bp, Artificial Sequence
  chemically synthesized
aacttgtgatgaactttcaatg

SEQ ID NO: 847554 - DNA, 22 bp, Artificial Sequence
  chemically synthesized
gtgatgaactttcaatgcagtt

SEQ ID NO: 847555 - DNA, 22 bp, Artificial Sequence
  chemically synthesized
tgatgaactttcaatgcagttg

SEQ ID NO: 847556 - DNA, 22 bp, Artificial Sequence
  chemically synthesized
aaggtcacctccccaactgcat

SEQ ID NO: 847557 - DNA, 22 bp, Artificial Sequence
  chemically synthesized
gcctgaaggtcacctccccaac

SEQ ID NO: 847558 - DNA, 22 bp, Artificial Sequence
  chemically synthesized
tcaatgcagttggggaggtgac

SEQ ID NO: 847559 - DNA, 22 bp, Artificial Sequence
  chemically synthesized
caatgcagttggggaggtgacc

SEQ ID NO: 847560 - DNA, 22 bp, Artificial Sequence
  chemically synthesized
aatgcagttggggaggtgacct

SEQ ID NO: 847561 - DNA, 22 bp, Artificial Sequence
  chemically synthesized
gggaggtgaccttcaggccagc

SEQ ID NO: 847562 - DNA, 22 bp, Artificial Sequence
  chemically synthesized
cgtgtgcgagcatgcatgggct

SEQ ID NO: 847563 - DNA, 22 bp, Artificial Sequence
  chemically synthesized
caggccagcccatgcatgctcg

SEQ ID NO: 847564 - DNA, 22 bp, Artificial Sequence
  chemically synthesized
aggccagcccatgcatgctcgc

SEQ ID NO: 847565 - DNA, 22 bp, Artificial Sequence
  chemically synthesized
ggtaactgcgtgtgcgagcatg

SEQ ID NO: 847566 - DNA, 22 bp, Artificial Sequence
  chemically synthesized
ttgggtaactgcgtgtgcgagc

SEQ ID NO: 847567 - DNA, 22 bp, Artificial Sequence
  chemically synthesized
ttattgggtaactgcgtgtgcg

SEQ ID NO: 847568 - DNA, 22 bp, Artificial Sequence
  chemically synthesized
tattattgggtaactgcgtgtg

SEQ ID NO: 847569 - DNA, 22 bp, Artificial Sequence
  chemically synthesized
ctattattgggtaactgcgtgt

SEQ ID NO: 847570 - DNA, 22 bp, Artificial Sequence
  chemically synthesized
tcttctattattgggtaactgc

SEQ ID NO: 847571 - DNA, 22 bp, Artificial Sequence
  chemically synthesized
gcacacgcagttacccaataat

SEQ ID NO: 847572 - DNA, 22 bp, Artificial Sequence
  chemically synthesized
catattgtcttctattattggg

SEQ ID NO: 847573 - DNA, 22 bp, Artificial Sequence
  chemically synthesized
acatattgtcttctattattgg

SEQ ID NO: 847574 - DNA, 22 bp, Artificial Sequence
  chemically synthesized
tcatttacatattgtcttctat

SEQ ID NO: 847575 - DNA, 22 bp, Artificial Sequence
  chemically synthesized
gtcatttacatattgtcttcta

SEQ ID NO: 847576 - DNA, 22 bp, Artificial Sequence
  chemically synthesized
cccaataatagaagacaatatg

SEQ ID NO: 847577 - DNA, 22 bp, Artificial Sequence
  chemically synthesized
cgtttgtcatttacatattgtc

SEQ ID NO: 847578 - DNA, 22 bp, Artificial Sequence
  chemically synthesized
ttacgtttgtcatttacatatt

SEQ ID NO: 847579 - DNA, 22 bp, Artificial Sequence
  chemically synthesized
tagactattacgtttgtcattt

SEQ ID NO: 847580 - DNA, 22 bp, Artificial Sequence
  chemically synthesized
gggtaggatatgtggtctgtag

SEQ ID NO: 847581 - DNA, 22 bp, Artificial Sequence
  chemically synthesized
agaatcccattagggtaggata

SEQ ID NO: 847582 - DNA, 22 bp, Artificial Sequence
  chemically synthesized
tcagaatcccattagggtagga

SEQ ID NO: 847583 - DNA, 22 bp, Artificial Sequence
  chemically synthesized
cagaccacatatcctaccctaa

SEQ ID NO: 847584 - DNA, 22 bp, Artificial Sequence
  chemically synthesized
ccctaatgggattctgagagat

SEQ ID NO: 847585 - DNA, 22 bp, Artificial Sequence
  chemically synthesized
atgggattctgagagatgggat

SEQ ID NO: 847586 - DNA, 22 bp, Artificial Sequence
  chemically synthesized
gtcccatataaaatcccatctc

SEQ ID NO: 847587 - DNA, 22 bp, Artificial Sequence
  chemically synthesized
aacctggtcccatataaaatcc

SEQ ID NO: 847588 - DNA, 22 bp, Artificial Sequence
  chemically synthesized
tgagagatgggattttatatgg

SEQ ID NO: 847589 - DNA, 22 bp, Artificial Sequence
  chemically synthesized
cctgaacctggtcccatataaa

SEQ ID NO: 847590 - DNA, 22 bp, Artificial Sequence
  chemically synthesized
agagatgggattttatatggga

SEQ ID NO: 847591 - DNA, 22 bp, Artificial Sequence
  chemically synthesized
ccctgaacctggtcccatataa

SEQ ID NO: 847592 - DNA, 22 bp, Artificial Sequence
  chemically synthesized
tggcaccttccctgaacctggt

SEQ ID NO: 847593 - DNA, 22 bp, Artificial Sequence
  chemically synthesized
tatggcaccttccctgaacctg

SEQ ID NO: 847594 - DNA, 22 bp, Artificial Sequence
  chemically synthesized
tatatgggaccaggttcaggga

SEQ ID NO: 847595 - DNA, 22 bp, Artificial Sequence
  chemically synthesized
atatgggaccaggttcagggaa

SEQ ID NO: 847596 - DNA, 22 bp, Artificial Sequence
  chemically synthesized
ctctatggcaccttccctgaac

SEQ ID NO: 847597 - DNA, 22 bp, Artificial Sequence
  chemically synthesized
tatgggaccaggttcagggaag

SEQ ID NO: 847598 - DNA, 22 bp, Artificial Sequence
  chemically synthesized
ttcctctatggcaccttccctg

SEQ ID NO: 847599 - DNA, 22 bp, Artificial Sequence
  chemically synthesized
ctgttcctctatggcaccttcc

SEQ ID NO: 847600 - DNA, 22 bp, Artificial Sequence
  chemically synthesized
atgttgctgttcctctatggca

SEQ ID NO: 847601 - DNA, 22 bp, Artificial Sequence
  chemically synthesized
agggaaggtgccatagaggaac

SEQ ID NO: 847602 - DNA, 22 bp, Artificial Sequence
  chemically synthesized
cagttcatgttgctgttcctct

SEQ ID NO: 847603 - DNA, 22 bp, Artificial Sequence
  chemically synthesized
agttacagttcatgttgctgtt

SEQ ID NO: 847604 - DNA, 22 bp, Artificial Sequence
  chemically synthesized
taagttacagttcatgttgctg

SEQ ID NO: 847605 - DNA, 22 bp, Artificial Sequence
  chemically synthesized
atcctctaagttacagttcatg

SEQ ID NO: 847606 - DNA, 22 bp, Artificial Sequence
  chemically synthesized
agttcatcctctaagttacagt

SEQ ID NO: 847607 - DNA, 22 bp, Artificial Sequence
  chemically synthesized
attgagttcatcctctaagtta

SEQ ID NO: 847608 - DNA, 22 bp, Artificial Sequence
  chemically synthesized
ttaattgagttcatcctctaag

SEQ ID NO: 847609 - DNA, 22 bp, Artificial Sequence
  chemically synthesized
ggtcattattaattgagttcat

SEQ ID NO: 847610 - DNA, 22 bp, Artificial Sequence
  chemically synthesized
taacttagaggatgaactcaat

SEQ ID NO: 847611 - DNA, 22 bp, Artificial Sequence
  chemically synthesized
ccattaggtcattattaattga

SEQ ID NO: 847612 - DNA, 22 bp, Artificial Sequence
  chemically synthesized
agaggatgaactcaattaataa

SEQ ID NO: 847613 - DNA, 22 bp, Artificial Sequence
  chemically synthesized
gaggatgaactcaattaataat

SEQ ID NO: 847614 - DNA, 22 bp, Artificial Sequence
  chemically synthesized
tcccattaggtcattattaatt

SEQ ID NO: 847615 - DNA, 22 bp, Artificial Sequence
  chemically synthesized
ctcccattaggtcattattaat

SEQ ID NO: 847616 - DNA, 22 bp, Artificial Sequence
  chemically synthesized
cttctcccattaggtcattatt

SEQ ID NO: 847617 - DNA, 22 bp, Artificial Sequence
  chemically synthesized
aaattccttctcccattaggtc

SEQ ID NO: 847618 - DNA, 22 bp, Artificial Sequence
  chemically synthesized
aattaataatgacctaatggga

SEQ ID NO: 847619 - DNA, 22 bp, Artificial Sequence
  chemically synthesized
tcctgaaattccttctcccatt

SEQ ID NO: 847620 - DNA, 22 bp, Artificial Sequence
  chemically synthesized
gtcctgaaattccttctcccat

SEQ ID NO: 847621 - DNA, 22 bp, Artificial Sequence
  chemically synthesized
ataatgacctaatgggagaagg

SEQ ID NO: 847622 - DNA, 22 bp, Artificial Sequence
  chemically synthesized
cttgtcctgaaattccttctcc

SEQ ID NO: 847623 - DNA, 22 bp, Artificial Sequence
  chemically synthesized
ctccttgtcctgaaattccttc

SEQ ID NO: 847624 - DNA, 22 bp, Artificial Sequence
  chemically synthesized
atgggagaaggaatttcaggac

SEQ ID NO: 847625 - DNA, 22 bp, Artificial Sequence
  chemically synthesized
aagctactccttgtcctgaaat

SEQ ID NO: 847626 - DNA, 22 bp, Artificial Sequence
  chemically synthesized
aaagctactccttgtcctgaaa

SEQ ID NO: 847627 - DNA, 22 bp, Artificial Sequence
  chemically synthesized
taaagctactccttgtcctgaa

SEQ ID NO: 847628 - DNA, 22 bp, Artificial Sequence
  chemically synthesized
gttttaaagctactccttgtcc

SEQ ID NO: 847629 - DNA, 22 bp, Artificial Sequence
  chemically synthesized
agttttaaagctactccttgtc

SEQ ID NO: 847630 - DNA, 22 bp, Artificial Sequence
  chemically synthesized
tagttttaaagctactccttgt

SEQ ID NO: 847631 - DNA, 22 bp, Artificial Sequence
  chemically synthesized
cactttagttttaaagctactc

SEQ ID NO: 847632 - DNA, 22 bp, Artificial Sequence
  chemically synthesized
tacactttagttttaaagctac

SEQ ID NO: 847633 - DNA, 22 bp, Artificial Sequence
  chemically synthesized
caggacaaggagtagctttaaa

SEQ ID NO: 847634 - DNA, 22 bp, Artificial Sequence
  chemically synthesized
ctacactttagttttaaagcta

SEQ ID NO: 847635 - DNA, 22 bp, Artificial Sequence
  chemically synthesized
aggacaaggagtagctttaaaa

SEQ ID NO: 847636 - DNA, 22 bp, Artificial Sequence
  chemically synthesized
acttctacactttagttttaaa

SEQ ID NO: 847637 - DNA, 22 bp, Artificial Sequence
  chemically synthesized
tgacttctacactttagtttta

SEQ ID NO: 847638 - DNA, 22 bp, Artificial Sequence
  chemically synthesized
tattctgacttctacactttag

SEQ ID NO: 847639 - DNA, 22 bp, Artificial Sequence
  chemically synthesized
ctgtattctgacttctacactt

SEQ ID NO: 847640 - DNA, 22 bp, Artificial Sequence
  chemically synthesized
tgctgtattctgacttctacac

SEQ ID NO: 847641 - DNA, 22 bp, Artificial Sequence
  chemically synthesized
taaaactaaagtgtagaagtca

SEQ ID NO: 847642 - DNA, 22 bp, Artificial Sequence
  chemically synthesized
aaaactaaagtgtagaagtcag

SEQ ID NO: 847643 - DNA, 22 bp, Artificial Sequence
  chemically synthesized
aaactaaagtgtagaagtcaga

SEQ ID NO: 847644 - DNA, 22 bp, Artificial Sequence
  chemically synthesized
aaccactctgctgtattctgac

SEQ ID NO: 847645 - DNA, 22 bp, Artificial Sequence
  chemically synthesized
aagtgtagaagtcagaatacag

SEQ ID NO: 847646 - DNA, 22 bp, Artificial Sequence
  chemically synthesized
tcaaccactctgctgtattctg

SEQ ID NO: 847647 - DNA, 22 bp, Artificial Sequence
  chemically synthesized
ctcaaccactctgctgtattct

SEQ ID NO: 847648 - DNA, 22 bp, Artificial Sequence
  chemically synthesized
tctcaaccactctgctgtattc

SEQ ID NO: 847649 - DNA, 22 bp, Artificial Sequence
  chemically synthesized
tttctcaaccactctgctgtat

SEQ ID NO: 847650 - DNA, 22 bp, Artificial Sequence
  chemically synthesized
ccactctttctcaaccactctg

SEQ ID NO: 847651 - DNA, 22 bp, Artificial Sequence
  chemically synthesized
cccactctttctcaaccactct

SEQ ID NO: 847652 - DNA, 22 bp, Artificial Sequence
  chemically synthesized
cccttcccactctttctcaacc

SEQ ID NO: 847653 - DNA, 22 bp, Artificial Sequence
  chemically synthesized
cacagctgcccttcccactctt

SEQ ID NO: 847654 - DNA, 22 bp, Artificial Sequence
  chemically synthesized
attacacagctgcccttcccac

SEQ ID NO: 847655 - DNA, 22 bp, Artificial Sequence
  chemically synthesized
actaattacacagctgcccttc

SEQ ID NO: 847656 - DNA, 22 bp, Artificial Sequence
  chemically synthesized
agaaagagtgggaagggcagct

SEQ ID NO: 847657 - DNA, 22 bp, Artificial Sequence
  chemically synthesized
ctaactaattacacagctgccc

SEQ ID NO: 847658 - DNA, 22 bp, Artificial Sequence
  chemically synthesized
tgctaactaattacacagctgc

SEQ ID NO: 847659 - DNA, 22 bp, Artificial Sequence
  chemically synthesized
tgtaattagttagcagaattac

SEQ ID NO: 847660 - DNA, 22 bp, Artificial Sequence
  chemically synthesized
atcacagccatcgtaattctgc

SEQ ID NO: 847661 - DNA, 22 bp, Artificial Sequence
  chemically synthesized
gatcacagccatcgtaattctg

SEQ ID NO: 847662 - DNA, 22 bp, Artificial Sequence
  chemically synthesized
aacttgatcacagccatcgtaa

SEQ ID NO: 847663 - DNA, 22 bp, Artificial Sequence
  chemically synthesized
gttagcagaattacgatggctg

SEQ ID NO: 847664 - DNA, 22 bp, Artificial Sequence
  chemically synthesized
tcaacttgatcacagccatcgt

SEQ ID NO: 847665 - DNA, 22 bp, Artificial Sequence
  chemically synthesized
ctcaacttgatcacagccatcg

SEQ ID NO: 847666 - DNA, 22 bp, Artificial Sequence
  chemically synthesized
gcagaattacgatggctgtgat

SEQ ID NO: 847667 - DNA, 22 bp, Artificial Sequence
  chemically synthesized
ccttctcaacttgatcacagcc

SEQ ID NO: 847668 - DNA, 22 bp, Artificial Sequence
  chemically synthesized
cccttctcaacttgatcacagc

SEQ ID NO: 847669 - DNA, 22 bp, Artificial Sequence
  chemically synthesized
cgatggctgtgatcaagttgag

SEQ ID NO: 847670 - DNA, 22 bp, Artificial Sequence
  chemically synthesized
gccccagcttcccttctcaact

SEQ ID NO: 847671 - DNA, 22 bp, Artificial Sequence
  chemically synthesized
tggccccagcttcccttctcaa

SEQ ID NO: 847672 - DNA, 22 bp, Artificial Sequence
  chemically synthesized
tgatcaagttgagaagggaagc

SEQ ID NO: 847673 - DNA, 22 bp, Artificial Sequence
  chemically synthesized
acattctggccccagcttccct

SEQ ID NO: 847674 - DNA, 22 bp, Artificial Sequence
  chemically synthesized
agccctcacattctggccccag

SEQ ID NO: 847675 - DNA, 22 bp, Artificial Sequence
  chemically synthesized
agaagggaagctggggccagaa

SEQ ID NO: 847676 - DNA, 22 bp, Artificial Sequence
  chemically synthesized
tgagccctcacattctggcccc

SEQ ID NO: 847677 - DNA, 22 bp, Artificial Sequence
  chemically synthesized
gtgttctgagccctcacattct

SEQ ID NO: 847678 - DNA, 22 bp, Artificial Sequence
  chemically synthesized
gggccagaatgtgagggctcag

SEQ ID NO: 847679 - DNA, 22 bp, Artificial Sequence
  chemically synthesized
ggcatctagtgttctgagccct

SEQ ID NO: 847680 - DNA, 22 bp, Artificial Sequence
  chemically synthesized
gggcatctagtgttctgagccc

SEQ ID NO: 847681 - DNA, 22 bp, Artificial Sequence
  chemically synthesized
tttgggcatctagtgttctgag

SEQ ID NO: 847682 - DNA, 22 bp, Artificial Sequence
  chemically synthesized
atttgggcatctagtgttctga

SEQ ID NO: 847683 - DNA, 22 bp, Artificial Sequence
  chemically synthesized
agaacactagatgcccaaataa

SEQ ID NO: 847684 - DNA, 22 bp, Artificial Sequence
  chemically synthesized
aacatgatgtccttatttgggc

SEQ ID NO: 847685 - DNA, 22 bp, Artificial Sequence
  chemically synthesized
caacatgatgtccttatttggg

SEQ ID NO: 847686 - DNA, 22 bp, Artificial Sequence
  chemically synthesized
gatgcccaaataaggacatcat

SEQ ID NO: 847687 - DNA, 22 bp, Artificial Sequence
  chemically synthesized
ccatggccttcaacatgatgtc

SEQ ID NO: 847688 - DNA, 22 bp, Artificial Sequence
  chemically synthesized
cccatggccttcaacatgatgt

SEQ ID NO: 847689 - DNA, 22 bp, Artificial Sequence
  chemically synthesized
atgatttcccatggccttcaac

SEQ ID NO: 847690 - DNA, 22 bp, Artificial Sequence
  chemically synthesized
tgatgatttcccatggccttca

SEQ ID NO: 847691 - DNA, 22 bp, Artificial Sequence
  chemically synthesized
aaacctctgatgatttcccatg

SEQ ID NO: 847692 - DNA, 22 bp, Artificial Sequence
  chemically synthesized
tcaaacctctgatgatttccca

SEQ ID NO: 847693 - DNA, 22 bp, Artificial Sequence
  chemically synthesized
ctctcaaacctctgatgatttc

SEQ ID NO: 847694 - DNA, 22 bp, Artificial Sequence
  chemically synthesized
aaggccatgggaaatcatcaga

SEQ ID NO: 847695 - DNA, 22 bp, Artificial Sequence
  chemically synthesized
tgctctcaaacctctgatgatt

SEQ ID NO: 847696 - DNA, 22 bp, Artificial Sequence
  chemically synthesized
ctgctctcaaacctctgatgat

SEQ ID NO: 847697 - DNA, 22 bp, Artificial Sequence
  chemically synthesized
ttctgctctcaaacctctgatg

SEQ ID NO: 847698 - DNA, 22 bp, Artificial Sequence
  chemically synthesized
tggcattcttctgctctcaaac

SEQ ID NO: 847699 - DNA, 22 bp, Artificial Sequence
  chemically synthesized
ttgtggcattcttctgctctca

SEQ ID NO: 847700 - DNA, 22 bp, Artificial Sequence
  chemically synthesized
attgtggcattcttctgctctc

SEQ ID NO: 847701 - DNA, 22 bp, Artificial Sequence
  chemically synthesized
tattgtggcattcttctgctct

SEQ ID NO: 847702 - DNA, 22 bp, Artificial Sequence
  chemically synthesized
ttattgtggcattcttctgctc

SEQ ID NO: 847703 - DNA, 22 bp, Artificial Sequence
  chemically synthesized
gagagcagaagaatgccacaat

SEQ ID NO: 847704 - DNA, 22 bp, Artificial Sequence
  chemically synthesized
agagcagaagaatgccacaata

SEQ ID NO: 847705 - DNA, 22 bp, Artificial Sequence
  chemically synthesized
acatgccacttttattgtggca

SEQ ID NO: 847706 - DNA, 22 bp, Artificial Sequence
  chemically synthesized
taacatgccacttttattgtgg

SEQ ID NO: 847707 - DNA, 22 bp, Artificial Sequence
  chemically synthesized
ctaacatgccacttttattgtg

SEQ ID NO: 847708 - DNA, 22 bp, Artificial Sequence
  chemically synthesized
atatttctaacatgccactttt

SEQ ID NO: 847709 - DNA, 22 bp, Artificial Sequence
  chemically synthesized
tacgaggttaatatttctaaca

SEQ ID NO: 847710 - DNA, 22 bp, Artificial Sequence
  chemically synthesized
gatgcagttgtacgaggttaat

SEQ ID NO: 847711 - DNA, 22 bp, Artificial Sequence
  chemically synthesized
gaaatattaacctcgtacaact

SEQ ID NO: 847712 - DNA, 22 bp, Artificial Sequence
  chemically synthesized
gaagggacattggatgcagttg

SEQ ID NO: 847713 - DNA, 22 bp, Artificial Sequence
  chemically synthesized
ggaagggacattggatgcagtt

SEQ ID NO: 847714 - DNA, 22 bp, Artificial Sequence
  chemically synthesized
ttggaagggacattggatgcag

SEQ ID NO: 847715 - DNA, 22 bp, Artificial Sequence
  chemically synthesized
acctcgtacaactgcatccaat

SEQ ID NO: 847716 - DNA, 22 bp, Artificial Sequence
  chemically synthesized
cttggaagggacattggatgca

SEQ ID NO: 847717 - DNA, 22 bp, Artificial Sequence
  chemically synthesized
tcttggaagggacattggatgc

SEQ ID NO: 847718 - DNA, 22 bp, Artificial Sequence
  chemically synthesized
tttcttggaagggacattggat

SEQ ID NO: 847719 - DNA, 22 bp, Artificial Sequence
  chemically synthesized
ctttcttggaagggacattgga

SEQ ID NO: 847720 - DNA, 22 bp, Artificial Sequence
  chemically synthesized
gtacaactgcatccaatgtccc

SEQ ID NO: 847721 - DNA, 22 bp, Artificial Sequence
  chemically synthesized
catttctttcttggaagggaca

SEQ ID NO: 847722 - DNA, 22 bp, Artificial Sequence
  chemically synthesized
ccatttctttcttggaagggac

SEQ ID NO: 847723 - DNA, 22 bp, Artificial Sequence
  chemically synthesized
tccatttctttcttggaaggga

SEQ ID NO: 847724 - DNA, 22 bp, Artificial Sequence
  chemically synthesized
catccaatgtcccttccaagaa

SEQ ID NO: 847725 - DNA, 22 bp, Artificial Sequence
  chemically synthesized
attttccatttctttcttggaa

SEQ ID NO: 847726 - DNA, 22 bp, Artificial Sequence
  chemically synthesized
aattttccatttctttcttgga

SEQ ID NO: 847727 - DNA, 22 bp, Artificial Sequence
  chemically synthesized
caatttaattttccatttcttt

SEQ ID NO: 847728 - DNA, 22 bp, Artificial Sequence
  chemically synthesized
ctgcaatttaattttccatttc

SEQ ID NO: 847729 - DNA, 22 bp, Artificial Sequence
  chemically synthesized
ccaagaaagaaatggaaaatta

SEQ ID NO: 847730 - DNA, 22 bp, Artificial Sequence
  chemically synthesized
caagaaagaaatggaaaattaa

SEQ ID NO: 847731 - DNA, 22 bp, Artificial Sequence
  chemically synthesized
ggttactgcaatttaattttcc

SEQ ID NO: 847732 - DNA, 22 bp, Artificial Sequence
  chemically synthesized
gggttactgcaatttaattttc

SEQ ID NO: 847733 - DNA, 22 bp, Artificial Sequence
  chemically synthesized
ttgggttactgcaatttaattt

SEQ ID NO: 847734 - DNA, 22 bp, Artificial Sequence
  chemically synthesized
cttgggttactgcaatttaatt

SEQ ID NO: 847735 - DNA, 22 bp, Artificial Sequence
  chemically synthesized
tcttgggttactgcaatttaat

SEQ ID NO: 847736 - DNA, 22 bp, Artificial Sequence
  chemically synthesized
ttcttgggttactgcaatttaa

SEQ ID NO: 847737 - DNA, 22 bp, Artificial Sequence
  chemically synthesized
aattgcagtaacccaagaaaag

SEQ ID NO: 847738 - DNA, 22 bp, Artificial Sequence
  chemically synthesized
cagtaacccaagaaaagcctct

SEQ ID NO: 847739 - DNA, 22 bp, Artificial Sequence
  chemically synthesized
atcaaagaggagatacaagagg

SEQ ID NO: 847740 - DNA, 22 bp, Artificial Sequence
  chemically synthesized
aatcaaagaggagatacaagag

SEQ ID NO: 847741 - DNA, 22 bp, Artificial Sequence
  chemically synthesized
atgacaggacatttaatcaaag

SEQ ID NO: 847742 - DNA, 22 bp, Artificial Sequence
  chemically synthesized
ttgtatctcctctttgattaaa

SEQ ID NO: 847743 - DNA, 22 bp, Artificial Sequence
  chemically synthesized
catgacaggacatttaatcaaa

SEQ ID NO: 847744 - DNA, 22 bp, Artificial Sequence
  chemically synthesized
tcatgacaggacatttaatcaa

SEQ ID NO: 847745 - DNA, 22 bp, Artificial Sequence
  chemically synthesized
gtatctcctctttgattaaatg

SEQ ID NO: 847746 - DNA, 22 bp, Artificial Sequence
  chemically synthesized
tatctcctctttgattaaatgt

SEQ ID NO: 847747 - DNA, 22 bp, Artificial Sequence
  chemically synthesized
catgttttcatgacaggacatt

SEQ ID NO: 847748 - DNA, 22 bp, Artificial Sequence
  chemically synthesized
ctctttgattaaatgtcctgtc

SEQ ID NO: 847749 - DNA, 22 bp, Artificial Sequence
  chemically synthesized
acatgttttcatgacaggacat

SEQ ID NO: 847750 - DNA, 22 bp, Artificial Sequence
  chemically synthesized
tacatgttttcatgacaggaca

SEQ ID NO: 847751 - DNA, 22 bp, Artificial Sequence
  chemically synthesized
tttgattaaatgtcctgtcatg

SEQ ID NO: 847752 - DNA, 22 bp, Artificial Sequence
  chemically synthesized
tgattaaatgtcctgtcatgaa

SEQ ID NO: 847753 - DNA, 22 bp, Artificial Sequence
  chemically synthesized
gattaaatgtcctgtcatgaaa

SEQ ID NO: 847754 - DNA, 22 bp, Artificial Sequence
  chemically synthesized
attaaatgtcctgtcatgaaaa

SEQ ID NO: 847755 - DNA, 22 bp, Artificial Sequence
  chemically synthesized
gaaatgttttacatgttttcat

SEQ ID NO: 847756 - DNA, 22 bp, Artificial Sequence
  chemically synthesized
aatgtcctgtcatgaaaacatg

SEQ ID NO: 847757 - DNA, 22 bp, Artificial Sequence
  chemically synthesized
tcatgaaaacatgtaaaacatt

SEQ ID NO: 847758 - DNA, 22 bp, Artificial Sequence
  chemically synthesized
aaaagatgcatgaaggtaaatt

SEQ ID NO: 847759 - DNA, 22 bp, Artificial Sequence
  chemically synthesized
aaaaagatgcatgaaggtaaat

SEQ ID NO: 847760 - DNA, 22 bp, Artificial Sequence
  chemically synthesized
ttaaaaagatgcatgaaggtaa

SEQ ID NO: 847761 - DNA, 22 bp, Artificial Sequence
  chemically synthesized
cttaaaaagatgcatgaaggta

SEQ ID NO: 847762 - DNA, 22 bp, Artificial Sequence
  chemically synthesized
ttcttaaaaagatgcatgaagg

SEQ ID NO: 847763 - DNA, 22 bp, Artificial Sequence
  chemically synthesized
ctaatttaccttcatgcatctt

SEQ ID NO: 847764 - DNA, 22 bp, Artificial Sequence
  chemically synthesized
taatttaccttcatgcatcttt

SEQ ID NO: 847765 - DNA, 22 bp, Artificial Sequence
  chemically synthesized
tattcttcttaaaaagatgcat

SEQ ID NO: 847766 - DNA, 22 bp, Artificial Sequence
  chemically synthesized
atttaccttcatgcatcttttt

SEQ ID NO: 847767 - DNA, 22 bp, Artificial Sequence
  chemically synthesized
ttatattcttcttaaaaagatg

SEQ ID NO: 847768 - DNA, 22 bp, Artificial Sequence
  chemically synthesized
accttcatgcatctttttaaga

SEQ ID NO: 847769 - DNA, 22 bp, Artificial Sequence
  chemically synthesized
ccttcatgcatctttttaagaa

SEQ ID NO: 847770 - DNA, 22 bp, Artificial Sequence
  chemically synthesized
catgcatctttttaagaagaat

SEQ ID NO: 847771 - DNA, 22 bp, Artificial Sequence
  chemically synthesized
atgcatctttttaagaagaata

SEQ ID NO: 847772 - DNA, 22 bp, Artificial Sequence
  chemically synthesized
tgtgcagtggagttattatatt

SEQ ID NO: 847773 - DNA, 22 bp, Artificial Sequence
  chemically synthesized
gtgtgcagtggagttattatat

SEQ ID NO: 847774 - DNA, 22 bp, Artificial Sequence
  chemically synthesized
tttaagaagaatataataactc

SEQ ID NO: 847775 - DNA, 22 bp, Artificial Sequence
  chemically synthesized
ttaagaagaatataataactcc

SEQ ID NO: 847776 - DNA, 22 bp, Artificial Sequence
  chemically synthesized
cttgtgtgcagtggagttatta

SEQ ID NO: 847777 - DNA, 22 bp, Artificial Sequence
  chemically synthesized
taagaagaatataataactcca

SEQ ID NO: 847778 - DNA, 22 bp, Artificial Sequence
  chemically synthesized
aagaagaatataataactccac

SEQ ID NO: 847779 - DNA, 22 bp, Artificial Sequence
  chemically synthesized
agaagaatataataactccact

SEQ ID NO: 847780 - DNA, 22 bp, Artificial Sequence
  chemically synthesized
tgttccttgtgtgcagtggagt

SEQ ID NO: 847781 - DNA, 22 bp, Artificial Sequence
  chemically synthesized
atgttccttgtgtgcagtggag

SEQ ID NO: 847782 - DNA, 22 bp, Artificial Sequence
  chemically synthesized
aatttatgttccttgtgtgcag

SEQ ID NO: 847783 - DNA, 22 bp, Artificial Sequence
  chemically synthesized
cactgcacacaaggaacataaa

SEQ ID NO: 847784 - DNA, 22 bp, Artificial Sequence
  chemically synthesized
cacacaaggaacataaattcaa

SEQ ID NO: 847785 - DNA, 22 bp, Artificial Sequence
  chemically synthesized
caagcaatggggttgaatttat

SEQ ID NO: 847786 - DNA, 22 bp, Artificial Sequence
  chemically synthesized
acaagcaatggggttgaattta

SEQ ID NO: 847787 - DNA, 22 bp, Artificial Sequence
  chemically synthesized
tacaagcaatggggttgaattt

SEQ ID NO: 847788 - DNA, 22 bp, Artificial Sequence
  chemically synthesized
ttacaagcaatggggttgaatt

SEQ ID NO: 847789 - DNA, 22 bp, Artificial Sequence
  chemically synthesized
ggacagtttttacaagcaatgg

SEQ ID NO: 847790 - DNA, 22 bp, Artificial Sequence
  chemically synthesized
gggacagtttttacaagcaatg

SEQ ID NO: 847791 - DNA, 22 bp, Artificial Sequence
  chemically synthesized
tgggacagtttttacaagcaat

SEQ ID NO: 847792 - DNA, 22 bp, Artificial Sequence
  chemically synthesized
tttgggacagtttttacaagca

SEQ ID NO: 847793 - DNA, 22 bp, Artificial Sequence
  chemically synthesized
aaccccattgcttgtaaaaact

SEQ ID NO: 847794 - DNA, 22 bp, Artificial Sequence
  chemically synthesized
ataattctttgggacagttttt

SEQ ID NO: 847795 - DNA, 22 bp, Artificial Sequence
  chemically synthesized
aataattctttgggacagtttt

SEQ ID NO: 847796 - DNA, 22 bp, Artificial Sequence
  chemically synthesized
tttaataattctttgggacagt

SEQ ID NO: 847797 - DNA, 22 bp, Artificial Sequence
  chemically synthesized
gtttaataattctttgggacag

SEQ ID NO: 847798 - DNA, 22 bp, Artificial Sequence
  chemically synthesized
cttgtaaaaactgtcccaaaga

SEQ ID NO: 847799 - DNA, 22 bp, Artificial Sequence
  chemically synthesized
gtaaaaactgtcccaaagaatt

SEQ ID NO: 847800 - DNA, 22 bp, Artificial Sequence
  chemically synthesized
taaaaactgtcccaaagaatta

SEQ ID NO: 847801 - DNA, 22 bp, Artificial Sequence
  chemically synthesized
tcccaaagaattattaaacaaa

SEQ ID NO: 847802 - DNA, 22 bp, Artificial Sequence
  chemically synthesized
caagtagaatcagcaaatttgt

SEQ ID NO: 847803 - DNA, 22 bp, Artificial Sequence
  chemically synthesized
ttaaacaaatttgctgattcta

SEQ ID NO: 847804 - DNA, 22 bp, Artificial Sequence
  chemically synthesized
aacaaatttgctgattctactt

SEQ ID NO: 847805 - DNA, 22 bp, Artificial Sequence
  chemically synthesized
gctgattctacttgtaatatta

SEQ ID NO: 847806 - DNA, 22 bp, Artificial Sequence
  chemically synthesized
tatagtaaaatataatattaca

SEQ ID NO: 847807 - DNA, 22 bp, Artificial Sequence
  chemically synthesized
ctgattctacttgtaatattat

SEQ ID NO: 847808 - DNA, 22 bp, Artificial Sequence
  chemically synthesized
attctacttgtaatattatatt

SEQ ID NO: 847809 - DNA, 22 bp, Artificial Sequence
  chemically synthesized
cccctatatagtaaaatataat

SEQ ID NO: 847810 - DNA, 22 bp, Artificial Sequence
  chemically synthesized
acccctatatagtaaaatataa

SEQ ID NO: 847811 - DNA, 22 bp, Artificial Sequence
  chemically synthesized
tacttgtaatattatattttac

SEQ ID NO: 847812 - DNA, 22 bp, Artificial Sequence
  chemically synthesized
tacccctatatagtaaaatata

SEQ ID NO: 847813 - DNA, 22 bp, Artificial Sequence
  chemically synthesized
ttacccctatatagtaaaatat

SEQ ID NO: 847814 - DNA, 22 bp, Artificial Sequence
  chemically synthesized
cttgtaatattatattttacta

SEQ ID NO: 847815 - DNA, 22 bp, Artificial Sequence
  chemically synthesized
tttacccctatatagtaaaata

SEQ ID NO: 847816 - DNA, 22 bp, Artificial Sequence
  chemically synthesized
gtaatattatattttactatat

SEQ ID NO: 847817 - DNA, 22 bp, Artificial Sequence
  chemically synthesized
taatattatattttactatata

SEQ ID NO: 847818 - DNA, 22 bp, Artificial Sequence
  chemically synthesized
caatccctttttacccctatat

SEQ ID NO: 847819 - DNA, 22 bp, Artificial Sequence
  chemically synthesized
tattttactatataggggtaaa

SEQ ID NO: 847820 - DNA, 22 bp, Artificial Sequence
  chemically synthesized
aaactacaatccctttttaccc

SEQ ID NO: 847821 - DNA, 22 bp, Artificial Sequence
  chemically synthesized
tactatataggggtaaaaaggg

SEQ ID NO: 847822 - DNA, 22 bp, Artificial Sequence
  chemically synthesized
actatataggggtaaaaaggga

SEQ ID NO: 847823 - DNA, 22 bp, Artificial Sequence
  chemically synthesized
ctatataggggtaaaaagggat

SEQ ID NO: 847824 - DNA, 22 bp, Artificial Sequence
  chemically synthesized
aactgaaactacaatccctttt

SEQ ID NO: 847825 - DNA, 22 bp, Artificial Sequence
  chemically synthesized
tataggggtaaaaagggattgt

SEQ ID NO: 847826 - DNA, 22 bp, Artificial Sequence
  chemically synthesized
taaactgaaactacaatccctt

SEQ ID NO: 847827 - DNA, 22 bp, Artificial Sequence
  chemically synthesized
ctaaactgaaactacaatccct

SEQ ID NO: 847828 - DNA, 22 bp, Artificial Sequence
  chemically synthesized
tctaaactgaaactacaatccc

SEQ ID NO: 847829 - DNA, 22 bp, Artificial Sequence
  chemically synthesized
ttctaaactgaaactacaatcc

SEQ ID NO: 847830 - DNA, 22 bp, Artificial Sequence
  chemically synthesized
tttctaaactgaaactacaatc

SEQ ID NO: 847831 - DNA, 22 bp, Artificial Sequence
  chemically synthesized
ttttctaaactgaaactacaat

SEQ ID NO: 847832 - DNA, 22 bp, Artificial Sequence
  chemically synthesized
ccttttttctaaactgaaacta

SEQ ID NO: 847833 - DNA, 22 bp, Artificial Sequence
  chemically synthesized
accttttttctaaactgaaact

SEQ ID NO: 847834 - DNA, 22 bp, Artificial Sequence
  chemically synthesized
aatgtttaccttttttctaaac

SEQ ID NO: 847835 - DNA, 22 bp, Artificial Sequence
  chemically synthesized
tgaatgtttaccttttttctaa

SEQ ID NO: 847836 - DNA, 22 bp, Artificial Sequence
  chemically synthesized
tagtttcagtttagaaaaaagg

SEQ ID NO: 847837 - DNA, 22 bp, Artificial Sequence
  chemically synthesized
cagtttagaaaaaaggtaaaca

SEQ ID NO: 847838 - DNA, 22 bp, Artificial Sequence
  chemically synthesized
agtttagaaaaaaggtaaacat

SEQ ID NO: 847839 - DNA, 22 bp, Artificial Sequence
  chemically synthesized
acaaaacattctgaatgtttac

SEQ ID NO: 847840 - DNA, 22 bp, Artificial Sequence
  chemically synthesized
aacaaaacattctgaatgttta

SEQ ID NO: 847841 - DNA, 22 bp, Artificial Sequence
  chemically synthesized
agaaaaaaggtaaacattcaga

SEQ ID NO: 847842 - DNA, 22 bp, Artificial Sequence
  chemically synthesized
gaaaaaaggtaaacattcagaa

SEQ ID NO: 847843 - DNA, 22 bp, Artificial Sequence
  chemically synthesized
gagtaggaatgtaagaatttaa

SEQ ID NO: 847844 - DNA, 22 bp, Artificial Sequence
  chemically synthesized
agaatgttttgttaaattctta

SEQ ID NO: 847845 - DNA, 22 bp, Artificial Sequence
  chemically synthesized
agagtaggaatgtaagaattta

SEQ ID NO: 847846 - DNA, 22 bp, Artificial Sequence
  chemically synthesized
tagagtaggaatgtaagaattt

SEQ ID NO: 847847 - DNA, 22 bp, Artificial Sequence
  chemically synthesized
tcctttagagtaggaatgtaag

SEQ ID NO: 847848 - DNA, 22 bp, Artificial Sequence
  chemically synthesized
atcctttagagtaggaatgtaa

SEQ ID NO: 847849 - DNA, 22 bp, Artificial Sequence
  chemically synthesized
tgttaaattcttacattcctac

SEQ ID NO: 847850 - DNA, 22 bp, Artificial Sequence
  chemically synthesized
gttaaattcttacattcctact

SEQ ID NO: 847851 - DNA, 22 bp, Artificial Sequence
  chemically synthesized
tttatcctttagagtaggaatg

SEQ ID NO: 847852 - DNA, 22 bp, Artificial Sequence
  chemically synthesized
ttaaattcttacattcctactc

SEQ ID NO: 847853 - DNA, 22 bp, Artificial Sequence
  chemically synthesized
tgtttatcctttagagtaggaa

SEQ ID NO: 847854 - DNA, 22 bp, Artificial Sequence
  chemically synthesized
aattcttacattcctactctaa

SEQ ID NO: 847855 - DNA, 22 bp, Artificial Sequence
  chemically synthesized
ttacattcctactctaaaggat

SEQ ID NO: 847856 - DNA, 22 bp, Artificial Sequence
  chemically synthesized
aaagtctctgtttatcctttag

SEQ ID NO: 847857 - DNA, 22 bp, Artificial Sequence
  chemically synthesized
acattcctactctaaaggataa

SEQ ID NO: 847858 - DNA, 22 bp, Artificial Sequence
  chemically synthesized
cattcctactctaaaggataaa

SEQ ID NO: 847859 - DNA, 22 bp, Artificial Sequence
  chemically synthesized
tgaaagtctctgtttatccttt

SEQ ID NO: 847860 - DNA, 22 bp, Artificial Sequence
  chemically synthesized
ctactctaaaggataaacagag

SEQ ID NO: 847861 - DNA, 22 bp, Artificial Sequence
  chemically synthesized
acactctgaaagtctctgttta

SEQ ID NO: 847862 - DNA, 22 bp, Artificial Sequence
  chemically synthesized
ctctaaaggataaacagagact

SEQ ID NO: 847863 - DNA, 22 bp, Artificial Sequence
  chemically synthesized
tcacactctgaaagtctctgtt

SEQ ID NO: 847864 - DNA, 22 bp, Artificial Sequence
  chemically synthesized
ctcacactctgaaagtctctgt

SEQ ID NO: 847865 - DNA, 22 bp, Artificial Sequence
  chemically synthesized
taaaggataaacagagactttc

SEQ ID NO: 847866 - DNA, 22 bp, Artificial Sequence
  chemically synthesized
ttctcacactctgaaagtctct

SEQ ID NO: 847867 - DNA, 22 bp, Artificial Sequence
  chemically synthesized
cttctcacactctgaaagtctc

SEQ ID NO: 847868 - DNA, 22 bp, Artificial Sequence
  chemically synthesized
aaggataaacagagactttcag

SEQ ID NO: 847869 - DNA, 22 bp, Artificial Sequence
  chemically synthesized
aatttcttctcacactctgaaa

SEQ ID NO: 847870 - DNA, 22 bp, Artificial Sequence
  chemically synthesized
cagagagatctcaatttcttct

SEQ ID NO: 847871 - DNA, 22 bp, Artificial Sequence
  chemically synthesized
ccagagagatctcaatttcttc

SEQ ID NO: 847872 - DNA, 22 bp, Artificial Sequence
  chemically synthesized
tcagagtgtgagaagaaattga

SEQ ID NO: 847873 - DNA, 22 bp, Artificial Sequence
  chemically synthesized
cagagtgtgagaagaaattgag

SEQ ID NO: 847874 - DNA, 22 bp, Artificial Sequence
  chemically synthesized
agagtgtgagaagaaattgaga

SEQ ID NO: 847875 - DNA, 22 bp, Artificial Sequence
  chemically synthesized
tatttccagagagatctcaatt

SEQ ID NO: 847876 - DNA, 22 bp, Artificial Sequence
  chemically synthesized
aagttgtatttccagagagatc

SEQ ID NO: 847877 - DNA, 22 bp, Artificial Sequence
  chemically synthesized
gaagttgtatttccagagagat

SEQ ID NO: 847878 - DNA, 22 bp, Artificial Sequence
  chemically synthesized
agatctctctggaaatacaact

SEQ ID NO: 847879 - DNA, 22 bp, Artificial Sequence
  chemically synthesized
ataataatccttgaagttgtat

SEQ ID NO: 847880 - DNA, 22 bp, Artificial Sequence
  chemically synthesized
tctggaaatacaacttcaagga

SEQ ID NO: 847881 - DNA, 22 bp, Artificial Sequence
  chemically synthesized
tcactgataataatccttgaag

SEQ ID NO: 847882 - DNA, 22 bp, Artificial Sequence
  chemically synthesized
tggaaatacaacttcaaggatt

SEQ ID NO: 847883 - DNA, 22 bp, Artificial Sequence
  chemically synthesized
atcactgataataatccttgaa

SEQ ID NO: 847884 - DNA, 22 bp, Artificial Sequence
  chemically synthesized
gaaatacaacttcaaggattat

SEQ ID NO: 847885 - DNA, 22 bp, Artificial Sequence
  chemically synthesized
ttatcactgataataatccttg

SEQ ID NO: 847886 - DNA, 22 bp, Artificial Sequence
  chemically synthesized
cttatcactgataataatcctt

SEQ ID NO: 847887 - DNA, 22 bp, Artificial Sequence
  chemically synthesized
atacttcttatcactgataata

SEQ ID NO: 847888 - DNA, 22 bp, Artificial Sequence
  chemically synthesized
caaggattattatcagtgataa

SEQ ID NO: 847889 - DNA, 22 bp, Artificial Sequence
  chemically synthesized
aaggattattatcagtgataag

SEQ ID NO: 847890 - DNA, 22 bp, Artificial Sequence
  chemically synthesized
ttatcagtgataagaagtatta

SEQ ID NO: 847891 - DNA, 22 bp, Artificial Sequence
  chemically synthesized
tcagtgataagaagtattaaca

SEQ ID NO: 847892 - DNA, 22 bp, Artificial Sequence
  chemically synthesized
acaaaatgtgacatcataacat

SEQ ID NO: 847893 - DNA, 22 bp, Artificial Sequence
  chemically synthesized
tattcacaaaatgtgacatcat

SEQ ID NO: 847894 - DNA, 22 bp, Artificial Sequence
  chemically synthesized
acatatgttatgatgtcacatt

SEQ ID NO: 847895 - DNA, 22 bp, Artificial Sequence
  chemically synthesized
aaaagttatattcacaaaatgt

SEQ ID NO: 847896 - DNA, 22 bp, Artificial Sequence
  chemically synthesized
tgatgtcacattttgtgaatat

SEQ ID NO: 847897 - DNA, 22 bp, Artificial Sequence
  chemically synthesized
agggcattgaaaagttatattc

SEQ ID NO: 847898 - DNA, 22 bp, Artificial Sequence
  chemically synthesized
tgtgaatataacttttcaatgc

SEQ ID NO: 847899 - DNA, 22 bp, Artificial Sequence
  chemically synthesized
gtgaatataacttttcaatgcc

SEQ ID NO: 847900 - DNA, 22 bp, Artificial Sequence
  chemically synthesized
tgaatataacttttcaatgccc

SEQ ID NO: 847901 - DNA, 22 bp, Artificial Sequence
  chemically synthesized
gtgcagcaatacgtattaaggg

SEQ ID NO: 847902 - DNA, 22 bp, Artificial Sequence
  chemically synthesized
ttcaatgcccttaatacgtatt

SEQ ID NO: 847903 - DNA, 22 bp, Artificial Sequence
  chemically synthesized
tcaatgcccttaatacgtattg

SEQ ID NO: 847904 - DNA, 22 bp, Artificial Sequence
  chemically synthesized
caatgcccttaatacgtattgc

SEQ ID NO: 847905 - DNA, 22 bp, Artificial Sequence
  chemically synthesized
aatgcccttaatacgtattgct

SEQ ID NO: 847906 - DNA, 22 bp, Artificial Sequence
  chemically synthesized
aatacgtattgctgcactagac

SEQ ID NO: 847907 - DNA, 22 bp, Artificial Sequence
  chemically synthesized
atacgtattgctgcactagacc

SEQ ID NO: 847908 - DNA, 22 bp, Artificial Sequence
  chemically synthesized
ccaaagaaaaatatcaggtcta

SEQ ID NO: 847909 - DNA, 22 bp, Artificial Sequence
  chemically synthesized
cccaaagaaaaatatcaggtct

SEQ ID NO: 847910 - DNA, 22 bp, Artificial Sequence
  chemically synthesized
tttcccaaagaaaaatatcagg

SEQ ID NO: 847911 - DNA, 22 bp, Artificial Sequence
  chemically synthesized
atttcccaaagaaaaatatcag

SEQ ID NO: 847912 - DNA, 22 bp, Artificial Sequence
  chemically synthesized
ctgcactagacctgatattttt

SEQ ID NO: 847913 - DNA, 22 bp, Artificial Sequence
  chemically synthesized
cactagacctgatatttttctt

SEQ ID NO: 847914 - DNA, 22 bp, Artificial Sequence
  chemically synthesized
aagacttatttcccaaagaaaa

SEQ ID NO: 847915 - DNA, 22 bp, Artificial Sequence
  chemically synthesized
gacctgatatttttctttggga

SEQ ID NO: 847916 - DNA, 22 bp, Artificial Sequence
  chemically synthesized
cctgaagacttatttcccaaag

SEQ ID NO: 847917 - DNA, 22 bp, Artificial Sequence
  chemically synthesized
atatttttctttgggaaataag

SEQ ID NO: 847918 - DNA, 22 bp, Artificial Sequence
  chemically synthesized
ttctttgggaaataagtcttca

SEQ ID NO: 847919 - DNA, 22 bp, Artificial Sequence
  chemically synthesized
tctttgggaaataagtcttcag

SEQ ID NO: 847920 - DNA, 22 bp, Artificial Sequence
  chemically synthesized
ctttgggaaataagtcttcagg

SEQ ID NO: 847921 - DNA, 22 bp, Artificial Sequence
  chemically synthesized
tttgggaaataagtcttcaggt

SEQ ID NO: 847922 - DNA, 22 bp, Artificial Sequence
  chemically synthesized
tgggaaataagtcttcaggtag

SEQ ID NO: 847923 - DNA, 22 bp, Artificial Sequence
  chemically synthesized
gaaataggagtactacctgaag

SEQ ID NO: 847924 - DNA, 22 bp, Artificial Sequence
  chemically synthesized
gggaaataagtcttcaggtagt

SEQ ID NO: 847925 - DNA, 22 bp, Artificial Sequence
  chemically synthesized
ggaaataagtcttcaggtagta

SEQ ID NO: 847926 - DNA, 22 bp, Artificial Sequence
  chemically synthesized
ctagaaataggagtactacctg

SEQ ID NO: 847927 - DNA, 22 bp, Artificial Sequence
  chemically synthesized
cctagaaataggagtactacct

SEQ ID NO: 847928 - DNA, 22 bp, Artificial Sequence
  chemically synthesized
tcctagaaataggagtactacc

SEQ ID NO: 847929 - DNA, 22 bp, Artificial Sequence
  chemically synthesized
ctttcctagaaataggagtact

SEQ ID NO: 847930 - DNA, 22 bp, Artificial Sequence
  chemically synthesized
caggtagtactcctatttctag

SEQ ID NO: 847931 - DNA, 22 bp, Artificial Sequence
  chemically synthesized
aggtagtactcctatttctagg

SEQ ID NO: 847932 - DNA, 22 bp, Artificial Sequence
  chemically synthesized
ctatttctaggaaaggagtact

SEQ ID NO: 847933 - DNA, 22 bp, Artificial Sequence
  chemically synthesized
tttctaggaaaggagtactggg

SEQ ID NO: 847934 - DNA, 22 bp, Artificial Sequence
  chemically synthesized
ctaggaaaggagtactggggta

SEQ ID NO: 847935 - DNA, 22 bp, Artificial Sequence
  chemically synthesized
taggaaaggagtactggggtat

SEQ ID NO: 847936 - DNA, 22 bp, Artificial Sequence
  chemically synthesized
ggaaaggagtactggggtattg

SEQ ID NO: 847937 - DNA, 22 bp, Artificial Sequence
  chemically synthesized
aacagatgagcacaatacccca

SEQ ID NO: 847938 - DNA, 22 bp, Artificial Sequence
  chemically synthesized
gaacagatgagcacaatacccc

SEQ ID NO: 847939 - DNA, 22 bp, Artificial Sequence
  chemically synthesized
tgaacagatgagcacaataccc

SEQ ID NO: 847940 - DNA, 22 bp, Artificial Sequence
  chemically synthesized
ttgaacagatgagcacaatacc

SEQ ID NO: 847941 - DNA, 22 bp, Artificial Sequence
  chemically synthesized
tttttgaacagatgagcacaat

SEQ ID NO: 847942 - DNA, 22 bp, Artificial Sequence
  chemically synthesized
atttttgaacagatgagcacaa

SEQ ID NO: 847943 - DNA, 22 bp, Artificial Sequence
  chemically synthesized
tatttttgaacagatgagcaca

SEQ ID NO: 847944 - DNA, 22 bp, Artificial Sequence
  chemically synthesized
ttatttttgaacagatgagcac

SEQ ID NO: 847945 - DNA, 22 bp, Artificial Sequence
  chemically synthesized
acttttatttttgaacagatga

SEQ ID NO: 847946 - DNA, 22 bp, Artificial Sequence
  chemically synthesized
gggtattgtgctcatctgttca

SEQ ID NO: 847947 - DNA, 22 bp, Artificial Sequence
  chemically synthesized
gacttttatttttgaacagatg

SEQ ID NO: 847948 - DNA, 22 bp, Artificial Sequence
  chemically synthesized
tgacttttatttttgaacagat

SEQ ID NO: 847949 - DNA, 22 bp, Artificial Sequence
  chemically synthesized
gctttgacttttatttttgaac

SEQ ID NO: 847950 - DNA, 22 bp, Artificial Sequence
  chemically synthesized
tgctcatctgttcaaaaataaa

SEQ ID NO: 847951 - DNA, 22 bp, Artificial Sequence
  chemically synthesized
ttagctttgacttttatttttg

SEQ ID NO: 847952 - DNA, 22 bp, Artificial Sequence
  chemically synthesized
gttagctttgacttttattttt

SEQ ID NO: 847953 - DNA, 22 bp, Artificial Sequence
  chemically synthesized
tgttagctttgacttttatttt

SEQ ID NO: 847954 - DNA, 22 bp, Artificial Sequence
  chemically synthesized
atctgttcaaaaataaaagtca

SEQ ID NO: 847955 - DNA, 22 bp, Artificial Sequence
  chemically synthesized
ttcaaaaataaaagtcaaagct

SEQ ID NO: 847956 - DNA, 22 bp, Artificial Sequence
  chemically synthesized
acaaatgttttgttagctttga

SEQ ID NO: 847957 - DNA, 22 bp, Artificial Sequence
  chemically synthesized
aaaaataaaagtcaaagctaac

SEQ ID NO: 847958 - DNA, 22 bp, Artificial Sequence
  chemically synthesized
aacaaatgttttgttagctttg

SEQ ID NO: 847959 - DNA, 22 bp, Artificial Sequence
  chemically synthesized
taacaaatgttttgttagcttt

SEQ ID NO: 847960 - DNA, 22 bp, Artificial Sequence
  chemically synthesized
ttaacaaatgttttgttagctt

SEQ ID NO: 847961 - DNA, 22 bp, Artificial Sequence
  chemically synthesized
aatgcatttttaacaaatgttt

SEQ ID NO: 847962 - DNA, 22 bp, Artificial Sequence
  chemically synthesized
acaaaacatttgttaaaaatgc

SEQ ID NO: 847963 - DNA, 22 bp, Artificial Sequence
  chemically synthesized
aaacgtgaaaaggttgaatgca

SEQ ID NO: 847964 - DNA, 22 bp, Artificial Sequence
  chemically synthesized
aaaacgtgaaaaggttgaatgc

SEQ ID NO: 847965 - DNA, 22 bp, Artificial Sequence
  chemically synthesized
taaaacgtgaaaaggttgaatg

SEQ ID NO: 847966 - DNA, 22 bp, Artificial Sequence
  chemically synthesized
ttaaaacgtgaaaaggttgaat

SEQ ID NO: 847967 - DNA, 22 bp, Artificial Sequence
  chemically synthesized
gttaaaaatgcattcaaccttt

SEQ ID NO: 847968 - DNA, 22 bp, Artificial Sequence
  chemically synthesized
ttaaaaatgcattcaacctttt

SEQ ID NO: 847969 - DNA, 22 bp, Artificial Sequence
  chemically synthesized
aaaatgcattcaaccttttcac

SEQ ID NO: 847970 - DNA, 22 bp, Artificial Sequence
  chemically synthesized
aaaatgtttttaaaacgtgaaa

SEQ ID NO: 847971 - DNA, 22 bp, Artificial Sequence
  chemically synthesized
caaaatgtttttaaaacgtgaa

SEQ ID NO: 847972 - DNA, 22 bp, Artificial Sequence
  chemically synthesized
aaccttttcacgttttaaaaac

SEQ ID NO: 847973 - DNA, 22 bp, Artificial Sequence
  chemically synthesized
ttcacgttttaaaaacattttg

SEQ ID NO: 847974 - DNA, 22 bp, Artificial Sequence
  chemically synthesized
tcacgttttaaaaacattttga

SEQ ID NO: 847975 - DNA, 22 bp, Artificial Sequence
  chemically synthesized
cacgttttaaaaacattttgaa

SEQ ID NO: 847976 - DNA, 22 bp, Artificial Sequence
  chemically synthesized
acgttttaaaaacattttgaag

SEQ ID NO: 847977 - DNA, 22 bp, Artificial Sequence
  chemically synthesized
aatgaataatatcttcaaaatg

SEQ ID NO: 847978 - DNA, 22 bp, Artificial Sequence
  chemically synthesized
aaatgaataatatcttcaaaat

SEQ ID NO: 847979 - DNA, 22 bp, Artificial Sequence
  chemically synthesized
taaaaacattttgaagatatta

SEQ ID NO: 847980 - DNA, 22 bp, Artificial Sequence
  chemically synthesized
aaaaacattttgaagatattat

SEQ ID NO: 847981 - DNA, 22 bp, Artificial Sequence
  chemically synthesized
aaaacattttgaagatattatt

SEQ ID NO: 847982 - DNA, 22 bp, Artificial Sequence
  chemically synthesized
agtacttaaatgaataatatct

SEQ ID NO: 847983 - DNA, 22 bp, Artificial Sequence
  chemically synthesized
cagtacttaaatgaataatatc

SEQ ID NO: 847984 - DNA, 22 bp, Artificial Sequence
  chemically synthesized
tttcagtacttaaatgaataat

SEQ ID NO: 847985 - DNA, 22 bp, Artificial Sequence
  chemically synthesized
gtttcagtacttaaatgaataa

SEQ ID NO: 847986 - DNA, 22 bp, Artificial Sequence
  chemically synthesized
tgtttcagtacttaaatgaata

SEQ ID NO: 847987 - DNA, 22 bp, Artificial Sequence
  chemically synthesized
tgaagatattattcatttaagt

SEQ ID NO: 847988 - DNA, 22 bp, Artificial Sequence
  chemically synthesized
gaagatattattcatttaagta

SEQ ID NO: 847989 - DNA, 22 bp, Artificial Sequence
  chemically synthesized
aagatattattcatttaagtac

SEQ ID NO: 847990 - DNA, 22 bp, Artificial Sequence
  chemically synthesized
ttcatttaagtactgaaacaaa

SEQ ID NO: 847991 - DNA, 22 bp, Artificial Sequence
  chemically synthesized
atttaagtactgaaacaaaacc

SEQ ID NO: 847992 - DNA, 22 bp, Artificial Sequence
  chemically synthesized
gaaataaaaagcatggttttgt

SEQ ID NO: 847993 - DNA, 22 bp, Artificial Sequence
  chemically synthesized
aagtactgaaacaaaaccatgc

SEQ ID NO: 847994 - DNA, 22 bp, Artificial Sequence
  chemically synthesized
agtactgaaacaaaaccatgct

SEQ ID NO: 847995 - DNA, 22 bp, Artificial Sequence
  chemically synthesized
ccgttagaaataaaaagcatgg

SEQ ID NO: 847996 - DNA, 22 bp, Artificial Sequence
  chemically synthesized
aaacaaaaccatgctttttatt

SEQ ID NO: 847997 - DNA, 22 bp, Artificial Sequence
  chemically synthesized
atggctgccgttagaaataaaa

SEQ ID NO: 847998 - DNA, 22 bp, Artificial Sequence
  chemically synthesized
ttgatggctgccgttagaaata

SEQ ID NO: 847999 - DNA, 22 bp, Artificial Sequence
  chemically synthesized
attgatggctgccgttagaaat

SEQ ID NO: 848000 - DNA, 22 bp, Artificial Sequence
  chemically synthesized
agtttattgatggctgccgtta

SEQ ID NO: 848001 - DNA, 22 bp, Artificial Sequence
  chemically synthesized
tttatttctaacggcagccatc

SEQ ID NO: 848002 - DNA, 22 bp, Artificial Sequence
  chemically synthesized
cctcagtttattgatggctgcc

SEQ ID NO: 848003 - DNA, 22 bp, Artificial Sequence
  chemically synthesized
ttatttctaacggcagccatca

SEQ ID NO: 848004 - DNA, 22 bp, Artificial Sequence
  chemically synthesized
gcctcagtttattgatggctgc

SEQ ID NO: 848005 - DNA, 22 bp, Artificial Sequence
  chemically synthesized
tatttctaacggcagccatcaa

SEQ ID NO: 848006 - DNA, 22 bp, Artificial Sequence
  chemically synthesized
tgcctcagtttattgatggctg

SEQ ID NO: 848007 - DNA, 22 bp, Artificial Sequence
  chemically synthesized
atttctaacggcagccatcaat

SEQ ID NO: 848008 - DNA, 22 bp, Artificial Sequence
  chemically synthesized
tttctaacggcagccatcaata

SEQ ID NO: 848009 - DNA, 22 bp, Artificial Sequence
  chemically synthesized
ctttgcctcagtttattgatgg

SEQ ID NO: 848010 - DNA, 22 bp, Artificial Sequence
  chemically synthesized
gctttgcctcagtttattgatg

SEQ ID NO: 848011 - DNA, 22 bp, Artificial Sequence
  chemically synthesized
ctaacggcagccatcaataaac

SEQ ID NO: 848012 - DNA, 22 bp, Artificial Sequence
  chemically synthesized
taacggcagccatcaataaact

SEQ ID NO: 848013 - DNA, 22 bp, Artificial Sequence
  chemically synthesized
ttgctttgcctcagtttattga

SEQ ID NO: 848014 - DNA, 22 bp, Artificial Sequence
  chemically synthesized
acggcagccatcaataaactga

SEQ ID NO: 848015 - DNA, 22 bp, Artificial Sequence
  chemically synthesized
aggcaaagcaagagatgttacc

SEQ ID NO: 848016 - DNA, 22 bp, Artificial Sequence
  chemically synthesized
caggtagtatcagcgaatggta

SEQ ID NO: 848017 - DNA, 22 bp, Artificial Sequence
  chemically synthesized
ccatctacaggtagtatcagcg

SEQ ID NO: 848018 - DNA, 22 bp, Artificial Sequence
  chemically synthesized
cccatctacaggtagtatcagc

SEQ ID NO: 848019 - DNA, 22 bp, Artificial Sequence
  chemically synthesized
acttcccatctacaggtagtat

SEQ ID NO: 848020 - DNA, 22 bp, Artificial Sequence
  chemically synthesized
cacttcccatctacaggtagta

SEQ ID NO: 848021 - DNA, 22 bp, Artificial Sequence
  chemically synthesized
ccattcgctgatactacctgta

SEQ ID NO: 848022 - DNA, 22 bp, Artificial Sequence
  chemically synthesized
acttcacttcccatctacaggt

SEQ ID NO: 848023 - DNA, 22 bp, Artificial Sequence
  chemically synthesized
cacttcacttcccatctacagg

SEQ ID NO: 848024 - DNA, 22 bp, Artificial Sequence
  chemically synthesized
gctgatactacctgtagatggg

SEQ ID NO: 848025 - DNA, 22 bp, Artificial Sequence
  chemically synthesized
ttcacttcacttcccatctaca

SEQ ID NO: 848026 - DNA, 22 bp, Artificial Sequence
  chemically synthesized
cttcacttcacttcccatctac

SEQ ID NO: 848027 - DNA, 22 bp, Artificial Sequence
  chemically synthesized
atactacctgtagatgggaagt

SEQ ID NO: 848028 - DNA, 22 bp, Artificial Sequence
  chemically synthesized
atttcttcacttcacttcccat

SEQ ID NO: 848029 - DNA, 22 bp, Artificial Sequence
  chemically synthesized
cctgtagatgggaagtgaagtg

SEQ ID NO: 848030 - DNA, 22 bp, Artificial Sequence
  chemically synthesized
tagatgggaagtgaagtgaaga

SEQ ID NO: 848031 - DNA, 22 bp, Artificial Sequence
  chemically synthesized
gataatcactcatttcttcact

SEQ ID NO: 848032 - DNA, 22 bp, Artificial Sequence
  chemically synthesized
tagataatcactcatttcttca

SEQ ID NO: 848033 - DNA, 22 bp, Artificial Sequence
  chemically synthesized
atgagtgtaatcgcctctagat

SEQ ID NO: 848034 - DNA, 22 bp, Artificial Sequence
  chemically synthesized
tgttcatgagtgtaatcgcctc

SEQ ID NO: 848035 - DNA, 22 bp, Artificial Sequence
  chemically synthesized
actgtgttcatgagtgtaatcg

SEQ ID NO: 848036 - DNA, 22 bp, Artificial Sequence
  chemically synthesized
tctagaggcgattacactcatg

SEQ ID NO: 848037 - DNA, 22 bp, Artificial Sequence
  chemically synthesized
attaactgtgttcatgagtgta

SEQ ID NO: 848038 - DNA, 22 bp, Artificial Sequence
  chemically synthesized
tgattaactgtgttcatgagtg

SEQ ID NO: 848039 - DNA, 22 bp, Artificial Sequence
  chemically synthesized
gaggcgattacactcatgaaca

SEQ ID NO: 848040 - DNA, 22 bp, Artificial Sequence
  chemically synthesized
ttctgattaactgtgttcatga

SEQ ID NO: 848041 - DNA, 22 bp, Artificial Sequence
  chemically synthesized
aattattctgattaactgtgtt

SEQ ID NO: 848042 - DNA, 22 bp, Artificial Sequence
  chemically synthesized
gaattattctgattaactgtgt

SEQ ID NO: 848043 - DNA, 22 bp, Artificial Sequence
  chemically synthesized
cactcatgaacacagttaatca

SEQ ID NO: 848044 - DNA, 22 bp, Artificial Sequence
  chemically synthesized
atgaacacagttaatcagaata

SEQ ID NO: 848045 - DNA, 22 bp, Artificial Sequence
  chemically synthesized
gggggcttgaattattctgatt

SEQ ID NO: 848046 - DNA, 22 bp, Artificial Sequence
  chemically synthesized
atcagaataattcaagccccct

SEQ ID NO: 848047 - DNA, 22 bp, Artificial Sequence
  chemically synthesized
aagccccctaaccctcttctgc

SEQ ID NO: 848048 - DNA, 22 bp, Artificial Sequence
  chemically synthesized
ccatgtgaagacagcagaagag

SEQ ID NO: 848049 - DNA, 22 bp, Artificial Sequence
  chemically synthesized
acatctaccatgtgaagacagc

SEQ ID NO: 848050 - DNA, 22 bp, Artificial Sequence
  chemically synthesized
cacatctaccatgtgaagacag

SEQ ID NO: 848051 - DNA, 22 bp, Artificial Sequence
  chemically synthesized
accctcttctgctgtcttcaca

SEQ ID NO: 848052 - DNA, 22 bp, Artificial Sequence
  chemically synthesized
aaatttcacatctaccatgtga

SEQ ID NO: 848053 - DNA, 22 bp, Artificial Sequence
  chemically synthesized
ttctgctgtcttcacatggtag

SEQ ID NO: 848054 - DNA, 22 bp, Artificial Sequence
  chemically synthesized
ctgctgtcttcacatggtagat

SEQ ID NO: 848055 - DNA, 22 bp, Artificial Sequence
  chemically synthesized
tgctgtcttcacatggtagatg

SEQ ID NO: 848056 - DNA, 22 bp, Artificial Sequence
  chemically synthesized
ctgtcttcacatggtagatgtg

SEQ ID NO: 848057 - DNA, 22 bp, Artificial Sequence
  chemically synthesized
ataattcaaatttcacatctac

SEQ ID NO: 848058 - DNA, 22 bp, Artificial Sequence
  chemically synthesized
gataattcaaatttcacatcta

SEQ ID NO: 848059 - DNA, 22 bp, Artificial Sequence
  chemically synthesized
tcttcacatggtagatgtgaaa

SEQ ID NO: 848060 - DNA, 22 bp, Artificial Sequence
  chemically synthesized
tgataattcaaatttcacatct

SEQ ID NO: 848061 - DNA, 22 bp, Artificial Sequence
  chemically synthesized
ttttgataattcaaatttcaca

SEQ ID NO: 848062 - DNA, 22 bp, Artificial Sequence
  chemically synthesized
cacatggtagatgtgaaatttg

SEQ ID NO: 848063 - DNA, 22 bp, Artificial Sequence
  chemically synthesized
acatggtagatgtgaaatttga

SEQ ID NO: 848064 - DNA, 22 bp, Artificial Sequence
  chemically synthesized
tgccaattattttgataattca

SEQ ID NO: 848065 - DNA, 22 bp, Artificial Sequence
  chemically synthesized
aacagctgtgccaattattttg

SEQ ID NO: 848066 - DNA, 22 bp, Artificial Sequence
  chemically synthesized
gaattatcaaaataattggcac

SEQ ID NO: 848067 - DNA, 22 bp, Artificial Sequence
  chemically synthesized
aattatcaaaataattggcaca

SEQ ID NO: 848068 - DNA, 22 bp, Artificial Sequence
  chemically synthesized
tcaaaataattggcacagctgt

SEQ ID NO: 848069 - DNA, 22 bp, Artificial Sequence
  chemically synthesized
tatgggaaacatgaattgaaca

SEQ ID NO: 848070 - DNA, 22 bp, Artificial Sequence
  chemically synthesized
gcacagctgttcaattcatgtt

SEQ ID NO: 848071 - DNA, 22 bp, Artificial Sequence
  chemically synthesized
tccctatatgggaaacatgaat

SEQ ID NO: 848072 - DNA, 22 bp, Artificial Sequence
  chemically synthesized
tatccctatatgggaaacatga

SEQ ID NO: 848073 - DNA, 22 bp, Artificial Sequence
  chemically synthesized
attctatccctatatgggaaac

SEQ ID NO: 848074 - DNA, 22 bp, Artificial Sequence
  chemically synthesized
ttcaattcatgtttcccatata

SEQ ID NO: 848075 - DNA, 22 bp, Artificial Sequence
  chemically synthesized
aattcatgtttcccatataggg

SEQ ID NO: 848076 - DNA, 22 bp, Artificial Sequence
  chemically synthesized
agcctgattctatccctatatg

SEQ ID NO: 848077 - DNA, 22 bp, Artificial Sequence
  chemically synthesized
atgtttcccatatagggataga

SEQ ID NO: 848078 - DNA, 22 bp, Artificial Sequence
  chemically synthesized
aataaactgagcctgattctat

SEQ ID NO: 848079 - DNA, 22 bp, Artificial Sequence
  chemically synthesized
cccatatagggatagaatcagg

SEQ ID NO: 848080 - DNA, 22 bp, Artificial Sequence
  chemically synthesized
ccatatagggatagaatcaggc

SEQ ID NO: 848081 - DNA, 22 bp, Artificial Sequence
  chemically synthesized
tagctgaataaactgagcctga

SEQ ID NO: 848082 - DNA, 22 bp, Artificial Sequence
  chemically synthesized
atagctgaataaactgagcctg

SEQ ID NO: 848083 - DNA, 22 bp, Artificial Sequence
  chemically synthesized
tatagctgaataaactgagcct

SEQ ID NO: 848084 - DNA, 22 bp, Artificial Sequence
  chemically synthesized
cactttatagctgaataaactg

SEQ ID NO: 848085 - DNA, 22 bp, Artificial Sequence
  chemically synthesized
tctccactttatagctgaataa

SEQ ID NO: 848086 - DNA, 22 bp, Artificial Sequence
  chemically synthesized
agtttattcagctataaagtgg

SEQ ID NO: 848087 - DNA, 22 bp, Artificial Sequence
  chemically synthesized
attcagctataaagtggagata

SEQ ID NO: 848088 - DNA, 22 bp, Artificial Sequence
  chemically synthesized
tatgaatgtaattatctccact

SEQ ID NO: 848089 - DNA, 22 bp, Artificial Sequence
  chemically synthesized
ttcagctataaagtggagataa

SEQ ID NO: 848090 - DNA, 22 bp, Artificial Sequence
  chemically synthesized
atatgaatgtaattatctccac

SEQ ID NO: 848091 - DNA, 22 bp, Artificial Sequence
  chemically synthesized
agctataaagtggagataatta

SEQ ID NO: 848092 - DNA, 22 bp, Artificial Sequence
  chemically synthesized
taaagtggagataattacattc

SEQ ID NO: 848093 - DNA, 22 bp, Artificial Sequence
  chemically synthesized
atcacacaagagtggtttatat

SEQ ID NO: 848094 - DNA, 22 bp, Artificial Sequence
  chemically synthesized
aatcacacaagagtggtttata

SEQ ID NO: 848095 - DNA, 22 bp, Artificial Sequence
  chemically synthesized
taatcacacaagagtggtttat

SEQ ID NO: 848096 - DNA, 22 bp, Artificial Sequence
  chemically synthesized
ctttaatcacacaagagtggtt

SEQ ID NO: 848097 - DNA, 22 bp, Artificial Sequence
  chemically synthesized
cattcatataaaccactcttgt

SEQ ID NO: 848098 - DNA, 22 bp, Artificial Sequence
  chemically synthesized
attgctttaatcacacaagagt

SEQ ID NO: 848099 - DNA, 22 bp, Artificial Sequence
  chemically synthesized
atataaaccactcttgtgtgat

SEQ ID NO: 848100 - DNA, 22 bp, Artificial Sequence
  chemically synthesized
taaatagattcattgctttaat

SEQ ID NO: 848101 - DNA, 22 bp, Artificial Sequence
  chemically synthesized
ataaatagattcattgctttaa

SEQ ID NO: 848102 - DNA, 22 bp, Artificial Sequence
  chemically synthesized
ttataaatagattcattgcttt

SEQ ID NO: 848103 - DNA, 22 bp, Artificial Sequence
  chemically synthesized
ttgtgtgattaaagcaatgaat

SEQ ID NO: 848104 - DNA, 22 bp, Artificial Sequence
  chemically synthesized
gtgtgattaaagcaatgaatct

SEQ ID NO: 848105 - DNA, 22 bp, Artificial Sequence
  chemically synthesized
tgtgattaaagcaatgaatcta

SEQ ID NO: 848106 - DNA, 22 bp, Artificial Sequence
  chemically synthesized
aattcttataaatagattcatt

SEQ ID NO: 848107 - DNA, 22 bp, Artificial Sequence
  chemically synthesized
gaattcttataaatagattcat

SEQ ID NO: 848108 - DNA, 22 bp, Artificial Sequence
  chemically synthesized
aagcaatgaatctatttataag

SEQ ID NO: 848109 - DNA, 22 bp, Artificial Sequence
  chemically synthesized
aggtatttgaattcttataaat

SEQ ID NO: 848110 - DNA, 22 bp, Artificial Sequence
  chemically synthesized
cctaaggtatttgaattcttat

SEQ ID NO: 848111 - DNA, 22 bp, Artificial Sequence
  chemically synthesized
tacctaaggtatttgaattctt

SEQ ID NO: 848112 - DNA, 22 bp, Artificial Sequence
  chemically synthesized
ctacctaaggtatttgaattct

SEQ ID NO: 848113 - DNA, 22 bp, Artificial Sequence
  chemically synthesized
atttctacctaaggtatttgaa

SEQ ID NO: 848114 - DNA, 22 bp, Artificial Sequence
  chemically synthesized
tttataagaattcaaatacctt

SEQ ID NO: 848115 - DNA, 22 bp, Artificial Sequence
  chemically synthesized
actaatttctacctaaggtatt

SEQ ID NO: 848116 - DNA, 22 bp, Artificial Sequence
  chemically synthesized
ataagaattcaaataccttagg

SEQ ID NO: 848117 - DNA, 22 bp, Artificial Sequence
  chemically synthesized
gactaatttctacctaaggtat

SEQ ID NO: 848118 - DNA, 22 bp, Artificial Sequence
  chemically synthesized
taagaattcaaataccttaggt

SEQ ID NO: 848119 - DNA, 22 bp, Artificial Sequence
  chemically synthesized
gccatatttgactaatttctac

SEQ ID NO: 848120 - DNA, 22 bp, Artificial Sequence
  chemically synthesized
aaataccttaggtagaaattag

SEQ ID NO: 848121 - DNA, 22 bp, Artificial Sequence
  chemically synthesized
gactagccatatttgactaatt

SEQ ID NO: 848122 - DNA, 22 bp, Artificial Sequence
  chemically synthesized
aggtagaaattagtcaaatatg

SEQ ID NO: 848123 - DNA, 22 bp, Artificial Sequence
  chemically synthesized
ggtagaaattagtcaaatatgg

SEQ ID NO: 848124 - DNA, 22 bp, Artificial Sequence
  chemically synthesized
taaagaaacctggactagccat

SEQ ID NO: 848125 - DNA, 22 bp, Artificial Sequence
  chemically synthesized
ctgtaaagaaacctggactagc

SEQ ID NO: 848126 - DNA, 22 bp, Artificial Sequence
  chemically synthesized
gtcaaatatggctagtccaggt

SEQ ID NO: 848127 - DNA, 22 bp, Artificial Sequence
  chemically synthesized
ttactgtaaagaaacctggact

SEQ ID NO: 848128 - DNA, 22 bp, Artificial Sequence
  chemically synthesized
ctgttactgtaaagaaacctgg

SEQ ID NO: 848129 - DNA, 22 bp, Artificial Sequence
  chemically synthesized
attgctgttactgtaaagaaac

SEQ ID NO: 848130 - DNA, 22 bp, Artificial Sequence
  chemically synthesized
aattgctgttactgtaaagaaa

SEQ ID NO: 848131 - DNA, 22 bp, Artificial Sequence
  chemically synthesized
gtccaggtttctttacagtaac

SEQ ID NO: 848132 - DNA, 22 bp, Artificial Sequence
  chemically synthesized
ctttacagtaacagcaattaag

SEQ ID NO: 848133 - DNA, 22 bp, Artificial Sequence
  chemically synthesized
tataacatatgtcttaattgct

SEQ ID NO: 848134 - DNA, 22 bp, Artificial Sequence
  chemically synthesized
tttacagtaacagcaattaaga

SEQ ID NO: 848135 - DNA, 22 bp, Artificial Sequence
  chemically synthesized
tatataacatatgtcttaattg

SEQ ID NO: 848136 - DNA, 22 bp, Artificial Sequence
  chemically synthesized
tacagtaacagcaattaagaca

SEQ ID NO: 848137 - DNA, 22 bp, Artificial Sequence
  chemically synthesized
acagtaacagcaattaagacat

SEQ ID NO: 848138 - DNA, 22 bp, Artificial Sequence
  chemically synthesized
cagtaacagcaattaagacata

SEQ ID NO: 848139 - DNA, 22 bp, Artificial Sequence
  chemically synthesized
aatatattctatataacatatg

SEQ ID NO: 848140 - DNA, 22 bp, Artificial Sequence
  chemically synthesized
atggattaaatatattctatat

SEQ ID NO: 848141 - DNA, 22 bp, Artificial Sequence
  chemically synthesized
agacatatgttatatagaatat

SEQ ID NO: 848142 - DNA, 22 bp, Artificial Sequence
  chemically synthesized
aaacctcatggattaaatatat

SEQ ID NO: 848143 - DNA, 22 bp, Artificial Sequence
  chemically synthesized
tatagaatatatttaatccatg

SEQ ID NO: 848144 - DNA, 22 bp, Artificial Sequence
  chemically synthesized
gcaaaatcagaaggctgaaacc

SEQ ID NO: 848145 - DNA, 22 bp, Artificial Sequence
  chemically synthesized
ggcaaaatcagaaggctgaaac

SEQ ID NO: 848146 - DNA, 22 bp, Artificial Sequence
  chemically synthesized
aatccatgaggtttcagccttc

SEQ ID NO: 848147 - DNA, 22 bp, Artificial Sequence
  chemically synthesized
atccatgaggtttcagccttct

SEQ ID NO: 848148 - DNA, 22 bp, Artificial Sequence
  chemically synthesized
agaatttggcaaaatcagaagg

SEQ ID NO: 848149 - DNA, 22 bp, Artificial Sequence
  chemically synthesized
tagcactcagaatttggcaaaa

SEQ ID NO: 848150 - DNA, 22 bp, Artificial Sequence
  chemically synthesized
cagccttctgattttgccaaat

SEQ ID NO: 848151 - DNA, 22 bp, Artificial Sequence
  chemically synthesized
gtagcactcagaatttggcaaa

SEQ ID NO: 848152 - DNA, 22 bp, Artificial Sequence
  chemically synthesized
agccttctgattttgccaaatt

SEQ ID NO: 848153 - DNA, 22 bp, Artificial Sequence
  chemically synthesized
tgtagcactcagaatttggcaa

SEQ ID NO: 848154 - DNA, 22 bp, Artificial Sequence
  chemically synthesized
actttgtagcactcagaatttg

SEQ ID NO: 848155 - DNA, 22 bp, Artificial Sequence
  chemically synthesized
cactttgtagcactcagaattt

SEQ ID NO: 848156 - DNA, 22 bp, Artificial Sequence
  chemically synthesized
ctgattttgccaaattctgagt

SEQ ID NO: 848157 - DNA, 22 bp, Artificial Sequence
  chemically synthesized
tgattttgccaaattctgagtg

SEQ ID NO: 848158 - DNA, 22 bp, Artificial Sequence
  chemically synthesized
attttgccaaattctgagtgct

SEQ ID NO: 848159 - DNA, 22 bp, Artificial Sequence
  chemically synthesized
tgccaaattctgagtgctacaa

SEQ ID NO: 848160 - DNA, 22 bp, Artificial Sequence
  chemically synthesized
gccaaattctgagtgctacaaa

SEQ ID NO: 848161 - DNA, 22 bp, Artificial Sequence
  chemically synthesized
ccaaattctgagtgctacaaag

SEQ ID NO: 848162 - DNA, 22 bp, Artificial Sequence
  chemically synthesized
tgagtgctacaaagtgaagata

SEQ ID NO: 848163 - DNA, 22 bp, Artificial Sequence
  chemically synthesized
accatccatatgtatcttcact

SEQ ID NO: 848164 - DNA, 22 bp, Artificial Sequence
  chemically synthesized
agtgctacaaagtgaagataca

SEQ ID NO: 848165 - DNA, 22 bp, Artificial Sequence
  chemically synthesized
ttcaccatccatatgtatcttc

SEQ ID NO: 848166 - DNA, 22 bp, Artificial Sequence
  chemically synthesized
caaagtgaagatacatatggat

SEQ ID NO: 848167 - DNA, 22 bp, Artificial Sequence
  chemically synthesized
aggtgaacacatggttgttcac

SEQ ID NO: 848168 - DNA, 22 bp, Artificial Sequence
  chemically synthesized
aaggtgaacacatggttgttca

SEQ ID NO: 848169 - DNA, 22 bp, Artificial Sequence
  chemically synthesized
tttaaggtgaacacatggttgt

SEQ ID NO: 848170 - DNA, 22 bp, Artificial Sequence
  chemically synthesized
atatagcattgtttaaggtgaa

SEQ ID NO: 848171 - DNA, 22 bp, Artificial Sequence
  chemically synthesized
caagccattaatatagcattgt

SEQ ID NO: 848172 - DNA, 22 bp, Artificial Sequence
  chemically synthesized
ccaagccattaatatagcattg

SEQ ID NO: 848173 - DNA, 22 bp, Artificial Sequence
  chemically synthesized
accttaaacaatgctatattaa

SEQ ID NO: 848174 - DNA, 22 bp, Artificial Sequence
  chemically synthesized
aaacaatgctatattaatggct

SEQ ID NO: 848175 - DNA, 22 bp, Artificial Sequence
  chemically synthesized
aacaatgctatattaatggctt

SEQ ID NO: 848176 - DNA, 22 bp, Artificial Sequence
  chemically synthesized
acaaggatttccaagccattaa

SEQ ID NO: 848177 - DNA, 22 bp, Artificial Sequence
  chemically synthesized
taaaactcacaaggatttccaa

SEQ ID NO: 848178 - DNA, 22 bp, Artificial Sequence
  chemically synthesized
gtaaaactcacaaggatttcca

SEQ ID NO: 848179 - DNA, 22 bp, Artificial Sequence
  chemically synthesized
tattaatggcttggaaatcctt

SEQ ID NO: 848180 - DNA, 22 bp, Artificial Sequence
  chemically synthesized
tttgtaaaactcacaaggattt

SEQ ID NO: 848181 - DNA, 22 bp, Artificial Sequence
  chemically synthesized
atttgtaaaactcacaaggatt

SEQ ID NO: 848182 - DNA, 22 bp, Artificial Sequence
  chemically synthesized
atggcttggaaatccttgtgag

SEQ ID NO: 848183 - DNA, 22 bp, Artificial Sequence
  chemically synthesized
acacttatttgtaaaactcaca

SEQ ID NO: 848184 - DNA, 22 bp, Artificial Sequence
  chemically synthesized
cacacttatttgtaaaactcac

SEQ ID NO: 848185 - DNA, 22 bp, Artificial Sequence
  chemically synthesized
ggaaatccttgtgagttttaca

SEQ ID NO: 848186 - DNA, 22 bp, Artificial Sequence
  chemically synthesized
gaaatccttgtgagttttacaa

SEQ ID NO: 848187 - DNA, 22 bp, Artificial Sequence
  chemically synthesized
tttcacacttatttgtaaaact

SEQ ID NO: 848188 - DNA, 22 bp, Artificial Sequence
  chemically synthesized
ctgtttcacacttatttgtaaa

SEQ ID NO: 848189 - DNA, 22 bp, Artificial Sequence
  chemically synthesized
gtgagttttacaaataagtgtg

SEQ ID NO: 848190 - DNA, 22 bp, Artificial Sequence
  chemically synthesized
tgagttttacaaataagtgtga

SEQ ID NO: 848191 - DNA, 22 bp, Artificial Sequence
  chemically synthesized
tacaaataagtgtgaaacagga

SEQ ID NO: 848192 - DNA, 22 bp, Artificial Sequence
  chemically synthesized
acaaataagtgtgaaacaggag

SEQ ID NO: 848193 - DNA, 22 bp, Artificial Sequence
  chemically synthesized
caaataagtgtgaaacaggagt

SEQ ID NO: 848194 - DNA, 22 bp, Artificial Sequence
  chemically synthesized
acagacacatgcacacatacac

SEQ ID NO: 848195 - DNA, 22 bp, Artificial Sequence
  chemically synthesized
tgtgagtgctcacagacacatg

SEQ ID NO: 848196 - DNA, 22 bp, Artificial Sequence
  chemically synthesized
tctgtgtgagtgctcacagaca

SEQ ID NO: 848197 - DNA, 22 bp, Artificial Sequence
  chemically synthesized
ggatgttgtctgtgtgagtgct

SEQ ID NO: 848198 - DNA, 22 bp, Artificial Sequence
  chemically synthesized
cattcggatgttgtctgtgtga

SEQ ID NO: 848199 - DNA, 22 bp, Artificial Sequence
  chemically synthesized
tccattcggatgttgtctgtgt

SEQ ID NO: 848200 - DNA, 22 bp, Artificial Sequence
  chemically synthesized
ctccattcggatgttgtctgtg

SEQ ID NO: 848201 - DNA, 22 bp, Artificial Sequence
  chemically synthesized
tgagcactcacacagacaacat

SEQ ID NO: 848202 - DNA, 22 bp, Artificial Sequence
  chemically synthesized
ttctccattcggatgttgtctg

SEQ ID NO: 848203 - DNA, 22 bp, Artificial Sequence
  chemically synthesized
tcttctccattcggatgttgtc

SEQ ID NO: 848204 - DNA, 22 bp, Artificial Sequence
  chemically synthesized
acacagacaacatccgaatgga

SEQ ID NO: 848205 - DNA, 22 bp, Artificial Sequence
  chemically synthesized
atacctctcttctccattcgga

SEQ ID NO: 848206 - DNA, 22 bp, Artificial Sequence
  chemically synthesized
ttcatacctctcttctccattc

SEQ ID NO: 848207 - DNA, 22 bp, Artificial Sequence
  chemically synthesized
attcatacctctcttctccatt

SEQ ID NO: 848208 - DNA, 22 bp, Artificial Sequence
  chemically synthesized
ggatatatatttattcatacct

SEQ ID NO: 848209 - DNA, 22 bp, Artificial Sequence
  chemically synthesized
aggatatatatttattcatacc

SEQ ID NO: 848210 - DNA, 22 bp, Artificial Sequence
  chemically synthesized
atgcaaatttaggatatatatt

SEQ ID NO: 848211 - DNA, 22 bp, Artificial Sequence
  chemically synthesized
gatgcaaatttaggatatatat

SEQ ID NO: 848212 - DNA, 22 bp, Artificial Sequence
  chemically synthesized
tgatgcaaatttaggatatata

SEQ ID NO: 848213 - DNA, 22 bp, Artificial Sequence
  chemically synthesized
caccattttgatgcaaatttag

SEQ ID NO: 848214 - DNA, 22 bp, Artificial Sequence
  chemically synthesized
aatttgcatcaaaatggtgtaa

SEQ ID NO: 848215 - DNA, 22 bp, Artificial Sequence
  chemically synthesized
gcatcaaaatggtgtaatggtt

SEQ ID NO: 848216 - DNA, 22 bp, Artificial Sequence
  chemically synthesized
catcaaaatggtgtaatggtta

SEQ ID NO: 848217 - DNA, 22 bp, Artificial Sequence
  chemically synthesized
tatgtacgtccaaaggtaacca

SEQ ID NO: 848218 - DNA, 22 bp, Artificial Sequence
  chemically synthesized
atatgtacgtccaaaggtaacc

SEQ ID NO: 848219 - DNA, 22 bp, Artificial Sequence
  chemically synthesized
cccttatatgtacgtccaaagg

SEQ ID NO: 848220 - DNA, 22 bp, Artificial Sequence
  chemically synthesized
ccccttatatgtacgtccaaag

SEQ ID NO: 848221 - DNA, 22 bp, Artificial Sequence
  chemically synthesized
tccccttatatgtacgtccaaa

SEQ ID NO: 848222 - DNA, 22 bp, Artificial Sequence
  chemically synthesized
ttccccttatatgtacgtccaa

SEQ ID NO: 848223 - DNA, 22 bp, Artificial Sequence
  chemically synthesized
tttccccttatatgtacgtcca

SEQ ID NO: 848224 - DNA, 22 bp, Artificial Sequence
  chemically synthesized
agcactttttccccttatatgt

SEQ ID NO: 848225 - DNA, 22 bp, Artificial Sequence
  chemically synthesized
cctttggacgtacatataaggg

SEQ ID NO: 848226 - DNA, 22 bp, Artificial Sequence
  chemically synthesized
ttaagcactttttccccttata

SEQ ID NO: 848227 - DNA, 22 bp, Artificial Sequence
  chemically synthesized
tggacgtacatataaggggaaa

SEQ ID NO: 848228 - DNA, 22 bp, Artificial Sequence
  chemically synthesized
ggacgtacatataaggggaaaa

SEQ ID NO: 848229 - DNA, 22 bp, Artificial Sequence
  chemically synthesized
gacgtacatataaggggaaaaa

SEQ ID NO: 848230 - DNA, 22 bp, Artificial Sequence
  chemically synthesized
gttgttaagcactttttcccct

SEQ ID NO: 848231 - DNA, 22 bp, Artificial Sequence
  chemically synthesized
aagaatgagacctagttgttaa

SEQ ID NO: 848232 - DNA, 22 bp, Artificial Sequence
  chemically synthesized
gaagaatgagacctagttgtta

SEQ ID NO: 848233 - DNA, 22 bp, Artificial Sequence
  chemically synthesized
tgaagaatgagacctagttgtt

SEQ ID NO: 848234 - DNA, 22 bp, Artificial Sequence
  chemically synthesized
ttttgaagaatgagacctagtt

SEQ ID NO: 848235 - DNA, 22 bp, Artificial Sequence
  chemically synthesized
attttgaagaatgagacctagt

SEQ ID NO: 848236 - DNA, 22 bp, Artificial Sequence
  chemically synthesized
tttattttgaagaatgagacct

SEQ ID NO: 848237 - DNA, 22 bp, Artificial Sequence
  chemically synthesized
aacaactaggtctcattcttca

SEQ ID NO: 848238 - DNA, 22 bp, Artificial Sequence
  chemically synthesized
acaactaggtctcattcttcaa

SEQ ID NO: 848239 - DNA, 22 bp, Artificial Sequence
  chemically synthesized
ggtctcattcttcaaaataaac

SEQ ID NO: 848240 - DNA, 22 bp, Artificial Sequence
  chemically synthesized
attcttcaaaataaacaacatc

SEQ ID NO: 848241 - DNA, 22 bp, Artificial Sequence
  chemically synthesized
agaaaatgtacaaaggatgttg

SEQ ID NO: 848242 - DNA, 22 bp, Artificial Sequence
  chemically synthesized
ttcaaaataaacaacatccttt

SEQ ID NO: 848243 - DNA, 22 bp, Artificial Sequence
  chemically synthesized
caaaataaacaacatcctttgt

SEQ ID NO: 848244 - DNA, 22 bp, Artificial Sequence
  chemically synthesized
ctgagaaaatgtacaaaggatg

SEQ ID NO: 848245 - DNA, 22 bp, Artificial Sequence
  chemically synthesized
aaaataaacaacatcctttgta

SEQ ID NO: 848246 - DNA, 22 bp, Artificial Sequence
  chemically synthesized
ccagacaactgctgagaaaatg

SEQ ID NO: 848247 - DNA, 22 bp, Artificial Sequence
  chemically synthesized
atctcccagacaactgctgaga

SEQ ID NO: 848248 - DNA, 22 bp, Artificial Sequence
  chemically synthesized
tgtacattttctcagcagttgt

SEQ ID NO: 848249 - DNA, 22 bp, Artificial Sequence
  chemically synthesized
gtacattttctcagcagttgtc

SEQ ID NO: 848250 - DNA, 22 bp, Artificial Sequence
  chemically synthesized
tacattttctcagcagttgtct

SEQ ID NO: 848251 - DNA, 22 bp, Artificial Sequence
  chemically synthesized
atgttgatctcccagacaactg

SEQ ID NO: 848252 - DNA, 22 bp, Artificial Sequence
  chemically synthesized
tctcagcagttgtctgggagat

SEQ ID NO: 848253 - DNA, 22 bp, Artificial Sequence
  chemically synthesized
ctcagcagttgtctgggagatc

SEQ ID NO: 848254 - DNA, 22 bp, Artificial Sequence
  chemically synthesized
tcagcagttgtctgggagatca

SEQ ID NO: 848255 - DNA, 22 bp, Artificial Sequence
  chemically synthesized
agcagttgtctgggagatcaac

SEQ ID NO: 848256 - DNA, 22 bp, Artificial Sequence
  chemically synthesized
agaagaaatagattaatgttga

SEQ ID NO: 848257 - DNA, 22 bp, Artificial Sequence
  chemically synthesized
tgagaagaaatagattaatgtt

SEQ ID NO: 848258 - DNA, 22 bp, Artificial Sequence
  chemically synthesized
tctgggagatcaacattaatct

SEQ ID NO: 848259 - DNA, 22 bp, Artificial Sequence
  chemically synthesized
ggagatcaacattaatctattt

SEQ ID NO: 848260 - DNA, 22 bp, Artificial Sequence
  chemically synthesized
ccagtcatataagttctgagaa

SEQ ID NO: 848261 - DNA, 22 bp, Artificial Sequence
  chemically synthesized
cccagtcatataagttctgaga

SEQ ID NO: 848262 - DNA, 22 bp, Artificial Sequence
  chemically synthesized
tcccagtcatataagttctgag

SEQ ID NO: 848263 - DNA, 22 bp, Artificial Sequence
  chemically synthesized
atctatttcttctcagaactta

SEQ ID NO: 848264 - DNA, 22 bp, Artificial Sequence
  chemically synthesized
ttcccagtcatataagttctga

SEQ ID NO: 848265 - DNA, 22 bp, Artificial Sequence
  chemically synthesized
tttcccagtcatataagttctg

SEQ ID NO: 848266 - DNA, 22 bp, Artificial Sequence
  chemically synthesized
tttcttctcagaacttatatga

SEQ ID NO: 848267 - DNA, 22 bp, Artificial Sequence
  chemically synthesized
tctttttcccagtcatataagt

SEQ ID NO: 848268 - DNA, 22 bp, Artificial Sequence
  chemically synthesized
atctttttcccagtcatataag

SEQ ID NO: 848269 - DNA, 22 bp, Artificial Sequence
  chemically synthesized
tatctttttcccagtcatataa

SEQ ID NO: 848270 - DNA, 22 bp, Artificial Sequence
  chemically synthesized
cttctcagaacttatatgactg

SEQ ID NO: 848271 - DNA, 22 bp, Artificial Sequence
  chemically synthesized
ttatctttttcccagtcatata

SEQ ID NO: 848272 - DNA, 22 bp, Artificial Sequence
  chemically synthesized
ttctcagaacttatatgactgg

SEQ ID NO: 848273 - DNA, 22 bp, Artificial Sequence
  chemically synthesized
ctcagaacttatatgactggga

SEQ ID NO: 848274 - DNA, 22 bp, Artificial Sequence
  chemically synthesized
tcagaacttatatgactgggaa

SEQ ID NO: 848275 - DNA, 22 bp, Artificial Sequence
  chemically synthesized
agaacttatatgactgggaaaa

SEQ ID NO: 848276 - DNA, 22 bp, Artificial Sequence
  chemically synthesized
atatgactgggaaaaagataaa

SEQ ID NO: 848277 - DNA, 22 bp, Artificial Sequence
  chemically synthesized
tatgactgggaaaaagataaaa

SEQ ID NO: 848278 - DNA, 22 bp, Artificial Sequence
  chemically synthesized
ggaaaaagataaaaatctgccc

SEQ ID NO: 848279 - DNA, 22 bp, Artificial Sequence
  chemically synthesized
aacacatagcacccaatcaagg

SEQ ID NO: 848280 - DNA, 22 bp, Artificial Sequence
  chemically synthesized
aaacacatagcacccaatcaag

SEQ ID NO: 848281 - DNA, 22 bp, Artificial Sequence
  chemically synthesized
cccttgattgggtgctatgtgt

SEQ ID NO: 848282 - DNA, 22 bp, Artificial Sequence
  chemically synthesized
aaccagagcttaaacacatagc

SEQ ID NO: 848283 - DNA, 22 bp, Artificial Sequence
  chemically synthesized
gattgggtgctatgtgtttaag

SEQ ID NO: 848284 - DNA, 22 bp, Artificial Sequence
  chemically synthesized
attgggtgctatgtgtttaagc

SEQ ID NO: 848285 - DNA, 22 bp, Artificial Sequence
  chemically synthesized
cagctaaaccagagcttaaaca

SEQ ID NO: 848286 - DNA, 22 bp, Artificial Sequence
  chemically synthesized
acagctaaaccagagcttaaac

SEQ ID NO: 848287 - DNA, 22 bp, Artificial Sequence
  chemically synthesized
ggtgctatgtgtttaagctctg

SEQ ID NO: 848288 - DNA, 22 bp, Artificial Sequence
  chemically synthesized
tgtgtttaagctctggtttagc

SEQ ID NO: 848289 - DNA, 22 bp, Artificial Sequence
  chemically synthesized
acaaatgatttacagctaaacc

SEQ ID NO: 848290 - DNA, 22 bp, Artificial Sequence
  chemically synthesized
cacaaatgatttacagctaaac

SEQ ID NO: 848291 - DNA, 22 bp, Artificial Sequence
  chemically synthesized
aagctctggtttagctgtaaat

SEQ ID NO: 848292 - DNA, 22 bp, Artificial Sequence
  chemically synthesized
agctctggtttagctgtaaatc

SEQ ID NO: 848293 - DNA, 22 bp, Artificial Sequence
  chemically synthesized
tggtttagctgtaaatcatttg

SEQ ID NO: 848294 - DNA, 22 bp, Artificial Sequence
  chemically synthesized
gtttagctgtaaatcatttgtg

SEQ ID NO: 848295 - DNA, 22 bp, Artificial Sequence
  chemically synthesized
ccaagaaatgatcttcacaaat

SEQ ID NO: 848296 - DNA, 22 bp, Artificial Sequence
  chemically synthesized
agctgtaaatcatttgtgaaga

SEQ ID NO: 848297 - DNA, 22 bp, Artificial Sequence
  chemically synthesized
gctgtaaatcatttgtgaagat

SEQ ID NO: 848298 - DNA, 22 bp, Artificial Sequence
  chemically synthesized
acctaccaagaaatgatcttca

SEQ ID NO: 848299 - DNA, 22 bp, Artificial Sequence
  chemically synthesized
taaatcatttgtgaagatcatt

SEQ ID NO: 848300 - DNA, 22 bp, Artificial Sequence
  chemically synthesized
cactcacctaccaagaaatgat

SEQ ID NO: 848301 - DNA, 22 bp, Artificial Sequence
  chemically synthesized
gtgaagatcatttcttggtagg

SEQ ID NO: 848302 - DNA, 22 bp, Artificial Sequence
  chemically synthesized
tgaagatcatttcttggtaggt

SEQ ID NO: 848303 - DNA, 22 bp, Artificial Sequence
  chemically synthesized
taatagcaattccactcaccta

SEQ ID NO: 848304 - DNA, 22 bp, Artificial Sequence
  chemically synthesized
tataatagcaattccactcacc

SEQ ID NO: 848305 - DNA, 22 bp, Artificial Sequence
  chemically synthesized
cttggtaggtgagtggaattgc

SEQ ID NO: 848306 - DNA, 22 bp, Artificial Sequence
  chemically synthesized
ttggtaggtgagtggaattgct

SEQ ID NO: 848307 - DNA, 22 bp, Artificial Sequence
  chemically synthesized
acactctataatagcaattcca

SEQ ID NO: 848308 - DNA, 22 bp, Artificial Sequence
  chemically synthesized
ggtaggtgagtggaattgctat

SEQ ID NO: 848309 - DNA, 22 bp, Artificial Sequence
  chemically synthesized
gtaggtgagtggaattgctatt

SEQ ID NO: 848310 - DNA, 22 bp, Artificial Sequence
  chemically synthesized
caagtatattaacactctataa

SEQ ID NO: 848311 - DNA, 22 bp, Artificial Sequence
  chemically synthesized
actgcaagtatattaacactct

SEQ ID NO: 848312 - DNA, 22 bp, Artificial Sequence
  chemically synthesized
cactgcaagtatattaacactc

SEQ ID NO: 848313 - DNA, 22 bp, Artificial Sequence
  chemically synthesized
ctattatagagtgttaatatac

SEQ ID NO: 848314 - DNA, 22 bp, Artificial Sequence
  chemically synthesized
ttatagagtgttaatatacttg

SEQ ID NO: 848315 - DNA, 22 bp, Artificial Sequence
  chemically synthesized
tagagtgttaatatacttgcag

SEQ ID NO: 848316 - DNA, 22 bp, Artificial Sequence
  chemically synthesized
cccccagcaacacttcactgca

SEQ ID NO: 848317 - DNA, 22 bp, Artificial Sequence
  chemically synthesized
ctacccccagcaacacttcact

SEQ ID NO: 848318 - DNA, 22 bp, Artificial Sequence
  chemically synthesized
atatacttgcagtgaagtgttg

SEQ ID NO: 848319 - DNA, 22 bp, Artificial Sequence
  chemically synthesized
acacctcctacccccagcaaca

SEQ ID NO: 848320 - DNA, 22 bp, Artificial Sequence
  chemically synthesized
gcagtgaagtgttgctgggggt

SEQ ID NO: 848321 - DNA, 22 bp, Artificial Sequence
  chemically synthesized
cagtgaagtgttgctgggggta

SEQ ID NO: 848322 - DNA, 22 bp, Artificial Sequence
  chemically synthesized
atcaatgtctaacacctcctac

SEQ ID NO: 848323 - DNA, 22 bp, Artificial Sequence
  chemically synthesized
ctgatcaatgtctaacacctcc

SEQ ID NO: 848324 - DNA, 22 bp, Artificial Sequence
  chemically synthesized
ctgggggtaggaggtgttagac

SEQ ID NO: 848325 - DNA, 22 bp, Artificial Sequence
  chemically synthesized
agctcctgatcaatgtctaaca

SEQ ID NO: 848326 - DNA, 22 bp, Artificial Sequence
  chemically synthesized
ggggtaggaggtgttagacatt

SEQ ID NO: 848327 - DNA, 22 bp, Artificial Sequence
  chemically synthesized
aagctcctgatcaatgtctaac

SEQ ID NO: 848328 - DNA, 22 bp, Artificial Sequence
  chemically synthesized
ttaagctcctgatcaatgtcta

SEQ ID NO: 848329 - DNA, 22 bp, Artificial Sequence
  chemically synthesized
atctcttaagctcctgatcaat

SEQ ID NO: 848330 - DNA, 22 bp, Artificial Sequence
  chemically synthesized
gacattgatcaggagcttaaga

SEQ ID NO: 848331 - DNA, 22 bp, Artificial Sequence
  chemically synthesized
atcaggagcttaagagatgagc

SEQ ID NO: 848332 - DNA, 22 bp, Artificial Sequence
  chemically synthesized
caacagcaaaaataaatagctc

SEQ ID NO: 848333 - DNA, 22 bp, Artificial Sequence
  chemically synthesized
acaacagcaaaaataaatagct

SEQ ID NO: 848334 - DNA, 22 bp, Artificial Sequence
  chemically synthesized
ttacaacagcaaaaataaatag

SEQ ID NO: 848335 - DNA, 22 bp, Artificial Sequence
  chemically synthesized
aagagatgagctatttattttt

SEQ ID NO: 848336 - DNA, 22 bp, Artificial Sequence
  chemically synthesized
agagatgagctatttatttttg

SEQ ID NO: 848337 - DNA, 22 bp, Artificial Sequence
  chemically synthesized
ctcttacaacagcaaaaataaa

SEQ ID NO: 848338 - DNA, 22 bp, Artificial Sequence
  chemically synthesized
gctcttacaacagcaaaaataa

SEQ ID NO: 848339 - DNA, 22 bp, Artificial Sequence
  chemically synthesized
tagaaatttgctcttacaacag

SEQ ID NO: 848340 - DNA, 22 bp, Artificial Sequence
  chemically synthesized
tttatttttgctgttgtaagag

SEQ ID NO: 848341 - DNA, 22 bp, Artificial Sequence
  chemically synthesized
ttatagaaatttgctcttacaa

SEQ ID NO: 848342 - DNA, 22 bp, Artificial Sequence
  chemically synthesized
attatagaaatttgctcttaca

SEQ ID NO: 848343 - DNA, 22 bp, Artificial Sequence
  chemically synthesized
atttttgctgttgtaagagcaa

SEQ ID NO: 848344 - DNA, 22 bp, Artificial Sequence
  chemically synthesized
tattatagaaatttgctcttac

SEQ ID NO: 848345 - DNA, 22 bp, Artificial Sequence
  chemically synthesized
tttttgctgttgtaagagcaaa

SEQ ID NO: 848346 - DNA, 22 bp, Artificial Sequence
  chemically synthesized
ttttattatagaaatttgctct

SEQ ID NO: 848347 - DNA, 22 bp, Artificial Sequence
  chemically synthesized
ttgctgttgtaagagcaaattt

SEQ ID NO: 848348 - DNA, 22 bp, Artificial Sequence
  chemically synthesized
tgctgttgtaagagcaaatttc

SEQ ID NO: 848349 - DNA, 22 bp, Artificial Sequence
  chemically synthesized
gctgttgtaagagcaaatttct

SEQ ID NO: 848350 - DNA, 22 bp, Artificial Sequence
  chemically synthesized
ctgttgtaagagcaaatttcta

SEQ ID NO: 848351 - DNA, 22 bp, Artificial Sequence
  chemically synthesized
ttgtaagagcaaatttctataa

SEQ ID NO: 848352 - DNA, 22 bp, Artificial Sequence
  chemically synthesized
taagagcaaatttctataataa

SEQ ID NO: 848353 - DNA, 22 bp, Artificial Sequence
  chemically synthesized
acagagaagcagaatcattgtt

SEQ ID NO: 848354 - DNA, 22 bp, Artificial Sequence
  chemically synthesized
gacagagaagcagaatcattgt

SEQ ID NO: 848355 - DNA, 22 bp, Artificial Sequence
  chemically synthesized
tgacagagaagcagaatcattg

SEQ ID NO: 848356 - DNA, 22 bp, Artificial Sequence
  chemically synthesized
ctataataaaacaatgattctg

SEQ ID NO: 848357 - DNA, 22 bp, Artificial Sequence
  chemically synthesized
ttgacagagaagcagaatcatt

SEQ ID NO: 848358 - DNA, 22 bp, Artificial Sequence
  chemically synthesized
tataataaaacaatgattctgc

SEQ ID NO: 848359 - DNA, 22 bp, Artificial Sequence
  chemically synthesized
tttgacagagaagcagaatcat

SEQ ID NO: 848360 - DNA, 22 bp, Artificial Sequence
  chemically synthesized
taataaaacaatgattctgctt

SEQ ID NO: 848361 - DNA, 22 bp, Artificial Sequence
  chemically synthesized
tgcttctctgtcaaaaaacacc

SEQ ID NO: 848362 - DNA, 22 bp, Artificial Sequence
  chemically synthesized
atgtcataaaatggtgtttttt

SEQ ID NO: 848363 - DNA, 22 bp, Artificial Sequence
  chemically synthesized
catgtcataaaatggtgttttt

SEQ ID NO: 848364 - DNA, 22 bp, Artificial Sequence
  chemically synthesized
cttctctgtcaaaaaacaccat

SEQ ID NO: 848365 - DNA, 22 bp, Artificial Sequence
  chemically synthesized
tcatgtcataaaatggtgtttt

SEQ ID NO: 848366 - DNA, 22 bp, Artificial Sequence
  chemically synthesized
ctctgtcaaaaaacaccatttt

SEQ ID NO: 848367 - DNA, 22 bp, Artificial Sequence
  chemically synthesized
tctgtcaaaaaacaccatttta

SEQ ID NO: 848368 - DNA, 22 bp, Artificial Sequence
  chemically synthesized
tgtcaaaaaacaccattttatg

SEQ ID NO: 848369 - DNA, 22 bp, Artificial Sequence
  chemically synthesized
tcaaaaaacaccattttatgac

SEQ ID NO: 848370 - DNA, 22 bp, Artificial Sequence
  chemically synthesized
aagagagctttcatgtcataaa

SEQ ID NO: 848371 - DNA, 22 bp, Artificial Sequence
  chemically synthesized
ctgaagagagctttcatgtcat

SEQ ID NO: 848372 - DNA, 22 bp, Artificial Sequence
  chemically synthesized
actgaagagagctttcatgtca

SEQ ID NO: 848373 - DNA, 22 bp, Artificial Sequence
  chemically synthesized
tttactgaagagagctttcatg

SEQ ID NO: 848374 - DNA, 22 bp, Artificial Sequence
  chemically synthesized
gtttactgaagagagctttcat

SEQ ID NO: 848375 - DNA, 22 bp, Artificial Sequence
  chemically synthesized
tgtttactgaagagagctttca

SEQ ID NO: 848376 - DNA, 22 bp, Artificial Sequence
  chemically synthesized
tttgtttactgaagagagcttt

SEQ ID NO: 848377 - DNA, 22 bp, Artificial Sequence
  chemically synthesized
tatgacatgaaagctctcttca

SEQ ID NO: 848378 - DNA, 22 bp, Artificial Sequence
  chemically synthesized
ttctttgtttactgaagagagc

SEQ ID NO: 848379 - DNA, 22 bp, Artificial Sequence
  chemically synthesized
atgacatgaaagctctcttcag

SEQ ID NO: 848380 - DNA, 22 bp, Artificial Sequence
  chemically synthesized
tgacatgaaagctctcttcagt

SEQ ID NO: 848381 - DNA, 22 bp, Artificial Sequence
  chemically synthesized
caataacagtctgttctttgtt

SEQ ID NO: 848382 - DNA, 22 bp, Artificial Sequence
  chemically synthesized
tccaataacagtctgttctttg

SEQ ID NO: 848383 - DNA, 22 bp, Artificial Sequence
  chemically synthesized
tcttcagtaaacaaagaacaga

SEQ ID NO: 848384 - DNA, 22 bp, Artificial Sequence
  chemically synthesized
ttcagtaaacaaagaacagact

SEQ ID NO: 848385 - DNA, 22 bp, Artificial Sequence
  chemically synthesized
cagtaaacaaagaacagactgt

SEQ ID NO: 848386 - DNA, 22 bp, Artificial Sequence
  chemically synthesized
cgttctccaataacagtctgtt

SEQ ID NO: 848387 - DNA, 22 bp, Artificial Sequence
  chemically synthesized
agtaaacaaagaacagactgtt

SEQ ID NO: 848388 - DNA, 22 bp, Artificial Sequence
  chemically synthesized
acgttctccaataacagtctgt

SEQ ID NO: 848389 - DNA, 22 bp, Artificial Sequence
  chemically synthesized
tacgttctccaataacagtctg

SEQ ID NO: 848390 - DNA, 22 bp, Artificial Sequence
  chemically synthesized
ttacgttctccaataacagtct

SEQ ID NO: 848391 - DNA, 22 bp, Artificial Sequence
  chemically synthesized
taatttttacgttctccaataa

SEQ ID NO: 848392 - DNA, 22 bp, Artificial Sequence
  chemically synthesized
ttgtaatttttacgttctccaa

SEQ ID NO: 848393 - DNA, 22 bp, Artificial Sequence
  chemically synthesized
tattgtaatttttacgttctcc

SEQ ID NO: 848394 - DNA, 22 bp, Artificial Sequence
  chemically synthesized
ttattggagaacgtaaaaatta

SEQ ID NO: 848395 - DNA, 22 bp, Artificial Sequence
  chemically synthesized
ttggagaacgtaaaaattacaa

SEQ ID NO: 848396 - DNA, 22 bp, Artificial Sequence
  chemically synthesized
gagaacgtaaaaattacaatag

SEQ ID NO: 848397 - DNA, 22 bp, Artificial Sequence
  chemically synthesized
tagggaaatatattctattgta

SEQ ID NO: 848398 - DNA, 22 bp, Artificial Sequence
  chemically synthesized
ctatagggaaatatattctatt

SEQ ID NO: 848399 - DNA, 22 bp, Artificial Sequence
  chemically synthesized
tgctcctatagggaaatatatt

SEQ ID NO: 848400 - DNA, 22 bp, Artificial Sequence
  chemically synthesized
caatagaatatatttccctata

SEQ ID NO: 848401 - DNA, 22 bp, Artificial Sequence
  chemically synthesized
aaggccactgtgctcctatagg

SEQ ID NO: 848402 - DNA, 22 bp, Artificial Sequence
  chemically synthesized
agttaaaggccactgtgctcct

SEQ ID NO: 848403 - DNA, 22 bp, Artificial Sequence
  chemically synthesized
ccctataggagcacagtggcct

SEQ ID NO: 848404 - DNA, 22 bp, Artificial Sequence
  chemically synthesized
cagctgagttaaaggccactgt

SEQ ID NO: 848405 - DNA, 22 bp, Artificial Sequence
  chemically synthesized
cctataggagcacagtggcctt

SEQ ID NO: 848406 - DNA, 22 bp, Artificial Sequence
  chemically synthesized
taggagcacagtggcctttaac

SEQ ID NO: 848407 - DNA, 22 bp, Artificial Sequence
  chemically synthesized
taagttccagctgagttaaagg

SEQ ID NO: 848408 - DNA, 22 bp, Artificial Sequence
  chemically synthesized
tcatactgtaagttccagctga

SEQ ID NO: 848409 - DNA, 22 bp, Artificial Sequence
  chemically synthesized
aaagctgtcatactgtaagttc

SEQ ID NO: 848410 - DNA, 22 bp, Artificial Sequence
  chemically synthesized
taactcagctggaacttacagt

SEQ ID NO: 848411 - DNA, 22 bp, Artificial Sequence
  chemically synthesized
aaaagctgtcatactgtaagtt

SEQ ID NO: 848412 - DNA, 22 bp, Artificial Sequence
  chemically synthesized
aactcagctggaacttacagta

SEQ ID NO: 848413 - DNA, 22 bp, Artificial Sequence
  chemically synthesized
taaaagctgtcatactgtaagt

SEQ ID NO: 848414 - DNA, 22 bp, Artificial Sequence
  chemically synthesized
actcagctggaacttacagtat

SEQ ID NO: 848415 - DNA, 22 bp, Artificial Sequence
  chemically synthesized
ctttaaaagctgtcatactgta

SEQ ID NO: 848416 - DNA, 22 bp, Artificial Sequence
  chemically synthesized
cctttaaaagctgtcatactgt

SEQ ID NO: 848417 - DNA, 22 bp, Artificial Sequence
  chemically synthesized
agctggaacttacagtatgaca

SEQ ID NO: 848418 - DNA, 22 bp, Artificial Sequence
  chemically synthesized
gaacttacagtatgacagcttt

SEQ ID NO: 848419 - DNA, 22 bp, Artificial Sequence
  chemically synthesized
acagtatgacagcttttaaagg

SEQ ID NO: 848420 - DNA, 22 bp, Artificial Sequence
  chemically synthesized
cagtatgacagcttttaaagga

SEQ ID NO: 848421 - DNA, 22 bp, Artificial Sequence
  chemically synthesized
cccatagaatatgtcccttcct

SEQ ID NO: 848422 - DNA, 22 bp, Artificial Sequence
  chemically synthesized
ttaaaggaagggacatattcta

SEQ ID NO: 848423 - DNA, 22 bp, Artificial Sequence
  chemically synthesized
aaatcctccccatagaatatgt

SEQ ID NO: 848424 - DNA, 22 bp, Artificial Sequence
  chemically synthesized
taaaggaagggacatattctat

SEQ ID NO: 848425 - DNA, 22 bp, Artificial Sequence
  chemically synthesized
aaaggaagggacatattctatg

SEQ ID NO: 848426 - DNA, 22 bp, Artificial Sequence
  chemically synthesized
aaggaagggacatattctatgg

SEQ ID NO: 848427 - DNA, 22 bp, Artificial Sequence
  chemically synthesized
tatggggaggattttagacata

SEQ ID NO: 848428 - DNA, 22 bp, Artificial Sequence
  chemically synthesized
gggaatagacaagtatgtctaa

SEQ ID NO: 848429 - DNA, 22 bp, Artificial Sequence
  chemically synthesized
tggggaggattttagacatact

SEQ ID NO: 848430 - DNA, 22 bp, Artificial Sequence
  chemically synthesized
gtacggcctagggaatagacaa

SEQ ID NO: 848431 - DNA, 22 bp, Artificial Sequence
  chemically synthesized
tagacatacttgtctattccct

SEQ ID NO: 848432 - DNA, 22 bp, Artificial Sequence
  chemically synthesized
agacatacttgtctattcccta

SEQ ID NO: 848433 - DNA, 22 bp, Artificial Sequence
  chemically synthesized
gacatacttgtctattccctag

SEQ ID NO: 848434 - DNA, 22 bp, Artificial Sequence
  chemically synthesized
gtctattccctaggccgtacta

SEQ ID NO: 848435 - DNA, 22 bp, Artificial Sequence
  chemically synthesized
tatgataagaattagtacggcc

SEQ ID NO: 848436 - DNA, 22 bp, Artificial Sequence
  chemically synthesized
tctattccctaggccgtactaa

SEQ ID NO: 848437 - DNA, 22 bp, Artificial Sequence
  chemically synthesized
atatgataagaattagtacggc

SEQ ID NO: 848438 - DNA, 22 bp, Artificial Sequence
  chemically synthesized
tatatgataagaattagtacgg

SEQ ID NO: 848439 - DNA, 22 bp, Artificial Sequence
  chemically synthesized
ttatatgataagaattagtacg

SEQ ID NO: 848440 - DNA, 22 bp, Artificial Sequence
  chemically synthesized
ttccctaggccgtactaattct

SEQ ID NO: 848441 - DNA, 22 bp, Artificial Sequence
  chemically synthesized
cctaggccgtactaattcttat

SEQ ID NO: 848442 - DNA, 22 bp, Artificial Sequence
  chemically synthesized
ggccgtactaattcttatcata

SEQ ID NO: 848443 - DNA, 22 bp, Artificial Sequence
  chemically synthesized
atgtagacccatttttatatga

SEQ ID NO: 848444 - DNA, 22 bp, Artificial Sequence
  chemically synthesized
attcttatcatataaaaatggg

SEQ ID NO: 848445 - DNA, 22 bp, Artificial Sequence
  chemically synthesized
ttatcatataaaaatgggtcta

SEQ ID NO: 848446 - DNA, 22 bp, Artificial Sequence
  chemically synthesized
atcatataaaaatgggtctaca

SEQ ID NO: 848447 - DNA, 22 bp, Artificial Sequence
  chemically synthesized
tcatataaaaatgggtctacat

SEQ ID NO: 848448 - DNA, 22 bp, Artificial Sequence
  chemically synthesized
gcaccatgtgctaatgtagacc

SEQ ID NO: 848449 - DNA, 22 bp, Artificial Sequence
  chemically synthesized
cattagcacatggtgccagtat

SEQ ID NO: 848450 - DNA, 22 bp, Artificial Sequence
  chemically synthesized
gcacatggtgccagtatatcac

SEQ ID NO: 848451 - DNA, 22 bp, Artificial Sequence
  chemically synthesized
atgccgcagtgcaagtgtgtga

SEQ ID NO: 848452 - DNA, 22 bp, Artificial Sequence
  chemically synthesized
catgccgcagtgcaagtgtgtg

SEQ ID NO: 848453 - DNA, 22 bp, Artificial Sequence
  chemically synthesized
tcatgccgcagtgcaagtgtgt

SEQ ID NO: 848454 - DNA, 22 bp, Artificial Sequence
  chemically synthesized
ctttcatgccgcagtgcaagtg

SEQ ID NO: 848455 - DNA, 22 bp, Artificial Sequence
  chemically synthesized
ggctcctttcatgccgcagtgc

SEQ ID NO: 848456 - DNA, 22 bp, Artificial Sequence
  chemically synthesized
aagctgggctcctttcatgccg

SEQ ID NO: 848457 - DNA, 22 bp, Artificial Sequence
  chemically synthesized
gcactgcggcatgaaaggagcc

SEQ ID NO: 848458 - DNA, 22 bp, Artificial Sequence
  chemically synthesized
cccctcaagctgggctcctttc

SEQ ID NO: 848459 - DNA, 22 bp, Artificial Sequence
  chemically synthesized
cactgcggcatgaaaggagccc

SEQ ID NO: 848460 - DNA, 22 bp, Artificial Sequence
  chemically synthesized
tccccctcaagctgggctcctt

SEQ ID NO: 848461 - DNA, 22 bp, Artificial Sequence
  chemically synthesized
cggcatgaaaggagcccagctt

SEQ ID NO: 848462 - DNA, 22 bp, Artificial Sequence
  chemically synthesized
tgccacagaaagcagttctccc

SEQ ID NO: 848463 - DNA, 22 bp, Artificial Sequence
  chemically synthesized
gaactatgccacagaaagcagt

SEQ ID NO: 848464 - DNA, 22 bp, Artificial Sequence
  chemically synthesized
ggaactatgccacagaaagcag

SEQ ID NO: 848465 - DNA, 22 bp, Artificial Sequence
  chemically synthesized
gagggggagaactgctttctgt

SEQ ID NO: 848466 - DNA, 22 bp, Artificial Sequence
  chemically synthesized
agggggagaactgctttctgtg

SEQ ID NO: 848467 - DNA, 22 bp, Artificial Sequence
  chemically synthesized
cttggaactatgccacagaaag

SEQ ID NO: 848468 - DNA, 22 bp, Artificial Sequence
  chemically synthesized
gcttggaactatgccacagaaa

SEQ ID NO: 848469 - DNA, 22 bp, Artificial Sequence
  chemically synthesized
ctttctgtggcatagttccaag

SEQ ID NO: 848470 - DNA, 22 bp, Artificial Sequence
  chemically synthesized
tgccatgtgtttgcttggaact

SEQ ID NO: 848471 - DNA, 22 bp, Artificial Sequence
  chemically synthesized
gtgccatgtgtttgcttggaac

SEQ ID NO: 848472 - DNA, 22 bp, Artificial Sequence
  chemically synthesized
tctgtggcatagttccaagcaa

SEQ ID NO: 848473 - DNA, 22 bp, Artificial Sequence
  chemically synthesized
ctgtggcatagttccaagcaaa

SEQ ID NO: 848474 - DNA, 22 bp, Artificial Sequence
  chemically synthesized
tgtggcatagttccaagcaaac

SEQ ID NO: 848475 - DNA, 22 bp, Artificial Sequence
  chemically synthesized
atttgtgccatgtgtttgcttg

SEQ ID NO: 848476 - DNA, 22 bp, Artificial Sequence
  chemically synthesized
tggcatagttccaagcaaacac

SEQ ID NO: 848477 - DNA, 22 bp, Artificial Sequence
  chemically synthesized
catttgtgccatgtgtttgctt

SEQ ID NO: 848478 - DNA, 22 bp, Artificial Sequence
  chemically synthesized
caagcaaacacatggcacaaat

SEQ ID NO: 848479 - DNA, 22 bp, Artificial Sequence
  chemically synthesized
agaatcggcttcatttgtgcca

SEQ ID NO: 848480 - DNA, 22 bp, Artificial Sequence
  chemically synthesized
ctcagaatcggcttcatttgtg

SEQ ID NO: 848481 - DNA, 22 bp, Artificial Sequence
  chemically synthesized
catattcctcagaatcggcttc

SEQ ID NO: 848482 - DNA, 22 bp, Artificial Sequence
  chemically synthesized
ccatattcctcagaatcggctt

SEQ ID NO: 848483 - DNA, 22 bp, Artificial Sequence
  chemically synthesized
tcaaacagtacataaagtttcc

SEQ ID NO: 848484 - DNA, 22 bp, Artificial Sequence
  chemically synthesized
tgaggaatatggaaactttatg

SEQ ID NO: 848485 - DNA, 22 bp, Artificial Sequence
  chemically synthesized
aggaatatggaaactttatgta

SEQ ID NO: 848486 - DNA, 22 bp, Artificial Sequence
  chemically synthesized
cctatcaaacagtacataaagt

SEQ ID NO: 848487 - DNA, 22 bp, Artificial Sequence
  chemically synthesized
ccctatcaaacagtacataaag

SEQ ID NO: 848488 - DNA, 22 bp, Artificial Sequence
  chemically synthesized
tgcacatttccctatcaaacag

SEQ ID NO: 848489 - DNA, 22 bp, Artificial Sequence
  chemically synthesized
tatgtactgtttgatagggaaa

SEQ ID NO: 848490 - DNA, 22 bp, Artificial Sequence
  chemically synthesized
atgtactgtttgatagggaaat

SEQ ID NO: 848491 - DNA, 22 bp, Artificial Sequence
  chemically synthesized
gaagctgtgcacatttccctat

SEQ ID NO: 848492 - DNA, 22 bp, Artificial Sequence
  chemically synthesized
tgtactgtttgatagggaaatg

SEQ ID NO: 848493 - DNA, 22 bp, Artificial Sequence
  chemically synthesized
agaagctgtgcacatttcccta

SEQ ID NO: 848494 - DNA, 22 bp, Artificial Sequence
  chemically synthesized
tttgatagggaaatgtgcacag

SEQ ID NO: 848495 - DNA, 22 bp, Artificial Sequence
  chemically synthesized
accgtttagaagctgtgcacat

SEQ ID NO: 848496 - DNA, 22 bp, Artificial Sequence
  chemically synthesized
gatagggaaatgtgcacagctt

SEQ ID NO: 848497 - DNA, 22 bp, Artificial Sequence
  chemically synthesized
atagggaaatgtgcacagcttc

SEQ ID NO: 848498 - DNA, 22 bp, Artificial Sequence
  chemically synthesized
gaagctcaccgtttagaagctg

SEQ ID NO: 848499 - DNA, 22 bp, Artificial Sequence
  chemically synthesized
gagcagaactagaagctcaccg

SEQ ID NO: 848500 - DNA, 22 bp, Artificial Sequence
  chemically synthesized
ggagcagaactagaagctcacc

SEQ ID NO: 848501 - DNA, 22 bp, Artificial Sequence
  chemically synthesized
ttggagcagaactagaagctca

SEQ ID NO: 848502 - DNA, 22 bp, Artificial Sequence
  chemically synthesized
ttcttggagcagaactagaagc

SEQ ID NO: 848503 - DNA, 22 bp, Artificial Sequence
  chemically synthesized
ctaaacggtgagcttctagttc

SEQ ID NO: 848504 - DNA, 22 bp, Artificial Sequence
  chemically synthesized
gttcttggagcagaactagaag

SEQ ID NO: 848505 - DNA, 22 bp, Artificial Sequence
  chemically synthesized
taaacggtgagcttctagttct

SEQ ID NO: 848506 - DNA, 22 bp, Artificial Sequence
  chemically synthesized
aacggtgagcttctagttctgc

SEQ ID NO: 848507 - DNA, 22 bp, Artificial Sequence
  chemically synthesized
tacttgttcttggagcagaact

SEQ ID NO: 848508 - DNA, 22 bp, Artificial Sequence
  chemically synthesized
attgtacttgttcttggagcag

SEQ ID NO: 848509 - DNA, 22 bp, Artificial Sequence
  chemically synthesized
ctagttctgctccaagaacaag

SEQ ID NO: 848510 - DNA, 22 bp, Artificial Sequence
  chemically synthesized
tagttctgctccaagaacaagt

SEQ ID NO: 848511 - DNA, 22 bp, Artificial Sequence
  chemically synthesized
agaattgattgtacttgttctt

SEQ ID NO: 848512 - DNA, 22 bp, Artificial Sequence
  chemically synthesized
aagaattgattgtacttgttct

SEQ ID NO: 848513 - DNA, 22 bp, Artificial Sequence
  chemically synthesized
gttctgctccaagaacaagtac

SEQ ID NO: 848514 - DNA, 22 bp, Artificial Sequence
  chemically synthesized
tgctccaagaacaagtacaatc

SEQ ID NO: 848515 - DNA, 22 bp, Artificial Sequence
  chemically synthesized
ctccaagaacaagtacaatcaa

SEQ ID NO: 848516 - DNA, 22 bp, Artificial Sequence
  chemically synthesized
caagaacaagtacaatcaattc

SEQ ID NO: 848517 - DNA, 22 bp, Artificial Sequence
  chemically synthesized
cagaaaccacttaagaattgat

SEQ ID NO: 848518 - DNA, 22 bp, Artificial Sequence
  chemically synthesized
ggaacacaacattacagaaacc

SEQ ID NO: 848519 - DNA, 22 bp, Artificial Sequence
  chemically synthesized
ggttaggaacacaacattacag

SEQ ID NO: 848520 - DNA, 22 bp, Artificial Sequence
  chemically synthesized
ttaagtggtttctgtaatgttg

SEQ ID NO: 848521 - DNA, 22 bp, Artificial Sequence
  chemically synthesized
aagtggtttctgtaatgttgtg

SEQ ID NO: 848522 - DNA, 22 bp, Artificial Sequence
  chemically synthesized
agtggtttctgtaatgttgtgt

SEQ ID NO: 848523 - DNA, 22 bp, Artificial Sequence
  chemically synthesized
ctgtaatgttgtgttcctaacc

SEQ ID NO: 848524 - DNA, 22 bp, Artificial Sequence
  chemically synthesized
tgtaatgttgtgttcctaaccg

SEQ ID NO: 848525 - DNA, 22 bp, Artificial Sequence
  chemically synthesized
taatgttgtgttcctaaccgag

SEQ ID NO: 848526 - DNA, 22 bp, Artificial Sequence
  chemically synthesized
taatgtaaacagctcggttagg

SEQ ID NO: 848527 - DNA, 22 bp, Artificial Sequence
  chemically synthesized
cctataatgtaaacagctcggt

SEQ ID NO: 848528 - DNA, 22 bp, Artificial Sequence
  chemically synthesized
ccctataatgtaaacagctcgg

SEQ ID NO: 848529 - DNA, 22 bp, Artificial Sequence
  chemically synthesized
tgttcctaaccgagctgtttac

SEQ ID NO: 848530 - DNA, 22 bp, Artificial Sequence
  chemically synthesized
acacttccctataatgtaaaca

SEQ ID NO: 848531 - DNA, 22 bp, Artificial Sequence
  chemically synthesized
aacacttccctataatgtaaac

SEQ ID NO: 848532 - DNA, 22 bp, Artificial Sequence
  chemically synthesized
ctaaccgagctgtttacattat

SEQ ID NO: 848533 - DNA, 22 bp, Artificial Sequence
  chemically synthesized
accgagctgtttacattatagg

SEQ ID NO: 848534 - DNA, 22 bp, Artificial Sequence
  chemically synthesized
aacttaacacttccctataatg

SEQ ID NO: 848535 - DNA, 22 bp, Artificial Sequence
  chemically synthesized
tttacattatagggaagtgtta

SEQ ID NO: 848536 - DNA, 22 bp, Artificial Sequence
  chemically synthesized
acattatagggaagtgttaagt

SEQ ID NO: 848537 - DNA, 22 bp, Artificial Sequence
  chemically synthesized
cattatagggaagtgttaagtt

SEQ ID NO: 848538 - DNA, 22 bp, Artificial Sequence
  chemically synthesized
ataaaacagaaaattaaactta

SEQ ID NO: 848539 - DNA, 22 bp, Artificial Sequence
  chemically synthesized
tagggaagtgttaagtttaatt

SEQ ID NO: 848540 - DNA, 22 bp, Artificial Sequence
  chemically synthesized
cctaataaaacagaaaattaaa

SEQ ID NO: 848541 - DNA, 22 bp, Artificial Sequence
  chemically synthesized
agtttaattttctgttttatta

SEQ ID NO: 848542 - DNA, 22 bp, Artificial Sequence
  chemically synthesized
aattttctgttttattaggcag

SEQ ID NO: 848543 - DNA, 22 bp, Artificial Sequence
  chemically synthesized
ataatgagaaacctgcctaata

SEQ ID NO: 848544 - DNA, 22 bp, Artificial Sequence
  chemically synthesized
attttctgttttattaggcagg

SEQ ID NO: 848545 - DNA, 22 bp, Artificial Sequence
  chemically synthesized
ttcataatgagaaacctgccta

SEQ ID NO: 848546 - DNA, 22 bp, Artificial Sequence
  chemically synthesized
tctgttttattaggcaggtttc

SEQ ID NO: 848547 - DNA, 22 bp, Artificial Sequence
  chemically synthesized
ctgttttattaggcaggtttct

SEQ ID NO: 848548 - DNA, 22 bp, Artificial Sequence
  chemically synthesized
ttgttcataatgagaaacctgc

SEQ ID NO: 848549 - DNA, 22 bp, Artificial Sequence
  chemically synthesized
tgttttattaggcaggtttctc

SEQ ID NO: 848550 - DNA, 22 bp, Artificial Sequence
  chemically synthesized
ttttattaggcaggtttctcat

SEQ ID NO: 848551 - DNA, 22 bp, Artificial Sequence
  chemically synthesized
tattaggcaggtttctcattat

SEQ ID NO: 848552 - DNA, 22 bp, Artificial Sequence
  chemically synthesized
aaattattgttcataatgagaa

SEQ ID NO: 848553 - DNA, 22 bp, Artificial Sequence
  chemically synthesized
attaggcaggtttctcattatg

SEQ ID NO: 848554 - DNA, 22 bp, Artificial Sequence
  chemically synthesized
ttaggcaggtttctcattatga

SEQ ID NO: 848555 - DNA, 22 bp, Artificial Sequence
  chemically synthesized
ggcaggtttctcattatgaaca

SEQ ID NO: 848556 - DNA, 22 bp, Artificial Sequence
  chemically synthesized
aaaggtattgaaattattgttc

SEQ ID NO: 848557 - DNA, 22 bp, Artificial Sequence
  chemically synthesized
aaaaggtattgaaattattgtt

SEQ ID NO: 848558 - DNA, 22 bp, Artificial Sequence
  chemically synthesized
ctcattatgaacaataatttca

SEQ ID NO: 848559 - DNA, 22 bp, Artificial Sequence
  chemically synthesized
cttaaaaggtattgaaattatt

SEQ ID NO: 848560 - DNA, 22 bp, Artificial Sequence
  chemically synthesized
tcattatgaacaataatttcaa

SEQ ID NO: 848561 - DNA, 22 bp, Artificial Sequence
  chemically synthesized
attatgaacaataatttcaata

SEQ ID NO: 848562 - DNA, 22 bp, Artificial Sequence
  chemically synthesized
aattacttaaaaggtattgaaa

SEQ ID NO: 848563 - DNA, 22 bp, Artificial Sequence
  chemically synthesized
aaattacttaaaaggtattgaa

SEQ ID NO: 848564 - DNA, 22 bp, Artificial Sequence
  chemically synthesized
tgaacaataatttcaatacctt

SEQ ID NO: 848565 - DNA, 22 bp, Artificial Sequence
  chemically synthesized
taaattacttaaaaggtattga

SEQ ID NO: 848566 - DNA, 22 bp, Artificial Sequence
  chemically synthesized
ttaaattacttaaaaggtattg

SEQ ID NO: 848567 - DNA, 22 bp, Artificial Sequence
  chemically synthesized
tttttaaattacttaaaaggta

SEQ ID NO: 848568 - DNA, 22 bp, Artificial Sequence
  chemically synthesized
atttttaaattacttaaaaggt

SEQ ID NO: 848569 - DNA, 22 bp, Artificial Sequence
  chemically synthesized
cttatttttaaattacttaaaa

SEQ ID NO: 848570 - DNA, 22 bp, Artificial Sequence
  chemically synthesized
ctgcttatttttaaattactta

SEQ ID NO: 848571 - DNA, 22 bp, Artificial Sequence
  chemically synthesized
caataccttttaagtaatttaa

SEQ ID NO: 848572 - DNA, 22 bp, Artificial Sequence
  chemically synthesized
aataccttttaagtaatttaaa

SEQ ID NO: 848573 - DNA, 22 bp, Artificial Sequence
  chemically synthesized
cagggattactgcttattttta

SEQ ID NO: 848574 - DNA, 22 bp, Artificial Sequence
  chemically synthesized
ttaagtaatttaaaaataagca

SEQ ID NO: 848575 - DNA, 22 bp, Artificial Sequence
  chemically synthesized
tgcagggattactgcttatttt

SEQ ID NO: 848576 - DNA, 22 bp, Artificial Sequence
  chemically synthesized
taagtaatttaaaaataagcag

SEQ ID NO: 848577 - DNA, 22 bp, Artificial Sequence
  chemically synthesized
ctgcagggattactgcttattt

SEQ ID NO: 848578 - DNA, 22 bp, Artificial Sequence
  chemically synthesized
aagtaatttaaaaataagcagt

SEQ ID NO: 848579 - DNA, 22 bp, Artificial Sequence
  chemically synthesized
tctgcagggattactgcttatt

SEQ ID NO: 848580 - DNA, 22 bp, Artificial Sequence
  chemically synthesized
agtaatttaaaaataagcagta

SEQ ID NO: 848581 - DNA, 22 bp, Artificial Sequence
  chemically synthesized
cagcctttctgcagggattact

SEQ ID NO: 848582 - DNA, 22 bp, Artificial Sequence
  chemically synthesized
aaaaataagcagtaatccctgc

SEQ ID NO: 848583 - DNA, 22 bp, Artificial Sequence
  chemically synthesized
aaaataagcagtaatccctgca

SEQ ID NO: 848584 - DNA, 22 bp, Artificial Sequence
  chemically synthesized
gagaaatggtactgcagccttt

SEQ ID NO: 848585 - DNA, 22 bp, Artificial Sequence
  chemically synthesized
cagaaaggctgcagtaccattt

SEQ ID NO: 848586 - DNA, 22 bp, Artificial Sequence
  chemically synthesized
cagtaccatttctctagtgatt

SEQ ID NO: 848587 - DNA, 22 bp, Artificial Sequence
  chemically synthesized
ctctagtgattcctttttctgt

SEQ ID NO: 848588 - DNA, 22 bp, Artificial Sequence
  chemically synthesized
tacaaataaaacacagaaaaag

SEQ ID NO: 848589 - DNA, 22 bp, Artificial Sequence
  chemically synthesized
tctagtgattcctttttctgtg

SEQ ID NO: 848590 - DNA, 22 bp, Artificial Sequence
  chemically synthesized
atacaaataaaacacagaaaaa

SEQ ID NO: 848591 - DNA, 22 bp, Artificial Sequence
  chemically synthesized
tagtgattcctttttctgtgtt

SEQ ID NO: 848592 - DNA, 22 bp, Artificial Sequence
  chemically synthesized
gtgattcctttttctgtgtttt

SEQ ID NO: 848593 - DNA, 22 bp, Artificial Sequence
  chemically synthesized
accttatacaaataaaacacag

SEQ ID NO: 848594 - DNA, 22 bp, Artificial Sequence
  chemically synthesized
ctcaccttatacaaataaaaca

SEQ ID NO: 848595 - DNA, 22 bp, Artificial Sequence
  chemically synthesized
gctcaccttatacaaataaaac

SEQ ID NO: 848596 - DNA, 22 bp, Artificial Sequence
  chemically synthesized
tgctcaccttatacaaataaaa

SEQ ID NO: 848597 - DNA, 22 bp, Artificial Sequence
  chemically synthesized
ctttttctgtgttttatttgta

SEQ ID NO: 848598 - DNA, 22 bp, Artificial Sequence
  chemically synthesized
tttctgtgttttatttgtataa

SEQ ID NO: 848599 - DNA, 22 bp, Artificial Sequence
  chemically synthesized
ttctgtgttttatttgtataag

SEQ ID NO: 848600 - DNA, 22 bp, Artificial Sequence
  chemically synthesized
tctgtgttttatttgtataagg

SEQ ID NO: 848601 - DNA, 22 bp, Artificial Sequence
  chemically synthesized
ctgtgttttatttgtataaggt

SEQ ID NO: 848602 - DNA, 22 bp, Artificial Sequence
  chemically synthesized
tgtgttttatttgtataaggtg

SEQ ID NO: 848603 - DNA, 22 bp, Artificial Sequence
  chemically synthesized
tgttttatttgtataaggtgag

SEQ ID NO: 848604 - DNA, 22 bp, Artificial Sequence
  chemically synthesized
tatttgtataaggtgagcaaaa

SEQ ID NO: 848605 - DNA, 22 bp, Artificial Sequence
  chemically synthesized
atttgtataaggtgagcaaaat

SEQ ID NO: 848606 - DNA, 22 bp, Artificial Sequence
  chemically synthesized
tttgtataaggtgagcaaaatt

SEQ ID NO: 848607 - DNA, 22 bp, Artificial Sequence
  chemically synthesized
gtataaggtgagcaaaattgct

SEQ ID NO: 848608 - DNA, 22 bp, Artificial Sequence
  chemically synthesized
tataaggtgagcaaaattgctt

SEQ ID NO: 848609 - DNA, 22 bp, Artificial Sequence
  chemically synthesized
aggcaacaaagaataagcaatt

SEQ ID NO: 848610 - DNA, 22 bp, Artificial Sequence
  chemically synthesized
tgaggcaacaaagaataagcaa

SEQ ID NO: 848611 - DNA, 22 bp, Artificial Sequence
  chemically synthesized
aagtctctgaggcaacaaagaa

SEQ ID NO: 848612 - DNA, 22 bp, Artificial Sequence
  chemically synthesized
cttattctttgttgcctcagag

SEQ ID NO: 848613 - DNA, 22 bp, Artificial Sequence
  chemically synthesized
atgccactaaagtctctgaggc

SEQ ID NO: 848614 - DNA, 22 bp, Artificial Sequence
  chemically synthesized
attctttgttgcctcagagact

SEQ ID NO: 848615 - DNA, 22 bp, Artificial Sequence
  chemically synthesized
ttctttgttgcctcagagactt

SEQ ID NO: 848616 - DNA, 22 bp, Artificial Sequence
  chemically synthesized
gcctcatgccactaaagtctct

SEQ ID NO: 848617 - DNA, 22 bp, Artificial Sequence
  chemically synthesized
tttgttgcctcagagactttag

SEQ ID NO: 848618 - DNA, 22 bp, Artificial Sequence
  chemically synthesized
tgttgcctcagagactttagtg

SEQ ID NO: 848619 - DNA, 22 bp, Artificial Sequence
  chemically synthesized
gttgcctcagagactttagtgg

SEQ ID NO: 848620 - DNA, 22 bp, Artificial Sequence
  chemically synthesized
cctagcctcatgccactaaagt

SEQ ID NO: 848621 - DNA, 22 bp, Artificial Sequence
  chemically synthesized
ttgcctcagagactttagtggc

SEQ ID NO: 848622 - DNA, 22 bp, Artificial Sequence
  chemically synthesized
tgcctagcctcatgccactaaa

SEQ ID NO: 848623 - DNA, 22 bp, Artificial Sequence
  chemically synthesized
cctcagagactttagtggcatg

SEQ ID NO: 848624 - DNA, 22 bp, Artificial Sequence
  chemically synthesized
tctctgcctagcctcatgccac

SEQ ID NO: 848625 - DNA, 22 bp, Artificial Sequence
  chemically synthesized
gtctctgcctagcctcatgcca

SEQ ID NO: 848626 - DNA, 22 bp, Artificial Sequence
  chemically synthesized
agagactttagtggcatgaggc

SEQ ID NO: 848627 - DNA, 22 bp, Artificial Sequence
  chemically synthesized
tgtctctgcctagcctcatgcc

SEQ ID NO: 848628 - DNA, 22 bp, Artificial Sequence
  chemically synthesized
ttgtctctgcctagcctcatgc

SEQ ID NO: 848629 - DNA, 22 bp, Artificial Sequence
  chemically synthesized
tagtggcatgaggctaggcaga

SEQ ID NO: 848630 - DNA, 22 bp, Artificial Sequence
  chemically synthesized
tcagtttttgtctctgcctagc

SEQ ID NO: 848631 - DNA, 22 bp, Artificial Sequence
  chemically synthesized
agtggcatgaggctaggcagag

SEQ ID NO: 848632 - DNA, 22 bp, Artificial Sequence
  chemically synthesized
gtggcatgaggctaggcagaga

SEQ ID NO: 848633 - DNA, 22 bp, Artificial Sequence
  chemically synthesized
tgattatcagtttttgtctctg

SEQ ID NO: 848634 - DNA, 22 bp, Artificial Sequence
  chemically synthesized
atgattatcagtttttgtctct

SEQ ID NO: 848635 - DNA, 22 bp, Artificial Sequence
  chemically synthesized
tttatgattatcagtttttgtc

SEQ ID NO: 848636 - DNA, 22 bp, Artificial Sequence
  chemically synthesized
atttatgattatcagtttttgt

SEQ ID NO: 848637 - DNA, 22 bp, Artificial Sequence
  chemically synthesized
atttatttatgattatcagttt

SEQ ID NO: 848638 - DNA, 22 bp, Artificial Sequence
  chemically synthesized
ggcagagacaaaaactgataat

SEQ ID NO: 848639 - DNA, 22 bp, Artificial Sequence
  chemically synthesized
ataatcataaataaatcaacac

SEQ ID NO: 848640 - DNA, 22 bp, Artificial Sequence
  chemically synthesized
gaaccacccaatagtgttgatt

SEQ ID NO: 848641 - DNA, 22 bp, Artificial Sequence
  chemically synthesized
gatattggaaccacccaatagt

SEQ ID NO: 848642 - DNA, 22 bp, Artificial Sequence
  chemically synthesized
agatactggatattggaaccac

SEQ ID NO: 848643 - DNA, 22 bp, Artificial Sequence
  chemically synthesized
ttgggtggttccaatatccagt

SEQ ID NO: 848644 - DNA, 22 bp, Artificial Sequence
  chemically synthesized
ggtggttccaatatccagtatc

SEQ ID NO: 848645 - DNA, 22 bp, Artificial Sequence
  chemically synthesized
caatatccagtatctcaatgtt

SEQ ID NO: 848646 - DNA, 22 bp, Artificial Sequence
  chemically synthesized
aatgttctctgccctttgtctc

SEQ ID NO: 848647 - DNA, 22 bp, Artificial Sequence
  chemically synthesized
atatagcagaaagagacaaagg

SEQ ID NO: 848648 - DNA, 22 bp, Artificial Sequence
  chemically synthesized
tctgccctttgtctctttctgc

SEQ ID NO: 848649 - DNA, 22 bp, Artificial Sequence
  chemically synthesized
tgccctttgtctctttctgcta

SEQ ID NO: 848650 - DNA, 22 bp, Artificial Sequence
  chemically synthesized
ccctttgtctctttctgctata

SEQ ID NO: 848651 - DNA, 22 bp, Artificial Sequence
  chemically synthesized
agacagatcattaatatagcag

SEQ ID NO: 848652 - DNA, 22 bp, Artificial Sequence
  chemically synthesized
tgtctctttctgctatattaat

SEQ ID NO: 848653 - DNA, 22 bp, Artificial Sequence
  chemically synthesized
gtctctttctgctatattaatg

SEQ ID NO: 848654 - DNA, 22 bp, Artificial Sequence
  chemically synthesized
tctctttctgctatattaatga

SEQ ID NO: 848655 - DNA, 22 bp, Artificial Sequence
  chemically synthesized
taaaattaagacagatcattaa

SEQ ID NO: 848656 - DNA, 22 bp, Artificial Sequence
  chemically synthesized
tttctgctatattaatgatctg

SEQ ID NO: 848657 - DNA, 22 bp, Artificial Sequence
  chemically synthesized
gtaaaattaagacagatcatta

SEQ ID NO: 848658 - DNA, 22 bp, Artificial Sequence
  chemically synthesized
tctgctatattaatgatctgtc

SEQ ID NO: 848659 - DNA, 22 bp, Artificial Sequence
  chemically synthesized
ctgctatattaatgatctgtct

SEQ ID NO: 848660 - DNA, 22 bp, Artificial Sequence
  chemically synthesized
tgctatattaatgatctgtctt

SEQ ID NO: 848661 - DNA, 22 bp, Artificial Sequence
  chemically synthesized
ctatattaatgatctgtcttaa

SEQ ID NO: 848662 - DNA, 22 bp, Artificial Sequence
  chemically synthesized
tattaatgatctgtcttaattt

SEQ ID NO: 848663 - DNA, 22 bp, Artificial Sequence
  chemically synthesized
cagaaaacttgtaaaattaaga

SEQ ID NO: 848664 - DNA, 22 bp, Artificial Sequence
  chemically synthesized
acagaaaacttgtaaaattaag

SEQ ID NO: 848665 - DNA, 22 bp, Artificial Sequence
  chemically synthesized
atgatctgtcttaattttacaa

SEQ ID NO: 848666 - DNA, 22 bp, Artificial Sequence
  chemically synthesized
tcttacagaaaacttgtaaaat

SEQ ID NO: 848667 - DNA, 22 bp, Artificial Sequence
  chemically synthesized
ctatcttacagaaaacttgtaa

SEQ ID NO: 848668 - DNA, 22 bp, Artificial Sequence
  chemically synthesized
tcttaattttacaagttttctg

SEQ ID NO: 848669 - DNA, 22 bp, Artificial Sequence
  chemically synthesized
tctactatcttacagaaaactt

SEQ ID NO: 848670 - DNA, 22 bp, Artificial Sequence
  chemically synthesized
tgtctactatcttacagaaaac

SEQ ID NO: 848671 - DNA, 22 bp, Artificial Sequence
  chemically synthesized
aattttacaagttttctgtaag

SEQ ID NO: 848672 - DNA, 22 bp, Artificial Sequence
  chemically synthesized
attttacaagttttctgtaaga

SEQ ID NO: 848673 - DNA, 22 bp, Artificial Sequence
  chemically synthesized
ttctgtctactatcttacagaa

SEQ ID NO: 848674 - DNA, 22 bp, Artificial Sequence
  chemically synthesized
tacaagttttctgtaagatagt

SEQ ID NO: 848675 - DNA, 22 bp, Artificial Sequence
  chemically synthesized
acaagttttctgtaagatagta

SEQ ID NO: 848676 - DNA, 22 bp, Artificial Sequence
  chemically synthesized
caagttttctgtaagatagtag

SEQ ID NO: 848677 - DNA, 22 bp, Artificial Sequence
  chemically synthesized
agtaacacctattctgtctact

SEQ ID NO: 848678 - DNA, 22 bp, Artificial Sequence
  chemically synthesized
tctgtaagatagtagacagaat

SEQ ID NO: 848679 - DNA, 22 bp, Artificial Sequence
  chemically synthesized
ctgtaagatagtagacagaata

SEQ ID NO: 848680 - DNA, 22 bp, Artificial Sequence
  chemically synthesized
tgtaagatagtagacagaatag

SEQ ID NO: 848681 - DNA, 22 bp, Artificial Sequence
  chemically synthesized
acctcagtaacacctattctgt

SEQ ID NO: 848682 - DNA, 22 bp, Artificial Sequence
  chemically synthesized
taagatagtagacagaataggt

SEQ ID NO: 848683 - DNA, 22 bp, Artificial Sequence
  chemically synthesized
cacctcagtaacacctattctg

SEQ ID NO: 848684 - DNA, 22 bp, Artificial Sequence
  chemically synthesized
aagccttcacctcagtaacacc

SEQ ID NO: 848685 - DNA, 22 bp, Artificial Sequence
  chemically synthesized
gattgaagccttcacctcagta

SEQ ID NO: 848686 - DNA, 22 bp, Artificial Sequence
  chemically synthesized
ggattgaagccttcacctcagt

SEQ ID NO: 848687 - DNA, 22 bp, Artificial Sequence
  chemically synthesized
tagtttggattgaagccttcac

SEQ ID NO: 848688 - DNA, 22 bp, Artificial Sequence
  chemically synthesized
gtagtttggattgaagccttca

SEQ ID NO: 848689 - DNA, 22 bp, Artificial Sequence
  chemically synthesized
tgtagtttggattgaagccttc

SEQ ID NO: 848690 - DNA, 22 bp, Artificial Sequence
  chemically synthesized
gttttgtagtttggattgaagc

SEQ ID NO: 848691 - DNA, 22 bp, Artificial Sequence
  chemically synthesized
ctgaggtgaaggcttcaatcca

SEQ ID NO: 848692 - DNA, 22 bp, Artificial Sequence
  chemically synthesized
aggtgaaggcttcaatccaaac

SEQ ID NO: 848693 - DNA, 22 bp, Artificial Sequence
  chemically synthesized
cctagttttgtagtttggattg

SEQ ID NO: 848694 - DNA, 22 bp, Artificial Sequence
  chemically synthesized
ggctacctagttttgtagtttg

SEQ ID NO: 848695 - DNA, 22 bp, Artificial Sequence
  chemically synthesized
taggctacctagttttgtagtt

SEQ ID NO: 848696 - DNA, 22 bp, Artificial Sequence
  chemically synthesized
cctctaggctacctagttttgt

SEQ ID NO: 848697 - DNA, 22 bp, Artificial Sequence
  chemically synthesized
caatccaaactacaaaactagg

SEQ ID NO: 848698 - DNA, 22 bp, Artificial Sequence
  chemically synthesized
aatccaaactacaaaactaggt

SEQ ID NO: 848699 - DNA, 22 bp, Artificial Sequence
  chemically synthesized
ttgcctctaggctacctagttt

SEQ ID NO: 848700 - DNA, 22 bp, Artificial Sequence
  chemically synthesized
gctgttgcctctaggctaccta

SEQ ID NO: 848701 - DNA, 22 bp, Artificial Sequence
  chemically synthesized
caaaactaggtagcctagaggc

SEQ ID NO: 848702 - DNA, 22 bp, Artificial Sequence
  chemically synthesized
ggtagcctagaggcaacagcta

SEQ ID NO: 848703 - DNA, 22 bp, Artificial Sequence
  chemically synthesized
tgaaccaaaagcatggaattag

SEQ ID NO: 848704 - DNA, 22 bp, Artificial Sequence
  chemically synthesized
gtgaaccaaaagcatggaatta

SEQ ID NO: 848705 - DNA, 22 bp, Artificial Sequence
  chemically synthesized
gaggcaacagctaattccatgc

SEQ ID NO: 848706 - DNA, 22 bp, Artificial Sequence
  chemically synthesized
tgtgaaccaaaagcatggaatt

SEQ ID NO: 848707 - DNA, 22 bp, Artificial Sequence
  chemically synthesized
ctttgtgaaccaaaagcatgga

SEQ ID NO: 848708 - DNA, 22 bp, Artificial Sequence
  chemically synthesized
gcattcctttgtgaaccaaaag

SEQ ID NO: 848709 - DNA, 22 bp, Artificial Sequence
  chemically synthesized
attccatgcttttggttcacaa

SEQ ID NO: 848710 - DNA, 22 bp, Artificial Sequence
  chemically synthesized
catgcttttggttcacaaagga

SEQ ID NO: 848711 - DNA, 22 bp, Artificial Sequence
  chemically synthesized
tgtgtattagcattcctttgtg

SEQ ID NO: 848712 - DNA, 22 bp, Artificial Sequence
  chemically synthesized
gtgtgtattagcattcctttgt

SEQ ID NO: 848713 - DNA, 22 bp, Artificial Sequence
  chemically synthesized
cttgtgtgtattagcattcctt

SEQ ID NO: 848714 - DNA, 22 bp, Artificial Sequence
  chemically synthesized
ttggttcacaaaggaatgctaa

SEQ ID NO: 848715 - DNA, 22 bp, Artificial Sequence
  chemically synthesized
tggttcacaaaggaatgctaat

SEQ ID NO: 848716 - DNA, 22 bp, Artificial Sequence
  chemically synthesized
ttacttgtgtgtattagcattc

SEQ ID NO: 848717 - DNA, 22 bp, Artificial Sequence
  chemically synthesized
ggttcacaaaggaatgctaata

SEQ ID NO: 848718 - DNA, 22 bp, Artificial Sequence
  chemically synthesized
gttcacaaaggaatgctaatac

SEQ ID NO: 848719 - DNA, 22 bp, Artificial Sequence
  chemically synthesized
ttattacttgtgtgtattagca

SEQ ID NO: 848720 - DNA, 22 bp, Artificial Sequence
  chemically synthesized
gttattacttgtgtgtattagc

SEQ ID NO: 848721 - DNA, 22 bp, Artificial Sequence
  chemically synthesized
tgttattacttgtgtgtattag

SEQ ID NO: 848722 - DNA, 22 bp, Artificial Sequence
  chemically synthesized
acaaaggaatgctaatacacac

SEQ ID NO: 848723 - DNA, 22 bp, Artificial Sequence
  chemically synthesized
ttttgttattacttgtgtgtat

SEQ ID NO: 848724 - DNA, 22 bp, Artificial Sequence
  chemically synthesized
gttttgttattacttgtgtgta

SEQ ID NO: 848725 - DNA, 22 bp, Artificial Sequence
  chemically synthesized
tgagtttgttttgttattactt

SEQ ID NO: 848726 - DNA, 22 bp, Artificial Sequence
  chemically synthesized
atacacacaagtaataacaaaa

SEQ ID NO: 848727 - DNA, 22 bp, Artificial Sequence
  chemically synthesized
agtagcacatgtactgtgagtt

SEQ ID NO: 848728 - DNA, 22 bp, Artificial Sequence
  chemically synthesized
cagtagcacatgtactgtgagt

SEQ ID NO: 848729 - DNA, 22 bp, Artificial Sequence
  chemically synthesized
ttcagtagcacatgtactgtga

SEQ ID NO: 848730 - DNA, 22 bp, Artificial Sequence
  chemically synthesized
ccaacacctcttcagtagcaca

SEQ ID NO: 848731 - DNA, 22 bp, Artificial Sequence
  chemically synthesized
acagtacatgtgctactgaaga

SEQ ID NO: 848732 - DNA, 22 bp, Artificial Sequence
  chemically synthesized
atgctcccaacacctcttcagt

SEQ ID NO: 848733 - DNA, 22 bp, Artificial Sequence
  chemically synthesized
aatgctcccaacacctcttcag

SEQ ID NO: 848734 - DNA, 22 bp, Artificial Sequence
  chemically synthesized
tacgaatatttaatgctcccaa

SEQ ID NO: 848735 - DNA, 22 bp, Artificial Sequence
  chemically synthesized
ctgaagaggtgttgggagcatt

SEQ ID NO: 848736 - DNA, 22 bp, Artificial Sequence
  chemically synthesized
gtacgaatatttaatgctccca

SEQ ID NO: 848737 - DNA, 22 bp, Artificial Sequence
  chemically synthesized
tgtacgaatatttaatgctccc

SEQ ID NO: 848738 - DNA, 22 bp, Artificial Sequence
  chemically synthesized
aagaggtgttgggagcattaaa

SEQ ID NO: 848739 - DNA, 22 bp, Artificial Sequence
  chemically synthesized
ccctttgtacgaatatttaatg

SEQ ID NO: 848740 - DNA, 22 bp, Artificial Sequence
  chemically synthesized
tgctgccctttgtacgaatatt

SEQ ID NO: 848741 - DNA, 22 bp, Artificial Sequence
  chemically synthesized
gtgctgccctttgtacgaatat

SEQ ID NO: 848742 - DNA, 22 bp, Artificial Sequence
  chemically synthesized
tgtgctgccctttgtacgaata

SEQ ID NO: 848743 - DNA, 22 bp, Artificial Sequence
  chemically synthesized
ggagcattaaatattcgtacaa

SEQ ID NO: 848744 - DNA, 22 bp, Artificial Sequence
  chemically synthesized
ccattttgtgctgccctttgta

SEQ ID NO: 848745 - DNA, 22 bp, Artificial Sequence
  chemically synthesized
aatattcgtacaaagggcagca

SEQ ID NO: 848746 - DNA, 22 bp, Artificial Sequence
  chemically synthesized
acctcccattttgtgctgccct

SEQ ID NO: 848747 - DNA, 22 bp, Artificial Sequence
  chemically synthesized
aacctcccattttgtgctgccc

SEQ ID NO: 848748 - DNA, 22 bp, Artificial Sequence
  chemically synthesized
taacctcccattttgtgctgcc

SEQ ID NO: 848749 - DNA, 22 bp, Artificial Sequence
  chemically synthesized
ttaacctcccattttgtgctgc

SEQ ID NO: 848750 - DNA, 22 bp, Artificial Sequence
  chemically synthesized
tttaacctcccattttgtgctg

SEQ ID NO: 848751 - DNA, 22 bp, Artificial Sequence
  chemically synthesized
gtacaaagggcagcacaaaatg

SEQ ID NO: 848752 - DNA, 22 bp, Artificial Sequence
  chemically synthesized
attttttaacctcccattttgt

SEQ ID NO: 848753 - DNA, 22 bp, Artificial Sequence
  chemically synthesized
aattttttaacctcccattttg

SEQ ID NO: 848754 - DNA, 22 bp, Artificial Sequence
  chemically synthesized
cttaattttttaacctcccatt

SEQ ID NO: 848755 - DNA, 22 bp, Artificial Sequence
  chemically synthesized
atgttgcttaattttttaacct

SEQ ID NO: 848756 - DNA, 22 bp, Artificial Sequence
  chemically synthesized
ctaatgttgcttaattttttaa

SEQ ID NO: 848757 - DNA, 22 bp, Artificial Sequence
  chemically synthesized
aggttcctaatgttgcttaatt

SEQ ID NO: 848758 - DNA, 22 bp, Artificial Sequence
  chemically synthesized
tcaggttcctaatgttgcttaa

SEQ ID NO: 848759 - DNA, 22 bp, Artificial Sequence
  chemically synthesized
catctctcaggttcctaatgtt

SEQ ID NO: 848760 - DNA, 22 bp, Artificial Sequence
  chemically synthesized
aaaaattaagcaacattaggaa

SEQ ID NO: 848761 - DNA, 22 bp, Artificial Sequence
  chemically synthesized
gttgcatctctcaggttcctaa

SEQ ID NO: 848762 - DNA, 22 bp, Artificial Sequence
  chemically synthesized
attagttgcatctctcaggttc

SEQ ID NO: 848763 - DNA, 22 bp, Artificial Sequence
  chemically synthesized
agcaacattaggaacctgagag

SEQ ID NO: 848764 - DNA, 22 bp, Artificial Sequence
  chemically synthesized
gttaattagttgcatctctcag

SEQ ID NO: 848765 - DNA, 22 bp, Artificial Sequence
  chemically synthesized
ggaacctgagagatgcaactaa

SEQ ID NO: 848766 - DNA, 22 bp, Artificial Sequence
  chemically synthesized
aggccaaactggttaattagtt

SEQ ID NO: 848767 - DNA, 22 bp, Artificial Sequence
  chemically synthesized
ttaaggccaaactggttaatta

SEQ ID NO: 848768 - DNA, 22 bp, Artificial Sequence
  chemically synthesized
agagatgcaactaattaaccag

SEQ ID NO: 848769 - DNA, 22 bp, Artificial Sequence
  chemically synthesized
attaaggccaaactggttaatt

SEQ ID NO: 848770 - DNA, 22 bp, Artificial Sequence
  chemically synthesized
attaaccagtttggccttaata

SEQ ID NO: 848771 - DNA, 22 bp, Artificial Sequence
  chemically synthesized
cagcatggatatttattaaggc

SEQ ID NO: 848772 - DNA, 22 bp, Artificial Sequence
  chemically synthesized
accagtttggccttaataaata

SEQ ID NO: 848773 - DNA, 22 bp, Artificial Sequence
  chemically synthesized
aaatattacagcatggatattt

SEQ ID NO: 848774 - DNA, 22 bp, Artificial Sequence
  chemically synthesized
ggccttaataaatatccatgct

SEQ ID NO: 848775 - DNA, 22 bp, Artificial Sequence
  chemically synthesized
ttaaaatattacagcatggata

SEQ ID NO: 848776 - DNA, 22 bp, Artificial Sequence
  chemically synthesized
gccttaataaatatccatgctg

SEQ ID NO: 848777 - DNA, 22 bp, Artificial Sequence
  chemically synthesized
ctattaaaatattacagcatgg

SEQ ID NO: 848778 - DNA, 22 bp, Artificial Sequence
  chemically synthesized
aataaatatccatgctgtaata

SEQ ID NO: 848779 - DNA, 22 bp, Artificial Sequence
  chemically synthesized
ataaatatccatgctgtaatat

SEQ ID NO: 848780 - DNA, 22 bp, Artificial Sequence
  chemically synthesized
ggggcagatattactattaaaa

SEQ ID NO: 848781 - DNA, 22 bp, Artificial Sequence
  chemically synthesized
taatattttaatagtaatatct

SEQ ID NO: 848782 - DNA, 22 bp, Artificial Sequence
  chemically synthesized
taatagtaatatctgcccctaa

SEQ ID NO: 848783 - DNA, 22 bp, Artificial Sequence
  chemically synthesized
aatagtaatatctgcccctaat

SEQ ID NO: 848784 - DNA, 22 bp, Artificial Sequence
  chemically synthesized
atagtaatatctgcccctaata

SEQ ID NO: 848785 - DNA, 22 bp, Artificial Sequence
  chemically synthesized
cataaatggatagatattaggg

SEQ ID NO: 848786 - DNA, 22 bp, Artificial Sequence
  chemically synthesized
cccctaatatctatccatttat

SEQ ID NO: 848787 - DNA, 22 bp, Artificial Sequence
  chemically synthesized
atatctatccatttatgtaata

SEQ ID NO: 848788 - DNA, 22 bp, Artificial Sequence
  chemically synthesized
tccatttatgtaatattcccca

SEQ ID NO: 848789 - DNA, 22 bp, Artificial Sequence
  chemically synthesized
agtagatagtaatggggaatat

SEQ ID NO: 848790 - DNA, 22 bp, Artificial Sequence
  chemically synthesized
gagtagatagtaatggggaata

SEQ ID NO: 848791 - DNA, 22 bp, Artificial Sequence
  chemically synthesized
atgtaatattccccattactat

SEQ ID NO: 848792 - DNA, 22 bp, Artificial Sequence
  chemically synthesized
tgtaatattccccattactatc

SEQ ID NO: 848793 - DNA, 22 bp, Artificial Sequence
  chemically synthesized
cccattactatctactcaaatg

SEQ ID NO: 848794 - DNA, 22 bp, Artificial Sequence
  chemically synthesized
cgagaaagtgtagcagaacatt

SEQ ID NO: 848795 - DNA, 22 bp, Artificial Sequence
  chemically synthesized
ctatctactcaaatgttctgct

SEQ ID NO: 848796 - DNA, 22 bp, Artificial Sequence
  chemically synthesized
acgagaaagtgtagcagaacat

SEQ ID NO: 848797 - DNA, 22 bp, Artificial Sequence
  chemically synthesized
tacgagaaagtgtagcagaaca

SEQ ID NO: 848798 - DNA, 22 bp, Artificial Sequence
  chemically synthesized
tctactcaaatgttctgctaca

SEQ ID NO: 848799 - DNA, 22 bp, Artificial Sequence
  chemically synthesized
acctttacgagaaagtgtagca

SEQ ID NO: 848800 - DNA, 22 bp, Artificial Sequence
  chemically synthesized
ctcaaatgttctgctacacttt

SEQ ID NO: 848801 - DNA, 22 bp, Artificial Sequence
  chemically synthesized
aaatgttctgctacactttctc

SEQ ID NO: 848802 - DNA, 22 bp, Artificial Sequence
  chemically synthesized
tgctacactttctcgtaaaggt

SEQ ID NO: 848803 - DNA, 22 bp, Artificial Sequence
  chemically synthesized
ctacactttctcgtaaaggtca

SEQ ID NO: 848804 - DNA, 22 bp, Artificial Sequence
  chemically synthesized
cactttctcgtaaaggtcagtg

SEQ ID NO: 848805 - DNA, 22 bp, Artificial Sequence
  chemically synthesized
taaggcagtggagagtcactga

SEQ ID NO: 848806 - DNA, 22 bp, Artificial Sequence
  chemically synthesized
tctcgtaaaggtcagtgactct

SEQ ID NO: 848807 - DNA, 22 bp, Artificial Sequence
  chemically synthesized
ctcgtaaaggtcagtgactctc

SEQ ID NO: 848808 - DNA, 22 bp, Artificial Sequence
  chemically synthesized
tcgtaaaggtcagtgactctcc

SEQ ID NO: 848809 - DNA, 22 bp, Artificial Sequence
  chemically synthesized
gtaaaggtcagtgactctccac

SEQ ID NO: 848810 - DNA, 22 bp, Artificial Sequence
  chemically synthesized
aattgtaaggcagtggagagtc

SEQ ID NO: 848811 - DNA, 22 bp, Artificial Sequence
  chemically synthesized
gaattgtaaggcagtggagagt

SEQ ID NO: 848812 - DNA, 22 bp, Artificial Sequence
  chemically synthesized
taggagtttgaattgtaaggca

SEQ ID NO: 848813 - DNA, 22 bp, Artificial Sequence
  chemically synthesized
cgctgtaggagtttgaattgta

SEQ ID NO: 848814 - DNA, 22 bp, Artificial Sequence
  chemically synthesized
tccactgccttacaattcaaac

SEQ ID NO: 848815 - DNA, 22 bp, Artificial Sequence
  chemically synthesized
ctacgctgtaggagtttgaatt

SEQ ID NO: 848816 - DNA, 22 bp, Artificial Sequence
  chemically synthesized
cactgccttacaattcaaactc

SEQ ID NO: 848817 - DNA, 22 bp, Artificial Sequence
  chemically synthesized
ccttacaattcaaactcctaca

SEQ ID NO: 848818 - DNA, 22 bp, Artificial Sequence
  chemically synthesized
tagtaattgctacgctgtagga

SEQ ID NO: 848819 - DNA, 22 bp, Artificial Sequence
  chemically synthesized
acaattcaaactcctacagcgt

SEQ ID NO: 848820 - DNA, 22 bp, Artificial Sequence
  chemically synthesized
caattcaaactcctacagcgta

SEQ ID NO: 848821 - DNA, 22 bp, Artificial Sequence
  chemically synthesized
ttgtagtaattgctacgctgta

SEQ ID NO: 848822 - DNA, 22 bp, Artificial Sequence
  chemically synthesized
gttgtagtaattgctacgctgt

SEQ ID NO: 848823 - DNA, 22 bp, Artificial Sequence
  chemically synthesized
ttgttgtagtaattgctacgct

SEQ ID NO: 848824 - DNA, 22 bp, Artificial Sequence
  chemically synthesized
aaactcctacagcgtagcaatt

SEQ ID NO: 848825 - DNA, 22 bp, Artificial Sequence
  chemically synthesized
ctcttgttgtagtaattgctac

SEQ ID NO: 848826 - DNA, 22 bp, Artificial Sequence
  chemically synthesized
ttactcttgttgtagtaattgc

SEQ ID NO: 848827 - DNA, 22 bp, Artificial Sequence
  chemically synthesized
ctacagcgtagcaattactaca

SEQ ID NO: 848828 - DNA, 22 bp, Artificial Sequence
  chemically synthesized
gttattactcttgttgtagtaa

SEQ ID NO: 848829 - DNA, 22 bp, Artificial Sequence
  chemically synthesized
cagcgtagcaattactacaaca

SEQ ID NO: 848830 - DNA, 22 bp, Artificial Sequence
  chemically synthesized
ctacaacaagagtaataactag

SEQ ID NO: 848831 - DNA, 22 bp, Artificial Sequence
  chemically synthesized
caacaagagtaataactagtta

SEQ ID NO: 848832 - DNA, 22 bp, Artificial Sequence
  chemically synthesized
gcacataggaaaagcacaataa

SEQ ID NO: 848833 - DNA, 22 bp, Artificial Sequence
  chemically synthesized
gttattgtgcttttcctatgtg

SEQ ID NO: 848834 - DNA, 22 bp, Artificial Sequence
  chemically synthesized
ttgtgcttttcctatgtgctag

SEQ ID NO: 848835 - DNA, 22 bp, Artificial Sequence
  chemically synthesized
tgcttttcctatgtgctagata

SEQ ID NO: 848836 - DNA, 22 bp, Artificial Sequence
  chemically synthesized
ttcctatgtgctagatattgca

SEQ ID NO: 848837 - DNA, 22 bp, Artificial Sequence
  chemically synthesized
tcctatgtgctagatattgcac

SEQ ID NO: 848838 - DNA, 22 bp, Artificial Sequence
  chemically synthesized
cctatgtgctagatattgcaca

SEQ ID NO: 848839 - DNA, 22 bp, Artificial Sequence
  chemically synthesized
ctatgtgctagatattgcacat

SEQ ID NO: 848840 - DNA, 22 bp, Artificial Sequence
  chemically synthesized
tgtgctagatattgcacatggg

SEQ ID NO: 848841 - DNA, 22 bp, Artificial Sequence
  chemically synthesized
caaatcaaatccatcccatgtg

SEQ ID NO: 848842 - DNA, 22 bp, Artificial Sequence
  chemically synthesized
gatattgcacatgggatggatt

SEQ ID NO: 848843 - DNA, 22 bp, Artificial Sequence
  chemically synthesized
gcacataattacaaatcaaatc

SEQ ID NO: 848844 - DNA, 22 bp, Artificial Sequence
  chemically synthesized
cacatgggatggatttgatttg

SEQ ID NO: 848845 - DNA, 22 bp, Artificial Sequence
  chemically synthesized
tgtacaatatctagcacataat

SEQ ID NO: 848846 - DNA, 22 bp, Artificial Sequence
  chemically synthesized
ctatgtacaatatctagcacat

SEQ ID NO: 848847 - DNA, 22 bp, Artificial Sequence
  chemically synthesized
gatttgtaattatgtgctagat

SEQ ID NO: 848848 - DNA, 22 bp, Artificial Sequence
  chemically synthesized
cctatgtacaatatctagcaca

SEQ ID NO: 848849 - DNA, 22 bp, Artificial Sequence
  chemically synthesized
atttgtaattatgtgctagata

SEQ ID NO: 848850 - DNA, 22 bp, Artificial Sequence
  chemically synthesized
tcctatgtacaatatctagcac

SEQ ID NO: 848851 - DNA, 22 bp, Artificial Sequence
  chemically synthesized
ttcctatgtacaatatctagca

SEQ ID NO: 848852 - DNA, 22 bp, Artificial Sequence
  chemically synthesized
gtaattatgtgctagatattgt

SEQ ID NO: 848853 - DNA, 22 bp, Artificial Sequence
  chemically synthesized
taattatgtgctagatattgta

SEQ ID NO: 848854 - DNA, 22 bp, Artificial Sequence
  chemically synthesized
tgcttttcctatgtacaatatc

SEQ ID NO: 848855 - DNA, 22 bp, Artificial Sequence
  chemically synthesized
tgtgctagatattgtacatagg

SEQ ID NO: 848856 - DNA, 22 bp, Artificial Sequence
  chemically synthesized
atatatattgtgcttttcctat

SEQ ID NO: 848857 - DNA, 22 bp, Artificial Sequence
  chemically synthesized
gatattgtacataggaaaagca

SEQ ID NO: 848858 - DNA, 22 bp, Artificial Sequence
  chemically synthesized
taagttaatatatattgtgctt

SEQ ID NO: 848859 - DNA, 22 bp, Artificial Sequence
  chemically synthesized
tacataggaaaagcacaatata

SEQ ID NO: 848860 - DNA, 22 bp, Artificial Sequence
  chemically synthesized
aaatggtgtctgtaagttaata

SEQ ID NO: 848861 - DNA, 22 bp, Artificial Sequence
  chemically synthesized
cctcaaatggtgtctgtaagtt

SEQ ID NO: 848862 - DNA, 22 bp, Artificial Sequence
  chemically synthesized
acctacctcaaatggtgtctgt

SEQ ID NO: 848863 - DNA, 22 bp, Artificial Sequence
  chemically synthesized
ttaacctacctcaaatggtgtc

SEQ ID NO: 848864 - DNA, 22 bp, Artificial Sequence
  chemically synthesized
acttacagacaccatttgaggt

SEQ ID NO: 848865 - DNA, 22 bp, Artificial Sequence
  chemically synthesized
acagacaccatttgaggtaggt

SEQ ID NO: 848866 - DNA, 22 bp, Artificial Sequence
  chemically synthesized
cagacaccatttgaggtaggtt

SEQ ID NO: 848867 - DNA, 22 bp, Artificial Sequence
  chemically synthesized
aggggtggtcattattaaccta

SEQ ID NO: 848868 - DNA, 22 bp, Artificial Sequence
  chemically synthesized
gaggtaggttaataatgaccac

SEQ ID NO: 848869 - DNA, 22 bp, Artificial Sequence
  chemically synthesized
aggtaggttaataatgaccacc

SEQ ID NO: 848870 - DNA, 22 bp, Artificial Sequence
  chemically synthesized
ataatgaccacccctcaatggt

SEQ ID NO: 848871 - DNA, 22 bp, Artificial Sequence
  chemically synthesized
taaaagggtgtaagtacagaac

SEQ ID NO: 848872 - DNA, 22 bp, Artificial Sequence
  chemically synthesized
tctataaaagggtgtaagtaca

SEQ ID NO: 848873 - DNA, 22 bp, Artificial Sequence
  chemically synthesized
gtctataaaagggtgtaagtac

SEQ ID NO: 848874 - DNA, 22 bp, Artificial Sequence
  chemically synthesized
aatggttctgtacttacaccct

SEQ ID NO: 848875 - DNA, 22 bp, Artificial Sequence
  chemically synthesized
cttgtctataaaagggtgtaag

SEQ ID NO: 848876 - DNA, 22 bp, Artificial Sequence
  chemically synthesized
ccttgtctataaaagggtgtaa

SEQ ID NO: 848877 - DNA, 22 bp, Artificial Sequence
  chemically synthesized
tccttgtctataaaagggtgta

SEQ ID NO: 848878 - DNA, 22 bp, Artificial Sequence
  chemically synthesized
attttccttgtctataaaaggg

SEQ ID NO: 848879 - DNA, 22 bp, Artificial Sequence
  chemically synthesized
cattttccttgtctataaaagg

SEQ ID NO: 848880 - DNA, 22 bp, Artificial Sequence
  chemically synthesized
tgtacttacacccttttataga

SEQ ID NO: 848881 - DNA, 22 bp, Artificial Sequence
  chemically synthesized
tacttacacccttttatagaca

SEQ ID NO: 848882 - DNA, 22 bp, Artificial Sequence
  chemically synthesized
cgtgcttcattttccttgtcta

SEQ ID NO: 848883 - DNA, 22 bp, Artificial Sequence
  chemically synthesized
acacccttttatagacaaggaa

SEQ ID NO: 848884 - DNA, 22 bp, Artificial Sequence
  chemically synthesized
cacccttttatagacaaggaaa

SEQ ID NO: 848885 - DNA, 22 bp, Artificial Sequence
  chemically synthesized
attccgtgcttcattttccttg

SEQ ID NO: 848886 - DNA, 22 bp, Artificial Sequence
  chemically synthesized
cattccgtgcttcattttcctt

SEQ ID NO: 848887 - DNA, 22 bp, Artificial Sequence
  chemically synthesized
ttatagacaaggaaaatgaagc

SEQ ID NO: 848888 - DNA, 22 bp, Artificial Sequence
  chemically synthesized
tatagacaaggaaaatgaagca

SEQ ID NO: 848889 - DNA, 22 bp, Artificial Sequence
  chemically synthesized
tgcttcattccgtgcttcattt

SEQ ID NO: 848890 - DNA, 22 bp, Artificial Sequence
  chemically synthesized
atagacaaggaaaatgaagcac

SEQ ID NO: 848891 - DNA, 22 bp, Artificial Sequence
  chemically synthesized
tagacaaggaaaatgaagcacg

SEQ ID NO: 848892 - DNA, 22 bp, Artificial Sequence
  chemically synthesized
ggcaaattatgcttcattccgt

SEQ ID NO: 848893 - DNA, 22 bp, Artificial Sequence
  chemically synthesized
gggcaaattatgcttcattccg

SEQ ID NO: 848894 - DNA, 22 bp, Artificial Sequence
  chemically synthesized
gtgaccttgggcaaattatgct

SEQ ID NO: 848895 - DNA, 22 bp, Artificial Sequence
  chemically synthesized
ggtgaccttgggcaaattatgc

SEQ ID NO: 848896 - DNA, 22 bp, Artificial Sequence
  chemically synthesized
gcttggtgaccttgggcaaatt

SEQ ID NO: 848897 - DNA, 22 bp, Artificial Sequence
  chemically synthesized
agcttggtgaccttgggcaaat

SEQ ID NO: 848898 - DNA, 22 bp, Artificial Sequence
  chemically synthesized
tagcttggtgaccttgggcaaa

SEQ ID NO: 848899 - DNA, 22 bp, Artificial Sequence
  chemically synthesized
ttagcttggtgaccttgggcaa

SEQ ID NO: 848900 - DNA, 22 bp, Artificial Sequence
  chemically synthesized
accaccttttagcttggtgacc

SEQ ID NO: 848901 - DNA, 22 bp, Artificial Sequence
  chemically synthesized
caccaccttttagcttggtgac

SEQ ID NO: 848902 - DNA, 22 bp, Artificial Sequence
  chemically synthesized
gcccaaggtcaccaagctaaaa

SEQ ID NO: 848903 - DNA, 22 bp, Artificial Sequence
  chemically synthesized
cccaaggtcaccaagctaaaag

SEQ ID NO: 848904 - DNA, 22 bp, Artificial Sequence
  chemically synthesized
caccttcaccaccttttagctt

SEQ ID NO: 848905 - DNA, 22 bp, Artificial Sequence
  chemically synthesized
ttccaccttcaccaccttttag

SEQ ID NO: 848906 - DNA, 22 bp, Artificial Sequence
  chemically synthesized
attccaccttcaccacctttta

SEQ ID NO: 848907 - DNA, 22 bp, Artificial Sequence
  chemically synthesized
tattccaccttcaccacctttt

SEQ ID NO: 848908 - DNA, 22 bp, Artificial Sequence
  chemically synthesized
aaaggtggtgaaggtggaataa

SEQ ID NO: 848909 - DNA, 22 bp, Artificial Sequence
  chemically synthesized
gaaaaggaggatatgggccatt

SEQ ID NO: 848910 - DNA, 22 bp, Artificial Sequence
  chemically synthesized
cgatgtaaaagagaaaaacact

SEQ ID NO: 848911 - DNA, 22 bp, Artificial Sequence
  chemically synthesized
cttttccagtgtttttctcttt

SEQ ID NO: 848912 - DNA, 22 bp, Artificial Sequence
  chemically synthesized
tagttacgatgtaaaagagaaa

SEQ ID NO: 848913 - DNA, 22 bp, Artificial Sequence
  chemically synthesized
ttccagtgtttttctcttttac

SEQ ID NO: 848914 - DNA, 22 bp, Artificial Sequence
  chemically synthesized
tccagtgtttttctcttttaca

SEQ ID NO: 848915 - DNA, 22 bp, Artificial Sequence
  chemically synthesized
ccagtgtttttctcttttacat

SEQ ID NO: 848916 - DNA, 22 bp, Artificial Sequence
  chemically synthesized
cagtgtttttctcttttacatc

SEQ ID NO: 848917 - DNA, 22 bp, Artificial Sequence
  chemically synthesized
cgaaattgtagttacgatgtaa

SEQ ID NO: 848918 - DNA, 22 bp, Artificial Sequence
  chemically synthesized
acgaaattgtagttacgatgta

SEQ ID NO: 848919 - DNA, 22 bp, Artificial Sequence
  chemically synthesized
cttacgaaattgtagttacgat

SEQ ID NO: 848920 - DNA, 22 bp, Artificial Sequence
  chemically synthesized
ttctcttttacatcgtaactac

SEQ ID NO: 848921 - DNA, 22 bp, Artificial Sequence
  chemically synthesized
tctcttttacatcgtaactaca

SEQ ID NO: 848922 - DNA, 22 bp, Artificial Sequence
  chemically synthesized
ctcttttacatcgtaactacaa

SEQ ID NO: 848923 - DNA, 22 bp, Artificial Sequence
  chemically synthesized
tcttttacatcgtaactacaat

SEQ ID NO: 848924 - DNA, 22 bp, Artificial Sequence
  chemically synthesized
ttttacatcgtaactacaattt

SEQ ID NO: 848925 - DNA, 22 bp, Artificial Sequence
  chemically synthesized
tagctgcttacgaaattgtagt

SEQ ID NO: 848926 - DNA, 22 bp, Artificial Sequence
  chemically synthesized
ttacatcgtaactacaatttcg

SEQ ID NO: 848927 - DNA, 22 bp, Artificial Sequence
  chemically synthesized
tacatcgtaactacaatttcgt

SEQ ID NO: 848928 - DNA, 22 bp, Artificial Sequence
  chemically synthesized
acatcgtaactacaatttcgta

SEQ ID NO: 848929 - DNA, 22 bp, Artificial Sequence
  chemically synthesized
catcgtaactacaatttcgtaa

SEQ ID NO: 848930 - DNA, 22 bp, Artificial Sequence
  chemically synthesized
cattatagctgcttacgaaatt

SEQ ID NO: 848931 - DNA, 22 bp, Artificial Sequence
  chemically synthesized
ggctacattatagctgcttacg

SEQ ID NO: 848932 - DNA, 22 bp, Artificial Sequence
  chemically synthesized
cggctacattatagctgcttac

SEQ ID NO: 848933 - DNA, 22 bp, Artificial Sequence
  chemically synthesized
caatttcgtaagcagctataat

SEQ ID NO: 848934 - DNA, 22 bp, Artificial Sequence
  chemically synthesized
gcccagcttcggctacattata

SEQ ID NO: 848935 - DNA, 22 bp, Artificial Sequence
  chemically synthesized
cgtaagcagctataatgtagcc

SEQ ID NO: 848936 - DNA, 22 bp, Artificial Sequence
  chemically synthesized
gtaagcagctataatgtagccg

SEQ ID NO: 848937 - DNA, 22 bp, Artificial Sequence
  chemically synthesized
taaagcatctagcccagcttcg

SEQ ID NO: 848938 - DNA, 22 bp, Artificial Sequence
  chemically synthesized
taatgtagccgaagctgggcta

SEQ ID NO: 848939 - DNA, 22 bp, Artificial Sequence
  chemically synthesized
aatgatgactataaagcatcta

SEQ ID NO: 848940 - DNA, 22 bp, Artificial Sequence
  chemically synthesized
ggattaaatgatgactataaag

SEQ ID NO: 848941 - DNA, 22 bp, Artificial Sequence
  chemically synthesized
ggctagatgctttatagtcatc

SEQ ID NO: 848942 - DNA, 22 bp, Artificial Sequence
  chemically synthesized
ttgggattaaatgatgactata

SEQ ID NO: 848943 - DNA, 22 bp, Artificial Sequence
  chemically synthesized
ttgttgggattaaatgatgact

SEQ ID NO: 848944 - DNA, 22 bp, Artificial Sequence
  chemically synthesized
gatgctttatagtcatcattta

SEQ ID NO: 848945 - DNA, 22 bp, Artificial Sequence
  chemically synthesized
tatagtcatcatttaatcccaa

SEQ ID NO: 848946 - DNA, 22 bp, Artificial Sequence
  chemically synthesized
atagtcatcatttaatcccaac

SEQ ID NO: 848947 - DNA, 22 bp, Artificial Sequence
  chemically synthesized
ggtagagttgttgttgggatta

SEQ ID NO: 848948 - DNA, 22 bp, Artificial Sequence
  chemically synthesized
tagtcatcatttaatcccaaca

SEQ ID NO: 848949 - DNA, 22 bp, Artificial Sequence
  chemically synthesized
aatcccaacaacaactctacct

SEQ ID NO: 848950 - DNA, 22 bp, Artificial Sequence
  chemically synthesized
atcccaacaacaactctaccta

SEQ ID NO: 848951 - DNA, 22 bp, Artificial Sequence
  chemically synthesized
tacctagctgggtactatattc

SEQ ID NO: 848952 - DNA, 22 bp, Artificial Sequence
  chemically synthesized
cctagctgggtactatattcat

SEQ ID NO: 848953 - DNA, 22 bp, Artificial Sequence
  chemically synthesized
atgtgtaaaaaaatgaatatag

SEQ ID NO: 848954 - DNA, 22 bp, Artificial Sequence
  chemically synthesized
ctcatgtgtaaaaaaatgaata

SEQ ID NO: 848955 - DNA, 22 bp, Artificial Sequence
  chemically synthesized
gctgggtactatattcattttt

SEQ ID NO: 848956 - DNA, 22 bp, Artificial Sequence
  chemically synthesized
cctcatgtgtaaaaaaatgaat

SEQ ID NO: 848957 - DNA, 22 bp, Artificial Sequence
  chemically synthesized
tttcctcatgtgtaaaaaaatg

SEQ ID NO: 848958 - DNA, 22 bp, Artificial Sequence
  chemically synthesized
ggtactatattcatttttttac

SEQ ID NO: 848959 - DNA, 22 bp, Artificial Sequence
  chemically synthesized
atttcctcatgtgtaaaaaaat

SEQ ID NO: 848960 - DNA, 22 bp, Artificial Sequence
  chemically synthesized
tgcttatttcctcatgtgtaaa

SEQ ID NO: 848961 - DNA, 22 bp, Artificial Sequence
  chemically synthesized
tattcatttttttacacatgag

SEQ ID NO: 848962 - DNA, 22 bp, Artificial Sequence
  chemically synthesized
tgtgcttatttcctcatgtgta

SEQ ID NO: 848963 - DNA, 22 bp, Artificial Sequence
  chemically synthesized
ctgtgcttatttcctcatgtgt

SEQ ID NO: 848964 - DNA, 22 bp, Artificial Sequence
  chemically synthesized
tctgtgcttatttcctcatgtg

SEQ ID NO: 848965 - DNA, 22 bp, Artificial Sequence
  chemically synthesized
ttctgtgcttatttcctcatgt

SEQ ID NO: 848966 - DNA, 22 bp, Artificial Sequence
  chemically synthesized
atttttttacacatgaggaaat

SEQ ID NO: 848967 - DNA, 22 bp, Artificial Sequence
  chemically synthesized
ttttacacatgaggaaataagc

SEQ ID NO: 848968 - DNA, 22 bp, Artificial Sequence
  chemically synthesized
tttacacatgaggaaataagca

SEQ ID NO: 848969 - DNA, 22 bp, Artificial Sequence
  chemically synthesized
ttacacatgaggaaataagcac

SEQ ID NO: 848970 - DNA, 22 bp, Artificial Sequence
  chemically synthesized
gtaatcttttctgtgcttattt

SEQ ID NO: 848971 - DNA, 22 bp, Artificial Sequence
  chemically synthesized
tacacatgaggaaataagcaca

SEQ ID NO: 848972 - DNA, 22 bp, Artificial Sequence
  chemically synthesized
acacatgaggaaataagcacag

SEQ ID NO: 848973 - DNA, 22 bp, Artificial Sequence
  chemically synthesized
cacatgaggaaataagcacaga

SEQ ID NO: 848974 - DNA, 22 bp, Artificial Sequence
  chemically synthesized
gggaagttggtaatcttttctg

SEQ ID NO: 848975 - DNA, 22 bp, Artificial Sequence
  chemically synthesized
ggggaagttggtaatcttttct

SEQ ID NO: 848976 - DNA, 22 bp, Artificial Sequence
  chemically synthesized
tggggaagttggtaatcttttc

SEQ ID NO: 848977 - DNA, 22 bp, Artificial Sequence
  chemically synthesized
tctttggggaagttggtaatct

SEQ ID NO: 848978 - DNA, 22 bp, Artificial Sequence
  chemically synthesized
gctgtctttggggaagttggta

SEQ ID NO: 848979 - DNA, 22 bp, Artificial Sequence
  chemically synthesized
gctggctgtctttggggaagtt

SEQ ID NO: 848980 - DNA, 22 bp, Artificial Sequence
  chemically synthesized
actggctggctgtctttgggga

SEQ ID NO: 848981 - DNA, 22 bp, Artificial Sequence
  chemically synthesized
ccaacttccccaaagacagcca

SEQ ID NO: 848982 - DNA, 22 bp, Artificial Sequence
  chemically synthesized
atcctaactggctggctgtctt

SEQ ID NO: 848983 - DNA, 22 bp, Artificial Sequence
  chemically synthesized
tcctgatcctaactggctggct

SEQ ID NO: 848984 - DNA, 22 bp, Artificial Sequence
  chemically synthesized
ccccaaagacagccagccagtt

SEQ ID NO: 848985 - DNA, 22 bp, Artificial Sequence
  chemically synthesized
cccaaagacagccagccagtta

SEQ ID NO: 848986 - DNA, 22 bp, Artificial Sequence
  chemically synthesized
aaaaaagaaacaaacaaatgct

SEQ ID NO: 848987 - DNA, 22 bp, Artificial Sequence
  chemically synthesized
ggatcaggatagcatttgtttg

SEQ ID NO: 848988 - DNA, 22 bp, Artificial Sequence
  chemically synthesized
aaaataattaaaaaaagaaaca

SEQ ID NO: 848989 - DNA, 22 bp, Artificial Sequence
  chemically synthesized
gtttgtttctttttttaattat

SEQ ID NO: 848990 - DNA, 22 bp, Artificial Sequence
  chemically synthesized
tttgtttctttttttaattatt

SEQ ID NO: 848991 - DNA, 22 bp, Artificial Sequence
  chemically synthesized
gtttctttttttaattattttg

SEQ ID NO: 848992 - DNA, 22 bp, Artificial Sequence
  chemically synthesized
tttctttttttaattattttga

SEQ ID NO: 848993 - DNA, 22 bp, Artificial Sequence
  chemically synthesized
ctttttttaattattttgagat

SEQ ID NO: 848994 - DNA, 22 bp, Artificial Sequence
  chemically synthesized
tttttttaattattttgagatt

SEQ ID NO: 848995 - DNA, 22 bp, Artificial Sequence
  chemically synthesized
tttttaattattttgagatttt

SEQ ID NO: 848996 - DNA, 22 bp, Artificial Sequence
  chemically synthesized
ttttaattattttgagatttta

SEQ ID NO: 848997 - DNA, 22 bp, Artificial Sequence
  chemically synthesized
tttaattattttgagattttat

SEQ ID NO: 848998 - DNA, 22 bp, Artificial Sequence
  chemically synthesized
ttaattattttgagattttatt

SEQ ID NO: 848999 - DNA, 22 bp, Artificial Sequence
  chemically synthesized
taattattttgagattttatta

SEQ ID NO: 849000 - DNA, 22 bp, Artificial Sequence
  chemically synthesized
aattattttgagattttattat

SEQ ID NO: 849001 - DNA, 22 bp, Artificial Sequence
  chemically synthesized
attattttgagattttattatt

SEQ ID NO: 849002 - DNA, 22 bp, Artificial Sequence
  chemically synthesized
ttttgagattttattattatta

SEQ ID NO: 849003 - DNA, 22 bp, Artificial Sequence
  chemically synthesized
aagtataataataataataata

SEQ ID NO: 849004 - DNA, 22 bp, Artificial Sequence
  chemically synthesized
tgagattttattattattatta

SEQ ID NO: 849005 - DNA, 22 bp, Artificial Sequence
  chemically synthesized
aaagtataataataataataat

SEQ ID NO: 849006 - DNA, 22 bp, Artificial Sequence
  chemically synthesized
gagattttattattattattat

SEQ ID NO: 849007 - DNA, 22 bp, Artificial Sequence
  chemically synthesized
agattttattattattattatt

SEQ ID NO: 849008 - DNA, 22 bp, Artificial Sequence
  chemically synthesized
aaacttaaagtataataataat

SEQ ID NO: 849009 - DNA, 22 bp, Artificial Sequence
  chemically synthesized
tattattattattattattata

SEQ ID NO: 849010 - DNA, 22 bp, Artificial Sequence
  chemically synthesized
attattattattattattatac

SEQ ID NO: 849011 - DNA, 22 bp, Artificial Sequence
  chemically synthesized
ttattattattattattatact

SEQ ID NO: 849012 - DNA, 22 bp, Artificial Sequence
  chemically synthesized
ttattattattattatacttta

SEQ ID NO: 849013 - DNA, 22 bp, Artificial Sequence
  chemically synthesized
ttattattattatactttaagt

SEQ ID NO: 849014 - DNA, 22 bp, Artificial Sequence
  chemically synthesized
ttattattatactttaagtttt

SEQ ID NO: 849015 - DNA, 22 bp, Artificial Sequence
  chemically synthesized
tgcacatgtaccctaaaactta

SEQ ID NO: 849016 - DNA, 22 bp, Artificial Sequence
  chemically synthesized
ttattatactttaagttttagg

SEQ ID NO: 849017 - DNA, 22 bp, Artificial Sequence
  chemically synthesized
ttatactttaagttttagggta

SEQ ID NO: 849018 - DNA, 22 bp, Artificial Sequence
  chemically synthesized
tactttaagttttagggtacat

SEQ ID NO: 849019 - DNA, 22 bp, Artificial Sequence
  chemically synthesized
cacattgtgcacatgtacccta

SEQ ID NO: 849020 - DNA, 22 bp, Artificial Sequence
  chemically synthesized
taagttttagggtacatgtgca

SEQ ID NO: 849021 - DNA, 22 bp, Artificial Sequence
  chemically synthesized
acctgcacattgtgcacatgta

SEQ ID NO: 849022 - DNA, 22 bp, Artificial Sequence
  chemically synthesized
aagttttagggtacatgtgcac

SEQ ID NO: 849023 - DNA, 22 bp, Artificial Sequence
  chemically synthesized
agttttagggtacatgtgcaca

SEQ ID NO: 849024 - DNA, 22 bp, Artificial Sequence
  chemically synthesized
tagggtacatgtgcacaatgtg

SEQ ID NO: 849025 - DNA, 22 bp, Artificial Sequence
  chemically synthesized
agggtacatgtgcacaatgtgc

SEQ ID NO: 849026 - DNA, 22 bp, Artificial Sequence
  chemically synthesized
gggtacatgtgcacaatgtgca

SEQ ID NO: 849027 - DNA, 22 bp, Artificial Sequence
  chemically synthesized
gttacatatgtatacatgtgcc

SEQ ID NO: 849028 - DNA, 22 bp, Artificial Sequence
  chemically synthesized
catatgtatacatgtgccatgc

SEQ ID NO: 849029 - DNA, 22 bp, Artificial Sequence
  chemically synthesized
gtgggtgcagcgtgccagcatg

SEQ ID NO: 849030 - DNA, 22 bp, Artificial Sequence
  chemically synthesized
gatgacgggttagtgggtgcag

SEQ ID NO: 849031 - DNA, 22 bp, Artificial Sequence
  chemically synthesized
atgctagatgacgggttagtgg

SEQ ID NO: 849032 - DNA, 22 bp, Artificial Sequence
  chemically synthesized
gcacgctgcacccactaacccg

SEQ ID NO: 849033 - DNA, 22 bp, Artificial Sequence
  chemically synthesized
cacccactaacccgtcatctag

SEQ ID NO: 849034 - DNA, 22 bp, Artificial Sequence
  chemically synthesized
ggagatatacctaatgctagat

SEQ ID NO: 849035 - DNA, 22 bp, Artificial Sequence
  chemically synthesized
acccgtcatctagcattaggta

SEQ ID NO: 849036 - DNA, 22 bp, Artificial Sequence
  chemically synthesized
gcattaggtatatctcccaatg

SEQ ID NO: 849037 - DNA, 22 bp, Artificial Sequence
  chemically synthesized
ggtatatctcccaatgccatcc

SEQ ID NO: 849038 - DNA, 22 bp, Artificial Sequence
  chemically synthesized
tggggtggggggaggggggagg

SEQ ID NO: 849039 - DNA, 22 bp, Artificial Sequence
  chemically synthesized
ccaatgccatccctcccccctc

SEQ ID NO: 849040 - DNA, 22 bp, Artificial Sequence
  chemically synthesized
ttgtggggtggggggagggggg

SEQ ID NO: 849041 - DNA, 22 bp, Artificial Sequence
  chemically synthesized
gggactgttgtggggtgggggg

SEQ ID NO: 849042 - DNA, 22 bp, Artificial Sequence
  chemically synthesized
tggggactgttgtggggtgggg

SEQ ID NO: 849043 - DNA, 22 bp, Artificial Sequence
  chemically synthesized
ccccctccccccaccccacaac

SEQ ID NO: 849044 - DNA, 22 bp, Artificial Sequence
  chemically synthesized
cccccaccccacaacagtcccc

SEQ ID NO: 849045 - DNA, 22 bp, Artificial Sequence
  chemically synthesized
aacaatgagaacacatggacac

SEQ ID NO: 849046 - DNA, 22 bp, Artificial Sequence
  chemically synthesized
cccttcctgtgtccatgtgttc

SEQ ID NO: 849047 - DNA, 22 bp, Artificial Sequence
  chemically synthesized
cctgtgtccatgtgttctcatt

SEQ ID NO: 849048 - DNA, 22 bp, Artificial Sequence
  chemically synthesized
ctgtgtccatgtgttctcattg

SEQ ID NO: 849049 - DNA, 22 bp, Artificial Sequence
  chemically synthesized
tgtccatgtgttctcattgttc

SEQ ID NO: 849050 - DNA, 22 bp, Artificial Sequence
  chemically synthesized
ataggtgggaattgaacaatga

SEQ ID NO: 849051 - DNA, 22 bp, Artificial Sequence
  chemically synthesized
attcataggtgggaattgaaca

SEQ ID NO: 849052 - DNA, 22 bp, Artificial Sequence
  chemically synthesized
tcattcataggtgggaattgaa

SEQ ID NO: 849053 - DNA, 22 bp, Artificial Sequence
  chemically synthesized
tcattgttcaattcccacctat

SEQ ID NO: 849054 - DNA, 22 bp, Artificial Sequence
  chemically synthesized
attgttcaattcccacctatga

SEQ ID NO: 849055 - DNA, 22 bp, Artificial Sequence
  chemically synthesized
ttcaattcccacctatgaatga

SEQ ID NO: 849056 - DNA, 22 bp, Artificial Sequence
  chemically synthesized
aattcccacctatgaatgagaa

SEQ ID NO: 849057 - DNA, 22 bp, Artificial Sequence
  chemically synthesized
ccacctatgaatgagaatatgc

SEQ ID NO: 849058 - DNA, 22 bp, Artificial Sequence
  chemically synthesized
tgaatgagaatatgcggtgttt

SEQ ID NO: 849059 - DNA, 22 bp, Artificial Sequence
  chemically synthesized
caagaacaaaaaaccaaacacc

SEQ ID NO: 849060 - DNA, 22 bp, Artificial Sequence
  chemically synthesized
ttgcaagaacaaaaaaccaaac

SEQ ID NO: 849061 - DNA, 22 bp, Artificial Sequence
  chemically synthesized
agtaaactattgcaagaacaaa

SEQ ID NO: 849062 - DNA, 22 bp, Artificial Sequence
  chemically synthesized
tcagtaaactattgcaagaaca

SEQ ID NO: 849063 - DNA, 22 bp, Artificial Sequence
  chemically synthesized
ggttttttgttcttgcaatagt

SEQ ID NO: 849064 - DNA, 22 bp, Artificial Sequence
  chemically synthesized
gttttttgttcttgcaatagtt

SEQ ID NO: 849065 - DNA, 22 bp, Artificial Sequence
  chemically synthesized
tttgttcttgcaatagtttact

SEQ ID NO: 849066 - DNA, 22 bp, Artificial Sequence
  chemically synthesized
ttgttcttgcaatagtttactg

SEQ ID NO: 849067 - DNA, 22 bp, Artificial Sequence
  chemically synthesized
tgttcttgcaatagtttactga

SEQ ID NO: 849068 - DNA, 22 bp, Artificial Sequence
  chemically synthesized
gttcttgcaatagtttactgag

SEQ ID NO: 849069 - DNA, 22 bp, Artificial Sequence
  chemically synthesized
gaaatcatcattctcagtaaac

SEQ ID NO: 849070 - DNA, 22 bp, Artificial Sequence
  chemically synthesized
ttcttgcaatagtttactgaga

SEQ ID NO: 849071 - DNA, 22 bp, Artificial Sequence
  chemically synthesized
ttgcaatagtttactgagaatg

SEQ ID NO: 849072 - DNA, 22 bp, Artificial Sequence
  chemically synthesized
gcaatagtttactgagaatgat

SEQ ID NO: 849073 - DNA, 22 bp, Artificial Sequence
  chemically synthesized
caatagtttactgagaatgatg

SEQ ID NO: 849074 - DNA, 22 bp, Artificial Sequence
  chemically synthesized
actgagaatgatgatttccaat

SEQ ID NO: 849075 - DNA, 22 bp, Artificial Sequence
  chemically synthesized
ctgagaatgatgatttccaatt

SEQ ID NO: 849076 - DNA, 22 bp, Artificial Sequence
  chemically synthesized
agaatgatgatttccaatttca

SEQ ID NO: 849077 - DNA, 22 bp, Artificial Sequence
  chemically synthesized
tagggacatggatgaaattgga

SEQ ID NO: 849078 - DNA, 22 bp, Artificial Sequence
  chemically synthesized
gtagggacatggatgaaattgg

SEQ ID NO: 849079 - DNA, 22 bp, Artificial Sequence
  chemically synthesized
tgtagggacatggatgaaattg

SEQ ID NO: 849080 - DNA, 22 bp, Artificial Sequence
  chemically synthesized
atgtcctttgtagggacatgga

SEQ ID NO: 849081 - DNA, 22 bp, Artificial Sequence
  chemically synthesized
ccaatttcatccatgtccctac

SEQ ID NO: 849082 - DNA, 22 bp, Artificial Sequence
  chemically synthesized
caatttcatccatgtccctaca

SEQ ID NO: 849083 - DNA, 22 bp, Artificial Sequence
  chemically synthesized
catccatgtccctacaaaggac

SEQ ID NO: 849084 - DNA, 22 bp, Artificial Sequence
  chemically synthesized
atccatgtccctacaaaggaca

SEQ ID NO: 849085 - DNA, 22 bp, Artificial Sequence
  chemically synthesized
caaaggacatgaactcatcctt

SEQ ID NO: 849086 - DNA, 22 bp, Artificial Sequence
  chemically synthesized
tgcagccataaaaaaggatgag

SEQ ID NO: 849087 - DNA, 22 bp, Artificial Sequence
  chemically synthesized
atccttttttatggctgcatag

SEQ ID NO: 849088 - DNA, 22 bp, Artificial Sequence
  chemically synthesized
ttttatggctgcatagtattcc

SEQ ID NO: 849089 - DNA, 22 bp, Artificial Sequence
  chemically synthesized
tttatggctgcatagtattcca

SEQ ID NO: 849090 - DNA, 22 bp, Artificial Sequence
  chemically synthesized
ttatggctgcatagtattccat

SEQ ID NO: 849091 - DNA, 22 bp, Artificial Sequence
  chemically synthesized
tatggctgcatagtattccatg

SEQ ID NO: 849092 - DNA, 22 bp, Artificial Sequence
  chemically synthesized
atggctgcatagtattccatgg

SEQ ID NO: 849093 - DNA, 22 bp, Artificial Sequence
  chemically synthesized
tggctgcatagtattccatggt

SEQ ID NO: 849094 - DNA, 22 bp, Artificial Sequence
  chemically synthesized
catagtattccatggtgtatat

SEQ ID NO: 849095 - DNA, 22 bp, Artificial Sequence
  chemically synthesized
agaaaatgtggcacatatacac

SEQ ID NO: 849096 - DNA, 22 bp, Artificial Sequence
  chemically synthesized
gattaagaaaatgtggcacata

SEQ ID NO: 849097 - DNA, 22 bp, Artificial Sequence
  chemically synthesized
catggtgtatatgtgccacatt

SEQ ID NO: 849098 - DNA, 22 bp, Artificial Sequence
  chemically synthesized
tcttaatccagtctatcattgt

SEQ ID NO: 849099 - DNA, 22 bp, Artificial Sequence
  chemically synthesized
cttaatccagtctatcattgtt

SEQ ID NO: 849100 - DNA, 22 bp, Artificial Sequence
  chemically synthesized
ttaatccagtctatcattgttg

SEQ ID NO: 849101 - DNA, 22 bp, Artificial Sequence
  chemically synthesized
aatccagtctatcattgttgga

SEQ ID NO: 849102 - DNA, 22 bp, Artificial Sequence
  chemically synthesized
atccagtctatcattgttggac

SEQ ID NO: 849103 - DNA, 22 bp, Artificial Sequence
  chemically synthesized
gaaccaacccaaatgtccaaca

SEQ ID NO: 849104 - DNA, 22 bp, Artificial Sequence
  chemically synthesized
ggaaccaacccaaatgtccaac

SEQ ID NO: 849105 - DNA, 22 bp, Artificial Sequence
  chemically synthesized
tcattgttggacatttgggttg

SEQ ID NO: 849106 - DNA, 22 bp, Artificial Sequence
  chemically synthesized
ttggacatttgggttggttcca

SEQ ID NO: 849107 - DNA, 22 bp, Artificial Sequence
  chemically synthesized
caatagcaaagacttggaacca

SEQ ID NO: 849108 - DNA, 22 bp, Artificial Sequence
  chemically synthesized
gacatttgggttggttccaagt

SEQ ID NO: 849109 - DNA, 22 bp, Artificial Sequence
  chemically synthesized
acaatagcaaagacttggaacc

SEQ ID NO: 849110 - DNA, 22 bp, Artificial Sequence
  chemically synthesized
tttacaatagcaaagacttgga

SEQ ID NO: 849111 - DNA, 22 bp, Artificial Sequence
  chemically synthesized
gggttggttccaagtctttgct

SEQ ID NO: 849112 - DNA, 22 bp, Artificial Sequence
  chemically synthesized
ggttggttccaagtctttgcta

SEQ ID NO: 849113 - DNA, 22 bp, Artificial Sequence
  chemically synthesized
aggcactatttacaatagcaaa

SEQ ID NO: 849114 - DNA, 22 bp, Artificial Sequence
  chemically synthesized
gttccaagtctttgctattgta

SEQ ID NO: 849115 - DNA, 22 bp, Artificial Sequence
  chemically synthesized
ttgaggcactatttacaatagc

SEQ ID NO: 849116 - DNA, 22 bp, Artificial Sequence
  chemically synthesized
attgaggcactatttacaatag

SEQ ID NO: 849117 - DNA, 22 bp, Artificial Sequence
  chemically synthesized
caagtctttgctattgtaaata

SEQ ID NO: 849118 - DNA, 22 bp, Artificial Sequence
  chemically synthesized
tgctattgtaaatagtgcctca

SEQ ID NO: 849119 - DNA, 22 bp, Artificial Sequence
  chemically synthesized
gctattgtaaatagtgcctcaa

SEQ ID NO: 849120 - DNA, 22 bp, Artificial Sequence
  chemically synthesized
ctattgtaaatagtgcctcaat

SEQ ID NO: 849121 - DNA, 22 bp, Artificial Sequence
  chemically synthesized
ttgtaaatagtgcctcaataaa

SEQ ID NO: 849122 - DNA, 22 bp, Artificial Sequence
  chemically synthesized
taaatagtgcctcaataaacat

SEQ ID NO: 849123 - DNA, 22 bp, Artificial Sequence
  chemically synthesized
taaagacacatgcacatgtatg

SEQ ID NO: 849124 - DNA, 22 bp, Artificial Sequence
  chemically synthesized
ctataaagacacatgcacatgt

SEQ ID NO: 849125 - DNA, 22 bp, Artificial Sequence
  chemically synthesized
aataaacatacatgtgcatgtg

SEQ ID NO: 849126 - DNA, 22 bp, Artificial Sequence
  chemically synthesized
taaatcatgctgctataaagac

SEQ ID NO: 849127 - DNA, 22 bp, Artificial Sequence
  chemically synthesized
tatagcagcatgatttatagtc

SEQ ID NO: 849128 - DNA, 22 bp, Artificial Sequence
  chemically synthesized
atagcagcatgatttatagtcc

SEQ ID NO: 849129 - DNA, 22 bp, Artificial Sequence
  chemically synthesized
tagcagcatgatttatagtcct

SEQ ID NO: 849130 - DNA, 22 bp, Artificial Sequence
  chemically synthesized
ggtatatacccaaaggactata

SEQ ID NO: 849131 - DNA, 22 bp, Artificial Sequence
  chemically synthesized
ctgggtatatacccaaaggact

SEQ ID NO: 849132 - DNA, 22 bp, Artificial Sequence
  chemically synthesized
atagtcctttgggtatataccc

SEQ ID NO: 849133 - DNA, 22 bp, Artificial Sequence
  chemically synthesized
tagtcctttgggtatataccca

SEQ ID NO: 849134 - DNA, 22 bp, Artificial Sequence
  chemically synthesized
acccagccatcccattactggg

SEQ ID NO: 849135 - DNA, 22 bp, Artificial Sequence
  chemically synthesized
gacccagccatcccattactgg

SEQ ID NO: 849136 - DNA, 22 bp, Artificial Sequence
  chemically synthesized
tgggtatatacccagtaatggg

SEQ ID NO: 849137 - DNA, 22 bp, Artificial Sequence
  chemically synthesized
gggtatatacccagtaatggga

SEQ ID NO: 849138 - DNA, 22 bp, Artificial Sequence
  chemically synthesized
ggtatatacccagtaatgggat

SEQ ID NO: 849139 - DNA, 22 bp, Artificial Sequence
  chemically synthesized
gaaataccatttgacccagcca

SEQ ID NO: 849140 - DNA, 22 bp, Artificial Sequence
  chemically synthesized
gaactagaaataccatttgacc

SEQ ID NO: 849141 - DNA, 22 bp, Artificial Sequence
  chemically synthesized
agggatctagaactagaaatac

SEQ ID NO: 849142 - DNA, 22 bp, Artificial Sequence
  chemically synthesized
ggtcaaatggtatttctagttc

SEQ ID NO: 849143 - DNA, 22 bp, Artificial Sequence
  chemically synthesized
ctcagggatctagaactagaaa

SEQ ID NO: 849144 - DNA, 22 bp, Artificial Sequence
  chemically synthesized
ctagttctagatccctgaggaa

SEQ ID NO: 849145 - DNA, 22 bp, Artificial Sequence
  chemically synthesized
tagttctagatccctgaggaat

SEQ ID NO: 849146 - DNA, 22 bp, Artificial Sequence
  chemically synthesized
gttctagatccctgaggaatcg

SEQ ID NO: 849147 - DNA, 22 bp, Artificial Sequence
  chemically synthesized
tggaagtcagtgtggcgattcc

SEQ ID NO: 849148 - DNA, 22 bp, Artificial Sequence
  chemically synthesized
tagatccctgaggaatcgccac

SEQ ID NO: 849149 - DNA, 22 bp, Artificial Sequence
  chemically synthesized
gatccctgaggaatcgccacac

SEQ ID NO: 849150 - DNA, 22 bp, Artificial Sequence
  chemically synthesized
aaccattgtggaagtcagtgtg

SEQ ID NO: 849151 - DNA, 22 bp, Artificial Sequence
  chemically synthesized
aggaatcgccacactgacttcc

SEQ ID NO: 849152 - DNA, 22 bp, Artificial Sequence
  chemically synthesized
gttcaaccattgtggaagtcag

SEQ ID NO: 849153 - DNA, 22 bp, Artificial Sequence
  chemically synthesized
taaactagttcaaccattgtgg

SEQ ID NO: 849154 - DNA, 22 bp, Artificial Sequence
  chemically synthesized
acttccacaatggttgaactag

SEQ ID NO: 849155 - DNA, 22 bp, Artificial Sequence
  chemically synthesized
gtgggactgtaaactagttcaa

SEQ ID NO: 849156 - DNA, 22 bp, Artificial Sequence
  chemically synthesized
ccacaatggttgaactagttta

SEQ ID NO: 849157 - DNA, 22 bp, Artificial Sequence
  chemically synthesized
ttggtgggactgtaaactagtt

SEQ ID NO: 849158 - DNA, 22 bp, Artificial Sequence
  chemically synthesized
cacaatggttgaactagtttac

SEQ ID NO: 849159 - DNA, 22 bp, Artificial Sequence
  chemically synthesized
cactgttggtgggactgtaaac

SEQ ID NO: 849160 - DNA, 22 bp, Artificial Sequence
  chemically synthesized
acactgttggtgggactgtaaa

SEQ ID NO: 849161 - DNA, 22 bp, Artificial Sequence
  chemically synthesized
ttacactgttggtgggactgta

SEQ ID NO: 849162 - DNA, 22 bp, Artificial Sequence
  chemically synthesized
aactagtttacagtcccaccaa

SEQ ID NO: 849163 - DNA, 22 bp, Artificial Sequence
  chemically synthesized
gtttacagtcccaccaacagtg

SEQ ID NO: 849164 - DNA, 22 bp, Artificial Sequence
  chemically synthesized
acagtcccaccaacagtgtaag

SEQ ID NO: 849165 - DNA, 22 bp, Artificial Sequence
  chemically synthesized
cagtcccaccaacagtgtaaga

SEQ ID NO: 849166 - DNA, 22 bp, Artificial Sequence
  chemically synthesized
gagaggatgtggagaaatagga

SEQ ID NO: 849167 - DNA, 22 bp, Artificial Sequence
  chemically synthesized
ctatttctccacatcctctcca

SEQ ID NO: 849168 - DNA, 22 bp, Artificial Sequence
  chemically synthesized
tttctccacatcctctccagca

SEQ ID NO: 849169 - DNA, 22 bp, Artificial Sequence
  chemically synthesized
ctccacatcctctccagcacct

SEQ ID NO: 849170 - DNA, 22 bp, Artificial Sequence
  chemically synthesized
tccacatcctctccagcacctg

SEQ ID NO: 849171 - DNA, 22 bp, Artificial Sequence
  chemically synthesized
cacatcctctccagcacctgtt

SEQ ID NO: 849172 - DNA, 22 bp, Artificial Sequence
  chemically synthesized
aaaagtcaggaaacaacaggtg

SEQ ID NO: 849173 - DNA, 22 bp, Artificial Sequence
  chemically synthesized
tccagcacctgttgtttcctga

SEQ ID NO: 849174 - DNA, 22 bp, Artificial Sequence
  chemically synthesized
cagcacctgttgtttcctgact

SEQ ID NO: 849175 - DNA, 22 bp, Artificial Sequence
  chemically synthesized
gaatggcaatcattaaaaagtc

SEQ ID NO: 849176 - DNA, 22 bp, Artificial Sequence
  chemically synthesized
ttgtttcctgactttttaatga

SEQ ID NO: 849177 - DNA, 22 bp, Artificial Sequence
  chemically synthesized
tttcctgactttttaatgattg

SEQ ID NO: 849178 - DNA, 22 bp, Artificial Sequence
  chemically synthesized
cctgactttttaatgattgcca

SEQ ID NO: 849179 - DNA, 22 bp, Artificial Sequence
  chemically synthesized
ctgactttttaatgattgccat

SEQ ID NO: 849180 - DNA, 22 bp, Artificial Sequence
  chemically synthesized
acaccagttagaatggcaatca

SEQ ID NO: 849181 - DNA, 22 bp, Artificial Sequence
  chemically synthesized
actttttaatgattgccattct

SEQ ID NO: 849182 - DNA, 22 bp, Artificial Sequence
  chemically synthesized
tttaatgattgccattctaact

SEQ ID NO: 849183 - DNA, 22 bp, Artificial Sequence
  chemically synthesized
ttaatgattgccattctaactg

SEQ ID NO: 849184 - DNA, 22 bp, Artificial Sequence
  chemically synthesized
taatgattgccattctaactgg

SEQ ID NO: 849185 - DNA, 22 bp, Artificial Sequence
  chemically synthesized
aatgattgccattctaactggt

SEQ ID NO: 849186 - DNA, 22 bp, Artificial Sequence
  chemically synthesized
atgattgccattctaactggtg

SEQ ID NO: 849187 - DNA, 22 bp, Artificial Sequence
  chemically synthesized
ccattctaactggtgtgagatg

SEQ ID NO: 849188 - DNA, 22 bp, Artificial Sequence
  chemically synthesized
taactggtgtgagatggtatct

SEQ ID NO: 849189 - DNA, 22 bp, Artificial Sequence
  chemically synthesized
actggtgtgagatggtatctca

SEQ ID NO: 849190 - DNA, 22 bp, Artificial Sequence
  chemically synthesized
gtgtgagatggtatctcattgt

SEQ ID NO: 849191 - DNA, 22 bp, Artificial Sequence
  chemically synthesized
gccatcagagaaatgcaaatca

SEQ ID NO: 849192 - DNA, 22 bp, Artificial Sequence
  chemically synthesized
attgtggttttgatttgcattt

SEQ ID NO: 849193 - DNA, 22 bp, Artificial Sequence
  chemically synthesized
tggttttgatttgcatttctct

SEQ ID NO: 849194 - DNA, 22 bp, Artificial Sequence
  chemically synthesized
accatcactggccatcagagaa

SEQ ID NO: 849195 - DNA, 22 bp, Artificial Sequence
  chemically synthesized
tgatttgcatttctctgatggc

SEQ ID NO: 849196 - DNA, 22 bp, Artificial Sequence
  chemically synthesized
gatttgcatttctctgatggcc

SEQ ID NO: 849197 - DNA, 22 bp, Artificial Sequence
  chemically synthesized
atttgcatttctctgatggcca

SEQ ID NO: 849198 - DNA, 22 bp, Artificial Sequence
  chemically synthesized
gcatttctctgatggccagtga

SEQ ID NO: 849199 - DNA, 22 bp, Artificial Sequence
  chemically synthesized
catttctctgatggccagtgat

SEQ ID NO: 849200 - DNA, 22 bp, Artificial Sequence
  chemically synthesized
ctctgatggccagtgatggtga

SEQ ID NO: 849201 - DNA, 22 bp, Artificial Sequence
  chemically synthesized
tctgatggccagtgatggtgag

SEQ ID NO: 849202 - DNA, 22 bp, Artificial Sequence
  chemically synthesized
tgatggccagtgatggtgagca

SEQ ID NO: 849203 - DNA, 22 bp, Artificial Sequence
  chemically synthesized
atggccagtgatggtgagcatt

SEQ ID NO: 849204 - DNA, 22 bp, Artificial Sequence
  chemically synthesized
tgcagccaaaagacacatgaaa

SEQ ID NO: 849205 - DNA, 22 bp, Artificial Sequence
  chemically synthesized
atgcagccaaaagacacatgaa

SEQ ID NO: 849206 - DNA, 22 bp, Artificial Sequence
  chemically synthesized
tttcatgtgtcttttggctgca

SEQ ID NO: 849207 - DNA, 22 bp, Artificial Sequence
  chemically synthesized
ttcatgtgtcttttggctgcat

SEQ ID NO: 849208 - DNA, 22 bp, Artificial Sequence
  chemically synthesized
tcatgtgtcttttggctgcata

SEQ ID NO: 849209 - DNA, 22 bp, Artificial Sequence
  chemically synthesized
catgtgtcttttggctgcataa

SEQ ID NO: 849210 - DNA, 22 bp, Artificial Sequence
  chemically synthesized
aaaagaagacatttatgcagcc

SEQ ID NO: 849211 - DNA, 22 bp, Artificial Sequence
  chemically synthesized
atgtgtcttttggctgcataaa

SEQ ID NO: 849212 - DNA, 22 bp, Artificial Sequence
  chemically synthesized
tcaaaagaagacatttatgcag

SEQ ID NO: 849213 - DNA, 22 bp, Artificial Sequence
  chemically synthesized
ctcaaaagaagacatttatgca

SEQ ID NO: 849214 - DNA, 22 bp, Artificial Sequence
  chemically synthesized
ttggctgcataaatgtcttctt

SEQ ID NO: 849215 - DNA, 22 bp, Artificial Sequence
  chemically synthesized
tggctgcataaatgtcttcttt

SEQ ID NO: 849216 - DNA, 22 bp, Artificial Sequence
  chemically synthesized
ggctgcataaatgtcttctttt

SEQ ID NO: 849217 - DNA, 22 bp, Artificial Sequence
  chemically synthesized
gctgcataaatgtcttcttttg

SEQ ID NO: 849218 - DNA, 22 bp, Artificial Sequence
  chemically synthesized
cataaatgtcttcttttgagaa

SEQ ID NO: 849219 - DNA, 22 bp, Artificial Sequence
  chemically synthesized
cttttgagaagtgtctgttcat

SEQ ID NO: 849220 - DNA, 22 bp, Artificial Sequence
  chemically synthesized
ttttgagaagtgtctgttcatg

SEQ ID NO: 849221 - DNA, 22 bp, Artificial Sequence
  chemically synthesized
ttgagaagtgtctgttcatgtc

SEQ ID NO: 849222 - DNA, 22 bp, Artificial Sequence
  chemically synthesized
tgagaagtgtctgttcatgtcc

SEQ ID NO: 849223 - DNA, 22 bp, Artificial Sequence
  chemically synthesized
gagaagtgtctgttcatgtcct

SEQ ID NO: 849224 - DNA, 22 bp, Artificial Sequence
  chemically synthesized
agaagtgtctgttcatgtcctt

SEQ ID NO: 849225 - DNA, 22 bp, Artificial Sequence
  chemically synthesized
ttcatgtccttcgcccactttt

SEQ ID NO: 849226 - DNA, 22 bp, Artificial Sequence
  chemically synthesized
atgtccttcgcccacttttgga

SEQ ID NO: 849227 - DNA, 22 bp, Artificial Sequence
  chemically synthesized
cgcccacttttggatggggttg

SEQ ID NO: 849228 - DNA, 22 bp, Artificial Sequence
  chemically synthesized
gcccacttttggatggggttgt

SEQ ID NO: 849229 - DNA, 22 bp, Artificial Sequence
  chemically synthesized
caagaaaaaaacaaacaacccc

SEQ ID NO: 849230 - DNA, 22 bp, Artificial Sequence
  chemically synthesized
acaagaaaaaaacaaacaaccc

SEQ ID NO: 849231 - DNA, 22 bp, Artificial Sequence
  chemically synthesized
ttggatggggttgtttgttttt

SEQ ID NO: 849232 - DNA, 22 bp, Artificial Sequence
  chemically synthesized
tggatggggttgtttgtttttt

SEQ ID NO: 849233 - DNA, 22 bp, Artificial Sequence
  chemically synthesized
ggatggggttgtttgttttttt

SEQ ID NO: 849234 - DNA, 22 bp, Artificial Sequence
  chemically synthesized
gatggggttgtttgtttttttc

SEQ ID NO: 849235 - DNA, 22 bp, Artificial Sequence
  chemically synthesized
caacaaatttacaagaaaaaaa

SEQ ID NO: 849236 - DNA, 22 bp, Artificial Sequence
  chemically synthesized
tttgtttttttcttgtaaattt

SEQ ID NO: 849237 - DNA, 22 bp, Artificial Sequence
  chemically synthesized
caatgaactccaacaaatttac

SEQ ID NO: 849238 - DNA, 22 bp, Artificial Sequence
  chemically synthesized
gtttttttcttgtaaatttgtt

SEQ ID NO: 849239 - DNA, 22 bp, Artificial Sequence
  chemically synthesized
tttttttcttgtaaatttgttg

SEQ ID NO: 849240 - DNA, 22 bp, Artificial Sequence
  chemically synthesized
ttttcttgtaaatttgttggag

SEQ ID NO: 849241 - DNA, 22 bp, Artificial Sequence
  chemically synthesized
tttcttgtaaatttgttggagt

SEQ ID NO: 849242 - DNA, 22 bp, Artificial Sequence
  chemically synthesized
ttcttgtaaatttgttggagtt

SEQ ID NO: 849243 - DNA, 22 bp, Artificial Sequence
  chemically synthesized
tcttgtaaatttgttggagttc

SEQ ID NO: 849244 - DNA, 22 bp, Artificial Sequence
  chemically synthesized
cttgtaaatttgttggagttca

SEQ ID NO: 849245 - DNA, 22 bp, Artificial Sequence
  chemically synthesized
ttgtaaatttgttggagttcat

SEQ ID NO: 849246 - DNA, 22 bp, Artificial Sequence
  chemically synthesized
gtaaatttgttggagttcattg

SEQ ID NO: 849247 - DNA, 22 bp, Artificial Sequence
  chemically synthesized
taaatttgttggagttcattgt

SEQ ID NO: 849248 - DNA, 22 bp, Artificial Sequence
  chemically synthesized
atatccagaatctacaatgaac

SEQ ID NO: 849249 - DNA, 22 bp, Artificial Sequence
  chemically synthesized
gttggagttcattgtagattct

SEQ ID NO: 849250 - DNA, 22 bp, Artificial Sequence
  chemically synthesized
ttggagttcattgtagattctg

SEQ ID NO: 849251 - DNA, 22 bp, Artificial Sequence
  chemically synthesized
gagttcattgtagattctggat

SEQ ID NO: 849252 - DNA, 22 bp, Artificial Sequence
  chemically synthesized
acaaagagctaatatccagaat

SEQ ID NO: 849253 - DNA, 22 bp, Artificial Sequence
  chemically synthesized
tctgacaaagagctaatatcca

SEQ ID NO: 849254 - DNA, 22 bp, Artificial Sequence
  chemically synthesized
attgtagattctggatattagc

SEQ ID NO: 849255 - DNA, 22 bp, Artificial Sequence
  chemically synthesized
atctgacaaagagctaatatcc

SEQ ID NO: 849256 - DNA, 22 bp, Artificial Sequence
  chemically synthesized
cttatctgacaaagagctaata

SEQ ID NO: 849257 - DNA, 22 bp, Artificial Sequence
  chemically synthesized
tagattctggatattagctctt

SEQ ID NO: 849258 - DNA, 22 bp, Artificial Sequence
  chemically synthesized
tggatattagctctttgtcaga

SEQ ID NO: 849259 - DNA, 22 bp, Artificial Sequence
  chemically synthesized
gcaacctgcttatctgacaaag

SEQ ID NO: 849260 - DNA, 22 bp, Artificial Sequence
  chemically synthesized
cgcaacctgcttatctgacaaa

SEQ ID NO: 849261 - DNA, 22 bp, Artificial Sequence
  chemically synthesized
gatattagctctttgtcagata

SEQ ID NO: 849262 - DNA, 22 bp, Artificial Sequence
  chemically synthesized
tcgcaacctgcttatctgacaa

SEQ ID NO: 849263 - DNA, 22 bp, Artificial Sequence
  chemically synthesized
gctctttgtcagataagcaggt

SEQ ID NO: 849264 - DNA, 22 bp, Artificial Sequence
  chemically synthesized
tttgtcagataagcaggttgcg

SEQ ID NO: 849265 - DNA, 22 bp, Artificial Sequence
  chemically synthesized
tgtcagataagcaggttgcgaa

SEQ ID NO: 849266 - DNA, 22 bp, Artificial Sequence
  chemically synthesized
gtcagataagcaggttgcgaaa

SEQ ID NO: 849267 - DNA, 22 bp, Artificial Sequence
  chemically synthesized
tcagataagcaggttgcgaaaa

SEQ ID NO: 849268 - DNA, 22 bp, Artificial Sequence
  chemically synthesized
caacatgggagaaaattttcgc

SEQ ID NO: 849269 - DNA, 22 bp, Artificial Sequence
  chemically synthesized
cgaaaattttctcccatgttgt

SEQ ID NO: 849270 - DNA, 22 bp, Artificial Sequence
  chemically synthesized
tctcccatgttgtaggttgcct

SEQ ID NO: 849271 - DNA, 22 bp, Artificial Sequence
  chemically synthesized
ctcccatgttgtaggttgcctg

SEQ ID NO: 849272 - DNA, 22 bp, Artificial Sequence
  chemically synthesized
tcccatgttgtaggttgcctgt

SEQ ID NO: 849273 - DNA, 22 bp, Artificial Sequence
  chemically synthesized
ccatcagagtgaacaggcaacc

SEQ ID NO: 849274 - DNA, 22 bp, Artificial Sequence
  chemically synthesized
ccatgttgtaggttgcctgttc

SEQ ID NO: 849275 - DNA, 22 bp, Artificial Sequence
  chemically synthesized
taggttgcctgttcactctgat

SEQ ID NO: 849276 - DNA, 22 bp, Artificial Sequence
  chemically synthesized
cctgttcactctgatggtagtt

SEQ ID NO: 849277 - DNA, 22 bp, Artificial Sequence
  chemically synthesized
cacagcaaaagaaactaccatc

SEQ ID NO: 849278 - DNA, 22 bp, Artificial Sequence
  chemically synthesized
tgcacagcaaaagaaactacca

SEQ ID NO: 849279 - DNA, 22 bp, Artificial Sequence
  chemically synthesized
ctgcacagcaaaagaaactacc

SEQ ID NO: 849280 - DNA, 22 bp, Artificial Sequence
  chemically synthesized
ttcactctgatggtagtttctt

SEQ ID NO: 849281 - DNA, 22 bp, Artificial Sequence
  chemically synthesized
actctgatggtagtttcttttg

SEQ ID NO: 849282 - DNA, 22 bp, Artificial Sequence
  chemically synthesized
tgatggtagtttcttttgctgt

SEQ ID NO: 849283 - DNA, 22 bp, Artificial Sequence
  chemically synthesized
aagagcttctgcacagcaaaag

SEQ ID NO: 849284 - DNA, 22 bp, Artificial Sequence
  chemically synthesized
atggtagtttcttttgctgtgc

SEQ ID NO: 849285 - DNA, 22 bp, Artificial Sequence
  chemically synthesized
aactaaagagcttctgcacagc

SEQ ID NO: 849286 - DNA, 22 bp, Artificial Sequence
  chemically synthesized
actaaactaaagagcttctgca

SEQ ID NO: 849287 - DNA, 22 bp, Artificial Sequence
  chemically synthesized
cttttgctgtgcagaagctctt

SEQ ID NO: 849288 - DNA, 22 bp, Artificial Sequence
  chemically synthesized
ttttgctgtgcagaagctcttt

SEQ ID NO: 849289 - DNA, 22 bp, Artificial Sequence
  chemically synthesized
ttgctgtgcagaagctctttag

SEQ ID NO: 849290 - DNA, 22 bp, Artificial Sequence
  chemically synthesized
tgctgtgcagaagctctttagt

SEQ ID NO: 849291 - DNA, 22 bp, Artificial Sequence
  chemically synthesized
gctgtgcagaagctctttagtt

SEQ ID NO: 849292 - DNA, 22 bp, Artificial Sequence
  chemically synthesized
ctgtgcagaagctctttagttt

SEQ ID NO: 849293 - DNA, 22 bp, Artificial Sequence
  chemically synthesized
tgcagaagctctttagtttagt

SEQ ID NO: 849294 - DNA, 22 bp, Artificial Sequence
  chemically synthesized
acaaatgggatctaactaaact

SEQ ID NO: 849295 - DNA, 22 bp, Artificial Sequence
  chemically synthesized
tttagtttagttagatcccatt

SEQ ID NO: 849296 - DNA, 22 bp, Artificial Sequence
  chemically synthesized
tagtttagttagatcccatttg

SEQ ID NO: 849297 - DNA, 22 bp, Artificial Sequence
  chemically synthesized
agtttagttagatcccatttgt

SEQ ID NO: 849298 - DNA, 22 bp, Artificial Sequence
  chemically synthesized
gtttagttagatcccatttgtc

SEQ ID NO: 849299 - DNA, 22 bp, Artificial Sequence
  chemically synthesized
agttagatcccatttgtcaatt

SEQ ID NO: 849300 - DNA, 22 bp, Artificial Sequence
  chemically synthesized
gttagatcccatttgtcaattt

SEQ ID NO: 849301 - DNA, 22 bp, Artificial Sequence
  chemically synthesized
gatcccatttgtcaattttggc

SEQ ID NO: 849302 - DNA, 22 bp, Artificial Sequence
  chemically synthesized
gtcaattttggcttttgttgcc

SEQ ID NO: 849303 - DNA, 22 bp, Artificial Sequence
  chemically synthesized
tcaattttggcttttgttgccc

SEQ ID NO: 849304 - DNA, 22 bp, Artificial Sequence
  chemically synthesized
aaacaccaaaagcaagggcaac

SEQ ID NO: 849305 - DNA, 22 bp, Artificial Sequence
  chemically synthesized
tggcttttgttgcccttgcttt

SEQ ID NO: 849306 - DNA, 22 bp, Artificial Sequence
  chemically synthesized
ggcttttgttgcccttgctttt

SEQ ID NO: 849307 - DNA, 22 bp, Artificial Sequence
  chemically synthesized
gcttttgttgcccttgcttttg

SEQ ID NO: 849308 - DNA, 22 bp, Artificial Sequence
  chemically synthesized
atgtctaaaacaccaaaagcaa

SEQ ID NO: 849309 - DNA, 22 bp, Artificial Sequence
  chemically synthesized
catgtctaaaacaccaaaagca

SEQ ID NO: 849310 - DNA, 22 bp, Artificial Sequence
  chemically synthesized
ttgttgcccttgcttttggtgt

SEQ ID NO: 849311 - DNA, 22 bp, Artificial Sequence
  chemically synthesized
tgttgcccttgcttttggtgtt

SEQ ID NO: 849312 - DNA, 22 bp, Artificial Sequence
  chemically synthesized
gttgcccttgcttttggtgttt

SEQ ID NO: 849313 - DNA, 22 bp, Artificial Sequence
  chemically synthesized
ttgcccttgcttttggtgtttt

SEQ ID NO: 849314 - DNA, 22 bp, Artificial Sequence
  chemically synthesized
cccttgcttttggtgttttaga

SEQ ID NO: 849315 - DNA, 22 bp, Artificial Sequence
  chemically synthesized
gcttttggtgttttagacatga

SEQ ID NO: 849316 - DNA, 22 bp, Artificial Sequence
  chemically synthesized
cttttggtgttttagacatgaa

SEQ ID NO: 849317 - DNA, 22 bp, Artificial Sequence
  chemically synthesized
ttggtgttttagacatgaagtc

SEQ ID NO: 849318 - DNA, 22 bp, Artificial Sequence
  chemically synthesized
tggtgttttagacatgaagtcc

SEQ ID NO: 849319 - DNA, 22 bp, Artificial Sequence
  chemically synthesized
ggtgttttagacatgaagtcct

SEQ ID NO: 849320 - DNA, 22 bp, Artificial Sequence
  chemically synthesized
gtgttttagacatgaagtcctt

SEQ ID NO: 849321 - DNA, 22 bp, Artificial Sequence
  chemically synthesized
aggacataggcatgggcaagga

SEQ ID NO: 849322 - DNA, 22 bp, Artificial Sequence
  chemically synthesized
tagacatgaagtccttgcccat

SEQ ID NO: 849323 - DNA, 22 bp, Artificial Sequence
  chemically synthesized
agacatgaagtccttgcccatg

SEQ ID NO: 849324 - DNA, 22 bp, Artificial Sequence
  chemically synthesized
gacatgaagtccttgcccatgc

SEQ ID NO: 849325 - DNA, 22 bp, Artificial Sequence
  chemically synthesized
ccattcaggacataggcatggg

SEQ ID NO: 849326 - DNA, 22 bp, Artificial Sequence
  chemically synthesized
ggcattaccattcaggacatag

SEQ ID NO: 849327 - DNA, 22 bp, Artificial Sequence
  chemically synthesized
gcccatgcctatgtcctgaatg

SEQ ID NO: 849328 - DNA, 22 bp, Artificial Sequence
  chemically synthesized
cccatgcctatgtcctgaatgg

SEQ ID NO: 849329 - DNA, 22 bp, Artificial Sequence
  chemically synthesized
gaagaaaacctaggcattacca

SEQ ID NO: 849330 - DNA, 22 bp, Artificial Sequence
  chemically synthesized
tgtcctgaatggtaatgcctag

SEQ ID NO: 849331 - DNA, 22 bp, Artificial Sequence
  chemically synthesized
aatggtaatgcctaggttttct

SEQ ID NO: 849332 - DNA, 22 bp, Artificial Sequence
  chemically synthesized
aaaccataaaaaccctagaaga

SEQ ID NO: 849333 - DNA, 22 bp, Artificial Sequence
  chemically synthesized
gacctaaaaccataaaaaccct

SEQ ID NO: 849334 - DNA, 22 bp, Artificial Sequence
  chemically synthesized
ggttttcttctagggtttttat

SEQ ID NO: 849335 - DNA, 22 bp, Artificial Sequence
  chemically synthesized
tcttctagggtttttatggttt

SEQ ID NO: 849336 - DNA, 22 bp, Artificial Sequence
  chemically synthesized
cttctagggtttttatggtttt

SEQ ID NO: 849337 - DNA, 22 bp, Artificial Sequence
  chemically synthesized
aacgttagacctaaaaccataa

SEQ ID NO: 849338 - DNA, 22 bp, Artificial Sequence
  chemically synthesized
ttctagggtttttatggtttta

SEQ ID NO: 849339 - DNA, 22 bp, Artificial Sequence
  chemically synthesized
aaacgttagacctaaaaccata

SEQ ID NO: 849340 - DNA, 22 bp, Artificial Sequence
  chemically synthesized
ctagggtttttatggttttagg

SEQ ID NO: 849341 - DNA, 22 bp, Artificial Sequence
  chemically synthesized
tagggtttttatggttttaggt

SEQ ID NO: 849342 - DNA, 22 bp, Artificial Sequence
  chemically synthesized
gggtttttatggttttaggtct

SEQ ID NO: 849343 - DNA, 22 bp, Artificial Sequence
  chemically synthesized
aagacttaaacgttagacctaa

SEQ ID NO: 849344 - DNA, 22 bp, Artificial Sequence
  chemically synthesized
ttatggttttaggtctaacgtt

SEQ ID NO: 849345 - DNA, 22 bp, Artificial Sequence
  chemically synthesized
tatggttttaggtctaacgttt

SEQ ID NO: 849346 - DNA, 22 bp, Artificial Sequence
  chemically synthesized
atggttttaggtctaacgttta

SEQ ID NO: 849347 - DNA, 22 bp, Artificial Sequence
  chemically synthesized
tggttttaggtctaacgtttaa

SEQ ID NO: 849348 - DNA, 22 bp, Artificial Sequence
  chemically synthesized
aagatggattaaagacttaaac

SEQ ID NO: 849349 - DNA, 22 bp, Artificial Sequence
  chemically synthesized
taggtctaacgtttaagtcttt

SEQ ID NO: 849350 - DNA, 22 bp, Artificial Sequence
  chemically synthesized
aggtctaacgtttaagtcttta

SEQ ID NO: 849351 - DNA, 22 bp, Artificial Sequence
  chemically synthesized
ggtctaacgtttaagtctttaa

SEQ ID NO: 849352 - DNA, 22 bp, Artificial Sequence
  chemically synthesized
acgtttaagtctttaatccatc

SEQ ID NO: 849353 - DNA, 22 bp, Artificial Sequence
  chemically synthesized
tacaaaaatcaattcaagatgg

SEQ ID NO: 849354 - DNA, 22 bp, Artificial Sequence
  chemically synthesized
aagtctttaatccatcttgaat

SEQ ID NO: 849355 - DNA, 22 bp, Artificial Sequence
  chemically synthesized
atacaaaaatcaattcaagatg

SEQ ID NO: 849356 - DNA, 22 bp, Artificial Sequence
  chemically synthesized
agtctttaatccatcttgaatt

SEQ ID NO: 849357 - DNA, 22 bp, Artificial Sequence
  chemically synthesized
caccttatacaaaaatcaattc

SEQ ID NO: 849358 - DNA, 22 bp, Artificial Sequence
  chemically synthesized
taatccatcttgaattgatttt

SEQ ID NO: 849359 - DNA, 22 bp, Artificial Sequence
  chemically synthesized
acaccttatacaaaaatcaatt

SEQ ID NO: 849360 - DNA, 22 bp, Artificial Sequence
  chemically synthesized
aatccatcttgaattgattttt

SEQ ID NO: 849361 - DNA, 22 bp, Artificial Sequence
  chemically synthesized
atccatcttgaattgatttttg

SEQ ID NO: 849362 - DNA, 22 bp, Artificial Sequence
  chemically synthesized
cttacaccttatacaaaaatca

SEQ ID NO: 849363 - DNA, 22 bp, Artificial Sequence
  chemically synthesized
ccttacaccttatacaaaaatc

SEQ ID NO: 849364 - DNA, 22 bp, Artificial Sequence
  chemically synthesized
gaattgatttttgtataaggtg

SEQ ID NO: 849365 - DNA, 22 bp, Artificial Sequence
  chemically synthesized
aattgatttttgtataaggtgt

SEQ ID NO: 849366 - DNA, 22 bp, Artificial Sequence
  chemically synthesized
gatcccttccttacaccttata

SEQ ID NO: 849367 - DNA, 22 bp, Artificial Sequence
  chemically synthesized
atttttgtataaggtgtaagga

SEQ ID NO: 849368 - DNA, 22 bp, Artificial Sequence
  chemically synthesized
aaactggatcccttccttacac

SEQ ID NO: 849369 - DNA, 22 bp, Artificial Sequence
  chemically synthesized
ttgtataaggtgtaaggaaggg

SEQ ID NO: 849370 - DNA, 22 bp, Artificial Sequence
  chemically synthesized
tgtataaggtgtaaggaaggga

SEQ ID NO: 849371 - DNA, 22 bp, Artificial Sequence
  chemically synthesized
gtataaggtgtaaggaagggat

SEQ ID NO: 849372 - DNA, 22 bp, Artificial Sequence
  chemically synthesized
tataaggtgtaaggaagggatc

SEQ ID NO: 849373 - DNA, 22 bp, Artificial Sequence
  chemically synthesized
gccatatgtagaaagctgaaac

SEQ ID NO: 849374 - DNA, 22 bp, Artificial Sequence
  chemically synthesized
gctagccatatgtagaaagctg

SEQ ID NO: 849375 - DNA, 22 bp, Artificial Sequence
  chemically synthesized
ggaaaactggctagccatatgt

SEQ ID NO: 849376 - DNA, 22 bp, Artificial Sequence
  chemically synthesized
cagctttctacatatggctagc

SEQ ID NO: 849377 - DNA, 22 bp, Artificial Sequence
  chemically synthesized
agctttctacatatggctagcc

SEQ ID NO: 849378 - DNA, 22 bp, Artificial Sequence
  chemically synthesized
tctacatatggctagccagttt

SEQ ID NO: 849379 - DNA, 22 bp, Artificial Sequence
  chemically synthesized
ctacatatggctagccagtttt

SEQ ID NO: 849380 - DNA, 22 bp, Artificial Sequence
  chemically synthesized
tacatatggctagccagttttc

SEQ ID NO: 849381 - DNA, 22 bp, Artificial Sequence
  chemically synthesized
catatggctagccagttttccc

SEQ ID NO: 849382 - DNA, 22 bp, Artificial Sequence
  chemically synthesized
ataaatggtgctgggaaaactg

SEQ ID NO: 849383 - DNA, 22 bp, Artificial Sequence
  chemically synthesized
aataaatggtgctgggaaaact

SEQ ID NO: 849384 - DNA, 22 bp, Artificial Sequence
  chemically synthesized
tttaataaatggtgctgggaaa

SEQ ID NO: 849385 - DNA, 22 bp, Artificial Sequence
  chemically synthesized
cctatttaataaatggtgctgg

SEQ ID NO: 849386 - DNA, 22 bp, Artificial Sequence
  chemically synthesized
gccagttttcccagcaccattt

SEQ ID NO: 849387 - DNA, 22 bp, Artificial Sequence
  chemically synthesized
tcccagcaccatttattaaata

SEQ ID NO: 849388 - DNA, 22 bp, Artificial Sequence
  chemically synthesized
cccagcaccatttattaaatag

SEQ ID NO: 849389 - DNA, 22 bp, Artificial Sequence
  chemically synthesized
ccagcaccatttattaaatagg

SEQ ID NO: 849390 - DNA, 22 bp, Artificial Sequence
  chemically synthesized
attaaatagggaatcctttccc

SEQ ID NO: 849391 - DNA, 22 bp, Artificial Sequence
  chemically synthesized
ttaaatagggaatcctttcccc

SEQ ID NO: 849392 - DNA, 22 bp, Artificial Sequence
  chemically synthesized
aatagggaatcctttccccatt

SEQ ID NO: 849393 - DNA, 22 bp, Artificial Sequence
  chemically synthesized
agaaaaacaagcaatggggaaa

SEQ ID NO: 849394 - DNA, 22 bp, Artificial Sequence
  chemically synthesized
acaaacctgagaaaaacaagca

SEQ ID NO: 849395 - DNA, 22 bp, Artificial Sequence
  chemically synthesized
gacaaacctgagaaaaacaagc

SEQ ID NO: 849396 - DNA, 22 bp, Artificial Sequence
  chemically synthesized
tgacaaacctgagaaaaacaag

SEQ ID NO: 849397 - DNA, 22 bp, Artificial Sequence
  chemically synthesized
tccccattgcttgtttttctca

SEQ ID NO: 849398 - DNA, 22 bp, Artificial Sequence
  chemically synthesized
ccccattgcttgtttttctcag

SEQ ID NO: 849399 - DNA, 22 bp, Artificial Sequence
  chemically synthesized
cccattgcttgtttttctcagg

SEQ ID NO: 849400 - DNA, 22 bp, Artificial Sequence
  chemically synthesized
atctttgacaaacctgagaaaa

SEQ ID NO: 849401 - DNA, 22 bp, Artificial Sequence
  chemically synthesized
tctgatctttgacaaacctgag

SEQ ID NO: 849402 - DNA, 22 bp, Artificial Sequence
  chemically synthesized
cttgtttttctcaggtttgtca

SEQ ID NO: 849403 - DNA, 22 bp, Artificial Sequence
  chemically synthesized
gtttttctcaggtttgtcaaag

SEQ ID NO: 849404 - DNA, 22 bp, Artificial Sequence
  chemically synthesized
ccactatctgatctttgacaaa

SEQ ID NO: 849405 - DNA, 22 bp, Artificial Sequence
  chemically synthesized
tttttctcaggtttgtcaaaga

SEQ ID NO: 849406 - DNA, 22 bp, Artificial Sequence
  chemically synthesized
ttctcaggtttgtcaaagatca

SEQ ID NO: 849407 - DNA, 22 bp, Artificial Sequence
  chemically synthesized
tctcaggtttgtcaaagatcag

SEQ ID NO: 849408 - DNA, 22 bp, Artificial Sequence
  chemically synthesized
ctcaggtttgtcaaagatcaga

SEQ ID NO: 849409 - DNA, 22 bp, Artificial Sequence
  chemically synthesized
tcaggtttgtcaaagatcagat

SEQ ID NO: 849410 - DNA, 22 bp, Artificial Sequence
  chemically synthesized
aggtttgtcaaagatcagatag

SEQ ID NO: 849411 - DNA, 22 bp, Artificial Sequence
  chemically synthesized
gtcaaagatcagatagtggtag

SEQ ID NO: 849412 - DNA, 22 bp, Artificial Sequence
  chemically synthesized
tcaaagatcagatagtggtaga

SEQ ID NO: 849413 - DNA, 22 bp, Artificial Sequence
  chemically synthesized
agaagtaacgccgcatatctac

SEQ ID NO: 849414 - DNA, 22 bp, Artificial Sequence
  chemically synthesized
cttctgagggctctgttctgtt

SEQ ID NO: 849415 - DNA, 22 bp, Artificial Sequence
  chemically synthesized
ctgagggctctgttctgttcca

SEQ ID NO: 849416 - DNA, 22 bp, Artificial Sequence
  chemically synthesized
tgagggctctgttctgttccat

SEQ ID NO: 849417 - DNA, 22 bp, Artificial Sequence
  chemically synthesized
agggctctgttctgttccattg

SEQ ID NO: 849418 - DNA, 22 bp, Artificial Sequence
  chemically synthesized
tgttctgttccattgatctata

SEQ ID NO: 849419 - DNA, 22 bp, Artificial Sequence
  chemically synthesized
ttctgttccattgatctatatg

SEQ ID NO: 849420 - DNA, 22 bp, Artificial Sequence
  chemically synthesized
gtaccaaaacagacatatagat

SEQ ID NO: 849421 - DNA, 22 bp, Artificial Sequence
  chemically synthesized
tgttccattgatctatatgtct

SEQ ID NO: 849422 - DNA, 22 bp, Artificial Sequence
  chemically synthesized
ttccattgatctatatgtctgt

SEQ ID NO: 849423 - DNA, 22 bp, Artificial Sequence
  chemically synthesized
cattgatctatatgtctgtttt

SEQ ID NO: 849424 - DNA, 22 bp, Artificial Sequence
  chemically synthesized
atctatatgtctgttttggtac

SEQ ID NO: 849425 - DNA, 22 bp, Artificial Sequence
  chemically synthesized
tatgtctgttttggtaccagta

SEQ ID NO: 849426 - DNA, 22 bp, Artificial Sequence
  chemically synthesized
ttttggtaccagtaccatgctg

SEQ ID NO: 849427 - DNA, 22 bp, Artificial Sequence
  chemically synthesized
cagtaaccaaaacagcatggta

SEQ ID NO: 849428 - DNA, 22 bp, Artificial Sequence
  chemically synthesized
tggtaccagtaccatgctgttt

SEQ ID NO: 849429 - DNA, 22 bp, Artificial Sequence
  chemically synthesized
ggtaccagtaccatgctgtttt

SEQ ID NO: 849430 - DNA, 22 bp, Artificial Sequence
  chemically synthesized
gtaccagtaccatgctgttttg

SEQ ID NO: 849431 - DNA, 22 bp, Artificial Sequence
  chemically synthesized
tagtacaaggctacagtaacca

SEQ ID NO: 849432 - DNA, 22 bp, Artificial Sequence
  chemically synthesized
tatagtacaaggctacagtaac

SEQ ID NO: 849433 - DNA, 22 bp, Artificial Sequence
  chemically synthesized
ctatagtacaaggctacagtaa

SEQ ID NO: 849434 - DNA, 22 bp, Artificial Sequence
  chemically synthesized
ttttggttactgtagccttgta

SEQ ID NO: 849435 - DNA, 22 bp, Artificial Sequence
  chemically synthesized
tggttactgtagccttgtacta

SEQ ID NO: 849436 - DNA, 22 bp, Artificial Sequence
  chemically synthesized
ggttactgtagccttgtactat

SEQ ID NO: 849437 - DNA, 22 bp, Artificial Sequence
  chemically synthesized
gttactgtagccttgtactata

SEQ ID NO: 849438 - DNA, 22 bp, Artificial Sequence
  chemically synthesized
aaagggaatgcttctatagtac

SEQ ID NO: 849439 - DNA, 22 bp, Artificial Sequence
  chemically synthesized
caaagggaatgcttctatagta

SEQ ID NO: 849440 - DNA, 22 bp, Artificial Sequence
  chemically synthesized
ctgtagccttgtactatagaag

SEQ ID NO: 849441 - DNA, 22 bp, Artificial Sequence
  chemically synthesized
tcaaagggaatgcttctatagt

SEQ ID NO: 849442 - DNA, 22 bp, Artificial Sequence
  chemically synthesized
tagccttgtactatagaagcat

SEQ ID NO: 849443 - DNA, 22 bp, Artificial Sequence
  chemically synthesized
tgccagttttcaaagggaatgc

SEQ ID NO: 849444 - DNA, 22 bp, Artificial Sequence
  chemically synthesized
gtactatagaagcattcccttt

SEQ ID NO: 849445 - DNA, 22 bp, Artificial Sequence
  chemically synthesized
gtgccagttttcaaagggaatg

SEQ ID NO: 849446 - DNA, 22 bp, Artificial Sequence
  chemically synthesized
tactatagaagcattccctttg

SEQ ID NO: 849447 - DNA, 22 bp, Artificial Sequence
  chemically synthesized
tcttgtgccagttttcaaaggg

SEQ ID NO: 849448 - DNA, 22 bp, Artificial Sequence
  chemically synthesized
tagaagcattccctttgaaaac

SEQ ID NO: 849449 - DNA, 22 bp, Artificial Sequence
  chemically synthesized
cctttgaaaactggcacaagac

SEQ ID NO: 849450 - DNA, 22 bp, Artificial Sequence
  chemically synthesized
tgaaaactggcacaagacaggg

SEQ ID NO: 849451 - DNA, 22 bp, Artificial Sequence
  chemically synthesized
gaaaactggcacaagacaggga

SEQ ID NO: 849452 - DNA, 22 bp, Artificial Sequence
  chemically synthesized
aaaactggcacaagacagggat

SEQ ID NO: 849453 - DNA, 22 bp, Artificial Sequence
  chemically synthesized
gcacaagacagggatgccctct

SEQ ID NO: 849454 - DNA, 22 bp, Artificial Sequence
  chemically synthesized
aataggagtggtgagagagggc

SEQ ID NO: 849455 - DNA, 22 bp, Artificial Sequence
  chemically synthesized
tgttgaataggagtggtgagag

SEQ ID NO: 849456 - DNA, 22 bp, Artificial Sequence
  chemically synthesized
caacactatgttgaataggagt

SEQ ID NO: 849457 - DNA, 22 bp, Artificial Sequence
  chemically synthesized
ccaacactatgttgaataggag

SEQ ID NO: 849458 - DNA, 22 bp, Artificial Sequence
  chemically synthesized
tctcaccactcctattcaacat

SEQ ID NO: 849459 - DNA, 22 bp, Artificial Sequence
  chemically synthesized
tcaccactcctattcaacatag

SEQ ID NO: 849460 - DNA, 22 bp, Artificial Sequence
  chemically synthesized
accactcctattcaacatagtg

SEQ ID NO: 849461 - DNA, 22 bp, Artificial Sequence
  chemically synthesized
gccagaacttccaacactatgt

SEQ ID NO: 849462 - DNA, 22 bp, Artificial Sequence
  chemically synthesized
ctattcaacatagtgttggaag

SEQ ID NO: 849463 - DNA, 22 bp, Artificial Sequence
  chemically synthesized
ccctggccagaacttccaacac

SEQ ID NO: 849464 - DNA, 22 bp, Artificial Sequence
  chemically synthesized
ttcaacatagtgttggaagttc

SEQ ID NO: 849465 - DNA, 22 bp, Artificial Sequence
  chemically synthesized
attgccctggccagaacttcca

SEQ ID NO: 849466 - DNA, 22 bp, Artificial Sequence
  chemically synthesized
aacatagtgttggaagttctgg

SEQ ID NO: 849467 - DNA, 22 bp, Artificial Sequence
  chemically synthesized
cctgattgccctggccagaact

SEQ ID NO: 849468 - DNA, 22 bp, Artificial Sequence
  chemically synthesized
ctgcctgattgccctggccaga

SEQ ID NO: 849469 - DNA, 22 bp, Artificial Sequence
  chemically synthesized
tcctgcctgattgccctggcca

SEQ ID NO: 849470 - DNA, 22 bp, Artificial Sequence
  chemically synthesized
ctcctgcctgattgccctggcc

SEQ ID NO: 849471 - DNA, 22 bp, Artificial Sequence
  chemically synthesized
cttctcctgcctgattgccctg

SEQ ID NO: 849472 - DNA, 22 bp, Artificial Sequence
  chemically synthesized
gaagttctggccagggcaatca

SEQ ID NO: 849473 - DNA, 22 bp, Artificial Sequence
  chemically synthesized
ccttctcctgcctgattgccct

SEQ ID NO: 849474 - DNA, 22 bp, Artificial Sequence
  chemically synthesized
tttccttctcctgcctgattgc

SEQ ID NO: 849475 - DNA, 22 bp, Artificial Sequence
  chemically synthesized
atttccttctcctgcctgattg

SEQ ID NO: 849476 - DNA, 22 bp, Artificial Sequence
  chemically synthesized
tatttccttctcctgcctgatt

SEQ ID NO: 849477 - DNA, 22 bp, Artificial Sequence
  chemically synthesized
tggccagggcaatcaggcagga

SEQ ID NO: 849478 - DNA, 22 bp, Artificial Sequence
  chemically synthesized
gccagggcaatcaggcaggaga

SEQ ID NO: 849479 - DNA, 22 bp, Artificial Sequence
  chemically synthesized
aataccctttatttccttctcc

SEQ ID NO: 849480 - DNA, 22 bp, Artificial Sequence
  chemically synthesized
attgaataccctttatttcctt

SEQ ID NO: 849481 - DNA, 22 bp, Artificial Sequence
  chemically synthesized
ctaattgaataccctttatttc

SEQ ID NO: 849482 - DNA, 22 bp, Artificial Sequence
  chemically synthesized
tcctaattgaataccctttatt

SEQ ID NO: 849483 - DNA, 22 bp, Artificial Sequence
  chemically synthesized
ctcctaattgaataccctttat

SEQ ID NO: 849484 - DNA, 22 bp, Artificial Sequence
  chemically synthesized
ttctcctaattgaatacccttt

SEQ ID NO: 849485 - DNA, 22 bp, Artificial Sequence
  chemically synthesized
ctcttctcctaattgaataccc

SEQ ID NO: 849486 - DNA, 22 bp, Artificial Sequence
  chemically synthesized
cctcttctcctaattgaatacc

SEQ ID NO: 849487 - DNA, 22 bp, Artificial Sequence
  chemically synthesized
acttcctcttctcctaattgaa

SEQ ID NO: 849488 - DNA, 22 bp, Artificial Sequence
  chemically synthesized
gacttcctcttctcctaattga

SEQ ID NO: 849489 - DNA, 22 bp, Artificial Sequence
  chemically synthesized
aattaggagaagaggaagtcaa

SEQ ID NO: 849490 - DNA, 22 bp, Artificial Sequence
  chemically synthesized
caaacagggacaatttgacttc

SEQ ID NO: 849491 - DNA, 22 bp, Artificial Sequence
  chemically synthesized
ggagaagaggaagtcaaattgt

SEQ ID NO: 849492 - DNA, 22 bp, Artificial Sequence
  chemically synthesized
gatatacaatcatgtcgtctgc

SEQ ID NO: 849493 - DNA, 22 bp, Artificial Sequence
  chemically synthesized
tagatatacaatcatgtcgtct

SEQ ID NO: 849494 - DNA, 22 bp, Artificial Sequence
  chemically synthesized
tccctgtttgcagacgacatga

SEQ ID NO: 849495 - DNA, 22 bp, Artificial Sequence
  chemically synthesized
ctagatatacaatcatgtcgtc

SEQ ID NO: 849496 - DNA, 22 bp, Artificial Sequence
  chemically synthesized
tctagatatacaatcatgtcgt

SEQ ID NO: 849497 - DNA, 22 bp, Artificial Sequence
  chemically synthesized
tttgcagacgacatgattgtat

SEQ ID NO: 849498 - DNA, 22 bp, Artificial Sequence
  chemically synthesized
gcagacgacatgattgtatatc

SEQ ID NO: 849499 - DNA, 22 bp, Artificial Sequence
  chemically synthesized
cagacgacatgattgtatatct

SEQ ID NO: 849500 - DNA, 22 bp, Artificial Sequence
  chemically synthesized
agacaatggggttttctagata

SEQ ID NO: 849501 - DNA, 22 bp, Artificial Sequence
  chemically synthesized
ggctgagacaatggggttttct

SEQ ID NO: 849502 - DNA, 22 bp, Artificial Sequence
  chemically synthesized
gggctgagacaatggggttttc

SEQ ID NO: 849503 - DNA, 22 bp, Artificial Sequence
  chemically synthesized
tgggctgagacaatggggtttt

SEQ ID NO: 849504 - DNA, 22 bp, Artificial Sequence
  chemically synthesized
tatatctagaaaaccccattgt

SEQ ID NO: 849505 - DNA, 22 bp, Artificial Sequence
  chemically synthesized
aggagattttgggctgagacaa

SEQ ID NO: 849506 - DNA, 22 bp, Artificial Sequence
  chemically synthesized
aaggagattttgggctgagaca

SEQ ID NO: 849507 - DNA, 22 bp, Artificial Sequence
  chemically synthesized
gaaaaccccattgtctcagccc

SEQ ID NO: 849508 - DNA, 22 bp, Artificial Sequence
  chemically synthesized
tcagcttaaggagattttgggc

SEQ ID NO: 849509 - DNA, 22 bp, Artificial Sequence
  chemically synthesized
atcagcttaaggagattttggg

SEQ ID NO: 849510 - DNA, 22 bp, Artificial Sequence
  chemically synthesized
cttatcagcttaaggagatttt

SEQ ID NO: 849511 - DNA, 22 bp, Artificial Sequence
  chemically synthesized
tctcagcccaaaatctccttaa

SEQ ID NO: 849512 - DNA, 22 bp, Artificial Sequence
  chemically synthesized
aagttgcttatcagcttaagga

SEQ ID NO: 849513 - DNA, 22 bp, Artificial Sequence
  chemically synthesized
agcccaaaatctccttaagctg

SEQ ID NO: 849514 - DNA, 22 bp, Artificial Sequence
  chemically synthesized
ctgaagttgcttatcagcttaa

SEQ ID NO: 849515 - DNA, 22 bp, Artificial Sequence
  chemically synthesized
gctgaagttgcttatcagctta

SEQ ID NO: 849516 - DNA, 22 bp, Artificial Sequence
  chemically synthesized
tgctgaagttgcttatcagctt

SEQ ID NO: 849517 - DNA, 22 bp, Artificial Sequence
  chemically synthesized
agactttgctgaagttgcttat

SEQ ID NO: 849518 - DNA, 22 bp, Artificial Sequence
  chemically synthesized
cttaagctgataagcaacttca

SEQ ID NO: 849519 - DNA, 22 bp, Artificial Sequence
  chemically synthesized
aagctgataagcaacttcagca

SEQ ID NO: 849520 - DNA, 22 bp, Artificial Sequence
  chemically synthesized
agctgataagcaacttcagcaa

SEQ ID NO: 849521 - DNA, 22 bp, Artificial Sequence
  chemically synthesized
tatcctgagactttgctgaagt

SEQ ID NO: 849522 - DNA, 22 bp, Artificial Sequence
  chemically synthesized
gtatcctgagactttgctgaag

SEQ ID NO: 849523 - DNA, 22 bp, Artificial Sequence
  chemically synthesized
tgtatcctgagactttgctgaa

SEQ ID NO: 849524 - DNA, 22 bp, Artificial Sequence
  chemically synthesized
ataagcaacttcagcaaagtct

SEQ ID NO: 849525 - DNA, 22 bp, Artificial Sequence
  chemically synthesized
attttgtatcctgagactttgc

SEQ ID NO: 849526 - DNA, 22 bp, Artificial Sequence
  chemically synthesized
tacattgattttgtatcctgag

SEQ ID NO: 849527 - DNA, 22 bp, Artificial Sequence
  chemically synthesized
gtacattgattttgtatcctga

SEQ ID NO: 849528 - DNA, 22 bp, Artificial Sequence
  chemically synthesized
tgtacattgattttgtatcctg

SEQ ID NO: 849529 - DNA, 22 bp, Artificial Sequence
  chemically synthesized
cagcaaagtctcaggatacaaa

SEQ ID NO: 849530 - DNA, 22 bp, Artificial Sequence
  chemically synthesized
ttgtacattgattttgtatcct

SEQ ID NO: 849531 - DNA, 22 bp, Artificial Sequence
  chemically synthesized
agcaaagtctcaggatacaaaa

SEQ ID NO: 849532 - DNA, 22 bp, Artificial Sequence
  chemically synthesized
tgatttttgtacattgattttg

SEQ ID NO: 849533 - DNA, 22 bp, Artificial Sequence
  chemically synthesized
gtgatttttgtacattgatttt

SEQ ID NO: 849534 - DNA, 22 bp, Artificial Sequence
  chemically synthesized
aggatacaaaatcaatgtacaa

SEQ ID NO: 849535 - DNA, 22 bp, Artificial Sequence
  chemically synthesized
gtgtataagaatgcttgtgatt

SEQ ID NO: 849536 - DNA, 22 bp, Artificial Sequence
  chemically synthesized
tcgttggtgtataagaatgctt

SEQ ID NO: 849537 - DNA, 22 bp, Artificial Sequence
  chemically synthesized
tctgtcgttggtgtataagaat

SEQ ID NO: 849538 - DNA, 22 bp, Artificial Sequence
  chemically synthesized
gtctgtcgttggtgtataagaa

SEQ ID NO: 849539 - DNA, 22 bp, Artificial Sequence
  chemically synthesized
tttgtctgtcgttggtgtataa

SEQ ID NO: 849540 - DNA, 22 bp, Artificial Sequence
  chemically synthesized
tgtttgtctgtcgttggtgtat

SEQ ID NO: 849541 - DNA, 22 bp, Artificial Sequence
  chemically synthesized
tctgtttgtctgtcgttggtgt

SEQ ID NO: 849542 - DNA, 22 bp, Artificial Sequence
  chemically synthesized
gctctctgtttgtctgtcgttg

SEQ ID NO: 849543 - DNA, 22 bp, Artificial Sequence
  chemically synthesized
ggctctctgtttgtctgtcgtt

SEQ ID NO: 849544 - DNA, 22 bp, Artificial Sequence
  chemically synthesized
ttatacaccaacgacagacaaa

SEQ ID NO: 849545 - DNA, 22 bp, Artificial Sequence
  chemically synthesized
atacaccaacgacagacaaaca

SEQ ID NO: 849546 - DNA, 22 bp, Artificial Sequence
  chemically synthesized
tacaccaacgacagacaaacag

SEQ ID NO: 849547 - DNA, 22 bp, Artificial Sequence
  chemically synthesized
atgatttggctctctgtttgtc

SEQ ID NO: 849548 - DNA, 22 bp, Artificial Sequence
  chemically synthesized
actcatgatttggctctctgtt

SEQ ID NO: 849549 - DNA, 22 bp, Artificial Sequence
  chemically synthesized
tgaatgggagttcactcatgat

SEQ ID NO: 849550 - DNA, 22 bp, Artificial Sequence
  chemically synthesized
aagcaattgtgaatgggagttc

SEQ ID NO: 849551 - DNA, 22 bp, Artificial Sequence
  chemically synthesized
gaagcaattgtgaatgggagtt

SEQ ID NO: 849552 - DNA, 22 bp, Artificial Sequence
  chemically synthesized
tgaagcaattgtgaatgggagt

SEQ ID NO: 849553 - DNA, 22 bp, Artificial Sequence
  chemically synthesized
tttgaagcaattgtgaatggga

SEQ ID NO: 849554 - DNA, 22 bp, Artificial Sequence
  chemically synthesized
tctttgaagcaattgtgaatgg

SEQ ID NO: 849555 - DNA, 22 bp, Artificial Sequence
  chemically synthesized
ttctctttgaagcaattgtgaa

SEQ ID NO: 849556 - DNA, 22 bp, Artificial Sequence
  chemically synthesized
attctctttgaagcaattgtga

SEQ ID NO: 849557 - DNA, 22 bp, Artificial Sequence
  chemically synthesized
tattctctttgaagcaattgtg

SEQ ID NO: 849558 - DNA, 22 bp, Artificial Sequence
  chemically synthesized
ccattcacaattgcttcaaaga

SEQ ID NO: 849559 - DNA, 22 bp, Artificial Sequence
  chemically synthesized
ggtattttattctctttgaagc

SEQ ID NO: 849560 - DNA, 22 bp, Artificial Sequence
  chemically synthesized
ctaggtattttattctctttga

SEQ ID NO: 849561 - DNA, 22 bp, Artificial Sequence
  chemically synthesized
acaattgcttcaaagagaataa

SEQ ID NO: 849562 - DNA, 22 bp, Artificial Sequence
  chemically synthesized
gattcctaggtattttattctc

SEQ ID NO: 849563 - DNA, 22 bp, Artificial Sequence
  chemically synthesized
cttcaaagagaataaaatacct

SEQ ID NO: 849564 - DNA, 22 bp, Artificial Sequence
  chemically synthesized
taagttggattcctaggtattt

SEQ ID NO: 849565 - DNA, 22 bp, Artificial Sequence
  chemically synthesized
caaagagaataaaatacctagg

SEQ ID NO: 849566 - DNA, 22 bp, Artificial Sequence
  chemically synthesized
gtaagttggattcctaggtatt

SEQ ID NO: 849567 - DNA, 22 bp, Artificial Sequence
  chemically synthesized
aaagagaataaaatacctagga

SEQ ID NO: 849568 - DNA, 22 bp, Artificial Sequence
  chemically synthesized
acatcgcttgtaagttggattc

SEQ ID NO: 849569 - DNA, 22 bp, Artificial Sequence
  chemically synthesized
cacatcgcttgtaagttggatt

SEQ ID NO: 849570 - DNA, 22 bp, Artificial Sequence
  chemically synthesized
ggaatccaacttacaagcgatg

SEQ ID NO: 849571 - DNA, 22 bp, Artificial Sequence
  chemically synthesized
aagaggtccttcacatcgcttg

SEQ ID NO: 849572 - DNA, 22 bp, Artificial Sequence
  chemically synthesized
gaagaggtccttcacatcgctt

SEQ ID NO: 849573 - DNA, 22 bp, Artificial Sequence
  chemically synthesized
cttgaagaggtccttcacatcg

SEQ ID NO: 849574 - DNA, 22 bp, Artificial Sequence
  chemically synthesized
tccttgaagaggtccttcacat

SEQ ID NO: 849575 - DNA, 22 bp, Artificial Sequence
  chemically synthesized
acaagcgatgtgaaggacctct

SEQ ID NO: 849576 - DNA, 22 bp, Artificial Sequence
  chemically synthesized
caagcgatgtgaaggacctctt

SEQ ID NO: 849577 - DNA, 22 bp, Artificial Sequence
  chemically synthesized
tagttctccttgaagaggtcct

SEQ ID NO: 849578 - DNA, 22 bp, Artificial Sequence
  chemically synthesized
gtagttctccttgaagaggtcc

SEQ ID NO: 849579 - DNA, 22 bp, Artificial Sequence
  chemically synthesized
agcagtggtttgtagttctcct

SEQ ID NO: 849580 - DNA, 22 bp, Artificial Sequence
  chemically synthesized
gagcagtggtttgtagttctcc

SEQ ID NO: 849581 - DNA, 22 bp, Artificial Sequence
  chemically synthesized
cttgagcagtggtttgtagttc

SEQ ID NO: 849582 - DNA, 22 bp, Artificial Sequence
  chemically synthesized
ccttgagcagtggtttgtagtt

SEQ ID NO: 849583 - DNA, 22 bp, Artificial Sequence
  chemically synthesized
ttcaaggagaactacaaaccac

SEQ ID NO: 849584 - DNA, 22 bp, Artificial Sequence
  chemically synthesized
tttccttgagcagtggtttgta

SEQ ID NO: 849585 - DNA, 22 bp, Artificial Sequence
  chemically synthesized
atttccttgagcagtggtttgt

SEQ ID NO: 849586 - DNA, 22 bp, Artificial Sequence
  chemically synthesized
caaggagaactacaaaccactg

SEQ ID NO: 849587 - DNA, 22 bp, Artificial Sequence
  chemically synthesized
tatttccttgagcagtggtttg

SEQ ID NO: 849588 - DNA, 22 bp, Artificial Sequence
  chemically synthesized
aaggagaactacaaaccactgc

SEQ ID NO: 849589 - DNA, 22 bp, Artificial Sequence
  chemically synthesized
ttatttccttgagcagtggttt

SEQ ID NO: 849590 - DNA, 22 bp, Artificial Sequence
  chemically synthesized
ttttatttccttgagcagtggt

SEQ ID NO: 849591 - DNA, 22 bp, Artificial Sequence
  chemically synthesized
tgtcctcttttatttccttgag

SEQ ID NO: 849592 - DNA, 22 bp, Artificial Sequence
  chemically synthesized
gtgtcctcttttatttccttga

SEQ ID NO: 849593 - DNA, 22 bp, Artificial Sequence
  chemically synthesized
caaaccactgctcaaggaaata

SEQ ID NO: 849594 - DNA, 22 bp, Artificial Sequence
  chemically synthesized
tttgtgtcctcttttatttcct

SEQ ID NO: 849595 - DNA, 22 bp, Artificial Sequence
  chemically synthesized
gtttgtgtcctcttttatttcc

SEQ ID NO: 849596 - DNA, 22 bp, Artificial Sequence
  chemically synthesized
catttgtttgtgtcctctttta

SEQ ID NO: 849597 - DNA, 22 bp, Artificial Sequence
  chemically synthesized
ccatttgtttgtgtcctctttt

SEQ ID NO: 849598 - DNA, 22 bp, Artificial Sequence
  chemically synthesized
ctcaaggaaataaaagaggaca

SEQ ID NO: 849599 - DNA, 22 bp, Artificial Sequence
  chemically synthesized
ttccatttgtttgtgtcctctt

SEQ ID NO: 849600 - DNA, 22 bp, Artificial Sequence
  chemically synthesized
aaggaaataaaagaggacacaa

SEQ ID NO: 849601 - DNA, 22 bp, Artificial Sequence
  chemically synthesized
cccatgagcacggaatgttctt

SEQ ID NO: 849602 - DNA, 22 bp, Artificial Sequence
  chemically synthesized
ctacccatgagcacggaatgtt

SEQ ID NO: 849603 - DNA, 22 bp, Artificial Sequence
  chemically synthesized
cctacccatgagcacggaatgt

SEQ ID NO: 849604 - DNA, 22 bp, Artificial Sequence
  chemically synthesized
ttcctacccatgagcacggaat

SEQ ID NO: 849605 - DNA, 22 bp, Artificial Sequence
  chemically synthesized
attcttcctacccatgagcacg

SEQ ID NO: 849606 - DNA, 22 bp, Artificial Sequence
  chemically synthesized
cacgatattgattcttcctacc

SEQ ID NO: 849607 - DNA, 22 bp, Artificial Sequence
  chemically synthesized
acacgatattgattcttcctac

SEQ ID NO: 849608 - DNA, 22 bp, Artificial Sequence
  chemically synthesized
cgtgctcatgggtaggaagaat

SEQ ID NO: 849609 - DNA, 22 bp, Artificial Sequence
  chemically synthesized
atgggtaggaagaatcaatatc

SEQ ID NO: 849610 - DNA, 22 bp, Artificial Sequence
  chemically synthesized
ggcagtatggccatttacacga

SEQ ID NO: 849611 - DNA, 22 bp, Artificial Sequence
  chemically synthesized
gggcagtatggccatttacacg

SEQ ID NO: 849612 - DNA, 22 bp, Artificial Sequence
  chemically synthesized
ccttgggcagtatggccattta

SEQ ID NO: 849613 - DNA, 22 bp, Artificial Sequence
  chemically synthesized
taaattaccttgggcagtatgg

SEQ ID NO: 849614 - DNA, 22 bp, Artificial Sequence
  chemically synthesized
aatctgtaaattaccttgggca

SEQ ID NO: 849615 - DNA, 22 bp, Artificial Sequence
  chemically synthesized
cccaaggtaatttacagattca

SEQ ID NO: 849616 - DNA, 22 bp, Artificial Sequence
  chemically synthesized
atggggatggcattgaatctgt

SEQ ID NO: 849617 - DNA, 22 bp, Artificial Sequence
  chemically synthesized
gatggggatggcattgaatctg

SEQ ID NO: 849618 - DNA, 22 bp, Artificial Sequence
  chemically synthesized
gtagcttgatggggatggcatt

SEQ ID NO: 849619 - DNA, 22 bp, Artificial Sequence
  chemically synthesized
acagattcaatgccatccccat

SEQ ID NO: 849620 - DNA, 22 bp, Artificial Sequence
  chemically synthesized
cagattcaatgccatccccatc

SEQ ID NO: 849621 - DNA, 22 bp, Artificial Sequence
  chemically synthesized
aatgccatccccatcaagctac

SEQ ID NO: 849622 - DNA, 22 bp, Artificial Sequence
  chemically synthesized
tgaagaaagtcattggtagctt

SEQ ID NO: 849623 - DNA, 22 bp, Artificial Sequence
  chemically synthesized
tgtgaagaaagtcattggtagc

SEQ ID NO: 849624 - DNA, 22 bp, Artificial Sequence
  chemically synthesized
caattctgtgaagaaagtcatt

SEQ ID NO: 849625 - DNA, 22 bp, Artificial Sequence
  chemically synthesized
ccaattctgtgaagaaagtcat

SEQ ID NO: 849626 - DNA, 22 bp, Artificial Sequence
  chemically synthesized
tccaattctgtgaagaaagtca

SEQ ID NO: 849627 - DNA, 22 bp, Artificial Sequence
  chemically synthesized
ttccaattctgtgaagaaagtc

SEQ ID NO: 849628 - DNA, 22 bp, Artificial Sequence
  chemically synthesized
tttccaattctgtgaagaaagt

SEQ ID NO: 849629 - DNA, 22 bp, Artificial Sequence
  chemically synthesized
ccaatgactttcttcacagaat

SEQ ID NO: 849630 - DNA, 22 bp, Artificial Sequence
  chemically synthesized
aagtagttttttccaattctgt

SEQ ID NO: 849631 - DNA, 22 bp, Artificial Sequence
  chemically synthesized
aaagtagttttttccaattctg

SEQ ID NO: 849632 - DNA, 22 bp, Artificial Sequence
  chemically synthesized
taaagtagttttttccaattct

SEQ ID NO: 849633 - DNA, 22 bp, Artificial Sequence
  chemically synthesized
tcttcacagaattggaaaaaac

SEQ ID NO: 849634 - DNA, 22 bp, Artificial Sequence
  chemically synthesized
cttcacagaattggaaaaaact

SEQ ID NO: 849635 - DNA, 22 bp, Artificial Sequence
  chemically synthesized
ttcacagaattggaaaaaacta

SEQ ID NO: 849636 - DNA, 22 bp, Artificial Sequence
  chemically synthesized
cacagaattggaaaaaactact

SEQ ID NO: 849637 - DNA, 22 bp, Artificial Sequence
  chemically synthesized
acagaattggaaaaaactactt

SEQ ID NO: 849638 - DNA, 22 bp, Artificial Sequence
  chemically synthesized
catatgaactttaaagtagttt

SEQ ID NO: 849639 - DNA, 22 bp, Artificial Sequence
  chemically synthesized
gttccatatgaactttaaagta

SEQ ID NO: 849640 - DNA, 22 bp, Artificial Sequence
  chemically synthesized
ggttccatatgaactttaaagt

SEQ ID NO: 849641 - DNA, 22 bp, Artificial Sequence
  chemically synthesized
tggttccatatgaactttaaag

SEQ ID NO: 849642 - DNA, 22 bp, Artificial Sequence
  chemically synthesized
ttggttccatatgaactttaaa

SEQ ID NO: 849643 - DNA, 22 bp, Artificial Sequence
  chemically synthesized
gaaaaaactactttaaagttca

SEQ ID NO: 849644 - DNA, 22 bp, Artificial Sequence
  chemically synthesized
tttggttccatatgaactttaa

SEQ ID NO: 849645 - DNA, 22 bp, Artificial Sequence
  chemically synthesized
ttttggttccatatgaacttta

SEQ ID NO: 849646 - DNA, 22 bp, Artificial Sequence
  chemically synthesized
ttttttggttccatatgaactt

SEQ ID NO: 849647 - DNA, 22 bp, Artificial Sequence
  chemically synthesized
ctttaaagttcatatggaacca

SEQ ID NO: 849648 - DNA, 22 bp, Artificial Sequence
  chemically synthesized
taaagttcatatggaaccaaaa

SEQ ID NO: 849649 - DNA, 22 bp, Artificial Sequence
  chemically synthesized
aaagttcatatggaaccaaaaa

SEQ ID NO: 849650 - DNA, 22 bp, Artificial Sequence
  chemically synthesized
aagttcatatggaaccaaaaaa

SEQ ID NO: 849651 - DNA, 22 bp, Artificial Sequence
  chemically synthesized
gcgatgcgggctcttttttggt

SEQ ID NO: 849652 - DNA, 22 bp, Artificial Sequence
  chemically synthesized
ggcgatgcgggctcttttttgg

SEQ ID NO: 849653 - DNA, 22 bp, Artificial Sequence
  chemically synthesized
atatggaaccaaaaaagagccc

SEQ ID NO: 849654 - DNA, 22 bp, Artificial Sequence
  chemically synthesized
acttggcgatgcgggctctttt

SEQ ID NO: 849655 - DNA, 22 bp, Artificial Sequence
  chemically synthesized
ggattgacttggcgatgcgggc

SEQ ID NO: 849656 - DNA, 22 bp, Artificial Sequence
  chemically synthesized
aggattgacttggcgatgcggg

SEQ ID NO: 849657 - DNA, 22 bp, Artificial Sequence
  chemically synthesized
gcttaggattgacttggcgatg

SEQ ID NO: 849658 - DNA, 22 bp, Artificial Sequence
  chemically synthesized
ggcttaggattgacttggcgat

SEQ ID NO: 849659 - DNA, 22 bp, Artificial Sequence
  chemically synthesized
tggcttaggattgacttggcga

SEQ ID NO: 849660 - DNA, 22 bp, Artificial Sequence
  chemically synthesized
ttggcttaggattgacttggcg

SEQ ID NO: 849661 - DNA, 22 bp, Artificial Sequence
  chemically synthesized
ttttggcttaggattgacttgg

SEQ ID NO: 849662 - DNA, 22 bp, Artificial Sequence
  chemically synthesized
ttcttttggcttaggattgact

SEQ ID NO: 849663 - DNA, 22 bp, Artificial Sequence
  chemically synthesized
gttcttttggcttaggattgac

SEQ ID NO: 849664 - DNA, 22 bp, Artificial Sequence
  chemically synthesized
tgttcttttggcttaggattga

SEQ ID NO: 849665 - DNA, 22 bp, Artificial Sequence
  chemically synthesized
cagctttgttcttttggcttag

SEQ ID NO: 849666 - DNA, 22 bp, Artificial Sequence
  chemically synthesized
agccaaaagaacaaagctggag

SEQ ID NO: 849667 - DNA, 22 bp, Artificial Sequence
  chemically synthesized
aagtcaggtagcgtgatgcctc

SEQ ID NO: 849668 - DNA, 22 bp, Artificial Sequence
  chemically synthesized
gaagtcaggtagcgtgatgcct

SEQ ID NO: 849669 - DNA, 22 bp, Artificial Sequence
  chemically synthesized
gtatagtttgaagtcaggtagc

SEQ ID NO: 849670 - DNA, 22 bp, Artificial Sequence
  chemically synthesized
agtatagtttgaagtcaggtag

SEQ ID NO: 849671 - DNA, 22 bp, Artificial Sequence
  chemically synthesized
gaggcatcacgctacctgactt

SEQ ID NO: 849672 - DNA, 22 bp, Artificial Sequence
  chemically synthesized
tagtatagtttgaagtcaggta

SEQ ID NO: 849673 - DNA, 22 bp, Artificial Sequence
  chemically synthesized
tcctttagtatagtttgaagtc

SEQ ID NO: 849674 - DNA, 22 bp, Artificial Sequence
  chemically synthesized
aaatgctatcctttagtatagt

SEQ ID NO: 849675 - DNA, 22 bp, Artificial Sequence
  chemically synthesized
cctgacttcaaactatactaaa

SEQ ID NO: 849676 - DNA, 22 bp, Artificial Sequence
  chemically synthesized
acttcaaactatactaaaggat

SEQ ID NO: 849677 - DNA, 22 bp, Artificial Sequence
  chemically synthesized
agttcaaatgctatcctttagt

SEQ ID NO: 849678 - DNA, 22 bp, Artificial Sequence
  chemically synthesized
caaactatactaaaggatagca

SEQ ID NO: 849679 - DNA, 22 bp, Artificial Sequence
  chemically synthesized
aaactatactaaaggatagcat

SEQ ID NO: 849680 - DNA, 22 bp, Artificial Sequence
  chemically synthesized
tactaaaggatagcatttgaac

SEQ ID NO: 849681 - DNA, 22 bp, Artificial Sequence
  chemically synthesized
aaggatagcatttgaactcagg

SEQ ID NO: 849682 - DNA, 22 bp, Artificial Sequence
  chemically synthesized
ggagtcagaaagacctgagttc

SEQ ID NO: 849683 - DNA, 22 bp, Artificial Sequence
  chemically synthesized
aggagtcagaaagacctgagtt

SEQ ID NO: 849684 - DNA, 22 bp, Artificial Sequence
  chemically synthesized
gacttaggagtcagaaagacct

SEQ ID NO: 849685 - DNA, 22 bp, Artificial Sequence
  chemically synthesized
gaactcaggtctttctgactcc

SEQ ID NO: 849686 - DNA, 22 bp, Artificial Sequence
  chemically synthesized
aactcaggtctttctgactcct

SEQ ID NO: 849687 - DNA, 22 bp, Artificial Sequence
  chemically synthesized
aggtctttctgactcctaagtc

SEQ ID NO: 849688 - DNA, 22 bp, Artificial Sequence
  chemically synthesized
tctgactcctaagtctagccct

SEQ ID NO: 849689 - DNA, 22 bp, Artificial Sequence
  chemically synthesized
tgacatgtggacagggctagac

SEQ ID NO: 849690 - DNA, 22 bp, Artificial Sequence
  chemically synthesized
ctgactcctaagtctagccctg

SEQ ID NO: 849691 - DNA, 22 bp, Artificial Sequence
  chemically synthesized
atgacatgtggacagggctaga

SEQ ID NO: 849692 - DNA, 22 bp, Artificial Sequence
  chemically synthesized
tgactcctaagtctagccctgt

SEQ ID NO: 849693 - DNA, 22 bp, Artificial Sequence
  chemically synthesized
actcctaagtctagccctgtcc

SEQ ID NO: 849694 - DNA, 22 bp, Artificial Sequence
  chemically synthesized
ctaagtctagccctgtccacat

SEQ ID NO: 849695 - DNA, 22 bp, Artificial Sequence
  chemically synthesized
agtctagccctgtccacatgtc

SEQ ID NO: 849696 - DNA, 22 bp, Artificial Sequence
  chemically synthesized
ggaagagaccttatgacatgtg

SEQ ID NO: 849697 - DNA, 22 bp, Artificial Sequence
  chemically synthesized
gggaagagaccttatgacatgt

SEQ ID NO: 849698 - DNA, 22 bp, Artificial Sequence
  chemically synthesized
gccctgtccacatgtcataagg

SEQ ID NO: 849699 - DNA, 22 bp, Artificial Sequence
  chemically synthesized
cttgggaagagaccttatgaca

SEQ ID NO: 849700 - DNA, 22 bp, Artificial Sequence
  chemically synthesized
tccacatgtcataaggtctctt

SEQ ID NO: 849701 - DNA, 22 bp, Artificial Sequence
  chemically synthesized
gaataggaagcagagttgcttg

SEQ ID NO: 849702 - DNA, 22 bp, Artificial Sequence
  chemically synthesized
ttcccaagcaactctgcttcct

SEQ ID NO: 849703 - DNA, 22 bp, Artificial Sequence
  chemically synthesized
cccaagcaactctgcttcctat

SEQ ID NO: 849704 - DNA, 22 bp, Artificial Sequence
  chemically synthesized
ccaagcaactctgcttcctatt

SEQ ID NO: 849705 - DNA, 22 bp, Artificial Sequence
  chemically synthesized
tgcttcctattctaacacttat

SEQ ID NO: 849706 - DNA, 22 bp, Artificial Sequence
  chemically synthesized
cttcctattctaacacttattc

SEQ ID NO: 849707 - DNA, 22 bp, Artificial Sequence
  chemically synthesized
cctattctaacacttattcctt

SEQ ID NO: 849708 - DNA, 22 bp, Artificial Sequence
  chemically synthesized
ctattctaacacttattcctta

SEQ ID NO: 849709 - DNA, 22 bp, Artificial Sequence
  chemically synthesized
ttctaacacttattccttactt

SEQ ID NO: 849710 - DNA, 22 bp, Artificial Sequence
  chemically synthesized
taacacttattccttactttcc

SEQ ID NO: 849711 - DNA, 22 bp, Artificial Sequence
  chemically synthesized
acacttattccttactttcctg

SEQ ID NO: 849712 - DNA, 22 bp, Artificial Sequence
  chemically synthesized
attccttactttcctgcctctg

SEQ ID NO: 849713 - DNA, 22 bp, Artificial Sequence
  chemically synthesized
ttccttactttcctgcctctgt

SEQ ID NO: 849714 - DNA, 22 bp, Artificial Sequence
  chemically synthesized
cttactttcctgcctctgtgac

SEQ ID NO: 849715 - DNA, 22 bp, Artificial Sequence
  chemically synthesized
actttcctgcctctgtgactct

SEQ ID NO: 849716 - DNA, 22 bp, Artificial Sequence
  chemically synthesized
ctttcctgcctctgtgactctg

SEQ ID NO: 849717 - DNA, 22 bp, Artificial Sequence
  chemically synthesized
gtggcatgagaaccagagtcac

SEQ ID NO: 849718 - DNA, 22 bp, Artificial Sequence
  chemically synthesized
ggtggcatgagaaccagagtca

SEQ ID NO: 849719 - DNA, 22 bp, Artificial Sequence
  chemically synthesized
tcctgcctctgtgactctggtt

SEQ ID NO: 849720 - DNA, 22 bp, Artificial Sequence
  chemically synthesized
cctgcctctgtgactctggttc

SEQ ID NO: 849721 - DNA, 22 bp, Artificial Sequence
  chemically synthesized
ctgcctctgtgactctggttct

SEQ ID NO: 849722 - DNA, 22 bp, Artificial Sequence
  chemically synthesized
cctctgtgactctggttctcat

SEQ ID NO: 849723 - DNA, 22 bp, Artificial Sequence
  chemically synthesized
atggatttggtggcatgagaac

SEQ ID NO: 849724 - DNA, 22 bp, Artificial Sequence
  chemically synthesized
tgtgactctggttctcatgcca

SEQ ID NO: 849725 - DNA, 22 bp, Artificial Sequence
  chemically synthesized
tgactctggttctcatgccacc

SEQ ID NO: 849726 - DNA, 22 bp, Artificial Sequence
  chemically synthesized
tggttctcatgccaccaaatcc

SEQ ID NO: 849727 - DNA, 22 bp, Artificial Sequence
  chemically synthesized
gttctcatgccaccaaatccat

SEQ ID NO: 849728 - DNA, 22 bp, Artificial Sequence
  chemically synthesized
caaggaagtgttgatggatttg

SEQ ID NO: 849729 - DNA, 22 bp, Artificial Sequence
  chemically synthesized
tcatgccaccaaatccatcaac

SEQ ID NO: 849730 - DNA, 22 bp, Artificial Sequence
  chemically synthesized
atgccaccaaatccatcaacac

SEQ ID NO: 849731 - DNA, 22 bp, Artificial Sequence
  chemically synthesized
gaaacaggactgcaaggaagtg

SEQ ID NO: 849732 - DNA, 22 bp, Artificial Sequence
  chemically synthesized
agaaacaggactgcaaggaagt

SEQ ID NO: 849733 - DNA, 22 bp, Artificial Sequence
  chemically synthesized
tagaaacaggactgcaaggaag

SEQ ID NO: 849734 - DNA, 22 bp, Artificial Sequence
  chemically synthesized
ttttagaaacaggactgcaagg

SEQ ID NO: 849735 - DNA, 22 bp, Artificial Sequence
  chemically synthesized
tattttagaaacaggactgcaa

SEQ ID NO: 849736 - DNA, 22 bp, Artificial Sequence
  chemically synthesized
aattctattttagaaacaggac

SEQ ID NO: 849737 - DNA, 22 bp, Artificial Sequence
  chemically synthesized
ccttgcagtcctgtttctaaaa

SEQ ID NO: 849738 - DNA, 22 bp, Artificial Sequence
  chemically synthesized
cttgcagtcctgtttctaaaat

SEQ ID NO: 849739 - DNA, 22 bp, Artificial Sequence
  chemically synthesized
acccactgaattctattttaga

SEQ ID NO: 849740 - DNA, 22 bp, Artificial Sequence
  chemically synthesized
gcagtcctgtttctaaaataga

SEQ ID NO: 849741 - DNA, 22 bp, Artificial Sequence
  chemically synthesized
aacccactgaattctattttag

SEQ ID NO: 849742 - DNA, 22 bp, Artificial Sequence
  chemically synthesized
cagtcctgtttctaaaatagaa

SEQ ID NO: 849743 - DNA, 22 bp, Artificial Sequence
  chemically synthesized
tttaacccactgaattctattt

SEQ ID NO: 849744 - DNA, 22 bp, Artificial Sequence
  chemically synthesized
gtttaacccactgaattctatt

SEQ ID NO: 849745 - DNA, 22 bp, Artificial Sequence
  chemically synthesized
tttctaaaatagaattcagtgg

SEQ ID NO: 849746 - DNA, 22 bp, Artificial Sequence
  chemically synthesized
ctaaaatagaattcagtgggtt

SEQ ID NO: 849747 - DNA, 22 bp, Artificial Sequence
  chemically synthesized
taaaatagaattcagtgggtta

SEQ ID NO: 849748 - DNA, 22 bp, Artificial Sequence
  chemically synthesized
aaatagaattcagtgggttaaa

SEQ ID NO: 849749 - DNA, 22 bp, Artificial Sequence
  chemically synthesized
aaatcatgatttgtttaaccca

SEQ ID NO: 849750 - DNA, 22 bp, Artificial Sequence
  chemically synthesized
aaaatcatgatttgtttaaccc

SEQ ID NO: 849751 - DNA, 22 bp, Artificial Sequence
  chemically synthesized
taaaatcatgatttgtttaacc

SEQ ID NO: 849752 - DNA, 22 bp, Artificial Sequence
  chemically synthesized
ttaaaatcatgatttgtttaac

SEQ ID NO: 849753 - DNA, 22 bp, Artificial Sequence
  chemically synthesized
tttaaaatcatgatttgtttaa

SEQ ID NO: 849754 - DNA, 22 bp, Artificial Sequence
  chemically synthesized
ctttttaaaatcatgatttgtt

SEQ ID NO: 849755 - DNA, 22 bp, Artificial Sequence
  chemically synthesized
tgctttttaaaatcatgatttg

SEQ ID NO: 849756 - DNA, 22 bp, Artificial Sequence
  chemically synthesized
agtgggttaaacaaatcatgat

SEQ ID NO: 849757 - DNA, 22 bp, Artificial Sequence
  chemically synthesized
ctgctttttaaaatcatgattt

SEQ ID NO: 849758 - DNA, 22 bp, Artificial Sequence
  chemically synthesized
ccttctgctttttaaaatcatg

SEQ ID NO: 849759 - DNA, 22 bp, Artificial Sequence
  chemically synthesized
cccttctgctttttaaaatcat

SEQ ID NO: 849760 - DNA, 22 bp, Artificial Sequence
  chemically synthesized
tcccttctgctttttaaaatca

SEQ ID NO: 849761 - DNA, 22 bp, Artificial Sequence
  chemically synthesized
aacaaatcatgattttaaaaag

SEQ ID NO: 849762 - DNA, 22 bp, Artificial Sequence
  chemically synthesized
tgtagttttcccttctgctttt

SEQ ID NO: 849763 - DNA, 22 bp, Artificial Sequence
  chemically synthesized
taaaaagcagaagggaaaacta

SEQ ID NO: 849764 - DNA, 22 bp, Artificial Sequence
  chemically synthesized
aaaaagcagaagggaaaactac

SEQ ID NO: 849765 - DNA, 22 bp, Artificial Sequence
  chemically synthesized
aaaagcagaagggaaaactaca

SEQ ID NO: 849766 - DNA, 22 bp, Artificial Sequence
  chemically synthesized
gagaaagatgaggagaagcaag

SEQ ID NO: 849767 - DNA, 22 bp, Artificial Sequence
  chemically synthesized
cacaattggcttgcttctcctc

SEQ ID NO: 849768 - DNA, 22 bp, Artificial Sequence
  chemically synthesized
gcttgcttctcctcatctttct

SEQ ID NO: 849769 - DNA, 22 bp, Artificial Sequence
  chemically synthesized
gaaatgaagttagagaaagatg

SEQ ID NO: 849770 - DNA, 22 bp, Artificial Sequence
  chemically synthesized
gcttctcctcatctttctctaa

SEQ ID NO: 849771 - DNA, 22 bp, Artificial Sequence
  chemically synthesized
cttctcctcatctttctctaac

SEQ ID NO: 849772 - DNA, 22 bp, Artificial Sequence
  chemically synthesized
ctcctcatctttctctaacttc

SEQ ID NO: 849773 - DNA, 22 bp, Artificial Sequence
  chemically synthesized
tcctcatctttctctaacttca

SEQ ID NO: 849774 - DNA, 22 bp, Artificial Sequence
  chemically synthesized
ctcatctttctctaacttcatt

SEQ ID NO: 849775 - DNA, 22 bp, Artificial Sequence
  chemically synthesized
atctttctctaacttcatttcc

SEQ ID NO: 849776 - DNA, 22 bp, Artificial Sequence
  chemically synthesized
tctctaacttcatttccagctg

SEQ ID NO: 849777 - DNA, 22 bp, Artificial Sequence
  chemically synthesized
ctctaacttcatttccagctgg

SEQ ID NO: 849778 - DNA, 22 bp, Artificial Sequence
  chemically synthesized
tctaacttcatttccagctgga

SEQ ID NO: 849779 - DNA, 22 bp, Artificial Sequence
  chemically synthesized
taacttcatttccagctggaca

SEQ ID NO: 849780 - DNA, 22 bp, Artificial Sequence
  chemically synthesized
acttcatttccagctggacact

SEQ ID NO: 849781 - DNA, 22 bp, Artificial Sequence
  chemically synthesized
catttccagctggacacttttc

SEQ ID NO: 849782 - DNA, 22 bp, Artificial Sequence
  chemically synthesized
atttccagctggacacttttcc

SEQ ID NO: 849783 - DNA, 22 bp, Artificial Sequence
  chemically synthesized
ccagctggacacttttcccttt

SEQ ID NO: 849784 - DNA, 22 bp, Artificial Sequence
  chemically synthesized
cagctggacacttttccctttt

SEQ ID NO: 849785 - DNA, 22 bp, Artificial Sequence
  chemically synthesized
gacacttttccctttttgttct

SEQ ID NO: 849786 - DNA, 22 bp, Artificial Sequence
  chemically synthesized
ttccctttttgttctgctttat

SEQ ID NO: 849787 - DNA, 22 bp, Artificial Sequence
  chemically synthesized
tgtgaaataataataaagcaga

SEQ ID NO: 849788 - DNA, 22 bp, Artificial Sequence
  chemically synthesized
tccctttttgttctgctttatt

SEQ ID NO: 849789 - DNA, 22 bp, Artificial Sequence
  chemically synthesized
gtgtgaaataataataaagcag

SEQ ID NO: 849790 - DNA, 22 bp, Artificial Sequence
  chemically synthesized
ccctttttgttctgctttatta

SEQ ID NO: 849791 - DNA, 22 bp, Artificial Sequence
  chemically synthesized
cctttttgttctgctttattat

SEQ ID NO: 849792 - DNA, 22 bp, Artificial Sequence
  chemically synthesized
tttgttctgctttattattatt

SEQ ID NO: 849793 - DNA, 22 bp, Artificial Sequence
  chemically synthesized
ttgttctgctttattattattt

SEQ ID NO: 849794 - DNA, 22 bp, Artificial Sequence
  chemically synthesized
tgttctgctttattattatttc

SEQ ID NO: 849795 - DNA, 22 bp, Artificial Sequence
  chemically synthesized
gttctgctttattattatttca

SEQ ID NO: 849796 - DNA, 22 bp, Artificial Sequence
  chemically synthesized
aatgtatttgtgtgaaataata

SEQ ID NO: 849797 - DNA, 22 bp, Artificial Sequence
  chemically synthesized
ttctgctttattattatttcac

SEQ ID NO: 849798 - DNA, 22 bp, Artificial Sequence
  chemically synthesized
tgctttattattatttcacaca

SEQ ID NO: 849799 - DNA, 22 bp, Artificial Sequence
  chemically synthesized
ctttattattatttcacacaaa

SEQ ID NO: 849800 - DNA, 22 bp, Artificial Sequence
  chemically synthesized
tattattatttcacacaaatac

SEQ ID NO: 849801 - DNA, 22 bp, Artificial Sequence
  chemically synthesized
attattatttcacacaaataca

SEQ ID NO: 849802 - DNA, 22 bp, Artificial Sequence
  chemically synthesized
ttattatttcacacaaatacat

SEQ ID NO: 849803 - DNA, 22 bp, Artificial Sequence
  chemically synthesized
ttatttcacacaaatacattca

SEQ ID NO: 849804 - DNA, 22 bp, Artificial Sequence
  chemically synthesized
tttcacacaaatacattcagat

SEQ ID NO: 849805 - DNA, 22 bp, Artificial Sequence
  chemically synthesized
cacacaaatacattcagatttg

SEQ ID NO: 849806 - DNA, 22 bp, Artificial Sequence
  chemically synthesized
acacaaatacattcagatttgt

SEQ ID NO: 849807 - DNA, 22 bp, Artificial Sequence
  chemically synthesized
gaacaaaaggtgacaaatctga

SEQ ID NO: 849808 - DNA, 22 bp, Artificial Sequence
  chemically synthesized
cagcattagaacaaaaggtgac

SEQ ID NO: 849809 - DNA, 22 bp, Artificial Sequence
  chemically synthesized
ccagcattagaacaaaaggtga

SEQ ID NO: 849810 - DNA, 22 bp, Artificial Sequence
  chemically synthesized
agatttgtcaccttttgttcta

SEQ ID NO: 849811 - DNA, 22 bp, Artificial Sequence
  chemically synthesized
tatttccagcattagaacaaaa

SEQ ID NO: 849812 - DNA, 22 bp, Artificial Sequence
  chemically synthesized
gtatttccagcattagaacaaa

SEQ ID NO: 849813 - DNA, 22 bp, Artificial Sequence
  chemically synthesized
gtcaccttttgttctaatgctg

SEQ ID NO: 849814 - DNA, 22 bp, Artificial Sequence
  chemically synthesized
tcaccttttgttctaatgctgg

SEQ ID NO: 849815 - DNA, 22 bp, Artificial Sequence
  chemically synthesized
ttgttctaatgctggaaataca

SEQ ID NO: 849816 - DNA, 22 bp, Artificial Sequence
  chemically synthesized
gccatatgaatttgtatttcca

SEQ ID NO: 849817 - DNA, 22 bp, Artificial Sequence
  chemically synthesized
tgttctaatgctggaaatacaa

SEQ ID NO: 849818 - DNA, 22 bp, Artificial Sequence
  chemically synthesized
agccatatgaatttgtatttcc

SEQ ID NO: 849819 - DNA, 22 bp, Artificial Sequence
  chemically synthesized
gttctaatgctggaaatacaaa

SEQ ID NO: 849820 - DNA, 22 bp, Artificial Sequence
  chemically synthesized
tagccatatgaatttgtatttc

SEQ ID NO: 849821 - DNA, 22 bp, Artificial Sequence
  chemically synthesized
ttctaatgctggaaatacaaat

SEQ ID NO: 849822 - DNA, 22 bp, Artificial Sequence
  chemically synthesized
taatgctggaaatacaaattca

SEQ ID NO: 849823 - DNA, 22 bp, Artificial Sequence
  chemically synthesized
cgttttagccatatgaatttgt

SEQ ID NO: 849824 - DNA, 22 bp, Artificial Sequence
  chemically synthesized
atgctggaaatacaaattcata

SEQ ID NO: 849825 - DNA, 22 bp, Artificial Sequence
  chemically synthesized
gaaatacaaattcatatggcta

SEQ ID NO: 849826 - DNA, 22 bp, Artificial Sequence
  chemically synthesized
atatggctaaaacggagtggac

SEQ ID NO: 849827 - DNA, 22 bp, Artificial Sequence
  chemically synthesized
ggggcaatgtcatggtccactc

SEQ ID NO: 849828 - DNA, 22 bp, Artificial Sequence
  chemically synthesized
aaacggagtggaccatgacatt

SEQ ID NO: 849829 - DNA, 22 bp, Artificial Sequence
  chemically synthesized
caaggaataaaagtggggtctg

SEQ ID NO: 849830 - DNA, 22 bp, Artificial Sequence
  chemically synthesized
attacaaggaataaaagtgggg

SEQ ID NO: 849831 - DNA, 22 bp, Artificial Sequence
  chemically synthesized
aattacaaggaataaaagtggg

SEQ ID NO: 849832 - DNA, 22 bp, Artificial Sequence
  chemically synthesized
ttaattacaaggaataaaagtg

SEQ ID NO: 849833 - DNA, 22 bp, Artificial Sequence
  chemically synthesized
cccccagaccccacttttattc

SEQ ID NO: 849834 - DNA, 22 bp, Artificial Sequence
  chemically synthesized
cttaattacaaggaataaaagt

SEQ ID NO: 849835 - DNA, 22 bp, Artificial Sequence
  chemically synthesized
tcttaattacaaggaataaaag

SEQ ID NO: 849836 - DNA, 22 bp, Artificial Sequence
  chemically synthesized
ttcttaattacaaggaataaaa

SEQ ID NO: 849837 - DNA, 22 bp, Artificial Sequence
  chemically synthesized
tttcttaattacaaggaataaa

SEQ ID NO: 849838 - DNA, 22 bp, Artificial Sequence
  chemically synthesized
ttttttcttaattacaaggaat

SEQ ID NO: 849839 - DNA, 22 bp, Artificial Sequence
  chemically synthesized
attttttcttaattacaaggaa

SEQ ID NO: 849840 - DNA, 22 bp, Artificial Sequence
  chemically synthesized
aggtttattttttcttaattac

SEQ ID NO: 849841 - DNA, 22 bp, Artificial Sequence
  chemically synthesized
ttattccttgtaattaagaaaa

SEQ ID NO: 849842 - DNA, 22 bp, Artificial Sequence
  chemically synthesized
ttaaggtttattttttcttaat

SEQ ID NO: 849843 - DNA, 22 bp, Artificial Sequence
  chemically synthesized
tattccttgtaattaagaaaaa

SEQ ID NO: 849844 - DNA, 22 bp, Artificial Sequence
  chemically synthesized
attaaggtttattttttcttaa

SEQ ID NO: 849845 - DNA, 22 bp, Artificial Sequence
  chemically synthesized
attccttgtaattaagaaaaaa

SEQ ID NO: 849846 - DNA, 22 bp, Artificial Sequence
  chemically synthesized
ttccttgtaattaagaaaaaat

SEQ ID NO: 849847 - DNA, 22 bp, Artificial Sequence
  chemically synthesized
ttattaaggtttattttttctt

SEQ ID NO: 849848 - DNA, 22 bp, Artificial Sequence
  chemically synthesized
cttattaaggtttattttttct

SEQ ID NO: 849849 - DNA, 22 bp, Artificial Sequence
  chemically synthesized
cttgtaattaagaaaaaataaa

SEQ ID NO: 849850 - DNA, 22 bp, Artificial Sequence
  chemically synthesized
gtaattaagaaaaaataaacct

SEQ ID NO: 849851 - DNA, 22 bp, Artificial Sequence
  chemically synthesized
taattaagaaaaaataaacctt

SEQ ID NO: 849852 - DNA, 22 bp, Artificial Sequence
  chemically synthesized
atacaagcttcttattaaggtt

SEQ ID NO: 849853 - DNA, 22 bp, Artificial Sequence
  chemically synthesized
aatacaagcttcttattaaggt

SEQ ID NO: 849854 - DNA, 22 bp, Artificial Sequence
  chemically synthesized
agaaaaaataaaccttaataag

SEQ ID NO: 849855 - DNA, 22 bp, Artificial Sequence
  chemically synthesized
taatacaagcttcttattaagg

SEQ ID NO: 849856 - DNA, 22 bp, Artificial Sequence
  chemically synthesized
cacaattttaatacaagcttct

SEQ ID NO: 849857 - DNA, 22 bp, Artificial Sequence
  chemically synthesized
gcacaattttaatacaagcttc

SEQ ID NO: 849858 - DNA, 22 bp, Artificial Sequence
  chemically synthesized
tgcacaattttaatacaagctt

SEQ ID NO: 849859 - DNA, 22 bp, Artificial Sequence
  chemically synthesized
actttgcacaattttaatacaa

SEQ ID NO: 849860 - DNA, 22 bp, Artificial Sequence
  chemically synthesized
aataagaagcttgtattaaaat

SEQ ID NO: 849861 - DNA, 22 bp, Artificial Sequence
  chemically synthesized
ataagaagcttgtattaaaatt

SEQ ID NO: 849862 - DNA, 22 bp, Artificial Sequence
  chemically synthesized
gtaatgactaactttgcacaat

SEQ ID NO: 849863 - DNA, 22 bp, Artificial Sequence
  chemically synthesized
agtaatgactaactttgcacaa

SEQ ID NO: 849864 - DNA, 22 bp, Artificial Sequence
  chemically synthesized
gtattaaaattgtgcaaagtta

SEQ ID NO: 849865 - DNA, 22 bp, Artificial Sequence
  chemically synthesized
tattaaaattgtgcaaagttag

SEQ ID NO: 849866 - DNA, 22 bp, Artificial Sequence
  chemically synthesized
aaattgtgcaaagttagtcatt

SEQ ID NO: 849867 - DNA, 22 bp, Artificial Sequence
  chemically synthesized
tgcaaagttagtcattactaaa

SEQ ID NO: 849868 - DNA, 22 bp, Artificial Sequence
  chemically synthesized
atacagccatgaacatttagta

SEQ ID NO: 849869 - DNA, 22 bp, Artificial Sequence
  chemically synthesized
gtcattactaaatgttcatggc

SEQ ID NO: 849870 - DNA, 22 bp, Artificial Sequence
  chemically synthesized
ctaaatgttcatggctgtatta

SEQ ID NO: 849871 - DNA, 22 bp, Artificial Sequence
  chemically synthesized
aatgttcatggctgtattagct

SEQ ID NO: 849872 - DNA, 22 bp, Artificial Sequence
  chemically synthesized
caacagccacaggcagctaata

SEQ ID NO: 849873 - DNA, 22 bp, Artificial Sequence
  chemically synthesized
ttacaacagccacaggcagcta

SEQ ID NO: 849874 - DNA, 22 bp, Artificial Sequence
  chemically synthesized
gttacaacagccacaggcagct

SEQ ID NO: 849875 - DNA, 22 bp, Artificial Sequence
  chemically synthesized
atggctgtattagctgcctgtg

SEQ ID NO: 849876 - DNA, 22 bp, Artificial Sequence
  chemically synthesized
tattagctgcctgtggctgttg

SEQ ID NO: 849877 - DNA, 22 bp, Artificial Sequence
  chemically synthesized
taatcatttgttacaacagcca

SEQ ID NO: 849878 - DNA, 22 bp, Artificial Sequence
  chemically synthesized
gctgcctgtggctgttgtaaca

SEQ ID NO: 849879 - DNA, 22 bp, Artificial Sequence
  chemically synthesized
agtctgtaatcatttgttacaa

SEQ ID NO: 849880 - DNA, 22 bp, Artificial Sequence
  chemically synthesized
cctgtggctgttgtaacaaatg

SEQ ID NO: 849881 - DNA, 22 bp, Artificial Sequence
  chemically synthesized
tggctgttgtaacaaatgatta

SEQ ID NO: 849882 - DNA, 22 bp, Artificial Sequence
  chemically synthesized
agccattaagtctgtaatcatt

SEQ ID NO: 849883 - DNA, 22 bp, Artificial Sequence
  chemically synthesized
aagccattaagtctgtaatcat

SEQ ID NO: 849884 - DNA, 22 bp, Artificial Sequence
  chemically synthesized
taagccattaagtctgtaatca

SEQ ID NO: 849885 - DNA, 22 bp, Artificial Sequence
  chemically synthesized
ttgtaacaaatgattacagact

SEQ ID NO: 849886 - DNA, 22 bp, Artificial Sequence
  chemically synthesized
ttttaagccattaagtctgtaa

SEQ ID NO: 849887 - DNA, 22 bp, Artificial Sequence
  chemically synthesized
taacaaatgattacagacttaa

SEQ ID NO: 849888 - DNA, 22 bp, Artificial Sequence
  chemically synthesized
ggttgttttaagccattaagtc

SEQ ID NO: 849889 - DNA, 22 bp, Artificial Sequence
  chemically synthesized
gggttgttttaagccattaagt

SEQ ID NO: 849890 - DNA, 22 bp, Artificial Sequence
  chemically synthesized
cagacttaatggcttaaaacaa

SEQ ID NO: 849891 - DNA, 22 bp, Artificial Sequence
  chemically synthesized
taagataataaatttgggttgt

SEQ ID NO: 849892 - DNA, 22 bp, Artificial Sequence
  chemically synthesized
aatggcttaaaacaacccaaat

SEQ ID NO: 849893 - DNA, 22 bp, Artificial Sequence
  chemically synthesized
atggcttaaaacaacccaaatt

SEQ ID NO: 849894 - DNA, 22 bp, Artificial Sequence
  chemically synthesized
caaaattgtaagataataaatt

SEQ ID NO: 849895 - DNA, 22 bp, Artificial Sequence
  chemically synthesized
aaaacaacccaaatttattatc

SEQ ID NO: 849896 - DNA, 22 bp, Artificial Sequence
  chemically synthesized
aaacaacccaaatttattatct

SEQ ID NO: 849897 - DNA, 22 bp, Artificial Sequence
  chemically synthesized
gacctccaaaattgtaagataa

SEQ ID NO: 849898 - DNA, 22 bp, Artificial Sequence
  chemically synthesized
ggacctccaaaattgtaagata

SEQ ID NO: 849899 - DNA, 22 bp, Artificial Sequence
  chemically synthesized
tggacctccaaaattgtaagat

SEQ ID NO: 849900 - DNA, 22 bp, Artificial Sequence
  chemically synthesized
gactttggacctccaaaattgt

SEQ ID NO: 849901 - DNA, 22 bp, Artificial Sequence
  chemically synthesized
ggactttggacctccaaaattg

SEQ ID NO: 849902 - DNA, 22 bp, Artificial Sequence
  chemically synthesized
tggactttggacctccaaaatt

SEQ ID NO: 849903 - DNA, 22 bp, Artificial Sequence
  chemically synthesized
ttggactttggacctccaaaat

SEQ ID NO: 849904 - DNA, 22 bp, Artificial Sequence
  chemically synthesized
attatcttacaattttggaggt

SEQ ID NO: 849905 - DNA, 22 bp, Artificial Sequence
  chemically synthesized
tttggactttggacctccaaaa

SEQ ID NO: 849906 - DNA, 22 bp, Artificial Sequence
  chemically synthesized
ttatcttacaattttggaggtc

SEQ ID NO: 849907 - DNA, 22 bp, Artificial Sequence
  chemically synthesized
tcttacaattttggaggtccaa

SEQ ID NO: 849908 - DNA, 22 bp, Artificial Sequence
  chemically synthesized
acaattttggaggtccaaagtc

SEQ ID NO: 849909 - DNA, 22 bp, Artificial Sequence
  chemically synthesized
caattttggaggtccaaagtcc

SEQ ID NO: 849910 - DNA, 22 bp, Artificial Sequence
  chemically synthesized
tgagacccattttttggacttt

SEQ ID NO: 849911 - DNA, 22 bp, Artificial Sequence
  chemically synthesized
gtgagacccattttttggactt

SEQ ID NO: 849912 - DNA, 22 bp, Artificial Sequence
  chemically synthesized
tggaggtccaaagtccaaaaaa

SEQ ID NO: 849913 - DNA, 22 bp, Artificial Sequence
  chemically synthesized
ggaggtccaaagtccaaaaaat

SEQ ID NO: 849914 - DNA, 22 bp, Artificial Sequence
  chemically synthesized
gaggtccaaagtccaaaaaatg

SEQ ID NO: 849915 - DNA, 22 bp, Artificial Sequence
  chemically synthesized
gcttgtgagacccattttttgg

SEQ ID NO: 849916 - DNA, 22 bp, Artificial Sequence
  chemically synthesized
tagcttgtgagacccatttttt

SEQ ID NO: 849917 - DNA, 22 bp, Artificial Sequence
  chemically synthesized
ctagcttgtgagacccattttt

SEQ ID NO: 849918 - DNA, 22 bp, Artificial Sequence
  chemically synthesized
tttctagcttgtgagacccatt

SEQ ID NO: 849919 - DNA, 22 bp, Artificial Sequence
  chemically synthesized
ccaacacattgtttctagcttg

SEQ ID NO: 849920 - DNA, 22 bp, Artificial Sequence
  chemically synthesized
tgccaacacattgtttctagct

SEQ ID NO: 849921 - DNA, 22 bp, Artificial Sequence
  chemically synthesized
acaagctagaaacaatgtgttg

SEQ ID NO: 849922 - DNA, 22 bp, Artificial Sequence
  chemically synthesized
gagggaatgcaagctctgccaa

SEQ ID NO: 849923 - DNA, 22 bp, Artificial Sequence
  chemically synthesized
gaaacaatgtgttggcagagct

SEQ ID NO: 849924 - DNA, 22 bp, Artificial Sequence
  chemically synthesized
agagggaatgcaagctctgcca

SEQ ID NO: 849925 - DNA, 22 bp, Artificial Sequence
  chemically synthesized
catcccttagagggaatgcaag

SEQ ID NO: 849926 - DNA, 22 bp, Artificial Sequence
  chemically synthesized
ccctacatcccttagagggaat

SEQ ID NO: 849927 - DNA, 22 bp, Artificial Sequence
  chemically synthesized
gcagagcttgcattccctctaa

SEQ ID NO: 849928 - DNA, 22 bp, Artificial Sequence
  chemically synthesized
gcattccctctaagggatgtag

SEQ ID NO: 849929 - DNA, 22 bp, Artificial Sequence
  chemically synthesized
cattccctctaagggatgtagg

SEQ ID NO: 849930 - DNA, 22 bp, Artificial Sequence
  chemically synthesized
cctctaagggatgtaggggagg

SEQ ID NO: 849931 - DNA, 22 bp, Artificial Sequence
  chemically synthesized
taagggatgtaggggaggattc

SEQ ID NO: 849932 - DNA, 22 bp, Artificial Sequence
  chemically synthesized
agggatgtaggggaggattctt

SEQ ID NO: 849933 - DNA, 22 bp, Artificial Sequence
  chemically synthesized
gaaaaggcatggaaaagaatcc

SEQ ID NO: 849934 - DNA, 22 bp, Artificial Sequence
  chemically synthesized
aaagctggaaaaggcatggaaa

SEQ ID NO: 849935 - DNA, 22 bp, Artificial Sequence
  chemically synthesized
taaaagctggaaaaggcatgga

SEQ ID NO: 849936 - DNA, 22 bp, Artificial Sequence
  chemically synthesized
ttttccatgccttttccagctt

SEQ ID NO: 849937 - DNA, 22 bp, Artificial Sequence
  chemically synthesized
ttccatgccttttccagctttt

SEQ ID NO: 849938 - DNA, 22 bp, Artificial Sequence
  chemically synthesized
tccatgccttttccagctttta

SEQ ID NO: 849939 - DNA, 22 bp, Artificial Sequence
  chemically synthesized
ccatgccttttccagcttttag

SEQ ID NO: 849940 - DNA, 22 bp, Artificial Sequence
  chemically synthesized
catgccttttccagcttttaga

SEQ ID NO: 849941 - DNA, 22 bp, Artificial Sequence
  chemically synthesized
ttccagcttttagagcctgcct

SEQ ID NO: 849942 - DNA, 22 bp, Artificial Sequence
  chemically synthesized
tccagcttttagagcctgcctg

SEQ ID NO: 849943 - DNA, 22 bp, Artificial Sequence
  chemically synthesized
ccagcttttagagcctgcctgc

SEQ ID NO: 849944 - DNA, 22 bp, Artificial Sequence
  chemically synthesized
cagcttttagagcctgcctgca

SEQ ID NO: 849945 - DNA, 22 bp, Artificial Sequence
  chemically synthesized
ttagagcctgcctgcatttctt

SEQ ID NO: 849946 - DNA, 22 bp, Artificial Sequence
  chemically synthesized
tagagcctgcctgcatttcttg

SEQ ID NO: 849947 - DNA, 22 bp, Artificial Sequence
  chemically synthesized
agagcctgcctgcatttcttgg

SEQ ID NO: 849948 - DNA, 22 bp, Artificial Sequence
  chemically synthesized
gagcctgcctgcatttcttggc

SEQ ID NO: 849949 - DNA, 22 bp, Artificial Sequence
  chemically synthesized
cctgcatttcttggctcttggc

SEQ ID NO: 849950 - DNA, 22 bp, Artificial Sequence
  chemically synthesized
aagatgaaggacagggccaaga

SEQ ID NO: 849951 - DNA, 22 bp, Artificial Sequence
  chemically synthesized
catttcttggctcttggccctg

SEQ ID NO: 849952 - DNA, 22 bp, Artificial Sequence
  chemically synthesized
cttggctcttggccctgtcctt

SEQ ID NO: 849953 - DNA, 22 bp, Artificial Sequence
  chemically synthesized
gcattgaagatgaaggacaggg

SEQ ID NO: 849954 - DNA, 22 bp, Artificial Sequence
  chemically synthesized
ttggctcttggccctgtccttc

SEQ ID NO: 849955 - DNA, 22 bp, Artificial Sequence
  chemically synthesized
ggctcttggccctgtccttcat

SEQ ID NO: 849956 - DNA, 22 bp, Artificial Sequence
  chemically synthesized
ctggcattgaagatgaaggaca

SEQ ID NO: 849957 - DNA, 22 bp, Artificial Sequence
  chemically synthesized
gctcttggccctgtccttcatc

SEQ ID NO: 849958 - DNA, 22 bp, Artificial Sequence
  chemically synthesized
ttggccctgtccttcatcttca

SEQ ID NO: 849959 - DNA, 22 bp, Artificial Sequence
  chemically synthesized
cactactggcattgaagatgaa

SEQ ID NO: 849960 - DNA, 22 bp, Artificial Sequence
  chemically synthesized
ggccctgtccttcatcttcaat

SEQ ID NO: 849961 - DNA, 22 bp, Artificial Sequence
  chemically synthesized
gccctgtccttcatcttcaatg

SEQ ID NO: 849962 - DNA, 22 bp, Artificial Sequence
  chemically synthesized
tccttcatcttcaatgccagta

SEQ ID NO: 849963 - DNA, 22 bp, Artificial Sequence
  chemically synthesized
gaagatgctacactactggcat

SEQ ID NO: 849964 - DNA, 22 bp, Artificial Sequence
  chemically synthesized
catcttcaatgccagtagtgta

SEQ ID NO: 849965 - DNA, 22 bp, Artificial Sequence
  chemically synthesized
atcttcaatgccagtagtgtag

SEQ ID NO: 849966 - DNA, 22 bp, Artificial Sequence
  chemically synthesized
caatgccagtagtgtagcatct

SEQ ID NO: 849967 - DNA, 22 bp, Artificial Sequence
  chemically synthesized
aatgccagtagtgtagcatctt

SEQ ID NO: 849968 - DNA, 22 bp, Artificial Sequence
  chemically synthesized
ccaatctctcttttactctgct

SEQ ID NO: 849969 - DNA, 22 bp, Artificial Sequence
  chemically synthesized
caatctctcttttactctgctt

SEQ ID NO: 849970 - DNA, 22 bp, Artificial Sequence
  chemically synthesized
tcttttactctgcttgtatcat

SEQ ID NO: 849971 - DNA, 22 bp, Artificial Sequence
  chemically synthesized
ttttactctgcttgtatcatca

SEQ ID NO: 849972 - DNA, 22 bp, Artificial Sequence
  chemically synthesized
agagagaaggaggtgatgatac

SEQ ID NO: 849973 - DNA, 22 bp, Artificial Sequence
  chemically synthesized
ttactctgcttgtatcatcacc

SEQ ID NO: 849974 - DNA, 22 bp, Artificial Sequence
  chemically synthesized
tactctgcttgtatcatcacct

SEQ ID NO: 849975 - DNA, 22 bp, Artificial Sequence
  chemically synthesized
actctgcttgtatcatcacctc

SEQ ID NO: 849976 - DNA, 22 bp, Artificial Sequence
  chemically synthesized
ctaagagagaaggaggtgatga

SEQ ID NO: 849977 - DNA, 22 bp, Artificial Sequence
  chemically synthesized
ctctgcttgtatcatcacctcc

SEQ ID NO: 849978 - DNA, 22 bp, Artificial Sequence
  chemically synthesized
tgcttgtatcatcacctccttc

SEQ ID NO: 849979 - DNA, 22 bp, Artificial Sequence
  chemically synthesized
cttgtatcatcacctccttctc

SEQ ID NO: 849980 - DNA, 22 bp, Artificial Sequence
  chemically synthesized
gtatcatcacctccttctctct

SEQ ID NO: 849981 - DNA, 22 bp, Artificial Sequence
  chemically synthesized
tatcatcacctccttctctctt

SEQ ID NO: 849982 - DNA, 22 bp, Artificial Sequence
  chemically synthesized
cttctctcttaggaggactctt

SEQ ID NO: 849983 - DNA, 22 bp, Artificial Sequence
  chemically synthesized
ctctcttaggaggactcttgtg

SEQ ID NO: 849984 - DNA, 22 bp, Artificial Sequence
  chemically synthesized
tctcttaggaggactcttgtga

SEQ ID NO: 849985 - DNA, 22 bp, Artificial Sequence
  chemically synthesized
tcttaggaggactcttgtgatt

SEQ ID NO: 849986 - DNA, 22 bp, Artificial Sequence
  chemically synthesized
ttaggaggactcttgtgattac

SEQ ID NO: 849987 - DNA, 22 bp, Artificial Sequence
  chemically synthesized
aggaggactcttgtgattacat

SEQ ID NO: 849988 - DNA, 22 bp, Artificial Sequence
  chemically synthesized
ggaggactcttgtgattacatt

SEQ ID NO: 849989 - DNA, 22 bp, Artificial Sequence
  chemically synthesized
ccccagtgcgcccaatgtaatc

SEQ ID NO: 849990 - DNA, 22 bp, Artificial Sequence
  chemically synthesized
ggttaccccagtgcgcccaatg

SEQ ID NO: 849991 - DNA, 22 bp, Artificial Sequence
  chemically synthesized
ttgtgattacattgggcgcact

SEQ ID NO: 849992 - DNA, 22 bp, Artificial Sequence
  chemically synthesized
gtgattacattgggcgcactgg

SEQ ID NO: 849993 - DNA, 22 bp, Artificial Sequence
  chemically synthesized
tgattacattgggcgcactggg

SEQ ID NO: 849994 - DNA, 22 bp, Artificial Sequence
  chemically synthesized
cattgggcgcactggggtaacc

SEQ ID NO: 849995 - DNA, 22 bp, Artificial Sequence
  chemically synthesized
ggcgcactggggtaacccaggc

SEQ ID NO: 849996 - DNA, 22 bp, Artificial Sequence
  chemically synthesized
acacggagagatagcctgggtt

SEQ ID NO: 849997 - DNA, 22 bp, Artificial Sequence
  chemically synthesized
gacacggagagatagcctgggt

SEQ ID NO: 849998 - DNA, 22 bp, Artificial Sequence
  chemically synthesized
gggtaacccaggctatctctcc

SEQ ID NO: 849999 - DNA, 22 bp, Artificial Sequence
  chemically synthesized
aaaatcttgacacggagagata

SEQ ID NO: 850000 - DNA, 22 bp, Artificial Sequence
  chemically synthesized
agttaaaaatcttgacacggag

SEQ ID NO: 850001 - DNA, 22 bp, Artificial Sequence
  chemically synthesized
tctctccgtgtcaagattttta

SEQ ID NO: 850002 - DNA, 22 bp, Artificial Sequence
  chemically synthesized
tccgtgtcaagatttttaactt

SEQ ID NO: 850003 - DNA, 22 bp, Artificial Sequence
  chemically synthesized
acagatgtggttaagttaaaaa

SEQ ID NO: 850004 - DNA, 22 bp, Artificial Sequence
  chemically synthesized
cgtgtcaagatttttaacttaa

SEQ ID NO: 850005 - DNA, 22 bp, Artificial Sequence
  chemically synthesized
tattaacagatgtggttaagtt

SEQ ID NO: 850006 - DNA, 22 bp, Artificial Sequence
  chemically synthesized
gtattaacagatgtggttaagt

SEQ ID NO: 850007 - DNA, 22 bp, Artificial Sequence
  chemically synthesized
tgtattaacagatgtggttaag

SEQ ID NO: 850008 - DNA, 22 bp, Artificial Sequence
  chemically synthesized
ttaacttaaccacatctgttaa

SEQ ID NO: 850009 - DNA, 22 bp, Artificial Sequence
  chemically synthesized
taacttaaccacatctgttaat

SEQ ID NO: 850010 - DNA, 22 bp, Artificial Sequence
  chemically synthesized
aacttaaccacatctgttaata

SEQ ID NO: 850011 - DNA, 22 bp, Artificial Sequence
  chemically synthesized
acttaaccacatctgttaatac

SEQ ID NO: 850012 - DNA, 22 bp, Artificial Sequence
  chemically synthesized
aaccacatctgttaatacaaag

SEQ ID NO: 850013 - DNA, 22 bp, Artificial Sequence
  chemically synthesized
catggcaaaaggctttgtatta

SEQ ID NO: 850014 - DNA, 22 bp, Artificial Sequence
  chemically synthesized
accacatctgttaatacaaagc

SEQ ID NO: 850015 - DNA, 22 bp, Artificial Sequence
  chemically synthesized
acatggcaaaaggctttgtatt

SEQ ID NO: 850016 - DNA, 22 bp, Artificial Sequence
  chemically synthesized
ccttacatggcaaaaggctttg

SEQ ID NO: 850017 - DNA, 22 bp, Artificial Sequence
  chemically synthesized
ttaatacaaagccttttgccat

SEQ ID NO: 850018 - DNA, 22 bp, Artificial Sequence
  chemically synthesized
atacaaagccttttgccatgta

SEQ ID NO: 850019 - DNA, 22 bp, Artificial Sequence
  chemically synthesized
tgaatatgttaccttacatggc

SEQ ID NO: 850020 - DNA, 22 bp, Artificial Sequence
  chemically synthesized
ttgccatgtaaggtaacatatt

SEQ ID NO: 850021 - DNA, 22 bp, Artificial Sequence
  chemically synthesized
tgccatgtaaggtaacatattc

SEQ ID NO: 850022 - DNA, 22 bp, Artificial Sequence
  chemically synthesized
gccatgtaaggtaacatattca

SEQ ID NO: 850023 - DNA, 22 bp, Artificial Sequence
  chemically synthesized
ccatgtaaggtaacatattcac

SEQ ID NO: 850024 - DNA, 22 bp, Artificial Sequence
  chemically synthesized
atcccaggaacctgtgaatatg

SEQ ID NO: 850025 - DNA, 22 bp, Artificial Sequence
  chemically synthesized
acaggttcctgggattaggata

SEQ ID NO: 850026 - DNA, 22 bp, Artificial Sequence
  chemically synthesized
ccccgccaaagatgtccatatc

SEQ ID NO: 850027 - DNA, 22 bp, Artificial Sequence
  chemically synthesized
ctgggattaggatatggacatc

SEQ ID NO: 850028 - DNA, 22 bp, Artificial Sequence
  chemically synthesized
ctcccccgccaaagatgtccat

SEQ ID NO: 850029 - DNA, 22 bp, Artificial Sequence
  chemically synthesized
ggattaggatatggacatcttt

SEQ ID NO: 850030 - DNA, 22 bp, Artificial Sequence
  chemically synthesized
ggatatggacatctttggcggg

SEQ ID NO: 850031 - DNA, 22 bp, Artificial Sequence
  chemically synthesized
ataatgcccactcctcccccgc

SEQ ID NO: 850032 - DNA, 22 bp, Artificial Sequence
  chemically synthesized
aataatgcccactcctcccccg

SEQ ID NO: 850033 - DNA, 22 bp, Artificial Sequence
  chemically synthesized
tggcgggggaggagtgggcatt

SEQ ID NO: 850034 - DNA, 22 bp, Artificial Sequence
  chemically synthesized
ggcgggggaggagtgggcatta

SEQ ID NO: 850035 - DNA, 22 bp, Artificial Sequence
  chemically synthesized
tgaaaggtttaataatgcccac

SEQ ID NO: 850036 - DNA, 22 bp, Artificial Sequence
  chemically synthesized
gcgggggaggagtgggcattat

SEQ ID NO: 850037 - DNA, 22 bp, Artificial Sequence
  chemically synthesized
agtaaatgcagaaccattgtga

SEQ ID NO: 850038 - DNA, 22 bp, Artificial Sequence
  chemically synthesized
ttaaacctttcacaatggttct

SEQ ID NO: 850039 - DNA, 22 bp, Artificial Sequence
  chemically synthesized
aacctttcacaatggttctgca

SEQ ID NO: 850040 - DNA, 22 bp, Artificial Sequence
  chemically synthesized
atgctaagtaaatgcagaacca

SEQ ID NO: 850041 - DNA, 22 bp, Artificial Sequence
  chemically synthesized
tcatgctaagtaaatgcagaac

SEQ ID NO: 850042 - DNA, 22 bp, Artificial Sequence
  chemically synthesized
ctcatgctaagtaaatgcagaa

SEQ ID NO: 850043 - DNA, 22 bp, Artificial Sequence
  chemically synthesized
tcacaatggttctgcatttact

SEQ ID NO: 850044 - DNA, 22 bp, Artificial Sequence
  chemically synthesized
cacaatggttctgcatttactt

SEQ ID NO: 850045 - DNA, 22 bp, Artificial Sequence
  chemically synthesized
acaatggttctgcatttactta

SEQ ID NO: 850046 - DNA, 22 bp, Artificial Sequence
  chemically synthesized
tgacaaacagcttctcatgcta

SEQ ID NO: 850047 - DNA, 22 bp, Artificial Sequence
  chemically synthesized
tgcatttacttagcatgagaag

SEQ ID NO: 850048 - DNA, 22 bp, Artificial Sequence
  chemically synthesized
catttacttagcatgagaagct

SEQ ID NO: 850049 - DNA, 22 bp, Artificial Sequence
  chemically synthesized
acttagcatgagaagctgtttg

SEQ ID NO: 850050 - DNA, 22 bp, Artificial Sequence
  chemically synthesized
cttagcatgagaagctgtttgt

SEQ ID NO: 850051 - DNA, 22 bp, Artificial Sequence
  chemically synthesized
agcatgagaagctgtttgtcac

SEQ ID NO: 850052 - DNA, 22 bp, Artificial Sequence
  chemically synthesized
gcatgagaagctgtttgtcaca

SEQ ID NO: 850053 - DNA, 22 bp, Artificial Sequence
  chemically synthesized
tttgtcacaatgtgacatactg

SEQ ID NO: 850054 - DNA, 22 bp, Artificial Sequence
  chemically synthesized
gtcacaatgtgacatactgaca

SEQ ID NO: 850055 - DNA, 22 bp, Artificial Sequence
  chemically synthesized
tcacaatgtgacatactgacat

SEQ ID NO: 850056 - DNA, 22 bp, Artificial Sequence
  chemically synthesized
acatacttcttcgggtgggttc

SEQ ID NO: 850057 - DNA, 22 bp, Artificial Sequence
  chemically synthesized
tcgatgacacatagtaccgaac

SEQ ID NO: 850058 - DNA, 22 bp, Artificial Sequence
  chemically synthesized
gtcgatgacacatagtaccgaa

SEQ ID NO: 850059 - DNA, 22 bp, Artificial Sequence
  chemically synthesized
cttcgggtgggttcggtactat

SEQ ID NO: 850060 - DNA, 22 bp, Artificial Sequence
  chemically synthesized
ttcgggtgggttcggtactatg

SEQ ID NO: 850061 - DNA, 22 bp, Artificial Sequence
  chemically synthesized
ttgtcgatgacacatagtaccg

SEQ ID NO: 850062 - DNA, 22 bp, Artificial Sequence
  chemically synthesized
cgggtgggttcggtactatgtg

SEQ ID NO: 850063 - DNA, 22 bp, Artificial Sequence
  chemically synthesized
gggtgggttcggtactatgtgt

SEQ ID NO: 850064 - DNA, 22 bp, Artificial Sequence
  chemically synthesized
taactcttgtcgatgacacata

SEQ ID NO: 850065 - DNA, 22 bp, Artificial Sequence
  chemically synthesized
ggtactatgtgtcatcgacaag

SEQ ID NO: 850066 - DNA, 22 bp, Artificial Sequence
  chemically synthesized
tgagatactgtaactcttgtcg

SEQ ID NO: 850067 - DNA, 22 bp, Artificial Sequence
  chemically synthesized
tgtgtcatcgacaagagttaca

SEQ ID NO: 850068 - DNA, 22 bp, Artificial Sequence
  chemically synthesized
gattgtgagatactgtaactct

SEQ ID NO: 850069 - DNA, 22 bp, Artificial Sequence
  chemically synthesized
tagattgtgagatactgtaact

SEQ ID NO: 850070 - DNA, 22 bp, Artificial Sequence
  chemically synthesized
ctagattgtgagatactgtaac

SEQ ID NO: 850071 - DNA, 22 bp, Artificial Sequence
  chemically synthesized
tctagattgtgagatactgtaa

SEQ ID NO: 850072 - DNA, 22 bp, Artificial Sequence
  chemically synthesized
tgctttctagattgtgagatac

SEQ ID NO: 850073 - DNA, 22 bp, Artificial Sequence
  chemically synthesized
ctgtgctttctagattgtgaga

SEQ ID NO: 850074 - DNA, 22 bp, Artificial Sequence
  chemically synthesized
cctcctgtgctttctagattgt

SEQ ID NO: 850075 - DNA, 22 bp, Artificial Sequence
  chemically synthesized
gcctcctgtgctttctagattg

SEQ ID NO: 850076 - DNA, 22 bp, Artificial Sequence
  chemically synthesized
tgcctcctgtgctttctagatt

SEQ ID NO: 850077 - DNA, 22 bp, Artificial Sequence
  chemically synthesized
cagtatctcacaatctagaaag

SEQ ID NO: 850078 - DNA, 22 bp, Artificial Sequence
  chemically synthesized
ttgcctcctgtgctttctagat

SEQ ID NO: 850079 - DNA, 22 bp, Artificial Sequence
  chemically synthesized
tttgcctcctgtgctttctaga

SEQ ID NO: 850080 - DNA, 22 bp, Artificial Sequence
  chemically synthesized
ttttgcctcctgtgctttctag

SEQ ID NO: 850081 - DNA, 22 bp, Artificial Sequence
  chemically synthesized
cttttttgcctcctgtgctttc

SEQ ID NO: 850082 - DNA, 22 bp, Artificial Sequence
  chemically synthesized
gcttttttgcctcctgtgcttt

SEQ ID NO: 850083 - DNA, 22 bp, Artificial Sequence
  chemically synthesized
acaatctagaaagcacaggagg

SEQ ID NO: 850084 - DNA, 22 bp, Artificial Sequence
  chemically synthesized
tttgcttttttgcctcctgtgc

SEQ ID NO: 850085 - DNA, 22 bp, Artificial Sequence
  chemically synthesized
gtttgcttttttgcctcctgtg

SEQ ID NO: 850086 - DNA, 22 bp, Artificial Sequence
  chemically synthesized
tgtttgcttttttgcctcctgt

SEQ ID NO: 850087 - DNA, 22 bp, Artificial Sequence
  chemically synthesized
ttgtttgcttttttgcctcctg

SEQ ID NO: 850088 - DNA, 22 bp, Artificial Sequence
  chemically synthesized
tttgtttgcttttttgcctcct

SEQ ID NO: 850089 - DNA, 22 bp, Artificial Sequence
  chemically synthesized
ttttttgtttgcttttttgcct

SEQ ID NO: 850090 - DNA, 22 bp, Artificial Sequence
  chemically synthesized
gaaagcacaggaggcaaaaaag

SEQ ID NO: 850091 - DNA, 22 bp, Artificial Sequence
  chemically synthesized
gttgttttttgtttgctttttt

SEQ ID NO: 850092 - DNA, 22 bp, Artificial Sequence
  chemically synthesized
gtatgactggttgttttttgtt

SEQ ID NO: 850093 - DNA, 22 bp, Artificial Sequence
  chemically synthesized
ccacaaggacacaggagcctgg

SEQ ID NO: 850094 - DNA, 22 bp, Artificial Sequence
  chemically synthesized
aaccatgtctgccacaaggaca

SEQ ID NO: 850095 - DNA, 22 bp, Artificial Sequence
  chemically synthesized
gttaaaccatgtctgccacaag

SEQ ID NO: 850096 - DNA, 22 bp, Artificial Sequence
  chemically synthesized
ggttaaaccatgtctgccacaa

SEQ ID NO: 850097 - DNA, 22 bp, Artificial Sequence
  chemically synthesized
tggttaaaccatgtctgccaca

SEQ ID NO: 850098 - DNA, 22 bp, Artificial Sequence
  chemically synthesized
ctgtgtccttgtggcagacatg

SEQ ID NO: 850099 - DNA, 22 bp, Artificial Sequence
  chemically synthesized
tgtccttgtggcagacatggtt

SEQ ID NO: 850100 - DNA, 22 bp, Artificial Sequence
  chemically synthesized
cggaggcctttggttaaaccat

SEQ ID NO: 850101 - DNA, 22 bp, Artificial Sequence
  chemically synthesized
ccggaggcctttggttaaacca

SEQ ID NO: 850102 - DNA, 22 bp, Artificial Sequence
  chemically synthesized
gtggcagacatggtttaaccaa

SEQ ID NO: 850103 - DNA, 22 bp, Artificial Sequence
  chemically synthesized
tggcagacatggtttaaccaaa

SEQ ID NO: 850104 - DNA, 22 bp, Artificial Sequence
  chemically synthesized
ccacttccggaggcctttggtt

SEQ ID NO: 850105 - DNA, 22 bp, Artificial Sequence
  chemically synthesized
cccacttccggaggcctttggt

SEQ ID NO: 850106 - DNA, 22 bp, Artificial Sequence
  chemically synthesized
tcccacttccggaggcctttgg

SEQ ID NO: 850107 - DNA, 22 bp, Artificial Sequence
  chemically synthesized
aaccaaaggcctccggaagtgg

SEQ ID NO: 850108 - DNA, 22 bp, Artificial Sequence
  chemically synthesized
accaaaggcctccggaagtggg

SEQ ID NO: 850109 - DNA, 22 bp, Artificial Sequence
  chemically synthesized
cggaagtgggaaaggtgtattg

SEQ ID NO: 850110 - DNA, 22 bp, Artificial Sequence
  chemically synthesized
cagggtgaaagagacccaacaa

SEQ ID NO: 850111 - DNA, 22 bp, Artificial Sequence
  chemically synthesized
gttacagggtgaaagagaccca

SEQ ID NO: 850112 - DNA, 22 bp, Artificial Sequence
  chemically synthesized
ggttacagggtgaaagagaccc

SEQ ID NO: 850113 - DNA, 22 bp, Artificial Sequence
  chemically synthesized
tggttacagggtgaaagagacc

SEQ ID NO: 850114 - DNA, 22 bp, Artificial Sequence
  chemically synthesized
ttggttacagggtgaaagagac

SEQ ID NO: 850115 - DNA, 22 bp, Artificial Sequence
  chemically synthesized
ttgggtctctttcaccctgtaa

SEQ ID NO: 850116 - DNA, 22 bp, Artificial Sequence
  chemically synthesized
aaatggtcttttggttacaggg

SEQ ID NO: 850117 - DNA, 22 bp, Artificial Sequence
  chemically synthesized
ggtctctttcaccctgtaacca

SEQ ID NO: 850118 - DNA, 22 bp, Artificial Sequence
  chemically synthesized
aattcaaatggtcttttggtta

SEQ ID NO: 850119 - DNA, 22 bp, Artificial Sequence
  chemically synthesized
tttcaccctgtaaccaaaagac

SEQ ID NO: 850120 - DNA, 22 bp, Artificial Sequence
  chemically synthesized
tcaccctgtaaccaaaagacca

SEQ ID NO: 850121 - DNA, 22 bp, Artificial Sequence
  chemically synthesized
caccctgtaaccaaaagaccat

SEQ ID NO: 850122 - DNA, 22 bp, Artificial Sequence
  chemically synthesized
accctgtaaccaaaagaccatt

SEQ ID NO: 850123 - DNA, 22 bp, Artificial Sequence
  chemically synthesized
cacctcaattcaaatggtcttt

SEQ ID NO: 850124 - DNA, 22 bp, Artificial Sequence
  chemically synthesized
ccacctcaattcaaatggtctt

SEQ ID NO: 850125 - DNA, 22 bp, Artificial Sequence
  chemically synthesized
taaccaaaagaccatttgaatt

SEQ ID NO: 850126 - DNA, 22 bp, Artificial Sequence
  chemically synthesized
cagtttccacctcaattcaaat

SEQ ID NO: 850127 - DNA, 22 bp, Artificial Sequence
  chemically synthesized
tgaactccagtttccacctcaa

SEQ ID NO: 850128 - DNA, 22 bp, Artificial Sequence
  chemically synthesized
gtgaactccagtttccacctca

SEQ ID NO: 850129 - DNA, 22 bp, Artificial Sequence
  chemically synthesized
tgtgaactccagtttccacctc

SEQ ID NO: 850130 - DNA, 22 bp, Artificial Sequence
  chemically synthesized
ttgtgaactccagtttccacct

SEQ ID NO: 850131 - DNA, 22 bp, Artificial Sequence
  chemically synthesized
gaattgaggtggaaactggagt

SEQ ID NO: 850132 - DNA, 22 bp, Artificial Sequence
  chemically synthesized
aattgaggtggaaactggagtt

SEQ ID NO: 850133 - DNA, 22 bp, Artificial Sequence
  chemically synthesized
atgtaacgcttttgtgaactcc

SEQ ID NO: 850134 - DNA, 22 bp, Artificial Sequence
  chemically synthesized
aggtggaaactggagttcacaa

SEQ ID NO: 850135 - DNA, 22 bp, Artificial Sequence
  chemically synthesized
aatgtaacgcttttgtgaactc

SEQ ID NO: 850136 - DNA, 22 bp, Artificial Sequence
  chemically synthesized
taatgtaacgcttttgtgaact

SEQ ID NO: 850137 - DNA, 22 bp, Artificial Sequence
  chemically synthesized
ttaatgtaacgcttttgtgaac

SEQ ID NO: 850138 - DNA, 22 bp, Artificial Sequence
  chemically synthesized
tttaatgtaacgcttttgtgaa

SEQ ID NO: 850139 - DNA, 22 bp, Artificial Sequence
  chemically synthesized
ttttaatgtaacgcttttgtga

SEQ ID NO: 850140 - DNA, 22 bp, Artificial Sequence
  chemically synthesized
tttttttaatgtaacgcttttg

SEQ ID NO: 850141 - DNA, 22 bp, Artificial Sequence
  chemically synthesized
ttatttttttaatgtaacgctt

SEQ ID NO: 850142 - DNA, 22 bp, Artificial Sequence
  chemically synthesized
gagttcacaaaagcgttacatt

SEQ ID NO: 850143 - DNA, 22 bp, Artificial Sequence
  chemically synthesized
ttattatttttttaatgtaacg

SEQ ID NO: 850144 - DNA, 22 bp, Artificial Sequence
  chemically synthesized
attattatttttttaatgtaac

SEQ ID NO: 850145 - DNA, 22 bp, Artificial Sequence
  chemically synthesized
acaaaagcgttacattaaaaaa

SEQ ID NO: 850146 - DNA, 22 bp, Artificial Sequence
  chemically synthesized
agggagtcacagtttattatta

SEQ ID NO: 850147 - DNA, 22 bp, Artificial Sequence
  chemically synthesized
cattaaaaaaataataataaac

SEQ ID NO: 850148 - DNA, 22 bp, Artificial Sequence
  chemically synthesized
ctcagggagtcacagtttatta

SEQ ID NO: 850149 - DNA, 22 bp, Artificial Sequence
  chemically synthesized
cctcagggagtcacagtttatt

SEQ ID NO: 850150 - DNA, 22 bp, Artificial Sequence
  chemically synthesized
aaaaaataataataaactgtga

SEQ ID NO: 850151 - DNA, 22 bp, Artificial Sequence
  chemically synthesized
tgatttcctcagggagtcacag

SEQ ID NO: 850152 - DNA, 22 bp, Artificial Sequence
  chemically synthesized
tgactccctgaggaaatcacag

SEQ ID NO: 850153 - DNA, 22 bp, Artificial Sequence
  chemically synthesized
tcaccaaacagaaacactgtga

SEQ ID NO: 850154 - DNA, 22 bp, Artificial Sequence
  chemically synthesized
gtcaccaaacagaaacactgtg

SEQ ID NO: 850155 - DNA, 22 bp, Artificial Sequence
  chemically synthesized
cctgaggaaatcacagtgtttc

SEQ ID NO: 850156 - DNA, 22 bp, Artificial Sequence
  chemically synthesized
aggaaatcacagtgtttctgtt

SEQ ID NO: 850157 - DNA, 22 bp, Artificial Sequence
  chemically synthesized
aagagcagcttgtcaccaaaca

SEQ ID NO: 850158 - DNA, 22 bp, Artificial Sequence
  chemically synthesized
ctgaagagcagcttgtcaccaa

SEQ ID NO: 850159 - DNA, 22 bp, Artificial Sequence
  chemically synthesized
attcctgaagagcagcttgtca

SEQ ID NO: 850160 - DNA, 22 bp, Artificial Sequence
  chemically synthesized
ctgtttggtgacaagctgctct

SEQ ID NO: 850161 - DNA, 22 bp, Artificial Sequence
  chemically synthesized
tgtttggtgacaagctgctctt

SEQ ID NO: 850162 - DNA, 22 bp, Artificial Sequence
  chemically synthesized
tttggtgacaagctgctcttca

SEQ ID NO: 850163 - DNA, 22 bp, Artificial Sequence
  chemically synthesized
taggattcattcctgaagagca

SEQ ID NO: 850164 - DNA, 22 bp, Artificial Sequence
  chemically synthesized
ataggattcattcctgaagagc

SEQ ID NO: 850165 - DNA, 22 bp, Artificial Sequence
  chemically synthesized
ggtgacaagctgctcttcagga

SEQ ID NO: 850166 - DNA, 22 bp, Artificial Sequence
  chemically synthesized
gtgacaagctgctcttcaggaa

SEQ ID NO: 850167 - DNA, 22 bp, Artificial Sequence
  chemically synthesized
ttataggattcattcctgaaga

SEQ ID NO: 850168 - DNA, 22 bp, Artificial Sequence
  chemically synthesized
aaattcttataggattcattcc

SEQ ID NO: 850169 - DNA, 22 bp, Artificial Sequence
  chemically synthesized
tctgaaattcttataggattca

SEQ ID NO: 850170 - DNA, 22 bp, Artificial Sequence
  chemically synthesized
ctcttcaggaatgaatcctata

SEQ ID NO: 850171 - DNA, 22 bp, Artificial Sequence
  chemically synthesized
atctgaaattcttataggattc

SEQ ID NO: 850172 - DNA, 22 bp, Artificial Sequence
  chemically synthesized
tatctgaaattcttataggatt

SEQ ID NO: 850173 - DNA, 22 bp, Artificial Sequence
  chemically synthesized
ttcaggaatgaatcctataaga

SEQ ID NO: 850174 - DNA, 22 bp, Artificial Sequence
  chemically synthesized
caggaatgaatcctataagaat

SEQ ID NO: 850175 - DNA, 22 bp, Artificial Sequence
  chemically synthesized
aggaatgaatcctataagaatt

SEQ ID NO: 850176 - DNA, 22 bp, Artificial Sequence
  chemically synthesized
cccaaaagataagagctttatc

SEQ ID NO: 850177 - DNA, 22 bp, Artificial Sequence
  chemically synthesized
taagaatttcagataaagctct

SEQ ID NO: 850178 - DNA, 22 bp, Artificial Sequence
  chemically synthesized
actccccaaaagataagagctt

SEQ ID NO: 850179 - DNA, 22 bp, Artificial Sequence
  chemically synthesized
cactccccaaaagataagagct

SEQ ID NO: 850180 - DNA, 22 bp, Artificial Sequence
  chemically synthesized
cagataaagctcttatcttttg

SEQ ID NO: 850181 - DNA, 22 bp, Artificial Sequence
  chemically synthesized
agataaagctcttatcttttgg

SEQ ID NO: 850182 - DNA, 22 bp, Artificial Sequence
  chemically synthesized
cagccttcactccccaaaagat

SEQ ID NO: 850183 - DNA, 22 bp, Artificial Sequence
  chemically synthesized
ctgcagccttcactccccaaaa

SEQ ID NO: 850184 - DNA, 22 bp, Artificial Sequence
  chemically synthesized
cctgcagccttcactccccaaa

SEQ ID NO: 850185 - DNA, 22 bp, Artificial Sequence
  chemically synthesized
tcctgcagccttcactccccaa

SEQ ID NO: 850186 - DNA, 22 bp, Artificial Sequence
  chemically synthesized
ttatcttttggggagtgaaggc

SEQ ID NO: 850187 - DNA, 22 bp, Artificial Sequence
  chemically synthesized
gcctttcctgcagccttcactc

SEQ ID NO: 850188 - DNA, 22 bp, Artificial Sequence
  chemically synthesized
atcttttggggagtgaaggctg

SEQ ID NO: 850189 - DNA, 22 bp, Artificial Sequence
  chemically synthesized
tcttttggggagtgaaggctgc

SEQ ID NO: 850190 - DNA, 22 bp, Artificial Sequence
  chemically synthesized
ttggggagtgaaggctgcagga

SEQ ID NO: 850191 - DNA, 22 bp, Artificial Sequence
  chemically synthesized
tggggagtgaaggctgcaggaa

SEQ ID NO: 850192 - DNA, 22 bp, Artificial Sequence
  chemically synthesized
ggggagtgaaggctgcaggaaa

SEQ ID NO: 850193 - DNA, 22 bp, Artificial Sequence
  chemically synthesized
gggagtgaaggctgcaggaaag

SEQ ID NO: 850194 - DNA, 22 bp, Artificial Sequence
  chemically synthesized
catcccagaaggcaatacccta

SEQ ID NO: 850195 - DNA, 22 bp, Artificial Sequence
  chemically synthesized
caggaaaggctagggtattgcc

SEQ ID NO: 850196 - DNA, 22 bp, Artificial Sequence
  chemically synthesized
tgcatcccagaaggcaataccc

SEQ ID NO: 850197 - DNA, 22 bp, Artificial Sequence
  chemically synthesized
ctgcatcccagaaggcaatacc

SEQ ID NO: 850198 - DNA, 22 bp, Artificial Sequence
  chemically synthesized
tctgcatcccagaaggcaatac

SEQ ID NO: 850199 - DNA, 22 bp, Artificial Sequence
  chemically synthesized
ttctgcatcccagaaggcaata

SEQ ID NO: 850200 - DNA, 22 bp, Artificial Sequence
  chemically synthesized
gggtattgccttctgggatgca

SEQ ID NO: 850201 - DNA, 22 bp, Artificial Sequence
  chemically synthesized
aggggaagatggtttttctgca

SEQ ID NO: 850202 - DNA, 22 bp, Artificial Sequence
  chemically synthesized
ccttctgggatgcagaaaaacc

SEQ ID NO: 850203 - DNA, 22 bp, Artificial Sequence
  chemically synthesized
agctaaggggaagatggttttt

SEQ ID NO: 850204 - DNA, 22 bp, Artificial Sequence
  chemically synthesized
ctgggatgcagaaaaaccatct

SEQ ID NO: 850205 - DNA, 22 bp, Artificial Sequence
  chemically synthesized
tgggatgcagaaaaaccatctt

SEQ ID NO: 850206 - DNA, 22 bp, Artificial Sequence
  chemically synthesized
ggatgcagaaaaaccatcttcc

SEQ ID NO: 850207 - DNA, 22 bp, Artificial Sequence
  chemically synthesized
aatgaacaaagctgagctaagg

SEQ ID NO: 850208 - DNA, 22 bp, Artificial Sequence
  chemically synthesized
agttgaatgaacaaagctgagc

SEQ ID NO: 850209 - DNA, 22 bp, Artificial Sequence
  chemically synthesized
ccccttagctcagctttgttca

SEQ ID NO: 850210 - DNA, 22 bp, Artificial Sequence
  chemically synthesized
cccttagctcagctttgttcat

SEQ ID NO: 850211 - DNA, 22 bp, Artificial Sequence
  chemically synthesized
agctcagctttgttcattcaac

SEQ ID NO: 850212 - DNA, 22 bp, Artificial Sequence
  chemically synthesized
gctcagctttgttcattcaact

SEQ ID NO: 850213 - DNA, 22 bp, Artificial Sequence
  chemically synthesized
agctttgttcattcaacttagt

SEQ ID NO: 850214 - DNA, 22 bp, Artificial Sequence
  chemically synthesized
tgttcattcaacttagttcttc

SEQ ID NO: 850215 - DNA, 22 bp, Artificial Sequence
  chemically synthesized
gttcattcaacttagttcttcc

SEQ ID NO: 850216 - DNA, 22 bp, Artificial Sequence
  chemically synthesized
ttcattcaacttagttcttccc

SEQ ID NO: 850217 - DNA, 22 bp, Artificial Sequence
  chemically synthesized
attcaacttagttcttcccctc

SEQ ID NO: 850218 - DNA, 22 bp, Artificial Sequence
  chemically synthesized
tgagtgggtgtggaggggaaga

SEQ ID NO: 850219 - DNA, 22 bp, Artificial Sequence
  chemically synthesized
atgagtgggtgtggaggggaag

SEQ ID NO: 850220 - DNA, 22 bp, Artificial Sequence
  chemically synthesized
aacttagttcttcccctccaca

SEQ ID NO: 850221 - DNA, 22 bp, Artificial Sequence
  chemically synthesized
atgtttatgagtgggtgtggag

SEQ ID NO: 850222 - DNA, 22 bp, Artificial Sequence
  chemically synthesized
aatgtttatgagtgggtgtgga

SEQ ID NO: 850223 - DNA, 22 bp, Artificial Sequence
  chemically synthesized
agttcttcccctccacacccac

SEQ ID NO: 850224 - DNA, 22 bp, Artificial Sequence
  chemically synthesized
gttcttcccctccacacccact

SEQ ID NO: 850225 - DNA, 22 bp, Artificial Sequence
  chemically synthesized
ttcccctccacacccactcata

SEQ ID NO: 850226 - DNA, 22 bp, Artificial Sequence
  chemically synthesized
cccctccacacccactcataaa

SEQ ID NO: 850227 - DNA, 22 bp, Artificial Sequence
  chemically synthesized
ccctccacacccactcataaac

SEQ ID NO: 850228 - DNA, 22 bp, Artificial Sequence
  chemically synthesized
ggaagaaggcttaatgtttatg

SEQ ID NO: 850229 - DNA, 22 bp, Artificial Sequence
  chemically synthesized
cacacccactcataaacattaa

SEQ ID NO: 850230 - DNA, 22 bp, Artificial Sequence
  chemically synthesized
ataaacattaagccttcttccc

SEQ ID NO: 850231 - DNA, 22 bp, Artificial Sequence
  chemically synthesized
agccttcttcccagctgtcttc

SEQ ID NO: 850232 - DNA, 22 bp, Artificial Sequence
  chemically synthesized
cttcccagctgtcttcctctct

SEQ ID NO: 850233 - DNA, 22 bp, Artificial Sequence
  chemically synthesized
aaaatgaaaaagagagaggaag

SEQ ID NO: 850234 - DNA, 22 bp, Artificial Sequence
  chemically synthesized
ttcccagctgtcttcctctctc

SEQ ID NO: 850235 - DNA, 22 bp, Artificial Sequence
  chemically synthesized
aaaaatgaaaaagagagaggaa

SEQ ID NO: 850236 - DNA, 22 bp, Artificial Sequence
  chemically synthesized
cccagctgtcttcctctctctt

SEQ ID NO: 850237 - DNA, 22 bp, Artificial Sequence
  chemically synthesized
ccagctgtcttcctctctcttt

SEQ ID NO: 850238 - DNA, 22 bp, Artificial Sequence
  chemically synthesized
tcttcctctctctttttcattt

SEQ ID NO: 850239 - DNA, 22 bp, Artificial Sequence
  chemically synthesized
cctctctctttttcatttttaa

SEQ ID NO: 850240 - DNA, 22 bp, Artificial Sequence
  chemically synthesized
ctctctctttttcatttttaaa

SEQ ID NO: 850241 - DNA, 22 bp, Artificial Sequence
  chemically synthesized
tctctttttcatttttaaactt

SEQ ID NO: 850242 - DNA, 22 bp, Artificial Sequence
  chemically synthesized
aaaaagtagatgaagtttaaaa

SEQ ID NO: 850243 - DNA, 22 bp, Artificial Sequence
  chemically synthesized
tctttttcatttttaaacttca

SEQ ID NO: 850244 - DNA, 22 bp, Artificial Sequence
  chemically synthesized
tttttcatttttaaacttcatc

SEQ ID NO: 850245 - DNA, 22 bp, Artificial Sequence
  chemically synthesized
tttcatttttaaacttcatcta

SEQ ID NO: 850246 - DNA, 22 bp, Artificial Sequence
  chemically synthesized
ttcatttttaaacttcatctac

SEQ ID NO: 850247 - DNA, 22 bp, Artificial Sequence
  chemically synthesized
tcatttttaaacttcatctact

SEQ ID NO: 850248 - DNA, 22 bp, Artificial Sequence
  chemically synthesized
catttttaaacttcatctactt

SEQ ID NO: 850249 - DNA, 22 bp, Artificial Sequence
  chemically synthesized
atttttaaacttcatctacttt

SEQ ID NO: 850250 - DNA, 22 bp, Artificial Sequence
  chemically synthesized
ttaaacttcatctactttttga

SEQ ID NO: 850251 - DNA, 22 bp, Artificial Sequence
  chemically synthesized
taaacttcatctactttttgaa

SEQ ID NO: 850252 - DNA, 22 bp, Artificial Sequence
  chemically synthesized
cagagaaaagaattcaaaaagt

SEQ ID NO: 850253 - DNA, 22 bp, Artificial Sequence
  chemically synthesized
aaacttcatctactttttgaat

SEQ ID NO: 850254 - DNA, 22 bp, Artificial Sequence
  chemically synthesized
aacttcatctactttttgaatt

SEQ ID NO: 850255 - DNA, 22 bp, Artificial Sequence
  chemically synthesized
ttgcagagaaaagaattcaaaa

SEQ ID NO: 850256 - DNA, 22 bp, Artificial Sequence
  chemically synthesized
catctactttttgaattctttt

SEQ ID NO: 850257 - DNA, 22 bp, Artificial Sequence
  chemically synthesized
atctactttttgaattcttttc

SEQ ID NO: 850258 - DNA, 22 bp, Artificial Sequence
  chemically synthesized
ctttttgaattcttttctctgc

SEQ ID NO: 850259 - DNA, 22 bp, Artificial Sequence
  chemically synthesized
gtagtagttgttgcagagaaaa

SEQ ID NO: 850260 - DNA, 22 bp, Artificial Sequence
  chemically synthesized
agtagtagttgttgcagagaaa

SEQ ID NO: 850261 - DNA, 22 bp, Artificial Sequence
  chemically synthesized
tagtagtagttgttgcagagaa

SEQ ID NO: 850262 - DNA, 22 bp, Artificial Sequence
  chemically synthesized
tttgaattcttttctctgcaac

SEQ ID NO: 850263 - DNA, 22 bp, Artificial Sequence
  chemically synthesized
ttgaattcttttctctgcaaca

SEQ ID NO: 850264 - DNA, 22 bp, Artificial Sequence
  chemically synthesized
tgaattcttttctctgcaacaa

SEQ ID NO: 850265 - DNA, 22 bp, Artificial Sequence
  chemically synthesized
gaattcttttctctgcaacaac

SEQ ID NO: 850266 - DNA, 22 bp, Artificial Sequence
  chemically synthesized
aattcttttctctgcaacaact

SEQ ID NO: 850267 - DNA, 22 bp, Artificial Sequence
  chemically synthesized
agattttagtagtagttgttgc

SEQ ID NO: 850268 - DNA, 22 bp, Artificial Sequence
  chemically synthesized
cagattttagtagtagttgttg

SEQ ID NO: 850269 - DNA, 22 bp, Artificial Sequence
  chemically synthesized
tcagattttagtagtagttgtt

SEQ ID NO: 850270 - DNA, 22 bp, Artificial Sequence
  chemically synthesized
ttttctctgcaacaactactac

SEQ ID NO: 850271 - DNA, 22 bp, Artificial Sequence
  chemically synthesized
ttctctgcaacaactactacta

SEQ ID NO: 850272 - DNA, 22 bp, Artificial Sequence
  chemically synthesized
tctctgcaacaactactactaa

SEQ ID NO: 850273 - DNA, 22 bp, Artificial Sequence
  chemically synthesized
ctctgcaacaactactactaaa

SEQ ID NO: 850274 - DNA, 22 bp, Artificial Sequence
  chemically synthesized
tctgcaacaactactactaaaa

SEQ ID NO: 850275 - DNA, 22 bp, Artificial Sequence
  chemically synthesized
tgcaacaactactactaaaatc

SEQ ID NO: 850276 - DNA, 22 bp, Artificial Sequence
  chemically synthesized
caacaactactactaaaatctg

SEQ ID NO: 850277 - DNA, 22 bp, Artificial Sequence
  chemically synthesized
ctactaaaatctgaaagcttct

SEQ ID NO: 850278 - DNA, 22 bp, Artificial Sequence
  chemically synthesized
ctaaaatctgaaagcttcttct

SEQ ID NO: 850279 - DNA, 22 bp, Artificial Sequence
  chemically synthesized
catggtaacaatagaagaagct

SEQ ID NO: 850280 - DNA, 22 bp, Artificial Sequence
  chemically synthesized
tccatggtaacaatagaagaag

SEQ ID NO: 850281 - DNA, 22 bp, Artificial Sequence
  chemically synthesized
aaatctgaaagcttcttctatt

SEQ ID NO: 850282 - DNA, 22 bp, Artificial Sequence
  chemically synthesized
ccctctccatggtaacaataga

SEQ ID NO: 850283 - DNA, 22 bp, Artificial Sequence
  chemically synthesized
aaagcttcttctattgttacca

SEQ ID NO: 850284 - DNA, 22 bp, Artificial Sequence
  chemically synthesized
agaaaattgccctctccatggt

SEQ ID NO: 850285 - DNA, 22 bp, Artificial Sequence
  chemically synthesized
cttctattgttaccatggagag

SEQ ID NO: 850286 - DNA, 22 bp, Artificial Sequence
  chemically synthesized
ttctattgttaccatggagagg

SEQ ID NO: 850287 - DNA, 22 bp, Artificial Sequence
  chemically synthesized
ttgagaaaattgccctctccat

SEQ ID NO: 850288 - DNA, 22 bp, Artificial Sequence
  chemically synthesized
ctattgttaccatggagagggc

SEQ ID NO: 850289 - DNA, 22 bp, Artificial Sequence
  chemically synthesized
gttgagaaaattgccctctcca

SEQ ID NO: 850290 - DNA, 22 bp, Artificial Sequence
  chemically synthesized
tattgttaccatggagagggca

SEQ ID NO: 850291 - DNA, 22 bp, Artificial Sequence
  chemically synthesized
ttgttaccatggagagggcaat

SEQ ID NO: 850292 - DNA, 22 bp, Artificial Sequence
  chemically synthesized
cttgttgagaaaattgccctct

SEQ ID NO: 850293 - DNA, 22 bp, Artificial Sequence
  chemically synthesized
acttgttgagaaaattgccctc

SEQ ID NO: 850294 - DNA, 22 bp, Artificial Sequence
  chemically synthesized
tacttgttgagaaaattgccct

SEQ ID NO: 850295 - DNA, 22 bp, Artificial Sequence
  chemically synthesized
ttaccatggagagggcaatttt

SEQ ID NO: 850296 - DNA, 22 bp, Artificial Sequence
  chemically synthesized
ctttacttgttgagaaaattgc

SEQ ID NO: 850297 - DNA, 22 bp, Artificial Sequence
  chemically synthesized
ccatggagagggcaattttctc

SEQ ID NO: 850298 - DNA, 22 bp, Artificial Sequence
  chemically synthesized
caccacctcctttacttgttga

SEQ ID NO: 850299 - DNA, 22 bp, Artificial Sequence
  chemically synthesized
tgcaccacctcctttacttgtt

SEQ ID NO: 850300 - DNA, 22 bp, Artificial Sequence
  chemically synthesized
cctctgcaccacctcctttact

SEQ ID NO: 850301 - DNA, 22 bp, Artificial Sequence
  chemically synthesized
tccctctgcaccacctccttta

SEQ ID NO: 850302 - DNA, 22 bp, Artificial Sequence
  chemically synthesized
tctcaacaagtaaaggaggtgg

SEQ ID NO: 850303 - DNA, 22 bp, Artificial Sequence
  chemically synthesized
ctcaacaagtaaaggaggtggt

SEQ ID NO: 850304 - DNA, 22 bp, Artificial Sequence
  chemically synthesized
tcaacaagtaaaggaggtggtg

SEQ ID NO: 850305 - DNA, 22 bp, Artificial Sequence
  chemically synthesized
cctctccctctgcaccacctcc

SEQ ID NO: 850306 - DNA, 22 bp, Artificial Sequence
  chemically synthesized
ccctctccctctgcaccacctc

SEQ ID NO: 850307 - DNA, 22 bp, Artificial Sequence
  chemically synthesized
aacaagtaaaggaggtggtgca

SEQ ID NO: 850308 - DNA, 22 bp, Artificial Sequence
  chemically synthesized
ttccctctccctctgcaccacc

SEQ ID NO: 850309 - DNA, 22 bp, Artificial Sequence
  chemically synthesized
atatgtagttcttccctctccc

SEQ ID NO: 850310 - DNA, 22 bp, Artificial Sequence
  chemically synthesized
catatgtagttcttccctctcc

SEQ ID NO: 850311 - DNA, 22 bp, Artificial Sequence
  chemically synthesized
tcatatgtagttcttccctctc

SEQ ID NO: 850312 - DNA, 22 bp, Artificial Sequence
  chemically synthesized
aattttcatatgtagttcttcc

SEQ ID NO: 850313 - DNA, 22 bp, Artificial Sequence
  chemically synthesized
caattttcatatgtagttcttc

SEQ ID NO: 850314 - DNA, 22 bp, Artificial Sequence
  chemically synthesized
tcaattttcatatgtagttctt

SEQ ID NO: 850315 - DNA, 22 bp, Artificial Sequence
  chemically synthesized
actttcaattttcatatgtagt

SEQ ID NO: 850316 - DNA, 22 bp, Artificial Sequence
  chemically synthesized
catatgaaaattgaaagttagc

SEQ ID NO: 850317 - DNA, 22 bp, Artificial Sequence
  chemically synthesized
aaaagacacagaggctaacttt

SEQ ID NO: 850318 - DNA, 22 bp, Artificial Sequence
  chemically synthesized
ttgaaaagacacagaggctaac

SEQ ID NO: 850319 - DNA, 22 bp, Artificial Sequence
  chemically synthesized
atgttgttgaaaagacacagag

SEQ ID NO: 850320 - DNA, 22 bp, Artificial Sequence
  chemically synthesized
gatgttgttgaaaagacacaga

SEQ ID NO: 850321 - DNA, 22 bp, Artificial Sequence
  chemically synthesized
aaagttagcctctgtgtctttt

SEQ ID NO: 850322 - DNA, 22 bp, Artificial Sequence
  chemically synthesized
atttgatgttgttgaaaagaca

SEQ ID NO: 850323 - DNA, 22 bp, Artificial Sequence
  chemically synthesized
aatttgatgttgttgaaaagac

SEQ ID NO: 850324 - DNA, 22 bp, Artificial Sequence
  chemically synthesized
gcctctgtgtcttttcaacaac

SEQ ID NO: 850325 - DNA, 22 bp, Artificial Sequence
  chemically synthesized
tgtgtcttttcaacaacatcaa

SEQ ID NO: 850326 - DNA, 22 bp, Artificial Sequence
  chemically synthesized
tgtcttttcaacaacatcaaat

SEQ ID NO: 850327 - DNA, 22 bp, Artificial Sequence
  chemically synthesized
ttcaacaacatcaaattaaatc

SEQ ID NO: 850328 - DNA, 22 bp, Artificial Sequence
  chemically synthesized
tcaacaacatcaaattaaatct

SEQ ID NO: 850329 - DNA, 22 bp, Artificial Sequence
  chemically synthesized
caacaacatcaaattaaatctt

SEQ ID NO: 850330 - DNA, 22 bp, Artificial Sequence
  chemically synthesized
aacaacatcaaattaaatcttt

SEQ ID NO: 850331 - DNA, 22 bp, Artificial Sequence
  chemically synthesized
tgtatggaagtgaaaagattta

SEQ ID NO: 850332 - DNA, 22 bp, Artificial Sequence
  chemically synthesized
gtgtatggaagtgaaaagattt

SEQ ID NO: 850333 - DNA, 22 bp, Artificial Sequence
  chemically synthesized
tgtgtatggaagtgaaaagatt

SEQ ID NO: 850334 - DNA, 22 bp, Artificial Sequence
  chemically synthesized
ttttgtgtatggaagtgaaaag

SEQ ID NO: 850335 - DNA, 22 bp, Artificial Sequence
  chemically synthesized
ttgttttgtgtatggaagtgaa

SEQ ID NO: 850336 - DNA, 22 bp, Artificial Sequence
  chemically synthesized
ctgttgttttgtgtatggaagt

SEQ ID NO: 850337 - DNA, 22 bp, Artificial Sequence
  chemically synthesized
aatcttttcacttccatacaca

SEQ ID NO: 850338 - DNA, 22 bp, Artificial Sequence
  chemically synthesized
tgtgttcctgttgttttgtgta

SEQ ID NO: 850339 - DNA, 22 bp, Artificial Sequence
  chemically synthesized
ttcacttccatacacaaaacaa

SEQ ID NO: 850340 - DNA, 22 bp, Artificial Sequence
  chemically synthesized
tcacttccatacacaaaacaac

SEQ ID NO: 850341 - DNA, 22 bp, Artificial Sequence
  chemically synthesized
cacttccatacacaaaacaaca

SEQ ID NO: 850342 - DNA, 22 bp, Artificial Sequence
  chemically synthesized
acttccatacacaaaacaacag

SEQ ID NO: 850343 - DNA, 22 bp, Artificial Sequence
  chemically synthesized
ccatacacaaaacaacaggaac

SEQ ID NO: 850344 - DNA, 22 bp, Artificial Sequence
  chemically synthesized
catacacaaaacaacaggaaca

SEQ ID NO: 850345 - DNA, 22 bp, Artificial Sequence
  chemically synthesized
ccacccactgtgtgttcctgtt

SEQ ID NO: 850346 - DNA, 22 bp, Artificial Sequence
  chemically synthesized
gccacccactgtgtgttcctgt

SEQ ID NO: 850347 - DNA, 22 bp, Artificial Sequence
  chemically synthesized
aatttgccacccactgtgtgtt

SEQ ID NO: 850348 - DNA, 22 bp, Artificial Sequence
  chemically synthesized
ggctgaatttgccacccactgt

SEQ ID NO: 850349 - DNA, 22 bp, Artificial Sequence
  chemically synthesized
acatccctgggctgaatttgcc

SEQ ID NO: 850350 - DNA, 22 bp, Artificial Sequence
  chemically synthesized
attcacatccctgggctgaatt

SEQ ID NO: 850351 - DNA, 22 bp, Artificial Sequence
  chemically synthesized
attcattcacatccctgggctg

SEQ ID NO: 850352 - DNA, 22 bp, Artificial Sequence
  chemically synthesized
ctgattcattcacatccctggg

SEQ ID NO: 850353 - DNA, 22 bp, Artificial Sequence
  chemically synthesized
agcccagggatgtgaatgaatc

SEQ ID NO: 850354 - DNA, 22 bp, Artificial Sequence
  chemically synthesized
tcacaaagcctactgattcatt

SEQ ID NO: 850355 - DNA, 22 bp, Artificial Sequence
  chemically synthesized
acacccccagcatattatcaca

SEQ ID NO: 850356 - DNA, 22 bp, Artificial Sequence
  chemically synthesized
cctcacacccccagcatattat

SEQ ID NO: 850357 - DNA, 22 bp, Artificial Sequence
  chemically synthesized
tgtgataatatgctgggggtgt

SEQ ID NO: 850358 - DNA, 22 bp, Artificial Sequence
  chemically synthesized
gccacctccctcacacccccag

SEQ ID NO: 850359 - DNA, 22 bp, Artificial Sequence
  chemically synthesized
gtgataatatgctgggggtgtg

SEQ ID NO: 850360 - DNA, 22 bp, Artificial Sequence
  chemically synthesized
tgataatatgctgggggtgtga

SEQ ID NO: 850361 - DNA, 22 bp, Artificial Sequence
  chemically synthesized
cctcgccacctccctcacaccc

SEQ ID NO: 850362 - DNA, 22 bp, Artificial Sequence
  chemically synthesized
aggggctgcctcgccacctccc

SEQ ID NO: 850363 - DNA, 22 bp, Artificial Sequence
  chemically synthesized
ggggtgtgagggaggtggcgag

SEQ ID NO: 850364 - DNA, 22 bp, Artificial Sequence
  chemically synthesized
ggattgaggggctgcctcgcca

SEQ ID NO: 850365 - DNA, 22 bp, Artificial Sequence
  chemically synthesized
aggattgaggggctgcctcgcc

SEQ ID NO: 850366 - DNA, 22 bp, Artificial Sequence
  chemically synthesized
taggattgaggggctgcctcgc

SEQ ID NO: 850367 - DNA, 22 bp, Artificial Sequence
  chemically synthesized
ttttaggattgaggggctgcct

SEQ ID NO: 850368 - DNA, 22 bp, Artificial Sequence
  chemically synthesized
tgttttaggattgaggggctgc

SEQ ID NO: 850369 - DNA, 22 bp, Artificial Sequence
  chemically synthesized
ctgttttaggattgaggggctg

SEQ ID NO: 850370 - DNA, 22 bp, Artificial Sequence
  chemically synthesized
tctgttttaggattgaggggct

SEQ ID NO: 850371 - DNA, 22 bp, Artificial Sequence
  chemically synthesized
ttctgttttaggattgaggggc

SEQ ID NO: 850372 - DNA, 22 bp, Artificial Sequence
  chemically synthesized
cttttctgttttaggattgagg

SEQ ID NO: 850373 - DNA, 22 bp, Artificial Sequence
  chemically synthesized
attacttttctgttttaggatt

SEQ ID NO: 850374 - DNA, 22 bp, Artificial Sequence
  chemically synthesized
ttcattacttttctgttttagg

SEQ ID NO: 850375 - DNA, 22 bp, Artificial Sequence
  chemically synthesized
tcattgttcattacttttctgt

SEQ ID NO: 850376 - DNA, 22 bp, Artificial Sequence
  chemically synthesized
aatcctaaaacagaaaagtaat

SEQ ID NO: 850377 - DNA, 22 bp, Artificial Sequence
  chemically synthesized
tatcagttatcattgttcatta

SEQ ID NO: 850378 - DNA, 22 bp, Artificial Sequence
  chemically synthesized
aaacagaaaagtaatgaacaat

SEQ ID NO: 850379 - DNA, 22 bp, Artificial Sequence
  chemically synthesized
tctatatcagttatcattgttc

SEQ ID NO: 850380 - DNA, 22 bp, Artificial Sequence
  chemically synthesized
cagagtaattgtctatatcagt

SEQ ID NO: 850381 - DNA, 22 bp, Artificial Sequence
  chemically synthesized
aaacaactgcagagtaattgtc

SEQ ID NO: 850382 - DNA, 22 bp, Artificial Sequence
  chemically synthesized
atatagacaattactctgcagt

SEQ ID NO: 850383 - DNA, 22 bp, Artificial Sequence
  chemically synthesized
ctctgcagttgtttgaatatat

SEQ ID NO: 850384 - DNA, 22 bp, Artificial Sequence
  chemically synthesized
tgcagttgtttgaatatatgct

SEQ ID NO: 850385 - DNA, 22 bp, Artificial Sequence
  chemically synthesized
cagttgtttgaatatatgctgc

SEQ ID NO: 850386 - DNA, 22 bp, Artificial Sequence
  chemically synthesized
aaaatgatagaaagcagcatat

SEQ ID NO: 850387 - DNA, 22 bp, Artificial Sequence
  chemically synthesized
cctgaaaatgatagaaagcagc

SEQ ID NO: 850388 - DNA, 22 bp, Artificial Sequence
  chemically synthesized
tttgaatatatgctgctttcta

SEQ ID NO: 850389 - DNA, 22 bp, Artificial Sequence
  chemically synthesized
acctgaaaatgatagaaagcag

SEQ ID NO: 850390 - DNA, 22 bp, Artificial Sequence
  chemically synthesized
gaatatatgctgctttctatca

SEQ ID NO: 850391 - DNA, 22 bp, Artificial Sequence
  chemically synthesized
aatatatgctgctttctatcat

SEQ ID NO: 850392 - DNA, 22 bp, Artificial Sequence
  chemically synthesized
aaggtcatttacctgaaaatga

SEQ ID NO: 850393 - DNA, 22 bp, Artificial Sequence
  chemically synthesized
tgaaggtcatttacctgaaaat

SEQ ID NO: 850394 - DNA, 22 bp, Artificial Sequence
  chemically synthesized
ctttctatcattttcaggtaaa

SEQ ID NO: 850395 - DNA, 22 bp, Artificial Sequence
  chemically synthesized
tctatcattttcaggtaaatga

SEQ ID NO: 850396 - DNA, 22 bp, Artificial Sequence
  chemically synthesized
ccattctgaaggtcatttacct

SEQ ID NO: 850397 - DNA, 22 bp, Artificial Sequence
  chemically synthesized
ctatcattttcaggtaaatgac

SEQ ID NO: 850398 - DNA, 22 bp, Artificial Sequence
  chemically synthesized
tatcattttcaggtaaatgacc

SEQ ID NO: 850399 - DNA, 22 bp, Artificial Sequence
  chemically synthesized
ctgccattctgaaggtcattta

SEQ ID NO: 850400 - DNA, 22 bp, Artificial Sequence
  chemically synthesized
tcattttcaggtaaatgacctt

SEQ ID NO: 850401 - DNA, 22 bp, Artificial Sequence
  chemically synthesized
tcaggtaaatgaccttcagaat

SEQ ID NO: 850402 - DNA, 22 bp, Artificial Sequence
  chemically synthesized
caggtaaatgaccttcagaatg

SEQ ID NO: 850403 - DNA, 22 bp, Artificial Sequence
  chemically synthesized
aggtaaatgaccttcagaatgg

SEQ ID NO: 850404 - DNA, 22 bp, Artificial Sequence
  chemically synthesized
gaaatccatctactgccattct

SEQ ID NO: 850405 - DNA, 22 bp, Artificial Sequence
  chemically synthesized
agaaatccatctactgccattc

SEQ ID NO: 850406 - DNA, 22 bp, Artificial Sequence
  chemically synthesized
ttagaaatccatctactgccat

SEQ ID NO: 850407 - DNA, 22 bp, Artificial Sequence
  chemically synthesized
cttagaaatccatctactgcca

SEQ ID NO: 850408 - DNA, 22 bp, Artificial Sequence
  chemically synthesized
cagaatggcagtagatggattt

SEQ ID NO: 850409 - DNA, 22 bp, Artificial Sequence
  chemically synthesized
atgatttcttagaaatccatct

SEQ ID NO: 850410 - DNA, 22 bp, Artificial Sequence
  chemically synthesized
agaatggcagtagatggatttc

SEQ ID NO: 850411 - DNA, 22 bp, Artificial Sequence
  chemically synthesized
catgatttcttagaaatccatc

SEQ ID NO: 850412 - DNA, 22 bp, Artificial Sequence
  chemically synthesized
tatttcatgatttcttagaaat

SEQ ID NO: 850413 - DNA, 22 bp, Artificial Sequence
  chemically synthesized
gtatttcatgatttcttagaaa

SEQ ID NO: 850414 - DNA, 22 bp, Artificial Sequence
  chemically synthesized
catgtttgtatttcatgatttc

SEQ ID NO: 850415 - DNA, 22 bp, Artificial Sequence
  chemically synthesized
tctacatgtttgtatttcatga

SEQ ID NO: 850416 - DNA, 22 bp, Artificial Sequence
  chemically synthesized
gtctacatgtttgtatttcatg

SEQ ID NO: 850417 - DNA, 22 bp, Artificial Sequence
  chemically synthesized
ctaagaaatcatgaaatacaaa

SEQ ID NO: 850418 - DNA, 22 bp, Artificial Sequence
  chemically synthesized
tttgtctacatgtttgtatttc

SEQ ID NO: 850419 - DNA, 22 bp, Artificial Sequence
  chemically synthesized
taagaaatcatgaaatacaaac

SEQ ID NO: 850420 - DNA, 22 bp, Artificial Sequence
  chemically synthesized
gtttgtctacatgtttgtattt

SEQ ID NO: 850421 - DNA, 22 bp, Artificial Sequence
  chemically synthesized
tgtttgtctacatgtttgtatt

SEQ ID NO: 850422 - DNA, 22 bp, Artificial Sequence
  chemically synthesized
agaaatcatgaaatacaaacat

SEQ ID NO: 850423 - DNA, 22 bp, Artificial Sequence
  chemically synthesized
ctttgtttgtctacatgtttgt

SEQ ID NO: 850424 - DNA, 22 bp, Artificial Sequence
  chemically synthesized
cctgctttgtttgtctacatgt

SEQ ID NO: 850425 - DNA, 22 bp, Artificial Sequence
  chemically synthesized
tgcctgctttgtttgtctacat

SEQ ID NO: 850426 - DNA, 22 bp, Artificial Sequence
  chemically synthesized
ctgcctgctttgtttgtctaca

SEQ ID NO: 850427 - DNA, 22 bp, Artificial Sequence
  chemically synthesized
cttctgcctgctttgtttgtct

SEQ ID NO: 850428 - DNA, 22 bp, Artificial Sequence
  chemically synthesized
ccttctgcctgctttgtttgtc

SEQ ID NO: 850429 - DNA, 22 bp, Artificial Sequence
  chemically synthesized
cttccttctgcctgctttgttt

SEQ ID NO: 850430 - DNA, 22 bp, Artificial Sequence
  chemically synthesized
ttacttccttctgcctgctttg

SEQ ID NO: 850431 - DNA, 22 bp, Artificial Sequence
  chemically synthesized
attacttccttctgcctgcttt

SEQ ID NO: 850432 - DNA, 22 bp, Artificial Sequence
  chemically synthesized
aacttattacttccttctgcct

SEQ ID NO: 850433 - DNA, 22 bp, Artificial Sequence
  chemically synthesized
aaacttattacttccttctgcc

SEQ ID NO: 850434 - DNA, 22 bp, Artificial Sequence
  chemically synthesized
taaacttattacttccttctgc

SEQ ID NO: 850435 - DNA, 22 bp, Artificial Sequence
  chemically synthesized
ttaaacttattacttccttctg

SEQ ID NO: 850436 - DNA, 22 bp, Artificial Sequence
  chemically synthesized
tttaaacttattacttccttct

SEQ ID NO: 850437 - DNA, 22 bp, Artificial Sequence
  chemically synthesized
attttttaaacttattacttcc

SEQ ID NO: 850438 - DNA, 22 bp, Artificial Sequence
  chemically synthesized
cattttttaaacttattacttc

SEQ ID NO: 850439 - DNA, 22 bp, Artificial Sequence
  chemically synthesized
tagcacttcattttttaaactt

SEQ ID NO: 850440 - DNA, 22 bp, Artificial Sequence
  chemically synthesized
atagcacttcattttttaaact

SEQ ID NO: 850441 - DNA, 22 bp, Artificial Sequence
  chemically synthesized
ttatagcacttcattttttaaa

SEQ ID NO: 850442 - DNA, 22 bp, Artificial Sequence
  chemically synthesized
agttcttatagcacttcatttt

SEQ ID NO: 850443 - DNA, 22 bp, Artificial Sequence
  chemically synthesized
tcagttcttatagcacttcatt

SEQ ID NO: 850444 - DNA, 22 bp, Artificial Sequence
  chemically synthesized
tctcagttcttatagcacttca

SEQ ID NO: 850445 - DNA, 22 bp, Artificial Sequence
  chemically synthesized
tctctcagttcttatagcactt

SEQ ID NO: 850446 - DNA, 22 bp, Artificial Sequence
  chemically synthesized
ctctctcagttcttatagcact

SEQ ID NO: 850447 - DNA, 22 bp, Artificial Sequence
  chemically synthesized
tctctctcagttcttatagcac

SEQ ID NO: 850448 - DNA, 22 bp, Artificial Sequence
  chemically synthesized
aaaaaatgaagtgctataagaa

SEQ ID NO: 850449 - DNA, 22 bp, Artificial Sequence
  chemically synthesized
aaaaatgaagtgctataagaac

SEQ ID NO: 850450 - DNA, 22 bp, Artificial Sequence
  chemically synthesized
ataatctttctctctcagttct

SEQ ID NO: 850451 - DNA, 22 bp, Artificial Sequence
  chemically synthesized
taagaactgagagagaaagatt

SEQ ID NO: 850452 - DNA, 22 bp, Artificial Sequence
  chemically synthesized
agagagaaagattatcaatcct

SEQ ID NO: 850453 - DNA, 22 bp, Artificial Sequence
  chemically synthesized
tcaatcctccctttttctttct

SEQ ID NO: 850454 - DNA, 22 bp, Artificial Sequence
  chemically synthesized
tatagagaagaatagaagaaag

SEQ ID NO: 850455 - DNA, 22 bp, Artificial Sequence
  chemically synthesized
gtatagagaagaatagaagaaa

SEQ ID NO: 850456 - DNA, 22 bp, Artificial Sequence
  chemically synthesized
cctttttctttcttctattctt

SEQ ID NO: 850457 - DNA, 22 bp, Artificial Sequence
  chemically synthesized
ataacttgtatagagaagaata

SEQ ID NO: 850458 - DNA, 22 bp, Artificial Sequence
  chemically synthesized
tttctttcttctattcttctct

SEQ ID NO: 850459 - DNA, 22 bp, Artificial Sequence
  chemically synthesized
cataacttgtatagagaagaat

SEQ ID NO: 850460 - DNA, 22 bp, Artificial Sequence
  chemically synthesized
ttctttcttctattcttctcta

SEQ ID NO: 850461 - DNA, 22 bp, Artificial Sequence
  chemically synthesized
tctttcttctattcttctctat

SEQ ID NO: 850462 - DNA, 22 bp, Artificial Sequence
  chemically synthesized
ctttcttctattcttctctata

SEQ ID NO: 850463 - DNA, 22 bp, Artificial Sequence
  chemically synthesized
tttcttctattcttctctatac

SEQ ID NO: 850464 - DNA, 22 bp, Artificial Sequence
  chemically synthesized
cacttcataacttgtatagaga

SEQ ID NO: 850465 - DNA, 22 bp, Artificial Sequence
  chemically synthesized
tcttctattcttctctatacaa

SEQ ID NO: 850466 - DNA, 22 bp, Artificial Sequence
  chemically synthesized
ccacttcataacttgtatagag

SEQ ID NO: 850467 - DNA, 22 bp, Artificial Sequence
  chemically synthesized
cttctattcttctctatacaag

SEQ ID NO: 850468 - DNA, 22 bp, Artificial Sequence
  chemically synthesized
ttctattcttctctatacaagt

SEQ ID NO: 850469 - DNA, 22 bp, Artificial Sequence
  chemically synthesized
ttccacttcataacttgtatag

SEQ ID NO: 850470 - DNA, 22 bp, Artificial Sequence
  chemically synthesized
cttccacttcataacttgtata

SEQ ID NO: 850471 - DNA, 22 bp, Artificial Sequence
  chemically synthesized
ctattcttctctatacaagtta

SEQ ID NO: 850472 - DNA, 22 bp, Artificial Sequence
  chemically synthesized
tcttccacttcataacttgtat

SEQ ID NO: 850473 - DNA, 22 bp, Artificial Sequence
  chemically synthesized
tattcttctctatacaagttat

SEQ ID NO: 850474 - DNA, 22 bp, Artificial Sequence
  chemically synthesized
ttcttctctatacaagttatga

SEQ ID NO: 850475 - DNA, 22 bp, Artificial Sequence
  chemically synthesized
tattttcttccacttcataact

SEQ ID NO: 850476 - DNA, 22 bp, Artificial Sequence
  chemically synthesized
ttctctatacaagttatgaagt

SEQ ID NO: 850477 - DNA, 22 bp, Artificial Sequence
  chemically synthesized
gtattttcttccacttcataac

SEQ ID NO: 850478 - DNA, 22 bp, Artificial Sequence
  chemically synthesized
ctctatacaagttatgaagtgg

SEQ ID NO: 850479 - DNA, 22 bp, Artificial Sequence
  chemically synthesized
tctatacaagttatgaagtgga

SEQ ID NO: 850480 - DNA, 22 bp, Artificial Sequence
  chemically synthesized
tatacaagttatgaagtggaag

SEQ ID NO: 850481 - DNA, 22 bp, Artificial Sequence
  chemically synthesized
tatttgtattttcttccacttc

SEQ ID NO: 850482 - DNA, 22 bp, Artificial Sequence
  chemically synthesized
atatttgtattttcttccactt

SEQ ID NO: 850483 - DNA, 22 bp, Artificial Sequence
  chemically synthesized
tacaagttatgaagtggaagaa

SEQ ID NO: 850484 - DNA, 22 bp, Artificial Sequence
  chemically synthesized
tatatttgtattttcttccact

SEQ ID NO: 850485 - DNA, 22 bp, Artificial Sequence
  chemically synthesized
tgaagtggaagaaaatacaaat

SEQ ID NO: 850486 - DNA, 22 bp, Artificial Sequence
  chemically synthesized
accatcagatgattttatattt

SEQ ID NO: 850487 - DNA, 22 bp, Artificial Sequence
  chemically synthesized
caccatcagatgattttatatt

SEQ ID NO: 850488 - DNA, 22 bp, Artificial Sequence
  chemically synthesized
atgtttcaccatcagatgattt

SEQ ID NO: 850489 - DNA, 22 bp, Artificial Sequence
  chemically synthesized
actgatgtttcaccatcagatg

SEQ ID NO: 850490 - DNA, 22 bp, Artificial Sequence
  chemically synthesized
aaatctcactgatgtttcacca

SEQ ID NO: 850491 - DNA, 22 bp, Artificial Sequence
  chemically synthesized
gatataattaaaatctcactga

SEQ ID NO: 850492 - DNA, 22 bp, Artificial Sequence
  chemically synthesized
atggtgaaacatcagtgagatt

SEQ ID NO: 850493 - DNA, 22 bp, Artificial Sequence
  chemically synthesized
aaaaatctagatataattaaaa

SEQ ID NO: 850494 - DNA, 22 bp, Artificial Sequence
  chemically synthesized
aaaaaatctagatataattaaa

SEQ ID NO: 850495 - DNA, 22 bp, Artificial Sequence
  chemically synthesized
agatttaaaaaatctagatata

SEQ ID NO: 850496 - DNA, 22 bp, Artificial Sequence
  chemically synthesized
gagatttaaaaaatctagatat

SEQ ID NO: 850497 - DNA, 22 bp, Artificial Sequence
  chemically synthesized
gtttgagatttaaaaaatctag

SEQ ID NO: 850498 - DNA, 22 bp, Artificial Sequence
  chemically synthesized
taattatatctagattttttaa

SEQ ID NO: 850499 - DNA, 22 bp, Artificial Sequence
  chemically synthesized
ctagtttgagatttaaaaaatc

SEQ ID NO: 850500 - DNA, 22 bp, Artificial Sequence
  chemically synthesized
aattatatctagattttttaaa

SEQ ID NO: 850501 - DNA, 22 bp, Artificial Sequence
  chemically synthesized
cctagtttgagatttaaaaaat

SEQ ID NO: 850502 - DNA, 22 bp, Artificial Sequence
  chemically synthesized
attatatctagattttttaaat

SEQ ID NO: 850503 - DNA, 22 bp, Artificial Sequence
  chemically synthesized
tcctagtttgagatttaaaaaa

SEQ ID NO: 850504 - DNA, 22 bp, Artificial Sequence
  chemically synthesized
ttcctagtttgagatttaaaaa

SEQ ID NO: 850505 - DNA, 22 bp, Artificial Sequence
  chemically synthesized
tatctagattttttaaatctca

SEQ ID NO: 850506 - DNA, 22 bp, Artificial Sequence
  chemically synthesized
gattttttaaatctcaaactag

SEQ ID NO: 850507 - DNA, 22 bp, Artificial Sequence
  chemically synthesized
tttaaatctcaaactaggaaaa

SEQ ID NO: 850508 - DNA, 22 bp, Artificial Sequence
  chemically synthesized
ttaaatctcaaactaggaaaaa

SEQ ID NO: 850509 - DNA, 22 bp, Artificial Sequence
  chemically synthesized
tgaatcagcagatttttcctag

SEQ ID NO: 850510 - DNA, 22 bp, Artificial Sequence
  chemically synthesized
taaatctcaaactaggaaaaat

SEQ ID NO: 850511 - DNA, 22 bp, Artificial Sequence
  chemically synthesized
gtgaatcagcagatttttccta

SEQ ID NO: 850512 - DNA, 22 bp, Artificial Sequence
  chemically synthesized
aaatctcaaactaggaaaaatc

SEQ ID NO: 850513 - DNA, 22 bp, Artificial Sequence
  chemically synthesized
aatctcaaactaggaaaaatct

SEQ ID NO: 850514 - DNA, 22 bp, Artificial Sequence
  chemically synthesized
atgtttgtgaatcagcagattt

SEQ ID NO: 850515 - DNA, 22 bp, Artificial Sequence
  chemically synthesized
catgtttgtgaatcagcagatt

SEQ ID NO: 850516 - DNA, 22 bp, Artificial Sequence
  chemically synthesized
aaactaggaaaaatctgctgat

SEQ ID NO: 850517 - DNA, 22 bp, Artificial Sequence
  chemically synthesized
tcatgtttgtgaatcagcagat

SEQ ID NO: 850518 - DNA, 22 bp, Artificial Sequence
  chemically synthesized
ggaaaaatctgctgattcacaa

SEQ ID NO: 850519 - DNA, 22 bp, Artificial Sequence
  chemically synthesized
aaatattttcatgtttgtgaat

SEQ ID NO: 850520 - DNA, 22 bp, Artificial Sequence
  chemically synthesized
aaaatattttcatgtttgtgaa

SEQ ID NO: 850521 - DNA, 22 bp, Artificial Sequence
  chemically synthesized
taaaatattttcatgtttgtga

SEQ ID NO: 850522 - DNA, 22 bp, Artificial Sequence
  chemically synthesized
ttaaaatattttcatgtttgtg

SEQ ID NO: 850523 - DNA, 22 bp, Artificial Sequence
  chemically synthesized
atcttttaaaatattttcatgt

SEQ ID NO: 850524 - DNA, 22 bp, Artificial Sequence
  chemically synthesized
ctgattcacaaacatgaaaata

SEQ ID NO: 850525 - DNA, 22 bp, Artificial Sequence
  chemically synthesized
tgatcttttaaaatattttcat

SEQ ID NO: 850526 - DNA, 22 bp, Artificial Sequence
  chemically synthesized
attcacaaacatgaaaatattt

SEQ ID NO: 850527 - DNA, 22 bp, Artificial Sequence
  chemically synthesized
acaaacatgaaaatattttaaa

SEQ ID NO: 850528 - DNA, 22 bp, Artificial Sequence
  chemically synthesized
atatatctctgatcttttaaaa

SEQ ID NO: 850529 - DNA, 22 bp, Artificial Sequence
  chemically synthesized
gaacatgagaattaatatatct

SEQ ID NO: 850530 - DNA, 22 bp, Artificial Sequence
  chemically synthesized
taaaagatcagagatatattaa

SEQ ID NO: 850531 - DNA, 22 bp, Artificial Sequence
  chemically synthesized
aaaagatcagagatatattaat

SEQ ID NO: 850532 - DNA, 22 bp, Artificial Sequence
  chemically synthesized
aaagatcagagatatattaatt

SEQ ID NO: 850533 - DNA, 22 bp, Artificial Sequence
  chemically synthesized
atgtcaggagaattagaacatg

SEQ ID NO: 850534 - DNA, 22 bp, Artificial Sequence
  chemically synthesized
attctcatgttctaattctcct

SEQ ID NO: 850535 - DNA, 22 bp, Artificial Sequence
  chemically synthesized
tcatgttctaattctcctgaca

SEQ ID NO: 850536 - DNA, 22 bp, Artificial Sequence
  chemically synthesized
atgttctaattctcctgacatg

SEQ ID NO: 850537 - DNA, 22 bp, Artificial Sequence
  chemically synthesized
taattctcctgacatgaaccat

SEQ ID NO: 850538 - DNA, 22 bp, Artificial Sequence
  chemically synthesized
attctcctgacatgaaccatat

SEQ ID NO: 850539 - DNA, 22 bp, Artificial Sequence
  chemically synthesized
tcctgacatgaaccatatatat

SEQ ID NO: 850540 - DNA, 22 bp, Artificial Sequence
  chemically synthesized
ctgacatgaaccatatatatgc

SEQ ID NO: 850541 - DNA, 22 bp, Artificial Sequence
  chemically synthesized
acatgaaccatatatatgcttt

SEQ ID NO: 850542 - DNA, 22 bp, Artificial Sequence
  chemically synthesized
agaatcatcagaaagaataaag

SEQ ID NO: 850543 - DNA, 22 bp, Artificial Sequence
  chemically synthesized
tcagaatcatcagaaagaataa

SEQ ID NO: 850544 - DNA, 22 bp, Artificial Sequence
  chemically synthesized
ctcagaatcatcagaaagaata

SEQ ID NO: 850545 - DNA, 22 bp, Artificial Sequence
  chemically synthesized
tctcagaatcatcagaaagaat

SEQ ID NO: 850546 - DNA, 22 bp, Artificial Sequence
  chemically synthesized
ttctcagaatcatcagaaagaa

SEQ ID NO: 850547 - DNA, 22 bp, Artificial Sequence
  chemically synthesized
atttttctcagaatcatcagaa

SEQ ID NO: 850548 - DNA, 22 bp, Artificial Sequence
  chemically synthesized
gatttttctcagaatcatcaga

SEQ ID NO: 850549 - DNA, 22 bp, Artificial Sequence
  chemically synthesized
tattctttctgatgattctgag

SEQ ID NO: 850550 - DNA, 22 bp, Artificial Sequence
  chemically synthesized
attctttctgatgattctgaga

SEQ ID NO: 850551 - DNA, 22 bp, Artificial Sequence
  chemically synthesized
ttctttctgatgattctgagaa

SEQ ID NO: 850552 - DNA, 22 bp, Artificial Sequence
  chemically synthesized
agaatttgatttttctcagaat

SEQ ID NO: 850553 - DNA, 22 bp, Artificial Sequence
  chemically synthesized
tttctgatgattctgagaaaaa

SEQ ID NO: 850554 - DNA, 22 bp, Artificial Sequence
  chemically synthesized
tctgatgattctgagaaaaatc

SEQ ID NO: 850555 - DNA, 22 bp, Artificial Sequence
  chemically synthesized
ctgatgattctgagaaaaatca

SEQ ID NO: 850556 - DNA, 22 bp, Artificial Sequence
  chemically synthesized
tgatgattctgagaaaaatcaa

SEQ ID NO: 850557 - DNA, 22 bp, Artificial Sequence
  chemically synthesized
aaaattcagaatttgatttttc

SEQ ID NO: 850558 - DNA, 22 bp, Artificial Sequence
  chemically synthesized
aaaaattcagaatttgattttt

SEQ ID NO: 850559 - DNA, 22 bp, Artificial Sequence
  chemically synthesized
atgattctgagaaaaatcaaat

SEQ ID NO: 850560 - DNA, 22 bp, Artificial Sequence
  chemically synthesized
taaaaattcagaatttgatttt

SEQ ID NO: 850561 - DNA, 22 bp, Artificial Sequence
  chemically synthesized
tgagaaaaatcaaattctgaat

SEQ ID NO: 850562 - DNA, 22 bp, Artificial Sequence
  chemically synthesized
agaaaaatcaaattctgaattt

SEQ ID NO: 850563 - DNA, 22 bp, Artificial Sequence
  chemically synthesized
ggcaacatcatcattttaaaaa

SEQ ID NO: 850564 - DNA, 22 bp, Artificial Sequence
  chemically synthesized
gggcaacatcatcattttaaaa

SEQ ID NO: 850565 - DNA, 22 bp, Artificial Sequence
  chemically synthesized
caatttgggcaacatcatcatt

SEQ ID NO: 850566 - DNA, 22 bp, Artificial Sequence
  chemically synthesized
tgaatttttaaaatgatgatgt

SEQ ID NO: 850567 - DNA, 22 bp, Artificial Sequence
  chemically synthesized
aatttttaaaatgatgatgttg

SEQ ID NO: 850568 - DNA, 22 bp, Artificial Sequence
  chemically synthesized
ttacaatttgggcaacatcatc

SEQ ID NO: 850569 - DNA, 22 bp, Artificial Sequence
  chemically synthesized
attacaatttgggcaacatcat

SEQ ID NO: 850570 - DNA, 22 bp, Artificial Sequence
  chemically synthesized
ttaaaatgatgatgttgcccaa

SEQ ID NO: 850571 - DNA, 22 bp, Artificial Sequence
  chemically synthesized
taaaatgatgatgttgcccaaa

SEQ ID NO: 850572 - DNA, 22 bp, Artificial Sequence
  chemically synthesized
aaaatgatgatgttgcccaaat

SEQ ID NO: 850573 - DNA, 22 bp, Artificial Sequence
  chemically synthesized
aaatgatgatgttgcccaaatt

SEQ ID NO: 850574 - DNA, 22 bp, Artificial Sequence
  chemically synthesized
gaaaatatggtgatttattaca

SEQ ID NO: 850575 - DNA, 22 bp, Artificial Sequence
  chemically synthesized
ggaaaatatggtgatttattac

SEQ ID NO: 850576 - DNA, 22 bp, Artificial Sequence
  chemically synthesized
tggaaaatatggtgatttatta

SEQ ID NO: 850577 - DNA, 22 bp, Artificial Sequence
  chemically synthesized
tttggaaaatatggtgatttat

SEQ ID NO: 850578 - DNA, 22 bp, Artificial Sequence
  chemically synthesized
cccaaattgtaataaatcacca

SEQ ID NO: 850579 - DNA, 22 bp, Artificial Sequence
  chemically synthesized
ctttggaaaatatggtgattta

SEQ ID NO: 850580 - DNA, 22 bp, Artificial Sequence
  chemically synthesized
tctttggaaaatatggtgattt

SEQ ID NO: 850581 - DNA, 22 bp, Artificial Sequence
  chemically synthesized
ttctttggaaaatatggtgatt

SEQ ID NO: 850582 - DNA, 22 bp, Artificial Sequence
  chemically synthesized
taataaatcaccatattttcca

SEQ ID NO: 850583 - DNA, 22 bp, Artificial Sequence
  chemically synthesized
tgtagaatttttctttggaaaa

SEQ ID NO: 850584 - DNA, 22 bp, Artificial Sequence
  chemically synthesized
tgtacaggaattgtgtagaatt

SEQ ID NO: 850585 - DNA, 22 bp, Artificial Sequence
  chemically synthesized
atgtacaggaattgtgtagaat

SEQ ID NO: 850586 - DNA, 22 bp, Artificial Sequence
  chemically synthesized
tccaaagaaaaattctacacaa

SEQ ID NO: 850587 - DNA, 22 bp, Artificial Sequence
  chemically synthesized
ccaaagaaaaattctacacaat

SEQ ID NO: 850588 - DNA, 22 bp, Artificial Sequence
  chemically synthesized
caaagaaaaattctacacaatt

SEQ ID NO: 850589 - DNA, 22 bp, Artificial Sequence
  chemically synthesized
cacacaaaatttatgtacagga

SEQ ID NO: 850590 - DNA, 22 bp, Artificial Sequence
  chemically synthesized
ccacacaaaatttatgtacagg

SEQ ID NO: 850591 - DNA, 22 bp, Artificial Sequence
  chemically synthesized
tccacacaaaatttatgtacag

SEQ ID NO: 850592 - DNA, 22 bp, Artificial Sequence
  chemically synthesized
tacacaattcctgtacataaat

SEQ ID NO: 850593 - DNA, 22 bp, Artificial Sequence
  chemically synthesized
cacaattcctgtacataaattt

SEQ ID NO: 850594 - DNA, 22 bp, Artificial Sequence
  chemically synthesized
ctgtacataaattttgtgtgga

SEQ ID NO: 850595 - DNA, 22 bp, Artificial Sequence
  chemically synthesized
tgatacaagcctttccacacaa

SEQ ID NO: 850596 - DNA, 22 bp, Artificial Sequence
  chemically synthesized
atgatacaagcctttccacaca

SEQ ID NO: 850597 - DNA, 22 bp, Artificial Sequence
  chemically synthesized
tacataaattttgtgtggaaag

SEQ ID NO: 850598 - DNA, 22 bp, Artificial Sequence
  chemically synthesized
ttatgatacaagcctttccaca

SEQ ID NO: 850599 - DNA, 22 bp, Artificial Sequence
  chemically synthesized
ttcttatgatacaagcctttcc

SEQ ID NO: 850600 - DNA, 22 bp, Artificial Sequence
  chemically synthesized
attattcttatgatacaagcct

SEQ ID NO: 850601 - DNA, 22 bp, Artificial Sequence
  chemically synthesized
gattattcttatgatacaagcc

SEQ ID NO: 850602 - DNA, 22 bp, Artificial Sequence
  chemically synthesized
tgattattcttatgatacaagc

SEQ ID NO: 850603 - DNA, 22 bp, Artificial Sequence
  chemically synthesized
tgtgtggaaaggcttgtatcat

SEQ ID NO: 850604 - DNA, 22 bp, Artificial Sequence
  chemically synthesized
gtgtggaaaggcttgtatcata

SEQ ID NO: 850605 - DNA, 22 bp, Artificial Sequence
  chemically synthesized
tgtggaaaggcttgtatcataa

SEQ ID NO: 850606 - DNA, 22 bp, Artificial Sequence
  chemically synthesized
ctttgattattcttatgataca

SEQ ID NO: 850607 - DNA, 22 bp, Artificial Sequence
  chemically synthesized
cctttgattattcttatgatac

SEQ ID NO: 850608 - DNA, 22 bp, Artificial Sequence
  chemically synthesized
tcctttgattattcttatgata

SEQ ID NO: 850609 - DNA, 22 bp, Artificial Sequence
  chemically synthesized
ttcctttgattattcttatgat

SEQ ID NO: 850610 - DNA, 22 bp, Artificial Sequence
  chemically synthesized
ttttcctttgattattcttatg

SEQ ID NO: 850611 - DNA, 22 bp, Artificial Sequence
  chemically synthesized
cagttcttttcctttgattatt

SEQ ID NO: 850612 - DNA, 22 bp, Artificial Sequence
  chemically synthesized
gcagttcttttcctttgattat

SEQ ID NO: 850613 - DNA, 22 bp, Artificial Sequence
  chemically synthesized
gtatcataagaataatcaaagg

SEQ ID NO: 850614 - DNA, 22 bp, Artificial Sequence
  chemically synthesized
tatcataagaataatcaaagga

SEQ ID NO: 850615 - DNA, 22 bp, Artificial Sequence
  chemically synthesized
gtttgcagttcttttcctttga

SEQ ID NO: 850616 - DNA, 22 bp, Artificial Sequence
  chemically synthesized
ctagtttgcagttcttttcctt

SEQ ID NO: 850617 - DNA, 22 bp, Artificial Sequence
  chemically synthesized
tactagtttgcagttcttttcc

SEQ ID NO: 850618 - DNA, 22 bp, Artificial Sequence
  chemically synthesized
ctactagtttgcagttcttttc

SEQ ID NO: 850619 - DNA, 22 bp, Artificial Sequence
  chemically synthesized
tgcttctactagtttgcagttc

SEQ ID NO: 850620 - DNA, 22 bp, Artificial Sequence
  chemically synthesized
atgcttctactagtttgcagtt

SEQ ID NO: 850621 - DNA, 22 bp, Artificial Sequence
  chemically synthesized
aatttatgcttctactagtttg

SEQ ID NO: 850622 - DNA, 22 bp, Artificial Sequence
  chemically synthesized
aaatttatgcttctactagttt

SEQ ID NO: 850623 - DNA, 22 bp, Artificial Sequence
  chemically synthesized
taaatttatgcttctactagtt

SEQ ID NO: 850624 - DNA, 22 bp, Artificial Sequence
  chemically synthesized
caaactagtagaagcataaatt

SEQ ID NO: 850625 - DNA, 22 bp, Artificial Sequence
  chemically synthesized
gtagaagcataaatttaaaatg

SEQ ID NO: 850626 - DNA, 22 bp, Artificial Sequence
  chemically synthesized
gatgtcatcatcagcaacattt

SEQ ID NO: 850627 - DNA, 22 bp, Artificial Sequence
  chemically synthesized
ctcgatgtcatcatcagcaaca

SEQ ID NO: 850628 - DNA, 22 bp, Artificial Sequence
  chemically synthesized
actcgatgtcatcatcagcaac

SEQ ID NO: 850629 - DNA, 22 bp, Artificial Sequence
  chemically synthesized
tactcgatgtcatcatcagcaa

SEQ ID NO: 850630 - DNA, 22 bp, Artificial Sequence
  chemically synthesized
aaaatgttgctgatgatgacat

SEQ ID NO: 850631 - DNA, 22 bp, Artificial Sequence
  chemically synthesized
aaatgttgctgatgatgacatc

SEQ ID NO: 850632 - DNA, 22 bp, Artificial Sequence
  chemically synthesized
aaatctttactcgatgtcatca

SEQ ID NO: 850633 - DNA, 22 bp, Artificial Sequence
  chemically synthesized
caaatctttactcgatgtcatc

SEQ ID NO: 850634 - DNA, 22 bp, Artificial Sequence
  chemically synthesized
acacttcaaatctttactcgat

SEQ ID NO: 850635 - DNA, 22 bp, Artificial Sequence
  chemically synthesized
ctgatgatgacatcgagtaaag

SEQ ID NO: 850636 - DNA, 22 bp, Artificial Sequence
  chemically synthesized
aacacttcaaatctttactcga

SEQ ID NO: 850637 - DNA, 22 bp, Artificial Sequence
  chemically synthesized
atgatgacatcgagtaaagatt

SEQ ID NO: 850638 - DNA, 22 bp, Artificial Sequence
  chemically synthesized
cttaacacttcaaatctttact

SEQ ID NO: 850639 - DNA, 22 bp, Artificial Sequence
  chemically synthesized
acatgctacttaacacttcaaa

SEQ ID NO: 850640 - DNA, 22 bp, Artificial Sequence
  chemically synthesized
gttaacatgctacttaacactt

SEQ ID NO: 850641 - DNA, 22 bp, Artificial Sequence
  chemically synthesized
gaagtgttaagtagcatgttaa

SEQ ID NO: 850642 - DNA, 22 bp, Artificial Sequence
  chemically synthesized
aagtgttaagtagcatgttaac

SEQ ID NO: 850643 - DNA, 22 bp, Artificial Sequence
  chemically synthesized
agtagcatgttaaccaactttt

SEQ ID NO: 850644 - DNA, 22 bp, Artificial Sequence
  chemically synthesized
agaaggggaagaggatcataga

SEQ ID NO: 850645 - DNA, 22 bp, Artificial Sequence
  chemically synthesized
accaactttttctatgatcctc

SEQ ID NO: 850646 - DNA, 22 bp, Artificial Sequence
  chemically synthesized
tttctatgatcctcttcccctt

SEQ ID NO: 850647 - DNA, 22 bp, Artificial Sequence
  chemically synthesized
ttctatgatcctcttccccttc

SEQ ID NO: 850648 - DNA, 22 bp, Artificial Sequence
  chemically synthesized
tctatgatcctcttccccttct

SEQ ID NO: 850649 - DNA, 22 bp, Artificial Sequence
  chemically synthesized
gagtgggtattgagaaggggaa

SEQ ID NO: 850650 - DNA, 22 bp, Artificial Sequence
  chemically synthesized
ctatgatcctcttccccttctc

SEQ ID NO: 850651 - DNA, 22 bp, Artificial Sequence
  chemically synthesized
tatgatcctcttccccttctca

SEQ ID NO: 850652 - DNA, 22 bp, Artificial Sequence
  chemically synthesized
tgatcctcttccccttctcaat

SEQ ID NO: 850653 - DNA, 22 bp, Artificial Sequence
  chemically synthesized
aaagctagagtgggtattgaga

SEQ ID NO: 850654 - DNA, 22 bp, Artificial Sequence
  chemically synthesized
aaaagctagagtgggtattgag

SEQ ID NO: 850655 - DNA, 22 bp, Artificial Sequence
  chemically synthesized
taaaagctagagtgggtattga

SEQ ID NO: 850656 - DNA, 22 bp, Artificial Sequence
  chemically synthesized
ttaaaagctagagtgggtattg

SEQ ID NO: 850657 - DNA, 22 bp, Artificial Sequence
  chemically synthesized
ttccccttctcaatacccactc

SEQ ID NO: 850658 - DNA, 22 bp, Artificial Sequence
  chemically synthesized
ccccttctcaatacccactcta

SEQ ID NO: 850659 - DNA, 22 bp, Artificial Sequence
  chemically synthesized
cccttctcaatacccactctag

SEQ ID NO: 850660 - DNA, 22 bp, Artificial Sequence
  chemically synthesized
tgtttttaaaagctagagtggg

SEQ ID NO: 850661 - DNA, 22 bp, Artificial Sequence
  chemically synthesized
attgtgtttttaaaagctagag

SEQ ID NO: 850662 - DNA, 22 bp, Artificial Sequence
  chemically synthesized
ctcaatacccactctagctttt

SEQ ID NO: 850663 - DNA, 22 bp, Artificial Sequence
  chemically synthesized
tcaatacccactctagctttta

SEQ ID NO: 850664 - DNA, 22 bp, Artificial Sequence
  chemically synthesized
aatacccactctagcttttaaa

SEQ ID NO: 850665 - DNA, 22 bp, Artificial Sequence
  chemically synthesized
tagaaaacaatctcattgtgtt

SEQ ID NO: 850666 - DNA, 22 bp, Artificial Sequence
  chemically synthesized
tagcttttaaaaacacaatgag

SEQ ID NO: 850667 - DNA, 22 bp, Artificial Sequence
  chemically synthesized
gcttttaaaaacacaatgagat

SEQ ID NO: 850668 - DNA, 22 bp, Artificial Sequence
  chemically synthesized
tgctgtagaaaacaatctcatt

SEQ ID NO: 850669 - DNA, 22 bp, Artificial Sequence
  chemically synthesized
ttaaaaacacaatgagattgtt

SEQ ID NO: 850670 - DNA, 22 bp, Artificial Sequence
  chemically synthesized
taaaaacacaatgagattgttt

SEQ ID NO: 850671 - DNA, 22 bp, Artificial Sequence
  chemically synthesized
aaaaacacaatgagattgtttt

SEQ ID NO: 850672 - DNA, 22 bp, Artificial Sequence
  chemically synthesized
aaaacacaatgagattgttttc

SEQ ID NO: 850673 - DNA, 22 bp, Artificial Sequence
  chemically synthesized
atcattgtgctgtagaaaacaa

SEQ ID NO: 850674 - DNA, 22 bp, Artificial Sequence
  chemically synthesized
aaatgttcatcattgtgctgta

SEQ ID NO: 850675 - DNA, 22 bp, Artificial Sequence
  chemically synthesized
ttttctacagcacaatgatgaa

SEQ ID NO: 850676 - DNA, 22 bp, Artificial Sequence
  chemically synthesized
tacacctgaaatgttcatcatt

SEQ ID NO: 850677 - DNA, 22 bp, Artificial Sequence
  chemically synthesized
atacacctgaaatgttcatcat

SEQ ID NO: 850678 - DNA, 22 bp, Artificial Sequence
  chemically synthesized
tctacagcacaatgatgaacat

SEQ ID NO: 850679 - DNA, 22 bp, Artificial Sequence
  chemically synthesized
tatacacctgaaatgttcatca

SEQ ID NO: 850680 - DNA, 22 bp, Artificial Sequence
  chemically synthesized
ctacagcacaatgatgaacatt

SEQ ID NO: 850681 - DNA, 22 bp, Artificial Sequence
  chemically synthesized
ttatacacctgaaatgttcatc

SEQ ID NO: 850682 - DNA, 22 bp, Artificial Sequence
  chemically synthesized
tacagcacaatgatgaacattt

SEQ ID NO: 850683 - DNA, 22 bp, Artificial Sequence
  chemically synthesized
tttatacacctgaaatgttcat

SEQ ID NO: 850684 - DNA, 22 bp, Artificial Sequence
  chemically synthesized
cagcacaatgatgaacatttca

SEQ ID NO: 850685 - DNA, 22 bp, Artificial Sequence
  chemically synthesized
tattttttatacacctgaaatg

SEQ ID NO: 850686 - DNA, 22 bp, Artificial Sequence
  chemically synthesized
atattttttatacacctgaaat

SEQ ID NO: 850687 - DNA, 22 bp, Artificial Sequence
  chemically synthesized
tatattttttatacacctgaaa

SEQ ID NO: 850688 - DNA, 22 bp, Artificial Sequence
  chemically synthesized
tttatattttttatacacctga

SEQ ID NO: 850689 - DNA, 22 bp, Artificial Sequence
  chemically synthesized
ctttatattttttatacacctg

SEQ ID NO: 850690 - DNA, 22 bp, Artificial Sequence
  chemically synthesized
tctttatattttttatacacct

SEQ ID NO: 850691 - DNA, 22 bp, Artificial Sequence
  chemically synthesized
ttctttatattttttatacacc

SEQ ID NO: 850692 - DNA, 22 bp, Artificial Sequence
  chemically synthesized
taatcttttctttatatttttt

SEQ ID NO: 850693 - DNA, 22 bp, Artificial Sequence
  chemically synthesized
gtaatcttttctttatattttt

SEQ ID NO: 850694 - DNA, 22 bp, Artificial Sequence
  chemically synthesized
caggtgtataaaaaatataaag

SEQ ID NO: 850695 - DNA, 22 bp, Artificial Sequence
  chemically synthesized
aggtgtataaaaaatataaaga

SEQ ID NO: 850696 - DNA, 22 bp, Artificial Sequence
  chemically synthesized
acttgtaatcttttctttatat

SEQ ID NO: 850697 - DNA, 22 bp, Artificial Sequence
  chemically synthesized
cacttgtaatcttttctttata

SEQ ID NO: 850698 - DNA, 22 bp, Artificial Sequence
  chemically synthesized
gtacagccatgccatagacttc

SEQ ID NO: 850699 - DNA, 22 bp, Artificial Sequence
  chemically synthesized
caagtgaagtctatggcatggc

SEQ ID NO: 850700 - DNA, 22 bp, Artificial Sequence
  chemically synthesized
tggcatggctgtactaatccac

SEQ ID NO: 850701 - DNA, 22 bp, Artificial Sequence
  chemically synthesized
ccgagcgtacgtgtgtgtggat

SEQ ID NO: 850702 - DNA, 22 bp, Artificial Sequence
  chemically synthesized
cactgccgagcgtacgtgtgtg

SEQ ID NO: 850703 - DNA, 22 bp, Artificial Sequence
  chemically synthesized
acactgccgagcgtacgtgtgt

SEQ ID NO: 850704 - DNA, 22 bp, Artificial Sequence
  chemically synthesized
tactaatccacacacacgtacg

SEQ ID NO: 850705 - DNA, 22 bp, Artificial Sequence
  chemically synthesized
tacactgccgagcgtacgtgtg

SEQ ID NO: 850706 - DNA, 22 bp, Artificial Sequence
  chemically synthesized
ttacactgccgagcgtacgtgt

SEQ ID NO: 850707 - DNA, 22 bp, Artificial Sequence
  chemically synthesized
atccacacacacgtacgctcgg

SEQ ID NO: 850708 - DNA, 22 bp, Artificial Sequence
  chemically synthesized
aagcaaatcagtgaggtaactt

SEQ ID NO: 850709 - DNA, 22 bp, Artificial Sequence
  chemically synthesized
ggcagtgtaaaagttacctcac

SEQ ID NO: 850710 - DNA, 22 bp, Artificial Sequence
  chemically synthesized
attcaagcaaatcagtgaggta

SEQ ID NO: 850711 - DNA, 22 bp, Artificial Sequence
  chemically synthesized
ttaattcaagcaaatcagtgag

SEQ ID NO: 850712 - DNA, 22 bp, Artificial Sequence
  chemically synthesized
aattgttaattcaagcaaatca

SEQ ID NO: 850713 - DNA, 22 bp, Artificial Sequence
  chemically synthesized
aaattgttaattcaagcaaatc

SEQ ID NO: 850714 - DNA, 22 bp, Artificial Sequence
  chemically synthesized
taaattgttaattcaagcaaat

SEQ ID NO: 850715 - DNA, 22 bp, Artificial Sequence
  chemically synthesized
ttttaaattgttaattcaagca

SEQ ID NO: 850716 - DNA, 22 bp, Artificial Sequence
  chemically synthesized
cctcactgatttgcttgaatta

SEQ ID NO: 850717 - DNA, 22 bp, Artificial Sequence
  chemically synthesized
attttaaattgttaattcaagc

SEQ ID NO: 850718 - DNA, 22 bp, Artificial Sequence
  chemically synthesized
tattttaaattgttaattcaag

SEQ ID NO: 850719 - DNA, 22 bp, Artificial Sequence
  chemically synthesized
actgatttgcttgaattaacaa

SEQ ID NO: 850720 - DNA, 22 bp, Artificial Sequence
  chemically synthesized
atttgcttgaattaacaattta

SEQ ID NO: 850721 - DNA, 22 bp, Artificial Sequence
  chemically synthesized
gcttgaattaacaatttaaaat

SEQ ID NO: 850722 - DNA, 22 bp, Artificial Sequence
  chemically synthesized
cttgaattaacaatttaaaata

SEQ ID NO: 850723 - DNA, 22 bp, Artificial Sequence
  chemically synthesized
agtataaaattttattttaaat

SEQ ID NO: 850724 - DNA, 22 bp, Artificial Sequence
  chemically synthesized
gaattaacaatttaaaataaaa

SEQ ID NO: 850725 - DNA, 22 bp, Artificial Sequence
  chemically synthesized
aattaacaatttaaaataaaat

SEQ ID NO: 850726 - DNA, 22 bp, Artificial Sequence
  chemically synthesized
attcagtataaaattttatttt

SEQ ID NO: 850727 - DNA, 22 bp, Artificial Sequence
  chemically synthesized
acaatttaaaataaaattttat

SEQ ID NO: 850728 - DNA, 22 bp, Artificial Sequence
  chemically synthesized
aaaataaaattttatactgaat

SEQ ID NO: 850729 - DNA, 22 bp, Artificial Sequence
  chemically synthesized
aaataaaattttatactgaatt

SEQ ID NO: 850730 - DNA, 22 bp, Artificial Sequence
  chemically synthesized
taaaaataaacattaattcagt

SEQ ID NO: 850731 - DNA, 22 bp, Artificial Sequence
  chemically synthesized
ataaaaataaacattaattcag

SEQ ID NO: 850732 - DNA, 22 bp, Artificial Sequence
  chemically synthesized
tataaaaataaacattaattca

SEQ ID NO: 850733 - DNA, 22 bp, Artificial Sequence
  chemically synthesized
ttttataaaaataaacattaat

SEQ ID NO: 850734 - DNA, 22 bp, Artificial Sequence
  chemically synthesized
ctattttataaaaataaacatt

SEQ ID NO: 850735 - DNA, 22 bp, Artificial Sequence
  chemically synthesized
tatactgaattaatgtttattt

SEQ ID NO: 850736 - DNA, 22 bp, Artificial Sequence
  chemically synthesized
atactgaattaatgtttatttt

SEQ ID NO: 850737 - DNA, 22 bp, Artificial Sequence
  chemically synthesized
tactgaattaatgtttattttt

SEQ ID NO: 850738 - DNA, 22 bp, Artificial Sequence
  chemically synthesized
aattaatgtttatttttataaa

SEQ ID NO: 850739 - DNA, 22 bp, Artificial Sequence
  chemically synthesized
ataacactgctattttataaaa

SEQ ID NO: 850740 - DNA, 22 bp, Artificial Sequence
  chemically synthesized
taataacactgctattttataa

SEQ ID NO: 850741 - DNA, 22 bp, Artificial Sequence
  chemically synthesized
ctaataacactgctattttata

SEQ ID NO: 850742 - DNA, 22 bp, Artificial Sequence
  chemically synthesized
atgtttatttttataaaatagc

SEQ ID NO: 850743 - DNA, 22 bp, Artificial Sequence
  chemically synthesized
tctaataacactgctattttat

SEQ ID NO: 850744 - DNA, 22 bp, Artificial Sequence
  chemically synthesized
atttttataaaatagcagtgtt

SEQ ID NO: 850745 - DNA, 22 bp, Artificial Sequence
  chemically synthesized
tttttataaaatagcagtgtta

SEQ ID NO: 850746 - DNA, 22 bp, Artificial Sequence
  chemically synthesized
ttataaaatagcagtgttatta

SEQ ID NO: 850747 - DNA, 22 bp, Artificial Sequence
  chemically synthesized
tataaaatagcagtgttattag

SEQ ID NO: 850748 - DNA, 22 bp, Artificial Sequence
  chemically synthesized
tcagaaatctttctaataacac

SEQ ID NO: 850749 - DNA, 22 bp, Artificial Sequence
  chemically synthesized
ataaaatagcagtgttattaga

SEQ ID NO: 850750 - DNA, 22 bp, Artificial Sequence
  chemically synthesized
gtcagaaatctttctaataaca

SEQ ID NO: 850751 - DNA, 22 bp, Artificial Sequence
  chemically synthesized
taaaatagcagtgttattagaa

SEQ ID NO: 850752 - DNA, 22 bp, Artificial Sequence
  chemically synthesized
cttgtcagaaatctttctaata

SEQ ID NO: 850753 - DNA, 22 bp, Artificial Sequence
  chemically synthesized
taatcgtacactacttgtcaga

SEQ ID NO: 850754 - DNA, 22 bp, Artificial Sequence
  chemically synthesized
ttagaaagatttctgacaagta

SEQ ID NO: 850755 - DNA, 22 bp, Artificial Sequence
  chemically synthesized
gtaatcgtacactacttgtcag

SEQ ID NO: 850756 - DNA, 22 bp, Artificial Sequence
  chemically synthesized
gaaagatttctgacaagtagtg

SEQ ID NO: 850757 - DNA, 22 bp, Artificial Sequence
  chemically synthesized
ctgacaagtagtgtacgattac

SEQ ID NO: 850758 - DNA, 22 bp, Artificial Sequence
  chemically synthesized
tgacaagtagtgtacgattaca

SEQ ID NO: 850759 - DNA, 22 bp, Artificial Sequence
  chemically synthesized
acaagtagtgtacgattacaaa

SEQ ID NO: 850760 - DNA, 22 bp, Artificial Sequence
  chemically synthesized
caaggtagatgatatttgtaat

SEQ ID NO: 850761 - DNA, 22 bp, Artificial Sequence
  chemically synthesized
atggtaactccaaggtagatga

SEQ ID NO: 850762 - DNA, 22 bp, Artificial Sequence
  chemically synthesized
catggtaactccaaggtagatg

SEQ ID NO: 850763 - DNA, 22 bp, Artificial Sequence
  chemically synthesized
atttcatggtaactccaaggta

SEQ ID NO: 850764 - DNA, 22 bp, Artificial Sequence
  chemically synthesized
caaatatcatctaccttggagt

SEQ ID NO: 850765 - DNA, 22 bp, Artificial Sequence
  chemically synthesized
ctaatttcatggtaactccaag

SEQ ID NO: 850766 - DNA, 22 bp, Artificial Sequence
  chemically synthesized
ccctcctaatttcatggtaact

SEQ ID NO: 850767 - DNA, 22 bp, Artificial Sequence
  chemically synthesized
accctcctaatttcatggtaac

SEQ ID NO: 850768 - DNA, 22 bp, Artificial Sequence
  chemically synthesized
taccctcctaatttcatggtaa

SEQ ID NO: 850769 - DNA, 22 bp, Artificial Sequence
  chemically synthesized
ttaccctcctaatttcatggta

SEQ ID NO: 850770 - DNA, 22 bp, Artificial Sequence
  chemically synthesized
ccttggagttaccatgaaatta

SEQ ID NO: 850771 - DNA, 22 bp, Artificial Sequence
  chemically synthesized
tttttaccctcctaatttcatg

SEQ ID NO: 850772 - DNA, 22 bp, Artificial Sequence
  chemically synthesized
ctatttttaccctcctaatttc

SEQ ID NO: 850773 - DNA, 22 bp, Artificial Sequence
  chemically synthesized
ggagttaccatgaaattaggag

SEQ ID NO: 850774 - DNA, 22 bp, Artificial Sequence
  chemically synthesized
actatttttaccctcctaattt

SEQ ID NO: 850775 - DNA, 22 bp, Artificial Sequence
  chemically synthesized
gagttaccatgaaattaggagg

SEQ ID NO: 850776 - DNA, 22 bp, Artificial Sequence
  chemically synthesized
tttactatttttaccctcctaa

SEQ ID NO: 850777 - DNA, 22 bp, Artificial Sequence
  chemically synthesized
atttactatttttaccctccta

SEQ ID NO: 850778 - DNA, 22 bp, Artificial Sequence
  chemically synthesized
tatttactatttttaccctcct

SEQ ID NO: 850779 - DNA, 22 bp, Artificial Sequence
  chemically synthesized
ccatgaaattaggagggtaaaa

SEQ ID NO: 850780 - DNA, 22 bp, Artificial Sequence
  chemically synthesized
gaataggatctttatttactat

SEQ ID NO: 850781 - DNA, 22 bp, Artificial Sequence
  chemically synthesized
ggagggtaaaaatagtaaataa

SEQ ID NO: 850782 - DNA, 22 bp, Artificial Sequence
  chemically synthesized
catataggccagatgtctagaa

SEQ ID NO: 850783 - DNA, 22 bp, Artificial Sequence
  chemically synthesized
tctgcatataggccagatgtct

SEQ ID NO: 850784 - DNA, 22 bp, Artificial Sequence
  chemically synthesized
gttgtctgcatataggccagat

SEQ ID NO: 850785 - DNA, 22 bp, Artificial Sequence
  chemically synthesized
ttctagacatctggcctatatg

SEQ ID NO: 850786 - DNA, 22 bp, Artificial Sequence
  chemically synthesized
cctggttgtctgcatataggcc

SEQ ID NO: 850787 - DNA, 22 bp, Artificial Sequence
  chemically synthesized
tagacatctggcctatatgcag

SEQ ID NO: 850788 - DNA, 22 bp, Artificial Sequence
  chemically synthesized
gacatctggcctatatgcagac

SEQ ID NO: 850789 - DNA, 22 bp, Artificial Sequence
  chemically synthesized
tgctgcctggttgtctgcatat

SEQ ID NO: 850790 - DNA, 22 bp, Artificial Sequence
  chemically synthesized
gtgctgcctggttgtctgcata

SEQ ID NO: 850791 - DNA, 22 bp, Artificial Sequence
  chemically synthesized
agtttgtgctgcctggttgtct

SEQ ID NO: 850792 - DNA, 22 bp, Artificial Sequence
  chemically synthesized
gagtttgtgctgcctggttgtc

SEQ ID NO: 850793 - DNA, 22 bp, Artificial Sequence
  chemically synthesized
gcctatatgcagacaaccaggc

SEQ ID NO: 850794 - DNA, 22 bp, Artificial Sequence
  chemically synthesized
ttgagtttgtgctgcctggttg

SEQ ID NO: 850795 - DNA, 22 bp, Artificial Sequence
  chemically synthesized
tatgcagacaaccaggcagcac

SEQ ID NO: 850796 - DNA, 22 bp, Artificial Sequence
  chemically synthesized
caagcggactcttgagtttgtg

SEQ ID NO: 850797 - DNA, 22 bp, Artificial Sequence
  chemically synthesized
aaaagcaattacaagcggactc

SEQ ID NO: 850798 - DNA, 22 bp, Artificial Sequence
  chemically synthesized
aattcaaaagcaattacaagcg

SEQ ID NO: 850799 - DNA, 22 bp, Artificial Sequence
  chemically synthesized
tgaattcaaaagcaattacaag

SEQ ID NO: 850800 - DNA, 22 bp, Artificial Sequence
  chemically synthesized
tctgaattcaaaagcaattaca

SEQ ID NO: 850801 - DNA, 22 bp, Artificial Sequence
  chemically synthesized
aagagtccgcttgtaattgctt

SEQ ID NO: 850802 - DNA, 22 bp, Artificial Sequence
  chemically synthesized
ctctgaattcaaaagcaattac

SEQ ID NO: 850803 - DNA, 22 bp, Artificial Sequence
  chemically synthesized
tctctgaattcaaaagcaatta

SEQ ID NO: 850804 - DNA, 22 bp, Artificial Sequence
  chemically synthesized
attttctctgaattcaaaagca

SEQ ID NO: 850805 - DNA, 22 bp, Artificial Sequence
  chemically synthesized
ccattaattttctctgaattca

SEQ ID NO: 850806 - DNA, 22 bp, Artificial Sequence
  chemically synthesized
gtaattgcttttgaattcagag

SEQ ID NO: 850807 - DNA, 22 bp, Artificial Sequence
  chemically synthesized
accattaattttctctgaattc

SEQ ID NO: 850808 - DNA, 22 bp, Artificial Sequence
  chemically synthesized
taattgcttttgaattcagaga

SEQ ID NO: 850809 - DNA, 22 bp, Artificial Sequence
  chemically synthesized
cttttgaattcagagaaaatta

SEQ ID NO: 850810 - DNA, 22 bp, Artificial Sequence
  chemically synthesized
ttgaattcagagaaaattaatg

SEQ ID NO: 850811 - DNA, 22 bp, Artificial Sequence
  chemically synthesized
tgaattcagagaaaattaatgg

SEQ ID NO: 850812 - DNA, 22 bp, Artificial Sequence
  chemically synthesized
gaattcagagaaaattaatggt

SEQ ID NO: 850813 - DNA, 22 bp, Artificial Sequence
  chemically synthesized
aattcagagaaaattaatggta

SEQ ID NO: 850814 - DNA, 22 bp, Artificial Sequence
  chemically synthesized
taaaccaaccaacttaccatta

SEQ ID NO: 850815 - DNA, 22 bp, Artificial Sequence
  chemically synthesized
agagaaaattaatggtaagttg

SEQ ID NO: 850816 - DNA, 22 bp, Artificial Sequence
  chemically synthesized
tgtgttgtaaaccaaccaactt

SEQ ID NO: 850817 - DNA, 22 bp, Artificial Sequence
  chemically synthesized
atggtaagttggttggtttaca

SEQ ID NO: 850818 - DNA, 22 bp, Artificial Sequence
  chemically synthesized
caaataagagaattgtgtgttg

SEQ ID NO: 850819 - DNA, 22 bp, Artificial Sequence
  chemically synthesized
gcaaataagagaattgtgtgtt

SEQ ID NO: 850820 - DNA, 22 bp, Artificial Sequence
  chemically synthesized
tgcaaataagagaattgtgtgt

SEQ ID NO: 850821 - DNA, 22 bp, Artificial Sequence
  chemically synthesized
gttggtttacaacacacaattc

SEQ ID NO: 850822 - DNA, 22 bp, Artificial Sequence
  chemically synthesized
ctttgcaaataagagaattgtg

SEQ ID NO: 850823 - DNA, 22 bp, Artificial Sequence
  chemically synthesized
gctttgcaaataagagaattgt

SEQ ID NO: 850824 - DNA, 22 bp, Artificial Sequence
  chemically synthesized
gtttacaacacacaattctctt

SEQ ID NO: 850825 - DNA, 22 bp, Artificial Sequence
  chemically synthesized
tgctttgcaaataagagaattg

SEQ ID NO: 850826 - DNA, 22 bp, Artificial Sequence
  chemically synthesized
acaacacacaattctcttattt

SEQ ID NO: 850827 - DNA, 22 bp, Artificial Sequence
  chemically synthesized
caacacacaattctcttatttg

SEQ ID NO: 850828 - DNA, 22 bp, Artificial Sequence
  chemically synthesized
agttttgctttgcaaataagag

SEQ ID NO: 850829 - DNA, 22 bp, Artificial Sequence
  chemically synthesized
cagttttgctttgcaaataaga

SEQ ID NO: 850830 - DNA, 22 bp, Artificial Sequence
  chemically synthesized
tcagttttgctttgcaaataag

SEQ ID NO: 850831 - DNA, 22 bp, Artificial Sequence
  chemically synthesized
ttcagttttgctttgcaaataa

SEQ ID NO: 850832 - DNA, 22 bp, Artificial Sequence
  chemically synthesized
tatttttcagttttgctttgca

SEQ ID NO: 850833 - DNA, 22 bp, Artificial Sequence
  chemically synthesized
tctgtatttttcagttttgctt

SEQ ID NO: 850834 - DNA, 22 bp, Artificial Sequence
  chemically synthesized
tcttatttgcaaagcaaaactg

SEQ ID NO: 850835 - DNA, 22 bp, Artificial Sequence
  chemically synthesized
ttatttgcaaagcaaaactgaa

SEQ ID NO: 850836 - DNA, 22 bp, Artificial Sequence
  chemically synthesized
tctatctgtatttttcagtttt

SEQ ID NO: 850837 - DNA, 22 bp, Artificial Sequence
  chemically synthesized
atttgcaaagcaaaactgaaaa

SEQ ID NO: 850838 - DNA, 22 bp, Artificial Sequence
  chemically synthesized
tttgcaaagcaaaactgaaaaa

SEQ ID NO: 850839 - DNA, 22 bp, Artificial Sequence
  chemically synthesized
gctatctatctgtatttttcag

SEQ ID NO: 850840 - DNA, 22 bp, Artificial Sequence
  chemically synthesized
gcaaagcaaaactgaaaaatac

SEQ ID NO: 850841 - DNA, 22 bp, Artificial Sequence
  chemically synthesized
caaagcaaaactgaaaaataca

SEQ ID NO: 850842 - DNA, 22 bp, Artificial Sequence
  chemically synthesized
cctggctatctatctgtatttt

SEQ ID NO: 850843 - DNA, 22 bp, Artificial Sequence
  chemically synthesized
cctgcctggctatctatctgta

SEQ ID NO: 850844 - DNA, 22 bp, Artificial Sequence
  chemically synthesized
ccctgcctggctatctatctgt

SEQ ID NO: 850845 - DNA, 22 bp, Artificial Sequence
  chemically synthesized
tccctgcctggctatctatctg

SEQ ID NO: 850846 - DNA, 22 bp, Artificial Sequence
  chemically synthesized
ttccctgcctggctatctatct

SEQ ID NO: 850847 - DNA, 22 bp, Artificial Sequence
  chemically synthesized
tttccctgcctggctatctatc

SEQ ID NO: 850848 - DNA, 22 bp, Artificial Sequence
  chemically synthesized
tttttccctgcctggctatcta

SEQ ID NO: 850849 - DNA, 22 bp, Artificial Sequence
  chemically synthesized
aaaaatacagatagatagccag

SEQ ID NO: 850850 - DNA, 22 bp, Artificial Sequence
  chemically synthesized
tctttttccctgcctggctatc

SEQ ID NO: 850851 - DNA, 22 bp, Artificial Sequence
  chemically synthesized
tctctttttccctgcctggcta

SEQ ID NO: 850852 - DNA, 22 bp, Artificial Sequence
  chemically synthesized
tctctctttttccctgcctggc

SEQ ID NO: 850853 - DNA, 22 bp, Artificial Sequence
  chemically synthesized
tctctctctctttttccctgcc

SEQ ID NO: 850854 - DNA, 22 bp, Artificial Sequence
  chemically synthesized
atgagtcagtctgtctctctct

SEQ ID NO: 850855 - DNA, 22 bp, Artificial Sequence
  chemically synthesized
aatgagtcagtctgtctctctc

SEQ ID NO: 850856 - DNA, 22 bp, Artificial Sequence
  chemically synthesized
taatgagtcagtctgtctctct

SEQ ID NO: 850857 - DNA, 22 bp, Artificial Sequence
  chemically synthesized
ttaatgagtcagtctgtctctc

SEQ ID NO: 850858 - DNA, 22 bp, Artificial Sequence
  chemically synthesized
ttttaatgagtcagtctgtctc

SEQ ID NO: 850859 - DNA, 22 bp, Artificial Sequence
  chemically synthesized
tcttttaatgagtcagtctgtc

SEQ ID NO: 850860 - DNA, 22 bp, Artificial Sequence
  chemically synthesized
tctcttttaatgagtcagtctg

SEQ ID NO: 850861 - DNA, 22 bp, Artificial Sequence
  chemically synthesized
tctctcttttaatgagtcagtc

SEQ ID NO: 850862 - DNA, 22 bp, Artificial Sequence
  chemically synthesized
tctctctcttttaatgagtcag

SEQ ID NO: 850863 - DNA, 22 bp, Artificial Sequence
  chemically synthesized
tctctctctcttttaatgagtc

SEQ ID NO: 850864 - DNA, 22 bp, Artificial Sequence
  chemically synthesized
actcattaaaagagagagagag

SEQ ID NO: 850865 - DNA, 22 bp, Artificial Sequence
  chemically synthesized
attaaaagagagagagagagac

SEQ ID NO: 850866 - DNA, 22 bp, Artificial Sequence
  chemically synthesized
taaatcagagtcagtgtctctc

SEQ ID NO: 850867 - DNA, 22 bp, Artificial Sequence
  chemically synthesized
aaagagagagagagagacactg

SEQ ID NO: 850868 - DNA, 22 bp, Artificial Sequence
  chemically synthesized
actctgatttataggatacttg

SEQ ID NO: 850869 - DNA, 22 bp, Artificial Sequence
  chemically synthesized
acaggaatagataagcaagtat

SEQ ID NO: 850870 - DNA, 22 bp, Artificial Sequence
  chemically synthesized
tgatttataggatacttgctta

SEQ ID NO: 850871 - DNA, 22 bp, Artificial Sequence
  chemically synthesized
taacaggaatagataagcaagt

SEQ ID NO: 850872 - DNA, 22 bp, Artificial Sequence
  chemically synthesized
atttataggatacttgcttatc

SEQ ID NO: 850873 - DNA, 22 bp, Artificial Sequence
  chemically synthesized
ataggatacttgcttatctatt

SEQ ID NO: 850874 - DNA, 22 bp, Artificial Sequence
  chemically synthesized
taggatacttgcttatctattc

SEQ ID NO: 850875 - DNA, 22 bp, Artificial Sequence
  chemically synthesized
gcttatctattcctgttagaat

SEQ ID NO: 850876 - DNA, 22 bp, Artificial Sequence
  chemically synthesized
cttatctattcctgttagaatt

SEQ ID NO: 850877 - DNA, 22 bp, Artificial Sequence
  chemically synthesized
atctattcctgttagaattttc

SEQ ID NO: 850878 - DNA, 22 bp, Artificial Sequence
  chemically synthesized
tctattcctgttagaattttct

SEQ ID NO: 850879 - DNA, 22 bp, Artificial Sequence
  chemically synthesized
tgtgaagtggcaagcagaaaat

SEQ ID NO: 850880 - DNA, 22 bp, Artificial Sequence
  chemically synthesized
ttcctgttagaattttctgctt

SEQ ID NO: 850881 - DNA, 22 bp, Artificial Sequence
  chemically synthesized
ctgttagaattttctgcttgcc

SEQ ID NO: 850882 - DNA, 22 bp, Artificial Sequence
  chemically synthesized
atactatgtgaagtggcaagca

SEQ ID NO: 850883 - DNA, 22 bp, Artificial Sequence
  chemically synthesized
ttagaattttctgcttgccact

SEQ ID NO: 850884 - DNA, 22 bp, Artificial Sequence
  chemically synthesized
ttgatactatgtgaagtggcaa

SEQ ID NO: 850885 - DNA, 22 bp, Artificial Sequence
  chemically synthesized
gaattttctgcttgccacttca

SEQ ID NO: 850886 - DNA, 22 bp, Artificial Sequence
  chemically synthesized
gttgatactatgtgaagtggca

SEQ ID NO: 850887 - DNA, 22 bp, Artificial Sequence
  chemically synthesized
tgttgatactatgtgaagtggc

SEQ ID NO: 850888 - DNA, 22 bp, Artificial Sequence
  chemically synthesized
gttttgttgatactatgtgaag

SEQ ID NO: 850889 - DNA, 22 bp, Artificial Sequence
  chemically synthesized
tctgcttgccacttcacatagt

SEQ ID NO: 850890 - DNA, 22 bp, Artificial Sequence
  chemically synthesized
ctgcttgccacttcacatagta

SEQ ID NO: 850891 - DNA, 22 bp, Artificial Sequence
  chemically synthesized
tgcttgccacttcacatagtat

SEQ ID NO: 850892 - DNA, 22 bp, Artificial Sequence
  chemically synthesized
cttgccacttcacatagtatca

SEQ ID NO: 850893 - DNA, 22 bp, Artificial Sequence
  chemically synthesized
gccacttcacatagtatcaaca

SEQ ID NO: 850894 - DNA, 22 bp, Artificial Sequence
  chemically synthesized
ccacttcacatagtatcaacaa

SEQ ID NO: 850895 - DNA, 22 bp, Artificial Sequence
  chemically synthesized
ggggtaatacattcgttttgtt

SEQ ID NO: 850896 - DNA, 22 bp, Artificial Sequence
  chemically synthesized
cacatagtatcaacaaaacgaa

SEQ ID NO: 850897 - DNA, 22 bp, Artificial Sequence
  chemically synthesized
gggggtaatacattcgttttgt

SEQ ID NO: 850898 - DNA, 22 bp, Artificial Sequence
  chemically synthesized
acatagtatcaacaaaacgaat

SEQ ID NO: 850899 - DNA, 22 bp, Artificial Sequence
  chemically synthesized
taatttgggggtaatacattcg

SEQ ID NO: 850900 - DNA, 22 bp, Artificial Sequence
  chemically synthesized
atagtctgtaatttgggggtaa

SEQ ID NO: 850901 - DNA, 22 bp, Artificial Sequence
  chemically synthesized
aatagtctgtaatttgggggta

SEQ ID NO: 850902 - DNA, 22 bp, Artificial Sequence
  chemically synthesized
tttaatagtctgtaatttgggg

SEQ ID NO: 850903 - DNA, 22 bp, Artificial Sequence
  chemically synthesized
atttaatagtctgtaatttggg

SEQ ID NO: 850904 - DNA, 22 bp, Artificial Sequence
  chemically synthesized
tatttaatagtctgtaatttgg

SEQ ID NO: 850905 - DNA, 22 bp, Artificial Sequence
  chemically synthesized
tctttatttaatagtctgtaat

SEQ ID NO: 850906 - DNA, 22 bp, Artificial Sequence
  chemically synthesized
atctttatttaatagtctgtaa

SEQ ID NO: 850907 - DNA, 22 bp, Artificial Sequence
  chemically synthesized
tatctttatttaatagtctgta

SEQ ID NO: 850908 - DNA, 22 bp, Artificial Sequence
  chemically synthesized
ttatctttatttaatagtctgt

SEQ ID NO: 850909 - DNA, 22 bp, Artificial Sequence
  chemically synthesized
cccccaaattacagactattaa

SEQ ID NO: 850910 - DNA, 22 bp, Artificial Sequence
  chemically synthesized
gtttttatctttatttaatagt

SEQ ID NO: 850911 - DNA, 22 bp, Artificial Sequence
  chemically synthesized
agtttttatctttatttaatag

SEQ ID NO: 850912 - DNA, 22 bp, Artificial Sequence
  chemically synthesized
cagactattaaataaagataaa

SEQ ID NO: 850913 - DNA, 22 bp, Artificial Sequence
  chemically synthesized
atgaaaatcatcttagttttta

SEQ ID NO: 850914 - DNA, 22 bp, Artificial Sequence
  chemically synthesized
ttaaataaagataaaaactaag

SEQ ID NO: 850915 - DNA, 22 bp, Artificial Sequence
  chemically synthesized
tcatgaaaatcatcttagtttt

SEQ ID NO: 850916 - DNA, 22 bp, Artificial Sequence
  chemically synthesized
ctcatgaaaatcatcttagttt

SEQ ID NO: 850917 - DNA, 22 bp, Artificial Sequence
  chemically synthesized
aataaagataaaaactaagatg

SEQ ID NO: 850918 - DNA, 22 bp, Artificial Sequence
  chemically synthesized
cttctcatgaaaatcatcttag

SEQ ID NO: 850919 - DNA, 22 bp, Artificial Sequence
  chemically synthesized
acttctcatgaaaatcatctta

SEQ ID NO: 850920 - DNA, 22 bp, Artificial Sequence
  chemically synthesized
tttacttctcatgaaaatcatc

SEQ ID NO: 850921 - DNA, 22 bp, Artificial Sequence
  chemically synthesized
ttgtttacttctcatgaaaatc

SEQ ID NO: 850922 - DNA, 22 bp, Artificial Sequence
  chemically synthesized
attgtttacttctcatgaaaat

SEQ ID NO: 850923 - DNA, 22 bp, Artificial Sequence
  chemically synthesized
agatgattttcatgagaagtaa

SEQ ID NO: 850924 - DNA, 22 bp, Artificial Sequence
  chemically synthesized
tgtaaaaagcttattgtttact

SEQ ID NO: 850925 - DNA, 22 bp, Artificial Sequence
  chemically synthesized
tcatgagaagtaaacaataagc

SEQ ID NO: 850926 - DNA, 22 bp, Artificial Sequence
  chemically synthesized
catgagaagtaaacaataagct

SEQ ID NO: 850927 - DNA, 22 bp, Artificial Sequence
  chemically synthesized
tgctgtgtaaaaagcttattgt

SEQ ID NO: 850928 - DNA, 22 bp, Artificial Sequence
  chemically synthesized
atgagaagtaaacaataagctt

SEQ ID NO: 850929 - DNA, 22 bp, Artificial Sequence
  chemically synthesized
gtgctgtgtaaaaagcttattg

SEQ ID NO: 850930 - DNA, 22 bp, Artificial Sequence
  chemically synthesized
agtttgtgctgtgtaaaaagct

SEQ ID NO: 850931 - DNA, 22 bp, Artificial Sequence
  chemically synthesized
tgtaatgaaatcctcagtttgt

SEQ ID NO: 850932 - DNA, 22 bp, Artificial Sequence
  chemically synthesized
gtgtaatgaaatcctcagtttg

SEQ ID NO: 850933 - DNA, 22 bp, Artificial Sequence
  chemically synthesized
tttacacagcacaaactgagga

SEQ ID NO: 850934 - DNA, 22 bp, Artificial Sequence
  chemically synthesized
tgtgtaatgaaatcctcagttt

SEQ ID NO: 850935 - DNA, 22 bp, Artificial Sequence
  chemically synthesized
ttacacagcacaaactgaggat

SEQ ID NO: 850936 - DNA, 22 bp, Artificial Sequence
  chemically synthesized
tacacagcacaaactgaggatt

SEQ ID NO: 850937 - DNA, 22 bp, Artificial Sequence
  chemically synthesized
acacagcacaaactgaggattt

SEQ ID NO: 850938 - DNA, 22 bp, Artificial Sequence
  chemically synthesized
cacagcacaaactgaggatttc

SEQ ID NO: 850939 - DNA, 22 bp, Artificial Sequence
  chemically synthesized
ccataactttgtgtaatgaaat

SEQ ID NO: 850940 - DNA, 22 bp, Artificial Sequence
  chemically synthesized
cccataactttgtgtaatgaaa

SEQ ID NO: 850941 - DNA, 22 bp, Artificial Sequence
  chemically synthesized
tcccataactttgtgtaatgaa

SEQ ID NO: 850942 - DNA, 22 bp, Artificial Sequence
  chemically synthesized
ttcccataactttgtgtaatga

SEQ ID NO: 850943 - DNA, 22 bp, Artificial Sequence
  chemically synthesized
aggatttcattacacaaagtta

SEQ ID NO: 850944 - DNA, 22 bp, Artificial Sequence
  chemically synthesized
cattacacaaagttatgggaaa

SEQ ID NO: 850945 - DNA, 22 bp, Artificial Sequence
  chemically synthesized
attacacaaagttatgggaaaa

SEQ ID NO: 850946 - DNA, 22 bp, Artificial Sequence
  chemically synthesized
cacaaagttatgggaaaagcta

SEQ ID NO: 850947 - DNA, 22 bp, Artificial Sequence
  chemically synthesized
tgggaaaagctacatattgata

SEQ ID NO: 850948 - DNA, 22 bp, Artificial Sequence
  chemically synthesized
acaataacaaagatatcaatat

SEQ ID NO: 850949 - DNA, 22 bp, Artificial Sequence
  chemically synthesized
agatattcacaataacaaagat

SEQ ID NO: 850950 - DNA, 22 bp, Artificial Sequence
  chemically synthesized
catattgatatctttgttattg

SEQ ID NO: 850951 - DNA, 22 bp, Artificial Sequence
  chemically synthesized
atatctttgttattgtgaatat

SEQ ID NO: 850952 - DNA, 22 bp, Artificial Sequence
  chemically synthesized
acaataactgagatattcacaa

SEQ ID NO: 850953 - DNA, 22 bp, Artificial Sequence
  chemically synthesized
tgttattgtgaatatctcagtt

SEQ ID NO: 850954 - DNA, 22 bp, Artificial Sequence
  chemically synthesized
cagattcacaataactgagata

SEQ ID NO: 850955 - DNA, 22 bp, Artificial Sequence
  chemically synthesized
gttattgtgaatatctcagtta

SEQ ID NO: 850956 - DNA, 22 bp, Artificial Sequence
  chemically synthesized
acagattcacaataactgagat

SEQ ID NO: 850957 - DNA, 22 bp, Artificial Sequence
  chemically synthesized
ttattgtgaatatctcagttat

SEQ ID NO: 850958 - DNA, 22 bp, Artificial Sequence
  chemically synthesized
ttgtgaatatctcagttattgt

SEQ ID NO: 850959 - DNA, 22 bp, Artificial Sequence
  chemically synthesized
tgaatatctcagttattgtgaa

SEQ ID NO: 850960 - DNA, 22 bp, Artificial Sequence
  chemically synthesized
agttattgtgaatctgtaaatt

SEQ ID NO: 850961 - DNA, 22 bp, Artificial Sequence
  chemically synthesized
ttgtgaatctgtaaattccatg

SEQ ID NO: 850962 - DNA, 22 bp, Artificial Sequence
  chemically synthesized
tgaatctgtaaattccatgccc

SEQ ID NO: 850963 - DNA, 22 bp, Artificial Sequence
  chemically synthesized
tatgggggtaatagggcatgga

SEQ ID NO: 850964 - DNA, 22 bp, Artificial Sequence
  chemically synthesized
gtatgggggtaatagggcatgg

SEQ ID NO: 850965 - DNA, 22 bp, Artificial Sequence
  chemically synthesized
gcttgtatgggggtaatagggc

SEQ ID NO: 850966 - DNA, 22 bp, Artificial Sequence
  chemically synthesized
taaattccatgccctattaccc

SEQ ID NO: 850967 - DNA, 22 bp, Artificial Sequence
  chemically synthesized
cctggcttgtatgggggtaata

SEQ ID NO: 850968 - DNA, 22 bp, Artificial Sequence
  chemically synthesized
catgccctattacccccataca

SEQ ID NO: 850969 - DNA, 22 bp, Artificial Sequence
  chemically synthesized
ttacccccatacaagccaggga

SEQ ID NO: 850970 - DNA, 22 bp, Artificial Sequence
  chemically synthesized
tacgagtacatctccctggctt

SEQ ID NO: 850971 - DNA, 22 bp, Artificial Sequence
  chemically synthesized
cccccatacaagccagggagat

SEQ ID NO: 850972 - DNA, 22 bp, Artificial Sequence
  chemically synthesized
ttatacgagtacatctccctgg

SEQ ID NO: 850973 - DNA, 22 bp, Artificial Sequence
  chemically synthesized
aatcatgagtgaaatgctatta

SEQ ID NO: 850974 - DNA, 22 bp, Artificial Sequence
  chemically synthesized
gtataatagcatttcactcatg

SEQ ID NO: 850975 - DNA, 22 bp, Artificial Sequence
  chemically synthesized
gtgtcaattcaatcatgagtga

SEQ ID NO: 850976 - DNA, 22 bp, Artificial Sequence
  chemically synthesized
ggtgtcaattcaatcatgagtg

SEQ ID NO: 850977 - DNA, 22 bp, Artificial Sequence
  chemically synthesized
cactcatgattgaattgacacc

SEQ ID NO: 850978 - DNA, 22 bp, Artificial Sequence
  chemically synthesized
actcatgattgaattgacacca

SEQ ID NO: 850979 - DNA, 22 bp, Artificial Sequence
  chemically synthesized
atgattgaattgacaccaaatg

SEQ ID NO: 850980 - DNA, 22 bp, Artificial Sequence
  chemically synthesized
caaagaggcaaccatttggtgt

SEQ ID NO: 850981 - DNA, 22 bp, Artificial Sequence
  chemically synthesized
aattgacaccaaatggttgcct

SEQ ID NO: 850982 - DNA, 22 bp, Artificial Sequence
  chemically synthesized
tatatattgcaaagaggcaacc

SEQ ID NO: 850983 - DNA, 22 bp, Artificial Sequence
  chemically synthesized
gtatatattgcaaagaggcaac

SEQ ID NO: 850984 - DNA, 22 bp, Artificial Sequence
  chemically synthesized
tgtatatattgcaaagaggcaa

SEQ ID NO: 850985 - DNA, 22 bp, Artificial Sequence
  chemically synthesized
acaccaaatggttgcctctttg

SEQ ID NO: 850986 - DNA, 22 bp, Artificial Sequence
  chemically synthesized
tttgtatatattgcaaagaggc

SEQ ID NO: 850987 - DNA, 22 bp, Artificial Sequence
  chemically synthesized
ctttgtatatattgcaaagagg

SEQ ID NO: 850988 - DNA, 22 bp, Artificial Sequence
  chemically synthesized
aaaatttctttgtatatattgc

SEQ ID NO: 850989 - DNA, 22 bp, Artificial Sequence
  chemically synthesized
cctctttgcaatatatacaaag

SEQ ID NO: 850990 - DNA, 22 bp, Artificial Sequence
  chemically synthesized
tttgcaatatatacaaagaaat

SEQ ID NO: 850991 - DNA, 22 bp, Artificial Sequence
  chemically synthesized
tgcaatatatacaaagaaattt

SEQ ID NO: 850992 - DNA, 22 bp, Artificial Sequence
  chemically synthesized
gcaatatatacaaagaaatttt

SEQ ID NO: 850993 - DNA, 22 bp, Artificial Sequence
  chemically synthesized
caatatatacaaagaaattttt

SEQ ID NO: 850994 - DNA, 22 bp, Artificial Sequence
  chemically synthesized
caaaacaaaacacaaagcccac

SEQ ID NO: 850995 - DNA, 22 bp, Artificial Sequence
  chemically synthesized
actacaaaacaaaacacaaagc

SEQ ID NO: 850996 - DNA, 22 bp, Artificial Sequence
  chemically synthesized
ttagttgtgggctttgtgtttt

SEQ ID NO: 850997 - DNA, 22 bp, Artificial Sequence
  chemically synthesized
tagttgtgggctttgtgttttg

SEQ ID NO: 850998 - DNA, 22 bp, Artificial Sequence
  chemically synthesized
agttgtgggctttgtgttttgt

SEQ ID NO: 850999 - DNA, 22 bp, Artificial Sequence
  chemically synthesized
gttgtgggctttgtgttttgtt

SEQ ID NO: 851000 - DNA, 22 bp, Artificial Sequence
  chemically synthesized
gcggtctaactacaaaacaaaa

SEQ ID NO: 851001 - DNA, 22 bp, Artificial Sequence
  chemically synthesized
tgggctttgtgttttgttttgt

SEQ ID NO: 851002 - DNA, 22 bp, Artificial Sequence
  chemically synthesized
agcggtctaactacaaaacaaa

SEQ ID NO: 851003 - DNA, 22 bp, Artificial Sequence
  chemically synthesized
tagcggtctaactacaaaacaa

SEQ ID NO: 851004 - DNA, 22 bp, Artificial Sequence
  chemically synthesized
ttagcggtctaactacaaaaca

SEQ ID NO: 851005 - DNA, 22 bp, Artificial Sequence
  chemically synthesized
tttttagcggtctaactacaaa

SEQ ID NO: 851006 - DNA, 22 bp, Artificial Sequence
  chemically synthesized
tgtgttttgttttgtagttaga

SEQ ID NO: 851007 - DNA, 22 bp, Artificial Sequence
  chemically synthesized
gtgttttgttttgtagttagac

SEQ ID NO: 851008 - DNA, 22 bp, Artificial Sequence
  chemically synthesized
tgttttgttttgtagttagacc

SEQ ID NO: 851009 - DNA, 22 bp, Artificial Sequence
  chemically synthesized
attatttttagcggtctaacta

SEQ ID NO: 851010 - DNA, 22 bp, Artificial Sequence
  chemically synthesized
gattatttttagcggtctaact

SEQ ID NO: 851011 - DNA, 22 bp, Artificial Sequence
  chemically synthesized
tgttttgtagttagaccgctaa

SEQ ID NO: 851012 - DNA, 22 bp, Artificial Sequence
  chemically synthesized
gttttgtagttagaccgctaaa

SEQ ID NO: 851013 - DNA, 22 bp, Artificial Sequence
  chemically synthesized
ttttgtagttagaccgctaaaa

SEQ ID NO: 851014 - DNA, 22 bp, Artificial Sequence
  chemically synthesized
tgtagttagaccgctaaaaata

SEQ ID NO: 851015 - DNA, 22 bp, Artificial Sequence
  chemically synthesized
gtagttagaccgctaaaaataa

SEQ ID NO: 851016 - DNA, 22 bp, Artificial Sequence
  chemically synthesized
tagttagaccgctaaaaataat

SEQ ID NO: 851017 - DNA, 22 bp, Artificial Sequence
  chemically synthesized
tatcagacatttgattattttt

SEQ ID NO: 851018 - DNA, 22 bp, Artificial Sequence
  chemically synthesized
actatatcagacatttgattat

SEQ ID NO: 851019 - DNA, 22 bp, Artificial Sequence
  chemically synthesized
gaccgctaaaaataatcaaatg

SEQ ID NO: 851020 - DNA, 22 bp, Artificial Sequence
  chemically synthesized
aactatatcagacatttgatta

SEQ ID NO: 851021 - DNA, 22 bp, Artificial Sequence
  chemically synthesized
tggcttaactatatcagacatt

SEQ ID NO: 851022 - DNA, 22 bp, Artificial Sequence
  chemically synthesized
atggcttaactatatcagacat

SEQ ID NO: 851023 - DNA, 22 bp, Artificial Sequence
  chemically synthesized
aaaataatcaaatgtctgatat

SEQ ID NO: 851024 - DNA, 22 bp, Artificial Sequence
  chemically synthesized
tatggcttaactatatcagaca

SEQ ID NO: 851025 - DNA, 22 bp, Artificial Sequence
  chemically synthesized
atctttatggcttaactatatc

SEQ ID NO: 851026 - DNA, 22 bp, Artificial Sequence
  chemically synthesized
catctttatggcttaactatat

SEQ ID NO: 851027 - DNA, 22 bp, Artificial Sequence
  chemically synthesized
tcatctttatggcttaactata

SEQ ID NO: 851028 - DNA, 22 bp, Artificial Sequence
  chemically synthesized
tttcatctttatggcttaacta

SEQ ID NO: 851029 - DNA, 22 bp, Artificial Sequence
  chemically synthesized
ctttcatctttatggcttaact

SEQ ID NO: 851030 - DNA, 22 bp, Artificial Sequence
  chemically synthesized
atatagttaagccataaagatg

SEQ ID NO: 851031 - DNA, 22 bp, Artificial Sequence
  chemically synthesized
agtgagacacttctttcatctt

SEQ ID NO: 851032 - DNA, 22 bp, Artificial Sequence
  chemically synthesized
aagtgagacacttctttcatct

SEQ ID NO: 851033 - DNA, 22 bp, Artificial Sequence
  chemically synthesized
taagtgagacacttctttcatc

SEQ ID NO: 851034 - DNA, 22 bp, Artificial Sequence
  chemically synthesized
agccataaagatgaaagaagtg

SEQ ID NO: 851035 - DNA, 22 bp, Artificial Sequence
  chemically synthesized
ataaatattttaagtgagacac

SEQ ID NO: 851036 - DNA, 22 bp, Artificial Sequence
  chemically synthesized
acttaaaatatttattaattac

SEQ ID NO: 851037 - DNA, 22 bp, Artificial Sequence
  chemically synthesized
aaaatatttattaattacatat

SEQ ID NO: 851038 - DNA, 22 bp, Artificial Sequence
  chemically synthesized
aaatatttattaattacatatg

SEQ ID NO: 851039 - DNA, 22 bp, Artificial Sequence
  chemically synthesized
tagatataaaaacatatgtaat

SEQ ID NO: 851040 - DNA, 22 bp, Artificial Sequence
  chemically synthesized
attaattacatatgtttttata

SEQ ID NO: 851041 - DNA, 22 bp, Artificial Sequence
  chemically synthesized
ttaattacatatgtttttatat

SEQ ID NO: 851042 - DNA, 22 bp, Artificial Sequence
  chemically synthesized
attacatatgtttttatatcta

SEQ ID NO: 851043 - DNA, 22 bp, Artificial Sequence
  chemically synthesized
catatgtttttatatctataat

SEQ ID NO: 851044 - DNA, 22 bp, Artificial Sequence
  chemically synthesized
cacatcagaatataagtatatt

SEQ ID NO: 851045 - DNA, 22 bp, Artificial Sequence
  chemically synthesized
ttatatctataatatacttata

SEQ ID NO: 851046 - DNA, 22 bp, Artificial Sequence
  chemically synthesized
tatatctataatatacttatat

SEQ ID NO: 851047 - DNA, 22 bp, Artificial Sequence
  chemically synthesized
ctgcacatcagaatataagtat

SEQ ID NO: 851048 - DNA, 22 bp, Artificial Sequence
  chemically synthesized
atatctataatatacttatatt

SEQ ID NO: 851049 - DNA, 22 bp, Artificial Sequence
  chemically synthesized
tatctataatatacttatattc

SEQ ID NO: 851050 - DNA, 22 bp, Artificial Sequence
  chemically synthesized
agttcctgcacatcagaatata

SEQ ID NO: 851051 - DNA, 22 bp, Artificial Sequence
  chemically synthesized
taatatacttatattctgatgt

SEQ ID NO: 851052 - DNA, 22 bp, Artificial Sequence
  chemically synthesized
agtaactgagttcctgcacatc

SEQ ID NO: 851053 - DNA, 22 bp, Artificial Sequence
  chemically synthesized
aagtaactgagttcctgcacat

SEQ ID NO: 851054 - DNA, 22 bp, Artificial Sequence
  chemically synthesized
atattctgatgtgcaggaactc

SEQ ID NO: 851055 - DNA, 22 bp, Artificial Sequence
  chemically synthesized
acttaagtaactgagttcctgc

SEQ ID NO: 851056 - DNA, 22 bp, Artificial Sequence
  chemically synthesized
tattctgatgtgcaggaactca

SEQ ID NO: 851057 - DNA, 22 bp, Artificial Sequence
  chemically synthesized
ctgacttaagtaactgagttcc

SEQ ID NO: 851058 - DNA, 22 bp, Artificial Sequence
  chemically synthesized
tgatgtgcaggaactcagttac

SEQ ID NO: 851059 - DNA, 22 bp, Artificial Sequence
  chemically synthesized
atgtgcaggaactcagttactt

SEQ ID NO: 851060 - DNA, 22 bp, Artificial Sequence
  chemically synthesized
tccccacgtgaattcctgactt

SEQ ID NO: 851061 - DNA, 22 bp, Artificial Sequence
  chemically synthesized
tatccccacgtgaattcctgac

SEQ ID NO: 851062 - DNA, 22 bp, Artificial Sequence
  chemically synthesized
agttacttaagtcaggaattca

SEQ ID NO: 851063 - DNA, 22 bp, Artificial Sequence
  chemically synthesized
actctatccccacgtgaattcc

SEQ ID NO: 851064 - DNA, 22 bp, Artificial Sequence
  chemically synthesized
taactctatccccacgtgaatt

SEQ ID NO: 851065 - DNA, 22 bp, Artificial Sequence
  chemically synthesized
cttaagtcaggaattcacgtgg

SEQ ID NO: 851066 - DNA, 22 bp, Artificial Sequence
  chemically synthesized
aagtcaggaattcacgtgggga

SEQ ID NO: 851067 - DNA, 22 bp, Artificial Sequence
  chemically synthesized
agtcaggaattcacgtggggat

SEQ ID NO: 851068 - DNA, 22 bp, Artificial Sequence
  chemically synthesized
aattctaactctatccccacgt

SEQ ID NO: 851069 - DNA, 22 bp, Artificial Sequence
  chemically synthesized
attaaattctaactctatcccc

SEQ ID NO: 851070 - DNA, 22 bp, Artificial Sequence
  chemically synthesized
tgattaaattctaactctatcc

SEQ ID NO: 851071 - DNA, 22 bp, Artificial Sequence
  chemically synthesized
ctgattaaattctaactctatc

SEQ ID NO: 851072 - DNA, 22 bp, Artificial Sequence
  chemically synthesized
tctgattaaattctaactctat

SEQ ID NO: 851073 - DNA, 22 bp, Artificial Sequence
  chemically synthesized
acgtggggatagagttagaatt

SEQ ID NO: 851074 - DNA, 22 bp, Artificial Sequence
  chemically synthesized
gcctttctgattaaattctaac

SEQ ID NO: 851075 - DNA, 22 bp, Artificial Sequence
  chemically synthesized
gaatttaatcagaaaggccagt

SEQ ID NO: 851076 - DNA, 22 bp, Artificial Sequence
  chemically synthesized
aatcagaaaggccagtctcctg

SEQ ID NO: 851077 - DNA, 22 bp, Artificial Sequence
  chemically synthesized
atcagaaaggccagtctcctgg

SEQ ID NO: 851078 - DNA, 22 bp, Artificial Sequence
  chemically synthesized
gtagaacccaccccaggagact

SEQ ID NO: 851079 - DNA, 22 bp, Artificial Sequence
  chemically synthesized
aaatgctggtagaacccacccc

SEQ ID NO: 851080 - DNA, 22 bp, Artificial Sequence
  chemically synthesized
ctggggtgggttctaccagcat

SEQ ID NO: 851081 - DNA, 22 bp, Artificial Sequence
  chemically synthesized
gggtgggttctaccagcatttg

SEQ ID NO: 851082 - DNA, 22 bp, Artificial Sequence
  chemically synthesized
tgataaaaaatagttcaaatgc

SEQ ID NO: 851083 - DNA, 22 bp, Artificial Sequence
  chemically synthesized
actgtgataaaaaatagttcaa

SEQ ID NO: 851084 - DNA, 22 bp, Artificial Sequence
  chemically synthesized
taccagcatttgaactattttt

SEQ ID NO: 851085 - DNA, 22 bp, Artificial Sequence
  chemically synthesized
ccagcatttgaactatttttta

SEQ ID NO: 851086 - DNA, 22 bp, Artificial Sequence
  chemically synthesized
gtgttgactgtgataaaaaata

SEQ ID NO: 851087 - DNA, 22 bp, Artificial Sequence
  chemically synthesized
tagtgttgactgtgataaaaaa

SEQ ID NO: 851088 - DNA, 22 bp, Artificial Sequence
  chemically synthesized
gaactattttttatcacagtca

SEQ ID NO: 851089 - DNA, 22 bp, Artificial Sequence
  chemically synthesized
aactattttttatcacagtcaa

SEQ ID NO: 851090 - DNA, 22 bp, Artificial Sequence
  chemically synthesized
gcaaggcctctagtgttgactg

SEQ ID NO: 851091 - DNA, 22 bp, Artificial Sequence
  chemically synthesized
ttttttatcacagtcaacacta

SEQ ID NO: 851092 - DNA, 22 bp, Artificial Sequence
  chemically synthesized
attagcaaggcctctagtgttg

SEQ ID NO: 851093 - DNA, 22 bp, Artificial Sequence
  chemically synthesized
tttatcacagtcaacactagag

SEQ ID NO: 851094 - DNA, 22 bp, Artificial Sequence
  chemically synthesized
ttatcacagtcaacactagagg

SEQ ID NO: 851095 - DNA, 22 bp, Artificial Sequence
  chemically synthesized
tatcacagtcaacactagaggc

SEQ ID NO: 851096 - DNA, 22 bp, Artificial Sequence
  chemically synthesized
ctcattagcaaggcctctagtg

SEQ ID NO: 851097 - DNA, 22 bp, Artificial Sequence
  chemically synthesized
atcacagtcaacactagaggcc

SEQ ID NO: 851098 - DNA, 22 bp, Artificial Sequence
  chemically synthesized
gctcattagcaaggcctctagt

SEQ ID NO: 851099 - DNA, 22 bp, Artificial Sequence
  chemically synthesized
tcacagtcaacactagaggcct

SEQ ID NO: 851100 - DNA, 22 bp, Artificial Sequence
  chemically synthesized
tgctcattagcaaggcctctag

SEQ ID NO: 851101 - DNA, 22 bp, Artificial Sequence
  chemically synthesized
attttgctcattagcaaggcct

SEQ ID NO: 851102 - DNA, 22 bp, Artificial Sequence
  chemically synthesized
atattcattttgctcattagca

SEQ ID NO: 851103 - DNA, 22 bp, Artificial Sequence
  chemically synthesized
taatattcattttgctcattag

SEQ ID NO: 851104 - DNA, 22 bp, Artificial Sequence
  chemically synthesized
ctaatattcattttgctcatta

SEQ ID NO: 851105 - DNA, 22 bp, Artificial Sequence
  chemically synthesized
gaggccttgctaatgagcaaaa

SEQ ID NO: 851106 - DNA, 22 bp, Artificial Sequence
  chemically synthesized
atttctaatattcattttgctc

SEQ ID NO: 851107 - DNA, 22 bp, Artificial Sequence
  chemically synthesized
gctaatgagcaaaatgaatatt

SEQ ID NO: 851108 - DNA, 22 bp, Artificial Sequence
  chemically synthesized
ctaatgagcaaaatgaatatta

SEQ ID NO: 851109 - DNA, 22 bp, Artificial Sequence
  chemically synthesized
atgagcaaaatgaatattagaa

SEQ ID NO: 851110 - DNA, 22 bp, Artificial Sequence
  chemically synthesized
ataagtgaaaactcatttctaa

SEQ ID NO: 851111 - DNA, 22 bp, Artificial Sequence
  chemically synthesized
atctcataagtgaaaactcatt

SEQ ID NO: 851112 - DNA, 22 bp, Artificial Sequence
  chemically synthesized
gaaatgagttttcacttatgag

SEQ ID NO: 851113 - DNA, 22 bp, Artificial Sequence
  chemically synthesized
agtaacactaatctcataagtg

SEQ ID NO: 851114 - DNA, 22 bp, Artificial Sequence
  chemically synthesized
aagtaacactaatctcataagt

SEQ ID NO: 851115 - DNA, 22 bp, Artificial Sequence
  chemically synthesized
tcacttatgagattagtgttac

SEQ ID NO: 851116 - DNA, 22 bp, Artificial Sequence
  chemically synthesized
cacttatgagattagtgttact

SEQ ID NO: 851117 - DNA, 22 bp, Artificial Sequence
  chemically synthesized
acttatgagattagtgttactt

SEQ ID NO: 851118 - DNA, 22 bp, Artificial Sequence
  chemically synthesized
atgagattagtgttacttaaga

SEQ ID NO: 851119 - DNA, 22 bp, Artificial Sequence
  chemically synthesized
tgagattagtgttacttaagat

SEQ ID NO: 851120 - DNA, 22 bp, Artificial Sequence
  chemically synthesized
accaaagcatgtatcttaagta

SEQ ID NO: 851121 - DNA, 22 bp, Artificial Sequence
  chemically synthesized
aaccaaagcatgtatcttaagt

SEQ ID NO: 851122 - DNA, 22 bp, Artificial Sequence
  chemically synthesized
taaccaaagcatgtatcttaag

SEQ ID NO: 851123 - DNA, 22 bp, Artificial Sequence
  chemically synthesized
gtgttacttaagatacatgctt

SEQ ID NO: 851124 - DNA, 22 bp, Artificial Sequence
  chemically synthesized
aaatattttaaccaaagcatgt

SEQ ID NO: 851125 - DNA, 22 bp, Artificial Sequence
  chemically synthesized
tcaaatattttaaccaaagcat

SEQ ID NO: 851126 - DNA, 22 bp, Artificial Sequence
  chemically synthesized
cttaagatacatgctttggtta

SEQ ID NO: 851127 - DNA, 22 bp, Artificial Sequence
  chemically synthesized
ctctcaaatattttaaccaaag

SEQ ID NO: 851128 - DNA, 22 bp, Artificial Sequence
  chemically synthesized
aagatacatgctttggttaaaa

SEQ ID NO: 851129 - DNA, 22 bp, Artificial Sequence
  chemically synthesized
agatacatgctttggttaaaat

SEQ ID NO: 851130 - DNA, 22 bp, Artificial Sequence
  chemically synthesized
gagatgaggaattgctctcaaa

SEQ ID NO: 851131 - DNA, 22 bp, Artificial Sequence
  chemically synthesized
tggttaaaatatttgagagcaa

SEQ ID NO: 851132 - DNA, 22 bp, Artificial Sequence
  chemically synthesized
ggttaaaatatttgagagcaat

SEQ ID NO: 851133 - DNA, 22 bp, Artificial Sequence
  chemically synthesized
gttaaaatatttgagagcaatt

SEQ ID NO: 851134 - DNA, 22 bp, Artificial Sequence
  chemically synthesized
aaatatttgagagcaattcctc

SEQ ID NO: 851135 - DNA, 22 bp, Artificial Sequence
  chemically synthesized
gcaagctagagatgaggaattg

SEQ ID NO: 851136 - DNA, 22 bp, Artificial Sequence
  chemically synthesized
tacctagcaagctagagatgag

SEQ ID NO: 851137 - DNA, 22 bp, Artificial Sequence
  chemically synthesized
gagagcaattcctcatctctag

SEQ ID NO: 851138 - DNA, 22 bp, Artificial Sequence
  chemically synthesized
atacctagcaagctagagatga

SEQ ID NO: 851139 - DNA, 22 bp, Artificial Sequence
  chemically synthesized
agagcaattcctcatctctagc

SEQ ID NO: 851140 - DNA, 22 bp, Artificial Sequence
  chemically synthesized
tatacctagcaagctagagatg

SEQ ID NO: 851141 - DNA, 22 bp, Artificial Sequence
  chemically synthesized
ttatacctagcaagctagagat

SEQ ID NO: 851142 - DNA, 22 bp, Artificial Sequence
  chemically synthesized
tatttttatacctagcaagcta

SEQ ID NO: 851143 - DNA, 22 bp, Artificial Sequence
  chemically synthesized
ctatatttttatacctagcaag

SEQ ID NO: 851144 - DNA, 22 bp, Artificial Sequence
  chemically synthesized
ctcatctctagcttgctaggta

SEQ ID NO: 851145 - DNA, 22 bp, Artificial Sequence
  chemically synthesized
actatatttttatacctagcaa

SEQ ID NO: 851146 - DNA, 22 bp, Artificial Sequence
  chemically synthesized
atctctagcttgctaggtataa

SEQ ID NO: 851147 - DNA, 22 bp, Artificial Sequence
  chemically synthesized
tagcttgctaggtataaaaata

SEQ ID NO: 851148 - DNA, 22 bp, Artificial Sequence
  chemically synthesized
cataacttactatatttttata

SEQ ID NO: 851149 - DNA, 22 bp, Artificial Sequence
  chemically synthesized
gcttgctaggtataaaaatata

SEQ ID NO: 851150 - DNA, 22 bp, Artificial Sequence
  chemically synthesized
gctaggtataaaaatatagtaa

SEQ ID NO: 851151 - DNA, 22 bp, Artificial Sequence
  chemically synthesized
ctaggtataaaaatatagtaag

SEQ ID NO: 851152 - DNA, 22 bp, Artificial Sequence
  chemically synthesized
ggtataaaaatatagtaagtta

SEQ ID NO: 851153 - DNA, 22 bp, Artificial Sequence
  chemically synthesized
caaagaatacaggttccataac

SEQ ID NO: 851154 - DNA, 22 bp, Artificial Sequence
  chemically synthesized
ggcaccattccaaagaatacag

SEQ ID NO: 851155 - DNA, 22 bp, Artificial Sequence
  chemically synthesized
gggcaccattccaaagaataca

SEQ ID NO: 851156 - DNA, 22 bp, Artificial Sequence
  chemically synthesized
tggaacctgtattctttggaat

SEQ ID NO: 851157 - DNA, 22 bp, Artificial Sequence
  chemically synthesized
aatcttgggcaccattccaaag

SEQ ID NO: 851158 - DNA, 22 bp, Artificial Sequence
  chemically synthesized
ggcattaaatcttgggcaccat

SEQ ID NO: 851159 - DNA, 22 bp, Artificial Sequence
  chemically synthesized
tattctttggaatggtgcccaa

SEQ ID NO: 851160 - DNA, 22 bp, Artificial Sequence
  chemically synthesized
aggcattaaatcttgggcacca

SEQ ID NO: 851161 - DNA, 22 bp, Artificial Sequence
  chemically synthesized
tttggaatggtgcccaagattt

SEQ ID NO: 851162 - DNA, 22 bp, Artificial Sequence
  chemically synthesized
tggaatggtgcccaagatttaa

SEQ ID NO: 851163 - DNA, 22 bp, Artificial Sequence
  chemically synthesized
ggaatggtgcccaagatttaat

SEQ ID NO: 851164 - DNA, 22 bp, Artificial Sequence
  chemically synthesized
gaatggtgcccaagatttaatg

SEQ ID NO: 851165 - DNA, 22 bp, Artificial Sequence
  chemically synthesized
aatgtggaaacaaagcatagtt

SEQ ID NO: 851166 - DNA, 22 bp, Artificial Sequence
  chemically synthesized
aatgcctaaactatgctttgtt

SEQ ID NO: 851167 - DNA, 22 bp, Artificial Sequence
  chemically synthesized
atgcctaaactatgctttgttt

SEQ ID NO: 851168 - DNA, 22 bp, Artificial Sequence
  chemically synthesized
ggattcaatgtggaaacaaagc

SEQ ID NO: 851169 - DNA, 22 bp, Artificial Sequence
  chemically synthesized
cggattcaatgtggaaacaaag

SEQ ID NO: 851170 - DNA, 22 bp, Artificial Sequence
  chemically synthesized
aactatgctttgtttccacatt

SEQ ID NO: 851171 - DNA, 22 bp, Artificial Sequence
  chemically synthesized
gaatcttcggattcaatgtgga

SEQ ID NO: 851172 - DNA, 22 bp, Artificial Sequence
  chemically synthesized
tgctttgtttccacattgaatc

SEQ ID NO: 851173 - DNA, 22 bp, Artificial Sequence
  chemically synthesized
tgtttccacattgaatccgaag

SEQ ID NO: 851174 - DNA, 22 bp, Artificial Sequence
  chemically synthesized
gtttccacattgaatccgaaga

SEQ ID NO: 851175 - DNA, 22 bp, Artificial Sequence
  chemically synthesized
tttccacattgaatccgaagat

SEQ ID NO: 851176 - DNA, 22 bp, Artificial Sequence
  chemically synthesized
ccacattgaatccgaagattct

SEQ ID NO: 851177 - DNA, 22 bp, Artificial Sequence
  chemically synthesized
cacattgaatccgaagattcta

SEQ ID NO: 851178 - DNA, 22 bp, Artificial Sequence
  chemically synthesized
gagaaggcatcagacaactaga

SEQ ID NO: 851179 - DNA, 22 bp, Artificial Sequence
  chemically synthesized
aatccgaagattctagttgtct

SEQ ID NO: 851180 - DNA, 22 bp, Artificial Sequence
  chemically synthesized
agagaaggcatcagacaactag

SEQ ID NO: 851181 - DNA, 22 bp, Artificial Sequence
  chemically synthesized
accttagagaaggcatcagaca

SEQ ID NO: 851182 - DNA, 22 bp, Artificial Sequence
  chemically synthesized
tagttgtctgatgccttctcta

SEQ ID NO: 851183 - DNA, 22 bp, Artificial Sequence
  chemically synthesized
gttgtctgatgccttctctaag

SEQ ID NO: 851184 - DNA, 22 bp, Artificial Sequence
  chemically synthesized
tctgatgccttctctaaggtta

SEQ ID NO: 851185 - DNA, 22 bp, Artificial Sequence
  chemically synthesized
gaggcaggatgcagttaacctt

SEQ ID NO: 851186 - DNA, 22 bp, Artificial Sequence
  chemically synthesized
atgccttctctaaggttaactg

SEQ ID NO: 851187 - DNA, 22 bp, Artificial Sequence
  chemically synthesized
ctctaaggttaactgcatcctg

SEQ ID NO: 851188 - DNA, 22 bp, Artificial Sequence
  chemically synthesized
tctaaggttaactgcatcctgc

SEQ ID NO: 851189 - DNA, 22 bp, Artificial Sequence
  chemically synthesized
cagaatctagaggcaggatgca

SEQ ID NO: 851190 - DNA, 22 bp, Artificial Sequence
  chemically synthesized
taaggttaactgcatcctgcct

SEQ ID NO: 851191 - DNA, 22 bp, Artificial Sequence
  chemically synthesized
aggttaactgcatcctgcctct

SEQ ID NO: 851192 - DNA, 22 bp, Artificial Sequence
  chemically synthesized
actgcatcctgcctctagattc

SEQ ID NO: 851193 - DNA, 22 bp, Artificial Sequence
  chemically synthesized
catcctgcctctagattctgga

SEQ ID NO: 851194 - DNA, 22 bp, Artificial Sequence
  chemically synthesized
cctctagattctggaatattct

SEQ ID NO: 851195 - DNA, 22 bp, Artificial Sequence
  chemically synthesized
tagattctggaatattctcatg

SEQ ID NO: 851196 - DNA, 22 bp, Artificial Sequence
  chemically synthesized
aatcaagggagacatgagaata

SEQ ID NO: 851197 - DNA, 22 bp, Artificial Sequence
  chemically synthesized
gattctggaatattctcatgtc

SEQ ID NO: 851198 - DNA, 22 bp, Artificial Sequence
  chemically synthesized
tggaatattctcatgtctccct

SEQ ID NO: 851199 - DNA, 22 bp, Artificial Sequence
  chemically synthesized
gaatattctcatgtctcccttg

SEQ ID NO: 851200 - DNA, 22 bp, Artificial Sequence
  chemically synthesized
cgtataaaaggttcaatcaagg

SEQ ID NO: 851201 - DNA, 22 bp, Artificial Sequence
  chemically synthesized
tcatgtctcccttgattgaacc

SEQ ID NO: 851202 - DNA, 22 bp, Artificial Sequence
  chemically synthesized
atgtctcccttgattgaacctt

SEQ ID NO: 851203 - DNA, 22 bp, Artificial Sequence
  chemically synthesized
tcatactccgtataaaaggttc

SEQ ID NO: 851204 - DNA, 22 bp, Artificial Sequence
  chemically synthesized
ccttgattgaaccttttatacg

SEQ ID NO: 851205 - DNA, 22 bp, Artificial Sequence
  chemically synthesized
gattgaaccttttatacggagt

SEQ ID NO: 851206 - DNA, 22 bp, Artificial Sequence
  chemically synthesized
aggtgttgtcatactccgtata

SEQ ID NO: 851207 - DNA, 22 bp, Artificial Sequence
  chemically synthesized
attgaaccttttatacggagta

SEQ ID NO: 851208 - DNA, 22 bp, Artificial Sequence
  chemically synthesized
tcaggtgttgtcatactccgta

SEQ ID NO: 851209 - DNA, 22 bp, Artificial Sequence
  chemically synthesized
aaccttttatacggagtatgac

SEQ ID NO: 851210 - DNA, 22 bp, Artificial Sequence
  chemically synthesized
actctcaggtgttgtcatactc

SEQ ID NO: 851211 - DNA, 22 bp, Artificial Sequence
  chemically synthesized
ttatacggagtatgacaacacc

SEQ ID NO: 851212 - DNA, 22 bp, Artificial Sequence
  chemically synthesized
tatacggagtatgacaacacct

SEQ ID NO: 851213 - DNA, 22 bp, Artificial Sequence
  chemically synthesized
atacggagtatgacaacacctg

SEQ ID NO: 851214 - DNA, 22 bp, Artificial Sequence
  chemically synthesized
tacggagtatgacaacacctga

SEQ ID NO: 851215 - DNA, 22 bp, Artificial Sequence
  chemically synthesized
ccataccctcactctcaggtgt

SEQ ID NO: 851216 - DNA, 22 bp, Artificial Sequence
  chemically synthesized
cactcccataccctcactctca

SEQ ID NO: 851217 - DNA, 22 bp, Artificial Sequence
  chemically synthesized
gctacactcccataccctcact

SEQ ID NO: 851218 - DNA, 22 bp, Artificial Sequence
  chemically synthesized
agagtgagggtatgggagtgta

SEQ ID NO: 851219 - DNA, 22 bp, Artificial Sequence
  chemically synthesized
gtataataggtaaaggttagct

SEQ ID NO: 851220 - DNA, 22 bp, Artificial Sequence
  chemically synthesized
agtataataggtaaaggttagc

SEQ ID NO: 851221 - DNA, 22 bp, Artificial Sequence
  chemically synthesized
tagtataataggtaaaggttag

SEQ ID NO: 851222 - DNA, 22 bp, Artificial Sequence
  chemically synthesized
acctttacctattatactaaag

SEQ ID NO: 851223 - DNA, 22 bp, Artificial Sequence
  chemically synthesized
tacctattatactaaagttttg

SEQ ID NO: 851224 - DNA, 22 bp, Artificial Sequence
  chemically synthesized
acctattatactaaagttttgc

SEQ ID NO: 851225 - DNA, 22 bp, Artificial Sequence
  chemically synthesized
cctattatactaaagttttgct

SEQ ID NO: 851226 - DNA, 22 bp, Artificial Sequence
  chemically synthesized
gtagataaccacagcaaaactt

SEQ ID NO: 851227 - DNA, 22 bp, Artificial Sequence
  chemically synthesized
ggtagataaccacagcaaaact

SEQ ID NO: 851228 - DNA, 22 bp, Artificial Sequence
  chemically synthesized
tggtagataaccacagcaaaac

SEQ ID NO: 851229 - DNA, 22 bp, Artificial Sequence
  chemically synthesized
ttggtagataaccacagcaaaa

SEQ ID NO: 851230 - DNA, 22 bp, Artificial Sequence
  chemically synthesized
ttatactaaagttttgctgtgg

SEQ ID NO: 851231 - DNA, 22 bp, Artificial Sequence
  chemically synthesized
tttttggtagataaccacagca

SEQ ID NO: 851232 - DNA, 22 bp, Artificial Sequence
  chemically synthesized
tactaaagttttgctgtggtta

SEQ ID NO: 851233 - DNA, 22 bp, Artificial Sequence
  chemically synthesized
ggttatttttggtagataacca

SEQ ID NO: 851234 - DNA, 22 bp, Artificial Sequence
  chemically synthesized
aagttttgctgtggttatctac

SEQ ID NO: 851235 - DNA, 22 bp, Artificial Sequence
  chemically synthesized
ttaggttatttttggtagataa

SEQ ID NO: 851236 - DNA, 22 bp, Artificial Sequence
  chemically synthesized
tgctgtggttatctaccaaaaa

SEQ ID NO: 851237 - DNA, 22 bp, Artificial Sequence
  chemically synthesized
gctgtggttatctaccaaaaat

SEQ ID NO: 851238 - DNA, 22 bp, Artificial Sequence
  chemically synthesized
ctgtggttatctaccaaaaata

SEQ ID NO: 851239 - DNA, 22 bp, Artificial Sequence
  chemically synthesized
tggttatctaccaaaaataacc

SEQ ID NO: 851240 - DNA, 22 bp, Artificial Sequence
  chemically synthesized
tgcaaggccaactattaggtta

SEQ ID NO: 851241 - DNA, 22 bp, Artificial Sequence
  chemically synthesized
tctaccaaaaataacctaatag

SEQ ID NO: 851242 - DNA, 22 bp, Artificial Sequence
  chemically synthesized
ttatgcaaggccaactattagg

SEQ ID NO: 851243 - DNA, 22 bp, Artificial Sequence
  chemically synthesized
ccaaaaataacctaatagttgg

SEQ ID NO: 851244 - DNA, 22 bp, Artificial Sequence
  chemically synthesized
gatcaacactattatgcaaggc

SEQ ID NO: 851245 - DNA, 22 bp, Artificial Sequence
  chemically synthesized
atagttggccttgcataatagt

SEQ ID NO: 851246 - DNA, 22 bp, Artificial Sequence
  chemically synthesized
ccctagatcaacactattatgc

SEQ ID NO: 851247 - DNA, 22 bp, Artificial Sequence
  chemically synthesized
gccttgcataatagtgttgatc

SEQ ID NO: 851248 - DNA, 22 bp, Artificial Sequence
  chemically synthesized
tgaattgccctagatcaacact

SEQ ID NO: 851249 - DNA, 22 bp, Artificial Sequence
  chemically synthesized
gcataatagtgttgatctaggg

SEQ ID NO: 851250 - DNA, 22 bp, Artificial Sequence
  chemically synthesized
cataatagtgttgatctagggc

SEQ ID NO: 851251 - DNA, 22 bp, Artificial Sequence
  chemically synthesized
cgtggtgttatgaattgcccta

SEQ ID NO: 851252 - DNA, 22 bp, Artificial Sequence
  chemically synthesized
acgtggtgttatgaattgccct

SEQ ID NO: 851253 - DNA, 22 bp, Artificial Sequence
  chemically synthesized
tggcttacgtggtgttatgaat

SEQ ID NO: 851254 - DNA, 22 bp, Artificial Sequence
  chemically synthesized
gtggcttacgtggtgttatgaa

SEQ ID NO: 851255 - DNA, 22 bp, Artificial Sequence
  chemically synthesized
atctagggcaattcataacacc

SEQ ID NO: 851256 - DNA, 22 bp, Artificial Sequence
  chemically synthesized
gggcaattcataacaccacgta

SEQ ID NO: 851257 - DNA, 22 bp, Artificial Sequence
  chemically synthesized
aaatttgtggcttacgtggtgt

SEQ ID NO: 851258 - DNA, 22 bp, Artificial Sequence
  chemically synthesized
aaaatttgtggcttacgtggtg

SEQ ID NO: 851259 - DNA, 22 bp, Artificial Sequence
  chemically synthesized
taaaatttgtggcttacgtggt

SEQ ID NO: 851260 - DNA, 22 bp, Artificial Sequence
  chemically synthesized
ttttaaaatttgtggcttacgt

SEQ ID NO: 851261 - DNA, 22 bp, Artificial Sequence
  chemically synthesized
ataacaccacgtaagccacaaa

SEQ ID NO: 851262 - DNA, 22 bp, Artificial Sequence
  chemically synthesized
tagtggaggttattttaaaatt

SEQ ID NO: 851263 - DNA, 22 bp, Artificial Sequence
  chemically synthesized
atagtggaggttattttaaaat

SEQ ID NO: 851264 - DNA, 22 bp, Artificial Sequence
  chemically synthesized
cttatagtggaggttattttaa

SEQ ID NO: 851265 - DNA, 22 bp, Artificial Sequence
  chemically synthesized
ccttatagtggaggttatttta

SEQ ID NO: 851266 - DNA, 22 bp, Artificial Sequence
  chemically synthesized
cacttccttatagtggaggtta

SEQ ID NO: 851267 - DNA, 22 bp, Artificial Sequence
  chemically synthesized
gttacacttccttatagtggag

SEQ ID NO: 851268 - DNA, 22 bp, Artificial Sequence
  chemically synthesized
taaaataacctccactataagg

SEQ ID NO: 851269 - DNA, 22 bp, Artificial Sequence
  chemically synthesized
aaaataacctccactataagga

SEQ ID NO: 851270 - DNA, 22 bp, Artificial Sequence
  chemically synthesized
aaataacctccactataaggaa

SEQ ID NO: 851271 - DNA, 22 bp, Artificial Sequence
  chemically synthesized
aatgtaaggagttggttacact

SEQ ID NO: 851272 - DNA, 22 bp, Artificial Sequence
  chemically synthesized
cactataaggaagtgtaaccaa

SEQ ID NO: 851273 - DNA, 22 bp, Artificial Sequence
  chemically synthesized
ttgaatgtaaggagttggttac

SEQ ID NO: 851274 - DNA, 22 bp, Artificial Sequence
  chemically synthesized
taaggaagtgtaaccaactcct

SEQ ID NO: 851275 - DNA, 22 bp, Artificial Sequence
  chemically synthesized
cttacattcaacaatacatttg

SEQ ID NO: 851276 - DNA, 22 bp, Artificial Sequence
  chemically synthesized
caagaataaagtcaaatgtatt

SEQ ID NO: 851277 - DNA, 22 bp, Artificial Sequence
  chemically synthesized
acattcaacaatacatttgact

SEQ ID NO: 851278 - DNA, 22 bp, Artificial Sequence
  chemically synthesized
cattcaacaatacatttgactt

SEQ ID NO: 851279 - DNA, 22 bp, Artificial Sequence
  chemically synthesized
aacaatacatttgactttattc

SEQ ID NO: 851280 - DNA, 22 bp, Artificial Sequence
  chemically synthesized
gactttattcttggagtatatt

SEQ ID NO: 851281 - DNA, 22 bp, Artificial Sequence
  chemically synthesized
actttattcttggagtatatta

SEQ ID NO: 851282 - DNA, 22 bp, Artificial Sequence
  chemically synthesized
tattcttggagtatattattac

SEQ ID NO: 851283 - DNA, 22 bp, Artificial Sequence
  chemically synthesized
attcttggagtatattattaca

SEQ ID NO: 851284 - DNA, 22 bp, Artificial Sequence
  chemically synthesized
ttcttggagtatattattacat

SEQ ID NO: 851285 - DNA, 22 bp, Artificial Sequence
  chemically synthesized
ttggagtatattattacatttt

SEQ ID NO: 851286 - DNA, 22 bp, Artificial Sequence
  chemically synthesized
ggagtatattattacatttttc

SEQ ID NO: 851287 - DNA, 22 bp, Artificial Sequence
  chemically synthesized
gagtatattattacatttttct

SEQ ID NO: 851288 - DNA, 22 bp, Artificial Sequence
  chemically synthesized
ttacatttttctttttatttcc

SEQ ID NO: 851289 - DNA, 22 bp, Artificial Sequence
  chemically synthesized
catttttctttttatttcctca

SEQ ID NO: 851290 - DNA, 22 bp, Artificial Sequence
  chemically synthesized
taacaaatataaccatgaggaa

SEQ ID NO: 851291 - DNA, 22 bp, Artificial Sequence
  chemically synthesized
ataacaaatataaccatgagga

SEQ ID NO: 851292 - DNA, 22 bp, Artificial Sequence
  chemically synthesized
ttctttttatttcctcatggtt

SEQ ID NO: 851293 - DNA, 22 bp, Artificial Sequence
  chemically synthesized
tataacaaatataaccatgagg

SEQ ID NO: 851294 - DNA, 22 bp, Artificial Sequence
  chemically synthesized
tctttttatttcctcatggtta

SEQ ID NO: 851295 - DNA, 22 bp, Artificial Sequence
  chemically synthesized
ctttttatttcctcatggttat

SEQ ID NO: 851296 - DNA, 22 bp, Artificial Sequence
  chemically synthesized
tttttatttcctcatggttata

SEQ ID NO: 851297 - DNA, 22 bp, Artificial Sequence
  chemically synthesized
tttatttcctcatggttatatt

SEQ ID NO: 851298 - DNA, 22 bp, Artificial Sequence
  chemically synthesized
ttatttcctcatggttatattt

SEQ ID NO: 851299 - DNA, 22 bp, Artificial Sequence
  chemically synthesized
tatttcctcatggttatatttg

SEQ ID NO: 851300 - DNA, 22 bp, Artificial Sequence
  chemically synthesized
atttcctcatggttatatttgt

SEQ ID NO: 851301 - DNA, 22 bp, Artificial Sequence
  chemically synthesized
tttcctcatggttatatttgtt

SEQ ID NO: 851302 - DNA, 22 bp, Artificial Sequence
  chemically synthesized
cctcatggttatatttgttata

SEQ ID NO: 851303 - DNA, 22 bp, Artificial Sequence
  chemically synthesized
ctcatggttatatttgttataa

SEQ ID NO: 851304 - DNA, 22 bp, Artificial Sequence
  chemically synthesized
taaaaccatgctttataacaaa

SEQ ID NO: 851305 - DNA, 22 bp, Artificial Sequence
  chemically synthesized
atggttatatttgttataaagc

SEQ ID NO: 851306 - DNA, 22 bp, Artificial Sequence
  chemically synthesized
gttataaaaccatgctttataa

SEQ ID NO: 851307 - DNA, 22 bp, Artificial Sequence
  chemically synthesized
tatttgttataaagcatggttt

SEQ ID NO: 851308 - DNA, 22 bp, Artificial Sequence
  chemically synthesized
acgacctagttataaaaccatg

SEQ ID NO: 851309 - DNA, 22 bp, Artificial Sequence
  chemically synthesized
aacgacctagttataaaaccat

SEQ ID NO: 851310 - DNA, 22 bp, Artificial Sequence
  chemically synthesized
taacgacctagttataaaacca

SEQ ID NO: 851311 - DNA, 22 bp, Artificial Sequence
  chemically synthesized
gttataaagcatggttttataa

SEQ ID NO: 851312 - DNA, 22 bp, Artificial Sequence
  chemically synthesized
ttataaagcatggttttataac

SEQ ID NO: 851313 - DNA, 22 bp, Artificial Sequence
  chemically synthesized
taaagcatggttttataactag

SEQ ID NO: 851314 - DNA, 22 bp, Artificial Sequence
  chemically synthesized
aagatctttaacgacctagtta

SEQ ID NO: 851315 - DNA, 22 bp, Artificial Sequence
  chemically synthesized
aaagatctttaacgacctagtt

SEQ ID NO: 851316 - DNA, 22 bp, Artificial Sequence
  chemically synthesized
taaagatctttaacgacctagt

SEQ ID NO: 851317 - DNA, 22 bp, Artificial Sequence
  chemically synthesized
tataactaggtcgttaaagatc

SEQ ID NO: 851318 - DNA, 22 bp, Artificial Sequence
  chemically synthesized
ataactaggtcgttaaagatct

SEQ ID NO: 851319 - DNA, 22 bp, Artificial Sequence
  chemically synthesized
taactaggtcgttaaagatctt

SEQ ID NO: 851320 - DNA, 22 bp, Artificial Sequence
  chemically synthesized
ggtcgttaaagatctttaaaga

SEQ ID NO: 851321 - DNA, 22 bp, Artificial Sequence
  chemically synthesized
aagatctttaaagattgtgtta

SEQ ID NO: 851322 - DNA, 22 bp, Artificial Sequence
  chemically synthesized
taaagattgtgttattttttgc

SEQ ID NO: 851323 - DNA, 22 bp, Artificial Sequence
  chemically synthesized
aaagattgtgttattttttgca

SEQ ID NO: 851324 - DNA, 22 bp, Artificial Sequence
  chemically synthesized
aagattgtgttattttttgcat

SEQ ID NO: 851325 - DNA, 22 bp, Artificial Sequence
  chemically synthesized
atatgatagtaatagtatgcaa

SEQ ID NO: 851326 - DNA, 22 bp, Artificial Sequence
  chemically synthesized
tgttattttttgcatactatta

SEQ ID NO: 851327 - DNA, 22 bp, Artificial Sequence
  chemically synthesized
ttcatatgatagtaatagtatg

SEQ ID NO: 851328 - DNA, 22 bp, Artificial Sequence
  chemically synthesized
ttttttgcatactattactatc

SEQ ID NO: 851329 - DNA, 22 bp, Artificial Sequence
  chemically synthesized
tttgcatactattactatcata

SEQ ID NO: 851330 - DNA, 22 bp, Artificial Sequence
  chemically synthesized
tgaaattattcatatgatagta

SEQ ID NO: 851331 - DNA, 22 bp, Artificial Sequence
  chemically synthesized
ttgcatactattactatcatat

SEQ ID NO: 851332 - DNA, 22 bp, Artificial Sequence
  chemically synthesized
tgcatactattactatcatatg

SEQ ID NO: 851333 - DNA, 22 bp, Artificial Sequence
  chemically synthesized
gcatactattactatcatatga

SEQ ID NO: 851334 - DNA, 22 bp, Artificial Sequence
  chemically synthesized
catactattactatcatatgaa

SEQ ID NO: 851335 - DNA, 22 bp, Artificial Sequence
  chemically synthesized
ttactatcatatgaataatttc

SEQ ID NO: 851336 - DNA, 22 bp, Artificial Sequence
  chemically synthesized
ctatcatatgaataatttcaca

SEQ ID NO: 851337 - DNA, 22 bp, Artificial Sequence
  chemically synthesized
tcatatgaataatttcacaatc

SEQ ID NO: 851338 - DNA, 22 bp, Artificial Sequence
  chemically synthesized
aagatgaaagacaaggcaagat

SEQ ID NO: 851339 - DNA, 22 bp, Artificial Sequence
  chemically synthesized
cacaatcttgccttgtctttca

SEQ ID NO: 851340 - DNA, 22 bp, Artificial Sequence
  chemically synthesized
acaatcttgccttgtctttcat

SEQ ID NO: 851341 - DNA, 22 bp, Artificial Sequence
  chemically synthesized
tgtgaataggtgcctcaagatg

SEQ ID NO: 851342 - DNA, 22 bp, Artificial Sequence
  chemically synthesized
gccttgtctttcatcttgaggc

SEQ ID NO: 851343 - DNA, 22 bp, Artificial Sequence
  chemically synthesized
ccttgtctttcatcttgaggca

SEQ ID NO: 851344 - DNA, 22 bp, Artificial Sequence
  chemically synthesized
gtctttcatcttgaggcaccta

SEQ ID NO: 851345 - DNA, 22 bp, Artificial Sequence
  chemically synthesized
tctttcatcttgaggcacctat

SEQ ID NO: 851346 - DNA, 22 bp, Artificial Sequence
  chemically synthesized
tcatcttgaggcacctattcac

SEQ ID NO: 851347 - DNA, 22 bp, Artificial Sequence
  chemically synthesized
catcttgaggcacctattcaca

SEQ ID NO: 851348 - DNA, 22 bp, Artificial Sequence
  chemically synthesized
atcttgaggcacctattcacat

SEQ ID NO: 851349 - DNA, 22 bp, Artificial Sequence
  chemically synthesized
tgaaaaaataattatgtgaata

SEQ ID NO: 851350 - DNA, 22 bp, Artificial Sequence
  chemically synthesized
gaggcacctattcacataatta

SEQ ID NO: 851351 - DNA, 22 bp, Artificial Sequence
  chemically synthesized
aggcacctattcacataattat

SEQ ID NO: 851352 - DNA, 22 bp, Artificial Sequence
  chemically synthesized
gactgtgaaaaaataattatgt

SEQ ID NO: 851353 - DNA, 22 bp, Artificial Sequence
  chemically synthesized
ggactgtgaaaaaataattatg

SEQ ID NO: 851354 - DNA, 22 bp, Artificial Sequence
  chemically synthesized
tttggactgtgaaaaaataatt

SEQ ID NO: 851355 - DNA, 22 bp, Artificial Sequence
  chemically synthesized
ttgtttggactgtgaaaaaata

SEQ ID NO: 851356 - DNA, 22 bp, Artificial Sequence
  chemically synthesized
ttcacataattattttttcaca

SEQ ID NO: 851357 - DNA, 22 bp, Artificial Sequence
  chemically synthesized
gttattgtttggactgtgaaaa

SEQ ID NO: 851358 - DNA, 22 bp, Artificial Sequence
  chemically synthesized
acataattattttttcacagtc

SEQ ID NO: 851359 - DNA, 22 bp, Artificial Sequence
  chemically synthesized
caaggcctggttattgtttgga

SEQ ID NO: 851360 - DNA, 22 bp, Artificial Sequence
  chemically synthesized
ttttttcacagtccaaacaata

SEQ ID NO: 851361 - DNA, 22 bp, Artificial Sequence
  chemically synthesized
tttcacagtccaaacaataacc

SEQ ID NO: 851362 - DNA, 22 bp, Artificial Sequence
  chemically synthesized
ttcacagtccaaacaataacca

SEQ ID NO: 851363 - DNA, 22 bp, Artificial Sequence
  chemically synthesized
aattacaaggcctggttattgt

SEQ ID NO: 851364 - DNA, 22 bp, Artificial Sequence
  chemically synthesized
tcacagtccaaacaataaccag

SEQ ID NO: 851365 - DNA, 22 bp, Artificial Sequence
  chemically synthesized
cacagtccaaacaataaccagg

SEQ ID NO: 851366 - DNA, 22 bp, Artificial Sequence
  chemically synthesized
acagtccaaacaataaccaggc

SEQ ID NO: 851367 - DNA, 22 bp, Artificial Sequence
  chemically synthesized
ataactaaattacaaggcctgg

SEQ ID NO: 851368 - DNA, 22 bp, Artificial Sequence
  chemically synthesized
cataactaaattacaaggcctg

SEQ ID NO: 851369 - DNA, 22 bp, Artificial Sequence
  chemically synthesized
tttcataactaaattacaaggc

SEQ ID NO: 851370 - DNA, 22 bp, Artificial Sequence
  chemically synthesized
atttcataactaaattacaagg

SEQ ID NO: 851371 - DNA, 22 bp, Artificial Sequence
  chemically synthesized
tatttcataactaaattacaag

SEQ ID NO: 851372 - DNA, 22 bp, Artificial Sequence
  chemically synthesized
ttatttcataactaaattacaa

SEQ ID NO: 851373 - DNA, 22 bp, Artificial Sequence
  chemically synthesized
tttatttcataactaaattaca

SEQ ID NO: 851374 - DNA, 22 bp, Artificial Sequence
  chemically synthesized
gtaatttagttatgaaataaaa

SEQ ID NO: 851375 - DNA, 22 bp, Artificial Sequence
  chemically synthesized
taatttagttatgaaataaaaa

SEQ ID NO: 851376 - DNA, 22 bp, Artificial Sequence
  chemically synthesized
tgtaaataccagcctttttatt

SEQ ID NO: 851377 - DNA, 22 bp, Artificial Sequence
  chemically synthesized
agttatgaaataaaaaggctgg

SEQ ID NO: 851378 - DNA, 22 bp, Artificial Sequence
  chemically synthesized
gttatgaaataaaaaggctggt

SEQ ID NO: 851379 - DNA, 22 bp, Artificial Sequence
  chemically synthesized
tgaaataaaaaggctggtattt

SEQ ID NO: 851380 - DNA, 22 bp, Artificial Sequence
  chemically synthesized
ataagacgattatgtaaatacc

SEQ ID NO: 851381 - DNA, 22 bp, Artificial Sequence
  chemically synthesized
gtatttacataatcgtcttatg

SEQ ID NO: 851382 - DNA, 22 bp, Artificial Sequence
  chemically synthesized
cacatgcataactcataagacg

SEQ ID NO: 851383 - DNA, 22 bp, Artificial Sequence
  chemically synthesized
gcacatgcataactcataagac

SEQ ID NO: 851384 - DNA, 22 bp, Artificial Sequence
  chemically synthesized
ttgcacatgcataactcataag

SEQ ID NO: 851385 - DNA, 22 bp, Artificial Sequence
  chemically synthesized
cttgcacatgcataactcataa

SEQ ID NO: 851386 - DNA, 22 bp, Artificial Sequence
  chemically synthesized
acataatcgtcttatgagttat

SEQ ID NO: 851387 - DNA, 22 bp, Artificial Sequence
  chemically synthesized
cataatcgtcttatgagttatg

SEQ ID NO: 851388 - DNA, 22 bp, Artificial Sequence
  chemically synthesized
atgagttatgcatgtgcaagaa

SEQ ID NO: 851389 - DNA, 22 bp, Artificial Sequence
  chemically synthesized
tgagttatgcatgtgcaagaaa

SEQ ID NO: 851390 - DNA, 22 bp, Artificial Sequence
  chemically synthesized
tgcatgtgcaagaaatgttctg

SEQ ID NO: 851391 - DNA, 22 bp, Artificial Sequence
  chemically synthesized
acgcacacaaacatgcagaaca

SEQ ID NO: 851392 - DNA, 22 bp, Artificial Sequence
  chemically synthesized
tcacgcacacaaacatgcagaa

SEQ ID NO: 851393 - DNA, 22 bp, Artificial Sequence
  chemically synthesized
tctcacgcacacaaacatgcag

SEQ ID NO: 851394 - DNA, 22 bp, Artificial Sequence
  chemically synthesized
tgtctctctcacgcacacaaac

SEQ ID NO: 851395 - DNA, 22 bp, Artificial Sequence
  chemically synthesized
tgtgtctctctcacgcacacaa

SEQ ID NO: 851396 - DNA, 22 bp, Artificial Sequence
  chemically synthesized
tctgtgtctctctcacgcacac

SEQ ID NO: 851397 - DNA, 22 bp, Artificial Sequence
  chemically synthesized
tctctgtgtctctctcacgcac

SEQ ID NO: 851398 - DNA, 22 bp, Artificial Sequence
  chemically synthesized
tgcatgtttgtgtgcgtgagag

SEQ ID NO: 851399 - DNA, 22 bp, Artificial Sequence
  chemically synthesized
tctctctgtgtctctctcacgc

SEQ ID NO: 851400 - DNA, 22 bp, Artificial Sequence
  chemically synthesized
catgtttgtgtgcgtgagagag

SEQ ID NO: 851401 - DNA, 22 bp, Artificial Sequence
  chemically synthesized
gctctctctctgtgtctctctc

SEQ ID NO: 851402 - DNA, 22 bp, Artificial Sequence
  chemically synthesized
tcgctctctctctgtgtctctc

SEQ ID NO: 851403 - DNA, 22 bp, Artificial Sequence
  chemically synthesized
gtgtgcgtgagagagacacaga

SEQ ID NO: 851404 - DNA, 22 bp, Artificial Sequence
  chemically synthesized
tgtgcgtgagagagacacagag

SEQ ID NO: 851405 - DNA, 22 bp, Artificial Sequence
  chemically synthesized
aatctctcgctctctctctgtg

SEQ ID NO: 851406 - DNA, 22 bp, Artificial Sequence
  chemically synthesized
tcaatctctcgctctctctctg

SEQ ID NO: 851407 - DNA, 22 bp, Artificial Sequence
  chemically synthesized
ctctcaatctctcgctctctct

SEQ ID NO: 851408 - DNA, 22 bp, Artificial Sequence
  chemically synthesized
actctcaatctctcgctctctc

SEQ ID NO: 851409 - DNA, 22 bp, Artificial Sequence
  chemically synthesized
aataatgatcgggcttactctc

SEQ ID NO: 851410 - DNA, 22 bp, Artificial Sequence
  chemically synthesized
cacccctcaataatgatcgggc

SEQ ID NO: 851411 - DNA, 22 bp, Artificial Sequence
  chemically synthesized
acacccctcaataatgatcggg

SEQ ID NO: 851412 - DNA, 22 bp, Artificial Sequence
  chemically synthesized
ttacacccctcaataatgatcg

SEQ ID NO: 851413 - DNA, 22 bp, Artificial Sequence
  chemically synthesized
cttacacccctcaataatgatc

SEQ ID NO: 851414 - DNA, 22 bp, Artificial Sequence
  chemically synthesized
agagtaagcccgatcattattg

SEQ ID NO: 851415 - DNA, 22 bp, Artificial Sequence
  chemically synthesized
cataaagtaatttcttacaccc

SEQ ID NO: 851416 - DNA, 22 bp, Artificial Sequence
  chemically synthesized
catctccataaagtaatttctt

SEQ ID NO: 851417 - DNA, 22 bp, Artificial Sequence
  chemically synthesized
ttgaggggtgtaagaaattact

SEQ ID NO: 851418 - DNA, 22 bp, Artificial Sequence
  chemically synthesized
gcatctccataaagtaatttct

SEQ ID NO: 851419 - DNA, 22 bp, Artificial Sequence
  chemically synthesized
tgcatctccataaagtaatttc

SEQ ID NO: 851420 - DNA, 22 bp, Artificial Sequence
  chemically synthesized
ttgcatctccataaagtaattt

SEQ ID NO: 851421 - DNA, 22 bp, Artificial Sequence
  chemically synthesized
aggggtgtaagaaattacttta

SEQ ID NO: 851422 - DNA, 22 bp, Artificial Sequence
  chemically synthesized
aaccccaggtttttgcatctcc

SEQ ID NO: 851423 - DNA, 22 bp, Artificial Sequence
  chemically synthesized
ctttatggagatgcaaaaacct

SEQ ID NO: 851424 - DNA, 22 bp, Artificial Sequence
  chemically synthesized
gtatctgaaccccaggtttttg

SEQ ID NO: 851425 - DNA, 22 bp, Artificial Sequence
  chemically synthesized
tatggagatgcaaaaacctggg

SEQ ID NO: 851426 - DNA, 22 bp, Artificial Sequence
  chemically synthesized
atggagatgcaaaaacctgggg

SEQ ID NO: 851427 - DNA, 22 bp, Artificial Sequence
  chemically synthesized
tggagatgcaaaaacctggggt

SEQ ID NO: 851428 - DNA, 22 bp, Artificial Sequence
  chemically synthesized
accgcagtctcgtatctgaacc

SEQ ID NO: 851429 - DNA, 22 bp, Artificial Sequence
  chemically synthesized
gggttcagatacgagactgcgg

SEQ ID NO: 851430 - DNA, 22 bp, Artificial Sequence
  chemically synthesized
agatacgagactgcggtgagat

SEQ ID NO: 851431 - DNA, 22 bp, Artificial Sequence
  chemically synthesized
cggtgagatcattgcctcccac

SEQ ID NO: 851432 - DNA, 22 bp, Artificial Sequence
  chemically synthesized
agatgagcccccagagggtggg

SEQ ID NO: 851433 - DNA, 22 bp, Artificial Sequence
  chemically synthesized
gcagctcagatgagcccccaga

SEQ ID NO: 851434 - DNA, 22 bp, Artificial Sequence
  chemically synthesized
ggcagctcagatgagcccccag

SEQ ID NO: 851435 - DNA, 22 bp, Artificial Sequence
  chemically synthesized
cctcccaccctctgggggctca

SEQ ID NO: 851436 - DNA, 22 bp, Artificial Sequence
  chemically synthesized
tggcagctcagatgagccccca

SEQ ID NO: 851437 - DNA, 22 bp, Artificial Sequence
  chemically synthesized
ccaccctctgggggctcatctg

SEQ ID NO: 851438 - DNA, 22 bp, Artificial Sequence
  chemically synthesized
tgggggctcatctgagctgcca

SEQ ID NO: 851439 - DNA, 22 bp, Artificial Sequence
  chemically synthesized
ggggctcatctgagctgccaaa

SEQ ID NO: 851440 - DNA, 22 bp, Artificial Sequence
  chemically synthesized
atctgagctgccaaaatattct

SEQ ID NO: 851441 - DNA, 22 bp, Artificial Sequence
  chemically synthesized
agctgccaaaatattctcctct

SEQ ID NO: 851442 - DNA, 22 bp, Artificial Sequence
  chemically synthesized
ccaaaatattctcctctctgac

SEQ ID NO: 851443 - DNA, 22 bp, Artificial Sequence
  chemically synthesized
tcgaagagccaagataaaaatg

SEQ ID NO: 851444 - DNA, 22 bp, Artificial Sequence
  chemically synthesized
gtcgaagagccaagataaaaat

SEQ ID NO: 851445 - DNA, 22 bp, Artificial Sequence
  chemically synthesized
tcctctctgacatttttatctt

SEQ ID NO: 851446 - DNA, 22 bp, Artificial Sequence
  chemically synthesized
ctctctgacatttttatcttgg

SEQ ID NO: 851447 - DNA, 22 bp, Artificial Sequence
  chemically synthesized
tctgacatttttatcttggctc

SEQ ID NO: 851448 - DNA, 22 bp, Artificial Sequence
  chemically synthesized
agaacttgtcgaagagccaaga

SEQ ID NO: 851449 - DNA, 22 bp, Artificial Sequence
  chemically synthesized
tgacatttttatcttggctctt

SEQ ID NO: 851450 - DNA, 22 bp, Artificial Sequence
  chemically synthesized
acatttttatcttggctcttcg

SEQ ID NO: 851451 - DNA, 22 bp, Artificial Sequence
  chemically synthesized
ttatcttggctcttcgacaagt

SEQ ID NO: 851452 - DNA, 22 bp, Artificial Sequence
  chemically synthesized
tatcttggctcttcgacaagtt

SEQ ID NO: 851453 - DNA, 22 bp, Artificial Sequence
  chemically synthesized
atcttggctcttcgacaagttc

SEQ ID NO: 851454 - DNA, 22 bp, Artificial Sequence
  chemically synthesized
tcttggctcttcgacaagttct

SEQ ID NO: 851455 - DNA, 22 bp, Artificial Sequence
  chemically synthesized
agcaggcaactgagaacttgtc

SEQ ID NO: 851456 - DNA, 22 bp, Artificial Sequence
  chemically synthesized
gagcaggcaactgagaacttgt

SEQ ID NO: 851457 - DNA, 22 bp, Artificial Sequence
  chemically synthesized
ggctcttcgacaagttctcagt

SEQ ID NO: 851458 - DNA, 22 bp, Artificial Sequence
  chemically synthesized
gctcttcgacaagttctcagtt

SEQ ID NO: 851459 - DNA, 22 bp, Artificial Sequence
  chemically synthesized
ttcgacaagttctcagttgcct

SEQ ID NO: 851460 - DNA, 22 bp, Artificial Sequence
  chemically synthesized
cgacaagttctcagttgcctgc

SEQ ID NO: 851461 - DNA, 22 bp, Artificial Sequence
  chemically synthesized
gacaagttctcagttgcctgct

SEQ ID NO: 851462 - DNA, 22 bp, Artificial Sequence
  chemically synthesized
tcagttgcctgctcaagattca

SEQ ID NO: 851463 - DNA, 22 bp, Artificial Sequence
  chemically synthesized
agttgcctgctcaagattcata

SEQ ID NO: 851464 - DNA, 22 bp, Artificial Sequence
  chemically synthesized
cctgctcaagattcatattctc

SEQ ID NO: 851465 - DNA, 22 bp, Artificial Sequence
  chemically synthesized
ctcaagattcatattctctatt

SEQ ID NO: 851466 - DNA, 22 bp, Artificial Sequence
  chemically synthesized
aagattcatattctctattatt

SEQ ID NO: 851467 - DNA, 22 bp, Artificial Sequence
  chemically synthesized
atattctctattatttcttccc

SEQ ID NO: 851468 - DNA, 22 bp, Artificial Sequence
  chemically synthesized
tgaaaatagatacccagggaag

SEQ ID NO: 851469 - DNA, 22 bp, Artificial Sequence
  chemically synthesized
tctattatttcttccctgggta

SEQ ID NO: 851470 - DNA, 22 bp, Artificial Sequence
  chemically synthesized
tgtgaaaatagatacccaggga

SEQ ID NO: 851471 - DNA, 22 bp, Artificial Sequence
  chemically synthesized
tattatttcttccctgggtatc

SEQ ID NO: 851472 - DNA, 22 bp, Artificial Sequence
  chemically synthesized
ttctgtgaaaatagatacccag

SEQ ID NO: 851473 - DNA, 22 bp, Artificial Sequence
  chemically synthesized
ttatttcttccctgggtatcta

SEQ ID NO: 851474 - DNA, 22 bp, Artificial Sequence
  chemically synthesized
tttcttccctgggtatctattt

SEQ ID NO: 851475 - DNA, 22 bp, Artificial Sequence
  chemically synthesized
aactattctgtgaaaatagata

SEQ ID NO: 851476 - DNA, 22 bp, Artificial Sequence
  chemically synthesized
caactattctgtgaaaatagat

SEQ ID NO: 851477 - DNA, 22 bp, Artificial Sequence
  chemically synthesized
cttccctgggtatctattttca

SEQ ID NO: 851478 - DNA, 22 bp, Artificial Sequence
  chemically synthesized
ttccctgggtatctattttcac

SEQ ID NO: 851479 - DNA, 22 bp, Artificial Sequence
  chemically synthesized
ccctgggtatctattttcacag

SEQ ID NO: 851480 - DNA, 22 bp, Artificial Sequence
  chemically synthesized
cctgggtatctattttcacaga

SEQ ID NO: 851481 - DNA, 22 bp, Artificial Sequence
  chemically synthesized
tgagtcttcaactattctgtga

SEQ ID NO: 851482 - DNA, 22 bp, Artificial Sequence
  chemically synthesized
ggtatctattttcacagaatag

SEQ ID NO: 851483 - DNA, 22 bp, Artificial Sequence
  chemically synthesized
ttatgagtcttcaactattctg

SEQ ID NO: 851484 - DNA, 22 bp, Artificial Sequence
  chemically synthesized
attatgagtcttcaactattct

SEQ ID NO: 851485 - DNA, 22 bp, Artificial Sequence
  chemically synthesized
tattatgagtcttcaactattc

SEQ ID NO: 851486 - DNA, 22 bp, Artificial Sequence
  chemically synthesized
ttttcacagaatagttgaagac

SEQ ID NO: 851487 - DNA, 22 bp, Artificial Sequence
  chemically synthesized
tcacagaatagttgaagactca

SEQ ID NO: 851488 - DNA, 22 bp, Artificial Sequence
  chemically synthesized
cacagaatagttgaagactcat

SEQ ID NO: 851489 - DNA, 22 bp, Artificial Sequence
  chemically synthesized
acagaatagttgaagactcata

SEQ ID NO: 851490 - DNA, 22 bp, Artificial Sequence
  chemically synthesized
aaataggctttattatgagtct

SEQ ID NO: 851491 - DNA, 22 bp, Artificial Sequence
  chemically synthesized
aagactcataataaagcctatt

SEQ ID NO: 851492 - DNA, 22 bp, Artificial Sequence
  chemically synthesized
ggaaaaatgatacattaaaata

SEQ ID NO: 851493 - DNA, 22 bp, Artificial Sequence
  chemically synthesized
ataataaagcctattttaatgt

SEQ ID NO: 851494 - DNA, 22 bp, Artificial Sequence
  chemically synthesized
aggaaaaatgatacattaaaat

SEQ ID NO: 851495 - DNA, 22 bp, Artificial Sequence
  chemically synthesized
cttaggaaaaatgatacattaa

SEQ ID NO: 851496 - DNA, 22 bp, Artificial Sequence
  chemically synthesized
gcttaggaaaaatgatacatta

SEQ ID NO: 851497 - DNA, 22 bp, Artificial Sequence
  chemically synthesized
ttttaatgtatcatttttccta

SEQ ID NO: 851498 - DNA, 22 bp, Artificial Sequence
  chemically synthesized
aaatggatttgcttaggaaaaa

SEQ ID NO: 851499 - DNA, 22 bp, Artificial Sequence
  chemically synthesized
taatgtatcatttttcctaagc

SEQ ID NO: 851500 - DNA, 22 bp, Artificial Sequence
  chemically synthesized
aatgtatcatttttcctaagca

SEQ ID NO: 851501 - DNA, 22 bp, Artificial Sequence
  chemically synthesized
atgtatcatttttcctaagcaa

SEQ ID NO: 851502 - DNA, 22 bp, Artificial Sequence
  chemically synthesized
ttcctaagcaaatccatttcaa

SEQ ID NO: 851503 - DNA, 22 bp, Artificial Sequence
  chemically synthesized
tcctaagcaaatccatttcaat

SEQ ID NO: 851504 - DNA, 22 bp, Artificial Sequence
  chemically synthesized
cctaagcaaatccatttcaatc

SEQ ID NO: 851505 - DNA, 22 bp, Artificial Sequence
  chemically synthesized
ctaagcaaatccatttcaatct

SEQ ID NO: 851506 - DNA, 22 bp, Artificial Sequence
  chemically synthesized
agcaaatccatttcaatctcca

SEQ ID NO: 851507 - DNA, 22 bp, Artificial Sequence
  chemically synthesized
gcaaataaaaacagtggagatt

SEQ ID NO: 851508 - DNA, 22 bp, Artificial Sequence
  chemically synthesized
ggcaaataaaaacagtggagat

SEQ ID NO: 851509 - DNA, 22 bp, Artificial Sequence
  chemically synthesized
caatctccactgtttttatttg

SEQ ID NO: 851510 - DNA, 22 bp, Artificial Sequence
  chemically synthesized
ggacatgtttggcaaataaaaa

SEQ ID NO: 851511 - DNA, 22 bp, Artificial Sequence
  chemically synthesized
aatctccactgtttttatttgc

SEQ ID NO: 851512 - DNA, 22 bp, Artificial Sequence
  chemically synthesized
aggacatgtttggcaaataaaa

SEQ ID NO: 851513 - DNA, 22 bp, Artificial Sequence
  chemically synthesized
cactgtttttatttgccaaaca

SEQ ID NO: 851514 - DNA, 22 bp, Artificial Sequence
  chemically synthesized
gtatttaggacatgtttggcaa

SEQ ID NO: 851515 - DNA, 22 bp, Artificial Sequence
  chemically synthesized
tttttatttgccaaacatgtcc

SEQ ID NO: 851516 - DNA, 22 bp, Artificial Sequence
  chemically synthesized
taattagtatttaggacatgtt

SEQ ID NO: 851517 - DNA, 22 bp, Artificial Sequence
  chemically synthesized
ataattagtatttaggacatgt

SEQ ID NO: 851518 - DNA, 22 bp, Artificial Sequence
  chemically synthesized
ttatttgccaaacatgtcctaa

SEQ ID NO: 851519 - DNA, 22 bp, Artificial Sequence
  chemically synthesized
tatttgccaaacatgtcctaaa

SEQ ID NO: 851520 - DNA, 22 bp, Artificial Sequence
  chemically synthesized
atttgccaaacatgtcctaaat

SEQ ID NO: 851521 - DNA, 22 bp, Artificial Sequence
  chemically synthesized
tttgccaaacatgtcctaaata

SEQ ID NO: 851522 - DNA, 22 bp, Artificial Sequence
  chemically synthesized
cgtttataattagtatttagga

SEQ ID NO: 851523 - DNA, 22 bp, Artificial Sequence
  chemically synthesized
gccaaacatgtcctaaatacta

SEQ ID NO: 851524 - DNA, 22 bp, Artificial Sequence
  chemically synthesized
ccaaacatgtcctaaatactaa

SEQ ID NO: 851525 - DNA, 22 bp, Artificial Sequence
  chemically synthesized
agctgcgtttataattagtatt

SEQ ID NO: 851526 - DNA, 22 bp, Artificial Sequence
  chemically synthesized
cattgagctgcgtttataatta

SEQ ID NO: 851527 - DNA, 22 bp, Artificial Sequence
  chemically synthesized
aatactaattataaacgcagct

SEQ ID NO: 851528 - DNA, 22 bp, Artificial Sequence
  chemically synthesized
attataaacgcagctcaatgca

SEQ ID NO: 851529 - DNA, 22 bp, Artificial Sequence
  chemically synthesized
taaacgcagctcaatgcagttt

SEQ ID NO: 851530 - DNA, 22 bp, Artificial Sequence
  chemically synthesized
aatgcagtttattatgtttcca

SEQ ID NO: 851531 - DNA, 22 bp, Artificial Sequence
  chemically synthesized
attatgtttccacgtatttata

SEQ ID NO: 851532 - DNA, 22 bp, Artificial Sequence
  chemically synthesized
ttatgtttccacgtatttatac

SEQ ID NO: 851533 - DNA, 22 bp, Artificial Sequence
  chemically synthesized
tgtttccacgtatttataccat

SEQ ID NO: 851534 - DNA, 22 bp, Artificial Sequence
  chemically synthesized
ccacgtatttataccatatatg

SEQ ID NO: 851535 - DNA, 22 bp, Artificial Sequence
  chemically synthesized
cacgtatttataccatatatgt

SEQ ID NO: 851536 - DNA, 22 bp, Artificial Sequence
  chemically synthesized
ataccatatatgttattcgtgt

SEQ ID NO: 851537 - DNA, 22 bp, Artificial Sequence
  chemically synthesized
taccatatatgttattcgtgta

SEQ ID NO: 851538 - DNA, 22 bp, Artificial Sequence
  chemically synthesized
ttcgtgtatgtgtacacacaca

SEQ ID NO: 851539 - DNA, 22 bp, Artificial Sequence
  chemically synthesized
gtgtatgtgtacacacacacac

SEQ ID NO: 851540 - DNA, 22 bp, Artificial Sequence
  chemically synthesized
gcaacaaaccatatgtgcgcgt

SEQ ID NO: 851541 - DNA, 22 bp, Artificial Sequence
  chemically synthesized
ttggcaacaaaccatatgtgcg

SEQ ID NO: 851542 - DNA, 22 bp, Artificial Sequence
  chemically synthesized
attggcaacaaaccatatgtgc

SEQ ID NO: 851543 - DNA, 22 bp, Artificial Sequence
  chemically synthesized
tcacaggtttattggcaacaaa

SEQ ID NO: 851544 - DNA, 22 bp, Artificial Sequence
  chemically synthesized
tatcacaggtttattggcaaca

SEQ ID NO: 851545 - DNA, 22 bp, Artificial Sequence
  chemically synthesized
gttgccaataaacctgtgatag

SEQ ID NO: 851546 - DNA, 22 bp, Artificial Sequence
  chemically synthesized
ttgccaataaacctgtgataga

SEQ ID NO: 851547 - DNA, 22 bp, Artificial Sequence
  chemically synthesized
ataagtgccagattctatcaca

SEQ ID NO: 851548 - DNA, 22 bp, Artificial Sequence
  chemically synthesized
ccaataaacctgtgatagaatc

SEQ ID NO: 851549 - DNA, 22 bp, Artificial Sequence
  chemically synthesized
tgatagaatctggcacttatca

SEQ ID NO: 851550 - DNA, 22 bp, Artificial Sequence
  chemically synthesized
cccaaggcaatgccattgataa

SEQ ID NO: 851551 - DNA, 22 bp, Artificial Sequence
  chemically synthesized
gcccaaggcaatgccattgata

SEQ ID NO: 851552 - DNA, 22 bp, Artificial Sequence
  chemically synthesized
gcacttatcaatggcattgcct

SEQ ID NO: 851553 - DNA, 22 bp, Artificial Sequence
  chemically synthesized
agtgacttgcccaaggcaatgc

SEQ ID NO: 851554 - DNA, 22 bp, Artificial Sequence
  chemically synthesized
atcaatggcattgccttgggca

SEQ ID NO: 851555 - DNA, 22 bp, Artificial Sequence
  chemically synthesized
tcaatggcattgccttgggcaa

SEQ ID NO: 851556 - DNA, 22 bp, Artificial Sequence
  chemically synthesized
agagaggttaagtgacttgccc

SEQ ID NO: 851557 - DNA, 22 bp, Artificial Sequence
  chemically synthesized
ccttgggcaagtcacttaacct

SEQ ID NO: 851558 - DNA, 22 bp, Artificial Sequence
  chemically synthesized
gggcaagtcacttaacctctct

SEQ ID NO: 851559 - DNA, 22 bp, Artificial Sequence
  chemically synthesized
ggcaagtcacttaacctctctg

SEQ ID NO: 851560 - DNA, 22 bp, Artificial Sequence
  chemically synthesized
aaagggagaaactcagagaggt

SEQ ID NO: 851561 - DNA, 22 bp, Artificial Sequence
  chemically synthesized
gaaagggagaaactcagagagg

SEQ ID NO: 851562 - DNA, 22 bp, Artificial Sequence
  chemically synthesized
tgaaagggagaaactcagagag

SEQ ID NO: 851563 - DNA, 22 bp, Artificial Sequence
  chemically synthesized
ttttgaaagggagaaactcaga

SEQ ID NO: 851564 - DNA, 22 bp, Artificial Sequence
  chemically synthesized
gttttgaaagggagaaactcag

SEQ ID NO: 851565 - DNA, 22 bp, Artificial Sequence
  chemically synthesized
ttgttttgaaagggagaaactc

SEQ ID NO: 851566 - DNA, 22 bp, Artificial Sequence
  chemically synthesized
cttgttttgaaagggagaaact

SEQ ID NO: 851567 - DNA, 22 bp, Artificial Sequence
  chemically synthesized
tcttgttttgaaagggagaaac

SEQ ID NO: 851568 - DNA, 22 bp, Artificial Sequence
  chemically synthesized
aacctctctgagtttctccctt

SEQ ID NO: 851569 - DNA, 22 bp, Artificial Sequence
  chemically synthesized
ttcttgttttgaaagggagaaa

SEQ ID NO: 851570 - DNA, 22 bp, Artificial Sequence
  chemically synthesized
acctctctgagtttctcccttt

SEQ ID NO: 851571 - DNA, 22 bp, Artificial Sequence
  chemically synthesized
tctgagtttctccctttcaaaa

SEQ ID NO: 851572 - DNA, 22 bp, Artificial Sequence
  chemically synthesized
gcgtttttcttgttttgaaagg

SEQ ID NO: 851573 - DNA, 22 bp, Artificial Sequence
  chemically synthesized
tgagtttctccctttcaaaaca

SEQ ID NO: 851574 - DNA, 22 bp, Artificial Sequence
  chemically synthesized
agtttctccctttcaaaacaag

SEQ ID NO: 851575 - DNA, 22 bp, Artificial Sequence
  chemically synthesized
actggcgtttttcttgttttga

SEQ ID NO: 851576 - DNA, 22 bp, Artificial Sequence
  chemically synthesized
ctccctttcaaaacaagaaaaa

SEQ ID NO: 851577 - DNA, 22 bp, Artificial Sequence
  chemically synthesized
tccctttcaaaacaagaaaaac

SEQ ID NO: 851578 - DNA, 22 bp, Artificial Sequence
  chemically synthesized
cctttcaaaacaagaaaaacgc

SEQ ID NO: 851579 - DNA, 22 bp, Artificial Sequence
  chemically synthesized
tcaaaacaagaaaaacgccagt

SEQ ID NO: 851580 - DNA, 22 bp, Artificial Sequence
  chemically synthesized
caaaacaagaaaaacgccagtt

SEQ ID NO: 851581 - DNA, 22 bp, Artificial Sequence
  chemically synthesized
aaaacaagaaaaacgccagtta

SEQ ID NO: 851582 - DNA, 22 bp, Artificial Sequence
  chemically synthesized
aaaagtggtacaagctaactgg

SEQ ID NO: 851583 - DNA, 22 bp, Artificial Sequence
  chemically synthesized
tcaaaagtggtacaagctaact

SEQ ID NO: 851584 - DNA, 22 bp, Artificial Sequence
  chemically synthesized
atcctctcaaaagtggtacaag

SEQ ID NO: 851585 - DNA, 22 bp, Artificial Sequence
  chemically synthesized
taatcctctcaaaagtggtaca

SEQ ID NO: 851586 - DNA, 22 bp, Artificial Sequence
  chemically synthesized
ctaatcctctcaaaagtggtac

SEQ ID NO: 851587 - DNA, 22 bp, Artificial Sequence
  chemically synthesized
aatatttctaatcctctcaaaa

SEQ ID NO: 851588 - DNA, 22 bp, Artificial Sequence
  chemically synthesized
gcttgtaccacttttgagagga

SEQ ID NO: 851589 - DNA, 22 bp, Artificial Sequence
  chemically synthesized
gtaccacttttgagaggattag

SEQ ID NO: 851590 - DNA, 22 bp, Artificial Sequence
  chemically synthesized
taccacttttgagaggattaga

SEQ ID NO: 851591 - DNA, 22 bp, Artificial Sequence
  chemically synthesized
ttgagaggattagaaatattga

SEQ ID NO: 851592 - DNA, 22 bp, Artificial Sequence
  chemically synthesized
tgcatatcatattcaatatttc

SEQ ID NO: 851593 - DNA, 22 bp, Artificial Sequence
  chemically synthesized
tgagaggattagaaatattgaa

SEQ ID NO: 851594 - DNA, 22 bp, Artificial Sequence
  chemically synthesized
gagaggattagaaatattgaat

SEQ ID NO: 851595 - DNA, 22 bp, Artificial Sequence
  chemically synthesized
agaggattagaaatattgaata

SEQ ID NO: 851596 - DNA, 22 bp, Artificial Sequence
  chemically synthesized
tgctatgcatatcatattcaat

SEQ ID NO: 851597 - DNA, 22 bp, Artificial Sequence
  chemically synthesized
gaaatattgaatatgatatgca

SEQ ID NO: 851598 - DNA, 22 bp, Artificial Sequence
  chemically synthesized
aatatgatatgcatagcacaat

SEQ ID NO: 851599 - DNA, 22 bp, Artificial Sequence
  chemically synthesized
gtatataccaggcattgtgcta

SEQ ID NO: 851600 - DNA, 22 bp, Artificial Sequence
  chemically synthesized
tagtatataccaggcattgtgc

SEQ ID NO: 851601 - DNA, 22 bp, Artificial Sequence
  chemically synthesized
ctagtatataccaggcattgtg

SEQ ID NO: 851602 - DNA, 22 bp, Artificial Sequence
  chemically synthesized
atttctagtatataccaggcat

SEQ ID NO: 851603 - DNA, 22 bp, Artificial Sequence
  chemically synthesized
ccatgcattaatttctagtata

SEQ ID NO: 851604 - DNA, 22 bp, Artificial Sequence
  chemically synthesized
accatgcattaatttctagtat

SEQ ID NO: 851605 - DNA, 22 bp, Artificial Sequence
  chemically synthesized
gtatatactagaaattaatgca

SEQ ID NO: 851606 - DNA, 22 bp, Artificial Sequence
  chemically synthesized
atgatgcttaccatgcattaat

SEQ ID NO: 851607 - DNA, 22 bp, Artificial Sequence
  chemically synthesized
gaaattaatgcatggtaagcat

SEQ ID NO: 851608 - DNA, 22 bp, Artificial Sequence
  chemically synthesized
ccataaaattcatgatgcttac

SEQ ID NO: 851609 - DNA, 22 bp, Artificial Sequence
  chemically synthesized
atgcatggtaagcatcatgaat

SEQ ID NO: 851610 - DNA, 22 bp, Artificial Sequence
  chemically synthesized
ggtcatatatactaccataaaa

SEQ ID NO: 851611 - DNA, 22 bp, Artificial Sequence
  chemically synthesized
gcccaaaatgttaggtcatata

SEQ ID NO: 851612 - DNA, 22 bp, Artificial Sequence
  chemically synthesized
ggcccaaaatgttaggtcatat

SEQ ID NO: 851613 - DNA, 22 bp, Artificial Sequence
  chemically synthesized
tatggtagtatatatgacctaa

SEQ ID NO: 851614 - DNA, 22 bp, Artificial Sequence
  chemically synthesized
tggcccaaaatgttaggtcata

SEQ ID NO: 851615 - DNA, 22 bp, Artificial Sequence
  chemically synthesized
atggtagtatatatgacctaac

SEQ ID NO: 851616 - DNA, 22 bp, Artificial Sequence
  chemically synthesized
ttggcccaaaatgttaggtcat

SEQ ID NO: 851617 - DNA, 22 bp, Artificial Sequence
  chemically synthesized
tggtagtatatatgacctaaca

SEQ ID NO: 851618 - DNA, 22 bp, Artificial Sequence
  chemically synthesized
cttttggcccaaaatgttaggt

SEQ ID NO: 851619 - DNA, 22 bp, Artificial Sequence
  chemically synthesized
ccttttggcccaaaatgttagg

SEQ ID NO: 851620 - DNA, 22 bp, Artificial Sequence
  chemically synthesized
aaacacttccttttggcccaaa

SEQ ID NO: 851621 - DNA, 22 bp, Artificial Sequence
  chemically synthesized
caaacacttccttttggcccaa

SEQ ID NO: 851622 - DNA, 22 bp, Artificial Sequence
  chemically synthesized
ccttcaaacacttccttttggc

SEQ ID NO: 851623 - DNA, 22 bp, Artificial Sequence
  chemically synthesized
acattttgggccaaaaggaagt

SEQ ID NO: 851624 - DNA, 22 bp, Artificial Sequence
  chemically synthesized
tgggccaaaaggaagtgtttga

SEQ ID NO: 851625 - DNA, 22 bp, Artificial Sequence
  chemically synthesized
accaaattgccttcaaacactt

SEQ ID NO: 851626 - DNA, 22 bp, Artificial Sequence
  chemically synthesized
gggccaaaaggaagtgtttgaa

SEQ ID NO: 851627 - DNA, 22 bp, Artificial Sequence
  chemically synthesized
gaccaaattgccttcaaacact

SEQ ID NO: 851628 - DNA, 22 bp, Artificial Sequence
  chemically synthesized
ggccaaaaggaagtgtttgaag

SEQ ID NO: 851629 - DNA, 22 bp, Artificial Sequence
  chemically synthesized
tgaccaaattgccttcaaacac

SEQ ID NO: 851630 - DNA, 22 bp, Artificial Sequence
  chemically synthesized
gctttgaccaaattgccttcaa

SEQ ID NO: 851631 - DNA, 22 bp, Artificial Sequence
  chemically synthesized
ggctttgaccaaattgccttca

SEQ ID NO: 851632 - DNA, 22 bp, Artificial Sequence
  chemically synthesized
gaaggcaatttggtcaaagcca

SEQ ID NO: 851633 - DNA, 22 bp, Artificial Sequence
  chemically synthesized
aaggcaatttggtcaaagccaa

SEQ ID NO: 851634 - DNA, 22 bp, Artificial Sequence
  chemically synthesized
aacatacagtgtttggctttga

SEQ ID NO: 851635 - DNA, 22 bp, Artificial Sequence
  chemically synthesized
aaacatacagtgtttggctttg

SEQ ID NO: 851636 - DNA, 22 bp, Artificial Sequence
  chemically synthesized
tttaaacatacagtgtttggct

SEQ ID NO: 851637 - DNA, 22 bp, Artificial Sequence
  chemically synthesized
ggtcaaagccaaacactgtatg

SEQ ID NO: 851638 - DNA, 22 bp, Artificial Sequence
  chemically synthesized
gtcaaagccaaacactgtatgt

SEQ ID NO: 851639 - DNA, 22 bp, Artificial Sequence
  chemically synthesized
cccaaccatcattatttaaaca

SEQ ID NO: 851640 - DNA, 22 bp, Artificial Sequence
  chemically synthesized
ttgcccaaccatcattatttaa

SEQ ID NO: 851641 - DNA, 22 bp, Artificial Sequence
  chemically synthesized
tatgtttaaataatgatggttg

SEQ ID NO: 851642 - DNA, 22 bp, Artificial Sequence
  chemically synthesized
aaataatgatggttgggcaaca

SEQ ID NO: 851643 - DNA, 22 bp, Artificial Sequence
  chemically synthesized
aagacatagcattgttgcccaa

SEQ ID NO: 851644 - DNA, 22 bp, Artificial Sequence
  chemically synthesized
aataatgatggttgggcaacaa

SEQ ID NO: 851645 - DNA, 22 bp, Artificial Sequence
  chemically synthesized
aaagacatagcattgttgccca

SEQ ID NO: 851646 - DNA, 22 bp, Artificial Sequence
  chemically synthesized
ggcaacaatgctatgtctttaa

SEQ ID NO: 851647 - DNA, 22 bp, Artificial Sequence
  chemically synthesized
aaaaatggaaagaaatgcttaa

SEQ ID NO: 851648 - DNA, 22 bp, Artificial Sequence
  chemically synthesized
gaaaaatggaaagaaatgctta

SEQ ID NO: 851649 - DNA, 22 bp, Artificial Sequence
  chemically synthesized
tgaaaaatggaaagaaatgctt

SEQ ID NO: 851650 - DNA, 22 bp, Artificial Sequence
  chemically synthesized
tgtctttaagcatttctttcca

SEQ ID NO: 851651 - DNA, 22 bp, Artificial Sequence
  chemically synthesized
taagcatttctttccatttttc

SEQ ID NO: 851652 - DNA, 22 bp, Artificial Sequence
  chemically synthesized
aagcatttctttccatttttca

SEQ ID NO: 851653 - DNA, 22 bp, Artificial Sequence
  chemically synthesized
agcatttctttccatttttcaa

SEQ ID NO: 851654 - DNA, 22 bp, Artificial Sequence
  chemically synthesized
ctttccatttttcaaaatctgc

SEQ ID NO: 851655 - DNA, 22 bp, Artificial Sequence
  chemically synthesized
tttccatttttcaaaatctgct

SEQ ID NO: 851656 - DNA, 22 bp, Artificial Sequence
  chemically synthesized
tgaataagaaagagcagatttt

SEQ ID NO: 851657 - DNA, 22 bp, Artificial Sequence
  chemically synthesized
tccatttttcaaaatctgctct

SEQ ID NO: 851658 - DNA, 22 bp, Artificial Sequence
  chemically synthesized
ccatttttcaaaatctgctctt

SEQ ID NO: 851659 - DNA, 22 bp, Artificial Sequence
  chemically synthesized
catttttcaaaatctgctcttt

SEQ ID NO: 851660 - DNA, 22 bp, Artificial Sequence
  chemically synthesized
ttcaaaatctgctctttcttat

SEQ ID NO: 851661 - DNA, 22 bp, Artificial Sequence
  chemically synthesized
tcaaaatctgctctttcttatt

SEQ ID NO: 851662 - DNA, 22 bp, Artificial Sequence
  chemically synthesized
caaaatctgctctttcttattc

SEQ ID NO: 851663 - DNA, 22 bp, Artificial Sequence
  chemically synthesized
aaaatctgctctttcttattca

SEQ ID NO: 851664 - DNA, 22 bp, Artificial Sequence
  chemically synthesized
aatagtagaaataattgtgaat

SEQ ID NO: 851665 - DNA, 22 bp, Artificial Sequence
  chemically synthesized
ctctttcttattcacaattatt

SEQ ID NO: 851666 - DNA, 22 bp, Artificial Sequence
  chemically synthesized
tttcttattcacaattatttct

SEQ ID NO: 851667 - DNA, 22 bp, Artificial Sequence
  chemically synthesized
tcttattcacaattatttctac

SEQ ID NO: 851668 - DNA, 22 bp, Artificial Sequence
  chemically synthesized
aaatattaaatagtagaaataa

SEQ ID NO: 851669 - DNA, 22 bp, Artificial Sequence
  chemically synthesized
cttattcacaattatttctact

SEQ ID NO: 851670 - DNA, 22 bp, Artificial Sequence
  chemically synthesized
ttattcacaattatttctacta

SEQ ID NO: 851671 - DNA, 22 bp, Artificial Sequence
  chemically synthesized
attcacaattatttctactatt

SEQ ID NO: 851672 - DNA, 22 bp, Artificial Sequence
  chemically synthesized
ttcacaattatttctactattt

SEQ ID NO: 851673 - DNA, 22 bp, Artificial Sequence
  chemically synthesized
ccattaaaatattaaatagtag

SEQ ID NO: 851674 - DNA, 22 bp, Artificial Sequence
  chemically synthesized
cccattaaaatattaaatagta

SEQ ID NO: 851675 - DNA, 22 bp, Artificial Sequence
  chemically synthesized
acaattatttctactatttaat

SEQ ID NO: 851676 - DNA, 22 bp, Artificial Sequence
  chemically synthesized
ttcccattaaaatattaaatag

SEQ ID NO: 851677 - DNA, 22 bp, Artificial Sequence
  chemically synthesized
tttctactatttaatattttaa

SEQ ID NO: 851678 - DNA, 22 bp, Artificial Sequence
  chemically synthesized
tccaactcttcccattaaaata

SEQ ID NO: 851679 - DNA, 22 bp, Artificial Sequence
  chemically synthesized
ctactatttaatattttaatgg

SEQ ID NO: 851680 - DNA, 22 bp, Artificial Sequence
  chemically synthesized
atccaactcttcccattaaaat

SEQ ID NO: 851681 - DNA, 22 bp, Artificial Sequence
  chemically synthesized
tactatttaatattttaatggg

SEQ ID NO: 851682 - DNA, 22 bp, Artificial Sequence
  chemically synthesized
ctatttaatattttaatgggaa

SEQ ID NO: 851683 - DNA, 22 bp, Artificial Sequence
  chemically synthesized
ggtttatccaactcttcccatt

SEQ ID NO: 851684 - DNA, 22 bp, Artificial Sequence
  chemically synthesized
tttaatattttaatgggaagag

SEQ ID NO: 851685 - DNA, 22 bp, Artificial Sequence
  chemically synthesized
aggtttatccaactcttcccat

SEQ ID NO: 851686 - DNA, 22 bp, Artificial Sequence
  chemically synthesized
aatattttaatgggaagagttg

SEQ ID NO: 851687 - DNA, 22 bp, Artificial Sequence
  chemically synthesized
atattttaatgggaagagttgg

SEQ ID NO: 851688 - DNA, 22 bp, Artificial Sequence
  chemically synthesized
cacatttaggtttatccaactc

SEQ ID NO: 851689 - DNA, 22 bp, Artificial Sequence
  chemically synthesized
taatgggaagagttggataaac

SEQ ID NO: 851690 - DNA, 22 bp, Artificial Sequence
  chemically synthesized
aatgggaagagttggataaacc

SEQ ID NO: 851691 - DNA, 22 bp, Artificial Sequence
  chemically synthesized
atgggaagagttggataaacct

SEQ ID NO: 851692 - DNA, 22 bp, Artificial Sequence
  chemically synthesized
gataaacctaaatgtgcagcat

SEQ ID NO: 851693 - DNA, 22 bp, Artificial Sequence
  chemically synthesized
tgaaaagaatcccaatgctgca

SEQ ID NO: 851694 - DNA, 22 bp, Artificial Sequence
  chemically synthesized
aatgtgcagcattgggattctt

SEQ ID NO: 851695 - DNA, 22 bp, Artificial Sequence
  chemically synthesized
agtgatcactatgaaaagaatc

SEQ ID NO: 851696 - DNA, 22 bp, Artificial Sequence
  chemically synthesized
aagtgatcactatgaaaagaat

SEQ ID NO: 851697 - DNA, 22 bp, Artificial Sequence
  chemically synthesized
taagtgatcactatgaaaagaa

SEQ ID NO: 851698 - DNA, 22 bp, Artificial Sequence
  chemically synthesized
ggattcttttcatagtgatcac

SEQ ID NO: 851699 - DNA, 22 bp, Artificial Sequence
  chemically synthesized
ttttcatagtgatcacttaaag

SEQ ID NO: 851700 - DNA, 22 bp, Artificial Sequence
  chemically synthesized
ttcatagtgatcacttaaagtt

SEQ ID NO: 851701 - DNA, 22 bp, Artificial Sequence
  chemically synthesized
tcatagtgatcacttaaagttt

SEQ ID NO: 851702 - DNA, 22 bp, Artificial Sequence
  chemically synthesized
catagtgatcacttaaagtttg

SEQ ID NO: 851703 - DNA, 22 bp, Artificial Sequence
  chemically synthesized
atagtgatcacttaaagtttgt

SEQ ID NO: 851704 - DNA, 22 bp, Artificial Sequence
  chemically synthesized
aaagtttgttttgctttttttt

SEQ ID NO: 851705 - DNA, 22 bp, Artificial Sequence
  chemically synthesized
atataaggtaaaaaaaaaaagc

SEQ ID NO: 851706 - DNA, 22 bp, Artificial Sequence
  chemically synthesized
aagtttgttttgcttttttttt

SEQ ID NO: 851707 - DNA, 22 bp, Artificial Sequence
  chemically synthesized
gatataaggtaaaaaaaaaaag

SEQ ID NO: 851708 - DNA, 22 bp, Artificial Sequence
  chemically synthesized
ttgatataaggtaaaaaaaaaa

SEQ ID NO: 851709 - DNA, 22 bp, Artificial Sequence
  chemically synthesized
cttgatataaggtaaaaaaaaa

SEQ ID NO: 851710 - DNA, 22 bp, Artificial Sequence
  chemically synthesized
gttttgctttttttttttacct

SEQ ID NO: 851711 - DNA, 22 bp, Artificial Sequence
  chemically synthesized
tttcttgatataaggtaaaaaa

SEQ ID NO: 851712 - DNA, 22 bp, Artificial Sequence
  chemically synthesized
ttttgctttttttttttacctt

SEQ ID NO: 851713 - DNA, 22 bp, Artificial Sequence
  chemically synthesized
tgctttttttttttaccttata

SEQ ID NO: 851714 - DNA, 22 bp, Artificial Sequence
  chemically synthesized
gctttttttttttaccttatat

SEQ ID NO: 851715 - DNA, 22 bp, Artificial Sequence
  chemically synthesized
ctttttttttttaccttatatc

SEQ ID NO: 851716 - DNA, 22 bp, Artificial Sequence
  chemically synthesized
tatattatttcttgatataagg

SEQ ID NO: 851717 - DNA, 22 bp, Artificial Sequence
  chemically synthesized
tttttttttaccttatatcaag

SEQ ID NO: 851718 - DNA, 22 bp, Artificial Sequence
  chemically synthesized
ttttttttaccttatatcaaga

SEQ ID NO: 851719 - DNA, 22 bp, Artificial Sequence
  chemically synthesized
tttttttaccttatatcaagaa

SEQ ID NO: 851720 - DNA, 22 bp, Artificial Sequence
  chemically synthesized
gttatatattatttcttgatat

SEQ ID NO: 851721 - DNA, 22 bp, Artificial Sequence
  chemically synthesized
ttttttaccttatatcaagaaa

SEQ ID NO: 851722 - DNA, 22 bp, Artificial Sequence
  chemically synthesized
tttttaccttatatcaagaaat

SEQ ID NO: 851723 - DNA, 22 bp, Artificial Sequence
  chemically synthesized
ttttaccttatatcaagaaata

SEQ ID NO: 851724 - DNA, 22 bp, Artificial Sequence
  chemically synthesized
tttaccttatatcaagaaataa

SEQ ID NO: 851725 - DNA, 22 bp, Artificial Sequence
  chemically synthesized
ttaccttatatcaagaaataat

SEQ ID NO: 851726 - DNA, 22 bp, Artificial Sequence
  chemically synthesized
taccttatatcaagaaataata

SEQ ID NO: 851727 - DNA, 22 bp, Artificial Sequence
  chemically synthesized
accttatatcaagaaataatat

SEQ ID NO: 851728 - DNA, 22 bp, Artificial Sequence
  chemically synthesized
tgtattggttatatattatttc

SEQ ID NO: 851729 - DNA, 22 bp, Artificial Sequence
  chemically synthesized
ccttatatcaagaaataatata

SEQ ID NO: 851730 - DNA, 22 bp, Artificial Sequence
  chemically synthesized
atatcaagaaataatatataac

SEQ ID NO: 851731 - DNA, 22 bp, Artificial Sequence
  chemically synthesized
tatcaagaaataatatataacc

SEQ ID NO: 851732 - DNA, 22 bp, Artificial Sequence
  chemically synthesized
atataattatgtattggttata

SEQ ID NO: 851733 - DNA, 22 bp, Artificial Sequence
  chemically synthesized
catataattatgtattggttat

SEQ ID NO: 851734 - DNA, 22 bp, Artificial Sequence
  chemically synthesized
tcatataattatgtattggtta

SEQ ID NO: 851735 - DNA, 22 bp, Artificial Sequence
  chemically synthesized
aagatcgatgttttcatataat

SEQ ID NO: 851736 - DNA, 22 bp, Artificial Sequence
  chemically synthesized
aaagatcgatgttttcatataa

SEQ ID NO: 851737 - DNA, 22 bp, Artificial Sequence
  chemically synthesized
taaagatcgatgttttcatata

SEQ ID NO: 851738 - DNA, 22 bp, Artificial Sequence
  chemically synthesized
ttttaaagatcgatgttttcat

SEQ ID NO: 851739 - DNA, 22 bp, Artificial Sequence
  chemically synthesized
tgctattttaaagatcgatgtt

SEQ ID NO: 851740 - DNA, 22 bp, Artificial Sequence
  chemically synthesized
atgctattttaaagatcgatgt

SEQ ID NO: 851741 - DNA, 22 bp, Artificial Sequence
  chemically synthesized
tttatgctattttaaagatcga

SEQ ID NO: 851742 - DNA, 22 bp, Artificial Sequence
  chemically synthesized
tatgaaaacatcgatctttaaa

SEQ ID NO: 851743 - DNA, 22 bp, Artificial Sequence
  chemically synthesized
atgttatttatgctattttaaa

SEQ ID NO: 851744 - DNA, 22 bp, Artificial Sequence
  chemically synthesized
ttgatgttatttatgctatttt

SEQ ID NO: 851745 - DNA, 22 bp, Artificial Sequence
  chemically synthesized
taaaatagcataaataacatca

SEQ ID NO: 851746 - DNA, 22 bp, Artificial Sequence
  chemically synthesized
aaaatagcataaataacatcaa

SEQ ID NO: 851747 - DNA, 22 bp, Artificial Sequence
  chemically synthesized
aaatagcataaataacatcaac

SEQ ID NO: 851748 - DNA, 22 bp, Artificial Sequence
  chemically synthesized
tatacacatagggaaggattgt

SEQ ID NO: 851749 - DNA, 22 bp, Artificial Sequence
  chemically synthesized
atatacacatagggaaggattg

SEQ ID NO: 851750 - DNA, 22 bp, Artificial Sequence
  chemically synthesized
tatatacacatagggaaggatt

SEQ ID NO: 851751 - DNA, 22 bp, Artificial Sequence
  chemically synthesized
tgaatattttatatacacatag

SEQ ID NO: 851752 - DNA, 22 bp, Artificial Sequence
  chemically synthesized
ccctatgtgtatataaaatatt

SEQ ID NO: 851753 - DNA, 22 bp, Artificial Sequence
  chemically synthesized
cctatgtgtatataaaatattc

SEQ ID NO: 851754 - DNA, 22 bp, Artificial Sequence
  chemically synthesized
tgtgtatataaaatattcatag

SEQ ID NO: 851755 - DNA, 22 bp, Artificial Sequence
  chemically synthesized
gaaacacacaccacatatatat

SEQ ID NO: 851756 - DNA, 22 bp, Artificial Sequence
  chemically synthesized
agaaacacacaccacatatata

SEQ ID NO: 851757 - DNA, 22 bp, Artificial Sequence
  chemically synthesized
tagaaacacacaccacatatat

SEQ ID NO: 851758 - DNA, 22 bp, Artificial Sequence
  chemically synthesized
ttagaaacacacaccacatata

SEQ ID NO: 851759 - DNA, 22 bp, Artificial Sequence
  chemically synthesized
cttttagaaacacacaccacat

SEQ ID NO: 851760 - DNA, 22 bp, Artificial Sequence
  chemically synthesized
atagatatatatgtggtgtgtg

SEQ ID NO: 851761 - DNA, 22 bp, Artificial Sequence
  chemically synthesized
tatacccaaacacacatatatt

SEQ ID NO: 851762 - DNA, 22 bp, Artificial Sequence
  chemically synthesized
ttatatacccaaacacacatat

SEQ ID NO: 851763 - DNA, 22 bp, Artificial Sequence
  chemically synthesized
ctaaaagtaatatatgtgtgtt

SEQ ID NO: 851764 - DNA, 22 bp, Artificial Sequence
  chemically synthesized
attatatacccaaacacacata

SEQ ID NO: 851765 - DNA, 22 bp, Artificial Sequence
  chemically synthesized
taaaagtaatatatgtgtgttt

SEQ ID NO: 851766 - DNA, 22 bp, Artificial Sequence
  chemically synthesized
aaagtaatatatgtgtgtttgg

SEQ ID NO: 851767 - DNA, 22 bp, Artificial Sequence
  chemically synthesized
caatatttattatatacccaaa

SEQ ID NO: 851768 - DNA, 22 bp, Artificial Sequence
  chemically synthesized
ttgcaatatttattatataccc

SEQ ID NO: 851769 - DNA, 22 bp, Artificial Sequence
  chemically synthesized
gttgcaatatttattatatacc

SEQ ID NO: 851770 - DNA, 22 bp, Artificial Sequence
  chemically synthesized
tgttgcaatatttattatatac

SEQ ID NO: 851771 - DNA, 22 bp, Artificial Sequence
  chemically synthesized
ttgttgcaatatttattatata

SEQ ID NO: 851772 - DNA, 22 bp, Artificial Sequence
  chemically synthesized
tttttgttgcaatatttattat

SEQ ID NO: 851773 - DNA, 22 bp, Artificial Sequence
  chemically synthesized
gggtatataataaatattgcaa

SEQ ID NO: 851774 - DNA, 22 bp, Artificial Sequence
  chemically synthesized
ggtatataataaatattgcaac

SEQ ID NO: 851775 - DNA, 22 bp, Artificial Sequence
  chemically synthesized
catgatattgtttttgttgcaa

SEQ ID NO: 851776 - DNA, 22 bp, Artificial Sequence
  chemically synthesized
caacaaaaacaatatcatgtag

SEQ ID NO: 851777 - DNA, 22 bp, Artificial Sequence
  chemically synthesized
aaaccagtatgtactacatgat

SEQ ID NO: 851778 - DNA, 22 bp, Artificial Sequence
  chemically synthesized
caaaccagtatgtactacatga

SEQ ID NO: 851779 - DNA, 22 bp, Artificial Sequence
  chemically synthesized
gagtatagtgaggagagcacct

SEQ ID NO: 851780 - DNA, 22 bp, Artificial Sequence
  chemically synthesized
gtttgaaggtgctctcctcact

SEQ ID NO: 851781 - DNA, 22 bp, Artificial Sequence
  chemically synthesized
gaaggtgctctcctcactatac

SEQ ID NO: 851782 - DNA, 22 bp, Artificial Sequence
  chemically synthesized
aaggtgctctcctcactatact

SEQ ID NO: 851783 - DNA, 22 bp, Artificial Sequence
  chemically synthesized
tggtgtgtaaattggagtatag

SEQ ID NO: 851784 - DNA, 22 bp, Artificial Sequence
  chemically synthesized
tcctcactatactccaatttac

SEQ ID NO: 851785 - DNA, 22 bp, Artificial Sequence
  chemically synthesized
ctcactatactccaatttacac

SEQ ID NO: 851786 - DNA, 22 bp, Artificial Sequence
  chemically synthesized
aaatagattgtggtgtgtaaat

SEQ ID NO: 851787 - DNA, 22 bp, Artificial Sequence
  chemically synthesized
actatactccaatttacacacc

SEQ ID NO: 851788 - DNA, 22 bp, Artificial Sequence
  chemically synthesized
tactccaatttacacaccacaa

SEQ ID NO: 851789 - DNA, 22 bp, Artificial Sequence
  chemically synthesized
caatttacacaccacaatctat

SEQ ID NO: 851790 - DNA, 22 bp, Artificial Sequence
  chemically synthesized
gtgggatgctgaaatagattgt

SEQ ID NO: 851791 - DNA, 22 bp, Artificial Sequence
  chemically synthesized
agtgggatgctgaaatagattg

SEQ ID NO: 851792 - DNA, 22 bp, Artificial Sequence
  chemically synthesized
acacaccacaatctatttcagc

SEQ ID NO: 851793 - DNA, 22 bp, Artificial Sequence
  chemically synthesized
cacaccacaatctatttcagca

SEQ ID NO: 851794 - DNA, 22 bp, Artificial Sequence
  chemically synthesized
cccaaaatttagtgggatgctg

SEQ ID NO: 851795 - DNA, 22 bp, Artificial Sequence
  chemically synthesized
aattgcccaaaatttagtggga

SEQ ID NO: 851796 - DNA, 22 bp, Artificial Sequence
  chemically synthesized
tttcagcatcccactaaatttt

SEQ ID NO: 851797 - DNA, 22 bp, Artificial Sequence
  chemically synthesized
cagcatcccactaaattttggg

SEQ ID NO: 851798 - DNA, 22 bp, Artificial Sequence
  chemically synthesized
agcatcccactaaattttgggc

SEQ ID NO: 851799 - DNA, 22 bp, Artificial Sequence
  chemically synthesized
gcaggaaaaaattaaattgccc

SEQ ID NO: 851800 - DNA, 22 bp, Artificial Sequence
  chemically synthesized
aattttgggcaatttaattttt

SEQ ID NO: 851801 - DNA, 22 bp, Artificial Sequence
  chemically synthesized
tgggcaatttaattttttcctg

SEQ ID NO: 851802 - DNA, 22 bp, Artificial Sequence
  chemically synthesized
gggcaatttaattttttcctgc

SEQ ID NO: 851803 - DNA, 22 bp, Artificial Sequence
  chemically synthesized
aaatagggactagcaggaaaaa

SEQ ID NO: 851804 - DNA, 22 bp, Artificial Sequence
  chemically synthesized
ggcaatttaattttttcctgct

SEQ ID NO: 851805 - DNA, 22 bp, Artificial Sequence
  chemically synthesized
caaatagggactagcaggaaaa

SEQ ID NO: 851806 - DNA, 22 bp, Artificial Sequence
  chemically synthesized
tttcaaatagggactagcagga

SEQ ID NO: 851807 - DNA, 22 bp, Artificial Sequence
  chemically synthesized
attatttcaaatagggactagc

SEQ ID NO: 851808 - DNA, 22 bp, Artificial Sequence
  chemically synthesized
aattttttcctgctagtcccta

SEQ ID NO: 851809 - DNA, 22 bp, Artificial Sequence
  chemically synthesized
attttttcctgctagtccctat

SEQ ID NO: 851810 - DNA, 22 bp, Artificial Sequence
  chemically synthesized
tttcctgctagtccctatttga

SEQ ID NO: 851811 - DNA, 22 bp, Artificial Sequence
  chemically synthesized
ttcctgctagtccctatttgaa

SEQ ID NO: 851812 - DNA, 22 bp, Artificial Sequence
  chemically synthesized
tcctgctagtccctatttgaaa

SEQ ID NO: 851813 - DNA, 22 bp, Artificial Sequence
  chemically synthesized
cctgctagtccctatttgaaat

SEQ ID NO: 851814 - DNA, 22 bp, Artificial Sequence
  chemically synthesized
ctgctagtccctatttgaaata

SEQ ID NO: 851815 - DNA, 22 bp, Artificial Sequence
  chemically synthesized
cagataagctcattatttcaaa

SEQ ID NO: 851816 - DNA, 22 bp, Artificial Sequence
  chemically synthesized
ctagtccctatttgaaataatg

SEQ ID NO: 851817 - DNA, 22 bp, Artificial Sequence
  chemically synthesized
actacagataagctcattattt

SEQ ID NO: 851818 - DNA, 22 bp, Artificial Sequence
  chemically synthesized
gtccctatttgaaataatgagc

SEQ ID NO: 851819 - DNA, 22 bp, Artificial Sequence
  chemically synthesized
cactacagataagctcattatt

SEQ ID NO: 851820 - DNA, 22 bp, Artificial Sequence
  chemically synthesized
tcactacagataagctcattat

SEQ ID NO: 851821 - DNA, 22 bp, Artificial Sequence
  chemically synthesized
ttcactacagataagctcatta

SEQ ID NO: 851822 - DNA, 22 bp, Artificial Sequence
  chemically synthesized
tttgaaataatgagcttatctg

SEQ ID NO: 851823 - DNA, 22 bp, Artificial Sequence
  chemically synthesized
cagcttttcactacagataagc

SEQ ID NO: 851824 - DNA, 22 bp, Artificial Sequence
  chemically synthesized
acagcttttcactacagataag

SEQ ID NO: 851825 - DNA, 22 bp, Artificial Sequence
  chemically synthesized
gaaataatgagcttatctgtag

SEQ ID NO: 851826 - DNA, 22 bp, Artificial Sequence
  chemically synthesized
aaataatgagcttatctgtagt

SEQ ID NO: 851827 - DNA, 22 bp, Artificial Sequence
  chemically synthesized
ggcagcatatttacagcttttc

SEQ ID NO: 851828 - DNA, 22 bp, Artificial Sequence
  chemically synthesized
atctgtagtgaaaagctgtaaa

SEQ ID NO: 851829 - DNA, 22 bp, Artificial Sequence
  chemically synthesized
tctgtagtgaaaagctgtaaat

SEQ ID NO: 851830 - DNA, 22 bp, Artificial Sequence
  chemically synthesized
tagtgaaaagctgtaaatatgc

SEQ ID NO: 851831 - DNA, 22 bp, Artificial Sequence
  chemically synthesized
caaaggggaatctaggcagcat

SEQ ID NO: 851832 - DNA, 22 bp, Artificial Sequence
  chemically synthesized
ccaaaggggaatctaggcagca

SEQ ID NO: 851833 - DNA, 22 bp, Artificial Sequence
  chemically synthesized
atttccaaaggggaatctaggc

SEQ ID NO: 851834 - DNA, 22 bp, Artificial Sequence
  chemically synthesized
catttccaaaggggaatctagg

SEQ ID NO: 851835 - DNA, 22 bp, Artificial Sequence
  chemically synthesized
taaatatgctgcctagattccc

SEQ ID NO: 851836 - DNA, 22 bp, Artificial Sequence
  chemically synthesized
agtccttcatttccaaagggga

SEQ ID NO: 851837 - DNA, 22 bp, Artificial Sequence
  chemically synthesized
cctagattcccctttggaaatg

SEQ ID NO: 851838 - DNA, 22 bp, Artificial Sequence
  chemically synthesized
gggaactaagtccttcatttcc

SEQ ID NO: 851839 - DNA, 22 bp, Artificial Sequence
  chemically synthesized
gattcccctttggaaatgaagg

SEQ ID NO: 851840 - DNA, 22 bp, Artificial Sequence
  chemically synthesized
ccctttggaaatgaaggactta

SEQ ID NO: 851841 - DNA, 22 bp, Artificial Sequence
  chemically synthesized
gcagctggggaactaagtcctt

SEQ ID NO: 851842 - DNA, 22 bp, Artificial Sequence
  chemically synthesized
ctagcagctggggaactaagtc

SEQ ID NO: 851843 - DNA, 22 bp, Artificial Sequence
  chemically synthesized
tggaaatgaaggacttagttcc

SEQ ID NO: 851844 - DNA, 22 bp, Artificial Sequence
  chemically synthesized
ggaaatgaaggacttagttccc

SEQ ID NO: 851845 - DNA, 22 bp, Artificial Sequence
  chemically synthesized
gaaatgaaggacttagttcccc

SEQ ID NO: 851846 - DNA, 22 bp, Artificial Sequence
  chemically synthesized
ccagcagcactcctagcagctg

SEQ ID NO: 851847 - DNA, 22 bp, Artificial Sequence
  chemically synthesized
tctaccagcagcactcctagca

SEQ ID NO: 851848 - DNA, 22 bp, Artificial Sequence
  chemically synthesized
agttccccagctgctaggagtg

SEQ ID NO: 851849 - DNA, 22 bp, Artificial Sequence
  chemically synthesized
gttccccagctgctaggagtgc

SEQ ID NO: 851850 - DNA, 22 bp, Artificial Sequence
  chemically synthesized
cccagctgctaggagtgctgct

SEQ ID NO: 851851 - DNA, 22 bp, Artificial Sequence
  chemically synthesized
aaggctgtctaccagcagcact

SEQ ID NO: 851852 - DNA, 22 bp, Artificial Sequence
  chemically synthesized
ctaggagtgctgctggtagaca

SEQ ID NO: 851853 - DNA, 22 bp, Artificial Sequence
  chemically synthesized
acagctgaaggctgtctaccag

SEQ ID NO: 851854 - DNA, 22 bp, Artificial Sequence
  chemically synthesized
ggagtgctgctggtagacagcc

SEQ ID NO: 851855 - DNA, 22 bp, Artificial Sequence
  chemically synthesized
ctggtagacagccttcagctgt

SEQ ID NO: 851856 - DNA, 22 bp, Artificial Sequence
  chemically synthesized
agacaagggctgacagctgaag

SEQ ID NO: 851857 - DNA, 22 bp, Artificial Sequence
  chemically synthesized
gtagacagccttcagctgtcag

SEQ ID NO: 851858 - DNA, 22 bp, Artificial Sequence
  chemically synthesized
cagctgtcagcccttgtcttag

SEQ ID NO: 851859 - DNA, 22 bp, Artificial Sequence
  chemically synthesized
tagcggcccagactaagacaag

SEQ ID NO: 851860 - DNA, 22 bp, Artificial Sequence
  chemically synthesized
agctgtcagcccttgtcttagt

SEQ ID NO: 851861 - DNA, 22 bp, Artificial Sequence
  chemically synthesized
gctatagcggcccagactaaga

SEQ ID NO: 851862 - DNA, 22 bp, Artificial Sequence
  chemically synthesized
agctatagcggcccagactaag

SEQ ID NO: 851863 - DNA, 22 bp, Artificial Sequence
  chemically synthesized
tcagcccttgtcttagtctggg

SEQ ID NO: 851864 - DNA, 22 bp, Artificial Sequence
  chemically synthesized
aggtatttagctatagcggccc

SEQ ID NO: 851865 - DNA, 22 bp, Artificial Sequence
  chemically synthesized
gtcttagtctgggccgctatag

SEQ ID NO: 851866 - DNA, 22 bp, Artificial Sequence
  chemically synthesized
tcttagtctgggccgctatagc

SEQ ID NO: 851867 - DNA, 22 bp, Artificial Sequence
  chemically synthesized
agtctgggccgctatagctaaa

SEQ ID NO: 851868 - DNA, 22 bp, Artificial Sequence
  chemically synthesized
gtctgggccgctatagctaaat

SEQ ID NO: 851869 - DNA, 22 bp, Artificial Sequence
  chemically synthesized
cccagtctaaggtatttagcta

SEQ ID NO: 851870 - DNA, 22 bp, Artificial Sequence
  chemically synthesized
ggccgctatagctaaatacctt

SEQ ID NO: 851871 - DNA, 22 bp, Artificial Sequence
  chemically synthesized
taaattacccagtctaaggtat

SEQ ID NO: 851872 - DNA, 22 bp, Artificial Sequence
  chemically synthesized
ataaattacccagtctaaggta

SEQ ID NO: 851873 - DNA, 22 bp, Artificial Sequence
  chemically synthesized
tttataaattacccagtctaag

SEQ ID NO: 851874 - DNA, 22 bp, Artificial Sequence
  chemically synthesized
tagctaaataccttagactggg

SEQ ID NO: 851875 - DNA, 22 bp, Artificial Sequence
  chemically synthesized
ttgtttataaattacccagtct

SEQ ID NO: 851876 - DNA, 22 bp, Artificial Sequence
  chemically synthesized
tgttgtttataaattacccagt

SEQ ID NO: 851877 - DNA, 22 bp, Artificial Sequence
  chemically synthesized
aataccttagactgggtaattt

SEQ ID NO: 851878 - DNA, 22 bp, Artificial Sequence
  chemically synthesized
agactgggtaatttataaacaa

SEQ ID NO: 851879 - DNA, 22 bp, Artificial Sequence
  chemically synthesized
gactgggtaatttataaacaac

SEQ ID NO: 851880 - DNA, 22 bp, Artificial Sequence
  chemically synthesized
taagcaataaattctgttgttt

SEQ ID NO: 851881 - DNA, 22 bp, Artificial Sequence
  chemically synthesized
ggtaatttataaacaacagaat

SEQ ID NO: 851882 - DNA, 22 bp, Artificial Sequence
  chemically synthesized
cagaactataagcaataaattc

SEQ ID NO: 851883 - DNA, 22 bp, Artificial Sequence
  chemically synthesized
ataaacaacagaatttattgct

SEQ ID NO: 851884 - DNA, 22 bp, Artificial Sequence
  chemically synthesized
taaacaacagaatttattgctt

SEQ ID NO: 851885 - DNA, 22 bp, Artificial Sequence
  chemically synthesized
ccagcctccagaactataagca

SEQ ID NO: 851886 - DNA, 22 bp, Artificial Sequence
  chemically synthesized
gaattcccagcctccagaacta

SEQ ID NO: 851887 - DNA, 22 bp, Artificial Sequence
  chemically synthesized
ggaattcccagcctccagaact

SEQ ID NO: 851888 - DNA, 22 bp, Artificial Sequence
  chemically synthesized
attgcttatagttctggaggct

SEQ ID NO: 851889 - DNA, 22 bp, Artificial Sequence
  chemically synthesized
ttgcttatagttctggaggctg

SEQ ID NO: 851890 - DNA, 22 bp, Artificial Sequence
  chemically synthesized
atcttggaattcccagcctcca

SEQ ID NO: 851891 - DNA, 22 bp, Artificial Sequence
  chemically synthesized
gatcttggaattcccagcctcc

SEQ ID NO: 851892 - DNA, 22 bp, Artificial Sequence
  chemically synthesized
cttatagttctggaggctggga

SEQ ID NO: 851893 - DNA, 22 bp, Artificial Sequence
  chemically synthesized
atagttctggaggctgggaatt

SEQ ID NO: 851894 - DNA, 22 bp, Artificial Sequence
  chemically synthesized
tagttctggaggctgggaattc

SEQ ID NO: 851895 - DNA, 22 bp, Artificial Sequence
  chemically synthesized
atgtcttgatcttggaattccc

SEQ ID NO: 851896 - DNA, 22 bp, Artificial Sequence
  chemically synthesized
ctgatgtcttgatcttggaatt

SEQ ID NO: 851897 - DNA, 22 bp, Artificial Sequence
  chemically synthesized
tggaggctgggaattccaagat

SEQ ID NO: 851898 - DNA, 22 bp, Artificial Sequence
  chemically synthesized
gaggctgggaattccaagatca

SEQ ID NO: 851899 - DNA, 22 bp, Artificial Sequence
  chemically synthesized
ggaattccaagatcaagacatc

SEQ ID NO: 851900 - DNA, 22 bp, Artificial Sequence
  chemically synthesized
caagatcaagacatcagcagat

SEQ ID NO: 851901 - DNA, 22 bp, Artificial Sequence
  chemically synthesized
accagacaatgaatctgctgat

SEQ ID NO: 851902 - DNA, 22 bp, Artificial Sequence
  chemically synthesized
acaggagtgggccctcaccaga

SEQ ID NO: 851903 - DNA, 22 bp, Artificial Sequence
  chemically synthesized
aacaggagtgggccctcaccag

SEQ ID NO: 851904 - DNA, 22 bp, Artificial Sequence
  chemically synthesized
attgtctggtgagggcccactc

SEQ ID NO: 851905 - DNA, 22 bp, Artificial Sequence
  chemically synthesized
tctggtgagggcccactcctgt

SEQ ID NO: 851906 - DNA, 22 bp, Artificial Sequence
  chemically synthesized
gtgagggcccactcctgttaaa

SEQ ID NO: 851907 - DNA, 22 bp, Artificial Sequence
  chemically synthesized
ctgttaaatggcatcttcggtg

SEQ ID NO: 851908 - DNA, 22 bp, Artificial Sequence
  chemically synthesized
ttaaatggcatcttcggtgtgt

SEQ ID NO: 851909 - DNA, 22 bp, Artificial Sequence
  chemically synthesized
ccaccatgtaaggacacaccga

SEQ ID NO: 851910 - DNA, 22 bp, Artificial Sequence
  chemically synthesized
aatggcatcttcggtgtgtcct

SEQ ID NO: 851911 - DNA, 22 bp, Artificial Sequence
  chemically synthesized
ccctcccaccatgtaaggacac

SEQ ID NO: 851912 - DNA, 22 bp, Artificial Sequence
  chemically synthesized
gccctcccaccatgtaaggaca

SEQ ID NO: 851913 - DNA, 22 bp, Artificial Sequence
  chemically synthesized
cttgccctcccaccatgtaagg

SEQ ID NO: 851914 - DNA, 22 bp, Artificial Sequence
  chemically synthesized
ccttgccctcccaccatgtaag

SEQ ID NO: 851915 - DNA, 22 bp, Artificial Sequence
  chemically synthesized
cggtgtgtccttacatggtggg

SEQ ID NO: 851916 - DNA, 22 bp, Artificial Sequence
  chemically synthesized
ggtgtgtccttacatggtggga

SEQ ID NO: 851917 - DNA, 22 bp, Artificial Sequence
  chemically synthesized
cagaaagcttccttgccctccc

SEQ ID NO: 851918 - DNA, 22 bp, Artificial Sequence
  chemically synthesized
acatggtgggagggcaaggaag

SEQ ID NO: 851919 - DNA, 22 bp, Artificial Sequence
  chemically synthesized
catggtgggagggcaaggaagc

SEQ ID NO: 851920 - DNA, 22 bp, Artificial Sequence
  chemically synthesized
taaaagcggctccagaaagctt

SEQ ID NO: 851921 - DNA, 22 bp, Artificial Sequence
  chemically synthesized
ataaaagcggctccagaaagct

SEQ ID NO: 851922 - DNA, 22 bp, Artificial Sequence
  chemically synthesized
tctggagccgcttttataaggg

SEQ ID NO: 851923 - DNA, 22 bp, Artificial Sequence
  chemically synthesized
ctggagccgcttttataagggc

SEQ ID NO: 851924 - DNA, 22 bp, Artificial Sequence
  chemically synthesized
tggagccgcttttataagggca

SEQ ID NO: 851925 - DNA, 22 bp, Artificial Sequence
  chemically synthesized
gagccgcttttataagggcact

SEQ ID NO: 851926 - DNA, 22 bp, Artificial Sequence
  chemically synthesized
agaaacaggatcagtgccctta

SEQ ID NO: 851927 - DNA, 22 bp, Artificial Sequence
  chemically synthesized
cagaaacaggatcagtgccctt

SEQ ID NO: 851928 - DNA, 22 bp, Artificial Sequence
  chemically synthesized
ccttcagaaacaggatcagtgc

SEQ ID NO: 851929 - DNA, 22 bp, Artificial Sequence
  chemically synthesized
tgccttcagaaacaggatcagt

SEQ ID NO: 851930 - DNA, 22 bp, Artificial Sequence
  chemically synthesized
ttataagggcactgatcctgtt

SEQ ID NO: 851931 - DNA, 22 bp, Artificial Sequence
  chemically synthesized
tataagggcactgatcctgttt

SEQ ID NO: 851932 - DNA, 22 bp, Artificial Sequence
  chemically synthesized
ataagggcactgatcctgtttc

SEQ ID NO: 851933 - DNA, 22 bp, Artificial Sequence
  chemically synthesized
taagggcactgatcctgtttct

SEQ ID NO: 851934 - DNA, 22 bp, Artificial Sequence
  chemically synthesized
ggtcatgcgggctctgccttca

SEQ ID NO: 851935 - DNA, 22 bp, Artificial Sequence
  chemically synthesized
atcctgtttctgaaggcagagc

SEQ ID NO: 851936 - DNA, 22 bp, Artificial Sequence
  chemically synthesized
tttctgaaggcagagcccgcat

SEQ ID NO: 851937 - DNA, 22 bp, Artificial Sequence
  chemically synthesized
ctgaaggcagagcccgcatgac

SEQ ID NO: 851938 - DNA, 22 bp, Artificial Sequence
  chemically synthesized
tgaaggcagagcccgcatgacc

SEQ ID NO: 851939 - DNA, 22 bp, Artificial Sequence
  chemically synthesized
ggggggtgattaggtcatgcgg

SEQ ID NO: 851940 - DNA, 22 bp, Artificial Sequence
  chemically synthesized
gggggggtgattaggtcatgcg

SEQ ID NO: 851941 - DNA, 22 bp, Artificial Sequence
  chemically synthesized
aaggcagagcccgcatgaccta

SEQ ID NO: 851942 - DNA, 22 bp, Artificial Sequence
  chemically synthesized
gaaggtgggggtttgggggggt

SEQ ID NO: 851943 - DNA, 22 bp, Artificial Sequence
  chemically synthesized
atcacccccccaaacccccacc

SEQ ID NO: 851944 - DNA, 22 bp, Artificial Sequence
  chemically synthesized
aaggtgatggtattagaaggtg

SEQ ID NO: 851945 - DNA, 22 bp, Artificial Sequence
  chemically synthesized
acactcaaggtgatggtattag

SEQ ID NO: 851946 - DNA, 22 bp, Artificial Sequence
  chemically synthesized
aaacctaacactcaaggtgatg

SEQ ID NO: 851947 - DNA, 22 bp, Artificial Sequence
  chemically synthesized
ctaataccatcaccttgagtgt

SEQ ID NO: 851948 - DNA, 22 bp, Artificial Sequence
  chemically synthesized
taataccatcaccttgagtgtt

SEQ ID NO: 851949 - DNA, 22 bp, Artificial Sequence
  chemically synthesized
ataccatcaccttgagtgttag

SEQ ID NO: 851950 - DNA, 22 bp, Artificial Sequence
  chemically synthesized
caaaatgtgtatgttgaaacct

SEQ ID NO: 851951 - DNA, 22 bp, Artificial Sequence
  chemically synthesized
gagtgttaggtttcaacataca

SEQ ID NO: 851952 - DNA, 22 bp, Artificial Sequence
  chemically synthesized
agtgttaggtttcaacatacac

SEQ ID NO: 851953 - DNA, 22 bp, Artificial Sequence
  chemically synthesized
tccctccaaaatgtgtatgttg

SEQ ID NO: 851954 - DNA, 22 bp, Artificial Sequence
  chemically synthesized
gtccctccaaaatgtgtatgtt

SEQ ID NO: 851955 - DNA, 22 bp, Artificial Sequence
  chemically synthesized
tgtccctccaaaatgtgtatgt

SEQ ID NO: 851956 - DNA, 22 bp, Artificial Sequence
  chemically synthesized
ttgtccctccaaaatgtgtatg

SEQ ID NO: 851957 - DNA, 22 bp, Artificial Sequence
  chemically synthesized
ggtttcaacatacacattttgg

SEQ ID NO: 851958 - DNA, 22 bp, Artificial Sequence
  chemically synthesized
aatgtttttgtccctccaaaat

SEQ ID NO: 851959 - DNA, 22 bp, Artificial Sequence
  chemically synthesized
caacatacacattttggaggga

SEQ ID NO: 851960 - DNA, 22 bp, Artificial Sequence
  chemically synthesized
aacatacacattttggagggac

SEQ ID NO: 851961 - DNA, 22 bp, Artificial Sequence
  chemically synthesized
tggtctgaatgtttttgtccct

SEQ ID NO: 851962 - DNA, 22 bp, Artificial Sequence
  chemically synthesized
ctatggtctgaatgtttttgtc

SEQ ID NO: 851963 - DNA, 22 bp, Artificial Sequence
  chemically synthesized
tggagggacaaaaacattcaga

SEQ ID NO: 851964 - DNA, 22 bp, Artificial Sequence
  chemically synthesized
ggagggacaaaaacattcagac

SEQ ID NO: 851965 - DNA, 22 bp, Artificial Sequence
  chemically synthesized
gagggacaaaaacattcagacc

SEQ ID NO: 851966 - DNA, 22 bp, Artificial Sequence
  chemically synthesized
cataagggggctgctatggtct

SEQ ID NO: 851967 - DNA, 22 bp, Artificial Sequence
  chemically synthesized
ccataagggggctgctatggtc

SEQ ID NO: 851968 - DNA, 22 bp, Artificial Sequence
  chemically synthesized
agaccatagcagcccccttatg

SEQ ID NO: 851969 - DNA, 22 bp, Artificial Sequence
  chemically synthesized
gccacgggaatttccataaggg

SEQ ID NO: 851970 - DNA, 22 bp, Artificial Sequence
  chemically synthesized
agccacgggaatttccataagg

SEQ ID NO: 851971 - DNA, 22 bp, Artificial Sequence
  chemically synthesized
tagccacgggaatttccataag

SEQ ID NO: 851972 - DNA, 22 bp, Artificial Sequence
  chemically synthesized
tttagccacgggaatttccata

SEQ ID NO: 851973 - DNA, 22 bp, Artificial Sequence
  chemically synthesized
tctttagccacgggaatttcca

SEQ ID NO: 851974 - DNA, 22 bp, Artificial Sequence
  chemically synthesized
atggaaattcccgtggctaaag

SEQ ID NO: 851975 - DNA, 22 bp, Artificial Sequence
  chemically synthesized
tggaaattcccgtggctaaaga

SEQ ID NO: 851976 - DNA, 22 bp, Artificial Sequence
  chemically synthesized
gcaagatgattctctttagcca

SEQ ID NO: 851977 - DNA, 22 bp, Artificial Sequence
  chemically synthesized
agcaagatgattctctttagcc

SEQ ID NO: 851978 - DNA, 22 bp, Artificial Sequence
  chemically synthesized
tagcaagatgattctctttagc

SEQ ID NO: 851979 - DNA, 22 bp, Artificial Sequence
  chemically synthesized
ccgtggctaaagagaatcatct

SEQ ID NO: 851980 - DNA, 22 bp, Artificial Sequence
  chemically synthesized
aagagaatcatcttgctaaagt

SEQ ID NO: 851981 - DNA, 22 bp, Artificial Sequence
  chemically synthesized
caggaaggcaacgaactttagc

SEQ ID NO: 851982 - DNA, 22 bp, Artificial Sequence
  chemically synthesized
ctccaggaaggcaacgaacttt

SEQ ID NO: 851983 - DNA, 22 bp, Artificial Sequence
  chemically synthesized
gctaaagttcgttgccttcctg

SEQ ID NO: 851984 - DNA, 22 bp, Artificial Sequence
  chemically synthesized
ctaaagttcgttgccttcctgg

SEQ ID NO: 851985 - DNA, 22 bp, Artificial Sequence
  chemically synthesized
gatgtgggctactccaggaagg

SEQ ID NO: 851986 - DNA, 22 bp, Artificial Sequence
  chemically synthesized
aagttcgttgccttcctggagt

SEQ ID NO: 851987 - DNA, 22 bp, Artificial Sequence
  chemically synthesized
gttgccttcctggagtagccca

SEQ ID NO: 851988 - DNA, 22 bp, Artificial Sequence
  chemically synthesized
ccttcctggagtagcccacatc

SEQ ID NO: 851989 - DNA, 22 bp, Artificial Sequence
  chemically synthesized
cctggagtagcccacatccagt

SEQ ID NO: 851990 - DNA, 22 bp, Artificial Sequence
  chemically synthesized
ctggagtagcccacatccagtg

SEQ ID NO: 851991 - DNA, 22 bp, Artificial Sequence
  chemically synthesized
gagtagcccacatccagtgcat

SEQ ID NO: 851992 - DNA, 22 bp, Artificial Sequence
  chemically synthesized
taaccccgtgtcaagtcatgca

SEQ ID NO: 851993 - DNA, 22 bp, Artificial Sequence
  chemically synthesized
ataaccccgtgtcaagtcatgc

SEQ ID NO: 851994 - DNA, 22 bp, Artificial Sequence
  chemically synthesized
tataaccccgtgtcaagtcatg

SEQ ID NO: 851995 - DNA, 22 bp, Artificial Sequence
  chemically synthesized
gatctttataaccccgtgtcaa

SEQ ID NO: 851996 - DNA, 22 bp, Artificial Sequence
  chemically synthesized
gacacggggttataaagatcca

SEQ ID NO: 851997 - DNA, 22 bp, Artificial Sequence
  chemically synthesized
acacggggttataaagatccag

SEQ ID NO: 851998 - DNA, 22 bp, Artificial Sequence
  chemically synthesized
ggaaacgaagaaaggggactgg

SEQ ID NO: 851999 - DNA, 22 bp, Artificial Sequence
  chemically synthesized
taaagatccagtcccctttctt

SEQ ID NO: 852000 - DNA, 22 bp, Artificial Sequence
  chemically synthesized
agaagtgctaggaaacgaagaa

SEQ ID NO: 852001 - DNA, 22 bp, Artificial Sequence
  chemically synthesized
cagaagtgctaggaaacgaaga

SEQ ID NO: 852002 - DNA, 22 bp, Artificial Sequence
  chemically synthesized
gaatgacccttcagaagtgcta

SEQ ID NO: 852003 - DNA, 22 bp, Artificial Sequence
  chemically synthesized
tcttcgtttcctagcacttctg

SEQ ID NO: 852004 - DNA, 22 bp, Artificial Sequence
  chemically synthesized
cttcgtttcctagcacttctga

SEQ ID NO: 852005 - DNA, 22 bp, Artificial Sequence
  chemically synthesized
ttcgtttcctagcacttctgaa

SEQ ID NO: 852006 - DNA, 22 bp, Artificial Sequence
  chemically synthesized
cgtttcctagcacttctgaagg

SEQ ID NO: 852007 - DNA, 22 bp, Artificial Sequence
  chemically synthesized
agctggaatgacccttcagaag

SEQ ID NO: 852008 - DNA, 22 bp, Artificial Sequence
  chemically synthesized
gtttcctagcacttctgaaggg

SEQ ID NO: 852009 - DNA, 22 bp, Artificial Sequence
  chemically synthesized
aagctggaatgacccttcagaa

SEQ ID NO: 852010 - DNA, 22 bp, Artificial Sequence
  chemically synthesized
ttaagctggaatgacccttcag

SEQ ID NO: 852011 - DNA, 22 bp, Artificial Sequence
  chemically synthesized
cctagcacttctgaagggtcat

SEQ ID NO: 852012 - DNA, 22 bp, Artificial Sequence
  chemically synthesized
ctagcacttctgaagggtcatt

SEQ ID NO: 852013 - DNA, 22 bp, Artificial Sequence
  chemically synthesized
gcacttctgaagggtcattcca

SEQ ID NO: 852014 - DNA, 22 bp, Artificial Sequence
  chemically synthesized
agggagttcttaagctggaatg

SEQ ID NO: 852015 - DNA, 22 bp, Artificial Sequence
  chemically synthesized
ctgaagggtcattccagcttaa

SEQ ID NO: 852016 - DNA, 22 bp, Artificial Sequence
  chemically synthesized
tgaagggtcattccagcttaag

SEQ ID NO: 852017 - DNA, 22 bp, Artificial Sequence
  chemically synthesized
aagggtcattccagcttaagaa

SEQ ID NO: 852018 - DNA, 22 bp, Artificial Sequence
  chemically synthesized
accgttcagggagttcttaagc

SEQ ID NO: 852019 - DNA, 22 bp, Artificial Sequence
  chemically synthesized
agctgaccgttcagggagttct

SEQ ID NO: 852020 - DNA, 22 bp, Artificial Sequence
  chemically synthesized
cagcttaagaactccctgaacg

SEQ ID NO: 852021 - DNA, 22 bp, Artificial Sequence
  chemically synthesized
aagaactccctgaacggtcagc

SEQ ID NO: 852022 - DNA, 22 bp, Artificial Sequence
  chemically synthesized
gtaagggcctcagctgaccgtt

SEQ ID NO: 852023 - DNA, 22 bp, Artificial Sequence
  chemically synthesized
agaactccctgaacggtcagct

SEQ ID NO: 852024 - DNA, 22 bp, Artificial Sequence
  chemically synthesized
agtaagggcctcagctgaccgt

SEQ ID NO: 852025 - DNA, 22 bp, Artificial Sequence
  chemically synthesized
cctgaacggtcagctgaggccc

SEQ ID NO: 852026 - DNA, 22 bp, Artificial Sequence
  chemically synthesized
acgcagtcttagtaagggcctc

SEQ ID NO: 852027 - DNA, 22 bp, Artificial Sequence
  chemically synthesized
aacggtcagctgaggcccttac

SEQ ID NO: 852028 - DNA, 22 bp, Artificial Sequence
  chemically synthesized
tgacgcagtcttagtaagggcc

SEQ ID NO: 852029 - DNA, 22 bp, Artificial Sequence
  chemically synthesized
agctctgacgcagtcttagtaa

SEQ ID NO: 852030 - DNA, 22 bp, Artificial Sequence
  chemically synthesized
aggcccttactaagactgcgtc

SEQ ID NO: 852031 - DNA, 22 bp, Artificial Sequence
  chemically synthesized
actaagactgcgtcagagctca

SEQ ID NO: 852032 - DNA, 22 bp, Artificial Sequence
  chemically synthesized
ctaagactgcgtcagagctcaa

SEQ ID NO: 852033 - DNA, 22 bp, Artificial Sequence
  chemically synthesized
agactgcgtcagagctcaactt

SEQ ID NO: 852034 - DNA, 22 bp, Artificial Sequence
  chemically synthesized
cgtcagagctcaacttctccct

SEQ ID NO: 852035 - DNA, 22 bp, Artificial Sequence
  chemically synthesized
gggtcaacgtgtaggggcagag

SEQ ID NO: 852036 - DNA, 22 bp, Artificial Sequence
  chemically synthesized
ggggtcaacgtgtaggggcaga

SEQ ID NO: 852037 - DNA, 22 bp, Artificial Sequence
  chemically synthesized
aacttctccctctgcccctaca

SEQ ID NO: 852038 - DNA, 22 bp, Artificial Sequence
  chemically synthesized
ttggggtcaacgtgtaggggca

SEQ ID NO: 852039 - DNA, 22 bp, Artificial Sequence
  chemically synthesized
ctccctctgcccctacacgttg

SEQ ID NO: 852040 - DNA, 22 bp, Artificial Sequence
  chemically synthesized
tccctctgcccctacacgttga

SEQ ID NO: 852041 - DNA, 22 bp, Artificial Sequence
  chemically synthesized
cctctgcccctacacgttgacc

SEQ ID NO: 852042 - DNA, 22 bp, Artificial Sequence
  chemically synthesized
ggagtgttcttggggtcaacgt

SEQ ID NO: 852043 - DNA, 22 bp, Artificial Sequence
  chemically synthesized
aggagtgttcttggggtcaacg

SEQ ID NO: 852044 - DNA, 22 bp, Artificial Sequence
  chemically synthesized
tgcccctacacgttgaccccaa

SEQ ID NO: 852045 - DNA, 22 bp, Artificial Sequence
  chemically synthesized
tttaggagtgttcttggggtca

SEQ ID NO: 852046 - DNA, 22 bp, Artificial Sequence
  chemically synthesized
cccctacacgttgaccccaaga

SEQ ID NO: 852047 - DNA, 22 bp, Artificial Sequence
  chemically synthesized
cacgttgaccccaagaacactc

SEQ ID NO: 852048 - DNA, 22 bp, Artificial Sequence
  chemically synthesized
accccaagaacactcctaaata

SEQ ID NO: 852049 - DNA, 22 bp, Artificial Sequence
  chemically synthesized
aggtgagcatgcagtatgtcta

SEQ ID NO: 852050 - DNA, 22 bp, Artificial Sequence
  chemically synthesized
agattgaggtgagcatgcagta

SEQ ID NO: 852051 - DNA, 22 bp, Artificial Sequence
  chemically synthesized
ctaaatagacatactgcatgct

SEQ ID NO: 852052 - DNA, 22 bp, Artificial Sequence
  chemically synthesized
aatagacatactgcatgctcac

SEQ ID NO: 852053 - DNA, 22 bp, Artificial Sequence
  chemically synthesized
ggaagcataccctgagattgag

SEQ ID NO: 852054 - DNA, 22 bp, Artificial Sequence
  chemically synthesized
catgctcacctcaatctcaggg

SEQ ID NO: 852055 - DNA, 22 bp, Artificial Sequence
  chemically synthesized
ggtgactgggaagcataccctg

SEQ ID NO: 852056 - DNA, 22 bp, Artificial Sequence
  chemically synthesized
gggtgactgggaagcataccct

SEQ ID NO: 852057 - DNA, 22 bp, Artificial Sequence
  chemically synthesized
acctcaatctcagggtatgctt

SEQ ID NO: 852058 - DNA, 22 bp, Artificial Sequence
  chemically synthesized
aatctcagggtatgcttcccag

SEQ ID NO: 852059 - DNA, 22 bp, Artificial Sequence
  chemically synthesized
agggtatgcttcccagtcaccc

SEQ ID NO: 852060 - DNA, 22 bp, Artificial Sequence
  chemically synthesized
aagataatatcatagtttgggt

SEQ ID NO: 852061 - DNA, 22 bp, Artificial Sequence
  chemically synthesized
aaagataatatcatagtttggg

SEQ ID NO: 852062 - DNA, 22 bp, Artificial Sequence
  chemically synthesized
cttaaagataatatcatagttt

SEQ ID NO: 852063 - DNA, 22 bp, Artificial Sequence
  chemically synthesized
cccagtcacccaaactatgata

SEQ ID NO: 852064 - DNA, 22 bp, Artificial Sequence
  chemically synthesized
acttaaagataatatcatagtt

SEQ ID NO: 852065 - DNA, 22 bp, Artificial Sequence
  chemically synthesized
ccagtcacccaaactatgatat

SEQ ID NO: 852066 - DNA, 22 bp, Artificial Sequence
  chemically synthesized
cttacttaaagataatatcata

SEQ ID NO: 852067 - DNA, 22 bp, Artificial Sequence
  chemically synthesized
acttacttaaagataatatcat

SEQ ID NO: 852068 - DNA, 22 bp, Artificial Sequence
  chemically synthesized
gggtttacttacttaaagataa

SEQ ID NO: 852069 - DNA, 22 bp, Artificial Sequence
  chemically synthesized
tgatattatctttaagtaagta

SEQ ID NO: 852070 - DNA, 22 bp, Artificial Sequence
  chemically synthesized
tctttaagtaagtaaaccctag

SEQ ID NO: 852071 - DNA, 22 bp, Artificial Sequence
  chemically synthesized
taagtaagtaaaccctaggcat

SEQ ID NO: 852072 - DNA, 22 bp, Artificial Sequence
  chemically synthesized
aagtaagtaaaccctaggcatt

SEQ ID NO: 852073 - DNA, 22 bp, Artificial Sequence
  chemically synthesized
agtaagtaaaccctaggcattt

SEQ ID NO: 852074 - DNA, 22 bp, Artificial Sequence
  chemically synthesized
gaaatcagtcccaaatgcctag

SEQ ID NO: 852075 - DNA, 22 bp, Artificial Sequence
  chemically synthesized
tagaaatcagtcccaaatgcct

SEQ ID NO: 852076 - DNA, 22 bp, Artificial Sequence
  chemically synthesized
agagcattctagaaatcagtcc

SEQ ID NO: 852077 - DNA, 22 bp, Artificial Sequence
  chemically synthesized
ggcatttgggactgatttctag

SEQ ID NO: 852078 - DNA, 22 bp, Artificial Sequence
  chemically synthesized
gattaagagcattctagaaatc

SEQ ID NO: 852079 - DNA, 22 bp, Artificial Sequence
  chemically synthesized
agattaagagcattctagaaat

SEQ ID NO: 852080 - DNA, 22 bp, Artificial Sequence
  chemically synthesized
tagattaagagcattctagaaa

SEQ ID NO: 852081 - DNA, 22 bp, Artificial Sequence
  chemically synthesized
gggactgatttctagaatgctc

SEQ ID NO: 852082 - DNA, 22 bp, Artificial Sequence
  chemically synthesized
ggactgatttctagaatgctct

SEQ ID NO: 852083 - DNA, 22 bp, Artificial Sequence
  chemically synthesized
gagagttttagattaagagcat

SEQ ID NO: 852084 - DNA, 22 bp, Artificial Sequence
  chemically synthesized
ggagagttttagattaagagca

SEQ ID NO: 852085 - DNA, 22 bp, Artificial Sequence
  chemically synthesized
tggagagttttagattaagagc

SEQ ID NO: 852086 - DNA, 22 bp, Artificial Sequence
  chemically synthesized
atttctagaatgctcttaatct

SEQ ID NO: 852087 - DNA, 22 bp, Artificial Sequence
  chemically synthesized
ctagaatgctcttaatctaaaa

SEQ ID NO: 852088 - DNA, 22 bp, Artificial Sequence
  chemically synthesized
cactttggagagttttagatta

SEQ ID NO: 852089 - DNA, 22 bp, Artificial Sequence
  chemically synthesized
tagaatgctcttaatctaaaac

SEQ ID NO: 852090 - DNA, 22 bp, Artificial Sequence
  chemically synthesized
gaatgctcttaatctaaaactc

SEQ ID NO: 852091 - DNA, 22 bp, Artificial Sequence
  chemically synthesized
acctacactttggagagtttta

SEQ ID NO: 852092 - DNA, 22 bp, Artificial Sequence
  chemically synthesized
gacctacactttggagagtttt

SEQ ID NO: 852093 - DNA, 22 bp, Artificial Sequence
  chemically synthesized
tgacctacactttggagagttt

SEQ ID NO: 852094 - DNA, 22 bp, Artificial Sequence
  chemically synthesized
ttaatctaaaactctccaaagt

SEQ ID NO: 852095 - DNA, 22 bp, Artificial Sequence
  chemically synthesized
aatctaaaactctccaaagtgt

SEQ ID NO: 852096 - DNA, 22 bp, Artificial Sequence
  chemically synthesized
atctaaaactctccaaagtgta

SEQ ID NO: 852097 - DNA, 22 bp, Artificial Sequence
  chemically synthesized
tggaaaagttttgacctacact

SEQ ID NO: 852098 - DNA, 22 bp, Artificial Sequence
  chemically synthesized
aaactctccaaagtgtaggtca

SEQ ID NO: 852099 - DNA, 22 bp, Artificial Sequence
  chemically synthesized
ttatggaaaagttttgacctac

SEQ ID NO: 852100 - DNA, 22 bp, Artificial Sequence
  chemically synthesized
tccaaagtgtaggtcaaaactt

SEQ ID NO: 852101 - DNA, 22 bp, Artificial Sequence
  chemically synthesized
caaagtgtaggtcaaaactttt

SEQ ID NO: 852102 - DNA, 22 bp, Artificial Sequence
  chemically synthesized
ttccataatagtgtgcatattt

SEQ ID NO: 852103 - DNA, 22 bp, Artificial Sequence
  chemically synthesized
tccataatagtgtgcatatttt

SEQ ID NO: 852104 - DNA, 22 bp, Artificial Sequence
  chemically synthesized
ccataatagtgtgcatattttc

SEQ ID NO: 852105 - DNA, 22 bp, Artificial Sequence
  chemically synthesized
cataatagtgtgcatattttct

SEQ ID NO: 852106 - DNA, 22 bp, Artificial Sequence
  chemically synthesized
ataaaggagcaatggggagaaa

SEQ ID NO: 852107 - DNA, 22 bp, Artificial Sequence
  chemically synthesized
gataaaggagcaatggggagaa

SEQ ID NO: 852108 - DNA, 22 bp, Artificial Sequence
  chemically synthesized
ccaagtacttgataaaggagca

SEQ ID NO: 852109 - DNA, 22 bp, Artificial Sequence
  chemically synthesized
tctccccattgctcctttatca

SEQ ID NO: 852110 - DNA, 22 bp, Artificial Sequence
  chemically synthesized
ctccccattgctcctttatcaa

SEQ ID NO: 852111 - DNA, 22 bp, Artificial Sequence
  chemically synthesized
attcccaagtacttgataaagg

SEQ ID NO: 852112 - DNA, 22 bp, Artificial Sequence
  chemically synthesized
tccccattgctcctttatcaag

SEQ ID NO: 852113 - DNA, 22 bp, Artificial Sequence
  chemically synthesized
aattcccaagtacttgataaag

SEQ ID NO: 852114 - DNA, 22 bp, Artificial Sequence
  chemically synthesized
cccattgctcctttatcaagta

SEQ ID NO: 852115 - DNA, 22 bp, Artificial Sequence
  chemically synthesized
ccttaattcccaagtacttgat

SEQ ID NO: 852116 - DNA, 22 bp, Artificial Sequence
  chemically synthesized
accttaattcccaagtacttga

SEQ ID NO: 852117 - DNA, 22 bp, Artificial Sequence
  chemically synthesized
taccttaattcccaagtacttg

SEQ ID NO: 852118 - DNA, 22 bp, Artificial Sequence
  chemically synthesized
tttaccttaattcccaagtact

SEQ ID NO: 852119 - DNA, 22 bp, Artificial Sequence
  chemically synthesized
ctcctttatcaagtacttggga

SEQ ID NO: 852120 - DNA, 22 bp, Artificial Sequence
  chemically synthesized
ctttatcaagtacttgggaatt

SEQ ID NO: 852121 - DNA, 22 bp, Artificial Sequence
  chemically synthesized
tatcaagtacttgggaattaag

SEQ ID NO: 852122 - DNA, 22 bp, Artificial Sequence
  chemically synthesized
atcaagtacttgggaattaagg

SEQ ID NO: 852123 - DNA, 22 bp, Artificial Sequence
  chemically synthesized
tcaagtacttgggaattaaggt

SEQ ID NO: 852124 - DNA, 22 bp, Artificial Sequence
  chemically synthesized
caaatattctttaccttaattc

SEQ ID NO: 852125 - DNA, 22 bp, Artificial Sequence
  chemically synthesized
ccaaatattctttaccttaatt

SEQ ID NO: 852126 - DNA, 22 bp, Artificial Sequence
  chemically synthesized
ttccaaatattctttaccttaa

SEQ ID NO: 852127 - DNA, 22 bp, Artificial Sequence
  chemically synthesized
attcttccaaatattctttacc

SEQ ID NO: 852128 - DNA, 22 bp, Artificial Sequence
  chemically synthesized
aattcttccaaatattctttac

SEQ ID NO: 852129 - DNA, 22 bp, Artificial Sequence
  chemically synthesized
taattcttccaaatattcttta

SEQ ID NO: 852130 - DNA, 22 bp, Artificial Sequence
  chemically synthesized
gggaattaaggtaaagaatatt

SEQ ID NO: 852131 - DNA, 22 bp, Artificial Sequence
  chemically synthesized
ggaattaaggtaaagaatattt

SEQ ID NO: 852132 - DNA, 22 bp, Artificial Sequence
  chemically synthesized
ccccactttaattcttccaaat

SEQ ID NO: 852133 - DNA, 22 bp, Artificial Sequence
  chemically synthesized
aggtaaagaatatttggaagaa

SEQ ID NO: 852134 - DNA, 22 bp, Artificial Sequence
  chemically synthesized
ggaagaattaaagtggggtaga

SEQ ID NO: 852135 - DNA, 22 bp, Artificial Sequence
  chemically synthesized
gaagaattaaagtggggtagac

SEQ ID NO: 852136 - DNA, 22 bp, Artificial Sequence
  chemically synthesized
agagatatgcaggaagtctacc

SEQ ID NO: 852137 - DNA, 22 bp, Artificial Sequence
  chemically synthesized
aagtggggtagacttcctgcat

SEQ ID NO: 852138 - DNA, 22 bp, Artificial Sequence
  chemically synthesized
acccctgagagatatgcaggaa

SEQ ID NO: 852139 - DNA, 22 bp, Artificial Sequence
  chemically synthesized
gacccctgagagatatgcagga

SEQ ID NO: 852140 - DNA, 22 bp, Artificial Sequence
  chemically synthesized
cctgcatatctctcaggggtca

SEQ ID NO: 852141 - DNA, 22 bp, Artificial Sequence
  chemically synthesized
ctgcatatctctcaggggtcaa

SEQ ID NO: 852142 - DNA, 22 bp, Artificial Sequence
  chemically synthesized
catatctctcaggggtcaaaca

SEQ ID NO: 852143 - DNA, 22 bp, Artificial Sequence
  chemically synthesized
tcaggggtcaaacacacctgtt

SEQ ID NO: 852144 - DNA, 22 bp, Artificial Sequence
  chemically synthesized
aggggtcaaacacacctgtttg

SEQ ID NO: 852145 - DNA, 22 bp, Artificial Sequence
  chemically synthesized
cgaaagtcagtggccacaaaca

SEQ ID NO: 852146 - DNA, 22 bp, Artificial Sequence
  chemically synthesized
gcgaaagtcagtggccacaaac

SEQ ID NO: 852147 - DNA, 22 bp, Artificial Sequence
  chemically synthesized
tgcgaaagtcagtggccacaaa

SEQ ID NO: 852148 - DNA, 22 bp, Artificial Sequence
  chemically synthesized
tttgtggccactgactttcgca

SEQ ID NO: 852149 - DNA, 22 bp, Artificial Sequence
  chemically synthesized
gtggccactgactttcgcaaaa

SEQ ID NO: 852150 - DNA, 22 bp, Artificial Sequence
  chemically synthesized
tggccactgactttcgcaaaac

SEQ ID NO: 852151 - DNA, 22 bp, Artificial Sequence
  chemically synthesized
actttcgcaaaaccatctcatc

SEQ ID NO: 852152 - DNA, 22 bp, Artificial Sequence
  chemically synthesized
tcgcaaaaccatctcatctttg

SEQ ID NO: 852153 - DNA, 22 bp, Artificial Sequence
  chemically synthesized
cgcaaaaccatctcatctttgg

SEQ ID NO: 852154 - DNA, 22 bp, Artificial Sequence
  chemically synthesized
gcaaaaccatctcatctttggc

SEQ ID NO: 852155 - DNA, 22 bp, Artificial Sequence
  chemically synthesized
agacgacagagtgtgcccaagg

SEQ ID NO: 852156 - DNA, 22 bp, Artificial Sequence
  chemically synthesized
atctttggccttgggcacactc

SEQ ID NO: 852157 - DNA, 22 bp, Artificial Sequence
  chemically synthesized
tggccttgggcacactctgtcg

SEQ ID NO: 852158 - DNA, 22 bp, Artificial Sequence
  chemically synthesized
ggccttgggcacactctgtcgt

SEQ ID NO: 852159 - DNA, 22 bp, Artificial Sequence
  chemically synthesized
agaggtgttcagacgacagagt

SEQ ID NO: 852160 - DNA, 22 bp, Artificial Sequence
  chemically synthesized
gccttgggcacactctgtcgtc

SEQ ID NO: 852161 - DNA, 22 bp, Artificial Sequence
  chemically synthesized
ttgagaggtgttcagacgacag

SEQ ID NO: 852162 - DNA, 22 bp, Artificial Sequence
  chemically synthesized
tgttgagaggtgttcagacgac

SEQ ID NO: 852163 - DNA, 22 bp, Artificial Sequence
  chemically synthesized
gggcacactctgtcgtctgaac

SEQ ID NO: 852164 - DNA, 22 bp, Artificial Sequence
  chemically synthesized
ctgttgagaggtgttcagacga

SEQ ID NO: 852165 - DNA, 22 bp, Artificial Sequence
  chemically synthesized
ggcacactctgtcgtctgaaca

SEQ ID NO: 852166 - DNA, 22 bp, Artificial Sequence
  chemically synthesized
tgtcgtctgaacacctctcaac

SEQ ID NO: 852167 - DNA, 22 bp, Artificial Sequence
  chemically synthesized
tcgtctgaacacctctcaacag

SEQ ID NO: 852168 - DNA, 22 bp, Artificial Sequence
  chemically synthesized
aacacctctcaacagaaggtgc

SEQ ID NO: 852169 - DNA, 22 bp, Artificial Sequence
  chemically synthesized
gagtgtagtgaggagggcacct

SEQ ID NO: 852170 - DNA, 22 bp, Artificial Sequence
  chemically synthesized
ggagtgtagtgaggagggcacc

SEQ ID NO: 852171 - DNA, 22 bp, Artificial Sequence
  chemically synthesized
tcaacagaaggtgccctcctca

SEQ ID NO: 852172 - DNA, 22 bp, Artificial Sequence
  chemically synthesized
aacagaaggtgccctcctcact

SEQ ID NO: 852173 - DNA, 22 bp, Artificial Sequence
  chemically synthesized
aaagggaagtcttggagtgtag

SEQ ID NO: 852174 - DNA, 22 bp, Artificial Sequence
  chemically synthesized
gattgaaagggaagtcttggag

SEQ ID NO: 852175 - DNA, 22 bp, Artificial Sequence
  chemically synthesized
ctcactacactccaagacttcc

SEQ ID NO: 852176 - DNA, 22 bp, Artificial Sequence
  chemically synthesized
agttggattgaaagggaagtct

SEQ ID NO: 852177 - DNA, 22 bp, Artificial Sequence
  chemically synthesized
actacactccaagacttccctt

SEQ ID NO: 852178 - DNA, 22 bp, Artificial Sequence
  chemically synthesized
cagttggattgaaagggaagtc

SEQ ID NO: 852179 - DNA, 22 bp, Artificial Sequence
  chemically synthesized
tcagttggattgaaagggaagt

SEQ ID NO: 852180 - DNA, 22 bp, Artificial Sequence
  chemically synthesized
ttcagttggattgaaagggaag

SEQ ID NO: 852181 - DNA, 22 bp, Artificial Sequence
  chemically synthesized
cactccaagacttccctttcaa

SEQ ID NO: 852182 - DNA, 22 bp, Artificial Sequence
  chemically synthesized
aaatttttcagttggattgaaa

SEQ ID NO: 852183 - DNA, 22 bp, Artificial Sequence
  chemically synthesized
caagacttccctttcaatccaa

SEQ ID NO: 852184 - DNA, 22 bp, Artificial Sequence
  chemically synthesized
atagattcaaatttttcagttg

SEQ ID NO: 852185 - DNA, 22 bp, Artificial Sequence
  chemically synthesized
ccctttcaatccaactgaaaaa

SEQ ID NO: 852186 - DNA, 22 bp, Artificial Sequence
  chemically synthesized
aatagattcaaatttttcagtt

SEQ ID NO: 852187 - DNA, 22 bp, Artificial Sequence
  chemically synthesized
cctttcaatccaactgaaaaat

SEQ ID NO: 852188 - DNA, 22 bp, Artificial Sequence
  chemically synthesized
ttaatagattcaaatttttcag

SEQ ID NO: 852189 - DNA, 22 bp, Artificial Sequence
  chemically synthesized
cttaatagattcaaatttttca

SEQ ID NO: 852190 - DNA, 22 bp, Artificial Sequence
  chemically synthesized
tcttaatagattcaaatttttc

SEQ ID NO: 852191 - DNA, 22 bp, Artificial Sequence
  chemically synthesized
tcaatccaactgaaaaatttga

SEQ ID NO: 852192 - DNA, 22 bp, Artificial Sequence
  chemically synthesized
caatccaactgaaaaatttgaa

SEQ ID NO: 852193 - DNA, 22 bp, Artificial Sequence
  chemically synthesized
aatccaactgaaaaatttgaat

SEQ ID NO: 852194 - DNA, 22 bp, Artificial Sequence
  chemically synthesized
aaaaatttgaatctattaagaa

SEQ ID NO: 852195 - DNA, 22 bp, Artificial Sequence
  chemically synthesized
caaaaaagcgtattttcttaat

SEQ ID NO: 852196 - DNA, 22 bp, Artificial Sequence
  chemically synthesized
ccaaaaaagcgtattttcttaa

SEQ ID NO: 852197 - DNA, 22 bp, Artificial Sequence
  chemically synthesized
gaatctattaagaaaatacgct

SEQ ID NO: 852198 - DNA, 22 bp, Artificial Sequence
  chemically synthesized
aatctattaagaaaatacgctt

SEQ ID NO: 852199 - DNA, 22 bp, Artificial Sequence
  chemically synthesized
agagcttccaaaaaagcgtatt

SEQ ID NO: 852200 - DNA, 22 bp, Artificial Sequence
  chemically synthesized
taagagcttccaaaaaagcgta

SEQ ID NO: 852201 - DNA, 22 bp, Artificial Sequence
  chemically synthesized
ctaagagcttccaaaaaagcgt

SEQ ID NO: 852202 - DNA, 22 bp, Artificial Sequence
  chemically synthesized
tctaagagcttccaaaaaagcg

SEQ ID NO: 852203 - DNA, 22 bp, Artificial Sequence
  chemically synthesized
ttaagaaaatacgcttttttgg

SEQ ID NO: 852204 - DNA, 22 bp, Artificial Sequence
  chemically synthesized
ttttctaagagcttccaaaaaa

SEQ ID NO: 852205 - DNA, 22 bp, Artificial Sequence
  chemically synthesized
agaaaatacgcttttttggaag

SEQ ID NO: 852206 - DNA, 22 bp, Artificial Sequence
  chemically synthesized
taattgttttctaagagcttcc

SEQ ID NO: 852207 - DNA, 22 bp, Artificial Sequence
  chemically synthesized
actgtaattgttttctaagagc

SEQ ID NO: 852208 - DNA, 22 bp, Artificial Sequence
  chemically synthesized
cactgtaattgttttctaagag

SEQ ID NO: 852209 - DNA, 22 bp, Artificial Sequence
  chemically synthesized
ttttggaagctcttagaaaaca

SEQ ID NO: 852210 - DNA, 22 bp, Artificial Sequence
  chemically synthesized
tttggaagctcttagaaaacaa

SEQ ID NO: 852211 - DNA, 22 bp, Artificial Sequence
  chemically synthesized
ttggaagctcttagaaaacaat

SEQ ID NO: 852212 - DNA, 22 bp, Artificial Sequence
  chemically synthesized
tggaagctcttagaaaacaatt

SEQ ID NO: 852213 - DNA, 22 bp, Artificial Sequence
  chemically synthesized
ggaagctcttagaaaacaatta

SEQ ID NO: 852214 - DNA, 22 bp, Artificial Sequence
  chemically synthesized
gaagctcttagaaaacaattac

SEQ ID NO: 852215 - DNA, 22 bp, Artificial Sequence
  chemically synthesized
ttagaaaacaattacagtgaaa

SEQ ID NO: 852216 - DNA, 22 bp, Artificial Sequence
  chemically synthesized
agaaaacaattacagtgaaaca

SEQ ID NO: 852217 - DNA, 22 bp, Artificial Sequence
  chemically synthesized
gaaaacaattacagtgaaacat

SEQ ID NO: 852218 - DNA, 22 bp, Artificial Sequence
  chemically synthesized
cagtgaaacatgtttctctctc

SEQ ID NO: 852219 - DNA, 22 bp, Artificial Sequence
  chemically synthesized
aaaagagagagagagagagaaa

SEQ ID NO: 852220 - DNA, 22 bp, Artificial Sequence
  chemically synthesized
aaaaagagagagagagagagaa

SEQ ID NO: 852221 - DNA, 22 bp, Artificial Sequence
  chemically synthesized
atggtacaaatttaaaaagaga

SEQ ID NO: 852222 - DNA, 22 bp, Artificial Sequence
  chemically synthesized
ctctctctctctctctttttaa

SEQ ID NO: 852223 - DNA, 22 bp, Artificial Sequence
  chemically synthesized
tctctctctctctctttttaaa

SEQ ID NO: 852224 - DNA, 22 bp, Artificial Sequence
  chemically synthesized
tctctctctctctttttaaatt

SEQ ID NO: 852225 - DNA, 22 bp, Artificial Sequence
  chemically synthesized
tctctctctctttttaaatttg

SEQ ID NO: 852226 - DNA, 22 bp, Artificial Sequence
  chemically synthesized
caattgatggtacaaatttaaa

SEQ ID NO: 852227 - DNA, 22 bp, Artificial Sequence
  chemically synthesized
ccaattgatggtacaaatttaa

SEQ ID NO: 852228 - DNA, 22 bp, Artificial Sequence
  chemically synthesized
tctctctctttttaaatttgta

SEQ ID NO: 852229 - DNA, 22 bp, Artificial Sequence
  chemically synthesized
tccaattgatggtacaaattta

SEQ ID NO: 852230 - DNA, 22 bp, Artificial Sequence
  chemically synthesized
tctctctttttaaatttgtacc

SEQ ID NO: 852231 - DNA, 22 bp, Artificial Sequence
  chemically synthesized
tctctttttaaatttgtaccat

SEQ ID NO: 852232 - DNA, 22 bp, Artificial Sequence
  chemically synthesized
tctttttaaatttgtaccatca

SEQ ID NO: 852233 - DNA, 22 bp, Artificial Sequence
  chemically synthesized
tttttaaatttgtaccatcaat

SEQ ID NO: 852234 - DNA, 22 bp, Artificial Sequence
  chemically synthesized
tttaaatttgtaccatcaattg

SEQ ID NO: 852235 - DNA, 22 bp, Artificial Sequence
  chemically synthesized
aaagcccctttccaattgatgg

SEQ ID NO: 852236 - DNA, 22 bp, Artificial Sequence
  chemically synthesized
ttaaatttgtaccatcaattgg

SEQ ID NO: 852237 - DNA, 22 bp, Artificial Sequence
  chemically synthesized
taaatttgtaccatcaattgga

SEQ ID NO: 852238 - DNA, 22 bp, Artificial Sequence
  chemically synthesized
aaatttgtaccatcaattggaa

SEQ ID NO: 852239 - DNA, 22 bp, Artificial Sequence
  chemically synthesized
aatttgtaccatcaattggaaa

SEQ ID NO: 852240 - DNA, 22 bp, Artificial Sequence
  chemically synthesized
gtaccatcaattggaaaggggc

SEQ ID NO: 852241 - DNA, 22 bp, Artificial Sequence
  chemically synthesized
taccatcaattggaaaggggct

SEQ ID NO: 852242 - DNA, 22 bp, Artificial Sequence
  chemically synthesized
gaaaggggctttgagacactat

SEQ ID NO: 852243 - DNA, 22 bp, Artificial Sequence
  chemically synthesized
tgagacactatactaccattgc

SEQ ID NO: 852244 - DNA, 22 bp, Artificial Sequence
  chemically synthesized
gagacactatactaccattgcc

SEQ ID NO: 852245 - DNA, 22 bp, Artificial Sequence
  chemically synthesized
agacactatactaccattgccc

SEQ ID NO: 852246 - DNA, 22 bp, Artificial Sequence
  chemically synthesized
agagggaatcaaaagggcaatg

SEQ ID NO: 852247 - DNA, 22 bp, Artificial Sequence
  chemically synthesized
gagagggaatcaaaagggcaat

SEQ ID NO: 852248 - DNA, 22 bp, Artificial Sequence
  chemically synthesized
tactaccattgcccttttgatt

SEQ ID NO: 852249 - DNA, 22 bp, Artificial Sequence
  chemically synthesized
aaatttgagagggaatcaaaag

SEQ ID NO: 852250 - DNA, 22 bp, Artificial Sequence
  chemically synthesized
caaatttgagagggaatcaaaa

SEQ ID NO: 852251 - DNA, 22 bp, Artificial Sequence
  chemically synthesized
tcaaatttgagagggaatcaaa

SEQ ID NO: 852252 - DNA, 22 bp, Artificial Sequence
  chemically synthesized
ccattgcccttttgattccctc

SEQ ID NO: 852253 - DNA, 22 bp, Artificial Sequence
  chemically synthesized
cccttttgattccctctcaaat

SEQ ID NO: 852254 - DNA, 22 bp, Artificial Sequence
  chemically synthesized
ttgattccctctcaaatttgaa

SEQ ID NO: 852255 - DNA, 22 bp, Artificial Sequence
  chemically synthesized
tgattccctctcaaatttgaaa

SEQ ID NO: 852256 - DNA, 22 bp, Artificial Sequence
  chemically synthesized
gattccctctcaaatttgaaag

SEQ ID NO: 852257 - DNA, 22 bp, Artificial Sequence
  chemically synthesized
attccctctcaaatttgaaagc

SEQ ID NO: 852258 - DNA, 22 bp, Artificial Sequence
  chemically synthesized
catcataaataaagctttcaaa

SEQ ID NO: 852259 - DNA, 22 bp, Artificial Sequence
  chemically synthesized
gcatcataaataaagctttcaa

SEQ ID NO: 852260 - DNA, 22 bp, Artificial Sequence
  chemically synthesized
tgcatcataaataaagctttca

SEQ ID NO: 852261 - DNA, 22 bp, Artificial Sequence
  chemically synthesized
cctctcaaatttgaaagcttta

SEQ ID NO: 852262 - DNA, 22 bp, Artificial Sequence
  chemically synthesized
ttgcatcataaataaagctttc

SEQ ID NO: 852263 - DNA, 22 bp, Artificial Sequence
  chemically synthesized
tttttgcatcataaataaagct

SEQ ID NO: 852264 - DNA, 22 bp, Artificial Sequence
  chemically synthesized
tcaaatttgaaagctttattta

SEQ ID NO: 852265 - DNA, 22 bp, Artificial Sequence
  chemically synthesized
aaatttgaaagctttatttatg

SEQ ID NO: 852266 - DNA, 22 bp, Artificial Sequence
  chemically synthesized
gaaagctttatttatgatgcaa

SEQ ID NO: 852267 - DNA, 22 bp, Artificial Sequence
  chemically synthesized
aaagctttatttatgatgcaaa

SEQ ID NO: 852268 - DNA, 22 bp, Artificial Sequence
  chemically synthesized
atcatgatggctatttttgcat

SEQ ID NO: 852269 - DNA, 22 bp, Artificial Sequence
  chemically synthesized
tatttatgatgcaaaaatagcc

SEQ ID NO: 852270 - DNA, 22 bp, Artificial Sequence
  chemically synthesized
atttatgatgcaaaaatagcca

SEQ ID NO: 852271 - DNA, 22 bp, Artificial Sequence
  chemically synthesized
tttatgatgcaaaaatagccat

SEQ ID NO: 852272 - DNA, 22 bp, Artificial Sequence
  chemically synthesized
atgatgcaaaaatagccatcat

SEQ ID NO: 852273 - DNA, 22 bp, Artificial Sequence
  chemically synthesized
tgatgcaaaaatagccatcatg

SEQ ID NO: 852274 - DNA, 22 bp, Artificial Sequence
  chemically synthesized
aaaaaaccaattaatcatgatg

SEQ ID NO: 852275 - DNA, 22 bp, Artificial Sequence
  chemically synthesized
gaaaaaaccaattaatcatgat

SEQ ID NO: 852276 - DNA, 22 bp, Artificial Sequence
  chemically synthesized
gtgaaaaatgatagacacttga

SEQ ID NO: 852277 - DNA, 22 bp, Artificial Sequence
  chemically synthesized
ggtgaaaaatgatagacacttg

SEQ ID NO: 852278 - DNA, 22 bp, Artificial Sequence
  chemically synthesized
attggttttttcaagtgtctat

SEQ ID NO: 852279 - DNA, 22 bp, Artificial Sequence
  chemically synthesized
gttttttcaagtgtctatcatt

SEQ ID NO: 852280 - DNA, 22 bp, Artificial Sequence
  chemically synthesized
tccttggtgaaaaatgatagac

SEQ ID NO: 852281 - DNA, 22 bp, Artificial Sequence
  chemically synthesized
tttcaagtgtctatcatttttc

SEQ ID NO: 852282 - DNA, 22 bp, Artificial Sequence
  chemically synthesized
ttcaagtgtctatcatttttca

SEQ ID NO: 852283 - DNA, 22 bp, Artificial Sequence
  chemically synthesized
tcaagtgtctatcatttttcac

SEQ ID NO: 852284 - DNA, 22 bp, Artificial Sequence
  chemically synthesized
caagtgtctatcatttttcacc

SEQ ID NO: 852285 - DNA, 22 bp, Artificial Sequence
  chemically synthesized
aagtgtctatcatttttcacca

SEQ ID NO: 852286 - DNA, 22 bp, Artificial Sequence
  chemically synthesized
atcatagcagttatccttggtg

SEQ ID NO: 852287 - DNA, 22 bp, Artificial Sequence
  chemically synthesized
ctaatcatagcagttatccttg

SEQ ID NO: 852288 - DNA, 22 bp, Artificial Sequence
  chemically synthesized
tcatttttcaccaaggataact

SEQ ID NO: 852289 - DNA, 22 bp, Artificial Sequence
  chemically synthesized
gctaatcatagcagttatcctt

SEQ ID NO: 852290 - DNA, 22 bp, Artificial Sequence
  chemically synthesized
ttgctaatcatagcagttatcc

SEQ ID NO: 852291 - DNA, 22 bp, Artificial Sequence
  chemically synthesized
cttgctaatcatagcagttatc

SEQ ID NO: 852292 - DNA, 22 bp, Artificial Sequence
  chemically synthesized
ttcttgctaatcatagcagtta

SEQ ID NO: 852293 - DNA, 22 bp, Artificial Sequence
  chemically synthesized
ttcaccaaggataactgctatg

SEQ ID NO: 852294 - DNA, 22 bp, Artificial Sequence
  chemically synthesized
tcaccaaggataactgctatga

SEQ ID NO: 852295 - DNA, 22 bp, Artificial Sequence
  chemically synthesized
caccaaggataactgctatgat

SEQ ID NO: 852296 - DNA, 22 bp, Artificial Sequence
  chemically synthesized
accaaggataactgctatgatt

SEQ ID NO: 852297 - DNA, 22 bp, Artificial Sequence
  chemically synthesized
tatggaggttcttcttgctaat

SEQ ID NO: 852298 - DNA, 22 bp, Artificial Sequence
  chemically synthesized
gtatggaggttcttcttgctaa

SEQ ID NO: 852299 - DNA, 22 bp, Artificial Sequence
  chemically synthesized
ctatgattagcaagaagaacct

SEQ ID NO: 852300 - DNA, 22 bp, Artificial Sequence
  chemically synthesized
tgattagcaagaagaacctcca

SEQ ID NO: 852301 - DNA, 22 bp, Artificial Sequence
  chemically synthesized
aatagatttgtatggaggttct

SEQ ID NO: 852302 - DNA, 22 bp, Artificial Sequence
  chemically synthesized
gcaagaagaacctccatacaaa

SEQ ID NO: 852303 - DNA, 22 bp, Artificial Sequence
  chemically synthesized
gatgattaaatagatttgtatg

SEQ ID NO: 852304 - DNA, 22 bp, Artificial Sequence
  chemically synthesized
agatgattaaatagatttgtat

SEQ ID NO: 852305 - DNA, 22 bp, Artificial Sequence
  chemically synthesized
tagatgattaaatagatttgta

SEQ ID NO: 852306 - DNA, 22 bp, Artificial Sequence
  chemically synthesized
catacaaatctatttaatcatc

SEQ ID NO: 852307 - DNA, 22 bp, Artificial Sequence
  chemically synthesized
aaacaaatatgaattttagatg

SEQ ID NO: 852308 - DNA, 22 bp, Artificial Sequence
  chemically synthesized
aaaacaaatatgaattttagat

SEQ ID NO: 852309 - DNA, 22 bp, Artificial Sequence
  chemically synthesized
tttaatcatctaaaattcatat

SEQ ID NO: 852310 - DNA, 22 bp, Artificial Sequence
  chemically synthesized
aatcatctaaaattcatatttg

SEQ ID NO: 852311 - DNA, 22 bp, Artificial Sequence
  chemically synthesized
atcatctaaaattcatatttgt

SEQ ID NO: 852312 - DNA, 22 bp, Artificial Sequence
  chemically synthesized
aaattcatatttgttttaagga

SEQ ID NO: 852313 - DNA, 22 bp, Artificial Sequence
  chemically synthesized
atatttgttttaaggatgactg

SEQ ID NO: 852314 - DNA, 22 bp, Artificial Sequence
  chemically synthesized
tcagtcaaaataacagtcatcc

SEQ ID NO: 852315 - DNA, 22 bp, Artificial Sequence
  chemically synthesized
gttttaaggatgactgttattt

SEQ ID NO: 852316 - DNA, 22 bp, Artificial Sequence
  chemically synthesized
cgttatcagtcaaaataacagt

SEQ ID NO: 852317 - DNA, 22 bp, Artificial Sequence
  chemically synthesized
ttttaaggatgactgttatttt

SEQ ID NO: 852318 - DNA, 22 bp, Artificial Sequence
  chemically synthesized
acgttatcagtcaaaataacag

SEQ ID NO: 852319 - DNA, 22 bp, Artificial Sequence
  chemically synthesized
tacgttatcagtcaaaataaca

SEQ ID NO: 852320 - DNA, 22 bp, Artificial Sequence
  chemically synthesized
taaggatgactgttattttgac

SEQ ID NO: 852321 - DNA, 22 bp, Artificial Sequence
  chemically synthesized
aaggatgactgttattttgact

SEQ ID NO: 852322 - DNA, 22 bp, Artificial Sequence
  chemically synthesized
aggatgactgttattttgactg

SEQ ID NO: 852323 - DNA, 22 bp, Artificial Sequence
  chemically synthesized
ttattttgactgataacgtaaa

SEQ ID NO: 852324 - DNA, 22 bp, Artificial Sequence
  chemically synthesized
ttttgactgataacgtaaaata

SEQ ID NO: 852325 - DNA, 22 bp, Artificial Sequence
  chemically synthesized
aaatcatagtagtattttacgt

SEQ ID NO: 852326 - DNA, 22 bp, Artificial Sequence
  chemically synthesized
tgactgataacgtaaaatacta

SEQ ID NO: 852327 - DNA, 22 bp, Artificial Sequence
  chemically synthesized
gactgataacgtaaaatactac

SEQ ID NO: 852328 - DNA, 22 bp, Artificial Sequence
  chemically synthesized
actgataacgtaaaatactact

SEQ ID NO: 852329 - DNA, 22 bp, Artificial Sequence
  chemically synthesized
cgctgaaatcatagtagtattt

SEQ ID NO: 852330 - DNA, 22 bp, Artificial Sequence
  chemically synthesized
gcgctgaaatcatagtagtatt

SEQ ID NO: 852331 - DNA, 22 bp, Artificial Sequence
  chemically synthesized
tgcgctgaaatcatagtagtat

SEQ ID NO: 852332 - DNA, 22 bp, Artificial Sequence
  chemically synthesized
ataacgtaaaatactactatga

SEQ ID NO: 852333 - DNA, 22 bp, Artificial Sequence
  chemically synthesized
actttgcgctgaaatcatagta

SEQ ID NO: 852334 - DNA, 22 bp, Artificial Sequence
  chemically synthesized
aactttgcgctgaaatcatagt

SEQ ID NO: 852335 - DNA, 22 bp, Artificial Sequence
  chemically synthesized
taactttgcgctgaaatcatag

SEQ ID NO: 852336 - DNA, 22 bp, Artificial Sequence
  chemically synthesized
acactttaactttgcgctgaaa

SEQ ID NO: 852337 - DNA, 22 bp, Artificial Sequence
  chemically synthesized
cacactttaactttgcgctgaa

SEQ ID NO: 852338 - DNA, 22 bp, Artificial Sequence
  chemically synthesized
ttcacactttaactttgcgctg

SEQ ID NO: 852339 - DNA, 22 bp, Artificial Sequence
  chemically synthesized
cttcacactttaactttgcgct

SEQ ID NO: 852340 - DNA, 22 bp, Artificial Sequence
  chemically synthesized
tcttcacactttaactttgcgc

SEQ ID NO: 852341 - DNA, 22 bp, Artificial Sequence
  chemically synthesized
ctatgatttcagcgcaaagtta

SEQ ID NO: 852342 - DNA, 22 bp, Artificial Sequence
  chemically synthesized
ttcttcacactttaactttgcg

SEQ ID NO: 852343 - DNA, 22 bp, Artificial Sequence
  chemically synthesized
tgatttcagcgcaaagttaaag

SEQ ID NO: 852344 - DNA, 22 bp, Artificial Sequence
  chemically synthesized
cttttcttcacactttaacttt

SEQ ID NO: 852345 - DNA, 22 bp, Artificial Sequence
  chemically synthesized
tattacttttcttcacacttta

SEQ ID NO: 852346 - DNA, 22 bp, Artificial Sequence
  chemically synthesized
cagcgcaaagttaaagtgtgaa

SEQ ID NO: 852347 - DNA, 22 bp, Artificial Sequence
  chemically synthesized
agcgcaaagttaaagtgtgaag

SEQ ID NO: 852348 - DNA, 22 bp, Artificial Sequence
  chemically synthesized
tgtattacttttcttcacactt

SEQ ID NO: 852349 - DNA, 22 bp, Artificial Sequence
  chemically synthesized
tgccaacctctgtattactttt

SEQ ID NO: 852350 - DNA, 22 bp, Artificial Sequence
  chemically synthesized
aagtgtgaagaaaagtaataca

SEQ ID NO: 852351 - DNA, 22 bp, Artificial Sequence
  chemically synthesized
atggttatgccaacctctgtat

SEQ ID NO: 852352 - DNA, 22 bp, Artificial Sequence
  chemically synthesized
gatggttatgccaacctctgta

SEQ ID NO: 852353 - DNA, 22 bp, Artificial Sequence
  chemically synthesized
tgatggttatgccaacctctgt

SEQ ID NO: 852354 - DNA, 22 bp, Artificial Sequence
  chemically synthesized
cctttgatggttatgccaacct

SEQ ID NO: 852355 - DNA, 22 bp, Artificial Sequence
  chemically synthesized
agaaattccctttgatggttat

SEQ ID NO: 852356 - DNA, 22 bp, Artificial Sequence
  chemically synthesized
aagaaattccctttgatggtta

SEQ ID NO: 852357 - DNA, 22 bp, Artificial Sequence
  chemically synthesized
taagaaattccctttgatggtt

SEQ ID NO: 852358 - DNA, 22 bp, Artificial Sequence
  chemically synthesized
tttaagaaattccctttgatgg

SEQ ID NO: 852359 - DNA, 22 bp, Artificial Sequence
  chemically synthesized
tattctttaagaaattcccttt

SEQ ID NO: 852360 - DNA, 22 bp, Artificial Sequence
  chemically synthesized
gcataaccatcaaagggaattt

SEQ ID NO: 852361 - DNA, 22 bp, Artificial Sequence
  chemically synthesized
tatattctttaagaaattccct

SEQ ID NO: 852362 - DNA, 22 bp, Artificial Sequence
  chemically synthesized
ttctatattctttaagaaattc

SEQ ID NO: 852363 - DNA, 22 bp, Artificial Sequence
  chemically synthesized
gttctatattctttaagaaatt

SEQ ID NO: 852364 - DNA, 22 bp, Artificial Sequence
  chemically synthesized
aatttgttctatattctttaag

SEQ ID NO: 852365 - DNA, 22 bp, Artificial Sequence
  chemically synthesized
tagttgaatttgttctatattc

SEQ ID NO: 852366 - DNA, 22 bp, Artificial Sequence
  chemically synthesized
tgtagttgaatttgttctatat

SEQ ID NO: 852367 - DNA, 22 bp, Artificial Sequence
  chemically synthesized
ctctgtagttgaatttgttcta

SEQ ID NO: 852368 - DNA, 22 bp, Artificial Sequence
  chemically synthesized
cttaaagaatatagaacaaatt

SEQ ID NO: 852369 - DNA, 22 bp, Artificial Sequence
  chemically synthesized
ttaaagaatatagaacaaattc

SEQ ID NO: 852370 - DNA, 22 bp, Artificial Sequence
  chemically synthesized
tactctgtagttgaatttgttc

SEQ ID NO: 852371 - DNA, 22 bp, Artificial Sequence
  chemically synthesized
aaagaatatagaacaaattcaa

SEQ ID NO: 852372 - DNA, 22 bp, Artificial Sequence
  chemically synthesized
aagaatatagaacaaattcaac

SEQ ID NO: 852373 - DNA, 22 bp, Artificial Sequence
  chemically synthesized
gtaaataataaatctctactct

SEQ ID NO: 852374 - DNA, 22 bp, Artificial Sequence
  chemically synthesized
agtaaataataaatctctactc

SEQ ID NO: 852375 - DNA, 22 bp, Artificial Sequence
  chemically synthesized
aactacagagtagagatttatt

SEQ ID NO: 852376 - DNA, 22 bp, Artificial Sequence
  chemically synthesized
agatcttagtaaataataaatc

SEQ ID NO: 852377 - DNA, 22 bp, Artificial Sequence
  chemically synthesized
aagatcttagtaaataataaat

SEQ ID NO: 852378 - DNA, 22 bp, Artificial Sequence
  chemically synthesized
taagatcttagtaaataataaa

SEQ ID NO: 852379 - DNA, 22 bp, Artificial Sequence
  chemically synthesized
cagagtagagatttattattta

SEQ ID NO: 852380 - DNA, 22 bp, Artificial Sequence
  chemically synthesized
aaaagcatgttttaagatctta

SEQ ID NO: 852381 - DNA, 22 bp, Artificial Sequence
  chemically synthesized
aaaaagcatgttttaagatctt

SEQ ID NO: 852382 - DNA, 22 bp, Artificial Sequence
  chemically synthesized
attatttactaagatcttaaaa

SEQ ID NO: 852383 - DNA, 22 bp, Artificial Sequence
  chemically synthesized
ttatttactaagatcttaaaac

SEQ ID NO: 852384 - DNA, 22 bp, Artificial Sequence
  chemically synthesized
tttactaagatcttaaaacatg

SEQ ID NO: 852385 - DNA, 22 bp, Artificial Sequence
  chemically synthesized
actaagatcttaaaacatgctt

SEQ ID NO: 852386 - DNA, 22 bp, Artificial Sequence
  chemically synthesized
tcagaatttaaaaagcatgttt

SEQ ID NO: 852387 - DNA, 22 bp, Artificial Sequence
  chemically synthesized
ctaagatcttaaaacatgcttt

SEQ ID NO: 852388 - DNA, 22 bp, Artificial Sequence
  chemically synthesized
agatcttaaaacatgcttttta

SEQ ID NO: 852389 - DNA, 22 bp, Artificial Sequence
  chemically synthesized
gttatcagaatttaaaaagcat

SEQ ID NO: 852390 - DNA, 22 bp, Artificial Sequence
  chemically synthesized
cgttatcagaatttaaaaagca

SEQ ID NO: 852391 - DNA, 22 bp, Artificial Sequence
  chemically synthesized
tcgttatcagaatttaaaaagc

SEQ ID NO: 852392 - DNA, 22 bp, Artificial Sequence
  chemically synthesized
aaaacatgctttttaaattctg

SEQ ID NO: 852393 - DNA, 22 bp, Artificial Sequence
  chemically synthesized
aaacatgctttttaaattctga

SEQ ID NO: 852394 - DNA, 22 bp, Artificial Sequence
  chemically synthesized
tgtcatattttcgttatcagaa

SEQ ID NO: 852395 - DNA, 22 bp, Artificial Sequence
  chemically synthesized
tatgtcatattttcgttatcag

SEQ ID NO: 852396 - DNA, 22 bp, Artificial Sequence
  chemically synthesized
tttaaattctgataacgaaaat

SEQ ID NO: 852397 - DNA, 22 bp, Artificial Sequence
  chemically synthesized
ttaaattctgataacgaaaata

SEQ ID NO: 852398 - DNA, 22 bp, Artificial Sequence
  chemically synthesized
taaattctgataacgaaaatat

SEQ ID NO: 852399 - DNA, 22 bp, Artificial Sequence
  chemically synthesized
aaattctgataacgaaaatatg

SEQ ID NO: 852400 - DNA, 22 bp, Artificial Sequence
  chemically synthesized
aattctgataacgaaaatatga

SEQ ID NO: 852401 - DNA, 22 bp, Artificial Sequence
  chemically synthesized
tgataacgaaaatatgacatag

SEQ ID NO: 852402 - DNA, 22 bp, Artificial Sequence
  chemically synthesized
ggatagcaaactctatgtcata

SEQ ID NO: 852403 - DNA, 22 bp, Artificial Sequence
  chemically synthesized
ataacgaaaatatgacatagag

SEQ ID NO: 852404 - DNA, 22 bp, Artificial Sequence
  chemically synthesized
taaaactaggatagcaaactct

SEQ ID NO: 852405 - DNA, 22 bp, Artificial Sequence
  chemically synthesized
aactgtaaaactaggatagcaa

SEQ ID NO: 852406 - DNA, 22 bp, Artificial Sequence
  chemically synthesized
ttcaactgtaaaactaggatag

SEQ ID NO: 852407 - DNA, 22 bp, Artificial Sequence
  chemically synthesized
gttcaactgtaaaactaggata

SEQ ID NO: 852408 - DNA, 22 bp, Artificial Sequence
  chemically synthesized
cagtttgttcaactgtaaaact

SEQ ID NO: 852409 - DNA, 22 bp, Artificial Sequence
  chemically synthesized
ttacagtttgttcaactgtaaa

SEQ ID NO: 852410 - DNA, 22 bp, Artificial Sequence
  chemically synthesized
gctatcctagttttacagttga

SEQ ID NO: 852411 - DNA, 22 bp, Artificial Sequence
  chemically synthesized
ctatcctagttttacagttgaa

SEQ ID NO: 852412 - DNA, 22 bp, Artificial Sequence
  chemically synthesized
tattacagtttgttcaactgta

SEQ ID NO: 852413 - DNA, 22 bp, Artificial Sequence
  chemically synthesized
tcctagttttacagttgaacaa

SEQ ID NO: 852414 - DNA, 22 bp, Artificial Sequence
  chemically synthesized
ttctattacagtttgttcaact

SEQ ID NO: 852415 - DNA, 22 bp, Artificial Sequence
  chemically synthesized
gttttacagttgaacaaactgt

SEQ ID NO: 852416 - DNA, 22 bp, Artificial Sequence
  chemically synthesized
ggatctattctattacagtttg

SEQ ID NO: 852417 - DNA, 22 bp, Artificial Sequence
  chemically synthesized
aggatctattctattacagttt

SEQ ID NO: 852418 - DNA, 22 bp, Artificial Sequence
  chemically synthesized
tacagttgaacaaactgtaata

SEQ ID NO: 852419 - DNA, 22 bp, Artificial Sequence
  chemically synthesized
taggatctattctattacagtt

SEQ ID NO: 852420 - DNA, 22 bp, Artificial Sequence
  chemically synthesized
acagttgaacaaactgtaatag

SEQ ID NO: 852421 - DNA, 22 bp, Artificial Sequence
  chemically synthesized
cagttgaacaaactgtaataga

SEQ ID NO: 852422 - DNA, 22 bp, Artificial Sequence
  chemically synthesized
aacaaactgtaatagaatagat

SEQ ID NO: 852423 - DNA, 22 bp, Artificial Sequence
  chemically synthesized
cacaaattttaggatctattct

SEQ ID NO: 852424 - DNA, 22 bp, Artificial Sequence
  chemically synthesized
taatagaatagatcctaaaatt

SEQ ID NO: 852425 - DNA, 22 bp, Artificial Sequence
  chemically synthesized
acaacctgcacaaattttagga

SEQ ID NO: 852426 - DNA, 22 bp, Artificial Sequence
  chemically synthesized
ttgacaacctgcacaaatttta

SEQ ID NO: 852427 - DNA, 22 bp, Artificial Sequence
  chemically synthesized
tatgttattgacaacctgcaca

SEQ ID NO: 852428 - DNA, 22 bp, Artificial Sequence
  chemically synthesized
ccctgtatgttattgacaacct

SEQ ID NO: 852429 - DNA, 22 bp, Artificial Sequence
  chemically synthesized
gccctgtatgttattgacaacc

SEQ ID NO: 852430 - DNA, 22 bp, Artificial Sequence
  chemically synthesized
aaatttgtgcaggttgtcaata

SEQ ID NO: 852431 - DNA, 22 bp, Artificial Sequence
  chemically synthesized
gtgcaggttgtcaataacatac

SEQ ID NO: 852432 - DNA, 22 bp, Artificial Sequence
  chemically synthesized
aaaccttgccctgtatgttatt

SEQ ID NO: 852433 - DNA, 22 bp, Artificial Sequence
  chemically synthesized
tgcaggttgtcaataacataca

SEQ ID NO: 852434 - DNA, 22 bp, Artificial Sequence
  chemically synthesized
tcaataacatacagggcaaggt

SEQ ID NO: 852435 - DNA, 22 bp, Artificial Sequence
  chemically synthesized
aagtcaggcatctaaaaccttg

SEQ ID NO: 852436 - DNA, 22 bp, Artificial Sequence
  chemically synthesized
aaagtcaggcatctaaaacctt

SEQ ID NO: 852437 - DNA, 22 bp, Artificial Sequence
  chemically synthesized
tttaaagtcaggcatctaaaac

SEQ ID NO: 852438 - DNA, 22 bp, Artificial Sequence
  chemically synthesized
gtttaaagtcaggcatctaaaa

SEQ ID NO: 852439 - DNA, 22 bp, Artificial Sequence
  chemically synthesized
tgtttaaagtcaggcatctaaa

SEQ ID NO: 852440 - DNA, 22 bp, Artificial Sequence
  chemically synthesized
tagatgcctgactttaaacaaa

SEQ ID NO: 852441 - DNA, 22 bp, Artificial Sequence
  chemically synthesized
agatgcctgactttaaacaaag

SEQ ID NO: 852442 - DNA, 22 bp, Artificial Sequence
  chemically synthesized
gatgcctgactttaaacaaagc

SEQ ID NO: 852443 - DNA, 22 bp, Artificial Sequence
  chemically synthesized
tagaaatagcatgagctttgtt

SEQ ID NO: 852444 - DNA, 22 bp, Artificial Sequence
  chemically synthesized
gtagaaatagcatgagctttgt

SEQ ID NO: 852445 - DNA, 22 bp, Artificial Sequence
  chemically synthesized
actttaaacaaagctcatgcta

SEQ ID NO: 852446 - DNA, 22 bp, Artificial Sequence
  chemically synthesized
tatttgtagaaatagcatgagc

SEQ ID NO: 852447 - DNA, 22 bp, Artificial Sequence
  chemically synthesized
gtatttgtagaaatagcatgag

SEQ ID NO: 852448 - DNA, 22 bp, Artificial Sequence
  chemically synthesized
ttgtatttgtagaaatagcatg

SEQ ID NO: 852449 - DNA, 22 bp, Artificial Sequence
  chemically synthesized
taaacaaagctcatgctatttc

SEQ ID NO: 852450 - DNA, 22 bp, Artificial Sequence
  chemically synthesized
cttgtatttgtagaaatagcat

SEQ ID NO: 852451 - DNA, 22 bp, Artificial Sequence
  chemically synthesized
aaacaaagctcatgctatttct

SEQ ID NO: 852452 - DNA, 22 bp, Artificial Sequence
  chemically synthesized
tcttgtatttgtagaaatagca

SEQ ID NO: 852453 - DNA, 22 bp, Artificial Sequence
  chemically synthesized
aacaaagctcatgctatttcta

SEQ ID NO: 852454 - DNA, 22 bp, Artificial Sequence
  chemically synthesized
gttttcttgtatttgtagaaat

SEQ ID NO: 852455 - DNA, 22 bp, Artificial Sequence
  chemically synthesized
tggttttcttgtatttgtagaa

SEQ ID NO: 852456 - DNA, 22 bp, Artificial Sequence
  chemically synthesized
ctggttttcttgtatttgtaga

SEQ ID NO: 852457 - DNA, 22 bp, Artificial Sequence
  chemically synthesized
tctggttttcttgtatttgtag

SEQ ID NO: 852458 - DNA, 22 bp, Artificial Sequence
  chemically synthesized
ttctggttttcttgtatttgta

SEQ ID NO: 852459 - DNA, 22 bp, Artificial Sequence
  chemically synthesized
tttctggttttcttgtatttgt

SEQ ID NO: 852460 - DNA, 22 bp, Artificial Sequence
  chemically synthesized
atgctatttctacaaatacaag

SEQ ID NO: 852461 - DNA, 22 bp, Artificial Sequence
  chemically synthesized
ttttctggttttcttgtatttg

SEQ ID NO: 852462 - DNA, 22 bp, Artificial Sequence
  chemically synthesized
tttctacaaatacaagaaaacc

SEQ ID NO: 852463 - DNA, 22 bp, Artificial Sequence
  chemically synthesized
ctacaaatacaagaaaaccaga

SEQ ID NO: 852464 - DNA, 22 bp, Artificial Sequence
  chemically synthesized
tacaaatacaagaaaaccagaa

SEQ ID NO: 852465 - DNA, 22 bp, Artificial Sequence
  chemically synthesized
tgtgaatatttttttctggttt

SEQ ID NO: 852466 - DNA, 22 bp, Artificial Sequence
  chemically synthesized
caaatacaagaaaaccagaaaa

SEQ ID NO: 852467 - DNA, 22 bp, Artificial Sequence
  chemically synthesized
agactatgtgaatatttttttc

SEQ ID NO: 852468 - DNA, 22 bp, Artificial Sequence
  chemically synthesized
aagactatgtgaatattttttt

SEQ ID NO: 852469 - DNA, 22 bp, Artificial Sequence
  chemically synthesized
taagactatgtgaatatttttt

SEQ ID NO: 852470 - DNA, 22 bp, Artificial Sequence
  chemically synthesized
aaatatagagaagctttaagac

SEQ ID NO: 852471 - DNA, 22 bp, Artificial Sequence
  chemically synthesized
ctgaaatatagagaagctttaa

SEQ ID NO: 852472 - DNA, 22 bp, Artificial Sequence
  chemically synthesized
acatagtcttaaagcttctcta

SEQ ID NO: 852473 - DNA, 22 bp, Artificial Sequence
  chemically synthesized
accccctcctgaaatatagaga

SEQ ID NO: 852474 - DNA, 22 bp, Artificial Sequence
  chemically synthesized
caccccctcctgaaatatagag

SEQ ID NO: 852475 - DNA, 22 bp, Artificial Sequence
  chemically synthesized
cttcaccccctcctgaaatata

SEQ ID NO: 852476 - DNA, 22 bp, Artificial Sequence
  chemically synthesized
aaagcttctctatatttcagga

SEQ ID NO: 852477 - DNA, 22 bp, Artificial Sequence
  chemically synthesized
aagcttctctatatttcaggag

SEQ ID NO: 852478 - DNA, 22 bp, Artificial Sequence
  chemically synthesized
agttacttcaccccctcctgaa

SEQ ID NO: 852479 - DNA, 22 bp, Artificial Sequence
  chemically synthesized
ctctatatttcaggagggggtg

SEQ ID NO: 852480 - DNA, 22 bp, Artificial Sequence
  chemically synthesized
tctatatttcaggagggggtga

SEQ ID NO: 852481 - DNA, 22 bp, Artificial Sequence
  chemically synthesized
tatatttcaggagggggtgaag

SEQ ID NO: 852482 - DNA, 22 bp, Artificial Sequence
  chemically synthesized
tatttcaggagggggtgaagta

SEQ ID NO: 852483 - DNA, 22 bp, Artificial Sequence
  chemically synthesized
atataattcagttacttcaccc

SEQ ID NO: 852484 - DNA, 22 bp, Artificial Sequence
  chemically synthesized
ttaatataattcagttacttca

SEQ ID NO: 852485 - DNA, 22 bp, Artificial Sequence
  chemically synthesized
caggagggggtgaagtaactga

SEQ ID NO: 852486 - DNA, 22 bp, Artificial Sequence
  chemically synthesized
aggagggggtgaagtaactgaa

SEQ ID NO: 852487 - DNA, 22 bp, Artificial Sequence
  chemically synthesized
ggtatcatggtaaagaacactg

SEQ ID NO: 852488 - DNA, 22 bp, Artificial Sequence
  chemically synthesized
aattatattaacagtgttcttt

SEQ ID NO: 852489 - DNA, 22 bp, Artificial Sequence
  chemically synthesized
tattaacagtgttctttaccat

SEQ ID NO: 852490 - DNA, 22 bp, Artificial Sequence
  chemically synthesized
acagtgttctttaccatgatac

SEQ ID NO: 852491 - DNA, 22 bp, Artificial Sequence
  chemically synthesized
atgacaagaattgggtatcatg

SEQ ID NO: 852492 - DNA, 22 bp, Artificial Sequence
  chemically synthesized
ttcatgacaagaattgggtatc

SEQ ID NO: 852493 - DNA, 22 bp, Artificial Sequence
  chemically synthesized
attcatgacaagaattgggtat

SEQ ID NO: 852494 - DNA, 22 bp, Artificial Sequence
  chemically synthesized
tattcatgacaagaattgggta

SEQ ID NO: 852495 - DNA, 22 bp, Artificial Sequence
  chemically synthesized
ttattcatgacaagaattgggt

SEQ ID NO: 852496 - DNA, 22 bp, Artificial Sequence
  chemically synthesized
tttaccatgatacccaattctt

SEQ ID NO: 852497 - DNA, 22 bp, Artificial Sequence
  chemically synthesized
taccatgatacccaattcttgt

SEQ ID NO: 852498 - DNA, 22 bp, Artificial Sequence
  chemically synthesized
accatgatacccaattcttgtc

SEQ ID NO: 852499 - DNA, 22 bp, Artificial Sequence
  chemically synthesized
ccatgatacccaattcttgtca

SEQ ID NO: 852500 - DNA, 22 bp, Artificial Sequence
  chemically synthesized
aacatcaccttttattcatgac

SEQ ID NO: 852501 - DNA, 22 bp, Artificial Sequence
  chemically synthesized
tgaacatcaccttttattcatg

SEQ ID NO: 852502 - DNA, 22 bp, Artificial Sequence
  chemically synthesized
ttgtcatgaataaaaggtgatg

SEQ ID NO: 852503 - DNA, 22 bp, Artificial Sequence
  chemically synthesized
gtcatgaataaaaggtgatgtt

SEQ ID NO: 852504 - DNA, 22 bp, Artificial Sequence
  chemically synthesized
atgacatctctgaacatcacct

SEQ ID NO: 852505 - DNA, 22 bp, Artificial Sequence
  chemically synthesized
tcatgaataaaaggtgatgttc

SEQ ID NO: 852506 - DNA, 22 bp, Artificial Sequence
  chemically synthesized
gatgacatctctgaacatcacc

SEQ ID NO: 852507 - DNA, 22 bp, Artificial Sequence
  chemically synthesized
tttgatgacatctctgaacatc

SEQ ID NO: 852508 - DNA, 22 bp, Artificial Sequence
  chemically synthesized
tcaattatttgatgacatctct

SEQ ID NO: 852509 - DNA, 22 bp, Artificial Sequence
  chemically synthesized
gtcaattatttgatgacatctc

SEQ ID NO: 852510 - DNA, 22 bp, Artificial Sequence
  chemically synthesized
tgtcaattatttgatgacatct

SEQ ID NO: 852511 - DNA, 22 bp, Artificial Sequence
  chemically synthesized
ttgtcaattatttgatgacatc

SEQ ID NO: 852512 - DNA, 22 bp, Artificial Sequence
  chemically synthesized
tttgtcaattatttgatgacat

SEQ ID NO: 852513 - DNA, 22 bp, Artificial Sequence
  chemically synthesized
ttttgtcaattatttgatgaca

SEQ ID NO: 852514 - DNA, 22 bp, Artificial Sequence
  chemically synthesized
tttttgtcaattatttgatgac

SEQ ID NO: 852515 - DNA, 22 bp, Artificial Sequence
  chemically synthesized
ttttttgtcaattatttgatga

SEQ ID NO: 852516 - DNA, 22 bp, Artificial Sequence
  chemically synthesized
tttttttgtcaattatttgatg

SEQ ID NO: 852517 - DNA, 22 bp, Artificial Sequence
  chemically synthesized
ttttttttgtcaattatttgat

SEQ ID NO: 852518 - DNA, 22 bp, Artificial Sequence
  chemically synthesized
tttttttttgtcaattatttga

SEQ ID NO: 852519 - DNA, 22 bp, Artificial Sequence
  chemically synthesized
ttttttttttgtcaattatttg

SEQ ID NO: 852520 - DNA, 22 bp, Artificial Sequence
  chemically synthesized
agagatgtcatcaaataattga

SEQ ID NO: 852521 - DNA, 22 bp, Artificial Sequence
  chemically synthesized
tttttttttttgtcaattattt

SEQ ID NO: 852522 - DNA, 22 bp, Artificial Sequence
  chemically synthesized
ttttttttttttgtcaattatt

SEQ ID NO: 852523 - DNA, 22 bp, Artificial Sequence
  chemically synthesized
tccttttttttttttttgtcaa

SEQ ID NO: 852524 - DNA, 22 bp, Artificial Sequence
  chemically synthesized
atccttttttttttttttgtca

SEQ ID NO: 852525 - DNA, 22 bp, Artificial Sequence
  chemically synthesized
ttatccttttttttttttttgt

SEQ ID NO: 852526 - DNA, 22 bp, Artificial Sequence
  chemically synthesized
cttatccttttttttttttttg

SEQ ID NO: 852527 - DNA, 22 bp, Artificial Sequence
  chemically synthesized
tcttatcctttttttttttttt

SEQ ID NO: 852528 - DNA, 22 bp, Artificial Sequence
  chemically synthesized
ttcttatccttttttttttttt

SEQ ID NO: 852529 - DNA, 22 bp, Artificial Sequence
  chemically synthesized
tttcttatcctttttttttttt

SEQ ID NO: 852530 - DNA, 22 bp, Artificial Sequence
  chemically synthesized
ttttcttatccttttttttttt

SEQ ID NO: 852531 - DNA, 22 bp, Artificial Sequence
  chemically synthesized
cttttttcttatcctttttttt

SEQ ID NO: 852532 - DNA, 22 bp, Artificial Sequence
  chemically synthesized
acaaaaaaaaaaaaaaggataa

SEQ ID NO: 852533 - DNA, 22 bp, Artificial Sequence
  chemically synthesized
attccttttttcttatcctttt

SEQ ID NO: 852534 - DNA, 22 bp, Artificial Sequence
  chemically synthesized
cattccttttttcttatccttt

SEQ ID NO: 852535 - DNA, 22 bp, Artificial Sequence
  chemically synthesized
tttcattccttttttcttatcc

SEQ ID NO: 852536 - DNA, 22 bp, Artificial Sequence
  chemically synthesized
atttcattccttttttcttatc

SEQ ID NO: 852537 - DNA, 22 bp, Artificial Sequence
  chemically synthesized
ccttatttcattccttttttct

SEQ ID NO: 852538 - DNA, 22 bp, Artificial Sequence
  chemically synthesized
gtcactaccttatttcattcct

SEQ ID NO: 852539 - DNA, 22 bp, Artificial Sequence
  chemically synthesized
ggtcactaccttatttcattcc

SEQ ID NO: 852540 - DNA, 22 bp, Artificial Sequence
  chemically synthesized
ataaaaagggaaggtttggtca

SEQ ID NO: 852541 - DNA, 22 bp, Artificial Sequence
  chemically synthesized
atcactgataaaaagggaaggt

SEQ ID NO: 852542 - DNA, 22 bp, Artificial Sequence
  chemically synthesized
gatcactgataaaaagggaagg

SEQ ID NO: 852543 - DNA, 22 bp, Artificial Sequence
  chemically synthesized
tgatcactgataaaaagggaag

SEQ ID NO: 852544 - DNA, 22 bp, Artificial Sequence
  chemically synthesized
ccctttttatcagtgatcaaaa

SEQ ID NO: 852545 - DNA, 22 bp, Artificial Sequence
  chemically synthesized
cctttttatcagtgatcaaaat

SEQ ID NO: 852546 - DNA, 22 bp, Artificial Sequence
  chemically synthesized
tttatcagtgatcaaaatcctt

SEQ ID NO: 852547 - DNA, 22 bp, Artificial Sequence
  chemically synthesized
ttatcagtgatcaaaatccttg

SEQ ID NO: 852548 - DNA, 22 bp, Artificial Sequence
  chemically synthesized
tatcagtgatcaaaatccttgc

SEQ ID NO: 852549 - DNA, 22 bp, Artificial Sequence
  chemically synthesized
atcagtgatcaaaatccttgct

SEQ ID NO: 852550 - DNA, 22 bp, Artificial Sequence
  chemically synthesized
taaatatgtaaaagcaaggatt

SEQ ID NO: 852551 - DNA, 22 bp, Artificial Sequence
  chemically synthesized
tcagtgatcaaaatccttgctt

SEQ ID NO: 852552 - DNA, 22 bp, Artificial Sequence
  chemically synthesized
ataaatatgtaaaagcaaggat

SEQ ID NO: 852553 - DNA, 22 bp, Artificial Sequence
  chemically synthesized
tataaatatgtaaaagcaagga

SEQ ID NO: 852554 - DNA, 22 bp, Artificial Sequence
  chemically synthesized
gcttttacatatttataaaatc

SEQ ID NO: 852555 - DNA, 22 bp, Artificial Sequence
  chemically synthesized
cttttacatatttataaaatcc

SEQ ID NO: 852556 - DNA, 22 bp, Artificial Sequence
  chemically synthesized
ttacatatttataaaatccatt

SEQ ID NO: 852557 - DNA, 22 bp, Artificial Sequence
  chemically synthesized
tacatatttataaaatccattc

SEQ ID NO: 852558 - DNA, 22 bp, Artificial Sequence
  chemically synthesized
acatatttataaaatccattct

SEQ ID NO: 852559 - DNA, 22 bp, Artificial Sequence
  chemically synthesized
catatttataaaatccattcta

SEQ ID NO: 852560 - DNA, 22 bp, Artificial Sequence
  chemically synthesized
cacatccagagaaatagaatgg

SEQ ID NO: 852561 - DNA, 22 bp, Artificial Sequence
  chemically synthesized
attacacatccagagaaataga

SEQ ID NO: 852562 - DNA, 22 bp, Artificial Sequence
  chemically synthesized
ataaaatccattctatttctct

SEQ ID NO: 852563 - DNA, 22 bp, Artificial Sequence
  chemically synthesized
cattacacatccagagaaatag

SEQ ID NO: 852564 - DNA, 22 bp, Artificial Sequence
  chemically synthesized
taaaatccattctatttctctg

SEQ ID NO: 852565 - DNA, 22 bp, Artificial Sequence
  chemically synthesized
tcattacacatccagagaaata

SEQ ID NO: 852566 - DNA, 22 bp, Artificial Sequence
  chemically synthesized
tttcattacacatccagagaaa

SEQ ID NO: 852567 - DNA, 22 bp, Artificial Sequence
  chemically synthesized
ctttcattacacatccagagaa

SEQ ID NO: 852568 - DNA, 22 bp, Artificial Sequence
  chemically synthesized
tctttcattacacatccagaga

SEQ ID NO: 852569 - DNA, 22 bp, Artificial Sequence
  chemically synthesized
attttctttcattacacatcca

SEQ ID NO: 852570 - DNA, 22 bp, Artificial Sequence
  chemically synthesized
tatttctctggatgtgtaatga

SEQ ID NO: 852571 - DNA, 22 bp, Artificial Sequence
  chemically synthesized
tttctctggatgtgtaatgaaa

SEQ ID NO: 852572 - DNA, 22 bp, Artificial Sequence
  chemically synthesized
ctctggatgtgtaatgaaagaa

SEQ ID NO: 852573 - DNA, 22 bp, Artificial Sequence
  chemically synthesized
tctggatgtgtaatgaaagaaa

SEQ ID NO: 852574 - DNA, 22 bp, Artificial Sequence
  chemically synthesized
tggatgtgtaatgaaagaaaat

SEQ ID NO: 852575 - DNA, 22 bp, Artificial Sequence
  chemically synthesized
gatgtgtaatgaaagaaaatga

SEQ ID NO: 852576 - DNA, 22 bp, Artificial Sequence
  chemically synthesized
gaaatgaacatacatattcatt

SEQ ID NO: 852577 - DNA, 22 bp, Artificial Sequence
  chemically synthesized
aaatggattagaaatgaacata

SEQ ID NO: 852578 - DNA, 22 bp, Artificial Sequence
  chemically synthesized
caaatggattagaaatgaacat

SEQ ID NO: 852579 - DNA, 22 bp, Artificial Sequence
  chemically synthesized
tttcaaatggattagaaatgaa

SEQ ID NO: 852580 - DNA, 22 bp, Artificial Sequence
  chemically synthesized
ttatttcaaatggattagaaat

SEQ ID NO: 852581 - DNA, 22 bp, Artificial Sequence
  chemically synthesized
gttatttcaaatggattagaaa

SEQ ID NO: 852582 - DNA, 22 bp, Artificial Sequence
  chemically synthesized
tgttatttcaaatggattagaa

SEQ ID NO: 852583 - DNA, 22 bp, Artificial Sequence
  chemically synthesized
ttgttatttcaaatggattaga

SEQ ID NO: 852584 - DNA, 22 bp, Artificial Sequence
  chemically synthesized
ttttgttatttcaaatggatta

SEQ ID NO: 852585 - DNA, 22 bp, Artificial Sequence
  chemically synthesized
atttctaatccatttgaaataa

SEQ ID NO: 852586 - DNA, 22 bp, Artificial Sequence
  chemically synthesized
ctaatccatttgaaataacaaa

SEQ ID NO: 852587 - DNA, 22 bp, Artificial Sequence
  chemically synthesized
taatccatttgaaataacaaaa

SEQ ID NO: 852588 - DNA, 22 bp, Artificial Sequence
  chemically synthesized
agaatgccatctcttttgttat

SEQ ID NO: 852589 - DNA, 22 bp, Artificial Sequence
  chemically synthesized
atccatttgaaataacaaaaga

SEQ ID NO: 852590 - DNA, 22 bp, Artificial Sequence
  chemically synthesized
gaaataacaaaagagatggcat

SEQ ID NO: 852591 - DNA, 22 bp, Artificial Sequence
  chemically synthesized
aaataacaaaagagatggcatt

SEQ ID NO: 852592 - DNA, 22 bp, Artificial Sequence
  chemically synthesized
gaaagagaatgtggactcagaa

SEQ ID NO: 852593 - DNA, 22 bp, Artificial Sequence
  chemically synthesized
aaatctggaaagagaatgtgga

SEQ ID NO: 852594 - DNA, 22 bp, Artificial Sequence
  chemically synthesized
aaaatctggaaagagaatgtgg

SEQ ID NO: 852595 - DNA, 22 bp, Artificial Sequence
  chemically synthesized
tgagtccacattctctttccag

SEQ ID NO: 852596 - DNA, 22 bp, Artificial Sequence
  chemically synthesized
taaaacttaaaatctggaaaga

SEQ ID NO: 852597 - DNA, 22 bp, Artificial Sequence
  chemically synthesized
agtccacattctctttccagat

SEQ ID NO: 852598 - DNA, 22 bp, Artificial Sequence
  chemically synthesized
tctttccagattttaagtttta

SEQ ID NO: 852599 - DNA, 22 bp, Artificial Sequence
  chemically synthesized
cgtaagtaattataaaacttaa

SEQ ID NO: 852600 - DNA, 22 bp, Artificial Sequence
  chemically synthesized
tttccagattttaagttttata

SEQ ID NO: 852601 - DNA, 22 bp, Artificial Sequence
  chemically synthesized
tccagattttaagttttataat

SEQ ID NO: 852602 - DNA, 22 bp, Artificial Sequence
  chemically synthesized
ccagattttaagttttataatt

SEQ ID NO: 852603 - DNA, 22 bp, Artificial Sequence
  chemically synthesized
cagattttaagttttataatta

SEQ ID NO: 852604 - DNA, 22 bp, Artificial Sequence
  chemically synthesized
atagtgttacgtaagtaattat

SEQ ID NO: 852605 - DNA, 22 bp, Artificial Sequence
  chemically synthesized
taagttttataattacttacgt

SEQ ID NO: 852606 - DNA, 22 bp, Artificial Sequence
  chemically synthesized
gttgatagtgttacgtaagtaa

SEQ ID NO: 852607 - DNA, 22 bp, Artificial Sequence
  chemically synthesized
aagttttataattacttacgta

SEQ ID NO: 852608 - DNA, 22 bp, Artificial Sequence
  chemically synthesized
agttttataattacttacgtaa

SEQ ID NO: 852609 - DNA, 22 bp, Artificial Sequence
  chemically synthesized
ttcgttgatagtgttacgtaag

SEQ ID NO: 852610 - DNA, 22 bp, Artificial Sequence
  chemically synthesized
tataattacttacgtaacacta

SEQ ID NO: 852611 - DNA, 22 bp, Artificial Sequence
  chemically synthesized
ataattacttacgtaacactat

SEQ ID NO: 852612 - DNA, 22 bp, Artificial Sequence
  chemically synthesized
tcctattcgttgatagtgttac

SEQ ID NO: 852613 - DNA, 22 bp, Artificial Sequence
  chemically synthesized
taattacttacgtaacactatc

SEQ ID NO: 852614 - DNA, 22 bp, Artificial Sequence
  chemically synthesized
ttgtcctattcgttgatagtgt

SEQ ID NO: 852615 - DNA, 22 bp, Artificial Sequence
  chemically synthesized
tattgtcctattcgttgatagt

SEQ ID NO: 852616 - DNA, 22 bp, Artificial Sequence
  chemically synthesized
cttacgtaacactatcaacgaa

SEQ ID NO: 852617 - DNA, 22 bp, Artificial Sequence
  chemically synthesized
acgtaacactatcaacgaatag

SEQ ID NO: 852618 - DNA, 22 bp, Artificial Sequence
  chemically synthesized
tattctattgtcctattcgttg

SEQ ID NO: 852619 - DNA, 22 bp, Artificial Sequence
  chemically synthesized
cgtaacactatcaacgaatagg

SEQ ID NO: 852620 - DNA, 22 bp, Artificial Sequence
  chemically synthesized
gtattctattgtcctattcgtt

SEQ ID NO: 852621 - DNA, 22 bp, Artificial Sequence
  chemically synthesized
tttgtattctattgtcctattc

SEQ ID NO: 852622 - DNA, 22 bp, Artificial Sequence
  chemically synthesized
gtttgtattctattgtcctatt

SEQ ID NO: 852623 - DNA, 22 bp, Artificial Sequence
  chemically synthesized
tgtttgtattctattgtcctat

SEQ ID NO: 852624 - DNA, 22 bp, Artificial Sequence
  chemically synthesized
ttgtttgtattctattgtccta

SEQ ID NO: 852625 - DNA, 22 bp, Artificial Sequence
  chemically synthesized
tttgtttgtattctattgtcct

SEQ ID NO: 852626 - DNA, 22 bp, Artificial Sequence
  chemically synthesized
tcaacgaataggacaatagaat

SEQ ID NO: 852627 - DNA, 22 bp, Artificial Sequence
  chemically synthesized
actttttgtttgtattctattg

SEQ ID NO: 852628 - DNA, 22 bp, Artificial Sequence
  chemically synthesized
aaaaggattcactttttgtttg

SEQ ID NO: 852629 - DNA, 22 bp, Artificial Sequence
  chemically synthesized
taaaaaggattcactttttgtt

SEQ ID NO: 852630 - DNA, 22 bp, Artificial Sequence
  chemically synthesized
ctaaaaaggattcactttttgt

SEQ ID NO: 852631 - DNA, 22 bp, Artificial Sequence
  chemically synthesized
tcttctaaaaaggattcacttt

SEQ ID NO: 852632 - DNA, 22 bp, Artificial Sequence
  chemically synthesized
aaactgtcttctaaaaaggatt

SEQ ID NO: 852633 - DNA, 22 bp, Artificial Sequence
  chemically synthesized
tactcaaactgtcttctaaaaa

SEQ ID NO: 852634 - DNA, 22 bp, Artificial Sequence
  chemically synthesized
gtactcaaactgtcttctaaaa

SEQ ID NO: 852635 - DNA, 22 bp, Artificial Sequence
  chemically synthesized
tttagaagacagtttgagtaca

SEQ ID NO: 852636 - DNA, 22 bp, Artificial Sequence
  chemically synthesized
ttagaagacagtttgagtacaa

SEQ ID NO: 852637 - DNA, 22 bp, Artificial Sequence
  chemically synthesized
tagaagacagtttgagtacaaa

SEQ ID NO: 852638 - DNA, 22 bp, Artificial Sequence
  chemically synthesized
agaagacagtttgagtacaaac

SEQ ID NO: 852639 - DNA, 22 bp, Artificial Sequence
  chemically synthesized
gaagacagtttgagtacaaact

SEQ ID NO: 852640 - DNA, 22 bp, Artificial Sequence
  chemically synthesized
gagtacaaactgctatatatta

SEQ ID NO: 852641 - DNA, 22 bp, Artificial Sequence
  chemically synthesized
aagagtagtacataatatatag

SEQ ID NO: 852642 - DNA, 22 bp, Artificial Sequence
  chemically synthesized
agtacaaactgctatatattat

SEQ ID NO: 852643 - DNA, 22 bp, Artificial Sequence
  chemically synthesized
aaagagtagtacataatatata

SEQ ID NO: 852644 - DNA, 22 bp, Artificial Sequence
  chemically synthesized
taaagagtagtacataatatat

SEQ ID NO: 852645 - DNA, 22 bp, Artificial Sequence
  chemically synthesized
ctatatattatgtactactctt

SEQ ID NO: 852646 - DNA, 22 bp, Artificial Sequence
  chemically synthesized
catgagagctttaaagagtagt

SEQ ID NO: 852647 - DNA, 22 bp, Artificial Sequence
  chemically synthesized
tatattatgtactactctttaa

SEQ ID NO: 852648 - DNA, 22 bp, Artificial Sequence
  chemically synthesized
aaatctgcatgagagctttaaa

SEQ ID NO: 852649 - DNA, 22 bp, Artificial Sequence
  chemically synthesized
tgtactactctttaaagctctc

SEQ ID NO: 852650 - DNA, 22 bp, Artificial Sequence
  chemically synthesized
ttaaaatctgcatgagagcttt

SEQ ID NO: 852651 - DNA, 22 bp, Artificial Sequence
  chemically synthesized
attattaaaatctgcatgagag

SEQ ID NO: 852652 - DNA, 22 bp, Artificial Sequence
  chemically synthesized
ctctttaaagctctcatgcaga

SEQ ID NO: 852653 - DNA, 22 bp, Artificial Sequence
  chemically synthesized
attaattattaaaatctgcatg

SEQ ID NO: 852654 - DNA, 22 bp, Artificial Sequence
  chemically synthesized
tttaaagctctcatgcagattt

SEQ ID NO: 852655 - DNA, 22 bp, Artificial Sequence
  chemically synthesized
taaagctctcatgcagatttta

SEQ ID NO: 852656 - DNA, 22 bp, Artificial Sequence
  chemically synthesized
aaagctctcatgcagattttaa

SEQ ID NO: 852657 - DNA, 22 bp, Artificial Sequence
  chemically synthesized
aagctctcatgcagattttaat

SEQ ID NO: 852658 - DNA, 22 bp, Artificial Sequence
  chemically synthesized
gaatattgattaattattaaaa

SEQ ID NO: 852659 - DNA, 22 bp, Artificial Sequence
  chemically synthesized
agaatattgattaattattaaa

SEQ ID NO: 852660 - DNA, 22 bp, Artificial Sequence
  chemically synthesized
tcatgcagattttaataattaa

SEQ ID NO: 852661 - DNA, 22 bp, Artificial Sequence
  chemically synthesized
atgcagattttaataattaatc

SEQ ID NO: 852662 - DNA, 22 bp, Artificial Sequence
  chemically synthesized
tatttagaatattgattaatta

SEQ ID NO: 852663 - DNA, 22 bp, Artificial Sequence
  chemically synthesized
atatttagaatattgattaatt

SEQ ID NO: 852664 - DNA, 22 bp, Artificial Sequence
  chemically synthesized
taataattaatcaatattctaa

SEQ ID NO: 852665 - DNA, 22 bp, Artificial Sequence
  chemically synthesized
aataattaatcaatattctaaa

SEQ ID NO: 852666 - DNA, 22 bp, Artificial Sequence
  chemically synthesized
ataattaatcaatattctaaat

SEQ ID NO: 852667 - DNA, 22 bp, Artificial Sequence
  chemically synthesized
catatagtaatttatatttaga

SEQ ID NO: 852668 - DNA, 22 bp, Artificial Sequence
  chemically synthesized
acatatagtaatttatatttag

SEQ ID NO: 852669 - DNA, 22 bp, Artificial Sequence
  chemically synthesized
tacatatagtaatttatattta

SEQ ID NO: 852670 - DNA, 22 bp, Artificial Sequence
  chemically synthesized
atcaatattctaaatataaatt

SEQ ID NO: 852671 - DNA, 22 bp, Artificial Sequence
  chemically synthesized
ctttacatatagtaatttatat

SEQ ID NO: 852672 - DNA, 22 bp, Artificial Sequence
  chemically synthesized
ctgctttacatatagtaattta

SEQ ID NO: 852673 - DNA, 22 bp, Artificial Sequence
  chemically synthesized
taaatataaattactatatgta

SEQ ID NO: 852674 - DNA, 22 bp, Artificial Sequence
  chemically synthesized
aatataaattactatatgtaaa

SEQ ID NO: 852675 - DNA, 22 bp, Artificial Sequence
  chemically synthesized
taaaaatagattactgctttac

SEQ ID NO: 852676 - DNA, 22 bp, Artificial Sequence
  chemically synthesized
ataaaaatagattactgcttta

SEQ ID NO: 852677 - DNA, 22 bp, Artificial Sequence
  chemically synthesized
tttataaaaatagattactgct

SEQ ID NO: 852678 - DNA, 22 bp, Artificial Sequence
  chemically synthesized
atttataaaaatagattactgc

SEQ ID NO: 852679 - DNA, 22 bp, Artificial Sequence
  chemically synthesized
ctatatgtaaagcagtaatcta

SEQ ID NO: 852680 - DNA, 22 bp, Artificial Sequence
  chemically synthesized
tatttataaaaatagattactg

SEQ ID NO: 852681 - DNA, 22 bp, Artificial Sequence
  chemically synthesized
tatgtaaagcagtaatctattt

SEQ ID NO: 852682 - DNA, 22 bp, Artificial Sequence
  chemically synthesized
cgaaatcattttatttataaaa

SEQ ID NO: 852683 - DNA, 22 bp, Artificial Sequence
  chemically synthesized
tacgaaatcattttatttataa

SEQ ID NO: 852684 - DNA, 22 bp, Artificial Sequence
  chemically synthesized
tttttataaataaaatgatttc

SEQ ID NO: 852685 - DNA, 22 bp, Artificial Sequence
  chemically synthesized
acacagcattctacgaaatcat

SEQ ID NO: 852686 - DNA, 22 bp, Artificial Sequence
  chemically synthesized
ttataaataaaatgatttcgta

SEQ ID NO: 852687 - DNA, 22 bp, Artificial Sequence
  chemically synthesized
aacacagcattctacgaaatca

SEQ ID NO: 852688 - DNA, 22 bp, Artificial Sequence
  chemically synthesized
tataaataaaatgatttcgtag

SEQ ID NO: 852689 - DNA, 22 bp, Artificial Sequence
  chemically synthesized
ataaataaaatgatttcgtaga

SEQ ID NO: 852690 - DNA, 22 bp, Artificial Sequence
  chemically synthesized
taaataaaatgatttcgtagaa

SEQ ID NO: 852691 - DNA, 22 bp, Artificial Sequence
  chemically synthesized
agggaaagaatttaacacagca

SEQ ID NO: 852692 - DNA, 22 bp, Artificial Sequence
  chemically synthesized
tctgagggaaagaatttaacac

SEQ ID NO: 852693 - DNA, 22 bp, Artificial Sequence
  chemically synthesized
cgtagaatgctgtgttaaattc

SEQ ID NO: 852694 - DNA, 22 bp, Artificial Sequence
  chemically synthesized
gtagaatgctgtgttaaattct

SEQ ID NO: 852695 - DNA, 22 bp, Artificial Sequence
  chemically synthesized
gagcaactgtctgagggaaaga

SEQ ID NO: 852696 - DNA, 22 bp, Artificial Sequence
  chemically synthesized
tagagcaactgtctgagggaaa

SEQ ID NO: 852697 - DNA, 22 bp, Artificial Sequence
  chemically synthesized
tgttaaattctttccctcagac

SEQ ID NO: 852698 - DNA, 22 bp, Artificial Sequence
  chemically synthesized
tctagagcaactgtctgaggga

SEQ ID NO: 852699 - DNA, 22 bp, Artificial Sequence
  chemically synthesized
ctctagagcaactgtctgaggg

SEQ ID NO: 852700 - DNA, 22 bp, Artificial Sequence
  chemically synthesized
cttctctagagcaactgtctga

SEQ ID NO: 852701 - DNA, 22 bp, Artificial Sequence
  chemically synthesized
aattctttccctcagacagttg

SEQ ID NO: 852702 - DNA, 22 bp, Artificial Sequence
  chemically synthesized
tttccctcagacagttgctcta

SEQ ID NO: 852703 - DNA, 22 bp, Artificial Sequence
  chemically synthesized
tccctcagacagttgctctaga

SEQ ID NO: 852704 - DNA, 22 bp, Artificial Sequence
  chemically synthesized
ccctcagacagttgctctagag

SEQ ID NO: 852705 - DNA, 22 bp, Artificial Sequence
  chemically synthesized
cctcagacagttgctctagaga

SEQ ID NO: 852706 - DNA, 22 bp, Artificial Sequence
  chemically synthesized
agacagttgctctagagaagga

SEQ ID NO: 852707 - DNA, 22 bp, Artificial Sequence
  chemically synthesized
ccagggtccaagcagccattcc

SEQ ID NO: 852708 - DNA, 22 bp, Artificial Sequence
  chemically synthesized
ctctagagaaggaatggctgct

SEQ ID NO: 852709 - DNA, 22 bp, Artificial Sequence
  chemically synthesized
tagagaaggaatggctgcttgg

SEQ ID NO: 852710 - DNA, 22 bp, Artificial Sequence
  chemically synthesized
gagaaggaatggctgcttggac

SEQ ID NO: 852711 - DNA, 22 bp, Artificial Sequence
  chemically synthesized
accatgatgtacctaccagggt

SEQ ID NO: 852712 - DNA, 22 bp, Artificial Sequence
  chemically synthesized
tcaccatgatgtacctaccagg

SEQ ID NO: 852713 - DNA, 22 bp, Artificial Sequence
  chemically synthesized
cttggaccctggtaggtacatc

SEQ ID NO: 852714 - DNA, 22 bp, Artificial Sequence
  chemically synthesized
tgcctctcaccatgatgtacct

SEQ ID NO: 852715 - DNA, 22 bp, Artificial Sequence
  chemically synthesized
gtgcctctcaccatgatgtacc

SEQ ID NO: 852716 - DNA, 22 bp, Artificial Sequence
  chemically synthesized
ggaccctggtaggtacatcatg

SEQ ID NO: 852717 - DNA, 22 bp, Artificial Sequence
  chemically synthesized
gaccctggtaggtacatcatgg

SEQ ID NO: 852718 - DNA, 22 bp, Artificial Sequence
  chemically synthesized
gtaggtacatcatggtgagagg

SEQ ID NO: 852719 - DNA, 22 bp, Artificial Sequence
  chemically synthesized
ccaggataacatttgtgcctct

SEQ ID NO: 852720 - DNA, 22 bp, Artificial Sequence
  chemically synthesized
ttaccaggataacatttgtgcc

SEQ ID NO: 852721 - DNA, 22 bp, Artificial Sequence
  chemically synthesized
tgaagttgttaccaggataaca

SEQ ID NO: 852722 - DNA, 22 bp, Artificial Sequence
  chemically synthesized
gtgaagttgttaccaggataac

SEQ ID NO: 852723 - DNA, 22 bp, Artificial Sequence
  chemically synthesized
taatttgtgaagttgttaccag

SEQ ID NO: 852724 - DNA, 22 bp, Artificial Sequence
  chemically synthesized
tgtctataatttgtgaagttgt

SEQ ID NO: 852725 - DNA, 22 bp, Artificial Sequence
  chemically synthesized
tcctggtaacaacttcacaaat

SEQ ID NO: 852726 - DNA, 22 bp, Artificial Sequence
  chemically synthesized
gcactatgtctataatttgtga

SEQ ID NO: 852727 - DNA, 22 bp, Artificial Sequence
  chemically synthesized
cgcactatgtctataatttgtg

SEQ ID NO: 852728 - DNA, 22 bp, Artificial Sequence
  chemically synthesized
gtaacaacttcacaaattatag

SEQ ID NO: 852729 - DNA, 22 bp, Artificial Sequence
  chemically synthesized
ttcgcactatgtctataatttg

SEQ ID NO: 852730 - DNA, 22 bp, Artificial Sequence
  chemically synthesized
tcttcgcactatgtctataatt

SEQ ID NO: 852731 - DNA, 22 bp, Artificial Sequence
  chemically synthesized
ctcttcgcactatgtctataat

SEQ ID NO: 852732 - DNA, 22 bp, Artificial Sequence
  chemically synthesized
tctcttcgcactatgtctataa

SEQ ID NO: 852733 - DNA, 22 bp, Artificial Sequence
  chemically synthesized
ttctcttcgcactatgtctata

SEQ ID NO: 852734 - DNA, 22 bp, Artificial Sequence
  chemically synthesized
cacaaattatagacatagtgcg

SEQ ID NO: 852735 - DNA, 22 bp, Artificial Sequence
  chemically synthesized
acaaattatagacatagtgcga

SEQ ID NO: 852736 - DNA, 22 bp, Artificial Sequence
  chemically synthesized
gaaatcttttctcttcgcacta

SEQ ID NO: 852737 - DNA, 22 bp, Artificial Sequence
  chemically synthesized
agaaatcttttctcttcgcact

SEQ ID NO: 852738 - DNA, 22 bp, Artificial Sequence
  chemically synthesized
tagaaatcttttctcttcgcac

SEQ ID NO: 852739 - DNA, 22 bp, Artificial Sequence
  chemically synthesized
ttagaaatcttttctcttcgca

SEQ ID NO: 852740 - DNA, 22 bp, Artificial Sequence
  chemically synthesized
tagacatagtgcgaagagaaaa

SEQ ID NO: 852741 - DNA, 22 bp, Artificial Sequence
  chemically synthesized
atcttttagaaatcttttctct

SEQ ID NO: 852742 - DNA, 22 bp, Artificial Sequence
  chemically synthesized
ccaaattaatcttttagaaatc

SEQ ID NO: 852743 - DNA, 22 bp, Artificial Sequence
  chemically synthesized
accaaattaatcttttagaaat

SEQ ID NO: 852744 - DNA, 22 bp, Artificial Sequence
  chemically synthesized
taccaaattaatcttttagaaa

SEQ ID NO: 852745 - DNA, 22 bp, Artificial Sequence
  chemically synthesized
ttaccaaattaatcttttagaa

SEQ ID NO: 852746 - DNA, 22 bp, Artificial Sequence
  chemically synthesized
catatgcttttaccaaattaat

SEQ ID NO: 852747 - DNA, 22 bp, Artificial Sequence
  chemically synthesized
tacatatgcttttaccaaatta

SEQ ID NO: 852748 - DNA, 22 bp, Artificial Sequence
  chemically synthesized
tctacatatgcttttaccaaat

SEQ ID NO: 852749 - DNA, 22 bp, Artificial Sequence
  chemically synthesized
ctaaaagattaatttggtaaaa

SEQ ID NO: 852750 - DNA, 22 bp, Artificial Sequence
  chemically synthesized
ctctacatatgcttttaccaaa

SEQ ID NO: 852751 - DNA, 22 bp, Artificial Sequence
  chemically synthesized
taaaagattaatttggtaaaag

SEQ ID NO: 852752 - DNA, 22 bp, Artificial Sequence
  chemically synthesized
aaagattaatttggtaaaagca

SEQ ID NO: 852753 - DNA, 22 bp, Artificial Sequence
  chemically synthesized
atttctctacatatgcttttac

SEQ ID NO: 852754 - DNA, 22 bp, Artificial Sequence
  chemically synthesized
gatttctctacatatgctttta

SEQ ID NO: 852755 - DNA, 22 bp, Artificial Sequence
  chemically synthesized
atttggtaaaagcatatgtaga

SEQ ID NO: 852756 - DNA, 22 bp, Artificial Sequence
  chemically synthesized
agtcacttgatttctctacata

SEQ ID NO: 852757 - DNA, 22 bp, Artificial Sequence
  chemically synthesized
ggtaaaagcatatgtagagaaa

SEQ ID NO: 852758 - DNA, 22 bp, Artificial Sequence
  chemically synthesized
tgagtcacttgatttctctaca

SEQ ID NO: 852759 - DNA, 22 bp, Artificial Sequence
  chemically synthesized
gtaaaagcatatgtagagaaat

SEQ ID NO: 852760 - DNA, 22 bp, Artificial Sequence
  chemically synthesized
gatgtgtatgtccctctgagtc

SEQ ID NO: 852761 - DNA, 22 bp, Artificial Sequence
  chemically synthesized
gttggatgtgtatgtccctctg

SEQ ID NO: 852762 - DNA, 22 bp, Artificial Sequence
  chemically synthesized
agttggatgtgtatgtccctct

SEQ ID NO: 852763 - DNA, 22 bp, Artificial Sequence
  chemically synthesized
tcttagttggatgtgtatgtcc

SEQ ID NO: 852764 - DNA, 22 bp, Artificial Sequence
  chemically synthesized
agagggacatacacatccaact

SEQ ID NO: 852765 - DNA, 22 bp, Artificial Sequence
  chemically synthesized
agagaacattatcttagttgga

SEQ ID NO: 852766 - DNA, 22 bp, Artificial Sequence
  chemically synthesized
aggagcacagctgagagaacat

SEQ ID NO: 852767 - DNA, 22 bp, Artificial Sequence
  chemically synthesized
gaggagcacagctgagagaaca

SEQ ID NO: 852768 - DNA, 22 bp, Artificial Sequence
  chemically synthesized
agataatgttctctcagctgtg

SEQ ID NO: 852769 - DNA, 22 bp, Artificial Sequence
  chemically synthesized
tgtagagcatcttgaggagcac

SEQ ID NO: 852770 - DNA, 22 bp, Artificial Sequence
  chemically synthesized
gtgtagagcatcttgaggagca

SEQ ID NO: 852771 - DNA, 22 bp, Artificial Sequence
  chemically synthesized
tctcagctgtgctcctcaagat

SEQ ID NO: 852772 - DNA, 22 bp, Artificial Sequence
  chemically synthesized
tcagctgtgctcctcaagatgc

SEQ ID NO: 852773 - DNA, 22 bp, Artificial Sequence
  chemically synthesized
agctgtgctcctcaagatgctc

SEQ ID NO: 852774 - DNA, 22 bp, Artificial Sequence
  chemically synthesized
tgctcctcaagatgctctacac

SEQ ID NO: 852775 - DNA, 22 bp, Artificial Sequence
  chemically synthesized
catggaaaccatttgtgtagag

SEQ ID NO: 852776 - DNA, 22 bp, Artificial Sequence
  chemically synthesized
tccatggaaaccatttgtgtag

SEQ ID NO: 852777 - DNA, 22 bp, Artificial Sequence
  chemically synthesized
ctcaagatgctctacacaaatg

SEQ ID NO: 852778 - DNA, 22 bp, Artificial Sequence
  chemically synthesized
ctccatggaaaccatttgtgta

SEQ ID NO: 852779 - DNA, 22 bp, Artificial Sequence
  chemically synthesized
aagatgctctacacaaatggtt

SEQ ID NO: 852780 - DNA, 22 bp, Artificial Sequence
  chemically synthesized
agtgatttctccatggaaacca

SEQ ID NO: 852781 - DNA, 22 bp, Artificial Sequence
  chemically synthesized
tcagtgatttctccatggaaac

SEQ ID NO: 852782 - DNA, 22 bp, Artificial Sequence
  chemically synthesized
ctcagtgatttctccatggaaa

SEQ ID NO: 852783 - DNA, 22 bp, Artificial Sequence
  chemically synthesized
tacacaaatggtttccatggag

SEQ ID NO: 852784 - DNA, 22 bp, Artificial Sequence
  chemically synthesized
cacaaatggtttccatggagaa

SEQ ID NO: 852785 - DNA, 22 bp, Artificial Sequence
  chemically synthesized
agtatttctcagtgatttctcc

SEQ ID NO: 852786 - DNA, 22 bp, Artificial Sequence
  chemically synthesized
gctcagtatttctcagtgattt

SEQ ID NO: 852787 - DNA, 22 bp, Artificial Sequence
  chemically synthesized
ttagctcagtatttctcagtga

SEQ ID NO: 852788 - DNA, 22 bp, Artificial Sequence
  chemically synthesized
ccatggagaaatcactgagaaa

SEQ ID NO: 852789 - DNA, 22 bp, Artificial Sequence
  chemically synthesized
catggagaaatcactgagaaat

SEQ ID NO: 852790 - DNA, 22 bp, Artificial Sequence
  chemically synthesized
gtattgttagctcagtatttct

SEQ ID NO: 852791 - DNA, 22 bp, Artificial Sequence
  chemically synthesized
ggaatgttagtattgttagctc

SEQ ID NO: 852792 - DNA, 22 bp, Artificial Sequence
  chemically synthesized
aggaatgttagtattgttagct

SEQ ID NO: 852793 - DNA, 22 bp, Artificial Sequence
  chemically synthesized
taggaatgttagtattgttagc

SEQ ID NO: 852794 - DNA, 22 bp, Artificial Sequence
  chemically synthesized
agaaatactgagctaacaatac

SEQ ID NO: 852795 - DNA, 22 bp, Artificial Sequence
  chemically synthesized
ttaggaatgttagtattgttag

SEQ ID NO: 852796 - DNA, 22 bp, Artificial Sequence
  chemically synthesized
aaaagtcttttaggaatgttag

SEQ ID NO: 852797 - DNA, 22 bp, Artificial Sequence
  chemically synthesized
agctaacaatactaacattcct

SEQ ID NO: 852798 - DNA, 22 bp, Artificial Sequence
  chemically synthesized
acaatactaacattcctaaaag

SEQ ID NO: 852799 - DNA, 22 bp, Artificial Sequence
  chemically synthesized
acattcctaaaagacttttcag

SEQ ID NO: 852800 - DNA, 22 bp, Artificial Sequence
  chemically synthesized
catagtaaggtcactgaaaagt

SEQ ID NO: 852801 - DNA, 22 bp, Artificial Sequence
  chemically synthesized
ctaaaagacttttcagtgacct

SEQ ID NO: 852802 - DNA, 22 bp, Artificial Sequence
  chemically synthesized
aaagacttttcagtgaccttac

SEQ ID NO: 852803 - DNA, 22 bp, Artificial Sequence
  chemically synthesized
tgatgtacatctccatagtaag

SEQ ID NO: 852804 - DNA, 22 bp, Artificial Sequence
  chemically synthesized
ttcagtgaccttactatggaga

SEQ ID NO: 852805 - DNA, 22 bp, Artificial Sequence
  chemically synthesized
tcagtgaccttactatggagat

SEQ ID NO: 852806 - DNA, 22 bp, Artificial Sequence
  chemically synthesized
cagtgaccttactatggagatg

SEQ ID NO: 852807 - DNA, 22 bp, Artificial Sequence
  chemically synthesized
agtgaccttactatggagatgt

SEQ ID NO: 852808 - DNA, 22 bp, Artificial Sequence
  chemically synthesized
gcaatctatgatgtacatctcc

SEQ ID NO: 852809 - DNA, 22 bp, Artificial Sequence
  chemically synthesized
tcctagcaatctatgatgtaca

SEQ ID NO: 852810 - DNA, 22 bp, Artificial Sequence
  chemically synthesized
actatggagatgtacatcatag

SEQ ID NO: 852811 - DNA, 22 bp, Artificial Sequence
  chemically synthesized
ctatggagatgtacatcataga

SEQ ID NO: 852812 - DNA, 22 bp, Artificial Sequence
  chemically synthesized
cctatcctagcaatctatgatg

SEQ ID NO: 852813 - DNA, 22 bp, Artificial Sequence
  chemically synthesized
tggagatgtacatcatagattg

SEQ ID NO: 852814 - DNA, 22 bp, Artificial Sequence
  chemically synthesized
aaaaacatgcatagacgttgcc

SEQ ID NO: 852815 - DNA, 22 bp, Artificial Sequence
  chemically synthesized
ctaggataggcaacgtctatgc

SEQ ID NO: 852816 - DNA, 22 bp, Artificial Sequence
  chemically synthesized
ggataggcaacgtctatgcatg

SEQ ID NO: 852817 - DNA, 22 bp, Artificial Sequence
  chemically synthesized
atgaaaaggtcaaataagctga

SEQ ID NO: 852818 - DNA, 22 bp, Artificial Sequence
  chemically synthesized
tgcatgtttttcagcttatttg

SEQ ID NO: 852819 - DNA, 22 bp, Artificial Sequence
  chemically synthesized
ttcagcttatttgaccttttca

SEQ ID NO: 852820 - DNA, 22 bp, Artificial Sequence
  chemically synthesized
tcagcttatttgaccttttcat

SEQ ID NO: 852821 - DNA, 22 bp, Artificial Sequence
  chemically synthesized
cagcttatttgaccttttcatg

SEQ ID NO: 852822 - DNA, 22 bp, Artificial Sequence
  chemically synthesized
atacatgatcctcatgaaaagg

SEQ ID NO: 852823 - DNA, 22 bp, Artificial Sequence
  chemically synthesized
agcttatttgaccttttcatga

SEQ ID NO: 852824 - DNA, 22 bp, Artificial Sequence
  chemically synthesized
atttgaccttttcatgaggatc

SEQ ID NO: 852825 - DNA, 22 bp, Artificial Sequence
  chemically synthesized
tttgaccttttcatgaggatca

SEQ ID NO: 852826 - DNA, 22 bp, Artificial Sequence
  chemically synthesized
gaccttttcatgaggatcatgt

SEQ ID NO: 852827 - DNA, 22 bp, Artificial Sequence
  chemically synthesized
accttttcatgaggatcatgta

SEQ ID NO: 852828 - DNA, 22 bp, Artificial Sequence
  chemically synthesized
atcaggtgttcatacatgatcc

SEQ ID NO: 852829 - DNA, 22 bp, Artificial Sequence
  chemically synthesized
ttcatgaggatcatgtatgaac

SEQ ID NO: 852830 - DNA, 22 bp, Artificial Sequence
  chemically synthesized
tcatgaggatcatgtatgaaca

SEQ ID NO: 852831 - DNA, 22 bp, Artificial Sequence
  chemically synthesized
catgaggatcatgtatgaacac

SEQ ID NO: 852832 - DNA, 22 bp, Artificial Sequence
  chemically synthesized
atgaggatcatgtatgaacacc

SEQ ID NO: 852833 - DNA, 22 bp, Artificial Sequence
  chemically synthesized
cagaaaaccaggttcatcaggt

SEQ ID NO: 852834 - DNA, 22 bp, Artificial Sequence
  chemically synthesized
tcctacagaaaaccaggttcat

SEQ ID NO: 852835 - DNA, 22 bp, Artificial Sequence
  chemically synthesized
caaaattgtcctacagaaaacc

SEQ ID NO: 852836 - DNA, 22 bp, Artificial Sequence
  chemically synthesized
ccaaaattgtcctacagaaaac

SEQ ID NO: 852837 - DNA, 22 bp, Artificial Sequence
  chemically synthesized
atgaacctggttttctgtagga

SEQ ID NO: 852838 - DNA, 22 bp, Artificial Sequence
  chemically synthesized
aacatttccaaaattgtcctac

SEQ ID NO: 852839 - DNA, 22 bp, Artificial Sequence
  chemically synthesized
gttttctgtaggacaattttgg

SEQ ID NO: 852840 - DNA, 22 bp, Artificial Sequence
  chemically synthesized
tctgtaggacaattttggaaat

SEQ ID NO: 852841 - DNA, 22 bp, Artificial Sequence
  chemically synthesized
ctgtaggacaattttggaaatg

SEQ ID NO: 852842 - DNA, 22 bp, Artificial Sequence
  chemically synthesized
tgtaggacaattttggaaatgt

SEQ ID NO: 852843 - DNA, 22 bp, Artificial Sequence
  chemically synthesized
ataaaagatctcaacatttcca

SEQ ID NO: 852844 - DNA, 22 bp, Artificial Sequence
  chemically synthesized
taggacaattttggaaatgttg

SEQ ID NO: 852845 - DNA, 22 bp, Artificial Sequence
  chemically synthesized
gttgataaaagatctcaacatt

SEQ ID NO: 852846 - DNA, 22 bp, Artificial Sequence
  chemically synthesized
tagttgataaaagatctcaaca

SEQ ID NO: 852847 - DNA, 22 bp, Artificial Sequence
  chemically synthesized
ctagttgataaaagatctcaac

SEQ ID NO: 852848 - DNA, 22 bp, Artificial Sequence
  chemically synthesized
tggaaatgttgagatcttttat

SEQ ID NO: 852849 - DNA, 22 bp, Artificial Sequence
  chemically synthesized
ggaaatgttgagatcttttatc

SEQ ID NO: 852850 - DNA, 22 bp, Artificial Sequence
  chemically synthesized
tcatttctagttgataaaagat

SEQ ID NO: 852851 - DNA, 22 bp, Artificial Sequence
  chemically synthesized
gaaatgttgagatcttttatca

SEQ ID NO: 852852 - DNA, 22 bp, Artificial Sequence
  chemically synthesized
agatcttttatcaactagaaat

SEQ ID NO: 852853 - DNA, 22 bp, Artificial Sequence
  chemically synthesized
ggaaatatactatcatttctag

SEQ ID NO: 852854 - DNA, 22 bp, Artificial Sequence
  chemically synthesized
actaggaaatatactatcattt

SEQ ID NO: 852855 - DNA, 22 bp, Artificial Sequence
  chemically synthesized
ttatcaactagaaatgatagta

SEQ ID NO: 852856 - DNA, 22 bp, Artificial Sequence
  chemically synthesized
gactaggaaatatactatcatt

SEQ ID NO: 852857 - DNA, 22 bp, Artificial Sequence
  chemically synthesized
tatcaactagaaatgatagtat

SEQ ID NO: 852858 - DNA, 22 bp, Artificial Sequence
  chemically synthesized
tgactaggaaatatactatcat

SEQ ID NO: 852859 - DNA, 22 bp, Artificial Sequence
  chemically synthesized
atcaactagaaatgatagtata

SEQ ID NO: 852860 - DNA, 22 bp, Artificial Sequence
  chemically synthesized
tcaactagaaatgatagtatat

SEQ ID NO: 852861 - DNA, 22 bp, Artificial Sequence
  chemically synthesized
gaaatgatagtatatttcctag

SEQ ID NO: 852862 - DNA, 22 bp, Artificial Sequence
  chemically synthesized
aaaaatattttgactaggaaat

SEQ ID NO: 852863 - DNA, 22 bp, Artificial Sequence
  chemically synthesized
cctagtcaaaatattttttaac

SEQ ID NO: 852864 - DNA, 22 bp, Artificial Sequence
  chemically synthesized
ctagtcaaaatattttttaacc

SEQ ID NO: 852865 - DNA, 22 bp, Artificial Sequence
  chemically synthesized
gtcaaaatattttttaaccact

SEQ ID NO: 852866 - DNA, 22 bp, Artificial Sequence
  chemically synthesized
agaaatcaataaagtggttaaa

SEQ ID NO: 852867 - DNA, 22 bp, Artificial Sequence
  chemically synthesized
tttaaccactttattgatttct

SEQ ID NO: 852868 - DNA, 22 bp, Artificial Sequence
  chemically synthesized
ttaaccactttattgatttctt

SEQ ID NO: 852869 - DNA, 22 bp, Artificial Sequence
  chemically synthesized
taaccactttattgatttctta

SEQ ID NO: 852870 - DNA, 22 bp, Artificial Sequence
  chemically synthesized
aaccactttattgatttcttaa

SEQ ID NO: 852871 - DNA, 22 bp, Artificial Sequence
  chemically synthesized
accactttattgatttcttaac

SEQ ID NO: 852872 - DNA, 22 bp, Artificial Sequence
  chemically synthesized
tgtcaataaagtggttaagaaa

SEQ ID NO: 852873 - DNA, 22 bp, Artificial Sequence
  chemically synthesized
atgtcaataaagtggttaagaa

SEQ ID NO: 852874 - DNA, 22 bp, Artificial Sequence
  chemically synthesized
tatgtcaataaagtggttaaga

SEQ ID NO: 852875 - DNA, 22 bp, Artificial Sequence
  chemically synthesized
ttatgtcaataaagtggttaag

SEQ ID NO: 852876 - DNA, 22 bp, Artificial Sequence
  chemically synthesized
tttatgtcaataaagtggttaa

SEQ ID NO: 852877 - DNA, 22 bp, Artificial Sequence
  chemically synthesized
tattgatttcttaaccacttta

SEQ ID NO: 852878 - DNA, 22 bp, Artificial Sequence
  chemically synthesized
attgatttcttaaccactttat

SEQ ID NO: 852879 - DNA, 22 bp, Artificial Sequence
  chemically synthesized
ttgatttcttaaccactttatt

SEQ ID NO: 852880 - DNA, 22 bp, Artificial Sequence
  chemically synthesized
atttcttaaccactttattgac

SEQ ID NO: 852881 - DNA, 22 bp, Artificial Sequence
  chemically synthesized
cttaaccactttattgacataa

SEQ ID NO: 852882 - DNA, 22 bp, Artificial Sequence
  chemically synthesized
ttaaccactttattgacataaa

SEQ ID NO: 852883 - DNA, 22 bp, Artificial Sequence
  chemically synthesized
aaccactttattgacataaaaa

SEQ ID NO: 852884 - DNA, 22 bp, Artificial Sequence
  chemically synthesized
aatgtgtatagctttttatgtc

SEQ ID NO: 852885 - DNA, 22 bp, Artificial Sequence
  chemically synthesized
accactttattgacataaaaag

SEQ ID NO: 852886 - DNA, 22 bp, Artificial Sequence
  chemically synthesized
attaaatgtgtatagcttttta

SEQ ID NO: 852887 - DNA, 22 bp, Artificial Sequence
  chemically synthesized
tattgacataaaaagctataca

SEQ ID NO: 852888 - DNA, 22 bp, Artificial Sequence
  chemically synthesized
attgacataaaaagctatacac

SEQ ID NO: 852889 - DNA, 22 bp, Artificial Sequence
  chemically synthesized
tgttcattaaatgtgtatagct

SEQ ID NO: 852890 - DNA, 22 bp, Artificial Sequence
  chemically synthesized
ttgacataaaaagctatacaca

SEQ ID NO: 852891 - DNA, 22 bp, Artificial Sequence
  chemically synthesized
acataaaaagctatacacattt

SEQ ID NO: 852892 - DNA, 22 bp, Artificial Sequence
  chemically synthesized
atcaagctgtgttcattaaatg

SEQ ID NO: 852893 - DNA, 22 bp, Artificial Sequence
  chemically synthesized
gaaactcatcaagctgtgttca

SEQ ID NO: 852894 - DNA, 22 bp, Artificial Sequence
  chemically synthesized
tacacatttaatgaacacagct

SEQ ID NO: 852895 - DNA, 22 bp, Artificial Sequence
  chemically synthesized
tctcgaaactcatcaagctgtg

SEQ ID NO: 852896 - DNA, 22 bp, Artificial Sequence
  chemically synthesized
aatgaacacagcttgatgagtt

SEQ ID NO: 852897 - DNA, 22 bp, Artificial Sequence
  chemically synthesized
taattatctcgaaactcatcaa

SEQ ID NO: 852898 - DNA, 22 bp, Artificial Sequence
  chemically synthesized
atgaacacagcttgatgagttt

SEQ ID NO: 852899 - DNA, 22 bp, Artificial Sequence
  chemically synthesized
gatgagtttcgagataattaca

SEQ ID NO: 852900 - DNA, 22 bp, Artificial Sequence
  chemically synthesized
atgagtttcgagataattacag

SEQ ID NO: 852901 - DNA, 22 bp, Artificial Sequence
  chemically synthesized
tgcagcacataactgtaattat

SEQ ID NO: 852902 - DNA, 22 bp, Artificial Sequence
  chemically synthesized
atgcagcacataactgtaatta

SEQ ID NO: 852903 - DNA, 22 bp, Artificial Sequence
  chemically synthesized
cgagataattacagttatgtgc

SEQ ID NO: 852904 - DNA, 22 bp, Artificial Sequence
  chemically synthesized
gagataattacagttatgtgct

SEQ ID NO: 852905 - DNA, 22 bp, Artificial Sequence
  chemically synthesized
atcaaaatgtccttatgcagca

SEQ ID NO: 852906 - DNA, 22 bp, Artificial Sequence
  chemically synthesized
cagttatgtgctgcataaggac

SEQ ID NO: 852907 - DNA, 22 bp, Artificial Sequence
  chemically synthesized
tgtgctgcataaggacattttg

SEQ ID NO: 852908 - DNA, 22 bp, Artificial Sequence
  chemically synthesized
cataaggacattttgatcaatg

SEQ ID NO: 852909 - DNA, 22 bp, Artificial Sequence
  chemically synthesized
tgcacatgatagtggtccattg

SEQ ID NO: 852910 - DNA, 22 bp, Artificial Sequence
  chemically synthesized
tgatcaatggaccactatcatg

SEQ ID NO: 852911 - DNA, 22 bp, Artificial Sequence
  chemically synthesized
gatcaatggaccactatcatgt

SEQ ID NO: 852912 - DNA, 22 bp, Artificial Sequence
  chemically synthesized
atcaatggaccactatcatgtg

SEQ ID NO: 852913 - DNA, 22 bp, Artificial Sequence
  chemically synthesized
catgtatacagactgtgcacat

SEQ ID NO: 852914 - DNA, 22 bp, Artificial Sequence
  chemically synthesized
tcctacatgtatacagactgtg

SEQ ID NO: 852915 - DNA, 22 bp, Artificial Sequence
  chemically synthesized
tcatgtgcacagtctgtataca

SEQ ID NO: 852916 - DNA, 22 bp, Artificial Sequence
  chemically synthesized
taggaccactgtcctacatgta

SEQ ID NO: 852917 - DNA, 22 bp, Artificial Sequence
  chemically synthesized
ataggaccactgtcctacatgt

SEQ ID NO: 852918 - DNA, 22 bp, Artificial Sequence
  chemically synthesized
taatcttataggaccactgtcc

SEQ ID NO: 852919 - DNA, 22 bp, Artificial Sequence
  chemically synthesized
tatacatgtaggacagtggtcc

SEQ ID NO: 852920 - DNA, 22 bp, Artificial Sequence
  chemically synthesized
cagaaaaatattataatcttat

SEQ ID NO: 852921 - DNA, 22 bp, Artificial Sequence
  chemically synthesized
taagattataatatttttctgt

SEQ ID NO: 852922 - DNA, 22 bp, Artificial Sequence
  chemically synthesized
aacatagaaaagttacagaaaa

SEQ ID NO: 852923 - DNA, 22 bp, Artificial Sequence
  chemically synthesized
taatatttttctgtaacttttc

SEQ ID NO: 852924 - DNA, 22 bp, Artificial Sequence
  chemically synthesized
atcacatctaaacatagaaaag

SEQ ID NO: 852925 - DNA, 22 bp, Artificial Sequence
  chemically synthesized
ttctgtaacttttctatgttta

SEQ ID NO: 852926 - DNA, 22 bp, Artificial Sequence
  chemically synthesized
tctgtaacttttctatgtttag

SEQ ID NO: 852927 - DNA, 22 bp, Artificial Sequence
  chemically synthesized
ctgtaacttttctatgtttaga

SEQ ID NO: 852928 - DNA, 22 bp, Artificial Sequence
  chemically synthesized
tgtaacttttctatgtttagat

SEQ ID NO: 852929 - DNA, 22 bp, Artificial Sequence
  chemically synthesized
tgtatctaatcacatctaaaca

SEQ ID NO: 852930 - DNA, 22 bp, Artificial Sequence
  chemically synthesized
taacttttctatgtttagatgt

SEQ ID NO: 852931 - DNA, 22 bp, Artificial Sequence
  chemically synthesized
gtgtatctaatcacatctaaac

SEQ ID NO: 852932 - DNA, 22 bp, Artificial Sequence
  chemically synthesized
ttctatgtttagatgtgattag

SEQ ID NO: 852933 - DNA, 22 bp, Artificial Sequence
  chemically synthesized
tctatgtttagatgtgattaga

SEQ ID NO: 852934 - DNA, 22 bp, Artificial Sequence
  chemically synthesized
ctatgtttagatgtgattagat

SEQ ID NO: 852935 - DNA, 22 bp, Artificial Sequence
  chemically synthesized
tatgtttagatgtgattagata

SEQ ID NO: 852936 - DNA, 22 bp, Artificial Sequence
  chemically synthesized
tgtttagatgtgattagataca

SEQ ID NO: 852937 - DNA, 22 bp, Artificial Sequence
  chemically synthesized
agatgtgattagatacacaaat

SEQ ID NO: 852938 - DNA, 22 bp, Artificial Sequence
  chemically synthesized
gatgtgattagatacacaaata

SEQ ID NO: 852939 - DNA, 22 bp, Artificial Sequence
  chemically synthesized
gaacacgatggcaagtatttgt

SEQ ID NO: 852940 - DNA, 22 bp, Artificial Sequence
  chemically synthesized
gatacacaaatacttgccatcg

SEQ ID NO: 852941 - DNA, 22 bp, Artificial Sequence
  chemically synthesized
aggcaattggaacacgatggca

SEQ ID NO: 852942 - DNA, 22 bp, Artificial Sequence
  chemically synthesized
caggcaattggaacacgatggc

SEQ ID NO: 852943 - DNA, 22 bp, Artificial Sequence
  chemically synthesized
aatacttcaggcaattggaaca

SEQ ID NO: 852944 - DNA, 22 bp, Artificial Sequence
  chemically synthesized
gccatcgtgttccaattgcctg

SEQ ID NO: 852945 - DNA, 22 bp, Artificial Sequence
  chemically synthesized
tactgaatacttcaggcaattg

SEQ ID NO: 852946 - DNA, 22 bp, Artificial Sequence
  chemically synthesized
ccatcgtgttccaattgcctga

SEQ ID NO: 852947 - DNA, 22 bp, Artificial Sequence
  chemically synthesized
caattgcctgaagtattcagta

SEQ ID NO: 852948 - DNA, 22 bp, Artificial Sequence
  chemically synthesized
cctgaagtattcagtacagtca

SEQ ID NO: 852949 - DNA, 22 bp, Artificial Sequence
  chemically synthesized
aagtattcagtacagtcacatg

SEQ ID NO: 852950 - DNA, 22 bp, Artificial Sequence
  chemically synthesized
taaaccagtacagcatgtgact

SEQ ID NO: 852951 - DNA, 22 bp, Artificial Sequence
  chemically synthesized
ggctataaaccagtacagcatg

SEQ ID NO: 852952 - DNA, 22 bp, Artificial Sequence
  chemically synthesized
agtacagtcacatgctgtactg

SEQ ID NO: 852953 - DNA, 22 bp, Artificial Sequence
  chemically synthesized
ctaggctataaaccagtacagc

SEQ ID NO: 852954 - DNA, 22 bp, Artificial Sequence
  chemically synthesized
ctcctaggctataaaccagtac

SEQ ID NO: 852955 - DNA, 22 bp, Artificial Sequence
  chemically synthesized
ttgctcctaggctataaaccag

SEQ ID NO: 852956 - DNA, 22 bp, Artificial Sequence
  chemically synthesized
tactggtttatagcctaggagc

SEQ ID NO: 852957 - DNA, 22 bp, Artificial Sequence
  chemically synthesized
tatggtatagcctattgctcct

SEQ ID NO: 852958 - DNA, 22 bp, Artificial Sequence
  chemically synthesized
gtttatagcctaggagcaatag

SEQ ID NO: 852959 - DNA, 22 bp, Artificial Sequence
  chemically synthesized
atagcctaggagcaataggcta

SEQ ID NO: 852960 - DNA, 22 bp, Artificial Sequence
  chemically synthesized
ggttgtatggtatagcctattg

SEQ ID NO: 852961 - DNA, 22 bp, Artificial Sequence
  chemically synthesized
tagcctaggagcaataggctat

SEQ ID NO: 852962 - DNA, 22 bp, Artificial Sequence
  chemically synthesized
ggagcaataggctataccatac

SEQ ID NO: 852963 - DNA, 22 bp, Artificial Sequence
  chemically synthesized
tacatctaggttgtatggtata

SEQ ID NO: 852964 - DNA, 22 bp, Artificial Sequence
  chemically synthesized
ctatacatctaggttgtatggt

SEQ ID NO: 852965 - DNA, 22 bp, Artificial Sequence
  chemically synthesized
taccatacaacctagatgtata

SEQ ID NO: 852966 - DNA, 22 bp, Artificial Sequence
  chemically synthesized
gatggtacatcctactatacat

SEQ ID NO: 852967 - DNA, 22 bp, Artificial Sequence
  chemically synthesized
cacaaacctagatggtacatcc

SEQ ID NO: 852968 - DNA, 22 bp, Artificial Sequence
  chemically synthesized
gatgtatagtaggatgtaccat

SEQ ID NO: 852969 - DNA, 22 bp, Artificial Sequence
  chemically synthesized
acacaaacctagatggtacatc

SEQ ID NO: 852970 - DNA, 22 bp, Artificial Sequence
  chemically synthesized
tgcaaacatcatacagtgtact

SEQ ID NO: 852971 - DNA, 22 bp, Artificial Sequence
  chemically synthesized
ggtttgtgtaagtacactgtat

SEQ ID NO: 852972 - DNA, 22 bp, Artificial Sequence
  chemically synthesized
ttgtgcaaacatcatacagtgt

SEQ ID NO: 852973 - DNA, 22 bp, Artificial Sequence
  chemically synthesized
gttgtgcaaacatcatacagtg

SEQ ID NO: 852974 - DNA, 22 bp, Artificial Sequence
  chemically synthesized
gtgtaagtacactgtatgatgt

SEQ ID NO: 852975 - DNA, 22 bp, Artificial Sequence
  chemically synthesized
tgtaagtacactgtatgatgtt

SEQ ID NO: 852976 - DNA, 22 bp, Artificial Sequence
  chemically synthesized
atcttgttgtgcaaacatcata

SEQ ID NO: 852977 - DNA, 22 bp, Artificial Sequence
  chemically synthesized
attgatcttgttgtgcaaacat

SEQ ID NO: 852978 - DNA, 22 bp, Artificial Sequence
  chemically synthesized
gctgattgatcttgttgtgcaa

SEQ ID NO: 852979 - DNA, 22 bp, Artificial Sequence
  chemically synthesized
tatgatgtttgcacaacaagat

SEQ ID NO: 852980 - DNA, 22 bp, Artificial Sequence
  chemically synthesized
gcacaacaagatcaatcagcta

SEQ ID NO: 852981 - DNA, 22 bp, Artificial Sequence
  chemically synthesized
cacaacaagatcaatcagctaa

SEQ ID NO: 852982 - DNA, 22 bp, Artificial Sequence
  chemically synthesized
ggagaaatgcatggttagctga

SEQ ID NO: 852983 - DNA, 22 bp, Artificial Sequence
  chemically synthesized
aacaacagatatacattcggag

SEQ ID NO: 852984 - DNA, 22 bp, Artificial Sequence
  chemically synthesized
accatgcatttctccgaatgta

SEQ ID NO: 852985 - DNA, 22 bp, Artificial Sequence
  chemically synthesized
ctcaacaacagatatacattcg

SEQ ID NO: 852986 - DNA, 22 bp, Artificial Sequence
  chemically synthesized
ctccgaatgtatatctgttgtt

SEQ ID NO: 852987 - DNA, 22 bp, Artificial Sequence
  chemically synthesized
tccgaatgtatatctgttgttg

SEQ ID NO: 852988 - DNA, 22 bp, Artificial Sequence
  chemically synthesized
cgaatgtatatctgttgttgag

SEQ ID NO: 852989 - DNA, 22 bp, Artificial Sequence
  chemically synthesized
acaggggtatacagtcatgcat

SEQ ID NO: 852990 - DNA, 22 bp, Artificial Sequence
  chemically synthesized
cacaggggtatacagtcatgca

SEQ ID NO: 852991 - DNA, 22 bp, Artificial Sequence
  chemically synthesized
ttgttgagcaatgcatgactgt

SEQ ID NO: 852992 - DNA, 22 bp, Artificial Sequence
  chemically synthesized
ttgagcaatgcatgactgtata

SEQ ID NO: 852993 - DNA, 22 bp, Artificial Sequence
  chemically synthesized
agcaatgcatgactgtataccc

SEQ ID NO: 852994 - DNA, 22 bp, Artificial Sequence
  chemically synthesized
gacatgatttcacaggggtata

SEQ ID NO: 852995 - DNA, 22 bp, Artificial Sequence
  chemically synthesized
tggacatgatttcacaggggta

SEQ ID NO: 852996 - DNA, 22 bp, Artificial Sequence
  chemically synthesized
tatacccctgtgaaatcatgtc

SEQ ID NO: 852997 - DNA, 22 bp, Artificial Sequence
  chemically synthesized
tggcatagattctggacatgat

SEQ ID NO: 852998 - DNA, 22 bp, Artificial Sequence
  chemically synthesized
atggcatagattctggacatga

SEQ ID NO: 852999 - DNA, 22 bp, Artificial Sequence
  chemically synthesized
tgaaatcatgtccagaatctat

SEQ ID NO: 853000 - DNA, 22 bp, Artificial Sequence
  chemically synthesized
gaggtgatgcataggtttatgg

SEQ ID NO: 853001 - DNA, 22 bp, Artificial Sequence
  chemically synthesized
ggaggtgatgcataggtttatg

SEQ ID NO: 853002 - DNA, 22 bp, Artificial Sequence
  chemically synthesized
tggaggtgatgcataggtttat

SEQ ID NO: 853003 - DNA, 22 bp, Artificial Sequence
  chemically synthesized
tgccataaacctatgcatcacc

SEQ ID NO: 853004 - DNA, 22 bp, Artificial Sequence
  chemically synthesized
tgcatcacctccaaaatttttc

SEQ ID NO: 853005 - DNA, 22 bp, Artificial Sequence
  chemically synthesized
caaaatttttctcttaccttcc

SEQ ID NO: 853006 - DNA, 22 bp, Artificial Sequence
  chemically synthesized
ttctcttaccttccttatttac

SEQ ID NO: 853007 - DNA, 22 bp, Artificial Sequence
  chemically synthesized
tctcttaccttccttatttact

SEQ ID NO: 853008 - DNA, 22 bp, Artificial Sequence
  chemically synthesized
ctcttaccttccttatttacta

SEQ ID NO: 853009 - DNA, 22 bp, Artificial Sequence
  chemically synthesized
tcttaccttccttatttactat

SEQ ID NO: 853010 - DNA, 22 bp, Artificial Sequence
  chemically synthesized
ttaccttccttatttactatta

SEQ ID NO: 853011 - DNA, 22 bp, Artificial Sequence
  chemically synthesized
accttccttatttactattatt

SEQ ID NO: 853012 - DNA, 22 bp, Artificial Sequence
  chemically synthesized
ccttccttatttactattattt

SEQ ID NO: 853013 - DNA, 22 bp, Artificial Sequence
  chemically synthesized
tcgtacatgcaaaaataatagt

SEQ ID NO: 853014 - DNA, 22 bp, Artificial Sequence
  chemically synthesized
ttatcgtacatgcaaaaataat

SEQ ID NO: 853015 - DNA, 22 bp, Artificial Sequence
  chemically synthesized
ccttatttactattatttttgc

SEQ ID NO: 853016 - DNA, 22 bp, Artificial Sequence
  chemically synthesized
cttatttactattatttttgca

SEQ ID NO: 853017 - DNA, 22 bp, Artificial Sequence
  chemically synthesized
ttattatcgtacatgcaaaaat

SEQ ID NO: 853018 - DNA, 22 bp, Artificial Sequence
  chemically synthesized
atttactattatttttgcatgt

SEQ ID NO: 853019 - DNA, 22 bp, Artificial Sequence
  chemically synthesized
tttactattatttttgcatgta

SEQ ID NO: 853020 - DNA, 22 bp, Artificial Sequence
  chemically synthesized
cctgttattatcgtacatgcaa

SEQ ID NO: 853021 - DNA, 22 bp, Artificial Sequence
  chemically synthesized
acctgttattatcgtacatgca

SEQ ID NO: 853022 - DNA, 22 bp, Artificial Sequence
  chemically synthesized
actattatttttgcatgtacga

SEQ ID NO: 853023 - DNA, 22 bp, Artificial Sequence
  chemically synthesized
tacctgttattatcgtacatgc

SEQ ID NO: 853024 - DNA, 22 bp, Artificial Sequence
  chemically synthesized
ctattatttttgcatgtacgat

SEQ ID NO: 853025 - DNA, 22 bp, Artificial Sequence
  chemically synthesized
ttacctgttattatcgtacatg

SEQ ID NO: 853026 - DNA, 22 bp, Artificial Sequence
  chemically synthesized
tttacctgttattatcgtacat

SEQ ID NO: 853027 - DNA, 22 bp, Artificial Sequence
  chemically synthesized
ttttacctgttattatcgtaca

SEQ ID NO: 853028 - DNA, 22 bp, Artificial Sequence
  chemically synthesized
ttatttttgcatgtacgataat

SEQ ID NO: 853029 - DNA, 22 bp, Artificial Sequence
  chemically synthesized
tttttacctgttattatcgtac

SEQ ID NO: 853030 - DNA, 22 bp, Artificial Sequence
  chemically synthesized
tttttgcatgtacgataataac

SEQ ID NO: 853031 - DNA, 22 bp, Artificial Sequence
  chemically synthesized
ttgcatgtacgataataacagg

SEQ ID NO: 853032 - DNA, 22 bp, Artificial Sequence
  chemically synthesized
tgcatgtacgataataacaggt

SEQ ID NO: 853033 - DNA, 22 bp, Artificial Sequence
  chemically synthesized
gcatgtacgataataacaggta

SEQ ID NO: 853034 - DNA, 22 bp, Artificial Sequence
  chemically synthesized
catgtacgataataacaggtaa

SEQ ID NO: 853035 - DNA, 22 bp, Artificial Sequence
  chemically synthesized
agagagtaaatctttttttacc

SEQ ID NO: 853036 - DNA, 22 bp, Artificial Sequence
  chemically synthesized
ctaagagagtaaatcttttttt

SEQ ID NO: 853037 - DNA, 22 bp, Artificial Sequence
  chemically synthesized
gctaagagagtaaatctttttt

SEQ ID NO: 853038 - DNA, 22 bp, Artificial Sequence
  chemically synthesized
tgctaagagagtaaatcttttt

SEQ ID NO: 853039 - DNA, 22 bp, Artificial Sequence
  chemically synthesized
aaactttgctaagagagtaaat

SEQ ID NO: 853040 - DNA, 22 bp, Artificial Sequence
  chemically synthesized
aaaactttgctaagagagtaaa

SEQ ID NO: 853041 - DNA, 22 bp, Artificial Sequence
  chemically synthesized
tatttaaaactttgctaagaga

SEQ ID NO: 853042 - DNA, 22 bp, Artificial Sequence
  chemically synthesized
atatttaaaactttgctaagag

SEQ ID NO: 853043 - DNA, 22 bp, Artificial Sequence
  chemically synthesized
tatatttaaaactttgctaaga

SEQ ID NO: 853044 - DNA, 22 bp, Artificial Sequence
  chemically synthesized
actctcttagcaaagttttaaa

SEQ ID NO: 853045 - DNA, 22 bp, Artificial Sequence
  chemically synthesized
ctctcttagcaaagttttaaat

SEQ ID NO: 853046 - DNA, 22 bp, Artificial Sequence
  chemically synthesized
acaatgttttatatttaaaact

SEQ ID NO: 853047 - DNA, 22 bp, Artificial Sequence
  chemically synthesized
tcttagcaaagttttaaatata

SEQ ID NO: 853048 - DNA, 22 bp, Artificial Sequence
  chemically synthesized
ttagcaaagttttaaatataaa

SEQ ID NO: 853049 - DNA, 22 bp, Artificial Sequence
  chemically synthesized
tagttaacaatgttttatattt

SEQ ID NO: 853050 - DNA, 22 bp, Artificial Sequence
  chemically synthesized
agcaaagttttaaatataaaac

SEQ ID NO: 853051 - DNA, 22 bp, Artificial Sequence
  chemically synthesized
gtagttaacaatgttttatatt

SEQ ID NO: 853052 - DNA, 22 bp, Artificial Sequence
  chemically synthesized
gcaaagttttaaatataaaaca

SEQ ID NO: 853053 - DNA, 22 bp, Artificial Sequence
  chemically synthesized
gggcttgtagttaacaatgttt

SEQ ID NO: 853054 - DNA, 22 bp, Artificial Sequence
  chemically synthesized
taaatataaaacattgttaact

SEQ ID NO: 853055 - DNA, 22 bp, Artificial Sequence
  chemically synthesized
aaatataaaacattgttaacta

SEQ ID NO: 853056 - DNA, 22 bp, Artificial Sequence
  chemically synthesized
aatataaaacattgttaactac

SEQ ID NO: 853057 - DNA, 22 bp, Artificial Sequence
  chemically synthesized
tacagcctagggcttgtagtta

SEQ ID NO: 853058 - DNA, 22 bp, Artificial Sequence
  chemically synthesized
caaatctgtacagcctagggct

SEQ ID NO: 853059 - DNA, 22 bp, Artificial Sequence
  chemically synthesized
ttaactacaagccctaggctgt

SEQ ID NO: 853060 - DNA, 22 bp, Artificial Sequence
  chemically synthesized
actacaagccctaggctgtaca

SEQ ID NO: 853061 - DNA, 22 bp, Artificial Sequence
  chemically synthesized
caagccctaggctgtacagatt

SEQ ID NO: 853062 - DNA, 22 bp, Artificial Sequence
  chemically synthesized
ggctgtacagatttgtaggact

SEQ ID NO: 853063 - DNA, 22 bp, Artificial Sequence
  chemically synthesized
tacagatttgtaggacttattc

SEQ ID NO: 853064 - DNA, 22 bp, Artificial Sequence
  chemically synthesized
agtcatatgagatgaataagtc

SEQ ID NO: 853065 - DNA, 22 bp, Artificial Sequence
  chemically synthesized
cagtcatatgagatgaataagt

SEQ ID NO: 853066 - DNA, 22 bp, Artificial Sequence
  chemically synthesized
ggtttcagtcatatgagatgaa

SEQ ID NO: 853067 - DNA, 22 bp, Artificial Sequence
  chemically synthesized
gtaggacttattcatctcatat

SEQ ID NO: 853068 - DNA, 22 bp, Artificial Sequence
  chemically synthesized
taggacttattcatctcatatg

SEQ ID NO: 853069 - DNA, 22 bp, Artificial Sequence
  chemically synthesized
actaggtttcagtcatatgaga

SEQ ID NO: 853070 - DNA, 22 bp, Artificial Sequence
  chemically synthesized
attcatctcatatgactgaaac

SEQ ID NO: 853071 - DNA, 22 bp, Artificial Sequence
  chemically synthesized
ttcatctcatatgactgaaacc

SEQ ID NO: 853072 - DNA, 22 bp, Artificial Sequence
  chemically synthesized
atctcatatgactgaaacctag

SEQ ID NO: 853073 - DNA, 22 bp, Artificial Sequence
  chemically synthesized
atatgactgaaacctagttagt

SEQ ID NO: 853074 - DNA, 22 bp, Artificial Sequence
  chemically synthesized
aaacctagttagtatttttttt

SEQ ID NO: 853075 - DNA, 22 bp, Artificial Sequence
  chemically synthesized
aaaaaaaaaaaaaaaaaaaata

SEQ ID NO: 853076 - DNA, 22 bp, Artificial Sequence
  chemically synthesized
catctcaaaaaaaaaaaaaaaa

SEQ ID NO: 853077 - DNA, 22 bp, Artificial Sequence
  chemically synthesized
gttagtattttttttttttttt

SEQ ID NO: 853078 - DNA, 22 bp, Artificial Sequence
  chemically synthesized
gtattttttttttttttttttt

SEQ ID NO: 853079 - DNA, 22 bp, Artificial Sequence
  chemically synthesized
tttttttttttttttttgagat

SEQ ID NO: 853080 - DNA, 22 bp, Artificial Sequence
  chemically synthesized
ttttttttttttttttgagatg

SEQ ID NO: 853081 - DNA, 22 bp, Artificial Sequence
  chemically synthesized
tttttttttttttttgagatgg

SEQ ID NO: 853082 - DNA, 22 bp, Artificial Sequence
  chemically synthesized
ttttttttttttttgagatgga

SEQ ID NO: 853083 - DNA, 22 bp, Artificial Sequence
  chemically synthesized
tttttttttttttgagatggag

SEQ ID NO: 853084 - DNA, 22 bp, Artificial Sequence
  chemically synthesized
ttttttttttttgagatggagt

SEQ ID NO: 853085 - DNA, 22 bp, Artificial Sequence
  chemically synthesized
tttttttttttgagatggagtc

SEQ ID NO: 853086 - DNA, 22 bp, Artificial Sequence
  chemically synthesized
ttttttttttgagatggagtct

SEQ ID NO: 853087 - DNA, 22 bp, Artificial Sequence
  chemically synthesized
ggcgacagagcaagactccatc

SEQ ID NO: 853088 - DNA, 22 bp, Artificial Sequence
  chemically synthesized
tttttttttgagatggagtctt

SEQ ID NO: 853089 - DNA, 22 bp, Artificial Sequence
  chemically synthesized
ttttttttgagatggagtcttg

SEQ ID NO: 853090 - DNA, 22 bp, Artificial Sequence
  chemically synthesized
tttttttgagatggagtcttgc

SEQ ID NO: 853091 - DNA, 22 bp, Artificial Sequence
  chemically synthesized
ttttttgagatggagtcttgct

SEQ ID NO: 853092 - DNA, 22 bp, Artificial Sequence
  chemically synthesized
tttttgagatggagtcttgctc

SEQ ID NO: 853093 - DNA, 22 bp, Artificial Sequence
  chemically synthesized
ttttgagatggagtcttgctct

SEQ ID NO: 853094 - DNA, 22 bp, Artificial Sequence
  chemically synthesized
tttgagatggagtcttgctctg

SEQ ID NO: 853095 - DNA, 22 bp, Artificial Sequence
  chemically synthesized
cagcctgggcgacagagcaaga

SEQ ID NO: 853096 - DNA, 22 bp, Artificial Sequence
  chemically synthesized
ttgagatggagtcttgctctgt

SEQ ID NO: 853097 - DNA, 22 bp, Artificial Sequence
  chemically synthesized
tgagatggagtcttgctctgtc

SEQ ID NO: 853098 - DNA, 22 bp, Artificial Sequence
  chemically synthesized
gagatggagtcttgctctgtcg

SEQ ID NO: 853099 - DNA, 22 bp, Artificial Sequence
  chemically synthesized
agatggagtcttgctctgtcgc

SEQ ID NO: 853100 - DNA, 22 bp, Artificial Sequence
  chemically synthesized
cactccagcctgggcgacagag

SEQ ID NO: 853101 - DNA, 22 bp, Artificial Sequence
  chemically synthesized
ctgcactccagcctgggcgaca

SEQ ID NO: 853102 - DNA, 22 bp, Artificial Sequence
  chemically synthesized
gctctgtcgcccaggctggagt

SEQ ID NO: 853103 - DNA, 22 bp, Artificial Sequence
  chemically synthesized
ctctgtcgcccaggctggagtg

SEQ ID NO: 853104 - DNA, 22 bp, Artificial Sequence
  chemically synthesized
gggaggctactgcactccagcc

SEQ ID NO: 853105 - DNA, 22 bp, Artificial Sequence
  chemically synthesized
tgtcgcccaggctggagtgcag

SEQ ID NO: 853106 - DNA, 22 bp, Artificial Sequence
  chemically synthesized
ctcgggaggctactgcactcca

SEQ ID NO: 853107 - DNA, 22 bp, Artificial Sequence
  chemically synthesized
tcgcccaggctggagtgcagta

SEQ ID NO: 853108 - DNA, 22 bp, Artificial Sequence
  chemically synthesized
tggtcccagctactcgggaggc

SEQ ID NO: 853109 - DNA, 22 bp, Artificial Sequence
  chemically synthesized
gagtgcagtagcctcccgagta

SEQ ID NO: 853110 - DNA, 22 bp, Artificial Sequence
  chemically synthesized
ccgagtagctgggaccacaggc

SEQ ID NO: 853111 - DNA, 22 bp, Artificial Sequence
  chemically synthesized
gccaggcgtggtggtgggtgcc

SEQ ID NO: 853112 - DNA, 22 bp, Artificial Sequence
  chemically synthesized
ggaccacaggcacccaccacca

SEQ ID NO: 853113 - DNA, 22 bp, Artificial Sequence
  chemically synthesized
aaaatacaaaaaattagccagg

SEQ ID NO: 853114 - DNA, 22 bp, Artificial Sequence
  chemically synthesized
ctaaaaatacaaaaaattagcc

SEQ ID NO: 853115 - DNA, 22 bp, Artificial Sequence
  chemically synthesized
tactaaaaatacaaaaaattag

SEQ ID NO: 853116 - DNA, 22 bp, Artificial Sequence
  chemically synthesized
gctaattttttgtatttttagt

SEQ ID NO: 853117 - DNA, 22 bp, Artificial Sequence
  chemically synthesized
attttttgtatttttagtagag

SEQ ID NO: 853118 - DNA, 22 bp, Artificial Sequence
  chemically synthesized
tttgtatttttagtagagacgt

SEQ ID NO: 853119 - DNA, 22 bp, Artificial Sequence
  chemically synthesized
ttgtatttttagtagagacgtg

SEQ ID NO: 853120 - DNA, 22 bp, Artificial Sequence
  chemically synthesized
acacggtgaaaccacgtctcta

SEQ ID NO: 853121 - DNA, 22 bp, Artificial Sequence
  chemically synthesized
tgtatttttagtagagacgtgg

SEQ ID NO: 853122 - DNA, 22 bp, Artificial Sequence
  chemically synthesized
gtatttttagtagagacgtggt

SEQ ID NO: 853123 - DNA, 22 bp, Artificial Sequence
  chemically synthesized
tatttttagtagagacgtggtt

SEQ ID NO: 853124 - DNA, 22 bp, Artificial Sequence
  chemically synthesized
gctaacacggtgaaaccacgtc

SEQ ID NO: 853125 - DNA, 22 bp, Artificial Sequence
  chemically synthesized
ttagtagagacgtggtttcacc

SEQ ID NO: 853126 - DNA, 22 bp, Artificial Sequence
  chemically synthesized
tagtagagacgtggtttcaccg

SEQ ID NO: 853127 - DNA, 22 bp, Artificial Sequence
  chemically synthesized
agtagagacgtggtttcaccgt

SEQ ID NO: 853128 - DNA, 22 bp, Artificial Sequence
  chemically synthesized
gtagagacgtggtttcaccgtg

SEQ ID NO: 853129 - DNA, 22 bp, Artificial Sequence
  chemically synthesized
agaccatcctggctaacacggt

SEQ ID NO: 853130 - DNA, 22 bp, Artificial Sequence
  chemically synthesized
caccgtgttagccaggatggtc

SEQ ID NO: 853131 - DNA, 22 bp, Artificial Sequence
  chemically synthesized
accgtgttagccaggatggtct

SEQ ID NO: 853132 - DNA, 22 bp, Artificial Sequence
  chemically synthesized
gccaggatggtctcaatcttct

SEQ ID NO: 853133 - DNA, 22 bp, Artificial Sequence
  chemically synthesized
aatcttctgacctcgtgatccg

SEQ ID NO: 853134 - DNA, 22 bp, Artificial Sequence
  chemically synthesized
ggaggatgaggcgggcggatca

SEQ ID NO: 853135 - DNA, 22 bp, Artificial Sequence
  chemically synthesized
gggaggatgaggcgggcggatc

SEQ ID NO: 853136 - DNA, 22 bp, Artificial Sequence
  chemically synthesized
tgggaggatgaggcgggcggat

SEQ ID NO: 853137 - DNA, 22 bp, Artificial Sequence
  chemically synthesized
ctgacctcgtgatccgcccgcc

SEQ ID NO: 853138 - DNA, 22 bp, Artificial Sequence
  chemically synthesized
tgacctcgtgatccgcccgcct

SEQ ID NO: 853139 - DNA, 22 bp, Artificial Sequence
  chemically synthesized
acctcgtgatccgcccgcctca

SEQ ID NO: 853140 - DNA, 22 bp, Artificial Sequence
  chemically synthesized
gtgatccgcccgcctcatcctc

SEQ ID NO: 853141 - DNA, 22 bp, Artificial Sequence
  chemically synthesized
taatcccagcactttgggagga

SEQ ID NO: 853142 - DNA, 22 bp, Artificial Sequence
  chemically synthesized
acgcctgtaatcccagcacttt

SEQ ID NO: 853143 - DNA, 22 bp, Artificial Sequence
  chemically synthesized
atcctcccaaagtgctgggatt

SEQ ID NO: 853144 - DNA, 22 bp, Artificial Sequence
  chemically synthesized
ccaaagtgctgggattacaggc

SEQ ID NO: 853145 - DNA, 22 bp, Artificial Sequence
  chemically synthesized
ggggccaggcgcggtggctcac

SEQ ID NO: 853146 - DNA, 22 bp, Artificial Sequence
  chemically synthesized
ggattacaggcgtgagccaccg

SEQ ID NO: 853147 - DNA, 22 bp, Artificial Sequence
  chemically synthesized
actaggggccaggcgcggtggc

SEQ ID NO: 853148 - DNA, 22 bp, Artificial Sequence
  chemically synthesized
caggcgtgagccaccgcgcctg

SEQ ID NO: 853149 - DNA, 22 bp, Artificial Sequence
  chemically synthesized
agatactaactaggggccaggc

SEQ ID NO: 853150 - DNA, 22 bp, Artificial Sequence
  chemically synthesized
gcccctagttagtatcttaata

SEQ ID NO: 853151 - DNA, 22 bp, Artificial Sequence
  chemically synthesized
aaatggaaaataatgagtatta

SEQ ID NO: 853152 - DNA, 22 bp, Artificial Sequence
  chemically synthesized
gttagtatcttaatactcatta

SEQ ID NO: 853153 - DNA, 22 bp, Artificial Sequence
  chemically synthesized
gtatcttaatactcattatttt

SEQ ID NO: 853154 - DNA, 22 bp, Artificial Sequence
  chemically synthesized
tgccgttaaaatggaaaataat

SEQ ID NO: 853155 - DNA, 22 bp, Artificial Sequence
  chemically synthesized
gtgccgttaaaatggaaaataa

SEQ ID NO: 853156 - DNA, 22 bp, Artificial Sequence
  chemically synthesized
tgtgccgttaaaatggaaaata

SEQ ID NO: 853157 - DNA, 22 bp, Artificial Sequence
  chemically synthesized
aatactcattattttccatttt

SEQ ID NO: 853158 - DNA, 22 bp, Artificial Sequence
  chemically synthesized
ttttgtgccgttaaaatggaaa

SEQ ID NO: 853159 - DNA, 22 bp, Artificial Sequence
  chemically synthesized
atactcattattttccatttta

SEQ ID NO: 853160 - DNA, 22 bp, Artificial Sequence
  chemically synthesized
agctgttttgtgccgttaaaat

SEQ ID NO: 853161 - DNA, 22 bp, Artificial Sequence
  chemically synthesized
attattttccattttaacggca

SEQ ID NO: 853162 - DNA, 22 bp, Artificial Sequence
  chemically synthesized
ttttccattttaacggcacaaa

SEQ ID NO: 853163 - DNA, 22 bp, Artificial Sequence
  chemically synthesized
ataatctcagctgttttgtgcc

SEQ ID NO: 853164 - DNA, 22 bp, Artificial Sequence
  chemically synthesized
tccattttaacggcacaaaaca

SEQ ID NO: 853165 - DNA, 22 bp, Artificial Sequence
  chemically synthesized
ccattttaacggcacaaaacag

SEQ ID NO: 853166 - DNA, 22 bp, Artificial Sequence
  chemically synthesized
tcataatctcagctgttttgtg

SEQ ID NO: 853167 - DNA, 22 bp, Artificial Sequence
  chemically synthesized
cattttaacggcacaaaacagc

SEQ ID NO: 853168 - DNA, 22 bp, Artificial Sequence
  chemically synthesized
tctctcataatctcagctgttt

SEQ ID NO: 853169 - DNA, 22 bp, Artificial Sequence
  chemically synthesized
gtctctcataatctcagctgtt

SEQ ID NO: 853170 - DNA, 22 bp, Artificial Sequence
  chemically synthesized
taacggcacaaaacagctgaga

SEQ ID NO: 853171 - DNA, 22 bp, Artificial Sequence
  chemically synthesized
aacggcacaaaacagctgagat

SEQ ID NO: 853172 - DNA, 22 bp, Artificial Sequence
  chemically synthesized
ttgtctctcataatctcagctg

SEQ ID NO: 853173 - DNA, 22 bp, Artificial Sequence
  chemically synthesized
acggcacaaaacagctgagatt

SEQ ID NO: 853174 - DNA, 22 bp, Artificial Sequence
  chemically synthesized
ataagaataaccactcttgtct

SEQ ID NO: 853175 - DNA, 22 bp, Artificial Sequence
  chemically synthesized
agattatgagagacaagagtgg

SEQ ID NO: 853176 - DNA, 22 bp, Artificial Sequence
  chemically synthesized
taataagaataaccactcttgt

SEQ ID NO: 853177 - DNA, 22 bp, Artificial Sequence
  chemically synthesized
ttctaataagaataaccactct

SEQ ID NO: 853178 - DNA, 22 bp, Artificial Sequence
  chemically synthesized
tgagagacaagagtggttattc

SEQ ID NO: 853179 - DNA, 22 bp, Artificial Sequence
  chemically synthesized
tggttgttctaataagaataac

SEQ ID NO: 853180 - DNA, 22 bp, Artificial Sequence
  chemically synthesized
tatggttgttctaataagaata

SEQ ID NO: 853181 - DNA, 22 bp, Artificial Sequence
  chemically synthesized
ctatggttgttctaataagaat

SEQ ID NO: 853182 - DNA, 22 bp, Artificial Sequence
  chemically synthesized
cttctatggttgttctaataag

SEQ ID NO: 853183 - DNA, 22 bp, Artificial Sequence
  chemically synthesized
ccctccttctatggttgttcta

SEQ ID NO: 853184 - DNA, 22 bp, Artificial Sequence
  chemically synthesized
ttcttattagaacaaccataga

SEQ ID NO: 853185 - DNA, 22 bp, Artificial Sequence
  chemically synthesized
ttattagaacaaccatagaagg

SEQ ID NO: 853186 - DNA, 22 bp, Artificial Sequence
  chemically synthesized
tagatattgccctccttctatg

SEQ ID NO: 853187 - DNA, 22 bp, Artificial Sequence
  chemically synthesized
attagaacaaccatagaaggag

SEQ ID NO: 853188 - DNA, 22 bp, Artificial Sequence
  chemically synthesized
gtagatattgccctccttctat

SEQ ID NO: 853189 - DNA, 22 bp, Artificial Sequence
  chemically synthesized
ttagaacaaccatagaaggagg

SEQ ID NO: 853190 - DNA, 22 bp, Artificial Sequence
  chemically synthesized
gaacaaccatagaaggagggca

SEQ ID NO: 853191 - DNA, 22 bp, Artificial Sequence
  chemically synthesized
atagcagcaccaccccatggcc

SEQ ID NO: 853192 - DNA, 22 bp, Artificial Sequence
  chemically synthesized
ttcatagcagcaccaccccatg

SEQ ID NO: 853193 - DNA, 22 bp, Artificial Sequence
  chemically synthesized
caagtttgggccatggggtggt

SEQ ID NO: 853194 - DNA, 22 bp, Artificial Sequence
  chemically synthesized
gggccatggggtggtgctgcta

SEQ ID NO: 853195 - DNA, 22 bp, Artificial Sequence
  chemically synthesized
gtagtctattcatagcagcacc

SEQ ID NO: 853196 - DNA, 22 bp, Artificial Sequence
  chemically synthesized
ggccatggggtggtgctgctat

SEQ ID NO: 853197 - DNA, 22 bp, Artificial Sequence
  chemically synthesized
catggccattcgtagtctattc

SEQ ID NO: 853198 - DNA, 22 bp, Artificial Sequence
  chemically synthesized
acatggccattcgtagtctatt

SEQ ID NO: 853199 - DNA, 22 bp, Artificial Sequence
  chemically synthesized
ctatgaatagactacgaatggc

SEQ ID NO: 853200 - DNA, 22 bp, Artificial Sequence
  chemically synthesized
tgaatagactacgaatggccat

SEQ ID NO: 853201 - DNA, 22 bp, Artificial Sequence
  chemically synthesized
tcacaaaccccaatatttacat

SEQ ID NO: 853202 - DNA, 22 bp, Artificial Sequence
  chemically synthesized
gtcacaaaccccaatatttaca

SEQ ID NO: 853203 - DNA, 22 bp, Artificial Sequence
  chemically synthesized
tgtcacaaaccccaatatttac

SEQ ID NO: 853204 - DNA, 22 bp, Artificial Sequence
  chemically synthesized
cgaatggccatgtaaatattgg

SEQ ID NO: 853205 - DNA, 22 bp, Artificial Sequence
  chemically synthesized
ttgtcacaaaccccaatattta

SEQ ID NO: 853206 - DNA, 22 bp, Artificial Sequence
  chemically synthesized
tcttttgtcacaaaccccaata

SEQ ID NO: 853207 - DNA, 22 bp, Artificial Sequence
  chemically synthesized
ctatcttttgtcacaaacccca

SEQ ID NO: 853208 - DNA, 22 bp, Artificial Sequence
  chemically synthesized
cctatcttttgtcacaaacccc

SEQ ID NO: 853209 - DNA, 22 bp, Artificial Sequence
  chemically synthesized
tcctatcttttgtcacaaaccc

SEQ ID NO: 853210 - DNA, 22 bp, Artificial Sequence
  chemically synthesized
agataggctttcctatcttttg

SEQ ID NO: 853211 - DNA, 22 bp, Artificial Sequence
  chemically synthesized
gagataggctttcctatctttt

SEQ ID NO: 853212 - DNA, 22 bp, Artificial Sequence
  chemically synthesized
gggtttgtgacaaaagatagga

SEQ ID NO: 853213 - DNA, 22 bp, Artificial Sequence
  chemically synthesized
ttgagataggctttcctatctt

SEQ ID NO: 853214 - DNA, 22 bp, Artificial Sequence
  chemically synthesized
cttgagataggctttcctatct

SEQ ID NO: 853215 - DNA, 22 bp, Artificial Sequence
  chemically synthesized
cttcttgagataggctttccta

SEQ ID NO: 853216 - DNA, 22 bp, Artificial Sequence
  chemically synthesized
gtgacaaaagataggaaagcct

SEQ ID NO: 853217 - DNA, 22 bp, Artificial Sequence
  chemically synthesized
ccttcttgagataggctttcct

SEQ ID NO: 853218 - DNA, 22 bp, Artificial Sequence
  chemically synthesized
tgacaaaagataggaaagccta

SEQ ID NO: 853219 - DNA, 22 bp, Artificial Sequence
  chemically synthesized
tccttcttgagataggctttcc

SEQ ID NO: 853220 - DNA, 22 bp, Artificial Sequence
  chemically synthesized
ttccttcttgagataggctttc

SEQ ID NO: 853221 - DNA, 22 bp, Artificial Sequence
  chemically synthesized
tttccttcttgagataggcttt

SEQ ID NO: 853222 - DNA, 22 bp, Artificial Sequence
  chemically synthesized
ttttccttcttgagataggctt

SEQ ID NO: 853223 - DNA, 22 bp, Artificial Sequence
  chemically synthesized
tttttccttcttgagataggct

SEQ ID NO: 853224 - DNA, 22 bp, Artificial Sequence
  chemically synthesized
ttttttccttcttgagataggc

SEQ ID NO: 853225 - DNA, 22 bp, Artificial Sequence
  chemically synthesized
taacacttttttttccttcttg

SEQ ID NO: 853226 - DNA, 22 bp, Artificial Sequence
  chemically synthesized
gtaacacttttttttccttctt

SEQ ID NO: 853227 - DNA, 22 bp, Artificial Sequence
  chemically synthesized
ttgtaacacttttttttccttc

SEQ ID NO: 853228 - DNA, 22 bp, Artificial Sequence
  chemically synthesized
cttgtaacacttttttttcctt

SEQ ID NO: 853229 - DNA, 22 bp, Artificial Sequence
  chemically synthesized
tcttgtaacacttttttttcct

SEQ ID NO: 853230 - DNA, 22 bp, Artificial Sequence
  chemically synthesized
tctcaagaaggaaaaaaaagtg

SEQ ID NO: 853231 - DNA, 22 bp, Artificial Sequence
  chemically synthesized
cctttcttgtaacacttttttt

SEQ ID NO: 853232 - DNA, 22 bp, Artificial Sequence
  chemically synthesized
aagaaggaaaaaaaagtgttac

SEQ ID NO: 853233 - DNA, 22 bp, Artificial Sequence
  chemically synthesized
ccaatgttgcctttcttgtaac

SEQ ID NO: 853234 - DNA, 22 bp, Artificial Sequence
  chemically synthesized
accaatgttgcctttcttgtaa

SEQ ID NO: 853235 - DNA, 22 bp, Artificial Sequence
  chemically synthesized
cttaccaatgttgcctttcttg

SEQ ID NO: 853236 - DNA, 22 bp, Artificial Sequence
  chemically synthesized
ccttaccaatgttgcctttctt

SEQ ID NO: 853237 - DNA, 22 bp, Artificial Sequence
  chemically synthesized
ttccttaccaatgttgcctttc

SEQ ID NO: 853238 - DNA, 22 bp, Artificial Sequence
  chemically synthesized
cttccttaccaatgttgccttt

SEQ ID NO: 853239 - DNA, 22 bp, Artificial Sequence
  chemically synthesized
tcttccttaccaatgttgcctt

SEQ ID NO: 853240 - DNA, 22 bp, Artificial Sequence
  chemically synthesized
ttcttccttaccaatgttgcct

SEQ ID NO: 853241 - DNA, 22 bp, Artificial Sequence
  chemically synthesized
caagaaaggcaacattggtaag

SEQ ID NO: 853242 - DNA, 22 bp, Artificial Sequence
  chemically synthesized
aagatcaagtttttcttcctta

SEQ ID NO: 853243 - DNA, 22 bp, Artificial Sequence
  chemically synthesized
aaagatcaagtttttcttcctt

SEQ ID NO: 853244 - DNA, 22 bp, Artificial Sequence
  chemically synthesized
taaagatcaagtttttcttcct

SEQ ID NO: 853245 - DNA, 22 bp, Artificial Sequence
  chemically synthesized
gtaaggaagaaaaacttgatct

SEQ ID NO: 853246 - DNA, 22 bp, Artificial Sequence
  chemically synthesized
gaataacatgttttaaagatca

SEQ ID NO: 853247 - DNA, 22 bp, Artificial Sequence
  chemically synthesized
agaataacatgttttaaagatc

SEQ ID NO: 853248 - DNA, 22 bp, Artificial Sequence
  chemically synthesized
tttagaataacatgttttaaag

SEQ ID NO: 853249 - DNA, 22 bp, Artificial Sequence
  chemically synthesized
gatctttaaaacatgttattct

SEQ ID NO: 853250 - DNA, 22 bp, Artificial Sequence
  chemically synthesized
atctttaaaacatgttattcta

SEQ ID NO: 853251 - DNA, 22 bp, Artificial Sequence
  chemically synthesized
taaaacatgttattctaaacag

SEQ ID NO: 853252 - DNA, 22 bp, Artificial Sequence
  chemically synthesized
aaaacatgttattctaaacaga

SEQ ID NO: 853253 - DNA, 22 bp, Artificial Sequence
  chemically synthesized
aaacatgttattctaaacagac

SEQ ID NO: 853254 - DNA, 22 bp, Artificial Sequence
  chemically synthesized
ttctaaacagactatattactt

SEQ ID NO: 853255 - DNA, 22 bp, Artificial Sequence
  chemically synthesized
taaacagactatattacttgtt

SEQ ID NO: 853256 - DNA, 22 bp, Artificial Sequence
  chemically synthesized
aacagactatattacttgtttt

SEQ ID NO: 853257 - DNA, 22 bp, Artificial Sequence
  chemically synthesized
gcaatgataatcaaacaagaaa

SEQ ID NO: 853258 - DNA, 22 bp, Artificial Sequence
  chemically synthesized
tattacttgttttcttgtttga

SEQ ID NO: 853259 - DNA, 22 bp, Artificial Sequence
  chemically synthesized
tagcaatgataatcaaacaaga

SEQ ID NO: 853260 - DNA, 22 bp, Artificial Sequence
  chemically synthesized
cttgttttcttgtttgattatc

SEQ ID NO: 853261 - DNA, 22 bp, Artificial Sequence
  chemically synthesized
ccagttctagcaatgataatca

SEQ ID NO: 853262 - DNA, 22 bp, Artificial Sequence
  chemically synthesized
gttttcttgtttgattatcatt

SEQ ID NO: 853263 - DNA, 22 bp, Artificial Sequence
  chemically synthesized
ttttcttgtttgattatcattg

SEQ ID NO: 853264 - DNA, 22 bp, Artificial Sequence
  chemically synthesized
tcttgtttgattatcattgcta

SEQ ID NO: 853265 - DNA, 22 bp, Artificial Sequence
  chemically synthesized
cttgtttgattatcattgctag

SEQ ID NO: 853266 - DNA, 22 bp, Artificial Sequence
  chemically synthesized
ttgtttgattatcattgctaga

SEQ ID NO: 853267 - DNA, 22 bp, Artificial Sequence
  chemically synthesized
gtttgattatcattgctagaac

SEQ ID NO: 853268 - DNA, 22 bp, Artificial Sequence
  chemically synthesized
tttgattatcattgctagaact

SEQ ID NO: 853269 - DNA, 22 bp, Artificial Sequence
  chemically synthesized
gattatcattgctagaactggt

SEQ ID NO: 853270 - DNA, 22 bp, Artificial Sequence
  chemically synthesized
attatcattgctagaactggta

SEQ ID NO: 853271 - DNA, 22 bp, Artificial Sequence
  chemically synthesized
agcaataaaaacattaccagtt

SEQ ID NO: 853272 - DNA, 22 bp, Artificial Sequence
  chemically synthesized
tcattgctagaactggtaatgt

SEQ ID NO: 853273 - DNA, 22 bp, Artificial Sequence
  chemically synthesized
ctagaactggtaatgtttttat

SEQ ID NO: 853274 - DNA, 22 bp, Artificial Sequence
  chemically synthesized
gaactggtaatgtttttattgc

SEQ ID NO: 853275 - DNA, 22 bp, Artificial Sequence
  chemically synthesized
gtaatgtttttattgctcagtg

SEQ ID NO: 853276 - DNA, 22 bp, Artificial Sequence
  chemically synthesized
aagagaaagtatacactgagca

SEQ ID NO: 853277 - DNA, 22 bp, Artificial Sequence
  chemically synthesized
agttcaagagaaagtatacact

SEQ ID NO: 853278 - DNA, 22 bp, Artificial Sequence
  chemically synthesized
ttattgctcagtgtatactttc

SEQ ID NO: 853279 - DNA, 22 bp, Artificial Sequence
  chemically synthesized
tattgctcagtgtatactttct

SEQ ID NO: 853280 - DNA, 22 bp, Artificial Sequence
  chemically synthesized
attgctcagtgtatactttctc

SEQ ID NO: 853281 - DNA, 22 bp, Artificial Sequence
  chemically synthesized
ttgctcagtgtatactttctct

SEQ ID NO: 853282 - DNA, 22 bp, Artificial Sequence
  chemically synthesized
ctcagtgtatactttctcttga

SEQ ID NO: 853283 - DNA, 22 bp, Artificial Sequence
  chemically synthesized
agtgtatactttctcttgaact

SEQ ID NO: 853284 - DNA, 22 bp, Artificial Sequence
  chemically synthesized
agacccaaataaacccactgag

SEQ ID NO: 853285 - DNA, 22 bp, Artificial Sequence
  chemically synthesized
tctcttgaactcagtgggttta

SEQ ID NO: 853286 - DNA, 22 bp, Artificial Sequence
  chemically synthesized
ttaagacccaaataaacccact

SEQ ID NO: 853287 - DNA, 22 bp, Artificial Sequence
  chemically synthesized
ctcttgaactcagtgggtttat

SEQ ID NO: 853288 - DNA, 22 bp, Artificial Sequence
  chemically synthesized
tcttgaactcagtgggtttatt

SEQ ID NO: 853289 - DNA, 22 bp, Artificial Sequence
  chemically synthesized
ttgaactcagtgggtttatttg

SEQ ID NO: 853290 - DNA, 22 bp, Artificial Sequence
  chemically synthesized
aattattaagacccaaataaac

SEQ ID NO: 853291 - DNA, 22 bp, Artificial Sequence
  chemically synthesized
gaactcagtgggtttatttggg

SEQ ID NO: 853292 - DNA, 22 bp, Artificial Sequence
  chemically synthesized
aactcagtgggtttatttgggt

SEQ ID NO: 853293 - DNA, 22 bp, Artificial Sequence
  chemically synthesized
tgaattattaagacccaaataa

SEQ ID NO: 853294 - DNA, 22 bp, Artificial Sequence
  chemically synthesized
agtgggtttatttgggtcttaa

SEQ ID NO: 853295 - DNA, 22 bp, Artificial Sequence
  chemically synthesized
tattctgaattattaagaccca

SEQ ID NO: 853296 - DNA, 22 bp, Artificial Sequence
  chemically synthesized
atattctgaattattaagaccc

SEQ ID NO: 853297 - DNA, 22 bp, Artificial Sequence
  chemically synthesized
tatattctgaattattaagacc

SEQ ID NO: 853298 - DNA, 22 bp, Artificial Sequence
  chemically synthesized
ttatattctgaattattaagac

SEQ ID NO: 853299 - DNA, 22 bp, Artificial Sequence
  chemically synthesized
atttgggtcttaataattcaga

SEQ ID NO: 853300 - DNA, 22 bp, Artificial Sequence
  chemically synthesized
tttgggtcttaataattcagaa

SEQ ID NO: 853301 - DNA, 22 bp, Artificial Sequence
  chemically synthesized
gggtcttaataattcagaatat

SEQ ID NO: 853302 - DNA, 22 bp, Artificial Sequence
  chemically synthesized
ggtcttaataattcagaatata

SEQ ID NO: 853303 - DNA, 22 bp, Artificial Sequence
  chemically synthesized
ggtcatcagtttttatattctg

SEQ ID NO: 853304 - DNA, 22 bp, Artificial Sequence
  chemically synthesized
aataattcagaatataaaaact

SEQ ID NO: 853305 - DNA, 22 bp, Artificial Sequence
  chemically synthesized
ataattcagaatataaaaactg

SEQ ID NO: 853306 - DNA, 22 bp, Artificial Sequence
  chemically synthesized
agaatataaaaactgatgacct

SEQ ID NO: 853307 - DNA, 22 bp, Artificial Sequence
  chemically synthesized
gcatcaatatacgtggtattag

SEQ ID NO: 853308 - DNA, 22 bp, Artificial Sequence
  chemically synthesized
atgacctaataccacgtatatt

SEQ ID NO: 853309 - DNA, 22 bp, Artificial Sequence
  chemically synthesized
aacatgtccgttagcatcaata

SEQ ID NO: 853310 - DNA, 22 bp, Artificial Sequence
  chemically synthesized
ataccacgtatattgatgctaa

SEQ ID NO: 853311 - DNA, 22 bp, Artificial Sequence
  chemically synthesized
taaacatgtccgttagcatcaa

SEQ ID NO: 853312 - DNA, 22 bp, Artificial Sequence
  chemically synthesized
acaaattctaaacatgtccgtt

SEQ ID NO: 853313 - DNA, 22 bp, Artificial Sequence
  chemically synthesized
atgctaacggacatgtttagaa

SEQ ID NO: 853314 - DNA, 22 bp, Artificial Sequence
  chemically synthesized
catagtctgacaaattctaaac

SEQ ID NO: 853315 - DNA, 22 bp, Artificial Sequence
  chemically synthesized
acatagtctgacaaattctaaa

SEQ ID NO: 853316 - DNA, 22 bp, Artificial Sequence
  chemically synthesized
acggacatgtttagaatttgtc

SEQ ID NO: 853317 - DNA, 22 bp, Artificial Sequence
  chemically synthesized
ataatagcttacatagtctgac

SEQ ID NO: 853318 - DNA, 22 bp, Artificial Sequence
  chemically synthesized
cataatagcttacatagtctga

SEQ ID NO: 853319 - DNA, 22 bp, Artificial Sequence
  chemically synthesized
tcataatagcttacatagtctg

SEQ ID NO: 853320 - DNA, 22 bp, Artificial Sequence
  chemically synthesized
agaatttgtcagactatgtaag

SEQ ID NO: 853321 - DNA, 22 bp, Artificial Sequence
  chemically synthesized
gaatttgtcagactatgtaagc

SEQ ID NO: 853322 - DNA, 22 bp, Artificial Sequence
  chemically synthesized
gtcagactatgtaagctattat

SEQ ID NO: 853323 - DNA, 22 bp, Artificial Sequence
  chemically synthesized
tcagactatgtaagctattatg

SEQ ID NO: 853324 - DNA, 22 bp, Artificial Sequence
  chemically synthesized
tgtaagctattatgaaagttac

SEQ ID NO: 853325 - DNA, 22 bp, Artificial Sequence
  chemically synthesized
gagaaagagaaagcagtaactt

SEQ ID NO: 853326 - DNA, 22 bp, Artificial Sequence
  chemically synthesized
tgttggagaaagagaaagcagt

SEQ ID NO: 853327 - DNA, 22 bp, Artificial Sequence
  chemically synthesized
ttatgaaagttactgctttctc

SEQ ID NO: 853328 - DNA, 22 bp, Artificial Sequence
  chemically synthesized
atgttggagaaagagaaagcag

SEQ ID NO: 853329 - DNA, 22 bp, Artificial Sequence
  chemically synthesized
tatgttggagaaagagaaagca

SEQ ID NO: 853330 - DNA, 22 bp, Artificial Sequence
  chemically synthesized
ttatgttggagaaagagaaagc

SEQ ID NO: 853331 - DNA, 22 bp, Artificial Sequence
  chemically synthesized
tgaaagttactgctttctcttt

SEQ ID NO: 853332 - DNA, 22 bp, Artificial Sequence
  chemically synthesized
aatatttttatgttggagaaag

SEQ ID NO: 853333 - DNA, 22 bp, Artificial Sequence
  chemically synthesized
tgaatatttttatgttggagaa

SEQ ID NO: 853334 - DNA, 22 bp, Artificial Sequence
  chemically synthesized
ctgctttctctttctccaacat

SEQ ID NO: 853335 - DNA, 22 bp, Artificial Sequence
  chemically synthesized
ctttctctttctccaacataaa

SEQ ID NO: 853336 - DNA, 22 bp, Artificial Sequence
  chemically synthesized
cctctgaatatttttatgttgg

SEQ ID NO: 853337 - DNA, 22 bp, Artificial Sequence
  chemically synthesized
tgcctctgaatatttttatgtt

SEQ ID NO: 853338 - DNA, 22 bp, Artificial Sequence
  chemically synthesized
tctctttctccaacataaaaat

SEQ ID NO: 853339 - DNA, 22 bp, Artificial Sequence
  chemically synthesized
ctgcctctgaatatttttatgt

SEQ ID NO: 853340 - DNA, 22 bp, Artificial Sequence
  chemically synthesized
ctctttctccaacataaaaata

SEQ ID NO: 853341 - DNA, 22 bp, Artificial Sequence
  chemically synthesized
tctgcctctgaatatttttatg

SEQ ID NO: 853342 - DNA, 22 bp, Artificial Sequence
  chemically synthesized
tctttctccaacataaaaatat

SEQ ID NO: 853343 - DNA, 22 bp, Artificial Sequence
  chemically synthesized
tttctccaacataaaaatattc

SEQ ID NO: 853344 - DNA, 22 bp, Artificial Sequence
  chemically synthesized
tctttctgcctctgaatatttt

SEQ ID NO: 853345 - DNA, 22 bp, Artificial Sequence
  chemically synthesized
tctccaacataaaaatattcag

SEQ ID NO: 853346 - DNA, 22 bp, Artificial Sequence
  chemically synthesized
ctccaacataaaaatattcaga

SEQ ID NO: 853347 - DNA, 22 bp, Artificial Sequence
  chemically synthesized
tccaacataaaaatattcagag

SEQ ID NO: 853348 - DNA, 22 bp, Artificial Sequence
  chemically synthesized
caacataaaaatattcagaggc

SEQ ID NO: 853349 - DNA, 22 bp, Artificial Sequence
  chemically synthesized
atgtctatctttctgcctctga

SEQ ID NO: 853350 - DNA, 22 bp, Artificial Sequence
  chemically synthesized
ttcatgtctatctttctgcctc

SEQ ID NO: 853351 - DNA, 22 bp, Artificial Sequence
  chemically synthesized
ttattcatgtctatctttctgc

SEQ ID NO: 853352 - DNA, 22 bp, Artificial Sequence
  chemically synthesized
tattattcatgtctatctttct

SEQ ID NO: 853353 - DNA, 22 bp, Artificial Sequence
  chemically synthesized
agaggcagaaagatagacatga

SEQ ID NO: 853354 - DNA, 22 bp, Artificial Sequence
  chemically synthesized
agaaatcaaggaaataaaatgg

SEQ ID NO: 853355 - DNA, 22 bp, Artificial Sequence
  chemically synthesized
cagaaatcaaggaaataaaatg

SEQ ID NO: 853356 - DNA, 22 bp, Artificial Sequence
  chemically synthesized
tttcagaaatcaaggaaataaa

SEQ ID NO: 853357 - DNA, 22 bp, Artificial Sequence
  chemically synthesized
gtttcagaaatcaaggaaataa

SEQ ID NO: 853358 - DNA, 22 bp, Artificial Sequence
  chemically synthesized
tttctccattttatttccttga

SEQ ID NO: 853359 - DNA, 22 bp, Artificial Sequence
  chemically synthesized
ttctccattttatttccttgat

SEQ ID NO: 853360 - DNA, 22 bp, Artificial Sequence
  chemically synthesized
tctccattttatttccttgatt

SEQ ID NO: 853361 - DNA, 22 bp, Artificial Sequence
  chemically synthesized
ctccattttatttccttgattt

SEQ ID NO: 853362 - DNA, 22 bp, Artificial Sequence
  chemically synthesized
aatttgtttcagaaatcaagga

SEQ ID NO: 853363 - DNA, 22 bp, Artificial Sequence
  chemically synthesized
tccattttatttccttgatttc

SEQ ID NO: 853364 - DNA, 22 bp, Artificial Sequence
  chemically synthesized
aaatttgtttcagaaatcaagg

SEQ ID NO: 853365 - DNA, 22 bp, Artificial Sequence
  chemically synthesized
cattttatttccttgatttctg

SEQ ID NO: 853366 - DNA, 22 bp, Artificial Sequence
  chemically synthesized
tttaaatttgtttcagaaatca

SEQ ID NO: 853367 - DNA, 22 bp, Artificial Sequence
  chemically synthesized
tgtttaaatttgtttcagaaat

SEQ ID NO: 853368 - DNA, 22 bp, Artificial Sequence
  chemically synthesized
tatttccttgatttctgaaaca

SEQ ID NO: 853369 - DNA, 22 bp, Artificial Sequence
  chemically synthesized
atttccttgatttctgaaacaa

SEQ ID NO: 853370 - DNA, 22 bp, Artificial Sequence
  chemically synthesized
tttccttgatttctgaaacaaa

SEQ ID NO: 853371 - DNA, 22 bp, Artificial Sequence
  chemically synthesized
gttctgtttaaatttgtttcag

SEQ ID NO: 853372 - DNA, 22 bp, Artificial Sequence
  chemically synthesized
agttctgtttaaatttgtttca

SEQ ID NO: 853373 - DNA, 22 bp, Artificial Sequence
  chemically synthesized
ccttgatttctgaaacaaattt

SEQ ID NO: 853374 - DNA, 22 bp, Artificial Sequence
  chemically synthesized
ttagttctgtttaaatttgttt

SEQ ID NO: 853375 - DNA, 22 bp, Artificial Sequence
  chemically synthesized
cttgatttctgaaacaaattta

SEQ ID NO: 853376 - DNA, 22 bp, Artificial Sequence
  chemically synthesized
cttagttctgtttaaatttgtt

SEQ ID NO: 853377 - DNA, 22 bp, Artificial Sequence
  chemically synthesized
gatttctgaaacaaatttaaac

SEQ ID NO: 853378 - DNA, 22 bp, Artificial Sequence
  chemically synthesized
atttctgaaacaaatttaaaca

SEQ ID NO: 853379 - DNA, 22 bp, Artificial Sequence
  chemically synthesized
tcttcttagttctgtttaaatt

SEQ ID NO: 853380 - DNA, 22 bp, Artificial Sequence
  chemically synthesized
ctgtcttcttagttctgtttaa

SEQ ID NO: 853381 - DNA, 22 bp, Artificial Sequence
  chemically synthesized
ctgaaacaaatttaaacagaac

SEQ ID NO: 853382 - DNA, 22 bp, Artificial Sequence
  chemically synthesized
cctgtcttcttagttctgttta

SEQ ID NO: 853383 - DNA, 22 bp, Artificial Sequence
  chemically synthesized
tgaaacaaatttaaacagaact

SEQ ID NO: 853384 - DNA, 22 bp, Artificial Sequence
  chemically synthesized
tcctgtcttcttagttctgttt

SEQ ID NO: 853385 - DNA, 22 bp, Artificial Sequence
  chemically synthesized
aaacaaatttaaacagaactaa

SEQ ID NO: 853386 - DNA, 22 bp, Artificial Sequence
  chemically synthesized
ttttcctgtcttcttagttctg

SEQ ID NO: 853387 - DNA, 22 bp, Artificial Sequence
  chemically synthesized
aaacagaactaagaagacagga

SEQ ID NO: 853388 - DNA, 22 bp, Artificial Sequence
  chemically synthesized
aacagaactaagaagacaggaa

SEQ ID NO: 853389 - DNA, 22 bp, Artificial Sequence
  chemically synthesized
aatatgatgtgattgttttcct

SEQ ID NO: 853390 - DNA, 22 bp, Artificial Sequence
  chemically synthesized
gctaaatatgatgtgattgttt

SEQ ID NO: 853391 - DNA, 22 bp, Artificial Sequence
  chemically synthesized
agaagacaggaaaacaatcaca

SEQ ID NO: 853392 - DNA, 22 bp, Artificial Sequence
  chemically synthesized
agctaaatatgatgtgattgtt

SEQ ID NO: 853393 - DNA, 22 bp, Artificial Sequence
  chemically synthesized
acttagctaaatatgatgtgat

SEQ ID NO: 853394 - DNA, 22 bp, Artificial Sequence
  chemically synthesized
aacttagctaaatatgatgtga

SEQ ID NO: 853395 - DNA, 22 bp, Artificial Sequence
  chemically synthesized
taacttagctaaatatgatgtg

SEQ ID NO: 853396 - DNA, 22 bp, Artificial Sequence
  chemically synthesized
gacataagcagttttaacttag

SEQ ID NO: 853397 - DNA, 22 bp, Artificial Sequence
  chemically synthesized
ggacataagcagttttaactta

SEQ ID NO: 853398 - DNA, 22 bp, Artificial Sequence
  chemically synthesized
tggacataagcagttttaactt

SEQ ID NO: 853399 - DNA, 22 bp, Artificial Sequence
  chemically synthesized
tttggacataagcagttttaac

SEQ ID NO: 853400 - DNA, 22 bp, Artificial Sequence
  chemically synthesized
ctttggacataagcagttttaa

SEQ ID NO: 853401 - DNA, 22 bp, Artificial Sequence
  chemically synthesized
ttctttggacataagcagtttt

SEQ ID NO: 853402 - DNA, 22 bp, Artificial Sequence
  chemically synthesized
cttctttggacataagcagttt

SEQ ID NO: 853403 - DNA, 22 bp, Artificial Sequence
  chemically synthesized
tcttctttggacataagcagtt

SEQ ID NO: 853404 - DNA, 22 bp, Artificial Sequence
  chemically synthesized
agctaagttaaaactgcttatg

SEQ ID NO: 853405 - DNA, 22 bp, Artificial Sequence
  chemically synthesized
ttcttctttggacataagcagt

SEQ ID NO: 853406 - DNA, 22 bp, Artificial Sequence
  chemically synthesized
gctaagttaaaactgcttatgt

SEQ ID NO: 853407 - DNA, 22 bp, Artificial Sequence
  chemically synthesized
agttaaaactgcttatgtccaa

SEQ ID NO: 853408 - DNA, 22 bp, Artificial Sequence
  chemically synthesized
aaactgcttatgtccaaagaag

SEQ ID NO: 853409 - DNA, 22 bp, Artificial Sequence
  chemically synthesized
ataatgcacatttttcttcttt

SEQ ID NO: 853410 - DNA, 22 bp, Artificial Sequence
  chemically synthesized
aataatgcacatttttcttctt

SEQ ID NO: 853411 - DNA, 22 bp, Artificial Sequence
  chemically synthesized
cttatgtccaaagaagaaaaat

SEQ ID NO: 853412 - DNA, 22 bp, Artificial Sequence
  chemically synthesized
ttaataatgcacatttttcttc

SEQ ID NO: 853413 - DNA, 22 bp, Artificial Sequence
  chemically synthesized
atgtccaaagaagaaaaatgtg

SEQ ID NO: 853414 - DNA, 22 bp, Artificial Sequence
  chemically synthesized
tgtccaaagaagaaaaatgtgc

SEQ ID NO: 853415 - DNA, 22 bp, Artificial Sequence
  chemically synthesized
gccaagatactcttaataatgc

SEQ ID NO: 853416 - DNA, 22 bp, Artificial Sequence
  chemically synthesized
tgctagccaagatactcttaat

SEQ ID NO: 853417 - DNA, 22 bp, Artificial Sequence
  chemically synthesized
gctatgctagccaagatactct

SEQ ID NO: 853418 - DNA, 22 bp, Artificial Sequence
  chemically synthesized
ttaagagtatcttggctagcat

SEQ ID NO: 853419 - DNA, 22 bp, Artificial Sequence
  chemically synthesized
agagtatcttggctagcatagc

SEQ ID NO: 853420 - DNA, 22 bp, Artificial Sequence
  chemically synthesized
ggctagcatagccagctgccta

SEQ ID NO: 853421 - DNA, 22 bp, Artificial Sequence
  chemically synthesized
gctagcatagccagctgcctat

SEQ ID NO: 853422 - DNA, 22 bp, Artificial Sequence
  chemically synthesized
gcatagccagctgcctatccga

SEQ ID NO: 853423 - DNA, 22 bp, Artificial Sequence
  chemically synthesized
agaaggaaagaaagggtatcgg

SEQ ID NO: 853424 - DNA, 22 bp, Artificial Sequence
  chemically synthesized
gctaagaaggaaagaaagggta

SEQ ID NO: 853425 - DNA, 22 bp, Artificial Sequence
  chemically synthesized
agctaagaaggaaagaaagggt

SEQ ID NO: 853426 - DNA, 22 bp, Artificial Sequence
  chemically synthesized
tagctaagaaggaaagaaaggg

SEQ ID NO: 853427 - DNA, 22 bp, Artificial Sequence
  chemically synthesized
cctatccgataccctttctttc

SEQ ID NO: 853428 - DNA, 22 bp, Artificial Sequence
  chemically synthesized
ttagctaagaaggaaagaaagg

SEQ ID NO: 853429 - DNA, 22 bp, Artificial Sequence
  chemically synthesized
tttagctaagaaggaaagaaag

SEQ ID NO: 853430 - DNA, 22 bp, Artificial Sequence
  chemically synthesized
ttttagctaagaaggaaagaaa

SEQ ID NO: 853431 - DNA, 22 bp, Artificial Sequence
  chemically synthesized
tccgataccctttctttccttc

SEQ ID NO: 853432 - DNA, 22 bp, Artificial Sequence
  chemically synthesized
gatttttttagctaagaaggaa

SEQ ID NO: 853433 - DNA, 22 bp, Artificial Sequence
  chemically synthesized
ggatttttttagctaagaagga

SEQ ID NO: 853434 - DNA, 22 bp, Artificial Sequence
  chemically synthesized
tctttccttcttagctaaaaaa

SEQ ID NO: 853435 - DNA, 22 bp, Artificial Sequence
  chemically synthesized
ctttccttcttagctaaaaaaa

SEQ ID NO: 853436 - DNA, 22 bp, Artificial Sequence
  chemically synthesized
tttccttcttagctaaaaaaat

SEQ ID NO: 853437 - DNA, 22 bp, Artificial Sequence
  chemically synthesized
aacagaatttggatttttttag

SEQ ID NO: 853438 - DNA, 22 bp, Artificial Sequence
  chemically synthesized
tccttcttagctaaaaaaatcc

SEQ ID NO: 853439 - DNA, 22 bp, Artificial Sequence
  chemically synthesized
ccttcttagctaaaaaaatcca

SEQ ID NO: 853440 - DNA, 22 bp, Artificial Sequence
  chemically synthesized
cttcttagctaaaaaaatccaa

SEQ ID NO: 853441 - DNA, 22 bp, Artificial Sequence
  chemically synthesized
gtctgaacagaatttggatttt

SEQ ID NO: 853442 - DNA, 22 bp, Artificial Sequence
  chemically synthesized
cttagctaaaaaaatccaaatt

SEQ ID NO: 853443 - DNA, 22 bp, Artificial Sequence
  chemically synthesized
ttagctaaaaaaatccaaattc

SEQ ID NO: 853444 - DNA, 22 bp, Artificial Sequence
  chemically synthesized
ctagtctgaacagaatttggat

SEQ ID NO: 853445 - DNA, 22 bp, Artificial Sequence
  chemically synthesized
gctagtctgaacagaatttgga

SEQ ID NO: 853446 - DNA, 22 bp, Artificial Sequence
  chemically synthesized
agctaaaaaaatccaaattctg

SEQ ID NO: 853447 - DNA, 22 bp, Artificial Sequence
  chemically synthesized
gctaaaaaaatccaaattctgt

SEQ ID NO: 853448 - DNA, 22 bp, Artificial Sequence
  chemically synthesized
aaaaaatccaaattctgttcag

SEQ ID NO: 853449 - DNA, 22 bp, Artificial Sequence
  chemically synthesized
taaaaccttgctagtctgaaca

SEQ ID NO: 853450 - DNA, 22 bp, Artificial Sequence
  chemically synthesized
gttataaaaccttgctagtctg

SEQ ID NO: 853451 - DNA, 22 bp, Artificial Sequence
  chemically synthesized
agttataaaaccttgctagtct

SEQ ID NO: 853452 - DNA, 22 bp, Artificial Sequence
  chemically synthesized
tgttcagactagcaaggtttta

SEQ ID NO: 853453 - DNA, 22 bp, Artificial Sequence
  chemically synthesized
gtaacttagttataaaaccttg

SEQ ID NO: 853454 - DNA, 22 bp, Artificial Sequence
  chemically synthesized
ttcagactagcaaggttttata

SEQ ID NO: 853455 - DNA, 22 bp, Artificial Sequence
  chemically synthesized
agactagcaaggttttataact

SEQ ID NO: 853456 - DNA, 22 bp, Artificial Sequence
  chemically synthesized
gcaaggttttataactaagtta

SEQ ID NO: 853457 - DNA, 22 bp, Artificial Sequence
  chemically synthesized
aaaatgtgaaaattggtaactt

SEQ ID NO: 853458 - DNA, 22 bp, Artificial Sequence
  chemically synthesized
tataactaagttaccaattttc

SEQ ID NO: 853459 - DNA, 22 bp, Artificial Sequence
  chemically synthesized
ataactaagttaccaattttca

SEQ ID NO: 853460 - DNA, 22 bp, Artificial Sequence
  chemically synthesized
taactaagttaccaattttcac

SEQ ID NO: 853461 - DNA, 22 bp, Artificial Sequence
  chemically synthesized
ataattcaaaatgtgaaaattg

SEQ ID NO: 853462 - DNA, 22 bp, Artificial Sequence
  chemically synthesized
cataattcaaaatgtgaaaatt

SEQ ID NO: 853463 - DNA, 22 bp, Artificial Sequence
  chemically synthesized
ttcataattcaaaatgtgaaaa

SEQ ID NO: 853464 - DNA, 22 bp, Artificial Sequence
  chemically synthesized
cttcataattcaaaatgtgaaa

SEQ ID NO: 853465 - DNA, 22 bp, Artificial Sequence
  chemically synthesized
tcttcataattcaaaatgtgaa

SEQ ID NO: 853466 - DNA, 22 bp, Artificial Sequence
  chemically synthesized
agttaccaattttcacattttg

SEQ ID NO: 853467 - DNA, 22 bp, Artificial Sequence
  chemically synthesized
tttcttcataattcaaaatgtg

SEQ ID NO: 853468 - DNA, 22 bp, Artificial Sequence
  chemically synthesized
ctttcttcataattcaaaatgt

SEQ ID NO: 853469 - DNA, 22 bp, Artificial Sequence
  chemically synthesized
ccaattttcacattttgaatta

SEQ ID NO: 853470 - DNA, 22 bp, Artificial Sequence
  chemically synthesized
tcacattttgaattatgaagaa

SEQ ID NO: 853471 - DNA, 22 bp, Artificial Sequence
  chemically synthesized
cacattttgaattatgaagaaa

SEQ ID NO: 853472 - DNA, 22 bp, Artificial Sequence
  chemically synthesized
acattttgaattatgaagaaag

SEQ ID NO: 853473 - DNA, 22 bp, Artificial Sequence
  chemically synthesized
aataggtgtgtttctttcttca

SEQ ID NO: 853474 - DNA, 22 bp, Artificial Sequence
  chemically synthesized
actgaataggtgtgtttctttc

SEQ ID NO: 853475 - DNA, 22 bp, Artificial Sequence
  chemically synthesized
tgaattatgaagaaagaaacac

SEQ ID NO: 853476 - DNA, 22 bp, Artificial Sequence
  chemically synthesized
aactgaataggtgtgtttcttt

SEQ ID NO: 853477 - DNA, 22 bp, Artificial Sequence
  chemically synthesized
gaattatgaagaaagaaacaca

SEQ ID NO: 853478 - DNA, 22 bp, Artificial Sequence
  chemically synthesized
taactgaataggtgtgtttctt

SEQ ID NO: 853479 - DNA, 22 bp, Artificial Sequence
  chemically synthesized
aattatgaagaaagaaacacac

SEQ ID NO: 853480 - DNA, 22 bp, Artificial Sequence
  chemically synthesized
tgaagaaagaaacacacctatt

SEQ ID NO: 853481 - DNA, 22 bp, Artificial Sequence
  chemically synthesized
agtgttttaactgaataggtgt

SEQ ID NO: 853482 - DNA, 22 bp, Artificial Sequence
  chemically synthesized
ggaggattgagtgttttaactg

SEQ ID NO: 853483 - DNA, 22 bp, Artificial Sequence
  chemically synthesized
gggaggattgagtgttttaact

SEQ ID NO: 853484 - DNA, 22 bp, Artificial Sequence
  chemically synthesized
aggatcttgggaggattgagtg

SEQ ID NO: 853485 - DNA, 22 bp, Artificial Sequence
  chemically synthesized
ttcagttaaaacactcaatcct

SEQ ID NO: 853486 - DNA, 22 bp, Artificial Sequence
  chemically synthesized
taaggatcttgggaggattgag

SEQ ID NO: 853487 - DNA, 22 bp, Artificial Sequence
  chemically synthesized
ctaaggatcttgggaggattga

SEQ ID NO: 853488 - DNA, 22 bp, Artificial Sequence
  chemically synthesized
agttaaaacactcaatcctccc

SEQ ID NO: 853489 - DNA, 22 bp, Artificial Sequence
  chemically synthesized
acttctaaggatcttgggagga

SEQ ID NO: 853490 - DNA, 22 bp, Artificial Sequence
  chemically synthesized
aaacactcaatcctcccaagat

SEQ ID NO: 853491 - DNA, 22 bp, Artificial Sequence
  chemically synthesized
ctaacttctaaggatcttggga

SEQ ID NO: 853492 - DNA, 22 bp, Artificial Sequence
  chemically synthesized
aatcctcccaagatccttagaa

SEQ ID NO: 853493 - DNA, 22 bp, Artificial Sequence
  chemically synthesized
ccaagatccttagaagttagga

SEQ ID NO: 853494 - DNA, 22 bp, Artificial Sequence
  chemically synthesized
agaagttaggaatggtcacgtg

SEQ ID NO: 853495 - DNA, 22 bp, Artificial Sequence
  chemically synthesized
gaagttaggaatggtcacgtga

SEQ ID NO: 853496 - DNA, 22 bp, Artificial Sequence
  chemically synthesized
accagaaatgtgtcacgtgacc

SEQ ID NO: 853497 - DNA, 22 bp, Artificial Sequence
  chemically synthesized
ggaatggtcacgtgacacattt

SEQ ID NO: 853498 - DNA, 22 bp, Artificial Sequence
  chemically synthesized
aacagtgcattaaccagaaatg

SEQ ID NO: 853499 - DNA, 22 bp, Artificial Sequence
  chemically synthesized
gaacagtgcattaaccagaaat

SEQ ID NO: 853500 - DNA, 22 bp, Artificial Sequence
  chemically synthesized
cttgaacagtgcattaaccaga

SEQ ID NO: 853501 - DNA, 22 bp, Artificial Sequence
  chemically synthesized
tacttgaacagtgcattaacca

SEQ ID NO: 853502 - DNA, 22 bp, Artificial Sequence
  chemically synthesized
ctacttgaacagtgcattaacc

SEQ ID NO: 853503 - DNA, 22 bp, Artificial Sequence
  chemically synthesized
ctggttaatgcactgttcaagt

SEQ ID NO: 853504 - DNA, 22 bp, Artificial Sequence
  chemically synthesized
tggttaatgcactgttcaagta

SEQ ID NO: 853505 - DNA, 22 bp, Artificial Sequence
  chemically synthesized
gttaatgcactgttcaagtaga

SEQ ID NO: 853506 - DNA, 22 bp, Artificial Sequence
  chemically synthesized
atgcactgttcaagtagaaact

SEQ ID NO: 853507 - DNA, 22 bp, Artificial Sequence
  chemically synthesized
gcagccccacacagaagagttt

SEQ ID NO: 853508 - DNA, 22 bp, Artificial Sequence
  chemically synthesized
tggcagccccacacagaagagt

SEQ ID NO: 853509 - DNA, 22 bp, Artificial Sequence
  chemically synthesized
ttcaagtagaaactcttctgtg

SEQ ID NO: 853510 - DNA, 22 bp, Artificial Sequence
  chemically synthesized
ctggcagccccacacagaagag

SEQ ID NO: 853511 - DNA, 22 bp, Artificial Sequence
  chemically synthesized
tctggcagccccacacagaaga

SEQ ID NO: 853512 - DNA, 22 bp, Artificial Sequence
  chemically synthesized
ttctggcagccccacacagaag

SEQ ID NO: 853513 - DNA, 22 bp, Artificial Sequence
  chemically synthesized
aagtagaaactcttctgtgtgg

SEQ ID NO: 853514 - DNA, 22 bp, Artificial Sequence
  chemically synthesized
ttctgtgtggggctgccagaaa

SEQ ID NO: 853515 - DNA, 22 bp, Artificial Sequence
  chemically synthesized
ctgtgtggggctgccagaaaag

SEQ ID NO: 853516 - DNA, 22 bp, Artificial Sequence
  chemically synthesized
tgtgtggggctgccagaaaagc

SEQ ID NO: 853517 - DNA, 22 bp, Artificial Sequence
  chemically synthesized
tgtggggctgccagaaaagcac

SEQ ID NO: 853518 - DNA, 22 bp, Artificial Sequence
  chemically synthesized
taaggaaaaccagtgcttttct

SEQ ID NO: 853519 - DNA, 22 bp, Artificial Sequence
  chemically synthesized
gtaaggaaaaccagtgcttttc

SEQ ID NO: 853520 - DNA, 22 bp, Artificial Sequence
  chemically synthesized
tttgtaaggaaaaccagtgctt

SEQ ID NO: 853521 - DNA, 22 bp, Artificial Sequence
  chemically synthesized
ctgtttgtaaggaaaaccagtg

SEQ ID NO: 853522 - DNA, 22 bp, Artificial Sequence
  chemically synthesized
ccagaaaagcactggttttcct

SEQ ID NO: 853523 - DNA, 22 bp, Artificial Sequence
  chemically synthesized
tgtcagctcctgtttgtaagga

SEQ ID NO: 853524 - DNA, 22 bp, Artificial Sequence
  chemically synthesized
cagctgtgtcagctcctgtttg

SEQ ID NO: 853525 - DNA, 22 bp, Artificial Sequence
  chemically synthesized
gttttccttacaaacaggagct

SEQ ID NO: 853526 - DNA, 22 bp, Artificial Sequence
  chemically synthesized
tccttacaaacaggagctgaca

SEQ ID NO: 853527 - DNA, 22 bp, Artificial Sequence
  chemically synthesized
ccttacaaacaggagctgacac

SEQ ID NO: 853528 - DNA, 22 bp, Artificial Sequence
  chemically synthesized
cttacaaacaggagctgacaca

SEQ ID NO: 853529 - DNA, 22 bp, Artificial Sequence
  chemically synthesized
acaaacaggagctgacacagct

SEQ ID NO: 853530 - DNA, 22 bp, Artificial Sequence
  chemically synthesized
caaacaggagctgacacagctg

SEQ ID NO: 853531 - DNA, 22 bp, Artificial Sequence
  chemically synthesized
acacagctggaatatgctttta

SEQ ID NO: 853532 - DNA, 22 bp, Artificial Sequence
  chemically synthesized
gaatatgcttttactttcccca

SEQ ID NO: 853533 - DNA, 22 bp, Artificial Sequence
  chemically synthesized
aaatggaagaagggaaaatggg

SEQ ID NO: 853534 - DNA, 22 bp, Artificial Sequence
  chemically synthesized
aaaatggaagaagggaaaatgg

SEQ ID NO: 853535 - DNA, 22 bp, Artificial Sequence
  chemically synthesized
taaaatggaagaagggaaaatg

SEQ ID NO: 853536 - DNA, 22 bp, Artificial Sequence
  chemically synthesized
ttactttccccattttcccttc

SEQ ID NO: 853537 - DNA, 22 bp, Artificial Sequence
  chemically synthesized
tactttccccattttcccttct

SEQ ID NO: 853538 - DNA, 22 bp, Artificial Sequence
  chemically synthesized
actttccccattttcccttctt

SEQ ID NO: 853539 - DNA, 22 bp, Artificial Sequence
  chemically synthesized
ctttccccattttcccttcttc

SEQ ID NO: 853540 - DNA, 22 bp, Artificial Sequence
  chemically synthesized
tactttaaaatggaagaaggga

SEQ ID NO: 853541 - DNA, 22 bp, Artificial Sequence
  chemically synthesized
tccccattttcccttcttccat

SEQ ID NO: 853542 - DNA, 22 bp, Artificial Sequence
  chemically synthesized
ccccattttcccttcttccatt

SEQ ID NO: 853543 - DNA, 22 bp, Artificial Sequence
  chemically synthesized
cccattttcccttcttccattt

SEQ ID NO: 853544 - DNA, 22 bp, Artificial Sequence
  chemically synthesized
tgtctgtactttaaaatggaag

SEQ ID NO: 853545 - DNA, 22 bp, Artificial Sequence
  chemically synthesized
tcccttcttccattttaaagta

SEQ ID NO: 853546 - DNA, 22 bp, Artificial Sequence
  chemically synthesized
cccttcttccattttaaagtac

SEQ ID NO: 853547 - DNA, 22 bp, Artificial Sequence
  chemically synthesized
ccttcttccattttaaagtaca

SEQ ID NO: 853548 - DNA, 22 bp, Artificial Sequence
  chemically synthesized
caggcactatgtctgtacttta

SEQ ID NO: 853549 - DNA, 22 bp, Artificial Sequence
  chemically synthesized
cttccattttaaagtacagaca

SEQ ID NO: 853550 - DNA, 22 bp, Artificial Sequence
  chemically synthesized
ttccattttaaagtacagacat

SEQ ID NO: 853551 - DNA, 22 bp, Artificial Sequence
  chemically synthesized
cctccaggcactatgtctgtac

SEQ ID NO: 853552 - DNA, 22 bp, Artificial Sequence
  chemically synthesized
ccattttaaagtacagacatag

SEQ ID NO: 853553 - DNA, 22 bp, Artificial Sequence
  chemically synthesized
tgcctccaggcactatgtctgt

SEQ ID NO: 853554 - DNA, 22 bp, Artificial Sequence
  chemically synthesized
cattttaaagtacagacatagt

SEQ ID NO: 853555 - DNA, 22 bp, Artificial Sequence
  chemically synthesized
ctctgcctccaggcactatgtc

SEQ ID NO: 853556 - DNA, 22 bp, Artificial Sequence
  chemically synthesized
taaagtacagacatagtgcctg

SEQ ID NO: 853557 - DNA, 22 bp, Artificial Sequence
  chemically synthesized
aaagtacagacatagtgcctgg

SEQ ID NO: 853558 - DNA, 22 bp, Artificial Sequence
  chemically synthesized
aagtacagacatagtgcctgga

SEQ ID NO: 853559 - DNA, 22 bp, Artificial Sequence
  chemically synthesized
aacatggctactctgcctccag

SEQ ID NO: 853560 - DNA, 22 bp, Artificial Sequence
  chemically synthesized
tggtctcaacatggctactctg

SEQ ID NO: 853561 - DNA, 22 bp, Artificial Sequence
  chemically synthesized
ctgtggtctcaacatggctact

SEQ ID NO: 853562 - DNA, 22 bp, Artificial Sequence
  chemically synthesized
cctgtggtctcaacatggctac

SEQ ID NO: 853563 - DNA, 22 bp, Artificial Sequence
  chemically synthesized
tcctgtggtctcaacatggcta

SEQ ID NO: 853564 - DNA, 22 bp, Artificial Sequence
  chemically synthesized
ttcctgtggtctcaacatggct

SEQ ID NO: 853565 - DNA, 22 bp, Artificial Sequence
  chemically synthesized
tttcctgtggtctcaacatggc

SEQ ID NO: 853566 - DNA, 22 bp, Artificial Sequence
  chemically synthesized
gaggcagagtagccatgttgag

SEQ ID NO: 853567 - DNA, 22 bp, Artificial Sequence
  chemically synthesized
ttttcctgtggtctcaacatgg

SEQ ID NO: 853568 - DNA, 22 bp, Artificial Sequence
  chemically synthesized
tttttcctgtggtctcaacatg

SEQ ID NO: 853569 - DNA, 22 bp, Artificial Sequence
  chemically synthesized
agaccacaggaaaaaaagtctt

SEQ ID NO: 853570 - DNA, 22 bp, Artificial Sequence
  chemically synthesized
caggcgtgagccaccgtgccca

SEQ ID NO: 853571 - DNA, 22 bp, Artificial Sequence
  chemically synthesized
gctgggcacggtggctcacgcc

SEQ ID NO: 853572 - DNA, 22 bp, Artificial Sequence
  chemically synthesized
ctgggcacggtggctcacgcct

SEQ ID NO: 853573 - DNA, 22 bp, Artificial Sequence
  chemically synthesized
ggcacggtggctcacgcctgta

SEQ ID NO: 853574 - DNA, 22 bp, Artificial Sequence
  chemically synthesized
ccaaagtggtgggattacaggc

SEQ ID NO: 853575 - DNA, 22 bp, Artificial Sequence
  chemically synthesized
agcctcccaaagtggtgggatt

SEQ ID NO: 853576 - DNA, 22 bp, Artificial Sequence
  chemically synthesized
acgcctgtaatcccaccacttt

SEQ ID NO: 853577 - DNA, 22 bp, Artificial Sequence
  chemically synthesized
cctcagcctcccaaagtggtgg

SEQ ID NO: 853578 - DNA, 22 bp, Artificial Sequence
  chemically synthesized
cctgcctcagcctcccaaagtg

SEQ ID NO: 853579 - DNA, 22 bp, Artificial Sequence
  chemically synthesized
taatcccaccactttgggaggc

SEQ ID NO: 853580 - DNA, 22 bp, Artificial Sequence
  chemically synthesized
atgatctgcctgcctcagcctc

SEQ ID NO: 853581 - DNA, 22 bp, Artificial Sequence
  chemically synthesized
acctcatgatctgcctgcctca

SEQ ID NO: 853582 - DNA, 22 bp, Artificial Sequence
  chemically synthesized
ctgacctcatgatctgcctgcc

SEQ ID NO: 853583 - DNA, 22 bp, Artificial Sequence
  chemically synthesized
tgggaggctgaggcaggcagat

SEQ ID NO: 853584 - DNA, 22 bp, Artificial Sequence
  chemically synthesized
gggaggctgaggcaggcagatc

SEQ ID NO: 853585 - DNA, 22 bp, Artificial Sequence
  chemically synthesized
ggaggctgaggcaggcagatca

SEQ ID NO: 853586 - DNA, 22 bp, Artificial Sequence
  chemically synthesized
gatctcctgacctcatgatctg

SEQ ID NO: 853587 - DNA, 22 bp, Artificial Sequence
  chemically synthesized
aggcaggcagatcatgaggtca

SEQ ID NO: 853588 - DNA, 22 bp, Artificial Sequence
  chemically synthesized
gccaggatggtctcgatctcct

SEQ ID NO: 853589 - DNA, 22 bp, Artificial Sequence
  chemically synthesized
accatgttggccaggatggtct

SEQ ID NO: 853590 - DNA, 22 bp, Artificial Sequence
  chemically synthesized
caccatgttggccaggatggtc

SEQ ID NO: 853591 - DNA, 22 bp, Artificial Sequence
  chemically synthesized
gtagagacggggtttcaccatg

SEQ ID NO: 853592 - DNA, 22 bp, Artificial Sequence
  chemically synthesized
agtagagacggggtttcaccat

SEQ ID NO: 853593 - DNA, 22 bp, Artificial Sequence
  chemically synthesized
tagtagagacggggtttcacca

SEQ ID NO: 853594 - DNA, 22 bp, Artificial Sequence
  chemically synthesized
ttagtagagacggggtttcacc

SEQ ID NO: 853595 - DNA, 22 bp, Artificial Sequence
  chemically synthesized
gccaacatggtgaaaccccgtc

SEQ ID NO: 853596 - DNA, 22 bp, Artificial Sequence
  chemically synthesized
tatttttagtagagacggggtt

SEQ ID NO: 853597 - DNA, 22 bp, Artificial Sequence
  chemically synthesized
gtatttttagtagagacggggt

SEQ ID NO: 853598 - DNA, 22 bp, Artificial Sequence
  chemically synthesized
tgtatttttagtagagacgggg

SEQ ID NO: 853599 - DNA, 22 bp, Artificial Sequence
  chemically synthesized
ttgtatttttagtagagacggg

SEQ ID NO: 853600 - DNA, 22 bp, Artificial Sequence
  chemically synthesized
atttttgtatttttagtagaga

SEQ ID NO: 853601 - DNA, 22 bp, Artificial Sequence
  chemically synthesized
tactaaaaatacaaaaattagc

SEQ ID NO: 853602 - DNA, 22 bp, Artificial Sequence
  chemically synthesized
ctaaaaatacaaaaattagctg

SEQ ID NO: 853603 - DNA, 22 bp, Artificial Sequence
  chemically synthesized
aaaatacaaaaattagctgggc

SEQ ID NO: 853604 - DNA, 22 bp, Artificial Sequence
  chemically synthesized
cgggaacgcaccaccacgccca

SEQ ID NO: 853605 - DNA, 22 bp, Artificial Sequence
  chemically synthesized
ggattacgggaacgcaccacca

SEQ ID NO: 853606 - DNA, 22 bp, Artificial Sequence
  chemically synthesized
gctgggcgtggtggtgcgttcc

SEQ ID NO: 853607 - DNA, 22 bp, Artificial Sequence
  chemically synthesized
ggcgtggtggtgcgttcccgta

SEQ ID NO: 853608 - DNA, 22 bp, Artificial Sequence
  chemically synthesized
agtagctgggattacgggaacg

SEQ ID NO: 853609 - DNA, 22 bp, Artificial Sequence
  chemically synthesized
ctgagtagctgggattacggga

SEQ ID NO: 853610 - DNA, 22 bp, Artificial Sequence
  chemically synthesized
agcctcctgagtagctgggatt

SEQ ID NO: 853611 - DNA, 22 bp, Artificial Sequence
  chemically synthesized
cctcagcctcctgagtagctgg

SEQ ID NO: 853612 - DNA, 22 bp, Artificial Sequence
  chemically synthesized
ctgcctcagcctcctgagtagc

SEQ ID NO: 853613 - DNA, 22 bp, Artificial Sequence
  chemically synthesized
ccgtaatcccagctactcagga

SEQ ID NO: 853614 - DNA, 22 bp, Artificial Sequence
  chemically synthesized
tcctgcctcagcctcctgagta

SEQ ID NO: 853615 - DNA, 22 bp, Artificial Sequence
  chemically synthesized
aagggattctcctgcctcagcc

SEQ ID NO: 853616 - DNA, 22 bp, Artificial Sequence
  chemically synthesized
gttcaagggattctcctgcctc

SEQ ID NO: 853617 - DNA, 22 bp, Artificial Sequence
  chemically synthesized
ctcaggaggctgaggcaggaga

SEQ ID NO: 853618 - DNA, 22 bp, Artificial Sequence
  chemically synthesized
aggaggctgaggcaggagaatc

SEQ ID NO: 853619 - DNA, 22 bp, Artificial Sequence
  chemically synthesized
cctggttcaagggattctcctg

SEQ ID NO: 853620 - DNA, 22 bp, Artificial Sequence
  chemically synthesized
actccctggttcaagggattct

SEQ ID NO: 853621 - DNA, 22 bp, Artificial Sequence
  chemically synthesized
tgactccctggttcaagggatt

SEQ ID NO: 853622 - DNA, 22 bp, Artificial Sequence
  chemically synthesized
aggcaggagaatcccttgaacc

SEQ ID NO: 853623 - DNA, 22 bp, Artificial Sequence
  chemically synthesized
caacctctgactccctggttca

SEQ ID NO: 853624 - DNA, 22 bp, Artificial Sequence
  chemically synthesized
actgcaacctctgactccctgg

SEQ ID NO: 853625 - DNA, 22 bp, Artificial Sequence
  chemically synthesized
gactcactgcaacctctgactc

SEQ ID NO: 853626 - DNA, 22 bp, Artificial Sequence
  chemically synthesized
gaaccagggagtcagaggttgc

SEQ ID NO: 853627 - DNA, 22 bp, Artificial Sequence
  chemically synthesized
aaccagggagtcagaggttgca

SEQ ID NO: 853628 - DNA, 22 bp, Artificial Sequence
  chemically synthesized
gagtgcagtggcgcgatctcga

SEQ ID NO: 853629 - DNA, 22 bp, Artificial Sequence
  chemically synthesized
cagtgagtcgagatcgcgccac

SEQ ID NO: 853630 - DNA, 22 bp, Artificial Sequence
  chemically synthesized
tcgccaggctggagtgcagtgg

SEQ ID NO: 853631 - DNA, 22 bp, Artificial Sequence
  chemically synthesized
tgtcgccaggctggagtgcagt

SEQ ID NO: 853632 - DNA, 22 bp, Artificial Sequence
  chemically synthesized
agatggagtctctgtcgccagg

SEQ ID NO: 853633 - DNA, 22 bp, Artificial Sequence
  chemically synthesized
gagatggagtctctgtcgccag

SEQ ID NO: 853634 - DNA, 22 bp, Artificial Sequence
  chemically synthesized
tgagatggagtctctgtcgcca

SEQ ID NO: 853635 - DNA, 22 bp, Artificial Sequence
  chemically synthesized
cactccagcctggcgacagaga

SEQ ID NO: 853636 - DNA, 22 bp, Artificial Sequence
  chemically synthesized
ttttgagatggagtctctgtcg

SEQ ID NO: 853637 - DNA, 22 bp, Artificial Sequence
  chemically synthesized
gttttgagatggagtctctgtc

SEQ ID NO: 853638 - DNA, 22 bp, Artificial Sequence
  chemically synthesized
tgttttgagatggagtctctgt

SEQ ID NO: 853639 - DNA, 22 bp, Artificial Sequence
  chemically synthesized
ttgttttgagatggagtctctg

SEQ ID NO: 853640 - DNA, 22 bp, Artificial Sequence
  chemically synthesized
cagcctggcgacagagactcca

SEQ ID NO: 853641 - DNA, 22 bp, Artificial Sequence
  chemically synthesized
tttttgttttgagatggagtct

SEQ ID NO: 853642 - DNA, 22 bp, Artificial Sequence
  chemically synthesized
gtttttgttttgagatggagtc

SEQ ID NO: 853643 - DNA, 22 bp, Artificial Sequence
  chemically synthesized
tgtttttgttttgagatggagt

SEQ ID NO: 853644 - DNA, 22 bp, Artificial Sequence
  chemically synthesized
ttgtttttgttttgagatggag

SEQ ID NO: 853645 - DNA, 22 bp, Artificial Sequence
  chemically synthesized
gcgacagagactccatctcaaa

SEQ ID NO: 853646 - DNA, 22 bp, Artificial Sequence
  chemically synthesized
tttttgtttttgttttgagatg

SEQ ID NO: 853647 - DNA, 22 bp, Artificial Sequence
  chemically synthesized
gtttttgtttttgttttgagat

SEQ ID NO: 853648 - DNA, 22 bp, Artificial Sequence
  chemically synthesized
tgtttttgtttttgttttgaga

SEQ ID NO: 853649 - DNA, 22 bp, Artificial Sequence
  chemically synthesized
ttgtttttgtttttgttttgag

SEQ ID NO: 853650 - DNA, 22 bp, Artificial Sequence
  chemically synthesized
tttttgtttttgtttttgtttt

SEQ ID NO: 853651 - DNA, 22 bp, Artificial Sequence
  chemically synthesized
ttgtttttgtttttgtttttgt

SEQ ID NO: 853652 - DNA, 22 bp, Artificial Sequence
  chemically synthesized
gttgtttttgtttttgtttttg

SEQ ID NO: 853653 - DNA, 22 bp, Artificial Sequence
  chemically synthesized
tgttgtttttgtttttgttttt

SEQ ID NO: 853654 - DNA, 22 bp, Artificial Sequence
  chemically synthesized
catctcaaaacaaaaacaaaaa

SEQ ID NO: 853655 - DNA, 22 bp, Artificial Sequence
  chemically synthesized
ttttgttgtttttgtttttgtt

SEQ ID NO: 853656 - DNA, 22 bp, Artificial Sequence
  chemically synthesized
gttttgttgtttttgtttttgt

SEQ ID NO: 853657 - DNA, 22 bp, Artificial Sequence
  chemically synthesized
tgttttgttgtttttgtttttg

SEQ ID NO: 853658 - DNA, 22 bp, Artificial Sequence
  chemically synthesized
aaaacaaaaacaaaaacaaaaa

SEQ ID NO: 853659 - DNA, 22 bp, Artificial Sequence
  chemically synthesized
ttttgttttgttgtttttgttt

SEQ ID NO: 853660 - DNA, 22 bp, Artificial Sequence
  chemically synthesized
gttttgttttgttgtttttgtt

SEQ ID NO: 853661 - DNA, 22 bp, Artificial Sequence
  chemically synthesized
tgttttgttttgttgtttttgt

SEQ ID NO: 853662 - DNA, 22 bp, Artificial Sequence
  chemically synthesized
ttgttttgttttgttgtttttg

SEQ ID NO: 853663 - DNA, 22 bp, Artificial Sequence
  chemically synthesized
tttgttttgttttgttgttttt

SEQ ID NO: 853664 - DNA, 22 bp, Artificial Sequence
  chemically synthesized
tttttgttttgttttgttgttt

SEQ ID NO: 853665 - DNA, 22 bp, Artificial Sequence
  chemically synthesized
ctttttgttttgttttgttgtt

SEQ ID NO: 853666 - DNA, 22 bp, Artificial Sequence
  chemically synthesized
tctttttgttttgttttgttgt

SEQ ID NO: 853667 - DNA, 22 bp, Artificial Sequence
  chemically synthesized
caacatgagactttctttttgt

SEQ ID NO: 853668 - DNA, 22 bp, Artificial Sequence
  chemically synthesized
caaccccagtcatctccaacat

SEQ ID NO: 853669 - DNA, 22 bp, Artificial Sequence
  chemically synthesized
ctccaaccccagtcatctccaa

SEQ ID NO: 853670 - DNA, 22 bp, Artificial Sequence
  chemically synthesized
cctccaaccccagtcatctcca

SEQ ID NO: 853671 - DNA, 22 bp, Artificial Sequence
  chemically synthesized
tcctccaaccccagtcatctcc

SEQ ID NO: 853672 - DNA, 22 bp, Artificial Sequence
  chemically synthesized
ttcctccaaccccagtcatctc

SEQ ID NO: 853673 - DNA, 22 bp, Artificial Sequence
  chemically synthesized
tttcctccaaccccagtcatct

SEQ ID NO: 853674 - DNA, 22 bp, Artificial Sequence
  chemically synthesized
atgttggagatgactggggttg

SEQ ID NO: 853675 - DNA, 22 bp, Artificial Sequence
  chemically synthesized
gagatgactggggttggaggaa

SEQ ID NO: 853676 - DNA, 22 bp, Artificial Sequence
  chemically synthesized
gggttggaggaaaaagttggga

SEQ ID NO: 853677 - DNA, 22 bp, Artificial Sequence
  chemically synthesized
caaaaccgtatgtcccaacttt

SEQ ID NO: 853678 - DNA, 22 bp, Artificial Sequence
  chemically synthesized
gaggaaaaagttgggacatacg

SEQ ID NO: 853679 - DNA, 22 bp, Artificial Sequence
  chemically synthesized
ggacatacggttttggaggtgc

SEQ ID NO: 853680 - DNA, 22 bp, Artificial Sequence
  chemically synthesized
cagggtcagtgcagcacctcca

SEQ ID NO: 853681 - DNA, 22 bp, Artificial Sequence
  chemically synthesized
tgtgttccagggtcagtgcagc

SEQ ID NO: 853682 - DNA, 22 bp, Artificial Sequence
  chemically synthesized
tggaggtgctgcactgaccctg

SEQ ID NO: 853683 - DNA, 22 bp, Artificial Sequence
  chemically synthesized
ggaggtgctgcactgaccctgg

SEQ ID NO: 853684 - DNA, 22 bp, Artificial Sequence
  chemically synthesized
gaggtgctgcactgaccctgga

SEQ ID NO: 853685 - DNA, 22 bp, Artificial Sequence
  chemically synthesized
cagaattatgtgttccagggtc

SEQ ID NO: 853686 - DNA, 22 bp, Artificial Sequence
  chemically synthesized
ccagaattatgtgttccagggt

SEQ ID NO: 853687 - DNA, 22 bp, Artificial Sequence
  chemically synthesized
cactgaccctggaacacataat

SEQ ID NO: 853688 - DNA, 22 bp, Artificial Sequence
  chemically synthesized
accctggaacacataattctgg

SEQ ID NO: 853689 - DNA, 22 bp, Artificial Sequence
  chemically synthesized
atagagcaagacttccagaatt

SEQ ID NO: 853690 - DNA, 22 bp, Artificial Sequence
  chemically synthesized
tcatagagcaagacttccagaa

SEQ ID NO: 853691 - DNA, 22 bp, Artificial Sequence
  chemically synthesized
ctcatagagcaagacttccaga

SEQ ID NO: 853692 - DNA, 22 bp, Artificial Sequence
  chemically synthesized
gaacacataattctggaagtct

SEQ ID NO: 853693 - DNA, 22 bp, Artificial Sequence
  chemically synthesized
tctcatagagcaagacttccag

SEQ ID NO: 853694 - DNA, 22 bp, Artificial Sequence
  chemically synthesized
ttctcatagagcaagacttcca

SEQ ID NO: 853695 - DNA, 22 bp, Artificial Sequence
  chemically synthesized
tttctcatagagcaagacttcc

SEQ ID NO: 853696 - DNA, 22 bp, Artificial Sequence
  chemically synthesized
tttttctcatagagcaagactt

SEQ ID NO: 853697 - DNA, 22 bp, Artificial Sequence
  chemically synthesized
ctttttctcatagagcaagact

SEQ ID NO: 853698 - DNA, 22 bp, Artificial Sequence
  chemically synthesized
tggaagtcttgctctatgagaa

SEQ ID NO: 853699 - DNA, 22 bp, Artificial Sequence
  chemically synthesized
gaagtcttgctctatgagaaaa

SEQ ID NO: 853700 - DNA, 22 bp, Artificial Sequence
  chemically synthesized
tccagatagtttctttttctca

SEQ ID NO: 853701 - DNA, 22 bp, Artificial Sequence
  chemically synthesized
atccagatagtttctttttctc

SEQ ID NO: 853702 - DNA, 22 bp, Artificial Sequence
  chemically synthesized
gctctatgagaaaaagaaacta

SEQ ID NO: 853703 - DNA, 22 bp, Artificial Sequence
  chemically synthesized
ctctatgagaaaaagaaactat

SEQ ID NO: 853704 - DNA, 22 bp, Artificial Sequence
  chemically synthesized
tatgagaaaaagaaactatctg

SEQ ID NO: 853705 - DNA, 22 bp, Artificial Sequence
  chemically synthesized
cagtggcttatccagatagttt

SEQ ID NO: 853706 - DNA, 22 bp, Artificial Sequence
  chemically synthesized
tgagaaaaagaaactatctgga

SEQ ID NO: 853707 - DNA, 22 bp, Artificial Sequence
  chemically synthesized
actacagtggcttatccagata

SEQ ID NO: 853708 - DNA, 22 bp, Artificial Sequence
  chemically synthesized
tcactacagtggcttatccaga

SEQ ID NO: 853709 - DNA, 22 bp, Artificial Sequence
  chemically synthesized
tctggataagccactgtagtga

SEQ ID NO: 853710 - DNA, 22 bp, Artificial Sequence
  chemically synthesized
tgcgtgacagcattctcactac

SEQ ID NO: 853711 - DNA, 22 bp, Artificial Sequence
  chemically synthesized
gataagccactgtagtgagaat

SEQ ID NO: 853712 - DNA, 22 bp, Artificial Sequence
  chemically synthesized
gctatgcgtgacagcattctca

SEQ ID NO: 853713 - DNA, 22 bp, Artificial Sequence
  chemically synthesized
agctatgcgtgacagcattctc

SEQ ID NO: 853714 - DNA, 22 bp, Artificial Sequence
  chemically synthesized
tgtttagctatgcgtgacagca

SEQ ID NO: 853715 - DNA, 22 bp, Artificial Sequence
  chemically synthesized
tagtgagaatgctgtcacgcat

SEQ ID NO: 853716 - DNA, 22 bp, Artificial Sequence
  chemically synthesized
agattgtgtttagctatgcgtg

SEQ ID NO: 853717 - DNA, 22 bp, Artificial Sequence
  chemically synthesized
ttaagattgtgtttagctatgc

SEQ ID NO: 853718 - DNA, 22 bp, Artificial Sequence
  chemically synthesized
tgttaagattgtgtttagctat

SEQ ID NO: 853719 - DNA, 22 bp, Artificial Sequence
  chemically synthesized
ctctgttaagattgtgtttagc

SEQ ID NO: 853720 - DNA, 22 bp, Artificial Sequence
  chemically synthesized
actctgttaagattgtgtttag

SEQ ID NO: 853721 - DNA, 22 bp, Artificial Sequence
  chemically synthesized
tcacgcatagctaaacacaatc

SEQ ID NO: 853722 - DNA, 22 bp, Artificial Sequence
  chemically synthesized
cagtttactctgttaagattgt

SEQ ID NO: 853723 - DNA, 22 bp, Artificial Sequence
  chemically synthesized
ccagtttactctgttaagattg

SEQ ID NO: 853724 - DNA, 22 bp, Artificial Sequence
  chemically synthesized
tccagtttactctgttaagatt

SEQ ID NO: 853725 - DNA, 22 bp, Artificial Sequence
  chemically synthesized
ttccagtttactctgttaagat

SEQ ID NO: 853726 - DNA, 22 bp, Artificial Sequence
  chemically synthesized
tttccagtttactctgttaaga

SEQ ID NO: 853727 - DNA, 22 bp, Artificial Sequence
  chemically synthesized
ttttccagtttactctgttaag

SEQ ID NO: 853728 - DNA, 22 bp, Artificial Sequence
  chemically synthesized
tttttccagtttactctgttaa

SEQ ID NO: 853729 - DNA, 22 bp, Artificial Sequence
  chemically synthesized
ttttttccagtttactctgtta

SEQ ID NO: 853730 - DNA, 22 bp, Artificial Sequence
  chemically synthesized
tttttttccagtttactctgtt

SEQ ID NO: 853731 - DNA, 22 bp, Artificial Sequence
  chemically synthesized
aacacaatcttaacagagtaaa

SEQ ID NO: 853732 - DNA, 22 bp, Artificial Sequence
  chemically synthesized
aaggattttttttttccagttt

SEQ ID NO: 853733 - DNA, 22 bp, Artificial Sequence
  chemically synthesized
aacagagtaaactggaaaaaaa

SEQ ID NO: 853734 - DNA, 22 bp, Artificial Sequence
  chemically synthesized
acagagtaaactggaaaaaaaa

SEQ ID NO: 853735 - DNA, 22 bp, Artificial Sequence
  chemically synthesized
gaaattaaaggatttttttttt

SEQ ID NO: 853736 - DNA, 22 bp, Artificial Sequence
  chemically synthesized
agaaattaaaggattttttttt

SEQ ID NO: 853737 - DNA, 22 bp, Artificial Sequence
  chemically synthesized
tagaaattaaaggatttttttt

SEQ ID NO: 853738 - DNA, 22 bp, Artificial Sequence
  chemically synthesized
agaattttagaaattaaaggat

SEQ ID NO: 853739 - DNA, 22 bp, Artificial Sequence
  chemically synthesized
gaaaaaaaaaatcctttaattt

SEQ ID NO: 853740 - DNA, 22 bp, Artificial Sequence
  chemically synthesized
taagaattttagaaattaaagg

SEQ ID NO: 853741 - DNA, 22 bp, Artificial Sequence
  chemically synthesized
gacactctaagaattttagaaa

SEQ ID NO: 853742 - DNA, 22 bp, Artificial Sequence
  chemically synthesized
agacactctaagaattttagaa

SEQ ID NO: 853743 - DNA, 22 bp, Artificial Sequence
  chemically synthesized
tagacactctaagaattttaga

SEQ ID NO: 853744 - DNA, 22 bp, Artificial Sequence
  chemically synthesized
taatttctaaaattcttagagt

SEQ ID NO: 853745 - DNA, 22 bp, Artificial Sequence
  chemically synthesized
aatttctaaaattcttagagtg

SEQ ID NO: 853746 - DNA, 22 bp, Artificial Sequence
  chemically synthesized
atttctaaaattcttagagtgt

SEQ ID NO: 853747 - DNA, 22 bp, Artificial Sequence
  chemically synthesized
ctaaaattcttagagtgtctaa

SEQ ID NO: 853748 - DNA, 22 bp, Artificial Sequence
  chemically synthesized
taaaattcttagagtgtctaaa

SEQ ID NO: 853749 - DNA, 22 bp, Artificial Sequence
  chemically synthesized
aaattcttagagtgtctaaaat

SEQ ID NO: 853750 - DNA, 22 bp, Artificial Sequence
  chemically synthesized
ttagagtgtctaaaattatgat

SEQ ID NO: 853751 - DNA, 22 bp, Artificial Sequence
  chemically synthesized
agagtgtctaaaattatgattg

SEQ ID NO: 853752 - DNA, 22 bp, Artificial Sequence
  chemically synthesized
gagtgtctaaaattatgattgt

SEQ ID NO: 853753 - DNA, 22 bp, Artificial Sequence
  chemically synthesized
catcgatgcaaaaacaatcata

SEQ ID NO: 853754 - DNA, 22 bp, Artificial Sequence
  chemically synthesized
ctgcatcgatgcaaaaacaatc

SEQ ID NO: 853755 - DNA, 22 bp, Artificial Sequence
  chemically synthesized
actgcatcgatgcaaaaacaat

SEQ ID NO: 853756 - DNA, 22 bp, Artificial Sequence
  chemically synthesized
aaattatgattgtttttgcatc

SEQ ID NO: 853757 - DNA, 22 bp, Artificial Sequence
  chemically synthesized
aatttactgcatcgatgcaaaa

SEQ ID NO: 853758 - DNA, 22 bp, Artificial Sequence
  chemically synthesized
tgattgtttttgcatcgatgca

SEQ ID NO: 853759 - DNA, 22 bp, Artificial Sequence
  chemically synthesized
agaattaaatttactgcatcga

SEQ ID NO: 853760 - DNA, 22 bp, Artificial Sequence
  chemically synthesized
ctgagaattaaatttactgcat

SEQ ID NO: 853761 - DNA, 22 bp, Artificial Sequence
  chemically synthesized
tttttgcatcgatgcagtaaat

SEQ ID NO: 853762 - DNA, 22 bp, Artificial Sequence
  chemically synthesized
ttgcatcgatgcagtaaattta

SEQ ID NO: 853763 - DNA, 22 bp, Artificial Sequence
  chemically synthesized
tgcatcgatgcagtaaatttaa

SEQ ID NO: 853764 - DNA, 22 bp, Artificial Sequence
  chemically synthesized
gcatcgatgcagtaaatttaat

SEQ ID NO: 853765 - DNA, 22 bp, Artificial Sequence
  chemically synthesized
catcgatgcagtaaatttaatt

SEQ ID NO: 853766 - DNA, 22 bp, Artificial Sequence
  chemically synthesized
gtcaatgatgaatgaaagtctc

SEQ ID NO: 853767 - DNA, 22 bp, Artificial Sequence
  chemically synthesized
ggtcaatgatgaatgaaagtct

SEQ ID NO: 853768 - DNA, 22 bp, Artificial Sequence
  chemically synthesized
tggtcaatgatgaatgaaagtc

SEQ ID NO: 853769 - DNA, 22 bp, Artificial Sequence
  chemically synthesized
aattctcaggagactttcattc

SEQ ID NO: 853770 - DNA, 22 bp, Artificial Sequence
  chemically synthesized
attctcaggagactttcattca

SEQ ID NO: 853771 - DNA, 22 bp, Artificial Sequence
  chemically synthesized
ttttggtcaatgatgaatgaaa

SEQ ID NO: 853772 - DNA, 22 bp, Artificial Sequence
  chemically synthesized
gttttggtcaatgatgaatgaa

SEQ ID NO: 853773 - DNA, 22 bp, Artificial Sequence
  chemically synthesized
tcaggagactttcattcatcat

SEQ ID NO: 853774 - DNA, 22 bp, Artificial Sequence
  chemically synthesized
aggagactttcattcatcattg

SEQ ID NO: 853775 - DNA, 22 bp, Artificial Sequence
  chemically synthesized
atgtcttgttttggtcaatgat

SEQ ID NO: 853776 - DNA, 22 bp, Artificial Sequence
  chemically synthesized
tcattcatcattgaccaaaaca

SEQ ID NO: 853777 - DNA, 22 bp, Artificial Sequence
  chemically synthesized
cattcatcattgaccaaaacaa

SEQ ID NO: 853778 - DNA, 22 bp, Artificial Sequence
  chemically synthesized
attcatcattgaccaaaacaag

SEQ ID NO: 853779 - DNA, 22 bp, Artificial Sequence
  chemically synthesized
atcattgaccaaaacaagacat

SEQ ID NO: 853780 - DNA, 22 bp, Artificial Sequence
  chemically synthesized
aatgcaatatgattcatgtctt

SEQ ID NO: 853781 - DNA, 22 bp, Artificial Sequence
  chemically synthesized
ttaaatgcaatatgattcatgt

SEQ ID NO: 853782 - DNA, 22 bp, Artificial Sequence
  chemically synthesized
accaaaacaagacatgaatcat

SEQ ID NO: 853783 - DNA, 22 bp, Artificial Sequence
  chemically synthesized
actgttaaatgcaatatgattc

SEQ ID NO: 853784 - DNA, 22 bp, Artificial Sequence
  chemically synthesized
aactgttaaatgcaatatgatt

SEQ ID NO: 853785 - DNA, 22 bp, Artificial Sequence
  chemically synthesized
tcttaactgttaaatgcaatat

SEQ ID NO: 853786 - DNA, 22 bp, Artificial Sequence
  chemically synthesized
atcttaactgttaaatgcaata

SEQ ID NO: 853787 - DNA, 22 bp, Artificial Sequence
  chemically synthesized
atatatatgtttatcttaactg

SEQ ID NO: 853788 - DNA, 22 bp, Artificial Sequence
  chemically synthesized
catttaacagttaagataaaca

SEQ ID NO: 853789 - DNA, 22 bp, Artificial Sequence
  chemically synthesized
tattcatatatatgtttatctt

SEQ ID NO: 853790 - DNA, 22 bp, Artificial Sequence
  chemically synthesized
aacagttaagataaacatatat

SEQ ID NO: 853791 - DNA, 22 bp, Artificial Sequence
  chemically synthesized
acagttaagataaacatatata

SEQ ID NO: 853792 - DNA, 22 bp, Artificial Sequence
  chemically synthesized
tagagctatattcatatatatg

SEQ ID NO: 853793 - DNA, 22 bp, Artificial Sequence
  chemically synthesized
atagagctatattcatatatat

SEQ ID NO: 853794 - DNA, 22 bp, Artificial Sequence
  chemically synthesized
tatagagctatattcatatata

SEQ ID NO: 853795 - DNA, 22 bp, Artificial Sequence
  chemically synthesized
agataaacatatatatgaatat

SEQ ID NO: 853796 - DNA, 22 bp, Artificial Sequence
  chemically synthesized
gaatatgacaacattttataga

SEQ ID NO: 853797 - DNA, 22 bp, Artificial Sequence
  chemically synthesized
ggaatatgacaacattttatag

SEQ ID NO: 853798 - DNA, 22 bp, Artificial Sequence
  chemically synthesized
gtatttggaatatgacaacatt

SEQ ID NO: 853799 - DNA, 22 bp, Artificial Sequence
  chemically synthesized
agtatttggaatatgacaacat

SEQ ID NO: 853800 - DNA, 22 bp, Artificial Sequence
  chemically synthesized
cttagtatttggaatatgacaa

SEQ ID NO: 853801 - DNA, 22 bp, Artificial Sequence
  chemically synthesized
acttagtatttggaatatgaca

SEQ ID NO: 853802 - DNA, 22 bp, Artificial Sequence
  chemically synthesized
tacttagtatttggaatatgac

SEQ ID NO: 853803 - DNA, 22 bp, Artificial Sequence
  chemically synthesized
tataaaatgttgtcatattcca

SEQ ID NO: 853804 - DNA, 22 bp, Artificial Sequence
  chemically synthesized
taaaatgttgtcatattccaaa

SEQ ID NO: 853805 - DNA, 22 bp, Artificial Sequence
  chemically synthesized
gttttacttagtatttggaata

SEQ ID NO: 853806 - DNA, 22 bp, Artificial Sequence
  chemically synthesized
ctagttttacttagtatttgga

SEQ ID NO: 853807 - DNA, 22 bp, Artificial Sequence
  chemically synthesized
tcatattccaaatactaagtaa

SEQ ID NO: 853808 - DNA, 22 bp, Artificial Sequence
  chemically synthesized
acagattactagttttacttag

SEQ ID NO: 853809 - DNA, 22 bp, Artificial Sequence
  chemically synthesized
cacagattactagttttactta

SEQ ID NO: 853810 - DNA, 22 bp, Artificial Sequence
  chemically synthesized
tcttcacagattactagtttta

SEQ ID NO: 853811 - DNA, 22 bp, Artificial Sequence
  chemically synthesized
caaatactaagtaaaactagta

SEQ ID NO: 853812 - DNA, 22 bp, Artificial Sequence
  chemically synthesized
atcttcacagattactagtttt

SEQ ID NO: 853813 - DNA, 22 bp, Artificial Sequence
  chemically synthesized
tatcttcacagattactagttt

SEQ ID NO: 853814 - DNA, 22 bp, Artificial Sequence
  chemically synthesized
ctttatcttcacagattactag

SEQ ID NO: 853815 - DNA, 22 bp, Artificial Sequence
  chemically synthesized
actttatcttcacagattacta

SEQ ID NO: 853816 - DNA, 22 bp, Artificial Sequence
  chemically synthesized
agtaaaactagtaatctgtgaa

SEQ ID NO: 853817 - DNA, 22 bp, Artificial Sequence
  chemically synthesized
atttactttatcttcacagatt

SEQ ID NO: 853818 - DNA, 22 bp, Artificial Sequence
  chemically synthesized
ttgatttactttatcttcacag

SEQ ID NO: 853819 - DNA, 22 bp, Artificial Sequence
  chemically synthesized
gtaatctgtgaagataaagtaa

SEQ ID NO: 853820 - DNA, 22 bp, Artificial Sequence
  chemically synthesized
taaatattgttgatttacttta

SEQ ID NO: 853821 - DNA, 22 bp, Artificial Sequence
  chemically synthesized
ataaatattgttgatttacttt

SEQ ID NO: 853822 - DNA, 22 bp, Artificial Sequence
  chemically synthesized
tataaatattgttgatttactt

SEQ ID NO: 853823 - DNA, 22 bp, Artificial Sequence
  chemically synthesized
tgaagataaagtaaatcaacaa

SEQ ID NO: 853824 - DNA, 22 bp, Artificial Sequence
  chemically synthesized
ggtgctttataaatattgttga

SEQ ID NO: 853825 - DNA, 22 bp, Artificial Sequence
  chemically synthesized
aagatgtactaggtgctttata

SEQ ID NO: 853826 - DNA, 22 bp, Artificial Sequence
  chemically synthesized
acatagccgctaaagatgtact

SEQ ID NO: 853827 - DNA, 22 bp, Artificial Sequence
  chemically synthesized
ataaagcacctagtacatcttt

SEQ ID NO: 853828 - DNA, 22 bp, Artificial Sequence
  chemically synthesized
gacatagccgctaaagatgtac

SEQ ID NO: 853829 - DNA, 22 bp, Artificial Sequence
  chemically synthesized
taaagcacctagtacatcttta

SEQ ID NO: 853830 - DNA, 22 bp, Artificial Sequence
  chemically synthesized
tttgacatagccgctaaagatg

SEQ ID NO: 853831 - DNA, 22 bp, Artificial Sequence
  chemically synthesized
tatttgacatagccgctaaaga

SEQ ID NO: 853832 - DNA, 22 bp, Artificial Sequence
  chemically synthesized
gtacatctttagcggctatgtc

SEQ ID NO: 853833 - DNA, 22 bp, Artificial Sequence
  chemically synthesized
tagcggctatgtcaaatagaat

SEQ ID NO: 853834 - DNA, 22 bp, Artificial Sequence
  chemically synthesized
agcggctatgtcaaatagaata

SEQ ID NO: 853835 - DNA, 22 bp, Artificial Sequence
  chemically synthesized
gcggctatgtcaaatagaatat

SEQ ID NO: 853836 - DNA, 22 bp, Artificial Sequence
  chemically synthesized
taaaggaaggtgtaatattcta

SEQ ID NO: 853837 - DNA, 22 bp, Artificial Sequence
  chemically synthesized
ctgtaaaggaaggtgtaatatt

SEQ ID NO: 853838 - DNA, 22 bp, Artificial Sequence
  chemically synthesized
cctgtaaaggaaggtgtaatat

SEQ ID NO: 853839 - DNA, 22 bp, Artificial Sequence
  chemically synthesized
tgtcaaatagaatattacacct

SEQ ID NO: 853840 - DNA, 22 bp, Artificial Sequence
  chemically synthesized
aatttcctgtaaaggaaggtgt

SEQ ID NO: 853841 - DNA, 22 bp, Artificial Sequence
  chemically synthesized
aaatttcctgtaaaggaaggtg

SEQ ID NO: 853842 - DNA, 22 bp, Artificial Sequence
  chemically synthesized
gaaataaatttaaatttcctgt

SEQ ID NO: 853843 - DNA, 22 bp, Artificial Sequence
  chemically synthesized
caccttcctttacaggaaattt

SEQ ID NO: 853844 - DNA, 22 bp, Artificial Sequence
  chemically synthesized
gtcctcgaaataaatttaaatt

SEQ ID NO: 853845 - DNA, 22 bp, Artificial Sequence
  chemically synthesized
cctttacaggaaatttaaattt

SEQ ID NO: 853846 - DNA, 22 bp, Artificial Sequence
  chemically synthesized
ctttacaggaaatttaaattta

SEQ ID NO: 853847 - DNA, 22 bp, Artificial Sequence
  chemically synthesized
tggtcctcgaaataaatttaaa

SEQ ID NO: 853848 - DNA, 22 bp, Artificial Sequence
  chemically synthesized
ctggtcctcgaaataaatttaa

SEQ ID NO: 853849 - DNA, 22 bp, Artificial Sequence
  chemically synthesized
tctggtcctcgaaataaattta

SEQ ID NO: 853850 - DNA, 22 bp, Artificial Sequence
  chemically synthesized
tacaggaaatttaaatttattt

SEQ ID NO: 853851 - DNA, 22 bp, Artificial Sequence
  chemically synthesized
acaggaaatttaaatttatttc

SEQ ID NO: 853852 - DNA, 22 bp, Artificial Sequence
  chemically synthesized
caggaaatttaaatttatttcg

SEQ ID NO: 853853 - DNA, 22 bp, Artificial Sequence
  chemically synthesized
ttttctggtcctcgaaataaat

SEQ ID NO: 853854 - DNA, 22 bp, Artificial Sequence
  chemically synthesized
ttattttctggtcctcgaaata

SEQ ID NO: 853855 - DNA, 22 bp, Artificial Sequence
  chemically synthesized
gattgttattttctggtcctcg

SEQ ID NO: 853856 - DNA, 22 bp, Artificial Sequence
  chemically synthesized
agattgttattttctggtcctc

SEQ ID NO: 853857 - DNA, 22 bp, Artificial Sequence
  chemically synthesized
aaatttatttcgaggaccagaa

SEQ ID NO: 853858 - DNA, 22 bp, Artificial Sequence
  chemically synthesized
tagattgttattttctggtcct

SEQ ID NO: 853859 - DNA, 22 bp, Artificial Sequence
  chemically synthesized
aatttatttcgaggaccagaaa

SEQ ID NO: 853860 - DNA, 22 bp, Artificial Sequence
  chemically synthesized
ttagattgttattttctggtcc

SEQ ID NO: 853861 - DNA, 22 bp, Artificial Sequence
  chemically synthesized
tttagattgttattttctggtc

SEQ ID NO: 853862 - DNA, 22 bp, Artificial Sequence
  chemically synthesized
atttcgaggaccagaaaataac

SEQ ID NO: 853863 - DNA, 22 bp, Artificial Sequence
  chemically synthesized
actttttagattgttattttct

SEQ ID NO: 853864 - DNA, 22 bp, Artificial Sequence
  chemically synthesized
tttcgaggaccagaaaataaca

SEQ ID NO: 853865 - DNA, 22 bp, Artificial Sequence
  chemically synthesized
gactttttagattgttattttc

SEQ ID NO: 853866 - DNA, 22 bp, Artificial Sequence
  chemically synthesized
cgaggaccagaaaataacaatc

SEQ ID NO: 853867 - DNA, 22 bp, Artificial Sequence
  chemically synthesized
gaggaccagaaaataacaatct

SEQ ID NO: 853868 - DNA, 22 bp, Artificial Sequence
  chemically synthesized
tcatttgactttttagattgtt

SEQ ID NO: 853869 - DNA, 22 bp, Artificial Sequence
  chemically synthesized
aaatgtatgttgtcatttgact

SEQ ID NO: 853870 - DNA, 22 bp, Artificial Sequence
  chemically synthesized
caaatgtatgttgtcatttgac

SEQ ID NO: 853871 - DNA, 22 bp, Artificial Sequence
  chemically synthesized
tcaaatgtatgttgtcatttga

SEQ ID NO: 853872 - DNA, 22 bp, Artificial Sequence
  chemically synthesized
ttcaaatgtatgttgtcatttg

SEQ ID NO: 853873 - DNA, 22 bp, Artificial Sequence
  chemically synthesized
ttttcaaatgtatgttgtcatt

SEQ ID NO: 853874 - DNA, 22 bp, Artificial Sequence
  chemically synthesized
cttttcaaatgtatgttgtcat

SEQ ID NO: 853875 - DNA, 22 bp, Artificial Sequence
  chemically synthesized
tcttttcaaatgtatgttgtca

SEQ ID NO: 853876 - DNA, 22 bp, Artificial Sequence
  chemically synthesized
ttcttttcaaatgtatgttgtc

SEQ ID NO: 853877 - DNA, 22 bp, Artificial Sequence
  chemically synthesized
aaaagtcaaatgacaacataca

SEQ ID NO: 853878 - DNA, 22 bp, Artificial Sequence
  chemically synthesized
aacttttcttttcaaatgtatg

SEQ ID NO: 853879 - DNA, 22 bp, Artificial Sequence
  chemically synthesized
gaacttttcttttcaaatgtat

SEQ ID NO: 853880 - DNA, 22 bp, Artificial Sequence
  chemically synthesized
tcttgaacttttcttttcaaat

SEQ ID NO: 853881 - DNA, 22 bp, Artificial Sequence
  chemically synthesized
ttgtcttgaacttttcttttca

SEQ ID NO: 853882 - DNA, 22 bp, Artificial Sequence
  chemically synthesized
tgttgtcttgaacttttctttt

SEQ ID NO: 853883 - DNA, 22 bp, Artificial Sequence
  chemically synthesized
ctgttgtcttgaacttttcttt

SEQ ID NO: 853884 - DNA, 22 bp, Artificial Sequence
  chemically synthesized
cttctgttgtcttgaacttttc

SEQ ID NO: 853885 - DNA, 22 bp, Artificial Sequence
  chemically synthesized
gaaaagaaaagttcaagacaac

SEQ ID NO: 853886 - DNA, 22 bp, Artificial Sequence
  chemically synthesized
aaaagaaaagttcaagacaaca

SEQ ID NO: 853887 - DNA, 22 bp, Artificial Sequence
  chemically synthesized
taaagctgcttctgttgtcttg

SEQ ID NO: 853888 - DNA, 22 bp, Artificial Sequence
  chemically synthesized
gtaaagctgcttctgttgtctt

SEQ ID NO: 853889 - DNA, 22 bp, Artificial Sequence
  chemically synthesized
ttgtaaagctgcttctgttgtc

SEQ ID NO: 853890 - DNA, 22 bp, Artificial Sequence
  chemically synthesized
cttgtaaagctgcttctgttgt

SEQ ID NO: 853891 - DNA, 22 bp, Artificial Sequence
  chemically synthesized
tcttgtaaagctgcttctgttg

SEQ ID NO: 853892 - DNA, 22 bp, Artificial Sequence
  chemically synthesized
tatattttcttgtaaagctgct

SEQ ID NO: 853893 - DNA, 22 bp, Artificial Sequence
  chemically synthesized
aagacaacagaagcagctttac

SEQ ID NO: 853894 - DNA, 22 bp, Artificial Sequence
  chemically synthesized
actatatattttcttgtaaagc

SEQ ID NO: 853895 - DNA, 22 bp, Artificial Sequence
  chemically synthesized
aactatatattttcttgtaaag

SEQ ID NO: 853896 - DNA, 22 bp, Artificial Sequence
  chemically synthesized
taactatatattttcttgtaaa

SEQ ID NO: 853897 - DNA, 22 bp, Artificial Sequence
  chemically synthesized
tcctttaactatatattttctt

SEQ ID NO: 853898 - DNA, 22 bp, Artificial Sequence
  chemically synthesized
gtcctttaactatatattttct

SEQ ID NO: 853899 - DNA, 22 bp, Artificial Sequence
  chemically synthesized
tgtcctttaactatatattttc

SEQ ID NO: 853900 - DNA, 22 bp, Artificial Sequence
  chemically synthesized
tacaagaaaatatatagttaaa

SEQ ID NO: 853901 - DNA, 22 bp, Artificial Sequence
  chemically synthesized
acaagaaaatatatagttaaag

SEQ ID NO: 853902 - DNA, 22 bp, Artificial Sequence
  chemically synthesized
caagaaaatatatagttaaagg

SEQ ID NO: 853903 - DNA, 22 bp, Artificial Sequence
  chemically synthesized
agtccaaaatcattttgtcctt

SEQ ID NO: 853904 - DNA, 22 bp, Artificial Sequence
  chemically synthesized
atcaatgattcagtccaaaatc

SEQ ID NO: 853905 - DNA, 22 bp, Artificial Sequence
  chemically synthesized
aaggacaaaatgattttggact

SEQ ID NO: 853906 - DNA, 22 bp, Artificial Sequence
  chemically synthesized
catcaatgattcagtccaaaat

SEQ ID NO: 853907 - DNA, 22 bp, Artificial Sequence
  chemically synthesized
tcatcaatgattcagtccaaaa

SEQ ID NO: 853908 - DNA, 22 bp, Artificial Sequence
  chemically synthesized
ttcatcaatgattcagtccaaa

SEQ ID NO: 853909 - DNA, 22 bp, Artificial Sequence
  chemically synthesized
tttcatcaatgattcagtccaa

SEQ ID NO: 853910 - DNA, 22 bp, Artificial Sequence
  chemically synthesized
gtctttttcatcaatgattcag

SEQ ID NO: 853911 - DNA, 22 bp, Artificial Sequence
  chemically synthesized
tggactgaatcattgatgaaaa

SEQ ID NO: 853912 - DNA, 22 bp, Artificial Sequence
  chemically synthesized
ggactgaatcattgatgaaaaa

SEQ ID NO: 853913 - DNA, 22 bp, Artificial Sequence
  chemically synthesized
gactgaatcattgatgaaaaag

SEQ ID NO: 853914 - DNA, 22 bp, Artificial Sequence
  chemically synthesized
ccaatatgtattggtctttttc

SEQ ID NO: 853915 - DNA, 22 bp, Artificial Sequence
  chemically synthesized
aatcattgatgaaaaagaccaa

SEQ ID NO: 853916 - DNA, 22 bp, Artificial Sequence
  chemically synthesized
atgaaaaagaccaatacatatt

SEQ ID NO: 853917 - DNA, 22 bp, Artificial Sequence
  chemically synthesized
caggcgtgagccaccgtgcccg

SEQ ID NO: 853918 - DNA, 22 bp, Artificial Sequence
  chemically synthesized
gcagccgggcacggtggctcac

SEQ ID NO: 853919 - DNA, 22 bp, Artificial Sequence
  chemically synthesized
ccaaagtgcggggattacaggc

SEQ ID NO: 853920 - DNA, 22 bp, Artificial Sequence
  chemically synthesized
gcctcccaaagtgcggggatta

SEQ ID NO: 853921 - DNA, 22 bp, Artificial Sequence
  chemically synthesized
ggcctcccaaagtgcggggatt

SEQ ID NO: 853922 - DNA, 22 bp, Artificial Sequence
  chemically synthesized
acgcctgtaatccccgcacttt

SEQ ID NO: 853923 - DNA, 22 bp, Artificial Sequence
  chemically synthesized
ccttggcctcccaaagtgcggg

SEQ ID NO: 853924 - DNA, 22 bp, Artificial Sequence
  chemically synthesized
taatccccgcactttgggaggc

SEQ ID NO: 853925 - DNA, 22 bp, Artificial Sequence
  chemically synthesized
atgatccacctgccttggcctc

SEQ ID NO: 853926 - DNA, 22 bp, Artificial Sequence
  chemically synthesized
acctcatgatccacctgccttg

SEQ ID NO: 853927 - DNA, 22 bp, Artificial Sequence
  chemically synthesized
tgggaggccaaggcaggtggat

SEQ ID NO: 853928 - DNA, 22 bp, Artificial Sequence
  chemically synthesized
gggaggccaaggcaggtggatc

SEQ ID NO: 853929 - DNA, 22 bp, Artificial Sequence
  chemically synthesized
ggaggccaaggcaggtggatca

SEQ ID NO: 853930 - DNA, 22 bp, Artificial Sequence
  chemically synthesized
aaatacctgacctcatgatcca

SEQ ID NO: 853931 - DNA, 22 bp, Artificial Sequence
  chemically synthesized
gtctcaaatacctgacctcatg

SEQ ID NO: 853932 - DNA, 22 bp, Artificial Sequence
  chemically synthesized
tggtggccaggctggtctcaaa

SEQ ID NO: 853933 - DNA, 22 bp, Artificial Sequence
  chemically synthesized
actatggtggccaggctggtct

SEQ ID NO: 853934 - DNA, 22 bp, Artificial Sequence
  chemically synthesized
cactatggtggccaggctggtc

SEQ ID NO: 853935 - DNA, 22 bp, Artificial Sequence
  chemically synthesized
gagaccagcctggccaccatag

SEQ ID NO: 853936 - DNA, 22 bp, Artificial Sequence
  chemically synthesized
agaccagcctggccaccatagt

SEQ ID NO: 853937 - DNA, 22 bp, Artificial Sequence
  chemically synthesized
gtagagatggggtttcactatg

SEQ ID NO: 853938 - DNA, 22 bp, Artificial Sequence
  chemically synthesized
agtagagatggggtttcactat

SEQ ID NO: 853939 - DNA, 22 bp, Artificial Sequence
  chemically synthesized
tagtagagatggggtttcacta

SEQ ID NO: 853940 - DNA, 22 bp, Artificial Sequence
  chemically synthesized
ttagtagagatggggtttcact

SEQ ID NO: 853941 - DNA, 22 bp, Artificial Sequence
  chemically synthesized
tttttagtagagatggggtttc

SEQ ID NO: 853942 - DNA, 22 bp, Artificial Sequence
  chemically synthesized
gccaccatagtgaaaccccatc

SEQ ID NO: 853943 - DNA, 22 bp, Artificial Sequence
  chemically synthesized
atttttagtagagatggggttt

SEQ ID NO: 853944 - DNA, 22 bp, Artificial Sequence
  chemically synthesized
tatttttagtagagatggggtt

SEQ ID NO: 853945 - DNA, 22 bp, Artificial Sequence
  chemically synthesized
ttatttttagtagagatggggt

SEQ ID NO: 853946 - DNA, 22 bp, Artificial Sequence
  chemically synthesized
tttatttttagtagagatgggg

SEQ ID NO: 853947 - DNA, 22 bp, Artificial Sequence
  chemically synthesized
ttttatttttagtagagatggg

SEQ ID NO: 853948 - DNA, 22 bp, Artificial Sequence
  chemically synthesized
tttttatttttagtagagatgg

SEQ ID NO: 853949 - DNA, 22 bp, Artificial Sequence
  chemically synthesized
attttttttatttttagtagag

SEQ ID NO: 853950 - DNA, 22 bp, Artificial Sequence
  chemically synthesized
tactaaaaataaaaaaaattag

SEQ ID NO: 853951 - DNA, 22 bp, Artificial Sequence
  chemically synthesized
ctaaaaataaaaaaaattagcc

SEQ ID NO: 853952 - DNA, 22 bp, Artificial Sequence
  chemically synthesized
accaccacacccggctaatttt

SEQ ID NO: 853953 - DNA, 22 bp, Artificial Sequence
  chemically synthesized
aaaataaaaaaaattagccggg

SEQ ID NO: 853954 - DNA, 22 bp, Artificial Sequence
  chemically synthesized
caggcactcaccaccacacccg

SEQ ID NO: 853955 - DNA, 22 bp, Artificial Sequence
  chemically synthesized
ggattacaggcactcaccacca

SEQ ID NO: 853956 - DNA, 22 bp, Artificial Sequence
  chemically synthesized
gccgggtgtggtggtgagtgcc

SEQ ID NO: 853957 - DNA, 22 bp, Artificial Sequence
  chemically synthesized
agtagctgggattacaggcact

SEQ ID NO: 853958 - DNA, 22 bp, Artificial Sequence
  chemically synthesized
ctgagtagctgggattacaggc

SEQ ID NO: 853959 - DNA, 22 bp, Artificial Sequence
  chemically synthesized
agcctcctgagtagctgggatt

SEQ ID NO: 853960 - DNA, 22 bp, Artificial Sequence
  chemically synthesized
cagcctcctgagtagctgggat

SEQ ID NO: 853961 - DNA, 22 bp, Artificial Sequence
  chemically synthesized
cttcagcctcctgagtagctgg

SEQ ID NO: 853962 - DNA, 22 bp, Artificial Sequence
  chemically synthesized
ctgcttcagcctcctgagtagc

SEQ ID NO: 853963 - DNA, 22 bp, Artificial Sequence
  chemically synthesized
tcctgcttcagcctcctgagta

SEQ ID NO: 853964 - DNA, 22 bp, Artificial Sequence
  chemically synthesized
taatcccagctactcaggaggc

SEQ ID NO: 853965 - DNA, 22 bp, Artificial Sequence
  chemically synthesized
aagcgattctcctgcttcagcc

SEQ ID NO: 853966 - DNA, 22 bp, Artificial Sequence
  chemically synthesized
ctcaggaggctgaagcaggaga

SEQ ID NO: 853967 - DNA, 22 bp, Artificial Sequence
  chemically synthesized
ggttcaagcgattctcctgctt

SEQ ID NO: 853968 - DNA, 22 bp, Artificial Sequence
  chemically synthesized
aggaggctgaagcaggagaatc

SEQ ID NO: 853969 - DNA, 22 bp, Artificial Sequence
  chemically synthesized
cgccacctaggttcaagcgatt

SEQ ID NO: 853970 - DNA, 22 bp, Artificial Sequence
  chemically synthesized
aagcaggagaatcgcttgaacc

SEQ ID NO: 853971 - DNA, 22 bp, Artificial Sequence
  chemically synthesized
caacctccgccacctaggttca

SEQ ID NO: 853972 - DNA, 22 bp, Artificial Sequence
  chemically synthesized
actgcaacctccgccacctagg

SEQ ID NO: 853973 - DNA, 22 bp, Artificial Sequence
  chemically synthesized
ggctcactgcaacctccgccac

SEQ ID NO: 853974 - DNA, 22 bp, Artificial Sequence
  chemically synthesized
gaacctaggtggcggaggttgc

SEQ ID NO: 853975 - DNA, 22 bp, Artificial Sequence
  chemically synthesized
aacctaggtggcggaggttgca

SEQ ID NO: 853976 - DNA, 22 bp, Artificial Sequence
  chemically synthesized
ggtggcggaggttgcagtgagc

SEQ ID NO: 853977 - DNA, 22 bp, Artificial Sequence
  chemically synthesized
gagtgcagtggcacgatctcgg

SEQ ID NO: 853978 - DNA, 22 bp, Artificial Sequence
  chemically synthesized
cagtgagccgagatcgtgccac

SEQ ID NO: 853979 - DNA, 22 bp, Artificial Sequence
  chemically synthesized
cccgggctggagtgcagtggca

SEQ ID NO: 853980 - DNA, 22 bp, Artificial Sequence
  chemically synthesized
ttgcccgggctggagtgcagtg

SEQ ID NO: 853981 - DNA, 22 bp, Artificial Sequence
  chemically synthesized
gcactgttgcccgggctggagt

SEQ ID NO: 853982 - DNA, 22 bp, Artificial Sequence
  chemically synthesized
cactccagcccgggcaacagtg

SEQ ID NO: 853983 - DNA, 22 bp, Artificial Sequence
  chemically synthesized
agatggagtctcgcactgttgc

SEQ ID NO: 853984 - DNA, 22 bp, Artificial Sequence
  chemically synthesized
gagatggagtctcgcactgttg

SEQ ID NO: 853985 - DNA, 22 bp, Artificial Sequence
  chemically synthesized
tgagatggagtctcgcactgtt

SEQ ID NO: 853986 - DNA, 22 bp, Artificial Sequence
  chemically synthesized
ttgagatggagtctcgcactgt

SEQ ID NO: 853987 - DNA, 22 bp, Artificial Sequence
  chemically synthesized
cagcccgggcaacagtgcgaga

SEQ ID NO: 853988 - DNA, 22 bp, Artificial Sequence
  chemically synthesized
tttgagatggagtctcgcactg

SEQ ID NO: 853989 - DNA, 22 bp, Artificial Sequence
  chemically synthesized
ttttgagatggagtctcgcact

SEQ ID NO: 853990 - DNA, 22 bp, Artificial Sequence
  chemically synthesized
tttttttgagatggagtctcgc

SEQ ID NO: 853991 - DNA, 22 bp, Artificial Sequence
  chemically synthesized
gtttttttgagatggagtctcg

SEQ ID NO: 853992 - DNA, 22 bp, Artificial Sequence
  chemically synthesized
tgtttttttgagatggagtctc

SEQ ID NO: 853993 - DNA, 22 bp, Artificial Sequence
  chemically synthesized
ttttgtttttttgagatggagt

SEQ ID NO: 853994 - DNA, 22 bp, Artificial Sequence
  chemically synthesized
gttttgtttttttgagatggag

SEQ ID NO: 853995 - DNA, 22 bp, Artificial Sequence
  chemically synthesized
tgttttgtttttttgagatgga

SEQ ID NO: 853996 - DNA, 22 bp, Artificial Sequence
  chemically synthesized
ttgttttgtttttttgagatgg

SEQ ID NO: 853997 - DNA, 22 bp, Artificial Sequence
  chemically synthesized
tttttgttttgtttttttgaga

SEQ ID NO: 853998 - DNA, 22 bp, Artificial Sequence
  chemically synthesized
gtttttgttttgtttttttgag

SEQ ID NO: 853999 - DNA, 22 bp, Artificial Sequence
  chemically synthesized
tgtttttgttttgtttttttga

SEQ ID NO: 854000 - DNA, 22 bp, Artificial Sequence
  chemically synthesized
ttgtttttgttttgtttttttg

SEQ ID NO: 854001 - DNA, 22 bp, Artificial Sequence
  chemically synthesized
tttttgtttttgttttgttttt

SEQ ID NO: 854002 - DNA, 22 bp, Artificial Sequence
  chemically synthesized
gtttttgtttttgttttgtttt

SEQ ID NO: 854003 - DNA, 22 bp, Artificial Sequence
  chemically synthesized
tgtttttgtttttgttttgttt

SEQ ID NO: 854004 - DNA, 22 bp, Artificial Sequence
  chemically synthesized
catctcaaaaaaacaaaacaaa

SEQ ID NO: 854005 - DNA, 22 bp, Artificial Sequence
  chemically synthesized
ttttgtttttgtttttgttttg

SEQ ID NO: 854006 - DNA, 22 bp, Artificial Sequence
  chemically synthesized
gttttgtttttgtttttgtttt

SEQ ID NO: 854007 - DNA, 22 bp, Artificial Sequence
  chemically synthesized
tgttttgtttttgtttttgttt

SEQ ID NO: 854008 - DNA, 22 bp, Artificial Sequence
  chemically synthesized
aaaaaaacaaaacaaaaacaaa

SEQ ID NO: 854009 - DNA, 22 bp, Artificial Sequence
  chemically synthesized
ttttgttttgtttttgtttttg

SEQ ID NO: 854010 - DNA, 22 bp, Artificial Sequence
  chemically synthesized
gttttgttttgtttttgttttt

SEQ ID NO: 854011 - DNA, 22 bp, Artificial Sequence
  chemically synthesized
tgttttgttttgtttttgtttt

SEQ ID NO: 854012 - DNA, 22 bp, Artificial Sequence
  chemically synthesized
ttgttttgttttgtttttgttt

SEQ ID NO: 854013 - DNA, 22 bp, Artificial Sequence
  chemically synthesized
gtcgtttttgttttgttttgtt

SEQ ID NO: 854014 - DNA, 22 bp, Artificial Sequence
  chemically synthesized
cagtatgtactggtcgtttttg

SEQ ID NO: 854015 - DNA, 22 bp, Artificial Sequence
  chemically synthesized
attccagtatgtactggtcgtt

SEQ ID NO: 854016 - DNA, 22 bp, Artificial Sequence
  chemically synthesized
ttaattccagtatgtactggtc

SEQ ID NO: 854017 - DNA, 22 bp, Artificial Sequence
  chemically synthesized
gttaattccagtatgtactggt

SEQ ID NO: 854018 - DNA, 22 bp, Artificial Sequence
  chemically synthesized
tgttaattccagtatgtactgg

SEQ ID NO: 854019 - DNA, 22 bp, Artificial Sequence
  chemically synthesized
ttttgttaattccagtatgtac

SEQ ID NO: 854020 - DNA, 22 bp, Artificial Sequence
  chemically synthesized
taaaggttgttttgttaattcc

SEQ ID NO: 854021 - DNA, 22 bp, Artificial Sequence
  chemically synthesized
tgtaaaggttgttttgttaatt

SEQ ID NO: 854022 - DNA, 22 bp, Artificial Sequence
  chemically synthesized
ctgtaaaggttgttttgttaat

SEQ ID NO: 854023 - DNA, 22 bp, Artificial Sequence
  chemically synthesized
tctgtaaaggttgttttgttaa

SEQ ID NO: 854024 - DNA, 22 bp, Artificial Sequence
  chemically synthesized
ttctgtaaaggttgttttgtta

SEQ ID NO: 854025 - DNA, 22 bp, Artificial Sequence
  chemically synthesized
ccttttctgtaaaggttgtttt

SEQ ID NO: 854026 - DNA, 22 bp, Artificial Sequence
  chemically synthesized
ctgccttttctgtaaaggttgt

SEQ ID NO: 854027 - DNA, 22 bp, Artificial Sequence
  chemically synthesized
gaattaacaaaacaacctttac

SEQ ID NO: 854028 - DNA, 22 bp, Artificial Sequence
  chemically synthesized
ttcctgccttttctgtaaaggt

SEQ ID NO: 854029 - DNA, 22 bp, Artificial Sequence
  chemically synthesized
attcctgccttttctgtaaagg

SEQ ID NO: 854030 - DNA, 22 bp, Artificial Sequence
  chemically synthesized
acaaaacaacctttacagaaaa

SEQ ID NO: 854031 - DNA, 22 bp, Artificial Sequence
  chemically synthesized
agatttattcctgccttttctg

SEQ ID NO: 854032 - DNA, 22 bp, Artificial Sequence
  chemically synthesized
gagatttattcctgccttttct

SEQ ID NO: 854033 - DNA, 22 bp, Artificial Sequence
  chemically synthesized
tgagatttattcctgccttttc

SEQ ID NO: 854034 - DNA, 22 bp, Artificial Sequence
  chemically synthesized
aagcctttgagatttattcctg

SEQ ID NO: 854035 - DNA, 22 bp, Artificial Sequence
  chemically synthesized
tacagaaaaggcaggaataaat

SEQ ID NO: 854036 - DNA, 22 bp, Artificial Sequence
  chemically synthesized
gaagcctttgagatttattcct

SEQ ID NO: 854037 - DNA, 22 bp, Artificial Sequence
  chemically synthesized
acagaaaaggcaggaataaatc

SEQ ID NO: 854038 - DNA, 22 bp, Artificial Sequence
  chemically synthesized
cagaaaaggcaggaataaatct

SEQ ID NO: 854039 - DNA, 22 bp, Artificial Sequence
  chemically synthesized
gtatgtcacagcttgaagcctt

SEQ ID NO: 854040 - DNA, 22 bp, Artificial Sequence
  chemically synthesized
actggtatgtcacagcttgaag

SEQ ID NO: 854041 - DNA, 22 bp, Artificial Sequence
  chemically synthesized
aaaggcttcaagctgtgacata

SEQ ID NO: 854042 - DNA, 22 bp, Artificial Sequence
  chemically synthesized
tatagttgactggtatgtcaca

SEQ ID NO: 854043 - DNA, 22 bp, Artificial Sequence
  chemically synthesized
caagctgtgacataccagtcaa

SEQ ID NO: 854044 - DNA, 22 bp, Artificial Sequence
  chemically synthesized
aagctgtgacataccagtcaac

SEQ ID NO: 854045 - DNA, 22 bp, Artificial Sequence
  chemically synthesized
atataatgattatatagttgac

SEQ ID NO: 854046 - DNA, 22 bp, Artificial Sequence
  chemically synthesized
tgacataccagtcaactatata

SEQ ID NO: 854047 - DNA, 22 bp, Artificial Sequence
  chemically synthesized
attaatataatgattatatagt

SEQ ID NO: 854048 - DNA, 22 bp, Artificial Sequence
  chemically synthesized
aagttgattaatataatgatta

SEQ ID NO: 854049 - DNA, 22 bp, Artificial Sequence
  chemically synthesized
aaagttgattaatataatgatt

SEQ ID NO: 854050 - DNA, 22 bp, Artificial Sequence
  chemically synthesized
cttaaagttgattaatataatg

SEQ ID NO: 854051 - DNA, 22 bp, Artificial Sequence
  chemically synthesized
tataatcattatattaatcaac

SEQ ID NO: 854052 - DNA, 22 bp, Artificial Sequence
  chemically synthesized
acactccttaaagttgattaat

SEQ ID NO: 854053 - DNA, 22 bp, Artificial Sequence
  chemically synthesized
cacactccttaaagttgattaa

SEQ ID NO: 854054 - DNA, 22 bp, Artificial Sequence
  chemically synthesized
ttcacactccttaaagttgatt

SEQ ID NO: 854055 - DNA, 22 bp, Artificial Sequence
  chemically synthesized
cttcacactccttaaagttgat

SEQ ID NO: 854056 - DNA, 22 bp, Artificial Sequence
  chemically synthesized
aggtttcttcacactccttaaa

SEQ ID NO: 854057 - DNA, 22 bp, Artificial Sequence
  chemically synthesized
tattaatcaactttaaggagtg

SEQ ID NO: 854058 - DNA, 22 bp, Artificial Sequence
  chemically synthesized
aaggtttcttcacactccttaa

SEQ ID NO: 854059 - DNA, 22 bp, Artificial Sequence
  chemically synthesized
atcaactttaaggagtgtgaag

SEQ ID NO: 854060 - DNA, 22 bp, Artificial Sequence
  chemically synthesized
taaggagtgtgaagaaacctta

SEQ ID NO: 854061 - DNA, 22 bp, Artificial Sequence
  chemically synthesized
aaggagtgtgaagaaaccttaa

SEQ ID NO: 854062 - DNA, 22 bp, Artificial Sequence
  chemically synthesized
aggagtgtgaagaaaccttaag

SEQ ID NO: 854063 - DNA, 22 bp, Artificial Sequence
  chemically synthesized
accataccaatgacttaaggtt

SEQ ID NO: 854064 - DNA, 22 bp, Artificial Sequence
  chemically synthesized
ttaaccataccaatgacttaag

SEQ ID NO: 854065 - DNA, 22 bp, Artificial Sequence
  chemically synthesized
accaaatccaattattaaccat

SEQ ID NO: 854066 - DNA, 22 bp, Artificial Sequence
  chemically synthesized
aagtcattggtatggttaataa

SEQ ID NO: 854067 - DNA, 22 bp, Artificial Sequence
  chemically synthesized
agtcattggtatggttaataat

SEQ ID NO: 854068 - DNA, 22 bp, Artificial Sequence
  chemically synthesized
tgaccaaatccaattattaacc

SEQ ID NO: 854069 - DNA, 22 bp, Artificial Sequence
  chemically synthesized
gtatggttaataattggatttg

SEQ ID NO: 854070 - DNA, 22 bp, Artificial Sequence
  chemically synthesized
aaggtgtgagttctgaccaaat

SEQ ID NO: 854071 - DNA, 22 bp, Artificial Sequence
  chemically synthesized
ataattggatttggtcagaact

SEQ ID NO: 854072 - DNA, 22 bp, Artificial Sequence
  chemically synthesized
gatttggtcagaactcacacct

SEQ ID NO: 854073 - DNA, 22 bp, Artificial Sequence
  chemically synthesized
ggtcagaactcacaccttgaat

SEQ ID NO: 854074 - DNA, 22 bp, Artificial Sequence
  chemically synthesized
gtcagaactcacaccttgaatg

SEQ ID NO: 854075 - DNA, 22 bp, Artificial Sequence
  chemically synthesized
taggtgaggaccatgcaaacat

SEQ ID NO: 854076 - DNA, 22 bp, Artificial Sequence
  chemically synthesized
gtaggtgaggaccatgcaaaca

SEQ ID NO: 854077 - DNA, 22 bp, Artificial Sequence
  chemically synthesized
tgtaggtgaggaccatgcaaac

SEQ ID NO: 854078 - DNA, 22 bp, Artificial Sequence
  chemically synthesized
acaccttgaatgtttgcatggt

SEQ ID NO: 854079 - DNA, 22 bp, Artificial Sequence
  chemically synthesized
gaaactttgtaggtgaggacca

SEQ ID NO: 854080 - DNA, 22 bp, Artificial Sequence
  chemically synthesized
gaatgtttgcatggtcctcacc

SEQ ID NO: 854081 - DNA, 22 bp, Artificial Sequence
  chemically synthesized
ggaaactttgtaggtgaggacc

SEQ ID NO: 854082 - DNA, 22 bp, Artificial Sequence
  chemically synthesized
aatgtttgcatggtcctcacct

SEQ ID NO: 854083 - DNA, 22 bp, Artificial Sequence
  chemically synthesized
acatttggaaactttgtaggtg

SEQ ID NO: 854084 - DNA, 22 bp, Artificial Sequence
  chemically synthesized
aacatttggaaactttgtaggt

SEQ ID NO: 854085 - DNA, 22 bp, Artificial Sequence
  chemically synthesized
gcatggtcctcacctacaaagt

SEQ ID NO: 854086 - DNA, 22 bp, Artificial Sequence
  chemically synthesized
taacatttggaaactttgtagg

SEQ ID NO: 854087 - DNA, 22 bp, Artificial Sequence
  chemically synthesized
catggtcctcacctacaaagtt

SEQ ID NO: 854088 - DNA, 22 bp, Artificial Sequence
  chemically synthesized
ttttaacatttggaaactttgt

SEQ ID NO: 854089 - DNA, 22 bp, Artificial Sequence
  chemically synthesized
attttaacatttggaaactttg

SEQ ID NO: 854090 - DNA, 22 bp, Artificial Sequence
  chemically synthesized
tattttaacatttggaaacttt

SEQ ID NO: 854091 - DNA, 22 bp, Artificial Sequence
  chemically synthesized
acctacaaagtttccaaatgtt

SEQ ID NO: 854092 - DNA, 22 bp, Artificial Sequence
  chemically synthesized
caaagtttccaaatgttaaaat

SEQ ID NO: 854093 - DNA, 22 bp, Artificial Sequence
  chemically synthesized
ccaaatgttaaaataaaatata

SEQ ID NO: 854094 - DNA, 22 bp, Artificial Sequence
  chemically synthesized
caaatgttaaaataaaatatat

SEQ ID NO: 854095 - DNA, 22 bp, Artificial Sequence
  chemically synthesized
aaataaaatatatcctcatttt

SEQ ID NO: 854096 - DNA, 22 bp, Artificial Sequence
  chemically synthesized
aaataataaataaataaaaatg

SEQ ID NO: 854097 - DNA, 22 bp, Artificial Sequence
  chemically synthesized
atttttatttatttattatttt

SEQ ID NO: 854098 - DNA, 22 bp, Artificial Sequence
  chemically synthesized
ttatttatttattattttagtt

SEQ ID NO: 854099 - DNA, 22 bp, Artificial Sequence
  chemically synthesized
tatttatttattattttagttt

SEQ ID NO: 854100 - DNA, 22 bp, Artificial Sequence
  chemically synthesized
atttatttattattttagtttt

SEQ ID NO: 854101 - DNA, 22 bp, Artificial Sequence
  chemically synthesized
tttatttattattttagtttta

SEQ ID NO: 854102 - DNA, 22 bp, Artificial Sequence
  chemically synthesized
atttattattttagttttatat

SEQ ID NO: 854103 - DNA, 22 bp, Artificial Sequence
  chemically synthesized
aaaaagaataaaatataaaact

SEQ ID NO: 854104 - DNA, 22 bp, Artificial Sequence
  chemically synthesized
tttattattttagttttatatt

SEQ ID NO: 854105 - DNA, 22 bp, Artificial Sequence
  chemically synthesized
taaaaaagaataaaatataaaa

SEQ ID NO: 854106 - DNA, 22 bp, Artificial Sequence
  chemically synthesized
ctaaaaaagaataaaatataaa

SEQ ID NO: 854107 - DNA, 22 bp, Artificial Sequence
  chemically synthesized
attattttagttttatatttta

SEQ ID NO: 854108 - DNA, 22 bp, Artificial Sequence
  chemically synthesized
ttattttagttttatattttat

SEQ ID NO: 854109 - DNA, 22 bp, Artificial Sequence
  chemically synthesized
ttttagttttatattttattct

SEQ ID NO: 854110 - DNA, 22 bp, Artificial Sequence
  chemically synthesized
catttctaaaaaagaataaaat

SEQ ID NO: 854111 - DNA, 22 bp, Artificial Sequence
  chemically synthesized
tagttttatattttattctttt

SEQ ID NO: 854112 - DNA, 22 bp, Artificial Sequence
  chemically synthesized
agttttatattttattcttttt

SEQ ID NO: 854113 - DNA, 22 bp, Artificial Sequence
  chemically synthesized
gttttatattttattctttttt

SEQ ID NO: 854114 - DNA, 22 bp, Artificial Sequence
  chemically synthesized
tatattttattcttttttagaa

SEQ ID NO: 854115 - DNA, 22 bp, Artificial Sequence
  chemically synthesized
atattttattcttttttagaaa

SEQ ID NO: 854116 - DNA, 22 bp, Artificial Sequence
  chemically synthesized
tattttattcttttttagaaat

SEQ ID NO: 854117 - DNA, 22 bp, Artificial Sequence
  chemically synthesized
tattcttttttagaaatggagt

SEQ ID NO: 854118 - DNA, 22 bp, Artificial Sequence
  chemically synthesized
attcttttttagaaatggagtt

SEQ ID NO: 854119 - DNA, 22 bp, Artificial Sequence
  chemically synthesized
ttcttttttagaaatggagttt

SEQ ID NO: 854120 - DNA, 22 bp, Artificial Sequence
  chemically synthesized
ggcaatggaacaaaactccatt

SEQ ID NO: 854121 - DNA, 22 bp, Artificial Sequence
  chemically synthesized
ttttttagaaatggagttttgt

SEQ ID NO: 854122 - DNA, 22 bp, Artificial Sequence
  chemically synthesized
ttttagaaatggagttttgttc

SEQ ID NO: 854123 - DNA, 22 bp, Artificial Sequence
  chemically synthesized
tttagaaatggagttttgttcc

SEQ ID NO: 854124 - DNA, 22 bp, Artificial Sequence
  chemically synthesized
ttagaaatggagttttgttcca

SEQ ID NO: 854125 - DNA, 22 bp, Artificial Sequence
  chemically synthesized
caacctgggcaatggaacaaaa

SEQ ID NO: 854126 - DNA, 22 bp, Artificial Sequence
  chemically synthesized
tagaaatggagttttgttccat

SEQ ID NO: 854127 - DNA, 22 bp, Artificial Sequence
  chemically synthesized
agaaatggagttttgttccatt

SEQ ID NO: 854128 - DNA, 22 bp, Artificial Sequence
  chemically synthesized
gaaatggagttttgttccattg

SEQ ID NO: 854129 - DNA, 22 bp, Artificial Sequence
  chemically synthesized
gattccaacctgggcaatggaa

SEQ ID NO: 854130 - DNA, 22 bp, Artificial Sequence
  chemically synthesized
tgttccattgcccaggttggaa

SEQ ID NO: 854131 - DNA, 22 bp, Artificial Sequence
  chemically synthesized
gttccattgcccaggttggaat

SEQ ID NO: 854132 - DNA, 22 bp, Artificial Sequence
  chemically synthesized
ttccattgcccaggttggaatc

SEQ ID NO: 854133 - DNA, 22 bp, Artificial Sequence
  chemically synthesized
tgatagcgccactggattccaa

SEQ ID NO: 854134 - DNA, 22 bp, Artificial Sequence
  chemically synthesized
cattgcccaggttggaatccag

SEQ ID NO: 854135 - DNA, 22 bp, Artificial Sequence
  chemically synthesized
cccaggttggaatccagtggcg

SEQ ID NO: 854136 - DNA, 22 bp, Artificial Sequence
  chemically synthesized
cagtgagctatgatagcgccac

SEQ ID NO: 854137 - DNA, 22 bp, Artificial Sequence
  chemically synthesized
gaatccagtggcgctatcatag

SEQ ID NO: 854138 - DNA, 22 bp, Artificial Sequence
  chemically synthesized
gaggctgcagtgagctatgata

SEQ ID NO: 854139 - DNA, 22 bp, Artificial Sequence
  chemically synthesized
ggcccaggagttcgaggctgca

SEQ ID NO: 854140 - DNA, 22 bp, Artificial Sequence
  chemically synthesized
tcatagctcactgcagcctcga

SEQ ID NO: 854141 - DNA, 22 bp, Artificial Sequence
  chemically synthesized
gggcccaggagttcgaggctgc

SEQ ID NO: 854142 - DNA, 22 bp, Artificial Sequence
  chemically synthesized
ttgggcccaggagttcgaggct

SEQ ID NO: 854143 - DNA, 22 bp, Artificial Sequence
  chemically synthesized
actgcagcctcgaactcctggg

SEQ ID NO: 854144 - DNA, 22 bp, Artificial Sequence
  chemically synthesized
cagcctcgaactcctgggccca

SEQ ID NO: 854145 - DNA, 22 bp, Artificial Sequence
  chemically synthesized
aggtgacatgatctcttgggcc

SEQ ID NO: 854146 - DNA, 22 bp, Artificial Sequence
  chemically synthesized
gaactcctgggcccaagagatc

SEQ ID NO: 854147 - DNA, 22 bp, Artificial Sequence
  chemically synthesized
ctgggcccaagagatcatgtca

SEQ ID NO: 854148 - DNA, 22 bp, Artificial Sequence
  chemically synthesized
aggaggctgaggtgacatgatc

SEQ ID NO: 854149 - DNA, 22 bp, Artificial Sequence
  chemically synthesized
ggcccaagagatcatgtcacct

SEQ ID NO: 854150 - DNA, 22 bp, Artificial Sequence
  chemically synthesized
ctcaggaggctgaggtgacatg

SEQ ID NO: 854151 - DNA, 22 bp, Artificial Sequence
  chemically synthesized
gctactcaggaggctgaggtga

SEQ ID NO: 854152 - DNA, 22 bp, Artificial Sequence
  chemically synthesized
agctactcaggaggctgaggtg

SEQ ID NO: 854153 - DNA, 22 bp, Artificial Sequence
  chemically synthesized
tagccttagctactcaggaggc

SEQ ID NO: 854154 - DNA, 22 bp, Artificial Sequence
  chemically synthesized
gtagccttagctactcaggagg

SEQ ID NO: 854155 - DNA, 22 bp, Artificial Sequence
  chemically synthesized
agcctcctgagtagctaaggct

SEQ ID NO: 854156 - DNA, 22 bp, Artificial Sequence
  chemically synthesized
tgatggtgtgggcttgtagcct

SEQ ID NO: 854157 - DNA, 22 bp, Artificial Sequence
  chemically synthesized
ctgagtagctaaggctacaagc

SEQ ID NO: 854158 - DNA, 22 bp, Artificial Sequence
  chemically synthesized
agtagctaaggctacaagccca

SEQ ID NO: 854159 - DNA, 22 bp, Artificial Sequence
  chemically synthesized
gctgtgatggtgtgggcttgta

SEQ ID NO: 854160 - DNA, 22 bp, Artificial Sequence
  chemically synthesized
gctggctgtgatggtgtgggct

SEQ ID NO: 854161 - DNA, 22 bp, Artificial Sequence
  chemically synthesized
aggctacaagcccacaccatca

SEQ ID NO: 854162 - DNA, 22 bp, Artificial Sequence
  chemically synthesized
caagcccacaccatcacagcca

SEQ ID NO: 854163 - DNA, 22 bp, Artificial Sequence
  chemically synthesized
caaaaaaatgaaataaaaagtt

SEQ ID NO: 854164 - DNA, 22 bp, Artificial Sequence
  chemically synthesized
tacaaaaaaatgaaataaaaag

SEQ ID NO: 854165 - DNA, 22 bp, Artificial Sequence
  chemically synthesized
atctctacaaaaaaatgaaata

SEQ ID NO: 854166 - DNA, 22 bp, Artificial Sequence
  chemically synthesized
catctctacaaaaaaatgaaat

SEQ ID NO: 854167 - DNA, 22 bp, Artificial Sequence
  chemically synthesized
actttttatttcatttttttgt

SEQ ID NO: 854168 - DNA, 22 bp, Artificial Sequence
  chemically synthesized
tttatttcatttttttgtagag

SEQ ID NO: 854169 - DNA, 22 bp, Artificial Sequence
  chemically synthesized
ttatttcatttttttgtagaga

SEQ ID NO: 854170 - DNA, 22 bp, Artificial Sequence
  chemically synthesized
tatttcatttttttgtagagat

SEQ ID NO: 854171 - DNA, 22 bp, Artificial Sequence
  chemically synthesized
atttcatttttttgtagagatg

SEQ ID NO: 854172 - DNA, 22 bp, Artificial Sequence
  chemically synthesized
tttcatttttttgtagagatga

SEQ ID NO: 854173 - DNA, 22 bp, Artificial Sequence
  chemically synthesized
catttttttgtagagatgaagt

SEQ ID NO: 854174 - DNA, 22 bp, Artificial Sequence
  chemically synthesized
atttttttgtagagatgaagtc

SEQ ID NO: 854175 - DNA, 22 bp, Artificial Sequence
  chemically synthesized
ggcaacagagtgagacttcatc

SEQ ID NO: 854176 - DNA, 22 bp, Artificial Sequence
  chemically synthesized
ttttgtagagatgaagtctcac

SEQ ID NO: 854177 - DNA, 22 bp, Artificial Sequence
  chemically synthesized
tttgtagagatgaagtctcact

SEQ ID NO: 854178 - DNA, 22 bp, Artificial Sequence
  chemically synthesized
ttgtagagatgaagtctcactc

SEQ ID NO: 854179 - DNA, 22 bp, Artificial Sequence
  chemically synthesized
tgtagagatgaagtctcactct

SEQ ID NO: 854180 - DNA, 22 bp, Artificial Sequence
  chemically synthesized
gtagagatgaagtctcactctg

SEQ ID NO: 854181 - DNA, 22 bp, Artificial Sequence
  chemically synthesized
tagagatgaagtctcactctgt

SEQ ID NO: 854182 - DNA, 22 bp, Artificial Sequence
  chemically synthesized
aagagcaacctgggcaacagag

SEQ ID NO: 854183 - DNA, 22 bp, Artificial Sequence
  chemically synthesized
actctgttgcccaggttgctct

SEQ ID NO: 854184 - DNA, 22 bp, Artificial Sequence
  chemically synthesized
aggccagaagttcaagagcaac

SEQ ID NO: 854185 - DNA, 22 bp, Artificial Sequence
  chemically synthesized
gaggccagaagttcaagagcaa

SEQ ID NO: 854186 - DNA, 22 bp, Artificial Sequence
  chemically synthesized
tgttgcccaggttgctcttgaa

SEQ ID NO: 854187 - DNA, 22 bp, Artificial Sequence
  chemically synthesized
ttgcccaggttgctcttgaact

SEQ ID NO: 854188 - DNA, 22 bp, Artificial Sequence
  chemically synthesized
cccaggttgctcttgaacttct

SEQ ID NO: 854189 - DNA, 22 bp, Artificial Sequence
  chemically synthesized
ctcttgaacttctggcctcaag

SEQ ID NO: 854190 - DNA, 22 bp, Artificial Sequence
  chemically synthesized
ttgaacttctggcctcaaggga

SEQ ID NO: 854191 - DNA, 22 bp, Artificial Sequence
  chemically synthesized
gaacttctggcctcaagggatc

SEQ ID NO: 854192 - DNA, 22 bp, Artificial Sequence
  chemically synthesized
aacttctggcctcaagggatcc

SEQ ID NO: 854193 - DNA, 22 bp, Artificial Sequence
  chemically synthesized
ctggcctcaagggatcctccat

SEQ ID NO: 854194 - DNA, 22 bp, Artificial Sequence
  chemically synthesized
tggcctcaagggatcctccatc

SEQ ID NO: 854195 - DNA, 22 bp, Artificial Sequence
  chemically synthesized
gcctcaagggatcctccatcct

SEQ ID NO: 854196 - DNA, 22 bp, Artificial Sequence
  chemically synthesized
taatatcagtgccaggatggag

SEQ ID NO: 854197 - DNA, 22 bp, Artificial Sequence
  chemically synthesized
gtaatatcagtgccaggatgga

SEQ ID NO: 854198 - DNA, 22 bp, Artificial Sequence
  chemically synthesized
aagggatcctccatcctggcac

SEQ ID NO: 854199 - DNA, 22 bp, Artificial Sequence
  chemically synthesized
acacttgtaatatcagtgccag

SEQ ID NO: 854200 - DNA, 22 bp, Artificial Sequence
  chemically synthesized
catcctggcactgatattacaa

SEQ ID NO: 854201 - DNA, 22 bp, Artificial Sequence
  chemically synthesized
gcactgatattacaagtgtgag

SEQ ID NO: 854202 - DNA, 22 bp, Artificial Sequence
  chemically synthesized
atattacaagtgtgagccattg

SEQ ID NO: 854203 - DNA, 22 bp, Artificial Sequence
  chemically synthesized
caagtgtgagccattgtgtctg

SEQ ID NO: 854204 - DNA, 22 bp, Artificial Sequence
  chemically synthesized
aatgaaaatgaggacgggtcca

SEQ ID NO: 854205 - DNA, 22 bp, Artificial Sequence
  chemically synthesized
taaatgaaaatgaggacgggtc

SEQ ID NO: 854206 - DNA, 22 bp, Artificial Sequence
  chemically synthesized
ctaaatgaaaatgaggacgggt

SEQ ID NO: 854207 - DNA, 22 bp, Artificial Sequence
  chemically synthesized
tctaaatgaaaatgaggacggg

SEQ ID NO: 854208 - DNA, 22 bp, Artificial Sequence
  chemically synthesized
ttttctaaatgaaaatgaggac

SEQ ID NO: 854209 - DNA, 22 bp, Artificial Sequence
  chemically synthesized
tgtctggacccgtcctcatttt

SEQ ID NO: 854210 - DNA, 22 bp, Artificial Sequence
  chemically synthesized
gacccgtcctcattttcattta

SEQ ID NO: 854211 - DNA, 22 bp, Artificial Sequence
  chemically synthesized
cagtacaattgttttctaaatg

SEQ ID NO: 854212 - DNA, 22 bp, Artificial Sequence
  chemically synthesized
acagtacaattgttttctaaat

SEQ ID NO: 854213 - DNA, 22 bp, Artificial Sequence
  chemically synthesized
tacagtacaattgttttctaaa

SEQ ID NO: 854214 - DNA, 22 bp, Artificial Sequence
  chemically synthesized
attttcatttagaaaacaattg

SEQ ID NO: 854215 - DNA, 22 bp, Artificial Sequence
  chemically synthesized
tcatttagaaaacaattgtact

SEQ ID NO: 854216 - DNA, 22 bp, Artificial Sequence
  chemically synthesized
catttagaaaacaattgtactg

SEQ ID NO: 854217 - DNA, 22 bp, Artificial Sequence
  chemically synthesized
atttagaaaacaattgtactgt

SEQ ID NO: 854218 - DNA, 22 bp, Artificial Sequence
  chemically synthesized
agaaaacaattgtactgtaaaa

SEQ ID NO: 854219 - DNA, 22 bp, Artificial Sequence
  chemically synthesized
tatataatgagattttacagta

SEQ ID NO: 854220 - DNA, 22 bp, Artificial Sequence
  chemically synthesized
gaaaacaattgtactgtaaaat

SEQ ID NO: 854221 - DNA, 22 bp, Artificial Sequence
  chemically synthesized
tactgtaaaatctcattatata

SEQ ID NO: 854222 - DNA, 22 bp, Artificial Sequence
  chemically synthesized
taaaatctcattatatatagct

SEQ ID NO: 854223 - DNA, 22 bp, Artificial Sequence
  chemically synthesized
attatatatagcttcttgcctg

SEQ ID NO: 854224 - DNA, 22 bp, Artificial Sequence
  chemically synthesized
gaaagaatgcaagcaggcaaga

SEQ ID NO: 854225 - DNA, 22 bp, Artificial Sequence
  chemically synthesized
tatatagcttcttgcctgcttg

SEQ ID NO: 854226 - DNA, 22 bp, Artificial Sequence
  chemically synthesized
cttgcctgcttgcattctttcc

SEQ ID NO: 854227 - DNA, 22 bp, Artificial Sequence
  chemically synthesized
ttgcctgcttgcattctttcca

SEQ ID NO: 854228 - DNA, 22 bp, Artificial Sequence
  chemically synthesized
gcctgcttgcattctttccaac

SEQ ID NO: 854229 - DNA, 22 bp, Artificial Sequence
  chemically synthesized
cctgcttgcattctttccaact

SEQ ID NO: 854230 - DNA, 22 bp, Artificial Sequence
  chemically synthesized
ggggcaaagatcagtagttgga

SEQ ID NO: 854231 - DNA, 22 bp, Artificial Sequence
  chemically synthesized
cttgcattctttccaactactg

SEQ ID NO: 854232 - DNA, 22 bp, Artificial Sequence
  chemically synthesized
ctgggggcaaagatcagtagtt

SEQ ID NO: 854233 - DNA, 22 bp, Artificial Sequence
  chemically synthesized
gcattctttccaactactgatc

SEQ ID NO: 854234 - DNA, 22 bp, Artificial Sequence
  chemically synthesized
actgggggcaaagatcagtagt

SEQ ID NO: 854235 - DNA, 22 bp, Artificial Sequence
  chemically synthesized
cattctttccaactactgatct

SEQ ID NO: 854236 - DNA, 22 bp, Artificial Sequence
  chemically synthesized
tttccaactactgatctttgcc

SEQ ID NO: 854237 - DNA, 22 bp, Artificial Sequence
  chemically synthesized
tccaactactgatctttgcccc

SEQ ID NO: 854238 - DNA, 22 bp, Artificial Sequence
  chemically synthesized
ccaactactgatctttgccccc

SEQ ID NO: 854239 - DNA, 22 bp, Artificial Sequence
  chemically synthesized
caactactgatctttgccccca

SEQ ID NO: 854240 - DNA, 22 bp, Artificial Sequence
  chemically synthesized
gaagaggacatttactgggggc

SEQ ID NO: 854241 - DNA, 22 bp, Artificial Sequence
  chemically synthesized
ctgatctttgcccccagtaaat

SEQ ID NO: 854242 - DNA, 22 bp, Artificial Sequence
  chemically synthesized
atctttgcccccagtaaatgtc

SEQ ID NO: 854243 - DNA, 22 bp, Artificial Sequence
  chemically synthesized
ggcactagaagaggacatttac

SEQ ID NO: 854244 - DNA, 22 bp, Artificial Sequence
  chemically synthesized
tgcccccagtaaatgtcctctt

SEQ ID NO: 854245 - DNA, 22 bp, Artificial Sequence
  chemically synthesized
gcccccagtaaatgtcctcttc

SEQ ID NO: 854246 - DNA, 22 bp, Artificial Sequence
  chemically synthesized
cccccagtaaatgtcctcttct

SEQ ID NO: 854247 - DNA, 22 bp, Artificial Sequence
  chemically synthesized
tgtaatagatgttaggcactag

SEQ ID NO: 854248 - DNA, 22 bp, Artificial Sequence
  chemically synthesized
agttatgtaatagatgttaggc

SEQ ID NO: 854249 - DNA, 22 bp, Artificial Sequence
  chemically synthesized
aagttatgtaatagatgttagg

SEQ ID NO: 854250 - DNA, 22 bp, Artificial Sequence
  chemically synthesized
taagttatgtaatagatgttag

SEQ ID NO: 854251 - DNA, 22 bp, Artificial Sequence
  chemically synthesized
ttaagttatgtaatagatgtta

SEQ ID NO: 854252 - DNA, 22 bp, Artificial Sequence
  chemically synthesized
tttaagttatgtaatagatgtt

SEQ ID NO: 854253 - DNA, 22 bp, Artificial Sequence
  chemically synthesized
ttctagtgcctaacatctatta

SEQ ID NO: 854254 - DNA, 22 bp, Artificial Sequence
  chemically synthesized
ttttaagttatgtaatagatgt

SEQ ID NO: 854255 - DNA, 22 bp, Artificial Sequence
  chemically synthesized
ctagtgcctaacatctattaca

SEQ ID NO: 854256 - DNA, 22 bp, Artificial Sequence
  chemically synthesized
tagtgcctaacatctattacat

SEQ ID NO: 854257 - DNA, 22 bp, Artificial Sequence
  chemically synthesized
atttttttaagttatgtaatag

SEQ ID NO: 854258 - DNA, 22 bp, Artificial Sequence
  chemically synthesized
gtgcctaacatctattacataa

SEQ ID NO: 854259 - DNA, 22 bp, Artificial Sequence
  chemically synthesized
gatttttttaagttatgtaata

SEQ ID NO: 854260 - DNA, 22 bp, Artificial Sequence
  chemically synthesized
aagtttgatttttttaagttat

SEQ ID NO: 854261 - DNA, 22 bp, Artificial Sequence
  chemically synthesized
acatctattacataacttaaaa

SEQ ID NO: 854262 - DNA, 22 bp, Artificial Sequence
  chemically synthesized
ctcaagtttgatttttttaagt

SEQ ID NO: 854263 - DNA, 22 bp, Artificial Sequence
  chemically synthesized
actcaagtttgatttttttaag

SEQ ID NO: 854264 - DNA, 22 bp, Artificial Sequence
  chemically synthesized
ttacataacttaaaaaaatcaa

SEQ ID NO: 854265 - DNA, 22 bp, Artificial Sequence
  chemically synthesized
cataacttaaaaaaatcaaact

SEQ ID NO: 854266 - DNA, 22 bp, Artificial Sequence
  chemically synthesized
ccacacttactcaagtttgatt

SEQ ID NO: 854267 - DNA, 22 bp, Artificial Sequence
  chemically synthesized
accacacttactcaagtttgat

SEQ ID NO: 854268 - DNA, 22 bp, Artificial Sequence
  chemically synthesized
taccacacttactcaagtttga

SEQ ID NO: 854269 - DNA, 22 bp, Artificial Sequence
  chemically synthesized
aaaaaaatcaaacttgagtaag

SEQ ID NO: 854270 - DNA, 22 bp, Artificial Sequence
  chemically synthesized
aaaaaatcaaacttgagtaagt

SEQ ID NO: 854271 - DNA, 22 bp, Artificial Sequence
  chemically synthesized
ccactttaccacacttactcaa

SEQ ID NO: 854272 - DNA, 22 bp, Artificial Sequence
  chemically synthesized
gcctgccactttaccacactta

SEQ ID NO: 854273 - DNA, 22 bp, Artificial Sequence
  chemically synthesized
gagtaagtgtggtaaagtggca

SEQ ID NO: 854274 - DNA, 22 bp, Artificial Sequence
  chemically synthesized
agtaagtgtggtaaagtggcag

SEQ ID NO: 854275 - DNA, 22 bp, Artificial Sequence
  chemically synthesized
cataaaaattagcctgccactt

SEQ ID NO: 854276 - DNA, 22 bp, Artificial Sequence
  chemically synthesized
tacataaaaattagcctgccac

SEQ ID NO: 854277 - DNA, 22 bp, Artificial Sequence
  chemically synthesized
agaaattctacataaaaattag

SEQ ID NO: 854278 - DNA, 22 bp, Artificial Sequence
  chemically synthesized
tgagaaattctacataaaaatt

SEQ ID NO: 854279 - DNA, 22 bp, Artificial Sequence
  chemically synthesized
atttttatgtagaatttctcag

SEQ ID NO: 854280 - DNA, 22 bp, Artificial Sequence
  chemically synthesized
ttatgtagaatttctcagaggg

SEQ ID NO: 854281 - DNA, 22 bp, Artificial Sequence
  chemically synthesized
tatgtagaatttctcagagggg

SEQ ID NO: 854282 - DNA, 22 bp, Artificial Sequence
  chemically synthesized
atgtagaatttctcagagggga

SEQ ID NO: 854283 - DNA, 22 bp, Artificial Sequence
  chemically synthesized
tgtagaatttctcagaggggac

SEQ ID NO: 854284 - DNA, 22 bp, Artificial Sequence
  chemically synthesized
cacagatagaatcagaagtccc

SEQ ID NO: 854285 - DNA, 22 bp, Artificial Sequence
  chemically synthesized
ccacagatagaatcagaagtcc

SEQ ID NO: 854286 - DNA, 22 bp, Artificial Sequence
  chemically synthesized
ctcagaggggacttctgattct

SEQ ID NO: 854287 - DNA, 22 bp, Artificial Sequence
  chemically synthesized
tcagaggggacttctgattcta

SEQ ID NO: 854288 - DNA, 22 bp, Artificial Sequence
  chemically synthesized
agaggggacttctgattctatc

SEQ ID NO: 854289 - DNA, 22 bp, Artificial Sequence
  chemically synthesized
ctgattctatctgtggaagcat

SEQ ID NO: 854290 - DNA, 22 bp, Artificial Sequence
  chemically synthesized
tgattctatctgtggaagcatt

SEQ ID NO: 854291 - DNA, 22 bp, Artificial Sequence
  chemically synthesized
attctatctgtggaagcatttc

SEQ ID NO: 854292 - DNA, 22 bp, Artificial Sequence
  chemically synthesized
tacgaaagtaatgaaatgcttc

SEQ ID NO: 854293 - DNA, 22 bp, Artificial Sequence
  chemically synthesized
tatctgtggaagcatttcatta

SEQ ID NO: 854294 - DNA, 22 bp, Artificial Sequence
  chemically synthesized
tattatacgaaagtaatgaaat

SEQ ID NO: 854295 - DNA, 22 bp, Artificial Sequence
  chemically synthesized
tctgtggaagcatttcattact

SEQ ID NO: 854296 - DNA, 22 bp, Artificial Sequence
  chemically synthesized
tggaagcatttcattactttcg

SEQ ID NO: 854297 - DNA, 22 bp, Artificial Sequence
  chemically synthesized
tcatgttatattatacgaaagt

SEQ ID NO: 854298 - DNA, 22 bp, Artificial Sequence
  chemically synthesized
tgtcatgttatattatacgaaa

SEQ ID NO: 854299 - DNA, 22 bp, Artificial Sequence
  chemically synthesized
ctgtcatgttatattatacgaa

SEQ ID NO: 854300 - DNA, 22 bp, Artificial Sequence
  chemically synthesized
tctgtcatgttatattatacga

SEQ ID NO: 854301 - DNA, 22 bp, Artificial Sequence
  chemically synthesized
cattactttcgtataatataac

SEQ ID NO: 854302 - DNA, 22 bp, Artificial Sequence
  chemically synthesized
attactttcgtataatataaca

SEQ ID NO: 854303 - DNA, 22 bp, Artificial Sequence
  chemically synthesized
agctttctgtcatgttatatta

SEQ ID NO: 854304 - DNA, 22 bp, Artificial Sequence
  chemically synthesized
ctttcgtataatataacatgac

SEQ ID NO: 854305 - DNA, 22 bp, Artificial Sequence
  chemically synthesized
aggctaagctttctgtcatgtt

SEQ ID NO: 854306 - DNA, 22 bp, Artificial Sequence
  chemically synthesized
tcgtataatataacatgacaga

SEQ ID NO: 854307 - DNA, 22 bp, Artificial Sequence
  chemically synthesized
cgtataatataacatgacagaa

SEQ ID NO: 854308 - DNA, 22 bp, Artificial Sequence
  chemically synthesized
gtataatataacatgacagaaa

SEQ ID NO: 854309 - DNA, 22 bp, Artificial Sequence
  chemically synthesized
attgaggctaagctttctgtca

SEQ ID NO: 854310 - DNA, 22 bp, Artificial Sequence
  chemically synthesized
cattgaggctaagctttctgtc

SEQ ID NO: 854311 - DNA, 22 bp, Artificial Sequence
  chemically synthesized
tagcaacttcattgaggctaag

SEQ ID NO: 854312 - DNA, 22 bp, Artificial Sequence
  chemically synthesized
agcctcaatgaagttgctacag

SEQ ID NO: 854313 - DNA, 22 bp, Artificial Sequence
  chemically synthesized
gcctcaatgaagttgctacagg

SEQ ID NO: 854314 - DNA, 22 bp, Artificial Sequence
  chemically synthesized
aatgaagttgctacaggttatt

SEQ ID NO: 854315 - DNA, 22 bp, Artificial Sequence
  chemically synthesized
tagtgagagggaaaataacctg

SEQ ID NO: 854316 - DNA, 22 bp, Artificial Sequence
  chemically synthesized
ctacaggttattttccctctca

SEQ ID NO: 854317 - DNA, 22 bp, Artificial Sequence
  chemically synthesized
caggttattttccctctcacta

SEQ ID NO: 854318 - DNA, 22 bp, Artificial Sequence
  chemically synthesized
ttttccctctcactacaatcta

SEQ ID NO: 854319 - DNA, 22 bp, Artificial Sequence
  chemically synthesized
aatgtgaaagaagtagattgta

SEQ ID NO: 854320 - DNA, 22 bp, Artificial Sequence
  chemically synthesized
tccctctcactacaatctactt

SEQ ID NO: 854321 - DNA, 22 bp, Artificial Sequence
  chemically synthesized
ccctctcactacaatctacttc

SEQ ID NO: 854322 - DNA, 22 bp, Artificial Sequence
  chemically synthesized
cctctcactacaatctacttct

SEQ ID NO: 854323 - DNA, 22 bp, Artificial Sequence
  chemically synthesized
cctaaatgtgaaagaagtagat

SEQ ID NO: 854324 - DNA, 22 bp, Artificial Sequence
  chemically synthesized
ccctaaatgtgaaagaagtaga

SEQ ID NO: 854325 - DNA, 22 bp, Artificial Sequence
  chemically synthesized
tccctaaatgtgaaagaagtag

SEQ ID NO: 854326 - DNA, 22 bp, Artificial Sequence
  chemically synthesized
ttccctaaatgtgaaagaagta

SEQ ID NO: 854327 - DNA, 22 bp, Artificial Sequence
  chemically synthesized
tcactacaatctacttctttca

SEQ ID NO: 854328 - DNA, 22 bp, Artificial Sequence
  chemically synthesized
tttccctaaatgtgaaagaagt

SEQ ID NO: 854329 - DNA, 22 bp, Artificial Sequence
  chemically synthesized
actacaatctacttctttcaca

SEQ ID NO: 854330 - DNA, 22 bp, Artificial Sequence
  chemically synthesized
caatctacttctttcacattta

SEQ ID NO: 854331 - DNA, 22 bp, Artificial Sequence
  chemically synthesized
atcccatattttttccctaaat

SEQ ID NO: 854332 - DNA, 22 bp, Artificial Sequence
  chemically synthesized
aatcccatattttttccctaaa

SEQ ID NO: 854333 - DNA, 22 bp, Artificial Sequence
  chemically synthesized
cttctttcacatttagggaaaa

SEQ ID NO: 854334 - DNA, 22 bp, Artificial Sequence
  chemically synthesized
ttaatcccatattttttcccta

SEQ ID NO: 854335 - DNA, 22 bp, Artificial Sequence
  chemically synthesized
ctttcacatttagggaaaaaat

SEQ ID NO: 854336 - DNA, 22 bp, Artificial Sequence
  chemically synthesized
tttcacatttagggaaaaaata

SEQ ID NO: 854337 - DNA, 22 bp, Artificial Sequence
  chemically synthesized
ctcttaatcccatattttttcc

SEQ ID NO: 854338 - DNA, 22 bp, Artificial Sequence
  chemically synthesized
actcttaatcccatattttttc

SEQ ID NO: 854339 - DNA, 22 bp, Artificial Sequence
  chemically synthesized
tcacatttagggaaaaaatatg

SEQ ID NO: 854340 - DNA, 22 bp, Artificial Sequence
  chemically synthesized
cacatttagggaaaaaatatgg

SEQ ID NO: 854341 - DNA, 22 bp, Artificial Sequence
  chemically synthesized
acatttagggaaaaaatatggg

SEQ ID NO: 854342 - DNA, 22 bp, Artificial Sequence
  chemically synthesized
agggaaaaaatatgggattaag

SEQ ID NO: 854343 - DNA, 22 bp, Artificial Sequence
  chemically synthesized
gggaaaaaatatgggattaaga

SEQ ID NO: 854344 - DNA, 22 bp, Artificial Sequence
  chemically synthesized
gagagagtaatttactcttaat

SEQ ID NO: 854345 - DNA, 22 bp, Artificial Sequence
  chemically synthesized
ggagagagtaatttactcttaa

SEQ ID NO: 854346 - DNA, 22 bp, Artificial Sequence
  chemically synthesized
agagtaaattactctctccaaa

SEQ ID NO: 854347 - DNA, 22 bp, Artificial Sequence
  chemically synthesized
ctctctccaaattactctctcc

SEQ ID NO: 854348 - DNA, 22 bp, Artificial Sequence
  chemically synthesized
agaaagtggagaggagagagta

SEQ ID NO: 854349 - DNA, 22 bp, Artificial Sequence
  chemically synthesized
aagaaagtggagaggagagagt

SEQ ID NO: 854350 - DNA, 22 bp, Artificial Sequence
  chemically synthesized
tctccaaattactctctcctct

SEQ ID NO: 854351 - DNA, 22 bp, Artificial Sequence
  chemically synthesized
tccaaattactctctcctctcc

SEQ ID NO: 854352 - DNA, 22 bp, Artificial Sequence
  chemically synthesized
tacttaagaaagtggagaggag

SEQ ID NO: 854353 - DNA, 22 bp, Artificial Sequence
  chemically synthesized
caaattactctctcctctccac

SEQ ID NO: 854354 - DNA, 22 bp, Artificial Sequence
  chemically synthesized
tatacttaagaaagtggagagg

SEQ ID NO: 854355 - DNA, 22 bp, Artificial Sequence
  chemically synthesized
attctatacttaagaaagtgga

SEQ ID NO: 854356 - DNA, 22 bp, Artificial Sequence
  chemically synthesized
ctctctcctctccactttctta

SEQ ID NO: 854357 - DNA, 22 bp, Artificial Sequence
  chemically synthesized
tctcctctccactttcttaagt

SEQ ID NO: 854358 - DNA, 22 bp, Artificial Sequence
  chemically synthesized
agttgattctatacttaagaaa

SEQ ID NO: 854359 - DNA, 22 bp, Artificial Sequence
  chemically synthesized
tcctctccactttcttaagtat

SEQ ID NO: 854360 - DNA, 22 bp, Artificial Sequence
  chemically synthesized
ctctccactttcttaagtatag

SEQ ID NO: 854361 - DNA, 22 bp, Artificial Sequence
  chemically synthesized
tccactttcttaagtatagaat

SEQ ID NO: 854362 - DNA, 22 bp, Artificial Sequence
  chemically synthesized
cactttcttaagtatagaatca

SEQ ID NO: 854363 - DNA, 22 bp, Artificial Sequence
  chemically synthesized
tcttaagtatagaatcaactca

SEQ ID NO: 854364 - DNA, 22 bp, Artificial Sequence
  chemically synthesized
cttaagtatagaatcaactcaa

SEQ ID NO: 854365 - DNA, 22 bp, Artificial Sequence
  chemically synthesized
ttaagtatagaatcaactcaat

SEQ ID NO: 854366 - DNA, 22 bp, Artificial Sequence
  chemically synthesized
aagtatagaatcaactcaattt

SEQ ID NO: 854367 - DNA, 22 bp, Artificial Sequence
  chemically synthesized
agtatagaatcaactcaattta

SEQ ID NO: 854368 - DNA, 22 bp, Artificial Sequence
  chemically synthesized
ccaaaagcatatagataaattg

SEQ ID NO: 854369 - DNA, 22 bp, Artificial Sequence
  chemically synthesized
gccaaaagcatatagataaatt

SEQ ID NO: 854370 - DNA, 22 bp, Artificial Sequence
  chemically synthesized
tgccaaaagcatatagataaat

SEQ ID NO: 854371 - DNA, 22 bp, Artificial Sequence
  chemically synthesized
ttgccaaaagcatatagataaa

SEQ ID NO: 854372 - DNA, 22 bp, Artificial Sequence
  chemically synthesized
aatttatctatatgcttttggc

SEQ ID NO: 854373 - DNA, 22 bp, Artificial Sequence
  chemically synthesized
atctatatgcttttggcaaaaa

SEQ ID NO: 854374 - DNA, 22 bp, Artificial Sequence
  chemically synthesized
tctatatgcttttggcaaaaat

SEQ ID NO: 854375 - DNA, 22 bp, Artificial Sequence
  chemically synthesized
aatccatgaagacgatttttgc

SEQ ID NO: 854376 - DNA, 22 bp, Artificial Sequence
  chemically synthesized
tatgcttttggcaaaaatcgtc

SEQ ID NO: 854377 - DNA, 22 bp, Artificial Sequence
  chemically synthesized
ttggcaaaaatcgtcttcatgg

SEQ ID NO: 854378 - DNA, 22 bp, Artificial Sequence
  chemically synthesized
tggcaaaaatcgtcttcatgga

SEQ ID NO: 854379 - DNA, 22 bp, Artificial Sequence
  chemically synthesized
aaaaaaattaaatccatgaaga

SEQ ID NO: 854380 - DNA, 22 bp, Artificial Sequence
  chemically synthesized
ggcaaaaatcgtcttcatggat

SEQ ID NO: 854381 - DNA, 22 bp, Artificial Sequence
  chemically synthesized
gcaaaaatcgtcttcatggatt

SEQ ID NO: 854382 - DNA, 22 bp, Artificial Sequence
  chemically synthesized
gaaattaaaaaaaattaaatcc

SEQ ID NO: 854383 - DNA, 22 bp, Artificial Sequence
  chemically synthesized
aaactagaaattaaaaaaaatt

SEQ ID NO: 854384 - DNA, 22 bp, Artificial Sequence
  chemically synthesized
catggatttaattttttttaat

SEQ ID NO: 854385 - DNA, 22 bp, Artificial Sequence
  chemically synthesized
atggatttaattttttttaatt

SEQ ID NO: 854386 - DNA, 22 bp, Artificial Sequence
  chemically synthesized
aacactcaaactagaaattaaa

SEQ ID NO: 854387 - DNA, 22 bp, Artificial Sequence
  chemically synthesized
gaacactcaaactagaaattaa

SEQ ID NO: 854388 - DNA, 22 bp, Artificial Sequence
  chemically synthesized
tgaacactcaaactagaaatta

SEQ ID NO: 854389 - DNA, 22 bp, Artificial Sequence
  chemically synthesized
ttgaacactcaaactagaaatt

SEQ ID NO: 854390 - DNA, 22 bp, Artificial Sequence
  chemically synthesized
aattttttttaatttctagttt

SEQ ID NO: 854391 - DNA, 22 bp, Artificial Sequence
  chemically synthesized
attttttttaatttctagtttg

SEQ ID NO: 854392 - DNA, 22 bp, Artificial Sequence
  chemically synthesized
tttttgaacactcaaactagaa

SEQ ID NO: 854393 - DNA, 22 bp, Artificial Sequence
  chemically synthesized
tttttaatttctagtttgagtg

SEQ ID NO: 854394 - DNA, 22 bp, Artificial Sequence
  chemically synthesized
ttttaatttctagtttgagtgt

SEQ ID NO: 854395 - DNA, 22 bp, Artificial Sequence
  chemically synthesized
tttaatttctagtttgagtgtt

SEQ ID NO: 854396 - DNA, 22 bp, Artificial Sequence
  chemically synthesized
ttaatttctagtttgagtgttc

SEQ ID NO: 854397 - DNA, 22 bp, Artificial Sequence
  chemically synthesized
taatttctagtttgagtgttca

SEQ ID NO: 854398 - DNA, 22 bp, Artificial Sequence
  chemically synthesized
cagaattatttttgaacactca

SEQ ID NO: 854399 - DNA, 22 bp, Artificial Sequence
  chemically synthesized
aatttctagtttgagtgttcaa

SEQ ID NO: 854400 - DNA, 22 bp, Artificial Sequence
  chemically synthesized
atttctagtttgagtgttcaaa

SEQ ID NO: 854401 - DNA, 22 bp, Artificial Sequence
  chemically synthesized
aactccagaattatttttgaac

SEQ ID NO: 854402 - DNA, 22 bp, Artificial Sequence
  chemically synthesized
ctagtttgagtgttcaaaaata

SEQ ID NO: 854403 - DNA, 22 bp, Artificial Sequence
  chemically synthesized
tagtttgagtgttcaaaaataa

SEQ ID NO: 854404 - DNA, 22 bp, Artificial Sequence
  chemically synthesized
gtttgagtgttcaaaaataatt

SEQ ID NO: 854405 - DNA, 22 bp, Artificial Sequence
  chemically synthesized
tgttcaactccagaattatttt

SEQ ID NO: 854406 - DNA, 22 bp, Artificial Sequence
  chemically synthesized
gagtgttcaaaaataattctgg

SEQ ID NO: 854407 - DNA, 22 bp, Artificial Sequence
  chemically synthesized
agtgttcaaaaataattctgga

SEQ ID NO: 854408 - DNA, 22 bp, Artificial Sequence
  chemically synthesized
atctatgttcaactccagaatt

SEQ ID NO: 854409 - DNA, 22 bp, Artificial Sequence
  chemically synthesized
aaaaataattctggagttgaac

SEQ ID NO: 854410 - DNA, 22 bp, Artificial Sequence
  chemically synthesized
ccccatatcaagttaatctatg

SEQ ID NO: 854411 - DNA, 22 bp, Artificial Sequence
  chemically synthesized
tggagttgaacatagattaact

SEQ ID NO: 854412 - DNA, 22 bp, Artificial Sequence
  chemically synthesized
gagttgaacatagattaacttg

SEQ ID NO: 854413 - DNA, 22 bp, Artificial Sequence
  chemically synthesized
aacatagattaacttgatatgg

SEQ ID NO: 854414 - DNA, 22 bp, Artificial Sequence
  chemically synthesized
acttgatatgggggaggggtta

SEQ ID NO: 854415 - DNA, 22 bp, Artificial Sequence
  chemically synthesized
taatgaccaatgtaacccctcc

SEQ ID NO: 854416 - DNA, 22 bp, Artificial Sequence
  chemically synthesized
gatatgggggaggggttacatt

SEQ ID NO: 854417 - DNA, 22 bp, Artificial Sequence
  chemically synthesized
atatgggggaggggttacattg

SEQ ID NO: 854418 - DNA, 22 bp, Artificial Sequence
  chemically synthesized
tggaagcaaaataaactgtaat

SEQ ID NO: 854419 - DNA, 22 bp, Artificial Sequence
  chemically synthesized
cattggtcattacagtttattt

SEQ ID NO: 854420 - DNA, 22 bp, Artificial Sequence
  chemically synthesized
aattatggaagcaaaataaact

SEQ ID NO: 854421 - DNA, 22 bp, Artificial Sequence
  chemically synthesized
caattatggaagcaaaataaac

SEQ ID NO: 854422 - DNA, 22 bp, Artificial Sequence
  chemically synthesized
ttcaattatggaagcaaaataa

SEQ ID NO: 854423 - DNA, 22 bp, Artificial Sequence
  chemically synthesized
gtcattacagtttattttgctt

SEQ ID NO: 854424 - DNA, 22 bp, Artificial Sequence
  chemically synthesized
tcttcaattatggaagcaaaat

SEQ ID NO: 854425 - DNA, 22 bp, Artificial Sequence
  chemically synthesized
tctcttcaattatggaagcaaa

SEQ ID NO: 854426 - DNA, 22 bp, Artificial Sequence
  chemically synthesized
ctctcttcaattatggaagcaa

SEQ ID NO: 854427 - DNA, 22 bp, Artificial Sequence
  chemically synthesized
cagtttattttgcttccataat

SEQ ID NO: 854428 - DNA, 22 bp, Artificial Sequence
  chemically synthesized
tcatcttctctcttcaattatg

SEQ ID NO: 854429 - DNA, 22 bp, Artificial Sequence
  chemically synthesized
attttgcttccataattgaaga

SEQ ID NO: 854430 - DNA, 22 bp, Artificial Sequence
  chemically synthesized
ttttgcttccataattgaagag

SEQ ID NO: 854431 - DNA, 22 bp, Artificial Sequence
  chemically synthesized
actgtcatcttctctcttcaat

SEQ ID NO: 854432 - DNA, 22 bp, Artificial Sequence
  chemically synthesized
aactgtcatcttctctcttcaa

SEQ ID NO: 854433 - DNA, 22 bp, Artificial Sequence
  chemically synthesized
tgcttccataattgaagagaga

SEQ ID NO: 854434 - DNA, 22 bp, Artificial Sequence
  chemically synthesized
gcttccataattgaagagagaa

SEQ ID NO: 854435 - DNA, 22 bp, Artificial Sequence
  chemically synthesized
cttccataattgaagagagaag

SEQ ID NO: 854436 - DNA, 22 bp, Artificial Sequence
  chemically synthesized
atttaactgtcatcttctctct

SEQ ID NO: 854437 - DNA, 22 bp, Artificial Sequence
  chemically synthesized
gatttaactgtcatcttctctc

SEQ ID NO: 854438 - DNA, 22 bp, Artificial Sequence
  chemically synthesized
ccataattgaagagagaagatg

SEQ ID NO: 854439 - DNA, 22 bp, Artificial Sequence
  chemically synthesized
tgatttaactgtcatcttctct

SEQ ID NO: 854440 - DNA, 22 bp, Artificial Sequence
  chemically synthesized
cataattgaagagagaagatga

SEQ ID NO: 854441 - DNA, 22 bp, Artificial Sequence
  chemically synthesized
aagagagaagatgacagttaaa

SEQ ID NO: 854442 - DNA, 22 bp, Artificial Sequence
  chemically synthesized
aagaacagaaatgctttgattt

SEQ ID NO: 854443 - DNA, 22 bp, Artificial Sequence
  chemically synthesized
caagaacagaaatgctttgatt

SEQ ID NO: 854444 - DNA, 22 bp, Artificial Sequence
  chemically synthesized
tttcaagaacagaaatgctttg

SEQ ID NO: 854445 - DNA, 22 bp, Artificial Sequence
  chemically synthesized
atttcaagaacagaaatgcttt

SEQ ID NO: 854446 - DNA, 22 bp, Artificial Sequence
  chemically synthesized
tttatttcaagaacagaaatgc

SEQ ID NO: 854447 - DNA, 22 bp, Artificial Sequence
  chemically synthesized
aatcaaagcatttctgttcttg

SEQ ID NO: 854448 - DNA, 22 bp, Artificial Sequence
  chemically synthesized
tattatttatttcaagaacaga

SEQ ID NO: 854449 - DNA, 22 bp, Artificial Sequence
  chemically synthesized
ctgttcttgaaataaataatac

SEQ ID NO: 854450 - DNA, 22 bp, Artificial Sequence
  chemically synthesized
tgttcttgaaataaataataca

SEQ ID NO: 854451 - DNA, 22 bp, Artificial Sequence
  chemically synthesized
ttcttgaaataaataatacagt

SEQ ID NO: 854452 - DNA, 22 bp, Artificial Sequence
  chemically synthesized
ttgaaataaataatacagtata

SEQ ID NO: 854453 - DNA, 22 bp, Artificial Sequence
  chemically synthesized
aagaaaagaatatatactgtat

SEQ ID NO: 854454 - DNA, 22 bp, Artificial Sequence
  chemically synthesized
gaaataaataatacagtatata

SEQ ID NO: 854455 - DNA, 22 bp, Artificial Sequence
  chemically synthesized
aaataaataatacagtatatat

SEQ ID NO: 854456 - DNA, 22 bp, Artificial Sequence
  chemically synthesized
ttcaagaaaagaatatatactg

SEQ ID NO: 854457 - DNA, 22 bp, Artificial Sequence
  chemically synthesized
attcaagaaaagaatatatact

SEQ ID NO: 854458 - DNA, 22 bp, Artificial Sequence
  chemically synthesized
tgatttattcaagaaaagaata

SEQ ID NO: 854459 - DNA, 22 bp, Artificial Sequence
  chemically synthesized
ctatgatttattcaagaaaaga

SEQ ID NO: 854460 - DNA, 22 bp, Artificial Sequence
  chemically synthesized
tatatctcctatgatttattca

SEQ ID NO: 854461 - DNA, 22 bp, Artificial Sequence
  chemically synthesized
ttttcttgaataaatcatagga

SEQ ID NO: 854462 - DNA, 22 bp, Artificial Sequence
  chemically synthesized
agaattatatatctcctatgat

SEQ ID NO: 854463 - DNA, 22 bp, Artificial Sequence
  chemically synthesized
ttcttgaataaatcataggaga

SEQ ID NO: 854464 - DNA, 22 bp, Artificial Sequence
  chemically synthesized
aagaattatatatctcctatga

SEQ ID NO: 854465 - DNA, 22 bp, Artificial Sequence
  chemically synthesized
tcttgaataaatcataggagat

SEQ ID NO: 854466 - DNA, 22 bp, Artificial Sequence
  chemically synthesized
cttgaataaatcataggagata

SEQ ID NO: 854467 - DNA, 22 bp, Artificial Sequence
  chemically synthesized
ttgaataaatcataggagatat

SEQ ID NO: 854468 - DNA, 22 bp, Artificial Sequence
  chemically synthesized
gaataaatcataggagatatat

SEQ ID NO: 854469 - DNA, 22 bp, Artificial Sequence
  chemically synthesized
aataaatcataggagatatata

SEQ ID NO: 854470 - DNA, 22 bp, Artificial Sequence
  chemically synthesized
tgtaaacaagtgacataatatt

SEQ ID NO: 854471 - DNA, 22 bp, Artificial Sequence
  chemically synthesized
tgtgtaaacaagtgacataata

SEQ ID NO: 854472 - DNA, 22 bp, Artificial Sequence
  chemically synthesized
tattctgtgtaaacaagtgaca

SEQ ID NO: 854473 - DNA, 22 bp, Artificial Sequence
  chemically synthesized
atattctgtgtaaacaagtgac

SEQ ID NO: 854474 - DNA, 22 bp, Artificial Sequence
  chemically synthesized
ttaaatattatgtcacttgttt

SEQ ID NO: 854475 - DNA, 22 bp, Artificial Sequence
  chemically synthesized
tatattctgtgtaaacaagtga

SEQ ID NO: 854476 - DNA, 22 bp, Artificial Sequence
  chemically synthesized
aaatattatgtcacttgtttac

SEQ ID NO: 854477 - DNA, 22 bp, Artificial Sequence
  chemically synthesized
aatattatgtcacttgtttaca

SEQ ID NO: 854478 - DNA, 22 bp, Artificial Sequence
  chemically synthesized
tattttatattctgtgtaaaca

SEQ ID NO: 854479 - DNA, 22 bp, Artificial Sequence
  chemically synthesized
atattttatattctgtgtaaac

SEQ ID NO: 854480 - DNA, 22 bp, Artificial Sequence
  chemically synthesized
tatattttatattctgtgtaaa

SEQ ID NO: 854481 - DNA, 22 bp, Artificial Sequence
  chemically synthesized
tgtcacttgtttacacagaata

SEQ ID NO: 854482 - DNA, 22 bp, Artificial Sequence
  chemically synthesized
cctttatattttatattctgtg

SEQ ID NO: 854483 - DNA, 22 bp, Artificial Sequence
  chemically synthesized
acctttatattttatattctgt

SEQ ID NO: 854484 - DNA, 22 bp, Artificial Sequence
  chemically synthesized
ccttacctttatattttatatt

SEQ ID NO: 854485 - DNA, 22 bp, Artificial Sequence
  chemically synthesized
gtttacacagaatataaaatat

SEQ ID NO: 854486 - DNA, 22 bp, Artificial Sequence
  chemically synthesized
tttacacagaatataaaatata

SEQ ID NO: 854487 - DNA, 22 bp, Artificial Sequence
  chemically synthesized
agttcccttacctttatatttt

SEQ ID NO: 854488 - DNA, 22 bp, Artificial Sequence
  chemically synthesized
acacagaatataaaatataaag

SEQ ID NO: 854489 - DNA, 22 bp, Artificial Sequence
  chemically synthesized
cagttcccttacctttatattt

SEQ ID NO: 854490 - DNA, 22 bp, Artificial Sequence
  chemically synthesized
cacagaatataaaatataaagg

SEQ ID NO: 854491 - DNA, 22 bp, Artificial Sequence
  chemically synthesized
tcagttcccttacctttatatt

SEQ ID NO: 854492 - DNA, 22 bp, Artificial Sequence
  chemically synthesized
acaaatgctttcagttccctta

SEQ ID NO: 854493 - DNA, 22 bp, Artificial Sequence
  chemically synthesized
gtaattcacaaatgctttcagt

SEQ ID NO: 854494 - DNA, 22 bp, Artificial Sequence
  chemically synthesized
agtaattcacaaatgctttcag

SEQ ID NO: 854495 - DNA, 22 bp, Artificial Sequence
  chemically synthesized
tagtaattcacaaatgctttca

SEQ ID NO: 854496 - DNA, 22 bp, Artificial Sequence
  chemically synthesized
aatacaattttagtaattcaca

SEQ ID NO: 854497 - DNA, 22 bp, Artificial Sequence
  chemically synthesized
gaatacaattttagtaattcac

SEQ ID NO: 854498 - DNA, 22 bp, Artificial Sequence
  chemically synthesized
tgaatacaattttagtaattca

SEQ ID NO: 854499 - DNA, 22 bp, Artificial Sequence
  chemically synthesized
aaagcatttgtgaattactaaa

SEQ ID NO: 854500 - DNA, 22 bp, Artificial Sequence
  chemically synthesized
gtgaattactaaaattgtattc

SEQ ID NO: 854501 - DNA, 22 bp, Artificial Sequence
  chemically synthesized
tgaattactaaaattgtattca

SEQ ID NO: 854502 - DNA, 22 bp, Artificial Sequence
  chemically synthesized
taaaaataactttgaatacaat

SEQ ID NO: 854503 - DNA, 22 bp, Artificial Sequence
  chemically synthesized
ataaaaataactttgaatacaa

SEQ ID NO: 854504 - DNA, 22 bp, Artificial Sequence
  chemically synthesized
gatttataaaaataactttgaa

SEQ ID NO: 854505 - DNA, 22 bp, Artificial Sequence
  chemically synthesized
ctaaaattgtattcaaagttat

SEQ ID NO: 854506 - DNA, 22 bp, Artificial Sequence
  chemically synthesized
ttcgatttataaaaataacttt

SEQ ID NO: 854507 - DNA, 22 bp, Artificial Sequence
  chemically synthesized
aaattgtattcaaagttatttt

SEQ ID NO: 854508 - DNA, 22 bp, Artificial Sequence
  chemically synthesized
attcgatttataaaaataactt

SEQ ID NO: 854509 - DNA, 22 bp, Artificial Sequence
  chemically synthesized
ttattcgatttataaaaataac

SEQ ID NO: 854510 - DNA, 22 bp, Artificial Sequence
  chemically synthesized
cttattcgatttataaaaataa

SEQ ID NO: 854511 - DNA, 22 bp, Artificial Sequence
  chemically synthesized
tattcaaagttatttttataaa

SEQ ID NO: 854512 - DNA, 22 bp, Artificial Sequence
  chemically synthesized
aaagttatttttataaatcgaa

SEQ ID NO: 854513 - DNA, 22 bp, Artificial Sequence
  chemically synthesized
agtcaatttcttattcgattta

SEQ ID NO: 854514 - DNA, 22 bp, Artificial Sequence
  chemically synthesized
gagtcaatttcttattcgattt

SEQ ID NO: 854515 - DNA, 22 bp, Artificial Sequence
  chemically synthesized
tttttataaatcgaataagaaa

SEQ ID NO: 854516 - DNA, 22 bp, Artificial Sequence
  chemically synthesized
ttataaatcgaataagaaattg

SEQ ID NO: 854517 - DNA, 22 bp, Artificial Sequence
  chemically synthesized
tataaatcgaataagaaattga

SEQ ID NO: 854518 - DNA, 22 bp, Artificial Sequence
  chemically synthesized
aaatgatttgagtcaatttctt

SEQ ID NO: 854519 - DNA, 22 bp, Artificial Sequence
  chemically synthesized
ataaatcgaataagaaattgac

SEQ ID NO: 854520 - DNA, 22 bp, Artificial Sequence
  chemically synthesized
taaatcgaataagaaattgact

SEQ ID NO: 854521 - DNA, 22 bp, Artificial Sequence
  chemically synthesized
taaaatgatttgagtcaatttc

SEQ ID NO: 854522 - DNA, 22 bp, Artificial Sequence
  chemically synthesized
ctaaaatgatttgagtcaattt

SEQ ID NO: 854523 - DNA, 22 bp, Artificial Sequence
  chemically synthesized
actcaaatcattttagaaaccg

SEQ ID NO: 854524 - DNA, 22 bp, Artificial Sequence
  chemically synthesized
aaaataatgccacggtttctaa

SEQ ID NO: 854525 - DNA, 22 bp, Artificial Sequence
  chemically synthesized
aaatcattttagaaaccgtggc

SEQ ID NO: 854526 - DNA, 22 bp, Artificial Sequence
  chemically synthesized
attaaaaataatgccacggttt

SEQ ID NO: 854527 - DNA, 22 bp, Artificial Sequence
  chemically synthesized
aagaattcattaaaaataatgc

SEQ ID NO: 854528 - DNA, 22 bp, Artificial Sequence
  chemically synthesized
tagaaaccgtggcattattttt

SEQ ID NO: 854529 - DNA, 22 bp, Artificial Sequence
  chemically synthesized
aaagaattcattaaaaataatg

SEQ ID NO: 854530 - DNA, 22 bp, Artificial Sequence
  chemically synthesized
agaaaccgtggcattattttta

SEQ ID NO: 854531 - DNA, 22 bp, Artificial Sequence
  chemically synthesized
taaagaattcattaaaaataat

SEQ ID NO: 854532 - DNA, 22 bp, Artificial Sequence
  chemically synthesized
gaaaccgtggcattatttttaa

SEQ ID NO: 854533 - DNA, 22 bp, Artificial Sequence
  chemically synthesized
ttaaagaattcattaaaaataa

SEQ ID NO: 854534 - DNA, 22 bp, Artificial Sequence
  chemically synthesized
tgatttttaaagaattcattaa

SEQ ID NO: 854535 - DNA, 22 bp, Artificial Sequence
  chemically synthesized
atgatttttaaagaattcatta

SEQ ID NO: 854536 - DNA, 22 bp, Artificial Sequence
  chemically synthesized
tatgatttttaaagaattcatt

SEQ ID NO: 854537 - DNA, 22 bp, Artificial Sequence
  chemically synthesized
ttatgatttttaaagaattcat

SEQ ID NO: 854538 - DNA, 22 bp, Artificial Sequence
  chemically synthesized
tgcttttatgatttttaaagaa

SEQ ID NO: 854539 - DNA, 22 bp, Artificial Sequence
  chemically synthesized
tttttaatgaattctttaaaaa

SEQ ID NO: 854540 - DNA, 22 bp, Artificial Sequence
  chemically synthesized
ttaatgaattctttaaaaatca

SEQ ID NO: 854541 - DNA, 22 bp, Artificial Sequence
  chemically synthesized
attgtgcttttatgatttttaa

SEQ ID NO: 854542 - DNA, 22 bp, Artificial Sequence
  chemically synthesized
taatgaattctttaaaaatcat

SEQ ID NO: 854543 - DNA, 22 bp, Artificial Sequence
  chemically synthesized
gattgtgcttttatgattttta

SEQ ID NO: 854544 - DNA, 22 bp, Artificial Sequence
  chemically synthesized
aatgaattctttaaaaatcata

SEQ ID NO: 854545 - DNA, 22 bp, Artificial Sequence
  chemically synthesized
atgaattctttaaaaatcataa

SEQ ID NO: 854546 - DNA, 22 bp, Artificial Sequence
  chemically synthesized
tttaaaaatcataaaagcacaa

SEQ ID NO: 854547 - DNA, 22 bp, Artificial Sequence
  chemically synthesized
taaaaatcataaaagcacaatc

SEQ ID NO: 854548 - DNA, 22 bp, Artificial Sequence
  chemically synthesized
aaaaatcataaaagcacaatca

SEQ ID NO: 854549 - DNA, 22 bp, Artificial Sequence
  chemically synthesized
aaaatcataaaagcacaatcaa

SEQ ID NO: 854550 - DNA, 22 bp, Artificial Sequence
  chemically synthesized
aaaaaaaaaaagcaacaggatt

SEQ ID NO: 854551 - DNA, 22 bp, Artificial Sequence
  chemically synthesized
gaaaaaaaaaaagcaacaggat

SEQ ID NO: 854552 - DNA, 22 bp, Artificial Sequence
  chemically synthesized
tgaaaaaaaaaaagcaacagga

SEQ ID NO: 854553 - DNA, 22 bp, Artificial Sequence
  chemically synthesized
ttgaaaaaaaaaaagcaacagg

SEQ ID NO: 854554 - DNA, 22 bp, Artificial Sequence
  chemically synthesized
tttttgaaaaaaaaaaagcaac

SEQ ID NO: 854555 - DNA, 22 bp, Artificial Sequence
  chemically synthesized
cattgtttttgaaaaaaaaaaa

SEQ ID NO: 854556 - DNA, 22 bp, Artificial Sequence
  chemically synthesized
ttgctttttttttttcaaaaac

SEQ ID NO: 854557 - DNA, 22 bp, Artificial Sequence
  chemically synthesized
ctttttttttttcaaaaacaat

SEQ ID NO: 854558 - DNA, 22 bp, Artificial Sequence
  chemically synthesized
tttttttttcaaaaacaatgca

SEQ ID NO: 854559 - DNA, 22 bp, Artificial Sequence
  chemically synthesized
ttttttttcaaaaacaatgcag

SEQ ID NO: 854560 - DNA, 22 bp, Artificial Sequence
  chemically synthesized
tttttttcaaaaacaatgcagc

SEQ ID NO: 854561 - DNA, 22 bp, Artificial Sequence
  chemically synthesized
ttttttcaaaaacaatgcagcc

SEQ ID NO: 854562 - DNA, 22 bp, Artificial Sequence
  chemically synthesized
caaggtagtaatggctgcattg

SEQ ID NO: 854563 - DNA, 22 bp, Artificial Sequence
  chemically synthesized
tttttcaaaaacaatgcagcca

SEQ ID NO: 854564 - DNA, 22 bp, Artificial Sequence
  chemically synthesized
ccaaggtagtaatggctgcatt

SEQ ID NO: 854565 - DNA, 22 bp, Artificial Sequence
  chemically synthesized
ttttcaaaaacaatgcagccat

SEQ ID NO: 854566 - DNA, 22 bp, Artificial Sequence
  chemically synthesized
tttcaaaaacaatgcagccatt

SEQ ID NO: 854567 - DNA, 22 bp, Artificial Sequence
  chemically synthesized
ttcaaaaacaatgcagccatta

SEQ ID NO: 854568 - DNA, 22 bp, Artificial Sequence
  chemically synthesized
tcaaaaacaatgcagccattac

SEQ ID NO: 854569 - DNA, 22 bp, Artificial Sequence
  chemically synthesized
caaaaacaatgcagccattact

SEQ ID NO: 854570 - DNA, 22 bp, Artificial Sequence
  chemically synthesized
aaaaacaatgcagccattacta

SEQ ID NO: 854571 - DNA, 22 bp, Artificial Sequence
  chemically synthesized
atcagtaatttccaaggtagta

SEQ ID NO: 854572 - DNA, 22 bp, Artificial Sequence
  chemically synthesized
ataaatgaattgatcagtaatt

SEQ ID NO: 854573 - DNA, 22 bp, Artificial Sequence
  chemically synthesized
cataaatgaattgatcagtaat

SEQ ID NO: 854574 - DNA, 22 bp, Artificial Sequence
  chemically synthesized
ctaccttggaaattactgatca

SEQ ID NO: 854575 - DNA, 22 bp, Artificial Sequence
  chemically synthesized
ccttggaaattactgatcaatt

SEQ ID NO: 854576 - DNA, 22 bp, Artificial Sequence
  chemically synthesized
aatttcataaatgaattgatca

SEQ ID NO: 854577 - DNA, 22 bp, Artificial Sequence
  chemically synthesized
aaatttcataaatgaattgatc

SEQ ID NO: 854578 - DNA, 22 bp, Artificial Sequence
  chemically synthesized
taaatttcataaatgaattgat

SEQ ID NO: 854579 - DNA, 22 bp, Artificial Sequence
  chemically synthesized
ggaaattactgatcaattcatt

SEQ ID NO: 854580 - DNA, 22 bp, Artificial Sequence
  chemically synthesized
ttaaatttcataaatgaattga

SEQ ID NO: 854581 - DNA, 22 bp, Artificial Sequence
  chemically synthesized
gaaattactgatcaattcattt

SEQ ID NO: 854582 - DNA, 22 bp, Artificial Sequence
  chemically synthesized
atgtttttaaatttcataaatg

SEQ ID NO: 854583 - DNA, 22 bp, Artificial Sequence
  chemically synthesized
aatgtttttaaatttcataaat

SEQ ID NO: 854584 - DNA, 22 bp, Artificial Sequence
  chemically synthesized
ctgatcaattcatttatgaaat

SEQ ID NO: 854585 - DNA, 22 bp, Artificial Sequence
  chemically synthesized
taatgtttttaaatttcataaa

SEQ ID NO: 854586 - DNA, 22 bp, Artificial Sequence
  chemically synthesized
atcaattcatttatgaaattta

SEQ ID NO: 854587 - DNA, 22 bp, Artificial Sequence
  chemically synthesized
catatgttttaatgtttttaaa

SEQ ID NO: 854588 - DNA, 22 bp, Artificial Sequence
  chemically synthesized
gcatatgttttaatgtttttaa

SEQ ID NO: 854589 - DNA, 22 bp, Artificial Sequence
  chemically synthesized
atttatgaaatttaaaaacatt

SEQ ID NO: 854590 - DNA, 22 bp, Artificial Sequence
  chemically synthesized
tgcatatgttttaatgttttta

SEQ ID NO: 854591 - DNA, 22 bp, Artificial Sequence
  chemically synthesized
ttgcatatgttttaatgttttt

SEQ ID NO: 854592 - DNA, 22 bp, Artificial Sequence
  chemically synthesized
atgaaatttaaaaacattaaaa

SEQ ID NO: 854593 - DNA, 22 bp, Artificial Sequence
  chemically synthesized
tgaaatttaaaaacattaaaac

SEQ ID NO: 854594 - DNA, 22 bp, Artificial Sequence
  chemically synthesized
atttttgcatatgttttaatgt

SEQ ID NO: 854595 - DNA, 22 bp, Artificial Sequence
  chemically synthesized
aaaaacattaaaacatatgcaa

SEQ ID NO: 854596 - DNA, 22 bp, Artificial Sequence
  chemically synthesized
aaaacattaaaacatatgcaaa

SEQ ID NO: 854597 - DNA, 22 bp, Artificial Sequence
  chemically synthesized
ggagtgaaagttgatttttgca

SEQ ID NO: 854598 - DNA, 22 bp, Artificial Sequence
  chemically synthesized
gggagtgaaagttgatttttgc

SEQ ID NO: 854599 - DNA, 22 bp, Artificial Sequence
  chemically synthesized
aaacatatgcaaaaatcaactt

SEQ ID NO: 854600 - DNA, 22 bp, Artificial Sequence
  chemically synthesized
aataacttgggagtgaaagttg

SEQ ID NO: 854601 - DNA, 22 bp, Artificial Sequence
  chemically synthesized
ttcaataacttgggagtgaaag

SEQ ID NO: 854602 - DNA, 22 bp, Artificial Sequence
  chemically synthesized
attcaataacttgggagtgaaa

SEQ ID NO: 854603 - DNA, 22 bp, Artificial Sequence
  chemically synthesized
tattcaataacttgggagtgaa

SEQ ID NO: 854604 - DNA, 22 bp, Artificial Sequence
  chemically synthesized
ttattcaataacttgggagtga

SEQ ID NO: 854605 - DNA, 22 bp, Artificial Sequence
  chemically synthesized
atttttattcaataacttggga

SEQ ID NO: 854606 - DNA, 22 bp, Artificial Sequence
  chemically synthesized
ttgatttttattcaataacttg

SEQ ID NO: 854607 - DNA, 22 bp, Artificial Sequence
  chemically synthesized
gttgatttttattcaataactt

SEQ ID NO: 854608 - DNA, 22 bp, Artificial Sequence
  chemically synthesized
tcactcccaagttattgaataa

SEQ ID NO: 854609 - DNA, 22 bp, Artificial Sequence
  chemically synthesized
cactcccaagttattgaataaa

SEQ ID NO: 854610 - DNA, 22 bp, Artificial Sequence
  chemically synthesized
actcccaagttattgaataaaa

SEQ ID NO: 854611 - DNA, 22 bp, Artificial Sequence
  chemically synthesized
ccaagttattgaataaaaatca

SEQ ID NO: 854612 - DNA, 22 bp, Artificial Sequence
  chemically synthesized
cagggatcttgttgatttttat

SEQ ID NO: 854613 - DNA, 22 bp, Artificial Sequence
  chemically synthesized
ccagggatcttgttgattttta

SEQ ID NO: 854614 - DNA, 22 bp, Artificial Sequence
  chemically synthesized
tccagggatcttgttgattttt

SEQ ID NO: 854615 - DNA, 22 bp, Artificial Sequence
  chemically synthesized
tctttccagggatcttgttgat

SEQ ID NO: 854616 - DNA, 22 bp, Artificial Sequence
  chemically synthesized
atctttccagggatcttgttga

SEQ ID NO: 854617 - DNA, 22 bp, Artificial Sequence
  chemically synthesized
ttgaataaaaatcaacaagatc

SEQ ID NO: 854618 - DNA, 22 bp, Artificial Sequence
  chemically synthesized
aataaaaatcaacaagatccct

SEQ ID NO: 854619 - DNA, 22 bp, Artificial Sequence
  chemically synthesized
tgtttatctttccagggatctt

SEQ ID NO: 854620 - DNA, 22 bp, Artificial Sequence
  chemically synthesized
agctatgtttatctttccaggg

SEQ ID NO: 854621 - DNA, 22 bp, Artificial Sequence
  chemically synthesized
atatagatgaaaattaagctat

SEQ ID NO: 854622 - DNA, 22 bp, Artificial Sequence
  chemically synthesized
gaaagataaacatagcttaatt

SEQ ID NO: 854623 - DNA, 22 bp, Artificial Sequence
  chemically synthesized
catatagatgaaaattaagcta

SEQ ID NO: 854624 - DNA, 22 bp, Artificial Sequence
  chemically synthesized
tcatatagatgaaaattaagct

SEQ ID NO: 854625 - DNA, 22 bp, Artificial Sequence
  chemically synthesized
ttcatatagatgaaaattaagc

SEQ ID NO: 854626 - DNA, 22 bp, Artificial Sequence
  chemically synthesized
tttcatatagatgaaaattaag

SEQ ID NO: 854627 - DNA, 22 bp, Artificial Sequence
  chemically synthesized
cctttttcatatagatgaaaat

SEQ ID NO: 854628 - DNA, 22 bp, Artificial Sequence
  chemically synthesized
aattttcatctatatgaaaaag

SEQ ID NO: 854629 - DNA, 22 bp, Artificial Sequence
  chemically synthesized
attttcatctatatgaaaaagg

SEQ ID NO: 854630 - DNA, 22 bp, Artificial Sequence
  chemically synthesized
aatatgtgcctgcctttttcat

SEQ ID NO: 854631 - DNA, 22 bp, Artificial Sequence
  chemically synthesized
taaatatgtgcctgcctttttc

SEQ ID NO: 854632 - DNA, 22 bp, Artificial Sequence
  chemically synthesized
tcatctatatgaaaaaggcagg

SEQ ID NO: 854633 - DNA, 22 bp, Artificial Sequence
  chemically synthesized
catctatatgaaaaaggcaggc

SEQ ID NO: 854634 - DNA, 22 bp, Artificial Sequence
  chemically synthesized
ttctaaatatgtgcctgccttt

SEQ ID NO: 854635 - DNA, 22 bp, Artificial Sequence
  chemically synthesized
atctatatgaaaaaggcaggca

SEQ ID NO: 854636 - DNA, 22 bp, Artificial Sequence
  chemically synthesized
attctaaatatgtgcctgcctt

SEQ ID NO: 854637 - DNA, 22 bp, Artificial Sequence
  chemically synthesized
ttattctaaatatgtgcctgcc

SEQ ID NO: 854638 - DNA, 22 bp, Artificial Sequence
  chemically synthesized
cttattctaaatatgtgcctgc

SEQ ID NO: 854639 - DNA, 22 bp, Artificial Sequence
  chemically synthesized
tatgaaaaaggcaggcacatat

SEQ ID NO: 854640 - DNA, 22 bp, Artificial Sequence
  chemically synthesized
tgatttcttattctaaatatgt

SEQ ID NO: 854641 - DNA, 22 bp, Artificial Sequence
  chemically synthesized
atcaattgtgatttcttattct

SEQ ID NO: 854642 - DNA, 22 bp, Artificial Sequence
  chemically synthesized
agaataagaaatcacaattgat

SEQ ID NO: 854643 - DNA, 22 bp, Artificial Sequence
  chemically synthesized
gaataagaaatcacaattgatc

SEQ ID NO: 854644 - DNA, 22 bp, Artificial Sequence
  chemically synthesized
gaatgaataaatcaactgatca

SEQ ID NO: 854645 - DNA, 22 bp, Artificial Sequence
  chemically synthesized
atcagttgatttattcattcta

SEQ ID NO: 854646 - DNA, 22 bp, Artificial Sequence
  chemically synthesized
aatcatatatgtattagaatga

SEQ ID NO: 854647 - DNA, 22 bp, Artificial Sequence
  chemically synthesized
caatcatatatgtattagaatg

SEQ ID NO: 854648 - DNA, 22 bp, Artificial Sequence
  chemically synthesized
atttattcattctaatacatat

SEQ ID NO: 854649 - DNA, 22 bp, Artificial Sequence
  chemically synthesized
attcattctaatacatatatga

SEQ ID NO: 854650 - DNA, 22 bp, Artificial Sequence
  chemically synthesized
tggtggtttcaatcatatatgt

SEQ ID NO: 854651 - DNA, 22 bp, Artificial Sequence
  chemically synthesized
ttcattctaatacatatatgat

SEQ ID NO: 854652 - DNA, 22 bp, Artificial Sequence
  chemically synthesized
attctaatacatatatgattga

SEQ ID NO: 854653 - DNA, 22 bp, Artificial Sequence
  chemically synthesized
taatacatatatgattgaaacc

SEQ ID NO: 854654 - DNA, 22 bp, Artificial Sequence
  chemically synthesized
atacatatatgattgaaaccac

SEQ ID NO: 854655 - DNA, 22 bp, Artificial Sequence
  chemically synthesized
aaaccaccataacacttttttc

SEQ ID NO: 854656 - DNA, 22 bp, Artificial Sequence
  chemically synthesized
ttttcttttgtggccatgactg

SEQ ID NO: 854657 - DNA, 22 bp, Artificial Sequence
  chemically synthesized
tttcttttgtggccatgactgc

SEQ ID NO: 854658 - DNA, 22 bp, Artificial Sequence
  chemically synthesized
ttcttttgtggccatgactgcc

SEQ ID NO: 854659 - DNA, 22 bp, Artificial Sequence
  chemically synthesized
tcttttgtggccatgactgccc

SEQ ID NO: 854660 - DNA, 22 bp, Artificial Sequence
  chemically synthesized
cttttgtggccatgactgccct

SEQ ID NO: 854661 - DNA, 22 bp, Artificial Sequence
  chemically synthesized
ttttgtggccatgactgcccta

SEQ ID NO: 854662 - DNA, 22 bp, Artificial Sequence
  chemically synthesized
ttgtggccatgactgccctatc

SEQ ID NO: 854663 - DNA, 22 bp, Artificial Sequence
  chemically synthesized
tgtggccatgactgccctatct

SEQ ID NO: 854664 - DNA, 22 bp, Artificial Sequence
  chemically synthesized
gtggccatgactgccctatctt

SEQ ID NO: 854665 - DNA, 22 bp, Artificial Sequence
  chemically synthesized
tggccatgactgccctatcttt

SEQ ID NO: 854666 - DNA, 22 bp, Artificial Sequence
  chemically synthesized
taagaaaaacataaaagatagg

SEQ ID NO: 854667 - DNA, 22 bp, Artificial Sequence
  chemically synthesized
tataagaaaaacataaaagata

SEQ ID NO: 854668 - DNA, 22 bp, Artificial Sequence
  chemically synthesized
ccctatcttttatgtttttctt

SEQ ID NO: 854669 - DNA, 22 bp, Artificial Sequence
  chemically synthesized
gagtgtatcctctataagaaaa

SEQ ID NO: 854670 - DNA, 22 bp, Artificial Sequence
  chemically synthesized
agagtgtatcctctataagaaa

SEQ ID NO: 854671 - DNA, 22 bp, Artificial Sequence
  chemically synthesized
tcttttatgtttttcttataga

SEQ ID NO: 854672 - DNA, 22 bp, Artificial Sequence
  chemically synthesized
tagagtgtatcctctataagaa

SEQ ID NO: 854673 - DNA, 22 bp, Artificial Sequence
  chemically synthesized
ttatgtttttcttatagaggat

SEQ ID NO: 854674 - DNA, 22 bp, Artificial Sequence
  chemically synthesized
attttagagtgtatcctctata

SEQ ID NO: 854675 - DNA, 22 bp, Artificial Sequence
  chemically synthesized
tatgtttttcttatagaggata

SEQ ID NO: 854676 - DNA, 22 bp, Artificial Sequence
  chemically synthesized
atgtttttcttatagaggatac

SEQ ID NO: 854677 - DNA, 22 bp, Artificial Sequence
  chemically synthesized
tgtttttcttatagaggataca

SEQ ID NO: 854678 - DNA, 22 bp, Artificial Sequence
  chemically synthesized
ttcttatagaggatacactcta

SEQ ID NO: 854679 - DNA, 22 bp, Artificial Sequence
  chemically synthesized
tcttatagaggatacactctaa

SEQ ID NO: 854680 - DNA, 22 bp, Artificial Sequence
  chemically synthesized
cttatagaggatacactctaaa

SEQ ID NO: 854681 - DNA, 22 bp, Artificial Sequence
  chemically synthesized
ttatagaggatacactctaaaa

SEQ ID NO: 854682 - DNA, 22 bp, Artificial Sequence
  chemically synthesized
atagaggatacactctaaaatt

SEQ ID NO: 854683 - DNA, 22 bp, Artificial Sequence
  chemically synthesized
tagaggatacactctaaaatta

SEQ ID NO: 854684 - DNA, 22 bp, Artificial Sequence
  chemically synthesized
aaaagggataggccctaatttt

SEQ ID NO: 854685 - DNA, 22 bp, Artificial Sequence
  chemically synthesized
taaaattagggcctatcccttt

SEQ ID NO: 854686 - DNA, 22 bp, Artificial Sequence
  chemically synthesized
aaattagggcctatcccttttt

SEQ ID NO: 854687 - DNA, 22 bp, Artificial Sequence
  chemically synthesized
gggaacaaaaattaaaaaggga

SEQ ID NO: 854688 - DNA, 22 bp, Artificial Sequence
  chemically synthesized
agggaacaaaaattaaaaaggg

SEQ ID NO: 854689 - DNA, 22 bp, Artificial Sequence
  chemically synthesized
ttagggaacaaaaattaaaaag

SEQ ID NO: 854690 - DNA, 22 bp, Artificial Sequence
  chemically synthesized
gggcctatccctttttaatttt

SEQ ID NO: 854691 - DNA, 22 bp, Artificial Sequence
  chemically synthesized
ctcttagggaacaaaaattaaa

SEQ ID NO: 854692 - DNA, 22 bp, Artificial Sequence
  chemically synthesized
tctgctcttagggaacaaaaat

SEQ ID NO: 854693 - DNA, 22 bp, Artificial Sequence
  chemically synthesized
tccctttttaatttttgttccc

SEQ ID NO: 854694 - DNA, 22 bp, Artificial Sequence
  chemically synthesized
tttaatttttgttccctaagag

SEQ ID NO: 854695 - DNA, 22 bp, Artificial Sequence
  chemically synthesized
ttaatttttgttccctaagagc

SEQ ID NO: 854696 - DNA, 22 bp, Artificial Sequence
  chemically synthesized
taatttttgttccctaagagca

SEQ ID NO: 854697 - DNA, 22 bp, Artificial Sequence
  chemically synthesized
aatttttgttccctaagagcag

SEQ ID NO: 854698 - DNA, 22 bp, Artificial Sequence
  chemically synthesized
atttttgttccctaagagcaga

SEQ ID NO: 854699 - DNA, 22 bp, Artificial Sequence
  chemically synthesized
ttgttccctaagagcagataac

SEQ ID NO: 854700 - DNA, 22 bp, Artificial Sequence
  chemically synthesized
tgttccctaagagcagataaca

SEQ ID NO: 854701 - DNA, 22 bp, Artificial Sequence
  chemically synthesized
gttccctaagagcagataacac

SEQ ID NO: 854702 - DNA, 22 bp, Artificial Sequence
  chemically synthesized
ttccctaagagcagataacact

SEQ ID NO: 854703 - DNA, 22 bp, Artificial Sequence
  chemically synthesized
gtgaaaggcatcagtgttatct

SEQ ID NO: 854704 - DNA, 22 bp, Artificial Sequence
  chemically synthesized
cctaagagcagataacactgat

SEQ ID NO: 854705 - DNA, 22 bp, Artificial Sequence
  chemically synthesized
ctggtgaaaggcatcagtgtta

SEQ ID NO: 854706 - DNA, 22 bp, Artificial Sequence
  chemically synthesized
gctggtgaaaggcatcagtgtt

SEQ ID NO: 854707 - DNA, 22 bp, Artificial Sequence
  chemically synthesized
agagcagataacactgatgcct

SEQ ID NO: 854708 - DNA, 22 bp, Artificial Sequence
  chemically synthesized
aacacttgctggtgaaaggcat

SEQ ID NO: 854709 - DNA, 22 bp, Artificial Sequence
  chemically synthesized
ttgaacacttgctggtgaaagg

SEQ ID NO: 854710 - DNA, 22 bp, Artificial Sequence
  chemically synthesized
attgaacacttgctggtgaaag

SEQ ID NO: 854711 - DNA, 22 bp, Artificial Sequence
  chemically synthesized
tttattgaacacttgctggtga

SEQ ID NO: 854712 - DNA, 22 bp, Artificial Sequence
  chemically synthesized
ttatttattgaacacttgctgg

SEQ ID NO: 854713 - DNA, 22 bp, Artificial Sequence
  chemically synthesized
atgcctttcaccagcaagtgtt

SEQ ID NO: 854714 - DNA, 22 bp, Artificial Sequence
  chemically synthesized
atctgttatttattgaacactt

SEQ ID NO: 854715 - DNA, 22 bp, Artificial Sequence
  chemically synthesized
tcaccagcaagtgttcaataaa

SEQ ID NO: 854716 - DNA, 22 bp, Artificial Sequence
  chemically synthesized
caccagcaagtgttcaataaat

SEQ ID NO: 854717 - DNA, 22 bp, Artificial Sequence
  chemically synthesized
cattcatctgttatttattgaa

SEQ ID NO: 854718 - DNA, 22 bp, Artificial Sequence
  chemically synthesized
accagcaagtgttcaataaata

SEQ ID NO: 854719 - DNA, 22 bp, Artificial Sequence
  chemically synthesized
acattcatctgttatttattga

SEQ ID NO: 854720 - DNA, 22 bp, Artificial Sequence
  chemically synthesized
agtttacattcatctgttattt

SEQ ID NO: 854721 - DNA, 22 bp, Artificial Sequence
  chemically synthesized
aataaataacagatgaatgtaa

SEQ ID NO: 854722 - DNA, 22 bp, Artificial Sequence
  chemically synthesized
atacaatactgagtttacattc

SEQ ID NO: 854723 - DNA, 22 bp, Artificial Sequence
  chemically synthesized
gatacaatactgagtttacatt

SEQ ID NO: 854724 - DNA, 22 bp, Artificial Sequence
  chemically synthesized
tgatacaatactgagtttacat

SEQ ID NO: 854725 - DNA, 22 bp, Artificial Sequence
  chemically synthesized
ttgatacaatactgagtttaca

SEQ ID NO: 854726 - DNA, 22 bp, Artificial Sequence
  chemically synthesized
agagcttttgatacaatactga

SEQ ID NO: 854727 - DNA, 22 bp, Artificial Sequence
  chemically synthesized
aagagcttttgatacaatactg

SEQ ID NO: 854728 - DNA, 22 bp, Artificial Sequence
  chemically synthesized
taagagcttttgatacaatact

SEQ ID NO: 854729 - DNA, 22 bp, Artificial Sequence
  chemically synthesized
ttaagagcttttgatacaatac

SEQ ID NO: 854730 - DNA, 22 bp, Artificial Sequence
  chemically synthesized
tcttttaagagcttttgataca

SEQ ID NO: 854731 - DNA, 22 bp, Artificial Sequence
  chemically synthesized
actgtcttttaagagcttttga

SEQ ID NO: 854732 - DNA, 22 bp, Artificial Sequence
  chemically synthesized
agtattgtatcaaaagctctta

SEQ ID NO: 854733 - DNA, 22 bp, Artificial Sequence
  chemically synthesized
tatcaaaagctcttaaaagaca

SEQ ID NO: 854734 - DNA, 22 bp, Artificial Sequence
  chemically synthesized
gaaatatattgactgtctttta

SEQ ID NO: 854735 - DNA, 22 bp, Artificial Sequence
  chemically synthesized
agaaatatattgactgtctttt

SEQ ID NO: 854736 - DNA, 22 bp, Artificial Sequence
  chemically synthesized
tagaaatatattgactgtcttt

SEQ ID NO: 854737 - DNA, 22 bp, Artificial Sequence
  chemically synthesized
tttagaaatatattgactgtct

SEQ ID NO: 854738 - DNA, 22 bp, Artificial Sequence
  chemically synthesized
ttaaaagacagtcaatatattt

SEQ ID NO: 854739 - DNA, 22 bp, Artificial Sequence
  chemically synthesized
aaaagacagtcaatatatttct

SEQ ID NO: 854740 - DNA, 22 bp, Artificial Sequence
  chemically synthesized
aaagacagtcaatatatttcta

SEQ ID NO: 854741 - DNA, 22 bp, Artificial Sequence
  chemically synthesized
cagtgtcataaagattctttag

SEQ ID NO: 854742 - DNA, 22 bp, Artificial Sequence
  chemically synthesized
gagttacagtgtcataaagatt

SEQ ID NO: 854743 - DNA, 22 bp, Artificial Sequence
  chemically synthesized
ctaaagaatctttatgacactg

SEQ ID NO: 854744 - DNA, 22 bp, Artificial Sequence
  chemically synthesized
taaagaatctttatgacactgt

SEQ ID NO: 854745 - DNA, 22 bp, Artificial Sequence
  chemically synthesized
atacctcgagttacagtgtcat

SEQ ID NO: 854746 - DNA, 22 bp, Artificial Sequence
  chemically synthesized
gatacctcgagttacagtgtca

SEQ ID NO: 854747 - DNA, 22 bp, Artificial Sequence
  chemically synthesized
aagaatctttatgacactgtaa

SEQ ID NO: 854748 - DNA, 22 bp, Artificial Sequence
  chemically synthesized
tgatacctcgagttacagtgtc

SEQ ID NO: 854749 - DNA, 22 bp, Artificial Sequence
  chemically synthesized
ttgatacctcgagttacagtgt

SEQ ID NO: 854750 - DNA, 22 bp, Artificial Sequence
  chemically synthesized
cttttgatacctcgagttacag

SEQ ID NO: 854751 - DNA, 22 bp, Artificial Sequence
  chemically synthesized
acttttgatacctcgagttaca

SEQ ID NO: 854752 - DNA, 22 bp, Artificial Sequence
  chemically synthesized
tatgacactgtaactcgaggta

SEQ ID NO: 854753 - DNA, 22 bp, Artificial Sequence
  chemically synthesized
atgacactgtaactcgaggtat

SEQ ID NO: 854754 - DNA, 22 bp, Artificial Sequence
  chemically synthesized
tgacactgtaactcgaggtatc

SEQ ID NO: 854755 - DNA, 22 bp, Artificial Sequence
  chemically synthesized
aagtgcttacttttgatacctc

SEQ ID NO: 854756 - DNA, 22 bp, Artificial Sequence
  chemically synthesized
caagtgcttacttttgatacct

SEQ ID NO: 854757 - DNA, 22 bp, Artificial Sequence
  chemically synthesized
cttcaagtgcttacttttgata

SEQ ID NO: 854758 - DNA, 22 bp, Artificial Sequence
  chemically synthesized
taactcgaggtatcaaaagtaa

SEQ ID NO: 854759 - DNA, 22 bp, Artificial Sequence
  chemically synthesized
ctccttcaagtgcttacttttg

SEQ ID NO: 854760 - DNA, 22 bp, Artificial Sequence
  chemically synthesized
cctccttcaagtgcttactttt

SEQ ID NO: 854761 - DNA, 22 bp, Artificial Sequence
  chemically synthesized
tcctccttcaagtgcttacttt

SEQ ID NO: 854762 - DNA, 22 bp, Artificial Sequence
  chemically synthesized
tttcctccttcaagtgcttact

SEQ ID NO: 854763 - DNA, 22 bp, Artificial Sequence
  chemically synthesized
gaggtatcaaaagtaagcactt

SEQ ID NO: 854764 - DNA, 22 bp, Artificial Sequence
  chemically synthesized
ctttcctccttcaagtgcttac

SEQ ID NO: 854765 - DNA, 22 bp, Artificial Sequence
  chemically synthesized
tctttcctccttcaagtgctta

SEQ ID NO: 854766 - DNA, 22 bp, Artificial Sequence
  chemically synthesized
gtattttctttcctccttcaag

SEQ ID NO: 854767 - DNA, 22 bp, Artificial Sequence
  chemically synthesized
ctagtattttctttcctccttc

SEQ ID NO: 854768 - DNA, 22 bp, Artificial Sequence
  chemically synthesized
aatactactagtattttctttc

SEQ ID NO: 854769 - DNA, 22 bp, Artificial Sequence
  chemically synthesized
gaaggaggaaagaaaatactag

SEQ ID NO: 854770 - DNA, 22 bp, Artificial Sequence
  chemically synthesized
aaggaggaaagaaaatactagt

SEQ ID NO: 854771 - DNA, 22 bp, Artificial Sequence
  chemically synthesized
taattaaatactactagtattt

SEQ ID NO: 854772 - DNA, 22 bp, Artificial Sequence
  chemically synthesized
atagtctgtaattaaatactac

SEQ ID NO: 854773 - DNA, 22 bp, Artificial Sequence
  chemically synthesized
aatagtctgtaattaaatacta

SEQ ID NO: 854774 - DNA, 22 bp, Artificial Sequence
  chemically synthesized
taatagtctgtaattaaatact

SEQ ID NO: 854775 - DNA, 22 bp, Artificial Sequence
  chemically synthesized
gtagtatttaattacagactat

SEQ ID NO: 854776 - DNA, 22 bp, Artificial Sequence
  chemically synthesized
agtagatattttaatagtctgt

SEQ ID NO: 854777 - DNA, 22 bp, Artificial Sequence
  chemically synthesized
aattacagactattaaaatatc

SEQ ID NO: 854778 - DNA, 22 bp, Artificial Sequence
  chemically synthesized
attacagactattaaaatatct

SEQ ID NO: 854779 - DNA, 22 bp, Artificial Sequence
  chemically synthesized
acgtatacattaagtagatatt

SEQ ID NO: 854780 - DNA, 22 bp, Artificial Sequence
  chemically synthesized
cagactattaaaatatctactt

SEQ ID NO: 854781 - DNA, 22 bp, Artificial Sequence
  chemically synthesized
ttaaaatatctacttaatgtat

SEQ ID NO: 854782 - DNA, 22 bp, Artificial Sequence
  chemically synthesized
tataaaattaacgtatacatta

SEQ ID NO: 854783 - DNA, 22 bp, Artificial Sequence
  chemically synthesized
aaatatctacttaatgtatacg

SEQ ID NO: 854784 - DNA, 22 bp, Artificial Sequence
  chemically synthesized
cttaatgtatacgttaatttta

SEQ ID NO: 854785 - DNA, 22 bp, Artificial Sequence
  chemically synthesized
aatgtatacgttaattttatat

SEQ ID NO: 854786 - DNA, 22 bp, Artificial Sequence
  chemically synthesized
atgtatacgttaattttatata

SEQ ID NO: 854787 - DNA, 22 bp, Artificial Sequence
  chemically synthesized
aagtgatacatattatataaaa

SEQ ID NO: 854788 - DNA, 22 bp, Artificial Sequence
  chemically synthesized
tgttaaagtgatacatattata

SEQ ID NO: 854789 - DNA, 22 bp, Artificial Sequence
  chemically synthesized
atgttaaagtgatacatattat

SEQ ID NO: 854790 - DNA, 22 bp, Artificial Sequence
  chemically synthesized
cttatgttaaagtgatacatat

SEQ ID NO: 854791 - DNA, 22 bp, Artificial Sequence
  chemically synthesized
attttatataatatgtatcact

SEQ ID NO: 854792 - DNA, 22 bp, Artificial Sequence
  chemically synthesized
tatataatatgtatcactttaa

SEQ ID NO: 854793 - DNA, 22 bp, Artificial Sequence
  chemically synthesized
atataatatgtatcactttaac

SEQ ID NO: 854794 - DNA, 22 bp, Artificial Sequence
  chemically synthesized
tataatatgtatcactttaaca

SEQ ID NO: 854795 - DNA, 22 bp, Artificial Sequence
  chemically synthesized
tgtatatggttacttatgttaa

SEQ ID NO: 854796 - DNA, 22 bp, Artificial Sequence
  chemically synthesized
atgtatatggttacttatgtta

SEQ ID NO: 854797 - DNA, 22 bp, Artificial Sequence
  chemically synthesized
tatgtatatggttacttatgtt

SEQ ID NO: 854798 - DNA, 22 bp, Artificial Sequence
  chemically synthesized
ttatgtatatggttacttatgt

SEQ ID NO: 854799 - DNA, 22 bp, Artificial Sequence
  chemically synthesized
taacataagtaaccatatacat

SEQ ID NO: 854800 - DNA, 22 bp, Artificial Sequence
  chemically synthesized
aacataagtaaccatatacata

SEQ ID NO: 854801 - DNA, 22 bp, Artificial Sequence
  chemically synthesized
tatccacacttttatgtatatg

SEQ ID NO: 854802 - DNA, 22 bp, Artificial Sequence
  chemically synthesized
acataagtaaccatatacataa

SEQ ID NO: 854803 - DNA, 22 bp, Artificial Sequence
  chemically synthesized
tacctgtatccacacttttatg

SEQ ID NO: 854804 - DNA, 22 bp, Artificial Sequence
  chemically synthesized
tgtacctgtatccacactttta

SEQ ID NO: 854805 - DNA, 22 bp, Artificial Sequence
  chemically synthesized
ctgtacctgtatccacactttt

SEQ ID NO: 854806 - DNA, 22 bp, Artificial Sequence
  chemically synthesized
gtaaaagtgtttctgtacctgt

SEQ ID NO: 854807 - DNA, 22 bp, Artificial Sequence
  chemically synthesized
ttagtaaaagtgtttctgtacc

SEQ ID NO: 854808 - DNA, 22 bp, Artificial Sequence
  chemically synthesized
ttactaatagtgatgtgtgatc

SEQ ID NO: 854809 - DNA, 22 bp, Artificial Sequence
  chemically synthesized
tactaatagtgatgtgtgatca

SEQ ID NO: 854810 - DNA, 22 bp, Artificial Sequence
  chemically synthesized
actaatagtgatgtgtgatcac

SEQ ID NO: 854811 - DNA, 22 bp, Artificial Sequence
  chemically synthesized
ctaatagtgatgtgtgatcact

SEQ ID NO: 854812 - DNA, 22 bp, Artificial Sequence
  chemically synthesized
atagtgatgtgtgatcactgcc

SEQ ID NO: 854813 - DNA, 22 bp, Artificial Sequence
  chemically synthesized
cctcatcttattcacacttatt

SEQ ID NO: 854814 - DNA, 22 bp, Artificial Sequence
  chemically synthesized
tgtatgatagtgaataagtgtg

SEQ ID NO: 854815 - DNA, 22 bp, Artificial Sequence
  chemically synthesized
gtgtatgatagtgaataagtgt

SEQ ID NO: 854816 - DNA, 22 bp, Artificial Sequence
  chemically synthesized
atcttattcacacttattcact

SEQ ID NO: 854817 - DNA, 22 bp, Artificial Sequence
  chemically synthesized
cttgtgtatgatagtgaataag

SEQ ID NO: 854818 - DNA, 22 bp, Artificial Sequence
  chemically synthesized
ccttgtgtatgatagtgaataa

SEQ ID NO: 854819 - DNA, 22 bp, Artificial Sequence
  chemically synthesized
attcacacttattcactatcat

SEQ ID NO: 854820 - DNA, 22 bp, Artificial Sequence
  chemically synthesized
atttccttgtgtatgatagtga

SEQ ID NO: 854821 - DNA, 22 bp, Artificial Sequence
  chemically synthesized
ttcacacttattcactatcata

SEQ ID NO: 854822 - DNA, 22 bp, Artificial Sequence
  chemically synthesized
gatttccttgtgtatgatagtg

SEQ ID NO: 854823 - DNA, 22 bp, Artificial Sequence
  chemically synthesized
acacttattcactatcatacac

SEQ ID NO: 854824 - DNA, 22 bp, Artificial Sequence
  chemically synthesized
aatttgatttccttgtgtatga

SEQ ID NO: 854825 - DNA, 22 bp, Artificial Sequence
  chemically synthesized
aaatttgatttccttgtgtatg

SEQ ID NO: 854826 - DNA, 22 bp, Artificial Sequence
  chemically synthesized
attcactatcatacacaaggaa

SEQ ID NO: 854827 - DNA, 22 bp, Artificial Sequence
  chemically synthesized
ttcactatcatacacaaggaaa

SEQ ID NO: 854828 - DNA, 22 bp, Artificial Sequence
  chemically synthesized
gatttaaatttgatttccttgt

SEQ ID NO: 854829 - DNA, 22 bp, Artificial Sequence
  chemically synthesized
ggatttaaatttgatttccttg

SEQ ID NO: 854830 - DNA, 22 bp, Artificial Sequence
  chemically synthesized
actatcatacacaaggaaatca

SEQ ID NO: 854831 - DNA, 22 bp, Artificial Sequence
  chemically synthesized
tcatacacaaggaaatcaaatt

SEQ ID NO: 854832 - DNA, 22 bp, Artificial Sequence
  chemically synthesized
gagtaataatttggatttaaat

SEQ ID NO: 854833 - DNA, 22 bp, Artificial Sequence
  chemically synthesized
aaatccaaattattactctagt

SEQ ID NO: 854834 - DNA, 22 bp, Artificial Sequence
  chemically synthesized
aatccaaattattactctagtg

SEQ ID NO: 854835 - DNA, 22 bp, Artificial Sequence
  chemically synthesized
agaaaggagaatagaaagagac

SEQ ID NO: 854836 - DNA, 22 bp, Artificial Sequence
  chemically synthesized
ttactctagtgtctctttctat

SEQ ID NO: 854837 - DNA, 22 bp, Artificial Sequence
  chemically synthesized
ttaagaaaggagaatagaaaga

SEQ ID NO: 854838 - DNA, 22 bp, Artificial Sequence
  chemically synthesized
ctctagtgtctctttctattct

SEQ ID NO: 854839 - DNA, 22 bp, Artificial Sequence
  chemically synthesized
tagtgtctctttctattctcct

SEQ ID NO: 854840 - DNA, 22 bp, Artificial Sequence
  chemically synthesized
gtgtctctttctattctccttt

SEQ ID NO: 854841 - DNA, 22 bp, Artificial Sequence
  chemically synthesized
aagactattaagaaaggagaat

SEQ ID NO: 854842 - DNA, 22 bp, Artificial Sequence
  chemically synthesized
tttctattctcctttcttaata

SEQ ID NO: 854843 - DNA, 22 bp, Artificial Sequence
  chemically synthesized
tctattctcctttcttaatagt

SEQ ID NO: 854844 - DNA, 22 bp, Artificial Sequence
  chemically synthesized
ctattctcctttcttaatagtc

SEQ ID NO: 854845 - DNA, 22 bp, Artificial Sequence
  chemically synthesized
tattctcctttcttaatagtct

SEQ ID NO: 854846 - DNA, 22 bp, Artificial Sequence
  chemically synthesized
gagtcaggttgaagactattaa

SEQ ID NO: 854847 - DNA, 22 bp, Artificial Sequence
  chemically synthesized
ttctcctttcttaatagtcttc

SEQ ID NO: 854848 - DNA, 22 bp, Artificial Sequence
  chemically synthesized
tagagtcaggttgaagactatt

SEQ ID NO: 854849 - DNA, 22 bp, Artificial Sequence
  chemically synthesized
tcctttcttaatagtcttcaac

SEQ ID NO: 854850 - DNA, 22 bp, Artificial Sequence
  chemically synthesized
ctttcttaatagtcttcaacct

SEQ ID NO: 854851 - DNA, 22 bp, Artificial Sequence
  chemically synthesized
tcttaatagtcttcaacctgac

SEQ ID NO: 854852 - DNA, 22 bp, Artificial Sequence
  chemically synthesized
cttaatagtcttcaacctgact

SEQ ID NO: 854853 - DNA, 22 bp, Artificial Sequence
  chemically synthesized
ttaatagtcttcaacctgactc

SEQ ID NO: 854854 - DNA, 22 bp, Artificial Sequence
  chemically synthesized
caaagcactctagagtcaggtt

SEQ ID NO: 854855 - DNA, 22 bp, Artificial Sequence
  chemically synthesized
aatagtcttcaacctgactcta

SEQ ID NO: 854856 - DNA, 22 bp, Artificial Sequence
  chemically synthesized
atagtcttcaacctgactctag

SEQ ID NO: 854857 - DNA, 22 bp, Artificial Sequence
  chemically synthesized
caacctgactctagagtgcttt

SEQ ID NO: 854858 - DNA, 22 bp, Artificial Sequence
  chemically synthesized
aacctgactctagagtgctttg

SEQ ID NO: 854859 - DNA, 22 bp, Artificial Sequence
  chemically synthesized
aaacccatgttacaaagcactc

SEQ ID NO: 854860 - DNA, 22 bp, Artificial Sequence
  chemically synthesized
gaaacccatgttacaaagcact

SEQ ID NO: 854861 - DNA, 22 bp, Artificial Sequence
  chemically synthesized
tgaaacccatgttacaaagcac

SEQ ID NO: 854862 - DNA, 22 bp, Artificial Sequence
  chemically synthesized
actctagagtgctttgtaacat

SEQ ID NO: 854863 - DNA, 22 bp, Artificial Sequence
  chemically synthesized
tctttgaaacccatgttacaaa

SEQ ID NO: 854864 - DNA, 22 bp, Artificial Sequence
  chemically synthesized
tagagtgctttgtaacatgggt

SEQ ID NO: 854865 - DNA, 22 bp, Artificial Sequence
  chemically synthesized
gagtgctttgtaacatgggttt

SEQ ID NO: 854866 - DNA, 22 bp, Artificial Sequence
  chemically synthesized
aacaaattgtctttgaaaccca

SEQ ID NO: 854867 - DNA, 22 bp, Artificial Sequence
  chemically synthesized
gttcaacaaattgtctttgaaa

SEQ ID NO: 854868 - DNA, 22 bp, Artificial Sequence
  chemically synthesized
tgtaacatgggtttcaaagaca

SEQ ID NO: 854869 - DNA, 22 bp, Artificial Sequence
  chemically synthesized
cgttcaacaaattgtctttgaa

SEQ ID NO: 854870 - DNA, 22 bp, Artificial Sequence
  chemically synthesized
gtaacatgggtttcaaagacaa

SEQ ID NO: 854871 - DNA, 22 bp, Artificial Sequence
  chemically synthesized
taacatgggtttcaaagacaat

SEQ ID NO: 854872 - DNA, 22 bp, Artificial Sequence
  chemically synthesized
cttcgttcaacaaattgtcttt

SEQ ID NO: 854873 - DNA, 22 bp, Artificial Sequence
  chemically synthesized
attccttcgttcaacaaattgt

SEQ ID NO: 854874 - DNA, 22 bp, Artificial Sequence
  chemically synthesized
cattccttcgttcaacaaattg

SEQ ID NO: 854875 - DNA, 22 bp, Artificial Sequence
  chemically synthesized
tcattccttcgttcaacaaatt

SEQ ID NO: 854876 - DNA, 22 bp, Artificial Sequence
  chemically synthesized
ttcattccttcgttcaacaaat

SEQ ID NO: 854877 - DNA, 22 bp, Artificial Sequence
  chemically synthesized
tttcattccttcgttcaacaaa

SEQ ID NO: 854878 - DNA, 22 bp, Artificial Sequence
  chemically synthesized
ttttcattccttcgttcaacaa

SEQ ID NO: 854879 - DNA, 22 bp, Artificial Sequence
  chemically synthesized
caaagacaatttgttgaacgaa

SEQ ID NO: 854880 - DNA, 22 bp, Artificial Sequence
  chemically synthesized
aaagacaatttgttgaacgaag

SEQ ID NO: 854881 - DNA, 22 bp, Artificial Sequence
  chemically synthesized
tttttttcattccttcgttcaa

SEQ ID NO: 854882 - DNA, 22 bp, Artificial Sequence
  chemically synthesized
gttgaacgaaggaatgaaaaaa

SEQ ID NO: 854883 - DNA, 22 bp, Artificial Sequence
  chemically synthesized
ttgaacgaaggaatgaaaaaaa

SEQ ID NO: 854884 - DNA, 22 bp, Artificial Sequence
  chemically synthesized
ggtatatggttgtttttttcat

SEQ ID NO: 854885 - DNA, 22 bp, Artificial Sequence
  chemically synthesized
aacgaaggaatgaaaaaaacaa

SEQ ID NO: 854886 - DNA, 22 bp, Artificial Sequence
  chemically synthesized
atgttaggtatatggttgtttt

SEQ ID NO: 854887 - DNA, 22 bp, Artificial Sequence
  chemically synthesized
atgttaatgttaggtatatggt

SEQ ID NO: 854888 - DNA, 22 bp, Artificial Sequence
  chemically synthesized
actaatgttaatgttaggtata

SEQ ID NO: 854889 - DNA, 22 bp, Artificial Sequence
  chemically synthesized
gggtaatgttaactaatgttaa

SEQ ID NO: 854890 - DNA, 22 bp, Artificial Sequence
  chemically synthesized
atgttagggtaatgttaactaa

SEQ ID NO: 854891 - DNA, 22 bp, Artificial Sequence
  chemically synthesized
aatgttagggtaatgttaacta

SEQ ID NO: 854892 - DNA, 22 bp, Artificial Sequence
  chemically synthesized
taatgttagggtaatgttaact

SEQ ID NO: 854893 - DNA, 22 bp, Artificial Sequence
  chemically synthesized
acattaacattagttaacatta

SEQ ID NO: 854894 - DNA, 22 bp, Artificial Sequence
  chemically synthesized
cctttaatgttagggtaatgtt

SEQ ID NO: 854895 - DNA, 22 bp, Artificial Sequence
  chemically synthesized
acattagttaacattaccctaa

SEQ ID NO: 854896 - DNA, 22 bp, Artificial Sequence
  chemically synthesized
ttacctttaatgttagggtaat

SEQ ID NO: 854897 - DNA, 22 bp, Artificial Sequence
  chemically synthesized
ttattacctttaatgttagggt

SEQ ID NO: 854898 - DNA, 22 bp, Artificial Sequence
  chemically synthesized
attattacctttaatgttaggg

SEQ ID NO: 854899 - DNA, 22 bp, Artificial Sequence
  chemically synthesized
gttaacattaccctaacattaa

SEQ ID NO: 854900 - DNA, 22 bp, Artificial Sequence
  chemically synthesized
ttattattacctttaatgttag

SEQ ID NO: 854901 - DNA, 22 bp, Artificial Sequence
  chemically synthesized
cttattattacctttaatgtta

SEQ ID NO: 854902 - DNA, 22 bp, Artificial Sequence
  chemically synthesized
tcttattattacctttaatgtt

SEQ ID NO: 854903 - DNA, 22 bp, Artificial Sequence
  chemically synthesized
ttcttattattacctttaatgt

SEQ ID NO: 854904 - DNA, 22 bp, Artificial Sequence
  chemically synthesized
acattaccctaacattaaaggt

SEQ ID NO: 854905 - DNA, 22 bp, Artificial Sequence
  chemically synthesized
ccctaacattaaaggtaataat

SEQ ID NO: 854906 - DNA, 22 bp, Artificial Sequence
  chemically synthesized
acattaaaggtaataataagaa

SEQ ID NO: 854907 - DNA, 22 bp, Artificial Sequence
  chemically synthesized
tgatgtaaatttttcttattat

SEQ ID NO: 854908 - DNA, 22 bp, Artificial Sequence
  chemically synthesized
aaggtaataataagaaaaattt

SEQ ID NO: 854909 - DNA, 22 bp, Artificial Sequence
  chemically synthesized
cagtgtgttatgatgtaaattt

SEQ ID NO: 854910 - DNA, 22 bp, Artificial Sequence
  chemically synthesized
aagttacagtgtgttatgatgt

SEQ ID NO: 854911 - DNA, 22 bp, Artificial Sequence
  chemically synthesized
taattgaagttacagtgtgtta

SEQ ID NO: 854912 - DNA, 22 bp, Artificial Sequence
  chemically synthesized
acatcataacacactgtaactt

SEQ ID NO: 854913 - DNA, 22 bp, Artificial Sequence
  chemically synthesized
catcataacacactgtaacttc

SEQ ID NO: 854914 - DNA, 22 bp, Artificial Sequence
  chemically synthesized
aagtctgtaattgaagttacag

SEQ ID NO: 854915 - DNA, 22 bp, Artificial Sequence
  chemically synthesized
aaagtctgtaattgaagttaca

SEQ ID NO: 854916 - DNA, 22 bp, Artificial Sequence
  chemically synthesized
gtccttaaagtctgtaattgaa

SEQ ID NO: 854917 - DNA, 22 bp, Artificial Sequence
  chemically synthesized
ggtccttaaagtctgtaattga

SEQ ID NO: 854918 - DNA, 22 bp, Artificial Sequence
  chemically synthesized
tggtccttaaagtctgtaattg

SEQ ID NO: 854919 - DNA, 22 bp, Artificial Sequence
  chemically synthesized
ttggtccttaaagtctgtaatt

SEQ ID NO: 854920 - DNA, 22 bp, Artificial Sequence
  chemically synthesized
taacttcaattacagactttaa

SEQ ID NO: 854921 - DNA, 22 bp, Artificial Sequence
  chemically synthesized
accataacttttggtccttaaa

SEQ ID NO: 854922 - DNA, 22 bp, Artificial Sequence
  chemically synthesized
caattacagactttaaggacca

SEQ ID NO: 854923 - DNA, 22 bp, Artificial Sequence
  chemically synthesized
caccataacttttggtccttaa

SEQ ID NO: 854924 - DNA, 22 bp, Artificial Sequence
  chemically synthesized
aattacagactttaaggaccaa

SEQ ID NO: 854925 - DNA, 22 bp, Artificial Sequence
  chemically synthesized
catttcaccataacttttggtc

SEQ ID NO: 854926 - DNA, 22 bp, Artificial Sequence
  chemically synthesized
cagactttaaggaccaaaagtt

SEQ ID NO: 854927 - DNA, 22 bp, Artificial Sequence
  chemically synthesized
ccatttcaccataacttttggt

SEQ ID NO: 854928 - DNA, 22 bp, Artificial Sequence
  chemically synthesized
tccatttcaccataacttttgg

SEQ ID NO: 854929 - DNA, 22 bp, Artificial Sequence
  chemically synthesized
ggctttccatttcaccataact

SEQ ID NO: 854930 - DNA, 22 bp, Artificial Sequence
  chemically synthesized
taaggaccaaaagttatggtga

SEQ ID NO: 854931 - DNA, 22 bp, Artificial Sequence
  chemically synthesized
aggctttccatttcaccataac

SEQ ID NO: 854932 - DNA, 22 bp, Artificial Sequence
  chemically synthesized
aaggaccaaaagttatggtgaa

SEQ ID NO: 854933 - DNA, 22 bp, Artificial Sequence
  chemically synthesized
taggctttccatttcaccataa

SEQ ID NO: 854934 - DNA, 22 bp, Artificial Sequence
  chemically synthesized
aggaccaaaagttatggtgaaa

SEQ ID NO: 854935 - DNA, 22 bp, Artificial Sequence
  chemically synthesized
ttaggctttccatttcaccata

SEQ ID NO: 854936 - DNA, 22 bp, Artificial Sequence
  chemically synthesized
ccttttaggctttccatttcac

SEQ ID NO: 854937 - DNA, 22 bp, Artificial Sequence
  chemically synthesized
ggacctgccttttaggctttcc

SEQ ID NO: 854938 - DNA, 22 bp, Artificial Sequence
  chemically synthesized
aggacctgccttttaggctttc

SEQ ID NO: 854939 - DNA, 22 bp, Artificial Sequence
  chemically synthesized
tggtgaaatggaaagcctaaaa

SEQ ID NO: 854940 - DNA, 22 bp, Artificial Sequence
  chemically synthesized
aagtttaggacctgccttttag

SEQ ID NO: 854941 - DNA, 22 bp, Artificial Sequence
  chemically synthesized
cctaaagtttaggacctgcctt

SEQ ID NO: 854942 - DNA, 22 bp, Artificial Sequence
  chemically synthesized
ttccctaaagtttaggacctgc

SEQ ID NO: 854943 - DNA, 22 bp, Artificial Sequence
  chemically synthesized
ttgttccctaaagtttaggacc

SEQ ID NO: 854944 - DNA, 22 bp, Artificial Sequence
  chemically synthesized
aaaggcaggtcctaaactttag

SEQ ID NO: 854945 - DNA, 22 bp, Artificial Sequence
  chemically synthesized
tataatgttattgttccctaaa

SEQ ID NO: 854946 - DNA, 22 bp, Artificial Sequence
  chemically synthesized
aaagttatataatgttattgtt

SEQ ID NO: 854947 - DNA, 22 bp, Artificial Sequence
  chemically synthesized
aactttagggaacaataacatt

SEQ ID NO: 854948 - DNA, 22 bp, Artificial Sequence
  chemically synthesized
tgaaagttatataatgttattg

SEQ ID NO: 854949 - DNA, 22 bp, Artificial Sequence
  chemically synthesized
ctgaaagttatataatgttatt

SEQ ID NO: 854950 - DNA, 22 bp, Artificial Sequence
  chemically synthesized
tctgaaagttatataatgttat

SEQ ID NO: 854951 - DNA, 22 bp, Artificial Sequence
  chemically synthesized
tagggaacaataacattatata

SEQ ID NO: 854952 - DNA, 22 bp, Artificial Sequence
  chemically synthesized
agggaacaataacattatataa

SEQ ID NO: 854953 - DNA, 22 bp, Artificial Sequence
  chemically synthesized
attttctgaaagttatataatg

SEQ ID NO: 854954 - DNA, 22 bp, Artificial Sequence
  chemically synthesized
gggaacaataacattatataac

SEQ ID NO: 854955 - DNA, 22 bp, Artificial Sequence
  chemically synthesized
aattttctgaaagttatataat

SEQ ID NO: 854956 - DNA, 22 bp, Artificial Sequence
  chemically synthesized
taattttctgaaagttatataa

SEQ ID NO: 854957 - DNA, 22 bp, Artificial Sequence
  chemically synthesized
ttaattttctgaaagttatata

SEQ ID NO: 854958 - DNA, 22 bp, Artificial Sequence
  chemically synthesized
tttaattttctgaaagttatat

SEQ ID NO: 854959 - DNA, 22 bp, Artificial Sequence
  chemically synthesized
ttttaattttctgaaagttata

SEQ ID NO: 854960 - DNA, 22 bp, Artificial Sequence
  chemically synthesized
tttttaattttctgaaagttat

SEQ ID NO: 854961 - DNA, 22 bp, Artificial Sequence
  chemically synthesized
ttttttaattttctgaaagtta

SEQ ID NO: 854962 - DNA, 22 bp, Artificial Sequence
  chemically synthesized
tataactttcagaaaattaaaa

SEQ ID NO: 854963 - DNA, 22 bp, Artificial Sequence
  chemically synthesized
tcagaaaattaaaaaaaaacct

SEQ ID NO: 854964 - DNA, 22 bp, Artificial Sequence
  chemically synthesized
cagaaaattaaaaaaaaacctt

SEQ ID NO: 854965 - DNA, 22 bp, Artificial Sequence
  chemically synthesized
agaaaattaaaaaaaaacctta

SEQ ID NO: 854966 - DNA, 22 bp, Artificial Sequence
  chemically synthesized
caggaaagcaatgtaataaggt

SEQ ID NO: 854967 - DNA, 22 bp, Artificial Sequence
  chemically synthesized
acaggaaagcaatgtaataagg

SEQ ID NO: 854968 - DNA, 22 bp, Artificial Sequence
  chemically synthesized
ttacaggaaagcaatgtaataa

SEQ ID NO: 854969 - DNA, 22 bp, Artificial Sequence
  chemically synthesized
cttacaggaaagcaatgtaata

SEQ ID NO: 854970 - DNA, 22 bp, Artificial Sequence
  chemically synthesized
aaaaaaaaccttattacattgc

SEQ ID NO: 854971 - DNA, 22 bp, Artificial Sequence
  chemically synthesized
tcttacaggaaagcaatgtaat

SEQ ID NO: 854972 - DNA, 22 bp, Artificial Sequence
  chemically synthesized
actttcttacaggaaagcaatg

SEQ ID NO: 854973 - DNA, 22 bp, Artificial Sequence
  chemically synthesized
taactttcttacaggaaagcaa

SEQ ID NO: 854974 - DNA, 22 bp, Artificial Sequence
  chemically synthesized
tctaactttcttacaggaaagc

SEQ ID NO: 854975 - DNA, 22 bp, Artificial Sequence
  chemically synthesized
ctctaactttcttacaggaaag

SEQ ID NO: 854976 - DNA, 22 bp, Artificial Sequence
  chemically synthesized
attacattgctttcctgtaaga

SEQ ID NO: 854977 - DNA, 22 bp, Artificial Sequence
  chemically synthesized
ttacattgctttcctgtaagaa

SEQ ID NO: 854978 - DNA, 22 bp, Artificial Sequence
  chemically synthesized
ggtcttctctaactttcttaca

SEQ ID NO: 854979 - DNA, 22 bp, Artificial Sequence
  chemically synthesized
cattgctttcctgtaagaaagt

SEQ ID NO: 854980 - DNA, 22 bp, Artificial Sequence
  chemically synthesized
ctttcctgtaagaaagttagag

SEQ ID NO: 854981 - DNA, 22 bp, Artificial Sequence
  chemically synthesized
tcctgtaagaaagttagagaag

SEQ ID NO: 854982 - DNA, 22 bp, Artificial Sequence
  chemically synthesized
cctgtaagaaagttagagaaga

SEQ ID NO: 854983 - DNA, 22 bp, Artificial Sequence
  chemically synthesized
ctgtaagaaagttagagaagac

SEQ ID NO: 854984 - DNA, 22 bp, Artificial Sequence
  chemically synthesized
taagaaagttagagaagaccca

SEQ ID NO: 854985 - DNA, 22 bp, Artificial Sequence
  chemically synthesized
atagaaatacgtagaatctggg

SEQ ID NO: 854986 - DNA, 22 bp, Artificial Sequence
  chemically synthesized
catagaaatacgtagaatctgg

SEQ ID NO: 854987 - DNA, 22 bp, Artificial Sequence
  chemically synthesized
tcatagaaatacgtagaatctg

SEQ ID NO: 854988 - DNA, 22 bp, Artificial Sequence
  chemically synthesized
gagaagacccagattctacgta

SEQ ID NO: 854989 - DNA, 22 bp, Artificial Sequence
  chemically synthesized
ttttcatagaaatacgtagaat

SEQ ID NO: 854990 - DNA, 22 bp, Artificial Sequence
  chemically synthesized
ttgttttcatagaaatacgtag

SEQ ID NO: 854991 - DNA, 22 bp, Artificial Sequence
  chemically synthesized
attgttttcatagaaatacgta

SEQ ID NO: 854992 - DNA, 22 bp, Artificial Sequence
  chemically synthesized
tattgttttcatagaaatacgt

SEQ ID NO: 854993 - DNA, 22 bp, Artificial Sequence
  chemically synthesized
ttattgttttcatagaaatacg

SEQ ID NO: 854994 - DNA, 22 bp, Artificial Sequence
  chemically synthesized
tacgtatttctatgaaaacaat

SEQ ID NO: 854995 - DNA, 22 bp, Artificial Sequence
  chemically synthesized
cgtatttctatgaaaacaataa

SEQ ID NO: 854996 - DNA, 22 bp, Artificial Sequence
  chemically synthesized
tatggagtgatttttattgttt

SEQ ID NO: 854997 - DNA, 22 bp, Artificial Sequence
  chemically synthesized
atatggagtgatttttattgtt

SEQ ID NO: 854998 - DNA, 22 bp, Artificial Sequence
  chemically synthesized
tatatggagtgatttttattgt

SEQ ID NO: 854999 - DNA, 22 bp, Artificial Sequence
  chemically synthesized
ctttatatggagtgatttttat

SEQ ID NO: 855000 - DNA, 22 bp, Artificial Sequence
  chemically synthesized
ctatgaaaacaataaaaatcac

SEQ ID NO: 855001 - DNA, 22 bp, Artificial Sequence
  chemically synthesized
tatgaaaacaataaaaatcact

SEQ ID NO: 855002 - DNA, 22 bp, Artificial Sequence
  chemically synthesized
tgaaaacaataaaaatcactcc

SEQ ID NO: 855003 - DNA, 22 bp, Artificial Sequence
  chemically synthesized
gggctcctttatatggagtgat

SEQ ID NO: 855004 - DNA, 22 bp, Artificial Sequence
  chemically synthesized
gttagggctcctttatatggag

SEQ ID NO: 855005 - DNA, 22 bp, Artificial Sequence
  chemically synthesized
gatctagttagggctcctttat

SEQ ID NO: 855006 - DNA, 22 bp, Artificial Sequence
  chemically synthesized
ggatctagttagggctccttta

SEQ ID NO: 855007 - DNA, 22 bp, Artificial Sequence
  chemically synthesized
ttggatctagttagggctcctt

SEQ ID NO: 855008 - DNA, 22 bp, Artificial Sequence
  chemically synthesized
cttggatctagttagggctcct

SEQ ID NO: 855009 - DNA, 22 bp, Artificial Sequence
  chemically synthesized
tcttggatctagttagggctcc

SEQ ID NO: 855010 - DNA, 22 bp, Artificial Sequence
  chemically synthesized
ctttcttggatctagttagggc

SEQ ID NO: 855011 - DNA, 22 bp, Artificial Sequence
  chemically synthesized
catataaaggagccctaactag

SEQ ID NO: 855012 - DNA, 22 bp, Artificial Sequence
  chemically synthesized
cctttcttggatctagttaggg

SEQ ID NO: 855013 - DNA, 22 bp, Artificial Sequence
  chemically synthesized
caaatttcctttcttggatcta

SEQ ID NO: 855014 - DNA, 22 bp, Artificial Sequence
  chemically synthesized
acaaatttcctttcttggatct

SEQ ID NO: 855015 - DNA, 22 bp, Artificial Sequence
  chemically synthesized
tttacaaatttcctttcttgga

SEQ ID NO: 855016 - DNA, 22 bp, Artificial Sequence
  chemically synthesized
tatttacaaatttcctttcttg

SEQ ID NO: 855017 - DNA, 22 bp, Artificial Sequence
  chemically synthesized
actagatccaagaaaggaaatt

SEQ ID NO: 855018 - DNA, 22 bp, Artificial Sequence
  chemically synthesized
gatccaagaaaggaaatttgta

SEQ ID NO: 855019 - DNA, 22 bp, Artificial Sequence
  chemically synthesized
gagaattctatttacaaatttc

SEQ ID NO: 855020 - DNA, 22 bp, Artificial Sequence
  chemically synthesized
aaataaataaataattagagaa

SEQ ID NO: 855021 - DNA, 22 bp, Artificial Sequence
  chemically synthesized
gtaaatagaattctctaattat

SEQ ID NO: 855022 - DNA, 22 bp, Artificial Sequence
  chemically synthesized
taaatagaattctctaattatt

SEQ ID NO: 855023 - DNA, 22 bp, Artificial Sequence
  chemically synthesized
cgtctcaaataaataaataatt

SEQ ID NO: 855024 - DNA, 22 bp, Artificial Sequence
  chemically synthesized
tctaattatttatttatttgag

SEQ ID NO: 855025 - DNA, 22 bp, Artificial Sequence
  chemically synthesized
taattatttatttatttgagac

SEQ ID NO: 855026 - DNA, 22 bp, Artificial Sequence
  chemically synthesized
attatttatttatttgagacgg

SEQ ID NO: 855027 - DNA, 22 bp, Artificial Sequence
  chemically synthesized
tttatttatttgagacggagtt

SEQ ID NO: 855028 - DNA, 22 bp, Artificial Sequence
  chemically synthesized
ggcaacaagagcgaaactccgt

SEQ ID NO: 855029 - DNA, 22 bp, Artificial Sequence
  chemically synthesized
atttatttgagacggagtttcg

SEQ ID NO: 855030 - DNA, 22 bp, Artificial Sequence
  chemically synthesized
tttatttgagacggagtttcgc

SEQ ID NO: 855031 - DNA, 22 bp, Artificial Sequence
  chemically synthesized
atttgagacggagtttcgctct

SEQ ID NO: 855032 - DNA, 22 bp, Artificial Sequence
  chemically synthesized
tttgagacggagtttcgctctt

SEQ ID NO: 855033 - DNA, 22 bp, Artificial Sequence
  chemically synthesized
cagcctgggcaacaagagcgaa

SEQ ID NO: 855034 - DNA, 22 bp, Artificial Sequence
  chemically synthesized
gagacggagtttcgctcttgtt

SEQ ID NO: 855035 - DNA, 22 bp, Artificial Sequence
  chemically synthesized
agacggagtttcgctcttgttg

SEQ ID NO: 855036 - DNA, 22 bp, Artificial Sequence
  chemically synthesized
cactccagcctgggcaacaaga

SEQ ID NO: 855037 - DNA, 22 bp, Artificial Sequence
  chemically synthesized
cgctcttgttgcccaggctgga

SEQ ID NO: 855038 - DNA, 22 bp, Artificial Sequence
  chemically synthesized
gctcttgttgcccaggctggag

SEQ ID NO: 855039 - DNA, 22 bp, Artificial Sequence
  chemically synthesized
ttgttgcccaggctggagtgca

SEQ ID NO: 855040 - DNA, 22 bp, Artificial Sequence
  chemically synthesized
gttgcccaggctggagtgcaat

SEQ ID NO: 855041 - DNA, 22 bp, Artificial Sequence
  chemically synthesized
ttgcccaggctggagtgcaatg

SEQ ID NO: 855042 - DNA, 22 bp, Artificial Sequence
  chemically synthesized
cccaggctggagtgcaatggtg

SEQ ID NO: 855043 - DNA, 22 bp, Artificial Sequence
  chemically synthesized
cagtgagccgagatcacaccat

SEQ ID NO: 855044 - DNA, 22 bp, Artificial Sequence
  chemically synthesized
gagtgcaatggtgtgatctcgg

SEQ ID NO: 855045 - DNA, 22 bp, Artificial Sequence
  chemically synthesized
aacccgggaggcagatgttgca

SEQ ID NO: 855046 - DNA, 22 bp, Artificial Sequence
  chemically synthesized
gaacccgggaggcagatgttgc

SEQ ID NO: 855047 - DNA, 22 bp, Artificial Sequence
  chemically synthesized
ggctcactgcaacatctgcctc

SEQ ID NO: 855048 - DNA, 22 bp, Artificial Sequence
  chemically synthesized
actgcaacatctgcctcccggg

SEQ ID NO: 855049 - DNA, 22 bp, Artificial Sequence
  chemically synthesized
caacatctgcctcccgggttca

SEQ ID NO: 855050 - DNA, 22 bp, Artificial Sequence
  chemically synthesized
aggcaggagaatcgcttgaacc

SEQ ID NO: 855051 - DNA, 22 bp, Artificial Sequence
  chemically synthesized
cctcccgggttcaagcgattct

SEQ ID NO: 855052 - DNA, 22 bp, Artificial Sequence
  chemically synthesized
aggctgaggcaggagaatcgct

SEQ ID NO: 855053 - DNA, 22 bp, Artificial Sequence
  chemically synthesized
ccgggttcaagcgattctcctg

SEQ ID NO: 855054 - DNA, 22 bp, Artificial Sequence
  chemically synthesized
ctgaggctgaggcaggagaatc

SEQ ID NO: 855055 - DNA, 22 bp, Artificial Sequence
  chemically synthesized
ctcctgaggctgaggcaggaga

SEQ ID NO: 855056 - DNA, 22 bp, Artificial Sequence
  chemically synthesized
aagcgattctcctgcctcagcc

SEQ ID NO: 855057 - DNA, 22 bp, Artificial Sequence
  chemically synthesized
tagccccagctactcctgaggc

SEQ ID NO: 855058 - DNA, 22 bp, Artificial Sequence
  chemically synthesized
tcctgcctcagcctcaggagta

SEQ ID NO: 855059 - DNA, 22 bp, Artificial Sequence
  chemically synthesized
ctgcctcagcctcaggagtagc

SEQ ID NO: 855060 - DNA, 22 bp, Artificial Sequence
  chemically synthesized
cctcagcctcaggagtagctgg

SEQ ID NO: 855061 - DNA, 22 bp, Artificial Sequence
  chemically synthesized
agcctcaggagtagctggggct

SEQ ID NO: 855062 - DNA, 22 bp, Artificial Sequence
  chemically synthesized
aggagtagctggggctacaggc

SEQ ID NO: 855063 - DNA, 22 bp, Artificial Sequence
  chemically synthesized
gccgggcgtggtggcgcatgcc

SEQ ID NO: 855064 - DNA, 22 bp, Artificial Sequence
  chemically synthesized
gggctacaggcatgcgccacca

SEQ ID NO: 855065 - DNA, 22 bp, Artificial Sequence
  chemically synthesized
caggcatgcgccaccacgcccg

SEQ ID NO: 855066 - DNA, 22 bp, Artificial Sequence
  chemically synthesized
aaaatacaaaattagccgggcg

SEQ ID NO: 855067 - DNA, 22 bp, Artificial Sequence
  chemically synthesized
ctaaaaatacaaaattagccgg

SEQ ID NO: 855068 - DNA, 22 bp, Artificial Sequence
  chemically synthesized
tactaaaaatacaaaattagcc

SEQ ID NO: 855069 - DNA, 22 bp, Artificial Sequence
  chemically synthesized
attttgtatttttagtagagac

SEQ ID NO: 855070 - DNA, 22 bp, Artificial Sequence
  chemically synthesized
tgtatttttagtagagacgggg

SEQ ID NO: 855071 - DNA, 22 bp, Artificial Sequence
  chemically synthesized
gtatttttagtagagacggggt

SEQ ID NO: 855072 - DNA, 22 bp, Artificial Sequence
  chemically synthesized
tatttttagtagagacggggtt

SEQ ID NO: 855073 - DNA, 22 bp, Artificial Sequence
  chemically synthesized
accaacatggagaaaccccgtc

SEQ ID NO: 855074 - DNA, 22 bp, Artificial Sequence
  chemically synthesized
ttagtagagacggggtttctcc

SEQ ID NO: 855075 - DNA, 22 bp, Artificial Sequence
  chemically synthesized
tagtagagacggggtttctcca

SEQ ID NO: 855076 - DNA, 22 bp, Artificial Sequence
  chemically synthesized
agtagagacggggtttctccat

SEQ ID NO: 855077 - DNA, 22 bp, Artificial Sequence
  chemically synthesized
gtagagacggggtttctccatg

SEQ ID NO: 855078 - DNA, 22 bp, Artificial Sequence
  chemically synthesized
agaccagcctgaccaacatgga

SEQ ID NO: 855079 - DNA, 22 bp, Artificial Sequence
  chemically synthesized
gagaccagcctgaccaacatgg

SEQ ID NO: 855080 - DNA, 22 bp, Artificial Sequence
  chemically synthesized
ctccatgttggtcaggctggtc

SEQ ID NO: 855081 - DNA, 22 bp, Artificial Sequence
  chemically synthesized
tccatgttggtcaggctggtct

SEQ ID NO: 855082 - DNA, 22 bp, Artificial Sequence
  chemically synthesized
catgttggtcaggctggtctca

SEQ ID NO: 855083 - DNA, 22 bp, Artificial Sequence
  chemically synthesized
aggtcaggagtttgagaccagc

SEQ ID NO: 855084 - DNA, 22 bp, Artificial Sequence
  chemically synthesized
gtcaggctggtctcaaactcct

SEQ ID NO: 855085 - DNA, 22 bp, Artificial Sequence
  chemically synthesized
gtctcaaactcctgacctcagg

SEQ ID NO: 855086 - DNA, 22 bp, Artificial Sequence
  chemically synthesized
aggcgggtgtatcacctgaggt

SEQ ID NO: 855087 - DNA, 22 bp, Artificial Sequence
  chemically synthesized
aaactcctgacctcaggtgata

SEQ ID NO: 855088 - DNA, 22 bp, Artificial Sequence
  chemically synthesized
ggaggctgaggcgggtgtatca

SEQ ID NO: 855089 - DNA, 22 bp, Artificial Sequence
  chemically synthesized
ctgacctcaggtgatacacccg

SEQ ID NO: 855090 - DNA, 22 bp, Artificial Sequence
  chemically synthesized
gggaggctgaggcgggtgtatc

SEQ ID NO: 855091 - DNA, 22 bp, Artificial Sequence
  chemically synthesized
tgggaggctgaggcgggtgtat

SEQ ID NO: 855092 - DNA, 22 bp, Artificial Sequence
  chemically synthesized
acctcaggtgatacacccgcct

SEQ ID NO: 855093 - DNA, 22 bp, Artificial Sequence
  chemically synthesized
aggtgatacacccgcctcagcc

SEQ ID NO: 855094 - DNA, 22 bp, Artificial Sequence
  chemically synthesized
taatcccagcactttgggaggc

SEQ ID NO: 855095 - DNA, 22 bp, Artificial Sequence
  chemically synthesized
acgcctgtaatcccagcacttt

SEQ ID NO: 855096 - DNA, 22 bp, Artificial Sequence
  chemically synthesized
agcctcccaaagtgctgggatt

SEQ ID NO: 855097 - DNA, 22 bp, Artificial Sequence
  chemically synthesized
ccaaagtgctgggattacaggc

SEQ ID NO: 855098 - DNA, 22 bp, Artificial Sequence
  chemically synthesized
ggccgggcatggtagctcacgc

SEQ ID NO: 855099 - DNA, 22 bp, Artificial Sequence
  chemically synthesized
tgggccgggcatggtagctcac

SEQ ID NO: 855100 - DNA, 22 bp, Artificial Sequence
  chemically synthesized
ggattacaggcgtgagctacca

SEQ ID NO: 855101 - DNA, 22 bp, Artificial Sequence
  chemically synthesized
caggcgtgagctaccatgcccg

SEQ ID NO: 855102 - DNA, 22 bp, Artificial Sequence
  chemically synthesized
aatagagaattctgggccgggc

SEQ ID NO: 855103 - DNA, 22 bp, Artificial Sequence
  chemically synthesized
aaatagagaattctgggccggg

SEQ ID NO: 855104 - DNA, 22 bp, Artificial Sequence
  chemically synthesized
tgtttaaatagagaattctggg

SEQ ID NO: 855105 - DNA, 22 bp, Artificial Sequence
  chemically synthesized
ccatgcccggcccagaattctc

SEQ ID NO: 855106 - DNA, 22 bp, Artificial Sequence
  chemically synthesized
ccattgtgtttaaatagagaat

SEQ ID NO: 855107 - DNA, 22 bp, Artificial Sequence
  chemically synthesized
gccattgtgtttaaatagagaa

SEQ ID NO: 855108 - DNA, 22 bp, Artificial Sequence
  chemically synthesized
tgtttgccattgtgtttaaata

SEQ ID NO: 855109 - DNA, 22 bp, Artificial Sequence
  chemically synthesized
atgtttgccattgtgtttaaat

SEQ ID NO: 855110 - DNA, 22 bp, Artificial Sequence
  chemically synthesized
tctatttaaacacaatggcaaa

SEQ ID NO: 855111 - DNA, 22 bp, Artificial Sequence
  chemically synthesized
tatttaaacacaatggcaaaca

SEQ ID NO: 855112 - DNA, 22 bp, Artificial Sequence
  chemically synthesized
ataaggaagtttatgtttgcca

SEQ ID NO: 855113 - DNA, 22 bp, Artificial Sequence
  chemically synthesized
tttaaacacaatggcaaacata

SEQ ID NO: 855114 - DNA, 22 bp, Artificial Sequence
  chemically synthesized
tgataaggaagtttatgtttgc

SEQ ID NO: 855115 - DNA, 22 bp, Artificial Sequence
  chemically synthesized
aaacacaatggcaaacataaac

SEQ ID NO: 855116 - DNA, 22 bp, Artificial Sequence
  chemically synthesized
aacacaatggcaaacataaact

SEQ ID NO: 855117 - DNA, 22 bp, Artificial Sequence
  chemically synthesized
cataaaataccagtgggattct

SEQ ID NO: 855118 - DNA, 22 bp, Artificial Sequence
  chemically synthesized
ccataaaataccagtgggattc

SEQ ID NO: 855119 - DNA, 22 bp, Artificial Sequence
  chemically synthesized
tccataaaataccagtgggatt

SEQ ID NO: 855120 - DNA, 22 bp, Artificial Sequence
  chemically synthesized
ccttatcagaatcccactggta

SEQ ID NO: 855121 - DNA, 22 bp, Artificial Sequence
  chemically synthesized
cttatcagaatcccactggtat

SEQ ID NO: 855122 - DNA, 22 bp, Artificial Sequence
  chemically synthesized
tgttttccataaaataccagtg

SEQ ID NO: 855123 - DNA, 22 bp, Artificial Sequence
  chemically synthesized
atcagaatcccactggtatttt

SEQ ID NO: 855124 - DNA, 22 bp, Artificial Sequence
  chemically synthesized
tcagaatcccactggtatttta

SEQ ID NO: 855125 - DNA, 22 bp, Artificial Sequence
  chemically synthesized
tactgtgttttccataaaatac

SEQ ID NO: 855126 - DNA, 22 bp, Artificial Sequence
  chemically synthesized
gtattttatggaaaacacagta

SEQ ID NO: 855127 - DNA, 22 bp, Artificial Sequence
  chemically synthesized
atggaagtcactgtactgtgtt

SEQ ID NO: 855128 - DNA, 22 bp, Artificial Sequence
  chemically synthesized
tgatggaagtcactgtactgtg

SEQ ID NO: 855129 - DNA, 22 bp, Artificial Sequence
  chemically synthesized
tatggaaaacacagtacagtga

SEQ ID NO: 855130 - DNA, 22 bp, Artificial Sequence
  chemically synthesized
atggaaaacacagtacagtgac

SEQ ID NO: 855131 - DNA, 22 bp, Artificial Sequence
  chemically synthesized
tggaaaacacagtacagtgact

SEQ ID NO: 855132 - DNA, 22 bp, Artificial Sequence
  chemically synthesized
catgaattctgatggaagtcac

SEQ ID NO: 855133 - DNA, 22 bp, Artificial Sequence
  chemically synthesized
acatgaattctgatggaagtca

SEQ ID NO: 855134 - DNA, 22 bp, Artificial Sequence
  chemically synthesized
atccaggatatttacatgaatt

SEQ ID NO: 855135 - DNA, 22 bp, Artificial Sequence
  chemically synthesized
ccatcagaattcatgtaaatat

SEQ ID NO: 855136 - DNA, 22 bp, Artificial Sequence
  chemically synthesized
catcagaattcatgtaaatatc

SEQ ID NO: 855137 - DNA, 22 bp, Artificial Sequence
  chemically synthesized
tcaagcaaaactgatccaggat

SEQ ID NO: 855138 - DNA, 22 bp, Artificial Sequence
  chemically synthesized
atcaagcaaaactgatccagga

SEQ ID NO: 855139 - DNA, 22 bp, Artificial Sequence
  chemically synthesized
atgtaaatatcctggatcagtt

SEQ ID NO: 855140 - DNA, 22 bp, Artificial Sequence
  chemically synthesized
tcaaaatcttatcaagcaaaac

SEQ ID NO: 855141 - DNA, 22 bp, Artificial Sequence
  chemically synthesized
tgtcaaaatcttatcaagcaaa

SEQ ID NO: 855142 - DNA, 22 bp, Artificial Sequence
  chemically synthesized
ctgtcaaaatcttatcaagcaa

SEQ ID NO: 855143 - DNA, 22 bp, Artificial Sequence
  chemically synthesized
tctgtcaaaatcttatcaagca

SEQ ID NO: 855144 - DNA, 22 bp, Artificial Sequence
  chemically synthesized
ttctgtcaaaatcttatcaagc

SEQ ID NO: 855145 - DNA, 22 bp, Artificial Sequence
  chemically synthesized
gatcagttttgcttgataagat

SEQ ID NO: 855146 - DNA, 22 bp, Artificial Sequence
  chemically synthesized
taaacttttctgtcaaaatctt

SEQ ID NO: 855147 - DNA, 22 bp, Artificial Sequence
  chemically synthesized
tgcttgataagattttgacaga

SEQ ID NO: 855148 - DNA, 22 bp, Artificial Sequence
  chemically synthesized
actgtaaacttttctgtcaaaa

SEQ ID NO: 855149 - DNA, 22 bp, Artificial Sequence
  chemically synthesized
gcttgataagattttgacagaa

SEQ ID NO: 855150 - DNA, 22 bp, Artificial Sequence
  chemically synthesized
cttgataagattttgacagaaa

SEQ ID NO: 855151 - DNA, 22 bp, Artificial Sequence
  chemically synthesized
gataagattttgacagaaaagt

SEQ ID NO: 855152 - DNA, 22 bp, Artificial Sequence
  chemically synthesized
aattcactgtaaacttttctgt

SEQ ID NO: 855153 - DNA, 22 bp, Artificial Sequence
  chemically synthesized
ataagattttgacagaaaagtt

SEQ ID NO: 855154 - DNA, 22 bp, Artificial Sequence
  chemically synthesized
attcaattcactgtaaactttt

SEQ ID NO: 855155 - DNA, 22 bp, Artificial Sequence
  chemically synthesized
aattcaattcactgtaaacttt

SEQ ID NO: 855156 - DNA, 22 bp, Artificial Sequence
  chemically synthesized
taattcaattcactgtaaactt

SEQ ID NO: 855157 - DNA, 22 bp, Artificial Sequence
  chemically synthesized
tgacagaaaagtttacagtgaa

SEQ ID NO: 855158 - DNA, 22 bp, Artificial Sequence
  chemically synthesized
gacagaaaagtttacagtgaat

SEQ ID NO: 855159 - DNA, 22 bp, Artificial Sequence
  chemically synthesized
tattttaattcaattcactgta

SEQ ID NO: 855160 - DNA, 22 bp, Artificial Sequence
  chemically synthesized
acagaaaagtttacagtgaatt

SEQ ID NO: 855161 - DNA, 22 bp, Artificial Sequence
  chemically synthesized
ttatattttaattcaattcact

SEQ ID NO: 855162 - DNA, 22 bp, Artificial Sequence
  chemically synthesized
attatattttaattcaattcac

SEQ ID NO: 855163 - DNA, 22 bp, Artificial Sequence
  chemically synthesized
acagtgaattgaattaaaatat

SEQ ID NO: 855164 - DNA, 22 bp, Artificial Sequence
  chemically synthesized
cagtgaattgaattaaaatata

SEQ ID NO: 855165 - DNA, 22 bp, Artificial Sequence
  chemically synthesized
aattaaaatataataagataca

SEQ ID NO: 855166 - DNA, 22 bp, Artificial Sequence
  chemically synthesized
tgaatggaaatgtgtatcttat

SEQ ID NO: 855167 - DNA, 22 bp, Artificial Sequence
  chemically synthesized
aaatataataagatacacattt

SEQ ID NO: 855168 - DNA, 22 bp, Artificial Sequence
  chemically synthesized
aaagtctatgaatggaaatgtg

SEQ ID NO: 855169 - DNA, 22 bp, Artificial Sequence
  chemically synthesized
caaagtctatgaatggaaatgt

SEQ ID NO: 855170 - DNA, 22 bp, Artificial Sequence
  chemically synthesized
cacatttcaaagtctatgaatg

SEQ ID NO: 855171 - DNA, 22 bp, Artificial Sequence
  chemically synthesized
aactacacatttcaaagtctat

SEQ ID NO: 855172 - DNA, 22 bp, Artificial Sequence
  chemically synthesized
tactaaactacacatttcaaag

SEQ ID NO: 855173 - DNA, 22 bp, Artificial Sequence
  chemically synthesized
ccattcatagactttgaaatgt

SEQ ID NO: 855174 - DNA, 22 bp, Artificial Sequence
  chemically synthesized
cattcatagactttgaaatgtg

SEQ ID NO: 855175 - DNA, 22 bp, Artificial Sequence
  chemically synthesized
atagactttgaaatgtgtagtt

SEQ ID NO: 855176 - DNA, 22 bp, Artificial Sequence
  chemically synthesized
taaactatactaaactacacat

SEQ ID NO: 855177 - DNA, 22 bp, Artificial Sequence
  chemically synthesized
ataaactatactaaactacaca

SEQ ID NO: 855178 - DNA, 22 bp, Artificial Sequence
  chemically synthesized
tgaaatgtgtagtttagtatag

SEQ ID NO: 855179 - DNA, 22 bp, Artificial Sequence
  chemically synthesized
gaaatgtgtagtttagtatagt

SEQ ID NO: 855180 - DNA, 22 bp, Artificial Sequence
  chemically synthesized
aaatgtgtagtttagtatagtt

SEQ ID NO: 855181 - DNA, 22 bp, Artificial Sequence
  chemically synthesized
cataaacttataaactatacta

SEQ ID NO: 855182 - DNA, 22 bp, Artificial Sequence
  chemically synthesized
aagaaactacataaacttataa

SEQ ID NO: 855183 - DNA, 22 bp, Artificial Sequence
  chemically synthesized
aaagaaactacataaacttata

SEQ ID NO: 855184 - DNA, 22 bp, Artificial Sequence
  chemically synthesized
ttaaagaaactacataaactta

SEQ ID NO: 855185 - DNA, 22 bp, Artificial Sequence
  chemically synthesized
agtatagtttataagtttatgt

SEQ ID NO: 855186 - DNA, 22 bp, Artificial Sequence
  chemically synthesized
cttaaagaaactacataaactt

SEQ ID NO: 855187 - DNA, 22 bp, Artificial Sequence
  chemically synthesized
gtatagtttataagtttatgta

SEQ ID NO: 855188 - DNA, 22 bp, Artificial Sequence
  chemically synthesized
tcttaaagaaactacataaact

SEQ ID NO: 855189 - DNA, 22 bp, Artificial Sequence
  chemically synthesized
ttcttaaagaaactacataaac

SEQ ID NO: 855190 - DNA, 22 bp, Artificial Sequence
  chemically synthesized
tttcttaaagaaactacataaa

SEQ ID NO: 855191 - DNA, 22 bp, Artificial Sequence
  chemically synthesized
ttttcttaaagaaactacataa

SEQ ID NO: 855192 - DNA, 22 bp, Artificial Sequence
  chemically synthesized
ataagtttatgtagtttcttta

SEQ ID NO: 855193 - DNA, 22 bp, Artificial Sequence
  chemically synthesized
taagtttatgtagtttctttaa

SEQ ID NO: 855194 - DNA, 22 bp, Artificial Sequence
  chemically synthesized
atgtagtttctttaagaaaaaa

SEQ ID NO: 855195 - DNA, 22 bp, Artificial Sequence
  chemically synthesized
tgtagtttctttaagaaaaaag

SEQ ID NO: 855196 - DNA, 22 bp, Artificial Sequence
  chemically synthesized
tggaaaatgataccatatgctt

SEQ ID NO: 855197 - DNA, 22 bp, Artificial Sequence
  chemically synthesized
ctttaagaaaaaagcatatggt

SEQ ID NO: 855198 - DNA, 22 bp, Artificial Sequence
  chemically synthesized
atggaaaatgataccatatgct

SEQ ID NO: 855199 - DNA, 22 bp, Artificial Sequence
  chemically synthesized
tttaagaaaaaagcatatggta

SEQ ID NO: 855200 - DNA, 22 bp, Artificial Sequence
  chemically synthesized
tatggaaaatgataccatatgc

SEQ ID NO: 855201 - DNA, 22 bp, Artificial Sequence
  chemically synthesized
ttatggaaaatgataccatatg

SEQ ID NO: 855202 - DNA, 22 bp, Artificial Sequence
  chemically synthesized
taagaaaaaagcatatggtatc

SEQ ID NO: 855203 - DNA, 22 bp, Artificial Sequence
  chemically synthesized
tttatggaaaatgataccatat

SEQ ID NO: 855204 - DNA, 22 bp, Artificial Sequence
  chemically synthesized
aagaaaaaagcatatggtatca

SEQ ID NO: 855205 - DNA, 22 bp, Artificial Sequence
  chemically synthesized
agaaaaaagcatatggtatcat

SEQ ID NO: 855206 - DNA, 22 bp, Artificial Sequence
  chemically synthesized
cctttttatggaaaatgatacc

SEQ ID NO: 855207 - DNA, 22 bp, Artificial Sequence
  chemically synthesized
attacctttttatggaaaatga

SEQ ID NO: 855208 - DNA, 22 bp, Artificial Sequence
  chemically synthesized
ctaattacctttttatggaaaa

SEQ ID NO: 855209 - DNA, 22 bp, Artificial Sequence
  chemically synthesized
agtctcctaattacctttttat

SEQ ID NO: 855210 - DNA, 22 bp, Artificial Sequence
  chemically synthesized
taagtctcctaattaccttttt

SEQ ID NO: 855211 - DNA, 22 bp, Artificial Sequence
  chemically synthesized
ctaagtctcctaattacctttt

SEQ ID NO: 855212 - DNA, 22 bp, Artificial Sequence
  chemically synthesized
tctaagtctcctaattaccttt

SEQ ID NO: 855213 - DNA, 22 bp, Artificial Sequence
  chemically synthesized
tccataaaaaggtaattaggag

SEQ ID NO: 855214 - DNA, 22 bp, Artificial Sequence
  chemically synthesized
ccataaaaaggtaattaggaga

SEQ ID NO: 855215 - DNA, 22 bp, Artificial Sequence
  chemically synthesized
cataaaaaggtaattaggagac

SEQ ID NO: 855216 - DNA, 22 bp, Artificial Sequence
  chemically synthesized
ggagacttagaaaatatgattt

SEQ ID NO: 855217 - DNA, 22 bp, Artificial Sequence
  chemically synthesized
agaaaatatgattttgtgtgtg

SEQ ID NO: 855218 - DNA, 22 bp, Artificial Sequence
  chemically synthesized
gaaaatatgattttgtgtgtgt

SEQ ID NO: 855219 - DNA, 22 bp, Artificial Sequence
  chemically synthesized
caaacacacacacacacacaca

SEQ ID NO: 855220 - DNA, 22 bp, Artificial Sequence
  chemically synthesized
tgtgtgtgtgtgtgtgtgtgtg

SEQ ID NO: 855221 - DNA, 22 bp, Artificial Sequence
  chemically synthesized
gtgtgtgtgtgtgtgtgtgtgt

SEQ ID NO: 855222 - DNA, 22 bp, Artificial Sequence
  chemically synthesized
tgtgtgtgtgtgtgtgtgtgtg

SEQ ID NO: 855223 - DNA, 22 bp, Artificial Sequence
  chemically synthesized
aataaaaaggtcatagagttgc

SEQ ID NO: 855224 - DNA, 22 bp, Artificial Sequence
  chemically synthesized
aaataaaaaggtcatagagttg

SEQ ID NO: 855225 - DNA, 22 bp, Artificial Sequence
  chemically synthesized
gcaactctatgacctttttatt

SEQ ID NO: 855226 - DNA, 22 bp, Artificial Sequence
  chemically synthesized
caactctatgacctttttattt

SEQ ID NO: 855227 - DNA, 22 bp, Artificial Sequence
  chemically synthesized
tatgacctttttatttaagggg

SEQ ID NO: 855228 - DNA, 22 bp, Artificial Sequence
  chemically synthesized
tgacctttttatttaaggggcg

SEQ ID NO: 855229 - DNA, 22 bp, Artificial Sequence
  chemically synthesized
gtcataacaaaaataaaccgcc

SEQ ID NO: 855230 - DNA, 22 bp, Artificial Sequence
  chemically synthesized
tttatttaaggggcggtttatt

SEQ ID NO: 855231 - DNA, 22 bp, Artificial Sequence
  chemically synthesized
ttatttaaggggcggtttattt

SEQ ID NO: 855232 - DNA, 22 bp, Artificial Sequence
  chemically synthesized
tggtcataacaaaaataaaccg

SEQ ID NO: 855233 - DNA, 22 bp, Artificial Sequence
  chemically synthesized
tatttaaggggcggtttatttt

SEQ ID NO: 855234 - DNA, 22 bp, Artificial Sequence
  chemically synthesized
atttaaggggcggtttattttt

SEQ ID NO: 855235 - DNA, 22 bp, Artificial Sequence
  chemically synthesized
tctggtcataacaaaaataaac

SEQ ID NO: 855236 - DNA, 22 bp, Artificial Sequence
  chemically synthesized
tttaaggggcggtttatttttg

SEQ ID NO: 855237 - DNA, 22 bp, Artificial Sequence
  chemically synthesized
aaggggcggtttatttttgtta

SEQ ID NO: 855238 - DNA, 22 bp, Artificial Sequence
  chemically synthesized
aggggcggtttatttttgttat

SEQ ID NO: 855239 - DNA, 22 bp, Artificial Sequence
  chemically synthesized
tattctctggtcataacaaaaa

SEQ ID NO: 855240 - DNA, 22 bp, Artificial Sequence
  chemically synthesized
atattctctggtcataacaaaa

SEQ ID NO: 855241 - DNA, 22 bp, Artificial Sequence
  chemically synthesized
tatattctctggtcataacaaa

SEQ ID NO: 855242 - DNA, 22 bp, Artificial Sequence
  chemically synthesized
ttttatattctctggtcataac

SEQ ID NO: 855243 - DNA, 22 bp, Artificial Sequence
  chemically synthesized
attttatattctctggtcataa

SEQ ID NO: 855244 - DNA, 22 bp, Artificial Sequence
  chemically synthesized
atttttgttatgaccagagaat

SEQ ID NO: 855245 - DNA, 22 bp, Artificial Sequence
  chemically synthesized
tttttgttatgaccagagaata

SEQ ID NO: 855246 - DNA, 22 bp, Artificial Sequence
  chemically synthesized
ttgttatgaccagagaatataa

SEQ ID NO: 855247 - DNA, 22 bp, Artificial Sequence
  chemically synthesized
tgttatgaccagagaatataaa

SEQ ID NO: 855248 - DNA, 22 bp, Artificial Sequence
  chemically synthesized
gttatgaccagagaatataaaa

SEQ ID NO: 855249 - DNA, 22 bp, Artificial Sequence
  chemically synthesized
ttatgaccagagaatataaaat

SEQ ID NO: 855250 - DNA, 22 bp, Artificial Sequence
  chemically synthesized
tgaccagagaatataaaataag

SEQ ID NO: 855251 - DNA, 22 bp, Artificial Sequence
  chemically synthesized
aacgaaggatgtaaagatatgt

SEQ ID NO: 855252 - DNA, 22 bp, Artificial Sequence
  chemically synthesized
caacgaaggatgtaaagatatg

SEQ ID NO: 855253 - DNA, 22 bp, Artificial Sequence
  chemically synthesized
ctgacactgacatatctttaca

SEQ ID NO: 855254 - DNA, 22 bp, Artificial Sequence
  chemically synthesized
tcttcaacgaaggatgtaaaga

SEQ ID NO: 855255 - DNA, 22 bp, Artificial Sequence
  chemically synthesized
acactgacatatctttacatcc

SEQ ID NO: 855256 - DNA, 22 bp, Artificial Sequence
  chemically synthesized
ttatcttcaacgaaggatgtaa

SEQ ID NO: 855257 - DNA, 22 bp, Artificial Sequence
  chemically synthesized
acatatctttacatccttcgtt

SEQ ID NO: 855258 - DNA, 22 bp, Artificial Sequence
  chemically synthesized
tacatccttcgttgaagataat

SEQ ID NO: 855259 - DNA, 22 bp, Artificial Sequence
  chemically synthesized
acatccttcgttgaagataata

SEQ ID NO: 855260 - DNA, 22 bp, Artificial Sequence
  chemically synthesized
catccttcgttgaagataatag

SEQ ID NO: 855261 - DNA, 22 bp, Artificial Sequence
  chemically synthesized
atgagaccaaatccactattat

SEQ ID NO: 855262 - DNA, 22 bp, Artificial Sequence
  chemically synthesized
cgttgaagataatagtggattt

SEQ ID NO: 855263 - DNA, 22 bp, Artificial Sequence
  chemically synthesized
cctaatgagaccaaatccacta

SEQ ID NO: 855264 - DNA, 22 bp, Artificial Sequence
  chemically synthesized
gttgaagataatagtggatttg

SEQ ID NO: 855265 - DNA, 22 bp, Artificial Sequence
  chemically synthesized
acctaatgagaccaaatccact

SEQ ID NO: 855266 - DNA, 22 bp, Artificial Sequence
  chemically synthesized
tacctaatgagaccaaatccac

SEQ ID NO: 855267 - DNA, 22 bp, Artificial Sequence
  chemically synthesized
tttacctaatgagaccaaatcc

SEQ ID NO: 855268 - DNA, 22 bp, Artificial Sequence
  chemically synthesized
aagataatagtggatttggtct

SEQ ID NO: 855269 - DNA, 22 bp, Artificial Sequence
  chemically synthesized
ctttacctaatgagaccaaatc

SEQ ID NO: 855270 - DNA, 22 bp, Artificial Sequence
  chemically synthesized
tctttacctaatgagaccaaat

SEQ ID NO: 855271 - DNA, 22 bp, Artificial Sequence
  chemically synthesized
tttctttacctaatgagaccaa

SEQ ID NO: 855272 - DNA, 22 bp, Artificial Sequence
  chemically synthesized
ctttctttacctaatgagacca

SEQ ID NO: 855273 - DNA, 22 bp, Artificial Sequence
  chemically synthesized
tctttctttacctaatgagacc

SEQ ID NO: 855274 - DNA, 22 bp, Artificial Sequence
  chemically synthesized
tataattttctttctttaccta

SEQ ID NO: 855275 - DNA, 22 bp, Artificial Sequence
  chemically synthesized
atataattttctttctttacct

SEQ ID NO: 855276 - DNA, 22 bp, Artificial Sequence
  chemically synthesized
ggtctcattaggtaaagaaaga

SEQ ID NO: 855277 - DNA, 22 bp, Artificial Sequence
  chemically synthesized
gtctcattaggtaaagaaagaa

SEQ ID NO: 855278 - DNA, 22 bp, Artificial Sequence
  chemically synthesized
attaggtaaagaaagaaaatta

SEQ ID NO: 855279 - DNA, 22 bp, Artificial Sequence
  chemically synthesized
atccatatttatataattttct

SEQ ID NO: 855280 - DNA, 22 bp, Artificial Sequence
  chemically synthesized
ggtaaagaaagaaaattatata

SEQ ID NO: 855281 - DNA, 22 bp, Artificial Sequence
  chemically synthesized
gatgactgatccatatttatat

SEQ ID NO: 855282 - DNA, 22 bp, Artificial Sequence
  chemically synthesized
cgaccatctggatgactgatcc

SEQ ID NO: 855283 - DNA, 22 bp, Artificial Sequence
  chemically synthesized
gcgaccatctggatgactgatc

SEQ ID NO: 855284 - DNA, 22 bp, Artificial Sequence
  chemically synthesized
tataaatatggatcagtcatcc

SEQ ID NO: 855285 - DNA, 22 bp, Artificial Sequence
  chemically synthesized
gtagacagcttgcgaccatctg

SEQ ID NO: 855286 - DNA, 22 bp, Artificial Sequence
  chemically synthesized
tggtagacagcttgcgaccatc

SEQ ID NO: 855287 - DNA, 22 bp, Artificial Sequence
  chemically synthesized
caacaaatgtacatgtctctgg

SEQ ID NO: 855288 - DNA, 22 bp, Artificial Sequence
  chemically synthesized
ccaacaaatgtacatgtctctg

SEQ ID NO: 855289 - DNA, 22 bp, Artificial Sequence
  chemically synthesized
tcttccaacaaatgtacatgtc

SEQ ID NO: 855290 - DNA, 22 bp, Artificial Sequence
  chemically synthesized
tctaccagagacatgtacattt

SEQ ID NO: 855291 - DNA, 22 bp, Artificial Sequence
  chemically synthesized
attatcttccaacaaatgtaca

SEQ ID NO: 855292 - DNA, 22 bp, Artificial Sequence
  chemically synthesized
aattatcttccaacaaatgtac

SEQ ID NO: 855293 - DNA, 22 bp, Artificial Sequence
  chemically synthesized
taattatcttccaacaaatgta

SEQ ID NO: 855294 - DNA, 22 bp, Artificial Sequence
  chemically synthesized
ccagagacatgtacatttgttg

SEQ ID NO: 855295 - DNA, 22 bp, Artificial Sequence
  chemically synthesized
tgctttaattatcttccaacaa

SEQ ID NO: 855296 - DNA, 22 bp, Artificial Sequence
  chemically synthesized
gtgctttaattatcttccaaca

SEQ ID NO: 855297 - DNA, 22 bp, Artificial Sequence
  chemically synthesized
tgtgctttaattatcttccaac

SEQ ID NO: 855298 - DNA, 22 bp, Artificial Sequence
  chemically synthesized
caaattttgtgctttaattatc

SEQ ID NO: 855299 - DNA, 22 bp, Artificial Sequence
  chemically synthesized
acaaattttgtgctttaattat

SEQ ID NO: 855300 - DNA, 22 bp, Artificial Sequence
  chemically synthesized
gttggaagataattaaagcaca

SEQ ID NO: 855301 - DNA, 22 bp, Artificial Sequence
  chemically synthesized
ttggaagataattaaagcacaa

SEQ ID NO: 855302 - DNA, 22 bp, Artificial Sequence
  chemically synthesized
gaagataattaaagcacaaaat

SEQ ID NO: 855303 - DNA, 22 bp, Artificial Sequence
  chemically synthesized
aagatatttacaaattttgtgc

SEQ ID NO: 855304 - DNA, 22 bp, Artificial Sequence
  chemically synthesized
gctgaagatatttacaaatttt

SEQ ID NO: 855305 - DNA, 22 bp, Artificial Sequence
  chemically synthesized
ggctgaagatatttacaaattt

SEQ ID NO: 855306 - DNA, 22 bp, Artificial Sequence
  chemically synthesized
tttggctgaagatatttacaaa

SEQ ID NO: 855307 - DNA, 22 bp, Artificial Sequence
  chemically synthesized
aagcacaaaatttgtaaatatc

SEQ ID NO: 855308 - DNA, 22 bp, Artificial Sequence
  chemically synthesized
taatctgtttggctgaagatat

SEQ ID NO: 855309 - DNA, 22 bp, Artificial Sequence
  chemically synthesized
atgttgtaatctgtttggctga

SEQ ID NO: 855310 - DNA, 22 bp, Artificial Sequence
  chemically synthesized
gtaaatatcttcagccaaacag

SEQ ID NO: 855311 - DNA, 22 bp, Artificial Sequence
  chemically synthesized
taaatatcttcagccaaacaga

SEQ ID NO: 855312 - DNA, 22 bp, Artificial Sequence
  chemically synthesized
agaaattaatgttgtaatctgt

SEQ ID NO: 855313 - DNA, 22 bp, Artificial Sequence
  chemically synthesized
attaagaaattaatgttgtaat

SEQ ID NO: 855314 - DNA, 22 bp, Artificial Sequence
  chemically synthesized
cagccaaacagattacaacatt

SEQ ID NO: 855315 - DNA, 22 bp, Artificial Sequence
  chemically synthesized
agccaaacagattacaacatta

SEQ ID NO: 855316 - DNA, 22 bp, Artificial Sequence
  chemically synthesized
agaaattaattaagaaattaat

SEQ ID NO: 855317 - DNA, 22 bp, Artificial Sequence
  chemically synthesized
caacattaatttcttaattaat

SEQ ID NO: 855318 - DNA, 22 bp, Artificial Sequence
  chemically synthesized
agaaataccaattaagaaatta

SEQ ID NO: 855319 - DNA, 22 bp, Artificial Sequence
  chemically synthesized
aagaaataccaattaagaaatt

SEQ ID NO: 855320 - DNA, 22 bp, Artificial Sequence
  chemically synthesized
atttcttaattaatttcttaat

SEQ ID NO: 855321 - DNA, 22 bp, Artificial Sequence
  chemically synthesized
tttaagaaataccaattaagaa

SEQ ID NO: 855322 - DNA, 22 bp, Artificial Sequence
  chemically synthesized
gtttaagaaataccaattaaga

SEQ ID NO: 855323 - DNA, 22 bp, Artificial Sequence
  chemically synthesized
cttaattaatttcttaattggt

SEQ ID NO: 855324 - DNA, 22 bp, Artificial Sequence
  chemically synthesized
ttaattaatttcttaattggta

SEQ ID NO: 855325 - DNA, 22 bp, Artificial Sequence
  chemically synthesized
aattaatttcttaattggtatt

SEQ ID NO: 855326 - DNA, 22 bp, Artificial Sequence
  chemically synthesized
attaatttcttaattggtattt

SEQ ID NO: 855327 - DNA, 22 bp, Artificial Sequence
  chemically synthesized
atttcttaattggtatttctta

SEQ ID NO: 855328 - DNA, 22 bp, Artificial Sequence
  chemically synthesized
cacaaacttgtttaagaaatac

SEQ ID NO: 855329 - DNA, 22 bp, Artificial Sequence
  chemically synthesized
tgcacaaacttgtttaagaaat

SEQ ID NO: 855330 - DNA, 22 bp, Artificial Sequence
  chemically synthesized
ctgcacaaacttgtttaagaaa

SEQ ID NO: 855331 - DNA, 22 bp, Artificial Sequence
  chemically synthesized
cttaattggtatttcttaaaca

SEQ ID NO: 855332 - DNA, 22 bp, Artificial Sequence
  chemically synthesized
ttaattggtatttcttaaacaa

SEQ ID NO: 855333 - DNA, 22 bp, Artificial Sequence
  chemically synthesized
aattggtatttcttaaacaagt

SEQ ID NO: 855334 - DNA, 22 bp, Artificial Sequence
  chemically synthesized
atttctgcacaaacttgtttaa

SEQ ID NO: 855335 - DNA, 22 bp, Artificial Sequence
  chemically synthesized
attggtatttcttaaacaagtt

SEQ ID NO: 855336 - DNA, 22 bp, Artificial Sequence
  chemically synthesized
catttctgcacaaacttgttta

SEQ ID NO: 855337 - DNA, 22 bp, Artificial Sequence
  chemically synthesized
gtatttcttaaacaagtttgtg

SEQ ID NO: 855338 - DNA, 22 bp, Artificial Sequence
  chemically synthesized
atcatttcatttctgcacaaac

SEQ ID NO: 855339 - DNA, 22 bp, Artificial Sequence
  chemically synthesized
cttaaacaagtttgtgcagaaa

SEQ ID NO: 855340 - DNA, 22 bp, Artificial Sequence
  chemically synthesized
ttaaacaagtttgtgcagaaat

SEQ ID NO: 855341 - DNA, 22 bp, Artificial Sequence
  chemically synthesized
atctcatcatttcatttctgca

SEQ ID NO: 855342 - DNA, 22 bp, Artificial Sequence
  chemically synthesized
aaacaagtttgtgcagaaatga

SEQ ID NO: 855343 - DNA, 22 bp, Artificial Sequence
  chemically synthesized
aacaagtttgtgcagaaatgaa

SEQ ID NO: 855344 - DNA, 22 bp, Artificial Sequence
  chemically synthesized
tcatctcatcatttcatttctg

SEQ ID NO: 855345 - DNA, 22 bp, Artificial Sequence
  chemically synthesized
ctcatctcatcatttcatttct

SEQ ID NO: 855346 - DNA, 22 bp, Artificial Sequence
  chemically synthesized
gtgcagaaatgaaatgatgaga

SEQ ID NO: 855347 - DNA, 22 bp, Artificial Sequence
  chemically synthesized
tgcagaaatgaaatgatgagat

SEQ ID NO: 855348 - DNA, 22 bp, Artificial Sequence
  chemically synthesized
atcgatcaacaatccagccctt

SEQ ID NO: 855349 - DNA, 22 bp, Artificial Sequence
  chemically synthesized
catcgatcaacaatccagccct

SEQ ID NO: 855350 - DNA, 22 bp, Artificial Sequence
  chemically synthesized
tcatcgatcaacaatccagccc

SEQ ID NO: 855351 - DNA, 22 bp, Artificial Sequence
  chemically synthesized
tttcatcgatcaacaatccagc

SEQ ID NO: 855352 - DNA, 22 bp, Artificial Sequence
  chemically synthesized
tctttcatcgatcaacaatcca

SEQ ID NO: 855353 - DNA, 22 bp, Artificial Sequence
  chemically synthesized
ctctttcatcgatcaacaatcc

SEQ ID NO: 855354 - DNA, 22 bp, Artificial Sequence
  chemically synthesized
tctctttcatcgatcaacaatc

SEQ ID NO: 855355 - DNA, 22 bp, Artificial Sequence
  chemically synthesized
ttctctttcatcgatcaacaat

SEQ ID NO: 855356 - DNA, 22 bp, Artificial Sequence
  chemically synthesized
tttttctctttcatcgatcaac

SEQ ID NO: 855357 - DNA, 22 bp, Artificial Sequence
  chemically synthesized
tgtttttctctttcatcgatca

SEQ ID NO: 855358 - DNA, 22 bp, Artificial Sequence
  chemically synthesized
ttctgtttttctctttcatcga

SEQ ID NO: 855359 - DNA, 22 bp, Artificial Sequence
  chemically synthesized
gattgttgatcgatgaaagaga

SEQ ID NO: 855360 - DNA, 22 bp, Artificial Sequence
  chemically synthesized
attattctgtttttctctttca

SEQ ID NO: 855361 - DNA, 22 bp, Artificial Sequence
  chemically synthesized
ttgatcgatgaaagagaaaaac

SEQ ID NO: 855362 - DNA, 22 bp, Artificial Sequence
  chemically synthesized
atcgatgaaagagaaaaacaga

SEQ ID NO: 855363 - DNA, 22 bp, Artificial Sequence
  chemically synthesized
gggtgaggagattgattattct

SEQ ID NO: 855364 - DNA, 22 bp, Artificial Sequence
  chemically synthesized
agggtgaggagattgattattc

SEQ ID NO: 855365 - DNA, 22 bp, Artificial Sequence
  chemically synthesized
ggtgacagtcatcttagggtga

SEQ ID NO: 855366 - DNA, 22 bp, Artificial Sequence
  chemically synthesized
acgaggttgggtgacagtcatc

SEQ ID NO: 855367 - DNA, 22 bp, Artificial Sequence
  chemically synthesized
cacgaggttgggtgacagtcat

SEQ ID NO: 855368 - DNA, 22 bp, Artificial Sequence
  chemically synthesized
ctcaccctaagatgactgtcac

SEQ ID NO: 855369 - DNA, 22 bp, Artificial Sequence
  chemically synthesized
accctaagatgactgtcaccca

SEQ ID NO: 855370 - DNA, 22 bp, Artificial Sequence
  chemically synthesized
agatgactgtcacccaacctcg

SEQ ID NO: 855371 - DNA, 22 bp, Artificial Sequence
  chemically synthesized
tcacccaacctcgtgaaatcca

SEQ ID NO: 855372 - DNA, 22 bp, Artificial Sequence
  chemically synthesized
catgggcatcaaatggatttca

SEQ ID NO: 855373 - DNA, 22 bp, Artificial Sequence
  chemically synthesized
ccatgggcatcaaatggatttc

SEQ ID NO: 855374 - DNA, 22 bp, Artificial Sequence
  chemically synthesized
tttccatgggcatcaaatggat

SEQ ID NO: 855375 - DNA, 22 bp, Artificial Sequence
  chemically synthesized
atttccatgggcatcaaatgga

SEQ ID NO: 855376 - DNA, 22 bp, Artificial Sequence
  chemically synthesized
gtgaaatccatttgatgcccat

SEQ ID NO: 855377 - DNA, 22 bp, Artificial Sequence
  chemically synthesized
gatgcccatggaaataaaccat

SEQ ID NO: 855378 - DNA, 22 bp, Artificial Sequence
  chemically synthesized
atgcccatggaaataaaccatg

SEQ ID NO: 855379 - DNA, 22 bp, Artificial Sequence
  chemically synthesized
taacaaaacaaagcaaacatgg

SEQ ID NO: 855380 - DNA, 22 bp, Artificial Sequence
  chemically synthesized
catccaaattataacaaaacaa

SEQ ID NO: 855381 - DNA, 22 bp, Artificial Sequence
  chemically synthesized
tccatccaaattataacaaaac

SEQ ID NO: 855382 - DNA, 22 bp, Artificial Sequence
  chemically synthesized
ctccatccaaattataacaaaa

SEQ ID NO: 855383 - DNA, 22 bp, Artificial Sequence
  chemically synthesized
atttctccatccaaattataac

SEQ ID NO: 855384 - DNA, 22 bp, Artificial Sequence
  chemically synthesized
gctttgttttgttataatttgg

SEQ ID NO: 855385 - DNA, 22 bp, Artificial Sequence
  chemically synthesized
ctttgttttgttataatttgga

SEQ ID NO: 855386 - DNA, 22 bp, Artificial Sequence
  chemically synthesized
tgttttgttataatttggatgg

SEQ ID NO: 855387 - DNA, 22 bp, Artificial Sequence
  chemically synthesized
gttttgttataatttggatgga

SEQ ID NO: 855388 - DNA, 22 bp, Artificial Sequence
  chemically synthesized
ttttgttataatttggatggag

SEQ ID NO: 855389 - DNA, 22 bp, Artificial Sequence
  chemically synthesized
cacatctcatttctccatccaa

SEQ ID NO: 855390 - DNA, 22 bp, Artificial Sequence
  chemically synthesized
acacatctcatttctccatcca

SEQ ID NO: 855391 - DNA, 22 bp, Artificial Sequence
  chemically synthesized
tgttataatttggatggagaaa

SEQ ID NO: 855392 - DNA, 22 bp, Artificial Sequence
  chemically synthesized
ttacacatctcatttctccatc

SEQ ID NO: 855393 - DNA, 22 bp, Artificial Sequence
  chemically synthesized
gttataatttggatggagaaat

SEQ ID NO: 855394 - DNA, 22 bp, Artificial Sequence
  chemically synthesized
cttacacatctcatttctccat

SEQ ID NO: 855395 - DNA, 22 bp, Artificial Sequence
  chemically synthesized
ttataatttggatggagaaatg

SEQ ID NO: 855396 - DNA, 22 bp, Artificial Sequence
  chemically synthesized
taatttggatggagaaatgaga

SEQ ID NO: 855397 - DNA, 22 bp, Artificial Sequence
  chemically synthesized
aacttcttacacatctcatttc

SEQ ID NO: 855398 - DNA, 22 bp, Artificial Sequence
  chemically synthesized
ggatggagaaatgagatgtgta

SEQ ID NO: 855399 - DNA, 22 bp, Artificial Sequence
  chemically synthesized
gatggagaaatgagatgtgtaa

SEQ ID NO: 855400 - DNA, 22 bp, Artificial Sequence
  chemically synthesized
agccacccccctcaacttctta

SEQ ID NO: 855401 - DNA, 22 bp, Artificial Sequence
  chemically synthesized
ctcagccacccccctcaacttc

SEQ ID NO: 855402 - DNA, 22 bp, Artificial Sequence
  chemically synthesized
cctcagccacccccctcaactt

SEQ ID NO: 855403 - DNA, 22 bp, Artificial Sequence
  chemically synthesized
tttcctcagccacccccctcaa

SEQ ID NO: 855404 - DNA, 22 bp, Artificial Sequence
  chemically synthesized
tatttcctcagccacccccctc

SEQ ID NO: 855405 - DNA, 22 bp, Artificial Sequence
  chemically synthesized
ctatttcctcagccacccccct

SEQ ID NO: 855406 - DNA, 22 bp, Artificial Sequence
  chemically synthesized
tctatttcctcagccacccccc

SEQ ID NO: 855407 - DNA, 22 bp, Artificial Sequence
  chemically synthesized
ttctatttcctcagccaccccc

SEQ ID NO: 855408 - DNA, 22 bp, Artificial Sequence
  chemically synthesized
ttttctatttcctcagccaccc

SEQ ID NO: 855409 - DNA, 22 bp, Artificial Sequence
  chemically synthesized
cttttctatttcctcagccacc

SEQ ID NO: 855410 - DNA, 22 bp, Artificial Sequence
  chemically synthesized
cttcttttctatttcctcagcc

SEQ ID NO: 855411 - DNA, 22 bp, Artificial Sequence
  chemically synthesized
acttcttttctatttcctcagc

SEQ ID NO: 855412 - DNA, 22 bp, Artificial Sequence
  chemically synthesized
ttacttcttttctatttcctca

SEQ ID NO: 855413 - DNA, 22 bp, Artificial Sequence
  chemically synthesized
aggggggtggctgaggaaatag

SEQ ID NO: 855414 - DNA, 22 bp, Artificial Sequence
  chemically synthesized
cttacttcttttctatttcctc

SEQ ID NO: 855415 - DNA, 22 bp, Artificial Sequence
  chemically synthesized
aggaaatagaaaagaagtaaga

SEQ ID NO: 855416 - DNA, 22 bp, Artificial Sequence
  chemically synthesized
ggaatagataatgtttcttact

SEQ ID NO: 855417 - DNA, 22 bp, Artificial Sequence
  chemically synthesized
gggaatagataatgtttcttac

SEQ ID NO: 855418 - DNA, 22 bp, Artificial Sequence
  chemically synthesized
ttgggaatagataatgtttctt

SEQ ID NO: 855419 - DNA, 22 bp, Artificial Sequence
  chemically synthesized
tctattcccaagaggtctgggg

SEQ ID NO: 855420 - DNA, 22 bp, Artificial Sequence
  chemically synthesized
acataaacccagacccccagac

SEQ ID NO: 855421 - DNA, 22 bp, Artificial Sequence
  chemically synthesized
ttcccaagaggtctgggggtct

SEQ ID NO: 855422 - DNA, 22 bp, Artificial Sequence
  chemically synthesized
ccaagaggtctgggggtctggg

SEQ ID NO: 855423 - DNA, 22 bp, Artificial Sequence
  chemically synthesized
tcctaacataaacccagacccc

SEQ ID NO: 855424 - DNA, 22 bp, Artificial Sequence
  chemically synthesized
ggggtctgggtttatgttagga

SEQ ID NO: 855425 - DNA, 22 bp, Artificial Sequence
  chemically synthesized
gtaaatgtaattgtcctaacat

SEQ ID NO: 855426 - DNA, 22 bp, Artificial Sequence
  chemically synthesized
agtaaatgtaattgtcctaaca

SEQ ID NO: 855427 - DNA, 22 bp, Artificial Sequence
  chemically synthesized
ggtttatgttaggacaattaca

SEQ ID NO: 855428 - DNA, 22 bp, Artificial Sequence
  chemically synthesized
aagtcacttagtaaatgtaatt

SEQ ID NO: 855429 - DNA, 22 bp, Artificial Sequence
  chemically synthesized
atgttaggacaattacatttac

SEQ ID NO: 855430 - DNA, 22 bp, Artificial Sequence
  chemically synthesized
tgttaggacaattacatttact

SEQ ID NO: 855431 - DNA, 22 bp, Artificial Sequence
  chemically synthesized
atctaaagtcacttagtaaatg

SEQ ID NO: 855432 - DNA, 22 bp, Artificial Sequence
  chemically synthesized
ggacaattacatttactaagtg

SEQ ID NO: 855433 - DNA, 22 bp, Artificial Sequence
  chemically synthesized
attgatctaaagtcacttagta

SEQ ID NO: 855434 - DNA, 22 bp, Artificial Sequence
  chemically synthesized
gttaattgatctaaagtcactt

SEQ ID NO: 855435 - DNA, 22 bp, Artificial Sequence
  chemically synthesized
agttaattgatctaaagtcact

SEQ ID NO: 855436 - DNA, 22 bp, Artificial Sequence
  chemically synthesized
catttactaagtgactttagat

SEQ ID NO: 855437 - DNA, 22 bp, Artificial Sequence
  chemically synthesized
actaagtgactttagatcaatt

SEQ ID NO: 855438 - DNA, 22 bp, Artificial Sequence
  chemically synthesized
ctaagtgactttagatcaatta

SEQ ID NO: 855439 - DNA, 22 bp, Artificial Sequence
  chemically synthesized
tagacaatttagttaattgatc

SEQ ID NO: 855440 - DNA, 22 bp, Artificial Sequence
  chemically synthesized
agtgactttagatcaattaact

SEQ ID NO: 855441 - DNA, 22 bp, Artificial Sequence
  chemically synthesized
tagatcaattaactaaattgtc

SEQ ID NO: 855442 - DNA, 22 bp, Artificial Sequence
  chemically synthesized
agatcaattaactaaattgtct

SEQ ID NO: 855443 - DNA, 22 bp, Artificial Sequence
  chemically synthesized
gatcaattaactaaattgtcta

SEQ ID NO: 855444 - DNA, 22 bp, Artificial Sequence
  chemically synthesized
aacaaatgagagaagttataga

SEQ ID NO: 855445 - DNA, 22 bp, Artificial Sequence
  chemically synthesized
actaaattgtctataacttctc

SEQ ID NO: 855446 - DNA, 22 bp, Artificial Sequence
  chemically synthesized
ttcaacaaatgagagaagttat

SEQ ID NO: 855447 - DNA, 22 bp, Artificial Sequence
  chemically synthesized
attcaacaaatgagagaagtta

SEQ ID NO: 855448 - DNA, 22 bp, Artificial Sequence
  chemically synthesized
aattgtctataacttctctcat

SEQ ID NO: 855449 - DNA, 22 bp, Artificial Sequence
  chemically synthesized
ccttattcaacaaatgagagaa

SEQ ID NO: 855450 - DNA, 22 bp, Artificial Sequence
  chemically synthesized
cccttattcaacaaatgagaga

SEQ ID NO: 855451 - DNA, 22 bp, Artificial Sequence
  chemically synthesized
tctataacttctctcatttgtt

SEQ ID NO: 855452 - DNA, 22 bp, Artificial Sequence
  chemically synthesized
taacttctctcatttgttgaat

SEQ ID NO: 855453 - DNA, 22 bp, Artificial Sequence
  chemically synthesized
caatagtttcccttattcaaca

SEQ ID NO: 855454 - DNA, 22 bp, Artificial Sequence
  chemically synthesized
ttacaatagtttcccttattca

SEQ ID NO: 855455 - DNA, 22 bp, Artificial Sequence
  chemically synthesized
ctctcatttgttgaataaggga

SEQ ID NO: 855456 - DNA, 22 bp, Artificial Sequence
  chemically synthesized
tctcatttgttgaataagggaa

SEQ ID NO: 855457 - DNA, 22 bp, Artificial Sequence
  chemically synthesized
tcatttgttgaataagggaaac

SEQ ID NO: 855458 - DNA, 22 bp, Artificial Sequence
  chemically synthesized
atttgttgaataagggaaacta

SEQ ID NO: 855459 - DNA, 22 bp, Artificial Sequence
  chemically synthesized
gttgaataagggaaactattgt

SEQ ID NO: 855460 - DNA, 22 bp, Artificial Sequence
  chemically synthesized
ttgaataagggaaactattgta

SEQ ID NO: 855461 - DNA, 22 bp, Artificial Sequence
  chemically synthesized
aataagggaaactattgtaata

SEQ ID NO: 855462 - DNA, 22 bp, Artificial Sequence
  chemically synthesized
tcacaaacccagcagaaagtgg

SEQ ID NO: 855463 - DNA, 22 bp, Artificial Sequence
  chemically synthesized
ttgtaatagccactttctgctg

SEQ ID NO: 855464 - DNA, 22 bp, Artificial Sequence
  chemically synthesized
ttgtcacaaacccagcagaaag

SEQ ID NO: 855465 - DNA, 22 bp, Artificial Sequence
  chemically synthesized
tgttgtcacaaacccagcagaa

SEQ ID NO: 855466 - DNA, 22 bp, Artificial Sequence
  chemically synthesized
taatagccactttctgctgggt

SEQ ID NO: 855467 - DNA, 22 bp, Artificial Sequence
  chemically synthesized
ttctgttgtcacaaacccagca

SEQ ID NO: 855468 - DNA, 22 bp, Artificial Sequence
  chemically synthesized
attctgttgtcacaaacccagc

SEQ ID NO: 855469 - DNA, 22 bp, Artificial Sequence
  chemically synthesized
tattctgttgtcacaaacccag

SEQ ID NO: 855470 - DNA, 22 bp, Artificial Sequence
  chemically synthesized
gttttattctgttgtcacaaac

SEQ ID NO: 855471 - DNA, 22 bp, Artificial Sequence
  chemically synthesized
ggttttattctgttgtcacaaa

SEQ ID NO: 855472 - DNA, 22 bp, Artificial Sequence
  chemically synthesized
ttggttttattctgttgtcaca

SEQ ID NO: 855473 - DNA, 22 bp, Artificial Sequence
  chemically synthesized
tctgctgggtttgtgacaacag

SEQ ID NO: 855474 - DNA, 22 bp, Artificial Sequence
  chemically synthesized
cttggttttattctgttgtcac

SEQ ID NO: 855475 - DNA, 22 bp, Artificial Sequence
  chemically synthesized
ctgctgggtttgtgacaacaga

SEQ ID NO: 855476 - DNA, 22 bp, Artificial Sequence
  chemically synthesized
tgctgggtttgtgacaacagaa

SEQ ID NO: 855477 - DNA, 22 bp, Artificial Sequence
  chemically synthesized
ctgggtttgtgacaacagaata

SEQ ID NO: 855478 - DNA, 22 bp, Artificial Sequence
  chemically synthesized
ggtttgtgacaacagaataaaa

SEQ ID NO: 855479 - DNA, 22 bp, Artificial Sequence
  chemically synthesized
gtgacaacagaataaaaccaag

SEQ ID NO: 855480 - DNA, 22 bp, Artificial Sequence
  chemically synthesized
tgacaacagaataaaaccaaga

SEQ ID NO: 855481 - DNA, 22 bp, Artificial Sequence
  chemically synthesized
aaagcaatacaaaacagaatgt

SEQ ID NO: 855482 - DNA, 22 bp, Artificial Sequence
  chemically synthesized
aactaaaagcaatacaaaacag

SEQ ID NO: 855483 - DNA, 22 bp, Artificial Sequence
  chemically synthesized
aaactaaaagcaatacaaaaca

SEQ ID NO: 855484 - DNA, 22 bp, Artificial Sequence
  chemically synthesized
tttaaactaaaagcaatacaaa

SEQ ID NO: 855485 - DNA, 22 bp, Artificial Sequence
  chemically synthesized
gctatttaaactaaaagcaata

SEQ ID NO: 855486 - DNA, 22 bp, Artificial Sequence
  chemically synthesized
tgttttgtattgcttttagttt

SEQ ID NO: 855487 - DNA, 22 bp, Artificial Sequence
  chemically synthesized
ttttgtattgcttttagtttaa

SEQ ID NO: 855488 - DNA, 22 bp, Artificial Sequence
  chemically synthesized
tgtattgcttttagtttaaata

SEQ ID NO: 855489 - DNA, 22 bp, Artificial Sequence
  chemically synthesized
gtattgcttttagtttaaatag

SEQ ID NO: 855490 - DNA, 22 bp, Artificial Sequence
  chemically synthesized
tattgcttttagtttaaatagc

SEQ ID NO: 855491 - DNA, 22 bp, Artificial Sequence
  chemically synthesized
cttttagtttaaatagccaatg

SEQ ID NO: 855492 - DNA, 22 bp, Artificial Sequence
  chemically synthesized
ttagtttaaatagccaatgcca

SEQ ID NO: 855493 - DNA, 22 bp, Artificial Sequence
  chemically synthesized
tagtttaaatagccaatgccac

SEQ ID NO: 855494 - DNA, 22 bp, Artificial Sequence
  chemically synthesized
agtttaaatagccaatgccact

SEQ ID NO: 855495 - DNA, 22 bp, Artificial Sequence
  chemically synthesized
gtttaaatagccaatgccactt

SEQ ID NO: 855496 - DNA, 22 bp, Artificial Sequence
  chemically synthesized
aaatagccaatgccactttacc

SEQ ID NO: 855497 - DNA, 22 bp, Artificial Sequence
  chemically synthesized
aatagccaatgccactttaccc

SEQ ID NO: 855498 - DNA, 22 bp, Artificial Sequence
  chemically synthesized
atgggacaatgtgtgggtaaag

SEQ ID NO: 855499 - DNA, 22 bp, Artificial Sequence
  chemically synthesized
gaagaattgatgggacaatgtg

SEQ ID NO: 855500 - DNA, 22 bp, Artificial Sequence
  chemically synthesized
tacccacacattgtcccatcaa

SEQ ID NO: 855501 - DNA, 22 bp, Artificial Sequence
  chemically synthesized
acccacacattgtcccatcaat

SEQ ID NO: 855502 - DNA, 22 bp, Artificial Sequence
  chemically synthesized
cccacacattgtcccatcaatt

SEQ ID NO: 855503 - DNA, 22 bp, Artificial Sequence
  chemically synthesized
tgtagtatagccctggaagaat

SEQ ID NO: 855504 - DNA, 22 bp, Artificial Sequence
  chemically synthesized
gtgtagtatagccctggaagaa

SEQ ID NO: 855505 - DNA, 22 bp, Artificial Sequence
  chemically synthesized
tcccatcaattcttccagggct

SEQ ID NO: 855506 - DNA, 22 bp, Artificial Sequence
  chemically synthesized
aacaacttgtgtagtatagccc

SEQ ID NO: 855507 - DNA, 22 bp, Artificial Sequence
  chemically synthesized
ctaaacaacttgtgtagtatag

SEQ ID NO: 855508 - DNA, 22 bp, Artificial Sequence
  chemically synthesized
ttccagggctatactacacaag

SEQ ID NO: 855509 - DNA, 22 bp, Artificial Sequence
  chemically synthesized
attactaaacaacttgtgtagt

SEQ ID NO: 855510 - DNA, 22 bp, Artificial Sequence
  chemically synthesized
ccagggctatactacacaagtt

SEQ ID NO: 855511 - DNA, 22 bp, Artificial Sequence
  chemically synthesized
cagggctatactacacaagttg

SEQ ID NO: 855512 - DNA, 22 bp, Artificial Sequence
  chemically synthesized
tactacacaagttgtttagtaa

SEQ ID NO: 855513 - DNA, 22 bp, Artificial Sequence
  chemically synthesized
agtcaaaatctgattactaaac

SEQ ID NO: 855514 - DNA, 22 bp, Artificial Sequence
  chemically synthesized
cacaagttgtttagtaatcaga

SEQ ID NO: 855515 - DNA, 22 bp, Artificial Sequence
  chemically synthesized
gtgaatagattcagtcaaaatc

SEQ ID NO: 855516 - DNA, 22 bp, Artificial Sequence
  chemically synthesized
tttagtaatcagattttgactg

SEQ ID NO: 855517 - DNA, 22 bp, Artificial Sequence
  chemically synthesized
ggtgaatagattcagtcaaaat

SEQ ID NO: 855518 - DNA, 22 bp, Artificial Sequence
  chemically synthesized
tggtgaatagattcagtcaaaa

SEQ ID NO: 855519 - DNA, 22 bp, Artificial Sequence
  chemically synthesized
ttggtgaatagattcagtcaaa

SEQ ID NO: 855520 - DNA, 22 bp, Artificial Sequence
  chemically synthesized
agtaatcagattttgactgaat

SEQ ID NO: 855521 - DNA, 22 bp, Artificial Sequence
  chemically synthesized
gtaatcagattttgactgaatc
